United States Patent 7,888,497 (BIOINFORMATICALLY DETECTABLE GROUP OF NOVEL REGULATORY OLIGONUCLEOTIDES AND USES THEREOF) - sequence listing, part 15

SEQ ID NO: 594120 - DNA, 14 bp, Homo sapiens
gaggacatggggag

SEQ ID NO: 594121 - DNA, 23 bp, Homo sapiens
gaggcttgtttacctttctctct

SEQ ID NO: 594122 - DNA, 13 bp, Homo sapiens
gagggaaaacaga

SEQ ID NO: 594123 - DNA, 14 bp, Homo sapiens
gaggggcgcgggag

SEQ ID NO: 594124 - DNA, 18 bp, Homo sapiens
gaggggcgcgggaggggg

SEQ ID NO: 594125 - DNA, 19 bp, Homo sapiens
gaggggcgcgggagggggc

SEQ ID NO: 594126 - DNA, 15 bp, Homo sapiens
gaggtatgggctggg

SEQ ID NO: 594127 - DNA, 17 bp, Homo sapiens
gaggttgggggaaccag

SEQ ID NO: 594128 - DNA, 20 bp, Homo sapiens
gagtattgtttaaaatgtaa

SEQ ID NO: 594129 - DNA, 15 bp, Homo sapiens
gagtggagagagcag

SEQ ID NO: 594130 - DNA, 16 bp, Homo sapiens
gagtggagagagcagg

SEQ ID NO: 594131 - DNA, 22 bp, Homo sapiens
gagtgggctttggtggccaggg

SEQ ID NO: 594132 - DNA, 17 bp, Homo sapiens
gagttctggatgtctgg

SEQ ID NO: 594133 - DNA, 19 bp, Homo sapiens
gagttctggatgtctggct

SEQ ID NO: 594134 - DNA, 16 bp, Homo sapiens
gccatagatgctggct

SEQ ID NO: 594135 - DNA, 22 bp, Homo sapiens
gccatggggtcggctcctgatg

SEQ ID NO: 594136 - DNA, 16 bp, Homo sapiens
gccattgaacagctgt

SEQ ID NO: 594137 - DNA, 17 bp, Homo sapiens
gccattgaacagctgtg

SEQ ID NO: 594138 - DNA, 18 bp, Homo sapiens
gccattgaacagctgtga

SEQ ID NO: 594139 - DNA, 21 bp, Homo sapiens
gccattttggggggttattta

SEQ ID NO: 594140 - DNA, 14 bp, Homo sapiens
gcccactcctggga

SEQ ID NO: 594141 - DNA, 17 bp, Homo sapiens
gcccaggatactggcac

SEQ ID NO: 594142 - DNA, 20 bp, Homo sapiens
gcccaggatactggcacaga

SEQ ID NO: 594143 - DNA, 18 bp, Homo sapiens
gcccccattctcccagtc

SEQ ID NO: 594144 - DNA, 16 bp, Homo sapiens
gccctctgaaataatg

SEQ ID NO: 594145 - DNA, 16 bp, Homo sapiens
gccctgccagctgcag

SEQ ID NO: 594146 - DNA, 16 bp, Homo sapiens
gccctggagctcaggg

SEQ ID NO: 594147 - DNA, 14 bp, Homo sapiens
gccctgggctcctc

SEQ ID NO: 594148 - DNA, 15 bp, Homo sapiens
gccctttcctggcag

SEQ ID NO: 594149 - DNA, 13 bp, Homo sapiens
gccgggggagggg

SEQ ID NO: 594150 - DNA, 23 bp, Homo sapiens
gccgggggaggggcgcgggaggg

SEQ ID NO: 594151 - DNA, 13 bp, Homo sapiens
gccgtaatttaac

SEQ ID NO: 594152 - DNA, 20 bp, Homo sapiens
gcctagcctatgtctggcag

SEQ ID NO: 594153 - DNA, 21 bp, Homo sapiens
gcctagcctatgtctggcaga

SEQ ID NO: 594154 - DNA, 15 bp, Homo sapiens
gcctatgtctggcag

SEQ ID NO: 594155 - DNA, 19 bp, Homo sapiens
gcctatgtctggcagatga

SEQ ID NO: 594156 - DNA, 14 bp, Homo sapiens
gcctcagcctgctt

SEQ ID NO: 594157 - DNA, 22 bp, Homo sapiens
gcctcagcctgctttcctgcag

SEQ ID NO: 594158 - DNA, 17 bp, Homo sapiens
gcctccctgggccacct

SEQ ID NO: 594159 - DNA, 20 bp, Homo sapiens
gcctcctggaatcagtattt

SEQ ID NO: 594160 - DNA, 15 bp, Homo sapiens
gcctctcttcttccc

SEQ ID NO: 594161 - DNA, 15 bp, Homo sapiens
gcctgagaaacacta

SEQ ID NO: 594162 - DNA, 16 bp, Homo sapiens
gcctgcattgagcttg

SEQ ID NO: 594163 - DNA, 21 bp, Homo sapiens
gcctgcattgagcttgcatgc

SEQ ID NO: 594164 - DNA, 21 bp, Homo sapiens
gcctgtgagcatggggccagg

SEQ ID NO: 594165 - DNA, 19 bp, Homo sapiens
gccttcccaagttgtgctt

SEQ ID NO: 594166 - DNA, 14 bp, Homo sapiens
gccttcgtttatat

SEQ ID NO: 594167 - DNA, 17 bp, Homo sapiens
gccttcgtttatatttt

SEQ ID NO: 594168 - DNA, 14 bp, Homo sapiens
gccttctggccttg

SEQ ID NO: 594169 - DNA, 17 bp, Homo sapiens
gccttgcagcggctcct

SEQ ID NO: 594170 - DNA, 13 bp, Homo sapiens
gccttggaaattc

SEQ ID NO: 594171 - DNA, 23 bp, Homo sapiens
gcctttatttttggcgtggctga

SEQ ID NO: 594172 - DNA, 17 bp, Homo sapiens
gcctttctcctccccac

SEQ ID NO: 594173 - DNA, 22 bp, Homo sapiens
gcctttctcctccccacctgta

SEQ ID NO: 594174 - DNA, 21 bp, Homo sapiens
gccttttctggtccctcttct

SEQ ID NO: 594175 - DNA, 23 bp, Homo sapiens
gccttttctggtccctcttctct

SEQ ID NO: 594176 - DNA, 15 bp, Homo sapiens
gcgacctctctgcct

SEQ ID NO: 594177 - DNA, 23 bp, Homo sapiens
gcgacctctctgcctctcttctt

SEQ ID NO: 594178 - DNA, 22 bp, Homo sapiens
gcgctgcgcggactcgccccca

SEQ ID NO: 594179 - DNA, 17 bp, Homo sapiens
gcggcatgaaccctctt

SEQ ID NO: 594180 - DNA, 18 bp, Homo sapiens
gcggcatgaaccctcttg

SEQ ID NO: 594181 - DNA, 14 bp, Homo sapiens
gcggctcctcgccc

SEQ ID NO: 594182 - DNA, 19 bp, Homo sapiens
gcgttctaaatatgaatga

SEQ ID NO: 594183 - DNA, 13 bp, Homo sapiens
gctacaattttaa

SEQ ID NO: 594184 - DNA, 21 bp, Homo sapiens
gctacccaggaggctgaggtg

SEQ ID NO: 594185 - DNA, 14 bp, Homo sapiens
gctactcccacagc

SEQ ID NO: 594186 - DNA, 18 bp, Homo sapiens
gctactgttgtaagaatt

SEQ ID NO: 594187 - DNA, 18 bp, Homo sapiens
gctatcggcagatgatgc

SEQ ID NO: 594188 - DNA, 20 bp, Homo sapiens
gctatcttttttagtgttaa

SEQ ID NO: 594189 - DNA, 15 bp, Homo sapiens
gctatgtcagtacta

SEQ ID NO: 594190 - DNA, 16 bp, Homo sapiens
gctattagcggctcct

SEQ ID NO: 594191 - DNA, 15 bp, Homo sapiens
gctatttctcttgct

SEQ ID NO: 594192 - DNA, 15 bp, Homo sapiens
gctcaaagcagcagg

SEQ ID NO: 594193 - DNA, 20 bp, Homo sapiens
gctcaagcattctgtttatc

SEQ ID NO: 594194 - DNA, 23 bp, Homo sapiens
gctcagctgagcatggagacagc

SEQ ID NO: 594195 - DNA, 15 bp, Homo sapiens
gctcctccccttcct

SEQ ID NO: 594196 - DNA, 22 bp, Homo sapiens
gctcctgttttgcacagccaaa

SEQ ID NO: 594197 - DNA, 22 bp, Homo sapiens
gctctcctcgagccctccccca

SEQ ID NO: 594198 - DNA, 13 bp, Homo sapiens
gctctgcctgtgg

SEQ ID NO: 594199 - DNA, 15 bp, Homo sapiens
gctcttttcaatgaa

SEQ ID NO: 594200 - DNA, 16 bp, Homo sapiens
gctgaagaattgaaaa

SEQ ID NO: 594201 - DNA, 17 bp, Homo sapiens
gctgagcatggagacag

SEQ ID NO: 594202 - DNA, 21 bp, Homo sapiens
gctgagcatggagacagcagt

SEQ ID NO: 594203 - DNA, 15 bp, Homo sapiens
gctgagccctcctga

SEQ ID NO: 594204 - DNA, 16 bp, Homo sapiens
gctgaggctgagaaag

SEQ ID NO: 594205 - DNA, 19 bp, Homo sapiens
gctgaggtgggaggatcac

SEQ ID NO: 594206 - DNA, 17 bp, Homo sapiens
gctgataccatatgaat

SEQ ID NO: 594207 - DNA, 16 bp, Homo sapiens
gctgatgggtgccctt

SEQ ID NO: 594208 - DNA, 11 bp, Homo sapiens
gctgatttttt

SEQ ID NO: 594209 - DNA, 20 bp, Homo sapiens
gctgccgtagcttcagccag

SEQ ID NO: 594210 - DNA, 19 bp, Homo sapiens
gctgcgcggactcgccccc

SEQ ID NO: 594211 - DNA, 19 bp, Homo sapiens
gctgctgcacacactcacc

SEQ ID NO: 594212 - DNA, 22 bp, Homo sapiens
gctgggtgtttttttttaaaag

SEQ ID NO: 594213 - DNA, 23 bp, Homo sapiens
gctgtaaggatccggaaagaaga

SEQ ID NO: 594214 - DNA, 16 bp, Homo sapiens
gctgtcctggaggggc

SEQ ID NO: 594215 - DNA, 17 bp, Homo sapiens
gctgtgagccatgcctc

SEQ ID NO: 594216 - DNA, 21 bp, Homo sapiens
gctgtgagccatgcctccctg

SEQ ID NO: 594217 - DNA, 18 bp, Homo sapiens
gctgtgggcaagcctaag

SEQ ID NO: 594218 - DNA, 20 bp, Homo sapiens
gctgtgtgaatacctgctca

SEQ ID NO: 594219 - DNA, 13 bp, Homo sapiens
gcttacctcctca

SEQ ID NO: 594220 - DNA, 22 bp, Homo sapiens
gcttcaggttagtgacatttaa

SEQ ID NO: 594221 - DNA, 15 bp, Homo sapiens
gcttcagttgcttgt

SEQ ID NO: 594222 - DNA, 14 bp, Homo sapiens
gcttctcacggcct

SEQ ID NO: 594223 - DNA, 11 bp, Homo sapiens
gcttgcagaac

SEQ ID NO: 594224 - DNA, 18 bp, Homo sapiens
gcttgtggtggggcagga

SEQ ID NO: 594225 - DNA, 18 bp, Homo sapiens
gcttgtttacctttctct

SEQ ID NO: 594226 - DNA, 16 bp, Homo sapiens
gctttggtggccaggg

SEQ ID NO: 594227 - DNA, 18 bp, Homo sapiens
ggaaaattctaacccagg

SEQ ID NO: 594228 - DNA, 22 bp, Homo sapiens
ggaaccagcagaaatgccccca

SEQ ID NO: 594229 - DNA, 18 bp, Homo sapiens
ggaacggtggaggcagag

SEQ ID NO: 594230 - DNA, 13 bp, Homo sapiens
ggaagaatgaaag

SEQ ID NO: 594231 - DNA, 16 bp, Homo sapiens
ggaagaatgaaagctg

SEQ ID NO: 594232 - DNA, 17 bp, Homo sapiens
ggaagagacagcccagg

SEQ ID NO: 594233 - DNA, 23 bp, Homo sapiens
ggaagccatagatgctggctggg

SEQ ID NO: 594234 - DNA, 19 bp, Homo sapiens
ggaagcccctgggcccagt

SEQ ID NO: 594235 - DNA, 16 bp, Homo sapiens
ggaaggagaagtaaga

SEQ ID NO: 594236 - DNA, 19 bp, Homo sapiens
ggaagttgccatgggaaac

SEQ ID NO: 594237 - DNA, 18 bp, Homo sapiens
ggaatcagtatttccttc

SEQ ID NO: 594238 - DNA, 23 bp, Homo sapiens
ggaatgcattatttattgctgtg

SEQ ID NO: 594239 - DNA, 22 bp, Homo sapiens
ggaatggatttttctttaactg

SEQ ID NO: 594240 - DNA, 17 bp, Homo sapiens
ggacacagttcctggga

SEQ ID NO: 594241 - DNA, 19 bp, Homo sapiens
ggacacagttcctgggaac

SEQ ID NO: 594242 - DNA, 11 bp, Homo sapiens
ggacagggccc

SEQ ID NO: 594243 - DNA, 18 bp, Homo sapiens
ggacatgcaataaaattt

SEQ ID NO: 594244 - DNA, 13 bp, Homo sapiens
ggacctacctccc

SEQ ID NO: 594245 - DNA, 16 bp, Homo sapiens
ggactaaatgatctct

SEQ ID NO: 594246 - DNA, 22 bp, Homo sapiens
ggactcctcaaaccacttgcct

SEQ ID NO: 594247 - DNA, 13 bp, Homo sapiens
ggactcgccccca

SEQ ID NO: 594248 - DNA, 18 bp, Homo sapiens
ggacttctgaagagacca

SEQ ID NO: 594249 - DNA, 12 bp, Homo sapiens
ggagaatactgc

SEQ ID NO: 594250 - DNA, 18 bp, Homo sapiens
ggagacagcagtttccag

SEQ ID NO: 594251 - DNA, 23 bp, Homo sapiens
ggagacagcagtttccagagagt

SEQ ID NO: 594252 - DNA, 22 bp, Homo sapiens
ggagaccccttgttgcactgcc

SEQ ID NO: 594253 - DNA, 14 bp, Homo sapiens
ggagattgaacttt

SEQ ID NO: 594254 - DNA, 17 bp, Homo sapiens
ggagattgaactttccc

SEQ ID NO: 594255 - DNA, 21 bp, Homo sapiens
ggagccttcccaagttgtgct

SEQ ID NO: 594256 - DNA, 22 bp, Homo sapiens
ggagccttcccaagttgtgctt

SEQ ID NO: 594257 - DNA, 22 bp, Homo sapiens
ggaggcctcaccccagggacag

SEQ ID NO: 594258 - DNA, 22 bp, Homo sapiens
ggaggtgagagaaggatgggtc

SEQ ID NO: 594259 - DNA, 18 bp, Homo sapiens
ggagtggtgatttgaaaa

SEQ ID NO: 594260 - DNA, 19 bp, Homo sapiens
ggagtttaagaccagcctg

SEQ ID NO: 594261 - DNA, 17 bp, Homo sapiens
ggatactggcacagagg

SEQ ID NO: 594262 - DNA, 18 bp, Homo sapiens
ggatactggcacagaggt

SEQ ID NO: 594263 - DNA, 20 bp, Homo sapiens
ggatatgttatactgaacca

SEQ ID NO: 594264 - DNA, 20 bp, Homo sapiens
ggatattttgaaatgaactt

SEQ ID NO: 594265 - DNA, 21 bp, Homo sapiens
ggatattttgaaatgaacttt

SEQ ID NO: 594266 - DNA, 23 bp, Homo sapiens
ggatcctcagttctcaaatgtgt

SEQ ID NO: 594267 - DNA, 18 bp, Homo sapiens
ggatggactaaatgatct

SEQ ID NO: 594268 - DNA, 19 bp, Homo sapiens
ggatgggtcccctccgcca

SEQ ID NO: 594269 - DNA, 15 bp, Homo sapiens
ggattgcctctgaaa

SEQ ID NO: 594270 - DNA, 19 bp, Homo sapiens
ggatttaaaagcctgctca

SEQ ID NO: 594271 - DNA, 19 bp, Homo sapiens
ggcaagaaagcttccttca

SEQ ID NO: 594272 - DNA, 12 bp, Homo sapiens
ggcacaataaat

SEQ ID NO: 594273 - DNA, 15 bp, Homo sapiens
ggcacattaactgtt

SEQ ID NO: 594274 - DNA, 22 bp, Homo sapiens
ggcaccgtattcctctcccagg

SEQ ID NO: 594275 - DNA, 14 bp, Homo sapiens
ggcagatgagggct

SEQ ID NO: 594276 - DNA, 15 bp, Homo sapiens
ggcagatgagggctg

SEQ ID NO: 594277 - DNA, 13 bp, Homo sapiens
ggcagccagacca

SEQ ID NO: 594278 - DNA, 15 bp, Homo sapiens
ggcagccagaccagc

SEQ ID NO: 594279 - DNA, 16 bp, Homo sapiens
ggcagcctagcctatg

SEQ ID NO: 594280 - DNA, 20 bp, Homo sapiens
ggcagggggtatgcagagct

SEQ ID NO: 594281 - DNA, 21 bp, Homo sapiens
ggcagggggtatgcagagctt

SEQ ID NO: 594282 - DNA, 12 bp, Homo sapiens
ggcatgaaccct

SEQ ID NO: 594283 - DNA, 11 bp, Homo sapiens
ggccacctcct

SEQ ID NO: 594284 - DNA, 21 bp, Homo sapiens
ggccacctcctaccccttcct

SEQ ID NO: 594285 - DNA, 13 bp, Homo sapiens
ggccagcgtggct

SEQ ID NO: 594286 - DNA, 19 bp, Homo sapiens
ggccataaacggttcctgg

SEQ ID NO: 594287 - DNA, 16 bp, Homo sapiens
ggccatgtcctctctt

SEQ ID NO: 594288 - DNA, 22 bp, Homo sapiens
ggcccagtacctagctggctct

SEQ ID NO: 594289 - DNA, 15 bp, Homo sapiens
ggccctggagctcag

SEQ ID NO: 594290 - DNA, 13 bp, Homo sapiens
ggcctagactctg

SEQ ID NO: 594291 - DNA, 13 bp, Homo sapiens
ggcctcagcctgc

SEQ ID NO: 594292 - DNA, 23 bp, Homo sapiens
ggcctgagaaacactatttgtga

SEQ ID NO: 594293 - DNA, 16 bp, Homo sapiens
ggcctttctcctcccc

SEQ ID NO: 594294 - DNA, 20 bp, Homo sapiens
ggcctttctcctccccacct

SEQ ID NO: 594295 - DNA, 17 bp, Homo sapiens
ggctaaataaagaggag

SEQ ID NO: 594296 - DNA, 15 bp, Homo sapiens
ggctcctcgccccca

SEQ ID NO: 594297 - DNA, 13 bp, Homo sapiens
ggctctagggcct

SEQ ID NO: 594298 - DNA, 15 bp, Homo sapiens
ggctgagccctcctg

SEQ ID NO: 594299 - DNA, 20 bp, Homo sapiens
ggctgccaacatgatccccg

SEQ ID NO: 594300 - DNA, 15 bp, Homo sapiens
ggctgctctgcctgt

SEQ ID NO: 594301 - DNA, 14 bp, Homo sapiens
ggctgtgggcaagc

SEQ ID NO: 594302 - DNA, 22 bp, Homo sapiens
ggcttgtctatactccttccct

SEQ ID NO: 594303 - DNA, 12 bp, Homo sapiens
ggcttttccttg

SEQ ID NO: 594304 - DNA, 22 bp, Homo sapiens
gggaaacaaataatttgaactt

SEQ ID NO: 594305 - DNA, 22 bp, Homo sapiens
gggaaccagcagaaatgccccc

SEQ ID NO: 594306 - DNA, 18 bp, Homo sapiens
gggaagagacagcccagg

SEQ ID NO: 594307 - DNA, 12 bp, Homo sapiens
gggagctgccaa

SEQ ID NO: 594308 - DNA, 21 bp, Homo sapiens
gggaggggcgcgggagggggc

SEQ ID NO: 594309 - DNA, 15 bp, Homo sapiens
gggatatttttttct

SEQ ID NO: 594310 - DNA, 14 bp, Homo sapiens
gggatcctgcctgc

SEQ ID NO: 594311 - DNA, 13 bp, Homo sapiens
gggcaccaggggc

SEQ ID NO: 594312 - DNA, 13 bp, Homo sapiens
gggcagctgtgat

SEQ ID NO: 594313 - DNA, 12 bp, Homo sapiens
gggccacctcct

SEQ ID NO: 594314 - DNA, 20 bp, Homo sapiens
gggccataaacggttcctgg

SEQ ID NO: 594315 - DNA, 14 bp, Homo sapiens
gggcctcaggctcc

SEQ ID NO: 594316 - DNA, 19 bp, Homo sapiens
gggcctcaggctccgggca

SEQ ID NO: 594317 - DNA, 17 bp, Homo sapiens
gggcctttctcctcccc

SEQ ID NO: 594318 - DNA, 22 bp, Homo sapiens
gggcctttctcctccccacctg

SEQ ID NO: 594319 - DNA, 20 bp, Homo sapiens
gggcgagactctgtctcaaa

SEQ ID NO: 594320 - DNA, 20 bp, Homo sapiens
gggctaccctgggaagctgc

SEQ ID NO: 594321 - DNA, 12 bp, Homo sapiens
gggctcctctta

SEQ ID NO: 594322 - DNA, 21 bp, Homo sapiens
gggctgatgggtgccctttcc

SEQ ID NO: 594323 - DNA, 11 bp, Homo sapiens
ggggactcctc

SEQ ID NO: 594324 - DNA, 15 bp, Homo sapiens
ggggagattgaactt

SEQ ID NO: 594325 - DNA, 22 bp, Homo sapiens
ggggccataaacggttcctggt

SEQ ID NO: 594326 - DNA, 14 bp, Homo sapiens
gggtccagggaggg

SEQ ID NO: 594327 - DNA, 23 bp, Homo sapiens
gggtcctcctaagtcccttccta

SEQ ID NO: 594328 - DNA, 13 bp, Homo sapiens
gggtcggctcctg

SEQ ID NO: 594329 - DNA, 20 bp, Homo sapiens
gggtgccctttcctggcagt

SEQ ID NO: 594330 - DNA, 21 bp, Homo sapiens
gggtgccctttcctggcagtc

SEQ ID NO: 594331 - DNA, 15 bp, Homo sapiens
gggtttattcactga

SEQ ID NO: 594332 - DNA, 16 bp, Homo sapiens
ggtatgggctgggggc

SEQ ID NO: 594333 - DNA, 14 bp, Homo sapiens
ggtcagagggccca

SEQ ID NO: 594334 - DNA, 11 bp, Homo sapiens
ggtccagggag

SEQ ID NO: 594335 - DNA, 16 bp, Homo sapiens
ggtcctatttttgtga

SEQ ID NO: 594336 - DNA, 20 bp, Homo sapiens
ggtcctcctaagtcccttcc

SEQ ID NO: 594337 - DNA, 15 bp, Homo sapiens
ggtcggctcctgatg

SEQ ID NO: 594338 - DNA, 15 bp, Homo sapiens
ggtctaccaatacaa

SEQ ID NO: 594339 - DNA, 21 bp, Homo sapiens
ggtctaccaatacaaaatgta

SEQ ID NO: 594340 - DNA, 20 bp, Homo sapiens
ggtctcccttctctacactc

SEQ ID NO: 594341 - DNA, 11 bp, Homo sapiens
ggtctgccaat

SEQ ID NO: 594342 - DNA, 15 bp, Homo sapiens
ggtggcactacccca

SEQ ID NO: 594343 - DNA, 23 bp, Homo sapiens
ggtggcatgtgcctatagtccca

SEQ ID NO: 594344 - DNA, 20 bp, Homo sapiens
ggtgtcccctatcctcccct

SEQ ID NO: 594345 - DNA, 20 bp, Homo sapiens
ggttgtggggcctcaggctc

SEQ ID NO: 594346 - DNA, 13 bp, Homo sapiens
ggtttcaggaagt

SEQ ID NO: 594347 - DNA, 20 bp, Homo sapiens
gtaaaacagggccacataga

SEQ ID NO: 594348 - DNA, 16 bp, Homo sapiens
gtaaacttctgcaaca

SEQ ID NO: 594349 - DNA, 17 bp, Homo sapiens
gtaaataggaatcattc

SEQ ID NO: 594350 - DNA, 22 bp, Homo sapiens
gtaaatagtttgaattcagtaa

SEQ ID NO: 594351 - DNA, 20 bp, Homo sapiens
gtaaatgaagatctttatat

SEQ ID NO: 594352 - DNA, 16 bp, Homo sapiens
gtaaccagctcagtgt

SEQ ID NO: 594353 - DNA, 18 bp, Homo sapiens
gtaagaacaactacctga

SEQ ID NO: 594354 - DNA, 22 bp, Homo sapiens
gtaagatatctcaatgaaccat

SEQ ID NO: 594355 - DNA, 17 bp, Homo sapiens
gtaataaatgtgactca

SEQ ID NO: 594356 - DNA, 17 bp, Homo sapiens
gtaataatgtaacatga

SEQ ID NO: 594357 - DNA, 17 bp, Homo sapiens
gtaatcccctaaaataa

SEQ ID NO: 594358 - DNA, 20 bp, Homo sapiens
gtaatcccctaaaataacag

SEQ ID NO: 594359 - DNA, 22 bp, Homo sapiens
gtaatctatgtttataatacta

SEQ ID NO: 594360 - DNA, 17 bp, Homo sapiens
gtaatgctaaatgtgta

SEQ ID NO: 594361 - DNA, 22 bp, Homo sapiens
gtaatgctaaatgtgtaataat

SEQ ID NO: 594362 - DNA, 21 bp, Homo sapiens
gtaatttaaatgaaagaaaat

SEQ ID NO: 594363 - DNA, 23 bp, Homo sapiens
gtaatttaaatgaaagaaaattg

SEQ ID NO: 594364 - DNA, 12 bp, Homo sapiens
gtacaaaattaa

SEQ ID NO: 594365 - DNA, 15 bp, Homo sapiens
gtacgatgacagtgt

SEQ ID NO: 594366 - DNA, 23 bp, Homo sapiens
gtacttaaatggtaataagcact

SEQ ID NO: 594367 - DNA, 14 bp, Homo sapiens
gtagaggcttgttt

SEQ ID NO: 594368 - DNA, 18 bp, Homo sapiens
gtagatatgtattctttt

SEQ ID NO: 594369 - DNA, 15 bp, Homo sapiens
gtagcatctcagtgg

SEQ ID NO: 594370 - DNA, 13 bp, Homo sapiens
gtagcatcttcct

SEQ ID NO: 594371 - DNA, 15 bp, Homo sapiens
gtagcttcagccagg

SEQ ID NO: 594372 - DNA, 12 bp, Homo sapiens
gtagggccaggg

SEQ ID NO: 594373 - DNA, 19 bp, Homo sapiens
gtagtctcactgcttgaac

SEQ ID NO: 594374 - DNA, 19 bp, Homo sapiens
gtagtgttgtccaggaagt

SEQ ID NO: 594375 - DNA, 16 bp, Homo sapiens
gtataaagctcagaag

SEQ ID NO: 594376 - DNA, 21 bp, Homo sapiens
gtatcactgccttcgtttata

SEQ ID NO: 594377 - DNA, 13 bp, Homo sapiens
gtatgcagagctt

SEQ ID NO: 594378 - DNA, 22 bp, Homo sapiens
gtatgggctgggggctatgtat

SEQ ID NO: 594379 - DNA, 20 bp, Homo sapiens
gtatgtgctatacacacaca

SEQ ID NO: 594380 - DNA, 15 bp, Homo sapiens
gtatgtgggatattg

SEQ ID NO: 594381 - DNA, 18 bp, Homo sapiens
gtatgttaaagagaatga

SEQ ID NO: 594382 - DNA, 23 bp, Homo sapiens
gtattaaaaaacaattaactgcc

SEQ ID NO: 594383 - DNA, 22 bp, Homo sapiens
gtattaactatcttctttggac

SEQ ID NO: 594384 - DNA, 20 bp, Homo sapiens
gtattatacatgtgatacat

SEQ ID NO: 594385 - DNA, 22 bp, Homo sapiens
gtattatacatgtgatacattt

SEQ ID NO: 594386 - DNA, 11 bp, Homo sapiens
gtattcctctc

SEQ ID NO: 594387 - DNA, 15 bp, Homo sapiens
gtatttccttccact

SEQ ID NO: 594388 - DNA, 22 bp, Homo sapiens
gtatttccttccactgtagcta

SEQ ID NO: 594389 - DNA, 23 bp, Homo sapiens
gtatttctatatagacttggaga

SEQ ID NO: 594390 - DNA, 15 bp, Homo sapiens
gtattttcatgaaaa

SEQ ID NO: 594391 - DNA, 18 bp, Homo sapiens
gtcagaatttttaactgt

SEQ ID NO: 594392 - DNA, 17 bp, Homo sapiens
gtcagctgctgttgaac

SEQ ID NO: 594393 - DNA, 19 bp, Homo sapiens
gtcagctgctgttgaactt

SEQ ID NO: 594394 - DNA, 20 bp, Homo sapiens
gtcagtgttgcctcttgcaa

SEQ ID NO: 594395 - DNA, 12 bp, Homo sapiens
gtcattctgcct

SEQ ID NO: 594396 - DNA, 17 bp, Homo sapiens
gtccaaacgtcctcttt

SEQ ID NO: 594397 - DNA, 21 bp, Homo sapiens
gtccagggaggggtccctgca

SEQ ID NO: 594398 - DNA, 15 bp, Homo sapiens
gtcccctatcctccc

SEQ ID NO: 594399 - DNA, 16 bp, Homo sapiens
gtcccctatcctcccc

SEQ ID NO: 594400 - DNA, 21 bp, Homo sapiens
gtccctcttctctcctcagtt

SEQ ID NO: 594401 - DNA, 22 bp, Homo sapiens
gtcccttcctattctcctgcca

SEQ ID NO: 594402 - DNA, 24 bp, Homo sapiens
gtcccttcctattctcctgccatg

SEQ ID NO: 594403 - DNA, 22 bp, Homo sapiens
gtcctaacctcgggcctgctgc

SEQ ID NO: 594404 - DNA, 19 bp, Homo sapiens
gtcctcctaagtcccttcc

SEQ ID NO: 594405 - DNA, 11 bp, Homo sapiens
gtcctgcctcc

SEQ ID NO: 594406 - DNA, 14 bp, Homo sapiens
gtcctgcctcctca

SEQ ID NO: 594407 - DNA, 15 bp, Homo sapiens
gtcctgcctcctcat

SEQ ID NO: 594408 - DNA, 16 bp, Homo sapiens
gtcctgcctcctcatc

SEQ ID NO: 594409 - DNA, 13 bp, Homo sapiens
gtcctggaggggc

SEQ ID NO: 594410 - DNA, 20 bp, Homo sapiens
gtcctggaggggctggggac

SEQ ID NO: 594411 - DNA, 17 bp, Homo sapiens
gtccttaggcctctgag

SEQ ID NO: 594412 - DNA, 18 bp, Homo sapiens
gtccttaggcctctgaga

SEQ ID NO: 594413 - DNA, 16 bp, Homo sapiens
gtccttgatttcaaag

SEQ ID NO: 594414 - DNA, 14 bp, Homo sapiens
gtcggctcctgatg

SEQ ID NO: 594415 - DNA, 13 bp, Homo sapiens
gtcgtggagccat

SEQ ID NO: 594416 - DNA, 15 bp, Homo sapiens
gtctaaaaacatttg

SEQ ID NO: 594417 - DNA, 18 bp, Homo sapiens
gtctaagtagggccaggg

SEQ ID NO: 594418 - DNA, 14 bp, Homo sapiens
gtctcactgcttga

SEQ ID NO: 594419 - DNA, 15 bp, Homo sapiens
gtctcactgcttgaa

SEQ ID NO: 594420 - DNA, 18 bp, Homo sapiens
gtctcctttgctcttgcc

SEQ ID NO: 594421 - DNA, 18 bp, Homo sapiens
gtctctgtcgtggagcca

SEQ ID NO: 594422 - DNA, 22 bp, Homo sapiens
gtctctgtgtaaccagctcagt

SEQ ID NO: 594423 - DNA, 16 bp, Homo sapiens
gtctgctccaatgact

SEQ ID NO: 594424 - DNA, 21 bp, Homo sapiens
gtctggcagatgagggctggc

SEQ ID NO: 594425 - DNA, 23 bp, Homo sapiens
gtctggttcctgtgtgaccctgg

SEQ ID NO: 594426 - DNA, 12 bp, Homo sapiens
gtctgtaatgac

SEQ ID NO: 594427 - DNA, 17 bp, Homo sapiens
gtcttccagagaacctg

SEQ ID NO: 594428 - DNA, 20 bp, Homo sapiens
gtgaaattgcatactttgta

SEQ ID NO: 594429 - DNA, 14 bp, Homo sapiens
gtgaagtttggaga

SEQ ID NO: 594430 - DNA, 17 bp, Homo sapiens
gtgagaacccagtttcc

SEQ ID NO: 594431 - DNA, 16 bp, Homo sapiens
gtgagacccctgtctc

SEQ ID NO: 594432 - DNA, 23 bp, Homo sapiens
gtgagctcttcctatccctctcc

SEQ ID NO: 594433 - DNA, 21 bp, Homo sapiens
gtgaggataacacaagtaaaa

SEQ ID NO: 594434 - DNA, 16 bp, Homo sapiens
gtgattactgcaatca

SEQ ID NO: 594435 - DNA, 16 bp, Homo sapiens
gtgatttaatccagtt

SEQ ID NO: 594436 - DNA, 13 bp, Homo sapiens
gtgccaacctctt

SEQ ID NO: 594437 - DNA, 13 bp, Homo sapiens
gtgccaagagcta

SEQ ID NO: 594438 - DNA, 17 bp, Homo sapiens
gtgctatacacacacac

SEQ ID NO: 594439 - DNA, 13 bp, Homo sapiens
gtgctttgcattt

SEQ ID NO: 594440 - DNA, 15 bp, Homo sapiens
gtggagagagcaggg

SEQ ID NO: 594441 - DNA, 22 bp, Homo sapiens
gtggagccattgaacagctgtg

SEQ ID NO: 594442 - DNA, 14 bp, Homo sapiens
gtggatattgttac

SEQ ID NO: 594443 - DNA, 19 bp, Homo sapiens
gtggatccaaactgatcca

SEQ ID NO: 594444 - DNA, 14 bp, Homo sapiens
taataaagatgagt

SEQ ID NO: 594445 - DNA, 13 bp, Homo sapiens
taataaagtactt

SEQ ID NO: 594446 - DNA, 16 bp, Homo sapiens
taataatgtaacatga

SEQ ID NO: 594447 - DNA, 19 bp, Homo sapiens
taatagctttagtgaatta

SEQ ID NO: 594448 - DNA, 18 bp, Homo sapiens
taataggaaaaacggaag

SEQ ID NO: 594449 - DNA, 20 bp, Homo sapiens
taatattgtttggtaaatgt

SEQ ID NO: 594450 - DNA, 19 bp, Homo sapiens
taatccagttataagaaga

SEQ ID NO: 594451 - DNA, 19 bp, Homo sapiens
taatcccctaaaataacag

SEQ ID NO: 594452 - DNA, 13 bp, Homo sapiens
taatctcaatgca

SEQ ID NO: 594453 - DNA, 17 bp, Homo sapiens
taatcttcaaagccttc

SEQ ID NO: 594454 - DNA, 18 bp, Homo sapiens
taatgacactgtttcctg

SEQ ID NO: 594455 - DNA, 17 bp, Homo sapiens
taatgctaaatgtgtaa

SEQ ID NO: 594456 - DNA, 15 bp, Homo sapiens
taatgctacaatttt

SEQ ID NO: 594457 - DNA, 16 bp, Homo sapiens
taatgctttgttaaat

SEQ ID NO: 594458 - DNA, 17 bp, Homo sapiens
taatgggattagaaaca

SEQ ID NO: 594459 - DNA, 14 bp, Homo sapiens
taatgtaacatgat

SEQ ID NO: 594460 - DNA, 16 bp, Homo sapiens
taatgtctcctttgct

SEQ ID NO: 594461 - DNA, 15 bp, Homo sapiens
taatgtgtggattgc

SEQ ID NO: 594462 - DNA, 14 bp, Homo sapiens
taatgttttcaaaa

SEQ ID NO: 594463 - DNA, 18 bp, Homo sapiens
taattatgtaaataactc

SEQ ID NO: 594464 - DNA, 15 bp, Homo sapiens
taattgtacaaaatt

SEQ ID NO: 594465 - DNA, 20 bp, Homo sapiens
taattgtgtggattctttaa

SEQ ID NO: 594466 - DNA, 16 bp, Homo sapiens
taatttaaatgaaaga

SEQ ID NO: 594467 - DNA, 19 bp, Homo sapiens
taatttaactttctgggtt

SEQ ID NO: 594468 - DNA, 16 bp, Homo sapiens
taatttacttgttttg

SEQ ID NO: 594469 - DNA, 12 bp, Homo sapiens
taatttgaactt

SEQ ID NO: 594470 - DNA, 13 bp, Homo sapiens
taatttgaacttt

SEQ ID NO: 594471 - DNA, 23 bp, Homo sapiens
tacaaaattaagcaaatgttaaa

SEQ ID NO: 594472 - DNA, 21 bp, Homo sapiens
tacaagtaaatagtttgaatt

SEQ ID NO: 594473 - DNA, 14 bp, Homo sapiens
tacaatattgattg

SEQ ID NO: 594474 - DNA, 15 bp, Homo sapiens
tacaatattgattgg

SEQ ID NO: 594475 - DNA, 17 bp, Homo sapiens
tacaatctctttttgtt

SEQ ID NO: 594476 - DNA, 13 bp, Homo sapiens
tacacatttgcta

SEQ ID NO: 594477 - DNA, 11 bp, Homo sapiens
tacagagccac

SEQ ID NO: 594478 - DNA, 16 bp, Homo sapiens
tacagaggtattaaaa

SEQ ID NO: 594479 - DNA, 14 bp, Homo sapiens
tacagttttaactg

SEQ ID NO: 594480 - DNA, 19 bp, Homo sapiens
tacagttttaactgtggat

SEQ ID NO: 594481 - DNA, 16 bp, Homo sapiens
tacatcaatatgtata

SEQ ID NO: 594482 - DNA, 17 bp, Homo sapiens
tacatgtgatacatttt

SEQ ID NO: 594483 - DNA, 18 bp, Homo sapiens
taccaatacaaaatgtat

SEQ ID NO: 594484 - DNA, 16 bp, Homo sapiens
taccatatgaatgaaa

SEQ ID NO: 594485 - DNA, 19 bp, Homo sapiens
taccatttagtaagaatac

SEQ ID NO: 594486 - DNA, 14 bp, Homo sapiens
tacccaaactgctt

SEQ ID NO: 594487 - DNA, 14 bp, Homo sapiens
tacccattcaacca

SEQ ID NO: 594488 - DNA, 13 bp, Homo sapiens
taccccttcctgt

SEQ ID NO: 594489 - DNA, 13 bp, Homo sapiens
tacctaacatctg

SEQ ID NO: 594490 - DNA, 23 bp, Homo sapiens
tacctactggtgtaatctcaatg

SEQ ID NO: 594491 - DNA, 15 bp, Homo sapiens
tacctagctggctct

SEQ ID NO: 594492 - DNA, 18 bp, Homo sapiens
tacctccagtcacactcc

SEQ ID NO: 594493 - DNA, 14 bp, Homo sapiens
tacctccctccctc

SEQ ID NO: 594494 - DNA, 17 bp, Homo sapiens
tacctggggactcctca

SEQ ID NO: 594495 - DNA, 17 bp, Homo sapiens
tacgaatgcccctgttc

SEQ ID NO: 594496 - DNA, 15 bp, Homo sapiens
tacgcatcccatctc

SEQ ID NO: 594497 - DNA, 21 bp, Homo sapiens
tacgtagcctaaggctcctgt

SEQ ID NO: 594498 - DNA, 15 bp, Homo sapiens
tactactactgttat

SEQ ID NO: 594499 - DNA, 13 bp, Homo sapiens
tactactgttatc

SEQ ID NO: 594500 - DNA, 15 bp, Homo sapiens
tactatggagtacca

SEQ ID NO: 594501 - DNA, 15 bp, Homo sapiens
tactctgctatttct

SEQ ID NO: 594502 - DNA, 16 bp, Homo sapiens
tactgacatttcttct

SEQ ID NO: 594503 - DNA, 14 bp, Homo sapiens
tactgcaatcactg

SEQ ID NO: 594504 - DNA, 20 bp, Homo sapiens
tactgcaatcactgtgctat

SEQ ID NO: 594505 - DNA, 21 bp, Homo sapiens
tactgcctctacagttaatag

SEQ ID NO: 594506 - DNA, 18 bp, Homo sapiens
tactggcttacctcctca

SEQ ID NO: 594507 - DNA, 16 bp, Homo sapiens
tactgtaacattcagg

SEQ ID NO: 594508 - DNA, 19 bp, Homo sapiens
tactgtctattaatattca

SEQ ID NO: 594509 - DNA, 14 bp, Homo sapiens
tacttaaatggtaa

SEQ ID NO: 594510 - DNA, 15 bp, Homo sapiens
tacttccctcttgaa

SEQ ID NO: 594511 - DNA, 14 bp, Homo sapiens
tagaactagccaaa

SEQ ID NO: 594512 - DNA, 18 bp, Homo sapiens
tagaagcctgacaactca

SEQ ID NO: 594513 - DNA, 21 bp, Homo sapiens
tagaagcctgacaactcattt

SEQ ID NO: 594514 - DNA, 14 bp, Homo sapiens
tagagaacaaagta

SEQ ID NO: 594515 - DNA, 22 bp, Homo sapiens
tagagaacaaagtaaaagtagt

SEQ ID NO: 594516 - DNA, 13 bp, Homo sapiens
tagataatattgt

SEQ ID NO: 594517 - DNA, 17 bp, Homo sapiens
tagcacacttttccaca

SEQ ID NO: 594518 - DNA, 16 bp, Homo sapiens
tagcagccagttcaaa

SEQ ID NO: 594519 - DNA, 15 bp, Homo sapiens
tagcatcttcctctg

SEQ ID NO: 594520 - DNA, 24 bp, Homo sapiens
tagcattgtaaaattatttcatga

SEQ ID NO: 594521 - DNA, 17 bp, Homo sapiens
tagccagaggctctaat

SEQ ID NO: 594522 - DNA, 15 bp, Homo sapiens
tagcctatgtctggc

SEQ ID NO: 594523 - DNA, 21 bp, Homo sapiens
tagctattagcggctcctcgc

SEQ ID NO: 594524 - DNA, 15 bp, Homo sapiens
tagctcagctgagca

SEQ ID NO: 594525 - DNA, 21 bp, Homo sapiens
tagctgaagaattgaaaagtt

SEQ ID NO: 594526 - DNA, 15 bp, Homo sapiens
tagcttcagccaggc

SEQ ID NO: 594527 - DNA, 18 bp, Homo sapiens
taggaacaatctttgctg

SEQ ID NO: 594528 - DNA, 22 bp, Homo sapiens
taggaatcattcagaaatgttg

SEQ ID NO: 594529 - DNA, 13 bp, Homo sapiens
tagggtctaccaa

SEQ ID NO: 594530 - DNA, 18 bp, Homo sapiens
tagggtctaccaatacaa

SEQ ID NO: 594531 - DNA, 20 bp, Homo sapiens
taggtagaagtgagcaaaaa

SEQ ID NO: 594532 - DNA, 17 bp, Homo sapiens
taggttccccaatccat

SEQ ID NO: 594533 - DNA, 11 bp, Homo sapiens
taggttctttt

SEQ ID NO: 594534 - DNA, 22 bp, Homo sapiens
tagtaagaataccacatcaaat

SEQ ID NO: 594535 - DNA, 11 bp, Homo sapiens
tagtaagcata

SEQ ID NO: 594536 - DNA, 11 bp, Homo sapiens
tagtgacattt

SEQ ID NO: 594537 - DNA, 15 bp, Homo sapiens
tagtgacatttaatg

SEQ ID NO: 594538 - DNA, 19 bp, Homo sapiens
tagtgacatttaatgccat

SEQ ID NO: 594539 - DNA, 16 bp, Homo sapiens
tagtgttgtccaggaa

SEQ ID NO: 594540 - DNA, 16 bp, Homo sapiens
tataaacagaaatgga

SEQ ID NO: 594541 - DNA, 15 bp, Homo sapiens
tataaatatacagta

SEQ ID NO: 594542 - DNA, 20 bp, Homo sapiens
tataaatgtataaatataca

SEQ ID NO: 594543 - DNA, 13 bp, Homo sapiens
tataacacatttt

SEQ ID NO: 594544 - DNA, 14 bp, Homo sapiens
tataacacattttt

SEQ ID NO: 594545 - DNA, 23 bp, Homo sapiens
tataacacatttttttgcatgca

SEQ ID NO: 594546 - DNA, 16 bp, Homo sapiens
tataacagtgtttaaa

SEQ ID NO: 594547 - DNA, 12 bp, Homo sapiens
tataatactact

SEQ ID NO: 594548 - DNA, 20 bp, Homo sapiens
tataatactactactgttat

SEQ ID NO: 594549 - DNA, 22 bp, Homo sapiens
tataataggaacaatctttgct

SEQ ID NO: 594550 - DNA, 17 bp, Homo sapiens
tataatgtcattaaaca

SEQ ID NO: 594551 - DNA, 13 bp, Homo sapiens
tataattgtacaa

SEQ ID NO: 594552 - DNA, 16 bp, Homo sapiens
tataattgtacaaaat

SEQ ID NO: 594553 - DNA, 12 bp, Homo sapiens
tccactgtagct

SEQ ID NO: 594554 - DNA, 13 bp, Homo sapiens
tccactgtagcta

SEQ ID NO: 594555 - DNA, 20 bp, Homo sapiens
tccacttctggggccacctc

SEQ ID NO: 594556 - DNA, 19 bp, Homo sapiens
tccagaaccacacttgaaa

SEQ ID NO: 594557 - DNA, 16 bp, Homo sapiens
tccagaagaaaatttg

SEQ ID NO: 594558 - DNA, 18 bp, Homo sapiens
tccagagaacctgtgggc

SEQ ID NO: 594559 - DNA, 15 bp, Homo sapiens
tccagagagtggaga

SEQ ID NO: 594560 - DNA, 17 bp, Homo sapiens
tccagatctttcagaaa

SEQ ID NO: 594561 - DNA, 10 bp, Homo sapiens
tccaggaagt

SEQ ID NO: 594562 - DNA, 21 bp, Homo sapiens
tccagtataagactactgaat

SEQ ID NO: 594563 - DNA, 15 bp, Homo sapiens
tccatccttgagatt

SEQ ID NO: 594564 - DNA, 15 bp, Homo sapiens
tccatcggggcaggg

SEQ ID NO: 594565 - DNA, 19 bp, Homo sapiens
tccatttccattgcttatt

SEQ ID NO: 594566 - DNA, 16 bp, Homo sapiens
tcccaagttgtgcttg

SEQ ID NO: 594567 - DNA, 18 bp, Homo sapiens
tcccacctgaatttgtat

SEQ ID NO: 594568 - DNA, 22 bp, Homo sapiens
tcccacttcctcctacctgggg

SEQ ID NO: 594569 - DNA, 10 bp, Homo sapiens
tcccagcctg

SEQ ID NO: 594570 - DNA, 11 bp, Homo sapiens
tcccagcctgg

SEQ ID NO: 594571 - DNA, 23 bp, Homo sapiens
tcccatctctcccacttcctcct

SEQ ID NO: 594572 - DNA, 23 bp, Homo sapiens
tccccacaggcacattaactgtt

SEQ ID NO: 594573 - DNA, 15 bp, Homo sapiens
tccccacctgtagct

SEQ ID NO: 594574 - DNA, 19 bp, Homo sapiens
tccccgtctctgccctggg

SEQ ID NO: 594575 - DNA, 14 bp, Homo sapiens
tcccctcgctgctg

SEQ ID NO: 594576 - DNA, 14 bp, Homo sapiens
tcccctttgtcctg

SEQ ID NO: 594577 - DNA, 17 bp, Homo sapiens
tccccttttaccactcc

SEQ ID NO: 594578 - DNA, 19 bp, Homo sapiens
tccccttttaccactccca

SEQ ID NO: 594579 - DNA, 21 bp, Homo sapiens
tccctaggatcccgtcttcca

SEQ ID NO: 594580 - DNA, 14 bp, Homo sapiens
tccctctcctaact

SEQ ID NO: 594581 - DNA, 13 bp, Homo sapiens
tccctcttctctc

SEQ ID NO: 594582 - DNA, 14 bp, Homo sapiens
tccctcttctctcc

SEQ ID NO: 594583 - DNA, 20 bp, Homo sapiens
tccctgcaaaactccaggca

SEQ ID NO: 594584 - DNA, 16 bp, Homo sapiens
tccctgcctcaggcca

SEQ ID NO: 594585 - DNA, 15 bp, Homo sapiens
tccctgggccacctc

SEQ ID NO: 594586 - DNA, 17 bp, Homo sapiens
tccctgggccacctcct

SEQ ID NO: 594587 - DNA, 20 bp, Homo sapiens
tcccttaaggggtatcatgt

SEQ ID NO: 594588 - DNA, 17 bp, Homo sapiens
tcccttcctattctcct

SEQ ID NO: 594589 - DNA, 18 bp, Homo sapiens
tccgcccactcctgggac

SEQ ID NO: 594590 - DNA, 19 bp, Homo sapiens
tccgggcaccaggggccaa

SEQ ID NO: 594591 - DNA, 17 bp, Homo sapiens
tcctaaaagttctcaat

SEQ ID NO: 594592 - DNA, 16 bp, Homo sapiens
tcctaagtcccttcct

SEQ ID NO: 594593 - DNA, 20 bp, Homo sapiens
tcctaccccttcctgtcctg

SEQ ID NO: 594594 - DNA, 21 bp, Homo sapiens
tcctaccccttcctgtcctgc

SEQ ID NO: 594595 - DNA, 23 bp, Homo sapiens
tcctaccccttcctgtcctgcct

SEQ ID NO: 594596 - DNA, 13 bp, Homo sapiens
tcctaccgtcttt

SEQ ID NO: 594597 - DNA, 14 bp, Homo sapiens
tcctagtaagaaga

SEQ ID NO: 594598 - DNA, 12 bp, Homo sapiens
tcctattctcct

SEQ ID NO: 594599 - DNA, 14 bp, Homo sapiens
tcctattctcctgc

SEQ ID NO: 594600 - DNA, 15 bp, Homo sapiens
tcctattctcctgcc

SEQ ID NO: 594601 - DNA, 16 bp, Homo sapiens
tcctattctcctgcca

SEQ ID NO: 594602 - DNA, 14 bp, Homo sapiens
tcctcaaaccactt

SEQ ID NO: 594603 - DNA, 18 bp, Homo sapiens
tcctcaaaccacttgcct

SEQ ID NO: 594604 - DNA, 20 bp, Homo sapiens
tcctcaaaccacttgcctgg

SEQ ID NO: 594605 - DNA, 13 bp, Homo sapiens
tcctcaccgagca

SEQ ID NO: 594606 - DNA, 13 bp, Homo sapiens
tcctccccacctg

SEQ ID NO: 594607 - DNA, 17 bp, Homo sapiens
tcctccccacctgtagc

SEQ ID NO: 594608 - DNA, 20 bp, Homo sapiens
tcctcctaagtcccttccta

SEQ ID NO: 594609 - DNA, 14 bp, Homo sapiens
tcctcctacctggg

SEQ ID NO: 594610 - DNA, 22 bp, Homo sapiens
tcctcctacctggggactcctc

SEQ ID NO: 594611 - DNA, 15 bp, Homo sapiens
tcctcgagccctccc

SEQ ID NO: 594612 - DNA, 16 bp, Homo sapiens
tcctcgagccctcccc

SEQ ID NO: 594613 - DNA, 17 bp, Homo sapiens
tcctcgagccctccccc

SEQ ID NO: 594614 - DNA, 15 bp, Homo sapiens
tcctgataataaagg

SEQ ID NO: 594615 - DNA, 14 bp, Homo sapiens
tcctgcctcctcat

SEQ ID NO: 594616 - DNA, 11 bp, Homo sapiens
tcctggagggg

SEQ ID NO: 594617 - DNA, 14 bp, Homo sapiens
tcctgggtttccat

SEQ ID NO: 594618 - DNA, 13 bp, Homo sapiens
tcctgtcctgcct

SEQ ID NO: 594619 - DNA, 16 bp, Homo sapiens
tcctgtcctgcctcct

SEQ ID NO: 594620 - DNA, 20 bp, Homo sapiens
tcctgttccatttcagttca

SEQ ID NO: 594621 - DNA, 17 bp, Homo sapiens
tcctgttttgcacagcc

SEQ ID NO: 594622 - DNA, 21 bp, Homo sapiens
tcctgttttgcacagccaaat

SEQ ID NO: 594623 - DNA, 14 bp, Homo sapiens
tccttaaaatgtgg

SEQ ID NO: 594624 - DNA, 20 bp, Homo sapiens
tgagagtccaacagacacaa

SEQ ID NO: 594625 - DNA, 22 bp, Homo sapiens
tgagattggttttcctgtggca

SEQ ID NO: 594626 - DNA, 21 bp, Homo sapiens
tgagcagcatccaccccaccc

SEQ ID NO: 594627 - DNA, 17 bp, Homo sapiens
tgagcatggagacagca

SEQ ID NO: 594628 - DNA, 18 bp, Homo sapiens
tgagcatggagacagcag

SEQ ID NO: 594629 - DNA, 19 bp, Homo sapiens
tgagcatggagacagcagt

SEQ ID NO: 594630 - DNA, 15 bp, Homo sapiens
tgagcatggggccag

SEQ ID NO: 594631 - DNA, 17 bp, Homo sapiens
tgagccatgcctccctg

SEQ ID NO: 594632 - DNA, 18 bp, Homo sapiens
tgagccatgcctccctgg

SEQ ID NO: 594633 - DNA, 15 bp, Homo sapiens
tgaggaaaattctta

SEQ ID NO: 594634 - DNA, 15 bp, Homo sapiens
tgaggacccagagct

SEQ ID NO: 594635 - DNA, 16 bp, Homo sapiens
tgaggacccagagctg

SEQ ID NO: 594636 - DNA, 14 bp, Homo sapiens
tgaggagattccca

SEQ ID NO: 594637 - DNA, 16 bp, Homo sapiens
tgaggcctagactctg

SEQ ID NO: 594638 - DNA, 23 bp, Homo sapiens
tgagggccggttctaaggctcag

SEQ ID NO: 594639 - DNA, 19 bp, Homo sapiens
tgaggggctaccctgggaa

SEQ ID NO: 594640 - DNA, 20 bp, Homo sapiens
tgagtaaaaagtttctaaag

SEQ ID NO: 594641 - DNA, 19 bp, Homo sapiens
tgagtattgtttaaaatgt

SEQ ID NO: 594642 - DNA, 20 bp, Homo sapiens
tgagtgacaaagcctctgaa

SEQ ID NO: 594643 - DNA, 14 bp, Homo sapiens
tgagtgtatgagta

SEQ ID NO: 594644 - DNA, 21 bp, Homo sapiens
tgataatgacactgtttcctg

SEQ ID NO: 594645 - DNA, 23 bp, Homo sapiens
tgataatgacactgtttcctgat

SEQ ID NO: 594646 - DNA, 18 bp, Homo sapiens
tgatacattttttaagct

SEQ ID NO: 594647 - DNA, 19 bp, Homo sapiens
tgatatgcatttcctgctg

SEQ ID NO: 594648 - DNA, 18 bp, Homo sapiens
tgatccccgtctctgccc

SEQ ID NO: 594649 - DNA, 20 bp, Homo sapiens
tgatccccgtctctgccctg

SEQ ID NO: 594650 - DNA, 21 bp, Homo sapiens
tgatcggccagttttcggaaa

SEQ ID NO: 594651 - DNA, 21 bp, Homo sapiens
tgatctacttctgtaattgtg

SEQ ID NO: 594652 - DNA, 13 bp, Homo sapiens
tgatgctttggaa

SEQ ID NO: 594653 - DNA, 19 bp, Homo sapiens
tgatgctttggaagatgca

SEQ ID NO: 594654 - DNA, 22 bp, Homo sapiens
tgatgctttggaagatgcagaa

SEQ ID NO: 594655 - DNA, 16 bp, Homo sapiens
tgatggacctgccccg

SEQ ID NO: 594656 - DNA, 16 bp, Homo sapiens
tgatgggtgccctttc

SEQ ID NO: 594657 - DNA, 21 bp, Homo sapiens
tgatggtgtcattctgcctgc

SEQ ID NO: 594658 - DNA, 17 bp, Homo sapiens
tgattactgcaatcact

SEQ ID NO: 594659 - DNA, 14 bp, Homo sapiens
tgattctggcttta

SEQ ID NO: 594660 - DNA, 15 bp, Homo sapiens
tgattgggaaaacat

SEQ ID NO: 594661 - DNA, 22 bp, Homo sapiens
tgatttccctccagagaaagca

SEQ ID NO: 594662 - DNA, 17 bp, Homo sapiens
tgattttttttaattac

SEQ ID NO: 594663 - DNA, 15 bp, Homo sapiens
tgcaaaaggaggtga

SEQ ID NO: 594664 - DNA, 16 bp, Homo sapiens
tgcaaagaccacctcc

SEQ ID NO: 594665 - DNA, 14 bp, Homo sapiens
tgcaataaaattta

SEQ ID NO: 594666 - DNA, 15 bp, Homo sapiens
tgcaataaaatttaa

SEQ ID NO: 594667 - DNA, 23 bp, Homo sapiens
tgcaatactgcttaattgctgat

SEQ ID NO: 594668 - DNA, 16 bp, Homo sapiens
tgcaatagaaggtgat

SEQ ID NO: 594669 - DNA, 16 bp, Homo sapiens
tgcaatcactgtgcta

SEQ ID NO: 594670 - DNA, 15 bp, Homo sapiens
tgcaatgcagaggtt

SEQ ID NO: 594671 - DNA, 15 bp, Homo sapiens
tgcaattcagtgttc

SEQ ID NO: 594672 - DNA, 21 bp, Homo sapiens
tgcacaagatgccccagggat

SEQ ID NO: 594673 - DNA, 22 bp, Homo sapiens
tgcacaagatgccccagggatg

SEQ ID NO: 594674 - DNA, 18 bp, Homo sapiens
tgcacacactcacctcta

SEQ ID NO: 594675 - DNA, 22 bp, Homo sapiens
tgcacataagcttccattttaa

SEQ ID NO: 594676 - DNA, 13 bp, Homo sapiens
tgcactatttcca

SEQ ID NO: 594677 - DNA, 16 bp, Homo sapiens
tgcactatttccacat

SEQ ID NO: 594678 - DNA, 14 bp, Homo sapiens
tgcactcagaaaat

SEQ ID NO: 594679 - DNA, 15 bp, Homo sapiens
tgcactgccccctgc

SEQ ID NO: 594680 - DNA, 23 bp, Homo sapiens
tgcactgccccctgcttggccag

SEQ ID NO: 594681 - DNA, 19 bp, Homo sapiens
tgcacttattgaccatttt

SEQ ID NO: 594682 - DNA, 14 bp, Homo sapiens
tgcacttttgaatg

SEQ ID NO: 594683 - DNA, 15 bp, Homo sapiens
tgcagagatttctca

SEQ ID NO: 594684 - DNA, 13 bp, Homo sapiens
tgctgtcttaaac

SEQ ID NO: 594685 - DNA, 14 bp, Homo sapiens
tgctgtcttaaact

SEQ ID NO: 594686 - DNA, 18 bp, Homo sapiens
tgctgttgaactttttaa

SEQ ID NO: 594687 - DNA, 16 bp, Homo sapiens
tgcttaatcttcaaag

SEQ ID NO: 594688 - DNA, 20 bp, Homo sapiens
tgcttaatcttcaaagcctt

SEQ ID NO: 594689 - DNA, 16 bp, Homo sapiens
tgcttactcattaaaa

SEQ ID NO: 594690 - DNA, 14 bp, Homo sapiens
tgcttcacaatgtt

SEQ ID NO: 594691 - DNA, 13 bp, Homo sapiens
tgcttccctagga

SEQ ID NO: 594692 - DNA, 16 bp, Homo sapiens
tgcttgcataagagct

SEQ ID NO: 594693 - DNA, 15 bp, Homo sapiens
tgctttattaatgtt

SEQ ID NO: 594694 - DNA, 18 bp, Homo sapiens
tgctttattaatgttttc

SEQ ID NO: 594695 - DNA, 15 bp, Homo sapiens
tgctttcctgcagca

SEQ ID NO: 594696 - DNA, 14 bp, Homo sapiens
tgctttttccaact

SEQ ID NO: 594697 - DNA, 15 bp, Homo sapiens
tggaaagtaactgtg

SEQ ID NO: 594698 - DNA, 13 bp, Homo sapiens
tggaaattcctgt

SEQ ID NO: 594699 - DNA, 16 bp, Homo sapiens
tggaagcccctgggcc

SEQ ID NO: 594700 - DNA, 20 bp, Homo sapiens
tggaaggacctgctcccaca

SEQ ID NO: 594701 - DNA, 23 bp, Homo sapiens
tggaatcagtatttccttccact

SEQ ID NO: 594702 - DNA, 14 bp, Homo sapiens
tggaccaggcccat

SEQ ID NO: 594703 - DNA, 15 bp, Homo sapiens
tggaccaggcccata

SEQ ID NO: 594704 - DNA, 17 bp, Homo sapiens
tggacttaaccggagtt

SEQ ID NO: 594705 - DNA, 22 bp, Homo sapiens
tggagaatactgccaaaacatt

SEQ ID NO: 594706 - DNA, 12 bp, Homo sapiens
tggagacagcag

SEQ ID NO: 594707 - DNA, 13 bp, Homo sapiens
tggagagagcagg

SEQ ID NO: 594708 - DNA, 15 bp, Homo sapiens
tggagagagcagggc

SEQ ID NO: 594709 - DNA, 16 bp, Homo sapiens
tggatacagagccacg

SEQ ID NO: 594710 - DNA, 22 bp, Homo sapiens
tggatcccgttcagaaaaccac

SEQ ID NO: 594711 - DNA, 23 bp, Homo sapiens
tggatggcttgtctatactcctt

SEQ ID NO: 594712 - DNA, 18 bp, Homo sapiens
tggatttggcactagcca

SEQ ID NO: 594713 - DNA, 15 bp, Homo sapiens
tggcagtctcagtcc

SEQ ID NO: 594714 - DNA, 22 bp, Homo sapiens
tggcattctttgcaatactgct

SEQ ID NO: 594715 - DNA, 23 bp, Homo sapiens
tggccttgtaagacccttattgc

SEQ ID NO: 594716 - DNA, 17 bp, Homo sapiens
tggctcaaagcagcagg

SEQ ID NO: 594717 - DNA, 13 bp, Homo sapiens
tggcttgtctata

SEQ ID NO: 594718 - DNA, 23 bp, Homo sapiens
tggctttaagccttcaaaactat

SEQ ID NO: 594719 - DNA, 12 bp, Homo sapiens
tgggactggagt

SEQ ID NO: 594720 - DNA, 18 bp, Homo sapiens
tgggactggagtccctgt

SEQ ID NO: 594721 - DNA, 20 bp, Homo sapiens
tgggaggcagaggttgcagt

SEQ ID NO: 594722 - DNA, 14 bp, Homo sapiens
tgggaggctgaggt

SEQ ID NO: 594723 - DNA, 20 bp, Homo sapiens
tgggaggtatgggctggggg

SEQ ID NO: 594724 - DNA, 17 bp, Homo sapiens
tgggatattttgaaatg

SEQ ID NO: 594725 - DNA, 23 bp, Homo sapiens
tgggatattttgaaatgaacttt

SEQ ID NO: 594726 - DNA, 18 bp, Homo sapiens
tgggcactggggcctcag

SEQ ID NO: 594727 - DNA, 13 bp, Homo sapiens
tgggcagccagac

SEQ ID NO: 594728 - DNA, 15 bp, Homo sapiens
tgggctcctcttagc

SEQ ID NO: 594729 - DNA, 20 bp, Homo sapiens
tgggctgcccacctggctgc

SEQ ID NO: 594730 - DNA, 13 bp, Homo sapiens
tgggctgggggct

SEQ ID NO: 594731 - DNA, 21 bp, Homo sapiens
tgggctgtgattactgcaatc

SEQ ID NO: 594732 - DNA, 20 bp, Homo sapiens
tgggctttggtggccaggga

SEQ ID NO: 594733 - DNA, 22 bp, Homo sapiens
tgggcttttggggagccagaag

SEQ ID NO: 594734 - DNA, 16 bp, Homo sapiens
tggggaacggaggagg

SEQ ID NO: 594735 - DNA, 14 bp, Homo sapiens
tggggaggcctcac

SEQ ID NO: 594736 - DNA, 12 bp, Homo sapiens
tggggccaggaa

SEQ ID NO: 594737 - DNA, 13 bp, Homo sapiens
tggggcctcagcc

SEQ ID NO: 594738 - DNA, 21 bp, Homo sapiens
tggggcctcaggctccgggca

SEQ ID NO: 594739 - DNA, 19 bp, Homo sapiens
tggggcgggtggggccata

SEQ ID NO: 594740 - DNA, 23 bp, Homo sapiens
tggggctgagccctcctgagggc

SEQ ID NO: 594741 - DNA, 21 bp, Homo sapiens
tgtccaaacgtcctctttagt

SEQ ID NO: 594742 - DNA, 19 bp, Homo sapiens
tgtccaacatggtaattca

SEQ ID NO: 594743 - DNA, 17 bp, Homo sapiens
tgtcccctatcctcccc

SEQ ID NO: 594744 - DNA, 11 bp, Homo sapiens
tgtcctgcctc

SEQ ID NO: 594745 - DNA, 12 bp, Homo sapiens
tgtcctgcctcc

SEQ ID NO: 594746 - DNA, 16 bp, Homo sapiens
tgtcctgcctcctcat

SEQ ID NO: 594747 - DNA, 18 bp, Homo sapiens
tgtccttaaaatgtggtc

SEQ ID NO: 594748 - DNA, 20 bp, Homo sapiens
tgtctatttttaatgtttgt

SEQ ID NO: 594749 - DNA, 12 bp, Homo sapiens
tgtctcaaaaaa

SEQ ID NO: 594750 - DNA, 17 bp, Homo sapiens
tgtctccttaagctgca

SEQ ID NO: 594751 - DNA, 15 bp, Homo sapiens
tgtctcctttgctct

SEQ ID NO: 594752 - DNA, 13 bp, Homo sapiens
tgtctgatttctt

SEQ ID NO: 594753 - DNA, 14 bp, Homo sapiens
tgtctggcagatga

SEQ ID NO: 594754 - DNA, 20 bp, Homo sapiens
tgtctggcagatgagggctg

SEQ ID NO: 594755 - DNA, 20 bp, Homo sapiens
tgtgaagcaaactctaaaat

SEQ ID NO: 594756 - DNA, 15 bp, Homo sapiens
tgtgaagtattcaca

SEQ ID NO: 594757 - DNA, 16 bp, Homo sapiens
tgtgaagtttggagat

SEQ ID NO: 594758 - DNA, 19 bp, Homo sapiens
tgtgaagtttggagataga

SEQ ID NO: 594759 - DNA, 20 bp, Homo sapiens
tgtgaccagaaagcttcatc

SEQ ID NO: 594760 - DNA, 16 bp, Homo sapiens
tgtgagccatgcctcc

SEQ ID NO: 594761 - DNA, 18 bp, Homo sapiens
tgtgagccatgcctccct

SEQ ID NO: 594762 - DNA, 15 bp, Homo sapiens
tgtgagggtgctgac

SEQ ID NO: 594763 - DNA, 14 bp, Homo sapiens
tgtgccaagagcta

SEQ ID NO: 594764 - DNA, 16 bp, Homo sapiens
tgtgctgggtcccagc

SEQ ID NO: 594765 - DNA, 20 bp, Homo sapiens
tgtgctgggtcccagcctgg

SEQ ID NO: 594766 - DNA, 14 bp, Homo sapiens
tgtggattctttaa

SEQ ID NO: 594767 - DNA, 13 bp, Homo sapiens
tgtgggaaagagc

SEQ ID NO: 594768 - DNA, 23 bp, Homo sapiens
tgtggtctgccaatctgtacaaa

SEQ ID NO: 594769 - DNA, 12 bp, Homo sapiens
tgtgtaaataat

SEQ ID NO: 594770 - DNA, 20 bp, Homo sapiens
tgtgtaaataatttgcactg

SEQ ID NO: 594771 - DNA, 14 bp, Homo sapiens
tgtgtaataatgta

SEQ ID NO: 594772 - DNA, 19 bp, Homo sapiens
tgtgtaataatgtaacatg

SEQ ID NO: 594773 - DNA, 20 bp, Homo sapiens
tgtgtaataatgtaacatga

SEQ ID NO: 594774 - DNA, 21 bp, Homo sapiens
tgtgtaataatgtaacatgat

SEQ ID NO: 594775 - DNA, 16 bp, Homo sapiens
tgtgtataactggatt

SEQ ID NO: 594776 - DNA, 16 bp, Homo sapiens
tgtgtcattagtcctt

SEQ ID NO: 594777 - DNA, 14 bp, Homo sapiens
tgtgtgaaattgca

SEQ ID NO: 594778 - DNA, 16 bp, Homo sapiens
tgtgttttgaaagaat

SEQ ID NO: 594779 - DNA, 15 bp, Homo sapiens
tgttaaaagttttat

SEQ ID NO: 594780 - DNA, 14 bp, Homo sapiens
tgttaaagagataa

SEQ ID NO: 594781 - DNA, 15 bp, Homo sapiens
tgttaaagagataaa

SEQ ID NO: 594782 - DNA, 23 bp, Homo sapiens
tgttaaggacccttttaagcatg

SEQ ID NO: 594783 - DNA, 20 bp, Homo sapiens
tgttactaaaaaaaagatga

SEQ ID NO: 594784 - DNA, 17 bp, Homo sapiens
tgttcattatttgtgct

SEQ ID NO: 594785 - DNA, 14 bp, Homo sapiens
tgttccaagtctct

SEQ ID NO: 594786 - DNA, 20 bp, Homo sapiens
tgttccaagtctctgtgtaa

SEQ ID NO: 594787 - DNA, 15 bp, Homo sapiens
tgttcccaaaacaat

SEQ ID NO: 594788 - DNA, 18 bp, Homo sapiens
tgttctgatcggccagtt

SEQ ID NO: 594789 - DNA, 16 bp, Homo sapiens
tgttctgcatggattc

SEQ ID NO: 594790 - DNA, 19 bp, Homo sapiens
tgttcttgccactgcactc

SEQ ID NO: 594791 - DNA, 12 bp, Homo sapiens
tgttgatgagga

SEQ ID NO: 594792 - DNA, 11 bp, Homo sapiens
tgttgcactgc

SEQ ID NO: 594793 - DNA, 16 bp, Homo sapiens
tgttgcactgccccct

SEQ ID NO: 594794 - DNA, 14 bp, Homo sapiens
tttgaactttggaa

SEQ ID NO: 594795 - DNA, 23 bp, Homo sapiens
tttgaatgtccaaaatttatatt

SEQ ID NO: 594796 - DNA, 14 bp, Homo sapiens
tttgaattcagtaa

SEQ ID NO: 594797 - DNA, 18 bp, Homo sapiens
tttgcaaagaccacctcc

SEQ ID NO: 594798 - DNA, 20 bp, Homo sapiens
tttgcatgcatgcaaatgag

SEQ ID NO: 594799 - DNA, 11 bp, Homo sapiens
tttgcctcctg

SEQ ID NO: 594800 - DNA, 21 bp, Homo sapiens
tttgctactgttgtaagaatt

SEQ ID NO: 594801 - DNA, 12 bp, Homo sapiens
tttgctcttgcc

SEQ ID NO: 594802 - DNA, 17 bp, Homo sapiens
tttgggaggctgaggtg

SEQ ID NO: 594803 - DNA, 16 bp, Homo sapiens
tttggtaaatgtttct

SEQ ID NO: 594804 - DNA, 23 bp, Homo sapiens
tttgtaaaaatcttttgaagcat

SEQ ID NO: 594805 - DNA, 15 bp, Homo sapiens
tttgtattttcatga

SEQ ID NO: 594806 - DNA, 12 bp, Homo sapiens
tttgtcagtgtt

SEQ ID NO: 594807 - DNA, 22 bp, Homo sapiens
tttgtcctgcgttttctccggg

SEQ ID NO: 594808 - DNA, 15 bp, Homo sapiens
tttgtgactttttaa

SEQ ID NO: 594809 - DNA, 20 bp, Homo sapiens
ttttaaaacgtgtaaatgaa

SEQ ID NO: 594810 - DNA, 18 bp, Homo sapiens
ttttaatttacttgtttt

SEQ ID NO: 594811 - DNA, 15 bp, Homo sapiens
ttttataaagcatgt

SEQ ID NO: 594812 - DNA, 16 bp, Homo sapiens
ttttataattgtacaa

SEQ ID NO: 594813 - DNA, 19 bp, Homo sapiens
ttttatattactgacattt

SEQ ID NO: 594814 - DNA, 13 bp, Homo sapiens
ttttcatgaaaat

SEQ ID NO: 594815 - DNA, 22 bp, Homo sapiens
ttttcggaaacactgacttagg

SEQ ID NO: 594816 - DNA, 12 bp, Homo sapiens
ttttgaaagaat

SEQ ID NO: 594817 - DNA, 17 bp, Homo sapiens
ttttgaaatgaactttg

SEQ ID NO: 594818 - DNA, 22 bp, Homo sapiens
ttttgattattttttttttctt

SEQ ID NO: 594819 - DNA, 19 bp, Homo sapiens
ttttgcatgcatgcaaatg

SEQ ID NO: 594820 - DNA, 14 bp, Homo sapiens
ttttgtatgttaaa

SEQ ID NO: 594821 - DNA, 17 bp, Homo sapiens
ttttgtatgttaaagag

SEQ ID NO: 594822 - DNA, 13 bp, Homo sapiens
tttttaagaaaaa

SEQ ID NO: 594823 - DNA, 16 bp, Homo sapiens
tttttaagcttcagtt

SEQ ID NO: 594824 - DNA, 15 bp, Homo sapiens
ttttttaagcttcag

SEQ ID NO: 594825 - DNA, 12 bp, Homo sapiens
tttttttctatt

SEQ ID NO: 594826 - DNA, 14 bp, Homo sapiens
aagactatatatat

SEQ ID NO: 594827 - DNA, 21 bp, Homo sapiens
aagactgagccagattggcca

SEQ ID NO: 594828 - DNA, 16 bp, Homo sapiens
aagagacagcccagga

SEQ ID NO: 594829 - DNA, 15 bp, Homo sapiens
aagagataagtcttt

SEQ ID NO: 594830 - DNA, 18 bp, Homo sapiens
aagagggaaaacagaaaa

SEQ ID NO: 594831 - DNA, 19 bp, Homo sapiens
aagagggaaaacagaaaac

SEQ ID NO: 594832 - DNA, 20 bp, Homo sapiens
aagagggacataagataaaa

SEQ ID NO: 594833 - DNA, 21 bp, Homo sapiens
aagagtttcagtttgttggaa

SEQ ID NO: 594834 - DNA, 18 bp, Homo sapiens
aagataaaatgatgttat

SEQ ID NO: 594835 - DNA, 12 bp, Homo sapiens
aagatgagttgg

SEQ ID NO: 594836 - DNA, 16 bp, Homo sapiens
aagatgcgtttgcctc

SEQ ID NO: 594837 - DNA, 22 bp, Homo sapiens
aagatgctacttcccactgtat

SEQ ID NO: 594838 - DNA, 16 bp, Homo sapiens
aagatgttatggtgtt

SEQ ID NO: 594839 - DNA, 19 bp, Homo sapiens
aagcaaatgttaaaagttt

SEQ ID NO: 594840 - DNA, 15 bp, Homo sapiens
aagcagagttttcat

SEQ ID NO: 594841 - DNA, 21 bp, Homo sapiens
aagccggcctgagaaacacta

SEQ ID NO: 594842 - DNA, 13 bp, Homo sapiens
aagccttcaaaac

SEQ ID NO: 594843 - DNA, 13 bp, Homo sapiens
aagctatctgtgc

SEQ ID NO: 594844 - DNA, 15 bp, Homo sapiens
aagctctgaagaact

SEQ ID NO: 594845 - DNA, 18 bp, Homo sapiens
aagctgattttttttaat

SEQ ID NO: 594846 - DNA, 23 bp, Homo sapiens
aagctgccgtagcttcagccagg

SEQ ID NO: 594847 - DNA, 16 bp, Homo sapiens
aagcttcagttgcttg

SEQ ID NO: 594848 - DNA, 18 bp, Homo sapiens
aagcttcagttgcttgtc

SEQ ID NO: 594849 - DNA, 17 bp, Homo sapiens
aaggacccttttaagca

SEQ ID NO: 594850 - DNA, 22 bp, Homo sapiens
aaggacccttttaagcatgtga

SEQ ID NO: 594851 - DNA, 17 bp, Homo sapiens
aaggacctgctcccaca

SEQ ID NO: 594852 - DNA, 17 bp, Homo sapiens
aaggatgggtcccctcc

SEQ ID NO: 594853 - DNA, 16 bp, Homo sapiens
aaggctcttcttcctc

SEQ ID NO: 594854 - DNA, 19 bp, Homo sapiens
aaggctgtgtttagattgt

SEQ ID NO: 594855 - DNA, 13 bp, Homo sapiens
aagggatcctgcc

SEQ ID NO: 594856 - DNA, 21 bp, Homo sapiens
aagggccagcgtggctctaaa

SEQ ID NO: 594857 - DNA, 13 bp, Homo sapiens
aaggggtaaaagg

SEQ ID NO: 594858 - DNA, 21 bp, Homo sapiens
aagggtgttgggagggtggtt

SEQ ID NO: 594859 - DNA, 16 bp, Homo sapiens
aaggtattatacatgt

SEQ ID NO: 594860 - DNA, 22 bp, Homo sapiens
aaggtattatacatgtgataca

SEQ ID NO: 594861 - DNA, 13 bp, Homo sapiens
aaggtgaactttg

SEQ ID NO: 594862 - DNA, 14 bp, Homo sapiens
aagtaactgtgaga

SEQ ID NO: 594863 - DNA, 19 bp, Homo sapiens
aagtacttgactacctact

SEQ ID NO: 594864 - DNA, 21 bp, Homo sapiens
aagtcccttcctattctcctg

SEQ ID NO: 594865 - DNA, 17 bp, Homo sapiens
aagtgcatgaaaaacca

SEQ ID NO: 594866 - DNA, 18 bp, Homo sapiens
aagtgcatgaaaaaccat

SEQ ID NO: 594867 - DNA, 17 bp, Homo sapiens
aagtgtgtatatatttt

SEQ ID NO: 594868 - DNA, 19 bp, Homo sapiens
aagtgtgtatatattttgt

SEQ ID NO: 594869 - DNA, 15 bp, Homo sapiens
aagtttggttttgac

SEQ ID NO: 594870 - DNA, 22 bp, Homo sapiens
aagttttgttgtacttaaatgg

SEQ ID NO: 594871 - DNA, 19 bp, Homo sapiens
aataaaaagaaagatactt

SEQ ID NO: 594872 - DNA, 13 bp, Homo sapiens
aataaaactattt

SEQ ID NO: 594873 - DNA, 11 bp, Homo sapiens
aataaagagga

SEQ ID NO: 594874 - DNA, 14 bp, Homo sapiens
aataaagtacttga

SEQ ID NO: 594875 - DNA, 23 bp, Homo sapiens
aataactatgccagcaaccttgt

SEQ ID NO: 594876 - DNA, 19 bp, Homo sapiens
aataagcactgtaaacttc

SEQ ID NO: 594877 - DNA, 18 bp, Homo sapiens
aataatgtaacatgattt

SEQ ID NO: 594878 - DNA, 19 bp, Homo sapiens
aataattaaccaaccttgt

SEQ ID NO: 594879 - DNA, 15 bp, Homo sapiens
aataatttgaacttt

SEQ ID NO: 594880 - DNA, 16 bp, Homo sapiens
aataatttgaactttg

SEQ ID NO: 594881 - DNA, 14 bp, Homo sapiens
aataatttgcactg

SEQ ID NO: 594882 - DNA, 19 bp, Homo sapiens
aataccacatcaaataaga

SEQ ID NO: 594883 - DNA, 15 bp, Homo sapiens
aatactactactgtt

SEQ ID NO: 594884 - DNA, 16 bp, Homo sapiens
aatactgccaaaacat

SEQ ID NO: 594885 - DNA, 17 bp, Homo sapiens
aatactgccaaaacatt

SEQ ID NO: 594886 - DNA, 19 bp, Homo sapiens
aatactgcttaattgctga

SEQ ID NO: 594887 - DNA, 13 bp, Homo sapiens
aatagaacacagt

SEQ ID NO: 594888 - DNA, 16 bp, Homo sapiens
aatagaattataactg

SEQ ID NO: 594889 - DNA, 14 bp, Homo sapiens
aatagctttagtga

SEQ ID NO: 594890 - DNA, 19 bp, Homo sapiens
aatagctttagtgaattaa

SEQ ID NO: 594891 - DNA, 20 bp, Homo sapiens
aataggaatcattcagaaat

SEQ ID NO: 594892 - DNA, 22 bp, Homo sapiens
aataggaatcattcagaaatgt

SEQ ID NO: 594893 - DNA, 21 bp, Homo sapiens
aataggagtggtgatttgaaa

SEQ ID NO: 594894 - DNA, 12 bp, Homo sapiens
aatataaaatta

SEQ ID NO: 594895 - DNA, 15 bp, Homo sapiens
aatataacacatttt

SEQ ID NO: 594896 - DNA, 13 bp, Homo sapiens
aatatatatatat

SEQ ID NO: 594897 - DNA, 16 bp, Homo sapiens
aatatatatatatata

SEQ ID NO: 594898 - DNA, 20 bp, Homo sapiens
aatattcagggtaaatagga

SEQ ID NO: 594899 - DNA, 22 bp, Homo sapiens
aatattccagatctttcagaaa

SEQ ID NO: 594900 - DNA, 23 bp, Homo sapiens
aatattccagatctttcagaaat

SEQ ID NO: 594901 - DNA, 16 bp, Homo sapiens
aatattgtttggtaaa

SEQ ID NO: 594902 - DNA, 23 bp, Homo sapiens
aatattgtttggtaaatgtttct

SEQ ID NO: 594903 - DNA, 22 bp, Homo sapiens
aatcaaagccggcctgagaaac

SEQ ID NO: 594904 - DNA, 14 bp, Homo sapiens
aatcactgtgctat

SEQ ID NO: 594905 - DNA, 15 bp, Homo sapiens
aatcagtatttcctt

SEQ ID NO: 594906 - DNA, 13 bp, Homo sapiens
aatcattcagaaa

SEQ ID NO: 594907 - DNA, 14 bp, Homo sapiens
aatcattcagaaat

SEQ ID NO: 594908 - DNA, 16 bp, Homo sapiens
aatccagttataagaa

SEQ ID NO: 594909 - DNA, 17 bp, Homo sapiens
aatccatccatgtactt

SEQ ID NO: 594910 - DNA, 20 bp, Homo sapiens
aatccttactaagtaggtga

SEQ ID NO: 594911 - DNA, 20 bp, Homo sapiens
aatctacaatctctttttgt

SEQ ID NO: 594912 - DNA, 20 bp, Homo sapiens
aatctatgaacctgaaaagg

SEQ ID NO: 594913 - DNA, 15 bp, Homo sapiens
aatctatgtttataa

SEQ ID NO: 594914 - DNA, 17 bp, Homo sapiens
aatctctttttgtttgc

SEQ ID NO: 594915 - DNA, 18 bp, Homo sapiens
aatctctttttgtttgcc

SEQ ID NO: 594916 - DNA, 17 bp, Homo sapiens
aatctgtacaaaatggt

SEQ ID NO: 594917 - DNA, 11 bp, Homo sapiens
aatctttgctg

SEQ ID NO: 594918 - DNA, 13 bp, Homo sapiens
aatcttttgaagc

SEQ ID NO: 594919 - DNA, 19 bp, Homo sapiens
aatgaaagaaaattgagtt

SEQ ID NO: 594920 - DNA, 16 bp, Homo sapiens
aatgaaagctgttcct

SEQ ID NO: 594921 - DNA, 16 bp, Homo sapiens
aatgaagatctttata

SEQ ID NO: 594922 - DNA, 23 bp, Homo sapiens
aatgaatgggatattttgaaatg

SEQ ID NO: 594923 - DNA, 16 bp, Homo sapiens
aatgacactgtttcct

SEQ ID NO: 594924 - DNA, 17 bp, Homo sapiens
aatgaggaaaattctta

SEQ ID NO: 594925 - DNA, 21 bp, Homo sapiens
aatgaggttgggggaaccagc

SEQ ID NO: 594926 - DNA, 21 bp, Homo sapiens
aatgatatataatttaaagtt

SEQ ID NO: 594927 - DNA, 17 bp, Homo sapiens
aatgccatctatctagt

SEQ ID NO: 594928 - DNA, 15 bp, Homo sapiens
aatgcccctgttcat

SEQ ID NO: 594929 - DNA, 19 bp, Homo sapiens
aatgggatattttgaaatg

SEQ ID NO: 594930 - DNA, 14 bp, Homo sapiens
aatggtaataagca

SEQ ID NO: 594931 - DNA, 13 bp, Homo sapiens
aatgtaacatgat

SEQ ID NO: 594932 - DNA, 16 bp, Homo sapiens
aatgtccaaaatttat

SEQ ID NO: 594933 - DNA, 19 bp, Homo sapiens
aatgtccaaaatttatatt

SEQ ID NO: 594934 - DNA, 15 bp, Homo sapiens
aatgtctcctttgct

SEQ ID NO: 594935 - DNA, 22 bp, Homo sapiens
aatgtggtctgccaatctgtac

SEQ ID NO: 594936 - DNA, 22 bp, Homo sapiens
actgtatgggggagattgaact

SEQ ID NO: 594937 - DNA, 15 bp, Homo sapiens
actgtggatattgtt

SEQ ID NO: 594938 - DNA, 17 bp, Homo sapiens
actgttgcacttttgaa

SEQ ID NO: 594939 - DNA, 19 bp, Homo sapiens
acttaggtttcaggaagtt

SEQ ID NO: 594940 - DNA, 15 bp, Homo sapiens
acttattgaccattt

SEQ ID NO: 594941 - DNA, 18 bp, Homo sapiens
acttcagcattgtaatta

SEQ ID NO: 594942 - DNA, 11 bp, Homo sapiens
acttcccagct

SEQ ID NO: 594943 - DNA, 14 bp, Homo sapiens
acttctcatgtata

SEQ ID NO: 594944 - DNA, 16 bp, Homo sapiens
acttctgaagagacca

SEQ ID NO: 594945 - DNA, 24 bp, Homo sapiens
acttctgcaacaagcatgcagctt

SEQ ID NO: 594946 - DNA, 18 bp, Homo sapiens
acttggtggcttttcctt

SEQ ID NO: 594947 - DNA, 19 bp, Homo sapiens
acttgttgtatctgctgga

SEQ ID NO: 594948 - DNA, 20 bp, Homo sapiens
acttgttgtatctgctggat

SEQ ID NO: 594949 - DNA, 18 bp, Homo sapiens
actttattgcaatgcaga

SEQ ID NO: 594950 - DNA, 18 bp, Homo sapiens
actttctatttttatgat

SEQ ID NO: 594951 - DNA, 20 bp, Homo sapiens
actttgacctaaattattta

SEQ ID NO: 594952 - DNA, 17 bp, Homo sapiens
actttggggctaattta

SEQ ID NO: 594953 - DNA, 22 bp, Homo sapiens
actttggtgcgggcacaataaa

SEQ ID NO: 594954 - DNA, 14 bp, Homo sapiens
acttttataaagca

SEQ ID NO: 594955 - DNA, 22 bp, Homo sapiens
actttttaaagaagtgcatgaa

SEQ ID NO: 594956 - DNA, 15 bp, Homo sapiens
agaaacaaacaaaac

SEQ ID NO: 594957 - DNA, 16 bp, Homo sapiens
agaaacaaacaaaact

SEQ ID NO: 594958 - DNA, 20 bp, Homo sapiens
agaaacactatttgtgactt

SEQ ID NO: 594959 - DNA, 15 bp, Homo sapiens
agaaagagtttgaaa

SEQ ID NO: 594960 - DNA, 15 bp, Homo sapiens
agaaagcttcatcca

SEQ ID NO: 594961 - DNA, 19 bp, Homo sapiens
agaaagcttccttcaacct

SEQ ID NO: 594962 - DNA, 17 bp, Homo sapiens
agaaataatgctacaat

SEQ ID NO: 594963 - DNA, 19 bp, Homo sapiens
agaaataatgctacaattt

SEQ ID NO: 594964 - DNA, 16 bp, Homo sapiens
agaaatataacacatt

SEQ ID NO: 594965 - DNA, 18 bp, Homo sapiens
agaaatataacacatttt

SEQ ID NO: 594966 - DNA, 19 bp, Homo sapiens
agaaattacctgtggatat

SEQ ID NO: 594967 - DNA, 17 bp, Homo sapiens
agaactagccaaaccag

SEQ ID NO: 594968 - DNA, 19 bp, Homo sapiens
agaactagccaaaccagga

SEQ ID NO: 594969 - DNA, 16 bp, Homo sapiens
agaacttcagcattgt

SEQ ID NO: 594970 - DNA, 15 bp, Homo sapiens
agaagacaaactgct

SEQ ID NO: 594971 - DNA, 24 bp, Homo sapiens
agaagagcgagagatcaaagatga

SEQ ID NO: 594972 - DNA, 21 bp, Homo sapiens
agaagagggaaaacagaaaac

SEQ ID NO: 594973 - DNA, 21 bp, Homo sapiens
agaagcaataataaagtactt

SEQ ID NO: 594974 - DNA, 10 bp, Homo sapiens
agaagcctgc

SEQ ID NO: 594975 - DNA, 19 bp, Homo sapiens
agaagctctgaagaactct

SEQ ID NO: 594976 - DNA, 14 bp, Homo sapiens
agaaggtgaacttt

SEQ ID NO: 594977 - DNA, 15 bp, Homo sapiens
agaaggttgagggca

SEQ ID NO: 594978 - DNA, 20 bp, Homo sapiens
agaagtaagaggctacctct

SEQ ID NO: 594979 - DNA, 18 bp, Homo sapiens
agaagtgagcaaaaaaga

SEQ ID NO: 594980 - DNA, 17 bp, Homo sapiens
agaataccacatcaaat

SEQ ID NO: 594981 - DNA, 16 bp, Homo sapiens
agaatgaaagctgttc

SEQ ID NO: 594982 - DNA, 21 bp, Homo sapiens
agaatgaaagctgttccttgg

SEQ ID NO: 594983 - DNA, 22 bp, Homo sapiens
agaatgagtccttgatttcaaa

SEQ ID NO: 594984 - DNA, 18 bp, Homo sapiens
agaattctgattgatttg

SEQ ID NO: 594985 - DNA, 23 bp, Homo sapiens
agaattctgattgatttgattgg

SEQ ID NO: 594986 - DNA, 18 bp, Homo sapiens
agacactgatctggctgc

SEQ ID NO: 594987 - DNA, 12 bp, Homo sapiens
agaccacctcca

SEQ ID NO: 594988 - DNA, 13 bp, Homo sapiens
agacccctgtctt

SEQ ID NO: 594989 - DNA, 23 bp, Homo sapiens
agacccggttattcgcccacccg

SEQ ID NO: 594990 - DNA, 21 bp, Homo sapiens
agacccttattgctgtcctgg

SEQ ID NO: 594991 - DNA, 22 bp, Homo sapiens
agacccttattgctgtcctgga

SEQ ID NO: 594992 - DNA, 16 bp, Homo sapiens
agacgtttataaacag

SEQ ID NO: 594993 - DNA, 21 bp, Homo sapiens
agactgaatagatatgaaagc

SEQ ID NO: 594994 - DNA, 21 bp, Homo sapiens
agactgggtgaggataacaca

SEQ ID NO: 594995 - DNA, 17 bp, Homo sapiens
agactgtagatatgtat

SEQ ID NO: 594996 - DNA, 15 bp, Homo sapiens
agacttgaggggcta

SEQ ID NO: 594997 - DNA, 15 bp, Homo sapiens
agagacagcccagga

SEQ ID NO: 594998 - DNA, 18 bp, Homo sapiens
agagagtggagagagcag

SEQ ID NO: 594999 - DNA, 22 bp, Homo sapiens
agagagttctggatgtctggct

SEQ ID NO: 595000 - DNA, 15 bp, Homo sapiens
agagatcaaagatga

SEQ ID NO: 595001 - DNA, 13 bp, Homo sapiens
agagatttctcat

SEQ ID NO: 595002 - DNA, 22 bp, Homo sapiens
agagccctgaggcctagactct

SEQ ID NO: 595003 - DNA, 19 bp, Homo sapiens
agagcgagagatcaaagat

SEQ ID NO: 595004 - DNA, 22 bp, Homo sapiens
agagctgctgcacacactcacc

SEQ ID NO: 595005 - DNA, 21 bp, Homo sapiens
agagcttgtggtggggcagga

SEQ ID NO: 595006 - DNA, 18 bp, Homo sapiens
agaggagataaggtggct

SEQ ID NO: 595007 - DNA, 21 bp, Homo sapiens
agaggagataaggtggcttct

SEQ ID NO: 595008 - DNA, 22 bp, Homo sapiens
agaggagataaggtggcttctc

SEQ ID NO: 595009 - DNA, 14 bp, Homo sapiens
agaggcttgtttac

SEQ ID NO: 595010 - DNA, 17 bp, Homo sapiens
agaggtattaaaactaa

SEQ ID NO: 595011 - DNA, 22 bp, Homo sapiens
agagtgaagggaagagacagcc

SEQ ID NO: 595012 - DNA, 21 bp, Homo sapiens
agagtggagagagcagggcta

SEQ ID NO: 595013 - DNA, 13 bp, Homo sapiens
agagtgggctttg

SEQ ID NO: 595014 - DNA, 20 bp, Homo sapiens
agagttcccttgaaactttg

SEQ ID NO: 595015 - DNA, 18 bp, Homo sapiens
agagttctggatgtctgg

SEQ ID NO: 595016 - DNA, 20 bp, Homo sapiens
agagttctggatgtctggct

SEQ ID NO: 595017 - DNA, 13 bp, Homo sapiens
agagtttgtcatt

SEQ ID NO: 595018 - DNA, 16 bp, Homo sapiens
agataaagaataataa

SEQ ID NO: 595019 - DNA, 18 bp, Homo sapiens
agataaggtggcttctca

SEQ ID NO: 595020 - DNA, 14 bp, Homo sapiens
agatcgcatttcct

SEQ ID NO: 595021 - DNA, 15 bp, Homo sapiens
agatcgcatttccta

SEQ ID NO: 595022 - DNA, 20 bp, Homo sapiens
agatctttcagaaatataac

SEQ ID NO: 595023 - DNA, 13 bp, Homo sapiens
agatgaaacatca

SEQ ID NO: 595024 - DNA, 18 bp, Homo sapiens
agatgaaacatcatttca

SEQ ID NO: 595025 - DNA, 17 bp, Homo sapiens
agatgagggctggctgc

SEQ ID NO: 595026 - DNA, 17 bp, Homo sapiens
agatgatgctttggaag

SEQ ID NO: 595027 - DNA, 18 bp, Homo sapiens
agatgcgtttgcctcctg

SEQ ID NO: 595028 - DNA, 15 bp, Homo sapiens
agatgtttatttcag

SEQ ID NO: 595029 - DNA, 18 bp, Homo sapiens
agattcccaccttccata

SEQ ID NO: 595030 - DNA, 12 bp, Homo sapiens
agattgaacttt

SEQ ID NO: 595031 - DNA, 18 bp, Homo sapiens
agattggccaattaaaaa

SEQ ID NO: 595032 - DNA, 21 bp, Homo sapiens
agattggccaattaaaaacga

SEQ ID NO: 595033 - DNA, 17 bp, Homo sapiens
agattgtattaactatc

SEQ ID NO: 595034 - DNA, 14 bp, Homo sapiens
agcaaaaaagagtt

SEQ ID NO: 595035 - DNA, 19 bp, Homo sapiens
agcaaaaagactggatttg

SEQ ID NO: 595036 - DNA, 16 bp, Homo sapiens
agcaaacagaaaaaga

SEQ ID NO: 595037 - DNA, 13 bp, Homo sapiens
agcaaattccaga

SEQ ID NO: 595038 - DNA, 14 bp, Homo sapiens
agcaaattccagat

SEQ ID NO: 595039 - DNA, 17 bp, Homo sapiens
agcaaattccagatttg

SEQ ID NO: 595040 - DNA, 22 bp, Homo sapiens
agcaattgcgaccttaatttaa

SEQ ID NO: 595041 - DNA, 14 bp, Homo sapiens
agcactcaagaccc

SEQ ID NO: 595042 - DNA, 20 bp, Homo sapiens
agcactcctgcttaatcttc

SEQ ID NO: 595043 - DNA, 15 bp, Homo sapiens
agcactgtaaacttc

SEQ ID NO: 595044 - DNA, 15 bp, Homo sapiens
agcagccccaggaga

SEQ ID NO: 595045 - DNA, 18 bp, Homo sapiens
atgcagagcttgtggtgg

SEQ ID NO: 595046 - DNA, 20 bp, Homo sapiens
atgcagttagctgaagaatt

SEQ ID NO: 595047 - DNA, 14 bp, Homo sapiens
atgcatacaagttt

SEQ ID NO: 595048 - DNA, 13 bp, Homo sapiens
atgcatgcaaatg

SEQ ID NO: 595049 - DNA, 16 bp, Homo sapiens
atgcatgcaaatgagc

SEQ ID NO: 595050 - DNA, 14 bp, Homo sapiens
atgcatttaataaa

SEQ ID NO: 595051 - DNA, 15 bp, Homo sapiens
atgcatttaataaag

SEQ ID NO: 595052 - DNA, 16 bp, Homo sapiens
atgcatttaataaaga

SEQ ID NO: 595053 - DNA, 21 bp, Homo sapiens
atgcatttaataaagatgagt

SEQ ID NO: 595054 - DNA, 21 bp, Homo sapiens
atgcctcagtagcatctcagt

SEQ ID NO: 595055 - DNA, 11 bp, Homo sapiens
atgcctccctg

SEQ ID NO: 595056 - DNA, 22 bp, Homo sapiens
atgcctccctgggccacctcct

SEQ ID NO: 595057 - DNA, 16 bp, Homo sapiens
atgcgtttgcctcctg

SEQ ID NO: 595058 - DNA, 17 bp, Homo sapiens
atgctaaatgtgtaata

SEQ ID NO: 595059 - DNA, 17 bp, Homo sapiens
atgctacaattttaaga

SEQ ID NO: 595060 - DNA, 20 bp, Homo sapiens
atgctcccacctgaatttgt

SEQ ID NO: 595061 - DNA, 22 bp, Homo sapiens
atgctcccacctgaatttgtat

SEQ ID NO: 595062 - DNA, 22 bp, Homo sapiens
atgctttattaatgttttcaaa

SEQ ID NO: 595063 - DNA, 23 bp, Homo sapiens
atggaaagcagagttttcattaa

SEQ ID NO: 595064 - DNA, 20 bp, Homo sapiens
atggactaaatgatctctga

SEQ ID NO: 595065 - DNA, 13 bp, Homo sapiens
atggagacagcag

SEQ ID NO: 595066 - DNA, 16 bp, Homo sapiens
atggatttttctttaa

SEQ ID NO: 595067 - DNA, 12 bp, Homo sapiens
atgggaaacaaa

SEQ ID NO: 595068 - DNA, 22 bp, Homo sapiens
atgggcttttggggagccagaa

SEQ ID NO: 595069 - DNA, 19 bp, Homo sapiens
atggggaggttgtggggcc

SEQ ID NO: 595070 - DNA, 13 bp, Homo sapiens
atggggccaggaa

SEQ ID NO: 595071 - DNA, 15 bp, Homo sapiens
atggggccaggaaag

SEQ ID NO: 595072 - DNA, 19 bp, Homo sapiens
atgggggagattgaacttt

SEQ ID NO: 595073 - DNA, 14 bp, Homo sapiens
atggtaatagcttt

SEQ ID NO: 595074 - DNA, 19 bp, Homo sapiens
atggtcctatttttgtgaa

SEQ ID NO: 595075 - DNA, 21 bp, Homo sapiens
atggtcctatttttgtgaaga

SEQ ID NO: 595076 - DNA, 19 bp, Homo sapiens
atggtgtggtgaatgtgtg

SEQ ID NO: 595077 - DNA, 13 bp, Homo sapiens
atgtaatttaaat

SEQ ID NO: 595078 - DNA, 17 bp, Homo sapiens
atgtaatttaaatgaaa

SEQ ID NO: 595079 - DNA, 14 bp, Homo sapiens
atgtacaaaaatta

SEQ ID NO: 595080 - DNA, 18 bp, Homo sapiens
atgtacaaaaattatgca

SEQ ID NO: 595081 - DNA, 16 bp, Homo sapiens
atgtacagattctttc

SEQ ID NO: 595082 - DNA, 18 bp, Homo sapiens
atgtagaggcttgtttac

SEQ ID NO: 595083 - DNA, 19 bp, Homo sapiens
atgtaggtaagactgtaga

SEQ ID NO: 595084 - DNA, 13 bp, Homo sapiens
atgtatatatgta

SEQ ID NO: 595085 - DNA, 14 bp, Homo sapiens
atgtatatatgtat

SEQ ID NO: 595086 - DNA, 21 bp, Homo sapiens
atgtatttctatatagacttg

SEQ ID NO: 595087 - DNA, 20 bp, Homo sapiens
atgtcagctgctgttgaact

SEQ ID NO: 595088 - DNA, 22 bp, Homo sapiens
atgtcagctgctgttgaacttt

SEQ ID NO: 595089 - DNA, 16 bp, Homo sapiens
atgtcattaaacatga

SEQ ID NO: 595090 - DNA, 17 bp, Homo sapiens
atgtccttaaaatgtgg

SEQ ID NO: 595091 - DNA, 20 bp, Homo sapiens
atgtctcctttgctcttgcc

SEQ ID NO: 595092 - DNA, 20 bp, Homo sapiens
atgtctggcagatgagggct

SEQ ID NO: 595093 - DNA, 15 bp, Homo sapiens
atgtgagctcttcct

SEQ ID NO: 595094 - DNA, 15 bp, Homo sapiens
atgtgatacattttt

SEQ ID NO: 595095 - DNA, 16 bp, Homo sapiens
atgtgctatacacaca

SEQ ID NO: 595096 - DNA, 19 bp, Homo sapiens
atgtgctatacacacacac

SEQ ID NO: 595097 - DNA, 17 bp, Homo sapiens
atgtgtaataatgtaac

SEQ ID NO: 595098 - DNA, 21 bp, Homo sapiens
atgtgtaataatgtaacatga

SEQ ID NO: 595099 - DNA, 18 bp, Homo sapiens
atgttaaagagaatgagt

SEQ ID NO: 595100 - DNA, 17 bp, Homo sapiens
atgttcccaaaacaatg

SEQ ID NO: 595101 - DNA, 21 bp, Homo sapiens
atgtttcttttgtttggtaaa

SEQ ID NO: 595102 - DNA, 23 bp, Homo sapiens
atgtttttgttttaaaacgtgta

SEQ ID NO: 595103 - DNA, 14 bp, Homo sapiens
attaaaaaacaatt

SEQ ID NO: 595104 - DNA, 20 bp, Homo sapiens
attaaaaaacaattaactgc

SEQ ID NO: 595105 - DNA, 22 bp, Homo sapiens
attaaccaaccttgtttaatag

SEQ ID NO: 595106 - DNA, 14 bp, Homo sapiens
attaagcaaatgtt

SEQ ID NO: 595107 - DNA, 15 bp, Homo sapiens
attaaggggaagaat

SEQ ID NO: 595108 - DNA, 18 bp, Homo sapiens
attaaggggaagaatgaa

SEQ ID NO: 595109 - DNA, 13 bp, Homo sapiens
attacccaatgga

SEQ ID NO: 595110 - DNA, 19 bp, Homo sapiens
attacctgtggatatttgt

SEQ ID NO: 595111 - DNA, 19 bp, Homo sapiens
attaccttctattggtctc

SEQ ID NO: 595112 - DNA, 22 bp, Homo sapiens
attacgaatgcccctgttcatg

SEQ ID NO: 595113 - DNA, 13 bp, Homo sapiens
attactgacattt

SEQ ID NO: 595114 - DNA, 16 bp, Homo sapiens
attactgacatttctt

SEQ ID NO: 595115 - DNA, 21 bp, Homo sapiens
attactgacatttcttctagt

SEQ ID NO: 595116 - DNA, 16 bp, Homo sapiens
attagaaacaaacaaa

SEQ ID NO: 595117 - DNA, 21 bp, Homo sapiens
attagcggctcctcgccccca

SEQ ID NO: 595118 - DNA, 12 bp, Homo sapiens
attataactgta

SEQ ID NO: 595119 - DNA, 17 bp, Homo sapiens
attatgtaaataactct

SEQ ID NO: 595120 - DNA, 18 bp, Homo sapiens
attatttttataattgta

SEQ ID NO: 595121 - DNA, 21 bp, Homo sapiens
attatttttttaaaattttgt

SEQ ID NO: 595122 - DNA, 22 bp, Homo sapiens
attatttttttaaaattttgta

SEQ ID NO: 595123 - DNA, 23 bp, Homo sapiens
attcacttcagtttaatgtctcc

SEQ ID NO: 595124 - DNA, 13 bp, Homo sapiens
attcagaaatgtt

SEQ ID NO: 595125 - DNA, 18 bp, Homo sapiens
attcaggacttgaaagaa

SEQ ID NO: 595126 - DNA, 16 bp, Homo sapiens
attccagatctttcag

SEQ ID NO: 595127 - DNA, 23 bp, Homo sapiens
attcgcccacccgagtacctcca

SEQ ID NO: 595128 - DNA, 14 bp, Homo sapiens
attctataaaactc

SEQ ID NO: 595129 - DNA, 24 bp, Homo sapiens
attctataaaactctgcatgtaga

SEQ ID NO: 595130 - DNA, 16 bp, Homo sapiens
attctcccagtctctg

SEQ ID NO: 595131 - DNA, 21 bp, Homo sapiens
attctgattctggctttaagc

SEQ ID NO: 595132 - DNA, 18 bp, Homo sapiens
attctgcactcagaaaat

SEQ ID NO: 595133 - DNA, 13 bp, Homo sapiens
attctgcctgctc

SEQ ID NO: 595134 - DNA, 14 bp, Homo sapiens
attctggctttaag

SEQ ID NO: 595135 - DNA, 23 bp, Homo sapiens
attcttaaaaggcccatagcagc

SEQ ID NO: 595136 - DNA, 23 bp, Homo sapiens
attgaaaagtttttgtttggaga

SEQ ID NO: 595137 - DNA, 15 bp, Homo sapiens
attgagtattgttta

SEQ ID NO: 595138 - DNA, 20 bp, Homo sapiens
attgagtattgtttaaaatg

SEQ ID NO: 595139 - DNA, 13 bp, Homo sapiens
attgattgggaaa

SEQ ID NO: 595140 - DNA, 20 bp, Homo sapiens
attgattgggaaaacatttg

SEQ ID NO: 595141 - DNA, 22 bp, Homo sapiens
attgattgggaaaacatttgct

SEQ ID NO: 595142 - DNA, 21 bp, Homo sapiens
attgcatactttgtattttga

SEQ ID NO: 595143 - DNA, 19 bp, Homo sapiens
attgcatcactgtatcatt

SEQ ID NO: 595144 - DNA, 13 bp, Homo sapiens
attgcctctgaaa

SEQ ID NO: 595145 - DNA, 19 bp, Homo sapiens
attgcttattatgtaggta

SEQ ID NO: 595146 - DNA, 15 bp, Homo sapiens
attggttttcctgtg

SEQ ID NO: 595147 - DNA, 15 bp, Homo sapiens
attgtaaaaatggca

SEQ ID NO: 595148 - DNA, 20 bp, Homo sapiens
attgtaaaattatttcatga

SEQ ID NO: 595149 - DNA, 16 bp, Homo sapiens
attgtaattatgtaaa

SEQ ID NO: 595150 - DNA, 22 bp, Homo sapiens
attgtacaaaattaagcaaatg

SEQ ID NO: 595151 - DNA, 14 bp, Homo sapiens
attgtcacatctat

SEQ ID NO: 595152 - DNA, 19 bp, Homo sapiens
attgtgtggattctttaaa

SEQ ID NO: 595153 - DNA, 19 bp, Homo sapiens
attgttacgtagcctaagg

SEQ ID NO: 595154 - DNA, 21 bp, Homo sapiens
caggagtttaagaccagcctg

SEQ ID NO: 595155 - DNA, 18 bp, Homo sapiens
caggatactggcacagag

SEQ ID NO: 595156 - DNA, 14 bp, Homo sapiens
caggcaagaaagct

SEQ ID NO: 595157 - DNA, 20 bp, Homo sapiens
caggcaagaaagcttccttc

SEQ ID NO: 595158 - DNA, 13 bp, Homo sapiens
caggcaggaacaa

SEQ ID NO: 595159 - DNA, 21 bp, Homo sapiens
caggctccgggcaccaggggc

SEQ ID NO: 595160 - DNA, 20 bp, Homo sapiens
cagggcaaaagggcagctgt

SEQ ID NO: 595161 - DNA, 22 bp, Homo sapiens
cagggcaaaagggcagctgtga

SEQ ID NO: 595162 - DNA, 23 bp, Homo sapiens
cagggcaaaagggcagctgtgat

SEQ ID NO: 595163 - DNA, 13 bp, Homo sapiens
cagggccctggag

SEQ ID NO: 595164 - DNA, 14 bp, Homo sapiens
cagggccctggagc

SEQ ID NO: 595165 - DNA, 19 bp, Homo sapiens
cagggcctttctcctcccc

SEQ ID NO: 595166 - DNA, 22 bp, Homo sapiens
cagggcctttctcctccccacc

SEQ ID NO: 595167 - DNA, 23 bp, Homo sapiens
cagggcctttctcctccccacct

SEQ ID NO: 595168 - DNA, 16 bp, Homo sapiens
cagggctaaataaaga

SEQ ID NO: 595169 - DNA, 17 bp, Homo sapiens
cagggctaaataaagag

SEQ ID NO: 595170 - DNA, 18 bp, Homo sapiens
cagggctaaataaagagg

SEQ ID NO: 595171 - DNA, 19 bp, Homo sapiens
cagggctaaataaagagga

SEQ ID NO: 595172 - DNA, 19 bp, Homo sapiens
caggggccaacctcaggct

SEQ ID NO: 595173 - DNA, 23 bp, Homo sapiens
caggtaaaacagggccacataga

SEQ ID NO: 595174 - DNA, 19 bp, Homo sapiens
caggtgtttgtggggctgg

SEQ ID NO: 595175 - DNA, 15 bp, Homo sapiens
caggttataacagtg

SEQ ID NO: 595176 - DNA, 20 bp, Homo sapiens
cagtaacccccttaaattta

SEQ ID NO: 595177 - DNA, 22 bp, Homo sapiens
cagtactattcaggtaacacta

SEQ ID NO: 595178 - DNA, 16 bp, Homo sapiens
cagtagcatctcagtg

SEQ ID NO: 595179 - DNA, 12 bp, Homo sapiens
cagtatttcctt

SEQ ID NO: 595180 - DNA, 15 bp, Homo sapiens
cagtatttccttcca

SEQ ID NO: 595181 - DNA, 16 bp, Homo sapiens
cagtatttccttccac

SEQ ID NO: 595182 - DNA, 14 bp, Homo sapiens
cagtcctaacaaat

SEQ ID NO: 595183 - DNA, 17 bp, Homo sapiens
cagtggatcacaaagtg

SEQ ID NO: 595184 - DNA, 15 bp, Homo sapiens
cagtggtgtgtgaag

SEQ ID NO: 595185 - DNA, 18 bp, Homo sapiens
cagtggtgtgtgaagttt

SEQ ID NO: 595186 - DNA, 19 bp, Homo sapiens
cagtgtagcatcttcctct

SEQ ID NO: 595187 - DNA, 20 bp, Homo sapiens
cagtgtagcatcttcctctg

SEQ ID NO: 595188 - DNA, 13 bp, Homo sapiens
cagtgtctgtgtt

SEQ ID NO: 595189 - DNA, 22 bp, Homo sapiens
cagtgttccaagtctctgtgta

SEQ ID NO: 595190 - DNA, 17 bp, Homo sapiens
cagtgttgcctcttgca

SEQ ID NO: 595191 - DNA, 14 bp, Homo sapiens
cagttgcttgtctt

SEQ ID NO: 595192 - DNA, 13 bp, Homo sapiens
cagttttcggaaa

SEQ ID NO: 595193 - DNA, 16 bp, Homo sapiens
cagttttcggaaacac

SEQ ID NO: 595194 - DNA, 19 bp, Homo sapiens
cagttttcggaaacactga

SEQ ID NO: 595195 - DNA, 19 bp, Homo sapiens
cataaattcaactttgtaa

SEQ ID NO: 595196 - DNA, 16 bp, Homo sapiens
cataacttctcatgta

SEQ ID NO: 595197 - DNA, 19 bp, Homo sapiens
cataacttctcatgtatat

SEQ ID NO: 595198 - DNA, 21 bp, Homo sapiens
catacgcatcccatctctccc

SEQ ID NO: 595199 - DNA, 13 bp, Homo sapiens
catagacatgaaa

SEQ ID NO: 595200 - DNA, 22 bp, Homo sapiens
catagagaacaaagtaaaagta

SEQ ID NO: 595201 - DNA, 22 bp, Homo sapiens
catagataatattgtttggtaa

SEQ ID NO: 595202 - DNA, 23 bp, Homo sapiens
catagataatattgtttggtaaa

SEQ ID NO: 595203 - DNA, 20 bp, Homo sapiens
catagtgagacccctgtctc

SEQ ID NO: 595204 - DNA, 21 bp, Homo sapiens
catattgtaatctatgtttat

SEQ ID NO: 595205 - DNA, 21 bp, Homo sapiens
catcaatatgtatatatgtat

SEQ ID NO: 595206 - DNA, 21 bp, Homo sapiens
catcacagatcgcatttccta

SEQ ID NO: 595207 - DNA, 18 bp, Homo sapiens
catcagggcctttctcct

SEQ ID NO: 595208 - DNA, 20 bp, Homo sapiens
catcagggcctttctcctcc

SEQ ID NO: 595209 - DNA, 22 bp, Homo sapiens
catcagggcctttctcctcccc

SEQ ID NO: 595210 - DNA, 16 bp, Homo sapiens
catcagtgtgtaaata

SEQ ID NO: 595211 - DNA, 15 bp, Homo sapiens
catcatctcttcctc

SEQ ID NO: 595212 - DNA, 22 bp, Homo sapiens
catccatggccgggcttggtgg

SEQ ID NO: 595213 - DNA, 22 bp, Homo sapiens
catccatgtacttccctcttga

SEQ ID NO: 595214 - DNA, 23 bp, Homo sapiens
catccatgtacttccctcttgaa

SEQ ID NO: 595215 - DNA, 15 bp, Homo sapiens
catcccatctctccc

SEQ ID NO: 595216 - DNA, 15 bp, Homo sapiens
catcctaccgtcttt

SEQ ID NO: 595217 - DNA, 19 bp, Homo sapiens
catcctgatggacctgccc

SEQ ID NO: 595218 - DNA, 22 bp, Homo sapiens
catcgtattaaaaaacaattaa

SEQ ID NO: 595219 - DNA, 23 bp, Homo sapiens
catcgtattaaaaaacaattaac

SEQ ID NO: 595220 - DNA, 16 bp, Homo sapiens
catctaattctgattc

SEQ ID NO: 595221 - DNA, 13 bp, Homo sapiens
catctctcccact

SEQ ID NO: 595222 - DNA, 16 bp, Homo sapiens
catctctcccacttcc

SEQ ID NO: 595223 - DNA, 13 bp, Homo sapiens
catcttcctctgc

SEQ ID NO: 595224 - DNA, 20 bp, Homo sapiens
catgaaaaaccatttttgaa

SEQ ID NO: 595225 - DNA, 14 bp, Homo sapiens
catgacagcctcca

SEQ ID NO: 595226 - DNA, 20 bp, Homo sapiens
catgatccccgtctctgccc

SEQ ID NO: 595227 - DNA, 20 bp, Homo sapiens
catgcaaatgagctctgaaa

SEQ ID NO: 595228 - DNA, 14 bp, Homo sapiens
catgcaataaaatt

SEQ ID NO: 595229 - DNA, 18 bp, Homo sapiens
catgcaataaaatttaaa

SEQ ID NO: 595230 - DNA, 14 bp, Homo sapiens
catgcacagctgta

SEQ ID NO: 595231 - DNA, 23 bp, Homo sapiens
catgcctccctgggccacctcct

SEQ ID NO: 595232 - DNA, 14 bp, Homo sapiens
catgcctgatgaaa

SEQ ID NO: 595233 - DNA, 12 bp, Homo sapiens
catggagacagc

SEQ ID NO: 595234 - DNA, 14 bp, Homo sapiens
catggagacagcag

SEQ ID NO: 595235 - DNA, 15 bp, Homo sapiens
catggagacagcagt

SEQ ID NO: 595236 - DNA, 23 bp, Homo sapiens
catggatatgttatactgaacca

SEQ ID NO: 595237 - DNA, 18 bp, Homo sapiens
catggcaggacagctcct

SEQ ID NO: 595238 - DNA, 15 bp, Homo sapiens
catggctgctgttgc

SEQ ID NO: 595239 - DNA, 11 bp, Homo sapiens
catggggccag

SEQ ID NO: 595240 - DNA, 11 bp, Homo sapiens
catgtcctctc

SEQ ID NO: 595241 - DNA, 16 bp, Homo sapiens
catgtgatacattttt

SEQ ID NO: 595242 - DNA, 16 bp, Homo sapiens
catgttcccaaggccc

SEQ ID NO: 595243 - DNA, 16 bp, Homo sapiens
catgtttttgttttaa

SEQ ID NO: 595244 - DNA, 20 bp, Homo sapiens
catgtttttgttttaaaacg

SEQ ID NO: 595245 - DNA, 13 bp, Homo sapiens
cattaactgttgc

SEQ ID NO: 595246 - DNA, 13 bp, Homo sapiens
cattatttgtgct

SEQ ID NO: 595247 - DNA, 20 bp, Homo sapiens
cattcaaccacgcaggaagc

SEQ ID NO: 595248 - DNA, 16 bp, Homo sapiens
cattctgcctgctcca

SEQ ID NO: 595249 - DNA, 18 bp, Homo sapiens
cattgacttttataaagc

SEQ ID NO: 595250 - DNA, 16 bp, Homo sapiens
cattgagtattgttta

SEQ ID NO: 595251 - DNA, 22 bp, Homo sapiens
cattgagtattgtttaaaatgt

SEQ ID NO: 595252 - DNA, 11 bp, Homo sapiens
cattggatatt

SEQ ID NO: 595253 - DNA, 19 bp, Homo sapiens
cattgtaattatgtaaata

SEQ ID NO: 595254 - DNA, 22 bp, Homo sapiens
cattgtaattatgtaaataact

SEQ ID NO: 595255 - DNA, 23 bp, Homo sapiens
cattgtaattatgtaaataactc

SEQ ID NO: 595256 - DNA, 12 bp, Homo sapiens
catttaataaag

SEQ ID NO: 595257 - DNA, 19 bp, Homo sapiens
catttaataaagatgagtt

SEQ ID NO: 595258 - DNA, 14 bp, Homo sapiens
catttagtaagaat

SEQ ID NO: 595259 - DNA, 17 bp, Homo sapiens
catttatattaaataac

SEQ ID NO: 595260 - DNA, 17 bp, Homo sapiens
catttcaatcgtaaaat

SEQ ID NO: 595261 - DNA, 20 bp, Homo sapiens
catttgactgttcaatgatt

SEQ ID NO: 595262 - DNA, 23 bp, Homo sapiens
catttgactgttcaatgattatt

SEQ ID NO: 595263 - DNA, 17 bp, Homo sapiens
ctcaaatacacatttgc

SEQ ID NO: 595264 - DNA, 18 bp, Homo sapiens
ctcaaatacacatttgct

SEQ ID NO: 595265 - DNA, 22 bp, Homo sapiens
ctcaatgcagttagctgaagaa

SEQ ID NO: 595266 - DNA, 20 bp, Homo sapiens
ctcacctgcactaacagagt

SEQ ID NO: 595267 - DNA, 18 bp, Homo sapiens
ctcactgcttgaactagg

SEQ ID NO: 595268 - DNA, 13 bp, Homo sapiens
ctcagactgggca

SEQ ID NO: 595269 - DNA, 20 bp, Homo sapiens
ctcagcctgctttcctgcag

SEQ ID NO: 595270 - DNA, 21 bp, Homo sapiens
ctcagcctgctttcctgcagc

SEQ ID NO: 595271 - DNA, 10 bp, Homo sapiens
ctcaggctcc

SEQ ID NO: 595272 - DNA, 13 bp, Homo sapiens
ctcagttctcaaa

SEQ ID NO: 595273 - DNA, 15 bp, Homo sapiens
ctcagtttcttgctt

SEQ ID NO: 595274 - DNA, 23 bp, Homo sapiens
ctcatgtatattacccaatggaa

SEQ ID NO: 595275 - DNA, 12 bp, Homo sapiens
ctcattgacttt

SEQ ID NO: 595276 - DNA, 16 bp, Homo sapiens
ctccaatgactgagca

SEQ ID NO: 595277 - DNA, 15 bp, Homo sapiens
ctccactcttctctc

SEQ ID NO: 595278 - DNA, 20 bp, Homo sapiens
ctccactcttctctcctttc

SEQ ID NO: 595279 - DNA, 14 bp, Homo sapiens
ctccaggcaggact

SEQ ID NO: 595280 - DNA, 16 bp, Homo sapiens
ctccagtcacactccc

SEQ ID NO: 595281 - DNA, 22 bp, Homo sapiens
ctccatcgcgccagcgacctct

SEQ ID NO: 595282 - DNA, 21 bp, Homo sapiens
ctccattctgcactcagaaaa

SEQ ID NO: 595283 - DNA, 18 bp, Homo sapiens
ctcccacagcagccccag

SEQ ID NO: 595284 - DNA, 16 bp, Homo sapiens
ctcccacttcctccta

SEQ ID NO: 595285 - DNA, 18 bp, Homo sapiens
ctcccacttcctcctacc

SEQ ID NO: 595286 - DNA, 15 bp, Homo sapiens
ctcccagtctctgtc

SEQ ID NO: 595287 - DNA, 17 bp, Homo sapiens
ctcccccaaacagactc

SEQ ID NO: 595288 - DNA, 17 bp, Homo sapiens
ctcccctcgctgctggg

SEQ ID NO: 595289 - DNA, 12 bp, Homo sapiens
ctccctgcagcc

SEQ ID NO: 595290 - DNA, 15 bp, Homo sapiens
ctccctgcagccttt

SEQ ID NO: 595291 - DNA, 14 bp, Homo sapiens
ctccctgggccacc

SEQ ID NO: 595292 - DNA, 18 bp, Homo sapiens
ctccctgggccacctcct

SEQ ID NO: 595293 - DNA, 21 bp, Homo sapiens
ctcccttctctacactcttgt

SEQ ID NO: 595294 - DNA, 21 bp, Homo sapiens
ctccgcgggagaccccttgtt

SEQ ID NO: 595295 - DNA, 16 bp, Homo sapiens
ctccgggtcctcctaa

SEQ ID NO: 595296 - DNA, 22 bp, Homo sapiens
ctcctacctggggactcctcaa

SEQ ID NO: 595297 - DNA, 15 bp, Homo sapiens
ctcctattctataaa

SEQ ID NO: 595298 - DNA, 15 bp, Homo sapiens
ctcctcaaaccactt

SEQ ID NO: 595299 - DNA, 20 bp, Homo sapiens
ctcctcaaaccacttgcctg

SEQ ID NO: 595300 - DNA, 14 bp, Homo sapiens
ctcctcagtttctc

SEQ ID NO: 595301 - DNA, 20 bp, Homo sapiens
ctcctcatcagtgtgtaaat

SEQ ID NO: 595302 - DNA, 13 bp, Homo sapiens
ctcctccccacct

SEQ ID NO: 595303 - DNA, 15 bp, Homo sapiens
ctcctccccacctgt

SEQ ID NO: 595304 - DNA, 16 bp, Homo sapiens
ctcctccccacctgta

SEQ ID NO: 595305 - DNA, 17 bp, Homo sapiens
ctcctccccacctgtag

SEQ ID NO: 595306 - DNA, 13 bp, Homo sapiens
ctcctcgccccca

SEQ ID NO: 595307 - DNA, 14 bp, Homo sapiens
ctcctcgcccccac

SEQ ID NO: 595308 - DNA, 17 bp, Homo sapiens
ctcctcgcccccaccag

SEQ ID NO: 595309 - DNA, 15 bp, Homo sapiens
ctcctcttagctcag

SEQ ID NO: 595310 - DNA, 22 bp, Homo sapiens
ctcctgatggtgtcattctgcc

SEQ ID NO: 595311 - DNA, 23 bp, Homo sapiens
ctcctgccatgggtgcagaccct

SEQ ID NO: 595312 - DNA, 17 bp, Homo sapiens
ctcctggaccaggccca

SEQ ID NO: 595313 - DNA, 22 bp, Homo sapiens
ctcctgttccatttcagttcag

SEQ ID NO: 595314 - DNA, 23 bp, Homo sapiens
ctccttaagctgcagagatttct

SEQ ID NO: 595315 - DNA, 19 bp, Homo sapiens
ctccttcatgacagcctcc

SEQ ID NO: 595316 - DNA, 18 bp, Homo sapiens
ctccttctcctgttccat

SEQ ID NO: 595317 - DNA, 19 bp, Homo sapiens
ctccttgagtgtatgagta

SEQ ID NO: 595318 - DNA, 14 bp, Homo sapiens
ctcctttctccctg

SEQ ID NO: 595319 - DNA, 15 bp, Homo sapiens
ctcctttctccctgc

SEQ ID NO: 595320 - DNA, 16 bp, Homo sapiens
ctcctttgctcttgcc

SEQ ID NO: 595321 - DNA, 22 bp, Homo sapiens
ctcgagaccataaagatattct

SEQ ID NO: 595322 - DNA, 17 bp, Homo sapiens
ctcgcccccaccagtgt

SEQ ID NO: 595323 - DNA, 21 bp, Homo sapiens
ctctaaccaaggctgtgttta

SEQ ID NO: 595324 - DNA, 20 bp, Homo sapiens
ctctagggcctcagtctgga

SEQ ID NO: 595325 - DNA, 23 bp, Homo sapiens
ctctaggtacgatgacagtgttc

SEQ ID NO: 595326 - DNA, 17 bp, Homo sapiens
ctctagtgcggtttact

SEQ ID NO: 595327 - DNA, 15 bp, Homo sapiens
ctctccactcttctc

SEQ ID NO: 595328 - DNA, 19 bp, Homo sapiens
ctctcccacttcctcctac

SEQ ID NO: 595329 - DNA, 22 bp, Homo sapiens
ctctcctaactgccagccccct

SEQ ID NO: 595330 - DNA, 17 bp, Homo sapiens
ctctcctcgagccctcc

SEQ ID NO: 595331 - DNA, 15 bp, Homo sapiens
ctctctgcctctctt

SEQ ID NO: 595332 - DNA, 15 bp, Homo sapiens
ctctgaaatcttccc

SEQ ID NO: 595333 - DNA, 20 bp, Homo sapiens
ctctgctatttctcttgctg

SEQ ID NO: 595334 - DNA, 22 bp, Homo sapiens
ctctgctatttctcttgctgga

SEQ ID NO: 595335 - DNA, 20 bp, Homo sapiens
ctctggatcccgttcagaaa

SEQ ID NO: 595336 - DNA, 20 bp, Homo sapiens
ctctgtctacctggtctggt

SEQ ID NO: 595337 - DNA, 17 bp, Homo sapiens
ctctgtgagggtgctga

SEQ ID NO: 595338 - DNA, 13 bp, Homo sapiens
ctctgtgtaacca

SEQ ID NO: 595339 - DNA, 22 bp, Homo sapiens
ctctgtgtaaccagctcagtgt

SEQ ID NO: 595340 - DNA, 21 bp, Homo sapiens
ctcttaagtcctaaaagttct

SEQ ID NO: 595341 - DNA, 22 bp, Homo sapiens
ctcttagctcagctgagcatgg

SEQ ID NO: 595342 - DNA, 12 bp, Homo sapiens
ctcttctctcct

SEQ ID NO: 595343 - DNA, 14 bp, Homo sapiens
ctcttgaaacctga

SEQ ID NO: 595344 - DNA, 16 bp, Homo sapiens
ctcttgaaacctgatg

SEQ ID NO: 595345 - DNA, 12 bp, Homo sapiens
ctcttgcaatgc

SEQ ID NO: 595346 - DNA, 22 bp, Homo sapiens
ctgaaaagtgtgtatatatttt

SEQ ID NO: 595347 - DNA, 15 bp, Homo sapiens
ctgaaagatgcatca

SEQ ID NO: 595348 - DNA, 21 bp, Homo sapiens
ctgaaatcttcccatgcattc

SEQ ID NO: 595349 - DNA, 23 bp, Homo sapiens
ctgaaatcttcccatgcattctg

SEQ ID NO: 595350 - DNA, 13 bp, Homo sapiens
ctgaagaattgaa

SEQ ID NO: 595351 - DNA, 15 bp, Homo sapiens
ctgaatagatatgaa

SEQ ID NO: 595352 - DNA, 19 bp, Homo sapiens
ctgaatagtcttcagagat

SEQ ID NO: 595353 - DNA, 15 bp, Homo sapiens
ctgaatctgctacca

SEQ ID NO: 595354 - DNA, 22 bp, Homo sapiens
ctgaatctgctaccaaaacagt

SEQ ID NO: 595355 - DNA, 17 bp, Homo sapiens
ctgaattatctatttca

SEQ ID NO: 595356 - DNA, 18 bp, Homo sapiens
ctgacatttcttctagtg

SEQ ID NO: 595357 - DNA, 21 bp, Homo sapiens
ctgactcagtgaccagtgcct

SEQ ID NO: 595358 - DNA, 20 bp, Homo sapiens
ctgagaaacactatttgtga

SEQ ID NO: 595359 - DNA, 22 bp, Homo sapiens
ctgagcagcatccaccccaccc

SEQ ID NO: 595360 - DNA, 18 bp, Homo sapiens
ctgagccctcctgagggc

SEQ ID NO: 595361 - DNA, 14 bp, Homo sapiens
ctgaggtgggcaga

SEQ ID NO: 595362 - DNA, 17 bp, Homo sapiens
ctgagttcaagggctgt

SEQ ID NO: 595363 - DNA, 15 bp, Homo sapiens
ctgatgctggggaca

SEQ ID NO: 595364 - DNA, 20 bp, Homo sapiens
ctgatgggtgccctttcctg

SEQ ID NO: 595365 - DNA, 22 bp, Homo sapiens
ctgatggtgtcattctgcctgc

SEQ ID NO: 595366 - DNA, 23 bp, Homo sapiens
ctgatgtcagctgctgttgaact

SEQ ID NO: 595367 - DNA, 14 bp, Homo sapiens
ctgattctggcttt

SEQ ID NO: 595368 - DNA, 19 bp, Homo sapiens
ctgattctggctttaagcc

SEQ ID NO: 595369 - DNA, 16 bp, Homo sapiens
ctgcaaaaattatata

SEQ ID NO: 595370 - DNA, 19 bp, Homo sapiens
ctgcaaaaattatatattg

SEQ ID NO: 595371 - DNA, 17 bp, Homo sapiens
ctgcaaaactccaggca

SEQ ID NO: 595372 - DNA, 18 bp, Homo sapiens
gaagtgtgtgccaagagc

SEQ ID NO: 595373 - DNA, 22 bp, Homo sapiens
gaataccacatcaaataagaaa

SEQ ID NO: 595374 - DNA, 13 bp, Homo sapiens
gaatacctgctca

SEQ ID NO: 595375 - DNA, 21 bp, Homo sapiens
gaatactgccaaaacatttat

SEQ ID NO: 595376 - DNA, 16 bp, Homo sapiens
gaatagatatgaaagc

SEQ ID NO: 595377 - DNA, 15 bp, Homo sapiens
gaatcagacagcagg

SEQ ID NO: 595378 - DNA, 23 bp, Homo sapiens
gaatcagtatttccttccactgt

SEQ ID NO: 595379 - DNA, 23 bp, Homo sapiens
gaatgaggaaaattcttaaaagg

SEQ ID NO: 595380 - DNA, 15 bp, Homo sapiens
gaattctgattgatt

SEQ ID NO: 595381 - DNA, 14 bp, Homo sapiens
gaattgaaaagttt

SEQ ID NO: 595382 - DNA, 22 bp, Homo sapiens
gaattgaaaagtttttgtttgg

SEQ ID NO: 595383 - DNA, 15 bp, Homo sapiens
gaatttaatatatat

SEQ ID NO: 595384 - DNA, 20 bp, Homo sapiens
gacaacaggtaaaacagggc

SEQ ID NO: 595385 - DNA, 15 bp, Homo sapiens
gacacagaacacaga

SEQ ID NO: 595386 - DNA, 18 bp, Homo sapiens
gacacagcatcagctcaa

SEQ ID NO: 595387 - DNA, 13 bp, Homo sapiens
gacacagttcctg

SEQ ID NO: 595388 - DNA, 23 bp, Homo sapiens
gacagaacttcagcattgtaatt

SEQ ID NO: 595389 - DNA, 23 bp, Homo sapiens
gacagcccaggatactggcacag

SEQ ID NO: 595390 - DNA, 12 bp, Homo sapiens
gacagtttttga

SEQ ID NO: 595391 - DNA, 15 bp, Homo sapiens
gacagtttttgacat

SEQ ID NO: 595392 - DNA, 14 bp, Homo sapiens
gacataagataaaa

SEQ ID NO: 595393 - DNA, 20 bp, Homo sapiens
gacatgcaataaaatttaaa

SEQ ID NO: 595394 - DNA, 15 bp, Homo sapiens
gacatttatattaaa

SEQ ID NO: 595395 - DNA, 18 bp, Homo sapiens
gacatttatattaaataa

SEQ ID NO: 595396 - DNA, 11 bp, Homo sapiens
gaccagcctgg

SEQ ID NO: 595397 - DNA, 12 bp, Homo sapiens
gaccagtgcctg

SEQ ID NO: 595398 - DNA, 20 bp, Homo sapiens
gaccccaatatatgtatttt

SEQ ID NO: 595399 - DNA, 18 bp, Homo sapiens
gacccggttattcgccca

SEQ ID NO: 595400 - DNA, 20 bp, Homo sapiens
gaccctatgggtctaggaca

SEQ ID NO: 595401 - DNA, 20 bp, Homo sapiens
gaccctgaacccacacctgg

SEQ ID NO: 595402 - DNA, 21 bp, Homo sapiens
gacccttctgggtccagggag

SEQ ID NO: 595403 - DNA, 15 bp, Homo sapiens
gacctacctccctcc

SEQ ID NO: 595404 - DNA, 19 bp, Homo sapiens
gacgtcaccctccattctg

SEQ ID NO: 595405 - DNA, 16 bp, Homo sapiens
gactaactcaaataca

SEQ ID NO: 595406 - DNA, 22 bp, Homo sapiens
gactaggttctgtagagccaat

SEQ ID NO: 595407 - DNA, 19 bp, Homo sapiens
gactatatatataaatgta

SEQ ID NO: 595408 - DNA, 20 bp, Homo sapiens
gactatatatataaatgtat

SEQ ID NO: 595409 - DNA, 19 bp, Homo sapiens
gactcctcaaaccacttgc

SEQ ID NO: 595410 - DNA, 12 bp, Homo sapiens
gactcgccccca

SEQ ID NO: 595411 - DNA, 19 bp, Homo sapiens
gactctgtctacctggtct

SEQ ID NO: 595412 - DNA, 14 bp, Homo sapiens
gactgatttcagag

SEQ ID NO: 595413 - DNA, 17 bp, Homo sapiens
gactgcatttgtgtgtg

SEQ ID NO: 595414 - DNA, 21 bp, Homo sapiens
gacttggtggcttttccttga

SEQ ID NO: 595415 - DNA, 22 bp, Homo sapiens
gagaaagcacaatttaaaacaa

SEQ ID NO: 595416 - DNA, 16 bp, Homo sapiens
gagaacccagtttccc

SEQ ID NO: 595417 - DNA, 19 bp, Homo sapiens
gagaacctgtgggctgact

SEQ ID NO: 595418 - DNA, 21 bp, Homo sapiens
gagaagagggaaaacagaaaa

SEQ ID NO: 595419 - DNA, 13 bp, Homo sapiens
gagaagctctgaa

SEQ ID NO: 595420 - DNA, 20 bp, Homo sapiens
gagaaggggctttgtgacca

SEQ ID NO: 595421 - DNA, 22 bp, Homo sapiens
gagaatactgccaaaacattta

SEQ ID NO: 595422 - DNA, 16 bp, Homo sapiens
gagacagcagtttcca

SEQ ID NO: 595423 - DNA, 22 bp, Homo sapiens
gagaccccttgttgcactgccc

SEQ ID NO: 595424 - DNA, 20 bp, Homo sapiens
gagacgtttataaacagaaa

SEQ ID NO: 595425 - DNA, 23 bp, Homo sapiens
gagacgtttataaacagaaatgg

SEQ ID NO: 595426 - DNA, 21 bp, Homo sapiens
gagagagttgttttaataact

SEQ ID NO: 595427 - DNA, 18 bp, Homo sapiens
gagagtggagagagcagg

SEQ ID NO: 595428 - DNA, 18 bp, Homo sapiens
gagataaggtggcttctc

SEQ ID NO: 595429 - DNA, 20 bp, Homo sapiens
gagatcaaagatgaaaagta

SEQ ID NO: 595430 - DNA, 14 bp, Homo sapiens
gagcaaacagaaaa

SEQ ID NO: 595431 - DNA, 14 bp, Homo sapiens
gagcatagagaaca

SEQ ID NO: 595432 - DNA, 18 bp, Homo sapiens
gagcatggagacagcagt

SEQ ID NO: 595433 - DNA, 15 bp, Homo sapiens
gagcatggggccagg

SEQ ID NO: 595434 - DNA, 16 bp, Homo sapiens
gagccaattagacttg

SEQ ID NO: 595435 - DNA, 15 bp, Homo sapiens
gagccatgcctccct

SEQ ID NO: 595436 - DNA, 21 bp, Homo sapiens
gaggcagcctagcctatgtct

SEQ ID NO: 595437 - DNA, 19 bp, Homo sapiens
gaggcttgtttacctttct

SEQ ID NO: 595438 - DNA, 20 bp, Homo sapiens
gagggccggttctaaggctc

SEQ ID NO: 595439 - DNA, 20 bp, Homo sapiens
gagggtggttcaacaaagaa

SEQ ID NO: 595440 - DNA, 16 bp, Homo sapiens
gaggtagttaagggat

SEQ ID NO: 595441 - DNA, 21 bp, Homo sapiens
gaggtccttaggcctctgaga

SEQ ID NO: 595442 - DNA, 13 bp, Homo sapiens
gaggttgcagtga

SEQ ID NO: 595443 - DNA, 14 bp, Homo sapiens
gaggttgtggggcc

SEQ ID NO: 595444 - DNA, 23 bp, Homo sapiens
gaggttgtggggcctcaggctcc

SEQ ID NO: 595445 - DNA, 22 bp, Homo sapiens
gagtacctccagtcacactccc

SEQ ID NO: 595446 - DNA, 23 bp, Homo sapiens
gagtacctccagtcacactcccc

SEQ ID NO: 595447 - DNA, 23 bp, Homo sapiens
gagtccaacagacacaatttata

SEQ ID NO: 595448 - DNA, 18 bp, Homo sapiens
gagtctgtatttttctaa

SEQ ID NO: 595449 - DNA, 20 bp, Homo sapiens
gagtggagagagcagggcta

SEQ ID NO: 595450 - DNA, 22 bp, Homo sapiens
gagttcccttgaaactttggga

SEQ ID NO: 595451 - DNA, 16 bp, Homo sapiens
gagttttcattaaatc

SEQ ID NO: 595452 - DNA, 11 bp, Homo sapiens
gataaacaaac

SEQ ID NO: 595453 - DNA, 16 bp, Homo sapiens
gataaagaataataat

SEQ ID NO: 595454 - DNA, 15 bp, Homo sapiens
gataaggtggcttct

SEQ ID NO: 595455 - DNA, 20 bp, Homo sapiens
gataatgacactgtttcctg

SEQ ID NO: 595456 - DNA, 21 bp, Homo sapiens
gataatgacactgtttcctga

SEQ ID NO: 595457 - DNA, 16 bp, Homo sapiens
gataccatatgaatga

SEQ ID NO: 595458 - DNA, 13 bp, Homo sapiens
gatactggcacag

SEQ ID NO: 595459 - DNA, 13 bp, Homo sapiens
gatagtaagcata

SEQ ID NO: 595460 - DNA, 14 bp, Homo sapiens
gatagtaagcatag

SEQ ID NO: 595461 - DNA, 16 bp, Homo sapiens
gatattgaatgttaaa

SEQ ID NO: 595462 - DNA, 15 bp, Homo sapiens
gatcaaagatgaaaa

SEQ ID NO: 595463 - DNA, 18 bp, Homo sapiens
gatcaaagatgaaaagta

SEQ ID NO: 595464 - DNA, 19 bp, Homo sapiens
gatcagcaaaaagactgga

SEQ ID NO: 595465 - DNA, 16 bp, Homo sapiens
gatccagtataagact

SEQ ID NO: 595466 - DNA, 17 bp, Homo sapiens
gatccagtataagacta

SEQ ID NO: 595467 - DNA, 20 bp, Homo sapiens
gatcctcagttctcaaatgt

SEQ ID NO: 595468 - DNA, 20 bp, Homo sapiens
gatctacttctgtaattgtg

SEQ ID NO: 595469 - DNA, 12 bp, Homo sapiens
gatctattgctc

SEQ ID NO: 595470 - DNA, 21 bp, Homo sapiens
gatctttatatttcaataaat

SEQ ID NO: 595471 - DNA, 15 bp, Homo sapiens
gatctttcagaaata

SEQ ID NO: 595472 - DNA, 18 bp, Homo sapiens
gatgaattgtcacatcta

SEQ ID NO: 595473 - DNA, 19 bp, Homo sapiens
gatgaattgtcacatctat

SEQ ID NO: 595474 - DNA, 12 bp, Homo sapiens
gatgaggaccca

SEQ ID NO: 595475 - DNA, 16 bp, Homo sapiens
gatgcatttaataaag

SEQ ID NO: 595476 - DNA, 21 bp, Homo sapiens
gatgcatttaataaagatgag

SEQ ID NO: 595477 - DNA, 13 bp, Homo sapiens
gatgccccaggga

SEQ ID NO: 595478 - DNA, 14 bp, Homo sapiens
gatgccccagggat

SEQ ID NO: 595479 - DNA, 15 bp, Homo sapiens
gatgccccagggatg

SEQ ID NO: 595480 - DNA, 17 bp, Homo sapiens
gatgccccagggatggg

SEQ ID NO: 595481 - DNA, 12 bp, Homo sapiens
gcctttctcctc

SEQ ID NO: 595482 - DNA, 20 bp, Homo sapiens
gcctttctcctccccacctg

SEQ ID NO: 595483 - DNA, 20 bp, Homo sapiens
gcgacctctctgcctctctt

SEQ ID NO: 595484 - DNA, 23 bp, Homo sapiens
gcgccagcgacctctctgcctct

SEQ ID NO: 595485 - DNA, 19 bp, Homo sapiens
gcgctgcgcggactcgccc

SEQ ID NO: 595486 - DNA, 18 bp, Homo sapiens
gcggacccttctgggtcc

SEQ ID NO: 595487 - DNA, 13 bp, Homo sapiens
gcgggagggggcg

SEQ ID NO: 595488 - DNA, 23 bp, Homo sapiens
gcgtggctctaaaaggtaatgtg

SEQ ID NO: 595489 - DNA, 12 bp, Homo sapiens
gcgtggctgact

SEQ ID NO: 595490 - DNA, 13 bp, Homo sapiens
gcgtttgcctcct

SEQ ID NO: 595491 - DNA, 12 bp, Homo sapiens
gcgttttctccg

SEQ ID NO: 595492 - DNA, 19 bp, Homo sapiens
gctactgttgtaagaattc

SEQ ID NO: 595493 - DNA, 22 bp, Homo sapiens
gctagttatacttatttgtata

SEQ ID NO: 595494 - DNA, 21 bp, Homo sapiens
gctcagactgggcactggggc

SEQ ID NO: 595495 - DNA, 22 bp, Homo sapiens
gctcagactgggcactggggcc

SEQ ID NO: 595496 - DNA, 17 bp, Homo sapiens
gctcatgcatagtccca

SEQ ID NO: 595497 - DNA, 18 bp, Homo sapiens
gctcatgcatagtcccag

SEQ ID NO: 595498 - DNA, 17 bp, Homo sapiens
gctccaatgactgagca

SEQ ID NO: 595499 - DNA, 12 bp, Homo sapiens
gctcctcgcccc

SEQ ID NO: 595500 - DNA, 13 bp, Homo sapiens
gctcctcgccccc

SEQ ID NO: 595501 - DNA, 16 bp, Homo sapiens
gctcctcgcccccacc

SEQ ID NO: 595502 - DNA, 18 bp, Homo sapiens
gctcctcttagctcagct

SEQ ID NO: 595503 - DNA, 20 bp, Homo sapiens
gctcctcttagctcagctga

SEQ ID NO: 595504 - DNA, 21 bp, Homo sapiens
gctcctgcaaaaggaggtgaa

SEQ ID NO: 595505 - DNA, 17 bp, Homo sapiens
gctcctggaccaggccc

SEQ ID NO: 595506 - DNA, 20 bp, Homo sapiens
gctctaaaaggtaatgtgtg

SEQ ID NO: 595507 - DNA, 18 bp, Homo sapiens
gctgaacataacttctca

SEQ ID NO: 595508 - DNA, 15 bp, Homo sapiens
gctgaggctgagaaa

SEQ ID NO: 595509 - DNA, 19 bp, Homo sapiens
gctgaggctgagaaagcta

SEQ ID NO: 595510 - DNA, 14 bp, Homo sapiens
gctgagggtttgaa

SEQ ID NO: 595511 - DNA, 19 bp, Homo sapiens
gctgaggtgagaggatcag

SEQ ID NO: 595512 - DNA, 18 bp, Homo sapiens
gctgatgggtgccctttc

SEQ ID NO: 595513 - DNA, 12 bp, Homo sapiens
gctgcaaaaatt

SEQ ID NO: 595514 - DNA, 18 bp, Homo sapiens
gctgcagagatttctcat

SEQ ID NO: 595515 - DNA, 17 bp, Homo sapiens
gctgcagttttgctatc

SEQ ID NO: 595516 - DNA, 17 bp, Homo sapiens
gctgcccacctggctgc

SEQ ID NO: 595517 - DNA, 18 bp, Homo sapiens
gctgcccacctggctgcc

SEQ ID NO: 595518 - DNA, 16 bp, Homo sapiens
gctgccgtagcttcag

SEQ ID NO: 595519 - DNA, 18 bp, Homo sapiens
gctgcgcggactcgcccc

SEQ ID NO: 595520 - DNA, 19 bp, Homo sapiens
gctgctgggccccatctcc

SEQ ID NO: 595521 - DNA, 13 bp, Homo sapiens
gctgttgaacttt

SEQ ID NO: 595522 - DNA, 16 bp, Homo sapiens
gcttaatgctacatgt

SEQ ID NO: 595523 - DNA, 14 bp, Homo sapiens
gcttactcattaaa

SEQ ID NO: 595524 - DNA, 19 bp, Homo sapiens
gcttccattttaattttaa

SEQ ID NO: 595525 - DNA, 15 bp, Homo sapiens
gcttcccttactttg

SEQ ID NO: 595526 - DNA, 23 bp, Homo sapiens
gcttgaacctgggaggcagaggt

SEQ ID NO: 595527 - DNA, 20 bp, Homo sapiens
gcttgtctatactccttccc

SEQ ID NO: 595528 - DNA, 15 bp, Homo sapiens
gctttagtgaattaa

SEQ ID NO: 595529 - DNA, 20 bp, Homo sapiens
gctttcaagacccctgtctt

SEQ ID NO: 595530 - DNA, 23 bp, Homo sapiens
gctttgcattttgatattgctgt

SEQ ID NO: 595531 - DNA, 12 bp, Homo sapiens
gcttttccttga

SEQ ID NO: 595532 - DNA, 13 bp, Homo sapiens
ggaaaacatttgc

SEQ ID NO: 595533 - DNA, 21 bp, Homo sapiens
ggaaacaaataatttgaactt

SEQ ID NO: 595534 - DNA, 23 bp, Homo sapiens
ggaaatgaggttgggggaaccag

SEQ ID NO: 595535 - DNA, 14 bp, Homo sapiens
ggaacaaacagggc

SEQ ID NO: 595536 - DNA, 15 bp, Homo sapiens
ggaacaaacagggct

SEQ ID NO: 595537 - DNA, 16 bp, Homo sapiens
ggaacaatctttgctg

SEQ ID NO: 595538 - DNA, 13 bp, Homo sapiens
ggaagcccctggg

SEQ ID NO: 595539 - DNA, 22 bp, Homo sapiens
ggaagtcagaatttttaactgt

SEQ ID NO: 595540 - DNA, 19 bp, Homo sapiens
ggaagtgtgtgccaagagc

SEQ ID NO: 595541 - DNA, 20 bp, Homo sapiens
ggaataataggccacagaag

SEQ ID NO: 595542 - DNA, 20 bp, Homo sapiens
ggaatcagtatttccttcca

SEQ ID NO: 595543 - DNA, 20 bp, Homo sapiens
ggaatggatttttctttaac

SEQ ID NO: 595544 - DNA, 18 bp, Homo sapiens
ggacacagttcctgggaa

SEQ ID NO: 595545 - DNA, 19 bp, Homo sapiens
ggaccaggtttgcaggagc

SEQ ID NO: 595546 - DNA, 11 bp, Homo sapiens
ggacctacctc

SEQ ID NO: 595547 - DNA, 16 bp, Homo sapiens
ggacctacctccctcc

SEQ ID NO: 595548 - DNA, 21 bp, Homo sapiens
ggacctacctccctccctctc

SEQ ID NO: 595549 - DNA, 22 bp, Homo sapiens
ggacctacctccctccctctcc

SEQ ID NO: 595550 - DNA, 23 bp, Homo sapiens
ggacctgccccggacctacctcc

SEQ ID NO: 595551 - DNA, 21 bp, Homo sapiens
ggactcctcaaaccacttgcc

SEQ ID NO: 595552 - DNA, 23 bp, Homo sapiens
ggactcctcaaaccacttgcctg

SEQ ID NO: 595553 - DNA, 16 bp, Homo sapiens
ggactgtgggaaagag

SEQ ID NO: 595554 - DNA, 12 bp, Homo sapiens
ggacttgtgtct

SEQ ID NO: 595555 - DNA, 22 bp, Homo sapiens
ggagacgtttataaacagaaat

SEQ ID NO: 595556 - DNA, 12 bp, Homo sapiens
ggagagagcagg

SEQ ID NO: 595557 - DNA, 13 bp, Homo sapiens
ggagagagcaggg

SEQ ID NO: 595558 - DNA, 16 bp, Homo sapiens
ggagataaggtggctt

SEQ ID NO: 595559 - DNA, 19 bp, Homo sapiens
ggagataaggtggcttctc

SEQ ID NO: 595560 - DNA, 13 bp, Homo sapiens
ggagattgaactt

SEQ ID NO: 595561 - DNA, 13 bp, Homo sapiens
ggagcgttctaaa

SEQ ID NO: 595562 - DNA, 15 bp, Homo sapiens
ggaggtatgggctgg

SEQ ID NO: 595563 - DNA, 18 bp, Homo sapiens
ggaggtatgggctggggg

SEQ ID NO: 595564 - DNA, 14 bp, Homo sapiens
ggagtgggatagga

SEQ ID NO: 595565 - DNA, 23 bp, Homo sapiens
ggatctctctagtgatggtcaga

SEQ ID NO: 595566 - DNA, 19 bp, Homo sapiens
ggatgggaggtatgggctg

SEQ ID NO: 595567 - DNA, 12 bp, Homo sapiens
ggatgggtcccc

SEQ ID NO: 595568 - DNA, 15 bp, Homo sapiens
ggattctaaatacat

SEQ ID NO: 595569 - DNA, 18 bp, Homo sapiens
ggatttaaaagcctgctc

SEQ ID NO: 595570 - DNA, 18 bp, Homo sapiens
ggcaaaagggcagctgtg

SEQ ID NO: 595571 - DNA, 22 bp, Homo sapiens
ggcacattaactgttgcacttt

SEQ ID NO: 595572 - DNA, 15 bp, Homo sapiens
ggcaccaggggccaa

SEQ ID NO: 595573 - DNA, 16 bp, Homo sapiens
ggcactagccaaagcg

SEQ ID NO: 595574 - DNA, 16 bp, Homo sapiens
ggcagcatctgctcca

SEQ ID NO: 595575 - DNA, 22 bp, Homo sapiens
ggcaggaacggtggaggcagag

SEQ ID NO: 595576 - DNA, 22 bp, Homo sapiens
ggcagggggtatgcagagcttg

SEQ ID NO: 595577 - DNA, 17 bp, Homo sapiens
ggcatgaaccctcttgc

SEQ ID NO: 595578 - DNA, 22 bp, Homo sapiens
ggcattcaaccacgcaggaagc

SEQ ID NO: 595579 - DNA, 19 bp, Homo sapiens
ggcattgagtattgtttaa

SEQ ID NO: 595580 - DNA, 16 bp, Homo sapiens
ggccaaagagtctcca

SEQ ID NO: 595581 - DNA, 23 bp, Homo sapiens
ggccacctcctaccccttcctgt

SEQ ID NO: 595582 - DNA, 21 bp, Homo sapiens
ggccagagcaaacagaaaaag

SEQ ID NO: 595583 - DNA, 20 bp, Homo sapiens
ggccagggaggcagcctagc

SEQ ID NO: 595584 - DNA, 20 bp, Homo sapiens
ggccataaacggttcctggt

SEQ ID NO: 595585 - DNA, 21 bp, Homo sapiens
ggccataaacggttcctggtg

SEQ ID NO: 595586 - DNA, 14 bp, Homo sapiens
ggcccaacattaaa

SEQ ID NO: 595587 - DNA, 18 bp, Homo sapiens
ggcccatagcagccagtt

SEQ ID NO: 595588 - DNA, 17 bp, Homo sapiens
ggccgggggaggggcgc

SEQ ID NO: 595589 - DNA, 18 bp, Homo sapiens
ggcctagactctgtctac

SEQ ID NO: 595590 - DNA, 22 bp, Homo sapiens
taaatgaaagaaaattgagttg

SEQ ID NO: 595591 - DNA, 22 bp, Homo sapiens
taaatgggactggagtccctgt

SEQ ID NO: 595592 - DNA, 18 bp, Homo sapiens
taaatggtaataagcact

SEQ ID NO: 595593 - DNA, 12 bp, Homo sapiens
taaatgtgtaat

SEQ ID NO: 595594 - DNA, 20 bp, Homo sapiens
taaatgtgtaataatgtaac

SEQ ID NO: 595595 - DNA, 21 bp, Homo sapiens
taaatgtttcttttaaagacc

SEQ ID NO: 595596 - DNA, 18 bp, Homo sapiens
taaattcaactttgtaaa

SEQ ID NO: 595597 - DNA, 19 bp, Homo sapiens
taaattcaactttgtaaaa

SEQ ID NO: 595598 - DNA, 16 bp, Homo sapiens
taaattgcatcactgt

SEQ ID NO: 595599 - DNA, 14 bp, Homo sapiens
taaatttaatacca

SEQ ID NO: 595600 - DNA, 17 bp, Homo sapiens
taaatttaataccagat

SEQ ID NO: 595601 - DNA, 21 bp, Homo sapiens
taacacagcattgtatatgtg

SEQ ID NO: 595602 - DNA, 20 bp, Homo sapiens
taacatgatttccctccaga

SEQ ID NO: 595603 - DNA, 20 bp, Homo sapiens
taaccagctcagtgttttgg

SEQ ID NO: 595604 - DNA, 16 bp, Homo sapiens
taacctcgggcctgct

SEQ ID NO: 595605 - DNA, 21 bp, Homo sapiens
taactcaaatacacatttgct

SEQ ID NO: 595606 - DNA, 13 bp, Homo sapiens
taactttctgggt

SEQ ID NO: 595607 - DNA, 23 bp, Homo sapiens
taagaataccacatcaaataaga

SEQ ID NO: 595608 - DNA, 19 bp, Homo sapiens
taagaattctgattgattt

SEQ ID NO: 595609 - DNA, 20 bp, Homo sapiens
taagaattctgattgatttg

SEQ ID NO: 595610 - DNA, 18 bp, Homo sapiens
taagactatatatataaa

SEQ ID NO: 595611 - DNA, 19 bp, Homo sapiens
taagactatatatataaat

SEQ ID NO: 595612 - DNA, 20 bp, Homo sapiens
taagactatatatataaatg

SEQ ID NO: 595613 - DNA, 23 bp, Homo sapiens
taagactatatatataaatgtat

SEQ ID NO: 595614 - DNA, 19 bp, Homo sapiens
taagatgaaacatcatttc

SEQ ID NO: 595615 - DNA, 17 bp, Homo sapiens
taagatgttcactgtgg

SEQ ID NO: 595616 - DNA, 14 bp, Homo sapiens
taagcaaatgttaa

SEQ ID NO: 595617 - DNA, 19 bp, Homo sapiens
taagcaaatgttaaaagtt

SEQ ID NO: 595618 - DNA, 15 bp, Homo sapiens
taagcatgtgatgtt

SEQ ID NO: 595619 - DNA, 23 bp, Homo sapiens
taagctaggatgttgctcagaag

SEQ ID NO: 595620 - DNA, 12 bp, Homo sapiens
taaggtggcttc

SEQ ID NO: 595621 - DNA, 13 bp, Homo sapiens
taaggtggcttct

SEQ ID NO: 595622 - DNA, 13 bp, Homo sapiens
taagtcccttcct

SEQ ID NO: 595623 - DNA, 22 bp, Homo sapiens
taagtcccttcctattctcctg

SEQ ID NO: 595624 - DNA, 16 bp, Homo sapiens
taataaaaagaaagat

SEQ ID NO: 595625 - DNA, 16 bp, Homo sapiens
taataagcactgtaaa

SEQ ID NO: 595626 - DNA, 21 bp, Homo sapiens
taataggaacaatctttgctg

SEQ ID NO: 595627 - DNA, 22 bp, Homo sapiens
taataggaacaatctttgctgt

SEQ ID NO: 595628 - DNA, 18 bp, Homo sapiens
taatagggaaaattctaa

SEQ ID NO: 595629 - DNA, 14 bp, Homo sapiens
taatctatgtttat

SEQ ID NO: 595630 - DNA, 15 bp, Homo sapiens
taatctcaatgcaag

SEQ ID NO: 595631 - DNA, 17 bp, Homo sapiens
taatgacactgtttcct

SEQ ID NO: 595632 - DNA, 19 bp, Homo sapiens
taatgacactgtttcctga

SEQ ID NO: 595633 - DNA, 18 bp, Homo sapiens
taatgctaaatgtgtaat

SEQ ID NO: 595634 - DNA, 13 bp, Homo sapiens
taatgggattaga

SEQ ID NO: 595635 - DNA, 16 bp, Homo sapiens
taatgtaacatgattt

SEQ ID NO: 595636 - DNA, 17 bp, Homo sapiens
taatgtctcctttgctc

SEQ ID NO: 595637 - DNA, 13 bp, Homo sapiens
taattagctgtgc

SEQ ID NO: 595638 - DNA, 16 bp, Homo sapiens
taattcacttcagttt

SEQ ID NO: 595639 - DNA, 18 bp, Homo sapiens
taattgctgataccatat

SEQ ID NO: 595640 - DNA, 23 bp, Homo sapiens
taattgtacaaaattaagcaaat

SEQ ID NO: 595641 - DNA, 16 bp, Homo sapiens
taatttaacccagctc

SEQ ID NO: 595642 - DNA, 20 bp, Homo sapiens
taatttacttgttttggatg

SEQ ID NO: 595643 - DNA, 13 bp, Homo sapiens
taatttgcactga

SEQ ID NO: 595644 - DNA, 17 bp, Homo sapiens
taatttgttttggatat

SEQ ID NO: 595645 - DNA, 14 bp, Homo sapiens
taattttaaagtgc

SEQ ID NO: 595646 - DNA, 15 bp, Homo sapiens
tacaaaattaagcaa

SEQ ID NO: 595647 - DNA, 17 bp, Homo sapiens
tacacatttgctactgt

SEQ ID NO: 595648 - DNA, 23 bp, Homo sapiens
tacagccttattttgttggtgct

SEQ ID NO: 595649 - DNA, 15 bp, Homo sapiens
tacagtatagatttt

SEQ ID NO: 595650 - DNA, 15 bp, Homo sapiens
tacagttttaactgt

SEQ ID NO: 595651 - DNA, 15 bp, Homo sapiens
tacatcaatatgtat

SEQ ID NO: 595652 - DNA, 17 bp, Homo sapiens
tacatgccacatcaaac

SEQ ID NO: 595653 - DNA, 15 bp, Homo sapiens
tacatgtgatacatt

SEQ ID NO: 595654 - DNA, 14 bp, Homo sapiens
taccatatgaatga

SEQ ID NO: 595655 - DNA, 18 bp, Homo sapiens
taccatttagtaagaata

SEQ ID NO: 595656 - DNA, 15 bp, Homo sapiens
tacccatagacatga

SEQ ID NO: 595657 - DNA, 12 bp, Homo sapiens
taccccttcctg

SEQ ID NO: 595658 - DNA, 19 bp, Homo sapiens
taccccttcctgtcctgcc

SEQ ID NO: 595659 - DNA, 20 bp, Homo sapiens
tacctccagtcacactcccc

SEQ ID NO: 595660 - DNA, 12 bp, Homo sapiens
tacctccctccc

SEQ ID NO: 595661 - DNA, 15 bp, Homo sapiens
tacctggggactcct

SEQ ID NO: 595662 - DNA, 14 bp, Homo sapiens
taccttatcttaca

SEQ ID NO: 595663 - DNA, 23 bp, Homo sapiens
taccttatcttacaatattgatt

SEQ ID NO: 595664 - DNA, 18 bp, Homo sapiens
tacctttctctctctaag

SEQ ID NO: 595665 - DNA, 22 bp, Homo sapiens
tacgaatgcccctgttcatgtt

SEQ ID NO: 595666 - DNA, 14 bp, Homo sapiens
tacgcatcccatct

SEQ ID NO: 595667 - DNA, 14 bp, Homo sapiens
tacgtttgtgtttc

SEQ ID NO: 595668 - DNA, 18 bp, Homo sapiens
tactaaaaaaaagatgaa

SEQ ID NO: 595669 - DNA, 23 bp, Homo sapiens
tactcccacagcagccccaggag

SEQ ID NO: 595670 - DNA, 14 bp, Homo sapiens
tactgacatttctt

SEQ ID NO: 595671 - DNA, 16 bp, Homo sapiens
tactgcaaaaagaaaa

SEQ ID NO: 595672 - DNA, 17 bp, Homo sapiens
tactgcttaattgctga

SEQ ID NO: 595673 - DNA, 19 bp, Homo sapiens
tactgtgtctcatggattt

SEQ ID NO: 595674 - DNA, 16 bp, Homo sapiens
tactgttgtaagaatt

SEQ ID NO: 595675 - DNA, 17 bp, Homo sapiens
tactgttgtaagaattc

SEQ ID NO: 595676 - DNA, 12 bp, Homo sapiens
tacttacatgtt

SEQ ID NO: 595677 - DNA, 18 bp, Homo sapiens
tacttatttgtatatggt

SEQ ID NO: 595678 - DNA, 15 bp, Homo sapiens
tacttcccactgtat

SEQ ID NO: 595679 - DNA, 16 bp, Homo sapiens
tacttctgtaattgtg

SEQ ID NO: 595680 - DNA, 20 bp, Homo sapiens
tacttctgtaattgtgtgga

SEQ ID NO: 595681 - DNA, 20 bp, Homo sapiens
tactttggggctaatttaac

SEQ ID NO: 595682 - DNA, 16 bp, Homo sapiens
tactttgtattttgat

SEQ ID NO: 595683 - DNA, 21 bp, Homo sapiens
tactttgtattttgattattt

SEQ ID NO: 595684 - DNA, 16 bp, Homo sapiens
tagaaattacctgtgg

SEQ ID NO: 595685 - DNA, 18 bp, Homo sapiens
tagaaattacctgtggat

SEQ ID NO: 595686 - DNA, 20 bp, Homo sapiens
tagaagtgagcaaaaaagag

SEQ ID NO: 595687 - DNA, 12 bp, Homo sapiens
tagacatgaaag

SEQ ID NO: 595688 - DNA, 17 bp, Homo sapiens
tagactctgtctacctg

SEQ ID NO: 595689 - DNA, 20 bp, Homo sapiens
tagacttggagaatactgcc

SEQ ID NO: 595690 - DNA, 23 bp, Homo sapiens
tagacttggagaatactgccaaa

SEQ ID NO: 595691 - DNA, 12 bp, Homo sapiens
tagagccaatta

SEQ ID NO: 595692 - DNA, 22 bp, Homo sapiens
tagatatgtattcttttctcag

SEQ ID NO: 595693 - DNA, 15 bp, Homo sapiens
tagatgctggctggg

SEQ ID NO: 595694 - DNA, 20 bp, Homo sapiens
tagatgggaggatgaattgt

SEQ ID NO: 595695 - DNA, 22 bp, Homo sapiens
tagattgactaactcaaataca

SEQ ID NO: 595696 - DNA, 16 bp, Homo sapiens
tagattgtattaacta

SEQ ID NO: 595697 - DNA, 18 bp, Homo sapiens
tagcacacttttccacat

SEQ ID NO: 595698 - DNA, 19 bp, Homo sapiens
tagcactcaagacccggtt

SEQ ID NO: 595699 - DNA, 17 bp, Homo sapiens
tagcacttatgttactg

SEQ ID NO: 595700 - DNA, 14 bp, Homo sapiens
tcgcatttcctaag

SEQ ID NO: 595701 - DNA, 12 bp, Homo sapiens
tcgcccccacca

SEQ ID NO: 595702 - DNA, 23 bp, Homo sapiens
tcgcccccaggaacgctctcctc

SEQ ID NO: 595703 - DNA, 19 bp, Homo sapiens
tcgcgccagcgacctctct

SEQ ID NO: 595704 - DNA, 22 bp, Homo sapiens
tcgcgccagcgacctctctgcc

SEQ ID NO: 595705 - DNA, 12 bp, Homo sapiens
tcggaaacactg

SEQ ID NO: 595706 - DNA, 15 bp, Homo sapiens
tcggaaatcttaaac

SEQ ID NO: 595707 - DNA, 22 bp, Homo sapiens
tcggcagatgatgctttggaag

SEQ ID NO: 595708 - DNA, 13 bp, Homo sapiens
tcggctcctgatg

SEQ ID NO: 595709 - DNA, 15 bp, Homo sapiens
tctaaaaacatttgt

SEQ ID NO: 595710 - DNA, 17 bp, Homo sapiens
tctaaaaggtaatgtgt

SEQ ID NO: 595711 - DNA, 18 bp, Homo sapiens
tctaaaattataaatgac

SEQ ID NO: 595712 - DNA, 23 bp, Homo sapiens
tctaaatatgaatgaatgggata

SEQ ID NO: 595713 - DNA, 22 bp, Homo sapiens
tctaacagtgaagttttactgt

SEQ ID NO: 595714 - DNA, 14 bp, Homo sapiens
tctacaatctcttt

SEQ ID NO: 595715 - DNA, 22 bp, Homo sapiens
tctagaatcacagctcaagcat

SEQ ID NO: 595716 - DNA, 13 bp, Homo sapiens
tctaggacacagt

SEQ ID NO: 595717 - DNA, 21 bp, Homo sapiens
tctaggacacagttcctggga

SEQ ID NO: 595718 - DNA, 16 bp, Homo sapiens
tctagggcctcagtct

SEQ ID NO: 595719 - DNA, 16 bp, Homo sapiens
tctataaaactctgca

SEQ ID NO: 595720 - DNA, 12 bp, Homo sapiens
tctataaagtat

SEQ ID NO: 595721 - DNA, 15 bp, Homo sapiens
tctatccttccagaa

SEQ ID NO: 595722 - DNA, 12 bp, Homo sapiens
tctatgtttata

SEQ ID NO: 595723 - DNA, 16 bp, Homo sapiens
tctattaatattcagg

SEQ ID NO: 595724 - DNA, 16 bp, Homo sapiens
tctattatttttataa

SEQ ID NO: 595725 - DNA, 22 bp, Homo sapiens
tctcaaagatgcgtttgcctcc

SEQ ID NO: 595726 - DNA, 23 bp, Homo sapiens
tctcaaagatgcgtttgcctcct

SEQ ID NO: 595727 - DNA, 12 bp, Homo sapiens
tctcaaatgtgt

SEQ ID NO: 595728 - DNA, 20 bp, Homo sapiens
tctcaccagcagtcgtgggg

SEQ ID NO: 595729 - DNA, 18 bp, Homo sapiens
tctcagtccagcagtttc

SEQ ID NO: 595730 - DNA, 22 bp, Homo sapiens
tctcattgacttttataaagca

SEQ ID NO: 595731 - DNA, 15 bp, Homo sapiens
tctccactcttctct

SEQ ID NO: 595732 - DNA, 18 bp, Homo sapiens
tctccactcttctctcct

SEQ ID NO: 595733 - DNA, 15 bp, Homo sapiens
tctcccacttcctcc

SEQ ID NO: 595734 - DNA, 14 bp, Homo sapiens
tctccctgcagcct

SEQ ID NO: 595735 - DNA, 14 bp, Homo sapiens
tctccgggtcctcc

SEQ ID NO: 595736 - DNA, 17 bp, Homo sapiens
tctccgggtcctcctaa

SEQ ID NO: 595737 - DNA, 19 bp, Homo sapiens
tctcctccccacctgtagc

SEQ ID NO: 595738 - DNA, 13 bp, Homo sapiens
tctcctcgagccc

SEQ ID NO: 595739 - DNA, 17 bp, Homo sapiens
tctcctcgagccctccc

SEQ ID NO: 595740 - DNA, 18 bp, Homo sapiens
tctcctcgagccctcccc

SEQ ID NO: 595741 - DNA, 20 bp, Homo sapiens
tctcctcgagccctccccca

SEQ ID NO: 595742 - DNA, 16 bp, Homo sapiens
tctccttgagtgtatg

SEQ ID NO: 595743 - DNA, 16 bp, Homo sapiens
tctcctttctccctgc

SEQ ID NO: 595744 - DNA, 21 bp, Homo sapiens
tctcctttctccctgcagcct

SEQ ID NO: 595745 - DNA, 13 bp, Homo sapiens
tctcctttgctct

SEQ ID NO: 595746 - DNA, 17 bp, Homo sapiens
tctcctttgctcttgcc

SEQ ID NO: 595747 - DNA, 18 bp, Homo sapiens
tctctgccctgggctcct

SEQ ID NO: 595748 - DNA, 19 bp, Homo sapiens
tctctgccctgggctcctc

SEQ ID NO: 595749 - DNA, 20 bp, Homo sapiens
tctctgccctgggctcctct

SEQ ID NO: 595750 - DNA, 11 bp, Homo sapiens
tctctgcctct

SEQ ID NO: 595751 - DNA, 19 bp, Homo sapiens
tctctggaagcccctgggc

SEQ ID NO: 595752 - DNA, 20 bp, Homo sapiens
tctctggaagcccctgggcc

SEQ ID NO: 595753 - DNA, 14 bp, Homo sapiens
tctctttttgtttg

SEQ ID NO: 595754 - DNA, 22 bp, Homo sapiens
tctgaaatcttcccatgcattc

SEQ ID NO: 595755 - DNA, 13 bp, Homo sapiens
tctgaagagacca

SEQ ID NO: 595756 - DNA, 23 bp, Homo sapiens
tctgaagagaccactcaatccat

SEQ ID NO: 595757 - DNA, 16 bp, Homo sapiens
tctgagaagctctgaa

SEQ ID NO: 595758 - DNA, 24 bp, Homo sapiens
tctgagaagctctgaagaactctc

SEQ ID NO: 595759 - DNA, 19 bp, Homo sapiens
tctgagggaaaccagagtc

SEQ ID NO: 595760 - DNA, 14 bp, Homo sapiens
tctgatcggccagt

SEQ ID NO: 595761 - DNA, 15 bp, Homo sapiens
tctgattctggcttt

SEQ ID NO: 595762 - DNA, 23 bp, Homo sapiens
tctgattctggctttaagccttc

SEQ ID NO: 595763 - DNA, 14 bp, Homo sapiens
tctgcaacaagcat

SEQ ID NO: 595764 - DNA, 16 bp, Homo sapiens
tctgcaacaagcatgc

SEQ ID NO: 595765 - DNA, 17 bp, Homo sapiens
tctgcaacaagcatgca

SEQ ID NO: 595766 - DNA, 22 bp, Homo sapiens
tctgcacaccctccagagacaa

SEQ ID NO: 595767 - DNA, 20 bp, Homo sapiens
tctgccaatctgtacaaaat

SEQ ID NO: 595768 - DNA, 19 bp, Homo sapiens
tctgccctgggctcctctt

SEQ ID NO: 595769 - DNA, 13 bp, Homo sapiens
tctgctggtgaat

SEQ ID NO: 595770 - DNA, 19 bp, Homo sapiens
tctggaatttaaggcccaa

SEQ ID NO: 595771 - DNA, 18 bp, Homo sapiens
tctggctcaaagcagcag

SEQ ID NO: 595772 - DNA, 20 bp, Homo sapiens
tctggctcaaagcagcagga

SEQ ID NO: 595773 - DNA, 14 bp, Homo sapiens
tctgggctgtgggc

SEQ ID NO: 595774 - DNA, 15 bp, Homo sapiens
tctgggtccagggag

SEQ ID NO: 595775 - DNA, 15 bp, Homo sapiens
tctggtactttctgt

SEQ ID NO: 595776 - DNA, 13 bp, Homo sapiens
tctggtccctctt

SEQ ID NO: 595777 - DNA, 15 bp, Homo sapiens
tctggtccctcttct

SEQ ID NO: 595778 - DNA, 21 bp, Homo sapiens
tctgtgtaaccagctcagtgt

SEQ ID NO: 595779 - DNA, 18 bp, Homo sapiens
tctgtgttttgaaagaat

SEQ ID NO: 595780 - DNA, 11 bp, Homo sapiens
tcttagcatgg

SEQ ID NO: 595781 - DNA, 20 bp, Homo sapiens
tcttagctgaggctgagaaa

SEQ ID NO: 595782 - DNA, 12 bp, Homo sapiens
tcttcctctgca

SEQ ID NO: 595783 - DNA, 15 bp, Homo sapiens
tcttctctcctttct

SEQ ID NO: 595784 - DNA, 16 bp, Homo sapiens
tcttgccatcctgatg

SEQ ID NO: 595785 - DNA, 19 bp, Homo sapiens
tctttaaccacttttcaat

SEQ ID NO: 595786 - DNA, 11 bp, Homo sapiens
tctttaactgc

SEQ ID NO: 595787 - DNA, 22 bp, Homo sapiens
tctttaactgccgtaatttaac

SEQ ID NO: 595788 - DNA, 14 bp, Homo sapiens
tctttatatttcaa

SEQ ID NO: 595789 - DNA, 17 bp, Homo sapiens
tctttggacttctgaag

SEQ ID NO: 595790 - DNA, 15 bp, Homo sapiens
tctttggattctaaa

SEQ ID NO: 595791 - DNA, 12 bp, Homo sapiens
tcttttgaagca

SEQ ID NO: 595792 - DNA, 21 bp, Homo sapiens
tcttttttaaccggtaagagt

SEQ ID NO: 595793 - DNA, 19 bp, Homo sapiens
tgaaaaatataaaattatg

SEQ ID NO: 595794 - DNA, 20 bp, Homo sapiens
tgaaacatgggctgtgatta

SEQ ID NO: 595795 - DNA, 13 bp, Homo sapiens
tgaaacctgatgt

SEQ ID NO: 595796 - DNA, 22 bp, Homo sapiens
tgaaacctgatgtcagctgctg

SEQ ID NO: 595797 - DNA, 17 bp, Homo sapiens
tgaaacctttttttatc

SEQ ID NO: 595798 - DNA, 19 bp, Homo sapiens
tgaaactcatagacactga

SEQ ID NO: 595799 - DNA, 14 bp, Homo sapiens
tgaaagaaaattga

SEQ ID NO: 595800 - DNA, 15 bp, Homo sapiens
tgaaatccctgcctc

SEQ ID NO: 595801 - DNA, 19 bp, Homo sapiens
tgaaatcttcccatgcatt

SEQ ID NO: 595802 - DNA, 17 bp, Homo sapiens
tgaaattgcatactttg

SEQ ID NO: 595803 - DNA, 12 bp, Homo sapiens
tgaacagctgtg

SEQ ID NO: 595804 - DNA, 14 bp, Homo sapiens
tgaacagctgtgag

SEQ ID NO: 595805 - DNA, 24 bp, Homo sapiens
tgaacagctgtgagccatgcctcc

SEQ ID NO: 595806 - DNA, 16 bp, Homo sapiens
tgaaccataaattcaa

SEQ ID NO: 595807 - DNA, 17 bp, Homo sapiens
tgaacccacacctgggc

SEQ ID NO: 595808 - DNA, 13 bp, Homo sapiens
tgaaccctcttgc

SEQ ID NO: 595809 - DNA, 20 bp, Homo sapiens
tgaaccctcttgccatcctg

SEQ ID NO: 595810 - DNA, 23 bp, Homo sapiens
tgggtggaagtgtgtgccaagag

SEQ ID NO: 595811 - DNA, 20 bp, Homo sapiens
tgggtggggggcattgagta

SEQ ID NO: 595812 - DNA, 23 bp, Homo sapiens
tggtcaagggctgtcattgcaca

SEQ ID NO: 595813 - DNA, 21 bp, Homo sapiens
tggtcctatttttgtgaagag

SEQ ID NO: 595814 - DNA, 18 bp, Homo sapiens
tggtctaaggttcagcct

SEQ ID NO: 595815 - DNA, 15 bp, Homo sapiens
tggtctcccttctct

SEQ ID NO: 595816 - DNA, 20 bp, Homo sapiens
tggtctgccaatctgtacaa

SEQ ID NO: 595817 - DNA, 17 bp, Homo sapiens
tggtctggttcctgtgt

SEQ ID NO: 595818 - DNA, 19 bp, Homo sapiens
tggtgatttgaaaaatata

SEQ ID NO: 595819 - DNA, 18 bp, Homo sapiens
tggtgcgggcacaataaa

SEQ ID NO: 595820 - DNA, 22 bp, Homo sapiens
tggttcggctctagggcctcag

SEQ ID NO: 595821 - DNA, 13 bp, Homo sapiens
tggttttcctgtg

SEQ ID NO: 595822 - DNA, 16 bp, Homo sapiens
tgtaaaaatcttttga

SEQ ID NO: 595823 - DNA, 23 bp, Homo sapiens
tgtaaaaatcttttgaagcatag

SEQ ID NO: 595824 - DNA, 11 bp, Homo sapiens
tgtaaagatgt

SEQ ID NO: 595825 - DNA, 18 bp, Homo sapiens
tgtaaataatttgcactg

SEQ ID NO: 595826 - DNA, 20 bp, Homo sapiens
tgtaaatgaagatctttata

SEQ ID NO: 595827 - DNA, 18 bp, Homo sapiens
tgtaataatgtaacatga

SEQ ID NO: 595828 - DNA, 17 bp, Homo sapiens
tgtaatctcaatgcaag

SEQ ID NO: 595829 - DNA, 18 bp, Homo sapiens
tgtacagaccacctttca

SEQ ID NO: 595830 - DNA, 22 bp, Homo sapiens
tgtactgaataggttccccaat

SEQ ID NO: 595831 - DNA, 22 bp, Homo sapiens
tgtacttaaatggtaataagca

SEQ ID NO: 595832 - DNA, 11 bp, Homo sapiens
tgtagctatta

SEQ ID NO: 595833 - DNA, 13 bp, Homo sapiens
tgtagctgaagca

SEQ ID NO: 595834 - DNA, 12 bp, Homo sapiens
tgtataaatata

SEQ ID NO: 595835 - DNA, 13 bp, Homo sapiens
tgtataaatatac

SEQ ID NO: 595836 - DNA, 20 bp, Homo sapiens
tgtatatattttgtgtgaaa

SEQ ID NO: 595837 - DNA, 20 bp, Homo sapiens
tgtatattacccaatggaaa

SEQ ID NO: 595838 - DNA, 23 bp, Homo sapiens
tgtatcactgccttcgtttatat

SEQ ID NO: 595839 - DNA, 18 bp, Homo sapiens
tgtattcttttctcagtg

SEQ ID NO: 595840 - DNA, 12 bp, Homo sapiens
tgtattttcatg

SEQ ID NO: 595841 - DNA, 17 bp, Homo sapiens
tgtcagtactattcagg

SEQ ID NO: 595842 - DNA, 16 bp, Homo sapiens
tgtcattagtcctttg

SEQ ID NO: 595843 - DNA, 14 bp, Homo sapiens
tgtcattctgcctg

SEQ ID NO: 595844 - DNA, 22 bp, Homo sapiens
tgtcattctgcctgctccatcg

SEQ ID NO: 595845 - DNA, 17 bp, Homo sapiens
tgtccaaaatttatatt

SEQ ID NO: 595846 - DNA, 18 bp, Homo sapiens
tgtccaaaatttatattt

SEQ ID NO: 595847 - DNA, 17 bp, Homo sapiens
tgtccaaacgtcctctt

SEQ ID NO: 595848 - DNA, 13 bp, Homo sapiens
tgtcccctatcct

SEQ ID NO: 595849 - DNA, 14 bp, Homo sapiens
tgtcccctatcctc

SEQ ID NO: 595850 - DNA, 14 bp, Homo sapiens
tgtcctgcctcctc

SEQ ID NO: 595851 - DNA, 17 bp, Homo sapiens
tgtcctgcctcctcatc

SEQ ID NO: 595852 - DNA, 15 bp, Homo sapiens
tgtcctgcgttttct

SEQ ID NO: 595853 - DNA, 21 bp, Homo sapiens
tgtctccttaagctgcagaga

SEQ ID NO: 595854 - DNA, 20 bp, Homo sapiens
tgtctcttaaaaaaataaaa

SEQ ID NO: 595855 - DNA, 15 bp, Homo sapiens
tgtctggcagatgag

SEQ ID NO: 595856 - DNA, 13 bp, Homo sapiens
tgtgaaattgcat

SEQ ID NO: 595857 - DNA, 16 bp, Homo sapiens
tgtgaccagaaagctt

SEQ ID NO: 595858 - DNA, 14 bp, Homo sapiens
tgtgaccctgggca

SEQ ID NO: 595859 - DNA, 19 bp, Homo sapiens
tgtgactcagcatcaccca

SEQ ID NO: 595860 - DNA, 12 bp, Homo sapiens
tgtgacttttta

SEQ ID NO: 595861 - DNA, 19 bp, Homo sapiens
tgtgagccatgcctccctg

SEQ ID NO: 595862 - DNA, 16 bp, Homo sapiens
tgtgagctatgcaaac

SEQ ID NO: 595863 - DNA, 21 bp, Homo sapiens
tgtgatacattttttaagctt

SEQ ID NO: 595864 - DNA, 20 bp, Homo sapiens
tgtgatgttgtcttagcatg

SEQ ID NO: 595865 - DNA, 13 bp, Homo sapiens
tgtgattactgca

SEQ ID NO: 595866 - DNA, 21 bp, Homo sapiens
tgtgattactgcaatcactgt

SEQ ID NO: 595867 - DNA, 13 bp, Homo sapiens
tgtgcaatagaag

SEQ ID NO: 595868 - DNA, 13 bp, Homo sapiens
tgtgcaggatatt

SEQ ID NO: 595869 - DNA, 18 bp, Homo sapiens
tgtgctatacacacacac

SEQ ID NO: 595870 - DNA, 22 bp, Homo sapiens
tgtgctcatgcattgcttgtgt

SEQ ID NO: 595871 - DNA, 19 bp, Homo sapiens
tgtgctgaacataacttct

SEQ ID NO: 595872 - DNA, 21 bp, Homo sapiens
tgtgctgaacataacttctca

SEQ ID NO: 595873 - DNA, 17 bp, Homo sapiens
tgtgctgggtcccagcc

SEQ ID NO: 595874 - DNA, 18 bp, Homo sapiens
tgtgctgggtcccagcct

SEQ ID NO: 595875 - DNA, 19 bp, Homo sapiens
tgtgctgggtcccagcctg

SEQ ID NO: 595876 - DNA, 23 bp, Homo sapiens
tgtggcataaattgcatcactgt

SEQ ID NO: 595877 - DNA, 17 bp, Homo sapiens
tgtgggatattgaatgt

SEQ ID NO: 595878 - DNA, 18 bp, Homo sapiens
tgtggggcctcaggctcc

SEQ ID NO: 595879 - DNA, 15 bp, Homo sapiens
tgtggtgaatgtgtg

SEQ ID NO: 595880 - DNA, 13 bp, Homo sapiens
tgtgtacacatgg

SEQ ID NO: 595881 - DNA, 22 bp, Homo sapiens
tgtgtggcagccaggatgacta

SEQ ID NO: 595882 - DNA, 20 bp, Homo sapiens
tgttaaaagttttatatgct

SEQ ID NO: 595883 - DNA, 12 bp, Homo sapiens
tgttaaagagaa

SEQ ID NO: 595884 - DNA, 21 bp, Homo sapiens
tgttaaagagataaagaataa

SEQ ID NO: 595885 - DNA, 20 bp, Homo sapiens
tgttaaggacccttttaagc

SEQ ID NO: 595886 - DNA, 16 bp, Homo sapiens
tgttacgtagcctaag

SEQ ID NO: 595887 - DNA, 17 bp, Homo sapiens
tgttactggtgtccagc

SEQ ID NO: 595888 - DNA, 19 bp, Homo sapiens
tgttccaagtctctgtgta

SEQ ID NO: 595889 - DNA, 17 bp, Homo sapiens
tgttctgcatggattca

SEQ ID NO: 595890 - DNA, 21 bp, Homo sapiens
tgttcttactgtaactacttc

SEQ ID NO: 595891 - DNA, 14 bp, Homo sapiens
tgttgactgtgtca

SEQ ID NO: 595892 - DNA, 14 bp, Homo sapiens
tgttgcacttttga

SEQ ID NO: 595893 - DNA, 24 bp, Homo sapiens
tgttgcacttttgaatgtccaaaa

SEQ ID NO: 595894 - DNA, 15 bp, Homo sapiens
tgttgcctcttgcaa

SEQ ID NO: 595895 - DNA, 18 bp, Homo sapiens
tgttgcctcttgcaatgc

SEQ ID NO: 595896 - DNA, 15 bp, Homo sapiens
tgttgtacttaaatg

SEQ ID NO: 595897 - DNA, 14 bp, Homo sapiens
tgttgtcttagcat

SEQ ID NO: 595898 - DNA, 13 bp, Homo sapiens
tgtttaaaatgta

SEQ ID NO: 595899 - DNA, 14 bp, Homo sapiens
tgtttaaaatgtaa

SEQ ID NO: 595900 - DNA, 22 bp, Homo sapiens
tgtttaaaatgtaatttaaatg

SEQ ID NO: 595901 - DNA, 23 bp, Homo sapiens
tgtttacctttctctctctaagg

SEQ ID NO: 595902 - DNA, 14 bp, Homo sapiens
tgtttggtaaatgt

SEQ ID NO: 595903 - DNA, 15 bp, Homo sapiens
tgtttggtaaatgtt

SEQ ID NO: 595904 - DNA, 18 bp, Homo sapiens
tgttttaaaacgtgtaaa

SEQ ID NO: 595905 - DNA, 16 bp, Homo sapiens
tgttttaataacttat

SEQ ID NO: 595906 - DNA, 13 bp, Homo sapiens
tgttttaattgta

SEQ ID NO: 595907 - DNA, 13 bp, Homo sapiens
ttaaaatgtaatt

SEQ ID NO: 595908 - DNA, 17 bp, Homo sapiens
ttaaaatgtaatttaaa

SEQ ID NO: 595909 - DNA, 20 bp, Homo sapiens
ttaaaattttgtatgttaaa

SEQ ID NO: 595910 - DNA, 14 bp, Homo sapiens
ttaaaccacttaaa

SEQ ID NO: 595911 - DNA, 19 bp, Homo sapiens
ttaaacgaagagttccctt

SEQ ID NO: 595912 - DNA, 22 bp, Homo sapiens
ttaaacgattagtgatgtcctt

SEQ ID NO: 595913 - DNA, 23 bp, Homo sapiens
ttaaacgctctaggtacgatgac

SEQ ID NO: 595914 - DNA, 14 bp, Homo sapiens
ttaaactaaatgtg

SEQ ID NO: 595915 - DNA, 14 bp, Homo sapiens
ttaaagagaatgag

SEQ ID NO: 595916 - DNA, 15 bp, Homo sapiens
ttaaagagaatgagt

SEQ ID NO: 595917 - DNA, 14 bp, Homo sapiens
ttaaagagataaag

SEQ ID NO: 595918 - DNA, 15 bp, Homo sapiens
ttaaattgtgtttta

SEQ ID NO: 595919 - DNA, 19 bp, Homo sapiens
ttaactatcttctttggac

SEQ ID NO: 595920 - DNA, 15 bp, Homo sapiens
aaaaacatttatttt

SEQ ID NO: 595921 - DNA, 21 bp, Homo sapiens
aaaagctttgaaccctgggac

SEQ ID NO: 595922 - DNA, 17 bp, Homo sapiens
aaacagaatcagtgtta

SEQ ID NO: 595923 - DNA, 15 bp, Homo sapiens
aaaggttcctttgtt

SEQ ID NO: 595924 - DNA, 18 bp, Homo sapiens
aaaggttcctttgttccc

SEQ ID NO: 595925 - DNA, 19 bp, Homo sapiens
aaaggttcctttgttccct

SEQ ID NO: 595926 - DNA, 19 bp, Homo sapiens
aaatatcaaacacggaccc

SEQ ID NO: 595927 - DNA, 16 bp, Homo sapiens
aaattcattttattct

SEQ ID NO: 595928 - DNA, 15 bp, Homo sapiens
aaattctcttaaata

SEQ ID NO: 595929 - DNA, 21 bp, Homo sapiens
aacagaatcagtgttaaattc

SEQ ID NO: 595930 - DNA, 23 bp, Homo sapiens
aacagaatcagtgttaaattcat

SEQ ID NO: 595931 - DNA, 19 bp, Homo sapiens
aaccaataatggtcagtcc

SEQ ID NO: 595932 - DNA, 14 bp, Homo sapiens
aactaaaaataaat

SEQ ID NO: 595933 - DNA, 16 bp, Homo sapiens
aactaaaaataaatta

SEQ ID NO: 595934 - DNA, 21 bp, Homo sapiens
aagaatcacaataattttcta

SEQ ID NO: 595935 - DNA, 17 bp, Homo sapiens
aagaggtgttttttcta

SEQ ID NO: 595936 - DNA, 13 bp, Homo sapiens
aagcattctgtct

SEQ ID NO: 595937 - DNA, 18 bp, Homo sapiens
aagctgcatctagaggct

SEQ ID NO: 595938 - DNA, 13 bp, Homo sapiens
aaggaaatacttt

SEQ ID NO: 595939 - DNA, 22 bp, Homo sapiens
aaggaaatactttgcataaatt

SEQ ID NO: 595940 - DNA, 18 bp, Homo sapiens
aagggccttgagcatctg

SEQ ID NO: 595941 - DNA, 19 bp, Homo sapiens
aagggccttgagcatctgg

SEQ ID NO: 595942 - DNA, 21 bp, Homo sapiens
aagggccttgagcatctggat

SEQ ID NO: 595943 - DNA, 19 bp, Homo sapiens
aatactttgcataaattaa

SEQ ID NO: 595944 - DNA, 20 bp, Homo sapiens
aatagactcgctagtcagta

SEQ ID NO: 595945 - DNA, 19 bp, Homo sapiens
aatcattgcttatgtcaaa

SEQ ID NO: 595946 - DNA, 17 bp, Homo sapiens
aatgaatgaatggcttg

SEQ ID NO: 595947 - DNA, 15 bp, Homo sapiens
aatgcgccaataaac

SEQ ID NO: 595948 - DNA, 21 bp, Homo sapiens
aatggaccctctcctggactc

SEQ ID NO: 595949 - DNA, 16 bp, Homo sapiens
aatggtgccttcattt

SEQ ID NO: 595950 - DNA, 19 bp, Homo sapiens
aatttgataaaaacccaaa

SEQ ID NO: 595951 - DNA, 17 bp, Homo sapiens
acacctatgtcatttca

SEQ ID NO: 595952 - DNA, 16 bp, Homo sapiens
acagaatcagtgttaa

SEQ ID NO: 595953 - DNA, 22 bp, Homo sapiens
acagaatcagtgttaaattcat

SEQ ID NO: 595954 - DNA, 18 bp, Homo sapiens
acaggctgcggcccctcc

SEQ ID NO: 595955 - DNA, 19 bp, Homo sapiens
acaggctgcggcccctccc

SEQ ID NO: 595956 - DNA, 24 bp, Homo sapiens
acaggctgcggcccctcccccgtc

SEQ ID NO: 595957 - DNA, 21 bp, Homo sapiens
acatacacctatgtcatttca

SEQ ID NO: 595958 - DNA, 21 bp, Homo sapiens
acatagaaattgcctgacgaa

SEQ ID NO: 595959 - DNA, 16 bp, Homo sapiens
acatgcattactgcat

SEQ ID NO: 595960 - DNA, 18 bp, Homo sapiens
acatggcctgtttgggag

SEQ ID NO: 595961 - DNA, 21 bp, Homo sapiens
acatgtatctatgcattttct

SEQ ID NO: 595962 - DNA, 15 bp, Homo sapiens
acatttattttcatt

SEQ ID NO: 595963 - DNA, 18 bp, Homo sapiens
acccagtaactcatctgt

SEQ ID NO: 595964 - DNA, 19 bp, Homo sapiens
acccagtgagacagaccgc

SEQ ID NO: 595965 - DNA, 13 bp, Homo sapiens
acccgttcaactt

SEQ ID NO: 595966 - DNA, 23 bp, Homo sapiens
acctaaacatagaaattgcctga

SEQ ID NO: 595967 - DNA, 15 bp, Homo sapiens
acctatgtcatttca

SEQ ID NO: 595968 - DNA, 18 bp, Homo sapiens
acctatgtcatttcattt

SEQ ID NO: 595969 - DNA, 21 bp, Homo sapiens
acctctcccctggaactgtct

SEQ ID NO: 595970 - DNA, 14 bp, Homo sapiens
acctggtctctcct

SEQ ID NO: 595971 - DNA, 13 bp, Homo sapiens
acgaatggaccct

SEQ ID NO: 595972 - DNA, 21 bp, Homo sapiens
actaaaaataaattaataaat

SEQ ID NO: 595973 - DNA, 17 bp, Homo sapiens
ctagtgactggggatgg

SEQ ID NO: 595974 - DNA, 13 bp, Homo sapiens
ctatgaaattggt

SEQ ID NO: 595975 - DNA, 16 bp, Homo sapiens
ctatgtcatttcattt

SEQ ID NO: 595976 - DNA, 18 bp, Homo sapiens
ctatgtcatttcatttcc

SEQ ID NO: 595977 - DNA, 23 bp, Homo sapiens
ctattaaaggttcctttgttccc

SEQ ID NO: 595978 - DNA, 17 bp, Homo sapiens
ctattatccccatttct

SEQ ID NO: 595979 - DNA, 19 bp, Homo sapiens
ctcagaccagctcccagat

SEQ ID NO: 595980 - DNA, 12 bp, Homo sapiens
ctcatctcttct

SEQ ID NO: 595981 - DNA, 15 bp, Homo sapiens
ctcatctcttctttt

SEQ ID NO: 595982 - DNA, 14 bp, Homo sapiens
ctccgggaccccca

SEQ ID NO: 595983 - DNA, 23 bp, Homo sapiens
ctcctggactcgcgttcccaaag

SEQ ID NO: 595984 - DNA, 15 bp, Homo sapiens
ctctagtattccaga

SEQ ID NO: 595985 - DNA, 13 bp, Homo sapiens
ctctgttcatttc

SEQ ID NO: 595986 - DNA, 16 bp, Homo sapiens
ctctgttcatttcctc

SEQ ID NO: 595987 - DNA, 17 bp, Homo sapiens
ctctgttcatttcctca

SEQ ID NO: 595988 - DNA, 15 bp, Homo sapiens
ctcttaaataaaaat

SEQ ID NO: 595989 - DNA, 14 bp, Homo sapiens
ctgagttcctgcat

SEQ ID NO: 595990 - DNA, 15 bp, Homo sapiens
ctgcagactcactgt

SEQ ID NO: 595991 - DNA, 12 bp, Homo sapiens
ctgcctaataaa

SEQ ID NO: 595992 - DNA, 16 bp, Homo sapiens
ctgcggcccctccccc

SEQ ID NO: 595993 - DNA, 16 bp, Homo sapiens
ctggcacttggactct

SEQ ID NO: 595994 - DNA, 13 bp, Homo sapiens
ctgggggatatta

SEQ ID NO: 595995 - DNA, 14 bp, Homo sapiens
ctggtgtctttgat

SEQ ID NO: 595996 - DNA, 20 bp, Homo sapiens
ctgtaatcccagcatgctga

SEQ ID NO: 595997 - DNA, 15 bp, Homo sapiens
ctgtacactgcacga

SEQ ID NO: 595998 - DNA, 19 bp, Homo sapiens
ctgtccaatttctattaaa

SEQ ID NO: 595999 - DNA, 22 bp, Homo sapiens
ctgtccaatttctattaaaggt

SEQ ID NO: 596000 - DNA, 21 bp, Homo sapiens
ctgtcgtgcaaacccagtgag

SEQ ID NO: 596001 - DNA, 18 bp, Homo sapiens
cttaaataaaaataatag

SEQ ID NO: 596002 - DNA, 19 bp, Homo sapiens
cttaatatatatatccaga

SEQ ID NO: 596003 - DNA, 24 bp, Homo sapiens
cttcatttgggatgctactctagt

SEQ ID NO: 596004 - DNA, 13 bp, Homo sapiens
cttccttcatttc

SEQ ID NO: 596005 - DNA, 13 bp, Homo sapiens
cttctctgttcat

SEQ ID NO: 596006 - DNA, 21 bp, Homo sapiens
cttcttacaataattctatga

SEQ ID NO: 596007 - DNA, 13 bp, Homo sapiens
cttgagcatctgg

SEQ ID NO: 596008 - DNA, 23 bp, Homo sapiens
ctttaggcattaaattttagcaa

SEQ ID NO: 596009 - DNA, 15 bp, Homo sapiens
ctttgcataaattaa

SEQ ID NO: 596010 - DNA, 21 bp, Homo sapiens
gaaatactttgcataaattaa

SEQ ID NO: 596011 - DNA, 17 bp, Homo sapiens
gaaattgcctgacgaac

SEQ ID NO: 596012 - DNA, 22 bp, Homo sapiens
gaactccttgattttagccttc

SEQ ID NO: 596013 - DNA, 13 bp, Homo sapiens
gaagataatcatt

SEQ ID NO: 596014 - DNA, 15 bp, Homo sapiens
gaagataatcattgc

SEQ ID NO: 596015 - DNA, 19 bp, Homo sapiens
gaagctttgtacctttaga

SEQ ID NO: 596016 - DNA, 19 bp, Homo sapiens
gaagggccttgagcatctg

SEQ ID NO: 596017 - DNA, 20 bp, Homo sapiens
gaatcagtgttaaattcatt

SEQ ID NO: 596018 - DNA, 23 bp, Homo sapiens
gaatggaccctctcctggactcg

SEQ ID NO: 596019 - DNA, 15 bp, Homo sapiens
gacaaaactagagac

SEQ ID NO: 596020 - DNA, 17 bp, Homo sapiens
gacacaatgctgggtgg

SEQ ID NO: 596021 - DNA, 14 bp, Homo sapiens
gacactcagaccag

SEQ ID NO: 596022 - DNA, 15 bp, Homo sapiens
gacagccctggggga

SEQ ID NO: 596023 - DNA, 18 bp, Homo sapiens
gacaggctgcggcccctc

SEQ ID NO: 596024 - DNA, 14 bp, Homo sapiens
gacaggctggcatt

SEQ ID NO: 596025 - DNA, 21 bp, Homo sapiens
gaccagctcccagatggccct

SEQ ID NO: 596026 - DNA, 12 bp, Homo sapiens
gacccccaggac

SEQ ID NO: 596027 - DNA, 13 bp, Homo sapiens
gacccccaggaca

SEQ ID NO: 596028 - DNA, 22 bp, Homo sapiens
gacccgttcaacttttcctttg

SEQ ID NO: 596029 - DNA, 14 bp, Homo sapiens
gactcgctagtcag

SEQ ID NO: 596030 - DNA, 18 bp, Homo sapiens
gacttacatgattcattt

SEQ ID NO: 596031 - DNA, 16 bp, Homo sapiens
gagtgtaggtgaaatg

SEQ ID NO: 596032 - DNA, 13 bp, Homo sapiens
gatatctcatctc

SEQ ID NO: 596033 - DNA, 17 bp, Homo sapiens
gattctgcctaataaaa

SEQ ID NO: 596034 - DNA, 14 bp, Homo sapiens
gattcttccatctg

SEQ ID NO: 596035 - DNA, 13 bp, Homo sapiens
gatttcttgcttt

SEQ ID NO: 596036 - DNA, 14 bp, Homo sapiens
gatttttacacatg

SEQ ID NO: 596037 - DNA, 22 bp, Homo sapiens
gcaaacccagtgagacagaccg

SEQ ID NO: 596038 - DNA, 15 bp, Homo sapiens
gcacttggctgcata

SEQ ID NO: 596039 - DNA, 14 bp, Homo sapiens
gcattactgcatgc

SEQ ID NO: 596040 - DNA, 17 bp, Homo sapiens
gcattactgcatgcact

SEQ ID NO: 596041 - DNA, 18 bp, Homo sapiens
gcattctagattactttt

SEQ ID NO: 596042 - DNA, 19 bp, Homo sapiens
gccaccttgtgtgtttaaa

SEQ ID NO: 596043 - DNA, 14 bp, Homo sapiens
gccccacttaccgc

SEQ ID NO: 596044 - DNA, 12 bp, Homo sapiens
gcccctcccccg

SEQ ID NO: 596045 - DNA, 19 bp, Homo sapiens
gcccctcccccgtcctgga

SEQ ID NO: 596046 - DNA, 15 bp, Homo sapiens
gccctgggggagcct

SEQ ID NO: 596047 - DNA, 18 bp, Homo sapiens
gcctccgggacccccagg

SEQ ID NO: 596048 - DNA, 16 bp, Homo sapiens
gccttctctgttcatt

SEQ ID NO: 596049 - DNA, 13 bp, Homo sapiens
gccttgagcatct

SEQ ID NO: 596050 - DNA, 15 bp, Homo sapiens
gccttgagcatctgg

SEQ ID NO: 596051 - DNA, 20 bp, Homo sapiens
gctactctagtattccagac

SEQ ID NO: 596052 - DNA, 14 bp, Homo sapiens
gctcttcatgtttc

SEQ ID NO: 596053 - DNA, 12 bp, Homo sapiens
gctgtacactgc

SEQ ID NO: 596054 - DNA, 17 bp, Homo sapiens
gcttccttcatttcctc

SEQ ID NO: 596055 - DNA, 15 bp, Homo sapiens
gcttggagtgcactg

SEQ ID NO: 596056 - DNA, 21 bp, Homo sapiens
gctttggggaaaaagaatgat

SEQ ID NO: 596057 - DNA, 19 bp, Homo sapiens
ggacaggctgcggcccctc

SEQ ID NO: 596058 - DNA, 21 bp, Homo sapiens
ggacaggctgcggcccctccc

SEQ ID NO: 596059 - DNA, 19 bp, Homo sapiens
ggacccccaggacaggctg

SEQ ID NO: 596060 - DNA, 20 bp, Homo sapiens
ggagagagttgaacctaaac

SEQ ID NO: 596061 - DNA, 18 bp, Homo sapiens
ggattctgcctaataaaa

SEQ ID NO: 596062 - DNA, 16 bp, Homo sapiens
ggattcttccatctga

SEQ ID NO: 596063 - DNA, 17 bp, Homo sapiens
ggcccctcccccgtcct

SEQ ID NO: 596064 - DNA, 14 bp, Homo sapiens
ggccctggacagca

SEQ ID NO: 596065 - DNA, 19 bp, Homo sapiens
ggggacttacatgattcat

SEQ ID NO: 596066 - DNA, 20 bp, Homo sapiens
ggggattcttccatctgatt

SEQ ID NO: 596067 - DNA, 17 bp, Homo sapiens
ggtttctgagttcctgc

SEQ ID NO: 596068 - DNA, 13 bp, Homo sapiens
gtaactcatctgt

SEQ ID NO: 596069 - DNA, 16 bp, Homo sapiens
gtaatgcgccaataaa

SEQ ID NO: 596070 - DNA, 19 bp, Homo sapiens
gtattccagacctgaagaa

SEQ ID NO: 596071 - DNA, 17 bp, Homo sapiens
gtatttgagaagataat

SEQ ID NO: 596072 - DNA, 18 bp, Homo sapiens
gtatttgagaagataatc

SEQ ID NO: 596073 - DNA, 15 bp, Homo sapiens
gtcatttcatttcct

SEQ ID NO: 596074 - DNA, 15 bp, Homo sapiens
gtccaactactaaac

SEQ ID NO: 596075 - DNA, 22 bp, Homo sapiens
gtgatccctagctgtgacctct

SEQ ID NO: 596076 - DNA, 15 bp, Homo sapiens
gtgatgtgagttgca

SEQ ID NO: 596077 - DNA, 21 bp, Homo sapiens
gtgccccctctggtgtctttg

SEQ ID NO: 596078 - DNA, 12 bp, Homo sapiens
gtgccttcattt

SEQ ID NO: 596079 - DNA, 12 bp, Homo sapiens
gtggtgtatttg

SEQ ID NO: 596080 - DNA, 14 bp, Homo sapiens
gttccctaagtcca

SEQ ID NO: 596081 - DNA, 23 bp, Homo sapiens
gttccctaagtccaactactaaa

SEQ ID NO: 596082 - DNA, 20 bp, Homo sapiens
gtttctgagttcctgcatgc

SEQ ID NO: 596083 - DNA, 13 bp, Homo sapiens
taaaaaattctct

SEQ ID NO: 596084 - DNA, 17 bp, Homo sapiens
taaataaaaataataga

SEQ ID NO: 596085 - DNA, 14 bp, Homo sapiens
taaccaataatggt

SEQ ID NO: 596086 - DNA, 23 bp, Homo sapiens
taagtccaactactaaactgggg

SEQ ID NO: 596087 - DNA, 21 bp, Homo sapiens
taatcagccccagagtgcttt

SEQ ID NO: 596088 - DNA, 21 bp, Homo sapiens
taatcccagcatgctgagatt

SEQ ID NO: 596089 - DNA, 16 bp, Homo sapiens
taatggtgccttcatt

SEQ ID NO: 596090 - DNA, 12 bp, Homo sapiens
taattttctacc

SEQ ID NO: 596091 - DNA, 16 bp, Homo sapiens
tacagctatgaagtgc

SEQ ID NO: 596092 - DNA, 18 bp, Homo sapiens
agaggcacctgtcccaga

SEQ ID NO: 596093 - DNA, 20 bp, Homo sapiens
agagtgtaggtgaaatgaat

SEQ ID NO: 596094 - DNA, 12 bp, Homo sapiens
agcattctgtct

SEQ ID NO: 596095 - DNA, 17 bp, Homo sapiens
agccccacttaccgcgt

SEQ ID NO: 596096 - DNA, 23 bp, Homo sapiens
agccttctctgttcatttcctca

SEQ ID NO: 596097 - DNA, 19 bp, Homo sapiens
aggaaatactttgcataaa

SEQ ID NO: 596098 - DNA, 17 bp, Homo sapiens
aggctgcggcccctccc

SEQ ID NO: 596099 - DNA, 16 bp, Homo sapiens
aggcttccttcatttc

SEQ ID NO: 596100 - DNA, 21 bp, Homo sapiens
aggtgcttcaggataccatat

SEQ ID NO: 596101 - DNA, 21 bp, Homo sapiens
aggtgtcatacagatttgcaa

SEQ ID NO: 596102 - DNA, 17 bp, Homo sapiens
aggttcctttgttccct

SEQ ID NO: 596103 - DNA, 22 bp, Homo sapiens
agtcttaatatatatatccaga

SEQ ID NO: 596104 - DNA, 16 bp, Homo sapiens
agtgagacagaccgcc

SEQ ID NO: 596105 - DNA, 21 bp, Homo sapiens
ataatagactcgctagtcagt

SEQ ID NO: 596106 - DNA, 13 bp, Homo sapiens
ataatcattgctt

SEQ ID NO: 596107 - DNA, 17 bp, Homo sapiens
atcaaacacggacccat

SEQ ID NO: 596108 - DNA, 18 bp, Homo sapiens
atcagtgttaaattcatt

SEQ ID NO: 596109 - DNA, 13 bp, Homo sapiens
atccacccaaata

SEQ ID NO: 596110 - DNA, 14 bp, Homo sapiens
atccctagctgtga

SEQ ID NO: 596111 - DNA, 22 bp, Homo sapiens
atctgagaaaagctttgaaccc

SEQ ID NO: 596112 - DNA, 17 bp, Homo sapiens
atctgattgtgatgtga

SEQ ID NO: 596113 - DNA, 18 bp, Homo sapiens
atgaaggtgtcatacaga

SEQ ID NO: 596114 - DNA, 16 bp, Homo sapiens
atgatttcttgctttg

SEQ ID NO: 596115 - DNA, 11 bp, Homo sapiens
atgcatatact

SEQ ID NO: 596116 - DNA, 15 bp, Homo sapiens
atgcgccaataaacc

SEQ ID NO: 596117 - DNA, 18 bp, Homo sapiens
atgcgccaataaaccaat

SEQ ID NO: 596118 - DNA, 14 bp, Homo sapiens
atggtgccttcatt

SEQ ID NO: 596119 - DNA, 21 bp, Homo sapiens
attaaaggttcctttgttccc

SEQ ID NO: 596120 - DNA, 17 bp, Homo sapiens
attactgcatgcacttc

SEQ ID NO: 596121 - DNA, 18 bp, Homo sapiens
attccagacctgaagaat

SEQ ID NO: 596122 - DNA, 16 bp, Homo sapiens
attctgcctaataaaa

SEQ ID NO: 596123 - DNA, 12 bp, Homo sapiens
attgttgcatta

SEQ ID NO: 596124 - DNA, 18 bp, Homo sapiens
atttcttttttaaatgaa

SEQ ID NO: 596125 - DNA, 23 bp, Homo sapiens
atttgagaagataatcattgctt

SEQ ID NO: 596126 - DNA, 23 bp, Homo sapiens
caaactgtcgtgcaaacccagtg

SEQ ID NO: 596127 - DNA, 13 bp, Homo sapiens
caactaaaaataa

SEQ ID NO: 596128 - DNA, 20 bp, Homo sapiens
caacttttcctttgaatcct

SEQ ID NO: 596129 - DNA, 13 bp, Homo sapiens
caagtttactttt

SEQ ID NO: 596130 - DNA, 20 bp, Homo sapiens
caataaaccaatgaacgaag

SEQ ID NO: 596131 - DNA, 13 bp, Homo sapiens
caatcaaataata

SEQ ID NO: 596132 - DNA, 19 bp, Homo sapiens
caatttctattaaaggttc

SEQ ID NO: 596133 - DNA, 15 bp, Homo sapiens
cacaatgctgggtgg

SEQ ID NO: 596134 - DNA, 12 bp, Homo sapiens
cacagctatgaa

SEQ ID NO: 596135 - DNA, 22 bp, Homo sapiens
cacagctatgaaggctgtacac

SEQ ID NO: 596136 - DNA, 19 bp, Homo sapiens
cacttcttacaataattct

SEQ ID NO: 596137 - DNA, 23 bp, Homo sapiens
cagagtgctttaaaaaattctct

SEQ ID NO: 596138 - DNA, 15 bp, Homo sapiens
cagatggttgcaatt

SEQ ID NO: 596139 - DNA, 22 bp, Homo sapiens
cagatggttgcaattgatcctt

SEQ ID NO: 596140 - DNA, 12 bp, Homo sapiens
cagcaggagagg

SEQ ID NO: 596141 - DNA, 16 bp, Homo sapiens
cagctatgaagtgctg

SEQ ID NO: 596142 - DNA, 15 bp, Homo sapiens
cagctcccagatggc

SEQ ID NO: 596143 - DNA, 18 bp, Homo sapiens
caggacaggctgcggccc

SEQ ID NO: 596144 - DNA, 23 bp, Homo sapiens
caggacaggctgcggcccctccc

SEQ ID NO: 596145 - DNA, 18 bp, Homo sapiens
caggctgcggcccctccc

SEQ ID NO: 596146 - DNA, 23 bp, Homo sapiens
cagggagccacacagagatgtcc

SEQ ID NO: 596147 - DNA, 14 bp, Homo sapiens
caggtaggaggcaa

SEQ ID NO: 596148 - DNA, 23 bp, Homo sapiens
caggtaggaggcaaatatcttga

SEQ ID NO: 596149 - DNA, 18 bp, Homo sapiens
cataaccttaccagattt

SEQ ID NO: 596150 - DNA, 20 bp, Homo sapiens
catacacctatgtcatttca

SEQ ID NO: 596151 - DNA, 22 bp, Homo sapiens
catagacagccctgggggagcc

SEQ ID NO: 596152 - DNA, 17 bp, Homo sapiens
catatacagctcagaag

SEQ ID NO: 596153 - DNA, 22 bp, Homo sapiens
catctagaggcttccttcattt

SEQ ID NO: 596154 - DNA, 23 bp, Homo sapiens
catctgagaaaagctttgaaccc

SEQ ID NO: 596155 - DNA, 20 bp, Homo sapiens
catgaacctcaagctgcatc

SEQ ID NO: 596156 - DNA, 13 bp, Homo sapiens
catgattcatttt

SEQ ID NO: 596157 - DNA, 14 bp, Homo sapiens
catgattcatttta

SEQ ID NO: 596158 - DNA, 15 bp, Homo sapiens
catgcattactgcat

SEQ ID NO: 596159 - DNA, 12 bp, Homo sapiens
catggctatctg

SEQ ID NO: 596160 - DNA, 23 bp, Homo sapiens
catgtatctatgcattttctgga

SEQ ID NO: 596161 - DNA, 22 bp, Homo sapiens
cattaaaaatgcatatacttta

SEQ ID NO: 596162 - DNA, 23 bp, Homo sapiens
cattactgcatgcacttcttaca

SEQ ID NO: 596163 - DNA, 16 bp, Homo sapiens
cattctagattacttt

SEQ ID NO: 596164 - DNA, 15 bp, Homo sapiens
catttaggtttctga

SEQ ID NO: 596165 - DNA, 17 bp, Homo sapiens
catttatgagctcttca

SEQ ID NO: 596166 - DNA, 20 bp, Homo sapiens
catttatgagctcttcatgt

SEQ ID NO: 596167 - DNA, 12 bp, Homo sapiens
ccaaagatccac

SEQ ID NO: 596168 - DNA, 22 bp, Homo sapiens
ccaagccttggggattcttcca

SEQ ID NO: 596169 - DNA, 18 bp, Homo sapiens
ccaatttctattaaaggt

SEQ ID NO: 596170 - DNA, 17 bp, Homo sapiens
cccacgaatggaccctc

SEQ ID NO: 596171 - DNA, 21 bp, Homo sapiens
cccccaggacaggctgcggcc

SEQ ID NO: 596172 - DNA, 23 bp, Homo sapiens
ccccgtcctggaggttccccagc

SEQ ID NO: 596173 - DNA, 15 bp, Homo sapiens
cccctcccccgtcct

SEQ ID NO: 596174 - DNA, 20 bp, Homo sapiens
ccctaagtccaactactaaa

SEQ ID NO: 596175 - DNA, 20 bp, Homo sapiens
ccctgccctggcacttggac

SEQ ID NO: 596176 - DNA, 15 bp, Homo sapiens
ccctggaactgtctc

SEQ ID NO: 596177 - DNA, 16 bp, Homo sapiens
ccctgggggagcctct

SEQ ID NO: 596178 - DNA, 21 bp, Homo sapiens
ccgcctccgggacccccagga

SEQ ID NO: 596179 - DNA, 18 bp, Homo sapiens
cctatgtcatttcatttc

SEQ ID NO: 596180 - DNA, 20 bp, Homo sapiens
cctcaaaaagatttccccat

SEQ ID NO: 596181 - DNA, 15 bp, Homo sapiens
cctcaagctgcatct

SEQ ID NO: 596182 - DNA, 18 bp, Homo sapiens
cctccgggacccccagga

SEQ ID NO: 596183 - DNA, 17 bp, Homo sapiens
ccttcagccacagggag

SEQ ID NO: 596184 - DNA, 21 bp, Homo sapiens
ccttgattttagccttctctg

SEQ ID NO: 596185 - DNA, 22 bp, Homo sapiens
ccttgattttagccttctctgt

SEQ ID NO: 596186 - DNA, 21 bp, Homo sapiens
ccttgttctgataatgaaaat

SEQ ID NO: 596187 - DNA, 12 bp, Homo sapiens
cctttgttccct

SEQ ID NO: 596188 - DNA, 21 bp, Homo sapiens
cgccgcctccgggacccccag

SEQ ID NO: 596189 - DNA, 20 bp, Homo sapiens
cgcctccgggacccccagga

SEQ ID NO: 596190 - DNA, 15 bp, Homo sapiens
ctaataaaaaacatt

SEQ ID NO: 596191 - DNA, 19 bp, Homo sapiens
ctaataaaaaacatttatt

SEQ ID NO: 596192 - DNA, 18 bp, Homo sapiens
ctacaactaaaaataaat

SEQ ID NO: 596193 - DNA, 15 bp, Homo sapiens
ctactgcaaatggca

SEQ ID NO: 596194 - DNA, 22 bp, Homo sapiens
ctacttacatgcattactgcat

SEQ ID NO: 596195 - DNA, 13 bp, Homo sapiens
ctagattactttt

SEQ ID NO: 596196 - DNA, 23 bp, Homo sapiens
ctagtattccagacctgaagaat

SEQ ID NO: 596197 - DNA, 13 bp, Homo sapiens
ctagtcataacct

SEQ ID NO: 596198 - DNA, 21 bp, Homo sapiens
ctagtcatttccaaacttgaa

SEQ ID NO: 596199 - DNA, 14 bp, Homo sapiens
ctagtgactgggga

SEQ ID NO: 596200 - DNA, 15 bp, Homo sapiens
attctgcaagcaata

SEQ ID NO: 596201 - DNA, 15 bp, Homo sapiens
attctgcaagcaatc

SEQ ID NO: 596202 - DNA, 14 bp, Homo sapiens
attctgtcttgaag

SEQ ID NO: 596203 - DNA, 14 bp, Homo sapiens
attcttccatctga

SEQ ID NO: 596204 - DNA, 15 bp, Homo sapiens
attcttccatctgat

SEQ ID NO: 596205 - DNA, 23 bp, Homo sapiens
attcttccatctgattgtgatgt

SEQ ID NO: 596206 - DNA, 23 bp, Homo sapiens
attggtgggtggtgtatttgaga

SEQ ID NO: 596207 - DNA, 19 bp, Homo sapiens
atttcctatttttggaaga

SEQ ID NO: 596208 - DNA, 14 bp, Homo sapiens
atttctattaaagg

SEQ ID NO: 596209 - DNA, 18 bp, Homo sapiens
attttagccttctctgtt

SEQ ID NO: 596210 - DNA, 21 bp, Homo sapiens
attttagccttctctgttcat

SEQ ID NO: 596211 - DNA, 23 bp, Homo sapiens
atttttggaagaggactccttaa

SEQ ID NO: 596212 - DNA, 14 bp, Homo sapiens
caataattttctac

SEQ ID NO: 596213 - DNA, 13 bp, Homo sapiens
caatgctgggtgg

SEQ ID NO: 596214 - DNA, 15 bp, Homo sapiens
cacacagagatgtcc

SEQ ID NO: 596215 - DNA, 14 bp, Homo sapiens
cacagagatgtcca

SEQ ID NO: 596216 - DNA, 13 bp, Homo sapiens
cagaatcagtgtt

SEQ ID NO: 596217 - DNA, 22 bp, Homo sapiens
cagaatcagtgttaaattcatt

SEQ ID NO: 596218 - DNA, 16 bp, Homo sapiens
cagatggcatgtgttt

SEQ ID NO: 596219 - DNA, 14 bp, Homo sapiens
cagccacagggagc

SEQ ID NO: 596220 - DNA, 16 bp, Homo sapiens
cagtaactcatctgtc

SEQ ID NO: 596221 - DNA, 14 bp, Homo sapiens
cagtgaaaaactat

SEQ ID NO: 596222 - DNA, 20 bp, Homo sapiens
cagtggacactcagaccagc

SEQ ID NO: 596223 - DNA, 16 bp, Homo sapiens
catatgatttcttgct

SEQ ID NO: 596224 - DNA, 21 bp, Homo sapiens
catctagaggcttccttcatt

SEQ ID NO: 596225 - DNA, 23 bp, Homo sapiens
catctagaggcttccttcatttc

SEQ ID NO: 596226 - DNA, 14 bp, Homo sapiens
catctgagaaaagc

SEQ ID NO: 596227 - DNA, 19 bp, Homo sapiens
catgaacctcaagctgcat

SEQ ID NO: 596228 - DNA, 18 bp, Homo sapiens
catgattcattttaacat

SEQ ID NO: 596229 - DNA, 17 bp, Homo sapiens
catgcacttggctgcat

SEQ ID NO: 596230 - DNA, 17 bp, Homo sapiens
catgcattactgcatgc

SEQ ID NO: 596231 - DNA, 16 bp, Homo sapiens
cattactgcatgcact

SEQ ID NO: 596232 - DNA, 15 bp, Homo sapiens
cattctgtcttgaag

SEQ ID NO: 596233 - DNA, 23 bp, Homo sapiens
catttatgagctcttcatgtttc

SEQ ID NO: 596234 - DNA, 14 bp, Homo sapiens
catttcatttccta

SEQ ID NO: 596235 - DNA, 16 bp, Homo sapiens
catttccaaacttgaa

SEQ ID NO: 596236 - DNA, 18 bp, Homo sapiens
ttatgagctcttcatgtt

SEQ ID NO: 596237 - DNA, 16 bp, Homo sapiens
ttattaaggaaatact

SEQ ID NO: 596238 - DNA, 20 bp, Homo sapiens
ttattcttattaaggaaata

SEQ ID NO: 596239 - DNA, 12 bp, Homo sapiens
ttccatctgatt

SEQ ID NO: 596240 - DNA, 21 bp, Homo sapiens
ttcctacaactaaaaataaat

SEQ ID NO: 596241 - DNA, 23 bp, Homo sapiens
ttcctacaactaaaaataaatta

SEQ ID NO: 596242 - DNA, 11 bp, Homo sapiens
ttcctttgttc

SEQ ID NO: 596243 - DNA, 13 bp, Homo sapiens
ttcctttgttccc

SEQ ID NO: 596244 - DNA, 16 bp, Homo sapiens
ttctgataatgaaaat

SEQ ID NO: 596245 - DNA, 13 bp, Homo sapiens
ttcttccatctga

SEQ ID NO: 596246 - DNA, 22 bp, Homo sapiens
ttgataaaaacccaaaatacag

SEQ ID NO: 596247 - DNA, 12 bp, Homo sapiens
ttgcataaatta

SEQ ID NO: 596248 - DNA, 18 bp, Homo sapiens
ttgtgatgtgagttgcac

SEQ ID NO: 596249 - DNA, 17 bp, Homo sapiens
ttgtgtgtttaaagaag

SEQ ID NO: 596250 - DNA, 14 bp, Homo sapiens
tttaaatgaagaaa

SEQ ID NO: 596251 - DNA, 21 bp, Homo sapiens
tttactttttttctgatgttt

SEQ ID NO: 596252 - DNA, 18 bp, Homo sapiens
tttagagtgtaggtgaaa

SEQ ID NO: 596253 - DNA, 23 bp, Homo sapiens
tttagagtgtaggtgaaatgaat

SEQ ID NO: 596254 - DNA, 20 bp, Homo sapiens
tttatgttactacatgcact

SEQ ID NO: 596255 - DNA, 22 bp, Homo sapiens
tttcaggagagagttgaaccta

SEQ ID NO: 596256 - DNA, 18 bp, Homo sapiens
tttccaaacttgaaaaca

SEQ ID NO: 596257 - DNA, 21 bp, Homo sapiens
tttcctacaactaaaaataaa

SEQ ID NO: 596258 - DNA, 23 bp, Homo sapiens
ttttagcaaagatatctcatctc

SEQ ID NO: 596259 - DNA, 23 bp, Homo sapiens
ttttagccttctctgttcatttc

SEQ ID NO: 596260 - DNA, 23 bp, Homo sapiens
aattgcctgacgaactccttgat

SEQ ID NO: 596261 - DNA, 15 bp, Homo sapiens
aatttctattaaagg

SEQ ID NO: 596262 - DNA, 14 bp, Homo sapiens
aatttgataaaaac

SEQ ID NO: 596263 - DNA, 21 bp, Homo sapiens
aatttgggggacttacatgat

SEQ ID NO: 596264 - DNA, 17 bp, Homo sapiens
acaactaaaaataaatt

SEQ ID NO: 596265 - DNA, 21 bp, Homo sapiens
acaagcattctgtcttgaagg

SEQ ID NO: 596266 - DNA, 14 bp, Homo sapiens
acaataattttcta

SEQ ID NO: 596267 - DNA, 16 bp, Homo sapiens
acaattaaagctgtta

SEQ ID NO: 596268 - DNA, 20 bp, Homo sapiens
acacctatgtcatttcattt

SEQ ID NO: 596269 - DNA, 21 bp, Homo sapiens
acaggctgcggcccctccccc

SEQ ID NO: 596270 - DNA, 18 bp, Homo sapiens
acatgcacttggctgcat

SEQ ID NO: 596271 - DNA, 22 bp, Homo sapiens
acatgcacttggctgcataaat

SEQ ID NO: 596272 - DNA, 20 bp, Homo sapiens
acatgcattactgcatgcac

SEQ ID NO: 596273 - DNA, 18 bp, Homo sapiens
acatgtatctatgcattt

SEQ ID NO: 596274 - DNA, 15 bp, Homo sapiens
accagctcccagatg

SEQ ID NO: 596275 - DNA, 16 bp, Homo sapiens
accgcgtaatgcgcca

SEQ ID NO: 596276 - DNA, 11 bp, Homo sapiens
acctgaagaat

SEQ ID NO: 596277 - DNA, 14 bp, Homo sapiens
acctgaagaatcac

SEQ ID NO: 596278 - DNA, 22 bp, Homo sapiens
acggactcagtggacactcaga

SEQ ID NO: 596279 - DNA, 15 bp, Homo sapiens
actaaaaataaatta

SEQ ID NO: 596280 - DNA, 21 bp, Homo sapiens
actcagaccagctcccagatg

SEQ ID NO: 596281 - DNA, 15 bp, Homo sapiens
actgtctctcatgaa

SEQ ID NO: 596282 - DNA, 14 bp, Homo sapiens
acttacatgattca

SEQ ID NO: 596283 - DNA, 17 bp, Homo sapiens
acttacatgattcattt

SEQ ID NO: 596284 - DNA, 20 bp, Homo sapiens
acttaccgcgtaatgcgcca

SEQ ID NO: 596285 - DNA, 14 bp, Homo sapiens
acttgaaaacagaa

SEQ ID NO: 596286 - DNA, 16 bp, Homo sapiens
actttgcataaattaa

SEQ ID NO: 596287 - DNA, 14 bp, Homo sapiens
agaaaagctttgaa

SEQ ID NO: 596288 - DNA, 14 bp, Homo sapiens
agaagataatcatt

SEQ ID NO: 596289 - DNA, 19 bp, Homo sapiens
agaccagctcccagatggc

SEQ ID NO: 596290 - DNA, 13 bp, Homo sapiens
agaccgccaaata

SEQ ID NO: 596291 - DNA, 13 bp, Homo sapiens
agacctgaagaat

SEQ ID NO: 596292 - DNA, 15 bp, Homo sapiens
agagagttgaaccta

SEQ ID NO: 596293 - DNA, 13 bp, Homo sapiens
agagttgaaccta

SEQ ID NO: 596294 - DNA, 21 bp, Homo sapiens
agcatatgatttcttgctttg

SEQ ID NO: 596295 - DNA, 19 bp, Homo sapiens
agcatctggattctgccta

SEQ ID NO: 596296 - DNA, 13 bp, Homo sapiens
agccccacttacc

SEQ ID NO: 596297 - DNA, 23 bp, Homo sapiens
agccttggggattcttccatctg

SEQ ID NO: 596298 - DNA, 13 bp, Homo sapiens
agctcttcatgtt

SEQ ID NO: 596299 - DNA, 16 bp, Homo sapiens
agctcttcatgtttca

SEQ ID NO: 596300 - DNA, 17 bp, Homo sapiens
agctgtgacctctcccc

SEQ ID NO: 596301 - DNA, 12 bp, Homo sapiens
aggacaggctgc

SEQ ID NO: 596302 - DNA, 21 bp, Homo sapiens
aggacaggctgcggcccctcc

SEQ ID NO: 596303 - DNA, 22 bp, Homo sapiens
aggcattaaattttagcaaaga

SEQ ID NO: 596304 - DNA, 18 bp, Homo sapiens
aggctgcggcccctcccc

SEQ ID NO: 596305 - DNA, 19 bp, Homo sapiens
aggctgcggcccctccccc

SEQ ID NO: 596306 - DNA, 18 bp, Homo sapiens
agggccttgagcatctgg

SEQ ID NO: 596307 - DNA, 12 bp, Homo sapiens
aggtactattat

SEQ ID NO: 596308 - DNA, 21 bp, Homo sapiens
aggtttctgagttcctgcatg

SEQ ID NO: 596309 - DNA, 20 bp, Homo sapiens
agtattccagacctgaagaa

SEQ ID NO: 596310 - DNA, 14 bp, Homo sapiens
agtgttaaattcat

SEQ ID NO: 596311 - DNA, 16 bp, Homo sapiens
agttgcacagctatga

SEQ ID NO: 596312 - DNA, 20 bp, Homo sapiens
agtttaatggtgccttcatt

SEQ ID NO: 596313 - DNA, 23 bp, Homo sapiens
agtttactttttttctgatgttt

SEQ ID NO: 596314 - DNA, 15 bp, Homo sapiens
ataaaaaacatttat

SEQ ID NO: 596315 - DNA, 13 bp, Homo sapiens
ataaaaataatag

SEQ ID NO: 596316 - DNA, 18 bp, Homo sapiens
ataaacggactcagtgga

SEQ ID NO: 596317 - DNA, 16 bp, Homo sapiens
ataatcattgcttatg

SEQ ID NO: 596318 - DNA, 18 bp, Homo sapiens
atactttgcataaattaa

SEQ ID NO: 596319 - DNA, 15 bp, Homo sapiens
atatacagctcagaa

SEQ ID NO: 596320 - DNA, 16 bp, Homo sapiens
atatgatttcttgctt

SEQ ID NO: 596321 - DNA, 22 bp, Homo sapiens
atcagccccagagtgctttaaa

SEQ ID NO: 596322 - DNA, 17 bp, Homo sapiens
atcagtgttaaattcat

SEQ ID NO: 596323 - DNA, 20 bp, Homo sapiens
atcagtgttaaattcatttt

SEQ ID NO: 596324 - DNA, 17 bp, Homo sapiens
atctagaggcttccttc

SEQ ID NO: 596325 - DNA, 19 bp, Homo sapiens
atctagaggcttccttcat

SEQ ID NO: 596326 - DNA, 23 bp, Homo sapiens
atctagaggcttccttcatttcc

SEQ ID NO: 596327 - DNA, 18 bp, Homo sapiens
atctatgcattttctgga

SEQ ID NO: 596328 - DNA, 21 bp, Homo sapiens
atgaagggccttgagcatctg

SEQ ID NO: 596329 - DNA, 16 bp, Homo sapiens
atgatgggtgttttta

SEQ ID NO: 596330 - DNA, 14 bp, Homo sapiens
atgctatgaaattg

SEQ ID NO: 596331 - DNA, 21 bp, Homo sapiens
atgctgagattacaggtgtga

SEQ ID NO: 596332 - DNA, 15 bp, Homo sapiens
atgtcatttcatttc

SEQ ID NO: 596333 - DNA, 17 bp, Homo sapiens
atgtgccatttttcaga

SEQ ID NO: 596334 - DNA, 17 bp, Homo sapiens
atgttactacatgcact

SEQ ID NO: 596335 - DNA, 17 bp, Homo sapiens
attagccagtgaaaaac

SEQ ID NO: 596336 - DNA, 18 bp, Homo sapiens
attattgttgcattaaaa

SEQ ID NO: 596337 - DNA, 15 bp, Homo sapiens
attcattttattctt

SEQ ID NO: 596338 - DNA, 21 bp, Homo sapiens
attctcttaaataaaaataat

SEQ ID NO: 596339 - DNA, 17 bp, Homo sapiens
atttaggtttctgagtt

SEQ ID NO: 596340 - DNA, 23 bp, Homo sapiens
atttaggtttctgagttcctgca

SEQ ID NO: 596341 - DNA, 22 bp, Homo sapiens
atttcttttttaaatgaagaaa

SEQ ID NO: 596342 - DNA, 19 bp, Homo sapiens
atttgagaagataatcatt

SEQ ID NO: 596343 - DNA, 17 bp, Homo sapiens
atttgataaaaacccaa

SEQ ID NO: 596344 - DNA, 17 bp, Homo sapiens
caaagatatctcatctc

SEQ ID NO: 596345 - DNA, 21 bp, Homo sapiens
caaataaacggactcagtgga

SEQ ID NO: 596346 - DNA, 14 bp, Homo sapiens
caaatggcagtttt

SEQ ID NO: 596347 - DNA, 15 bp, Homo sapiens
caactaaaaataaat

SEQ ID NO: 596348 - DNA, 17 bp, Homo sapiens
caactaaaaataaatta

SEQ ID NO: 596349 - DNA, 11 bp, Homo sapiens
caactactaaa

SEQ ID NO: 596350 - DNA, 14 bp, Homo sapiens
caagcattctgtct

SEQ ID NO: 596351 - DNA, 16 bp, Homo sapiens
caataaaccaatgaac

SEQ ID NO: 596352 - DNA, 19 bp, Homo sapiens
caataaaccaatgaacgaa

SEQ ID NO: 596353 - DNA, 22 bp, Homo sapiens
caattgatccttaaccaataat

SEQ ID NO: 596354 - DNA, 16 bp, Homo sapiens
caatttctattaaagg

SEQ ID NO: 596355 - DNA, 17 bp, Homo sapiens
cacatgtatctatgcat

SEQ ID NO: 596356 - DNA, 19 bp, Homo sapiens
cacctatgtcatttcattt

SEQ ID NO: 596357 - DNA, 20 bp, Homo sapiens
cacctatgtcatttcatttc

SEQ ID NO: 596358 - DNA, 23 bp, Homo sapiens
cacctatgtcatttcatttccta

SEQ ID NO: 596359 - DNA, 14 bp, Homo sapiens
cacctgtcccagaa

SEQ ID NO: 596360 - DNA, 15 bp, Homo sapiens
cacctgtcccagaaa

SEQ ID NO: 596361 - DNA, 18 bp, Homo sapiens
cagacaggctggcattct

SEQ ID NO: 596362 - DNA, 22 bp, Homo sapiens
cagatggcatgtgtttacttta

SEQ ID NO: 596363 - DNA, 16 bp, Homo sapiens
cagatttttacacatg

SEQ ID NO: 596364 - DNA, 13 bp, Homo sapiens
cagccctggggga

SEQ ID NO: 596365 - DNA, 21 bp, Homo sapiens
cagctcagaagtttcttcttt

SEQ ID NO: 596366 - DNA, 22 bp, Homo sapiens
cagctcagaagtttcttcttta

SEQ ID NO: 596367 - DNA, 22 bp, Homo sapiens
caggacaggctgcggcccctcc

SEQ ID NO: 596368 - DNA, 19 bp, Homo sapiens
caggagagagttgaaccta

SEQ ID NO: 596369 - DNA, 15 bp, Homo sapiens
caggctgcggcccct

SEQ ID NO: 596370 - DNA, 16 bp, Homo sapiens
caggctgcggcccctc

SEQ ID NO: 596371 - DNA, 14 bp, Homo sapiens
cagtgttaaattca

SEQ ID NO: 596372 - DNA, 12 bp, Homo sapiens
tgttaaattcat

SEQ ID NO: 596373 - DNA, 16 bp, Homo sapiens
tgttaaattcatttta

SEQ ID NO: 596374 - DNA, 21 bp, Homo sapiens
tgttacccagtaactcatctg

SEQ ID NO: 596375 - DNA, 14 bp, Homo sapiens
tgttcatttcctca

SEQ ID NO: 596376 - DNA, 12 bp, Homo sapiens
tgttttttctaa

SEQ ID NO: 596377 - DNA, 13 bp, Homo sapiens
ttaaaaaattctc

SEQ ID NO: 596378 - DNA, 17 bp, Homo sapiens
ttaatcagccccagagt

SEQ ID NO: 596379 - DNA, 16 bp, Homo sapiens
ttacatgattcatttt

SEQ ID NO: 596380 - DNA, 22 bp, Homo sapiens
ttaccgcgtaatgcgccaataa

SEQ ID NO: 596381 - DNA, 22 bp, Homo sapiens
ttacttcgtgtccgactcttct

SEQ ID NO: 596382 - DNA, 22 bp, Homo sapiens
ttatgaagggccttgagcatct

SEQ ID NO: 596383 - DNA, 13 bp, Homo sapiens
ttcatttcctcaa

SEQ ID NO: 596384 - DNA, 16 bp, Homo sapiens
ttcatttcctccgtca

SEQ ID NO: 596385 - DNA, 17 bp, Homo sapiens
ttctaattggcatgaag

SEQ ID NO: 596386 - DNA, 12 bp, Homo sapiens
ttctattaaagg

SEQ ID NO: 596387 - DNA, 12 bp, Homo sapiens
ttctgagttcct

SEQ ID NO: 596388 - DNA, 14 bp, Homo sapiens
ttctgcctaataaa

SEQ ID NO: 596389 - DNA, 13 bp, Homo sapiens
ttgctgtccaatt

SEQ ID NO: 596390 - DNA, 22 bp, Homo sapiens
ttgctgtccaatttctattaaa

SEQ ID NO: 596391 - DNA, 23 bp, Homo sapiens
ttggtggtctcttcacacggacg

SEQ ID NO: 596392 - DNA, 11 bp, Homo sapiens
ttgtgaagagg

SEQ ID NO: 596393 - DNA, 16 bp, Homo sapiens
tttagccttctctgtt

SEQ ID NO: 596394 - DNA, 14 bp, Homo sapiens
tttctattaaaggt

SEQ ID NO: 596395 - DNA, 16 bp, Homo sapiens
tttctgagttcctgca

SEQ ID NO: 596396 - DNA, 13 bp, Homo sapiens
tttgataaaaacc

SEQ ID NO: 596397 - DNA, 15 bp, Homo sapiens
tttgcataaattaat

SEQ ID NO: 596398 - DNA, 16 bp, Homo sapiens
ttttagccttctctgt

SEQ ID NO: 596399 - DNA, 17 bp, Homo sapiens
ttttcctttgaatcctc

SEQ ID NO: 596400 - DNA, 23 bp, Homo sapiens
gggaagctttgtacctttagagt

SEQ ID NO: 596401 - DNA, 13 bp, Homo sapiens
gggacccccagga

SEQ ID NO: 596402 - DNA, 16 bp, Homo sapiens
gggccttgagcatctg

SEQ ID NO: 596403 - DNA, 15 bp, Homo sapiens
ggttcctttgttccc

SEQ ID NO: 596404 - DNA, 16 bp, Homo sapiens
ggttcctttgttccct

SEQ ID NO: 596405 - DNA, 20 bp, Homo sapiens
ggttcctttgttccctaagt

SEQ ID NO: 596406 - DNA, 13 bp, Homo sapiens
gtagtatgatggg

SEQ ID NO: 596407 - DNA, 21 bp, Homo sapiens
gtcacctcagagacatacacc

SEQ ID NO: 596408 - DNA, 13 bp, Homo sapiens
gtccaactactaa

SEQ ID NO: 596409 - DNA, 14 bp, Homo sapiens
gtccaactactaaa

SEQ ID NO: 596410 - DNA, 14 bp, Homo sapiens
gtccaatttctatt

SEQ ID NO: 596411 - DNA, 19 bp, Homo sapiens
gtccaatttctattaaagg

SEQ ID NO: 596412 - DNA, 22 bp, Homo sapiens
gtccaatttctattaaaggttc

SEQ ID NO: 596413 - DNA, 15 bp, Homo sapiens
gttactacatgcact

SEQ ID NO: 596414 - DNA, 19 bp, Homo sapiens
gttcaacttttcctttgaa

SEQ ID NO: 596415 - DNA, 13 bp, Homo sapiens
gttcatttcctca

SEQ ID NO: 596416 - DNA, 16 bp, Homo sapiens
gttgcacagctatgaa

SEQ ID NO: 596417 - DNA, 20 bp, Homo sapiens
gttgcattaaaaatgcatat

SEQ ID NO: 596418 - DNA, 22 bp, Homo sapiens
gtttcaggagagagttgaacct

SEQ ID NO: 596419 - DNA, 22 bp, Homo sapiens
taaaattttgaaccattcccta

SEQ ID NO: 596420 - DNA, 17 bp, Homo sapiens
taaaccaatgaacgaag

SEQ ID NO: 596421 - DNA, 20 bp, Homo sapiens
taaaggttcctttgttccct

SEQ ID NO: 596422 - DNA, 16 bp, Homo sapiens
taaataaaaataatag

SEQ ID NO: 596423 - DNA, 21 bp, Homo sapiens
taaccttaccagatttttaca

SEQ ID NO: 596424 - DNA, 14 bp, Homo sapiens
taactcatctgtca

SEQ ID NO: 596425 - DNA, 15 bp, Homo sapiens
taactcatctgtcac

SEQ ID NO: 596426 - DNA, 19 bp, Homo sapiens
taagtccaactactaaact

SEQ ID NO: 596427 - DNA, 23 bp, Homo sapiens
taataaaaaacatttattttcat

SEQ ID NO: 596428 - DNA, 21 bp, Homo sapiens
taatagactcgctagtcagta

SEQ ID NO: 596429 - DNA, 16 bp, Homo sapiens
taatcagccccagagt

SEQ ID NO: 596430 - DNA, 20 bp, Homo sapiens
taatcagccccagagtgctt

SEQ ID NO: 596431 - DNA, 14 bp, Homo sapiens
taatcattgcttat

SEQ ID NO: 596432 - DNA, 20 bp, Homo sapiens
taatcattgcttatgtcaaa

SEQ ID NO: 596433 - DNA, 17 bp, Homo sapiens
tacaactaaaaataaat

SEQ ID NO: 596434 - DNA, 18 bp, Homo sapiens
tacaactaaaaataaatt

SEQ ID NO: 596435 - DNA, 19 bp, Homo sapiens
tacaactaaaaataaatta

SEQ ID NO: 596436 - DNA, 19 bp, Homo sapiens
tacaattaaagctgttatt

SEQ ID NO: 596437 - DNA, 14 bp, Homo sapiens
tacacctatgtcat

SEQ ID NO: 596438 - DNA, 17 bp, Homo sapiens
tacacctatgtcatttc

SEQ ID NO: 596439 - DNA, 19 bp, Homo sapiens
tacccagtaactcatctgt

SEQ ID NO: 596440 - DNA, 21 bp, Homo sapiens
taccgcgtaatgcgccaataa

SEQ ID NO: 596441 - DNA, 23 bp, Homo sapiens
taccgcgtaatgcgccaataaac

SEQ ID NO: 596442 - DNA, 13 bp, Homo sapiens
tactgcatgcact

SEQ ID NO: 596443 - DNA, 23 bp, Homo sapiens
tacttacatgcattactgcatgc

SEQ ID NO: 596444 - DNA, 16 bp, Homo sapiens
tagcaaagatatctca

SEQ ID NO: 596445 - DNA, 14 bp, Homo sapiens
tagccttctctgtt

SEQ ID NO: 596446 - DNA, 15 bp, Homo sapiens
tagccttctctgttc

SEQ ID NO: 596447 - DNA, 15 bp, Homo sapiens
tatcaaacacggacc

SEQ ID NO: 596448 - DNA, 21 bp, Homo sapiens
tatgaaggctgtacactgcac

SEQ ID NO: 596449 - DNA, 15 bp, Homo sapiens
tatgagctcttcatg

SEQ ID NO: 596450 - DNA, 21 bp, Homo sapiens
tatgatgggtgtttttagcag

SEQ ID NO: 596451 - DNA, 17 bp, Homo sapiens
tatgatttcttgctttg

SEQ ID NO: 596452 - DNA, 23 bp, Homo sapiens
tatgtcaaatggagctgaatttg

SEQ ID NO: 596453 - DNA, 18 bp, Homo sapiens
tatgttactacatgcact

SEQ ID NO: 596454 - DNA, 16 bp, Homo sapiens
tcacaataattttcta

SEQ ID NO: 596455 - DNA, 23 bp, Homo sapiens
tcagccacagggagccacacaga

SEQ ID NO: 596456 - DNA, 19 bp, Homo sapiens
tcagtggacactcagacca

SEQ ID NO: 596457 - DNA, 16 bp, Homo sapiens
tcagtgttaaattcat

SEQ ID NO: 596458 - DNA, 17 bp, Homo sapiens
tcatctctgtcgtgctt

SEQ ID NO: 596459 - DNA, 11 bp, Homo sapiens
tcatgaacctc

SEQ ID NO: 596460 - DNA, 22 bp, Homo sapiens
tcattttaacatctgagaaaag

SEQ ID NO: 596461 - DNA, 15 bp, Homo sapiens
tccagacctgaagaa

SEQ ID NO: 596462 - DNA, 14 bp, Homo sapiens
tcccagagaccctg

SEQ ID NO: 596463 - DNA, 20 bp, Homo sapiens
tcccagcatgctgagattac

SEQ ID NO: 596464 - DNA, 19 bp, Homo sapiens
tccccatttaggtttctga

SEQ ID NO: 596465 - DNA, 13 bp, Homo sapiens
tccgggaccccca

SEQ ID NO: 596466 - DNA, 22 bp, Homo sapiens
tcctagtgactggggatgggac

SEQ ID NO: 596467 - DNA, 16 bp, Homo sapiens
tcctctctctgtgtta

SEQ ID NO: 596468 - DNA, 17 bp, Homo sapiens
tcctggaggttccccag

SEQ ID NO: 596469 - DNA, 14 bp, Homo sapiens
tccttcatttcctc

SEQ ID NO: 596470 - DNA, 15 bp, Homo sapiens
tccttcatttcctcc

SEQ ID NO: 596471 - DNA, 16 bp, Homo sapiens
tcgcgttcccaaagat

SEQ ID NO: 596472 - DNA, 21 bp, Homo sapiens
tctacctggtctctccttgtt

SEQ ID NO: 596473 - DNA, 24 bp, Homo sapiens
tctagtattccagacctgaagaat

SEQ ID NO: 596474 - DNA, 11 bp, Homo sapiens
tctattaaagg

SEQ ID NO: 596475 - DNA, 22 bp, Homo sapiens
tctcatgaacctcaagctgcat

SEQ ID NO: 596476 - DNA, 16 bp, Homo sapiens
tctccttgttctgata

SEQ ID NO: 596477 - DNA, 12 bp, Homo sapiens
tctctcatgaac

SEQ ID NO: 596478 - DNA, 15 bp, Homo sapiens
tctctcatgaacctc

SEQ ID NO: 596479 - DNA, 22 bp, Homo sapiens
tctctcatgaacctcaagctgc

SEQ ID NO: 596480 - DNA, 15 bp, Homo sapiens
tctctccttgttctg

SEQ ID NO: 596481 - DNA, 14 bp, Homo sapiens
tctctgttcatttc

SEQ ID NO: 596482 - DNA, 22 bp, Homo sapiens
tctgagaaaagctttgaaccct

SEQ ID NO: 596483 - DNA, 14 bp, Homo sapiens
tctgcctaataaaa

SEQ ID NO: 596484 - DNA, 20 bp, Homo sapiens
tctggattctgcctaataaa

SEQ ID NO: 596485 - DNA, 17 bp, Homo sapiens
tcttaaataaaaataat

SEQ ID NO: 596486 - DNA, 22 bp, Homo sapiens
tcttcttttaaaccattttctt

SEQ ID NO: 596487 - DNA, 19 bp, Homo sapiens
tcttgctgtccaatttcta

SEQ ID NO: 596488 - DNA, 22 bp, Homo sapiens
tgaaaacagaatcagtgttaaa

SEQ ID NO: 596489 - DNA, 20 bp, Homo sapiens
tgaagggccttgagcatctg

SEQ ID NO: 596490 - DNA, 23 bp, Homo sapiens
tgaagggccttgagcatctggat

SEQ ID NO: 596491 - DNA, 21 bp, Homo sapiens
tgaatggcttggagtgcactg

SEQ ID NO: 596492 - DNA, 16 bp, Homo sapiens
tgacacaatgctgggt

SEQ ID NO: 596493 - DNA, 19 bp, Homo sapiens
tgagaagataatcattgct

SEQ ID NO: 596494 - DNA, 20 bp, Homo sapiens
tgattcattttaacatctga

SEQ ID NO: 596495 - DNA, 22 bp, Homo sapiens
tgattcattttaacatctgaga

SEQ ID NO: 596496 - DNA, 20 bp, Homo sapiens
tgcaaacccagtgagacaga

SEQ ID NO: 596497 - DNA, 14 bp, Homo sapiens
tgcacttcttacaa

SEQ ID NO: 596498 - DNA, 16 bp, Homo sapiens
tgcacttggctgcata

SEQ ID NO: 596499 - DNA, 14 bp, Homo sapiens
tgcagactcactgt

SEQ ID NO: 596500 - DNA, 21 bp, Homo sapiens
tgcatctagaggcttccttca

SEQ ID NO: 596501 - DNA, 15 bp, Homo sapiens
tgcattactgcatgc

SEQ ID NO: 596502 - DNA, 17 bp, Homo sapiens
tgcattactgcatgcac

SEQ ID NO: 596503 - DNA, 18 bp, Homo sapiens
tgcattactgcatgcact

SEQ ID NO: 596504 - DNA, 19 bp, Homo sapiens
tgcatttatgagctcttca

SEQ ID NO: 596505 - DNA, 13 bp, Homo sapiens
tgcccctcccaga

SEQ ID NO: 596506 - DNA, 12 bp, Homo sapiens
tgcctaataaaa

SEQ ID NO: 596507 - DNA, 12 bp, Homo sapiens
tgccttcatttg

SEQ ID NO: 596508 - DNA, 20 bp, Homo sapiens
tgctgagattacaggtgtga

SEQ ID NO: 596509 - DNA, 12 bp, Homo sapiens
tgctttaaaaaa

SEQ ID NO: 596510 - DNA, 23 bp, Homo sapiens
tggaactgtctctcatgaacctc

SEQ ID NO: 596511 - DNA, 17 bp, Homo sapiens
tggacactcagaccagc

SEQ ID NO: 596512 - DNA, 14 bp, Homo sapiens
ataatcattgctta

SEQ ID NO: 596513 - DNA, 12 bp, Homo sapiens
atatctcatctc

SEQ ID NO: 596514 - DNA, 18 bp, Homo sapiens
atatgatttcttgctttg

SEQ ID NO: 596515 - DNA, 11 bp, Homo sapiens
atcattgctta

SEQ ID NO: 596516 - DNA, 16 bp, Homo sapiens
atctatgcattttctg

SEQ ID NO: 596517 - DNA, 13 bp, Homo sapiens
atcttatcttttg

SEQ ID NO: 596518 - DNA, 17 bp, Homo sapiens
atgaatgaatggcttgg

SEQ ID NO: 596519 - DNA, 16 bp, Homo sapiens
atgagctcttcatgtt

SEQ ID NO: 596520 - DNA, 15 bp, Homo sapiens
atgaggcttcccaga

SEQ ID NO: 596521 - DNA, 16 bp, Homo sapiens
atggtgccttcatttg

SEQ ID NO: 596522 - DNA, 12 bp, Homo sapiens
atgtcaaatgga

SEQ ID NO: 596523 - DNA, 15 bp, Homo sapiens
atgtcaaatggagct

SEQ ID NO: 596524 - DNA, 17 bp, Homo sapiens
attaaaggttcctttgt

SEQ ID NO: 596525 - DNA, 15 bp, Homo sapiens
attaataaatttata

SEQ ID NO: 596526 - DNA, 22 bp, Homo sapiens
attaatcagccccagagtgctt

SEQ ID NO: 596527 - DNA, 23 bp, Homo sapiens
attaatcagccccagagtgcttt

SEQ ID NO: 596528 - DNA, 18 bp, Homo sapiens
attcattttaacatctga

SEQ ID NO: 596529 - DNA, 17 bp, Homo sapiens
attccagacctgaagaa

SEQ ID NO: 596530 - DNA, 15 bp, Homo sapiens
attctagattacttt

SEQ ID NO: 596531 - DNA, 22 bp, Homo sapiens
attctcttaaataaaaataata

SEQ ID NO: 596532 - DNA, 14 bp, Homo sapiens
attctgcctaataa

SEQ ID NO: 596533 - DNA, 15 bp, Homo sapiens
attctgcctaataaa

SEQ ID NO: 596534 - DNA, 13 bp, Homo sapiens
attcttccatctg

SEQ ID NO: 596535 - DNA, 21 bp, Homo sapiens
attgatccttaaccaataatg

SEQ ID NO: 596536 - DNA, 14 bp, Homo sapiens
atttaggtttctga

SEQ ID NO: 596537 - DNA, 21 bp, Homo sapiens
atttaggtttctgagttcctg

SEQ ID NO: 596538 - DNA, 17 bp, Homo sapiens
atttatgagctcttcat

SEQ ID NO: 596539 - DNA, 20 bp, Homo sapiens
atttcctccgtcacctcaga

SEQ ID NO: 596540 - DNA, 15 bp, Homo sapiens
atttctattaaaggt

SEQ ID NO: 596541 - DNA, 21 bp, Homo sapiens
atttcttttttaaatgaagaa

SEQ ID NO: 596542 - DNA, 17 bp, Homo sapiens
attttagccttctctgt

SEQ ID NO: 596543 - DNA, 21 bp, Homo sapiens
attttctacctggtctctcct

SEQ ID NO: 596544 - DNA, 17 bp, Homo sapiens
caaacacggacccatag

SEQ ID NO: 596545 - DNA, 16 bp, Homo sapiens
caactaaaaataaatt

SEQ ID NO: 596546 - DNA, 23 bp, Homo sapiens
caagccttcagccacagggagcc

SEQ ID NO: 596547 - DNA, 14 bp, Homo sapiens
caagctgcatctag

SEQ ID NO: 596548 - DNA, 13 bp, Homo sapiens
caataattttcta

SEQ ID NO: 596549 - DNA, 15 bp, Homo sapiens
cacaataattttcta

SEQ ID NO: 596550 - DNA, 19 bp, Homo sapiens
cacagggagccacacagag

SEQ ID NO: 596551 - DNA, 20 bp, Homo sapiens
cacctcagagacatacacct

SEQ ID NO: 596552 - DNA, 23 bp, Homo sapiens
cacttggctgcataaatgtggta

SEQ ID NO: 596553 - DNA, 14 bp, Homo sapiens
cagaatcagtgtta

SEQ ID NO: 596554 - DNA, 18 bp, Homo sapiens
cagcctgcagactcactg

SEQ ID NO: 596555 - DNA, 16 bp, Homo sapiens
cagctcccagatggcc

SEQ ID NO: 596556 - DNA, 19 bp, Homo sapiens
caggctgcggcccctcccc

SEQ ID NO: 596557 - DNA, 20 bp, Homo sapiens
caggctgcggcccctccccc

SEQ ID NO: 596558 - DNA, 18 bp, Homo sapiens
cagtaaagatatttgaat

SEQ ID NO: 596559 - DNA, 14 bp, Homo sapiens
cagtaactcatctg

SEQ ID NO: 596560 - DNA, 17 bp, Homo sapiens
cagtgaaaaactattaa

SEQ ID NO: 596561 - DNA, 13 bp, Homo sapiens
cagtgagacagac

SEQ ID NO: 596562 - DNA, 18 bp, Homo sapiens
cagtggacactcagacca

SEQ ID NO: 596563 - DNA, 15 bp, Homo sapiens
cagtgttaaattcat

SEQ ID NO: 596564 - DNA, 20 bp, Homo sapiens
catctagaggcttccttcat

SEQ ID NO: 596565 - DNA, 20 bp, Homo sapiens
catgtatctatgcattttct

SEQ ID NO: 596566 - DNA, 23 bp, Homo sapiens
cattctagattacttttcttact

SEQ ID NO: 596567 - DNA, 17 bp, Homo sapiens
catttccaaacttgaaa

SEQ ID NO: 596568 - DNA, 18 bp, Homo sapiens
ccaaagatccacccaaat

SEQ ID NO: 596569 - DNA, 17 bp, Homo sapiens
ccaactactaaactggg

SEQ ID NO: 596570 - DNA, 20 bp, Homo sapiens
ccaataaaccaatgaacgaa

SEQ ID NO: 596571 - DNA, 17 bp, Homo sapiens
ccacacagagatgtcca

SEQ ID NO: 596572 - DNA, 15 bp, Homo sapiens
ccacagggagccaca

SEQ ID NO: 596573 - DNA, 18 bp, Homo sapiens
ccagctcccagatggccc

SEQ ID NO: 596574 - DNA, 15 bp, Homo sapiens
ccagtaactcatctg

SEQ ID NO: 596575 - DNA, 16 bp, Homo sapiens
ccagtaactcatctgt

SEQ ID NO: 596576 - DNA, 20 bp, Homo sapiens
ccatagacagccctggggga

SEQ ID NO: 596577 - DNA, 16 bp, Homo sapiens
ccattccctagtcatt

SEQ ID NO: 596578 - DNA, 16 bp, Homo sapiens
ccatttaggtttctga

SEQ ID NO: 596579 - DNA, 21 bp, Homo sapiens
ccatttaggtttctgagttcc

SEQ ID NO: 596580 - DNA, 19 bp, Homo sapiens
cccagatggccctggacag

SEQ ID NO: 596581 - DNA, 15 bp, Homo sapiens
cccagtaactcatct

SEQ ID NO: 596582 - DNA, 18 bp, Homo sapiens
ccccacttaccgcgtaat

SEQ ID NO: 596583 - DNA, 22 bp, Homo sapiens
ccccagagtgctttaaaaaatt

SEQ ID NO: 596584 - DNA, 14 bp, Homo sapiens
ccccagccccactt

SEQ ID NO: 596585 - DNA, 13 bp, Homo sapiens
ccccaggacaggc

SEQ ID NO: 596586 - DNA, 18 bp, Homo sapiens
ccccatttaggtttctga

SEQ ID NO: 596587 - DNA, 18 bp, Homo sapiens
ccctggaactgtctctca

SEQ ID NO: 596588 - DNA, 23 bp, Homo sapiens
ccgcctccgggacccccaggaca

SEQ ID NO: 596589 - DNA, 21 bp, Homo sapiens
cctagctgtgacctctcccct

SEQ ID NO: 596590 - DNA, 18 bp, Homo sapiens
cctcccccgtcctggagg

SEQ ID NO: 596591 - DNA, 18 bp, Homo sapiens
cctggaactgtctctcat

SEQ ID NO: 596592 - DNA, 17 bp, Homo sapiens
cctggaggttccccagc

SEQ ID NO: 596593 - DNA, 15 bp, Homo sapiens
ccttaaccaataatg

SEQ ID NO: 596594 - DNA, 14 bp, Homo sapiens
ccttcatttcctcc

SEQ ID NO: 596595 - DNA, 21 bp, Homo sapiens
ccttctctgttcatttcctca

SEQ ID NO: 596596 - DNA, 20 bp, Homo sapiens
ccttgattttagccttctct

SEQ ID NO: 596597 - DNA, 18 bp, Homo sapiens
ccttggggattcttccat

SEQ ID NO: 596598 - DNA, 16 bp, Homo sapiens
cctttgaatcctctct

SEQ ID NO: 596599 - DNA, 20 bp, Homo sapiens
cctttgaatcctctctctgt

SEQ ID NO: 596600 - DNA, 15 bp, Homo sapiens
cgaactccttgattt

SEQ ID NO: 596601 - DNA, 23 bp, Homo sapiens
cgaatggaccctctcctggactc

SEQ ID NO: 596602 - DNA, 16 bp, Homo sapiens
cgccaataaaccaatg

SEQ ID NO: 596603 - DNA, 23 bp, Homo sapiens
cgccaataaaccaatgaacgaag

SEQ ID NO: 596604 - DNA, 19 bp, Homo sapiens
cgcctccgggacccccagg

SEQ ID NO: 596605 - DNA, 12 bp, Homo sapiens
cgtcacctcaga

SEQ ID NO: 596606 - DNA, 12 bp, Homo sapiens
cgtgacacaatg

SEQ ID NO: 596607 - DNA, 14 bp, Homo sapiens
ctaaaaataaatta

SEQ ID NO: 596608 - DNA, 18 bp, Homo sapiens
ctaagtccaactactaaa

SEQ ID NO: 596609 - DNA, 20 bp, Homo sapiens
ctacaactaaaaataaatta

SEQ ID NO: 596610 - DNA, 16 bp, Homo sapiens
ctacctggtctctcct

SEQ ID NO: 596611 - DNA, 18 bp, Homo sapiens
ctagaggcttccttcatt

SEQ ID NO: 596612 - DNA, 15 bp, Homo sapiens
ctagtgactggggat

SEQ ID NO: 596613 - DNA, 13 bp, Homo sapiens
ctattaaaggttc

SEQ ID NO: 596614 - DNA, 16 bp, Homo sapiens
ctattatccccatttc

SEQ ID NO: 596615 - DNA, 18 bp, Homo sapiens
ctcaaagagggagtgcat

SEQ ID NO: 596616 - DNA, 17 bp, Homo sapiens
ctcaagctgcatctaga

SEQ ID NO: 596617 - DNA, 19 bp, Homo sapiens
ctcagaagtttcttcttta

SEQ ID NO: 596618 - DNA, 18 bp, Homo sapiens
ctcagaccagctcccaga

SEQ ID NO: 596619 - DNA, 12 bp, Homo sapiens
ctcatgaacctc

SEQ ID NO: 596620 - DNA, 21 bp, Homo sapiens
ctcatgaacctcaagctgcat

SEQ ID NO: 596621 - DNA, 17 bp, Homo sapiens
ctccgggacccccagga

SEQ ID NO: 596622 - DNA, 23 bp, Homo sapiens
ctcttcttttaaaccattttctt

SEQ ID NO: 596623 - DNA, 14 bp, Homo sapiens
ctgaatttgataaa

SEQ ID NO: 596624 - DNA, 18 bp, Homo sapiens
ctgcaaatggcagtttta

SEQ ID NO: 596625 - DNA, 20 bp, Homo sapiens
ctgccctggcacttggactc

SEQ ID NO: 596626 - DNA, 17 bp, Homo sapiens
ctggcattctagattac

SEQ ID NO: 596627 - DNA, 17 bp, Homo sapiens
ctgtgacctctcccctg

SEQ ID NO: 596628 - DNA, 17 bp, Homo sapiens
ctgttcatttcctcaaa

SEQ ID NO: 596629 - DNA, 13 bp, Homo sapiens
aaaaaacatttat

SEQ ID NO: 596630 - DNA, 14 bp, Homo sapiens
aaaataaattaata

SEQ ID NO: 596631 - DNA, 17 bp, Homo sapiens
aaaattctcttaaataa

SEQ ID NO: 596632 - DNA, 13 bp, Homo sapiens
aaagaatgatgct

SEQ ID NO: 596633 - DNA, 20 bp, Homo sapiens
aaagatatctcatctcttct

SEQ ID NO: 596634 - DNA, 20 bp, Homo sapiens
aaagcatcatggctatctgt

SEQ ID NO: 596635 - DNA, 21 bp, Homo sapiens
aaaggttcctttgttccctaa

SEQ ID NO: 596636 - DNA, 14 bp, Homo sapiens
aaataaaaataata

SEQ ID NO: 596637 - DNA, 20 bp, Homo sapiens
aaataaacggactcagtgga

SEQ ID NO: 596638 - DNA, 17 bp, Homo sapiens
aaataaattaataaatt

SEQ ID NO: 596639 - DNA, 18 bp, Homo sapiens
aaatactttgcataaatt

SEQ ID NO: 596640 - DNA, 21 bp, Homo sapiens
aacacggacccatagacagcc

SEQ ID NO: 596641 - DNA, 21 bp, Homo sapiens
aactgtcgtgcaaacccagtg

SEQ ID NO: 596642 - DNA, 19 bp, Homo sapiens
aactgtctctcatgaacct

SEQ ID NO: 596643 - DNA, 18 bp, Homo sapiens
aaggttcctttgttccct

SEQ ID NO: 596644 - DNA, 16 bp, Homo sapiens
aagtccaactactaaa

SEQ ID NO: 596645 - DNA, 20 bp, Homo sapiens
aagtttaatggtgccttcat

SEQ ID NO: 596646 - DNA, 14 bp, Homo sapiens
aataaaaataatag

SEQ ID NO: 596647 - DNA, 19 bp, Homo sapiens
aataaacggactcagtgga

SEQ ID NO: 596648 - DNA, 20 bp, Homo sapiens
aatactttgcataaattaat

SEQ ID NO: 596649 - DNA, 12 bp, Homo sapiens
gcttggagtgca

SEQ ID NO: 596650 - DNA, 20 bp, Homo sapiens
ggaaatactttgcataaatt

SEQ ID NO: 596651 - DNA, 17 bp, Homo sapiens
ggagagagttgaaccta

SEQ ID NO: 596652 - DNA, 20 bp, Homo sapiens
ggagagggtgtgggatgagg

SEQ ID NO: 596653 - DNA, 17 bp, Homo sapiens
ggattctgcctaataaa

SEQ ID NO: 596654 - DNA, 16 bp, Homo sapiens
ggcaagtttacttttt

SEQ ID NO: 596655 - DNA, 23 bp, Homo sapiens
ggcatgtgtttactttatgttac

SEQ ID NO: 596656 - DNA, 13 bp, Homo sapiens
ggcccctcccccg

SEQ ID NO: 596657 - DNA, 17 bp, Homo sapiens
gggccttgagcatctgg

SEQ ID NO: 596658 - DNA, 17 bp, Homo sapiens
gtaatgcgccaataaac

SEQ ID NO: 596659 - DNA, 17 bp, Homo sapiens
gtccaatttctattaaa

SEQ ID NO: 596660 - DNA, 22 bp, Homo sapiens
gtcccagaaaaagcatcatggc

SEQ ID NO: 596661 - DNA, 22 bp, Homo sapiens
gtcctcatctctgtcgtgcttc

SEQ ID NO: 596662 - DNA, 16 bp, Homo sapiens
gtctctcatgaacctc

SEQ ID NO: 596663 - DNA, 21 bp, Homo sapiens
gtgatccctagctgtgacctc

SEQ ID NO: 596664 - DNA, 18 bp, Homo sapiens
gtgatttacgctcattgt

SEQ ID NO: 596665 - DNA, 20 bp, Homo sapiens
gtgccaccttgtgtgtttaa

SEQ ID NO: 596666 - DNA, 14 bp, Homo sapiens
gtgccttcatttgg

SEQ ID NO: 596667 - DNA, 17 bp, Homo sapiens
gtggacactcagaccag

SEQ ID NO: 596668 - DNA, 14 bp, Homo sapiens
gtggtgtatttgag

SEQ ID NO: 596669 - DNA, 23 bp, Homo sapiens
gtgttacccagtaactcatctgt

SEQ ID NO: 596670 - DNA, 15 bp, Homo sapiens
gttaaattcatttta

SEQ ID NO: 596671 - DNA, 12 bp, Homo sapiens
gttcctgcatgc

SEQ ID NO: 596672 - DNA, 14 bp, Homo sapiens
gttcctttgttccc

SEQ ID NO: 596673 - DNA, 15 bp, Homo sapiens
gttcctttgttccct

SEQ ID NO: 596674 - DNA, 14 bp, Homo sapiens
taaaaaacatttat

SEQ ID NO: 596675 - DNA, 14 bp, Homo sapiens
taaaaacccaaaat

SEQ ID NO: 596676 - DNA, 15 bp, Homo sapiens
taaaggttcctttgt

SEQ ID NO: 596677 - DNA, 16 bp, Homo sapiens
taaaggttcctttgtt

SEQ ID NO: 596678 - DNA, 19 bp, Homo sapiens
taaaggttcctttgttccc

SEQ ID NO: 596679 - DNA, 15 bp, Homo sapiens
taaataaaaataata

SEQ ID NO: 596680 - DNA, 13 bp, Homo sapiens
taacatctgagaa

SEQ ID NO: 596681 - DNA, 17 bp, Homo sapiens
taagtccaactactaaa

SEQ ID NO: 596682 - DNA, 17 bp, Homo sapiens
taatgcgccaataaacc

SEQ ID NO: 596683 - DNA, 15 bp, Homo sapiens
taattctatgagata

SEQ ID NO: 596684 - DNA, 21 bp, Homo sapiens
tacaactaaaaataaattaat

SEQ ID NO: 596685 - DNA, 16 bp, Homo sapiens
tacaataattctatga

SEQ ID NO: 596686 - DNA, 21 bp, Homo sapiens
tacacatgtatctatgcattt

SEQ ID NO: 596687 - DNA, 21 bp, Homo sapiens
tacacctatgtcatttcattt

SEQ ID NO: 596688 - DNA, 21 bp, Homo sapiens
tacagctcagaagtttcttct

SEQ ID NO: 596689 - DNA, 21 bp, Homo sapiens
tacatgcacttggctgcataa

SEQ ID NO: 596690 - DNA, 20 bp, Homo sapiens
tacatgcattactgcatgca

SEQ ID NO: 596691 - DNA, 16 bp, Homo sapiens
tagaggcttccttcat

SEQ ID NO: 596692 - DNA, 17 bp, Homo sapiens
tagaggcttccttcatt

SEQ ID NO: 596693 - DNA, 17 bp, Homo sapiens
tagcaaagatatctcat

SEQ ID NO: 596694 - DNA, 20 bp, Homo sapiens
tagccttctctgttcatttc

SEQ ID NO: 596695 - DNA, 22 bp, Homo sapiens
tagccttctctgttcatttcct

SEQ ID NO: 596696 - DNA, 16 bp, Homo sapiens
tagctgtgacctctcc

SEQ ID NO: 596697 - DNA, 17 bp, Homo sapiens
tagtcagtaaagatatt

SEQ ID NO: 596698 - DNA, 16 bp, Homo sapiens
tatgatttcttgcttt

SEQ ID NO: 596699 - DNA, 23 bp, Homo sapiens
tatgtagaaaaaagtaaatgtga

SEQ ID NO: 596700 - DNA, 16 bp, Homo sapiens
tattatccccatttct

SEQ ID NO: 596701 - DNA, 22 bp, Homo sapiens
tattcttattaaggaaatactt

SEQ ID NO: 596702 - DNA, 14 bp, Homo sapiens
tatttgagaagata

SEQ ID NO: 596703 - DNA, 15 bp, Homo sapiens
tcacaataattttct

SEQ ID NO: 596704 - DNA, 17 bp, Homo sapiens
tcagaccagctcccaga

SEQ ID NO: 596705 - DNA, 20 bp, Homo sapiens
tcagtggacactcagaccag

SEQ ID NO: 596706 - DNA, 15 bp, Homo sapiens
tcagtgttaaattca

SEQ ID NO: 596707 - DNA, 14 bp, Homo sapiens
tcattgtagaaaag

SEQ ID NO: 596708 - DNA, 15 bp, Homo sapiens
tcatttcatttccta

SEQ ID NO: 596709 - DNA, 20 bp, Homo sapiens
tcatttccaaacttgaaaac

SEQ ID NO: 596710 - DNA, 20 bp, Homo sapiens
tcccctggaactgtctctca

SEQ ID NO: 596711 - DNA, 19 bp, Homo sapiens
tcctggaggttccccagcc

SEQ ID NO: 596712 - DNA, 11 bp, Homo sapiens
tccttcatttc

SEQ ID NO: 596713 - DNA, 20 bp, Homo sapiens
tcctttgaatcctctctctg

SEQ ID NO: 596714 - DNA, 13 bp, Homo sapiens
tcctttgttccct

SEQ ID NO: 596715 - DNA, 20 bp, Homo sapiens
tcctttgttccctaagtcca

SEQ ID NO: 596716 - DNA, 21 bp, Homo sapiens
tctagaggcttccttcatttc

SEQ ID NO: 596717 - DNA, 19 bp, Homo sapiens
tctcttaaataaaaataat

SEQ ID NO: 596718 - DNA, 16 bp, Homo sapiens
tctgattgtgatgtga

SEQ ID NO: 596719 - DNA, 18 bp, Homo sapiens
tcttaaataaaaataata

SEQ ID NO: 596720 - DNA, 16 bp, Homo sapiens
ctgtttgggagtgcgg

SEQ ID NO: 596721 - DNA, 14 bp, Homo sapiens
cttaaccaataatg

SEQ ID NO: 596722 - DNA, 19 bp, Homo sapiens
cttacatgcattactgcat

SEQ ID NO: 596723 - DNA, 22 bp, Homo sapiens
cttaccgcgtaatgcgccaata

SEQ ID NO: 596724 - DNA, 23 bp, Homo sapiens
cttacggaaaatccgacaagcct

SEQ ID NO: 596725 - DNA, 14 bp, Homo sapiens
cttcatttcctccg

SEQ ID NO: 596726 - DNA, 16 bp, Homo sapiens
cttccttcatttcctc

SEQ ID NO: 596727 - DNA, 19 bp, Homo sapiens
cttcttttaaaccattttc

SEQ ID NO: 596728 - DNA, 15 bp, Homo sapiens
ctttaaaaaattctc

SEQ ID NO: 596729 - DNA, 15 bp, Homo sapiens
ctttaggcattaaat

SEQ ID NO: 596730 - DNA, 23 bp, Homo sapiens
ctttgaatcctctctctgtgtta

SEQ ID NO: 596731 - DNA, 18 bp, Homo sapiens
cttttttaaatgaagaaa

SEQ ID NO: 596732 - DNA, 17 bp, Homo sapiens
gaactgtctctcatgaa

SEQ ID NO: 596733 - DNA, 10 bp, Homo sapiens
gaagaggact

SEQ ID NO: 596734 - DNA, 16 bp, Homo sapiens
gaatcagtgttaaatt

SEQ ID NO: 596735 - DNA, 17 bp, Homo sapiens
gactcttctgagcacct

SEQ ID NO: 596736 - DNA, 14 bp, Homo sapiens
gacttacatgattc

SEQ ID NO: 596737 - DNA, 14 bp, Homo sapiens
gaggcttcccagag

SEQ ID NO: 596738 - DNA, 22 bp, Homo sapiens
gataaaaacccaaaatacagct

SEQ ID NO: 596739 - DNA, 15 bp, Homo sapiens
gatccctagctgtga

SEQ ID NO: 596740 - DNA, 19 bp, Homo sapiens
gatccctagctgtgacctc

SEQ ID NO: 596741 - DNA, 20 bp, Homo sapiens
gcaaatggcagttttaatct

SEQ ID NO: 596742 - DNA, 14 bp, Homo sapiens
gcacctacttacat

SEQ ID NO: 596743 - DNA, 15 bp, Homo sapiens
gcacctgtcccagaa

SEQ ID NO: 596744 - DNA, 22 bp, Homo sapiens
gcacctgtcccagaaaaagcat

SEQ ID NO: 596745 - DNA, 13 bp, Homo sapiens
gcatcatggctat

SEQ ID NO: 596746 - DNA, 22 bp, Homo sapiens
gcatctagaggcttccttcatt

SEQ ID NO: 596747 - DNA, 23 bp, Homo sapiens
gcatctggattctgcctaataaa

SEQ ID NO: 596748 - DNA, 23 bp, Homo sapiens
gccgcctccgggacccccaggac

SEQ ID NO: 596749 - DNA, 15 bp, Homo sapiens
gcctccgggaccccc

SEQ ID NO: 596750 - DNA, 17 bp, Homo sapiens
gcctccgggacccccag

SEQ ID NO: 596751 - DNA, 12 bp, Homo sapiens
gcctgtttggga

SEQ ID NO: 596752 - DNA, 17 bp, Homo sapiens
gcctgtttgggagtgcg

SEQ ID NO: 596753 - DNA, 14 bp, Homo sapiens
gccttgagcatctg

SEQ ID NO: 596754 - DNA, 17 bp, Homo sapiens
gcggcccctcccccgtc

SEQ ID NO: 596755 - DNA, 18 bp, Homo sapiens
gctcagaagtttcttctt

SEQ ID NO: 596756 - DNA, 17 bp, Homo sapiens
gctgcggcccctccccc

SEQ ID NO: 596757 - DNA, 13 bp, Homo sapiens
gcttccttcattt

SEQ ID NO: 596758 - DNA, 9 bp, Homo sapiens
ggaggttcc

SEQ ID NO: 596759 - DNA, 16 bp, Homo sapiens
ggcaaatatcttgaaa

SEQ ID NO: 596760 - DNA, 16 bp, Homo sapiens
ggccttgagcatctgg

SEQ ID NO: 596761 - DNA, 18 bp, Homo sapiens
ggctgcggcccctccccc

SEQ ID NO: 596762 - DNA, 11 bp, Homo sapiens
gggacccccag

SEQ ID NO: 596763 - DNA, 21 bp, Homo sapiens
gggggacttacatgattcatt

SEQ ID NO: 596764 - DNA, 15 bp, Homo sapiens
gggggatattatgaa

SEQ ID NO: 596765 - DNA, 15 bp, Homo sapiens
gtaactcatctgtca

SEQ ID NO: 596766 - DNA, 13 bp, Homo sapiens
gtagaaaagctat

SEQ ID NO: 596767 - DNA, 17 bp, Homo sapiens
gtatctatgcattttct

SEQ ID NO: 596768 - DNA, 11 bp, Homo sapiens
gtatttgagaa

SEQ ID NO: 596769 - DNA, 16 bp, Homo sapiens
gtcacctcagagacat

SEQ ID NO: 596770 - DNA, 18 bp, Homo sapiens
gtcctggaggttccccag

SEQ ID NO: 596771 - DNA, 15 bp, Homo sapiens
gtctctcatgaacct

SEQ ID NO: 596772 - DNA, 17 bp, Homo sapiens
gtgcatttatgagctct

SEQ ID NO: 596773 - DNA, 11 bp, Homo sapiens
gtgccttcatt

SEQ ID NO: 596774 - DNA, 19 bp, Homo sapiens
gtgggtggtgtatttgaga

SEQ ID NO: 596775 - DNA, 15 bp, Homo sapiens
gtggtgtatttgaga

SEQ ID NO: 596776 - DNA, 13 bp, Homo sapiens
gtgttaaattcat

SEQ ID NO: 596777 - DNA, 20 bp, Homo sapiens
gttacccagtaactcatctg

SEQ ID NO: 596778 - DNA, 23 bp, Homo sapiens
gtttcaggagagagttgaaccta

SEQ ID NO: 596779 - DNA, 16 bp, Homo sapiens
taaaaataaattaata

SEQ ID NO: 596780 - DNA, 12 bp, Homo sapiens
taaatgaagaaa

SEQ ID NO: 596781 - DNA, 17 bp, Homo sapiens
taaattcattttattct

SEQ ID NO: 596782 - DNA, 14 bp, Homo sapiens
taaggaaatacttt

SEQ ID NO: 596783 - DNA, 16 bp, Homo sapiens
taagtccaactactaa

SEQ ID NO: 596784 - DNA, 18 bp, Homo sapiens
taatggtgccttcatttg

SEQ ID NO: 596785 - DNA, 21 bp, Homo sapiens
tacaagcattctgtcttgaag

SEQ ID NO: 596786 - DNA, 14 bp, Homo sapiens
tacatgattcattt

SEQ ID NO: 596787 - DNA, 15 bp, Homo sapiens
tacatgattcatttt

SEQ ID NO: 596788 - DNA, 22 bp, Homo sapiens
tacccagtaactcatctgtcac

SEQ ID NO: 596789 - DNA, 19 bp, Homo sapiens
tactctgaaacatggcctg

SEQ ID NO: 596790 - DNA, 17 bp, Homo sapiens
tactttatgttactaca

SEQ ID NO: 596791 - DNA, 16 bp, Homo sapiens
tactttgcataaatta

SEQ ID NO: 596792 - DNA, 18 bp, Homo sapiens
tactttgcataaattaat

SEQ ID NO: 596793 - DNA, 18 bp, Homo sapiens
tagaggcttccttcattt

SEQ ID NO: 596794 - DNA, 19 bp, Homo sapiens
tagaggcttccttcatttc

SEQ ID NO: 596795 - DNA, 19 bp, Homo sapiens
tagcaaagatatctcatct

SEQ ID NO: 596796 - DNA, 13 bp, Homo sapiens
tagccttctctgt

SEQ ID NO: 596797 - DNA, 16 bp, Homo sapiens
tagccttctctgttca

SEQ ID NO: 596798 - DNA, 22 bp, Homo sapiens
tagtcagtaaagatatttgaat

SEQ ID NO: 596799 - DNA, 16 bp, Homo sapiens
tatccccatttctttt

SEQ ID NO: 596800 - DNA, 11 bp, Homo sapiens
tatctcatctc

SEQ ID NO: 596801 - DNA, 14 bp, Homo sapiens
tatgagctcttcat

SEQ ID NO: 596802 - DNA, 18 bp, Homo sapiens
tcagccacagggagccac

SEQ ID NO: 596803 - DNA, 13 bp, Homo sapiens
tcagtcctcatct

SEQ ID NO: 596804 - DNA, 17 bp, Homo sapiens
tcagtgttaaattcatt

SEQ ID NO: 596805 - DNA, 14 bp, Homo sapiens
tcatctcttctttt

SEQ ID NO: 596806 - DNA, 18 bp, Homo sapiens
tcatttccaaacttgaaa

SEQ ID NO: 596807 - DNA, 13 bp, Homo sapiens
tccaactactaaa

SEQ ID NO: 596808 - DNA, 16 bp, Homo sapiens
tccagacctgaagaat

SEQ ID NO: 596809 - DNA, 16 bp, Homo sapiens
tcccacgaatggaccc

SEQ ID NO: 596810 - DNA, 18 bp, Homo sapiens
tcccctggaactgtctct

SEQ ID NO: 596811 - DNA, 12 bp, Homo sapiens
tccctagtcatt

SEQ ID NO: 596812 - DNA, 21 bp, Homo sapiens
tcctacaactaaaaataaatt

SEQ ID NO: 596813 - DNA, 22 bp, Homo sapiens
tccttgattttagccttctctg

SEQ ID NO: 596814 - DNA, 21 bp, Homo sapiens
tcctttgaatcctctctctgt

SEQ ID NO: 596815 - DNA, 18 bp, Homo sapiens
tcctttgttccctaagtc

SEQ ID NO: 596816 - DNA, 19 bp, Homo sapiens
tcgctagtcagtaaagata

SEQ ID NO: 596817 - DNA, 15 bp, Homo sapiens
tctatgcattttctg

SEQ ID NO: 596818 - DNA, 14 bp, Homo sapiens
tctattaaaggttc

SEQ ID NO: 596819 - DNA, 13 bp, Homo sapiens
tctcatgaacctc

SEQ ID NO: 596820 - DNA, 17 bp, Homo sapiens
tctcctagtgactgggg

SEQ ID NO: 596821 - DNA, 13 bp, Homo sapiens
tctccttgttctg

SEQ ID NO: 596822 - DNA, 14 bp, Homo sapiens
tctccttgttctga

SEQ ID NO: 596823 - DNA, 17 bp, Homo sapiens
tctctcatgaacctcaa

SEQ ID NO: 596824 - DNA, 13 bp, Homo sapiens
tctctgttcattt

SEQ ID NO: 596825 - DNA, 16 bp, Homo sapiens
tctctgttcatttcct

SEQ ID NO: 596826 - DNA, 18 bp, Homo sapiens
tctctgttcatttcctca

SEQ ID NO: 596827 - DNA, 16 bp, Homo sapiens
tctcttaaataaaaat

SEQ ID NO: 596828 - DNA, 23 bp, Homo sapiens
tctgatgtttcctacaactaaaa

SEQ ID NO: 596829 - DNA, 18 bp, Homo sapiens
tctgttcatttcctcaaa

SEQ ID NO: 596830 - DNA, 15 bp, Homo sapiens
tcttactctgaaaca

SEQ ID NO: 596831 - DNA, 16 bp, Homo sapiens
tcttcatgtttcagga

SEQ ID NO: 596832 - DNA, 21 bp, Homo sapiens
tcttcttttaaaccattttct

SEQ ID NO: 596833 - DNA, 19 bp, Homo sapiens
tcttttttaaatgaagaaa

SEQ ID NO: 596834 - DNA, 18 bp, Homo sapiens
tgaaaacagaatcagtgt

SEQ ID NO: 596835 - DNA, 23 bp, Homo sapiens
tgaaccattccctagtcatttcc

SEQ ID NO: 596836 - DNA, 19 bp, Homo sapiens
tgaagggcaggtgcttcag

SEQ ID NO: 596837 - DNA, 14 bp, Homo sapiens
tgaatttgataaaa

SEQ ID NO: 596838 - DNA, 12 bp, Homo sapiens
actacatgcact

SEQ ID NO: 596839 - DNA, 23 bp, Homo sapiens
actcagaccagctcccagatggc

SEQ ID NO: 596840 - DNA, 22 bp, Homo sapiens
actcagtggacactcagaccag

SEQ ID NO: 596841 - DNA, 23 bp, Homo sapiens
actcttctgagcacctacttaca

SEQ ID NO: 596842 - DNA, 18 bp, Homo sapiens
actgcatgcacttcttac

SEQ ID NO: 596843 - DNA, 18 bp, Homo sapiens
actgtctctcatgaacct

SEQ ID NO: 596844 - DNA, 15 bp, Homo sapiens
actttgcataaatta

SEQ ID NO: 596845 - DNA, 18 bp, Homo sapiens
agaatcagtgttaaattc

SEQ ID NO: 596846 - DNA, 19 bp, Homo sapiens
agaatcagtgttaaattca

SEQ ID NO: 596847 - DNA, 18 bp, Homo sapiens
catatgatttcttgcttt

SEQ ID NO: 596848 - DNA, 18 bp, Homo sapiens
ggcttcccagagaccctg

SEQ ID NO: 596849 - DNA, 18 bp, Homo sapiens
tcttatcttttggcttct

SEQ ID NO: 596850 - DNA, 13 bp, Homo sapiens
tcttgctgtccaa

SEQ ID NO: 596851 - DNA, 15 bp, Homo sapiens
tgaaaacagaatcag

SEQ ID NO: 596852 - DNA, 21 bp, Homo sapiens
tgaaaacagaatcagtgttaa

SEQ ID NO: 596853 - DNA, 13 bp, Homo sapiens
tgaaatgaatgaa

SEQ ID NO: 596854 - DNA, 20 bp, Homo sapiens
tgaaccattccctagtcatt

SEQ ID NO: 596855 - DNA, 14 bp, Homo sapiens
tgaaggctgtacac

SEQ ID NO: 596856 - DNA, 19 bp, Homo sapiens
tgaagggccttgagcatct

SEQ ID NO: 596857 - DNA, 21 bp, Homo sapiens
tgaagtgctgggcaagtttac

SEQ ID NO: 596858 - DNA, 14 bp, Homo sapiens
tgaatcctctctct

SEQ ID NO: 596859 - DNA, 20 bp, Homo sapiens
tgagaacagcatatgatttc

SEQ ID NO: 596860 - DNA, 20 bp, Homo sapiens
tgagaagataatcattgctt

SEQ ID NO: 596861 - DNA, 16 bp, Homo sapiens
tgagctcttcatgttt

SEQ ID NO: 596862 - DNA, 15 bp, Homo sapiens
tgaggcttcccagag

SEQ ID NO: 596863 - DNA, 16 bp, Homo sapiens
tgatttacgctcattg

SEQ ID NO: 596864 - DNA, 19 bp, Homo sapiens
tgatttcttgctttgggga

SEQ ID NO: 596865 - DNA, 15 bp, Homo sapiens
tgattttagccttct

SEQ ID NO: 596866 - DNA, 19 bp, Homo sapiens
tgattttagccttctctgt

SEQ ID NO: 596867 - DNA, 21 bp, Homo sapiens
tgcagacaggctggcattcta

SEQ ID NO: 596868 - DNA, 20 bp, Homo sapiens
tgcatttatgagctcttcat

SEQ ID NO: 596869 - DNA, 18 bp, Homo sapiens
tgcggcccctcccccgtc

SEQ ID NO: 596870 - DNA, 12 bp, Homo sapiens
tgctgtccaatt

SEQ ID NO: 596871 - DNA, 16 bp, Homo sapiens
tggaccctctcctgga

SEQ ID NO: 596872 - DNA, 16 bp, Homo sapiens
tggagctgaatttgat

SEQ ID NO: 596873 - DNA, 17 bp, Homo sapiens
tggagctgaatttgata

SEQ ID NO: 596874 - DNA, 19 bp, Homo sapiens
tggagctgaatttgataaa

SEQ ID NO: 596875 - DNA, 18 bp, Homo sapiens
tggagtgcactgagaaca

SEQ ID NO: 596876 - DNA, 21 bp, Homo sapiens
tgggggacttacatgattcat

SEQ ID NO: 596877 - DNA, 12 bp, Homo sapiens
tggtgccttcat

SEQ ID NO: 596878 - DNA, 18 bp, Homo sapiens
tggtgtctttgatcagga

SEQ ID NO: 596879 - DNA, 19 bp, Homo sapiens
tgtatctatgcattttctg

SEQ ID NO: 596880 - DNA, 20 bp, Homo sapiens
tgtatttgagaagataatca

SEQ ID NO: 596881 - DNA, 18 bp, Homo sapiens
tgtcaatggttatgggtc

SEQ ID NO: 596882 - DNA, 15 bp, Homo sapiens
tgtccgactcttctg

SEQ ID NO: 596883 - DNA, 18 bp, Homo sapiens
tgtctattacctgttagt

SEQ ID NO: 596884 - DNA, 13 bp, Homo sapiens
tgttcatttcctc

SEQ ID NO: 596885 - DNA, 20 bp, Homo sapiens
ttaaataaaaataatagact

SEQ ID NO: 596886 - DNA, 14 bp, Homo sapiens
ttaacaacttgtct

SEQ ID NO: 596887 - DNA, 17 bp, Homo sapiens
ttaatggtgccttcatt

SEQ ID NO: 596888 - DNA, 22 bp, Homo sapiens
ttacatgcattactgcatgcac

SEQ ID NO: 596889 - DNA, 24 bp, Homo sapiens
ttaccagatttttacacatgtatc

SEQ ID NO: 596890 - DNA, 13 bp, Homo sapiens
ttactacatgcac

SEQ ID NO: 596891 - DNA, 22 bp, Homo sapiens
ttagcaaagatatctcatctct

SEQ ID NO: 596892 - DNA, 15 bp, Homo sapiens
ttagccttctctgtt

SEQ ID NO: 596893 - DNA, 14 bp, Homo sapiens
ttatcttttggctt

SEQ ID NO: 596894 - DNA, 15 bp, Homo sapiens
ttatcttttggcttc

SEQ ID NO: 596895 - DNA, 23 bp, Homo sapiens
ttatgaagggccttgagcatctg

SEQ ID NO: 596896 - DNA, 20 bp, Homo sapiens
ctttatgttactacatgcac

SEQ ID NO: 596897 - DNA, 18 bp, Homo sapiens
ctttgaatcctctctctg

SEQ ID NO: 596898 - DNA, 11 bp, Homo sapiens
ctttgttccct

SEQ ID NO: 596899 - DNA, 17 bp, Homo sapiens
cttttcttactctgaaa

SEQ ID NO: 596900 - DNA, 15 bp, Homo sapiens
gaaaacagaatcagt

SEQ ID NO: 596901 - DNA, 16 bp, Homo sapiens
gaagataatcattgct

SEQ ID NO: 596902 - DNA, 22 bp, Homo sapiens
gaagggccttgagcatctggat

SEQ ID NO: 596903 - DNA, 14 bp, Homo sapiens
gaatcagtgttaaa

SEQ ID NO: 596904 - DNA, 22 bp, Homo sapiens
gacaggctgcggcccctccccc

SEQ ID NO: 596905 - DNA, 23 bp, Homo sapiens
gacaggctgcggcccctcccccg

SEQ ID NO: 596906 - DNA, 15 bp, Homo sapiens
gacttacatgattca

SEQ ID NO: 596907 - DNA, 21 bp, Homo sapiens
gagcatctggattctgcctaa

SEQ ID NO: 596908 - DNA, 13 bp, Homo sapiens
gagccacacagag

SEQ ID NO: 596909 - DNA, 17 bp, Homo sapiens
gagctcttcatgtttca

SEQ ID NO: 596910 - DNA, 12 bp, Homo sapiens
gagttcctgcat

SEQ ID NO: 596911 - DNA, 20 bp, Homo sapiens
gataaaaacccaaaatacag

SEQ ID NO: 596912 - DNA, 14 bp, Homo sapiens
gatatctcatctct

SEQ ID NO: 596913 - DNA, 21 bp, Homo sapiens
gatccctagctgtgacctctc

SEQ ID NO: 596914 - DNA, 16 bp, Homo sapiens
gatgggacaagaagcc

SEQ ID NO: 596915 - DNA, 16 bp, Homo sapiens
gatggttgcaattgat

SEQ ID NO: 596916 - DNA, 19 bp, Homo sapiens
gatgtgagttgcacagcta

SEQ ID NO: 596917 - DNA, 19 bp, Homo sapiens
gattcattttaacatctga

SEQ ID NO: 596918 - DNA, 16 bp, Homo sapiens
gattctgcctaataaa

SEQ ID NO: 596919 - DNA, 14 bp, Homo sapiens
gcaagtttactttt

SEQ ID NO: 596920 - DNA, 13 bp, Homo sapiens
gcacagctatgaa

SEQ ID NO: 596921 - DNA, 19 bp, Homo sapiens
gcacctgtcccagaaaaag

SEQ ID NO: 596922 - DNA, 13 bp, Homo sapiens
gcacttggactct

SEQ ID NO: 596923 - DNA, 17 bp, Homo sapiens
gcataaattaatcagcc

SEQ ID NO: 596924 - DNA, 22 bp, Homo sapiens
gccaataaaccaatgaacgaag

SEQ ID NO: 596925 - DNA, 18 bp, Homo sapiens
gccgcctccgggaccccc

SEQ ID NO: 596926 - DNA, 22 bp, Homo sapiens
gccgcctccgggacccccagga

SEQ ID NO: 596927 - DNA, 11 bp, Homo sapiens
gcctaataaaa

SEQ ID NO: 596928 - DNA, 16 bp, Homo sapiens
gcctccgggaccccca

SEQ ID NO: 596929 - DNA, 19 bp, Homo sapiens
gcctccgggacccccagga

SEQ ID NO: 596930 - DNA, 14 bp, Homo sapiens
gccttctctgttca

SEQ ID NO: 596931 - DNA, 13 bp, Homo sapiens
gcgccaataaacc

SEQ ID NO: 596932 - DNA, 14 bp, Homo sapiens
gcggcccctccccc

SEQ ID NO: 596933 - DNA, 19 bp, Homo sapiens
gctactctagtattccaga

SEQ ID NO: 596934 - DNA, 21 bp, Homo sapiens
gctactctagtattccagacc

SEQ ID NO: 596935 - DNA, 15 bp, Homo sapiens
gctgcggcccctccc

SEQ ID NO: 596936 - DNA, 16 bp, Homo sapiens
gctgtacactgcacga

SEQ ID NO: 596937 - DNA, 23 bp, Homo sapiens
gctgtccaatttctattaaaggt

SEQ ID NO: 596938 - DNA, 16 bp, Homo sapiens
taccatatacagctca

SEQ ID NO: 596939 - DNA, 17 bp, Homo sapiens
taccgcgtaatgcgcca

SEQ ID NO: 596940 - DNA, 13 bp, Homo sapiens
tactacatgcact

SEQ ID NO: 596941 - DNA, 19 bp, Homo sapiens
tacttacatgcattactgc

SEQ ID NO: 596942 - DNA, 22 bp, Homo sapiens
tacttcgtgtccgactcttctg

SEQ ID NO: 596943 - DNA, 20 bp, Homo sapiens
tactttatgttactacatgc

SEQ ID NO: 596944 - DNA, 14 bp, Homo sapiens
tagtcatttccaaa

SEQ ID NO: 596945 - DNA, 21 bp, Homo sapiens
tatgaagggccttgagcatct

SEQ ID NO: 596946 - DNA, 22 bp, Homo sapiens
tatgaagggccttgagcatctg

SEQ ID NO: 596947 - DNA, 23 bp, Homo sapiens
tatgaagggccttgagcatctgg

SEQ ID NO: 596948 - DNA, 16 bp, Homo sapiens
tatgagctcttcatgt

SEQ ID NO: 596949 - DNA, 16 bp, Homo sapiens
tatgtcatttcatttc

SEQ ID NO: 596950 - DNA, 22 bp, Homo sapiens
tattaaaggttcctttgttccc

SEQ ID NO: 596951 - DNA, 20 bp, Homo sapiens
tcaaacacggacccatagac

SEQ ID NO: 596952 - DNA, 15 bp, Homo sapiens
tcaacttttcctttg

SEQ ID NO: 596953 - DNA, 21 bp, Homo sapiens
tcaacttttcctttgaatcct

SEQ ID NO: 596954 - DNA, 20 bp, Homo sapiens
tcaggagagagttgaaccta

SEQ ID NO: 596955 - DNA, 22 bp, Homo sapiens
tcatgaacctcaagctgcatct

SEQ ID NO: 596956 - DNA, 13 bp, Homo sapiens
tcatttcctcaaa

SEQ ID NO: 596957 - DNA, 20 bp, Homo sapiens
tcattttaacatctgagaaa

SEQ ID NO: 596958 - DNA, 13 bp, Homo sapiens
tcattttattctt

SEQ ID NO: 596959 - DNA, 18 bp, Homo sapiens
tccaatttctattaaagg

SEQ ID NO: 596960 - DNA, 21 bp, Homo sapiens
tccctaagtccaactactaaa

SEQ ID NO: 596961 - DNA, 18 bp, Homo sapiens
tccctagctgtgacctct

SEQ ID NO: 596962 - DNA, 19 bp, Homo sapiens
tccgacaagccttcagcca

SEQ ID NO: 596963 - DNA, 17 bp, Homo sapiens
tccgactcttctgagca

SEQ ID NO: 596964 - DNA, 16 bp, Homo sapiens
tccgggacccccagga

SEQ ID NO: 596965 - DNA, 17 bp, Homo sapiens
tcctacaactaaaaata

SEQ ID NO: 596966 - DNA, 17 bp, Homo sapiens
tcctccgtcacctcaga

SEQ ID NO: 596967 - DNA, 22 bp, Homo sapiens
tcctggaggttccccagcccca

SEQ ID NO: 596968 - DNA, 23 bp, Homo sapiens
tccttgattttagccttctctgt

SEQ ID NO: 596969 - DNA, 12 bp, Homo sapiens
tcctttgttccc

SEQ ID NO: 596970 - DNA, 19 bp, Homo sapiens
tcgctttcttgctgtccaa

SEQ ID NO: 596971 - DNA, 16 bp, Homo sapiens
tctagaggcttccttc

SEQ ID NO: 596972 - DNA, 14 bp, Homo sapiens
tctatgcattttct

SEQ ID NO: 596973 - DNA, 12 bp, Homo sapiens
tctattaaaggt

SEQ ID NO: 596974 - DNA, 18 bp, Homo sapiens
tctcatctcttcttttaa

SEQ ID NO: 596975 - DNA, 14 bp, Homo sapiens
tctcatgaacctca

SEQ ID NO: 596976 - DNA, 18 bp, Homo sapiens
tctccttgttctgataat

SEQ ID NO: 596977 - DNA, 19 bp, Homo sapiens
tctctccttgttctgataa

SEQ ID NO: 596978 - DNA, 15 bp, Homo sapiens
tctctgtcgtgcttc

SEQ ID NO: 596979 - DNA, 17 bp, Homo sapiens
tctctgttcatttcctc

SEQ ID NO: 596980 - DNA, 17 bp, Homo sapiens
tctgaaacatggcctgt

SEQ ID NO: 596981 - DNA, 17 bp, Homo sapiens
tctgagttcctgcatgc

SEQ ID NO: 596982 - DNA, 15 bp, Homo sapiens
tctgataatgaaaat

SEQ ID NO: 596983 - DNA, 13 bp, Homo sapiens
tctgcctaataaa

SEQ ID NO: 596984 - DNA, 12 bp, Homo sapiens
tctgtcttgaag

SEQ ID NO: 596985 - DNA, 19 bp, Homo sapiens
tcttacaataattctatga

SEQ ID NO: 596986 - DNA, 19 bp, Homo sapiens
tcttattaaggaaatactt

SEQ ID NO: 596987 - DNA, 15 bp, Homo sapiens
tgaagggcaggtgct

SEQ ID NO: 596988 - DNA, 21 bp, Homo sapiens
tgaagggccttgagcatctgg

SEQ ID NO: 596989 - DNA, 16 bp, Homo sapiens
tgaatcctctctctgt

SEQ ID NO: 596990 - DNA, 21 bp, Homo sapiens
tgaatcctctctctgtgttac

SEQ ID NO: 596991 - DNA, 19 bp, Homo sapiens
tgagaaaagctttgaaccc

SEQ ID NO: 596992 - DNA, 16 bp, Homo sapiens
tgagaagataatcatt

SEQ ID NO: 596993 - DNA, 15 bp, Homo sapiens
tgagctcttcatgtt

SEQ ID NO: 596994 - DNA, 17 bp, Homo sapiens
tgattcattttaacatc

SEQ ID NO: 596995 - DNA, 13 bp, Homo sapiens
tgcataaattaat

SEQ ID NO: 596996 - DNA, 19 bp, Homo sapiens
tggactcgcgttcccaaag

SEQ ID NO: 596997 - DNA, 21 bp, Homo sapiens
tggactctcctagtgactggg

SEQ ID NO: 596998 - DNA, 19 bp, Homo sapiens
tggctgcataaatgtggta

SEQ ID NO: 596999 - DNA, 15 bp, Homo sapiens
tggtgtctttgatca

SEQ ID NO: 597000 - DNA, 17 bp, Homo sapiens
tgtcatttcatttccta

SEQ ID NO: 597001 - DNA, 21 bp, Homo sapiens
tgtccaatttctattaaaggt

SEQ ID NO: 597002 - DNA, 12 bp, Homo sapiens
tgtctctcatga

SEQ ID NO: 597003 - DNA, 20 bp, Homo sapiens
tgtgtttactttatgttact

SEQ ID NO: 597004 - DNA, 11 bp, Homo sapiens
tgttcatttcc

SEQ ID NO: 597005 - DNA, 15 bp, Homo sapiens
tgttctgataatgaa

SEQ ID NO: 597006 - DNA, 14 bp, Homo sapiens
ttaaagctgttatt

SEQ ID NO: 597007 - DNA, 14 bp, Homo sapiens
ttaaataaaaataa

SEQ ID NO: 597008 - DNA, 15 bp, Homo sapiens
ttaaataaaaataat

SEQ ID NO: 597009 - DNA, 19 bp, Homo sapiens
ttaatggtgccttcatttg

SEQ ID NO: 597010 - DNA, 17 bp, Homo sapiens
ttacatgattcatttta

SEQ ID NO: 597011 - DNA, 21 bp, Homo sapiens
ttaccgcgtaatgcgccaata

SEQ ID NO: 597012 - DNA, 14 bp, Homo sapiens
ttactacatgcact

SEQ ID NO: 597013 - DNA, 14 bp, Homo sapiens
ttagccttctctgt

SEQ ID NO: 597014 - DNA, 21 bp, Homo sapiens
ttagccttctctgttcatttc

SEQ ID NO: 597015 - DNA, 12 bp, Homo sapiens
ttcaacttttcc

SEQ ID NO: 597016 - DNA, 20 bp, Homo sapiens
ttcaggagagagttgaacct

SEQ ID NO: 597017 - DNA, 18 bp, Homo sapiens
ttcattttaacatctgag

SEQ ID NO: 597018 - DNA, 17 bp, Homo sapiens
ttcctacaactaaaaat

SEQ ID NO: 597019 - DNA, 18 bp, Homo sapiens
ttcctttgttccctaagt

SEQ ID NO: 597020 - DNA, 14 bp, Homo sapiens
ttctagattacttt

SEQ ID NO: 597021 - DNA, 13 bp, Homo sapiens
ttctattaaaggt

SEQ ID NO: 597022 - DNA, 15 bp, Homo sapiens
ttctgagttcctgca

SEQ ID NO: 597023 - DNA, 21 bp, Homo sapiens
ttgaaaggggttgtgaagagg

SEQ ID NO: 597024 - DNA, 15 bp, Homo sapiens
ttgaatcctctctct

SEQ ID NO: 597025 - DNA, 12 bp, Homo sapiens
ttgagcatctgg

SEQ ID NO: 597026 - DNA, 16 bp, Homo sapiens
ttgataaaaacccaaa

SEQ ID NO: 597027 - DNA, 17 bp, Homo sapiens
ttgatccttaaccaata

SEQ ID NO: 597028 - DNA, 16 bp, Homo sapiens
ttgcacagctatgaag

SEQ ID NO: 597029 - DNA, 23 bp, Homo sapiens
tttccccatttaggtttctgagt

SEQ ID NO: 597030 - DNA, 13 bp, Homo sapiens
tttctattaaagg

SEQ ID NO: 597031 - DNA, 19 bp, Homo sapiens
tttgaatcctctctctgtg

SEQ ID NO: 597032 - DNA, 18 bp, Homo sapiens
catttccaaacttgaaaa

SEQ ID NO: 597033 - DNA, 16 bp, Homo sapiens
cattttaacatctgag

SEQ ID NO: 597034 - DNA, 22 bp, Homo sapiens
ccaaataaacggactcagtgga

SEQ ID NO: 597035 - DNA, 20 bp, Homo sapiens
ccaatttctattaaaggttc

SEQ ID NO: 597036 - DNA, 14 bp, Homo sapiens
ccacagggagccac

SEQ ID NO: 597037 - DNA, 20 bp, Homo sapiens
ccagagtgctttaaaaaatt

SEQ ID NO: 597038 - DNA, 16 bp, Homo sapiens
ccagctcccagatggc

SEQ ID NO: 597039 - DNA, 13 bp, Homo sapiens
ccaggacaggctg

SEQ ID NO: 597040 - DNA, 20 bp, Homo sapiens
ccaggacaggctgcggcccc

SEQ ID NO: 597041 - DNA, 15 bp, Homo sapiens
ccattccctagtcat

SEQ ID NO: 597042 - DNA, 18 bp, Homo sapiens
cccagatggccctggaca

SEQ ID NO: 597043 - DNA, 13 bp, Homo sapiens
cccagccccactt

SEQ ID NO: 597044 - DNA, 16 bp, Homo sapiens
cccagccccacttacc

SEQ ID NO: 597045 - DNA, 13 bp, Homo sapiens
ccccagccccact

SEQ ID NO: 597046 - DNA, 14 bp, Homo sapiens
ccccaggacaggct

SEQ ID NO: 597047 - DNA, 15 bp, Homo sapiens
ccccaggacaggctg

SEQ ID NO: 597048 - DNA, 13 bp, Homo sapiens
ccctcccccgtcc

SEQ ID NO: 597049 - DNA, 17 bp, Homo sapiens
ccgcctccgggaccccc

SEQ ID NO: 597050 - DNA, 15 bp, Homo sapiens
ccgggacccccagga

SEQ ID NO: 597051 - DNA, 17 bp, Homo sapiens
ccgggacccccaggaca

SEQ ID NO: 597052 - DNA, 13 bp, Homo sapiens
cctaagtccaact

SEQ ID NO: 597053 - DNA, 13 bp, Homo sapiens
cctctcctggact

SEQ ID NO: 597054 - DNA, 16 bp, Homo sapiens
cctgcagactcactgt

SEQ ID NO: 597055 - DNA, 20 bp, Homo sapiens
cctggaactgtctctcatga

SEQ ID NO: 597056 - DNA, 13 bp, Homo sapiens
ccttcatttcctc

SEQ ID NO: 597057 - DNA, 15 bp, Homo sapiens
ccttcatttcctccg

SEQ ID NO: 597058 - DNA, 19 bp, Homo sapiens
ccttctctgttcatttcct

SEQ ID NO: 597059 - DNA, 12 bp, Homo sapiens
ccttgagcatct

SEQ ID NO: 597060 - DNA, 22 bp, Homo sapiens
ccttggggattcttccatctga

SEQ ID NO: 597061 - DNA, 14 bp, Homo sapiens
cctttgaatcctct

SEQ ID NO: 597062 - DNA, 19 bp, Homo sapiens
cctttgttccctaagtcca

SEQ ID NO: 597063 - DNA, 17 bp, Homo sapiens
cgacaagccttcagcca

SEQ ID NO: 597064 - DNA, 22 bp, Homo sapiens
cgcgtgacacaatgctgggtgg

SEQ ID NO: 597065 - DNA, 22 bp, Homo sapiens
cggacgcgcgtgacacaatgct

SEQ ID NO: 597066 - DNA, 20 bp, Homo sapiens
cggtggctcacgcctgtaat

SEQ ID NO: 597067 - DNA, 17 bp, Homo sapiens
cgtgtccgactcttctg

SEQ ID NO: 597068 - DNA, 15 bp, Homo sapiens
ctaaaaataaattaa

SEQ ID NO: 597069 - DNA, 19 bp, Homo sapiens
ctaagtccaactactaaac

SEQ ID NO: 597070 - DNA, 20 bp, Homo sapiens
ctaagtccaactactaaact

SEQ ID NO: 597071 - DNA, 19 bp, Homo sapiens
ctagaggcttccttcattt

SEQ ID NO: 597072 - DNA, 21 bp, Homo sapiens
ctagaggcttccttcatttcc

SEQ ID NO: 597073 - DNA, 22 bp, Homo sapiens
ctagtcagtaaagatatttgaa

SEQ ID NO: 597074 - DNA, 23 bp, Homo sapiens
ctataaaaatgcccctcccagat

SEQ ID NO: 597075 - DNA, 13 bp, Homo sapiens
ctatgaaggctgt

SEQ ID NO: 597076 - DNA, 22 bp, Homo sapiens
ctcacgcctgtaatcccagcat

SEQ ID NO: 597077 - DNA, 23 bp, Homo sapiens
ctcagaccagctcccagatggcc

SEQ ID NO: 597078 - DNA, 20 bp, Homo sapiens
ctcagtggacactcagacca

SEQ ID NO: 597079 - DNA, 21 bp, Homo sapiens
ctcagtggacactcagaccag

SEQ ID NO: 597080 - DNA, 17 bp, Homo sapiens
ctcccccgtcctggagg

SEQ ID NO: 597081 - DNA, 17 bp, Homo sapiens
ctcctagtgactgggga

SEQ ID NO: 597082 - DNA, 21 bp, Homo sapiens
ctccttgattttagccttctc

SEQ ID NO: 597083 - DNA, 13 bp, Homo sapiens
ctcgctagtcagt

SEQ ID NO: 597084 - DNA, 14 bp, Homo sapiens
ctctcatgaacctc

SEQ ID NO: 597085 - DNA, 20 bp, Homo sapiens
ctctgaaacatggcctgttt

SEQ ID NO: 597086 - DNA, 15 bp, Homo sapiens
ctctggtgtctttga

SEQ ID NO: 597087 - DNA, 14 bp, Homo sapiens
ctctgttcatttcc

SEQ ID NO: 597088 - DNA, 17 bp, Homo sapiens
ctcttaaataaaaataa

SEQ ID NO: 597089 - DNA, 21 bp, Homo sapiens
ctgagaaaagctttgaaccct

SEQ ID NO: 597090 - DNA, 21 bp, Homo sapiens
ctgcagatggttgcaattgat

SEQ ID NO: 597091 - DNA, 20 bp, Homo sapiens
ctgcatctagaggcttcctt

SEQ ID NO: 597092 - DNA, 18 bp, Homo sapiens
ctggaactgtctctcatg

SEQ ID NO: 597093 - DNA, 19 bp, Homo sapiens
ctggactcgcgttcccaaa

SEQ ID NO: 597094 - DNA, 14 bp, Homo sapiens
ctggtctctccttg

SEQ ID NO: 597095 - DNA, 16 bp, Homo sapiens
ctgtcaatggttatgg

SEQ ID NO: 597096 - DNA, 13 bp, Homo sapiens
ctgtctctcatga

SEQ ID NO: 597097 - DNA, 17 bp, Homo sapiens
ctgtctctcatgaacct

SEQ ID NO: 597098 - DNA, 15 bp, Homo sapiens
ctgtgggtagtatga

SEQ ID NO: 597099 - DNA, 14 bp, Homo sapiens
ctgttcatttcctc

SEQ ID NO: 597100 - DNA, 16 bp, Homo sapiens
cttaaataaaaataat

SEQ ID NO: 597101 - DNA, 18 bp, Homo sapiens
cttacatgcattactgca

SEQ ID NO: 597102 - DNA, 17 bp, Homo sapiens
cttatcttttggcttct

SEQ ID NO: 597103 - DNA, 18 bp, Homo sapiens
cttattaaggaaatactt

SEQ ID NO: 597104 - DNA, 18 bp, Homo sapiens
cttcatttgggatgctac

SEQ ID NO: 597105 - DNA, 17 bp, Homo sapiens
cttctctgttcatttcc

SEQ ID NO: 597106 - DNA, 12 bp, Homo sapiens
cttgagcatctg

SEQ ID NO: 597107 - DNA, 19 bp, Homo sapiens
cttgattttagccttctct

SEQ ID NO: 597108 - DNA, 19 bp, Homo sapiens
cttggggattcttccatct

SEQ ID NO: 597109 - DNA, 13 bp, Homo sapiens
aaaaacccaaaat

SEQ ID NO: 597110 - DNA, 14 bp, Homo sapiens
aaaaacccaaaata

SEQ ID NO: 597111 - DNA, 14 bp, Homo sapiens
aaacacggacccat

SEQ ID NO: 597112 - DNA, 19 bp, Homo sapiens
aaatactttgcataaatta

SEQ ID NO: 597113 - DNA, 20 bp, Homo sapiens
aaatactttgcataaattaa

SEQ ID NO: 597114 - DNA, 11 bp, Homo sapiens
aaatgaagaaa

SEQ ID NO: 597115 - DNA, 17 bp, Homo sapiens
aaatgcccctcccagat

SEQ ID NO: 597116 - DNA, 13 bp, Homo sapiens
aaatggcagtttt

SEQ ID NO: 597117 - DNA, 14 bp, Homo sapiens
aaattcattttatt

SEQ ID NO: 597118 - DNA, 16 bp, Homo sapiens
aaattctcttaaataa

SEQ ID NO: 597119 - DNA, 16 bp, Homo sapiens
aacagaatcagtgtta

SEQ ID NO: 597120 - DNA, 22 bp, Homo sapiens
aacatagaaattgcctgacgaa

SEQ ID NO: 597121 - DNA, 17 bp, Homo sapiens
aacatttattttcattg

SEQ ID NO: 597122 - DNA, 19 bp, Homo sapiens
aaccattccctagtcattt

SEQ ID NO: 597123 - DNA, 15 bp, Homo sapiens
aacggactcagtgga

SEQ ID NO: 597124 - DNA, 17 bp, Homo sapiens
aactcatctgtcaccaa

SEQ ID NO: 597125 - DNA, 18 bp, Homo sapiens
aagaggcacctgtcccag

SEQ ID NO: 597126 - DNA, 16 bp, Homo sapiens
aagataatcattgctt

SEQ ID NO: 597127 - DNA, 13 bp, Homo sapiens
aatacaaataata

SEQ ID NO: 597128 - DNA, 20 bp, Homo sapiens
aatcttatcttttggcttct

SEQ ID NO: 597129 - DNA, 16 bp, Homo sapiens
aatgaatgaatggctt

SEQ ID NO: 597130 - DNA, 19 bp, Homo sapiens
aatggttatgggtcctata

SEQ ID NO: 597131 - DNA, 20 bp, Homo sapiens
aatgtgatttacgctcattg

SEQ ID NO: 597132 - DNA, 12 bp, Homo sapiens
aattaataaatt

SEQ ID NO: 597133 - DNA, 16 bp, Homo sapiens
aattctcttaaataaa

SEQ ID NO: 597134 - DNA, 16 bp, Homo sapiens
aatttctattaaaggt

SEQ ID NO: 597135 - DNA, 17 bp, Homo sapiens
aatttgataaaaaccca

SEQ ID NO: 597136 - DNA, 18 bp, Homo sapiens
aatttgggggacttacat

SEQ ID NO: 597137 - DNA, 16 bp, Homo sapiens
acaaaactagagactc

SEQ ID NO: 597138 - DNA, 15 bp, Homo sapiens
acaagccttcagcca

SEQ ID NO: 597139 - DNA, 18 bp, Homo sapiens
acaagccttcagccacag

SEQ ID NO: 597140 - DNA, 14 bp, Homo sapiens
acactcagaccagc

SEQ ID NO: 597141 - DNA, 18 bp, Homo sapiens
acagctcagaagtttctt

SEQ ID NO: 597142 - DNA, 16 bp, Homo sapiens
acaggctgcggcccct

SEQ ID NO: 597143 - DNA, 12 bp, Homo sapiens
acagggagccac

SEQ ID NO: 597144 - DNA, 16 bp, Homo sapiens
acagggagccacacag

SEQ ID NO: 597145 - DNA, 16 bp, Homo sapiens
acatagaaattgcctg

SEQ ID NO: 597146 - DNA, 13 bp, Homo sapiens
acatgattcattt

SEQ ID NO: 597147 - DNA, 14 bp, Homo sapiens
acccatagacagcc

SEQ ID NO: 597148 - DNA, 21 bp, Homo sapiens
acccgttcaacttttcctttg

SEQ ID NO: 597149 - DNA, 12 bp, Homo sapiens
acctatgtcatt

SEQ ID NO: 597150 - DNA, 16 bp, Homo sapiens
acctatgtcatttcat

SEQ ID NO: 597151 - DNA, 22 bp, Homo sapiens
acctatgtcatttcatttccta

SEQ ID NO: 597152 - DNA, 14 bp, Homo sapiens
acctcaagctgcat

SEQ ID NO: 597153 - DNA, 16 bp, Homo sapiens
acctcaagctgcatct

SEQ ID NO: 597154 - DNA, 17 bp, Homo sapiens
acctctcccctggaact

SEQ ID NO: 597155 - DNA, 16 bp, Homo sapiens
actaaaaataaattaa

SEQ ID NO: 597156 - DNA, 14 bp, Homo sapiens
actacatgcacttg

SEQ ID NO: 597157 - DNA, 12 bp, Homo sapiens
actctcctagtg

SEQ ID NO: 597158 - DNA, 20 bp, Homo sapiens
actgcaaatggcagttttaa

SEQ ID NO: 597159 - DNA, 12 bp, Homo sapiens
actgcatgcact

SEQ ID NO: 597160 - DNA, 17 bp, Homo sapiens
actgtctctcatgaacc

SEQ ID NO: 597161 - DNA, 12 bp, Homo sapiens
acttacatgatt

SEQ ID NO: 597162 - DNA, 19 bp, Homo sapiens
acttacatgattcatttta

SEQ ID NO: 597163 - DNA, 18 bp, Homo sapiens
acttttcctttgaatcct

SEQ ID NO: 597164 - DNA, 20 bp, Homo sapiens
agaagataatcattgcttat

SEQ ID NO: 597165 - DNA, 17 bp, Homo sapiens
agacaggctggcattct

SEQ ID NO: 597166 - DNA, 20 bp, Homo sapiens
agaggcttccttcatttcct

SEQ ID NO: 597167 - DNA, 12 bp, Homo sapiens
agagttgaacct

SEQ ID NO: 597168 - DNA, 14 bp, Homo sapiens
agataatcattgct

SEQ ID NO: 597169 - DNA, 14 bp, Homo sapiens
agatccacccaaat

SEQ ID NO: 597170 - DNA, 20 bp, Homo sapiens
agcaaagatatctcatctct

SEQ ID NO: 597171 - DNA, 19 bp, Homo sapiens
agcatatgatttcttgctt

SEQ ID NO: 597172 - DNA, 17 bp, Homo sapiens
agccacagggagccaca

SEQ ID NO: 597173 - DNA, 23 bp, Homo sapiens
agccccagagtgctttaaaaaat

SEQ ID NO: 597174 - DNA, 12 bp, Homo sapiens
agccttctctgt

SEQ ID NO: 597175 - DNA, 20 bp, Homo sapiens
agccttctctgttcatttcc

SEQ ID NO: 597176 - DNA, 21 bp, Homo sapiens
agccttctctgttcatttcct

SEQ ID NO: 597177 - DNA, 16 bp, Homo sapiens
agccttggggattctt

SEQ ID NO: 597178 - DNA, 22 bp, Homo sapiens
aggaaatactttgcataaatta

SEQ ID NO: 597179 - DNA, 16 bp, Homo sapiens
aggacaggctgcggcc

SEQ ID NO: 597180 - DNA, 17 bp, Homo sapiens
aggactccttaaatttg

SEQ ID NO: 597181 - DNA, 14 bp, Homo sapiens
aggagagagttgaa

SEQ ID NO: 597182 - DNA, 14 bp, Homo sapiens
aggcattaaatttt

SEQ ID NO: 597183 - DNA, 16 bp, Homo sapiens
aggctgcggcccctcc

SEQ ID NO: 597184 - DNA, 14 bp, Homo sapiens
aggcttccttcatt

SEQ ID NO: 597185 - DNA, 19 bp, Homo sapiens
aggcttccttcatttcctc

SEQ ID NO: 597186 - DNA, 21 bp, Homo sapiens
aggcttccttcatttcctccg

SEQ ID NO: 597187 - DNA, 16 bp, Homo sapiens
agggcaggtgcttcag

SEQ ID NO: 597188 - DNA, 14 bp, Homo sapiens
aggtgaaatgaatg

SEQ ID NO: 597189 - DNA, 22 bp, Homo sapiens
agtaaagatatttgaatatgta

SEQ ID NO: 597190 - DNA, 20 bp, Homo sapiens
agtcatttccaaacttgaaa

SEQ ID NO: 597191 - DNA, 18 bp, Homo sapiens
agtgctgggcaagtttac

SEQ ID NO: 597192 - DNA, 17 bp, Homo sapiens
agttgcacagctatgaa

SEQ ID NO: 597193 - DNA, 22 bp, Homo sapiens
agtttaatggtgccttcatttg

SEQ ID NO: 597194 - DNA, 20 bp, Homo sapiens
ataaaaaacatttattttca

SEQ ID NO: 597195 - DNA, 13 bp, Homo sapiens
ataaattaataaa

SEQ ID NO: 597196 - DNA, 14 bp, Homo sapiens
ataaggtaaaattt

SEQ ID NO: 597197 - DNA, 12 bp, Homo sapiens
ataatcattgct

SEQ ID NO: 597198 - DNA, 13 bp, Homo sapiens
atacagctcagaa

SEQ ID NO: 597199 - DNA, 15 bp, Homo sapiens
atcatggctatctgt

SEQ ID NO: 597200 - DNA, 14 bp, Homo sapiens
atcattgcttatgt

SEQ ID NO: 597201 - DNA, 16 bp, Homo sapiens
atccttaaccaataat

SEQ ID NO: 597202 - DNA, 14 bp, Homo sapiens
atctcttcttttaa

SEQ ID NO: 597203 - DNA, 18 bp, Homo sapiens
atctgagaaaagctttga

SEQ ID NO: 597204 - DNA, 14 bp, Homo sapiens
atcttttggcttct

SEQ ID NO: 597205 - DNA, 23 bp, Homo sapiens
atgaacctcaagctgcatctaga

SEQ ID NO: 597206 - DNA, 22 bp, Homo sapiens
atgaagggccttgagcatctgg

SEQ ID NO: 597207 - DNA, 15 bp, Homo sapiens
atgaatgaatggctt

SEQ ID NO: 597208 - DNA, 13 bp, Homo sapiens
atgattcatttta

SEQ ID NO: 597209 - DNA, 14 bp, Homo sapiens
atgatttcttgctt

SEQ ID NO: 597210 - DNA, 17 bp, Homo sapiens
atgatttcttgctttgg

SEQ ID NO: 597211 - DNA, 16 bp, Homo sapiens
atgcgccaataaacca

SEQ ID NO: 597212 - DNA, 21 bp, Homo sapiens
atggaccctctcctggactcg

SEQ ID NO: 597213 - DNA, 13 bp, Homo sapiens
atggccctggaca

SEQ ID NO: 597214 - DNA, 20 bp, Homo sapiens
atgtcaaatggagctgaatt

SEQ ID NO: 597215 - DNA, 18 bp, Homo sapiens
atgtcatttcatttccta

SEQ ID NO: 597216 - DNA, 17 bp, Homo sapiens
atgtgtttactttatgt

SEQ ID NO: 597217 - DNA, 22 bp, Homo sapiens
attaaaggttcctttgttccct

SEQ ID NO: 597218 - DNA, 14 bp, Homo sapiens
attactgcatgcac

SEQ ID NO: 597219 - DNA, 21 bp, Homo sapiens
attcattttaacatctgagaa

SEQ ID NO: 597220 - DNA, 15 bp, Homo sapiens
attctcttaaataaa

SEQ ID NO: 597221 - DNA, 17 bp, Homo sapiens
aatcagtgttaaattca

SEQ ID NO: 597222 - DNA, 16 bp, Homo sapiens
aatgcccctcccagat

SEQ ID NO: 597223 - DNA, 20 bp, Homo sapiens
aatggaccctctcctggact

SEQ ID NO: 597224 - DNA, 15 bp, Homo sapiens
aattaaagctgttat

SEQ ID NO: 597225 - DNA, 15 bp, Homo sapiens
aattctcttaaataa

SEQ ID NO: 597226 - DNA, 15 bp, Homo sapiens
aattgcctgacgaac

SEQ ID NO: 597227 - DNA, 15 bp, Homo sapiens
catcatggctatctg

SEQ ID NO: 597228 - DNA, 19 bp, Homo sapiens
catctagaggcttccttca

SEQ ID NO: 597229 - DNA, 17 bp, Homo sapiens
catctggattctgccta

SEQ ID NO: 597230 - DNA, 23 bp, Homo sapiens
catctggattctgcctaataaaa

SEQ ID NO: 597231 - DNA, 16 bp, Homo sapiens
catgaaggtgtcatac

SEQ ID NO: 597232 - DNA, 20 bp, Homo sapiens
catgcattactgcatgcact

SEQ ID NO: 597233 - DNA, 13 bp, Homo sapiens
catgtgccatttt

SEQ ID NO: 597234 - DNA, 18 bp, Homo sapiens
catgtgtttactttatgt

SEQ ID NO: 597235 - DNA, 13 bp, Homo sapiens
cattactgcatgc

SEQ ID NO: 597236 - DNA, 14 bp, Homo sapiens
cattgtagaaaagc

SEQ ID NO: 597237 - DNA, 16 bp, Homo sapiens
ccagatttttacacat

SEQ ID NO: 597238 - DNA, 21 bp, Homo sapiens
cccagagtgctttaaaaaatt

SEQ ID NO: 597239 - DNA, 15 bp, Homo sapiens
ccccagccccactta

SEQ ID NO: 597240 - DNA, 14 bp, Homo sapiens
cccccaggacaggc

SEQ ID NO: 597241 - DNA, 20 bp, Homo sapiens
cccctcccccgtcctggagg

SEQ ID NO: 597242 - DNA, 14 bp, Homo sapiens
ccctaagtccaact

SEQ ID NO: 597243 - DNA, 13 bp, Homo sapiens
ccctctcctggac

SEQ ID NO: 597244 - DNA, 16 bp, Homo sapiens
ccctggacagcaggag

SEQ ID NO: 597245 - DNA, 15 bp, Homo sapiens
ccctgggggagcctc

SEQ ID NO: 597246 - DNA, 18 bp, Homo sapiens
ccgcctccgggaccccca

SEQ ID NO: 597247 - DNA, 22 bp, Homo sapiens
ccgcctccgggacccccaggac

SEQ ID NO: 597248 - DNA, 13 bp, Homo sapiens
ccgggacccccag

SEQ ID NO: 597249 - DNA, 20 bp, Homo sapiens
ccgtcctggaggttccccag

SEQ ID NO: 597250 - DNA, 16 bp, Homo sapiens
cctacaactaaaaata

SEQ ID NO: 597251 - DNA, 20 bp, Homo sapiens
cctacaactaaaaataaatt

SEQ ID NO: 597252 - DNA, 15 bp, Homo sapiens
cctccgggaccccca

SEQ ID NO: 597253 - DNA, 19 bp, Homo sapiens
cctccgggacccccaggac

SEQ ID NO: 597254 - DNA, 15 bp, Homo sapiens
cctgcagactcactg

SEQ ID NO: 597255 - DNA, 16 bp, Homo sapiens
cctggaggttccccag

SEQ ID NO: 597256 - DNA, 12 bp, Homo sapiens
ccttcatttcct

SEQ ID NO: 597257 - DNA, 13 bp, Homo sapiens
ccttctctgttca

SEQ ID NO: 597258 - DNA, 17 bp, Homo sapiens
ccttctctgttcatttc

SEQ ID NO: 597259 - DNA, 18 bp, Homo sapiens
ccttctctgttcatttcc

SEQ ID NO: 597260 - DNA, 13 bp, Homo sapiens
ccttgagcatctg

SEQ ID NO: 597261 - DNA, 14 bp, Homo sapiens
ccttgagcatctgg

SEQ ID NO: 597262 - DNA, 20 bp, Homo sapiens
cctttagagtgtaggtgaaa

SEQ ID NO: 597263 - DNA, 11 bp, Homo sapiens
cctttgttccc

SEQ ID NO: 597264 - DNA, 17 bp, Homo sapiens
cgcctccgggaccccca

SEQ ID NO: 597265 - DNA, 22 bp, Homo sapiens
cgcctccgggacccccaggaca

SEQ ID NO: 597266 - DNA, 17 bp, Homo sapiens
cgtaatgcgccaataaa

SEQ ID NO: 597267 - DNA, 20 bp, Homo sapiens
cgtcctggaggttccccagc

SEQ ID NO: 597268 - DNA, 19 bp, Homo sapiens
cgttcaacttttcctttga

SEQ ID NO: 597269 - DNA, 22 bp, Homo sapiens
ctaattggcatgaaggtgtcat

SEQ ID NO: 597270 - DNA, 23 bp, Homo sapiens
ctagaggcttccttcatttcctc

SEQ ID NO: 597271 - DNA, 16 bp, Homo sapiens
ctcagaagtttcttct

SEQ ID NO: 597272 - DNA, 12 bp, Homo sapiens
ctcatctgtcac

SEQ ID NO: 597273 - DNA, 14 bp, Homo sapiens
ctcatctgtcacca

SEQ ID NO: 597274 - DNA, 22 bp, Homo sapiens
ctcccctggaactgtctctcat

SEQ ID NO: 597275 - DNA, 15 bp, Homo sapiens
ctccgggacccccag

SEQ ID NO: 597276 - DNA, 16 bp, Homo sapiens
ctccgggacccccagg

SEQ ID NO: 597277 - DNA, 13 bp, Homo sapiens
ctctcatgaacct

SEQ ID NO: 597278 - DNA, 21 bp, Homo sapiens
ctctcccctggaactgtctct

SEQ ID NO: 597279 - DNA, 16 bp, Homo sapiens
ctgagttcctgcatgc

SEQ ID NO: 597280 - DNA, 22 bp, Homo sapiens
ctgcacgaatggaagaggcacc

SEQ ID NO: 597281 - DNA, 21 bp, Homo sapiens
ctgcatctagaggcttccttc

SEQ ID NO: 597282 - DNA, 16 bp, Homo sapiens
ctggaactgtctctca

SEQ ID NO: 597283 - DNA, 19 bp, Homo sapiens
ctggaactgtctctcatga

SEQ ID NO: 597284 - DNA, 20 bp, Homo sapiens
ctggattctgcctaataaaa

SEQ ID NO: 597285 - DNA, 13 bp, Homo sapiens
ctgtacactgcac

SEQ ID NO: 597286 - DNA, 14 bp, Homo sapiens
cttaaataaaaata

SEQ ID NO: 597287 - DNA, 18 bp, Homo sapiens
cttaaccaataatggtca

SEQ ID NO: 597288 - DNA, 12 bp, Homo sapiens
cttacatgattc

SEQ ID NO: 597289 - DNA, 15 bp, Homo sapiens
cttccttcatttcct

SEQ ID NO: 597290 - DNA, 14 bp, Homo sapiens
cttctctgttcatt

SEQ ID NO: 597291 - DNA, 23 bp, Homo sapiens
cttgaaaacagaatcagtgttaa

SEQ ID NO: 597292 - DNA, 20 bp, Homo sapiens
cttgattttagccttctctg

SEQ ID NO: 597293 - DNA, 21 bp, Homo sapiens
cttgattttagccttctctgt

SEQ ID NO: 597294 - DNA, 12 bp, Homo sapiens
cttgctgtccaa

SEQ ID NO: 597295 - DNA, 21 bp, Homo sapiens
cttggggattcttccatctga

SEQ ID NO: 597296 - DNA, 16 bp, Homo sapiens
ctttcttgctgtccaa

SEQ ID NO: 597297 - DNA, 19 bp, Homo sapiens
ctttgaatcctctctctgt

SEQ ID NO: 597298 - DNA, 17 bp, Homo sapiens
cttttaaaccattttct

SEQ ID NO: 597299 - DNA, 21 bp, Homo sapiens
gaaaacagaatcagtgttaaa

SEQ ID NO: 597300 - DNA, 18 bp, Homo sapiens
gaacagcatatgatttct

SEQ ID NO: 597301 - DNA, 15 bp, Homo sapiens
gaactccttgatttt

SEQ ID NO: 597302 - DNA, 21 bp, Homo sapiens
gaactgtctctcatgaacctc

SEQ ID NO: 597303 - DNA, 18 bp, Homo sapiens
gaagggccttgagcatct

SEQ ID NO: 597304 - DNA, 20 bp, Homo sapiens
gaagggccttgagcatctgg

SEQ ID NO: 597305 - DNA, 15 bp, Homo sapiens
gacaggctgcggccc

SEQ ID NO: 597306 - DNA, 18 bp, Homo sapiens
gacaggctggcattctag

SEQ ID NO: 597307 - DNA, 12 bp, Homo sapiens
gacctgaagaat

SEQ ID NO: 597308 - DNA, 22 bp, Homo sapiens
gacgtgcagacaggctggcatt

SEQ ID NO: 597309 - DNA, 16 bp, Homo sapiens
gacttacatgattcat

SEQ ID NO: 597310 - DNA, 19 bp, Homo sapiens
gacttacatgattcatttt

SEQ ID NO: 597311 - DNA, 16 bp, Homo sapiens
gagagagttgaaccta

SEQ ID NO: 597312 - DNA, 17 bp, Homo sapiens
gaggcttcccagagacc

SEQ ID NO: 597313 - DNA, 14 bp, Homo sapiens
gaggcttccttcat

SEQ ID NO: 597314 - DNA, 13 bp, Homo sapiens
gagtgctttaaaa

SEQ ID NO: 597315 - DNA, 14 bp, Homo sapiens
gagttcctgcatgc

SEQ ID NO: 597316 - DNA, 15 bp, Homo sapiens
gataatcattgctta

SEQ ID NO: 597317 - DNA, 18 bp, Homo sapiens
gataccatatacagctca

SEQ ID NO: 597318 - DNA, 15 bp, Homo sapiens
gatgctatgaaattg

SEQ ID NO: 597319 - DNA, 15 bp, Homo sapiens
gatttacgctcattg

SEQ ID NO: 597320 - DNA, 16 bp, Homo sapiens
gcaaagatatctcatc

SEQ ID NO: 597321 - DNA, 13 bp, Homo sapiens
gcaaatggcagtt

SEQ ID NO: 597322 - DNA, 16 bp, Homo sapiens
gcacagctatgaaggc

SEQ ID NO: 597323 - DNA, 20 bp, Homo sapiens
gcagacaggctggcattcta

SEQ ID NO: 597324 - DNA, 13 bp, Homo sapiens
gcagactcactgt

SEQ ID NO: 597325 - DNA, 21 bp, Homo sapiens
gcatctagaggcttccttcat

SEQ ID NO: 597326 - DNA, 23 bp, Homo sapiens
gcatctagaggcttccttcattt

SEQ ID NO: 597327 - DNA, 23 bp, Homo sapiens
gcattaaattttagcaaagatat

SEQ ID NO: 597328 - DNA, 16 bp, Homo sapiens
gccaataaaccaatga

SEQ ID NO: 597329 - DNA, 19 bp, Homo sapiens
gccaataaaccaatgaacg

SEQ ID NO: 597330 - DNA, 14 bp, Homo sapiens
gccacagggagcca

SEQ ID NO: 597331 - DNA, 16 bp, Homo sapiens
gccccagagtgcttta

SEQ ID NO: 597332 - DNA, 22 bp, Homo sapiens
gcccctcccccgtcctggaggt

SEQ ID NO: 597333 - DNA, 19 bp, Homo sapiens
gccgcctccgggaccccca

SEQ ID NO: 597334 - DNA, 20 bp, Homo sapiens
gcctccgggacccccaggac

SEQ ID NO: 597335 - DNA, 16 bp, Homo sapiens
gcctgcagactcactg

SEQ ID NO: 597336 - DNA, 23 bp, Homo sapiens
gctagtcagtaaagatatttgaa

SEQ ID NO: 597337 - DNA, 14 bp, Homo sapiens
gcttccttcatttc

SEQ ID NO: 597338 - DNA, 13 bp, Homo sapiens
gctttggggaaaa

SEQ ID NO: 597339 - DNA, 17 bp, Homo sapiens
ggacactcagaccagct

SEQ ID NO: 597340 - DNA, 22 bp, Homo sapiens
ggacaggctgcggcccctcccc

SEQ ID NO: 597341 - DNA, 23 bp, Homo sapiens
ggcagttttaatcttatcttttg

SEQ ID NO: 597342 - DNA, 15 bp, Homo sapiens
ggccttgagcatctg

SEQ ID NO: 597343 - DNA, 12 bp, Homo sapiens
ggctgcggcccc

SEQ ID NO: 597344 - DNA, 12 bp, Homo sapiens
tggcatgtgttt

SEQ ID NO: 597345 - DNA, 19 bp, Homo sapiens
tggggaaaaagaatgatgc

SEQ ID NO: 597346 - DNA, 14 bp, Homo sapiens
tggtgccttcattt

SEQ ID NO: 597347 - DNA, 14 bp, Homo sapiens
tggtgtatttgaga

SEQ ID NO: 597348 - DNA, 14 bp, Homo sapiens
tgtatttgagaaga

SEQ ID NO: 597349 - DNA, 21 bp, Homo sapiens
tgtggtacaagcattctgtct

SEQ ID NO: 597350 - DNA, 19 bp, Homo sapiens
aaaaataaattaataaatt

SEQ ID NO: 597351 - DNA, 13 bp, Homo sapiens
aaaataaattaat

SEQ ID NO: 597352 - DNA, 16 bp, Homo sapiens
aaataaggtaaaattt

SEQ ID NO: 597353 - DNA, 15 bp, Homo sapiens
aaatatcttgaaagg

SEQ ID NO: 597354 - DNA, 20 bp, Homo sapiens
aaattaatcagccccagagt

SEQ ID NO: 597355 - DNA, 17 bp, Homo sapiens
aaattctcttaaataaa

SEQ ID NO: 597356 - DNA, 21 bp, Homo sapiens
aacatctgagaaaagctttga

SEQ ID NO: 597357 - DNA, 15 bp, Homo sapiens
aaccaatgaacgaag

SEQ ID NO: 597358 - DNA, 18 bp, Homo sapiens
aaccattccctagtcatt

SEQ ID NO: 597359 - DNA, 21 bp, Homo sapiens
aaccattccctagtcatttcc

SEQ ID NO: 597360 - DNA, 19 bp, Homo sapiens
aacggactcagtggacact

SEQ ID NO: 597361 - DNA, 17 bp, Homo sapiens
aactaaaaataaattaa

SEQ ID NO: 597362 - DNA, 17 bp, Homo sapiens
aagataatcattgctta

SEQ ID NO: 597363 - DNA, 21 bp, Homo sapiens
aaggaaatactttgcataaat

SEQ ID NO: 597364 - DNA, 22 bp, Homo sapiens
aataaaaaacatttattttcat

SEQ ID NO: 597365 - DNA, 19 bp, Homo sapiens
aataaaccaatgaacgaag

SEQ ID NO: 597366 - DNA, 18 bp, Homo sapiens
aatactttgcataaatta

SEQ ID NO: 597367 - DNA, 13 bp, Homo sapiens
aatcagtgttaaa

SEQ ID NO: 597368 - DNA, 18 bp, Homo sapiens
aatcctctctctgtgtta

SEQ ID NO: 597369 - DNA, 19 bp, Homo sapiens
aattgatccttaaccaata

SEQ ID NO: 597370 - DNA, 15 bp, Homo sapiens
acaactaaaaataaa

SEQ ID NO: 597371 - DNA, 19 bp, Homo sapiens
acaactaaaaataaattaa

SEQ ID NO: 597372 - DNA, 22 bp, Homo sapiens
acaacttgtctattacctgtta

SEQ ID NO: 597373 - DNA, 19 bp, Homo sapiens
acaattaaagctgttattt

SEQ ID NO: 597374 - DNA, 22 bp, Homo sapiens
acagcatatgatttcttgcttt

SEQ ID NO: 597375 - DNA, 15 bp, Homo sapiens
acaggctggcattct

SEQ ID NO: 597376 - DNA, 13 bp, Homo sapiens
acagggagccaca

SEQ ID NO: 597377 - DNA, 17 bp, Homo sapiens
acccagtaactcatctg

SEQ ID NO: 597378 - DNA, 20 bp, Homo sapiens
acccagtgagacagaccgcc

SEQ ID NO: 597379 - DNA, 13 bp, Homo sapiens
acccatagacagc

SEQ ID NO: 597380 - DNA, 12 bp, Homo sapiens
acccccaggaca

SEQ ID NO: 597381 - DNA, 16 bp, Homo sapiens
accctctcctggactc

SEQ ID NO: 597382 - DNA, 19 bp, Homo sapiens
acctatgtcatttcatttc

SEQ ID NO: 597383 - DNA, 16 bp, Homo sapiens
acctgaagaatcacaa

SEQ ID NO: 597384 - DNA, 14 bp, Homo sapiens
actactaaactggg

SEQ ID NO: 597385 - DNA, 18 bp, Homo sapiens
actattatccccatttct

SEQ ID NO: 597386 - DNA, 13 bp, Homo sapiens
actcagaccagct

SEQ ID NO: 597387 - DNA, 23 bp, Homo sapiens
actccttgattttagccttctct

SEQ ID NO: 597388 - DNA, 15 bp, Homo sapiens
actgcaaatggcagt

SEQ ID NO: 597389 - DNA, 14 bp, Homo sapiens
actgcatgcacttc

SEQ ID NO: 597390 - DNA, 18 bp, Homo sapiens
acttacatgattcatttt

SEQ ID NO: 597391 - DNA, 11 bp, Homo sapiens
acttggactct

SEQ ID NO: 597392 - DNA, 16 bp, Homo sapiens
acttgtctattacctg

SEQ ID NO: 597393 - DNA, 19 bp, Homo sapiens
acttttcctttgaatcctc

SEQ ID NO: 597394 - DNA, 13 bp, Homo sapiens
agaaaagctataa

SEQ ID NO: 597395 - DNA, 21 bp, Homo sapiens
agaaaagctataaaatgaata

SEQ ID NO: 597396 - DNA, 18 bp, Homo sapiens
agaacagcatatgatttc

SEQ ID NO: 597397 - DNA, 18 bp, Homo sapiens
agaagataatcattgctt

SEQ ID NO: 597398 - DNA, 14 bp, Homo sapiens
agaatcagtgttaa

SEQ ID NO: 597399 - DNA, 21 bp, Homo sapiens
agaatcagtgttaaattcatt

SEQ ID NO: 597400 - DNA, 12 bp, Homo sapiens
agaatgatgcta

SEQ ID NO: 597401 - DNA, 15 bp, Homo sapiens
agaatgatgctatga

SEQ ID NO: 597402 - DNA, 16 bp, Homo sapiens
agacagccctggggga

SEQ ID NO: 597403 - DNA, 23 bp, Homo sapiens
agaggacgtgcagacaggctggc

SEQ ID NO: 597404 - DNA, 19 bp, Homo sapiens
agagtgtaggtgaaatgaa

SEQ ID NO: 597405 - DNA, 15 bp, Homo sapiens
agataatcattgctt

SEQ ID NO: 597406 - DNA, 18 bp, Homo sapiens
agataatcattgcttatg

SEQ ID NO: 597407 - DNA, 15 bp, Homo sapiens
agatccacccaaata

SEQ ID NO: 597408 - DNA, 15 bp, Homo sapiens
agcacctacttacat

SEQ ID NO: 597409 - DNA, 13 bp, Homo sapiens
agccacagggagc

SEQ ID NO: 597410 - DNA, 17 bp, Homo sapiens
agccccagagtgcttta

SEQ ID NO: 597411 - DNA, 15 bp, Homo sapiens
agccctgggggagcc

SEQ ID NO: 597412 - DNA, 18 bp, Homo sapiens
agccctgggggagcctct

SEQ ID NO: 597413 - DNA, 14 bp, Homo sapiens
agccttctctgttc

SEQ ID NO: 597414 - DNA, 15 bp, Homo sapiens
agccttctctgttca

SEQ ID NO: 597415 - DNA, 19 bp, Homo sapiens
agccttctctgttcatttc

SEQ ID NO: 597416 - DNA, 22 bp, Homo sapiens
agccttctctgttcatttcctc

SEQ ID NO: 597417 - DNA, 18 bp, Homo sapiens
agctataaaatgaataca

SEQ ID NO: 597418 - DNA, 22 bp, Homo sapiens
agctatgaagtgctgggcaagt

SEQ ID NO: 597419 - DNA, 14 bp, Homo sapiens
agctcccagatggc

SEQ ID NO: 597420 - DNA, 23 bp, Homo sapiens
aggaaatactttgcataaattaa

SEQ ID NO: 597421 - DNA, 20 bp, Homo sapiens
aggacaggctgcggcccctc

SEQ ID NO: 597422 - DNA, 15 bp, Homo sapiens
aggataccatataca

SEQ ID NO: 597423 - DNA, 22 bp, Homo sapiens
aggataccatatacagctcaga

SEQ ID NO: 597424 - DNA, 18 bp, Homo sapiens
aggcttccttcatttcct

SEQ ID NO: 597425 - DNA, 17 bp, Homo sapiens
agggccttgagcatctg

SEQ ID NO: 597426 - DNA, 15 bp, Homo sapiens
aggtgtcatacagat

SEQ ID NO: 597427 - DNA, 19 bp, Homo sapiens
aggtttctgagttcctgca

SEQ ID NO: 597428 - DNA, 14 bp, Homo sapiens
agtaactcatctgt

SEQ ID NO: 597429 - DNA, 15 bp, Homo sapiens
agtccaactactaaa

SEQ ID NO: 597430 - DNA, 22 bp, Homo sapiens
agtgcatttatgagctcttcat

SEQ ID NO: 597431 - DNA, 17 bp, Homo sapiens
ataaaccaatgaacgaa

SEQ ID NO: 597432 - DNA, 17 bp, Homo sapiens
ataaattaataaattta

SEQ ID NO: 597433 - DNA, 12 bp, Homo sapiens
tgagctcttcat

SEQ ID NO: 597434 - DNA, 18 bp, Homo sapiens
tgagctcttcatgtttca

SEQ ID NO: 597435 - DNA, 14 bp, Homo sapiens
tgcactgagaacag

SEQ ID NO: 597436 - DNA, 13 bp, Homo sapiens
tgcggcccctccc

SEQ ID NO: 597437 - DNA, 15 bp, Homo sapiens
tgcggcccctccccc

SEQ ID NO: 597438 - DNA, 16 bp, Homo sapiens
tgcggcccctcccccg

SEQ ID NO: 597439 - DNA, 23 bp, Homo sapiens
tgctgtccaatttctattaaagg

SEQ ID NO: 597440 - DNA, 15 bp, Homo sapiens
tgctttaaaaaattc

SEQ ID NO: 597441 - DNA, 21 bp, Homo sapiens
tgctttaaaaaattctcttaa

SEQ ID NO: 597442 - DNA, 17 bp, Homo sapiens
tgctttggggaaaaaga

SEQ ID NO: 597443 - DNA, 18 bp, Homo sapiens
tggattctgcctaataaa

SEQ ID NO: 597444 - DNA, 14 bp, Homo sapiens
tgggggacttacat

SEQ ID NO: 597445 - DNA, 18 bp, Homo sapiens
tggtcagtcctcatctct

SEQ ID NO: 597446 - DNA, 15 bp, Homo sapiens
tggtgtatttgagaa

SEQ ID NO: 597447 - DNA, 13 bp, Homo sapiens
tggttagaaaagt

SEQ ID NO: 597448 - DNA, 14 bp, Homo sapiens
tgtaggtgaaatga

SEQ ID NO: 597449 - DNA, 18 bp, Homo sapiens
tgtatctatgcattttct

SEQ ID NO: 597450 - DNA, 13 bp, Homo sapiens
tgtatttgagaag

SEQ ID NO: 597451 - DNA, 14 bp, Homo sapiens
tgtcatttcatttc

SEQ ID NO: 597452 - DNA, 16 bp, Homo sapiens
tgtcatttcatttcct

SEQ ID NO: 597453 - DNA, 15 bp, Homo sapiens
tgtgtgtttaaagaa

SEQ ID NO: 597454 - DNA, 17 bp, Homo sapiens
tgttaaattcattttat

SEQ ID NO: 597455 - DNA, 13 bp, Homo sapiens
tgtttaaagaagg

SEQ ID NO: 597456 - DNA, 21 bp, Homo sapiens
ttaaaaaattctcttaaataa

SEQ ID NO: 597457 - DNA, 20 bp, Homo sapiens
ttaaaggttcctttgttccc

SEQ ID NO: 597458 - DNA, 13 bp, Homo sapiens
ttaaattcatttt

SEQ ID NO: 597459 - DNA, 20 bp, Homo sapiens
ttaatggtgccttcatttgg

SEQ ID NO: 597460 - DNA, 19 bp, Homo sapiens
ttaattagccagtgaaaaa

SEQ ID NO: 597461 - DNA, 21 bp, Homo sapiens
ttaccagatttttacacatgt

SEQ ID NO: 597462 - DNA, 16 bp, Homo sapiens
ttactttatgttacta

SEQ ID NO: 597463 - DNA, 12 bp, Homo sapiens
ttagccttctct

SEQ ID NO: 597464 - DNA, 17 bp, Homo sapiens
ttagccttctctgttca

SEQ ID NO: 597465 - DNA, 21 bp, Homo sapiens
ttcaggagagagttgaaccta

SEQ ID NO: 597466 - DNA, 16 bp, Homo sapiens
ttcatttcctcaaaaa

SEQ ID NO: 597467 - DNA, 21 bp, Homo sapiens
ttcattttaacatctgagaaa

SEQ ID NO: 597468 - DNA, 14 bp, Homo sapiens
ttccagacctgaag

SEQ ID NO: 597469 - DNA, 16 bp, Homo sapiens
ttccagacctgaagaa

SEQ ID NO: 597470 - DNA, 17 bp, Homo sapiens
ttccagacctgaagaat

SEQ ID NO: 597471 - DNA, 14 bp, Homo sapiens
ttccccagccccac

SEQ ID NO: 597472 - DNA, 19 bp, Homo sapiens
ttcctacaactaaaaataa

SEQ ID NO: 597473 - DNA, 17 bp, Homo sapiens
ttccttcatttcctccg

SEQ ID NO: 597474 - DNA, 22 bp, Homo sapiens
ttcctttgaatcctctctctgt

SEQ ID NO: 597475 - DNA, 19 bp, Homo sapiens
ttctgcctaataaaaaaca

SEQ ID NO: 597476 - DNA, 19 bp, Homo sapiens
ttctggacccgttcaactt

SEQ ID NO: 597477 - DNA, 14 bp, Homo sapiens
ttcttccatctgat

SEQ ID NO: 597478 - DNA, 18 bp, Homo sapiens
ttcttgctttggggaaaa

SEQ ID NO: 597479 - DNA, 17 bp, Homo sapiens
ttgagaagataatcatt

SEQ ID NO: 597480 - DNA, 22 bp, Homo sapiens
ttgagaagataatcattgctta

SEQ ID NO: 597481 - DNA, 20 bp, Homo sapiens
ttgatccttaaccaataatg

SEQ ID NO: 597482 - DNA, 20 bp, Homo sapiens
ttgattttagccttctctgt

SEQ ID NO: 597483 - DNA, 13 bp, Homo sapiens
ttgcataaattaa

SEQ ID NO: 597484 - DNA, 16 bp, Homo sapiens
ttggggaaaaagaatg

SEQ ID NO: 597485 - DNA, 18 bp, Homo sapiens
ttgtctattacctgttag

SEQ ID NO: 597486 - DNA, 13 bp, Homo sapiens
tttaatcttatct

SEQ ID NO: 597487 - DNA, 22 bp, Homo sapiens
tttcctccgtcacctcagagac

SEQ ID NO: 597488 - DNA, 16 bp, Homo sapiens
tttctattaaaggttc

SEQ ID NO: 597489 - DNA, 23 bp, Homo sapiens
tttgaaccattccctagtcattt

SEQ ID NO: 597490 - DNA, 18 bp, Homo sapiens
tttgagaagataatcatt

SEQ ID NO: 597491 - DNA, 22 bp, Homo sapiens
tttttggaagaggactccttaa

SEQ ID NO: 597492 - DNA, 16 bp, Homo sapiens
aaacaagatacgtata

SEQ ID NO: 597493 - DNA, 18 bp, Homo sapiens
aaacaagatacgtatatt

SEQ ID NO: 597494 - DNA, 13 bp, Homo sapiens
aaacaattcaaag

SEQ ID NO: 597495 - DNA, 17 bp, Homo sapiens
aaacacagcatgcattt

SEQ ID NO: 597496 - DNA, 16 bp, Homo sapiens
aaacacggagtttcca

SEQ ID NO: 597497 - DNA, 22 bp, Homo sapiens
aaacacggagtttccatttgga

SEQ ID NO: 597498 - DNA, 19 bp, Homo sapiens
aaacactgcttaaggaaaa

SEQ ID NO: 597499 - DNA, 16 bp, Homo sapiens
aaacagaagaaaaaca

SEQ ID NO: 597500 - DNA, 20 bp, Homo sapiens
aaacagaagaaaaacactga

SEQ ID NO: 597501 - DNA, 20 bp, Homo sapiens
aaacagggacactacaaaca

SEQ ID NO: 597502 - DNA, 13 bp, Homo sapiens
aattagattttaa

SEQ ID NO: 597503 - DNA, 19 bp, Homo sapiens
aattagggctctaatttcc

SEQ ID NO: 597504 - DNA, 20 bp, Homo sapiens
aattagggctctaatttcct

SEQ ID NO: 597505 - DNA, 14 bp, Homo sapiens
aattaggtaatgga

SEQ ID NO: 597506 - DNA, 16 bp, Homo sapiens
aattaggtaatggata

SEQ ID NO: 597507 - DNA, 14 bp, Homo sapiens
aattagtattttga

SEQ ID NO: 597508 - DNA, 20 bp, Homo sapiens
aattagtgttttcattctgg

SEQ ID NO: 597509 - DNA, 19 bp, Homo sapiens
aattatatgaagcagaatg

SEQ ID NO: 597510 - DNA, 15 bp, Homo sapiens
aattatcattgtttg

SEQ ID NO: 597511 - DNA, 21 bp, Homo sapiens
aattatcattgtttgtccttt

SEQ ID NO: 597512 - DNA, 23 bp, Homo sapiens
aattatcattgtttgtcctttat

SEQ ID NO: 597513 - DNA, 22 bp, Homo sapiens
aattatcctcaagttgtgtgct

SEQ ID NO: 597514 - DNA, 15 bp, Homo sapiens
aattatctttaaaac

SEQ ID NO: 597515 - DNA, 16 bp, Homo sapiens
aattatctttaaaact

SEQ ID NO: 597516 - DNA, 18 bp, Homo sapiens
aattatgtcaaatggatg

SEQ ID NO: 597517 - DNA, 13 bp, Homo sapiens
aattattaaaaat

SEQ ID NO: 597518 - DNA, 17 bp, Homo sapiens
aattattagcaccagct

SEQ ID NO: 597519 - DNA, 18 bp, Homo sapiens
aattattagcaccagctt

SEQ ID NO: 597520 - DNA, 18 bp, Homo sapiens
aattccagggaaccagag

SEQ ID NO: 597521 - DNA, 13 bp, Homo sapiens
aattcctaattct

SEQ ID NO: 597522 - DNA, 14 bp, Homo sapiens
aattcctaattcta

SEQ ID NO: 597523 - DNA, 18 bp, Homo sapiens
aattctgcttctctttca

SEQ ID NO: 597524 - DNA, 20 bp, Homo sapiens
aattcttaccgaaatgaaaa

SEQ ID NO: 597525 - DNA, 10 bp, Homo sapiens
aattgaaagg

SEQ ID NO: 597526 - DNA, 22 bp, Homo sapiens
aattgaaagggacaagtatcat

SEQ ID NO: 597527 - DNA, 16 bp, Homo sapiens
aattgaaatacctatt

SEQ ID NO: 597528 - DNA, 22 bp, Homo sapiens
aattgaaccgtcaatgtgaaat

SEQ ID NO: 597529 - DNA, 17 bp, Homo sapiens
aattgaagagagatata

SEQ ID NO: 597530 - DNA, 21 bp, Homo sapiens
aattgagaactacagctttta

SEQ ID NO: 597531 - DNA, 13 bp, Homo sapiens
aattgctgagatg

SEQ ID NO: 597532 - DNA, 14 bp, Homo sapiens
aattgcttgagcat

SEQ ID NO: 597533 - DNA, 14 bp, Homo sapiens
aattgggttttgat

SEQ ID NO: 597534 - DNA, 21 bp, Homo sapiens
aattgtaaaggtgatgaattt

SEQ ID NO: 597535 - DNA, 20 bp, Homo sapiens
aattgtatatatatgtgaac

SEQ ID NO: 597536 - DNA, 21 bp, Homo sapiens
aattgtatatatatgtgaact

SEQ ID NO: 597537 - DNA, 20 bp, Homo sapiens
aattgtcttttgtcatgtgg

SEQ ID NO: 597538 - DNA, 22 bp, Homo sapiens
aatttaaaaattaaagcagcaa

SEQ ID NO: 597539 - DNA, 18 bp, Homo sapiens
acaatgtggaattacata

SEQ ID NO: 597540 - DNA, 17 bp, Homo sapiens
acaatgttttttatact

SEQ ID NO: 597541 - DNA, 19 bp, Homo sapiens
acaattcaaagaatcacct

SEQ ID NO: 597542 - DNA, 14 bp, Homo sapiens
acacaaagtgaaat

SEQ ID NO: 597543 - DNA, 16 bp, Homo sapiens
acacaaagtgaaatta

SEQ ID NO: 597544 - DNA, 18 bp, Homo sapiens
acacaaagtgaaattagt

SEQ ID NO: 597545 - DNA, 12 bp, Homo sapiens
acacacaaaaca

SEQ ID NO: 597546 - DNA, 20 bp, Homo sapiens
acacacaagcagacacacac

SEQ ID NO: 597547 - DNA, 13 bp, Homo sapiens
acacacacaaaac

SEQ ID NO: 597548 - DNA, 12 bp, Homo sapiens
acacacacagac

SEQ ID NO: 597549 - DNA, 22 bp, Homo sapiens
acacacacccttccccactccc

SEQ ID NO: 597550 - DNA, 15 bp, Homo sapiens
acacacatatataca

SEQ ID NO: 597551 - DNA, 13 bp, Homo sapiens
acacacccttccc

SEQ ID NO: 597552 - DNA, 15 bp, Homo sapiens
acacactcaccattt

SEQ ID NO: 597553 - DNA, 20 bp, Homo sapiens
acacagaggacggcttcccc

SEQ ID NO: 597554 - DNA, 22 bp, Homo sapiens
acacagcatgcatttagcatga

SEQ ID NO: 597555 - DNA, 21 bp, Homo sapiens
acacagctgagctggcctatt

SEQ ID NO: 597556 - DNA, 14 bp, Homo sapiens
acacaggagaaaat

SEQ ID NO: 597557 - DNA, 20 bp, Homo sapiens
acacagtatagataaatcca

SEQ ID NO: 597558 - DNA, 16 bp, Homo sapiens
acacataacacacatc

SEQ ID NO: 597559 - DNA, 16 bp, Homo sapiens
acacataattaaagtg

SEQ ID NO: 597560 - DNA, 21 bp, Homo sapiens
acacataattaaagtgtccat

SEQ ID NO: 597561 - DNA, 17 bp, Homo sapiens
acacatacatatataca

SEQ ID NO: 597562 - DNA, 15 bp, Homo sapiens
acacatatatacata

SEQ ID NO: 597563 - DNA, 19 bp, Homo sapiens
acacatatatacatacgca

SEQ ID NO: 597564 - DNA, 20 bp, Homo sapiens
acacatcataaacaaagagt

SEQ ID NO: 597565 - DNA, 19 bp, Homo sapiens
acacattgaaactgtattt

SEQ ID NO: 597566 - DNA, 14 bp, Homo sapiens
acacattgcacaca

SEQ ID NO: 597567 - DNA, 23 bp, Homo sapiens
acacattgcacacacagtctgtt

SEQ ID NO: 597568 - DNA, 19 bp, Homo sapiens
acaccaaatagcttttcac

SEQ ID NO: 597569 - DNA, 22 bp, Homo sapiens
acaccaaatagcttttcacttc

SEQ ID NO: 597570 - DNA, 19 bp, Homo sapiens
acaccaaatattttcaagc

SEQ ID NO: 597571 - DNA, 23 bp, Homo sapiens
acaccaaatattttcaagctttt

SEQ ID NO: 597572 - DNA, 18 bp, Homo sapiens
acaccaatttagaatgaa

SEQ ID NO: 597573 - DNA, 18 bp, Homo sapiens
acaccactttcccacact

SEQ ID NO: 597574 - DNA, 16 bp, Homo sapiens
acacccttgaaaatat

SEQ ID NO: 597575 - DNA, 21 bp, Homo sapiens
acacctagactctaaaactat

SEQ ID NO: 597576 - DNA, 13 bp, Homo sapiens
acacctccacccg

SEQ ID NO: 597577 - DNA, 14 bp, Homo sapiens
acacctcccttcat

SEQ ID NO: 597578 - DNA, 13 bp, Homo sapiens
acacctgagaatg

SEQ ID NO: 597579 - DNA, 15 bp, Homo sapiens
acaccttagcagctc

SEQ ID NO: 597580 - DNA, 12 bp, Homo sapiens
acacgaatattg

SEQ ID NO: 597581 - DNA, 21 bp, Homo sapiens
agcatcctggaaatttgtgtg

SEQ ID NO: 597582 - DNA, 18 bp, Homo sapiens
agcatcgtgtgggtccct

SEQ ID NO: 597583 - DNA, 14 bp, Homo sapiens
agcatgagttctgc

SEQ ID NO: 597584 - DNA, 16 bp, Homo sapiens
agcatgagttctgcac

SEQ ID NO: 597585 - DNA, 19 bp, Homo sapiens
agcatgcccaaatataaca

SEQ ID NO: 597586 - DNA, 22 bp, Homo sapiens
agcatgcccaaatataacatga

SEQ ID NO: 597587 - DNA, 12 bp, Homo sapiens
agcatgtaatat

SEQ ID NO: 597588 - DNA, 16 bp, Homo sapiens
agcatgtacagtgttc

SEQ ID NO: 597589 - DNA, 13 bp, Homo sapiens
agcattcccaatt

SEQ ID NO: 597590 - DNA, 16 bp, Homo sapiens
agcattctggggtggg

SEQ ID NO: 597591 - DNA, 21 bp, Homo sapiens
agccaacttaaacctgtgctt

SEQ ID NO: 597592 - DNA, 14 bp, Homo sapiens
agccaagcctgact

SEQ ID NO: 597593 - DNA, 16 bp, Homo sapiens
agccaaggtctgaacc

SEQ ID NO: 597594 - DNA, 14 bp, Homo sapiens
agccaagtgtcctg

SEQ ID NO: 597595 - DNA, 18 bp, Homo sapiens
agccaataaagctcacac

SEQ ID NO: 597596 - DNA, 16 bp, Homo sapiens
agccaatttcaaagaa

SEQ ID NO: 597597 - DNA, 14 bp, Homo sapiens
agccacagtggggc

SEQ ID NO: 597598 - DNA, 18 bp, Homo sapiens
agccacgttgcagaaaaa

SEQ ID NO: 597599 - DNA, 19 bp, Homo sapiens
agccacttatttccatgga

SEQ ID NO: 597600 - DNA, 14 bp, Homo sapiens
agccagcagacatt

SEQ ID NO: 597601 - DNA, 16 bp, Homo sapiens
agccagcagacattgt

SEQ ID NO: 597602 - DNA, 19 bp, Homo sapiens
agccagcattcagcacaca

SEQ ID NO: 597603 - DNA, 20 bp, Homo sapiens
agccagcattcagcacacac

SEQ ID NO: 597604 - DNA, 13 bp, Homo sapiens
agccagctctgag

SEQ ID NO: 597605 - DNA, 12 bp, Homo sapiens
agccaggagacc

SEQ ID NO: 597606 - DNA, 18 bp, Homo sapiens
agccaggagaccctgtct

SEQ ID NO: 597607 - DNA, 19 bp, Homo sapiens
agccagggcagaggaatgt

SEQ ID NO: 597608 - DNA, 20 bp, Homo sapiens
agccagggtcctgagtggct

SEQ ID NO: 597609 - DNA, 17 bp, Homo sapiens
agccagggttccagaca

SEQ ID NO: 597610 - DNA, 18 bp, Homo sapiens
agccagtggcacaggaga

SEQ ID NO: 597611 - DNA, 18 bp, Homo sapiens
agccatagccccaggccc

SEQ ID NO: 597612 - DNA, 18 bp, Homo sapiens
agccatggtgaactgata

SEQ ID NO: 597613 - DNA, 12 bp, Homo sapiens
agccattaatga

SEQ ID NO: 597614 - DNA, 15 bp, Homo sapiens
agccattcatttaca

SEQ ID NO: 597615 - DNA, 16 bp, Homo sapiens
agcccacccgccccag

SEQ ID NO: 597616 - DNA, 23 bp, Homo sapiens
agcccacccgccccagagactgc

SEQ ID NO: 597617 - DNA, 15 bp, Homo sapiens
agcccacttcacaca

SEQ ID NO: 597618 - DNA, 21 bp, Homo sapiens
agcccagaagctcaaggctgc

SEQ ID NO: 597619 - DNA, 19 bp, Homo sapiens
agcccagagactgaacggc

SEQ ID NO: 597620 - DNA, 22 bp, Homo sapiens
agcccagcctatctctcttctg

SEQ ID NO: 597621 - DNA, 17 bp, Homo sapiens
agcccagtccctggagc

SEQ ID NO: 597622 - DNA, 18 bp, Homo sapiens
agccccatcgcctgggac

SEQ ID NO: 597623 - DNA, 11 bp, Homo sapiens
agcccccaccc

SEQ ID NO: 597624 - DNA, 21 bp, Homo sapiens
agcccccacccatgccagcgc

SEQ ID NO: 597625 - DNA, 14 bp, Homo sapiens
agccccctggcggc

SEQ ID NO: 597626 - DNA, 22 bp, Homo sapiens
agccccgcgaccacccctgtgc

SEQ ID NO: 597627 - DNA, 23 bp, Homo sapiens
agccccgcgaccacccctgtgcg

SEQ ID NO: 597628 - DNA, 13 bp, Homo sapiens
agcccctcagaga

SEQ ID NO: 597629 - DNA, 14 bp, Homo sapiens
agcccctcagagaa

SEQ ID NO: 597630 - DNA, 21 bp, Homo sapiens
agcccctcagagaatgatcac

SEQ ID NO: 597631 - DNA, 14 bp, Homo sapiens
agcccctcctctcc

SEQ ID NO: 597632 - DNA, 17 bp, Homo sapiens
agcccctcctctcctcg

SEQ ID NO: 597633 - DNA, 18 bp, Homo sapiens
agcccctcctctcctcgt

SEQ ID NO: 597634 - DNA, 12 bp, Homo sapiens
agccccttggag

SEQ ID NO: 597635 - DNA, 13 bp, Homo sapiens
agccccttggaga

SEQ ID NO: 597636 - DNA, 22 bp, Homo sapiens
agccctaagtaaatctaaatta

SEQ ID NO: 597637 - DNA, 18 bp, Homo sapiens
agccctcacctctgagga

SEQ ID NO: 597638 - DNA, 17 bp, Homo sapiens
agccctccgccagccct

SEQ ID NO: 597639 - DNA, 18 bp, Homo sapiens
agccctccgccagccctg

SEQ ID NO: 597640 - DNA, 13 bp, Homo sapiens
agccctctttctc

SEQ ID NO: 597641 - DNA, 18 bp, Homo sapiens
agccctctttctctctgt

SEQ ID NO: 597642 - DNA, 21 bp, Homo sapiens
agccctctttctctctgtgtg

SEQ ID NO: 597643 - DNA, 11 bp, Homo sapiens
agccctgccct

SEQ ID NO: 597644 - DNA, 20 bp, Homo sapiens
agccctgccctcactccact

SEQ ID NO: 597645 - DNA, 22 bp, Homo sapiens
agccctgccctcactccactcc

SEQ ID NO: 597646 - DNA, 14 bp, Homo sapiens
agccctgggcaagg

SEQ ID NO: 597647 - DNA, 22 bp, Homo sapiens
agccctgttccgcctcactggg

SEQ ID NO: 597648 - DNA, 18 bp, Homo sapiens
agcccttgctctacctgg

SEQ ID NO: 597649 - DNA, 21 bp, Homo sapiens
agcccttgctctacctggccg

SEQ ID NO: 597650 - DNA, 20 bp, Homo sapiens
agccctttgcaggcccagca

SEQ ID NO: 597651 - DNA, 15 bp, Homo sapiens
agccgcgctctgccc

SEQ ID NO: 597652 - DNA, 17 bp, Homo sapiens
agccgcgctctgcccct

SEQ ID NO: 597653 - DNA, 15 bp, Homo sapiens
agccgtcagcctgtg

SEQ ID NO: 597654 - DNA, 23 bp, Homo sapiens
agcctcaattttggtttttctca

SEQ ID NO: 597655 - DNA, 13 bp, Homo sapiens
agcctcccccagg

SEQ ID NO: 597656 - DNA, 22 bp, Homo sapiens
agcctcccccaggctgcgcctg

SEQ ID NO: 597657 - DNA, 15 bp, Homo sapiens
agcctcgttggagag

SEQ ID NO: 597658 - DNA, 13 bp, Homo sapiens
agcctctccgccc

SEQ ID NO: 597659 - DNA, 16 bp, Homo sapiens
agcctcttgttcttag

SEQ ID NO: 597660 - DNA, 22 bp, Homo sapiens
agcctcttgttcttagggcttg

SEQ ID NO: 597661 - DNA, 17 bp, Homo sapiens
agcctgaaagatacagg

SEQ ID NO: 597662 - DNA, 14 bp, Homo sapiens
agcctgaagcctgg

SEQ ID NO: 597663 - DNA, 18 bp, Homo sapiens
agcctgaagcctggattc

SEQ ID NO: 597664 - DNA, 13 bp, Homo sapiens
agcctgagccaca

SEQ ID NO: 597665 - DNA, 14 bp, Homo sapiens
agcctgagccacag

SEQ ID NO: 597666 - DNA, 13 bp, Homo sapiens
agcctgagctcca

SEQ ID NO: 597667 - DNA, 17 bp, Homo sapiens
agcctgatgatggaagg

SEQ ID NO: 597668 - DNA, 16 bp, Homo sapiens
agcctgccaggccctc

SEQ ID NO: 597669 - DNA, 19 bp, Homo sapiens
agcctgccaggccctccag

SEQ ID NO: 597670 - DNA, 16 bp, Homo sapiens
agcctggattccagca

SEQ ID NO: 597671 - DNA, 14 bp, Homo sapiens
agcctgggcagcac

SEQ ID NO: 597672 - DNA, 21 bp, Homo sapiens
agcctgggcagcacctccggg

SEQ ID NO: 597673 - DNA, 17 bp, Homo sapiens
agcctgtcacgtggtca

SEQ ID NO: 597674 - DNA, 14 bp, Homo sapiens
agcctgtctctccc

SEQ ID NO: 597675 - DNA, 13 bp, Homo sapiens
agcctgtgggtcc

SEQ ID NO: 597676 - DNA, 15 bp, Homo sapiens
agcctgtgggtcctt

SEQ ID NO: 597677 - DNA, 22 bp, Homo sapiens
agccttaagtcttactgttttg

SEQ ID NO: 597678 - DNA, 14 bp, Homo sapiens
agccttattaaaat

SEQ ID NO: 597679 - DNA, 16 bp, Homo sapiens
agccttattaaaatat

SEQ ID NO: 597680 - DNA, 23 bp, Homo sapiens
agccttattaaaatattttctta

SEQ ID NO: 597681 - DNA, 11 bp, Homo sapiens
agccttgctgg

SEQ ID NO: 597682 - DNA, 17 bp, Homo sapiens
agccttgctgggccagg

SEQ ID NO: 597683 - DNA, 22 bp, Homo sapiens
agccttgtaaatgggaaaatat

SEQ ID NO: 597684 - DNA, 18 bp, Homo sapiens
agcctttgcgctctgggt

SEQ ID NO: 597685 - DNA, 12 bp, Homo sapiens
agcgcagccccc

SEQ ID NO: 597686 - DNA, 16 bp, Homo sapiens
agcgcagcccccacgc

SEQ ID NO: 597687 - DNA, 15 bp, Homo sapiens
agcgccagggctcag

SEQ ID NO: 597688 - DNA, 12 bp, Homo sapiens
agcgcctcccgc

SEQ ID NO: 597689 - DNA, 15 bp, Homo sapiens
agcgcctcccgccgc

SEQ ID NO: 597690 - DNA, 18 bp, Homo sapiens
agcgcctcccgccgcctc

SEQ ID NO: 597691 - DNA, 20 bp, Homo sapiens
agcgcctcccgccgcctcgg

SEQ ID NO: 597692 - DNA, 16 bp, Homo sapiens
agcgcctcgccccagc

SEQ ID NO: 597693 - DNA, 15 bp, Homo sapiens
agcgcgtgccttccc

SEQ ID NO: 597694 - DNA, 14 bp, Homo sapiens
agcggcccggccca

SEQ ID NO: 597695 - DNA, 18 bp, Homo sapiens
agcggcccggcccacgca

SEQ ID NO: 597696 - DNA, 21 bp, Homo sapiens
agcggctgaggacggggcaga

SEQ ID NO: 597697 - DNA, 22 bp, Homo sapiens
agcggctgaggacggggcagag

SEQ ID NO: 597698 - DNA, 13 bp, Homo sapiens
agggccaccctga

SEQ ID NO: 597699 - DNA, 18 bp, Homo sapiens
agggccaccctgagcaga

SEQ ID NO: 597700 - DNA, 17 bp, Homo sapiens
agggcccaaataacagt

SEQ ID NO: 597701 - DNA, 13 bp, Homo sapiens
agggcccagggag

SEQ ID NO: 597702 - DNA, 14 bp, Homo sapiens
agggcccagggagg

SEQ ID NO: 597703 - DNA, 15 bp, Homo sapiens
agggcccagggaggt

SEQ ID NO: 597704 - DNA, 20 bp, Homo sapiens
agggcccagggaggtggcag

SEQ ID NO: 597705 - DNA, 17 bp, Homo sapiens
agggcccccacaggagc

SEQ ID NO: 597706 - DNA, 15 bp, Homo sapiens
agggccctggggtct

SEQ ID NO: 597707 - DNA, 14 bp, Homo sapiens
agggcccttcccaa

SEQ ID NO: 597708 - DNA, 18 bp, Homo sapiens
agggcccttcccaacctc

SEQ ID NO: 597709 - DNA, 16 bp, Homo sapiens
agggcgctccggcaga

SEQ ID NO: 597710 - DNA, 15 bp, Homo sapiens
agggcgctgagggca

SEQ ID NO: 597711 - DNA, 16 bp, Homo sapiens
agggcggcggggcctg

SEQ ID NO: 597712 - DNA, 15 bp, Homo sapiens
agggcgtgaaacaca

SEQ ID NO: 597713 - DNA, 17 bp, Homo sapiens
agggctcagatggggcc

SEQ ID NO: 597714 - DNA, 18 bp, Homo sapiens
agggctcagatggggcct

SEQ ID NO: 597715 - DNA, 21 bp, Homo sapiens
agggctcagatggggcctggg

SEQ ID NO: 597716 - DNA, 14 bp, Homo sapiens
agggctgagcccct

SEQ ID NO: 597717 - DNA, 15 bp, Homo sapiens
agggctgagcccctc

SEQ ID NO: 597718 - DNA, 20 bp, Homo sapiens
agggctgagcccctcctctc

SEQ ID NO: 597719 - DNA, 24 bp, Homo sapiens
aggggatctaaaaggaggacaggg

SEQ ID NO: 597720 - DNA, 13 bp, Homo sapiens
aggggcaggcagc

SEQ ID NO: 597721 - DNA, 15 bp, Homo sapiens
aggggcaggcagcta

SEQ ID NO: 597722 - DNA, 22 bp, Homo sapiens
aggggcaggcagctaggcaggg

SEQ ID NO: 597723 - DNA, 12 bp, Homo sapiens
aggggccagacc

SEQ ID NO: 597724 - DNA, 16 bp, Homo sapiens
aggggccagaccacgc

SEQ ID NO: 597725 - DNA, 15 bp, Homo sapiens
aggggcgcgcgcccc

SEQ ID NO: 597726 - DNA, 20 bp, Homo sapiens
aggggcgcgcgcccccagga

SEQ ID NO: 597727 - DNA, 22 bp, Homo sapiens
aggggcttacctgttctctagt

SEQ ID NO: 597728 - DNA, 20 bp, Homo sapiens
aggggcttctccccctcagc

SEQ ID NO: 597729 - DNA, 21 bp, Homo sapiens
agggggatgcccctggccctg

SEQ ID NO: 597730 - DNA, 21 bp, Homo sapiens
aggggggttgggttccagaca

SEQ ID NO: 597731 - DNA, 23 bp, Homo sapiens
aggggtgggggagaatggctctg

SEQ ID NO: 597732 - DNA, 18 bp, Homo sapiens
agggtctccctgggcacc

SEQ ID NO: 597733 - DNA, 15 bp, Homo sapiens
agggtgaggcgtggg

SEQ ID NO: 597734 - DNA, 22 bp, Homo sapiens
agggtgaggcgtgggatccaga

SEQ ID NO: 597735 - DNA, 18 bp, Homo sapiens
agggtgcaggcgcgcacc

SEQ ID NO: 597736 - DNA, 14 bp, Homo sapiens
agggtgcccctggg

SEQ ID NO: 597737 - DNA, 12 bp, Homo sapiens
agggtgggaaga

SEQ ID NO: 597738 - DNA, 15 bp, Homo sapiens
agggtggggcttaga

SEQ ID NO: 597739 - DNA, 20 bp, Homo sapiens
agggtgtggcttggaacatt

SEQ ID NO: 597740 - DNA, 17 bp, Homo sapiens
agggtgtgggtgccctg

SEQ ID NO: 597741 - DNA, 19 bp, Homo sapiens
agggttaaagaaaggcaga

SEQ ID NO: 597742 - DNA, 21 bp, Homo sapiens
agggttaaagaaaggcagaga

SEQ ID NO: 597743 - DNA, 15 bp, Homo sapiens
agggttccagacagg

SEQ ID NO: 597744 - DNA, 14 bp, Homo sapiens
agggttctagaagg

SEQ ID NO: 597745 - DNA, 18 bp, Homo sapiens
agggttctatatttactg

SEQ ID NO: 597746 - DNA, 13 bp, Homo sapiens
agggttctgccct

SEQ ID NO: 597747 - DNA, 21 bp, Homo sapiens
agggttctgccctgcctgagg

SEQ ID NO: 597748 - DNA, 14 bp, Homo sapiens
agggttgtgatttt

SEQ ID NO: 597749 - DNA, 23 bp, Homo sapiens
agggtttggaagaaagggagaag

SEQ ID NO: 597750 - DNA, 16 bp, Homo sapiens
agggttttttagaaaa

SEQ ID NO: 597751 - DNA, 14 bp, Homo sapiens
aggtaatggatatg

SEQ ID NO: 597752 - DNA, 22 bp, Homo sapiens
aggtaatggatatgaaagagaa

SEQ ID NO: 597753 - DNA, 17 bp, Homo sapiens
aggtacggtgagactct

SEQ ID NO: 597754 - DNA, 21 bp, Homo sapiens
aggtacggtgagactctgagg

SEQ ID NO: 597755 - DNA, 16 bp, Homo sapiens
aggtatcccagctttg

SEQ ID NO: 597756 - DNA, 17 bp, Homo sapiens
aggtatctgatgatgtt

SEQ ID NO: 597757 - DNA, 13 bp, Homo sapiens
aggtcctgtcctg

SEQ ID NO: 597758 - DNA, 15 bp, Homo sapiens
aggtcctgtcctggc

SEQ ID NO: 597759 - DNA, 22 bp, Homo sapiens
aggtcctgtcctggctcccagg

SEQ ID NO: 597760 - DNA, 16 bp, Homo sapiens
aggtctccacccctca

SEQ ID NO: 597761 - DNA, 19 bp, Homo sapiens
aggtctccacccctcaagc

SEQ ID NO: 597762 - DNA, 16 bp, Homo sapiens
aggtctgcacacataa

SEQ ID NO: 597763 - DNA, 20 bp, Homo sapiens
aggtctgttgaagtgcatgt

SEQ ID NO: 597764 - DNA, 22 bp, Homo sapiens
aggtctgttgaagtgcatgtta

SEQ ID NO: 597765 - DNA, 18 bp, Homo sapiens
aggtcttgagtttcattt

SEQ ID NO: 597766 - DNA, 21 bp, Homo sapiens
aggtcttgagtttcatttttc

SEQ ID NO: 597767 - DNA, 13 bp, Homo sapiens
aggtcttgcctga

SEQ ID NO: 597768 - DNA, 14 bp, Homo sapiens
aggtgaaatggagg

SEQ ID NO: 597769 - DNA, 14 bp, Homo sapiens
aggtgaccagaatg

SEQ ID NO: 597770 - DNA, 21 bp, Homo sapiens
aggtgcccagtcttgagtggg

SEQ ID NO: 597771 - DNA, 18 bp, Homo sapiens
aggtgccccacctcccca

SEQ ID NO: 597772 - DNA, 16 bp, Homo sapiens
aggtgcctcatagcat

SEQ ID NO: 597773 - DNA, 21 bp, Homo sapiens
aggtgcctcatagcatagcca

SEQ ID NO: 597774 - DNA, 22 bp, Homo sapiens
aggtgctgaatgaagctgccat

SEQ ID NO: 597775 - DNA, 11 bp, Homo sapiens
aggtgctttct

SEQ ID NO: 597776 - DNA, 16 bp, Homo sapiens
aggtggcagggaaggg

SEQ ID NO: 597777 - DNA, 20 bp, Homo sapiens
aggtggcagggaagggtgcc

SEQ ID NO: 597778 - DNA, 14 bp, Homo sapiens
aggtggcatttgca

SEQ ID NO: 597779 - DNA, 16 bp, Homo sapiens
aggtgggctgcctgct

SEQ ID NO: 597780 - DNA, 20 bp, Homo sapiens
aggtgggggtcaggctacag

SEQ ID NO: 597781 - DNA, 13 bp, Homo sapiens
aggtggtcttgga

SEQ ID NO: 597782 - DNA, 19 bp, Homo sapiens
aggtgtatagggaattttc

SEQ ID NO: 597783 - DNA, 22 bp, Homo sapiens
aggtgtatagggaattttcatt

SEQ ID NO: 597784 - DNA, 14 bp, Homo sapiens
aggtgtggagtgga

SEQ ID NO: 597785 - DNA, 15 bp, Homo sapiens
aggtgtggagtggag

SEQ ID NO: 597786 - DNA, 17 bp, Homo sapiens
aggtgtggagtggaggg

SEQ ID NO: 597787 - DNA, 22 bp, Homo sapiens
aggttagaaaggcagccctcac

SEQ ID NO: 597788 - DNA, 15 bp, Homo sapiens
aggttatttatttaa

SEQ ID NO: 597789 - DNA, 16 bp, Homo sapiens
aggttatttatttaaa

SEQ ID NO: 597790 - DNA, 20 bp, Homo sapiens
aggtttagaatcaagtctgt

SEQ ID NO: 597791 - DNA, 17 bp, Homo sapiens
aggtttcactgttcatg

SEQ ID NO: 597792 - DNA, 12 bp, Homo sapiens
aggtttcatact

SEQ ID NO: 597793 - DNA, 21 bp, Homo sapiens
aggtttcatactctagatttt

SEQ ID NO: 597794 - DNA, 21 bp, Homo sapiens
agtaaataatgattcaatgtg

SEQ ID NO: 597795 - DNA, 13 bp, Homo sapiens
agtaaatgtcttc

SEQ ID NO: 597796 - DNA, 17 bp, Homo sapiens
agtaaattcctaattct

SEQ ID NO: 597797 - DNA, 18 bp, Homo sapiens
agtaacacagtgcagtgc

SEQ ID NO: 597798 - DNA, 17 bp, Homo sapiens
agtaacagtatttccat

SEQ ID NO: 597799 - DNA, 15 bp, Homo sapiens
agtaataactgttag

SEQ ID NO: 597800 - DNA, 19 bp, Homo sapiens
agtacaattctttgttgct

SEQ ID NO: 597801 - DNA, 17 bp, Homo sapiens
agtaccatcccactgat

SEQ ID NO: 597802 - DNA, 21 bp, Homo sapiens
agtacccaacctggtaattat

SEQ ID NO: 597803 - DNA, 13 bp, Homo sapiens
agtacttaatagt

SEQ ID NO: 597804 - DNA, 17 bp, Homo sapiens
agtactttctttctgtg

SEQ ID NO: 597805 - DNA, 16 bp, Homo sapiens
agtagagtcaggagaa

SEQ ID NO: 597806 - DNA, 22 bp, Homo sapiens
agtagcattttaatagtttcta

SEQ ID NO: 597807 - DNA, 14 bp, Homo sapiens
agtagctgataaag

SEQ ID NO: 597808 - DNA, 16 bp, Homo sapiens
agtagctgataaagaa

SEQ ID NO: 597809 - DNA, 21 bp, Homo sapiens
actcatacagtggtattgcta

SEQ ID NO: 597810 - DNA, 19 bp, Homo sapiens
actcatttggatataaatc

SEQ ID NO: 597811 - DNA, 21 bp, Homo sapiens
actcatttggatataaatctt

SEQ ID NO: 597812 - DNA, 14 bp, Homo sapiens
actccaaggtggca

SEQ ID NO: 597813 - DNA, 22 bp, Homo sapiens
actccaaggtggcatagccatt

SEQ ID NO: 597814 - DNA, 10 bp, Homo sapiens
actccagtgg

SEQ ID NO: 597815 - DNA, 11 bp, Homo sapiens
actcccagggc

SEQ ID NO: 597816 - DNA, 13 bp, Homo sapiens
actcccagggccc

SEQ ID NO: 597817 - DNA, 21 bp, Homo sapiens
actccccgcccgccctcctct

SEQ ID NO: 597818 - DNA, 15 bp, Homo sapiens
actccctaggcctga

SEQ ID NO: 597819 - DNA, 16 bp, Homo sapiens
actccctaggcctgag

SEQ ID NO: 597820 - DNA, 17 bp, Homo sapiens
actccctaggcctgagt

SEQ ID NO: 597821 - DNA, 15 bp, Homo sapiens
actcctccccctcct

SEQ ID NO: 597822 - DNA, 16 bp, Homo sapiens
actcctccccctcctc

SEQ ID NO: 597823 - DNA, 22 bp, Homo sapiens
actcctccccctcctccatgct

SEQ ID NO: 597824 - DNA, 23 bp, Homo sapiens
actcctccccctcctccatgctg

SEQ ID NO: 597825 - DNA, 14 bp, Homo sapiens
actcctgggtgggt

SEQ ID NO: 597826 - DNA, 18 bp, Homo sapiens
actcgcgacaatgcaaac

SEQ ID NO: 597827 - DNA, 20 bp, Homo sapiens
actcgcgacaatgcaaacca

SEQ ID NO: 597828 - DNA, 16 bp, Homo sapiens
actcgttattcataca

SEQ ID NO: 597829 - DNA, 18 bp, Homo sapiens
actcgttattcatacaaa

SEQ ID NO: 597830 - DNA, 15 bp, Homo sapiens
actctaatatacagt

SEQ ID NO: 597831 - DNA, 17 bp, Homo sapiens
actctaatatacagtgt

SEQ ID NO: 597832 - DNA, 22 bp, Homo sapiens
actctctcctctctctccctcc

SEQ ID NO: 597833 - DNA, 14 bp, Homo sapiens
actctcttcttact

SEQ ID NO: 597834 - DNA, 21 bp, Homo sapiens
actctgaagtcccttcctgtc

SEQ ID NO: 597835 - DNA, 11 bp, Homo sapiens
actctgagact

SEQ ID NO: 597836 - DNA, 22 bp, Homo sapiens
actctgagactcgcgacaatgc

SEQ ID NO: 597837 - DNA, 14 bp, Homo sapiens
actctgagtcctca

SEQ ID NO: 597838 - DNA, 14 bp, Homo sapiens
actcttcatgtaat

SEQ ID NO: 597839 - DNA, 14 bp, Homo sapiens
actctttccccagc

SEQ ID NO: 597840 - DNA, 18 bp, Homo sapiens
actcttttgagcagtaaa

SEQ ID NO: 597841 - DNA, 23 bp, Homo sapiens
actcttttgagcagtaaatgtat

SEQ ID NO: 597842 - DNA, 10 bp, Homo sapiens
actgaagaaa

SEQ ID NO: 597843 - DNA, 12 bp, Homo sapiens
actgaagcagag

SEQ ID NO: 597844 - DNA, 13 bp, Homo sapiens
actgaagcagagt

SEQ ID NO: 597845 - DNA, 15 bp, Homo sapiens
actgaagcagagtca

SEQ ID NO: 597846 - DNA, 15 bp, Homo sapiens
actgaatctgagaaa

SEQ ID NO: 597847 - DNA, 20 bp, Homo sapiens
actgacaagttacccctgaa

SEQ ID NO: 597848 - DNA, 17 bp, Homo sapiens
actgacatggtgctgtg

SEQ ID NO: 597849 - DNA, 18 bp, Homo sapiens
actgacatggtgctgtgt

SEQ ID NO: 597850 - DNA, 17 bp, Homo sapiens
actgagtgaaatattac

SEQ ID NO: 597851 - DNA, 16 bp, Homo sapiens
actgatatcacgggcc

SEQ ID NO: 597852 - DNA, 21 bp, Homo sapiens
actgatatcacgggcccgctc

SEQ ID NO: 597853 - DNA, 19 bp, Homo sapiens
actgatgagacaacacaca

SEQ ID NO: 597854 - DNA, 20 bp, Homo sapiens
actgatgagacaacacacac

SEQ ID NO: 597855 - DNA, 18 bp, Homo sapiens
actgatttttttttcctt

SEQ ID NO: 597856 - DNA, 23 bp, Homo sapiens
actgcatgatcttacacgaagaa

SEQ ID NO: 597857 - DNA, 19 bp, Homo sapiens
actgccatttcctcctggg

SEQ ID NO: 597858 - DNA, 22 bp, Homo sapiens
actgccattttttgtctgtgat

SEQ ID NO: 597859 - DNA, 11 bp, Homo sapiens
actgcccaccc

SEQ ID NO: 597860 - DNA, 14 bp, Homo sapiens
actgcccaccctgg

SEQ ID NO: 597861 - DNA, 15 bp, Homo sapiens
actgccccatctcct

SEQ ID NO: 597862 - DNA, 22 bp, Homo sapiens
actgcccctgcacctgcttctc

SEQ ID NO: 597863 - DNA, 15 bp, Homo sapiens
actgccctctgccac

SEQ ID NO: 597864 - DNA, 17 bp, Homo sapiens
actgccttatattattt

SEQ ID NO: 597865 - DNA, 14 bp, Homo sapiens
actgctttcagtgc

SEQ ID NO: 597866 - DNA, 14 bp, Homo sapiens
actgctttgagaaa

SEQ ID NO: 597867 - DNA, 15 bp, Homo sapiens
actggaaacatctga

SEQ ID NO: 597868 - DNA, 17 bp, Homo sapiens
actggaaacatctgatt

SEQ ID NO: 597869 - DNA, 20 bp, Homo sapiens
actggaaggctttattcttc

SEQ ID NO: 597870 - DNA, 14 bp, Homo sapiens
actggatgcttaca

SEQ ID NO: 597871 - DNA, 20 bp, Homo sapiens
actggatgcttacagtgact

SEQ ID NO: 597872 - DNA, 16 bp, Homo sapiens
actggcccacccctct

SEQ ID NO: 597873 - DNA, 19 bp, Homo sapiens
actggcccacccctcttcc

SEQ ID NO: 597874 - DNA, 22 bp, Homo sapiens
actggccccaggcggaggggct

SEQ ID NO: 597875 - DNA, 14 bp, Homo sapiens
actgggctgctggg

SEQ ID NO: 597876 - DNA, 16 bp, Homo sapiens
actgggctgctggggc

SEQ ID NO: 597877 - DNA, 17 bp, Homo sapiens
actgggctgctggggca

SEQ ID NO: 597878 - DNA, 22 bp, Homo sapiens
actgggctgctggggcagggcc

SEQ ID NO: 597879 - DNA, 16 bp, Homo sapiens
actgggttctttggaa

SEQ ID NO: 597880 - DNA, 14 bp, Homo sapiens
actgtcaggaatgg

SEQ ID NO: 597881 - DNA, 22 bp, Homo sapiens
actgtcccggagctcaggccct

SEQ ID NO: 597882 - DNA, 13 bp, Homo sapiens
actgtctatttct

SEQ ID NO: 597883 - DNA, 16 bp, Homo sapiens
actgtctatttctgct

SEQ ID NO: 597884 - DNA, 17 bp, Homo sapiens
actgtctatttctgctg

SEQ ID NO: 597885 - DNA, 23 bp, Homo sapiens
actgtctatttctgctgaatttt

SEQ ID NO: 597886 - DNA, 17 bp, Homo sapiens
actgtgacacagctgag

SEQ ID NO: 597887 - DNA, 14 bp, Homo sapiens
actgtgacattcca

SEQ ID NO: 597888 - DNA, 21 bp, Homo sapiens
actgtgacattccacagagtt

SEQ ID NO: 597889 - DNA, 21 bp, Homo sapiens
actgtgacctgctcctgccca

SEQ ID NO: 597890 - DNA, 19 bp, Homo sapiens
actgtggctgcagagacct

SEQ ID NO: 597891 - DNA, 15 bp, Homo sapiens
agtaggtctgcacac

SEQ ID NO: 597892 - DNA, 16 bp, Homo sapiens
agtaggtgggtcttgg

SEQ ID NO: 597893 - DNA, 19 bp, Homo sapiens
agtagtgcctgtgatcgtg

SEQ ID NO: 597894 - DNA, 21 bp, Homo sapiens
agtagtgtgagtgttagaaaa

SEQ ID NO: 597895 - DNA, 17 bp, Homo sapiens
agtatagataaatccaa

SEQ ID NO: 597896 - DNA, 12 bp, Homo sapiens
agtatagatggt

SEQ ID NO: 597897 - DNA, 20 bp, Homo sapiens
agtatagatggtagaaactt

SEQ ID NO: 597898 - DNA, 19 bp, Homo sapiens
agtatatagccttaagtct

SEQ ID NO: 597899 - DNA, 13 bp, Homo sapiens
agtatcatctaaa

SEQ ID NO: 597900 - DNA, 22 bp, Homo sapiens
agtatccctgatttattctggt

SEQ ID NO: 597901 - DNA, 21 bp, Homo sapiens
agtattgacaataagaaacag

SEQ ID NO: 597902 - DNA, 17 bp, Homo sapiens
agtattgagacactgtc

SEQ ID NO: 597903 - DNA, 20 bp, Homo sapiens
agtattgagacactgtcaag

SEQ ID NO: 597904 - DNA, 15 bp, Homo sapiens
agtatttaacattct

SEQ ID NO: 597905 - DNA, 23 bp, Homo sapiens
agtcaattgcttgagcatgccca

SEQ ID NO: 597906 - DNA, 18 bp, Homo sapiens
agtcacgtgaggcccctg

SEQ ID NO: 597907 - DNA, 23 bp, Homo sapiens
agtcacgtgaggcccctgtgcag

SEQ ID NO: 597908 - DNA, 14 bp, Homo sapiens
agtcagcacagaga

SEQ ID NO: 597909 - DNA, 17 bp, Homo sapiens
agtcagtattgttttgg

SEQ ID NO: 597910 - DNA, 22 bp, Homo sapiens
agtcatggctgtcccctgcaag

SEQ ID NO: 597911 - DNA, 17 bp, Homo sapiens
agtccactttcctctct

SEQ ID NO: 597912 - DNA, 19 bp, Homo sapiens
agtccactttcctctctct

SEQ ID NO: 597913 - DNA, 17 bp, Homo sapiens
agtccatgtgataattg

SEQ ID NO: 597914 - DNA, 17 bp, Homo sapiens
agtccctggagctgtcc

SEQ ID NO: 597915 - DNA, 13 bp, Homo sapiens
agtcccttcctgt

SEQ ID NO: 597916 - DNA, 17 bp, Homo sapiens
agtcccttcctgtcctg

SEQ ID NO: 597917 - DNA, 22 bp, Homo sapiens
agtcccttcctgtcctgctcac

SEQ ID NO: 597918 - DNA, 16 bp, Homo sapiens
agtcctcacagcctct

SEQ ID NO: 597919 - DNA, 18 bp, Homo sapiens
agtcctcattgttcagaa

SEQ ID NO: 597920 - DNA, 18 bp, Homo sapiens
agtcggctgggcagggcc

SEQ ID NO: 597921 - DNA, 14 bp, Homo sapiens
agtctatgctgtgt

SEQ ID NO: 597922 - DNA, 19 bp, Homo sapiens
agtctatgctgtgtgcaga

SEQ ID NO: 597923 - DNA, 21 bp, Homo sapiens
agtctcaattctgaaggggaa

SEQ ID NO: 597924 - DNA, 16 bp, Homo sapiens
agtctccacgtgtttc

SEQ ID NO: 597925 - DNA, 14 bp, Homo sapiens
agtctcctgtatca

SEQ ID NO: 597926 - DNA, 16 bp, Homo sapiens
agtctcctgtatcatt

SEQ ID NO: 597927 - DNA, 16 bp, Homo sapiens
agtctgaaggagagga

SEQ ID NO: 597928 - DNA, 17 bp, Homo sapiens
agtctgaaggagaggag

SEQ ID NO: 597929 - DNA, 15 bp, Homo sapiens
agtctgagaaattta

SEQ ID NO: 597930 - DNA, 22 bp, Homo sapiens
agtctgaggccccaggccctag

SEQ ID NO: 597931 - DNA, 11 bp, Homo sapiens
agtctggataa

SEQ ID NO: 597932 - DNA, 18 bp, Homo sapiens
agtctggataatttgtat

SEQ ID NO: 597933 - DNA, 12 bp, Homo sapiens
agtctgtacttc

SEQ ID NO: 597934 - DNA, 22 bp, Homo sapiens
agtctgtacttcagttctcatc

SEQ ID NO: 597935 - DNA, 14 bp, Homo sapiens
agtcttgagtgggc

SEQ ID NO: 597936 - DNA, 21 bp, Homo sapiens
agtcttgctacctcagtcagt

SEQ ID NO: 597937 - DNA, 21 bp, Homo sapiens
agtgaaaacctctttcggaaa

SEQ ID NO: 597938 - DNA, 19 bp, Homo sapiens
agtgaaattagtattttga

SEQ ID NO: 597939 - DNA, 22 bp, Homo sapiens
agtgaagccagctgcaggaatc

SEQ ID NO: 597940 - DNA, 20 bp, Homo sapiens
agtgaatgagtttccagcta

SEQ ID NO: 597941 - DNA, 16 bp, Homo sapiens
agtgacagaaggcccg

SEQ ID NO: 597942 - DNA, 17 bp, Homo sapiens
agtgacatttcaatcac

SEQ ID NO: 597943 - DNA, 20 bp, Homo sapiens
agtgatgtgatttatgcatt

SEQ ID NO: 597944 - DNA, 17 bp, Homo sapiens
agtgatttgtaaaacag

SEQ ID NO: 597945 - DNA, 21 bp, Homo sapiens
agtgcagggacagcctgcaca

SEQ ID NO: 597946 - DNA, 14 bp, Homo sapiens
agtgcatgttaaaa

SEQ ID NO: 597947 - DNA, 16 bp, Homo sapiens
agtgcatgttaaaata

SEQ ID NO: 597948 - DNA, 22 bp, Homo sapiens
agtgcattcattcatcctctta

SEQ ID NO: 597949 - DNA, 16 bp, Homo sapiens
agtgcccatgtgtatg

SEQ ID NO: 597950 - DNA, 14 bp, Homo sapiens
agtgccccagtggt

SEQ ID NO: 597951 - DNA, 15 bp, Homo sapiens
agtgccctggggcat

SEQ ID NO: 597952 - DNA, 13 bp, Homo sapiens
agtgcctgtgatc

SEQ ID NO: 597953 - DNA, 10 bp, Homo sapiens
agtgccttat

SEQ ID NO: 597954 - DNA, 16 bp, Homo sapiens
agtgccttatggaaca

SEQ ID NO: 597955 - DNA, 22 bp, Homo sapiens
agtgctatgcatatttatagag

SEQ ID NO: 597956 - DNA, 21 bp, Homo sapiens
agtggaagagctgctgtattt

SEQ ID NO: 597957 - DNA, 14 bp, Homo sapiens
agtggacatttgtt

SEQ ID NO: 597958 - DNA, 20 bp, Homo sapiens
agtggcacgtcatctagttt

SEQ ID NO: 597959 - DNA, 19 bp, Homo sapiens
agtggcaggtgggctgcct

SEQ ID NO: 597960 - DNA, 17 bp, Homo sapiens
agtggcctgagaagagt

SEQ ID NO: 597961 - DNA, 19 bp, Homo sapiens
agtggctgaaataaaagcc

SEQ ID NO: 597962 - DNA, 14 bp, Homo sapiens
agtggctgggggac

SEQ ID NO: 597963 - DNA, 16 bp, Homo sapiens
agtgggccccctctct

SEQ ID NO: 597964 - DNA, 18 bp, Homo sapiens
agtggggcccatggcccc

SEQ ID NO: 597965 - DNA, 22 bp, Homo sapiens
agtggggcccatggccccagct

SEQ ID NO: 597966 - DNA, 23 bp, Homo sapiens
agtggtattttaacatagcagct

SEQ ID NO: 597967 - DNA, 12 bp, Homo sapiens
agtggtcaagga

SEQ ID NO: 597968 - DNA, 20 bp, Homo sapiens
agtggtcatttggtggctct

SEQ ID NO: 597969 - DNA, 15 bp, Homo sapiens
agtggtgcgggccag

SEQ ID NO: 597970 - DNA, 12 bp, Homo sapiens
agtgtacatttg

SEQ ID NO: 597971 - DNA, 17 bp, Homo sapiens
agtgtatatttgtatca

SEQ ID NO: 597972 - DNA, 16 bp, Homo sapiens
agtgtattttctgtgt

SEQ ID NO: 597973 - DNA, 20 bp, Homo sapiens
agtgtccattgacatgtaca

SEQ ID NO: 597974 - DNA, 21 bp, Homo sapiens
agtgtccattgacatgtacag

SEQ ID NO: 597975 - DNA, 22 bp, Homo sapiens
agtgtccattgacatgtacaga

SEQ ID NO: 597976 - DNA, 20 bp, Homo sapiens
agtgtctgctgctgcctccc

SEQ ID NO: 597977 - DNA, 23 bp, Homo sapiens
agtgtcttttttttcttcacctc

SEQ ID NO: 597978 - DNA, 16 bp, Homo sapiens
agtgtgcttacctgtt

SEQ ID NO: 597979 - DNA, 20 bp, Homo sapiens
agtgtggatgtaaattttat

SEQ ID NO: 597980 - DNA, 18 bp, Homo sapiens
agtgtggcttaaacattt

SEQ ID NO: 597981 - DNA, 17 bp, Homo sapiens
agtgtgtgtgcaatgtt

SEQ ID NO: 597982 - DNA, 21 bp, Homo sapiens
agtgttacctaacaatgtttt

SEQ ID NO: 597983 - DNA, 16 bp, Homo sapiens
agtgttcaaattctga

SEQ ID NO: 597984 - DNA, 24 bp, Homo sapiens
agtgttggccatcatttcattcgt

SEQ ID NO: 597985 - DNA, 16 bp, Homo sapiens
agtgttgtgttacaat

SEQ ID NO: 597986 - DNA, 14 bp, Homo sapiens
agtgttttcattct

SEQ ID NO: 597987 - DNA, 17 bp, Homo sapiens
agtgttttcattctggt

SEQ ID NO: 597988 - DNA, 24 bp, Homo sapiens
agttaagcacaaccatgttcttga

SEQ ID NO: 597989 - DNA, 21 bp, Homo sapiens
agttaatctttgaaaactcat

SEQ ID NO: 597990 - DNA, 18 bp, Homo sapiens
atattgccttgatgtttc

SEQ ID NO: 597991 - DNA, 24 bp, Homo sapiens
atattgctattgtttataggaaat

SEQ ID NO: 597992 - DNA, 22 bp, Homo sapiens
atattgctgatggtgcaatgac

SEQ ID NO: 597993 - DNA, 12 bp, Homo sapiens
atattgtatctc

SEQ ID NO: 597994 - DNA, 22 bp, Homo sapiens
atatttaataggataaattaat

SEQ ID NO: 597995 - DNA, 15 bp, Homo sapiens
atatttactgtttat

SEQ ID NO: 597996 - DNA, 17 bp, Homo sapiens
atatttactgtttataa

SEQ ID NO: 597997 - DNA, 22 bp, Homo sapiens
atatttatagagttcatagaaa

SEQ ID NO: 597998 - DNA, 23 bp, Homo sapiens
atatttatagagttcatagaaat

SEQ ID NO: 597999 - DNA, 19 bp, Homo sapiens
atatttattattttcatat

SEQ ID NO: 598000 - DNA, 15 bp, Homo sapiens
atatttgcataatat

SEQ ID NO: 598001 - DNA, 22 bp, Homo sapiens
atatttgtggtttaactttgtg

SEQ ID NO: 598002 - DNA, 13 bp, Homo sapiens
atattttgctgct

SEQ ID NO: 598003 - DNA, 15 bp, Homo sapiens
atatttttttgtaga

SEQ ID NO: 598004 - DNA, 21 bp, Homo sapiens
atcaaaaaacagaaaaacaaa

SEQ ID NO: 598005 - DNA, 16 bp, Homo sapiens
atcaaacaaatcattt

SEQ ID NO: 598006 - DNA, 11 bp, Homo sapiens
atcaaagccct

SEQ ID NO: 598007 - DNA, 12 bp, Homo sapiens
atcaaagccctc

SEQ ID NO: 598008 - DNA, 15 bp, Homo sapiens
atcaaatttttctgg

SEQ ID NO: 598009 - DNA, 15 bp, Homo sapiens
atcaacaaagaaata

SEQ ID NO: 598010 - DNA, 13 bp, Homo sapiens
atcaagaatcttt

SEQ ID NO: 598011 - DNA, 22 bp, Homo sapiens
atcaatgttcacgcaacttgaa

SEQ ID NO: 598012 - DNA, 15 bp, Homo sapiens
atcaattaatttttt

SEQ ID NO: 598013 - DNA, 17 bp, Homo sapiens
atcacaccaatttagaa

SEQ ID NO: 598014 - DNA, 15 bp, Homo sapiens
atcacagatttccaa

SEQ ID NO: 598015 - DNA, 22 bp, Homo sapiens
atcacagtctaatttttattca

SEQ ID NO: 598016 - DNA, 16 bp, Homo sapiens
atcacatgcccctctt

SEQ ID NO: 598017 - DNA, 15 bp, Homo sapiens
atcaccctgaattca

SEQ ID NO: 598018 - DNA, 21 bp, Homo sapiens
atcaccgaaaacgtggctgct

SEQ ID NO: 598019 - DNA, 22 bp, Homo sapiens
atcaccgggaacgcccccgccc

SEQ ID NO: 598020 - DNA, 17 bp, Homo sapiens
atcacctaattaatttc

SEQ ID NO: 598021 - DNA, 20 bp, Homo sapiens
atcacgggcccgctcaacct

SEQ ID NO: 598022 - DNA, 13 bp, Homo sapiens
atcagaaagacat

SEQ ID NO: 598023 - DNA, 16 bp, Homo sapiens
atcagaactcctttct

SEQ ID NO: 598024 - DNA, 18 bp, Homo sapiens
atcagaactcctttctaa

SEQ ID NO: 598025 - DNA, 15 bp, Homo sapiens
atcagctctgcataa

SEQ ID NO: 598026 - DNA, 20 bp, Homo sapiens
atcagggcccaaataacagt

SEQ ID NO: 598027 - DNA, 23 bp, Homo sapiens
atcagtccacccccattgtgaat

SEQ ID NO: 598028 - DNA, 17 bp, Homo sapiens
atcagttacagtggcag

SEQ ID NO: 598029 - DNA, 16 bp, Homo sapiens
atcatctaaatattat

SEQ ID NO: 598030 - DNA, 21 bp, Homo sapiens
atcatgcctacattagtgaga

SEQ ID NO: 598031 - DNA, 12 bp, Homo sapiens
atcatgcttcta

SEQ ID NO: 598032 - DNA, 15 bp, Homo sapiens
atcatgtgtttctgt

SEQ ID NO: 598033 - DNA, 13 bp, Homo sapiens
atcattcctgtca

SEQ ID NO: 598034 - DNA, 13 bp, Homo sapiens
atcattgaaatct

SEQ ID NO: 598035 - DNA, 20 bp, Homo sapiens
atcattgaaatctttttgct

SEQ ID NO: 598036 - DNA, 19 bp, Homo sapiens
atcattggtatctgatatc

SEQ ID NO: 598037 - DNA, 19 bp, Homo sapiens
atcattgtttgtcctttat

SEQ ID NO: 598038 - DNA, 21 bp, Homo sapiens
atcattgtttgtcctttatgt

SEQ ID NO: 598039 - DNA, 14 bp, Homo sapiens
atcatttcattcgt

SEQ ID NO: 598040 - DNA, 15 bp, Homo sapiens
atcatttcattcgtg

SEQ ID NO: 598041 - DNA, 13 bp, Homo sapiens
atcatttccagca

SEQ ID NO: 598042 - DNA, 20 bp, Homo sapiens
atcattttagtatagttttc

SEQ ID NO: 598043 - DNA, 21 bp, Homo sapiens
atcattttagtatagttttcg

SEQ ID NO: 598044 - DNA, 22 bp, Homo sapiens
atcattttgggaaattcttgca

SEQ ID NO: 598045 - DNA, 17 bp, Homo sapiens
atcattttttgtttctt

SEQ ID NO: 598046 - DNA, 18 bp, Homo sapiens
atccaaaatagtcatgtt

SEQ ID NO: 598047 - DNA, 22 bp, Homo sapiens
atccaaaatagtcatgtttctg

SEQ ID NO: 598048 - DNA, 13 bp, Homo sapiens
atccaactccagg

SEQ ID NO: 598049 - DNA, 21 bp, Homo sapiens
atccaactggaaggctttatt

SEQ ID NO: 598050 - DNA, 15 bp, Homo sapiens
atccaagcccagcct

SEQ ID NO: 598051 - DNA, 19 bp, Homo sapiens
atccaatagtctgccacaa

SEQ ID NO: 598052 - DNA, 16 bp, Homo sapiens
atccaccttcctgccc

SEQ ID NO: 598053 - DNA, 17 bp, Homo sapiens
atccaccttcctgccca

SEQ ID NO: 598054 - DNA, 12 bp, Homo sapiens
atccactacagg

SEQ ID NO: 598055 - DNA, 18 bp, Homo sapiens
atccagcagtccaaggta

SEQ ID NO: 598056 - DNA, 16 bp, Homo sapiens
atccatatcagctctg

SEQ ID NO: 598057 - DNA, 17 bp, Homo sapiens
atccatgtgctgctgtg

SEQ ID NO: 598058 - DNA, 13 bp, Homo sapiens
atcccagctttgg

SEQ ID NO: 598059 - DNA, 22 bp, Homo sapiens
atccccaccctcccctctcctg

SEQ ID NO: 598060 - DNA, 23 bp, Homo sapiens
atccccatggaacagccctgcac

SEQ ID NO: 598061 - DNA, 16 bp, Homo sapiens
atccccgtgctcacag

SEQ ID NO: 598062 - DNA, 14 bp, Homo sapiens
atcccctgcctcta

SEQ ID NO: 598063 - DNA, 23 bp, Homo sapiens
atcccctgcctctatccctggcc

SEQ ID NO: 598064 - DNA, 21 bp, Homo sapiens
atccctcggtcagcaccgtgg

SEQ ID NO: 598065 - DNA, 15 bp, Homo sapiens
atccctggccacctg

SEQ ID NO: 598066 - DNA, 18 bp, Homo sapiens
atccctggccacctgcca

SEQ ID NO: 598067 - DNA, 13 bp, Homo sapiens
atcccttggcccc

SEQ ID NO: 598068 - DNA, 15 bp, Homo sapiens
atcccttggcccctc

SEQ ID NO: 598069 - DNA, 20 bp, Homo sapiens
atcctccgcggaggcccctg

SEQ ID NO: 598070 - DNA, 17 bp, Homo sapiens
atcctctcgttcagttt

SEQ ID NO: 598071 - DNA, 21 bp, Homo sapiens
atcctctcttcttttcccatt

SEQ ID NO: 598072 - DNA, 24 bp, Homo sapiens
atcctctgcttgtcattctgctaa

SEQ ID NO: 598073 - DNA, 14 bp, Homo sapiens
atcctgcaccctct

SEQ ID NO: 598074 - DNA, 17 bp, Homo sapiens
atcctgcaccctctgct

SEQ ID NO: 598075 - DNA, 15 bp, Homo sapiens
gattttgttttgctt

SEQ ID NO: 598076 - DNA, 17 bp, Homo sapiens
gatttttcaaagacttc

SEQ ID NO: 598077 - DNA, 14 bp, Homo sapiens
gatttttgttgatt

SEQ ID NO: 598078 - DNA, 17 bp, Homo sapiens
gatttttttttccttca

SEQ ID NO: 598079 - DNA, 23 bp, Homo sapiens
gatttttttttccttcagtgcct

SEQ ID NO: 598080 - DNA, 11 bp, Homo sapiens
gcaaacacagt

SEQ ID NO: 598081 - DNA, 11 bp, Homo sapiens
gcaaacattta

SEQ ID NO: 598082 - DNA, 15 bp, Homo sapiens
gcaaaccaatttgtt

SEQ ID NO: 598083 - DNA, 18 bp, Homo sapiens
gcaaaccaatttgttctg

SEQ ID NO: 598084 - DNA, 15 bp, Homo sapiens
gcaaaccatcattga

SEQ ID NO: 598085 - DNA, 19 bp, Homo sapiens
gcaaaccatcattgaaatc

SEQ ID NO: 598086 - DNA, 14 bp, Homo sapiens
gcaaactgaaatta

SEQ ID NO: 598087 - DNA, 16 bp, Homo sapiens
gcaaagaactgcccca

SEQ ID NO: 598088 - DNA, 14 bp, Homo sapiens
gcaaagaatcaaca

SEQ ID NO: 598089 - DNA, 19 bp, Homo sapiens
gcaaagatccagcggggct

SEQ ID NO: 598090 - DNA, 21 bp, Homo sapiens
gcaaagatccagcggggcttc

SEQ ID NO: 598091 - DNA, 21 bp, Homo sapiens
gcaaagcatgccaatttctct

SEQ ID NO: 598092 - DNA, 14 bp, Homo sapiens
gcaaaggtgcctca

SEQ ID NO: 598093 - DNA, 20 bp, Homo sapiens
gcaaatgaatttatcatttt

SEQ ID NO: 598094 - DNA, 22 bp, Homo sapiens
gcaaatgaatttatcattttag

SEQ ID NO: 598095 - DNA, 21 bp, Homo sapiens
gcaaattaattggcagcagat

SEQ ID NO: 598096 - DNA, 24 bp, Homo sapiens
gcaaatttctagatatgagaaata

SEQ ID NO: 598097 - DNA, 12 bp, Homo sapiens
gcaacactgcca

SEQ ID NO: 598098 - DNA, 19 bp, Homo sapiens
gcaaccagagcactgtata

SEQ ID NO: 598099 - DNA, 21 bp, Homo sapiens
gcaacctgacagcaaacacag

SEQ ID NO: 598100 - DNA, 20 bp, Homo sapiens
gcaaccttgtactttacaat

SEQ ID NO: 598101 - DNA, 19 bp, Homo sapiens
gcaactgtctatttctgct

SEQ ID NO: 598102 - DNA, 23 bp, Homo sapiens
gcaactgtctatttctgctgaat

SEQ ID NO: 598103 - DNA, 23 bp, Homo sapiens
gcaagctcatagcacatgtttta

SEQ ID NO: 598104 - DNA, 16 bp, Homo sapiens
gcaaggaagctttgga

SEQ ID NO: 598105 - DNA, 18 bp, Homo sapiens
gcaaggaagctttggaag

SEQ ID NO: 598106 - DNA, 21 bp, Homo sapiens
gcaaggacaacctgcccctcc

SEQ ID NO: 598107 - DNA, 17 bp, Homo sapiens
gcaaggcaagaagtggg

SEQ ID NO: 598108 - DNA, 21 bp, Homo sapiens
gcaaggggcgcgcgcccccag

SEQ ID NO: 598109 - DNA, 23 bp, Homo sapiens
gcaaggggcgcgcgcccccagga

SEQ ID NO: 598110 - DNA, 16 bp, Homo sapiens
gcaagtttttggtaat

SEQ ID NO: 598111 - DNA, 17 bp, Homo sapiens
gcaataaactcagtcaa

SEQ ID NO: 598112 - DNA, 21 bp, Homo sapiens
gcaataaactcagtcaaatgt

SEQ ID NO: 598113 - DNA, 22 bp, Homo sapiens
gcaatagcgctcccttttcacc

SEQ ID NO: 598114 - DNA, 22 bp, Homo sapiens
gcaataggtttgggggacgccc

SEQ ID NO: 598115 - DNA, 17 bp, Homo sapiens
gcaatcttgctgtgaaa

SEQ ID NO: 598116 - DNA, 22 bp, Homo sapiens
gcaattgtatatatatgtgaac

SEQ ID NO: 598117 - DNA, 18 bp, Homo sapiens
gcacaaaaaatttaagag

SEQ ID NO: 598118 - DNA, 18 bp, Homo sapiens
gcacaaccatgttcttga

SEQ ID NO: 598119 - DNA, 14 bp, Homo sapiens
gcacaagggcacat

SEQ ID NO: 598120 - DNA, 15 bp, Homo sapiens
gcacaagggcacatt

SEQ ID NO: 598121 - DNA, 16 bp, Homo sapiens
gcacaagggcacattg

SEQ ID NO: 598122 - DNA, 21 bp, Homo sapiens
gcacaagggcacattgcccat

SEQ ID NO: 598123 - DNA, 20 bp, Homo sapiens
gcacacaactgtggtcccag

SEQ ID NO: 598124 - DNA, 18 bp, Homo sapiens
gcacacacaaacctactg

SEQ ID NO: 598125 - DNA, 21 bp, Homo sapiens
gcacacacaaacctactgccc

SEQ ID NO: 598126 - DNA, 19 bp, Homo sapiens
gcacacacacgcaaataca

SEQ ID NO: 598127 - DNA, 17 bp, Homo sapiens
gcacacataacacacat

SEQ ID NO: 598128 - DNA, 18 bp, Homo sapiens
gcacaccaaattgctgag

SEQ ID NO: 598129 - DNA, 21 bp, Homo sapiens
gcacaccaaattgctgagatg

SEQ ID NO: 598130 - DNA, 18 bp, Homo sapiens
gcacactgccctctgcca

SEQ ID NO: 598131 - DNA, 20 bp, Homo sapiens
gcacagagagcggcttcccc

SEQ ID NO: 598132 - DNA, 20 bp, Homo sapiens
gcacagaggatggcttcccc

SEQ ID NO: 598133 - DNA, 18 bp, Homo sapiens
gcacagctttcctgggtc

SEQ ID NO: 598134 - DNA, 21 bp, Homo sapiens
gcacaggagactccaaggagc

SEQ ID NO: 598135 - DNA, 15 bp, Homo sapiens
gcacatacagatggt

SEQ ID NO: 598136 - DNA, 13 bp, Homo sapiens
gcacatgttttac

SEQ ID NO: 598137 - DNA, 17 bp, Homo sapiens
gcacattggcagtgtgt

SEQ ID NO: 598138 - DNA, 18 bp, Homo sapiens
gcacatttgttaatgatt

SEQ ID NO: 598139 - DNA, 12 bp, Homo sapiens
gcaccagcctga

SEQ ID NO: 598140 - DNA, 16 bp, Homo sapiens
gcaccagtgccgcctg

SEQ ID NO: 598141 - DNA, 17 bp, Homo sapiens
gcacccccagcctcccc

SEQ ID NO: 598142 - DNA, 15 bp, Homo sapiens
gcacccccggacgcc

SEQ ID NO: 598143 - DNA, 17 bp, Homo sapiens
gcaccctccacaggagc

SEQ ID NO: 598144 - DNA, 19 bp, Homo sapiens
gcaccctccacaggagccg

SEQ ID NO: 598145 - DNA, 20 bp, Homo sapiens
gcaccctctgctatgtctgt

SEQ ID NO: 598146 - DNA, 18 bp, Homo sapiens
gcaccctgcaggcaggca

SEQ ID NO: 598147 - DNA, 21 bp, Homo sapiens
gcaccctgcaggcaggcagac

SEQ ID NO: 598148 - DNA, 20 bp, Homo sapiens
gcaccgcccaacccccacct

SEQ ID NO: 598149 - DNA, 21 bp, Homo sapiens
gcaccgcccaacccccacctc

SEQ ID NO: 598150 - DNA, 15 bp, Homo sapiens
gcaccgcccacccac

SEQ ID NO: 598151 - DNA, 19 bp, Homo sapiens
gcaccgcccacccacaccc

SEQ ID NO: 598152 - DNA, 18 bp, Homo sapiens
gcaccgtggtgtgaggcc

SEQ ID NO: 598153 - DNA, 17 bp, Homo sapiens
gcacctccgggactgac

SEQ ID NO: 598154 - DNA, 21 bp, Homo sapiens
gcaccttgggcacgggagagc

SEQ ID NO: 598155 - DNA, 23 bp, Homo sapiens
gcaccttgggcacgggagagcgc

SEQ ID NO: 598156 - DNA, 13 bp, Homo sapiens
gcacggcagcttg

SEQ ID NO: 598157 - DNA, 15 bp, Homo sapiens
gcacgggagagcgcc

SEQ ID NO: 598158 - DNA, 20 bp, Homo sapiens
gcactagaatgagaaatcat

SEQ ID NO: 598159 - DNA, 13 bp, Homo sapiens
gcactcaggagca

SEQ ID NO: 598160 - DNA, 19 bp, Homo sapiens
gcactcaggagcacagcca

SEQ ID NO: 598161 - DNA, 13 bp, Homo sapiens
gcactcccagggc

SEQ ID NO: 598162 - DNA, 21 bp, Homo sapiens
gcactcccagggcccgagcgc

SEQ ID NO: 598163 - DNA, 22 bp, Homo sapiens
gcactctagggtgaaccaagct

SEQ ID NO: 598164 - DNA, 19 bp, Homo sapiens
gcactcttttgagcagtaa

SEQ ID NO: 598165 - DNA, 12 bp, Homo sapiens
gcagaaaacatt

SEQ ID NO: 598166 - DNA, 18 bp, Homo sapiens
gcagaaagccagggtcct

SEQ ID NO: 598167 - DNA, 16 bp, Homo sapiens
gcagaatgagatgatt

SEQ ID NO: 598168 - DNA, 18 bp, Homo sapiens
gcagaatgagatgattta

SEQ ID NO: 598169 - DNA, 12 bp, Homo sapiens
gcagacacacac

SEQ ID NO: 598170 - DNA, 15 bp, Homo sapiens
gcagacacacacata

SEQ ID NO: 598171 - DNA, 17 bp, Homo sapiens
gcagacagggcgtcctc

SEQ ID NO: 598172 - DNA, 21 bp, Homo sapiens
gcagacagggcgtcctctcgt

SEQ ID NO: 598173 - DNA, 15 bp, Homo sapiens
gcagacattgtcagc

SEQ ID NO: 598174 - DNA, 21 bp, Homo sapiens
gcatgagttctgcacatacag

SEQ ID NO: 598175 - DNA, 23 bp, Homo sapiens
gcatgagttctgcacatacagat

SEQ ID NO: 598176 - DNA, 22 bp, Homo sapiens
gcatgcagggcccccatgcagg

SEQ ID NO: 598177 - DNA, 17 bp, Homo sapiens
gcatgccatctccaccc

SEQ ID NO: 598178 - DNA, 23 bp, Homo sapiens
gcatgcctgggcccaggcccagc

SEQ ID NO: 598179 - DNA, 23 bp, Homo sapiens
gcatggagaagggttctgccctg

SEQ ID NO: 598180 - DNA, 19 bp, Homo sapiens
gcatggcgccccgggccgc

SEQ ID NO: 598181 - DNA, 11 bp, Homo sapiens
gcatgtacagt

SEQ ID NO: 598182 - DNA, 13 bp, Homo sapiens
gcatgtatgccat

SEQ ID NO: 598183 - DNA, 19 bp, Homo sapiens
gcatgtatgccatgtatgt

SEQ ID NO: 598184 - DNA, 21 bp, Homo sapiens
gcatgtattgtgtcttttgca

SEQ ID NO: 598185 - DNA, 21 bp, Homo sapiens
gcatgtgatgagaggaaatca

SEQ ID NO: 598186 - DNA, 19 bp, Homo sapiens
gcatgtttaataatatgta

SEQ ID NO: 598187 - DNA, 14 bp, Homo sapiens
gcattaagcacaca

SEQ ID NO: 598188 - DNA, 22 bp, Homo sapiens
gcattctggggtggggcttgga

SEQ ID NO: 598189 - DNA, 20 bp, Homo sapiens
gcattgcactaaaagtgatg

SEQ ID NO: 598190 - DNA, 16 bp, Homo sapiens
gcatttagcacagtat

SEQ ID NO: 598191 - DNA, 18 bp, Homo sapiens
gcatttagcacagtattt

SEQ ID NO: 598192 - DNA, 13 bp, Homo sapiens
gcatttatgcatg

SEQ ID NO: 598193 - DNA, 22 bp, Homo sapiens
gcatttatgcatgagaactaaa

SEQ ID NO: 598194 - DNA, 24 bp, Homo sapiens
gcatttatgcatgagaactaaata

SEQ ID NO: 598195 - DNA, 12 bp, Homo sapiens
gcatttgctgaa

SEQ ID NO: 598196 - DNA, 15 bp, Homo sapiens
gccaaaatgtcaatt

SEQ ID NO: 598197 - DNA, 16 bp, Homo sapiens
ctctcctctctctccc

SEQ ID NO: 598198 - DNA, 20 bp, Homo sapiens
ctctcctctctctccctcca

SEQ ID NO: 598199 - DNA, 20 bp, Homo sapiens
ctctcctgagcctgtctctc

SEQ ID NO: 598200 - DNA, 17 bp, Homo sapiens
ctctcgggctctctcac

SEQ ID NO: 598201 - DNA, 17 bp, Homo sapiens
ctctctccctccactcc

SEQ ID NO: 598202 - DNA, 18 bp, Homo sapiens
ctctctcctctctctccc

SEQ ID NO: 598203 - DNA, 16 bp, Homo sapiens
ctctctctctctgttc

SEQ ID NO: 598204 - DNA, 11 bp, Homo sapiens
ctctctctctg

SEQ ID NO: 598205 - DNA, 12 bp, Homo sapiens
ctctctctctgt

SEQ ID NO: 598206 - DNA, 13 bp, Homo sapiens
ctctctctgttcc

SEQ ID NO: 598207 - DNA, 20 bp, Homo sapiens
ctctctgaactgcaacactg

SEQ ID NO: 598208 - DNA, 13 bp, Homo sapiens
ctctctgtgtggc

SEQ ID NO: 598209 - DNA, 22 bp, Homo sapiens
ctctctgttccaagtgtgtgtg

SEQ ID NO: 598210 - DNA, 20 bp, Homo sapiens
ctctctgtttaccctccctg

SEQ ID NO: 598211 - DNA, 22 bp, Homo sapiens
ctctctgtttaccctccctgtc

SEQ ID NO: 598212 - DNA, 16 bp, Homo sapiens
ctctcttaccccgtcc

SEQ ID NO: 598213 - DNA, 15 bp, Homo sapiens
ctctcttcttactgt

SEQ ID NO: 598214 - DNA, 19 bp, Homo sapiens
ctctcttggtctctttctt

SEQ ID NO: 598215 - DNA, 15 bp, Homo sapiens
ctctgaactgcaaca

SEQ ID NO: 598216 - DNA, 18 bp, Homo sapiens
ctctgaactgcaacactg

SEQ ID NO: 598217 - DNA, 20 bp, Homo sapiens
ctctgaactgcaacactgga

SEQ ID NO: 598218 - DNA, 15 bp, Homo sapiens
ctctgaagtcccttc

SEQ ID NO: 598219 - DNA, 24 bp, Homo sapiens
ctctgaagtcccttcctgtcctgc

SEQ ID NO: 598220 - DNA, 23 bp, Homo sapiens
ctctgagactcgcgacaatgcaa

SEQ ID NO: 598221 - DNA, 22 bp, Homo sapiens
ctctgaggacagaggccggggt

SEQ ID NO: 598222 - DNA, 12 bp, Homo sapiens
ctctgcagcctg

SEQ ID NO: 598223 - DNA, 13 bp, Homo sapiens
ctctgcagcctga

SEQ ID NO: 598224 - DNA, 10 bp, Homo sapiens
ctctgccccc

SEQ ID NO: 598225 - DNA, 21 bp, Homo sapiens
ctctgccccctcccccgcaga

SEQ ID NO: 598226 - DNA, 18 bp, Homo sapiens
ctctgcccctccgtcccc

SEQ ID NO: 598227 - DNA, 23 bp, Homo sapiens
ctctgcccctccgtccccagggt

SEQ ID NO: 598228 - DNA, 19 bp, Homo sapiens
ctctgcccgcgggtggctg

SEQ ID NO: 598229 - DNA, 20 bp, Homo sapiens
ctctgctatgtctgtgatgt

SEQ ID NO: 598230 - DNA, 17 bp, Homo sapiens
ctctggatgaaggcaaa

SEQ ID NO: 598231 - DNA, 19 bp, Homo sapiens
ctctggatgaaggcaaaaa

SEQ ID NO: 598232 - DNA, 23 bp, Homo sapiens
ctctggccttggttcctccagca

SEQ ID NO: 598233 - DNA, 21 bp, Homo sapiens
ctctgggttttgggatttggg

SEQ ID NO: 598234 - DNA, 18 bp, Homo sapiens
ctctgtcagtttgtgaag

SEQ ID NO: 598235 - DNA, 22 bp, Homo sapiens
ctctgtccgtctgtcctgcgcc

SEQ ID NO: 598236 - DNA, 19 bp, Homo sapiens
ctctgtgctaagttgtctt

SEQ ID NO: 598237 - DNA, 18 bp, Homo sapiens
ctctgttccaagtgtgtg

SEQ ID NO: 598238 - DNA, 15 bp, Homo sapiens
ctctgtttaccctcc

SEQ ID NO: 598239 - DNA, 18 bp, Homo sapiens
ctctgtttaccctccctg

SEQ ID NO: 598240 - DNA, 20 bp, Homo sapiens
ctctgtttaccctccctgtc

SEQ ID NO: 598241 - DNA, 21 bp, Homo sapiens
ctcttaccccgtccctttccc

SEQ ID NO: 598242 - DNA, 20 bp, Homo sapiens
ctcttacctgtaatagcctc

SEQ ID NO: 598243 - DNA, 22 bp, Homo sapiens
ctcttacctgtaatagcctcac

SEQ ID NO: 598244 - DNA, 17 bp, Homo sapiens
ctcttatatgtgcccct

SEQ ID NO: 598245 - DNA, 22 bp, Homo sapiens
ctcttcatgcgcagtccccagg

SEQ ID NO: 598246 - DNA, 14 bp, Homo sapiens
ctcttcccccttcc

SEQ ID NO: 598247 - DNA, 14 bp, Homo sapiens
cttctgtgcatctg

SEQ ID NO: 598248 - DNA, 15 bp, Homo sapiens
cttcttactgtattt

SEQ ID NO: 598249 - DNA, 13 bp, Homo sapiens
cttcttcccccag

SEQ ID NO: 598250 - DNA, 17 bp, Homo sapiens
cttcttcccccagggtc

SEQ ID NO: 598251 - DNA, 20 bp, Homo sapiens
cttcttgcggcaccgcccac

SEQ ID NO: 598252 - DNA, 18 bp, Homo sapiens
cttctttaatttttctgt

SEQ ID NO: 598253 - DNA, 18 bp, Homo sapiens
cttctttactaacactgg

SEQ ID NO: 598254 - DNA, 19 bp, Homo sapiens
cttctttactaacactggc

SEQ ID NO: 598255 - DNA, 13 bp, Homo sapiens
cttctttccttcc

SEQ ID NO: 598256 - DNA, 12 bp, Homo sapiens
cttctttttggt

SEQ ID NO: 598257 - DNA, 19 bp, Homo sapiens
cttgaaaagaggtgaccat

SEQ ID NO: 598258 - DNA, 22 bp, Homo sapiens
cttgaaagcgaaatacttgaaa

SEQ ID NO: 598259 - DNA, 23 bp, Homo sapiens
cttgaaagcgaaatacttgaaaa

SEQ ID NO: 598260 - DNA, 20 bp, Homo sapiens
cttgacaggcgccgcctcgc

SEQ ID NO: 598261 - DNA, 19 bp, Homo sapiens
cttgacagttacttacaca

SEQ ID NO: 598262 - DNA, 23 bp, Homo sapiens
cttgaccctgaaatattttctac

SEQ ID NO: 598263 - DNA, 18 bp, Homo sapiens
cttgactattacactgcc

SEQ ID NO: 598264 - DNA, 21 bp, Homo sapiens
cttgagcaaggcaagaagtgg

SEQ ID NO: 598265 - DNA, 22 bp, Homo sapiens
cttgagggacgactttctttaa

SEQ ID NO: 598266 - DNA, 17 bp, Homo sapiens
cttgagtgggccccctc

SEQ ID NO: 598267 - DNA, 20 bp, Homo sapiens
cttgagtgggccccctctct

SEQ ID NO: 598268 - DNA, 14 bp, Homo sapiens
cttgagtttcattt

SEQ ID NO: 598269 - DNA, 19 bp, Homo sapiens
cttgagtttcatttttcat

SEQ ID NO: 598270 - DNA, 21 bp, Homo sapiens
cttgattaaggactacagaat

SEQ ID NO: 598271 - DNA, 16 bp, Homo sapiens
cttgattctaaagggg

SEQ ID NO: 598272 - DNA, 16 bp, Homo sapiens
cttgatttttcaaaga

SEQ ID NO: 598273 - DNA, 15 bp, Homo sapiens
cttgcacttctgtta

SEQ ID NO: 598274 - DNA, 20 bp, Homo sapiens
cttgcattttagctaattta

SEQ ID NO: 598275 - DNA, 17 bp, Homo sapiens
cttgcggcaccgcccac

SEQ ID NO: 598276 - DNA, 22 bp, Homo sapiens
cttgcggcaccgcccacccaca

SEQ ID NO: 598277 - DNA, 16 bp, Homo sapiens
cttgctcagagctagg

SEQ ID NO: 598278 - DNA, 15 bp, Homo sapiens
cttgctctacctggc

SEQ ID NO: 598279 - DNA, 18 bp, Homo sapiens
cttgctctacctggccgg

SEQ ID NO: 598280 - DNA, 12 bp, Homo sapiens
cttgctgggcca

SEQ ID NO: 598281 - DNA, 19 bp, Homo sapiens
cttgctgtttaccgcccac

SEQ ID NO: 598282 - DNA, 22 bp, Homo sapiens
cttgctgtttaccgcccaccca

SEQ ID NO: 598283 - DNA, 12 bp, Homo sapiens
cttggaaaatgt

SEQ ID NO: 598284 - DNA, 15 bp, Homo sapiens
cttggacatttatgt

SEQ ID NO: 598285 - DNA, 18 bp, Homo sapiens
cttggacatttatgtaca

SEQ ID NO: 598286 - DNA, 19 bp, Homo sapiens
cttggacatttatgtacaa

SEQ ID NO: 598287 - DNA, 20 bp, Homo sapiens
cttggagagagaggctgcct

SEQ ID NO: 598288 - DNA, 21 bp, Homo sapiens
cttggagagagaggctgcctc

SEQ ID NO: 598289 - DNA, 19 bp, Homo sapiens
cttggagaggaggtgtgga

SEQ ID NO: 598290 - DNA, 20 bp, Homo sapiens
cttggagccccctggcggca

SEQ ID NO: 598291 - DNA, 21 bp, Homo sapiens
cttggagccccctggcggcag

SEQ ID NO: 598292 - DNA, 15 bp, Homo sapiens
cttggatcgtggaag

SEQ ID NO: 598293 - DNA, 22 bp, Homo sapiens
cttggattggtaccagagccta

SEQ ID NO: 598294 - DNA, 14 bp, Homo sapiens
cttggcattgacct

SEQ ID NO: 598295 - DNA, 19 bp, Homo sapiens
cttggcattgaccttcatg

SEQ ID NO: 598296 - DNA, 23 bp, Homo sapiens
cttgggacggaagtggcctgaga

SEQ ID NO: 598297 - DNA, 19 bp, Homo sapiens
cttggggtagagaggacag

SEQ ID NO: 598298 - DNA, 13 bp, Homo sapiens
cttggtccttaaa

SEQ ID NO: 598299 - DNA, 18 bp, Homo sapiens
cttggtctctttctttcc

SEQ ID NO: 598300 - DNA, 19 bp, Homo sapiens
cttggtgattacctgaaag

SEQ ID NO: 598301 - DNA, 16 bp, Homo sapiens
cttggtttccatcaaa

SEQ ID NO: 598302 - DNA, 14 bp, Homo sapiens
cttgtaaaactgtg

SEQ ID NO: 598303 - DNA, 16 bp, Homo sapiens
cttgtaaaactgtgac

SEQ ID NO: 598304 - DNA, 20 bp, Homo sapiens
cttgtaaaactgtgacattc

SEQ ID NO: 598305 - DNA, 17 bp, Homo sapiens
cttgtaaataatgctta

SEQ ID NO: 598306 - DNA, 14 bp, Homo sapiens
cttgtacagaacca

SEQ ID NO: 598307 - DNA, 21 bp, Homo sapiens
cttgtacttacactgaaatcc

SEQ ID NO: 598308 - DNA, 13 bp, Homo sapiens
cttgtagggtgag

SEQ ID NO: 598309 - DNA, 16 bp, Homo sapiens
cttgtcattctgctaa

SEQ ID NO: 598310 - DNA, 16 bp, Homo sapiens
cttgtgcagaaaacat

SEQ ID NO: 598311 - DNA, 18 bp, Homo sapiens
cttgtgcagaaaacattg

SEQ ID NO: 598312 - DNA, 20 bp, Homo sapiens
cttgtgcagaaaacattgtt

SEQ ID NO: 598313 - DNA, 15 bp, Homo sapiens
cttgtggcagcttcc

SEQ ID NO: 598314 - DNA, 17 bp, Homo sapiens
cttgtggcagcttccct

SEQ ID NO: 598315 - DNA, 21 bp, Homo sapiens
cttgtggcagcttccctgaac

SEQ ID NO: 598316 - DNA, 18 bp, Homo sapiens
cttgtgtaatttcctgct

SEQ ID NO: 598317 - DNA, 14 bp, Homo sapiens
cttgttatgttgta

SEQ ID NO: 598318 - DNA, 22 bp, Homo sapiens
cttgttatgttgtaatattttg

SEQ ID NO: 598319 - DNA, 23 bp, Homo sapiens
cttgttatgttgtaatattttgc

SEQ ID NO: 598320 - DNA, 12 bp, Homo sapiens
cttgttcttcct

SEQ ID NO: 598321 - DNA, 15 bp, Homo sapiens
cttgttgttcatata

SEQ ID NO: 598322 - DNA, 16 bp, Homo sapiens
ctttaaaaaaatccca

SEQ ID NO: 598323 - DNA, 23 bp, Homo sapiens
ctttaaaatgattcacttttatt

SEQ ID NO: 598324 - DNA, 14 bp, Homo sapiens
ctttaaattgtgga

SEQ ID NO: 598325 - DNA, 16 bp, Homo sapiens
ctttaaattgtggatg

SEQ ID NO: 598326 - DNA, 18 bp, Homo sapiens
ctttaaattgtggatgaa

SEQ ID NO: 598327 - DNA, 17 bp, Homo sapiens
ctttaagcgaggcagaa

SEQ ID NO: 598328 - DNA, 20 bp, Homo sapiens
ctttaagcgaggcagaatgg

SEQ ID NO: 598329 - DNA, 19 bp, Homo sapiens
ctttaatatactccttaaa

SEQ ID NO: 598330 - DNA, 14 bp, Homo sapiens
ctttaatgttctat

SEQ ID NO: 598331 - DNA, 13 bp, Homo sapiens
ctttaatttagaa

SEQ ID NO: 598332 - DNA, 22 bp, Homo sapiens
ctttacagatgagattccctct

SEQ ID NO: 598333 - DNA, 19 bp, Homo sapiens
ctttaccatagcttaagaa

SEQ ID NO: 598334 - DNA, 15 bp, Homo sapiens
ctttagagaagccat

SEQ ID NO: 598335 - DNA, 16 bp, Homo sapiens
ctttagagaagccata

SEQ ID NO: 598336 - DNA, 19 bp, Homo sapiens
ctttaggtaaaaagcttaa

SEQ ID NO: 598337 - DNA, 15 bp, Homo sapiens
ctttatagagctctt

SEQ ID NO: 598338 - DNA, 18 bp, Homo sapiens
ctttatcatgtgtttctg

SEQ ID NO: 598339 - DNA, 13 bp, Homo sapiens
ctttatgatttca

SEQ ID NO: 598340 - DNA, 17 bp, Homo sapiens
ctttattcttccaagtt

SEQ ID NO: 598341 - DNA, 23 bp, Homo sapiens
ctttcaataggaaaaactgattt

SEQ ID NO: 598342 - DNA, 17 bp, Homo sapiens
ctttcaatccacagtat

SEQ ID NO: 598343 - DNA, 23 bp, Homo sapiens
ctttcaatccacagtattgttct

SEQ ID NO: 598344 - DNA, 12 bp, Homo sapiens
ctttcaggaaat

SEQ ID NO: 598345 - DNA, 14 bp, Homo sapiens
ctttcaggaaattt

SEQ ID NO: 598346 - DNA, 13 bp, Homo sapiens
ctttcagtgcctg

SEQ ID NO: 598347 - DNA, 14 bp, Homo sapiens
ctttcagtgcctgc

SEQ ID NO: 598348 - DNA, 16 bp, Homo sapiens
ctttcagtgcctgctg

SEQ ID NO: 598349 - DNA, 14 bp, Homo sapiens
ctttcccaaaccct

SEQ ID NO: 598350 - DNA, 14 bp, Homo sapiens
ctttcccacactgt

SEQ ID NO: 598351 - DNA, 16 bp, Homo sapiens
ctttccccattcagtg

SEQ ID NO: 598352 - DNA, 17 bp, Homo sapiens
ctttccccattcagtga

SEQ ID NO: 598353 - DNA, 12 bp, Homo sapiens
ctttccctgagg

SEQ ID NO: 598354 - DNA, 13 bp, Homo sapiens
ctttccctgagga

SEQ ID NO: 598355 - DNA, 14 bp, Homo sapiens
ctttccctgaggaa

SEQ ID NO: 598356 - DNA, 15 bp, Homo sapiens
gacagaggccggggt

SEQ ID NO: 598357 - DNA, 14 bp, Homo sapiens
gacagaggtttcat

SEQ ID NO: 598358 - DNA, 15 bp, Homo sapiens
gacagaggtttcatt

SEQ ID NO: 598359 - DNA, 21 bp, Homo sapiens
gacagaggtttcattttcatc

SEQ ID NO: 598360 - DNA, 14 bp, Homo sapiens
gacagagtgccctg

SEQ ID NO: 598361 - DNA, 19 bp, Homo sapiens
gacagagtgccctggggca

SEQ ID NO: 598362 - DNA, 18 bp, Homo sapiens
gacagagtggatctggag

SEQ ID NO: 598363 - DNA, 15 bp, Homo sapiens
gacagccatacttcc

SEQ ID NO: 598364 - DNA, 14 bp, Homo sapiens
gacagcctgcacag

SEQ ID NO: 598365 - DNA, 12 bp, Homo sapiens
gacagcggcccc

SEQ ID NO: 598366 - DNA, 16 bp, Homo sapiens
gacagcggcccggccc

SEQ ID NO: 598367 - DNA, 17 bp, Homo sapiens
gacagcggcccggccca

SEQ ID NO: 598368 - DNA, 15 bp, Homo sapiens
gacaggcaccatgct

SEQ ID NO: 598369 - DNA, 15 bp, Homo sapiens
gacaggcgccgcctc

SEQ ID NO: 598370 - DNA, 18 bp, Homo sapiens
gacagtggttatatttca

SEQ ID NO: 598371 - DNA, 15 bp, Homo sapiens
gacatattcccatgg

SEQ ID NO: 598372 - DNA, 13 bp, Homo sapiens
gacatctctgtaa

SEQ ID NO: 598373 - DNA, 19 bp, Homo sapiens
gacatggaatttatgaatg

SEQ ID NO: 598374 - DNA, 14 bp, Homo sapiens
gacatggtgctgtg

SEQ ID NO: 598375 - DNA, 13 bp, Homo sapiens
gacattgtcagaa

SEQ ID NO: 598376 - DNA, 17 bp, Homo sapiens
gacattgtcagaatgtt

SEQ ID NO: 598377 - DNA, 17 bp, Homo sapiens
gacattgtcagcaaatt

SEQ ID NO: 598378 - DNA, 14 bp, Homo sapiens
gacattgttttgcc

SEQ ID NO: 598379 - DNA, 21 bp, Homo sapiens
gacattgttttgccaacattg

SEQ ID NO: 598380 - DNA, 15 bp, Homo sapiens
gacatttatgtacaa

SEQ ID NO: 598381 - DNA, 15 bp, Homo sapiens
gacattttgtagcta

SEQ ID NO: 598382 - DNA, 18 bp, Homo sapiens
gacattttgtagctagtt

SEQ ID NO: 598383 - DNA, 21 bp, Homo sapiens
gaccaacgatcctatgagaga

SEQ ID NO: 598384 - DNA, 15 bp, Homo sapiens
gaccacccctgtgcg

SEQ ID NO: 598385 - DNA, 16 bp, Homo sapiens
gaccacccctgtgcgc

SEQ ID NO: 598386 - DNA, 17 bp, Homo sapiens
gaccaccgcgcccctct

SEQ ID NO: 598387 - DNA, 15 bp, Homo sapiens
gaccacgcccctgcc

SEQ ID NO: 598388 - DNA, 16 bp, Homo sapiens
gaccacttccttaaca

SEQ ID NO: 598389 - DNA, 18 bp, Homo sapiens
gaccagcatagttctgca

SEQ ID NO: 598390 - DNA, 16 bp, Homo sapiens
gaccagcctgccaggc

SEQ ID NO: 598391 - DNA, 17 bp, Homo sapiens
gaccagcctgccaggcc

SEQ ID NO: 598392 - DNA, 20 bp, Homo sapiens
gaccagcctgccaggccctc

SEQ ID NO: 598393 - DNA, 20 bp, Homo sapiens
gaccagttccctcagccctc

SEQ ID NO: 598394 - DNA, 10 bp, Homo sapiens
gaccccacac

SEQ ID NO: 598395 - DNA, 22 bp, Homo sapiens
gaccccacacgccggggctggc

SEQ ID NO: 598396 - DNA, 18 bp, Homo sapiens
gacccccccagtccgccc

SEQ ID NO: 598397 - DNA, 18 bp, Homo sapiens
gacccctaccctttccca

SEQ ID NO: 598398 - DNA, 12 bp, Homo sapiens
gacccctgccct

SEQ ID NO: 598399 - DNA, 15 bp, Homo sapiens
gaccctgcgcccctg

SEQ ID NO: 598400 - DNA, 22 bp, Homo sapiens
gaccctgcgcccctgcccagca

SEQ ID NO: 598401 - DNA, 15 bp, Homo sapiens
gaccggacgcatgca

SEQ ID NO: 598402 - DNA, 17 bp, Homo sapiens
gaccgtggtgtcctctg

SEQ ID NO: 598403 - DNA, 19 bp, Homo sapiens
gaccgtggtgtcctctgtc

SEQ ID NO: 598404 - DNA, 15 bp, Homo sapiens
gacctacatctgaaa

SEQ ID NO: 598405 - DNA, 20 bp, Homo sapiens
gacctccagattattttcta

SEQ ID NO: 598406 - DNA, 17 bp, Homo sapiens
gacctcctgatgtcttg

SEQ ID NO: 598407 - DNA, 18 bp, Homo sapiens
gacctgctcctgcccacg

SEQ ID NO: 598408 - DNA, 14 bp, Homo sapiens
gaccttacaaccac

SEQ ID NO: 598409 - DNA, 18 bp, Homo sapiens
gacgactttctttaacat

SEQ ID NO: 598410 - DNA, 13 bp, Homo sapiens
gacgcatgcaggg

SEQ ID NO: 598411 - DNA, 21 bp, Homo sapiens
gacgcccagcccccacccccg

SEQ ID NO: 598412 - DNA, 13 bp, Homo sapiens
gacgcccctccgg

SEQ ID NO: 598413 - DNA, 16 bp, Homo sapiens
gacgctggagaccctg

SEQ ID NO: 598414 - DNA, 19 bp, Homo sapiens
gacggacgggacagcggcc

SEQ ID NO: 598415 - DNA, 20 bp, Homo sapiens
gacggcttccccatcgcctt

SEQ ID NO: 598416 - DNA, 22 bp, Homo sapiens
gacggggcagagctgagtcggc

SEQ ID NO: 598417 - DNA, 21 bp, Homo sapiens
gacgtcgctgtccgtcctgct

SEQ ID NO: 598418 - DNA, 16 bp, Homo sapiens
gactaacttattttga

SEQ ID NO: 598419 - DNA, 13 bp, Homo sapiens
gactacagaagtg

SEQ ID NO: 598420 - DNA, 21 bp, Homo sapiens
gactcagaaacagaagaaaaa

SEQ ID NO: 598421 - DNA, 23 bp, Homo sapiens
gactcagtgcagggacagcctgc

SEQ ID NO: 598422 - DNA, 18 bp, Homo sapiens
gactccagaagcagcagc

SEQ ID NO: 598423 - DNA, 15 bp, Homo sapiens
gactcgagagggctg

SEQ ID NO: 598424 - DNA, 16 bp, Homo sapiens
gactcgagagggctga

SEQ ID NO: 598425 - DNA, 24 bp, Homo sapiens
gactcgagagggctgagcccctcc

SEQ ID NO: 598426 - DNA, 18 bp, Homo sapiens
gactcgcgacaatgcaaa

SEQ ID NO: 598427 - DNA, 22 bp, Homo sapiens
gactctccatatgtgagcacta

SEQ ID NO: 598428 - DNA, 13 bp, Homo sapiens
gactctgaggtgt

SEQ ID NO: 598429 - DNA, 14 bp, Homo sapiens
gactctgtgagatt

SEQ ID NO: 598430 - DNA, 14 bp, Homo sapiens
gactgacactcaga

SEQ ID NO: 598431 - DNA, 22 bp, Homo sapiens
gactgaccttcggcagtggctg

SEQ ID NO: 598432 - DNA, 23 bp, Homo sapiens
gactgaccttcggcagtggctgg

SEQ ID NO: 598433 - DNA, 10 bp, Homo sapiens
gactgcccac

SEQ ID NO: 598434 - DNA, 15 bp, Homo sapiens
gactgcccaccctgg

SEQ ID NO: 598435 - DNA, 17 bp, Homo sapiens
gactgcccaccctgggc

SEQ ID NO: 598436 - DNA, 21 bp, Homo sapiens
gactgcccaccctgggcctcc

SEQ ID NO: 598437 - DNA, 17 bp, Homo sapiens
gactgctttcagtgcct

SEQ ID NO: 598438 - DNA, 19 bp, Homo sapiens
gactgctttcagtgcctgc

SEQ ID NO: 598439 - DNA, 22 bp, Homo sapiens
gactgctttcagtgcctgctgt

SEQ ID NO: 598440 - DNA, 14 bp, Homo sapiens
gactggcccacccc

SEQ ID NO: 598441 - DNA, 18 bp, Homo sapiens
gactgtcttcaaccctgc

SEQ ID NO: 598442 - DNA, 15 bp, Homo sapiens
gactgtggctgcaga

SEQ ID NO: 598443 - DNA, 21 bp, Homo sapiens
gactgtgttcagtgccttgga

SEQ ID NO: 598444 - DNA, 21 bp, Homo sapiens
gacttcagaaactttttctaa

SEQ ID NO: 598445 - DNA, 21 bp, Homo sapiens
gacttcccagctggcagcgcc

SEQ ID NO: 598446 - DNA, 18 bp, Homo sapiens
gacttcctattaatttat

SEQ ID NO: 598447 - DNA, 21 bp, Homo sapiens
gacttcctattaatttattaa

SEQ ID NO: 598448 - DNA, 21 bp, Homo sapiens
gacttctaaatcataatcatc

SEQ ID NO: 598449 - DNA, 22 bp, Homo sapiens
gagaaaatgctttctcatgcat

SEQ ID NO: 598450 - DNA, 15 bp, Homo sapiens
gagaaatttacaaaa

SEQ ID NO: 598451 - DNA, 11 bp, Homo sapiens
gagaagccata

SEQ ID NO: 598452 - DNA, 14 bp, Homo sapiens
gagaagcctgtctg

SEQ ID NO: 598453 - DNA, 17 bp, Homo sapiens
gagaaggattctttttt

SEQ ID NO: 598454 - DNA, 13 bp, Homo sapiens
gagaagggttctg

SEQ ID NO: 598455 - DNA, 18 bp, Homo sapiens
gagaagggttctgccctg

SEQ ID NO: 598456 - DNA, 20 bp, Homo sapiens
gagaagggttctgccctgcc

SEQ ID NO: 598457 - DNA, 22 bp, Homo sapiens
gagaagggttctgccctgcctg

SEQ ID NO: 598458 - DNA, 22 bp, Homo sapiens
gagaatgagggcgtgaaacaca

SEQ ID NO: 598459 - DNA, 15 bp, Homo sapiens
gagacaacacacaca

SEQ ID NO: 598460 - DNA, 16 bp, Homo sapiens
gagaccacttccttaa

SEQ ID NO: 598461 - DNA, 16 bp, Homo sapiens
gagaccagcctgccag

SEQ ID NO: 598462 - DNA, 16 bp, Homo sapiens
gagacggcagccccat

SEQ ID NO: 598463 - DNA, 19 bp, Homo sapiens
gagacggcagccccatcct

SEQ ID NO: 598464 - DNA, 16 bp, Homo sapiens
gagactcgcgacaatg

SEQ ID NO: 598465 - DNA, 12 bp, Homo sapiens
gagactctgagg

SEQ ID NO: 598466 - DNA, 15 bp, Homo sapiens
gagactctgaggtgt

SEQ ID NO: 598467 - DNA, 12 bp, Homo sapiens
gagactgcccac

SEQ ID NO: 598468 - DNA, 15 bp, Homo sapiens
gagactgcccaccct

SEQ ID NO: 598469 - DNA, 20 bp, Homo sapiens
gagactgcccaccctgggcc

SEQ ID NO: 598470 - DNA, 15 bp, Homo sapiens
gagagaaaggagggc

SEQ ID NO: 598471 - DNA, 22 bp, Homo sapiens
gagagagcaatcttgctgtgaa

SEQ ID NO: 598472 - DNA, 14 bp, Homo sapiens
gagagaggctgcct

SEQ ID NO: 598473 - DNA, 16 bp, Homo sapiens
gagagcagcaggtgct

SEQ ID NO: 598474 - DNA, 20 bp, Homo sapiens
gagagcagcaggtgctgtgc

SEQ ID NO: 598475 - DNA, 20 bp, Homo sapiens
gagaggaggtgtggagtgga

SEQ ID NO: 598476 - DNA, 14 bp, Homo sapiens
gagagggctgagcc

SEQ ID NO: 598477 - DNA, 16 bp, Homo sapiens
gagagggctgagcccc

SEQ ID NO: 598478 - DNA, 17 bp, Homo sapiens
gagagggctgagcccct

SEQ ID NO: 598479 - DNA, 22 bp, Homo sapiens
gagagggggatgcccctggccc

SEQ ID NO: 598480 - DNA, 22 bp, Homo sapiens
gagagggtgtgggtgccctgtt

SEQ ID NO: 598481 - DNA, 15 bp, Homo sapiens
gagagtggcaggtgg

SEQ ID NO: 598482 - DNA, 12 bp, Homo sapiens
gagataaatatc

SEQ ID NO: 598483 - DNA, 21 bp, Homo sapiens
gagatcataaagagcacgttt

SEQ ID NO: 598484 - DNA, 21 bp, Homo sapiens
gagatggggagggcgcttttg

SEQ ID NO: 598485 - DNA, 13 bp, Homo sapiens
gagcaacttgagt

SEQ ID NO: 598486 - DNA, 20 bp, Homo sapiens
gagcaaggcaagaagtggga

SEQ ID NO: 598487 - DNA, 18 bp, Homo sapiens
gagcacagccatagcaga

SEQ ID NO: 598488 - DNA, 18 bp, Homo sapiens
gagcacccccagcctccc

SEQ ID NO: 598489 - DNA, 20 bp, Homo sapiens
gagcactagaatgagaaatc

SEQ ID NO: 598490 - DNA, 22 bp, Homo sapiens
gagcactagaatgagaaatcat

SEQ ID NO: 598491 - DNA, 16 bp, Homo sapiens
gagcactgtatacccc

SEQ ID NO: 598492 - DNA, 20 bp, Homo sapiens
gagcagaaagccagggtcct

SEQ ID NO: 598493 - DNA, 19 bp, Homo sapiens
gagcagagacgaagacccc

SEQ ID NO: 598494 - DNA, 20 bp, Homo sapiens
gagcagagtcttgctacctc

SEQ ID NO: 598495 - DNA, 18 bp, Homo sapiens
gagcagatcgtgccgtgg

SEQ ID NO: 598496 - DNA, 23 bp, Homo sapiens
gagcagatcgtgccgtggagctt

SEQ ID NO: 598497 - DNA, 22 bp, Homo sapiens
gagcatgcccaaatataacatg

SEQ ID NO: 598498 - DNA, 18 bp, Homo sapiens
gagccacagtggggccca

SEQ ID NO: 598499 - DNA, 22 bp, Homo sapiens
gagccacagtggggcccatggc

SEQ ID NO: 598500 - DNA, 18 bp, Homo sapiens
gagccagatttcactctc

SEQ ID NO: 598501 - DNA, 19 bp, Homo sapiens
gagccagatttcactctcc

SEQ ID NO: 598502 - DNA, 12 bp, Homo sapiens
gagccagcagac

SEQ ID NO: 598503 - DNA, 15 bp, Homo sapiens
gagccagcagacatt

SEQ ID NO: 598504 - DNA, 17 bp, Homo sapiens
gagccagcagacattgt

SEQ ID NO: 598505 - DNA, 14 bp, Homo sapiens
gagccagggcagag

SEQ ID NO: 598506 - DNA, 20 bp, Homo sapiens
gagccagggcagaggaatgt

SEQ ID NO: 598507 - DNA, 17 bp, Homo sapiens
gagccccatcgcctggg

SEQ ID NO: 598508 - DNA, 17 bp, Homo sapiens
gagcccccgcccctccc

SEQ ID NO: 598509 - DNA, 18 bp, Homo sapiens
gagcccccgcccctcccc

SEQ ID NO: 598510 - DNA, 20 bp, Homo sapiens
gagcccccgcccctccccct

SEQ ID NO: 598511 - DNA, 14 bp, Homo sapiens
gagccccggagcac

SEQ ID NO: 598512 - DNA, 13 bp, Homo sapiens
gagcccctcctct

SEQ ID NO: 598513 - DNA, 13 bp, Homo sapiens
gagcccctgtttc

SEQ ID NO: 598514 - DNA, 17 bp, Homo sapiens
gagccctgccctcactc

SEQ ID NO: 598515 - DNA, 19 bp, Homo sapiens
gagccctgccctcactcca

SEQ ID NO: 598516 - DNA, 15 bp, Homo sapiens
gagccgcagaggccc

SEQ ID NO: 598517 - DNA, 23 bp, Homo sapiens
gagccgcagaggcccgaggcacc

SEQ ID NO: 598518 - DNA, 20 bp, Homo sapiens
gagcctgactgtgttcagtg

SEQ ID NO: 598519 - DNA, 13 bp, Homo sapiens
gagcctgcaggca

SEQ ID NO: 598520 - DNA, 13 bp, Homo sapiens
gagcctgggcagc

SEQ ID NO: 598521 - DNA, 11 bp, Homo sapiens
gagcctgtctc

SEQ ID NO: 598522 - DNA, 14 bp, Homo sapiens
gagccttgctgggc

SEQ ID NO: 598523 - DNA, 18 bp, Homo sapiens
gagccttgctgggccagg

SEQ ID NO: 598524 - DNA, 21 bp, Homo sapiens
gagcctttctccagcccatgc

SEQ ID NO: 598525 - DNA, 17 bp, Homo sapiens
gagcgatgtgttctttg

SEQ ID NO: 598526 - DNA, 14 bp, Homo sapiens
gagcgcagccccca

SEQ ID NO: 598527 - DNA, 15 bp, Homo sapiens
gagcgcagcccccac

SEQ ID NO: 598528 - DNA, 13 bp, Homo sapiens
gagcgccacccgc

SEQ ID NO: 598529 - DNA, 15 bp, Homo sapiens
gagcgcgtgccttcc

SEQ ID NO: 598530 - DNA, 17 bp, Homo sapiens
gagcgcgtgccttcccc

SEQ ID NO: 598531 - DNA, 23 bp, Homo sapiens
gagcggctgaggacggggcagag

SEQ ID NO: 598532 - DNA, 16 bp, Homo sapiens
gagcgtgtcctatccc

SEQ ID NO: 598533 - DNA, 22 bp, Homo sapiens
gagctatgcacaccaaattgct

SEQ ID NO: 598534 - DNA, 15 bp, Homo sapiens
gagctcaggagaagg

SEQ ID NO: 598535 - DNA, 18 bp, Homo sapiens
gagctgagtcggctgggc

SEQ ID NO: 598536 - DNA, 23 bp, Homo sapiens
gagctgagtcggctgggcagggc

SEQ ID NO: 598537 - DNA, 16 bp, Homo sapiens
gagctgggtatctcaa

SEQ ID NO: 598538 - DNA, 17 bp, Homo sapiens
gagcttccagtgcatgt

SEQ ID NO: 598539 - DNA, 18 bp, Homo sapiens
gagcttccagtgcatgtt

SEQ ID NO: 598540 - DNA, 22 bp, Homo sapiens
gagcttcccctaacctgggttg

SEQ ID NO: 598541 - DNA, 17 bp, Homo sapiens
gagcttggagccccctg

SEQ ID NO: 598542 - DNA, 18 bp, Homo sapiens
gagcttggagccccctgg

SEQ ID NO: 598543 - DNA, 21 bp, Homo sapiens
gagcttggagccccctggcgg

SEQ ID NO: 598544 - DNA, 16 bp, Homo sapiens
gaggaaaaggcttgag

SEQ ID NO: 598545 - DNA, 14 bp, Homo sapiens
gaggaatgtagggc

SEQ ID NO: 598546 - DNA, 17 bp, Homo sapiens
gaggaatgtagggcctg

SEQ ID NO: 598547 - DNA, 14 bp, Homo sapiens
gaggacacagcaca

SEQ ID NO: 598548 - DNA, 21 bp, Homo sapiens
gaggacacagcacaagggcac

SEQ ID NO: 598549 - DNA, 13 bp, Homo sapiens
gaggacccctgcc

SEQ ID NO: 598550 - DNA, 14 bp, Homo sapiens
gaggacccctgccc

SEQ ID NO: 598551 - DNA, 21 bp, Homo sapiens
gaggacggcttccccatcgcc

SEQ ID NO: 598552 - DNA, 17 bp, Homo sapiens
gaggacggggcagagct

SEQ ID NO: 598553 - DNA, 11 bp, Homo sapiens
gaggagcaccc

SEQ ID NO: 598554 - DNA, 13 bp, Homo sapiens
gaggagcaccccc

SEQ ID NO: 598555 - DNA, 16 bp, Homo sapiens
gaggagcacccccagc

SEQ ID NO: 598556 - DNA, 21 bp, Homo sapiens
gaggagcacccccagcctccc

SEQ ID NO: 598557 - DNA, 23 bp, Homo sapiens
gaggagcacccccagcctccccc

SEQ ID NO: 598558 - DNA, 19 bp, Homo sapiens
gaggagcttccagtgcatg

SEQ ID NO: 598559 - DNA, 15 bp, Homo sapiens
gaggaggacacagca

SEQ ID NO: 598560 - DNA, 13 bp, Homo sapiens
gaggaggaggagc

SEQ ID NO: 598561 - DNA, 18 bp, Homo sapiens
gaggaggccgactgggct

SEQ ID NO: 598562 - DNA, 16 bp, Homo sapiens
gaggcagaatggtggg

SEQ ID NO: 598563 - DNA, 13 bp, Homo sapiens
gaggcagggccct

SEQ ID NO: 598564 - DNA, 22 bp, Homo sapiens
gaggcatgtgatgagaggaaat

SEQ ID NO: 598565 - DNA, 13 bp, Homo sapiens
gaggcccccggag

SEQ ID NO: 598566 - DNA, 17 bp, Homo sapiens
gaggcccccggaggcgc

SEQ ID NO: 598567 - DNA, 16 bp, Homo sapiens
gaggccgactgggctg

SEQ ID NO: 598568 - DNA, 17 bp, Homo sapiens
gaggccgactgggctgc

SEQ ID NO: 598569 - DNA, 18 bp, Homo sapiens
gaggccgactgggctgct

SEQ ID NO: 598570 - DNA, 21 bp, Homo sapiens
gaggccgactgggctgctggg

SEQ ID NO: 598571 - DNA, 12 bp, Homo sapiens
gaggcctggtct

SEQ ID NO: 598572 - DNA, 17 bp, Homo sapiens
gaggcctttccccagtg

SEQ ID NO: 598573 - DNA, 19 bp, Homo sapiens
gaggcctttccccagtgtg

SEQ ID NO: 598574 - DNA, 13 bp, Homo sapiens
gaggcgcccacct

SEQ ID NO: 598575 - DNA, 14 bp, Homo sapiens
gaggcgcccacctg

SEQ ID NO: 598576 - DNA, 17 bp, Homo sapiens
gaggctcgtgcatgtaa

SEQ ID NO: 598577 - DNA, 20 bp, Homo sapiens
gaggctgctgccccctggct

SEQ ID NO: 598578 - DNA, 21 bp, Homo sapiens
gaggctgctgccccctggctt

SEQ ID NO: 598579 - DNA, 12 bp, Homo sapiens
gaggctggggga

SEQ ID NO: 598580 - DNA, 20 bp, Homo sapiens
gaggctttaagcgaggcaga

SEQ ID NO: 598581 - DNA, 15 bp, Homo sapiens
gagggaagcccaccc

SEQ ID NO: 598582 - DNA, 14 bp, Homo sapiens
gagggacacagagg

SEQ ID NO: 598583 - DNA, 16 bp, Homo sapiens
gagggacgagcagagc

SEQ ID NO: 598584 - DNA, 21 bp, Homo sapiens
gacacttttgccaatgaactc

SEQ ID NO: 598585 - DNA, 23 bp, Homo sapiens
gacacttttgccaatgaactctt

SEQ ID NO: 598586 - DNA, 12 bp, Homo sapiens
gacagacagacg

SEQ ID NO: 598587 - DNA, 14 bp, Homo sapiens
gaggtgtggagtgg

SEQ ID NO: 598588 - DNA, 17 bp, Homo sapiens
gaggtgtggagtggagg

SEQ ID NO: 598589 - DNA, 21 bp, Homo sapiens
gagtatggtgctgggtcctta

SEQ ID NO: 598590 - DNA, 12 bp, Homo sapiens
gagtcaggagaa

SEQ ID NO: 598591 - DNA, 22 bp, Homo sapiens
gagtcagtgcccatgtgtatgg

SEQ ID NO: 598592 - DNA, 21 bp, Homo sapiens
gagtccactttcctctctctc

SEQ ID NO: 598593 - DNA, 14 bp, Homo sapiens
gagtcggctgggca

SEQ ID NO: 598594 - DNA, 17 bp, Homo sapiens
gagtcggctgggcaggg

SEQ ID NO: 598595 - DNA, 18 bp, Homo sapiens
gagtcggctgggcagggc

SEQ ID NO: 598596 - DNA, 19 bp, Homo sapiens
gagtcggctgggcagggcc

SEQ ID NO: 598597 - DNA, 23 bp, Homo sapiens
gagtcggctgggcagggccgcag

SEQ ID NO: 598598 - DNA, 16 bp, Homo sapiens
gagtctgaaggagagg

SEQ ID NO: 598599 - DNA, 17 bp, Homo sapiens
gagtctgaaggagagga

SEQ ID NO: 598600 - DNA, 17 bp, Homo sapiens
gagtctgtcctttccca

SEQ ID NO: 598601 - DNA, 23 bp, Homo sapiens
gagtgacatgggtgtgccaggct

SEQ ID NO: 598602 - DNA, 20 bp, Homo sapiens
gagtgatttgtaaaacagtg

SEQ ID NO: 598603 - DNA, 22 bp, Homo sapiens
gagtggaccacgacctcgtcca

SEQ ID NO: 598604 - DNA, 19 bp, Homo sapiens
gagtggaggggtcagcagg

SEQ ID NO: 598605 - DNA, 17 bp, Homo sapiens
gagtggcaggtgggctg

SEQ ID NO: 598606 - DNA, 14 bp, Homo sapiens
gagtgtcaggctct

SEQ ID NO: 598607 - DNA, 20 bp, Homo sapiens
gagttattatagttattcaa

SEQ ID NO: 598608 - DNA, 17 bp, Homo sapiens
gagtttaatcttttcag

SEQ ID NO: 598609 - DNA, 19 bp, Homo sapiens
gataaatatcattatagca

SEQ ID NO: 598610 - DNA, 20 bp, Homo sapiens
gataacagagtgatttgtaa

SEQ ID NO: 598611 - DNA, 12 bp, Homo sapiens
gataattcttac

SEQ ID NO: 598612 - DNA, 12 bp, Homo sapiens
gataattgtaaa

SEQ ID NO: 598613 - DNA, 15 bp, Homo sapiens
gataccctctgagac

SEQ ID NO: 598614 - DNA, 21 bp, Homo sapiens
gataccctctgagacagagag

SEQ ID NO: 598615 - DNA, 14 bp, Homo sapiens
gataggagaggaaa

SEQ ID NO: 598616 - DNA, 17 bp, Homo sapiens
gataggagaggaaaagg

SEQ ID NO: 598617 - DNA, 16 bp, Homo sapiens
gataggagcttccaga

SEQ ID NO: 598618 - DNA, 13 bp, Homo sapiens
gatagtttattat

SEQ ID NO: 598619 - DNA, 15 bp, Homo sapiens
gatatcacgggcccg

SEQ ID NO: 598620 - DNA, 20 bp, Homo sapiens
gatatgagaaatataaaaat

SEQ ID NO: 598621 - DNA, 18 bp, Homo sapiens
gatatgtctttaaaatga

SEQ ID NO: 598622 - DNA, 20 bp, Homo sapiens
gatattggttctatttattt

SEQ ID NO: 598623 - DNA, 15 bp, Homo sapiens
gatattgtatctcct

SEQ ID NO: 598624 - DNA, 15 bp, Homo sapiens
gatcaaggagggaga

SEQ ID NO: 598625 - DNA, 21 bp, Homo sapiens
gatcacatgcccctcttagaa

SEQ ID NO: 598626 - DNA, 16 bp, Homo sapiens
gatccagagagaagca

SEQ ID NO: 598627 - DNA, 23 bp, Homo sapiens
gatccagagagaagcaccccacc

SEQ ID NO: 598628 - DNA, 13 bp, Homo sapiens
gatccagggatgg

SEQ ID NO: 598629 - DNA, 20 bp, Homo sapiens
gatccccatggaacagccct

SEQ ID NO: 598630 - DNA, 22 bp, Homo sapiens
gatccccatggaacagccctgc

SEQ ID NO: 598631 - DNA, 21 bp, Homo sapiens
gatcctccgcggaggcccctg

SEQ ID NO: 598632 - DNA, 22 bp, Homo sapiens
gatcctccgcggaggcccctga

SEQ ID NO: 598633 - DNA, 21 bp, Homo sapiens
gatcctgagccagatttcact

SEQ ID NO: 598634 - DNA, 16 bp, Homo sapiens
gatctcctgtgcacct

SEQ ID NO: 598635 - DNA, 13 bp, Homo sapiens
gatctggagtctg

SEQ ID NO: 598636 - DNA, 14 bp, Homo sapiens
gatctggagtctga

SEQ ID NO: 598637 - DNA, 17 bp, Homo sapiens
gatctggagtctgaagg

SEQ ID NO: 598638 - DNA, 14 bp, Homo sapiens
gatctgtccttcca

SEQ ID NO: 598639 - DNA, 20 bp, Homo sapiens
gatcttacacgaagaaatag

SEQ ID NO: 598640 - DNA, 17 bp, Homo sapiens
gatgaaaaagcatgtac

SEQ ID NO: 598641 - DNA, 22 bp, Homo sapiens
gatgacccccaggtattgtctt

SEQ ID NO: 598642 - DNA, 13 bp, Homo sapiens
gatgactggaaac

SEQ ID NO: 598643 - DNA, 14 bp, Homo sapiens
gatgagacaacaca

SEQ ID NO: 598644 - DNA, 17 bp, Homo sapiens
gatgagacaacacacac

SEQ ID NO: 598645 - DNA, 16 bp, Homo sapiens
gatgatttaattctta

SEQ ID NO: 598646 - DNA, 12 bp, Homo sapiens
gatgcatattaa

SEQ ID NO: 598647 - DNA, 16 bp, Homo sapiens
gatgcatgcagggccc

SEQ ID NO: 598648 - DNA, 21 bp, Homo sapiens
gatgcccctgcagtttggccc

SEQ ID NO: 598649 - DNA, 15 bp, Homo sapiens
gatgcccctggccct

SEQ ID NO: 598650 - DNA, 19 bp, Homo sapiens
gatgcccctggccctgcct

SEQ ID NO: 598651 - DNA, 22 bp, Homo sapiens
gatgcccctggccctgcctcac

SEQ ID NO: 598652 - DNA, 14 bp, Homo sapiens
gatgccgtgcgggc

SEQ ID NO: 598653 - DNA, 18 bp, Homo sapiens
gatgcgtggctcccagca

SEQ ID NO: 598654 - DNA, 16 bp, Homo sapiens
gatggagatgggaagg

SEQ ID NO: 598655 - DNA, 18 bp, Homo sapiens
gatggatttgacacactc

SEQ ID NO: 598656 - DNA, 21 bp, Homo sapiens
gatggccaggcctcagggacc

SEQ ID NO: 598657 - DNA, 23 bp, Homo sapiens
gatgggaaggttagaaaggcagc

SEQ ID NO: 598658 - DNA, 20 bp, Homo sapiens
gatggggcctgggctgttgt

SEQ ID NO: 598659 - DNA, 15 bp, Homo sapiens
gatgggtcctgctgc

SEQ ID NO: 598660 - DNA, 21 bp, Homo sapiens
gatgggttttgttaggggtgg

SEQ ID NO: 598661 - DNA, 12 bp, Homo sapiens
gatggtgcaatg

SEQ ID NO: 598662 - DNA, 20 bp, Homo sapiens
gatggtgcaatgacctttca

SEQ ID NO: 598663 - DNA, 17 bp, Homo sapiens
gatggtgtcctgcatgt

SEQ ID NO: 598664 - DNA, 17 bp, Homo sapiens
gatggttcgttctgttt

SEQ ID NO: 598665 - DNA, 14 bp, Homo sapiens
gatgtatgtgtata

SEQ ID NO: 598666 - DNA, 15 bp, Homo sapiens
gatgtatgtgtatat

SEQ ID NO: 598667 - DNA, 15 bp, Homo sapiens
gatgtattattatat

SEQ ID NO: 598668 - DNA, 22 bp, Homo sapiens
gatgtccaaacttaacagatca

SEQ ID NO: 598669 - DNA, 14 bp, Homo sapiens
gatgtttagtagct

SEQ ID NO: 598670 - DNA, 20 bp, Homo sapiens
gatgtttctatatgtaactt

SEQ ID NO: 598671 - DNA, 20 bp, Homo sapiens
gattaaactgggaaatgaga

SEQ ID NO: 598672 - DNA, 18 bp, Homo sapiens
gattaaattatcattgtt

SEQ ID NO: 598673 - DNA, 20 bp, Homo sapiens
gattaaattatcattgtttg

SEQ ID NO: 598674 - DNA, 18 bp, Homo sapiens
gattaagttataccagca

SEQ ID NO: 598675 - DNA, 20 bp, Homo sapiens
gattaagttataccagcaaa

SEQ ID NO: 598676 - DNA, 22 bp, Homo sapiens
gattaagttataccagcaaaag

SEQ ID NO: 598677 - DNA, 14 bp, Homo sapiens
gattacctgaaagc

SEQ ID NO: 598678 - DNA, 18 bp, Homo sapiens
gattatatacaaagctgt

SEQ ID NO: 598679 - DNA, 15 bp, Homo sapiens
gattattttctatat

SEQ ID NO: 598680 - DNA, 15 bp, Homo sapiens
gattcaggaatgggc

SEQ ID NO: 598681 - DNA, 21 bp, Homo sapiens
gattccaacccaggtctgctt

SEQ ID NO: 598682 - DNA, 18 bp, Homo sapiens
gattccagcagtgaatgc

SEQ ID NO: 598683 - DNA, 21 bp, Homo sapiens
gattcccgtggctttgtgctt

SEQ ID NO: 598684 - DNA, 22 bp, Homo sapiens
gattcccgtggctttgtgctta

SEQ ID NO: 598685 - DNA, 15 bp, Homo sapiens
gattctaaaggggac

SEQ ID NO: 598686 - DNA, 18 bp, Homo sapiens
gattctaaaggggacaga

SEQ ID NO: 598687 - DNA, 15 bp, Homo sapiens
gattctcctctccca

SEQ ID NO: 598688 - DNA, 16 bp, Homo sapiens
gattctttgatatgtt

SEQ ID NO: 598689 - DNA, 23 bp, Homo sapiens
gattctttgatatgttgatgaaa

SEQ ID NO: 598690 - DNA, 19 bp, Homo sapiens
gattcttttttcaatgtac

SEQ ID NO: 598691 - DNA, 19 bp, Homo sapiens
atgcctacattagtgagat

SEQ ID NO: 598692 - DNA, 12 bp, Homo sapiens
atgcctgcctga

SEQ ID NO: 598693 - DNA, 18 bp, Homo sapiens
atgcctgggcccaggccc

SEQ ID NO: 598694 - DNA, 20 bp, Homo sapiens
atgcctgggcccaggcccag

SEQ ID NO: 598695 - DNA, 21 bp, Homo sapiens
atgcctgggcccaggcccagc

SEQ ID NO: 598696 - DNA, 22 bp, Homo sapiens
atgccttcataaattatttcta

SEQ ID NO: 598697 - DNA, 22 bp, Homo sapiens
atgcctttctagcaattgcttc

SEQ ID NO: 598698 - DNA, 16 bp, Homo sapiens
atgcgatgtcatattt

SEQ ID NO: 598699 - DNA, 19 bp, Homo sapiens
atgctaacctctctgaact

SEQ ID NO: 598700 - DNA, 15 bp, Homo sapiens
atgctcaatgtgctg

SEQ ID NO: 598701 - DNA, 16 bp, Homo sapiens
atgctcaatgtgctgt

SEQ ID NO: 598702 - DNA, 14 bp, Homo sapiens
atgctccctcatgc

SEQ ID NO: 598703 - DNA, 22 bp, Homo sapiens
atgctggctggggccggggctg

SEQ ID NO: 598704 - DNA, 15 bp, Homo sapiens
atgctgtccctgtgg

SEQ ID NO: 598705 - DNA, 22 bp, Homo sapiens
atgcttgatggaattttttcct

SEQ ID NO: 598706 - DNA, 20 bp, Homo sapiens
atgctttctcatgcatagac

SEQ ID NO: 598707 - DNA, 23 bp, Homo sapiens
atgctttctcatgcatagacaag

SEQ ID NO: 598708 - DNA, 13 bp, Homo sapiens
atgctttctcctt

SEQ ID NO: 598709 - DNA, 14 bp, Homo sapiens
atgctttctccttt

SEQ ID NO: 598710 - DNA, 16 bp, Homo sapiens
atgctttgaaaatgtt

SEQ ID NO: 598711 - DNA, 18 bp, Homo sapiens
atgctttgaaaatgtttt

SEQ ID NO: 598712 - DNA, 14 bp, Homo sapiens
atgcttttctcatg

SEQ ID NO: 598713 - DNA, 21 bp, Homo sapiens
atggaaagggtgtggcttgga

SEQ ID NO: 598714 - DNA, 11 bp, Homo sapiens
atggaacactc

SEQ ID NO: 598715 - DNA, 16 bp, Homo sapiens
atggaacactctgaga

SEQ ID NO: 598716 - DNA, 18 bp, Homo sapiens
atggaacactctgagact

SEQ ID NO: 598717 - DNA, 22 bp, Homo sapiens
atggaactcagctgtctgtggc

SEQ ID NO: 598718 - DNA, 23 bp, Homo sapiens
atggaactcagctgtctgtggct

SEQ ID NO: 598719 - DNA, 15 bp, Homo sapiens
atggaagacaaatac

SEQ ID NO: 598720 - DNA, 16 bp, Homo sapiens
atggaagacaaataca

SEQ ID NO: 598721 - DNA, 17 bp, Homo sapiens
atggactcgattttacc

SEQ ID NO: 598722 - DNA, 15 bp, Homo sapiens
atggagaagggttct

SEQ ID NO: 598723 - DNA, 15 bp, Homo sapiens
atggagatgggaagg

SEQ ID NO: 598724 - DNA, 22 bp, Homo sapiens
atggatatttttaatttatgat

SEQ ID NO: 598725 - DNA, 14 bp, Homo sapiens
atggatgcagaaat

SEQ ID NO: 598726 - DNA, 16 bp, Homo sapiens
atggatgcagaaatga

SEQ ID NO: 598727 - DNA, 13 bp, Homo sapiens
atggatgtaatat

SEQ ID NO: 598728 - DNA, 23 bp, Homo sapiens
atggattgggtatcaaaatgaat

SEQ ID NO: 598729 - DNA, 16 bp, Homo sapiens
atggcatttagcacag

SEQ ID NO: 598730 - DNA, 20 bp, Homo sapiens
atggcatttagcacagtatt

SEQ ID NO: 598731 - DNA, 15 bp, Homo sapiens
atggccaagtgtaca

SEQ ID NO: 598732 - DNA, 16 bp, Homo sapiens
atggccaagtgtacat

SEQ ID NO: 598733 - DNA, 18 bp, Homo sapiens
atggccaggcctcaggga

SEQ ID NO: 598734 - DNA, 14 bp, Homo sapiens
atggccccagctgg

SEQ ID NO: 598735 - DNA, 17 bp, Homo sapiens
atggccccagctggctg

SEQ ID NO: 598736 - DNA, 20 bp, Homo sapiens
atggccccagctggctgggt

SEQ ID NO: 598737 - DNA, 20 bp, Homo sapiens
atggccgaagccccttggag

SEQ ID NO: 598738 - DNA, 13 bp, Homo sapiens
atggctctggcta

SEQ ID NO: 598739 - DNA, 19 bp, Homo sapiens
atggctgaagaaacacagc

SEQ ID NO: 598740 - DNA, 17 bp, Homo sapiens
atggctgttatctgtct

SEQ ID NO: 598741 - DNA, 20 bp, Homo sapiens
atggctgttatctgtcttta

SEQ ID NO: 598742 - DNA, 14 bp, Homo sapiens
atgggccaagccag

SEQ ID NO: 598743 - DNA, 16 bp, Homo sapiens
atgggccaagccaggg

SEQ ID NO: 598744 - DNA, 23 bp, Homo sapiens
atgggccaagccagggttccaga

SEQ ID NO: 598745 - DNA, 12 bp, Homo sapiens
atgggccagccc

SEQ ID NO: 598746 - DNA, 21 bp, Homo sapiens
atgggccctcagcgtctcccc

SEQ ID NO: 598747 - DNA, 17 bp, Homo sapiens
atggggggcgggccagg

SEQ ID NO: 598748 - DNA, 21 bp, Homo sapiens
atgggttttgttaggggtggg

SEQ ID NO: 598749 - DNA, 21 bp, Homo sapiens
atggtagaaactttggaagtt

SEQ ID NO: 598750 - DNA, 13 bp, Homo sapiens
atggtatatattt

SEQ ID NO: 598751 - DNA, 22 bp, Homo sapiens
atggtccgccacgaggagcttc

SEQ ID NO: 598752 - DNA, 19 bp, Homo sapiens
atggtgcaatgacctttca

SEQ ID NO: 598753 - DNA, 16 bp, Homo sapiens
atggtgcagtgaagaa

SEQ ID NO: 598754 - DNA, 17 bp, Homo sapiens
atggtgcagtgaagaaa

SEQ ID NO: 598755 - DNA, 12 bp, Homo sapiens
atggtgctgtgt

SEQ ID NO: 598756 - DNA, 15 bp, Homo sapiens
atggtgggctccaga

SEQ ID NO: 598757 - DNA, 20 bp, Homo sapiens
atggtgggctccagagtagg

SEQ ID NO: 598758 - DNA, 17 bp, Homo sapiens
atggtggtttcagaaag

SEQ ID NO: 598759 - DNA, 16 bp, Homo sapiens
atggttgcaaagtgtt

SEQ ID NO: 598760 - DNA, 13 bp, Homo sapiens
atgtaacttcaga

SEQ ID NO: 598761 - DNA, 15 bp, Homo sapiens
atgtaacttcagatg

SEQ ID NO: 598762 - DNA, 16 bp, Homo sapiens
atgtaacttcagatgt

SEQ ID NO: 598763 - DNA, 18 bp, Homo sapiens
atgtaacttcagatgttt

SEQ ID NO: 598764 - DNA, 19 bp, Homo sapiens
atgtaacttcagatgtttc

SEQ ID NO: 598765 - DNA, 21 bp, Homo sapiens
atgtaacttcagatgtttcca

SEQ ID NO: 598766 - DNA, 15 bp, Homo sapiens
atgtaaggcactgtc

SEQ ID NO: 598767 - DNA, 23 bp, Homo sapiens
atgtaaggcactgtcaggaatgg

SEQ ID NO: 598768 - DNA, 19 bp, Homo sapiens
atgtaatatagggtttgtt

SEQ ID NO: 598769 - DNA, 14 bp, Homo sapiens
atgtaatattaaat

SEQ ID NO: 598770 - DNA, 16 bp, Homo sapiens
atgtaatattaaattc

SEQ ID NO: 598771 - DNA, 13 bp, Homo sapiens
atgtacaaaatga

SEQ ID NO: 598772 - DNA, 18 bp, Homo sapiens
atgtacaggctgagacac

SEQ ID NO: 598773 - DNA, 14 bp, Homo sapiens
atgtacagtgttct

SEQ ID NO: 598774 - DNA, 20 bp, Homo sapiens
atgtacagtgttctgtttaa

SEQ ID NO: 598775 - DNA, 13 bp, Homo sapiens
atgtactgtattg

SEQ ID NO: 598776 - DNA, 16 bp, Homo sapiens
atgtatatatttatta

SEQ ID NO: 598777 - DNA, 22 bp, Homo sapiens
atgtatatctgtgtaagacacg

SEQ ID NO: 598778 - DNA, 14 bp, Homo sapiens
atgtatatttacca

SEQ ID NO: 598779 - DNA, 15 bp, Homo sapiens
atgtatgccatgtat

SEQ ID NO: 598780 - DNA, 12 bp, Homo sapiens
atgtatgtgtat

SEQ ID NO: 598781 - DNA, 17 bp, Homo sapiens
atgtatgtgtatatgtt

SEQ ID NO: 598782 - DNA, 19 bp, Homo sapiens
atgtattgtgtcttttgca

SEQ ID NO: 598783 - DNA, 15 bp, Homo sapiens
atgtcaaatggatgt

SEQ ID NO: 598784 - DNA, 21 bp, Homo sapiens
atgtcatattttcctttatgt

SEQ ID NO: 598785 - DNA, 16 bp, Homo sapiens
atgtcattttcagatc

SEQ ID NO: 598786 - DNA, 19 bp, Homo sapiens
atgtccaaacttaacagat

SEQ ID NO: 598787 - DNA, 17 bp, Homo sapiens
atgtcccattgataatt

SEQ ID NO: 598788 - DNA, 19 bp, Homo sapiens
atgtcggggcccctgcgtg

SEQ ID NO: 598789 - DNA, 19 bp, Homo sapiens
atgtctgtccctaaacata

SEQ ID NO: 598790 - DNA, 22 bp, Homo sapiens
atgtctgtccctaaacatagtg

SEQ ID NO: 598791 - DNA, 16 bp, Homo sapiens
atgtctttaaaatgat

SEQ ID NO: 598792 - DNA, 22 bp, Homo sapiens
atgtctttctccaaagttatcc

SEQ ID NO: 598793 - DNA, 19 bp, Homo sapiens
atgtctttggcttcagaat

SEQ ID NO: 598794 - DNA, 22 bp, Homo sapiens
atgtctttggcttcagaattgt

SEQ ID NO: 598795 - DNA, 13 bp, Homo sapiens
atgtgaaaatgct

SEQ ID NO: 598796 - DNA, 19 bp, Homo sapiens
atgtgaaaatgctttgaaa

SEQ ID NO: 598797 - DNA, 21 bp, Homo sapiens
atgtgaactttctcagcatat

SEQ ID NO: 598798 - DNA, 22 bp, Homo sapiens
atgtgagcactatctttcagga

SEQ ID NO: 598799 - DNA, 13 bp, Homo sapiens
atgtgatgtaact

SEQ ID NO: 598800 - DNA, 13 bp, Homo sapiens
atgtgatttatgc

SEQ ID NO: 598801 - DNA, 14 bp, Homo sapiens
atgtgatttatgca

SEQ ID NO: 598802 - DNA, 15 bp, Homo sapiens
atgtgcacggcagct

SEQ ID NO: 598803 - DNA, 22 bp, Homo sapiens
atgtgcacggcagcttgagcct

SEQ ID NO: 598804 - DNA, 15 bp, Homo sapiens
atgtgcatagataca

SEQ ID NO: 598805 - DNA, 14 bp, Homo sapiens
atgtgccccttccc

SEQ ID NO: 598806 - DNA, 23 bp, Homo sapiens
atgtgccgtctttggttcctcat

SEQ ID NO: 598807 - DNA, 15 bp, Homo sapiens
atgtgcgaacacagt

SEQ ID NO: 598808 - DNA, 19 bp, Homo sapiens
atgtgcgaacacagtgaca

SEQ ID NO: 598809 - DNA, 14 bp, Homo sapiens
atgtgctgctgtgg

SEQ ID NO: 598810 - DNA, 21 bp, Homo sapiens
atgtgctgttgattctttcaa

SEQ ID NO: 598811 - DNA, 15 bp, Homo sapiens
atgtggaattacata

SEQ ID NO: 598812 - DNA, 17 bp, Homo sapiens
atgtggaattacataac

SEQ ID NO: 598813 - DNA, 16 bp, Homo sapiens
atgtggggacagggct

SEQ ID NO: 598814 - DNA, 20 bp, Homo sapiens
atgtgtatatgtttatacac

SEQ ID NO: 598815 - DNA, 20 bp, Homo sapiens
atgtgtccgtgaaagttgtg

SEQ ID NO: 598816 - DNA, 16 bp, Homo sapiens
atgtgtcttgtattat

SEQ ID NO: 598817 - DNA, 18 bp, Homo sapiens
atgtgtgaaggtcttgcc

SEQ ID NO: 598818 - DNA, 22 bp, Homo sapiens
atgtgttgctctccattctttt

SEQ ID NO: 598819 - DNA, 13 bp, Homo sapiens
atgttaaaataat

SEQ ID NO: 598820 - DNA, 18 bp, Homo sapiens
atgttaaaataattatat

SEQ ID NO: 598821 - DNA, 11 bp, Homo sapiens
atgttaaatct

SEQ ID NO: 598822 - DNA, 13 bp, Homo sapiens
atgttaaatctac

SEQ ID NO: 598823 - DNA, 21 bp, Homo sapiens
atgttaatagaaaatatattt

SEQ ID NO: 598824 - DNA, 19 bp, Homo sapiens
atgttagatacacaaaata

SEQ ID NO: 598825 - DNA, 16 bp, Homo sapiens
atgttatcattcttat

SEQ ID NO: 598826 - DNA, 19 bp, Homo sapiens
atgttcacgcaacttgaaa

SEQ ID NO: 598827 - DNA, 18 bp, Homo sapiens
atgttccgttcatctgag

SEQ ID NO: 598828 - DNA, 22 bp, Homo sapiens
atgttccgttcatctgaggagt

SEQ ID NO: 598829 - DNA, 19 bp, Homo sapiens
atgttctatataatttttc

SEQ ID NO: 598830 - DNA, 15 bp, Homo sapiens
atgttctccatccca

SEQ ID NO: 598831 - DNA, 14 bp, Homo sapiens
atgttctgaaatgg

SEQ ID NO: 598832 - DNA, 12 bp, Homo sapiens
atgttcttgcag

SEQ ID NO: 598833 - DNA, 13 bp, Homo sapiens
atgttgatgaaat

SEQ ID NO: 598834 - DNA, 16 bp, Homo sapiens
atgttgatgaaattct

SEQ ID NO: 598835 - DNA, 18 bp, Homo sapiens
atgttgccatgaggcctt

SEQ ID NO: 598836 - DNA, 16 bp, Homo sapiens
atgttgtaatattttg

SEQ ID NO: 598837 - DNA, 16 bp, Homo sapiens
atgttgtcctgtgtca

SEQ ID NO: 598838 - DNA, 23 bp, Homo sapiens
atgttgtcctgtgtcatctgtca

SEQ ID NO: 598839 - DNA, 20 bp, Homo sapiens
atgttgtgttggtatttact

SEQ ID NO: 598840 - DNA, 21 bp, Homo sapiens
atgttgtgttggtatttactg

SEQ ID NO: 598841 - DNA, 19 bp, Homo sapiens
atgttgttcgatcgtttca

SEQ ID NO: 598842 - DNA, 18 bp, Homo sapiens
atgtttaataatatgtac

SEQ ID NO: 598843 - DNA, 21 bp, Homo sapiens
atgtttagtagctgataaaga

SEQ ID NO: 598844 - DNA, 14 bp, Homo sapiens
atgtttatacacac

SEQ ID NO: 598845 - DNA, 17 bp, Homo sapiens
atgtttatttttgctct

SEQ ID NO: 598846 - DNA, 15 bp, Homo sapiens
atgtttctatatgta

SEQ ID NO: 598847 - DNA, 17 bp, Homo sapiens
atgtttgcgaatggctt

SEQ ID NO: 598848 - DNA, 23 bp, Homo sapiens
atgttttacaaagaaacaaaata

SEQ ID NO: 598849 - DNA, 20 bp, Homo sapiens
atgttttagtttaaaaatca

SEQ ID NO: 598850 - DNA, 16 bp, Homo sapiens
atgttttatatgatta

SEQ ID NO: 598851 - DNA, 17 bp, Homo sapiens
atgttttggagagagca

SEQ ID NO: 598852 - DNA, 18 bp, Homo sapiens
atgtttttaagtgctatg

SEQ ID NO: 598853 - DNA, 15 bp, Homo sapiens
attaaaaagttaatc

SEQ ID NO: 598854 - DNA, 17 bp, Homo sapiens
attaaaaagttaatctt

SEQ ID NO: 598855 - DNA, 14 bp, Homo sapiens
attaaaaataagcc

SEQ ID NO: 598856 - DNA, 17 bp, Homo sapiens
attaaaaataagccaaa

SEQ ID NO: 598857 - DNA, 21 bp, Homo sapiens
attaaaatattttcttaatta

SEQ ID NO: 598858 - DNA, 15 bp, Homo sapiens
attaaaatcttgaaa

SEQ ID NO: 598859 - DNA, 17 bp, Homo sapiens
attaaactgggaaatga

SEQ ID NO: 598860 - DNA, 16 bp, Homo sapiens
attaaagaaagtcata

SEQ ID NO: 598861 - DNA, 18 bp, Homo sapiens
attaaagtctgagaaatt

SEQ ID NO: 598862 - DNA, 14 bp, Homo sapiens
attaaatgaaatac

SEQ ID NO: 598863 - DNA, 23 bp, Homo sapiens
attaaatgaaatacttgacaaca

SEQ ID NO: 598864 - DNA, 16 bp, Homo sapiens
attaaattatcattgt

SEQ ID NO: 598865 - DNA, 12 bp, Homo sapiens
attaaatttatt

SEQ ID NO: 598866 - DNA, 13 bp, Homo sapiens
attaaatttatta

SEQ ID NO: 598867 - DNA, 18 bp, Homo sapiens
attaacttctattttcaa

SEQ ID NO: 598868 - DNA, 17 bp, Homo sapiens
attaagcacacacatct

SEQ ID NO: 598869 - DNA, 15 bp, Homo sapiens
attaaggactacaga

SEQ ID NO: 598870 - DNA, 17 bp, Homo sapiens
attaaggactacagaat

SEQ ID NO: 598871 - DNA, 13 bp, Homo sapiens
attaataacagaa

SEQ ID NO: 598872 - DNA, 19 bp, Homo sapiens
attaataacagaaatacat

SEQ ID NO: 598873 - DNA, 23 bp, Homo sapiens
attaatgtagggcagaatagctg

SEQ ID NO: 598874 - DNA, 11 bp, Homo sapiens
attaattgagg

SEQ ID NO: 598875 - DNA, 17 bp, Homo sapiens
attaattggcagcagat

SEQ ID NO: 598876 - DNA, 21 bp, Homo sapiens
attaattggcagcagatttta

SEQ ID NO: 598877 - DNA, 19 bp, Homo sapiens
attaatttattaaatttat

SEQ ID NO: 598878 - DNA, 18 bp, Homo sapiens
attaatttttcaatttct

SEQ ID NO: 598879 - DNA, 22 bp, Homo sapiens
attaatttttttattgtttaaa

SEQ ID NO: 598880 - DNA, 23 bp, Homo sapiens
attacaacaagcaaactgaaatt

SEQ ID NO: 598881 - DNA, 15 bp, Homo sapiens
attacagttcacact

SEQ ID NO: 598882 - DNA, 20 bp, Homo sapiens
attacataacaggcattgca

SEQ ID NO: 598883 - DNA, 14 bp, Homo sapiens
ccagtcttctagtg

SEQ ID NO: 598884 - DNA, 21 bp, Homo sapiens
ccagtcttgagtgggccccct

SEQ ID NO: 598885 - DNA, 22 bp, Homo sapiens
ccagtcttgagtgggccccctc

SEQ ID NO: 598886 - DNA, 23 bp, Homo sapiens
ccagtcttgagtgggccccctct

SEQ ID NO: 598887 - DNA, 20 bp, Homo sapiens
ccagtgcatgttgccatgag

SEQ ID NO: 598888 - DNA, 14 bp, Homo sapiens
ccagtggcacagga

SEQ ID NO: 598889 - DNA, 20 bp, Homo sapiens
ccagtggggtcccccctgag

SEQ ID NO: 598890 - DNA, 18 bp, Homo sapiens
ccagtgtattttctgtgt

SEQ ID NO: 598891 - DNA, 19 bp, Homo sapiens
ccagtgtattttctgtgtt

SEQ ID NO: 598892 - DNA, 20 bp, Homo sapiens
ccagtgtggccccagcccga

SEQ ID NO: 598893 - DNA, 21 bp, Homo sapiens
ccagtgtttagaagagcctga

SEQ ID NO: 598894 - DNA, 17 bp, Homo sapiens
ccagttaatgtgccaaa

SEQ ID NO: 598895 - DNA, 16 bp, Homo sapiens
ccagttagcccggcca

SEQ ID NO: 598896 - DNA, 21 bp, Homo sapiens
ccagttagcccggccaaggac

SEQ ID NO: 598897 - DNA, 17 bp, Homo sapiens
ccagttccctcagccct

SEQ ID NO: 598898 - DNA, 13 bp, Homo sapiens
ccagttctgatga

SEQ ID NO: 598899 - DNA, 14 bp, Homo sapiens
ccagttctgatgag

SEQ ID NO: 598900 - DNA, 19 bp, Homo sapiens
ccataaagaagatgtttaa

SEQ ID NO: 598901 - DNA, 20 bp, Homo sapiens
ccataaagaagatgtttaac

SEQ ID NO: 598902 - DNA, 17 bp, Homo sapiens
ccatactgtttaatatt

SEQ ID NO: 598903 - DNA, 14 bp, Homo sapiens
ccatatcagctctg

SEQ ID NO: 598904 - DNA, 17 bp, Homo sapiens
ccatcattgaaatcttt

SEQ ID NO: 598905 - DNA, 13 bp, Homo sapiens
ccatcccactgat

SEQ ID NO: 598906 - DNA, 15 bp, Homo sapiens
ccatcccctgcctct

SEQ ID NO: 598907 - DNA, 12 bp, Homo sapiens
ccatccttcccg

SEQ ID NO: 598908 - DNA, 16 bp, Homo sapiens
ccatccttcccgcagc

SEQ ID NO: 598909 - DNA, 13 bp, Homo sapiens
ccatccttgctgc

SEQ ID NO: 598910 - DNA, 14 bp, Homo sapiens
ccatcgatttgtat

SEQ ID NO: 598911 - DNA, 18 bp, Homo sapiens
ccatctcctcccatggcc

SEQ ID NO: 598912 - DNA, 23 bp, Homo sapiens
ccatcttgggattcctcccctgg

SEQ ID NO: 598913 - DNA, 16 bp, Homo sapiens
ccatcttgtggggcca

SEQ ID NO: 598914 - DNA, 19 bp, Homo sapiens
ccatcttgtggggccagga

SEQ ID NO: 598915 - DNA, 16 bp, Homo sapiens
ccatgcaattaaaagg

SEQ ID NO: 598916 - DNA, 19 bp, Homo sapiens
ccatgcccacgcccctccc

SEQ ID NO: 598917 - DNA, 16 bp, Homo sapiens
ccatgccccagctctg

SEQ ID NO: 598918 - DNA, 11 bp, Homo sapiens
ccatgccctcc

SEQ ID NO: 598919 - DNA, 14 bp, Homo sapiens
ccatgccctccctg

SEQ ID NO: 598920 - DNA, 13 bp, Homo sapiens
ccatgctgggctc

SEQ ID NO: 598921 - DNA, 14 bp, Homo sapiens
ccatgctgggctca

SEQ ID NO: 598922 - DNA, 17 bp, Homo sapiens
ccatgctgggctcacta

SEQ ID NO: 598923 - DNA, 12 bp, Homo sapiens
ccatggaacagc

SEQ ID NO: 598924 - DNA, 18 bp, Homo sapiens
ccatggaacagccctgca

SEQ ID NO: 598925 - DNA, 13 bp, Homo sapiens
ccatggccccagc

SEQ ID NO: 598926 - DNA, 21 bp, Homo sapiens
ccatggccccagctggctggg

SEQ ID NO: 598927 - DNA, 21 bp, Homo sapiens
ccatggccttccctccccaca

SEQ ID NO: 598928 - DNA, 14 bp, Homo sapiens
ccatgggccctcag

SEQ ID NO: 598929 - DNA, 16 bp, Homo sapiens
ccatgggccctcagcg

SEQ ID NO: 598930 - DNA, 18 bp, Homo sapiens
ccatggtagactgtgaca

SEQ ID NO: 598931 - DNA, 22 bp, Homo sapiens
ccatggtgaactgaagcagagt

SEQ ID NO: 598932 - DNA, 17 bp, Homo sapiens
ccatggtggtttcagaa

SEQ ID NO: 598933 - DNA, 21 bp, Homo sapiens
ccatgtctttctccaaagtta

SEQ ID NO: 598934 - DNA, 17 bp, Homo sapiens
ccattcactttcaggaa

SEQ ID NO: 598935 - DNA, 13 bp, Homo sapiens
ccattcagtgaca

SEQ ID NO: 598936 - DNA, 17 bp, Homo sapiens
ccattcagtgacatgtc

SEQ ID NO: 598937 - DNA, 16 bp, Homo sapiens
ccattcatttacaact

SEQ ID NO: 598938 - DNA, 20 bp, Homo sapiens
ccattgaacactgcaccctc

SEQ ID NO: 598939 - DNA, 15 bp, Homo sapiens
ccattgacatgtaca

SEQ ID NO: 598940 - DNA, 16 bp, Homo sapiens
ccattgacatgtacag

SEQ ID NO: 598941 - DNA, 23 bp, Homo sapiens
ccattgcacttcggataattttc

SEQ ID NO: 598942 - DNA, 22 bp, Homo sapiens
ccattgtgaatgttgtcctgtg

SEQ ID NO: 598943 - DNA, 16 bp, Homo sapiens
ccatttaatcatttcc

SEQ ID NO: 598944 - DNA, 21 bp, Homo sapiens
ccatttaatcatttccagcaa

SEQ ID NO: 598945 - DNA, 18 bp, Homo sapiens
ccatttagtcctcacctt

SEQ ID NO: 598946 - DNA, 14 bp, Homo sapiens
ccatttcccctgtg

SEQ ID NO: 598947 - DNA, 17 bp, Homo sapiens
ccatttggattttaaac

SEQ ID NO: 598948 - DNA, 12 bp, Homo sapiens
ccattttagaag

SEQ ID NO: 598949 - DNA, 21 bp, Homo sapiens
ccattttgtctggctgtggcc

SEQ ID NO: 598950 - DNA, 19 bp, Homo sapiens
cccaacccccacctcccgg

SEQ ID NO: 598951 - DNA, 20 bp, Homo sapiens
cccaacctcccctggtcctg

SEQ ID NO: 598952 - DNA, 23 bp, Homo sapiens
cccaaggtggtcttggagaggag

SEQ ID NO: 598953 - DNA, 21 bp, Homo sapiens
cccacaaggcccagccctggg

SEQ ID NO: 598954 - DNA, 17 bp, Homo sapiens
cccacaccccgtctgcc

SEQ ID NO: 598955 - DNA, 21 bp, Homo sapiens
cccacacgccggggctggccc

SEQ ID NO: 598956 - DNA, 22 bp, Homo sapiens
cccacacgccggggctggccct

SEQ ID NO: 598957 - DNA, 17 bp, Homo sapiens
cccacaggagcgtgtcc

SEQ ID NO: 598958 - DNA, 22 bp, Homo sapiens
cccacagtcctcacagcctctc

SEQ ID NO: 598959 - DNA, 14 bp, Homo sapiens
cccacataaacact

SEQ ID NO: 598960 - DNA, 22 bp, Homo sapiens
cccacataaacacttctcctta

SEQ ID NO: 598961 - DNA, 20 bp, Homo sapiens
cccacatttgggctcagggt

SEQ ID NO: 598962 - DNA, 15 bp, Homo sapiens
cccaccacacacacc

SEQ ID NO: 598963 - DNA, 17 bp, Homo sapiens
cccaccacacacaccct

SEQ ID NO: 598964 - DNA, 14 bp, Homo sapiens
cccacccagcagcg

SEQ ID NO: 598965 - DNA, 18 bp, Homo sapiens
cccacccccagcagctca

SEQ ID NO: 598966 - DNA, 14 bp, Homo sapiens
cccacccccgtcac

SEQ ID NO: 598967 - DNA, 15 bp, Homo sapiens
cccacccctcttccc

SEQ ID NO: 598968 - DNA, 18 bp, Homo sapiens
cccacccctcttccccct

SEQ ID NO: 598969 - DNA, 15 bp, Homo sapiens
cccacccgccccaga

SEQ ID NO: 598970 - DNA, 20 bp, Homo sapiens
cccacccgtgttctcctcca

SEQ ID NO: 598971 - DNA, 21 bp, Homo sapiens
cccacctaaagggaagccctg

SEQ ID NO: 598972 - DNA, 22 bp, Homo sapiens
cccacctctccccaccttaccc

SEQ ID NO: 598973 - DNA, 14 bp, Homo sapiens
cccacgcagagccc

SEQ ID NO: 598974 - DNA, 16 bp, Homo sapiens
cccacgcagagccccg

SEQ ID NO: 598975 - DNA, 17 bp, Homo sapiens
cccacgcagagccccgg

SEQ ID NO: 598976 - DNA, 16 bp, Homo sapiens
cccacgtgcagcacct

SEQ ID NO: 598977 - DNA, 18 bp, Homo sapiens
cccacgtgcagcacctgt

SEQ ID NO: 598978 - DNA, 19 bp, Homo sapiens
cccacgtgcagcacctgtc

SEQ ID NO: 598979 - DNA, 19 bp, Homo sapiens
cccactagccctctttctc

SEQ ID NO: 598980 - DNA, 12 bp, Homo sapiens
cccactcccgtg

SEQ ID NO: 598981 - DNA, 16 bp, Homo sapiens
cccactgcccctgcac

SEQ ID NO: 598982 - DNA, 17 bp, Homo sapiens
cccagaacgcatgcagg

SEQ ID NO: 598983 - DNA, 13 bp, Homo sapiens
cccagaacgggcc

SEQ ID NO: 598984 - DNA, 16 bp, Homo sapiens
cccagagactgcccac

SEQ ID NO: 598985 - DNA, 18 bp, Homo sapiens
cccagagactgcccaccc

SEQ ID NO: 598986 - DNA, 20 bp, Homo sapiens
cccagagactgcccaccctg

SEQ ID NO: 598987 - DNA, 18 bp, Homo sapiens
cccagagccactaccttt

SEQ ID NO: 598988 - DNA, 16 bp, Homo sapiens
cccagagccctgcagt

SEQ ID NO: 598989 - DNA, 22 bp, Homo sapiens
cccagcacctcctccgtgggca

SEQ ID NO: 598990 - DNA, 14 bp, Homo sapiens
cccagccaagcctg

SEQ ID NO: 598991 - DNA, 17 bp, Homo sapiens
cccagcctatctctctt

SEQ ID NO: 598992 - DNA, 11 bp, Homo sapiens
cccagcctccc

SEQ ID NO: 598993 - DNA, 18 bp, Homo sapiens
cccagcctcccccaggct

SEQ ID NO: 598994 - DNA, 19 bp, Homo sapiens
cccagcctcccccaggctg

SEQ ID NO: 598995 - DNA, 18 bp, Homo sapiens
cccagcgcatggcgcccc

SEQ ID NO: 598996 - DNA, 19 bp, Homo sapiens
cccagctgattagtgtcta

SEQ ID NO: 598997 - DNA, 15 bp, Homo sapiens
ccctcttcccccttc

SEQ ID NO: 598998 - DNA, 17 bp, Homo sapiens
ccctcttctcagctcca

SEQ ID NO: 598999 - DNA, 23 bp, Homo sapiens
ccctctttctttcttttgtgttg

SEQ ID NO: 599000 - DNA, 15 bp, Homo sapiens
ccctgaacactcatc

SEQ ID NO: 599001 - DNA, 14 bp, Homo sapiens
ccctgacttcccag

SEQ ID NO: 599002 - DNA, 13 bp, Homo sapiens
ccctgacttctgg

SEQ ID NO: 599003 - DNA, 23 bp, Homo sapiens
ccctgagcagatcgtgccgtgga

SEQ ID NO: 599004 - DNA, 12 bp, Homo sapiens
ccctgagcctga

SEQ ID NO: 599005 - DNA, 17 bp, Homo sapiens
ccctgagggacgagcag

SEQ ID NO: 599006 - DNA, 13 bp, Homo sapiens
ccctgagggccct

SEQ ID NO: 599007 - DNA, 16 bp, Homo sapiens
ccctgagggcccttcc

SEQ ID NO: 599008 - DNA, 23 bp, Homo sapiens
ccctgagggcccttcccaacctc

SEQ ID NO: 599009 - DNA, 18 bp, Homo sapiens
ccctgagtgggctgggcc

SEQ ID NO: 599010 - DNA, 22 bp, Homo sapiens
agaattgggcccttagaatgtg

SEQ ID NO: 599011 - DNA, 14 bp, Homo sapiens
agacaaatacacat

SEQ ID NO: 599012 - DNA, 14 bp, Homo sapiens
agacaacacacaca

SEQ ID NO: 599013 - DNA, 20 bp, Homo sapiens
agacaatgtggaattacata

SEQ ID NO: 599014 - DNA, 20 bp, Homo sapiens
agacacacacatatatacat

SEQ ID NO: 599015 - DNA, 16 bp, Homo sapiens
agacacagcccagaga

SEQ ID NO: 599016 - DNA, 15 bp, Homo sapiens
agacacttttaccga

SEQ ID NO: 599017 - DNA, 24 bp, Homo sapiens
agacagacggacgggacagcggcc

SEQ ID NO: 599018 - DNA, 16 bp, Homo sapiens
agacagaggtttcatt

SEQ ID NO: 599019 - DNA, 14 bp, Homo sapiens
agacagagtggatc

SEQ ID NO: 599020 - DNA, 17 bp, Homo sapiens
agacagggcgtcctctc

SEQ ID NO: 599021 - DNA, 13 bp, Homo sapiens
agacagggtgggg

SEQ ID NO: 599022 - DNA, 14 bp, Homo sapiens
agacagggtggggc

SEQ ID NO: 599023 - DNA, 13 bp, Homo sapiens
agacattgtcagc

SEQ ID NO: 599024 - DNA, 19 bp, Homo sapiens
agaccacgcccctgcctga

SEQ ID NO: 599025 - DNA, 14 bp, Homo sapiens
agaccacttcctta

SEQ ID NO: 599026 - DNA, 16 bp, Homo sapiens
agaccacttccttaac

SEQ ID NO: 599027 - DNA, 19 bp, Homo sapiens
agaccacttccttaacagc

SEQ ID NO: 599028 - DNA, 18 bp, Homo sapiens
agaccagcatagttctgc

SEQ ID NO: 599029 - DNA, 23 bp, Homo sapiens
agaccagcatagttctgcaataa

SEQ ID NO: 599030 - DNA, 13 bp, Homo sapiens
agaccagcctgcc

SEQ ID NO: 599031 - DNA, 18 bp, Homo sapiens
agaccagcctgccaggcc

SEQ ID NO: 599032 - DNA, 18 bp, Homo sapiens
agaccatgcattcagatc

SEQ ID NO: 599033 - DNA, 17 bp, Homo sapiens
agacccctaccctttcc

SEQ ID NO: 599034 - DNA, 19 bp, Homo sapiens
agacccctaccctttccca

SEQ ID NO: 599035 - DNA, 14 bp, Homo sapiens
agaccctatctccc

SEQ ID NO: 599036 - DNA, 20 bp, Homo sapiens
agaccctgcgcccctgccca

SEQ ID NO: 599037 - DNA, 21 bp, Homo sapiens
agaccctgcgcccctgcccag

SEQ ID NO: 599038 - DNA, 13 bp, Homo sapiens
agaccctgtcttt

SEQ ID NO: 599039 - DNA, 16 bp, Homo sapiens
agaccctgtctttgct

SEQ ID NO: 599040 - DNA, 14 bp, Homo sapiens
agaccggggtggag

SEQ ID NO: 599041 - DNA, 23 bp, Homo sapiens
agaccggggtggagtcagggctg

SEQ ID NO: 599042 - DNA, 20 bp, Homo sapiens
agaccgtggtgtcctctgtc

SEQ ID NO: 599043 - DNA, 23 bp, Homo sapiens
agacctccagattattttctata

SEQ ID NO: 599044 - DNA, 18 bp, Homo sapiens
agacctcctgatgtcttg

SEQ ID NO: 599045 - DNA, 16 bp, Homo sapiens
agacctcggctgtgtg

SEQ ID NO: 599046 - DNA, 17 bp, Homo sapiens
agaccttgcgaccatgt

SEQ ID NO: 599047 - DNA, 20 bp, Homo sapiens
agacgcaagaggtttcagca

SEQ ID NO: 599048 - DNA, 20 bp, Homo sapiens
agacggacgggacagcggcc

SEQ ID NO: 599049 - DNA, 14 bp, Homo sapiens
agacggcagcccca

SEQ ID NO: 599050 - DNA, 14 bp, Homo sapiens
agactaacttattt

SEQ ID NO: 599051 - DNA, 18 bp, Homo sapiens
agactaacttattttgat

SEQ ID NO: 599052 - DNA, 21 bp, Homo sapiens
agactcaaggcctccagccac

SEQ ID NO: 599053 - DNA, 12 bp, Homo sapiens
agactcaatcat

SEQ ID NO: 599054 - DNA, 23 bp, Homo sapiens
agactcagtatgctttccctgag

SEQ ID NO: 599055 - DNA, 16 bp, Homo sapiens
agactccaaggagcta

SEQ ID NO: 599056 - DNA, 19 bp, Homo sapiens
agactcgagagggctgagc

SEQ ID NO: 599057 - DNA, 17 bp, Homo sapiens
agactcgcgacaatgca

SEQ ID NO: 599058 - DNA, 18 bp, Homo sapiens
agactcgcgacaatgcaa

SEQ ID NO: 599059 - DNA, 22 bp, Homo sapiens
agactctaaaactatcagcagc

SEQ ID NO: 599060 - DNA, 21 bp, Homo sapiens
agactgagcttgattctaaag

SEQ ID NO: 599061 - DNA, 14 bp, Homo sapiens
agactgcccaccct

SEQ ID NO: 599062 - DNA, 23 bp, Homo sapiens
agactgcccaccctgggcctccc

SEQ ID NO: 599063 - DNA, 23 bp, Homo sapiens
agactgccttatattattttctg

SEQ ID NO: 599064 - DNA, 15 bp, Homo sapiens
agacttcatttaaca

SEQ ID NO: 599065 - DNA, 20 bp, Homo sapiens
agacttcctattaatttatt

SEQ ID NO: 599066 - DNA, 14 bp, Homo sapiens
agacttctaaatca

SEQ ID NO: 599067 - DNA, 16 bp, Homo sapiens
agacttctaaatcata

SEQ ID NO: 599068 - DNA, 14 bp, Homo sapiens
agagaaaaagccct

SEQ ID NO: 599069 - DNA, 19 bp, Homo sapiens
agagaaaatgctttctcat

SEQ ID NO: 599070 - DNA, 12 bp, Homo sapiens
agagaaatgaaa

SEQ ID NO: 599071 - DNA, 19 bp, Homo sapiens
agagaagaaatagcagagc

SEQ ID NO: 599072 - DNA, 19 bp, Homo sapiens
agagaccaccgcgcccctc

SEQ ID NO: 599073 - DNA, 21 bp, Homo sapiens
agagaccaccgcgcccctctg

SEQ ID NO: 599074 - DNA, 13 bp, Homo sapiens
agagaccacttcc

SEQ ID NO: 599075 - DNA, 23 bp, Homo sapiens
agagaccacttccttaacagctg

SEQ ID NO: 599076 - DNA, 13 bp, Homo sapiens
agagacggcagcc

SEQ ID NO: 599077 - DNA, 15 bp, Homo sapiens
agagactgcccaccc

SEQ ID NO: 599078 - DNA, 21 bp, Homo sapiens
agagactgcccaccctgggcc

SEQ ID NO: 599079 - DNA, 22 bp, Homo sapiens
agagactgcccaccctgggcct

SEQ ID NO: 599080 - DNA, 14 bp, Homo sapiens
agagagaggctgcc

SEQ ID NO: 599081 - DNA, 15 bp, Homo sapiens
agagagaggctgcct

SEQ ID NO: 599082 - DNA, 16 bp, Homo sapiens
agagagtatggtgctg

SEQ ID NO: 599083 - DNA, 15 bp, Homo sapiens
agagataccctctga

SEQ ID NO: 599084 - DNA, 17 bp, Homo sapiens
agagatgttttgttgat

SEQ ID NO: 599085 - DNA, 14 bp, Homo sapiens
agagattttatgtt

SEQ ID NO: 599086 - DNA, 14 bp, Homo sapiens
agagcattctgggg

SEQ ID NO: 599087 - DNA, 10 bp, Homo sapiens
agagccacaa

SEQ ID NO: 599088 - DNA, 12 bp, Homo sapiens
agagccccggag

SEQ ID NO: 599089 - DNA, 15 bp, Homo sapiens
agagccctgcagtca

SEQ ID NO: 599090 - DNA, 16 bp, Homo sapiens
agagcctatggaaagg

SEQ ID NO: 599091 - DNA, 20 bp, Homo sapiens
agagcctatggaaagggtgt

SEQ ID NO: 599092 - DNA, 13 bp, Homo sapiens
agagcctgactgt

SEQ ID NO: 599093 - DNA, 18 bp, Homo sapiens
agagcctgactgtgttca

SEQ ID NO: 599094 - DNA, 23 bp, Homo sapiens
agagcctttctccagcccatgct

SEQ ID NO: 599095 - DNA, 13 bp, Homo sapiens
agagcgcagcccc

SEQ ID NO: 599096 - DNA, 14 bp, Homo sapiens
agagcgcagccccc

SEQ ID NO: 599097 - DNA, 15 bp, Homo sapiens
agagcgccacccgcc

SEQ ID NO: 599098 - DNA, 23 bp, Homo sapiens
agagctaggcccccaaattgcct

SEQ ID NO: 599099 - DNA, 17 bp, Homo sapiens
agagctatgcacaccaa

SEQ ID NO: 599100 - DNA, 19 bp, Homo sapiens
cattgtcagaatgttgtgt

SEQ ID NO: 599101 - DNA, 15 bp, Homo sapiens
cattgtgaatgttgt

SEQ ID NO: 599102 - DNA, 20 bp, Homo sapiens
cattgtgaatgttgtcctgt

SEQ ID NO: 599103 - DNA, 21 bp, Homo sapiens
cattgtgaatgttgtcctgtg

SEQ ID NO: 599104 - DNA, 20 bp, Homo sapiens
cattgttcagaaaagcacct

SEQ ID NO: 599105 - DNA, 22 bp, Homo sapiens
cattgttcagaaaagcacctct

SEQ ID NO: 599106 - DNA, 17 bp, Homo sapiens
catttaacactgagtga

SEQ ID NO: 599107 - DNA, 21 bp, Homo sapiens
catttaacactgagtgaaata

SEQ ID NO: 599108 - DNA, 12 bp, Homo sapiens
catttaatcatt

SEQ ID NO: 599109 - DNA, 15 bp, Homo sapiens
catttagcacagtat

SEQ ID NO: 599110 - DNA, 19 bp, Homo sapiens
catttagcatgagttctgc

SEQ ID NO: 599111 - DNA, 20 bp, Homo sapiens
catttagcatgagttctgca

SEQ ID NO: 599112 - DNA, 14 bp, Homo sapiens
catttatgcatgag

SEQ ID NO: 599113 - DNA, 15 bp, Homo sapiens
catttatgcatgaga

SEQ ID NO: 599114 - DNA, 17 bp, Homo sapiens
catttatgcatgagaac

SEQ ID NO: 599115 - DNA, 23 bp, Homo sapiens
catttatgcatgagaactaaata

SEQ ID NO: 599116 - DNA, 22 bp, Homo sapiens
catttatgtgtgaagcaaattt

SEQ ID NO: 599117 - DNA, 18 bp, Homo sapiens
catttatttaaaactacc

SEQ ID NO: 599118 - DNA, 16 bp, Homo sapiens
catttcacattcctga

SEQ ID NO: 599119 - DNA, 18 bp, Homo sapiens
catttcacattcctgacc

SEQ ID NO: 599120 - DNA, 13 bp, Homo sapiens
catttcatacaaa

SEQ ID NO: 599121 - DNA, 18 bp, Homo sapiens
catttcccctgtggtttg

SEQ ID NO: 599122 - DNA, 13 bp, Homo sapiens
catttccctgctg

SEQ ID NO: 599123 - DNA, 11 bp, Homo sapiens
catttgctgaa

SEQ ID NO: 599124 - DNA, 21 bp, Homo sapiens
catttgctgcatttcaagtta

SEQ ID NO: 599125 - DNA, 14 bp, Homo sapiens
catttggattttaa

SEQ ID NO: 599126 - DNA, 16 bp, Homo sapiens
cattttagctaattta

SEQ ID NO: 599127 - DNA, 20 bp, Homo sapiens
cattttgatgtattattata

SEQ ID NO: 599128 - DNA, 15 bp, Homo sapiens
cattttgtctggctg

SEQ ID NO: 599129 - DNA, 18 bp, Homo sapiens
cattttgtctggctgtgg

SEQ ID NO: 599130 - DNA, 17 bp, Homo sapiens
catttttcattttctct

SEQ ID NO: 599131 - DNA, 22 bp, Homo sapiens
catttttgtaatataagacaag

SEQ ID NO: 599132 - DNA, 17 bp, Homo sapiens
cattttttgtctatttt

SEQ ID NO: 599133 - DNA, 14 bp, Homo sapiens
cattttttgtctgt

SEQ ID NO: 599134 - DNA, 22 bp, Homo sapiens
ccaaaagctgctttccatggca

SEQ ID NO: 599135 - DNA, 15 bp, Homo sapiens
ccaaaagtactagca

SEQ ID NO: 599136 - DNA, 15 bp, Homo sapiens
ccaaaccccggggct

SEQ ID NO: 599137 - DNA, 17 bp, Homo sapiens
ccaaaggttgtacatag

SEQ ID NO: 599138 - DNA, 19 bp, Homo sapiens
ccaaataaatcatcctcat

SEQ ID NO: 599139 - DNA, 18 bp, Homo sapiens
ccaaatagcttttcactt

SEQ ID NO: 599140 - DNA, 23 bp, Homo sapiens
ccaaatagcttttcacttcttaa

SEQ ID NO: 599141 - DNA, 13 bp, Homo sapiens
ccaaatagggcaa

SEQ ID NO: 599142 - DNA, 16 bp, Homo sapiens
ccaaattgccttcagc

SEQ ID NO: 599143 - DNA, 22 bp, Homo sapiens
ccaacaatactttgtgtctttt

SEQ ID NO: 599144 - DNA, 13 bp, Homo sapiens
ccaacctcccctg

SEQ ID NO: 599145 - DNA, 21 bp, Homo sapiens
ccaacctcccctggtcctgca

SEQ ID NO: 599146 - DNA, 12 bp, Homo sapiens
ccaactccaggg

SEQ ID NO: 599147 - DNA, 18 bp, Homo sapiens
ccaagccagggttccaga

SEQ ID NO: 599148 - DNA, 15 bp, Homo sapiens
ccaagcctgactttg

SEQ ID NO: 599149 - DNA, 19 bp, Homo sapiens
ccaaggtctgaacccttcc

SEQ ID NO: 599150 - DNA, 19 bp, Homo sapiens
ccaagtcaaacagtgtggc

SEQ ID NO: 599151 - DNA, 20 bp, Homo sapiens
ccaagtcaaacagtgtggct

SEQ ID NO: 599152 - DNA, 15 bp, Homo sapiens
ccaagtgtgtgtgca

SEQ ID NO: 599153 - DNA, 17 bp, Homo sapiens
ccaagtgtgtgtgcaat

SEQ ID NO: 599154 - DNA, 22 bp, Homo sapiens
ccaagttatttgatctggtgcg

SEQ ID NO: 599155 - DNA, 20 bp, Homo sapiens
ccaagttcattcatactcaa

SEQ ID NO: 599156 - DNA, 16 bp, Homo sapiens
ccaataaagctcacac

SEQ ID NO: 599157 - DNA, 19 bp, Homo sapiens
ccaatgccaattcatctca

SEQ ID NO: 599158 - DNA, 22 bp, Homo sapiens
ccaattatcaaaaaacagaaaa

SEQ ID NO: 599159 - DNA, 17 bp, Homo sapiens
ccaattcatctcagcaa

SEQ ID NO: 599160 - DNA, 14 bp, Homo sapiens
ccaatttgttctgt

SEQ ID NO: 599161 - DNA, 20 bp, Homo sapiens
ccacaagggtgcccacctct

SEQ ID NO: 599162 - DNA, 15 bp, Homo sapiens
ccacacacacccttc

SEQ ID NO: 599163 - DNA, 17 bp, Homo sapiens
ccacaccccgtctgccc

SEQ ID NO: 599164 - DNA, 19 bp, Homo sapiens
ccacaccccgtctgcccct

SEQ ID NO: 599165 - DNA, 17 bp, Homo sapiens
ccacacgccggggctgg

SEQ ID NO: 599166 - DNA, 18 bp, Homo sapiens
ccacagagttactgccac

SEQ ID NO: 599167 - DNA, 19 bp, Homo sapiens
ccacagctgggcagggtga

SEQ ID NO: 599168 - DNA, 20 bp, Homo sapiens
ccacagctgggcagggtgag

SEQ ID NO: 599169 - DNA, 20 bp, Homo sapiens
ccacaggagccgcagaggcc

SEQ ID NO: 599170 - DNA, 23 bp, Homo sapiens
ccacaggagccgcagaggcccga

SEQ ID NO: 599171 - DNA, 22 bp, Homo sapiens
ccacaggagcgtgtcctatccc

SEQ ID NO: 599172 - DNA, 15 bp, Homo sapiens
ccacaggatgcatat

SEQ ID NO: 599173 - DNA, 14 bp, Homo sapiens
ccacagtagcattt

SEQ ID NO: 599174 - DNA, 24 bp, Homo sapiens
ccacagtggggcccatggccccag

SEQ ID NO: 599175 - DNA, 21 bp, Homo sapiens
ccacatccccaccctcccctc

SEQ ID NO: 599176 - DNA, 22 bp, Homo sapiens
ccacatccccaccctcccctct

SEQ ID NO: 599177 - DNA, 20 bp, Homo sapiens
ccacattgcttcattaaaac

SEQ ID NO: 599178 - DNA, 16 bp, Homo sapiens
ccacatttgggctcag

SEQ ID NO: 599179 - DNA, 22 bp, Homo sapiens
ccaccacacacacccttcccca

SEQ ID NO: 599180 - DNA, 22 bp, Homo sapiens
ccacccacaccccgtctgcccc

SEQ ID NO: 599181 - DNA, 23 bp, Homo sapiens
ccacccacaccccgtctgcccct

SEQ ID NO: 599182 - DNA, 15 bp, Homo sapiens
ccacccactagccct

SEQ ID NO: 599183 - DNA, 20 bp, Homo sapiens
ccacccccgtcaccccgctc

SEQ ID NO: 599184 - DNA, 14 bp, Homo sapiens
ccaccccgtcccgg

SEQ ID NO: 599185 - DNA, 22 bp, Homo sapiens
ccaccccgtcccggccccgcgc

SEQ ID NO: 599186 - DNA, 20 bp, Homo sapiens
ccaccccgttgttgtccctg

SEQ ID NO: 599187 - DNA, 21 bp, Homo sapiens
ccaccccgttgttgtccctgc

SEQ ID NO: 599188 - DNA, 13 bp, Homo sapiens
ccacccctcttcc

SEQ ID NO: 599189 - DNA, 14 bp, Homo sapiens
ccacccctcttccc

SEQ ID NO: 599190 - DNA, 16 bp, Homo sapiens
ccacccctcttccccc

SEQ ID NO: 599191 - DNA, 21 bp, Homo sapiens
ccacccctcttcccccttccc

SEQ ID NO: 599192 - DNA, 11 bp, Homo sapiens
ccacccctgtg

SEQ ID NO: 599193 - DNA, 17 bp, Homo sapiens
ccacccctgtgcgcgcg

SEQ ID NO: 599194 - DNA, 15 bp, Homo sapiens
ccacccgccccagag

SEQ ID NO: 599195 - DNA, 22 bp, Homo sapiens
ccacccgccccagagactgccc

SEQ ID NO: 599196 - DNA, 12 bp, Homo sapiens
ccacccgcccgc

SEQ ID NO: 599197 - DNA, 14 bp, Homo sapiens
ccaccctgagcctg

SEQ ID NO: 599198 - DNA, 17 bp, Homo sapiens
ccaccctgggcctcccg

SEQ ID NO: 599199 - DNA, 12 bp, Homo sapiens
ccacctgccagg

SEQ ID NO: 599200 - DNA, 19 bp, Homo sapiens
ccacctgccaggcctccct

SEQ ID NO: 599201 - DNA, 20 bp, Homo sapiens
ccacctgccaggcctccctc

SEQ ID NO: 599202 - DNA, 22 bp, Homo sapiens
ccacctgcccagttagcccggc

SEQ ID NO: 599203 - DNA, 15 bp, Homo sapiens
ccacctggtggccct

SEQ ID NO: 599204 - DNA, 18 bp, Homo sapiens
ccaccttcaagcaccctg

SEQ ID NO: 599205 - DNA, 14 bp, Homo sapiens
ccaccttcctgccc

SEQ ID NO: 599206 - DNA, 17 bp, Homo sapiens
ccacgacctcgtccatt

SEQ ID NO: 599207 - DNA, 14 bp, Homo sapiens
ccacgcagagcccc

SEQ ID NO: 599208 - DNA, 19 bp, Homo sapiens
ccgcgctctgcccctccgt

SEQ ID NO: 599209 - DNA, 12 bp, Homo sapiens
ccgcggagcccc

SEQ ID NO: 599210 - DNA, 14 bp, Homo sapiens
ccgcggaggcccct

SEQ ID NO: 599211 - DNA, 19 bp, Homo sapiens
ccgcgggtggctggagccc

SEQ ID NO: 599212 - DNA, 17 bp, Homo sapiens
ccgcgtggttctgccac

SEQ ID NO: 599213 - DNA, 14 bp, Homo sapiens
ccgctctccgcccc

SEQ ID NO: 599214 - DNA, 17 bp, Homo sapiens
ccgctctccgccccccg

SEQ ID NO: 599215 - DNA, 19 bp, Homo sapiens
ccgctcttcccaagtcctc

SEQ ID NO: 599216 - DNA, 21 bp, Homo sapiens
ccgctgcctggcgggcagccc

SEQ ID NO: 599217 - DNA, 23 bp, Homo sapiens
ccgctgcctggcgggcagcccct

SEQ ID NO: 599218 - DNA, 18 bp, Homo sapiens
ccggacgctggagaccct

SEQ ID NO: 599219 - DNA, 22 bp, Homo sapiens
ccggacgctggagaccctgcgc

SEQ ID NO: 599220 - DNA, 23 bp, Homo sapiens
ccggacgctggagaccctgcgcc

SEQ ID NO: 599221 - DNA, 12 bp, Homo sapiens
ccggagcaccac

SEQ ID NO: 599222 - DNA, 17 bp, Homo sapiens
ccggagcggctgaggac

SEQ ID NO: 599223 - DNA, 16 bp, Homo sapiens
ccggaggcgcccacct

SEQ ID NO: 599224 - DNA, 19 bp, Homo sapiens
ccggaggcgcccacctgcc

SEQ ID NO: 599225 - DNA, 20 bp, Homo sapiens
ccggaggcgcccacctgccc

SEQ ID NO: 599226 - DNA, 22 bp, Homo sapiens
ccggaggcgcccacctgcccag

SEQ ID NO: 599227 - DNA, 14 bp, Homo sapiens
ccggcactgtgcac

SEQ ID NO: 599228 - DNA, 16 bp, Homo sapiens
ccggcactgtgcactc

SEQ ID NO: 599229 - DNA, 20 bp, Homo sapiens
ccggcactgtgcactctact

SEQ ID NO: 599230 - DNA, 14 bp, Homo sapiens
ccggcagaggcagg

SEQ ID NO: 599231 - DNA, 23 bp, Homo sapiens
ccggcagaggcagggccctgggg

SEQ ID NO: 599232 - DNA, 22 bp, Homo sapiens
ccggcccacgcagagccccgga

SEQ ID NO: 599233 - DNA, 17 bp, Homo sapiens
ccggccccgcgcgtgcc

SEQ ID NO: 599234 - DNA, 15 bp, Homo sapiens
ccggcctggccccct

SEQ ID NO: 599235 - DNA, 16 bp, Homo sapiens
ccggctggccggtcca

SEQ ID NO: 599236 - DNA, 22 bp, Homo sapiens
ccggggctggccctgccctccc

SEQ ID NO: 599237 - DNA, 20 bp, Homo sapiens
ccggggtggagtcagggctg

SEQ ID NO: 599238 - DNA, 17 bp, Homo sapiens
ccgggtctcgcagcctg

SEQ ID NO: 599239 - DNA, 18 bp, Homo sapiens
ccgggtctcgcagcctga

SEQ ID NO: 599240 - DNA, 19 bp, Homo sapiens
ccgggtgcgtgaccggccc

SEQ ID NO: 599241 - DNA, 18 bp, Homo sapiens
ccggttccacgtggggtg

SEQ ID NO: 599242 - DNA, 22 bp, Homo sapiens
ccggttccacgtggggtggaat

SEQ ID NO: 599243 - DNA, 13 bp, Homo sapiens
ccgtcaccccgct

SEQ ID NO: 599244 - DNA, 13 bp, Homo sapiens
ccgtccccagggt

SEQ ID NO: 599245 - DNA, 13 bp, Homo sapiens
ccgtcccggcccc

SEQ ID NO: 599246 - DNA, 12 bp, Homo sapiens
ccgtccgcccgc

SEQ ID NO: 599247 - DNA, 17 bp, Homo sapiens
ccgtccgcccgcccacc

SEQ ID NO: 599248 - DNA, 16 bp, Homo sapiens
ccgtccgtccgcccgc

SEQ ID NO: 599249 - DNA, 24 bp, Homo sapiens
ccgtcctggggtggttggaggcct

SEQ ID NO: 599250 - DNA, 15 bp, Homo sapiens
ccgtctgtcctgcgc

SEQ ID NO: 599251 - DNA, 23 bp, Homo sapiens
ccgtctttggttcctcatggctg

SEQ ID NO: 599252 - DNA, 14 bp, Homo sapiens
ccgtgaaagttgtg

SEQ ID NO: 599253 - DNA, 21 bp, Homo sapiens
ccgtgcggcccgtgcgcagcc

SEQ ID NO: 599254 - DNA, 14 bp, Homo sapiens
ccgtgctcctctgc

SEQ ID NO: 599255 - DNA, 16 bp, Homo sapiens
ccgtgctcctctgccc

SEQ ID NO: 599256 - DNA, 17 bp, Homo sapiens
ccgtgctcctctgcccg

SEQ ID NO: 599257 - DNA, 21 bp, Homo sapiens
ccgtgctcctctgcccgcggg

SEQ ID NO: 599258 - DNA, 16 bp, Homo sapiens
ccgtggagcttggagc

SEQ ID NO: 599259 - DNA, 18 bp, Homo sapiens
ccgtggagcttggagccc

SEQ ID NO: 599260 - DNA, 22 bp, Homo sapiens
ccgtggagcttggagccccctg

SEQ ID NO: 599261 - DNA, 21 bp, Homo sapiens
ccgtgggcgcaaaggtgcctc

SEQ ID NO: 599262 - DNA, 23 bp, Homo sapiens
ccgtgggcgcaaaggtgcctcat

SEQ ID NO: 599263 - DNA, 16 bp, Homo sapiens
ccgtggtgtgaggccc

SEQ ID NO: 599264 - DNA, 21 bp, Homo sapiens
ccgtggtgtgaggcccccgga

SEQ ID NO: 599265 - DNA, 11 bp, Homo sapiens
ccgtgttctcc

SEQ ID NO: 599266 - DNA, 20 bp, Homo sapiens
ccgttaggaataacactgca

SEQ ID NO: 599267 - DNA, 19 bp, Homo sapiens
ccgttagggaaatccaact

SEQ ID NO: 599268 - DNA, 20 bp, Homo sapiens
ccgttcatctgaggagtcca

SEQ ID NO: 599269 - DNA, 21 bp, Homo sapiens
cctaaacatagtggtatttta

SEQ ID NO: 599270 - DNA, 22 bp, Homo sapiens
cctaaacatagtggtattttaa

SEQ ID NO: 599271 - DNA, 18 bp, Homo sapiens
cctaaagggaagccctga

SEQ ID NO: 599272 - DNA, 19 bp, Homo sapiens
cctaaagggaagccctgac

SEQ ID NO: 599273 - DNA, 12 bp, Homo sapiens
cctaaatgcaaa

SEQ ID NO: 599274 - DNA, 18 bp, Homo sapiens
cctaaatttttgtaagaa

SEQ ID NO: 599275 - DNA, 22 bp, Homo sapiens
cctaacaatgttttttatactt

SEQ ID NO: 599276 - DNA, 15 bp, Homo sapiens
cctaacatagtgtct

SEQ ID NO: 599277 - DNA, 19 bp, Homo sapiens
cctaacatagtgtctgctg

SEQ ID NO: 599278 - DNA, 18 bp, Homo sapiens
cctaagagtggaggagga

SEQ ID NO: 599279 - DNA, 19 bp, Homo sapiens
cctaagtaaatctaaatta

SEQ ID NO: 599280 - DNA, 15 bp, Homo sapiens
cctaatccacctggt

SEQ ID NO: 599281 - DNA, 14 bp, Homo sapiens
cctaattaatttca

SEQ ID NO: 599282 - DNA, 17 bp, Homo sapiens
cctaattaatttcagta

SEQ ID NO: 599283 - DNA, 13 bp, Homo sapiens
cctacagatcctc

SEQ ID NO: 599284 - DNA, 14 bp, Homo sapiens
cctaccctttccca

SEQ ID NO: 599285 - DNA, 17 bp, Homo sapiens
cctacctaactccctag

SEQ ID NO: 599286 - DNA, 19 bp, Homo sapiens
cctactcctccccctcctc

SEQ ID NO: 599287 - DNA, 23 bp, Homo sapiens
cctactcctccccctcctccatg

SEQ ID NO: 599288 - DNA, 14 bp, Homo sapiens
cctacttaaacaaa

SEQ ID NO: 599289 - DNA, 18 bp, Homo sapiens
cctagatttggagacttt

SEQ ID NO: 599290 - DNA, 21 bp, Homo sapiens
cctagcactttgggaggctga

SEQ ID NO: 599291 - DNA, 14 bp, Homo sapiens
cctagcctctccgc

SEQ ID NO: 599292 - DNA, 17 bp, Homo sapiens
cctaggtctccacccct

SEQ ID NO: 599293 - DNA, 19 bp, Homo sapiens
cctaggtctccacccctca

SEQ ID NO: 599294 - DNA, 21 bp, Homo sapiens
cctaggtctccacccctcaag

SEQ ID NO: 599295 - DNA, 18 bp, Homo sapiens
cctagtcttgttgttcat

SEQ ID NO: 599296 - DNA, 22 bp, Homo sapiens
cctataccctaggtctccaccc

SEQ ID NO: 599297 - DNA, 16 bp, Homo sapiens
cctatgaccataaaat

SEQ ID NO: 599298 - DNA, 18 bp, Homo sapiens
cctatggaaagggtgtgg

SEQ ID NO: 599299 - DNA, 21 bp, Homo sapiens
cctatggaaagggtgtggctt

SEQ ID NO: 599300 - DNA, 13 bp, Homo sapiens
cctatttgtttca

SEQ ID NO: 599301 - DNA, 15 bp, Homo sapiens
cctcaagccaggaga

SEQ ID NO: 599302 - DNA, 20 bp, Homo sapiens
cctcaagccaggagaccctg

SEQ ID NO: 599303 - DNA, 22 bp, Homo sapiens
cctcaagccaggagaccctgtc

SEQ ID NO: 599304 - DNA, 21 bp, Homo sapiens
cctccagactcgagagggctg

SEQ ID NO: 599305 - DNA, 22 bp, Homo sapiens
cctccagcaatgcctgcctgaa

SEQ ID NO: 599306 - DNA, 20 bp, Homo sapiens
cctccagccacttatttcca

SEQ ID NO: 599307 - DNA, 19 bp, Homo sapiens
cctccatgccccagctctg

SEQ ID NO: 599308 - DNA, 22 bp, Homo sapiens
cctccatgctgtccctgtgggc

SEQ ID NO: 599309 - DNA, 23 bp, Homo sapiens
cctccatgctgtccctgtgggct

SEQ ID NO: 599310 - DNA, 19 bp, Homo sapiens
cctcccatggccttccctc

SEQ ID NO: 599311 - DNA, 15 bp, Homo sapiens
cctccccaaggaaga

SEQ ID NO: 599312 - DNA, 13 bp, Homo sapiens
cctccccacagtc

SEQ ID NO: 599313 - DNA, 23 bp, Homo sapiens
cctccccacagtcctcacagcct

SEQ ID NO: 599314 - DNA, 14 bp, Homo sapiens
cctccccagccccc

SEQ ID NO: 599315 - DNA, 22 bp, Homo sapiens
cctccccatggtgcagtgaaga

SEQ ID NO: 599316 - DNA, 17 bp, Homo sapiens
cctcccccagagccact

SEQ ID NO: 599317 - DNA, 13 bp, Homo sapiens
cctcccccaggct

SEQ ID NO: 599318 - DNA, 23 bp, Homo sapiens
cctcccccaggctgcgcctgccc

SEQ ID NO: 599319 - DNA, 12 bp, Homo sapiens
cctcccctctcc

SEQ ID NO: 599320 - DNA, 22 bp, Homo sapiens
cctcccctcttcttgcggcacc

SEQ ID NO: 599321 - DNA, 14 bp, Homo sapiens
cctcccctggtcct

SEQ ID NO: 599322 - DNA, 22 bp, Homo sapiens
cctcccctggtcctgcactgtc

SEQ ID NO: 599323 - DNA, 13 bp, Homo sapiens
cctcccgccgcct

SEQ ID NO: 599324 - DNA, 19 bp, Homo sapiens
cctccctccacacctccac

SEQ ID NO: 599325 - DNA, 14 bp, Homo sapiens
cctccctccctcca

SEQ ID NO: 599326 - DNA, 14 bp, Homo sapiens
cctccctccctgct

SEQ ID NO: 599327 - DNA, 15 bp, Homo sapiens
cctccctccctgctc

SEQ ID NO: 599328 - DNA, 13 bp, Homo sapiens
cctccctgctgcc

SEQ ID NO: 599329 - DNA, 23 bp, Homo sapiens
cctccctggggaccaggagctag

SEQ ID NO: 599330 - DNA, 18 bp, Homo sapiens
cctcccttctttccttcc

SEQ ID NO: 599331 - DNA, 16 bp, Homo sapiens
cctccgccagccctgt

SEQ ID NO: 599332 - DNA, 16 bp, Homo sapiens
cctccgcggaggcccc

SEQ ID NO: 599333 - DNA, 16 bp, Homo sapiens
cctccgggcagagacc

SEQ ID NO: 599334 - DNA, 15 bp, Homo sapiens
cctccgtccccaggg

SEQ ID NO: 599335 - DNA, 11 bp, Homo sapiens
cctcctagcct

SEQ ID NO: 599336 - DNA, 13 bp, Homo sapiens
cctcctagcctct

SEQ ID NO: 599337 - DNA, 21 bp, Homo sapiens
cctcctagcctctccgcccac

SEQ ID NO: 599338 - DNA, 12 bp, Homo sapiens
cctcctccatgc

SEQ ID NO: 599339 - DNA, 15 bp, Homo sapiens
cctcctccgtgggca

SEQ ID NO: 599340 - DNA, 12 bp, Homo sapiens
cctcctcctgca

SEQ ID NO: 599341 - DNA, 14 bp, Homo sapiens
cctcctcctgcatg

SEQ ID NO: 599342 - DNA, 15 bp, Homo sapiens
cctcctcgggcgcct

SEQ ID NO: 599343 - DNA, 17 bp, Homo sapiens
cctcctcgggcgcctgc

SEQ ID NO: 599344 - DNA, 19 bp, Homo sapiens
cctcctcgggcgcctgcgc

SEQ ID NO: 599345 - DNA, 23 bp, Homo sapiens
cctcctctgccccctcccccgca

SEQ ID NO: 599346 - DNA, 15 bp, Homo sapiens
cctcctgatgtcttg

SEQ ID NO: 599347 - DNA, 17 bp, Homo sapiens
cctcctgctcctcaccc

SEQ ID NO: 599348 - DNA, 20 bp, Homo sapiens
cctcctgctcctcacccctg

SEQ ID NO: 599349 - DNA, 20 bp, Homo sapiens
cctccttctcccctccagac

SEQ ID NO: 599350 - DNA, 16 bp, Homo sapiens
cctcgcgcccctgtcc

SEQ ID NO: 599351 - DNA, 23 bp, Homo sapiens
cctcggccattgaacactgcacc

SEQ ID NO: 599352 - DNA, 14 bp, Homo sapiens
cctcggctgtgtgg

SEQ ID NO: 599353 - DNA, 14 bp, Homo sapiens
cctcgggcgcctgc

SEQ ID NO: 599354 - DNA, 16 bp, Homo sapiens
cctcgggcgcctgcgc

SEQ ID NO: 599355 - DNA, 17 bp, Homo sapiens
cctcgggcgcctgcgct

SEQ ID NO: 599356 - DNA, 14 bp, Homo sapiens
cctcgggctggtgt

SEQ ID NO: 599357 - DNA, 18 bp, Homo sapiens
cctcggtcagcaccgtgg

SEQ ID NO: 599358 - DNA, 21 bp, Homo sapiens
cctcgtccggcctgcagccca

SEQ ID NO: 599359 - DNA, 14 bp, Homo sapiens
cctcgttggagagc

SEQ ID NO: 599360 - DNA, 16 bp, Homo sapiens
cctcgttggagagcag

SEQ ID NO: 599361 - DNA, 13 bp, Homo sapiens
cctctatccctgg

SEQ ID NO: 599362 - DNA, 14 bp, Homo sapiens
cctctatccctggc

SEQ ID NO: 599363 - DNA, 19 bp, Homo sapiens
cctctatccctggccacct

SEQ ID NO: 599364 - DNA, 20 bp, Homo sapiens
cctctatccctggccacctg

SEQ ID NO: 599365 - DNA, 16 bp, Homo sapiens
cctctcactgacttct

SEQ ID NO: 599366 - DNA, 14 bp, Homo sapiens
cctctcactttttt

SEQ ID NO: 599367 - DNA, 18 bp, Homo sapiens
cctctcagatccctcggt

SEQ ID NO: 599368 - DNA, 22 bp, Homo sapiens
cctctcctcgtccggcctgcag

SEQ ID NO: 599369 - DNA, 19 bp, Homo sapiens
cctctcctgagcctgtctc

SEQ ID NO: 599370 - DNA, 20 bp, Homo sapiens
cctctcgtagaacctgcgca

SEQ ID NO: 599371 - DNA, 18 bp, Homo sapiens
cctctctctccctccact

SEQ ID NO: 599372 - DNA, 20 bp, Homo sapiens
cctctctctccctccactcc

SEQ ID NO: 599373 - DNA, 20 bp, Homo sapiens
cctctctctctctctctctg

SEQ ID NO: 599374 - DNA, 22 bp, Homo sapiens
cctctctctctctctctctgtt

SEQ ID NO: 599375 - DNA, 11 bp, Homo sapiens
cctctctggaa

SEQ ID NO: 599376 - DNA, 23 bp, Homo sapiens
cctctctggaaggttttgcttct

SEQ ID NO: 599377 - DNA, 15 bp, Homo sapiens
cctctcttctgactg

SEQ ID NO: 599378 - DNA, 13 bp, Homo sapiens
cctctgcagcctg

SEQ ID NO: 599379 - DNA, 23 bp, Homo sapiens
cctctgcagcctgagctccaccc

SEQ ID NO: 599380 - DNA, 16 bp, Homo sapiens
cctctgcccctcttcc

SEQ ID NO: 599381 - DNA, 18 bp, Homo sapiens
cctctgctatgtctgtga

SEQ ID NO: 599382 - DNA, 20 bp, Homo sapiens
cctctgctatgtctgtgatg

SEQ ID NO: 599383 - DNA, 17 bp, Homo sapiens
cctctgcttgtcattct

SEQ ID NO: 599384 - DNA, 22 bp, Homo sapiens
cctctgcttgtcattctgctaa

SEQ ID NO: 599385 - DNA, 15 bp, Homo sapiens
cctctgtcagtttgt

SEQ ID NO: 599386 - DNA, 16 bp, Homo sapiens
cctctgtccacatgtg

SEQ ID NO: 599387 - DNA, 18 bp, Homo sapiens
cctctgtccgtctgtcct

SEQ ID NO: 599388 - DNA, 21 bp, Homo sapiens
cctctgtccgtctgtcctgcg

SEQ ID NO: 599389 - DNA, 19 bp, Homo sapiens
cctcttaagatctgactgc

SEQ ID NO: 599390 - DNA, 14 bp, Homo sapiens
cctcttagaagaaa

SEQ ID NO: 599391 - DNA, 14 bp, Homo sapiens
cctgagcctgacct

SEQ ID NO: 599392 - DNA, 18 bp, Homo sapiens
cctgagcctgacctttct

SEQ ID NO: 599393 - DNA, 13 bp, Homo sapiens
cctgagctccacc

SEQ ID NO: 599394 - DNA, 15 bp, Homo sapiens
cctgagctccaccct

SEQ ID NO: 599395 - DNA, 16 bp, Homo sapiens
cctgagctccaccctc

SEQ ID NO: 599396 - DNA, 17 bp, Homo sapiens
cctgagctccaccctcc

SEQ ID NO: 599397 - DNA, 19 bp, Homo sapiens
cctgagctccaccctcccc

SEQ ID NO: 599398 - DNA, 18 bp, Homo sapiens
cctgaggaggaggacaca

SEQ ID NO: 599399 - DNA, 22 bp, Homo sapiens
cctgagggaagcccacccgccc

SEQ ID NO: 599400 - DNA, 17 bp, Homo sapiens
cctgagggacgagcaga

SEQ ID NO: 599401 - DNA, 20 bp, Homo sapiens
cctgagggacgagcagagcg

SEQ ID NO: 599402 - DNA, 21 bp, Homo sapiens
cctgagggacgagcagagcgc

SEQ ID NO: 599403 - DNA, 15 bp, Homo sapiens
cctgagggcccttcc

SEQ ID NO: 599404 - DNA, 17 bp, Homo sapiens
cctgagggcccttccca

SEQ ID NO: 599405 - DNA, 16 bp, Homo sapiens
cctgaggttaagggga

SEQ ID NO: 599406 - DNA, 22 bp, Homo sapiens
cctgagtggatatgcgaatctt

SEQ ID NO: 599407 - DNA, 19 bp, Homo sapiens
cctgagtggctgaaataaa

SEQ ID NO: 599408 - DNA, 18 bp, Homo sapiens
cctgagtgggctgggccc

SEQ ID NO: 599409 - DNA, 22 bp, Homo sapiens
cctgcaagtggacgtgggctcc

SEQ ID NO: 599410 - DNA, 17 bp, Homo sapiens
cctgcaccctctgctat

SEQ ID NO: 599411 - DNA, 18 bp, Homo sapiens
cctgcaccttgggcacgg

SEQ ID NO: 599412 - DNA, 15 bp, Homo sapiens
cctgcagcccagaac

SEQ ID NO: 599413 - DNA, 16 bp, Homo sapiens
cctgcagcccagaacg

SEQ ID NO: 599414 - DNA, 13 bp, Homo sapiens
cctgcaggcaggc

SEQ ID NO: 599415 - DNA, 15 bp, Homo sapiens
cctgcaggcaggtgg

SEQ ID NO: 599416 - DNA, 20 bp, Homo sapiens
cctgcaggcaggtgggggct

SEQ ID NO: 599417 - DNA, 16 bp, Homo sapiens
cctgcagtttggccct

SEQ ID NO: 599418 - DNA, 14 bp, Homo sapiens
cctgcatggagaag

SEQ ID NO: 599419 - DNA, 20 bp, Homo sapiens
cctgcatgtcggggcccctg

SEQ ID NO: 599420 - DNA, 21 bp, Homo sapiens
cctgcatgtcggggcccctgc

SEQ ID NO: 599421 - DNA, 13 bp, Homo sapiens
cctgccaggcctc

SEQ ID NO: 599422 - DNA, 19 bp, Homo sapiens
cctgcccacgtgcagcacc

SEQ ID NO: 599423 - DNA, 13 bp, Homo sapiens
cctgcccagcacc

SEQ ID NO: 599424 - DNA, 14 bp, Homo sapiens
cctgcccagcacct

SEQ ID NO: 599425 - DNA, 15 bp, Homo sapiens
cctgcccagcacctc

SEQ ID NO: 599426 - DNA, 20 bp, Homo sapiens
cctgcccagttagcccggcc

SEQ ID NO: 599427 - DNA, 20 bp, Homo sapiens
cctgccccccttcccacccc

SEQ ID NO: 599428 - DNA, 15 bp, Homo sapiens
cctgcccgcccgccg

SEQ ID NO: 599429 - DNA, 17 bp, Homo sapiens
cctgcccgcgcccgccg

SEQ ID NO: 599430 - DNA, 12 bp, Homo sapiens
cctgccctcact

SEQ ID NO: 599431 - DNA, 13 bp, Homo sapiens
cctgccctcactc

SEQ ID NO: 599432 - DNA, 16 bp, Homo sapiens
cctgccctcactccac

SEQ ID NO: 599433 - DNA, 16 bp, Homo sapiens
cctgccctcccccacg

SEQ ID NO: 599434 - DNA, 14 bp, Homo sapiens
cctgccctgcacct

SEQ ID NO: 599435 - DNA, 22 bp, Homo sapiens
cctgcctctatccctggccacc

SEQ ID NO: 599436 - DNA, 15 bp, Homo sapiens
cctgcgcaccccgtt

SEQ ID NO: 599437 - DNA, 14 bp, Homo sapiens
cctgcgcccctgcc

SEQ ID NO: 599438 - DNA, 15 bp, Homo sapiens
cctgcgcccctgccc

SEQ ID NO: 599439 - DNA, 17 bp, Homo sapiens
cctgcgcccctgcccag

SEQ ID NO: 599440 - DNA, 14 bp, Homo sapiens
cctgcgccctccct

SEQ ID NO: 599441 - DNA, 17 bp, Homo sapiens
cctgcgccctccctccc

SEQ ID NO: 599442 - DNA, 13 bp, Homo sapiens
cctgcgcctcctc

SEQ ID NO: 599443 - DNA, 20 bp, Homo sapiens
cctgcgcctcctcctgcatg

SEQ ID NO: 599444 - DNA, 16 bp, Homo sapiens
cctgcgcctgcgcctc

SEQ ID NO: 599445 - DNA, 15 bp, Homo sapiens
cctgcgctcctctgc

SEQ ID NO: 599446 - DNA, 17 bp, Homo sapiens
cctgcgctcctctgcag

SEQ ID NO: 599447 - DNA, 20 bp, Homo sapiens
cctgcgctcctctgcagcct

SEQ ID NO: 599448 - DNA, 22 bp, Homo sapiens
cctgcggggcggcatccgagcc

SEQ ID NO: 599449 - DNA, 19 bp, Homo sapiens
cctgcggggttccctgcgc

SEQ ID NO: 599450 - DNA, 14 bp, Homo sapiens
cctgcgtgtgttct

SEQ ID NO: 599451 - DNA, 16 bp, Homo sapiens
cctgctcacgtctgtg

SEQ ID NO: 599452 - DNA, 12 bp, Homo sapiens
cctgctcagccc

SEQ ID NO: 599453 - DNA, 15 bp, Homo sapiens
cctgctcagcccatc

SEQ ID NO: 599454 - DNA, 17 bp, Homo sapiens
cctgctcagcccatccc

SEQ ID NO: 599455 - DNA, 21 bp, Homo sapiens
cctgctcccggctctgaggct

SEQ ID NO: 599456 - DNA, 13 bp, Homo sapiens
cctgctccctgct

SEQ ID NO: 599457 - DNA, 11 bp, Homo sapiens
cctgctcctcc

SEQ ID NO: 599458 - DNA, 19 bp, Homo sapiens
cctgctcctgcccacgtgc

SEQ ID NO: 599459 - DNA, 14 bp, Homo sapiens
cctgctcgccctgt

SEQ ID NO: 599460 - DNA, 18 bp, Homo sapiens
cctgctcgccctgtgccc

SEQ ID NO: 599461 - DNA, 20 bp, Homo sapiens
cctgctgctcgggaaggcct

SEQ ID NO: 599462 - DNA, 17 bp, Homo sapiens
cctgctgctctctaaga

SEQ ID NO: 599463 - DNA, 22 bp, Homo sapiens
cctgctgctctctaagaattca

SEQ ID NO: 599464 - DNA, 13 bp, Homo sapiens
cctgcttctcagc

SEQ ID NO: 599465 - DNA, 22 bp, Homo sapiens
cctggaagttgtcctttctgat

SEQ ID NO: 599466 - DNA, 21 bp, Homo sapiens
cctggagccagggcagaggaa

SEQ ID NO: 599467 - DNA, 15 bp, Homo sapiens
cctggagcctgggca

SEQ ID NO: 599468 - DNA, 19 bp, Homo sapiens
cctggagcctgggcagcac

SEQ ID NO: 599469 - DNA, 15 bp, Homo sapiens
cctggattccagcag

SEQ ID NO: 599470 - DNA, 17 bp, Homo sapiens
cctggattccagcagtg

SEQ ID NO: 599471 - DNA, 13 bp, Homo sapiens
cctggccacctgc

SEQ ID NO: 599472 - DNA, 22 bp, Homo sapiens
cctggccccctcgcgcccctgt

SEQ ID NO: 599473 - DNA, 14 bp, Homo sapiens
cctggccctcttct

SEQ ID NO: 599474 - DNA, 21 bp, Homo sapiens
cgtcaatgtgaaataaagagt

SEQ ID NO: 599475 - DNA, 12 bp, Homo sapiens
cgtcagcctgtg

SEQ ID NO: 599476 - DNA, 14 bp, Homo sapiens
cgtcatctagtttt

SEQ ID NO: 599477 - DNA, 17 bp, Homo sapiens
cgtcatctagttttaaa

SEQ ID NO: 599478 - DNA, 12 bp, Homo sapiens
cgtccccagggt

SEQ ID NO: 599479 - DNA, 14 bp, Homo sapiens
cgtcccggccccgc

SEQ ID NO: 599480 - DNA, 18 bp, Homo sapiens
cgtccctgacttcccagc

SEQ ID NO: 599481 - DNA, 20 bp, Homo sapiens
cgtccctgacttcccagctg

SEQ ID NO: 599482 - DNA, 17 bp, Homo sapiens
cgtccctgagggccctt

SEQ ID NO: 599483 - DNA, 21 bp, Homo sapiens
cgtccctgagggcccttccca

SEQ ID NO: 599484 - DNA, 13 bp, Homo sapiens
cgtccctgctcag

SEQ ID NO: 599485 - DNA, 20 bp, Homo sapiens
cgtccgcccgcccaccccgc

SEQ ID NO: 599486 - DNA, 17 bp, Homo sapiens
cgtccggcctgcagccc

SEQ ID NO: 599487 - DNA, 20 bp, Homo sapiens
cgtcctgctcgccctgtgcc

SEQ ID NO: 599488 - DNA, 23 bp, Homo sapiens
cgtcctggggtggttggaggcct

SEQ ID NO: 599489 - DNA, 21 bp, Homo sapiens
cgtcctttcctctcctctctg

SEQ ID NO: 599490 - DNA, 22 bp, Homo sapiens
cgtcctttcctctcctctctgg

SEQ ID NO: 599491 - DNA, 21 bp, Homo sapiens
cgtctccccatgctgggctca

SEQ ID NO: 599492 - DNA, 11 bp, Homo sapiens
cgtctgcccct

SEQ ID NO: 599493 - DNA, 12 bp, Homo sapiens
cgtctgcccctt

SEQ ID NO: 599494 - DNA, 19 bp, Homo sapiens
cgtctgccccttgacccca

SEQ ID NO: 599495 - DNA, 22 bp, Homo sapiens
cgtctgccccttgaccccacac

SEQ ID NO: 599496 - DNA, 21 bp, Homo sapiens
cgtctttggttcctcatggct

SEQ ID NO: 599497 - DNA, 17 bp, Homo sapiens
cgtgaaagttgtgatct

SEQ ID NO: 599498 - DNA, 22 bp, Homo sapiens
cgtgaccggcccgccaccttgt

SEQ ID NO: 599499 - DNA, 16 bp, Homo sapiens
cgtgacttcagactct

SEQ ID NO: 599500 - DNA, 17 bp, Homo sapiens
cgtgacttcagactctc

SEQ ID NO: 599501 - DNA, 22 bp, Homo sapiens
cgtgacttcagactctctcctc

SEQ ID NO: 599502 - DNA, 15 bp, Homo sapiens
cgtgaggcccctgtg

SEQ ID NO: 599503 - DNA, 16 bp, Homo sapiens
cgtgaggcccctgtgc

SEQ ID NO: 599504 - DNA, 18 bp, Homo sapiens
cgtgaggcccctgtgcag

SEQ ID NO: 599505 - DNA, 22 bp, Homo sapiens
cgtgccacatcaataacaacag

SEQ ID NO: 599506 - DNA, 21 bp, Homo sapiens
cgtgccgtggagcttggagcc

SEQ ID NO: 599507 - DNA, 22 bp, Homo sapiens
cgtgccgtggagcttggagccc

SEQ ID NO: 599508 - DNA, 16 bp, Homo sapiens
cgtgccttccccgtgc

SEQ ID NO: 599509 - DNA, 12 bp, Homo sapiens
cgtgcggcccgt

SEQ ID NO: 599510 - DNA, 13 bp, Homo sapiens
cgtgctcctctgc

SEQ ID NO: 599511 - DNA, 22 bp, Homo sapiens
cgtgctgcccgagggcaggggc

SEQ ID NO: 599512 - DNA, 21 bp, Homo sapiens
cgtggaagaagggccaccctg

SEQ ID NO: 599513 - DNA, 14 bp, Homo sapiens
cgtggagcttggag

SEQ ID NO: 599514 - DNA, 15 bp, Homo sapiens
cgtggagcttggagc

SEQ ID NO: 599515 - DNA, 15 bp, Homo sapiens
cgtggctgcttcaag

SEQ ID NO: 599516 - DNA, 17 bp, Homo sapiens
cgtggctgcttcaagga

SEQ ID NO: 599517 - DNA, 16 bp, Homo sapiens
cgtggctttgtgctta

SEQ ID NO: 599518 - DNA, 21 bp, Homo sapiens
cgtgggatccagagagaagca

SEQ ID NO: 599519 - DNA, 21 bp, Homo sapiens
cgtggtcaaggcccggcccca

SEQ ID NO: 599520 - DNA, 15 bp, Homo sapiens
cgtggtgtgaggccc

SEQ ID NO: 599521 - DNA, 15 bp, Homo sapiens
cgtgtactaccccag

SEQ ID NO: 599522 - DNA, 14 bp, Homo sapiens
cgtgtcctatcccc

SEQ ID NO: 599523 - DNA, 17 bp, Homo sapiens
cgtgtcttgtgttgctg

SEQ ID NO: 599524 - DNA, 17 bp, Homo sapiens
cgtgtgcagactgtggc

SEQ ID NO: 599525 - DNA, 17 bp, Homo sapiens
ctcactgggtgtggcct

SEQ ID NO: 599526 - DNA, 16 bp, Homo sapiens
ctcactgtgacctgct

SEQ ID NO: 599527 - DNA, 23 bp, Homo sapiens
ctcacttgtggcagcttccctga

SEQ ID NO: 599528 - DNA, 16 bp, Homo sapiens
ctcagacacctagact

SEQ ID NO: 599529 - DNA, 23 bp, Homo sapiens
ctcagatccctcggtcagcaccg

SEQ ID NO: 599530 - DNA, 17 bp, Homo sapiens
ctcagatggggcctggg

SEQ ID NO: 599531 - DNA, 14 bp, Homo sapiens
ctcagcatatatat

SEQ ID NO: 599532 - DNA, 23 bp, Homo sapiens
ctcagcatatatataaaatacac

SEQ ID NO: 599533 - DNA, 18 bp, Homo sapiens
ctcagcatcctggaaatt

SEQ ID NO: 599534 - DNA, 23 bp, Homo sapiens
ctcagccagtggcacaggagact

SEQ ID NO: 599535 - DNA, 17 bp, Homo sapiens
ctcagcccatcccctgc

SEQ ID NO: 599536 - DNA, 16 bp, Homo sapiens
ctcagctccactctga

SEQ ID NO: 599537 - DNA, 17 bp, Homo sapiens
ctcagctccactctgaa

SEQ ID NO: 599538 - DNA, 15 bp, Homo sapiens
ctcagctctccctca

SEQ ID NO: 599539 - DNA, 16 bp, Homo sapiens
ctcagctctccctcac

SEQ ID NO: 599540 - DNA, 18 bp, Homo sapiens
ctcaggagcacagccata

SEQ ID NO: 599541 - DNA, 15 bp, Homo sapiens
ctcaggcagcctgtg

SEQ ID NO: 599542 - DNA, 16 bp, Homo sapiens
ctcaggcggggatcac

SEQ ID NO: 599543 - DNA, 17 bp, Homo sapiens
ctcagggaccaaggaga

SEQ ID NO: 599544 - DNA, 14 bp, Homo sapiens
ctcagggttggcca

SEQ ID NO: 599545 - DNA, 16 bp, Homo sapiens
ctcagggttggccatt

SEQ ID NO: 599546 - DNA, 16 bp, Homo sapiens
ctcagtaacagtgcag

SEQ ID NO: 599547 - DNA, 14 bp, Homo sapiens
ctcagtatcttaaa

SEQ ID NO: 599548 - DNA, 21 bp, Homo sapiens
ctcagtattgagacactgtca

SEQ ID NO: 599549 - DNA, 16 bp, Homo sapiens
ctcagttggcctctgc

SEQ ID NO: 599550 - DNA, 17 bp, Homo sapiens
ctcagttggcctctgcc

SEQ ID NO: 599551 - DNA, 19 bp, Homo sapiens
ctcagttggcctctgcccc

SEQ ID NO: 599552 - DNA, 21 bp, Homo sapiens
ctcatacagtctctatttgat

SEQ ID NO: 599553 - DNA, 13 bp, Homo sapiens
ctcatagatgacc

SEQ ID NO: 599554 - DNA, 18 bp, Homo sapiens
ctcatagcatagccagca

SEQ ID NO: 599555 - DNA, 21 bp, Homo sapiens
ctcatagcatagccagcattc

SEQ ID NO: 599556 - DNA, 18 bp, Homo sapiens
ctcatcaacaaagaaata

SEQ ID NO: 599557 - DNA, 20 bp, Homo sapiens
ctcatcagaaacaatttctg

SEQ ID NO: 599558 - DNA, 21 bp, Homo sapiens
ctcatccactaggtgcccagt

SEQ ID NO: 599559 - DNA, 23 bp, Homo sapiens
ctcatccactaggtgcccagtct

SEQ ID NO: 599560 - DNA, 13 bp, Homo sapiens
ctcatcccccatc

SEQ ID NO: 599561 - DNA, 14 bp, Homo sapiens
ctcatctacacata

SEQ ID NO: 599562 - DNA, 16 bp, Homo sapiens
ctcatgaccctcctgt

SEQ ID NO: 599563 - DNA, 22 bp, Homo sapiens
ctcatgaccctcctgtccagca

SEQ ID NO: 599564 - DNA, 21 bp, Homo sapiens
ctcatgttttatatgattaaa

SEQ ID NO: 599565 - DNA, 22 bp, Homo sapiens
ctcattgttcagaaaagcacct

SEQ ID NO: 599566 - DNA, 15 bp, Homo sapiens
ctcatttgaaatgtt

SEQ ID NO: 599567 - DNA, 12 bp, Homo sapiens
ctcattttattc

SEQ ID NO: 599568 - DNA, 15 bp, Homo sapiens
ctccacacctccacc

SEQ ID NO: 599569 - DNA, 20 bp, Homo sapiens
ctccacaggagccgcagagg

SEQ ID NO: 599570 - DNA, 22 bp, Homo sapiens
ctccacaggagccgcagaggcc

SEQ ID NO: 599571 - DNA, 13 bp, Homo sapiens
ctccacccctcaa

SEQ ID NO: 599572 - DNA, 16 bp, Homo sapiens
ctccacccgtcctggg

SEQ ID NO: 599573 - DNA, 14 bp, Homo sapiens
ctccaccctcccct

SEQ ID NO: 599574 - DNA, 21 bp, Homo sapiens
ctccacgtgtttcgggccagg

SEQ ID NO: 599575 - DNA, 15 bp, Homo sapiens
ctccactcccctcat

SEQ ID NO: 599576 - DNA, 12 bp, Homo sapiens
ctccagaagcag

SEQ ID NO: 599577 - DNA, 13 bp, Homo sapiens
ctccagaagcagc

SEQ ID NO: 599578 - DNA, 14 bp, Homo sapiens
ctccagaagcagca

SEQ ID NO: 599579 - DNA, 15 bp, Homo sapiens
ctccagacccctacc

SEQ ID NO: 599580 - DNA, 22 bp, Homo sapiens
ctccagacccctaccctttccc

SEQ ID NO: 599581 - DNA, 15 bp, Homo sapiens
ctccagagtaggtgg

SEQ ID NO: 599582 - DNA, 21 bp, Homo sapiens
ctccagagtaggtgggtcttg

SEQ ID NO: 599583 - DNA, 20 bp, Homo sapiens
tgcttttgatggctatgttt

SEQ ID NO: 599584 - DNA, 22 bp, Homo sapiens
tggaaacaaggaaggacatttc

SEQ ID NO: 599585 - DNA, 13 bp, Homo sapiens
tggaaacatctga

SEQ ID NO: 599586 - DNA, 16 bp, Homo sapiens
tggaaacatctgattt

SEQ ID NO: 599587 - DNA, 17 bp, Homo sapiens
tggaaaccaccttaaaa

SEQ ID NO: 599588 - DNA, 21 bp, Homo sapiens
tggaaaccaccttaaaacatt

SEQ ID NO: 599589 - DNA, 18 bp, Homo sapiens
tggaaagggtgtggcttg

SEQ ID NO: 599590 - DNA, 21 bp, Homo sapiens
tggaaagggtgtggcttggaa

SEQ ID NO: 599591 - DNA, 14 bp, Homo sapiens
ggcctgatggccag

SEQ ID NO: 599592 - DNA, 12 bp, Homo sapiens
ggcctgcagccc

SEQ ID NO: 599593 - DNA, 14 bp, Homo sapiens
ggcctgcatggaga

SEQ ID NO: 599594 - DNA, 22 bp, Homo sapiens
ggcctgccccccttcccacccc

SEQ ID NO: 599595 - DNA, 20 bp, Homo sapiens
ggcctgcggggttccctgcg

SEQ ID NO: 599596 - DNA, 23 bp, Homo sapiens
ggcctggccccctcgcgcccctg

SEQ ID NO: 599597 - DNA, 14 bp, Homo sapiens
ggcctggcttctgg

SEQ ID NO: 599598 - DNA, 23 bp, Homo sapiens
ggcctgggggctgttagctcaga

SEQ ID NO: 599599 - DNA, 20 bp, Homo sapiens
ggcctgggtccccctcctgc

SEQ ID NO: 599600 - DNA, 19 bp, Homo sapiens
ggccttggttcctccagca

SEQ ID NO: 599601 - DNA, 17 bp, Homo sapiens
ggcgccaggggcaggca

SEQ ID NO: 599602 - DNA, 12 bp, Homo sapiens
ggcgcccacctg

SEQ ID NO: 599603 - DNA, 17 bp, Homo sapiens
ggcgcccacctgcccag

SEQ ID NO: 599604 - DNA, 21 bp, Homo sapiens
ggcgccccatgggccctcagc

SEQ ID NO: 599605 - DNA, 18 bp, Homo sapiens
ggcgcctgcgctcctctg

SEQ ID NO: 599606 - DNA, 19 bp, Homo sapiens
ggcgcctgcgctcctctgc

SEQ ID NO: 599607 - DNA, 20 bp, Homo sapiens
ggcgcctgcgctcctctgca

SEQ ID NO: 599608 - DNA, 24 bp, Homo sapiens
ggcgcctgcgctcctctgcagcct

SEQ ID NO: 599609 - DNA, 15 bp, Homo sapiens
ggcgcctgtcgggcc

SEQ ID NO: 599610 - DNA, 18 bp, Homo sapiens
ggcgcctgtcgggcccgc

SEQ ID NO: 599611 - DNA, 13 bp, Homo sapiens
ggcgcgcaccgcc

SEQ ID NO: 599612 - DNA, 16 bp, Homo sapiens
ggcgctccggcagagg

SEQ ID NO: 599613 - DNA, 16 bp, Homo sapiens
ggcggaggggcttgga

SEQ ID NO: 599614 - DNA, 17 bp, Homo sapiens
ggcggcaggggttggca

SEQ ID NO: 599615 - DNA, 20 bp, Homo sapiens
ggcggcaggggttggcagcg

SEQ ID NO: 599616 - DNA, 21 bp, Homo sapiens
ggcggcaggggttggcagcgc

SEQ ID NO: 599617 - DNA, 16 bp, Homo sapiens
ggcggcatccgagccc

SEQ ID NO: 599618 - DNA, 11 bp, Homo sapiens
ggcgggcagcc

SEQ ID NO: 599619 - DNA, 12 bp, Homo sapiens
ggcgggcagccc

SEQ ID NO: 599620 - DNA, 15 bp, Homo sapiens
ggcgggccagggtgg

SEQ ID NO: 599621 - DNA, 22 bp, Homo sapiens
ggcgggccagggtgggaagaga

SEQ ID NO: 599622 - DNA, 14 bp, Homo sapiens
ggctaacgggcgcc

SEQ ID NO: 599623 - DNA, 13 bp, Homo sapiens
ggctaactggccc

SEQ ID NO: 599624 - DNA, 19 bp, Homo sapiens
ggctaactggccccaggcg

SEQ ID NO: 599625 - DNA, 21 bp, Homo sapiens
ggctatgtctcatgttttata

SEQ ID NO: 599626 - DNA, 20 bp, Homo sapiens
ggctcacaccggcactgtgc

SEQ ID NO: 599627 - DNA, 22 bp, Homo sapiens
ggctcacaccggcactgtgcac

SEQ ID NO: 599628 - DNA, 23 bp, Homo sapiens
ggctcacaccggcactgtgcact

SEQ ID NO: 599629 - DNA, 22 bp, Homo sapiens
ggctcactacatgggccagccc

SEQ ID NO: 599630 - DNA, 16 bp, Homo sapiens
ggctcagacacctaga

SEQ ID NO: 599631 - DNA, 23 bp, Homo sapiens
ggctcagatggggcctgggctgt

SEQ ID NO: 599632 - DNA, 14 bp, Homo sapiens
ggctcccagcagag

SEQ ID NO: 599633 - DNA, 19 bp, Homo sapiens
ggctccctccctccctgct

SEQ ID NO: 599634 - DNA, 23 bp, Homo sapiens
ggctccctccctccctgctccct

SEQ ID NO: 599635 - DNA, 18 bp, Homo sapiens
ggctcgtgtttcacagtg

SEQ ID NO: 599636 - DNA, 17 bp, Homo sapiens
ggctctgaatctctcaa

SEQ ID NO: 599637 - DNA, 10 bp, Homo sapiens
ggctctggct

SEQ ID NO: 599638 - DNA, 14 bp, Homo sapiens
ggctgaaattatgt

SEQ ID NO: 599639 - DNA, 11 bp, Homo sapiens
ggctgaagaaa

SEQ ID NO: 599640 - DNA, 16 bp, Homo sapiens
ggctgagacacagccc

SEQ ID NO: 599641 - DNA, 20 bp, Homo sapiens
ggctgagagggtgtgggtgc

SEQ ID NO: 599642 - DNA, 12 bp, Homo sapiens
ggctgagcccct

SEQ ID NO: 599643 - DNA, 18 bp, Homo sapiens
ggctgagcccctcctctc

SEQ ID NO: 599644 - DNA, 20 bp, Homo sapiens
ggctgaggacggggcagagc

SEQ ID NO: 599645 - DNA, 14 bp, Homo sapiens
ggctgcagtgagcc

SEQ ID NO: 599646 - DNA, 20 bp, Homo sapiens
ggctgccgcatctgcctgga

SEQ ID NO: 599647 - DNA, 21 bp, Homo sapiens
ggctgccgcatctgcctggag

SEQ ID NO: 599648 - DNA, 14 bp, Homo sapiens
ggctgcctgctgtg

SEQ ID NO: 599649 - DNA, 15 bp, Homo sapiens
ggctgcgtccctgct

SEQ ID NO: 599650 - DNA, 22 bp, Homo sapiens
ggctgcgtccctgctcagccca

SEQ ID NO: 599651 - DNA, 22 bp, Homo sapiens
ggctgctgcagtcagcacagag

SEQ ID NO: 599652 - DNA, 12 bp, Homo sapiens
ggctgctgcccc

SEQ ID NO: 599653 - DNA, 18 bp, Homo sapiens
ggctgctgccccctggct

SEQ ID NO: 599654 - DNA, 19 bp, Homo sapiens
ggctgctgccccctggctt

SEQ ID NO: 599655 - DNA, 12 bp, Homo sapiens
ggctgctggggc

SEQ ID NO: 599656 - DNA, 21 bp, Homo sapiens
ggctgctggggcagggcccag

SEQ ID NO: 599657 - DNA, 15 bp, Homo sapiens
ggctgcttcaaggat

SEQ ID NO: 599658 - DNA, 19 bp, Homo sapiens
ggctggcacccactggagg

SEQ ID NO: 599659 - DNA, 13 bp, Homo sapiens
ggctggccctgcc

SEQ ID NO: 599660 - DNA, 17 bp, Homo sapiens
ggctggccctgccctcc

SEQ ID NO: 599661 - DNA, 16 bp, Homo sapiens
ggctggccggtccacc

SEQ ID NO: 599662 - DNA, 17 bp, Homo sapiens
ggctgggcagggccgca

SEQ ID NO: 599663 - DNA, 19 bp, Homo sapiens
ggctgggtcgcccctcctc

SEQ ID NO: 599664 - DNA, 21 bp, Homo sapiens
ggctgggtcgcccctcctcgg

SEQ ID NO: 599665 - DNA, 19 bp, Homo sapiens
ggctgggtttgggcagtgg

SEQ ID NO: 599666 - DNA, 22 bp, Homo sapiens
ggctgggtttgggcagtggaga

SEQ ID NO: 599667 - DNA, 16 bp, Homo sapiens
ggctggtgtggctgct

SEQ ID NO: 599668 - DNA, 15 bp, Homo sapiens
ggctgtcccctgcaa

SEQ ID NO: 599669 - DNA, 14 bp, Homo sapiens
ggctgtggcccctc

SEQ ID NO: 599670 - DNA, 15 bp, Homo sapiens
ggctgtggcccctcc

SEQ ID NO: 599671 - DNA, 21 bp, Homo sapiens
ggctgtggcccctccttctcc

SEQ ID NO: 599672 - DNA, 19 bp, Homo sapiens
ggctgttgtgtctggagcc

SEQ ID NO: 599673 - DNA, 22 bp, Homo sapiens
ggctgttgtgtctggagcctgc

SEQ ID NO: 599674 - DNA, 14 bp, Homo sapiens
ggcttaaacatttt

SEQ ID NO: 599675 - DNA, 24 bp, Homo sapiens
ggcttctgggacaggcaccatgct

SEQ ID NO: 599676 - DNA, 16 bp, Homo sapiens
ggcttggaagggcgct

SEQ ID NO: 599677 - DNA, 16 bp, Homo sapiens
ggcttggagcagagac

SEQ ID NO: 599678 - DNA, 15 bp, Homo sapiens
ggcttggggtagaga

SEQ ID NO: 599679 - DNA, 18 bp, Homo sapiens
ggcttggggtagagagga

SEQ ID NO: 599680 - DNA, 19 bp, Homo sapiens
ggcttggggtagagaggac

SEQ ID NO: 599681 - DNA, 20 bp, Homo sapiens
ggcttggggtagagaggaca

SEQ ID NO: 599682 - DNA, 21 bp, Homo sapiens
ggcttggggtagagaggacag

SEQ ID NO: 599683 - DNA, 23 bp, Homo sapiens
ggctttggcgccccatgggccct

SEQ ID NO: 599684 - DNA, 14 bp, Homo sapiens
gggaaaccttggag

SEQ ID NO: 599685 - DNA, 18 bp, Homo sapiens
gggaaatccaactccagg

SEQ ID NO: 599686 - DNA, 13 bp, Homo sapiens
gggaacacctgct

SEQ ID NO: 599687 - DNA, 13 bp, Homo sapiens
gggaagcccaccc

SEQ ID NO: 599688 - DNA, 18 bp, Homo sapiens
gggaagcccacccgcccc

SEQ ID NO: 599689 - DNA, 12 bp, Homo sapiens
gggaagccctga

SEQ ID NO: 599690 - DNA, 13 bp, Homo sapiens
gggaaggcctgag

SEQ ID NO: 599691 - DNA, 14 bp, Homo sapiens
gggaaggcctgagg

SEQ ID NO: 599692 - DNA, 21 bp, Homo sapiens
gggaaggcctgagggaagccc

SEQ ID NO: 599693 - DNA, 23 bp, Homo sapiens
gggaaggcctgagggaagcccac

SEQ ID NO: 599694 - DNA, 16 bp, Homo sapiens
gggaatccatatcagc

SEQ ID NO: 599695 - DNA, 13 bp, Homo sapiens
gggaattgcatgc

SEQ ID NO: 599696 - DNA, 16 bp, Homo sapiens
gggaattttcattttc

SEQ ID NO: 599697 - DNA, 16 bp, Homo sapiens
gggacactacaaacat

SEQ ID NO: 599698 - DNA, 13 bp, Homo sapiens
gggacagcggccc

SEQ ID NO: 599699 - DNA, 16 bp, Homo sapiens
gggacagcggccccgc

SEQ ID NO: 599700 - DNA, 23 bp, Homo sapiens
gggacagcggccccgcggagccc

SEQ ID NO: 599701 - DNA, 13 bp, Homo sapiens
gggaccaggagct

SEQ ID NO: 599702 - DNA, 21 bp, Homo sapiens
gggacgagcagagcgcagccc

SEQ ID NO: 599703 - DNA, 16 bp, Homo sapiens
gggacgcccagccccc

SEQ ID NO: 599704 - DNA, 18 bp, Homo sapiens
gggacgcccagcccccac

SEQ ID NO: 599705 - DNA, 22 bp, Homo sapiens
gggactccagaagcagcagcta

SEQ ID NO: 599706 - DNA, 19 bp, Homo sapiens
gggactgctttcagtgcct

SEQ ID NO: 599707 - DNA, 22 bp, Homo sapiens
gggactggcccacccctcttcc

SEQ ID NO: 599708 - DNA, 15 bp, Homo sapiens
gggagaatggctctg

SEQ ID NO: 599709 - DNA, 17 bp, Homo sapiens
gcccagtcttgagtggg

SEQ ID NO: 599710 - DNA, 23 bp, Homo sapiens
gcccagttagcccggccaaggac

SEQ ID NO: 599711 - DNA, 16 bp, Homo sapiens
gcccatcccctgcctc

SEQ ID NO: 599712 - DNA, 19 bp, Homo sapiens
gcccatcccctgcctctat

SEQ ID NO: 599713 - DNA, 14 bp, Homo sapiens
gcccatgctggctg

SEQ ID NO: 599714 - DNA, 15 bp, Homo sapiens
gcccatgctggctgg

SEQ ID NO: 599715 - DNA, 13 bp, Homo sapiens
gcccatggcccca

SEQ ID NO: 599716 - DNA, 14 bp, Homo sapiens
gcccatggccccag

SEQ ID NO: 599717 - DNA, 17 bp, Homo sapiens
gcccatggccccagctg

SEQ ID NO: 599718 - DNA, 19 bp, Homo sapiens
gcccatggccccagctggc

SEQ ID NO: 599719 - DNA, 17 bp, Homo sapiens
gcccatgtgtatggaag

SEQ ID NO: 599720 - DNA, 17 bp, Homo sapiens
gccccacaaggcccagc

SEQ ID NO: 599721 - DNA, 17 bp, Homo sapiens
gccccagagactgccca

SEQ ID NO: 599722 - DNA, 23 bp, Homo sapiens
gccccagagactgcccaccctgg

SEQ ID NO: 599723 - DNA, 20 bp, Homo sapiens
gccccagcccgacaggcatg

SEQ ID NO: 599724 - DNA, 13 bp, Homo sapiens
gccccagctctgg

SEQ ID NO: 599725 - DNA, 20 bp, Homo sapiens
gccccagctctggatgaagg

SEQ ID NO: 599726 - DNA, 14 bp, Homo sapiens
gccccagctggctg

SEQ ID NO: 599727 - DNA, 17 bp, Homo sapiens
gccccagctggctgggt

SEQ ID NO: 599728 - DNA, 18 bp, Homo sapiens
gccccagctggctgggtc

SEQ ID NO: 599729 - DNA, 19 bp, Homo sapiens
gccccagctggctgggtcg

SEQ ID NO: 599730 - DNA, 16 bp, Homo sapiens
gccccaggcccgccct

SEQ ID NO: 599731 - DNA, 15 bp, Homo sapiens
gccccagtggtgcgg

SEQ ID NO: 599732 - DNA, 23 bp, Homo sapiens
gccccatcgcctgggacgcccct

SEQ ID NO: 599733 - DNA, 21 bp, Homo sapiens
gcccccaaattgccttcagcc

SEQ ID NO: 599734 - DNA, 14 bp, Homo sapiens
gcccccacaggagc

SEQ ID NO: 599735 - DNA, 21 bp, Homo sapiens
gcccccacaggagcatgtcct

SEQ ID NO: 599736 - DNA, 15 bp, Homo sapiens
gcccccacaggagcg

SEQ ID NO: 599737 - DNA, 21 bp, Homo sapiens
gcccccacaggagcgtgtcct

SEQ ID NO: 599738 - DNA, 18 bp, Homo sapiens
gggagagcgccacccgcc

SEQ ID NO: 599739 - DNA, 11 bp, Homo sapiens
gggaggctgag

SEQ ID NO: 599740 - DNA, 21 bp, Homo sapiens
gggagtccactttcctctctc

SEQ ID NO: 599741 - DNA, 12 bp, Homo sapiens
gggataggaggg

SEQ ID NO: 599742 - DNA, 16 bp, Homo sapiens
gggatgcccctggccc

SEQ ID NO: 599743 - DNA, 23 bp, Homo sapiens
gggatgcccctggccctgcctca

SEQ ID NO: 599744 - DNA, 11 bp, Homo sapiens
gggattacaga

SEQ ID NO: 599745 - DNA, 23 bp, Homo sapiens
gggcaagagctcaggagaaggcc

SEQ ID NO: 599746 - DNA, 18 bp, Homo sapiens
gggcaaggaagctttgga

SEQ ID NO: 599747 - DNA, 17 bp, Homo sapiens
gggcaccctgcaggcag

SEQ ID NO: 599748 - DNA, 22 bp, Homo sapiens
gggcaccctgcaggcaggcaga

SEQ ID NO: 599749 - DNA, 20 bp, Homo sapiens
gcccccacccatgccagcgc

SEQ ID NO: 599750 - DNA, 20 bp, Homo sapiens
gcccccacccccgtcacccc

SEQ ID NO: 599751 - DNA, 12 bp, Homo sapiens
gcccccactgga

SEQ ID NO: 599752 - DNA, 15 bp, Homo sapiens
gcccccaggaccccc

SEQ ID NO: 599753 - DNA, 16 bp, Homo sapiens
gcccccaggacccccc

SEQ ID NO: 599754 - DNA, 14 bp, Homo sapiens
gccccccatgccct

SEQ ID NO: 599755 - DNA, 17 bp, Homo sapiens
gccccccggcctgatgg

SEQ ID NO: 599756 - DNA, 20 bp, Homo sapiens
gccccccggcctggccccct

SEQ ID NO: 599757 - DNA, 15 bp, Homo sapiens
gccccccttcccacc

SEQ ID NO: 599758 - DNA, 13 bp, Homo sapiens
gcccccgcccctc

SEQ ID NO: 599759 - DNA, 14 bp, Homo sapiens
gcccccgcccctcc

SEQ ID NO: 599760 - DNA, 18 bp, Homo sapiens
gcccccgcccctccccct

SEQ ID NO: 599761 - DNA, 18 bp, Homo sapiens
gcccccggaggcgcccac

SEQ ID NO: 599762 - DNA, 23 bp, Homo sapiens
gcccccggaggcgcccacctgcc

SEQ ID NO: 599763 - DNA, 16 bp, Homo sapiens
gcccccgggccctttc

SEQ ID NO: 599764 - DNA, 21 bp, Homo sapiens
gccccctcccccgcagacaga

SEQ ID NO: 599765 - DNA, 22 bp, Homo sapiens
gccccctcgcgcccctgtccat

SEQ ID NO: 599766 - DNA, 19 bp, Homo sapiens
gccccctggctttggcgcc

SEQ ID NO: 599767 - DNA, 12 bp, Homo sapiens
gccccctgtggc

SEQ ID NO: 599768 - DNA, 16 bp, Homo sapiens
gccccgcgaccacccc

SEQ ID NO: 599769 - DNA, 21 bp, Homo sapiens
gccccgcgaccacccctgtgc

SEQ ID NO: 599770 - DNA, 14 bp, Homo sapiens
gccccgcgcgtgcc

SEQ ID NO: 599771 - DNA, 17 bp, Homo sapiens
gccccgcgcgtgccccc

SEQ ID NO: 599772 - DNA, 20 bp, Homo sapiens
gccccgcgcgtgcccccagc

SEQ ID NO: 599773 - DNA, 21 bp, Homo sapiens
gccccgcgcgtgcccccagcg

SEQ ID NO: 599774 - DNA, 13 bp, Homo sapiens
gccccgcggagcc

SEQ ID NO: 599775 - DNA, 14 bp, Homo sapiens
gccccgcggagccc

SEQ ID NO: 599776 - DNA, 18 bp, Homo sapiens
gccccgcggagcccccgc

SEQ ID NO: 599777 - DNA, 19 bp, Homo sapiens
gccccgtgctcctctgccc

SEQ ID NO: 599778 - DNA, 15 bp, Homo sapiens
gcccctatcctgcac

SEQ ID NO: 599779 - DNA, 18 bp, Homo sapiens
gcccctatcctgcaccct

SEQ ID NO: 599780 - DNA, 19 bp, Homo sapiens
gcccctatcctgcaccctc

SEQ ID NO: 599781 - DNA, 20 bp, Homo sapiens
gcccctatcctgcaccctct

SEQ ID NO: 599782 - DNA, 13 bp, Homo sapiens
gcccctcagagaa

SEQ ID NO: 599783 - DNA, 13 bp, Homo sapiens
gcccctccccagc

SEQ ID NO: 599784 - DNA, 15 bp, Homo sapiens
gcccctccccagccc

SEQ ID NO: 599785 - DNA, 22 bp, Homo sapiens
gcccctccccagcccccaccca

SEQ ID NO: 599786 - DNA, 17 bp, Homo sapiens
gcccctccccagccctt

SEQ ID NO: 599787 - DNA, 13 bp, Homo sapiens
gcccctccccatg

SEQ ID NO: 599788 - DNA, 17 bp, Homo sapiens
gcccctccccatggtgc

SEQ ID NO: 599789 - DNA, 13 bp, Homo sapiens
gcccctccgtccc

SEQ ID NO: 599790 - DNA, 16 bp, Homo sapiens
gcccctccgtccccag

SEQ ID NO: 599791 - DNA, 16 bp, Homo sapiens
gcccctccttctcccc

SEQ ID NO: 599792 - DNA, 21 bp, Homo sapiens
gcccctctctgtttaccctcc

SEQ ID NO: 599793 - DNA, 23 bp, Homo sapiens
gcccctctctgtttaccctccct

SEQ ID NO: 599794 - DNA, 12 bp, Homo sapiens
gcccctctgcgc

SEQ ID NO: 599795 - DNA, 17 bp, Homo sapiens
gcccctcttccctggcc

SEQ ID NO: 599796 - DNA, 21 bp, Homo sapiens
gcccctgagggacgagcagag

SEQ ID NO: 599797 - DNA, 22 bp, Homo sapiens
gcccctgagggacgagcagagc

SEQ ID NO: 599798 - DNA, 21 bp, Homo sapiens
gcccctgcagtttggccctgg

SEQ ID NO: 599799 - DNA, 22 bp, Homo sapiens
gcccctgcagtttggccctgga

SEQ ID NO: 599800 - DNA, 23 bp, Homo sapiens
gcccctgcagtttggccctggag

SEQ ID NO: 599801 - DNA, 15 bp, Homo sapiens
gcccctgcccagcac

SEQ ID NO: 599802 - DNA, 16 bp, Homo sapiens
gcccctgcctgagacc

SEQ ID NO: 599803 - DNA, 15 bp, Homo sapiens
gcccctgtccatccg

SEQ ID NO: 599804 - DNA, 21 bp, Homo sapiens
gcccctgtgcagtagagagcc

SEQ ID NO: 599805 - DNA, 15 bp, Homo sapiens
gccccttgaccccac

SEQ ID NO: 599806 - DNA, 19 bp, Homo sapiens
gccccttgaccccacacgc

SEQ ID NO: 599807 - DNA, 24 bp, Homo sapiens
gcccgaggaggccgactgggctgc

SEQ ID NO: 599808 - DNA, 13 bp, Homo sapiens
gcccgaggcaccg

SEQ ID NO: 599809 - DNA, 15 bp, Homo sapiens
gcccgaggccagggc

SEQ ID NO: 599810 - DNA, 16 bp, Homo sapiens
gcccgaggccagggcc

SEQ ID NO: 599811 - DNA, 19 bp, Homo sapiens
ggcatccaccttcctgccc

SEQ ID NO: 599812 - DNA, 16 bp, Homo sapiens
ggcatccgagcccctg

SEQ ID NO: 599813 - DNA, 17 bp, Homo sapiens
ggcatccgagcccctgt

SEQ ID NO: 599814 - DNA, 18 bp, Homo sapiens
ggcatgtgatgagaggaa

SEQ ID NO: 599815 - DNA, 14 bp, Homo sapiens
ggcattgaccttca

SEQ ID NO: 599816 - DNA, 16 bp, Homo sapiens
ggcattgaccttcatg

SEQ ID NO: 599817 - DNA, 21 bp, Homo sapiens
ggccaagccagggttccagac

SEQ ID NO: 599818 - DNA, 20 bp, Homo sapiens
ggccaaggacactgatgggt

SEQ ID NO: 599819 - DNA, 19 bp, Homo sapiens
ggccacctgccaggcctcc

SEQ ID NO: 599820 - DNA, 19 bp, Homo sapiens
ggccagcgagtggtcaagg

SEQ ID NO: 599821 - DNA, 23 bp, Homo sapiens
ggccaggggcttctccccctcag

SEQ ID NO: 599822 - DNA, 16 bp, Homo sapiens
ggccagggtgggaaga

SEQ ID NO: 599823 - DNA, 15 bp, Homo sapiens
ggccaggtctggcgc

SEQ ID NO: 599824 - DNA, 18 bp, Homo sapiens
ggccaggtctggcgccag

SEQ ID NO: 599825 - DNA, 22 bp, Homo sapiens
ggccaggtctggcgccaggggc

SEQ ID NO: 599826 - DNA, 18 bp, Homo sapiens
ggccatttcacattcctg

SEQ ID NO: 599827 - DNA, 18 bp, Homo sapiens
ggccatttgctagttctg

SEQ ID NO: 599828 - DNA, 14 bp, Homo sapiens
ggcccacgcagagc

SEQ ID NO: 599829 - DNA, 15 bp, Homo sapiens
ggcccacgcagagcc

SEQ ID NO: 599830 - DNA, 18 bp, Homo sapiens
ggcccacgcagagccccg

SEQ ID NO: 599831 - DNA, 20 bp, Homo sapiens
ggcccacgcagagccccgga

SEQ ID NO: 599832 - DNA, 21 bp, Homo sapiens
ggcccacgcagagccccggag

SEQ ID NO: 599833 - DNA, 23 bp, Homo sapiens
ggcccacgcagagccccggagca

SEQ ID NO: 599834 - DNA, 16 bp, Homo sapiens
ggcccagccctgggca

SEQ ID NO: 599835 - DNA, 14 bp, Homo sapiens
ggcccagcctcttg

SEQ ID NO: 599836 - DNA, 14 bp, Homo sapiens
ggcccaggcccagc

SEQ ID NO: 599837 - DNA, 20 bp, Homo sapiens
ggcccaggcccagcctcttg

SEQ ID NO: 599838 - DNA, 11 bp, Homo sapiens
ggcccagggag

SEQ ID NO: 599839 - DNA, 12 bp, Homo sapiens
ggcccagggagg

SEQ ID NO: 599840 - DNA, 16 bp, Homo sapiens
ggcccatggccccagc

SEQ ID NO: 599841 - DNA, 14 bp, Homo sapiens
ggccccagctggct

SEQ ID NO: 599842 - DNA, 16 bp, Homo sapiens
ggccccagctggctgg

SEQ ID NO: 599843 - DNA, 18 bp, Homo sapiens
ggccccagctggctgggt

SEQ ID NO: 599844 - DNA, 22 bp, Homo sapiens
ggccccaggcggaggggcttgg

SEQ ID NO: 599845 - DNA, 21 bp, Homo sapiens
ggccccatcagaggctggggg

SEQ ID NO: 599846 - DNA, 23 bp, Homo sapiens
ggccccatcagaggctgggggag

SEQ ID NO: 599847 - DNA, 12 bp, Homo sapiens
ggcccccacagg

SEQ ID NO: 599848 - DNA, 20 bp, Homo sapiens
ggcccccggaggcgcccacc

SEQ ID NO: 599849 - DNA, 18 bp, Homo sapiens
ggccccgcgcgtgccccc

SEQ ID NO: 599850 - DNA, 19 bp, Homo sapiens
ggccccgcgcgtgccccca

SEQ ID NO: 599851 - DNA, 21 bp, Homo sapiens
ggccccgcgcgtgcccccagc

SEQ ID NO: 599852 - DNA, 11 bp, Homo sapiens
ggcccctcctt

SEQ ID NO: 599853 - DNA, 15 bp, Homo sapiens
ggcccgagcgcgtgc

SEQ ID NO: 599854 - DNA, 13 bp, Homo sapiens
ggcccgaggcacc

SEQ ID NO: 599855 - DNA, 16 bp, Homo sapiens
ggcccgaggcaccgga

SEQ ID NO: 599856 - DNA, 20 bp, Homo sapiens
ggcccgcactcaggagcaca

SEQ ID NO: 599857 - DNA, 15 bp, Homo sapiens
ggcccgccctgcccg

SEQ ID NO: 599858 - DNA, 18 bp, Homo sapiens
ggcccgctcaacctctca

SEQ ID NO: 599859 - DNA, 20 bp, Homo sapiens
ggcccgctcaacctctcaga

SEQ ID NO: 599860 - DNA, 15 bp, Homo sapiens
ggcccggcccacgca

SEQ ID NO: 599861 - DNA, 17 bp, Homo sapiens
ggcccgtgcgcagccgc

SEQ ID NO: 599862 - DNA, 13 bp, Homo sapiens
ggccctgcctcac

SEQ ID NO: 599863 - DNA, 15 bp, Homo sapiens
ggccctgcctcactg

SEQ ID NO: 599864 - DNA, 22 bp, Homo sapiens
ggccctgcctcactgtgacctg

SEQ ID NO: 599865 - DNA, 20 bp, Homo sapiens
ggccctggagccagggcaga

SEQ ID NO: 599866 - DNA, 21 bp, Homo sapiens
ggccctggagccagggcagag

SEQ ID NO: 599867 - DNA, 12 bp, Homo sapiens
ggccctggggtc

SEQ ID NO: 599868 - DNA, 19 bp, Homo sapiens
ggcccttacacccttgtcc

SEQ ID NO: 599869 - DNA, 23 bp, Homo sapiens
ggccgactgggctgctggggcag

SEQ ID NO: 599870 - DNA, 14 bp, Homo sapiens
ggccgcagggcgct

SEQ ID NO: 599871 - DNA, 17 bp, Homo sapiens
ggccgcagggcgctccg

SEQ ID NO: 599872 - DNA, 18 bp, Homo sapiens
ggccgcagggcgctccgg

SEQ ID NO: 599873 - DNA, 22 bp, Homo sapiens
ggccgccgaagggcagccccgc

SEQ ID NO: 599874 - DNA, 23 bp, Homo sapiens
ggccgccgaagggcagccccgcg

SEQ ID NO: 599875 - DNA, 19 bp, Homo sapiens
ggccgcctcctccagactc

SEQ ID NO: 599876 - DNA, 21 bp, Homo sapiens
ggccgctctccgccccccggc

SEQ ID NO: 599877 - DNA, 22 bp, Homo sapiens
ggccgctgcagtcagcacagag

SEQ ID NO: 599878 - DNA, 12 bp, Homo sapiens
ggccggctggcc

SEQ ID NO: 599879 - DNA, 22 bp, Homo sapiens
ggccggctggccggtccacccc

SEQ ID NO: 599880 - DNA, 18 bp, Homo sapiens
ggccggtaggctgctggc

SEQ ID NO: 599881 - DNA, 15 bp, Homo sapiens
ggcctaatccacctg

SEQ ID NO: 599882 - DNA, 23 bp, Homo sapiens
ggcctaatccacctggtggccct

SEQ ID NO: 599883 - DNA, 22 bp, Homo sapiens
ggcctcagggaccaaggagatg

SEQ ID NO: 599884 - DNA, 22 bp, Homo sapiens
ggcctccatgccccagctctgg

SEQ ID NO: 599885 - DNA, 22 bp, Homo sapiens
ggcctccccgggggtccccgga

SEQ ID NO: 599886 - DNA, 13 bp, Homo sapiens
ggcctcctagcct

SEQ ID NO: 599887 - DNA, 17 bp, Homo sapiens
ggcctcctagcctctcc

SEQ ID NO: 599888 - DNA, 14 bp, Homo sapiens
ggcctctgcccctc

SEQ ID NO: 599889 - DNA, 20 bp, Homo sapiens
ggcctctgcccctcttccct

SEQ ID NO: 599890 - DNA, 14 bp, Homo sapiens
ggcctgagaagagt

SEQ ID NO: 599891 - DNA, 18 bp, Homo sapiens
ggcctgagggaagcccac

SEQ ID NO: 599892 - DNA, 19 bp, Homo sapiens
ggcctgagggaagcccacc

SEQ ID NO: 599893 - DNA, 22 bp, Homo sapiens
ggcctgagggaagcccacccgc

SEQ ID NO: 599894 - DNA, 13 bp, Homo sapiens
ggcctgatggcca

SEQ ID NO: 599895 - DNA, 14 bp, Homo sapiens
gtaaaaccaggctg

SEQ ID NO: 599896 - DNA, 21 bp, Homo sapiens
gtaaaacttgtattggaagta

SEQ ID NO: 599897 - DNA, 15 bp, Homo sapiens
gtaaataaaaatagc

SEQ ID NO: 599898 - DNA, 15 bp, Homo sapiens
taaatctttgttaaa

SEQ ID NO: 599899 - DNA, 16 bp, Homo sapiens
taaatctttgttaaaa

SEQ ID NO: 599900 - DNA, 21 bp, Homo sapiens
taaatctttgttaaaatatag

SEQ ID NO: 599901 - DNA, 15 bp, Homo sapiens
taaatgaatgaaata

SEQ ID NO: 599902 - DNA, 17 bp, Homo sapiens
taaatgtcttcatgttg

SEQ ID NO: 599903 - DNA, 15 bp, Homo sapiens
taaattaacttctat

SEQ ID NO: 599904 - DNA, 18 bp, Homo sapiens
taaattaatttttcaatt

SEQ ID NO: 599905 - DNA, 20 bp, Homo sapiens
taaattaatttttcaatttc

SEQ ID NO: 599906 - DNA, 21 bp, Homo sapiens
taaattataatgcatctaaac

SEQ ID NO: 599907 - DNA, 21 bp, Homo sapiens
taaattatcattgtttgtcct

SEQ ID NO: 599908 - DNA, 19 bp, Homo sapiens
taaattcctaattctatga

SEQ ID NO: 599909 - DNA, 21 bp, Homo sapiens
taaattcctcctgtctcctct

SEQ ID NO: 599910 - DNA, 13 bp, Homo sapiens
taacaaattcagt

SEQ ID NO: 599911 - DNA, 22 bp, Homo sapiens
taacaatgttttttatacttca

SEQ ID NO: 599912 - DNA, 19 bp, Homo sapiens
taacactgcagccctctcc

SEQ ID NO: 599913 - DNA, 21 bp, Homo sapiens
taacagaaaaatgaaatttaa

SEQ ID NO: 599914 - DNA, 18 bp, Homo sapiens
taacagacattgttttgc

SEQ ID NO: 599915 - DNA, 20 bp, Homo sapiens
taatttgccagacagagatc

SEQ ID NO: 599916 - DNA, 15 bp, Homo sapiens
taatttgtgaaagtg

SEQ ID NO: 599917 - DNA, 13 bp, Homo sapiens
taatttttattca

SEQ ID NO: 599918 - DNA, 14 bp, Homo sapiens
taatttttttattg

SEQ ID NO: 599919 - DNA, 15 bp, Homo sapiens
taatttttttattgt

SEQ ID NO: 599920 - DNA, 16 bp, Homo sapiens
taatttttttattgtt

SEQ ID NO: 599921 - DNA, 18 bp, Homo sapiens
taatttttttattgttta

SEQ ID NO: 599922 - DNA, 12 bp, Homo sapiens
tacaaaatgaat

SEQ ID NO: 599923 - DNA, 18 bp, Homo sapiens
tacaaaatgaattgcctt

SEQ ID NO: 599924 - DNA, 15 bp, Homo sapiens
tacaaacaggtgcta

SEQ ID NO: 599925 - DNA, 13 bp, Homo sapiens
tacaaagaaacaa

SEQ ID NO: 599926 - DNA, 13 bp, Homo sapiens
tacaaagccagct

SEQ ID NO: 599927 - DNA, 12 bp, Homo sapiens
tacaaagctgtc

SEQ ID NO: 599928 - DNA, 14 bp, Homo sapiens
tacaaagctgtcac

SEQ ID NO: 599929 - DNA, 15 bp, Homo sapiens
tacaaagctgtcact

SEQ ID NO: 599930 - DNA, 16 bp, Homo sapiens
tacaaagctgtcactc

SEQ ID NO: 599931 - DNA, 19 bp, Homo sapiens
tacaaataatattgccttg

SEQ ID NO: 599932 - DNA, 22 bp, Homo sapiens
tacaacaagcaaactgaaatta

SEQ ID NO: 599933 - DNA, 18 bp, Homo sapiens
tacaacacattgaaactg

SEQ ID NO: 599934 - DNA, 20 bp, Homo sapiens
tacaacacattgaaactgta

SEQ ID NO: 599935 - DNA, 18 bp, Homo sapiens
tacaacttccagatttga

SEQ ID NO: 599936 - DNA, 14 bp, Homo sapiens
tacaagctacatat

SEQ ID NO: 599937 - DNA, 13 bp, Homo sapiens
tacaagtgtttct

SEQ ID NO: 599938 - DNA, 13 bp, Homo sapiens
tacaataagtgtt

SEQ ID NO: 599939 - DNA, 18 bp, Homo sapiens
tacaatacaacacattga

SEQ ID NO: 599940 - DNA, 19 bp, Homo sapiens
tacaattctttgttgctta

SEQ ID NO: 599941 - DNA, 21 bp, Homo sapiens
tacaattctttgttgcttaat

SEQ ID NO: 599942 - DNA, 21 bp, Homo sapiens
tacacaatcgtattacataaa

SEQ ID NO: 599943 - DNA, 13 bp, Homo sapiens
tacacacacagac

SEQ ID NO: 599944 - DNA, 19 bp, Homo sapiens
tacacacacagacacacaa

SEQ ID NO: 599945 - DNA, 16 bp, Homo sapiens
tacacatacatatata

SEQ ID NO: 599946 - DNA, 19 bp, Homo sapiens
tacacatataaacacagta

SEQ ID NO: 599947 - DNA, 14 bp, Homo sapiens
tacacgaagaaata

SEQ ID NO: 599948 - DNA, 18 bp, Homo sapiens
tacacgaagaaatagaat

SEQ ID NO: 599949 - DNA, 14 bp, Homo sapiens
tacacgtgtatatg

SEQ ID NO: 599950 - DNA, 16 bp, Homo sapiens
tacacgtgtatatgag

SEQ ID NO: 599951 - DNA, 21 bp, Homo sapiens
tacagaaccagcactcccagg

SEQ ID NO: 599952 - DNA, 22 bp, Homo sapiens
tacagaaccagcactcccaggg

SEQ ID NO: 599953 - DNA, 13 bp, Homo sapiens
tacagacctccag

SEQ ID NO: 599954 - DNA, 23 bp, Homo sapiens
tacagagaactaacactatttta

SEQ ID NO: 599955 - DNA, 16 bp, Homo sapiens
tacagatcctccgcgg

SEQ ID NO: 599956 - DNA, 22 bp, Homo sapiens
tacagatggtgtcctgcatgta

SEQ ID NO: 599957 - DNA, 19 bp, Homo sapiens
tacaggctgagacacagcc

SEQ ID NO: 599958 - DNA, 15 bp, Homo sapiens
tacaggggaggctga

SEQ ID NO: 599959 - DNA, 18 bp, Homo sapiens
tacaggttttatgagact

SEQ ID NO: 599960 - DNA, 15 bp, Homo sapiens
tacagtggcagtatt

SEQ ID NO: 599961 - DNA, 20 bp, Homo sapiens
tacataaagtaataactgtt

SEQ ID NO: 599962 - DNA, 16 bp, Homo sapiens
tacataacaggcattg

SEQ ID NO: 599963 - DNA, 19 bp, Homo sapiens
tacatacgcaattgtatat

SEQ ID NO: 599964 - DNA, 21 bp, Homo sapiens
tacatagctttagagaagcca

SEQ ID NO: 599965 - DNA, 15 bp, Homo sapiens
tacatcattttttgt

SEQ ID NO: 599966 - DNA, 18 bp, Homo sapiens
tacatcattttttgtttc

SEQ ID NO: 599967 - DNA, 20 bp, Homo sapiens
tacatcattttttgtttctt

SEQ ID NO: 599968 - DNA, 23 bp, Homo sapiens
tacatcattttttgtttcttcct

SEQ ID NO: 599969 - DNA, 13 bp, Homo sapiens
tacatcctctgct

SEQ ID NO: 599970 - DNA, 22 bp, Homo sapiens
tacatctgaaatctacaacata

SEQ ID NO: 599971 - DNA, 15 bp, Homo sapiens
tacatgatgatttca

SEQ ID NO: 599972 - DNA, 17 bp, Homo sapiens
tacatgatgatttcaga

SEQ ID NO: 599973 - DNA, 22 bp, Homo sapiens
tacatgatgatttcagaaacaa

SEQ ID NO: 599974 - DNA, 17 bp, Homo sapiens
tacatgggccagccctt

SEQ ID NO: 599975 - DNA, 23 bp, Homo sapiens
tacatgggccagcccttgctcta

SEQ ID NO: 599976 - DNA, 13 bp, Homo sapiens
tacatggtatctc

SEQ ID NO: 599977 - DNA, 19 bp, Homo sapiens
tacattcggaggtcaagaa

SEQ ID NO: 599978 - DNA, 13 bp, Homo sapiens
tacattgtcctgt

SEQ ID NO: 599979 - DNA, 15 bp, Homo sapiens
tacatttatgtgtga

SEQ ID NO: 599980 - DNA, 22 bp, Homo sapiens
tacattttgcagctatggacaa

SEQ ID NO: 599981 - DNA, 22 bp, Homo sapiens
taccaactaagttgtattttaa

SEQ ID NO: 599982 - DNA, 20 bp, Homo sapiens
taccacaggatgcatattaa

SEQ ID NO: 599983 - DNA, 18 bp, Homo sapiens
taccagcaaaagtgcagt

SEQ ID NO: 599984 - DNA, 20 bp, Homo sapiens
taccatgttaatacatcatt

SEQ ID NO: 599985 - DNA, 16 bp, Homo sapiens
taccattttgaaatat

SEQ ID NO: 599986 - DNA, 23 bp, Homo sapiens
taccccagcctcgttggagagca

SEQ ID NO: 599987 - DNA, 20 bp, Homo sapiens
taccctaggtctccacccct

SEQ ID NO: 599988 - DNA, 13 bp, Homo sapiens
taccctccctgtc

SEQ ID NO: 599989 - DNA, 17 bp, Homo sapiens
taccctccctgtcccct

SEQ ID NO: 599990 - DNA, 19 bp, Homo sapiens
taccctcttctcagctcca

SEQ ID NO: 599991 - DNA, 22 bp, Homo sapiens
taccctcttctcagctccactc

SEQ ID NO: 599992 - DNA, 18 bp, Homo sapiens
tacctattgctgtaaata

SEQ ID NO: 599993 - DNA, 18 bp, Homo sapiens
tacctctgcataaatatt

SEQ ID NO: 599994 - DNA, 14 bp, Homo sapiens
tacctgaaagccct

SEQ ID NO: 599995 - DNA, 20 bp, Homo sapiens
tacctggccggtaggctgct

SEQ ID NO: 599996 - DNA, 22 bp, Homo sapiens
tacctggccggtaggctgctgg

SEQ ID NO: 599997 - DNA, 14 bp, Homo sapiens
tacctgtacacaca

SEQ ID NO: 599998 - DNA, 15 bp, Homo sapiens
tacctgtacacacac

SEQ ID NO: 599999 - DNA, 16 bp, Homo sapiens
tacctgtacacacaca

SEQ ID NO: 600000 - DNA, 18 bp, Homo sapiens
tacctgtacacacacaga

SEQ ID NO: 600001 - DNA, 17 bp, Homo sapiens
tacctgttctctagttt

SEQ ID NO: 600002 - DNA, 20 bp, Homo sapiens
taccttctgatgaagttgta

SEQ ID NO: 600003 - DNA, 19 bp, Homo sapiens
tacgaggcttctctaaccc

SEQ ID NO: 600004 - DNA, 16 bp, Homo sapiens
tacgcaattgtatata

SEQ ID NO: 600005 - DNA, 18 bp, Homo sapiens
tacgcaattgtatatata

SEQ ID NO: 600006 - DNA, 20 bp, Homo sapiens
tacgcaattgtatatatatg

SEQ ID NO: 600007 - DNA, 14 bp, Homo sapiens
tataaatgttttaa

SEQ ID NO: 600008 - DNA, 15 bp, Homo sapiens
tataaatgttttaaa

SEQ ID NO: 600009 - DNA, 13 bp, Homo sapiens
tataacattgtat

SEQ ID NO: 600010 - DNA, 15 bp, Homo sapiens
tataagccaatgaag

SEQ ID NO: 600011 - DNA, 14 bp, Homo sapiens
tataatttcaattt

SEQ ID NO: 600012 - DNA, 15 bp, Homo sapiens
tataatttcaatttt

SEQ ID NO: 600013 - DNA, 13 bp, Homo sapiens
tatacaagtgttt

SEQ ID NO: 600014 - DNA, 15 bp, Homo sapiens
tatacaagtgtttct

SEQ ID NO: 600015 - DNA, 22 bp, Homo sapiens
tatacaagtgtttctagtaaca

SEQ ID NO: 600016 - DNA, 12 bp, Homo sapiens
tatacacacagg

SEQ ID NO: 600017 - DNA, 11 bp, Homo sapiens
tatacagacct

SEQ ID NO: 600018 - DNA, 18 bp, Homo sapiens
tatacagacctccagatt

SEQ ID NO: 600019 - DNA, 16 bp, Homo sapiens
tatacagtgtgtagtt

SEQ ID NO: 600020 - DNA, 23 bp, Homo sapiens
tatacatacgcaattgtatatat

SEQ ID NO: 600021 - DNA, 17 bp, Homo sapiens
tataccagcaaaagtgc

SEQ ID NO: 600022 - DNA, 16 bp, Homo sapiens
tatacctgtacacaca

SEQ ID NO: 600023 - DNA, 18 bp, Homo sapiens
tatacctgtacacacaca

SEQ ID NO: 600024 - DNA, 14 bp, Homo sapiens
tatactcatttgga

SEQ ID NO: 600025 - DNA, 14 bp, Homo sapiens
tatacttcaaatgt

SEQ ID NO: 600026 - DNA, 16 bp, Homo sapiens
tatagagacttctaaa

SEQ ID NO: 600027 - DNA, 13 bp, Homo sapiens
tatagagttcata

SEQ ID NO: 600028 - DNA, 17 bp, Homo sapiens
tatagagttcatagaaa

SEQ ID NO: 600029 - DNA, 20 bp, Homo sapiens
tatagataaatccaatagtc

SEQ ID NO: 600030 - DNA, 22 bp, Homo sapiens
tatagataaatccaatagtctg

SEQ ID NO: 600031 - DNA, 15 bp, Homo sapiens
tatagcatgtaatat

SEQ ID NO: 600032 - DNA, 20 bp, Homo sapiens
tataggacttaatttagcag

SEQ ID NO: 600033 - DNA, 14 bp, Homo sapiens
tatagtctgtactt

SEQ ID NO: 600034 - DNA, 15 bp, Homo sapiens
tatagtctgtacttc

SEQ ID NO: 600035 - DNA, 24 bp, Homo sapiens
tatagtctgtacttcagttctcat

SEQ ID NO: 600036 - DNA, 21 bp, Homo sapiens
tatataaaatacacgtgtata

SEQ ID NO: 600037 - DNA, 22 bp, Homo sapiens
tatataaaatacacgtgtatat

SEQ ID NO: 600038 - DNA, 14 bp, Homo sapiens
tatataatcaaaat

SEQ ID NO: 600039 - DNA, 17 bp, Homo sapiens
tatatataaaatacacg

SEQ ID NO: 600040 - DNA, 14 bp, Homo sapiens
tatatataaatatc

SEQ ID NO: 600041 - DNA, 15 bp, Homo sapiens
tatatatatgtatat

SEQ ID NO: 600042 - DNA, 20 bp, Homo sapiens
tatatatgtgaactttctca

SEQ ID NO: 600043 - DNA, 17 bp, Homo sapiens
tatatattttgaaagga

SEQ ID NO: 600044 - DNA, 19 bp, Homo sapiens
tatatattttgaaaggaga

SEQ ID NO: 600045 - DNA, 12 bp, Homo sapiens
tatatctgaaaa

SEQ ID NO: 600046 - DNA, 17 bp, Homo sapiens
tatatgaagcagaatga

SEQ ID NO: 600047 - DNA, 18 bp, Homo sapiens
tatatgaggatgtatgtg

SEQ ID NO: 600048 - DNA, 14 bp, Homo sapiens
tatatgattaaatt

SEQ ID NO: 600049 - DNA, 19 bp, Homo sapiens
tatatgtaacttcagatgt

SEQ ID NO: 600050 - DNA, 20 bp, Homo sapiens
tatatgtatatatttattat

SEQ ID NO: 600051 - DNA, 14 bp, Homo sapiens
tatatgtatatctg

SEQ ID NO: 600052 - DNA, 18 bp, Homo sapiens
tatatgtttatacacaca

SEQ ID NO: 600053 - DNA, 16 bp, Homo sapiens
tatattattttctgta

SEQ ID NO: 600054 - DNA, 22 bp, Homo sapiens
tatattccgggtgccattccca

SEQ ID NO: 600055 - DNA, 17 bp, Homo sapiens
tatattctgcagaaaat

SEQ ID NO: 600056 - DNA, 19 bp, Homo sapiens
tatatttactgtttataat

SEQ ID NO: 600057 - DNA, 13 bp, Homo sapiens
tatatttatcata

SEQ ID NO: 600058 - DNA, 13 bp, Homo sapiens
tatcaaaaaacag

SEQ ID NO: 600059 - DNA, 19 bp, Homo sapiens
tatcaaaaaacagaaaaac

SEQ ID NO: 600060 - DNA, 15 bp, Homo sapiens
tatcacagtctaatt

SEQ ID NO: 600061 - DNA, 20 bp, Homo sapiens
tatcagaactcctttctaag

SEQ ID NO: 600062 - DNA, 20 bp, Homo sapiens
tatcagggcccaaataacag

SEQ ID NO: 600063 - DNA, 17 bp, Homo sapiens
tatcagtacaattcttt

SEQ ID NO: 600064 - DNA, 20 bp, Homo sapiens
tatcagtacaattctttgtt

SEQ ID NO: 600065 - DNA, 21 bp, Homo sapiens
tatcagtggttcgggggaaat

SEQ ID NO: 600066 - DNA, 17 bp, Homo sapiens
tatcagttacagtggca

SEQ ID NO: 600067 - DNA, 23 bp, Homo sapiens
tatcatacgttgatagtttacaa

SEQ ID NO: 600068 - DNA, 13 bp, Homo sapiens
tatcatatttaat

SEQ ID NO: 600069 - DNA, 21 bp, Homo sapiens
tatcatggcagcatgcgatgt

SEQ ID NO: 600070 - DNA, 16 bp, Homo sapiens
tatcattatagcatgt

SEQ ID NO: 600071 - DNA, 21 bp, Homo sapiens
tatcattcttataacattgta

SEQ ID NO: 600072 - DNA, 22 bp, Homo sapiens
tatcattcttataacattgtat

SEQ ID NO: 600073 - DNA, 17 bp, Homo sapiens
tatccctggccacctgc

SEQ ID NO: 600074 - DNA, 21 bp, Homo sapiens
tatccctggccacctgccagg

SEQ ID NO: 600075 - DNA, 20 bp, Homo sapiens
tatcctcaagttgtgtgcta

SEQ ID NO: 600076 - DNA, 15 bp, Homo sapiens
tatcctcaattatct

SEQ ID NO: 600077 - DNA, 20 bp, Homo sapiens
tatcctgcaccctctgctat

SEQ ID NO: 600078 - DNA, 17 bp, Homo sapiens
tatctatttatctgtct

SEQ ID NO: 600079 - DNA, 18 bp, Homo sapiens
tatctatttatctgtctg

SEQ ID NO: 600080 - DNA, 12 bp, Homo sapiens
tatctcccacaa

SEQ ID NO: 600081 - DNA, 16 bp, Homo sapiens
tatctcctttaatata

SEQ ID NO: 600082 - DNA, 14 bp, Homo sapiens
tatctgaaaactgg

SEQ ID NO: 600083 - DNA, 16 bp, Homo sapiens
tatctgaaaactggaa

SEQ ID NO: 600084 - DNA, 16 bp, Homo sapiens
tatctgggttttagaa

SEQ ID NO: 600085 - DNA, 15 bp, Homo sapiens
tatctgtctgagccc

SEQ ID NO: 600086 - DNA, 12 bp, Homo sapiens
tatctgtcttta

SEQ ID NO: 600087 - DNA, 21 bp, Homo sapiens
tatctgtctttatgatttcat

SEQ ID NO: 600088 - DNA, 13 bp, Homo sapiens
tatctgtggtctt

SEQ ID NO: 600089 - DNA, 13 bp, Homo sapiens
tatcttaaaaggg

SEQ ID NO: 600090 - DNA, 14 bp, Homo sapiens
gggtctcgcagcct

SEQ ID NO: 600091 - DNA, 14 bp, Homo sapiens
gggtctctgagcag

SEQ ID NO: 600092 - DNA, 22 bp, Homo sapiens
gggtgcaggcgcgcaccgccca

SEQ ID NO: 600093 - DNA, 20 bp, Homo sapiens
gggtgccccacaaggcccag

SEQ ID NO: 600094 - DNA, 21 bp, Homo sapiens
gggtgccccacaaggcccagc

SEQ ID NO: 600095 - DNA, 12 bp, Homo sapiens
gggtgcccctgg

SEQ ID NO: 600096 - DNA, 14 bp, Homo sapiens
gggtgcccctggga

SEQ ID NO: 600097 - DNA, 17 bp, Homo sapiens
tcaattgcttgagcatg

SEQ ID NO: 600098 - DNA, 24 bp, Homo sapiens
tcaattgcttgagcatgcccaaat

SEQ ID NO: 600099 - DNA, 13 bp, Homo sapiens
tcaatttaaagga

SEQ ID NO: 600100 - DNA, 14 bp, Homo sapiens
tcaatttcagaaac

SEQ ID NO: 600101 - DNA, 23 bp, Homo sapiens
tcacaaaaggctggatgtgcttt

SEQ ID NO: 600102 - DNA, 19 bp, Homo sapiens
tcacaaagctatttaagtg

SEQ ID NO: 600103 - DNA, 20 bp, Homo sapiens
tcacacaactgtggataaat

SEQ ID NO: 600104 - DNA, 24 bp, Homo sapiens
tcacaccagttacttgtgttcatt

SEQ ID NO: 600105 - DNA, 17 bp, Homo sapiens
tcacaccggcactgtgc

SEQ ID NO: 600106 - DNA, 19 bp, Homo sapiens
tcacaccttacaaagccag

SEQ ID NO: 600107 - DNA, 14 bp, Homo sapiens
tcacacttgggctg

SEQ ID NO: 600108 - DNA, 20 bp, Homo sapiens
tcacagatttccaaaagtac

SEQ ID NO: 600109 - DNA, 15 bp, Homo sapiens
tcacagcctctccct

SEQ ID NO: 600110 - DNA, 22 bp, Homo sapiens
tcacagtgggcggcttccctgc

SEQ ID NO: 600111 - DNA, 22 bp, Homo sapiens
tcacatctgtatatcagctcta

SEQ ID NO: 600112 - DNA, 21 bp, Homo sapiens
tcacatgaacatactggctgg

SEQ ID NO: 600113 - DNA, 13 bp, Homo sapiens
tcacattcctgac

SEQ ID NO: 600114 - DNA, 21 bp, Homo sapiens
tcacattcctgaccctcactt

SEQ ID NO: 600115 - DNA, 22 bp, Homo sapiens
tcaccccaccccaccccacctc

SEQ ID NO: 600116 - DNA, 15 bp, Homo sapiens
tcaccgaaaacgtgg

SEQ ID NO: 600117 - DNA, 16 bp, Homo sapiens
tcacctctgaggacag

SEQ ID NO: 600118 - DNA, 14 bp, Homo sapiens
tcaccttctgtgca

SEQ ID NO: 600119 - DNA, 16 bp, Homo sapiens
tcacgcaacttgaaat

SEQ ID NO: 600120 - DNA, 14 bp, Homo sapiens
tcacgtctgtgagt

SEQ ID NO: 600121 - DNA, 21 bp, Homo sapiens
tcacgtgaggcccctgtgcag

SEQ ID NO: 600122 - DNA, 18 bp, Homo sapiens
tcactacatgggccagcc

SEQ ID NO: 600123 - DNA, 19 bp, Homo sapiens
tcactacatgggccagccc

SEQ ID NO: 600124 - DNA, 18 bp, Homo sapiens
tcactccactcccctcat

SEQ ID NO: 600125 - DNA, 12 bp, Homo sapiens
tcactctccttg

SEQ ID NO: 600126 - DNA, 14 bp, Homo sapiens
tcactctccttggt

SEQ ID NO: 600127 - DNA, 23 bp, Homo sapiens
tcactctccttggtgtcgggcat

SEQ ID NO: 600128 - DNA, 23 bp, Homo sapiens
tcactgtcatgtgcgaacacagt

SEQ ID NO: 600129 - DNA, 23 bp, Homo sapiens
tcacttaaaatcaaatttttctg

SEQ ID NO: 600130 - DNA, 22 bp, Homo sapiens
tcacttgtggcagcttccctga

SEQ ID NO: 600131 - DNA, 20 bp, Homo sapiens
tcactttaatttagaagata

SEQ ID NO: 600132 - DNA, 16 bp, Homo sapiens
tcacttttctcatctg

SEQ ID NO: 600133 - DNA, 17 bp, Homo sapiens
tcacttttttataaatt

SEQ ID NO: 600134 - DNA, 13 bp, Homo sapiens
tcacttttttcct

SEQ ID NO: 600135 - DNA, 17 bp, Homo sapiens
tcacttttttcctgtca

SEQ ID NO: 600136 - DNA, 14 bp, Homo sapiens
tcagaaaagcacct

SEQ ID NO: 600137 - DNA, 21 bp, Homo sapiens
tcagaaaagcacctcttgaag

SEQ ID NO: 600138 - DNA, 16 bp, Homo sapiens
tcagaaacaatttctg

SEQ ID NO: 600139 - DNA, 21 bp, Homo sapiens
tcagaaagggcagcccctccc

SEQ ID NO: 600140 - DNA, 17 bp, Homo sapiens
tcagaactcctttctaa

SEQ ID NO: 600141 - DNA, 17 bp, Homo sapiens
tcagaattgtttttaga

SEQ ID NO: 600142 - DNA, 15 bp, Homo sapiens
tcagacacctagact

SEQ ID NO: 600143 - DNA, 17 bp, Homo sapiens
tcagactctctcctctc

SEQ ID NO: 600144 - DNA, 20 bp, Homo sapiens
tcagagaatgatcaccctga

SEQ ID NO: 600145 - DNA, 16 bp, Homo sapiens
tcagaggagaggagca

SEQ ID NO: 600146 - DNA, 16 bp, Homo sapiens
tcagaggctgggggag

SEQ ID NO: 600147 - DNA, 12 bp, Homo sapiens
tcagatccctcg

SEQ ID NO: 600148 - DNA, 22 bp, Homo sapiens
tcagatccctcggtcagcaccg

SEQ ID NO: 600149 - DNA, 14 bp, Homo sapiens
tcagatgtttccaa

SEQ ID NO: 600150 - DNA, 16 bp, Homo sapiens
tcagattgtaaaggta

SEQ ID NO: 600151 - DNA, 21 bp, Homo sapiens
tcagcaaattaattggcagca

SEQ ID NO: 600152 - DNA, 14 bp, Homo sapiens
tcagcaacatcatt

SEQ ID NO: 600153 - DNA, 19 bp, Homo sapiens
tcagcagcggcagcagcag

SEQ ID NO: 600154 - DNA, 23 bp, Homo sapiens
tcagcaggggggttgggttccag

SEQ ID NO: 600155 - DNA, 12 bp, Homo sapiens
tcagcatatata

SEQ ID NO: 600156 - DNA, 20 bp, Homo sapiens
tcagcatatatataaaatac

SEQ ID NO: 600157 - DNA, 21 bp, Homo sapiens
tcagcatatatataaaataca

SEQ ID NO: 600158 - DNA, 16 bp, Homo sapiens
tcagcatcctggaaat

SEQ ID NO: 600159 - DNA, 14 bp, Homo sapiens
tcagcattcccaat

SEQ ID NO: 600160 - DNA, 20 bp, Homo sapiens
tcagccagtggcacaggaga

SEQ ID NO: 600161 - DNA, 23 bp, Homo sapiens
tcagcgtctccccatgctgggct

SEQ ID NO: 600162 - DNA, 22 bp, Homo sapiens
tcagctcagcattgtgtacaaa

SEQ ID NO: 600163 - DNA, 14 bp, Homo sapiens
tcagctccactctg

SEQ ID NO: 600164 - DNA, 15 bp, Homo sapiens
tcagctccactctga

SEQ ID NO: 600165 - DNA, 15 bp, Homo sapiens
tcagctctaaagcag

SEQ ID NO: 600166 - DNA, 15 bp, Homo sapiens
tcaggaaatttttgc

SEQ ID NO: 600167 - DNA, 23 bp, Homo sapiens
tcaggaaatttttgcatgtttaa

SEQ ID NO: 600168 - DNA, 23 bp, Homo sapiens
tcaggaatggggggcgggccagg

SEQ ID NO: 600169 - DNA, 17 bp, Homo sapiens
tcaggaggggtgttaaa

SEQ ID NO: 600170 - DNA, 14 bp, Homo sapiens
tcccaagtcaaaca

SEQ ID NO: 600171 - DNA, 15 bp, Homo sapiens
tcccaagtcctcgcc

SEQ ID NO: 600172 - DNA, 22 bp, Homo sapiens
tcccaagtcctcgccccccgcc

SEQ ID NO: 600173 - DNA, 21 bp, Homo sapiens
tcccaattatcaaaaaacaga

SEQ ID NO: 600174 - DNA, 21 bp, Homo sapiens
tcccacaaataagttcccatt

SEQ ID NO: 600175 - DNA, 16 bp, Homo sapiens
tcccacactgtgaact

SEQ ID NO: 600176 - DNA, 20 bp, Homo sapiens
tcccacccccagcagctcac

SEQ ID NO: 600177 - DNA, 14 bp, Homo sapiens
tcccagctacaggg

SEQ ID NO: 600178 - DNA, 22 bp, Homo sapiens
tcccagctacaggggaggctga

SEQ ID NO: 600179 - DNA, 15 bp, Homo sapiens
tcccagctggcagcg

SEQ ID NO: 600180 - DNA, 17 bp, Homo sapiens
tcccagctggcagcgcc

SEQ ID NO: 600181 - DNA, 18 bp, Homo sapiens
tcccagctggcagcgcct

SEQ ID NO: 600182 - DNA, 21 bp, Homo sapiens
tcccagctggcagcgcctccc

SEQ ID NO: 600183 - DNA, 22 bp, Homo sapiens
tcccagctggcagcgcctcccg

SEQ ID NO: 600184 - DNA, 11 bp, Homo sapiens
tcccagggccc

SEQ ID NO: 600185 - DNA, 15 bp, Homo sapiens
tcccagggcccgagc

SEQ ID NO: 600186 - DNA, 22 bp, Homo sapiens
tcccagggcccgagcgcgtgcc

SEQ ID NO: 600187 - DNA, 14 bp, Homo sapiens
tcccagtgaataaa

SEQ ID NO: 600188 - DNA, 15 bp, Homo sapiens
tcccatggccttccc

SEQ ID NO: 600189 - DNA, 20 bp, Homo sapiens
tcccatggtagactgtgaca

SEQ ID NO: 600190 - DNA, 16 bp, Homo sapiens
tcccatttccttgtct

SEQ ID NO: 600191 - DNA, 18 bp, Homo sapiens
tcccatttccttgtctaa

SEQ ID NO: 600192 - DNA, 20 bp, Homo sapiens
tccccacagtcctcacagcc

SEQ ID NO: 600193 - DNA, 18 bp, Homo sapiens
tccccaccctcccctctc

SEQ ID NO: 600194 - DNA, 22 bp, Homo sapiens
tccccaccctcccctctcctga

SEQ ID NO: 600195 - DNA, 16 bp, Homo sapiens
tccccagagccctgca

SEQ ID NO: 600196 - DNA, 12 bp, Homo sapiens
tccccagccccc

SEQ ID NO: 600197 - DNA, 15 bp, Homo sapiens
tccccagccctttgc

SEQ ID NO: 600198 - DNA, 20 bp, Homo sapiens
tccccagttaatgtgccaaa

SEQ ID NO: 600199 - DNA, 16 bp, Homo sapiens
tccccatcgccttctg

SEQ ID NO: 600200 - DNA, 18 bp, Homo sapiens
tccccatcgccttctggc

SEQ ID NO: 600201 - DNA, 17 bp, Homo sapiens
tccccatgctcagctca

SEQ ID NO: 600202 - DNA, 20 bp, Homo sapiens
tccccatggtgcagtgaaga

SEQ ID NO: 600203 - DNA, 15 bp, Homo sapiens
tccccattcagtgac

SEQ ID NO: 600204 - DNA, 21 bp, Homo sapiens
tcccccaggctgcgcctgccc

SEQ ID NO: 600205 - DNA, 12 bp, Homo sapiens
tcccccctgagt

SEQ ID NO: 600206 - DNA, 12 bp, Homo sapiens
tccccctcagct

SEQ ID NO: 600207 - DNA, 16 bp, Homo sapiens
tccccctcagctctcc

SEQ ID NO: 600208 - DNA, 13 bp, Homo sapiens
tccccctcctgca

SEQ ID NO: 600209 - DNA, 20 bp, Homo sapiens
tccccgcccgccctcctctg

SEQ ID NO: 600210 - DNA, 22 bp, Homo sapiens
tccccggaccggacgcatgcag

SEQ ID NO: 600211 - DNA, 18 bp, Homo sapiens
tccccggacgcatgcagg

SEQ ID NO: 600212 - DNA, 20 bp, Homo sapiens
tccccggacgcatgcagggc

SEQ ID NO: 600213 - DNA, 16 bp, Homo sapiens
tccccgtgctcacagt

SEQ ID NO: 600214 - DNA, 13 bp, Homo sapiens
tcccctccagacc

SEQ ID NO: 600215 - DNA, 16 bp, Homo sapiens
tcccctgcatggctga

SEQ ID NO: 600216 - DNA, 19 bp, Homo sapiens
tcccgcagcaccagcctga

SEQ ID NO: 600217 - DNA, 15 bp, Homo sapiens
tcccgccgcctcggg

SEQ ID NO: 600218 - DNA, 17 bp, Homo sapiens
tcccggtgtatgcagtg

SEQ ID NO: 600219 - DNA, 15 bp, Homo sapiens
tcccggtgtgcagcg

SEQ ID NO: 600220 - DNA, 14 bp, Homo sapiens
tcccgtccgtccgc

SEQ ID NO: 600221 - DNA, 19 bp, Homo sapiens
tcccgtggctttgtgctta

SEQ ID NO: 600222 - DNA, 15 bp, Homo sapiens
tccctaaacatagtg

SEQ ID NO: 600223 - DNA, 22 bp, Homo sapiens
tccctaaacatagtggtatttt

SEQ ID NO: 600224 - DNA, 19 bp, Homo sapiens
tccctaccctcttctcagc

SEQ ID NO: 600225 - DNA, 15 bp, Homo sapiens
tccctaggcctgagt

SEQ ID NO: 600226 - DNA, 21 bp, Homo sapiens
tccctcacacctcccttcatc

SEQ ID NO: 600227 - DNA, 22 bp, Homo sapiens
tccctcacccactttggcctcc

SEQ ID NO: 600228 - DNA, 16 bp, Homo sapiens
tccctcagccctcatt

SEQ ID NO: 600229 - DNA, 15 bp, Homo sapiens
tccctccacacctcc

SEQ ID NO: 600230 - DNA, 18 bp, Homo sapiens
tccctccactcctcccaa

SEQ ID NO: 600231 - DNA, 12 bp, Homo sapiens
tccctccctcca

SEQ ID NO: 600232 - DNA, 17 bp, Homo sapiens
tccctccctccacacct

SEQ ID NO: 600233 - DNA, 16 bp, Homo sapiens
tccctccctccctgct

SEQ ID NO: 600234 - DNA, 15 bp, Homo sapiens
tccctccctgctccc

SEQ ID NO: 600235 - DNA, 19 bp, Homo sapiens
tccttaaaaatgtatgttg

SEQ ID NO: 600236 - DNA, 19 bp, Homo sapiens
tccttaacagctgtattat

SEQ ID NO: 600237 - DNA, 20 bp, Homo sapiens
tccttagaatactgtattgt

SEQ ID NO: 600238 - DNA, 17 bp, Homo sapiens
tccttcagcaatcctta

SEQ ID NO: 600239 - DNA, 14 bp, Homo sapiens
tccttcagtgcctt

SEQ ID NO: 600240 - DNA, 20 bp, Homo sapiens
tccttcagtgccttatggaa

SEQ ID NO: 600241 - DNA, 19 bp, Homo sapiens
tccttcattccgttaggaa

SEQ ID NO: 600242 - DNA, 13 bp, Homo sapiens
tccttccatcttg

SEQ ID NO: 600243 - DNA, 12 bp, Homo sapiens
tccttcccgcag

SEQ ID NO: 600244 - DNA, 22 bp, Homo sapiens
tccttcccgcagcaccagcctg

SEQ ID NO: 600245 - DNA, 16 bp, Homo sapiens
tccttctcccctccag

SEQ ID NO: 600246 - DNA, 17 bp, Homo sapiens
tccttctcccctccaga

SEQ ID NO: 600247 - DNA, 18 bp, Homo sapiens
tccttctcccctccagac

SEQ ID NO: 600248 - DNA, 15 bp, Homo sapiens
tccttgccttcaaac

SEQ ID NO: 600249 - DNA, 12 bp, Homo sapiens
tccttgtacttg

SEQ ID NO: 600250 - DNA, 17 bp, Homo sapiens
tccttgtacttgaataa

SEQ ID NO: 600251 - DNA, 13 bp, Homo sapiens
tcctttatgtatt

SEQ ID NO: 600252 - DNA, 19 bp, Homo sapiens
tcctttctaaggagcacta

SEQ ID NO: 600253 - DNA, 14 bp, Homo sapiens
tcctttctctcttt

SEQ ID NO: 600254 - DNA, 14 bp, Homo sapiens
tcctttcttccttc

SEQ ID NO: 600255 - DNA, 15 bp, Homo sapiens
tcctttcttccttcc

SEQ ID NO: 600256 - DNA, 17 bp, Homo sapiens
tcctttcttccttcctt

SEQ ID NO: 600257 - DNA, 16 bp, Homo sapiens
tcctttgtcaaatggt

SEQ ID NO: 600258 - DNA, 21 bp, Homo sapiens
tcgaagaattggcagaagcag

SEQ ID NO: 600259 - DNA, 14 bp, Homo sapiens
tcgagagggctgag

SEQ ID NO: 600260 - DNA, 19 bp, Homo sapiens
tcgagagggctgagcccct

SEQ ID NO: 600261 - DNA, 21 bp, Homo sapiens
tcgagagggctgagcccctcc

SEQ ID NO: 600262 - DNA, 22 bp, Homo sapiens
tcgagagggctgagcccctcct

SEQ ID NO: 600263 - DNA, 21 bp, Homo sapiens
tcgagcaaacaactttctgga

SEQ ID NO: 600264 - DNA, 20 bp, Homo sapiens
tcgaggaagcacctctcagc

SEQ ID NO: 600265 - DNA, 21 bp, Homo sapiens
tcgagtgatatggcttgtagg

SEQ ID NO: 600266 - DNA, 18 bp, Homo sapiens
tcgatttgtattaatgta

SEQ ID NO: 600267 - DNA, 16 bp, Homo sapiens
tcgcattaagcacaca

SEQ ID NO: 600268 - DNA, 17 bp, Homo sapiens
tcgcattaagcacacac

SEQ ID NO: 600269 - DNA, 22 bp, Homo sapiens
tcgcattaagcacacacatctg

SEQ ID NO: 600270 - DNA, 22 bp, Homo sapiens
tcgccccccgcccggcctccta

SEQ ID NO: 600271 - DNA, 17 bp, Homo sapiens
tcgccctgtgccctctc

SEQ ID NO: 600272 - DNA, 14 bp, Homo sapiens
tcgcctgggacgcc

SEQ ID NO: 600273 - DNA, 17 bp, Homo sapiens
tcgcctgggacgcccct

SEQ ID NO: 600274 - DNA, 12 bp, Homo sapiens
tcgccttctggc

SEQ ID NO: 600275 - DNA, 15 bp, Homo sapiens
tcgccttctggctgc

SEQ ID NO: 600276 - DNA, 13 bp, Homo sapiens
tcgccttctgggg

SEQ ID NO: 600277 - DNA, 19 bp, Homo sapiens
tcgcgacaatgcaaaccat

SEQ ID NO: 600278 - DNA, 12 bp, Homo sapiens
tcgcgcccctgt

SEQ ID NO: 600279 - DNA, 13 bp, Homo sapiens
tcgcgcccctgtc

SEQ ID NO: 600280 - DNA, 17 bp, Homo sapiens
tcgctgtccgtcctgct

SEQ ID NO: 600281 - DNA, 14 bp, Homo sapiens
tcggataattttca

SEQ ID NO: 600282 - DNA, 17 bp, Homo sapiens
tcggataattttcattt

SEQ ID NO: 600283 - DNA, 16 bp, Homo sapiens
tcggcagtggctgggg

SEQ ID NO: 600284 - DNA, 17 bp, Homo sapiens
tcggcagtggctggggg

SEQ ID NO: 600285 - DNA, 13 bp, Homo sapiens
tcggccgaggcct

SEQ ID NO: 600286 - DNA, 13 bp, Homo sapiens
tcggctgggcagg

SEQ ID NO: 600287 - DNA, 14 bp, Homo sapiens
tcggctgggcaggg

SEQ ID NO: 600288 - DNA, 15 bp, Homo sapiens
tcggctgggcagggc

SEQ ID NO: 600289 - DNA, 19 bp, Homo sapiens
tcggctgggcagggccgca

SEQ ID NO: 600290 - DNA, 21 bp, Homo sapiens
tcggctgggcagggccgcagg

SEQ ID NO: 600291 - DNA, 21 bp, Homo sapiens
tcgggaaggcctgagggaagc

SEQ ID NO: 600292 - DNA, 11 bp, Homo sapiens
tcgggcatgac

SEQ ID NO: 600293 - DNA, 20 bp, Homo sapiens
tcgggcccgcactcaggagc

SEQ ID NO: 600294 - DNA, 19 bp, Homo sapiens
tgaatcagaggcagagacc

SEQ ID NO: 600295 - DNA, 15 bp, Homo sapiens
tgaatccatcgattt

SEQ ID NO: 600296 - DNA, 19 bp, Homo sapiens
tgaatctctcaaaatgtgc

SEQ ID NO: 600297 - DNA, 21 bp, Homo sapiens
tgaatctctcaaaatgtgccg

SEQ ID NO: 600298 - DNA, 15 bp, Homo sapiens
tgaatgaaatataaa

SEQ ID NO: 600299 - DNA, 21 bp, Homo sapiens
tgaatgaaatataaactgtga

SEQ ID NO: 600300 - DNA, 15 bp, Homo sapiens
tgaatgctgattcaa

SEQ ID NO: 600301 - DNA, 23 bp, Homo sapiens
tgaatggcatctcgttgtaagta

SEQ ID NO: 600302 - DNA, 19 bp, Homo sapiens
tgaatggttgcaaagtgtt

SEQ ID NO: 600303 - DNA, 21 bp, Homo sapiens
tgaattcattgtctcagtgaa

SEQ ID NO: 600304 - DNA, 12 bp, Homo sapiens
tgaattgccttt

SEQ ID NO: 600305 - DNA, 16 bp, Homo sapiens
tgaattgctatcattt

SEQ ID NO: 600306 - DNA, 14 bp, Homo sapiens
tgaattgttatgta

SEQ ID NO: 600307 - DNA, 13 bp, Homo sapiens
tgaatttaccatc

SEQ ID NO: 600308 - DNA, 16 bp, Homo sapiens
tgaatttatcatttta

SEQ ID NO: 600309 - DNA, 18 bp, Homo sapiens
tgaatttggggctactta

SEQ ID NO: 600310 - DNA, 19 bp, Homo sapiens
tgaatttggggctacttat

SEQ ID NO: 600311 - DNA, 22 bp, Homo sapiens
tgaatttggggctacttatatt

SEQ ID NO: 600312 - DNA, 15 bp, Homo sapiens
tgaattttcacatga

SEQ ID NO: 600313 - DNA, 17 bp, Homo sapiens
tgaattttcacatgaac

SEQ ID NO: 600314 - DNA, 18 bp, Homo sapiens
tgaattttcacatgaaca

SEQ ID NO: 600315 - DNA, 19 bp, Homo sapiens
tgaattttcacatgaacat

SEQ ID NO: 600316 - DNA, 12 bp, Homo sapiens
tgacaacatttt

SEQ ID NO: 600317 - DNA, 17 bp, Homo sapiens
tgacacactcaccattt

SEQ ID NO: 600318 - DNA, 19 bp, Homo sapiens
tgacaccaaatattttcaa

SEQ ID NO: 600319 - DNA, 20 bp, Homo sapiens
tgacaccctttaatgttcta

SEQ ID NO: 600320 - DNA, 19 bp, Homo sapiens
tgacacgaatattgctgat

SEQ ID NO: 600321 - DNA, 18 bp, Homo sapiens
tgacactgtctgctgccc

SEQ ID NO: 600322 - DNA, 15 bp, Homo sapiens
tgacagaaggcccga

SEQ ID NO: 600323 - DNA, 20 bp, Homo sapiens
tgacagcatttcagctgtga

SEQ ID NO: 600324 - DNA, 21 bp, Homo sapiens
tgacagcatttcagctgtgag

SEQ ID NO: 600325 - DNA, 18 bp, Homo sapiens
tgacaggcgccgcctcgc

SEQ ID NO: 600326 - DNA, 15 bp, Homo sapiens
tgacagtagcatact

SEQ ID NO: 600327 - DNA, 16 bp, Homo sapiens
tgaggccccaggccct

SEQ ID NO: 600328 - DNA, 12 bp, Homo sapiens
tgaggcccccgg

SEQ ID NO: 600329 - DNA, 15 bp, Homo sapiens
tgaggcccctgtgca

SEQ ID NO: 600330 - DNA, 17 bp, Homo sapiens
tgaggcctttccccagt

SEQ ID NO: 600331 - DNA, 19 bp, Homo sapiens
tgaggcgtgggatccagag

SEQ ID NO: 600332 - DNA, 20 bp, Homo sapiens
tgaggcgtgggatccagaga

SEQ ID NO: 600333 - DNA, 12 bp, Homo sapiens
tgagggaagccc

SEQ ID NO: 600334 - DNA, 20 bp, Homo sapiens
tgagggaagcccacccgccc

SEQ ID NO: 600335 - DNA, 21 bp, Homo sapiens
tgagggaagcccacccgcccc

SEQ ID NO: 600336 - DNA, 19 bp, Homo sapiens
tgagggcagtggggagcat

SEQ ID NO: 600337 - DNA, 18 bp, Homo sapiens
tgagggcgtgaaacacaa

SEQ ID NO: 600338 - DNA, 17 bp, Homo sapiens
tgagggggctctttccc

SEQ ID NO: 600339 - DNA, 21 bp, Homo sapiens
tgaggtcttgagtttcatttt

SEQ ID NO: 600340 - DNA, 12 bp, Homo sapiens
tgagtagcatat

SEQ ID NO: 600341 - DNA, 20 bp, Homo sapiens
tgagtcctcattgttcagaa

SEQ ID NO: 600342 - DNA, 14 bp, Homo sapiens
tgagtcggctgggc

SEQ ID NO: 600343 - DNA, 15 bp, Homo sapiens
tgagtcggctgggca

SEQ ID NO: 600344 - DNA, 16 bp, Homo sapiens
tgagtcggctgggcag

SEQ ID NO: 600345 - DNA, 15 bp, Homo sapiens
tgagtctgaggcccc

SEQ ID NO: 600346 - DNA, 14 bp, Homo sapiens
tgagtgataaattt

SEQ ID NO: 600347 - DNA, 12 bp, Homo sapiens
tgagtgggcccc

SEQ ID NO: 600348 - DNA, 12 bp, Homo sapiens
tgagtgttgaag

SEQ ID NO: 600349 - DNA, 22 bp, Homo sapiens
tgagttagctgtttactgacat

SEQ ID NO: 600350 - DNA, 15 bp, Homo sapiens
tgagttctgcacata

SEQ ID NO: 600351 - DNA, 21 bp, Homo sapiens
tgagttctgcacatacagatg

SEQ ID NO: 600352 - DNA, 19 bp, Homo sapiens
tgagttggttacctattgc

SEQ ID NO: 600353 - DNA, 21 bp, Homo sapiens
tgagttggttacctattgctg

SEQ ID NO: 600354 - DNA, 16 bp, Homo sapiens
tgagtttcatttttca

SEQ ID NO: 600355 - DNA, 19 bp, Homo sapiens
tgataatagctcacagcac

SEQ ID NO: 600356 - DNA, 19 bp, Homo sapiens
tgcagctatggacaattta

SEQ ID NO: 600357 - DNA, 19 bp, Homo sapiens
tgcaggaaaaggctgcagc

SEQ ID NO: 600358 - DNA, 12 bp, Homo sapiens
tgcaggaatcaa

SEQ ID NO: 600359 - DNA, 15 bp, Homo sapiens
tgcaggaatcaaaaa

SEQ ID NO: 600360 - DNA, 15 bp, Homo sapiens
tgcaggcagcctgca

SEQ ID NO: 600361 - DNA, 17 bp, Homo sapiens
tgcaggcagcctgcaga

SEQ ID NO: 600362 - DNA, 16 bp, Homo sapiens
tgcaggcaggcagacc

SEQ ID NO: 600363 - DNA, 14 bp, Homo sapiens
tgcagggacagcct

SEQ ID NO: 600364 - DNA, 18 bp, Homo sapiens
tgcaggtgaccagaatga

SEQ ID NO: 600365 - DNA, 17 bp, Homo sapiens
tgcagtagagagccttt

SEQ ID NO: 600366 - DNA, 18 bp, Homo sapiens
tgcagtagagagcctttc

SEQ ID NO: 600367 - DNA, 21 bp, Homo sapiens
tgcagtcacgtgaggcccctg

SEQ ID NO: 600368 - DNA, 14 bp, Homo sapiens
tgcagtcagcacag

SEQ ID NO: 600369 - DNA, 20 bp, Homo sapiens
tgcagttatttaccagaagt

SEQ ID NO: 600370 - DNA, 22 bp, Homo sapiens
tgcagttatttaccagaagttt

SEQ ID NO: 600371 - DNA, 15 bp, Homo sapiens
tgcagtttggccctg

SEQ ID NO: 600372 - DNA, 21 bp, Homo sapiens
tgcagtttggtatgaaacaaa

SEQ ID NO: 600373 - DNA, 18 bp, Homo sapiens
tgcataatatgcatatat

SEQ ID NO: 600374 - DNA, 16 bp, Homo sapiens
tgcatagacaagtgtt

SEQ ID NO: 600375 - DNA, 17 bp, Homo sapiens
tgcatagacaagtgttt

SEQ ID NO: 600376 - DNA, 17 bp, Homo sapiens
tgcatatatatgtatat

SEQ ID NO: 600377 - DNA, 14 bp, Homo sapiens
tgcatatttataga

SEQ ID NO: 600378 - DNA, 23 bp, Homo sapiens
tgcatatttatagagttattata

SEQ ID NO: 600379 - DNA, 17 bp, Homo sapiens
tgcatcccttggcccct

SEQ ID NO: 600380 - DNA, 20 bp, Homo sapiens
tgcatcccttggcccctctc

SEQ ID NO: 600381 - DNA, 18 bp, Homo sapiens
tgcgcctgcccgcccgcc

SEQ ID NO: 600382 - DNA, 17 bp, Homo sapiens
tgcgccttgtagaatgc

SEQ ID NO: 600383 - DNA, 13 bp, Homo sapiens
tgcgctcctctgc

SEQ ID NO: 600384 - DNA, 14 bp, Homo sapiens
tgcgctctgggttt

SEQ ID NO: 600385 - DNA, 23 bp, Homo sapiens
tgcggaccggagcggctgaggac

SEQ ID NO: 600386 - DNA, 17 bp, Homo sapiens
tgcggcaccgcccaccc

SEQ ID NO: 600387 - DNA, 20 bp, Homo sapiens
tgcggcaccgcccacccaca

SEQ ID NO: 600388 - DNA, 18 bp, Homo sapiens
tgcggcccgtgcgcagcc

SEQ ID NO: 600389 - DNA, 19 bp, Homo sapiens
tgcggcccgtgcgcagccg

SEQ ID NO: 600390 - DNA, 17 bp, Homo sapiens
tgcgggccaggtctggc

SEQ ID NO: 600391 - DNA, 21 bp, Homo sapiens
tgcgggccaggtctggcgcca

SEQ ID NO: 600392 - DNA, 21 bp, Homo sapiens
tgcggggcggcatccgagccc

SEQ ID NO: 600393 - DNA, 16 bp, Homo sapiens
tgcgtccctgctcagc

SEQ ID NO: 600394 - DNA, 20 bp, Homo sapiens
tgcgtccctgctcagcccat

SEQ ID NO: 600395 - DNA, 22 bp, Homo sapiens
tgcgtccgcacgcggccgctct

SEQ ID NO: 600396 - DNA, 20 bp, Homo sapiens
tgcgtgtggccctgtgggag

SEQ ID NO: 600397 - DNA, 15 bp, Homo sapiens
tgctaatttatgaag

SEQ ID NO: 600398 - DNA, 16 bp, Homo sapiens
tgctagttctgctgcc

SEQ ID NO: 600399 - DNA, 17 bp, Homo sapiens
tgctatctcgctagcca

SEQ ID NO: 600400 - DNA, 15 bp, Homo sapiens
tgctatgcatattta

SEQ ID NO: 600401 - DNA, 18 bp, Homo sapiens
tgctatttgtgtaactga

SEQ ID NO: 600402 - DNA, 16 bp, Homo sapiens
tgctcaatgtgctgtt

SEQ ID NO: 600403 - DNA, 20 bp, Homo sapiens
tgctcaatgtgctgttgatt

SEQ ID NO: 600404 - DNA, 16 bp, Homo sapiens
tgctcacgtctgtgag

SEQ ID NO: 600405 - DNA, 19 bp, Homo sapiens
tgctcagcccatcccctgc

SEQ ID NO: 600406 - DNA, 23 bp, Homo sapiens
tgctcagcccatcccctgcctct

SEQ ID NO: 600407 - DNA, 17 bp, Homo sapiens
tgctcataagtaaatgt

SEQ ID NO: 600408 - DNA, 19 bp, Homo sapiens
tgctcataagtaaatgtct

SEQ ID NO: 600409 - DNA, 21 bp, Homo sapiens
tgctcataagtaaatgtcttc

SEQ ID NO: 600410 - DNA, 13 bp, Homo sapiens
tgctccattcctg

SEQ ID NO: 600411 - DNA, 12 bp, Homo sapiens
tgctcctcaccc

SEQ ID NO: 600412 - DNA, 19 bp, Homo sapiens
tgctcctcacccctgtagg

SEQ ID NO: 600413 - DNA, 14 bp, Homo sapiens
tgctcctctgcccg

SEQ ID NO: 600414 - DNA, 12 bp, Homo sapiens
tgctcctgccca

SEQ ID NO: 600415 - DNA, 13 bp, Homo sapiens
tgctcctgcccac

SEQ ID NO: 600416 - DNA, 19 bp, Homo sapiens
tgctcgccctgtgccctct

SEQ ID NO: 600417 - DNA, 14 bp, Homo sapiens
tgctctacctggcc

SEQ ID NO: 600418 - DNA, 13 bp, Homo sapiens
tgctctctaagaa

SEQ ID NO: 600419 - DNA, 16 bp, Homo sapiens
tgctgaataacaacaa

SEQ ID NO: 600420 - DNA, 14 bp, Homo sapiens
tgctgaattttcac

SEQ ID NO: 600421 - DNA, 22 bp, Homo sapiens
tgctgaattttcacatgaacat

SEQ ID NO: 600422 - DNA, 23 bp, Homo sapiens
tgctgaattttcacatgaacata

SEQ ID NO: 600423 - DNA, 22 bp, Homo sapiens
tgctgagatgtttagtagctga

SEQ ID NO: 600424 - DNA, 21 bp, Homo sapiens
tgctgagggggctctttccct

SEQ ID NO: 600425 - DNA, 23 bp, Homo sapiens
tgctgagggggctctttccctca

SEQ ID NO: 600426 - DNA, 17 bp, Homo sapiens
tgctgagtggctcgtgt

SEQ ID NO: 600427 - DNA, 13 bp, Homo sapiens
tgctgatggtgca

SEQ ID NO: 600428 - DNA, 20 bp, Homo sapiens
tgctgattcaaggcattatt

SEQ ID NO: 600429 - DNA, 21 bp, Homo sapiens
tgctgcagtcagcacagagag

SEQ ID NO: 600430 - DNA, 17 bp, Homo sapiens
tgctgccccacaacaca

SEQ ID NO: 600431 - DNA, 15 bp, Homo sapiens
tgctgcctcaggaat

SEQ ID NO: 600432 - DNA, 22 bp, Homo sapiens
tgctgctgagcacatctcttca

SEQ ID NO: 600433 - DNA, 13 bp, Homo sapiens
tgctgcttttgat

SEQ ID NO: 600434 - DNA, 21 bp, Homo sapiens
tgctggaccaaggtgcggacc

SEQ ID NO: 600435 - DNA, 11 bp, Homo sapiens
tgctggctggg

SEQ ID NO: 600436 - DNA, 12 bp, Homo sapiens
tgctgggccagg

SEQ ID NO: 600437 - DNA, 13 bp, Homo sapiens
tgctgggccaggg

SEQ ID NO: 600438 - DNA, 16 bp, Homo sapiens
tgctgggccagggaaa

SEQ ID NO: 600439 - DNA, 23 bp, Homo sapiens
tgctgggccggggtgtggaatca

SEQ ID NO: 600440 - DNA, 23 bp, Homo sapiens
tgctggggcagggcccagggagg

SEQ ID NO: 600441 - DNA, 16 bp, Homo sapiens
tgctgggtccttaaaa

SEQ ID NO: 600442 - DNA, 16 bp, Homo sapiens
tgctgtaaataaaaat

SEQ ID NO: 600443 - DNA, 13 bp, Homo sapiens
tgctgtccctgtg

SEQ ID NO: 600444 - DNA, 17 bp, Homo sapiens
tgctgtccctgtgggct

SEQ ID NO: 600445 - DNA, 21 bp, Homo sapiens
tgctgtccctgtgggctcaca

SEQ ID NO: 600446 - DNA, 23 bp, Homo sapiens
tgctgtcgggcaagatagctcct

SEQ ID NO: 600447 - DNA, 14 bp, Homo sapiens
tgctgtctgaaaaa

SEQ ID NO: 600448 - DNA, 11 bp, Homo sapiens
tgctgtgtagc

SEQ ID NO: 600449 - DNA, 16 bp, Homo sapiens
tgctgtgtagctctgt

SEQ ID NO: 600450 - DNA, 15 bp, Homo sapiens
tgctgtgtgcagagt

SEQ ID NO: 600451 - DNA, 20 bp, Homo sapiens
tgctgtgtgcagagtataca

SEQ ID NO: 600452 - DNA, 13 bp, Homo sapiens
tgctgttcattga

SEQ ID NO: 600453 - DNA, 16 bp, Homo sapiens
tgctgttgattctttc

SEQ ID NO: 600454 - DNA, 16 bp, Homo sapiens
tgctgtttatatatat

SEQ ID NO: 600455 - DNA, 18 bp, Homo sapiens
tgcttaaatgatcaagga

SEQ ID NO: 600456 - DNA, 13 bp, Homo sapiens
tgcttaacataaa

SEQ ID NO: 600457 - DNA, 13 bp, Homo sapiens
tgcttaaggaaaa

SEQ ID NO: 600458 - DNA, 21 bp, Homo sapiens
tgcttaatctagagctatgca

SEQ ID NO: 600459 - DNA, 12 bp, Homo sapiens
tgcttcaaggat

SEQ ID NO: 600460 - DNA, 16 bp, Homo sapiens
tgcttcaaggatcctg

SEQ ID NO: 600461 - DNA, 23 bp, Homo sapiens
tgcttcaagtgttacctaacaat

SEQ ID NO: 600462 - DNA, 14 bp, Homo sapiens
tgcttcacacaaag

SEQ ID NO: 600463 - DNA, 17 bp, Homo sapiens
tgcttcattaaaacaag

SEQ ID NO: 600464 - DNA, 18 bp, Homo sapiens
tgcttcattaaaacaaga

SEQ ID NO: 600465 - DNA, 23 bp, Homo sapiens
tgcttcattaaaacaagagacca

SEQ ID NO: 600466 - DNA, 13 bp, Homo sapiens
tgcttctccctgg

SEQ ID NO: 600467 - DNA, 15 bp, Homo sapiens
tgcttctctttcaca

SEQ ID NO: 600468 - DNA, 19 bp, Homo sapiens
tgcttcttacgaacgccac

SEQ ID NO: 600469 - DNA, 17 bp, Homo sapiens
tgcttgtcattctgcta

SEQ ID NO: 600470 - DNA, 14 bp, Homo sapiens
tgctttcagtgcct

SEQ ID NO: 600471 - DNA, 16 bp, Homo sapiens
tgctttcagtgcctgc

SEQ ID NO: 600472 - DNA, 19 bp, Homo sapiens
tgctttcagtgcctgctgt

SEQ ID NO: 600473 - DNA, 13 bp, Homo sapiens
tgctttcatccag

SEQ ID NO: 600474 - DNA, 17 bp, Homo sapiens
tgctttcatgtttaaga

SEQ ID NO: 600475 - DNA, 20 bp, Homo sapiens
tgctttcatgtttaagaaat

SEQ ID NO: 600476 - DNA, 18 bp, Homo sapiens
tgctttccctgaggaatg

SEQ ID NO: 600477 - DNA, 21 bp, Homo sapiens
tgctttccgcgtggttctgcc

SEQ ID NO: 600478 - DNA, 12 bp, Homo sapiens
tgctttctgata

SEQ ID NO: 600479 - DNA, 14 bp, Homo sapiens
tgctttgaaaatgt

SEQ ID NO: 600480 - DNA, 19 bp, Homo sapiens
aaagcagagatgtattatg

SEQ ID NO: 600481 - DNA, 14 bp, Homo sapiens
aaagcatgtacagt

SEQ ID NO: 600482 - DNA, 21 bp, Homo sapiens
aaagcatgtacagtgttctgt

SEQ ID NO: 600483 - DNA, 12 bp, Homo sapiens
aaagccctccct

SEQ ID NO: 600484 - DNA, 17 bp, Homo sapiens
aaagccctccctgtctg

SEQ ID NO: 600485 - DNA, 16 bp, Homo sapiens
aaagcccttctcaaga

SEQ ID NO: 600486 - DNA, 17 bp, Homo sapiens
aaaggaaagttctatta

SEQ ID NO: 600487 - DNA, 21 bp, Homo sapiens
aaaggaaagttctattatctg

SEQ ID NO: 600488 - DNA, 19 bp, Homo sapiens
aaaggcaaaccaatttgtt

SEQ ID NO: 600489 - DNA, 16 bp, Homo sapiens
aaaggcagccctcacc

SEQ ID NO: 600490 - DNA, 18 bp, Homo sapiens
aaaggctggatgtgcttt

SEQ ID NO: 600491 - DNA, 13 bp, Homo sapiens
aaaggcttctcca

SEQ ID NO: 600492 - DNA, 19 bp, Homo sapiens
aaagggaaggctgctgtgt

SEQ ID NO: 600493 - DNA, 21 bp, Homo sapiens
aaagggattgaggagttgcct

SEQ ID NO: 600494 - DNA, 22 bp, Homo sapiens
aaagggcagcccctccccatgg

SEQ ID NO: 600495 - DNA, 13 bp, Homo sapiens
aaagggtggtagt

SEQ ID NO: 600496 - DNA, 18 bp, Homo sapiens
aaaggtgatgaatttacc

SEQ ID NO: 600497 - DNA, 19 bp, Homo sapiens
aaagtctgagaaatttaca

SEQ ID NO: 600498 - DNA, 12 bp, Homo sapiens
aaagtgaaatta

SEQ ID NO: 600499 - DNA, 13 bp, Homo sapiens
aaagtggcaagct

SEQ ID NO: 600500 - DNA, 19 bp, Homo sapiens
aaagtgtccattgacatgt

SEQ ID NO: 600501 - DNA, 22 bp, Homo sapiens
aaagtgtccattgacatgtaca

SEQ ID NO: 600502 - DNA, 22 bp, Homo sapiens
aaagtgttgtcttattcctaat

SEQ ID NO: 600503 - DNA, 16 bp, Homo sapiens
aaagttaatcttcatg

SEQ ID NO: 600504 - DNA, 13 bp, Homo sapiens
aaagttctattat

SEQ ID NO: 600505 - DNA, 19 bp, Homo sapiens
aaagttctattatctgggt

SEQ ID NO: 600506 - DNA, 21 bp, Homo sapiens
aaagttgtgatctgttgtaat

SEQ ID NO: 600507 - DNA, 19 bp, Homo sapiens
aaagtttacattgtcctgt

SEQ ID NO: 600508 - DNA, 15 bp, Homo sapiens
aaagttttcaagcat

SEQ ID NO: 600509 - DNA, 12 bp, Homo sapiens
aaagttttcaga

SEQ ID NO: 600510 - DNA, 17 bp, Homo sapiens
aaataaaaccagaaaga

SEQ ID NO: 600511 - DNA, 14 bp, Homo sapiens
aaataaaagcctct

SEQ ID NO: 600512 - DNA, 13 bp, Homo sapiens
aaataaatctaaa

SEQ ID NO: 600513 - DNA, 14 bp, Homo sapiens
aaataatataaatg

SEQ ID NO: 600514 - DNA, 22 bp, Homo sapiens
aaataatattgccttgatgttt

SEQ ID NO: 600515 - DNA, 20 bp, Homo sapiens
aaataatgattcaatgtgaa

SEQ ID NO: 600516 - DNA, 13 bp, Homo sapiens
aaataattaaaac

SEQ ID NO: 600517 - DNA, 14 bp, Homo sapiens
aaatacacgtgtat

SEQ ID NO: 600518 - DNA, 14 bp, Homo sapiens
aaatacatgatgat

SEQ ID NO: 600519 - DNA, 21 bp, Homo sapiens
aaatacatgcctttccagtgc

SEQ ID NO: 600520 - DNA, 13 bp, Homo sapiens
aaatacttgacaa

SEQ ID NO: 600521 - DNA, 17 bp, Homo sapiens
aaatagatttttagatt

SEQ ID NO: 600522 - DNA, 14 bp, Homo sapiens
aaatagcatgtatt

SEQ ID NO: 600523 - DNA, 21 bp, Homo sapiens
aaatagcatgtattgtgtctt

SEQ ID NO: 600524 - DNA, 22 bp, Homo sapiens
aaatagcatgtattgtgtcttt

SEQ ID NO: 600525 - DNA, 20 bp, Homo sapiens
aaatagctataaatagtgaa

SEQ ID NO: 600526 - DNA, 16 bp, Homo sapiens
aaatagtcatgtttct

SEQ ID NO: 600527 - DNA, 18 bp, Homo sapiens
aaatagtgtgtccatgca

SEQ ID NO: 600528 - DNA, 14 bp, Homo sapiens
aaatataaactgtg

SEQ ID NO: 600529 - DNA, 12 bp, Homo sapiens
aaatataaatca

SEQ ID NO: 600530 - DNA, 19 bp, Homo sapiens
aaatataaatcacagattt

SEQ ID NO: 600531 - DNA, 17 bp, Homo sapiens
aaatataacatgaaagt

SEQ ID NO: 600532 - DNA, 17 bp, Homo sapiens
aaatatacactttacat

SEQ ID NO: 600533 - DNA, 19 bp, Homo sapiens
aaatatatgtttggctgaa

SEQ ID NO: 600534 - DNA, 23 bp, Homo sapiens
aaatatatgtttggctgaaatta

SEQ ID NO: 600535 - DNA, 15 bp, Homo sapiens
aagttcatcaaacat

SEQ ID NO: 600536 - DNA, 19 bp, Homo sapiens
aagttgaatgataatagct

SEQ ID NO: 600537 - DNA, 11 bp, Homo sapiens
aagttgcagtt

SEQ ID NO: 600538 - DNA, 22 bp, Homo sapiens
aagttgtgatctgttgtaatat

SEQ ID NO: 600539 - DNA, 18 bp, Homo sapiens
aagtttaaatctttgtta

SEQ ID NO: 600540 - DNA, 23 bp, Homo sapiens
aagtttaaatctttgttaaaata

SEQ ID NO: 600541 - DNA, 22 bp, Homo sapiens
aagtttacattgtcctgtagct

SEQ ID NO: 600542 - DNA, 11 bp, Homo sapiens
aataaaacatt

SEQ ID NO: 600543 - DNA, 19 bp, Homo sapiens
aataaaaccagaaagagga

SEQ ID NO: 600544 - DNA, 20 bp, Homo sapiens
aataaaatgtttatttttgc

SEQ ID NO: 600545 - DNA, 12 bp, Homo sapiens
aataaacacaga

SEQ ID NO: 600546 - DNA, 21 bp, Homo sapiens
aataaatattgtcctgtttct

SEQ ID NO: 600547 - DNA, 16 bp, Homo sapiens
aataaatattttagga

SEQ ID NO: 600548 - DNA, 15 bp, Homo sapiens
aataaatcatcctca

SEQ ID NO: 600549 - DNA, 12 bp, Homo sapiens
aataaatctaaa

SEQ ID NO: 600550 - DNA, 15 bp, Homo sapiens
aataaattaattttt

SEQ ID NO: 600551 - DNA, 16 bp, Homo sapiens
aataaattaatttttc

SEQ ID NO: 600552 - DNA, 21 bp, Homo sapiens
aataacactgcagccctctcc

SEQ ID NO: 600553 - DNA, 14 bp, Homo sapiens
aataacagaaatac

SEQ ID NO: 600554 - DNA, 17 bp, Homo sapiens
aataacagaaatacatc

SEQ ID NO: 600555 - DNA, 13 bp, Homo sapiens
aataactattgct

SEQ ID NO: 600556 - DNA, 14 bp, Homo sapiens
aataactgttagaa

SEQ ID NO: 600557 - DNA, 15 bp, Homo sapiens
aataagaagcaaata

SEQ ID NO: 600558 - DNA, 20 bp, Homo sapiens
aataagccaaaataagacta

SEQ ID NO: 600559 - DNA, 16 bp, Homo sapiens
aataatatgtacaaat

SEQ ID NO: 600560 - DNA, 17 bp, Homo sapiens
aataatatgtacaaata

SEQ ID NO: 600561 - DNA, 18 bp, Homo sapiens
aataatatgtacaaataa

SEQ ID NO: 600562 - DNA, 15 bp, Homo sapiens
aataatgattcaatg

SEQ ID NO: 600563 - DNA, 16 bp, Homo sapiens
aataatgattcaatgt

SEQ ID NO: 600564 - DNA, 19 bp, Homo sapiens
aataatgattcaatgtgaa

SEQ ID NO: 600565 - DNA, 14 bp, Homo sapiens
aataattatatgaa

SEQ ID NO: 600566 - DNA, 14 bp, Homo sapiens
aatacacgtgtata

SEQ ID NO: 600567 - DNA, 12 bp, Homo sapiens
aatacatgcctt

SEQ ID NO: 600568 - DNA, 21 bp, Homo sapiens
aatagacagaggtttcatttt

SEQ ID NO: 600569 - DNA, 23 bp, Homo sapiens
aatagacagaggtttcattttca

SEQ ID NO: 600570 - DNA, 18 bp, Homo sapiens
aatagatttttagattcc

SEQ ID NO: 600571 - DNA, 19 bp, Homo sapiens
aatagctcacagcacattt

SEQ ID NO: 600572 - DNA, 21 bp, Homo sapiens
aatagctcacagcacatttgt

SEQ ID NO: 600573 - DNA, 17 bp, Homo sapiens
aataggaaaaactgatt

SEQ ID NO: 600574 - DNA, 18 bp, Homo sapiens
aataggaggacagaacca

SEQ ID NO: 600575 - DNA, 16 bp, Homo sapiens
aatagtcatgtttctg

SEQ ID NO: 600576 - DNA, 21 bp, Homo sapiens
aatagtgaaaattttattgaa

SEQ ID NO: 600577 - DNA, 19 bp, Homo sapiens
aatagttgagccagcagac

SEQ ID NO: 600578 - DNA, 12 bp, Homo sapiens
aatataaactgt

SEQ ID NO: 600579 - DNA, 14 bp, Homo sapiens
aatataaactgtga

SEQ ID NO: 600580 - DNA, 16 bp, Homo sapiens
aatataaatcacagat

SEQ ID NO: 600581 - DNA, 18 bp, Homo sapiens
aatataaatcacagattt

SEQ ID NO: 600582 - DNA, 22 bp, Homo sapiens
aatataaatcacagatttccaa

SEQ ID NO: 600583 - DNA, 15 bp, Homo sapiens
aatataaatgaatga

SEQ ID NO: 600584 - DNA, 20 bp, Homo sapiens
aatataatggcctcttaaaa

SEQ ID NO: 600585 - DNA, 16 bp, Homo sapiens
aatatactcatttgga

SEQ ID NO: 600586 - DNA, 22 bp, Homo sapiens
aatatactccttaaaaatgtat

SEQ ID NO: 600587 - DNA, 18 bp, Homo sapiens
aatatagggtttgtttgc

SEQ ID NO: 600588 - DNA, 17 bp, Homo sapiens
aatgtgtcttgtattat

SEQ ID NO: 600589 - DNA, 17 bp, Homo sapiens
aatgtgtgtggtttttt

SEQ ID NO: 600590 - DNA, 15 bp, Homo sapiens
aatgtgtttttcagt

SEQ ID NO: 600591 - DNA, 22 bp, Homo sapiens
aatgtgtttttcagttataatt

SEQ ID NO: 600592 - DNA, 13 bp, Homo sapiens
aatgttaaatcta

SEQ ID NO: 600593 - DNA, 17 bp, Homo sapiens
aatgttccgttcatctg

SEQ ID NO: 600594 - DNA, 16 bp, Homo sapiens
aatgttctatataatt

SEQ ID NO: 600595 - DNA, 22 bp, Homo sapiens
aatgttgtgttggtatttactg

SEQ ID NO: 600596 - DNA, 23 bp, Homo sapiens
aatgttgtgttggtatttactgc

SEQ ID NO: 600597 - DNA, 19 bp, Homo sapiens
aatgttttttatacttcaa

SEQ ID NO: 600598 - DNA, 23 bp, Homo sapiens
aatgttttttatacttcaaatgt

SEQ ID NO: 600599 - DNA, 15 bp, Homo sapiens
aattaaactgatggg

SEQ ID NO: 600600 - DNA, 23 bp, Homo sapiens
aattaactccgtttccaaataca

SEQ ID NO: 600601 - DNA, 18 bp, Homo sapiens
aattaacttctattttca

SEQ ID NO: 600602 - DNA, 23 bp, Homo sapiens
aattaagattgaagctaaaacac

SEQ ID NO: 600603 - DNA, 13 bp, Homo sapiens
aattaattggcag

SEQ ID NO: 600604 - DNA, 12 bp, Homo sapiens
aattaatttcag

SEQ ID NO: 600605 - DNA, 19 bp, Homo sapiens
aattaatttttcaatttct

SEQ ID NO: 600606 - DNA, 21 bp, Homo sapiens
aattaatttttttattgttta

SEQ ID NO: 600607 - DNA, 22 bp, Homo sapiens
aattaatttttttattgtttaa

SEQ ID NO: 600608 - DNA, 11 bp, Homo sapiens
aattacagttc

SEQ ID NO: 600609 - DNA, 14 bp, Homo sapiens
aattacataacagg

SEQ ID NO: 600610 - DNA, 19 bp, Homo sapiens
aattacataacaggcattg

SEQ ID NO: 600611 - DNA, 19 bp, Homo sapiens
aattacctaagagccacaa

SEQ ID NO: 600612 - DNA, 21 bp, Homo sapiens
aattagattttaaaacttcat

SEQ ID NO: 600613 - DNA, 17 bp, Homo sapiens
aattataatgcatctaa

SEQ ID NO: 600614 - DNA, 19 bp, Homo sapiens
aattatagagcctcaattt

SEQ ID NO: 600615 - DNA, 21 bp, Homo sapiens
aattatatctgtggtcttcaa

SEQ ID NO: 600616 - DNA, 18 bp, Homo sapiens
aattatatgaagcagaat

SEQ ID NO: 600617 - DNA, 15 bp, Homo sapiens
aattatcaaaaaaca

SEQ ID NO: 600618 - DNA, 22 bp, Homo sapiens
aattatcaaaaaacagaaaaac

SEQ ID NO: 600619 - DNA, 13 bp, Homo sapiens
aattatcattgtt

SEQ ID NO: 600620 - DNA, 20 bp, Homo sapiens
aattatcctcaagttgtgtg

SEQ ID NO: 600621 - DNA, 12 bp, Homo sapiens
aattatctttaa

SEQ ID NO: 600622 - DNA, 13 bp, Homo sapiens
aattatctttaaa

SEQ ID NO: 600623 - DNA, 21 bp, Homo sapiens
aattatttatattactgaatt

SEQ ID NO: 600624 - DNA, 22 bp, Homo sapiens
aattatttatattactgaattg

SEQ ID NO: 600625 - DNA, 13 bp, Homo sapiens
aattcaaacctaa

SEQ ID NO: 600626 - DNA, 15 bp, Homo sapiens
aattcacaaagttaa

SEQ ID NO: 600627 - DNA, 18 bp, Homo sapiens
aattcagtggacatttgt

SEQ ID NO: 600628 - DNA, 16 bp, Homo sapiens
aattcatatttatgaa

SEQ ID NO: 600629 - DNA, 13 bp, Homo sapiens
aattcattgtctc

SEQ ID NO: 600630 - DNA, 18 bp, Homo sapiens
aattcattgtctcagtga

SEQ ID NO: 600631 - DNA, 20 bp, Homo sapiens
aattcattgtctcagtgaag

SEQ ID NO: 600632 - DNA, 15 bp, Homo sapiens
aattcctaattctat

SEQ ID NO: 600633 - DNA, 16 bp, Homo sapiens
aattcctaattctatg

SEQ ID NO: 600634 - DNA, 18 bp, Homo sapiens
aattcgagcaaacaactt

SEQ ID NO: 600635 - DNA, 13 bp, Homo sapiens
aattctataagag

SEQ ID NO: 600636 - DNA, 19 bp, Homo sapiens
aattctataagagacaaag

SEQ ID NO: 600637 - DNA, 17 bp, Homo sapiens
aattctcagaagtgaaa

SEQ ID NO: 600638 - DNA, 15 bp, Homo sapiens
aattctgaaggggaa

SEQ ID NO: 600639 - DNA, 14 bp, Homo sapiens
aattctgattatta

SEQ ID NO: 600640 - DNA, 15 bp, Homo sapiens
aattcttactgttct

SEQ ID NO: 600641 - DNA, 18 bp, Homo sapiens
aattcttactgttctgaa

SEQ ID NO: 600642 - DNA, 20 bp, Homo sapiens
aattcttctcctttgtcaaa

SEQ ID NO: 600643 - DNA, 23 bp, Homo sapiens
aattctttgttgcttaatctaga

SEQ ID NO: 600644 - DNA, 9 bp, Homo sapiens
aattgaaag

SEQ ID NO: 600645 - DNA, 15 bp, Homo sapiens
aattgaaagggacaa

SEQ ID NO: 600646 - DNA, 19 bp, Homo sapiens
aattgaaagggacaagtat

SEQ ID NO: 600647 - DNA, 21 bp, Homo sapiens
aattgaaccgtcaatgtgaaa

SEQ ID NO: 600648 - DNA, 15 bp, Homo sapiens
aattgagagatgttt

SEQ ID NO: 600649 - DNA, 20 bp, Homo sapiens
aattgcctttgataattctt

SEQ ID NO: 600650 - DNA, 14 bp, Homo sapiens
aattgctatcattt

SEQ ID NO: 600651 - DNA, 15 bp, Homo sapiens
aattgctccattcct

SEQ ID NO: 600652 - DNA, 20 bp, Homo sapiens
aattgctgagatgtttagta

SEQ ID NO: 600653 - DNA, 21 bp, Homo sapiens
aattgcttctctaaaacagca

SEQ ID NO: 600654 - DNA, 14 bp, Homo sapiens
aattggcagcagat

SEQ ID NO: 600655 - DNA, 19 bp, Homo sapiens
aattgggcccttagaatgt

SEQ ID NO: 600656 - DNA, 18 bp, Homo sapiens
cagcgaaatggtaccaag

SEQ ID NO: 600657 - DNA, 16 bp, Homo sapiens
cagcgccagggctcag

SEQ ID NO: 600658 - DNA, 20 bp, Homo sapiens
cagcgcccgaggccagggcc

SEQ ID NO: 600659 - DNA, 13 bp, Homo sapiens
cagcgcctcccgc

SEQ ID NO: 600660 - DNA, 14 bp, Homo sapiens
cagcgcctcccgcc

SEQ ID NO: 600661 - DNA, 23 bp, Homo sapiens
cagcgcctcccgccgcctcgggc

SEQ ID NO: 600662 - DNA, 16 bp, Homo sapiens
cagcgcctcgccccag

SEQ ID NO: 600663 - DNA, 14 bp, Homo sapiens
cagcgctgaacaga

SEQ ID NO: 600664 - DNA, 17 bp, Homo sapiens
cagcgctgaacagaccg

SEQ ID NO: 600665 - DNA, 15 bp, Homo sapiens
cagcggcagcagcag

SEQ ID NO: 600666 - DNA, 18 bp, Homo sapiens
cagcggcccggcccacgc

SEQ ID NO: 600667 - DNA, 19 bp, Homo sapiens
cagcggcccggcccacgca

SEQ ID NO: 600668 - DNA, 24 bp, Homo sapiens
cagcgtctccccatgctgggctca

SEQ ID NO: 600669 - DNA, 14 bp, Homo sapiens
cagctaatttgtga

SEQ ID NO: 600670 - DNA, 18 bp, Homo sapiens
cagctaatttgtgaaagt

SEQ ID NO: 600671 - DNA, 20 bp, Homo sapiens
cagctacaggggaggctgag

SEQ ID NO: 600672 - DNA, 23 bp, Homo sapiens
cagctagaaagagaaaaagccct

SEQ ID NO: 600673 - DNA, 14 bp, Homo sapiens
cagctaggcaggga

SEQ ID NO: 600674 - DNA, 18 bp, Homo sapiens
cagctaggttaataggag

SEQ ID NO: 600675 - DNA, 23 bp, Homo sapiens
cagctaggttaataggaggacag

SEQ ID NO: 600676 - DNA, 22 bp, Homo sapiens
cagctatggacaatttaccaca

SEQ ID NO: 600677 - DNA, 18 bp, Homo sapiens
cagctcagcattgtgtac

SEQ ID NO: 600678 - DNA, 17 bp, Homo sapiens
cagctccactctgaagt

SEQ ID NO: 600679 - DNA, 17 bp, Homo sapiens
cagctcttcccctttcc

SEQ ID NO: 600680 - DNA, 20 bp, Homo sapiens
cagctcttcccctttcctgg

SEQ ID NO: 600681 - DNA, 21 bp, Homo sapiens
cagctcttcccctttcctggg

SEQ ID NO: 600682 - DNA, 15 bp, Homo sapiens
cagctgcaggaatca

SEQ ID NO: 600683 - DNA, 22 bp, Homo sapiens
cagctgcagttagcacagagga

SEQ ID NO: 600684 - DNA, 14 bp, Homo sapiens
cagctggcagcgcc

SEQ ID NO: 600685 - DNA, 19 bp, Homo sapiens
cagctggcagcgcctcccg

SEQ ID NO: 600686 - DNA, 23 bp, Homo sapiens
cagctggcagcgcctcccgccgc

SEQ ID NO: 600687 - DNA, 15 bp, Homo sapiens
cagctgggcagggtg

SEQ ID NO: 600688 - DNA, 16 bp, Homo sapiens
cagctgggcagggtga

SEQ ID NO: 600689 - DNA, 22 bp, Homo sapiens
cagctgtattatcttaaaccca

SEQ ID NO: 600690 - DNA, 16 bp, Homo sapiens
cagcttcacttaaaat

SEQ ID NO: 600691 - DNA, 13 bp, Homo sapiens
cagcttccctgaa

SEQ ID NO: 600692 - DNA, 11 bp, Homo sapiens
caggaaaatga

SEQ ID NO: 600693 - DNA, 15 bp, Homo sapiens
caggaaaggaagatg

SEQ ID NO: 600694 - DNA, 23 bp, Homo sapiens
caggaaatatctgtgaaggactt

SEQ ID NO: 600695 - DNA, 16 bp, Homo sapiens
caggaaatttttgcat

SEQ ID NO: 600696 - DNA, 19 bp, Homo sapiens
caggaacccttacagtaga

SEQ ID NO: 600697 - DNA, 20 bp, Homo sapiens
caggaatgggccaagccagg

SEQ ID NO: 600698 - DNA, 20 bp, Homo sapiens
caggacccccccagtccgcc

SEQ ID NO: 600699 - DNA, 21 bp, Homo sapiens
caggacccccccagtccgccc

SEQ ID NO: 600700 - DNA, 23 bp, Homo sapiens
caggacccccccagtccgccccg

SEQ ID NO: 600701 - DNA, 19 bp, Homo sapiens
caggagaaggcctgccccc

SEQ ID NO: 600702 - DNA, 18 bp, Homo sapiens
caggagactccaaggagc

SEQ ID NO: 600703 - DNA, 13 bp, Homo sapiens
caggagcacagcc

SEQ ID NO: 600704 - DNA, 16 bp, Homo sapiens
caggagcacagccata

SEQ ID NO: 600705 - DNA, 21 bp, Homo sapiens
caggagcacagccatagcaga

SEQ ID NO: 600706 - DNA, 15 bp, Homo sapiens
caggagcatgtccta

SEQ ID NO: 600707 - DNA, 18 bp, Homo sapiens
caggagccgcagaggccc

SEQ ID NO: 600708 - DNA, 15 bp, Homo sapiens
caggagcgtgtccta

SEQ ID NO: 600709 - DNA, 15 bp, Homo sapiens
cagagactgcccacc

SEQ ID NO: 600710 - DNA, 17 bp, Homo sapiens
cagagactgcccaccct

SEQ ID NO: 600711 - DNA, 18 bp, Homo sapiens
cagagactgcccaccctg

SEQ ID NO: 600712 - DNA, 19 bp, Homo sapiens
cagagagaagcaccccacc

SEQ ID NO: 600713 - DNA, 23 bp, Homo sapiens
cagagatttggtaactcatttgg

SEQ ID NO: 600714 - DNA, 16 bp, Homo sapiens
cagagccctgcagtca

SEQ ID NO: 600715 - DNA, 17 bp, Homo sapiens
cagagcgatgtgttctt

SEQ ID NO: 600716 - DNA, 14 bp, Homo sapiens
cagagcgcagcccc

SEQ ID NO: 600717 - DNA, 16 bp, Homo sapiens
cagagcgcagccccca

SEQ ID NO: 600718 - DNA, 19 bp, Homo sapiens
cagagctgagtcggctggg

SEQ ID NO: 600719 - DNA, 20 bp, Homo sapiens
cagagctgagtcggctgggc

SEQ ID NO: 600720 - DNA, 13 bp, Homo sapiens
cagaggagaggag

SEQ ID NO: 600721 - DNA, 22 bp, Homo sapiens
cagaggagaggagcaaacagga

SEQ ID NO: 600722 - DNA, 12 bp, Homo sapiens
cagaggatggct

SEQ ID NO: 600723 - DNA, 15 bp, Homo sapiens
cagaggcagggccct

SEQ ID NO: 600724 - DNA, 21 bp, Homo sapiens
cagaggcagggccctggggtc

SEQ ID NO: 600725 - DNA, 17 bp, Homo sapiens
cagaggccggggtccag

SEQ ID NO: 600726 - DNA, 22 bp, Homo sapiens
cagaggctgggggaggcggcac

SEQ ID NO: 600727 - DNA, 16 bp, Homo sapiens
cagaggtttcattttc

SEQ ID NO: 600728 - DNA, 16 bp, Homo sapiens
cagagtaggtgggtct

SEQ ID NO: 600729 - DNA, 16 bp, Homo sapiens
cagagtatacaagtgt

SEQ ID NO: 600730 - DNA, 14 bp, Homo sapiens
cagagtgccctggg

SEQ ID NO: 600731 - DNA, 19 bp, Homo sapiens
cagagtggatctggagtct

SEQ ID NO: 600732 - DNA, 22 bp, Homo sapiens
cagatagtatacacatcataaa

SEQ ID NO: 600733 - DNA, 23 bp, Homo sapiens
cagatcacatgcccctcttagaa

SEQ ID NO: 600734 - DNA, 23 bp, Homo sapiens
cagatcctccgcggaggcccctg

SEQ ID NO: 600735 - DNA, 18 bp, Homo sapiens
cagatccttccaaactct

SEQ ID NO: 600736 - DNA, 13 bp, Homo sapiens
cagatcgtgccgt

SEQ ID NO: 600737 - DNA, 19 bp, Homo sapiens
cagatcgtgccgtggagct

SEQ ID NO: 600738 - DNA, 17 bp, Homo sapiens
cagatgagattccctct

SEQ ID NO: 600739 - DNA, 18 bp, Homo sapiens
cagatgagattccctctc

SEQ ID NO: 600740 - DNA, 19 bp, Homo sapiens
cagatggtgtcctgcatgt

SEQ ID NO: 600741 - DNA, 14 bp, Homo sapiens
cagatgtttccaag

SEQ ID NO: 600742 - DNA, 21 bp, Homo sapiens
cagatgtttccaagatgtccc

SEQ ID NO: 600743 - DNA, 14 bp, Homo sapiens
cagattattttcta

SEQ ID NO: 600744 - DNA, 23 bp, Homo sapiens
cagattattttctatatttggat

SEQ ID NO: 600745 - DNA, 18 bp, Homo sapiens
cagattgtaaaggtaggt

SEQ ID NO: 600746 - DNA, 15 bp, Homo sapiens
cagatttcactctcc

SEQ ID NO: 600747 - DNA, 16 bp, Homo sapiens
cagatttcactctcct

SEQ ID NO: 600748 - DNA, 20 bp, Homo sapiens
cagatttcactctccttggt

SEQ ID NO: 600749 - DNA, 12 bp, Homo sapiens
cagcaaacacag

SEQ ID NO: 600750 - DNA, 13 bp, Homo sapiens
cagcaaacacagt

SEQ ID NO: 600751 - DNA, 14 bp, Homo sapiens
cagcaaacacagtc

SEQ ID NO: 600752 - DNA, 17 bp, Homo sapiens
cagcaaattaattggca

SEQ ID NO: 600753 - DNA, 22 bp, Homo sapiens
cagcaaattaattggcagcaga

SEQ ID NO: 600754 - DNA, 22 bp, Homo sapiens
cagcaacattataatggccctg

SEQ ID NO: 600755 - DNA, 15 bp, Homo sapiens
cagcaaccagagcac

SEQ ID NO: 600756 - DNA, 22 bp, Homo sapiens
atttagggttctatatttactg

SEQ ID NO: 600757 - DNA, 15 bp, Homo sapiens
atttataacattgta

SEQ ID NO: 600758 - DNA, 16 bp, Homo sapiens
atttataacattgtaa

SEQ ID NO: 600759 - DNA, 21 bp, Homo sapiens
atttataaggacagagatttg

SEQ ID NO: 600760 - DNA, 16 bp, Homo sapiens
atttatagagttcata

SEQ ID NO: 600761 - DNA, 14 bp, Homo sapiens
atttatcattttag

SEQ ID NO: 600762 - DNA, 15 bp, Homo sapiens
atttatgaagatagt

SEQ ID NO: 600763 - DNA, 16 bp, Homo sapiens
atttatgcatgagaac

SEQ ID NO: 600764 - DNA, 16 bp, Homo sapiens
atttatgcatttatgc

SEQ ID NO: 600765 - DNA, 14 bp, Homo sapiens
atttatgtacaaaa

SEQ ID NO: 600766 - DNA, 15 bp, Homo sapiens
atttatgtgtgaagc

SEQ ID NO: 600767 - DNA, 12 bp, Homo sapiens
atttattaaatt

SEQ ID NO: 600768 - DNA, 13 bp, Homo sapiens
atttattgtatat

SEQ ID NO: 600769 - DNA, 14 bp, Homo sapiens
atttatttaaaact

SEQ ID NO: 600770 - DNA, 13 bp, Homo sapiens
atttcaattttta

SEQ ID NO: 600771 - DNA, 19 bp, Homo sapiens
atttcacacaactgtggat

SEQ ID NO: 600772 - DNA, 14 bp, Homo sapiens
atttcacattcctg

SEQ ID NO: 600773 - DNA, 12 bp, Homo sapiens
atttcactctcc

SEQ ID NO: 600774 - DNA, 20 bp, Homo sapiens
atttcagaaactaagaatca

SEQ ID NO: 600775 - DNA, 22 bp, Homo sapiens
atttcagaaactaagaatcatc

SEQ ID NO: 600776 - DNA, 12 bp, Homo sapiens
atttcatacaaa

SEQ ID NO: 600777 - DNA, 17 bp, Homo sapiens
atttcatacaaattttc

SEQ ID NO: 600778 - DNA, 22 bp, Homo sapiens
atttccagcaaaatatatgttt

SEQ ID NO: 600779 - DNA, 16 bp, Homo sapiens
atttccgtgagagtca

SEQ ID NO: 600780 - DNA, 23 bp, Homo sapiens
atttccgtgagagtcatctcaaa

SEQ ID NO: 600781 - DNA, 19 bp, Homo sapiens
atttccttgtctaaagatc

SEQ ID NO: 600782 - DNA, 15 bp, Homo sapiens
atttcggctatgtct

SEQ ID NO: 600783 - DNA, 13 bp, Homo sapiens
atttctaaaacat

SEQ ID NO: 600784 - DNA, 17 bp, Homo sapiens
atttctaaaacattaat

SEQ ID NO: 600785 - DNA, 15 bp, Homo sapiens
atttctcttaagtac

SEQ ID NO: 600786 - DNA, 20 bp, Homo sapiens
atttctgctgaattttcaca

SEQ ID NO: 600787 - DNA, 18 bp, Homo sapiens
atttctgtatctgacata

SEQ ID NO: 600788 - DNA, 14 bp, Homo sapiens
atttgaaatgtttt

SEQ ID NO: 600789 - DNA, 14 bp, Homo sapiens
atttgacacactca

SEQ ID NO: 600790 - DNA, 21 bp, Homo sapiens
atttgacattgtcagaatgtt

SEQ ID NO: 600791 - DNA, 23 bp, Homo sapiens
atttgacattgtcagaatgttgt

SEQ ID NO: 600792 - DNA, 15 bp, Homo sapiens
atttgactgttattt

SEQ ID NO: 600793 - DNA, 18 bp, Homo sapiens
atttgcaacactgccaaa

SEQ ID NO: 600794 - DNA, 19 bp, Homo sapiens
atttgcataatatgcatat

SEQ ID NO: 600795 - DNA, 21 bp, Homo sapiens
atttgcataatatgcatatat

SEQ ID NO: 600796 - DNA, 22 bp, Homo sapiens
atttgctagttctgctgccctc

SEQ ID NO: 600797 - DNA, 15 bp, Homo sapiens
atttgctcataagta

SEQ ID NO: 600798 - DNA, 13 bp, Homo sapiens
atttgctgaataa

SEQ ID NO: 600799 - DNA, 16 bp, Homo sapiens
atttgctgaataacaa

SEQ ID NO: 600800 - DNA, 15 bp, Homo sapiens
atttggattcacagc

SEQ ID NO: 600801 - DNA, 13 bp, Homo sapiens
atttgggctcagg

SEQ ID NO: 600802 - DNA, 19 bp, Homo sapiens
atttgggtattttgtcagt

SEQ ID NO: 600803 - DNA, 14 bp, Homo sapiens
atttggtggctcta

SEQ ID NO: 600804 - DNA, 22 bp, Homo sapiens
atttgtcagtgtagatcaactc

SEQ ID NO: 600805 - DNA, 14 bp, Homo sapiens
atttgtgtaactga

SEQ ID NO: 600806 - DNA, 16 bp, Homo sapiens
atttgtgtaactgaaa

SEQ ID NO: 600807 - DNA, 18 bp, Homo sapiens
atttgtgtgcttcacaca

SEQ ID NO: 600808 - DNA, 15 bp, Homo sapiens
atttgttaatgattc

SEQ ID NO: 600809 - DNA, 21 bp, Homo sapiens
atttgttctgggttaacagta

SEQ ID NO: 600810 - DNA, 23 bp, Homo sapiens
atttgttctgggttaacagtaaa

SEQ ID NO: 600811 - DNA, 13 bp, Homo sapiens
atttgtttcatta

SEQ ID NO: 600812 - DNA, 15 bp, Homo sapiens
attttaaacaaaatt

SEQ ID NO: 600813 - DNA, 18 bp, Homo sapiens
attttaaacaaaatttat

SEQ ID NO: 600814 - DNA, 12 bp, Homo sapiens
attttaacatag

SEQ ID NO: 600815 - DNA, 21 bp, Homo sapiens
attttaacatagcagctggtt

SEQ ID NO: 600816 - DNA, 22 bp, Homo sapiens
attttaatagtttctaaaccat

SEQ ID NO: 600817 - DNA, 18 bp, Homo sapiens
attttaccatatggaata

SEQ ID NO: 600818 - DNA, 11 bp, Homo sapiens
attttaggaaa

SEQ ID NO: 600819 - DNA, 16 bp, Homo sapiens
attttaggaaatgaat

SEQ ID NO: 600820 - DNA, 18 bp, Homo sapiens
attttcattatttcaagg

SEQ ID NO: 600821 - DNA, 11 bp, Homo sapiens
attttcatttt

SEQ ID NO: 600822 - DNA, 22 bp, Homo sapiens
attttccagggcaatcaatgtt

SEQ ID NO: 600823 - DNA, 19 bp, Homo sapiens
attttcccagtgaataaat

SEQ ID NO: 600824 - DNA, 15 bp, Homo sapiens
attttcctttatgtg

SEQ ID NO: 600825 - DNA, 17 bp, Homo sapiens
attttcctttatgtgat

SEQ ID NO: 600826 - DNA, 18 bp, Homo sapiens
attttcctttatgtgatg

SEQ ID NO: 600827 - DNA, 17 bp, Homo sapiens
attttccttttttatac

SEQ ID NO: 600828 - DNA, 15 bp, Homo sapiens
attttcgcccaccta

SEQ ID NO: 600829 - DNA, 12 bp, Homo sapiens
attttctgtaat

SEQ ID NO: 600830 - DNA, 15 bp, Homo sapiens
attttctgtaattct

SEQ ID NO: 600831 - DNA, 18 bp, Homo sapiens
attttcttctttaatttt

SEQ ID NO: 600832 - DNA, 12 bp, Homo sapiens
attttgaaatat

SEQ ID NO: 600833 - DNA, 21 bp, Homo sapiens
attttgagccttattaaaata

SEQ ID NO: 600834 - DNA, 15 bp, Homo sapiens
attttgatgtattat

SEQ ID NO: 600835 - DNA, 18 bp, Homo sapiens
attttgattgtttgatga

SEQ ID NO: 600836 - DNA, 20 bp, Homo sapiens
attttggaagaattcatgat

SEQ ID NO: 600837 - DNA, 22 bp, Homo sapiens
attttggaagaattcatgatgc

SEQ ID NO: 600838 - DNA, 16 bp, Homo sapiens
attttggacgtgtgag

SEQ ID NO: 600839 - DNA, 17 bp, Homo sapiens
attttgtctggctgtgg

SEQ ID NO: 600840 - DNA, 14 bp, Homo sapiens
attttgttttgctt

SEQ ID NO: 600841 - DNA, 19 bp, Homo sapiens
attttgttttgctttttct

SEQ ID NO: 600842 - DNA, 23 bp, Homo sapiens
attttgttttgctttttctgact

SEQ ID NO: 600843 - DNA, 14 bp, Homo sapiens
atttttactcaggc

SEQ ID NO: 600844 - DNA, 15 bp, Homo sapiens
atttttactcaggct

SEQ ID NO: 600845 - DNA, 15 bp, Homo sapiens
atttttcattttctc

SEQ ID NO: 600846 - DNA, 15 bp, Homo sapiens
atttttgagtaaaac

SEQ ID NO: 600847 - DNA, 15 bp, Homo sapiens
atttttgcatgttta

SEQ ID NO: 600848 - DNA, 16 bp, Homo sapiens
atttttgcatgtttaa

SEQ ID NO: 600849 - DNA, 16 bp, Homo sapiens
atttttgtaagaaaat

SEQ ID NO: 600850 - DNA, 13 bp, Homo sapiens
attttttgtctgt

SEQ ID NO: 600851 - DNA, 23 bp, Homo sapiens
attttttgtctgtgataacagag

SEQ ID NO: 600852 - DNA, 13 bp, Homo sapiens
attttttgtgaat

SEQ ID NO: 600853 - DNA, 20 bp, Homo sapiens
caagatgtcccattgataat

SEQ ID NO: 600854 - DNA, 22 bp, Homo sapiens
caagattaagttataccagcaa

SEQ ID NO: 600855 - DNA, 17 bp, Homo sapiens
caagattttcctttttt

SEQ ID NO: 600856 - DNA, 22 bp, Homo sapiens
caagattttccttttttataca

SEQ ID NO: 600857 - DNA, 17 bp, Homo sapiens
caagcaaactgaaatta

SEQ ID NO: 600858 - DNA, 23 bp, Homo sapiens
caagcagacacacacatatatac

SEQ ID NO: 600859 - DNA, 16 bp, Homo sapiens
caagccacgttgcaga

SEQ ID NO: 600860 - DNA, 12 bp, Homo sapiens
caagccaggaga

SEQ ID NO: 600861 - DNA, 21 bp, Homo sapiens
caagcccagcctatctctctt

SEQ ID NO: 600862 - DNA, 19 bp, Homo sapiens
caagcccctagtcttagag

SEQ ID NO: 600863 - DNA, 14 bp, Homo sapiens
caagcctgactttg

SEQ ID NO: 600864 - DNA, 17 bp, Homo sapiens
caagctataaaagccca

SEQ ID NO: 600865 - DNA, 18 bp, Homo sapiens
caagctcacttgctttag

SEQ ID NO: 600866 - DNA, 16 bp, Homo sapiens
caagctcatagcacat

SEQ ID NO: 600867 - DNA, 17 bp, Homo sapiens
caagctcatagcacatg

SEQ ID NO: 600868 - DNA, 19 bp, Homo sapiens
caagctcttcattgcactg

SEQ ID NO: 600869 - DNA, 17 bp, Homo sapiens
caaggaaggacatttcc

SEQ ID NO: 600870 - DNA, 16 bp, Homo sapiens
caaggacaacctgccc

SEQ ID NO: 600871 - DNA, 17 bp, Homo sapiens
caaggacaacctgcccc

SEQ ID NO: 600872 - DNA, 12 bp, Homo sapiens
caaggacactga

SEQ ID NO: 600873 - DNA, 14 bp, Homo sapiens
caaggacactgatg

SEQ ID NO: 600874 - DNA, 15 bp, Homo sapiens
caaggagggagaaag

SEQ ID NO: 600875 - DNA, 13 bp, Homo sapiens
caaggatcctgag

SEQ ID NO: 600876 - DNA, 17 bp, Homo sapiens
caaggatcctgagccag

SEQ ID NO: 600877 - DNA, 19 bp, Homo sapiens
caaggatcctgagccagat

SEQ ID NO: 600878 - DNA, 14 bp, Homo sapiens
caaggcaagaagtg

SEQ ID NO: 600879 - DNA, 16 bp, Homo sapiens
caaggcaagaagtggg

SEQ ID NO: 600880 - DNA, 17 bp, Homo sapiens
caaggcccagccctggg

SEQ ID NO: 600881 - DNA, 19 bp, Homo sapiens
ataatataaatgaatgaaa

SEQ ID NO: 600882 - DNA, 13 bp, Homo sapiens
ataatatgcatat

SEQ ID NO: 600883 - DNA, 15 bp, Homo sapiens
ataatatgtacaaat

SEQ ID NO: 600884 - DNA, 14 bp, Homo sapiens
ataatattgccttg

SEQ ID NO: 600885 - DNA, 18 bp, Homo sapiens
ataatattgccttgatgt

SEQ ID NO: 600886 - DNA, 14 bp, Homo sapiens
ataatgagatgtaa

SEQ ID NO: 600887 - DNA, 15 bp, Homo sapiens
atgagaggaaatcac

SEQ ID NO: 600888 - DNA, 14 bp, Homo sapiens
atgagatgatttaa

SEQ ID NO: 600889 - DNA, 14 bp, Homo sapiens
acgtggctgcttca

SEQ ID NO: 600890 - DNA, 15 bp, Homo sapiens
acgtggggtggaatt

SEQ ID NO: 600891 - DNA, 22 bp, Homo sapiens
acgtgtatatgaggatgtatgt

SEQ ID NO: 600892 - DNA, 17 bp, Homo sapiens
acgtgtttcgggccagg

SEQ ID NO: 600893 - DNA, 13 bp, Homo sapiens
acgttaattaaac

SEQ ID NO: 600894 - DNA, 19 bp, Homo sapiens
actaaatagatttttagat

SEQ ID NO: 600895 - DNA, 23 bp, Homo sapiens
actaaatagcatgtattgtgtct

SEQ ID NO: 600896 - DNA, 20 bp, Homo sapiens
actaacgaccgacgcccctc

SEQ ID NO: 600897 - DNA, 15 bp, Homo sapiens
actaacttattttga

SEQ ID NO: 600898 - DNA, 17 bp, Homo sapiens
actaagaatcatcctca

SEQ ID NO: 600899 - DNA, 21 bp, Homo sapiens
actaatgacaagtgacttatt

SEQ ID NO: 600900 - DNA, 15 bp, Homo sapiens
actaatgtaaatatt

SEQ ID NO: 600901 - DNA, 18 bp, Homo sapiens
actacagaagtggaagga

SEQ ID NO: 600902 - DNA, 12 bp, Homo sapiens
actacagaattg

SEQ ID NO: 600903 - DNA, 21 bp, Homo sapiens
actagcactttataagccaat

SEQ ID NO: 600904 - DNA, 18 bp, Homo sapiens
actagccctctttctctc

SEQ ID NO: 600905 - DNA, 20 bp, Homo sapiens
actagccctctttctctctg

SEQ ID NO: 600906 - DNA, 22 bp, Homo sapiens
actagccctctttctctctgtg

SEQ ID NO: 600907 - DNA, 15 bp, Homo sapiens
actaggtgcccagtc

SEQ ID NO: 600908 - DNA, 19 bp, Homo sapiens
actaggtgcccagtcttga

SEQ ID NO: 600909 - DNA, 13 bp, Homo sapiens
actatcagcagcg

SEQ ID NO: 600910 - DNA, 16 bp, Homo sapiens
actatcagggcaagct

SEQ ID NO: 600911 - DNA, 19 bp, Homo sapiens
actatcagggcaagctcat

SEQ ID NO: 600912 - DNA, 18 bp, Homo sapiens
actatggtatatattttg

SEQ ID NO: 600913 - DNA, 18 bp, Homo sapiens
actatttattaaaaccat

SEQ ID NO: 600914 - DNA, 14 bp, Homo sapiens
actattttatgcaa

SEQ ID NO: 600915 - DNA, 18 bp, Homo sapiens
actcaagactatgttctc

SEQ ID NO: 600916 - DNA, 15 bp, Homo sapiens
actcacaaaaggctg

SEQ ID NO: 600917 - DNA, 18 bp, Homo sapiens
actcaccatttaatcatt

SEQ ID NO: 600918 - DNA, 22 bp, Homo sapiens
actcaccatttaatcatttcca

SEQ ID NO: 600919 - DNA, 20 bp, Homo sapiens
actcaggagcacagccatag

SEQ ID NO: 600920 - DNA, 23 bp, Homo sapiens
actcaggtttccggctactgaca

SEQ ID NO: 600921 - DNA, 20 bp, Homo sapiens
actcagtatgctttccctga

SEQ ID NO: 600922 - DNA, 22 bp, Homo sapiens
actcagtgcagggacagcctgc

SEQ ID NO: 600923 - DNA, 15 bp, Homo sapiens
aggctgcgcctgccc

SEQ ID NO: 600924 - DNA, 12 bp, Homo sapiens
aggctgctgccc

SEQ ID NO: 600925 - DNA, 19 bp, Homo sapiens
aggctgctgccccctggct

SEQ ID NO: 600926 - DNA, 20 bp, Homo sapiens
aggctgctgccccctggctt

SEQ ID NO: 600927 - DNA, 14 bp, Homo sapiens
aggctgctggcgcc

SEQ ID NO: 600928 - DNA, 15 bp, Homo sapiens
aggctgctggcgcct

SEQ ID NO: 600929 - DNA, 20 bp, Homo sapiens
aggctgctgtgtagctctgt

SEQ ID NO: 600930 - DNA, 16 bp, Homo sapiens
aggctggataggagag

SEQ ID NO: 600931 - DNA, 12 bp, Homo sapiens
aggcttctccac

SEQ ID NO: 600932 - DNA, 19 bp, Homo sapiens
aggctttattcttccaagt

SEQ ID NO: 600933 - DNA, 12 bp, Homo sapiens
aggctttctatt

SEQ ID NO: 600934 - DNA, 17 bp, Homo sapiens
agggaaaccttggagag

SEQ ID NO: 600935 - DNA, 23 bp, Homo sapiens
agggaaatcaatttaaaggaaag

SEQ ID NO: 600936 - DNA, 14 bp, Homo sapiens
agggaagcccaccc

SEQ ID NO: 600937 - DNA, 16 bp, Homo sapiens
agtacataaagtaata

SEQ ID NO: 600938 - DNA, 15 bp, Homo sapiens
agtaccatcccactg

SEQ ID NO: 600939 - DNA, 16 bp, Homo sapiens
agtactctaatataca

SEQ ID NO: 600940 - DNA, 22 bp, Homo sapiens
agtactgcatgatcttacacga

SEQ ID NO: 600941 - DNA, 22 bp, Homo sapiens
agtacttaccagtcaatgcatt

SEQ ID NO: 600942 - DNA, 19 bp, Homo sapiens
agtactttgccatccttgc

SEQ ID NO: 600943 - DNA, 17 bp, Homo sapiens
agtagagtcaggagaaa

SEQ ID NO: 600944 - DNA, 20 bp, Homo sapiens
agtagcattttaatagtttc

SEQ ID NO: 600945 - DNA, 15 bp, Homo sapiens
agtagctgataaaga

SEQ ID NO: 600946 - DNA, 16 bp, Homo sapiens
agtatacaagtgtttc

SEQ ID NO: 600947 - DNA, 21 bp, Homo sapiens
agtatacacatcataaacaaa

SEQ ID NO: 600948 - DNA, 22 bp, Homo sapiens
agtatacacatcataaacaaag

SEQ ID NO: 600949 - DNA, 15 bp, Homo sapiens
agtatagataaatcc

SEQ ID NO: 600950 - DNA, 23 bp, Homo sapiens
agtatagataaatccaatagtct

SEQ ID NO: 600951 - DNA, 17 bp, Homo sapiens
agtatagatggtagaaa

SEQ ID NO: 600952 - DNA, 20 bp, Homo sapiens
agtatcatctaaatattatg

SEQ ID NO: 600953 - DNA, 21 bp, Homo sapiens
agtatcatctaaatattatgc

SEQ ID NO: 600954 - DNA, 14 bp, Homo sapiens
agtatcttaaaatt

SEQ ID NO: 600955 - DNA, 14 bp, Homo sapiens
agtattgagacact

SEQ ID NO: 600956 - DNA, 18 bp, Homo sapiens
agtattgagacactgtca

SEQ ID NO: 600957 - DNA, 23 bp, Homo sapiens
agtattgttcttgtaaaactgtg

SEQ ID NO: 600958 - DNA, 12 bp, Homo sapiens
agtatttaacat

SEQ ID NO: 600959 - DNA, 13 bp, Homo sapiens
agtatttaacatt

SEQ ID NO: 600960 - DNA, 11 bp, Homo sapiens
agtattttgag

SEQ ID NO: 600961 - DNA, 21 bp, Homo sapiens
agtattttgagccttattaaa

SEQ ID NO: 600962 - DNA, 23 bp, Homo sapiens
agtattttgagccttattaaaat

SEQ ID NO: 600963 - DNA, 16 bp, Homo sapiens
agtcaagctgatgaag

SEQ ID NO: 600964 - DNA, 15 bp, Homo sapiens
agtcaagtctacctg

SEQ ID NO: 600965 - DNA, 15 bp, Homo sapiens
agtcaatcaaacagg

SEQ ID NO: 600966 - DNA, 12 bp, Homo sapiens
agtcagcacaga

SEQ ID NO: 600967 - DNA, 13 bp, Homo sapiens
agtcagcacagag

SEQ ID NO: 600968 - DNA, 13 bp, Homo sapiens
agtcagtattgtt

SEQ ID NO: 600969 - DNA, 15 bp, Homo sapiens
agtcagtgtactctg

SEQ ID NO: 600970 - DNA, 13 bp, Homo sapiens
agtcatctcaaac

SEQ ID NO: 600971 - DNA, 16 bp, Homo sapiens
agtcatctcaaacact

SEQ ID NO: 600972 - DNA, 22 bp, Homo sapiens
agtcatctcaaacactgcttaa

SEQ ID NO: 600973 - DNA, 15 bp, Homo sapiens
agtcatggctgtccc

SEQ ID NO: 600974 - DNA, 23 bp, Homo sapiens
agtcatggctgtcccctgcaagt

SEQ ID NO: 600975 - DNA, 20 bp, Homo sapiens
agtccacccccattgtgaat

SEQ ID NO: 600976 - DNA, 21 bp, Homo sapiens
agtccacccccattgtgaatg

SEQ ID NO: 600977 - DNA, 15 bp, Homo sapiens
agtccactttcctct

SEQ ID NO: 600978 - DNA, 16 bp, Homo sapiens
agtccactttcctctc

SEQ ID NO: 600979 - DNA, 15 bp, Homo sapiens
agtccatgtgataat

SEQ ID NO: 600980 - DNA, 15 bp, Homo sapiens
agtccatttttgagt

SEQ ID NO: 600981 - DNA, 21 bp, Homo sapiens
agtccatttttgagtaaaact

SEQ ID NO: 600982 - DNA, 20 bp, Homo sapiens
agtcccgtgccctgtttcca

SEQ ID NO: 600983 - DNA, 22 bp, Homo sapiens
agtccctggagctgtccttcat

SEQ ID NO: 600984 - DNA, 21 bp, Homo sapiens
agtccgccccgtgctcctctg

SEQ ID NO: 600985 - DNA, 18 bp, Homo sapiens
agtcctcacagcctctcc

SEQ ID NO: 600986 - DNA, 19 bp, Homo sapiens
agtcctcacagcctctccc

SEQ ID NO: 600987 - DNA, 19 bp, Homo sapiens
agtcctcaccttctgtttt

SEQ ID NO: 600988 - DNA, 17 bp, Homo sapiens
agtcctcattgttcaga

SEQ ID NO: 600989 - DNA, 18 bp, Homo sapiens
agtcctcgccccccgccc

SEQ ID NO: 600990 - DNA, 13 bp, Homo sapiens
agtcggctgggca

SEQ ID NO: 600991 - DNA, 14 bp, Homo sapiens
agtcggctgggcag

SEQ ID NO: 600992 - DNA, 20 bp, Homo sapiens
agtcggctgggcagggccgc

SEQ ID NO: 600993 - DNA, 17 bp, Homo sapiens
agtctaatttttattca

SEQ ID NO: 600994 - DNA, 21 bp, Homo sapiens
agtctacctgccttgcctgtt

SEQ ID NO: 600995 - DNA, 15 bp, Homo sapiens
agtctgaaggagagg

SEQ ID NO: 600996 - DNA, 15 bp, Homo sapiens
agtcttactgttttg

SEQ ID NO: 600997 - DNA, 15 bp, Homo sapiens
agtcttgagtgggcc

SEQ ID NO: 600998 - DNA, 15 bp, Homo sapiens
agtcttgttgttcat

SEQ ID NO: 600999 - DNA, 16 bp, Homo sapiens
agtcttgttgttcata

SEQ ID NO: 601000 - DNA, 17 bp, Homo sapiens
agtcttgttgttcatat

SEQ ID NO: 601001 - DNA, 18 bp, Homo sapiens
agtcttgttgttcatata

SEQ ID NO: 601002 - DNA, 13 bp, Homo sapiens
agtgaaatattac

SEQ ID NO: 601003 - DNA, 16 bp, Homo sapiens
agtgaaattagtattt

SEQ ID NO: 601004 - DNA, 21 bp, Homo sapiens
agtgaaattagtattttgagc

SEQ ID NO: 601005 - DNA, 20 bp, Homo sapiens
agtgaagcccaggaggacct

SEQ ID NO: 601006 - DNA, 17 bp, Homo sapiens
agtgacagaaggcccga

SEQ ID NO: 601007 - DNA, 21 bp, Homo sapiens
agtgacatgggtgtgccaggc

SEQ ID NO: 601008 - DNA, 22 bp, Homo sapiens
agtgacatgggtgtgccaggct

SEQ ID NO: 601009 - DNA, 20 bp, Homo sapiens
agtgacatgtcctctctgct

SEQ ID NO: 601010 - DNA, 14 bp, Homo sapiens
agtgagaaattttt

SEQ ID NO: 601011 - DNA, 16 bp, Homo sapiens
agtgatgtgatttatg

SEQ ID NO: 601012 - DNA, 19 bp, Homo sapiens
agtgatgtgatttatgcat

SEQ ID NO: 601013 - DNA, 21 bp, Homo sapiens
agtgatgtgatttatgcattt

SEQ ID NO: 601014 - DNA, 23 bp, Homo sapiens
agtgatgtggtgggagcacagct

SEQ ID NO: 601015 - DNA, 22 bp, Homo sapiens
agtgattgacattttgtagcta

SEQ ID NO: 601016 - DNA, 13 bp, Homo sapiens
agtgatttgtaaa

SEQ ID NO: 601017 - DNA, 21 bp, Homo sapiens
agtgatttgtaaaacagtggt

SEQ ID NO: 601018 - DNA, 18 bp, Homo sapiens
agtgcagcaaccagagca

SEQ ID NO: 601019 - DNA, 20 bp, Homo sapiens
agtgcagcaaccagagcact

SEQ ID NO: 601020 - DNA, 22 bp, Homo sapiens
agtgcagcaaccagagcactgt

SEQ ID NO: 601021 - DNA, 20 bp, Homo sapiens
agtgcagggacagcctgcac

SEQ ID NO: 601022 - DNA, 17 bp, Homo sapiens
agtgcatgttaaaataa

SEQ ID NO: 601023 - DNA, 20 bp, Homo sapiens
agtgcattcattcatcctct

SEQ ID NO: 601024 - DNA, 14 bp, Homo sapiens
agtgccgcctgtgc

SEQ ID NO: 601025 - DNA, 12 bp, Homo sapiens
agtgcctgctgt

SEQ ID NO: 601026 - DNA, 14 bp, Homo sapiens
agtgcctgctgttc

SEQ ID NO: 601027 - DNA, 13 bp, Homo sapiens
agtgccttatgga

SEQ ID NO: 601028 - DNA, 15 bp, Homo sapiens
agtgccttatggaac

SEQ ID NO: 601029 - DNA, 18 bp, Homo sapiens
agtgccttatggaacact

SEQ ID NO: 601030 - DNA, 21 bp, Homo sapiens
agtgccttatggaacactctg

SEQ ID NO: 601031 - DNA, 22 bp, Homo sapiens
agtgccttatggaacactctga

SEQ ID NO: 601032 - DNA, 17 bp, Homo sapiens
agtgctatgcatattta

SEQ ID NO: 601033 - DNA, 16 bp, Homo sapiens
agtgctgctcccttta

SEQ ID NO: 601034 - DNA, 18 bp, Homo sapiens
agtggacgtgggctccag

SEQ ID NO: 601035 - DNA, 14 bp, Homo sapiens
agtggagaggggac

SEQ ID NO: 601036 - DNA, 15 bp, Homo sapiens
agtggatatgcgaat

SEQ ID NO: 601037 - DNA, 13 bp, Homo sapiens
agtggatctggag

SEQ ID NO: 601038 - DNA, 21 bp, Homo sapiens
agtggcaggtgggctgcctgc

SEQ ID NO: 601039 - DNA, 15 bp, Homo sapiens
agtggcctgagaaga

SEQ ID NO: 601040 - DNA, 16 bp, Homo sapiens
agtggcctgagaagag

SEQ ID NO: 601041 - DNA, 21 bp, Homo sapiens
agtggcctgagaagagtcgag

SEQ ID NO: 601042 - DNA, 12 bp, Homo sapiens
agtggctggggg

SEQ ID NO: 601043 - DNA, 21 bp, Homo sapiens
agtggctgggggactgctttc

SEQ ID NO: 601044 - DNA, 21 bp, Homo sapiens
agcagcaaggtgggggtcagg

SEQ ID NO: 601045 - DNA, 15 bp, Homo sapiens
agcagcagcagcagc

SEQ ID NO: 601046 - DNA, 14 bp, Homo sapiens
agcagccccctgtg

SEQ ID NO: 601047 - DNA, 14 bp, Homo sapiens
agcagcgcccgagg

SEQ ID NO: 601048 - DNA, 22 bp, Homo sapiens
agcagcgcccgaggccagggcc

SEQ ID NO: 601049 - DNA, 18 bp, Homo sapiens
agcagctagaaagagaaa

SEQ ID NO: 601050 - DNA, 21 bp, Homo sapiens
agcaggaggacagagtgccct

SEQ ID NO: 601051 - DNA, 20 bp, Homo sapiens
agcaggggggttgggttcca

SEQ ID NO: 601052 - DNA, 16 bp, Homo sapiens
agcagtaaatgtatat

SEQ ID NO: 601053 - DNA, 18 bp, Homo sapiens
agcagtaccatcccactg

SEQ ID NO: 601054 - DNA, 16 bp, Homo sapiens
agcagtccaaggtatt

SEQ ID NO: 601055 - DNA, 24 bp, Homo sapiens
agcagtccatttttgagtaaaact

SEQ ID NO: 601056 - DNA, 13 bp, Homo sapiens
agcagtggggagc

SEQ ID NO: 601057 - DNA, 15 bp, Homo sapiens
agcagtggggagcgg

SEQ ID NO: 601058 - DNA, 16 bp, Homo sapiens
agcatagccagcattc

SEQ ID NO: 601059 - DNA, 22 bp, Homo sapiens
agcatagccagcattcagcaca

SEQ ID NO: 601060 - DNA, 11 bp, Homo sapiens
agcatatataa

SEQ ID NO: 601061 - DNA, 17 bp, Homo sapiens
agcatatatataaaata

SEQ ID NO: 601062 - DNA, 22 bp, Homo sapiens
agcatatatataaaatacacgt

SEQ ID NO: 601063 - DNA, 21 bp, Homo sapiens
agcatccatggatgcagaaat

SEQ ID NO: 601064 - DNA, 17 bp, Homo sapiens
agcatgcccaaatataa

SEQ ID NO: 601065 - DNA, 21 bp, Homo sapiens
agcgcctcgccccagccaagc

SEQ ID NO: 601066 - DNA, 16 bp, Homo sapiens
agcgcgtgccttcccc

SEQ ID NO: 601067 - DNA, 19 bp, Homo sapiens
agcggccccgcggagcccc

SEQ ID NO: 601068 - DNA, 19 bp, Homo sapiens
agcggcccggcccacgcag

SEQ ID NO: 601069 - DNA, 19 bp, Homo sapiens
agcgggggctaactggccc

SEQ ID NO: 601070 - DNA, 21 bp, Homo sapiens
agcgggggctaactggcccca

SEQ ID NO: 601071 - DNA, 21 bp, Homo sapiens
agcgtgtcctatccccggacc

SEQ ID NO: 601072 - DNA, 18 bp, Homo sapiens
agcgttgttttgtggata

SEQ ID NO: 601073 - DNA, 18 bp, Homo sapiens
agctaccaactaagttgt

SEQ ID NO: 601074 - DNA, 13 bp, Homo sapiens
agctagaaagaga

SEQ ID NO: 601075 - DNA, 22 bp, Homo sapiens
agctagaggagattgctctggg

SEQ ID NO: 601076 - DNA, 16 bp, Homo sapiens
agctagatgcccctgc

SEQ ID NO: 601077 - DNA, 13 bp, Homo sapiens
agctaggcaggga

SEQ ID NO: 601078 - DNA, 20 bp, Homo sapiens
agctaggttaataggaggac

SEQ ID NO: 601079 - DNA, 17 bp, Homo sapiens
agctaggttgtcctatt

SEQ ID NO: 601080 - DNA, 23 bp, Homo sapiens
agctagttagagactcgcctggg

SEQ ID NO: 601081 - DNA, 21 bp, Homo sapiens
agctagtttaaaattattaaa

SEQ ID NO: 601082 - DNA, 22 bp, Homo sapiens
agctagtttaaaattattaaaa

SEQ ID NO: 601083 - DNA, 21 bp, Homo sapiens
agctatatatatatatatatg

SEQ ID NO: 601084 - DNA, 23 bp, Homo sapiens
agctatatatatatatatatgta

SEQ ID NO: 601085 - DNA, 14 bp, Homo sapiens
agctatgcacacca

SEQ ID NO: 601086 - DNA, 14 bp, Homo sapiens
agctcacacttggg

SEQ ID NO: 601087 - DNA, 22 bp, Homo sapiens
agctcacacttgggctggcacc

SEQ ID NO: 601088 - DNA, 22 bp, Homo sapiens
agctcacagcacatttgttaat

SEQ ID NO: 601089 - DNA, 18 bp, Homo sapiens
agctcaggagaaggcctg

SEQ ID NO: 601090 - DNA, 19 bp, Homo sapiens
agctcaggagaaggcctgc

SEQ ID NO: 601091 - DNA, 16 bp, Homo sapiens
agctcaggccctggtg

SEQ ID NO: 601092 - DNA, 15 bp, Homo sapiens
agctcatagcacatg

SEQ ID NO: 601093 - DNA, 16 bp, Homo sapiens
agctcatagcacatgt

SEQ ID NO: 601094 - DNA, 19 bp, Homo sapiens
agctcatagcacatgtttt

SEQ ID NO: 601095 - DNA, 20 bp, Homo sapiens
agctcatagcacatgtttta

SEQ ID NO: 601096 - DNA, 22 bp, Homo sapiens
agctcatagcacatgttttaca

SEQ ID NO: 601097 - DNA, 23 bp, Homo sapiens
agctcatagcacatgttttacaa

SEQ ID NO: 601098 - DNA, 14 bp, Homo sapiens
agctccaccctccc

SEQ ID NO: 601099 - DNA, 13 bp, Homo sapiens
agctccttcatgc

SEQ ID NO: 601100 - DNA, 17 bp, Homo sapiens
agctccttcatgctttt

SEQ ID NO: 601101 - DNA, 14 bp, Homo sapiens
agctcgtagaaaca

SEQ ID NO: 601102 - DNA, 16 bp, Homo sapiens
agctcgtagaaacaag

SEQ ID NO: 601103 - DNA, 18 bp, Homo sapiens
agctcgtgtgcttagaaa

SEQ ID NO: 601104 - DNA, 13 bp, Homo sapiens
agctctaaagcag

SEQ ID NO: 601105 - DNA, 18 bp, Homo sapiens
agctctaaagcagagatg

SEQ ID NO: 601106 - DNA, 21 bp, Homo sapiens
agctctaaagcagagatgtat

SEQ ID NO: 601107 - DNA, 14 bp, Homo sapiens
agctctccctcaca

SEQ ID NO: 601108 - DNA, 19 bp, Homo sapiens
agctctgaatgctatttgt

SEQ ID NO: 601109 - DNA, 15 bp, Homo sapiens
agctctgagcagaca

SEQ ID NO: 601110 - DNA, 18 bp, Homo sapiens
agctctgcataagattat

SEQ ID NO: 601111 - DNA, 22 bp, Homo sapiens
agctctgcataagattatatac

SEQ ID NO: 601112 - DNA, 18 bp, Homo sapiens
agctctggatgaaggcaa

SEQ ID NO: 601113 - DNA, 12 bp, Homo sapiens
agctctgtccac

SEQ ID NO: 601114 - DNA, 13 bp, Homo sapiens
agctctgtccact

SEQ ID NO: 601115 - DNA, 14 bp, Homo sapiens
agctgagctggcct

SEQ ID NO: 601116 - DNA, 19 bp, Homo sapiens
agctgataaagaaaccttt

SEQ ID NO: 601117 - DNA, 21 bp, Homo sapiens
agctgatagaagaaggactga

SEQ ID NO: 601118 - DNA, 13 bp, Homo sapiens
agctgattagtgt

SEQ ID NO: 601119 - DNA, 22 bp, Homo sapiens
agctgctgtatttgaggaaact

SEQ ID NO: 601120 - DNA, 19 bp, Homo sapiens
agctgcttctctttataga

SEQ ID NO: 601121 - DNA, 15 bp, Homo sapiens
agctggcagcgcctc

SEQ ID NO: 601122 - DNA, 20 bp, Homo sapiens
agctggcagcgcctcccgcc

SEQ ID NO: 601123 - DNA, 19 bp, Homo sapiens
agctggcgcgtgtgtggcc

SEQ ID NO: 601124 - DNA, 13 bp, Homo sapiens
agctggctgggtc

SEQ ID NO: 601125 - DNA, 21 bp, Homo sapiens
agctggctgggtcgcccctcc

SEQ ID NO: 601126 - DNA, 23 bp, Homo sapiens
agctggctgggtcgcccctcctc

SEQ ID NO: 601127 - DNA, 15 bp, Homo sapiens
agctgtgaccctcaa

SEQ ID NO: 601128 - DNA, 12 bp, Homo sapiens
agctgtgatttt

SEQ ID NO: 601129 - DNA, 23 bp, Homo sapiens
agctgtttactgacatggtgctg

SEQ ID NO: 601130 - DNA, 13 bp, Homo sapiens
agcttccagatgg

SEQ ID NO: 601131 - DNA, 17 bp, Homo sapiens
agcttggagccccctgg

SEQ ID NO: 601132 - DNA, 20 bp, Homo sapiens
agcttggagccccctggcgg

SEQ ID NO: 601133 - DNA, 21 bp, Homo sapiens
agcttggagccccctggcggc

SEQ ID NO: 601134 - DNA, 18 bp, Homo sapiens
agctttaaaaccacagct

SEQ ID NO: 601135 - DNA, 19 bp, Homo sapiens
agctttaaaaccacagctg

SEQ ID NO: 601136 - DNA, 23 bp, Homo sapiens
agctttaaaaccacagctgggca

SEQ ID NO: 601137 - DNA, 19 bp, Homo sapiens
agctttagagaagccataa

SEQ ID NO: 601138 - DNA, 20 bp, Homo sapiens
agctttagagaagccataac

SEQ ID NO: 601139 - DNA, 15 bp, Homo sapiens
agctttcctgggtct

SEQ ID NO: 601140 - DNA, 23 bp, Homo sapiens
agctttgcaaccttgtactttac

SEQ ID NO: 601141 - DNA, 19 bp, Homo sapiens
agctttggaagcagcaagg

SEQ ID NO: 601142 - DNA, 15 bp, Homo sapiens
agcttttcacttctt

SEQ ID NO: 601143 - DNA, 18 bp, Homo sapiens
agcttttcacttcttaag

SEQ ID NO: 601144 - DNA, 12 bp, Homo sapiens
aggaaaagagaa

SEQ ID NO: 601145 - DNA, 14 bp, Homo sapiens
aggaaaaggcttga

SEQ ID NO: 601146 - DNA, 22 bp, Homo sapiens
aggaaacttggacatttatgta

SEQ ID NO: 601147 - DNA, 16 bp, Homo sapiens
aggaaagatcccaagt

SEQ ID NO: 601148 - DNA, 17 bp, Homo sapiens
aggaaagatcccaagtc

SEQ ID NO: 601149 - DNA, 16 bp, Homo sapiens
aggaaagcagtgcagt

SEQ ID NO: 601150 - DNA, 15 bp, Homo sapiens
aggaaagttctatta

SEQ ID NO: 601151 - DNA, 19 bp, Homo sapiens
aggaaagttctattatctg

SEQ ID NO: 601152 - DNA, 21 bp, Homo sapiens
aggaaatatctgtgaaggact

SEQ ID NO: 601153 - DNA, 17 bp, Homo sapiens
aggaaatgaatgtgtgt

SEQ ID NO: 601154 - DNA, 11 bp, Homo sapiens
aggaaattttt

SEQ ID NO: 601155 - DNA, 14 bp, Homo sapiens
aggaaatttttgca

SEQ ID NO: 601156 - DNA, 17 bp, Homo sapiens
aggaaatttttgcatgt

SEQ ID NO: 601157 - DNA, 22 bp, Homo sapiens
aggaaatttttgcatgtttaat

SEQ ID NO: 601158 - DNA, 13 bp, Homo sapiens
aggaagcacctct

SEQ ID NO: 601159 - DNA, 15 bp, Homo sapiens
aggaagcacctctca

SEQ ID NO: 601160 - DNA, 14 bp, Homo sapiens
aggaagctttggaa

SEQ ID NO: 601161 - DNA, 16 bp, Homo sapiens
aggaagctttggaagc

SEQ ID NO: 601162 - DNA, 18 bp, Homo sapiens
aggaagctttggaagcag

SEQ ID NO: 601163 - DNA, 17 bp, Homo sapiens
aggaagtcatcctgcaa

SEQ ID NO: 601164 - DNA, 18 bp, Homo sapiens
accctgtgggggcggctg

SEQ ID NO: 601165 - DNA, 17 bp, Homo sapiens
acccttcaatgttaaat

SEQ ID NO: 601166 - DNA, 10 bp, Homo sapiens
acccttcccc

SEQ ID NO: 601167 - DNA, 17 bp, Homo sapiens
acccttccccactcccg

SEQ ID NO: 601168 - DNA, 17 bp, Homo sapiens
accgaaaacgtggctgc

SEQ ID NO: 601169 - DNA, 18 bp, Homo sapiens
accgcccacccacacccc

SEQ ID NO: 601170 - DNA, 20 bp, Homo sapiens
accgcccacccagcagcgcc

SEQ ID NO: 601171 - DNA, 21 bp, Homo sapiens
accgcccacccagcagcgccc

SEQ ID NO: 601172 - DNA, 22 bp, Homo sapiens
accgcccacccagcagcgcccg

SEQ ID NO: 601173 - DNA, 14 bp, Homo sapiens
accgcgcccctctg

SEQ ID NO: 601174 - DNA, 20 bp, Homo sapiens
accgcgcccctctgcgcccc

SEQ ID NO: 601175 - DNA, 23 bp, Homo sapiens
accgcgcccctctgcgccccagc

SEQ ID NO: 601176 - DNA, 19 bp, Homo sapiens
accggacgcatgcagggcc

SEQ ID NO: 601177 - DNA, 14 bp, Homo sapiens
accgggactacaga

SEQ ID NO: 601178 - DNA, 16 bp, Homo sapiens
accgggactacagaag

SEQ ID NO: 601179 - DNA, 20 bp, Homo sapiens
accggggtggagtcagggct

SEQ ID NO: 601180 - DNA, 22 bp, Homo sapiens
accggggtggagtcagggctgt

SEQ ID NO: 601181 - DNA, 15 bp, Homo sapiens
accgtcaatgtgaaa

SEQ ID NO: 601182 - DNA, 17 bp, Homo sapiens
accgtcaatgtgaaata

SEQ ID NO: 601183 - DNA, 14 bp, Homo sapiens
accgtggtgtcctc

SEQ ID NO: 601184 - DNA, 18 bp, Homo sapiens
accgtggtgtcctctgtc

SEQ ID NO: 601185 - DNA, 21 bp, Homo sapiens
accgtggtgtgaggcccccgg

SEQ ID NO: 601186 - DNA, 22 bp, Homo sapiens
accgtggtgtgaggcccccgga

SEQ ID NO: 601187 - DNA, 19 bp, Homo sapiens
acctaaagggaagccctga

SEQ ID NO: 601188 - DNA, 16 bp, Homo sapiens
acctaaattaacaaat

SEQ ID NO: 601189 - DNA, 22 bp, Homo sapiens
acctaactccctaggcctgagt

SEQ ID NO: 601190 - DNA, 15 bp, Homo sapiens
acctaattaatttca

SEQ ID NO: 601191 - DNA, 13 bp, Homo sapiens
acctactgcccac

SEQ ID NO: 601192 - DNA, 14 bp, Homo sapiens
acctactgcccaca

SEQ ID NO: 601193 - DNA, 17 bp, Homo sapiens
acctactgcccacattt

SEQ ID NO: 601194 - DNA, 23 bp, Homo sapiens
acctattcaagaagatagttgta

SEQ ID NO: 601195 - DNA, 21 bp, Homo sapiens
acctcacaaggttatcagaaa

SEQ ID NO: 601196 - DNA, 15 bp, Homo sapiens
acctcagtcagtatt

SEQ ID NO: 601197 - DNA, 17 bp, Homo sapiens
acctcagtcagtattgt

SEQ ID NO: 601198 - DNA, 16 bp, Homo sapiens
acctcagttggcctct

SEQ ID NO: 601199 - DNA, 21 bp, Homo sapiens
acctcagttggcctctgcccc

SEQ ID NO: 601200 - DNA, 13 bp, Homo sapiens
actgggtgtggcc

SEQ ID NO: 601201 - DNA, 23 bp, Homo sapiens
actgtacttgatttttcaaagac

SEQ ID NO: 601202 - DNA, 23 bp, Homo sapiens
actgtagtttttgttcaccttct

SEQ ID NO: 601203 - DNA, 20 bp, Homo sapiens
actgtatttacttgttatgt

SEQ ID NO: 601204 - DNA, 20 bp, Homo sapiens
actgtcatgtgcgaacacag

SEQ ID NO: 601205 - DNA, 19 bp, Homo sapiens
actgtcccggagctcaggc

SEQ ID NO: 601206 - DNA, 16 bp, Homo sapiens
actgtcttcaaccctg

SEQ ID NO: 601207 - DNA, 18 bp, Homo sapiens
actgtcttcaaccctgcc

SEQ ID NO: 601208 - DNA, 20 bp, Homo sapiens
actgtgacacagctgagctg

SEQ ID NO: 601209 - DNA, 17 bp, Homo sapiens
actgtgacattccacag

SEQ ID NO: 601210 - DNA, 15 bp, Homo sapiens
actgtgagataaata

SEQ ID NO: 601211 - DNA, 17 bp, Homo sapiens
actgtgagataaatatc

SEQ ID NO: 601212 - DNA, 19 bp, Homo sapiens
actgtgagataaatatcat

SEQ ID NO: 601213 - DNA, 21 bp, Homo sapiens
actgtggataaattttggaag

SEQ ID NO: 601214 - DNA, 23 bp, Homo sapiens
actgtggatacgggggttccctt

SEQ ID NO: 601215 - DNA, 14 bp, Homo sapiens
actgtggctgcaga

SEQ ID NO: 601216 - DNA, 21 bp, Homo sapiens
actgtggtcccagctacaggg

SEQ ID NO: 601217 - DNA, 14 bp, Homo sapiens
actgtgttcagtgc

SEQ ID NO: 601218 - DNA, 22 bp, Homo sapiens
actgtgtttcgcattaagcaca

SEQ ID NO: 601219 - DNA, 20 bp, Homo sapiens
actgttcccagcaaagtttt

SEQ ID NO: 601220 - DNA, 12 bp, Homo sapiens
actgtttataat

SEQ ID NO: 601221 - DNA, 22 bp, Homo sapiens
actgttttgggcctccatgccc

SEQ ID NO: 601222 - DNA, 13 bp, Homo sapiens
acttaaaatcaaa

SEQ ID NO: 601223 - DNA, 20 bp, Homo sapiens
acttaaacaaaaactttcca

SEQ ID NO: 601224 - DNA, 17 bp, Homo sapiens
acttaaacctgtgcttt

SEQ ID NO: 601225 - DNA, 18 bp, Homo sapiens
acttaaacctgtgctttc

SEQ ID NO: 601226 - DNA, 11 bp, Homo sapiens
acttaatttag

SEQ ID NO: 601227 - DNA, 17 bp, Homo sapiens
acttacacacctgagaa

SEQ ID NO: 601228 - DNA, 21 bp, Homo sapiens
acttacacacctgagaatgtg

SEQ ID NO: 601229 - DNA, 22 bp, Homo sapiens
agaatgagggcgtgaaacacaa

SEQ ID NO: 601230 - DNA, 16 bp, Homo sapiens
agaatgatcaccctga

SEQ ID NO: 601231 - DNA, 13 bp, Homo sapiens
agaatggtgggct

SEQ ID NO: 601232 - DNA, 23 bp, Homo sapiens
agaatggtgggctccagagtagg

SEQ ID NO: 601233 - DNA, 15 bp, Homo sapiens
agaattcatgatgct

SEQ ID NO: 601234 - DNA, 21 bp, Homo sapiens
agaattgtttttagaaattta

SEQ ID NO: 601235 - DNA, 13 bp, Homo sapiens
agaattttaaaaa

SEQ ID NO: 601236 - DNA, 21 bp, Homo sapiens
agacaaagtttggaagtacat

SEQ ID NO: 601237 - DNA, 12 bp, Homo sapiens
agacaaatacac

SEQ ID NO: 601238 - DNA, 13 bp, Homo sapiens
agacaagtctgag

SEQ ID NO: 601239 - DNA, 18 bp, Homo sapiens
agacaagtctgagtagtt

SEQ ID NO: 601240 - DNA, 14 bp, Homo sapiens
agacaatgtggaat

SEQ ID NO: 601241 - DNA, 22 bp, Homo sapiens
agacacacaagcagacacacac

SEQ ID NO: 601242 - DNA, 20 bp, Homo sapiens
agacacagcccagagactga

SEQ ID NO: 601243 - DNA, 13 bp, Homo sapiens
agacactgtcaag

SEQ ID NO: 601244 - DNA, 20 bp, Homo sapiens
agacagaggtttcattttca

SEQ ID NO: 601245 - DNA, 13 bp, Homo sapiens
agacagagtggat

SEQ ID NO: 601246 - DNA, 16 bp, Homo sapiens
agacagagtggatctg

SEQ ID NO: 601247 - DNA, 18 bp, Homo sapiens
agacagagtggatctgga

SEQ ID NO: 601248 - DNA, 23 bp, Homo sapiens
agacattgttttgccaacattgc

SEQ ID NO: 601249 - DNA, 17 bp, Homo sapiens
agaccaccgcgcccctc

SEQ ID NO: 601250 - DNA, 18 bp, Homo sapiens
agaccaccgcgcccctct

SEQ ID NO: 601251 - DNA, 14 bp, Homo sapiens
agaccacgcccctg

SEQ ID NO: 601252 - DNA, 16 bp, Homo sapiens
agaccacgcccctgcc

SEQ ID NO: 601253 - DNA, 15 bp, Homo sapiens
agaccagcctgccag

SEQ ID NO: 601254 - DNA, 21 bp, Homo sapiens
agaccatttagtcctcacctt

SEQ ID NO: 601255 - DNA, 12 bp, Homo sapiens
agaccctgtctt

SEQ ID NO: 601256 - DNA, 21 bp, Homo sapiens
agacctccagattattttcta

SEQ ID NO: 601257 - DNA, 22 bp, Homo sapiens
agaccttacaaccacatttctg

SEQ ID NO: 601258 - DNA, 20 bp, Homo sapiens
agacggaatgaccagaaaat

SEQ ID NO: 601259 - DNA, 15 bp, Homo sapiens
agacggacgggacag

SEQ ID NO: 601260 - DNA, 23 bp, Homo sapiens
agacggacgggacagcggcccgg

SEQ ID NO: 601261 - DNA, 19 bp, Homo sapiens
agactccaaggagctactg

SEQ ID NO: 601262 - DNA, 15 bp, Homo sapiens
agactcgcgacaatg

SEQ ID NO: 601263 - DNA, 23 bp, Homo sapiens
agactctaaaactatcagcagcg

SEQ ID NO: 601264 - DNA, 20 bp, Homo sapiens
agactctgtgagattctaaa

SEQ ID NO: 601265 - DNA, 12 bp, Homo sapiens
agactgcccacc

SEQ ID NO: 601266 - DNA, 16 bp, Homo sapiens
agactgcccaccctgg

SEQ ID NO: 601267 - DNA, 21 bp, Homo sapiens
agactgcccaccctgggcctc

SEQ ID NO: 601268 - DNA, 18 bp, Homo sapiens
agactgccttatattatt

SEQ ID NO: 601269 - DNA, 16 bp, Homo sapiens
agactgctttgagaaa

SEQ ID NO: 601270 - DNA, 14 bp, Homo sapiens
agacttcatttaac

SEQ ID NO: 601271 - DNA, 17 bp, Homo sapiens
agacttcctattaattt

SEQ ID NO: 601272 - DNA, 19 bp, Homo sapiens
agacttcctattaatttat

SEQ ID NO: 601273 - DNA, 20 bp, Homo sapiens
agagaaacactaatggccaa

SEQ ID NO: 601274 - DNA, 22 bp, Homo sapiens
agagaactaacactattttatg

SEQ ID NO: 601275 - DNA, 14 bp, Homo sapiens
agagaccacttcct

SEQ ID NO: 601276 - DNA, 17 bp, Homo sapiens
agagaccacttccttaa

SEQ ID NO: 601277 - DNA, 18 bp, Homo sapiens
agagaccacttccttaac

SEQ ID NO: 601278 - DNA, 19 bp, Homo sapiens
agagaccacttccttaaca

SEQ ID NO: 601279 - DNA, 16 bp, Homo sapiens
agagacggcagcccca

SEQ ID NO: 601280 - DNA, 20 bp, Homo sapiens
agagacggcagccccatcct

SEQ ID NO: 601281 - DNA, 12 bp, Homo sapiens
agagactgccca

SEQ ID NO: 601282 - DNA, 14 bp, Homo sapiens
agagactgcccacc

SEQ ID NO: 601283 - DNA, 20 bp, Homo sapiens
agagactgcccaccctgggc

SEQ ID NO: 601284 - DNA, 19 bp, Homo sapiens
agagactggttttttccag

SEQ ID NO: 601285 - DNA, 17 bp, Homo sapiens
agagacttctaaatcat

SEQ ID NO: 601286 - DNA, 22 bp, Homo sapiens
agagagcaatcttgctgtgaaa

SEQ ID NO: 601287 - DNA, 23 bp, Homo sapiens
agagagcggcttccccatcgcct

SEQ ID NO: 601288 - DNA, 12 bp, Homo sapiens
agagaggacagt

SEQ ID NO: 601289 - DNA, 13 bp, Homo sapiens
agagaggctgcct

SEQ ID NO: 601290 - DNA, 16 bp, Homo sapiens
agagaggctgcctcag

SEQ ID NO: 601291 - DNA, 14 bp, Homo sapiens
agagataccctctg

SEQ ID NO: 601292 - DNA, 23 bp, Homo sapiens
agagatatatctgaaaactggaa

SEQ ID NO: 601293 - DNA, 15 bp, Homo sapiens
agagatcataaagag

SEQ ID NO: 601294 - DNA, 23 bp, Homo sapiens
agagattgacttcagaaactttt

SEQ ID NO: 601295 - DNA, 13 bp, Homo sapiens
agagattgggggg

SEQ ID NO: 601296 - DNA, 19 bp, Homo sapiens
agagattgggggggcttgg

SEQ ID NO: 601297 - DNA, 16 bp, Homo sapiens
agagattttatgttta

SEQ ID NO: 601298 - DNA, 18 bp, Homo sapiens
agagattttatgtttaaa

SEQ ID NO: 601299 - DNA, 20 bp, Homo sapiens
agagcaatcttgctgtgaaa

SEQ ID NO: 601300 - DNA, 20 bp, Homo sapiens
agagcattctggggtggggc

SEQ ID NO: 601301 - DNA, 16 bp, Homo sapiens
agagccactacctttg

SEQ ID NO: 601302 - DNA, 17 bp, Homo sapiens
agagccccggagcacca

SEQ ID NO: 601303 - DNA, 22 bp, Homo sapiens
agagccccggagcaccacgggg

SEQ ID NO: 601304 - DNA, 10 bp, Homo sapiens
agagccctgc

SEQ ID NO: 601305 - DNA, 18 bp, Homo sapiens
agagcctttctccagccc

SEQ ID NO: 601306 - DNA, 22 bp, Homo sapiens
agagcctttctccagcccatgc

SEQ ID NO: 601307 - DNA, 17 bp, Homo sapiens
agagcgatgtgttcttt

SEQ ID NO: 601308 - DNA, 19 bp, Homo sapiens
agagcgccacccgcccgcc

SEQ ID NO: 601309 - DNA, 20 bp, Homo sapiens
agagcgccacccgcccgccc

SEQ ID NO: 601310 - DNA, 13 bp, Homo sapiens
agagctatgcaca

SEQ ID NO: 601311 - DNA, 23 bp, Homo sapiens
agaggaaaaggcttgagtctgga

SEQ ID NO: 601312 - DNA, 21 bp, Homo sapiens
agaggaaatcaccgaaaacgt

SEQ ID NO: 601313 - DNA, 21 bp, Homo sapiens
agaggaatgtagggcctgcat

SEQ ID NO: 601314 - DNA, 23 bp, Homo sapiens
agaggacagtttaggacccaagg

SEQ ID NO: 601315 - DNA, 19 bp, Homo sapiens
agaggagagtggcaggtgg

SEQ ID NO: 601316 - DNA, 14 bp, Homo sapiens
agaggagcaaacag

SEQ ID NO: 601317 - DNA, 16 bp, Homo sapiens
agaggagcgtgtccta

SEQ ID NO: 601318 - DNA, 22 bp, Homo sapiens
agaggaggtgtggagtggaggg

SEQ ID NO: 601319 - DNA, 11 bp, Homo sapiens
agaggcagggc

SEQ ID NO: 601320 - DNA, 13 bp, Homo sapiens
agaggcagggccc

SEQ ID NO: 601321 - DNA, 17 bp, Homo sapiens
gataatcagtttccact

SEQ ID NO: 601322 - DNA, 14 bp, Homo sapiens
gataattaaatgaa

SEQ ID NO: 601323 - DNA, 18 bp, Homo sapiens
gataattaaatgaaatac

SEQ ID NO: 601324 - DNA, 17 bp, Homo sapiens
gataattcgagcaaaca

SEQ ID NO: 601325 - DNA, 13 bp, Homo sapiens
gataattttcatt

SEQ ID NO: 601326 - DNA, 23 bp, Homo sapiens
gatacgggggttccctttcccca

SEQ ID NO: 601327 - DNA, 14 bp, Homo sapiens
gatacttggtcctt

SEQ ID NO: 601328 - DNA, 15 bp, Homo sapiens
gataggagggtgccc

SEQ ID NO: 601329 - DNA, 20 bp, Homo sapiens
gataggagggtgcccctggg

SEQ ID NO: 601330 - DNA, 13 bp, Homo sapiens
gatagtttacaaa

SEQ ID NO: 601331 - DNA, 14 bp, Homo sapiens
gatataagccatag

SEQ ID NO: 601332 - DNA, 12 bp, Homo sapiens
gatatatctgaa

SEQ ID NO: 601333 - DNA, 14 bp, Homo sapiens
gatatatctgaaaa

SEQ ID NO: 601334 - DNA, 18 bp, Homo sapiens
gatatcacagtctaattt

SEQ ID NO: 601335 - DNA, 21 bp, Homo sapiens
gatatcaggaaatatctgtga

SEQ ID NO: 601336 - DNA, 15 bp, Homo sapiens
gatatgaaagagaaa

SEQ ID NO: 601337 - DNA, 23 bp, Homo sapiens
gatatgaaagagaaaatgctttc

SEQ ID NO: 601338 - DNA, 13 bp, Homo sapiens
gatatgtctttaa

SEQ ID NO: 601339 - DNA, 19 bp, Homo sapiens
gatcaaggagggagaaagg

SEQ ID NO: 601340 - DNA, 20 bp, Homo sapiens
gatcattggtatctgatatc

SEQ ID NO: 601341 - DNA, 18 bp, Homo sapiens
gatccagggatggagatg

SEQ ID NO: 601342 - DNA, 19 bp, Homo sapiens
gatccccatggaacagccc

SEQ ID NO: 601343 - DNA, 19 bp, Homo sapiens
gatccctcggtcagcaccg

SEQ ID NO: 601344 - DNA, 20 bp, Homo sapiens
gatcctccgcggaggcccct

SEQ ID NO: 601345 - DNA, 23 bp, Homo sapiens
gatcctccgcggaggcccctgag

SEQ ID NO: 601346 - DNA, 15 bp, Homo sapiens
gatcctgagccagat

SEQ ID NO: 601347 - DNA, 16 bp, Homo sapiens
gatcgtgccgtggagc

SEQ ID NO: 601348 - DNA, 21 bp, Homo sapiens
gatcgtggaagaagggccacc

SEQ ID NO: 601349 - DNA, 19 bp, Homo sapiens
gatctagtgccattatttc

SEQ ID NO: 601350 - DNA, 19 bp, Homo sapiens
gatctcagcatcctggaaa

SEQ ID NO: 601351 - DNA, 16 bp, Homo sapiens
gatctcatagatgacc

SEQ ID NO: 601352 - DNA, 18 bp, Homo sapiens
gatctcatagatgacccc

SEQ ID NO: 601353 - DNA, 14 bp, Homo sapiens
gatctcctgtgcac

SEQ ID NO: 601354 - DNA, 14 bp, Homo sapiens
gatctgactgccaa

SEQ ID NO: 601355 - DNA, 17 bp, Homo sapiens
gatctggtgcgtgtggc

SEQ ID NO: 601356 - DNA, 23 bp, Homo sapiens
gatcttacacgaagaaatagaat

SEQ ID NO: 601357 - DNA, 12 bp, Homo sapiens
gatgaagaccct

SEQ ID NO: 601358 - DNA, 17 bp, Homo sapiens
gatgaataaaatgttta

SEQ ID NO: 601359 - DNA, 16 bp, Homo sapiens
gatgagacaacacaca

SEQ ID NO: 601360 - DNA, 15 bp, Homo sapiens
gatgagattccctct

SEQ ID NO: 601361 - DNA, 21 bp, Homo sapiens
gatgatccggatttaatttga

SEQ ID NO: 601362 - DNA, 13 bp, Homo sapiens
gatgatgttctga

SEQ ID NO: 601363 - DNA, 17 bp, Homo sapiens
gatgatttaattcttac

SEQ ID NO: 601364 - DNA, 15 bp, Homo sapiens
gatgcatattaaaga

SEQ ID NO: 601365 - DNA, 13 bp, Homo sapiens
gatgcccctggcc

SEQ ID NO: 601366 - DNA, 21 bp, Homo sapiens
gatgcccctggccctgcctca

SEQ ID NO: 601367 - DNA, 14 bp, Homo sapiens
gatgcttacagtga

SEQ ID NO: 601368 - DNA, 18 bp, Homo sapiens
gatgcttacagtgactgt

SEQ ID NO: 601369 - DNA, 16 bp, Homo sapiens
gatggaatcacagcca

SEQ ID NO: 601370 - DNA, 15 bp, Homo sapiens
gatggatttgacaca

SEQ ID NO: 601371 - DNA, 19 bp, Homo sapiens
gatggatttgacacactca

SEQ ID NO: 601372 - DNA, 12 bp, Homo sapiens
gatggccaggcc

SEQ ID NO: 601373 - DNA, 22 bp, Homo sapiens
gatgggggtgaagtatgtcttc

SEQ ID NO: 601374 - DNA, 20 bp, Homo sapiens
gatggtccgccacgaggagc

SEQ ID NO: 601375 - DNA, 21 bp, Homo sapiens
gatggtccgccacgaggagct

SEQ ID NO: 601376 - DNA, 14 bp, Homo sapiens
gatggtgcaatgac

SEQ ID NO: 601377 - DNA, 15 bp, Homo sapiens
gatggtgcaatgacc

SEQ ID NO: 601378 - DNA, 16 bp, Homo sapiens
gatggtgcaatgacct

SEQ ID NO: 601379 - DNA, 13 bp, Homo sapiens
gatgtaatacacc

SEQ ID NO: 601380 - DNA, 20 bp, Homo sapiens
gatgtaatatagggtttgtt

SEQ ID NO: 601381 - DNA, 13 bp, Homo sapiens
gatgtcccttccc

SEQ ID NO: 601382 - DNA, 19 bp, Homo sapiens
gatgtggatggaggtgatg

SEQ ID NO: 601383 - DNA, 12 bp, Homo sapiens
gatgtgttcttt

SEQ ID NO: 601384 - DNA, 15 bp, Homo sapiens
gatgttattactgtt

SEQ ID NO: 601385 - DNA, 15 bp, Homo sapiens
gatgtttagtagctg

SEQ ID NO: 601386 - DNA, 20 bp, Homo sapiens
gatgtttagtagctgataaa

SEQ ID NO: 601387 - DNA, 16 bp, Homo sapiens
gattaaggactacaga

SEQ ID NO: 601388 - DNA, 18 bp, Homo sapiens
gattaaggactacagaat

SEQ ID NO: 601389 - DNA, 19 bp, Homo sapiens
gattaagttataccagcaa

SEQ ID NO: 601390 - DNA, 17 bp, Homo sapiens
gattaataacagaaata

SEQ ID NO: 601391 - DNA, 21 bp, Homo sapiens
gattaataacagaaatacatc

SEQ ID NO: 601392 - DNA, 17 bp, Homo sapiens
gattacctgaaagccct

SEQ ID NO: 601393 - DNA, 20 bp, Homo sapiens
gattcaatcattttgggaaa

SEQ ID NO: 601394 - DNA, 19 bp, Homo sapiens
gattcccgtggctttgtgc

SEQ ID NO: 601395 - DNA, 20 bp, Homo sapiens
gattcccgtggctttgtgct

SEQ ID NO: 601396 - DNA, 21 bp, Homo sapiens
gattcctacttaaacaaaaac

SEQ ID NO: 601397 - DNA, 19 bp, Homo sapiens
gattctaaaggggacagat

SEQ ID NO: 601398 - DNA, 12 bp, Homo sapiens
gattctcctctc

SEQ ID NO: 601399 - DNA, 13 bp, Homo sapiens
gattctcctctcc

SEQ ID NO: 601400 - DNA, 16 bp, Homo sapiens
gattcttttttcaatg

SEQ ID NO: 601401 - DNA, 17 bp, Homo sapiens
gattcttttttcaatgt

SEQ ID NO: 601402 - DNA, 16 bp, Homo sapiens
gattgaggagttgcct

SEQ ID NO: 601403 - DNA, 21 bp, Homo sapiens
gattgtacttttatcttaaaa

SEQ ID NO: 601404 - DNA, 15 bp, Homo sapiens
gatttactaacagta

SEQ ID NO: 601405 - DNA, 16 bp, Homo sapiens
gatttatcaatatttg

SEQ ID NO: 601406 - DNA, 17 bp, Homo sapiens
gatttcactctccttgg

SEQ ID NO: 601407 - DNA, 18 bp, Homo sapiens
gatttcctttgacctctc

SEQ ID NO: 601408 - DNA, 22 bp, Homo sapiens
gatttgatatacagacctccag

SEQ ID NO: 601409 - DNA, 14 bp, Homo sapiens
gattttgttttgct

SEQ ID NO: 601410 - DNA, 22 bp, Homo sapiens
gattttgttttgctttttctga

SEQ ID NO: 601411 - DNA, 21 bp, Homo sapiens
gcaaactgaaattagtgtttt

SEQ ID NO: 601412 - DNA, 22 bp, Homo sapiens
gcaaactgaaattagtgttttc

SEQ ID NO: 601413 - DNA, 18 bp, Homo sapiens
gcaaactgaagcccacag

SEQ ID NO: 601414 - DNA, 16 bp, Homo sapiens
gcaaacttttatgcag

SEQ ID NO: 601415 - DNA, 13 bp, Homo sapiens
gcaaagatccagc

SEQ ID NO: 601416 - DNA, 22 bp, Homo sapiens
gcaaaggagggcaacctgacag

SEQ ID NO: 601417 - DNA, 23 bp, Homo sapiens
gcaaaggtgcctcatagcatagc

SEQ ID NO: 601418 - DNA, 22 bp, Homo sapiens
gcaaatttctagatatgagaaa

SEQ ID NO: 601419 - DNA, 18 bp, Homo sapiens
gcaacactgccaaacatc

SEQ ID NO: 601420 - DNA, 15 bp, Homo sapiens
gcaacagactgcctt

SEQ ID NO: 601421 - DNA, 23 bp, Homo sapiens
gcaacagactgccttatattatt

SEQ ID NO: 601422 - DNA, 15 bp, Homo sapiens
gcaaccagagcactg

SEQ ID NO: 601423 - DNA, 22 bp, Homo sapiens
gcaacctgacagcaaacacagt

SEQ ID NO: 601424 - DNA, 20 bp, Homo sapiens
gcaactgtctatttctgctg

SEQ ID NO: 601425 - DNA, 18 bp, Homo sapiens
gcaacttgagggacgact

SEQ ID NO: 601426 - DNA, 14 bp, Homo sapiens
gcaacttttctcat

SEQ ID NO: 601427 - DNA, 14 bp, Homo sapiens
gcaagagctcagga

SEQ ID NO: 601428 - DNA, 17 bp, Homo sapiens
gcaagagctcaggagaa

SEQ ID NO: 601429 - DNA, 21 bp, Homo sapiens
gcaagaggtttcagcattccc

SEQ ID NO: 601430 - DNA, 22 bp, Homo sapiens
gcaagatagctccttcatgctt

SEQ ID NO: 601431 - DNA, 18 bp, Homo sapiens
gcaagctcatagcacatg

SEQ ID NO: 601432 - DNA, 22 bp, Homo sapiens
gcaagctcatagcacatgtttt

SEQ ID NO: 601433 - DNA, 11 bp, Homo sapiens
gcaaggatcac

SEQ ID NO: 601434 - DNA, 16 bp, Homo sapiens
gcaaggcaagaagtgg

SEQ ID NO: 601435 - DNA, 24 bp, Homo sapiens
gcaaggtgggggtcaggctacagg

SEQ ID NO: 601436 - DNA, 21 bp, Homo sapiens
gcaataaagtgtagcaccctg

SEQ ID NO: 601437 - DNA, 13 bp, Homo sapiens
gcaataacagttt

SEQ ID NO: 601438 - DNA, 20 bp, Homo sapiens
gcaatccttaaaaagaccat

SEQ ID NO: 601439 - DNA, 15 bp, Homo sapiens
gagccagatttcact

SEQ ID NO: 601440 - DNA, 23 bp, Homo sapiens
gagccagatttcactctccttgg

SEQ ID NO: 601441 - DNA, 22 bp, Homo sapiens
gagccagcagacattgtcagca

SEQ ID NO: 601442 - DNA, 15 bp, Homo sapiens
gagccagggcagagg

SEQ ID NO: 601443 - DNA, 17 bp, Homo sapiens
gagccagggcagaggaa

SEQ ID NO: 601444 - DNA, 19 bp, Homo sapiens
gagcccccgcccctccccc

SEQ ID NO: 601445 - DNA, 13 bp, Homo sapiens
gagccccctggcg

SEQ ID NO: 601446 - DNA, 15 bp, Homo sapiens
gagccccctggcggc

SEQ ID NO: 601447 - DNA, 17 bp, Homo sapiens
gagccccctggcggcag

SEQ ID NO: 601448 - DNA, 16 bp, Homo sapiens
gagccccggagcacca

SEQ ID NO: 601449 - DNA, 18 bp, Homo sapiens
gagcccctatcctgcacc

SEQ ID NO: 601450 - DNA, 22 bp, Homo sapiens
gagcccctatcctgcaccctct

SEQ ID NO: 601451 - DNA, 17 bp, Homo sapiens
gagcccctcctctcctc

SEQ ID NO: 601452 - DNA, 18 bp, Homo sapiens
gagcccctcctctcctcg

SEQ ID NO: 601453 - DNA, 22 bp, Homo sapiens
gagcccctcctctcctcgtccg

SEQ ID NO: 601454 - DNA, 19 bp, Homo sapiens
gagcccctgtttctcctcc

SEQ ID NO: 601455 - DNA, 22 bp, Homo sapiens
gagccctctgctgctttccaac

SEQ ID NO: 601456 - DNA, 15 bp, Homo sapiens
gagccctgcagtcac

SEQ ID NO: 601457 - DNA, 13 bp, Homo sapiens
gagccgcagaggc

SEQ ID NO: 601458 - DNA, 17 bp, Homo sapiens
gagccgcagaggcccga

SEQ ID NO: 601459 - DNA, 15 bp, Homo sapiens
gagccgtcagcctgt

SEQ ID NO: 601460 - DNA, 16 bp, Homo sapiens
gagccgtcagcctgtg

SEQ ID NO: 601461 - DNA, 22 bp, Homo sapiens
gagcctgcaggcaggtgggggc

SEQ ID NO: 601462 - DNA, 16 bp, Homo sapiens
gagcctgcttgctgat

SEQ ID NO: 601463 - DNA, 14 bp, Homo sapiens
gagcctgggcagca

SEQ ID NO: 601464 - DNA, 15 bp, Homo sapiens
gagcctgggcagcac

SEQ ID NO: 601465 - DNA, 13 bp, Homo sapiens
gagcctgtctctc

SEQ ID NO: 601466 - DNA, 16 bp, Homo sapiens
gagcgcacctcgccgt

SEQ ID NO: 601467 - DNA, 16 bp, Homo sapiens
gagcgcgtgccttccc

SEQ ID NO: 601468 - DNA, 13 bp, Homo sapiens
gagcggctgagga

SEQ ID NO: 601469 - DNA, 18 bp, Homo sapiens
gagcgtgtactaccccag

SEQ ID NO: 601470 - DNA, 21 bp, Homo sapiens
gagctatgcacaccaaattgc

SEQ ID NO: 601471 - DNA, 17 bp, Homo sapiens
gagctcaggagaaggcc

SEQ ID NO: 601472 - DNA, 18 bp, Homo sapiens
gagctcaggagaaggcct

SEQ ID NO: 601473 - DNA, 20 bp, Homo sapiens
gagctcaggccctggtgagg

SEQ ID NO: 601474 - DNA, 15 bp, Homo sapiens
gagctccaccctccc

SEQ ID NO: 601475 - DNA, 21 bp, Homo sapiens
gagcttgattctaaaggggac

SEQ ID NO: 601476 - DNA, 22 bp, Homo sapiens
gagcttgattctaaaggggaca

SEQ ID NO: 601477 - DNA, 12 bp, Homo sapiens
gagcttggagcc

SEQ ID NO: 601478 - DNA, 23 bp, Homo sapiens
gagcttggagccccctggcggca

SEQ ID NO: 601479 - DNA, 21 bp, Homo sapiens
gaggaaacttggacatttatg

SEQ ID NO: 601480 - DNA, 14 bp, Homo sapiens
gaggaacccccatg

SEQ ID NO: 601481 - DNA, 14 bp, Homo sapiens
gaggaagcacctct

SEQ ID NO: 601482 - DNA, 16 bp, Homo sapiens
gaggaatgtagggcct

SEQ ID NO: 601483 - DNA, 17 bp, Homo sapiens
gaggacacagcacaagg

SEQ ID NO: 601484 - DNA, 10 bp, Homo sapiens
gaggacagag

SEQ ID NO: 601485 - DNA, 16 bp, Homo sapiens
gaggacagagtgccct

SEQ ID NO: 601486 - DNA, 18 bp, Homo sapiens
gaggacagagtgccctgg

SEQ ID NO: 601487 - DNA, 14 bp, Homo sapiens
gaggacagcttccc

SEQ ID NO: 601488 - DNA, 21 bp, Homo sapiens
gaggacagcttccccatcgcc

SEQ ID NO: 601489 - DNA, 13 bp, Homo sapiens
gaggacagggagg

SEQ ID NO: 601490 - DNA, 16 bp, Homo sapiens
gaggacccctgccctc

SEQ ID NO: 601491 - DNA, 21 bp, Homo sapiens
gaggactgttctaactagtaa

SEQ ID NO: 601492 - DNA, 14 bp, Homo sapiens
gaggagaaggagga

SEQ ID NO: 601493 - DNA, 16 bp, Homo sapiens
gaggagattgctctgg

SEQ ID NO: 601494 - DNA, 17 bp, Homo sapiens
gaggagcacccccagcc

SEQ ID NO: 601495 - DNA, 19 bp, Homo sapiens
gaggagcacccccagcctc

SEQ ID NO: 601496 - DNA, 16 bp, Homo sapiens
gaggagccttgctggg

SEQ ID NO: 601497 - DNA, 20 bp, Homo sapiens
gaggagcttccagtgcatgt

SEQ ID NO: 601498 - DNA, 14 bp, Homo sapiens
gaggaggacacagc

SEQ ID NO: 601499 - DNA, 14 bp, Homo sapiens
gaggaggaggacac

SEQ ID NO: 601500 - DNA, 15 bp, Homo sapiens
gaggaggaggacaca

SEQ ID NO: 601501 - DNA, 14 bp, Homo sapiens
gaggaggaggagcc

SEQ ID NO: 601502 - DNA, 11 bp, Homo sapiens
gaggagtccaa

SEQ ID NO: 601503 - DNA, 14 bp, Homo sapiens
gaggagtccaaaat

SEQ ID NO: 601504 - DNA, 21 bp, Homo sapiens
gaggatggcttccccattgcc

SEQ ID NO: 601505 - DNA, 12 bp, Homo sapiens
gaggatgtatgt

SEQ ID NO: 601506 - DNA, 13 bp, Homo sapiens
gaggatgtatgtg

SEQ ID NO: 601507 - DNA, 16 bp, Homo sapiens
gaggatgtatgtgtat

SEQ ID NO: 601508 - DNA, 13 bp, Homo sapiens
gaggcacatgaca

SEQ ID NO: 601509 - DNA, 14 bp, Homo sapiens
gaggcagggccctg

SEQ ID NO: 601510 - DNA, 20 bp, Homo sapiens
gaggcatgtgatgagaggaa

SEQ ID NO: 601511 - DNA, 21 bp, Homo sapiens
gaggcatgtgatgagaggaaa

SEQ ID NO: 601512 - DNA, 14 bp, Homo sapiens
gaggccaaatgagt

SEQ ID NO: 601513 - DNA, 14 bp, Homo sapiens
gaggccagggccgc

SEQ ID NO: 601514 - DNA, 15 bp, Homo sapiens
gaggcccctgtgcag

SEQ ID NO: 601515 - DNA, 18 bp, Homo sapiens
gaggcccgaggcaccgga

SEQ ID NO: 601516 - DNA, 15 bp, Homo sapiens
gaggccgactgggct

SEQ ID NO: 601517 - DNA, 17 bp, Homo sapiens
gaggccggggtccaggc

SEQ ID NO: 601518 - DNA, 19 bp, Homo sapiens
gaggccggggtccaggccc

SEQ ID NO: 601519 - DNA, 13 bp, Homo sapiens
gaggcctggtctg

SEQ ID NO: 601520 - DNA, 18 bp, Homo sapiens
gaggcgcccacctgccca

SEQ ID NO: 601521 - DNA, 20 bp, Homo sapiens
gaggcggcacattggcagtg

SEQ ID NO: 601522 - DNA, 16 bp, Homo sapiens
gaggcgtgggatccag

SEQ ID NO: 601523 - DNA, 24 bp, Homo sapiens
gaggctgcctcagccagtggcaca

SEQ ID NO: 601524 - DNA, 19 bp, Homo sapiens
gaggctgctgccccctggc

SEQ ID NO: 601525 - DNA, 17 bp, Homo sapiens
gagggaagcccacccgc

SEQ ID NO: 601526 - DNA, 19 bp, Homo sapiens
gagggacgactttctttaa

SEQ ID NO: 601527 - DNA, 18 bp, Homo sapiens
gagggacgagcagagcgc

SEQ ID NO: 601528 - DNA, 18 bp, Homo sapiens
gagggctgagcccctcct

SEQ ID NO: 601529 - DNA, 21 bp, Homo sapiens
gaggggcttggagcagagacg

SEQ ID NO: 601530 - DNA, 21 bp, Homo sapiens
gagggggatgcccctggccct

SEQ ID NO: 601531 - DNA, 14 bp, Homo sapiens
gagggggctgggaa

SEQ ID NO: 601532 - DNA, 17 bp, Homo sapiens
gagggtctccctgggca

SEQ ID NO: 601533 - DNA, 15 bp, Homo sapiens
gagtaggtgggtctt

SEQ ID NO: 601534 - DNA, 16 bp, Homo sapiens
gagtcagggctgtgct

SEQ ID NO: 601535 - DNA, 13 bp, Homo sapiens
gagtcatctcaaa

SEQ ID NO: 601536 - DNA, 14 bp, Homo sapiens
gagtccactttcct

SEQ ID NO: 601537 - DNA, 16 bp, Homo sapiens
gagtccactttcctct

SEQ ID NO: 601538 - DNA, 18 bp, Homo sapiens
gagtccactttcctctct

SEQ ID NO: 601539 - DNA, 16 bp, Homo sapiens
gagtcggctgggcagg

SEQ ID NO: 601540 - DNA, 19 bp, Homo sapiens
gagtctgaaggagaggagt

SEQ ID NO: 601541 - DNA, 22 bp, Homo sapiens
gagtcttgctacctcagtcagt

SEQ ID NO: 601542 - DNA, 11 bp, Homo sapiens
gagtgacatgg

SEQ ID NO: 601543 - DNA, 22 bp, Homo sapiens
gagtgagaaatttttttccaga

SEQ ID NO: 601544 - DNA, 15 bp, Homo sapiens
gagtgccctggggca

SEQ ID NO: 601545 - DNA, 24 bp, Homo sapiens
gagtggctgaaataaaagcctctg

SEQ ID NO: 601546 - DNA, 21 bp, Homo sapiens
gagttcccttgattcaaataa

SEQ ID NO: 601547 - DNA, 20 bp, Homo sapiens
gagttctgcacatacagatg

SEQ ID NO: 601548 - DNA, 23 bp, Homo sapiens
gagttgcctgactcctgggtggg

SEQ ID NO: 601549 - DNA, 15 bp, Homo sapiens
gagtttaatcttttc

SEQ ID NO: 601550 - DNA, 15 bp, Homo sapiens
gagtttccatttgga

SEQ ID NO: 601551 - DNA, 22 bp, Homo sapiens
gagtttgctgtatacaaacagg

SEQ ID NO: 601552 - DNA, 22 bp, Homo sapiens
gataaatatcattatagcatgt

SEQ ID NO: 601553 - DNA, 20 bp, Homo sapiens
gataaatttggccatgaaag

SEQ ID NO: 601554 - DNA, 21 bp, Homo sapiens
gataaattttggaagaattca

SEQ ID NO: 601555 - DNA, 15 bp, Homo sapiens
gataacagagtgatt

SEQ ID NO: 601556 - DNA, 18 bp, Homo sapiens
gataagtgctcagtattg

SEQ ID NO: 601557 - DNA, 15 bp, Homo sapiens
gataatcagtttcca

SEQ ID NO: 601558 - DNA, 15 bp, Homo sapiens
gaatgctcaatgtgc

SEQ ID NO: 601559 - DNA, 18 bp, Homo sapiens
gaatgctcaatgtgctgt

SEQ ID NO: 601560 - DNA, 21 bp, Homo sapiens
gaatggggggcgggccagggt

SEQ ID NO: 601561 - DNA, 17 bp, Homo sapiens
gaatggtgggctccaga

SEQ ID NO: 601562 - DNA, 21 bp, Homo sapiens
gaaagtcaagtctacctgcct

SEQ ID NO: 601563 - DNA, 13 bp, Homo sapiens
gaaagttctatta

SEQ ID NO: 601564 - DNA, 19 bp, Homo sapiens
gaaagttgtgattctttga

SEQ ID NO: 601565 - DNA, 18 bp, Homo sapiens
gaaatacatcatatgtta

SEQ ID NO: 601566 - DNA, 20 bp, Homo sapiens
gaaatacttgacaacatttt

SEQ ID NO: 601567 - DNA, 17 bp, Homo sapiens
gaaatataaactgtgag

SEQ ID NO: 601568 - DNA, 19 bp, Homo sapiens
gaaatattactctgcctgt

SEQ ID NO: 601569 - DNA, 17 bp, Homo sapiens
gaaatattcacaaggtt

SEQ ID NO: 601570 - DNA, 17 bp, Homo sapiens
gaaatcaccgaaaacgt

SEQ ID NO: 601571 - DNA, 16 bp, Homo sapiens
gaaatccaactccagg

SEQ ID NO: 601572 - DNA, 20 bp, Homo sapiens
gaaatctaagtttcgagaga

SEQ ID NO: 601573 - DNA, 15 bp, Homo sapiens
gaaatgaatgtgtgt

SEQ ID NO: 601574 - DNA, 20 bp, Homo sapiens
gaaatgaatgtgtgtggttt

SEQ ID NO: 601575 - DNA, 11 bp, Homo sapiens
gaaatgagaaa

SEQ ID NO: 601576 - DNA, 18 bp, Homo sapiens
gaaatggatagattgttt

SEQ ID NO: 601577 - DNA, 20 bp, Homo sapiens
gaaatggatagattgtttta

SEQ ID NO: 601578 - DNA, 22 bp, Homo sapiens
gaaattagtgttttcattctgg

SEQ ID NO: 601579 - DNA, 23 bp, Homo sapiens
gaaattagtgttttcattctggt

SEQ ID NO: 601580 - DNA, 13 bp, Homo sapiens
gaaattatatctg

SEQ ID NO: 601581 - DNA, 13 bp, Homo sapiens
gaaattatgtcaa

SEQ ID NO: 601582 - DNA, 22 bp, Homo sapiens
gaaattctataagagacaaagt

SEQ ID NO: 601583 - DNA, 16 bp, Homo sapiens
gaaattcttgcactgt

SEQ ID NO: 601584 - DNA, 13 bp, Homo sapiens
gaaatttaagcac

SEQ ID NO: 601585 - DNA, 22 bp, Homo sapiens
gaaatttactatgtaaatgctt

SEQ ID NO: 601586 - DNA, 14 bp, Homo sapiens
gaaatttgtgtgct

SEQ ID NO: 601587 - DNA, 21 bp, Homo sapiens
gaaatttgtgtgcttcacaca

SEQ ID NO: 601588 - DNA, 15 bp, Homo sapiens
gaaattttatctctt

SEQ ID NO: 601589 - DNA, 16 bp, Homo sapiens
gaaatttttgcatgtt

SEQ ID NO: 601590 - DNA, 17 bp, Homo sapiens
gaaatttttgcatgttt

SEQ ID NO: 601591 - DNA, 22 bp, Homo sapiens
gaacactgcaccctccacagga

SEQ ID NO: 601592 - DNA, 16 bp, Homo sapiens
gaacagaccggggtgg

SEQ ID NO: 601593 - DNA, 16 bp, Homo sapiens
gaacatagttttcacc

SEQ ID NO: 601594 - DNA, 14 bp, Homo sapiens
gaacatgacccagc

SEQ ID NO: 601595 - DNA, 15 bp, Homo sapiens
gaacatgacccgtac

SEQ ID NO: 601596 - DNA, 18 bp, Homo sapiens
gaacatgacccgtacaca

SEQ ID NO: 601597 - DNA, 22 bp, Homo sapiens
gaacatgacccgtacacaccac

SEQ ID NO: 601598 - DNA, 18 bp, Homo sapiens
gaaccaacgggtctgtgg

SEQ ID NO: 601599 - DNA, 21 bp, Homo sapiens
gaaccaagctataaaagccca

SEQ ID NO: 601600 - DNA, 23 bp, Homo sapiens
gaaccagcactcccagggcccga

SEQ ID NO: 601601 - DNA, 13 bp, Homo sapiens
gaacgcatgcagg

SEQ ID NO: 601602 - DNA, 14 bp, Homo sapiens
gaacgggcctcccc

SEQ ID NO: 601603 - DNA, 15 bp, Homo sapiens
gaacgggcctccccg

SEQ ID NO: 601604 - DNA, 16 bp, Homo sapiens
gaactcagctgtctgt

SEQ ID NO: 601605 - DNA, 21 bp, Homo sapiens
gaactcagctgtctgtggctt

SEQ ID NO: 601606 - DNA, 14 bp, Homo sapiens
gaactgaagcagag

SEQ ID NO: 601607 - DNA, 16 bp, Homo sapiens
gaactgcaacactgga

SEQ ID NO: 601608 - DNA, 14 bp, Homo sapiens
gaactttaaaagaa

SEQ ID NO: 601609 - DNA, 15 bp, Homo sapiens
gaagaaacacagcat

SEQ ID NO: 601610 - DNA, 19 bp, Homo sapiens
gaagaaacacagcatgcat

SEQ ID NO: 601611 - DNA, 16 bp, Homo sapiens
gaagacaaatacacat

SEQ ID NO: 601612 - DNA, 23 bp, Homo sapiens
gaagacaaatacacatacatata

SEQ ID NO: 601613 - DNA, 19 bp, Homo sapiens
gaagagagatatatctgaa

SEQ ID NO: 601614 - DNA, 15 bp, Homo sapiens
gaagcaaacacacag

SEQ ID NO: 601615 - DNA, 22 bp, Homo sapiens
gaagcaaacacacagactctgt

SEQ ID NO: 601616 - DNA, 13 bp, Homo sapiens
gaagcaccccacc

SEQ ID NO: 601617 - DNA, 23 bp, Homo sapiens
gaagcagcaaggtgggggtcagg

SEQ ID NO: 601618 - DNA, 18 bp, Homo sapiens
gaagcagccccctgtggc

SEQ ID NO: 601619 - DNA, 12 bp, Homo sapiens
gaagcccacccg

SEQ ID NO: 601620 - DNA, 15 bp, Homo sapiens
gaagcccacccgccc

SEQ ID NO: 601621 - DNA, 16 bp, Homo sapiens
gaagcccacccgcccc

SEQ ID NO: 601622 - DNA, 17 bp, Homo sapiens
gaagcccacccgcccca

SEQ ID NO: 601623 - DNA, 21 bp, Homo sapiens
gaagcccacccgccccagaga

SEQ ID NO: 601624 - DNA, 23 bp, Homo sapiens
gaagcccacccgccccagagact

SEQ ID NO: 601625 - DNA, 20 bp, Homo sapiens
gaagcccaggaggacctggg

SEQ ID NO: 601626 - DNA, 13 bp, Homo sapiens
gaagccccttgga

SEQ ID NO: 601627 - DNA, 14 bp, Homo sapiens
gaagccccttggag

SEQ ID NO: 601628 - DNA, 18 bp, Homo sapiens
gaagccccttggagagag

SEQ ID NO: 601629 - DNA, 23 bp, Homo sapiens
gaagctgccatccttgctgcagc

SEQ ID NO: 601630 - DNA, 21 bp, Homo sapiens
gaaggattcttttttcaatgt

SEQ ID NO: 601631 - DNA, 22 bp, Homo sapiens
gaaggcaaaaactgtactgtgt

SEQ ID NO: 601632 - DNA, 21 bp, Homo sapiens
gaaggcctgagggaagcccac

SEQ ID NO: 601633 - DNA, 22 bp, Homo sapiens
gaaggcctgagggaagcccacc

SEQ ID NO: 601634 - DNA, 14 bp, Homo sapiens
gaaggcctgccccc

SEQ ID NO: 601635 - DNA, 15 bp, Homo sapiens
gaaggcctgcccccc

SEQ ID NO: 601636 - DNA, 19 bp, Homo sapiens
gaaggcctgccccccttcc

SEQ ID NO: 601637 - DNA, 21 bp, Homo sapiens
gaaggcctgccccccttccca

SEQ ID NO: 601638 - DNA, 17 bp, Homo sapiens
gaagggccaccctgagc

SEQ ID NO: 601639 - DNA, 14 bp, Homo sapiens
gaagggtgcctggc

SEQ ID NO: 601640 - DNA, 14 bp, Homo sapiens
gaagggtggatgtc

SEQ ID NO: 601641 - DNA, 13 bp, Homo sapiens
gaagggttctgcc

SEQ ID NO: 601642 - DNA, 21 bp, Homo sapiens
gaagggttctgccctgcctga

SEQ ID NO: 601643 - DNA, 22 bp, Homo sapiens
gaagggttctgccctgcctgag

SEQ ID NO: 601644 - DNA, 18 bp, Homo sapiens
gaaggttagaaaggcagc

SEQ ID NO: 601645 - DNA, 22 bp, Homo sapiens
gaagtagtgtgagtgttagaaa

SEQ ID NO: 601646 - DNA, 19 bp, Homo sapiens
gaagtatccctgatttatt

SEQ ID NO: 601647 - DNA, 12 bp, Homo sapiens
gaagtgcatgtt

SEQ ID NO: 601648 - DNA, 13 bp, Homo sapiens
gaagtgcatgtta

SEQ ID NO: 601649 - DNA, 14 bp, Homo sapiens
gaagtggcctgaga

SEQ ID NO: 601650 - DNA, 15 bp, Homo sapiens
gaagttttacttgat

SEQ ID NO: 601651 - DNA, 12 bp, Homo sapiens
gaataacactgc

SEQ ID NO: 601652 - DNA, 13 bp, Homo sapiens
gaataacactgca

SEQ ID NO: 601653 - DNA, 13 bp, Homo sapiens
gaatactgtattg

SEQ ID NO: 601654 - DNA, 12 bp, Homo sapiens
gaatattgctga

SEQ ID NO: 601655 - DNA, 15 bp, Homo sapiens
gaatattgctgatgg

SEQ ID NO: 601656 - DNA, 18 bp, Homo sapiens
gaatcacctaattaattt

SEQ ID NO: 601657 - DNA, 23 bp, Homo sapiens
gaatcacctaattaatttcagta

SEQ ID NO: 601658 - DNA, 16 bp, Homo sapiens
gaatcagaggcagaga

SEQ ID NO: 601659 - DNA, 18 bp, Homo sapiens
gaatccatatcagctctg

SEQ ID NO: 601660 - DNA, 17 bp, Homo sapiens
gaatccccgtgctcaca

SEQ ID NO: 601661 - DNA, 13 bp, Homo sapiens
gaatctttggtct

SEQ ID NO: 601662 - DNA, 15 bp, Homo sapiens
gaatctttggtcttc

SEQ ID NO: 601663 - DNA, 21 bp, Homo sapiens
gaatgaaatataaactgtgag

SEQ ID NO: 601664 - DNA, 16 bp, Homo sapiens
gaatgaagctgccatc

SEQ ID NO: 601665 - DNA, 12 bp, Homo sapiens
gaatgagaaatc

SEQ ID NO: 601666 - DNA, 16 bp, Homo sapiens
gaatgagaaatcatgt

SEQ ID NO: 601667 - DNA, 19 bp, Homo sapiens
gaatgagggcgtgaaacac

SEQ ID NO: 601668 - DNA, 15 bp, Homo sapiens
gaatgatccaatact

SEQ ID NO: 601669 - DNA, 14 bp, Homo sapiens
gaatgctagacaga

SEQ ID NO: 601670 - DNA, 12 bp, Homo sapiens
cttgtattggaa

SEQ ID NO: 601671 - DNA, 15 bp, Homo sapiens
cttgtattggaagta

SEQ ID NO: 601672 - DNA, 14 bp, Homo sapiens
cttgtctaaagatc

SEQ ID NO: 601673 - DNA, 19 bp, Homo sapiens
cttgtgtaatttcctgctc

SEQ ID NO: 601674 - DNA, 14 bp, Homo sapiens
cttgttcagtcact

SEQ ID NO: 601675 - DNA, 20 bp, Homo sapiens
cttgtttaaggttcttgctg

SEQ ID NO: 601676 - DNA, 16 bp, Homo sapiens
ctttaatttttctgtt

SEQ ID NO: 601677 - DNA, 20 bp, Homo sapiens
ctttacagatgagattccct

SEQ ID NO: 601678 - DNA, 16 bp, Homo sapiens
ctttactaacactggc

SEQ ID NO: 601679 - DNA, 22 bp, Homo sapiens
ctttagaatagttaaattggct

SEQ ID NO: 601680 - DNA, 17 bp, Homo sapiens
ctttagagaagccataa

SEQ ID NO: 601681 - DNA, 17 bp, Homo sapiens
ctttataagccaatgaa

SEQ ID NO: 601682 - DNA, 17 bp, Homo sapiens
ctttatcatgtgtttct

SEQ ID NO: 601683 - DNA, 18 bp, Homo sapiens
ctttatgtgatgtaacta

SEQ ID NO: 601684 - DNA, 18 bp, Homo sapiens
ctttcaataggaaaaact

SEQ ID NO: 601685 - DNA, 22 bp, Homo sapiens
ctttcaataggaaaaactgatt

SEQ ID NO: 601686 - DNA, 14 bp, Homo sapiens
ctttcaatccacag

SEQ ID NO: 601687 - DNA, 21 bp, Homo sapiens
ctttcaggaaatttttgcatg

SEQ ID NO: 601688 - DNA, 21 bp, Homo sapiens
ctttcagggagggctgttcaa

SEQ ID NO: 601689 - DNA, 17 bp, Homo sapiens
ctttcagtgcctgctgt

SEQ ID NO: 601690 - DNA, 20 bp, Homo sapiens
ctttcagtgcctgctgttcg

SEQ ID NO: 601691 - DNA, 23 bp, Homo sapiens
ctttcatggaatgcaatttgact

SEQ ID NO: 601692 - DNA, 18 bp, Homo sapiens
ctttcatgtttaagaaat

SEQ ID NO: 601693 - DNA, 20 bp, Homo sapiens
ctttcatgtttaagaaatga

SEQ ID NO: 601694 - DNA, 15 bp, Homo sapiens
ctttccaaaggttgt

SEQ ID NO: 601695 - DNA, 15 bp, Homo sapiens
ctttccaacacacaa

SEQ ID NO: 601696 - DNA, 15 bp, Homo sapiens
ctttccagtgctgct

SEQ ID NO: 601697 - DNA, 12 bp, Homo sapiens
ctttccatgaca

SEQ ID NO: 601698 - DNA, 23 bp, Homo sapiens
ctttccccagctgattagtgtct

SEQ ID NO: 601699 - DNA, 23 bp, Homo sapiens
ctttccccagtgtggccccagcc

SEQ ID NO: 601700 - DNA, 23 bp, Homo sapiens
ctttccgcgtggttctgccactt

SEQ ID NO: 601701 - DNA, 21 bp, Homo sapiens
ctttccttccttttttccttt

SEQ ID NO: 601702 - DNA, 13 bp, Homo sapiens
ctttctattggca

SEQ ID NO: 601703 - DNA, 15 bp, Homo sapiens
ctttctccaaagtta

SEQ ID NO: 601704 - DNA, 20 bp, Homo sapiens
ctttctccagcccatgctgg

SEQ ID NO: 601705 - DNA, 16 bp, Homo sapiens
ctttctctctgtgtgg

SEQ ID NO: 601706 - DNA, 11 bp, Homo sapiens
ctttctcttgc

SEQ ID NO: 601707 - DNA, 17 bp, Homo sapiens
ctttctgtgtggtgaaa

SEQ ID NO: 601708 - DNA, 21 bp, Homo sapiens
ctttctttaacatatcattca

SEQ ID NO: 601709 - DNA, 18 bp, Homo sapiens
ctttcttttgtgcatatg

SEQ ID NO: 601710 - DNA, 20 bp, Homo sapiens
ctttgagtgtcaggctctga

SEQ ID NO: 601711 - DNA, 22 bp, Homo sapiens
ctttgcaaccttgtactttaca

SEQ ID NO: 601712 - DNA, 20 bp, Homo sapiens
ctttgcaggcccagcagact

SEQ ID NO: 601713 - DNA, 16 bp, Homo sapiens
ctttgcgctctgggtt

SEQ ID NO: 601714 - DNA, 15 bp, Homo sapiens
ctttgctgtttatat

SEQ ID NO: 601715 - DNA, 15 bp, Homo sapiens
ctttggaagcagccc

SEQ ID NO: 601716 - DNA, 14 bp, Homo sapiens
ctttgggaggctga

SEQ ID NO: 601717 - DNA, 15 bp, Homo sapiens
ctttgtcaaatggta

SEQ ID NO: 601718 - DNA, 20 bp, Homo sapiens
ctttgtctaattaattacat

SEQ ID NO: 601719 - DNA, 15 bp, Homo sapiens
ctttgtgtcttttgt

SEQ ID NO: 601720 - DNA, 22 bp, Homo sapiens
ctttgttaaaatatagtgttgt

SEQ ID NO: 601721 - DNA, 18 bp, Homo sapiens
cttttaaaaactcctgtt

SEQ ID NO: 601722 - DNA, 11 bp, Homo sapiens
cttttaatttt

SEQ ID NO: 601723 - DNA, 12 bp, Homo sapiens
cttttataaatg

SEQ ID NO: 601724 - DNA, 15 bp, Homo sapiens
cttttcacctgaaat

SEQ ID NO: 601725 - DNA, 20 bp, Homo sapiens
cttttcatggagtagagtca

SEQ ID NO: 601726 - DNA, 13 bp, Homo sapiens
cttttctttttat

SEQ ID NO: 601727 - DNA, 15 bp, Homo sapiens
cttttgagcagtaaa

SEQ ID NO: 601728 - DNA, 13 bp, Homo sapiens
cttttgatggcta

SEQ ID NO: 601729 - DNA, 20 bp, Homo sapiens
cttttgatggctatgttttg

SEQ ID NO: 601730 - DNA, 22 bp, Homo sapiens
cttttggtttgtgggtccagga

SEQ ID NO: 601731 - DNA, 17 bp, Homo sapiens
cttttgtcatgtggcta

SEQ ID NO: 601732 - DNA, 14 bp, Homo sapiens
cttttgttctctct

SEQ ID NO: 601733 - DNA, 17 bp, Homo sapiens
cttttgttctctcttgg

SEQ ID NO: 601734 - DNA, 17 bp, Homo sapiens
cttttttaattgaaagg

SEQ ID NO: 601735 - DNA, 16 bp, Homo sapiens
cttttttcctgtcaat

SEQ ID NO: 601736 - DNA, 16 bp, Homo sapiens
cttttttcctttcttc

SEQ ID NO: 601737 - DNA, 13 bp, Homo sapiens
ctttttttaagtg

SEQ ID NO: 601738 - DNA, 20 bp, Homo sapiens
ctttttttaagtgttctgtg

SEQ ID NO: 601739 - DNA, 14 bp, Homo sapiens
gaaaaactgatttt

SEQ ID NO: 601740 - DNA, 16 bp, Homo sapiens
gaaaaagcatgtacag

SEQ ID NO: 601741 - DNA, 18 bp, Homo sapiens
gaaaaagcatgtacagtg

SEQ ID NO: 601742 - DNA, 22 bp, Homo sapiens
gaaaaagcatgtacagtgttct

SEQ ID NO: 601743 - DNA, 15 bp, Homo sapiens
gaaaaagcattaaaa

SEQ ID NO: 601744 - DNA, 16 bp, Homo sapiens
gaaaaagcattaaaaa

SEQ ID NO: 601745 - DNA, 18 bp, Homo sapiens
gaaaaatctgaatttcta

SEQ ID NO: 601746 - DNA, 18 bp, Homo sapiens
gaaaacgatttaatttat

SEQ ID NO: 601747 - DNA, 19 bp, Homo sapiens
gaaaacgtggctgcttcaa

SEQ ID NO: 601748 - DNA, 19 bp, Homo sapiens
gaaaaggcttgagtctgga

SEQ ID NO: 601749 - DNA, 20 bp, Homo sapiens
gaaaaggcttgagtctggat

SEQ ID NO: 601750 - DNA, 18 bp, Homo sapiens
gaaaagttttcaagcatt

SEQ ID NO: 601751 - DNA, 21 bp, Homo sapiens
gaaaagttttcaagcattgct

SEQ ID NO: 601752 - DNA, 15 bp, Homo sapiens
gaaaatggctgaaga

SEQ ID NO: 601753 - DNA, 16 bp, Homo sapiens
gaaaatggctgaagaa

SEQ ID NO: 601754 - DNA, 20 bp, Homo sapiens
gaaaatggctgaagaaacac

SEQ ID NO: 601755 - DNA, 19 bp, Homo sapiens
gaaaattttattgaatata

SEQ ID NO: 601756 - DNA, 17 bp, Homo sapiens
gaaacaaaatataaatc

SEQ ID NO: 601757 - DNA, 17 bp, Homo sapiens
gaaacaaatatactcat

SEQ ID NO: 601758 - DNA, 15 bp, Homo sapiens
gaaacacagcatgca

SEQ ID NO: 601759 - DNA, 15 bp, Homo sapiens
gaaacagtgtggatg

SEQ ID NO: 601760 - DNA, 16 bp, Homo sapiens
gaaacagtttaacaga

SEQ ID NO: 601761 - DNA, 12 bp, Homo sapiens
gaaacatctgat

SEQ ID NO: 601762 - DNA, 18 bp, Homo sapiens
gaaaccaccttaaaacat

SEQ ID NO: 601763 - DNA, 17 bp, Homo sapiens
gaaacccctgacacctt

SEQ ID NO: 601764 - DNA, 19 bp, Homo sapiens
gaaaccttggagaggagag

SEQ ID NO: 601765 - DNA, 12 bp, Homo sapiens
gaaactgtattt

SEQ ID NO: 601766 - DNA, 15 bp, Homo sapiens
gaaacttggacattt

SEQ ID NO: 601767 - DNA, 17 bp, Homo sapiens
gaaacttggacatttat

SEQ ID NO: 601768 - DNA, 20 bp, Homo sapiens
gaaactttggaagttttact

SEQ ID NO: 601769 - DNA, 11 bp, Homo sapiens
gaaagaaaaaa

SEQ ID NO: 601770 - DNA, 21 bp, Homo sapiens
gaaagaacttggacttctaaa

SEQ ID NO: 601771 - DNA, 22 bp, Homo sapiens
cttcccaagtcctcgccccccg

SEQ ID NO: 601772 - DNA, 12 bp, Homo sapiens
cttcccacccct

SEQ ID NO: 601773 - DNA, 13 bp, Homo sapiens
cttcccaccccta

SEQ ID NO: 601774 - DNA, 15 bp, Homo sapiens
cttcccagctggcag

SEQ ID NO: 601775 - DNA, 11 bp, Homo sapiens
cttccccactc

SEQ ID NO: 601776 - DNA, 13 bp, Homo sapiens
cttccccatgctc

SEQ ID NO: 601777 - DNA, 19 bp, Homo sapiens
cttccccattgccttctgg

SEQ ID NO: 601778 - DNA, 12 bp, Homo sapiens
cttcccccttcc

SEQ ID NO: 601779 - DNA, 13 bp, Homo sapiens
cttcccccttccc

SEQ ID NO: 601780 - DNA, 14 bp, Homo sapiens
cttcccccttcccc

SEQ ID NO: 601781 - DNA, 15 bp, Homo sapiens
cttcccccttcccct

SEQ ID NO: 601782 - DNA, 19 bp, Homo sapiens
cttccccgtgcggcccgtg

SEQ ID NO: 601783 - DNA, 20 bp, Homo sapiens
cttcccctgcgccctccctc

SEQ ID NO: 601784 - DNA, 21 bp, Homo sapiens
cttcccctgcgccctccctcc

SEQ ID NO: 601785 - DNA, 13 bp, Homo sapiens
cttcccctttcct

SEQ ID NO: 601786 - DNA, 15 bp, Homo sapiens
cttcccgcagcacca

SEQ ID NO: 601787 - DNA, 18 bp, Homo sapiens
cttcccgcagcaccagcc

SEQ ID NO: 601788 - DNA, 16 bp, Homo sapiens
cttccctgaacactca

SEQ ID NO: 601789 - DNA, 20 bp, Homo sapiens
cttccgggtctcgcagcctg

SEQ ID NO: 601790 - DNA, 21 bp, Homo sapiens
cttccgggtctcgcagcctga

SEQ ID NO: 601791 - DNA, 21 bp, Homo sapiens
cttcctattaatttattaaat

SEQ ID NO: 601792 - DNA, 22 bp, Homo sapiens
cttcctattaatttattaaatt

SEQ ID NO: 601793 - DNA, 13 bp, Homo sapiens
cttcctgtcctgc

SEQ ID NO: 601794 - DNA, 16 bp, Homo sapiens
cttcctgtcctgctca

SEQ ID NO: 601795 - DNA, 13 bp, Homo sapiens
cttccttaacagc

SEQ ID NO: 601796 - DNA, 15 bp, Homo sapiens
cttccttaacagctg

SEQ ID NO: 601797 - DNA, 12 bp, Homo sapiens
cttccttccttt

SEQ ID NO: 601798 - DNA, 21 bp, Homo sapiens
cttcggataattttcattttt

SEQ ID NO: 601799 - DNA, 14 bp, Homo sapiens
cttcggcagtggct

SEQ ID NO: 601800 - DNA, 16 bp, Homo sapiens
cttcggcagtggctgg

SEQ ID NO: 601801 - DNA, 23 bp, Homo sapiens
cttctaaaggtttcactgttcat

SEQ ID NO: 601802 - DNA, 21 bp, Homo sapiens
cttctaatccatgtgctgctg

SEQ ID NO: 601803 - DNA, 23 bp, Homo sapiens
cttctactccatggtgaactgaa

SEQ ID NO: 601804 - DNA, 21 bp, Homo sapiens
cttctcaaatgctactcagta

SEQ ID NO: 601805 - DNA, 17 bp, Homo sapiens
cttctcagctccactct

SEQ ID NO: 601806 - DNA, 19 bp, Homo sapiens
cttctcagctccactctga

SEQ ID NO: 601807 - DNA, 22 bp, Homo sapiens
cttctcagctccactctgaagt

SEQ ID NO: 601808 - DNA, 21 bp, Homo sapiens
cttctccccctcagctctccc

SEQ ID NO: 601809 - DNA, 14 bp, Homo sapiens
cttctcccctccag

SEQ ID NO: 601810 - DNA, 22 bp, Homo sapiens
cttctcccctccagacccctac

SEQ ID NO: 601811 - DNA, 16 bp, Homo sapiens
cttctccctggggagg

SEQ ID NO: 601812 - DNA, 15 bp, Homo sapiens
cttctctctgtgctg

SEQ ID NO: 601813 - DNA, 15 bp, Homo sapiens
cttctgactgtttac

SEQ ID NO: 601814 - DNA, 17 bp, Homo sapiens
cttctggagatggatcc

SEQ ID NO: 601815 - DNA, 23 bp, Homo sapiens
cttctggagatggatccttccat

SEQ ID NO: 601816 - DNA, 23 bp, Homo sapiens
cttctggctgctgcagtcagcac

SEQ ID NO: 601817 - DNA, 21 bp, Homo sapiens
cttctggggagggacacagag

SEQ ID NO: 601818 - DNA, 22 bp, Homo sapiens
cttctggggagggacacagagg

SEQ ID NO: 601819 - DNA, 23 bp, Homo sapiens
cttcttattcatgctttctcctt

SEQ ID NO: 601820 - DNA, 21 bp, Homo sapiens
cttcttgcggcaccgcccacc

SEQ ID NO: 601821 - DNA, 22 bp, Homo sapiens
cttcttgcggcaccgcccaccc

SEQ ID NO: 601822 - DNA, 17 bp, Homo sapiens
cttctttactaacactg

SEQ ID NO: 601823 - DNA, 14 bp, Homo sapiens
cttctttccttcct

SEQ ID NO: 601824 - DNA, 17 bp, Homo sapiens
cttgaaaccagctcagg

SEQ ID NO: 601825 - DNA, 22 bp, Homo sapiens
cttgaagaactgacttcctgaa

SEQ ID NO: 601826 - DNA, 13 bp, Homo sapiens
cttgacaggcgcc

SEQ ID NO: 601827 - DNA, 14 bp, Homo sapiens
cttgaccccacacg

SEQ ID NO: 601828 - DNA, 14 bp, Homo sapiens
cttgaccctgaaat

SEQ ID NO: 601829 - DNA, 12 bp, Homo sapiens
cttgactattac

SEQ ID NO: 601830 - DNA, 14 bp, Homo sapiens
cttgagaccagcct

SEQ ID NO: 601831 - DNA, 16 bp, Homo sapiens
cttgagaccagcctgc

SEQ ID NO: 601832 - DNA, 23 bp, Homo sapiens
cttgagaccagcctgccaggccc

SEQ ID NO: 601833 - DNA, 18 bp, Homo sapiens
cttgagcaaggcaagaag

SEQ ID NO: 601834 - DNA, 16 bp, Homo sapiens
cttgagcagctgaatt

SEQ ID NO: 601835 - DNA, 20 bp, Homo sapiens
cttgagcatgcccaaatata

SEQ ID NO: 601836 - DNA, 23 bp, Homo sapiens
cttgagggacgactttctttaac

SEQ ID NO: 601837 - DNA, 13 bp, Homo sapiens
cttgatgtttcta

SEQ ID NO: 601838 - DNA, 19 bp, Homo sapiens
cttgatgtttctatatgta

SEQ ID NO: 601839 - DNA, 13 bp, Homo sapiens
cttgattctaaag

SEQ ID NO: 601840 - DNA, 20 bp, Homo sapiens
cttgattctaaaggggacag

SEQ ID NO: 601841 - DNA, 13 bp, Homo sapiens
cttgatttttcaa

SEQ ID NO: 601842 - DNA, 18 bp, Homo sapiens
cttgatttttcaaagact

SEQ ID NO: 601843 - DNA, 18 bp, Homo sapiens
cttgcactgtatccaagt

SEQ ID NO: 601844 - DNA, 15 bp, Homo sapiens
cttgcagtcatcaga

SEQ ID NO: 601845 - DNA, 16 bp, Homo sapiens
cttgcagttatgttat

SEQ ID NO: 601846 - DNA, 23 bp, Homo sapiens
cttgcctgaatccatcaggactt

SEQ ID NO: 601847 - DNA, 20 bp, Homo sapiens
cttgccttgaggctctgcag

SEQ ID NO: 601848 - DNA, 18 bp, Homo sapiens
cttgcggcaccgcccacc

SEQ ID NO: 601849 - DNA, 21 bp, Homo sapiens
cttgctctgctcatctacaca

SEQ ID NO: 601850 - DNA, 14 bp, Homo sapiens
cttgctgggccagg

SEQ ID NO: 601851 - DNA, 15 bp, Homo sapiens
cttgctgtgacttat

SEQ ID NO: 601852 - DNA, 20 bp, Homo sapiens
cttgctgtttaccgcccacc

SEQ ID NO: 601853 - DNA, 18 bp, Homo sapiens
cttggaacatttgggaga

SEQ ID NO: 601854 - DNA, 17 bp, Homo sapiens
cttggagagagaggctg

SEQ ID NO: 601855 - DNA, 23 bp, Homo sapiens
cttggagagagaggctgcctcag

SEQ ID NO: 601856 - DNA, 24 bp, Homo sapiens
cttggagagagaggctgcctcagc

SEQ ID NO: 601857 - DNA, 12 bp, Homo sapiens
cttggagaggag

SEQ ID NO: 601858 - DNA, 14 bp, Homo sapiens
cttggagaggagag

SEQ ID NO: 601859 - DNA, 18 bp, Homo sapiens
cttggagaggagagtggc

SEQ ID NO: 601860 - DNA, 13 bp, Homo sapiens
cttggagaggagg

SEQ ID NO: 601861 - DNA, 14 bp, Homo sapiens
cttggagccccctg

SEQ ID NO: 601862 - DNA, 17 bp, Homo sapiens
cttggagccccctggcg

SEQ ID NO: 601863 - DNA, 18 bp, Homo sapiens
cttggagccccctggcgg

SEQ ID NO: 601864 - DNA, 15 bp, Homo sapiens
cttggataggagctt

SEQ ID NO: 601865 - DNA, 17 bp, Homo sapiens
cttggatcgtggaagaa

SEQ ID NO: 601866 - DNA, 21 bp, Homo sapiens
ctccagactcgagagggctga

SEQ ID NO: 601867 - DNA, 23 bp, Homo sapiens
ctccagactcgagagggctgagc

SEQ ID NO: 601868 - DNA, 23 bp, Homo sapiens
ctccagagtaggtgggtcttgga

SEQ ID NO: 601869 - DNA, 14 bp, Homo sapiens
ctccagattatttt

SEQ ID NO: 601870 - DNA, 21 bp, Homo sapiens
ctccagccaatttcaaagaaa

SEQ ID NO: 601871 - DNA, 22 bp, Homo sapiens
ctccagccaatttcaaagaaaa

SEQ ID NO: 601872 - DNA, 13 bp, Homo sapiens
ctccagcccatgc

SEQ ID NO: 601873 - DNA, 15 bp, Homo sapiens
ctccagcccatgctg

SEQ ID NO: 601874 - DNA, 21 bp, Homo sapiens
ctccagcccatgctggctggg

SEQ ID NO: 601875 - DNA, 23 bp, Homo sapiens
ctccaggaagggaccccactgga

SEQ ID NO: 601876 - DNA, 18 bp, Homo sapiens
ctccaggaggactgttct

SEQ ID NO: 601877 - DNA, 19 bp, Homo sapiens
ctccaggaggactgttcta

SEQ ID NO: 601878 - DNA, 19 bp, Homo sapiens
ctccagtacaataaataaa

SEQ ID NO: 601879 - DNA, 23 bp, Homo sapiens
ctccagtggggcaagattttcct

SEQ ID NO: 601880 - DNA, 18 bp, Homo sapiens
ctccatgccccagctctg

SEQ ID NO: 601881 - DNA, 21 bp, Homo sapiens
ctccatgccccagctctggat

SEQ ID NO: 601882 - DNA, 19 bp, Homo sapiens
ctccatgctgtccctgtgg

SEQ ID NO: 601883 - DNA, 21 bp, Homo sapiens
ctccatgctgtccctgtgggc

SEQ ID NO: 601884 - DNA, 22 bp, Homo sapiens
ctccatgctgtccctgtgggct

SEQ ID NO: 601885 - DNA, 21 bp, Homo sapiens
ctccatggtgaactgaagcag

SEQ ID NO: 601886 - DNA, 18 bp, Homo sapiens
ctcccaaataaactcctt

SEQ ID NO: 601887 - DNA, 15 bp, Homo sapiens
ctcccaactctggcc

SEQ ID NO: 601888 - DNA, 15 bp, Homo sapiens
ctcccagcctcttgc

SEQ ID NO: 601889 - DNA, 13 bp, Homo sapiens
ctcccagggtcct

SEQ ID NO: 601890 - DNA, 22 bp, Homo sapiens
ctcccagggtcctgggggctgc

SEQ ID NO: 601891 - DNA, 21 bp, Homo sapiens
ctccccacagtcctcacagcc

SEQ ID NO: 601892 - DNA, 22 bp, Homo sapiens
ctccccacagtcctcacagcct

SEQ ID NO: 601893 - DNA, 20 bp, Homo sapiens
ctccccagagccctgcagtc

SEQ ID NO: 601894 - DNA, 12 bp, Homo sapiens
ctccccagcccc

SEQ ID NO: 601895 - DNA, 13 bp, Homo sapiens
ctccccagccccc

SEQ ID NO: 601896 - DNA, 12 bp, Homo sapiens
ctccccagccct

SEQ ID NO: 601897 - DNA, 14 bp, Homo sapiens
ctccccatgctggg

SEQ ID NO: 601898 - DNA, 13 bp, Homo sapiens
ctcccccagagcc

SEQ ID NO: 601899 - DNA, 11 bp, Homo sapiens
ctcccccaggc

SEQ ID NO: 601900 - DNA, 13 bp, Homo sapiens
ctcccccaggctg

SEQ ID NO: 601901 - DNA, 12 bp, Homo sapiens
ctcccctccaga

SEQ ID NO: 601902 - DNA, 15 bp, Homo sapiens
ctcccctctcctgag

SEQ ID NO: 601903 - DNA, 13 bp, Homo sapiens
ctcccctggtcct

SEQ ID NO: 601904 - DNA, 16 bp, Homo sapiens
ctcccctggtcctgca

SEQ ID NO: 601905 - DNA, 17 bp, Homo sapiens
ctcccgccgcctcgggc

SEQ ID NO: 601906 - DNA, 20 bp, Homo sapiens
ctcccgccgcctcgggccgc

SEQ ID NO: 601907 - DNA, 15 bp, Homo sapiens
ctcccgggtcgtgtc

SEQ ID NO: 601908 - DNA, 18 bp, Homo sapiens
ctcccggtgtgcagcggg

SEQ ID NO: 601909 - DNA, 22 bp, Homo sapiens
ctcccgtccgtccgcccgccca

SEQ ID NO: 601910 - DNA, 19 bp, Homo sapiens
ctccctaagtccactctag

SEQ ID NO: 601911 - DNA, 13 bp, Homo sapiens
ctccctaccctct

SEQ ID NO: 601912 - DNA, 16 bp, Homo sapiens
ctccctaccctcttct

SEQ ID NO: 601913 - DNA, 19 bp, Homo sapiens
ctccctaccctcttctcag

SEQ ID NO: 601914 - DNA, 13 bp, Homo sapiens
ctccctaggcctg

SEQ ID NO: 601915 - DNA, 14 bp, Homo sapiens
ctccctccacacct

SEQ ID NO: 601916 - DNA, 15 bp, Homo sapiens
ctccctccacacctc

SEQ ID NO: 601917 - DNA, 17 bp, Homo sapiens
ctccctccactcctccc

SEQ ID NO: 601918 - DNA, 13 bp, Homo sapiens
ctccctccctgct

SEQ ID NO: 601919 - DNA, 16 bp, Homo sapiens
ctccctcccttctttc

SEQ ID NO: 601920 - DNA, 21 bp, Homo sapiens
ctccctcccttctttccttcc

SEQ ID NO: 601921 - DNA, 13 bp, Homo sapiens
ctccctgggcacc

SEQ ID NO: 601922 - DNA, 20 bp, Homo sapiens
ctccctgggcaccctgcagg

SEQ ID NO: 601923 - DNA, 20 bp, Homo sapiens
ctctcctcgtccggcctgca

SEQ ID NO: 601924 - DNA, 21 bp, Homo sapiens
ctctcctctctctccctccac

SEQ ID NO: 601925 - DNA, 13 bp, Homo sapiens
ctctcctctctgg

SEQ ID NO: 601926 - DNA, 14 bp, Homo sapiens
ctctcctctctgga

SEQ ID NO: 601927 - DNA, 21 bp, Homo sapiens
ctctcgtagaacctgcgcacc

SEQ ID NO: 601928 - DNA, 13 bp, Homo sapiens
ctctctcacccag

SEQ ID NO: 601929 - DNA, 15 bp, Homo sapiens
ctctctcacccagcc

SEQ ID NO: 601930 - DNA, 14 bp, Homo sapiens
ctctctcattccca

SEQ ID NO: 601931 - DNA, 19 bp, Homo sapiens
ctctctccctccactcctc

SEQ ID NO: 601932 - DNA, 9 bp, Homo sapiens
ctctctctc

SEQ ID NO: 601933 - DNA, 12 bp, Homo sapiens
ctctctctccct

SEQ ID NO: 601934 - DNA, 15 bp, Homo sapiens
ctctctctctctctg

SEQ ID NO: 601935 - DNA, 15 bp, Homo sapiens
ctctctctctctgtt

SEQ ID NO: 601936 - DNA, 14 bp, Homo sapiens
ctctctctctgttc

SEQ ID NO: 601937 - DNA, 15 bp, Homo sapiens
ctctctgttccaagt

SEQ ID NO: 601938 - DNA, 18 bp, Homo sapiens
ctctctgttccaagtgtg

SEQ ID NO: 601939 - DNA, 23 bp, Homo sapiens
ctctctgtttaccctccctgtcc

SEQ ID NO: 601940 - DNA, 13 bp, Homo sapiens
ctctcttcttact

SEQ ID NO: 601941 - DNA, 15 bp, Homo sapiens
ctctctttcttttgt

SEQ ID NO: 601942 - DNA, 20 bp, Homo sapiens
ctctgaagtcccttcctgtc

SEQ ID NO: 601943 - DNA, 15 bp, Homo sapiens
ctctgaatctctcaa

SEQ ID NO: 601944 - DNA, 16 bp, Homo sapiens
ctctgaatctctcaaa

SEQ ID NO: 601945 - DNA, 20 bp, Homo sapiens
ctctgaatctctcaaaatgt

SEQ ID NO: 601946 - DNA, 21 bp, Homo sapiens
ctctgagactcgcgacaatgc

SEQ ID NO: 601947 - DNA, 17 bp, Homo sapiens
ctctgagcagacagggc

SEQ ID NO: 601948 - DNA, 22 bp, Homo sapiens
ctctgagcagacagggcgtcct

SEQ ID NO: 601949 - DNA, 23 bp, Homo sapiens
ctctgagcagacagggcgtcctc

SEQ ID NO: 601950 - DNA, 12 bp, Homo sapiens
ctctgagcagtg

SEQ ID NO: 601951 - DNA, 16 bp, Homo sapiens
ctctgagcagtgggga

SEQ ID NO: 601952 - DNA, 12 bp, Homo sapiens
ctctgaggacag

SEQ ID NO: 601953 - DNA, 13 bp, Homo sapiens
ctctgagtcctca

SEQ ID NO: 601954 - DNA, 16 bp, Homo sapiens
ctctgcagcctgagct

SEQ ID NO: 601955 - DNA, 23 bp, Homo sapiens
ctctgcataagattatatacaaa

SEQ ID NO: 601956 - DNA, 16 bp, Homo sapiens
ctctgccccctccccc

SEQ ID NO: 601957 - DNA, 13 bp, Homo sapiens
ctctgcccctccg

SEQ ID NO: 601958 - DNA, 21 bp, Homo sapiens
ctctgcccctccgtccccagg

SEQ ID NO: 601959 - DNA, 22 bp, Homo sapiens
ctctgccggtggggccagcgct

SEQ ID NO: 601960 - DNA, 18 bp, Homo sapiens
ctctgcgacgatccccat

SEQ ID NO: 601961 - DNA, 16 bp, Homo sapiens
ctctgcgccccagcga

SEQ ID NO: 601962 - DNA, 15 bp, Homo sapiens
ctctggatgaaggca

SEQ ID NO: 601963 - DNA, 17 bp, Homo sapiens
ctctggtggaacctgca

SEQ ID NO: 601964 - DNA, 16 bp, Homo sapiens
ctctgtcagtttgtga

SEQ ID NO: 601965 - DNA, 23 bp, Homo sapiens
ctctgtcagtttgtgaagtgatt

SEQ ID NO: 601966 - DNA, 16 bp, Homo sapiens
ctctgtccactctgaa

SEQ ID NO: 601967 - DNA, 23 bp, Homo sapiens
ctctgtccgcgtcctttcctctc

SEQ ID NO: 601968 - DNA, 18 bp, Homo sapiens
ctctgtctataggactta

SEQ ID NO: 601969 - DNA, 13 bp, Homo sapiens
ctctgtgtggcaa

SEQ ID NO: 601970 - DNA, 20 bp, Homo sapiens
ctctgttccaagtgtgtgtg

SEQ ID NO: 601971 - DNA, 22 bp, Homo sapiens
ctcttaaaaattatctttaaaa

SEQ ID NO: 601972 - DNA, 21 bp, Homo sapiens
ctcttaatgtctcaaaataaa

SEQ ID NO: 601973 - DNA, 20 bp, Homo sapiens
ctcttaccccgtccctttcc

SEQ ID NO: 601974 - DNA, 22 bp, Homo sapiens
ctcttaccccgtccctttccct

SEQ ID NO: 601975 - DNA, 19 bp, Homo sapiens
ctcttactaaccaccattt

SEQ ID NO: 601976 - DNA, 15 bp, Homo sapiens
ctcttcaatccccat

SEQ ID NO: 601977 - DNA, 22 bp, Homo sapiens
ctcttcccaagtcctcgccccc

SEQ ID NO: 601978 - DNA, 14 bp, Homo sapiens
ctcttcccctttcc

SEQ ID NO: 601979 - DNA, 20 bp, Homo sapiens
ctcttctcagctccactctg

SEQ ID NO: 601980 - DNA, 21 bp, Homo sapiens
ctcttcttactgtatttggga

SEQ ID NO: 601981 - DNA, 22 bp, Homo sapiens
ctcttcttattcatgctttctc

SEQ ID NO: 601982 - DNA, 11 bp, Homo sapiens
ctcttcttcct

SEQ ID NO: 601983 - DNA, 16 bp, Homo sapiens
ctcttgaatgcttaaa

SEQ ID NO: 601984 - DNA, 19 bp, Homo sapiens
ctcttgaatgcttaaatga

SEQ ID NO: 601985 - DNA, 21 bp, Homo sapiens
ctcttggtctctttctttcca

SEQ ID NO: 601986 - DNA, 11 bp, Homo sapiens
ctctttccctc

SEQ ID NO: 601987 - DNA, 16 bp, Homo sapiens
ctctttccctcatgta

SEQ ID NO: 601988 - DNA, 17 bp, Homo sapiens
ctctttcggaaatgatt

SEQ ID NO: 601989 - DNA, 15 bp, Homo sapiens
ctctttctctctgtg

SEQ ID NO: 601990 - DNA, 16 bp, Homo sapiens
ctctttctctctgtgt

SEQ ID NO: 601991 - DNA, 16 bp, Homo sapiens
ctatcagggcaagctc

SEQ ID NO: 601992 - DNA, 22 bp, Homo sapiens
ctatcagggcaagctcatagca

SEQ ID NO: 601993 - DNA, 20 bp, Homo sapiens
ctatccccggacgcatgcag

SEQ ID NO: 601994 - DNA, 22 bp, Homo sapiens
ctatccccggacgcatgcaggg

SEQ ID NO: 601995 - DNA, 20 bp, Homo sapiens
ctatccctggacgcatgcag

SEQ ID NO: 601996 - DNA, 13 bp, Homo sapiens
ctatccctggcca

SEQ ID NO: 601997 - DNA, 20 bp, Homo sapiens
ctatccctggccacctgcca

SEQ ID NO: 601998 - DNA, 14 bp, Homo sapiens
ctatcctgcaccct

SEQ ID NO: 601999 - DNA, 16 bp, Homo sapiens
ctatcctgcaccctct

SEQ ID NO: 602000 - DNA, 18 bp, Homo sapiens
ctatcctgcaccctctgc

SEQ ID NO: 602001 - DNA, 14 bp, Homo sapiens
ctatctggaaaaaa

SEQ ID NO: 602002 - DNA, 20 bp, Homo sapiens
ctatgattaaactgggaaat

SEQ ID NO: 602003 - DNA, 22 bp, Homo sapiens
ctatgattaaactgggaaatga

SEQ ID NO: 602004 - DNA, 17 bp, Homo sapiens
ctatgcacaccaaattg

SEQ ID NO: 602005 - DNA, 21 bp, Homo sapiens
ctatgcacaccaaattgctga

SEQ ID NO: 602006 - DNA, 16 bp, Homo sapiens
ctatgctgtgtgcaga

SEQ ID NO: 602007 - DNA, 15 bp, Homo sapiens
ctatgctgttcattg

SEQ ID NO: 602008 - DNA, 14 bp, Homo sapiens
ctatgtgtgtgctt

SEQ ID NO: 602009 - DNA, 13 bp, Homo sapiens
ctattaagaaact

SEQ ID NO: 602010 - DNA, 22 bp, Homo sapiens
ctattatctgggttttagaaat

SEQ ID NO: 602011 - DNA, 20 bp, Homo sapiens
ctattgctgtaaataaaaat

SEQ ID NO: 602012 - DNA, 17 bp, Homo sapiens
ctattggcataaaacaa

SEQ ID NO: 602013 - DNA, 22 bp, Homo sapiens
ctatttaagtggactgtatttc

SEQ ID NO: 602014 - DNA, 13 bp, Homo sapiens
ctatttctgctga

SEQ ID NO: 602015 - DNA, 16 bp, Homo sapiens
ctatttgtgtaactga

SEQ ID NO: 602016 - DNA, 23 bp, Homo sapiens
ctcaaaataaaaccagaaagagg

SEQ ID NO: 602017 - DNA, 12 bp, Homo sapiens
ctcaaaatgtgc

SEQ ID NO: 602018 - DNA, 14 bp, Homo sapiens
ctcaacacacagta

SEQ ID NO: 602019 - DNA, 13 bp, Homo sapiens
ctcaacctctcag

SEQ ID NO: 602020 - DNA, 22 bp, Homo sapiens
ctcaagccaggagaccctgtct

SEQ ID NO: 602021 - DNA, 18 bp, Homo sapiens
ctcaagttgtgtgctatt

SEQ ID NO: 602022 - DNA, 16 bp, Homo sapiens
ctcaatcatgacttct

SEQ ID NO: 602023 - DNA, 11 bp, Homo sapiens
ctcaatgtgct

SEQ ID NO: 602024 - DNA, 19 bp, Homo sapiens
ctcaattcatatttatgaa

SEQ ID NO: 602025 - DNA, 15 bp, Homo sapiens
ctcaattccagggaa

SEQ ID NO: 602026 - DNA, 18 bp, Homo sapiens
ctcaattctgaaggggaa

SEQ ID NO: 602027 - DNA, 20 bp, Homo sapiens
ctcaattttggtttttctca

SEQ ID NO: 602028 - DNA, 15 bp, Homo sapiens
ctcacaaaaggctgg

SEQ ID NO: 602029 - DNA, 23 bp, Homo sapiens
ctcacaaaaggctggatgtgctt

SEQ ID NO: 602030 - DNA, 17 bp, Homo sapiens
ctcacacttgggctggc

SEQ ID NO: 602031 - DNA, 13 bp, Homo sapiens
ctcacagcctctc

SEQ ID NO: 602032 - DNA, 14 bp, Homo sapiens
ctcacagcctctcc

SEQ ID NO: 602033 - DNA, 17 bp, Homo sapiens
ctcacagcctctccctt

SEQ ID NO: 602034 - DNA, 18 bp, Homo sapiens
ctcacagcctctccctta

SEQ ID NO: 602035 - DNA, 17 bp, Homo sapiens
ctcaccatttaatcatt

SEQ ID NO: 602036 - DNA, 15 bp, Homo sapiens
ctcacccctgtaggg

SEQ ID NO: 602037 - DNA, 15 bp, Homo sapiens
ctcacctctgaggac

SEQ ID NO: 602038 - DNA, 21 bp, Homo sapiens
ctcacgtctgtgagtctgtcc

SEQ ID NO: 602039 - DNA, 19 bp, Homo sapiens
ctcactacatgggccagcc

SEQ ID NO: 602040 - DNA, 21 bp, Homo sapiens
ctcactacatgggccagccct

SEQ ID NO: 602041 - DNA, 23 bp, Homo sapiens
ctcactacatgggccagcccttg

SEQ ID NO: 602042 - DNA, 17 bp, Homo sapiens
ctcactccactcccctc

SEQ ID NO: 602043 - DNA, 16 bp, Homo sapiens
ctcactgggtgtggcc

SEQ ID NO: 602044 - DNA, 15 bp, Homo sapiens
ctcactgtgacctgc

SEQ ID NO: 602045 - DNA, 20 bp, Homo sapiens
ctcactgtgacctgctcctg

SEQ ID NO: 602046 - DNA, 23 bp, Homo sapiens
ctcactgtgacctgctcctgccc

SEQ ID NO: 602047 - DNA, 17 bp, Homo sapiens
ctcacttttctcatctg

SEQ ID NO: 602048 - DNA, 14 bp, Homo sapiens
ctcacttttttata

SEQ ID NO: 602049 - DNA, 19 bp, Homo sapiens
ctcagaaacagaagaaaaa

SEQ ID NO: 602050 - DNA, 22 bp, Homo sapiens
ctcagaagtgaaaaagacttca

SEQ ID NO: 602051 - DNA, 11 bp, Homo sapiens
ctcagcagccc

SEQ ID NO: 602052 - DNA, 14 bp, Homo sapiens
ctcagcagccccct

SEQ ID NO: 602053 - DNA, 16 bp, Homo sapiens
ctcagccagtggcaca

SEQ ID NO: 602054 - DNA, 14 bp, Homo sapiens
ctcagcccatcccc

SEQ ID NO: 602055 - DNA, 19 bp, Homo sapiens
cgctgcctggcgggcagcc

SEQ ID NO: 602056 - DNA, 15 bp, Homo sapiens
cgctggagaccctgc

SEQ ID NO: 602057 - DNA, 18 bp, Homo sapiens
cgctggagaccctgcgcc

SEQ ID NO: 602058 - DNA, 17 bp, Homo sapiens
cgcttgtgcagaaaaca

SEQ ID NO: 602059 - DNA, 18 bp, Homo sapiens
cgcttgtgcagaaaacat

SEQ ID NO: 602060 - DNA, 20 bp, Homo sapiens
cgcttgtgcagaaaacattg

SEQ ID NO: 602061 - DNA, 23 bp, Homo sapiens
cgcttttgtacgttaattaaaca

SEQ ID NO: 602062 - DNA, 15 bp, Homo sapiens
cggaccggagcggct

SEQ ID NO: 602063 - DNA, 18 bp, Homo sapiens
cggaccggagcggctgag

SEQ ID NO: 602064 - DNA, 19 bp, Homo sapiens
cggaccggagcggctgagg

SEQ ID NO: 602065 - DNA, 13 bp, Homo sapiens
cggacgctggctc

SEQ ID NO: 602066 - DNA, 19 bp, Homo sapiens
cggagcccccgcccctccc

SEQ ID NO: 602067 - DNA, 16 bp, Homo sapiens
cggagcggctgaggac

SEQ ID NO: 602068 - DNA, 13 bp, Homo sapiens
cggaggcccctga

SEQ ID NO: 602069 - DNA, 16 bp, Homo sapiens
cggaggcgcccacctg

SEQ ID NO: 602070 - DNA, 20 bp, Homo sapiens
cggaggcgcccacctgccca

SEQ ID NO: 602071 - DNA, 22 bp, Homo sapiens
cggaggcgcccacctgcccagt

SEQ ID NO: 602072 - DNA, 19 bp, Homo sapiens
cggaggggcttggagcaga

SEQ ID NO: 602073 - DNA, 20 bp, Homo sapiens
cggaggggcttggagcagag

SEQ ID NO: 602074 - DNA, 20 bp, Homo sapiens
cggagggtctccctgggcac

SEQ ID NO: 602075 - DNA, 21 bp, Homo sapiens
cggagggtctccctgggcacc

SEQ ID NO: 602076 - DNA, 16 bp, Homo sapiens
cggagtttccatttgg

SEQ ID NO: 602077 - DNA, 18 bp, Homo sapiens
cggagtttccatttggat

SEQ ID NO: 602078 - DNA, 19 bp, Homo sapiens
cggatggaatcacagccaa

SEQ ID NO: 602079 - DNA, 24 bp, Homo sapiens
cggcagaggcagggccctggggtc

SEQ ID NO: 602080 - DNA, 15 bp, Homo sapiens
cggcagccccatcct

SEQ ID NO: 602081 - DNA, 17 bp, Homo sapiens
cggcaggggttggcagc

SEQ ID NO: 602082 - DNA, 18 bp, Homo sapiens
cggcaggggttggcagcg

SEQ ID NO: 602083 - DNA, 13 bp, Homo sapiens
cggcagtggctgg

SEQ ID NO: 602084 - DNA, 14 bp, Homo sapiens
cggcagtggctggg

SEQ ID NO: 602085 - DNA, 16 bp, Homo sapiens
cggcagtggctggggg

SEQ ID NO: 602086 - DNA, 20 bp, Homo sapiens
cggcagtggctgggggactg

SEQ ID NO: 602087 - DNA, 23 bp, Homo sapiens
cggcagtggctgggggactgctt

SEQ ID NO: 602088 - DNA, 13 bp, Homo sapiens
cggcatccgagcc

SEQ ID NO: 602089 - DNA, 19 bp, Homo sapiens
cggccaggcacggaggctc

SEQ ID NO: 602090 - DNA, 22 bp, Homo sapiens
cggccattgaacactgcaccct

SEQ ID NO: 602091 - DNA, 21 bp, Homo sapiens
cggcccacgcagagccccgga

SEQ ID NO: 602092 - DNA, 22 bp, Homo sapiens
cggcccacgcagagccccggag

SEQ ID NO: 602093 - DNA, 14 bp, Homo sapiens
cggccccatcagag

SEQ ID NO: 602094 - DNA, 18 bp, Homo sapiens
cggccccatcagaggctg

SEQ ID NO: 602095 - DNA, 12 bp, Homo sapiens
cggcccccctct

SEQ ID NO: 602096 - DNA, 18 bp, Homo sapiens
cggccccgcgcgtgcccc

SEQ ID NO: 602097 - DNA, 19 bp, Homo sapiens
cggccccgcgcgtgccccc

SEQ ID NO: 602098 - DNA, 15 bp, Homo sapiens
cggcccgccaccttg

SEQ ID NO: 602099 - DNA, 16 bp, Homo sapiens
cggcccggcccacgca

SEQ ID NO: 602100 - DNA, 18 bp, Homo sapiens
cggcccggcccacgcaga

SEQ ID NO: 602101 - DNA, 14 bp, Homo sapiens
cggccgctctccgc

SEQ ID NO: 602102 - DNA, 13 bp, Homo sapiens
cggccgtccctga

SEQ ID NO: 602103 - DNA, 12 bp, Homo sapiens
cggcctgcagcc

SEQ ID NO: 602104 - DNA, 14 bp, Homo sapiens
cggcctgcagccca

SEQ ID NO: 602105 - DNA, 15 bp, Homo sapiens
cggcctggccccctc

SEQ ID NO: 602106 - DNA, 16 bp, Homo sapiens
cggcggggcctgggtc

SEQ ID NO: 602107 - DNA, 19 bp, Homo sapiens
cggcgtccctgagggccct

SEQ ID NO: 602108 - DNA, 17 bp, Homo sapiens
cggctctgaggctgccc

SEQ ID NO: 602109 - DNA, 19 bp, Homo sapiens
cggctctgaggctgcccca

SEQ ID NO: 602110 - DNA, 20 bp, Homo sapiens
cggctgaggacggggcagag

SEQ ID NO: 602111 - DNA, 15 bp, Homo sapiens
cggctgggcagggcc

SEQ ID NO: 602112 - DNA, 20 bp, Homo sapiens
cggctgggcagggccgcagg

SEQ ID NO: 602113 - DNA, 20 bp, Homo sapiens
cggctgtgggggaggtccct

SEQ ID NO: 602114 - DNA, 19 bp, Homo sapiens
cggctgtgtggggagggtg

SEQ ID NO: 602115 - DNA, 13 bp, Homo sapiens
cgggaaggcctga

SEQ ID NO: 602116 - DNA, 23 bp, Homo sapiens
cgggactgaccttcggcagtggc

SEQ ID NO: 602117 - DNA, 14 bp, Homo sapiens
cgggagagcgccac

SEQ ID NO: 602118 - DNA, 16 bp, Homo sapiens
cgggagagcgccaccc

SEQ ID NO: 602119 - DNA, 19 bp, Homo sapiens
cgggagagcgccacccgcc

SEQ ID NO: 602120 - DNA, 21 bp, Homo sapiens
cgggcacccccggacgccccc

SEQ ID NO: 602121 - DNA, 22 bp, Homo sapiens
cgggccatttcacattcctgac

SEQ ID NO: 602122 - DNA, 19 bp, Homo sapiens
cgggcccgcactcaggagc

SEQ ID NO: 602123 - DNA, 20 bp, Homo sapiens
cgggcccgcactcaggagca

SEQ ID NO: 602124 - DNA, 18 bp, Homo sapiens
cgggcccgctcaacctct

SEQ ID NO: 602125 - DNA, 13 bp, Homo sapiens
cgggccgcctcct

SEQ ID NO: 602126 - DNA, 17 bp, Homo sapiens
cgggccgcctcctccag

SEQ ID NO: 602127 - DNA, 19 bp, Homo sapiens
cgggccgcctcctccagac

SEQ ID NO: 602128 - DNA, 22 bp, Homo sapiens
cgggcgcctgcgctcctctgca

SEQ ID NO: 602129 - DNA, 23 bp, Homo sapiens
cgggcgcctgcgctcctctgcag

SEQ ID NO: 602130 - DNA, 14 bp, Homo sapiens
cgggcggggcgagg

SEQ ID NO: 602131 - DNA, 13 bp, Homo sapiens
ccacccctgtgcg

SEQ ID NO: 602132 - DNA, 14 bp, Homo sapiens
ccacccgccccaga

SEQ ID NO: 602133 - DNA, 17 bp, Homo sapiens
ccacccgccccagagac

SEQ ID NO: 602134 - DNA, 19 bp, Homo sapiens
ccacccgccccagagactg

SEQ ID NO: 602135 - DNA, 20 bp, Homo sapiens
ccacccgccccagagactgc

SEQ ID NO: 602136 - DNA, 18 bp, Homo sapiens
ccaccctcccctctcctg

SEQ ID NO: 602137 - DNA, 13 bp, Homo sapiens
ccaccctgggcct

SEQ ID NO: 602138 - DNA, 16 bp, Homo sapiens
ccaccctgggcctccc

SEQ ID NO: 602139 - DNA, 17 bp, Homo sapiens
ccaccgcgcccctctgc

SEQ ID NO: 602140 - DNA, 18 bp, Homo sapiens
ccaccgcgcccctctgcg

SEQ ID NO: 602141 - DNA, 15 bp, Homo sapiens
ccacctgccaggcct

SEQ ID NO: 602142 - DNA, 12 bp, Homo sapiens
ccacctgcccag

SEQ ID NO: 602143 - DNA, 15 bp, Homo sapiens
ccacctgcccagtta

SEQ ID NO: 602144 - DNA, 16 bp, Homo sapiens
ccacctggtggccctg

SEQ ID NO: 602145 - DNA, 18 bp, Homo sapiens
ccacctggtggccctgcg

SEQ ID NO: 602146 - DNA, 23 bp, Homo sapiens
ccacctgttactacttctttttg

SEQ ID NO: 602147 - DNA, 15 bp, Homo sapiens
ccacgacctcgtcca

SEQ ID NO: 602148 - DNA, 16 bp, Homo sapiens
ccacgacctcgtccat

SEQ ID NO: 602149 - DNA, 13 bp, Homo sapiens
ccacgcagagccc

SEQ ID NO: 602150 - DNA, 15 bp, Homo sapiens
ccacgcagagccccg

SEQ ID NO: 602151 - DNA, 20 bp, Homo sapiens
ccacgcccctccccagcccc

SEQ ID NO: 602152 - DNA, 15 bp, Homo sapiens
ccacgcccctgcctg

SEQ ID NO: 602153 - DNA, 21 bp, Homo sapiens
ccacgccgatataagccatag

SEQ ID NO: 602154 - DNA, 23 bp, Homo sapiens
ccacgccgatataagccatagcc

SEQ ID NO: 602155 - DNA, 23 bp, Homo sapiens
ccacggggtcgggggaggagcac

SEQ ID NO: 602156 - DNA, 20 bp, Homo sapiens
ccacggtccaatccagcctt

SEQ ID NO: 602157 - DNA, 14 bp, Homo sapiens
ccacggtcctttga

SEQ ID NO: 602158 - DNA, 17 bp, Homo sapiens
ccacgtgcagcacctgt

SEQ ID NO: 602159 - DNA, 19 bp, Homo sapiens
ccacgtgtttcgggccagg

SEQ ID NO: 602160 - DNA, 20 bp, Homo sapiens
ccacgtgtttcgggccaggg

SEQ ID NO: 602161 - DNA, 12 bp, Homo sapiens
cattgcactaaa

SEQ ID NO: 602162 - DNA, 13 bp, Homo sapiens
cattgcactaaaa

SEQ ID NO: 602163 - DNA, 16 bp, Homo sapiens
cattgcactaaaagtg

SEQ ID NO: 602164 - DNA, 17 bp, Homo sapiens
cattgcactaaaagtga

SEQ ID NO: 602165 - DNA, 19 bp, Homo sapiens
cattgcactaaaagtgatg

SEQ ID NO: 602166 - DNA, 15 bp, Homo sapiens
cattgcactgcagtt

SEQ ID NO: 602167 - DNA, 16 bp, Homo sapiens
cattgcactgcagtta

SEQ ID NO: 602168 - DNA, 19 bp, Homo sapiens
cattgcccatggctgggaa

SEQ ID NO: 602169 - DNA, 12 bp, Homo sapiens
cattgccttctg

SEQ ID NO: 602170 - DNA, 15 bp, Homo sapiens
cattgccttctgggg

SEQ ID NO: 602171 - DNA, 22 bp, Homo sapiens
cattgccttctggggagggaca

SEQ ID NO: 602172 - DNA, 16 bp, Homo sapiens
cattgcttcattaaaa

SEQ ID NO: 602173 - DNA, 19 bp, Homo sapiens
cattgcttcattaaaacaa

SEQ ID NO: 602174 - DNA, 16 bp, Homo sapiens
cattgtcctgtagctt

SEQ ID NO: 602175 - DNA, 15 bp, Homo sapiens
cattgtctcagtgaa

SEQ ID NO: 602176 - DNA, 22 bp, Homo sapiens
cattgtgaatgttgtcctgtgt

SEQ ID NO: 602177 - DNA, 14 bp, Homo sapiens
cattgtgttttctt

SEQ ID NO: 602178 - DNA, 15 bp, Homo sapiens
cattgttcagaaaag

SEQ ID NO: 602179 - DNA, 15 bp, Homo sapiens
cattgtttgtccttt

SEQ ID NO: 602180 - DNA, 14 bp, Homo sapiens
cattgttttgccaa

SEQ ID NO: 602181 - DNA, 18 bp, Homo sapiens
catttacaacttccagat

SEQ ID NO: 602182 - DNA, 13 bp, Homo sapiens
catttagcacagt

SEQ ID NO: 602183 - DNA, 17 bp, Homo sapiens
catttagcacagtattt

SEQ ID NO: 602184 - DNA, 18 bp, Homo sapiens
catttagcacagtattta

SEQ ID NO: 602185 - DNA, 22 bp, Homo sapiens
catttagcacagtatttaacat

SEQ ID NO: 602186 - DNA, 16 bp, Homo sapiens
catttagtcctcacct

SEQ ID NO: 602187 - DNA, 17 bp, Homo sapiens
catttagtcctcacctt

SEQ ID NO: 602188 - DNA, 22 bp, Homo sapiens
catttatgcatgagaactaaat

SEQ ID NO: 602189 - DNA, 17 bp, Homo sapiens
catttatgtacaaaatg

SEQ ID NO: 602190 - DNA, 15 bp, Homo sapiens
catttcacattcctg

SEQ ID NO: 602191 - DNA, 20 bp, Homo sapiens
catttcacattcctgaccct

SEQ ID NO: 602192 - DNA, 21 bp, Homo sapiens
catttccagcaaaatatatgt

SEQ ID NO: 602193 - DNA, 20 bp, Homo sapiens
catttcccctgtggtttgtt

SEQ ID NO: 602194 - DNA, 12 bp, Homo sapiens
catttccctgct

SEQ ID NO: 602195 - DNA, 15 bp, Homo sapiens
catttccttgtctaa

SEQ ID NO: 602196 - DNA, 14 bp, Homo sapiens
catttctcttcccc

SEQ ID NO: 602197 - DNA, 19 bp, Homo sapiens
catttcttctctctgtgct

SEQ ID NO: 602198 - DNA, 13 bp, Homo sapiens
ccctcagccctca

SEQ ID NO: 602199 - DNA, 20 bp, Homo sapiens
ccctcagcgtctccccatgc

SEQ ID NO: 602200 - DNA, 22 bp, Homo sapiens
ccctcagcgtctccccatgctg

SEQ ID NO: 602201 - DNA, 21 bp, Homo sapiens
ccctcagctctccctcacacc

SEQ ID NO: 602202 - DNA, 16 bp, Homo sapiens
ccaggccctccagcag

SEQ ID NO: 602203 - DNA, 15 bp, Homo sapiens
ccaggcggaggggct

SEQ ID NO: 602204 - DNA, 21 bp, Homo sapiens
ccaggctagactaggaggttc

SEQ ID NO: 602205 - DNA, 18 bp, Homo sapiens
ccaggctcccactgcccc

SEQ ID NO: 602206 - DNA, 12 bp, Homo sapiens
ccaggctgcgcc

SEQ ID NO: 602207 - DNA, 14 bp, Homo sapiens
ccaggctgcgcctg

SEQ ID NO: 602208 - DNA, 15 bp, Homo sapiens
ccaggctgcgcctgc

SEQ ID NO: 602209 - DNA, 17 bp, Homo sapiens
ccaggctgcgcctgccc

SEQ ID NO: 602210 - DNA, 17 bp, Homo sapiens
ccagggaaccagagcga

SEQ ID NO: 602211 - DNA, 10 bp, Homo sapiens
ccagggaggt

SEQ ID NO: 602212 - DNA, 13 bp, Homo sapiens
ccagggaggtggc

SEQ ID NO: 602213 - DNA, 15 bp, Homo sapiens
ccagggaggtggcag

SEQ ID NO: 602214 - DNA, 17 bp, Homo sapiens
ccagggcagaggaatgt

SEQ ID NO: 602215 - DNA, 23 bp, Homo sapiens
ccaggggcttctccccctcagct

SEQ ID NO: 602216 - DNA, 15 bp, Homo sapiens
ccagggtccagccct

SEQ ID NO: 602217 - DNA, 15 bp, Homo sapiens
ccagggtgcaggcgc

SEQ ID NO: 602218 - DNA, 17 bp, Homo sapiens
ccagggtgcaggcgcgc

SEQ ID NO: 602219 - DNA, 18 bp, Homo sapiens
ccagggtgggaagagaag

SEQ ID NO: 602220 - DNA, 14 bp, Homo sapiens
ccagggttccagac

SEQ ID NO: 602221 - DNA, 17 bp, Homo sapiens
ccagggttccagacagg

SEQ ID NO: 602222 - DNA, 23 bp, Homo sapiens
ccaggtatctgatgatgttctga

SEQ ID NO: 602223 - DNA, 14 bp, Homo sapiens
ccaggtattgtctt

SEQ ID NO: 602224 - DNA, 13 bp, Homo sapiens
ccaggtctggcgc

SEQ ID NO: 602225 - DNA, 14 bp, Homo sapiens
ccaggtctggcgcc

SEQ ID NO: 602226 - DNA, 22 bp, Homo sapiens
ccaggtgttgtccgtgtctgtt

SEQ ID NO: 602227 - DNA, 21 bp, Homo sapiens
cccagagactgcccaccctgg

SEQ ID NO: 602228 - DNA, 22 bp, Homo sapiens
cccagagactgcccaccctggg

SEQ ID NO: 602229 - DNA, 14 bp, Homo sapiens
cccagagccctgca

SEQ ID NO: 602230 - DNA, 14 bp, Homo sapiens
cccagcacctcctc

SEQ ID NO: 602231 - DNA, 13 bp, Homo sapiens
cccagcagcgccc

SEQ ID NO: 602232 - DNA, 13 bp, Homo sapiens
cccagccaagcct

SEQ ID NO: 602233 - DNA, 15 bp, Homo sapiens
cccagccaagcctga

SEQ ID NO: 602234 - DNA, 16 bp, Homo sapiens
cccagccaagcctgac

SEQ ID NO: 602235 - DNA, 13 bp, Homo sapiens
cccagcccccacc

SEQ ID NO: 602236 - DNA, 18 bp, Homo sapiens
cccagcccccacccatgc

SEQ ID NO: 602237 - DNA, 15 bp, Homo sapiens
cccagcccccacccc

SEQ ID NO: 602238 - DNA, 12 bp, Homo sapiens
cccagccctggg

SEQ ID NO: 602239 - DNA, 16 bp, Homo sapiens
cccagcctatctctct

SEQ ID NO: 602240 - DNA, 17 bp, Homo sapiens
cccagcctcccccaggc

SEQ ID NO: 602241 - DNA, 18 bp, Homo sapiens
cccagcctcgttggagag

SEQ ID NO: 602242 - DNA, 20 bp, Homo sapiens
cccagcgacgcggcccgcgg

SEQ ID NO: 602243 - DNA, 21 bp, Homo sapiens
cccagctacaggggaggctga

SEQ ID NO: 602244 - DNA, 21 bp, Homo sapiens
cccagctgattagtgtctaag

SEQ ID NO: 602245 - DNA, 16 bp, Homo sapiens
cccagctggcagcgcc

SEQ ID NO: 602246 - DNA, 17 bp, Homo sapiens
cccagctggcagcgcct

SEQ ID NO: 602247 - DNA, 18 bp, Homo sapiens
cccagctggcagcgcctc

SEQ ID NO: 602248 - DNA, 12 bp, Homo sapiens
cccagctggctg

SEQ ID NO: 602249 - DNA, 19 bp, Homo sapiens
cccaggaagtcatcctgca

SEQ ID NO: 602250 - DNA, 15 bp, Homo sapiens
cccaggaccccccca

SEQ ID NO: 602251 - DNA, 18 bp, Homo sapiens
cccaggacccccccagtc

SEQ ID NO: 602252 - DNA, 23 bp, Homo sapiens
cccaggacgcatgcagggccccc

SEQ ID NO: 602253 - DNA, 13 bp, Homo sapiens
cccaggaggacct

SEQ ID NO: 602254 - DNA, 19 bp, Homo sapiens
cccaggaggactccctgct

SEQ ID NO: 602255 - DNA, 15 bp, Homo sapiens
cccaggatgcatgca

SEQ ID NO: 602256 - DNA, 20 bp, Homo sapiens
cccaggatgcatgcagggcc

SEQ ID NO: 602257 - DNA, 23 bp, Homo sapiens
cccaggatgcatgcagggccccc

SEQ ID NO: 602258 - DNA, 13 bp, Homo sapiens
cccaggcccgccc

SEQ ID NO: 602259 - DNA, 13 bp, Homo sapiens
cccaggctgcgcc

SEQ ID NO: 602260 - DNA, 17 bp, Homo sapiens
cccaggctgcgcctgcc

SEQ ID NO: 602261 - DNA, 18 bp, Homo sapiens
cccaggggcactgtgttc

SEQ ID NO: 602262 - DNA, 14 bp, Homo sapiens
cccagggtcccctg

SEQ ID NO: 602263 - DNA, 15 bp, Homo sapiens
cccagggtcccctgc

SEQ ID NO: 602264 - DNA, 20 bp, Homo sapiens
cccagggtcccctgcatggc

SEQ ID NO: 602265 - DNA, 13 bp, Homo sapiens
cccagggtgcagg

SEQ ID NO: 602266 - DNA, 16 bp, Homo sapiens
cccaggtgttgtccgt

SEQ ID NO: 602267 - DNA, 14 bp, Homo sapiens
cccagtccctggag

SEQ ID NO: 602268 - DNA, 17 bp, Homo sapiens
cccagtccctggagctg

SEQ ID NO: 602269 - DNA, 16 bp, Homo sapiens
cccagttagcccggcc

SEQ ID NO: 602270 - DNA, 21 bp, Homo sapiens
cccataatgcttctttcctct

SEQ ID NO: 602271 - DNA, 16 bp, Homo sapiens
cccatcagaggctggg

SEQ ID NO: 602272 - DNA, 15 bp, Homo sapiens
cccatcccctgcctc

SEQ ID NO: 602273 - DNA, 18 bp, Homo sapiens
cccatccttcccgcagca

SEQ ID NO: 602274 - DNA, 13 bp, Homo sapiens
cccatcgcctggg

SEQ ID NO: 602275 - DNA, 14 bp, Homo sapiens
cccatcgccttctg

SEQ ID NO: 602276 - DNA, 15 bp, Homo sapiens
cccatctcctcccat

SEQ ID NO: 602277 - DNA, 15 bp, Homo sapiens
cccatgccaatgtcc

SEQ ID NO: 602278 - DNA, 15 bp, Homo sapiens
cccatgctggctggg

SEQ ID NO: 602279 - DNA, 17 bp, Homo sapiens
cccatggaacagccctg

SEQ ID NO: 602280 - DNA, 19 bp, Homo sapiens
cccatggaacagccctgca

SEQ ID NO: 602281 - DNA, 21 bp, Homo sapiens
cccatggaacagccctgcacg

SEQ ID NO: 602282 - DNA, 22 bp, Homo sapiens
cccatgtctttctccaaagtta

SEQ ID NO: 602283 - DNA, 12 bp, Homo sapiens
cccatgtgtatg

SEQ ID NO: 602284 - DNA, 12 bp, Homo sapiens
cccattcagtga

SEQ ID NO: 602285 - DNA, 14 bp, Homo sapiens
cccattcagtgaca

SEQ ID NO: 602286 - DNA, 14 bp, Homo sapiens
cccattgccttctg

SEQ ID NO: 602287 - DNA, 16 bp, Homo sapiens
cccattgccttctggg

SEQ ID NO: 602288 - DNA, 16 bp, Homo sapiens
cccatttcacacaact

SEQ ID NO: 602289 - DNA, 15 bp, Homo sapiens
cccatttttgtaata

SEQ ID NO: 602290 - DNA, 16 bp, Homo sapiens
cccatttttgtaatat

SEQ ID NO: 602291 - DNA, 22 bp, Homo sapiens
cccatttttgtaatataagaca

SEQ ID NO: 602292 - DNA, 12 bp, Homo sapiens
ccccaaggaaga

SEQ ID NO: 602293 - DNA, 22 bp, Homo sapiens
ccccacaaggcccagccctggg

SEQ ID NO: 602294 - DNA, 14 bp, Homo sapiens
ccccacacgccggg

SEQ ID NO: 602295 - DNA, 19 bp, Homo sapiens
ccccacaggagcgtgtcct

SEQ ID NO: 602296 - DNA, 18 bp, Homo sapiens
ccccaccacacacaccct

SEQ ID NO: 602297 - DNA, 13 bp, Homo sapiens
ccccacccccgtc

SEQ ID NO: 602298 - DNA, 16 bp, Homo sapiens
ccccaccctcccctct

SEQ ID NO: 602299 - DNA, 18 bp, Homo sapiens
ccccaccctcccctctcc

SEQ ID NO: 602300 - DNA, 19 bp, Homo sapiens
ccccactggagcgtgtact

SEQ ID NO: 602301 - DNA, 22 bp, Homo sapiens
ccccagagccactacctttgtc

SEQ ID NO: 602302 - DNA, 17 bp, Homo sapiens
ccccaggcccgccctgc

SEQ ID NO: 602303 - DNA, 19 bp, Homo sapiens
ccccaggcccgccctgccc

SEQ ID NO: 602304 - DNA, 15 bp, Homo sapiens
ccccaggctgcgcct

SEQ ID NO: 602305 - DNA, 20 bp, Homo sapiens
ccccaggctgcgcctgcccg

SEQ ID NO: 602306 - DNA, 22 bp, Homo sapiens
ccccagggtgcaggcgcgcacc

SEQ ID NO: 602307 - DNA, 12 bp, Homo sapiens
ccccagtccgcc

SEQ ID NO: 602308 - DNA, 14 bp, Homo sapiens
ccccagtccgcccc

SEQ ID NO: 602309 - DNA, 17 bp, Homo sapiens
ccccagtccgccccgtg

SEQ ID NO: 602310 - DNA, 20 bp, Homo sapiens
ccccagttaatgtgccaaaa

SEQ ID NO: 602311 - DNA, 14 bp, Homo sapiens
ccccatccttcccg

SEQ ID NO: 602312 - DNA, 21 bp, Homo sapiens
ccccatccttcccgcagcacc

SEQ ID NO: 602313 - DNA, 14 bp, Homo sapiens
ccccatcgcctggg

SEQ ID NO: 602314 - DNA, 17 bp, Homo sapiens
ccccatcgccttctggg

SEQ ID NO: 602315 - DNA, 21 bp, Homo sapiens
ccccatgccctccctgctgcc

SEQ ID NO: 602316 - DNA, 17 bp, Homo sapiens
ccccatggaacagccct

SEQ ID NO: 602317 - DNA, 18 bp, Homo sapiens
ccccatggaacagccctg

SEQ ID NO: 602318 - DNA, 19 bp, Homo sapiens
ccccatggaacagccctgc

SEQ ID NO: 602319 - DNA, 22 bp, Homo sapiens
ccccatggaacagccctgcacg

SEQ ID NO: 602320 - DNA, 15 bp, Homo sapiens
ccccatgggccctca

SEQ ID NO: 602321 - DNA, 18 bp, Homo sapiens
ccccatgggccctcagcg

SEQ ID NO: 602322 - DNA, 13 bp, Homo sapiens
ccccattcagtga

SEQ ID NO: 602323 - DNA, 18 bp, Homo sapiens
ccccattgtgaatgttgt

SEQ ID NO: 602324 - DNA, 18 bp, Homo sapiens
cccccacccatgccagcg

SEQ ID NO: 602325 - DNA, 15 bp, Homo sapiens
cccccacggccgtcc

SEQ ID NO: 602326 - DNA, 19 bp, Homo sapiens
cccccacggccgtccctga

SEQ ID NO: 602327 - DNA, 12 bp, Homo sapiens
cccccagcctcc

SEQ ID NO: 602328 - DNA, 22 bp, Homo sapiens
cccccagcctcccccaggctgc

SEQ ID NO: 602329 - DNA, 14 bp, Homo sapiens
cgaagggcagcccc

SEQ ID NO: 602330 - DNA, 15 bp, Homo sapiens
cgaagggcagccccg

SEQ ID NO: 602331 - DNA, 18 bp, Homo sapiens
cgaccatgtgtagattgc

SEQ ID NO: 602332 - DNA, 14 bp, Homo sapiens
cgaccgacgcccct

SEQ ID NO: 602333 - DNA, 20 bp, Homo sapiens
cgacttgggacggaagtggc

SEQ ID NO: 602334 - DNA, 16 bp, Homo sapiens
cgactttctttaacat

SEQ ID NO: 602335 - DNA, 12 bp, Homo sapiens
cgagagggctga

SEQ ID NO: 602336 - DNA, 18 bp, Homo sapiens
cgagagggctgagcccct

SEQ ID NO: 602337 - DNA, 20 bp, Homo sapiens
cgagagggctgagcccctcc

SEQ ID NO: 602338 - DNA, 18 bp, Homo sapiens
cgagcaaacaactttctg

SEQ ID NO: 602339 - DNA, 16 bp, Homo sapiens
cgagcagagcgcagcc

SEQ ID NO: 602340 - DNA, 21 bp, Homo sapiens
cgaggagcttccagtgcatgt

SEQ ID NO: 602341 - DNA, 20 bp, Homo sapiens
cgaggcaccggacgctggag

SEQ ID NO: 602342 - DNA, 20 bp, Homo sapiens
cgaggcggcaaagatccagc

SEQ ID NO: 602343 - DNA, 19 bp, Homo sapiens
cgagtgacagaaggcccga

SEQ ID NO: 602344 - DNA, 18 bp, Homo sapiens
cgatcatatctgtatgcc

SEQ ID NO: 602345 - DNA, 13 bp, Homo sapiens
cgatccccatgga

SEQ ID NO: 602346 - DNA, 16 bp, Homo sapiens
cgcaaaggtgcctcat

SEQ ID NO: 602347 - DNA, 20 bp, Homo sapiens
cgcaaatacatgcctttcca

SEQ ID NO: 602348 - DNA, 19 bp, Homo sapiens
cgcaattgtatatatatgt

SEQ ID NO: 602349 - DNA, 14 bp, Homo sapiens
cgcaccgcccaacc

SEQ ID NO: 602350 - DNA, 14 bp, Homo sapiens
cgcactcaggagca

SEQ ID NO: 602351 - DNA, 14 bp, Homo sapiens
cgcagagccccgga

SEQ ID NO: 602352 - DNA, 16 bp, Homo sapiens
cgcagagccccggagc

SEQ ID NO: 602353 - DNA, 20 bp, Homo sapiens
cgcagcaccagcctgagcca

SEQ ID NO: 602354 - DNA, 22 bp, Homo sapiens
cgcagcaccagcctgagccaca

SEQ ID NO: 602355 - DNA, 16 bp, Homo sapiens
cgcagccgcgctctgc

SEQ ID NO: 602356 - DNA, 17 bp, Homo sapiens
cgcagccgcgctctgcc

SEQ ID NO: 602357 - DNA, 14 bp, Homo sapiens
cgcagcctgaagcc

SEQ ID NO: 602358 - DNA, 18 bp, Homo sapiens
cgcagcgccagggctcag

SEQ ID NO: 602359 - DNA, 22 bp, Homo sapiens
cgcagctggcgcgtgtgtggcc

SEQ ID NO: 602360 - DNA, 23 bp, Homo sapiens
cgcagggcgctccggcagaggca

SEQ ID NO: 602361 - DNA, 11 bp, Homo sapiens
cgcattaagca

SEQ ID NO: 602362 - DNA, 15 bp, Homo sapiens
cgcattaagcacaca

SEQ ID NO: 602363 - DNA, 16 bp, Homo sapiens
cgcattaagcacacac

SEQ ID NO: 602364 - DNA, 22 bp, Homo sapiens
cgccacccgcccgcccccgccc

SEQ ID NO: 602365 - DNA, 20 bp, Homo sapiens
cgccaccttgtacagaacca

SEQ ID NO: 602366 - DNA, 21 bp, Homo sapiens
cgccagggctcagatggggcc

SEQ ID NO: 602367 - DNA, 17 bp, Homo sapiens
cgcccaacccccacctc

SEQ ID NO: 602368 - DNA, 12 bp, Homo sapiens
cgcccacccagc

SEQ ID NO: 602369 - DNA, 10 bp, Homo sapiens
cgcccacccc

SEQ ID NO: 602370 - DNA, 19 bp, Homo sapiens
cgcccaccccgctgcctgg

SEQ ID NO: 602371 - DNA, 20 bp, Homo sapiens
cgcccaccccgctgcctggc

SEQ ID NO: 602372 - DNA, 22 bp, Homo sapiens
cgcccacctaaagggaagccct

SEQ ID NO: 602373 - DNA, 14 bp, Homo sapiens
cgcccacctgccca

SEQ ID NO: 602374 - DNA, 16 bp, Homo sapiens
cgcccacctgcccagt

SEQ ID NO: 602375 - DNA, 14 bp, Homo sapiens
cgcccagcccccac

SEQ ID NO: 602376 - DNA, 19 bp, Homo sapiens
cgccccatgggccctcagc

SEQ ID NO: 602377 - DNA, 18 bp, Homo sapiens
cgccccccggcctggccc

SEQ ID NO: 602378 - DNA, 19 bp, Homo sapiens
cgccccccggcctggcccc

SEQ ID NO: 602379 - DNA, 13 bp, Homo sapiens
cgccccgggccgc

SEQ ID NO: 602380 - DNA, 10 bp, Homo sapiens
cgcccctccc

SEQ ID NO: 602381 - DNA, 13 bp, Homo sapiens
cgcccctccccag

SEQ ID NO: 602382 - DNA, 17 bp, Homo sapiens
cgcccctccgggcagag

SEQ ID NO: 602383 - DNA, 12 bp, Homo sapiens
cgcccctgccca

SEQ ID NO: 602384 - DNA, 17 bp, Homo sapiens
cgcccctgcctgagacc

SEQ ID NO: 602385 - DNA, 21 bp, Homo sapiens
cgcccgaggccagggccgccg

SEQ ID NO: 602386 - DNA, 22 bp, Homo sapiens
cgcccgcccaccccgctgcctg

SEQ ID NO: 602387 - DNA, 14 bp, Homo sapiens
cgcccgcccccgcc

SEQ ID NO: 602388 - DNA, 21 bp, Homo sapiens
cgcccgccctcctctgccccc

SEQ ID NO: 602389 - DNA, 21 bp, Homo sapiens
cgcccggcctcctagcctctc

SEQ ID NO: 602390 - DNA, 21 bp, Homo sapiens
cgccctccctccctccacacc

SEQ ID NO: 602391 - DNA, 13 bp, Homo sapiens
cgccctcctctgc

SEQ ID NO: 602392 - DNA, 15 bp, Homo sapiens
cgccctcctctgccc

SEQ ID NO: 602393 - DNA, 12 bp, Homo sapiens
cgccctgcccgc

SEQ ID NO: 602394 - DNA, 18 bp, Homo sapiens
cgccgaagggcagccccg

SEQ ID NO: 602395 - DNA, 16 bp, Homo sapiens
cgccgcctccctcacc

SEQ ID NO: 602396 - DNA, 15 bp, Homo sapiens
cgccgcctcgccccc

SEQ ID NO: 602397 - DNA, 16 bp, Homo sapiens
cgccgcctcgggccgc

SEQ ID NO: 602398 - DNA, 18 bp, Homo sapiens
cgccgcctcgggccgcct

SEQ ID NO: 602399 - DNA, 13 bp, Homo sapiens
cgccggttccacg

SEQ ID NO: 602400 - DNA, 19 bp, Homo sapiens
cgccggttggccggctggc

SEQ ID NO: 602401 - DNA, 12 bp, Homo sapiens
cgcctcactggg

SEQ ID NO: 602402 - DNA, 13 bp, Homo sapiens
cgcctcactgggt

SEQ ID NO: 602403 - DNA, 13 bp, Homo sapiens
cgcctcctccaga

SEQ ID NO: 602404 - DNA, 13 bp, Homo sapiens
cgcctcctcctgc

SEQ ID NO: 602405 - DNA, 22 bp, Homo sapiens
cgcctcgggccgcctcctccag

SEQ ID NO: 602406 - DNA, 12 bp, Homo sapiens
cgcctgcccgcc

SEQ ID NO: 602407 - DNA, 13 bp, Homo sapiens
cgcctgcccgccc

SEQ ID NO: 602408 - DNA, 14 bp, Homo sapiens
cgcctgcgctcctc

SEQ ID NO: 602409 - DNA, 15 bp, Homo sapiens
cgcctgcgctcctct

SEQ ID NO: 602410 - DNA, 18 bp, Homo sapiens
cgcctgcgctcctctgca

SEQ ID NO: 602411 - DNA, 19 bp, Homo sapiens
cgcctgcgctcctctgcag

SEQ ID NO: 602412 - DNA, 21 bp, Homo sapiens
cctggccaggggcttctcccc

SEQ ID NO: 602413 - DNA, 15 bp, Homo sapiens
cctggccctcttctt

SEQ ID NO: 602414 - DNA, 20 bp, Homo sapiens
cctggccggtaggctgctgg

SEQ ID NO: 602415 - DNA, 13 bp, Homo sapiens
cctggcgggcagc

SEQ ID NO: 602416 - DNA, 17 bp, Homo sapiens
cctggcgggcagcccct

SEQ ID NO: 602417 - DNA, 23 bp, Homo sapiens
cctggctgggctttggggctggt

SEQ ID NO: 602418 - DNA, 15 bp, Homo sapiens
cctggcttctgggac

SEQ ID NO: 602419 - DNA, 16 bp, Homo sapiens
cctggcttctgggaca

SEQ ID NO: 602420 - DNA, 23 bp, Homo sapiens
cctggcttctgggacaggcacca

SEQ ID NO: 602421 - DNA, 16 bp, Homo sapiens
cctggctttggcgccc

SEQ ID NO: 602422 - DNA, 19 bp, Homo sapiens
cctggctttggcgccccat

SEQ ID NO: 602423 - DNA, 23 bp, Homo sapiens
cctgggaaattgctccattcctg

SEQ ID NO: 602424 - DNA, 15 bp, Homo sapiens
cctgggacgcccctt

SEQ ID NO: 602425 - DNA, 21 bp, Homo sapiens
cctgggcaaggaagctttgga

SEQ ID NO: 602426 - DNA, 13 bp, Homo sapiens
cctgggcaccctg

SEQ ID NO: 602427 - DNA, 15 bp, Homo sapiens
cctgggcaccctgca

SEQ ID NO: 602428 - DNA, 16 bp, Homo sapiens
cctgggcaccctgcag

SEQ ID NO: 602429 - DNA, 16 bp, Homo sapiens
cctgggcagcacctcc

SEQ ID NO: 602430 - DNA, 22 bp, Homo sapiens
cctgggcagcacctccgggact

SEQ ID NO: 602431 - DNA, 16 bp, Homo sapiens
cctgggcccaggccca

SEQ ID NO: 602432 - DNA, 17 bp, Homo sapiens
cctgggcccaggcccag

SEQ ID NO: 602433 - DNA, 23 bp, Homo sapiens
cctgggcccaggcccagcctctt

SEQ ID NO: 602434 - DNA, 13 bp, Homo sapiens
cctgggcctcccg

SEQ ID NO: 602435 - DNA, 17 bp, Homo sapiens
cctggggaccaggagct

SEQ ID NO: 602436 - DNA, 17 bp, Homo sapiens
cctggggaggacccctg

SEQ ID NO: 602437 - DNA, 20 bp, Homo sapiens
cctggggaggacccctgccc

SEQ ID NO: 602438 - DNA, 22 bp, Homo sapiens
cctggggaggacccctgccctc

SEQ ID NO: 602439 - DNA, 16 bp, Homo sapiens
cctggggcatccacct

SEQ ID NO: 602440 - DNA, 20 bp, Homo sapiens
cctgggggctgttagctcag

SEQ ID NO: 602441 - DNA, 15 bp, Homo sapiens
cctggggggggcaag

SEQ ID NO: 602442 - DNA, 17 bp, Homo sapiens
cctggggtctctgagca

SEQ ID NO: 602443 - DNA, 21 bp, Homo sapiens
cctgggtaacaaagtgagacc

SEQ ID NO: 602444 - DNA, 15 bp, Homo sapiens
cctgggtccccctcc

SEQ ID NO: 602445 - DNA, 18 bp, Homo sapiens
cctgggtccccctcctgc

SEQ ID NO: 602446 - DNA, 20 bp, Homo sapiens
cctgggtccccctcctgcac

SEQ ID NO: 602447 - DNA, 17 bp, Homo sapiens
cctggtctggagcccct

SEQ ID NO: 602448 - DNA, 20 bp, Homo sapiens
cctggtctggagcccctatc

SEQ ID NO: 602449 - DNA, 13 bp, Homo sapiens
cctggtggccctg

SEQ ID NO: 602450 - DNA, 15 bp, Homo sapiens
cctggtggccctgcg

SEQ ID NO: 602451 - DNA, 17 bp, Homo sapiens
cctgtactcgcttgtgc

SEQ ID NO: 602452 - DNA, 18 bp, Homo sapiens
cctgtactcgcttgtgca

SEQ ID NO: 602453 - DNA, 16 bp, Homo sapiens
cctgtagaagatgacc

SEQ ID NO: 602454 - DNA, 21 bp, Homo sapiens
cctgtcaggaccattttagaa

SEQ ID NO: 602455 - DNA, 18 bp, Homo sapiens
cctgtccatccgtctctg

SEQ ID NO: 602456 - DNA, 22 bp, Homo sapiens
cctgtccatccgtctctgtccg

SEQ ID NO: 602457 - DNA, 12 bp, Homo sapiens
cctgtcctggct

SEQ ID NO: 602458 - DNA, 16 bp, Homo sapiens
cctgtcctggctccca

SEQ ID NO: 602459 - DNA, 14 bp, Homo sapiens
cctgtctctcccta

SEQ ID NO: 602460 - DNA, 21 bp, Homo sapiens
cctgtctctccctaccctctt

SEQ ID NO: 602461 - DNA, 18 bp, Homo sapiens
cctgtgactatggctctg

SEQ ID NO: 602462 - DNA, 15 bp, Homo sapiens
cctgtgccctctcac

SEQ ID NO: 602463 - DNA, 11 bp, Homo sapiens
cctgtgctttc

SEQ ID NO: 602464 - DNA, 12 bp, Homo sapiens
cctgtgctttca

SEQ ID NO: 602465 - DNA, 14 bp, Homo sapiens
cctgtgctttcatg

SEQ ID NO: 602466 - DNA, 14 bp, Homo sapiens
cctgtgggagtcca

SEQ ID NO: 602467 - DNA, 13 bp, Homo sapiens
cctgtgggctcac

SEQ ID NO: 602468 - DNA, 15 bp, Homo sapiens
cctgtgggctcacac

SEQ ID NO: 602469 - DNA, 18 bp, Homo sapiens
cctgtgggctcacaccgg

SEQ ID NO: 602470 - DNA, 18 bp, Homo sapiens
cctgtggtgaggtcctgt

SEQ ID NO: 602471 - DNA, 13 bp, Homo sapiens
cctgtggtttgtt

SEQ ID NO: 602472 - DNA, 16 bp, Homo sapiens
cctgtgtcatctgtca

SEQ ID NO: 602473 - DNA, 12 bp, Homo sapiens
cctgttccgcct

SEQ ID NO: 602474 - DNA, 13 bp, Homo sapiens
cctgttccgcctc

SEQ ID NO: 602475 - DNA, 16 bp, Homo sapiens
cctgtttctcctccat

SEQ ID NO: 602476 - DNA, 20 bp, Homo sapiens
ccttaaaaaatatgctctcc

SEQ ID NO: 602477 - DNA, 14 bp, Homo sapiens
ccttacaaagccag

SEQ ID NO: 602478 - DNA, 16 bp, Homo sapiens
ccttagtaaattccta

SEQ ID NO: 602479 - DNA, 14 bp, Homo sapiens
ccttatcataaatt

SEQ ID NO: 602480 - DNA, 12 bp, Homo sapiens
ccttatggaaca

SEQ ID NO: 602481 - DNA, 18 bp, Homo sapiens
ccttatggaacactctga

SEQ ID NO: 602482 - DNA, 13 bp, Homo sapiens
ccttattaaaata

SEQ ID NO: 602483 - DNA, 20 bp, Homo sapiens
ccttcaagcaccctgttccc

SEQ ID NO: 602484 - DNA, 11 bp, Homo sapiens
ccttcagtgcc

SEQ ID NO: 602485 - DNA, 12 bp, Homo sapiens
ccttcagtgcct

SEQ ID NO: 602486 - DNA, 16 bp, Homo sapiens
ccttcatcccagggta

SEQ ID NO: 602487 - DNA, 18 bp, Homo sapiens
ccttcatgcttttctcat

SEQ ID NO: 602488 - DNA, 16 bp, Homo sapiens
ccttccatcttgtggg

SEQ ID NO: 602489 - DNA, 23 bp, Homo sapiens
ccttccatcttgtggggccagga

SEQ ID NO: 602490 - DNA, 17 bp, Homo sapiens
ccttcccaacctcccct

SEQ ID NO: 602491 - DNA, 13 bp, Homo sapiens
ccttcccacccct

SEQ ID NO: 602492 - DNA, 15 bp, Homo sapiens
ccttcccacccctat

SEQ ID NO: 602493 - DNA, 22 bp, Homo sapiens
ccttcccctgcgccctccctcc

SEQ ID NO: 602494 - DNA, 15 bp, Homo sapiens
ccttcccgcagcacc

SEQ ID NO: 602495 - DNA, 19 bp, Homo sapiens
ccttcccgcagcaccagcc

SEQ ID NO: 602496 - DNA, 17 bp, Homo sapiens
ccttccctgacactgtc

SEQ ID NO: 602497 - DNA, 21 bp, Homo sapiens
ccttccgggtctcgcagcctg

SEQ ID NO: 602498 - DNA, 11 bp, Homo sapiens
ccttcctgccc

SEQ ID NO: 602499 - DNA, 16 bp, Homo sapiens
ccttcctgtcctgctc

SEQ ID NO: 602500 - DNA, 18 bp, Homo sapiens
ccttcggcagtggctggg

SEQ ID NO: 602501 - DNA, 19 bp, Homo sapiens
ccttcggcagtggctgggg

SEQ ID NO: 602502 - DNA, 22 bp, Homo sapiens
ccttctaatccatgtgctgctg

SEQ ID NO: 602503 - DNA, 16 bp, Homo sapiens
ccttctcccctccaga

SEQ ID NO: 602504 - DNA, 18 bp, Homo sapiens
ccttctcccctccagacc

SEQ ID NO: 602505 - DNA, 15 bp, Homo sapiens
ccttctgatccacag

SEQ ID NO: 602506 - DNA, 20 bp, Homo sapiens
ccttctggctgctgcagtca

SEQ ID NO: 602507 - DNA, 24 bp, Homo sapiens
ccttctggggagggacacagagga

SEQ ID NO: 602508 - DNA, 20 bp, Homo sapiens
ccttctggggaggggctccg

SEQ ID NO: 602509 - DNA, 23 bp, Homo sapiens
ccttctgtgcatctggcctgggg

SEQ ID NO: 602510 - DNA, 14 bp, Homo sapiens
ccttctttccttcc

SEQ ID NO: 602511 - DNA, 18 bp, Homo sapiens
ccttctttccttcctttt

SEQ ID NO: 602512 - DNA, 14 bp, Homo sapiens
ccttgaccccacac

SEQ ID NO: 602513 - DNA, 18 bp, Homo sapiens
ccttgagccgtgacctcc

SEQ ID NO: 602514 - DNA, 17 bp, Homo sapiens
ccttgcgaccatgtgta

SEQ ID NO: 602515 - DNA, 19 bp, Homo sapiens
ccttgctctacctggccgg

SEQ ID NO: 602516 - DNA, 13 bp, Homo sapiens
ccttgctgcagct

SEQ ID NO: 602517 - DNA, 15 bp, Homo sapiens
tctgaaattaggaaa

SEQ ID NO: 602518 - DNA, 22 bp, Homo sapiens
tctgaactatcagggcaagctc

SEQ ID NO: 602519 - DNA, 16 bp, Homo sapiens
tctgaactgcaacact

SEQ ID NO: 602520 - DNA, 20 bp, Homo sapiens
tctgaagtagtgtgagtgtt

SEQ ID NO: 602521 - DNA, 17 bp, Homo sapiens
tctgaagtcccttcctg

SEQ ID NO: 602522 - DNA, 21 bp, Homo sapiens
tctgaagtcccttcctgtcct

SEQ ID NO: 602523 - DNA, 17 bp, Homo sapiens
tctgaatctctcaaaat

SEQ ID NO: 602524 - DNA, 22 bp, Homo sapiens
tctgacagcatttcagctgtga

SEQ ID NO: 602525 - DNA, 13 bp, Homo sapiens
tctgactccagtg

SEQ ID NO: 602526 - DNA, 16 bp, Homo sapiens
tctgactgccaaataa

SEQ ID NO: 602527 - DNA, 22 bp, Homo sapiens
tctgagactcgcgacaatgcaa

SEQ ID NO: 602528 - DNA, 14 bp, Homo sapiens
tctgagcagtgggg

SEQ ID NO: 602529 - DNA, 17 bp, Homo sapiens
tctgagccctgccctca

SEQ ID NO: 602530 - DNA, 22 bp, Homo sapiens
tctgagccctgccctcactcca

SEQ ID NO: 602531 - DNA, 19 bp, Homo sapiens
tctgaggacagaggccggg

SEQ ID NO: 602532 - DNA, 16 bp, Homo sapiens
tctgaggagtccaaaa

SEQ ID NO: 602533 - DNA, 12 bp, Homo sapiens
tctgagtcctca

SEQ ID NO: 602534 - DNA, 16 bp, Homo sapiens
tctgatacatctgtca

SEQ ID NO: 602535 - DNA, 14 bp, Homo sapiens
tctgatcctctctt

SEQ ID NO: 602536 - DNA, 16 bp, Homo sapiens
tctgatgatgttctga

SEQ ID NO: 602537 - DNA, 18 bp, Homo sapiens
tctgatgatgttctgaaa

SEQ ID NO: 602538 - DNA, 15 bp, Homo sapiens
tctgcactgagcaga

SEQ ID NO: 602539 - DNA, 23 bp, Homo sapiens
tctgcagcctgagctccaccctc

SEQ ID NO: 602540 - DNA, 24 bp, Homo sapiens
tctgcagcctgagctccaccctcc

SEQ ID NO: 602541 - DNA, 15 bp, Homo sapiens
tctgcagtattctgt

SEQ ID NO: 602542 - DNA, 16 bp, Homo sapiens
tctgccccctcccccg

SEQ ID NO: 602543 - DNA, 23 bp, Homo sapiens
tctgccccctcccccgcagacag

SEQ ID NO: 602544 - DNA, 16 bp, Homo sapiens
tctgcccctccgtccc

SEQ ID NO: 602545 - DNA, 20 bp, Homo sapiens
tctgccccttgaccccacac

SEQ ID NO: 602546 - DNA, 13 bp, Homo sapiens
tctgccctgcctg

SEQ ID NO: 602547 - DNA, 14 bp, Homo sapiens
tctgccctgcctga

SEQ ID NO: 602548 - DNA, 16 bp, Homo sapiens
tctgccctgcctgagg

SEQ ID NO: 602549 - DNA, 13 bp, Homo sapiens
tctgcctggagcc

SEQ ID NO: 602550 - DNA, 16 bp, Homo sapiens
tctgcctggagcctgg

SEQ ID NO: 602551 - DNA, 18 bp, Homo sapiens
tctgcctggagcctgggc

SEQ ID NO: 602552 - DNA, 22 bp, Homo sapiens
tctgcctggagcctgggcagca

SEQ ID NO: 602553 - DNA, 17 bp, Homo sapiens
tctgcgacgatccccat

SEQ ID NO: 602554 - DNA, 16 bp, Homo sapiens
tctgctatgtctgtga

SEQ ID NO: 602555 - DNA, 17 bp, Homo sapiens
tctgctatgtctgtgat

SEQ ID NO: 602556 - DNA, 17 bp, Homo sapiens
tctgctgaattttcaca

SEQ ID NO: 602557 - DNA, 18 bp, Homo sapiens
tctgcttaggcccctcag

SEQ ID NO: 602558 - DNA, 21 bp, Homo sapiens
tctgcttaggcccctcaggac

SEQ ID NO: 602559 - DNA, 15 bp, Homo sapiens
tctgctttcatccag

SEQ ID NO: 602560 - DNA, 14 bp, Homo sapiens
tctgctttctgata

SEQ ID NO: 602561 - DNA, 17 bp, Homo sapiens
tctgctttctgatacat

SEQ ID NO: 602562 - DNA, 18 bp, Homo sapiens
tctggaaaaaaaaaaata

SEQ ID NO: 602563 - DNA, 19 bp, Homo sapiens
tctggaaaaaaaaaaatat

SEQ ID NO: 602564 - DNA, 13 bp, Homo sapiens
tctggagccccta

SEQ ID NO: 602565 - DNA, 23 bp, Homo sapiens
tctggagtctgaaggagaggagt

SEQ ID NO: 602566 - DNA, 20 bp, Homo sapiens
tctggcaccactagggtcct

SEQ ID NO: 602567 - DNA, 18 bp, Homo sapiens
tctggccctgacttctgg

SEQ ID NO: 602568 - DNA, 22 bp, Homo sapiens
tctggccttggttcctccagca

SEQ ID NO: 602569 - DNA, 21 bp, Homo sapiens
tctggcgccaggggcaggcag

SEQ ID NO: 602570 - DNA, 23 bp, Homo sapiens
tctggcgccaggggcaggcagct

SEQ ID NO: 602571 - DNA, 19 bp, Homo sapiens
tctggctgtggcccctcct

SEQ ID NO: 602572 - DNA, 22 bp, Homo sapiens
tctgggacaggcaccatgctgg

SEQ ID NO: 602573 - DNA, 21 bp, Homo sapiens
tctgggcgccggttccacgtg

SEQ ID NO: 602574 - DNA, 20 bp, Homo sapiens
tctggggagggacacagagg

SEQ ID NO: 602575 - DNA, 19 bp, Homo sapiens
tctgggggactagaacaca

SEQ ID NO: 602576 - DNA, 19 bp, Homo sapiens
tctggggtggggcttggaa

SEQ ID NO: 602577 - DNA, 18 bp, Homo sapiens
tctgggttttagaaattc

SEQ ID NO: 602578 - DNA, 23 bp, Homo sapiens
tctggtcagtgaagcccaggagg

SEQ ID NO: 602579 - DNA, 21 bp, Homo sapiens
tctggtgcgtgtggccctgtg

SEQ ID NO: 602580 - DNA, 15 bp, Homo sapiens
tctgtaaaaccaggc

SEQ ID NO: 602581 - DNA, 23 bp, Homo sapiens
tctgtaatcacactctcttctta

SEQ ID NO: 602582 - DNA, 20 bp, Homo sapiens
tctgtaattcttctcctttg

SEQ ID NO: 602583 - DNA, 23 bp, Homo sapiens
tctgtaattcttctcctttgtca

SEQ ID NO: 602584 - DNA, 18 bp, Homo sapiens
tctgtacgaggcttctct

SEQ ID NO: 602585 - DNA, 16 bp, Homo sapiens
tctgtagccaacttaa

SEQ ID NO: 602586 - DNA, 20 bp, Homo sapiens
tctgtagccaacttaaacct

SEQ ID NO: 602587 - DNA, 15 bp, Homo sapiens
tctgtcagcttccca

SEQ ID NO: 602588 - DNA, 16 bp, Homo sapiens
tctgtcagtttgtgaa

SEQ ID NO: 602589 - DNA, 17 bp, Homo sapiens
tctgtcagtttgtgaag

SEQ ID NO: 602590 - DNA, 12 bp, Homo sapiens
tctgtccactct

SEQ ID NO: 602591 - DNA, 22 bp, Homo sapiens
tggccatttgctagttctgctg

SEQ ID NO: 602592 - DNA, 12 bp, Homo sapiens
tggcccacccct

SEQ ID NO: 602593 - DNA, 17 bp, Homo sapiens
tggcccacccctcttcc

SEQ ID NO: 602594 - DNA, 20 bp, Homo sapiens
tggcccacccctcttccccc

SEQ ID NO: 602595 - DNA, 14 bp, Homo sapiens
tggccccagctggc

SEQ ID NO: 602596 - DNA, 16 bp, Homo sapiens
tggccccagctggctg

SEQ ID NO: 602597 - DNA, 19 bp, Homo sapiens
tggccccagctggctgggt

SEQ ID NO: 602598 - DNA, 14 bp, Homo sapiens
tggtatttactgca

SEQ ID NO: 602599 - DNA, 18 bp, Homo sapiens
tggtatttactgcaatgt

SEQ ID NO: 602600 - DNA, 16 bp, Homo sapiens
tggtcacaaagctatt

SEQ ID NO: 602601 - DNA, 18 bp, Homo sapiens
tggtcacaaagctattta

SEQ ID NO: 602602 - DNA, 22 bp, Homo sapiens
tggtcagtgaagcccaggagga

SEQ ID NO: 602603 - DNA, 17 bp, Homo sapiens
tggtccttagtaaattc

SEQ ID NO: 602604 - DNA, 14 bp, Homo sapiens
tggtctggagcccc

SEQ ID NO: 602605 - DNA, 15 bp, Homo sapiens
tggtctggagcccct

SEQ ID NO: 602606 - DNA, 17 bp, Homo sapiens
tggtctggagcccctat

SEQ ID NO: 602607 - DNA, 20 bp, Homo sapiens
tggtctggagcccctatcct

SEQ ID NO: 602608 - DNA, 22 bp, Homo sapiens
tggtctgtgttctcaacacaca

SEQ ID NO: 602609 - DNA, 20 bp, Homo sapiens
tggtcttaactaatgtaaat

SEQ ID NO: 602610 - DNA, 23 bp, Homo sapiens
tggtcttctcgacaggtgccctt

SEQ ID NO: 602611 - DNA, 17 bp, Homo sapiens
tggtcttggagaggagg

SEQ ID NO: 602612 - DNA, 19 bp, Homo sapiens
tggtgaggttgtgctgcct

SEQ ID NO: 602613 - DNA, 19 bp, Homo sapiens
tggtgcaatgacctttcaa

SEQ ID NO: 602614 - DNA, 17 bp, Homo sapiens
tggtgcgtgtggccctg

SEQ ID NO: 602615 - DNA, 21 bp, Homo sapiens
tggtgcgtgtggccctgtggg

SEQ ID NO: 602616 - DNA, 18 bp, Homo sapiens
tggtggtttcagaaaggg

SEQ ID NO: 602617 - DNA, 18 bp, Homo sapiens
tggtgtgaggcccccgga

SEQ ID NO: 602618 - DNA, 20 bp, Homo sapiens
tggtgtgaggcccccggagg

SEQ ID NO: 602619 - DNA, 21 bp, Homo sapiens
tggttaaccgggactacagaa

SEQ ID NO: 602620 - DNA, 18 bp, Homo sapiens
tggttaatgaaaaatctg

SEQ ID NO: 602621 - DNA, 15 bp, Homo sapiens
tggttacctattgct

SEQ ID NO: 602622 - DNA, 19 bp, Homo sapiens
tggttacctattgctgtaa

SEQ ID NO: 602623 - DNA, 14 bp, Homo sapiens
tggttagattcatt

SEQ ID NO: 602624 - DNA, 13 bp, Homo sapiens
tggttatatttca

SEQ ID NO: 602625 - DNA, 22 bp, Homo sapiens
tggttccacaatcatctattga

SEQ ID NO: 602626 - DNA, 23 bp, Homo sapiens
tggttccttctgatccacagcct

SEQ ID NO: 602627 - DNA, 17 bp, Homo sapiens
tggttcgggggaaatag

SEQ ID NO: 602628 - DNA, 14 bp, Homo sapiens
tggtttcagaaagg

SEQ ID NO: 602629 - DNA, 22 bp, Homo sapiens
tggtttcagaaagggcagcccc

SEQ ID NO: 602630 - DNA, 21 bp, Homo sapiens
tggtttccatcaaagccctcc

SEQ ID NO: 602631 - DNA, 12 bp, Homo sapiens
tgtaaaacagtg

SEQ ID NO: 602632 - DNA, 15 bp, Homo sapiens
tgtaaaaccaggctg

SEQ ID NO: 602633 - DNA, 15 bp, Homo sapiens
tgtaaaactgtgaca

SEQ ID NO: 602634 - DNA, 19 bp, Homo sapiens
tgtaaaactgtgacattcc

SEQ ID NO: 602635 - DNA, 22 bp, Homo sapiens
tgtaaaactgtgacattccaca

SEQ ID NO: 602636 - DNA, 23 bp, Homo sapiens
tgtaaaactgtgacattccacag

SEQ ID NO: 602637 - DNA, 15 bp, Homo sapiens
tgtaaaggtaggtgc

SEQ ID NO: 602638 - DNA, 22 bp, Homo sapiens
tgtaaaggtaggtgcatgcctt

SEQ ID NO: 602639 - DNA, 17 bp, Homo sapiens
tgtaaaggtgatgaatt

SEQ ID NO: 602640 - DNA, 19 bp, Homo sapiens
tgtaaataaaaatagctat

SEQ ID NO: 602641 - DNA, 14 bp, Homo sapiens
tgtaaataatgctt

SEQ ID NO: 602642 - DNA, 15 bp, Homo sapiens
tgtaaataatgctta

SEQ ID NO: 602643 - DNA, 22 bp, Homo sapiens
tgtaaatattgctgtctgaaaa

SEQ ID NO: 602644 - DNA, 16 bp, Homo sapiens
tgtaaatgatatgtct

SEQ ID NO: 602645 - DNA, 16 bp, Homo sapiens
tgtaaatgggaaaata

SEQ ID NO: 602646 - DNA, 15 bp, Homo sapiens
tgtaacagacattgt

SEQ ID NO: 602647 - DNA, 16 bp, Homo sapiens
tgtaacagacattgtt

SEQ ID NO: 602648 - DNA, 20 bp, Homo sapiens
tgtaacttcagatgtttcca

SEQ ID NO: 602649 - DNA, 23 bp, Homo sapiens
tgtaagcaacgggaacacctgct

SEQ ID NO: 602650 - DNA, 20 bp, Homo sapiens
tgtaagtactctaatataca

SEQ ID NO: 602651 - DNA, 17 bp, Homo sapiens
tgtaatataagacaagt

SEQ ID NO: 602652 - DNA, 13 bp, Homo sapiens
tgtaatatcagtt

SEQ ID NO: 602653 - DNA, 17 bp, Homo sapiens
tgtaatatcagttacag

SEQ ID NO: 602654 - DNA, 18 bp, Homo sapiens
tgtaatatcagttacagt

SEQ ID NO: 602655 - DNA, 22 bp, Homo sapiens
tgtaatatcagttacagtggca

SEQ ID NO: 602656 - DNA, 20 bp, Homo sapiens
tgtaatcacactctcttctt

SEQ ID NO: 602657 - DNA, 23 bp, Homo sapiens
tgtaatcacactctcttcttact

SEQ ID NO: 602658 - DNA, 20 bp, Homo sapiens
tgtaattagagattgacttc

SEQ ID NO: 602659 - DNA, 23 bp, Homo sapiens
tgtaattcttctcctttgtcaaa

SEQ ID NO: 602660 - DNA, 21 bp, Homo sapiens
tgtacaaaatgaattgccttt

SEQ ID NO: 602661 - DNA, 18 bp, Homo sapiens
tgtacaaataatattgcc

SEQ ID NO: 602662 - DNA, 20 bp, Homo sapiens
tgtacaaataatattgcctt

SEQ ID NO: 602663 - DNA, 13 bp, Homo sapiens
tgtacacacacag

SEQ ID NO: 602664 - DNA, 22 bp, Homo sapiens
tgtacagaaccagcactcccag

SEQ ID NO: 602665 - DNA, 21 bp, Homo sapiens
tgtacagagaactaacactat

SEQ ID NO: 602666 - DNA, 22 bp, Homo sapiens
tgtacagagaactaacactatt

SEQ ID NO: 602667 - DNA, 17 bp, Homo sapiens
tgtacaggctgagacac

SEQ ID NO: 602668 - DNA, 11 bp, Homo sapiens
tgtacagtgtt

SEQ ID NO: 602669 - DNA, 16 bp, Homo sapiens
tgtacatagtggtcat

SEQ ID NO: 602670 - DNA, 23 bp, Homo sapiens
tgtacatagtggtcatttggtgg

SEQ ID NO: 602671 - DNA, 17 bp, Homo sapiens
tgtacatttatgtgtga

SEQ ID NO: 602672 - DNA, 19 bp, Homo sapiens
tgtactggttagattcatt

SEQ ID NO: 602673 - DNA, 16 bp, Homo sapiens
tgtacttcagttctca

SEQ ID NO: 602674 - DNA, 17 bp, Homo sapiens
tgtacttcagttctcat

SEQ ID NO: 602675 - DNA, 24 bp, Homo sapiens
tgtacttcagttctcatcttgtaa

SEQ ID NO: 602676 - DNA, 14 bp, Homo sapiens
tgtacttcattcaa

SEQ ID NO: 602677 - DNA, 16 bp, Homo sapiens
tgtacttgaataataa

SEQ ID NO: 602678 - DNA, 17 bp, Homo sapiens
tgtagaagatgacctcg

SEQ ID NO: 602679 - DNA, 13 bp, Homo sapiens
tgtagatgaaaaa

SEQ ID NO: 602680 - DNA, 14 bp, Homo sapiens
tgtagctctgtcca

SEQ ID NO: 602681 - DNA, 22 bp, Homo sapiens
tgtaggaaaattttcttcttta

SEQ ID NO: 602682 - DNA, 19 bp, Homo sapiens
tgtagggaaaccttggaga

SEQ ID NO: 602683 - DNA, 21 bp, Homo sapiens
tgtagggaacggcctgagagg

SEQ ID NO: 602684 - DNA, 22 bp, Homo sapiens
tgtataagatgctgctgagcac

SEQ ID NO: 602685 - DNA, 19 bp, Homo sapiens
tgtatacaaacaggtgcta

SEQ ID NO: 602686 - DNA, 23 bp, Homo sapiens
tgtataccccgtgaagcatccag

SEQ ID NO: 602687 - DNA, 22 bp, Homo sapiens
tgtatatatttattattttcat

SEQ ID NO: 602688 - DNA, 11 bp, Homo sapiens
tgtatatcagc

SEQ ID NO: 602689 - DNA, 19 bp, Homo sapiens
tgtatatcagctctaaagc

SEQ ID NO: 602690 - DNA, 22 bp, Homo sapiens
tgtatatcagctctaaagcaga

SEQ ID NO: 602691 - DNA, 22 bp, Homo sapiens
tgtatatgaggatgtatgtgta

SEQ ID NO: 602692 - DNA, 18 bp, Homo sapiens
tgtatcacaccagttact

SEQ ID NO: 602693 - DNA, 21 bp, Homo sapiens
tgtatccaagttatttgatct

SEQ ID NO: 602694 - DNA, 19 bp, Homo sapiens
tgtatcctccattgtatct

SEQ ID NO: 602695 - DNA, 20 bp, Homo sapiens
tgtatgtccattcactttca

SEQ ID NO: 602696 - DNA, 14 bp, Homo sapiens
tgtatgtgtatatg

SEQ ID NO: 602697 - DNA, 18 bp, Homo sapiens
tgtattatcttaaaccca

SEQ ID NO: 602698 - DNA, 22 bp, Homo sapiens
tgtatttacttgttatgttgta

SEQ ID NO: 602699 - DNA, 15 bp, Homo sapiens
tgtatttgaggaaac

SEQ ID NO: 602700 - DNA, 18 bp, Homo sapiens
tgtattttaataaagatt

SEQ ID NO: 602701 - DNA, 21 bp, Homo sapiens
tgtattttattgtaacagaca

SEQ ID NO: 602702 - DNA, 14 bp, Homo sapiens
tgtattttctgtgt

SEQ ID NO: 602703 - DNA, 22 bp, Homo sapiens
tgtcaaatggtattttttgtga

SEQ ID NO: 602704 - DNA, 20 bp, Homo sapiens
tgtcaatttttaacttatct

SEQ ID NO: 602705 - DNA, 20 bp, Homo sapiens
tgtcacactgagctgggcac

SEQ ID NO: 602706 - DNA, 23 bp, Homo sapiens
tgtcacgtggtcaaggcccggcc

SEQ ID NO: 602707 - DNA, 13 bp, Homo sapiens
tgtcactcacaaa

SEQ ID NO: 602708 - DNA, 14 bp, Homo sapiens
tgtcagaatgttgt

SEQ ID NO: 602709 - DNA, 12 bp, Homo sapiens
tgtcaggaatgg

SEQ ID NO: 602710 - DNA, 19 bp, Homo sapiens
tgtcaggctctgaatctct

SEQ ID NO: 602711 - DNA, 15 bp, Homo sapiens
tgtcagtttgtgaag

SEQ ID NO: 602712 - DNA, 15 bp, Homo sapiens
tgtcatcaagtagta

SEQ ID NO: 602713 - DNA, 15 bp, Homo sapiens
tgaaattatatctgt

SEQ ID NO: 602714 - DNA, 18 bp, Homo sapiens
tgaaattatgtcaaatgg

SEQ ID NO: 602715 - DNA, 20 bp, Homo sapiens
tgaaattatgtcaaatggat

SEQ ID NO: 602716 - DNA, 22 bp, Homo sapiens
tgaaattatgtcaaatggatgt

SEQ ID NO: 602717 - DNA, 13 bp, Homo sapiens
tgaaatttaagca

SEQ ID NO: 602718 - DNA, 21 bp, Homo sapiens
tgaactatcagggcaagctca

SEQ ID NO: 602719 - DNA, 15 bp, Homo sapiens
tgaactctttcccca

SEQ ID NO: 602720 - DNA, 14 bp, Homo sapiens
tgaactgaagcaga

SEQ ID NO: 602721 - DNA, 17 bp, Homo sapiens
tgaactgaagcagagtc

SEQ ID NO: 602722 - DNA, 16 bp, Homo sapiens
tgaagaaacacagcat

SEQ ID NO: 602723 - DNA, 20 bp, Homo sapiens
tgaagaaacacagcatgcat

SEQ ID NO: 602724 - DNA, 16 bp, Homo sapiens
tgaagaccctatctcc

SEQ ID NO: 602725 - DNA, 21 bp, Homo sapiens
tgaagagagatatatctgaaa

SEQ ID NO: 602726 - DNA, 22 bp, Homo sapiens
tgaagcaaacacacagactctg

SEQ ID NO: 602727 - DNA, 13 bp, Homo sapiens
tgaagcagaatga

SEQ ID NO: 602728 - DNA, 13 bp, Homo sapiens
tgaagcccaggag

SEQ ID NO: 602729 - DNA, 21 bp, Homo sapiens
tgaaggcaaaaactgtactgt

SEQ ID NO: 602730 - DNA, 22 bp, Homo sapiens
tgaaggcaaaaactgtactgtg

SEQ ID NO: 602731 - DNA, 17 bp, Homo sapiens
tgaagggaaatcaattt

SEQ ID NO: 602732 - DNA, 18 bp, Homo sapiens
tgaaggggaaaacctcag

SEQ ID NO: 602733 - DNA, 12 bp, Homo sapiens
tgaaggggccag

SEQ ID NO: 602734 - DNA, 17 bp, Homo sapiens
tgaagtaagttcatcaa

SEQ ID NO: 602735 - DNA, 23 bp, Homo sapiens
tgaagtaagttcatcaaacatgt

SEQ ID NO: 602736 - DNA, 14 bp, Homo sapiens
tgaagtcccttcct

SEQ ID NO: 602737 - DNA, 13 bp, Homo sapiens
tgaagtgcatgtt

SEQ ID NO: 602738 - DNA, 16 bp, Homo sapiens
tgaagtgcatgttaaa

SEQ ID NO: 602739 - DNA, 15 bp, Homo sapiens
tgaagttaagcacaa

SEQ ID NO: 602740 - DNA, 17 bp, Homo sapiens
tgaagttgtacaacacc

SEQ ID NO: 602741 - DNA, 16 bp, Homo sapiens
tgaataaaataaagct

SEQ ID NO: 602742 - DNA, 12 bp, Homo sapiens
tgaataaatatt

SEQ ID NO: 602743 - DNA, 15 bp, Homo sapiens
tgaataacaacaatt

SEQ ID NO: 602744 - DNA, 18 bp, Homo sapiens
tgaatccatcgatttgta

SEQ ID NO: 602745 - DNA, 18 bp, Homo sapiens
tgcactcttttgagcagt

SEQ ID NO: 602746 - DNA, 15 bp, Homo sapiens
tgcactgagcagagt

SEQ ID NO: 602747 - DNA, 20 bp, Homo sapiens
tgcactgcagttatttacca

SEQ ID NO: 602748 - DNA, 22 bp, Homo sapiens
tgcactgtcccggagctcaggc

SEQ ID NO: 602749 - DNA, 14 bp, Homo sapiens
tgcacttcggataa

SEQ ID NO: 602750 - DNA, 20 bp, Homo sapiens
tgcagaaatgagtgataaat

SEQ ID NO: 602751 - DNA, 18 bp, Homo sapiens
tgcagactgtggctgcag

SEQ ID NO: 602752 - DNA, 13 bp, Homo sapiens
tgcagagaccttg

SEQ ID NO: 602753 - DNA, 18 bp, Homo sapiens
tgcagagtatacaagtgt

SEQ ID NO: 602754 - DNA, 14 bp, Homo sapiens
tgcagcaaccagag

SEQ ID NO: 602755 - DNA, 17 bp, Homo sapiens
tgcagcaaccagagcac

SEQ ID NO: 602756 - DNA, 20 bp, Homo sapiens
tgcagcaaccagagcactgt

SEQ ID NO: 602757 - DNA, 21 bp, Homo sapiens
tgcagcagtaccatcccactg

SEQ ID NO: 602758 - DNA, 23 bp, Homo sapiens
tgcagccctctccaccctccggc

SEQ ID NO: 602759 - DNA, 13 bp, Homo sapiens
tgcagcctgagct

SEQ ID NO: 602760 - DNA, 15 bp, Homo sapiens
tgcagcgaggtccac

SEQ ID NO: 602761 - DNA, 16 bp, Homo sapiens
tgcagctaatttgtga

SEQ ID NO: 602762 - DNA, 21 bp, Homo sapiens
tgcagctaatttgtgaaagtg

SEQ ID NO: 602763 - DNA, 17 bp, Homo sapiens
tgcaggaaaaggctgca

SEQ ID NO: 602764 - DNA, 15 bp, Homo sapiens
tgcaggaacatgacc

SEQ ID NO: 602765 - DNA, 14 bp, Homo sapiens
tgcaggcaggcaga

SEQ ID NO: 602766 - DNA, 20 bp, Homo sapiens
tgcaggcaggtgggggctgc

SEQ ID NO: 602767 - DNA, 16 bp, Homo sapiens
tgcaggcccagcagac

SEQ ID NO: 602768 - DNA, 15 bp, Homo sapiens
tgcagggacagcctg

SEQ ID NO: 602769 - DNA, 20 bp, Homo sapiens
tgcagggacagcctgcacag

SEQ ID NO: 602770 - DNA, 23 bp, Homo sapiens
tgcagtatccgcgagcctgcttg

SEQ ID NO: 602771 - DNA, 22 bp, Homo sapiens
tgcagtcacgtgaggcccctgt

SEQ ID NO: 602772 - DNA, 15 bp, Homo sapiens
tgcagtcatcagaag

SEQ ID NO: 602773 - DNA, 16 bp, Homo sapiens
tgcagtcatcagaagt

SEQ ID NO: 602774 - DNA, 18 bp, Homo sapiens
tgcagttagcacagagga

SEQ ID NO: 602775 - DNA, 21 bp, Homo sapiens
tgcagttatttaccagaagtt

SEQ ID NO: 602776 - DNA, 19 bp, Homo sapiens
tgcagtttggccctggagc

SEQ ID NO: 602777 - DNA, 22 bp, Homo sapiens
tgcagtttggccctggagccag

SEQ ID NO: 602778 - DNA, 20 bp, Homo sapiens
tgcagtttggtatgaaacaa

SEQ ID NO: 602779 - DNA, 20 bp, Homo sapiens
tgcataatatgcatatatat

SEQ ID NO: 602780 - DNA, 22 bp, Homo sapiens
tgcataatatgcatatatatgt

SEQ ID NO: 602781 - DNA, 14 bp, Homo sapiens
tgcatatatatgta

SEQ ID NO: 602782 - DNA, 22 bp, Homo sapiens
tgcatatggcaacgttcatgtt

SEQ ID NO: 602783 - DNA, 18 bp, Homo sapiens
tgcatcaagtctccacgt

SEQ ID NO: 602784 - DNA, 18 bp, Homo sapiens
tgcatcccttggcccctc

SEQ ID NO: 602785 - DNA, 13 bp, Homo sapiens
tgcatctggcctg

SEQ ID NO: 602786 - DNA, 14 bp, Homo sapiens
tgcatctggcctgg

SEQ ID NO: 602787 - DNA, 22 bp, Homo sapiens
tgcatgagaactaaatagattt

SEQ ID NO: 602788 - DNA, 14 bp, Homo sapiens
tgcatgcagggccc

SEQ ID NO: 602789 - DNA, 15 bp, Homo sapiens
tgcatgtcggggccc

SEQ ID NO: 602790 - DNA, 16 bp, Homo sapiens
tgcatgtcggggcccc

SEQ ID NO: 602791 - DNA, 17 bp, Homo sapiens
tgcatgttaaaataatt

SEQ ID NO: 602792 - DNA, 15 bp, Homo sapiens
tgcatgtttaataat

SEQ ID NO: 602793 - DNA, 20 bp, Homo sapiens
tgcatgtttaataatatgta

SEQ ID NO: 602794 - DNA, 21 bp, Homo sapiens
tgcatgtttaataatatgtac

SEQ ID NO: 602795 - DNA, 17 bp, Homo sapiens
tgcattcagatctgaag

SEQ ID NO: 602796 - DNA, 18 bp, Homo sapiens
tgcattcagatctgaagt

SEQ ID NO: 602797 - DNA, 21 bp, Homo sapiens
tgcatttagcatgagttctgc

SEQ ID NO: 602798 - DNA, 13 bp, Homo sapiens
tgccaacattgcc

SEQ ID NO: 602799 - DNA, 22 bp, Homo sapiens
tgccaacattgcctatttcagt

SEQ ID NO: 602800 - DNA, 19 bp, Homo sapiens
tgccaatgaactctttccc

SEQ ID NO: 602801 - DNA, 22 bp, Homo sapiens
tgccaatgaactctttccccag

SEQ ID NO: 602802 - DNA, 15 bp, Homo sapiens
tgccagacagagatc

SEQ ID NO: 602803 - DNA, 16 bp, Homo sapiens
tgccagacagagatca

SEQ ID NO: 602804 - DNA, 17 bp, Homo sapiens
tgccagacgtgctcctg

SEQ ID NO: 602805 - DNA, 16 bp, Homo sapiens
tgccaggcagctgcag

SEQ ID NO: 602806 - DNA, 18 bp, Homo sapiens
tgccaggctagactagga

SEQ ID NO: 602807 - DNA, 23 bp, Homo sapiens
tgccagtgtttagaagagcctga

SEQ ID NO: 602808 - DNA, 15 bp, Homo sapiens
tgccatctccaccct

SEQ ID NO: 602809 - DNA, 12 bp, Homo sapiens
tgccattcccac

SEQ ID NO: 602810 - DNA, 23 bp, Homo sapiens
tgccatttcctcctgggcaacag

SEQ ID NO: 602811 - DNA, 14 bp, Homo sapiens
tgccattttgtctg

SEQ ID NO: 602812 - DNA, 22 bp, Homo sapiens
tgccattttgtctggctgtggc

SEQ ID NO: 602813 - DNA, 17 bp, Homo sapiens
tgccattttttgtctgt

SEQ ID NO: 602814 - DNA, 18 bp, Homo sapiens
tgcccaaatataacatga

SEQ ID NO: 602815 - DNA, 16 bp, Homo sapiens
tgcccacatttgggct

SEQ ID NO: 602816 - DNA, 20 bp, Homo sapiens
tgcccacatttgggctcagg

SEQ ID NO: 602817 - DNA, 22 bp, Homo sapiens
tgcccacatttgggctcagggt

SEQ ID NO: 602818 - DNA, 22 bp, Homo sapiens
tgcccacccgtgttctcctcca

SEQ ID NO: 602819 - DNA, 14 bp, Homo sapiens
tgcccaccctgggc

SEQ ID NO: 602820 - DNA, 15 bp, Homo sapiens
tgcccaccctgggcc

SEQ ID NO: 602821 - DNA, 17 bp, Homo sapiens
tgcccaccctgggcctc

SEQ ID NO: 602822 - DNA, 19 bp, Homo sapiens
tgcccaccctgggcctccc

SEQ ID NO: 602823 - DNA, 17 bp, Homo sapiens
tgcccacgcccctcccc

SEQ ID NO: 602824 - DNA, 18 bp, Homo sapiens
tgcccacgcccctcccca

SEQ ID NO: 602825 - DNA, 19 bp, Homo sapiens
tgcccacgcccctccccag

SEQ ID NO: 602826 - DNA, 19 bp, Homo sapiens
tgcccacgtgcagcacctg

SEQ ID NO: 602827 - DNA, 21 bp, Homo sapiens
tgcccagcacctcctccgtgg

SEQ ID NO: 602828 - DNA, 23 bp, Homo sapiens
tgcccagttagcccggccaagga

SEQ ID NO: 602829 - DNA, 20 bp, Homo sapiens
tgcccatttcacacaactgt

SEQ ID NO: 602830 - DNA, 16 bp, Homo sapiens
tgccccagctctggat

SEQ ID NO: 602831 - DNA, 23 bp, Homo sapiens
tgccccagctctggatgaaggca

SEQ ID NO: 602832 - DNA, 15 bp, Homo sapiens
tgccccagtggtgcg

SEQ ID NO: 602833 - DNA, 17 bp, Homo sapiens
tgccccatctcctccca

SEQ ID NO: 602834 - DNA, 19 bp, Homo sapiens
tgccccccatgccctccct

SEQ ID NO: 602835 - DNA, 15 bp, Homo sapiens
tgcccccccacccca

SEQ ID NO: 602836 - DNA, 18 bp, Homo sapiens
tgccccccttcccacccc

SEQ ID NO: 602837 - DNA, 15 bp, Homo sapiens
tgccccctcccccgc

SEQ ID NO: 602838 - DNA, 16 bp, Homo sapiens
ttggggtagagaggac

SEQ ID NO: 602839 - DNA, 19 bp, Homo sapiens
ttgggtaagggactccaga

SEQ ID NO: 602840 - DNA, 19 bp, Homo sapiens
ttggtaacttgctgtgaaa

SEQ ID NO: 602841 - DNA, 19 bp, Homo sapiens
ttggtaatgatgattcaat

SEQ ID NO: 602842 - DNA, 18 bp, Homo sapiens
ttggtctgtgttctcaac

SEQ ID NO: 602843 - DNA, 17 bp, Homo sapiens
ttggtgtcgggcatgac

SEQ ID NO: 602844 - DNA, 18 bp, Homo sapiens
ttggtgtcgggcatgaca

SEQ ID NO: 602845 - DNA, 15 bp, Homo sapiens
ttggttacaaatttt

SEQ ID NO: 602846 - DNA, 13 bp, Homo sapiens
ttgtaaaacagtg

SEQ ID NO: 602847 - DNA, 19 bp, Homo sapiens
ttgtaaaactgtgacattc

SEQ ID NO: 602848 - DNA, 22 bp, Homo sapiens
ttgtaaagatattgtatctcct

SEQ ID NO: 602849 - DNA, 23 bp, Homo sapiens
ttgtaaagatattgtatctcctt

SEQ ID NO: 602850 - DNA, 17 bp, Homo sapiens
ttgtaaaggtgatgaat

SEQ ID NO: 602851 - DNA, 14 bp, Homo sapiens
ttgtaacagacatt

SEQ ID NO: 602852 - DNA, 15 bp, Homo sapiens
ttgtaatataagaca

SEQ ID NO: 602853 - DNA, 16 bp, Homo sapiens
ttgtaatataagacaa

SEQ ID NO: 602854 - DNA, 13 bp, Homo sapiens
ttgtacttacact

SEQ ID NO: 602855 - DNA, 19 bp, Homo sapiens
ttgtacttacactgaaatc

SEQ ID NO: 602856 - DNA, 12 bp, Homo sapiens
ttgtagatgaaa

SEQ ID NO: 602857 - DNA, 19 bp, Homo sapiens
ttgtagatgaaaaagcatg

SEQ ID NO: 602858 - DNA, 16 bp, Homo sapiens
ttgtagctagtttaaa

SEQ ID NO: 602859 - DNA, 15 bp, Homo sapiens
ttgtagggtgaggcg

SEQ ID NO: 602860 - DNA, 18 bp, Homo sapiens
ttgtataagatgctgctg

SEQ ID NO: 602861 - DNA, 16 bp, Homo sapiens
ttgtatatatatgtga

SEQ ID NO: 602862 - DNA, 18 bp, Homo sapiens
ttgtatatatatgtgaac

SEQ ID NO: 602863 - DNA, 11 bp, Homo sapiens
ttgtattttaa

SEQ ID NO: 602864 - DNA, 17 bp, Homo sapiens
ttgtattttaataaaga

SEQ ID NO: 602865 - DNA, 13 bp, Homo sapiens
ttgtcatgtggct

SEQ ID NO: 602866 - DNA, 13 bp, Homo sapiens
ttgtctgaaacat

SEQ ID NO: 602867 - DNA, 20 bp, Homo sapiens
ttgtctggctgtggcccctc

SEQ ID NO: 602868 - DNA, 22 bp, Homo sapiens
ttgtctggctgtggcccctcct

SEQ ID NO: 602869 - DNA, 16 bp, Homo sapiens
ttgtctgtgataacag

SEQ ID NO: 602870 - DNA, 19 bp, Homo sapiens
ttgtgaaagtggcaagctc

SEQ ID NO: 602871 - DNA, 13 bp, Homo sapiens
ttgtgaagtgatt

SEQ ID NO: 602872 - DNA, 17 bp, Homo sapiens
ttgtgaagtgattgaca

SEQ ID NO: 602873 - DNA, 19 bp, Homo sapiens
ttgtgaagtgattgacatt

SEQ ID NO: 602874 - DNA, 18 bp, Homo sapiens
ttgtgatctgttgtaata

SEQ ID NO: 602875 - DNA, 19 bp, Homo sapiens
ttgtgattctttgatatgt

SEQ ID NO: 602876 - DNA, 15 bp, Homo sapiens
ttgtgcagaaaacat

SEQ ID NO: 602877 - DNA, 14 bp, Homo sapiens
ttgtgccaaagata

SEQ ID NO: 602878 - DNA, 19 bp, Homo sapiens
ttgtgccaaagatagcaga

SEQ ID NO: 602879 - DNA, 18 bp, Homo sapiens
ttgtgtctggagcctgca

SEQ ID NO: 602880 - DNA, 21 bp, Homo sapiens
ttgtgtgggtttactctgtgc

SEQ ID NO: 602881 - DNA, 22 bp, Homo sapiens
ttgttatcagtacaattctttg

SEQ ID NO: 602882 - DNA, 21 bp, Homo sapiens
ttgttcaaagaacccccctcc

SEQ ID NO: 602883 - DNA, 23 bp, Homo sapiens
ttgttcagatctcatagatgacc

SEQ ID NO: 602884 - DNA, 13 bp, Homo sapiens
ttgttccagattc

SEQ ID NO: 602885 - DNA, 23 bp, Homo sapiens
ttgttcgatcgtttcacatctgt

SEQ ID NO: 602886 - DNA, 12 bp, Homo sapiens
ttgttctgtgca

SEQ ID NO: 602887 - DNA, 19 bp, Homo sapiens
ttgtttgttaataaagtgc

SEQ ID NO: 602888 - DNA, 18 bp, Homo sapiens
ttgttttgccaacattgc

SEQ ID NO: 602889 - DNA, 18 bp, Homo sapiens
ttgttttgctttttctga

SEQ ID NO: 602890 - DNA, 13 bp, Homo sapiens
ttgttttgtggat

SEQ ID NO: 602891 - DNA, 20 bp, Homo sapiens
tttaaaaatcagaaagacat

SEQ ID NO: 602892 - DNA, 14 bp, Homo sapiens
tttaaaatggcatt

SEQ ID NO: 602893 - DNA, 19 bp, Homo sapiens
tttaaaatggcatttagca

SEQ ID NO: 602894 - DNA, 21 bp, Homo sapiens
tttaaaatggcatttagcaca

SEQ ID NO: 602895 - DNA, 13 bp, Homo sapiens
tttaaaattatta

SEQ ID NO: 602896 - DNA, 13 bp, Homo sapiens
tttaaacaaatgg

SEQ ID NO: 602897 - DNA, 18 bp, Homo sapiens
tttaaacttcttaactgg

SEQ ID NO: 602898 - DNA, 20 bp, Homo sapiens
tttaaatctttgttaaaata

SEQ ID NO: 602899 - DNA, 16 bp, Homo sapiens
tttaaatgtctaatgt

SEQ ID NO: 602900 - DNA, 17 bp, Homo sapiens
tttaaattatttatatt

SEQ ID NO: 602901 - DNA, 15 bp, Homo sapiens
tttaaattgtggatg

SEQ ID NO: 602902 - DNA, 11 bp, Homo sapiens
tttaacagaaa

SEQ ID NO: 602903 - DNA, 18 bp, Homo sapiens
tttaacatagcagctggt

SEQ ID NO: 602904 - DNA, 18 bp, Homo sapiens
tttaacatatcattcaga

SEQ ID NO: 602905 - DNA, 17 bp, Homo sapiens
tttaagcacaaaaaatt

SEQ ID NO: 602906 - DNA, 21 bp, Homo sapiens
tttaagcacaaaaaatttaag

SEQ ID NO: 602907 - DNA, 16 bp, Homo sapiens
tttaagtggactgtat

SEQ ID NO: 602908 - DNA, 19 bp, Homo sapiens
ttcattacatcctctgctt

SEQ ID NO: 602909 - DNA, 12 bp, Homo sapiens
ttcattccgtta

SEQ ID NO: 602910 - DNA, 21 bp, Homo sapiens
ttcattcgtgggcctgctgct

SEQ ID NO: 602911 - DNA, 23 bp, Homo sapiens
ttcattctggtccttagtaaatt

SEQ ID NO: 602912 - DNA, 19 bp, Homo sapiens
ttcattgacaccaaatatt

SEQ ID NO: 602913 - DNA, 16 bp, Homo sapiens
ttcattgtctcagtga

SEQ ID NO: 602914 - DNA, 20 bp, Homo sapiens
ttcatttacaacttccagat

SEQ ID NO: 602915 - DNA, 12 bp, Homo sapiens
ttcattttctct

SEQ ID NO: 602916 - DNA, 17 bp, Homo sapiens
ttcattttctctcctcg

SEQ ID NO: 602917 - DNA, 18 bp, Homo sapiens
ttccaaatacattccagt

SEQ ID NO: 602918 - DNA, 16 bp, Homo sapiens
ttccaacacacaatta

SEQ ID NO: 602919 - DNA, 16 bp, Homo sapiens
ttccaagtgtatattt

SEQ ID NO: 602920 - DNA, 16 bp, Homo sapiens
ttccaagtgtgtgtgc

SEQ ID NO: 602921 - DNA, 11 bp, Homo sapiens
ttccagaattg

SEQ ID NO: 602922 - DNA, 15 bp, Homo sapiens
ttccagaattgagag

SEQ ID NO: 602923 - DNA, 20 bp, Homo sapiens
ttccagacagggtggggctt

SEQ ID NO: 602924 - DNA, 12 bp, Homo sapiens
ttccagcaaaat

SEQ ID NO: 602925 - DNA, 19 bp, Homo sapiens
ttccagctaagcctgatga

SEQ ID NO: 602926 - DNA, 13 bp, Homo sapiens
ttccagtgcatgt

SEQ ID NO: 602927 - DNA, 15 bp, Homo sapiens
ttccagtgtattttc

SEQ ID NO: 602928 - DNA, 22 bp, Homo sapiens
ttccatacgtgcccatttcaca

SEQ ID NO: 602929 - DNA, 16 bp, Homo sapiens
ttccatgacagtagca

SEQ ID NO: 602930 - DNA, 19 bp, Homo sapiens
ttccatgcactcttcatgt

SEQ ID NO: 602931 - DNA, 17 bp, Homo sapiens
ttccatgggttgaacaa

SEQ ID NO: 602932 - DNA, 21 bp, Homo sapiens
ttccatgggttgaacaagcca

SEQ ID NO: 602933 - DNA, 20 bp, Homo sapiens
ttccatttggattttaaaca

SEQ ID NO: 602934 - DNA, 15 bp, Homo sapiens
ttcccaacctcccct

SEQ ID NO: 602935 - DNA, 21 bp, Homo sapiens
ttcccaacctcccctggtcct

SEQ ID NO: 602936 - DNA, 20 bp, Homo sapiens
ttcccactaagctttctcct

SEQ ID NO: 602937 - DNA, 21 bp, Homo sapiens
ttcccactaagctttctcctt

SEQ ID NO: 602938 - DNA, 21 bp, Homo sapiens
ttcccagcaaagttttcagat

SEQ ID NO: 602939 - DNA, 21 bp, Homo sapiens
ttccccataatacccttttcc

SEQ ID NO: 602940 - DNA, 23 bp, Homo sapiens
ttccccatcgccttctggctgct

SEQ ID NO: 602941 - DNA, 16 bp, Homo sapiens
ttccccattgccttct

SEQ ID NO: 602942 - DNA, 12 bp, Homo sapiens
ttcccccttccc

SEQ ID NO: 602943 - DNA, 15 bp, Homo sapiens
ttcccccttcccctg

SEQ ID NO: 602944 - DNA, 17 bp, Homo sapiens
ttcccccttcccctgcg

SEQ ID NO: 602945 - DNA, 16 bp, Homo sapiens
ttcccctgcgccctcc

SEQ ID NO: 602946 - DNA, 17 bp, Homo sapiens
ttcccctgcgccctccc

SEQ ID NO: 602947 - DNA, 20 bp, Homo sapiens
ttcccctgcgccctccctcc

SEQ ID NO: 602948 - DNA, 15 bp, Homo sapiens
ttcccgcagcaccag

SEQ ID NO: 602949 - DNA, 22 bp, Homo sapiens
ttcccgcagcaccagcctgagc

SEQ ID NO: 602950 - DNA, 18 bp, Homo sapiens
ttccctcagccctcatta

SEQ ID NO: 602951 - DNA, 21 bp, Homo sapiens
ttccctgacactgtctgctgc

SEQ ID NO: 602952 - DNA, 22 bp, Homo sapiens
ttccctgacactgtctgctgcc

SEQ ID NO: 602953 - DNA, 11 bp, Homo sapiens
ttccctgagga

SEQ ID NO: 602954 - DNA, 11 bp, Homo sapiens
ttccctgctga

SEQ ID NO: 602955 - DNA, 13 bp, Homo sapiens
ttccctttcccca

SEQ ID NO: 602956 - DNA, 14 bp, Homo sapiens
ttccctttccccat

SEQ ID NO: 602957 - DNA, 14 bp, Homo sapiens
ttccgcctcactgg

SEQ ID NO: 602958 - DNA, 20 bp, Homo sapiens
ttccgggtctcgcagcctga

SEQ ID NO: 602959 - DNA, 16 bp, Homo sapiens
ttccgttcatctgagg

SEQ ID NO: 602960 - DNA, 17 bp, Homo sapiens
ttcctacggtacaagct

SEQ ID NO: 602961 - DNA, 14 bp, Homo sapiens
ttcctacttaaaca

SEQ ID NO: 602962 - DNA, 22 bp, Homo sapiens
ttcctacttaaacaaaaacttt

SEQ ID NO: 602963 - DNA, 16 bp, Homo sapiens
ttcctcccccagagcc

SEQ ID NO: 602964 - DNA, 13 bp, Homo sapiens
ttcctgaccctca

SEQ ID NO: 602965 - DNA, 11 bp, Homo sapiens
ttcctgcccag

SEQ ID NO: 602966 - DNA, 22 bp, Homo sapiens
ttcctgctcctccagtacaata

SEQ ID NO: 602967 - DNA, 11 bp, Homo sapiens
ttcctgtcaat

SEQ ID NO: 602968 - DNA, 13 bp, Homo sapiens
ttcctgtcctgct

SEQ ID NO: 602969 - DNA, 16 bp, Homo sapiens
ttccttcagtgcctta

SEQ ID NO: 602970 - DNA, 15 bp, Homo sapiens
ttccttgcctgtcag

SEQ ID NO: 602971 - DNA, 14 bp, Homo sapiens
ttcctttcttcctt

SEQ ID NO: 602972 - DNA, 16 bp, Homo sapiens
ttcctttcttccttcc

SEQ ID NO: 602973 - DNA, 22 bp, Homo sapiens
ttcgataaaggatatagcaaca

SEQ ID NO: 602974 - DNA, 17 bp, Homo sapiens
ttcgcattaagcacaca

SEQ ID NO: 602975 - DNA, 18 bp, Homo sapiens
ttcggatcgctccgccgt

SEQ ID NO: 602976 - DNA, 16 bp, Homo sapiens
ttcggcagtggctggg

SEQ ID NO: 602977 - DNA, 17 bp, Homo sapiens
ttcggcagtggctgggg

SEQ ID NO: 602978 - DNA, 18 bp, Homo sapiens
ttcggctatgtctcatgt

SEQ ID NO: 602979 - DNA, 14 bp, Homo sapiens
ttcgtaagttctgt

SEQ ID NO: 602980 - DNA, 16 bp, Homo sapiens
ttcgtaagttctgtgc

SEQ ID NO: 602981 - DNA, 15 bp, Homo sapiens
ttcgtgggcctgctg

SEQ ID NO: 602982 - DNA, 18 bp, Homo sapiens
ttctaaaactaaatagca

SEQ ID NO: 602983 - DNA, 18 bp, Homo sapiens
ttctaaatcataatcatc

SEQ ID NO: 602984 - DNA, 14 bp, Homo sapiens
ttctaatccatgtg

SEQ ID NO: 602985 - DNA, 20 bp, Homo sapiens
ttctatatgtaacttcagat

SEQ ID NO: 602986 - DNA, 16 bp, Homo sapiens
ttctatatttactgtt

SEQ ID NO: 602987 - DNA, 13 bp, Homo sapiens
ttctattatctgg

SEQ ID NO: 602988 - DNA, 19 bp, Homo sapiens
ttctattggcatggatttc

SEQ ID NO: 602989 - DNA, 19 bp, Homo sapiens
ttctcaaatgctactcagt

SEQ ID NO: 602990 - DNA, 20 bp, Homo sapiens
ttctcaaatgctactcagta

SEQ ID NO: 602991 - DNA, 21 bp, Homo sapiens
tgccctcttaagatctgactg

SEQ ID NO: 602992 - DNA, 14 bp, Homo sapiens
tgccctgcaccttg

SEQ ID NO: 602993 - DNA, 20 bp, Homo sapiens
tgccgcatctgcctggagcc

SEQ ID NO: 602994 - DNA, 23 bp, Homo sapiens
tgccgcttaaacatttccctgct

SEQ ID NO: 602995 - DNA, 17 bp, Homo sapiens
tgccggtggggccagcg

SEQ ID NO: 602996 - DNA, 17 bp, Homo sapiens
tgccgtctttggttcct

SEQ ID NO: 602997 - DNA, 17 bp, Homo sapiens
tgcctaactccttacag

SEQ ID NO: 602998 - DNA, 13 bp, Homo sapiens
tgcctacattagt

SEQ ID NO: 602999 - DNA, 20 bp, Homo sapiens
tgcctacattagtgagattt

SEQ ID NO: 603000 - DNA, 15 bp, Homo sapiens
tgcctcactgtgacc

SEQ ID NO: 603001 - DNA, 19 bp, Homo sapiens
tgcctcactgtgacctgct

SEQ ID NO: 603002 - DNA, 16 bp, Homo sapiens
tgcctccccattcctt

SEQ ID NO: 603003 - DNA, 19 bp, Homo sapiens
tgcctctatccctggccac

SEQ ID NO: 603004 - DNA, 16 bp, Homo sapiens
tgcctgactcctgggt

SEQ ID NO: 603005 - DNA, 13 bp, Homo sapiens
tgcctgaggagga

SEQ ID NO: 603006 - DNA, 23 bp, Homo sapiens
tgcctgaggaggaggacacagca

SEQ ID NO: 603007 - DNA, 13 bp, Homo sapiens
tgcctgctgttcg

SEQ ID NO: 603008 - DNA, 21 bp, Homo sapiens
tgcctggaggagaaggaggaa

SEQ ID NO: 603009 - DNA, 13 bp, Homo sapiens
tgcctggcgggca

SEQ ID NO: 603010 - DNA, 14 bp, Homo sapiens
tgcctggcgggcag

SEQ ID NO: 603011 - DNA, 15 bp, Homo sapiens
tgcctggcgggcagc

SEQ ID NO: 603012 - DNA, 16 bp, Homo sapiens
tgcctggcgggcagcc

SEQ ID NO: 603013 - DNA, 18 bp, Homo sapiens
tgcctggcgggcagcccc

SEQ ID NO: 603014 - DNA, 19 bp, Homo sapiens
tgcctggcgggcagcccct

SEQ ID NO: 603015 - DNA, 11 bp, Homo sapiens
tgcctggctgg

SEQ ID NO: 603016 - DNA, 13 bp, Homo sapiens
tgcctggctgggc

SEQ ID NO: 603017 - DNA, 14 bp, Homo sapiens
tgcctggctgggct

SEQ ID NO: 603018 - DNA, 21 bp, Homo sapiens
tgcctgtggtgaggtcctgtc

SEQ ID NO: 603019 - DNA, 22 bp, Homo sapiens
tgcctgtggtgaggtcctgtcc

SEQ ID NO: 603020 - DNA, 15 bp, Homo sapiens
tgccttatggaacac

SEQ ID NO: 603021 - DNA, 22 bp, Homo sapiens
tgccttatggaacactctgaga

SEQ ID NO: 603022 - DNA, 21 bp, Homo sapiens
tgccttcataaattatttcta

SEQ ID NO: 603023 - DNA, 12 bp, Homo sapiens
tgccttctgggg

SEQ ID NO: 603024 - DNA, 18 bp, Homo sapiens
tgcctttatttctgtatc

SEQ ID NO: 603025 - DNA, 20 bp, Homo sapiens
tgcctttccagtgctgctcc

SEQ ID NO: 603026 - DNA, 23 bp, Homo sapiens
tgcgacggaggcaggaccaggca

SEQ ID NO: 603027 - DNA, 21 bp, Homo sapiens
tgcgcaccccgttcccagcgc

SEQ ID NO: 603028 - DNA, 20 bp, Homo sapiens
tgcgcagccgcgctctgccc

SEQ ID NO: 603029 - DNA, 11 bp, Homo sapiens
tgcgcccctgc

SEQ ID NO: 603030 - DNA, 21 bp, Homo sapiens
tgcgcccctgcccagcacctc

SEQ ID NO: 603031 - DNA, 17 bp, Homo sapiens
tgcgccctccctccctc

SEQ ID NO: 603032 - DNA, 16 bp, Homo sapiens
tgcgcctcctcctgca

SEQ ID NO: 603033 - DNA, 17 bp, Homo sapiens
tgcgcctcctcctgcat

SEQ ID NO: 603034 - DNA, 12 bp, Homo sapiens
tgcgcctgcccg

SEQ ID NO: 603035 - DNA, 17 bp, Homo sapiens
tgcgcctgcccgcccgc

SEQ ID NO: 603036 - DNA, 17 bp, Homo sapiens
tgcgcctgcgcctcctc

SEQ ID NO: 603037 - DNA, 18 bp, Homo sapiens
tgcgcctgcgcctcctcc

SEQ ID NO: 603038 - DNA, 19 bp, Homo sapiens
tgcgcctgcgcctcctcct

SEQ ID NO: 603039 - DNA, 12 bp, Homo sapiens
tgcgctagagca

SEQ ID NO: 603040 - DNA, 21 bp, Homo sapiens
tgcgctagagcattctggggt

SEQ ID NO: 603041 - DNA, 22 bp, Homo sapiens
tgcgctagagcattctggggtg

SEQ ID NO: 603042 - DNA, 17 bp, Homo sapiens
tgcgctcctctgcagcc

SEQ ID NO: 603043 - DNA, 22 bp, Homo sapiens
tgcggaccggagcggctgagga

SEQ ID NO: 603044 - DNA, 13 bp, Homo sapiens
tgcggcaccgccc

SEQ ID NO: 603045 - DNA, 16 bp, Homo sapiens
tgcggcaccgcccacc

SEQ ID NO: 603046 - DNA, 18 bp, Homo sapiens
tgcggcaccgcccaccca

SEQ ID NO: 603047 - DNA, 13 bp, Homo sapiens
tgcggtgtgtctc

SEQ ID NO: 603048 - DNA, 15 bp, Homo sapiens
tgcgtccctgctcag

SEQ ID NO: 603049 - DNA, 19 bp, Homo sapiens
tgcgtccctgctcagccca

SEQ ID NO: 603050 - DNA, 12 bp, Homo sapiens
tgcgtggctccc

SEQ ID NO: 603051 - DNA, 17 bp, Homo sapiens
tgcgtgtggccctgtgg

SEQ ID NO: 603052 - DNA, 16 bp, Homo sapiens
tgctagacagaaacca

SEQ ID NO: 603053 - DNA, 21 bp, Homo sapiens
tgctagacagaaaccaagcca

SEQ ID NO: 603054 - DNA, 13 bp, Homo sapiens
tgctatgtctgtg

SEQ ID NO: 603055 - DNA, 14 bp, Homo sapiens
tgctatgtctgtga

SEQ ID NO: 603056 - DNA, 15 bp, Homo sapiens
tgctatgtctgtgat

SEQ ID NO: 603057 - DNA, 17 bp, Homo sapiens
tgctatgtctgtgatgt

SEQ ID NO: 603058 - DNA, 19 bp, Homo sapiens
tgctattcgtaagttctgt

SEQ ID NO: 603059 - DNA, 20 bp, Homo sapiens
tgctattcgtaagttctgtg

SEQ ID NO: 603060 - DNA, 13 bp, Homo sapiens
tgctattgtttat

SEQ ID NO: 603061 - DNA, 22 bp, Homo sapiens
tgctattgtttataggaaataa

SEQ ID NO: 603062 - DNA, 12 bp, Homo sapiens
tgctcaatgtgc

SEQ ID NO: 603063 - DNA, 13 bp, Homo sapiens
tgctcaatgtgct

SEQ ID NO: 603064 - DNA, 19 bp, Homo sapiens
tgctcaatgtgctgttgat

SEQ ID NO: 603065 - DNA, 17 bp, Homo sapiens
tgctcacgtctgtgagt

SEQ ID NO: 603066 - DNA, 24 bp, Homo sapiens
tgctcagcccatcccctgcctcta

SEQ ID NO: 603067 - DNA, 21 bp, Homo sapiens
tgctcatctacacatataaac

SEQ ID NO: 603068 - DNA, 13 bp, Homo sapiens
tgctcctctgccc

SEQ ID NO: 603069 - DNA, 17 bp, Homo sapiens
tgctcctgcccacgtgc

SEQ ID NO: 603070 - DNA, 15 bp, Homo sapiens
tgctcgccctgtgcc

SEQ ID NO: 603071 - DNA, 19 bp, Homo sapiens
tgctcgggaaggcctgagg

SEQ ID NO: 603072 - DNA, 14 bp, Homo sapiens
tgctctacatctcg

SEQ ID NO: 603073 - DNA, 16 bp, Homo sapiens
tgctctacctggccgg

SEQ ID NO: 603074 - DNA, 18 bp, Homo sapiens
tgctctatgcctcagttt

SEQ ID NO: 603075 - DNA, 16 bp, Homo sapiens
tgctctccattctttt

SEQ ID NO: 603076 - DNA, 15 bp, Homo sapiens
tgctctctcattccc

SEQ ID NO: 603077 - DNA, 20 bp, Homo sapiens
tgctctctcattcccaggca

SEQ ID NO: 603078 - DNA, 18 bp, Homo sapiens
tgctgaataacaacaatt

SEQ ID NO: 603079 - DNA, 16 bp, Homo sapiens
tgctgaattttcacat

SEQ ID NO: 603080 - DNA, 19 bp, Homo sapiens
tgctgagatgtttagtagc

SEQ ID NO: 603081 - DNA, 20 bp, Homo sapiens
tgctgagatgtttagtagct

SEQ ID NO: 603082 - DNA, 21 bp, Homo sapiens
tgctgagatgtttagtagctg

SEQ ID NO: 603083 - DNA, 15 bp, Homo sapiens
tgctgatggtgcaat

SEQ ID NO: 603084 - DNA, 17 bp, Homo sapiens
tgctgatggtgcaatga

SEQ ID NO: 603085 - DNA, 20 bp, Homo sapiens
tgctgcagtcagcacagaga

SEQ ID NO: 603086 - DNA, 14 bp, Homo sapiens
tgctgccccctggc

SEQ ID NO: 603087 - DNA, 14 bp, Homo sapiens
tgctgccctcttaa

SEQ ID NO: 603088 - DNA, 13 bp, Homo sapiens
tgctgcctcagga

SEQ ID NO: 603089 - DNA, 24 bp, Homo sapiens
tgctgctccctttatcatgtgttt

SEQ ID NO: 603090 - DNA, 16 bp, Homo sapiens
tgctgctcgggaaggc

SEQ ID NO: 603091 - DNA, 12 bp, Homo sapiens
ggctctttccct

SEQ ID NO: 603092 - DNA, 19 bp, Homo sapiens
ggctgaaataaaagcctct

SEQ ID NO: 603093 - DNA, 20 bp, Homo sapiens
ggctgaaataaaagcctctg

SEQ ID NO: 603094 - DNA, 13 bp, Homo sapiens
ggctgaaattatg

SEQ ID NO: 603095 - DNA, 18 bp, Homo sapiens
ggctgaagaaacacagca

SEQ ID NO: 603096 - DNA, 19 bp, Homo sapiens
ggctgaagaaacacagcat

SEQ ID NO: 603097 - DNA, 20 bp, Homo sapiens
ggctgagacacagcccagag

SEQ ID NO: 603098 - DNA, 11 bp, Homo sapiens
ggctgagcccc

SEQ ID NO: 603099 - DNA, 14 bp, Homo sapiens
ggctgagcccctcc

SEQ ID NO: 603100 - DNA, 15 bp, Homo sapiens
ggctgagcccctcct

SEQ ID NO: 603101 - DNA, 17 bp, Homo sapiens
ggctgaggacggggcag

SEQ ID NO: 603102 - DNA, 21 bp, Homo sapiens
ggctgaggacggggcagagct

SEQ ID NO: 603103 - DNA, 22 bp, Homo sapiens
ggctgccaagagtccaagccat

SEQ ID NO: 603104 - DNA, 17 bp, Homo sapiens
ggctgccccaggggcac

SEQ ID NO: 603105 - DNA, 15 bp, Homo sapiens
ggctgcctcagccag

SEQ ID NO: 603106 - DNA, 18 bp, Homo sapiens
ggctgcctcagccagtgg

SEQ ID NO: 603107 - DNA, 19 bp, Homo sapiens
ggctgcgcctgcccgcccg

SEQ ID NO: 603108 - DNA, 17 bp, Homo sapiens
ggctgctgcagtcagca

SEQ ID NO: 603109 - DNA, 20 bp, Homo sapiens
ggctgctgcttctccctggg

SEQ ID NO: 603110 - DNA, 23 bp, Homo sapiens
ggctgctgtgtagctctgtccac

SEQ ID NO: 603111 - DNA, 11 bp, Homo sapiens
ggctgcttcaa

SEQ ID NO: 603112 - DNA, 21 bp, Homo sapiens
ggctgcttcaaggatcctgag

SEQ ID NO: 603113 - DNA, 23 bp, Homo sapiens
ggctgcttcaaggatcctgagcc

SEQ ID NO: 603114 - DNA, 12 bp, Homo sapiens
ggctggagcccc

SEQ ID NO: 603115 - DNA, 14 bp, Homo sapiens
ggctggagccccat

SEQ ID NO: 603116 - DNA, 22 bp, Homo sapiens
ggctggagccccatcgcctggg

SEQ ID NO: 603117 - DNA, 19 bp, Homo sapiens
ggctggataggagaggaaa

SEQ ID NO: 603118 - DNA, 18 bp, Homo sapiens
ggctggccggtccacccc

SEQ ID NO: 603119 - DNA, 21 bp, Homo sapiens
ggctgggaaagaacttggact

SEQ ID NO: 603120 - DNA, 21 bp, Homo sapiens
ggctgggaacatgacccagcc

SEQ ID NO: 603121 - DNA, 17 bp, Homo sapiens
ggctggggccggggctg

SEQ ID NO: 603122 - DNA, 14 bp, Homo sapiens
ggctgggtcgcccc

SEQ ID NO: 603123 - DNA, 16 bp, Homo sapiens
ggctgggtcgcccctc

SEQ ID NO: 603124 - DNA, 22 bp, Homo sapiens
ggctggtgggataggagggtgc

SEQ ID NO: 603125 - DNA, 13 bp, Homo sapiens
ggctgtggcccct

SEQ ID NO: 603126 - DNA, 17 bp, Homo sapiens
ggctgtggcccctcctt

SEQ ID NO: 603127 - DNA, 18 bp, Homo sapiens
ggctgttgtgtctggagc

SEQ ID NO: 603128 - DNA, 21 bp, Homo sapiens
ggctgttgtgtctggagcctg

SEQ ID NO: 603129 - DNA, 13 bp, Homo sapiens
ggcttaaacattt

SEQ ID NO: 603130 - DNA, 20 bp, Homo sapiens
ggcttagcgttctgtttcac

SEQ ID NO: 603131 - DNA, 16 bp, Homo sapiens
ggcttgtagggtgagg

SEQ ID NO: 603132 - DNA, 16 bp, Homo sapiens
gggaaaacctcagttg

SEQ ID NO: 603133 - DNA, 19 bp, Homo sapiens
gggaaaccttggagaggag

SEQ ID NO: 603134 - DNA, 18 bp, Homo sapiens
gggaaatgctgatttaaa

SEQ ID NO: 603135 - DNA, 14 bp, Homo sapiens
gggaaattcttgca

SEQ ID NO: 603136 - DNA, 15 bp, Homo sapiens
gggaacacagtgccc

SEQ ID NO: 603137 - DNA, 17 bp, Homo sapiens
gggaacatgacccagcc

SEQ ID NO: 603138 - DNA, 19 bp, Homo sapiens
gggaagcccacccgcccca

SEQ ID NO: 603139 - DNA, 23 bp, Homo sapiens
gggaagcccacccgccccagaga

SEQ ID NO: 603140 - DNA, 19 bp, Homo sapiens
gggaaggcctgagggaagc

SEQ ID NO: 603141 - DNA, 14 bp, Homo sapiens
gggaagggtgcctg

SEQ ID NO: 603142 - DNA, 15 bp, Homo sapiens
gggaagggtgcctgg

SEQ ID NO: 603143 - DNA, 19 bp, Homo sapiens
gggaagggtgcctggctgg

SEQ ID NO: 603144 - DNA, 20 bp, Homo sapiens
gggaagggtgcctggctggg

SEQ ID NO: 603145 - DNA, 21 bp, Homo sapiens
gggaagggtgcctggctgggc

SEQ ID NO: 603146 - DNA, 21 bp, Homo sapiens
gggaaggttagaaaggcagcc

SEQ ID NO: 603147 - DNA, 15 bp, Homo sapiens
gggacaccctcctgc

SEQ ID NO: 603148 - DNA, 16 bp, Homo sapiens
gggacaccctcctgcc

SEQ ID NO: 603149 - DNA, 12 bp, Homo sapiens
gggacagcggcc

SEQ ID NO: 603150 - DNA, 15 bp, Homo sapiens
gggacagcggcccgg

SEQ ID NO: 603151 - DNA, 18 bp, Homo sapiens
gggacagcggcccggccc

SEQ ID NO: 603152 - DNA, 20 bp, Homo sapiens
gggacctactcctccccctc

SEQ ID NO: 603153 - DNA, 16 bp, Homo sapiens
gggacgagcagagcgc

SEQ ID NO: 603154 - DNA, 22 bp, Homo sapiens
gggacgagcagagcgcagcccc

SEQ ID NO: 603155 - DNA, 13 bp, Homo sapiens
gggacgcccagcc

SEQ ID NO: 603156 - DNA, 17 bp, Homo sapiens
gggacgcccagccccca

SEQ ID NO: 603157 - DNA, 16 bp, Homo sapiens
gggactccagaagcag

SEQ ID NO: 603158 - DNA, 20 bp, Homo sapiens
gggactgctttcagtgcctg

SEQ ID NO: 603159 - DNA, 22 bp, Homo sapiens
gggactgtcttcaaccctgccc

SEQ ID NO: 603160 - DNA, 15 bp, Homo sapiens
gggactgtgcctttg

SEQ ID NO: 603161 - DNA, 13 bp, Homo sapiens
gggagagcgccac

SEQ ID NO: 603162 - DNA, 22 bp, Homo sapiens
gggagagcgccacccgcccgcc

SEQ ID NO: 603163 - DNA, 23 bp, Homo sapiens
gggagagcgccacccgcccgccc

SEQ ID NO: 603164 - DNA, 22 bp, Homo sapiens
gggaggcggcacattggcagtg

SEQ ID NO: 603165 - DNA, 16 bp, Homo sapiens
gggagggacacagagg

SEQ ID NO: 603166 - DNA, 15 bp, Homo sapiens
gggagggtgggcgtg

SEQ ID NO: 603167 - DNA, 20 bp, Homo sapiens
gggagtccactttcctctct

SEQ ID NO: 603168 - DNA, 16 bp, Homo sapiens
gggatccagagagaag

SEQ ID NO: 603169 - DNA, 15 bp, Homo sapiens
gggatgcccctggcc

SEQ ID NO: 603170 - DNA, 17 bp, Homo sapiens
gggatgcccctggccct

SEQ ID NO: 603171 - DNA, 19 bp, Homo sapiens
gggatgcccctggccctgc

SEQ ID NO: 603172 - DNA, 19 bp, Homo sapiens
gggcaagagctcaggagaa

SEQ ID NO: 603173 - DNA, 19 bp, Homo sapiens
gggcaccctgcaggcaggc

SEQ ID NO: 603174 - DNA, 18 bp, Homo sapiens
gggcacgggagagcgcca

SEQ ID NO: 603175 - DNA, 23 bp, Homo sapiens
gggcagagaccaccgcgcccctc

SEQ ID NO: 603176 - DNA, 15 bp, Homo sapiens
gggcagagctgagtc

SEQ ID NO: 603177 - DNA, 21 bp, Homo sapiens
gggcagagctgagtcggctgg

SEQ ID NO: 603178 - DNA, 17 bp, Homo sapiens
gggcagcacctccggga

SEQ ID NO: 603179 - DNA, 20 bp, Homo sapiens
gggcagcacctccgggactg

SEQ ID NO: 603180 - DNA, 19 bp, Homo sapiens
gggcagccccgcgaccacc

SEQ ID NO: 603181 - DNA, 20 bp, Homo sapiens
gggcagccccgcgaccaccc

SEQ ID NO: 603182 - DNA, 22 bp, Homo sapiens
gggcagccccgcgaccacccct

SEQ ID NO: 603183 - DNA, 12 bp, Homo sapiens
gggcagcccctc

SEQ ID NO: 603184 - DNA, 14 bp, Homo sapiens
gggcagcccctccc

SEQ ID NO: 603185 - DNA, 16 bp, Homo sapiens
gggcagcccctgctgg

SEQ ID NO: 603186 - DNA, 18 bp, Homo sapiens
gggcagggcccagggagg

SEQ ID NO: 603187 - DNA, 14 bp, Homo sapiens
gggcagggccgcag

SEQ ID NO: 603188 - DNA, 15 bp, Homo sapiens
gggcagggccgcagg

SEQ ID NO: 603189 - DNA, 18 bp, Homo sapiens
gggcagggccgcagggcg

SEQ ID NO: 603190 - DNA, 17 bp, Homo sapiens
gggcagggttctagaag

SEQ ID NO: 603191 - DNA, 16 bp, Homo sapiens
gggcagtggagagggg

SEQ ID NO: 603192 - DNA, 17 bp, Homo sapiens
gggcagtggagagggga

SEQ ID NO: 603193 - DNA, 15 bp, Homo sapiens
gggcagtggggagca

SEQ ID NO: 603194 - DNA, 22 bp, Homo sapiens
gggcatccaccttcctgcccag

SEQ ID NO: 603195 - DNA, 12 bp, Homo sapiens
gggccaccctga

SEQ ID NO: 603196 - DNA, 12 bp, Homo sapiens
gggccagggtgg

SEQ ID NO: 603197 - DNA, 13 bp, Homo sapiens
gggccaggtctgg

SEQ ID NO: 603198 - DNA, 19 bp, Homo sapiens
gggcccatggccccagctg

SEQ ID NO: 603199 - DNA, 15 bp, Homo sapiens
gggcccccacaggag

SEQ ID NO: 603200 - DNA, 13 bp, Homo sapiens
gggccccctctct

SEQ ID NO: 603201 - DNA, 13 bp, Homo sapiens
gggcccctgcgtg

SEQ ID NO: 603202 - DNA, 16 bp, Homo sapiens
gggcccgcactcagga

SEQ ID NO: 603203 - DNA, 20 bp, Homo sapiens
gggcccgcactcaggagcac

SEQ ID NO: 603204 - DNA, 22 bp, Homo sapiens
gggccctggggtctctgagcag

SEQ ID NO: 603205 - DNA, 23 bp, Homo sapiens
gggccctggggtctctgagcagt

SEQ ID NO: 603206 - DNA, 23 bp, Homo sapiens
gggccgccgaagggcagccccgc

SEQ ID NO: 603207 - DNA, 18 bp, Homo sapiens
gggccgcctcctccagac

SEQ ID NO: 603208 - DNA, 17 bp, Homo sapiens
gggcctccatgccccag

SEQ ID NO: 603209 - DNA, 18 bp, Homo sapiens
ggcatgacacgaatattg

SEQ ID NO: 603210 - DNA, 21 bp, Homo sapiens
ggcattactggccttttcact

SEQ ID NO: 603211 - DNA, 22 bp, Homo sapiens
ggcatttagcacagtatttaac

SEQ ID NO: 603212 - DNA, 21 bp, Homo sapiens
ggcatttgctgaataacaaca

SEQ ID NO: 603213 - DNA, 12 bp, Homo sapiens
ggccaaggacac

SEQ ID NO: 603214 - DNA, 11 bp, Homo sapiens
ggccaccctga

SEQ ID NO: 603215 - DNA, 16 bp, Homo sapiens
ggccaccctgagcaga

SEQ ID NO: 603216 - DNA, 12 bp, Homo sapiens
ggccacctgcca

SEQ ID NO: 603217 - DNA, 20 bp, Homo sapiens
ggccacctgccaggcctccc

SEQ ID NO: 603218 - DNA, 13 bp, Homo sapiens
ggccagcccttgc

SEQ ID NO: 603219 - DNA, 23 bp, Homo sapiens
ggccagcccttgctctacctggc

SEQ ID NO: 603220 - DNA, 16 bp, Homo sapiens
ggccagggcgtggctt

SEQ ID NO: 603221 - DNA, 21 bp, Homo sapiens
ggccaggggcttctccccctc

SEQ ID NO: 603222 - DNA, 20 bp, Homo sapiens
ggccaggtctggcgccaggg

SEQ ID NO: 603223 - DNA, 14 bp, Homo sapiens
ggccagtactttgc

SEQ ID NO: 603224 - DNA, 13 bp, Homo sapiens
ggccatttcacat

SEQ ID NO: 603225 - DNA, 22 bp, Homo sapiens
ggccatttgctagttctgctgc

SEQ ID NO: 603226 - DNA, 23 bp, Homo sapiens
ggccatttgctagttctgctgcc

SEQ ID NO: 603227 - DNA, 21 bp, Homo sapiens
ggcccaaataacagtggcaag

SEQ ID NO: 603228 - DNA, 23 bp, Homo sapiens
ggcccacccctcttcccccttcc

SEQ ID NO: 603229 - DNA, 16 bp, Homo sapiens
ggcccacgcagagccc

SEQ ID NO: 603230 - DNA, 14 bp, Homo sapiens
ggcccagccctggg

SEQ ID NO: 603231 - DNA, 21 bp, Homo sapiens
ggcccagggaggtggcaggga

SEQ ID NO: 603232 - DNA, 17 bp, Homo sapiens
ggcccatggccccagct

SEQ ID NO: 603233 - DNA, 18 bp, Homo sapiens
ggcccatggccccagctg

SEQ ID NO: 603234 - DNA, 19 bp, Homo sapiens
ggcccatggccccagctgg

SEQ ID NO: 603235 - DNA, 21 bp, Homo sapiens
ggcccatggccccagctggct

SEQ ID NO: 603236 - DNA, 13 bp, Homo sapiens
ggccccagctggc

SEQ ID NO: 603237 - DNA, 19 bp, Homo sapiens
ggccccagctggctgggtc

SEQ ID NO: 603238 - DNA, 16 bp, Homo sapiens
ggccccatcagaggct

SEQ ID NO: 603239 - DNA, 20 bp, Homo sapiens
ggcccccaaattgccttcag

SEQ ID NO: 603240 - DNA, 21 bp, Homo sapiens
ggcccccaaattgccttcagc

SEQ ID NO: 603241 - DNA, 14 bp, Homo sapiens
ggcccccctctcgg

SEQ ID NO: 603242 - DNA, 18 bp, Homo sapiens
ggccccctcgcgcccctg

SEQ ID NO: 603243 - DNA, 21 bp, Homo sapiens
ggccccctcgcgcccctgtcc

SEQ ID NO: 603244 - DNA, 22 bp, Homo sapiens
ggccccgcgcgtgcccccagcg

SEQ ID NO: 603245 - DNA, 14 bp, Homo sapiens
ggccccgcggagcc

SEQ ID NO: 603246 - DNA, 16 bp, Homo sapiens
ggccccgcggagcccc

SEQ ID NO: 603247 - DNA, 23 bp, Homo sapiens
ggcccctccttctcccctccaga

SEQ ID NO: 603248 - DNA, 19 bp, Homo sapiens
ggcccctgtgcagtagaga

SEQ ID NO: 603249 - DNA, 21 bp, Homo sapiens
ggcccgagcgcgtgccttccc

SEQ ID NO: 603250 - DNA, 19 bp, Homo sapiens
ggagcagagacggcagccc

SEQ ID NO: 603251 - DNA, 21 bp, Homo sapiens
ggagcagagacggcagcccca

SEQ ID NO: 603252 - DNA, 14 bp, Homo sapiens
ggagccccatcgcc

SEQ ID NO: 603253 - DNA, 16 bp, Homo sapiens
ggagccccatcgcctg

SEQ ID NO: 603254 - DNA, 17 bp, Homo sapiens
ggagcccccgcccctcc

SEQ ID NO: 603255 - DNA, 18 bp, Homo sapiens
ggagcccccgcccctccc

SEQ ID NO: 603256 - DNA, 20 bp, Homo sapiens
ggagcccccgcccctccccc

SEQ ID NO: 603257 - DNA, 17 bp, Homo sapiens
ggagccgcagaggcccg

SEQ ID NO: 603258 - DNA, 18 bp, Homo sapiens
ggagccgcagaggcccga

SEQ ID NO: 603259 - DNA, 12 bp, Homo sapiens
ggagcctgggca

SEQ ID NO: 603260 - DNA, 13 bp, Homo sapiens
ggagcctgggcag

SEQ ID NO: 603261 - DNA, 19 bp, Homo sapiens
ggagccttgctgggccagg

SEQ ID NO: 603262 - DNA, 13 bp, Homo sapiens
ggagcggctgagg

SEQ ID NO: 603263 - DNA, 23 bp, Homo sapiens
ggagcggctgaggacggggcaga

SEQ ID NO: 603264 - DNA, 20 bp, Homo sapiens
ggagcgggggctaactggcc

SEQ ID NO: 603265 - DNA, 13 bp, Homo sapiens
ggagcgtgtccta

SEQ ID NO: 603266 - DNA, 18 bp, Homo sapiens
ggagctactgacattcct

SEQ ID NO: 603267 - DNA, 15 bp, Homo sapiens
ggagctagcccagtc

SEQ ID NO: 603268 - DNA, 17 bp, Homo sapiens
ggagctagcccagtccc

SEQ ID NO: 603269 - DNA, 14 bp, Homo sapiens
ggagcttccagatg

SEQ ID NO: 603270 - DNA, 13 bp, Homo sapiens
ggagcttccagtg

SEQ ID NO: 603271 - DNA, 16 bp, Homo sapiens
ggagcttccagtgcat

SEQ ID NO: 603272 - DNA, 18 bp, Homo sapiens
ggagcttccagtgcatgt

SEQ ID NO: 603273 - DNA, 23 bp, Homo sapiens
ggagcttggagccccctggcggc

SEQ ID NO: 603274 - DNA, 18 bp, Homo sapiens
ggaggacagagtgccctg

SEQ ID NO: 603275 - DNA, 22 bp, Homo sapiens
ggaggacagagtgccctggggc

SEQ ID NO: 603276 - DNA, 14 bp, Homo sapiens
ggaggacccctgcc

SEQ ID NO: 603277 - DNA, 16 bp, Homo sapiens
ggaggacccctgccct

SEQ ID NO: 603278 - DNA, 13 bp, Homo sapiens
ggaggactgttct

SEQ ID NO: 603279 - DNA, 11 bp, Homo sapiens
ggaggagcacc

SEQ ID NO: 603280 - DNA, 20 bp, Homo sapiens
ggaggagcacccccagcctc

SEQ ID NO: 603281 - DNA, 11 bp, Homo sapiens
ggaggagcctt

SEQ ID NO: 603282 - DNA, 23 bp, Homo sapiens
ggaggagccttgctgggccaggg

SEQ ID NO: 603283 - DNA, 16 bp, Homo sapiens
ggaggaggacacagca

SEQ ID NO: 603284 - DNA, 16 bp, Homo sapiens
ggaggaggaggagcct

SEQ ID NO: 603285 - DNA, 20 bp, Homo sapiens
ggaggccgactgggctgctg

SEQ ID NO: 603286 - DNA, 15 bp, Homo sapiens
ggaggcctggtctgg

SEQ ID NO: 603287 - DNA, 20 bp, Homo sapiens
ggaggctgagatgggaggat

SEQ ID NO: 603288 - DNA, 20 bp, Homo sapiens
ggaggggcttggagcagaga

SEQ ID NO: 603289 - DNA, 14 bp, Homo sapiens
ggagggggctggga

SEQ ID NO: 603290 - DNA, 17 bp, Homo sapiens
ggagggggctgggaaag

SEQ ID NO: 603291 - DNA, 23 bp, Homo sapiens
ggaggggtcagcaggggggttgg

SEQ ID NO: 603292 - DNA, 18 bp, Homo sapiens
ggagggtctccctgggca

SEQ ID NO: 603293 - DNA, 18 bp, Homo sapiens
ggaggtccctgccagtgt

SEQ ID NO: 603294 - DNA, 13 bp, Homo sapiens
ggaggtggcaggg

SEQ ID NO: 603295 - DNA, 22 bp, Homo sapiens
ggaggtgtggagtggaggggtc

SEQ ID NO: 603296 - DNA, 15 bp, Homo sapiens
ggagtagagtcagga

SEQ ID NO: 603297 - DNA, 15 bp, Homo sapiens
ggagtccactttcct

SEQ ID NO: 603298 - DNA, 23 bp, Homo sapiens
gctcgtgtttcacagtgggcggc

SEQ ID NO: 603299 - DNA, 14 bp, Homo sapiens
gctctaaagcagag

SEQ ID NO: 603300 - DNA, 14 bp, Homo sapiens
gctctacctggccg

SEQ ID NO: 603301 - DNA, 19 bp, Homo sapiens
gctctccctcccttctttc

SEQ ID NO: 603302 - DNA, 14 bp, Homo sapiens
gctctgaatctctc

SEQ ID NO: 603303 - DNA, 21 bp, Homo sapiens
gctctgaatctctcaaaatgt

SEQ ID NO: 603304 - DNA, 22 bp, Homo sapiens
gctctgaatctctcaaaatgtg

SEQ ID NO: 603305 - DNA, 19 bp, Homo sapiens
gctctgaggctgccccagg

SEQ ID NO: 603306 - DNA, 16 bp, Homo sapiens
gctctgcccctccgtc

SEQ ID NO: 603307 - DNA, 18 bp, Homo sapiens
gctctgcccctccgtccc

SEQ ID NO: 603308 - DNA, 23 bp, Homo sapiens
gctctgcccctccgtccccaggg

SEQ ID NO: 603309 - DNA, 19 bp, Homo sapiens
gctcttcattgcactgcag

SEQ ID NO: 603310 - DNA, 19 bp, Homo sapiens
gctcttcccaagtcctcgc

SEQ ID NO: 603311 - DNA, 21 bp, Homo sapiens
gctcttcccaagtcctcgccc

SEQ ID NO: 603312 - DNA, 11 bp, Homo sapiens
gctctttccct

SEQ ID NO: 603313 - DNA, 20 bp, Homo sapiens
gctgaaataaaagcctctgg

SEQ ID NO: 603314 - DNA, 18 bp, Homo sapiens
gctgaaattatgtcaaat

SEQ ID NO: 603315 - DNA, 18 bp, Homo sapiens
gctgaagaaacacagcat

SEQ ID NO: 603316 - DNA, 15 bp, Homo sapiens
gctgaataacaacaa

SEQ ID NO: 603317 - DNA, 12 bp, Homo sapiens
gctgaattttca

SEQ ID NO: 603318 - DNA, 22 bp, Homo sapiens
gctgagaatccccgtgctcaca

SEQ ID NO: 603319 - DNA, 21 bp, Homo sapiens
gctgagcccctcctctcctcg

SEQ ID NO: 603320 - DNA, 21 bp, Homo sapiens
gctgaggacggggcagagctg

SEQ ID NO: 603321 - DNA, 22 bp, Homo sapiens
gctgagggcagggttctagaag

SEQ ID NO: 603322 - DNA, 18 bp, Homo sapiens
gctgagtcggctgggcag

SEQ ID NO: 603323 - DNA, 21 bp, Homo sapiens
gctgatggtgcaatgaccttt

SEQ ID NO: 603324 - DNA, 18 bp, Homo sapiens
gctgatttactaacagta

SEQ ID NO: 603325 - DNA, 16 bp, Homo sapiens
gctgcactgccctccg

SEQ ID NO: 603326 - DNA, 20 bp, Homo sapiens
gctgcagctaatttgtgaaa

SEQ ID NO: 603327 - DNA, 22 bp, Homo sapiens
gctgcaggaatcaaaaattgaa

SEQ ID NO: 603328 - DNA, 15 bp, Homo sapiens
gctgccaggctccca

SEQ ID NO: 603329 - DNA, 20 bp, Homo sapiens
gctgccatccttgctgcagc

SEQ ID NO: 603330 - DNA, 14 bp, Homo sapiens
gctgccccctggct

SEQ ID NO: 603331 - DNA, 16 bp, Homo sapiens
gctgccgcatctgcct

SEQ ID NO: 603332 - DNA, 18 bp, Homo sapiens
gctgccgcatctgcctgg

SEQ ID NO: 603333 - DNA, 19 bp, Homo sapiens
gctgccgcatctgcctgga

SEQ ID NO: 603334 - DNA, 23 bp, Homo sapiens
gctgccgcatctgcctggagcct

SEQ ID NO: 603335 - DNA, 12 bp, Homo sapiens
gctgcctcagcc

SEQ ID NO: 603336 - DNA, 22 bp, Homo sapiens
gctgcctcagccagtggcacag

SEQ ID NO: 603337 - DNA, 24 bp, Homo sapiens
gctgcctcagccagtggcacagga

SEQ ID NO: 603338 - DNA, 12 bp, Homo sapiens
gctgcctggagg

SEQ ID NO: 603339 - DNA, 22 bp, Homo sapiens
gctgcctggcgggcagcccctg

SEQ ID NO: 603340 - DNA, 23 bp, Homo sapiens
gctgcctggcgggcagcccctgc

SEQ ID NO: 603341 - DNA, 20 bp, Homo sapiens
gctgcctgtggtgaggtcct

SEQ ID NO: 603342 - DNA, 22 bp, Homo sapiens
gctgcgcctgcccgcccgccgg

SEQ ID NO: 603343 - DNA, 20 bp, Homo sapiens
gctgcgctcccacctcggac

SEQ ID NO: 603344 - DNA, 15 bp, Homo sapiens
gctgcgtccctgctc

SEQ ID NO: 603345 - DNA, 19 bp, Homo sapiens
gctgcgtccctgctcagcc

SEQ ID NO: 603346 - DNA, 21 bp, Homo sapiens
gctgcgtccctgctcagccca

SEQ ID NO: 603347 - DNA, 14 bp, Homo sapiens
gctgctatgctgtt

SEQ ID NO: 603348 - DNA, 19 bp, Homo sapiens
gctgctcccagcctcttgc

SEQ ID NO: 603349 - DNA, 19 bp, Homo sapiens
gctgctcgggaaggcctga

SEQ ID NO: 603350 - DNA, 21 bp, Homo sapiens
gctgctcgggaaggcctgagg

SEQ ID NO: 603351 - DNA, 22 bp, Homo sapiens
gctgctcgggaaggcctgaggg

SEQ ID NO: 603352 - DNA, 19 bp, Homo sapiens
gctgctctctaagaattca

SEQ ID NO: 603353 - DNA, 23 bp, Homo sapiens
gctgctgagcacatctcttcatg

SEQ ID NO: 603354 - DNA, 12 bp, Homo sapiens
gctgctgcactg

SEQ ID NO: 603355 - DNA, 23 bp, Homo sapiens
gctgctgcagtcagcacagagag

SEQ ID NO: 603356 - DNA, 15 bp, Homo sapiens
gcgcccgccgcctcc

SEQ ID NO: 603357 - DNA, 18 bp, Homo sapiens
gcgccctccctccctcca

SEQ ID NO: 603358 - DNA, 18 bp, Homo sapiens
gcgccggttccacgtggg

SEQ ID NO: 603359 - DNA, 17 bp, Homo sapiens
gcgcctcccgccgcctc

SEQ ID NO: 603360 - DNA, 21 bp, Homo sapiens
gcgcctcccgccgcctcgggc

SEQ ID NO: 603361 - DNA, 18 bp, Homo sapiens
gcgcctcgccccagccaa

SEQ ID NO: 603362 - DNA, 20 bp, Homo sapiens
gcgcctcgccccagccaagc

SEQ ID NO: 603363 - DNA, 13 bp, Homo sapiens
gcgcctgcgcctc

SEQ ID NO: 603364 - DNA, 15 bp, Homo sapiens
gcgcctgcgcctcct

SEQ ID NO: 603365 - DNA, 23 bp, Homo sapiens
gcgcctgcgcctcctcctgcatg

SEQ ID NO: 603366 - DNA, 22 bp, Homo sapiens
gcgcctgcgctcctctgcagcc

SEQ ID NO: 603367 - DNA, 16 bp, Homo sapiens
gcgcctgtcgggcccg

SEQ ID NO: 603368 - DNA, 14 bp, Homo sapiens
gcgcgcgcccccag

SEQ ID NO: 603369 - DNA, 19 bp, Homo sapiens
gcgcgcgggacagcggccc

SEQ ID NO: 603370 - DNA, 16 bp, Homo sapiens
gcgcgggacagcggcc

SEQ ID NO: 603371 - DNA, 20 bp, Homo sapiens
gcgcgggacagcggccccgc

SEQ ID NO: 603372 - DNA, 14 bp, Homo sapiens
gcgcgtgcccccag

SEQ ID NO: 603373 - DNA, 13 bp, Homo sapiens
gcgcgtgccttcc

SEQ ID NO: 603374 - DNA, 14 bp, Homo sapiens
gcgcgtgccttccc

SEQ ID NO: 603375 - DNA, 16 bp, Homo sapiens
gcgctccggcagaggc

SEQ ID NO: 603376 - DNA, 21 bp, Homo sapiens
gcgctccggcagaggcagggc

SEQ ID NO: 603377 - DNA, 17 bp, Homo sapiens
gcgctcctctgcagcct

SEQ ID NO: 603378 - DNA, 15 bp, Homo sapiens
gcgctctgcccctcc

SEQ ID NO: 603379 - DNA, 20 bp, Homo sapiens
gcgctctgcccctccgtccc

SEQ ID NO: 603380 - DNA, 13 bp, Homo sapiens
gcgctctgggttt

SEQ ID NO: 603381 - DNA, 21 bp, Homo sapiens
gcggaccggagcggctgagga

SEQ ID NO: 603382 - DNA, 11 bp, Homo sapiens
gcggaggcccc

SEQ ID NO: 603383 - DNA, 16 bp, Homo sapiens
gcggaggcccctgagg

SEQ ID NO: 603384 - DNA, 20 bp, Homo sapiens
gcggaggggcttggagcaga

SEQ ID NO: 603385 - DNA, 21 bp, Homo sapiens
gcggaggggcttggagcagag

SEQ ID NO: 603386 - DNA, 17 bp, Homo sapiens
gcggcaaagatccagcg

SEQ ID NO: 603387 - DNA, 15 bp, Homo sapiens
gcggcacattggcag

SEQ ID NO: 603388 - DNA, 16 bp, Homo sapiens
gcggcaccgcccaccc

SEQ ID NO: 603389 - DNA, 19 bp, Homo sapiens
gcggcaggggttggcagcg

SEQ ID NO: 603390 - DNA, 19 bp, Homo sapiens
gcggcatccgagcccctgt

SEQ ID NO: 603391 - DNA, 22 bp, Homo sapiens
gcggcccggcccacgcagagcc

SEQ ID NO: 603392 - DNA, 23 bp, Homo sapiens
gcggcccggcccacgcagagccc

SEQ ID NO: 603393 - DNA, 17 bp, Homo sapiens
gcggcccgtgcgcagcc

SEQ ID NO: 603394 - DNA, 21 bp, Homo sapiens
gcggccgctctccgccccccg

SEQ ID NO: 603395 - DNA, 23 bp, Homo sapiens
gcggccttccgggtctcgcagcc

SEQ ID NO: 603396 - DNA, 17 bp, Homo sapiens
gcggcggggcctgggtc

SEQ ID NO: 603397 - DNA, 14 bp, Homo sapiens
gcggctgaggacgg

SEQ ID NO: 603398 - DNA, 21 bp, Homo sapiens
gcggctgtgggggaggtccct

SEQ ID NO: 603399 - DNA, 14 bp, Homo sapiens
gcggcttccctgcg

SEQ ID NO: 603400 - DNA, 12 bp, Homo sapiens
gcgggcagcccc

SEQ ID NO: 603401 - DNA, 13 bp, Homo sapiens
gcgggcagcccct

SEQ ID NO: 603402 - DNA, 19 bp, Homo sapiens
gcgggcagcccctgctgga

SEQ ID NO: 603403 - DNA, 19 bp, Homo sapiens
gcgggccagggtgggaaga

SEQ ID NO: 603404 - DNA, 20 bp, Homo sapiens
gcgggccaggtctggcgcca

SEQ ID NO: 603405 - DNA, 23 bp, Homo sapiens
gcgggccaggtctggcgccaggg

SEQ ID NO: 603406 - DNA, 20 bp, Homo sapiens
gcggggcggcatccgagccc

SEQ ID NO: 603407 - DNA, 13 bp, Homo sapiens
gcggggcttctgg

SEQ ID NO: 603408 - DNA, 23 bp, Homo sapiens
gcgggggctaactggccccaggc

SEQ ID NO: 603409 - DNA, 16 bp, Homo sapiens
gcgggtggctggagcc

SEQ ID NO: 603410 - DNA, 16 bp, Homo sapiens
gcgtcctttcctctcc

SEQ ID NO: 603411 - DNA, 21 bp, Homo sapiens
gcgtcctttcctctcctctct

SEQ ID NO: 603412 - DNA, 20 bp, Homo sapiens
gcgtctccccatgctgggct

SEQ ID NO: 603413 - DNA, 14 bp, Homo sapiens
gcgtggttctgcca

SEQ ID NO: 603414 - DNA, 18 bp, Homo sapiens
gcgtgtcctatccccgga

SEQ ID NO: 603415 - DNA, 11 bp, Homo sapiens
gcgtgtggccc

SEQ ID NO: 603416 - DNA, 16 bp, Homo sapiens
gctaactggccccagg

SEQ ID NO: 603417 - DNA, 23 bp, Homo sapiens
gctaagataattaaatgaaatac

SEQ ID NO: 603418 - DNA, 16 bp, Homo sapiens
gctaagcctgatgatg

SEQ ID NO: 603419 - DNA, 23 bp, Homo sapiens
gctaagttgtcttacacttctca

SEQ ID NO: 603420 - DNA, 14 bp, Homo sapiens
gctaatgtggtagt

SEQ ID NO: 603421 - DNA, 18 bp, Homo sapiens
gctaatgtggtagtgaaa

SEQ ID NO: 603422 - DNA, 13 bp, Homo sapiens
gctaatttgtgaa

SEQ ID NO: 603423 - DNA, 14 bp, Homo sapiens
gctaatttgtgaaa

SEQ ID NO: 603424 - DNA, 16 bp, Homo sapiens
gctacaaaatgtgtgc

SEQ ID NO: 603425 - DNA, 16 bp, Homo sapiens
gctacaggtgccccac

SEQ ID NO: 603426 - DNA, 19 bp, Homo sapiens
gctacaggtgccccacctc

SEQ ID NO: 603427 - DNA, 19 bp, Homo sapiens
gctaccatgttaatacatc

SEQ ID NO: 603428 - DNA, 20 bp, Homo sapiens
gctacttccctcacccactt

SEQ ID NO: 603429 - DNA, 19 bp, Homo sapiens
gctagcccagtccctggag

SEQ ID NO: 603430 - DNA, 20 bp, Homo sapiens
gctaggttaataggaggaca

SEQ ID NO: 603431 - DNA, 14 bp, Homo sapiens
gctagtttaaaatt

SEQ ID NO: 603432 - DNA, 21 bp, Homo sapiens
gctagtttaaaattattaaaa

SEQ ID NO: 603433 - DNA, 14 bp, Homo sapiens
gctataaaagccca

SEQ ID NO: 603434 - DNA, 23 bp, Homo sapiens
gctatgcacaccaaattgctgag

SEQ ID NO: 603435 - DNA, 13 bp, Homo sapiens
gctatgtctgtga

SEQ ID NO: 603436 - DNA, 14 bp, Homo sapiens
gctatgtctgtgat

SEQ ID NO: 603437 - DNA, 12 bp, Homo sapiens
gctatttaagtg

SEQ ID NO: 603438 - DNA, 21 bp, Homo sapiens
gctatttaagtggactgtatt

SEQ ID NO: 603439 - DNA, 22 bp, Homo sapiens
gctatttaagtggactgtattt

SEQ ID NO: 603440 - DNA, 20 bp, Homo sapiens
gctcaacctctcagatccct

SEQ ID NO: 603441 - DNA, 21 bp, Homo sapiens
gctcaacctctcagatccctc

SEQ ID NO: 603442 - DNA, 17 bp, Homo sapiens
gctcaaggctgcagtga

SEQ ID NO: 603443 - DNA, 12 bp, Homo sapiens
gctcaatgtgct

SEQ ID NO: 603444 - DNA, 19 bp, Homo sapiens
gctcacaccggcactgtgc

SEQ ID NO: 603445 - DNA, 21 bp, Homo sapiens
gctcacaccggcactgtgcac

SEQ ID NO: 603446 - DNA, 15 bp, Homo sapiens
gctcacagcacattt

SEQ ID NO: 603447 - DNA, 16 bp, Homo sapiens
gctcacgtctgtgagt

SEQ ID NO: 603448 - DNA, 17 bp, Homo sapiens
gctcactacatgggcca

SEQ ID NO: 603449 - DNA, 20 bp, Homo sapiens
gctcactacatgggccagcc

SEQ ID NO: 603450 - DNA, 20 bp, Homo sapiens
gctcagatggggcctgggct

SEQ ID NO: 603451 - DNA, 21 bp, Homo sapiens
gctcagatggggcctgggctg

SEQ ID NO: 603452 - DNA, 14 bp, Homo sapiens
gctcagcccatccc

SEQ ID NO: 603453 - DNA, 11 bp, Homo sapiens
gctcaggagaa

SEQ ID NO: 603454 - DNA, 17 bp, Homo sapiens
gctcaggagaaggcctg

SEQ ID NO: 603455 - DNA, 20 bp, Homo sapiens
gctcagtaacacagtgcagt

SEQ ID NO: 603456 - DNA, 12 bp, Homo sapiens
gctcatagcaca

SEQ ID NO: 603457 - DNA, 15 bp, Homo sapiens
gctcatcagaaacaa

SEQ ID NO: 603458 - DNA, 15 bp, Homo sapiens
gctccaccctcccct

SEQ ID NO: 603459 - DNA, 16 bp, Homo sapiens
gctccaccctcccctc

SEQ ID NO: 603460 - DNA, 12 bp, Homo sapiens
gctccactctga

SEQ ID NO: 603461 - DNA, 12 bp, Homo sapiens
gctccagggact

SEQ ID NO: 603462 - DNA, 16 bp, Homo sapiens
gctccattcctgagta

SEQ ID NO: 603463 - DNA, 15 bp, Homo sapiens
gctcccggctctgag

SEQ ID NO: 603464 - DNA, 12 bp, Homo sapiens
gctccggcagag

SEQ ID NO: 603465 - DNA, 13 bp, Homo sapiens
gctcctctgcagc

SEQ ID NO: 603466 - DNA, 14 bp, Homo sapiens
gctcctctgcagcc

SEQ ID NO: 603467 - DNA, 15 bp, Homo sapiens
gctcctctgcagcct

SEQ ID NO: 603468 - DNA, 19 bp, Homo sapiens
gctcctctgcagcctgagc

SEQ ID NO: 603469 - DNA, 12 bp, Homo sapiens
gctcctgcccac

SEQ ID NO: 603470 - DNA, 17 bp, Homo sapiens
gctccttcatgcttttc

SEQ ID NO: 603471 - DNA, 20 bp, Homo sapiens
gctccttcatgcttttctca

SEQ ID NO: 603472 - DNA, 16 bp, Homo sapiens
gctcgccctgtgccct

SEQ ID NO: 603473 - DNA, 17 bp, Homo sapiens
gctcgggaaggcctgag

SEQ ID NO: 603474 - DNA, 17 bp, Homo sapiens
gctcgtgtttcacagtg

SEQ ID NO: 603475 - DNA, 12 bp, Homo sapiens
gcaatcttgctg

SEQ ID NO: 603476 - DNA, 15 bp, Homo sapiens
gcaatcttgctgtga

SEQ ID NO: 603477 - DNA, 16 bp, Homo sapiens
gcaatcttgctgtgaa

SEQ ID NO: 603478 - DNA, 14 bp, Homo sapiens
gcaatgacctttca

SEQ ID NO: 603479 - DNA, 15 bp, Homo sapiens
gcaatgacctttcaa

SEQ ID NO: 603480 - DNA, 20 bp, Homo sapiens
gcaatgttccgttcatctga

SEQ ID NO: 603481 - DNA, 23 bp, Homo sapiens
gcaatgttccgttcatctgagga

SEQ ID NO: 603482 - DNA, 16 bp, Homo sapiens
gcaattgtatatatat

SEQ ID NO: 603483 - DNA, 19 bp, Homo sapiens
gcacaaaaaatttaagaga

SEQ ID NO: 603484 - DNA, 19 bp, Homo sapiens
gcacaagggcacattgccc

SEQ ID NO: 603485 - DNA, 23 bp, Homo sapiens
gcacacacaaacctactgcccac

SEQ ID NO: 603486 - DNA, 13 bp, Homo sapiens
gcacacacatctg

SEQ ID NO: 603487 - DNA, 20 bp, Homo sapiens
gcacacacatctggccctga

SEQ ID NO: 603488 - DNA, 13 bp, Homo sapiens
gcacacataacac

SEQ ID NO: 603489 - DNA, 23 bp, Homo sapiens
gcacacctcggccgaggcctgcg

SEQ ID NO: 603490 - DNA, 12 bp, Homo sapiens
gcacagccatag

SEQ ID NO: 603491 - DNA, 16 bp, Homo sapiens
gcacaggagactccaa

SEQ ID NO: 603492 - DNA, 15 bp, Homo sapiens
gcacaggcatattat

SEQ ID NO: 603493 - DNA, 11 bp, Homo sapiens
gcacagtattt

SEQ ID NO: 603494 - DNA, 13 bp, Homo sapiens
gcacattgcccat

SEQ ID NO: 603495 - DNA, 17 bp, Homo sapiens
gcacattgcccatggct

SEQ ID NO: 603496 - DNA, 16 bp, Homo sapiens
gcacattggcagtgtg

SEQ ID NO: 603497 - DNA, 23 bp, Homo sapiens
gcacatttgttaatgattcttgt

SEQ ID NO: 603498 - DNA, 15 bp, Homo sapiens
gcaccacaggctgcc

SEQ ID NO: 603499 - DNA, 18 bp, Homo sapiens
gcaccagtgccgcctgtg

SEQ ID NO: 603500 - DNA, 16 bp, Homo sapiens
gcaccatgctgggccg

SEQ ID NO: 603501 - DNA, 12 bp, Homo sapiens
gcacccactgga

SEQ ID NO: 603502 - DNA, 16 bp, Homo sapiens
gcaccccaccacacac

SEQ ID NO: 603503 - DNA, 22 bp, Homo sapiens
gcaccccaccacacacaccctt

SEQ ID NO: 603504 - DNA, 12 bp, Homo sapiens
gcacccccagcc

SEQ ID NO: 603505 - DNA, 13 bp, Homo sapiens
gcacccccagcct

SEQ ID NO: 603506 - DNA, 14 bp, Homo sapiens
gcacccccagcctc

SEQ ID NO: 603507 - DNA, 18 bp, Homo sapiens
gcaccccgttcccagcgc

SEQ ID NO: 603508 - DNA, 15 bp, Homo sapiens
gcaccctccacagga

SEQ ID NO: 603509 - DNA, 16 bp, Homo sapiens
gcaccctgcaggcagg

SEQ ID NO: 603510 - DNA, 23 bp, Homo sapiens
gcaccgcccaacccccacctccc

SEQ ID NO: 603511 - DNA, 19 bp, Homo sapiens
gcaccgtggtgtgaggccc

SEQ ID NO: 603512 - DNA, 21 bp, Homo sapiens
gcaccgtggtgtgaggccccc

SEQ ID NO: 603513 - DNA, 13 bp, Homo sapiens
gcacctcctccgt

SEQ ID NO: 603514 - DNA, 17 bp, Homo sapiens
gcacctcgccgtgtctt

SEQ ID NO: 603515 - DNA, 13 bp, Homo sapiens
gcacctcttgaag

SEQ ID NO: 603516 - DNA, 16 bp, Homo sapiens
gcacggcagcttgagc

SEQ ID NO: 603517 - DNA, 20 bp, Homo sapiens
gcacggcagcttgagcctgt

SEQ ID NO: 603518 - DNA, 22 bp, Homo sapiens
gcacgggagagcgccacccgcc

SEQ ID NO: 603519 - DNA, 15 bp, Homo sapiens
gcactaaaagtgatg

SEQ ID NO: 603520 - DNA, 22 bp, Homo sapiens
gcactaaaagtgatgtgattta

SEQ ID NO: 603521 - DNA, 14 bp, Homo sapiens
gcactatctttcag

SEQ ID NO: 603522 - DNA, 15 bp, Homo sapiens
gcactatctttcagg

SEQ ID NO: 603523 - DNA, 18 bp, Homo sapiens
gcactcaggagcacagcc

SEQ ID NO: 603524 - DNA, 14 bp, Homo sapiens
gcactcccagggcc

SEQ ID NO: 603525 - DNA, 18 bp, Homo sapiens
gcactcccagggcccgag

SEQ ID NO: 603526 - DNA, 19 bp, Homo sapiens
gcactcccagggcccgagc

SEQ ID NO: 603527 - DNA, 13 bp, Homo sapiens
gcactgccctccg

SEQ ID NO: 603528 - DNA, 16 bp, Homo sapiens
gcactgtcaggaatgg

SEQ ID NO: 603529 - DNA, 16 bp, Homo sapiens
gcactttgggaggctg

SEQ ID NO: 603530 - DNA, 13 bp, Homo sapiens
gcagaaaacattg

SEQ ID NO: 603531 - DNA, 23 bp, Homo sapiens
gcagaatgagatgatttaattct

SEQ ID NO: 603532 - DNA, 19 bp, Homo sapiens
gcagaatggtgggctccag

SEQ ID NO: 603533 - DNA, 22 bp, Homo sapiens
gcagaatggtgggctccagagt

SEQ ID NO: 603534 - DNA, 16 bp, Homo sapiens
gcagacacacacatat

SEQ ID NO: 603535 - DNA, 18 bp, Homo sapiens
gcagacacacacatatat

SEQ ID NO: 603536 - DNA, 22 bp, Homo sapiens
gcagacgcaagaggtttcagca

SEQ ID NO: 603537 - DNA, 20 bp, Homo sapiens
gcagacggggggctgcgggc

SEQ ID NO: 603538 - DNA, 20 bp, Homo sapiens
gcagagaccaccgcgcccct

SEQ ID NO: 603539 - DNA, 14 bp, Homo sapiens
gcagagaccttgcg

SEQ ID NO: 603540 - DNA, 17 bp, Homo sapiens
gcagagacggcagcccc

SEQ ID NO: 603541 - DNA, 22 bp, Homo sapiens
gcagagattgggggggcttggg

SEQ ID NO: 603542 - DNA, 11 bp, Homo sapiens
gcagagccccg

SEQ ID NO: 603543 - DNA, 19 bp, Homo sapiens
gcagagccccggagcacca

SEQ ID NO: 603544 - DNA, 16 bp, Homo sapiens
gcagagcgcagccccc

SEQ ID NO: 603545 - DNA, 12 bp, Homo sapiens
gcagaggaatgt

SEQ ID NO: 603546 - DNA, 12 bp, Homo sapiens
gcagaggcaggg

SEQ ID NO: 603547 - DNA, 20 bp, Homo sapiens
gcagaggcagggccctgggg

SEQ ID NO: 603548 - DNA, 15 bp, Homo sapiens
gcagaggcccgaggc

SEQ ID NO: 603549 - DNA, 22 bp, Homo sapiens
gcagagtatacaagtgtttcta

SEQ ID NO: 603550 - DNA, 15 bp, Homo sapiens
gcagagtcaagctga

SEQ ID NO: 603551 - DNA, 20 bp, Homo sapiens
gcagatcgtgccgtggagct

SEQ ID NO: 603552 - DNA, 21 bp, Homo sapiens
gcagattaataacagaaatac

SEQ ID NO: 603553 - DNA, 15 bp, Homo sapiens
gcagcaaccagagca

SEQ ID NO: 603554 - DNA, 17 bp, Homo sapiens
gcagcaaccagagcact

SEQ ID NO: 603555 - DNA, 17 bp, Homo sapiens
gcagcaaggtgggggtc

SEQ ID NO: 603556 - DNA, 14 bp, Homo sapiens
gcagcaccagcctg

SEQ ID NO: 603557 - DNA, 15 bp, Homo sapiens
gcagcaccagcctga

SEQ ID NO: 603558 - DNA, 13 bp, Homo sapiens
gcagcacctccgg

SEQ ID NO: 603559 - DNA, 22 bp, Homo sapiens
gcagcacctccgggactgacct

SEQ ID NO: 603560 - DNA, 20 bp, Homo sapiens
gcagcagtaccatcccactg

SEQ ID NO: 603561 - DNA, 20 bp, Homo sapiens
gcagcccagaacgggcctcc

SEQ ID NO: 603562 - DNA, 18 bp, Homo sapiens
gcagccccatccttcccg

SEQ ID NO: 603563 - DNA, 15 bp, Homo sapiens
gcagcccccacgccg

SEQ ID NO: 603564 - DNA, 18 bp, Homo sapiens
gcagccccctgtggcggc

SEQ ID NO: 603565 - DNA, 22 bp, Homo sapiens
gcagccccgcgaccacccctgt

SEQ ID NO: 603566 - DNA, 12 bp, Homo sapiens
gcagcccctccc

SEQ ID NO: 603567 - DNA, 14 bp, Homo sapiens
gcagcccctgctgg

SEQ ID NO: 603568 - DNA, 17 bp, Homo sapiens
gcagccgcgctctgccc

SEQ ID NO: 603569 - DNA, 14 bp, Homo sapiens
gcagcctgaagcct

SEQ ID NO: 603570 - DNA, 20 bp, Homo sapiens
gcagcctgaagcctggattc

SEQ ID NO: 603571 - DNA, 20 bp, Homo sapiens
gcctggcgggcagcccctgc

SEQ ID NO: 603572 - DNA, 13 bp, Homo sapiens
gcctggcttctgg

SEQ ID NO: 603573 - DNA, 17 bp, Homo sapiens
gcctggcttctgggaca

SEQ ID NO: 603574 - DNA, 22 bp, Homo sapiens
gcctgggacgcccctttctctt

SEQ ID NO: 603575 - DNA, 12 bp, Homo sapiens
gcctgggcccag

SEQ ID NO: 603576 - DNA, 14 bp, Homo sapiens
gcctgggcccaggc

SEQ ID NO: 603577 - DNA, 21 bp, Homo sapiens
gcctgggcccaggcccagcct

SEQ ID NO: 603578 - DNA, 14 bp, Homo sapiens
gcctgggtccccct

SEQ ID NO: 603579 - DNA, 18 bp, Homo sapiens
gcctgggtccccctcctg

SEQ ID NO: 603580 - DNA, 16 bp, Homo sapiens
gcctggtctggagccc

SEQ ID NO: 603581 - DNA, 20 bp, Homo sapiens
gcctgtactcgcttgtgcag

SEQ ID NO: 603582 - DNA, 20 bp, Homo sapiens
gcctgtcaggaccattttag

SEQ ID NO: 603583 - DNA, 13 bp, Homo sapiens
gcctgtcgggccc

SEQ ID NO: 603584 - DNA, 16 bp, Homo sapiens
gcctgtcgggcccgca

SEQ ID NO: 603585 - DNA, 18 bp, Homo sapiens
gcctgtcgggcccgcact

SEQ ID NO: 603586 - DNA, 18 bp, Homo sapiens
gccttatggaacactctg

SEQ ID NO: 603587 - DNA, 19 bp, Homo sapiens
gccttatggaacactctga

SEQ ID NO: 603588 - DNA, 22 bp, Homo sapiens
gccttccccgtgcggcccgtgc

SEQ ID NO: 603589 - DNA, 19 bp, Homo sapiens
gccttccctccccacagtc

SEQ ID NO: 603590 - DNA, 13 bp, Homo sapiens
gccttgctgggcc

SEQ ID NO: 603591 - DNA, 14 bp, Homo sapiens
gccttgctgggcca

SEQ ID NO: 603592 - DNA, 18 bp, Homo sapiens
gccttgctgggccaggga

SEQ ID NO: 603593 - DNA, 17 bp, Homo sapiens
gccttggttcctccagc

SEQ ID NO: 603594 - DNA, 18 bp, Homo sapiens
gcctttccccagtgtggc

SEQ ID NO: 603595 - DNA, 12 bp, Homo sapiens
gcgacaatgcaa

SEQ ID NO: 603596 - DNA, 14 bp, Homo sapiens
gcgaccacccctgt

SEQ ID NO: 603597 - DNA, 19 bp, Homo sapiens
gcgaggctttaagcgaggc

SEQ ID NO: 603598 - DNA, 14 bp, Homo sapiens
gcgagtggtcaagg

SEQ ID NO: 603599 - DNA, 14 bp, Homo sapiens
gcgcaaaggtgcct

SEQ ID NO: 603600 - DNA, 17 bp, Homo sapiens
gcgcaccgcccaacccc

SEQ ID NO: 603601 - DNA, 22 bp, Homo sapiens
gcgcaccgcccaacccccacct

SEQ ID NO: 603602 - DNA, 23 bp, Homo sapiens
gcgcaccgcccaacccccacctc

SEQ ID NO: 603603 - DNA, 19 bp, Homo sapiens
gcgcagccgcgctctgccc

SEQ ID NO: 603604 - DNA, 20 bp, Homo sapiens
gcgcagccgcgctctgcccc

SEQ ID NO: 603605 - DNA, 23 bp, Homo sapiens
gcgcagccgcgctctgcccctcc

SEQ ID NO: 603606 - DNA, 13 bp, Homo sapiens
gcgcagcgccagg

SEQ ID NO: 603607 - DNA, 13 bp, Homo sapiens
gcgcagtccccag

SEQ ID NO: 603608 - DNA, 13 bp, Homo sapiens
gcgcatggcgccc

SEQ ID NO: 603609 - DNA, 14 bp, Homo sapiens
gcgccacccgcccg

SEQ ID NO: 603610 - DNA, 17 bp, Homo sapiens
gcgccaggggcaggcag

SEQ ID NO: 603611 - DNA, 12 bp, Homo sapiens
gcgcccacctgc

SEQ ID NO: 603612 - DNA, 13 bp, Homo sapiens
gcgcccacctgcc

SEQ ID NO: 603613 - DNA, 13 bp, Homo sapiens
gcgcccccaggac

SEQ ID NO: 603614 - DNA, 13 bp, Homo sapiens
gcgcccctctgcg

SEQ ID NO: 603615 - DNA, 15 bp, Homo sapiens
gcgcccctctgcgcc

SEQ ID NO: 603616 - DNA, 20 bp, Homo sapiens
gcgcccctctgcgccccagc

SEQ ID NO: 603617 - DNA, 16 bp, Homo sapiens
gcgcccctgcccagca

SEQ ID NO: 603618 - DNA, 14 bp, Homo sapiens
gcgcccctgtccat

SEQ ID NO: 603619 - DNA, 18 bp, Homo sapiens
gcgcccgaggccagggcc

SEQ ID NO: 603620 - DNA, 21 bp, Homo sapiens
gtgctctacatctcgtatgga

SEQ ID NO: 603621 - DNA, 18 bp, Homo sapiens
gtgctgcccgagggcagg

SEQ ID NO: 603622 - DNA, 17 bp, Homo sapiens
gtgcttagaaacctcac

SEQ ID NO: 603623 - DNA, 18 bp, Homo sapiens
gtgcttatgtcatttctt

SEQ ID NO: 603624 - DNA, 16 bp, Homo sapiens
gtggaagaagggccac

SEQ ID NO: 603625 - DNA, 22 bp, Homo sapiens
gtggaattacataacaggcatt

SEQ ID NO: 603626 - DNA, 21 bp, Homo sapiens
gtggaccagttccctcagccc

SEQ ID NO: 603627 - DNA, 13 bp, Homo sapiens
gtggactgtattt

SEQ ID NO: 603628 - DNA, 12 bp, Homo sapiens
gtggagcttgga

SEQ ID NO: 603629 - DNA, 13 bp, Homo sapiens
gtggaggggtcag

SEQ ID NO: 603630 - DNA, 12 bp, Homo sapiens
gtggagtggagg

SEQ ID NO: 603631 - DNA, 14 bp, Homo sapiens
gtggatgtaaattt

SEQ ID NO: 603632 - DNA, 14 bp, Homo sapiens
gtggatgtcccttc

SEQ ID NO: 603633 - DNA, 19 bp, Homo sapiens
gtggatgtcccttccccac

SEQ ID NO: 603634 - DNA, 12 bp, Homo sapiens
gtggattgtttt

SEQ ID NO: 603635 - DNA, 14 bp, Homo sapiens
gtggattgtttttt

SEQ ID NO: 603636 - DNA, 13 bp, Homo sapiens
gtggcaaacattt

SEQ ID NO: 603637 - DNA, 21 bp, Homo sapiens
gtggcagggaagggtgcctgg

SEQ ID NO: 603638 - DNA, 12 bp, Homo sapiens
gtggcccctcct

SEQ ID NO: 603639 - DNA, 17 bp, Homo sapiens
gtggcccctccttctcc

SEQ ID NO: 603640 - DNA, 14 bp, Homo sapiens
gtggcctgagaaga

SEQ ID NO: 603641 - DNA, 20 bp, Homo sapiens
gtggctcgtgtttcacagtg

SEQ ID NO: 603642 - DNA, 23 bp, Homo sapiens
gtggctgatttactaacagtaac

SEQ ID NO: 603643 - DNA, 15 bp, Homo sapiens
gtggctgcttcaagg

SEQ ID NO: 603644 - DNA, 16 bp, Homo sapiens
gtggctgcttcaagga

SEQ ID NO: 603645 - DNA, 23 bp, Homo sapiens
gtggctgcttcaaggatcctgag

SEQ ID NO: 603646 - DNA, 23 bp, Homo sapiens
gtggctggagccccatcgcctgg

SEQ ID NO: 603647 - DNA, 18 bp, Homo sapiens
gtggcttcccatgtcttt

SEQ ID NO: 603648 - DNA, 19 bp, Homo sapiens
gtgggagcacagctttcct

SEQ ID NO: 603649 - DNA, 23 bp, Homo sapiens
gtgggataggagggtgcccctgg

SEQ ID NO: 603650 - DNA, 18 bp, Homo sapiens
gtgggatccagagagaag

SEQ ID NO: 603651 - DNA, 17 bp, Homo sapiens
gtgggattcaggaatgg

SEQ ID NO: 603652 - DNA, 13 bp, Homo sapiens
gtgggcctgccta

SEQ ID NO: 603653 - DNA, 19 bp, Homo sapiens
gtgggcgcctgtcgggccc

SEQ ID NO: 603654 - DNA, 22 bp, Homo sapiens
gtgggcgcctgtcgggcccgca

SEQ ID NO: 603655 - DNA, 12 bp, Homo sapiens
gtgggctcacac

SEQ ID NO: 603656 - DNA, 13 bp, Homo sapiens
gtgggctcacacc

SEQ ID NO: 603657 - DNA, 22 bp, Homo sapiens
gtgggctccagggactggagtg

SEQ ID NO: 603658 - DNA, 20 bp, Homo sapiens
gtgggctgggccctctgtcc

SEQ ID NO: 603659 - DNA, 14 bp, Homo sapiens
gtggggacagggct

SEQ ID NO: 603660 - DNA, 15 bp, Homo sapiens
gtggggagcgggggc

SEQ ID NO: 603661 - DNA, 18 bp, Homo sapiens
gtggggcaagattttcct

SEQ ID NO: 603662 - DNA, 14 bp, Homo sapiens
gtggggccagcgct

SEQ ID NO: 603663 - DNA, 15 bp, Homo sapiens
gtggggccagcgctg

SEQ ID NO: 603664 - DNA, 11 bp, Homo sapiens
gtggggccagg

SEQ ID NO: 603665 - DNA, 14 bp, Homo sapiens
gtggggccaggacc

SEQ ID NO: 603666 - DNA, 18 bp, Homo sapiens
gtggggcccatggcccca

SEQ ID NO: 603667 - DNA, 20 bp, Homo sapiens
gtggggcccatggccccagc

SEQ ID NO: 603668 - DNA, 15 bp, Homo sapiens
gtggggggtgcccca

SEQ ID NO: 603669 - DNA, 16 bp, Homo sapiens
gtggggtacaggcagt

SEQ ID NO: 603670 - DNA, 21 bp, Homo sapiens
gtgggtcttggattggtacca

SEQ ID NO: 603671 - DNA, 14 bp, Homo sapiens
gtgggtgccctgtt

SEQ ID NO: 603672 - DNA, 19 bp, Homo sapiens
gtgggtggggtacaggcag

SEQ ID NO: 603673 - DNA, 16 bp, Homo sapiens
gtggtagttttcccta

SEQ ID NO: 603674 - DNA, 20 bp, Homo sapiens
gtggtccagggtccagccct

SEQ ID NO: 603675 - DNA, 18 bp, Homo sapiens
gtggtcttggagaggagg

SEQ ID NO: 603676 - DNA, 14 bp, Homo sapiens
gtggtgaggtcctg

SEQ ID NO: 603677 - DNA, 14 bp, Homo sapiens
gtggtgtcctctgt

SEQ ID NO: 603678 - DNA, 14 bp, Homo sapiens
gtggtgtgaggccc

SEQ ID NO: 603679 - DNA, 15 bp, Homo sapiens
gtggttatatttcaa

SEQ ID NO: 603680 - DNA, 13 bp, Homo sapiens
gtggttggaggcc

SEQ ID NO: 603681 - DNA, 16 bp, Homo sapiens
gtggtttcagaaaggg

SEQ ID NO: 603682 - DNA, 24 bp, Homo sapiens
gtgtaagacacgtgcaacagactg

SEQ ID NO: 603683 - DNA, 15 bp, Homo sapiens
gtgtactctgagtcc

SEQ ID NO: 603684 - DNA, 22 bp, Homo sapiens
gtgtatatgaggatgtatgtgt

SEQ ID NO: 603685 - DNA, 17 bp, Homo sapiens
gtgtatatgtttataca

SEQ ID NO: 603686 - DNA, 20 bp, Homo sapiens
gtgtatggaagacaaataca

SEQ ID NO: 603687 - DNA, 21 bp, Homo sapiens
gtgtatggaagacaaatacac

SEQ ID NO: 603688 - DNA, 22 bp, Homo sapiens
gtgtatttctattttgcagcag

SEQ ID NO: 603689 - DNA, 13 bp, Homo sapiens
gtgtcatctgtca

SEQ ID NO: 603690 - DNA, 14 bp, Homo sapiens
gtgtcatctgtcag

SEQ ID NO: 603691 - DNA, 16 bp, Homo sapiens
gtgtccattgacatgt

SEQ ID NO: 603692 - DNA, 23 bp, Homo sapiens
gtgtccattgacatgtacagaga

SEQ ID NO: 603693 - DNA, 13 bp, Homo sapiens
gtgtcctctgtcc

SEQ ID NO: 603694 - DNA, 14 bp, Homo sapiens
gtgtcctctgtccg

SEQ ID NO: 603695 - DNA, 18 bp, Homo sapiens
gtgtctggaaaagcactt

SEQ ID NO: 603696 - DNA, 14 bp, Homo sapiens
gtgtctggagcctg

SEQ ID NO: 603697 - DNA, 20 bp, Homo sapiens
gtgtcttgagaccagcctgc

SEQ ID NO: 603698 - DNA, 13 bp, Homo sapiens
gtgtgaaggtctt

SEQ ID NO: 603699 - DNA, 17 bp, Homo sapiens
gtgtgaggcccccggag

SEQ ID NO: 603700 - DNA, 13 bp, Homo sapiens
gtgtgcagactgt

SEQ ID NO: 603701 - DNA, 13 bp, Homo sapiens
gtgtgcagagtat

SEQ ID NO: 603702 - DNA, 22 bp, Homo sapiens
gtgtgccaggctagactaggag

SEQ ID NO: 603703 - DNA, 13 bp, Homo sapiens
gtgtggaatcacc

SEQ ID NO: 603704 - DNA, 13 bp, Homo sapiens
gtgtggagtggag

SEQ ID NO: 603705 - DNA, 15 bp, Homo sapiens
gtgtggcaaacattt

SEQ ID NO: 603706 - DNA, 23 bp, Homo sapiens
gtgtggccctgtgggagtccact

SEQ ID NO: 603707 - DNA, 12 bp, Homo sapiens
gtgtggcttgga

SEQ ID NO: 603708 - DNA, 15 bp, Homo sapiens
gtgtggcttggaaca

SEQ ID NO: 603709 - DNA, 23 bp, Homo sapiens
gtgtggcttggaacatttgggag

SEQ ID NO: 603710 - DNA, 16 bp, Homo sapiens
gtgtgggtgccctgtt

SEQ ID NO: 603711 - DNA, 18 bp, Homo sapiens
gtgtgggtttactctgtg

SEQ ID NO: 603712 - DNA, 21 bp, Homo sapiens
gtgtgtcacactgagctgggc

SEQ ID NO: 603713 - DNA, 16 bp, Homo sapiens
gtgtgtgcaatgttcc

SEQ ID NO: 603714 - DNA, 17 bp, Homo sapiens
gtgttcagtgccttgga

SEQ ID NO: 603715 - DNA, 16 bp, Homo sapiens
gtgttgggaattgcat

SEQ ID NO: 603716 - DNA, 14 bp, Homo sapiens
gtgttttcttcgtg

SEQ ID NO: 603717 - DNA, 13 bp, Homo sapiens
gtgttttgggttt

SEQ ID NO: 603718 - DNA, 19 bp, Homo sapiens
gtgttttgggtttttaaaa

SEQ ID NO: 603719 - DNA, 15 bp, Homo sapiens
gtgtttttacatata

SEQ ID NO: 603720 - DNA, 12 bp, Homo sapiens
gttaaaatatag

SEQ ID NO: 603721 - DNA, 21 bp, Homo sapiens
gttaaaatgtgtttttcagtt

SEQ ID NO: 603722 - DNA, 15 bp, Homo sapiens
gttaacccagtgttc

SEQ ID NO: 603723 - DNA, 22 bp, Homo sapiens
gttaagcacaaccatgttcttg

SEQ ID NO: 603724 - DNA, 15 bp, Homo sapiens
gttaatacatcattt

SEQ ID NO: 603725 - DNA, 14 bp, Homo sapiens
gttaatcttcatgg

SEQ ID NO: 603726 - DNA, 17 bp, Homo sapiens
gttaatgaaaaatctga

SEQ ID NO: 603727 - DNA, 16 bp, Homo sapiens
gttaatgattcttgtg

SEQ ID NO: 603728 - DNA, 14 bp, Homo sapiens
gttaatgtgccaaa

SEQ ID NO: 603729 - DNA, 17 bp, Homo sapiens
gttaattgatagaataa

SEQ ID NO: 603730 - DNA, 12 bp, Homo sapiens
gttacagctgaa

SEQ ID NO: 603731 - DNA, 22 bp, Homo sapiens
gttagaattaggtaatggatat

SEQ ID NO: 603732 - DNA, 16 bp, Homo sapiens
gttagcacagaggatg

SEQ ID NO: 603733 - DNA, 13 bp, Homo sapiens
gttagcccggcca

SEQ ID NO: 603734 - DNA, 23 bp, Homo sapiens
gttagcccggccaaggacactga

SEQ ID NO: 603735 - DNA, 13 bp, Homo sapiens
gttagctcagagg

SEQ ID NO: 603736 - DNA, 18 bp, Homo sapiens
gttaggaataacactgca

SEQ ID NO: 603737 - DNA, 19 bp, Homo sapiens
gttaggaataacactgcag

SEQ ID NO: 603738 - DNA, 13 bp, Homo sapiens
gttaggggtgggg

SEQ ID NO: 603739 - DNA, 13 bp, Homo sapiens
gttataaaatctg

SEQ ID NO: 603740 - DNA, 17 bp, Homo sapiens
gtcgctgtccgtcctgc

SEQ ID NO: 603741 - DNA, 17 bp, Homo sapiens
gtcggctgggcagggcc

SEQ ID NO: 603742 - DNA, 19 bp, Homo sapiens
gtcgggcccgcactcagga

SEQ ID NO: 603743 - DNA, 22 bp, Homo sapiens
gtcggtgtttggaggctgctgc

SEQ ID NO: 603744 - DNA, 16 bp, Homo sapiens
gtctatgctgtgtgca

SEQ ID NO: 603745 - DNA, 19 bp, Homo sapiens
gtctatgctgtgtgcagag

SEQ ID NO: 603746 - DNA, 11 bp, Homo sapiens
gtctcagtgaa

SEQ ID NO: 603747 - DNA, 13 bp, Homo sapiens
gtctccacccctc

SEQ ID NO: 603748 - DNA, 16 bp, Homo sapiens
gtctccacccctcaag

SEQ ID NO: 603749 - DNA, 16 bp, Homo sapiens
gtctccccatgctggg

SEQ ID NO: 603750 - DNA, 23 bp, Homo sapiens
gtctccctgggcaccctgcaggc

SEQ ID NO: 603751 - DNA, 17 bp, Homo sapiens
gtctcctctgtcagttt

SEQ ID NO: 603752 - DNA, 22 bp, Homo sapiens
gtctcctctgtcagtttgtgaa

SEQ ID NO: 603753 - DNA, 18 bp, Homo sapiens
gtctcctgtatcatttct

SEQ ID NO: 603754 - DNA, 19 bp, Homo sapiens
gtctcgcagcctgaagcct

SEQ ID NO: 603755 - DNA, 22 bp, Homo sapiens
gtctcgcagcctgaagcctgga

SEQ ID NO: 603756 - DNA, 18 bp, Homo sapiens
gtctctatttgatttgca

SEQ ID NO: 603757 - DNA, 23 bp, Homo sapiens
gtctctgtccgcgtcctttcctc

SEQ ID NO: 603758 - DNA, 14 bp, Homo sapiens
gtctgaaaaagtgt

SEQ ID NO: 603759 - DNA, 15 bp, Homo sapiens
gtctgaaggagagga

SEQ ID NO: 603760 - DNA, 12 bp, Homo sapiens
gtctgagccctg

SEQ ID NO: 603761 - DNA, 16 bp, Homo sapiens
gtctgagccctgccct

SEQ ID NO: 603762 - DNA, 18 bp, Homo sapiens
gtctgagccctgccctca

SEQ ID NO: 603763 - DNA, 15 bp, Homo sapiens
gtctgaggccccagg

SEQ ID NO: 603764 - DNA, 19 bp, Homo sapiens
gtctgaggccccaggccct

SEQ ID NO: 603765 - DNA, 12 bp, Homo sapiens
gtctgctgcccc

SEQ ID NO: 603766 - DNA, 21 bp, Homo sapiens
gtctgctgctgcctccctggg

SEQ ID NO: 603767 - DNA, 17 bp, Homo sapiens
gtctggaaaagcacttt

SEQ ID NO: 603768 - DNA, 15 bp, Homo sapiens
gtctggagcccctat

SEQ ID NO: 603769 - DNA, 22 bp, Homo sapiens
gtctggagcccctatcctgcac

SEQ ID NO: 603770 - DNA, 19 bp, Homo sapiens
gtctggagcctgcaggcag

SEQ ID NO: 603771 - DNA, 16 bp, Homo sapiens
gtctggataatttgta

SEQ ID NO: 603772 - DNA, 14 bp, Homo sapiens
gtctggctgtggcc

SEQ ID NO: 603773 - DNA, 16 bp, Homo sapiens
gtctggctgtggcccc

SEQ ID NO: 603774 - DNA, 13 bp, Homo sapiens
gtctgtcctgcgc

SEQ ID NO: 603775 - DNA, 14 bp, Homo sapiens
gtctgtcctgcgcc

SEQ ID NO: 603776 - DNA, 21 bp, Homo sapiens
gtctgtgaaagtctcctgtat

SEQ ID NO: 603777 - DNA, 18 bp, Homo sapiens
gtctgtgagtctgtcctt

SEQ ID NO: 603778 - DNA, 13 bp, Homo sapiens
gtctgtgataaca

SEQ ID NO: 603779 - DNA, 18 bp, Homo sapiens
gtctgtgttctcaacaca

SEQ ID NO: 603780 - DNA, 20 bp, Homo sapiens
gtcttcaaattgtcttttgt

SEQ ID NO: 603781 - DNA, 17 bp, Homo sapiens
gtcttgagaccagcctg

SEQ ID NO: 603782 - DNA, 16 bp, Homo sapiens
gtcttgagtgggcccc

SEQ ID NO: 603783 - DNA, 14 bp, Homo sapiens
gtcttggagaggag

SEQ ID NO: 603784 - DNA, 20 bp, Homo sapiens
gtcttggagaggaggtgtgg

SEQ ID NO: 603785 - DNA, 13 bp, Homo sapiens
gtcttgtattatc

SEQ ID NO: 603786 - DNA, 18 bp, Homo sapiens
gtcttgtttaatatttgt

SEQ ID NO: 603787 - DNA, 19 bp, Homo sapiens
gtctttcatggaatgcaat

SEQ ID NO: 603788 - DNA, 19 bp, Homo sapiens
gtctttgctgtttatatat

SEQ ID NO: 603789 - DNA, 19 bp, Homo sapiens
gtctttggcttcagaattg

SEQ ID NO: 603790 - DNA, 21 bp, Homo sapiens
gtgaaaatgctttgaaaatgt

SEQ ID NO: 603791 - DNA, 15 bp, Homo sapiens
gtgaaacacaatatc

SEQ ID NO: 603792 - DNA, 17 bp, Homo sapiens
gtgaaagtggcaagctc

SEQ ID NO: 603793 - DNA, 18 bp, Homo sapiens
gtgaaattagtattttga

SEQ ID NO: 603794 - DNA, 21 bp, Homo sapiens
gtgaactaatgacaagtgact

SEQ ID NO: 603795 - DNA, 15 bp, Homo sapiens
gtgaactgaagcaga

SEQ ID NO: 603796 - DNA, 21 bp, Homo sapiens
gtgaacttggtgcctaatgtt

SEQ ID NO: 603797 - DNA, 17 bp, Homo sapiens
gtgaagcatccaggcac

SEQ ID NO: 603798 - DNA, 16 bp, Homo sapiens
gtgaagcccaggagga

SEQ ID NO: 603799 - DNA, 21 bp, Homo sapiens
gtgaagcccaggaggacctgg

SEQ ID NO: 603800 - DNA, 23 bp, Homo sapiens
gtgaagtatgtcttcaaaatata

SEQ ID NO: 603801 - DNA, 16 bp, Homo sapiens
gtgaataaatatttta

SEQ ID NO: 603802 - DNA, 19 bp, Homo sapiens
gtgaataaatattttagga

SEQ ID NO: 603803 - DNA, 16 bp, Homo sapiens
gtgaatgctagacaga

SEQ ID NO: 603804 - DNA, 20 bp, Homo sapiens
gtgaattttaaaatgcaaat

SEQ ID NO: 603805 - DNA, 23 bp, Homo sapiens
gtgacagaaggcccgaggaggcc

SEQ ID NO: 603806 - DNA, 15 bp, Homo sapiens
gtgacatgggtgtgc

SEQ ID NO: 603807 - DNA, 22 bp, Homo sapiens
gtgacatgggtgtgccaggcta

SEQ ID NO: 603808 - DNA, 17 bp, Homo sapiens
gtgacatgtcctctctg

SEQ ID NO: 603809 - DNA, 16 bp, Homo sapiens
gtgaccggcccgccac

SEQ ID NO: 603810 - DNA, 13 bp, Homo sapiens
gtgacctgctcct

SEQ ID NO: 603811 - DNA, 17 bp, Homo sapiens
gtgacctgctcctgccc

SEQ ID NO: 603812 - DNA, 14 bp, Homo sapiens
gtgagactctgagg

SEQ ID NO: 603813 - DNA, 23 bp, Homo sapiens
gtgagatttagggttctatattt

SEQ ID NO: 603814 - DNA, 22 bp, Homo sapiens
gtgaggcccccggaggcgccca

SEQ ID NO: 603815 - DNA, 12 bp, Homo sapiens
gtgaggcccctg

SEQ ID NO: 603816 - DNA, 16 bp, Homo sapiens
gtgaggcccctgtgca

SEQ ID NO: 603817 - DNA, 13 bp, Homo sapiens
gtgaggcgtggga

SEQ ID NO: 603818 - DNA, 21 bp, Homo sapiens
gtgaggcgtgggatccagaga

SEQ ID NO: 603819 - DNA, 21 bp, Homo sapiens
gtgaggctccctccctccctg

SEQ ID NO: 603820 - DNA, 14 bp, Homo sapiens
gtgagtctgtcctt

SEQ ID NO: 603821 - DNA, 14 bp, Homo sapiens
gtgatcactttctg

SEQ ID NO: 603822 - DNA, 23 bp, Homo sapiens
gtgatcactttctgaaattcaca

SEQ ID NO: 603823 - DNA, 21 bp, Homo sapiens
gtgatctgttgtaatatcagt

SEQ ID NO: 603824 - DNA, 20 bp, Homo sapiens
gtgatgtgatttatgcattt

SEQ ID NO: 603825 - DNA, 15 bp, Homo sapiens
gtgcaaagcagtatg

SEQ ID NO: 603826 - DNA, 16 bp, Homo sapiens
gtgcacggcagcttga

SEQ ID NO: 603827 - DNA, 16 bp, Homo sapiens
gtgcactctactctgc

SEQ ID NO: 603828 - DNA, 19 bp, Homo sapiens
gtgcactctactctgcgac

SEQ ID NO: 603829 - DNA, 15 bp, Homo sapiens
gtgcagaaaacattg

SEQ ID NO: 603830 - DNA, 16 bp, Homo sapiens
gtgcagaaaacattgt

SEQ ID NO: 603831 - DNA, 22 bp, Homo sapiens
gtgcaggaaaaggctgcagcta

SEQ ID NO: 603832 - DNA, 14 bp, Homo sapiens
gtgcaggcgcgcac

SEQ ID NO: 603833 - DNA, 14 bp, Homo sapiens
gtgcagtagtgtca

SEQ ID NO: 603834 - DNA, 19 bp, Homo sapiens
gtgcagtttggtatgaaac

SEQ ID NO: 603835 - DNA, 21 bp, Homo sapiens
gtgcatatggcaacgttcatg

SEQ ID NO: 603836 - DNA, 14 bp, Homo sapiens
gtgcatctggcctg

SEQ ID NO: 603837 - DNA, 15 bp, Homo sapiens
gtgcatctggcctgg

SEQ ID NO: 603838 - DNA, 16 bp, Homo sapiens
gtgcatctggcctggg

SEQ ID NO: 603839 - DNA, 16 bp, Homo sapiens
gtgcatgttaaaataa

SEQ ID NO: 603840 - DNA, 20 bp, Homo sapiens
gtgcatgttaaaataattat

SEQ ID NO: 603841 - DNA, 16 bp, Homo sapiens
gtgcatgttgccatga

SEQ ID NO: 603842 - DNA, 14 bp, Homo sapiens
gtgccaaagatagc

SEQ ID NO: 603843 - DNA, 15 bp, Homo sapiens
gtgccagacgtgctc

SEQ ID NO: 603844 - DNA, 18 bp, Homo sapiens
gtgccccacaaggcccag

SEQ ID NO: 603845 - DNA, 19 bp, Homo sapiens
gtgccccacaaggcccagc

SEQ ID NO: 603846 - DNA, 15 bp, Homo sapiens
gtgccccccatgccc

SEQ ID NO: 603847 - DNA, 15 bp, Homo sapiens
gtgccctctcactga

SEQ ID NO: 603848 - DNA, 21 bp, Homo sapiens
gtgcctcatagcatagccagc

SEQ ID NO: 603849 - DNA, 23 bp, Homo sapiens
gtgcctcatagcatagccagcat

SEQ ID NO: 603850 - DNA, 12 bp, Homo sapiens
gtgcctggctgg

SEQ ID NO: 603851 - DNA, 21 bp, Homo sapiens
gtgccttccccgtgcggcccg

SEQ ID NO: 603852 - DNA, 20 bp, Homo sapiens
gtgcgcagccgcgctctgcc

SEQ ID NO: 603853 - DNA, 22 bp, Homo sapiens
gtgcgcagccgcgctctgcccc

SEQ ID NO: 603854 - DNA, 17 bp, Homo sapiens
gtgcggcccgtgcgcag

SEQ ID NO: 603855 - DNA, 12 bp, Homo sapiens
gtgcgtgtggcc

SEQ ID NO: 603856 - DNA, 13 bp, Homo sapiens
gtgcgtgtggccc

SEQ ID NO: 603857 - DNA, 20 bp, Homo sapiens
gtgctattcgtaagttctgt

SEQ ID NO: 603858 - DNA, 19 bp, Homo sapiens
gttatcagaaagatcaaat

SEQ ID NO: 603859 - DNA, 15 bp, Homo sapiens
gttatctagaaatta

SEQ ID NO: 603860 - DNA, 18 bp, Homo sapiens
gttatctgtctttatgat

SEQ ID NO: 603861 - DNA, 22 bp, Homo sapiens
gttatgttgtaatattttgctg

SEQ ID NO: 603862 - DNA, 17 bp, Homo sapiens
gttatttaccagaagtt

SEQ ID NO: 603863 - DNA, 21 bp, Homo sapiens
gttcaaagaacccccctcccc

SEQ ID NO: 603864 - DNA, 22 bp, Homo sapiens
gttcaaagaacccccctcccca

SEQ ID NO: 603865 - DNA, 18 bp, Homo sapiens
gttcaatgctacaaaatg

SEQ ID NO: 603866 - DNA, 21 bp, Homo sapiens
gttcaatgctacaaaatgtgt

SEQ ID NO: 603867 - DNA, 16 bp, Homo sapiens
gttcacgcaacttgaa

SEQ ID NO: 603868 - DNA, 20 bp, Homo sapiens
gttcacgtgactcctcaatt

SEQ ID NO: 603869 - DNA, 22 bp, Homo sapiens
gttcagaaaagcacctcttgaa

SEQ ID NO: 603870 - DNA, 14 bp, Homo sapiens
gttcagatctcata

SEQ ID NO: 603871 - DNA, 17 bp, Homo sapiens
gttcagtgccttggagc

SEQ ID NO: 603872 - DNA, 17 bp, Homo sapiens
gttcatagaaatacatc

SEQ ID NO: 603873 - DNA, 20 bp, Homo sapiens
gttcatagtcaatcaaacag

SEQ ID NO: 603874 - DNA, 19 bp, Homo sapiens
gttcatctgaggagtccaa

SEQ ID NO: 603875 - DNA, 19 bp, Homo sapiens
gttccaagtgtgtgtgcaa

SEQ ID NO: 603876 - DNA, 21 bp, Homo sapiens
gttccaagtgtgtgtgcaatg

SEQ ID NO: 603877 - DNA, 12 bp, Homo sapiens
gttccagacaga

SEQ ID NO: 603878 - DNA, 15 bp, Homo sapiens
gttccagacagagtg

SEQ ID NO: 603879 - DNA, 17 bp, Homo sapiens
gttccctgcgcgcagct

SEQ ID NO: 603880 - DNA, 18 bp, Homo sapiens
gttccgttcatctgagga

SEQ ID NO: 603881 - DNA, 23 bp, Homo sapiens
gttccgttcatctgaggagtcca

SEQ ID NO: 603882 - DNA, 17 bp, Homo sapiens
gttcggatcgctccgcc

SEQ ID NO: 603883 - DNA, 23 bp, Homo sapiens
gttcgggggaaatagttccattc

SEQ ID NO: 603884 - DNA, 15 bp, Homo sapiens
gttctatataatttt

SEQ ID NO: 603885 - DNA, 13 bp, Homo sapiens
gttctatatttac

SEQ ID NO: 603886 - DNA, 16 bp, Homo sapiens
gttctatatttactgt

SEQ ID NO: 603887 - DNA, 16 bp, Homo sapiens
gttctcaacacacagt

SEQ ID NO: 603888 - DNA, 18 bp, Homo sapiens
gttctcaacacacagtat

SEQ ID NO: 603889 - DNA, 23 bp, Homo sapiens
gttctcaacacacagtatagata

SEQ ID NO: 603890 - DNA, 16 bp, Homo sapiens
gttctccttgtacttg

SEQ ID NO: 603891 - DNA, 21 bp, Homo sapiens
gttctgaaattaggaaagtac

SEQ ID NO: 603892 - DNA, 19 bp, Homo sapiens
gttctgcacatacagatgg

SEQ ID NO: 603893 - DNA, 16 bp, Homo sapiens
gttctgccctgcctga

SEQ ID NO: 603894 - DNA, 20 bp, Homo sapiens
gttctgccctgcctgaggag

SEQ ID NO: 603895 - DNA, 14 bp, Homo sapiens
gttctgctgccctc

SEQ ID NO: 603896 - DNA, 19 bp, Homo sapiens
gttctgggttaacagtaaa

SEQ ID NO: 603897 - DNA, 14 bp, Homo sapiens
gttctgtttacatc

SEQ ID NO: 603898 - DNA, 19 bp, Homo sapiens
gttctgtttacatcagttt

SEQ ID NO: 603899 - DNA, 15 bp, Homo sapiens
gttcttgcagcagag

SEQ ID NO: 603900 - DNA, 21 bp, Homo sapiens
gttcttgcagtcatcagaagt

SEQ ID NO: 603901 - DNA, 13 bp, Homo sapiens
gttctttgtacct

SEQ ID NO: 603902 - DNA, 22 bp, Homo sapiens
gttgaacaagccacgttgcaga

SEQ ID NO: 603903 - DNA, 17 bp, Homo sapiens
gttgaagggaaatcaat

SEQ ID NO: 603904 - DNA, 17 bp, Homo sapiens
gttgacctaccctggac

SEQ ID NO: 603905 - DNA, 20 bp, Homo sapiens
gttgagccagcagacattgt

SEQ ID NO: 603906 - DNA, 13 bp, Homo sapiens
gttgagtttgctg

SEQ ID NO: 603907 - DNA, 14 bp, Homo sapiens
gttgcccttttcct

SEQ ID NO: 603908 - DNA, 14 bp, Homo sapiens
gttggagtgcagtg

SEQ ID NO: 603909 - DNA, 22 bp, Homo sapiens
gttggcagcgcctcgccccagc

SEQ ID NO: 603910 - DNA, 16 bp, Homo sapiens
gttggccggctggccg

SEQ ID NO: 603911 - DNA, 17 bp, Homo sapiens
gttggccggctggccgg

SEQ ID NO: 603912 - DNA, 11 bp, Homo sapiens
gttggcctctg

SEQ ID NO: 603913 - DNA, 12 bp, Homo sapiens
gttggcctctgc

SEQ ID NO: 603914 - DNA, 14 bp, Homo sapiens
gttgggttccagac

SEQ ID NO: 603915 - DNA, 22 bp, Homo sapiens
gttgggttccagacagagtgga

SEQ ID NO: 603916 - DNA, 15 bp, Homo sapiens
gttgtcctgtgtcat

SEQ ID NO: 603917 - DNA, 13 bp, Homo sapiens
gttgtcctttctg

SEQ ID NO: 603918 - DNA, 20 bp, Homo sapiens
gttgttcgatcgtttcacat

SEQ ID NO: 603919 - DNA, 16 bp, Homo sapiens
gttgttgtccctgcag

SEQ ID NO: 603920 - DNA, 14 bp, Homo sapiens
gttgttttgtggat

SEQ ID NO: 603921 - DNA, 18 bp, Homo sapiens
gttgttttttcattgtgt

SEQ ID NO: 603922 - DNA, 14 bp, Homo sapiens
gtttaaagcaactg

SEQ ID NO: 603923 - DNA, 15 bp, Homo sapiens
gtttaaatctttgtt

SEQ ID NO: 603924 - DNA, 22 bp, Homo sapiens
gtttaacttaatcaattaattt

SEQ ID NO: 603925 - DNA, 13 bp, Homo sapiens
gtttaactttgtg

SEQ ID NO: 603926 - DNA, 19 bp, Homo sapiens
gtttaagaaatgagaaatt

SEQ ID NO: 603927 - DNA, 16 bp, Homo sapiens
gtttaataatatgtac

SEQ ID NO: 603928 - DNA, 20 bp, Homo sapiens
gtttaatactcatccttgta

SEQ ID NO: 603929 - DNA, 14 bp, Homo sapiens
gtttaccctccctg

SEQ ID NO: 603930 - DNA, 18 bp, Homo sapiens
gtttaccctccctgtccc

SEQ ID NO: 603931 - DNA, 23 bp, Homo sapiens
gtttaccctccctgtcccctgag

SEQ ID NO: 603932 - DNA, 17 bp, Homo sapiens
gtttaccgcccacccag

SEQ ID NO: 603933 - DNA, 12 bp, Homo sapiens
gtttactctgtg

SEQ ID NO: 603934 - DNA, 19 bp, Homo sapiens
gtttactgacatggtgctg

SEQ ID NO: 603935 - DNA, 23 bp, Homo sapiens
gtttactgacatggtgctgtgtg

SEQ ID NO: 603936 - DNA, 22 bp, Homo sapiens
gtttagacttcctctcattgct

SEQ ID NO: 603937 - DNA, 20 bp, Homo sapiens
gtttagcgttgttttgtgga

SEQ ID NO: 603938 - DNA, 20 bp, Homo sapiens
gtttagtagctgataaagaa

SEQ ID NO: 603939 - DNA, 14 bp, Homo sapiens
gtttatacacacag

SEQ ID NO: 603940 - DNA, 15 bp, Homo sapiens
gtttataggaaataa

SEQ ID NO: 603941 - DNA, 19 bp, Homo sapiens
gtttatgtcccttcacata

SEQ ID NO: 603942 - DNA, 13 bp, Homo sapiens
gtttcagaaaggg

SEQ ID NO: 603943 - DNA, 17 bp, Homo sapiens
gtttcatactctagatt

SEQ ID NO: 603944 - DNA, 17 bp, Homo sapiens
gtttcattttcatctca

SEQ ID NO: 603945 - DNA, 21 bp, Homo sapiens
gtttccaatgccaattcatct

SEQ ID NO: 603946 - DNA, 19 bp, Homo sapiens
gtttccagctaagcctgat

SEQ ID NO: 603947 - DNA, 19 bp, Homo sapiens
gtttgatgaataaaatgtt

SEQ ID NO: 603948 - DNA, 19 bp, Homo sapiens
gtttgcttctaaaggtttc

SEQ ID NO: 603949 - DNA, 18 bp, Homo sapiens
gtttgggcagtggagagg

SEQ ID NO: 603950 - DNA, 15 bp, Homo sapiens
gtttgtcctttatgt

SEQ ID NO: 603951 - DNA, 19 bp, Homo sapiens
gtttgttatcagtacaatt

SEQ ID NO: 603952 - DNA, 20 bp, Homo sapiens
gtttgtttgctgcttttgat

SEQ ID NO: 603953 - DNA, 17 bp, Homo sapiens
gttttacaaagaaacaa

SEQ ID NO: 603954 - DNA, 15 bp, Homo sapiens
gttttatatgattaa

SEQ ID NO: 603955 - DNA, 17 bp, Homo sapiens
gttttcccattgcagtt

SEQ ID NO: 603956 - DNA, 16 bp, Homo sapiens
gttttgatctcagcat

SEQ ID NO: 603957 - DNA, 14 bp, Homo sapiens
gttttgccaacatt

SEQ ID NO: 603958 - DNA, 22 bp, Homo sapiens
gtttttatacctgtacacacac

SEQ ID NO: 603959 - DNA, 22 bp, Homo sapiens
gtttttgttcaccttctgtgca

SEQ ID NO: 603960 - DNA, 16 bp, Homo sapiens
gttttttatacttcaa

SEQ ID NO: 603961 - DNA, 23 bp, Homo sapiens
gtttttttcttttttaattgaaa

SEQ ID NO: 603962 - DNA, 23 bp, Homo sapiens
taaaaaaaatagttgagccagca

SEQ ID NO: 603963 - DNA, 17 bp, Homo sapiens
taaaaaaataaaacatt

SEQ ID NO: 603964 - DNA, 14 bp, Homo sapiens
taaaaaaataatat

SEQ ID NO: 603965 - DNA, 21 bp, Homo sapiens
taaaaaagatggatttgacac

SEQ ID NO: 603966 - DNA, 17 bp, Homo sapiens
taaaaagaccatgcatt

SEQ ID NO: 603967 - DNA, 20 bp, Homo sapiens
taaaaagaccatgcattcag

SEQ ID NO: 603968 - DNA, 17 bp, Homo sapiens
taaaaatagcagtatta

SEQ ID NO: 603969 - DNA, 23 bp, Homo sapiens
taaaacaaaccagcaacttttct

SEQ ID NO: 603970 - DNA, 21 bp, Homo sapiens
taaaacacccttgaaaatata

SEQ ID NO: 603971 - DNA, 16 bp, Homo sapiens
taaaacattttaaatg

SEQ ID NO: 603972 - DNA, 21 bp, Homo sapiens
taaaacattttaaatggacag

SEQ ID NO: 603973 - DNA, 22 bp, Homo sapiens
taaaacccttggtctgtgttct

SEQ ID NO: 603974 - DNA, 13 bp, Homo sapiens
taaaactgtgaca

SEQ ID NO: 603975 - DNA, 16 bp, Homo sapiens
taaaactgtgacattc

SEQ ID NO: 603976 - DNA, 12 bp, Homo sapiens
taactggcccca

SEQ ID NO: 603977 - DNA, 19 bp, Homo sapiens
taactgttaacccagtgtt

SEQ ID NO: 603978 - DNA, 14 bp, Homo sapiens
taactgttagaatt

SEQ ID NO: 603979 - DNA, 18 bp, Homo sapiens
taacttattttgattgtt

SEQ ID NO: 603980 - DNA, 21 bp, Homo sapiens
taacttattttgattgtttga

SEQ ID NO: 603981 - DNA, 16 bp, Homo sapiens
taagaaaatttaaaaa

SEQ ID NO: 603982 - DNA, 17 bp, Homo sapiens
taagaaaatttaaaaat

SEQ ID NO: 603983 - DNA, 20 bp, Homo sapiens
gcttcccctaacctgggttg

SEQ ID NO: 603984 - DNA, 13 bp, Homo sapiens
gcttctccccctc

SEQ ID NO: 603985 - DNA, 16 bp, Homo sapiens
gcttctccccctcagc

SEQ ID NO: 603986 - DNA, 15 bp, Homo sapiens
gcttctccctgggga

SEQ ID NO: 603987 - DNA, 24 bp, Homo sapiens
gcttctgggacaggcaccatgctg

SEQ ID NO: 603988 - DNA, 14 bp, Homo sapiens
gcttgagcctgtca

SEQ ID NO: 603989 - DNA, 11 bp, Homo sapiens
gcttggagcag

SEQ ID NO: 603990 - DNA, 20 bp, Homo sapiens
gcttggagcagagacggcag

SEQ ID NO: 603991 - DNA, 17 bp, Homo sapiens
gcttggagccccctggc

SEQ ID NO: 603992 - DNA, 22 bp, Homo sapiens
gcttggtttagctgtgcagaag

SEQ ID NO: 603993 - DNA, 20 bp, Homo sapiens
gcttgtagggtgaggcgtgg

SEQ ID NO: 603994 - DNA, 22 bp, Homo sapiens
gcttgtgcagaaaacattgttc

SEQ ID NO: 603995 - DNA, 11 bp, Homo sapiens
gcttgttcttc

SEQ ID NO: 603996 - DNA, 20 bp, Homo sapiens
gcttgtttaaggttcttgct

SEQ ID NO: 603997 - DNA, 17 bp, Homo sapiens
gctttaaaaccacagct

SEQ ID NO: 603998 - DNA, 21 bp, Homo sapiens
gctttactctgaatttccagt

SEQ ID NO: 603999 - DNA, 16 bp, Homo sapiens
gctttagagaagccat

SEQ ID NO: 604000 - DNA, 15 bp, Homo sapiens
gctttcagtgcctgc

SEQ ID NO: 604001 - DNA, 14 bp, Homo sapiens
gctttctgatacat

SEQ ID NO: 604002 - DNA, 21 bp, Homo sapiens
gctttgcaaccttgtacttta

SEQ ID NO: 604003 - DNA, 21 bp, Homo sapiens
gctttggaagcagcaaggtgg

SEQ ID NO: 604004 - DNA, 17 bp, Homo sapiens
gctttgggcacatgtat

SEQ ID NO: 604005 - DNA, 13 bp, Homo sapiens
gctttgtgcttat

SEQ ID NO: 604006 - DNA, 13 bp, Homo sapiens
gcttttctcatgg

SEQ ID NO: 604007 - DNA, 14 bp, Homo sapiens
gcttttctcatggt

SEQ ID NO: 604008 - DNA, 15 bp, Homo sapiens
gcttttctcatggta

SEQ ID NO: 604009 - DNA, 17 bp, Homo sapiens
gcttttgatggctatgt

SEQ ID NO: 604010 - DNA, 19 bp, Homo sapiens
gcttttgtacgttaattaa

SEQ ID NO: 604011 - DNA, 16 bp, Homo sapiens
gctttttgtgagaaag

SEQ ID NO: 604012 - DNA, 13 bp, Homo sapiens
ggaaaacctcagt

SEQ ID NO: 604013 - DNA, 22 bp, Homo sapiens
ggaaaacctcagttggcctctg

SEQ ID NO: 604014 - DNA, 15 bp, Homo sapiens
ggaaaacgatttaat

SEQ ID NO: 604015 - DNA, 21 bp, Homo sapiens
ggaaacaaagtttacattgtc

SEQ ID NO: 604016 - DNA, 14 bp, Homo sapiens
ggaaacatctgatt

SEQ ID NO: 604017 - DNA, 13 bp, Homo sapiens
ggaaaccttggag

SEQ ID NO: 604018 - DNA, 23 bp, Homo sapiens
ggaaactcatacagtctctattt

SEQ ID NO: 604019 - DNA, 20 bp, Homo sapiens
ggaaagttctattatctggg

SEQ ID NO: 604020 - DNA, 13 bp, Homo sapiens
ggaaataaatcta

SEQ ID NO: 604021 - DNA, 23 bp, Homo sapiens
ggaaatcaccgaaaacgtggctg

SEQ ID NO: 604022 - DNA, 21 bp, Homo sapiens
ggaaattcttgcactgtatcc

SEQ ID NO: 604023 - DNA, 15 bp, Homo sapiens
ggaaatttgtgtgct

SEQ ID NO: 604024 - DNA, 12 bp, Homo sapiens
ggaacactctga

SEQ ID NO: 604025 - DNA, 14 bp, Homo sapiens
ggaacactctgaga

SEQ ID NO: 604026 - DNA, 16 bp, Homo sapiens
ggaacactctgagact

SEQ ID NO: 604027 - DNA, 16 bp, Homo sapiens
ggaacatgacccagcc

SEQ ID NO: 604028 - DNA, 17 bp, Homo sapiens
ggaagacaaatacacat

SEQ ID NO: 604029 - DNA, 19 bp, Homo sapiens
ggaagacaaatacacatac

SEQ ID NO: 604030 - DNA, 23 bp, Homo sapiens
ggaagacaaatacacatacatat

SEQ ID NO: 604031 - DNA, 22 bp, Homo sapiens
ggaagagaagaaatagcagagc

SEQ ID NO: 604032 - DNA, 21 bp, Homo sapiens
ggaagagctgctgtatttgag

SEQ ID NO: 604033 - DNA, 19 bp, Homo sapiens
ggaagcagcaaggtggggg

SEQ ID NO: 604034 - DNA, 12 bp, Homo sapiens
ggaagcccaccc

SEQ ID NO: 604035 - DNA, 17 bp, Homo sapiens
ggaagcccacccgcccc

SEQ ID NO: 604036 - DNA, 17 bp, Homo sapiens
ggaagctttggaagcag

SEQ ID NO: 604037 - DNA, 13 bp, Homo sapiens
ggggaagggtgga

SEQ ID NO: 604038 - DNA, 15 bp, Homo sapiens
ggggacaccctcctg

SEQ ID NO: 604039 - DNA, 18 bp, Homo sapiens
ggggactgctttcagtgc

SEQ ID NO: 604040 - DNA, 15 bp, Homo sapiens
ggggacttggatagg

SEQ ID NO: 604041 - DNA, 14 bp, Homo sapiens
ggggagaatggctc

SEQ ID NO: 604042 - DNA, 18 bp, Homo sapiens
ggggaggagcacccccag

SEQ ID NO: 604043 - DNA, 12 bp, Homo sapiens
ggggaggctgag

SEQ ID NO: 604044 - DNA, 16 bp, Homo sapiens
ggggaggctgagacgc

SEQ ID NO: 604045 - DNA, 20 bp, Homo sapiens
ggggatgcccctggccctgc

SEQ ID NO: 604046 - DNA, 13 bp, Homo sapiens
ggggcaagagctc

SEQ ID NO: 604047 - DNA, 13 bp, Homo sapiens
ggggcagggccca

SEQ ID NO: 604048 - DNA, 22 bp, Homo sapiens
ggggcagggcccagggaggtgg

SEQ ID NO: 604049 - DNA, 23 bp, Homo sapiens
ggggcatccaccttcctgcccag

SEQ ID NO: 604050 - DNA, 16 bp, Homo sapiens
ggggcccatggcccca

SEQ ID NO: 604051 - DNA, 20 bp, Homo sapiens
ggggcccatggccccagctg

SEQ ID NO: 604052 - DNA, 11 bp, Homo sapiens
ggggcccctgc

SEQ ID NO: 604053 - DNA, 17 bp, Homo sapiens
ggggcctgggtccccct

SEQ ID NO: 604054 - DNA, 17 bp, Homo sapiens
ggggcgcgcgcccccag

SEQ ID NO: 604055 - DNA, 14 bp, Homo sapiens
ggggcgggccaggg

SEQ ID NO: 604056 - DNA, 17 bp, Homo sapiens
ggggctaacgggcgcct

SEQ ID NO: 604057 - DNA, 15 bp, Homo sapiens
ggggctaactggccc

SEQ ID NO: 604058 - DNA, 15 bp, Homo sapiens
ggggctctttccctc

SEQ ID NO: 604059 - DNA, 22 bp, Homo sapiens
ggggctgccgcatctgcctgga

SEQ ID NO: 604060 - DNA, 12 bp, Homo sapiens
ggggctggccct

SEQ ID NO: 604061 - DNA, 14 bp, Homo sapiens
ggggctggccctgc

SEQ ID NO: 604062 - DNA, 14 bp, Homo sapiens
ggggcttggagcag

SEQ ID NO: 604063 - DNA, 18 bp, Homo sapiens
ggggcttggagcagagac

SEQ ID NO: 604064 - DNA, 18 bp, Homo sapiens
gggggacgcccagccccc

SEQ ID NO: 604065 - DNA, 15 bp, Homo sapiens
gggggatgcccctgg

SEQ ID NO: 604066 - DNA, 18 bp, Homo sapiens
gggggatgcccctggccc

SEQ ID NO: 604067 - DNA, 22 bp, Homo sapiens
gggggcaagagctcaggagaag

SEQ ID NO: 604068 - DNA, 16 bp, Homo sapiens
gggggctaactggccc

SEQ ID NO: 604069 - DNA, 19 bp, Homo sapiens
gggggctaactggccccag

SEQ ID NO: 604070 - DNA, 23 bp, Homo sapiens
gggggctgttagctcagaggaga

SEQ ID NO: 604071 - DNA, 21 bp, Homo sapiens
ggggtaagttgaagggaaatc

SEQ ID NO: 604072 - DNA, 16 bp, Homo sapiens
ggggtagagaggacag

SEQ ID NO: 604073 - DNA, 22 bp, Homo sapiens
ggggtcgggggaggagcacccc

SEQ ID NO: 604074 - DNA, 20 bp, Homo sapiens
ggggtctctgagcagtgggg

SEQ ID NO: 604075 - DNA, 22 bp, Homo sapiens
ggggtgggggagaatggctctg

SEQ ID NO: 604076 - DNA, 18 bp, Homo sapiens
ggggttgggttccagaca

SEQ ID NO: 604077 - DNA, 23 bp, Homo sapiens
gggtaagggactccagaagcagc

SEQ ID NO: 604078 - DNA, 12 bp, Homo sapiens
gggtacaggcag

SEQ ID NO: 604079 - DNA, 22 bp, Homo sapiens
gggtatctcaaatctgctttca

SEQ ID NO: 604080 - DNA, 16 bp, Homo sapiens
gggtattttgtcagtt

SEQ ID NO: 604081 - DNA, 20 bp, Homo sapiens
gggtcagcaggggggttggg

SEQ ID NO: 604082 - DNA, 13 bp, Homo sapiens
gggtccaggcccg

SEQ ID NO: 604083 - DNA, 18 bp, Homo sapiens
gggtcccccctgagtggg

SEQ ID NO: 604084 - DNA, 14 bp, Homo sapiens
gggtccccctcctg

SEQ ID NO: 604085 - DNA, 12 bp, Homo sapiens
gggtccccggac

SEQ ID NO: 604086 - DNA, 17 bp, Homo sapiens
gggtcctgagtggctga

SEQ ID NO: 604087 - DNA, 13 bp, Homo sapiens
gggtcgcccctcc

SEQ ID NO: 604088 - DNA, 19 bp, Homo sapiens
gggtcgggggaggagcacc

SEQ ID NO: 604089 - DNA, 19 bp, Homo sapiens
gggtctcgcagcctgaagc

SEQ ID NO: 604090 - DNA, 13 bp, Homo sapiens
gggtctctgagca

SEQ ID NO: 604091 - DNA, 22 bp, Homo sapiens
gggtgaggcgtgggatccagag

SEQ ID NO: 604092 - DNA, 15 bp, Homo sapiens
gggtgcaggcgcgca

SEQ ID NO: 604093 - DNA, 19 bp, Homo sapiens
gggtgccccacaaggccca

SEQ ID NO: 604094 - DNA, 18 bp, Homo sapiens
gggtgcgtgaccggcccg

SEQ ID NO: 604095 - DNA, 15 bp, Homo sapiens
gggtggctggagccc

SEQ ID NO: 604096 - DNA, 14 bp, Homo sapiens
gggtggggcttgga

SEQ ID NO: 604097 - DNA, 11 bp, Homo sapiens
gggtgtcagta

SEQ ID NO: 604098 - DNA, 12 bp, Homo sapiens
gggtgtggcttg

SEQ ID NO: 604099 - DNA, 14 bp, Homo sapiens
gggtgtggcttgga

SEQ ID NO: 604100 - DNA, 19 bp, Homo sapiens
gggttaacagtaaatatac

SEQ ID NO: 604101 - DNA, 16 bp, Homo sapiens
gggttctagaaggggc

SEQ ID NO: 604102 - DNA, 14 bp, Homo sapiens
gggttctatattta

SEQ ID NO: 604103 - DNA, 14 bp, Homo sapiens
gggttctgccctgc

SEQ ID NO: 604104 - DNA, 15 bp, Homo sapiens
gggttggcagcgcct

SEQ ID NO: 604105 - DNA, 16 bp, Homo sapiens
gggttgggttccagac

SEQ ID NO: 604106 - DNA, 22 bp, Homo sapiens
ggtagaaactttggaagtttta

SEQ ID NO: 604107 - DNA, 21 bp, Homo sapiens
ggtatctcaaatctgctttca

SEQ ID NO: 604108 - DNA, 11 bp, Homo sapiens
ggtattgtctt

SEQ ID NO: 604109 - DNA, 21 bp, Homo sapiens
ggtatttactgcaatgtctgt

SEQ ID NO: 604110 - DNA, 15 bp, Homo sapiens
ggtattttaacatag

SEQ ID NO: 604111 - DNA, 16 bp, Homo sapiens
ggtattttaacatagc

SEQ ID NO: 604112 - DNA, 12 bp, Homo sapiens
ggtattttgtca

SEQ ID NO: 604113 - DNA, 11 bp, Homo sapiens
ggtcacaggca

SEQ ID NO: 604114 - DNA, 21 bp, Homo sapiens
ggtcagtgaagcccaggagga

SEQ ID NO: 604115 - DNA, 20 bp, Homo sapiens
ggtccaccccgtcccggccc

SEQ ID NO: 604116 - DNA, 22 bp, Homo sapiens
ggtccaccccgtcccggccccg

SEQ ID NO: 604117 - DNA, 12 bp, Homo sapiens
ggtccagccctc

SEQ ID NO: 604118 - DNA, 14 bp, Homo sapiens
ggtccagccctccg

SEQ ID NO: 604119 - DNA, 23 bp, Homo sapiens
ggtccagccctccgccagccctg

SEQ ID NO: 604120 - DNA, 22 bp, Homo sapiens
ggtcccagctacaggggaggct

SEQ ID NO: 604121 - DNA, 20 bp, Homo sapiens
ggtcctgctgctcgggaagg

SEQ ID NO: 604122 - DNA, 17 bp, Homo sapiens
ggtcctgggggctgctg

SEQ ID NO: 604123 - DNA, 21 bp, Homo sapiens
ggtccttaaaaaaaaaaatga

SEQ ID NO: 604124 - DNA, 15 bp, Homo sapiens
ggtccttagtaaatt

SEQ ID NO: 604125 - DNA, 21 bp, Homo sapiens
ctgccaggcctccctcgggct

SEQ ID NO: 604126 - DNA, 22 bp, Homo sapiens
ctgccaggcctccctcgggctg

SEQ ID NO: 604127 - DNA, 20 bp, Homo sapiens
ctgccatccttgctgcagct

SEQ ID NO: 604128 - DNA, 16 bp, Homo sapiens
ctgcccacatttgggc

SEQ ID NO: 604129 - DNA, 12 bp, Homo sapiens
ctgcccaccctg

SEQ ID NO: 604130 - DNA, 17 bp, Homo sapiens
ctgcccaccctgggcct

SEQ ID NO: 604131 - DNA, 19 bp, Homo sapiens
ctgcccacgtgcagcacct

SEQ ID NO: 604132 - DNA, 22 bp, Homo sapiens
ctgcccacgtgcagcacctgtc

SEQ ID NO: 604133 - DNA, 16 bp, Homo sapiens
ctgcccagcacctcct

SEQ ID NO: 604134 - DNA, 22 bp, Homo sapiens
ctgcccaggggacgtggcgctg

SEQ ID NO: 604135 - DNA, 19 bp, Homo sapiens
ctgccccaggggcactgtg

SEQ ID NO: 604136 - DNA, 19 bp, Homo sapiens
ctgcccccccaccccactc

SEQ ID NO: 604137 - DNA, 12 bp, Homo sapiens
ctgccccccttc

SEQ ID NO: 604138 - DNA, 20 bp, Homo sapiens
ctgccccccttcccacccct

SEQ ID NO: 604139 - DNA, 22 bp, Homo sapiens
ctgccccccttcccacccctat

SEQ ID NO: 604140 - DNA, 18 bp, Homo sapiens
ctgccccctcccccgcag

SEQ ID NO: 604141 - DNA, 20 bp, Homo sapiens
ctgccccctggctttggcgc

SEQ ID NO: 604142 - DNA, 20 bp, Homo sapiens
ctgcccctcttccctggcca

SEQ ID NO: 604143 - DNA, 17 bp, Homo sapiens
ctgccccttgaccccac

SEQ ID NO: 604144 - DNA, 16 bp, Homo sapiens
ctgcccgcgggtggct

SEQ ID NO: 604145 - DNA, 13 bp, Homo sapiens
ctgccctccccca

SEQ ID NO: 604146 - DNA, 17 bp, Homo sapiens
ctgccctcccccacggc

SEQ ID NO: 604147 - DNA, 22 bp, Homo sapiens
ctgccctcccccacggccgtcc

SEQ ID NO: 604148 - DNA, 16 bp, Homo sapiens
ctgccctccgcccttc

SEQ ID NO: 604149 - DNA, 19 bp, Homo sapiens
ctgccctccgcccttccct

SEQ ID NO: 604150 - DNA, 13 bp, Homo sapiens
ctgccctgcacct

SEQ ID NO: 604151 - DNA, 13 bp, Homo sapiens
ctgccctgcctga

SEQ ID NO: 604152 - DNA, 16 bp, Homo sapiens
ctgccgcatctgcctg

SEQ ID NO: 604153 - DNA, 19 bp, Homo sapiens
ctgccgcatctgcctggag

SEQ ID NO: 604154 - DNA, 15 bp, Homo sapiens
ctgcctcagccagtg

SEQ ID NO: 604155 - DNA, 17 bp, Homo sapiens
ctgcctcagccagtggc

SEQ ID NO: 604156 - DNA, 13 bp, Homo sapiens
ctgcctccctggg

SEQ ID NO: 604157 - DNA, 21 bp, Homo sapiens
ctgcctccctggggaccagga

SEQ ID NO: 604158 - DNA, 17 bp, Homo sapiens
ctgcctctatccctggc

SEQ ID NO: 604159 - DNA, 13 bp, Homo sapiens
ctgcctggagcct

SEQ ID NO: 604160 - DNA, 16 bp, Homo sapiens
ctgcctggagcctggg

SEQ ID NO: 604161 - DNA, 19 bp, Homo sapiens
ctgcctggagcctgggcag

SEQ ID NO: 604162 - DNA, 19 bp, Homo sapiens
ctgtgggggcggctgtggg

SEQ ID NO: 604163 - DNA, 14 bp, Homo sapiens
ctgtggtttgttat

SEQ ID NO: 604164 - DNA, 15 bp, Homo sapiens
ctgtgtaacctccac

SEQ ID NO: 604165 - DNA, 18 bp, Homo sapiens
ctgtgtaacctccacagt

SEQ ID NO: 604166 - DNA, 23 bp, Homo sapiens
ctgtgtaacctccacagtagcat

SEQ ID NO: 604167 - DNA, 19 bp, Homo sapiens
ctgtgtagctctgtccact

SEQ ID NO: 604168 - DNA, 18 bp, Homo sapiens
ctgtgtggcaaacattta

SEQ ID NO: 604169 - DNA, 21 bp, Homo sapiens
ctgtgtggcaaacatttaaaa

SEQ ID NO: 604170 - DNA, 15 bp, Homo sapiens
ctgtgttcagtgcct

SEQ ID NO: 604171 - DNA, 14 bp, Homo sapiens
ctgtgttctcaaca

SEQ ID NO: 604172 - DNA, 20 bp, Homo sapiens
ctgtgttctcaacacacagt

SEQ ID NO: 604173 - DNA, 21 bp, Homo sapiens
ctgtgttctcaacacacagta

SEQ ID NO: 604174 - DNA, 17 bp, Homo sapiens
ctgttagaattaggtaa

SEQ ID NO: 604175 - DNA, 17 bp, Homo sapiens
ctgttagctcagaggag

SEQ ID NO: 604176 - DNA, 17 bp, Homo sapiens
ctgttatctagaaatta

SEQ ID NO: 604177 - DNA, 20 bp, Homo sapiens
ctgttatctgtctttatgat

SEQ ID NO: 604178 - DNA, 18 bp, Homo sapiens
ctgttcacgtgactcctc

SEQ ID NO: 604179 - DNA, 14 bp, Homo sapiens
ctgttccaagtgtg

SEQ ID NO: 604180 - DNA, 21 bp, Homo sapiens
ctgttccaagtgtgtgtgcaa

SEQ ID NO: 604181 - DNA, 23 bp, Homo sapiens
ctgttcccagcaaagttttcaga

SEQ ID NO: 604182 - DNA, 15 bp, Homo sapiens
ctgttccgcctcact

SEQ ID NO: 604183 - DNA, 15 bp, Homo sapiens
ctgttctaactagta

SEQ ID NO: 604184 - DNA, 19 bp, Homo sapiens
ctgttctaactagtaatct

SEQ ID NO: 604185 - DNA, 16 bp, Homo sapiens
ctgttgaagtgcatgt

SEQ ID NO: 604186 - DNA, 17 bp, Homo sapiens
ctgttgaagtgcatgtt

SEQ ID NO: 604187 - DNA, 18 bp, Homo sapiens
ctgttgacctaccctgga

SEQ ID NO: 604188 - DNA, 23 bp, Homo sapiens
ctgttgcccttttccttgactat

SEQ ID NO: 604189 - DNA, 22 bp, Homo sapiens
ctgttgtaatatcagttacagt

SEQ ID NO: 604190 - DNA, 17 bp, Homo sapiens
ctgttgtgtctggagcc

SEQ ID NO: 604191 - DNA, 22 bp, Homo sapiens
ctgtttaccctccctgtcccct

SEQ ID NO: 604192 - DNA, 14 bp, Homo sapiens
ctgtttactgacat

SEQ ID NO: 604193 - DNA, 13 bp, Homo sapiens
ctgtttctcctcc

SEQ ID NO: 604194 - DNA, 13 bp, Homo sapiens
ctgtttgcttcta

SEQ ID NO: 604195 - DNA, 13 bp, Homo sapiens
ctgttttgggcct

SEQ ID NO: 604196 - DNA, 14 bp, Homo sapiens
ctgttttgggcctc

SEQ ID NO: 604197 - DNA, 21 bp, Homo sapiens
cttaaaattggttaatgaaaa

SEQ ID NO: 604198 - DNA, 11 bp, Homo sapiens
cttaaacattt

SEQ ID NO: 604199 - DNA, 12 bp, Homo sapiens
cttaaacatttt

SEQ ID NO: 604200 - DNA, 16 bp, Homo sapiens
cttaaacattttttgt

SEQ ID NO: 604201 - DNA, 16 bp, Homo sapiens
cttaaacctgtgcttt

SEQ ID NO: 604202 - DNA, 22 bp, Homo sapiens
cttaaacctgtgctttcatgtt

SEQ ID NO: 604203 - DNA, 16 bp, Homo sapiens
cttaacataaacttgt

SEQ ID NO: 604204 - DNA, 20 bp, Homo sapiens
cttaacccccatttttgtaa

SEQ ID NO: 604205 - DNA, 21 bp, Homo sapiens
cttaagaagtatccctgattt

SEQ ID NO: 604206 - DNA, 18 bp, Homo sapiens
cttaagatctgactgcca

SEQ ID NO: 604207 - DNA, 13 bp, Homo sapiens
cttaaggaaaaga

SEQ ID NO: 604208 - DNA, 16 bp, Homo sapiens
cttaaggacagtgttc

SEQ ID NO: 604209 - DNA, 21 bp, Homo sapiens
cttaaggacagtgttcaaatt

SEQ ID NO: 604210 - DNA, 18 bp, Homo sapiens
cttaagggttttttagaa

SEQ ID NO: 604211 - DNA, 18 bp, Homo sapiens
cttaataggcctaaaata

SEQ ID NO: 604212 - DNA, 16 bp, Homo sapiens
cttacaaagccagctc

SEQ ID NO: 604213 - DNA, 18 bp, Homo sapiens
cttacaaagccagctctg

SEQ ID NO: 604214 - DNA, 20 bp, Homo sapiens
cttacacacctgagaatgtg

SEQ ID NO: 604215 - DNA, 17 bp, Homo sapiens
cttacacgaagaaatag

SEQ ID NO: 604216 - DNA, 16 bp, Homo sapiens
cttacactgaaatcca

SEQ ID NO: 604217 - DNA, 18 bp, Homo sapiens
cttacagaagggagtgaa

SEQ ID NO: 604218 - DNA, 18 bp, Homo sapiens
cttaccccgtccctttcc

SEQ ID NO: 604219 - DNA, 20 bp, Homo sapiens
cttaccccgtccctttccct

SEQ ID NO: 604220 - DNA, 23 bp, Homo sapiens
cttaccccgtccctttccctgca

SEQ ID NO: 604221 - DNA, 17 bp, Homo sapiens
cttaccgaaatgaaaat

SEQ ID NO: 604222 - DNA, 11 bp, Homo sapiens
cttagaatgtg

SEQ ID NO: 604223 - DNA, 20 bp, Homo sapiens
cttagagataccctctgaga

SEQ ID NO: 604224 - DNA, 19 bp, Homo sapiens
cttagcctttaataggctt

SEQ ID NO: 604225 - DNA, 15 bp, Homo sapiens
cttagcgttctgttt

SEQ ID NO: 604226 - DNA, 16 bp, Homo sapiens
cttaggatttaccaaa

SEQ ID NO: 604227 - DNA, 18 bp, Homo sapiens
cttagtaaattcctaatt

SEQ ID NO: 604228 - DNA, 17 bp, Homo sapiens
cttagtatctcatcaac

SEQ ID NO: 604229 - DNA, 17 bp, Homo sapiens
cttagtgtcccttacct

SEQ ID NO: 604230 - DNA, 19 bp, Homo sapiens
cttagttaatctttgaaaa

SEQ ID NO: 604231 - DNA, 18 bp, Homo sapiens
cttatattattttctgta

SEQ ID NO: 604232 - DNA, 13 bp, Homo sapiens
cttatggaacact

SEQ ID NO: 604233 - DNA, 21 bp, Homo sapiens
cttattcatgctttctccttt

SEQ ID NO: 604234 - DNA, 22 bp, Homo sapiens
cttattcatgctttctcctttt

SEQ ID NO: 604235 - DNA, 15 bp, Homo sapiens
cttattcctaattcc

SEQ ID NO: 604236 - DNA, 18 bp, Homo sapiens
cttatttgctcataagta

SEQ ID NO: 604237 - DNA, 18 bp, Homo sapiens
cttatttgtttggtcact

SEQ ID NO: 604238 - DNA, 20 bp, Homo sapiens
cttatttgtttggtcactgc

SEQ ID NO: 604239 - DNA, 16 bp, Homo sapiens
cttcaaacgaaatggc

SEQ ID NO: 604240 - DNA, 13 bp, Homo sapiens
cttcaaatacatt

SEQ ID NO: 604241 - DNA, 23 bp, Homo sapiens
cttcaaatgtcatttcatacaaa

SEQ ID NO: 604242 - DNA, 18 bp, Homo sapiens
cttcaagcaccctgttcc

SEQ ID NO: 604243 - DNA, 20 bp, Homo sapiens
cttcaagcaccctgttccct

SEQ ID NO: 604244 - DNA, 16 bp, Homo sapiens
cttcaaggatcctgag

SEQ ID NO: 604245 - DNA, 18 bp, Homo sapiens
cttcaaggatcctgagcc

SEQ ID NO: 604246 - DNA, 13 bp, Homo sapiens
cttcaatgttaaa

SEQ ID NO: 604247 - DNA, 19 bp, Homo sapiens
cttcacacaaagtgaaatt

SEQ ID NO: 604248 - DNA, 20 bp, Homo sapiens
cttcacacaaagtgaaatta

SEQ ID NO: 604249 - DNA, 16 bp, Homo sapiens
cttcacacatttataa

SEQ ID NO: 604250 - DNA, 13 bp, Homo sapiens
cttcacatagttt

SEQ ID NO: 604251 - DNA, 20 bp, Homo sapiens
ctctttctttcttttgtgtt

SEQ ID NO: 604252 - DNA, 14 bp, Homo sapiens
ctctttcttttgtg

SEQ ID NO: 604253 - DNA, 15 bp, Homo sapiens
ctgaaacatagatag

SEQ ID NO: 604254 - DNA, 18 bp, Homo sapiens
ctgaaataaaagcctctg

SEQ ID NO: 604255 - DNA, 19 bp, Homo sapiens
ctgaaataaaagcctctgg

SEQ ID NO: 604256 - DNA, 16 bp, Homo sapiens
ctgaaattagtgtttt

SEQ ID NO: 604257 - DNA, 18 bp, Homo sapiens
ctgaactgcaacactgga

SEQ ID NO: 604258 - DNA, 12 bp, Homo sapiens
ctgaagcagagt

SEQ ID NO: 604259 - DNA, 16 bp, Homo sapiens
ctgaaggggaaaacct

SEQ ID NO: 604260 - DNA, 20 bp, Homo sapiens
ctgaaggggaaaacctcagt

SEQ ID NO: 604261 - DNA, 23 bp, Homo sapiens
ctgaagtagtgtgagtgttagaa

SEQ ID NO: 604262 - DNA, 17 bp, Homo sapiens
ctgaagtcccttcctgt

SEQ ID NO: 604263 - DNA, 15 bp, Homo sapiens
ctgaataacaacaat

SEQ ID NO: 604264 - DNA, 15 bp, Homo sapiens
ctgaatcagaggcag

SEQ ID NO: 604265 - DNA, 22 bp, Homo sapiens
ctgaatccatcaggacttggga

SEQ ID NO: 604266 - DNA, 17 bp, Homo sapiens
ctgaatctctcaaaatg

SEQ ID NO: 604267 - DNA, 14 bp, Homo sapiens
ctgaatctgagaaa

SEQ ID NO: 604268 - DNA, 18 bp, Homo sapiens
ctgaatgctatttgtgta

SEQ ID NO: 604269 - DNA, 20 bp, Homo sapiens
ctgaatgctatttgtgtaac

SEQ ID NO: 604270 - DNA, 15 bp, Homo sapiens
ctgaattcattgtct

SEQ ID NO: 604271 - DNA, 15 bp, Homo sapiens
ctgaattggctgcca

SEQ ID NO: 604272 - DNA, 16 bp, Homo sapiens
ctgaattgttatgtaa

SEQ ID NO: 604273 - DNA, 20 bp, Homo sapiens
ctgaattgttatgtaaacat

SEQ ID NO: 604274 - DNA, 23 bp, Homo sapiens
ctgaattgttatgtaaacatcat

SEQ ID NO: 604275 - DNA, 14 bp, Homo sapiens
ctgaattttcacat

SEQ ID NO: 604276 - DNA, 17 bp, Homo sapiens
ctgacactcagatgccc

SEQ ID NO: 604277 - DNA, 16 bp, Homo sapiens
ctgacagcaaacacag

SEQ ID NO: 604278 - DNA, 13 bp, Homo sapiens
ctgacatgctaac

SEQ ID NO: 604279 - DNA, 14 bp, Homo sapiens
ctgacatggtgctg

SEQ ID NO: 604280 - DNA, 15 bp, Homo sapiens
ctgacatggtgctgt

SEQ ID NO: 604281 - DNA, 17 bp, Homo sapiens
ctgacatggtgctgtgt

SEQ ID NO: 604282 - DNA, 22 bp, Homo sapiens
ctgacattcctaagagtggagg

SEQ ID NO: 604283 - DNA, 12 bp, Homo sapiens
ctgaccctcact

SEQ ID NO: 604284 - DNA, 24 bp, Homo sapiens
ctgaccctcacttttctcatctgt

SEQ ID NO: 604285 - DNA, 19 bp, Homo sapiens
ctgaccttcggcagtggct

SEQ ID NO: 604286 - DNA, 12 bp, Homo sapiens
ctgactgtgggg

SEQ ID NO: 604287 - DNA, 13 bp, Homo sapiens
ctgacttcccagc

SEQ ID NO: 604288 - DNA, 16 bp, Homo sapiens
ctgacttcccagctgg

SEQ ID NO: 604289 - DNA, 18 bp, Homo sapiens
ctgacttcccagctggca

SEQ ID NO: 604290 - DNA, 14 bp, Homo sapiens
ctgacttctggaga

SEQ ID NO: 604291 - DNA, 11 bp, Homo sapiens
ctgagaatgtg

SEQ ID NO: 604292 - DNA, 11 bp, Homo sapiens
ctgagaccacg

SEQ ID NO: 604293 - DNA, 23 bp, Homo sapiens
ctgagaccacggtccaatccagc

SEQ ID NO: 604294 - DNA, 17 bp, Homo sapiens
ctgagacgcaaggatca

SEQ ID NO: 604295 - DNA, 17 bp, Homo sapiens
tatacctgtacacacac

SEQ ID NO: 604296 - DNA, 20 bp, Homo sapiens
tatacctgtacacacacaga

SEQ ID NO: 604297 - DNA, 23 bp, Homo sapiens
tatactatttattaaaaccattc

SEQ ID NO: 604298 - DNA, 21 bp, Homo sapiens
tatactcatttggatataaat

SEQ ID NO: 604299 - DNA, 20 bp, Homo sapiens
tatactccttaaaaatgtat

SEQ ID NO: 604300 - DNA, 18 bp, Homo sapiens
tatagagttcatagaaat

SEQ ID NO: 604301 - DNA, 17 bp, Homo sapiens
tatagatggtagaaact

SEQ ID NO: 604302 - DNA, 13 bp, Homo sapiens
tatagcatgtaat

SEQ ID NO: 604303 - DNA, 19 bp, Homo sapiens
tataggacttaatttagca

SEQ ID NO: 604304 - DNA, 17 bp, Homo sapiens
tatagggtttgtttgct

SEQ ID NO: 604305 - DNA, 13 bp, Homo sapiens
tatataaaataca

SEQ ID NO: 604306 - DNA, 20 bp, Homo sapiens
tatataaaatacacgtgtat

SEQ ID NO: 604307 - DNA, 18 bp, Homo sapiens
tatatacaaagctgtcac

SEQ ID NO: 604308 - DNA, 21 bp, Homo sapiens
tatatagagacttctaaatca

SEQ ID NO: 604309 - DNA, 13 bp, Homo sapiens
tatatataaatat

SEQ ID NO: 604310 - DNA, 13 bp, Homo sapiens
tatatatatatgt

SEQ ID NO: 604311 - DNA, 14 bp, Homo sapiens
tatatatatatgta

SEQ ID NO: 604312 - DNA, 12 bp, Homo sapiens
tatatatatgtg

SEQ ID NO: 604313 - DNA, 13 bp, Homo sapiens
tatatatatgtga

SEQ ID NO: 604314 - DNA, 13 bp, Homo sapiens
tatatatgtgaac

SEQ ID NO: 604315 - DNA, 20 bp, Homo sapiens
tatatatttatcatatttaa

SEQ ID NO: 604316 - DNA, 20 bp, Homo sapiens
tatatatttattattttcat

SEQ ID NO: 604317 - DNA, 11 bp, Homo sapiens
tatatcagctc

SEQ ID NO: 604318 - DNA, 13 bp, Homo sapiens
tatatcagctcta

SEQ ID NO: 604319 - DNA, 16 bp, Homo sapiens
tatatcagctctaaag

SEQ ID NO: 604320 - DNA, 18 bp, Homo sapiens
tatatctgtggtcttcaa

SEQ ID NO: 604321 - DNA, 15 bp, Homo sapiens
tatatgtatatattt

SEQ ID NO: 604322 - DNA, 12 bp, Homo sapiens
tatatgtatatt

SEQ ID NO: 604323 - DNA, 14 bp, Homo sapiens
tatatgtttataca

SEQ ID NO: 604324 - DNA, 15 bp, Homo sapiens
tatatgtttatacac

SEQ ID NO: 604325 - DNA, 16 bp, Homo sapiens
tatatgtttatacaca

SEQ ID NO: 604326 - DNA, 20 bp, Homo sapiens
tatatgtttatacacacagg

SEQ ID NO: 604327 - DNA, 15 bp, Homo sapiens
tatattaaaattgat

SEQ ID NO: 604328 - DNA, 13 bp, Homo sapiens
tatattatatata

SEQ ID NO: 604329 - DNA, 21 bp, Homo sapiens
tatattgaagtaagttcatca

SEQ ID NO: 604330 - DNA, 13 bp, Homo sapiens
tatatttactgtt

SEQ ID NO: 604331 - DNA, 14 bp, Homo sapiens
tatatttactgttt

SEQ ID NO: 604332 - DNA, 18 bp, Homo sapiens
tatatttactgtttataa

SEQ ID NO: 604333 - DNA, 20 bp, Homo sapiens
tatatttatcatatttaata

SEQ ID NO: 604334 - DNA, 18 bp, Homo sapiens
tatatttattattttcat

SEQ ID NO: 604335 - DNA, 16 bp, Homo sapiens
tatcacagtctaattt

SEQ ID NO: 604336 - DNA, 17 bp, Homo sapiens
tatcagaaagatcaaat

SEQ ID NO: 604337 - DNA, 22 bp, Homo sapiens
tatcagaactcctttctaagga

SEQ ID NO: 604338 - DNA, 17 bp, Homo sapiens
tatcagggcaagctcat

SEQ ID NO: 604339 - DNA, 21 bp, Homo sapiens
tatcagggcccaaataacagt

SEQ ID NO: 604340 - DNA, 13 bp, Homo sapiens
tatcagtggttcg

SEQ ID NO: 604341 - DNA, 16 bp, Homo sapiens
tatcagttacagtggc

SEQ ID NO: 604342 - DNA, 21 bp, Homo sapiens
tatcagttacagtggcagtat

SEQ ID NO: 604343 - DNA, 21 bp, Homo sapiens
tatcatacgttgatagtttac

SEQ ID NO: 604344 - DNA, 13 bp, Homo sapiens
tatcatgtgtttc

SEQ ID NO: 604345 - DNA, 16 bp, Homo sapiens
tatcattcttataaca

SEQ ID NO: 604346 - DNA, 20 bp, Homo sapiens
tatcattgtttgtcctttat

SEQ ID NO: 604347 - DNA, 19 bp, Homo sapiens
tatccctggacgcatgcag

SEQ ID NO: 604348 - DNA, 16 bp, Homo sapiens
tatccctggccacctg

SEQ ID NO: 604349 - DNA, 19 bp, Homo sapiens
tatccctggccacctgcca

SEQ ID NO: 604350 - DNA, 16 bp, Homo sapiens
tatcctcaagttgtgt

SEQ ID NO: 604351 - DNA, 15 bp, Homo sapiens
tatcctgcaccctct

SEQ ID NO: 604352 - DNA, 16 bp, Homo sapiens
tatctagtaggtctgc

SEQ ID NO: 604353 - DNA, 17 bp, Homo sapiens
tatctcgctagccatat

SEQ ID NO: 604354 - DNA, 20 bp, Homo sapiens
tatctcgctagccatatatt

SEQ ID NO: 604355 - DNA, 13 bp, Homo sapiens
tatctgaaaactg

SEQ ID NO: 604356 - DNA, 15 bp, Homo sapiens
tatctgatatctgtt

SEQ ID NO: 604357 - DNA, 22 bp, Homo sapiens
tatctgggttttagaaattcta

SEQ ID NO: 604358 - DNA, 14 bp, Homo sapiens
tatctgtctgagcc

SEQ ID NO: 604359 - DNA, 17 bp, Homo sapiens
tatctgtctgagccctg

SEQ ID NO: 604360 - DNA, 14 bp, Homo sapiens
tatctgtctttatg

SEQ ID NO: 604361 - DNA, 16 bp, Homo sapiens
tatctgtctttatgat

SEQ ID NO: 604362 - DNA, 13 bp, Homo sapiens
tatcttaaaattg

SEQ ID NO: 604363 - DNA, 18 bp, Homo sapiens
tatcttaaaattggttaa

SEQ ID NO: 604364 - DNA, 19 bp, Homo sapiens
tatcttaaacccacataaa

SEQ ID NO: 604365 - DNA, 14 bp, Homo sapiens
tatctttcaggaaa

SEQ ID NO: 604366 - DNA, 19 bp, Homo sapiens
tatgaaacaaatatactca

SEQ ID NO: 604367 - DNA, 15 bp, Homo sapiens
tatgaagcagaatga

SEQ ID NO: 604368 - DNA, 23 bp, Homo sapiens
tatgaagccctaagtaaatctaa

SEQ ID NO: 604369 - DNA, 15 bp, Homo sapiens
tatgactttgaataa

SEQ ID NO: 604370 - DNA, 22 bp, Homo sapiens
tatgagattggaaaaaattaga

SEQ ID NO: 604371 - DNA, 19 bp, Homo sapiens
tatgaggatgtatgtgtat

SEQ ID NO: 604372 - DNA, 13 bp, Homo sapiens
tatgataaatttg

SEQ ID NO: 604373 - DNA, 15 bp, Homo sapiens
tatgattaaactggg

SEQ ID NO: 604374 - DNA, 16 bp, Homo sapiens
tatgattaaattatca

SEQ ID NO: 604375 - DNA, 12 bp, Homo sapiens
tatgatttcatg

SEQ ID NO: 604376 - DNA, 18 bp, Homo sapiens
tcaaatggatgtaatata

SEQ ID NO: 604377 - DNA, 15 bp, Homo sapiens
tcaaatggtattttt

SEQ ID NO: 604378 - DNA, 23 bp, Homo sapiens
tcaaatggtattttttgtgaatg

SEQ ID NO: 604379 - DNA, 12 bp, Homo sapiens
tcaaattaaata

SEQ ID NO: 604380 - DNA, 14 bp, Homo sapiens
tcaaattctgatta

SEQ ID NO: 604381 - DNA, 19 bp, Homo sapiens
tcaaattctgattattaca

SEQ ID NO: 604382 - DNA, 23 bp, Homo sapiens
tcaaattctgattattacaacaa

SEQ ID NO: 604383 - DNA, 18 bp, Homo sapiens
tcaacacacagtatagat

SEQ ID NO: 604384 - DNA, 21 bp, Homo sapiens
tcaacacacagtatagataaa

SEQ ID NO: 604385 - DNA, 16 bp, Homo sapiens
tcaacagtgaacagct

SEQ ID NO: 604386 - DNA, 17 bp, Homo sapiens
tcaacagtgaacagctt

SEQ ID NO: 604387 - DNA, 15 bp, Homo sapiens
tcaaccacacctaaa

SEQ ID NO: 604388 - DNA, 18 bp, Homo sapiens
tcaaccacacctaaatta

SEQ ID NO: 604389 - DNA, 22 bp, Homo sapiens
tcaagaaagcagtatatattct

SEQ ID NO: 604390 - DNA, 15 bp, Homo sapiens
tcaagaatcttttgt

SEQ ID NO: 604391 - DNA, 22 bp, Homo sapiens
tcaagattaagttataccagca

SEQ ID NO: 604392 - DNA, 16 bp, Homo sapiens
tcaagcaccctgttcc

SEQ ID NO: 604393 - DNA, 14 bp, Homo sapiens
tcaagccaggagac

SEQ ID NO: 604394 - DNA, 20 bp, Homo sapiens
tcaagctttttgtgagaaag

SEQ ID NO: 604395 - DNA, 20 bp, Homo sapiens
tcaaggagggagaaaggcaa

SEQ ID NO: 604396 - DNA, 15 bp, Homo sapiens
tcaaggctgcagtga

SEQ ID NO: 604397 - DNA, 11 bp, Homo sapiens
tcaagtctgtg

SEQ ID NO: 604398 - DNA, 15 bp, Homo sapiens
tcaataactattgct

SEQ ID NO: 604399 - DNA, 16 bp, Homo sapiens
tcaataactattgctg

SEQ ID NO: 604400 - DNA, 22 bp, Homo sapiens
tcaataggaaaaactgattttt

SEQ ID NO: 604401 - DNA, 20 bp, Homo sapiens
tcaatccacagtattgttct

SEQ ID NO: 604402 - DNA, 16 bp, Homo sapiens
tcaatgctacaaaatg

SEQ ID NO: 604403 - DNA, 14 bp, Homo sapiens
tcaatgtactgtat

SEQ ID NO: 604404 - DNA, 16 bp, Homo sapiens
tcaatgtactgtattg

SEQ ID NO: 604405 - DNA, 12 bp, Homo sapiens
tcaatgtgaaat

SEQ ID NO: 604406 - DNA, 17 bp, Homo sapiens
tcaatgtgaaataaaga

SEQ ID NO: 604407 - DNA, 19 bp, Homo sapiens
tcaatgtgaaataaagagt

SEQ ID NO: 604408 - DNA, 17 bp, Homo sapiens
tcaatgttaaatctaca

SEQ ID NO: 604409 - DNA, 22 bp, Homo sapiens
tcaatgttcacgcaacttgaaa

SEQ ID NO: 604410 - DNA, 19 bp, Homo sapiens
tcaattctgaaggggaaaa

SEQ ID NO: 604411 - DNA, 21 bp, Homo sapiens
tcaatttcagaaactaagaat

SEQ ID NO: 604412 - DNA, 23 bp, Homo sapiens
tcaatttcagaaactaagaatca

SEQ ID NO: 604413 - DNA, 13 bp, Homo sapiens
tcaatttctcctt

SEQ ID NO: 604414 - DNA, 17 bp, Homo sapiens
tcaattttggtttttct

SEQ ID NO: 604415 - DNA, 23 bp, Homo sapiens
tcaattttggtttttctcatttg

SEQ ID NO: 604416 - DNA, 15 bp, Homo sapiens
tcaatttttaactta

SEQ ID NO: 604417 - DNA, 15 bp, Homo sapiens
tcacaaagctattta

SEQ ID NO: 604418 - DNA, 13 bp, Homo sapiens
aaaaaaaaatatg

SEQ ID NO: 604419 - DNA, 13 bp, Homo sapiens
aaaaaaaatatga

SEQ ID NO: 604420 - DNA, 11 bp, Homo sapiens
aaaaaagtaat

SEQ ID NO: 604421 - DNA, 16 bp, Homo sapiens
aaaaaataaaacattt

SEQ ID NO: 604422 - DNA, 22 bp, Homo sapiens
aaaaactcctgttttcacacct

SEQ ID NO: 604423 - DNA, 18 bp, Homo sapiens
aaaaactggaaacatctg

SEQ ID NO: 604424 - DNA, 22 bp, Homo sapiens
aaaaactggaaacatctgattt

SEQ ID NO: 604425 - DNA, 13 bp, Homo sapiens
aaaaactttccat

SEQ ID NO: 604426 - DNA, 20 bp, Homo sapiens
aaaaactttccatgacagta

SEQ ID NO: 604427 - DNA, 22 bp, Homo sapiens
aaaaactttccatgacagtagc

SEQ ID NO: 604428 - DNA, 22 bp, Homo sapiens
aaaaagatggatttgacacact

SEQ ID NO: 604429 - DNA, 14 bp, Homo sapiens
aaaaagcatgtaca

SEQ ID NO: 604430 - DNA, 18 bp, Homo sapiens
aaaaagcatgtacagtgt

SEQ ID NO: 604431 - DNA, 21 bp, Homo sapiens
aaaaagcatgtacagtgttct

SEQ ID NO: 604432 - DNA, 13 bp, Homo sapiens
aaaaagcattaaa

SEQ ID NO: 604433 - DNA, 20 bp, Homo sapiens
aaaaagcttaaacattgcct

SEQ ID NO: 604434 - DNA, 16 bp, Homo sapiens
aaaaagtgcaacttga

SEQ ID NO: 604435 - DNA, 14 bp, Homo sapiens
aaaaataaaacatt

SEQ ID NO: 604436 - DNA, 16 bp, Homo sapiens
aaaaataatataaatg

SEQ ID NO: 604437 - DNA, 18 bp, Homo sapiens
aaaaatcaaaaaattatc

SEQ ID NO: 604438 - DNA, 22 bp, Homo sapiens
aaaacaacagcaacaacaacag

SEQ ID NO: 604439 - DNA, 22 bp, Homo sapiens
aaaacaagagaccacttcctta

SEQ ID NO: 604440 - DNA, 16 bp, Homo sapiens
aaaacagaaaaacaaa

SEQ ID NO: 604441 - DNA, 19 bp, Homo sapiens
aaaaccccacagaaatctc

SEQ ID NO: 604442 - DNA, 24 bp, Homo sapiens
aaaacccttggtctgtgttctcaa

SEQ ID NO: 604443 - DNA, 21 bp, Homo sapiens
aaaacctcagttggcctctgc

SEQ ID NO: 604444 - DNA, 14 bp, Homo sapiens
aaaacgtggctgct

SEQ ID NO: 604445 - DNA, 13 bp, Homo sapiens
aaaactaagttct

SEQ ID NO: 604446 - DNA, 18 bp, Homo sapiens
aaaactgatttttttttc

SEQ ID NO: 604447 - DNA, 15 bp, Homo sapiens
aaaactgtactgtgt

SEQ ID NO: 604448 - DNA, 11 bp, Homo sapiens
aaaactgtgac

SEQ ID NO: 604449 - DNA, 15 bp, Homo sapiens
aaaactgtgacattc

SEQ ID NO: 604450 - DNA, 17 bp, Homo sapiens
aaaactgtgacattcca

SEQ ID NO: 604451 - DNA, 15 bp, Homo sapiens
aaaactttccatgac

SEQ ID NO: 604452 - DNA, 13 bp, Homo sapiens
aaaagaaataagt

SEQ ID NO: 604453 - DNA, 14 bp, Homo sapiens
aaaagacatccaca

SEQ ID NO: 604454 - DNA, 24 bp, Homo sapiens
aaaagacccactgaatctgagaaa

SEQ ID NO: 604455 - DNA, 13 bp, Homo sapiens
aaaagcatgtaca

SEQ ID NO: 604456 - DNA, 14 bp, Homo sapiens
aaaagcatgtacag

SEQ ID NO: 604457 - DNA, 18 bp, Homo sapiens
aaaagcccatgcttaaat

SEQ ID NO: 604458 - DNA, 16 bp, Homo sapiens
aaaagcctctggtgga

SEQ ID NO: 604459 - DNA, 22 bp, Homo sapiens
aaaaggctggatgtgctttcat

SEQ ID NO: 604460 - DNA, 12 bp, Homo sapiens
aaaagtgatgtg

SEQ ID NO: 604461 - DNA, 21 bp, Homo sapiens
aaaagtgatgtgatttatgca

SEQ ID NO: 604462 - DNA, 16 bp, Homo sapiens
aaaataaaacatttta

SEQ ID NO: 604463 - DNA, 21 bp, Homo sapiens
aaaataaagctaccatgttaa

SEQ ID NO: 604464 - DNA, 13 bp, Homo sapiens
aaaataagccaaa

SEQ ID NO: 604465 - DNA, 12 bp, Homo sapiens
aaaataatactt

SEQ ID NO: 604466 - DNA, 21 bp, Homo sapiens
aaaatagagagtatacagtcc

SEQ ID NO: 604467 - DNA, 15 bp, Homo sapiens
aaaatagctataaat

SEQ ID NO: 604468 - DNA, 20 bp, Homo sapiens
aaaatagttgagccagcaga

SEQ ID NO: 604469 - DNA, 11 bp, Homo sapiens
aaaatattctg

SEQ ID NO: 604470 - DNA, 16 bp, Homo sapiens
aaaatattttcttaat

SEQ ID NO: 604471 - DNA, 18 bp, Homo sapiens
aaaatattttcttaatta

SEQ ID NO: 604472 - DNA, 20 bp, Homo sapiens
aaaatcagaaagacattctt

SEQ ID NO: 604473 - DNA, 19 bp, Homo sapiens
aaaatcccatttatgcaat

SEQ ID NO: 604474 - DNA, 15 bp, Homo sapiens
aaaatccttcagcaa

SEQ ID NO: 604475 - DNA, 14 bp, Homo sapiens
aaaatctgaatttc

SEQ ID NO: 604476 - DNA, 14 bp, Homo sapiens
aaaatcttgaaagc

SEQ ID NO: 604477 - DNA, 17 bp, Homo sapiens
aaaatgaaatttaagca

SEQ ID NO: 604478 - DNA, 12 bp, Homo sapiens
aaaatgcaattt

SEQ ID NO: 604479 - DNA, 14 bp, Homo sapiens
aaaatgcaatttga

SEQ ID NO: 604480 - DNA, 20 bp, Homo sapiens
aaaatgcttgaccctgaaat

SEQ ID NO: 604481 - DNA, 19 bp, Homo sapiens
aaaatgctttctcatgcat

SEQ ID NO: 604482 - DNA, 19 bp, Homo sapiens
aaaatggcatttagcacag

SEQ ID NO: 604483 - DNA, 20 bp, Homo sapiens
aaaatggctgaagaaacaca

SEQ ID NO: 604484 - DNA, 20 bp, Homo sapiens
aaaatgtcaatttttaactt

SEQ ID NO: 604485 - DNA, 18 bp, Homo sapiens
aaaatgtgccgtctttgg

SEQ ID NO: 604486 - DNA, 18 bp, Homo sapiens
aaaatgtgtgcttggaaa

SEQ ID NO: 604487 - DNA, 19 bp, Homo sapiens
aaaatgtgtgcttggaaaa

SEQ ID NO: 604488 - DNA, 17 bp, Homo sapiens
aaaatgtgtttttcagt

SEQ ID NO: 604489 - DNA, 13 bp, Homo sapiens
aaaatgtttattt

SEQ ID NO: 604490 - DNA, 16 bp, Homo sapiens
aaaattatctttaaaa

SEQ ID NO: 604491 - DNA, 22 bp, Homo sapiens
aaaattatctttaaaacttact

SEQ ID NO: 604492 - DNA, 19 bp, Homo sapiens
aaaattattaaaaattata

SEQ ID NO: 604493 - DNA, 21 bp, Homo sapiens
aaaattattaaaaattataga

SEQ ID NO: 604494 - DNA, 17 bp, Homo sapiens
aaaattgattgtcaaat

SEQ ID NO: 604495 - DNA, 14 bp, Homo sapiens
aaaatttgacattg

SEQ ID NO: 604496 - DNA, 23 bp, Homo sapiens
aaaatttgacattgtcagaatgt

SEQ ID NO: 604497 - DNA, 13 bp, Homo sapiens
aaaatttttgtct

SEQ ID NO: 604498 - DNA, 21 bp, Homo sapiens
aaacaaaaactttccatgaca

SEQ ID NO: 604499 - DNA, 13 bp, Homo sapiens
aaacaaaatttat

SEQ ID NO: 604500 - DNA, 20 bp, Homo sapiens
aaacaaaatttatgtcattt

SEQ ID NO: 604501 - DNA, 15 bp, Homo sapiens
aaacaaattccttcc

SEQ ID NO: 604502 - DNA, 13 bp, Homo sapiens
aaacaacagcaac

SEQ ID NO: 604503 - DNA, 22 bp, Homo sapiens
aaacaagagaccacttccttaa

SEQ ID NO: 604504 - DNA, 18 bp, Homo sapiens
aaacaaggaaggacattt

SEQ ID NO: 604505 - DNA, 16 bp, Homo sapiens
aaacacacagactctg

SEQ ID NO: 604506 - DNA, 21 bp, Homo sapiens
aaacacggagtttccatttgg

SEQ ID NO: 604507 - DNA, 23 bp, Homo sapiens
aaacactaatggccaagtgtaca

SEQ ID NO: 604508 - DNA, 22 bp, Homo sapiens
aaacactgcttaaggaaaagag

SEQ ID NO: 604509 - DNA, 15 bp, Homo sapiens
aaacacttctcctta

SEQ ID NO: 604510 - DNA, 13 bp, Homo sapiens
aaacagaagaaaa

SEQ ID NO: 604511 - DNA, 21 bp, Homo sapiens
aaacagagatcataaagagca

SEQ ID NO: 604512 - DNA, 20 bp, Homo sapiens
aaacaggatacgatgactga

SEQ ID NO: 604513 - DNA, 19 bp, Homo sapiens
aaacataagccatggtgaa

SEQ ID NO: 604514 - DNA, 21 bp, Homo sapiens
aaacatagtggtattttaaca

SEQ ID NO: 604515 - DNA, 17 bp, Homo sapiens
aaacatctgatttctga

SEQ ID NO: 604516 - DNA, 16 bp, Homo sapiens
aaacatttccctgctg

SEQ ID NO: 604517 - DNA, 15 bp, Homo sapiens
aaaccaactctctac

SEQ ID NO: 604518 - DNA, 16 bp, Homo sapiens
aaaccaatttgttctg

SEQ ID NO: 604519 - DNA, 20 bp, Homo sapiens
aaaccacagctgggcagggt

SEQ ID NO: 604520 - DNA, 18 bp, Homo sapiens
aaaccatcattgaaatct

SEQ ID NO: 604521 - DNA, 19 bp, Homo sapiens
aaaccatgaaaagttttca

SEQ ID NO: 604522 - DNA, 15 bp, Homo sapiens
aaacccacataaaca

SEQ ID NO: 604523 - DNA, 19 bp, Homo sapiens
aaacccacataaacacttc

SEQ ID NO: 604524 - DNA, 12 bp, Homo sapiens
aaacccctgaca

SEQ ID NO: 604525 - DNA, 17 bp, Homo sapiens
aaacctactgcccacat

SEQ ID NO: 604526 - DNA, 22 bp, Homo sapiens
aaacctcagttggcctctgccc

SEQ ID NO: 604527 - DNA, 15 bp, Homo sapiens
aaacctgtgctttca

SEQ ID NO: 604528 - DNA, 11 bp, Homo sapiens
aaaccttggag

SEQ ID NO: 604529 - DNA, 17 bp, Homo sapiens
aaaccttggagaggaga

SEQ ID NO: 604530 - DNA, 17 bp, Homo sapiens
aaacgtctaacttcatg

SEQ ID NO: 604531 - DNA, 13 bp, Homo sapiens
aaactaattaaac

SEQ ID NO: 604532 - DNA, 15 bp, Homo sapiens
aaactcatacagtct

SEQ ID NO: 604533 - DNA, 18 bp, Homo sapiens
aaactcatacagtggtat

SEQ ID NO: 604534 - DNA, 18 bp, Homo sapiens
aaactggaaacatctgat

SEQ ID NO: 604535 - DNA, 19 bp, Homo sapiens
aaactggaaacatctgatt

SEQ ID NO: 604536 - DNA, 22 bp, Homo sapiens
aaactggaaacatctgatttct

SEQ ID NO: 604537 - DNA, 14 bp, Homo sapiens
aaactggaataaga

SEQ ID NO: 604538 - DNA, 15 bp, Homo sapiens
aaactggaataagaa

SEQ ID NO: 604539 - DNA, 13 bp, Homo sapiens
aaactgggaaatg

SEQ ID NO: 604540 - DNA, 21 bp, Homo sapiens
aaactgtgacattccacagag

SEQ ID NO: 604541 - DNA, 17 bp, Homo sapiens
aaactgtgagataaata

SEQ ID NO: 604542 - DNA, 20 bp, Homo sapiens
aaactgtgagataaatatca

SEQ ID NO: 604543 - DNA, 15 bp, Homo sapiens
aaacttaacagatca

SEQ ID NO: 604544 - DNA, 22 bp, Homo sapiens
aaacttactatggtatatattt

SEQ ID NO: 604545 - DNA, 16 bp, Homo sapiens
aaacttggacatttat

SEQ ID NO: 604546 - DNA, 18 bp, Homo sapiens
aacaacaaagcatgctca

SEQ ID NO: 604547 - DNA, 14 bp, Homo sapiens
aacaactttctgga

SEQ ID NO: 604548 - DNA, 13 bp, Homo sapiens
aacaagacaaggt

SEQ ID NO: 604549 - DNA, 20 bp, Homo sapiens
aacaattcaaagaatcacct

SEQ ID NO: 604550 - DNA, 19 bp, Homo sapiens
aacaatttaggaatgctca

SEQ ID NO: 604551 - DNA, 20 bp, Homo sapiens
aacacagtaagataggttct

SEQ ID NO: 604552 - DNA, 16 bp, Homo sapiens
aacaccagcaacatta

SEQ ID NO: 604553 - DNA, 21 bp, Homo sapiens
aacaccagcaacattataatg

SEQ ID NO: 604554 - DNA, 19 bp, Homo sapiens
aacacggagtttccatttg

SEQ ID NO: 604555 - DNA, 16 bp, Homo sapiens
aacactattttatgca

SEQ ID NO: 604556 - DNA, 11 bp, Homo sapiens
aacactctgag

SEQ ID NO: 604557 - DNA, 13 bp, Homo sapiens
aacactctgagac

SEQ ID NO: 604558 - DNA, 14 bp, Homo sapiens
aacactctgagact

SEQ ID NO: 604559 - DNA, 14 bp, Homo sapiens
aacactgagtgaaa

SEQ ID NO: 604560 - DNA, 15 bp, Homo sapiens
aacactgccaaacat

SEQ ID NO: 604561 - DNA, 20 bp, Homo sapiens
aacactgcttaaggaaaaga

SEQ ID NO: 604562 - DNA, 15 bp, Homo sapiens
aacacttctccttaa

SEQ ID NO: 604563 - DNA, 20 bp, Homo sapiens
aacagaaaaatgaaatttaa

SEQ ID NO: 604564 - DNA, 12 bp, Homo sapiens
aacagacattgt

SEQ ID NO: 604565 - DNA, 13 bp, Homo sapiens
aacagaccagcat

SEQ ID NO: 604566 - DNA, 19 bp, Homo sapiens
aacagaccagcatagttct

SEQ ID NO: 604567 - DNA, 21 bp, Homo sapiens
aacagatcacatgcccctctt

SEQ ID NO: 604568 - DNA, 23 bp, Homo sapiens
aacagatcacatgcccctcttag

SEQ ID NO: 604569 - DNA, 24 bp, Homo sapiens
aacagctaggttaataggaggaca

SEQ ID NO: 604570 - DNA, 13 bp, Homo sapiens
aacagctgtatta

SEQ ID NO: 604571 - DNA, 19 bp, Homo sapiens
aacaggcattgcactaaaa

SEQ ID NO: 604572 - DNA, 22 bp, Homo sapiens
aacaggcattgcactaaaagtg

SEQ ID NO: 604573 - DNA, 22 bp, Homo sapiens
aacagtaaatatacactttaca

SEQ ID NO: 604574 - DNA, 13 bp, Homo sapiens
aacagtatttcca

SEQ ID NO: 604575 - DNA, 18 bp, Homo sapiens
aacagtggcaagctacca

SEQ ID NO: 604576 - DNA, 16 bp, Homo sapiens
aacataaacttgtact

SEQ ID NO: 604577 - DNA, 21 bp, Homo sapiens
aacatagtggtattttaacat

SEQ ID NO: 604578 - DNA, 14 bp, Homo sapiens
aacatagttttcac

SEQ ID NO: 604579 - DNA, 17 bp, Homo sapiens
aacatatcattcagaat

SEQ ID NO: 604580 - DNA, 20 bp, Homo sapiens
aacatcagtcaattgcttga

SEQ ID NO: 604581 - DNA, 18 bp, Homo sapiens
aacattgttccagattca

SEQ ID NO: 604582 - DNA, 19 bp, Homo sapiens
aaccaagctataaaagccc

SEQ ID NO: 604583 - DNA, 16 bp, Homo sapiens
aaccaccttaaaacat

SEQ ID NO: 604584 - DNA, 13 bp, Homo sapiens
aaccagagcactg

SEQ ID NO: 604585 - DNA, 18 bp, Homo sapiens
aaccagagcactgtatac

SEQ ID NO: 604586 - DNA, 14 bp, Homo sapiens
aaccatgaaaagtt

SEQ ID NO: 604587 - DNA, 15 bp, Homo sapiens
aacccacataaacac

SEQ ID NO: 604588 - DNA, 16 bp, Homo sapiens
aacccacataaacact

SEQ ID NO: 604589 - DNA, 11 bp, Homo sapiens
aacccagtgtt

SEQ ID NO: 604590 - DNA, 16 bp, Homo sapiens
aacccccacctcccgg

SEQ ID NO: 604591 - DNA, 16 bp, Homo sapiens
aacccccatttttgta

SEQ ID NO: 604592 - DNA, 14 bp, Homo sapiens
aacccccctcccca

SEQ ID NO: 604593 - DNA, 19 bp, Homo sapiens
aacccctgacaccttttca

SEQ ID NO: 604594 - DNA, 11 bp, Homo sapiens
aaccctgccct

SEQ ID NO: 604595 - DNA, 17 bp, Homo sapiens
aaccgggactacagaag

SEQ ID NO: 604596 - DNA, 13 bp, Homo sapiens
aaccgtcaatgtg

SEQ ID NO: 604597 - DNA, 14 bp, Homo sapiens
aacctactgcccac

SEQ ID NO: 604598 - DNA, 18 bp, Homo sapiens
aacctcagttggcctctg

SEQ ID NO: 604599 - DNA, 17 bp, Homo sapiens
aacctcccctggtcctg

SEQ ID NO: 604600 - DNA, 12 bp, Homo sapiens
aagcattaaaaa

SEQ ID NO: 604601 - DNA, 14 bp, Homo sapiens
aagcattgctaaag

SEQ ID NO: 604602 - DNA, 14 bp, Homo sapiens
aagccaaaataaga

SEQ ID NO: 604603 - DNA, 19 bp, Homo sapiens
aagccaaaatagagagtat

SEQ ID NO: 604604 - DNA, 13 bp, Homo sapiens
aagccaatttttc

SEQ ID NO: 604605 - DNA, 14 bp, Homo sapiens
aagccaatttttct

SEQ ID NO: 604606 - DNA, 17 bp, Homo sapiens
aagccaatttttctgca

SEQ ID NO: 604607 - DNA, 15 bp, Homo sapiens
aagccacgttgcaga

SEQ ID NO: 604608 - DNA, 19 bp, Homo sapiens
aagccacgttgcagaaaaa

SEQ ID NO: 604609 - DNA, 20 bp, Homo sapiens
aagccaggagaccctgtctt

SEQ ID NO: 604610 - DNA, 21 bp, Homo sapiens
aagccatagccccaggcccgc

SEQ ID NO: 604611 - DNA, 18 bp, Homo sapiens
aagcccacccgccccaga

SEQ ID NO: 604612 - DNA, 19 bp, Homo sapiens
aagcccacccgccccagag

SEQ ID NO: 604613 - DNA, 19 bp, Homo sapiens
aagcccctagtcttagaga

SEQ ID NO: 604614 - DNA, 21 bp, Homo sapiens
aagccctggaattttaggaaa

SEQ ID NO: 604615 - DNA, 17 bp, Homo sapiens
aagcgaaatacttgaaa

SEQ ID NO: 604616 - DNA, 19 bp, Homo sapiens
aagctcaaggctgcagtga

SEQ ID NO: 604617 - DNA, 15 bp, Homo sapiens
aagctcatagcacat

SEQ ID NO: 604618 - DNA, 14 bp, Homo sapiens
aagctttctccttt

SEQ ID NO: 604619 - DNA, 16 bp, Homo sapiens
aagctttggaagcagc

SEQ ID NO: 604620 - DNA, 18 bp, Homo sapiens
aagctttggaagcagcaa

SEQ ID NO: 604621 - DNA, 20 bp, Homo sapiens
aaggaaaagagaaacactaa

SEQ ID NO: 604622 - DNA, 23 bp, Homo sapiens
aaggaaagttctattatctgggt

SEQ ID NO: 604623 - DNA, 15 bp, Homo sapiens
aaggaagctttggaa

SEQ ID NO: 604624 - DNA, 20 bp, Homo sapiens
aaggacactgatgggtcctg

SEQ ID NO: 604625 - DNA, 13 bp, Homo sapiens
aaggacagtgttc

SEQ ID NO: 604626 - DNA, 15 bp, Homo sapiens
aaggacagtgttcaa

SEQ ID NO: 604627 - DNA, 22 bp, Homo sapiens
aaggacagtgttcaaattctga

SEQ ID NO: 604628 - DNA, 16 bp, Homo sapiens
aaggactacagaattg

SEQ ID NO: 604629 - DNA, 22 bp, Homo sapiens
aaggagatggggagggcgcttt

SEQ ID NO: 604630 - DNA, 13 bp, Homo sapiens
aaggagggagaaa

SEQ ID NO: 604631 - DNA, 15 bp, Homo sapiens
aaggattcttttttc

SEQ ID NO: 604632 - DNA, 15 bp, Homo sapiens
aaggcaagaagtggg

SEQ ID NO: 604633 - DNA, 23 bp, Homo sapiens
aaggcagtgaacacactcagcag

SEQ ID NO: 604634 - DNA, 15 bp, Homo sapiens
aaggcagtgcagtgc

SEQ ID NO: 604635 - DNA, 14 bp, Homo sapiens
aaggcccagccctg

SEQ ID NO: 604636 - DNA, 17 bp, Homo sapiens
aaggcccagccctgggc

SEQ ID NO: 604637 - DNA, 14 bp, Homo sapiens
aaggcccgaggagg

SEQ ID NO: 604638 - DNA, 19 bp, Homo sapiens
aaggcctgagggaagccca

SEQ ID NO: 604639 - DNA, 16 bp, Homo sapiens
aaggcctgcccccctt

SEQ ID NO: 604640 - DNA, 19 bp, Homo sapiens
aaggctgcagctaatttgt

SEQ ID NO: 604641 - DNA, 17 bp, Homo sapiens
aaggctgctgtgtagct

SEQ ID NO: 604642 - DNA, 17 bp, Homo sapiens
aaggctggatgtgcttt

SEQ ID NO: 604643 - DNA, 13 bp, Homo sapiens
aaggcttctccac

SEQ ID NO: 604644 - DNA, 17 bp, Homo sapiens
aagggattgaggagttg

SEQ ID NO: 604645 - DNA, 13 bp, Homo sapiens
aagggcagccccg

SEQ ID NO: 604646 - DNA, 14 bp, Homo sapiens
aagggccaccctga

SEQ ID NO: 604647 - DNA, 18 bp, Homo sapiens
aagggccaccctgagcag

SEQ ID NO: 604648 - DNA, 13 bp, Homo sapiens
aaggggccagacc

SEQ ID NO: 604649 - DNA, 16 bp, Homo sapiens
aagggtgcctggctgg

SEQ ID NO: 604650 - DNA, 17 bp, Homo sapiens
aagggtgcctggctggg

SEQ ID NO: 604651 - DNA, 19 bp, Homo sapiens
aagggtgcctggctgggct

SEQ ID NO: 604652 - DNA, 16 bp, Homo sapiens
aagggtggtagttttc

SEQ ID NO: 604653 - DNA, 20 bp, Homo sapiens
aagggttctgccctgcctga

SEQ ID NO: 604654 - DNA, 23 bp, Homo sapiens
aagggttctgccctgcctgagga

SEQ ID NO: 604655 - DNA, 18 bp, Homo sapiens
aaggtaggtgcatgcctt

SEQ ID NO: 604656 - DNA, 18 bp, Homo sapiens
aaggtcagtgttataaaa

SEQ ID NO: 604657 - DNA, 14 bp, Homo sapiens
aaggtcttgcctga

SEQ ID NO: 604658 - DNA, 21 bp, Homo sapiens
aaggtgatgaatttaccatca

SEQ ID NO: 604659 - DNA, 20 bp, Homo sapiens
aaggtgcctcatagcatagc

SEQ ID NO: 604660 - DNA, 14 bp, Homo sapiens
aaggtggtcttgga

SEQ ID NO: 604661 - DNA, 17 bp, Homo sapiens
aaggttatcagaaagat

SEQ ID NO: 604662 - DNA, 22 bp, Homo sapiens
aaggttatttatttaaatgtct

SEQ ID NO: 604663 - DNA, 15 bp, Homo sapiens
aaggttgtacatagt

SEQ ID NO: 604664 - DNA, 16 bp, Homo sapiens
aaggttgtacatagtg

SEQ ID NO: 604665 - DNA, 16 bp, Homo sapiens
aaggtttcactgttca

SEQ ID NO: 604666 - DNA, 22 bp, Homo sapiens
aagtactagcaataagttgaat

SEQ ID NO: 604667 - DNA, 17 bp, Homo sapiens
aagtactctaatataca

SEQ ID NO: 604668 - DNA, 22 bp, Homo sapiens
aagtagaattcttaccatctta

SEQ ID NO: 604669 - DNA, 14 bp, Homo sapiens
aagtagtgtcattc

SEQ ID NO: 604670 - DNA, 19 bp, Homo sapiens
aagtatcatctaaatatta

SEQ ID NO: 604671 - DNA, 21 bp, Homo sapiens
aagtatcatctaaatattatg

SEQ ID NO: 604672 - DNA, 22 bp, Homo sapiens
aagtatgtcttcaaaatatatt

SEQ ID NO: 604673 - DNA, 20 bp, Homo sapiens
aagtcccgtgccctgtttcc

SEQ ID NO: 604674 - DNA, 16 bp, Homo sapiens
aagtcctcgccccccg

SEQ ID NO: 604675 - DNA, 15 bp, Homo sapiens
aagtcttactgtttt

SEQ ID NO: 604676 - DNA, 20 bp, Homo sapiens
aagtgaaaaagacttcaaat

SEQ ID NO: 604677 - DNA, 21 bp, Homo sapiens
aagtgaaattagtattttgag

SEQ ID NO: 604678 - DNA, 14 bp, Homo sapiens
aagtgatgtgattt

SEQ ID NO: 604679 - DNA, 20 bp, Homo sapiens
aagtgatgtgatttatgcat

SEQ ID NO: 604680 - DNA, 22 bp, Homo sapiens
aagtgatgtgatttatgcattt

SEQ ID NO: 604681 - DNA, 23 bp, Homo sapiens
aagtgatgtgatttatgcattta

SEQ ID NO: 604682 - DNA, 13 bp, Homo sapiens
aagtgattgacat

SEQ ID NO: 604683 - DNA, 15 bp, Homo sapiens
aagtgattgacattt

SEQ ID NO: 604684 - DNA, 14 bp, Homo sapiens
aagtggactgtatt

SEQ ID NO: 604685 - DNA, 21 bp, Homo sapiens
aagtggcctgagaagagtcga

SEQ ID NO: 604686 - DNA, 19 bp, Homo sapiens
aagtgggattcaggaatgg

SEQ ID NO: 604687 - DNA, 19 bp, Homo sapiens
aagtgtccattgacatgta

SEQ ID NO: 604688 - DNA, 21 bp, Homo sapiens
aagtgtccattgacatgtaca

SEQ ID NO: 604689 - DNA, 22 bp, Homo sapiens
aagtgtccattgacatgtacag

SEQ ID NO: 604690 - DNA, 23 bp, Homo sapiens
aagtgtccattgacatgtacaga

SEQ ID NO: 604691 - DNA, 22 bp, Homo sapiens
aagtgttacctaacaatgtttt

SEQ ID NO: 604692 - DNA, 15 bp, Homo sapiens
aagtgttgtcttatt

SEQ ID NO: 604693 - DNA, 17 bp, Homo sapiens
aagttataccagcaaaa

SEQ ID NO: 604694 - DNA, 21 bp, Homo sapiens
aagttatttactcctcctgct

SEQ ID NO: 604695 - DNA, 17 bp, Homo sapiens
aagttatttgatctggt

SEQ ID NO: 604696 - DNA, 20 bp, Homo sapiens
aagttcatcaaacatgttta

SEQ ID NO: 604697 - DNA, 24 bp, Homo sapiens
aagttcattcatactcaaagaggc

SEQ ID NO: 604698 - DNA, 16 bp, Homo sapiens
aagttctattatctgg

SEQ ID NO: 604699 - DNA, 22 bp, Homo sapiens
aagttgccacattgcttcatta

SEQ ID NO: 604700 - DNA, 17 bp, Homo sapiens
aagttggagtgcagtgg

SEQ ID NO: 604701 - DNA, 17 bp, Homo sapiens
aagttgtgatctgttgt

SEQ ID NO: 604702 - DNA, 14 bp, Homo sapiens
aagtttaaatcttt

SEQ ID NO: 604703 - DNA, 21 bp, Homo sapiens
aagtttacattgtcctgtagc

SEQ ID NO: 604704 - DNA, 22 bp, Homo sapiens
aagtttggaagtacataaagta

SEQ ID NO: 604705 - DNA, 16 bp, Homo sapiens
aagttttacttgatta

SEQ ID NO: 604706 - DNA, 14 bp, Homo sapiens
aagtttttatacct

SEQ ID NO: 604707 - DNA, 23 bp, Homo sapiens
aagtttttatacctgtacacaca

SEQ ID NO: 604708 - DNA, 24 bp, Homo sapiens
aataaaaatagctataaatagtga

SEQ ID NO: 604709 - DNA, 23 bp, Homo sapiens
aataaaacattttaaatggacag

SEQ ID NO: 604710 - DNA, 13 bp, Homo sapiens
aataaaaccagaa

SEQ ID NO: 604711 - DNA, 14 bp, Homo sapiens
aataaactccttaa

SEQ ID NO: 604712 - DNA, 17 bp, Homo sapiens
aataaattaatttttca

SEQ ID NO: 604713 - DNA, 19 bp, Homo sapiens
aataacaacaatttaggaa

SEQ ID NO: 604714 - DNA, 12 bp, Homo sapiens
aataacactgca

SEQ ID NO: 604715 - DNA, 13 bp, Homo sapiens
aataacagaaata

SEQ ID NO: 604716 - DNA, 18 bp, Homo sapiens
aataaccctgaatcagag

SEQ ID NO: 604717 - DNA, 17 bp, Homo sapiens
aataagaaacagtttaa

SEQ ID NO: 604718 - DNA, 19 bp, Homo sapiens
aataagaaacagtttaaca

SEQ ID NO: 604719 - DNA, 16 bp, Homo sapiens
aataagttgaatgata

SEQ ID NO: 604720 - DNA, 16 bp, Homo sapiens
aataatacttcataca

SEQ ID NO: 604721 - DNA, 14 bp, Homo sapiens
aataatattgcctt

SEQ ID NO: 604722 - DNA, 23 bp, Homo sapiens
aataatgcttaacataaacttgt

SEQ ID NO: 604723 - DNA, 21 bp, Homo sapiens
aataattaaaacaaaatcctt

SEQ ID NO: 604724 - DNA, 15 bp, Homo sapiens
aataattatatgaag

SEQ ID NO: 604725 - DNA, 13 bp, Homo sapiens
aatacacatacat

SEQ ID NO: 604726 - DNA, 16 bp, Homo sapiens
aatacacatacatata

SEQ ID NO: 604727 - DNA, 16 bp, Homo sapiens
aatacacgtgtatatg

SEQ ID NO: 604728 - DNA, 14 bp, Homo sapiens
aatacatcatatgt

SEQ ID NO: 604729 - DNA, 18 bp, Homo sapiens
aatactgtattgttacag

SEQ ID NO: 604730 - DNA, 23 bp, Homo sapiens
aatactgtattgttacagctgaa

SEQ ID NO: 604731 - DNA, 17 bp, Homo sapiens
aatactttgtgtctttt

SEQ ID NO: 604732 - DNA, 15 bp, Homo sapiens
aatagaaaatatatt

SEQ ID NO: 604733 - DNA, 14 bp, Homo sapiens
aatagcatgtattg

SEQ ID NO: 604734 - DNA, 14 bp, Homo sapiens
aatagcctcacctt

SEQ ID NO: 604735 - DNA, 18 bp, Homo sapiens
aatagctataaatagtga

SEQ ID NO: 604736 - DNA, 22 bp, Homo sapiens
aatagctcacagcacatttgtt

SEQ ID NO: 604737 - DNA, 20 bp, Homo sapiens
aatagcttttcacttcttaa

SEQ ID NO: 604738 - DNA, 21 bp, Homo sapiens
aatagcttttcacttcttaag

SEQ ID NO: 604739 - DNA, 19 bp, Homo sapiens
aatagtaaataatgattca

SEQ ID NO: 604740 - DNA, 13 bp, Homo sapiens
aatagtcatgttt

SEQ ID NO: 604741 - DNA, 15 bp, Homo sapiens
aatagtcatgtttct

SEQ ID NO: 604742 - DNA, 16 bp, Homo sapiens
aatagtctgccacaag

SEQ ID NO: 604743 - DNA, 13 bp, Homo sapiens
aatagtgaaaatt

SEQ ID NO: 604744 - DNA, 22 bp, Homo sapiens
aatagttgagccagcagacatt

SEQ ID NO: 604745 - DNA, 23 bp, Homo sapiens
aatagttgagccagcagacattg

SEQ ID NO: 604746 - DNA, 17 bp, Homo sapiens
aatataaaaataattaa

SEQ ID NO: 604747 - DNA, 17 bp, Homo sapiens
aatataaatcacagatt

SEQ ID NO: 604748 - DNA, 19 bp, Homo sapiens
aatataaatcacagatttc

SEQ ID NO: 604749 - DNA, 21 bp, Homo sapiens
aatataaatcacagatttcca

SEQ ID NO: 604750 - DNA, 15 bp, Homo sapiens
aatataacatgaaag

SEQ ID NO: 604751 - DNA, 12 bp, Homo sapiens
acatggtgctgt

SEQ ID NO: 604752 - DNA, 14 bp, Homo sapiens
acatggtgctgtgt

SEQ ID NO: 604753 - DNA, 11 bp, Homo sapiens
acatgtacaga

SEQ ID NO: 604754 - DNA, 13 bp, Homo sapiens
acatgtacagaga

SEQ ID NO: 604755 - DNA, 16 bp, Homo sapiens
acattagtgagattta

SEQ ID NO: 604756 - DNA, 20 bp, Homo sapiens
acattcctaagagtggagga

SEQ ID NO: 604757 - DNA, 20 bp, Homo sapiens
acattgcccatggctgggaa

SEQ ID NO: 604758 - DNA, 21 bp, Homo sapiens
acattgcttcattaaaacaag

SEQ ID NO: 604759 - DNA, 12 bp, Homo sapiens
acattgtatgtt

SEQ ID NO: 604760 - DNA, 15 bp, Homo sapiens
acattgtcctgtagc

SEQ ID NO: 604761 - DNA, 18 bp, Homo sapiens
acatttatgtacaaaatg

SEQ ID NO: 604762 - DNA, 21 bp, Homo sapiens
acatttgatttgatatacaga

SEQ ID NO: 604763 - DNA, 14 bp, Homo sapiens
acatttgggctcag

SEQ ID NO: 604764 - DNA, 17 bp, Homo sapiens
acatttgggctcagggt

SEQ ID NO: 604765 - DNA, 12 bp, Homo sapiens
acatttgttctg

SEQ ID NO: 604766 - DNA, 20 bp, Homo sapiens
acattttgcagctatggaca

SEQ ID NO: 604767 - DNA, 21 bp, Homo sapiens
acattttgcagctatggacaa

SEQ ID NO: 604768 - DNA, 16 bp, Homo sapiens
acattttgtagctagt

SEQ ID NO: 604769 - DNA, 19 bp, Homo sapiens
acattttttgtttcttggt

SEQ ID NO: 604770 - DNA, 17 bp, Homo sapiens
accaaattgctgagatg

SEQ ID NO: 604771 - DNA, 22 bp, Homo sapiens
accaactaagttgtattttaat

SEQ ID NO: 604772 - DNA, 15 bp, Homo sapiens
accaatttgttctgt

SEQ ID NO: 604773 - DNA, 21 bp, Homo sapiens
accacacacacccttccccac

SEQ ID NO: 604774 - DNA, 15 bp, Homo sapiens
accacacctaaatta

SEQ ID NO: 604775 - DNA, 14 bp, Homo sapiens
accacagctgggca

SEQ ID NO: 604776 - DNA, 23 bp, Homo sapiens
accacaggctgcctcatgaccct

SEQ ID NO: 604777 - DNA, 15 bp, Homo sapiens
accaccgcgcccctc

SEQ ID NO: 604778 - DNA, 23 bp, Homo sapiens
accaccgcgcccctctgcgcccc

SEQ ID NO: 604779 - DNA, 19 bp, Homo sapiens
accctctgctatgtctgtg

SEQ ID NO: 604780 - DNA, 19 bp, Homo sapiens
accctcttctcagctccac

SEQ ID NO: 604781 - DNA, 23 bp, Homo sapiens
accctcttctcagctccactctg

SEQ ID NO: 604782 - DNA, 13 bp, Homo sapiens
accctgaatcaga

SEQ ID NO: 604783 - DNA, 12 bp, Homo sapiens
accctgcaggca

SEQ ID NO: 604784 - DNA, 14 bp, Homo sapiens
accctgcaggcagg

SEQ ID NO: 604785 - DNA, 17 bp, Homo sapiens
accctgcaggcaggcag

SEQ ID NO: 604786 - DNA, 18 bp, Homo sapiens
accctgcaggcaggcaga

SEQ ID NO: 604787 - DNA, 12 bp, Homo sapiens
accctgccctgc

SEQ ID NO: 604788 - DNA, 13 bp, Homo sapiens
accctgccctgca

SEQ ID NO: 604789 - DNA, 19 bp, Homo sapiens
accctgccctgcaccttgg

SEQ ID NO: 604790 - DNA, 13 bp, Homo sapiens
accctgcgcccct

SEQ ID NO: 604791 - DNA, 14 bp, Homo sapiens
accctgcgcccctg

SEQ ID NO: 604792 - DNA, 18 bp, Homo sapiens
accctgcgcccctgccca

SEQ ID NO: 604793 - DNA, 19 bp, Homo sapiens
accctgcgcccctgcccag

SEQ ID NO: 604794 - DNA, 17 bp, Homo sapiens
accctggacagtgccta

SEQ ID NO: 604795 - DNA, 21 bp, Homo sapiens
accctgtgggggcggctgtgg

SEQ ID NO: 604796 - DNA, 18 bp, Homo sapiens
accctgttccctctttct

SEQ ID NO: 604797 - DNA, 12 bp, Homo sapiens
acccttcaatgt

SEQ ID NO: 604798 - DNA, 19 bp, Homo sapiens
acccttcaatgttaaatct

SEQ ID NO: 604799 - DNA, 15 bp, Homo sapiens
acccttccccactcc

SEQ ID NO: 604800 - DNA, 16 bp, Homo sapiens
acccttccccactccc

SEQ ID NO: 604801 - DNA, 14 bp, Homo sapiens
accctttaatgttc

SEQ ID NO: 604802 - DNA, 15 bp, Homo sapiens
accgaaaacgtggct

SEQ ID NO: 604803 - DNA, 21 bp, Homo sapiens
accgacgcccctccgggcaga

SEQ ID NO: 604804 - DNA, 21 bp, Homo sapiens
accgcccaacccccacctccc

SEQ ID NO: 604805 - DNA, 14 bp, Homo sapiens
accgcccacccagc

SEQ ID NO: 604806 - DNA, 20 bp, Homo sapiens
accggacgcatgcagggccc

SEQ ID NO: 604807 - DNA, 24 bp, Homo sapiens
accggacgctggagaccctgcgcc

SEQ ID NO: 604808 - DNA, 13 bp, Homo sapiens
accggcactgtgc

SEQ ID NO: 604809 - DNA, 16 bp, Homo sapiens
accggcccgccacctt

SEQ ID NO: 604810 - DNA, 12 bp, Homo sapiens
accgtcaatgtg

SEQ ID NO: 604811 - DNA, 16 bp, Homo sapiens
accgtggtgtcctctg

SEQ ID NO: 604812 - DNA, 18 bp, Homo sapiens
accgtggtgtgaggcccc

SEQ ID NO: 604813 - DNA, 14 bp, Homo sapiens
acctaacaatgttt

SEQ ID NO: 604814 - DNA, 18 bp, Homo sapiens
agaaacacggagtttcca

SEQ ID NO: 604815 - DNA, 15 bp, Homo sapiens
agaaacagaagaaaa

SEQ ID NO: 604816 - DNA, 18 bp, Homo sapiens
agaaacagagatcataaa

SEQ ID NO: 604817 - DNA, 14 bp, Homo sapiens
agaaacccctgaca

SEQ ID NO: 604818 - DNA, 22 bp, Homo sapiens
agaaaccttttaaaaaaataat

SEQ ID NO: 604819 - DNA, 22 bp, Homo sapiens
agaaactttggaagttttactt

SEQ ID NO: 604820 - DNA, 13 bp, Homo sapiens
agaaagaaaaaag

SEQ ID NO: 604821 - DNA, 15 bp, Homo sapiens
agaaaggagggcaac

SEQ ID NO: 604822 - DNA, 13 bp, Homo sapiens
agaaaggcagaga

SEQ ID NO: 604823 - DNA, 17 bp, Homo sapiens
agaaaggcagagattgg

SEQ ID NO: 604824 - DNA, 17 bp, Homo sapiens
agaaagggcagcccctc

SEQ ID NO: 604825 - DNA, 18 bp, Homo sapiens
agaaagggcagcccctcc

SEQ ID NO: 604826 - DNA, 22 bp, Homo sapiens
agaaataagtagtgtcattcat

SEQ ID NO: 604827 - DNA, 17 bp, Homo sapiens
agaaatacatcatatgt

SEQ ID NO: 604828 - DNA, 16 bp, Homo sapiens
agaaatagaataggca

SEQ ID NO: 604829 - DNA, 17 bp, Homo sapiens
agaaatataaaaataat

SEQ ID NO: 604830 - DNA, 12 bp, Homo sapiens
agaaatcatgtt

SEQ ID NO: 604831 - DNA, 15 bp, Homo sapiens
agaaatggctttcca

SEQ ID NO: 604832 - DNA, 22 bp, Homo sapiens
agaaattagggctctaatttcc

SEQ ID NO: 604833 - DNA, 23 bp, Homo sapiens
agaaattagggctctaatttcct

SEQ ID NO: 604834 - DNA, 14 bp, Homo sapiens
agaaattgtgccaa

SEQ ID NO: 604835 - DNA, 15 bp, Homo sapiens
agaaattgtgccaaa

SEQ ID NO: 604836 - DNA, 16 bp, Homo sapiens
agaaattgtgccaaag

SEQ ID NO: 604837 - DNA, 18 bp, Homo sapiens
agaaattgtgccaaagat

SEQ ID NO: 604838 - DNA, 18 bp, Homo sapiens
agaaatttactatgtaaa

SEQ ID NO: 604839 - DNA, 17 bp, Homo sapiens
agaaatttttttccaga

SEQ ID NO: 604840 - DNA, 18 bp, Homo sapiens
agaaatttttttccagaa

SEQ ID NO: 604841 - DNA, 14 bp, Homo sapiens
agaacaacaacaaa

SEQ ID NO: 604842 - DNA, 22 bp, Homo sapiens
agaacaacaacaaagcatgctc

SEQ ID NO: 604843 - DNA, 17 bp, Homo sapiens
agaaccagcactcccag

SEQ ID NO: 604844 - DNA, 16 bp, Homo sapiens
agaacccccctcccca

SEQ ID NO: 604845 - DNA, 21 bp, Homo sapiens
agaacctgcgcaccccgttcc

SEQ ID NO: 604846 - DNA, 18 bp, Homo sapiens
agaacgcatgcagggccc

SEQ ID NO: 604847 - DNA, 15 bp, Homo sapiens
agaacgggcctcccc

SEQ ID NO: 604848 - DNA, 15 bp, Homo sapiens
agaactcatgtgatt

SEQ ID NO: 604849 - DNA, 17 bp, Homo sapiens
agaactcctttctaagg

SEQ ID NO: 604850 - DNA, 18 bp, Homo sapiens
agaactgacttcctgaac

SEQ ID NO: 604851 - DNA, 15 bp, Homo sapiens
agaagaaatagcaga

SEQ ID NO: 604852 - DNA, 16 bp, Homo sapiens
agaagaaggactgaag

SEQ ID NO: 604853 - DNA, 12 bp, Homo sapiens
agaagagcctga

SEQ ID NO: 604854 - DNA, 15 bp, Homo sapiens
agaagatagttgtaa

SEQ ID NO: 604855 - DNA, 16 bp, Homo sapiens
agaagatagttgtaaa

SEQ ID NO: 604856 - DNA, 14 bp, Homo sapiens
agaagatgtttaac

SEQ ID NO: 604857 - DNA, 22 bp, Homo sapiens
agaagatgtttaacttaatcaa

SEQ ID NO: 604858 - DNA, 20 bp, Homo sapiens
agaagcagcagctagaaaga

SEQ ID NO: 604859 - DNA, 16 bp, Homo sapiens
agaaggactgaagaaa

SEQ ID NO: 604860 - DNA, 19 bp, Homo sapiens
agaaggattcttttttcaa

SEQ ID NO: 604861 - DNA, 17 bp, Homo sapiens
agaaggcccgaggaggc

SEQ ID NO: 604862 - DNA, 15 bp, Homo sapiens
agaaggcctgccccc

SEQ ID NO: 604863 - DNA, 16 bp, Homo sapiens
agaaggcctgcccccc

SEQ ID NO: 604864 - DNA, 17 bp, Homo sapiens
agaagggttctgccctg

SEQ ID NO: 604865 - DNA, 18 bp, Homo sapiens
agaagggttctgccctgc

SEQ ID NO: 604866 - DNA, 22 bp, Homo sapiens
agaagggttctgccctgcctga

SEQ ID NO: 604867 - DNA, 23 bp, Homo sapiens
agaagggttctgccctgcctgag

SEQ ID NO: 604868 - DNA, 21 bp, Homo sapiens
agaagtgaaaaagacttcaaa

SEQ ID NO: 604869 - DNA, 14 bp, Homo sapiens
agaatactgtattg

SEQ ID NO: 604870 - DNA, 16 bp, Homo sapiens
agaataggcaaacttt

SEQ ID NO: 604871 - DNA, 20 bp, Homo sapiens
agaatagttaaattggcttg

SEQ ID NO: 604872 - DNA, 14 bp, Homo sapiens
agaatcaagtctgt

SEQ ID NO: 604873 - DNA, 20 bp, Homo sapiens
agaatcatcctcatgccttt

SEQ ID NO: 604874 - DNA, 18 bp, Homo sapiens
agaatgagatgatttaat

SEQ ID NO: 604875 - DNA, 20 bp, Homo sapiens
agaatgagatgatttaattc

SEQ ID NO: 604876 - DNA, 22 bp, Homo sapiens
agaatgagatgatttaattctt

SEQ ID NO: 604877 - DNA, 20 bp, Homo sapiens
agaatgagggcgtgaaacac

SEQ ID NO: 604878 - DNA, 23 bp, Homo sapiens
agaatgatcaccctgaattcatt

SEQ ID NO: 604879 - DNA, 13 bp, Homo sapiens
agaatggctctgg

SEQ ID NO: 604880 - DNA, 19 bp, Homo sapiens
agaatggtgggctccagag

SEQ ID NO: 604881 - DNA, 20 bp, Homo sapiens
agaatggtgggctccagagt

SEQ ID NO: 604882 - DNA, 21 bp, Homo sapiens
agaatggtgggctccagagta

SEQ ID NO: 604883 - DNA, 21 bp, Homo sapiens
agaatgtgcaaagcagtatgt

SEQ ID NO: 604884 - DNA, 14 bp, Homo sapiens
agaatgttgtgttg

SEQ ID NO: 604885 - DNA, 15 bp, Homo sapiens
agaattcagtagcat

SEQ ID NO: 604886 - DNA, 14 bp, Homo sapiens
agaattcatgatgc

SEQ ID NO: 604887 - DNA, 17 bp, Homo sapiens
agaattttaaaaaagat

SEQ ID NO: 604888 - DNA, 21 bp, Homo sapiens
agaattttaaaaaagatggat

SEQ ID NO: 604889 - DNA, 13 bp, Homo sapiens
agacaaatacaca

SEQ ID NO: 604890 - DNA, 17 bp, Homo sapiens
agacaaatacacataca

SEQ ID NO: 604891 - DNA, 18 bp, Homo sapiens
agacaagtctagtggaac

SEQ ID NO: 604892 - DNA, 14 bp, Homo sapiens
agacaagtctgagt

SEQ ID NO: 604893 - DNA, 22 bp, Homo sapiens
agacaatgtggaattacataac

SEQ ID NO: 604894 - DNA, 21 bp, Homo sapiens
agacacacaagcagacacaca

SEQ ID NO: 604895 - DNA, 14 bp, Homo sapiens
agacacacacatat

SEQ ID NO: 604896 - DNA, 19 bp, Homo sapiens
agacacacacatatataca

SEQ ID NO: 604897 - DNA, 21 bp, Homo sapiens
agacacacacatatatacata

SEQ ID NO: 604898 - DNA, 12 bp, Homo sapiens
agacactgtcaa

SEQ ID NO: 604899 - DNA, 20 bp, Homo sapiens
agacagacggacgggacagc

SEQ ID NO: 604900 - DNA, 11 bp, Homo sapiens
agacagagatc

SEQ ID NO: 604901 - DNA, 12 bp, Homo sapiens
agacagagtgga

SEQ ID NO: 604902 - DNA, 19 bp, Homo sapiens
agacagagtggatctggag

SEQ ID NO: 604903 - DNA, 18 bp, Homo sapiens
agacagggcgtcctctcg

SEQ ID NO: 604904 - DNA, 19 bp, Homo sapiens
agacagggtggggcttaga

SEQ ID NO: 604905 - DNA, 22 bp, Homo sapiens
agacattgttttgccaacattg

SEQ ID NO: 604906 - DNA, 16 bp, Homo sapiens
agaccaccgcgcccct

SEQ ID NO: 604907 - DNA, 20 bp, Homo sapiens
agaccaccgcgcccctctgc

SEQ ID NO: 604908 - DNA, 15 bp, Homo sapiens
agaccacttccttaa

SEQ ID NO: 604909 - DNA, 16 bp, Homo sapiens
agaccagcctgccagg

SEQ ID NO: 604910 - DNA, 13 bp, Homo sapiens
agaccatgcattc

SEQ ID NO: 604911 - DNA, 16 bp, Homo sapiens
agaccatgcattcaga

SEQ ID NO: 604912 - DNA, 21 bp, Homo sapiens
agaccatgcattcagatctga

SEQ ID NO: 604913 - DNA, 14 bp, Homo sapiens
agatggtagaaact

SEQ ID NO: 604914 - DNA, 17 bp, Homo sapiens
agatgtaagaagctaaa

SEQ ID NO: 604915 - DNA, 15 bp, Homo sapiens
agatgtaatacacca

SEQ ID NO: 604916 - DNA, 21 bp, Homo sapiens
agatgtgaaaatgctttgaaa

SEQ ID NO: 604917 - DNA, 16 bp, Homo sapiens
agatgttattactgtt

SEQ ID NO: 604918 - DNA, 16 bp, Homo sapiens
agatgtttagtagctg

SEQ ID NO: 604919 - DNA, 21 bp, Homo sapiens
agatgtttagtagctgataaa

SEQ ID NO: 604920 - DNA, 18 bp, Homo sapiens
agattatatacaaagctg

SEQ ID NO: 604921 - DNA, 18 bp, Homo sapiens
agattcctacttaaacaa

SEQ ID NO: 604922 - DNA, 19 bp, Homo sapiens
agattcctacttaaacaaa

SEQ ID NO: 604923 - DNA, 20 bp, Homo sapiens
agattcctacttaaacaaaa

SEQ ID NO: 604924 - DNA, 18 bp, Homo sapiens
agattggaaaaaattaga

SEQ ID NO: 604925 - DNA, 20 bp, Homo sapiens
agattgtaaaggtaggtgca

SEQ ID NO: 604926 - DNA, 18 bp, Homo sapiens
agatttagggttctatat

SEQ ID NO: 604927 - DNA, 22 bp, Homo sapiens
agatttagggttctatatttac

SEQ ID NO: 604928 - DNA, 17 bp, Homo sapiens
agatttcactctccttg

SEQ ID NO: 604929 - DNA, 19 bp, Homo sapiens
agatttcactctccttggt

SEQ ID NO: 604930 - DNA, 19 bp, Homo sapiens
agattttaggaaatgaatg

SEQ ID NO: 604931 - DNA, 19 bp, Homo sapiens
agattttatgtttaaaatg

SEQ ID NO: 604932 - DNA, 13 bp, Homo sapiens
agatttttagatt

SEQ ID NO: 604933 - DNA, 18 bp, Homo sapiens
agcaaacaactttctgga

SEQ ID NO: 604934 - DNA, 19 bp, Homo sapiens
agcaaacaactttctggaa

SEQ ID NO: 604935 - DNA, 12 bp, Homo sapiens
agcaaacacaca

SEQ ID NO: 604936 - DNA, 17 bp, Homo sapiens
agcaaactgaaattagt

SEQ ID NO: 604937 - DNA, 22 bp, Homo sapiens
agcaaactgaaattagtgtttt

SEQ ID NO: 604938 - DNA, 19 bp, Homo sapiens
agcaaactgaagcccacag

SEQ ID NO: 604939 - DNA, 21 bp, Homo sapiens
agcaaattaattggcagcaga

SEQ ID NO: 604940 - DNA, 17 bp, Homo sapiens
agcaaccagagcactgt

SEQ ID NO: 604941 - DNA, 17 bp, Homo sapiens
agcaactgtctatttct

SEQ ID NO: 604942 - DNA, 20 bp, Homo sapiens
agcaactgtctatttctgct

SEQ ID NO: 604943 - DNA, 22 bp, Homo sapiens
agcaactgtctatttctgctga

SEQ ID NO: 604944 - DNA, 15 bp, Homo sapiens
agcaacttttctcat

SEQ ID NO: 604945 - DNA, 16 bp, Homo sapiens
agcaacttttctcatg

SEQ ID NO: 604946 - DNA, 20 bp, Homo sapiens
agcaaggacaacctgcccct

SEQ ID NO: 604947 - DNA, 18 bp, Homo sapiens
agcaaggcaagaagtggg

SEQ ID NO: 604948 - DNA, 22 bp, Homo sapiens
agcaaggcaagaagtgggattc

SEQ ID NO: 604949 - DNA, 22 bp, Homo sapiens
agcaataagttgaatgataata

SEQ ID NO: 604950 - DNA, 13 bp, Homo sapiens
agcaatcttgctg

SEQ ID NO: 604951 - DNA, 14 bp, Homo sapiens
agcacaagggcaca

SEQ ID NO: 604952 - DNA, 21 bp, Homo sapiens
agcacaagggcacattgccca

SEQ ID NO: 604953 - DNA, 22 bp, Homo sapiens
agcacacacaaacctactgccc

SEQ ID NO: 604954 - DNA, 22 bp, Homo sapiens
agcacagagagcggcttcccca

SEQ ID NO: 604955 - DNA, 13 bp, Homo sapiens
agcacagccatag

SEQ ID NO: 604956 - DNA, 14 bp, Homo sapiens
agcacagccatagc

SEQ ID NO: 604957 - DNA, 12 bp, Homo sapiens
agcacagtattt

SEQ ID NO: 604958 - DNA, 20 bp, Homo sapiens
agcacagtatttaacattct

SEQ ID NO: 604959 - DNA, 15 bp, Homo sapiens
agcacatctcttcat

SEQ ID NO: 604960 - DNA, 13 bp, Homo sapiens
agcacatgtttta

SEQ ID NO: 604961 - DNA, 13 bp, Homo sapiens
agcaccagcctga

SEQ ID NO: 604962 - DNA, 21 bp, Homo sapiens
agcaccagcctgagccacagt

SEQ ID NO: 604963 - DNA, 22 bp, Homo sapiens
agcaccagcttgcttctctgcc

SEQ ID NO: 604964 - DNA, 11 bp, Homo sapiens
agcacccccag

SEQ ID NO: 604965 - DNA, 13 bp, Homo sapiens
agcacccccagcc

SEQ ID NO: 604966 - DNA, 16 bp, Homo sapiens
agcacccccagcctcc

SEQ ID NO: 604967 - DNA, 17 bp, Homo sapiens
agcacccccagcctccc

SEQ ID NO: 604968 - DNA, 19 bp, Homo sapiens
agcacccccagcctccccc

SEQ ID NO: 604969 - DNA, 22 bp, Homo sapiens
agcacccccagcctcccccagg

SEQ ID NO: 604970 - DNA, 21 bp, Homo sapiens
agcaccctgttccctctttct

SEQ ID NO: 604971 - DNA, 14 bp, Homo sapiens
agcacctcctccgt

SEQ ID NO: 604972 - DNA, 13 bp, Homo sapiens
agcacctctcagc

SEQ ID NO: 604973 - DNA, 21 bp, Homo sapiens
agcacctctcagcccctcaga

SEQ ID NO: 604974 - DNA, 13 bp, Homo sapiens
agcactagaatga

SEQ ID NO: 604975 - DNA, 18 bp, Homo sapiens
agcactagaatgagaaat

SEQ ID NO: 604976 - DNA, 20 bp, Homo sapiens
agcactatctttcaggaaat

SEQ ID NO: 604977 - DNA, 12 bp, Homo sapiens
agcactcccagg

SEQ ID NO: 604978 - DNA, 14 bp, Homo sapiens
agcactcccagggc

SEQ ID NO: 604979 - DNA, 15 bp, Homo sapiens
agcactcccagggcc

SEQ ID NO: 604980 - DNA, 12 bp, Homo sapiens
agcactgtatac

SEQ ID NO: 604981 - DNA, 18 bp, Homo sapiens
agcactttgggaggctga

SEQ ID NO: 604982 - DNA, 17 bp, Homo sapiens
agcagaatgagatgatt

SEQ ID NO: 604983 - DNA, 19 bp, Homo sapiens
agcagaatgagatgattta

SEQ ID NO: 604984 - DNA, 22 bp, Homo sapiens
agcagaatgagatgatttaatt

SEQ ID NO: 604985 - DNA, 13 bp, Homo sapiens
agcagacacacac

SEQ ID NO: 604986 - DNA, 13 bp, Homo sapiens
agcagacagggcg

SEQ ID NO: 604987 - DNA, 17 bp, Homo sapiens
agcagacggggggctgc

SEQ ID NO: 604988 - DNA, 16 bp, Homo sapiens
agcagagacggcagcc

SEQ ID NO: 604989 - DNA, 21 bp, Homo sapiens
agcagagacggcagccccatc

SEQ ID NO: 604990 - DNA, 19 bp, Homo sapiens
agcagagcgcagcccccac

SEQ ID NO: 604991 - DNA, 18 bp, Homo sapiens
agcagatcgtgccgtgga

SEQ ID NO: 604992 - DNA, 21 bp, Homo sapiens
agcagatcgtgccgtggagct

SEQ ID NO: 604993 - DNA, 22 bp, Homo sapiens
agcagatcgtgccgtggagctt

SEQ ID NO: 604994 - DNA, 21 bp, Homo sapiens
actgcagccctctccaccctc

SEQ ID NO: 604995 - DNA, 23 bp, Homo sapiens
actgcagccctctccaccctccg

SEQ ID NO: 604996 - DNA, 13 bp, Homo sapiens
actgccaaacatc

SEQ ID NO: 604997 - DNA, 20 bp, Homo sapiens
actgccaaataaatcatcct

SEQ ID NO: 604998 - DNA, 18 bp, Homo sapiens
actgcccacatttgggct

SEQ ID NO: 604999 - DNA, 22 bp, Homo sapiens
actgcccacatttgggctcagg

SEQ ID NO: 605000 - DNA, 21 bp, Homo sapiens
actgcccaccctgggcctccc

SEQ ID NO: 605001 - DNA, 18 bp, Homo sapiens
actgccctccgcccttcc

SEQ ID NO: 605002 - DNA, 18 bp, Homo sapiens
actgctacaccttagcag

SEQ ID NO: 605003 - DNA, 17 bp, Homo sapiens
actgctttcagtgcctg

SEQ ID NO: 605004 - DNA, 19 bp, Homo sapiens
actgctttcagtgcctgct

SEQ ID NO: 605005 - DNA, 21 bp, Homo sapiens
actggaaacaaggaaggacat

SEQ ID NO: 605006 - DNA, 12 bp, Homo sapiens
actggaaacatc

SEQ ID NO: 605007 - DNA, 18 bp, Homo sapiens
actggaaacatctgattt

SEQ ID NO: 605008 - DNA, 21 bp, Homo sapiens
actggaaacatctgatttctg

SEQ ID NO: 605009 - DNA, 15 bp, Homo sapiens
actggcccacccctc

SEQ ID NO: 605010 - DNA, 10 bp, Homo sapiens
actggcccca

SEQ ID NO: 605011 - DNA, 14 bp, Homo sapiens
actggccccaggcg

SEQ ID NO: 605012 - DNA, 14 bp, Homo sapiens
actggccttttcac

SEQ ID NO: 605013 - DNA, 17 bp, Homo sapiens
actggctagctatatta

SEQ ID NO: 605014 - DNA, 14 bp, Homo sapiens
actgggaaatgaga

SEQ ID NO: 605015 - DNA, 13 bp, Homo sapiens
actgggctgctgg

SEQ ID NO: 605016 - DNA, 18 bp, Homo sapiens
actgggctgctggggcag

SEQ ID NO: 605017 - DNA, 17 bp, Homo sapiens
actgggtgttcaaggcc

SEQ ID NO: 605018 - DNA, 20 bp, Homo sapiens
actgggttctttggaagcag

SEQ ID NO: 605019 - DNA, 24 bp, Homo sapiens
actggtaaaaagatccagggatgg

SEQ ID NO: 605020 - DNA, 17 bp, Homo sapiens
actgtaaaatacttctt

SEQ ID NO: 605021 - DNA, 22 bp, Homo sapiens
actgtacttgatttttcaaaga

SEQ ID NO: 605022 - DNA, 22 bp, Homo sapiens
actgtagtttttgttcaccttc

SEQ ID NO: 605023 - DNA, 21 bp, Homo sapiens
actgtataccccgtgaagcat

SEQ ID NO: 605024 - DNA, 23 bp, Homo sapiens
actgtattgggacgctggtaact

SEQ ID NO: 605025 - DNA, 15 bp, Homo sapiens
actgtatttacttgt

SEQ ID NO: 605026 - DNA, 22 bp, Homo sapiens
actgtatttcggctatgtctca

SEQ ID NO: 605027 - DNA, 21 bp, Homo sapiens
actgtcatgtgcgaacacagt

SEQ ID NO: 605028 - DNA, 18 bp, Homo sapiens
actgtctatttctgctga

SEQ ID NO: 605029 - DNA, 19 bp, Homo sapiens
actgtctatttctgctgaa

SEQ ID NO: 605030 - DNA, 19 bp, Homo sapiens
actgtcttcaaccctgccc

SEQ ID NO: 605031 - DNA, 20 bp, Homo sapiens
actgtcttcaaccctgccct

SEQ ID NO: 605032 - DNA, 12 bp, Homo sapiens
actgtgacattc

SEQ ID NO: 605033 - DNA, 18 bp, Homo sapiens
actgtgacattccacaga

SEQ ID NO: 605034 - DNA, 19 bp, Homo sapiens
actgtgacattccacagag

SEQ ID NO: 605035 - DNA, 13 bp, Homo sapiens
actgtgacctgct

SEQ ID NO: 605036 - DNA, 20 bp, Homo sapiens
actgtgacctgctcctgccc

SEQ ID NO: 605037 - DNA, 16 bp, Homo sapiens
actgtgagataaatat

SEQ ID NO: 605038 - DNA, 17 bp, Homo sapiens
actgtggataaattttg

SEQ ID NO: 605039 - DNA, 16 bp, Homo sapiens
actgttaacccagtgt

SEQ ID NO: 605040 - DNA, 17 bp, Homo sapiens
actgttaacccagtgtt

SEQ ID NO: 605041 - DNA, 15 bp, Homo sapiens
actgttctgaaatta

SEQ ID NO: 605042 - DNA, 18 bp, Homo sapiens
actgttgcccttttcctt

SEQ ID NO: 605043 - DNA, 23 bp, Homo sapiens
actgtttataataggtggagact

SEQ ID NO: 605044 - DNA, 19 bp, Homo sapiens
actgtttgaaaagaaataa

SEQ ID NO: 605045 - DNA, 17 bp, Homo sapiens
actgttttgggcctcca

SEQ ID NO: 605046 - DNA, 15 bp, Homo sapiens
agtgccttggagcag

SEQ ID NO: 605047 - DNA, 21 bp, Homo sapiens
agtgccttggagcagaaagcc

SEQ ID NO: 605048 - DNA, 21 bp, Homo sapiens
agtgctatgcatatttataga

SEQ ID NO: 605049 - DNA, 15 bp, Homo sapiens
agtgctcagtattga

SEQ ID NO: 605050 - DNA, 21 bp, Homo sapiens
agtgcttgaggccaaatgagt

SEQ ID NO: 605051 - DNA, 13 bp, Homo sapiens
agtggactgtatt

SEQ ID NO: 605052 - DNA, 13 bp, Homo sapiens
agtggaggaggag

SEQ ID NO: 605053 - DNA, 19 bp, Homo sapiens
agtggaggagggggtacag

SEQ ID NO: 605054 - DNA, 23 bp, Homo sapiens
agtggaggggtcagcaggggggt

SEQ ID NO: 605055 - DNA, 20 bp, Homo sapiens
agtggatccagcttcactgt

SEQ ID NO: 605056 - DNA, 21 bp, Homo sapiens
agtggatctggagtctgaagg

SEQ ID NO: 605057 - DNA, 16 bp, Homo sapiens
agtggcaggtgggctg

SEQ ID NO: 605058 - DNA, 22 bp, Homo sapiens
agtggctcgtgtttcacagtgg

SEQ ID NO: 605059 - DNA, 23 bp, Homo sapiens
agtggctgaaataaaagcctctg

SEQ ID NO: 605060 - DNA, 11 bp, Homo sapiens
agtggctgggg

SEQ ID NO: 605061 - DNA, 20 bp, Homo sapiens
agtggctgggggactgcttt

SEQ ID NO: 605062 - DNA, 16 bp, Homo sapiens
agtgggcggcttccct

SEQ ID NO: 605063 - DNA, 19 bp, Homo sapiens
agtggggcccatggcccca

SEQ ID NO: 605064 - DNA, 20 bp, Homo sapiens
agtggtagagtcctaggaca

SEQ ID NO: 605065 - DNA, 16 bp, Homo sapiens
agtggtattttaacat

SEQ ID NO: 605066 - DNA, 21 bp, Homo sapiens
agtgtacatttgatttgatat

SEQ ID NO: 605067 - DNA, 16 bp, Homo sapiens
agtgtactctgagtcc

SEQ ID NO: 605068 - DNA, 21 bp, Homo sapiens
agtgtcacttttttcctgtca

SEQ ID NO: 605069 - DNA, 22 bp, Homo sapiens
agtgtcacttttttcctgtcaa

SEQ ID NO: 605070 - DNA, 16 bp, Homo sapiens
agtgtggatgtaaatt

SEQ ID NO: 605071 - DNA, 19 bp, Homo sapiens
agtgtggcttaaacatttt

SEQ ID NO: 605072 - DNA, 18 bp, Homo sapiens
agtgtgtgtgcaatgttc

SEQ ID NO: 605073 - DNA, 21 bp, Homo sapiens
agtgtgttgggaattgcatgc

SEQ ID NO: 605074 - DNA, 19 bp, Homo sapiens
agtgttataaaatctgtat

SEQ ID NO: 605075 - DNA, 23 bp, Homo sapiens
agtgttataaaatctgtattgct

SEQ ID NO: 605076 - DNA, 20 bp, Homo sapiens
agtgttcaaattctgattat

SEQ ID NO: 605077 - DNA, 18 bp, Homo sapiens
agtgttgtcttattccta

SEQ ID NO: 605078 - DNA, 19 bp, Homo sapiens
agtgtttagaagagcctga

SEQ ID NO: 605079 - DNA, 17 bp, Homo sapiens
agtgtttctagtaacag

SEQ ID NO: 605080 - DNA, 22 bp, Homo sapiens
agtgtttctagtaacagtattt

SEQ ID NO: 605081 - DNA, 23 bp, Homo sapiens
agtgttttcattctggtccttag

SEQ ID NO: 605082 - DNA, 19 bp, Homo sapiens
agttaaaatgtgtttttca

SEQ ID NO: 605083 - DNA, 15 bp, Homo sapiens
agttaatgtgccaaa

SEQ ID NO: 605084 - DNA, 21 bp, Homo sapiens
agttactgccacggtcctttg

SEQ ID NO: 605085 - DNA, 15 bp, Homo sapiens
agttacttacacacc

SEQ ID NO: 605086 - DNA, 16 bp, Homo sapiens
agttacttgtgttcat

SEQ ID NO: 605087 - DNA, 17 bp, Homo sapiens
agttacttgtgttcatt

SEQ ID NO: 605088 - DNA, 19 bp, Homo sapiens
agttagagactcgcctggg

SEQ ID NO: 605089 - DNA, 14 bp, Homo sapiens
agttagcacagagg

SEQ ID NO: 605090 - DNA, 19 bp, Homo sapiens
agttagcccggccaaggac

SEQ ID NO: 605091 - DNA, 21 bp, Homo sapiens
agttagcccggccaaggacac

SEQ ID NO: 605092 - DNA, 12 bp, Homo sapiens
agttataatttc

SEQ ID NO: 605093 - DNA, 21 bp, Homo sapiens
agttattatagttattcaaat

SEQ ID NO: 605094 - DNA, 11 bp, Homo sapiens
agttatttacc

SEQ ID NO: 605095 - DNA, 23 bp, Homo sapiens
agttatttaccagaagtttaaat

SEQ ID NO: 605096 - DNA, 18 bp, Homo sapiens
agttatttgatctggtgc

SEQ ID NO: 605097 - DNA, 17 bp, Homo sapiens
agttattttgtgtcctt

SEQ ID NO: 605098 - DNA, 13 bp, Homo sapiens
agttcatagaaat

SEQ ID NO: 605099 - DNA, 16 bp, Homo sapiens
agttcccatttccttg

SEQ ID NO: 605100 - DNA, 19 bp, Homo sapiens
agttcccatttccttgtct

SEQ ID NO: 605101 - DNA, 18 bp, Homo sapiens
agttcccttgattcaaat

SEQ ID NO: 605102 - DNA, 20 bp, Homo sapiens
agttcccttgattcaaataa

SEQ ID NO: 605103 - DNA, 16 bp, Homo sapiens
agttctattatctggg

SEQ ID NO: 605104 - DNA, 18 bp, Homo sapiens
agttctattatctgggtt

SEQ ID NO: 605105 - DNA, 17 bp, Homo sapiens
agttctccttgtacttg

SEQ ID NO: 605106 - DNA, 19 bp, Homo sapiens
agttctgcacatacagatg

SEQ ID NO: 605107 - DNA, 13 bp, Homo sapiens
agttctgctgccc

SEQ ID NO: 605108 - DNA, 16 bp, Homo sapiens
agttctgctgccctct

SEQ ID NO: 605109 - DNA, 19 bp, Homo sapiens
agttctgctgccctcttaa

SEQ ID NO: 605110 - DNA, 17 bp, Homo sapiens
agttgaagggaaatcaa

SEQ ID NO: 605111 - DNA, 20 bp, Homo sapiens
agttgagccagcagacattg

SEQ ID NO: 605112 - DNA, 21 bp, Homo sapiens
agttgcaataaactcagtcaa

SEQ ID NO: 605113 - DNA, 22 bp, Homo sapiens
agttgccgcatattatatcaga

SEQ ID NO: 605114 - DNA, 13 bp, Homo sapiens
agttgcttacaaa

SEQ ID NO: 605115 - DNA, 17 bp, Homo sapiens
aggagcttccagtgcat

SEQ ID NO: 605116 - DNA, 20 bp, Homo sapiens
aggaggacagagtgccctgg

SEQ ID NO: 605117 - DNA, 15 bp, Homo sapiens
aggaggacagggagg

SEQ ID NO: 605118 - DNA, 22 bp, Homo sapiens
aggaggacctggggggggcaag

SEQ ID NO: 605119 - DNA, 23 bp, Homo sapiens
aggaggacctggggggggcaaga

SEQ ID NO: 605120 - DNA, 23 bp, Homo sapiens
aggaggagccttgctgggccagg

SEQ ID NO: 605121 - DNA, 14 bp, Homo sapiens
aggaggaggacaca

SEQ ID NO: 605122 - DNA, 13 bp, Homo sapiens
aggaggccgactg

SEQ ID NO: 605123 - DNA, 16 bp, Homo sapiens
aggagggtgcccctgg

SEQ ID NO: 605124 - DNA, 17 bp, Homo sapiens
aggagggtgcccctggg

SEQ ID NO: 605125 - DNA, 19 bp, Homo sapiens
aggagggtgcccctgggaa

SEQ ID NO: 605126 - DNA, 15 bp, Homo sapiens
aggaggtgtggagtg

SEQ ID NO: 605127 - DNA, 16 bp, Homo sapiens
aggaggtgtggagtgg

SEQ ID NO: 605128 - DNA, 23 bp, Homo sapiens
aggaggtgtggagtggaggggtc

SEQ ID NO: 605129 - DNA, 19 bp, Homo sapiens
aggataatgagatgtaata

SEQ ID NO: 605130 - DNA, 15 bp, Homo sapiens
aggatagcagagaag

SEQ ID NO: 605131 - DNA, 15 bp, Homo sapiens
aggatatagcaacat

SEQ ID NO: 605132 - DNA, 16 bp, Homo sapiens
aggatcctgagccaga

SEQ ID NO: 605133 - DNA, 18 bp, Homo sapiens
aggatgcatgcagggccc

SEQ ID NO: 605134 - DNA, 19 bp, Homo sapiens
aggattaggtttagaatca

SEQ ID NO: 605135 - DNA, 14 bp, Homo sapiens
aggattctcctttt

SEQ ID NO: 605136 - DNA, 11 bp, Homo sapiens
aggattctttt

SEQ ID NO: 605137 - DNA, 22 bp, Homo sapiens
aggattcttttttcaatgtact

SEQ ID NO: 605138 - DNA, 23 bp, Homo sapiens
aggattcttttttcaatgtactg

SEQ ID NO: 605139 - DNA, 17 bp, Homo sapiens
aggcaaaaactgtactg

SEQ ID NO: 605140 - DNA, 20 bp, Homo sapiens
aggcaaaccaatttgttctg

SEQ ID NO: 605141 - DNA, 21 bp, Homo sapiens
aggcaaaccaatttgttctgt

SEQ ID NO: 605142 - DNA, 18 bp, Homo sapiens
aggcaaacttttatgcag

SEQ ID NO: 605143 - DNA, 15 bp, Homo sapiens
aggcaagaagtggga

SEQ ID NO: 605144 - DNA, 13 bp, Homo sapiens
aggcaccatgctg

SEQ ID NO: 605145 - DNA, 17 bp, Homo sapiens
aggcaccatgctgggcc

SEQ ID NO: 605146 - DNA, 17 bp, Homo sapiens
aggcaccggacgctgga

SEQ ID NO: 605147 - DNA, 23 bp, Homo sapiens
aggcaccggacgctggagaccct

SEQ ID NO: 605148 - DNA, 18 bp, Homo sapiens
aggcactgtcaggaatgg

SEQ ID NO: 605149 - DNA, 20 bp, Homo sapiens
aggcagaatggtgggctcca

SEQ ID NO: 605150 - DNA, 23 bp, Homo sapiens
aggcagaatggtgggctccagag

SEQ ID NO: 605151 - DNA, 22 bp, Homo sapiens
aggcagagattgggggggcttg

SEQ ID NO: 605152 - DNA, 23 bp, Homo sapiens
aggcagccctcacctctgaggac

SEQ ID NO: 605153 - DNA, 20 bp, Homo sapiens
aggcagctaggcagggaggg

SEQ ID NO: 605154 - DNA, 16 bp, Homo sapiens
aggcagggagggggct

SEQ ID NO: 605155 - DNA, 17 bp, Homo sapiens
aggcagggagggggctg

SEQ ID NO: 605156 - DNA, 23 bp, Homo sapiens
aggcagggagggggctgggaaag

SEQ ID NO: 605157 - DNA, 13 bp, Homo sapiens
aggcagggccctg

SEQ ID NO: 605158 - DNA, 19 bp, Homo sapiens
aggcaggtgggggctgcgt

SEQ ID NO: 605159 - DNA, 21 bp, Homo sapiens
aggcagtgaacacactcagca

SEQ ID NO: 605160 - DNA, 17 bp, Homo sapiens
aggcatattattttctg

SEQ ID NO: 605161 - DNA, 23 bp, Homo sapiens
aggcattactggccttttcactg

SEQ ID NO: 605162 - DNA, 14 bp, Homo sapiens
aggcccagccctgg

SEQ ID NO: 605163 - DNA, 15 bp, Homo sapiens
aggcccagccctggg

SEQ ID NO: 605164 - DNA, 14 bp, Homo sapiens
aggcccagcctctt

SEQ ID NO: 605165 - DNA, 13 bp, Homo sapiens
aggcccccggagg

SEQ ID NO: 605166 - DNA, 13 bp, Homo sapiens
aggcccctgaggg

SEQ ID NO: 605167 - DNA, 14 bp, Homo sapiens
aggcccctgtgcag

SEQ ID NO: 605168 - DNA, 13 bp, Homo sapiens
aggcccgaggagg

SEQ ID NO: 605169 - DNA, 21 bp, Homo sapiens
aggcccgaggaggccgactgg

SEQ ID NO: 605170 - DNA, 22 bp, Homo sapiens
aggcccggccccatcagaggct

SEQ ID NO: 605171 - DNA, 15 bp, Homo sapiens
aggccggggtccagg

SEQ ID NO: 605172 - DNA, 18 bp, Homo sapiens
aggcctcagggaccaagg

SEQ ID NO: 605173 - DNA, 21 bp, Homo sapiens
aggcctcagggaccaaggaga

SEQ ID NO: 605174 - DNA, 22 bp, Homo sapiens
aggcctcagggaccaaggagat

SEQ ID NO: 605175 - DNA, 18 bp, Homo sapiens
aggcctccctcgggctgg

SEQ ID NO: 605176 - DNA, 21 bp, Homo sapiens
aggcctccctcgggctggtgt

SEQ ID NO: 605177 - DNA, 18 bp, Homo sapiens
aggcctgagggaagccca

SEQ ID NO: 605178 - DNA, 21 bp, Homo sapiens
aggcctgagggaagcccaccc

SEQ ID NO: 605179 - DNA, 15 bp, Homo sapiens
aggcctggtctggag

SEQ ID NO: 605180 - DNA, 23 bp, Homo sapiens
aggcctggtctggagcccctatc

SEQ ID NO: 605181 - DNA, 17 bp, Homo sapiens
aggcctttccccagtgt

SEQ ID NO: 605182 - DNA, 19 bp, Homo sapiens
atcttggccctgttaaggc

SEQ ID NO: 605183 - DNA, 12 bp, Homo sapiens
atcttgtaaata

SEQ ID NO: 605184 - DNA, 15 bp, Homo sapiens
atcttgtggggccag

SEQ ID NO: 605185 - DNA, 17 bp, Homo sapiens
atcttgtggggccagga

SEQ ID NO: 605186 - DNA, 12 bp, Homo sapiens
atctttgttaaa

SEQ ID NO: 605187 - DNA, 15 bp, Homo sapiens
atctttttttaagtg

SEQ ID NO: 605188 - DNA, 18 bp, Homo sapiens
atgaaaaagcatgtacag

SEQ ID NO: 605189 - DNA, 19 bp, Homo sapiens
atgaaaaagcatgtacagt

SEQ ID NO: 605190 - DNA, 16 bp, Homo sapiens
atgaaaaatctgaatt

SEQ ID NO: 605191 - DNA, 18 bp, Homo sapiens
atgaaaaatctgaatttc

SEQ ID NO: 605192 - DNA, 19 bp, Homo sapiens
atgaaaaccaccctatcat

SEQ ID NO: 605193 - DNA, 14 bp, Homo sapiens
atgaaaagttttca

SEQ ID NO: 605194 - DNA, 18 bp, Homo sapiens
atgaaaatggctgaagaa

SEQ ID NO: 605195 - DNA, 16 bp, Homo sapiens
atgaaacaaatatact

SEQ ID NO: 605196 - DNA, 19 bp, Homo sapiens
atgaaacaaatatactcat

SEQ ID NO: 605197 - DNA, 13 bp, Homo sapiens
atgaaagagaaaa

SEQ ID NO: 605198 - DNA, 22 bp, Homo sapiens
atgaaagagaaaatgctttctc

SEQ ID NO: 605199 - DNA, 18 bp, Homo sapiens
atgcttttctcatggtat

SEQ ID NO: 605200 - DNA, 15 bp, Homo sapiens
atggaacagccctgc

SEQ ID NO: 605201 - DNA, 19 bp, Homo sapiens
atggaagacaaatacacat

SEQ ID NO: 605202 - DNA, 15 bp, Homo sapiens
atggaatcacagcca

SEQ ID NO: 605203 - DNA, 18 bp, Homo sapiens
atggaatcacagccaata

SEQ ID NO: 605204 - DNA, 21 bp, Homo sapiens
atggaattttttcctgctagt

SEQ ID NO: 605205 - DNA, 18 bp, Homo sapiens
atggagaagggttctgcc

SEQ ID NO: 605206 - DNA, 18 bp, Homo sapiens
atggaggtgatgaaaacc

SEQ ID NO: 605207 - DNA, 15 bp, Homo sapiens
atggagtagagtcag

SEQ ID NO: 605208 - DNA, 18 bp, Homo sapiens
atggattcccctggacat

SEQ ID NO: 605209 - DNA, 16 bp, Homo sapiens
atggatttgacacact

SEQ ID NO: 605210 - DNA, 18 bp, Homo sapiens
atggatttgacacactca

SEQ ID NO: 605211 - DNA, 13 bp, Homo sapiens
atggccccagctg

SEQ ID NO: 605212 - DNA, 17 bp, Homo sapiens
atggccctgtagctctg

SEQ ID NO: 605213 - DNA, 14 bp, Homo sapiens
atggccttccctcc

SEQ ID NO: 605214 - DNA, 13 bp, Homo sapiens
atggctgaagaaa

SEQ ID NO: 605215 - DNA, 17 bp, Homo sapiens
atggctgaagaaacaca

SEQ ID NO: 605216 - DNA, 21 bp, Homo sapiens
atggctgaagaaacacagcat

SEQ ID NO: 605217 - DNA, 16 bp, Homo sapiens
atggctgggtttgggc

SEQ ID NO: 605218 - DNA, 21 bp, Homo sapiens
atggctgtcccctgcaagtgg

SEQ ID NO: 605219 - DNA, 18 bp, Homo sapiens
atggcttgtagggtgagg

SEQ ID NO: 605220 - DNA, 15 bp, Homo sapiens
atgggccaagccagg

SEQ ID NO: 605221 - DNA, 12 bp, Homo sapiens
atgggccctcag

SEQ ID NO: 605222 - DNA, 14 bp, Homo sapiens
atggggcctgggct

SEQ ID NO: 605223 - DNA, 15 bp, Homo sapiens
atggggcctgggctg

SEQ ID NO: 605224 - DNA, 18 bp, Homo sapiens
atggggggcgggccaggg

SEQ ID NO: 605225 - DNA, 14 bp, Homo sapiens
atgggtcctgctgc

SEQ ID NO: 605226 - DNA, 18 bp, Homo sapiens
atgggttgaacaagccac

SEQ ID NO: 605227 - DNA, 13 bp, Homo sapiens
atggtagaaactt

SEQ ID NO: 605228 - DNA, 18 bp, Homo sapiens
atggtagaaactttggaa

SEQ ID NO: 605229 - DNA, 18 bp, Homo sapiens
atggtagaaattttatct

SEQ ID NO: 605230 - DNA, 23 bp, Homo sapiens
atggtagaaattttatctcttct

SEQ ID NO: 605231 - DNA, 17 bp, Homo sapiens
atggtatatattttgaa

SEQ ID NO: 605232 - DNA, 17 bp, Homo sapiens
atggtattttttgtgaa

SEQ ID NO: 605233 - DNA, 18 bp, Homo sapiens
atggtattttttgtgaat

SEQ ID NO: 605234 - DNA, 18 bp, Homo sapiens
atggtgatactccaaggt

SEQ ID NO: 605235 - DNA, 17 bp, Homo sapiens
atggtgcaatgaccttt

SEQ ID NO: 605236 - DNA, 16 bp, Homo sapiens
atggtgctgggtcctt

SEQ ID NO: 605237 - DNA, 19 bp, Homo sapiens
atggtggtttcagaaaggg

SEQ ID NO: 605238 - DNA, 21 bp, Homo sapiens
atggtggtttcagaaagggca

SEQ ID NO: 605239 - DNA, 17 bp, Homo sapiens
atggtgtcctgcatgta

SEQ ID NO: 605240 - DNA, 15 bp, Homo sapiens
atggttgcaaagtgt

SEQ ID NO: 605241 - DNA, 15 bp, Homo sapiens
atgtaaacatcataa

SEQ ID NO: 605242 - DNA, 17 bp, Homo sapiens
atgtaaatattgctgtc

SEQ ID NO: 605243 - DNA, 20 bp, Homo sapiens
atgtaatacaccaaatagct

SEQ ID NO: 605244 - DNA, 14 bp, Homo sapiens
atgtacaaaatgaa

SEQ ID NO: 605245 - DNA, 15 bp, Homo sapiens
atgtacaaaatgaat

SEQ ID NO: 605246 - DNA, 17 bp, Homo sapiens
atgtacaggctgagaca

SEQ ID NO: 605247 - DNA, 11 bp, Homo sapiens
atgtacagtgt

SEQ ID NO: 605248 - DNA, 14 bp, Homo sapiens
atgtacccagccta

SEQ ID NO: 605249 - DNA, 23 bp, Homo sapiens
atgtatatctgtgtaagacacgt

SEQ ID NO: 605250 - DNA, 17 bp, Homo sapiens
atgtatgccatgtatgt

SEQ ID NO: 605251 - DNA, 13 bp, Homo sapiens
atgtatgtgtata

SEQ ID NO: 605252 - DNA, 14 bp, Homo sapiens
atgtatgtgtatat

SEQ ID NO: 605253 - DNA, 18 bp, Homo sapiens
atgtatgtgtatatgttt

SEQ ID NO: 605254 - DNA, 19 bp, Homo sapiens
atgtatgtgtatatgttta

SEQ ID NO: 605255 - DNA, 20 bp, Homo sapiens
atgtatgtgtatatgtttat

SEQ ID NO: 605256 - DNA, 17 bp, Homo sapiens
atgtatgttgcatgaat

SEQ ID NO: 605257 - DNA, 14 bp, Homo sapiens
atgtattatggtga

SEQ ID NO: 605258 - DNA, 15 bp, Homo sapiens
atgtattctcttcta

SEQ ID NO: 605259 - DNA, 20 bp, Homo sapiens
atgtattgtgtcttttgcat

SEQ ID NO: 605260 - DNA, 16 bp, Homo sapiens
atgtattttattgtaa

SEQ ID NO: 605261 - DNA, 23 bp, Homo sapiens
atgtattttattgtaacagacat

SEQ ID NO: 605262 - DNA, 17 bp, Homo sapiens
atgtcagtagtgcctgt

SEQ ID NO: 605263 - DNA, 13 bp, Homo sapiens
atgtcatttcata

SEQ ID NO: 605264 - DNA, 13 bp, Homo sapiens
atgtcattttcag

SEQ ID NO: 605265 - DNA, 15 bp, Homo sapiens
atgtcattttcagat

SEQ ID NO: 605266 - DNA, 16 bp, Homo sapiens
atgtccaggtcacagg

SEQ ID NO: 605267 - DNA, 14 bp, Homo sapiens
atgtcctatccctg

SEQ ID NO: 605268 - DNA, 22 bp, Homo sapiens
atgtctcaccaggaaattctgt

SEQ ID NO: 605269 - DNA, 19 bp, Homo sapiens
atgtcttcatgttgatgtg

SEQ ID NO: 605270 - DNA, 15 bp, Homo sapiens
atgtctttaaaatga

SEQ ID NO: 605271 - DNA, 18 bp, Homo sapiens
atgtgaaaaaaaaaagta

SEQ ID NO: 605272 - DNA, 21 bp, Homo sapiens
atgtgaaaaaaaaaagtaatt

SEQ ID NO: 605273 - DNA, 23 bp, Homo sapiens
atgtgaactttctcagcatatat

SEQ ID NO: 605274 - DNA, 16 bp, Homo sapiens
atgtgagcactatctt

SEQ ID NO: 605275 - DNA, 17 bp, Homo sapiens
atgtgatgagaggaaat

SEQ ID NO: 605276 - DNA, 17 bp, Homo sapiens
atgtgctcatcagaaac

SEQ ID NO: 605277 - DNA, 19 bp, Homo sapiens
atgtgctgttgattctttc

SEQ ID NO: 605278 - DNA, 22 bp, Homo sapiens
atgtgctgttgattctttcaat

SEQ ID NO: 605279 - DNA, 18 bp, Homo sapiens
atgtggatggaggtgatg

SEQ ID NO: 605280 - DNA, 22 bp, Homo sapiens
atgtgtatggaagacaaataca

SEQ ID NO: 605281 - DNA, 15 bp, Homo sapiens
atgtgttgctctcca

SEQ ID NO: 605282 - DNA, 17 bp, Homo sapiens
atgttattactgttttg

SEQ ID NO: 605283 - DNA, 16 bp, Homo sapiens
atgttattcaataact

SEQ ID NO: 605284 - DNA, 21 bp, Homo sapiens
atgttcatgtgtaacttctag

SEQ ID NO: 605285 - DNA, 19 bp, Homo sapiens
atgttcttgcagtcatcag

SEQ ID NO: 605286 - DNA, 17 bp, Homo sapiens
atgttgccatgaggcct

SEQ ID NO: 605287 - DNA, 21 bp, Homo sapiens
atgttgccatgaggcctttcc

SEQ ID NO: 605288 - DNA, 12 bp, Homo sapiens
atgttgtaatat

SEQ ID NO: 605289 - DNA, 22 bp, Homo sapiens
atgttgtgttggtatttactgc

SEQ ID NO: 605290 - DNA, 16 bp, Homo sapiens
atgtttaaaatggcat

SEQ ID NO: 605291 - DNA, 22 bp, Homo sapiens
atgtttaaaatggcatttagca

SEQ ID NO: 605292 - DNA, 23 bp, Homo sapiens
atgtttaaaatggcatttagcac

SEQ ID NO: 605293 - DNA, 17 bp, Homo sapiens
atgtttaacttaatcaa

SEQ ID NO: 605294 - DNA, 19 bp, Homo sapiens
atgtttaataatatgtaca

SEQ ID NO: 605295 - DNA, 15 bp, Homo sapiens
atgtttccaagatgt

SEQ ID NO: 605296 - DNA, 14 bp, Homo sapiens
atgtttctatatgt

SEQ ID NO: 605297 - DNA, 13 bp, Homo sapiens
atgtttggctgaa

SEQ ID NO: 605298 - DNA, 16 bp, Homo sapiens
atgtttggctgaaatt

SEQ ID NO: 605299 - DNA, 19 bp, Homo sapiens
atgtttggctgaaattatg

SEQ ID NO: 605300 - DNA, 19 bp, Homo sapiens
atgttttggagagagcaat

SEQ ID NO: 605301 - DNA, 22 bp, Homo sapiens
atgttttggagagagcaatctt

SEQ ID NO: 605302 - DNA, 14 bp, Homo sapiens
attaaaaagacact

SEQ ID NO: 605303 - DNA, 18 bp, Homo sapiens
attaaaaagacactttta

SEQ ID NO: 605304 - DNA, 13 bp, Homo sapiens
attaaaaagttaa

SEQ ID NO: 605305 - DNA, 15 bp, Homo sapiens
attaaaaattataga

SEQ ID NO: 605306 - DNA, 13 bp, Homo sapiens
attaaaacaaaat

SEQ ID NO: 605307 - DNA, 21 bp, Homo sapiens
cattgcttcattaaaacaaga

SEQ ID NO: 605308 - DNA, 18 bp, Homo sapiens
cattggcagtgtgtcaca

SEQ ID NO: 605309 - DNA, 14 bp, Homo sapiens
cattggttacaaat

SEQ ID NO: 605310 - DNA, 13 bp, Homo sapiens
cattgtcagaatg

SEQ ID NO: 605311 - DNA, 14 bp, Homo sapiens
cattgtcagaatgt

SEQ ID NO: 605312 - DNA, 20 bp, Homo sapiens
cattgtggatatgagctttc

SEQ ID NO: 605313 - DNA, 21 bp, Homo sapiens
cattgttcagaaaagcacctc

SEQ ID NO: 605314 - DNA, 14 bp, Homo sapiens
cattgtttgtcctt

SEQ ID NO: 605315 - DNA, 16 bp, Homo sapiens
cattgttttgccaaca

SEQ ID NO: 605316 - DNA, 20 bp, Homo sapiens
catttaacactgagtgaaat

SEQ ID NO: 605317 - DNA, 22 bp, Homo sapiens
catttacaacttccagatttga

SEQ ID NO: 605318 - DNA, 15 bp, Homo sapiens
catttagtcctcacc

SEQ ID NO: 605319 - DNA, 18 bp, Homo sapiens
catttagtcctcaccttc

SEQ ID NO: 605320 - DNA, 23 bp, Homo sapiens
catttagtcctcaccttctgttt

SEQ ID NO: 605321 - DNA, 13 bp, Homo sapiens
catttatgcatga

SEQ ID NO: 605322 - DNA, 21 bp, Homo sapiens
catttatgcatgagaactaaa

SEQ ID NO: 605323 - DNA, 13 bp, Homo sapiens
catttatgtacaa

SEQ ID NO: 605324 - DNA, 22 bp, Homo sapiens
catttatgtacaaaatgaattg

SEQ ID NO: 605325 - DNA, 15 bp, Homo sapiens
catttcacacaactg

SEQ ID NO: 605326 - DNA, 16 bp, Homo sapiens
catttcacacaactgt

SEQ ID NO: 605327 - DNA, 19 bp, Homo sapiens
catttccagcaaaatatat

SEQ ID NO: 605328 - DNA, 14 bp, Homo sapiens
catttgatttgata

SEQ ID NO: 605329 - DNA, 21 bp, Homo sapiens
catttgcaggtgaccagaatg

SEQ ID NO: 605330 - DNA, 20 bp, Homo sapiens
catttgctagttctgctgcc

SEQ ID NO: 605331 - DNA, 17 bp, Homo sapiens
catttggatataaatct

SEQ ID NO: 605332 - DNA, 19 bp, Homo sapiens
catttggatataaatctta

SEQ ID NO: 605333 - DNA, 19 bp, Homo sapiens
catttggattttaaacaaa

SEQ ID NO: 605334 - DNA, 22 bp, Homo sapiens
catttggattttaaacaaaatt

SEQ ID NO: 605335 - DNA, 22 bp, Homo sapiens
catttgggtattttgtcagttt

SEQ ID NO: 605336 - DNA, 14 bp, Homo sapiens
catttggtggctct

SEQ ID NO: 605337 - DNA, 18 bp, Homo sapiens
catttgttaatgattctt

SEQ ID NO: 605338 - DNA, 14 bp, Homo sapiens
catttgttctgggt

SEQ ID NO: 605339 - DNA, 12 bp, Homo sapiens
cattttaaatgg

SEQ ID NO: 605340 - DNA, 17 bp, Homo sapiens
cattttaatagtttcta

SEQ ID NO: 605341 - DNA, 12 bp, Homo sapiens
cattttcagatc

SEQ ID NO: 605342 - DNA, 18 bp, Homo sapiens
cattttcagatccttcca

SEQ ID NO: 605343 - DNA, 19 bp, Homo sapiens
cattttcagatccttccaa

SEQ ID NO: 605344 - DNA, 13 bp, Homo sapiens
cattttgatgtat

SEQ ID NO: 605345 - DNA, 17 bp, Homo sapiens
cattttgatgtattatt

SEQ ID NO: 605346 - DNA, 20 bp, Homo sapiens
cattttgcagctatggacaa

SEQ ID NO: 605347 - DNA, 13 bp, Homo sapiens
cattttgtagcta

SEQ ID NO: 605348 - DNA, 14 bp, Homo sapiens
cattttgtctggct

SEQ ID NO: 605349 - DNA, 21 bp, Homo sapiens
cattttgtctggctgtggccc

SEQ ID NO: 605350 - DNA, 14 bp, Homo sapiens
catttttaattcct

SEQ ID NO: 605351 - DNA, 16 bp, Homo sapiens
catttttgagtaaaac

SEQ ID NO: 605352 - DNA, 22 bp, Homo sapiens
catttttgagtaaaacttgtat

SEQ ID NO: 605353 - DNA, 15 bp, Homo sapiens
catttttgtaatata

SEQ ID NO: 605354 - DNA, 15 bp, Homo sapiens
cattttttgtctgtg

SEQ ID NO: 605355 - DNA, 16 bp, Homo sapiens
ccaaaagctgctttcc

SEQ ID NO: 605356 - DNA, 12 bp, Homo sapiens
ccaaataacagt

SEQ ID NO: 605357 - DNA, 14 bp, Homo sapiens
ccaaataagcatct

SEQ ID NO: 605358 - DNA, 20 bp, Homo sapiens
ccaaatagggcaaagaatca

SEQ ID NO: 605359 - DNA, 22 bp, Homo sapiens
ccaaatgtgtcttgtattatca

SEQ ID NO: 605360 - DNA, 13 bp, Homo sapiens
ccaaattgctgag

SEQ ID NO: 605361 - DNA, 15 bp, Homo sapiens
ccaaattgctgagat

SEQ ID NO: 605362 - DNA, 20 bp, Homo sapiens
ccaacaatactttgtgtctt

SEQ ID NO: 605363 - DNA, 21 bp, Homo sapiens
ccaacacatcacttaccactt

SEQ ID NO: 605364 - DNA, 15 bp, Homo sapiens
ccaacccccacctcc

SEQ ID NO: 605365 - DNA, 16 bp, Homo sapiens
ccaacctggtaattat

SEQ ID NO: 605366 - DNA, 19 bp, Homo sapiens
ccaacgatcatatctgtat

SEQ ID NO: 605367 - DNA, 14 bp, Homo sapiens
ccaactatattgcg

SEQ ID NO: 605368 - DNA, 12 bp, Homo sapiens
ccaactctggcc

SEQ ID NO: 605369 - DNA, 19 bp, Homo sapiens
ccaagacagccatacttcc

SEQ ID NO: 605370 - DNA, 23 bp, Homo sapiens
ccaagccagggttccagacaggg

SEQ ID NO: 605371 - DNA, 20 bp, Homo sapiens
ccaagcccctagtcttagag

SEQ ID NO: 605372 - DNA, 20 bp, Homo sapiens
ccagggttaaagaaaggcag

SEQ ID NO: 605373 - DNA, 15 bp, Homo sapiens
ccagggttccagaca

SEQ ID NO: 605374 - DNA, 22 bp, Homo sapiens
ccagggttccagacagggtggg

SEQ ID NO: 605375 - DNA, 22 bp, Homo sapiens
ccaggtctggcgccaggggcag

SEQ ID NO: 605376 - DNA, 17 bp, Homo sapiens
ccagtacaataaataaa

SEQ ID NO: 605377 - DNA, 15 bp, Homo sapiens
ccagtcatggctgtc

SEQ ID NO: 605378 - DNA, 12 bp, Homo sapiens
ccagtccctgga

SEQ ID NO: 605379 - DNA, 14 bp, Homo sapiens
ccagtccctggagc

SEQ ID NO: 605380 - DNA, 16 bp, Homo sapiens
ccagtccctggagctg

SEQ ID NO: 605381 - DNA, 21 bp, Homo sapiens
ccagtccgccccgtgctcctc

SEQ ID NO: 605382 - DNA, 22 bp, Homo sapiens
ccagtccgccccgtgctcctct

SEQ ID NO: 605383 - DNA, 23 bp, Homo sapiens
ccagtccgccccgtgctcctctg

SEQ ID NO: 605384 - DNA, 15 bp, Homo sapiens
ccagtggcacaggag

SEQ ID NO: 605385 - DNA, 16 bp, Homo sapiens
ccagtggtgcgggcca

SEQ ID NO: 605386 - DNA, 23 bp, Homo sapiens
ccagtggtgcgggccaggtctgg

SEQ ID NO: 605387 - DNA, 13 bp, Homo sapiens
ccagtgtggcccc

SEQ ID NO: 605388 - DNA, 20 bp, Homo sapiens
ccagtgtttagaagagcctg

SEQ ID NO: 605389 - DNA, 19 bp, Homo sapiens
ccagttagcccggccaagg

SEQ ID NO: 605390 - DNA, 23 bp, Homo sapiens
ccagttagcccggccaaggacac

SEQ ID NO: 605391 - DNA, 13 bp, Homo sapiens
ccataatgcttct

SEQ ID NO: 605392 - DNA, 18 bp, Homo sapiens
ccatacttccagcgaaat

SEQ ID NO: 605393 - DNA, 13 bp, Homo sapiens
ccatagccccagg

SEQ ID NO: 605394 - DNA, 17 bp, Homo sapiens
ccatagccccaggcccg

SEQ ID NO: 605395 - DNA, 23 bp, Homo sapiens
ccatagccccaggcccgccctgc

SEQ ID NO: 605396 - DNA, 22 bp, Homo sapiens
ccatattctgtagtatttttct

SEQ ID NO: 605397 - DNA, 15 bp, Homo sapiens
ccatcagaggctggg

SEQ ID NO: 605398 - DNA, 15 bp, Homo sapiens
ccatcaggacttggg

SEQ ID NO: 605399 - DNA, 22 bp, Homo sapiens
ccatcattgaaatctttttgct

SEQ ID NO: 605400 - DNA, 14 bp, Homo sapiens
ccatcccctgcctc

SEQ ID NO: 605401 - DNA, 14 bp, Homo sapiens
ccatccttgcactt

SEQ ID NO: 605402 - DNA, 17 bp, Homo sapiens
ccatccttgctgcagct

SEQ ID NO: 605403 - DNA, 16 bp, Homo sapiens
ccatcgccttctgggg

SEQ ID NO: 605404 - DNA, 18 bp, Homo sapiens
ccatcttgtggggccagg

SEQ ID NO: 605405 - DNA, 14 bp, Homo sapiens
ccatgacagtagca

SEQ ID NO: 605406 - DNA, 16 bp, Homo sapiens
ccatgacagtagcata

SEQ ID NO: 605407 - DNA, 20 bp, Homo sapiens
ccatgcaggcagcctgcaga

SEQ ID NO: 605408 - DNA, 21 bp, Homo sapiens
ccatgcattcagatctgaagt

SEQ ID NO: 605409 - DNA, 13 bp, Homo sapiens
ccatgccaatgtc

SEQ ID NO: 605410 - DNA, 21 bp, Homo sapiens
ccatgccccagctctggatga

SEQ ID NO: 605411 - DNA, 17 bp, Homo sapiens
ccatgccctccctgctg

SEQ ID NO: 605412 - DNA, 11 bp, Homo sapiens
ccatgctgggc

SEQ ID NO: 605413 - DNA, 16 bp, Homo sapiens
ccatgctgggctcact

SEQ ID NO: 605414 - DNA, 13 bp, Homo sapiens
ccatgctgtccct

SEQ ID NO: 605415 - DNA, 15 bp, Homo sapiens
ccatgctgtccctgt

SEQ ID NO: 605416 - DNA, 17 bp, Homo sapiens
ccatgctgtccctgtgg

SEQ ID NO: 605417 - DNA, 19 bp, Homo sapiens
ccatgctgtccctgtgggc

SEQ ID NO: 605418 - DNA, 16 bp, Homo sapiens
ccatggattcccctgg

SEQ ID NO: 605419 - DNA, 20 bp, Homo sapiens
ccatggattcccctggacat

SEQ ID NO: 605420 - DNA, 23 bp, Homo sapiens
ccatggccgaagccccttggaga

SEQ ID NO: 605421 - DNA, 12 bp, Homo sapiens
ccatggccttcc

SEQ ID NO: 605422 - DNA, 12 bp, Homo sapiens
ccatgggccctc

SEQ ID NO: 605423 - DNA, 13 bp, Homo sapiens
ccatggtgcagtg

SEQ ID NO: 605424 - DNA, 20 bp, Homo sapiens
ccatggtggtttcagaaagg

SEQ ID NO: 605425 - DNA, 22 bp, Homo sapiens
ccatggtggtttcagaaagggc

SEQ ID NO: 605426 - DNA, 19 bp, Homo sapiens
ccatgtatgttgcatgaat

SEQ ID NO: 605427 - DNA, 19 bp, Homo sapiens
ccatgttaatacatcattt

SEQ ID NO: 605428 - DNA, 23 bp, Homo sapiens
ccattcagtctatgctgtgtgca

SEQ ID NO: 605429 - DNA, 12 bp, Homo sapiens
ccattcagtgac

SEQ ID NO: 605430 - DNA, 21 bp, Homo sapiens
ccattgaacactgcaccctcc

SEQ ID NO: 605431 - DNA, 15 bp, Homo sapiens
ccattgccttctggg

SEQ ID NO: 605432 - DNA, 16 bp, Homo sapiens
ccattgccttctgggg

SEQ ID NO: 605433 - DNA, 19 bp, Homo sapiens
ccatttaactagcacttta

SEQ ID NO: 605434 - DNA, 22 bp, Homo sapiens
ccatttaatcatttccagcaaa

SEQ ID NO: 605435 - DNA, 16 bp, Homo sapiens
ccatttcacattcctg

SEQ ID NO: 605436 - DNA, 15 bp, Homo sapiens
ccatttcctcctggg

SEQ ID NO: 605437 - DNA, 20 bp, Homo sapiens
ccatttccttgtctaaagat

SEQ ID NO: 605438 - DNA, 21 bp, Homo sapiens
ccatttgctagttctgctgcc

SEQ ID NO: 605439 - DNA, 22 bp, Homo sapiens
ccatttgctagttctgctgccc

SEQ ID NO: 605440 - DNA, 22 bp, Homo sapiens
ccatttggattttaaacaaaat

SEQ ID NO: 605441 - DNA, 18 bp, Homo sapiens
ccattttgtctggctgtg

SEQ ID NO: 605442 - DNA, 12 bp, Homo sapiens
cccaaataacag

SEQ ID NO: 605443 - DNA, 20 bp, Homo sapiens
cccaacaatactttgtgtct

SEQ ID NO: 605444 - DNA, 21 bp, Homo sapiens
cccaacaatactttgtgtctt

SEQ ID NO: 605445 - DNA, 18 bp, Homo sapiens
cccaacccccacctcccg

SEQ ID NO: 605446 - DNA, 20 bp, Homo sapiens
cccagaacgggcctccccgg

SEQ ID NO: 605447 - DNA, 23 bp, Homo sapiens
cccagagactgcccaccctgggc

SEQ ID NO: 605448 - DNA, 17 bp, Homo sapiens
cccagagccctgcagtc

SEQ ID NO: 605449 - DNA, 14 bp, Homo sapiens
cccagcagctcacc

SEQ ID NO: 605450 - DNA, 16 bp, Homo sapiens
cccagccctgggcaag

SEQ ID NO: 605451 - DNA, 22 bp, Homo sapiens
cccagccctgggcaaggaagct

SEQ ID NO: 605452 - DNA, 12 bp, Homo sapiens
cccagcctcccc

SEQ ID NO: 605453 - DNA, 16 bp, Homo sapiens
cccagcctcccccagg

SEQ ID NO: 605454 - DNA, 23 bp, Homo sapiens
cccagcctcccccaggctgcgcc

SEQ ID NO: 605455 - DNA, 10 bp, Homo sapiens
cccagcctga

SEQ ID NO: 605456 - DNA, 18 bp, Homo sapiens
cccagcctgaaagataca

SEQ ID NO: 605457 - DNA, 19 bp, Homo sapiens
cccagcctgaaagatacag

SEQ ID NO: 605458 - DNA, 19 bp, Homo sapiens
cccagctctggatgaaggc

SEQ ID NO: 605459 - DNA, 20 bp, Homo sapiens
cccagctgattagtgtctaa

SEQ ID NO: 605460 - DNA, 12 bp, Homo sapiens
cccagctggcag

SEQ ID NO: 605461 - DNA, 15 bp, Homo sapiens
cccagctggcagcgc

SEQ ID NO: 605462 - DNA, 19 bp, Homo sapiens
cccagctggcagcgcctcc

SEQ ID NO: 605463 - DNA, 15 bp, Homo sapiens
cccagctggctgggt

SEQ ID NO: 605464 - DNA, 19 bp, Homo sapiens
cccagctggctgggtcgcc

SEQ ID NO: 605465 - DNA, 15 bp, Homo sapiens
cccaggacgcatgca

SEQ ID NO: 605466 - DNA, 12 bp, Homo sapiens
cccaggcccagc

SEQ ID NO: 605467 - DNA, 13 bp, Homo sapiens
cccaggcccagcc

SEQ ID NO: 605468 - DNA, 16 bp, Homo sapiens
cccaggcccgccctgc

SEQ ID NO: 605469 - DNA, 18 bp, Homo sapiens
cccaggcccgccctgccc

SEQ ID NO: 605470 - DNA, 16 bp, Homo sapiens
cccaggcggaggggct

SEQ ID NO: 605471 - DNA, 18 bp, Homo sapiens
cccaggcggaggggcttg

SEQ ID NO: 605472 - DNA, 16 bp, Homo sapiens
cccaggctgcgcctgc

SEQ ID NO: 605473 - DNA, 10 bp, Homo sapiens
cccagggagg

SEQ ID NO: 605474 - DNA, 21 bp, Homo sapiens
cccaggggcactgtgttctca

SEQ ID NO: 605475 - DNA, 21 bp, Homo sapiens
cccagggtcccctgcatggct

SEQ ID NO: 605476 - DNA, 12 bp, Homo sapiens
cccagggtcctg

SEQ ID NO: 605477 - DNA, 14 bp, Homo sapiens
cccagggtgcaggc

SEQ ID NO: 605478 - DNA, 16 bp, Homo sapiens
cccagggtgcaggcgc

SEQ ID NO: 605479 - DNA, 14 bp, Homo sapiens
cccaggtattgtct

SEQ ID NO: 605480 - DNA, 16 bp, Homo sapiens
cccagtccctggagct

SEQ ID NO: 605481 - DNA, 17 bp, Homo sapiens
cccagtcttgagtgggc

SEQ ID NO: 605482 - DNA, 21 bp, Homo sapiens
cccagtgaataaatattttag

SEQ ID NO: 605483 - DNA, 19 bp, Homo sapiens
cccagtggtgcgggccagg

SEQ ID NO: 605484 - DNA, 20 bp, Homo sapiens
cccagtgtggccccagcccg

SEQ ID NO: 605485 - DNA, 14 bp, Homo sapiens
cccagttagcccgg

SEQ ID NO: 605486 - DNA, 17 bp, Homo sapiens
cccagttagcccggcca

SEQ ID NO: 605487 - DNA, 19 bp, Homo sapiens
cccagttagcccggccaag

SEQ ID NO: 605488 - DNA, 18 bp, Homo sapiens
cccatcagaggctggggg

SEQ ID NO: 605489 - DNA, 17 bp, Homo sapiens
cccatcccctgcctcta

SEQ ID NO: 605490 - DNA, 21 bp, Homo sapiens
cccatccttcccgcagcacca

SEQ ID NO: 605491 - DNA, 16 bp, Homo sapiens
cccatcgccttctggg

SEQ ID NO: 605492 - DNA, 13 bp, Homo sapiens
cccatctcctccc

SEQ ID NO: 605493 - DNA, 20 bp, Homo sapiens
cccatctcctcccatggcct

SEQ ID NO: 605494 - DNA, 13 bp, Homo sapiens
cccatgaccgttc

SEQ ID NO: 605495 - DNA, 13 bp, Homo sapiens
cccatgccctccc

SEQ ID NO: 605496 - DNA, 13 bp, Homo sapiens
cccatgctggctg

SEQ ID NO: 605497 - DNA, 14 bp, Homo sapiens
cccatgctggctgg

SEQ ID NO: 605498 - DNA, 16 bp, Homo sapiens
cccatgctggctgggg

SEQ ID NO: 605499 - DNA, 15 bp, Homo sapiens
cccatgctgggctca

SEQ ID NO: 605500 - DNA, 16 bp, Homo sapiens
cccatggaacagccct

SEQ ID NO: 605501 - DNA, 18 bp, Homo sapiens
cccatggaacagccctgc

SEQ ID NO: 605502 - DNA, 22 bp, Homo sapiens
cccatggaacagccctgcacgc

SEQ ID NO: 605503 - DNA, 12 bp, Homo sapiens
cccatggcccca

SEQ ID NO: 605504 - DNA, 16 bp, Homo sapiens
cccatggccccagctg

SEQ ID NO: 605505 - DNA, 17 bp, Homo sapiens
cccatggccccagctgg

SEQ ID NO: 605506 - DNA, 19 bp, Homo sapiens
cccatggccccagctggct

SEQ ID NO: 605507 - DNA, 20 bp, Homo sapiens
cccatggccttccctcccca

SEQ ID NO: 605508 - DNA, 16 bp, Homo sapiens
cccatgggccctcagc

SEQ ID NO: 605509 - DNA, 17 bp, Homo sapiens
cccatggtagactgtga

SEQ ID NO: 605510 - DNA, 11 bp, Homo sapiens
cccatgtgtat

SEQ ID NO: 605511 - DNA, 17 bp, Homo sapiens
ccccaaattgccttcag

SEQ ID NO: 605512 - DNA, 19 bp, Homo sapiens
ccccaaattgccttcagcc

SEQ ID NO: 605513 - DNA, 13 bp, Homo sapiens
ccccaaggaagaa

SEQ ID NO: 605514 - DNA, 17 bp, Homo sapiens
ccccaaggaagaacaaa

SEQ ID NO: 605515 - DNA, 16 bp, Homo sapiens
ccccacaaggcccagc

SEQ ID NO: 605516 - DNA, 21 bp, Homo sapiens
ccccacacgccggggctggcc

SEQ ID NO: 605517 - DNA, 22 bp, Homo sapiens
ccccacacgccggggctggccc

SEQ ID NO: 605518 - DNA, 18 bp, Homo sapiens
ccccacccatgccagcgc

SEQ ID NO: 605519 - DNA, 14 bp, Homo sapiens
ccccacccccgtca

SEQ ID NO: 605520 - DNA, 18 bp, Homo sapiens
ccccacccccgtcacccc

SEQ ID NO: 605521 - DNA, 20 bp, Homo sapiens
ccccacccccgtcaccccgc

SEQ ID NO: 605522 - DNA, 15 bp, Homo sapiens
ccccacggccgtccc

SEQ ID NO: 605523 - DNA, 18 bp, Homo sapiens
ccccactccccccatcct

SEQ ID NO: 605524 - DNA, 17 bp, Homo sapiens
ccccagagactgcccac

SEQ ID NO: 605525 - DNA, 21 bp, Homo sapiens
ccccagagactgcccaccctg

SEQ ID NO: 605526 - DNA, 15 bp, Homo sapiens
ccccagagccctgca

SEQ ID NO: 605527 - DNA, 10 bp, Homo sapiens
ccccagcctc

SEQ ID NO: 605528 - DNA, 11 bp, Homo sapiens
ccccagcctcc

SEQ ID NO: 605529 - DNA, 12 bp, Homo sapiens
ccccagcctccc

SEQ ID NO: 605530 - DNA, 13 bp, Homo sapiens
ccccagcctcccc

SEQ ID NO: 605531 - DNA, 16 bp, Homo sapiens
ccccagcctcccccag

SEQ ID NO: 605532 - DNA, 23 bp, Homo sapiens
ccccagcctcccccaggctgcgc

SEQ ID NO: 605533 - DNA, 22 bp, Homo sapiens
ccccagcgtggggctaacgggc

SEQ ID NO: 605534 - DNA, 13 bp, Homo sapiens
ccccagctctgga

SEQ ID NO: 605535 - DNA, 20 bp, Homo sapiens
ccccaggaagtcatcctgca

SEQ ID NO: 605536 - DNA, 12 bp, Homo sapiens
ccccaggacccc

SEQ ID NO: 605537 - DNA, 16 bp, Homo sapiens
ccccaggaccccccca

SEQ ID NO: 605538 - DNA, 19 bp, Homo sapiens
ccccaggacccccccagtc

SEQ ID NO: 605539 - DNA, 19 bp, Homo sapiens
ccccaggacgcatgcaggg

SEQ ID NO: 605540 - DNA, 21 bp, Homo sapiens
ccccaggcggaggggcttgga

SEQ ID NO: 605541 - DNA, 14 bp, Homo sapiens
ccccaggctgcgcc

SEQ ID NO: 605542 - DNA, 19 bp, Homo sapiens
ccccaggctgcgcctgccc

SEQ ID NO: 605543 - DNA, 22 bp, Homo sapiens
ccccaggctgcgcctgcccgcc

SEQ ID NO: 605544 - DNA, 13 bp, Homo sapiens
ccccagtccgccc

SEQ ID NO: 605545 - DNA, 19 bp, Homo sapiens
ccccagtggtgcgggccag

SEQ ID NO: 605546 - DNA, 17 bp, Homo sapiens
ccccagtgtggccccag

SEQ ID NO: 605547 - DNA, 19 bp, Homo sapiens
ccccagttaatgtgccaaa

SEQ ID NO: 605548 - DNA, 23 bp, Homo sapiens
ccccataatgcttctttcctctt

SEQ ID NO: 605549 - DNA, 19 bp, Homo sapiens
ccccatcgcctgggacgcc

SEQ ID NO: 605550 - DNA, 21 bp, Homo sapiens
ccccatcgccttctggctgct

SEQ ID NO: 605551 - DNA, 20 bp, Homo sapiens
ccccatgccaatgtccaggt

SEQ ID NO: 605552 - DNA, 12 bp, Homo sapiens
ccccatgctggg

SEQ ID NO: 605553 - DNA, 17 bp, Homo sapiens
ccccattgccttctggg

SEQ ID NO: 605554 - DNA, 19 bp, Homo sapiens
cccccaaattgccttcagc

SEQ ID NO: 605555 - DNA, 12 bp, Homo sapiens
cccccacaggag

SEQ ID NO: 605556 - DNA, 14 bp, Homo sapiens
cccccacctcccgg

SEQ ID NO: 605557 - DNA, 13 bp, Homo sapiens
cccccaggacccc

SEQ ID NO: 605558 - DNA, 14 bp, Homo sapiens
cccccaggctgcgc

SEQ ID NO: 605559 - DNA, 16 bp, Homo sapiens
cccccaggctgcgcct

SEQ ID NO: 605560 - DNA, 19 bp, Homo sapiens
cccccaggctgcgcctgcc

SEQ ID NO: 605561 - DNA, 18 bp, Homo sapiens
cccccatgccctccctgc

SEQ ID NO: 605562 - DNA, 22 bp, Homo sapiens
cccccatgccctccctgctgcc

SEQ ID NO: 605563 - DNA, 20 bp, Homo sapiens
cccccattgtgaatgttgtc

SEQ ID NO: 605564 - DNA, 16 bp, Homo sapiens
cccccgccctcgctcc

SEQ ID NO: 605565 - DNA, 14 bp, Homo sapiens
cccccggaggcgcc

SEQ ID NO: 605566 - DNA, 15 bp, Homo sapiens
cccccggaggcgccc

SEQ ID NO: 605567 - DNA, 20 bp, Homo sapiens
cccccggaggcgcccacctg

SEQ ID NO: 605568 - DNA, 11 bp, Homo sapiens
ccccctcagct

SEQ ID NO: 605569 - DNA, 12 bp, Homo sapiens
ccccctccccaa

SEQ ID NO: 605570 - DNA, 12 bp, Homo sapiens
ccccctcctgca

SEQ ID NO: 605571 - DNA, 10 bp, Homo sapiens
ccccctctct

SEQ ID NO: 605572 - DNA, 21 bp, Homo sapiens
ccccctctcttaccccgtccc

SEQ ID NO: 605573 - DNA, 12 bp, Homo sapiens
ccccctggcggc

SEQ ID NO: 605574 - DNA, 13 bp, Homo sapiens
cccccttcccctg

SEQ ID NO: 605575 - DNA, 16 bp, Homo sapiens
ccccgcagacagacag

SEQ ID NO: 605576 - DNA, 18 bp, Homo sapiens
ccccgcccgccctcctct

SEQ ID NO: 605577 - DNA, 19 bp, Homo sapiens
ccccgcgaccacccctgtg

SEQ ID NO: 605578 - DNA, 13 bp, Homo sapiens
ccccgcggagccc

SEQ ID NO: 605579 - DNA, 18 bp, Homo sapiens
ccccgcggagcccccgcc

SEQ ID NO: 605580 - DNA, 23 bp, Homo sapiens
ccccgcggagcccccgcccctcc

SEQ ID NO: 605581 - DNA, 20 bp, Homo sapiens
ccccggagcaccacggggtc

SEQ ID NO: 605582 - DNA, 21 bp, Homo sapiens
ccccggaggcgcccacctgcc

SEQ ID NO: 605583 - DNA, 15 bp, Homo sapiens
ccccgtccctttccc

SEQ ID NO: 605584 - DNA, 16 bp, Homo sapiens
ccccgtccctttccct

SEQ ID NO: 605585 - DNA, 13 bp, Homo sapiens
ccccgtgctcctc

SEQ ID NO: 605586 - DNA, 16 bp, Homo sapiens
ccccgttcccagcgca

SEQ ID NO: 605587 - DNA, 16 bp, Homo sapiens
ccccgttgttgtccct

SEQ ID NO: 605588 - DNA, 14 bp, Homo sapiens
cccctacagatcct

SEQ ID NO: 605589 - DNA, 15 bp, Homo sapiens
cccctacagatcctc

SEQ ID NO: 605590 - DNA, 12 bp, Homo sapiens
cccctccagacc

SEQ ID NO: 605591 - DNA, 15 bp, Homo sapiens
cccctcccccgcaga

SEQ ID NO: 605592 - DNA, 16 bp, Homo sapiens
cccctcccccgcagac

SEQ ID NO: 605593 - DNA, 23 bp, Homo sapiens
cccctccgggcagagaccaccgc

SEQ ID NO: 605594 - DNA, 16 bp, Homo sapiens
cccctccgtccccagg

SEQ ID NO: 605595 - DNA, 20 bp, Homo sapiens
cccctccgtccccagggtgc

SEQ ID NO: 605596 - DNA, 15 bp, Homo sapiens
cccctcctccatgct

SEQ ID NO: 605597 - DNA, 19 bp, Homo sapiens
cccctcctcgggcgcctgc

SEQ ID NO: 605598 - DNA, 22 bp, Homo sapiens
cccctcctcgggcgcctgcgct

SEQ ID NO: 605599 - DNA, 11 bp, Homo sapiens
cccctcctctc

SEQ ID NO: 605600 - DNA, 16 bp, Homo sapiens
cccctcgcgcccctgt

SEQ ID NO: 605601 - DNA, 20 bp, Homo sapiens
cccctctcttaccccgtccc

SEQ ID NO: 605602 - DNA, 16 bp, Homo sapiens
cccctctgcgccccag

SEQ ID NO: 605603 - DNA, 19 bp, Homo sapiens
cccctctgcgccccagcga

SEQ ID NO: 605604 - DNA, 17 bp, Homo sapiens
cccctcttcccccttcc

SEQ ID NO: 605605 - DNA, 21 bp, Homo sapiens
cccctgagggacgagcagagc

SEQ ID NO: 605606 - DNA, 23 bp, Homo sapiens
cccctgagggacgagcagagcgc

SEQ ID NO: 605607 - DNA, 22 bp, Homo sapiens
cccctgcagtttggccctggag

SEQ ID NO: 605608 - DNA, 23 bp, Homo sapiens
cccctgcagtttggccctggagc

SEQ ID NO: 605609 - DNA, 14 bp, Homo sapiens
cccctgcatggctg

SEQ ID NO: 605610 - DNA, 15 bp, Homo sapiens
cccctgcccagcacc

SEQ ID NO: 605611 - DNA, 17 bp, Homo sapiens
cccctgcccagcacctc

SEQ ID NO: 605612 - DNA, 21 bp, Homo sapiens
cccctgcccagcacctcctcc

SEQ ID NO: 605613 - DNA, 22 bp, Homo sapiens
cccctgcccgaccccatctcat

SEQ ID NO: 605614 - DNA, 14 bp, Homo sapiens
cccctggccctgcc

SEQ ID NO: 605615 - DNA, 16 bp, Homo sapiens
cccctggccctgcctc

SEQ ID NO: 605616 - DNA, 17 bp, Homo sapiens
cccctggccctgcctca

SEQ ID NO: 605617 - DNA, 20 bp, Homo sapiens
cccctggccctgcctcactg

SEQ ID NO: 605618 - DNA, 17 bp, Homo sapiens
ccccttgaccccacacg

SEQ ID NO: 605619 - DNA, 15 bp, Homo sapiens
cccctttcctggggg

SEQ ID NO: 605620 - DNA, 19 bp, Homo sapiens
cccgagcgcgtgccttccc

SEQ ID NO: 605621 - DNA, 14 bp, Homo sapiens
cccgaggaggccga

SEQ ID NO: 605622 - DNA, 21 bp, Homo sapiens
cccgaggaggccgactgggct

SEQ ID NO: 605623 - DNA, 12 bp, Homo sapiens
cccgaggccagg

SEQ ID NO: 605624 - DNA, 20 bp, Homo sapiens
cccgcactcaggagcacagc

SEQ ID NO: 605625 - DNA, 12 bp, Homo sapiens
cccgcagcacca

SEQ ID NO: 605626 - DNA, 13 bp, Homo sapiens
cccgccccagaga

SEQ ID NO: 605627 - DNA, 15 bp, Homo sapiens
cccgccccagagact

SEQ ID NO: 605628 - DNA, 18 bp, Homo sapiens
cccgccccagagactgcc

SEQ ID NO: 605629 - DNA, 20 bp, Homo sapiens
cccgccccagagactgccca

SEQ ID NO: 605630 - DNA, 14 bp, Homo sapiens
cccgccccgctgct

SEQ ID NO: 605631 - DNA, 16 bp, Homo sapiens
cccgccctcctctgcc

SEQ ID NO: 605632 - DNA, 11 bp, Homo sapiens
cccgccctcgc

SEQ ID NO: 605633 - DNA, 15 bp, Homo sapiens
cccgcgcgtgccccc

SEQ ID NO: 605634 - DNA, 17 bp, Homo sapiens
cccgcgcgtgcccccag

SEQ ID NO: 605635 - DNA, 19 bp, Homo sapiens
cccgctgcctggcgggcag

SEQ ID NO: 605636 - DNA, 17 bp, Homo sapiens
cccggaggcgcccacct

SEQ ID NO: 605637 - DNA, 18 bp, Homo sapiens
cccggaggcgcccacctg

SEQ ID NO: 605638 - DNA, 22 bp, Homo sapiens
cccggaggcgcccacctgccca

SEQ ID NO: 605639 - DNA, 16 bp, Homo sapiens
cccggccaaggacact

SEQ ID NO: 605640 - DNA, 13 bp, Homo sapiens
cccggcccacgca

SEQ ID NO: 605641 - DNA, 15 bp, Homo sapiens
cccggcccacgcaga

SEQ ID NO: 605642 - DNA, 17 bp, Homo sapiens
cccggcccacgcagagc

SEQ ID NO: 605643 - DNA, 19 bp, Homo sapiens
cccggcccacgcagagccc

SEQ ID NO: 605644 - DNA, 19 bp, Homo sapiens
cccggcccccctctcgggc

SEQ ID NO: 605645 - DNA, 13 bp, Homo sapiens
cccggccccgcgc

SEQ ID NO: 605646 - DNA, 15 bp, Homo sapiens
cccggcctgatggcc

SEQ ID NO: 605647 - DNA, 18 bp, Homo sapiens
cccggcctggccccctcg

SEQ ID NO: 605648 - DNA, 17 bp, Homo sapiens
cccggctctgaggctgc

SEQ ID NO: 605649 - DNA, 20 bp, Homo sapiens
cccggctgactcagtgcagg

SEQ ID NO: 605650 - DNA, 16 bp, Homo sapiens
cccgggggtccccgga

SEQ ID NO: 605651 - DNA, 18 bp, Homo sapiens
cccgtccctttccctgca

SEQ ID NO: 605652 - DNA, 19 bp, Homo sapiens
cccgtccctttccctgcat

SEQ ID NO: 605653 - DNA, 18 bp, Homo sapiens
cccgtccgtccgcccgcc

SEQ ID NO: 605654 - DNA, 13 bp, Homo sapiens
cccgtctgcccct

SEQ ID NO: 605655 - DNA, 16 bp, Homo sapiens
cccgtgctcctctgcc

SEQ ID NO: 605656 - DNA, 15 bp, Homo sapiens
cccgtggctttgtgc

SEQ ID NO: 605657 - DNA, 23 bp, Homo sapiens
cccgtgggcgcaaaggtgcctca

SEQ ID NO: 605658 - DNA, 22 bp, Homo sapiens
ccctaagcacaataaaagacat

SEQ ID NO: 605659 - DNA, 14 bp, Homo sapiens
ccctaccctcttct

SEQ ID NO: 605660 - DNA, 16 bp, Homo sapiens
ccctaggtctccaccc

SEQ ID NO: 605661 - DNA, 20 bp, Homo sapiens
ccctaggtctccacccctca

SEQ ID NO: 605662 - DNA, 14 bp, Homo sapiens
ccctatcctgcacc

SEQ ID NO: 605663 - DNA, 16 bp, Homo sapiens
ccctatcctgcaccct

SEQ ID NO: 605664 - DNA, 17 bp, Homo sapiens
ccctatcctgcaccctc

SEQ ID NO: 605665 - DNA, 13 bp, Homo sapiens
ccctcacctctga

SEQ ID NO: 605666 - DNA, 14 bp, Homo sapiens
ccctcactccactc

SEQ ID NO: 605667 - DNA, 15 bp, Homo sapiens
ccctcagctctccct

SEQ ID NO: 605668 - DNA, 20 bp, Homo sapiens
ccctcattaaactaattaaa

SEQ ID NO: 605669 - DNA, 16 bp, Homo sapiens
ccctccacaggagccg

SEQ ID NO: 605670 - DNA, 14 bp, Homo sapiens
ccctccactcctcc

SEQ ID NO: 605671 - DNA, 10 bp, Homo sapiens
ccctccagac

SEQ ID NO: 605672 - DNA, 16 bp, Homo sapiens
ccctccagacccctac

SEQ ID NO: 605673 - DNA, 19 bp, Homo sapiens
ccctccagacccctaccct

SEQ ID NO: 605674 - DNA, 14 bp, Homo sapiens
ccctccccaaggaa

SEQ ID NO: 605675 - DNA, 14 bp, Homo sapiens
ccctcccccacggc

SEQ ID NO: 605676 - DNA, 23 bp, Homo sapiens
ccctcccccacggccgtccctga

SEQ ID NO: 605677 - DNA, 17 bp, Homo sapiens
ccctcccccgcagacag

SEQ ID NO: 605678 - DNA, 22 bp, Homo sapiens
ccctcccctctcctgagcctgt

SEQ ID NO: 605679 - DNA, 13 bp, Homo sapiens
ccctccctccaca

SEQ ID NO: 605680 - DNA, 15 bp, Homo sapiens
ccctccctccacacc

SEQ ID NO: 605681 - DNA, 11 bp, Homo sapiens
ccctccctccc

SEQ ID NO: 605682 - DNA, 15 bp, Homo sapiens
ccctccctccctcca

SEQ ID NO: 605683 - DNA, 16 bp, Homo sapiens
ccctccctccctccac

SEQ ID NO: 605684 - DNA, 14 bp, Homo sapiens
ccctccctccctgc

SEQ ID NO: 605685 - DNA, 11 bp, Homo sapiens
ccctccctgct

SEQ ID NO: 605686 - DNA, 21 bp, Homo sapiens
ccctccgggcagagaccaccg

SEQ ID NO: 605687 - DNA, 14 bp, Homo sapiens
ccctccgtccccag

SEQ ID NO: 605688 - DNA, 15 bp, Homo sapiens
ccctcctccatgctg

SEQ ID NO: 605689 - DNA, 21 bp, Homo sapiens
ccctcctcgggcgcctgcgct

SEQ ID NO: 605690 - DNA, 12 bp, Homo sapiens
ccctcctctgcc

SEQ ID NO: 605691 - DNA, 16 bp, Homo sapiens
ccctcctctgccccct

SEQ ID NO: 605692 - DNA, 11 bp, Homo sapiens
ccctcctgcac

SEQ ID NO: 605693 - DNA, 16 bp, Homo sapiens
ccctccttctcccctc

SEQ ID NO: 605694 - DNA, 17 bp, Homo sapiens
ccctccttctcccctcc

SEQ ID NO: 605695 - DNA, 13 bp, Homo sapiens
ccctcgcgcccct

SEQ ID NO: 605696 - DNA, 16 bp, Homo sapiens
ccctcgcgcccctgtc

SEQ ID NO: 605697 - DNA, 23 bp, Homo sapiens
ccctcggccattgaacactgcac

SEQ ID NO: 605698 - DNA, 14 bp, Homo sapiens
ccctcggtcagcac

SEQ ID NO: 605699 - DNA, 22 bp, Homo sapiens
ccctctctgtttaccctccctg

SEQ ID NO: 605700 - DNA, 18 bp, Homo sapiens
ccctctgagacagagagc

SEQ ID NO: 605701 - DNA, 12 bp, Homo sapiens
ccctctgccact

SEQ ID NO: 605702 - DNA, 16 bp, Homo sapiens
ccctctgcgccccagc

SEQ ID NO: 605703 - DNA, 17 bp, Homo sapiens
ccctctgcgccccagcg

SEQ ID NO: 605704 - DNA, 13 bp, Homo sapiens
ccctctgctgctt

SEQ ID NO: 605705 - DNA, 16 bp, Homo sapiens
ccctcttaagatctga

SEQ ID NO: 605706 - DNA, 15 bp, Homo sapiens
ccctcttagaagaaa

SEQ ID NO: 605707 - DNA, 14 bp, Homo sapiens
ccctctttctctct

SEQ ID NO: 605708 - DNA, 22 bp, Homo sapiens
ccctctttctctctgtgtggca

SEQ ID NO: 605709 - DNA, 15 bp, Homo sapiens
ccctgacatgctaac

SEQ ID NO: 605710 - DNA, 20 bp, Homo sapiens
ccctgacatgctaacctctc

SEQ ID NO: 605711 - DNA, 14 bp, Homo sapiens
ccctgactgtgggg

SEQ ID NO: 605712 - DNA, 13 bp, Homo sapiens
ccctgacttccca

SEQ ID NO: 605713 - DNA, 17 bp, Homo sapiens
ccctgacttcccagctg

SEQ ID NO: 605714 - DNA, 18 bp, Homo sapiens
ccctgacttcccagctgg

SEQ ID NO: 605715 - DNA, 20 bp, Homo sapiens
ccctgacttcccagctggca

SEQ ID NO: 605716 - DNA, 18 bp, Homo sapiens
ccctgagggacgagcaga

SEQ ID NO: 605717 - DNA, 20 bp, Homo sapiens
ccctgagggacgagcagagc

SEQ ID NO: 605718 - DNA, 22 bp, Homo sapiens
ccctgagggacgagcagagcgc

SEQ ID NO: 605719 - DNA, 18 bp, Homo sapiens
ccctgagggcccttccca

SEQ ID NO: 605720 - DNA, 14 bp, Homo sapiens
ccctgcaagtggac

SEQ ID NO: 605721 - DNA, 16 bp, Homo sapiens
ccctgcacctgcttct

SEQ ID NO: 605722 - DNA, 15 bp, Homo sapiens
ccctgcaccttgggc

SEQ ID NO: 605723 - DNA, 19 bp, Homo sapiens
ccctgcaccttgggcacgg

SEQ ID NO: 605724 - DNA, 17 bp, Homo sapiens
ccctgcaggcaggcaga

SEQ ID NO: 605725 - DNA, 19 bp, Homo sapiens
ccctgcagtttggccctgg

SEQ ID NO: 605726 - DNA, 20 bp, Homo sapiens
ccctgcagtttggccctgga

SEQ ID NO: 605727 - DNA, 22 bp, Homo sapiens
ccctgcagtttggccctggagc

SEQ ID NO: 605728 - DNA, 17 bp, Homo sapiens
ccctgcatcccttggcc

SEQ ID NO: 605729 - DNA, 13 bp, Homo sapiens
ccctgcatggctg

SEQ ID NO: 605730 - DNA, 12 bp, Homo sapiens
ccctgccagtgt

SEQ ID NO: 605731 - DNA, 20 bp, Homo sapiens
ccctgcccagcacctcctcc

SEQ ID NO: 605732 - DNA, 21 bp, Homo sapiens
ccctgcccagcacctcctccg

SEQ ID NO: 605733 - DNA, 16 bp, Homo sapiens
ccctgccctcccccac

SEQ ID NO: 605734 - DNA, 17 bp, Homo sapiens
ccctgccctcccccacg

SEQ ID NO: 605735 - DNA, 12 bp, Homo sapiens
ccctgccctcgg

SEQ ID NO: 605736 - DNA, 15 bp, Homo sapiens
ccctgccctcggcca

SEQ ID NO: 605737 - DNA, 17 bp, Homo sapiens
ccctgccctcggccatt

SEQ ID NO: 605738 - DNA, 12 bp, Homo sapiens
ccctgccctgca

SEQ ID NO: 605739 - DNA, 15 bp, Homo sapiens
ccctgccctgcacct

SEQ ID NO: 605740 - DNA, 22 bp, Homo sapiens
ccctgcctctatccctggccac

SEQ ID NO: 605741 - DNA, 13 bp, Homo sapiens
ccctgcctgagac

SEQ ID NO: 605742 - DNA, 14 bp, Homo sapiens
ccctgcctgaggag

SEQ ID NO: 605743 - DNA, 16 bp, Homo sapiens
ccctgcctgaggagga

SEQ ID NO: 605744 - DNA, 18 bp, Homo sapiens
ccctgcctgaggaggagg

SEQ ID NO: 605745 - DNA, 17 bp, Homo sapiens
ccctgcgcccctgccca

SEQ ID NO: 605746 - DNA, 20 bp, Homo sapiens
ccctgcgcccctgcccagca

SEQ ID NO: 605747 - DNA, 16 bp, Homo sapiens
ccctgcgccctccctc

SEQ ID NO: 605748 - DNA, 13 bp, Homo sapiens
ccctgcgcgcagc

SEQ ID NO: 605749 - DNA, 22 bp, Homo sapiens
ccctgcggggcggcatccgagc

SEQ ID NO: 605750 - DNA, 21 bp, Homo sapiens
ccctgctcagcccatcccctg

SEQ ID NO: 605751 - DNA, 13 bp, Homo sapiens
ccctgctgagtgg

SEQ ID NO: 605752 - DNA, 19 bp, Homo sapiens
ccctggaccgagtggacca

SEQ ID NO: 605753 - DNA, 21 bp, Homo sapiens
ccctggagccagggcagagga

SEQ ID NO: 605754 - DNA, 23 bp, Homo sapiens
ccctggagccagggcagaggaat

SEQ ID NO: 605755 - DNA, 13 bp, Homo sapiens
ccctggccctgcc

SEQ ID NO: 605756 - DNA, 18 bp, Homo sapiens
ccctggccctgcctcact

SEQ ID NO: 605757 - DNA, 22 bp, Homo sapiens
ccctgggaacacagtgccccag

SEQ ID NO: 605758 - DNA, 15 bp, Homo sapiens
ccctgggcaccctgc

SEQ ID NO: 605759 - DNA, 19 bp, Homo sapiens
ccctgggcaccctgcaggc

SEQ ID NO: 605760 - DNA, 17 bp, Homo sapiens
ccctggggaccaggagc

SEQ ID NO: 605761 - DNA, 21 bp, Homo sapiens
ccctggggaggacccctgccc

SEQ ID NO: 605762 - DNA, 22 bp, Homo sapiens
ccctggggaggacccctgccct

SEQ ID NO: 605763 - DNA, 19 bp, Homo sapiens
ccctggggcatccaccttc

SEQ ID NO: 605764 - DNA, 14 bp, Homo sapiens
ccctggggtctctg

SEQ ID NO: 605765 - DNA, 19 bp, Homo sapiens
ccctggggtctctgagcag

SEQ ID NO: 605766 - DNA, 14 bp, Homo sapiens
ccctggtcctgcac

SEQ ID NO: 605767 - DNA, 19 bp, Homo sapiens
ccctgtagggaaaccttgg

SEQ ID NO: 605768 - DNA, 23 bp, Homo sapiens
ccctgtctttgctgtttatatat

SEQ ID NO: 605769 - DNA, 23 bp, Homo sapiens
ccctgtgcagtagagagcctttc

SEQ ID NO: 605770 - DNA, 16 bp, Homo sapiens
ccctgtgccctctcac

SEQ ID NO: 605771 - DNA, 14 bp, Homo sapiens
ccctgtgggagtcc

SEQ ID NO: 605772 - DNA, 15 bp, Homo sapiens
ccctgtgggagtcca

SEQ ID NO: 605773 - DNA, 17 bp, Homo sapiens
ccctgtgggctcacacc

SEQ ID NO: 605774 - DNA, 20 bp, Homo sapiens
ccctgtgggggcggctgtgg

SEQ ID NO: 605775 - DNA, 16 bp, Homo sapiens
ccctgttccgcctcac

SEQ ID NO: 605776 - DNA, 22 bp, Homo sapiens
ccctgttgacctaccctggacc

SEQ ID NO: 605777 - DNA, 15 bp, Homo sapiens
ccctgtttctcctcc

SEQ ID NO: 605778 - DNA, 17 bp, Homo sapiens
ccctgtttctcctccat

SEQ ID NO: 605779 - DNA, 13 bp, Homo sapiens
cccttacctggct

SEQ ID NO: 605780 - DNA, 13 bp, Homo sapiens
cccttcaatgtta

SEQ ID NO: 605781 - DNA, 15 bp, Homo sapiens
cccttcacatagttt

SEQ ID NO: 605782 - DNA, 13 bp, Homo sapiens
cccttcccacccc

SEQ ID NO: 605783 - DNA, 14 bp, Homo sapiens
cccttcccacccct

SEQ ID NO: 605784 - DNA, 18 bp, Homo sapiens
cccttccccactcccgtg

SEQ ID NO: 605785 - DNA, 14 bp, Homo sapiens
cccttcccctgcgc

SEQ ID NO: 605786 - DNA, 14 bp, Homo sapiens
cccttcctgtcctg

SEQ ID NO: 605787 - DNA, 21 bp, Homo sapiens
cccttcctgtcctgctcacgt

SEQ ID NO: 605788 - DNA, 15 bp, Homo sapiens
cccttctttccttcc

SEQ ID NO: 605789 - DNA, 15 bp, Homo sapiens
cccttgaccccacac

SEQ ID NO: 605790 - DNA, 15 bp, Homo sapiens
cccttgctctacctg

SEQ ID NO: 605791 - DNA, 13 bp, Homo sapiens
ccctttccctgca

SEQ ID NO: 605792 - DNA, 17 bp, Homo sapiens
ccctttccctgcatccc

SEQ ID NO: 605793 - DNA, 15 bp, Homo sapiens
ccctttcctggggga

SEQ ID NO: 605794 - DNA, 16 bp, Homo sapiens
ccgaaaacgtggctgc

SEQ ID NO: 605795 - DNA, 17 bp, Homo sapiens
ccgaaaacgtggctgct

SEQ ID NO: 605796 - DNA, 19 bp, Homo sapiens
ccgaagccccttggagaga

SEQ ID NO: 605797 - DNA, 15 bp, Homo sapiens
ccgaagggcagcccc

SEQ ID NO: 605798 - DNA, 16 bp, Homo sapiens
ccgaagggcagccccg

SEQ ID NO: 605799 - DNA, 17 bp, Homo sapiens
ccgaagggcagccccgc

SEQ ID NO: 605800 - DNA, 20 bp, Homo sapiens
ccgacaggcatgcaccagtg

SEQ ID NO: 605801 - DNA, 17 bp, Homo sapiens
ccgacgcccctccgggc

SEQ ID NO: 605802 - DNA, 13 bp, Homo sapiens
ccgactgggctgc

SEQ ID NO: 605803 - DNA, 19 bp, Homo sapiens
ccgactgggctgctggggc

SEQ ID NO: 605804 - DNA, 14 bp, Homo sapiens
ccgagcgcgtgcct

SEQ ID NO: 605805 - DNA, 22 bp, Homo sapiens
ccgagcgcgtgccttccccgtg

SEQ ID NO: 605806 - DNA, 16 bp, Homo sapiens
ccgatataagccatag

SEQ ID NO: 605807 - DNA, 19 bp, Homo sapiens
ccgatataagccatagccc

SEQ ID NO: 605808 - DNA, 15 bp, Homo sapiens
ccgcagcaccagcct

SEQ ID NO: 605809 - DNA, 18 bp, Homo sapiens
ccgcagcaccagcctgag

SEQ ID NO: 605810 - DNA, 22 bp, Homo sapiens
ccgcagcaccagcctgagccac

SEQ ID NO: 605811 - DNA, 19 bp, Homo sapiens
ccgcagggcgctccggcag

SEQ ID NO: 605812 - DNA, 21 bp, Homo sapiens
ccgcagggcgctccggcagag

SEQ ID NO: 605813 - DNA, 13 bp, Homo sapiens
ccgcatctgcctg

SEQ ID NO: 605814 - DNA, 14 bp, Homo sapiens
ccgcatctgcctgg

SEQ ID NO: 605815 - DNA, 18 bp, Homo sapiens
ccgcatctgcctggagcc

SEQ ID NO: 605816 - DNA, 12 bp, Homo sapiens
ccgccagccctg

SEQ ID NO: 605817 - DNA, 14 bp, Homo sapiens
ccgccagccctgtt

SEQ ID NO: 605818 - DNA, 18 bp, Homo sapiens
ccgcccacccacaccccg

SEQ ID NO: 605819 - DNA, 20 bp, Homo sapiens
ccgcccacccagcagcgccc

SEQ ID NO: 605820 - DNA, 16 bp, Homo sapiens
ccgcccaccccgctgc

SEQ ID NO: 605821 - DNA, 18 bp, Homo sapiens
ccgcccaccccgctgcct

SEQ ID NO: 605822 - DNA, 10 bp, Homo sapiens
ccgccccaga

SEQ ID NO: 605823 - DNA, 12 bp, Homo sapiens
ccgccccagaga

SEQ ID NO: 605824 - DNA, 21 bp, Homo sapiens
ccgccccagagactgcccacc

SEQ ID NO: 605825 - DNA, 22 bp, Homo sapiens
ccgccccagagactgcccaccc

SEQ ID NO: 605826 - DNA, 18 bp, Homo sapiens
ccgccccccggcctggcc

SEQ ID NO: 605827 - DNA, 12 bp, Homo sapiens
ccgcccgccccc

SEQ ID NO: 605828 - DNA, 15 bp, Homo sapiens
ccgcccgcccccgcc

SEQ ID NO: 605829 - DNA, 11 bp, Homo sapiens
ccgcccgccct

SEQ ID NO: 605830 - DNA, 14 bp, Homo sapiens
ccgcccgccctcct

SEQ ID NO: 605831 - DNA, 15 bp, Homo sapiens
ccgcccgccctcctc

SEQ ID NO: 605832 - DNA, 13 bp, Homo sapiens
ccgccctcctctg

SEQ ID NO: 605833 - DNA, 16 bp, Homo sapiens
ccgccctcctctgccc

SEQ ID NO: 605834 - DNA, 17 bp, Homo sapiens
ccgccctcctctgcccc

SEQ ID NO: 605835 - DNA, 23 bp, Homo sapiens
ccgccctgcccgcgcccgccgcc

SEQ ID NO: 605836 - DNA, 15 bp, Homo sapiens
ccgccgaagggcagc

SEQ ID NO: 605837 - DNA, 14 bp, Homo sapiens
ccgccgcctccctc

SEQ ID NO: 605838 - DNA, 21 bp, Homo sapiens
ccgccggttggccggctggcc

SEQ ID NO: 605839 - DNA, 22 bp, Homo sapiens
ccgccggttggccggctggccg

SEQ ID NO: 605840 - DNA, 15 bp, Homo sapiens
ccgcctcactgggtg

SEQ ID NO: 605841 - DNA, 20 bp, Homo sapiens
ccgcctcactgggtgtggcc

SEQ ID NO: 605842 - DNA, 13 bp, Homo sapiens
ccgcctccctcac

SEQ ID NO: 605843 - DNA, 14 bp, Homo sapiens
ccgcctcctccaga

SEQ ID NO: 605844 - DNA, 15 bp, Homo sapiens
ccgcctcctccagac

SEQ ID NO: 605845 - DNA, 12 bp, Homo sapiens
ccgcctcgcccc

SEQ ID NO: 605846 - DNA, 16 bp, Homo sapiens
ccgcctcgggccgcct

SEQ ID NO: 605847 - DNA, 17 bp, Homo sapiens
ccgcgaccacccctgtg

SEQ ID NO: 605848 - DNA, 14 bp, Homo sapiens
ccgcgcccctctgc

SEQ ID NO: 605849 - DNA, 16 bp, Homo sapiens
ccgcgcccgccgcctc

SEQ ID NO: 605850 - DNA, 19 bp, Homo sapiens
ccgcgcccgccgcctccct

SEQ ID NO: 605851 - DNA, 14 bp, Homo sapiens
ccgcggagcccccg

SEQ ID NO: 605852 - DNA, 16 bp, Homo sapiens
ccgcggagcccccgcc

SEQ ID NO: 605853 - DNA, 15 bp, Homo sapiens
ccgcggaggcccctg

SEQ ID NO: 605854 - DNA, 16 bp, Homo sapiens
ccgcggaggcccctga

SEQ ID NO: 605855 - DNA, 18 bp, Homo sapiens
ccgcgggtggctggagcc

SEQ ID NO: 605856 - DNA, 18 bp, Homo sapiens
ccgcgtggttctgccact

SEQ ID NO: 605857 - DNA, 15 bp, Homo sapiens
ccgctcaacctctca

SEQ ID NO: 605858 - DNA, 15 bp, Homo sapiens
ccggagcggctgagg

SEQ ID NO: 605859 - DNA, 15 bp, Homo sapiens
ccggcagaggcaggg

SEQ ID NO: 605860 - DNA, 19 bp, Homo sapiens
ccggcagaggcagggccct

SEQ ID NO: 605861 - DNA, 21 bp, Homo sapiens
ccggcagaggcagggccctgg

SEQ ID NO: 605862 - DNA, 18 bp, Homo sapiens
ccggccaaggacactgat

SEQ ID NO: 605863 - DNA, 14 bp, Homo sapiens
ccggcccacgcaga

SEQ ID NO: 605864 - DNA, 17 bp, Homo sapiens
ccggcccacgcagagcc

SEQ ID NO: 605865 - DNA, 19 bp, Homo sapiens
ccggcccacgcagagcccc

SEQ ID NO: 605866 - DNA, 13 bp, Homo sapiens
ccggcccccctct

SEQ ID NO: 605867 - DNA, 20 bp, Homo sapiens
ccggccccgcgcgtgccccc

SEQ ID NO: 605868 - DNA, 11 bp, Homo sapiens
ccggcctccta

SEQ ID NO: 605869 - DNA, 18 bp, Homo sapiens
ccggcctcctagcctctc

SEQ ID NO: 605870 - DNA, 12 bp, Homo sapiens
ccggcctgcagc

SEQ ID NO: 605871 - DNA, 15 bp, Homo sapiens
ccggcctgcagccca

SEQ ID NO: 605872 - DNA, 16 bp, Homo sapiens
ccggcctgcagcccag

SEQ ID NO: 605873 - DNA, 16 bp, Homo sapiens
ccggcctggccccctc

SEQ ID NO: 605874 - DNA, 17 bp, Homo sapiens
ccggcctggccccctcg

SEQ ID NO: 605875 - DNA, 12 bp, Homo sapiens
ccggctgactca

SEQ ID NO: 605876 - DNA, 21 bp, Homo sapiens
ccggctggccggtccaccccg

SEQ ID NO: 605877 - DNA, 13 bp, Homo sapiens
ccgggcagagacc

SEQ ID NO: 605878 - DNA, 24 bp, Homo sapiens
ccggggctgccgcatctgcctgga

SEQ ID NO: 605879 - DNA, 14 bp, Homo sapiens
ccggggctggccct

SEQ ID NO: 605880 - DNA, 14 bp, Homo sapiens
ccggggtgtggaat

SEQ ID NO: 605881 - DNA, 21 bp, Homo sapiens
ccgggtgccccccatgccctc

SEQ ID NO: 605882 - DNA, 16 bp, Homo sapiens
cctcgggctggtgtct

SEQ ID NO: 605883 - DNA, 14 bp, Homo sapiens
cctcggtcagcacc

SEQ ID NO: 605884 - DNA, 20 bp, Homo sapiens
cctcggtggcatttgctgaa

SEQ ID NO: 605885 - DNA, 18 bp, Homo sapiens
cctcgtccggcctgcagc

SEQ ID NO: 605886 - DNA, 22 bp, Homo sapiens
cctcgtccggcctgcagcccag

SEQ ID NO: 605887 - DNA, 18 bp, Homo sapiens
cctctaggtaaactagca

SEQ ID NO: 605888 - DNA, 16 bp, Homo sapiens
cctctatccctggcca

SEQ ID NO: 605889 - DNA, 17 bp, Homo sapiens
cctctatccctggccac

SEQ ID NO: 605890 - DNA, 22 bp, Homo sapiens
cctctatccctggccacctgcc

SEQ ID NO: 605891 - DNA, 14 bp, Homo sapiens
cctctcagatccct

SEQ ID NO: 605892 - DNA, 19 bp, Homo sapiens
cctctcagatccctcggtc

SEQ ID NO: 605893 - DNA, 12 bp, Homo sapiens
cctctcctcgtc

SEQ ID NO: 605894 - DNA, 23 bp, Homo sapiens
cctctcctcgtccggcctgcagc

SEQ ID NO: 605895 - DNA, 11 bp, Homo sapiens
cctctcctctc

SEQ ID NO: 605896 - DNA, 17 bp, Homo sapiens
cctctcgggctctctca

SEQ ID NO: 605897 - DNA, 21 bp, Homo sapiens
cctctctctccctccactcct

SEQ ID NO: 605898 - DNA, 13 bp, Homo sapiens
cctctctctctct

SEQ ID NO: 605899 - DNA, 21 bp, Homo sapiens
cctctctgtttaccctccctg

SEQ ID NO: 605900 - DNA, 17 bp, Homo sapiens
cctctgagacagagagc

SEQ ID NO: 605901 - DNA, 13 bp, Homo sapiens
cctctgaggacag

SEQ ID NO: 605902 - DNA, 14 bp, Homo sapiens
cctctgaggacaga

SEQ ID NO: 605903 - DNA, 21 bp, Homo sapiens
cctctgaggacagaggccggg

SEQ ID NO: 605904 - DNA, 12 bp, Homo sapiens
cctctgcagcct

SEQ ID NO: 605905 - DNA, 14 bp, Homo sapiens
cctctgcagcctga

SEQ ID NO: 605906 - DNA, 15 bp, Homo sapiens
cctctgcagcctgag

SEQ ID NO: 605907 - DNA, 11 bp, Homo sapiens
cctctgccccc

SEQ ID NO: 605908 - DNA, 21 bp, Homo sapiens
cctctgcccctcttccctggc

SEQ ID NO: 605909 - DNA, 12 bp, Homo sapiens
cctctgcgcccc

SEQ ID NO: 605910 - DNA, 17 bp, Homo sapiens
cctctgctatgtctgtg

SEQ ID NO: 605911 - DNA, 17 bp, Homo sapiens
cctctgctgctttccaa

SEQ ID NO: 605912 - DNA, 23 bp, Homo sapiens
cctctgcttgtcattctgctaat

SEQ ID NO: 605913 - DNA, 12 bp, Homo sapiens
cctcttccccct

SEQ ID NO: 605914 - DNA, 15 bp, Homo sapiens
cctcttcccccttcc

SEQ ID NO: 605915 - DNA, 22 bp, Homo sapiens
cctcttctcagctccactctga

SEQ ID NO: 605916 - DNA, 18 bp, Homo sapiens
cctcttgctcagagctag

SEQ ID NO: 605917 - DNA, 22 bp, Homo sapiens
cctcttggtgtcaaatttttaa

SEQ ID NO: 605918 - DNA, 20 bp, Homo sapiens
cctcttgttcttagggcttg

SEQ ID NO: 605919 - DNA, 17 bp, Homo sapiens
cctctttctctctgtgt

SEQ ID NO: 605920 - DNA, 12 bp, Homo sapiens
cctgaaagccct

SEQ ID NO: 605921 - DNA, 11 bp, Homo sapiens
cctgaaatctg

SEQ ID NO: 605922 - DNA, 12 bp, Homo sapiens
cctgaagcctgg

SEQ ID NO: 605923 - DNA, 14 bp, Homo sapiens
cctgaagcctggat

SEQ ID NO: 605924 - DNA, 16 bp, Homo sapiens
cctgaatcagaggcag

SEQ ID NO: 605925 - DNA, 15 bp, Homo sapiens
cctgaatccatcagg

SEQ ID NO: 605926 - DNA, 18 bp, Homo sapiens
cctgaattcattgtctca

SEQ ID NO: 605927 - DNA, 19 bp, Homo sapiens
cctgacactgtctgctgcc

SEQ ID NO: 605928 - DNA, 15 bp, Homo sapiens
cctgacagcaaacac

SEQ ID NO: 605929 - DNA, 17 bp, Homo sapiens
cctgacagcaaacacag

SEQ ID NO: 605930 - DNA, 15 bp, Homo sapiens
cctgacatgctaacc

SEQ ID NO: 605931 - DNA, 22 bp, Homo sapiens
cctgacatgctaacctctctga

SEQ ID NO: 605932 - DNA, 14 bp, Homo sapiens
cctgactgtgttca

SEQ ID NO: 605933 - DNA, 24 bp, Homo sapiens
cctgactgtgttcagtgccttgga

SEQ ID NO: 605934 - DNA, 15 bp, Homo sapiens
cctgacttcccagct

SEQ ID NO: 605935 - DNA, 16 bp, Homo sapiens
cctgactttggggaca

SEQ ID NO: 605936 - DNA, 16 bp, Homo sapiens
cctgagccacagtggg

SEQ ID NO: 605937 - DNA, 23 bp, Homo sapiens
cctgagccacagtggggcccatg

SEQ ID NO: 605938 - DNA, 15 bp, Homo sapiens
cctgagccagatttc

SEQ ID NO: 605939 - DNA, 20 bp, Homo sapiens
cctgagccagatttcactct

SEQ ID NO: 605940 - DNA, 13 bp, Homo sapiens
cctgagcctgtct

SEQ ID NO: 605941 - DNA, 15 bp, Homo sapiens
cctgagggaagccca

SEQ ID NO: 605942 - DNA, 19 bp, Homo sapiens
cctgagggaagcccacccg

SEQ ID NO: 605943 - DNA, 17 bp, Homo sapiens
cctgagtgggctgggcc

SEQ ID NO: 605944 - DNA, 14 bp, Homo sapiens
cctgagttagctgt

SEQ ID NO: 605945 - DNA, 17 bp, Homo sapiens
cctgagttagctgttta

SEQ ID NO: 605946 - DNA, 16 bp, Homo sapiens
cctgatggccaggcct

SEQ ID NO: 605947 - DNA, 23 bp, Homo sapiens
cctgatggccaggcctcagggac

SEQ ID NO: 605948 - DNA, 16 bp, Homo sapiens
cctgcacagtggtcca

SEQ ID NO: 605949 - DNA, 14 bp, Homo sapiens
cctgcaccctctgc

SEQ ID NO: 605950 - DNA, 14 bp, Homo sapiens
cctgcaggcaggca

SEQ ID NO: 605951 - DNA, 18 bp, Homo sapiens
cctgcaggcaggcagacc

SEQ ID NO: 605952 - DNA, 19 bp, Homo sapiens
cctgcagtcacgtgaggcc

SEQ ID NO: 605953 - DNA, 23 bp, Homo sapiens
cctgcagtttggccctggagcca

SEQ ID NO: 605954 - DNA, 18 bp, Homo sapiens
cctgcatcccttggcccc

SEQ ID NO: 605955 - DNA, 22 bp, Homo sapiens
cctgcatcccttggcccctctc

SEQ ID NO: 605956 - DNA, 22 bp, Homo sapiens
cctgcatgtcggggcccctgcg

SEQ ID NO: 605957 - DNA, 23 bp, Homo sapiens
cctgcatgtcggggcccctgcgt

SEQ ID NO: 605958 - DNA, 20 bp, Homo sapiens
cctgccaggccctccagcag

SEQ ID NO: 605959 - DNA, 14 bp, Homo sapiens
cctgccaggcctcc

SEQ ID NO: 605960 - DNA, 12 bp, Homo sapiens
cctgcccccctt

SEQ ID NO: 605961 - DNA, 17 bp, Homo sapiens
cctgcccctccccagcc

SEQ ID NO: 605962 - DNA, 20 bp, Homo sapiens
cctgcccgcgcccgccgcct

SEQ ID NO: 605963 - DNA, 21 bp, Homo sapiens
cctgcccgcgcccgccgcctc

SEQ ID NO: 605964 - DNA, 18 bp, Homo sapiens
cctgccctcactccactc

SEQ ID NO: 605965 - DNA, 17 bp, Homo sapiens
cctgccctcccccacgg

SEQ ID NO: 605966 - DNA, 13 bp, Homo sapiens
cctgccctgcacc

SEQ ID NO: 605967 - DNA, 20 bp, Homo sapiens
cctgcctctatccctggcca

SEQ ID NO: 605968 - DNA, 21 bp, Homo sapiens
cctgcctctatccctggccac

SEQ ID NO: 605969 - DNA, 19 bp, Homo sapiens
cctgcctggaggagaagga

SEQ ID NO: 605970 - DNA, 22 bp, Homo sapiens
cctgcgcccctgcccagcacct

SEQ ID NO: 605971 - DNA, 22 bp, Homo sapiens
cctgcgccctccctccctccac

SEQ ID NO: 605972 - DNA, 16 bp, Homo sapiens
cctgcgcctcctcctg

SEQ ID NO: 605973 - DNA, 18 bp, Homo sapiens
cctgcgcctcctcctgca

SEQ ID NO: 605974 - DNA, 13 bp, Homo sapiens
cctgcgcctgcgc

SEQ ID NO: 605975 - DNA, 17 bp, Homo sapiens
cctgcgcctgcgcctcc

SEQ ID NO: 605976 - DNA, 13 bp, Homo sapiens
cctgcgcgcagct

SEQ ID NO: 605977 - DNA, 12 bp, Homo sapiens
cctgcgctcctc

SEQ ID NO: 605978 - DNA, 19 bp, Homo sapiens
cctgcgctcctctgcagcc

SEQ ID NO: 605979 - DNA, 16 bp, Homo sapiens
cctgcgtgtgttctct

SEQ ID NO: 605980 - DNA, 18 bp, Homo sapiens
cctgctcacgtctgtgag

SEQ ID NO: 605981 - DNA, 19 bp, Homo sapiens
cctgctcacgtctgtgagt

SEQ ID NO: 605982 - DNA, 13 bp, Homo sapiens
cctgctcagccca

SEQ ID NO: 605983 - DNA, 20 bp, Homo sapiens
cctgctcctcacccctgtag

SEQ ID NO: 605984 - DNA, 14 bp, Homo sapiens
cctgctcctgccca

SEQ ID NO: 605985 - DNA, 20 bp, Homo sapiens
cctgctgagtggctcgtgtt

SEQ ID NO: 605986 - DNA, 18 bp, Homo sapiens
cctgctgctcgggaaggc

SEQ ID NO: 605987 - DNA, 20 bp, Homo sapiens
cctgctgtgttaagaggact

SEQ ID NO: 605988 - DNA, 18 bp, Homo sapiens
cctggaaatttgtgtgct

SEQ ID NO: 605989 - DNA, 23 bp, Homo sapiens
cctggccccctcgcgcccctgtc

SEQ ID NO: 605990 - DNA, 14 bp, Homo sapiens
cctggccctgcctc

SEQ ID NO: 605991 - DNA, 19 bp, Homo sapiens
cctggccctgcctcactgt

SEQ ID NO: 605992 - DNA, 16 bp, Homo sapiens
cctggccggtaggctg

SEQ ID NO: 605993 - DNA, 18 bp, Homo sapiens
cctggccggtaggctgct

SEQ ID NO: 605994 - DNA, 22 bp, Homo sapiens
cctggcggcaggggttggcagc

SEQ ID NO: 605995 - DNA, 12 bp, Homo sapiens
cctggcgggcag

SEQ ID NO: 605996 - DNA, 14 bp, Homo sapiens
cctggcgggcagcc

SEQ ID NO: 605997 - DNA, 21 bp, Homo sapiens
cctggcgggcagcccctgctg

SEQ ID NO: 605998 - DNA, 16 bp, Homo sapiens
cctggctcccagggtc

SEQ ID NO: 605999 - DNA, 18 bp, Homo sapiens
cctggctttggcgcccca

SEQ ID NO: 606000 - DNA, 21 bp, Homo sapiens
cctgggcaacagagtgagacc

SEQ ID NO: 606001 - DNA, 17 bp, Homo sapiens
cctgggcaccctgcagg

SEQ ID NO: 606002 - DNA, 20 bp, Homo sapiens
cctgggcaccctgcaggcag

SEQ ID NO: 606003 - DNA, 18 bp, Homo sapiens
cctgggcccaggcccagc

SEQ ID NO: 606004 - DNA, 19 bp, Homo sapiens
cctgggcccaggcccagcc

SEQ ID NO: 606005 - DNA, 14 bp, Homo sapiens
cctgggcctcccgt

SEQ ID NO: 606006 - DNA, 16 bp, Homo sapiens
cctgggcctcccgtcc

SEQ ID NO: 606007 - DNA, 22 bp, Homo sapiens
cctgggctgttgtgtctggagc

SEQ ID NO: 606008 - DNA, 19 bp, Homo sapiens
cctggggaccaggagctag

SEQ ID NO: 606009 - DNA, 14 bp, Homo sapiens
cctggggaggaccc

SEQ ID NO: 606010 - DNA, 19 bp, Homo sapiens
cctggggaggacccctgcc

SEQ ID NO: 606011 - DNA, 22 bp, Homo sapiens
cctgggggatgtgcacggcagc

SEQ ID NO: 606012 - DNA, 19 bp, Homo sapiens
cctgggggctgctgcactg

SEQ ID NO: 606013 - DNA, 23 bp, Homo sapiens
cctgggggctgctgcactgccct

SEQ ID NO: 606014 - DNA, 14 bp, Homo sapiens
cctggggtctctga

SEQ ID NO: 606015 - DNA, 23 bp, Homo sapiens
cctggggtctctgagcagtgggg

SEQ ID NO: 606016 - DNA, 21 bp, Homo sapiens
cctggggtggttggaggcctg

SEQ ID NO: 606017 - DNA, 17 bp, Homo sapiens
cctgggtccccctcctg

SEQ ID NO: 606018 - DNA, 20 bp, Homo sapiens
cctggtatgtctcaccagga

SEQ ID NO: 606019 - DNA, 15 bp, Homo sapiens
cctggtctggagccc

SEQ ID NO: 606020 - DNA, 14 bp, Homo sapiens
cctggtggccctgc

SEQ ID NO: 606021 - DNA, 22 bp, Homo sapiens
cctggtggccctgcggggcggc

SEQ ID NO: 606022 - DNA, 19 bp, Homo sapiens
cctgtaatagcctcacctt

SEQ ID NO: 606023 - DNA, 21 bp, Homo sapiens
cctgtagggaaaccttggaga

SEQ ID NO: 606024 - DNA, 22 bp, Homo sapiens
cctgtagggaaaccttggagag

SEQ ID NO: 606025 - DNA, 23 bp, Homo sapiens
cctgtagggaaaccttggagagg

SEQ ID NO: 606026 - DNA, 21 bp, Homo sapiens
cctgtaggtctatgatgtcca

SEQ ID NO: 606027 - DNA, 13 bp, Homo sapiens
cctgtcaatatat

SEQ ID NO: 606028 - DNA, 19 bp, Homo sapiens
cctgtccatccgtctctgt

SEQ ID NO: 606029 - DNA, 18 bp, Homo sapiens
cctgtccccagttaatgt

SEQ ID NO: 606030 - DNA, 13 bp, Homo sapiens
cctgtcctgctca

SEQ ID NO: 606031 - DNA, 14 bp, Homo sapiens
cctgtcgggcccgc

SEQ ID NO: 606032 - DNA, 17 bp, Homo sapiens
cctgtctcctctgtcag

SEQ ID NO: 606033 - DNA, 14 bp, Homo sapiens
cctgtctttgctgt

SEQ ID NO: 606034 - DNA, 18 bp, Homo sapiens
cctgtctttgctgtttat

SEQ ID NO: 606035 - DNA, 18 bp, Homo sapiens
cctgtgaactgccaggca

SEQ ID NO: 606036 - DNA, 16 bp, Homo sapiens
cctgtgatcgtgtgtt

SEQ ID NO: 606037 - DNA, 13 bp, Homo sapiens
cctgtgggagtcc

SEQ ID NO: 606038 - DNA, 15 bp, Homo sapiens
cctgtgggagtccac

SEQ ID NO: 606039 - DNA, 16 bp, Homo sapiens
cctgtgggagtccact

SEQ ID NO: 606040 - DNA, 22 bp, Homo sapiens
cctgtgggagtccactttcctc

SEQ ID NO: 606041 - DNA, 14 bp, Homo sapiens
cctgtgggctcaca

SEQ ID NO: 606042 - DNA, 16 bp, Homo sapiens
cctgtgggggcggctg

SEQ ID NO: 606043 - DNA, 15 bp, Homo sapiens
cctgtgggtccttgc

SEQ ID NO: 606044 - DNA, 17 bp, Homo sapiens
cctgtggtttgttatca

SEQ ID NO: 606045 - DNA, 18 bp, Homo sapiens
cctgttccgcctcactgg

SEQ ID NO: 606046 - DNA, 21 bp, Homo sapiens
cctgttgacctaccctggacc

SEQ ID NO: 606047 - DNA, 13 bp, Homo sapiens
cctgtttctcctc

SEQ ID NO: 606048 - DNA, 18 bp, Homo sapiens
ccttaaaaaaaaaaatga

SEQ ID NO: 606049 - DNA, 19 bp, Homo sapiens
ccttacaaccacatttctg

SEQ ID NO: 606050 - DNA, 21 bp, Homo sapiens
ccttacatagctttagagaag

SEQ ID NO: 606051 - DNA, 16 bp, Homo sapiens
ccttatggaacactct

SEQ ID NO: 606052 - DNA, 12 bp, Homo sapiens
ccttattaaaat

SEQ ID NO: 606053 - DNA, 19 bp, Homo sapiens
ccttcaaatacattctaaa

SEQ ID NO: 606054 - DNA, 18 bp, Homo sapiens
ccttcactccctgtcata

SEQ ID NO: 606055 - DNA, 13 bp, Homo sapiens
ccttcagtgcctt

SEQ ID NO: 606056 - DNA, 14 bp, Homo sapiens
ccttcagtgcctta

SEQ ID NO: 606057 - DNA, 19 bp, Homo sapiens
ccttcagtgccttatggaa

SEQ ID NO: 606058 - DNA, 20 bp, Homo sapiens
ccttcagtgccttatggaac

SEQ ID NO: 606059 - DNA, 17 bp, Homo sapiens
ccttcattccgttagga

SEQ ID NO: 606060 - DNA, 13 bp, Homo sapiens
ccttccatcttgt

SEQ ID NO: 606061 - DNA, 13 bp, Homo sapiens
ccttcccctgcgc

SEQ ID NO: 606062 - DNA, 17 bp, Homo sapiens
ccttcccctgcgccctc

SEQ ID NO: 606063 - DNA, 21 bp, Homo sapiens
ccttcccctgcgccctccctc

SEQ ID NO: 606064 - DNA, 18 bp, Homo sapiens
ccttccctccccacagtc

SEQ ID NO: 606065 - DNA, 21 bp, Homo sapiens
ccttccctgacactgtctgct

SEQ ID NO: 606066 - DNA, 14 bp, Homo sapiens
ccttcctgtcctgc

SEQ ID NO: 606067 - DNA, 15 bp, Homo sapiens
ccttcctgtcctgct

SEQ ID NO: 606068 - DNA, 17 bp, Homo sapiens
ccttcctgtcctgctca

SEQ ID NO: 606069 - DNA, 9 bp, Homo sapiens
ccttccttt

SEQ ID NO: 606070 - DNA, 16 bp, Homo sapiens
ccttcggcagtggctg

SEQ ID NO: 606071 - DNA, 17 bp, Homo sapiens
ccttctcccctccagac

SEQ ID NO: 606072 - DNA, 20 bp, Homo sapiens
ccttctggccgctgcagtca

SEQ ID NO: 606073 - DNA, 21 bp, Homo sapiens
ccttctggggaggggctccgt

SEQ ID NO: 606074 - DNA, 13 bp, Homo sapiens
ccttctgtgcatc

SEQ ID NO: 606075 - DNA, 20 bp, Homo sapiens
ccttctgtgcatctggcctg

SEQ ID NO: 606076 - DNA, 21 bp, Homo sapiens
ccttctgtgcatctggcctgg

SEQ ID NO: 606077 - DNA, 17 bp, Homo sapiens
ccttcttcccccagggt

SEQ ID NO: 606078 - DNA, 18 bp, Homo sapiens
ccttcttcccccagggtc

SEQ ID NO: 606079 - DNA, 13 bp, Homo sapiens
ccttctttccttc

SEQ ID NO: 606080 - DNA, 16 bp, Homo sapiens
ccttctttccttcctt

SEQ ID NO: 606081 - DNA, 17 bp, Homo sapiens
ccttgactattacactg

SEQ ID NO: 606082 - DNA, 21 bp, Homo sapiens
ccttgagaatgagggcgtgaa

SEQ ID NO: 606083 - DNA, 21 bp, Homo sapiens
ccttgcattttagctaattta

SEQ ID NO: 606084 - DNA, 15 bp, Homo sapiens
ccttgctgcagcttc

SEQ ID NO: 606085 - DNA, 12 bp, Homo sapiens
ccttgctgggcc

SEQ ID NO: 606086 - DNA, 19 bp, Homo sapiens
ccttgctgggccagggaaa

SEQ ID NO: 606087 - DNA, 13 bp, Homo sapiens
ccttggagcagaa

SEQ ID NO: 606088 - DNA, 17 bp, Homo sapiens
ccttggagcagaaagcc

SEQ ID NO: 606089 - DNA, 14 bp, Homo sapiens
ccttgggcacggga

SEQ ID NO: 606090 - DNA, 14 bp, Homo sapiens
ccttgggcgggcca

SEQ ID NO: 606091 - DNA, 21 bp, Homo sapiens
ccttggtgtcgggcatgacac

SEQ ID NO: 606092 - DNA, 13 bp, Homo sapiens
ccttggttcctcc

SEQ ID NO: 606093 - DNA, 16 bp, Homo sapiens
ccttggttcctccagc

SEQ ID NO: 606094 - DNA, 16 bp, Homo sapiens
ccttgtaaatgggaaa

SEQ ID NO: 606095 - DNA, 20 bp, Homo sapiens
ccttgtaaatgggaaaatat

SEQ ID NO: 606096 - DNA, 19 bp, Homo sapiens
ccttgtacagaaccagcac

SEQ ID NO: 606097 - DNA, 11 bp, Homo sapiens
ccttgtacttg

SEQ ID NO: 606098 - DNA, 15 bp, Homo sapiens
ccttgtctaaagatc

SEQ ID NO: 606099 - DNA, 13 bp, Homo sapiens
cctttatgtattc

SEQ ID NO: 606100 - DNA, 12 bp, Homo sapiens
cctttatgtgat

SEQ ID NO: 606101 - DNA, 18 bp, Homo sapiens
cctttcaataggaaaaac

SEQ ID NO: 606102 - DNA, 16 bp, Homo sapiens
cctttccagtgctgct

SEQ ID NO: 606103 - DNA, 11 bp, Homo sapiens
cctttccccat

SEQ ID NO: 606104 - DNA, 14 bp, Homo sapiens
cctttccctgcatc

SEQ ID NO: 606105 - DNA, 18 bp, Homo sapiens
cctttccctgcatccctt

SEQ ID NO: 606106 - DNA, 15 bp, Homo sapiens
cctttcctctcctct

SEQ ID NO: 606107 - DNA, 16 bp, Homo sapiens
cctttcctctcctctc

SEQ ID NO: 606108 - DNA, 16 bp, Homo sapiens
cgcgcccccaggaccc

SEQ ID NO: 606109 - DNA, 18 bp, Homo sapiens
cgcgcccctctgcgcccc

SEQ ID NO: 606110 - DNA, 11 bp, Homo sapiens
cgcgcccctgt

SEQ ID NO: 606111 - DNA, 14 bp, Homo sapiens
cgcgcgcccccagg

SEQ ID NO: 606112 - DNA, 21 bp, Homo sapiens
cgcgcgcccccaggacccccc

SEQ ID NO: 606113 - DNA, 17 bp, Homo sapiens
cgcgcgggacagcggcc

SEQ ID NO: 606114 - DNA, 15 bp, Homo sapiens
cgcgcgtgcccccag

SEQ ID NO: 606115 - DNA, 16 bp, Homo sapiens
cgcgcgttcgcggcgg

SEQ ID NO: 606116 - DNA, 22 bp, Homo sapiens
cgcgcgttcgcggcggtgggcg

SEQ ID NO: 606117 - DNA, 12 bp, Homo sapiens
cgcggaggcccc

SEQ ID NO: 606118 - DNA, 16 bp, Homo sapiens
cgcggcggtgggcgcc

SEQ ID NO: 606119 - DNA, 13 bp, Homo sapiens
cgcgtgcccccag

SEQ ID NO: 606120 - DNA, 14 bp, Homo sapiens
cgcgtgcccccagc

SEQ ID NO: 606121 - DNA, 13 bp, Homo sapiens
cgcgtgccttccc

SEQ ID NO: 606122 - DNA, 15 bp, Homo sapiens
cgcgtggttctgcca

SEQ ID NO: 606123 - DNA, 17 bp, Homo sapiens
cgcgtggttctgccact

SEQ ID NO: 606124 - DNA, 22 bp, Homo sapiens
cgcgttcgcggcggtgggcgcc

SEQ ID NO: 606125 - DNA, 20 bp, Homo sapiens
cgctcaacctctcagatccc

SEQ ID NO: 606126 - DNA, 17 bp, Homo sapiens
cgctccggcagaggcag

SEQ ID NO: 606127 - DNA, 20 bp, Homo sapiens
cgctccggcagaggcagggc

SEQ ID NO: 606128 - DNA, 21 bp, Homo sapiens
cgctccggcagaggcagggcc

SEQ ID NO: 606129 - DNA, 13 bp, Homo sapiens
cgctcctctgcag

SEQ ID NO: 606130 - DNA, 16 bp, Homo sapiens
cgctcctctgcagcct

SEQ ID NO: 606131 - DNA, 20 bp, Homo sapiens
cgctcctctgcagcctgagc

SEQ ID NO: 606132 - DNA, 14 bp, Homo sapiens
cgctgaacagaccg

SEQ ID NO: 606133 - DNA, 22 bp, Homo sapiens
cgctgagggcagggttctagaa

SEQ ID NO: 606134 - DNA, 15 bp, Homo sapiens
cgctgcagtcagcac

SEQ ID NO: 606135 - DNA, 18 bp, Homo sapiens
cgctgcagtcagcacaga

SEQ ID NO: 606136 - DNA, 22 bp, Homo sapiens
cgctgcctggcgggcagcccct

SEQ ID NO: 606137 - DNA, 23 bp, Homo sapiens
cgctgcctggcgggcagcccctg

SEQ ID NO: 606138 - DNA, 17 bp, Homo sapiens
cgctggagaccctgcgc

SEQ ID NO: 606139 - DNA, 22 bp, Homo sapiens
cgctggagaccctgcgcccctg

SEQ ID NO: 606140 - DNA, 23 bp, Homo sapiens
cgctggagaccctgcgcccctgc

SEQ ID NO: 606141 - DNA, 14 bp, Homo sapiens
cgctgtcggtgttt

SEQ ID NO: 606142 - DNA, 22 bp, Homo sapiens
cgctgtcggtgtttggaggctg

SEQ ID NO: 606143 - DNA, 14 bp, Homo sapiens
cggaagtggcctga

SEQ ID NO: 606144 - DNA, 20 bp, Homo sapiens
cggaccggagcggctgagga

SEQ ID NO: 606145 - DNA, 15 bp, Homo sapiens
cggacgcatgcaggg

SEQ ID NO: 606146 - DNA, 22 bp, Homo sapiens
cggacgctggagaccctgcgcc

SEQ ID NO: 606147 - DNA, 14 bp, Homo sapiens
cggacgctggctcg

SEQ ID NO: 606148 - DNA, 13 bp, Homo sapiens
cggacgggacagc

SEQ ID NO: 606149 - DNA, 16 bp, Homo sapiens
cggacgggacagcggc

SEQ ID NO: 606150 - DNA, 13 bp, Homo sapiens
cggagcggctgag

SEQ ID NO: 606151 - DNA, 19 bp, Homo sapiens
cggagctgggtatctcaaa

SEQ ID NO: 606152 - DNA, 19 bp, Homo sapiens
cggaggcgcccacctgccc

SEQ ID NO: 606153 - DNA, 21 bp, Homo sapiens
cggaggcgcccacctgcccag

SEQ ID NO: 606154 - DNA, 18 bp, Homo sapiens
cggaggggcttggagcag

SEQ ID NO: 606155 - DNA, 15 bp, Homo sapiens
cggagggtctccctg

SEQ ID NO: 606156 - DNA, 13 bp, Homo sapiens
cggcaccgcccac

SEQ ID NO: 606157 - DNA, 14 bp, Homo sapiens
cggcaccgcccacc

SEQ ID NO: 606158 - DNA, 15 bp, Homo sapiens
cggcaccgcccaccc

SEQ ID NO: 606159 - DNA, 17 bp, Homo sapiens
cggcagaggcagggccc

SEQ ID NO: 606160 - DNA, 19 bp, Homo sapiens
cggcagaggcagggccctg

SEQ ID NO: 606161 - DNA, 22 bp, Homo sapiens
cggcagaggcagggccctgggg

SEQ ID NO: 606162 - DNA, 11 bp, Homo sapiens
cggcagcccca

SEQ ID NO: 606163 - DNA, 19 bp, Homo sapiens
cggcagccccatccttccc

SEQ ID NO: 606164 - DNA, 21 bp, Homo sapiens
cggcaggggttggcagcgcct

SEQ ID NO: 606165 - DNA, 17 bp, Homo sapiens
cggcatccgagcccctg

SEQ ID NO: 606166 - DNA, 18 bp, Homo sapiens
cggcatccgagcccctgt

SEQ ID NO: 606167 - DNA, 16 bp, Homo sapiens
cggccaaggacactga

SEQ ID NO: 606168 - DNA, 21 bp, Homo sapiens
cggccattgaacactgcaccc

SEQ ID NO: 606169 - DNA, 17 bp, Homo sapiens
cggcccacgcagagccc

SEQ ID NO: 606170 - DNA, 13 bp, Homo sapiens
cggccccatcaga

SEQ ID NO: 606171 - DNA, 23 bp, Homo sapiens
cggccccatcagaggctggggga

SEQ ID NO: 606172 - DNA, 16 bp, Homo sapiens
cggccccgcgcgtgcc

SEQ ID NO: 606173 - DNA, 17 bp, Homo sapiens
cggccccgcgcgtgccc

SEQ ID NO: 606174 - DNA, 22 bp, Homo sapiens
cggccccgcgcgtgcccccagc

SEQ ID NO: 606175 - DNA, 17 bp, Homo sapiens
cggccccgcggagcccc

SEQ ID NO: 606176 - DNA, 20 bp, Homo sapiens
cggccccgcggagcccccgc

SEQ ID NO: 606177 - DNA, 14 bp, Homo sapiens
cggcccggcccacg

SEQ ID NO: 606178 - DNA, 16 bp, Homo sapiens
cggcccgtgcgcagcc

SEQ ID NO: 606179 - DNA, 18 bp, Homo sapiens
cggccgctctccgccccc

SEQ ID NO: 606180 - DNA, 19 bp, Homo sapiens
cggcctgatggccaggcct

SEQ ID NO: 606181 - DNA, 20 bp, Homo sapiens
cggccttccgggtctcgcag

SEQ ID NO: 606182 - DNA, 22 bp, Homo sapiens
cggcggggcctgggtccccctc

SEQ ID NO: 606183 - DNA, 23 bp, Homo sapiens
cggcgtccctgagggcccttccc

SEQ ID NO: 606184 - DNA, 20 bp, Homo sapiens
cggctggccggtccaccccg

SEQ ID NO: 606185 - DNA, 22 bp, Homo sapiens
cggctggccggtccaccccgtc

SEQ ID NO: 606186 - DNA, 12 bp, Homo sapiens
cggctgggcagg

SEQ ID NO: 606187 - DNA, 14 bp, Homo sapiens
cggctgggcagggc

SEQ ID NO: 606188 - DNA, 17 bp, Homo sapiens
cggctgggcagggccgc

SEQ ID NO: 606189 - DNA, 23 bp, Homo sapiens
cggctgggcagggccgcagggcg

SEQ ID NO: 606190 - DNA, 14 bp, Homo sapiens
ctaaatattatgcc

SEQ ID NO: 606191 - DNA, 13 bp, Homo sapiens
ctaaatcacttta

SEQ ID NO: 606192 - DNA, 21 bp, Homo sapiens
ctaaatcactttaatttagaa

SEQ ID NO: 606193 - DNA, 13 bp, Homo sapiens
ctaaatcataatc

SEQ ID NO: 606194 - DNA, 14 bp, Homo sapiens
ctaaatgttcatgt

SEQ ID NO: 606195 - DNA, 19 bp, Homo sapiens
ctaaattaacaaattcagt

SEQ ID NO: 606196 - DNA, 17 bp, Homo sapiens
ctaacagtaactgccat

SEQ ID NO: 606197 - DNA, 18 bp, Homo sapiens
ctaacagtaactgccatt

SEQ ID NO: 606198 - DNA, 22 bp, Homo sapiens
ctaacctgggttgttgcagagt

SEQ ID NO: 606199 - DNA, 14 bp, Homo sapiens
ctaacgggcgcctt

SEQ ID NO: 606200 - DNA, 19 bp, Homo sapiens
ctaactccttgaggtcttg

SEQ ID NO: 606201 - DNA, 12 bp, Homo sapiens
ctaactggcccc

SEQ ID NO: 606202 - DNA, 23 bp, Homo sapiens
ctaactggtaaaaagatccaggg

SEQ ID NO: 606203 - DNA, 11 bp, Homo sapiens
ctaagaattca

SEQ ID NO: 606204 - DNA, 16 bp, Homo sapiens
ctaagagccacaataa

SEQ ID NO: 606205 - DNA, 16 bp, Homo sapiens
ctaagagtggaggagg

SEQ ID NO: 606206 - DNA, 17 bp, Homo sapiens
ctaagataattaaatga

SEQ ID NO: 606207 - DNA, 16 bp, Homo sapiens
ctaagctttctccttt

SEQ ID NO: 606208 - DNA, 21 bp, Homo sapiens
ctaaggtcagtgttataaaat

SEQ ID NO: 606209 - DNA, 20 bp, Homo sapiens
ctaatggccaagtgtacatt

SEQ ID NO: 606210 - DNA, 21 bp, Homo sapiens
ctaatgtaaatattgctgtct

SEQ ID NO: 606211 - DNA, 13 bp, Homo sapiens
ctaattaatttca

SEQ ID NO: 606212 - DNA, 15 bp, Homo sapiens
ctaattctatgatta

SEQ ID NO: 606213 - DNA, 14 bp, Homo sapiens
ctaatttgtgaaag

SEQ ID NO: 606214 - DNA, 19 bp, Homo sapiens
ctacaatacaacacattga

SEQ ID NO: 606215 - DNA, 12 bp, Homo sapiens
ctacagatcctc

SEQ ID NO: 606216 - DNA, 15 bp, Homo sapiens
ctacaggtgccccac

SEQ ID NO: 606217 - DNA, 15 bp, Homo sapiens
ctacatgggccagcc

SEQ ID NO: 606218 - DNA, 18 bp, Homo sapiens
ctacatgggccagccctt

SEQ ID NO: 606219 - DNA, 18 bp, Homo sapiens
ctacattagtgagattta

SEQ ID NO: 606220 - DNA, 16 bp, Homo sapiens
ctaccattaaaatctt

SEQ ID NO: 606221 - DNA, 20 bp, Homo sapiens
ctaccccaggacgcatgcag

SEQ ID NO: 606222 - DNA, 20 bp, Homo sapiens
ctaccccaggatgcatgcag

SEQ ID NO: 606223 - DNA, 17 bp, Homo sapiens
ctactcctccccctcct

SEQ ID NO: 606224 - DNA, 18 bp, Homo sapiens
ctactcctccccctcctc

SEQ ID NO: 606225 - DNA, 22 bp, Homo sapiens
ctactgcccacatttgggctca

SEQ ID NO: 606226 - DNA, 22 bp, Homo sapiens
ctacttaaacaaaaactttcca

SEQ ID NO: 606227 - DNA, 23 bp, Homo sapiens
ctacttaaacaaaaactttccat

SEQ ID NO: 606228 - DNA, 14 bp, Homo sapiens
ctacttatattctg

SEQ ID NO: 606229 - DNA, 15 bp, Homo sapiens
ctactttaaattgtg

SEQ ID NO: 606230 - DNA, 22 bp, Homo sapiens
ctagaaataaaatcaccctgac

SEQ ID NO: 606231 - DNA, 14 bp, Homo sapiens
ctagaaggggcgag

SEQ ID NO: 606232 - DNA, 23 bp, Homo sapiens
ctagagcattctggggtggggct

SEQ ID NO: 606233 - DNA, 17 bp, Homo sapiens
ctagattttgttttgct

SEQ ID NO: 606234 - DNA, 18 bp, Homo sapiens
ctagattttgttttgctt

SEQ ID NO: 606235 - DNA, 13 bp, Homo sapiens
ctagcaaaaggat

SEQ ID NO: 606236 - DNA, 17 bp, Homo sapiens
ctagccatatattttct

SEQ ID NO: 606237 - DNA, 22 bp, Homo sapiens
ctagcccagtccctggagctgt

SEQ ID NO: 606238 - DNA, 20 bp, Homo sapiens
ctagccctctttctctctgt

SEQ ID NO: 606239 - DNA, 12 bp, Homo sapiens
ctagcctctccg

SEQ ID NO: 606240 - DNA, 22 bp, Homo sapiens
ctaggacatctctgtaaaaagc

SEQ ID NO: 606241 - DNA, 13 bp, Homo sapiens
ctaggaggttccg

SEQ ID NO: 606242 - DNA, 14 bp, Homo sapiens
ctaggattcctccc

SEQ ID NO: 606243 - DNA, 15 bp, Homo sapiens
ctaggcagggagggg

SEQ ID NO: 606244 - DNA, 15 bp, Homo sapiens
ctaggcccccaaatt

SEQ ID NO: 606245 - DNA, 21 bp, Homo sapiens
ctaggcctgagttagctgttt

SEQ ID NO: 606246 - DNA, 15 bp, Homo sapiens
ctaggctgagtctag

SEQ ID NO: 606247 - DNA, 17 bp, Homo sapiens
ctagggtcctggccctc

SEQ ID NO: 606248 - DNA, 15 bp, Homo sapiens
ctaggtctccacccc

SEQ ID NO: 606249 - DNA, 16 bp, Homo sapiens
ctaggtctccacccct

SEQ ID NO: 606250 - DNA, 17 bp, Homo sapiens
ctaggtctccacccctc

SEQ ID NO: 606251 - DNA, 19 bp, Homo sapiens
ctaggtctccacccctcaa

SEQ ID NO: 606252 - DNA, 18 bp, Homo sapiens
ctaggtgcccagtcttga

SEQ ID NO: 606253 - DNA, 22 bp, Homo sapiens
ctagtaggtctgcacacataac

SEQ ID NO: 606254 - DNA, 23 bp, Homo sapiens
ctagtaggtctgcacacataaca

SEQ ID NO: 606255 - DNA, 15 bp, Homo sapiens
ctagtcttagagata

SEQ ID NO: 606256 - DNA, 21 bp, Homo sapiens
ctagtgcaggaaaaggctgca

SEQ ID NO: 606257 - DNA, 11 bp, Homo sapiens
ctagttctgct

SEQ ID NO: 606258 - DNA, 13 bp, Homo sapiens
ctagttctgctgc

SEQ ID NO: 606259 - DNA, 18 bp, Homo sapiens
ctagttctttgcattcgt

SEQ ID NO: 606260 - DNA, 16 bp, Homo sapiens
ctagtttaaaattatt

SEQ ID NO: 606261 - DNA, 13 bp, Homo sapiens
ctataaaagccca

SEQ ID NO: 606262 - DNA, 22 bp, Homo sapiens
ctataaaagcccatgcttaaat

SEQ ID NO: 606263 - DNA, 16 bp, Homo sapiens
ctataagagacaaagt

SEQ ID NO: 606264 - DNA, 18 bp, Homo sapiens
ctataagagacaaagttt

SEQ ID NO: 606265 - DNA, 22 bp, Homo sapiens
ctataatgattaggagagctgt

SEQ ID NO: 606266 - DNA, 13 bp, Homo sapiens
ctataattgagaa

SEQ ID NO: 606267 - DNA, 20 bp, Homo sapiens
ctatatatatatatatatgt

SEQ ID NO: 606268 - DNA, 20 bp, Homo sapiens
ctatatgtaacttcagatgt

SEQ ID NO: 606269 - DNA, 19 bp, Homo sapiens
ctatattccgggtgccatt

SEQ ID NO: 606270 - DNA, 22 bp, Homo sapiens
ctatattgcgagaaacagagat

SEQ ID NO: 606271 - DNA, 11 bp, Homo sapiens
ctatatttact

SEQ ID NO: 606272 - DNA, 22 bp, Homo sapiens
ctatcagcagcggcagcagcag

SEQ ID NO: 606273 - DNA, 17 bp, Homo sapiens
ctatcagggcaagctca

SEQ ID NO: 606274 - DNA, 24 bp, Homo sapiens
ctatcagggcaagctcatagcaca

SEQ ID NO: 606275 - DNA, 14 bp, Homo sapiens
ctatccctggccac

SEQ ID NO: 606276 - DNA, 19 bp, Homo sapiens
ctatccctggccacctgcc

SEQ ID NO: 606277 - DNA, 22 bp, Homo sapiens
ctatccctggccacctgccagg

SEQ ID NO: 606278 - DNA, 13 bp, Homo sapiens
ctatctcccacaa

SEQ ID NO: 606279 - DNA, 14 bp, Homo sapiens
ctatctctcttctg

SEQ ID NO: 606280 - DNA, 22 bp, Homo sapiens
ctatctttcaggaaatttttgc

SEQ ID NO: 606281 - DNA, 19 bp, Homo sapiens
ctatgatgtccaaacttaa

SEQ ID NO: 606282 - DNA, 18 bp, Homo sapiens
ctatgcacaccaaattgc

SEQ ID NO: 606283 - DNA, 14 bp, Homo sapiens
ctatgctgtgtgca

SEQ ID NO: 606284 - DNA, 17 bp, Homo sapiens
ctatgctgtgtgcagag

SEQ ID NO: 606285 - DNA, 16 bp, Homo sapiens
ctatggacaatttacc

SEQ ID NO: 606286 - DNA, 18 bp, Homo sapiens
ctatgtctcatgttttat

SEQ ID NO: 606287 - DNA, 12 bp, Homo sapiens
ctatgtctgtga

SEQ ID NO: 606288 - DNA, 13 bp, Homo sapiens
ctattaatttatt

SEQ ID NO: 606289 - DNA, 14 bp, Homo sapiens
ctattaatttatta

SEQ ID NO: 606290 - DNA, 21 bp, Homo sapiens
ctattacactgcctggaggat

SEQ ID NO: 606291 - DNA, 13 bp, Homo sapiens
ctattatctgggt

SEQ ID NO: 606292 - DNA, 20 bp, Homo sapiens
ctattatctgggttttagaa

SEQ ID NO: 606293 - DNA, 23 bp, Homo sapiens
ctattatctgggttttagaaatt

SEQ ID NO: 606294 - DNA, 21 bp, Homo sapiens
ctattcaagaagatagttgta

SEQ ID NO: 606295 - DNA, 20 bp, Homo sapiens
ctatttaagtggactgtatt

SEQ ID NO: 606296 - DNA, 11 bp, Homo sapiens
ctatttatctg

SEQ ID NO: 606297 - DNA, 16 bp, Homo sapiens
ctatttatctgtctga

SEQ ID NO: 606298 - DNA, 21 bp, Homo sapiens
ctatttctgctgaattttcac

SEQ ID NO: 606299 - DNA, 20 bp, Homo sapiens
ctatttgtttcattaaagag

SEQ ID NO: 606300 - DNA, 20 bp, Homo sapiens
ctcaaaaaccattacaaaat

SEQ ID NO: 606301 - DNA, 17 bp, Homo sapiens
ctcaaaataaaaccaga

SEQ ID NO: 606302 - DNA, 19 bp, Homo sapiens
ctcaaagaggccagtactt

SEQ ID NO: 606303 - DNA, 20 bp, Homo sapiens
ctgatttttttttccttcag

SEQ ID NO: 606304 - DNA, 21 bp, Homo sapiens
ctgatttttttttccttcagt

SEQ ID NO: 606305 - DNA, 14 bp, Homo sapiens
ctgcaataacagtt

SEQ ID NO: 606306 - DNA, 15 bp, Homo sapiens
ctgcaataacagttt

SEQ ID NO: 606307 - DNA, 16 bp, Homo sapiens
ctgcaataacagtttt

SEQ ID NO: 606308 - DNA, 20 bp, Homo sapiens
ctgcaataacagttttaaga

SEQ ID NO: 606309 - DNA, 13 bp, Homo sapiens
ctgcaatgggaga

SEQ ID NO: 606310 - DNA, 13 bp, Homo sapiens
ctgcacatacaga

SEQ ID NO: 606311 - DNA, 14 bp, Homo sapiens
ctgcaccctccaca

SEQ ID NO: 606312 - DNA, 19 bp, Homo sapiens
ctgcaccctccacaggagc

SEQ ID NO: 606313 - DNA, 13 bp, Homo sapiens
ctgcaccctctgc

SEQ ID NO: 606314 - DNA, 16 bp, Homo sapiens
ctgcacctgcttctca

SEQ ID NO: 606315 - DNA, 11 bp, Homo sapiens
ctgcaccttgg

SEQ ID NO: 606316 - DNA, 18 bp, Homo sapiens
ctgcactgagcagagtct

SEQ ID NO: 606317 - DNA, 12 bp, Homo sapiens
ctgcactgccct

SEQ ID NO: 606318 - DNA, 13 bp, Homo sapiens
ctgcactgccctc

SEQ ID NO: 606319 - DNA, 13 bp, Homo sapiens
ctgcagagacctt

SEQ ID NO: 606320 - DNA, 13 bp, Homo sapiens
ctgcagcctgagc

SEQ ID NO: 606321 - DNA, 17 bp, Homo sapiens
ctgcagcctgagctcca

SEQ ID NO: 606322 - DNA, 18 bp, Homo sapiens
ctgcagctaatttgtgaa

SEQ ID NO: 606323 - DNA, 22 bp, Homo sapiens
ctgcaggaatcaaaaattgaag

SEQ ID NO: 606324 - DNA, 13 bp, Homo sapiens
ctgcaggcaggca

SEQ ID NO: 606325 - DNA, 22 bp, Homo sapiens
ctgcagtcacgtgaggcccctg

SEQ ID NO: 606326 - DNA, 15 bp, Homo sapiens
ctgcagtcagcacag

SEQ ID NO: 606327 - DNA, 17 bp, Homo sapiens
ctgcagtggcaaatggt

SEQ ID NO: 606328 - DNA, 18 bp, Homo sapiens
ctgcagttagcacagagg

SEQ ID NO: 606329 - DNA, 23 bp, Homo sapiens
ctgcagttatttaccagaagttt

SEQ ID NO: 606330 - DNA, 22 bp, Homo sapiens
ctgcagtttggccctggagcca

SEQ ID NO: 606331 - DNA, 23 bp, Homo sapiens
ctgcagtttggccctggagccag

SEQ ID NO: 606332 - DNA, 15 bp, Homo sapiens
ctgcataagattata

SEQ ID NO: 606333 - DNA, 21 bp, Homo sapiens
ctgcataagattatatacaaa

SEQ ID NO: 606334 - DNA, 21 bp, Homo sapiens
ctgcatcccttggcccctctc

SEQ ID NO: 606335 - DNA, 22 bp, Homo sapiens
ctgcatcccttggcccctctct

SEQ ID NO: 606336 - DNA, 20 bp, Homo sapiens
ctgcatgatcttacacgaag

SEQ ID NO: 606337 - DNA, 21 bp, Homo sapiens
ctgcatgtatgccatgtatgt

SEQ ID NO: 606338 - DNA, 23 bp, Homo sapiens
ctgcatgtcggggcccctgcgtg

SEQ ID NO: 606339 - DNA, 22 bp, Homo sapiens
ctgccaaataaatcatcctcat

SEQ ID NO: 606340 - DNA, 14 bp, Homo sapiens
ctgccaggcctccc

SEQ ID NO: 606341 - DNA, 17 bp, Homo sapiens
ctgccaggctcccactg

SEQ ID NO: 606342 - DNA, 22 bp, Homo sapiens
ctgccaggctcccactgcccct

SEQ ID NO: 606343 - DNA, 23 bp, Homo sapiens
ctgccaggctcccactgcccctg

SEQ ID NO: 606344 - DNA, 23 bp, Homo sapiens
ctgccagtgtttagaagagcctg

SEQ ID NO: 606345 - DNA, 19 bp, Homo sapiens
ctgccattttttgtctgtg

SEQ ID NO: 606346 - DNA, 17 bp, Homo sapiens
ctgcccacatttgggct

SEQ ID NO: 606347 - DNA, 23 bp, Homo sapiens
ctgcccacatttgggctcagggt

SEQ ID NO: 606348 - DNA, 15 bp, Homo sapiens
ctgcccaccctgggc

SEQ ID NO: 606349 - DNA, 16 bp, Homo sapiens
ctgcccaccctgggcc

SEQ ID NO: 606350 - DNA, 21 bp, Homo sapiens
ctgcccaccctgggcctcccg

SEQ ID NO: 606351 - DNA, 13 bp, Homo sapiens
ctgcccagcacct

SEQ ID NO: 606352 - DNA, 18 bp, Homo sapiens
ctgcccagcacctcctcc

SEQ ID NO: 606353 - DNA, 21 bp, Homo sapiens
ctgcccagcacctcctccgtg

SEQ ID NO: 606354 - DNA, 20 bp, Homo sapiens
ctgcccagttagcccggcca

SEQ ID NO: 606355 - DNA, 21 bp, Homo sapiens
ctgccccagcctactccacct

SEQ ID NO: 606356 - DNA, 13 bp, Homo sapiens
ctgccccatctcc

SEQ ID NO: 606357 - DNA, 18 bp, Homo sapiens
ctgcccccccaccccact

SEQ ID NO: 606358 - DNA, 14 bp, Homo sapiens
ctgccccctccccc

SEQ ID NO: 606359 - DNA, 19 bp, Homo sapiens
ctgccccctcccccgcaga

SEQ ID NO: 606360 - DNA, 13 bp, Homo sapiens
ctgccccctggct

SEQ ID NO: 606361 - DNA, 14 bp, Homo sapiens
ctgccccctggctt

SEQ ID NO: 606362 - DNA, 18 bp, Homo sapiens
ctgcccctccccagccct

SEQ ID NO: 606363 - DNA, 18 bp, Homo sapiens
ctgcccctcttccctggc

SEQ ID NO: 606364 - DNA, 20 bp, Homo sapiens
ctgcccctgcacctgcttct

SEQ ID NO: 606365 - DNA, 19 bp, Homo sapiens
ctgccccttgaccccacac

SEQ ID NO: 606366 - DNA, 20 bp, Homo sapiens
ctgccccttgaccccacacg

SEQ ID NO: 606367 - DNA, 13 bp, Homo sapiens
ctgcccgcgcccg

SEQ ID NO: 606368 - DNA, 22 bp, Homo sapiens
ctgcccgcgggtggctggagcc

SEQ ID NO: 606369 - DNA, 14 bp, Homo sapiens
ctgccctcactcca

SEQ ID NO: 606370 - DNA, 18 bp, Homo sapiens
ctgccctcactccactcc

SEQ ID NO: 606371 - DNA, 19 bp, Homo sapiens
ctgccctcactccactccc

SEQ ID NO: 606372 - DNA, 18 bp, Homo sapiens
ctgccctcccccacggcc

SEQ ID NO: 606373 - DNA, 20 bp, Homo sapiens
ctgccctgcaccttgggcac

SEQ ID NO: 606374 - DNA, 14 bp, Homo sapiens
ctgccgcatctgcc

SEQ ID NO: 606375 - DNA, 22 bp, Homo sapiens
ctgccgcatctgcctggagcct

SEQ ID NO: 606376 - DNA, 20 bp, Homo sapiens
ctgccggtggggccagcgct

SEQ ID NO: 606377 - DNA, 21 bp, Homo sapiens
ctgccggtggggccagcgctg

SEQ ID NO: 606378 - DNA, 17 bp, Homo sapiens
ctgcctacgtgctgccc

SEQ ID NO: 606379 - DNA, 18 bp, Homo sapiens
ctgcctcactgtgacctg

SEQ ID NO: 606380 - DNA, 20 bp, Homo sapiens
ctgcctcactgtgacctgct

SEQ ID NO: 606381 - DNA, 21 bp, Homo sapiens
ctgcctcactgtgacctgctc

SEQ ID NO: 606382 - DNA, 21 bp, Homo sapiens
ctgcctcatgaccctcctgtc

SEQ ID NO: 606383 - DNA, 22 bp, Homo sapiens
ctgcctcatgaccctcctgtcc

SEQ ID NO: 606384 - DNA, 23 bp, Homo sapiens
ctgcctcatgaccctcctgtcca

SEQ ID NO: 606385 - DNA, 20 bp, Homo sapiens
ctgcctctatccctggccac

SEQ ID NO: 606386 - DNA, 21 bp, Homo sapiens
ctgcctctatccctggccacc

SEQ ID NO: 606387 - DNA, 15 bp, Homo sapiens
ctgcctgaggaggag

SEQ ID NO: 606388 - DNA, 15 bp, Homo sapiens
ctgcctggagcctgg

SEQ ID NO: 606389 - DNA, 13 bp, Homo sapiens
ctgcctggccttg

SEQ ID NO: 606390 - DNA, 16 bp, Homo sapiens
ctgcctggcgggcagc

SEQ ID NO: 606391 - DNA, 17 bp, Homo sapiens
ctgcctggcgggcagcc

SEQ ID NO: 606392 - DNA, 19 bp, Homo sapiens
ctgcctggcgggcagcccc

SEQ ID NO: 606393 - DNA, 21 bp, Homo sapiens
ctgccttatattattttctgt

SEQ ID NO: 606394 - DNA, 23 bp, Homo sapiens
ctgcgacggaggcaggaccaggc

SEQ ID NO: 606395 - DNA, 15 bp, Homo sapiens
ctgcgcccctgccca

SEQ ID NO: 606396 - DNA, 12 bp, Homo sapiens
ctgcgccctccc

SEQ ID NO: 606397 - DNA, 13 bp, Homo sapiens
ctgcgccctccct

SEQ ID NO: 606398 - DNA, 14 bp, Homo sapiens
ctgcgccctccctc

SEQ ID NO: 606399 - DNA, 21 bp, Homo sapiens
ctgcgccctccctccctccac

SEQ ID NO: 606400 - DNA, 23 bp, Homo sapiens
ctgcgccctccctccctccacac

SEQ ID NO: 606401 - DNA, 15 bp, Homo sapiens
ctgcgcgcagctggc

SEQ ID NO: 606402 - DNA, 21 bp, Homo sapiens
ctgcgctcctctgcagcctga

SEQ ID NO: 606403 - DNA, 18 bp, Homo sapiens
ctgcgtaggagagaacag

SEQ ID NO: 606404 - DNA, 12 bp, Homo sapiens
ctgcgtccctgc

SEQ ID NO: 606405 - DNA, 15 bp, Homo sapiens
ctgcgtccctgctca

SEQ ID NO: 606406 - DNA, 18 bp, Homo sapiens
ctgcgtccctgctcagcc

SEQ ID NO: 606407 - DNA, 21 bp, Homo sapiens
ctgctagtgtagcttctgaaa

SEQ ID NO: 606408 - DNA, 16 bp, Homo sapiens
ctgctcacgtctgtga

SEQ ID NO: 606409 - DNA, 17 bp, Homo sapiens
ctgctcacgtctgtgag

SEQ ID NO: 606410 - DNA, 14 bp, Homo sapiens
ctgctcagcccatc

SEQ ID NO: 606411 - DNA, 17 bp, Homo sapiens
ctgctcagcccatcccc

SEQ ID NO: 606412 - DNA, 22 bp, Homo sapiens
ctgctcagcccatcccctgcct

SEQ ID NO: 606413 - DNA, 17 bp, Homo sapiens
ctgctcatctacacata

SEQ ID NO: 606414 - DNA, 15 bp, Homo sapiens
ctgctcccagcctct

SEQ ID NO: 606415 - DNA, 22 bp, Homo sapiens
ctgctcccggtgtgcagcgggt

SEQ ID NO: 606416 - DNA, 15 bp, Homo sapiens
ctgctcgccctgtgc

SEQ ID NO: 606417 - DNA, 14 bp, Homo sapiens
ctgctcgggaaggc

SEQ ID NO: 606418 - DNA, 17 bp, Homo sapiens
ctgctcgggaaggcctg

SEQ ID NO: 606419 - DNA, 20 bp, Homo sapiens
ctgctcgggaaggcctgagg

SEQ ID NO: 606420 - DNA, 21 bp, Homo sapiens
ctgctcgggaaggcctgaggg

SEQ ID NO: 606421 - DNA, 17 bp, Homo sapiens
gcctgcgcctcctcctg

SEQ ID NO: 606422 - DNA, 18 bp, Homo sapiens
gcctgcgcctcctcctgc

SEQ ID NO: 606423 - DNA, 19 bp, Homo sapiens
gcctgcgcctcctcctgca

SEQ ID NO: 606424 - DNA, 15 bp, Homo sapiens
gcctgcgctcctctg

SEQ ID NO: 606425 - DNA, 23 bp, Homo sapiens
gcctgcgctcctctgcagcctga

SEQ ID NO: 606426 - DNA, 17 bp, Homo sapiens
gcctgcggggttccctg

SEQ ID NO: 606427 - DNA, 13 bp, Homo sapiens
gcctggagcctgg

SEQ ID NO: 606428 - DNA, 14 bp, Homo sapiens
gcctggagcctggg

SEQ ID NO: 606429 - DNA, 18 bp, Homo sapiens
gcctggagcctgggcagc

SEQ ID NO: 606430 - DNA, 19 bp, Homo sapiens
gcctggattccagcagtga

SEQ ID NO: 606431 - DNA, 14 bp, Homo sapiens
gcctggccccctcg

SEQ ID NO: 606432 - DNA, 15 bp, Homo sapiens
gcctggccccctcgc

SEQ ID NO: 606433 - DNA, 23 bp, Homo sapiens
gcctggccccctcgcgcccctgt

SEQ ID NO: 606434 - DNA, 14 bp, Homo sapiens
gcctggcgggcagc

SEQ ID NO: 606435 - DNA, 19 bp, Homo sapiens
gcctggcgggcagcccctg

SEQ ID NO: 606436 - DNA, 21 bp, Homo sapiens
gcctggcgggcagcccctgct

SEQ ID NO: 606437 - DNA, 23 bp, Homo sapiens
gcctggcgggcagcccctgctgg

SEQ ID NO: 606438 - DNA, 12 bp, Homo sapiens
gcctggctgggc

SEQ ID NO: 606439 - DNA, 14 bp, Homo sapiens
gcctggctgggctt

SEQ ID NO: 606440 - DNA, 16 bp, Homo sapiens
gcctgggacgcccctt

SEQ ID NO: 606441 - DNA, 21 bp, Homo sapiens
gcctgggacgcccctttctct

SEQ ID NO: 606442 - DNA, 13 bp, Homo sapiens
gcctgggcagcac

SEQ ID NO: 606443 - DNA, 13 bp, Homo sapiens
gcctgggcccagg

SEQ ID NO: 606444 - DNA, 16 bp, Homo sapiens
gcctgggcccaggccc

SEQ ID NO: 606445 - DNA, 19 bp, Homo sapiens
gcctgggcccaggcccagc

SEQ ID NO: 606446 - DNA, 20 bp, Homo sapiens
gcctgggcccaggcccagcc

SEQ ID NO: 606447 - DNA, 14 bp, Homo sapiens
gcctgggctgttgt

SEQ ID NO: 606448 - DNA, 16 bp, Homo sapiens
gcctgggtccccctcc

SEQ ID NO: 606449 - DNA, 17 bp, Homo sapiens
gcctgggtccccctcct

SEQ ID NO: 606450 - DNA, 19 bp, Homo sapiens
gcctgggtccccctcctgc

SEQ ID NO: 606451 - DNA, 12 bp, Homo sapiens
gcctggtctgga

SEQ ID NO: 606452 - DNA, 13 bp, Homo sapiens
gcctggtctggag

SEQ ID NO: 606453 - DNA, 14 bp, Homo sapiens
gcctggtctggagc

SEQ ID NO: 606454 - DNA, 17 bp, Homo sapiens
gcctggtctggagcccc

SEQ ID NO: 606455 - DNA, 15 bp, Homo sapiens
gcctgtctgtacttc

SEQ ID NO: 606456 - DNA, 17 bp, Homo sapiens
gcctgtgatcgtgtgtt

SEQ ID NO: 606457 - DNA, 16 bp, Homo sapiens
gccttaagtcttactg

SEQ ID NO: 606458 - DNA, 14 bp, Homo sapiens
gccttatggaacac

SEQ ID NO: 606459 - DNA, 22 bp, Homo sapiens
gccttatggaacactctgagac

SEQ ID NO: 606460 - DNA, 23 bp, Homo sapiens
gccttatggaacactctgagact

SEQ ID NO: 606461 - DNA, 14 bp, Homo sapiens
gccttattaaaata

SEQ ID NO: 606462 - DNA, 13 bp, Homo sapiens
gccttctcccctc

SEQ ID NO: 606463 - DNA, 14 bp, Homo sapiens
gccttctcccctcc

SEQ ID NO: 606464 - DNA, 18 bp, Homo sapiens
gccttctggccgctgcag

SEQ ID NO: 606465 - DNA, 16 bp, Homo sapiens
gccttgctgggccagg

SEQ ID NO: 606466 - DNA, 18 bp, Homo sapiens
gccttggagcagaaagcc

SEQ ID NO: 606467 - DNA, 17 bp, Homo sapiens
gcctttccagtgctgct

SEQ ID NO: 606468 - DNA, 15 bp, Homo sapiens
gcctttccccagtgt

SEQ ID NO: 606469 - DNA, 19 bp, Homo sapiens
gcctttgcgctctgggttt

SEQ ID NO: 606470 - DNA, 19 bp, Homo sapiens
gcctttgggaggcagcatc

SEQ ID NO: 606471 - DNA, 13 bp, Homo sapiens
gcgacaatgcaaa

SEQ ID NO: 606472 - DNA, 16 bp, Homo sapiens
gcgaccacccctgtgc

SEQ ID NO: 606473 - DNA, 14 bp, Homo sapiens
gcgagaaacagaga

SEQ ID NO: 606474 - DNA, 17 bp, Homo sapiens
gcgagtgacagaaggcc

SEQ ID NO: 606475 - DNA, 17 bp, Homo sapiens
gcgcaaaggtgcctcat

SEQ ID NO: 606476 - DNA, 17 bp, Homo sapiens
gcgcatggcgccccggg

SEQ ID NO: 606477 - DNA, 18 bp, Homo sapiens
gcgcatggcgccccgggc

SEQ ID NO: 606478 - DNA, 13 bp, Homo sapiens
gcgccacccgccc

SEQ ID NO: 606479 - DNA, 14 bp, Homo sapiens
gcgcccacctgccc

SEQ ID NO: 606480 - DNA, 16 bp, Homo sapiens
gcgcccacctgcccag

SEQ ID NO: 606481 - DNA, 12 bp, Homo sapiens
gcgcccccagga

SEQ ID NO: 606482 - DNA, 14 bp, Homo sapiens
gcgcccctctgcgc

SEQ ID NO: 606483 - DNA, 16 bp, Homo sapiens
gcgcccctctgcgccc

SEQ ID NO: 606484 - DNA, 13 bp, Homo sapiens
gcgcccctgccca

SEQ ID NO: 606485 - DNA, 13 bp, Homo sapiens
gcgcccctgtcca

SEQ ID NO: 606486 - DNA, 19 bp, Homo sapiens
gcgcccgccgcctccctca

SEQ ID NO: 606487 - DNA, 12 bp, Homo sapiens
gcgccctccctc

SEQ ID NO: 606488 - DNA, 20 bp, Homo sapiens
gcgccctccctccctccaca

SEQ ID NO: 606489 - DNA, 20 bp, Homo sapiens
gcgccgcctcgcccccgggc

SEQ ID NO: 606490 - DNA, 16 bp, Homo sapiens
gcgcctcccgccgcct

SEQ ID NO: 606491 - DNA, 14 bp, Homo sapiens
gcgcctcctcctgc

SEQ ID NO: 606492 - DNA, 17 bp, Homo sapiens
gcgcctcctcctgcatg

SEQ ID NO: 606493 - DNA, 14 bp, Homo sapiens
gcgcctcgccccag

SEQ ID NO: 606494 - DNA, 11 bp, Homo sapiens
gcgcctgcccg

SEQ ID NO: 606495 - DNA, 17 bp, Homo sapiens
gcgcctgcccgcccgcc

SEQ ID NO: 606496 - DNA, 15 bp, Homo sapiens
gcgcctgcgctcctc

SEQ ID NO: 606497 - DNA, 23 bp, Homo sapiens
gcgcctgcgctcctctgcagcct

SEQ ID NO: 606498 - DNA, 18 bp, Homo sapiens
gcgcctgtcgggcccgca

SEQ ID NO: 606499 - DNA, 14 bp, Homo sapiens
gcgcgcaccgccca

SEQ ID NO: 606500 - DNA, 17 bp, Homo sapiens
gcgcgcaccgcccaacc

SEQ ID NO: 606501 - DNA, 12 bp, Homo sapiens
gcgcgcccccag

SEQ ID NO: 606502 - DNA, 22 bp, Homo sapiens
gcgcgcgggacagcggccccgc

SEQ ID NO: 606503 - DNA, 16 bp, Homo sapiens
gcgcgtgcccccagcg

SEQ ID NO: 606504 - DNA, 20 bp, Homo sapiens
gcgctccggcagaggcaggg

SEQ ID NO: 606505 - DNA, 22 bp, Homo sapiens
gcgctccggcagaggcagggcc

SEQ ID NO: 606506 - DNA, 13 bp, Homo sapiens
gcgctcctctgca

SEQ ID NO: 606507 - DNA, 15 bp, Homo sapiens
gcgctcctctgcagc

SEQ ID NO: 606508 - DNA, 23 bp, Homo sapiens
gcgctcctctgcagcctgagctc

SEQ ID NO: 606509 - DNA, 18 bp, Homo sapiens
gcgctctgcccctccgtc

SEQ ID NO: 606510 - DNA, 16 bp, Homo sapiens
gcggagcccccgcccc

SEQ ID NO: 606511 - DNA, 14 bp, Homo sapiens
gcggaggcccctga

SEQ ID NO: 606512 - DNA, 23 bp, Homo sapiens
gcggaggggcttggagcagagac

SEQ ID NO: 606513 - DNA, 18 bp, Homo sapiens
gcggagggtctccctggg

SEQ ID NO: 606514 - DNA, 17 bp, Homo sapiens
gcggcaggggttggcag

SEQ ID NO: 606515 - DNA, 21 bp, Homo sapiens
gcggcaggggttggcagcgcc

SEQ ID NO: 606516 - DNA, 18 bp, Homo sapiens
gcggcatccgagcccctg

SEQ ID NO: 606517 - DNA, 17 bp, Homo sapiens
gcggccccgcggagccc

SEQ ID NO: 606518 - DNA, 13 bp, Homo sapiens
gcggcccggccca

SEQ ID NO: 606519 - DNA, 17 bp, Homo sapiens
gcggcccggcccacgca

SEQ ID NO: 606520 - DNA, 21 bp, Homo sapiens
gcggcccggcccacgcagagc

SEQ ID NO: 606521 - DNA, 16 bp, Homo sapiens
gcggcccgtgcgcagc

SEQ ID NO: 606522 - DNA, 22 bp, Homo sapiens
gcggcccgtgcgcagccgcgct

SEQ ID NO: 606523 - DNA, 17 bp, Homo sapiens
gcggccgctctccgccc

SEQ ID NO: 606524 - DNA, 16 bp, Homo sapiens
gcggccttccgggtct

SEQ ID NO: 606525 - DNA, 12 bp, Homo sapiens
gcggctgaggac

SEQ ID NO: 606526 - DNA, 22 bp, Homo sapiens
gcggctgaggacggggcagagc

SEQ ID NO: 606527 - DNA, 15 bp, Homo sapiens
gcggctgtgggggag

SEQ ID NO: 606528 - DNA, 16 bp, Homo sapiens
gcggcttccctgcgac

SEQ ID NO: 606529 - DNA, 14 bp, Homo sapiens
gcgggcagcccctg

SEQ ID NO: 606530 - DNA, 16 bp, Homo sapiens
gcgggcagcccctgct

SEQ ID NO: 606531 - DNA, 12 bp, Homo sapiens
gcgggccagggt

SEQ ID NO: 606532 - DNA, 15 bp, Homo sapiens
gcgggccagggtggg

SEQ ID NO: 606533 - DNA, 18 bp, Homo sapiens
gcgggccaggtctggcgc

SEQ ID NO: 606534 - DNA, 21 bp, Homo sapiens
gcgggccaggtctggcgccag

SEQ ID NO: 606535 - DNA, 17 bp, Homo sapiens
gcgggggctaactggcc

SEQ ID NO: 606536 - DNA, 20 bp, Homo sapiens
gcgggggctaactggcccca

SEQ ID NO: 606537 - DNA, 22 bp, Homo sapiens
gcgggggctaactggccccagg

SEQ ID NO: 606538 - DNA, 19 bp, Homo sapiens
gcgtccctgagggcccttc

SEQ ID NO: 606539 - DNA, 13 bp, Homo sapiens
gcgtccctgctca

SEQ ID NO: 606540 - DNA, 17 bp, Homo sapiens
gcgtccctgctcagccc

SEQ ID NO: 606541 - DNA, 18 bp, Homo sapiens
ctgctctctaagaattca

SEQ ID NO: 606542 - DNA, 15 bp, Homo sapiens
ctgctgaattttcac

SEQ ID NO: 606543 - DNA, 12 bp, Homo sapiens
ctgctgcactgc

SEQ ID NO: 606544 - DNA, 17 bp, Homo sapiens
ctgctgcagtcagcaca

SEQ ID NO: 606545 - DNA, 15 bp, Homo sapiens
ctgctgccccctggc

SEQ ID NO: 606546 - DNA, 23 bp, Homo sapiens
ctgctgctcgggaaggcctgagg

SEQ ID NO: 606547 - DNA, 18 bp, Homo sapiens
ctgctgctgcctccctgg

SEQ ID NO: 606548 - DNA, 19 bp, Homo sapiens
ctgctggaccaaggtgcgg

SEQ ID NO: 606549 - DNA, 17 bp, Homo sapiens
ctgctggggcagggccc

SEQ ID NO: 606550 - DNA, 10 bp, Homo sapiens
ctgctgtgta

SEQ ID NO: 606551 - DNA, 12 bp, Homo sapiens
ctgctgtgtagc

SEQ ID NO: 606552 - DNA, 18 bp, Homo sapiens
ctgctgtgtagctctgtc

SEQ ID NO: 606553 - DNA, 22 bp, Homo sapiens
ctgctgtgtagctctgtccact

SEQ ID NO: 606554 - DNA, 18 bp, Homo sapiens
ctgctgtgttaagaggac

SEQ ID NO: 606555 - DNA, 14 bp, Homo sapiens
ctgcttcaaggatc

SEQ ID NO: 606556 - DNA, 19 bp, Homo sapiens
ctgcttcaaggatcctgag

SEQ ID NO: 606557 - DNA, 22 bp, Homo sapiens
ctgcttcaaggatcctgagcca

SEQ ID NO: 606558 - DNA, 23 bp, Homo sapiens
ctgcttcaaggatcctgagccag

SEQ ID NO: 606559 - DNA, 13 bp, Homo sapiens
ctgcttctccctg

SEQ ID NO: 606560 - DNA, 14 bp, Homo sapiens
ctgcttctccctgg

SEQ ID NO: 606561 - DNA, 14 bp, Homo sapiens
ctgcttctctttca

SEQ ID NO: 606562 - DNA, 15 bp, Homo sapiens
ggaaatatctgtgaa

SEQ ID NO: 606563 - DNA, 13 bp, Homo sapiens
ggaaatcaattta

SEQ ID NO: 606564 - DNA, 16 bp, Homo sapiens
ggaaatgaatgtgtgt

SEQ ID NO: 606565 - DNA, 18 bp, Homo sapiens
ggaaattcttgcactgta

SEQ ID NO: 606566 - DNA, 12 bp, Homo sapiens
ggaaatttgtgt

SEQ ID NO: 606567 - DNA, 22 bp, Homo sapiens
ggaaatttgtgtgcttcacaca

SEQ ID NO: 606568 - DNA, 13 bp, Homo sapiens
ggaaatttttgca

SEQ ID NO: 606569 - DNA, 15 bp, Homo sapiens
ggaacactctgagac

SEQ ID NO: 606570 - DNA, 18 bp, Homo sapiens
ggaacatgacccagcctg

SEQ ID NO: 606571 - DNA, 19 bp, Homo sapiens
ggaacatgacccagcctga

SEQ ID NO: 606572 - DNA, 23 bp, Homo sapiens
ggaaccagagcgatgtgttcttt

SEQ ID NO: 606573 - DNA, 23 bp, Homo sapiens
ggaagagaagaaatagcagagcc

SEQ ID NO: 606574 - DNA, 13 bp, Homo sapiens
ggaagcccacccg

SEQ ID NO: 606575 - DNA, 14 bp, Homo sapiens
ggaagcccacccgc

SEQ ID NO: 606576 - DNA, 15 bp, Homo sapiens
ggaagcccacccgcc

SEQ ID NO: 606577 - DNA, 23 bp, Homo sapiens
ggaagcccacccgccccagagac

SEQ ID NO: 606578 - DNA, 18 bp, Homo sapiens
ggaagctttggaagcagc

SEQ ID NO: 606579 - DNA, 13 bp, Homo sapiens
ggaaggcctgagg

SEQ ID NO: 606580 - DNA, 19 bp, Homo sapiens
ggaaggcctgagggaagcc

SEQ ID NO: 606581 - DNA, 22 bp, Homo sapiens
ggaaggcctgagggaagcccac

SEQ ID NO: 606582 - DNA, 23 bp, Homo sapiens
ggaaggcctgagggaagcccacc

SEQ ID NO: 606583 - DNA, 15 bp, Homo sapiens
ggaaggctgctgtgt

SEQ ID NO: 606584 - DNA, 21 bp, Homo sapiens
ggaagggtgcctggctgggct

SEQ ID NO: 606585 - DNA, 19 bp, Homo sapiens
ggaaggttagaaaggcagc

SEQ ID NO: 606586 - DNA, 13 bp, Homo sapiens
ggaataacactgc

SEQ ID NO: 606587 - DNA, 17 bp, Homo sapiens
ggaatagagttttcctc

SEQ ID NO: 606588 - DNA, 16 bp, Homo sapiens
ggaatgctcaatgtgc

SEQ ID NO: 606589 - DNA, 14 bp, Homo sapiens
ggacaacctgcccc

SEQ ID NO: 606590 - DNA, 19 bp, Homo sapiens
ggacaacctgcccctcccc

SEQ ID NO: 606591 - DNA, 17 bp, Homo sapiens
ggacaatttaccacagg

SEQ ID NO: 606592 - DNA, 23 bp, Homo sapiens
ggacacagaggacggcttcccca

SEQ ID NO: 606593 - DNA, 13 bp, Homo sapiens
ggacacagcacaa

SEQ ID NO: 606594 - DNA, 20 bp, Homo sapiens
ggacagaaccaacgggtctg

SEQ ID NO: 606595 - DNA, 17 bp, Homo sapiens
ggacagaggatttctgc

SEQ ID NO: 606596 - DNA, 23 bp, Homo sapiens
ggacagcggccccgcggagcccc

SEQ ID NO: 606597 - DNA, 19 bp, Homo sapiens
ggacagcggcccggcccac

SEQ ID NO: 606598 - DNA, 13 bp, Homo sapiens
ggacagtgttcaa

SEQ ID NO: 606599 - DNA, 16 bp, Homo sapiens
ggacatttatgtacaa

SEQ ID NO: 606600 - DNA, 18 bp, Homo sapiens
ggaccaaggagatgggga

SEQ ID NO: 606601 - DNA, 11 bp, Homo sapiens
ggaccaggagc

SEQ ID NO: 606602 - DNA, 12 bp, Homo sapiens
ggaccaggagct

SEQ ID NO: 606603 - DNA, 14 bp, Homo sapiens
ggacccctgccctc

SEQ ID NO: 606604 - DNA, 20 bp, Homo sapiens
ggaccggagcggctgaggac

SEQ ID NO: 606605 - DNA, 21 bp, Homo sapiens
ggacctactcctccccctcct

SEQ ID NO: 606606 - DNA, 20 bp, Homo sapiens
ggacgcccagcccccacccc

SEQ ID NO: 606607 - DNA, 21 bp, Homo sapiens
ggacgccccccggcctgatgg

SEQ ID NO: 606608 - DNA, 11 bp, Homo sapiens
ggacgcccctt

SEQ ID NO: 606609 - DNA, 21 bp, Homo sapiens
ggacgctggagaccctgcgcc

SEQ ID NO: 606610 - DNA, 18 bp, Homo sapiens
ggataggagcttccagat

SEQ ID NO: 606611 - DNA, 21 bp, Homo sapiens
ggataggagggtgcccctggg

SEQ ID NO: 606612 - DNA, 17 bp, Homo sapiens
ggatcacttgagcccag

SEQ ID NO: 606613 - DNA, 14 bp, Homo sapiens
ggatcctgagccag

SEQ ID NO: 606614 - DNA, 20 bp, Homo sapiens
ggatcctgagccagatttca

SEQ ID NO: 606615 - DNA, 23 bp, Homo sapiens
ggatcctgagccagatttcactc

SEQ ID NO: 606616 - DNA, 22 bp, Homo sapiens
ggatcgtggaagaagggccacc

SEQ ID NO: 606617 - DNA, 11 bp, Homo sapiens
ggatgcatatt

SEQ ID NO: 606618 - DNA, 14 bp, Homo sapiens
ggatgcatgcaggg

SEQ ID NO: 606619 - DNA, 16 bp, Homo sapiens
ggatgcatgcagggcc

SEQ ID NO: 606620 - DNA, 16 bp, Homo sapiens
ggatgcccctggccct

SEQ ID NO: 606621 - DNA, 18 bp, Homo sapiens
ggatgcccctggccctgc

SEQ ID NO: 606622 - DNA, 17 bp, Homo sapiens
ggatgcttacagtgact

SEQ ID NO: 606623 - DNA, 12 bp, Homo sapiens
ggatgtcccttc

SEQ ID NO: 606624 - DNA, 11 bp, Homo sapiens
ggattacagaa

SEQ ID NO: 606625 - DNA, 12 bp, Homo sapiens
ggcaaacattta

SEQ ID NO: 606626 - DNA, 17 bp, Homo sapiens
gggtcatattcatacct

SEQ ID NO: 606627 - DNA, 19 bp, Homo sapiens
gggtcccccctgagtgggc

SEQ ID NO: 606628 - DNA, 18 bp, Homo sapiens
gggtccccctcctgcacg

SEQ ID NO: 606629 - DNA, 20 bp, Homo sapiens
gggtccccggacgctggctc

SEQ ID NO: 606630 - DNA, 23 bp, Homo sapiens
gggtccccggacgctggctcggg

SEQ ID NO: 606631 - DNA, 16 bp, Homo sapiens
gggtcgggggaggagc

SEQ ID NO: 606632 - DNA, 16 bp, Homo sapiens
gggtctcgcagcctga

SEQ ID NO: 606633 - DNA, 15 bp, Homo sapiens
gggtctctgagcagt

SEQ ID NO: 606634 - DNA, 22 bp, Homo sapiens
gggtctctgagcagtggggagc

SEQ ID NO: 606635 - DNA, 13 bp, Homo sapiens
gggtgcccctggg

SEQ ID NO: 606636 - DNA, 12 bp, Homo sapiens
gggtgcctggct

SEQ ID NO: 606637 - DNA, 13 bp, Homo sapiens
gggtgcctggctg

SEQ ID NO: 606638 - DNA, 16 bp, Homo sapiens
gggtgcctggctgggc

SEQ ID NO: 606639 - DNA, 17 bp, Homo sapiens
gggtgcctggctgggct

SEQ ID NO: 606640 - DNA, 13 bp, Homo sapiens
gggtggctggagc

SEQ ID NO: 606641 - DNA, 11 bp, Homo sapiens
gggtgggaaga

SEQ ID NO: 606642 - DNA, 17 bp, Homo sapiens
gggttaaagaaaggcag

SEQ ID NO: 606643 - DNA, 18 bp, Homo sapiens
gggttaacagtaaatata

SEQ ID NO: 606644 - DNA, 13 bp, Homo sapiens
gggttccagacag

SEQ ID NO: 606645 - DNA, 16 bp, Homo sapiens
gggttccagacagagt

SEQ ID NO: 606646 - DNA, 14 bp, Homo sapiens
gggttccagacagg

SEQ ID NO: 606647 - DNA, 12 bp, Homo sapiens
gggttggcagcg

SEQ ID NO: 606648 - DNA, 15 bp, Homo sapiens
gggttgggttccaga

SEQ ID NO: 606649 - DNA, 18 bp, Homo sapiens
gggttttgttaggggtgg

SEQ ID NO: 606650 - DNA, 20 bp, Homo sapiens
ggtaagggactccagaagca

SEQ ID NO: 606651 - DNA, 17 bp, Homo sapiens
ggtaagttgaagggaaa

SEQ ID NO: 606652 - DNA, 13 bp, Homo sapiens
ggtaggctgctgg

SEQ ID NO: 606653 - DNA, 15 bp, Homo sapiens
ggtaggctgctggcg

SEQ ID NO: 606654 - DNA, 18 bp, Homo sapiens
ggtaggctgctggcgcct

SEQ ID NO: 606655 - DNA, 20 bp, Homo sapiens
ggtatctgatgatgttctga

SEQ ID NO: 606656 - DNA, 19 bp, Homo sapiens
ggtatttactgcaatgtct

SEQ ID NO: 606657 - DNA, 17 bp, Homo sapiens
ggtattttttgtgaatg

SEQ ID NO: 606658 - DNA, 17 bp, Homo sapiens
ggtcatttggtggctct

SEQ ID NO: 606659 - DNA, 15 bp, Homo sapiens
ggtccaatccagcct

SEQ ID NO: 606660 - DNA, 23 bp, Homo sapiens
ggtccaccccgttgttgtccctg

SEQ ID NO: 606661 - DNA, 15 bp, Homo sapiens
ggtccagccctccgc

SEQ ID NO: 606662 - DNA, 24 bp, Homo sapiens
ggtccagccctccgccagccctgt

SEQ ID NO: 606663 - DNA, 17 bp, Homo sapiens
ggtccagggtccagccc

SEQ ID NO: 606664 - DNA, 18 bp, Homo sapiens
ggtccagggtccagccct

SEQ ID NO: 606665 - DNA, 19 bp, Homo sapiens
ggtccagggtccagccctc

SEQ ID NO: 606666 - DNA, 16 bp, Homo sapiens
ggtcccccctgagtgg

SEQ ID NO: 606667 - DNA, 19 bp, Homo sapiens
ggtccccggacgctggctc

SEQ ID NO: 606668 - DNA, 20 bp, Homo sapiens
ggtccccggacgctggctcg

SEQ ID NO: 606669 - DNA, 21 bp, Homo sapiens
ggtccccggacgctggctcgg

SEQ ID NO: 606670 - DNA, 12 bp, Homo sapiens
ggtccctgccag

SEQ ID NO: 606671 - DNA, 18 bp, Homo sapiens
ggtccgccacgaggagct

SEQ ID NO: 606672 - DNA, 13 bp, Homo sapiens
ggtcctgagtggc

SEQ ID NO: 606673 - DNA, 13 bp, Homo sapiens
ggtcctgctgctc

SEQ ID NO: 606674 - DNA, 14 bp, Homo sapiens
ggtcctgctgctcg

SEQ ID NO: 606675 - DNA, 15 bp, Homo sapiens
ggtcctgggggctgc

SEQ ID NO: 606676 - DNA, 21 bp, Homo sapiens
ggtcctgggggctgctgcact

SEQ ID NO: 606677 - DNA, 21 bp, Homo sapiens
ggtcctgtcctggctcccagg

SEQ ID NO: 606678 - DNA, 11 bp, Homo sapiens
ggtccttaaaa

SEQ ID NO: 606679 - DNA, 18 bp, Homo sapiens
ggtcgggggaggagcacc

SEQ ID NO: 606680 - DNA, 21 bp, Homo sapiens
ggtcgggggaggagcaccccc

SEQ ID NO: 606681 - DNA, 13 bp, Homo sapiens
ggtctccacccct

SEQ ID NO: 606682 - DNA, 15 bp, Homo sapiens
ggtctccacccctca

SEQ ID NO: 606683 - DNA, 12 bp, Homo sapiens
ggtctccctggg

SEQ ID NO: 606684 - DNA, 13 bp, Homo sapiens
ggtctccctgggc

SEQ ID NO: 606685 - DNA, 14 bp, Homo sapiens
ggtctcgcagcctg

SEQ ID NO: 606686 - DNA, 17 bp, Homo sapiens
ggtctcgcagcctgaag

SEQ ID NO: 606687 - DNA, 12 bp, Homo sapiens
ggtctctgagca

SEQ ID NO: 606688 - DNA, 19 bp, Homo sapiens
ggtctctgagcagtgggga

SEQ ID NO: 606689 - DNA, 12 bp, Homo sapiens
ggtctgcacaca

SEQ ID NO: 606690 - DNA, 19 bp, Homo sapiens
ggtctgctgcctcaggaat

SEQ ID NO: 606691 - DNA, 23 bp, Homo sapiens
ggtctggcgccaggggcaggcag

SEQ ID NO: 606692 - DNA, 21 bp, Homo sapiens
ggtctgtgttctcaacacaca

SEQ ID NO: 606693 - DNA, 22 bp, Homo sapiens
ggtctgtgttctcaacacacag

SEQ ID NO: 606694 - DNA, 23 bp, Homo sapiens
ggtctgtgttctcaacacacagt

SEQ ID NO: 606695 - DNA, 13 bp, Homo sapiens
ggtcttggagagg

SEQ ID NO: 606696 - DNA, 20 bp, Homo sapiens
ggtgaactgaagcagagtca

SEQ ID NO: 606697 - DNA, 20 bp, Homo sapiens
ggtgaggcgtgggatccaga

SEQ ID NO: 606698 - DNA, 12 bp, Homo sapiens
ggtgcaatgacc

SEQ ID NO: 606699 - DNA, 20 bp, Homo sapiens
ggtgcaggcgcgcaccgccc

SEQ ID NO: 606700 - DNA, 21 bp, Homo sapiens
ggtgcaggcgcgcaccgccca

SEQ ID NO: 606701 - DNA, 21 bp, Homo sapiens
ggtgcccagactcaaggcctc

SEQ ID NO: 606702 - DNA, 22 bp, Homo sapiens
ggtgccccacaaggcccagccc

SEQ ID NO: 606703 - DNA, 13 bp, Homo sapiens
ggtgcccctggga

SEQ ID NO: 606704 - DNA, 16 bp, Homo sapiens
ggtgcctggctgggct

SEQ ID NO: 606705 - DNA, 16 bp, Homo sapiens
ggtgcggaccggagcg

SEQ ID NO: 606706 - DNA, 12 bp, Homo sapiens
ggtgcgggccag

SEQ ID NO: 606707 - DNA, 13 bp, Homo sapiens
ggtgcgggccagg

SEQ ID NO: 606708 - DNA, 16 bp, Homo sapiens
ggtgcgtgaccggccc

SEQ ID NO: 606709 - DNA, 22 bp, Homo sapiens
ggtggaattattagcaccagct

SEQ ID NO: 606710 - DNA, 22 bp, Homo sapiens
ggtggcatttgcaggtgaccag

SEQ ID NO: 606711 - DNA, 16 bp, Homo sapiens
ggtggcatttgctgaa

SEQ ID NO: 606712 - DNA, 22 bp, Homo sapiens
ggtgggcgcctgtcgggcccgc

SEQ ID NO: 606713 - DNA, 14 bp, Homo sapiens
ggtgggctccagag

SEQ ID NO: 606714 - DNA, 17 bp, Homo sapiens
ggtggtcttggagagga

SEQ ID NO: 606715 - DNA, 18 bp, Homo sapiens
ggtggtcttggagaggag

SEQ ID NO: 606716 - DNA, 22 bp, Homo sapiens
ggtggtcttggagaggaggtgt

SEQ ID NO: 606717 - DNA, 14 bp, Homo sapiens
ggtggttggaggcc

SEQ ID NO: 606718 - DNA, 15 bp, Homo sapiens
ggtggttggaggcct

SEQ ID NO: 606719 - DNA, 15 bp, Homo sapiens
ggtgtcctctgtccg

SEQ ID NO: 606720 - DNA, 23 bp, Homo sapiens
ggtgtcctctgtccgtctgtcct

SEQ ID NO: 606721 - DNA, 21 bp, Homo sapiens
ggtgtcttgagaccagcctgc

SEQ ID NO: 606722 - DNA, 19 bp, Homo sapiens
ggtgtgaggacataaatct

SEQ ID NO: 606723 - DNA, 21 bp, Homo sapiens
ggtgtggagtggaggggtcag

SEQ ID NO: 606724 - DNA, 15 bp, Homo sapiens
ggtgtggcctggctt

SEQ ID NO: 606725 - DNA, 17 bp, Homo sapiens
ggtgtgggtgccctgtt

SEQ ID NO: 606726 - DNA, 22 bp, Homo sapiens
ggtgtttggaggctgctgcccc

SEQ ID NO: 606727 - DNA, 21 bp, Homo sapiens
ggttaacagtaaatatacact

SEQ ID NO: 606728 - DNA, 15 bp, Homo sapiens
ggttagaaaggcagc

SEQ ID NO: 606729 - DNA, 13 bp, Homo sapiens
ggttccagacaga

SEQ ID NO: 606730 - DNA, 19 bp, Homo sapiens
ggttccagacagagtggat

SEQ ID NO: 606731 - DNA, 14 bp, Homo sapiens
ggttccagacaggg

SEQ ID NO: 606732 - DNA, 23 bp, Homo sapiens
ggttccagacagggtggggctta

SEQ ID NO: 606733 - DNA, 14 bp, Homo sapiens
ggttccctttcccc

SEQ ID NO: 606734 - DNA, 12 bp, Homo sapiens
ggttcctccagc

SEQ ID NO: 606735 - DNA, 16 bp, Homo sapiens
ggttctatatttactg

SEQ ID NO: 606736 - DNA, 17 bp, Homo sapiens
gtctgaaaaagtgtttt

SEQ ID NO: 606737 - DNA, 20 bp, Homo sapiens
gtctgaacgaccgtcttttg

SEQ ID NO: 606738 - DNA, 10 bp, Homo sapiens
gtctgagccc

SEQ ID NO: 606739 - DNA, 15 bp, Homo sapiens
gtctgagccctgccc

SEQ ID NO: 606740 - DNA, 20 bp, Homo sapiens
gtctgcacacataacacaca

SEQ ID NO: 606741 - DNA, 21 bp, Homo sapiens
gtctgcacacataacacacat

SEQ ID NO: 606742 - DNA, 10 bp, Homo sapiens
gtctgcccct

SEQ ID NO: 606743 - DNA, 19 bp, Homo sapiens
gtctgccccttgaccccac

SEQ ID NO: 606744 - DNA, 13 bp, Homo sapiens
gtctggagcctgc

SEQ ID NO: 606745 - DNA, 16 bp, Homo sapiens
gtctggagcctgcagg

SEQ ID NO: 606746 - DNA, 14 bp, Homo sapiens
gtctggcgccaggg

SEQ ID NO: 606747 - DNA, 19 bp, Homo sapiens
gtctggctgtggcccctcc

SEQ ID NO: 606748 - DNA, 22 bp, Homo sapiens
gtctggctgtggcccctccttc

SEQ ID NO: 606749 - DNA, 11 bp, Homo sapiens
gtctgtacttc

SEQ ID NO: 606750 - DNA, 18 bp, Homo sapiens
gtctgtccctaaacatag

SEQ ID NO: 606751 - DNA, 22 bp, Homo sapiens
gtctgtctctcttttgctctct

SEQ ID NO: 606752 - DNA, 12 bp, Homo sapiens
gtctgtgggact

SEQ ID NO: 606753 - DNA, 18 bp, Homo sapiens
gtctgtgggactggccca

SEQ ID NO: 606754 - DNA, 15 bp, Homo sapiens
gtctgtgttctcaac

SEQ ID NO: 606755 - DNA, 21 bp, Homo sapiens
gtcttcaaccctgccctgcac

SEQ ID NO: 606756 - DNA, 23 bp, Homo sapiens
gtcttcaaccctgccctgcacct

SEQ ID NO: 606757 - DNA, 18 bp, Homo sapiens
gtcttgagaccagcctgc

SEQ ID NO: 606758 - DNA, 19 bp, Homo sapiens
gtcttgagtgggccccctc

SEQ ID NO: 606759 - DNA, 22 bp, Homo sapiens
gtcttgagtgggccccctctct

SEQ ID NO: 606760 - DNA, 17 bp, Homo sapiens
gtcttgagtttcatttt

SEQ ID NO: 606761 - DNA, 20 bp, Homo sapiens
gtcttgagtttcatttttca

SEQ ID NO: 606762 - DNA, 15 bp, Homo sapiens
gtcttggagaggagg

SEQ ID NO: 606763 - DNA, 14 bp, Homo sapiens
gtcttgttgttcat

SEQ ID NO: 606764 - DNA, 14 bp, Homo sapiens
gtctttaaaatgat

SEQ ID NO: 606765 - DNA, 17 bp, Homo sapiens
gtctttatgatttcatg

SEQ ID NO: 606766 - DNA, 16 bp, Homo sapiens
gtctttcatggaatgc

SEQ ID NO: 606767 - DNA, 18 bp, Homo sapiens
gtctttgctgtttatata

SEQ ID NO: 606768 - DNA, 20 bp, Homo sapiens
gtcttttaaaaactcctgtt

SEQ ID NO: 606769 - DNA, 14 bp, Homo sapiens
gtcttttgttctct

SEQ ID NO: 606770 - DNA, 21 bp, Homo sapiens
gtcttttttttcttcacctca

SEQ ID NO: 606771 - DNA, 13 bp, Homo sapiens
gtgaaaatgcttt

SEQ ID NO: 606772 - DNA, 12 bp, Homo sapiens
gtgaaacagtgt

SEQ ID NO: 606773 - DNA, 16 bp, Homo sapiens
gtgaaagtggcaagct

SEQ ID NO: 606774 - DNA, 23 bp, Homo sapiens
gtgaaccaagctataaaagccca

SEQ ID NO: 606775 - DNA, 15 bp, Homo sapiens
gtgaagcatccaggc

SEQ ID NO: 606776 - DNA, 16 bp, Homo sapiens
gtgaaggtcttgcctg

SEQ ID NO: 606777 - DNA, 14 bp, Homo sapiens
gtgaagtgattgac

SEQ ID NO: 606778 - DNA, 15 bp, Homo sapiens
gtgaagtgattgaca

SEQ ID NO: 606779 - DNA, 19 bp, Homo sapiens
gtgaatgtgtgaaggtctt

SEQ ID NO: 606780 - DNA, 21 bp, Homo sapiens
gtgaatgttgtcctgtgtcat

SEQ ID NO: 606781 - DNA, 15 bp, Homo sapiens
gtgacctgctcctgc

SEQ ID NO: 606782 - DNA, 23 bp, Homo sapiens
gtgacttatttgctcataagtaa

SEQ ID NO: 606783 - DNA, 14 bp, Homo sapiens
gtgagaaatttttt

SEQ ID NO: 606784 - DNA, 16 bp, Homo sapiens
gtgagataaatatcat

SEQ ID NO: 606785 - DNA, 20 bp, Homo sapiens
gtgagatttagggttctata

SEQ ID NO: 606786 - DNA, 23 bp, Homo sapiens
gtgagcactatctttcaggaaat

SEQ ID NO: 606787 - DNA, 16 bp, Homo sapiens
gtgaggcccccggagg

SEQ ID NO: 606788 - DNA, 20 bp, Homo sapiens
gtgaggcccccggaggcgcc

SEQ ID NO: 606789 - DNA, 21 bp, Homo sapiens
gtgaggcccccggaggcgccc

SEQ ID NO: 606790 - DNA, 13 bp, Homo sapiens
gtgaggcccctgt

SEQ ID NO: 606791 - DNA, 23 bp, Homo sapiens
gtgaggctccctccctccctgct

SEQ ID NO: 606792 - DNA, 16 bp, Homo sapiens
gtgaggttgtgctgcc

SEQ ID NO: 606793 - DNA, 17 bp, Homo sapiens
gtgaggttgtgctgcct

SEQ ID NO: 606794 - DNA, 13 bp, Homo sapiens
gtgatactccaag

SEQ ID NO: 606795 - DNA, 14 bp, Homo sapiens
gtgatctgttgtaa

SEQ ID NO: 606796 - DNA, 23 bp, Homo sapiens
gtgatgaatttaccatcaaacaa

SEQ ID NO: 606797 - DNA, 16 bp, Homo sapiens
gtgatgagaggaaatc

SEQ ID NO: 606798 - DNA, 19 bp, Homo sapiens
gtgattacctgaaagccct

SEQ ID NO: 606799 - DNA, 20 bp, Homo sapiens
gtgattgacattttgtagct

SEQ ID NO: 606800 - DNA, 13 bp, Homo sapiens
gtgcaacagactg

SEQ ID NO: 606801 - DNA, 15 bp, Homo sapiens
gtgcacggcagcttg

SEQ ID NO: 606802 - DNA, 14 bp, Homo sapiens
gtgcagaaaacatt

SEQ ID NO: 606803 - DNA, 18 bp, Homo sapiens
gtgcagcaaccagagcac

SEQ ID NO: 606804 - DNA, 20 bp, Homo sapiens
gtgcaggcgcgcaccgccca

SEQ ID NO: 606805 - DNA, 17 bp, Homo sapiens
gtgcagggacagcctgc

SEQ ID NO: 606806 - DNA, 21 bp, Homo sapiens
gtgcagggacagcctgcacag

SEQ ID NO: 606807 - DNA, 15 bp, Homo sapiens
gtgcagtagtgtcac

SEQ ID NO: 606808 - DNA, 17 bp, Homo sapiens
gtgcatctggcctgggg

SEQ ID NO: 606809 - DNA, 20 bp, Homo sapiens
gtgcatgccttcataaatta

SEQ ID NO: 606810 - DNA, 19 bp, Homo sapiens
gtgcatgttaaaataatta

SEQ ID NO: 606811 - DNA, 18 bp, Homo sapiens
gtgccagtacttaccagt

SEQ ID NO: 606812 - DNA, 20 bp, Homo sapiens
gtgcccacccgtgttctcct

SEQ ID NO: 606813 - DNA, 22 bp, Homo sapiens
gtgcccacccgtgttctcctcc

SEQ ID NO: 606814 - DNA, 17 bp, Homo sapiens
gtgcccacgtgtgcaga

SEQ ID NO: 606815 - DNA, 16 bp, Homo sapiens
gtgcccatttcacaca

SEQ ID NO: 606816 - DNA, 24 bp, Homo sapiens
gtgccccacaaggcccagccctgg

SEQ ID NO: 606817 - DNA, 22 bp, Homo sapiens
gtgccccacctccccagagccc

SEQ ID NO: 606818 - DNA, 20 bp, Homo sapiens
gtgccccagtggtgcgggcc

SEQ ID NO: 606819 - DNA, 23 bp, Homo sapiens
gtgccctctcactgacttctccc

SEQ ID NO: 606820 - DNA, 22 bp, Homo sapiens
gtgccctgttgacctaccctgg

SEQ ID NO: 606821 - DNA, 13 bp, Homo sapiens
gtgccgcctgtgc

SEQ ID NO: 606822 - DNA, 23 bp, Homo sapiens
gtgccgcttaaacatttccctgc

SEQ ID NO: 606823 - DNA, 21 bp, Homo sapiens
gtgccgtggagcttggagccc

SEQ ID NO: 606824 - DNA, 11 bp, Homo sapiens
gtgcctgctgt

SEQ ID NO: 606825 - DNA, 14 bp, Homo sapiens
gtgccttggagcag

SEQ ID NO: 606826 - DNA, 11 bp, Homo sapiens
gtgccttgggc

SEQ ID NO: 606827 - DNA, 19 bp, Homo sapiens
gtgcgctagagcattctgg

SEQ ID NO: 606828 - DNA, 11 bp, Homo sapiens
gtgcggcccgt

SEQ ID NO: 606829 - DNA, 17 bp, Homo sapiens
gtgcgggccaggtctgg

SEQ ID NO: 606830 - DNA, 21 bp, Homo sapiens
gtgcgtgtggccctgtgggag

SEQ ID NO: 606831 - DNA, 14 bp, Homo sapiens
gtgctaagttgtct

SEQ ID NO: 606832 - DNA, 22 bp, Homo sapiens
gtgctcagtattgacgacctac

SEQ ID NO: 606833 - DNA, 19 bp, Homo sapiens
gttcctccagcaatgcctg

SEQ ID NO: 606834 - DNA, 13 bp, Homo sapiens
gttcgttctgttt

SEQ ID NO: 606835 - DNA, 14 bp, Homo sapiens
gttcgttctgttta

SEQ ID NO: 606836 - DNA, 21 bp, Homo sapiens
gttctagaaggggcgaggctt

SEQ ID NO: 606837 - DNA, 18 bp, Homo sapiens
gttctcctccaaatgctg

SEQ ID NO: 606838 - DNA, 16 bp, Homo sapiens
gttctctagttttcca

SEQ ID NO: 606839 - DNA, 19 bp, Homo sapiens
gttctctcttggtctcttt

SEQ ID NO: 606840 - DNA, 21 bp, Homo sapiens
gttctctcttggtctctttct

SEQ ID NO: 606841 - DNA, 18 bp, Homo sapiens
gttctgccctgcctgagg

SEQ ID NO: 606842 - DNA, 21 bp, Homo sapiens
gttctgctttctgatacatct

SEQ ID NO: 606843 - DNA, 16 bp, Homo sapiens
gttctgtttacatcag

SEQ ID NO: 606844 - DNA, 15 bp, Homo sapiens
gttcttgagcagctg

SEQ ID NO: 606845 - DNA, 17 bp, Homo sapiens
gttcttgcagcagagag

SEQ ID NO: 606846 - DNA, 16 bp, Homo sapiens
gttcttgtaaaactgt

SEQ ID NO: 606847 - DNA, 18 bp, Homo sapiens
gttcttgtaaaactgtga

SEQ ID NO: 606848 - DNA, 21 bp, Homo sapiens
gttcttgtaaaactgtgacat

SEQ ID NO: 606849 - DNA, 14 bp, Homo sapiens
gttctttcttttct

SEQ ID NO: 606850 - DNA, 13 bp, Homo sapiens
gttctttggaagc

SEQ ID NO: 606851 - DNA, 21 bp, Homo sapiens
gttcttttttaagactcaatc

SEQ ID NO: 606852 - DNA, 16 bp, Homo sapiens
gttgaagtgcatgtta

SEQ ID NO: 606853 - DNA, 20 bp, Homo sapiens
gttgaatgataatagctcac

SEQ ID NO: 606854 - DNA, 21 bp, Homo sapiens
gttgacacattgcacacacag

SEQ ID NO: 606855 - DNA, 19 bp, Homo sapiens
gttgacctaccctggaccg

SEQ ID NO: 606856 - DNA, 18 bp, Homo sapiens
gttgagccagcagacatt

SEQ ID NO: 606857 - DNA, 22 bp, Homo sapiens
gttgagccagcagacattgtca

SEQ ID NO: 606858 - DNA, 15 bp, Homo sapiens
gttgatagtttacaa

SEQ ID NO: 606859 - DNA, 15 bp, Homo sapiens
gttgattctttcaat

SEQ ID NO: 606860 - DNA, 23 bp, Homo sapiens
gttgcatgaatccatcgatttgt

SEQ ID NO: 606861 - DNA, 16 bp, Homo sapiens
gttgccattttgtctg

SEQ ID NO: 606862 - DNA, 17 bp, Homo sapiens
gttgcttaatctagagc

SEQ ID NO: 606863 - DNA, 13 bp, Homo sapiens
gttggagagcagc

SEQ ID NO: 606864 - DNA, 14 bp, Homo sapiens
gttggagagcagca

SEQ ID NO: 606865 - DNA, 15 bp, Homo sapiens
gttggagtgcagtgg

SEQ ID NO: 606866 - DNA, 20 bp, Homo sapiens
gttggccggctggccggtcc

SEQ ID NO: 606867 - DNA, 18 bp, Homo sapiens
gttggttacctattgctg

SEQ ID NO: 606868 - DNA, 17 bp, Homo sapiens
gttgtaaagatattgta

SEQ ID NO: 606869 - DNA, 23 bp, Homo sapiens
gttgtaaagatattgtatctcct

SEQ ID NO: 606870 - DNA, 22 bp, Homo sapiens
gttgtaagtactctaatataca

SEQ ID NO: 606871 - DNA, 15 bp, Homo sapiens
gttgtacatagtggt

SEQ ID NO: 606872 - DNA, 17 bp, Homo sapiens
gttgtacatagtggtca

SEQ ID NO: 606873 - DNA, 18 bp, Homo sapiens
gttgtcctgtgtcatctg

SEQ ID NO: 606874 - DNA, 21 bp, Homo sapiens
gttgtcctgtgtcatctgtca

SEQ ID NO: 606875 - DNA, 13 bp, Homo sapiens
gttgtgatctgtt

SEQ ID NO: 606876 - DNA, 17 bp, Homo sapiens
gttgtgatctgttgtaa

SEQ ID NO: 606877 - DNA, 17 bp, Homo sapiens
gttgtgtctggagcctg

SEQ ID NO: 606878 - DNA, 13 bp, Homo sapiens
gttgtgttcttct

SEQ ID NO: 606879 - DNA, 18 bp, Homo sapiens
gtttaaaaatcagaaaga

SEQ ID NO: 606880 - DNA, 21 bp, Homo sapiens
gtttaaatctttgttaaaata

SEQ ID NO: 606881 - DNA, 19 bp, Homo sapiens
gtttaataatatgtacaaa

SEQ ID NO: 606882 - DNA, 13 bp, Homo sapiens
gtttacaaacaag

SEQ ID NO: 606883 - DNA, 15 bp, Homo sapiens
gtttaccctccctgt

SEQ ID NO: 606884 - DNA, 22 bp, Homo sapiens
gtttaccgcccacccagcagcg

SEQ ID NO: 606885 - DNA, 20 bp, Homo sapiens
gtttactgacatggtgctgt

SEQ ID NO: 606886 - DNA, 18 bp, Homo sapiens
gtttagaagagcctgact

SEQ ID NO: 606887 - DNA, 18 bp, Homo sapiens
gtttagtagctgataaag

SEQ ID NO: 606888 - DNA, 22 bp, Homo sapiens
gtttataggaaataaatctaaa

SEQ ID NO: 606889 - DNA, 18 bp, Homo sapiens
gtttcatactctagattt

SEQ ID NO: 606890 - DNA, 11 bp, Homo sapiens
gtttcattttc

SEQ ID NO: 606891 - DNA, 21 bp, Homo sapiens
gtttcatttttcattttctct

SEQ ID NO: 606892 - DNA, 22 bp, Homo sapiens
gtttccagctaagcctgatgat

SEQ ID NO: 606893 - DNA, 11 bp, Homo sapiens
gtttccatttg

SEQ ID NO: 606894 - DNA, 17 bp, Homo sapiens
gtttctatatgtaactt

SEQ ID NO: 606895 - DNA, 17 bp, Homo sapiens
gtttgctgcttttgatg

SEQ ID NO: 606896 - DNA, 13 bp, Homo sapiens
gtttgcttctaaa

SEQ ID NO: 606897 - DNA, 19 bp, Homo sapiens
gtttggaagcttgtctcaa

SEQ ID NO: 606898 - DNA, 15 bp, Homo sapiens
gtttggaggctgctg

SEQ ID NO: 606899 - DNA, 16 bp, Homo sapiens
gtttggaggctgctgc

SEQ ID NO: 606900 - DNA, 18 bp, Homo sapiens
gtttggaggctgctgccc

SEQ ID NO: 606901 - DNA, 11 bp, Homo sapiens
gtttggccctg

SEQ ID NO: 606902 - DNA, 12 bp, Homo sapiens
gtttggccctgg

SEQ ID NO: 606903 - DNA, 14 bp, Homo sapiens
gtttggccctggag

SEQ ID NO: 606904 - DNA, 17 bp, Homo sapiens
gtttggctgaaattatg

SEQ ID NO: 606905 - DNA, 14 bp, Homo sapiens
gtttgggcagtgga

SEQ ID NO: 606906 - DNA, 20 bp, Homo sapiens
gtttgggggacgcccagccc

SEQ ID NO: 606907 - DNA, 17 bp, Homo sapiens
gtttgtcctttatgtat

SEQ ID NO: 606908 - DNA, 20 bp, Homo sapiens
gtttgtttctgttgttcact

SEQ ID NO: 606909 - DNA, 13 bp, Homo sapiens
gtttgtttgctgc

SEQ ID NO: 606910 - DNA, 19 bp, Homo sapiens
gttttaaaaaaataaaaca

SEQ ID NO: 606911 - DNA, 21 bp, Homo sapiens
gttttaaaaaaataaaacatt

SEQ ID NO: 606912 - DNA, 22 bp, Homo sapiens
gttttaaaaaaataaaacattt

SEQ ID NO: 606913 - DNA, 14 bp, Homo sapiens
gttttacaaagaaa

SEQ ID NO: 606914 - DNA, 13 bp, Homo sapiens
gttttagtttaaa

SEQ ID NO: 606915 - DNA, 13 bp, Homo sapiens
gttttatatgatt

SEQ ID NO: 606916 - DNA, 20 bp, Homo sapiens
gttttccccaattatcctcc

SEQ ID NO: 606917 - DNA, 16 bp, Homo sapiens
gttttgccaacattgc

SEQ ID NO: 606918 - DNA, 22 bp, Homo sapiens
gtttttacatatagctttgcaa

SEQ ID NO: 606919 - DNA, 19 bp, Homo sapiens
gtttttatacctgtacaca

SEQ ID NO: 606920 - DNA, 18 bp, Homo sapiens
gtttttgttcaccttctg

SEQ ID NO: 606921 - DNA, 23 bp, Homo sapiens
gtttttgttcaccttctgtgcat

SEQ ID NO: 606922 - DNA, 17 bp, Homo sapiens
gttttttatacttcaaa

SEQ ID NO: 606923 - DNA, 14 bp, Homo sapiens
taaaaaaaatagtt

SEQ ID NO: 606924 - DNA, 21 bp, Homo sapiens
taaaaaaaatattctgtcatt

SEQ ID NO: 606925 - DNA, 15 bp, Homo sapiens
taaaaaaataatata

SEQ ID NO: 606926 - DNA, 23 bp, Homo sapiens
taaaaagatccagggatggagat

SEQ ID NO: 606927 - DNA, 14 bp, Homo sapiens
taaaaatcagaaag

SEQ ID NO: 606928 - DNA, 17 bp, Homo sapiens
taaaacaagagaccact

SEQ ID NO: 606929 - DNA, 23 bp, Homo sapiens
taaaacaagagaccacttcctta

SEQ ID NO: 606930 - DNA, 16 bp, Homo sapiens
taaaacacccttgaaa

SEQ ID NO: 606931 - DNA, 18 bp, Homo sapiens
taaaacacccttgaaaat

SEQ ID NO: 606932 - DNA, 21 bp, Homo sapiens
taaaacagtggttgttttttc

SEQ ID NO: 606933 - DNA, 20 bp, Homo sapiens
taaaacattatagattttca

SEQ ID NO: 606934 - DNA, 14 bp, Homo sapiens
taaaacattttaaa

SEQ ID NO: 606935 - DNA, 18 bp, Homo sapiens
taaaacattttaaatgga

SEQ ID NO: 606936 - DNA, 10 bp, Homo sapiens
taaaactaaa

SEQ ID NO: 606937 - DNA, 10 bp, Homo sapiens
taaaactgtg

SEQ ID NO: 606938 - DNA, 12 bp, Homo sapiens
taaaactgtgac

SEQ ID NO: 606939 - DNA, 14 bp, Homo sapiens
taaaactgtgacat

SEQ ID NO: 606940 - DNA, 18 bp, Homo sapiens
taaaactgtgacattcca

SEQ ID NO: 606941 - DNA, 18 bp, Homo sapiens
taaaacttgtattggaag

SEQ ID NO: 606942 - DNA, 21 bp, Homo sapiens
taaaaggaggacagggaggga

SEQ ID NO: 606943 - DNA, 23 bp, Homo sapiens
taaaagggtggtagttttcccta

SEQ ID NO: 606944 - DNA, 16 bp, Homo sapiens
taaaataattatatga

SEQ ID NO: 606945 - DNA, 15 bp, Homo sapiens
taaaatacacgtgta

SEQ ID NO: 606946 - DNA, 13 bp, Homo sapiens
taaaatacttctt

SEQ ID NO: 606947 - DNA, 14 bp, Homo sapiens
taaaatattttctt

SEQ ID NO: 606948 - DNA, 18 bp, Homo sapiens
taaaatctgtattgctaa

SEQ ID NO: 606949 - DNA, 13 bp, Homo sapiens
taaaatcttgaaa

SEQ ID NO: 606950 - DNA, 23 bp, Homo sapiens
taaaatgagtcacttacttcata

SEQ ID NO: 606951 - DNA, 14 bp, Homo sapiens
taaaatgattcact

SEQ ID NO: 606952 - DNA, 20 bp, Homo sapiens
taactgttaacccagtgttc

SEQ ID NO: 606953 - DNA, 14 bp, Homo sapiens
taacttaatcaatt

SEQ ID NO: 606954 - DNA, 14 bp, Homo sapiens
taacttatctccag

SEQ ID NO: 606955 - DNA, 15 bp, Homo sapiens
taacttcagatgttt

SEQ ID NO: 606956 - DNA, 15 bp, Homo sapiens
taacttgctgtgaaa

SEQ ID NO: 606957 - DNA, 16 bp, Homo sapiens
taacttgctgtgaaat

SEQ ID NO: 606958 - DNA, 15 bp, Homo sapiens
taagaataacactca

SEQ ID NO: 606959 - DNA, 12 bp, Homo sapiens
taagagacaaag

SEQ ID NO: 606960 - DNA, 15 bp, Homo sapiens
taagagattttatgt

SEQ ID NO: 606961 - DNA, 23 bp, Homo sapiens
taagagattttatgtttaaaatg

SEQ ID NO: 606962 - DNA, 20 bp, Homo sapiens
taagataattaaatgaaata

SEQ ID NO: 606963 - DNA, 22 bp, Homo sapiens
taagataattaaatgaaatact

SEQ ID NO: 606964 - DNA, 18 bp, Homo sapiens
taagataggttctgcttt

SEQ ID NO: 606965 - DNA, 22 bp, Homo sapiens
taagataggttctgctttctga

SEQ ID NO: 606966 - DNA, 13 bp, Homo sapiens
taagatctgactg

SEQ ID NO: 606967 - DNA, 18 bp, Homo sapiens
taagatgggcatagggtt

SEQ ID NO: 606968 - DNA, 11 bp, Homo sapiens
taagcacaaaa

SEQ ID NO: 606969 - DNA, 20 bp, Homo sapiens
taagccaatgaagcaaacac

SEQ ID NO: 606970 - DNA, 18 bp, Homo sapiens
taagccaatttttctgca

SEQ ID NO: 606971 - DNA, 17 bp, Homo sapiens
taagccatagccccagg

SEQ ID NO: 606972 - DNA, 19 bp, Homo sapiens
taagctggtatcagtggtt

SEQ ID NO: 606973 - DNA, 17 bp, Homo sapiens
taaggaaaagagaaaca

SEQ ID NO: 606974 - DNA, 13 bp, Homo sapiens
taaggctgactct

SEQ ID NO: 606975 - DNA, 19 bp, Homo sapiens
taagggactccagaagcag

SEQ ID NO: 606976 - DNA, 20 bp, Homo sapiens
taaggtacggtgagactctg

SEQ ID NO: 606977 - DNA, 13 bp, Homo sapiens
taaggttcttgct

SEQ ID NO: 606978 - DNA, 20 bp, Homo sapiens
taagtaaatgtcttcatgtt

SEQ ID NO: 606979 - DNA, 20 bp, Homo sapiens
taagtaatttcatgcacaca

SEQ ID NO: 606980 - DNA, 17 bp, Homo sapiens
taagtagtgtcattcat

SEQ ID NO: 606981 - DNA, 23 bp, Homo sapiens
taagtctcaattctgaaggggaa

SEQ ID NO: 606982 - DNA, 16 bp, Homo sapiens
taagtgctatgcatat

SEQ ID NO: 606983 - DNA, 18 bp, Homo sapiens
taagtgctatgcatattt

SEQ ID NO: 606984 - DNA, 17 bp, Homo sapiens
taagtgcttgaggccaa

SEQ ID NO: 606985 - DNA, 15 bp, Homo sapiens
taagtggactgtatt

SEQ ID NO: 606986 - DNA, 16 bp, Homo sapiens
taagtggactgtattt

SEQ ID NO: 606987 - DNA, 17 bp, Homo sapiens
taagtggactgtatttc

SEQ ID NO: 606988 - DNA, 22 bp, Homo sapiens
taagtgttggccatcatttcat

SEQ ID NO: 606989 - DNA, 15 bp, Homo sapiens
taagttataccagca

SEQ ID NO: 606990 - DNA, 13 bp, Homo sapiens
taagttctgtgca

SEQ ID NO: 606991 - DNA, 15 bp, Homo sapiens
taagttctgtgcagt

SEQ ID NO: 606992 - DNA, 14 bp, Homo sapiens
taagttgtcttaca

SEQ ID NO: 606993 - DNA, 14 bp, Homo sapiens
taataaagattcca

SEQ ID NO: 606994 - DNA, 20 bp, Homo sapiens
taataatatgtacaaataat

SEQ ID NO: 606995 - DNA, 18 bp, Homo sapiens
taatacaccaaatagctt

SEQ ID NO: 606996 - DNA, 19 bp, Homo sapiens
taatacaccaaatagcttt

SEQ ID NO: 606997 - DNA, 19 bp, Homo sapiens
taatagatgtgaaaatgct

SEQ ID NO: 606998 - DNA, 14 bp, Homo sapiens
taatagcctcacct

SEQ ID NO: 606999 - DNA, 15 bp, Homo sapiens
taatagctcacagca

SEQ ID NO: 607000 - DNA, 14 bp, Homo sapiens
taatagtttctaaa

SEQ ID NO: 607001 - DNA, 19 bp, Homo sapiens
taatagtttctaaaccatg

SEQ ID NO: 607002 - DNA, 12 bp, Homo sapiens
taatataaatga

SEQ ID NO: 607003 - DNA, 16 bp, Homo sapiens
taatatacagtgtgta

SEQ ID NO: 607004 - DNA, 16 bp, Homo sapiens
taatatactccttaaa

SEQ ID NO: 607005 - DNA, 21 bp, Homo sapiens
taatatactccttaaaaatgt

SEQ ID NO: 607006 - DNA, 23 bp, Homo sapiens
taatatactccttaaaaatgtat

SEQ ID NO: 607007 - DNA, 14 bp, Homo sapiens
taatatagggtttg

SEQ ID NO: 607008 - DNA, 23 bp, Homo sapiens
taatatagggtttgtttgctgct

SEQ ID NO: 607009 - DNA, 12 bp, Homo sapiens
taatatgtacaa

SEQ ID NO: 607010 - DNA, 14 bp, Homo sapiens
taatatgtacaaat

SEQ ID NO: 607011 - DNA, 15 bp, Homo sapiens
taatatgtacaaata

SEQ ID NO: 607012 - DNA, 17 bp, Homo sapiens
taatatgtacaaataat

SEQ ID NO: 607013 - DNA, 12 bp, Homo sapiens
taatattaaatt

SEQ ID NO: 607014 - DNA, 15 bp, Homo sapiens
taatattaaattcct

SEQ ID NO: 607015 - DNA, 20 bp, Homo sapiens
taatatttatagagttcata

SEQ ID NO: 607016 - DNA, 18 bp, Homo sapiens
taatcacactctcttctt

SEQ ID NO: 607017 - DNA, 21 bp, Homo sapiens
taatccacctggtggccctgc

SEQ ID NO: 607018 - DNA, 20 bp, Homo sapiens
taatccatgtgctgctgtgg

SEQ ID NO: 607019 - DNA, 22 bp, Homo sapiens
taatccatgtgctgctgtggca

SEQ ID NO: 607020 - DNA, 16 bp, Homo sapiens
taatctagagctatgc

SEQ ID NO: 607021 - DNA, 22 bp, Homo sapiens
taatctagagctatgcacacca

SEQ ID NO: 607022 - DNA, 15 bp, Homo sapiens
taatgattcaatgtg

SEQ ID NO: 607023 - DNA, 16 bp, Homo sapiens
taatgattcttgtgtc

SEQ ID NO: 607024 - DNA, 14 bp, Homo sapiens
taatggccaagtgt

SEQ ID NO: 607025 - DNA, 19 bp, Homo sapiens
taatgtattttattgtaac

SEQ ID NO: 607026 - DNA, 15 bp, Homo sapiens
taatgtctcaaaata

SEQ ID NO: 607027 - DNA, 16 bp, Homo sapiens
taattaaatgaaatac

SEQ ID NO: 607028 - DNA, 18 bp, Homo sapiens
taattaaatgaaatactt

SEQ ID NO: 607029 - DNA, 13 bp, Homo sapiens
taattaatttcag

SEQ ID NO: 607030 - DNA, 15 bp, Homo sapiens
taattcctgtatgtt

SEQ ID NO: 607031 - DNA, 18 bp, Homo sapiens
taattcctgtatgttatc

SEQ ID NO: 607032 - DNA, 16 bp, Homo sapiens
taattcgagcaaacaa

SEQ ID NO: 607033 - DNA, 16 bp, Homo sapiens
taattctatgattaaa

SEQ ID NO: 607034 - DNA, 23 bp, Homo sapiens
taattcttaccgaaatgaaaatg

SEQ ID NO: 607035 - DNA, 11 bp, Homo sapiens
taattgaaagg

SEQ ID NO: 607036 - DNA, 16 bp, Homo sapiens
taattgaaagggacaa

SEQ ID NO: 607037 - DNA, 22 bp, Homo sapiens
taattgaaagggacaagtatca

SEQ ID NO: 607038 - DNA, 16 bp, Homo sapiens
taattgtaaaggtgat

SEQ ID NO: 607039 - DNA, 18 bp, Homo sapiens
taatttagcagtccattt

SEQ ID NO: 607040 - DNA, 16 bp, Homo sapiens
taatttattaaattta

SEQ ID NO: 607041 - DNA, 17 bp, Homo sapiens
taatttccttaaagcaa

SEQ ID NO: 607042 - DNA, 12 bp, Homo sapiens
taatttgatatc

SEQ ID NO: 607043 - DNA, 19 bp, Homo sapiens
taatttgatatcacagtct

SEQ ID NO: 607044 - DNA, 22 bp, Homo sapiens
taatttgatatcacagtctaat

SEQ ID NO: 607045 - DNA, 11 bp, Homo sapiens
taatttgcatc

SEQ ID NO: 607046 - DNA, 19 bp, Homo sapiens
taatttgccagacagagat

SEQ ID NO: 607047 - DNA, 13 bp, Homo sapiens
taattttcatttt

SEQ ID NO: 607048 - DNA, 21 bp, Homo sapiens
tacaaaatcttaaccttcaaa

SEQ ID NO: 607049 - DNA, 19 bp, Homo sapiens
tacaaaatgaattgccttt

SEQ ID NO: 607050 - DNA, 16 bp, Homo sapiens
tacaaacttttataaa

SEQ ID NO: 607051 - DNA, 20 bp, Homo sapiens
tacaaagaaacaaaatataa

SEQ ID NO: 607052 - DNA, 23 bp, Homo sapiens
tacaaagaaacaaaatataaatc

SEQ ID NO: 607053 - DNA, 19 bp, Homo sapiens
tacaaatttttactcaggc

SEQ ID NO: 607054 - DNA, 22 bp, Homo sapiens
tacaaatttttactcaggcttt

SEQ ID NO: 607055 - DNA, 17 bp, Homo sapiens
tacaacaagcaaactga

SEQ ID NO: 607056 - DNA, 18 bp, Homo sapiens
tacaacaagcaaactgaa

SEQ ID NO: 607057 - DNA, 19 bp, Homo sapiens
tacaacaagcaaactgaaa

SEQ ID NO: 607058 - DNA, 19 bp, Homo sapiens
tacaacacattgaaactgt

SEQ ID NO: 607059 - DNA, 21 bp, Homo sapiens
tacaacacattgaaactgtat

SEQ ID NO: 607060 - DNA, 22 bp, Homo sapiens
tacaacacattgaaactgtatt

SEQ ID NO: 607061 - DNA, 23 bp, Homo sapiens
tacaacacattgaaactgtattt

SEQ ID NO: 607062 - DNA, 20 bp, Homo sapiens
tacaacaccagcaacattat

SEQ ID NO: 607063 - DNA, 12 bp, Homo sapiens
tacaagctacat

SEQ ID NO: 607064 - DNA, 23 bp, Homo sapiens
tacaatacaacacattgaaactg

SEQ ID NO: 607065 - DNA, 22 bp, Homo sapiens
tacaatggctgggtttgggcag

SEQ ID NO: 607066 - DNA, 12 bp, Homo sapiens
tacacacacaga

SEQ ID NO: 607067 - DNA, 17 bp, Homo sapiens
tacacagaaatcctaac

SEQ ID NO: 607068 - DNA, 19 bp, Homo sapiens
tacacataattaaagtgtc

SEQ ID NO: 607069 - DNA, 13 bp, Homo sapiens
tacacatacatat

SEQ ID NO: 607070 - DNA, 21 bp, Homo sapiens
taaaattattaaaaattatag

SEQ ID NO: 607071 - DNA, 22 bp, Homo sapiens
taaaattattaaaaattataga

SEQ ID NO: 607072 - DNA, 16 bp, Homo sapiens
taaaattggttaatga

SEQ ID NO: 607073 - DNA, 21 bp, Homo sapiens
taaaattggttaatgaaaaat

SEQ ID NO: 607074 - DNA, 15 bp, Homo sapiens
taaacaaaaactttc

SEQ ID NO: 607075 - DNA, 17 bp, Homo sapiens
taaacaaaaactttcca

SEQ ID NO: 607076 - DNA, 22 bp, Homo sapiens
taaacaaaaactttccatgaca

SEQ ID NO: 607077 - DNA, 17 bp, Homo sapiens
taaacacagattatttg

SEQ ID NO: 607078 - DNA, 16 bp, Homo sapiens
taaacacttctcctta

SEQ ID NO: 607079 - DNA, 17 bp, Homo sapiens
taaacacttctccttaa

SEQ ID NO: 607080 - DNA, 19 bp, Homo sapiens
taaacacttctccttaacc

SEQ ID NO: 607081 - DNA, 19 bp, Homo sapiens
taaacatagtggtatttta

SEQ ID NO: 607082 - DNA, 22 bp, Homo sapiens
taaacatagtggtattttaaca

SEQ ID NO: 607083 - DNA, 14 bp, Homo sapiens
taaaccatgaaaag

SEQ ID NO: 607084 - DNA, 16 bp, Homo sapiens
taaacccacataaaca

SEQ ID NO: 607085 - DNA, 18 bp, Homo sapiens
taaacccacataaacact

SEQ ID NO: 607086 - DNA, 22 bp, Homo sapiens
taaacccacataaacacttctc

SEQ ID NO: 607087 - DNA, 20 bp, Homo sapiens
taaacctgtgctttcatgtt

SEQ ID NO: 607088 - DNA, 12 bp, Homo sapiens
taaactgggaaa

SEQ ID NO: 607089 - DNA, 17 bp, Homo sapiens
taaactgggaaatgaga

SEQ ID NO: 607090 - DNA, 17 bp, Homo sapiens
taaactgtgagataaat

SEQ ID NO: 607091 - DNA, 18 bp, Homo sapiens
taaactgtgagataaata

SEQ ID NO: 607092 - DNA, 15 bp, Homo sapiens
taaagaaagtcatag

SEQ ID NO: 607093 - DNA, 18 bp, Homo sapiens
taaagaagatgtttaact

SEQ ID NO: 607094 - DNA, 23 bp, Homo sapiens
taaagaagtccatgtgataattg

SEQ ID NO: 607095 - DNA, 18 bp, Homo sapiens
taaagaccatttagtcct

SEQ ID NO: 607096 - DNA, 15 bp, Homo sapiens
taaagagttctcctt

SEQ ID NO: 607097 - DNA, 18 bp, Homo sapiens
taaagagttctccttgta

SEQ ID NO: 607098 - DNA, 22 bp, Homo sapiens
taaagagttctccttgtacttg

SEQ ID NO: 607099 - DNA, 17 bp, Homo sapiens
taaagatattgtatctc

SEQ ID NO: 607100 - DNA, 19 bp, Homo sapiens
taaagatattgtatctcct

SEQ ID NO: 607101 - DNA, 22 bp, Homo sapiens
taaagcaactgtctatttctgc

SEQ ID NO: 607102 - DNA, 11 bp, Homo sapiens
taaagcagcaa

SEQ ID NO: 607103 - DNA, 14 bp, Homo sapiens
taaagctcacactt

SEQ ID NO: 607104 - DNA, 21 bp, Homo sapiens
taaagctcacacttgggctgg

SEQ ID NO: 607105 - DNA, 22 bp, Homo sapiens
taaagctcgtagaaacaagaca

SEQ ID NO: 607106 - DNA, 16 bp, Homo sapiens
taaaggtgatgaattt

SEQ ID NO: 607107 - DNA, 17 bp, Homo sapiens
taaaggtgatgaattta

SEQ ID NO: 607108 - DNA, 21 bp, Homo sapiens
taaaggtgatgaatttaccat

SEQ ID NO: 607109 - DNA, 19 bp, Homo sapiens
taaagtcaggccattcagt

SEQ ID NO: 607110 - DNA, 14 bp, Homo sapiens
taaagtctgagaaa

SEQ ID NO: 607111 - DNA, 16 bp, Homo sapiens
taaagtctgagaaatt

SEQ ID NO: 607112 - DNA, 15 bp, Homo sapiens
taaagtgtagcaccc

SEQ ID NO: 607113 - DNA, 17 bp, Homo sapiens
taaagtgtccattgaca

SEQ ID NO: 607114 - DNA, 22 bp, Homo sapiens
taaagtgtccattgacatgtac

SEQ ID NO: 607115 - DNA, 14 bp, Homo sapiens
taaataaaaattat

SEQ ID NO: 607116 - DNA, 18 bp, Homo sapiens
taaataatgcttaacata

SEQ ID NO: 607117 - DNA, 15 bp, Homo sapiens
taaatagcatgtatt

SEQ ID NO: 607118 - DNA, 12 bp, Homo sapiens
taaatagtaaat

SEQ ID NO: 607119 - DNA, 16 bp, Homo sapiens
taaatatatatttatc

SEQ ID NO: 607120 - DNA, 14 bp, Homo sapiens
taaatattatgcct

SEQ ID NO: 607121 - DNA, 20 bp, Homo sapiens
taaatattatgccttgagaa

SEQ ID NO: 607122 - DNA, 20 bp, Homo sapiens
taaatattgctgtctgaaaa

SEQ ID NO: 607123 - DNA, 14 bp, Homo sapiens
taaatcatcctcat

SEQ ID NO: 607124 - DNA, 15 bp, Homo sapiens
taaatctaaatataa

SEQ ID NO: 607125 - DNA, 16 bp, Homo sapiens
taaatctaaattaact

SEQ ID NO: 607126 - DNA, 15 bp, Homo sapiens
taaatctacaaactt

SEQ ID NO: 607127 - DNA, 17 bp, Homo sapiens
taaatctacaaactttt

SEQ ID NO: 607128 - DNA, 22 bp, Homo sapiens
taaatctcgcactacatctgat

SEQ ID NO: 607129 - DNA, 20 bp, Homo sapiens
taaatctttgttaaaatata

SEQ ID NO: 607130 - DNA, 13 bp, Homo sapiens
taaatgaaatact

SEQ ID NO: 607131 - DNA, 14 bp, Homo sapiens
taaatgaaatactt

SEQ ID NO: 607132 - DNA, 12 bp, Homo sapiens
taaatgaatgaa

SEQ ID NO: 607133 - DNA, 19 bp, Homo sapiens
taaatgatatgtctttaaa

SEQ ID NO: 607134 - DNA, 19 bp, Homo sapiens
taaatgtatattgatgtaa

SEQ ID NO: 607135 - DNA, 12 bp, Homo sapiens
taaatgtctaat

SEQ ID NO: 607136 - DNA, 22 bp, Homo sapiens
taaatgtcttcatgttgatgtg

SEQ ID NO: 607137 - DNA, 23 bp, Homo sapiens
taaatgtcttcatgttgatgtgt

SEQ ID NO: 607138 - DNA, 19 bp, Homo sapiens
taaattaacaaattcagtg

SEQ ID NO: 607139 - DNA, 12 bp, Homo sapiens
taaattatagag

SEQ ID NO: 607140 - DNA, 22 bp, Homo sapiens
taaattatagagcctcaatttt

SEQ ID NO: 607141 - DNA, 17 bp, Homo sapiens
taaattatcattgtttg

SEQ ID NO: 607142 - DNA, 16 bp, Homo sapiens
taaattatttctaaaa

SEQ ID NO: 607143 - DNA, 15 bp, Homo sapiens
taaattcctaattct

SEQ ID NO: 607144 - DNA, 13 bp, Homo sapiens
taaattgtggatg

SEQ ID NO: 607145 - DNA, 16 bp, Homo sapiens
taaatttattaaatgt

SEQ ID NO: 607146 - DNA, 19 bp, Homo sapiens
taaattttggaagaattca

SEQ ID NO: 607147 - DNA, 22 bp, Homo sapiens
taaattttggaagaattcatga

SEQ ID NO: 607148 - DNA, 23 bp, Homo sapiens
taaattttggaagaattcatgat

SEQ ID NO: 607149 - DNA, 24 bp, Homo sapiens
taaattttggaagaattcatgatg

SEQ ID NO: 607150 - DNA, 13 bp, Homo sapiens
taacaaagtgaga

SEQ ID NO: 607151 - DNA, 11 bp, Homo sapiens
taacaacaatt

SEQ ID NO: 607152 - DNA, 15 bp, Homo sapiens
taacactattttatg

SEQ ID NO: 607153 - DNA, 14 bp, Homo sapiens
taacactgagtgaa

SEQ ID NO: 607154 - DNA, 17 bp, Homo sapiens
taacactgagtgaaata

SEQ ID NO: 607155 - DNA, 23 bp, Homo sapiens
taacagaaaaatgaaatttaagc

SEQ ID NO: 607156 - DNA, 23 bp, Homo sapiens
taacagagtgatttgtaaaacag

SEQ ID NO: 607157 - DNA, 12 bp, Homo sapiens
taacagctgtat

SEQ ID NO: 607158 - DNA, 14 bp, Homo sapiens
taacagctgtatta

SEQ ID NO: 607159 - DNA, 22 bp, Homo sapiens
taacagctgtattatcttaaac

SEQ ID NO: 607160 - DNA, 14 bp, Homo sapiens
taacagtaaatata

SEQ ID NO: 607161 - DNA, 19 bp, Homo sapiens
taacagtaactgccatttt

SEQ ID NO: 607162 - DNA, 15 bp, Homo sapiens
taacagtatttccat

SEQ ID NO: 607163 - DNA, 16 bp, Homo sapiens
taacagtatttccata

SEQ ID NO: 607164 - DNA, 14 bp, Homo sapiens
taacataaacttgt

SEQ ID NO: 607165 - DNA, 18 bp, Homo sapiens
taacatatcattcagaat

SEQ ID NO: 607166 - DNA, 15 bp, Homo sapiens
taacattctatttca

SEQ ID NO: 607167 - DNA, 19 bp, Homo sapiens
taacattctatttcaactt

SEQ ID NO: 607168 - DNA, 15 bp, Homo sapiens
taacattgtaaatga

SEQ ID NO: 607169 - DNA, 20 bp, Homo sapiens
taaccaccatttcccctgtg

SEQ ID NO: 607170 - DNA, 20 bp, Homo sapiens
taaccacgattccaacccag

SEQ ID NO: 607171 - DNA, 19 bp, Homo sapiens
taaccgggactacagaagt

SEQ ID NO: 607172 - DNA, 19 bp, Homo sapiens
taacctccacagtagcatt

SEQ ID NO: 607173 - DNA, 12 bp, Homo sapiens
taactaatgtaa

SEQ ID NO: 607174 - DNA, 16 bp, Homo sapiens
taactaatgtaaatat

SEQ ID NO: 607175 - DNA, 17 bp, Homo sapiens
taactacctttggctta

SEQ ID NO: 607176 - DNA, 22 bp, Homo sapiens
taactacctttggcttaattcc

SEQ ID NO: 607177 - DNA, 17 bp, Homo sapiens
taactactttctgttat

SEQ ID NO: 607178 - DNA, 22 bp, Homo sapiens
taactactttctgttatctaga

SEQ ID NO: 607179 - DNA, 18 bp, Homo sapiens
taactccctaggcctgag

SEQ ID NO: 607180 - DNA, 14 bp, Homo sapiens
taactgaaaggttg

SEQ ID NO: 607181 - DNA, 15 bp, Homo sapiens
taactggccccaggc

SEQ ID NO: 607182 - DNA, 16 bp, Homo sapiens
taactggccccaggcg

SEQ ID NO: 607183 - DNA, 23 bp, Homo sapiens
taactgtcctttttcttccctta

SEQ ID NO: 607184 - DNA, 15 bp, Homo sapiens
tccacccctcaagcc

SEQ ID NO: 607185 - DNA, 14 bp, Homo sapiens
tccaccctcccctc

SEQ ID NO: 607186 - DNA, 17 bp, Homo sapiens
tccaccctcccctcttc

SEQ ID NO: 607187 - DNA, 15 bp, Homo sapiens
tccaccctgagcctg

SEQ ID NO: 607188 - DNA, 16 bp, Homo sapiens
tccaccctgagcctga

SEQ ID NO: 607189 - DNA, 19 bp, Homo sapiens
tccaccctgagcctgacct

SEQ ID NO: 607190 - DNA, 18 bp, Homo sapiens
tccacctggtggccctgc

SEQ ID NO: 607191 - DNA, 14 bp, Homo sapiens
tccaccttcctgcc

SEQ ID NO: 607192 - DNA, 20 bp, Homo sapiens
tccactacaggttttatgag

SEQ ID NO: 607193 - DNA, 19 bp, Homo sapiens
tccactaggtgcccagtct

SEQ ID NO: 607194 - DNA, 18 bp, Homo sapiens
tccactcctcccaactct

SEQ ID NO: 607195 - DNA, 15 bp, Homo sapiens
tccagaagcagcagc

SEQ ID NO: 607196 - DNA, 16 bp, Homo sapiens
tccagaagcagcagct

SEQ ID NO: 607197 - DNA, 20 bp, Homo sapiens
tccagacccctaccctttcc

SEQ ID NO: 607198 - DNA, 22 bp, Homo sapiens
tccagacccctaccctttccca

SEQ ID NO: 607199 - DNA, 16 bp, Homo sapiens
tccagactcgagaggg

SEQ ID NO: 607200 - DNA, 23 bp, Homo sapiens
tccagactcgagagggctgagcc

SEQ ID NO: 607201 - DNA, 17 bp, Homo sapiens
tccagattattttctat

SEQ ID NO: 607202 - DNA, 18 bp, Homo sapiens
tccagattattttctata

SEQ ID NO: 607203 - DNA, 17 bp, Homo sapiens
tccagcaatgcctgcct

SEQ ID NO: 607204 - DNA, 23 bp, Homo sapiens
tccagcaggtagtgggtgaatgt

SEQ ID NO: 607205 - DNA, 15 bp, Homo sapiens
tccagcagtgaatgc

SEQ ID NO: 607206 - DNA, 14 bp, Homo sapiens
tccagcccatgctg

SEQ ID NO: 607207 - DNA, 19 bp, Homo sapiens
tccagcccatgctggctgg

SEQ ID NO: 607208 - DNA, 20 bp, Homo sapiens
tccagcccatgctggctggg

SEQ ID NO: 607209 - DNA, 21 bp, Homo sapiens
tccagccctccgccagccctg

SEQ ID NO: 607210 - DNA, 18 bp, Homo sapiens
tccagcggggcttctggg

SEQ ID NO: 607211 - DNA, 19 bp, Homo sapiens
tccagctaagcctgatgat

SEQ ID NO: 607212 - DNA, 10 bp, Homo sapiens
tccaggagat

SEQ ID NO: 607213 - DNA, 19 bp, Homo sapiens
tccaggcagtagatcattt

SEQ ID NO: 607214 - DNA, 16 bp, Homo sapiens
tccagggaaccagagc

SEQ ID NO: 607215 - DNA, 17 bp, Homo sapiens
tccagggatggagatgg

SEQ ID NO: 607216 - DNA, 18 bp, Homo sapiens
tccagggtccagccctcc

SEQ ID NO: 607217 - DNA, 16 bp, Homo sapiens
tccaggtcacaggcat

SEQ ID NO: 607218 - DNA, 22 bp, Homo sapiens
tccaggtcacaggcatccgctg

SEQ ID NO: 607219 - DNA, 14 bp, Homo sapiens
tccagtgcatgttg

SEQ ID NO: 607220 - DNA, 16 bp, Homo sapiens
tccagtgctgctccct

SEQ ID NO: 607221 - DNA, 19 bp, Homo sapiens
tccagtgctgctcccttta

SEQ ID NO: 607222 - DNA, 19 bp, Homo sapiens
tccagtggggcaagatttt

SEQ ID NO: 607223 - DNA, 16 bp, Homo sapiens
tccagtgtattttctg

SEQ ID NO: 607224 - DNA, 15 bp, Homo sapiens
tccagttctgatgag

SEQ ID NO: 607225 - DNA, 21 bp, Homo sapiens
tccataaagaagatgtttaac

SEQ ID NO: 607226 - DNA, 15 bp, Homo sapiens
tccatactgtttaat

SEQ ID NO: 607227 - DNA, 20 bp, Homo sapiens
tccatcttgtggggccagga

SEQ ID NO: 607228 - DNA, 16 bp, Homo sapiens
tccatgccccagctct

SEQ ID NO: 607229 - DNA, 17 bp, Homo sapiens
tccatggtgaactgaag

SEQ ID NO: 607230 - DNA, 23 bp, Homo sapiens
tccatggtgaactgaagcagagt

SEQ ID NO: 607231 - DNA, 18 bp, Homo sapiens
tccatggtggtttcagaa

SEQ ID NO: 607232 - DNA, 23 bp, Homo sapiens
tccatgtgataattgtaaaggtg

SEQ ID NO: 607233 - DNA, 18 bp, Homo sapiens
tccattcactttcaggaa

SEQ ID NO: 607234 - DNA, 15 bp, Homo sapiens
tccattgacatgtac

SEQ ID NO: 607235 - DNA, 17 bp, Homo sapiens
tccattgacatgtacag

SEQ ID NO: 607236 - DNA, 19 bp, Homo sapiens
tccattgacatgtacagag

SEQ ID NO: 607237 - DNA, 15 bp, Homo sapiens
tcagcattcccaatt

SEQ ID NO: 607238 - DNA, 16 bp, Homo sapiens
tcagcccatcccctgc

SEQ ID NO: 607239 - DNA, 20 bp, Homo sapiens
tcagcccatcccctgcctct

SEQ ID NO: 607240 - DNA, 21 bp, Homo sapiens
tcagcccatcccctgcctcta

SEQ ID NO: 607241 - DNA, 12 bp, Homo sapiens
tcagctccactc

SEQ ID NO: 607242 - DNA, 13 bp, Homo sapiens
tcagctccactct

SEQ ID NO: 607243 - DNA, 21 bp, Homo sapiens
tcagctccactctgaagtccc

SEQ ID NO: 607244 - DNA, 20 bp, Homo sapiens
tcagctctaaagcagagatg

SEQ ID NO: 607245 - DNA, 22 bp, Homo sapiens
tcagctctaaagcagagatgta

SEQ ID NO: 607246 - DNA, 13 bp, Homo sapiens
tcagctctgcata

SEQ ID NO: 607247 - DNA, 13 bp, Homo sapiens
tcagcttcccaac

SEQ ID NO: 607248 - DNA, 21 bp, Homo sapiens
tcagcttcccaacaatacttt

SEQ ID NO: 607249 - DNA, 16 bp, Homo sapiens
tcaggaatgggccaag

SEQ ID NO: 607250 - DNA, 15 bp, Homo sapiens
tcaggacttgggaaa

SEQ ID NO: 607251 - DNA, 15 bp, Homo sapiens
tcaggagaaacccct

SEQ ID NO: 607252 - DNA, 22 bp, Homo sapiens
tcaggagaaggcctgcccccct

SEQ ID NO: 607253 - DNA, 20 bp, Homo sapiens
tcaggagagccctctgctgc

SEQ ID NO: 607254 - DNA, 18 bp, Homo sapiens
tcaggagcacagccatag

SEQ ID NO: 607255 - DNA, 14 bp, Homo sapiens
tcaggcagcctgtg

SEQ ID NO: 607256 - DNA, 19 bp, Homo sapiens
tcaggctacaggtgcccca

SEQ ID NO: 607257 - DNA, 12 bp, Homo sapiens
tcaggctctgaa

SEQ ID NO: 607258 - DNA, 15 bp, Homo sapiens
tcaggctctgaatct

SEQ ID NO: 607259 - DNA, 19 bp, Homo sapiens
tcagggaccaaggagatgg

SEQ ID NO: 607260 - DNA, 20 bp, Homo sapiens
tcagggagggctgttcaagt

SEQ ID NO: 607261 - DNA, 13 bp, Homo sapiens
tcagggcaagctc

SEQ ID NO: 607262 - DNA, 18 bp, Homo sapiens
tcaggtggcatttgcagg

SEQ ID NO: 607263 - DNA, 23 bp, Homo sapiens
tcaggtgtatagggaattttcat

SEQ ID NO: 607264 - DNA, 21 bp, Homo sapiens
tcaggtttccggctactgaca

SEQ ID NO: 607265 - DNA, 22 bp, Homo sapiens
tcagtacaattctttgttgctt

SEQ ID NO: 607266 - DNA, 14 bp, Homo sapiens
tcagtagcatttta

SEQ ID NO: 607267 - DNA, 18 bp, Homo sapiens
tcagtattgagacactgt

SEQ ID NO: 607268 - DNA, 21 bp, Homo sapiens
tcagtattgagacactgtcaa

SEQ ID NO: 607269 - DNA, 22 bp, Homo sapiens
tcagtattgttttggtttgcta

SEQ ID NO: 607270 - DNA, 21 bp, Homo sapiens
tcagtccacccccattgtgaa

SEQ ID NO: 607271 - DNA, 16 bp, Homo sapiens
tcagtctatgctgtgt

SEQ ID NO: 607272 - DNA, 19 bp, Homo sapiens
tcagtgaagcccaggagga

SEQ ID NO: 607273 - DNA, 13 bp, Homo sapiens
tcagtgacatgtc

SEQ ID NO: 607274 - DNA, 19 bp, Homo sapiens
tcagtgcagggacagcctg

SEQ ID NO: 607275 - DNA, 20 bp, Homo sapiens
tcagtgcagggacagcctgc

SEQ ID NO: 607276 - DNA, 16 bp, Homo sapiens
tcagtgcccatgtgta

SEQ ID NO: 607277 - DNA, 19 bp, Homo sapiens
tcagtgcccatgtgtatgg

SEQ ID NO: 607278 - DNA, 9 bp, Homo sapiens
tcagtgcct

SEQ ID NO: 607279 - DNA, 11 bp, Homo sapiens
tcagtgcctta

SEQ ID NO: 607280 - DNA, 14 bp, Homo sapiens
tcagtgccttatgg

SEQ ID NO: 607281 - DNA, 17 bp, Homo sapiens
tcagtgccttggagcag

SEQ ID NO: 607282 - DNA, 18 bp, Homo sapiens
tcagtggacatttgttct

SEQ ID NO: 607283 - DNA, 20 bp, Homo sapiens
tcagtgtactctgagtcctc

SEQ ID NO: 607284 - DNA, 18 bp, Homo sapiens
tctgtatatcagctctaa

SEQ ID NO: 607285 - DNA, 13 bp, Homo sapiens
tctgtattgctaa

SEQ ID NO: 607286 - DNA, 15 bp, Homo sapiens
tctgtcagtttgtga

SEQ ID NO: 607287 - DNA, 19 bp, Homo sapiens
tctgtcattggttacaaat

SEQ ID NO: 607288 - DNA, 20 bp, Homo sapiens
tctgtcattggttacaaatt

SEQ ID NO: 607289 - DNA, 13 bp, Homo sapiens
tctgtccactctg

SEQ ID NO: 607290 - DNA, 16 bp, Homo sapiens
tctgtccctaaacata

SEQ ID NO: 607291 - DNA, 17 bp, Homo sapiens
tctgtccctaaacatag

SEQ ID NO: 607292 - DNA, 23 bp, Homo sapiens
tctgtccctaaacatagtggtat

SEQ ID NO: 607293 - DNA, 12 bp, Homo sapiens
tctgtcctgcgc

SEQ ID NO: 607294 - DNA, 12 bp, Homo sapiens
tctgtcctttcc

SEQ ID NO: 607295 - DNA, 22 bp, Homo sapiens
tctgtctataggacttaattta

SEQ ID NO: 607296 - DNA, 14 bp, Homo sapiens
tctgtctgagccct

SEQ ID NO: 607297 - DNA, 16 bp, Homo sapiens
tctgtctgagccctgc

SEQ ID NO: 607298 - DNA, 17 bp, Homo sapiens
tctgtctgagccctgcc

SEQ ID NO: 607299 - DNA, 19 bp, Homo sapiens
tctgtctgagccctgccct

SEQ ID NO: 607300 - DNA, 20 bp, Homo sapiens
tctgtctgagccctgccctc

SEQ ID NO: 607301 - DNA, 14 bp, Homo sapiens
tctgtctttatgat

SEQ ID NO: 607302 - DNA, 16 bp, Homo sapiens
tctgtctttatgattt

SEQ ID NO: 607303 - DNA, 19 bp, Homo sapiens
tctgtctttatgatttcat

SEQ ID NO: 607304 - DNA, 22 bp, Homo sapiens
tctgtgaaagtctcctgtatca

SEQ ID NO: 607305 - DNA, 14 bp, Homo sapiens
tctgtgagtctgtc

SEQ ID NO: 607306 - DNA, 18 bp, Homo sapiens
tctgtgcatctggcctgg

SEQ ID NO: 607307 - DNA, 17 bp, Homo sapiens
tctgtggctgatttact

SEQ ID NO: 607308 - DNA, 21 bp, Homo sapiens
tctgtggcttcccatgtcttt

SEQ ID NO: 607309 - DNA, 17 bp, Homo sapiens
tctgtgggactggccca

SEQ ID NO: 607310 - DNA, 23 bp, Homo sapiens
tctgtgtagtagctcgtgtgctt

SEQ ID NO: 607311 - DNA, 11 bp, Homo sapiens
tctgtgtggca

SEQ ID NO: 607312 - DNA, 14 bp, Homo sapiens
tctgtgtggtgaaa

SEQ ID NO: 607313 - DNA, 18 bp, Homo sapiens
tctgttccaagtgtgtgt

SEQ ID NO: 607314 - DNA, 16 bp, Homo sapiens
tctgttgtaatatcag

SEQ ID NO: 607315 - DNA, 15 bp, Homo sapiens
tctgtttaatactca

SEQ ID NO: 607316 - DNA, 17 bp, Homo sapiens
tctgtttaatactcatc

SEQ ID NO: 607317 - DNA, 24 bp, Homo sapiens
tctgtttaccctccctgtcccctg

SEQ ID NO: 607318 - DNA, 12 bp, Homo sapiens
tctgtttatgtt

SEQ ID NO: 607319 - DNA, 13 bp, Homo sapiens
tcttaaaaattat

SEQ ID NO: 607320 - DNA, 16 bp, Homo sapiens
tcttaaaattggttaa

SEQ ID NO: 607321 - DNA, 21 bp, Homo sapiens
tcttaaacccacataaacact

SEQ ID NO: 607322 - DNA, 13 bp, Homo sapiens
tcttaactaatgt

SEQ ID NO: 607323 - DNA, 16 bp, Homo sapiens
tcttaactaatgtaaa

SEQ ID NO: 607324 - DNA, 22 bp, Homo sapiens
tcttaaggacagtgttcaaatt

SEQ ID NO: 607325 - DNA, 15 bp, Homo sapiens
tcttaatgtctcaaa

SEQ ID NO: 607326 - DNA, 19 bp, Homo sapiens
tcttacacgaagaaataga

SEQ ID NO: 607327 - DNA, 17 bp, Homo sapiens
tcttaccactagttgct

SEQ ID NO: 607328 - DNA, 20 bp, Homo sapiens
tcttacctgtaatagcctca

SEQ ID NO: 607329 - DNA, 14 bp, Homo sapiens
tcttactgtatttg

SEQ ID NO: 607330 - DNA, 23 bp, Homo sapiens
tcttattcatgctttctcctttt

SEQ ID NO: 607331 - DNA, 17 bp, Homo sapiens
tcttattcctaattcct

SEQ ID NO: 607332 - DNA, 14 bp, Homo sapiens
tcttcaaaatatat

SEQ ID NO: 607333 - DNA, 23 bp, Homo sapiens
tcttcatgttgatgtgtccgtga

SEQ ID NO: 607334 - DNA, 16 bp, Homo sapiens
tcttcattgcactgca

SEQ ID NO: 607335 - DNA, 16 bp, Homo sapiens
tcttccaacatgtgat

SEQ ID NO: 607336 - DNA, 18 bp, Homo sapiens
tcttccaacatgtgatgt

SEQ ID NO: 607337 - DNA, 12 bp, Homo sapiens
tcttcccccttc

SEQ ID NO: 607338 - DNA, 23 bp, Homo sapiens
tcttccctggccaggggcttctc

SEQ ID NO: 607339 - DNA, 18 bp, Homo sapiens
tcttcctaattaacaaaa

SEQ ID NO: 607340 - DNA, 14 bp, Homo sapiens
tcttcctcttacct

SEQ ID NO: 607341 - DNA, 12 bp, Homo sapiens
tcttccttcctt

SEQ ID NO: 607342 - DNA, 19 bp, Homo sapiens
tcttccttttgtatcctcc

SEQ ID NO: 607343 - DNA, 22 bp, Homo sapiens
tcttcgtggattgttttttctg

SEQ ID NO: 607344 - DNA, 16 bp, Homo sapiens
tcttctcagctccact

SEQ ID NO: 607345 - DNA, 13 bp, Homo sapiens
tcttctcctttgt

SEQ ID NO: 607346 - DNA, 18 bp, Homo sapiens
tcttctcctttgtcaaat

SEQ ID NO: 607347 - DNA, 16 bp, Homo sapiens
tcttctctctgtgctg

SEQ ID NO: 607348 - DNA, 21 bp, Homo sapiens
tcttcttattcatgctttctc

SEQ ID NO: 607349 - DNA, 23 bp, Homo sapiens
tcttctttaggattgtgatggtt

SEQ ID NO: 607350 - DNA, 18 bp, Homo sapiens
tcttcttttcccatttac

SEQ ID NO: 607351 - DNA, 18 bp, Homo sapiens
tcttgaatgcttaaatga

SEQ ID NO: 607352 - DNA, 22 bp, Homo sapiens
tcttgaatgttgaagaactcat

SEQ ID NO: 607353 - DNA, 20 bp, Homo sapiens
tcttgagaccagcctgccag

SEQ ID NO: 607354 - DNA, 15 bp, Homo sapiens
tcttgagtgggcccc

SEQ ID NO: 607355 - DNA, 15 bp, Homo sapiens
tcttgcagcagagag

SEQ ID NO: 607356 - DNA, 16 bp, Homo sapiens
tcttgctcagagctag

SEQ ID NO: 607357 - DNA, 12 bp, Homo sapiens
tcttggagagga

SEQ ID NO: 607358 - DNA, 19 bp, Homo sapiens
tcttggtcacaaagctatt

SEQ ID NO: 607359 - DNA, 21 bp, Homo sapiens
tcttggtcacaaagctattta

SEQ ID NO: 607360 - DNA, 18 bp, Homo sapiens
tcttgtaaaactgtgaca

SEQ ID NO: 607361 - DNA, 20 bp, Homo sapiens
tcttgtaaaactgtgacatt

SEQ ID NO: 607362 - DNA, 14 bp, Homo sapiens
tctttaacatatca

SEQ ID NO: 607363 - DNA, 16 bp, Homo sapiens
tgaaaatgctttgaaa

SEQ ID NO: 607364 - DNA, 16 bp, Homo sapiens
tgaaaatggctgaaga

SEQ ID NO: 607365 - DNA, 14 bp, Homo sapiens
tgaaacaaatatac

SEQ ID NO: 607366 - DNA, 20 bp, Homo sapiens
tgaaacagtgtggatgtaaa

SEQ ID NO: 607367 - DNA, 11 bp, Homo sapiens
tgaaactgtat

SEQ ID NO: 607368 - DNA, 14 bp, Homo sapiens
tgaaactgtattta

SEQ ID NO: 607369 - DNA, 15 bp, Homo sapiens
tgaaactgtatttac

SEQ ID NO: 607370 - DNA, 20 bp, Homo sapiens
tgaaactgtatttacttgtt

SEQ ID NO: 607371 - DNA, 15 bp, Homo sapiens
tgaaagacagtaaag

SEQ ID NO: 607372 - DNA, 17 bp, Homo sapiens
tgaaagccctggaattt

SEQ ID NO: 607373 - DNA, 13 bp, Homo sapiens
tgaaagggacaag

SEQ ID NO: 607374 - DNA, 15 bp, Homo sapiens
tgaaagggacaagta

SEQ ID NO: 607375 - DNA, 17 bp, Homo sapiens
tgaaaggtgctttctcc

SEQ ID NO: 607376 - DNA, 21 bp, Homo sapiens
tgaaagtcagtttaagaggct

SEQ ID NO: 607377 - DNA, 21 bp, Homo sapiens
tgaaatataaactgtgagata

SEQ ID NO: 607378 - DNA, 23 bp, Homo sapiens
tgaaatataaactgtgagataaa

SEQ ID NO: 607379 - DNA, 16 bp, Homo sapiens
tgaaatattttctact

SEQ ID NO: 607380 - DNA, 15 bp, Homo sapiens
tgaaatccaaaatag

SEQ ID NO: 607381 - DNA, 23 bp, Homo sapiens
tgaaatctacaacataatgatac

SEQ ID NO: 607382 - DNA, 17 bp, Homo sapiens
tgaaatctttttgcttt

SEQ ID NO: 607383 - DNA, 18 bp, Homo sapiens
tgaaatgtttttgattta

SEQ ID NO: 607384 - DNA, 19 bp, Homo sapiens
tgaaattagtattttgagc

SEQ ID NO: 607385 - DNA, 17 bp, Homo sapiens
tgaaattagtgttttca

SEQ ID NO: 607386 - DNA, 22 bp, Homo sapiens
tgaaattagtgttttcattctg

SEQ ID NO: 607387 - DNA, 15 bp, Homo sapiens
tgaaattatgtcaaa

SEQ ID NO: 607388 - DNA, 11 bp, Homo sapiens
tgaaatttaag

SEQ ID NO: 607389 - DNA, 12 bp, Homo sapiens
tgaaatttaagc

SEQ ID NO: 607390 - DNA, 16 bp, Homo sapiens
tgaacacactcagcag

SEQ ID NO: 607391 - DNA, 14 bp, Homo sapiens
tgaacactgcaccc

SEQ ID NO: 607392 - DNA, 17 bp, Homo sapiens
tgaacactgcaccctcc

SEQ ID NO: 607393 - DNA, 15 bp, Homo sapiens
tgaacagcttcactt

SEQ ID NO: 607394 - DNA, 15 bp, Homo sapiens
tgaaccgtcaatgtg

SEQ ID NO: 607395 - DNA, 22 bp, Homo sapiens
tgaaccgtcaatgtgaaataaa

SEQ ID NO: 607396 - DNA, 14 bp, Homo sapiens
tgaactctttcccc

SEQ ID NO: 607397 - DNA, 21 bp, Homo sapiens
tgaactttctcagcatatata

SEQ ID NO: 607398 - DNA, 14 bp, Homo sapiens
tgaagaaaatcctt

SEQ ID NO: 607399 - DNA, 19 bp, Homo sapiens
tgaagaaaatccttcagca

SEQ ID NO: 607400 - DNA, 13 bp, Homo sapiens
tgaagaaacacag

SEQ ID NO: 607401 - DNA, 18 bp, Homo sapiens
tgaagaaacacagcatgc

SEQ ID NO: 607402 - DNA, 19 bp, Homo sapiens
tgaagaaacacagcatgca

SEQ ID NO: 607403 - DNA, 22 bp, Homo sapiens
tgaagaaacacagcatgcattt

SEQ ID NO: 607404 - DNA, 17 bp, Homo sapiens
tgaagaccctatctccc

SEQ ID NO: 607405 - DNA, 21 bp, Homo sapiens
tgaagaccctatctcccacaa

SEQ ID NO: 607406 - DNA, 15 bp, Homo sapiens
tgaagagagatatat

SEQ ID NO: 607407 - DNA, 13 bp, Homo sapiens
tgaagcaaacaca

SEQ ID NO: 607408 - DNA, 12 bp, Homo sapiens
tgaagcagagtc

SEQ ID NO: 607409 - DNA, 13 bp, Homo sapiens
tgaagcagagtca

SEQ ID NO: 607410 - DNA, 16 bp, Homo sapiens
tgaagcagagtcaagc

SEQ ID NO: 607411 - DNA, 14 bp, Homo sapiens
tgaagcccaggagg

SEQ ID NO: 607412 - DNA, 20 bp, Homo sapiens
tgaagcctggattccagcag

SEQ ID NO: 607413 - DNA, 15 bp, Homo sapiens
tgaagctaaaacact

SEQ ID NO: 607414 - DNA, 13 bp, Homo sapiens
tgaaggagaggag

SEQ ID NO: 607415 - DNA, 23 bp, Homo sapiens
tgaaggcaaaaactgtactgtgt

SEQ ID NO: 607416 - DNA, 13 bp, Homo sapiens
tgaagggaaatca

SEQ ID NO: 607417 - DNA, 21 bp, Homo sapiens
tgaagggaaatcaatttaaag

SEQ ID NO: 607418 - DNA, 17 bp, Homo sapiens
tgaaggggccagaccac

SEQ ID NO: 607419 - DNA, 16 bp, Homo sapiens
tgaaggtcttgcctga

SEQ ID NO: 607420 - DNA, 22 bp, Homo sapiens
tgaagtagtgtgagtgttagaa

SEQ ID NO: 607421 - DNA, 18 bp, Homo sapiens
tgaagtcccttcctgtcc

SEQ ID NO: 607422 - DNA, 20 bp, Homo sapiens
tgaagtcccttcctgtcctg

SEQ ID NO: 607423 - DNA, 15 bp, Homo sapiens
tgaagtgattgacat

SEQ ID NO: 607424 - DNA, 12 bp, Homo sapiens
tgaagtgcatgt

SEQ ID NO: 607425 - DNA, 15 bp, Homo sapiens
tgaagtgcatgttaa

SEQ ID NO: 607426 - DNA, 13 bp, Homo sapiens
tgaagttttatga

SEQ ID NO: 607427 - DNA, 15 bp, Homo sapiens
tgaataaaatgttta

SEQ ID NO: 607428 - DNA, 14 bp, Homo sapiens
tgaataataaccac

SEQ ID NO: 607429 - DNA, 17 bp, Homo sapiens
tgaatccatcaggactt

SEQ ID NO: 607430 - DNA, 18 bp, Homo sapiens
tgaatccatcaggacttg

SEQ ID NO: 607431 - DNA, 17 bp, Homo sapiens
tgaatccatcgatttgt

SEQ ID NO: 607432 - DNA, 21 bp, Homo sapiens
tgaatccatcgatttgtatta

SEQ ID NO: 607433 - DNA, 18 bp, Homo sapiens
tgaatctctcaaaatgtg

SEQ ID NO: 607434 - DNA, 20 bp, Homo sapiens
tgaatctctcaaaatgtgcc

SEQ ID NO: 607435 - DNA, 21 bp, Homo sapiens
tgaatgataatagctcacagc

SEQ ID NO: 607436 - DNA, 20 bp, Homo sapiens
tgaatgctatttgtgtaact

SEQ ID NO: 607437 - DNA, 23 bp, Homo sapiens
tgaatggttctttatcatttctc

SEQ ID NO: 607438 - DNA, 15 bp, Homo sapiens
tgaatggttgcaaag

SEQ ID NO: 607439 - DNA, 14 bp, Homo sapiens
tgaatgtgtgtggt

SEQ ID NO: 607440 - DNA, 16 bp, Homo sapiens
tgaattgcctttgata

SEQ ID NO: 607441 - DNA, 16 bp, Homo sapiens
tgaattggctgccaag

SEQ ID NO: 607442 - DNA, 18 bp, Homo sapiens
tgaattttttcctaccat

SEQ ID NO: 607443 - DNA, 21 bp, Homo sapiens
tgacaagtgacttatttgctc

SEQ ID NO: 607444 - DNA, 21 bp, Homo sapiens
tgacaagttacccctgaaatc

SEQ ID NO: 607445 - DNA, 17 bp, Homo sapiens
tgacaagtttaaaggct

SEQ ID NO: 607446 - DNA, 22 bp, Homo sapiens
tgagttaatttgataaagatct

SEQ ID NO: 607447 - DNA, 19 bp, Homo sapiens
tgagttctgcacatacaga

SEQ ID NO: 607448 - DNA, 20 bp, Homo sapiens
tgagttctgcacatacagat

SEQ ID NO: 607449 - DNA, 18 bp, Homo sapiens
tgagtttaatcttttcag

SEQ ID NO: 607450 - DNA, 16 bp, Homo sapiens
tgataaagaaaccttt

SEQ ID NO: 607451 - DNA, 16 bp, Homo sapiens
tgataatagctcacag

SEQ ID NO: 607452 - DNA, 22 bp, Homo sapiens
tgataatagctcacagcacatt

SEQ ID NO: 607453 - DNA, 22 bp, Homo sapiens
tgataattcgagcaaacaactt

SEQ ID NO: 607454 - DNA, 20 bp, Homo sapiens
tgataattgtgctttacaac

SEQ ID NO: 607455 - DNA, 21 bp, Homo sapiens
tgatactgaattgttatgtaa

SEQ ID NO: 607456 - DNA, 22 bp, Homo sapiens
tgatactgaattgttatgtaaa

SEQ ID NO: 607457 - DNA, 22 bp, Homo sapiens
tgatagaagaaggactgaagaa

SEQ ID NO: 607458 - DNA, 19 bp, Homo sapiens
tgatatcacagtctaattt

SEQ ID NO: 607459 - DNA, 11 bp, Homo sapiens
tgatatcagga

SEQ ID NO: 607460 - DNA, 15 bp, Homo sapiens
tgatatgtctttaaa

SEQ ID NO: 607461 - DNA, 16 bp, Homo sapiens
tgatatgtctttaaaa

SEQ ID NO: 607462 - DNA, 16 bp, Homo sapiens
tgatatgttgatgaaa

SEQ ID NO: 607463 - DNA, 16 bp, Homo sapiens
tgatcaaggagggaga

SEQ ID NO: 607464 - DNA, 22 bp, Homo sapiens
tgatctggtgcgtgtggccctg

SEQ ID NO: 607465 - DNA, 13 bp, Homo sapiens
tgatctgtccttc

SEQ ID NO: 607466 - DNA, 20 bp, Homo sapiens
tgatctgttgtaatatcagt

SEQ ID NO: 607467 - DNA, 16 bp, Homo sapiens
tgatgaataaaatgtt

SEQ ID NO: 607468 - DNA, 18 bp, Homo sapiens
tgatgagacaacacacac

SEQ ID NO: 607469 - DNA, 15 bp, Homo sapiens
tgatgatgttctgaa

SEQ ID NO: 607470 - DNA, 16 bp, Homo sapiens
tgatgattcaatcatt

SEQ ID NO: 607471 - DNA, 14 bp, Homo sapiens
tgatggccaggcct

SEQ ID NO: 607472 - DNA, 23 bp, Homo sapiens
tgatggggaagggtggatgtccc

SEQ ID NO: 607473 - DNA, 16 bp, Homo sapiens
tgatggtgcaatgacc

SEQ ID NO: 607474 - DNA, 17 bp, Homo sapiens
tgatggtgcaatgacct

SEQ ID NO: 607475 - DNA, 15 bp, Homo sapiens
tgatgtccaaactta

SEQ ID NO: 607476 - DNA, 13 bp, Homo sapiens
tgatgttctgaaa

SEQ ID NO: 607477 - DNA, 21 bp, Homo sapiens
tgatgtttctatatgtaactt

SEQ ID NO: 607478 - DNA, 19 bp, Homo sapiens
tgattaaattatcattgtt

SEQ ID NO: 607479 - DNA, 21 bp, Homo sapiens
tgattaaattatcattgtttg

SEQ ID NO: 607480 - DNA, 13 bp, Homo sapiens
tgattaaggacta

SEQ ID NO: 607481 - DNA, 18 bp, Homo sapiens
tgattaaggactacagaa

SEQ ID NO: 607482 - DNA, 13 bp, Homo sapiens
tgattcaaataac

SEQ ID NO: 607483 - DNA, 19 bp, Homo sapiens
tgattcaaataaccctgaa

SEQ ID NO: 607484 - DNA, 11 bp, Homo sapiens
tgattcaatgt

SEQ ID NO: 607485 - DNA, 12 bp, Homo sapiens
tgattcaatgtg

SEQ ID NO: 607486 - DNA, 11 bp, Homo sapiens
tgattctcctc

SEQ ID NO: 607487 - DNA, 15 bp, Homo sapiens
tgattctcctctccc

SEQ ID NO: 607488 - DNA, 21 bp, Homo sapiens
tgattcttgtgtcatcaagta

SEQ ID NO: 607489 - DNA, 21 bp, Homo sapiens
tgattctttcaatccacagta

SEQ ID NO: 607490 - DNA, 17 bp, Homo sapiens
tgattgtttgatgaata

SEQ ID NO: 607491 - DNA, 20 bp, Homo sapiens
tgatttactaacagtaactg

SEQ ID NO: 607492 - DNA, 14 bp, Homo sapiens
tgatttatgcattt

SEQ ID NO: 607493 - DNA, 14 bp, Homo sapiens
tgatttgatataca

SEQ ID NO: 607494 - DNA, 19 bp, Homo sapiens
tgatttgatatacagacct

SEQ ID NO: 607495 - DNA, 18 bp, Homo sapiens
tgatttgcaacactgcca

SEQ ID NO: 607496 - DNA, 19 bp, Homo sapiens
tgatttgtaaaacagtggt

SEQ ID NO: 607497 - DNA, 20 bp, Homo sapiens
tgatttttcaaagacttcat

SEQ ID NO: 607498 - DNA, 16 bp, Homo sapiens
tgatttttttttcctt

SEQ ID NO: 607499 - DNA, 22 bp, Homo sapiens
tgatttttttttccttcagtgc

SEQ ID NO: 607500 - DNA, 20 bp, Homo sapiens
tgcaaaccatcattgaaatc

SEQ ID NO: 607501 - DNA, 18 bp, Homo sapiens
tgcaaatatttttttgta

SEQ ID NO: 607502 - DNA, 11 bp, Homo sapiens
tgcaacactgc

SEQ ID NO: 607503 - DNA, 12 bp, Homo sapiens
tgcaacactgcc

SEQ ID NO: 607504 - DNA, 20 bp, Homo sapiens
tgcaacactgccaaacatca

SEQ ID NO: 607505 - DNA, 23 bp, Homo sapiens
tgcaataaactcagtcaaatgta

SEQ ID NO: 607506 - DNA, 12 bp, Homo sapiens
tgcaataacagt

SEQ ID NO: 607507 - DNA, 20 bp, Homo sapiens
tgcaataacagttttaagat

SEQ ID NO: 607508 - DNA, 19 bp, Homo sapiens
tgcaatgacctttcaatag

SEQ ID NO: 607509 - DNA, 22 bp, Homo sapiens
tgcaatgtctgtccctaaacat

SEQ ID NO: 607510 - DNA, 20 bp, Homo sapiens
tgcaatgttccgttcatctg

SEQ ID NO: 607511 - DNA, 21 bp, Homo sapiens
tgcaatgttccgttcatctga

SEQ ID NO: 607512 - DNA, 14 bp, Homo sapiens
tgcaattaaaaggt

SEQ ID NO: 607513 - DNA, 23 bp, Homo sapiens
tgcacacacagtctgttcagagg

SEQ ID NO: 607514 - DNA, 13 bp, Homo sapiens
tgcacacataaca

SEQ ID NO: 607515 - DNA, 17 bp, Homo sapiens
tgcacacataacacaca

SEQ ID NO: 607516 - DNA, 21 bp, Homo sapiens
tgcacacataacacacatcag

SEQ ID NO: 607517 - DNA, 17 bp, Homo sapiens
tgcacaccaaattgctg

SEQ ID NO: 607518 - DNA, 18 bp, Homo sapiens
tgcacagtggtccagggt

SEQ ID NO: 607519 - DNA, 22 bp, Homo sapiens
tgcaccagtgccgcctgtgccc

SEQ ID NO: 607520 - DNA, 22 bp, Homo sapiens
tgcaccctccacaggagccgca

SEQ ID NO: 607521 - DNA, 13 bp, Homo sapiens
tgcacctgcttct

SEQ ID NO: 607522 - DNA, 20 bp, Homo sapiens
tgcacgcggactccggggtt

SEQ ID NO: 607523 - DNA, 15 bp, Homo sapiens
tgcactaaaagtgat

SEQ ID NO: 607524 - DNA, 18 bp, Homo sapiens
tgcactaaaagtgatgtg

SEQ ID NO: 607525 - DNA, 21 bp, Homo sapiens
tgcactaaaagtgatgtgatt

SEQ ID NO: 607526 - DNA, 14 bp, Homo sapiens
tgcactctactctg

SEQ ID NO: 607527 - DNA, 17 bp, Homo sapiens
tgcactctactctgcga

SEQ ID NO: 607528 - DNA, 17 bp, Homo sapiens
tgcactgagcagagtct

SEQ ID NO: 607529 - DNA, 16 bp, Homo sapiens
tgcactgtatccaagt

SEQ ID NO: 607530 - DNA, 18 bp, Homo sapiens
tgcacttcggataatttt

SEQ ID NO: 607531 - DNA, 21 bp, Homo sapiens
tgcacttcggataattttcat

SEQ ID NO: 607532 - DNA, 22 bp, Homo sapiens
tgcacttcggataattttcatt

SEQ ID NO: 607533 - DNA, 14 bp, Homo sapiens
tgcacttctgttat

SEQ ID NO: 607534 - DNA, 15 bp, Homo sapiens
tgcacttctgttatc

SEQ ID NO: 607535 - DNA, 15 bp, Homo sapiens
tgcagaaaacattgt

SEQ ID NO: 607536 - DNA, 12 bp, Homo sapiens
tgcagactgtgg

SEQ ID NO: 607537 - DNA, 19 bp, Homo sapiens
tgcagcaaccagagcactg

SEQ ID NO: 607538 - DNA, 22 bp, Homo sapiens
tgcagcaaccagagcactgtat

SEQ ID NO: 607539 - DNA, 12 bp, Homo sapiens
tgcagcacctgt

SEQ ID NO: 607540 - DNA, 20 bp, Homo sapiens
tgcagcccagaacgggcctc

SEQ ID NO: 607541 - DNA, 22 bp, Homo sapiens
tgcagcccagaacgggcctccc

SEQ ID NO: 607542 - DNA, 23 bp, Homo sapiens
tgcagcccagaacgggcctcccc

SEQ ID NO: 607543 - DNA, 14 bp, Homo sapiens
tgcagccctctcca

SEQ ID NO: 607544 - DNA, 22 bp, Homo sapiens
tgcagccctctccaccctccgg

SEQ ID NO: 607545 - DNA, 12 bp, Homo sapiens
tgcagcctgagc

SEQ ID NO: 607546 - DNA, 21 bp, Homo sapiens
tgcagcctgagctccaccctc

SEQ ID NO: 607547 - DNA, 18 bp, Homo sapiens
tgcagctaatttgtgaaa

SEQ ID NO: 607548 - DNA, 17 bp, Homo sapiens
tgcagctatggacaatt

SEQ ID NO: 607549 - DNA, 14 bp, Homo sapiens
tgcaggaatcaaaa

SEQ ID NO: 607550 - DNA, 20 bp, Homo sapiens
tgcaggaatcaaaaattgaa

SEQ ID NO: 607551 - DNA, 14 bp, Homo sapiens
tgcaggcccagcag

SEQ ID NO: 607552 - DNA, 19 bp, Homo sapiens
tgcaggcgcgcaccgccca

SEQ ID NO: 607553 - DNA, 21 bp, Homo sapiens
tgcaggcgcgcaccgcccaac

SEQ ID NO: 607554 - DNA, 16 bp, Homo sapiens
tgcagggacagcctgc

SEQ ID NO: 607555 - DNA, 15 bp, Homo sapiens
tgcagtagagagcct

SEQ ID NO: 607556 - DNA, 23 bp, Homo sapiens
tgcagtcacgtgaggcccctgtg

SEQ ID NO: 607557 - DNA, 16 bp, Homo sapiens
tgcagtcagcacagag

SEQ ID NO: 607558 - DNA, 17 bp, Homo sapiens
tgcagtcagcacagaga

SEQ ID NO: 607559 - DNA, 16 bp, Homo sapiens
tgcagttagcacagag

SEQ ID NO: 607560 - DNA, 14 bp, Homo sapiens
tgcagtttggccct

SEQ ID NO: 607561 - DNA, 16 bp, Homo sapiens
tgcagtttggccctgg

SEQ ID NO: 607562 - DNA, 20 bp, Homo sapiens
tgcagtttggccctggagcc

SEQ ID NO: 607563 - DNA, 13 bp, Homo sapiens
tgcataagattat

SEQ ID NO: 607564 - DNA, 20 bp, Homo sapiens
tgcataagattatatacaaa

SEQ ID NO: 607565 - DNA, 15 bp, Homo sapiens
tgcataatatgcata

SEQ ID NO: 607566 - DNA, 16 bp, Homo sapiens
tgcataatatgcatat

SEQ ID NO: 607567 - DNA, 17 bp, Homo sapiens
tgcataatatgcatata

SEQ ID NO: 607568 - DNA, 14 bp, Homo sapiens
tgcatattaaagaa

SEQ ID NO: 607569 - DNA, 13 bp, Homo sapiens
tgcatgttaaaat

SEQ ID NO: 607570 - DNA, 13 bp, Homo sapiens
tgcattcagatct

SEQ ID NO: 607571 - DNA, 20 bp, Homo sapiens
tgcattcattcatcctctta

SEQ ID NO: 607572 - DNA, 22 bp, Homo sapiens
tgcattcattcatcctcttata

SEQ ID NO: 607573 - DNA, 16 bp, Homo sapiens
tgcatttagcatgagt

SEQ ID NO: 607574 - DNA, 14 bp, Homo sapiens
tgccaaagatagca

SEQ ID NO: 607575 - DNA, 12 bp, Homo sapiens
tgccaacattgc

SEQ ID NO: 607576 - DNA, 14 bp, Homo sapiens
tgccaacattgcct

SEQ ID NO: 607577 - DNA, 16 bp, Homo sapiens
tgccaagagtccaagc

SEQ ID NO: 607578 - DNA, 15 bp, Homo sapiens
tgccaatgtccaggt

SEQ ID NO: 607579 - DNA, 23 bp, Homo sapiens
tgccaatgtccaggtcacaggca

SEQ ID NO: 607580 - DNA, 22 bp, Homo sapiens
tgccactgacaggaaagtggat

SEQ ID NO: 607581 - DNA, 21 bp, Homo sapiens
tgccagacgtgctcctgctga

SEQ ID NO: 607582 - DNA, 19 bp, Homo sapiens
tgccagcgcagcgccaggg

SEQ ID NO: 607583 - DNA, 22 bp, Homo sapiens
tgccagggacattttcaagaca

SEQ ID NO: 607584 - DNA, 14 bp, Homo sapiens
tgccatctccaccc

SEQ ID NO: 607585 - DNA, 15 bp, Homo sapiens
tgccatgaggccttt

SEQ ID NO: 607586 - DNA, 16 bp, Homo sapiens
tgccatgtatgttgca

SEQ ID NO: 607587 - DNA, 17 bp, Homo sapiens
tgccatttcctcctggg

SEQ ID NO: 607588 - DNA, 16 bp, Homo sapiens
tgccattttgtctggc

SEQ ID NO: 607589 - DNA, 18 bp, Homo sapiens
tgccattttttgtctgtg

SEQ ID NO: 607590 - DNA, 19 bp, Homo sapiens
tgccattttttgtctgtga

SEQ ID NO: 607591 - DNA, 19 bp, Homo sapiens
tgcccacatttgggctcag

SEQ ID NO: 607592 - DNA, 21 bp, Homo sapiens
tgcccacccgtgttctcctcc

SEQ ID NO: 607593 - DNA, 11 bp, Homo sapiens
tgcccaccctg

SEQ ID NO: 607594 - DNA, 12 bp, Homo sapiens
tgcccaccctgg

SEQ ID NO: 607595 - DNA, 20 bp, Homo sapiens
tgcccaccctgggcctcccg

SEQ ID NO: 607596 - DNA, 21 bp, Homo sapiens
tgcccacgtgcagcacctgtc

SEQ ID NO: 607597 - DNA, 22 bp, Homo sapiens
tgcccacgtgcagcacctgtca

SEQ ID NO: 607598 - DNA, 24 bp, Homo sapiens
tgcccacgtgcagcacctgtcacc

SEQ ID NO: 607599 - DNA, 13 bp, Homo sapiens
tgcccagcacctc

SEQ ID NO: 607600 - DNA, 20 bp, Homo sapiens
tgcccaggggacgtggcgct

SEQ ID NO: 607601 - DNA, 15 bp, Homo sapiens
tgcccagtcttgagt

SEQ ID NO: 607602 - DNA, 19 bp, Homo sapiens
tgcccagtcttgagtgggc

SEQ ID NO: 607603 - DNA, 18 bp, Homo sapiens
tgcccatttcacacaact

SEQ ID NO: 607604 - DNA, 14 bp, Homo sapiens
tgccccagctctgg

SEQ ID NO: 607605 - DNA, 11 bp, Homo sapiens
tgcccccagcg

SEQ ID NO: 607606 - DNA, 15 bp, Homo sapiens
tgccccccatgccct

SEQ ID NO: 607607 - DNA, 20 bp, Homo sapiens
tgccccccatgccctccctg

SEQ ID NO: 607608 - DNA, 11 bp, Homo sapiens
tgccccccttc

SEQ ID NO: 607609 - DNA, 15 bp, Homo sapiens
tgccccccttcccac

SEQ ID NO: 607610 - DNA, 20 bp, Homo sapiens
tgccccctcccccgcagaca

SEQ ID NO: 607611 - DNA, 20 bp, Homo sapiens
tgcccctccgtccccagggt

SEQ ID NO: 607612 - DNA, 14 bp, Homo sapiens
tgcccctcttagaa

SEQ ID NO: 607613 - DNA, 16 bp, Homo sapiens
tgcccctgcagtttgg

SEQ ID NO: 607614 - DNA, 23 bp, Homo sapiens
tgcccctgcagtttggccctgga

SEQ ID NO: 607615 - DNA, 15 bp, Homo sapiens
tgcccctggccctgc

SEQ ID NO: 607616 - DNA, 13 bp, Homo sapiens
tgcccctgggaac

SEQ ID NO: 607617 - DNA, 19 bp, Homo sapiens
tgccccttccccatgctca

SEQ ID NO: 607618 - DNA, 18 bp, Homo sapiens
tgccccttgaccccacac

SEQ ID NO: 607619 - DNA, 21 bp, Homo sapiens
tgccccttgaccccacacgcc

SEQ ID NO: 607620 - DNA, 22 bp, Homo sapiens
tgcccgcgcccgccgcctccct

SEQ ID NO: 607621 - DNA, 20 bp, Homo sapiens
tgccctcactccactcccct

SEQ ID NO: 607622 - DNA, 12 bp, Homo sapiens
tgccctccccca

SEQ ID NO: 607623 - DNA, 15 bp, Homo sapiens
tgccctcccccacgg

SEQ ID NO: 607624 - DNA, 19 bp, Homo sapiens
tgccctccctgctgccagg

SEQ ID NO: 607625 - DNA, 15 bp, Homo sapiens
tgccctccgcccttc

SEQ ID NO: 607626 - DNA, 18 bp, Homo sapiens
tgccctccgcccttccct

SEQ ID NO: 607627 - DNA, 16 bp, Homo sapiens
tgccctgcctgaggag

SEQ ID NO: 607628 - DNA, 12 bp, Homo sapiens
tgccctggggca

SEQ ID NO: 607629 - DNA, 22 bp, Homo sapiens
tgccctggggcatccaccttcc

SEQ ID NO: 607630 - DNA, 15 bp, Homo sapiens
tgccgcatctgcctg

SEQ ID NO: 607631 - DNA, 16 bp, Homo sapiens
tgccgcatctgcctgg

SEQ ID NO: 607632 - DNA, 22 bp, Homo sapiens
tgccgcatctgcctggagcctg

SEQ ID NO: 607633 - DNA, 14 bp, Homo sapiens
tgccgcctgtgccc

SEQ ID NO: 607634 - DNA, 16 bp, Homo sapiens
tgccggtggggccagc

SEQ ID NO: 607635 - DNA, 20 bp, Homo sapiens
tgccggtggggccagcgctg

SEQ ID NO: 607636 - DNA, 12 bp, Homo sapiens
tgccgtctttgg

SEQ ID NO: 607637 - DNA, 14 bp, Homo sapiens
tgccgtggcaactg

SEQ ID NO: 607638 - DNA, 22 bp, Homo sapiens
tgcctcagccagtggcacagga

SEQ ID NO: 607639 - DNA, 22 bp, Homo sapiens
tgcctccctggggaccaggagc

SEQ ID NO: 607640 - DNA, 23 bp, Homo sapiens
tgcctccctggggaccaggagct

SEQ ID NO: 607641 - DNA, 21 bp, Homo sapiens
tgcctctatccctggccacct

SEQ ID NO: 607642 - DNA, 11 bp, Homo sapiens
tgcctgaggag

SEQ ID NO: 607643 - DNA, 21 bp, Homo sapiens
tgcctgctgtgttaagaggac

SEQ ID NO: 607644 - DNA, 17 bp, Homo sapiens
tgcctggagcctgggca

SEQ ID NO: 607645 - DNA, 17 bp, Homo sapiens
tgcctggcgggcagccc

SEQ ID NO: 607646 - DNA, 20 bp, Homo sapiens
tgcctggcgggcagcccctg

SEQ ID NO: 607647 - DNA, 22 bp, Homo sapiens
tgcctggcgggcagcccctgct

SEQ ID NO: 607648 - DNA, 23 bp, Homo sapiens
tgcctggcgggcagcccctgctg

SEQ ID NO: 607649 - DNA, 12 bp, Homo sapiens
tgcctggctggg

SEQ ID NO: 607650 - DNA, 14 bp, Homo sapiens
tgcctgggcccagg

SEQ ID NO: 607651 - DNA, 18 bp, Homo sapiens
tgcctgggcccaggccca

SEQ ID NO: 607652 - DNA, 14 bp, Homo sapiens
tgcctgtggtgagg

SEQ ID NO: 607653 - DNA, 16 bp, Homo sapiens
tgccttatattatttt

SEQ ID NO: 607654 - DNA, 15 bp, Homo sapiens
tgccttcagccctaa

SEQ ID NO: 607655 - DNA, 13 bp, Homo sapiens
tgccttctgggga

SEQ ID NO: 607656 - DNA, 14 bp, Homo sapiens
tgccttctggggag

SEQ ID NO: 607657 - DNA, 22 bp, Homo sapiens
tgccttctggggagggacacag

SEQ ID NO: 607658 - DNA, 24 bp, Homo sapiens
tgccttgggcgggccatttcacat

SEQ ID NO: 607659 - DNA, 15 bp, Homo sapiens
tgcctttctagcaat

SEQ ID NO: 607660 - DNA, 16 bp, Homo sapiens
tgcgaccatgtgtaga

SEQ ID NO: 607661 - DNA, 12 bp, Homo sapiens
tgcgcccctgcc

SEQ ID NO: 607662 - DNA, 15 bp, Homo sapiens
tgcgcccctgcccag

SEQ ID NO: 607663 - DNA, 17 bp, Homo sapiens
tgcgcccctgcccagca

SEQ ID NO: 607664 - DNA, 14 bp, Homo sapiens
tgcgccctccctcc

SEQ ID NO: 607665 - DNA, 17 bp, Homo sapiens
tgcgccctgacatgcta

SEQ ID NO: 607666 - DNA, 18 bp, Homo sapiens
tgcgcctcctcctgcatg

SEQ ID NO: 607667 - DNA, 16 bp, Homo sapiens
tgcgcgcagctggcgc

SEQ ID NO: 607668 - DNA, 12 bp, Homo sapiens
tgcgctcctctg

SEQ ID NO: 607669 - DNA, 15 bp, Homo sapiens
tgcgctcctctgcag

SEQ ID NO: 607670 - DNA, 16 bp, Homo sapiens
tgcgctcctctgcagc

SEQ ID NO: 607671 - DNA, 19 bp, Homo sapiens
tgcgctcctctgcagcctg

SEQ ID NO: 607672 - DNA, 16 bp, Homo sapiens
tgcggaccggagcggc

SEQ ID NO: 607673 - DNA, 15 bp, Homo sapiens
tgcggcaccgcccac

SEQ ID NO: 607674 - DNA, 19 bp, Homo sapiens
tgcggcaccgcccacccac

SEQ ID NO: 607675 - DNA, 22 bp, Homo sapiens
tgcgtgccacatcaataacaac

SEQ ID NO: 607676 - DNA, 13 bp, Homo sapiens
tgcgtggaccccg

SEQ ID NO: 607677 - DNA, 12 bp, Homo sapiens
tgcgtgtggccc

SEQ ID NO: 607678 - DNA, 19 bp, Homo sapiens
tgcgtgtggccctgtggga

SEQ ID NO: 607679 - DNA, 21 bp, Homo sapiens
tgcgtgtggccctgtgggagt

SEQ ID NO: 607680 - DNA, 19 bp, Homo sapiens
tgcgtgtgttctctccgga

SEQ ID NO: 607681 - DNA, 21 bp, Homo sapiens
tgctaaagtcaggccattcag

SEQ ID NO: 607682 - DNA, 22 bp, Homo sapiens
tgctaaagtcaggccattcagt

SEQ ID NO: 607683 - DNA, 20 bp, Homo sapiens
tgctatttgtgtaactgaaa

SEQ ID NO: 607684 - DNA, 14 bp, Homo sapiens
tgctcaatgtgctg

SEQ ID NO: 607685 - DNA, 18 bp, Homo sapiens
tgctcaatgtgctgttga

SEQ ID NO: 607686 - DNA, 22 bp, Homo sapiens
tgctcaatgtgctgttgattct

SEQ ID NO: 607687 - DNA, 22 bp, Homo sapiens
tgctcacgtctgtgagtctgtc

SEQ ID NO: 607688 - DNA, 13 bp, Homo sapiens
tgctcagcccatc

SEQ ID NO: 607689 - DNA, 15 bp, Homo sapiens
tgctcagcccatccc

SEQ ID NO: 607690 - DNA, 21 bp, Homo sapiens
tgctcagcccatcccctgcct

SEQ ID NO: 607691 - DNA, 12 bp, Homo sapiens
tgctcagtattg

SEQ ID NO: 607692 - DNA, 13 bp, Homo sapiens
tgctcagtattga

SEQ ID NO: 607693 - DNA, 22 bp, Homo sapiens
tgctcagtattgagacactgtc

SEQ ID NO: 607694 - DNA, 20 bp, Homo sapiens
tgctcatctacacatataaa

SEQ ID NO: 607695 - DNA, 15 bp, Homo sapiens
tgctccattcctgag

SEQ ID NO: 607696 - DNA, 19 bp, Homo sapiens
tgctcccggctctgaggct

SEQ ID NO: 607697 - DNA, 14 bp, Homo sapiens
tgctccctgctccc

SEQ ID NO: 607698 - DNA, 20 bp, Homo sapiens
tgctcctccagtacaataaa

SEQ ID NO: 607699 - DNA, 21 bp, Homo sapiens
tgctcctccagtacaataaat

SEQ ID NO: 607700 - DNA, 14 bp, Homo sapiens
tgctcctgcccacg

SEQ ID NO: 607701 - DNA, 18 bp, Homo sapiens
tgctcgccctgtgccctc

SEQ ID NO: 607702 - DNA, 22 bp, Homo sapiens
tgctcgccctgtgccctctcac

SEQ ID NO: 607703 - DNA, 12 bp, Homo sapiens
tgctctacctgg

SEQ ID NO: 607704 - DNA, 18 bp, Homo sapiens
tgctctccattcttttaa

SEQ ID NO: 607705 - DNA, 17 bp, Homo sapiens
tgctctctaagaattca

SEQ ID NO: 607706 - DNA, 19 bp, Homo sapiens
tgctgaataacaacaattt

SEQ ID NO: 607707 - DNA, 19 bp, Homo sapiens
tgctgagggggctctttcc

SEQ ID NO: 607708 - DNA, 18 bp, Homo sapiens
tgctgatggtgcaatgac

SEQ ID NO: 607709 - DNA, 23 bp, Homo sapiens
tgctgatggtgcaatgacctttc

SEQ ID NO: 607710 - DNA, 17 bp, Homo sapiens
tgctgcactgccctccg

SEQ ID NO: 607711 - DNA, 20 bp, Homo sapiens
tgctgcagcttctaactggt

SEQ ID NO: 607712 - DNA, 24 bp, Homo sapiens
tgctgccccacaacacaccttgcc

SEQ ID NO: 607713 - DNA, 17 bp, Homo sapiens
tgctgctcgggaaggcc

SEQ ID NO: 607714 - DNA, 19 bp, Homo sapiens
tgctgctcgggaaggcctg

SEQ ID NO: 607715 - DNA, 13 bp, Homo sapiens
tgctgctgcctcc

SEQ ID NO: 607716 - DNA, 13 bp, Homo sapiens
tgctgctgtggca

SEQ ID NO: 607717 - DNA, 13 bp, Homo sapiens
tgctgcttctccc

SEQ ID NO: 607718 - DNA, 16 bp, Homo sapiens
tgctgcttctccctgg

SEQ ID NO: 607719 - DNA, 14 bp, Homo sapiens
tgctgctttccaac

SEQ ID NO: 607720 - DNA, 20 bp, Homo sapiens
tgctgcttttgatggctatg

SEQ ID NO: 607721 - DNA, 12 bp, Homo sapiens
tgctggctgggg

SEQ ID NO: 607722 - DNA, 13 bp, Homo sapiens
tgctggctggggc

SEQ ID NO: 607723 - DNA, 18 bp, Homo sapiens
tgctgggccagggaaaca

SEQ ID NO: 607724 - DNA, 19 bp, Homo sapiens
tgctggggcagggcccagg

SEQ ID NO: 607725 - DNA, 20 bp, Homo sapiens
tgctgtaaataaaaatagct

SEQ ID NO: 607726 - DNA, 18 bp, Homo sapiens
tgctgtatacaaacaggt

SEQ ID NO: 607727 - DNA, 19 bp, Homo sapiens
tgctgtatttgaggaaact

SEQ ID NO: 607728 - DNA, 19 bp, Homo sapiens
tgctgtccctgtgggctca

SEQ ID NO: 607729 - DNA, 20 bp, Homo sapiens
tgctgtccctgtgggctcac

SEQ ID NO: 607730 - DNA, 23 bp, Homo sapiens
tgctgtccctgtgggctcacacc

SEQ ID NO: 607731 - DNA, 21 bp, Homo sapiens
tgctgtctgtgtgaggctccc

SEQ ID NO: 607732 - DNA, 16 bp, Homo sapiens
tgctgtgaaatgactg

SEQ ID NO: 607733 - DNA, 13 bp, Homo sapiens
tgctgtggcatca

SEQ ID NO: 607734 - DNA, 19 bp, Homo sapiens
tgctgtgtagctctgtcca

SEQ ID NO: 607735 - DNA, 13 bp, Homo sapiens
tgctgtgtgcaga

SEQ ID NO: 607736 - DNA, 23 bp, Homo sapiens
tgctgtttaccgcccacccagca

SEQ ID NO: 607737 - DNA, 17 bp, Homo sapiens
tgcttaaataaaaatta

SEQ ID NO: 607738 - DNA, 20 bp, Homo sapiens
tgcttaaggaaaagagaaac

SEQ ID NO: 607739 - DNA, 16 bp, Homo sapiens
tgcttatgtcatttct

SEQ ID NO: 607740 - DNA, 23 bp, Homo sapiens
tgcttcaaggatcctgagccaga

SEQ ID NO: 607741 - DNA, 12 bp, Homo sapiens
tgcttcacacaa

SEQ ID NO: 607742 - DNA, 15 bp, Homo sapiens
tgcttcacacaaagt

SEQ ID NO: 607743 - DNA, 16 bp, Homo sapiens
tgcttcacacaaagtg

SEQ ID NO: 607744 - DNA, 21 bp, Homo sapiens
tgcttcacacaaagtgaaatt

SEQ ID NO: 607745 - DNA, 19 bp, Homo sapiens
tgcttcattaaaacaagag

SEQ ID NO: 607746 - DNA, 15 bp, Homo sapiens
tgcttctactccatg

SEQ ID NO: 607747 - DNA, 14 bp, Homo sapiens
tgcttctccctggg

SEQ ID NO: 607748 - DNA, 16 bp, Homo sapiens
tgcttctccctgggga

SEQ ID NO: 607749 - DNA, 17 bp, Homo sapiens
tgcttctttcctcttaa

SEQ ID NO: 607750 - DNA, 18 bp, Homo sapiens
tgcttgaccctgaaatat

SEQ ID NO: 607751 - DNA, 18 bp, Homo sapiens
tgcttgagcatgcccaaa

SEQ ID NO: 607752 - DNA, 18 bp, Homo sapiens
tgctttcagtgcctgctg

SEQ ID NO: 607753 - DNA, 19 bp, Homo sapiens
tgctttcatccaactggaa

SEQ ID NO: 607754 - DNA, 18 bp, Homo sapiens
tgctttcatgtttaagaa

SEQ ID NO: 607755 - DNA, 15 bp, Homo sapiens
tgctttccctgagga

SEQ ID NO: 607756 - DNA, 19 bp, Homo sapiens
tgctttccctgaggaatga

SEQ ID NO: 607757 - DNA, 12 bp, Homo sapiens
tgctttctcatg

SEQ ID NO: 607758 - DNA, 21 bp, Homo sapiens
tgctttctccatttatttaaa

SEQ ID NO: 607759 - DNA, 16 bp, Homo sapiens
tgctttctgatacatc

SEQ ID NO: 607760 - DNA, 19 bp, Homo sapiens
tgctttctgatacatctgt

SEQ ID NO: 607761 - DNA, 23 bp, Homo sapiens
tgctttggggcttatcagaactc

SEQ ID NO: 607762 - DNA, 12 bp, Homo sapiens
tgctttttctga

SEQ ID NO: 607763 - DNA, 17 bp, Homo sapiens
tggaaaaaaaaaaatat

SEQ ID NO: 607764 - DNA, 14 bp, Homo sapiens
tggaaacatctgat

SEQ ID NO: 607765 - DNA, 14 bp, Homo sapiens
tggaacactctgag

SEQ ID NO: 607766 - DNA, 15 bp, Homo sapiens
tggaacactctgaga

SEQ ID NO: 607767 - DNA, 19 bp, Homo sapiens
tggaagaagggccaccctg

SEQ ID NO: 607768 - DNA, 20 bp, Homo sapiens
tggaagaagggccaccctga

SEQ ID NO: 607769 - DNA, 22 bp, Homo sapiens
tggaagaagggccaccctgagc

SEQ ID NO: 607770 - DNA, 12 bp, Homo sapiens
tggaagaattca

SEQ ID NO: 607771 - DNA, 16 bp, Homo sapiens
tggaagacaaatacac

SEQ ID NO: 607772 - DNA, 19 bp, Homo sapiens
tggaagagctgctgtattt

SEQ ID NO: 607773 - DNA, 22 bp, Homo sapiens
tggaagcagcaaggtgggggtc

SEQ ID NO: 607774 - DNA, 14 bp, Homo sapiens
tggaatcacagcca

SEQ ID NO: 607775 - DNA, 15 bp, Homo sapiens
tggaatcacagccaa

SEQ ID NO: 607776 - DNA, 18 bp, Homo sapiens
tggaatctactagaacct

SEQ ID NO: 607777 - DNA, 13 bp, Homo sapiens
tggaatgcaattt

SEQ ID NO: 607778 - DNA, 13 bp, Homo sapiens
tggaattacataa

SEQ ID NO: 607779 - DNA, 18 bp, Homo sapiens
tggaattacataacaggc

SEQ ID NO: 607780 - DNA, 21 bp, Homo sapiens
tggaattacataacaggcatt

SEQ ID NO: 607781 - DNA, 20 bp, Homo sapiens
tggaattattagcaccagct

SEQ ID NO: 607782 - DNA, 17 bp, Homo sapiens
tggaatttatgaatggt

SEQ ID NO: 607783 - DNA, 16 bp, Homo sapiens
tggacaatttaccaca

SEQ ID NO: 607784 - DNA, 15 bp, Homo sapiens
tggacatttatgtac

SEQ ID NO: 607785 - DNA, 17 bp, Homo sapiens
tggacgtgggctccagg

SEQ ID NO: 607786 - DNA, 14 bp, Homo sapiens
tggacgtgtgagga

SEQ ID NO: 607787 - DNA, 20 bp, Homo sapiens
tggagaagggttctgccctg

SEQ ID NO: 607788 - DNA, 14 bp, Homo sapiens
tggtgtcttgagac

SEQ ID NO: 607789 - DNA, 16 bp, Homo sapiens
tggtgtcttgagacca

SEQ ID NO: 607790 - DNA, 18 bp, Homo sapiens
tggtgtcttgagaccagc

SEQ ID NO: 607791 - DNA, 19 bp, Homo sapiens
tggtgttgttatggcaagt

SEQ ID NO: 607792 - DNA, 23 bp, Homo sapiens
tggttaaccgggactacagaagt

SEQ ID NO: 607793 - DNA, 12 bp, Homo sapiens
tggttaacttaa

SEQ ID NO: 607794 - DNA, 19 bp, Homo sapiens
tggttaatgaaaaatctga

SEQ ID NO: 607795 - DNA, 16 bp, Homo sapiens
tggttacctattgctg

SEQ ID NO: 607796 - DNA, 16 bp, Homo sapiens
tggttcctcatggctg

SEQ ID NO: 607797 - DNA, 13 bp, Homo sapiens
tggttcctccagc

SEQ ID NO: 607798 - DNA, 14 bp, Homo sapiens
tggttcctccagca

SEQ ID NO: 607799 - DNA, 20 bp, Homo sapiens
tggttctttatcatttctct

SEQ ID NO: 607800 - DNA, 17 bp, Homo sapiens
tggttctttcttttctt

SEQ ID NO: 607801 - DNA, 22 bp, Homo sapiens
tggtttagcgttgttttgtgga

SEQ ID NO: 607802 - DNA, 23 bp, Homo sapiens
tggtttagcgttgttttgtggat

SEQ ID NO: 607803 - DNA, 14 bp, Homo sapiens
tgtaaaacagtggt

SEQ ID NO: 607804 - DNA, 13 bp, Homo sapiens
tgtaaaactgtga

SEQ ID NO: 607805 - DNA, 17 bp, Homo sapiens
tgtaaacatcataaata

SEQ ID NO: 607806 - DNA, 18 bp, Homo sapiens
tgtaaagatattgtatct

SEQ ID NO: 607807 - DNA, 22 bp, Homo sapiens
tgtaaagatattgtatctcctt

SEQ ID NO: 607808 - DNA, 20 bp, Homo sapiens
tgtaaaggtaggtgcatgcc

SEQ ID NO: 607809 - DNA, 15 bp, Homo sapiens
tgtaaataaaaatag

SEQ ID NO: 607810 - DNA, 17 bp, Homo sapiens
tgtaacattctatttca

SEQ ID NO: 607811 - DNA, 15 bp, Homo sapiens
tgtaactaagttatt

SEQ ID NO: 607812 - DNA, 23 bp, Homo sapiens
tgtaagacacgtgcaacagactg

SEQ ID NO: 607813 - DNA, 18 bp, Homo sapiens
tgtaatacaccaaatagc

SEQ ID NO: 607814 - DNA, 16 bp, Homo sapiens
tgtaatagcctcacct

SEQ ID NO: 607815 - DNA, 16 bp, Homo sapiens
tgtaatatcagttaca

SEQ ID NO: 607816 - DNA, 15 bp, Homo sapiens
tgtaatattttgctg

SEQ ID NO: 607817 - DNA, 19 bp, Homo sapiens
tgtaatcacactctcttct

SEQ ID NO: 607818 - DNA, 14 bp, Homo sapiens
tgtacaaataatat

SEQ ID NO: 607819 - DNA, 11 bp, Homo sapiens
tgtacacacac

SEQ ID NO: 607820 - DNA, 12 bp, Homo sapiens
tgtacacacaca

SEQ ID NO: 607821 - DNA, 16 bp, Homo sapiens
tgtacacacacagaca

SEQ ID NO: 607822 - DNA, 23 bp, Homo sapiens
tgtacagaaccagcactcccagg

SEQ ID NO: 607823 - DNA, 20 bp, Homo sapiens
tgtacagtgttctgtttaat

SEQ ID NO: 607824 - DNA, 16 bp, Homo sapiens
tgtacatttatgtgtg

SEQ ID NO: 607825 - DNA, 20 bp, Homo sapiens
tgtacatttatgtgtgaagc

SEQ ID NO: 607826 - DNA, 16 bp, Homo sapiens
tgtacatttgatttga

SEQ ID NO: 607827 - DNA, 13 bp, Homo sapiens
tgtactaccccag

SEQ ID NO: 607828 - DNA, 23 bp, Homo sapiens
tgtacttacactgaaatccaaaa

SEQ ID NO: 607829 - DNA, 18 bp, Homo sapiens
tgtacttcagttctcatc

SEQ ID NO: 607830 - DNA, 20 bp, Homo sapiens
tgtacttgatttttcaaaga

SEQ ID NO: 607831 - DNA, 17 bp, Homo sapiens
tgtacttttatcttaaa

SEQ ID NO: 607832 - DNA, 14 bp, Homo sapiens
tgtagaagatgacc

SEQ ID NO: 607833 - DNA, 11 bp, Homo sapiens
tgtagatgaaa

SEQ ID NO: 607834 - DNA, 19 bp, Homo sapiens
tgtagctctgaatgctatt

SEQ ID NO: 607835 - DNA, 14 bp, Homo sapiens
tgtagcttctgaaa

SEQ ID NO: 607836 - DNA, 20 bp, Homo sapiens
tgtagctttaaaaccacagc

SEQ ID NO: 607837 - DNA, 21 bp, Homo sapiens
tgtagtttttgttcaccttct

SEQ ID NO: 607838 - DNA, 17 bp, Homo sapiens
tgtatacaaacaggtgc

SEQ ID NO: 607839 - DNA, 20 bp, Homo sapiens
tgtatacaaacaggtgctaa

SEQ ID NO: 607840 - DNA, 20 bp, Homo sapiens
tgtatagggaattttcattt

SEQ ID NO: 607841 - DNA, 16 bp, Homo sapiens
tgtatatatatgtgaa

SEQ ID NO: 607842 - DNA, 23 bp, Homo sapiens
tgtatatatttattattttcata

SEQ ID NO: 607843 - DNA, 14 bp, Homo sapiens
tgtatatcagctct

SEQ ID NO: 607844 - DNA, 18 bp, Homo sapiens
tgtatatgaggatgtatg

SEQ ID NO: 607845 - DNA, 19 bp, Homo sapiens
tgtatatgaggatgtatgt

SEQ ID NO: 607846 - DNA, 19 bp, Homo sapiens
tgtatatgtttatacacac

SEQ ID NO: 607847 - DNA, 21 bp, Homo sapiens
tgtatattgatgtaactgtgt

SEQ ID NO: 607848 - DNA, 15 bp, Homo sapiens
tgtatctgacatatt

SEQ ID NO: 607849 - DNA, 17 bp, Homo sapiens
tgtatgccatgtatgtt

SEQ ID NO: 607850 - DNA, 20 bp, Homo sapiens
tgtatggaagacaaatacac

SEQ ID NO: 607851 - DNA, 13 bp, Homo sapiens
tgtatgtgccagt

SEQ ID NO: 607852 - DNA, 16 bp, Homo sapiens
tgtatgtgtatatgtt

SEQ ID NO: 607853 - DNA, 15 bp, Homo sapiens
tgtatgttgcatgaa

SEQ ID NO: 607854 - DNA, 15 bp, Homo sapiens
tgtattattatatat

SEQ ID NO: 607855 - DNA, 16 bp, Homo sapiens
tgtattttaataaaga

SEQ ID NO: 607856 - DNA, 13 bp, Homo sapiens
tgtattttattgt

SEQ ID NO: 607857 - DNA, 13 bp, Homo sapiens
tgtcaaatggatg

SEQ ID NO: 607858 - DNA, 15 bp, Homo sapiens
tgtcaaatggtattt

SEQ ID NO: 607859 - DNA, 19 bp, Homo sapiens
tgtcaagtttttatacctg

SEQ ID NO: 607860 - DNA, 20 bp, Homo sapiens
tgtcaagtttttatacctgt

SEQ ID NO: 607861 - DNA, 22 bp, Homo sapiens
tgtcaagtttttatacctgtac

SEQ ID NO: 607862 - DNA, 19 bp, Homo sapiens
tgtcaatatatagagactt

SEQ ID NO: 607863 - DNA, 15 bp, Homo sapiens
tgtcacactgagctg

SEQ ID NO: 607864 - DNA, 22 bp, Homo sapiens
tgtcacttttttcctgtcaata

SEQ ID NO: 607865 - DNA, 13 bp, Homo sapiens
tgtcagcttccca

SEQ ID NO: 607866 - DNA, 15 bp, Homo sapiens
tgtcagcttcccaac

SEQ ID NO: 607867 - DNA, 14 bp, Homo sapiens
tgtcaggctctgaa

SEQ ID NO: 607868 - DNA, 23 bp, Homo sapiens
tgtcaggctctgaatctctcaaa

SEQ ID NO: 607869 - DNA, 15 bp, Homo sapiens
tgtcagtactttctt

SEQ ID NO: 607870 - DNA, 21 bp, Homo sapiens
tgtcatcaagtagtagtactt

SEQ ID NO: 607871 - DNA, 15 bp, Homo sapiens
tgtcatctgtcagct

SEQ ID NO: 607872 - DNA, 16 bp, Homo sapiens
tgtcatctgtcagctt

SEQ ID NO: 607873 - DNA, 18 bp, Homo sapiens
tgtcatctgtcagcttcc

SEQ ID NO: 607874 - DNA, 18 bp, Homo sapiens
tgtcatgtgcgaacacag

SEQ ID NO: 607875 - DNA, 16 bp, Homo sapiens
tgtcattggttacaaa

SEQ ID NO: 607876 - DNA, 20 bp, Homo sapiens
tgtcattttcagatccttcc

SEQ ID NO: 607877 - DNA, 22 bp, Homo sapiens
tgtcattttcagatccttccaa

SEQ ID NO: 607878 - DNA, 21 bp, Homo sapiens
tgtccaggcagtagatcattt

SEQ ID NO: 607879 - DNA, 16 bp, Homo sapiens
tgtccattcactttca

SEQ ID NO: 607880 - DNA, 19 bp, Homo sapiens
tgtccattgacatgtacag

SEQ ID NO: 607881 - DNA, 19 bp, Homo sapiens
tgtcccacccccagcagct

SEQ ID NO: 607882 - DNA, 22 bp, Homo sapiens
tgtccccagttaatgtgccaaa

SEQ ID NO: 607883 - DNA, 15 bp, Homo sapiens
tgtccctaaacatag

SEQ ID NO: 607884 - DNA, 16 bp, Homo sapiens
tgtccctgtgggctca

SEQ ID NO: 607885 - DNA, 19 bp, Homo sapiens
tgtccctgtgggctcacac

SEQ ID NO: 607886 - DNA, 15 bp, Homo sapiens
tgtcccttacctggc

SEQ ID NO: 607887 - DNA, 13 bp, Homo sapiens
tgtccgtcctgct

SEQ ID NO: 607888 - DNA, 15 bp, Homo sapiens
tgtccgtctgtcctg

SEQ ID NO: 607889 - DNA, 17 bp, Homo sapiens
tgtccgtctgtcctgcg

SEQ ID NO: 607890 - DNA, 21 bp, Homo sapiens
tgtcctatccccggacgcatg

SEQ ID NO: 607891 - DNA, 16 bp, Homo sapiens
tgtcctatccctggac

SEQ ID NO: 607892 - DNA, 20 bp, Homo sapiens
tgtcctctgtccgtctgtcc

SEQ ID NO: 607893 - DNA, 16 bp, Homo sapiens
tgtcctgcgcctgcgc

SEQ ID NO: 607894 - DNA, 18 bp, Homo sapiens
tgtcctgctcacgtctgt

SEQ ID NO: 607895 - DNA, 17 bp, Homo sapiens
tgtcctgtgtcatctgt

SEQ ID NO: 607896 - DNA, 13 bp, Homo sapiens
tgtcctttatgta

SEQ ID NO: 607897 - DNA, 21 bp, Homo sapiens
tgtcctttatgtattctcttc

SEQ ID NO: 607898 - DNA, 14 bp, Homo sapiens
tgtcgggcatgaca

SEQ ID NO: 607899 - DNA, 23 bp, Homo sapiens
tgtcgggcccgcactcaggagca

SEQ ID NO: 607900 - DNA, 12 bp, Homo sapiens
tgtctaaagatc

SEQ ID NO: 607901 - DNA, 21 bp, Homo sapiens
tgtctaaagatctttttttaa

SEQ ID NO: 607902 - DNA, 19 bp, Homo sapiens
tgtctaaggaatgatccaa

SEQ ID NO: 607903 - DNA, 13 bp, Homo sapiens
tgtctataggact

SEQ ID NO: 607904 - DNA, 13 bp, Homo sapiens
tgtctatttctgc

SEQ ID NO: 607905 - DNA, 20 bp, Homo sapiens
tggctgggtttgggcagtgg

SEQ ID NO: 607906 - DNA, 18 bp, Homo sapiens
tggctgtcccctgcaagt

SEQ ID NO: 607907 - DNA, 15 bp, Homo sapiens
tggcttaaacatttt

SEQ ID NO: 607908 - DNA, 22 bp, Homo sapiens
tggcttgtagggtgaggcgtgg

SEQ ID NO: 607909 - DNA, 12 bp, Homo sapiens
tggctttgtgct

SEQ ID NO: 607910 - DNA, 23 bp, Homo sapiens
tgggaaatgctgatttaaacttc

SEQ ID NO: 607911 - DNA, 19 bp, Homo sapiens
tgggaacatgacccagcct

SEQ ID NO: 607912 - DNA, 21 bp, Homo sapiens
tgggaacatgacccagcctga

SEQ ID NO: 607913 - DNA, 14 bp, Homo sapiens
tgggaagagaagaa

SEQ ID NO: 607914 - DNA, 18 bp, Homo sapiens
tgggacaggcaccatgct

SEQ ID NO: 607915 - DNA, 12 bp, Homo sapiens
tgggacgcccct

SEQ ID NO: 607916 - DNA, 19 bp, Homo sapiens
tgggacgctggtaactgtt

SEQ ID NO: 607917 - DNA, 15 bp, Homo sapiens
tgggacggaagtggc

SEQ ID NO: 607918 - DNA, 16 bp, Homo sapiens
tgggactggcccaccc

SEQ ID NO: 607919 - DNA, 17 bp, Homo sapiens
tgggactggcccacccc

SEQ ID NO: 607920 - DNA, 20 bp, Homo sapiens
tgggagccgtcagcctgtga

SEQ ID NO: 607921 - DNA, 16 bp, Homo sapiens
tgggagtccactttcc

SEQ ID NO: 607922 - DNA, 19 bp, Homo sapiens
tgggagtccactttcctct

SEQ ID NO: 607923 - DNA, 20 bp, Homo sapiens
tgggagtccactttcctctc

SEQ ID NO: 607924 - DNA, 23 bp, Homo sapiens
tgggagtccactttcctctctct

SEQ ID NO: 607925 - DNA, 14 bp, Homo sapiens
tgggataggagggt

SEQ ID NO: 607926 - DNA, 21 bp, Homo sapiens
tgggataggagggtgcccctg

SEQ ID NO: 607927 - DNA, 23 bp, Homo sapiens
tgggataggagggtgcccctggg

SEQ ID NO: 607928 - DNA, 14 bp, Homo sapiens
tgggatccagagag

SEQ ID NO: 607929 - DNA, 19 bp, Homo sapiens
tgggatccagagagaagca

SEQ ID NO: 607930 - DNA, 14 bp, Homo sapiens
tgggattcaggaat

SEQ ID NO: 607931 - DNA, 21 bp, Homo sapiens
tgggattcctcccctggaagt

SEQ ID NO: 607932 - DNA, 23 bp, Homo sapiens
tgggcaaggaagctttggaagca

SEQ ID NO: 607933 - DNA, 18 bp, Homo sapiens
tgggcaccctgcaggcag

SEQ ID NO: 607934 - DNA, 21 bp, Homo sapiens
tgggcaccctgcaggcaggca

SEQ ID NO: 607935 - DNA, 22 bp, Homo sapiens
tgggcaccctgcaggcaggcag

SEQ ID NO: 607936 - DNA, 13 bp, Homo sapiens
tgggcagctcctc

SEQ ID NO: 607937 - DNA, 21 bp, Homo sapiens
tgggcagggccgcagggcgct

SEQ ID NO: 607938 - DNA, 12 bp, Homo sapiens
tgggcagggtga

SEQ ID NO: 607939 - DNA, 13 bp, Homo sapiens
tgggcagtggaga

SEQ ID NO: 607940 - DNA, 13 bp, Homo sapiens
tgggccaagccag

SEQ ID NO: 607941 - DNA, 22 bp, Homo sapiens
tgggccaagccagggttccaga

SEQ ID NO: 607942 - DNA, 14 bp, Homo sapiens
tgggccagcccttg

SEQ ID NO: 607943 - DNA, 16 bp, Homo sapiens
tgggcccaggcccagc

SEQ ID NO: 607944 - DNA, 17 bp, Homo sapiens
tgggcccaggcccagcc

SEQ ID NO: 607945 - DNA, 18 bp, Homo sapiens
tgggcccaggcccagcct

SEQ ID NO: 607946 - DNA, 13 bp, Homo sapiens
tgggccctcagcg

SEQ ID NO: 607947 - DNA, 22 bp, Homo sapiens
tgggccctcagcgtctccccat

SEQ ID NO: 607948 - DNA, 21 bp, Homo sapiens
tgggcccttagaatgtgaaaa

SEQ ID NO: 607949 - DNA, 15 bp, Homo sapiens
tgggcctccatgccc

SEQ ID NO: 607950 - DNA, 22 bp, Homo sapiens
tgggcctccatgccccagctct

SEQ ID NO: 607951 - DNA, 21 bp, Homo sapiens
tgggcctcccgtccgtccgcc

SEQ ID NO: 607952 - DNA, 22 bp, Homo sapiens
tgggcgccggttccacgtgggg

SEQ ID NO: 607953 - DNA, 14 bp, Homo sapiens
tgggctcagggttg

SEQ ID NO: 607954 - DNA, 15 bp, Homo sapiens
tgggctcagggttgg

SEQ ID NO: 607955 - DNA, 20 bp, Homo sapiens
tgggctcagggttggccatt

SEQ ID NO: 607956 - DNA, 16 bp, Homo sapiens
tgggctccagagtagg

SEQ ID NO: 607957 - DNA, 14 bp, Homo sapiens
tgggctggcaccca

SEQ ID NO: 607958 - DNA, 17 bp, Homo sapiens
tgggctgttgtgtctgg

SEQ ID NO: 607959 - DNA, 16 bp, Homo sapiens
tgggctttggggctgg

SEQ ID NO: 607960 - DNA, 16 bp, Homo sapiens
tggggacaccctcctg

SEQ ID NO: 607961 - DNA, 19 bp, Homo sapiens
tggggacaccctcctgccc

SEQ ID NO: 607962 - DNA, 23 bp, Homo sapiens
tggggagcgggggctaactggcc

SEQ ID NO: 607963 - DNA, 18 bp, Homo sapiens
tggggagggacacagagg

SEQ ID NO: 607964 - DNA, 17 bp, Homo sapiens
tggggagggcgcttttg

SEQ ID NO: 607965 - DNA, 23 bp, Homo sapiens
tggggcatccaccttcctgccca

SEQ ID NO: 607966 - DNA, 21 bp, Homo sapiens
tggggccagcgctgaacagac

SEQ ID NO: 607967 - DNA, 12 bp, Homo sapiens
tggggccaggac

SEQ ID NO: 607968 - DNA, 15 bp, Homo sapiens
tggggcccatggccc

SEQ ID NO: 607969 - DNA, 14 bp, Homo sapiens
tggggcctgcgggg

SEQ ID NO: 607970 - DNA, 16 bp, Homo sapiens
tgggggctgctgcact

SEQ ID NO: 607971 - DNA, 22 bp, Homo sapiens
tgggggctgctgcactgccctc

SEQ ID NO: 607972 - DNA, 18 bp, Homo sapiens
tgggggtcaggctacagg

SEQ ID NO: 607973 - DNA, 20 bp, Homo sapiens
tggggtaagttgaagggaaa

SEQ ID NO: 607974 - DNA, 21 bp, Homo sapiens
tggggtcccccctgagtgggc

SEQ ID NO: 607975 - DNA, 19 bp, Homo sapiens
tggggtggggcttggaagg

SEQ ID NO: 607976 - DNA, 18 bp, Homo sapiens
tgggtatgtagaactgta

SEQ ID NO: 607977 - DNA, 18 bp, Homo sapiens
tgggtattttgtcagttt

SEQ ID NO: 607978 - DNA, 12 bp, Homo sapiens
tgggtccccctc

SEQ ID NO: 607979 - DNA, 13 bp, Homo sapiens
tgggtccccctcc

SEQ ID NO: 607980 - DNA, 15 bp, Homo sapiens
tgggtccccctcctg

SEQ ID NO: 607981 - DNA, 11 bp, Homo sapiens
tgggtcctgct

SEQ ID NO: 607982 - DNA, 16 bp, Homo sapiens
tgggtcctgctgctcg

SEQ ID NO: 607983 - DNA, 13 bp, Homo sapiens
tgggtcgcccctc

SEQ ID NO: 607984 - DNA, 15 bp, Homo sapiens
tgggtcgcccctcct

SEQ ID NO: 607985 - DNA, 15 bp, Homo sapiens
tgggtgaatgtgtga

SEQ ID NO: 607986 - DNA, 13 bp, Homo sapiens
tgggtgccctgtt

SEQ ID NO: 607987 - DNA, 16 bp, Homo sapiens
tgggttaacagtaaat

SEQ ID NO: 607988 - DNA, 12 bp, Homo sapiens
tgggttccagac

SEQ ID NO: 607989 - DNA, 13 bp, Homo sapiens
tgggttccagaca

SEQ ID NO: 607990 - DNA, 21 bp, Homo sapiens
tgggttgttgcagagtaaatc

SEQ ID NO: 607991 - DNA, 16 bp, Homo sapiens
tgggttttagaaattc

SEQ ID NO: 607992 - DNA, 19 bp, Homo sapiens
tgggttttgatctcagcat

SEQ ID NO: 607993 - DNA, 23 bp, Homo sapiens
tgggtttttaaaaaaaatattct

SEQ ID NO: 607994 - DNA, 22 bp, Homo sapiens
tggtaaaaagatccagggatgg

SEQ ID NO: 607995 - DNA, 15 bp, Homo sapiens
tggtatgaaacaaat

SEQ ID NO: 607996 - DNA, 17 bp, Homo sapiens
tggtatgaaacaaatat

SEQ ID NO: 607997 - DNA, 21 bp, Homo sapiens
tggtattttaacatagcagct

SEQ ID NO: 607998 - DNA, 24 bp, Homo sapiens
tggtcagtgaagcccaggaggacc

SEQ ID NO: 607999 - DNA, 18 bp, Homo sapiens
tggtcatttggtggctct

SEQ ID NO: 608000 - DNA, 21 bp, Homo sapiens
tggtcatttggtggctctaac

SEQ ID NO: 608001 - DNA, 16 bp, Homo sapiens
tggtccagggtccagc

SEQ ID NO: 608002 - DNA, 19 bp, Homo sapiens
tggtccagggtccagccct

SEQ ID NO: 608003 - DNA, 20 bp, Homo sapiens
tggtccagggtccagccctc

SEQ ID NO: 608004 - DNA, 13 bp, Homo sapiens
tggtcctgcactg

SEQ ID NO: 608005 - DNA, 15 bp, Homo sapiens
tggtccttagtaaat

SEQ ID NO: 608006 - DNA, 15 bp, Homo sapiens
tggtctctttctttc

SEQ ID NO: 608007 - DNA, 16 bp, Homo sapiens
tggtctggagccccta

SEQ ID NO: 608008 - DNA, 19 bp, Homo sapiens
tggtcttcaaattgtcttt

SEQ ID NO: 608009 - DNA, 18 bp, Homo sapiens
tggtcttggagaggaggt

SEQ ID NO: 608010 - DNA, 16 bp, Homo sapiens
tggtgaactgaagcag

SEQ ID NO: 608011 - DNA, 13 bp, Homo sapiens
tggtgcgggccag

SEQ ID NO: 608012 - DNA, 14 bp, Homo sapiens
tggtgcgggccagg

SEQ ID NO: 608013 - DNA, 22 bp, Homo sapiens
tggtgcgggccaggtctggcgc

SEQ ID NO: 608014 - DNA, 23 bp, Homo sapiens
tggtgcgggccaggtctggcgcc

SEQ ID NO: 608015 - DNA, 21 bp, Homo sapiens
tggtggcagtgcagcaaccag

SEQ ID NO: 608016 - DNA, 13 bp, Homo sapiens
tggtgggatagga

SEQ ID NO: 608017 - DNA, 14 bp, Homo sapiens
tggtgggctccaga

SEQ ID NO: 608018 - DNA, 16 bp, Homo sapiens
tggtgggctccagagt

SEQ ID NO: 608019 - DNA, 19 bp, Homo sapiens
tggtgggctccagagtagg

SEQ ID NO: 608020 - DNA, 14 bp, Homo sapiens
tggtggtttcagaa

SEQ ID NO: 608021 - DNA, 15 bp, Homo sapiens
tggtgtcctgcatgt

SEQ ID NO: 608022 - DNA, 15 bp, Homo sapiens
tggtgtcgggcatga

SEQ ID NO: 608023 - DNA, 13 bp, Homo sapiens
tgttctctccgga

SEQ ID NO: 608024 - DNA, 16 bp, Homo sapiens
tgttctgacagcattt

SEQ ID NO: 608025 - DNA, 13 bp, Homo sapiens
tgttctgtgcaac

SEQ ID NO: 608026 - DNA, 11 bp, Homo sapiens
tgttctgtggc

SEQ ID NO: 608027 - DNA, 14 bp, Homo sapiens
tgttcttgagcagc

SEQ ID NO: 608028 - DNA, 16 bp, Homo sapiens
tgttcttgagcagctg

SEQ ID NO: 608029 - DNA, 21 bp, Homo sapiens
tgttcttgagcagctgaattg

SEQ ID NO: 608030 - DNA, 15 bp, Homo sapiens
tgttgaagtgcatgt

SEQ ID NO: 608031 - DNA, 16 bp, Homo sapiens
tgttgaagtgcatgtt

SEQ ID NO: 608032 - DNA, 20 bp, Homo sapiens
tgttgaagtgcatgttaaaa

SEQ ID NO: 608033 - DNA, 15 bp, Homo sapiens
tgttgacctaccctg

SEQ ID NO: 608034 - DNA, 22 bp, Homo sapiens
tgttgagagggggatgcccctg

SEQ ID NO: 608035 - DNA, 13 bp, Homo sapiens
tgttgattaaaac

SEQ ID NO: 608036 - DNA, 21 bp, Homo sapiens
tgttgattctttcaatccaca

SEQ ID NO: 608037 - DNA, 20 bp, Homo sapiens
tgttgccatgaggcctttcc

SEQ ID NO: 608038 - DNA, 18 bp, Homo sapiens
tgttgccattttgtctgg

SEQ ID NO: 608039 - DNA, 15 bp, Homo sapiens
tgttggtatttactg

SEQ ID NO: 608040 - DNA, 21 bp, Homo sapiens
tgttggtatttactgcaatgt

SEQ ID NO: 608041 - DNA, 13 bp, Homo sapiens
tgttgtgtctgga

SEQ ID NO: 608042 - DNA, 13 bp, Homo sapiens
tgttgtgttacaa

SEQ ID NO: 608043 - DNA, 23 bp, Homo sapiens
tgttgttcgatcgtttcacatct

SEQ ID NO: 608044 - DNA, 20 bp, Homo sapiens
tgtttaaaatggcatttagc

SEQ ID NO: 608045 - DNA, 16 bp, Homo sapiens
tgtttaaggttcttgc

SEQ ID NO: 608046 - DNA, 21 bp, Homo sapiens
tgtttaataatatgtacaaat

SEQ ID NO: 608047 - DNA, 14 bp, Homo sapiens
tgtttacatcagtt

SEQ ID NO: 608048 - DNA, 13 bp, Homo sapiens
tgtttaccctccc

SEQ ID NO: 608049 - DNA, 19 bp, Homo sapiens
tgtttactgacatggtgct

SEQ ID NO: 608050 - DNA, 23 bp, Homo sapiens
tgtttactgacatggtgctgtgt

SEQ ID NO: 608051 - DNA, 19 bp, Homo sapiens
tgtttagtcagtgtactct

SEQ ID NO: 608052 - DNA, 15 bp, Homo sapiens
tgtttatacacacag

SEQ ID NO: 608053 - DNA, 22 bp, Homo sapiens
tgtttataggaaataaatctaa

SEQ ID NO: 608054 - DNA, 15 bp, Homo sapiens
tgtttcaccagtttc

SEQ ID NO: 608055 - DNA, 19 bp, Homo sapiens
tgtttcgcattaagcacac

SEQ ID NO: 608056 - DNA, 19 bp, Homo sapiens
tgtttctatatgtaacttc

SEQ ID NO: 608057 - DNA, 19 bp, Homo sapiens
tgtttctgcagtattctgt

SEQ ID NO: 608058 - DNA, 19 bp, Homo sapiens
tgtttgtcctttatgtatt

SEQ ID NO: 608059 - DNA, 17 bp, Homo sapiens
tgttttacaaagaaaca

SEQ ID NO: 608060 - DNA, 17 bp, Homo sapiens
tgttttacaatggctgg

SEQ ID NO: 608061 - DNA, 14 bp, Homo sapiens
tgttttcattctgg

SEQ ID NO: 608062 - DNA, 23 bp, Homo sapiens
tgttttgggcctccatgccccag

SEQ ID NO: 608063 - DNA, 15 bp, Homo sapiens
tgttttggtttgcta

SEQ ID NO: 608064 - DNA, 22 bp, Homo sapiens
tgttttgtgcggtgtgtctcca

SEQ ID NO: 608065 - DNA, 22 bp, Homo sapiens
tgtttttaagtgctatgcatat

SEQ ID NO: 608066 - DNA, 19 bp, Homo sapiens
ttaaaaaaataaaacattt

SEQ ID NO: 608067 - DNA, 23 bp, Homo sapiens
ttaaaaaaatcccatttatgcaa

SEQ ID NO: 608068 - DNA, 21 bp, Homo sapiens
ttaaaaagacacttttaccga

SEQ ID NO: 608069 - DNA, 20 bp, Homo sapiens
ttaaaaagccaagtgtcctg

SEQ ID NO: 608070 - DNA, 13 bp, Homo sapiens
ttaaaaattatag

SEQ ID NO: 608071 - DNA, 20 bp, Homo sapiens
ttaaaaattatctttaaaac

SEQ ID NO: 608072 - DNA, 16 bp, Homo sapiens
ttaaaacaagagacca

SEQ ID NO: 608073 - DNA, 13 bp, Homo sapiens
ttaaaacatcaaa

SEQ ID NO: 608074 - DNA, 15 bp, Homo sapiens
ttaaaacatcaaaat

SEQ ID NO: 608075 - DNA, 16 bp, Homo sapiens
ttaaaaccacagctgg

SEQ ID NO: 608076 - DNA, 22 bp, Homo sapiens
ttaaaataattatatgaagcag

SEQ ID NO: 608077 - DNA, 13 bp, Homo sapiens
ttaaaatcttgaa

SEQ ID NO: 608078 - DNA, 22 bp, Homo sapiens
ttaaaatgtgtttttcagttat

SEQ ID NO: 608079 - DNA, 22 bp, Homo sapiens
ttaaaattggttaatgaaaaat

SEQ ID NO: 608080 - DNA, 11 bp, Homo sapiens
ttaaacatttt

SEQ ID NO: 608081 - DNA, 18 bp, Homo sapiens
ttaaacccacataaacac

SEQ ID NO: 608082 - DNA, 16 bp, Homo sapiens
ttaaacctgtgctttc

SEQ ID NO: 608083 - DNA, 20 bp, Homo sapiens
ttaaacctgtgctttcatgt

SEQ ID NO: 608084 - DNA, 16 bp, Homo sapiens
ttaaagaaaggcagag

SEQ ID NO: 608085 - DNA, 20 bp, Homo sapiens
ttaaagaagtccatgtgata

SEQ ID NO: 608086 - DNA, 23 bp, Homo sapiens
ttaaagcaactgtctatttctgc

SEQ ID NO: 608087 - DNA, 14 bp, Homo sapiens
ttaaagtctgagaa

SEQ ID NO: 608088 - DNA, 15 bp, Homo sapiens
ttaaatctttgttaa

SEQ ID NO: 608089 - DNA, 16 bp, Homo sapiens
ttaaatctttgttaaa

SEQ ID NO: 608090 - DNA, 21 bp, Homo sapiens
ttaaatctttgttaaaatata

SEQ ID NO: 608091 - DNA, 12 bp, Homo sapiens
ttaaatgaaata

SEQ ID NO: 608092 - DNA, 15 bp, Homo sapiens
ttaaatgaaatactt

SEQ ID NO: 608093 - DNA, 14 bp, Homo sapiens
ttaaatgtctaatg

SEQ ID NO: 608094 - DNA, 17 bp, Homo sapiens
ttaaatgtctaatgtat

SEQ ID NO: 608095 - DNA, 19 bp, Homo sapiens
ttaaatgtctaatgtattt

SEQ ID NO: 608096 - DNA, 17 bp, Homo sapiens
ttaaattggcttgttta

SEQ ID NO: 608097 - DNA, 15 bp, Homo sapiens
ttaaatttattaaat

SEQ ID NO: 608098 - DNA, 19 bp, Homo sapiens
ttaacatatcattcagaat

SEQ ID NO: 608099 - DNA, 13 bp, Homo sapiens
ttaacccagtgtt

SEQ ID NO: 608100 - DNA, 21 bp, Homo sapiens
ttaaccgggactacagaagtg

SEQ ID NO: 608101 - DNA, 16 bp, Homo sapiens
ttaactaatgtaaata

SEQ ID NO: 608102 - DNA, 17 bp, Homo sapiens
ttaacttctattttcaa

SEQ ID NO: 608103 - DNA, 17 bp, Homo sapiens
ttaagaaatgagaaatt

SEQ ID NO: 608104 - DNA, 14 bp, Homo sapiens
ttaagcacacacat

SEQ ID NO: 608105 - DNA, 13 bp, Homo sapiens
ttaaggacagtgt

SEQ ID NO: 608106 - DNA, 21 bp, Homo sapiens
ttaaggacagtgttcaaattc

SEQ ID NO: 608107 - DNA, 17 bp, Homo sapiens
ttaaggactacagaatt

SEQ ID NO: 608108 - DNA, 18 bp, Homo sapiens
ttaagtggactgtatttc

SEQ ID NO: 608109 - DNA, 19 bp, Homo sapiens
ttaagtggactgtatttcg

SEQ ID NO: 608110 - DNA, 15 bp, Homo sapiens
ttaataacagaaata

SEQ ID NO: 608111 - DNA, 16 bp, Homo sapiens
ttaataacagaaatac

SEQ ID NO: 608112 - DNA, 17 bp, Homo sapiens
ttaataatatgtacaaa

SEQ ID NO: 608113 - DNA, 15 bp, Homo sapiens
ttaatacatcatttt

SEQ ID NO: 608114 - DNA, 23 bp, Homo sapiens
ttaatacatcattttttgtttct

SEQ ID NO: 608115 - DNA, 20 bp, Homo sapiens
ttaatactcatccttgtata

SEQ ID NO: 608116 - DNA, 21 bp, Homo sapiens
ttaatactcatccttgtataa

SEQ ID NO: 608117 - DNA, 22 bp, Homo sapiens
ttaatactcatccttgtataaa

SEQ ID NO: 608118 - DNA, 17 bp, Homo sapiens
ttaataggataaattaa

SEQ ID NO: 608119 - DNA, 17 bp, Homo sapiens
ttaataggcttgtgtaa

SEQ ID NO: 608120 - DNA, 24 bp, Homo sapiens
ttaatagtacccaacctggtaatt

SEQ ID NO: 608121 - DNA, 13 bp, Homo sapiens
ttaatagtttcta

SEQ ID NO: 608122 - DNA, 14 bp, Homo sapiens
ttaatagtttctaa

SEQ ID NO: 608123 - DNA, 14 bp, Homo sapiens
ttaatatactcctt

SEQ ID NO: 608124 - DNA, 15 bp, Homo sapiens
ttaatatactcctta

SEQ ID NO: 608125 - DNA, 22 bp, Homo sapiens
ttaatcatttccagcaaaatat

SEQ ID NO: 608126 - DNA, 16 bp, Homo sapiens
ttaatctagagctatg

SEQ ID NO: 608127 - DNA, 22 bp, Homo sapiens
ttaatctagagctatgcacacc

SEQ ID NO: 608128 - DNA, 18 bp, Homo sapiens
ttaatgtttagtcagtgt

SEQ ID NO: 608129 - DNA, 21 bp, Homo sapiens
ttaatgtttagtcagtgtact

SEQ ID NO: 608130 - DNA, 21 bp, Homo sapiens
ttaattgaaagggacaagtat

SEQ ID NO: 608131 - DNA, 13 bp, Homo sapiens
ttaattgaaatac

SEQ ID NO: 608132 - DNA, 22 bp, Homo sapiens
ttaattgctctatgcctcagtt

SEQ ID NO: 608133 - DNA, 14 bp, Homo sapiens
ttaatttcagtaag

SEQ ID NO: 608134 - DNA, 20 bp, Homo sapiens
ttaatttgatatcacagtct

SEQ ID NO: 608135 - DNA, 16 bp, Homo sapiens
ttacaaagaaacaaaa

SEQ ID NO: 608136 - DNA, 21 bp, Homo sapiens
ttacaaagaaacaaaatataa

SEQ ID NO: 608137 - DNA, 12 bp, Homo sapiens
ttacaacaagca

SEQ ID NO: 608138 - DNA, 13 bp, Homo sapiens
ttacaacaagcaa

SEQ ID NO: 608139 - DNA, 18 bp, Homo sapiens
ttacaacaagcaaactga

SEQ ID NO: 608140 - DNA, 19 bp, Homo sapiens
ttacaacaagcaaactgaa

SEQ ID NO: 608141 - DNA, 23 bp, Homo sapiens
ttacaacaagcaaactgaaatta

SEQ ID NO: 608142 - DNA, 16 bp, Homo sapiens
ttacacgaagaaatag

SEQ ID NO: 608143 - DNA, 17 bp, Homo sapiens
ttacactgaaatccaaa

SEQ ID NO: 608144 - DNA, 18 bp, Homo sapiens
ttacactgaaatccaaaa

SEQ ID NO: 608145 - DNA, 21 bp, Homo sapiens
ttacactgaaatccaaaatag

SEQ ID NO: 608146 - DNA, 23 bp, Homo sapiens
ttacacttctcaaatgctactca

SEQ ID NO: 608147 - DNA, 19 bp, Homo sapiens
ttacagatgagattccctc

SEQ ID NO: 608148 - DNA, 22 bp, Homo sapiens
ttacataaaacacccttgaaaa

SEQ ID NO: 608149 - DNA, 17 bp, Homo sapiens
ttacataacaggcattg

SEQ ID NO: 608150 - DNA, 22 bp, Homo sapiens
ttacataacaggcattgcacta

SEQ ID NO: 608151 - DNA, 22 bp, Homo sapiens
ttacatagctttagagaagcca

SEQ ID NO: 608152 - DNA, 15 bp, Homo sapiens
ttacattgtcctgta

SEQ ID NO: 608153 - DNA, 17 bp, Homo sapiens
ttaccacaggatgcata

SEQ ID NO: 608154 - DNA, 19 bp, Homo sapiens
ttaccacaggatgcatatt

SEQ ID NO: 608155 - DNA, 20 bp, Homo sapiens
ttaccagaagtttaaatctt

SEQ ID NO: 608156 - DNA, 16 bp, Homo sapiens
ttaccctccctgtccc

SEQ ID NO: 608157 - DNA, 19 bp, Homo sapiens
ttaccctccctgtcccctg

SEQ ID NO: 608158 - DNA, 18 bp, Homo sapiens
ttacccttcaatgttaaa

SEQ ID NO: 608159 - DNA, 16 bp, Homo sapiens
ttacctaacaatgttt

SEQ ID NO: 608160 - DNA, 21 bp, Homo sapiens
ttacctaagagccacaataag

SEQ ID NO: 608161 - DNA, 17 bp, Homo sapiens
ttacctattgctgtaaa

SEQ ID NO: 608162 - DNA, 22 bp, Homo sapiens
ttacctgtaatagcctcacctt

SEQ ID NO: 608163 - DNA, 14 bp, Homo sapiens
ttactaacactggc

SEQ ID NO: 608164 - DNA, 17 bp, Homo sapiens
ttactaacagtaactgc

SEQ ID NO: 608165 - DNA, 20 bp, Homo sapiens
ttactaacagtaactgccat

SEQ ID NO: 608166 - DNA, 20 bp, Homo sapiens
ttactctaaggtaaaaccat

SEQ ID NO: 608167 - DNA, 21 bp, Homo sapiens
ttactgacatggtgctgtgtg

SEQ ID NO: 608168 - DNA, 20 bp, Homo sapiens
ttactgcaatgtctgtccct

SEQ ID NO: 608169 - DNA, 22 bp, Homo sapiens
ttactgttctgaaattaggaaa

SEQ ID NO: 608170 - DNA, 14 bp, Homo sapiens
ttactgtttgaaaa

SEQ ID NO: 608171 - DNA, 14 bp, Homo sapiens
ttacttacacacct

SEQ ID NO: 608172 - DNA, 20 bp, Homo sapiens
ttagaaaaaactggaaacat

SEQ ID NO: 608173 - DNA, 22 bp, Homo sapiens
ttagaaaaaactggaaacatct

SEQ ID NO: 608174 - DNA, 21 bp, Homo sapiens
ttagaaatttattcttatctt

SEQ ID NO: 608175 - DNA, 13 bp, Homo sapiens
ttagaatggggct

SEQ ID NO: 608176 - DNA, 16 bp, Homo sapiens
ttagaatgtgaaaaaa

SEQ ID NO: 608177 - DNA, 12 bp, Homo sapiens
ttagacaatgtg

SEQ ID NO: 608178 - DNA, 13 bp, Homo sapiens
ttagacaatgtgg

SEQ ID NO: 608179 - DNA, 20 bp, Homo sapiens
ttagaccgtggtgtcctctg

SEQ ID NO: 608180 - DNA, 14 bp, Homo sapiens
ttagagaagccata

SEQ ID NO: 608181 - DNA, 20 bp, Homo sapiens
ttagagttattttgtgtcct

SEQ ID NO: 608182 - DNA, 15 bp, Homo sapiens
ttagatacacaaaat

SEQ ID NO: 608183 - DNA, 21 bp, Homo sapiens
ttagcagctcttcccctttcc

SEQ ID NO: 608184 - DNA, 15 bp, Homo sapiens
ttagcagtccatttt

SEQ ID NO: 608185 - DNA, 19 bp, Homo sapiens
ttagctagttagagactcg

SEQ ID NO: 608186 - DNA, 15 bp, Homo sapiens
ttagctgttaactcc

SEQ ID NO: 608187 - DNA, 18 bp, Homo sapiens
ttaggaaagttgtgattc

SEQ ID NO: 608188 - DNA, 17 bp, Homo sapiens
ttaggaatgctcaatgt

SEQ ID NO: 608189 - DNA, 18 bp, Homo sapiens
ttaggaatgctcaatgtg

SEQ ID NO: 608190 - DNA, 22 bp, Homo sapiens
ttagggcttggatcgtggaaga

SEQ ID NO: 608191 - DNA, 16 bp, Homo sapiens
ttagggttctatattt

SEQ ID NO: 608192 - DNA, 21 bp, Homo sapiens
ttagtattttgagccttatta

SEQ ID NO: 608193 - DNA, 23 bp, Homo sapiens
ttagtcagtgtactctgagtcct

SEQ ID NO: 608194 - DNA, 14 bp, Homo sapiens
ttagtcctcacctt

SEQ ID NO: 608195 - DNA, 19 bp, Homo sapiens
ttagtcctcaccttctgtt

SEQ ID NO: 608196 - DNA, 15 bp, Homo sapiens
ttagtgtctaaggaa

SEQ ID NO: 608197 - DNA, 12 bp, Homo sapiens
ttagtgtgattg

SEQ ID NO: 608198 - DNA, 18 bp, Homo sapiens
ttagtgttttcattctgg

SEQ ID NO: 608199 - DNA, 22 bp, Homo sapiens
ttagtgttttcattctggtcct

SEQ ID NO: 608200 - DNA, 23 bp, Homo sapiens
ttagttgaccaactatattgcga

SEQ ID NO: 608201 - DNA, 18 bp, Homo sapiens
ttataaatgttttaaaga

SEQ ID NO: 608202 - DNA, 18 bp, Homo sapiens
ttatacacataattaaag

SEQ ID NO: 608203 - DNA, 21 bp, Homo sapiens
ttatacacataattaaagtgt

SEQ ID NO: 608204 - DNA, 15 bp, Homo sapiens
ttataccagcaaaag

SEQ ID NO: 608205 - DNA, 16 bp, Homo sapiens
ttatacctgtacacac

SEQ ID NO: 608206 - DNA, 18 bp, Homo sapiens
ttatacctgtacacacac

SEQ ID NO: 608207 - DNA, 14 bp, Homo sapiens
ttctagcaattgct

SEQ ID NO: 608208 - DNA, 21 bp, Homo sapiens
ttctagtgggtttaatgttta

SEQ ID NO: 608209 - DNA, 19 bp, Homo sapiens
ttctatataatttttcctt

SEQ ID NO: 608210 - DNA, 17 bp, Homo sapiens
ttctatatgtaacttca

SEQ ID NO: 608211 - DNA, 14 bp, Homo sapiens
ttctatatttactg

SEQ ID NO: 608212 - DNA, 15 bp, Homo sapiens
ttctatatttactgt

SEQ ID NO: 608213 - DNA, 23 bp, Homo sapiens
ttctatatttggattcacagcct

SEQ ID NO: 608214 - DNA, 15 bp, Homo sapiens
ttctcaacacacagt

SEQ ID NO: 608215 - DNA, 15 bp, Homo sapiens
ttctcagaagtgaaa

SEQ ID NO: 608216 - DNA, 14 bp, Homo sapiens
ttctcagctccact

SEQ ID NO: 608217 - DNA, 17 bp, Homo sapiens
ttctcagctccactctg

SEQ ID NO: 608218 - DNA, 20 bp, Homo sapiens
ttctcatctgtaaaaccagg

SEQ ID NO: 608219 - DNA, 12 bp, Homo sapiens
ttctcatcttgt

SEQ ID NO: 608220 - DNA, 19 bp, Homo sapiens
ttctccagcccatgctggc

SEQ ID NO: 608221 - DNA, 16 bp, Homo sapiens
ttctccccctcagctc

SEQ ID NO: 608222 - DNA, 13 bp, Homo sapiens
ttctcctccaaat

SEQ ID NO: 608223 - DNA, 12 bp, Homo sapiens
ttctccttaacc

SEQ ID NO: 608224 - DNA, 21 bp, Homo sapiens
ttctctaacccctagtgtctt

SEQ ID NO: 608225 - DNA, 11 bp, Homo sapiens
ttctctctgtg

SEQ ID NO: 608226 - DNA, 13 bp, Homo sapiens
ttctctctgtgtg

SEQ ID NO: 608227 - DNA, 20 bp, Homo sapiens
ttctctgccggtggggccag

SEQ ID NO: 608228 - DNA, 21 bp, Homo sapiens
ttctgaaaggtgctttctcca

SEQ ID NO: 608229 - DNA, 22 bp, Homo sapiens
ttctgaaaggtgctttctccat

SEQ ID NO: 608230 - DNA, 23 bp, Homo sapiens
ttctgaactatcagggcaagctc

SEQ ID NO: 608231 - DNA, 20 bp, Homo sapiens
ttctgaaggggaaaacctca

SEQ ID NO: 608232 - DNA, 15 bp, Homo sapiens
ttctgatcctctctt

SEQ ID NO: 608233 - DNA, 17 bp, Homo sapiens
ttgctgtttaccgccca

SEQ ID NO: 608234 - DNA, 17 bp, Homo sapiens
ttgctgtttatatatat

SEQ ID NO: 608235 - DNA, 12 bp, Homo sapiens
ttgcttcattaa

SEQ ID NO: 608236 - DNA, 17 bp, Homo sapiens
ttgcttcattaaaacaa

SEQ ID NO: 608237 - DNA, 13 bp, Homo sapiens
ttgcttctctgcc

SEQ ID NO: 608238 - DNA, 15 bp, Homo sapiens
ttgcttgagcatgcc

SEQ ID NO: 608239 - DNA, 20 bp, Homo sapiens
ttggaacagtaatcagtttg

SEQ ID NO: 608240 - DNA, 13 bp, Homo sapiens
ttggaagaattca

SEQ ID NO: 608241 - DNA, 16 bp, Homo sapiens
ttggaattctgcttct

SEQ ID NO: 608242 - DNA, 17 bp, Homo sapiens
ttggacatttatgtaca

SEQ ID NO: 608243 - DNA, 19 bp, Homo sapiens
ttggacatttatgtacaaa

SEQ ID NO: 608244 - DNA, 22 bp, Homo sapiens
ttggagagagaggctgcctcag

SEQ ID NO: 608245 - DNA, 21 bp, Homo sapiens
ttggagagagcaatcttgctg

SEQ ID NO: 608246 - DNA, 22 bp, Homo sapiens
ttggagagcagcaggtgctgtg

SEQ ID NO: 608247 - DNA, 13 bp, Homo sapiens
ttggagaggagag

SEQ ID NO: 608248 - DNA, 15 bp, Homo sapiens
ttggagaggaggtgt

SEQ ID NO: 608249 - DNA, 19 bp, Homo sapiens
ttggagaggaggtgtggag

SEQ ID NO: 608250 - DNA, 19 bp, Homo sapiens
ttggagcagagacggcagc

SEQ ID NO: 608251 - DNA, 22 bp, Homo sapiens
ttggagcagagacggcagcccc

SEQ ID NO: 608252 - DNA, 16 bp, Homo sapiens
ttggagccccctggcg

SEQ ID NO: 608253 - DNA, 14 bp, Homo sapiens
ttggaggctgctgc

SEQ ID NO: 608254 - DNA, 15 bp, Homo sapiens
ttggagttaaaatgt

SEQ ID NO: 608255 - DNA, 19 bp, Homo sapiens
ttggataggagcttccaga

SEQ ID NO: 608256 - DNA, 20 bp, Homo sapiens
ttggataggagcttccagat

SEQ ID NO: 608257 - DNA, 12 bp, Homo sapiens
ttggattcacag

SEQ ID NO: 608258 - DNA, 18 bp, Homo sapiens
ttggccctggagccaggg

SEQ ID NO: 608259 - DNA, 14 bp, Homo sapiens
ttggcctctgcccc

SEQ ID NO: 608260 - DNA, 20 bp, Homo sapiens
ttggctcagacacctagact

SEQ ID NO: 608261 - DNA, 21 bp, Homo sapiens
ttgggaaattcttgcactgta

SEQ ID NO: 608262 - DNA, 20 bp, Homo sapiens
ttgggaattgcatgccatct

SEQ ID NO: 608263 - DNA, 20 bp, Homo sapiens
ttgggcacgggagagcgcca

SEQ ID NO: 608264 - DNA, 17 bp, Homo sapiens
ttgggcccttagaatgt

SEQ ID NO: 608265 - DNA, 15 bp, Homo sapiens
ttgggctggcaccca

SEQ ID NO: 608266 - DNA, 16 bp, Homo sapiens
ttgggctggcacccac

SEQ ID NO: 608267 - DNA, 22 bp, Homo sapiens
ttggggacaccctcctgccccc

SEQ ID NO: 608268 - DNA, 19 bp, Homo sapiens
ttggggctacttatattct

SEQ ID NO: 608269 - DNA, 15 bp, Homo sapiens
ttggggcttatcaga

SEQ ID NO: 608270 - DNA, 20 bp, Homo sapiens
ttggggcttatcagaactcc

SEQ ID NO: 608271 - DNA, 17 bp, Homo sapiens
ttgggggacgcccagcc

SEQ ID NO: 608272 - DNA, 23 bp, Homo sapiens
ttgggggacgcccagcccccacc

SEQ ID NO: 608273 - DNA, 14 bp, Homo sapiens
ttgggttccagaca

SEQ ID NO: 608274 - DNA, 21 bp, Homo sapiens
ttggtaccctggacagtgcct

SEQ ID NO: 608275 - DNA, 14 bp, Homo sapiens
ttggtatgaaacaa

SEQ ID NO: 608276 - DNA, 12 bp, Homo sapiens
ttggtatttact

SEQ ID NO: 608277 - DNA, 13 bp, Homo sapiens
ttggtatttactg

SEQ ID NO: 608278 - DNA, 17 bp, Homo sapiens
ttggtatttactgcaat

SEQ ID NO: 608279 - DNA, 17 bp, Homo sapiens
ttggtcacaaagctatt

SEQ ID NO: 608280 - DNA, 22 bp, Homo sapiens
ttggtcacaaagctatttaagt

SEQ ID NO: 608281 - DNA, 14 bp, Homo sapiens
ttggtctctttctt

SEQ ID NO: 608282 - DNA, 19 bp, Homo sapiens
ttggtctctttctttccaa

SEQ ID NO: 608283 - DNA, 15 bp, Homo sapiens
ttggttaatgaaaaa

SEQ ID NO: 608284 - DNA, 16 bp, Homo sapiens
ttggtttgtgggtcca

SEQ ID NO: 608285 - DNA, 15 bp, Homo sapiens
ttgtaaaacagtggt

SEQ ID NO: 608286 - DNA, 23 bp, Homo sapiens
ttgtaaaactgtgacattccaca

SEQ ID NO: 608287 - DNA, 13 bp, Homo sapiens
ttgtaaagatatt

SEQ ID NO: 608288 - DNA, 19 bp, Homo sapiens
ttgtaaagatattgtatct

SEQ ID NO: 608289 - DNA, 20 bp, Homo sapiens
ttgtaaagatattgtatctc

SEQ ID NO: 608290 - DNA, 18 bp, Homo sapiens
ttgtaaaggtaggtgcat

SEQ ID NO: 608291 - DNA, 19 bp, Homo sapiens
ttgtaaataatgcttaaca

SEQ ID NO: 608292 - DNA, 15 bp, Homo sapiens
ttgtaacagacattg

SEQ ID NO: 608293 - DNA, 16 bp, Homo sapiens
ttgtaacagacattgt

SEQ ID NO: 608294 - DNA, 17 bp, Homo sapiens
ttgtaacagacattgtt

SEQ ID NO: 608295 - DNA, 21 bp, Homo sapiens
ttgtaacattctatttcaact

SEQ ID NO: 608296 - DNA, 12 bp, Homo sapiens
ttgtaagaaaat

SEQ ID NO: 608297 - DNA, 14 bp, Homo sapiens
ttgtaatatcagtt

SEQ ID NO: 608298 - DNA, 19 bp, Homo sapiens
ttgtaatatcagttacagt

SEQ ID NO: 608299 - DNA, 16 bp, Homo sapiens
ttgtacgttaattaaa

SEQ ID NO: 608300 - DNA, 14 bp, Homo sapiens
ttgtacttgaataa

SEQ ID NO: 608301 - DNA, 15 bp, Homo sapiens
ttgtatctcctttaa

SEQ ID NO: 608302 - DNA, 13 bp, Homo sapiens
ttgtcaaatacag

SEQ ID NO: 608303 - DNA, 12 bp, Homo sapiens
ttgtcagaatgt

SEQ ID NO: 608304 - DNA, 20 bp, Homo sapiens
ttgtcctgtgtcatctgtca

SEQ ID NO: 608305 - DNA, 15 bp, Homo sapiens
ttgtcctttatgtat

SEQ ID NO: 608306 - DNA, 16 bp, Homo sapiens
ttgtcctttatgtatt

SEQ ID NO: 608307 - DNA, 17 bp, Homo sapiens
ttgtcctttatgtattc

SEQ ID NO: 608308 - DNA, 16 bp, Homo sapiens
ttgtctggctgtggcc

SEQ ID NO: 608309 - DNA, 21 bp, Homo sapiens
ttgtctgtgtatttctatttt

SEQ ID NO: 608310 - DNA, 13 bp, Homo sapiens
ttgtctttcatgg

SEQ ID NO: 608311 - DNA, 19 bp, Homo sapiens
ttgtcttttgacatccagc

SEQ ID NO: 608312 - DNA, 20 bp, Homo sapiens
ttgtgaaagtggcaagctct

SEQ ID NO: 608313 - DNA, 16 bp, Homo sapiens
ttgtgaatgttgtcct

SEQ ID NO: 608314 - DNA, 15 bp, Homo sapiens
ttgtgagctgcttct

SEQ ID NO: 608315 - DNA, 15 bp, Homo sapiens
ttgtgagttaatttg

SEQ ID NO: 608316 - DNA, 14 bp, Homo sapiens
ttgtgatctgttgt

SEQ ID NO: 608317 - DNA, 18 bp, Homo sapiens
ttgtgcagaaaacattgt

SEQ ID NO: 608318 - DNA, 16 bp, Homo sapiens
ttgtgccaaagatagc

SEQ ID NO: 608319 - DNA, 21 bp, Homo sapiens
ttgtgcggtgtgtctccagct

SEQ ID NO: 608320 - DNA, 17 bp, Homo sapiens
ttgtggacttttcccca

SEQ ID NO: 608321 - DNA, 15 bp, Homo sapiens
ttgtggataagaaaa

SEQ ID NO: 608322 - DNA, 19 bp, Homo sapiens
ttgtggcagcttccctgaa

SEQ ID NO: 608323 - DNA, 20 bp, Homo sapiens
ttgtgtaatttcctgctcct

SEQ ID NO: 608324 - DNA, 13 bp, Homo sapiens
ttgtgtgctattc

SEQ ID NO: 608325 - DNA, 15 bp, Homo sapiens
ttgtgttggtattta

SEQ ID NO: 608326 - DNA, 19 bp, Homo sapiens
ttgtgttggtatttactgc

SEQ ID NO: 608327 - DNA, 21 bp, Homo sapiens
ttgttaatgattcttgtgtca

SEQ ID NO: 608328 - DNA, 22 bp, Homo sapiens
ttgttaggggtgggggagaatg

SEQ ID NO: 608329 - DNA, 14 bp, Homo sapiens
ttgttctctcttgg

SEQ ID NO: 608330 - DNA, 14 bp, Homo sapiens
ttgttctgggttaa

SEQ ID NO: 608331 - DNA, 20 bp, Homo sapiens
ttgttcttgtaaaactgtga

SEQ ID NO: 608332 - DNA, 19 bp, Homo sapiens
ttgttgatattggttctat

SEQ ID NO: 608333 - DNA, 11 bp, Homo sapiens
ttgtttgctgc

SEQ ID NO: 608334 - DNA, 14 bp, Homo sapiens
ttgtttgctgcttt

SEQ ID NO: 608335 - DNA, 16 bp, Homo sapiens
ttgtttggtcactgct

SEQ ID NO: 608336 - DNA, 12 bp, Homo sapiens
ttgttttttcat

SEQ ID NO: 608337 - DNA, 20 bp, Homo sapiens
tttaaaaaaaatattctgtc

SEQ ID NO: 608338 - DNA, 17 bp, Homo sapiens
tttaaaaaaataaaaca

SEQ ID NO: 608339 - DNA, 18 bp, Homo sapiens
tttaaaaaaataaaacat

SEQ ID NO: 608340 - DNA, 19 bp, Homo sapiens
tttttgatttatcaatatt

SEQ ID NO: 608341 - DNA, 16 bp, Homo sapiens
tttttgtaatataaga

SEQ ID NO: 608342 - DNA, 11 bp, Homo sapiens
tttttgtgaat

SEQ ID NO: 608343 - DNA, 22 bp, Homo sapiens
tttttgttcaccttctgtgcat

SEQ ID NO: 608344 - DNA, 16 bp, Homo sapiens
ttttttattgtttaaa

SEQ ID NO: 608345 - DNA, 12 bp, Homo sapiens
ttttttgtttct

SEQ ID NO: 608346 - DNA, 13 bp, Homo sapiens
aaaaaaaatgata

SEQ ID NO: 608347 - DNA, 14 bp, Homo sapiens
aaaaaaatatgaga

SEQ ID NO: 608348 - DNA, 12 bp, Homo sapiens
aaaaaataatat

SEQ ID NO: 608349 - DNA, 15 bp, Homo sapiens
aaaaactgatttttt

SEQ ID NO: 608350 - DNA, 12 bp, Homo sapiens
aaaaactggaaa

SEQ ID NO: 608351 - DNA, 15 bp, Homo sapiens
aaaaactttccatga

SEQ ID NO: 608352 - DNA, 12 bp, Homo sapiens
aaaaagcatgta

SEQ ID NO: 608353 - DNA, 20 bp, Homo sapiens
aaaaataagccaaaataaga

SEQ ID NO: 608354 - DNA, 18 bp, Homo sapiens
aaaaatagctataaatag

SEQ ID NO: 608355 - DNA, 13 bp, Homo sapiens
aaaaatctgaatt

SEQ ID NO: 608356 - DNA, 14 bp, Homo sapiens
aaaaatctgaattt

SEQ ID NO: 608357 - DNA, 15 bp, Homo sapiens
aaaaattatctttaa

SEQ ID NO: 608358 - DNA, 12 bp, Homo sapiens
aaaaatttaaga

SEQ ID NO: 608359 - DNA, 22 bp, Homo sapiens
aaaaatttgacattgtcagaat

SEQ ID NO: 608360 - DNA, 20 bp, Homo sapiens
aaaacaagagaccacttcct

SEQ ID NO: 608361 - DNA, 17 bp, Homo sapiens
aaaacacccttgaaaat

SEQ ID NO: 608362 - DNA, 21 bp, Homo sapiens
aaaacacccttgaaaatatat

SEQ ID NO: 608363 - DNA, 11 bp, Homo sapiens
aaaacagtggt

SEQ ID NO: 608364 - DNA, 14 bp, Homo sapiens
aaaacatcaaaatg

SEQ ID NO: 608365 - DNA, 13 bp, Homo sapiens
aaaacattgttcc

SEQ ID NO: 608366 - DNA, 17 bp, Homo sapiens
aaaacattttaaatgga

SEQ ID NO: 608367 - DNA, 11 bp, Homo sapiens
aaaaccacagc

SEQ ID NO: 608368 - DNA, 15 bp, Homo sapiens
aaaaccagaaagagg

SEQ ID NO: 608369 - DNA, 11 bp, Homo sapiens
aaaacctcagt

SEQ ID NO: 608370 - DNA, 20 bp, Homo sapiens
aaaacctcagttggcctctg

SEQ ID NO: 608371 - DNA, 15 bp, Homo sapiens
aaaacgtatttatct

SEQ ID NO: 608372 - DNA, 16 bp, Homo sapiens
aaaactatcagcagcg

SEQ ID NO: 608373 - DNA, 21 bp, Homo sapiens
aaaactggaataagaagcaaa

SEQ ID NO: 608374 - DNA, 14 bp, Homo sapiens
aaaactgtactgtg

SEQ ID NO: 608375 - DNA, 19 bp, Homo sapiens
aaaactgtgacattccaca

SEQ ID NO: 608376 - DNA, 22 bp, Homo sapiens
aaaactgtgacattccacagag

SEQ ID NO: 608377 - DNA, 22 bp, Homo sapiens
aaaactttccatgacagtagca

SEQ ID NO: 608378 - DNA, 16 bp, Homo sapiens
aaaagacacttttacc

SEQ ID NO: 608379 - DNA, 21 bp, Homo sapiens
aaaagaccatgcattcagatc

SEQ ID NO: 608380 - DNA, 23 bp, Homo sapiens
aaaagattactagggttttgcca

SEQ ID NO: 608381 - DNA, 15 bp, Homo sapiens
aaaagcatgtacagt

SEQ ID NO: 608382 - DNA, 19 bp, Homo sapiens
aaaagcatgtacagtgttc

SEQ ID NO: 608383 - DNA, 22 bp, Homo sapiens
aaaagcatgtacagtgttctgt

SEQ ID NO: 608384 - DNA, 15 bp, Homo sapiens
aaaagcccatgctta

SEQ ID NO: 608385 - DNA, 14 bp, Homo sapiens
aaaagccctcttca

SEQ ID NO: 608386 - DNA, 19 bp, Homo sapiens
aaaaggctggatgtgcttt

SEQ ID NO: 608387 - DNA, 17 bp, Homo sapiens
aaaagtaattaaaaaga

SEQ ID NO: 608388 - DNA, 15 bp, Homo sapiens
aaaagtgatgtgatt

SEQ ID NO: 608389 - DNA, 22 bp, Homo sapiens
aaaagtgatgtgatttatgcat

SEQ ID NO: 608390 - DNA, 13 bp, Homo sapiens
aaaataaaacatt

SEQ ID NO: 608391 - DNA, 14 bp, Homo sapiens
aaaataaaacattt

SEQ ID NO: 608392 - DNA, 22 bp, Homo sapiens
aaaataaaacattttaaatgga

SEQ ID NO: 608393 - DNA, 14 bp, Homo sapiens
aaaataaaaccaga

SEQ ID NO: 608394 - DNA, 19 bp, Homo sapiens
aaaataaaaccagaaagag

SEQ ID NO: 608395 - DNA, 16 bp, Homo sapiens
aaaatagctataaata

SEQ ID NO: 608396 - DNA, 18 bp, Homo sapiens
aaaatagttgagccagca

SEQ ID NO: 608397 - DNA, 21 bp, Homo sapiens
aaaatagttgagccagcagac

SEQ ID NO: 608398 - DNA, 16 bp, Homo sapiens
aaaatatatgtttggc

SEQ ID NO: 608399 - DNA, 14 bp, Homo sapiens
aaaatattctgtca

SEQ ID NO: 608400 - DNA, 15 bp, Homo sapiens
aaaatattctgtcat

SEQ ID NO: 608401 - DNA, 12 bp, Homo sapiens
aaaatattttct

SEQ ID NO: 608402 - DNA, 19 bp, Homo sapiens
aaaatattttcttaattat

SEQ ID NO: 608403 - DNA, 20 bp, Homo sapiens
aaaatcaccctgactgtggg

SEQ ID NO: 608404 - DNA, 17 bp, Homo sapiens
aacactgagtgaaatat

SEQ ID NO: 608405 - DNA, 19 bp, Homo sapiens
aacactgagtgaaatatta

SEQ ID NO: 608406 - DNA, 18 bp, Homo sapiens
aacactgcagccctctcc

SEQ ID NO: 608407 - DNA, 12 bp, Homo sapiens
aacactgccaaa

SEQ ID NO: 608408 - DNA, 14 bp, Homo sapiens
aacactgcttaagg

SEQ ID NO: 608409 - DNA, 13 bp, Homo sapiens
aacagaaatacat

SEQ ID NO: 608410 - DNA, 11 bp, Homo sapiens
aacagacattg

SEQ ID NO: 608411 - DNA, 14 bp, Homo sapiens
aacagacattgttt

SEQ ID NO: 608412 - DNA, 18 bp, Homo sapiens
aacagacctcggctgtgt

SEQ ID NO: 608413 - DNA, 19 bp, Homo sapiens
aacagactgccttatatta

SEQ ID NO: 608414 - DNA, 11 bp, Homo sapiens
aacagcaacaa

SEQ ID NO: 608415 - DNA, 17 bp, Homo sapiens
aacagcaacaacaacag

SEQ ID NO: 608416 - DNA, 16 bp, Homo sapiens
aacagcacagtctttt

SEQ ID NO: 608417 - DNA, 14 bp, Homo sapiens
aacagctgtattat

SEQ ID NO: 608418 - DNA, 10 bp, Homo sapiens
aacagtaaat

SEQ ID NO: 608419 - DNA, 13 bp, Homo sapiens
aacagtaaatata

SEQ ID NO: 608420 - DNA, 17 bp, Homo sapiens
aacagtaaatatacact

SEQ ID NO: 608421 - DNA, 13 bp, Homo sapiens
aacagtaactgcc

SEQ ID NO: 608422 - DNA, 17 bp, Homo sapiens
aacagtgtggatgtaaa

SEQ ID NO: 608423 - DNA, 12 bp, Homo sapiens
aacagtgtggct

SEQ ID NO: 608424 - DNA, 17 bp, Homo sapiens
aacataaacttgtactt

SEQ ID NO: 608425 - DNA, 17 bp, Homo sapiens
aacataatgatactgaa

SEQ ID NO: 608426 - DNA, 21 bp, Homo sapiens
aacataatgatactgaattgt

SEQ ID NO: 608427 - DNA, 14 bp, Homo sapiens
aacatctgatttct

SEQ ID NO: 608428 - DNA, 15 bp, Homo sapiens
aacattctatttcaa

SEQ ID NO: 608429 - DNA, 18 bp, Homo sapiens
aacattgccttatattgg

SEQ ID NO: 608430 - DNA, 13 bp, Homo sapiens
aacattgtatgtt

SEQ ID NO: 608431 - DNA, 15 bp, Homo sapiens
aacattgttccagat

SEQ ID NO: 608432 - DNA, 13 bp, Homo sapiens
aacattttaaatg

SEQ ID NO: 608433 - DNA, 20 bp, Homo sapiens
aacattttttgtttcttggt

SEQ ID NO: 608434 - DNA, 24 bp, Homo sapiens
aaccaagctataaaagcccatgct

SEQ ID NO: 608435 - DNA, 16 bp, Homo sapiens
aaccaatttgttctgt

SEQ ID NO: 608436 - DNA, 15 bp, Homo sapiens
aaccacaaattcatg

SEQ ID NO: 608437 - DNA, 15 bp, Homo sapiens
aaccacacctaaatt

SEQ ID NO: 608438 - DNA, 21 bp, Homo sapiens
aaccacagctgggcagggtga

SEQ ID NO: 608439 - DNA, 14 bp, Homo sapiens
aaccagagcactgt

SEQ ID NO: 608440 - DNA, 15 bp, Homo sapiens
aaccagcactcccag

SEQ ID NO: 608441 - DNA, 17 bp, Homo sapiens
aaccagcactcccaggg

SEQ ID NO: 608442 - DNA, 20 bp, Homo sapiens
aaccagcactcccagggccc

SEQ ID NO: 608443 - DNA, 17 bp, Homo sapiens
aaccatcattgaaatct

SEQ ID NO: 608444 - DNA, 12 bp, Homo sapiens
aaccatgaaaag

SEQ ID NO: 608445 - DNA, 16 bp, Homo sapiens
aaccatgaaaagtttt

SEQ ID NO: 608446 - DNA, 14 bp, Homo sapiens
aaccatgttcttga

SEQ ID NO: 608447 - DNA, 14 bp, Homo sapiens
aacccacataaaca

SEQ ID NO: 608448 - DNA, 13 bp, Homo sapiens
aacccagtgttca

SEQ ID NO: 608449 - DNA, 18 bp, Homo sapiens
aacccagtgttcagcata

SEQ ID NO: 608450 - DNA, 15 bp, Homo sapiens
aaccctgaatcagag

SEQ ID NO: 608451 - DNA, 14 bp, Homo sapiens
aaccctgccctgca

SEQ ID NO: 608452 - DNA, 15 bp, Homo sapiens
aaccctgccctgcac

SEQ ID NO: 608453 - DNA, 17 bp, Homo sapiens
aaccctgccctgcacct

SEQ ID NO: 608454 - DNA, 15 bp, Homo sapiens
aaccgggactacaga

SEQ ID NO: 608455 - DNA, 18 bp, Homo sapiens
aaccgggactacagaagt

SEQ ID NO: 608456 - DNA, 23 bp, Homo sapiens
aaccgtcaatgtgaaataaagag

SEQ ID NO: 608457 - DNA, 19 bp, Homo sapiens
aacctactgcccacatttg

SEQ ID NO: 608458 - DNA, 20 bp, Homo sapiens
aacctactgcccacatttgg

SEQ ID NO: 608459 - DNA, 16 bp, Homo sapiens
aacctcagttggcctc

SEQ ID NO: 608460 - DNA, 22 bp, Homo sapiens
aacctcagttggcctctgcccc

SEQ ID NO: 608461 - DNA, 14 bp, Homo sapiens
aacctcccctggtc

SEQ ID NO: 608462 - DNA, 19 bp, Homo sapiens
aacctcccctggtcctgca

SEQ ID NO: 608463 - DNA, 15 bp, Homo sapiens
aacctctcagatccc

SEQ ID NO: 608464 - DNA, 19 bp, Homo sapiens
aacctgacagcaaacacag

SEQ ID NO: 608465 - DNA, 14 bp, Homo sapiens
aacctgcgcacccc

SEQ ID NO: 608466 - DNA, 19 bp, Homo sapiens
aacctggtaattatcctca

SEQ ID NO: 608467 - DNA, 18 bp, Homo sapiens
aacctgtagaagatgacc

SEQ ID NO: 608468 - DNA, 23 bp, Homo sapiens
aacctgtgctttcatgtttaaga

SEQ ID NO: 608469 - DNA, 16 bp, Homo sapiens
aaccttcaaatacatt

SEQ ID NO: 608470 - DNA, 16 bp, Homo sapiens
aaccttgtactttaca

SEQ ID NO: 608471 - DNA, 18 bp, Homo sapiens
aaccttgtactttacaat

SEQ ID NO: 608472 - DNA, 21 bp, Homo sapiens
aaccttttaaaaaaataatat

SEQ ID NO: 608473 - DNA, 19 bp, Homo sapiens
aacgaccgacgcccctccg

SEQ ID NO: 608474 - DNA, 14 bp, Homo sapiens
aacgggcctccccg

SEQ ID NO: 608475 - DNA, 15 bp, Homo sapiens
aacgtggctgcttca

SEQ ID NO: 608476 - DNA, 19 bp, Homo sapiens
aacgtggctgcttcaagga

SEQ ID NO: 608477 - DNA, 23 bp, Homo sapiens
aacgtggctgcttcaaggatcct

SEQ ID NO: 608478 - DNA, 16 bp, Homo sapiens
aacgttcatgttcatc

SEQ ID NO: 608479 - DNA, 17 bp, Homo sapiens
aactaaatagcatgtat

SEQ ID NO: 608480 - DNA, 16 bp, Homo sapiens
aactaacactatttta

SEQ ID NO: 608481 - DNA, 15 bp, Homo sapiens
aactaagttgtattt

SEQ ID NO: 608482 - DNA, 13 bp, Homo sapiens
aactaatgtaaat

SEQ ID NO: 608483 - DNA, 21 bp, Homo sapiens
aactatattgcgagaaacaga

SEQ ID NO: 608484 - DNA, 12 bp, Homo sapiens
aactcatacagt

SEQ ID NO: 608485 - DNA, 19 bp, Homo sapiens
aactcctgttttcacacct

SEQ ID NO: 608486 - DNA, 12 bp, Homo sapiens
aactccttacag

SEQ ID NO: 608487 - DNA, 20 bp, Homo sapiens
aactcgggattacagaaaca

SEQ ID NO: 608488 - DNA, 13 bp, Homo sapiens
aactgaagcagag

SEQ ID NO: 608489 - DNA, 19 bp, Homo sapiens
aactgaattgctatcattt

SEQ ID NO: 608490 - DNA, 16 bp, Homo sapiens
aactgatgctttcaga

SEQ ID NO: 608491 - DNA, 17 bp, Homo sapiens
aactgatttttttttcc

SEQ ID NO: 608492 - DNA, 23 bp, Homo sapiens
aactgatttttttttccttcagt

SEQ ID NO: 608493 - DNA, 19 bp, Homo sapiens
aactggaaacatctgattt

SEQ ID NO: 608494 - DNA, 23 bp, Homo sapiens
aactggaaacatctgatttctga

SEQ ID NO: 608495 - DNA, 18 bp, Homo sapiens
aactggaaggctttattc

SEQ ID NO: 608496 - DNA, 15 bp, Homo sapiens
aactggaataagaag

SEQ ID NO: 608497 - DNA, 21 bp, Homo sapiens
aactggaataagaagcaaata

SEQ ID NO: 608498 - DNA, 14 bp, Homo sapiens
aactggccccaggc

SEQ ID NO: 608499 - DNA, 22 bp, Homo sapiens
aactggccccaggcggaggggc

SEQ ID NO: 608500 - DNA, 23 bp, Homo sapiens
aactggccccaggcggaggggct

SEQ ID NO: 608501 - DNA, 23 bp, Homo sapiens
aactgggttctttggaagcagcc

SEQ ID NO: 608502 - DNA, 20 bp, Homo sapiens
aactggtaaaaagatccagg

SEQ ID NO: 608503 - DNA, 24 bp, Homo sapiens
aactggtaaaaagatccagggatg

SEQ ID NO: 608504 - DNA, 16 bp, Homo sapiens
aactgtagccaccctg

SEQ ID NO: 608505 - DNA, 14 bp, Homo sapiens
aactgtctatttct

SEQ ID NO: 608506 - DNA, 19 bp, Homo sapiens
aactgtctatttctgctga

SEQ ID NO: 608507 - DNA, 20 bp, Homo sapiens
aacttactatggtatatatt

SEQ ID NO: 608508 - DNA, 17 bp, Homo sapiens
aacttcagatgtttcca

SEQ ID NO: 608509 - DNA, 12 bp, Homo sapiens
aacttcaggaaa

SEQ ID NO: 608510 - DNA, 16 bp, Homo sapiens
aacttcatctgtctgt

SEQ ID NO: 608511 - DNA, 22 bp, Homo sapiens
aacttggacatttatgtacaaa

SEQ ID NO: 608512 - DNA, 20 bp, Homo sapiens
aacttgtacttacactgaaa

SEQ ID NO: 608513 - DNA, 14 bp, Homo sapiens
aactttccatgaca

SEQ ID NO: 608514 - DNA, 20 bp, Homo sapiens
aactttccatgacagtagca

SEQ ID NO: 608515 - DNA, 16 bp, Homo sapiens
aactttctcagcatat

SEQ ID NO: 608516 - DNA, 23 bp, Homo sapiens
aactttggaagttttacttgatt

SEQ ID NO: 608517 - DNA, 18 bp, Homo sapiens
aactttttctaaattata

SEQ ID NO: 608518 - DNA, 20 bp, Homo sapiens
aactttttctaaattataaa

SEQ ID NO: 608519 - DNA, 15 bp, Homo sapiens
aagaaacaaaatata

SEQ ID NO: 608520 - DNA, 17 bp, Homo sapiens
aagaaacacagcatgca

SEQ ID NO: 608521 - DNA, 20 bp, Homo sapiens
aagggccaccctgagcagat

SEQ ID NO: 608522 - DNA, 13 bp, Homo sapiens
aaggggaaaacct

SEQ ID NO: 608523 - DNA, 16 bp, Homo sapiens
aaggggaaaacctcag

SEQ ID NO: 608524 - DNA, 15 bp, Homo sapiens
aaggggaattaacaa

SEQ ID NO: 608525 - DNA, 13 bp, Homo sapiens
aagggtgcctggc

SEQ ID NO: 608526 - DNA, 15 bp, Homo sapiens
aagggtgcctggctg

SEQ ID NO: 608527 - DNA, 21 bp, Homo sapiens
aagggtgcctggctgggcttt

SEQ ID NO: 608528 - DNA, 14 bp, Homo sapiens
aagggtgtggcttg

SEQ ID NO: 608529 - DNA, 21 bp, Homo sapiens
aaggtacggtgagactctgag

SEQ ID NO: 608530 - DNA, 22 bp, Homo sapiens
aaggtacggtgagactctgagg

SEQ ID NO: 608531 - DNA, 20 bp, Homo sapiens
aaggtggtcttggagaggag

SEQ ID NO: 608532 - DNA, 21 bp, Homo sapiens
aaggtggtcttggagaggagg

SEQ ID NO: 608533 - DNA, 12 bp, Homo sapiens
aaggttgtacat

SEQ ID NO: 608534 - DNA, 13 bp, Homo sapiens
aaggttgtacata

SEQ ID NO: 608535 - DNA, 21 bp, Homo sapiens
aagtaaatgtcttcatgttga

SEQ ID NO: 608536 - DNA, 16 bp, Homo sapiens
aagtagtgtcattcat

SEQ ID NO: 608537 - DNA, 18 bp, Homo sapiens
aagtagtgtcattcatat

SEQ ID NO: 608538 - DNA, 22 bp, Homo sapiens
aagtatcatctaaatattatgc

SEQ ID NO: 608539 - DNA, 18 bp, Homo sapiens
aagtcaggccattcagtc

SEQ ID NO: 608540 - DNA, 22 bp, Homo sapiens
aagtcctttcccgatgcgtggc

SEQ ID NO: 608541 - DNA, 21 bp, Homo sapiens
aagtctacctgccttgcctgt

SEQ ID NO: 608542 - DNA, 23 bp, Homo sapiens
aagtctacctgccttgcctgtta

SEQ ID NO: 608543 - DNA, 15 bp, Homo sapiens
aagtctcctgtatca

SEQ ID NO: 608544 - DNA, 20 bp, Homo sapiens
aagtctgagaaatttacaaa

SEQ ID NO: 608545 - DNA, 12 bp, Homo sapiens
aagtgaaaaaga

SEQ ID NO: 608546 - DNA, 17 bp, Homo sapiens
aagtgaaattagtattt

SEQ ID NO: 608547 - DNA, 22 bp, Homo sapiens
aagtgattgacattttgtagct

SEQ ID NO: 608548 - DNA, 12 bp, Homo sapiens
aagtgcatgtta

SEQ ID NO: 608549 - DNA, 16 bp, Homo sapiens
aagtgcatgttaaaat

SEQ ID NO: 608550 - DNA, 12 bp, Homo sapiens
aagtgctcagta

SEQ ID NO: 608551 - DNA, 14 bp, Homo sapiens
aagtgctcagtatt

SEQ ID NO: 608552 - DNA, 21 bp, Homo sapiens
aagtggaaggataatgagatg

SEQ ID NO: 608553 - DNA, 12 bp, Homo sapiens
aagtggcaagct

SEQ ID NO: 608554 - DNA, 18 bp, Homo sapiens
aagtggcctgagaagagt

SEQ ID NO: 608555 - DNA, 12 bp, Homo sapiens
aagtgtacattt

SEQ ID NO: 608556 - DNA, 14 bp, Homo sapiens
aagtgtacatttga

SEQ ID NO: 608557 - DNA, 15 bp, Homo sapiens
aagtgtactggattt

SEQ ID NO: 608558 - DNA, 20 bp, Homo sapiens
aagtgttctgtggctgattt

SEQ ID NO: 608559 - DNA, 20 bp, Homo sapiens
aagtgttggccatcatttca

SEQ ID NO: 608560 - DNA, 15 bp, Homo sapiens
aagtgtttttacata

SEQ ID NO: 608561 - DNA, 18 bp, Homo sapiens
aagttagatgttttagtt

SEQ ID NO: 608562 - DNA, 15 bp, Homo sapiens
aagttataccagcaa

SEQ ID NO: 608563 - DNA, 15 bp, Homo sapiens
aagttgaagggaaat

SEQ ID NO: 608564 - DNA, 13 bp, Homo sapiens
aagttgaatgata

SEQ ID NO: 608565 - DNA, 19 bp, Homo sapiens
aagttgccacattgcttca

SEQ ID NO: 608566 - DNA, 22 bp, Homo sapiens
aagttgtattttaataaagatt

SEQ ID NO: 608567 - DNA, 18 bp, Homo sapiens
aagttgtgatctgttgta

SEQ ID NO: 608568 - DNA, 19 bp, Homo sapiens
aagttgtgtgctattcgta

SEQ ID NO: 608569 - DNA, 12 bp, Homo sapiens
aataaaacattt

SEQ ID NO: 608570 - DNA, 13 bp, Homo sapiens
aataaaacatttt

SEQ ID NO: 608571 - DNA, 19 bp, Homo sapiens
aataaagctaccatgttaa

SEQ ID NO: 608572 - DNA, 14 bp, Homo sapiens
aataaagctcacac

SEQ ID NO: 608573 - DNA, 21 bp, Homo sapiens
aataacaacagtttttatgtt

SEQ ID NO: 608574 - DNA, 19 bp, Homo sapiens
aataacactgcagccctct

SEQ ID NO: 608575 - DNA, 18 bp, Homo sapiens
aataacagaaatacatca

SEQ ID NO: 608576 - DNA, 15 bp, Homo sapiens
aataagttcccattt

SEQ ID NO: 608577 - DNA, 13 bp, Homo sapiens
aataatatgtaca

SEQ ID NO: 608578 - DNA, 15 bp, Homo sapiens
aataatatgtacaaa

SEQ ID NO: 608579 - DNA, 22 bp, Homo sapiens
aatacaacacattgaaactgta

SEQ ID NO: 608580 - DNA, 17 bp, Homo sapiens
aatacacatacatatat

SEQ ID NO: 608581 - DNA, 17 bp, Homo sapiens
aatacacgtgtatatga

SEQ ID NO: 608582 - DNA, 20 bp, Homo sapiens
aatacacgtgtatatgagga

SEQ ID NO: 608583 - DNA, 15 bp, Homo sapiens
aatacatcatatgtt

SEQ ID NO: 608584 - DNA, 17 bp, Homo sapiens
aatacatgatgatttca

SEQ ID NO: 608585 - DNA, 12 bp, Homo sapiens
aatactgtattg

SEQ ID NO: 608586 - DNA, 19 bp, Homo sapiens
aatactgttgcccttttcc

SEQ ID NO: 608587 - DNA, 15 bp, Homo sapiens
aatacttgacaacat

SEQ ID NO: 608588 - DNA, 15 bp, Homo sapiens
aatactttgtgtctt

SEQ ID NO: 608589 - DNA, 18 bp, Homo sapiens
aatagacagaggtttcat

SEQ ID NO: 608590 - DNA, 15 bp, Homo sapiens
aatagatgtgaaaat

SEQ ID NO: 608591 - DNA, 19 bp, Homo sapiens
aatagcgctcccttttcac

SEQ ID NO: 608592 - DNA, 18 bp, Homo sapiens
aatagcttttcacttctt

SEQ ID NO: 608593 - DNA, 15 bp, Homo sapiens
aataggaaaaactga

SEQ ID NO: 608594 - DNA, 18 bp, Homo sapiens
aataggaaaaactgattt

SEQ ID NO: 608595 - DNA, 13 bp, Homo sapiens
aataggcttgtgt

SEQ ID NO: 608596 - DNA, 15 bp, Homo sapiens
aatagggatccactt

SEQ ID NO: 608597 - DNA, 16 bp, Homo sapiens
aatagttccattctat

SEQ ID NO: 608598 - DNA, 19 bp, Homo sapiens
aatagttccattctatgac

SEQ ID NO: 608599 - DNA, 16 bp, Homo sapiens
aatagttgagccagca

SEQ ID NO: 608600 - DNA, 18 bp, Homo sapiens
aatagttgagccagcaga

SEQ ID NO: 608601 - DNA, 22 bp, Homo sapiens
aatagtttctaaaccatgaaaa

SEQ ID NO: 608602 - DNA, 16 bp, Homo sapiens
aatataaaaataatta

SEQ ID NO: 608603 - DNA, 13 bp, Homo sapiens
aatataaactgtg

SEQ ID NO: 608604 - DNA, 15 bp, Homo sapiens
aatataaactgtgag

SEQ ID NO: 608605 - DNA, 16 bp, Homo sapiens
aatataaactgtgaga

SEQ ID NO: 608606 - DNA, 19 bp, Homo sapiens
aatataaactgtgagataa

SEQ ID NO: 608607 - DNA, 19 bp, Homo sapiens
aatataaatgaatgaaata

SEQ ID NO: 608608 - DNA, 22 bp, Homo sapiens
aatataaatgaatgaaatataa

SEQ ID NO: 608609 - DNA, 11 bp, Homo sapiens
aatataagaca

SEQ ID NO: 608610 - DNA, 13 bp, Homo sapiens
aatataagacaag

SEQ ID NO: 608611 - DNA, 18 bp, Homo sapiens
aatataagacaagtctga

SEQ ID NO: 608612 - DNA, 16 bp, Homo sapiens
aatatacactttacat

SEQ ID NO: 608613 - DNA, 17 bp, Homo sapiens
aatatactcatttggat

SEQ ID NO: 608614 - DNA, 14 bp, Homo sapiens
aatatatatttatc

SEQ ID NO: 608615 - DNA, 15 bp, Homo sapiens
aatatatatttatca

SEQ ID NO: 608616 - DNA, 21 bp, Homo sapiens
aatatatgtttggctgaaatt

SEQ ID NO: 608617 - DNA, 18 bp, Homo sapiens
aatatatttgcataatat

SEQ ID NO: 608618 - DNA, 16 bp, Homo sapiens
aatatcagttacagtg

SEQ ID NO: 608619 - DNA, 17 bp, Homo sapiens
aatatcagttacagtgg

SEQ ID NO: 608620 - DNA, 22 bp, Homo sapiens
aatatcagttacagtggcagta

SEQ ID NO: 608621 - DNA, 16 bp, Homo sapiens
aatatccaagcccagc

SEQ ID NO: 608622 - DNA, 17 bp, Homo sapiens
aatatctgtgaaggact

SEQ ID NO: 608623 - DNA, 19 bp, Homo sapiens
aatatgtacaaataatatt

SEQ ID NO: 608624 - DNA, 22 bp, Homo sapiens
aatatgtacaaataatattgcc

SEQ ID NO: 608625 - DNA, 19 bp, Homo sapiens
aatattaaagtctgagaaa

SEQ ID NO: 608626 - DNA, 23 bp, Homo sapiens
aatattgctattgtttataggaa

SEQ ID NO: 608627 - DNA, 12 bp, Homo sapiens
aatattgctgat

SEQ ID NO: 608628 - DNA, 13 bp, Homo sapiens
aatattgctgatg

SEQ ID NO: 608629 - DNA, 13 bp, Homo sapiens
aatattttcaagc

SEQ ID NO: 608630 - DNA, 16 bp, Homo sapiens
aatattttcaagcttt

SEQ ID NO: 608631 - DNA, 17 bp, Homo sapiens
aatatttttttgtagat

SEQ ID NO: 608632 - DNA, 21 bp, Homo sapiens
aatatttttttgtagatgaaa

SEQ ID NO: 608633 - DNA, 16 bp, Homo sapiens
aatcacagatttccaa

SEQ ID NO: 608634 - DNA, 11 bp, Homo sapiens
aatcacagcca

SEQ ID NO: 608635 - DNA, 12 bp, Homo sapiens
aatcacagccaa

SEQ ID NO: 608636 - DNA, 14 bp, Homo sapiens
aatcacagccaata

SEQ ID NO: 608637 - DNA, 15 bp, Homo sapiens
aatcaccctgactgt

SEQ ID NO: 608638 - DNA, 19 bp, Homo sapiens
acaaggcccagccctgggc

SEQ ID NO: 608639 - DNA, 21 bp, Homo sapiens
acaaggcccagccctgggcaa

SEQ ID NO: 608640 - DNA, 15 bp, Homo sapiens
acaagtatcatctaa

SEQ ID NO: 608641 - DNA, 23 bp, Homo sapiens
acaagtatcatctaaatattatg

SEQ ID NO: 608642 - DNA, 11 bp, Homo sapiens
acaagtgtttc

SEQ ID NO: 608643 - DNA, 14 bp, Homo sapiens
acaataaaagacat

SEQ ID NO: 608644 - DNA, 21 bp, Homo sapiens
acaataagaaacagtttaaca

SEQ ID NO: 608645 - DNA, 14 bp, Homo sapiens
acaataagccactg

SEQ ID NO: 608646 - DNA, 18 bp, Homo sapiens
acaatactttgtgtcttt

SEQ ID NO: 608647 - DNA, 22 bp, Homo sapiens
acaatcgtattacataaaacac

SEQ ID NO: 608648 - DNA, 11 bp, Homo sapiens
acaatgcaaac

SEQ ID NO: 608649 - DNA, 19 bp, Homo sapiens
acaatgcaaaccatcattg

SEQ ID NO: 608650 - DNA, 21 bp, Homo sapiens
acaatgcaaaccatcattgaa

SEQ ID NO: 608651 - DNA, 12 bp, Homo sapiens
acaattctttgt

SEQ ID NO: 608652 - DNA, 20 bp, Homo sapiens
acaattctttgttgcttaat

SEQ ID NO: 608653 - DNA, 13 bp, Homo sapiens
acacaaaacaaca

SEQ ID NO: 608654 - DNA, 18 bp, Homo sapiens
acacaaacctactgccca

SEQ ID NO: 608655 - DNA, 15 bp, Homo sapiens
acacaaagtgaaatt

SEQ ID NO: 608656 - DNA, 22 bp, Homo sapiens
acacaactgtggataaattttg

SEQ ID NO: 608657 - DNA, 22 bp, Homo sapiens
acacaagcagacacacacatat

SEQ ID NO: 608658 - DNA, 19 bp, Homo sapiens
acacaatcgtattacataa

SEQ ID NO: 608659 - DNA, 21 bp, Homo sapiens
acacacaaaacaacagcaaca

SEQ ID NO: 608660 - DNA, 15 bp, Homo sapiens
acacacacacacaaa

SEQ ID NO: 608661 - DNA, 13 bp, Homo sapiens
acacacacagaca

SEQ ID NO: 608662 - DNA, 14 bp, Homo sapiens
acacacacccttcc

SEQ ID NO: 608663 - DNA, 18 bp, Homo sapiens
acacacagacacacaagc

SEQ ID NO: 608664 - DNA, 13 bp, Homo sapiens
acacacatatata

SEQ ID NO: 608665 - DNA, 16 bp, Homo sapiens
acacacatctggccct

SEQ ID NO: 608666 - DNA, 17 bp, Homo sapiens
acacacatctggccctg

SEQ ID NO: 608667 - DNA, 20 bp, Homo sapiens
acacacccttccccactccc

SEQ ID NO: 608668 - DNA, 19 bp, Homo sapiens
acacactcagcagccccct

SEQ ID NO: 608669 - DNA, 20 bp, Homo sapiens
acacagaggacagcttcccc

SEQ ID NO: 608670 - DNA, 14 bp, Homo sapiens
acacagattatttg

SEQ ID NO: 608671 - DNA, 16 bp, Homo sapiens
acacagcatgcattta

SEQ ID NO: 608672 - DNA, 18 bp, Homo sapiens
acacagcccagagactga

SEQ ID NO: 608673 - DNA, 20 bp, Homo sapiens
acacagtaagataggttctg

SEQ ID NO: 608674 - DNA, 16 bp, Homo sapiens
acacagtgacacgttt

SEQ ID NO: 608675 - DNA, 15 bp, Homo sapiens
acacataacacacat

SEQ ID NO: 608676 - DNA, 13 bp, Homo sapiens
acacataattaaa

SEQ ID NO: 608677 - DNA, 19 bp, Homo sapiens
acacataattaaagtgtcc

SEQ ID NO: 608678 - DNA, 21 bp, Homo sapiens
acacatacatatatacatttt

SEQ ID NO: 608679 - DNA, 14 bp, Homo sapiens
acacatataaacac

SEQ ID NO: 608680 - DNA, 12 bp, Homo sapiens
acacatatatac

SEQ ID NO: 608681 - DNA, 18 bp, Homo sapiens
acacatatatacatacgc

SEQ ID NO: 608682 - DNA, 16 bp, Homo sapiens
acacattgaaactgta

SEQ ID NO: 608683 - DNA, 20 bp, Homo sapiens
acaccaaattgctgagatgt

SEQ ID NO: 608684 - DNA, 20 bp, Homo sapiens
acaccaatttagaatgaata

SEQ ID NO: 608685 - DNA, 21 bp, Homo sapiens
acaccaatttagaatgaatat

SEQ ID NO: 608686 - DNA, 17 bp, Homo sapiens
acaccactttcccacac

SEQ ID NO: 608687 - DNA, 18 bp, Homo sapiens
acaccagttacttgtgtt

SEQ ID NO: 608688 - DNA, 15 bp, Homo sapiens
acaccccgtctgccc

SEQ ID NO: 608689 - DNA, 16 bp, Homo sapiens
acaccccgtctgcccc

SEQ ID NO: 608690 - DNA, 18 bp, Homo sapiens
acaccccgtctgcccctt

SEQ ID NO: 608691 - DNA, 17 bp, Homo sapiens
acacccttccccactcc

SEQ ID NO: 608692 - DNA, 15 bp, Homo sapiens
acacccttgaaaata

SEQ ID NO: 608693 - DNA, 17 bp, Homo sapiens
acacccttgaaaatata

SEQ ID NO: 608694 - DNA, 17 bp, Homo sapiens
acaccggcactgtgcac

SEQ ID NO: 608695 - DNA, 13 bp, Homo sapiens
acacctaaattaa

SEQ ID NO: 608696 - DNA, 19 bp, Homo sapiens
acacctaaattaacaaatt

SEQ ID NO: 608697 - DNA, 12 bp, Homo sapiens
acacctccaccc

SEQ ID NO: 608698 - DNA, 23 bp, Homo sapiens
acacctcccttcatcccagggta

SEQ ID NO: 608699 - DNA, 18 bp, Homo sapiens
acaccttacaaagccagc

SEQ ID NO: 608700 - DNA, 22 bp, Homo sapiens
acaccttacaaagccagctctg

SEQ ID NO: 608701 - DNA, 16 bp, Homo sapiens
acaccttagcagctct

SEQ ID NO: 608702 - DNA, 14 bp, Homo sapiens
acacgaagaaatag

SEQ ID NO: 608703 - DNA, 15 bp, Homo sapiens
acacgccggggctgg

SEQ ID NO: 608704 - DNA, 13 bp, Homo sapiens
acactaatggcca

SEQ ID NO: 608705 - DNA, 14 bp, Homo sapiens
acactattttatgc

SEQ ID NO: 608706 - DNA, 16 bp, Homo sapiens
acactcatcaggtaaa

SEQ ID NO: 608707 - DNA, 14 bp, Homo sapiens
acactgaaatccaa

SEQ ID NO: 608708 - DNA, 18 bp, Homo sapiens
acactgagtgaaatatta

SEQ ID NO: 608709 - DNA, 14 bp, Homo sapiens
acactgcaccctcc

SEQ ID NO: 608710 - DNA, 15 bp, Homo sapiens
acactgcaccctcca

SEQ ID NO: 608711 - DNA, 11 bp, Homo sapiens
acactgcagcc

SEQ ID NO: 608712 - DNA, 16 bp, Homo sapiens
acactgcagccctctc

SEQ ID NO: 608713 - DNA, 17 bp, Homo sapiens
acactgcagccctctcc

SEQ ID NO: 608714 - DNA, 18 bp, Homo sapiens
acactgtcaagattaagt

SEQ ID NO: 608715 - DNA, 19 bp, Homo sapiens
acactgtgaactaatgaca

SEQ ID NO: 608716 - DNA, 15 bp, Homo sapiens
acacttctccttaac

SEQ ID NO: 608717 - DNA, 22 bp, Homo sapiens
acacttgggctggcacccactg

SEQ ID NO: 608718 - DNA, 21 bp, Homo sapiens
acagaaaaatgaaatttaagc

SEQ ID NO: 608719 - DNA, 16 bp, Homo sapiens
acagaaaccaagccat

SEQ ID NO: 608720 - DNA, 19 bp, Homo sapiens
acagaaaccaagccattaa

SEQ ID NO: 608721 - DNA, 16 bp, Homo sapiens
acagaaagcatagacg

SEQ ID NO: 608722 - DNA, 15 bp, Homo sapiens
acagaacaacaacaa

SEQ ID NO: 608723 - DNA, 12 bp, Homo sapiens
acagaaggcccg

SEQ ID NO: 608724 - DNA, 12 bp, Homo sapiens
acagacattgtt

SEQ ID NO: 608725 - DNA, 19 bp, Homo sapiens
acagacctccagattattt

SEQ ID NO: 608726 - DNA, 22 bp, Homo sapiens
acagacctccagattattttct

SEQ ID NO: 608727 - DNA, 22 bp, Homo sapiens
acagacggacgggacagcggcc

SEQ ID NO: 608728 - DNA, 19 bp, Homo sapiens
acagactctgtgagattct

SEQ ID NO: 608729 - DNA, 18 bp, Homo sapiens
acagagtgccctggggca

SEQ ID NO: 608730 - DNA, 18 bp, Homo sapiens
acagagtggatctggagt

SEQ ID NO: 608731 - DNA, 21 bp, Homo sapiens
acagatcacatgcccctctta

SEQ ID NO: 608732 - DNA, 22 bp, Homo sapiens
acagatcctccgcggaggcccc

SEQ ID NO: 608733 - DNA, 12 bp, Homo sapiens
acagatcttgag

SEQ ID NO: 608734 - DNA, 20 bp, Homo sapiens
acagatgagattccctctcc

SEQ ID NO: 608735 - DNA, 22 bp, Homo sapiens
acagatggtgtcctgcatgtat

SEQ ID NO: 608736 - DNA, 15 bp, Homo sapiens
acagcaaacacagtc

SEQ ID NO: 608737 - DNA, 15 bp, Homo sapiens
acagcatgcatttag

SEQ ID NO: 608738 - DNA, 20 bp, Homo sapiens
acagcatgcatttagcatga

SEQ ID NO: 608739 - DNA, 19 bp, Homo sapiens
acagcatttctttggaaac

SEQ ID NO: 608740 - DNA, 13 bp, Homo sapiens
acagcctctccct

SEQ ID NO: 608741 - DNA, 12 bp, Homo sapiens
acagcctgcaca

SEQ ID NO: 608742 - DNA, 18 bp, Homo sapiens
acagcggcccggcccacg

SEQ ID NO: 608743 - DNA, 19 bp, Homo sapiens
acagcggcccggcccacgc

SEQ ID NO: 608744 - DNA, 21 bp, Homo sapiens
acagcggcccggcccacgcag

SEQ ID NO: 608745 - DNA, 19 bp, Homo sapiens
acagctgaaagacagtaaa

SEQ ID NO: 608746 - DNA, 16 bp, Homo sapiens
acagctgtattatctt

SEQ ID NO: 608747 - DNA, 19 bp, Homo sapiens
acagcttcacttaaaatca

SEQ ID NO: 608748 - DNA, 14 bp, Homo sapiens
acaggagactccaa

SEQ ID NO: 608749 - DNA, 16 bp, Homo sapiens
acaggagcgtgtacta

SEQ ID NO: 608750 - DNA, 15 bp, Homo sapiens
acaggatgcatatta

SEQ ID NO: 608751 - DNA, 22 bp, Homo sapiens
acaggatgcatattaaagaaag

SEQ ID NO: 608752 - DNA, 15 bp, Homo sapiens
acaggcaccatgctg

SEQ ID NO: 608753 - DNA, 23 bp, Homo sapiens
acaggcagttaggtgctgaatga

SEQ ID NO: 608754 - DNA, 19 bp, Homo sapiens
acaggcatattattttctg

SEQ ID NO: 608755 - DNA, 19 bp, Homo sapiens
acccaaggtggtcttggag

SEQ ID NO: 608756 - DNA, 20 bp, Homo sapiens
acccacaccccgtctgcccc

SEQ ID NO: 608757 - DNA, 21 bp, Homo sapiens
acccacaccccgtctgcccct

SEQ ID NO: 608758 - DNA, 22 bp, Homo sapiens
acccacaccccgtctgcccctt

SEQ ID NO: 608759 - DNA, 23 bp, Homo sapiens
acccacaccccgtctgccccttg

SEQ ID NO: 608760 - DNA, 12 bp, Homo sapiens
acccacataaac

SEQ ID NO: 608761 - DNA, 13 bp, Homo sapiens
acccacataaaca

SEQ ID NO: 608762 - DNA, 14 bp, Homo sapiens
acccacataaacac

SEQ ID NO: 608763 - DNA, 15 bp, Homo sapiens
acccacataaacact

SEQ ID NO: 608764 - DNA, 20 bp, Homo sapiens
acccactagccctctttctc

SEQ ID NO: 608765 - DNA, 13 bp, Homo sapiens
acccagcagcgcc

SEQ ID NO: 608766 - DNA, 19 bp, Homo sapiens
acccagcagcgcccgaggc

SEQ ID NO: 608767 - DNA, 12 bp, Homo sapiens
acccagcctgaa

SEQ ID NO: 608768 - DNA, 15 bp, Homo sapiens
acccaggtgttgtcc

SEQ ID NO: 608769 - DNA, 12 bp, Homo sapiens
acccagtgttca

SEQ ID NO: 608770 - DNA, 20 bp, Homo sapiens
accccacacgccggggctgg

SEQ ID NO: 608771 - DNA, 23 bp, Homo sapiens
accccacacgccggggctggccc

SEQ ID NO: 608772 - DNA, 22 bp, Homo sapiens
accccaggacgcatgcagggcc

SEQ ID NO: 608773 - DNA, 16 bp, Homo sapiens
acccccagcctccccc

SEQ ID NO: 608774 - DNA, 18 bp, Homo sapiens
acccccaggtattgtctt

SEQ ID NO: 608775 - DNA, 14 bp, Homo sapiens
acccccattgtgaa

SEQ ID NO: 608776 - DNA, 21 bp, Homo sapiens
acccccccagtccgccccgtg

SEQ ID NO: 608777 - DNA, 15 bp, Homo sapiens
accccgctcttccca

SEQ ID NO: 608778 - DNA, 13 bp, Homo sapiens
accccgctgcctg

SEQ ID NO: 608779 - DNA, 14 bp, Homo sapiens
accccgctgcctgg

SEQ ID NO: 608780 - DNA, 15 bp, Homo sapiens
accccgtcccggccc

SEQ ID NO: 608781 - DNA, 17 bp, Homo sapiens
accccgtccctttccct

SEQ ID NO: 608782 - DNA, 22 bp, Homo sapiens
accccgtccctttccctgcatc

SEQ ID NO: 608783 - DNA, 15 bp, Homo sapiens
accccgtctgcccct

SEQ ID NO: 608784 - DNA, 16 bp, Homo sapiens
accccgttcccagcgc

SEQ ID NO: 608785 - DNA, 22 bp, Homo sapiens
accccgttgttgtccctgcagg

SEQ ID NO: 608786 - DNA, 18 bp, Homo sapiens
acccctcaagccaggaga

SEQ ID NO: 608787 - DNA, 13 bp, Homo sapiens
acccctcttcccc

SEQ ID NO: 608788 - DNA, 13 bp, Homo sapiens
acccctgccctcg

SEQ ID NO: 608789 - DNA, 13 bp, Homo sapiens
acccgccccagag

SEQ ID NO: 608790 - DNA, 15 bp, Homo sapiens
acccgccccagagac

SEQ ID NO: 608791 - DNA, 16 bp, Homo sapiens
acccgccccagagact

SEQ ID NO: 608792 - DNA, 17 bp, Homo sapiens
accctaggtctccaccc

SEQ ID NO: 608793 - DNA, 20 bp, Homo sapiens
accctaggtctccacccctc

SEQ ID NO: 608794 - DNA, 23 bp, Homo sapiens
accctaggtctccacccctcaag

SEQ ID NO: 608795 - DNA, 24 bp, Homo sapiens
accctaggtctccacccctcaagc

SEQ ID NO: 608796 - DNA, 12 bp, Homo sapiens
accctatctccc

SEQ ID NO: 608797 - DNA, 16 bp, Homo sapiens
accctccacaggagcc

SEQ ID NO: 608798 - DNA, 14 bp, Homo sapiens
accctcccctctcc

SEQ ID NO: 608799 - DNA, 20 bp, Homo sapiens
accctcttctcagctccact

SEQ ID NO: 608800 - DNA, 23 bp, Homo sapiens
accctgaaatattttctacttta

SEQ ID NO: 608801 - DNA, 14 bp, Homo sapiens
accctgactgtggg

SEQ ID NO: 608802 - DNA, 24 bp, Homo sapiens
accctgagcagatcgtgccgtgga

SEQ ID NO: 608803 - DNA, 13 bp, Homo sapiens
accctgagcctga

SEQ ID NO: 608804 - DNA, 15 bp, Homo sapiens
accctgccctgcacc

SEQ ID NO: 608805 - DNA, 15 bp, Homo sapiens
accctgcgcccctgc

SEQ ID NO: 608806 - DNA, 20 bp, Homo sapiens
accctgcgcccctgcccagc

SEQ ID NO: 608807 - DNA, 21 bp, Homo sapiens
accctgcgcccctgcccagca

SEQ ID NO: 608808 - DNA, 15 bp, Homo sapiens
accctgggcctcccg

SEQ ID NO: 608809 - DNA, 13 bp, Homo sapiens
acccttcaatgtt

SEQ ID NO: 608810 - DNA, 13 bp, Homo sapiens
acccttccccact

SEQ ID NO: 608811 - DNA, 14 bp, Homo sapiens
acccttccccactc

SEQ ID NO: 608812 - DNA, 15 bp, Homo sapiens
acccttgaaaatata

SEQ ID NO: 608813 - DNA, 17 bp, Homo sapiens
acccttggtctgtgttc

SEQ ID NO: 608814 - DNA, 20 bp, Homo sapiens
accgaaaacgtggctgcttc

SEQ ID NO: 608815 - DNA, 21 bp, Homo sapiens
accgaaaacgtggctgcttca

SEQ ID NO: 608816 - DNA, 22 bp, Homo sapiens
accgaaaacgtggctgcttcaa

SEQ ID NO: 608817 - DNA, 14 bp, Homo sapiens
accgaaatgaaaat

SEQ ID NO: 608818 - DNA, 17 bp, Homo sapiens
accgcccaacccccacc

SEQ ID NO: 608819 - DNA, 18 bp, Homo sapiens
accgcccaacccccacct

SEQ ID NO: 608820 - DNA, 11 bp, Homo sapiens
accgcccaccc

SEQ ID NO: 608821 - DNA, 12 bp, Homo sapiens
accgcccaccca

SEQ ID NO: 608822 - DNA, 14 bp, Homo sapiens
accgcccacccaca

SEQ ID NO: 608823 - DNA, 16 bp, Homo sapiens
accgcccacccacacc

SEQ ID NO: 608824 - DNA, 15 bp, Homo sapiens
accgcccacccagca

SEQ ID NO: 608825 - DNA, 16 bp, Homo sapiens
accgcccacccagcag

SEQ ID NO: 608826 - DNA, 17 bp, Homo sapiens
accgcccacccagcagc

SEQ ID NO: 608827 - DNA, 18 bp, Homo sapiens
accgcccacccagcagcg

SEQ ID NO: 608828 - DNA, 13 bp, Homo sapiens
accgcgcccctct

SEQ ID NO: 608829 - DNA, 18 bp, Homo sapiens
accgcgcccctctgcgcc

SEQ ID NO: 608830 - DNA, 19 bp, Homo sapiens
accggacgctggagaccct

SEQ ID NO: 608831 - DNA, 15 bp, Homo sapiens
accggagcggctgag

SEQ ID NO: 608832 - DNA, 17 bp, Homo sapiens
accggagcggctgagga

SEQ ID NO: 608833 - DNA, 14 bp, Homo sapiens
accgtcaatgtgaa

SEQ ID NO: 608834 - DNA, 20 bp, Homo sapiens
accgtggtgtgaggcccccg

SEQ ID NO: 608835 - DNA, 21 bp, Homo sapiens
acctaaatttttgtaagaaaa

SEQ ID NO: 608836 - DNA, 14 bp, Homo sapiens
acctacatctgaaa

SEQ ID NO: 608837 - DNA, 14 bp, Homo sapiens
acctaccctggacc

SEQ ID NO: 608838 - DNA, 19 bp, Homo sapiens
acctactcctccccctcct

SEQ ID NO: 608839 - DNA, 22 bp, Homo sapiens
acctactcctccccctcctcca

SEQ ID NO: 608840 - DNA, 23 bp, Homo sapiens
acctcacttgtggcagcttccct

SEQ ID NO: 608841 - DNA, 18 bp, Homo sapiens
acctcagttggcctctgc

SEQ ID NO: 608842 - DNA, 23 bp, Homo sapiens
acctcagttggcctctgcccctc

SEQ ID NO: 608843 - DNA, 18 bp, Homo sapiens
acctcccctggtcctgca

SEQ ID NO: 608844 - DNA, 20 bp, Homo sapiens
acctccctgtctctacaaaa

SEQ ID NO: 608845 - DNA, 16 bp, Homo sapiens
acctcccttcatccca

SEQ ID NO: 608846 - DNA, 12 bp, Homo sapiens
acctctgaggac

SEQ ID NO: 608847 - DNA, 22 bp, Homo sapiens
acctgaaagcccttctcaagac

SEQ ID NO: 608848 - DNA, 24 bp, Homo sapiens
acctgccaggcctccctcgggctg

SEQ ID NO: 608849 - DNA, 19 bp, Homo sapiens
acctgcccagttagcccgg

SEQ ID NO: 608850 - DNA, 14 bp, Homo sapiens
acctgcgcaccccg

SEQ ID NO: 608851 - DNA, 13 bp, Homo sapiens
acctggtggccct

SEQ ID NO: 608852 - DNA, 16 bp, Homo sapiens
acctgttgtctgaaac

SEQ ID NO: 608853 - DNA, 14 bp, Homo sapiens
accttacaaccaca

SEQ ID NO: 608854 - DNA, 20 bp, Homo sapiens
accttacaaccacatttctg

SEQ ID NO: 608855 - DNA, 13 bp, Homo sapiens
accttcctgccca

SEQ ID NO: 608856 - DNA, 14 bp, Homo sapiens
accttcctgcccag

SEQ ID NO: 608857 - DNA, 22 bp, Homo sapiens
accttctgtgcatctggcctgg

SEQ ID NO: 608858 - DNA, 18 bp, Homo sapiens
accttgcgaccatgtgta

SEQ ID NO: 608859 - DNA, 14 bp, Homo sapiens
accttggagaggag

SEQ ID NO: 608860 - DNA, 23 bp, Homo sapiens
accttgggcacgggagagcgcca

SEQ ID NO: 608861 - DNA, 17 bp, Homo sapiens
acctttgtccaggcctg

SEQ ID NO: 608862 - DNA, 17 bp, Homo sapiens
accttttaaaaaaataa

SEQ ID NO: 608863 - DNA, 22 bp, Homo sapiens
accttttaaaaaaataatataa

SEQ ID NO: 608864 - DNA, 14 bp, Homo sapiens
acgaatattgctga

SEQ ID NO: 608865 - DNA, 14 bp, Homo sapiens
acgacataagctgg

SEQ ID NO: 608866 - DNA, 22 bp, Homo sapiens
acgaccgtcttttgaaaactca

SEQ ID NO: 608867 - DNA, 21 bp, Homo sapiens
acgacctacatctgaaatcta

SEQ ID NO: 608868 - DNA, 14 bp, Homo sapiens
acgactttctttaa

SEQ ID NO: 608869 - DNA, 17 bp, Homo sapiens
acgactttctttaacat

SEQ ID NO: 608870 - DNA, 19 bp, Homo sapiens
acgagcagagcgcagcccc

SEQ ID NO: 608871 - DNA, 18 bp, Homo sapiens
acgaggagcttccagtgc

SEQ ID NO: 608872 - DNA, 13 bp, Homo sapiens
agaaaagcacctc

SEQ ID NO: 608873 - DNA, 19 bp, Homo sapiens
agaaaatgctttctcatgc

SEQ ID NO: 608874 - DNA, 14 bp, Homo sapiens
agaaaatttaaaaa

SEQ ID NO: 608875 - DNA, 20 bp, Homo sapiens
agaaaatttttgtctttcat

SEQ ID NO: 608876 - DNA, 19 bp, Homo sapiens
agaaacacagcatgcattt

SEQ ID NO: 608877 - DNA, 24 bp, Homo sapiens
agaaacacagcatgcatttagcat

SEQ ID NO: 608878 - DNA, 16 bp, Homo sapiens
agaaacacggagtttc

SEQ ID NO: 608879 - DNA, 10 bp, Homo sapiens
agaaagaaaa

SEQ ID NO: 608880 - DNA, 15 bp, Homo sapiens
agaaagacattctta

SEQ ID NO: 608881 - DNA, 22 bp, Homo sapiens
agaaagatcaaattaaataata

SEQ ID NO: 608882 - DNA, 19 bp, Homo sapiens
agaaagggagaaggattct

SEQ ID NO: 608883 - DNA, 18 bp, Homo sapiens
agaaataaaatcaccctg

SEQ ID NO: 608884 - DNA, 21 bp, Homo sapiens
agaaatcctaacattatattc

SEQ ID NO: 608885 - DNA, 16 bp, Homo sapiens
agaaatgagaaattgt

SEQ ID NO: 608886 - DNA, 13 bp, Homo sapiens
agaaattagggct

SEQ ID NO: 608887 - DNA, 21 bp, Homo sapiens
agaaattagggctctaatttc

SEQ ID NO: 608888 - DNA, 11 bp, Homo sapiens
agaaattctat

SEQ ID NO: 608889 - DNA, 20 bp, Homo sapiens
agaaattctataagagacaa

SEQ ID NO: 608890 - DNA, 22 bp, Homo sapiens
agaaattctataagagacaaag

SEQ ID NO: 608891 - DNA, 17 bp, Homo sapiens
agaaattgtgccaaaga

SEQ ID NO: 608892 - DNA, 23 bp, Homo sapiens
agaaatttattcttatcttagga

SEQ ID NO: 608893 - DNA, 22 bp, Homo sapiens
agaaatttttttccagaattga

SEQ ID NO: 608894 - DNA, 22 bp, Homo sapiens
agaacaaatatgattctcctct

SEQ ID NO: 608895 - DNA, 23 bp, Homo sapiens
agaacaacaacaaagcatgctca

SEQ ID NO: 608896 - DNA, 14 bp, Homo sapiens
agaaccagcactcc

SEQ ID NO: 608897 - DNA, 16 bp, Homo sapiens
agaaccagcactccca

SEQ ID NO: 608898 - DNA, 18 bp, Homo sapiens
agaaccagcactcccagg

SEQ ID NO: 608899 - DNA, 22 bp, Homo sapiens
agaaccagcactcccagggccc

SEQ ID NO: 608900 - DNA, 13 bp, Homo sapiens
agaacccccctcc

SEQ ID NO: 608901 - DNA, 14 bp, Homo sapiens
agaacccccctccc

SEQ ID NO: 608902 - DNA, 19 bp, Homo sapiens
agaacccccctccccaagg

SEQ ID NO: 608903 - DNA, 22 bp, Homo sapiens
agaacctagtcttgttgttcat

SEQ ID NO: 608904 - DNA, 13 bp, Homo sapiens
agaacctgcgcac

SEQ ID NO: 608905 - DNA, 20 bp, Homo sapiens
agaacctgtagaagatgacc

SEQ ID NO: 608906 - DNA, 13 bp, Homo sapiens
agaaccttctaat

SEQ ID NO: 608907 - DNA, 16 bp, Homo sapiens
agaacgggcctccccg

SEQ ID NO: 608908 - DNA, 19 bp, Homo sapiens
agaacgggcctccccgggg

SEQ ID NO: 608909 - DNA, 18 bp, Homo sapiens
agaactcatgtgatttac

SEQ ID NO: 608910 - DNA, 19 bp, Homo sapiens
agaagaaatagcagagcct

SEQ ID NO: 608911 - DNA, 19 bp, Homo sapiens
agaagaaggactgaagaaa

SEQ ID NO: 608912 - DNA, 18 bp, Homo sapiens
agaagatagttgtaaaga

SEQ ID NO: 608913 - DNA, 14 bp, Homo sapiens
agaagcagcagcta

SEQ ID NO: 608914 - DNA, 22 bp, Homo sapiens
agaagcagcagctagaaagaga

SEQ ID NO: 608915 - DNA, 15 bp, Homo sapiens
agaagctagatgccc

SEQ ID NO: 608916 - DNA, 14 bp, Homo sapiens
agaaggactgaaga

SEQ ID NO: 608917 - DNA, 14 bp, Homo sapiens
agaaggaggaaccc

SEQ ID NO: 608918 - DNA, 22 bp, Homo sapiens
agaaggcctgccccccttccca

SEQ ID NO: 608919 - DNA, 14 bp, Homo sapiens
agaagggccaccct

SEQ ID NO: 608920 - DNA, 13 bp, Homo sapiens
agaaggggcgagg

SEQ ID NO: 608921 - DNA, 21 bp, Homo sapiens
agaagggttctgccctgcctg

SEQ ID NO: 608922 - DNA, 17 bp, Homo sapiens
agaaggtgaaatggagg

SEQ ID NO: 608923 - DNA, 14 bp, Homo sapiens
agaagtgaaaaaga

SEQ ID NO: 608924 - DNA, 16 bp, Homo sapiens
agaagtgaaaaagact

SEQ ID NO: 608925 - DNA, 20 bp, Homo sapiens
agaagtggaaggataatgag

SEQ ID NO: 608926 - DNA, 17 bp, Homo sapiens
agaagtgggattcagga

SEQ ID NO: 608927 - DNA, 22 bp, Homo sapiens
agaagtttaaatctttgttaaa

SEQ ID NO: 608928 - DNA, 23 bp, Homo sapiens
agaataaagccttgtgatcactt

SEQ ID NO: 608929 - DNA, 17 bp, Homo sapiens
agaataggcaaactttt

SEQ ID NO: 608930 - DNA, 13 bp, Homo sapiens
agaatgagaaatc

SEQ ID NO: 608931 - DNA, 14 bp, Homo sapiens
agaatgagaaatca

SEQ ID NO: 608932 - DNA, 18 bp, Homo sapiens
agaatgagaaatcatgtt

SEQ ID NO: 608933 - DNA, 17 bp, Homo sapiens
agaatgagatgatttaa

SEQ ID NO: 608934 - DNA, 14 bp, Homo sapiens
agaatggctctggc

SEQ ID NO: 608935 - DNA, 15 bp, Homo sapiens
agaatggctctggct

SEQ ID NO: 608936 - DNA, 23 bp, Homo sapiens
agaatgttgaaactgacttgctg

SEQ ID NO: 608937 - DNA, 19 bp, Homo sapiens
agaattgaaccgtcaatgt

SEQ ID NO: 608938 - DNA, 20 bp, Homo sapiens
agaattgaaccgtcaatgtg

SEQ ID NO: 608939 - DNA, 22 bp, Homo sapiens
agaattgaaccgtcaatgtgaa

SEQ ID NO: 608940 - DNA, 10 bp, Homo sapiens
agaattgaga

SEQ ID NO: 608941 - DNA, 18 bp, Homo sapiens
agaattttaaaaaagatg

SEQ ID NO: 608942 - DNA, 22 bp, Homo sapiens
agaattttaaaaaagatggatt

SEQ ID NO: 608943 - DNA, 15 bp, Homo sapiens
agacaaatacacata

SEQ ID NO: 608944 - DNA, 16 bp, Homo sapiens
agacaaatacacatac

SEQ ID NO: 608945 - DNA, 13 bp, Homo sapiens
agacaacacacac

SEQ ID NO: 608946 - DNA, 21 bp, Homo sapiens
agacaagtctagtggaaccaa

SEQ ID NO: 608947 - DNA, 21 bp, Homo sapiens
agacaagtctgagtagttatg

SEQ ID NO: 608948 - DNA, 21 bp, Homo sapiens
agacaatgtggaattacataa

SEQ ID NO: 608949 - DNA, 17 bp, Homo sapiens
agacacacaagcagaca

SEQ ID NO: 608950 - DNA, 11 bp, Homo sapiens
agacacacaca

SEQ ID NO: 608951 - DNA, 12 bp, Homo sapiens
agacacacacat

SEQ ID NO: 608952 - DNA, 13 bp, Homo sapiens
agacacacacata

SEQ ID NO: 608953 - DNA, 18 bp, Homo sapiens
agacacagcccagagact

SEQ ID NO: 608954 - DNA, 15 bp, Homo sapiens
agacagaaaccaagc

SEQ ID NO: 608955 - DNA, 21 bp, Homo sapiens
agacagaggtttcattttcat

SEQ ID NO: 608956 - DNA, 20 bp, Homo sapiens
agacagagtggatctggagt

SEQ ID NO: 608957 - DNA, 16 bp, Homo sapiens
agacagccatacttcc

SEQ ID NO: 608958 - DNA, 16 bp, Homo sapiens
agacagggcgtcctct

SEQ ID NO: 608959 - DNA, 17 bp, Homo sapiens
agacagggtggggctta

SEQ ID NO: 608960 - DNA, 23 bp, Homo sapiens
agacagggtggggcttagaatgg

SEQ ID NO: 608961 - DNA, 16 bp, Homo sapiens
agacatccacaatgga

SEQ ID NO: 608962 - DNA, 15 bp, Homo sapiens
agacattcttagtta

SEQ ID NO: 608963 - DNA, 17 bp, Homo sapiens
agacattgtcagcaaat

SEQ ID NO: 608964 - DNA, 19 bp, Homo sapiens
agacattgttttgccaaca

SEQ ID NO: 608965 - DNA, 22 bp, Homo sapiens
agaccaccgcgcccctctgcgc

SEQ ID NO: 608966 - DNA, 17 bp, Homo sapiens
agaccacgcccctgcct

SEQ ID NO: 608967 - DNA, 18 bp, Homo sapiens
agaccacgcccctgcctg

SEQ ID NO: 608968 - DNA, 22 bp, Homo sapiens
agaccacggtccaatccagcct

SEQ ID NO: 608969 - DNA, 17 bp, Homo sapiens
agaccacttccttaaca

SEQ ID NO: 608970 - DNA, 20 bp, Homo sapiens
agaccacttccttaacagct

SEQ ID NO: 608971 - DNA, 20 bp, Homo sapiens
agaccagcctgccaggccct

SEQ ID NO: 608972 - DNA, 17 bp, Homo sapiens
agaccatgcattcagat

SEQ ID NO: 608973 - DNA, 17 bp, Homo sapiens
agaccctatttgtttca

SEQ ID NO: 608974 - DNA, 20 bp, Homo sapiens
agaccctatttgtttcatta

SEQ ID NO: 608975 - DNA, 16 bp, Homo sapiens
agaccctgcgcccctg

SEQ ID NO: 608976 - DNA, 21 bp, Homo sapiens
agaccctgtctttgctgttta

SEQ ID NO: 608977 - DNA, 17 bp, Homo sapiens
agaccgtggtgtcctct

SEQ ID NO: 608978 - DNA, 13 bp, Homo sapiens
agacggcagcccc

SEQ ID NO: 608979 - DNA, 23 bp, Homo sapiens
agactaacttattttgattgttt

SEQ ID NO: 608980 - DNA, 15 bp, Homo sapiens
agactccaaggagct

SEQ ID NO: 608981 - DNA, 15 bp, Homo sapiens
agactcgagagggct

SEQ ID NO: 608982 - DNA, 15 bp, Homo sapiens
agactcgcctgggaa

SEQ ID NO: 608983 - DNA, 19 bp, Homo sapiens
agactcgcgacaatgcaaa

SEQ ID NO: 608984 - DNA, 20 bp, Homo sapiens
agactcgcgacaatgcaaac

SEQ ID NO: 608985 - DNA, 21 bp, Homo sapiens
agactcgcgacaatgcaaacc

SEQ ID NO: 608986 - DNA, 17 bp, Homo sapiens
agactctctcctctctc

SEQ ID NO: 608987 - DNA, 22 bp, Homo sapiens
agactctctcctctctctccct

SEQ ID NO: 608988 - DNA, 23 bp, Homo sapiens
agcacacctcggccgaggcctgc

SEQ ID NO: 608989 - DNA, 21 bp, Homo sapiens
agcacagagagcggcttcccc

SEQ ID NO: 608990 - DNA, 11 bp, Homo sapiens
agcacagccat

SEQ ID NO: 608991 - DNA, 12 bp, Homo sapiens
agcacagccata

SEQ ID NO: 608992 - DNA, 15 bp, Homo sapiens
agcacagtatttaac

SEQ ID NO: 608993 - DNA, 21 bp, Homo sapiens
agcacatttgttaatgattct

SEQ ID NO: 608994 - DNA, 12 bp, Homo sapiens
agcacccccagc

SEQ ID NO: 608995 - DNA, 15 bp, Homo sapiens
agcacccccagcctc

SEQ ID NO: 608996 - DNA, 19 bp, Homo sapiens
agcaccgtggtgtgaggcc

SEQ ID NO: 608997 - DNA, 21 bp, Homo sapiens
agcaccgtggtgtgaggcccc

SEQ ID NO: 608998 - DNA, 22 bp, Homo sapiens
agcaccgtggtgtgaggccccc

SEQ ID NO: 608999 - DNA, 17 bp, Homo sapiens
agcacctcctccgtggg

SEQ ID NO: 609000 - DNA, 13 bp, Homo sapiens
agcacctcttgaa

SEQ ID NO: 609001 - DNA, 18 bp, Homo sapiens
agcactcccagggcccga

SEQ ID NO: 609002 - DNA, 22 bp, Homo sapiens
agcactttacagatgagattcc

SEQ ID NO: 609003 - DNA, 13 bp, Homo sapiens
agcagaatgagat

SEQ ID NO: 609004 - DNA, 15 bp, Homo sapiens
agcagaatgagatga

SEQ ID NO: 609005 - DNA, 14 bp, Homo sapiens
agcagacacacaca

SEQ ID NO: 609006 - DNA, 16 bp, Homo sapiens
agcagacacacacata

SEQ ID NO: 609007 - DNA, 19 bp, Homo sapiens
agcagacacacacatatat

SEQ ID NO: 609008 - DNA, 12 bp, Homo sapiens
agcagacattgt

SEQ ID NO: 609009 - DNA, 17 bp, Homo sapiens
agcagacattgtcagca

SEQ ID NO: 609010 - DNA, 18 bp, Homo sapiens
agcagagaagcctgtctg

SEQ ID NO: 609011 - DNA, 11 bp, Homo sapiens
agcagagccta

SEQ ID NO: 609012 - DNA, 16 bp, Homo sapiens
agcagatcgtgccgtg

SEQ ID NO: 609013 - DNA, 20 bp, Homo sapiens
agcagatcgtgccgtggagc

SEQ ID NO: 609014 - DNA, 23 bp, Homo sapiens
agcagatcgtgccgtggagcttg

SEQ ID NO: 609015 - DNA, 20 bp, Homo sapiens
agcagattttaggaaatgaa

SEQ ID NO: 609016 - DNA, 15 bp, Homo sapiens
agcagcagtttgtga

SEQ ID NO: 609017 - DNA, 20 bp, Homo sapiens
agcagcagtttgtgatctgt

SEQ ID NO: 609018 - DNA, 16 bp, Homo sapiens
agcagccccctgtggc

SEQ ID NO: 609019 - DNA, 15 bp, Homo sapiens
agcagcgcccgaggc

SEQ ID NO: 609020 - DNA, 21 bp, Homo sapiens
agcagcgcccgaggccagggc

SEQ ID NO: 609021 - DNA, 15 bp, Homo sapiens
agcagctagaaagag

SEQ ID NO: 609022 - DNA, 17 bp, Homo sapiens
agcagctagaaagagaa

SEQ ID NO: 609023 - DNA, 20 bp, Homo sapiens
agcagctcttcccctttcct

SEQ ID NO: 609024 - DNA, 16 bp, Homo sapiens
agcagtaccatcccac

SEQ ID NO: 609025 - DNA, 22 bp, Homo sapiens
agcagtccaaggtattgagaca

SEQ ID NO: 609026 - DNA, 17 bp, Homo sapiens
agcagtttgtgatctgt

SEQ ID NO: 609027 - DNA, 20 bp, Homo sapiens
agcatactgatgagacaaca

SEQ ID NO: 609028 - DNA, 22 bp, Homo sapiens
agcatactgatgagacaacaca

SEQ ID NO: 609029 - DNA, 15 bp, Homo sapiens
agcatagttctgcaa

SEQ ID NO: 609030 - DNA, 22 bp, Homo sapiens
agcatagttctgcaataacagt

SEQ ID NO: 609031 - DNA, 18 bp, Homo sapiens
agcatatataatcaaaat

SEQ ID NO: 609032 - DNA, 18 bp, Homo sapiens
agcatatatataaaatac

SEQ ID NO: 609033 - DNA, 19 bp, Homo sapiens
agcatatatataaaataca

SEQ ID NO: 609034 - DNA, 16 bp, Homo sapiens
agcatgcatttagcat

SEQ ID NO: 609035 - DNA, 18 bp, Homo sapiens
agcatgcatttagcatga

SEQ ID NO: 609036 - DNA, 20 bp, Homo sapiens
agcatgcatttagcatgagt

SEQ ID NO: 609037 - DNA, 23 bp, Homo sapiens
agcatgcatttagcatgagttct

SEQ ID NO: 609038 - DNA, 17 bp, Homo sapiens
agcatgccaatttctct

SEQ ID NO: 609039 - DNA, 20 bp, Homo sapiens
agcatgcccaaatataacat

SEQ ID NO: 609040 - DNA, 21 bp, Homo sapiens
agcatgctccctcatgcagat

SEQ ID NO: 609041 - DNA, 21 bp, Homo sapiens
agcatgggactgtgcctttgg

SEQ ID NO: 609042 - DNA, 16 bp, Homo sapiens
agcatgtaatattaaa

SEQ ID NO: 609043 - DNA, 17 bp, Homo sapiens
agcatgtaatattaaat

SEQ ID NO: 609044 - DNA, 15 bp, Homo sapiens
agcatgtacagtgtt

SEQ ID NO: 609045 - DNA, 14 bp, Homo sapiens
agcatgtattgtgt

SEQ ID NO: 609046 - DNA, 22 bp, Homo sapiens
agcatgtattgtgtcttttgca

SEQ ID NO: 609047 - DNA, 23 bp, Homo sapiens
agcatgtattgtgtcttttgcat

SEQ ID NO: 609048 - DNA, 14 bp, Homo sapiens
agcatgtcctatcc

SEQ ID NO: 609049 - DNA, 15 bp, Homo sapiens
agcattcagcacaca

SEQ ID NO: 609050 - DNA, 13 bp, Homo sapiens
agcattctggggt

SEQ ID NO: 609051 - DNA, 20 bp, Homo sapiens
agcattctggggtggggctt

SEQ ID NO: 609052 - DNA, 16 bp, Homo sapiens
agcatttgactttctg

SEQ ID NO: 609053 - DNA, 21 bp, Homo sapiens
agcattttaatagtttctaaa

SEQ ID NO: 609054 - DNA, 16 bp, Homo sapiens
agccaacttaaacctg

SEQ ID NO: 609055 - DNA, 23 bp, Homo sapiens
agccaacttaaacctgtgctttc

SEQ ID NO: 609056 - DNA, 15 bp, Homo sapiens
agccaagcctgactt

SEQ ID NO: 609057 - DNA, 17 bp, Homo sapiens
agccaataaagctcaca

SEQ ID NO: 609058 - DNA, 15 bp, Homo sapiens
agccaatttcaaaga

SEQ ID NO: 609059 - DNA, 14 bp, Homo sapiens
agccaatttttctg

SEQ ID NO: 609060 - DNA, 15 bp, Homo sapiens
agccaatttttctgc

SEQ ID NO: 609061 - DNA, 16 bp, Homo sapiens
agccaatttttctgca

SEQ ID NO: 609062 - DNA, 17 bp, Homo sapiens
agccaatttttctgcac

SEQ ID NO: 609063 - DNA, 20 bp, Homo sapiens
agccaatttttctgcactga

SEQ ID NO: 609064 - DNA, 13 bp, Homo sapiens
agccacagtgggg

SEQ ID NO: 609065 - DNA, 16 bp, Homo sapiens
agccacagtggggccc

SEQ ID NO: 609066 - DNA, 20 bp, Homo sapiens
agccacagtggggcccatgg

SEQ ID NO: 609067 - DNA, 22 bp, Homo sapiens
agccagatttcactctccttgg

SEQ ID NO: 609068 - DNA, 18 bp, Homo sapiens
agccagctgcaggaatca

SEQ ID NO: 609069 - DNA, 15 bp, Homo sapiens
agccaggagaccctg

SEQ ID NO: 609070 - DNA, 19 bp, Homo sapiens
agccaggagaccctgtctt

SEQ ID NO: 609071 - DNA, 15 bp, Homo sapiens
agccagggcagagga

SEQ ID NO: 609072 - DNA, 17 bp, Homo sapiens
agccagggcagaggaat

SEQ ID NO: 609073 - DNA, 15 bp, Homo sapiens
agccagggtcctgag

SEQ ID NO: 609074 - DNA, 18 bp, Homo sapiens
agccagggttccagacag

SEQ ID NO: 609075 - DNA, 19 bp, Homo sapiens
agccagggttccagacagg

SEQ ID NO: 609076 - DNA, 20 bp, Homo sapiens
agccagggttccagacaggg

SEQ ID NO: 609077 - DNA, 16 bp, Homo sapiens
agccagtggcacagga

SEQ ID NO: 609078 - DNA, 19 bp, Homo sapiens
agccagtggcacaggagac

SEQ ID NO: 609079 - DNA, 22 bp, Homo sapiens
agccagtggggtcccccctgag

SEQ ID NO: 609080 - DNA, 20 bp, Homo sapiens
agccatacttccagcgaaat

SEQ ID NO: 609081 - DNA, 15 bp, Homo sapiens
agccatagccccagg

SEQ ID NO: 609082 - DNA, 19 bp, Homo sapiens
agccatgcccacgcccctc

SEQ ID NO: 609083 - DNA, 17 bp, Homo sapiens
agcccacccgccccaga

SEQ ID NO: 609084 - DNA, 17 bp, Homo sapiens
agcccacttcacacatt

SEQ ID NO: 609085 - DNA, 19 bp, Homo sapiens
agcccagaacgggcctccc

SEQ ID NO: 609086 - DNA, 20 bp, Homo sapiens
agcccagaacgggcctcccc

SEQ ID NO: 609087 - DNA, 21 bp, Homo sapiens
agcccagtccctggagctgtc

SEQ ID NO: 609088 - DNA, 18 bp, Homo sapiens
agcccatcccctgcctct

SEQ ID NO: 609089 - DNA, 15 bp, Homo sapiens
agcccatgctggctg

SEQ ID NO: 609090 - DNA, 16 bp, Homo sapiens
agcccatgctggctgg

SEQ ID NO: 609091 - DNA, 12 bp, Homo sapiens
agccccaggccc

SEQ ID NO: 609092 - DNA, 16 bp, Homo sapiens
agccccaggcccgccc

SEQ ID NO: 609093 - DNA, 19 bp, Homo sapiens
agccccatccttcccgcag

SEQ ID NO: 609094 - DNA, 20 bp, Homo sapiens
agccccatccttcccgcagc

SEQ ID NO: 609095 - DNA, 22 bp, Homo sapiens
agcccccacccccgtcaccccg

SEQ ID NO: 609096 - DNA, 22 bp, Homo sapiens
agcccccgcccctccccctaca

SEQ ID NO: 609097 - DNA, 15 bp, Homo sapiens
agccccgcgaccacc

SEQ ID NO: 609098 - DNA, 21 bp, Homo sapiens
agccccgcgaccacccctgtg

SEQ ID NO: 609099 - DNA, 19 bp, Homo sapiens
agccccggagcaccacggg

SEQ ID NO: 609100 - DNA, 21 bp, Homo sapiens
agcccctatcctgcaccctct

SEQ ID NO: 609101 - DNA, 23 bp, Homo sapiens
agcccctatcctgcaccctctgc

SEQ ID NO: 609102 - DNA, 22 bp, Homo sapiens
agcccctccccatggtgcagtg

SEQ ID NO: 609103 - DNA, 11 bp, Homo sapiens
agcccctcctc

SEQ ID NO: 609104 - DNA, 17 bp, Homo sapiens
agctgtttactgacatg

SEQ ID NO: 609105 - DNA, 23 bp, Homo sapiens
agcttagaccgtggtgtcctctg

SEQ ID NO: 609106 - DNA, 18 bp, Homo sapiens
agcttcccaacaatactt

SEQ ID NO: 609107 - DNA, 14 bp, Homo sapiens
agcttgagcctgtc

SEQ ID NO: 609108 - DNA, 19 bp, Homo sapiens
agcttggagccccctggcg

SEQ ID NO: 609109 - DNA, 12 bp, Homo sapiens
agctttcctggg

SEQ ID NO: 609110 - DNA, 12 bp, Homo sapiens
agctttctcctt

SEQ ID NO: 609111 - DNA, 16 bp, Homo sapiens
agctttctgatactta

SEQ ID NO: 609112 - DNA, 14 bp, Homo sapiens
agctttggaagcag

SEQ ID NO: 609113 - DNA, 18 bp, Homo sapiens
agctttggaagcagcaag

SEQ ID NO: 609114 - DNA, 19 bp, Homo sapiens
agctttttgtgagaaagag

SEQ ID NO: 609115 - DNA, 21 bp, Homo sapiens
aggaaaaggcttgagtctgga

SEQ ID NO: 609116 - DNA, 22 bp, Homo sapiens
aggaaaattttcttctttaatt

SEQ ID NO: 609117 - DNA, 20 bp, Homo sapiens
aggaaagatcccaagtcaaa

SEQ ID NO: 609118 - DNA, 20 bp, Homo sapiens
aggaaagcctcactgatata

SEQ ID NO: 609119 - DNA, 15 bp, Homo sapiens
aggaaagtactgcat

SEQ ID NO: 609120 - DNA, 23 bp, Homo sapiens
aggaaagtactgcatgatcttac

SEQ ID NO: 609121 - DNA, 14 bp, Homo sapiens
aggaaataaatcta

SEQ ID NO: 609122 - DNA, 16 bp, Homo sapiens
aggaaatatctgtgaa

SEQ ID NO: 609123 - DNA, 19 bp, Homo sapiens
aggaaatcaccgaaaacgt

SEQ ID NO: 609124 - DNA, 15 bp, Homo sapiens
aggaaatgaatgtgt

SEQ ID NO: 609125 - DNA, 21 bp, Homo sapiens
aggaaatttttgcatgtttaa

SEQ ID NO: 609126 - DNA, 19 bp, Homo sapiens
aggaagctttggaagcagc

SEQ ID NO: 609127 - DNA, 17 bp, Homo sapiens
aggaatcaaaaattgaa

SEQ ID NO: 609128 - DNA, 15 bp, Homo sapiens
aggaatgctcaatgt

SEQ ID NO: 609129 - DNA, 16 bp, Homo sapiens
aggaatgctcaatgtg

SEQ ID NO: 609130 - DNA, 17 bp, Homo sapiens
aggaatgctcaatgtgc

SEQ ID NO: 609131 - DNA, 18 bp, Homo sapiens
aggaatgctcaatgtgct

SEQ ID NO: 609132 - DNA, 19 bp, Homo sapiens
aggaatgggccaagccagg

SEQ ID NO: 609133 - DNA, 21 bp, Homo sapiens
aggaatggggggcgggccagg

SEQ ID NO: 609134 - DNA, 22 bp, Homo sapiens
aggaatggggggcgggccaggg

SEQ ID NO: 609135 - DNA, 23 bp, Homo sapiens
aggaatggggggcgggccagggt

SEQ ID NO: 609136 - DNA, 14 bp, Homo sapiens
aggacaacctgccc

SEQ ID NO: 609137 - DNA, 15 bp, Homo sapiens
aggacaacctgcccc

SEQ ID NO: 609138 - DNA, 18 bp, Homo sapiens
aggacactgatgggtcct

SEQ ID NO: 609139 - DNA, 21 bp, Homo sapiens
aggacactgatgggtcctgct

SEQ ID NO: 609140 - DNA, 23 bp, Homo sapiens
aggacagaaccaacgggtctgtg

SEQ ID NO: 609141 - DNA, 23 bp, Homo sapiens
aggacagaggccggggtccaggc

SEQ ID NO: 609142 - DNA, 12 bp, Homo sapiens
aggacagggagg

SEQ ID NO: 609143 - DNA, 18 bp, Homo sapiens
aggacagtttaggaccca

SEQ ID NO: 609144 - DNA, 14 bp, Homo sapiens
aggaccattttaga

SEQ ID NO: 609145 - DNA, 21 bp, Homo sapiens
aggacccccccagtccgcccc

SEQ ID NO: 609146 - DNA, 15 bp, Homo sapiens
aggacggggcagagc

SEQ ID NO: 609147 - DNA, 23 bp, Homo sapiens
aggacttggtgattacctgaaag

SEQ ID NO: 609148 - DNA, 14 bp, Homo sapiens
aggagaaaatgcaa

SEQ ID NO: 609149 - DNA, 15 bp, Homo sapiens
aggagaccctgtctt

SEQ ID NO: 609150 - DNA, 23 bp, Homo sapiens
aggagatgaggctggataggaga

SEQ ID NO: 609151 - DNA, 13 bp, Homo sapiens
aggagcaaacagg

SEQ ID NO: 609152 - DNA, 13 bp, Homo sapiens
aggagcacagcca

SEQ ID NO: 609153 - DNA, 20 bp, Homo sapiens
aggagcacagccatagcaga

SEQ ID NO: 609154 - DNA, 10 bp, Homo sapiens
aggagcaccc

SEQ ID NO: 609155 - DNA, 11 bp, Homo sapiens
aggagcacccc

SEQ ID NO: 609156 - DNA, 14 bp, Homo sapiens
aggagcacccccag

SEQ ID NO: 609157 - DNA, 19 bp, Homo sapiens
aggagcacccccagcctcc

SEQ ID NO: 609158 - DNA, 22 bp, Homo sapiens
aggagcacccccagcctccccc

SEQ ID NO: 609159 - DNA, 21 bp, Homo sapiens
aggagccttgctgggccaggg

SEQ ID NO: 609160 - DNA, 15 bp, Homo sapiens
aggagcgtgtcctat

SEQ ID NO: 609161 - DNA, 18 bp, Homo sapiens
aggagctactgacattcc

SEQ ID NO: 609162 - DNA, 18 bp, Homo sapiens
aggagctagcccagtccc

SEQ ID NO: 609163 - DNA, 14 bp, Homo sapiens
aggagcttccagat

SEQ ID NO: 609164 - DNA, 21 bp, Homo sapiens
aggagcttccagtgcatgttg

SEQ ID NO: 609165 - DNA, 18 bp, Homo sapiens
aggaggacagagtgccct

SEQ ID NO: 609166 - DNA, 21 bp, Homo sapiens
aggaggacagagtgccctggg

SEQ ID NO: 609167 - DNA, 11 bp, Homo sapiens
aggaggacagg

SEQ ID NO: 609168 - DNA, 12 bp, Homo sapiens
aggaggacaggg

SEQ ID NO: 609169 - DNA, 19 bp, Homo sapiens
aggaggagccttgctgggc

SEQ ID NO: 609170 - DNA, 22 bp, Homo sapiens
aggaggccgactgggctgctgg

SEQ ID NO: 609171 - DNA, 15 bp, Homo sapiens
aggagggtgcccctg

SEQ ID NO: 609172 - DNA, 22 bp, Homo sapiens
aggagtcagtgcccatgtgtat

SEQ ID NO: 609173 - DNA, 12 bp, Homo sapiens
aggagttgcctg

SEQ ID NO: 609174 - DNA, 13 bp, Homo sapiens
aggagttgcctga

SEQ ID NO: 609175 - DNA, 22 bp, Homo sapiens
aggagttgcctgactcctgggt

SEQ ID NO: 609176 - DNA, 19 bp, Homo sapiens
aggataaattaatgagttt

SEQ ID NO: 609177 - DNA, 14 bp, Homo sapiens
aggatcctgagcca

SEQ ID NO: 609178 - DNA, 17 bp, Homo sapiens
aggatcctgagccagat

SEQ ID NO: 609179 - DNA, 18 bp, Homo sapiens
aggatcctgagccagatt

SEQ ID NO: 609180 - DNA, 16 bp, Homo sapiens
aggatgtatgtgtata

SEQ ID NO: 609181 - DNA, 22 bp, Homo sapiens
aggatgtggatggaggtgatga

SEQ ID NO: 609182 - DNA, 12 bp, Homo sapiens
aggattcaacat

SEQ ID NO: 609183 - DNA, 19 bp, Homo sapiens
aggattcttttttcaatgt

SEQ ID NO: 609184 - DNA, 20 bp, Homo sapiens
aggattcttttttcaatgta

SEQ ID NO: 609185 - DNA, 19 bp, Homo sapiens
aggcaaaaactgtactgtg

SEQ ID NO: 609186 - DNA, 19 bp, Homo sapiens
aggcacactgagcaagttt

SEQ ID NO: 609187 - DNA, 18 bp, Homo sapiens
aggcaccatgctgggccg

SEQ ID NO: 609188 - DNA, 23 bp, Homo sapiens
aggcagagattgggggggcttgg

SEQ ID NO: 609189 - DNA, 15 bp, Homo sapiens
aggcagattaataac

SEQ ID NO: 609190 - DNA, 15 bp, Homo sapiens
aggcagccctcacct

SEQ ID NO: 609191 - DNA, 18 bp, Homo sapiens
aggcagccctcacctctg

SEQ ID NO: 609192 - DNA, 16 bp, Homo sapiens
aggcagcctgcagacc

SEQ ID NO: 609193 - DNA, 17 bp, Homo sapiens
aggcagctaggcaggga

SEQ ID NO: 609194 - DNA, 21 bp, Homo sapiens
aggcagctaggcagggagggg

SEQ ID NO: 609195 - DNA, 16 bp, Homo sapiens
aggcagttaggtgctg

SEQ ID NO: 609196 - DNA, 16 bp, Homo sapiens
aggcatgcaccagtgc

SEQ ID NO: 609197 - DNA, 22 bp, Homo sapiens
aggcatgcaccagtgccgcctg

SEQ ID NO: 609198 - DNA, 19 bp, Homo sapiens
aggcatgtgatgagaggaa

SEQ ID NO: 609199 - DNA, 21 bp, Homo sapiens
aggcatgtgatgagaggaaat

SEQ ID NO: 609200 - DNA, 23 bp, Homo sapiens
aggcatgtgatgagaggaaatca

SEQ ID NO: 609201 - DNA, 21 bp, Homo sapiens
aggcattatttggatgtgagt

SEQ ID NO: 609202 - DNA, 17 bp, Homo sapiens
aggcattgcactaaaag

SEQ ID NO: 609203 - DNA, 19 bp, Homo sapiens
aggcattgcactaaaagtg

SEQ ID NO: 609204 - DNA, 21 bp, Homo sapiens
aggcattgcactaaaagtgat

SEQ ID NO: 609205 - DNA, 13 bp, Homo sapiens
aggcccagccctg

SEQ ID NO: 609206 - DNA, 17 bp, Homo sapiens
aggcccagccctgggca

SEQ ID NO: 609207 - DNA, 15 bp, Homo sapiens
aggcccagcctcttg

SEQ ID NO: 609208 - DNA, 20 bp, Homo sapiens
aggcccagcctcttgttctt

SEQ ID NO: 609209 - DNA, 14 bp, Homo sapiens
aggccccaggccct

SEQ ID NO: 609210 - DNA, 20 bp, Homo sapiens
aggcccccaaattgccttca

SEQ ID NO: 609211 - DNA, 21 bp, Homo sapiens
aggcccccaaattgccttcag

SEQ ID NO: 609212 - DNA, 19 bp, Homo sapiens
aggcccccggaggcgccca

SEQ ID NO: 609213 - DNA, 12 bp, Homo sapiens
aggcccctgagg

SEQ ID NO: 609214 - DNA, 17 bp, Homo sapiens
aggcccgaggaggccga

SEQ ID NO: 609215 - DNA, 15 bp, Homo sapiens
aggcccgccctgccc

SEQ ID NO: 609216 - DNA, 22 bp, Homo sapiens
aggccctaggattcctccccca

SEQ ID NO: 609217 - DNA, 11 bp, Homo sapiens
aggccctccag

SEQ ID NO: 609218 - DNA, 13 bp, Homo sapiens
aggccctccagca

SEQ ID NO: 609219 - DNA, 18 bp, Homo sapiens
aggccgactgggctgctg

SEQ ID NO: 609220 - DNA, 21 bp, Homo sapiens
aggtgggggctgcgtccctgc

SEQ ID NO: 609221 - DNA, 14 bp, Homo sapiens
aggtggtcttggag

SEQ ID NO: 609222 - DNA, 15 bp, Homo sapiens
aggtggtcttggaga

SEQ ID NO: 609223 - DNA, 22 bp, Homo sapiens
aggtggtcttggagaggaggtg

SEQ ID NO: 609224 - DNA, 13 bp, Homo sapiens
aggtgtggagtgg

SEQ ID NO: 609225 - DNA, 16 bp, Homo sapiens
aggtgtggagtggagg

SEQ ID NO: 609226 - DNA, 14 bp, Homo sapiens
aggtgttgtccgtg

SEQ ID NO: 609227 - DNA, 13 bp, Homo sapiens
aggttaagtctca

SEQ ID NO: 609228 - DNA, 23 bp, Homo sapiens
aggttaataggaggacagaacca

SEQ ID NO: 609229 - DNA, 17 bp, Homo sapiens
aggttctgctttctgat

SEQ ID NO: 609230 - DNA, 18 bp, Homo sapiens
aggttctgctttctgata

SEQ ID NO: 609231 - DNA, 13 bp, Homo sapiens
aggttcttgctgc

SEQ ID NO: 609232 - DNA, 16 bp, Homo sapiens
aggtttcactgttcat

SEQ ID NO: 609233 - DNA, 18 bp, Homo sapiens
agtaaaacttgtattgga

SEQ ID NO: 609234 - DNA, 20 bp, Homo sapiens
agtaaataatgattcaatgt

SEQ ID NO: 609235 - DNA, 14 bp, Homo sapiens
agtaaatatacact

SEQ ID NO: 609236 - DNA, 20 bp, Homo sapiens
agtaaatatacactttacat

SEQ ID NO: 609237 - DNA, 21 bp, Homo sapiens
agtaaatatacactttacatt

SEQ ID NO: 609238 - DNA, 17 bp, Homo sapiens
agtaaatctaaattaac

SEQ ID NO: 609239 - DNA, 19 bp, Homo sapiens
agtaaattcctaattctat

SEQ ID NO: 609240 - DNA, 13 bp, Homo sapiens
agtaattaaaaag

SEQ ID NO: 609241 - DNA, 18 bp, Homo sapiens
agtaatttcatgcacaca

SEQ ID NO: 609242 - DNA, 14 bp, Homo sapiens
agtacaataaataa

SEQ ID NO: 609243 - DNA, 14 bp, Homo sapiens
agtacaattctttg

SEQ ID NO: 609244 - DNA, 22 bp, Homo sapiens
agtacaattctttgttgcttaa

SEQ ID NO: 609245 - DNA, 20 bp, Homo sapiens
agtacataaagtaataactg

SEQ ID NO: 609246 - DNA, 21 bp, Homo sapiens
agtacataaagtaataactgt

SEQ ID NO: 609247 - DNA, 18 bp, Homo sapiens
agtaccatcccactgata

SEQ ID NO: 609248 - DNA, 15 bp, Homo sapiens
agtactagcaataag

SEQ ID NO: 609249 - DNA, 16 bp, Homo sapiens
agtactagcaataagt

SEQ ID NO: 609250 - DNA, 18 bp, Homo sapiens
agtactctaatatacagt

SEQ ID NO: 609251 - DNA, 20 bp, Homo sapiens
agtactgcatgatcttacac

SEQ ID NO: 609252 - DNA, 14 bp, Homo sapiens
agtagagagccttt

SEQ ID NO: 609253 - DNA, 23 bp, Homo sapiens
agtagcattttaatagtttctaa

SEQ ID NO: 609254 - DNA, 14 bp, Homo sapiens
agtaggtctgcaca

SEQ ID NO: 609255 - DNA, 17 bp, Homo sapiens
agtaggtctgcacacat

SEQ ID NO: 609256 - DNA, 14 bp, Homo sapiens
agtagtgcctgtga

SEQ ID NO: 609257 - DNA, 16 bp, Homo sapiens
agtagtgcctgtgatc

SEQ ID NO: 609258 - DNA, 22 bp, Homo sapiens
agtagtgtgagtgttagaaaaa

SEQ ID NO: 609259 - DNA, 17 bp, Homo sapiens
agtatacaagtgtttct

SEQ ID NO: 609260 - DNA, 13 bp, Homo sapiens
agtatatattctt

SEQ ID NO: 609261 - DNA, 16 bp, Homo sapiens
agtatatattctttca

SEQ ID NO: 609262 - DNA, 19 bp, Homo sapiens
agtatatattctttcacaa

SEQ ID NO: 609263 - DNA, 10 bp, Homo sapiens
agtatctcat

SEQ ID NO: 609264 - DNA, 21 bp, Homo sapiens
agtatctcatcaacaaagaaa

SEQ ID NO: 609265 - DNA, 12 bp, Homo sapiens
agtattctgtag

SEQ ID NO: 609266 - DNA, 22 bp, Homo sapiens
agtattgacgacctacatctga

SEQ ID NO: 609267 - DNA, 19 bp, Homo sapiens
agtattgagacactgtcaa

SEQ ID NO: 609268 - DNA, 12 bp, Homo sapiens
agtattttgagc

SEQ ID NO: 609269 - DNA, 13 bp, Homo sapiens
agtattttgagcc

SEQ ID NO: 609270 - DNA, 16 bp, Homo sapiens
agtcaaacagtgtggc

SEQ ID NO: 609271 - DNA, 17 bp, Homo sapiens
agtcaaacagtgtggct

SEQ ID NO: 609272 - DNA, 13 bp, Homo sapiens
agtcaatgcattg

SEQ ID NO: 609273 - DNA, 19 bp, Homo sapiens
agtcacgtgaggcccctgt

SEQ ID NO: 609274 - DNA, 22 bp, Homo sapiens
agtcacgtgaggcccctgtgca

SEQ ID NO: 609275 - DNA, 16 bp, Homo sapiens
agtcagggctgtgctt

SEQ ID NO: 609276 - DNA, 14 bp, Homo sapiens
agtcagtattgttt

SEQ ID NO: 609277 - DNA, 15 bp, Homo sapiens
agtcagtattgtttt

SEQ ID NO: 609278 - DNA, 21 bp, Homo sapiens
agtcagtgcccatgtgtatgg

SEQ ID NO: 609279 - DNA, 22 bp, Homo sapiens
agtcagtgcccatgtgtatgga

SEQ ID NO: 609280 - DNA, 21 bp, Homo sapiens
agtcagtgtactctgagtcct

SEQ ID NO: 609281 - DNA, 18 bp, Homo sapiens
agtcatggctgtcccctg

SEQ ID NO: 609282 - DNA, 17 bp, Homo sapiens
agtcatgtttctgcagt

SEQ ID NO: 609283 - DNA, 11 bp, Homo sapiens
agtccaaggta

SEQ ID NO: 609284 - DNA, 12 bp, Homo sapiens
agtccactttcc

SEQ ID NO: 609285 - DNA, 13 bp, Homo sapiens
agtccactttcct

SEQ ID NO: 609286 - DNA, 18 bp, Homo sapiens
agtccactttcctctctc

SEQ ID NO: 609287 - DNA, 20 bp, Homo sapiens
agtccatgtgataattgtaa

SEQ ID NO: 609288 - DNA, 19 bp, Homo sapiens
agtccatttttgagtaaaa

SEQ ID NO: 609289 - DNA, 22 bp, Homo sapiens
agtccgccccgtgctcctctgc

SEQ ID NO: 609290 - DNA, 14 bp, Homo sapiens
agtcctcacagcct

SEQ ID NO: 609291 - DNA, 21 bp, Homo sapiens
agtcctcacagcctctccctt

SEQ ID NO: 609292 - DNA, 15 bp, Homo sapiens
agtcggctgggcagg

SEQ ID NO: 609293 - DNA, 17 bp, Homo sapiens
agtcggctgggcagggc

SEQ ID NO: 609294 - DNA, 16 bp, Homo sapiens
agtcgttgatgctaat

SEQ ID NO: 609295 - DNA, 22 bp, Homo sapiens
agtctacctgccttgcctgtta

SEQ ID NO: 609296 - DNA, 17 bp, Homo sapiens
agtctatgctgtgtgca

SEQ ID NO: 609297 - DNA, 21 bp, Homo sapiens
agtctcagtgctagcttattt

SEQ ID NO: 609298 - DNA, 22 bp, Homo sapiens
agtctccacgtgtttcgggcca

SEQ ID NO: 609299 - DNA, 19 bp, Homo sapiens
agtctgaaggagaggagtg

SEQ ID NO: 609300 - DNA, 20 bp, Homo sapiens
agtctgaaggagaggagtgc

SEQ ID NO: 609301 - DNA, 19 bp, Homo sapiens
agtctgtacttcagttctc

SEQ ID NO: 609302 - DNA, 19 bp, Homo sapiens
agtcttactgttttgtgcg

SEQ ID NO: 609303 - DNA, 17 bp, Homo sapiens
agtcttgagtgggcccc

SEQ ID NO: 609304 - DNA, 23 bp, Homo sapiens
agtcttgagtgggccccctctct

SEQ ID NO: 609305 - DNA, 19 bp, Homo sapiens
agtgaaaaagacttcaaat

SEQ ID NO: 609306 - DNA, 23 bp, Homo sapiens
agtgaaaaagacttcaaatgtta

SEQ ID NO: 609307 - DNA, 20 bp, Homo sapiens
agtgaacacactcagcagcc

SEQ ID NO: 609308 - DNA, 15 bp, Homo sapiens
agtgaacagcttcac

SEQ ID NO: 609309 - DNA, 17 bp, Homo sapiens
agtgaatgctagacaga

SEQ ID NO: 609310 - DNA, 23 bp, Homo sapiens
agtgagacctccctgtctctaca

SEQ ID NO: 609311 - DNA, 15 bp, Homo sapiens
agtgatatggcttgt

SEQ ID NO: 609312 - DNA, 23 bp, Homo sapiens
agtgatatggcttgtagggtgag

SEQ ID NO: 609313 - DNA, 14 bp, Homo sapiens
agtgatgtgattta

SEQ ID NO: 609314 - DNA, 15 bp, Homo sapiens
agtgcagcaaccaga

SEQ ID NO: 609315 - DNA, 21 bp, Homo sapiens
agtgcagcaaccagagcactg

SEQ ID NO: 609316 - DNA, 15 bp, Homo sapiens
agtgcccatgtgtat

SEQ ID NO: 609317 - DNA, 17 bp, Homo sapiens
agtgccccagtggtgcg

SEQ ID NO: 609318 - DNA, 16 bp, Homo sapiens
agtgcctgctgttcgt

SEQ ID NO: 609319 - DNA, 14 bp, Homo sapiens
agtgccttatggaa

SEQ ID NO: 609320 - DNA, 19 bp, Homo sapiens
agtgccttatggaacactc

SEQ ID NO: 609321 - DNA, 22 bp, Homo sapiens
agtgccttggagcagaaagcca

SEQ ID NO: 609322 - DNA, 14 bp, Homo sapiens
agtgcttgaggcca

SEQ ID NO: 609323 - DNA, 13 bp, Homo sapiens
agtggaagagctg

SEQ ID NO: 609324 - DNA, 21 bp, Homo sapiens
agtggaaggataatgagatgt

SEQ ID NO: 609325 - DNA, 15 bp, Homo sapiens
agtggactgtatttc

SEQ ID NO: 609326 - DNA, 16 bp, Homo sapiens
agtggactgtatttcg

SEQ ID NO: 609327 - DNA, 22 bp, Homo sapiens
agtggaggaggaggaggagcct

SEQ ID NO: 609328 - DNA, 17 bp, Homo sapiens
agtggaggggtcagcag

SEQ ID NO: 609329 - DNA, 18 bp, Homo sapiens
agtggaggggtcagcagg

SEQ ID NO: 609330 - DNA, 12 bp, Homo sapiens
agtggcaagcta

SEQ ID NO: 609331 - DNA, 12 bp, Homo sapiens
agtggcacagga

SEQ ID NO: 609332 - DNA, 20 bp, Homo sapiens
agtggcaggtgggctgcctg

SEQ ID NO: 609333 - DNA, 23 bp, Homo sapiens
agtggcaggtgggctgcctgctg

SEQ ID NO: 609334 - DNA, 13 bp, Homo sapiens
agtggcagtattg

SEQ ID NO: 609335 - DNA, 18 bp, Homo sapiens
agtgggattcaggaatgg

SEQ ID NO: 609336 - DNA, 23 bp, Homo sapiens
atagggaattttcattttcatta

SEQ ID NO: 609337 - DNA, 18 bp, Homo sapiens
ataggggcaaaaatttga

SEQ ID NO: 609338 - DNA, 17 bp, Homo sapiens
atagggtttggaagaaa

SEQ ID NO: 609339 - DNA, 13 bp, Homo sapiens
ataggttctgctt

SEQ ID NO: 609340 - DNA, 14 bp, Homo sapiens
ataggttctgcttt

SEQ ID NO: 609341 - DNA, 23 bp, Homo sapiens
ataggtttgggggacgcccagcc

SEQ ID NO: 609342 - DNA, 15 bp, Homo sapiens
atagtatacacatca

SEQ ID NO: 609343 - DNA, 16 bp, Homo sapiens
atagtcaatcaaacag

SEQ ID NO: 609344 - DNA, 21 bp, Homo sapiens
atagtcaatcaaacagggaca

SEQ ID NO: 609345 - DNA, 23 bp, Homo sapiens
atagtcatgtttctgcagtattc

SEQ ID NO: 609346 - DNA, 14 bp, Homo sapiens
atagtctgtacttc

SEQ ID NO: 609347 - DNA, 19 bp, Homo sapiens
atagtggtattttaacata

SEQ ID NO: 609348 - DNA, 14 bp, Homo sapiens
atagtgtgtccatg

SEQ ID NO: 609349 - DNA, 20 bp, Homo sapiens
atagtgttgtgttacaataa

SEQ ID NO: 609350 - DNA, 19 bp, Homo sapiens
atagttccattctatgact

SEQ ID NO: 609351 - DNA, 18 bp, Homo sapiens
atagttgagccagcagac

SEQ ID NO: 609352 - DNA, 22 bp, Homo sapiens
atagttgctccaactgaattgc

SEQ ID NO: 609353 - DNA, 12 bp, Homo sapiens
atagttgtaaag

SEQ ID NO: 609354 - DNA, 15 bp, Homo sapiens
atagttgtaaagata

SEQ ID NO: 609355 - DNA, 15 bp, Homo sapiens
atagtttacaaacaa

SEQ ID NO: 609356 - DNA, 13 bp, Homo sapiens
atagtttctaaac

SEQ ID NO: 609357 - DNA, 11 bp, Homo sapiens
atagttttcac

SEQ ID NO: 609358 - DNA, 13 bp, Homo sapiens
atataaaaataat

SEQ ID NO: 609359 - DNA, 12 bp, Homo sapiens
atataaacacag

SEQ ID NO: 609360 - DNA, 13 bp, Homo sapiens
atataaactgtga

SEQ ID NO: 609361 - DNA, 20 bp, Homo sapiens
atataaatcacagatttcca

SEQ ID NO: 609362 - DNA, 13 bp, Homo sapiens
atataacatgaaa

SEQ ID NO: 609363 - DNA, 18 bp, Homo sapiens
atataacatgaaagtcaa

SEQ ID NO: 609364 - DNA, 13 bp, Homo sapiens
atataagccatag

SEQ ID NO: 609365 - DNA, 22 bp, Homo sapiens
atataataaatatatatttatc

SEQ ID NO: 609366 - DNA, 20 bp, Homo sapiens
atataatttgccagacagag

SEQ ID NO: 609367 - DNA, 16 bp, Homo sapiens
atataatttttccttt

SEQ ID NO: 609368 - DNA, 17 bp, Homo sapiens
atatacagacctccaga

SEQ ID NO: 609369 - DNA, 21 bp, Homo sapiens
atatacatacgcaattgtata

SEQ ID NO: 609370 - DNA, 14 bp, Homo sapiens
atatactccttaaa

SEQ ID NO: 609371 - DNA, 14 bp, Homo sapiens
atatagctttgcaa

SEQ ID NO: 609372 - DNA, 20 bp, Homo sapiens
atataggggcaaaaatttga

SEQ ID NO: 609373 - DNA, 15 bp, Homo sapiens
atatataaatatcta

SEQ ID NO: 609374 - DNA, 13 bp, Homo sapiens
atatatacatacg

SEQ ID NO: 609375 - DNA, 16 bp, Homo sapiens
atatatacattttgca

SEQ ID NO: 609376 - DNA, 16 bp, Homo sapiens
atatatataaaataca

SEQ ID NO: 609377 - DNA, 13 bp, Homo sapiens
atatatatgtata

SEQ ID NO: 609378 - DNA, 14 bp, Homo sapiens
atatatggatattt

SEQ ID NO: 609379 - DNA, 15 bp, Homo sapiens
atatatgtatatctg

SEQ ID NO: 609380 - DNA, 14 bp, Homo sapiens
atatatgtatattt

SEQ ID NO: 609381 - DNA, 21 bp, Homo sapiens
atatatgtgaactttctcagc

SEQ ID NO: 609382 - DNA, 15 bp, Homo sapiens
atatatgtttggctg

SEQ ID NO: 609383 - DNA, 13 bp, Homo sapiens
atatattaaaatt

SEQ ID NO: 609384 - DNA, 22 bp, Homo sapiens
atatatttgcataatatgcata

SEQ ID NO: 609385 - DNA, 18 bp, Homo sapiens
atatattttgaaaggaga

SEQ ID NO: 609386 - DNA, 22 bp, Homo sapiens
atatcagctctaaagcagagat

SEQ ID NO: 609387 - DNA, 23 bp, Homo sapiens
atatcagctctaaagcagagatg

SEQ ID NO: 609388 - DNA, 13 bp, Homo sapiens
atatcattatagc

SEQ ID NO: 609389 - DNA, 17 bp, Homo sapiens
atatcattatagcatgt

SEQ ID NO: 609390 - DNA, 18 bp, Homo sapiens
atatcattatagcatgta

SEQ ID NO: 609391 - DNA, 16 bp, Homo sapiens
atatcctcaattatct

SEQ ID NO: 609392 - DNA, 11 bp, Homo sapiens
atatctgaaaa

SEQ ID NO: 609393 - DNA, 14 bp, Homo sapiens
atatgaaagagaaa

SEQ ID NO: 609394 - DNA, 15 bp, Homo sapiens
atatgaagcagaatg

SEQ ID NO: 609395 - DNA, 22 bp, Homo sapiens
atatgagaaatataaaaataat

SEQ ID NO: 609396 - DNA, 18 bp, Homo sapiens
atatgagattggaaaaaa

SEQ ID NO: 609397 - DNA, 15 bp, Homo sapiens
atatgaggatgtatg

SEQ ID NO: 609398 - DNA, 21 bp, Homo sapiens
atatgattaaattatcattgt

SEQ ID NO: 609399 - DNA, 16 bp, Homo sapiens
atatgattctcctctc

SEQ ID NO: 609400 - DNA, 19 bp, Homo sapiens
atatgattctcctctccca

SEQ ID NO: 609401 - DNA, 16 bp, Homo sapiens
atatgcatatatatgt

SEQ ID NO: 609402 - DNA, 17 bp, Homo sapiens
atatggcttgtagggtg

SEQ ID NO: 609403 - DNA, 21 bp, Homo sapiens
atatgtaacttcagatgtttc

SEQ ID NO: 609404 - DNA, 16 bp, Homo sapiens
atatgtatatctgtgt

SEQ ID NO: 609405 - DNA, 18 bp, Homo sapiens
atatgttagatacacaaa

SEQ ID NO: 609406 - DNA, 17 bp, Homo sapiens
atatgttgatgaaattc

SEQ ID NO: 609407 - DNA, 16 bp, Homo sapiens
atattaaagaaagtca

SEQ ID NO: 609408 - DNA, 18 bp, Homo sapiens
atattaaagtctgagaaa

SEQ ID NO: 609409 - DNA, 20 bp, Homo sapiens
atattaaagtctgagaaatt

SEQ ID NO: 609410 - DNA, 21 bp, Homo sapiens
atattactctgcctgtcaagt

SEQ ID NO: 609411 - DNA, 23 bp, Homo sapiens
atattatttgctaattaaaaagt

SEQ ID NO: 609412 - DNA, 12 bp, Homo sapiens
atattattttct

SEQ ID NO: 609413 - DNA, 15 bp, Homo sapiens
atattattttctgta

SEQ ID NO: 609414 - DNA, 18 bp, Homo sapiens
atattattttctgtaatt

SEQ ID NO: 609415 - DNA, 10 bp, Homo sapiens
atattctgtc

SEQ ID NO: 609416 - DNA, 11 bp, Homo sapiens
atattgccttg

SEQ ID NO: 609417 - DNA, 15 bp, Homo sapiens
atattgcgagaaaca

SEQ ID NO: 609418 - DNA, 21 bp, Homo sapiens
atattgctattgtttatagga

SEQ ID NO: 609419 - DNA, 21 bp, Homo sapiens
atattgctgatggtgcaatga

SEQ ID NO: 609420 - DNA, 13 bp, Homo sapiens
atatttaaagtct

SEQ ID NO: 609421 - DNA, 13 bp, Homo sapiens
atatttactgttt

SEQ ID NO: 609422 - DNA, 14 bp, Homo sapiens
atatttactgttta

SEQ ID NO: 609423 - DNA, 21 bp, Homo sapiens
atatttgcataatatgcatat

SEQ ID NO: 609424 - DNA, 13 bp, Homo sapiens
atattttaggaaa

SEQ ID NO: 609425 - DNA, 19 bp, Homo sapiens
atattttctgagtagcata

SEQ ID NO: 609426 - DNA, 14 bp, Homo sapiens
atcaaaaaacagaa

SEQ ID NO: 609427 - DNA, 15 bp, Homo sapiens
atcaaaaaacagaaa

SEQ ID NO: 609428 - DNA, 22 bp, Homo sapiens
atcaaacaaatcattttgatgt

SEQ ID NO: 609429 - DNA, 20 bp, Homo sapiens
atcaacagtgaacagcttca

SEQ ID NO: 609430 - DNA, 23 bp, Homo sapiens
atcaagtagtagtacttaatagt

SEQ ID NO: 609431 - DNA, 14 bp, Homo sapiens
atcaatttaaagga

SEQ ID NO: 609432 - DNA, 18 bp, Homo sapiens
atcacagtctaattttta

SEQ ID NO: 609433 - DNA, 18 bp, Homo sapiens
atcacatatgtgcataga

SEQ ID NO: 609434 - DNA, 21 bp, Homo sapiens
atcaccctgaattcattgtct

SEQ ID NO: 609435 - DNA, 19 bp, Homo sapiens
atcaccgaaaacgtggctg

SEQ ID NO: 609436 - DNA, 20 bp, Homo sapiens
atcacctaattaatttcagt

SEQ ID NO: 609437 - DNA, 14 bp, Homo sapiens
atcacgggcccgct

SEQ ID NO: 609438 - DNA, 15 bp, Homo sapiens
atcacgggcccgctc

SEQ ID NO: 609439 - DNA, 21 bp, Homo sapiens
atcagaactcctttctaagga

SEQ ID NO: 609440 - DNA, 23 bp, Homo sapiens
atcagaattgaaccgtcaatgtg

SEQ ID NO: 609441 - DNA, 23 bp, Homo sapiens
atcagtacaattctttgttgctt

SEQ ID NO: 609442 - DNA, 22 bp, Homo sapiens
atcatacgttgatagtttacaa

SEQ ID NO: 609443 - DNA, 13 bp, Homo sapiens
atcatatctgtat

SEQ ID NO: 609444 - DNA, 16 bp, Homo sapiens
atcatatctgtatgcc

SEQ ID NO: 609445 - DNA, 21 bp, Homo sapiens
atcatatgttagatacacaaa

SEQ ID NO: 609446 - DNA, 16 bp, Homo sapiens
atcatatttaatagga

SEQ ID NO: 609447 - DNA, 17 bp, Homo sapiens
atcatccccaaatgtgt

SEQ ID NO: 609448 - DNA, 19 bp, Homo sapiens
atcatctattgagtgtaca

SEQ ID NO: 609449 - DNA, 19 bp, Homo sapiens
atcattatagcatgtaata

SEQ ID NO: 609450 - DNA, 20 bp, Homo sapiens
atcattatagcatgtaatat

SEQ ID NO: 609451 - DNA, 20 bp, Homo sapiens
atcattcctgtcagagcttt

SEQ ID NO: 609452 - DNA, 12 bp, Homo sapiens
atcattgaaatc

SEQ ID NO: 609453 - DNA, 13 bp, Homo sapiens
atgaccagaaaat

SEQ ID NO: 609454 - DNA, 20 bp, Homo sapiens
atgaccataaaattagacat

SEQ ID NO: 609455 - DNA, 15 bp, Homo sapiens
atgaccctcctgtcc

SEQ ID NO: 609456 - DNA, 13 bp, Homo sapiens
atgacctttcaat

SEQ ID NO: 609457 - DNA, 18 bp, Homo sapiens
atgacctttcaataggaa

SEQ ID NO: 609458 - DNA, 21 bp, Homo sapiens
atgactggaaacaaggaagga

SEQ ID NO: 609459 - DNA, 23 bp, Homo sapiens
atgacttctttactaacactggc

SEQ ID NO: 609460 - DNA, 19 bp, Homo sapiens
atgagaaatataaaaataa

SEQ ID NO: 609461 - DNA, 13 bp, Homo sapiens
atgagaactaaat

SEQ ID NO: 609462 - DNA, 16 bp, Homo sapiens
atgagaactaaataga

SEQ ID NO: 609463 - DNA, 17 bp, Homo sapiens
atgagaactaaatagat

SEQ ID NO: 609464 - DNA, 16 bp, Homo sapiens
atgagacaacacacac

SEQ ID NO: 609465 - DNA, 23 bp, Homo sapiens
atgagacttcctattaatttatt

SEQ ID NO: 609466 - DNA, 16 bp, Homo sapiens
atgagatcccagagtt

SEQ ID NO: 609467 - DNA, 18 bp, Homo sapiens
atgagatgatttaattct

SEQ ID NO: 609468 - DNA, 20 bp, Homo sapiens
atgagatgatttaattctta

SEQ ID NO: 609469 - DNA, 21 bp, Homo sapiens
atgagatgggttgagtttgct

SEQ ID NO: 609470 - DNA, 18 bp, Homo sapiens
atgagatgtaatacacca

SEQ ID NO: 609471 - DNA, 21 bp, Homo sapiens
atgagattccctctcctcccc

SEQ ID NO: 609472 - DNA, 12 bp, Homo sapiens
atgagattggaa

SEQ ID NO: 609473 - DNA, 19 bp, Homo sapiens
atgaggcctttccccagtg

SEQ ID NO: 609474 - DNA, 20 bp, Homo sapiens
atgaggcctttccccagtgt

SEQ ID NO: 609475 - DNA, 17 bp, Homo sapiens
atgagggcgtgaaacac

SEQ ID NO: 609476 - DNA, 16 bp, Homo sapiens
atgagttctgcacata

SEQ ID NO: 609477 - DNA, 18 bp, Homo sapiens
atgatataataaatatat

SEQ ID NO: 609478 - DNA, 20 bp, Homo sapiens
atgatatgtctttaaaatga

SEQ ID NO: 609479 - DNA, 22 bp, Homo sapiens
atgatcttacacgaagaaatag

SEQ ID NO: 609480 - DNA, 22 bp, Homo sapiens
atgatgatccggatttaatttg

SEQ ID NO: 609481 - DNA, 22 bp, Homo sapiens
atgattaaactgggaaatgaga

SEQ ID NO: 609482 - DNA, 22 bp, Homo sapiens
atgattaagtgcttgaggccaa

SEQ ID NO: 609483 - DNA, 14 bp, Homo sapiens
atgattagacaatg

SEQ ID NO: 609484 - DNA, 16 bp, Homo sapiens
atgattagacaatgtg

SEQ ID NO: 609485 - DNA, 21 bp, Homo sapiens
atgattagacaatgtggaatt

SEQ ID NO: 609486 - DNA, 12 bp, Homo sapiens
atgattcaatgt

SEQ ID NO: 609487 - DNA, 21 bp, Homo sapiens
atgattcaatgtgaattttaa

SEQ ID NO: 609488 - DNA, 22 bp, Homo sapiens
atgattcaatgtgaattttaaa

SEQ ID NO: 609489 - DNA, 17 bp, Homo sapiens
atgattcacttttattg

SEQ ID NO: 609490 - DNA, 15 bp, Homo sapiens
atgattctcctctcc

SEQ ID NO: 609491 - DNA, 21 bp, Homo sapiens
atgattcttgtgtcatcaagt

SEQ ID NO: 609492 - DNA, 15 bp, Homo sapiens
atgattgagagcagc

SEQ ID NO: 609493 - DNA, 16 bp, Homo sapiens
atgatttcagaaacaa

SEQ ID NO: 609494 - DNA, 13 bp, Homo sapiens
atgatttcatgat

SEQ ID NO: 609495 - DNA, 17 bp, Homo sapiens
atgatttcgtgactgta

SEQ ID NO: 609496 - DNA, 21 bp, Homo sapiens
atgcaaaccatcattgaaatc

SEQ ID NO: 609497 - DNA, 17 bp, Homo sapiens
atgcaaagcacacctcg

SEQ ID NO: 609498 - DNA, 20 bp, Homo sapiens
atgcaatttgataatcagtt

SEQ ID NO: 609499 - DNA, 22 bp, Homo sapiens
atgcacacaggagaaaatgcaa

SEQ ID NO: 609500 - DNA, 19 bp, Homo sapiens
atgcaggcagattaataac

SEQ ID NO: 609501 - DNA, 23 bp, Homo sapiens
atgcaggcagattaataacagaa

SEQ ID NO: 609502 - DNA, 17 bp, Homo sapiens
atgcaggcagcctgcag

SEQ ID NO: 609503 - DNA, 13 bp, Homo sapiens
atgcatagacaag

SEQ ID NO: 609504 - DNA, 14 bp, Homo sapiens
atgcatatatatgt

SEQ ID NO: 609505 - DNA, 15 bp, Homo sapiens
atgcatatttataga

SEQ ID NO: 609506 - DNA, 16 bp, Homo sapiens
atgcatatttatagag

SEQ ID NO: 609507 - DNA, 16 bp, Homo sapiens
atgcatgagaactaaa

SEQ ID NO: 609508 - DNA, 17 bp, Homo sapiens
atgcatgagaactaaat

SEQ ID NO: 609509 - DNA, 18 bp, Homo sapiens
atgcatgcactcttttga

SEQ ID NO: 609510 - DNA, 17 bp, Homo sapiens
atgcatttagcatgagt

SEQ ID NO: 609511 - DNA, 19 bp, Homo sapiens
atgcatttagcatgagttc

SEQ ID NO: 609512 - DNA, 20 bp, Homo sapiens
atgcatttatgcatgagaac

SEQ ID NO: 609513 - DNA, 16 bp, Homo sapiens
atgccaatgtccaggt

SEQ ID NO: 609514 - DNA, 23 bp, Homo sapiens
atgccaatgtccaggtcacaggc

SEQ ID NO: 609515 - DNA, 14 bp, Homo sapiens
atgccatgtatgtt

SEQ ID NO: 609516 - DNA, 16 bp, Homo sapiens
atgcccacgcccctcc

SEQ ID NO: 609517 - DNA, 20 bp, Homo sapiens
atgcccacgcccctccccag

SEQ ID NO: 609518 - DNA, 15 bp, Homo sapiens
atgccccagctctgg

SEQ ID NO: 609519 - DNA, 18 bp, Homo sapiens
atgcccctggccctgcct

SEQ ID NO: 609520 - DNA, 19 bp, Homo sapiens
atgcccctggccctgcctc

SEQ ID NO: 609521 - DNA, 23 bp, Homo sapiens
atgcccctggccctgcctcactg

SEQ ID NO: 609522 - DNA, 19 bp, Homo sapiens
atgcctgggcccaggccca

SEQ ID NO: 609523 - DNA, 21 bp, Homo sapiens
atgcctgtactcgcttgtgca

SEQ ID NO: 609524 - DNA, 21 bp, Homo sapiens
atgccttcataaattatttct

SEQ ID NO: 609525 - DNA, 22 bp, Homo sapiens
atgcctttatttctgtatctga

SEQ ID NO: 609526 - DNA, 19 bp, Homo sapiens
atgcctttctagcaattgc

SEQ ID NO: 609527 - DNA, 18 bp, Homo sapiens
atgctacaaaatgtgtgc

SEQ ID NO: 609528 - DNA, 16 bp, Homo sapiens
atgctactcagtatat

SEQ ID NO: 609529 - DNA, 14 bp, Homo sapiens
atgctagttcttac

SEQ ID NO: 609530 - DNA, 13 bp, Homo sapiens
atgctcaatgtgc

SEQ ID NO: 609531 - DNA, 14 bp, Homo sapiens
atgctgctgagcac

SEQ ID NO: 609532 - DNA, 15 bp, Homo sapiens
atgctgctgagcaca

SEQ ID NO: 609533 - DNA, 11 bp, Homo sapiens
atgctggctgg

SEQ ID NO: 609534 - DNA, 12 bp, Homo sapiens
atgctggctggg

SEQ ID NO: 609535 - DNA, 12 bp, Homo sapiens
atgctgtccctg

SEQ ID NO: 609536 - DNA, 16 bp, Homo sapiens
atgctgtgtgcagagt

SEQ ID NO: 609537 - DNA, 17 bp, Homo sapiens
atgctgtgtgcagagta

SEQ ID NO: 609538 - DNA, 21 bp, Homo sapiens
atgctgtgtgcagagtataca

SEQ ID NO: 609539 - DNA, 23 bp, Homo sapiens
atgctgtgtgcagagtatacaag

SEQ ID NO: 609540 - DNA, 14 bp, Homo sapiens
atgctgttcattga

SEQ ID NO: 609541 - DNA, 15 bp, Homo sapiens
atgcttaacataaac

SEQ ID NO: 609542 - DNA, 20 bp, Homo sapiens
atgctttccctgaggaatga

SEQ ID NO: 609543 - DNA, 10 bp, Homo sapiens
atgctttctc

SEQ ID NO: 609544 - DNA, 16 bp, Homo sapiens
atgctttctcatgcat

SEQ ID NO: 609545 - DNA, 15 bp, Homo sapiens
atggaaagggtgtgg

SEQ ID NO: 609546 - DNA, 16 bp, Homo sapiens
atggaaagggtgtggc

SEQ ID NO: 609547 - DNA, 14 bp, Homo sapiens
atggaacactctga

SEQ ID NO: 609548 - DNA, 14 bp, Homo sapiens
atggaagacaaata

SEQ ID NO: 609549 - DNA, 17 bp, Homo sapiens
atggaagacaaatacac

SEQ ID NO: 609550 - DNA, 16 bp, Homo sapiens
atggacaatttaccac

SEQ ID NO: 609551 - DNA, 21 bp, Homo sapiens
atggagaagggttctgccctg

SEQ ID NO: 609552 - DNA, 17 bp, Homo sapiens
atggaggagagtgttta

SEQ ID NO: 609553 - DNA, 14 bp, Homo sapiens
atggatagattgtt

SEQ ID NO: 609554 - DNA, 18 bp, Homo sapiens
atggatccttccatcttg

SEQ ID NO: 609555 - DNA, 15 bp, Homo sapiens
atggatgtaatatag

SEQ ID NO: 609556 - DNA, 14 bp, Homo sapiens
atggatttgacaca

SEQ ID NO: 609557 - DNA, 16 bp, Homo sapiens
atggcaacgttcatgt

SEQ ID NO: 609558 - DNA, 18 bp, Homo sapiens
atggcatttagcacagta

SEQ ID NO: 609559 - DNA, 21 bp, Homo sapiens
atggcatttagcacagtattt

SEQ ID NO: 609560 - DNA, 14 bp, Homo sapiens
atggccctgtagct

SEQ ID NO: 609561 - DNA, 19 bp, Homo sapiens
atggccctgtagctctgaa

SEQ ID NO: 609562 - DNA, 19 bp, Homo sapiens
atggcctcttaaaaattat

SEQ ID NO: 609563 - DNA, 12 bp, Homo sapiens
atggccttccct

SEQ ID NO: 609564 - DNA, 18 bp, Homo sapiens
atggccttccctccccac

SEQ ID NO: 609565 - DNA, 12 bp, Homo sapiens
atggctgaagaa

SEQ ID NO: 609566 - DNA, 16 bp, Homo sapiens
atggctgaagaaacac

SEQ ID NO: 609567 - DNA, 20 bp, Homo sapiens
atggctgaagaaacacagca

SEQ ID NO: 609568 - DNA, 16 bp, Homo sapiens
atggctgtcccctgca

SEQ ID NO: 609569 - DNA, 20 bp, Homo sapiens
attaacttctattttcaagt

SEQ ID NO: 609570 - DNA, 11 bp, Homo sapiens
attaagaaact

SEQ ID NO: 609571 - DNA, 13 bp, Homo sapiens
attaagcacacac

SEQ ID NO: 609572 - DNA, 19 bp, Homo sapiens
attaagcacacacatctgg

SEQ ID NO: 609573 - DNA, 14 bp, Homo sapiens
attaataacagaaa

SEQ ID NO: 609574 - DNA, 20 bp, Homo sapiens
attaattggcagcagatttt

SEQ ID NO: 609575 - DNA, 22 bp, Homo sapiens
attaatttttcaatttctcctt

SEQ ID NO: 609576 - DNA, 17 bp, Homo sapiens
attaatttttttattgt

SEQ ID NO: 609577 - DNA, 20 bp, Homo sapiens
attacaacaagcaaactgaa

SEQ ID NO: 609578 - DNA, 12 bp, Homo sapiens
attacctgaaag

SEQ ID NO: 609579 - DNA, 16 bp, Homo sapiens
attactgttttgggcc

SEQ ID NO: 609580 - DNA, 18 bp, Homo sapiens
attactgttttgggcctc

SEQ ID NO: 609581 - DNA, 14 bp, Homo sapiens
attagacaatgtgg

SEQ ID NO: 609582 - DNA, 22 bp, Homo sapiens
attagacaatgtggaattacat

SEQ ID NO: 609583 - DNA, 22 bp, Homo sapiens
attagagattgacttcagaaac

SEQ ID NO: 609584 - DNA, 15 bp, Homo sapiens
attagctgtgatttt

SEQ ID NO: 609585 - DNA, 22 bp, Homo sapiens
attagctgtgatttttgttgat

SEQ ID NO: 609586 - DNA, 17 bp, Homo sapiens
attagggctctaatttc

SEQ ID NO: 609587 - DNA, 17 bp, Homo sapiens
attataatgcatctaaa

SEQ ID NO: 609588 - DNA, 13 bp, Homo sapiens
attatagcatgta

SEQ ID NO: 609589 - DNA, 15 bp, Homo sapiens
attatagcatgtaat

SEQ ID NO: 609590 - DNA, 21 bp, Homo sapiens
attatagttattcaaatccat

SEQ ID NO: 609591 - DNA, 18 bp, Homo sapiens
attatatcagactgcttt

SEQ ID NO: 609592 - DNA, 12 bp, Homo sapiens
attatcattgtt

SEQ ID NO: 609593 - DNA, 16 bp, Homo sapiens
attatcattgtttgtc

SEQ ID NO: 609594 - DNA, 18 bp, Homo sapiens
attatcctcaagttgtgt

SEQ ID NO: 609595 - DNA, 23 bp, Homo sapiens
attatcctcaagttgtgtgctat

SEQ ID NO: 609596 - DNA, 19 bp, Homo sapiens
attatcttaaacccacata

SEQ ID NO: 609597 - DNA, 15 bp, Homo sapiens
attatctttaaaact

SEQ ID NO: 609598 - DNA, 14 bp, Homo sapiens
attatgaggaaact

SEQ ID NO: 609599 - DNA, 22 bp, Homo sapiens
attatgaggaaacttggacatt

SEQ ID NO: 609600 - DNA, 21 bp, Homo sapiens
attatggctttgtgcttgttc

SEQ ID NO: 609601 - DNA, 18 bp, Homo sapiens
attatggtgatactccaa

SEQ ID NO: 609602 - DNA, 16 bp, Homo sapiens
attatgtcaaatggat

SEQ ID NO: 609603 - DNA, 23 bp, Homo sapiens
attatgtcaaatggatgtaatat

SEQ ID NO: 609604 - DNA, 15 bp, Homo sapiens
attattaaaaattat

SEQ ID NO: 609605 - DNA, 18 bp, Homo sapiens
attattaaaaattataga

SEQ ID NO: 609606 - DNA, 16 bp, Homo sapiens
attattacaacaagca

SEQ ID NO: 609607 - DNA, 22 bp, Homo sapiens
attatttcaaggaatagagttt

SEQ ID NO: 609608 - DNA, 14 bp, Homo sapiens
attcaaagaatcac

SEQ ID NO: 609609 - DNA, 22 bp, Homo sapiens
attcaatcgactgggtttatgt

SEQ ID NO: 609610 - DNA, 18 bp, Homo sapiens
attcacttttattgtata

SEQ ID NO: 609611 - DNA, 18 bp, Homo sapiens
attcagtctatgctgtgt

SEQ ID NO: 609612 - DNA, 17 bp, Homo sapiens
attcagtggacatttgt

SEQ ID NO: 609613 - DNA, 23 bp, Homo sapiens
attcataagccaatttttctgca

SEQ ID NO: 609614 - DNA, 18 bp, Homo sapiens
attcataccttctgatga

SEQ ID NO: 609615 - DNA, 12 bp, Homo sapiens
attcatgatgct

SEQ ID NO: 609616 - DNA, 20 bp, Homo sapiens
attcatgatgctagttctta

SEQ ID NO: 609617 - DNA, 15 bp, Homo sapiens
attcatgcctcaagt

SEQ ID NO: 609618 - DNA, 14 bp, Homo sapiens
attcatgctttctc

SEQ ID NO: 609619 - DNA, 20 bp, Homo sapiens
attcatttacaacttccaga

SEQ ID NO: 609620 - DNA, 23 bp, Homo sapiens
attccaagtgtatatttgtatca

SEQ ID NO: 609621 - DNA, 21 bp, Homo sapiens
attccacagagttactgccac

SEQ ID NO: 609622 - DNA, 17 bp, Homo sapiens
attccagcagtgaatgc

SEQ ID NO: 609623 - DNA, 16 bp, Homo sapiens
attccagtgtattttc

SEQ ID NO: 609624 - DNA, 19 bp, Homo sapiens
attccagtgtattttctgt

SEQ ID NO: 609625 - DNA, 22 bp, Homo sapiens
attccatgggttgaacaagcca

SEQ ID NO: 609626 - DNA, 17 bp, Homo sapiens
attcccaaatctcaaaa

SEQ ID NO: 609627 - DNA, 19 bp, Homo sapiens
attcccactaagctttctc

SEQ ID NO: 609628 - DNA, 18 bp, Homo sapiens
attcccttcaatgcaaaa

SEQ ID NO: 609629 - DNA, 13 bp, Homo sapiens
attccgttaggaa

SEQ ID NO: 609630 - DNA, 23 bp, Homo sapiens
attccgttaggaataacactgca

SEQ ID NO: 609631 - DNA, 18 bp, Homo sapiens
attcctaagagtggagga

SEQ ID NO: 609632 - DNA, 14 bp, Homo sapiens
attcctaattctat

SEQ ID NO: 609633 - DNA, 23 bp, Homo sapiens
attcctaattctatgattaaact

SEQ ID NO: 609634 - DNA, 13 bp, Homo sapiens
attcctacttaaa

SEQ ID NO: 609635 - DNA, 15 bp, Homo sapiens
attcctacttaaaca

SEQ ID NO: 609636 - DNA, 13 bp, Homo sapiens
attcctcccctgg

SEQ ID NO: 609637 - DNA, 12 bp, Homo sapiens
attcctcctgtc

SEQ ID NO: 609638 - DNA, 22 bp, Homo sapiens
attcctcctgtctcctctgtca

SEQ ID NO: 609639 - DNA, 23 bp, Homo sapiens
attcctcctgtctcctctgtcag

SEQ ID NO: 609640 - DNA, 16 bp, Homo sapiens
attcctgaccctcact

SEQ ID NO: 609641 - DNA, 17 bp, Homo sapiens
attcctgtcagagcttt

SEQ ID NO: 609642 - DNA, 15 bp, Homo sapiens
attcgtaagttctgt

SEQ ID NO: 609643 - DNA, 17 bp, Homo sapiens
attctaaatcactttaa

SEQ ID NO: 609644 - DNA, 22 bp, Homo sapiens
attctatgattaaactgggaaa

SEQ ID NO: 609645 - DNA, 12 bp, Homo sapiens
attctatttcaa

SEQ ID NO: 609646 - DNA, 19 bp, Homo sapiens
attctcagaagtgaaaaag

SEQ ID NO: 609647 - DNA, 15 bp, Homo sapiens
attctgaaggggaaa

SEQ ID NO: 609648 - DNA, 19 bp, Homo sapiens
attctgaaggggaaaacct

SEQ ID NO: 609649 - DNA, 18 bp, Homo sapiens
attctgctaatttatgaa

SEQ ID NO: 609650 - DNA, 13 bp, Homo sapiens
attctgcttctct

SEQ ID NO: 609651 - DNA, 16 bp, Homo sapiens
attctggggtggggct

SEQ ID NO: 609652 - DNA, 20 bp, Homo sapiens
attctggggtggggcttgga

SEQ ID NO: 609653 - DNA, 19 bp, Homo sapiens
attctggtccttagtaaat

SEQ ID NO: 609654 - DNA, 17 bp, Homo sapiens
attctgtcaatgaaaag

SEQ ID NO: 609655 - DNA, 20 bp, Homo sapiens
attcttaccgaaatgaaaat

SEQ ID NO: 609656 - DNA, 16 bp, Homo sapiens
attcttactgttctga

SEQ ID NO: 609657 - DNA, 17 bp, Homo sapiens
attcttactgttctgaa

SEQ ID NO: 609658 - DNA, 16 bp, Homo sapiens
attcttagttaatctt

SEQ ID NO: 609659 - DNA, 17 bp, Homo sapiens
attcttataacattgta

SEQ ID NO: 609660 - DNA, 21 bp, Homo sapiens
attcttataacattgtatgtt

SEQ ID NO: 609661 - DNA, 22 bp, Homo sapiens
attcttctcctttgtcaaatgg

SEQ ID NO: 609662 - DNA, 23 bp, Homo sapiens
attcttctcctttgtcaaatggt

SEQ ID NO: 609663 - DNA, 17 bp, Homo sapiens
attcttgcactgtatcc

SEQ ID NO: 609664 - DNA, 21 bp, Homo sapiens
attcttgtgtcatcaagtagt

SEQ ID NO: 609665 - DNA, 23 bp, Homo sapiens
attctttcaatccacagtattgt

SEQ ID NO: 609666 - DNA, 14 bp, Homo sapiens
attctttgttgctt

SEQ ID NO: 609667 - DNA, 17 bp, Homo sapiens
attcttttttcaatgta

SEQ ID NO: 609668 - DNA, 21 bp, Homo sapiens
attcttttttcaatgtactgt

SEQ ID NO: 609669 - DNA, 15 bp, Homo sapiens
attgaaactgtattt

SEQ ID NO: 609670 - DNA, 17 bp, Homo sapiens
attgaaccgtcaatgtg

SEQ ID NO: 609671 - DNA, 14 bp, Homo sapiens
attgacaagtttaa

SEQ ID NO: 609672 - DNA, 14 bp, Homo sapiens
attgacatgtacag

SEQ ID NO: 609673 - DNA, 17 bp, Homo sapiens
attgacatgtacagaga

SEQ ID NO: 609674 - DNA, 10 bp, Homo sapiens
attgacattt

SEQ ID NO: 609675 - DNA, 19 bp, Homo sapiens
attgacgacctacatctga

SEQ ID NO: 609676 - DNA, 22 bp, Homo sapiens
attgagttggttacctattgct

SEQ ID NO: 609677 - DNA, 13 bp, Homo sapiens
attgatagaataa

SEQ ID NO: 609678 - DNA, 16 bp, Homo sapiens
attgcactaaaagtga

SEQ ID NO: 609679 - DNA, 18 bp, Homo sapiens
attgcactaaaagtgatg

SEQ ID NO: 609680 - DNA, 22 bp, Homo sapiens
attgcactgcagttatttacca

SEQ ID NO: 609681 - DNA, 21 bp, Homo sapiens
attgcacttcggataattttc

SEQ ID NO: 609682 - DNA, 18 bp, Homo sapiens
attgcctatttcagtggc

SEQ ID NO: 609683 - DNA, 23 bp, Homo sapiens
attgccttatattggatcaggaa

SEQ ID NO: 609684 - DNA, 12 bp, Homo sapiens
attgccttcagc

SEQ ID NO: 609685 - DNA, 17 bp, Homo sapiens
atttgtttcattaaaga

SEQ ID NO: 609686 - DNA, 19 bp, Homo sapiens
attttaaaatgcaaatatt

SEQ ID NO: 609687 - DNA, 24 bp, Homo sapiens
attttaaaatgcaaatattgctat

SEQ ID NO: 609688 - DNA, 19 bp, Homo sapiens
attttaaacaaaatttatg

SEQ ID NO: 609689 - DNA, 13 bp, Homo sapiens
attttaacatagc

SEQ ID NO: 609690 - DNA, 20 bp, Homo sapiens
attttaacatagcagctggt

SEQ ID NO: 609691 - DNA, 23 bp, Homo sapiens
attttaccatatggaatagggat

SEQ ID NO: 609692 - DNA, 16 bp, Homo sapiens
attttagctaatttag

SEQ ID NO: 609693 - DNA, 20 bp, Homo sapiens
attttataaggctgactctt

SEQ ID NO: 609694 - DNA, 14 bp, Homo sapiens
attttatgcaaata

SEQ ID NO: 609695 - DNA, 23 bp, Homo sapiens
attttattgaatataatggcctc

SEQ ID NO: 609696 - DNA, 22 bp, Homo sapiens
attttattgtaacagacattgt

SEQ ID NO: 609697 - DNA, 16 bp, Homo sapiens
attttatttctctcag

SEQ ID NO: 609698 - DNA, 20 bp, Homo sapiens
attttcaagtggaaaccttg

SEQ ID NO: 609699 - DNA, 11 bp, Homo sapiens
attttcatgtt

SEQ ID NO: 609700 - DNA, 15 bp, Homo sapiens
attttcccagtgaat

SEQ ID NO: 609701 - DNA, 18 bp, Homo sapiens
attttccttttttataca

SEQ ID NO: 609702 - DNA, 20 bp, Homo sapiens
attttccttttttatacaca

SEQ ID NO: 609703 - DNA, 14 bp, Homo sapiens
attttctactttaa

SEQ ID NO: 609704 - DNA, 17 bp, Homo sapiens
attttctgagtagcata

SEQ ID NO: 609705 - DNA, 13 bp, Homo sapiens
attttctgtaatt

SEQ ID NO: 609706 - DNA, 17 bp, Homo sapiens
attttctgtaattcttc

SEQ ID NO: 609707 - DNA, 14 bp, Homo sapiens
attttcttaattat

SEQ ID NO: 609708 - DNA, 13 bp, Homo sapiens
attttcttcttta

SEQ ID NO: 609709 - DNA, 20 bp, Homo sapiens
attttcttctttaatttttc

SEQ ID NO: 609710 - DNA, 12 bp, Homo sapiens
attttgatgtat

SEQ ID NO: 609711 - DNA, 16 bp, Homo sapiens
attttgatgtattatt

SEQ ID NO: 609712 - DNA, 19 bp, Homo sapiens
attttgatgtattattata

SEQ ID NO: 609713 - DNA, 17 bp, Homo sapiens
attttgattgtttgatg

SEQ ID NO: 609714 - DNA, 16 bp, Homo sapiens
attttggaagaattca

SEQ ID NO: 609715 - DNA, 19 bp, Homo sapiens
attttggaagaattcatga

SEQ ID NO: 609716 - DNA, 22 bp, Homo sapiens
attttgggaaattcttgcactg

SEQ ID NO: 609717 - DNA, 12 bp, Homo sapiens
attttgtagcta

SEQ ID NO: 609718 - DNA, 24 bp, Homo sapiens
attttgttttgctttttctgactc

SEQ ID NO: 609719 - DNA, 21 bp, Homo sapiens
atttttaaccaaataagaata

SEQ ID NO: 609720 - DNA, 19 bp, Homo sapiens
atttttaacttatctccag

SEQ ID NO: 609721 - DNA, 15 bp, Homo sapiens
atttttaatttatga

SEQ ID NO: 609722 - DNA, 13 bp, Homo sapiens
atttttattcata

SEQ ID NO: 609723 - DNA, 14 bp, Homo sapiens
atttttattcataa

SEQ ID NO: 609724 - DNA, 12 bp, Homo sapiens
atttttctgcac

SEQ ID NO: 609725 - DNA, 15 bp, Homo sapiens
atttttctgcactga

SEQ ID NO: 609726 - DNA, 18 bp, Homo sapiens
atttttctgttggtctta

SEQ ID NO: 609727 - DNA, 22 bp, Homo sapiens
atttttctgttggtcttaacta

SEQ ID NO: 609728 - DNA, 20 bp, Homo sapiens
atttttgagtaaaacttgta

SEQ ID NO: 609729 - DNA, 14 bp, Homo sapiens
attttttcctacca

SEQ ID NO: 609730 - DNA, 19 bp, Homo sapiens
attttttcctgctagtgta

SEQ ID NO: 609731 - DNA, 14 bp, Homo sapiens
attttttgtctgtg

SEQ ID NO: 609732 - DNA, 16 bp, Homo sapiens
attttttgtctgtgat

SEQ ID NO: 609733 - DNA, 13 bp, Homo sapiens
atttttttccaga

SEQ ID NO: 609734 - DNA, 12 bp, Homo sapiens
atttttttttcc

SEQ ID NO: 609735 - DNA, 13 bp, Homo sapiens
atttttttttcct

SEQ ID NO: 609736 - DNA, 20 bp, Homo sapiens
atttttttttccttcagtgc

SEQ ID NO: 609737 - DNA, 22 bp, Homo sapiens
atttttttttccttcagtgcct

SEQ ID NO: 609738 - DNA, 16 bp, Homo sapiens
caaaaaaaagaaagaa

SEQ ID NO: 609739 - DNA, 15 bp, Homo sapiens
caaaaaacagaaaaa

SEQ ID NO: 609740 - DNA, 16 bp, Homo sapiens
caaaaaagattactag

SEQ ID NO: 609741 - DNA, 15 bp, Homo sapiens
caaaaactgtactgt

SEQ ID NO: 609742 - DNA, 23 bp, Homo sapiens
caaaaactttccatgacagtagc

SEQ ID NO: 609743 - DNA, 13 bp, Homo sapiens
caaaaagccaaaa

SEQ ID NO: 609744 - DNA, 15 bp, Homo sapiens
caaaaatttgacatt

SEQ ID NO: 609745 - DNA, 16 bp, Homo sapiens
caaaaatttgacattg

SEQ ID NO: 609746 - DNA, 18 bp, Homo sapiens
caaaacaacagcaacaac

SEQ ID NO: 609747 - DNA, 21 bp, Homo sapiens
caaaacaacagcaacaacaac

SEQ ID NO: 609748 - DNA, 22 bp, Homo sapiens
caaaagtgcagtagtgtcactt

SEQ ID NO: 609749 - DNA, 15 bp, Homo sapiens
caaaatataaatcac

SEQ ID NO: 609750 - DNA, 15 bp, Homo sapiens
caaaatatatgtttg

SEQ ID NO: 609751 - DNA, 21 bp, Homo sapiens
caaaatatatgtttggctgaa

SEQ ID NO: 609752 - DNA, 17 bp, Homo sapiens
caaaatgaattgccttt

SEQ ID NO: 609753 - DNA, 18 bp, Homo sapiens
caaaatgtcaatttttaa

SEQ ID NO: 609754 - DNA, 21 bp, Homo sapiens
caaaatgtgccgtctttggtt

SEQ ID NO: 609755 - DNA, 19 bp, Homo sapiens
caaaatttatgtcattttc

SEQ ID NO: 609756 - DNA, 20 bp, Homo sapiens
caaaatttatgtcattttca

SEQ ID NO: 609757 - DNA, 23 bp, Homo sapiens
caaaatttatgtcattttcagat

SEQ ID NO: 609758 - DNA, 20 bp, Homo sapiens
caaacactgcttaaggaaaa

SEQ ID NO: 609759 - DNA, 22 bp, Homo sapiens
caaacagggacactacaaacat

SEQ ID NO: 609760 - DNA, 12 bp, Homo sapiens
caaacaggtgct

SEQ ID NO: 609761 - DNA, 19 bp, Homo sapiens
caaaccatcattgaaatct

SEQ ID NO: 609762 - DNA, 14 bp, Homo sapiens
caaacgaaatggct

SEQ ID NO: 609763 - DNA, 14 bp, Homo sapiens
caaacttaacagat

SEQ ID NO: 609764 - DNA, 14 bp, Homo sapiens
caaacttttataaa

SEQ ID NO: 609765 - DNA, 21 bp, Homo sapiens
caaacttttataaatgtttta

SEQ ID NO: 609766 - DNA, 17 bp, Homo sapiens
caaagaaacaaaatata

SEQ ID NO: 609767 - DNA, 14 bp, Homo sapiens
caaagaacccccct

SEQ ID NO: 609768 - DNA, 16 bp, Homo sapiens
caaagaatcaacagtg

SEQ ID NO: 609769 - DNA, 22 bp, Homo sapiens
caaagacttcatttaacactga

SEQ ID NO: 609770 - DNA, 17 bp, Homo sapiens
caaagaggccagtactt

SEQ ID NO: 609771 - DNA, 13 bp, Homo sapiens
caaagatagcaga

SEQ ID NO: 609772 - DNA, 14 bp, Homo sapiens
caaagcatgctcag

SEQ ID NO: 609773 - DNA, 16 bp, Homo sapiens
caaagcatgctcagta

SEQ ID NO: 609774 - DNA, 19 bp, Homo sapiens
caaagcatgctcagtattg

SEQ ID NO: 609775 - DNA, 20 bp, Homo sapiens
caaagcatttgactttctgt

SEQ ID NO: 609776 - DNA, 17 bp, Homo sapiens
caaagccagctctgagc

SEQ ID NO: 609777 - DNA, 18 bp, Homo sapiens
caaagcccacttcacaca

SEQ ID NO: 609778 - DNA, 11 bp, Homo sapiens
caaagccctcc

SEQ ID NO: 609779 - DNA, 16 bp, Homo sapiens
caaagccctccctgtc

SEQ ID NO: 609780 - DNA, 15 bp, Homo sapiens
caaagctatttaagt

SEQ ID NO: 609781 - DNA, 18 bp, Homo sapiens
caaagctgtcactcacaa

SEQ ID NO: 609782 - DNA, 17 bp, Homo sapiens
caaaggttgtacatagt

SEQ ID NO: 609783 - DNA, 13 bp, Homo sapiens
caaagtgaaatta

SEQ ID NO: 609784 - DNA, 21 bp, Homo sapiens
caaagtgaaattagtattttg

SEQ ID NO: 609785 - DNA, 17 bp, Homo sapiens
caaagtttacattgtcc

SEQ ID NO: 609786 - DNA, 13 bp, Homo sapiens
caaataaccctga

SEQ ID NO: 609787 - DNA, 15 bp, Homo sapiens
caaataatattgcct

SEQ ID NO: 609788 - DNA, 17 bp, Homo sapiens
caaataatattgccttg

SEQ ID NO: 609789 - DNA, 21 bp, Homo sapiens
caaatacacatacatatatac

SEQ ID NO: 609790 - DNA, 21 bp, Homo sapiens
caaatagcttttcacttctta

SEQ ID NO: 609791 - DNA, 18 bp, Homo sapiens
caaatatactcatttgga

SEQ ID NO: 609792 - DNA, 18 bp, Homo sapiens
caaatattgctattgttt

SEQ ID NO: 609793 - DNA, 21 bp, Homo sapiens
caaatattgctattgtttata

SEQ ID NO: 609794 - DNA, 22 bp, Homo sapiens
caaatcattttgatgtattatt

SEQ ID NO: 609795 - DNA, 23 bp, Homo sapiens
caaatccataagcaggttatttt

SEQ ID NO: 609796 - DNA, 17 bp, Homo sapiens
caaatctgctttcatcc

SEQ ID NO: 609797 - DNA, 16 bp, Homo sapiens
caaatgctactcagta

SEQ ID NO: 609798 - DNA, 18 bp, Homo sapiens
caaatggatgtaatatag

SEQ ID NO: 609799 - DNA, 19 bp, Homo sapiens
caaatgtgtcttgtattat

SEQ ID NO: 609800 - DNA, 18 bp, Homo sapiens
caaattaattggcagcag

SEQ ID NO: 609801 - DNA, 19 bp, Homo sapiens
caattccagggaaccagag

SEQ ID NO: 609802 - DNA, 22 bp, Homo sapiens
caattctgaaggggaaaacctc

SEQ ID NO: 609803 - DNA, 15 bp, Homo sapiens
caattgcttgagcat

SEQ ID NO: 609804 - DNA, 12 bp, Homo sapiens
caattgtatata

SEQ ID NO: 609805 - DNA, 16 bp, Homo sapiens
caattgtatatatatg

SEQ ID NO: 609806 - DNA, 17 bp, Homo sapiens
caattgtatatatatgt

SEQ ID NO: 609807 - DNA, 18 bp, Homo sapiens
caattgtatatatatgtg

SEQ ID NO: 609808 - DNA, 22 bp, Homo sapiens
caatttaaaggaaagttctatt

SEQ ID NO: 609809 - DNA, 23 bp, Homo sapiens
caatttaggaatgctcaatgtgc

SEQ ID NO: 609810 - DNA, 19 bp, Homo sapiens
caatttcaaagaaaacaga

SEQ ID NO: 609811 - DNA, 13 bp, Homo sapiens
caatttgataatc

SEQ ID NO: 609812 - DNA, 23 bp, Homo sapiens
caattttggtttttctcatttga

SEQ ID NO: 609813 - DNA, 21 bp, Homo sapiens
caatttttaacttatctccag

SEQ ID NO: 609814 - DNA, 13 bp, Homo sapiens
caatttttctgca

SEQ ID NO: 609815 - DNA, 14 bp, Homo sapiens
caatttttctgcac

SEQ ID NO: 609816 - DNA, 13 bp, Homo sapiens
cacaaaaaattta

SEQ ID NO: 609817 - DNA, 22 bp, Homo sapiens
cacaaaacaacagcaacaacaa

SEQ ID NO: 609818 - DNA, 23 bp, Homo sapiens
cacaaaacaacagcaacaacaac

SEQ ID NO: 609819 - DNA, 13 bp, Homo sapiens
cacaaaaggctgg

SEQ ID NO: 609820 - DNA, 17 bp, Homo sapiens
cacaaacctactgccca

SEQ ID NO: 609821 - DNA, 16 bp, Homo sapiens
cacaaacgtttttcca

SEQ ID NO: 609822 - DNA, 16 bp, Homo sapiens
cacaaagctatttaag

SEQ ID NO: 609823 - DNA, 15 bp, Homo sapiens
cacaaagtgaaatta

SEQ ID NO: 609824 - DNA, 21 bp, Homo sapiens
cacaaggcccagccctgggca

SEQ ID NO: 609825 - DNA, 14 bp, Homo sapiens
cacacaaaacaaca

SEQ ID NO: 609826 - DNA, 17 bp, Homo sapiens
cacacaaaacaacagca

SEQ ID NO: 609827 - DNA, 16 bp, Homo sapiens
cacacaaagtgaaatt

SEQ ID NO: 609828 - DNA, 22 bp, Homo sapiens
cacacaagcagacacacacata

SEQ ID NO: 609829 - DNA, 13 bp, Homo sapiens
cacacacaaaaca

SEQ ID NO: 609830 - DNA, 22 bp, Homo sapiens
cacacacaaacctactgcccac

SEQ ID NO: 609831 - DNA, 12 bp, Homo sapiens
cacacacacaaa

SEQ ID NO: 609832 - DNA, 15 bp, Homo sapiens
cacacacacaaaaca

SEQ ID NO: 609833 - DNA, 13 bp, Homo sapiens
cacacacatctgg

SEQ ID NO: 609834 - DNA, 15 bp, Homo sapiens
cacacataacacaca

SEQ ID NO: 609835 - DNA, 18 bp, Homo sapiens
cacaccccgtctgcccct

SEQ ID NO: 609836 - DNA, 18 bp, Homo sapiens
cacacccttccccactcc

SEQ ID NO: 609837 - DNA, 14 bp, Homo sapiens
cacacctaaattaa

SEQ ID NO: 609838 - DNA, 15 bp, Homo sapiens
cacacctccacccgt

SEQ ID NO: 609839 - DNA, 18 bp, Homo sapiens
cacacctccacccgtcct

SEQ ID NO: 609840 - DNA, 15 bp, Homo sapiens
cacacctcccttcat

SEQ ID NO: 609841 - DNA, 17 bp, Homo sapiens
cacaccttacaaagcca

SEQ ID NO: 609842 - DNA, 18 bp, Homo sapiens
cacaccttacaaagccag

SEQ ID NO: 609843 - DNA, 20 bp, Homo sapiens
cacaccttacaaagccagct

SEQ ID NO: 609844 - DNA, 19 bp, Homo sapiens
cacacgccggggctggccc

SEQ ID NO: 609845 - DNA, 20 bp, Homo sapiens
cacacgccggggctggccct

SEQ ID NO: 609846 - DNA, 21 bp, Homo sapiens
cacacgccggggctggccctg

SEQ ID NO: 609847 - DNA, 23 bp, Homo sapiens
cacacgccggggctggccctgcc

SEQ ID NO: 609848 - DNA, 14 bp, Homo sapiens
cacactcaccattt

SEQ ID NO: 609849 - DNA, 12 bp, Homo sapiens
cacactcagcag

SEQ ID NO: 609850 - DNA, 18 bp, Homo sapiens
cacactgccctctgccac

SEQ ID NO: 609851 - DNA, 15 bp, Homo sapiens
cacagaaatctctca

SEQ ID NO: 609852 - DNA, 16 bp, Homo sapiens
cacagagagcggcttc

SEQ ID NO: 609853 - DNA, 19 bp, Homo sapiens
cacagaggacggcttcccc

SEQ ID NO: 609854 - DNA, 11 bp, Homo sapiens
cacagcacatt

SEQ ID NO: 609855 - DNA, 15 bp, Homo sapiens
cacagcacatttgtt

SEQ ID NO: 609856 - DNA, 19 bp, Homo sapiens
cacagcatgcatttagcat

SEQ ID NO: 609857 - DNA, 21 bp, Homo sapiens
cacagcatgcatttagcatga

SEQ ID NO: 609858 - DNA, 16 bp, Homo sapiens
cacagcccagagactg

SEQ ID NO: 609859 - DNA, 16 bp, Homo sapiens
cacagctgggcagggt

SEQ ID NO: 609860 - DNA, 18 bp, Homo sapiens
cacagctgggcagggtga

SEQ ID NO: 609861 - DNA, 12 bp, Homo sapiens
cacaggagccgc

SEQ ID NO: 609862 - DNA, 19 bp, Homo sapiens
cacaggagccgcagaggcc

SEQ ID NO: 609863 - DNA, 17 bp, Homo sapiens
cacaggatgcatattaa

SEQ ID NO: 609864 - DNA, 20 bp, Homo sapiens
cacaggatgcatattaaaga

SEQ ID NO: 609865 - DNA, 22 bp, Homo sapiens
cacaggggcaaagaactgcccc

SEQ ID NO: 609866 - DNA, 19 bp, Homo sapiens
cacagtaagataggttctg

SEQ ID NO: 609867 - DNA, 15 bp, Homo sapiens
cacagtatttaacat

SEQ ID NO: 609868 - DNA, 20 bp, Homo sapiens
cacagtcctcacagcctctc

SEQ ID NO: 609869 - DNA, 14 bp, Homo sapiens
cacagtgggcggct

SEQ ID NO: 609870 - DNA, 19 bp, Homo sapiens
cacagtgggcggcttccct

SEQ ID NO: 609871 - DNA, 16 bp, Homo sapiens
cacagtggtccagggt

SEQ ID NO: 609872 - DNA, 22 bp, Homo sapiens
cacatagtttttaaggttattt

SEQ ID NO: 609873 - DNA, 19 bp, Homo sapiens
cacatcataaacaaagagt

SEQ ID NO: 609874 - DNA, 14 bp, Homo sapiens
cacatctcttcatg

SEQ ID NO: 609875 - DNA, 13 bp, Homo sapiens
cacatctggccct

SEQ ID NO: 609876 - DNA, 15 bp, Homo sapiens
cacatctggccctga

SEQ ID NO: 609877 - DNA, 22 bp, Homo sapiens
cacatctggccctgacttctgg

SEQ ID NO: 609878 - DNA, 20 bp, Homo sapiens
cacatctgtatatcagctct

SEQ ID NO: 609879 - DNA, 15 bp, Homo sapiens
cacatgacagtggtt

SEQ ID NO: 609880 - DNA, 21 bp, Homo sapiens
cacatggcacttggaagaaaa

SEQ ID NO: 609881 - DNA, 13 bp, Homo sapiens
cacatgttttaca

SEQ ID NO: 609882 - DNA, 16 bp, Homo sapiens
cacattgaaactgtat

SEQ ID NO: 609883 - DNA, 17 bp, Homo sapiens
cacattgaaactgtatt

SEQ ID NO: 609884 - DNA, 18 bp, Homo sapiens
cacattgaaactgtattt

SEQ ID NO: 609885 - DNA, 13 bp, Homo sapiens
cacattgcttcat

SEQ ID NO: 609886 - DNA, 20 bp, Homo sapiens
cacattggcagtgtgtcaca

SEQ ID NO: 609887 - DNA, 20 bp, Homo sapiens
cacatttctggccatttaac

SEQ ID NO: 609888 - DNA, 17 bp, Homo sapiens
cacatttgggctcaggg

SEQ ID NO: 609889 - DNA, 19 bp, Homo sapiens
caccacacacacccttccc

SEQ ID NO: 609890 - DNA, 21 bp, Homo sapiens
caccactagggtcctggccct

SEQ ID NO: 609891 - DNA, 13 bp, Homo sapiens
caccagcctgagc

SEQ ID NO: 609892 - DNA, 18 bp, Homo sapiens
caccagcctgagccacag

SEQ ID NO: 609893 - DNA, 15 bp, Homo sapiens
caccagcttgcttct

SEQ ID NO: 609894 - DNA, 20 bp, Homo sapiens
caccagtgccgcctgtgccc

SEQ ID NO: 609895 - DNA, 16 bp, Homo sapiens
caccatttcccctgtg

SEQ ID NO: 609896 - DNA, 19 bp, Homo sapiens
caccatttcccctgtggtt

SEQ ID NO: 609897 - DNA, 13 bp, Homo sapiens
cacccacaccccg

SEQ ID NO: 609898 - DNA, 19 bp, Homo sapiens
cacccacaccccgtctgcc

SEQ ID NO: 609899 - DNA, 22 bp, Homo sapiens
cacccacaccccgtctgcccct

SEQ ID NO: 609900 - DNA, 20 bp, Homo sapiens
cacccactagccctctttct

SEQ ID NO: 609901 - DNA, 15 bp, Homo sapiens
cacccagcagcgccc

SEQ ID NO: 609902 - DNA, 21 bp, Homo sapiens
cacccagcagcgcccgaggcc

SEQ ID NO: 609903 - DNA, 11 bp, Homo sapiens
cacccatgcca

SEQ ID NO: 609904 - DNA, 15 bp, Homo sapiens
cacccatgccagcgc

SEQ ID NO: 609905 - DNA, 16 bp, Homo sapiens
cacccccagcagctca

SEQ ID NO: 609906 - DNA, 14 bp, Homo sapiens
cacccccagcctcc

SEQ ID NO: 609907 - DNA, 20 bp, Homo sapiens
cacccccgtcaccccgctct

SEQ ID NO: 609908 - DNA, 17 bp, Homo sapiens
caccccgctgcctggcg

SEQ ID NO: 609909 - DNA, 12 bp, Homo sapiens
caccccgtcccg

SEQ ID NO: 609910 - DNA, 16 bp, Homo sapiens
caccccgtctgcccct

SEQ ID NO: 609911 - DNA, 19 bp, Homo sapiens
caccccgttcccagcgcat

SEQ ID NO: 609912 - DNA, 15 bp, Homo sapiens
caccccgttgttgtc

SEQ ID NO: 609913 - DNA, 21 bp, Homo sapiens
caccccgttgttgtccctgca

SEQ ID NO: 609914 - DNA, 18 bp, Homo sapiens
cacccctcttcccccttc

SEQ ID NO: 609915 - DNA, 12 bp, Homo sapiens
cacccctgtagg

SEQ ID NO: 609916 - DNA, 11 bp, Homo sapiens
cacccgcccca

SEQ ID NO: 609917 - DNA, 13 bp, Homo sapiens
cacccgccccaga

SEQ ID NO: 609918 - DNA, 12 bp, Homo sapiens
cagcaacaacaa

SEQ ID NO: 609919 - DNA, 13 bp, Homo sapiens
cagcaacaacaac

SEQ ID NO: 609920 - DNA, 17 bp, Homo sapiens
cagcaacaacaacagaa

SEQ ID NO: 609921 - DNA, 14 bp, Homo sapiens
cagcaaccagagca

SEQ ID NO: 609922 - DNA, 18 bp, Homo sapiens
cagcaaccagagcactgt

SEQ ID NO: 609923 - DNA, 15 bp, Homo sapiens
cagcaacttttctca

SEQ ID NO: 609924 - DNA, 14 bp, Homo sapiens
cagcacaagggcac

SEQ ID NO: 609925 - DNA, 22 bp, Homo sapiens
cagcacaagggcacattgccca

SEQ ID NO: 609926 - DNA, 15 bp, Homo sapiens
cagcacagagagcgg

SEQ ID NO: 609927 - DNA, 17 bp, Homo sapiens
cagcacagagagcggct

SEQ ID NO: 609928 - DNA, 23 bp, Homo sapiens
cagcacatttgttaatgattctt

SEQ ID NO: 609929 - DNA, 13 bp, Homo sapiens
cagcaccagcctg

SEQ ID NO: 609930 - DNA, 23 bp, Homo sapiens
cagcacctcctccgtgggcagct

SEQ ID NO: 609931 - DNA, 12 bp, Homo sapiens
cagcactcccag

SEQ ID NO: 609932 - DNA, 16 bp, Homo sapiens
cagcactcccagggcc

SEQ ID NO: 609933 - DNA, 17 bp, Homo sapiens
cagcactcccagggccc

SEQ ID NO: 609934 - DNA, 20 bp, Homo sapiens
cagcactcccagggcccgag

SEQ ID NO: 609935 - DNA, 13 bp, Homo sapiens
cagcagacattgt

SEQ ID NO: 609936 - DNA, 16 bp, Homo sapiens
cagcagacattgtcag

SEQ ID NO: 609937 - DNA, 16 bp, Homo sapiens
cagcagcgcccgaggc

SEQ ID NO: 609938 - DNA, 11 bp, Homo sapiens
cagcagctcac

SEQ ID NO: 609939 - DNA, 14 bp, Homo sapiens
cagcagctcaccat

SEQ ID NO: 609940 - DNA, 16 bp, Homo sapiens
cagcaggggggttggg

SEQ ID NO: 609941 - DNA, 21 bp, Homo sapiens
cagcagtgaatgctagacaga

SEQ ID NO: 609942 - DNA, 16 bp, Homo sapiens
cagcatagttctgcaa

SEQ ID NO: 609943 - DNA, 23 bp, Homo sapiens
cagcatagttctgcaataacagt

SEQ ID NO: 609944 - DNA, 18 bp, Homo sapiens
cagcatcgtgtgggtccc

SEQ ID NO: 609945 - DNA, 21 bp, Homo sapiens
cagcatgcatttagcatgagt

SEQ ID NO: 609946 - DNA, 16 bp, Homo sapiens
cagcattcagcacaca

SEQ ID NO: 609947 - DNA, 15 bp, Homo sapiens
cagccaagcctgact

SEQ ID NO: 609948 - DNA, 16 bp, Homo sapiens
cagccaagcctgactt

SEQ ID NO: 609949 - DNA, 19 bp, Homo sapiens
cagccaataaacaccagtg

SEQ ID NO: 609950 - DNA, 12 bp, Homo sapiens
cagccaatttca

SEQ ID NO: 609951 - DNA, 13 bp, Homo sapiens
cagccaatttcaa

SEQ ID NO: 609952 - DNA, 16 bp, Homo sapiens
cagccaatttcaaaga

SEQ ID NO: 609953 - DNA, 21 bp, Homo sapiens
cagccatacttccagcgaaat

SEQ ID NO: 609954 - DNA, 14 bp, Homo sapiens
cagcccatgctggc

SEQ ID NO: 609955 - DNA, 12 bp, Homo sapiens
cagccccatcct

SEQ ID NO: 609956 - DNA, 22 bp, Homo sapiens
cagcccccacccatgccagcgc

SEQ ID NO: 609957 - DNA, 14 bp, Homo sapiens
cagcccccaccccc

SEQ ID NO: 609958 - DNA, 13 bp, Homo sapiens
cagccccctgtgg

SEQ ID NO: 609959 - DNA, 16 bp, Homo sapiens
cagccccgcgaccacc

SEQ ID NO: 609960 - DNA, 13 bp, Homo sapiens
cagcccctgctgg

SEQ ID NO: 609961 - DNA, 14 bp, Homo sapiens
cagcccctgctgga

SEQ ID NO: 609962 - DNA, 12 bp, Homo sapiens
cagccctcacct

SEQ ID NO: 609963 - DNA, 18 bp, Homo sapiens
cagccctcacctctgagg

SEQ ID NO: 609964 - DNA, 19 bp, Homo sapiens
cagccctcattaaactaat

SEQ ID NO: 609965 - DNA, 14 bp, Homo sapiens
cagccctccgccag

SEQ ID NO: 609966 - DNA, 21 bp, Homo sapiens
cagccctccgccagccctgtt

SEQ ID NO: 609967 - DNA, 18 bp, Homo sapiens
cagccctgttccgcctca

SEQ ID NO: 609968 - DNA, 16 bp, Homo sapiens
cagcccttgctctacc

SEQ ID NO: 609969 - DNA, 21 bp, Homo sapiens
cagcccttgctctacctggcc

SEQ ID NO: 609970 - DNA, 14 bp, Homo sapiens
cagccgcgctctgc

SEQ ID NO: 609971 - DNA, 17 bp, Homo sapiens
cagccgcgctctgcccc

SEQ ID NO: 609972 - DNA, 13 bp, Homo sapiens
cagcctcccccag

SEQ ID NO: 609973 - DNA, 16 bp, Homo sapiens
cagcctcccccaggct

SEQ ID NO: 609974 - DNA, 18 bp, Homo sapiens
cagcctcgttggagagca

SEQ ID NO: 609975 - DNA, 12 bp, Homo sapiens
cagcctcttgaa

SEQ ID NO: 609976 - DNA, 13 bp, Homo sapiens
cagcctgaagcct

SEQ ID NO: 609977 - DNA, 15 bp, Homo sapiens
cagcctgaagcctgg

SEQ ID NO: 609978 - DNA, 16 bp, Homo sapiens
cagcctgaagcctgga

SEQ ID NO: 609979 - DNA, 20 bp, Homo sapiens
cagcctgaagcctggattcc

SEQ ID NO: 609980 - DNA, 21 bp, Homo sapiens
cagcctgaagcctggattcca

SEQ ID NO: 609981 - DNA, 23 bp, Homo sapiens
cagcctgaagcctggattccagc

SEQ ID NO: 609982 - DNA, 18 bp, Homo sapiens
cagcctgagccacagtgg

SEQ ID NO: 609983 - DNA, 12 bp, Homo sapiens
cagcctgagctc

SEQ ID NO: 609984 - DNA, 19 bp, Homo sapiens
cagcctgagctccaccctc

SEQ ID NO: 609985 - DNA, 12 bp, Homo sapiens
cagcctgcacag

SEQ ID NO: 609986 - DNA, 14 bp, Homo sapiens
cagcctgcacagtg

SEQ ID NO: 609987 - DNA, 15 bp, Homo sapiens
cagcctgcacagtgg

SEQ ID NO: 609988 - DNA, 20 bp, Homo sapiens
cagcctgccaggccctccag

SEQ ID NO: 609989 - DNA, 15 bp, Homo sapiens
cagcctgtgggtcct

SEQ ID NO: 609990 - DNA, 16 bp, Homo sapiens
cagcctttgcgctctg

SEQ ID NO: 609991 - DNA, 16 bp, Homo sapiens
cagcgacgcggcccgc

SEQ ID NO: 609992 - DNA, 21 bp, Homo sapiens
cagcgcctcgccccagccaag

SEQ ID NO: 609993 - DNA, 17 bp, Homo sapiens
cagcggcccggcccacg

SEQ ID NO: 609994 - DNA, 15 bp, Homo sapiens
cagcggggcttctgg

SEQ ID NO: 609995 - DNA, 21 bp, Homo sapiens
cagcgtctccccatgctgggc

SEQ ID NO: 609996 - DNA, 22 bp, Homo sapiens
cagcgtctccccatgctgggct

SEQ ID NO: 609997 - DNA, 23 bp, Homo sapiens
cagcgtctccccatgctgggctc

SEQ ID NO: 609998 - DNA, 15 bp, Homo sapiens
cagcgtggggctaac

SEQ ID NO: 609999 - DNA, 18 bp, Homo sapiens
cagctaagcctgatgatg

SEQ ID NO: 610000 - DNA, 15 bp, Homo sapiens
cagctaatttgtgaa

SEQ ID NO: 610001 - DNA, 16 bp, Homo sapiens
cagctaatttgtgaaa

SEQ ID NO: 610002 - DNA, 17 bp, Homo sapiens
cagctaatttgtgaaag

SEQ ID NO: 610003 - DNA, 14 bp, Homo sapiens
cagctagaaagaga

SEQ ID NO: 610004 - DNA, 13 bp, Homo sapiens
cagctaggcaggg

SEQ ID NO: 610005 - DNA, 17 bp, Homo sapiens
cagctaggcagggaggg

SEQ ID NO: 610006 - DNA, 20 bp, Homo sapiens
cagctcaggctactgccact

SEQ ID NO: 610007 - DNA, 22 bp, Homo sapiens
cagctcaggctactgccactca

SEQ ID NO: 610008 - DNA, 14 bp, Homo sapiens
cagctccactctga

SEQ ID NO: 610009 - DNA, 23 bp, Homo sapiens
cagctccactctgaagtcccttc

SEQ ID NO: 610010 - DNA, 15 bp, Homo sapiens
cagctcctcgggtgg

SEQ ID NO: 610011 - DNA, 20 bp, Homo sapiens
cagctcctcgggtggggcct

SEQ ID NO: 610012 - DNA, 21 bp, Homo sapiens
cagctctaaagcagagatgta

SEQ ID NO: 610013 - DNA, 14 bp, Homo sapiens
cagctctccctcac

SEQ ID NO: 610014 - DNA, 16 bp, Homo sapiens
cagctctggatgaagg

SEQ ID NO: 610015 - DNA, 19 bp, Homo sapiens
cagctgcagttagcacaga

SEQ ID NO: 610016 - DNA, 15 bp, Homo sapiens
cagctggcagcgcct

SEQ ID NO: 610017 - DNA, 14 bp, Homo sapiens
cagctggctgggtc

SEQ ID NO: 610018 - DNA, 22 bp, Homo sapiens
cagctggctgggtcgcccctcc

SEQ ID NO: 610019 - DNA, 18 bp, Homo sapiens
cagctgtattatcttaaa

SEQ ID NO: 610020 - DNA, 14 bp, Homo sapiens
cagctgtctgtggc

SEQ ID NO: 610021 - DNA, 14 bp, Homo sapiens
cagctgtgagcttt

SEQ ID NO: 610022 - DNA, 23 bp, Homo sapiens
cagcttagaagttcgaaaactca

SEQ ID NO: 610023 - DNA, 14 bp, Homo sapiens
cagcttcacttaaa

SEQ ID NO: 610024 - DNA, 16 bp, Homo sapiens
cagcttgagcctgtca

SEQ ID NO: 610025 - DNA, 20 bp, Homo sapiens
caggaaatttttgcatgttt

SEQ ID NO: 610026 - DNA, 22 bp, Homo sapiens
caggaatggggggcgggccagg

SEQ ID NO: 610027 - DNA, 13 bp, Homo sapiens
caggaccatggcc

SEQ ID NO: 610028 - DNA, 18 bp, Homo sapiens
caggaccattttagaaga

SEQ ID NO: 610029 - DNA, 18 bp, Homo sapiens
caggacccccccagtccg

SEQ ID NO: 610030 - DNA, 22 bp, Homo sapiens
caggacccccccagtccgcccc

SEQ ID NO: 610031 - DNA, 16 bp, Homo sapiens
caggacgcatgcaggg

SEQ ID NO: 610032 - DNA, 17 bp, Homo sapiens
caggacgcatgcagggc

SEQ ID NO: 610033 - DNA, 20 bp, Homo sapiens
caggagaaaatgcaatttga

SEQ ID NO: 610034 - DNA, 15 bp, Homo sapiens
caggagaaggcctgc

SEQ ID NO: 610035 - DNA, 12 bp, Homo sapiens
catcgccttctg

SEQ ID NO: 610036 - DNA, 22 bp, Homo sapiens
catcgccttctggccgctgcag

SEQ ID NO: 610037 - DNA, 22 bp, Homo sapiens
catcgccttctggggaggggct

SEQ ID NO: 610038 - DNA, 13 bp, Homo sapiens
catctaaatatta

SEQ ID NO: 610039 - DNA, 12 bp, Homo sapiens
catctacacata

SEQ ID NO: 610040 - DNA, 20 bp, Homo sapiens
catctacacatataaacaca

SEQ ID NO: 610041 - DNA, 23 bp, Homo sapiens
catctacacatataaacacagta

SEQ ID NO: 610042 - DNA, 15 bp, Homo sapiens
catctaggatgattt

SEQ ID NO: 610043 - DNA, 16 bp, Homo sapiens
catctccaccctgagc

SEQ ID NO: 610044 - DNA, 17 bp, Homo sapiens
catctccaccctgagcc

SEQ ID NO: 610045 - DNA, 19 bp, Homo sapiens
catctccaccctgagcctg

SEQ ID NO: 610046 - DNA, 20 bp, Homo sapiens
catctccaccctgagcctga

SEQ ID NO: 610047 - DNA, 11 bp, Homo sapiens
catctgcctgg

SEQ ID NO: 610048 - DNA, 12 bp, Homo sapiens
catctgcctgga

SEQ ID NO: 610049 - DNA, 16 bp, Homo sapiens
catctgcctggagcct

SEQ ID NO: 610050 - DNA, 18 bp, Homo sapiens
catctgcctggagcctgg

SEQ ID NO: 610051 - DNA, 21 bp, Homo sapiens
catctgcctggagcctgggca

SEQ ID NO: 610052 - DNA, 12 bp, Homo sapiens
catctggccctg

SEQ ID NO: 610053 - DNA, 14 bp, Homo sapiens
catctggcctgggg

SEQ ID NO: 610054 - DNA, 18 bp, Homo sapiens
catctgtaaaaccaggct

SEQ ID NO: 610055 - DNA, 19 bp, Homo sapiens
catctgtaaaaccaggctg

SEQ ID NO: 610056 - DNA, 20 bp, Homo sapiens
catctgtaaaaccaggctga

SEQ ID NO: 610057 - DNA, 13 bp, Homo sapiens
catctgtcagctt

SEQ ID NO: 610058 - DNA, 20 bp, Homo sapiens
catctgtgtaacctccacag

SEQ ID NO: 610059 - DNA, 18 bp, Homo sapiens
catcttgtggggccagga

SEQ ID NO: 610060 - DNA, 22 bp, Homo sapiens
catgaaagccctggaattttag

SEQ ID NO: 610061 - DNA, 21 bp, Homo sapiens
catgaatacgtaaactgcgta

SEQ ID NO: 610062 - DNA, 18 bp, Homo sapiens
catgaatccatcgatttg

SEQ ID NO: 610063 - DNA, 21 bp, Homo sapiens
catgacacgaatattgctgat

SEQ ID NO: 610064 - DNA, 23 bp, Homo sapiens
catgacacgaatattgctgatgg

SEQ ID NO: 610065 - DNA, 22 bp, Homo sapiens
catgacagtggttatatttcaa

SEQ ID NO: 610066 - DNA, 12 bp, Homo sapiens
catgacccagcc

SEQ ID NO: 610067 - DNA, 15 bp, Homo sapiens
catgacccagcctga

SEQ ID NO: 610068 - DNA, 23 bp, Homo sapiens
catgaccctcctgtccagcaggt

SEQ ID NO: 610069 - DNA, 16 bp, Homo sapiens
catgaccttacatagc

SEQ ID NO: 610070 - DNA, 19 bp, Homo sapiens
catgaggcctttccccagt

SEQ ID NO: 610071 - DNA, 12 bp, Homo sapiens
catgagttctgc

SEQ ID NO: 610072 - DNA, 15 bp, Homo sapiens
catgagttctgcaca

SEQ ID NO: 610073 - DNA, 16 bp, Homo sapiens
catgattagacaatgt

SEQ ID NO: 610074 - DNA, 20 bp, Homo sapiens
catgattagacaatgtggaa

SEQ ID NO: 610075 - DNA, 21 bp, Homo sapiens
catgattattagttgaccaac

SEQ ID NO: 610076 - DNA, 21 bp, Homo sapiens
catgcagatagtatacacatc

SEQ ID NO: 610077 - DNA, 12 bp, Homo sapiens
catgcagggccc

SEQ ID NO: 610078 - DNA, 21 bp, Homo sapiens
catgcagggcccccacaggag

SEQ ID NO: 610079 - DNA, 22 bp, Homo sapiens
catgcagggcccccacaggagc

SEQ ID NO: 610080 - DNA, 18 bp, Homo sapiens
catgccagcgcagcgcca

SEQ ID NO: 610081 - DNA, 20 bp, Homo sapiens
catgccagcgcagcgccagg

SEQ ID NO: 610082 - DNA, 18 bp, Homo sapiens
catgccatctccaccctg

SEQ ID NO: 610083 - DNA, 16 bp, Homo sapiens
catgccccagctctgg

SEQ ID NO: 610084 - DNA, 11 bp, Homo sapiens
catgccctccc

SEQ ID NO: 610085 - DNA, 20 bp, Homo sapiens
catgcctacattagtgagat

SEQ ID NO: 610086 - DNA, 15 bp, Homo sapiens
catgctcagtattga

SEQ ID NO: 610087 - DNA, 19 bp, Homo sapiens
catgctccctcatgcagat

SEQ ID NO: 610088 - DNA, 17 bp, Homo sapiens
catgctgtccctgtggg

SEQ ID NO: 610089 - DNA, 20 bp, Homo sapiens
catgctgtccctgtgggctc

SEQ ID NO: 610090 - DNA, 22 bp, Homo sapiens
catgctgtctgtgtgaggctcc

SEQ ID NO: 610091 - DNA, 22 bp, Homo sapiens
catgcttaaataaaaattatgt

SEQ ID NO: 610092 - DNA, 17 bp, Homo sapiens
catgcttttctcatggt

SEQ ID NO: 610093 - DNA, 15 bp, Homo sapiens
catggaacagccctg

SEQ ID NO: 610094 - DNA, 21 bp, Homo sapiens
catggagtagagtcaggagaa

SEQ ID NO: 610095 - DNA, 19 bp, Homo sapiens
catggatttcctttgacct

SEQ ID NO: 610096 - DNA, 12 bp, Homo sapiens
catggctgggaa

SEQ ID NO: 610097 - DNA, 18 bp, Homo sapiens
catggctgtcccctgcaa

SEQ ID NO: 610098 - DNA, 12 bp, Homo sapiens
catgggccctca

SEQ ID NO: 610099 - DNA, 17 bp, Homo sapiens
catgggtgtgccaggct

SEQ ID NO: 610100 - DNA, 14 bp, Homo sapiens
catggtcagtctac

SEQ ID NO: 610101 - DNA, 15 bp, Homo sapiens
catggtgaactgaag

SEQ ID NO: 610102 - DNA, 14 bp, Homo sapiens
catggtgctgtgtg

SEQ ID NO: 610103 - DNA, 15 bp, Homo sapiens
catgtaatattaaat

SEQ ID NO: 610104 - DNA, 13 bp, Homo sapiens
catgtacagagaa

SEQ ID NO: 610105 - DNA, 10 bp, Homo sapiens
catgtacagt

SEQ ID NO: 610106 - DNA, 19 bp, Homo sapiens
catgtacagtgttctgttt

SEQ ID NO: 610107 - DNA, 13 bp, Homo sapiens
catgtatgccatg

SEQ ID NO: 610108 - DNA, 15 bp, Homo sapiens
catgtatgttgcatg

SEQ ID NO: 610109 - DNA, 14 bp, Homo sapiens
catgtattgtgtct

SEQ ID NO: 610110 - DNA, 15 bp, Homo sapiens
catgtattgtgtctt

SEQ ID NO: 610111 - DNA, 23 bp, Homo sapiens
catgtattgtgtcttttgcatga

SEQ ID NO: 610112 - DNA, 19 bp, Homo sapiens
catgtcggggcccctgcgt

SEQ ID NO: 610113 - DNA, 21 bp, Homo sapiens
catgtctttctccaaagttat

SEQ ID NO: 610114 - DNA, 22 bp, Homo sapiens
catgtctttggcttcagaattg

SEQ ID NO: 610115 - DNA, 18 bp, Homo sapiens
catgtgataattgtaaag

SEQ ID NO: 610116 - DNA, 18 bp, Homo sapiens
catgtgatgagaggaaat

SEQ ID NO: 610117 - DNA, 21 bp, Homo sapiens
catgtgatgagaggaaatcac

SEQ ID NO: 610118 - DNA, 23 bp, Homo sapiens
catgtgatgtgttgctctccatt

SEQ ID NO: 610119 - DNA, 18 bp, Homo sapiens
catgtgtagattgcgtgg

SEQ ID NO: 610120 - DNA, 19 bp, Homo sapiens
catgtgtagattgcgtgga

SEQ ID NO: 610121 - DNA, 13 bp, Homo sapiens
catgtgtatggaa

SEQ ID NO: 610122 - DNA, 23 bp, Homo sapiens
catgtgtatggaagacaaataca

SEQ ID NO: 610123 - DNA, 19 bp, Homo sapiens
catgttaaaaatagcagta

SEQ ID NO: 610124 - DNA, 16 bp, Homo sapiens
catgttaaaataatta

SEQ ID NO: 610125 - DNA, 21 bp, Homo sapiens
catgtttaagaaatgagaaat

SEQ ID NO: 610126 - DNA, 14 bp, Homo sapiens
catgtttaataata

SEQ ID NO: 610127 - DNA, 17 bp, Homo sapiens
catgtttaataatatgt

SEQ ID NO: 610128 - DNA, 21 bp, Homo sapiens
catgtttaataatatgtacaa

SEQ ID NO: 610129 - DNA, 16 bp, Homo sapiens
cattaagcacacacat

SEQ ID NO: 610130 - DNA, 24 bp, Homo sapiens
cattaagcacacacatctggccct

SEQ ID NO: 610131 - DNA, 17 bp, Homo sapiens
cattacatcctctgctt

SEQ ID NO: 610132 - DNA, 22 bp, Homo sapiens
cattacatcctctgcttgtcat

SEQ ID NO: 610133 - DNA, 19 bp, Homo sapiens
cattactggccttttcact

SEQ ID NO: 610134 - DNA, 20 bp, Homo sapiens
cattaggttgaatgaggaga

SEQ ID NO: 610135 - DNA, 13 bp, Homo sapiens
cattatagcatgt

SEQ ID NO: 610136 - DNA, 17 bp, Homo sapiens
cattatagcatgtaata

SEQ ID NO: 610137 - DNA, 18 bp, Homo sapiens
cattatagcatgtaatat

SEQ ID NO: 610138 - DNA, 15 bp, Homo sapiens
cattatgaggaaact

SEQ ID NO: 610139 - DNA, 16 bp, Homo sapiens
cattatggctttgtgc

SEQ ID NO: 610140 - DNA, 17 bp, Homo sapiens
cattatggctttgtgct

SEQ ID NO: 610141 - DNA, 20 bp, Homo sapiens
cattatggctttgtgcttgt

SEQ ID NO: 610142 - DNA, 13 bp, Homo sapiens
cattcagatctga

SEQ ID NO: 610143 - DNA, 18 bp, Homo sapiens
cattcaggtgttctcttc

SEQ ID NO: 610144 - DNA, 19 bp, Homo sapiens
cattcaggtgttctcttct

SEQ ID NO: 610145 - DNA, 14 bp, Homo sapiens
cattcatcctctta

SEQ ID NO: 610146 - DNA, 20 bp, Homo sapiens
cattccaagtgtatatttgt

SEQ ID NO: 610147 - DNA, 23 bp, Homo sapiens
cattcccaattatcaaaaaacag

SEQ ID NO: 610148 - DNA, 22 bp, Homo sapiens
cattcctaagagtggaggagga

SEQ ID NO: 610149 - DNA, 19 bp, Homo sapiens
cattcctgaccctcacttt

SEQ ID NO: 610150 - DNA, 20 bp, Homo sapiens
cattcctgtcagagctttca

SEQ ID NO: 610151 - DNA, 14 bp, Homo sapiens
ccagtccgccccgt

SEQ ID NO: 610152 - DNA, 17 bp, Homo sapiens
ccagtccgccccgtgct

SEQ ID NO: 610153 - DNA, 18 bp, Homo sapiens
ccagtccgccccgtgctc

SEQ ID NO: 610154 - DNA, 20 bp, Homo sapiens
ccagtccgccccgtgctcct

SEQ ID NO: 610155 - DNA, 17 bp, Homo sapiens
ccagtgccgcctgtgcc

SEQ ID NO: 610156 - DNA, 20 bp, Homo sapiens
ccagtgccgcctgtgcccac

SEQ ID NO: 610157 - DNA, 14 bp, Homo sapiens
ccagtggggtcccc

SEQ ID NO: 610158 - DNA, 23 bp, Homo sapiens
ccagtggggtcccccctgagtgg

SEQ ID NO: 610159 - DNA, 17 bp, Homo sapiens
ccagtgtttagaagagc

SEQ ID NO: 610160 - DNA, 23 bp, Homo sapiens
ccagtgtttagaagagcctgact

SEQ ID NO: 610161 - DNA, 23 bp, Homo sapiens
ccataatgcttctttcctcttaa

SEQ ID NO: 610162 - DNA, 18 bp, Homo sapiens
ccatagtttgaattcatg

SEQ ID NO: 610163 - DNA, 23 bp, Homo sapiens
ccatatggaatagggatccactt

SEQ ID NO: 610164 - DNA, 22 bp, Homo sapiens
ccatcaaacaaatcattttgat

SEQ ID NO: 610165 - DNA, 17 bp, Homo sapiens
ccatcagcaacatcatt

SEQ ID NO: 610166 - DNA, 14 bp, Homo sapiens
ccatcccactgata

SEQ ID NO: 610167 - DNA, 21 bp, Homo sapiens
ccatccttcccgcagcaccag

SEQ ID NO: 610168 - DNA, 13 bp, Homo sapiens
ccatcgccttctg

SEQ ID NO: 610169 - DNA, 20 bp, Homo sapiens
ccatctaggatgattttccc

SEQ ID NO: 610170 - DNA, 19 bp, Homo sapiens
ccatctccaccctgagcct

SEQ ID NO: 610171 - DNA, 21 bp, Homo sapiens
ccatctccaccctgagcctga

SEQ ID NO: 610172 - DNA, 13 bp, Homo sapiens
ccatctcctccca

SEQ ID NO: 610173 - DNA, 17 bp, Homo sapiens
ccatcttgtggggccag

SEQ ID NO: 610174 - DNA, 22 bp, Homo sapiens
ccatgaggcctttccccagtgt

SEQ ID NO: 610175 - DNA, 16 bp, Homo sapiens
ccatgcaggcagcctg

SEQ ID NO: 610176 - DNA, 15 bp, Homo sapiens
ccatgcattcagatc

SEQ ID NO: 610177 - DNA, 17 bp, Homo sapiens
ccatgccaatgtccagg

SEQ ID NO: 610178 - DNA, 14 bp, Homo sapiens
ccatgccagcgcag

SEQ ID NO: 610179 - DNA, 21 bp, Homo sapiens
ccatgccagcgcagcgccagg

SEQ ID NO: 610180 - DNA, 17 bp, Homo sapiens
ccatgctggctggggcc

SEQ ID NO: 610181 - DNA, 12 bp, Homo sapiens
ccatgctgggcc

SEQ ID NO: 610182 - DNA, 13 bp, Homo sapiens
ccatgctgggccg

SEQ ID NO: 610183 - DNA, 24 bp, Homo sapiens
ccatgctgggccggggtgtggaat

SEQ ID NO: 610184 - DNA, 16 bp, Homo sapiens
ccatggaacagccctg

SEQ ID NO: 610185 - DNA, 17 bp, Homo sapiens
ccatggaacagccctgc

SEQ ID NO: 610186 - DNA, 16 bp, Homo sapiens
ccatggccccagctgg

SEQ ID NO: 610187 - DNA, 15 bp, Homo sapiens
ccatggtagactgtg

SEQ ID NO: 610188 - DNA, 16 bp, Homo sapiens
ccatggtagactgtga

SEQ ID NO: 610189 - DNA, 14 bp, Homo sapiens
ccatggtgaactga

SEQ ID NO: 610190 - DNA, 16 bp, Homo sapiens
ccatggtgaactgaag

SEQ ID NO: 610191 - DNA, 21 bp, Homo sapiens
ccatggtggtttcagaaaggg

SEQ ID NO: 610192 - DNA, 17 bp, Homo sapiens
ccatgtatgttgcatga

SEQ ID NO: 610193 - DNA, 15 bp, Homo sapiens
ccatgtctttctcca

SEQ ID NO: 610194 - DNA, 12 bp, Homo sapiens
ccatgtgctgct

SEQ ID NO: 610195 - DNA, 15 bp, Homo sapiens
ccatgtgctgctgtg

SEQ ID NO: 610196 - DNA, 11 bp, Homo sapiens
ccatgtgtatg

SEQ ID NO: 610197 - DNA, 21 bp, Homo sapiens
ccatgttaatacatcattttt

SEQ ID NO: 610198 - DNA, 18 bp, Homo sapiens
ccattatggctttgtgct

SEQ ID NO: 610199 - DNA, 18 bp, Homo sapiens
ccattcagtctatgctgt

SEQ ID NO: 610200 - DNA, 22 bp, Homo sapiens
ccattctatgactcttgtctcc

SEQ ID NO: 610201 - DNA, 18 bp, Homo sapiens
ccattgaacactgcaccc

SEQ ID NO: 610202 - DNA, 17 bp, Homo sapiens
ccattgacatgtacaga

SEQ ID NO: 610203 - DNA, 18 bp, Homo sapiens
ccattgaccctcacctga

SEQ ID NO: 610204 - DNA, 12 bp, Homo sapiens
ccatttcacaca

SEQ ID NO: 610205 - DNA, 18 bp, Homo sapiens
ccatttcacattcctgac

SEQ ID NO: 610206 - DNA, 20 bp, Homo sapiens
ccatttgctagttctgctgc

SEQ ID NO: 610207 - DNA, 15 bp, Homo sapiens
cccaaattgccttca

SEQ ID NO: 610208 - DNA, 14 bp, Homo sapiens
cccaactctggcct

SEQ ID NO: 610209 - DNA, 21 bp, Homo sapiens
cccaaggaagaacaaatatga

SEQ ID NO: 610210 - DNA, 21 bp, Homo sapiens
cccaaggtggtcttggagagg

SEQ ID NO: 610211 - DNA, 14 bp, Homo sapiens
cccaagtcctcgcc

SEQ ID NO: 610212 - DNA, 20 bp, Homo sapiens
cccacaccccgtctgcccct

SEQ ID NO: 610213 - DNA, 22 bp, Homo sapiens
cccacaccccgtctgccccttg

SEQ ID NO: 610214 - DNA, 19 bp, Homo sapiens
cccacaggagcatgtccta

SEQ ID NO: 610215 - DNA, 19 bp, Homo sapiens
cccacaggagcgtgtccta

SEQ ID NO: 610216 - DNA, 21 bp, Homo sapiens
cccacagtcctcacagcctct

SEQ ID NO: 610217 - DNA, 13 bp, Homo sapiens
cccacataaacac

SEQ ID NO: 610218 - DNA, 15 bp, Homo sapiens
cccacataaacactt

SEQ ID NO: 610219 - DNA, 17 bp, Homo sapiens
cccacataaacacttct

SEQ ID NO: 610220 - DNA, 19 bp, Homo sapiens
cccacatttgggctcaggg

SEQ ID NO: 610221 - DNA, 21 bp, Homo sapiens
cccacccagcagcgcccgagg

SEQ ID NO: 610222 - DNA, 13 bp, Homo sapiens
cccacccatgcca

SEQ ID NO: 610223 - DNA, 18 bp, Homo sapiens
cccacccgccccagagac

SEQ ID NO: 610224 - DNA, 16 bp, Homo sapiens
cccacccgtgttctcc

SEQ ID NO: 610225 - DNA, 12 bp, Homo sapiens
cccaccctgggc

SEQ ID NO: 610226 - DNA, 13 bp, Homo sapiens
cccaccctgggcc

SEQ ID NO: 610227 - DNA, 20 bp, Homo sapiens
cccacctaaagggaagccct

SEQ ID NO: 610228 - DNA, 12 bp, Homo sapiens
cccacctgccca

SEQ ID NO: 610229 - DNA, 13 bp, Homo sapiens
cccacctgcccag

SEQ ID NO: 610230 - DNA, 13 bp, Homo sapiens
cccacgcagagcc

SEQ ID NO: 610231 - DNA, 18 bp, Homo sapiens
cccacgcagagccccgga

SEQ ID NO: 610232 - DNA, 19 bp, Homo sapiens
cccacgcagagccccggag

SEQ ID NO: 610233 - DNA, 20 bp, Homo sapiens
cccacgcagagccccggagc

SEQ ID NO: 610234 - DNA, 22 bp, Homo sapiens
cccacgcagagccccggagcac

SEQ ID NO: 610235 - DNA, 23 bp, Homo sapiens
cccacgcagagccccggagcacc

SEQ ID NO: 610236 - DNA, 20 bp, Homo sapiens
cccacgccgatataagccat

SEQ ID NO: 610237 - DNA, 22 bp, Homo sapiens
cccacgccgatataagccatag

SEQ ID NO: 610238 - DNA, 23 bp, Homo sapiens
cccacgccgatataagccatagc

SEQ ID NO: 610239 - DNA, 19 bp, Homo sapiens
cccacggccgtccctgact

SEQ ID NO: 610240 - DNA, 21 bp, Homo sapiens
cccacgtgcagcacctgtcac

SEQ ID NO: 610241 - DNA, 19 bp, Homo sapiens
cccactaagctttctcctt

SEQ ID NO: 610242 - DNA, 13 bp, Homo sapiens
cccactagccctc

SEQ ID NO: 610243 - DNA, 14 bp, Homo sapiens
cccactagccctct

SEQ ID NO: 610244 - DNA, 18 bp, Homo sapiens
cccactagccctctttct

SEQ ID NO: 610245 - DNA, 23 bp, Homo sapiens
cccactagccctctttctctctg

SEQ ID NO: 610246 - DNA, 23 bp, Homo sapiens
cccagaacgcatgcagggccccc

SEQ ID NO: 610247 - DNA, 17 bp, Homo sapiens
cccagaacgggcctccc

SEQ ID NO: 610248 - DNA, 20 bp, Homo sapiens
cccagaagctcaaggctgca

SEQ ID NO: 610249 - DNA, 13 bp, Homo sapiens
cccagagactgcc

SEQ ID NO: 610250 - DNA, 17 bp, Homo sapiens
cccagcacctcctccgt

SEQ ID NO: 610251 - DNA, 17 bp, Homo sapiens
cccagcagcgcccgagg

SEQ ID NO: 610252 - DNA, 20 bp, Homo sapiens
cccagcccccacccccgtca

SEQ ID NO: 610253 - DNA, 14 bp, Homo sapiens
cccagccctgggca

SEQ ID NO: 610254 - DNA, 15 bp, Homo sapiens
cccagcctcccccag

SEQ ID NO: 610255 - DNA, 20 bp, Homo sapiens
cccagcctcccccaggctgc

SEQ ID NO: 610256 - DNA, 16 bp, Homo sapiens
cccagcctcgttggag

SEQ ID NO: 610257 - DNA, 21 bp, Homo sapiens
cccagcctcttgctcagagct

SEQ ID NO: 610258 - DNA, 12 bp, Homo sapiens
cccagcctgaaa

SEQ ID NO: 610259 - DNA, 19 bp, Homo sapiens
cccagcgcatggcgccccg

SEQ ID NO: 610260 - DNA, 21 bp, Homo sapiens
cccagcgcatggcgccccggg

SEQ ID NO: 610261 - DNA, 13 bp, Homo sapiens
cccagctctggat

SEQ ID NO: 610262 - DNA, 20 bp, Homo sapiens
cccagctggcagcgcctccc

SEQ ID NO: 610263 - DNA, 20 bp, Homo sapiens
cccaggacgcatgcagggcc

SEQ ID NO: 610264 - DNA, 15 bp, Homo sapiens
cccaggcactctctt

SEQ ID NO: 610265 - DNA, 17 bp, Homo sapiens
cccaggcccgccctgcc

SEQ ID NO: 610266 - DNA, 15 bp, Homo sapiens
cccaggcggaggggc

SEQ ID NO: 610267 - DNA, 18 bp, Homo sapiens
ccgtctttggttcctcat

SEQ ID NO: 610268 - DNA, 15 bp, Homo sapiens
ccgtgccctgtttcc

SEQ ID NO: 610269 - DNA, 19 bp, Homo sapiens
ccgtgcggcccgtgcgcag

SEQ ID NO: 610270 - DNA, 21 bp, Homo sapiens
ccgtggtgaggttgtgctgcc

SEQ ID NO: 610271 - DNA, 22 bp, Homo sapiens
ccgtggtgtgaggcccccggag

SEQ ID NO: 610272 - DNA, 12 bp, Homo sapiens
ccgttcatctga

SEQ ID NO: 610273 - DNA, 15 bp, Homo sapiens
ccgttcatctgagga

SEQ ID NO: 610274 - DNA, 17 bp, Homo sapiens
ccgttcatctgaggagt

SEQ ID NO: 610275 - DNA, 21 bp, Homo sapiens
ccgttcatctgaggagtccaa

SEQ ID NO: 610276 - DNA, 15 bp, Homo sapiens
ccgttcccagcgcat

SEQ ID NO: 610277 - DNA, 16 bp, Homo sapiens
ccgttgttgtccctgc

SEQ ID NO: 610278 - DNA, 17 bp, Homo sapiens
cctaaacatagtggtat

SEQ ID NO: 610279 - DNA, 12 bp, Homo sapiens
cctaacagtcag

SEQ ID NO: 610280 - DNA, 14 bp, Homo sapiens
cctaacctgggttg

SEQ ID NO: 610281 - DNA, 18 bp, Homo sapiens
cctaactccctaggcctg

SEQ ID NO: 610282 - DNA, 16 bp, Homo sapiens
cctaagagtggaggag

SEQ ID NO: 610283 - DNA, 12 bp, Homo sapiens
cctacatctgaa

SEQ ID NO: 610284 - DNA, 15 bp, Homo sapiens
cctaccctcttctca

SEQ ID NO: 610285 - DNA, 13 bp, Homo sapiens
cctaccctggacc

SEQ ID NO: 610286 - DNA, 15 bp, Homo sapiens
cctacggtacaagct

SEQ ID NO: 610287 - DNA, 23 bp, Homo sapiens
cctacggtacaagctacatatgt

SEQ ID NO: 610288 - DNA, 16 bp, Homo sapiens
cctactcctccccctc

SEQ ID NO: 610289 - DNA, 16 bp, Homo sapiens
cctactgcccacattt

SEQ ID NO: 610290 - DNA, 21 bp, Homo sapiens
cctactggatgcttacagtga

SEQ ID NO: 610291 - DNA, 13 bp, Homo sapiens
cctacttaaacaa

SEQ ID NO: 610292 - DNA, 16 bp, Homo sapiens
cctacttaaacaaaaa

SEQ ID NO: 610293 - DNA, 18 bp, Homo sapiens
cctacttaaacaaaaact

SEQ ID NO: 610294 - DNA, 20 bp, Homo sapiens
cctacttaaacaaaaacttt

SEQ ID NO: 610295 - DNA, 20 bp, Homo sapiens
cctagcctctccgcccacgc

SEQ ID NO: 610296 - DNA, 13 bp, Homo sapiens
cctaggcctgagt

SEQ ID NO: 610297 - DNA, 22 bp, Homo sapiens
cctaggcctgagttagctgttt

SEQ ID NO: 610298 - DNA, 13 bp, Homo sapiens
cctagttctttgc

SEQ ID NO: 610299 - DNA, 20 bp, Homo sapiens
cctataccctaggtctccac

SEQ ID NO: 610300 - DNA, 23 bp, Homo sapiens
cctatctggaaaaaaaaaaatat

SEQ ID NO: 610301 - DNA, 15 bp, Homo sapiens
cctatgagagaagag

SEQ ID NO: 610302 - DNA, 19 bp, Homo sapiens
cctcacagcctctccctta

SEQ ID NO: 610303 - DNA, 11 bp, Homo sapiens
cctcacctctg

SEQ ID NO: 610304 - DNA, 18 bp, Homo sapiens
cctcacctctgaggacag

SEQ ID NO: 610305 - DNA, 15 bp, Homo sapiens
cctcactccactccc

SEQ ID NO: 610306 - DNA, 22 bp, Homo sapiens
cctcactccactcccctcatcc

SEQ ID NO: 610307 - DNA, 17 bp, Homo sapiens
cctcactgtgacctgct

SEQ ID NO: 610308 - DNA, 12 bp, Homo sapiens
cctcagccctca

SEQ ID NO: 610309 - DNA, 23 bp, Homo sapiens
cctcatcagtatttggacttttt

SEQ ID NO: 610310 - DNA, 17 bp, Homo sapiens
cctcatgaccctcctgt

SEQ ID NO: 610311 - DNA, 13 bp, Homo sapiens
cctcatggctgtt

SEQ ID NO: 610312 - DNA, 17 bp, Homo sapiens
cctcatggctgttatct

SEQ ID NO: 610313 - DNA, 15 bp, Homo sapiens
cctccaaatgctgtc

SEQ ID NO: 610314 - DNA, 16 bp, Homo sapiens
cctccaaatgctgtcg

SEQ ID NO: 610315 - DNA, 14 bp, Homo sapiens
cctccacacctcca

SEQ ID NO: 610316 - DNA, 14 bp, Homo sapiens
cctccacccgtcct

SEQ ID NO: 610317 - DNA, 16 bp, Homo sapiens
cctccactcctcccaa

SEQ ID NO: 610318 - DNA, 9 bp, Homo sapiens
cctccagac

SEQ ID NO: 610319 - DNA, 13 bp, Homo sapiens
cctccagacccct

SEQ ID NO: 610320 - DNA, 22 bp, Homo sapiens
cctccagacccctaccctttcc

SEQ ID NO: 610321 - DNA, 20 bp, Homo sapiens
cctccaggaggactgttcta

SEQ ID NO: 610322 - DNA, 16 bp, Homo sapiens
cctccagttctgatga

SEQ ID NO: 610323 - DNA, 20 bp, Homo sapiens
cctccatgccccagctctgg

SEQ ID NO: 610324 - DNA, 21 bp, Homo sapiens
cctcccaactctggccttggt

SEQ ID NO: 610325 - DNA, 16 bp, Homo sapiens
cctccccagagccctg

SEQ ID NO: 610326 - DNA, 12 bp, Homo sapiens
cctcccccaggc

SEQ ID NO: 610327 - DNA, 14 bp, Homo sapiens
cctcccccaggctg

SEQ ID NO: 610328 - DNA, 18 bp, Homo sapiens
cctcccccaggctgcgcc

SEQ ID NO: 610329 - DNA, 18 bp, Homo sapiens
cctccccgggggtccccg

SEQ ID NO: 610330 - DNA, 17 bp, Homo sapiens
cctcccctggtcctgca

SEQ ID NO: 610331 - DNA, 18 bp, Homo sapiens
cctcccctggtcctgcac

SEQ ID NO: 610332 - DNA, 19 bp, Homo sapiens
cctcccctggtcctgcact

SEQ ID NO: 610333 - DNA, 14 bp, Homo sapiens
cctccctgctccct

SEQ ID NO: 610334 - DNA, 22 bp, Homo sapiens
cctccctgctgccaggctccca

SEQ ID NO: 610335 - DNA, 21 bp, Homo sapiens
cctccctggggaccaggagct

SEQ ID NO: 610336 - DNA, 12 bp, Homo sapiens
cctccctgtccc

SEQ ID NO: 610337 - DNA, 15 bp, Homo sapiens
cctccctgtcccctg

SEQ ID NO: 610338 - DNA, 16 bp, Homo sapiens
cctccctgtctgtctg

SEQ ID NO: 610339 - DNA, 17 bp, Homo sapiens
cctcccttctttccttc

SEQ ID NO: 610340 - DNA, 21 bp, Homo sapiens
cctcccttctttccttccttt

SEQ ID NO: 610341 - DNA, 12 bp, Homo sapiens
cctccgccagcc

SEQ ID NO: 610342 - DNA, 15 bp, Homo sapiens
cctccgccagccctg

SEQ ID NO: 610343 - DNA, 17 bp, Homo sapiens
cctccgccagccctgtt

SEQ ID NO: 610344 - DNA, 14 bp, Homo sapiens
cctccgcccttccc

SEQ ID NO: 610345 - DNA, 18 bp, Homo sapiens
cctccgcggaggcccctg

SEQ ID NO: 610346 - DNA, 18 bp, Homo sapiens
cctccggccagcgagtgg

SEQ ID NO: 610347 - DNA, 16 bp, Homo sapiens
cctccgggactgacct

SEQ ID NO: 610348 - DNA, 17 bp, Homo sapiens
cctccgggactgacctt

SEQ ID NO: 610349 - DNA, 17 bp, Homo sapiens
cctccgggcagagacca

SEQ ID NO: 610350 - DNA, 19 bp, Homo sapiens
cctccgggcagagaccacc

SEQ ID NO: 610351 - DNA, 13 bp, Homo sapiens
cctccgtccccag

SEQ ID NO: 610352 - DNA, 15 bp, Homo sapiens
cctccgtgggcagct

SEQ ID NO: 610353 - DNA, 13 bp, Homo sapiens
cctcctccagact

SEQ ID NO: 610354 - DNA, 14 bp, Homo sapiens
cctcctccagactc

SEQ ID NO: 610355 - DNA, 18 bp, Homo sapiens
cctcctccatgctgtccc

SEQ ID NO: 610356 - DNA, 23 bp, Homo sapiens
cctcctccgtgggcagctcctcg

SEQ ID NO: 610357 - DNA, 11 bp, Homo sapiens
cctcctcctgc

SEQ ID NO: 610358 - DNA, 12 bp, Homo sapiens
cctcctctgccc

SEQ ID NO: 610359 - DNA, 13 bp, Homo sapiens
cctcctctgcccc

SEQ ID NO: 610360 - DNA, 14 bp, Homo sapiens
cctcctctgccccc

SEQ ID NO: 610361 - DNA, 17 bp, Homo sapiens
cctcctctgccccctcc

SEQ ID NO: 610362 - DNA, 20 bp, Homo sapiens
cctcctctgccccctccccc

SEQ ID NO: 610363 - DNA, 22 bp, Homo sapiens
cctcctgcatgtcggggcccct

SEQ ID NO: 610364 - DNA, 15 bp, Homo sapiens
cctcctgctcctcac

SEQ ID NO: 610365 - DNA, 14 bp, Homo sapiens
cctcctgtccagca

SEQ ID NO: 610366 - DNA, 10 bp, Homo sapiens
cctcctgtct

SEQ ID NO: 610367 - DNA, 17 bp, Homo sapiens
cctcctgtctcctctgt

SEQ ID NO: 610368 - DNA, 17 bp, Homo sapiens
cctccttctcccctcca

SEQ ID NO: 610369 - DNA, 18 bp, Homo sapiens
cctccttctcccctccag

SEQ ID NO: 610370 - DNA, 16 bp, Homo sapiens
cctcgccccagccaag

SEQ ID NO: 610371 - DNA, 23 bp, Homo sapiens
cctcgccccagccaagcctgact

SEQ ID NO: 610372 - DNA, 22 bp, Homo sapiens
cctcgccccccgcccggcctcc

SEQ ID NO: 610373 - DNA, 17 bp, Homo sapiens
cctcgcccccgggccct

SEQ ID NO: 610374 - DNA, 13 bp, Homo sapiens
cctcgcgcccctg

SEQ ID NO: 610375 - DNA, 15 bp, Homo sapiens
cctcgcgcccctgtc

SEQ ID NO: 610376 - DNA, 18 bp, Homo sapiens
cctcgcgcccctgtccat

SEQ ID NO: 610377 - DNA, 20 bp, Homo sapiens
cctcgcgcccctgtccatcc

SEQ ID NO: 610378 - DNA, 22 bp, Homo sapiens
cctcggccattgaacactgcac

SEQ ID NO: 610379 - DNA, 15 bp, Homo sapiens
cctcggctgtgtggg

SEQ ID NO: 610380 - DNA, 17 bp, Homo sapiens
cctcgggccgcctcctc

SEQ ID NO: 610381 - DNA, 20 bp, Homo sapiens
cctcgggccgcctcctccag

SEQ ID NO: 610382 - DNA, 18 bp, Homo sapiens
cctcgggcgcctgcgctc

SEQ ID NO: 610383 - DNA, 20 bp, Homo sapiens
cctcgggcgcctgcgctcct

SEQ ID NO: 610384 - DNA, 23 bp, Homo sapiens
cctcgggcgcctgcgctcctctg

SEQ ID NO: 610385 - DNA, 13 bp, Homo sapiens
ccttcctgtcctg

SEQ ID NO: 610386 - DNA, 17 bp, Homo sapiens
ccttcggcagtggctgg

SEQ ID NO: 610387 - DNA, 12 bp, Homo sapiens
ccttctcccctc

SEQ ID NO: 610388 - DNA, 17 bp, Homo sapiens
ccttctggccgctgcag

SEQ ID NO: 610389 - DNA, 18 bp, Homo sapiens
ccttctggctgctgcagt

SEQ ID NO: 610390 - DNA, 23 bp, Homo sapiens
ccttctggggagggacacagagg

SEQ ID NO: 610391 - DNA, 17 bp, Homo sapiens
ccttctgtgcatctggc

SEQ ID NO: 610392 - DNA, 22 bp, Homo sapiens
ccttctgtgcatctggcctggg

SEQ ID NO: 610393 - DNA, 17 bp, Homo sapiens
ccttgaccccacacgcc

SEQ ID NO: 610394 - DNA, 21 bp, Homo sapiens
ccttgagccgtgacctccagg

SEQ ID NO: 610395 - DNA, 21 bp, Homo sapiens
ccttgattcaaataaccctga

SEQ ID NO: 610396 - DNA, 17 bp, Homo sapiens
ccttgcctgttaggtct

SEQ ID NO: 610397 - DNA, 18 bp, Homo sapiens
ccttgctctacctggccg

SEQ ID NO: 610398 - DNA, 14 bp, Homo sapiens
ccttgctgggccag

SEQ ID NO: 610399 - DNA, 15 bp, Homo sapiens
ccttgctgggccagg

SEQ ID NO: 610400 - DNA, 16 bp, Homo sapiens
ccttgctgggccaggg

SEQ ID NO: 610401 - DNA, 15 bp, Homo sapiens
ccttggagaggagag

SEQ ID NO: 610402 - DNA, 13 bp, Homo sapiens
ccttggcccctct

SEQ ID NO: 610403 - DNA, 17 bp, Homo sapiens
ccttggcccctctctgt

SEQ ID NO: 610404 - DNA, 19 bp, Homo sapiens
ccttggtgtcgggcatgac

SEQ ID NO: 610405 - DNA, 22 bp, Homo sapiens
ccttggtgtcgggcatgacacg

SEQ ID NO: 610406 - DNA, 18 bp, Homo sapiens
ccttggttcctccagcaa

SEQ ID NO: 610407 - DNA, 16 bp, Homo sapiens
ccttgtactttacaat

SEQ ID NO: 610408 - DNA, 21 bp, Homo sapiens
ccttgtagacgcacctgctga

SEQ ID NO: 610409 - DNA, 16 bp, Homo sapiens
cctttatttctgtatc

SEQ ID NO: 610410 - DNA, 18 bp, Homo sapiens
cctttatttctgtatctg

SEQ ID NO: 610411 - DNA, 17 bp, Homo sapiens
cctttcaataggaaaaa

SEQ ID NO: 610412 - DNA, 22 bp, Homo sapiens
cctttcccacccactagccctc

SEQ ID NO: 610413 - DNA, 21 bp, Homo sapiens
cctttccccattcagtgacat

SEQ ID NO: 610414 - DNA, 18 bp, Homo sapiens
cctttctccagcccatgc

SEQ ID NO: 610415 - DNA, 16 bp, Homo sapiens
cctttctctctttctt

SEQ ID NO: 610416 - DNA, 23 bp, Homo sapiens
cctttctctctttcttttgtgca

SEQ ID NO: 610417 - DNA, 17 bp, Homo sapiens
cctttctcttaccacta

SEQ ID NO: 610418 - DNA, 15 bp, Homo sapiens
cctttcttccttcct

SEQ ID NO: 610419 - DNA, 17 bp, Homo sapiens
cctttcttccttccttt

SEQ ID NO: 610420 - DNA, 22 bp, Homo sapiens
cctttgagggcagtggggagca

SEQ ID NO: 610421 - DNA, 18 bp, Homo sapiens
cctttgcaggcccagcag

SEQ ID NO: 610422 - DNA, 20 bp, Homo sapiens
cctttgcaggcccagcagac

SEQ ID NO: 610423 - DNA, 16 bp, Homo sapiens
cctttgcgctctgggt

SEQ ID NO: 610424 - DNA, 14 bp, Homo sapiens
cctttttctacctt

SEQ ID NO: 610425 - DNA, 16 bp, Homo sapiens
cctttttttctctcct

SEQ ID NO: 610426 - DNA, 20 bp, Homo sapiens
cgaaaacgtggctgcttcaa

SEQ ID NO: 610427 - DNA, 14 bp, Homo sapiens
cgaagccagtccag

SEQ ID NO: 610428 - DNA, 16 bp, Homo sapiens
cgaagccccttggaga

SEQ ID NO: 610429 - DNA, 20 bp, Homo sapiens
cgaagccccttggagagaga

SEQ ID NO: 610430 - DNA, 13 bp, Homo sapiens
cgaagggcagccc

SEQ ID NO: 610431 - DNA, 11 bp, Homo sapiens
cgaatattgct

SEQ ID NO: 610432 - DNA, 12 bp, Homo sapiens
cgaatattgctg

SEQ ID NO: 610433 - DNA, 17 bp, Homo sapiens
cgaatattgctgatggt

SEQ ID NO: 610434 - DNA, 13 bp, Homo sapiens
cgacaatgcaaac

SEQ ID NO: 610435 - DNA, 19 bp, Homo sapiens
cgacaggcatgcaccagtg

SEQ ID NO: 610436 - DNA, 11 bp, Homo sapiens
cgaccacccct

SEQ ID NO: 610437 - DNA, 15 bp, Homo sapiens
cgaccacccctgtgc

SEQ ID NO: 610438 - DNA, 14 bp, Homo sapiens
cgactgggctgctg

SEQ ID NO: 610439 - DNA, 18 bp, Homo sapiens
cgactgggctgctggggc

SEQ ID NO: 610440 - DNA, 19 bp, Homo sapiens
cgactgggctgctggggca

SEQ ID NO: 610441 - DNA, 15 bp, Homo sapiens
cgactgggtttatgt

SEQ ID NO: 610442 - DNA, 23 bp, Homo sapiens
cgacttgggacggaagtggcctg

SEQ ID NO: 610443 - DNA, 15 bp, Homo sapiens
cgagagggctgagcc

SEQ ID NO: 610444 - DNA, 16 bp, Homo sapiens
cgagagggctgagccc

SEQ ID NO: 610445 - DNA, 17 bp, Homo sapiens
cgagagggctgagcccc

SEQ ID NO: 610446 - DNA, 19 bp, Homo sapiens
cgagagggctgagcccctc

SEQ ID NO: 610447 - DNA, 22 bp, Homo sapiens
cgagagggctgagcccctcctc

SEQ ID NO: 610448 - DNA, 18 bp, Homo sapiens
cgagaggtatgcctgtac

SEQ ID NO: 610449 - DNA, 18 bp, Homo sapiens
cgagcagagcgcagcccc

SEQ ID NO: 610450 - DNA, 19 bp, Homo sapiens
cgagcagagcgcagccccc

SEQ ID NO: 610451 - DNA, 12 bp, Homo sapiens
cgagcccctgtt

SEQ ID NO: 610452 - DNA, 21 bp, Homo sapiens
cgagcccctgtttctcctcca

SEQ ID NO: 610453 - DNA, 19 bp, Homo sapiens
cgaggaggccgactgggct

SEQ ID NO: 610454 - DNA, 23 bp, Homo sapiens
cgaggaggccgactgggctgctg

SEQ ID NO: 610455 - DNA, 20 bp, Homo sapiens
cgaggcagaatggtgggctc

SEQ ID NO: 610456 - DNA, 13 bp, Homo sapiens
cgaggccagggcc

SEQ ID NO: 610457 - DNA, 13 bp, Homo sapiens
cgaggcttctcta

SEQ ID NO: 610458 - DNA, 13 bp, Homo sapiens
cgagggcggcggg

SEQ ID NO: 610459 - DNA, 14 bp, Homo sapiens
cgatataagccata

SEQ ID NO: 610460 - DNA, 15 bp, Homo sapiens
cgatataagccatag

SEQ ID NO: 610461 - DNA, 22 bp, Homo sapiens
cgatataagccatagccccagg

SEQ ID NO: 610462 - DNA, 14 bp, Homo sapiens
cgatgcgtggctcc

SEQ ID NO: 610463 - DNA, 13 bp, Homo sapiens
cgatgtgttcttt

SEQ ID NO: 610464 - DNA, 18 bp, Homo sapiens
cgcaagaggtttcagcat

SEQ ID NO: 610465 - DNA, 14 bp, Homo sapiens
cgcaattgtatata

SEQ ID NO: 610466 - DNA, 17 bp, Homo sapiens
cgcaattgtatatatat

SEQ ID NO: 610467 - DNA, 20 bp, Homo sapiens
cgcaattgtatatatatgtg

SEQ ID NO: 610468 - DNA, 14 bp, Homo sapiens
cgcacgcggccgct

SEQ ID NO: 610469 - DNA, 21 bp, Homo sapiens
cgcactcaggagcacagccat

SEQ ID NO: 610470 - DNA, 19 bp, Homo sapiens
cgcagagccccggagcacc

SEQ ID NO: 610471 - DNA, 20 bp, Homo sapiens
cgcagagccccggagcacca

SEQ ID NO: 610472 - DNA, 20 bp, Homo sapiens
cgcagccgcgctctgcccct

SEQ ID NO: 610473 - DNA, 15 bp, Homo sapiens
cgcagcctgaagcct

SEQ ID NO: 610474 - DNA, 19 bp, Homo sapiens
cgcagcctgaagcctggat

SEQ ID NO: 610475 - DNA, 20 bp, Homo sapiens
cgcagggcgctccggcagag

SEQ ID NO: 610476 - DNA, 22 bp, Homo sapiens
cgcagggcgctccggcagaggc

SEQ ID NO: 610477 - DNA, 15 bp, Homo sapiens
cgcatctgcctggag

SEQ ID NO: 610478 - DNA, 17 bp, Homo sapiens
cgcatctgcctggagcc

SEQ ID NO: 610479 - DNA, 20 bp, Homo sapiens
cgcatctgcctggagcctgg

SEQ ID NO: 610480 - DNA, 21 bp, Homo sapiens
cgcatgcagggcccccacagg

SEQ ID NO: 610481 - DNA, 22 bp, Homo sapiens
cgcatgcagggcccccacagga

SEQ ID NO: 610482 - DNA, 23 bp, Homo sapiens
cgcatgcagggcccccactggag

SEQ ID NO: 610483 - DNA, 14 bp, Homo sapiens
cgcattaagcacac

SEQ ID NO: 610484 - DNA, 18 bp, Homo sapiens
cgcattaagcacacacat

SEQ ID NO: 610485 - DNA, 15 bp, Homo sapiens
cgccaggggcaggca

SEQ ID NO: 610486 - DNA, 16 bp, Homo sapiens
cgccaggggcaggcag

SEQ ID NO: 610487 - DNA, 21 bp, Homo sapiens
cgccaggggcaggcagctagg

SEQ ID NO: 610488 - DNA, 14 bp, Homo sapiens
cgcccacccacacc

SEQ ID NO: 610489 - DNA, 22 bp, Homo sapiens
cgcccacccacaccccgtctgc

SEQ ID NO: 610490 - DNA, 14 bp, Homo sapiens
cgcccacccagcag

SEQ ID NO: 610491 - DNA, 12 bp, Homo sapiens
cgcccacctgcc

SEQ ID NO: 610492 - DNA, 15 bp, Homo sapiens
cgcccacctgcccag

SEQ ID NO: 610493 - DNA, 18 bp, Homo sapiens
cgcccacctgcccagtta

SEQ ID NO: 610494 - DNA, 11 bp, Homo sapiens
cgcccagcccc

SEQ ID NO: 610495 - DNA, 12 bp, Homo sapiens
cgcccagccccc

SEQ ID NO: 610496 - DNA, 21 bp, Homo sapiens
cgcccaggatgaaggggccag

SEQ ID NO: 610497 - DNA, 16 bp, Homo sapiens
cgccccagagactgcc

SEQ ID NO: 610498 - DNA, 21 bp, Homo sapiens
cgccccagagactgcccaccc

SEQ ID NO: 610499 - DNA, 23 bp, Homo sapiens
cgccccagagactgcccaccctg

SEQ ID NO: 610500 - DNA, 20 bp, Homo sapiens
cgccccagccaagcctgact

SEQ ID NO: 610501 - DNA, 23 bp, Homo sapiens
ctcaacacacagtatagataaat

SEQ ID NO: 610502 - DNA, 12 bp, Homo sapiens
ctcaagccagga

SEQ ID NO: 610503 - DNA, 14 bp, Homo sapiens
ctcaagccaggaga

SEQ ID NO: 610504 - DNA, 16 bp, Homo sapiens
ctcaagccaggagacc

SEQ ID NO: 610505 - DNA, 18 bp, Homo sapiens
ctcaagccaggagaccct

SEQ ID NO: 610506 - DNA, 19 bp, Homo sapiens
ctcaagccaggagaccctg

SEQ ID NO: 610507 - DNA, 23 bp, Homo sapiens
ctcaagccaggagaccctgtctt

SEQ ID NO: 610508 - DNA, 14 bp, Homo sapiens
ctcaaggcctccag

SEQ ID NO: 610509 - DNA, 21 bp, Homo sapiens
ctcaaggctgcagtgagccaa

SEQ ID NO: 610510 - DNA, 15 bp, Homo sapiens
ctcaagttgtgtgct

SEQ ID NO: 610511 - DNA, 12 bp, Homo sapiens
ctcaatgtgctg

SEQ ID NO: 610512 - DNA, 15 bp, Homo sapiens
ctcaatgtgctgttg

SEQ ID NO: 610513 - DNA, 20 bp, Homo sapiens
ctcaatgtgctgttgattct

SEQ ID NO: 610514 - DNA, 22 bp, Homo sapiens
ctcaatgtgctgttgattcttt

SEQ ID NO: 610515 - DNA, 20 bp, Homo sapiens
ctcaattccagggaaccaga

SEQ ID NO: 610516 - DNA, 22 bp, Homo sapiens
ctcaattccagggaaccagagc

SEQ ID NO: 610517 - DNA, 16 bp, Homo sapiens
ctcacaccggcactgt

SEQ ID NO: 610518 - DNA, 14 bp, Homo sapiens
ctcacacttgggct

SEQ ID NO: 610519 - DNA, 19 bp, Homo sapiens
ctcacacttgggctggcac

SEQ ID NO: 610520 - DNA, 23 bp, Homo sapiens
ctcacacttgggctggcacccac

SEQ ID NO: 610521 - DNA, 20 bp, Homo sapiens
ctcacagcctctcccttaat

SEQ ID NO: 610522 - DNA, 14 bp, Homo sapiens
ctcacccagcctgg

SEQ ID NO: 610523 - DNA, 17 bp, Homo sapiens
ctcacctctgaggacag

SEQ ID NO: 610524 - DNA, 20 bp, Homo sapiens
ctcactacatgggccagccc

SEQ ID NO: 610525 - DNA, 13 bp, Homo sapiens
ctcactccactcc

SEQ ID NO: 610526 - DNA, 15 bp, Homo sapiens
ctcactccactcccc

SEQ ID NO: 610527 - DNA, 18 bp, Homo sapiens
ctcactccactcccctca

SEQ ID NO: 610528 - DNA, 15 bp, Homo sapiens
ctcactgacttctcc

SEQ ID NO: 610529 - DNA, 22 bp, Homo sapiens
ctcactgatatattttccaggg

SEQ ID NO: 610530 - DNA, 18 bp, Homo sapiens
ctcactgtgacctgctcc

SEQ ID NO: 610531 - DNA, 21 bp, Homo sapiens
ctcactgtgacctgctcctgc

SEQ ID NO: 610532 - DNA, 19 bp, Homo sapiens
ctcacttgtggcagcttcc

SEQ ID NO: 610533 - DNA, 21 bp, Homo sapiens
ctcacttgtggcagcttccct

SEQ ID NO: 610534 - DNA, 15 bp, Homo sapiens
ctcagaggagaggag

SEQ ID NO: 610535 - DNA, 15 bp, Homo sapiens
ctcagatggggcctg

SEQ ID NO: 610536 - DNA, 19 bp, Homo sapiens
ctcagatggggcctgggct

SEQ ID NO: 610537 - DNA, 13 bp, Homo sapiens
ctcagcagccccc

SEQ ID NO: 610538 - DNA, 13 bp, Homo sapiens
ctcagcatatata

SEQ ID NO: 610539 - DNA, 21 bp, Homo sapiens
ctcagcatatatataaaatac

SEQ ID NO: 610540 - DNA, 17 bp, Homo sapiens
ctcagccagtggcacag

SEQ ID NO: 610541 - DNA, 15 bp, Homo sapiens
ctcagcccatcccct

SEQ ID NO: 610542 - DNA, 16 bp, Homo sapiens
ctcagcccctcagaga

SEQ ID NO: 610543 - DNA, 22 bp, Homo sapiens
ctcagcgtctccccatgctggg

SEQ ID NO: 610544 - DNA, 12 bp, Homo sapiens
ctcagctccact

SEQ ID NO: 610545 - DNA, 15 bp, Homo sapiens
ctcagctccactctg

SEQ ID NO: 610546 - DNA, 13 bp, Homo sapiens
ctcaggagaaggc

SEQ ID NO: 610547 - DNA, 17 bp, Homo sapiens
ctcaggagaaggcctgc

SEQ ID NO: 610548 - DNA, 16 bp, Homo sapiens
ctcaggagcacagcca

SEQ ID NO: 610549 - DNA, 14 bp, Homo sapiens
ctcaggcagtgcag

SEQ ID NO: 610550 - DNA, 23 bp, Homo sapiens
ctcaggtaaatgaggtctttgca

SEQ ID NO: 610551 - DNA, 13 bp, Homo sapiens
ctcaggtggcatt

SEQ ID NO: 610552 - DNA, 21 bp, Homo sapiens
ctcagtatgctttccctgagg

SEQ ID NO: 610553 - DNA, 22 bp, Homo sapiens
ctcagtatgctttccctgagga

SEQ ID NO: 610554 - DNA, 23 bp, Homo sapiens
ctcagtattgagacactgtcaag

SEQ ID NO: 610555 - DNA, 13 bp, Homo sapiens
ctcagtcaaatgt

SEQ ID NO: 610556 - DNA, 13 bp, Homo sapiens
ctcagtcagtatt

SEQ ID NO: 610557 - DNA, 20 bp, Homo sapiens
ctcagttggcctctgcccct

SEQ ID NO: 610558 - DNA, 17 bp, Homo sapiens
ctcataagtaaatgtct

SEQ ID NO: 610559 - DNA, 18 bp, Homo sapiens
ctcatacagtctctattt

SEQ ID NO: 610560 - DNA, 20 bp, Homo sapiens
ctcatagcacatgttttaca

SEQ ID NO: 610561 - DNA, 21 bp, Homo sapiens
ctcatagcacatgttttacaa

SEQ ID NO: 610562 - DNA, 16 bp, Homo sapiens
ctcatctgtaaaacca

SEQ ID NO: 610563 - DNA, 21 bp, Homo sapiens
ctcatctgtaaaaccaggctg

SEQ ID NO: 610564 - DNA, 14 bp, Homo sapiens
ctcatcttgtaaat

SEQ ID NO: 610565 - DNA, 18 bp, Homo sapiens
ctcatgaccctcctgtcc

SEQ ID NO: 610566 - DNA, 21 bp, Homo sapiens
ctcatgaccctcctgtccagc

SEQ ID NO: 610567 - DNA, 18 bp, Homo sapiens
ctcatggctgttatctgt

SEQ ID NO: 610568 - DNA, 22 bp, Homo sapiens
ctcatggctgttatctgtcttt

SEQ ID NO: 610569 - DNA, 17 bp, Homo sapiens
ctcatgttttatatgat

SEQ ID NO: 610570 - DNA, 20 bp, Homo sapiens
ctcatttggatataaatctt

SEQ ID NO: 610571 - DNA, 16 bp, Homo sapiens
ctccaaagttatccag

SEQ ID NO: 610572 - DNA, 13 bp, Homo sapiens
ctccacaggagcc

SEQ ID NO: 610573 - DNA, 23 bp, Homo sapiens
ctccacagggacacagtctggtg

SEQ ID NO: 610574 - DNA, 14 bp, Homo sapiens
ctccacccctcaag

SEQ ID NO: 610575 - DNA, 15 bp, Homo sapiens
ctccacccctcaagc

SEQ ID NO: 610576 - DNA, 18 bp, Homo sapiens
ctccacccctcaagccag

SEQ ID NO: 610577 - DNA, 21 bp, Homo sapiens
ctccacccctcaagccaggag

SEQ ID NO: 610578 - DNA, 20 bp, Homo sapiens
ctccacccgtcctggggtgg

SEQ ID NO: 610579 - DNA, 22 bp, Homo sapiens
ctccacgtgtttcgggccaggg

SEQ ID NO: 610580 - DNA, 9 bp, Homo sapiens
ctccactcc

SEQ ID NO: 610581 - DNA, 16 bp, Homo sapiens
ctccactcccctcatc

SEQ ID NO: 610582 - DNA, 17 bp, Homo sapiens
ctccagaagcagcagct

SEQ ID NO: 610583 - DNA, 9 bp, Homo sapiens
ctccagacc

SEQ ID NO: 610584 - DNA, 12 bp, Homo sapiens
ctccagacccct

SEQ ID NO: 610585 - DNA, 19 bp, Homo sapiens
ctccagactcgagagggct

SEQ ID NO: 610586 - DNA, 20 bp, Homo sapiens
ctccagagtaggtgggtctt

SEQ ID NO: 610587 - DNA, 16 bp, Homo sapiens
ctccagattattttct

SEQ ID NO: 610588 - DNA, 21 bp, Homo sapiens
ctccagattattttctatatt

SEQ ID NO: 610589 - DNA, 13 bp, Homo sapiens
ctccagcaggagg

SEQ ID NO: 610590 - DNA, 22 bp, Homo sapiens
ctccagcccatgctggctgggg

SEQ ID NO: 610591 - DNA, 23 bp, Homo sapiens
ctccagcccatgctggctggggc

SEQ ID NO: 610592 - DNA, 20 bp, Homo sapiens
ctccagtggggcaagatttt

SEQ ID NO: 610593 - DNA, 23 bp, Homo sapiens
ctccatgccccagctctggatga

SEQ ID NO: 610594 - DNA, 14 bp, Homo sapiens
ctccatgctgtccc

SEQ ID NO: 610595 - DNA, 18 bp, Homo sapiens
ctccatggtgaactgaag

SEQ ID NO: 610596 - DNA, 23 bp, Homo sapiens
ctccatggtgaactgaagcagag

SEQ ID NO: 610597 - DNA, 16 bp, Homo sapiens
ctccattcatgtttaa

SEQ ID NO: 610598 - DNA, 11 bp, Homo sapiens
ctccattcctg

SEQ ID NO: 610599 - DNA, 16 bp, Homo sapiens
ctcccaactctggcct

SEQ ID NO: 610600 - DNA, 14 bp, Homo sapiens
ctcccagcagaggc

SEQ ID NO: 610601 - DNA, 15 bp, Homo sapiens
ctcccagcagaggcc

SEQ ID NO: 610602 - DNA, 22 bp, Homo sapiens
ctcccagcctcttgctcagagc

SEQ ID NO: 610603 - DNA, 12 bp, Homo sapiens
ctcccagggccc

SEQ ID NO: 610604 - DNA, 13 bp, Homo sapiens
ctcccagggcccg

SEQ ID NO: 610605 - DNA, 15 bp, Homo sapiens
ctcccagggcccgag

SEQ ID NO: 610606 - DNA, 19 bp, Homo sapiens
ctcccagggcccgagcgcg

SEQ ID NO: 610607 - DNA, 23 bp, Homo sapiens
ctcccagggcccgagcgcgtgcc

SEQ ID NO: 610608 - DNA, 16 bp, Homo sapiens
ctcccagggtcctggg

SEQ ID NO: 610609 - DNA, 14 bp, Homo sapiens
ctcccagtcatgtt

SEQ ID NO: 610610 - DNA, 14 bp, Homo sapiens
ctcccatggccttc

SEQ ID NO: 610611 - DNA, 17 bp, Homo sapiens
ctcccatggccttccct

SEQ ID NO: 610612 - DNA, 14 bp, Homo sapiens
ctccccaaggaaga

SEQ ID NO: 610613 - DNA, 17 bp, Homo sapiens
ctccccagagccctgca

SEQ ID NO: 610614 - DNA, 21 bp, Homo sapiens
ctccccatggtgcagtgaaga

SEQ ID NO: 610615 - DNA, 21 bp, Homo sapiens
ctcccccacggccgtccctga

SEQ ID NO: 610616 - DNA, 12 bp, Homo sapiens
ctcccccagagc

SEQ ID NO: 610617 - DNA, 21 bp, Homo sapiens
ctgagcttgattctaaagggg

SEQ ID NO: 610618 - DNA, 23 bp, Homo sapiens
ctgagcttgattctaaaggggac

SEQ ID NO: 610619 - DNA, 21 bp, Homo sapiens
ctgaggaggaggacacagcac

SEQ ID NO: 610620 - DNA, 23 bp, Homo sapiens
ctgaggaggaggacacagcacaa

SEQ ID NO: 610621 - DNA, 12 bp, Homo sapiens
ctgaggagtcca

SEQ ID NO: 610622 - DNA, 19 bp, Homo sapiens
ctgagggcagggttctaga

SEQ ID NO: 610623 - DNA, 21 bp, Homo sapiens
ctgagggcagggttctagaag

SEQ ID NO: 610624 - DNA, 12 bp, Homo sapiens
ctgagggccctt

SEQ ID NO: 610625 - DNA, 16 bp, Homo sapiens
ctgaggttaaggggat

SEQ ID NO: 610626 - DNA, 18 bp, Homo sapiens
ctgagtaaacagatattt

SEQ ID NO: 610627 - DNA, 20 bp, Homo sapiens
ctgagtcctcattgttcaga

SEQ ID NO: 610628 - DNA, 22 bp, Homo sapiens
ctgagtcctcattgttcagaaa

SEQ ID NO: 610629 - DNA, 14 bp, Homo sapiens
ctgagtcggctggg

SEQ ID NO: 610630 - DNA, 15 bp, Homo sapiens
ctgagtcggctgggc

SEQ ID NO: 610631 - DNA, 17 bp, Homo sapiens
ctgagtcggctgggcag

SEQ ID NO: 610632 - DNA, 22 bp, Homo sapiens
ctgagtcggctgggcagggccg

SEQ ID NO: 610633 - DNA, 23 bp, Homo sapiens
ctgagtcggctgggcagggccgc

SEQ ID NO: 610634 - DNA, 13 bp, Homo sapiens
ctgagtgaaatat

SEQ ID NO: 610635 - DNA, 16 bp, Homo sapiens
ctgagtgacatgggtg

SEQ ID NO: 610636 - DNA, 21 bp, Homo sapiens
ctgagtggctcgtgtttcaca

SEQ ID NO: 610637 - DNA, 13 bp, Homo sapiens
ctgagtgggctgg

SEQ ID NO: 610638 - DNA, 23 bp, Homo sapiens
ctgagttagctgtttactgacat

SEQ ID NO: 610639 - DNA, 23 bp, Homo sapiens
ctgagttgtactggttagattca

SEQ ID NO: 610640 - DNA, 21 bp, Homo sapiens
ctgatacatctgtcagtgagt

SEQ ID NO: 610641 - DNA, 21 bp, Homo sapiens
ctgatacttatttataacatt

SEQ ID NO: 610642 - DNA, 21 bp, Homo sapiens
ctgatatcacgggcccgctca

SEQ ID NO: 610643 - DNA, 19 bp, Homo sapiens
ctgatatctgtttgcttct

SEQ ID NO: 610644 - DNA, 16 bp, Homo sapiens
ctgatgagacaacaca

SEQ ID NO: 610645 - DNA, 19 bp, Homo sapiens
ctgatgagacaacacacac

SEQ ID NO: 610646 - DNA, 21 bp, Homo sapiens
ctgatgatgttctgaaatgga

SEQ ID NO: 610647 - DNA, 14 bp, Homo sapiens
ctgatgggtcctgc

SEQ ID NO: 610648 - DNA, 15 bp, Homo sapiens
ctgatgggtcctgct

SEQ ID NO: 610649 - DNA, 18 bp, Homo sapiens
ctgatgggtcctgctgct

SEQ ID NO: 610650 - DNA, 14 bp, Homo sapiens
ctgatggtgcaatg

SEQ ID NO: 610651 - DNA, 17 bp, Homo sapiens
ctgatggtgcaatgacc

SEQ ID NO: 610652 - DNA, 20 bp, Homo sapiens
ctgatggtgcaatgaccttt

SEQ ID NO: 610653 - DNA, 16 bp, Homo sapiens
ctgatttttttttcct

SEQ ID NO: 610654 - DNA, 18 bp, Homo sapiens
ctgatttttttttccttc

SEQ ID NO: 610655 - DNA, 22 bp, Homo sapiens
ctgatttttttttccttcagtg

SEQ ID NO: 610656 - DNA, 13 bp, Homo sapiens
ctgcaacactgga

SEQ ID NO: 610657 - DNA, 17 bp, Homo sapiens
ctgcaataacagtttta

SEQ ID NO: 610658 - DNA, 21 bp, Homo sapiens
ctgcaataacagttttaagat

SEQ ID NO: 610659 - DNA, 14 bp, Homo sapiens
ctgcacacataaca

SEQ ID NO: 610660 - DNA, 18 bp, Homo sapiens
ctgcacacataacacaca

SEQ ID NO: 610661 - DNA, 19 bp, Homo sapiens
ctgcacacataacacacat

SEQ ID NO: 610662 - DNA, 15 bp, Homo sapiens
ctgcacatacagatg

SEQ ID NO: 610663 - DNA, 19 bp, Homo sapiens
ctgcacatacagatggtgt

SEQ ID NO: 610664 - DNA, 14 bp, Homo sapiens
ctgcaccctctgct

SEQ ID NO: 610665 - DNA, 14 bp, Homo sapiens
ctgcacctgcttct

SEQ ID NO: 610666 - DNA, 22 bp, Homo sapiens
ctgcacgcggactccggggttc

SEQ ID NO: 610667 - DNA, 14 bp, Homo sapiens
ctgcactgagcaga

SEQ ID NO: 610668 - DNA, 13 bp, Homo sapiens
ctgcagcccagaa

SEQ ID NO: 610669 - DNA, 22 bp, Homo sapiens
ctgcagcccagaacgggcctcc

SEQ ID NO: 610670 - DNA, 19 bp, Homo sapiens
ctgcagccctctccaccct

SEQ ID NO: 610671 - DNA, 16 bp, Homo sapiens
ctgcagcctgagctcc

SEQ ID NO: 610672 - DNA, 17 bp, Homo sapiens
ctgcagctaatttgtga

SEQ ID NO: 610673 - DNA, 15 bp, Homo sapiens
ctgcaggcaggcaga

SEQ ID NO: 610674 - DNA, 16 bp, Homo sapiens
ctgcagtattctgtag

SEQ ID NO: 610675 - DNA, 21 bp, Homo sapiens
ctgcagtattctgtagccaac

SEQ ID NO: 610676 - DNA, 23 bp, Homo sapiens
ctgcagtcacgtgaggcccctgt

SEQ ID NO: 610677 - DNA, 18 bp, Homo sapiens
ctgcagtcagcacagaga

SEQ ID NO: 610678 - DNA, 16 bp, Homo sapiens
ctgcagttagcacaga

SEQ ID NO: 610679 - DNA, 18 bp, Homo sapiens
ctgcagtttggccctgga

SEQ ID NO: 610680 - DNA, 19 bp, Homo sapiens
ctgcagtttggccctggag

SEQ ID NO: 610681 - DNA, 20 bp, Homo sapiens
ctgcagtttggccctggagc

SEQ ID NO: 610682 - DNA, 14 bp, Homo sapiens
ctgcataaccgcac

SEQ ID NO: 610683 - DNA, 15 bp, Homo sapiens
ctgcatcccttggcc

SEQ ID NO: 610684 - DNA, 23 bp, Homo sapiens
ctgcatcccttggcccctctctg

SEQ ID NO: 610685 - DNA, 19 bp, Homo sapiens
ctgcatgtcggggcccctg

SEQ ID NO: 610686 - DNA, 15 bp, Homo sapiens
ctgccaagagtccaa

SEQ ID NO: 610687 - DNA, 17 bp, Homo sapiens
ctgccacacatgctcat

SEQ ID NO: 610688 - DNA, 21 bp, Homo sapiens
ctgccactcaggcagcctgtg

SEQ ID NO: 610689 - DNA, 22 bp, Homo sapiens
ctgccactcaggcagcctgtgg

SEQ ID NO: 610690 - DNA, 21 bp, Homo sapiens
ctgccactgacaggaaagtgg

SEQ ID NO: 610691 - DNA, 16 bp, Homo sapiens
ctgccaggccctccag

SEQ ID NO: 610692 - DNA, 20 bp, Homo sapiens
ctgccaggccctccagcagg

SEQ ID NO: 610693 - DNA, 21 bp, Homo sapiens
ctgccaggctcccactgcccc

SEQ ID NO: 610694 - DNA, 22 bp, Homo sapiens
ctgccagtgtttagaagagcct

SEQ ID NO: 610695 - DNA, 19 bp, Homo sapiens
ctgcccacatttgggctca

SEQ ID NO: 610696 - DNA, 21 bp, Homo sapiens
ctgcccacatttgggctcagg

SEQ ID NO: 610697 - DNA, 22 bp, Homo sapiens
ctgcccacatttgggctcaggg

SEQ ID NO: 610698 - DNA, 14 bp, Homo sapiens
ctgcccaccctggg

SEQ ID NO: 610699 - DNA, 20 bp, Homo sapiens
ctgcccaccctgggcctccc

SEQ ID NO: 610700 - DNA, 21 bp, Homo sapiens
ctgcccagttagcccggccaa

SEQ ID NO: 610701 - DNA, 15 bp, Homo sapiens
ctgccccacaacaca

SEQ ID NO: 610702 - DNA, 13 bp, Homo sapiens
ctgccccccttcc

SEQ ID NO: 610703 - DNA, 15 bp, Homo sapiens
ctgccccctcccccg

SEQ ID NO: 610704 - DNA, 17 bp, Homo sapiens
ctgccccctcccccgca

SEQ ID NO: 610705 - DNA, 22 bp, Homo sapiens
ctgccccctcccccgcagacag

SEQ ID NO: 610706 - DNA, 23 bp, Homo sapiens
ctgccccctcccccgcagacaga

SEQ ID NO: 610707 - DNA, 12 bp, Homo sapiens
ctgccccctggc

SEQ ID NO: 610708 - DNA, 20 bp, Homo sapiens
ctgcccctccgtccccaggg

SEQ ID NO: 610709 - DNA, 21 bp, Homo sapiens
ctgcccctccgtccccagggt

SEQ ID NO: 610710 - DNA, 15 bp, Homo sapiens
ctgcccctcttccct

SEQ ID NO: 610711 - DNA, 17 bp, Homo sapiens
ctgcccctcttccctgg

SEQ ID NO: 610712 - DNA, 13 bp, Homo sapiens
ctgcccctgcacc

SEQ ID NO: 610713 - DNA, 22 bp, Homo sapiens
ctgccccttgaccccacacgcc

SEQ ID NO: 610714 - DNA, 18 bp, Homo sapiens
ctgcccgagggcaggggc

SEQ ID NO: 610715 - DNA, 22 bp, Homo sapiens
ctgcccgagggcaggggccgtg

SEQ ID NO: 610716 - DNA, 13 bp, Homo sapiens
ctgcccgcccgcc

SEQ ID NO: 610717 - DNA, 16 bp, Homo sapiens
ctgccctcactccact

SEQ ID NO: 610718 - DNA, 20 bp, Homo sapiens
ctgccctcactccactcccc

SEQ ID NO: 610719 - DNA, 12 bp, Homo sapiens
ctgccctccccc

SEQ ID NO: 610720 - DNA, 14 bp, Homo sapiens
ctgccctcccccac

SEQ ID NO: 610721 - DNA, 16 bp, Homo sapiens
ctgccctcccccacgg

SEQ ID NO: 610722 - DNA, 18 bp, Homo sapiens
ctgccctctgccactgac

SEQ ID NO: 610723 - DNA, 15 bp, Homo sapiens
ctgccctgcaccttg

SEQ ID NO: 610724 - DNA, 14 bp, Homo sapiens
ctgccctgcctgag

SEQ ID NO: 610725 - DNA, 15 bp, Homo sapiens
ctgccctgcctgagg

SEQ ID NO: 610726 - DNA, 12 bp, Homo sapiens
ctgccgcatctg

SEQ ID NO: 610727 - DNA, 15 bp, Homo sapiens
ctgccgcatctgcct

SEQ ID NO: 610728 - DNA, 18 bp, Homo sapiens
ctgccgcatctgcctgga

SEQ ID NO: 610729 - DNA, 16 bp, Homo sapiens
ctgccggtggggccag

SEQ ID NO: 610730 - DNA, 13 bp, Homo sapiens
ctgcctcactgtg

SEQ ID NO: 610731 - DNA, 13 bp, Homo sapiens
ctgcctcagccag

SEQ ID NO: 610732 - DNA, 21 bp, Homo sapiens
ctgcctcagccagtggcacag

SEQ ID NO: 610733 - DNA, 12 bp, Homo sapiens
ctgtgggctcac

SEQ ID NO: 610734 - DNA, 14 bp, Homo sapiens
ctgtgggctcacac

SEQ ID NO: 610735 - DNA, 17 bp, Homo sapiens
ctgtggtgaggtcctgt

SEQ ID NO: 610736 - DNA, 17 bp, Homo sapiens
ctgtggtttgttatcag

SEQ ID NO: 610737 - DNA, 16 bp, Homo sapiens
ctgtgtagctctgtcc

SEQ ID NO: 610738 - DNA, 17 bp, Homo sapiens
ctgtgtagctctgtcca

SEQ ID NO: 610739 - DNA, 18 bp, Homo sapiens
ctgtgtagctctgtccac

SEQ ID NO: 610740 - DNA, 12 bp, Homo sapiens
ctgtgtcatctg

SEQ ID NO: 610741 - DNA, 13 bp, Homo sapiens
ctgtgtggcaaac

SEQ ID NO: 610742 - DNA, 17 bp, Homo sapiens
ctgtgtggcaaacattt

SEQ ID NO: 610743 - DNA, 16 bp, Homo sapiens
ctgtgtggggagggtg

SEQ ID NO: 610744 - DNA, 15 bp, Homo sapiens
ctgtgttaagaggac

SEQ ID NO: 610745 - DNA, 14 bp, Homo sapiens
ctgtgttcagtgcc

SEQ ID NO: 610746 - DNA, 21 bp, Homo sapiens
ctgtgttcagtgccttggagc

SEQ ID NO: 610747 - DNA, 13 bp, Homo sapiens
ctgtgttctcaac

SEQ ID NO: 610748 - DNA, 21 bp, Homo sapiens
ctgtgtttcgcattaagcaca

SEQ ID NO: 610749 - DNA, 17 bp, Homo sapiens
ctgttaacccagtgttc

SEQ ID NO: 610750 - DNA, 15 bp, Homo sapiens
ctgttatctgtcttt

SEQ ID NO: 610751 - DNA, 20 bp, Homo sapiens
ctgttcacgtgactcctcaa

SEQ ID NO: 610752 - DNA, 10 bp, Homo sapiens
ctgttccaag

SEQ ID NO: 610753 - DNA, 15 bp, Homo sapiens
ctgttccaagtgtgt

SEQ ID NO: 610754 - DNA, 17 bp, Homo sapiens
ctgttccaagtgtgtgt

SEQ ID NO: 610755 - DNA, 19 bp, Homo sapiens
ctgttccaagtgtgtgtgc

SEQ ID NO: 610756 - DNA, 20 bp, Homo sapiens
ctgttccaagtgtgtgtgca

SEQ ID NO: 610757 - DNA, 13 bp, Homo sapiens
ctgttccgcctca

SEQ ID NO: 610758 - DNA, 19 bp, Homo sapiens
ctgttgaagtgcatgttaa

SEQ ID NO: 610759 - DNA, 20 bp, Homo sapiens
ctgttgaagtgcatgttaaa

SEQ ID NO: 610760 - DNA, 16 bp, Homo sapiens
ctgttgcccttttcct

SEQ ID NO: 610761 - DNA, 18 bp, Homo sapiens
ctgttggtcttaactaat

SEQ ID NO: 610762 - DNA, 21 bp, Homo sapiens
ctgttggtcttaactaatgta

SEQ ID NO: 610763 - DNA, 17 bp, Homo sapiens
ctgtttaccctccctgt

SEQ ID NO: 610764 - DNA, 19 bp, Homo sapiens
ctgtttaccctccctgtcc

SEQ ID NO: 610765 - DNA, 16 bp, Homo sapiens
ctgtttaccgcccacc

SEQ ID NO: 610766 - DNA, 23 bp, Homo sapiens
ctgtttactgacatggtgctgtg

SEQ ID NO: 610767 - DNA, 14 bp, Homo sapiens
ctgtttatgttctt

SEQ ID NO: 610768 - DNA, 14 bp, Homo sapiens
ctgttttcacacct

SEQ ID NO: 610769 - DNA, 12 bp, Homo sapiens
ctgttttgggcc

SEQ ID NO: 610770 - DNA, 22 bp, Homo sapiens
ctgttttgggcctccatgcccc

SEQ ID NO: 610771 - DNA, 19 bp, Homo sapiens
cttaaaaagaccatgcatt

SEQ ID NO: 610772 - DNA, 23 bp, Homo sapiens
cttaaaattggttaatgaaaaat

SEQ ID NO: 610773 - DNA, 12 bp, Homo sapiens
cttaaacaaaaa

SEQ ID NO: 610774 - DNA, 14 bp, Homo sapiens
cttaaacaaaaact

SEQ ID NO: 610775 - DNA, 17 bp, Homo sapiens
cttaaacatttccctgc

SEQ ID NO: 610776 - DNA, 23 bp, Homo sapiens
cttaaacattttttgtttcttgg

SEQ ID NO: 610777 - DNA, 22 bp, Homo sapiens
cttaaacccacataaacacttc

SEQ ID NO: 610778 - DNA, 19 bp, Homo sapiens
cttaaacctgtgctttcat

SEQ ID NO: 610779 - DNA, 15 bp, Homo sapiens
cttaaataaaaatta

SEQ ID NO: 610780 - DNA, 22 bp, Homo sapiens
cttaacccccatttttgtaata

SEQ ID NO: 610781 - DNA, 17 bp, Homo sapiens
cttaactaatgtaaata

SEQ ID NO: 610782 - DNA, 12 bp, Homo sapiens
cttaagaagtat

SEQ ID NO: 610783 - DNA, 21 bp, Homo sapiens
cttaagatctgactgccaaat

SEQ ID NO: 610784 - DNA, 18 bp, Homo sapiens
cttaaggacagtgttcaa

SEQ ID NO: 610785 - DNA, 19 bp, Homo sapiens
cttaagggttttttagaaa

SEQ ID NO: 610786 - DNA, 22 bp, Homo sapiens
cttaattgcatcagtatttcct

SEQ ID NO: 610787 - DNA, 21 bp, Homo sapiens
cttaatttagcagtccatttt

SEQ ID NO: 610788 - DNA, 14 bp, Homo sapiens
cttacaaaaatagc

SEQ ID NO: 610789 - DNA, 13 bp, Homo sapiens
cttacaaagccag

SEQ ID NO: 610790 - DNA, 19 bp, Homo sapiens
cttacacacctgagaatgt

SEQ ID NO: 610791 - DNA, 13 bp, Homo sapiens
cttacagtgactg

SEQ ID NO: 610792 - DNA, 16 bp, Homo sapiens
cttaccgaaatgaaaa

SEQ ID NO: 610793 - DNA, 18 bp, Homo sapiens
cttaccgaaatgaaaatg

SEQ ID NO: 610794 - DNA, 12 bp, Homo sapiens
cttagaatgtga

SEQ ID NO: 610795 - DNA, 17 bp, Homo sapiens
cttagaatgtgaaaaaa

SEQ ID NO: 610796 - DNA, 17 bp, Homo sapiens
cttagcagctcttcccc

SEQ ID NO: 610797 - DNA, 17 bp, Homo sapiens
cttagcttagaccgtgg

SEQ ID NO: 610798 - DNA, 14 bp, Homo sapiens
cttagtaaattcct

SEQ ID NO: 610799 - DNA, 13 bp, Homo sapiens
cttagtatctcat

SEQ ID NO: 610800 - DNA, 22 bp, Homo sapiens
cttagtttgtgatgtaaggcac

SEQ ID NO: 610801 - DNA, 13 bp, Homo sapiens
cttatattctgca

SEQ ID NO: 610802 - DNA, 14 bp, Homo sapiens
cttatctccagcca

SEQ ID NO: 610803 - DNA, 14 bp, Homo sapiens
cttatgtcatttct

SEQ ID NO: 610804 - DNA, 20 bp, Homo sapiens
cttattcatgctttctcctt

SEQ ID NO: 610805 - DNA, 23 bp, Homo sapiens
cttattcatgctttctccttttt

SEQ ID NO: 610806 - DNA, 16 bp, Homo sapiens
cttattcctaattcct

SEQ ID NO: 610807 - DNA, 18 bp, Homo sapiens
cttattcctaattcctgt

SEQ ID NO: 610808 - DNA, 19 bp, Homo sapiens
cttattcctaattcctgta

SEQ ID NO: 610809 - DNA, 23 bp, Homo sapiens
cttatttgctcataagtaaatgt

SEQ ID NO: 610810 - DNA, 17 bp, Homo sapiens
cttcaaattgtcttttg

SEQ ID NO: 610811 - DNA, 22 bp, Homo sapiens
cttcaaccctgccctgcacctt

SEQ ID NO: 610812 - DNA, 13 bp, Homo sapiens
cttcaaggatcct

SEQ ID NO: 610813 - DNA, 15 bp, Homo sapiens
cttcaaggatcctga

SEQ ID NO: 610814 - DNA, 17 bp, Homo sapiens
cttcaaggatcctgagc

SEQ ID NO: 610815 - DNA, 14 bp, Homo sapiens
cttcaatgttaaat

SEQ ID NO: 610816 - DNA, 13 bp, Homo sapiens
cttcacacaaagt

SEQ ID NO: 610817 - DNA, 17 bp, Homo sapiens
cttcacacaaagtgaaa

SEQ ID NO: 610818 - DNA, 18 bp, Homo sapiens
cttcacacaaagtgaaat

SEQ ID NO: 610819 - DNA, 10 bp, Homo sapiens
cttcacctca

SEQ ID NO: 610820 - DNA, 22 bp, Homo sapiens
cttcactgtcatgtgcgaacac

SEQ ID NO: 610821 - DNA, 17 bp, Homo sapiens
cttcagactctctcctc

SEQ ID NO: 610822 - DNA, 21 bp, Homo sapiens
cttcagactctctcctctctc

SEQ ID NO: 610823 - DNA, 17 bp, Homo sapiens
cttcagatgtttccaag

SEQ ID NO: 610824 - DNA, 13 bp, Homo sapiens
cttcagtgcctta

SEQ ID NO: 610825 - DNA, 19 bp, Homo sapiens
cttcagttctcatcttgta

SEQ ID NO: 610826 - DNA, 23 bp, Homo sapiens
cttcatatcctctcgttcagttt

SEQ ID NO: 610827 - DNA, 15 bp, Homo sapiens
cttcatgaccttaca

SEQ ID NO: 610828 - DNA, 17 bp, Homo sapiens
cttcatgcgcagtcccc

SEQ ID NO: 610829 - DNA, 13 bp, Homo sapiens
cttcatgctgtct

SEQ ID NO: 610830 - DNA, 16 bp, Homo sapiens
cttcatgctgtctgtg

SEQ ID NO: 610831 - DNA, 20 bp, Homo sapiens
cttcatgcttttctcatggt

SEQ ID NO: 610832 - DNA, 21 bp, Homo sapiens
cttcatggaactcagctgtct

SEQ ID NO: 610833 - DNA, 13 bp, Homo sapiens
cttcattaaaaca

SEQ ID NO: 610834 - DNA, 16 bp, Homo sapiens
cttcattaaaacaaga

SEQ ID NO: 610835 - DNA, 21 bp, Homo sapiens
cttcattaaaacaagagacca

SEQ ID NO: 610836 - DNA, 16 bp, Homo sapiens
cttcattccgttagga

SEQ ID NO: 610837 - DNA, 18 bp, Homo sapiens
cttcattgcactgcagtt

SEQ ID NO: 610838 - DNA, 17 bp, Homo sapiens
cttccaacatgtgatgt

SEQ ID NO: 610839 - DNA, 18 bp, Homo sapiens
cttccagcgaaatggtac

SEQ ID NO: 610840 - DNA, 20 bp, Homo sapiens
cttccatcttgtggggccag

SEQ ID NO: 610841 - DNA, 23 bp, Homo sapiens
cttccatgcactcttcatgtaat

SEQ ID NO: 610842 - DNA, 21 bp, Homo sapiens
cttcccagctggcagcgcctc

SEQ ID NO: 610843 - DNA, 13 bp, Homo sapiens
cttccccacaata

SEQ ID NO: 610844 - DNA, 18 bp, Homo sapiens
cttccccacaataggctt

SEQ ID NO: 610845 - DNA, 12 bp, Homo sapiens
cttccccactcc

SEQ ID NO: 610846 - DNA, 20 bp, Homo sapiens
cttcccccagggtcccctgc

SEQ ID NO: 610847 - DNA, 19 bp, Homo sapiens
cttccctccccacagtcct

SEQ ID NO: 610848 - DNA, 20 bp, Homo sapiens
cttccctccccacagtcctc

SEQ ID NO: 610849 - DNA, 17 bp, Homo sapiens
cttccctgaacactcat

SEQ ID NO: 610850 - DNA, 22 bp, Homo sapiens
gaaatgaaaatggctgaagaaa

SEQ ID NO: 610851 - DNA, 13 bp, Homo sapiens
gaaatgaatgtgt

SEQ ID NO: 610852 - DNA, 12 bp, Homo sapiens
gaaatgagaaat

SEQ ID NO: 610853 - DNA, 14 bp, Homo sapiens
gaaatgagaaattg

SEQ ID NO: 610854 - DNA, 19 bp, Homo sapiens
gaaatgagatcccagagtt

SEQ ID NO: 610855 - DNA, 21 bp, Homo sapiens
gaaatgagatcccagagttat

SEQ ID NO: 610856 - DNA, 22 bp, Homo sapiens
gaaatgctgatttaaacttctt

SEQ ID NO: 610857 - DNA, 15 bp, Homo sapiens
gaaatgtttttgatt

SEQ ID NO: 610858 - DNA, 14 bp, Homo sapiens
gaaattagtgtttt

SEQ ID NO: 610859 - DNA, 17 bp, Homo sapiens
gaaattagtgttttcat

SEQ ID NO: 610860 - DNA, 19 bp, Homo sapiens
gaaattatatctgtggtct

SEQ ID NO: 610861 - DNA, 12 bp, Homo sapiens
gaaattctataa

SEQ ID NO: 610862 - DNA, 22 bp, Homo sapiens
gaaatttaagcacaaaaaattt

SEQ ID NO: 610863 - DNA, 21 bp, Homo sapiens
gaaatttttgcatgtttaata

SEQ ID NO: 610864 - DNA, 22 bp, Homo sapiens
gaacaacaacaaagcatgctca

SEQ ID NO: 610865 - DNA, 14 bp, Homo sapiens
gaacacactcagca

SEQ ID NO: 610866 - DNA, 13 bp, Homo sapiens
gaacacagtgaca

SEQ ID NO: 610867 - DNA, 16 bp, Homo sapiens
gaacactgcaccctcc

SEQ ID NO: 610868 - DNA, 15 bp, Homo sapiens
gaacagacctcggct

SEQ ID NO: 610869 - DNA, 13 bp, Homo sapiens
gaacagccctgca

SEQ ID NO: 610870 - DNA, 19 bp, Homo sapiens
gaacatgacccagcctgaa

SEQ ID NO: 610871 - DNA, 22 bp, Homo sapiens
gaaccagagcgatgtgttcttt

SEQ ID NO: 610872 - DNA, 14 bp, Homo sapiens
gaaccagcactccc

SEQ ID NO: 610873 - DNA, 18 bp, Homo sapiens
gaaccagcactcccaggg

SEQ ID NO: 610874 - DNA, 20 bp, Homo sapiens
gaaccagcactcccagggcc

SEQ ID NO: 610875 - DNA, 13 bp, Homo sapiens
gaacccccctccc

SEQ ID NO: 610876 - DNA, 14 bp, Homo sapiens
gaacccccctcccc

SEQ ID NO: 610877 - DNA, 15 bp, Homo sapiens
gaacccccctcccca

SEQ ID NO: 610878 - DNA, 13 bp, Homo sapiens
gaaccgtcaatgt

SEQ ID NO: 610879 - DNA, 14 bp, Homo sapiens
gaacgcatgcaggg

SEQ ID NO: 610880 - DNA, 19 bp, Homo sapiens
gaactaatgacaagtgact

SEQ ID NO: 610881 - DNA, 20 bp, Homo sapiens
gaactcagctgtctgtggct

SEQ ID NO: 610882 - DNA, 16 bp, Homo sapiens
gaactgaagcagagtc

SEQ ID NO: 610883 - DNA, 17 bp, Homo sapiens
gaactgaagcagagtca

SEQ ID NO: 610884 - DNA, 14 bp, Homo sapiens
gaactgcaacactg

SEQ ID NO: 610885 - DNA, 12 bp, Homo sapiens
gaactgccccat

SEQ ID NO: 610886 - DNA, 22 bp, Homo sapiens
gaactgggttctttggaagcag

SEQ ID NO: 610887 - DNA, 23 bp, Homo sapiens
gaactttctcagcatatatataa

SEQ ID NO: 610888 - DNA, 16 bp, Homo sapiens
gaagaaaatgagatgg

SEQ ID NO: 610889 - DNA, 16 bp, Homo sapiens
gaagaaatagcagagc

SEQ ID NO: 610890 - DNA, 17 bp, Homo sapiens
gaagaactcatgtgatt

SEQ ID NO: 610891 - DNA, 16 bp, Homo sapiens
gaagaaggactgaaga

SEQ ID NO: 610892 - DNA, 13 bp, Homo sapiens
gaagaagggccac

SEQ ID NO: 610893 - DNA, 18 bp, Homo sapiens
gaagaagggccaccctga

SEQ ID NO: 610894 - DNA, 14 bp, Homo sapiens
gaagacaaatacac

SEQ ID NO: 610895 - DNA, 18 bp, Homo sapiens
gaagacaaatacacatac

SEQ ID NO: 610896 - DNA, 20 bp, Homo sapiens
gaagaccctatctcccacaa

SEQ ID NO: 610897 - DNA, 18 bp, Homo sapiens
gaagagagatatatctga

SEQ ID NO: 610898 - DNA, 23 bp, Homo sapiens
gaagagagatatatctgaaaact

SEQ ID NO: 610899 - DNA, 15 bp, Homo sapiens
gaagagcctgactgt

SEQ ID NO: 610900 - DNA, 19 bp, Homo sapiens
gaagagctgctgtatttga

SEQ ID NO: 610901 - DNA, 14 bp, Homo sapiens
gaagagtatggatt

SEQ ID NO: 610902 - DNA, 13 bp, Homo sapiens
gaagatgtttaac

SEQ ID NO: 610903 - DNA, 22 bp, Homo sapiens
gaagccataacgttagactgca

SEQ ID NO: 610904 - DNA, 11 bp, Homo sapiens
gaagcccaccc

SEQ ID NO: 610905 - DNA, 22 bp, Homo sapiens
gaagcccacccgccccagagac

SEQ ID NO: 610906 - DNA, 14 bp, Homo sapiens
gaagcccaggagga

SEQ ID NO: 610907 - DNA, 15 bp, Homo sapiens
gaagccccttggaga

SEQ ID NO: 610908 - DNA, 19 bp, Homo sapiens
gaagccctaagtaaatcta

SEQ ID NO: 610909 - DNA, 14 bp, Homo sapiens
gaagcctggattcc

SEQ ID NO: 610910 - DNA, 14 bp, Homo sapiens
gaagctaaaacact

SEQ ID NO: 610911 - DNA, 15 bp, Homo sapiens
gaagctttggaagca

SEQ ID NO: 610912 - DNA, 21 bp, Homo sapiens
gaagctttggaagcagcaagg

SEQ ID NO: 610913 - DNA, 14 bp, Homo sapiens
gaaggagaggagtg

SEQ ID NO: 610914 - DNA, 16 bp, Homo sapiens
gaaggagaggagtgcg

SEQ ID NO: 610915 - DNA, 16 bp, Homo sapiens
gaaggcacactgagca

SEQ ID NO: 610916 - DNA, 16 bp, Homo sapiens
gaaggcccgaggaggc

SEQ ID NO: 610917 - DNA, 14 bp, Homo sapiens
gaaggcctgaggga

SEQ ID NO: 610918 - DNA, 17 bp, Homo sapiens
gaaggcctgagggaagc

SEQ ID NO: 610919 - DNA, 19 bp, Homo sapiens
gaaggcctgagggaagccc

SEQ ID NO: 610920 - DNA, 18 bp, Homo sapiens
gaaggcctgccccccttc

SEQ ID NO: 610921 - DNA, 13 bp, Homo sapiens
gaaggctgctgtg

SEQ ID NO: 610922 - DNA, 18 bp, Homo sapiens
gaagggaaatcaatttaa

SEQ ID NO: 610923 - DNA, 18 bp, Homo sapiens
gaagggccaccctgagca

SEQ ID NO: 610924 - DNA, 15 bp, Homo sapiens
gaagggttctgccct

SEQ ID NO: 610925 - DNA, 16 bp, Homo sapiens
gaagggttctgccctg

SEQ ID NO: 610926 - DNA, 17 bp, Homo sapiens
gaagggttctgccctgc

SEQ ID NO: 610927 - DNA, 14 bp, Homo sapiens
gaagtaagttcatc

SEQ ID NO: 610928 - DNA, 15 bp, Homo sapiens
gaagtaagttcatca

SEQ ID NO: 610929 - DNA, 16 bp, Homo sapiens
gaagtaagttcatcaa

SEQ ID NO: 610930 - DNA, 15 bp, Homo sapiens
gaagtagtgtgagtg

SEQ ID NO: 610931 - DNA, 17 bp, Homo sapiens
gaagtatgtcttcaaaa

SEQ ID NO: 610932 - DNA, 15 bp, Homo sapiens
gaagtcccttcctgt

SEQ ID NO: 610933 - DNA, 19 bp, Homo sapiens
gaagtcccttcctgtcctg

SEQ ID NO: 610934 - DNA, 15 bp, Homo sapiens
gaagtggcctgagaa

SEQ ID NO: 610935 - DNA, 18 bp, Homo sapiens
gaagtggtaggaaagcct

SEQ ID NO: 610936 - DNA, 13 bp, Homo sapiens
gaagtttaaatct

SEQ ID NO: 610937 - DNA, 21 bp, Homo sapiens
gaagtttaaatctttgttaaa

SEQ ID NO: 610938 - DNA, 24 bp, Homo sapiens
gaatactgtattgttacagctgaa

SEQ ID NO: 610939 - DNA, 20 bp, Homo sapiens
gaatagacagaggtttcatt

SEQ ID NO: 610940 - DNA, 22 bp, Homo sapiens
gaatagacagaggtttcatttt

SEQ ID NO: 610941 - DNA, 17 bp, Homo sapiens
gaataggcaaactttta

SEQ ID NO: 610942 - DNA, 19 bp, Homo sapiens
gaatataatggcctcttaa

SEQ ID NO: 610943 - DNA, 13 bp, Homo sapiens
gaatattgctgat

SEQ ID NO: 610944 - DNA, 23 bp, Homo sapiens
gaatattgctgatggtgcaatga

SEQ ID NO: 610945 - DNA, 15 bp, Homo sapiens
gaatcaaaaattgaa

SEQ ID NO: 610946 - DNA, 21 bp, Homo sapiens
gaatcaaaaattgaagagaga

SEQ ID NO: 610947 - DNA, 16 bp, Homo sapiens
gaatcaagtctgtgaa

SEQ ID NO: 610948 - DNA, 12 bp, Homo sapiens
gaatcacagcca

SEQ ID NO: 610949 - DNA, 19 bp, Homo sapiens
gaatcacctaattaatttc

SEQ ID NO: 610950 - DNA, 20 bp, Homo sapiens
gaatcacctaattaatttca

SEQ ID NO: 610951 - DNA, 15 bp, Homo sapiens
gaatccatatcagct

SEQ ID NO: 610952 - DNA, 19 bp, Homo sapiens
gaatcctgccacacatgct

SEQ ID NO: 610953 - DNA, 16 bp, Homo sapiens
gaatctctcaaaatgt

SEQ ID NO: 610954 - DNA, 18 bp, Homo sapiens
gaatgaaatataaactgt

SEQ ID NO: 610955 - DNA, 17 bp, Homo sapiens
gaatgagaaatcatgtt

SEQ ID NO: 610956 - DNA, 22 bp, Homo sapiens
gaatgagggcgtgaaacacaat

SEQ ID NO: 610957 - DNA, 15 bp, Homo sapiens
gaatgcttaaatgat

SEQ ID NO: 610958 - DNA, 23 bp, Homo sapiens
gaatgggccaagccagggttcca

SEQ ID NO: 610959 - DNA, 13 bp, Homo sapiens
gaatgtagggcct

SEQ ID NO: 610960 - DNA, 17 bp, Homo sapiens
gaattacataacaggca

SEQ ID NO: 610961 - DNA, 18 bp, Homo sapiens
gaattgaaccgtcaatgt

SEQ ID NO: 610962 - DNA, 15 bp, Homo sapiens
gaatttaccatcaaa

SEQ ID NO: 610963 - DNA, 20 bp, Homo sapiens
gaattttaaaaaagatggat

SEQ ID NO: 610964 - DNA, 19 bp, Homo sapiens
gaattttaaaatgcaaata

SEQ ID NO: 610965 - DNA, 21 bp, Homo sapiens
gacaaagggaaggctgctgtg

SEQ ID NO: 610966 - DNA, 18 bp, Homo sapiens
gacaaatacacatacata

SEQ ID NO: 610967 - DNA, 14 bp, Homo sapiens
gaggagcaccccca

SEQ ID NO: 610968 - DNA, 15 bp, Homo sapiens
gaggagcacccccag

SEQ ID NO: 610969 - DNA, 20 bp, Homo sapiens
gaggagcacccccagcctcc

SEQ ID NO: 610970 - DNA, 22 bp, Homo sapiens
gaggagcacccccagcctcccc

SEQ ID NO: 610971 - DNA, 18 bp, Homo sapiens
gaggagccttgctgggcc

SEQ ID NO: 610972 - DNA, 22 bp, Homo sapiens
gaggagccttgctgggccaggg

SEQ ID NO: 610973 - DNA, 15 bp, Homo sapiens
gaggagcgtgtccta

SEQ ID NO: 610974 - DNA, 15 bp, Homo sapiens
gaggaggagccttgc

SEQ ID NO: 610975 - DNA, 16 bp, Homo sapiens
gaggaggtgtggagtg

SEQ ID NO: 610976 - DNA, 19 bp, Homo sapiens
gaggaggtgtggagtggag

SEQ ID NO: 610977 - DNA, 12 bp, Homo sapiens
gaggagtccaaa

SEQ ID NO: 610978 - DNA, 22 bp, Homo sapiens
gaggcagaatggtgggctccag

SEQ ID NO: 610979 - DNA, 15 bp, Homo sapiens
gaggcagggccctgg

SEQ ID NO: 610980 - DNA, 16 bp, Homo sapiens
gaggcagggccctggg

SEQ ID NO: 610981 - DNA, 12 bp, Homo sapiens
gaggccagggcc

SEQ ID NO: 610982 - DNA, 17 bp, Homo sapiens
gaggccagtactttgcc

SEQ ID NO: 610983 - DNA, 14 bp, Homo sapiens
gaggccccaggccc

SEQ ID NO: 610984 - DNA, 19 bp, Homo sapiens
gaggcccccggaggcgccc

SEQ ID NO: 610985 - DNA, 20 bp, Homo sapiens
gaggcccccggaggcgccca

SEQ ID NO: 610986 - DNA, 22 bp, Homo sapiens
gaggccgactgggctgctgggg

SEQ ID NO: 610987 - DNA, 19 bp, Homo sapiens
gaggcctggtctggagccc

SEQ ID NO: 610988 - DNA, 16 bp, Homo sapiens
gaggcgcccacctgcc

SEQ ID NO: 610989 - DNA, 19 bp, Homo sapiens
gaggcgcccacctgcccag

SEQ ID NO: 610990 - DNA, 20 bp, Homo sapiens
gaggcgtgggatccagagag

SEQ ID NO: 610991 - DNA, 21 bp, Homo sapiens
gaggcgtgggatccagagaga

SEQ ID NO: 610992 - DNA, 19 bp, Homo sapiens
gaggctgccccaggggcac

SEQ ID NO: 610993 - DNA, 13 bp, Homo sapiens
gaggctgcctcag

SEQ ID NO: 610994 - DNA, 14 bp, Homo sapiens
gaggctgcctcagc

SEQ ID NO: 610995 - DNA, 10 bp, Homo sapiens
gaggctgctg

SEQ ID NO: 610996 - DNA, 18 bp, Homo sapiens
gagggaagcccacccgcc

SEQ ID NO: 610997 - DNA, 20 bp, Homo sapiens
gagggaagcccacccgcccc

SEQ ID NO: 610998 - DNA, 22 bp, Homo sapiens
gagggaagcccacccgccccag

SEQ ID NO: 610999 - DNA, 22 bp, Homo sapiens
gagggaatccatatcagctctg

SEQ ID NO: 611000 - DNA, 16 bp, Homo sapiens
gagggcccttcccaac

SEQ ID NO: 611001 - DNA, 21 bp, Homo sapiens
gagggctgagcccctcctctc

SEQ ID NO: 611002 - DNA, 17 bp, Homo sapiens
gaggggcttggagcaga

SEQ ID NO: 611003 - DNA, 22 bp, Homo sapiens
gagggggatgcccctggccctg

SEQ ID NO: 611004 - DNA, 17 bp, Homo sapiens
gagggggctgggaaaga

SEQ ID NO: 611005 - DNA, 13 bp, Homo sapiens
gagggtctccctg

SEQ ID NO: 611006 - DNA, 15 bp, Homo sapiens
gagggtctccctggg

SEQ ID NO: 611007 - DNA, 22 bp, Homo sapiens
gagggtctccctgggcaccctg

SEQ ID NO: 611008 - DNA, 16 bp, Homo sapiens
gaggtggcagggaagg

SEQ ID NO: 611009 - DNA, 20 bp, Homo sapiens
gaggtggcagggaagggtgc

SEQ ID NO: 611010 - DNA, 21 bp, Homo sapiens
gaggtggcagggaagggtgcc

SEQ ID NO: 611011 - DNA, 18 bp, Homo sapiens
gaggtgtggagtggaggg

SEQ ID NO: 611012 - DNA, 19 bp, Homo sapiens
gaggtgtggagtggagggg

SEQ ID NO: 611013 - DNA, 18 bp, Homo sapiens
gaggtttcattttcatct

SEQ ID NO: 611014 - DNA, 22 bp, Homo sapiens
gaggtttcattttcatctcatt

SEQ ID NO: 611015 - DNA, 17 bp, Homo sapiens
gagtatacaagtgtttc

SEQ ID NO: 611016 - DNA, 20 bp, Homo sapiens
gagtatacaagtgtttctag

SEQ ID NO: 611017 - DNA, 17 bp, Homo sapiens
gagtatggtgctgggtc

SEQ ID NO: 611018 - DNA, 18 bp, Homo sapiens
gagtcaagctgatgaagt

SEQ ID NO: 611019 - DNA, 17 bp, Homo sapiens
gagtcagggctgtgctt

SEQ ID NO: 611020 - DNA, 17 bp, Homo sapiens
gagtccactttcctctc

SEQ ID NO: 611021 - DNA, 22 bp, Homo sapiens
gagtcctcattgttcagaaaag

SEQ ID NO: 611022 - DNA, 12 bp, Homo sapiens
gagtcggctggg

SEQ ID NO: 611023 - DNA, 15 bp, Homo sapiens
gagtcggctgggcag

SEQ ID NO: 611024 - DNA, 20 bp, Homo sapiens
gagtctgaaggagaggagtg

SEQ ID NO: 611025 - DNA, 20 bp, Homo sapiens
gagtcttgctacctcagtca

SEQ ID NO: 611026 - DNA, 13 bp, Homo sapiens
gagtgaaatatta

SEQ ID NO: 611027 - DNA, 18 bp, Homo sapiens
gagtgacagaaggcccga

SEQ ID NO: 611028 - DNA, 22 bp, Homo sapiens
gagtgacatgggtgtgccaggc

SEQ ID NO: 611029 - DNA, 22 bp, Homo sapiens
gagtgatatggcttgtagggtg

SEQ ID NO: 611030 - DNA, 22 bp, Homo sapiens
gagtgatttgtaaaacagtggt

SEQ ID NO: 611031 - DNA, 14 bp, Homo sapiens
gagtgcgctagagc

SEQ ID NO: 611032 - DNA, 13 bp, Homo sapiens
gagtggaccacga

SEQ ID NO: 611033 - DNA, 13 bp, Homo sapiens
gagtggaggagga

SEQ ID NO: 611034 - DNA, 20 bp, Homo sapiens
gagtggaggggtcagcaggg

SEQ ID NO: 611035 - DNA, 14 bp, Homo sapiens
gagtgggccccctc

SEQ ID NO: 611036 - DNA, 17 bp, Homo sapiens
gagtgtatgtgccagta

SEQ ID NO: 611037 - DNA, 21 bp, Homo sapiens
gagttcatagaaatacatcaa

SEQ ID NO: 611038 - DNA, 19 bp, Homo sapiens
gagttctccttgtacttga

SEQ ID NO: 611039 - DNA, 16 bp, Homo sapiens
gagtttccatttggat

SEQ ID NO: 611040 - DNA, 21 bp, Homo sapiens
gagtttccatttggattttaa

SEQ ID NO: 611041 - DNA, 22 bp, Homo sapiens
gataacagagtgatttgtaaaa

SEQ ID NO: 611042 - DNA, 13 bp, Homo sapiens
gataactctgtac

SEQ ID NO: 611043 - DNA, 22 bp, Homo sapiens
gataatgagatgtaatacacca

SEQ ID NO: 611044 - DNA, 17 bp, Homo sapiens
gataattaaatgaaata

SEQ ID NO: 611045 - DNA, 19 bp, Homo sapiens
gataattaaatgaaatact

SEQ ID NO: 611046 - DNA, 18 bp, Homo sapiens
gataattcgagcaaacaa

SEQ ID NO: 611047 - DNA, 17 bp, Homo sapiens
gataattgtaaaggtga

SEQ ID NO: 611048 - DNA, 17 bp, Homo sapiens
gatacgtatatttttaa

SEQ ID NO: 611049 - DNA, 18 bp, Homo sapiens
gatacgtatatttttaac

SEQ ID NO: 611050 - DNA, 21 bp, Homo sapiens
gatagaagaaggactgaagaa

SEQ ID NO: 611051 - DNA, 22 bp, Homo sapiens
gatagaagaaggactgaagaaa

SEQ ID NO: 611052 - DNA, 13 bp, Homo sapiens
gatagctccttca

SEQ ID NO: 611053 - DNA, 14 bp, Homo sapiens
gatagctccttcat

SEQ ID NO: 611054 - DNA, 13 bp, Homo sapiens
gataggagaggaa

SEQ ID NO: 611055 - DNA, 21 bp, Homo sapiens
gataggagggtgcccctggga

SEQ ID NO: 611056 - DNA, 22 bp, Homo sapiens
gataggagggtgcccctgggaa

SEQ ID NO: 611057 - DNA, 19 bp, Homo sapiens
gataggttctgctttctga

SEQ ID NO: 611058 - DNA, 16 bp, Homo sapiens
gatagtttacaaacaa

SEQ ID NO: 611059 - DNA, 15 bp, Homo sapiens
gatataagccatagc

SEQ ID NO: 611060 - DNA, 17 bp, Homo sapiens
gatatacagacctccag

SEQ ID NO: 611061 - DNA, 20 bp, Homo sapiens
gatatacagacctccagatt

SEQ ID NO: 611062 - DNA, 18 bp, Homo sapiens
gatatatctgaaaactgg

SEQ ID NO: 611063 - DNA, 19 bp, Homo sapiens
gatatcacagtctaatttt

SEQ ID NO: 611064 - DNA, 20 bp, Homo sapiens
gatatctgtttgcttctaaa

SEQ ID NO: 611065 - DNA, 22 bp, Homo sapiens
gatatgagaaatataaaaataa

SEQ ID NO: 611066 - DNA, 19 bp, Homo sapiens
gatattggttctatttatt

SEQ ID NO: 611067 - DNA, 19 bp, Homo sapiens
gatattgtatctcctttaa

SEQ ID NO: 611068 - DNA, 17 bp, Homo sapiens
gatcaccctgaattcat

SEQ ID NO: 611069 - DNA, 23 bp, Homo sapiens
gatcaccctgaattcattgtctc

SEQ ID NO: 611070 - DNA, 19 bp, Homo sapiens
gatcaggaggggtgttaaa

SEQ ID NO: 611071 - DNA, 19 bp, Homo sapiens
gatcataaagagcacgttt

SEQ ID NO: 611072 - DNA, 20 bp, Homo sapiens
gatcattttttgtctatttt

SEQ ID NO: 611073 - DNA, 14 bp, Homo sapiens
gatccagagagaag

SEQ ID NO: 611074 - DNA, 15 bp, Homo sapiens
gatccagagagaagc

SEQ ID NO: 611075 - DNA, 22 bp, Homo sapiens
gatcccaagtcaaacagtgtgg

SEQ ID NO: 611076 - DNA, 17 bp, Homo sapiens
gatcccagagttatttc

SEQ ID NO: 611077 - DNA, 21 bp, Homo sapiens
gatccccatggaacagccctg

SEQ ID NO: 611078 - DNA, 18 bp, Homo sapiens
gatccctcggtcagcacc

SEQ ID NO: 611079 - DNA, 14 bp, Homo sapiens
gatcctgagccaga

SEQ ID NO: 611080 - DNA, 22 bp, Homo sapiens
gatcctgagccagatttcactc

SEQ ID NO: 611081 - DNA, 13 bp, Homo sapiens
gatccttccatct

SEQ ID NO: 611082 - DNA, 21 bp, Homo sapiens
gcacccccagcctcccccagg

SEQ ID NO: 611083 - DNA, 23 bp, Homo sapiens
gcaccctctgctatgtctgtgat

SEQ ID NO: 611084 - DNA, 14 bp, Homo sapiens
gcaccctgcaggca

SEQ ID NO: 611085 - DNA, 17 bp, Homo sapiens
gcaccctgcaggcaggc

SEQ ID NO: 611086 - DNA, 15 bp, Homo sapiens
gcaccgcccaacccc

SEQ ID NO: 611087 - DNA, 22 bp, Homo sapiens
gcaccgcccaacccccacctcc

SEQ ID NO: 611088 - DNA, 16 bp, Homo sapiens
gcaccgcccacccaca

SEQ ID NO: 611089 - DNA, 17 bp, Homo sapiens
gcaccgcccacccacac

SEQ ID NO: 611090 - DNA, 16 bp, Homo sapiens
gcaccggacgctggag

SEQ ID NO: 611091 - DNA, 19 bp, Homo sapiens
gcaccggacgctggagacc

SEQ ID NO: 611092 - DNA, 20 bp, Homo sapiens
gcaccgtggtgtgaggcccc

SEQ ID NO: 611093 - DNA, 12 bp, Homo sapiens
gcacctcttgaa

SEQ ID NO: 611094 - DNA, 14 bp, Homo sapiens
gcacctgcttctca

SEQ ID NO: 611095 - DNA, 14 bp, Homo sapiens
gcacctgtcacctt

SEQ ID NO: 611096 - DNA, 13 bp, Homo sapiens
gcaccttgggcac

SEQ ID NO: 611097 - DNA, 21 bp, Homo sapiens
gcacgcggccgctctccgccc

SEQ ID NO: 611098 - DNA, 14 bp, Homo sapiens
gcacggcagcttga

SEQ ID NO: 611099 - DNA, 13 bp, Homo sapiens
gcacgggagagcg

SEQ ID NO: 611100 - DNA, 20 bp, Homo sapiens
gcacgggagagcgccacccg

SEQ ID NO: 611101 - DNA, 19 bp, Homo sapiens
gcactacaacttaattgct

SEQ ID NO: 611102 - DNA, 22 bp, Homo sapiens
gcactacatctgatatcaggaa

SEQ ID NO: 611103 - DNA, 16 bp, Homo sapiens
gcactatctttcagga

SEQ ID NO: 611104 - DNA, 17 bp, Homo sapiens
gcactcaggagcacagc

SEQ ID NO: 611105 - DNA, 22 bp, Homo sapiens
gcactcaggagcacagccatag

SEQ ID NO: 611106 - DNA, 13 bp, Homo sapiens
gcactgagcagag

SEQ ID NO: 611107 - DNA, 20 bp, Homo sapiens
gcacttcggataattttcat

SEQ ID NO: 611108 - DNA, 22 bp, Homo sapiens
gcacttcggataattttcattt

SEQ ID NO: 611109 - DNA, 17 bp, Homo sapiens
gcacttctgttatcagg

SEQ ID NO: 611110 - DNA, 15 bp, Homo sapiens
gcagaaaacattgtt

SEQ ID NO: 611111 - DNA, 21 bp, Homo sapiens
gcagaatggtgggctccagag

SEQ ID NO: 611112 - DNA, 14 bp, Homo sapiens
gcagacacacacat

SEQ ID NO: 611113 - DNA, 20 bp, Homo sapiens
gcagaccacggtgtgggggg

SEQ ID NO: 611114 - DNA, 14 bp, Homo sapiens
gcagactgtggctg

SEQ ID NO: 611115 - DNA, 15 bp, Homo sapiens
gcagagaccaccgcg

SEQ ID NO: 611116 - DNA, 19 bp, Homo sapiens
gcagagacctcctgatgtc

SEQ ID NO: 611117 - DNA, 15 bp, Homo sapiens
gcagagacggcagcc

SEQ ID NO: 611118 - DNA, 22 bp, Homo sapiens
gcagagacggcagccccatcct

SEQ ID NO: 611119 - DNA, 18 bp, Homo sapiens
gcagagattgggggggct

SEQ ID NO: 611120 - DNA, 13 bp, Homo sapiens
gcagagccccgga

SEQ ID NO: 611121 - DNA, 14 bp, Homo sapiens
gcagagccccggag

SEQ ID NO: 611122 - DNA, 16 bp, Homo sapiens
gcagagccccggagca

SEQ ID NO: 611123 - DNA, 20 bp, Homo sapiens
gcagagccccggagcaccac

SEQ ID NO: 611124 - DNA, 10 bp, Homo sapiens
gcagagccta

SEQ ID NO: 611125 - DNA, 20 bp, Homo sapiens
gcagagctgagtcggctggg

SEQ ID NO: 611126 - DNA, 13 bp, Homo sapiens
gcagaggcagggc

SEQ ID NO: 611127 - DNA, 17 bp, Homo sapiens
gcagaggcagggccctg

SEQ ID NO: 611128 - DNA, 14 bp, Homo sapiens
gcagaggcccgagg

SEQ ID NO: 611129 - DNA, 19 bp, Homo sapiens
gcagagtatacaagtgttt

SEQ ID NO: 611130 - DNA, 15 bp, Homo sapiens
gcagagtcttgctac

SEQ ID NO: 611131 - DNA, 22 bp, Homo sapiens
gcagatcgtgccgtggagcttg

SEQ ID NO: 611132 - DNA, 13 bp, Homo sapiens
gcagattaataac

SEQ ID NO: 611133 - DNA, 18 bp, Homo sapiens
gcagcaaccagagcactg

SEQ ID NO: 611134 - DNA, 21 bp, Homo sapiens
gcagcaccagcctgagccaca

SEQ ID NO: 611135 - DNA, 23 bp, Homo sapiens
gcagcaccagcctgagccacagt

SEQ ID NO: 611136 - DNA, 15 bp, Homo sapiens
gcagcacctccggga

SEQ ID NO: 611137 - DNA, 20 bp, Homo sapiens
gcagcagagagaaataaaac

SEQ ID NO: 611138 - DNA, 13 bp, Homo sapiens
gcagcagatttta

SEQ ID NO: 611139 - DNA, 13 bp, Homo sapiens
gcagcaggtgctg

SEQ ID NO: 611140 - DNA, 21 bp, Homo sapiens
gcagcccagaacgggcctccc

SEQ ID NO: 611141 - DNA, 21 bp, Homo sapiens
gcagccccatccttcccgcag

SEQ ID NO: 611142 - DNA, 14 bp, Homo sapiens
gcagcccccacgcc

SEQ ID NO: 611143 - DNA, 19 bp, Homo sapiens
gcagccccgcgaccacccc

SEQ ID NO: 611144 - DNA, 20 bp, Homo sapiens
gcagccccgcgaccacccct

SEQ ID NO: 611145 - DNA, 23 bp, Homo sapiens
gcagccctcacctctgaggacag

SEQ ID NO: 611146 - DNA, 14 bp, Homo sapiens
gcagccgcgctctg

SEQ ID NO: 611147 - DNA, 18 bp, Homo sapiens
gcagccgcgctctgcccc

SEQ ID NO: 611148 - DNA, 20 bp, Homo sapiens
gcagcctgagctccaccctc

SEQ ID NO: 611149 - DNA, 21 bp, Homo sapiens
gcagcctgagctccaccctcc

SEQ ID NO: 611150 - DNA, 22 bp, Homo sapiens
gcagcgccagggctcagatggg

SEQ ID NO: 611151 - DNA, 17 bp, Homo sapiens
gcagcgcctcccgccgc

SEQ ID NO: 611152 - DNA, 15 bp, Homo sapiens
gcagctagaaagaga

SEQ ID NO: 611153 - DNA, 17 bp, Homo sapiens
gcagctaggcagggagg

SEQ ID NO: 611154 - DNA, 22 bp, Homo sapiens
gcagctcttcccctttcctggg

SEQ ID NO: 611155 - DNA, 13 bp, Homo sapiens
gcagcttgagcct

SEQ ID NO: 611156 - DNA, 22 bp, Homo sapiens
gcaggaaagatcccaagtcaaa

SEQ ID NO: 611157 - DNA, 19 bp, Homo sapiens
gcaggaatcaaaaattgaa

SEQ ID NO: 611158 - DNA, 23 bp, Homo sapiens
gcaggaggacagagtgccctggg

SEQ ID NO: 611159 - DNA, 12 bp, Homo sapiens
gcaggcagacca

SEQ ID NO: 611160 - DNA, 15 bp, Homo sapiens
gcaggcagcctgcag

SEQ ID NO: 611161 - DNA, 23 bp, Homo sapiens
gcaggcagctaggcagggagggg

SEQ ID NO: 611162 - DNA, 11 bp, Homo sapiens
gcaggcaggca

SEQ ID NO: 611163 - DNA, 16 bp, Homo sapiens
gcaggcaggcagacca

SEQ ID NO: 611164 - DNA, 15 bp, Homo sapiens
gcaggcccagcagac

SEQ ID NO: 611165 - DNA, 17 bp, Homo sapiens
gcagggaagggtgcctg

SEQ ID NO: 611166 - DNA, 23 bp, Homo sapiens
gcagggaagggtgcctggctggg

SEQ ID NO: 611167 - DNA, 12 bp, Homo sapiens
gcagggcccagg

SEQ ID NO: 611168 - DNA, 17 bp, Homo sapiens
gcagggcccagggaggt

SEQ ID NO: 611169 - DNA, 21 bp, Homo sapiens
gcagggcccagggaggtggca

SEQ ID NO: 611170 - DNA, 17 bp, Homo sapiens
gcagggcccccactgga

SEQ ID NO: 611171 - DNA, 15 bp, Homo sapiens
gcagggccctggggt

SEQ ID NO: 611172 - DNA, 21 bp, Homo sapiens
gcagggccctggggtctctga

SEQ ID NO: 611173 - DNA, 17 bp, Homo sapiens
gcagggccgcagggcgc

SEQ ID NO: 611174 - DNA, 21 bp, Homo sapiens
gcaggggggttgggttccaga

SEQ ID NO: 611175 - DNA, 22 bp, Homo sapiens
gcaggggggttgggttccagac

SEQ ID NO: 611176 - DNA, 23 bp, Homo sapiens
gcaggggggttgggttccagaca

SEQ ID NO: 611177 - DNA, 14 bp, Homo sapiens
gcagggttctagaa

SEQ ID NO: 611178 - DNA, 17 bp, Homo sapiens
gcagggttctagaaggg

SEQ ID NO: 611179 - DNA, 16 bp, Homo sapiens
gcaggtgggctgcctg

SEQ ID NO: 611180 - DNA, 17 bp, Homo sapiens
gcaggtgggctgcctgc

SEQ ID NO: 611181 - DNA, 18 bp, Homo sapiens
gcaggtgggctgcctgct

SEQ ID NO: 611182 - DNA, 19 bp, Homo sapiens
gcaggtgggggctgcgtcc

SEQ ID NO: 611183 - DNA, 14 bp, Homo sapiens
gcagtaccatccca

SEQ ID NO: 611184 - DNA, 20 bp, Homo sapiens
gcagtcacgtgaggcccctg

SEQ ID NO: 611185 - DNA, 21 bp, Homo sapiens
gcagtcacgtgaggcccctgt

SEQ ID NO: 611186 - DNA, 22 bp, Homo sapiens
gcagtcacgtgaggcccctgtg

SEQ ID NO: 611187 - DNA, 18 bp, Homo sapiens
gcagtcagcacagagagc

SEQ ID NO: 611188 - DNA, 19 bp, Homo sapiens
gcagtcagcacagagagcg

SEQ ID NO: 611189 - DNA, 22 bp, Homo sapiens
gcagtcagcacagagagcggct

SEQ ID NO: 611190 - DNA, 20 bp, Homo sapiens
gcagtccatttttgagtaaa

SEQ ID NO: 611191 - DNA, 15 bp, Homo sapiens
gcagtgatgtggtgg

SEQ ID NO: 611192 - DNA, 23 bp, Homo sapiens
gcagtgcagcaaccagagcactg

SEQ ID NO: 611193 - DNA, 12 bp, Homo sapiens
gcagtgcagtgc

SEQ ID NO: 611194 - DNA, 14 bp, Homo sapiens
gcagtggagagggg

SEQ ID NO: 611195 - DNA, 15 bp, Homo sapiens
gcagtggagagggga

SEQ ID NO: 611196 - DNA, 24 bp, Homo sapiens
gcagtggagaggggacttggatag

SEQ ID NO: 611197 - DNA, 15 bp, Homo sapiens
gcagtggctggggga

SEQ ID NO: 611198 - DNA, 16 bp, Homo sapiens
gcccggcctcctagcc

SEQ ID NO: 611199 - DNA, 21 bp, Homo sapiens
gcccggcctcctagcctctcc

SEQ ID NO: 611200 - DNA, 15 bp, Homo sapiens
gcccgtgcgcagccg

SEQ ID NO: 611201 - DNA, 24 bp, Homo sapiens
gcccgtgcgcagccgcgctctgcc

SEQ ID NO: 611202 - DNA, 16 bp, Homo sapiens
gccctcactccactcc

SEQ ID NO: 611203 - DNA, 21 bp, Homo sapiens
gccctcactccactcccctca

SEQ ID NO: 611204 - DNA, 13 bp, Homo sapiens
gccctcccccacg

SEQ ID NO: 611205 - DNA, 15 bp, Homo sapiens
gccctcccccacggc

SEQ ID NO: 611206 - DNA, 11 bp, Homo sapiens
gccctccctcc

SEQ ID NO: 611207 - DNA, 13 bp, Homo sapiens
gccctccctgctg

SEQ ID NO: 611208 - DNA, 17 bp, Homo sapiens
gccctccgccagccctg

SEQ ID NO: 611209 - DNA, 18 bp, Homo sapiens
gccctccgccagccctgt

SEQ ID NO: 611210 - DNA, 16 bp, Homo sapiens
gccctcctctgccccc

SEQ ID NO: 611211 - DNA, 21 bp, Homo sapiens
gccctcctctgccccctcccc

SEQ ID NO: 611212 - DNA, 18 bp, Homo sapiens
gccctctgccactgacag

SEQ ID NO: 611213 - DNA, 14 bp, Homo sapiens
gccctctgtccaca

SEQ ID NO: 611214 - DNA, 15 bp, Homo sapiens
gccctcttcaatccc

SEQ ID NO: 611215 - DNA, 18 bp, Homo sapiens
gccctctttctctctgtg

SEQ ID NO: 611216 - DNA, 16 bp, Homo sapiens
gccctgacatgctaac

SEQ ID NO: 611217 - DNA, 16 bp, Homo sapiens
gccctgcaccttgggc

SEQ ID NO: 611218 - DNA, 17 bp, Homo sapiens
gccctgccctcactcca

SEQ ID NO: 611219 - DNA, 15 bp, Homo sapiens
gccctgccctccccc

SEQ ID NO: 611220 - DNA, 16 bp, Homo sapiens
gccctgccctccccca

SEQ ID NO: 611221 - DNA, 12 bp, Homo sapiens
gccctgcctgag

SEQ ID NO: 611222 - DNA, 17 bp, Homo sapiens
gccctgcctgaggagga

SEQ ID NO: 611223 - DNA, 17 bp, Homo sapiens
gccctggagccagggca

SEQ ID NO: 611224 - DNA, 23 bp, Homo sapiens
gccctgggcaaggaagctttgga

SEQ ID NO: 611225 - DNA, 22 bp, Homo sapiens
gccctggggcatccaccttcct

SEQ ID NO: 611226 - DNA, 15 bp, Homo sapiens
gccctgtagctctga

SEQ ID NO: 611227 - DNA, 13 bp, Homo sapiens
gccctgtgccctc

SEQ ID NO: 611228 - DNA, 19 bp, Homo sapiens
gccctgtgccctctcactg

SEQ ID NO: 611229 - DNA, 18 bp, Homo sapiens
gccctgttccgcctcact

SEQ ID NO: 611230 - DNA, 21 bp, Homo sapiens
gccctgttccgcctcactggg

SEQ ID NO: 611231 - DNA, 22 bp, Homo sapiens
gccctgttccgcctcactgggt

SEQ ID NO: 611232 - DNA, 14 bp, Homo sapiens
gcccttcccaacct

SEQ ID NO: 611233 - DNA, 17 bp, Homo sapiens
gcccttgctctacctgg

SEQ ID NO: 611234 - DNA, 20 bp, Homo sapiens
gcccttgctctacctggccg

SEQ ID NO: 611235 - DNA, 16 bp, Homo sapiens
gccgaagccccttgga

SEQ ID NO: 611236 - DNA, 17 bp, Homo sapiens
gccgaagggcagccccg

SEQ ID NO: 611237 - DNA, 13 bp, Homo sapiens
gccgcagggcgct

SEQ ID NO: 611238 - DNA, 19 bp, Homo sapiens
gccgcagggcgctccggca

SEQ ID NO: 611239 - DNA, 15 bp, Homo sapiens
gccgcatctgcctgg

SEQ ID NO: 611240 - DNA, 16 bp, Homo sapiens
gccgcatctgcctgga

SEQ ID NO: 611241 - DNA, 18 bp, Homo sapiens
gccgccgaagggcagccc

SEQ ID NO: 611242 - DNA, 14 bp, Homo sapiens
gccgcctccctcac

SEQ ID NO: 611243 - DNA, 16 bp, Homo sapiens
gccgcctccctcaccc

SEQ ID NO: 611244 - DNA, 13 bp, Homo sapiens
gccgcctcgcccc

SEQ ID NO: 611245 - DNA, 20 bp, Homo sapiens
gccgcctcgggccgcctcct

SEQ ID NO: 611246 - DNA, 15 bp, Homo sapiens
gccgcgctctgcccc

SEQ ID NO: 611247 - DNA, 23 bp, Homo sapiens
gccgctgcagtcagcacagagag

SEQ ID NO: 611248 - DNA, 21 bp, Homo sapiens
gccgcttaaacatttccctgc

SEQ ID NO: 611249 - DNA, 22 bp, Homo sapiens
gccgcttaaacatttccctgct

SEQ ID NO: 611250 - DNA, 16 bp, Homo sapiens
gccggctggccggtcc

SEQ ID NO: 611251 - DNA, 20 bp, Homo sapiens
gccggggctgccgcatctgc

SEQ ID NO: 611252 - DNA, 18 bp, Homo sapiens
gccggggctggccctgcc

SEQ ID NO: 611253 - DNA, 17 bp, Homo sapiens
gccggtaggctgctggc

SEQ ID NO: 611254 - DNA, 13 bp, Homo sapiens
gccggtccacccc

SEQ ID NO: 611255 - DNA, 19 bp, Homo sapiens
gccgtccctgacttcccag

SEQ ID NO: 611256 - DNA, 21 bp, Homo sapiens
gccgtctttggttcctcatgg

SEQ ID NO: 611257 - DNA, 14 bp, Homo sapiens
gccgtggagcttgg

SEQ ID NO: 611258 - DNA, 19 bp, Homo sapiens
gccgtggagcttggagccc

SEQ ID NO: 611259 - DNA, 16 bp, Homo sapiens
gcctatcctaagagct

SEQ ID NO: 611260 - DNA, 15 bp, Homo sapiens
gcctatggaaagggt

SEQ ID NO: 611261 - DNA, 22 bp, Homo sapiens
gcctatggaaagggtgtggctt

SEQ ID NO: 611262 - DNA, 21 bp, Homo sapiens
gcctatttcagtggcacgtca

SEQ ID NO: 611263 - DNA, 15 bp, Homo sapiens
gcctcaattttggtt

SEQ ID NO: 611264 - DNA, 16 bp, Homo sapiens
gcctcagccagtggca

SEQ ID NO: 611265 - DNA, 19 bp, Homo sapiens
gcctcagccagtggcacag

SEQ ID NO: 611266 - DNA, 15 bp, Homo sapiens
gcctcagggaccaag

SEQ ID NO: 611267 - DNA, 21 bp, Homo sapiens
gcctcagggaccaaggagatg

SEQ ID NO: 611268 - DNA, 21 bp, Homo sapiens
gcctcatgaccctcctgtcca

SEQ ID NO: 611269 - DNA, 17 bp, Homo sapiens
gcctccatgccccagct

SEQ ID NO: 611270 - DNA, 12 bp, Homo sapiens
gcctcccccagg

SEQ ID NO: 611271 - DNA, 16 bp, Homo sapiens
gcctcccccaggctgc

SEQ ID NO: 611272 - DNA, 20 bp, Homo sapiens
gcctcccccaggctgcgcct

SEQ ID NO: 611273 - DNA, 21 bp, Homo sapiens
gcctccccgggggtccccgga

SEQ ID NO: 611274 - DNA, 15 bp, Homo sapiens
gcctcccgccgcctc

SEQ ID NO: 611275 - DNA, 12 bp, Homo sapiens
gcctccctcacc

SEQ ID NO: 611276 - DNA, 21 bp, Homo sapiens
gcctccctcgggctggtgtct

SEQ ID NO: 611277 - DNA, 14 bp, Homo sapiens
gcctcctcctgcat

SEQ ID NO: 611278 - DNA, 16 bp, Homo sapiens
gcctcctcctgcatgt

SEQ ID NO: 611279 - DNA, 13 bp, Homo sapiens
gcctcgccccagc

SEQ ID NO: 611280 - DNA, 14 bp, Homo sapiens
gcctcgccccagcc

SEQ ID NO: 611281 - DNA, 19 bp, Homo sapiens
gcctcgccccagccaagcc

SEQ ID NO: 611282 - DNA, 15 bp, Homo sapiens
gcctcgggccgcctc

SEQ ID NO: 611283 - DNA, 17 bp, Homo sapiens
gcctcgggccgcctcct

SEQ ID NO: 611284 - DNA, 18 bp, Homo sapiens
gcctcgggccgcctcctc

SEQ ID NO: 611285 - DNA, 14 bp, Homo sapiens
gcctcgttggagag

SEQ ID NO: 611286 - DNA, 19 bp, Homo sapiens
gcctcgttggagagcagca

SEQ ID NO: 611287 - DNA, 15 bp, Homo sapiens
gcctctatccctggc

SEQ ID NO: 611288 - DNA, 12 bp, Homo sapiens
gcctctccgccc

SEQ ID NO: 611289 - DNA, 14 bp, Homo sapiens
gcctctgcccctct

SEQ ID NO: 611290 - DNA, 19 bp, Homo sapiens
gcctctgcccctcttccct

SEQ ID NO: 611291 - DNA, 13 bp, Homo sapiens
gcctcttaaaaat

SEQ ID NO: 611292 - DNA, 14 bp, Homo sapiens
gcctcttaaaaatt

SEQ ID NO: 611293 - DNA, 23 bp, Homo sapiens
gcctcttgttcttagggcttgga

SEQ ID NO: 611294 - DNA, 14 bp, Homo sapiens
gcctgaaagataca

SEQ ID NO: 611295 - DNA, 15 bp, Homo sapiens
gcctgactcctgggt

SEQ ID NO: 611296 - DNA, 21 bp, Homo sapiens
gcctgactttggggacaccct

SEQ ID NO: 611297 - DNA, 12 bp, Homo sapiens
gcctgagccaca

SEQ ID NO: 611298 - DNA, 14 bp, Homo sapiens
gcctgagccacagt

SEQ ID NO: 611299 - DNA, 17 bp, Homo sapiens
gcctgagccacagtggg

SEQ ID NO: 611300 - DNA, 16 bp, Homo sapiens
gcctgagctccaccct

SEQ ID NO: 611301 - DNA, 17 bp, Homo sapiens
gcctgagctccaccctc

SEQ ID NO: 611302 - DNA, 21 bp, Homo sapiens
gcctgagctccaccctcccct

SEQ ID NO: 611303 - DNA, 10 bp, Homo sapiens
gcctgaggag

SEQ ID NO: 611304 - DNA, 19 bp, Homo sapiens
gcctgaggaggaggacaca

SEQ ID NO: 611305 - DNA, 18 bp, Homo sapiens
gcctgagggaagcccacc

SEQ ID NO: 611306 - DNA, 14 bp, Homo sapiens
gcctgatggccagg

SEQ ID NO: 611307 - DNA, 17 bp, Homo sapiens
gcctgcaggcaggtggg

SEQ ID NO: 611308 - DNA, 23 bp, Homo sapiens
gcctgcaggcaggtgggggctgc

SEQ ID NO: 611309 - DNA, 13 bp, Homo sapiens
gcctgcatggaga

SEQ ID NO: 611310 - DNA, 21 bp, Homo sapiens
gcctgccaggccctccagcag

SEQ ID NO: 611311 - DNA, 12 bp, Homo sapiens
gcctgcccccct

SEQ ID NO: 611312 - DNA, 21 bp, Homo sapiens
gcctgccccccttcccacccc

SEQ ID NO: 611313 - DNA, 22 bp, Homo sapiens
gcctgccccccttcccacccct

SEQ ID NO: 611314 - DNA, 13 bp, Homo sapiens
gcctgcgcctcct

SEQ ID NO: 611315 - DNA, 14 bp, Homo sapiens
ggacagcctgcaca

SEQ ID NO: 611316 - DNA, 22 bp, Homo sapiens
ggacagcggcccggcccacgca

SEQ ID NO: 611317 - DNA, 21 bp, Homo sapiens
ggacccccccagtccgccccg

SEQ ID NO: 611318 - DNA, 13 bp, Homo sapiens
ggacccctgccct

SEQ ID NO: 611319 - DNA, 16 bp, Homo sapiens
ggaccggagcggctga

SEQ ID NO: 611320 - DNA, 19 bp, Homo sapiens
ggacgagcagagcgcagcc

SEQ ID NO: 611321 - DNA, 12 bp, Homo sapiens
ggacgcccagcc

SEQ ID NO: 611322 - DNA, 15 bp, Homo sapiens
ggacgcccagccccc

SEQ ID NO: 611323 - DNA, 16 bp, Homo sapiens
ggacgcccagccccca

SEQ ID NO: 611324 - DNA, 12 bp, Homo sapiens
ggacgctggaga

SEQ ID NO: 611325 - DNA, 13 bp, Homo sapiens
ggacgggacagcg

SEQ ID NO: 611326 - DNA, 16 bp, Homo sapiens
ggacgtgggctccagg

SEQ ID NO: 611327 - DNA, 14 bp, Homo sapiens
ggactgaagaaaat

SEQ ID NO: 611328 - DNA, 22 bp, Homo sapiens
ggactgaccttcggcagtggct

SEQ ID NO: 611329 - DNA, 21 bp, Homo sapiens
ggactgctttcagtgcctgct

SEQ ID NO: 611330 - DNA, 23 bp, Homo sapiens
ggactgctttcagtgcctgctgt

SEQ ID NO: 611331 - DNA, 19 bp, Homo sapiens
ggacttctaaaggcggagg

SEQ ID NO: 611332 - DNA, 16 bp, Homo sapiens
ggagaaggcctgcccc

SEQ ID NO: 611333 - DNA, 19 bp, Homo sapiens
ggagaccctatttgtttca

SEQ ID NO: 611334 - DNA, 21 bp, Homo sapiens
ggagaccctgcgcccctgccc

SEQ ID NO: 611335 - DNA, 15 bp, Homo sapiens
ggagactaacttatt

SEQ ID NO: 611336 - DNA, 20 bp, Homo sapiens
ggagactaacttattttgat

SEQ ID NO: 611337 - DNA, 18 bp, Homo sapiens
ggagactccaaggagcta

SEQ ID NO: 611338 - DNA, 15 bp, Homo sapiens
ggagactgagcttga

SEQ ID NO: 611339 - DNA, 22 bp, Homo sapiens
ggagagagaggctgcctcagcc

SEQ ID NO: 611340 - DNA, 16 bp, Homo sapiens
ggagagcgccacccgc

SEQ ID NO: 611341 - DNA, 14 bp, Homo sapiens
ggagaggagtgcgc

SEQ ID NO: 611342 - DNA, 15 bp, Homo sapiens
ggagagtggcaggtg

SEQ ID NO: 611343 - DNA, 14 bp, Homo sapiens
ggagatgaggctgg

SEQ ID NO: 611344 - DNA, 15 bp, Homo sapiens
ggagattgctctggg

SEQ ID NO: 611345 - DNA, 14 bp, Homo sapiens
ggagcacagccata

SEQ ID NO: 611346 - DNA, 16 bp, Homo sapiens
ggagcacccccagcct

SEQ ID NO: 611347 - DNA, 19 bp, Homo sapiens
ggagcacccccagcctccc

SEQ ID NO: 611348 - DNA, 22 bp, Homo sapiens
ggagcacccccagcctccccca

SEQ ID NO: 611349 - DNA, 22 bp, Homo sapiens
ggagcactagaatgagaaatca

SEQ ID NO: 611350 - DNA, 16 bp, Homo sapiens
ggagcagagacggcag

SEQ ID NO: 611351 - DNA, 20 bp, Homo sapiens
ggagcagagacggcagcccc

SEQ ID NO: 611352 - DNA, 11 bp, Homo sapiens
ggagccagggc

SEQ ID NO: 611353 - DNA, 13 bp, Homo sapiens
ggagcccccgccc

SEQ ID NO: 611354 - DNA, 13 bp, Homo sapiens
ggagccccctggc

SEQ ID NO: 611355 - DNA, 17 bp, Homo sapiens
ggagccccctggcggca

SEQ ID NO: 611356 - DNA, 18 bp, Homo sapiens
ggagccccctggcggcag

SEQ ID NO: 611357 - DNA, 20 bp, Homo sapiens
ggagccccctggcggcaggg

SEQ ID NO: 611358 - DNA, 21 bp, Homo sapiens
ggagccccctggcggcagggg

SEQ ID NO: 611359 - DNA, 14 bp, Homo sapiens
ggagcctgggcagc

SEQ ID NO: 611360 - DNA, 18 bp, Homo sapiens
ggagccttgctgggccag

SEQ ID NO: 611361 - DNA, 21 bp, Homo sapiens
ggagccttgctgggccaggga

SEQ ID NO: 611362 - DNA, 17 bp, Homo sapiens
ggagctactgacattcc

SEQ ID NO: 611363 - DNA, 13 bp, Homo sapiens
ggagcttccagat

SEQ ID NO: 611364 - DNA, 15 bp, Homo sapiens
ggagcttccagatgg

SEQ ID NO: 611365 - DNA, 17 bp, Homo sapiens
ggagcttggagccccct

SEQ ID NO: 611366 - DNA, 21 bp, Homo sapiens
ggaggacacagcacaagggca

SEQ ID NO: 611367 - DNA, 13 bp, Homo sapiens
ggaggacagggag

SEQ ID NO: 611368 - DNA, 14 bp, Homo sapiens
ggaggacagggagg

SEQ ID NO: 611369 - DNA, 13 bp, Homo sapiens
ggaggacccctgc

SEQ ID NO: 611370 - DNA, 19 bp, Homo sapiens
ggaggacccctgccctcgg

SEQ ID NO: 611371 - DNA, 15 bp, Homo sapiens
ggaggagcaccccca

SEQ ID NO: 611372 - DNA, 19 bp, Homo sapiens
ggaggagccttgctgggcc

SEQ ID NO: 611373 - DNA, 21 bp, Homo sapiens
ggaggagccttgctgggccag

SEQ ID NO: 611374 - DNA, 22 bp, Homo sapiens
ggaggagccttgctgggccagg

SEQ ID NO: 611375 - DNA, 15 bp, Homo sapiens
ggaggaggagccttg

SEQ ID NO: 611376 - DNA, 15 bp, Homo sapiens
ggaggaggaggagga

SEQ ID NO: 611377 - DNA, 21 bp, Homo sapiens
ggaggcatgtgatgagaggaa

SEQ ID NO: 611378 - DNA, 14 bp, Homo sapiens
ggaggcccctgagg

SEQ ID NO: 611379 - DNA, 22 bp, Homo sapiens
ggaggccgactgggctgctggg

SEQ ID NO: 611380 - DNA, 16 bp, Homo sapiens
ggaggcctggtctgga

SEQ ID NO: 611381 - DNA, 12 bp, Homo sapiens
ggaggcgcccac

SEQ ID NO: 611382 - DNA, 14 bp, Homo sapiens
ggaggcgcccacct

SEQ ID NO: 611383 - DNA, 16 bp, Homo sapiens
ggaggcgcccacctgc

SEQ ID NO: 611384 - DNA, 18 bp, Homo sapiens
ggaggcgcccacctgccc

SEQ ID NO: 611385 - DNA, 20 bp, Homo sapiens
ggaggcgcccacctgcccag

SEQ ID NO: 611386 - DNA, 12 bp, Homo sapiens
ggaggctgagat

SEQ ID NO: 611387 - DNA, 11 bp, Homo sapiens
ggaggctgctg

SEQ ID NO: 611388 - DNA, 21 bp, Homo sapiens
ggaggctgctgccccctggct

SEQ ID NO: 611389 - DNA, 13 bp, Homo sapiens
ggaggggcttgga

SEQ ID NO: 611390 - DNA, 16 bp, Homo sapiens
ggagggtctccctggg

SEQ ID NO: 611391 - DNA, 15 bp, Homo sapiens
ggagggtgcccctgg

SEQ ID NO: 611392 - DNA, 16 bp, Homo sapiens
ggagggtgcccctggg

SEQ ID NO: 611393 - DNA, 12 bp, Homo sapiens
ggaggtggcagg

SEQ ID NO: 611394 - DNA, 18 bp, Homo sapiens
ggagtccactttcctctc

SEQ ID NO: 611395 - DNA, 16 bp, Homo sapiens
ggagtctgaaggagag

SEQ ID NO: 611396 - DNA, 17 bp, Homo sapiens
ggagtctgaaggagagg

SEQ ID NO: 611397 - DNA, 16 bp, Homo sapiens
ggagtgagaaattttt

SEQ ID NO: 611398 - DNA, 12 bp, Homo sapiens
ggagtgcagtgg

SEQ ID NO: 611399 - DNA, 17 bp, Homo sapiens
ggagtggaggggtcagc

SEQ ID NO: 611400 - DNA, 17 bp, Homo sapiens
ggagtttccatttggat

SEQ ID NO: 611401 - DNA, 14 bp, Homo sapiens
ggataattttcatt

SEQ ID NO: 611402 - DNA, 15 bp, Homo sapiens
ggataggagggtgcc

SEQ ID NO: 611403 - DNA, 22 bp, Homo sapiens
ggataggagggtgcccctggga

SEQ ID NO: 611404 - DNA, 11 bp, Homo sapiens
ggatataaatc

SEQ ID NO: 611405 - DNA, 16 bp, Homo sapiens
ggatatagcaacatct

SEQ ID NO: 611406 - DNA, 15 bp, Homo sapiens
ggatatgaaagagaa

SEQ ID NO: 611407 - DNA, 16 bp, Homo sapiens
ggatatttttaattta

SEQ ID NO: 611408 - DNA, 15 bp, Homo sapiens
ggatccagagagaag

SEQ ID NO: 611409 - DNA, 15 bp, Homo sapiens
ggatcctgagccaga

SEQ ID NO: 611410 - DNA, 16 bp, Homo sapiens
ggatcctgagccagat

SEQ ID NO: 611411 - DNA, 19 bp, Homo sapiens
ggatcctgagccagatttc

SEQ ID NO: 611412 - DNA, 21 bp, Homo sapiens
ggatcgtggaagaagggccac

SEQ ID NO: 611413 - DNA, 19 bp, Homo sapiens
ggatctaaaaggaggacag

SEQ ID NO: 611414 - DNA, 15 bp, Homo sapiens
ggatgaagaccctat

SEQ ID NO: 611415 - DNA, 23 bp, Homo sapiens
ggatgaaggcaaaaactgtactg

SEQ ID NO: 611416 - DNA, 14 bp, Homo sapiens
ggatgcccctggcc

SEQ ID NO: 611417 - DNA, 21 bp, Homo sapiens
ggatgcccctggccctgcctc

SEQ ID NO: 611418 - DNA, 16 bp, Homo sapiens
ggatggaatcacagcc

SEQ ID NO: 611419 - DNA, 23 bp, Homo sapiens
ggatgggggtcctggtatgtctc

SEQ ID NO: 611420 - DNA, 21 bp, Homo sapiens
ggatgtaatatagggtttgtt

SEQ ID NO: 611421 - DNA, 22 bp, Homo sapiens
ggatgtgcacggcagcttgagc

SEQ ID NO: 611422 - DNA, 16 bp, Homo sapiens
ggattcccctggacat

SEQ ID NO: 611423 - DNA, 14 bp, Homo sapiens
ggattcctcccctg

SEQ ID NO: 611424 - DNA, 19 bp, Homo sapiens
ggattcttttttcaatgta

SEQ ID NO: 611425 - DNA, 14 bp, Homo sapiens
ggattttaaacaaa

SEQ ID NO: 611426 - DNA, 16 bp, Homo sapiens
ggcaaacttttatgca

SEQ ID NO: 611427 - DNA, 22 bp, Homo sapiens
ggcaacctgacagcaaacacag

SEQ ID NO: 611428 - DNA, 17 bp, Homo sapiens
ggcaagctcatagcaca

SEQ ID NO: 611429 - DNA, 15 bp, Homo sapiens
ggcaccctgcaggca

SEQ ID NO: 611430 - DNA, 18 bp, Homo sapiens
ggcaccctgcaggcaggc

SEQ ID NO: 611431 - DNA, 19 bp, Homo sapiens
ggcaccctgcaggcaggca

SEQ ID NO: 611432 - DNA, 23 bp, Homo sapiens
gggcaaggaagctttggaagcag

SEQ ID NO: 611433 - DNA, 19 bp, Homo sapiens
gggcacatgtatgtccatt

SEQ ID NO: 611434 - DNA, 12 bp, Homo sapiens
gggcacattgcc

SEQ ID NO: 611435 - DNA, 23 bp, Homo sapiens
gggcacgggagagcgccacccgc

SEQ ID NO: 611436 - DNA, 16 bp, Homo sapiens
gggcagagctgagtcg

SEQ ID NO: 611437 - DNA, 21 bp, Homo sapiens
gggcagaggaatgtagggcct

SEQ ID NO: 611438 - DNA, 11 bp, Homo sapiens
gggcagcccct

SEQ ID NO: 611439 - DNA, 16 bp, Homo sapiens
gggcagcccctcccca

SEQ ID NO: 611440 - DNA, 12 bp, Homo sapiens
gggcagcccctg

SEQ ID NO: 611441 - DNA, 20 bp, Homo sapiens
gggcaggcagctaggcaggg

SEQ ID NO: 611442 - DNA, 11 bp, Homo sapiens
gggcagggccg

SEQ ID NO: 611443 - DNA, 12 bp, Homo sapiens
gggcagtggaga

SEQ ID NO: 611444 - DNA, 14 bp, Homo sapiens
gggcagtggagagg

SEQ ID NO: 611445 - DNA, 21 bp, Homo sapiens
gggcatccaccttcctgccca

SEQ ID NO: 611446 - DNA, 12 bp, Homo sapiens
gggcatgacacg

SEQ ID NO: 611447 - DNA, 20 bp, Homo sapiens
gggccaagccagggttccag

SEQ ID NO: 611448 - DNA, 23 bp, Homo sapiens
gggccaagccagggttccagaca

SEQ ID NO: 611449 - DNA, 24 bp, Homo sapiens
gggccaagccagggttccagacag

SEQ ID NO: 611450 - DNA, 11 bp, Homo sapiens
gggccaccctg

SEQ ID NO: 611451 - DNA, 16 bp, Homo sapiens
gggccaccctgagcag

SEQ ID NO: 611452 - DNA, 14 bp, Homo sapiens
gggccagcccttgc

SEQ ID NO: 611453 - DNA, 19 bp, Homo sapiens
gggccagcccttgctctac

SEQ ID NO: 611454 - DNA, 20 bp, Homo sapiens
gggccagcccttgctctacc

SEQ ID NO: 611455 - DNA, 14 bp, Homo sapiens
gggccaggaccatg

SEQ ID NO: 611456 - DNA, 13 bp, Homo sapiens
gggccagggcgtg

SEQ ID NO: 611457 - DNA, 17 bp, Homo sapiens
gggccagggtgggaaga

SEQ ID NO: 611458 - DNA, 18 bp, Homo sapiens
gggccagggtgggaagag

SEQ ID NO: 611459 - DNA, 18 bp, Homo sapiens
gggcccagggaggtggca

SEQ ID NO: 611460 - DNA, 14 bp, Homo sapiens
gggcccatggcccc

SEQ ID NO: 611461 - DNA, 15 bp, Homo sapiens
gggcccatggcccca

SEQ ID NO: 611462 - DNA, 16 bp, Homo sapiens
gggcccatggccccag

SEQ ID NO: 611463 - DNA, 21 bp, Homo sapiens
gggcccatggccccagctggc

SEQ ID NO: 611464 - DNA, 23 bp, Homo sapiens
gggccccctctcttaccccgtcc

SEQ ID NO: 611465 - DNA, 23 bp, Homo sapiens
gggcccgagcgcgtgccttcccc

SEQ ID NO: 611466 - DNA, 15 bp, Homo sapiens
gggcccgcactcagg

SEQ ID NO: 611467 - DNA, 19 bp, Homo sapiens
gggcccgcactcaggagca

SEQ ID NO: 611468 - DNA, 21 bp, Homo sapiens
gggccctcagcgtctccccat

SEQ ID NO: 611469 - DNA, 14 bp, Homo sapiens
gggccgcagggcgc

SEQ ID NO: 611470 - DNA, 15 bp, Homo sapiens
gggccgcagggcgct

SEQ ID NO: 611471 - DNA, 23 bp, Homo sapiens
gggccgcagggcgctccggcaga

SEQ ID NO: 611472 - DNA, 13 bp, Homo sapiens
gggccgcctcctc

SEQ ID NO: 611473 - DNA, 13 bp, Homo sapiens
gggcctcccgtcc

SEQ ID NO: 611474 - DNA, 20 bp, Homo sapiens
gggcctcccgtccgtccgcc

SEQ ID NO: 611475 - DNA, 18 bp, Homo sapiens
gggcctgcatggagaagg

SEQ ID NO: 611476 - DNA, 22 bp, Homo sapiens
gggcctgcggggttccctgcgc

SEQ ID NO: 611477 - DNA, 21 bp, Homo sapiens
gggcctgggtccccctcctgc

SEQ ID NO: 611478 - DNA, 15 bp, Homo sapiens
gggcgcctgcgctcc

SEQ ID NO: 611479 - DNA, 20 bp, Homo sapiens
gggcgcctgtcgggcccgca

SEQ ID NO: 611480 - DNA, 14 bp, Homo sapiens
gggcgcgcgccccc

SEQ ID NO: 611481 - DNA, 20 bp, Homo sapiens
gggcgcgcgcccccaggacc

SEQ ID NO: 611482 - DNA, 18 bp, Homo sapiens
gggcgctccggcagaggc

SEQ ID NO: 611483 - DNA, 20 bp, Homo sapiens
gggcgctccggcagaggcag

SEQ ID NO: 611484 - DNA, 16 bp, Homo sapiens
gggcgctgagggcagg

SEQ ID NO: 611485 - DNA, 19 bp, Homo sapiens
gggcggcatccgagcccct

SEQ ID NO: 611486 - DNA, 20 bp, Homo sapiens
gggcggcatccgagcccctg

SEQ ID NO: 611487 - DNA, 16 bp, Homo sapiens
gggcgggccagggtgg

SEQ ID NO: 611488 - DNA, 13 bp, Homo sapiens
gggctaactggcc

SEQ ID NO: 611489 - DNA, 16 bp, Homo sapiens
gggctaactggcccca

SEQ ID NO: 611490 - DNA, 22 bp, Homo sapiens
gggctcacaccggcactgtgca

SEQ ID NO: 611491 - DNA, 19 bp, Homo sapiens
gggctcagatggggcctgg

SEQ ID NO: 611492 - DNA, 12 bp, Homo sapiens
gggctccagagt

SEQ ID NO: 611493 - DNA, 20 bp, Homo sapiens
gggctccagagtaggtgggt

SEQ ID NO: 611494 - DNA, 20 bp, Homo sapiens
gggctctctcacccagcctg

SEQ ID NO: 611495 - DNA, 11 bp, Homo sapiens
gggctgagccc

SEQ ID NO: 611496 - DNA, 19 bp, Homo sapiens
gggctgagcccctcctctc

SEQ ID NO: 611497 - DNA, 20 bp, Homo sapiens
gggctgagcccctcctctcc

SEQ ID NO: 611498 - DNA, 23 bp, Homo sapiens
gggctgcgtccctgctcagccca

SEQ ID NO: 611499 - DNA, 16 bp, Homo sapiens
gggctgctgcactgcc

SEQ ID NO: 611500 - DNA, 11 bp, Homo sapiens
gggctggccct

SEQ ID NO: 611501 - DNA, 15 bp, Homo sapiens
gggctggccctgccc

SEQ ID NO: 611502 - DNA, 17 bp, Homo sapiens
gggctggccctgccctc

SEQ ID NO: 611503 - DNA, 19 bp, Homo sapiens
gggctggccctgccctccc

SEQ ID NO: 611504 - DNA, 21 bp, Homo sapiens
gggctggccctgccctccccc

SEQ ID NO: 611505 - DNA, 23 bp, Homo sapiens
gggctggccctgccctcccccac

SEQ ID NO: 611506 - DNA, 20 bp, Homo sapiens
gggctggtgtcttgagacca

SEQ ID NO: 611507 - DNA, 14 bp, Homo sapiens
gggcttagaatggg

SEQ ID NO: 611508 - DNA, 15 bp, Homo sapiens
gggcttagaatgggg

SEQ ID NO: 611509 - DNA, 15 bp, Homo sapiens
gggcttctccccctc

SEQ ID NO: 611510 - DNA, 20 bp, Homo sapiens
gggcttctccccctcagctc

SEQ ID NO: 611511 - DNA, 16 bp, Homo sapiens
gggcttggaagggcgc

SEQ ID NO: 611512 - DNA, 21 bp, Homo sapiens
gggcttggggtagagaggaca

SEQ ID NO: 611513 - DNA, 15 bp, Homo sapiens
ggggaaaacctcagt

SEQ ID NO: 611514 - DNA, 19 bp, Homo sapiens
ggggacagatcttgagcaa

SEQ ID NO: 611515 - DNA, 14 bp, Homo sapiens
ggggacgcccagcc

SEQ ID NO: 611516 - DNA, 15 bp, Homo sapiens
ggggacgcccagccc

SEQ ID NO: 611517 - DNA, 16 bp, Homo sapiens
ggggacgtggcgctgt

SEQ ID NO: 611518 - DNA, 19 bp, Homo sapiens
ggggactgctttcagtgcc

SEQ ID NO: 611519 - DNA, 17 bp, Homo sapiens
ggggaggacccctgccc

SEQ ID NO: 611520 - DNA, 22 bp, Homo sapiens
ggggaggagcacccccagcctc

SEQ ID NO: 611521 - DNA, 12 bp, Homo sapiens
ggggagggcgct

SEQ ID NO: 611522 - DNA, 22 bp, Homo sapiens
ggggatctaaaaggaggacagg

SEQ ID NO: 611523 - DNA, 23 bp, Homo sapiens
ggggatctaaaaggaggacaggg

SEQ ID NO: 611524 - DNA, 17 bp, Homo sapiens
ggggatgcccctggccc

SEQ ID NO: 611525 - DNA, 19 bp, Homo sapiens
ggggcaagagctcaggaga

SEQ ID NO: 611526 - DNA, 20 bp, Homo sapiens
ggggcaagagctcaggagaa

SEQ ID NO: 611527 - DNA, 14 bp, Homo sapiens
ggggcagagctgag

SEQ ID NO: 611528 - DNA, 12 bp, Homo sapiens
ggggcaggcagc

SEQ ID NO: 611529 - DNA, 19 bp, Homo sapiens
ggggccagaccacgcccct

SEQ ID NO: 611530 - DNA, 10 bp, Homo sapiens
ggggccagga

SEQ ID NO: 611531 - DNA, 11 bp, Homo sapiens
ggggccaggac

SEQ ID NO: 611532 - DNA, 12 bp, Homo sapiens
ggggccaggacc

SEQ ID NO: 611533 - DNA, 17 bp, Homo sapiens
ggggcccatggccccag

SEQ ID NO: 611534 - DNA, 18 bp, Homo sapiens
ggggcccatggccccagc

SEQ ID NO: 611535 - DNA, 14 bp, Homo sapiens
ggggcctgggctgt

SEQ ID NO: 611536 - DNA, 16 bp, Homo sapiens
ggggcgcgcgccccca

SEQ ID NO: 611537 - DNA, 16 bp, Homo sapiens
ggggcgggccagggtg

SEQ ID NO: 611538 - DNA, 16 bp, Homo sapiens
ggggctaactggcccc

SEQ ID NO: 611539 - DNA, 20 bp, Homo sapiens
ggggctacttatattctgca

SEQ ID NO: 611540 - DNA, 20 bp, Homo sapiens
ggggctgccgcatctgcctg

SEQ ID NO: 611541 - DNA, 21 bp, Homo sapiens
ggggctgccgcatctgcctgg

SEQ ID NO: 611542 - DNA, 17 bp, Homo sapiens
ggggctgcgtccctgct

SEQ ID NO: 611543 - DNA, 18 bp, Homo sapiens
ggggctggccctgccctc

SEQ ID NO: 611544 - DNA, 19 bp, Homo sapiens
ggggctggccctgccctcc

SEQ ID NO: 611545 - DNA, 23 bp, Homo sapiens
ggggctggccctgccctccccca

SEQ ID NO: 611546 - DNA, 21 bp, Homo sapiens
ggggctgggaaagaacttgga

SEQ ID NO: 611547 - DNA, 21 bp, Homo sapiens
ggggctggtgggataggaggg

SEQ ID NO: 611548 - DNA, 17 bp, Homo sapiens
gtcagcaaattaattgg

SEQ ID NO: 611549 - DNA, 20 bp, Homo sapiens
gtcagtactttctttctgtg

SEQ ID NO: 611550 - DNA, 14 bp, Homo sapiens
gtcagtattgtttt

SEQ ID NO: 611551 - DNA, 18 bp, Homo sapiens
gtcagtgaagcccaggag

SEQ ID NO: 611552 - DNA, 21 bp, Homo sapiens
gtcagtgaagcccaggaggac

SEQ ID NO: 611553 - DNA, 22 bp, Homo sapiens
gtcagtgagtcagaggcagaac

SEQ ID NO: 611554 - DNA, 19 bp, Homo sapiens
gtcagtgcccatgtgtatg

SEQ ID NO: 611555 - DNA, 22 bp, Homo sapiens
gtcagtgtactctgagtcctca

SEQ ID NO: 611556 - DNA, 13 bp, Homo sapiens
gtcagtttgtgaa

SEQ ID NO: 611557 - DNA, 20 bp, Homo sapiens
gtcatctgtcagcttcccaa

SEQ ID NO: 611558 - DNA, 18 bp, Homo sapiens
gtcattctgctaatttat

SEQ ID NO: 611559 - DNA, 17 bp, Homo sapiens
gtcattggttacaaatt

SEQ ID NO: 611560 - DNA, 23 bp, Homo sapiens
gtcatttcatacaaattttccca

SEQ ID NO: 611561 - DNA, 21 bp, Homo sapiens
gtccaagttgccacattgctt

SEQ ID NO: 611562 - DNA, 18 bp, Homo sapiens
gtccacccccattgtgaa

SEQ ID NO: 611563 - DNA, 23 bp, Homo sapiens
gtccacccccattgtgaatgttg

SEQ ID NO: 611564 - DNA, 17 bp, Homo sapiens
gtccaccccgtcccggc

SEQ ID NO: 611565 - DNA, 22 bp, Homo sapiens
gtccaccccgttgttgtccctg

SEQ ID NO: 611566 - DNA, 18 bp, Homo sapiens
gtccactttcctctctct

SEQ ID NO: 611567 - DNA, 19 bp, Homo sapiens
gtccactttcctctctctc

SEQ ID NO: 611568 - DNA, 15 bp, Homo sapiens
gtccagggtccagcc

SEQ ID NO: 611569 - DNA, 14 bp, Homo sapiens
gtccattgacatgt

SEQ ID NO: 611570 - DNA, 18 bp, Homo sapiens
gtccattgacatgtacag

SEQ ID NO: 611571 - DNA, 23 bp, Homo sapiens
gtccatttaaacccggctgactc

SEQ ID NO: 611572 - DNA, 15 bp, Homo sapiens
gtcccccctgagtgg

SEQ ID NO: 611573 - DNA, 20 bp, Homo sapiens
gtcccccctgagtgggctgg

SEQ ID NO: 611574 - DNA, 14 bp, Homo sapiens
gtccccctcctgca

SEQ ID NO: 611575 - DNA, 16 bp, Homo sapiens
gtccccggacgctggc

SEQ ID NO: 611576 - DNA, 19 bp, Homo sapiens
gtccccggacgctggctcg

SEQ ID NO: 611577 - DNA, 21 bp, Homo sapiens
gtcccggccccgcgcgtgccc

SEQ ID NO: 611578 - DNA, 18 bp, Homo sapiens
gtcccgtgccctgtttcc

SEQ ID NO: 611579 - DNA, 20 bp, Homo sapiens
gtccctaagcacaataaaag

SEQ ID NO: 611580 - DNA, 19 bp, Homo sapiens
gtccctgacttcccagctg

SEQ ID NO: 611581 - DNA, 15 bp, Homo sapiens
gtccctgagggccct

SEQ ID NO: 611582 - DNA, 15 bp, Homo sapiens
gtccctgccagtgtt

SEQ ID NO: 611583 - DNA, 15 bp, Homo sapiens
gtccctgctcagccc

SEQ ID NO: 611584 - DNA, 16 bp, Homo sapiens
gtccctgctcagccca

SEQ ID NO: 611585 - DNA, 18 bp, Homo sapiens
gtccctgctcagcccatc

SEQ ID NO: 611586 - DNA, 17 bp, Homo sapiens
gtcccttacctggctta

SEQ ID NO: 611587 - DNA, 10 bp, Homo sapiens
gtccctttcc

SEQ ID NO: 611588 - DNA, 15 bp, Homo sapiens
gtccgccccgtgctc

SEQ ID NO: 611589 - DNA, 15 bp, Homo sapiens
gtccgcccgcccacc

SEQ ID NO: 611590 - DNA, 16 bp, Homo sapiens
gtccgcccgcccaccc

SEQ ID NO: 611591 - DNA, 17 bp, Homo sapiens
gtccggcctgcagccca

SEQ ID NO: 611592 - DNA, 20 bp, Homo sapiens
gtccgtcctgctcgccctgt

SEQ ID NO: 611593 - DNA, 14 bp, Homo sapiens
gtcctaaatgcaaa

SEQ ID NO: 611594 - DNA, 17 bp, Homo sapiens
gtcctatccccggacgc

SEQ ID NO: 611595 - DNA, 18 bp, Homo sapiens
gtcctcacagcctctccc

SEQ ID NO: 611596 - DNA, 19 bp, Homo sapiens
gtcctcattgttcagaaaa

SEQ ID NO: 611597 - DNA, 21 bp, Homo sapiens
gtcctcattgttcagaaaagc

SEQ ID NO: 611598 - DNA, 18 bp, Homo sapiens
gtcctctcgtagaacctg

SEQ ID NO: 611599 - DNA, 23 bp, Homo sapiens
gtcctctgtccgtctgtcctgcg

SEQ ID NO: 611600 - DNA, 16 bp, Homo sapiens
gtcctgcgcctgcgcc

SEQ ID NO: 611601 - DNA, 21 bp, Homo sapiens
gtcctgcgcctgcgcctcctc

SEQ ID NO: 611602 - DNA, 14 bp, Homo sapiens
gtcctgctcgccct

SEQ ID NO: 611603 - DNA, 15 bp, Homo sapiens
gtcctgctcgccctg

SEQ ID NO: 611604 - DNA, 19 bp, Homo sapiens
gtcctgctcgccctgtgcc

SEQ ID NO: 611605 - DNA, 14 bp, Homo sapiens
gtcctgctgctcgg

SEQ ID NO: 611606 - DNA, 19 bp, Homo sapiens
gtcctgtgtcatctgtcag

SEQ ID NO: 611607 - DNA, 14 bp, Homo sapiens
gtcctttatgtatt

SEQ ID NO: 611608 - DNA, 11 bp, Homo sapiens
gtcgctgtccg

SEQ ID NO: 611609 - DNA, 11 bp, Homo sapiens
gtcggctgggc

SEQ ID NO: 611610 - DNA, 23 bp, Homo sapiens
gtcggctgggcagggccgcaggg

SEQ ID NO: 611611 - DNA, 16 bp, Homo sapiens
gtcgggcatgacacga

SEQ ID NO: 611612 - DNA, 21 bp, Homo sapiens
gtcgggcccgcactcaggagc

SEQ ID NO: 611613 - DNA, 22 bp, Homo sapiens
gtcgggggaggagcacccccag

SEQ ID NO: 611614 - DNA, 21 bp, Homo sapiens
gtcggtgtttggaggctgctg

SEQ ID NO: 611615 - DNA, 13 bp, Homo sapiens
gtctatttctgct

SEQ ID NO: 611616 - DNA, 17 bp, Homo sapiens
gtctatttctgctgaat

SEQ ID NO: 611617 - DNA, 23 bp, Homo sapiens
gtctcaattctgaaggggaaaac

SEQ ID NO: 611618 - DNA, 13 bp, Homo sapiens
gtctcatgtttta

SEQ ID NO: 611619 - DNA, 15 bp, Homo sapiens
gtctccacccctcaa

SEQ ID NO: 611620 - DNA, 12 bp, Homo sapiens
gtctccccatgc

SEQ ID NO: 611621 - DNA, 20 bp, Homo sapiens
gtctccccatgctgggctca

SEQ ID NO: 611622 - DNA, 13 bp, Homo sapiens
gtctccctgggca

SEQ ID NO: 611623 - DNA, 14 bp, Homo sapiens
gtctcctcctccag

SEQ ID NO: 611624 - DNA, 14 bp, Homo sapiens
gtctcctctgtcag

SEQ ID NO: 611625 - DNA, 14 bp, Homo sapiens
gtctcgcagcctga

SEQ ID NO: 611626 - DNA, 17 bp, Homo sapiens
gtctcgcagcctgaagc

SEQ ID NO: 611627 - DNA, 20 bp, Homo sapiens
gtctctacaaaaaaaatcaa

SEQ ID NO: 611628 - DNA, 20 bp, Homo sapiens
gtctctccctaccctcttct

SEQ ID NO: 611629 - DNA, 23 bp, Homo sapiens
gtctctccctaccctcttctcag

SEQ ID NO: 611630 - DNA, 20 bp, Homo sapiens
gtctctttctttccaaaggt

SEQ ID NO: 611631 - DNA, 14 bp, Homo sapiens
gtctgaaggagagg

SEQ ID NO: 611632 - DNA, 17 bp, Homo sapiens
gtctgaaggagaggagt

SEQ ID NO: 611633 - DNA, 22 bp, Homo sapiens
gtctgaaggagaggagtgcgct

SEQ ID NO: 611634 - DNA, 12 bp, Homo sapiens
gtctgagaaatt

SEQ ID NO: 611635 - DNA, 15 bp, Homo sapiens
gtctgagtagttatg

SEQ ID NO: 611636 - DNA, 11 bp, Homo sapiens
gtctgcccctt

SEQ ID NO: 611637 - DNA, 21 bp, Homo sapiens
gtctggcgccaggggcaggca

SEQ ID NO: 611638 - DNA, 18 bp, Homo sapiens
gtctggctgtggcccctc

SEQ ID NO: 611639 - DNA, 21 bp, Homo sapiens
gtctggctgtggcccctcctt

SEQ ID NO: 611640 - DNA, 19 bp, Homo sapiens
gtctgtcccagttaactgt

SEQ ID NO: 611641 - DNA, 17 bp, Homo sapiens
gtctgtcctgcgcctgc

SEQ ID NO: 611642 - DNA, 21 bp, Homo sapiens
gtctgtctctcttttgctctc

SEQ ID NO: 611643 - DNA, 24 bp, Homo sapiens
gtctgtctctcttttgctctctca

SEQ ID NO: 611644 - DNA, 11 bp, Homo sapiens
gtctgtgttct

SEQ ID NO: 611645 - DNA, 17 bp, Homo sapiens
gtcttaactaatgtaaa

SEQ ID NO: 611646 - DNA, 17 bp, Homo sapiens
gtcttattcctaattcc

SEQ ID NO: 611647 - DNA, 17 bp, Homo sapiens
gtcttcaaattgtcttt

SEQ ID NO: 611648 - DNA, 15 bp, Homo sapiens
gtcttcaaccctgcc

SEQ ID NO: 611649 - DNA, 17 bp, Homo sapiens
gtcttcaaccctgccct

SEQ ID NO: 611650 - DNA, 22 bp, Homo sapiens
gtcttcaaccctgccctgcacc

SEQ ID NO: 611651 - DNA, 13 bp, Homo sapiens
gtcttgagtgggc

SEQ ID NO: 611652 - DNA, 18 bp, Homo sapiens
gtcttgagtgggccccct

SEQ ID NO: 611653 - DNA, 18 bp, Homo sapiens
gtcttgctacctcagtca

SEQ ID NO: 611654 - DNA, 23 bp, Homo sapiens
gtcttggtttccatcaaagccct

SEQ ID NO: 611655 - DNA, 18 bp, Homo sapiens
gtcttgtattatcataag

SEQ ID NO: 611656 - DNA, 13 bp, Homo sapiens
gtctttatgattt

SEQ ID NO: 611657 - DNA, 19 bp, Homo sapiens
gtctttatgatttcatgat

SEQ ID NO: 611658 - DNA, 14 bp, Homo sapiens
gtctttctccaaag

SEQ ID NO: 611659 - DNA, 16 bp, Homo sapiens
gtctttctccaaagtt

SEQ ID NO: 611660 - DNA, 16 bp, Homo sapiens
gtctttgctgtttata

SEQ ID NO: 611661 - DNA, 17 bp, Homo sapiens
gtctttggttcctcatg

SEQ ID NO: 611662 - DNA, 20 bp, Homo sapiens
gtctttggttcctcatggct

SEQ ID NO: 611663 - DNA, 21 bp, Homo sapiens
gtctttggttcctcatggctg

SEQ ID NO: 611664 - DNA, 18 bp, Homo sapiens
gtttaagaaatgagaaat

SEQ ID NO: 611665 - DNA, 14 bp, Homo sapiens
gtttaataatatgt

SEQ ID NO: 611666 - DNA, 17 bp, Homo sapiens
gtttaataatatgtaca

SEQ ID NO: 611667 - DNA, 21 bp, Homo sapiens
gtttaataatatgtacaaata

SEQ ID NO: 611668 - DNA, 23 bp, Homo sapiens
gtttaataatatgtacaaataat

SEQ ID NO: 611669 - DNA, 13 bp, Homo sapiens
gtttaatactcat

SEQ ID NO: 611670 - DNA, 13 bp, Homo sapiens
gtttaccctccct

SEQ ID NO: 611671 - DNA, 13 bp, Homo sapiens
gtttactctgtgc

SEQ ID NO: 611672 - DNA, 19 bp, Homo sapiens
gtttagaagagcctgactg

SEQ ID NO: 611673 - DNA, 21 bp, Homo sapiens
gtttagaatcaagtctgtgaa

SEQ ID NO: 611674 - DNA, 21 bp, Homo sapiens
gtttattatagtctgtacttc

SEQ ID NO: 611675 - DNA, 22 bp, Homo sapiens
gtttcagaaagggcagcccctc

SEQ ID NO: 611676 - DNA, 14 bp, Homo sapiens
gtttcagcattccc

SEQ ID NO: 611677 - DNA, 15 bp, Homo sapiens
gtttcagcattccca

SEQ ID NO: 611678 - DNA, 23 bp, Homo sapiens
gtttccaatgccaattcatctca

SEQ ID NO: 611679 - DNA, 19 bp, Homo sapiens
gtttccatcaaagccctcc

SEQ ID NO: 611680 - DNA, 15 bp, Homo sapiens
gtttctgcagtattc

SEQ ID NO: 611681 - DNA, 22 bp, Homo sapiens
gtttgatgaataaaatgtttat

SEQ ID NO: 611682 - DNA, 19 bp, Homo sapiens
gtttgctgtatacaaacag

SEQ ID NO: 611683 - DNA, 16 bp, Homo sapiens
gtttggccctggagcc

SEQ ID NO: 611684 - DNA, 16 bp, Homo sapiens
gtttgggcagtggaga

SEQ ID NO: 611685 - DNA, 15 bp, Homo sapiens
gtttggtatgaaaca

SEQ ID NO: 611686 - DNA, 17 bp, Homo sapiens
gtttgtgaagtgattga

SEQ ID NO: 611687 - DNA, 15 bp, Homo sapiens
gttttaaaaaaataa

SEQ ID NO: 611688 - DNA, 20 bp, Homo sapiens
gttttaaaaaaataaaacat

SEQ ID NO: 611689 - DNA, 23 bp, Homo sapiens
gttttaaagaagtccatgtgata

SEQ ID NO: 611690 - DNA, 18 bp, Homo sapiens
gttttacaaagaaacaaa

SEQ ID NO: 611691 - DNA, 18 bp, Homo sapiens
gttttacaatggctgggt

SEQ ID NO: 611692 - DNA, 22 bp, Homo sapiens
gttttagaaattctataagaga

SEQ ID NO: 611693 - DNA, 16 bp, Homo sapiens
gttttcaagcattgct

SEQ ID NO: 611694 - DNA, 14 bp, Homo sapiens
gttttcttcgtgga

SEQ ID NO: 611695 - DNA, 16 bp, Homo sapiens
gttttcttttaatttt

SEQ ID NO: 611696 - DNA, 18 bp, Homo sapiens
gttttgctttttctgact

SEQ ID NO: 611697 - DNA, 15 bp, Homo sapiens
gttttgggcctccat

SEQ ID NO: 611698 - DNA, 17 bp, Homo sapiens
gttttgtggataagaaa

SEQ ID NO: 611699 - DNA, 13 bp, Homo sapiens
gtttttaagtgct

SEQ ID NO: 611700 - DNA, 21 bp, Homo sapiens
gtttttaagtgctatgcatat

SEQ ID NO: 611701 - DNA, 20 bp, Homo sapiens
gttttttatacttcaaatgt

SEQ ID NO: 611702 - DNA, 17 bp, Homo sapiens
gttttttttctaaaact

SEQ ID NO: 611703 - DNA, 15 bp, Homo sapiens
taaaaaaaaaaatga

SEQ ID NO: 611704 - DNA, 17 bp, Homo sapiens
taaaaaaaatattctgt

SEQ ID NO: 611705 - DNA, 18 bp, Homo sapiens
taaaaaaataaaacattt

SEQ ID NO: 611706 - DNA, 20 bp, Homo sapiens
taaaaaaataatataaatga

SEQ ID NO: 611707 - DNA, 12 bp, Homo sapiens
taaaaagttaat

SEQ ID NO: 611708 - DNA, 21 bp, Homo sapiens
taaaaatagctataaatagtg

SEQ ID NO: 611709 - DNA, 16 bp, Homo sapiens
taaaaattaaagcagc

SEQ ID NO: 611710 - DNA, 19 bp, Homo sapiens
taaaaattaaagcagcaaa

SEQ ID NO: 611711 - DNA, 12 bp, Homo sapiens
taaaacaaaatc

SEQ ID NO: 611712 - DNA, 21 bp, Homo sapiens
taaaacaagagaccacttcct

SEQ ID NO: 611713 - DNA, 12 bp, Homo sapiens
taaaacagtggt

SEQ ID NO: 611714 - DNA, 21 bp, Homo sapiens
taaaaccacagctgggcaggg

SEQ ID NO: 611715 - DNA, 18 bp, Homo sapiens
taaaactaaatagcatgt

SEQ ID NO: 611716 - DNA, 17 bp, Homo sapiens
taaaacttactatggta

SEQ ID NO: 611717 - DNA, 18 bp, Homo sapiens
taaaagaaagatgctgat

SEQ ID NO: 611718 - DNA, 17 bp, Homo sapiens
taaaagaaggtaaataa

SEQ ID NO: 611719 - DNA, 15 bp, Homo sapiens
taaaaggaggacagg

SEQ ID NO: 611720 - DNA, 15 bp, Homo sapiens
taaaagtgatgtgat

SEQ ID NO: 611721 - DNA, 22 bp, Homo sapiens
taaaataaagctaccatgttaa

SEQ ID NO: 611722 - DNA, 16 bp, Homo sapiens
taaaatacacgtgtat

SEQ ID NO: 611723 - DNA, 23 bp, Homo sapiens
taaaatacacgtgtatatgagga

SEQ ID NO: 611724 - DNA, 22 bp, Homo sapiens
taaaatacttctttttacaatg

SEQ ID NO: 611725 - DNA, 19 bp, Homo sapiens
taaaatattttcttaatta

SEQ ID NO: 611726 - DNA, 20 bp, Homo sapiens
taaaatcaccctgactgtgg

SEQ ID NO: 611727 - DNA, 18 bp, Homo sapiens
taaaatggcatttagcac

SEQ ID NO: 611728 - DNA, 18 bp, Homo sapiens
taaaatgtgtttttcagt

SEQ ID NO: 611729 - DNA, 13 bp, Homo sapiens
taaaatgtttatt

SEQ ID NO: 611730 - DNA, 13 bp, Homo sapiens
taaaattattaaa

SEQ ID NO: 611731 - DNA, 19 bp, Homo sapiens
taaaattattaaaaattat

SEQ ID NO: 611732 - DNA, 13 bp, Homo sapiens
taaacaaaattta

SEQ ID NO: 611733 - DNA, 11 bp, Homo sapiens
taaacaaatgg

SEQ ID NO: 611734 - DNA, 16 bp, Homo sapiens
taaacacagtaagata

SEQ ID NO: 611735 - DNA, 22 bp, Homo sapiens
taaacacagtaagataggttct

SEQ ID NO: 611736 - DNA, 18 bp, Homo sapiens
taaacacttctccttaac

SEQ ID NO: 611737 - DNA, 16 bp, Homo sapiens
taaacatagtggtatt

SEQ ID NO: 611738 - DNA, 17 bp, Homo sapiens
taaacatttccctgctg

SEQ ID NO: 611739 - DNA, 16 bp, Homo sapiens
taaacctgtgctttca

SEQ ID NO: 611740 - DNA, 21 bp, Homo sapiens
taaacctgtgctttcatgttt

SEQ ID NO: 611741 - DNA, 12 bp, Homo sapiens
taaactgtgaga

SEQ ID NO: 611742 - DNA, 19 bp, Homo sapiens
taaactgtgagataaatat

SEQ ID NO: 611743 - DNA, 20 bp, Homo sapiens
taaactgtgagataaatatc

SEQ ID NO: 611744 - DNA, 13 bp, Homo sapiens
taaagaaaccttt

SEQ ID NO: 611745 - DNA, 17 bp, Homo sapiens
taaagaaaccttttaaa

SEQ ID NO: 611746 - DNA, 15 bp, Homo sapiens
taaagaaaggcagag

SEQ ID NO: 611747 - DNA, 16 bp, Homo sapiens
taaagaaaggcagaga

SEQ ID NO: 611748 - DNA, 22 bp, Homo sapiens
taaagaggattgggtagcatat

SEQ ID NO: 611749 - DNA, 18 bp, Homo sapiens
taaagatattgtatctcc

SEQ ID NO: 611750 - DNA, 14 bp, Homo sapiens
taaagatctccagt

SEQ ID NO: 611751 - DNA, 13 bp, Homo sapiens
taaagatcttttt

SEQ ID NO: 611752 - DNA, 19 bp, Homo sapiens
taaagatctttttttaagt

SEQ ID NO: 611753 - DNA, 22 bp, Homo sapiens
taaagatctttttttaagtgtt

SEQ ID NO: 611754 - DNA, 16 bp, Homo sapiens
taaaggaaagttctat

SEQ ID NO: 611755 - DNA, 16 bp, Homo sapiens
taaagggaagccctga

SEQ ID NO: 611756 - DNA, 20 bp, Homo sapiens
taaaggggacagatcttgag

SEQ ID NO: 611757 - DNA, 19 bp, Homo sapiens
taaaggtgatgaatttacc

SEQ ID NO: 611758 - DNA, 21 bp, Homo sapiens
taaaggtttcactgttcatga

SEQ ID NO: 611759 - DNA, 23 bp, Homo sapiens
taaagtgtccattgacatgtaca

SEQ ID NO: 611760 - DNA, 13 bp, Homo sapiens
taaataaaaatag

SEQ ID NO: 611761 - DNA, 15 bp, Homo sapiens
taaataaaaatagct

SEQ ID NO: 611762 - DNA, 20 bp, Homo sapiens
taaataatagatgtgaaaat

SEQ ID NO: 611763 - DNA, 18 bp, Homo sapiens
taaataatgattcaatgt

SEQ ID NO: 611764 - DNA, 14 bp, Homo sapiens
taaataatgcttaa

SEQ ID NO: 611765 - DNA, 22 bp, Homo sapiens
taaatatacactttacattctt

SEQ ID NO: 611766 - DNA, 20 bp, Homo sapiens
taaatatcattatagcatgt

SEQ ID NO: 611767 - DNA, 21 bp, Homo sapiens
taaatatcattatagcatgta

SEQ ID NO: 611768 - DNA, 23 bp, Homo sapiens
taaatatctatttatctgtctga

SEQ ID NO: 611769 - DNA, 22 bp, Homo sapiens
taaatattatgccttgagaatg

SEQ ID NO: 611770 - DNA, 15 bp, Homo sapiens
taaatattgctgtct

SEQ ID NO: 611771 - DNA, 21 bp, Homo sapiens
taaatattgctgtctgaaaaa

SEQ ID NO: 611772 - DNA, 22 bp, Homo sapiens
taaatattgctgtctgaaaaag

SEQ ID NO: 611773 - DNA, 21 bp, Homo sapiens
taaatattgtcctgtttcttc

SEQ ID NO: 611774 - DNA, 16 bp, Homo sapiens
taaatattttaggaaa

SEQ ID NO: 611775 - DNA, 17 bp, Homo sapiens
taaatattttaggaaac

SEQ ID NO: 611776 - DNA, 12 bp, Homo sapiens
taaatcacagat

SEQ ID NO: 611777 - DNA, 18 bp, Homo sapiens
taaatcacagatttccaa

SEQ ID NO: 611778 - DNA, 14 bp, Homo sapiens
taaatcactttaat

SEQ ID NO: 611779 - DNA, 23 bp, Homo sapiens
taaatccaatagtctgccacaag

SEQ ID NO: 611780 - DNA, 16 bp, Homo sapiens
tacttgatttttcaaa

SEQ ID NO: 611781 - DNA, 13 bp, Homo sapiens
tacttgtgttcat

SEQ ID NO: 611782 - DNA, 14 bp, Homo sapiens
tacttgtgttcatt

SEQ ID NO: 611783 - DNA, 17 bp, Homo sapiens
tacttgttatgttgtaa

SEQ ID NO: 611784 - DNA, 18 bp, Homo sapiens
tacttgttatgttgtaat

SEQ ID NO: 611785 - DNA, 17 bp, Homo sapiens
tactttaaattgtggat

SEQ ID NO: 611786 - DNA, 22 bp, Homo sapiens
tactttctggtggcaaatgaat

SEQ ID NO: 611787 - DNA, 19 bp, Homo sapiens
tactttctgttatctagaa

SEQ ID NO: 611788 - DNA, 15 bp, Homo sapiens
tacttttatcttaaa

SEQ ID NO: 611789 - DNA, 20 bp, Homo sapiens
tagaaaaaactggaaacatc

SEQ ID NO: 611790 - DNA, 15 bp, Homo sapiens
tagaaactttggaag

SEQ ID NO: 611791 - DNA, 23 bp, Homo sapiens
tagaaactttggaagttttactt

SEQ ID NO: 611792 - DNA, 12 bp, Homo sapiens
tagaaaggcagc

SEQ ID NO: 611793 - DNA, 13 bp, Homo sapiens
tagaaattctata

SEQ ID NO: 611794 - DNA, 20 bp, Homo sapiens
tagaagaaggactgaagaaa

SEQ ID NO: 611795 - DNA, 21 bp, Homo sapiens
tagaagaaggactgaagaaaa

SEQ ID NO: 611796 - DNA, 18 bp, Homo sapiens
tagaatcaagtctgtgaa

SEQ ID NO: 611797 - DNA, 14 bp, Homo sapiens
tagaatgagaaatc

SEQ ID NO: 611798 - DNA, 15 bp, Homo sapiens
tagaatgagaaatca

SEQ ID NO: 611799 - DNA, 19 bp, Homo sapiens
tagaatgagaaatcatgtt

SEQ ID NO: 611800 - DNA, 13 bp, Homo sapiens
tagaatggggctt

SEQ ID NO: 611801 - DNA, 22 bp, Homo sapiens
tagacaatgtggaattacataa

SEQ ID NO: 611802 - DNA, 18 bp, Homo sapiens
tagaccgtggtgtcctct

SEQ ID NO: 611803 - DNA, 19 bp, Homo sapiens
tagagacttctaaatcata

SEQ ID NO: 611804 - DNA, 17 bp, Homo sapiens
tagataccattttgaaa

SEQ ID NO: 611805 - DNA, 22 bp, Homo sapiens
tagatcaactcatgttaattga

SEQ ID NO: 611806 - DNA, 15 bp, Homo sapiens
tagatcattttttgt

SEQ ID NO: 611807 - DNA, 13 bp, Homo sapiens
tagatgaaaaagc

SEQ ID NO: 611808 - DNA, 19 bp, Homo sapiens
tagatgaaaaagcatgtac

SEQ ID NO: 611809 - DNA, 17 bp, Homo sapiens
tagatgtgaaaatgctt

SEQ ID NO: 611810 - DNA, 23 bp, Homo sapiens
tagattcctacttaaacaaaaac

SEQ ID NO: 611811 - DNA, 17 bp, Homo sapiens
tagattttgttttgctt

SEQ ID NO: 611812 - DNA, 20 bp, Homo sapiens
tagcaataagttgaatgata

SEQ ID NO: 611813 - DNA, 21 bp, Homo sapiens
tagcaattgcttctctaaaac

SEQ ID NO: 611814 - DNA, 21 bp, Homo sapiens
tagcacagaggatggcttccc

SEQ ID NO: 611815 - DNA, 13 bp, Homo sapiens
tagcacagtattt

SEQ ID NO: 611816 - DNA, 19 bp, Homo sapiens
tagcacagtatttaacatt

SEQ ID NO: 611817 - DNA, 11 bp, Homo sapiens
tagcaccagct

SEQ ID NO: 611818 - DNA, 19 bp, Homo sapiens
tagcactttgggaggctga

SEQ ID NO: 611819 - DNA, 13 bp, Homo sapiens
tagcagagcctat

SEQ ID NO: 611820 - DNA, 19 bp, Homo sapiens
tagcagctcttcccctttc

SEQ ID NO: 611821 - DNA, 19 bp, Homo sapiens
tagcatactgatgagacaa

SEQ ID NO: 611822 - DNA, 18 bp, Homo sapiens
tagcatatataattttat

SEQ ID NO: 611823 - DNA, 20 bp, Homo sapiens
tagcatatcctcaattatct

SEQ ID NO: 611824 - DNA, 17 bp, Homo sapiens
tagccaacttaaacctg

SEQ ID NO: 611825 - DNA, 16 bp, Homo sapiens
tagccattcatttaca

SEQ ID NO: 611826 - DNA, 12 bp, Homo sapiens
tagcccagtccc

SEQ ID NO: 611827 - DNA, 19 bp, Homo sapiens
tagcccagtccctggagct

SEQ ID NO: 611828 - DNA, 13 bp, Homo sapiens
tagccccaggccc

SEQ ID NO: 611829 - DNA, 20 bp, Homo sapiens
tagccccaggcccgccctgc

SEQ ID NO: 611830 - DNA, 18 bp, Homo sapiens
tagccctctttctctctg

SEQ ID NO: 611831 - DNA, 15 bp, Homo sapiens
tagcctctccgccca

SEQ ID NO: 611832 - DNA, 22 bp, Homo sapiens
tagctagtttaaaattattaaa

SEQ ID NO: 611833 - DNA, 13 bp, Homo sapiens
tagctcacagcac

SEQ ID NO: 611834 - DNA, 20 bp, Homo sapiens
tagctcacagcacatttgtt

SEQ ID NO: 611835 - DNA, 22 bp, Homo sapiens
tagcttctgaaaggtgctttct

SEQ ID NO: 611836 - DNA, 21 bp, Homo sapiens
tagctttaaaaccacagctgg

SEQ ID NO: 611837 - DNA, 13 bp, Homo sapiens
taggaaaaactga

SEQ ID NO: 611838 - DNA, 16 bp, Homo sapiens
taggaaaaactgattt

SEQ ID NO: 611839 - DNA, 15 bp, Homo sapiens
taggaaaattttctt

SEQ ID NO: 611840 - DNA, 19 bp, Homo sapiens
taggaaagcctcactgata

SEQ ID NO: 611841 - DNA, 13 bp, Homo sapiens
taggaatgctcaa

SEQ ID NO: 611842 - DNA, 14 bp, Homo sapiens
taggaatgctcaat

SEQ ID NO: 611843 - DNA, 18 bp, Homo sapiens
taggaatgctcaatgtgc

SEQ ID NO: 611844 - DNA, 22 bp, Homo sapiens
taggaatgctcaatgtgctgtt

SEQ ID NO: 611845 - DNA, 22 bp, Homo sapiens
taggacccaaggtggtcttgga

SEQ ID NO: 611846 - DNA, 12 bp, Homo sapiens
taggagaggaaa

SEQ ID NO: 611847 - DNA, 18 bp, Homo sapiens
taggagcttccagatggg

SEQ ID NO: 611848 - DNA, 16 bp, Homo sapiens
taggaggacagaacca

SEQ ID NO: 611849 - DNA, 17 bp, Homo sapiens
taggagggtgcccctgg

SEQ ID NO: 611850 - DNA, 18 bp, Homo sapiens
taggagggtgcccctggg

SEQ ID NO: 611851 - DNA, 23 bp, Homo sapiens
taggcccccaaattgccttcagc

SEQ ID NO: 611852 - DNA, 16 bp, Homo sapiens
tagggaaaccttggag

SEQ ID NO: 611853 - DNA, 23 bp, Homo sapiens
tagggaaaccttggagaggagag

SEQ ID NO: 611854 - DNA, 17 bp, Homo sapiens
tagggaaatccaactcc

SEQ ID NO: 611855 - DNA, 19 bp, Homo sapiens
tagggaaatccaactccag

SEQ ID NO: 611856 - DNA, 20 bp, Homo sapiens
tagggaaatccaactccagg

SEQ ID NO: 611857 - DNA, 16 bp, Homo sapiens
tagggaattttcattt

SEQ ID NO: 611858 - DNA, 18 bp, Homo sapiens
tagggcctgcatggagaa

SEQ ID NO: 611859 - DNA, 17 bp, Homo sapiens
tagggctctaatttcct

SEQ ID NO: 611860 - DNA, 19 bp, Homo sapiens
tagggttctatatttactg

SEQ ID NO: 611861 - DNA, 23 bp, Homo sapiens
tagggtttgtttgctgcttttga

SEQ ID NO: 611862 - DNA, 12 bp, Homo sapiens
taggtctccacc

SEQ ID NO: 611863 - DNA, 22 bp, Homo sapiens
taggtctgttgaagtgcatgtt

SEQ ID NO: 611864 - DNA, 19 bp, Homo sapiens
taggtgcccagtcttgagt

SEQ ID NO: 611865 - DNA, 17 bp, Homo sapiens
taggttctgctttctga

SEQ ID NO: 611866 - DNA, 22 bp, Homo sapiens
tagtaaataatgattcaatgtg

SEQ ID NO: 611867 - DNA, 21 bp, Homo sapiens
tagtacccaacctggtaatta

SEQ ID NO: 611868 - DNA, 15 bp, Homo sapiens
tagtagctgataaag

SEQ ID NO: 611869 - DNA, 19 bp, Homo sapiens
tagtagctgataaagaaac

SEQ ID NO: 611870 - DNA, 16 bp, Homo sapiens
tagtatagttttcgat

SEQ ID NO: 611871 - DNA, 17 bp, Homo sapiens
tagtcaatcaaacaggg

SEQ ID NO: 611872 - DNA, 22 bp, Homo sapiens
tagtgcctgtgatcgtgtgttg

SEQ ID NO: 611873 - DNA, 15 bp, Homo sapiens
tagtgtcccttacct

SEQ ID NO: 611874 - DNA, 12 bp, Homo sapiens
tagtgttttcat

SEQ ID NO: 611875 - DNA, 12 bp, Homo sapiens
tagttctgcaat

SEQ ID NO: 611876 - DNA, 20 bp, Homo sapiens
tagtttaaaattattaaaaa

SEQ ID NO: 611877 - DNA, 14 bp, Homo sapiens
tagtttacaaacaa

SEQ ID NO: 611878 - DNA, 23 bp, Homo sapiens
tagtttgtgatgtaaggcactgt

SEQ ID NO: 611879 - DNA, 13 bp, Homo sapiens
tagtttgtttctg

SEQ ID NO: 611880 - DNA, 12 bp, Homo sapiens
tagttttccaga

SEQ ID NO: 611881 - DNA, 12 bp, Homo sapiens
tagttttcccta

SEQ ID NO: 611882 - DNA, 23 bp, Homo sapiens
tataaaaaaaatagttgagccag

SEQ ID NO: 611883 - DNA, 18 bp, Homo sapiens
tataaaatacacgtgtat

SEQ ID NO: 611884 - DNA, 23 bp, Homo sapiens
tataaaatacacgtgtatatgag

SEQ ID NO: 611885 - DNA, 13 bp, Homo sapiens
tataaacacagta

SEQ ID NO: 611886 - DNA, 12 bp, Homo sapiens
tataaactgtga

SEQ ID NO: 611887 - DNA, 14 bp, Homo sapiens
tataaactgtgaga

SEQ ID NO: 611888 - DNA, 15 bp, Homo sapiens
tataaactgtgagat

SEQ ID NO: 611889 - DNA, 14 bp, Homo sapiens
tataaatgaatgaa

SEQ ID NO: 611890 - DNA, 16 bp, Homo sapiens
tataaatgaatgaaat

SEQ ID NO: 611891 - DNA, 17 bp, Homo sapiens
tataacatgaaagtcaa

SEQ ID NO: 611892 - DNA, 16 bp, Homo sapiens
tataagacaagtctga

SEQ ID NO: 611893 - DNA, 11 bp, Homo sapiens
tataagccata

SEQ ID NO: 611894 - DNA, 12 bp, Homo sapiens
tataagccatag

SEQ ID NO: 611895 - DNA, 22 bp, Homo sapiens
tataatggcctcttaaaaatta

SEQ ID NO: 611896 - DNA, 23 bp, Homo sapiens
tataatttgccagacagagatca

SEQ ID NO: 611897 - DNA, 18 bp, Homo sapiens
tcaataggaaaaactgat

SEQ ID NO: 611898 - DNA, 21 bp, Homo sapiens
tcaatatatagagacttctaa

SEQ ID NO: 611899 - DNA, 22 bp, Homo sapiens
tcaatatatagagacttctaaa

SEQ ID NO: 611900 - DNA, 14 bp, Homo sapiens
tcaatcaaacaggg

SEQ ID NO: 611901 - DNA, 21 bp, Homo sapiens
tcaatccacagtattgttctt

SEQ ID NO: 611902 - DNA, 15 bp, Homo sapiens
tcaatgctacaaaat

SEQ ID NO: 611903 - DNA, 13 bp, Homo sapiens
tcaatgtactgta

SEQ ID NO: 611904 - DNA, 15 bp, Homo sapiens
tcaatgtactgtatt

SEQ ID NO: 611905 - DNA, 14 bp, Homo sapiens
tcaatgtgaaataa

SEQ ID NO: 611906 - DNA, 20 bp, Homo sapiens
tcaatgtgctgttgattctt

SEQ ID NO: 611907 - DNA, 14 bp, Homo sapiens
tcaatgttaaatct

SEQ ID NO: 611908 - DNA, 15 bp, Homo sapiens
tcaatgttaaatcta

SEQ ID NO: 611909 - DNA, 20 bp, Homo sapiens
tcaatgttaaatctacaaac

SEQ ID NO: 611910 - DNA, 21 bp, Homo sapiens
tcaatgttcacgcaacttgaa

SEQ ID NO: 611911 - DNA, 16 bp, Homo sapiens
tcaattcatatttatg

SEQ ID NO: 611912 - DNA, 22 bp, Homo sapiens
tcaatttttaacttatctccag

SEQ ID NO: 611913 - DNA, 17 bp, Homo sapiens
tcacacaaagtgaaatt

SEQ ID NO: 611914 - DNA, 16 bp, Homo sapiens
tcacaccggcactgtg

SEQ ID NO: 611915 - DNA, 19 bp, Homo sapiens
tcacaccggcactgtgcac

SEQ ID NO: 611916 - DNA, 20 bp, Homo sapiens
tcacaccggcactgtgcact

SEQ ID NO: 611917 - DNA, 20 bp, Homo sapiens
tcacacctcccttcatccca

SEQ ID NO: 611918 - DNA, 20 bp, Homo sapiens
tcacaccttacaaagccagc

SEQ ID NO: 611919 - DNA, 21 bp, Homo sapiens
tcacaccttacaaagccagct

SEQ ID NO: 611920 - DNA, 16 bp, Homo sapiens
tcacactctcttctta

SEQ ID NO: 611921 - DNA, 18 bp, Homo sapiens
tcacactctcttcttact

SEQ ID NO: 611922 - DNA, 13 bp, Homo sapiens
tcacactgagctg

SEQ ID NO: 611923 - DNA, 12 bp, Homo sapiens
tcacacttgggc

SEQ ID NO: 611924 - DNA, 21 bp, Homo sapiens
tcacagatttccaaaagtact

SEQ ID NO: 611925 - DNA, 18 bp, Homo sapiens
tcacagcacatttgttaa

SEQ ID NO: 611926 - DNA, 14 bp, Homo sapiens
tcacagcctctccc

SEQ ID NO: 611927 - DNA, 16 bp, Homo sapiens
tcacagcctctccctt

SEQ ID NO: 611928 - DNA, 21 bp, Homo sapiens
tcacatatgtgcatagataca

SEQ ID NO: 611929 - DNA, 18 bp, Homo sapiens
tcacatgcccctcttaga

SEQ ID NO: 611930 - DNA, 16 bp, Homo sapiens
tcacattcctgaccct

SEQ ID NO: 611931 - DNA, 20 bp, Homo sapiens
tcaccatttaatcatttcca

SEQ ID NO: 611932 - DNA, 16 bp, Homo sapiens
tcaccctgactgtggg

SEQ ID NO: 611933 - DNA, 21 bp, Homo sapiens
tcaccgaaaacgtggctgctt

SEQ ID NO: 611934 - DNA, 23 bp, Homo sapiens
tcaccgagaggaaaaaggcttct

SEQ ID NO: 611935 - DNA, 17 bp, Homo sapiens
tcaccgtcacaataaaa

SEQ ID NO: 611936 - DNA, 15 bp, Homo sapiens
tcacctcacttgtgg

SEQ ID NO: 611937 - DNA, 14 bp, Homo sapiens
tcacctctgaggac

SEQ ID NO: 611938 - DNA, 19 bp, Homo sapiens
tcacctgaataagggactt

SEQ ID NO: 611939 - DNA, 19 bp, Homo sapiens
tcaccttccctagttcttt

SEQ ID NO: 611940 - DNA, 20 bp, Homo sapiens
tcaccttctgttttagagtt

SEQ ID NO: 611941 - DNA, 17 bp, Homo sapiens
tcacgtgaggcccctgt

SEQ ID NO: 611942 - DNA, 20 bp, Homo sapiens
tcactacatgggccagccct

SEQ ID NO: 611943 - DNA, 21 bp, Homo sapiens
tcactacatgggccagccctt

SEQ ID NO: 611944 - DNA, 12 bp, Homo sapiens
tcactccactcc

SEQ ID NO: 611945 - DNA, 13 bp, Homo sapiens
tcactccactccc

SEQ ID NO: 611946 - DNA, 17 bp, Homo sapiens
tcactccactcccctca

SEQ ID NO: 611947 - DNA, 15 bp, Homo sapiens
tcactccctgtcata

SEQ ID NO: 611948 - DNA, 18 bp, Homo sapiens
tcactgtgacctgctcct

SEQ ID NO: 611949 - DNA, 21 bp, Homo sapiens
tcactgtgacctgctcctgcc

SEQ ID NO: 611950 - DNA, 23 bp, Homo sapiens
tcactgtgacctgctcctgccca

SEQ ID NO: 611951 - DNA, 21 bp, Homo sapiens
tcacttttttataaattataa

SEQ ID NO: 611952 - DNA, 15 bp, Homo sapiens
tcacttttttcctgt

SEQ ID NO: 611953 - DNA, 21 bp, Homo sapiens
tcacttttttcctgtcaatat

SEQ ID NO: 611954 - DNA, 20 bp, Homo sapiens
tcagaaagggcagcccctcc

SEQ ID NO: 611955 - DNA, 14 bp, Homo sapiens
tcagaagtgaaaaa

SEQ ID NO: 611956 - DNA, 21 bp, Homo sapiens
tcagaatgttgtgttggtatt

SEQ ID NO: 611957 - DNA, 22 bp, Homo sapiens
tcagaattgaaccgtcaatgtg

SEQ ID NO: 611958 - DNA, 22 bp, Homo sapiens
tcagaattgtttttagaaattt

SEQ ID NO: 611959 - DNA, 14 bp, Homo sapiens
tcagactctctcct

SEQ ID NO: 611960 - DNA, 16 bp, Homo sapiens
tcagactgctttgaga

SEQ ID NO: 611961 - DNA, 13 bp, Homo sapiens
tcagagctaggcc

SEQ ID NO: 611962 - DNA, 18 bp, Homo sapiens
tcagaggcagagacctcc

SEQ ID NO: 611963 - DNA, 16 bp, Homo sapiens
tcagatccctcggtca

SEQ ID NO: 611964 - DNA, 19 bp, Homo sapiens
tcagatccttccaaactct

SEQ ID NO: 611965 - DNA, 13 bp, Homo sapiens
tcagatgtttcca

SEQ ID NO: 611966 - DNA, 22 bp, Homo sapiens
tcagattgtaaaggtaggtgca

SEQ ID NO: 611967 - DNA, 24 bp, Homo sapiens
tcagattgtaaaggtaggtgcatg

SEQ ID NO: 611968 - DNA, 12 bp, Homo sapiens
tcagcacagaga

SEQ ID NO: 611969 - DNA, 21 bp, Homo sapiens
tcagcaccgtggtgtgaggcc

SEQ ID NO: 611970 - DNA, 16 bp, Homo sapiens
tcagcatagagctata

SEQ ID NO: 611971 - DNA, 19 bp, Homo sapiens
tcagcatagagctatatat

SEQ ID NO: 611972 - DNA, 15 bp, Homo sapiens
tcagcatcctggaaa

SEQ ID NO: 611973 - DNA, 20 bp, Homo sapiens
tcagcatcctggaaatttgt

SEQ ID NO: 611974 - DNA, 22 bp, Homo sapiens
tcagcatcctggaaatttgtgt

SEQ ID NO: 611975 - DNA, 21 bp, Homo sapiens
tcagcattcccaattatcaaa

SEQ ID NO: 611976 - DNA, 18 bp, Homo sapiens
tcagcccatcccctgcct

SEQ ID NO: 611977 - DNA, 19 bp, Homo sapiens
tcagcccatcccctgcctc

SEQ ID NO: 611978 - DNA, 15 bp, Homo sapiens
tcagcccctcagaga

SEQ ID NO: 611979 - DNA, 12 bp, Homo sapiens
tcagcctgtgaa

SEQ ID NO: 611980 - DNA, 16 bp, Homo sapiens
tcagctccactctgaa

SEQ ID NO: 611981 - DNA, 14 bp, Homo sapiens
tcagctctgcataa

SEQ ID NO: 611982 - DNA, 12 bp, Homo sapiens
tcaggaatgggc

SEQ ID NO: 611983 - DNA, 21 bp, Homo sapiens
tcaggagaaggcctgcccccc

SEQ ID NO: 611984 - DNA, 15 bp, Homo sapiens
tcaggagcacagcca

SEQ ID NO: 611985 - DNA, 22 bp, Homo sapiens
tcagggagggctgttcaagttt

SEQ ID NO: 611986 - DNA, 15 bp, Homo sapiens
tcaggtaaactgatg

SEQ ID NO: 611987 - DNA, 17 bp, Homo sapiens
tcaggtggcatttgcag

SEQ ID NO: 611988 - DNA, 16 bp, Homo sapiens
tcagtagtgcctgtga

SEQ ID NO: 611989 - DNA, 22 bp, Homo sapiens
tcagtatgctttccctgaggaa

SEQ ID NO: 611990 - DNA, 22 bp, Homo sapiens
tcagtattgagacactgtcaag

SEQ ID NO: 611991 - DNA, 14 bp, Homo sapiens
tcagtattgttttg

SEQ ID NO: 611992 - DNA, 23 bp, Homo sapiens
tcagtccacccccattgtgaatg

SEQ ID NO: 611993 - DNA, 21 bp, Homo sapiens
tcagtctatgctgtgtgcaga

SEQ ID NO: 611994 - DNA, 18 bp, Homo sapiens
tcagtgcagggacagcct

SEQ ID NO: 611995 - DNA, 17 bp, Homo sapiens
tcagtgcccatgtgtat

SEQ ID NO: 611996 - DNA, 18 bp, Homo sapiens
tcagtgcccatgtgtatg

SEQ ID NO: 611997 - DNA, 15 bp, Homo sapiens
tcagtgcctgctgtt

SEQ ID NO: 611998 - DNA, 16 bp, Homo sapiens
tcagtgcctgctgttc

SEQ ID NO: 611999 - DNA, 12 bp, Homo sapiens
tcagtgccttat

SEQ ID NO: 612000 - DNA, 16 bp, Homo sapiens
tcagtgccttatggaa

SEQ ID NO: 612001 - DNA, 18 bp, Homo sapiens
tcagtgccttatggaaca

SEQ ID NO: 612002 - DNA, 20 bp, Homo sapiens
tcagtgccttatggaacact

SEQ ID NO: 612003 - DNA, 23 bp, Homo sapiens
tcagtgccttatggaacactctg

SEQ ID NO: 612004 - DNA, 17 bp, Homo sapiens
tcagtgctagcttattt

SEQ ID NO: 612005 - DNA, 20 bp, Homo sapiens
tcagtttgtgaagtgattga

SEQ ID NO: 612006 - DNA, 21 bp, Homo sapiens
tcataaattatttctaaaaca

SEQ ID NO: 612007 - DNA, 14 bp, Homo sapiens
tcataagtaaatgt

SEQ ID NO: 612008 - DNA, 22 bp, Homo sapiens
tcataagttagatgttttagtt

SEQ ID NO: 612009 - DNA, 21 bp, Homo sapiens
tcatacaaaggacagtacaca

SEQ ID NO: 612010 - DNA, 22 bp, Homo sapiens
tcatacacagaaatcctaacat

SEQ ID NO: 612011 - DNA, 22 bp, Homo sapiens
tcatacagtggtattgctagtt

SEQ ID NO: 612012 - DNA, 19 bp, Homo sapiens
tcccttcacatagttttta

SEQ ID NO: 612013 - DNA, 23 bp, Homo sapiens
tccctttatcatgtgtttctgtg

SEQ ID NO: 612014 - DNA, 13 bp, Homo sapiens
tccctttccccat

SEQ ID NO: 612015 - DNA, 14 bp, Homo sapiens
tccctttccctgca

SEQ ID NO: 612016 - DNA, 18 bp, Homo sapiens
tcccttttcacctgaaat

SEQ ID NO: 612017 - DNA, 18 bp, Homo sapiens
tccgcacgcggccgctct

SEQ ID NO: 612018 - DNA, 22 bp, Homo sapiens
tccgcacgcggccgctctccgc

SEQ ID NO: 612019 - DNA, 16 bp, Homo sapiens
tccgccccgtgctcct

SEQ ID NO: 612020 - DNA, 15 bp, Homo sapiens
tccgcccgcccaccc

SEQ ID NO: 612021 - DNA, 16 bp, Homo sapiens
tccgcccgcccacccc

SEQ ID NO: 612022 - DNA, 13 bp, Homo sapiens
tccgcccttccct

SEQ ID NO: 612023 - DNA, 13 bp, Homo sapiens
tccgcctcactgg

SEQ ID NO: 612024 - DNA, 19 bp, Homo sapiens
tccgcgtggttctgccact

SEQ ID NO: 612025 - DNA, 20 bp, Homo sapiens
tccggatggaatcacagcca

SEQ ID NO: 612026 - DNA, 14 bp, Homo sapiens
tccggcagaggcag

SEQ ID NO: 612027 - DNA, 16 bp, Homo sapiens
tccggcagaggcaggg

SEQ ID NO: 612028 - DNA, 18 bp, Homo sapiens
tccggcagaggcagggcc

SEQ ID NO: 612029 - DNA, 13 bp, Homo sapiens
tccggcctgcagc

SEQ ID NO: 612030 - DNA, 15 bp, Homo sapiens
tccggcctgcagccc

SEQ ID NO: 612031 - DNA, 18 bp, Homo sapiens
tccggcctgcagcccaga

SEQ ID NO: 612032 - DNA, 13 bp, Homo sapiens
tccgggactgacc

SEQ ID NO: 612033 - DNA, 18 bp, Homo sapiens
tccgggcagagaccaccg

SEQ ID NO: 612034 - DNA, 14 bp, Homo sapiens
tccgggtctcgcag

SEQ ID NO: 612035 - DNA, 16 bp, Homo sapiens
tccgggtctcgcagcc

SEQ ID NO: 612036 - DNA, 14 bp, Homo sapiens
tccgggtgccattc

SEQ ID NO: 612037 - DNA, 22 bp, Homo sapiens
tccgggtgcgtgaccggcccgc

SEQ ID NO: 612038 - DNA, 23 bp, Homo sapiens
tccggtgtctggaaaagcacttt

SEQ ID NO: 612039 - DNA, 22 bp, Homo sapiens
tccgtccccagggtgcaggcgc

SEQ ID NO: 612040 - DNA, 17 bp, Homo sapiens
tccgtccgcccgcccac

SEQ ID NO: 612041 - DNA, 16 bp, Homo sapiens
tccgtcctgctcgccc

SEQ ID NO: 612042 - DNA, 17 bp, Homo sapiens
tccgtcctgctcgccct

SEQ ID NO: 612043 - DNA, 19 bp, Homo sapiens
tccgtgaaagttgtgatct

SEQ ID NO: 612044 - DNA, 15 bp, Homo sapiens
tccgtgggcagctcc

SEQ ID NO: 612045 - DNA, 17 bp, Homo sapiens
tccgtgggcagctcctc

SEQ ID NO: 612046 - DNA, 21 bp, Homo sapiens
tccgttaggaataacactgca

SEQ ID NO: 612047 - DNA, 16 bp, Homo sapiens
tccgttcatctgagga

SEQ ID NO: 612048 - DNA, 18 bp, Homo sapiens
tcctaattcctgtatgtt

SEQ ID NO: 612049 - DNA, 21 bp, Homo sapiens
tcctaattctatgattaaact

SEQ ID NO: 612050 - DNA, 15 bp, Homo sapiens
tcctaccattatggc

SEQ ID NO: 612051 - DNA, 16 bp, Homo sapiens
tcctacttaaacaaaa

SEQ ID NO: 612052 - DNA, 22 bp, Homo sapiens
tcctagcactttgggaggctga

SEQ ID NO: 612053 - DNA, 19 bp, Homo sapiens
tcctaggacatctctgtaa

SEQ ID NO: 612054 - DNA, 13 bp, Homo sapiens
tcctatccctgga

SEQ ID NO: 612055 - DNA, 17 bp, Homo sapiens
tcctattaatttattaa

SEQ ID NO: 612056 - DNA, 16 bp, Homo sapiens
tcctcacccctgtagg

SEQ ID NO: 612057 - DNA, 18 bp, Homo sapiens
tcctcacccctgtaggga

SEQ ID NO: 612058 - DNA, 17 bp, Homo sapiens
tcctcattgttcagaaa

SEQ ID NO: 612059 - DNA, 16 bp, Homo sapiens
tcctccaaatgctgtc

SEQ ID NO: 612060 - DNA, 21 bp, Homo sapiens
tcctccaggaggactgttcta

SEQ ID NO: 612061 - DNA, 22 bp, Homo sapiens
tcctcccaactctggccttggt

SEQ ID NO: 612062 - DNA, 13 bp, Homo sapiens
tcctcccatggcc

SEQ ID NO: 612063 - DNA, 14 bp, Homo sapiens
tcctcccatggcct

SEQ ID NO: 612064 - DNA, 18 bp, Homo sapiens
tcctcccatggccttccc

SEQ ID NO: 612065 - DNA, 14 bp, Homo sapiens
tcctcccccagagc

SEQ ID NO: 612066 - DNA, 16 bp, Homo sapiens
tcctccccctcctcca

SEQ ID NO: 612067 - DNA, 21 bp, Homo sapiens
tcctccccctcctccatgctg

SEQ ID NO: 612068 - DNA, 14 bp, Homo sapiens
tcctcccctggaag

SEQ ID NO: 612069 - DNA, 19 bp, Homo sapiens
tcctccttcactccctgtc

SEQ ID NO: 612070 - DNA, 22 bp, Homo sapiens
tcctcgccccccgcccggcctc

SEQ ID NO: 612071 - DNA, 15 bp, Homo sapiens
tcctcgggcgcctgc

SEQ ID NO: 612072 - DNA, 22 bp, Homo sapiens
tcctcgggcgcctgcgctcctc

SEQ ID NO: 612073 - DNA, 21 bp, Homo sapiens
tcctcgtccggcctgcagccc

SEQ ID NO: 612074 - DNA, 14 bp, Homo sapiens
tcctctcctcgtcc

SEQ ID NO: 612075 - DNA, 20 bp, Homo sapiens
tcctctcgtagaacctgcgc

SEQ ID NO: 612076 - DNA, 13 bp, Homo sapiens
tcctctctctccc

SEQ ID NO: 612077 - DNA, 17 bp, Homo sapiens
tcctctctctccctcca

SEQ ID NO: 612078 - DNA, 18 bp, Homo sapiens
tcctctgcagcctgagct

SEQ ID NO: 612079 - DNA, 16 bp, Homo sapiens
tcctctgccccctccc

SEQ ID NO: 612080 - DNA, 23 bp, Homo sapiens
tcctctgccccctcccccgcaga

SEQ ID NO: 612081 - DNA, 19 bp, Homo sapiens
tcctctgtcagtttgtgaa

SEQ ID NO: 612082 - DNA, 21 bp, Homo sapiens
tcctctgtccgtctgtcctgc

SEQ ID NO: 612083 - DNA, 13 bp, Homo sapiens
tcctcttacctgt

SEQ ID NO: 612084 - DNA, 19 bp, Homo sapiens
tcctcttatatgtgcccct

SEQ ID NO: 612085 - DNA, 15 bp, Homo sapiens
tcctgaccctcactt

SEQ ID NO: 612086 - DNA, 17 bp, Homo sapiens
tcctgagcctgtctctc

SEQ ID NO: 612087 - DNA, 14 bp, Homo sapiens
tcctgcaccctctg

SEQ ID NO: 612088 - DNA, 21 bp, Homo sapiens
tcctgcaccctctgctatgtc

SEQ ID NO: 612089 - DNA, 21 bp, Homo sapiens
tcctgcatgtcggggcccctg

SEQ ID NO: 612090 - DNA, 23 bp, Homo sapiens
tcctgcatgtcggggcccctgcg

SEQ ID NO: 612091 - DNA, 22 bp, Homo sapiens
tcctgcccacgtgcagcacctg

SEQ ID NO: 612092 - DNA, 21 bp, Homo sapiens
tcctgccccagcctactccac

SEQ ID NO: 612093 - DNA, 19 bp, Homo sapiens
tcctgcctccccattcctt

SEQ ID NO: 612094 - DNA, 19 bp, Homo sapiens
tcctgcgcctgcgcctcct

SEQ ID NO: 612095 - DNA, 21 bp, Homo sapiens
tcctgcgcctgcgcctcctcc

SEQ ID NO: 612096 - DNA, 20 bp, Homo sapiens
tcctgctcacgtctgtgagt

SEQ ID NO: 612097 - DNA, 18 bp, Homo sapiens
tcctgctcctcacccctg

SEQ ID NO: 612098 - DNA, 15 bp, Homo sapiens
tcctgctcgccctgt

SEQ ID NO: 612099 - DNA, 18 bp, Homo sapiens
tcctgctcgccctgtgcc

SEQ ID NO: 612100 - DNA, 16 bp, Homo sapiens
tcctggaaatttgtgt

SEQ ID NO: 612101 - DNA, 22 bp, Homo sapiens
tcctggaaatttgtgtgcttca

SEQ ID NO: 612102 - DNA, 18 bp, Homo sapiens
tcctgggggatgtgcacg

SEQ ID NO: 612103 - DNA, 14 bp, Homo sapiens
tcctgggggctgct

SEQ ID NO: 612104 - DNA, 19 bp, Homo sapiens
tcctgggggctgctgcact

SEQ ID NO: 612105 - DNA, 22 bp, Homo sapiens
tcctgggggctgctgcactgcc

SEQ ID NO: 612106 - DNA, 11 bp, Homo sapiens
tcctgtatgtt

SEQ ID NO: 612107 - DNA, 14 bp, Homo sapiens
tcctgtcctgctca

SEQ ID NO: 612108 - DNA, 16 bp, Homo sapiens
tcctgtcctgctcacg

SEQ ID NO: 612109 - DNA, 17 bp, Homo sapiens
tcctgtcctgctcacgt

SEQ ID NO: 612110 - DNA, 16 bp, Homo sapiens
tcctgtcctggctccc

SEQ ID NO: 612111 - DNA, 12 bp, Homo sapiens
tcctgtctcctc

SEQ ID NO: 612112 - DNA, 17 bp, Homo sapiens
tcctgtgtcatctgtca

SEQ ID NO: 612113 - DNA, 16 bp, Homo sapiens
tcctgttttcacacct

SEQ ID NO: 612114 - DNA, 19 bp, Homo sapiens
tccttaaaaaaaaaaatga

SEQ ID NO: 612115 - DNA, 13 bp, Homo sapiens
tccttagtaaatt

SEQ ID NO: 612116 - DNA, 15 bp, Homo sapiens
tccttagtaaattcc

SEQ ID NO: 612117 - DNA, 22 bp, Homo sapiens
tccttcactccctgtcatagtt

SEQ ID NO: 612118 - DNA, 13 bp, Homo sapiens
tccttcagcaatc

SEQ ID NO: 612119 - DNA, 12 bp, Homo sapiens
tccttcagtgcc

SEQ ID NO: 612120 - DNA, 15 bp, Homo sapiens
tccttcatgcttttc

SEQ ID NO: 612121 - DNA, 16 bp, Homo sapiens
tccttcatgcttttct

SEQ ID NO: 612122 - DNA, 17 bp, Homo sapiens
tccttcatgcttttctc

SEQ ID NO: 612123 - DNA, 21 bp, Homo sapiens
tccttcatgcttttctcatgg

SEQ ID NO: 612124 - DNA, 14 bp, Homo sapiens
tccttccaaactct

SEQ ID NO: 612125 - DNA, 22 bp, Homo sapiens
tccttccatcttgtggggccag

SEQ ID NO: 612126 - DNA, 14 bp, Homo sapiens
tccttcccgcagca

SEQ ID NO: 612127 - DNA, 16 bp, Homo sapiens
tccttcccgcagcacc

SEQ ID NO: 612128 - DNA, 21 bp, Homo sapiens
tctccggatggaatcacagcc

SEQ ID NO: 612129 - DNA, 14 bp, Homo sapiens
tctcctccaaatgc

SEQ ID NO: 612130 - DNA, 24 bp, Homo sapiens
tctcctcggtggcatttgctgaat

SEQ ID NO: 612131 - DNA, 15 bp, Homo sapiens
tctcctcgtccggcc

SEQ ID NO: 612132 - DNA, 19 bp, Homo sapiens
tctcctctctctccctcca

SEQ ID NO: 612133 - DNA, 19 bp, Homo sapiens
tctcctgagcctgtctctc

SEQ ID NO: 612134 - DNA, 15 bp, Homo sapiens
tctcctgtatcattt

SEQ ID NO: 612135 - DNA, 12 bp, Homo sapiens
tctcctgtgcac

SEQ ID NO: 612136 - DNA, 11 bp, Homo sapiens
tctccttaacc

SEQ ID NO: 612137 - DNA, 13 bp, Homo sapiens
tctccttgtactt

SEQ ID NO: 612138 - DNA, 14 bp, Homo sapiens
tctccttgtacttg

SEQ ID NO: 612139 - DNA, 21 bp, Homo sapiens
tctcgcagcctgaagcctgga

SEQ ID NO: 612140 - DNA, 14 bp, Homo sapiens
tctctaacccctag

SEQ ID NO: 612141 - DNA, 17 bp, Homo sapiens
tctctatttgatttgca

SEQ ID NO: 612142 - DNA, 14 bp, Homo sapiens
tctctcaaaatgtg

SEQ ID NO: 612143 - DNA, 12 bp, Homo sapiens
tctctctccctc

SEQ ID NO: 612144 - DNA, 16 bp, Homo sapiens
tctctctccctccact

SEQ ID NO: 612145 - DNA, 11 bp, Homo sapiens
tctctctctct

SEQ ID NO: 612146 - DNA, 16 bp, Homo sapiens
tctctctctctctctg

SEQ ID NO: 612147 - DNA, 14 bp, Homo sapiens
tctctctctctctg

SEQ ID NO: 612148 - DNA, 13 bp, Homo sapiens
tctctctctctgt

SEQ ID NO: 612149 - DNA, 13 bp, Homo sapiens
tctctctctgttc

SEQ ID NO: 612150 - DNA, 14 bp, Homo sapiens
tctctctctgttcc

SEQ ID NO: 612151 - DNA, 15 bp, Homo sapiens
tctctctctgttcca

SEQ ID NO: 612152 - DNA, 9 bp, Homo sapiens
tctctctgt

SEQ ID NO: 612153 - DNA, 15 bp, Homo sapiens
tctctctgtgctggt

SEQ ID NO: 612154 - DNA, 14 bp, Homo sapiens
tctctctgtgtggc

SEQ ID NO: 612155 - DNA, 15 bp, Homo sapiens
tctctctgtgtggca

SEQ ID NO: 612156 - DNA, 18 bp, Homo sapiens
tctctctgtgtggcaaac

SEQ ID NO: 612157 - DNA, 20 bp, Homo sapiens
tctctctgtgtggcaaacat

SEQ ID NO: 612158 - DNA, 16 bp, Homo sapiens
tctctctgttccaagt

SEQ ID NO: 612159 - DNA, 19 bp, Homo sapiens
tctctgagcagtggggagc

SEQ ID NO: 612160 - DNA, 18 bp, Homo sapiens
tctctgtgtggcaaacat

SEQ ID NO: 612161 - DNA, 19 bp, Homo sapiens
tctctgtgtggcaaacatt

SEQ ID NO: 612162 - DNA, 21 bp, Homo sapiens
tctctgtgtggcaaacattta

SEQ ID NO: 612163 - DNA, 18 bp, Homo sapiens
tctctgttccaagtgtgt

SEQ ID NO: 612164 - DNA, 23 bp, Homo sapiens
tctctgttccaagtgtgtgtgca

SEQ ID NO: 612165 - DNA, 23 bp, Homo sapiens
tctcttgctgtttaccgcccacc

SEQ ID NO: 612166 - DNA, 13 bp, Homo sapiens
tctcttggtctct

SEQ ID NO: 612167 - DNA, 17 bp, Homo sapiens
tctcttggtctctttct

SEQ ID NO: 612168 - DNA, 17 bp, Homo sapiens
tctctttcttttgtgca

SEQ ID NO: 612169 - DNA, 14 bp, Homo sapiens
tctgaaaactggaa

SEQ ID NO: 612170 - DNA, 19 bp, Homo sapiens
tctgaaattaggaaagtac

SEQ ID NO: 612171 - DNA, 19 bp, Homo sapiens
tctgaactgcaacactgga

SEQ ID NO: 612172 - DNA, 16 bp, Homo sapiens
tctgaaggagaggagt

SEQ ID NO: 612173 - DNA, 14 bp, Homo sapiens
tctgactccagtgg

SEQ ID NO: 612174 - DNA, 20 bp, Homo sapiens
tctgactgccaaataaatca

SEQ ID NO: 612175 - DNA, 15 bp, Homo sapiens
tctgagacagagagc

SEQ ID NO: 612176 - DNA, 21 bp, Homo sapiens
tctgagactcgcgacaatgca

SEQ ID NO: 612177 - DNA, 16 bp, Homo sapiens
tctgagcagacagggc

SEQ ID NO: 612178 - DNA, 13 bp, Homo sapiens
tctgagcagtggg

SEQ ID NO: 612179 - DNA, 18 bp, Homo sapiens
tctgaggccccaggccct

SEQ ID NO: 612180 - DNA, 22 bp, Homo sapiens
tctgagtgacatgggtgtgcca

SEQ ID NO: 612181 - DNA, 12 bp, Homo sapiens
tctgatatcagg

SEQ ID NO: 612182 - DNA, 20 bp, Homo sapiens
tctgatatcaggaaatatct

SEQ ID NO: 612183 - DNA, 16 bp, Homo sapiens
tctgatgaagttgtac

SEQ ID NO: 612184 - DNA, 21 bp, Homo sapiens
tctgatgatgttctgaaatgg

SEQ ID NO: 612185 - DNA, 16 bp, Homo sapiens
tctgatttctgaacta

SEQ ID NO: 612186 - DNA, 14 bp, Homo sapiens
tctgcaataacagt

SEQ ID NO: 612187 - DNA, 13 bp, Homo sapiens
tctgcacacataa

SEQ ID NO: 612188 - DNA, 20 bp, Homo sapiens
tctgcacacataacacacat

SEQ ID NO: 612189 - DNA, 22 bp, Homo sapiens
tctgcacacataacacacatca

SEQ ID NO: 612190 - DNA, 22 bp, Homo sapiens
tctgccacttagggagtgtgcc

SEQ ID NO: 612191 - DNA, 20 bp, Homo sapiens
tctgcccctccgtccccagg

SEQ ID NO: 612192 - DNA, 21 bp, Homo sapiens
tctgcccctccgtccccaggg

SEQ ID NO: 612193 - DNA, 22 bp, Homo sapiens
tctgcccctccgtccccagggt

SEQ ID NO: 612194 - DNA, 13 bp, Homo sapiens
tctgcccctcttc

SEQ ID NO: 612195 - DNA, 17 bp, Homo sapiens
tctgcccctcttccctg

SEQ ID NO: 612196 - DNA, 21 bp, Homo sapiens
tctgccccttgaccccacacg

SEQ ID NO: 612197 - DNA, 17 bp, Homo sapiens
tctgccctgcctgagga

SEQ ID NO: 612198 - DNA, 16 bp, Homo sapiens
tctgccggtggggcca

SEQ ID NO: 612199 - DNA, 23 bp, Homo sapiens
tctgccggtggggccagcgctga

SEQ ID NO: 612200 - DNA, 14 bp, Homo sapiens
tctgcctggagcct

SEQ ID NO: 612201 - DNA, 23 bp, Homo sapiens
tctgcctggagcctgggcagcac

SEQ ID NO: 612202 - DNA, 15 bp, Homo sapiens
tctgcctgtcaagtt

SEQ ID NO: 612203 - DNA, 16 bp, Homo sapiens
tctgcgccccagcgac

SEQ ID NO: 612204 - DNA, 13 bp, Homo sapiens
tctgctatgtctg

SEQ ID NO: 612205 - DNA, 16 bp, Homo sapiens
tctgctcatctacaca

SEQ ID NO: 612206 - DNA, 13 bp, Homo sapiens
tctgctgccctct

SEQ ID NO: 612207 - DNA, 15 bp, Homo sapiens
tctgcttctctttca

SEQ ID NO: 612208 - DNA, 16 bp, Homo sapiens
tctggaaaagcacttt

SEQ ID NO: 612209 - DNA, 15 bp, Homo sapiens
tctggagtctgaagg

SEQ ID NO: 612210 - DNA, 20 bp, Homo sapiens
tctggagtctgaaggagagg

SEQ ID NO: 612211 - DNA, 22 bp, Homo sapiens
tctggccctgacttctggagat

SEQ ID NO: 612212 - DNA, 20 bp, Homo sapiens
tctggccttggttcctccag

SEQ ID NO: 612213 - DNA, 12 bp, Homo sapiens
tctggcgccagg

SEQ ID NO: 612214 - DNA, 14 bp, Homo sapiens
tctggcgccagggg

SEQ ID NO: 612215 - DNA, 13 bp, Homo sapiens
tctggctgtggcc

SEQ ID NO: 612216 - DNA, 14 bp, Homo sapiens
tctgggaagaaaat

SEQ ID NO: 612217 - DNA, 19 bp, Homo sapiens
tctgggacaggcaccatgc

SEQ ID NO: 612218 - DNA, 19 bp, Homo sapiens
tctggtgcgtgtggccctg

SEQ ID NO: 612219 - DNA, 22 bp, Homo sapiens
tctggtgcgtgtggccctgtgg

SEQ ID NO: 612220 - DNA, 21 bp, Homo sapiens
tctgtaatcacactctcttct

SEQ ID NO: 612221 - DNA, 23 bp, Homo sapiens
tctgtacttcagttctcatcttg

SEQ ID NO: 612222 - DNA, 16 bp, Homo sapiens
tctgtatatcagctct

SEQ ID NO: 612223 - DNA, 14 bp, Homo sapiens
tctgtcaatgaaaa

SEQ ID NO: 612224 - DNA, 16 bp, Homo sapiens
tctgtcagcttcccaa

SEQ ID NO: 612225 - DNA, 21 bp, Homo sapiens
tctgtcattggttacaaattt

SEQ ID NO: 612226 - DNA, 19 bp, Homo sapiens
tctgtccctaaacatagtg

SEQ ID NO: 612227 - DNA, 22 bp, Homo sapiens
tctgtccctaaacatagtggta

SEQ ID NO: 612228 - DNA, 17 bp, Homo sapiens
tctgtccgtctgtcctg

SEQ ID NO: 612229 - DNA, 18 bp, Homo sapiens
tctgtccgtctgtcctgc

SEQ ID NO: 612230 - DNA, 14 bp, Homo sapiens
tctgtcctgcgcct

SEQ ID NO: 612231 - DNA, 21 bp, Homo sapiens
tctgtccttccaacctgttca

SEQ ID NO: 612232 - DNA, 22 bp, Homo sapiens
tctgtctgagccctgccctcac

SEQ ID NO: 612233 - DNA, 13 bp, Homo sapiens
tctgtctttatga

SEQ ID NO: 612234 - DNA, 23 bp, Homo sapiens
tctgtctttatgatttcatgatt

SEQ ID NO: 612235 - DNA, 21 bp, Homo sapiens
tctgtgaaagtctcctgtatc

SEQ ID NO: 612236 - DNA, 23 bp, Homo sapiens
tctgtgaaagtctcctgtatcat

SEQ ID NO: 612237 - DNA, 20 bp, Homo sapiens
tctgtgaaggacttggtgat

SEQ ID NO: 612238 - DNA, 14 bp, Homo sapiens
tctgtgataacaga

SEQ ID NO: 612239 - DNA, 20 bp, Homo sapiens
tctgtgcagtttggtatgaa

SEQ ID NO: 612240 - DNA, 15 bp, Homo sapiens
tctgtgcatctggcc

SEQ ID NO: 612241 - DNA, 23 bp, Homo sapiens
tctgtgggactggcccacccctc

SEQ ID NO: 612242 - DNA, 19 bp, Homo sapiens
tctgtgtaagacacgtgca

SEQ ID NO: 612243 - DNA, 18 bp, Homo sapiens
tctgtgtggcaaacattt

SEQ ID NO: 612244 - DNA, 22 bp, Homo sapiens
tctgtgttctcaacacacagta

SEQ ID NO: 612245 - DNA, 22 bp, Homo sapiens
tgagcctgtcacgtggtcaagg

SEQ ID NO: 612246 - DNA, 14 bp, Homo sapiens
tgagctccaccctc

SEQ ID NO: 612247 - DNA, 15 bp, Homo sapiens
tgaggagttgcctga

SEQ ID NO: 612248 - DNA, 13 bp, Homo sapiens
tgaggccccaggc

SEQ ID NO: 612249 - DNA, 15 bp, Homo sapiens
tgaggccccaggccc

SEQ ID NO: 612250 - DNA, 15 bp, Homo sapiens
tgaggcccccggagg

SEQ ID NO: 612251 - DNA, 23 bp, Homo sapiens
tgaggcctttccccagtgtggcc

SEQ ID NO: 612252 - DNA, 22 bp, Homo sapiens
tgaggcgtgggatccagagaga

SEQ ID NO: 612253 - DNA, 18 bp, Homo sapiens
tgaggctggataggagag

SEQ ID NO: 612254 - DNA, 13 bp, Homo sapiens
tgagggaagccca

SEQ ID NO: 612255 - DNA, 16 bp, Homo sapiens
tgagggaagcccaccc

SEQ ID NO: 612256 - DNA, 15 bp, Homo sapiens
tgagggacgagcaga

SEQ ID NO: 612257 - DNA, 23 bp, Homo sapiens
tgagggacgagcagagcgcagcc

SEQ ID NO: 612258 - DNA, 16 bp, Homo sapiens
tgagggcgtgaaacac

SEQ ID NO: 612259 - DNA, 17 bp, Homo sapiens
tgagtcggctgggcagg

SEQ ID NO: 612260 - DNA, 12 bp, Homo sapiens
tgagtctgtcct

SEQ ID NO: 612261 - DNA, 15 bp, Homo sapiens
tgagtgggctgggcc

SEQ ID NO: 612262 - DNA, 22 bp, Homo sapiens
tgagtgtacatttatgtgtgaa

SEQ ID NO: 612263 - DNA, 14 bp, Homo sapiens
tgagtgttagaaaa

SEQ ID NO: 612264 - DNA, 16 bp, Homo sapiens
tgagttaatttgataa

SEQ ID NO: 612265 - DNA, 14 bp, Homo sapiens
tgagttagctgttt

SEQ ID NO: 612266 - DNA, 17 bp, Homo sapiens
tgagttctgcacataca

SEQ ID NO: 612267 - DNA, 18 bp, Homo sapiens
tgagtttccagctaagcc

SEQ ID NO: 612268 - DNA, 17 bp, Homo sapiens
tgagttttatcttgaca

SEQ ID NO: 612269 - DNA, 21 bp, Homo sapiens
tgatactcgttattcatacaa

SEQ ID NO: 612270 - DNA, 23 bp, Homo sapiens
tgatactcgttattcatacaaat

SEQ ID NO: 612271 - DNA, 21 bp, Homo sapiens
tgatacttatttataacattg

SEQ ID NO: 612272 - DNA, 17 bp, Homo sapiens
tgatagtttacaaacaa

SEQ ID NO: 612273 - DNA, 14 bp, Homo sapiens
tgatatattttcca

SEQ ID NO: 612274 - DNA, 18 bp, Homo sapiens
tgatatcacgggcccgct

SEQ ID NO: 612275 - DNA, 19 bp, Homo sapiens
tgatatctgtttgcttcta

SEQ ID NO: 612276 - DNA, 20 bp, Homo sapiens
tgatatgtctttaaaatgat

SEQ ID NO: 612277 - DNA, 12 bp, Homo sapiens
tgatatgttgat

SEQ ID NO: 612278 - DNA, 13 bp, Homo sapiens
tgatcaccctgaa

SEQ ID NO: 612279 - DNA, 23 bp, Homo sapiens
tgatcaccctgaattcattgtct

SEQ ID NO: 612280 - DNA, 16 bp, Homo sapiens
tgatcgtgtgttgcca

SEQ ID NO: 612281 - DNA, 22 bp, Homo sapiens
tgatctcagcatcctggaaatt

SEQ ID NO: 612282 - DNA, 15 bp, Homo sapiens
tgatctgtccttcca

SEQ ID NO: 612283 - DNA, 20 bp, Homo sapiens
tgatctgtccttccaacctg

SEQ ID NO: 612284 - DNA, 18 bp, Homo sapiens
tgatctgttgtaatatca

SEQ ID NO: 612285 - DNA, 21 bp, Homo sapiens
tgatctgttgtaatatcagtt

SEQ ID NO: 612286 - DNA, 20 bp, Homo sapiens
tgatcttacacgaagaaata

SEQ ID NO: 612287 - DNA, 23 bp, Homo sapiens
tgatcttacacgaagaaatagaa

SEQ ID NO: 612288 - DNA, 13 bp, Homo sapiens
tgatgagaggaaa

SEQ ID NO: 612289 - DNA, 14 bp, Homo sapiens
tgatgagaggaaat

SEQ ID NO: 612290 - DNA, 15 bp, Homo sapiens
tgatgagaggaaatc

SEQ ID NO: 612291 - DNA, 16 bp, Homo sapiens
tgatgagaggaaatca

SEQ ID NO: 612292 - DNA, 18 bp, Homo sapiens
tgatggaggtttcatact

SEQ ID NO: 612293 - DNA, 20 bp, Homo sapiens
tgatgtattattatatatgt

SEQ ID NO: 612294 - DNA, 13 bp, Homo sapiens
tgatgtgatttat

SEQ ID NO: 612295 - DNA, 17 bp, Homo sapiens
tgatgtgatttatgcat

SEQ ID NO: 612296 - DNA, 22 bp, Homo sapiens
tgatgtgtccgtgaaagttgtg

SEQ ID NO: 612297 - DNA, 17 bp, Homo sapiens
tgattaaggactacaga

SEQ ID NO: 612298 - DNA, 20 bp, Homo sapiens
tgattaaggactacagaatt

SEQ ID NO: 612299 - DNA, 21 bp, Homo sapiens
tgattattagttgaccaacta

SEQ ID NO: 612300 - DNA, 13 bp, Homo sapiens
tgattcaatgtga

SEQ ID NO: 612301 - DNA, 14 bp, Homo sapiens
tgattcaatgtgaa

SEQ ID NO: 612302 - DNA, 15 bp, Homo sapiens
tgattcaatgtgaat

SEQ ID NO: 612303 - DNA, 14 bp, Homo sapiens
tgattcttgtgtca

SEQ ID NO: 612304 - DNA, 23 bp, Homo sapiens
tgattgagagcagcctcttgaat

SEQ ID NO: 612305 - DNA, 13 bp, Homo sapiens
tgatttaaacttc

SEQ ID NO: 612306 - DNA, 21 bp, Homo sapiens
tgatttaaacttcttaactgg

SEQ ID NO: 612307 - DNA, 17 bp, Homo sapiens
tgatttactaacagtaa

SEQ ID NO: 612308 - DNA, 21 bp, Homo sapiens
tgatttactaacagtaactgc

SEQ ID NO: 612309 - DNA, 18 bp, Homo sapiens
tgatttcatgattagaca

SEQ ID NO: 612310 - DNA, 14 bp, Homo sapiens
tgatttctgaacta

SEQ ID NO: 612311 - DNA, 15 bp, Homo sapiens
tgatttgtaaaacag

SEQ ID NO: 612312 - DNA, 20 bp, Homo sapiens
tgatttttttttccttcagt

SEQ ID NO: 612313 - DNA, 23 bp, Homo sapiens
tgatttttttttccttcagtgcc

SEQ ID NO: 612314 - DNA, 13 bp, Homo sapiens
tgcaaaccatcat

SEQ ID NO: 612315 - DNA, 14 bp, Homo sapiens
tgcaaagcacacct

SEQ ID NO: 612316 - DNA, 16 bp, Homo sapiens
tgcaacaaactcaaaa

SEQ ID NO: 612317 - DNA, 16 bp, Homo sapiens
tgcaacactgccaaac

SEQ ID NO: 612318 - DNA, 19 bp, Homo sapiens
tgcaacactgccaaacatc

SEQ ID NO: 612319 - DNA, 12 bp, Homo sapiens
tgcaacactgga

SEQ ID NO: 612320 - DNA, 14 bp, Homo sapiens
tgcaacagactgcc

SEQ ID NO: 612321 - DNA, 18 bp, Homo sapiens
tgcaacagactgccttat

SEQ ID NO: 612322 - DNA, 21 bp, Homo sapiens
tgcaataacagttttaagatg

SEQ ID NO: 612323 - DNA, 16 bp, Homo sapiens
tgcaatgacctttcaa

SEQ ID NO: 612324 - DNA, 22 bp, Homo sapiens
tgcaatgacctttcaataggaa

SEQ ID NO: 612325 - DNA, 17 bp, Homo sapiens
tgcaatttacttggaat

SEQ ID NO: 612326 - DNA, 14 bp, Homo sapiens
tgcaatttgacttg

SEQ ID NO: 612327 - DNA, 18 bp, Homo sapiens
tgcacaccaaattgctga

SEQ ID NO: 612328 - DNA, 20 bp, Homo sapiens
tgcacaccaaattgctgaga

SEQ ID NO: 612329 - DNA, 16 bp, Homo sapiens
tgcaccagtgccgcct

SEQ ID NO: 612330 - DNA, 19 bp, Homo sapiens
tgcaccagtgccgcctgtg

SEQ ID NO: 612331 - DNA, 19 bp, Homo sapiens
tgcaccctccacaggagcc

SEQ ID NO: 612332 - DNA, 20 bp, Homo sapiens
tgcaccctctgctatgtctg

SEQ ID NO: 612333 - DNA, 19 bp, Homo sapiens
tgcaccggtttcatagacg

SEQ ID NO: 612334 - DNA, 14 bp, Homo sapiens
tgcacctgcttctc

SEQ ID NO: 612335 - DNA, 15 bp, Homo sapiens
tgcacctgcttctca

SEQ ID NO: 612336 - DNA, 14 bp, Homo sapiens
tgcaccttgggcac

SEQ ID NO: 612337 - DNA, 20 bp, Homo sapiens
tgcacttcggataattttca

SEQ ID NO: 612338 - DNA, 13 bp, Homo sapiens
tgcacttctgtta

SEQ ID NO: 612339 - DNA, 18 bp, Homo sapiens
tgcacttctgttatcagg

SEQ ID NO: 612340 - DNA, 14 bp, Homo sapiens
tgcagaaaacattg

SEQ ID NO: 612341 - DNA, 19 bp, Homo sapiens
tgcagaaatgagtgataaa

SEQ ID NO: 612342 - DNA, 20 bp, Homo sapiens
tgcagaccacactctgcctg

SEQ ID NO: 612343 - DNA, 14 bp, Homo sapiens
tgcagaccctcaga

SEQ ID NO: 612344 - DNA, 15 bp, Homo sapiens
tgcagactgtggctg

SEQ ID NO: 612345 - DNA, 22 bp, Homo sapiens
tgcagactgtggctgcagagac

SEQ ID NO: 612346 - DNA, 23 bp, Homo sapiens
tgcagactgtggctgcagagacc

SEQ ID NO: 612347 - DNA, 20 bp, Homo sapiens
tgcagagctaggttgtccta

SEQ ID NO: 612348 - DNA, 23 bp, Homo sapiens
tgcagagtaaatcccacgacata

SEQ ID NO: 612349 - DNA, 20 bp, Homo sapiens
tgcagatgactggaaacaag

SEQ ID NO: 612350 - DNA, 16 bp, Homo sapiens
tgcagcaaccagagca

SEQ ID NO: 612351 - DNA, 18 bp, Homo sapiens
tgcagcaaccagagcact

SEQ ID NO: 612352 - DNA, 19 bp, Homo sapiens
tgcagcagtaccatcccac

SEQ ID NO: 612353 - DNA, 19 bp, Homo sapiens
tgcagcccagaacgggcct

SEQ ID NO: 612354 - DNA, 16 bp, Homo sapiens
tgcagcctgagctcca

SEQ ID NO: 612355 - DNA, 19 bp, Homo sapiens
tgcagcctgagctccaccc

SEQ ID NO: 612356 - DNA, 17 bp, Homo sapiens
tgcagctaatttgtgaa

SEQ ID NO: 612357 - DNA, 18 bp, Homo sapiens
tgcagctatggacaattt

SEQ ID NO: 612358 - DNA, 14 bp, Homo sapiens
tgcaggaaaaggct

SEQ ID NO: 612359 - DNA, 19 bp, Homo sapiens
tgcaggaatcaaaaattga

SEQ ID NO: 612360 - DNA, 21 bp, Homo sapiens
tgcaggaatcaaaaattgaag

SEQ ID NO: 612361 - DNA, 15 bp, Homo sapiens
ttgggttccagacag

SEQ ID NO: 612362 - DNA, 17 bp, Homo sapiens
ttggtaacttgctgtga

SEQ ID NO: 612363 - DNA, 20 bp, Homo sapiens
ttggtcacaaagctatttaa

SEQ ID NO: 612364 - DNA, 23 bp, Homo sapiens
ttggtcacaaagctatttaagtg

SEQ ID NO: 612365 - DNA, 21 bp, Homo sapiens
ttggttaatgaaaaatctgaa

SEQ ID NO: 612366 - DNA, 23 bp, Homo sapiens
ttggttacaaatttttactcagg

SEQ ID NO: 612367 - DNA, 23 bp, Homo sapiens
ttggttccacaatcatctattga

SEQ ID NO: 612368 - DNA, 15 bp, Homo sapiens
ttggttcctccagca

SEQ ID NO: 612369 - DNA, 17 bp, Homo sapiens
ttgtaaaactgtgacat

SEQ ID NO: 612370 - DNA, 18 bp, Homo sapiens
ttgtaaaactgtgacatt

SEQ ID NO: 612371 - DNA, 15 bp, Homo sapiens
ttgtaatattttgct

SEQ ID NO: 612372 - DNA, 19 bp, Homo sapiens
ttgtactggttagattcat

SEQ ID NO: 612373 - DNA, 15 bp, Homo sapiens
ttgtacttttatctt

SEQ ID NO: 612374 - DNA, 21 bp, Homo sapiens
ttgtagatgaaaaagcatgta

SEQ ID NO: 612375 - DNA, 20 bp, Homo sapiens
ttgtatgttaatagaaaata

SEQ ID NO: 612376 - DNA, 22 bp, Homo sapiens
ttgtatgttaatagaaaatata

SEQ ID NO: 612377 - DNA, 23 bp, Homo sapiens
ttgtcaaatggtattttttgtga

SEQ ID NO: 612378 - DNA, 16 bp, Homo sapiens
ttgtcagaatgttgtg

SEQ ID NO: 612379 - DNA, 12 bp, Homo sapiens
ttgtccctgcag

SEQ ID NO: 612380 - DNA, 13 bp, Homo sapiens
ttgtcctgtgtca

SEQ ID NO: 612381 - DNA, 19 bp, Homo sapiens
ttgtcctgtttcttcatat

SEQ ID NO: 612382 - DNA, 18 bp, Homo sapiens
ttgtcctttatgtattct

SEQ ID NO: 612383 - DNA, 13 bp, Homo sapiens
ttgtctaaagatc

SEQ ID NO: 612384 - DNA, 14 bp, Homo sapiens
ttgtctaaagatct

SEQ ID NO: 612385 - DNA, 16 bp, Homo sapiens
ttgtctaaagatcttt

SEQ ID NO: 612386 - DNA, 23 bp, Homo sapiens
ttgtcttattcctaattcctgta

SEQ ID NO: 612387 - DNA, 20 bp, Homo sapiens
ttgtgaagtgattgacattt

SEQ ID NO: 612388 - DNA, 21 bp, Homo sapiens
ttgtgaagtgattgacatttt

SEQ ID NO: 612389 - DNA, 17 bp, Homo sapiens
ttgtgaatggttgcaaa

SEQ ID NO: 612390 - DNA, 22 bp, Homo sapiens
ttgtgaatggttgcaaagtgtt

SEQ ID NO: 612391 - DNA, 14 bp, Homo sapiens
ttgtgatctgtcct

SEQ ID NO: 612392 - DNA, 13 bp, Homo sapiens
ttgtgatctgttg

SEQ ID NO: 612393 - DNA, 19 bp, Homo sapiens
ttgtgatgtaaggcactgt

SEQ ID NO: 612394 - DNA, 16 bp, Homo sapiens
ttgtgcagaaaacatt

SEQ ID NO: 612395 - DNA, 19 bp, Homo sapiens
ttgtgcagaaaacattgtt

SEQ ID NO: 612396 - DNA, 15 bp, Homo sapiens
ttgtgcttgttcttc

SEQ ID NO: 612397 - DNA, 15 bp, Homo sapiens
ttgtgtcttttgcat

SEQ ID NO: 612398 - DNA, 14 bp, Homo sapiens
ttgtgtcttttgtt

SEQ ID NO: 612399 - DNA, 19 bp, Homo sapiens
ttgtgtgggtttactctgt

SEQ ID NO: 612400 - DNA, 23 bp, Homo sapiens
ttgtgtgggtttactctgtgcta

SEQ ID NO: 612401 - DNA, 19 bp, Homo sapiens
ttgtgttacaataagtgtt

SEQ ID NO: 612402 - DNA, 17 bp, Homo sapiens
ttgtgttttcttcgtgg

SEQ ID NO: 612403 - DNA, 18 bp, Homo sapiens
ttgttaatgattcttgtg

SEQ ID NO: 612404 - DNA, 13 bp, Homo sapiens
ttgttaggggtgg

SEQ ID NO: 612405 - DNA, 17 bp, Homo sapiens
ttgttaggggtggggga

SEQ ID NO: 612406 - DNA, 16 bp, Homo sapiens
ttgttatcagtacaat

SEQ ID NO: 612407 - DNA, 22 bp, Homo sapiens
ttgttatgtaaacatcataaat

SEQ ID NO: 612408 - DNA, 22 bp, Homo sapiens
ttgttcaaagaacccccctccc

SEQ ID NO: 612409 - DNA, 15 bp, Homo sapiens
ttgttctgtgcaaca

SEQ ID NO: 612410 - DNA, 18 bp, Homo sapiens
ttgttcttagggcttgga

SEQ ID NO: 612411 - DNA, 19 bp, Homo sapiens
ttgttcttgtaaaactgtg

SEQ ID NO: 612412 - DNA, 9 bp, Homo sapiens
ttgtttaaa

SEQ ID NO: 612413 - DNA, 13 bp, Homo sapiens
ttgtttaaagcaa

SEQ ID NO: 612414 - DNA, 12 bp, Homo sapiens
ttgtttcttcct

SEQ ID NO: 612415 - DNA, 19 bp, Homo sapiens
tttaaaaaaaatattctgt

SEQ ID NO: 612416 - DNA, 15 bp, Homo sapiens
tttaaaaaaataaaa

SEQ ID NO: 612417 - DNA, 18 bp, Homo sapiens
tttaaaaattaaagcagc

SEQ ID NO: 612418 - DNA, 19 bp, Homo sapiens
tttaaaaattaaagcagca

SEQ ID NO: 612419 - DNA, 18 bp, Homo sapiens
tttaaaacatgctgtctt

SEQ ID NO: 612420 - DNA, 20 bp, Homo sapiens
tttaaaagaaggtaaataat

SEQ ID NO: 612421 - DNA, 21 bp, Homo sapiens
tttaaaattattaaaaattat

SEQ ID NO: 612422 - DNA, 23 bp, Homo sapiens
tttaaaattattaaaaattatag

SEQ ID NO: 612423 - DNA, 23 bp, Homo sapiens
tttaaacaaaatttatgtcattt

SEQ ID NO: 612424 - DNA, 13 bp, Homo sapiens
tttaaaggaaagt

SEQ ID NO: 612425 - DNA, 17 bp, Homo sapiens
tttaaatctttgttaaa

SEQ ID NO: 612426 - DNA, 19 bp, Homo sapiens
tttaaatgacgcacaaact

SEQ ID NO: 612427 - DNA, 14 bp, Homo sapiens
tttaaatggacaga

SEQ ID NO: 612428 - DNA, 22 bp, Homo sapiens
tttaacatagcagctggttaac

SEQ ID NO: 612429 - DNA, 15 bp, Homo sapiens
tttaactttgtgggg

SEQ ID NO: 612430 - DNA, 18 bp, Homo sapiens
tttaagaaatgagaaatt

SEQ ID NO: 612431 - DNA, 21 bp, Homo sapiens
tttaagaaatgagaaattgtg

SEQ ID NO: 612432 - DNA, 15 bp, Homo sapiens
tttaagagattttat

SEQ ID NO: 612433 - DNA, 19 bp, Homo sapiens
tttaagcgaggcagaatgg

SEQ ID NO: 612434 - DNA, 18 bp, Homo sapiens
tttaagtggactgtattt

SEQ ID NO: 612435 - DNA, 22 bp, Homo sapiens
tttaagtggactgtatttcggc

SEQ ID NO: 612436 - DNA, 13 bp, Homo sapiens
tttaagtgttctg

SEQ ID NO: 612437 - DNA, 22 bp, Homo sapiens
tttaatatactccttaaaaatg

SEQ ID NO: 612438 - DNA, 21 bp, Homo sapiens
tttaatatttatagagttcat

SEQ ID NO: 612439 - DNA, 15 bp, Homo sapiens
tttaatcatttccag

SEQ ID NO: 612440 - DNA, 21 bp, Homo sapiens
tttaatttgatatcacagtct

SEQ ID NO: 612441 - DNA, 15 bp, Homo sapiens
tttacaaacaagata

SEQ ID NO: 612442 - DNA, 19 bp, Homo sapiens
tttacatatagctttgcaa

SEQ ID NO: 612443 - DNA, 15 bp, Homo sapiens
tttacattgtcctgt

SEQ ID NO: 612444 - DNA, 19 bp, Homo sapiens
tttaccatcaaacaaatca

SEQ ID NO: 612445 - DNA, 13 bp, Homo sapiens
tttaccctccctg

SEQ ID NO: 612446 - DNA, 21 bp, Homo sapiens
tttaccgcccacccagcagcg

SEQ ID NO: 612447 - DNA, 16 bp, Homo sapiens
tttactaacagtaact

SEQ ID NO: 612448 - DNA, 18 bp, Homo sapiens
tttactatgtaaatgctt

SEQ ID NO: 612449 - DNA, 17 bp, Homo sapiens
tttactgacatggtgct

SEQ ID NO: 612450 - DNA, 17 bp, Homo sapiens
tttacttgattaaggac

SEQ ID NO: 612451 - DNA, 18 bp, Homo sapiens
tttagacttcctctcatt

SEQ ID NO: 612452 - DNA, 13 bp, Homo sapiens
tttagagaagcca

SEQ ID NO: 612453 - DNA, 21 bp, Homo sapiens
tttagattcctacttaaacaa

SEQ ID NO: 612454 - DNA, 13 bp, Homo sapiens
tttagcacagtat

SEQ ID NO: 612455 - DNA, 15 bp, Homo sapiens
tttagcacagtattt

SEQ ID NO: 612456 - DNA, 20 bp, Homo sapiens
tttagcacagtatttaacat

SEQ ID NO: 612457 - DNA, 18 bp, Homo sapiens
tttaggaaatgaatgtgt

SEQ ID NO: 612458 - DNA, 14 bp, Homo sapiens
tttaggaatgctca

SEQ ID NO: 612459 - DNA, 21 bp, Homo sapiens
tttaggaatgctcaatgtgct

SEQ ID NO: 612460 - DNA, 16 bp, Homo sapiens
tttagtcattccaagt

SEQ ID NO: 612461 - DNA, 12 bp, Homo sapiens
tttataaatgtt

SEQ ID NO: 612462 - DNA, 20 bp, Homo sapiens
tttataacattgtaaatgat

SEQ ID NO: 612463 - DNA, 20 bp, Homo sapiens
tttatacctgtacacacaca

SEQ ID NO: 612464 - DNA, 21 bp, Homo sapiens
tttatagagttcatagaaata

SEQ ID NO: 612465 - DNA, 16 bp, Homo sapiens
tttatctcttcttcct

SEQ ID NO: 612466 - DNA, 17 bp, Homo sapiens
tttatgagacttcctat

SEQ ID NO: 612467 - DNA, 16 bp, Homo sapiens
tttatgcaaatatttt

SEQ ID NO: 612468 - DNA, 21 bp, Homo sapiens
tttatgcaggcagattaataa

SEQ ID NO: 612469 - DNA, 20 bp, Homo sapiens
tttatgcatgagaactaaat

SEQ ID NO: 612470 - DNA, 14 bp, Homo sapiens
tttatgtacaaaat

SEQ ID NO: 612471 - DNA, 15 bp, Homo sapiens
tttatgtcattttca

SEQ ID NO: 612472 - DNA, 15 bp, Homo sapiens
tttatgtgatgtaac

SEQ ID NO: 612473 - DNA, 13 bp, Homo sapiens
tttattaaatgtt

SEQ ID NO: 612474 - DNA, 14 bp, Homo sapiens
tttattaggttaag

SEQ ID NO: 612475 - DNA, 15 bp, Homo sapiens
tttattaggttaagt

SEQ ID NO: 612476 - DNA, 22 bp, Homo sapiens
tttcaagctttttgtgagaaag

SEQ ID NO: 612477 - DNA, 12 bp, Homo sapiens
ttttcagattgt

SEQ ID NO: 612478 - DNA, 14 bp, Homo sapiens
ttttcattatttca

SEQ ID NO: 612479 - DNA, 14 bp, Homo sapiens
ttttcattgtgttt

SEQ ID NO: 612480 - DNA, 13 bp, Homo sapiens
ttttcattttcat

SEQ ID NO: 612481 - DNA, 14 bp, Homo sapiens
ttttccataaagaa

SEQ ID NO: 612482 - DNA, 18 bp, Homo sapiens
ttttcccagtgaataaat

SEQ ID NO: 612483 - DNA, 12 bp, Homo sapiens
ttttcctgtcaa

SEQ ID NO: 612484 - DNA, 22 bp, Homo sapiens
ttttctactttaaattgtggat

SEQ ID NO: 612485 - DNA, 13 bp, Homo sapiens
ttttctgcactga

SEQ ID NO: 612486 - DNA, 16 bp, Homo sapiens
ttttctgtaattcttc

SEQ ID NO: 612487 - DNA, 19 bp, Homo sapiens
ttttctgtaattcttctcc

SEQ ID NO: 612488 - DNA, 19 bp, Homo sapiens
ttttgatgtattattatat

SEQ ID NO: 612489 - DNA, 15 bp, Homo sapiens
ttttgccaacattgc

SEQ ID NO: 612490 - DNA, 16 bp, Homo sapiens
ttttgctgctgaattt

SEQ ID NO: 612491 - DNA, 22 bp, Homo sapiens
ttttgggaaattcttgcactgt

SEQ ID NO: 612492 - DNA, 17 bp, Homo sapiens
ttttgtaatataagaca

SEQ ID NO: 612493 - DNA, 20 bp, Homo sapiens
ttttgtacatagccaactgt

SEQ ID NO: 612494 - DNA, 13 bp, Homo sapiens
ttttgtatcctcc

SEQ ID NO: 612495 - DNA, 12 bp, Homo sapiens
ttttgtcagttt

SEQ ID NO: 612496 - DNA, 15 bp, Homo sapiens
ttttgttgattaaaa

SEQ ID NO: 612497 - DNA, 16 bp, Homo sapiens
tttttaagtgctatgc

SEQ ID NO: 612498 - DNA, 19 bp, Homo sapiens
tttttaagtgctatgcata

SEQ ID NO: 612499 - DNA, 13 bp, Homo sapiens
tttttatacttca

SEQ ID NO: 612500 - DNA, 21 bp, Homo sapiens
tttttattaggttaagtctca

SEQ ID NO: 612501 - DNA, 15 bp, Homo sapiens
tttttcaaagacttc

SEQ ID NO: 612502 - DNA, 17 bp, Homo sapiens
tttttcaaagacttcat

SEQ ID NO: 612503 - DNA, 13 bp, Homo sapiens
tttttcattgtgt

SEQ ID NO: 612504 - DNA, 14 bp, Homo sapiens
tttttcattgtgtt

SEQ ID NO: 612505 - DNA, 13 bp, Homo sapiens
tttttcctgtcaa

SEQ ID NO: 612506 - DNA, 14 bp, Homo sapiens
tttttcctgtcaat

SEQ ID NO: 612507 - DNA, 19 bp, Homo sapiens
tttttccttcagtgcctta

SEQ ID NO: 612508 - DNA, 18 bp, Homo sapiens
tttttctaaaactaaata

SEQ ID NO: 612509 - DNA, 22 bp, Homo sapiens
tttttctgcactgagcagagtc

SEQ ID NO: 612510 - DNA, 18 bp, Homo sapiens
tttttgatttatcaatat

SEQ ID NO: 612511 - DNA, 16 bp, Homo sapiens
tttttgtaagaaaatt

SEQ ID NO: 612512 - DNA, 18 bp, Homo sapiens
tttttgtaatataagaca

SEQ ID NO: 612513 - DNA, 14 bp, Homo sapiens
ttttttcctgtcaa

SEQ ID NO: 612514 - DNA, 17 bp, Homo sapiens
ttttttccttcagtgcc

SEQ ID NO: 612515 - DNA, 14 bp, Homo sapiens
ttttttgtctgtga

SEQ ID NO: 612516 - DNA, 15 bp, Homo sapiens
acacctgagaatgtg

SEQ ID NO: 612517 - DNA, 19 bp, Homo sapiens
acaccttacaaagccagct

SEQ ID NO: 612518 - DNA, 18 bp, Homo sapiens
acaccttagcagctcttc

SEQ ID NO: 612519 - DNA, 17 bp, Homo sapiens
acacgccggggctggcc

SEQ ID NO: 612520 - DNA, 13 bp, Homo sapiens
acacgtgtatatg

SEQ ID NO: 612521 - DNA, 13 bp, Homo sapiens
acactacaaacat

SEQ ID NO: 612522 - DNA, 15 bp, Homo sapiens
acactattttatgca

SEQ ID NO: 612523 - DNA, 20 bp, Homo sapiens
acactcaagactatgttctc

SEQ ID NO: 612524 - DNA, 11 bp, Homo sapiens
acactctgaga

SEQ ID NO: 612525 - DNA, 13 bp, Homo sapiens
acactctgagact

SEQ ID NO: 612526 - DNA, 13 bp, Homo sapiens
acactgaaatcca

SEQ ID NO: 612527 - DNA, 17 bp, Homo sapiens
acactgagctgggcacc

SEQ ID NO: 612528 - DNA, 13 bp, Homo sapiens
acactgagtgaaa

SEQ ID NO: 612529 - DNA, 15 bp, Homo sapiens
acactgagtgaaata

SEQ ID NO: 612530 - DNA, 16 bp, Homo sapiens
acactgatgggtcctg

SEQ ID NO: 612531 - DNA, 22 bp, Homo sapiens
acactgatgggtcctgctgctc

SEQ ID NO: 612532 - DNA, 17 bp, Homo sapiens
acactgccaaacatcag

SEQ ID NO: 612533 - DNA, 15 bp, Homo sapiens
acactgcctggagga

SEQ ID NO: 612534 - DNA, 14 bp, Homo sapiens
acactgcttaagga

SEQ ID NO: 612535 - DNA, 22 bp, Homo sapiens
acactgtcaagattaagttata

SEQ ID NO: 612536 - DNA, 15 bp, Homo sapiens
acacttgggctggca

SEQ ID NO: 612537 - DNA, 17 bp, Homo sapiens
acacttgggctggcacc

SEQ ID NO: 612538 - DNA, 20 bp, Homo sapiens
acacttgggctggcacccac

SEQ ID NO: 612539 - DNA, 23 bp, Homo sapiens
acacttgggtaattaaaaataaa

SEQ ID NO: 612540 - DNA, 17 bp, Homo sapiens
acacttttgccaatgaa

SEQ ID NO: 612541 - DNA, 15 bp, Homo sapiens
acagaaatacatcat

SEQ ID NO: 612542 - DNA, 19 bp, Homo sapiens
acagaaatacatcatatgt

SEQ ID NO: 612543 - DNA, 17 bp, Homo sapiens
acagaacaacaacaaag

SEQ ID NO: 612544 - DNA, 15 bp, Homo sapiens
acagaaccagcactc

SEQ ID NO: 612545 - DNA, 16 bp, Homo sapiens
acagaaccagcactcc

SEQ ID NO: 612546 - DNA, 20 bp, Homo sapiens
acagaaccagcactcccagg

SEQ ID NO: 612547 - DNA, 13 bp, Homo sapiens
acagaaggcccga

SEQ ID NO: 612548 - DNA, 21 bp, Homo sapiens
acagaagtggaaggataatga

SEQ ID NO: 612549 - DNA, 11 bp, Homo sapiens
acagacattgt

SEQ ID NO: 612550 - DNA, 16 bp, Homo sapiens
acagacattgttttgc

SEQ ID NO: 612551 - DNA, 16 bp, Homo sapiens
acagaccagcatagtt

SEQ ID NO: 612552 - DNA, 13 bp, Homo sapiens
acagacctcggct

SEQ ID NO: 612553 - DNA, 23 bp, Homo sapiens
acagacctcggctgtgtggggag

SEQ ID NO: 612554 - DNA, 20 bp, Homo sapiens
acagacggacgggacagcgg

SEQ ID NO: 612555 - DNA, 14 bp, Homo sapiens
acagactgccttat

SEQ ID NO: 612556 - DNA, 18 bp, Homo sapiens
acagactgccttatatta

SEQ ID NO: 612557 - DNA, 19 bp, Homo sapiens
acagactgccttatattat

SEQ ID NO: 612558 - DNA, 18 bp, Homo sapiens
acagagaactaacactat

SEQ ID NO: 612559 - DNA, 16 bp, Homo sapiens
acagagagccaagcta

SEQ ID NO: 612560 - DNA, 16 bp, Homo sapiens
acagagatcataaaga

SEQ ID NO: 612561 - DNA, 15 bp, Homo sapiens
acagaggatttctgc

SEQ ID NO: 612562 - DNA, 14 bp, Homo sapiens
acagaggtttcatt

SEQ ID NO: 612563 - DNA, 15 bp, Homo sapiens
acagaggtttcattt

SEQ ID NO: 612564 - DNA, 18 bp, Homo sapiens
acagaggtttcattttca

SEQ ID NO: 612565 - DNA, 17 bp, Homo sapiens
acagagtgatttgtaaa

SEQ ID NO: 612566 - DNA, 11 bp, Homo sapiens
acagagtggat

SEQ ID NO: 612567 - DNA, 20 bp, Homo sapiens
acagagtggatctggagtct

SEQ ID NO: 612568 - DNA, 19 bp, Homo sapiens
acagatcacatgcccctct

SEQ ID NO: 612569 - DNA, 23 bp, Homo sapiens
acagatcctccgcggaggcccct

SEQ ID NO: 612570 - DNA, 20 bp, Homo sapiens
acagatggtgtcctgcatgt

SEQ ID NO: 612571 - DNA, 14 bp, Homo sapiens
acagcaaacacagt

SEQ ID NO: 612572 - DNA, 15 bp, Homo sapiens
acagcaacaacaaca

SEQ ID NO: 612573 - DNA, 16 bp, Homo sapiens
acagcacaagggcaca

SEQ ID NO: 612574 - DNA, 13 bp, Homo sapiens
acagcacatttgt

SEQ ID NO: 612575 - DNA, 21 bp, Homo sapiens
acagcatgcatttagcatgag

SEQ ID NO: 612576 - DNA, 19 bp, Homo sapiens
acagcatttcagctgtgag

SEQ ID NO: 612577 - DNA, 17 bp, Homo sapiens
acagccatagcagacgg

SEQ ID NO: 612578 - DNA, 14 bp, Homo sapiens
acagcccagagact

SEQ ID NO: 612579 - DNA, 13 bp, Homo sapiens
acagcctgcacag

SEQ ID NO: 612580 - DNA, 20 bp, Homo sapiens
acagcctttgcgctctgggt

SEQ ID NO: 612581 - DNA, 23 bp, Homo sapiens
acagcggccccgcggagcccccg

SEQ ID NO: 612582 - DNA, 13 bp, Homo sapiens
acagcggcccggc

SEQ ID NO: 612583 - DNA, 15 bp, Homo sapiens
acagcggcccggccc

SEQ ID NO: 612584 - DNA, 17 bp, Homo sapiens
acagctgggcagggtga

SEQ ID NO: 612585 - DNA, 17 bp, Homo sapiens
acagcttcacttaaaat

SEQ ID NO: 612586 - DNA, 21 bp, Homo sapiens
acagcttcacttaaaatcaaa

SEQ ID NO: 612587 - DNA, 22 bp, Homo sapiens
acagcttccccatcgccttctg

SEQ ID NO: 612588 - DNA, 16 bp, Homo sapiens
acaggagcgtgtccta

SEQ ID NO: 612589 - DNA, 13 bp, Homo sapiens
acaggatgcatat

SEQ ID NO: 612590 - DNA, 16 bp, Homo sapiens
acaggatgcatattaa

SEQ ID NO: 612591 - DNA, 20 bp, Homo sapiens
acaggcaccatgctgggccg

SEQ ID NO: 612592 - DNA, 22 bp, Homo sapiens
acaggcatccgctgcgctccca

SEQ ID NO: 612593 - DNA, 22 bp, Homo sapiens
acaggcattgcactaaaagtga

SEQ ID NO: 612594 - DNA, 20 bp, Homo sapiens
acagggacacagtctggtgc

SEQ ID NO: 612595 - DNA, 13 bp, Homo sapiens
acagggcgtcctc

SEQ ID NO: 612596 - DNA, 21 bp, Homo sapiens
acagggtggggcttagaatgg

SEQ ID NO: 612597 - DNA, 15 bp, Homo sapiens
acagtaaatatacac

SEQ ID NO: 612598 - DNA, 13 bp, Homo sapiens
acagtaatcagtt

SEQ ID NO: 612599 - DNA, 13 bp, Homo sapiens
acagtatttaaca

SEQ ID NO: 612600 - DNA, 21 bp, Homo sapiens
acagtcctcacagcctctccc

SEQ ID NO: 612601 - DNA, 14 bp, Homo sapiens
acagtctaattttt

SEQ ID NO: 612602 - DNA, 18 bp, Homo sapiens
acagtctaatttttattc

SEQ ID NO: 612603 - DNA, 21 bp, Homo sapiens
acagtctaatttttattcata

SEQ ID NO: 612604 - DNA, 22 bp, Homo sapiens
acagtctctatttgatttgcaa

SEQ ID NO: 612605 - DNA, 13 bp, Homo sapiens
acagtgaacagct

SEQ ID NO: 612606 - DNA, 14 bp, Homo sapiens
acagtggggcccat

SEQ ID NO: 612607 - DNA, 15 bp, Homo sapiens
acagtggggcccatg

SEQ ID NO: 612608 - DNA, 21 bp, Homo sapiens
acagtggggcccatggcccca

SEQ ID NO: 612609 - DNA, 20 bp, Homo sapiens
acagtggttgttttttcatt

SEQ ID NO: 612610 - DNA, 15 bp, Homo sapiens
acagtgttcaaattc

SEQ ID NO: 612611 - DNA, 15 bp, Homo sapiens
acagttacttacaca

SEQ ID NO: 612612 - DNA, 17 bp, Homo sapiens
acataaacacttctcct

SEQ ID NO: 612613 - DNA, 12 bp, Homo sapiens
acataacacaca

SEQ ID NO: 612614 - DNA, 13 bp, Homo sapiens
acataacaggcat

SEQ ID NO: 612615 - DNA, 14 bp, Homo sapiens
acataacaggcatt

SEQ ID NO: 612616 - DNA, 22 bp, Homo sapiens
acataagctggtatcagtggtt

SEQ ID NO: 612617 - DNA, 16 bp, Homo sapiens
acatagcagctggtta

SEQ ID NO: 612618 - DNA, 14 bp, Homo sapiens
acatagtggtattt

SEQ ID NO: 612619 - DNA, 16 bp, Homo sapiens
acatagtggtatttta

SEQ ID NO: 612620 - DNA, 13 bp, Homo sapiens
acatataaacaca

SEQ ID NO: 612621 - DNA, 16 bp, Homo sapiens
acatataaacacagta

SEQ ID NO: 612622 - DNA, 13 bp, Homo sapiens
acatatatacata

SEQ ID NO: 612623 - DNA, 22 bp, Homo sapiens
acatattcccatggtagactgt

SEQ ID NO: 612624 - DNA, 22 bp, Homo sapiens
acatatttcataagcacatcca

SEQ ID NO: 612625 - DNA, 12 bp, Homo sapiens
acatctgatatc

SEQ ID NO: 612626 - DNA, 22 bp, Homo sapiens
acatctgatatcaggaaatatc

SEQ ID NO: 612627 - DNA, 15 bp, Homo sapiens
acatctgatttctga

SEQ ID NO: 612628 - DNA, 21 bp, Homo sapiens
acatctggccctgacttctgg

SEQ ID NO: 612629 - DNA, 18 bp, Homo sapiens
acatctgtatatcagctc

SEQ ID NO: 612630 - DNA, 20 bp, Homo sapiens
acatgacccgtacacaccac

SEQ ID NO: 612631 - DNA, 16 bp, Homo sapiens
acatgatgatttcaga

SEQ ID NO: 612632 - DNA, 17 bp, Homo sapiens
acatgcctttccagtgc

SEQ ID NO: 612633 - DNA, 20 bp, Homo sapiens
acatggcacttggaagaaaa

SEQ ID NO: 612634 - DNA, 14 bp, Homo sapiens
acatgggccagccc

SEQ ID NO: 612635 - DNA, 15 bp, Homo sapiens
aagaggtttcagcat

SEQ ID NO: 612636 - DNA, 20 bp, Homo sapiens
aagataaatccaactctgac

SEQ ID NO: 612637 - DNA, 19 bp, Homo sapiens
aagataattaaatgaaata

SEQ ID NO: 612638 - DNA, 18 bp, Homo sapiens
aagatagttgtaaagata

SEQ ID NO: 612639 - DNA, 23 bp, Homo sapiens
aagatagttgtaaagatattgta

SEQ ID NO: 612640 - DNA, 16 bp, Homo sapiens
aagatctcctgtgcac

SEQ ID NO: 612641 - DNA, 18 bp, Homo sapiens
aagatctttttttaagtg

SEQ ID NO: 612642 - DNA, 22 bp, Homo sapiens
aagatctttttttaagtgttct

SEQ ID NO: 612643 - DNA, 20 bp, Homo sapiens
aagatggatttgacacactc

SEQ ID NO: 612644 - DNA, 21 bp, Homo sapiens
aagatggatttgacacactca

SEQ ID NO: 612645 - DNA, 14 bp, Homo sapiens
aagatgtttaactt

SEQ ID NO: 612646 - DNA, 18 bp, Homo sapiens
aagatgtttaacttaatc

SEQ ID NO: 612647 - DNA, 20 bp, Homo sapiens
aagattatatacaaagctgt

SEQ ID NO: 612648 - DNA, 12 bp, Homo sapiens
aagattccatgg

SEQ ID NO: 612649 - DNA, 21 bp, Homo sapiens
aagattttccttttttataca

SEQ ID NO: 612650 - DNA, 23 bp, Homo sapiens
aagcaaacacacagactctgtga

SEQ ID NO: 612651 - DNA, 14 bp, Homo sapiens
aagcaaactgaaat

SEQ ID NO: 612652 - DNA, 18 bp, Homo sapiens
aagcaaactgaaattagt

SEQ ID NO: 612653 - DNA, 14 bp, Homo sapiens
aagcaaataaatat

SEQ ID NO: 612654 - DNA, 23 bp, Homo sapiens
aagcaactgtctatttctgctga

SEQ ID NO: 612655 - DNA, 19 bp, Homo sapiens
aagcacaaaaaatttaaga

SEQ ID NO: 612656 - DNA, 11 bp, Homo sapiens
aagcacacaca

SEQ ID NO: 612657 - DNA, 16 bp, Homo sapiens
aagcacacacatctgg

SEQ ID NO: 612658 - DNA, 11 bp, Homo sapiens
aagcagaatga

SEQ ID NO: 612659 - DNA, 16 bp, Homo sapiens
aagcagaatgagatga

SEQ ID NO: 612660 - DNA, 17 bp, Homo sapiens
aagcagacacacacata

SEQ ID NO: 612661 - DNA, 15 bp, Homo sapiens
aagcagcaaggtggg

SEQ ID NO: 612662 - DNA, 13 bp, Homo sapiens
aagcagcagctag

SEQ ID NO: 612663 - DNA, 22 bp, Homo sapiens
aagcagcagctagaaagagaaa

SEQ ID NO: 612664 - DNA, 20 bp, Homo sapiens
aagcaggaaagatcccaagt

SEQ ID NO: 612665 - DNA, 16 bp, Homo sapiens
aagcatagacgtctca

SEQ ID NO: 612666 - DNA, 13 bp, Homo sapiens
aagcatccaggca

SEQ ID NO: 612667 - DNA, 12 bp, Homo sapiens
aagcatctgtgt

SEQ ID NO: 612668 - DNA, 13 bp, Homo sapiens
aagcatctgtgta

SEQ ID NO: 612669 - DNA, 15 bp, Homo sapiens
aagcatgtacagtgt

SEQ ID NO: 612670 - DNA, 21 bp, Homo sapiens
aagcattaaaaataagccaaa

SEQ ID NO: 612671 - DNA, 13 bp, Homo sapiens
aagcattgctaaa

SEQ ID NO: 612672 - DNA, 17 bp, Homo sapiens
aagccaaaataagacta

SEQ ID NO: 612673 - DNA, 14 bp, Homo sapiens
aagccaagtgtcct

SEQ ID NO: 612674 - DNA, 15 bp, Homo sapiens
aagccaagtgtcctg

SEQ ID NO: 612675 - DNA, 21 bp, Homo sapiens
aagccaatttttctgcactga

SEQ ID NO: 612676 - DNA, 22 bp, Homo sapiens
aagccaatttttctgcactgag

SEQ ID NO: 612677 - DNA, 13 bp, Homo sapiens
aagccaggagacc

SEQ ID NO: 612678 - DNA, 19 bp, Homo sapiens
aagccagggttccagacag

SEQ ID NO: 612679 - DNA, 16 bp, Homo sapiens
aagccatagccccagg

SEQ ID NO: 612680 - DNA, 14 bp, Homo sapiens
aagcccacccgccc

SEQ ID NO: 612681 - DNA, 23 bp, Homo sapiens
aagcccacccgccccagagactg

SEQ ID NO: 612682 - DNA, 16 bp, Homo sapiens
aagcccacttcacaca

SEQ ID NO: 612683 - DNA, 13 bp, Homo sapiens
aagcccaggagga

SEQ ID NO: 612684 - DNA, 22 bp, Homo sapiens
aagcccctagtcttagagatac

SEQ ID NO: 612685 - DNA, 21 bp, Homo sapiens
aagccctccctgtctgtctgt

SEQ ID NO: 612686 - DNA, 17 bp, Homo sapiens
aagctaaaatgaaaaat

SEQ ID NO: 612687 - DNA, 14 bp, Homo sapiens
aagctatttaagtg

SEQ ID NO: 612688 - DNA, 16 bp, Homo sapiens
aagctcacttgcttta

SEQ ID NO: 612689 - DNA, 20 bp, Homo sapiens
aagctcatagcacatgtttt

SEQ ID NO: 612690 - DNA, 16 bp, Homo sapiens
aagctccatcttattt

SEQ ID NO: 612691 - DNA, 23 bp, Homo sapiens
aatatagggtttgtttgctgctt

SEQ ID NO: 612692 - DNA, 21 bp, Homo sapiens
aatatagtgttgtgttacaat

SEQ ID NO: 612693 - DNA, 17 bp, Homo sapiens
aatatatattaaaattg

SEQ ID NO: 612694 - DNA, 22 bp, Homo sapiens
aatatatatttatcatatttaa

SEQ ID NO: 612695 - DNA, 14 bp, Homo sapiens
aatatatgtttggc

SEQ ID NO: 612696 - DNA, 22 bp, Homo sapiens
aatatatgtttggctgaaatta

SEQ ID NO: 612697 - DNA, 18 bp, Homo sapiens
aatatcagttacagtggc

SEQ ID NO: 612698 - DNA, 18 bp, Homo sapiens
aatatcattatagcatgt

SEQ ID NO: 612699 - DNA, 22 bp, Homo sapiens
aatatcattatagcatgtaata

SEQ ID NO: 612700 - DNA, 19 bp, Homo sapiens
aatatgattctcctctccc

SEQ ID NO: 612701 - DNA, 20 bp, Homo sapiens
aatatgattctcctctccca

SEQ ID NO: 612702 - DNA, 21 bp, Homo sapiens
aatatgattctcctctcccaa

SEQ ID NO: 612703 - DNA, 15 bp, Homo sapiens
aatatgcatatatat

SEQ ID NO: 612704 - DNA, 18 bp, Homo sapiens
aatatgcatatatatgta

SEQ ID NO: 612705 - DNA, 21 bp, Homo sapiens
aatatgcatatatatgtatat

SEQ ID NO: 612706 - DNA, 22 bp, Homo sapiens
aatattactctgcctgtcaagt

SEQ ID NO: 612707 - DNA, 17 bp, Homo sapiens
aatattgccttgatgtt

SEQ ID NO: 612708 - DNA, 19 bp, Homo sapiens
aatattgccttgatgtttc

SEQ ID NO: 612709 - DNA, 20 bp, Homo sapiens
aatattgccttgatgtttct

SEQ ID NO: 612710 - DNA, 11 bp, Homo sapiens
aatattgctga

SEQ ID NO: 612711 - DNA, 22 bp, Homo sapiens
aatattgctgatggtgcaatga

SEQ ID NO: 612712 - DNA, 16 bp, Homo sapiens
aatattttctacttta

SEQ ID NO: 612713 - DNA, 21 bp, Homo sapiens
aatattttctactttaaattg

SEQ ID NO: 612714 - DNA, 19 bp, Homo sapiens
aatattttcttaattatgg

SEQ ID NO: 612715 - DNA, 13 bp, Homo sapiens
aatcaaaaaatta

SEQ ID NO: 612716 - DNA, 16 bp, Homo sapiens
aatcaaaaaattatct

SEQ ID NO: 612717 - DNA, 17 bp, Homo sapiens
aatcaaaaattgaagag

SEQ ID NO: 612718 - DNA, 16 bp, Homo sapiens
aatcaaaataatactt

SEQ ID NO: 612719 - DNA, 19 bp, Homo sapiens
aatcaacagtgaacagctt

SEQ ID NO: 612720 - DNA, 14 bp, Homo sapiens
aatcaccgaaaacg

SEQ ID NO: 612721 - DNA, 19 bp, Homo sapiens
aatcacctaattaatttca

SEQ ID NO: 612722 - DNA, 20 bp, Homo sapiens
aatcacctaattaatttcag

SEQ ID NO: 612723 - DNA, 20 bp, Homo sapiens
aatcactttaatttagaaga

SEQ ID NO: 612724 - DNA, 12 bp, Homo sapiens
aatcataatcat

SEQ ID NO: 612725 - DNA, 13 bp, Homo sapiens
aatcataatcatc

SEQ ID NO: 612726 - DNA, 14 bp, Homo sapiens
aatcatacacagaa

SEQ ID NO: 612727 - DNA, 18 bp, Homo sapiens
aatcatcctcatgccttt

SEQ ID NO: 612728 - DNA, 12 bp, Homo sapiens
aatcatctattg

SEQ ID NO: 612729 - DNA, 15 bp, Homo sapiens
aatcatctattgagt

SEQ ID NO: 612730 - DNA, 14 bp, Homo sapiens
aatcattttgatgt

SEQ ID NO: 612731 - DNA, 14 bp, Homo sapiens
aatccacctggtgg

SEQ ID NO: 612732 - DNA, 15 bp, Homo sapiens
aatccatatcagctc

SEQ ID NO: 612733 - DNA, 13 bp, Homo sapiens
aatctaaatataa

SEQ ID NO: 612734 - DNA, 17 bp, Homo sapiens
aatctacaaacttttat

SEQ ID NO: 612735 - DNA, 19 bp, Homo sapiens
aatctacaaacttttataa

SEQ ID NO: 612736 - DNA, 21 bp, Homo sapiens
aatctacaaacttttataaat

SEQ ID NO: 612737 - DNA, 15 bp, Homo sapiens
aatctagagctatgc

SEQ ID NO: 612738 - DNA, 22 bp, Homo sapiens
aatctctcaaaatgtgccgtct

SEQ ID NO: 612739 - DNA, 19 bp, Homo sapiens
aatctctcacccagttcag

SEQ ID NO: 612740 - DNA, 15 bp, Homo sapiens
aatctgaatttctaa

SEQ ID NO: 612741 - DNA, 22 bp, Homo sapiens
aatctgctttcatccagccact

SEQ ID NO: 612742 - DNA, 23 bp, Homo sapiens
aatcttacccttcaatgttaaat

SEQ ID NO: 612743 - DNA, 20 bp, Homo sapiens
aatcttgaaagcgaaatact

SEQ ID NO: 612744 - DNA, 23 bp, Homo sapiens
aatcttgctgtgaaacagtgtgg

SEQ ID NO: 612745 - DNA, 14 bp, Homo sapiens
aatgaaaaatctga

SEQ ID NO: 612746 - DNA, 18 bp, Homo sapiens
aatgaaaaatctgaattt

SEQ ID NO: 612747 - DNA, 12 bp, Homo sapiens
aatgaaatataa

SEQ ID NO: 612748 - DNA, 17 bp, Homo sapiens
aatgaaatataaactgt

SEQ ID NO: 612749 - DNA, 14 bp, Homo sapiens
aatgaactctttcc

SEQ ID NO: 612750 - DNA, 15 bp, Homo sapiens
aatgaatgaaatata

SEQ ID NO: 612751 - DNA, 13 bp, Homo sapiens
aatgaattgcctt

SEQ ID NO: 612752 - DNA, 14 bp, Homo sapiens
aatgaattgccttt

SEQ ID NO: 612753 - DNA, 17 bp, Homo sapiens
aatgaattgcctttgat

SEQ ID NO: 612754 - DNA, 14 bp, Homo sapiens
aatgaatttatcat

SEQ ID NO: 612755 - DNA, 16 bp, Homo sapiens
aatgaatttatcattt

SEQ ID NO: 612756 - DNA, 22 bp, Homo sapiens
aatgaccagaaaatttttgtct

SEQ ID NO: 612757 - DNA, 17 bp, Homo sapiens
aacagtaactgccattt

SEQ ID NO: 612758 - DNA, 14 bp, Homo sapiens
aacagtaatcagtt

SEQ ID NO: 612759 - DNA, 22 bp, Homo sapiens
aacagtgtggcttaaacatttt

SEQ ID NO: 612760 - DNA, 13 bp, Homo sapiens
aacagttttaaga

SEQ ID NO: 612761 - DNA, 13 bp, Homo sapiens
aacatagtggtat

SEQ ID NO: 612762 - DNA, 16 bp, Homo sapiens
aacatagtggtatttt

SEQ ID NO: 612763 - DNA, 18 bp, Homo sapiens
aacatagtggtattttaa

SEQ ID NO: 612764 - DNA, 19 bp, Homo sapiens
aacatagtggtattttaac

SEQ ID NO: 612765 - DNA, 13 bp, Homo sapiens
aacatagttttca

SEQ ID NO: 612766 - DNA, 16 bp, Homo sapiens
aacatgacccagcctg

SEQ ID NO: 612767 - DNA, 17 bp, Homo sapiens
aacatgacccagcctga

SEQ ID NO: 612768 - DNA, 14 bp, Homo sapiens
aacatgtgatgtgt

SEQ ID NO: 612769 - DNA, 15 bp, Homo sapiens
aacatgtgatgtgtt

SEQ ID NO: 612770 - DNA, 21 bp, Homo sapiens
aacattatagattttcatgtt

SEQ ID NO: 612771 - DNA, 20 bp, Homo sapiens
aacattgcctatttcagtgg

SEQ ID NO: 612772 - DNA, 14 bp, Homo sapiens
aacattgtatgtta

SEQ ID NO: 612773 - DNA, 19 bp, Homo sapiens
aacattgttccagattcaa

SEQ ID NO: 612774 - DNA, 18 bp, Homo sapiens
aacattttaaatggacag

SEQ ID NO: 612775 - DNA, 18 bp, Homo sapiens
aacattttttgtttcttg

SEQ ID NO: 612776 - DNA, 21 bp, Homo sapiens
aacattttttgtttcttggtg

SEQ ID NO: 612777 - DNA, 17 bp, Homo sapiens
aaccaacgggtctgtgg

SEQ ID NO: 612778 - DNA, 15 bp, Homo sapiens
aaccaatttgttctg

SEQ ID NO: 612779 - DNA, 12 bp, Homo sapiens
aaccacagctgg

SEQ ID NO: 612780 - DNA, 13 bp, Homo sapiens
aaccagaaagagg

SEQ ID NO: 612781 - DNA, 16 bp, Homo sapiens
aaccagcactcccagg

SEQ ID NO: 612782 - DNA, 18 bp, Homo sapiens
aaccagcactcccagggc

SEQ ID NO: 612783 - DNA, 17 bp, Homo sapiens
aaccagctcaggctact

SEQ ID NO: 612784 - DNA, 12 bp, Homo sapiens
aaccatcattga

SEQ ID NO: 612785 - DNA, 18 bp, Homo sapiens
aaccatcattgaaatctt

SEQ ID NO: 612786 - DNA, 19 bp, Homo sapiens
aaccatcattgaaatcttt

SEQ ID NO: 612787 - DNA, 23 bp, Homo sapiens
aaccatcattgaaatctttttgc

SEQ ID NO: 612788 - DNA, 19 bp, Homo sapiens
aaccatgaaaagttttcaa

SEQ ID NO: 612789 - DNA, 20 bp, Homo sapiens
aaccattcttgggaggacac

SEQ ID NO: 612790 - DNA, 16 bp, Homo sapiens
aacccaggattcaaca

SEQ ID NO: 612791 - DNA, 15 bp, Homo sapiens
aacccaggtgttgtc

SEQ ID NO: 612792 - DNA, 19 bp, Homo sapiens
aacccaggtgttgtccgtg

SEQ ID NO: 612793 - DNA, 12 bp, Homo sapiens
aacccagtgttc

SEQ ID NO: 612794 - DNA, 11 bp, Homo sapiens
aacccccacct

SEQ ID NO: 612795 - DNA, 17 bp, Homo sapiens
aaccgtcaatgtgaaat

SEQ ID NO: 612796 - DNA, 13 bp, Homo sapiens
aacctactgccca

SEQ ID NO: 612797 - DNA, 17 bp, Homo sapiens
aacctcagttggcctct

SEQ ID NO: 612798 - DNA, 21 bp, Homo sapiens
aacctcagttggcctctgccc

SEQ ID NO: 612799 - DNA, 18 bp, Homo sapiens
aacctcccctggtcctgc

SEQ ID NO: 612800 - DNA, 19 bp, Homo sapiens
aacctctcagatccctcgg

SEQ ID NO: 612801 - DNA, 18 bp, Homo sapiens
aacctgggttgttgcaga

SEQ ID NO: 612802 - DNA, 16 bp, Homo sapiens
aacctgtgctttcatg

SEQ ID NO: 612803 - DNA, 19 bp, Homo sapiens
aaccttcaaatacattcta

SEQ ID NO: 612804 - DNA, 17 bp, Homo sapiens
aaccttgtactttacaa

SEQ ID NO: 612805 - DNA, 18 bp, Homo sapiens
aacgaccgacgcccctcc

SEQ ID NO: 612806 - DNA, 20 bp, Homo sapiens
aacgggtctgtgggactggc

SEQ ID NO: 612807 - DNA, 12 bp, Homo sapiens
aacgtggctgct

SEQ ID NO: 612808 - DNA, 16 bp, Homo sapiens
aacgtggctgcttcaa

SEQ ID NO: 612809 - DNA, 22 bp, Homo sapiens
aacgtggctgcttcaaggatcc

SEQ ID NO: 612810 - DNA, 22 bp, Homo sapiens
aactaaaggaaacaaagcaata

SEQ ID NO: 612811 - DNA, 20 bp, Homo sapiens
aactaaatagatttttagat

SEQ ID NO: 612812 - DNA, 11 bp, Homo sapiens
aactaatgtaa

SEQ ID NO: 612813 - DNA, 17 bp, Homo sapiens
aactatcagggcaagct

SEQ ID NO: 612814 - DNA, 15 bp, Homo sapiens
aactcatacagtctc

SEQ ID NO: 612815 - DNA, 20 bp, Homo sapiens
cacgattccaacccaggtct

SEQ ID NO: 612816 - DNA, 21 bp, Homo sapiens
cacgattccaacccaggtctg

SEQ ID NO: 612817 - DNA, 11 bp, Homo sapiens
cacgcagagcc

SEQ ID NO: 612818 - DNA, 12 bp, Homo sapiens
cacgcagagccc

SEQ ID NO: 612819 - DNA, 15 bp, Homo sapiens
cacgcagagccccgg

SEQ ID NO: 612820 - DNA, 16 bp, Homo sapiens
cacgcagagccccgga

SEQ ID NO: 612821 - DNA, 21 bp, Homo sapiens
cacgcagagccccggagcacc

SEQ ID NO: 612822 - DNA, 17 bp, Homo sapiens
cacgccgatataagcca

SEQ ID NO: 612823 - DNA, 19 bp, Homo sapiens
cacgccgatataagccata

SEQ ID NO: 612824 - DNA, 22 bp, Homo sapiens
cacgccgatataagccatagcc

SEQ ID NO: 612825 - DNA, 17 bp, Homo sapiens
cacgccggggctggccc

SEQ ID NO: 612826 - DNA, 21 bp, Homo sapiens
cacggcgtccctgagggccct

SEQ ID NO: 612827 - DNA, 15 bp, Homo sapiens
cacgggagagcgcca

SEQ ID NO: 612828 - DNA, 18 bp, Homo sapiens
cacgggcccgctcaacct

SEQ ID NO: 612829 - DNA, 23 bp, Homo sapiens
cacgggcccgctcaacctctcag

SEQ ID NO: 612830 - DNA, 17 bp, Homo sapiens
cacggggtcgggggagg

SEQ ID NO: 612831 - DNA, 23 bp, Homo sapiens
cacggggtcgggggaggagcacc

SEQ ID NO: 612832 - DNA, 20 bp, Homo sapiens
cacggtccaatccagccttc

SEQ ID NO: 612833 - DNA, 13 bp, Homo sapiens
cacggtgtggggg

SEQ ID NO: 612834 - DNA, 15 bp, Homo sapiens
cacggtgtggggggt

SEQ ID NO: 612835 - DNA, 17 bp, Homo sapiens
cacgtcatctagtttta

SEQ ID NO: 612836 - DNA, 21 bp, Homo sapiens
cacgtctgtgagtctgtcctt

SEQ ID NO: 612837 - DNA, 20 bp, Homo sapiens
cacgtgcagcacctgtcacc

SEQ ID NO: 612838 - DNA, 20 bp, Homo sapiens
cacgtggtcaaggcccggcc

SEQ ID NO: 612839 - DNA, 18 bp, Homo sapiens
cactaaaagtgatgtgat

SEQ ID NO: 612840 - DNA, 19 bp, Homo sapiens
cactacatgggccagccct

SEQ ID NO: 612841 - DNA, 21 bp, Homo sapiens
cactacctttgtccaggcctg

SEQ ID NO: 612842 - DNA, 21 bp, Homo sapiens
cactagccctctttctctctg

SEQ ID NO: 612843 - DNA, 21 bp, Homo sapiens
cactaggtgcccagtcttgag

SEQ ID NO: 612844 - DNA, 18 bp, Homo sapiens
cactatctttcaggaaat

SEQ ID NO: 612845 - DNA, 13 bp, Homo sapiens
cactattttatgc

SEQ ID NO: 612846 - DNA, 12 bp, Homo sapiens
cactcaccattt

SEQ ID NO: 612847 - DNA, 12 bp, Homo sapiens
cactcagcagcc

SEQ ID NO: 612848 - DNA, 13 bp, Homo sapiens
cactcagcagccc

SEQ ID NO: 612849 - DNA, 17 bp, Homo sapiens
cactcaggagcacagcc

SEQ ID NO: 612850 - DNA, 21 bp, Homo sapiens
cactcaggagcacagccatag

SEQ ID NO: 612851 - DNA, 23 bp, Homo sapiens
cactcaggagcacagccatagca

SEQ ID NO: 612852 - DNA, 15 bp, Homo sapiens
cactccccccatcct

SEQ ID NO: 612853 - DNA, 12 bp, Homo sapiens
cactcccctcat

SEQ ID NO: 612854 - DNA, 20 bp, Homo sapiens
cactccctaagtccactcta

SEQ ID NO: 612855 - DNA, 23 bp, Homo sapiens
caaacagtgtggcttaaacattt

SEQ ID NO: 612856 - DNA, 15 bp, Homo sapiens
caaacatcagtcaat

SEQ ID NO: 612857 - DNA, 18 bp, Homo sapiens
caaaccaatttgttctgt

SEQ ID NO: 612858 - DNA, 20 bp, Homo sapiens
caaaccaatttgttctgtgc

SEQ ID NO: 612859 - DNA, 13 bp, Homo sapiens
caaacctaagttg

SEQ ID NO: 612860 - DNA, 15 bp, Homo sapiens
caaacctactgccca

SEQ ID NO: 612861 - DNA, 18 bp, Homo sapiens
caaacttttataaatgtt

SEQ ID NO: 612862 - DNA, 15 bp, Homo sapiens
caaagaactgcccca

SEQ ID NO: 612863 - DNA, 20 bp, Homo sapiens
caaagaactgccccatctcc

SEQ ID NO: 612864 - DNA, 20 bp, Homo sapiens
caaagacttcatttaacact

SEQ ID NO: 612865 - DNA, 20 bp, Homo sapiens
caaagaggccagtactttgc

SEQ ID NO: 612866 - DNA, 18 bp, Homo sapiens
caaagcatgctcagtatt

SEQ ID NO: 612867 - DNA, 14 bp, Homo sapiens
caaagccagctctg

SEQ ID NO: 612868 - DNA, 16 bp, Homo sapiens
caaagccagctctgag

SEQ ID NO: 612869 - DNA, 14 bp, Homo sapiens
caaagtcctttccc

SEQ ID NO: 612870 - DNA, 17 bp, Homo sapiens
caaagtgttgtcttatt

SEQ ID NO: 612871 - DNA, 13 bp, Homo sapiens
caaagttatccag

SEQ ID NO: 612872 - DNA, 15 bp, Homo sapiens
caaagtttacattgt

SEQ ID NO: 612873 - DNA, 13 bp, Homo sapiens
caaagtttggaag

SEQ ID NO: 612874 - DNA, 14 bp, Homo sapiens
caaagtttggaagt

SEQ ID NO: 612875 - DNA, 22 bp, Homo sapiens
caaagtttggaagtacataaag

SEQ ID NO: 612876 - DNA, 15 bp, Homo sapiens
caaagttttcagatt

SEQ ID NO: 612877 - DNA, 20 bp, Homo sapiens
caaagttttcagattgtaaa

SEQ ID NO: 612878 - DNA, 20 bp, Homo sapiens
caaataaatcatcctcatgt

SEQ ID NO: 612879 - DNA, 21 bp, Homo sapiens
caaataaatcatcctcatgtc

SEQ ID NO: 612880 - DNA, 20 bp, Homo sapiens
caaataaccctgaatcagag

SEQ ID NO: 612881 - DNA, 13 bp, Homo sapiens
caaataatattgc

SEQ ID NO: 612882 - DNA, 14 bp, Homo sapiens
caaataatattgcc

SEQ ID NO: 612883 - DNA, 16 bp, Homo sapiens
caaataatattgcctt

SEQ ID NO: 612884 - DNA, 23 bp, Homo sapiens
caaataatattgccttgatgttt

SEQ ID NO: 612885 - DNA, 14 bp, Homo sapiens
caaatacacataca

SEQ ID NO: 612886 - DNA, 15 bp, Homo sapiens
caaatacacatacat

SEQ ID NO: 612887 - DNA, 16 bp, Homo sapiens
caaatacacatacata

SEQ ID NO: 612888 - DNA, 20 bp, Homo sapiens
caaatacacatacatatata

SEQ ID NO: 612889 - DNA, 17 bp, Homo sapiens
caaatatactcatttgg

SEQ ID NO: 612890 - DNA, 17 bp, Homo sapiens
caaatatgattctcctc

SEQ ID NO: 612891 - DNA, 19 bp, Homo sapiens
caaatatgattctcctctc

SEQ ID NO: 612892 - DNA, 22 bp, Homo sapiens
caaatatgattctcctctccca

SEQ ID NO: 612893 - DNA, 12 bp, Homo sapiens
caaatattttca

SEQ ID NO: 612894 - DNA, 17 bp, Homo sapiens
caaatatttttttgtag

SEQ ID NO: 612895 - DNA, 23 bp, Homo sapiens
caaatcattttgatgtattatta

SEQ ID NO: 612896 - DNA, 15 bp, Homo sapiens
caaatgaatttatca

SEQ ID NO: 612897 - DNA, 18 bp, Homo sapiens
caaatgaatttatcattt

SEQ ID NO: 612898 - DNA, 20 bp, Homo sapiens
caaatgaatttatcatttta

SEQ ID NO: 612899 - DNA, 15 bp, Homo sapiens
caaatggatgtaata

SEQ ID NO: 612900 - DNA, 14 bp, Homo sapiens
caaatggtattttt

SEQ ID NO: 612901 - DNA, 20 bp, Homo sapiens
caaatggtattttttgtgaa

SEQ ID NO: 612902 - DNA, 21 bp, Homo sapiens
caaatggtattttttgtgaat

SEQ ID NO: 612903 - DNA, 20 bp, Homo sapiens
caaatgtgtcttgtattatc

SEQ ID NO: 612904 - DNA, 13 bp, Homo sapiens
caaattctgatta

SEQ ID NO: 612905 - DNA, 18 bp, Homo sapiens
caaattctgattattaca

SEQ ID NO: 612906 - DNA, 19 bp, Homo sapiens
caaattctgattattacaa

SEQ ID NO: 612907 - DNA, 14 bp, Homo sapiens
caaattgccttcag

SEQ ID NO: 612908 - DNA, 15 bp, Homo sapiens
caaattgccttcagc

SEQ ID NO: 612909 - DNA, 15 bp, Homo sapiens
caaatttttactcag

SEQ ID NO: 612910 - DNA, 20 bp, Homo sapiens
caaatttttactcaggcttt

SEQ ID NO: 612911 - DNA, 19 bp, Homo sapiens
caaatttttctgggaagaa

SEQ ID NO: 612912 - DNA, 14 bp, Homo sapiens
caacaaagcatgct

SEQ ID NO: 612913 - DNA, 22 bp, Homo sapiens
caacaaagcatgctcagtattg

SEQ ID NO: 612914 - DNA, 13 bp, Homo sapiens
caacaacagaaca

SEQ ID NO: 612915 - DNA, 22 bp, Homo sapiens
caacaagcaaactgaaattagt

SEQ ID NO: 612916 - DNA, 20 bp, Homo sapiens
caacaatttaggaatgctca

SEQ ID NO: 612917 - DNA, 14 bp, Homo sapiens
caacagaacaacaa

SEQ ID NO: 612918 - DNA, 20 bp, Homo sapiens
caacagaacaacaacaaagc

SEQ ID NO: 612919 - DNA, 22 bp, Homo sapiens
caacagactgccttatattatt

SEQ ID NO: 612920 - DNA, 23 bp, Homo sapiens
caacagactgccttatattattt

SEQ ID NO: 612921 - DNA, 15 bp, Homo sapiens
caacagcaacaacaa

SEQ ID NO: 612922 - DNA, 16 bp, Homo sapiens
caacagcaacaacaac

SEQ ID NO: 612923 - DNA, 18 bp, Homo sapiens
caacagcaacaacaacag

SEQ ID NO: 612924 - DNA, 21 bp, Homo sapiens
caacagtgaacagcttcactt

SEQ ID NO: 612925 - DNA, 13 bp, Homo sapiens
caaccagagcact

SEQ ID NO: 612926 - DNA, 15 bp, Homo sapiens
caaccagagcactgt

SEQ ID NO: 612927 - DNA, 16 bp, Homo sapiens
caaccagagcactgta

SEQ ID NO: 612928 - DNA, 13 bp, Homo sapiens
caacccaggtctg

SEQ ID NO: 612929 - DNA, 17 bp, Homo sapiens
caacccccacctcccgg

SEQ ID NO: 612930 - DNA, 12 bp, Homo sapiens
caaccctgccct

SEQ ID NO: 612931 - DNA, 14 bp, Homo sapiens
caaccctgccctgc

SEQ ID NO: 612932 - DNA, 18 bp, Homo sapiens
caaccctgccctgcacct

SEQ ID NO: 612933 - DNA, 21 bp, Homo sapiens
caacctcccctggtcctgcac

SEQ ID NO: 612934 - DNA, 16 bp, Homo sapiens
caacctgacagcaaac

SEQ ID NO: 612935 - DNA, 20 bp, Homo sapiens
caacctgacagcaaacacag

SEQ ID NO: 612936 - DNA, 23 bp, Homo sapiens
caacctgacagcaaacacagtca

SEQ ID NO: 612937 - DNA, 12 bp, Homo sapiens
caacctgcccct

SEQ ID NO: 612938 - DNA, 17 bp, Homo sapiens
caaccttgtactttaca

SEQ ID NO: 612939 - DNA, 14 bp, Homo sapiens
caacgggtctgtgg

SEQ ID NO: 612940 - DNA, 20 bp, Homo sapiens
caactgtggataaattttgg

SEQ ID NO: 612941 - DNA, 21 bp, Homo sapiens
caactgtggataaattttgga

SEQ ID NO: 612942 - DNA, 24 bp, Homo sapiens
caacttgaaattatatctgtggtc

SEQ ID NO: 612943 - DNA, 23 bp, Homo sapiens
caagagaccacttccttaacagc

SEQ ID NO: 612944 - DNA, 19 bp, Homo sapiens
caagagtccaagccatctg

SEQ ID NO: 612945 - DNA, 22 bp, Homo sapiens
cacactgagctgggcaccacag

SEQ ID NO: 612946 - DNA, 17 bp, Homo sapiens
cacacttgggctggcac

SEQ ID NO: 612947 - DNA, 20 bp, Homo sapiens
cacagactctgtgagattct

SEQ ID NO: 612948 - DNA, 19 bp, Homo sapiens
cacagagagcggcttcccc

SEQ ID NO: 612949 - DNA, 16 bp, Homo sapiens
cacagaggatggcttc

SEQ ID NO: 612950 - DNA, 13 bp, Homo sapiens
cacagcatgcatt

SEQ ID NO: 612951 - DNA, 18 bp, Homo sapiens
cacagcatgcatttagca

SEQ ID NO: 612952 - DNA, 17 bp, Homo sapiens
cacagccatagcagacg

SEQ ID NO: 612953 - DNA, 15 bp, Homo sapiens
cacagcccagagact

SEQ ID NO: 612954 - DNA, 17 bp, Homo sapiens
cacagcctcatcagtat

SEQ ID NO: 612955 - DNA, 13 bp, Homo sapiens
cacagcctctccc

SEQ ID NO: 612956 - DNA, 14 bp, Homo sapiens
cacagcctctccct

SEQ ID NO: 612957 - DNA, 21 bp, Homo sapiens
cacagcctttgcgctctgggt

SEQ ID NO: 612958 - DNA, 17 bp, Homo sapiens
cacagctgagctggcct

SEQ ID NO: 612959 - DNA, 18 bp, Homo sapiens
cacagctgagctggccta

SEQ ID NO: 612960 - DNA, 13 bp, Homo sapiens
cacagctgggcag

SEQ ID NO: 612961 - DNA, 14 bp, Homo sapiens
cacagctgggcagg

SEQ ID NO: 612962 - DNA, 15 bp, Homo sapiens
cacaggagcgtgtac

SEQ ID NO: 612963 - DNA, 16 bp, Homo sapiens
cacaggagcgtgtcct

SEQ ID NO: 612964 - DNA, 18 bp, Homo sapiens
cacaggagcgtgtcctat

SEQ ID NO: 612965 - DNA, 14 bp, Homo sapiens
cacagggactctcc

SEQ ID NO: 612966 - DNA, 23 bp, Homo sapiens
cacaggggcaaagaactgcccca

SEQ ID NO: 612967 - DNA, 15 bp, Homo sapiens
cacagtattgttctt

SEQ ID NO: 612968 - DNA, 13 bp, Homo sapiens
cacagtatttaac

SEQ ID NO: 612969 - DNA, 13 bp, Homo sapiens
cacagtcctcaca

SEQ ID NO: 612970 - DNA, 13 bp, Homo sapiens
cacagtgccccag

SEQ ID NO: 612971 - DNA, 14 bp, Homo sapiens
cacagtggggccca

SEQ ID NO: 612972 - DNA, 17 bp, Homo sapiens
cacagtggggcccatgg

SEQ ID NO: 612973 - DNA, 20 bp, Homo sapiens
cacagtggggcccatggccc

SEQ ID NO: 612974 - DNA, 22 bp, Homo sapiens
cacagtggggcccatggcccca

SEQ ID NO: 612975 - DNA, 23 bp, Homo sapiens
cacataaacacttctccttaacc

SEQ ID NO: 612976 - DNA, 13 bp, Homo sapiens
cacataacacaca

SEQ ID NO: 612977 - DNA, 18 bp, Homo sapiens
cacataattaaagtgtcc

SEQ ID NO: 612978 - DNA, 15 bp, Homo sapiens
cacatacatatatac

SEQ ID NO: 612979 - DNA, 14 bp, Homo sapiens
agtgggccccctct

SEQ ID NO: 612980 - DNA, 19 bp, Homo sapiens
agtgggcggcttccctgcg

SEQ ID NO: 612981 - DNA, 21 bp, Homo sapiens
agtggggcccatggccccagc

SEQ ID NO: 612982 - DNA, 14 bp, Homo sapiens
agtgggtgaatgtg

SEQ ID NO: 612983 - DNA, 17 bp, Homo sapiens
agtgggtgaatgtgtga

SEQ ID NO: 612984 - DNA, 21 bp, Homo sapiens
agtggtccagggtccagccct

SEQ ID NO: 612985 - DNA, 23 bp, Homo sapiens
agtggttcgggggaaatagttcc

SEQ ID NO: 612986 - DNA, 16 bp, Homo sapiens
agtgtactggatttaa

SEQ ID NO: 612987 - DNA, 20 bp, Homo sapiens
atgtacaaataatattgcct

SEQ ID NO: 612988 - DNA, 21 bp, Homo sapiens
atgtacaaataatattgcctt

SEQ ID NO: 612989 - DNA, 23 bp, Homo sapiens
atgtacagagaactaacactatt

SEQ ID NO: 612990 - DNA, 19 bp, Homo sapiens
atgtacaggctgagacaca

SEQ ID NO: 612991 - DNA, 13 bp, Homo sapiens
attcaacatcaat

SEQ ID NO: 612992 - DNA, 17 bp, Homo sapiens
attcaaggcattatttg

SEQ ID NO: 612993 - DNA, 18 bp, Homo sapiens
attcaataactattgctg

SEQ ID NO: 612994 - DNA, 13 bp, Homo sapiens
attcaatgtgaat

SEQ ID NO: 612995 - DNA, 16 bp, Homo sapiens
attcagatctgaagta

SEQ ID NO: 612996 - DNA, 12 bp, Homo sapiens
attcagcacaca

SEQ ID NO: 612997 - DNA, 21 bp, Homo sapiens
attcagcatcgtgtgggtccc

SEQ ID NO: 612998 - DNA, 17 bp, Homo sapiens
attcaggtgttctcttc

SEQ ID NO: 612999 - DNA, 21 bp, Homo sapiens
attcagtctatgctgtgtgca

SEQ ID NO: 613000 - DNA, 10 bp, Homo sapiens
attcagtgac

SEQ ID NO: 613001 - DNA, 11 bp, Homo sapiens
attcagtgaca

SEQ ID NO: 613002 - DNA, 16 bp, Homo sapiens
attcagtgacatgtcc

SEQ ID NO: 613003 - DNA, 14 bp, Homo sapiens
attcatactcaaag

SEQ ID NO: 613004 - DNA, 15 bp, Homo sapiens
attcatgatgctagt

SEQ ID NO: 613005 - DNA, 20 bp, Homo sapiens
attccaacccaggtctgctt

SEQ ID NO: 613006 - DNA, 22 bp, Homo sapiens
attccaacccaggtctgctttg

SEQ ID NO: 613007 - DNA, 17 bp, Homo sapiens
attccagggaaccagag

SEQ ID NO: 613008 - DNA, 21 bp, Homo sapiens
attcccactaagctttctcct

SEQ ID NO: 613009 - DNA, 16 bp, Homo sapiens
attcccaggcactctc

SEQ ID NO: 613010 - DNA, 20 bp, Homo sapiens
attcccatggtagactgtga

SEQ ID NO: 613011 - DNA, 22 bp, Homo sapiens
attcccatggtagactgtgaca

SEQ ID NO: 613012 - DNA, 14 bp, Homo sapiens
attccgttaggaat

SEQ ID NO: 613013 - DNA, 16 bp, Homo sapiens
attcctaattcctgta

SEQ ID NO: 613014 - DNA, 20 bp, Homo sapiens
attcctaattcctgtatgtt

SEQ ID NO: 613015 - DNA, 17 bp, Homo sapiens
attcctcccccagagcc

SEQ ID NO: 613016 - DNA, 17 bp, Homo sapiens
attcctgaccctcactt

SEQ ID NO: 613017 - DNA, 11 bp, Homo sapiens
attctcctctc

SEQ ID NO: 613018 - DNA, 18 bp, Homo sapiens
attctgattattacaaca

SEQ ID NO: 613019 - DNA, 23 bp, Homo sapiens
attctgcagaaaattaattgaaa

SEQ ID NO: 613020 - DNA, 17 bp, Homo sapiens
attctgctaatttatga

SEQ ID NO: 613021 - DNA, 18 bp, Homo sapiens
attctggggtggggcttg

SEQ ID NO: 613022 - DNA, 17 bp, Homo sapiens
attcttagttaatcttt

SEQ ID NO: 613023 - DNA, 18 bp, Homo sapiens
attcttataacattgtat

SEQ ID NO: 613024 - DNA, 22 bp, Homo sapiens
attcttataacattgtatgtta

SEQ ID NO: 613025 - DNA, 15 bp, Homo sapiens
attcttctcctttgt

SEQ ID NO: 613026 - DNA, 12 bp, Homo sapiens
attcttgcactg

SEQ ID NO: 613027 - DNA, 22 bp, Homo sapiens
attcttgccttgaggctctgca

SEQ ID NO: 613028 - DNA, 13 bp, Homo sapiens
attcttgggagga

SEQ ID NO: 613029 - DNA, 20 bp, Homo sapiens
attctttagtcattccaagt

SEQ ID NO: 613030 - DNA, 22 bp, Homo sapiens
attctttcacaaggcatccata

SEQ ID NO: 613031 - DNA, 16 bp, Homo sapiens
attctttgatatgttg

SEQ ID NO: 613032 - DNA, 23 bp, Homo sapiens
attctttgatatgttgatgaaat

SEQ ID NO: 613033 - DNA, 15 bp, Homo sapiens
attcttttaaatctc

SEQ ID NO: 613034 - DNA, 15 bp, Homo sapiens
attcttttttcaatg

SEQ ID NO: 613035 - DNA, 13 bp, Homo sapiens
attgaaactgtat

SEQ ID NO: 613036 - DNA, 18 bp, Homo sapiens
attgaaactgtatttact

SEQ ID NO: 613037 - DNA, 20 bp, Homo sapiens
attgaaactgtatttacttg

SEQ ID NO: 613038 - DNA, 17 bp, Homo sapiens
attgaaatctttttgct

SEQ ID NO: 613039 - DNA, 20 bp, Homo sapiens
attgaaccgtcaatgtgaaa

SEQ ID NO: 613040 - DNA, 19 bp, Homo sapiens
attgaagagagatatatct

SEQ ID NO: 613041 - DNA, 21 bp, Homo sapiens
attgaagagagatatatctga

SEQ ID NO: 613042 - DNA, 15 bp, Homo sapiens
attgacatgtacaga

SEQ ID NO: 613043 - DNA, 18 bp, Homo sapiens
attgacattttgtagcta

SEQ ID NO: 613044 - DNA, 17 bp, Homo sapiens
attgagacactgtcaag

SEQ ID NO: 613045 - DNA, 22 bp, Homo sapiens
attgagagatgttttgttgata

SEQ ID NO: 613046 - DNA, 20 bp, Homo sapiens
attgataattcgagcaaaca

SEQ ID NO: 613047 - DNA, 23 bp, Homo sapiens
attgattcaagggcctagatttg

SEQ ID NO: 613048 - DNA, 14 bp, Homo sapiens
attgcactaaaagt

SEQ ID NO: 613049 - DNA, 18 bp, Homo sapiens
attgcactgcagttattt

SEQ ID NO: 613050 - DNA, 13 bp, Homo sapiens
attgcctatttca

SEQ ID NO: 613051 - DNA, 14 bp, Homo sapiens
attgcctatttcag

SEQ ID NO: 613052 - DNA, 16 bp, Homo sapiens
attgccttgatgtttc

SEQ ID NO: 613053 - DNA, 16 bp, Homo sapiens
attgcctttgataatt

SEQ ID NO: 613054 - DNA, 17 bp, Homo sapiens
attgctatcatttggct

SEQ ID NO: 613055 - DNA, 15 bp, Homo sapiens
attgctccattcctg

SEQ ID NO: 613056 - DNA, 23 bp, Homo sapiens
attgctgagatgtttagtagctg

SEQ ID NO: 613057 - DNA, 20 bp, Homo sapiens
attgctgtaaataaaaatag

SEQ ID NO: 613058 - DNA, 20 bp, Homo sapiens
attgcttcattaaaacaaga

SEQ ID NO: 613059 - DNA, 11 bp, Homo sapiens
attggcagcag

SEQ ID NO: 613060 - DNA, 15 bp, Homo sapiens
attggcataaaacaa

SEQ ID NO: 613061 - DNA, 22 bp, Homo sapiens
attggctgccaagagtccaagc

SEQ ID NO: 613062 - DNA, 12 bp, Homo sapiens
attggcttgttt

SEQ ID NO: 613063 - DNA, 20 bp, Homo sapiens
attgggcccttagaatgtga

SEQ ID NO: 613064 - DNA, 22 bp, Homo sapiens
attgggcccttagaatgtgaaa

SEQ ID NO: 613065 - DNA, 23 bp, Homo sapiens
attgggcccttagaatgtgaaaa

SEQ ID NO: 613066 - DNA, 15 bp, Homo sapiens
attggttaatgaaaa

SEQ ID NO: 613067 - DNA, 15 bp, Homo sapiens
attggttctatttat

SEQ ID NO: 613068 - DNA, 18 bp, Homo sapiens
attgtaaaggtgatgaat

SEQ ID NO: 613069 - DNA, 16 bp, Homo sapiens
attgtaacagacattg

SEQ ID NO: 613070 - DNA, 19 bp, Homo sapiens
attgtaacagacattgttt

SEQ ID NO: 613071 - DNA, 15 bp, Homo sapiens
attgtatatatatgt

SEQ ID NO: 613072 - DNA, 18 bp, Homo sapiens
attgtatatatatgtgaa

SEQ ID NO: 613073 - DNA, 21 bp, Homo sapiens
attgtatatatatgtgaactt

SEQ ID NO: 613074 - DNA, 13 bp, Homo sapiens
attgtatctcctt

SEQ ID NO: 613075 - DNA, 14 bp, Homo sapiens
attgtcagaatgtt

SEQ ID NO: 613076 - DNA, 18 bp, Homo sapiens
attgtcagaatgttgtgt

SEQ ID NO: 613077 - DNA, 18 bp, Homo sapiens
attgtcctgtttcttcat

SEQ ID NO: 613078 - DNA, 21 bp, Homo sapiens
attgtgatggttcgttctgtt

SEQ ID NO: 613079 - DNA, 13 bp, Homo sapiens
attgtgtcttttg

SEQ ID NO: 613080 - DNA, 15 bp, Homo sapiens
attgtgtcttttgca

SEQ ID NO: 613081 - DNA, 20 bp, Homo sapiens
attgttcttgtaaaactgtg

SEQ ID NO: 613082 - DNA, 21 bp, Homo sapiens
attgttcttgtaaaactgtga

SEQ ID NO: 613083 - DNA, 20 bp, Homo sapiens
attgtttaaagcaactgtct

SEQ ID NO: 613084 - DNA, 22 bp, Homo sapiens
attgtttaaagcaactgtctat

SEQ ID NO: 613085 - DNA, 19 bp, Homo sapiens
attgtttgatgaataaaat

SEQ ID NO: 613086 - DNA, 21 bp, Homo sapiens
attgtttgatgaataaaatgt

SEQ ID NO: 613087 - DNA, 18 bp, Homo sapiens
attgtttgtcctttatgt

SEQ ID NO: 613088 - DNA, 18 bp, Homo sapiens
attgttttgccaacattg

SEQ ID NO: 613089 - DNA, 20 bp, Homo sapiens
atttaaaaattaaagcagca

SEQ ID NO: 613090 - DNA, 16 bp, Homo sapiens
atttaacattcttggt

SEQ ID NO: 613091 - DNA, 20 bp, Homo sapiens
atttaacattcttggtcaca

SEQ ID NO: 613092 - DNA, 19 bp, Homo sapiens
atttaagagattttatgtt

SEQ ID NO: 613093 - DNA, 13 bp, Homo sapiens
agggaagccctga

SEQ ID NO: 613094 - DNA, 13 bp, Homo sapiens
agggaaggctgct

SEQ ID NO: 613095 - DNA, 16 bp, Homo sapiens
agggaaggctgctgtg

SEQ ID NO: 613096 - DNA, 16 bp, Homo sapiens
agggaagggtgcctgg

SEQ ID NO: 613097 - DNA, 19 bp, Homo sapiens
agggaagggtgcctggctg

SEQ ID NO: 613098 - DNA, 21 bp, Homo sapiens
agggaagggtgcctggctggg

SEQ ID NO: 613099 - DNA, 16 bp, Homo sapiens
agggaattttcatttt

SEQ ID NO: 613100 - DNA, 13 bp, Homo sapiens
agggacagcctgc

SEQ ID NO: 613101 - DNA, 20 bp, Homo sapiens
agggacgactttctttaaca

SEQ ID NO: 613102 - DNA, 15 bp, Homo sapiens
agggacgagcagagc

SEQ ID NO: 613103 - DNA, 22 bp, Homo sapiens
agggacgagcagagcgcagccc

SEQ ID NO: 613104 - DNA, 23 bp, Homo sapiens
agggactttggaattctgcttct

SEQ ID NO: 613105 - DNA, 22 bp, Homo sapiens
agggagggaacagacctcggct

SEQ ID NO: 613106 - DNA, 20 bp, Homo sapiens
agggagggctgttcaagttt

SEQ ID NO: 613107 - DNA, 23 bp, Homo sapiens
agggagggggctgggaaagaact

SEQ ID NO: 613108 - DNA, 17 bp, Homo sapiens
agggatccacttctctg

SEQ ID NO: 613109 - DNA, 18 bp, Homo sapiens
agggcaagctcatagcac

SEQ ID NO: 613110 - DNA, 15 bp, Homo sapiens
agggcagaggaatgt

SEQ ID NO: 613111 - DNA, 22 bp, Homo sapiens
agggcagaggaatgtagggcct

SEQ ID NO: 613112 - DNA, 12 bp, Homo sapiens
agggcagccccg

SEQ ID NO: 613113 - DNA, 15 bp, Homo sapiens
agggcagccccgcga

SEQ ID NO: 613114 - DNA, 21 bp, Homo sapiens
agggcagccccgcgaccaccc

SEQ ID NO: 613115 - DNA, 20 bp, Homo sapiens
agggcagggttctagaaggg

SEQ ID NO: 613116 - DNA, 22 bp, Homo sapiens
agggcagggttctagaaggggc

SEQ ID NO: 613117 - DNA, 13 bp, Homo sapiens
agggcccccactg

SEQ ID NO: 613118 - DNA, 20 bp, Homo sapiens
agggccctggggtctctgag

SEQ ID NO: 613119 - DNA, 22 bp, Homo sapiens
agggccctggggtctctgagca

SEQ ID NO: 613120 - DNA, 20 bp, Homo sapiens
agggcccttcccaacctccc

SEQ ID NO: 613121 - DNA, 16 bp, Homo sapiens
agggccgcagggcgct

SEQ ID NO: 613122 - DNA, 18 bp, Homo sapiens
agggccgcagggcgctcc

SEQ ID NO: 613123 - DNA, 16 bp, Homo sapiens
agggcctgcatggaga

SEQ ID NO: 613124 - DNA, 19 bp, Homo sapiens
agggcctgcatggagaagg

SEQ ID NO: 613125 - DNA, 15 bp, Homo sapiens
agggcgctccggcag

SEQ ID NO: 613126 - DNA, 18 bp, Homo sapiens
agggcgctccggcagagg

SEQ ID NO: 613127 - DNA, 18 bp, Homo sapiens
agggcgctgagggcaggg

SEQ ID NO: 613128 - DNA, 16 bp, Homo sapiens
agggcgtgaaacacaa

SEQ ID NO: 613129 - DNA, 22 bp, Homo sapiens
agggcttggatcgtggaagaag

SEQ ID NO: 613130 - DNA, 15 bp, Homo sapiens
aggggaaaacctcag

SEQ ID NO: 613131 - DNA, 16 bp, Homo sapiens
aggggaaaacctcagt

SEQ ID NO: 613132 - DNA, 15 bp, Homo sapiens
aggggacagatcttg

SEQ ID NO: 613133 - DNA, 21 bp, Homo sapiens
aggggacagatcttgagcaag

SEQ ID NO: 613134 - DNA, 23 bp, Homo sapiens
aggggatcatgttaaaaatagca

SEQ ID NO: 613135 - DNA, 20 bp, Homo sapiens
aggggatctaaaaggaggac

SEQ ID NO: 613136 - DNA, 22 bp, Homo sapiens
aggggatctaaaaggaggacag

SEQ ID NO: 613137 - DNA, 23 bp, Homo sapiens
aggggatctaaaaggaggacagg

SEQ ID NO: 613138 - DNA, 18 bp, Homo sapiens
aggggcaaagaactgccc

SEQ ID NO: 613139 - DNA, 23 bp, Homo sapiens
aggggcaggcagctaggcaggga

SEQ ID NO: 613140 - DNA, 15 bp, Homo sapiens
aggggcttggagcag

SEQ ID NO: 613141 - DNA, 17 bp, Homo sapiens
aggggcttggagcagag

SEQ ID NO: 613142 - DNA, 12 bp, Homo sapiens
agggggctggga

SEQ ID NO: 613143 - DNA, 12 bp, Homo sapiens
aggggggttggg

SEQ ID NO: 613144 - DNA, 13 bp, Homo sapiens
aggggtcagcagg

SEQ ID NO: 613145 - DNA, 15 bp, Homo sapiens
aggggtcagcagggg

SEQ ID NO: 613146 - DNA, 15 bp, Homo sapiens
aggggtgttaaaaca

SEQ ID NO: 613147 - DNA, 13 bp, Homo sapiens
aggggttggcagc

SEQ ID NO: 613148 - DNA, 15 bp, Homo sapiens
aggggttggcagcgc

SEQ ID NO: 613149 - DNA, 12 bp, Homo sapiens
agggtccagccc

SEQ ID NO: 613150 - DNA, 14 bp, Homo sapiens
agggtccagccctc

SEQ ID NO: 613151 - DNA, 13 bp, Homo sapiens
agggtgaggcgtg

SEQ ID NO: 613152 - DNA, 14 bp, Homo sapiens
agggtgaggcgtgg

SEQ ID NO: 613153 - DNA, 16 bp, Homo sapiens
agggtgaggcgtggga

SEQ ID NO: 613154 - DNA, 23 bp, Homo sapiens
agggtgaggcgtgggatccagag

SEQ ID NO: 613155 - DNA, 15 bp, Homo sapiens
agggtgcccctggga

SEQ ID NO: 613156 - DNA, 15 bp, Homo sapiens
agggtgcctggctgg

SEQ ID NO: 613157 - DNA, 16 bp, Homo sapiens
agggtgcctggctggg

SEQ ID NO: 613158 - DNA, 11 bp, Homo sapiens
agggtggtagt

SEQ ID NO: 613159 - DNA, 15 bp, Homo sapiens
agggtgtggcttgga

SEQ ID NO: 613160 - DNA, 20 bp, Homo sapiens
agggttccagacagggtggg

SEQ ID NO: 613161 - DNA, 22 bp, Homo sapiens
agggttctagaaggggcgaggc

SEQ ID NO: 613162 - DNA, 15 bp, Homo sapiens
agggttctgccctgc

SEQ ID NO: 613163 - DNA, 23 bp, Homo sapiens
agggttctgccctgcctgaggag

SEQ ID NO: 613164 - DNA, 22 bp, Homo sapiens
agggttgtgattttgtctgctt

SEQ ID NO: 613165 - DNA, 19 bp, Homo sapiens
aggtaaactgatgctttca

SEQ ID NO: 613166 - DNA, 18 bp, Homo sapiens
aggtagtgggtgaatgtg

SEQ ID NO: 613167 - DNA, 12 bp, Homo sapiens
aggtattgtctt

SEQ ID NO: 613168 - DNA, 21 bp, Homo sapiens
aggtcagtgttataaaatctg

SEQ ID NO: 613169 - DNA, 21 bp, Homo sapiens
aggtccaccccgttgttgtcc

SEQ ID NO: 613170 - DNA, 21 bp, Homo sapiens
aggtcctgtcctggctcccag

SEQ ID NO: 613171 - DNA, 23 bp, Homo sapiens
aggtcctgtcctggctcccaggg

SEQ ID NO: 613172 - DNA, 17 bp, Homo sapiens
aggtctccacccctcaa

SEQ ID NO: 613173 - DNA, 22 bp, Homo sapiens
aggtctgcacacataacacaca

SEQ ID NO: 613174 - DNA, 23 bp, Homo sapiens
aggtctgcacacataacacacat

SEQ ID NO: 613175 - DNA, 15 bp, Homo sapiens
aggtctggcgccagg

SEQ ID NO: 613176 - DNA, 24 bp, Homo sapiens
aggtctggcgccaggggcaggcag

SEQ ID NO: 613177 - DNA, 13 bp, Homo sapiens
aggtctgttgaag

SEQ ID NO: 613178 - DNA, 21 bp, Homo sapiens
aggtctgttgaagtgcatgtt

SEQ ID NO: 613179 - DNA, 18 bp, Homo sapiens
aggtgatgaatttaccat

SEQ ID NO: 613180 - DNA, 20 bp, Homo sapiens
aggtgcaccggtttcataga

SEQ ID NO: 613181 - DNA, 16 bp, Homo sapiens
aggtgcccagtcttga

SEQ ID NO: 613182 - DNA, 20 bp, Homo sapiens
aggtgcccagtcttgagtgg

SEQ ID NO: 613183 - DNA, 21 bp, Homo sapiens
aggtgcggaccggagcggctg

SEQ ID NO: 613184 - DNA, 15 bp, Homo sapiens
aggtggcatttgcag

SEQ ID NO: 613185 - DNA, 14 bp, Homo sapiens
aggtgggtcttgga

SEQ ID NO: 613186 - DNA, 18 bp, Homo sapiens
aggtggtcttggagagga

SEQ ID NO: 613187 - DNA, 20 bp, Homo sapiens
aggtggtcttggagaggagg

SEQ ID NO: 613188 - DNA, 21 bp, Homo sapiens
aggtggtcttggagaggaggt

SEQ ID NO: 613189 - DNA, 21 bp, Homo sapiens
aggtgtatagggaattttcat

SEQ ID NO: 613190 - DNA, 23 bp, Homo sapiens
aggtgtatagggaattttcattt

SEQ ID NO: 613191 - DNA, 16 bp, Homo sapiens
aggttagaaaggcagc

SEQ ID NO: 613192 - DNA, 19 bp, Homo sapiens
aggttagaaaggcagccct

SEQ ID NO: 613193 - DNA, 16 bp, Homo sapiens
aggttatcagaaagat

SEQ ID NO: 613194 - DNA, 21 bp, Homo sapiens
aggttatcagaaagatcaaat

SEQ ID NO: 613195 - DNA, 18 bp, Homo sapiens
aggttgctggcatttgct

SEQ ID NO: 613196 - DNA, 15 bp, Homo sapiens
aggttgtgctgcctg

SEQ ID NO: 613197 - DNA, 16 bp, Homo sapiens
aggactgaagaaaatc

SEQ ID NO: 613198 - DNA, 18 bp, Homo sapiens
aggacttaatttagcagt

SEQ ID NO: 613199 - DNA, 14 bp, Homo sapiens
aggagaaggcctgc

SEQ ID NO: 613200 - DNA, 17 bp, Homo sapiens
aggagaaggcctgcccc

SEQ ID NO: 613201 - DNA, 19 bp, Homo sapiens
aggagaaggcctgcccccc

SEQ ID NO: 613202 - DNA, 16 bp, Homo sapiens
aggagaccctgtcttt

SEQ ID NO: 613203 - DNA, 13 bp, Homo sapiens
aggagagtggcag

SEQ ID NO: 613204 - DNA, 14 bp, Homo sapiens
aggagcacagccat

SEQ ID NO: 613205 - DNA, 16 bp, Homo sapiens
aggagcacagccatag

SEQ ID NO: 613206 - DNA, 13 bp, Homo sapiens
aggagcaccccca

SEQ ID NO: 613207 - DNA, 15 bp, Homo sapiens
aggagcacccccagc

SEQ ID NO: 613208 - DNA, 16 bp, Homo sapiens
aggagcacccccagcc

SEQ ID NO: 613209 - DNA, 17 bp, Homo sapiens
aggagcacccccagcct

SEQ ID NO: 613210 - DNA, 18 bp, Homo sapiens
aggagcacccccagcctc

SEQ ID NO: 613211 - DNA, 20 bp, Homo sapiens
aggagcacccccagcctccc

SEQ ID NO: 613212 - DNA, 21 bp, Homo sapiens
aggagcacccccagcctcccc

SEQ ID NO: 613213 - DNA, 13 bp, Homo sapiens
aggagcactagaa

SEQ ID NO: 613214 - DNA, 22 bp, Homo sapiens
aggagcatgtcctatccctgga

SEQ ID NO: 613215 - DNA, 18 bp, Homo sapiens
aggagccttgctgggcca

SEQ ID NO: 613216 - DNA, 20 bp, Homo sapiens
aggagccttgctgggccagg

SEQ ID NO: 613217 - DNA, 22 bp, Homo sapiens
aggagccttgctgggccaggga

SEQ ID NO: 613218 - DNA, 13 bp, Homo sapiens
aggagcgtgtcct

SEQ ID NO: 613219 - DNA, 24 bp, Homo sapiens
aggagctagcccagtccctggagc

SEQ ID NO: 613220 - DNA, 16 bp, Homo sapiens
aggagcttccagatgg

SEQ ID NO: 613221 - DNA, 19 bp, Homo sapiens
aggagcttccagtgcatgt

SEQ ID NO: 613222 - DNA, 20 bp, Homo sapiens
aggagcttccagtgcatgtt

SEQ ID NO: 613223 - DNA, 16 bp, Homo sapiens
aggaggacctgggggg

SEQ ID NO: 613224 - DNA, 11 bp, Homo sapiens
aggaggagcct

SEQ ID NO: 613225 - DNA, 14 bp, Homo sapiens
aggaggagccttgc

SEQ ID NO: 613226 - DNA, 22 bp, Homo sapiens
aggaggagccttgctgggccag

SEQ ID NO: 613227 - DNA, 17 bp, Homo sapiens
aggaggaggacacagca

SEQ ID NO: 613228 - DNA, 17 bp, Homo sapiens
aggaggccgactgggct

SEQ ID NO: 613229 - DNA, 21 bp, Homo sapiens
aggaggccgactgggctgctg

SEQ ID NO: 613230 - DNA, 19 bp, Homo sapiens
aggaggggtgttaaaacat

SEQ ID NO: 613231 - DNA, 20 bp, Homo sapiens
aggaggtgtggagtggaggg

SEQ ID NO: 613232 - DNA, 21 bp, Homo sapiens
aggaggtgtggagtggagggg

SEQ ID NO: 613233 - DNA, 14 bp, Homo sapiens
aggagttgcctgac

SEQ ID NO: 613234 - DNA, 16 bp, Homo sapiens
aggagttgcctgactc

SEQ ID NO: 613235 - DNA, 13 bp, Homo sapiens
aggatcctgagcc

SEQ ID NO: 613236 - DNA, 13 bp, Homo sapiens
aggatgcatatta

SEQ ID NO: 613237 - DNA, 17 bp, Homo sapiens
aggatgcatattaaaga

SEQ ID NO: 613238 - DNA, 19 bp, Homo sapiens
aggatgcatattaaagaaa

SEQ ID NO: 613239 - DNA, 14 bp, Homo sapiens
aggatgcatgcagg

SEQ ID NO: 613240 - DNA, 19 bp, Homo sapiens
aggatgcatgcagggcccc

SEQ ID NO: 613241 - DNA, 14 bp, Homo sapiens
aggatgtatgtgta

SEQ ID NO: 613242 - DNA, 12 bp, Homo sapiens
aggatttctgct

SEQ ID NO: 613243 - DNA, 14 bp, Homo sapiens
aggatttctgctta

SEQ ID NO: 613244 - DNA, 17 bp, Homo sapiens
aggcaaacttttatgca

SEQ ID NO: 613245 - DNA, 18 bp, Homo sapiens
aggcaccggacgctggag

SEQ ID NO: 613246 - DNA, 21 bp, Homo sapiens
aggcaccggacgctggagacc

SEQ ID NO: 613247 - DNA, 15 bp, Homo sapiens
aggcagaatggtggg

SEQ ID NO: 613248 - DNA, 22 bp, Homo sapiens
aggcagattaataacagaaata

SEQ ID NO: 613249 - DNA, 22 bp, Homo sapiens
aggcagccctcacctctgagga

SEQ ID NO: 613250 - DNA, 15 bp, Homo sapiens
aggcagctaggcagg

SEQ ID NO: 613251 - DNA, 16 bp, Homo sapiens
aggcagctaggcaggg

SEQ ID NO: 613252 - DNA, 12 bp, Homo sapiens
aggcagggccct

SEQ ID NO: 613253 - DNA, 14 bp, Homo sapiens
aggcagggccctgg

SEQ ID NO: 613254 - DNA, 15 bp, Homo sapiens
aggcatattattttc

SEQ ID NO: 613255 - DNA, 21 bp, Homo sapiens
aggcattactggccttttcac

SEQ ID NO: 613256 - DNA, 22 bp, Homo sapiens
aggcattgcactaaaagtgatg

SEQ ID NO: 613257 - DNA, 21 bp, Homo sapiens
aggccaagagtttgagaccaa

SEQ ID NO: 613258 - DNA, 13 bp, Homo sapiens
aggccagtacttt

SEQ ID NO: 613259 - DNA, 19 bp, Homo sapiens
aggccagtactttgccatc

SEQ ID NO: 613260 - DNA, 22 bp, Homo sapiens
aggcccccaaattgccttcagc

SEQ ID NO: 613261 - DNA, 22 bp, Homo sapiens
aggcccccggaggcgcccacct

SEQ ID NO: 613262 - DNA, 22 bp, Homo sapiens
aggcccctgagggacgagcaga

SEQ ID NO: 613263 - DNA, 18 bp, Homo sapiens
aggcccctgtgcagtaga

SEQ ID NO: 613264 - DNA, 15 bp, Homo sapiens
aggcccgaggcaccg

SEQ ID NO: 613265 - DNA, 14 bp, Homo sapiens
aggcccgccctgcc

SEQ ID NO: 613266 - DNA, 16 bp, Homo sapiens
aggcccgccctgcccg

SEQ ID NO: 613267 - DNA, 17 bp, Homo sapiens
aggcccgccctgcccgc

SEQ ID NO: 613268 - DNA, 14 bp, Homo sapiens
aggcccggccccat

SEQ ID NO: 613269 - DNA, 17 bp, Homo sapiens
aggccctaggattcctc

SEQ ID NO: 613270 - DNA, 14 bp, Homo sapiens
aggccgactgggct

SEQ ID NO: 613271 - DNA, 15 bp, Homo sapiens
aggccgactgggctg

SEQ ID NO: 613272 - DNA, 22 bp, Homo sapiens
aggccgactgggctgctggggc

SEQ ID NO: 613273 - DNA, 19 bp, Homo sapiens
aggccggggtccaggcccg

SEQ ID NO: 613274 - DNA, 16 bp, Homo sapiens
aggcctcagggaccaa

SEQ ID NO: 613275 - DNA, 23 bp, Homo sapiens
aggcctgagggaagcccacccgc

SEQ ID NO: 613276 - DNA, 15 bp, Homo sapiens
aggcctgcccccctt

SEQ ID NO: 613277 - DNA, 17 bp, Homo sapiens
aggcctgccccccttcc

SEQ ID NO: 613278 - DNA, 18 bp, Homo sapiens
aggcctgccccccttccc

SEQ ID NO: 613279 - DNA, 16 bp, Homo sapiens
aggcctggtctggagc

SEQ ID NO: 613280 - DNA, 21 bp, Homo sapiens
aggcctggtctggagccccta

SEQ ID NO: 613281 - DNA, 22 bp, Homo sapiens
aggcctggtctggagcccctat

SEQ ID NO: 613282 - DNA, 24 bp, Homo sapiens
aggcctggtctggagcccctatcc

SEQ ID NO: 613283 - DNA, 21 bp, Homo sapiens
aggcgcccacctgcccagtta

SEQ ID NO: 613284 - DNA, 20 bp, Homo sapiens
aggcgccgcctcgcccccgg

SEQ ID NO: 613285 - DNA, 23 bp, Homo sapiens
aggcgccgcctcgcccccgggcc

SEQ ID NO: 613286 - DNA, 14 bp, Homo sapiens
aggcgcgcaccgcc

SEQ ID NO: 613287 - DNA, 16 bp, Homo sapiens
aggcgcgcaccgccca

SEQ ID NO: 613288 - DNA, 21 bp, Homo sapiens
aggcgcgcaccgcccaacccc

SEQ ID NO: 613289 - DNA, 21 bp, Homo sapiens
aggcggaggggcttggagcag

SEQ ID NO: 613290 - DNA, 19 bp, Homo sapiens
aggcggcacattggcagtg

SEQ ID NO: 613291 - DNA, 23 bp, Homo sapiens
aggcgtgggatccagagagaagc

SEQ ID NO: 613292 - DNA, 13 bp, Homo sapiens
aggctactgccac

SEQ ID NO: 613293 - DNA, 22 bp, Homo sapiens
aggctgactcttactaaccacc

SEQ ID NO: 613294 - DNA, 22 bp, Homo sapiens
aggctgatgccgtgcgggctaa

SEQ ID NO: 613295 - DNA, 17 bp, Homo sapiens
aggctgcagctaatttg

SEQ ID NO: 613296 - DNA, 22 bp, Homo sapiens
aggctgccccaggggcactgtg

SEQ ID NO: 613297 - DNA, 19 bp, Homo sapiens
aggctgcctcatgaccctc

SEQ ID NO: 613298 - DNA, 15 bp, Homo sapiens
agaggcagggccctg

SEQ ID NO: 613299 - DNA, 16 bp, Homo sapiens
agaggcagggccctgg

SEQ ID NO: 613300 - DNA, 17 bp, Homo sapiens
agaggctgcctcagcca

SEQ ID NO: 613301 - DNA, 13 bp, Homo sapiens
agagggctgagcc

SEQ ID NO: 613302 - DNA, 14 bp, Homo sapiens
agagggctgagccc

SEQ ID NO: 613303 - DNA, 19 bp, Homo sapiens
agagggctgagcccctcct

SEQ ID NO: 613304 - DNA, 22 bp, Homo sapiens
agaggggacttggataggagct

SEQ ID NO: 613305 - DNA, 22 bp, Homo sapiens
agagggggatgcccctggccct

SEQ ID NO: 613306 - DNA, 23 bp, Homo sapiens
agagggggatgcccctggccctg

SEQ ID NO: 613307 - DNA, 19 bp, Homo sapiens
agagggtgtgggtgccctg

SEQ ID NO: 613308 - DNA, 21 bp, Homo sapiens
agagggtgtgggtgccctgtt

SEQ ID NO: 613309 - DNA, 19 bp, Homo sapiens
agagtatacaagtgtttct

SEQ ID NO: 613310 - DNA, 23 bp, Homo sapiens
agagtgatttgtaaaacagtggt

SEQ ID NO: 613311 - DNA, 13 bp, Homo sapiens
agagtgccctggg

SEQ ID NO: 613312 - DNA, 15 bp, Homo sapiens
agagtgccctggggc

SEQ ID NO: 613313 - DNA, 23 bp, Homo sapiens
agagtgccctggggcatccacct

SEQ ID NO: 613314 - DNA, 14 bp, Homo sapiens
agagtggcaggtgg

SEQ ID NO: 613315 - DNA, 20 bp, Homo sapiens
agagtggcaggtgggctgcc

SEQ ID NO: 613316 - DNA, 22 bp, Homo sapiens
agagttactgccacggtccttt

SEQ ID NO: 613317 - DNA, 17 bp, Homo sapiens
agagttcatagaaatac

SEQ ID NO: 613318 - DNA, 14 bp, Homo sapiens
agataaatatcatt

SEQ ID NO: 613319 - DNA, 16 bp, Homo sapiens
agataaatccaatagt

SEQ ID NO: 613320 - DNA, 12 bp, Homo sapiens
agataagtgctc

SEQ ID NO: 613321 - DNA, 17 bp, Homo sapiens
agcatgctcagtattga

SEQ ID NO: 613322 - DNA, 12 bp, Homo sapiens
agcatgtacagt

SEQ ID NO: 613323 - DNA, 19 bp, Homo sapiens
agcatgtacagtgttctgt

SEQ ID NO: 613324 - DNA, 15 bp, Homo sapiens
agcatgtcctatccc

SEQ ID NO: 613325 - DNA, 14 bp, Homo sapiens
agcattcagcacac

SEQ ID NO: 613326 - DNA, 19 bp, Homo sapiens
agcattcccaattatcaaa

SEQ ID NO: 613327 - DNA, 12 bp, Homo sapiens
agcattgctaaa

SEQ ID NO: 613328 - DNA, 23 bp, Homo sapiens
agcatttcttatttgtttggtca

SEQ ID NO: 613329 - DNA, 20 bp, Homo sapiens
agcattttaatagtttctaa

SEQ ID NO: 613330 - DNA, 22 bp, Homo sapiens
agcattttaatagtttctaaac

SEQ ID NO: 613331 - DNA, 16 bp, Homo sapiens
agccaaaatagagagt

SEQ ID NO: 613332 - DNA, 17 bp, Homo sapiens
agccaatttcaaagaaa

SEQ ID NO: 613333 - DNA, 13 bp, Homo sapiens
agccaatttttct

SEQ ID NO: 613334 - DNA, 23 bp, Homo sapiens
agccaatttttctgcactgagca

SEQ ID NO: 613335 - DNA, 17 bp, Homo sapiens
agccagatttcactctc

SEQ ID NO: 613336 - DNA, 20 bp, Homo sapiens
agccagatttcactctcctt

SEQ ID NO: 613337 - DNA, 17 bp, Homo sapiens
agccagcagacattgtc

SEQ ID NO: 613338 - DNA, 22 bp, Homo sapiens
agccagcagacattgtcagcaa

SEQ ID NO: 613339 - DNA, 18 bp, Homo sapiens
agccagcattcagcacac

SEQ ID NO: 613340 - DNA, 14 bp, Homo sapiens
agccagctctgagc

SEQ ID NO: 613341 - DNA, 17 bp, Homo sapiens
agccagctctgagcaga

SEQ ID NO: 613342 - DNA, 19 bp, Homo sapiens
agccagggtcctgagtggc

SEQ ID NO: 613343 - DNA, 13 bp, Homo sapiens
agccagggttcca

SEQ ID NO: 613344 - DNA, 15 bp, Homo sapiens
agccagggttccaga

SEQ ID NO: 613345 - DNA, 20 bp, Homo sapiens
agccataacgttagactgca

SEQ ID NO: 613346 - DNA, 16 bp, Homo sapiens
agccatagccccaggc

SEQ ID NO: 613347 - DNA, 22 bp, Homo sapiens
agccatagccccaggcccgccc

SEQ ID NO: 613348 - DNA, 20 bp, Homo sapiens
agccatatattttctgagta

SEQ ID NO: 613349 - DNA, 18 bp, Homo sapiens
agcccacccgccccagag

SEQ ID NO: 613350 - DNA, 19 bp, Homo sapiens
agcccacccgccccagaga

SEQ ID NO: 613351 - DNA, 20 bp, Homo sapiens
agcccacccgccccagagac

SEQ ID NO: 613352 - DNA, 21 bp, Homo sapiens
agcccacccgccccagagact

SEQ ID NO: 613353 - DNA, 15 bp, Homo sapiens
agcccagaacgggcc

SEQ ID NO: 613354 - DNA, 17 bp, Homo sapiens
agcccagaacgggcctc

SEQ ID NO: 613355 - DNA, 15 bp, Homo sapiens
agcccagagactgaa

SEQ ID NO: 613356 - DNA, 18 bp, Homo sapiens
agcccagtccctggagct

SEQ ID NO: 613357 - DNA, 16 bp, Homo sapiens
agcccatcccctgcct

SEQ ID NO: 613358 - DNA, 17 bp, Homo sapiens
agcccatcccctgcctc

SEQ ID NO: 613359 - DNA, 19 bp, Homo sapiens
agcccatcccctgcctcta

SEQ ID NO: 613360 - DNA, 17 bp, Homo sapiens
agcccatgctggctggg

SEQ ID NO: 613361 - DNA, 18 bp, Homo sapiens
agcccatgctggctgggg

SEQ ID NO: 613362 - DNA, 21 bp, Homo sapiens
agccccaggcccgccctgccc

SEQ ID NO: 613363 - DNA, 15 bp, Homo sapiens
agccccatccttccc

SEQ ID NO: 613364 - DNA, 16 bp, Homo sapiens
agccccatccttcccg

SEQ ID NO: 613365 - DNA, 15 bp, Homo sapiens
agcccccacccatgc

SEQ ID NO: 613366 - DNA, 19 bp, Homo sapiens
agcccccacccatgccagc

SEQ ID NO: 613367 - DNA, 22 bp, Homo sapiens
agcccccacccatgccagcgca

SEQ ID NO: 613368 - DNA, 23 bp, Homo sapiens
agcccccacccatgccagcgcag

SEQ ID NO: 613369 - DNA, 20 bp, Homo sapiens
agcccccacccccgtcaccc

SEQ ID NO: 613370 - DNA, 21 bp, Homo sapiens
agcccccacccccgtcacccc

SEQ ID NO: 613371 - DNA, 14 bp, Homo sapiens
agcccccgcccctc

SEQ ID NO: 613372 - DNA, 15 bp, Homo sapiens
agcccccgcccctcc

SEQ ID NO: 613373 - DNA, 16 bp, Homo sapiens
agcccccgcccctccc

SEQ ID NO: 613374 - DNA, 18 bp, Homo sapiens
agcccccgcccctccccc

SEQ ID NO: 613375 - DNA, 17 bp, Homo sapiens
agccccgcgaccacccc

SEQ ID NO: 613376 - DNA, 17 bp, Homo sapiens
agcccctatcctgcacc

SEQ ID NO: 613377 - DNA, 18 bp, Homo sapiens
agcccctcagagaatgat

SEQ ID NO: 613378 - DNA, 12 bp, Homo sapiens
agcccctcccca

SEQ ID NO: 613379 - DNA, 21 bp, Homo sapiens
agcccctccccatggtgcagt

SEQ ID NO: 613380 - DNA, 21 bp, Homo sapiens
agcccctgctggaccaaggtg

SEQ ID NO: 613381 - DNA, 15 bp, Homo sapiens
agcccctgtttctcc

SEQ ID NO: 613382 - DNA, 22 bp, Homo sapiens
agccccttggagagagaggctg

SEQ ID NO: 613383 - DNA, 10 bp, Homo sapiens
agcccggcca

SEQ ID NO: 613384 - DNA, 15 bp, Homo sapiens
agcccggccaaggac

SEQ ID NO: 613385 - DNA, 19 bp, Homo sapiens
agcccggccaaggacactg

SEQ ID NO: 613386 - DNA, 20 bp, Homo sapiens
agcccggccaaggacactga

SEQ ID NO: 613387 - DNA, 18 bp, Homo sapiens
agccctaacatagtgtct

SEQ ID NO: 613388 - DNA, 18 bp, Homo sapiens
agccctaagtaaatctaa

SEQ ID NO: 613389 - DNA, 14 bp, Homo sapiens
agccctcacctctg

SEQ ID NO: 613390 - DNA, 17 bp, Homo sapiens
agccctcacctctgagg

SEQ ID NO: 613391 - DNA, 19 bp, Homo sapiens
agccctcacctctgaggac

SEQ ID NO: 613392 - DNA, 23 bp, Homo sapiens
agccctcacctctgaggacagag

SEQ ID NO: 613393 - DNA, 19 bp, Homo sapiens
agccctctttctctctgtg

SEQ ID NO: 613394 - DNA, 24 bp, Homo sapiens
agccctctttctctctgtgtggca

SEQ ID NO: 613395 - DNA, 13 bp, Homo sapiens
agccctgcagtca

SEQ ID NO: 613396 - DNA, 20 bp, Homo sapiens
agccctgcagtcacgtgagg

SEQ ID NO: 613397 - DNA, 14 bp, Homo sapiens
agccctgccctcac

SEQ ID NO: 613398 - DNA, 15 bp, Homo sapiens
agccctgccctcact

SEQ ID NO: 613399 - DNA, 13 bp, Homo sapiens
agccctgggcaag

SEQ ID NO: 613400 - DNA, 21 bp, Homo sapiens
agccctgttccgcctcactgg

SEQ ID NO: 613401 - DNA, 22 bp, Homo sapiens
agcccttgctctacctggccgg

SEQ ID NO: 613402 - DNA, 15 bp, Homo sapiens
agccgcagaggcccg

SEQ ID NO: 613403 - DNA, 17 bp, Homo sapiens
agccgcagaggcccgag

SEQ ID NO: 613404 - DNA, 16 bp, Homo sapiens
agccgcgctctgcccc

SEQ ID NO: 613405 - DNA, 19 bp, Homo sapiens
agccgcgctctgcccctcc

SEQ ID NO: 613406 - DNA, 20 bp, Homo sapiens
agccgcgctctgcccctccg

SEQ ID NO: 613407 - DNA, 11 bp, Homo sapiens
agcctccccca

SEQ ID NO: 613408 - DNA, 21 bp, Homo sapiens
agcctcccccaggctgcgcct

SEQ ID NO: 613409 - DNA, 21 bp, Homo sapiens
agcctcgttggagagcagcag

SEQ ID NO: 613410 - DNA, 17 bp, Homo sapiens
agcctctccgcccacgc

SEQ ID NO: 613411 - DNA, 16 bp, Homo sapiens
agcctgaagcctggat

SEQ ID NO: 613412 - DNA, 23 bp, Homo sapiens
agcctgacctttctgagtgacat

SEQ ID NO: 613413 - DNA, 11 bp, Homo sapiens
agcctgactgt

SEQ ID NO: 613414 - DNA, 12 bp, Homo sapiens
agcctgactttg

SEQ ID NO: 613415 - DNA, 20 bp, Homo sapiens
agcctgactttggggacacc

SEQ ID NO: 613416 - DNA, 19 bp, Homo sapiens
agcctgagccacagtgggg

SEQ ID NO: 613417 - DNA, 17 bp, Homo sapiens
agcctgagctccaccct

SEQ ID NO: 613418 - DNA, 13 bp, Homo sapiens
actcatgtgattt

SEQ ID NO: 613419 - DNA, 18 bp, Homo sapiens
actcatttggatataaat

SEQ ID NO: 613420 - DNA, 22 bp, Homo sapiens
actcatttggatataaatctta

SEQ ID NO: 613421 - DNA, 20 bp, Homo sapiens
actccaaggtggcatagcca

SEQ ID NO: 613422 - DNA, 15 bp, Homo sapiens
actccactcccctca

SEQ ID NO: 613423 - DNA, 19 bp, Homo sapiens
actccagggttaaagaaag

SEQ ID NO: 613424 - DNA, 23 bp, Homo sapiens
actccatggtgaactgaagcaga

SEQ ID NO: 613425 - DNA, 14 bp, Homo sapiens
actcccagggcccg

SEQ ID NO: 613426 - DNA, 16 bp, Homo sapiens
actcccagggcccgag

SEQ ID NO: 613427 - DNA, 19 bp, Homo sapiens
actcccagggcccgagcgc

SEQ ID NO: 613428 - DNA, 20 bp, Homo sapiens
actccccgcccgccctcctc

SEQ ID NO: 613429 - DNA, 22 bp, Homo sapiens
actccccgcccgccctcctctg

SEQ ID NO: 613430 - DNA, 23 bp, Homo sapiens
actccccgcccgccctcctctgc

SEQ ID NO: 613431 - DNA, 14 bp, Homo sapiens
actccctaggcctg

SEQ ID NO: 613432 - DNA, 19 bp, Homo sapiens
actcctcaattccagggaa

SEQ ID NO: 613433 - DNA, 14 bp, Homo sapiens
actcctccccctcc

SEQ ID NO: 613434 - DNA, 17 bp, Homo sapiens
actcctccccctcctcc

SEQ ID NO: 613435 - DNA, 18 bp, Homo sapiens
actcctccccctcctcca

SEQ ID NO: 613436 - DNA, 15 bp, Homo sapiens
actcctcctgctcct

SEQ ID NO: 613437 - DNA, 23 bp, Homo sapiens
actcctgttttcacaccttacaa

SEQ ID NO: 613438 - DNA, 21 bp, Homo sapiens
actccttgaaaccagctcagg

SEQ ID NO: 613439 - DNA, 24 bp, Homo sapiens
actcctttctaaggagcactagaa

SEQ ID NO: 613440 - DNA, 16 bp, Homo sapiens
actcgagagggctgag

SEQ ID NO: 613441 - DNA, 18 bp, Homo sapiens
actcgagagggctgagcc

SEQ ID NO: 613442 - DNA, 23 bp, Homo sapiens
actcgagagggctgagcccctcc

SEQ ID NO: 613443 - DNA, 15 bp, Homo sapiens
actcgcgacaatgca

SEQ ID NO: 613444 - DNA, 23 bp, Homo sapiens
actcgcgacaatgcaaaccatca

SEQ ID NO: 613445 - DNA, 15 bp, Homo sapiens
actcgcttgtgcaga

SEQ ID NO: 613446 - DNA, 23 bp, Homo sapiens
actcgcttgtgcagaaaacattg

SEQ ID NO: 613447 - DNA, 17 bp, Homo sapiens
actcgggattacagaaa

SEQ ID NO: 613448 - DNA, 15 bp, Homo sapiens
actctccttggtgtc

SEQ ID NO: 613449 - DNA, 23 bp, Homo sapiens
actctccttggtgtcgggcatga

SEQ ID NO: 613450 - DNA, 18 bp, Homo sapiens
actctctagtgcaggaaa

SEQ ID NO: 613451 - DNA, 14 bp, Homo sapiens
actctctcctctct

SEQ ID NO: 613452 - DNA, 15 bp, Homo sapiens
actctctcctctctc

SEQ ID NO: 613453 - DNA, 18 bp, Homo sapiens
actctctcctctctctcc

SEQ ID NO: 613454 - DNA, 20 bp, Homo sapiens
actctcttcttactgtattt

SEQ ID NO: 613455 - DNA, 13 bp, Homo sapiens
actctgagtcctc

SEQ ID NO: 613456 - DNA, 11 bp, Homo sapiens
actctggcctt

SEQ ID NO: 613457 - DNA, 17 bp, Homo sapiens
actcttgtctcctcctc

SEQ ID NO: 613458 - DNA, 20 bp, Homo sapiens
actcttgtctcctcctccag

SEQ ID NO: 613459 - DNA, 23 bp, Homo sapiens
actgaaaatgtgctctacatctc

SEQ ID NO: 613460 - DNA, 22 bp, Homo sapiens
actgaaattagtgttttcattc

SEQ ID NO: 613461 - DNA, 16 bp, Homo sapiens
actgaagcagagtcaa

SEQ ID NO: 613462 - DNA, 17 bp, Homo sapiens
actgaatctgagaaagt

SEQ ID NO: 613463 - DNA, 18 bp, Homo sapiens
actgaattgctatcattt

SEQ ID NO: 613464 - DNA, 13 bp, Homo sapiens
actgacatggtgc

SEQ ID NO: 613465 - DNA, 15 bp, Homo sapiens
actgacatggtgctg

SEQ ID NO: 613466 - DNA, 24 bp, Homo sapiens
actgaccttcggcagtggctgggg

SEQ ID NO: 613467 - DNA, 18 bp, Homo sapiens
actgactaggattctgca

SEQ ID NO: 613468 - DNA, 18 bp, Homo sapiens
actgacttctcccgggtc

SEQ ID NO: 613469 - DNA, 21 bp, Homo sapiens
actgagaaaaagcattaaaaa

SEQ ID NO: 613470 - DNA, 19 bp, Homo sapiens
actgagttagaatgttgaa

SEQ ID NO: 613471 - DNA, 20 bp, Homo sapiens
actgataatttttgttttta

SEQ ID NO: 613472 - DNA, 14 bp, Homo sapiens
actgatatattttc

SEQ ID NO: 613473 - DNA, 18 bp, Homo sapiens
actgatatcacgggcccg

SEQ ID NO: 613474 - DNA, 19 bp, Homo sapiens
actgatatcacgggcccgc

SEQ ID NO: 613475 - DNA, 22 bp, Homo sapiens
actgatatcacgggcccgctca

SEQ ID NO: 613476 - DNA, 18 bp, Homo sapiens
actgatgggtcctgctgc

SEQ ID NO: 613477 - DNA, 14 bp, Homo sapiens
actgcaccctccac

SEQ ID NO: 613478 - DNA, 21 bp, Homo sapiens
actgcaccctccacaggagcc

SEQ ID NO: 613479 - DNA, 14 bp, Homo sapiens
actgcagccctctc

SEQ ID NO: 613480 - DNA, 23 bp, Homo sapiens
actgcccacatttgggctcaggg

SEQ ID NO: 613481 - DNA, 16 bp, Homo sapiens
actgcccaccctgggc

SEQ ID NO: 613482 - DNA, 17 bp, Homo sapiens
actgcccaccctgggcc

SEQ ID NO: 613483 - DNA, 18 bp, Homo sapiens
actgcccaccctgggcct

SEQ ID NO: 613484 - DNA, 21 bp, Homo sapiens
actgcccctgcacctgcttct

SEQ ID NO: 613485 - DNA, 16 bp, Homo sapiens
actgcctggaggatag

SEQ ID NO: 613486 - DNA, 22 bp, Homo sapiens
actgccttatattattttctgt

SEQ ID NO: 613487 - DNA, 14 bp, Homo sapiens
actgcttaaggaaa

SEQ ID NO: 613488 - DNA, 15 bp, Homo sapiens
actgcttcaagtgtt

SEQ ID NO: 613489 - DNA, 20 bp, Homo sapiens
actgctttcagtgcctgctg

SEQ ID NO: 613490 - DNA, 21 bp, Homo sapiens
actgctttcagtgcctgctgt

SEQ ID NO: 613491 - DNA, 16 bp, Homo sapiens
actggaaacaaggaag

SEQ ID NO: 613492 - DNA, 16 bp, Homo sapiens
actggaaacatctgat

SEQ ID NO: 613493 - DNA, 22 bp, Homo sapiens
actggaattttatttctctcag

SEQ ID NO: 613494 - DNA, 14 bp, Homo sapiens
actggcccacccct

SEQ ID NO: 613495 - DNA, 20 bp, Homo sapiens
actggcccacccctcttccc

SEQ ID NO: 613496 - DNA, 11 bp, Homo sapiens
actggccccag

SEQ ID NO: 613497 - DNA, 12 bp, Homo sapiens
actggccccagg

SEQ ID NO: 613498 - DNA, 16 bp, Homo sapiens
actggccccaggcgga

SEQ ID NO: 613499 - DNA, 12 bp, Homo sapiens
actggctggtga

SEQ ID NO: 613500 - DNA, 15 bp, Homo sapiens
actgggctgctgggg

SEQ ID NO: 613501 - DNA, 16 bp, Homo sapiens
acaaagctatttaagt

SEQ ID NO: 613502 - DNA, 19 bp, Homo sapiens
acaaagctatttaagtgga

SEQ ID NO: 613503 - DNA, 20 bp, Homo sapiens
acaaagctgtcactcacaaa

SEQ ID NO: 613504 - DNA, 22 bp, Homo sapiens
acaaagtgaaattagtattttg

SEQ ID NO: 613505 - DNA, 23 bp, Homo sapiens
acaaagtgaaattagtattttga

SEQ ID NO: 613506 - DNA, 22 bp, Homo sapiens
acaaagtttacattgtcctgta

SEQ ID NO: 613507 - DNA, 20 bp, Homo sapiens
acaaatatactcatttggat

SEQ ID NO: 613508 - DNA, 17 bp, Homo sapiens
acaaatcattttgatgt

SEQ ID NO: 613509 - DNA, 21 bp, Homo sapiens
acaaatcattttgatgtatta

SEQ ID NO: 613510 - DNA, 14 bp, Homo sapiens
acaaattcagtgga

SEQ ID NO: 613511 - DNA, 18 bp, Homo sapiens
acaaattcagtggacatt

SEQ ID NO: 613512 - DNA, 14 bp, Homo sapiens
acaaatttttactc

SEQ ID NO: 613513 - DNA, 22 bp, Homo sapiens
acaaatttttactcaggctttc

SEQ ID NO: 613514 - DNA, 15 bp, Homo sapiens
acaacaacaaagcat

SEQ ID NO: 613515 - DNA, 14 bp, Homo sapiens
acaacaacagaaca

SEQ ID NO: 613516 - DNA, 18 bp, Homo sapiens
acaacacattgaaactgt

SEQ ID NO: 613517 - DNA, 23 bp, Homo sapiens
acaaccatgttcttgagcagctg

SEQ ID NO: 613518 - DNA, 16 bp, Homo sapiens
acaacttaattgctct

SEQ ID NO: 613519 - DNA, 19 bp, Homo sapiens
acaagatacgtatattttt

SEQ ID NO: 613520 - DNA, 16 bp, Homo sapiens
acaagcagacacacac

SEQ ID NO: 613521 - DNA, 18 bp, Homo sapiens
acaagcagacacacacat

SEQ ID NO: 613522 - DNA, 22 bp, Homo sapiens
acaagcagacacacacatatat

SEQ ID NO: 613523 - DNA, 17 bp, Homo sapiens
acaagctacatatgtag

SEQ ID NO: 613524 - DNA, 22 bp, Homo sapiens
acaaggttgctggcatttgctg

SEQ ID NO: 613525 - DNA, 14 bp, Homo sapiens
acaagtgtttctag

SEQ ID NO: 613526 - DNA, 17 bp, Homo sapiens
acaataagaaacagttt

SEQ ID NO: 613527 - DNA, 19 bp, Homo sapiens
acaatactttgtgtctttt

SEQ ID NO: 613528 - DNA, 21 bp, Homo sapiens
acaatcgtattacataaaaca

SEQ ID NO: 613529 - DNA, 23 bp, Homo sapiens
acaatgcaaaccatcattgaaat

SEQ ID NO: 613530 - DNA, 16 bp, Homo sapiens
acaatggctgggtttg

SEQ ID NO: 613531 - DNA, 18 bp, Homo sapiens
acaatggctgggtttggg

SEQ ID NO: 613532 - DNA, 14 bp, Homo sapiens
acaatgtggaatta

SEQ ID NO: 613533 - DNA, 17 bp, Homo sapiens
acaatgtggaattacat

SEQ ID NO: 613534 - DNA, 20 bp, Homo sapiens
acaatgtggaattacataac

SEQ ID NO: 613535 - DNA, 13 bp, Homo sapiens
acaattctttgtt

SEQ ID NO: 613536 - DNA, 23 bp, Homo sapiens
acaatttaccacaggatgcatat

SEQ ID NO: 613537 - DNA, 19 bp, Homo sapiens
acaatttaggaatgctcaa

SEQ ID NO: 613538 - DNA, 20 bp, Homo sapiens
acaatttaggaatgctcaat

SEQ ID NO: 613539 - DNA, 16 bp, Homo sapiens
acacaaaacaacagca

SEQ ID NO: 613540 - DNA, 17 bp, Homo sapiens
acacaaaacaacagcaa

SEQ ID NO: 613541 - DNA, 19 bp, Homo sapiens
acacaactgtggataaatt

SEQ ID NO: 613542 - DNA, 17 bp, Homo sapiens
acacaagcagacacaca

SEQ ID NO: 613543 - DNA, 14 bp, Homo sapiens
acacacacaaaaca

SEQ ID NO: 613544 - DNA, 15 bp, Homo sapiens
acacacacccttccc

SEQ ID NO: 613545 - DNA, 13 bp, Homo sapiens
acacactcagcag

SEQ ID NO: 613546 - DNA, 15 bp, Homo sapiens
acacagattatttgt

SEQ ID NO: 613547 - DNA, 11 bp, Homo sapiens
acacagcacaa

SEQ ID NO: 613548 - DNA, 13 bp, Homo sapiens
acacagcatgcat

SEQ ID NO: 613549 - DNA, 14 bp, Homo sapiens
acacagtctggtgc

SEQ ID NO: 613550 - DNA, 14 bp, Homo sapiens
acacataacacaca

SEQ ID NO: 613551 - DNA, 19 bp, Homo sapiens
acacatacatatatacatt

SEQ ID NO: 613552 - DNA, 21 bp, Homo sapiens
acacatataaacacagtaaga

SEQ ID NO: 613553 - DNA, 13 bp, Homo sapiens
acacatatataca

SEQ ID NO: 613554 - DNA, 16 bp, Homo sapiens
acacatatatacatac

SEQ ID NO: 613555 - DNA, 13 bp, Homo sapiens
acacatctggccc

SEQ ID NO: 613556 - DNA, 15 bp, Homo sapiens
acacatctggccctg

SEQ ID NO: 613557 - DNA, 17 bp, Homo sapiens
acacattgaaactgtat

SEQ ID NO: 613558 - DNA, 22 bp, Homo sapiens
acacattgaaactgtatttact

SEQ ID NO: 613559 - DNA, 17 bp, Homo sapiens
acaccaaatattttcaa

SEQ ID NO: 613560 - DNA, 15 bp, Homo sapiens
acaccaaattgctga

SEQ ID NO: 613561 - DNA, 16 bp, Homo sapiens
acaccaaattgctgag

SEQ ID NO: 613562 - DNA, 19 bp, Homo sapiens
acaccaaattgctgagatg

SEQ ID NO: 613563 - DNA, 21 bp, Homo sapiens
acaccaaattgctgagatgtt

SEQ ID NO: 613564 - DNA, 16 bp, Homo sapiens
acaccagcaacattat

SEQ ID NO: 613565 - DNA, 11 bp, Homo sapiens
acacccttccc

SEQ ID NO: 613566 - DNA, 13 bp, Homo sapiens
acacccttcccca

SEQ ID NO: 613567 - DNA, 15 bp, Homo sapiens
acacccttccccact

SEQ ID NO: 613568 - DNA, 18 bp, Homo sapiens
acaccctttaatgttcta

SEQ ID NO: 613569 - DNA, 20 bp, Homo sapiens
acaccggcactgtgcactct

SEQ ID NO: 613570 - DNA, 15 bp, Homo sapiens
acacctaaattaaca

SEQ ID NO: 613571 - DNA, 15 bp, Homo sapiens
acacctcccttcatc

SEQ ID NO: 613572 - DNA, 15 bp, Homo sapiens
agaactcctttctaa

SEQ ID NO: 613573 - DNA, 13 bp, Homo sapiens
agaagaaaaacac

SEQ ID NO: 613574 - DNA, 20 bp, Homo sapiens
agaagaaatagcagagccta

SEQ ID NO: 613575 - DNA, 14 bp, Homo sapiens
agaagagcctgact

SEQ ID NO: 613576 - DNA, 20 bp, Homo sapiens
agaagatagttgtaaagata

SEQ ID NO: 613577 - DNA, 16 bp, Homo sapiens
agaagcaccccaccac

SEQ ID NO: 613578 - DNA, 18 bp, Homo sapiens
agaagctagatgcccctg

SEQ ID NO: 613579 - DNA, 21 bp, Homo sapiens
agaagctagatgcccctgcag

SEQ ID NO: 613580 - DNA, 21 bp, Homo sapiens
agaaggcctgccccccttccc

SEQ ID NO: 613581 - DNA, 13 bp, Homo sapiens
agaagggagtgaa

SEQ ID NO: 613582 - DNA, 15 bp, Homo sapiens
agaagggccaccctg

SEQ ID NO: 613583 - DNA, 20 bp, Homo sapiens
agaagggccaccctgagcag

SEQ ID NO: 613584 - DNA, 16 bp, Homo sapiens
agaagggttctgccct

SEQ ID NO: 613585 - DNA, 19 bp, Homo sapiens
agaagggttctgccctgcc

SEQ ID NO: 613586 - DNA, 24 bp, Homo sapiens
agaagggttctgccctgcctgagg

SEQ ID NO: 613587 - DNA, 14 bp, Homo sapiens
agaaggtaaataat

SEQ ID NO: 613588 - DNA, 23 bp, Homo sapiens
agaagtatccctgatttattctg

SEQ ID NO: 613589 - DNA, 22 bp, Homo sapiens
agaagtgggattcaggaatggg

SEQ ID NO: 613590 - DNA, 21 bp, Homo sapiens
agaagtttaaatctttgttaa

SEQ ID NO: 613591 - DNA, 19 bp, Homo sapiens
agaatcacctaattaattt

SEQ ID NO: 613592 - DNA, 22 bp, Homo sapiens
agaatcacctaattaatttcag

SEQ ID NO: 613593 - DNA, 22 bp, Homo sapiens
agaatccccgtgctcacagtag

SEQ ID NO: 613594 - DNA, 15 bp, Homo sapiens
agaatgagaaatcat

SEQ ID NO: 613595 - DNA, 15 bp, Homo sapiens
agaatgagatgattt

SEQ ID NO: 613596 - DNA, 21 bp, Homo sapiens
agaatgagatgatttaattct

SEQ ID NO: 613597 - DNA, 17 bp, Homo sapiens
agaatgagggcgtgaaa

SEQ ID NO: 613598 - DNA, 20 bp, Homo sapiens
aaacagtgtggatgtaaatt

SEQ ID NO: 613599 - DNA, 13 bp, Homo sapiens
aaacagtttaaca

SEQ ID NO: 613600 - DNA, 14 bp, Homo sapiens
aaacatagtggtat

SEQ ID NO: 613601 - DNA, 22 bp, Homo sapiens
aaacatagtggtattttaacat

SEQ ID NO: 613602 - DNA, 20 bp, Homo sapiens
aaacatttccctgctgagtg

SEQ ID NO: 613603 - DNA, 23 bp, Homo sapiens
aaaccaagccattaatgagatgt

SEQ ID NO: 613604 - DNA, 12 bp, Homo sapiens
aaaccagaaaga

SEQ ID NO: 613605 - DNA, 17 bp, Homo sapiens
aaaccagaaagaggaat

SEQ ID NO: 613606 - DNA, 20 bp, Homo sapiens
aaaccagaaagaggaataaa

SEQ ID NO: 613607 - DNA, 12 bp, Homo sapiens
aaaccatgaaaa

SEQ ID NO: 613608 - DNA, 17 bp, Homo sapiens
aaaccatgaaaagtttt

SEQ ID NO: 613609 - DNA, 20 bp, Homo sapiens
aaaccatgaaaagttttcaa

SEQ ID NO: 613610 - DNA, 21 bp, Homo sapiens
aaaccatgaaaagttttcaag

SEQ ID NO: 613611 - DNA, 17 bp, Homo sapiens
aaacccacataaacact

SEQ ID NO: 613612 - DNA, 16 bp, Homo sapiens
aaacccggctgactca

SEQ ID NO: 613613 - DNA, 18 bp, Homo sapiens
aaacctactgcccacatt

SEQ ID NO: 613614 - DNA, 18 bp, Homo sapiens
aaacctctgagtgttgaa

SEQ ID NO: 613615 - DNA, 20 bp, Homo sapiens
aaacctctttcggaaatgat

SEQ ID NO: 613616 - DNA, 17 bp, Homo sapiens
aaactaaatagcatgta

SEQ ID NO: 613617 - DNA, 13 bp, Homo sapiens
aaactaagaatca

SEQ ID NO: 613618 - DNA, 17 bp, Homo sapiens
aaactatcagcagcggc

SEQ ID NO: 613619 - DNA, 13 bp, Homo sapiens
aaactgatttttt

SEQ ID NO: 613620 - DNA, 23 bp, Homo sapiens
aaactgatttttttttccttcag

SEQ ID NO: 613621 - DNA, 14 bp, Homo sapiens
aaactggaaacatc

SEQ ID NO: 613622 - DNA, 15 bp, Homo sapiens
aaactgggaaatgag

SEQ ID NO: 613623 - DNA, 21 bp, Homo sapiens
aaactgggtgttcaaggccct

SEQ ID NO: 613624 - DNA, 18 bp, Homo sapiens
aaactgtatttacttgtt

SEQ ID NO: 613625 - DNA, 20 bp, Homo sapiens
aaactgtatttacttgttat

SEQ ID NO: 613626 - DNA, 10 bp, Homo sapiens
aaactgtgag

SEQ ID NO: 613627 - DNA, 14 bp, Homo sapiens
aaactgtgagataa

SEQ ID NO: 613628 - DNA, 18 bp, Homo sapiens
aaactgtgagataaatat

SEQ ID NO: 613629 - DNA, 14 bp, Homo sapiens
aaacttggacattt

SEQ ID NO: 613630 - DNA, 23 bp, Homo sapiens
aaacttggacatttatgtacaaa

SEQ ID NO: 613631 - DNA, 15 bp, Homo sapiens
aaactttccatgaca

SEQ ID NO: 613632 - DNA, 15 bp, Homo sapiens
aaacttttataaatg

SEQ ID NO: 613633 - DNA, 22 bp, Homo sapiens
aaacttttatgcaggcagatta

SEQ ID NO: 613634 - DNA, 16 bp, Homo sapiens
aaagaaagaaaaaagt

SEQ ID NO: 613635 - DNA, 15 bp, Homo sapiens
aaagaaaggcagaga

SEQ ID NO: 613636 - DNA, 17 bp, Homo sapiens
aaagaacccccctcccc

SEQ ID NO: 613637 - DNA, 14 bp, Homo sapiens
aaagaactgcccca

SEQ ID NO: 613638 - DNA, 15 bp, Homo sapiens
aaagaagatgtttaa

SEQ ID NO: 613639 - DNA, 17 bp, Homo sapiens
aaagaagtccatgtgat

SEQ ID NO: 613640 - DNA, 14 bp, Homo sapiens
aaagacatgaaatt

SEQ ID NO: 613641 - DNA, 24 bp, Homo sapiens
aaagagaaaatgctttctcatgca

SEQ ID NO: 613642 - DNA, 14 bp, Homo sapiens
aaagagaaacacta

SEQ ID NO: 613643 - DNA, 12 bp, Homo sapiens
aaagagcttccc

SEQ ID NO: 613644 - DNA, 13 bp, Homo sapiens
aaagatattgtat

SEQ ID NO: 613645 - DNA, 18 bp, Homo sapiens
aaagatcacaccaattta

SEQ ID NO: 613646 - DNA, 12 bp, Homo sapiens
aaagatggattt

SEQ ID NO: 613647 - DNA, 21 bp, Homo sapiens
aaagcagtatgtacaggctga

SEQ ID NO: 613648 - DNA, 23 bp, Homo sapiens
aaagcagtatgtacaggctgaga

SEQ ID NO: 613649 - DNA, 22 bp, Homo sapiens
aaagcatgctcagtattgagac

SEQ ID NO: 613650 - DNA, 15 bp, Homo sapiens
aaagcatgtacagtg

SEQ ID NO: 613651 - DNA, 21 bp, Homo sapiens
aaagctaccatgttaatacat

SEQ ID NO: 613652 - DNA, 14 bp, Homo sapiens
aaagctatttaagt

SEQ ID NO: 613653 - DNA, 20 bp, Homo sapiens
aaagctcgtagaaacaagac

SEQ ID NO: 613654 - DNA, 19 bp, Homo sapiens
aaagctgctttccatggca

SEQ ID NO: 613655 - DNA, 15 bp, Homo sapiens
aaaggcagagattgg

SEQ ID NO: 613656 - DNA, 20 bp, Homo sapiens
aaaggcagccctcacctctg

SEQ ID NO: 613657 - DNA, 23 bp, Homo sapiens
aaaggctgcagctaatttgtgaa

SEQ ID NO: 613658 - DNA, 14 bp, Homo sapiens
aaaggcttctccac

SEQ ID NO: 613659 - DNA, 18 bp, Homo sapiens
aaaggcttgagtctggat

SEQ ID NO: 613660 - DNA, 19 bp, Homo sapiens
aaaggcttgagtctggata

SEQ ID NO: 613661 - DNA, 15 bp, Homo sapiens
aaagggaagccctga

SEQ ID NO: 613662 - DNA, 17 bp, Homo sapiens
aaagggcagcccctccc

SEQ ID NO: 613663 - DNA, 14 bp, Homo sapiens
aaaggtaggtgcat

SEQ ID NO: 613664 - DNA, 13 bp, Homo sapiens
aaaggtgcctcat

SEQ ID NO: 613665 - DNA, 18 bp, Homo sapiens
aaagtaataactgttaga

SEQ ID NO: 613666 - DNA, 14 bp, Homo sapiens
aaagtctcctgtat

SEQ ID NO: 613667 - DNA, 22 bp, Homo sapiens
aaagtgatgtgatttatgcatt

SEQ ID NO: 613668 - DNA, 16 bp, Homo sapiens
aaagtgtccattgaca

SEQ ID NO: 613669 - DNA, 23 bp, Homo sapiens
aaagtgtccattgacatgtacag

SEQ ID NO: 613670 - DNA, 15 bp, Homo sapiens
aaagtgttgtcttat

SEQ ID NO: 613671 - DNA, 14 bp, Homo sapiens
aaagtgtttttaca

SEQ ID NO: 613672 - DNA, 16 bp, Homo sapiens
aaagtttacattgtcc

SEQ ID NO: 613673 - DNA, 22 bp, Homo sapiens
aaagttttcagattgtaaaggt

SEQ ID NO: 613674 - DNA, 11 bp, Homo sapiens
aaataaaagaa

SEQ ID NO: 613675 - DNA, 19 bp, Homo sapiens
aaataaagctaccatgtta

SEQ ID NO: 613676 - DNA, 21 bp, Homo sapiens
aaataaatcatcctcatgtcc

SEQ ID NO: 613677 - DNA, 19 bp, Homo sapiens
aaataaccctgaatcagag

SEQ ID NO: 613678 - DNA, 15 bp, Homo sapiens
aaataatacttcata

SEQ ID NO: 613679 - DNA, 20 bp, Homo sapiens
aaataatagatgtgaaaatg

SEQ ID NO: 613680 - DNA, 13 bp, Homo sapiens
aaataatataaat

SEQ ID NO: 613681 - DNA, 13 bp, Homo sapiens
aaataatattgcc

SEQ ID NO: 613682 - DNA, 14 bp, Homo sapiens
aaataatattgcct

SEQ ID NO: 613683 - DNA, 15 bp, Homo sapiens
aaataatattgcctt

SEQ ID NO: 613684 - DNA, 18 bp, Homo sapiens
aaataatcatacacagaa

SEQ ID NO: 613685 - DNA, 23 bp, Homo sapiens
aaataatgcttaacataaacttg

SEQ ID NO: 613686 - DNA, 16 bp, Homo sapiens
aaatacacgtgtatat

SEQ ID NO: 613687 - DNA, 19 bp, Homo sapiens
aaatacacgtgtatatgag

SEQ ID NO: 613688 - DNA, 22 bp, Homo sapiens
aaatacagcatttctttggaaa

SEQ ID NO: 613689 - DNA, 23 bp, Homo sapiens
aaatacatcatatgttagataca

SEQ ID NO: 613690 - DNA, 13 bp, Homo sapiens
aaatagcagagcc

SEQ ID NO: 613691 - DNA, 15 bp, Homo sapiens
aaatagcatgtattg

SEQ ID NO: 613692 - DNA, 16 bp, Homo sapiens
aaatagcatgtattgt

SEQ ID NO: 613693 - DNA, 14 bp, Homo sapiens
aaatagctataaat

SEQ ID NO: 613694 - DNA, 21 bp, Homo sapiens
aaatagctataaatagtgaaa

SEQ ID NO: 613695 - DNA, 14 bp, Homo sapiens
aaatagcttttcac

SEQ ID NO: 613696 - DNA, 15 bp, Homo sapiens
aaatagcttttcact

SEQ ID NO: 613697 - DNA, 19 bp, Homo sapiens
aaatagttgagccagcaga

SEQ ID NO: 613698 - DNA, 15 bp, Homo sapiens
aaatataaaaataat

SEQ ID NO: 613699 - DNA, 17 bp, Homo sapiens
aaatataaactgtgaga

SEQ ID NO: 613700 - DNA, 18 bp, Homo sapiens
aaatataaactgtgagat

SEQ ID NO: 613701 - DNA, 13 bp, Homo sapiens
aaatataacatga

SEQ ID NO: 613702 - DNA, 14 bp, Homo sapiens
aaatataacatgaa

SEQ ID NO: 613703 - DNA, 22 bp, Homo sapiens
aacagcacagtcttttcctacg

SEQ ID NO: 613704 - DNA, 15 bp, Homo sapiens
aacagcaggttgtgt

SEQ ID NO: 613705 - DNA, 23 bp, Homo sapiens
aacagctaggttaataggaggac

SEQ ID NO: 613706 - DNA, 15 bp, Homo sapiens
aacagctgtattatc

SEQ ID NO: 613707 - DNA, 12 bp, Homo sapiens
aacagtaactgc

SEQ ID NO: 613708 - DNA, 12 bp, Homo sapiens
aacagtatttcc

SEQ ID NO: 613709 - DNA, 18 bp, Homo sapiens
aacagtgctggtttgtcc

SEQ ID NO: 613710 - DNA, 21 bp, Homo sapiens
aacagtgtggatgtaaatttt

SEQ ID NO: 613711 - DNA, 21 bp, Homo sapiens
aacagtgtggcttaaacattt

SEQ ID NO: 613712 - DNA, 15 bp, Homo sapiens
aacagtttttatgtt

SEQ ID NO: 613713 - DNA, 17 bp, Homo sapiens
aacatactggctggtga

SEQ ID NO: 613714 - DNA, 22 bp, Homo sapiens
aacatagtggtattttaacata

SEQ ID NO: 613715 - DNA, 20 bp, Homo sapiens
aacatcaattgggttttgat

SEQ ID NO: 613716 - DNA, 22 bp, Homo sapiens
aacatcaattgggttttgatct

SEQ ID NO: 613717 - DNA, 14 bp, Homo sapiens
aacatcataaatag

SEQ ID NO: 613718 - DNA, 12 bp, Homo sapiens
aacatctgattt

SEQ ID NO: 613719 - DNA, 21 bp, Homo sapiens
aacatctgatttctgaactat

SEQ ID NO: 613720 - DNA, 19 bp, Homo sapiens
aacatgacccgtacacacc

SEQ ID NO: 613721 - DNA, 23 bp, Homo sapiens
aatttaccatcaaacaaatcatt

SEQ ID NO: 613722 - DNA, 15 bp, Homo sapiens
aatttactatgtaaa

SEQ ID NO: 613723 - DNA, 19 bp, Homo sapiens
aatttactatgtaaatgct

SEQ ID NO: 613724 - DNA, 15 bp, Homo sapiens
aatttagaatgaata

SEQ ID NO: 613725 - DNA, 17 bp, Homo sapiens
aatttagcagtccattt

SEQ ID NO: 613726 - DNA, 18 bp, Homo sapiens
aatttagcagtccatttt

SEQ ID NO: 613727 - DNA, 16 bp, Homo sapiens
aatttatgatataata

SEQ ID NO: 613728 - DNA, 15 bp, Homo sapiens
aatttattaaattta

SEQ ID NO: 613729 - DNA, 15 bp, Homo sapiens
aatttcaatttttaa

SEQ ID NO: 613730 - DNA, 13 bp, Homo sapiens
aatttcatgcaca

SEQ ID NO: 613731 - DNA, 20 bp, Homo sapiens
aatttctagatatgagaaat

SEQ ID NO: 613732 - DNA, 20 bp, Homo sapiens
aatttgacattgtcagaatg

SEQ ID NO: 613733 - DNA, 22 bp, Homo sapiens
aatttgacattgtcagaatgtt

SEQ ID NO: 613734 - DNA, 17 bp, Homo sapiens
aatttgataatcagttt

SEQ ID NO: 613735 - DNA, 14 bp, Homo sapiens
aatttgatatcaca

SEQ ID NO: 613736 - DNA, 18 bp, Homo sapiens
aatttgatatcacagtct

SEQ ID NO: 613737 - DNA, 21 bp, Homo sapiens
aatttgtgaaagtggcaagct

SEQ ID NO: 613738 - DNA, 15 bp, Homo sapiens
aatttgtgtgcttca

SEQ ID NO: 613739 - DNA, 21 bp, Homo sapiens
aattttataaggctgactctt

SEQ ID NO: 613740 - DNA, 13 bp, Homo sapiens
aattttattgctg

SEQ ID NO: 613741 - DNA, 17 bp, Homo sapiens
aattttcacatgaacat

SEQ ID NO: 613742 - DNA, 21 bp, Homo sapiens
aattttcccagtgaataaata

SEQ ID NO: 613743 - DNA, 19 bp, Homo sapiens
aattttggaagaattcatg

SEQ ID NO: 613744 - DNA, 15 bp, Homo sapiens
aatttttaaatttct

SEQ ID NO: 613745 - DNA, 23 bp, Homo sapiens
aatttttctgcactgagcagagt

SEQ ID NO: 613746 - DNA, 21 bp, Homo sapiens
aatttttgtttttaaattatt

SEQ ID NO: 613747 - DNA, 16 bp, Homo sapiens
aatttttttattgttt

SEQ ID NO: 613748 - DNA, 19 bp, Homo sapiens
aatttttttattgtttaaa

SEQ ID NO: 613749 - DNA, 18 bp, Homo sapiens
aatttttttccagaattg

SEQ ID NO: 613750 - DNA, 21 bp, Homo sapiens
acaaaaaaaagaaagaaaaaa

SEQ ID NO: 613751 - DNA, 21 bp, Homo sapiens
acaaaaactttccatgacagt

SEQ ID NO: 613752 - DNA, 23 bp, Homo sapiens
acaaaaggctggatgtgctttca

SEQ ID NO: 613753 - DNA, 20 bp, Homo sapiens
acaaaatccttgccttcaaa

SEQ ID NO: 613754 - DNA, 20 bp, Homo sapiens
acaaaccagcaacttttctc

SEQ ID NO: 613755 - DNA, 12 bp, Homo sapiens
acaaacttttat

SEQ ID NO: 613756 - DNA, 14 bp, Homo sapiens
acaaacttttataa

SEQ ID NO: 613757 - DNA, 15 bp, Homo sapiens
acaaacttttataaa

SEQ ID NO: 613758 - DNA, 18 bp, Homo sapiens
acaaacttttataaatgt

SEQ ID NO: 613759 - DNA, 12 bp, Homo sapiens
acaaagaaacaa

SEQ ID NO: 613760 - DNA, 12 bp, Homo sapiens
acaaagcatgct

SEQ ID NO: 613761 - DNA, 16 bp, Homo sapiens
acaaagcatgctcagt

SEQ ID NO: 613762 - DNA, 17 bp, Homo sapiens
acaaagctatttaagtg

SEQ ID NO: 613763 - DNA, 16 bp, Homo sapiens
acaaagtttacattgt

SEQ ID NO: 613764 - DNA, 20 bp, Homo sapiens
acaaagtttacattgtcctg

SEQ ID NO: 613765 - DNA, 16 bp, Homo sapiens
acaaataatattgcct

SEQ ID NO: 613766 - DNA, 11 bp, Homo sapiens
acaaatacaca

SEQ ID NO: 613767 - DNA, 14 bp, Homo sapiens
acaaatacacatac

SEQ ID NO: 613768 - DNA, 18 bp, Homo sapiens
acaaatatactcatttgg

SEQ ID NO: 613769 - DNA, 19 bp, Homo sapiens
acaaatatactcatttgga

SEQ ID NO: 613770 - DNA, 21 bp, Homo sapiens
acaaatatactcatttggata

SEQ ID NO: 613771 - DNA, 23 bp, Homo sapiens
acaaatgatttcgtgactgtagt

SEQ ID NO: 613772 - DNA, 20 bp, Homo sapiens
acaaattttcccagtgaata

SEQ ID NO: 613773 - DNA, 18 bp, Homo sapiens
acaaatttttactcaggc

SEQ ID NO: 613774 - DNA, 20 bp, Homo sapiens
acaaatttttactcaggctt

SEQ ID NO: 613775 - DNA, 20 bp, Homo sapiens
acaacaagcaaactgaaatt

SEQ ID NO: 613776 - DNA, 19 bp, Homo sapiens
acaacaccagcaacattat

SEQ ID NO: 613777 - DNA, 12 bp, Homo sapiens
acaacagcaaca

SEQ ID NO: 613778 - DNA, 15 bp, Homo sapiens
acaaccatgttcttg

SEQ ID NO: 613779 - DNA, 16 bp, Homo sapiens
acaacctgcccctccc

SEQ ID NO: 613780 - DNA, 18 bp, Homo sapiens
acaactgtggataaattt

SEQ ID NO: 613781 - DNA, 17 bp, Homo sapiens
acaacttccagatttga

SEQ ID NO: 613782 - DNA, 13 bp, Homo sapiens
acaactttctgga

SEQ ID NO: 613783 - DNA, 20 bp, Homo sapiens
acaagagaccacttccttaa

SEQ ID NO: 613784 - DNA, 13 bp, Homo sapiens
acaagcagacaca

SEQ ID NO: 613785 - DNA, 15 bp, Homo sapiens
acaagcagacacaca

SEQ ID NO: 613786 - DNA, 17 bp, Homo sapiens
acaagccacgttgcaga

SEQ ID NO: 613787 - DNA, 15 bp, Homo sapiens
acaagctacatatgt

SEQ ID NO: 613788 - DNA, 18 bp, Homo sapiens
acaaggttatcagaaaga

SEQ ID NO: 613789 - DNA, 18 bp, Homo sapiens
acaagtatcatctaaata

SEQ ID NO: 613790 - DNA, 21 bp, Homo sapiens
acaagtctgagtagttatgaa

SEQ ID NO: 613791 - DNA, 18 bp, Homo sapiens
acaagtgacttatttgct

SEQ ID NO: 613792 - DNA, 21 bp, Homo sapiens
acaagttacccctgaaatctg

SEQ ID NO: 613793 - DNA, 22 bp, Homo sapiens
acaataagaaacagtttaacag

SEQ ID NO: 613794 - DNA, 12 bp, Homo sapiens
acaataagtgtt

SEQ ID NO: 613795 - DNA, 16 bp, Homo sapiens
acaatgcaaaccatca

SEQ ID NO: 613796 - DNA, 18 bp, Homo sapiens
acaatgcaaaccatcatt

SEQ ID NO: 613797 - DNA, 17 bp, Homo sapiens
aagatattgtatctcct

SEQ ID NO: 613798 - DNA, 22 bp, Homo sapiens
aagatcacaccaatttagaatg

SEQ ID NO: 613799 - DNA, 16 bp, Homo sapiens
aagatcccaagtcaaa

SEQ ID NO: 613800 - DNA, 13 bp, Homo sapiens
aagatctgactgc

SEQ ID NO: 613801 - DNA, 15 bp, Homo sapiens
aagatctgactgcca

SEQ ID NO: 613802 - DNA, 16 bp, Homo sapiens
aagatctttttttaag

SEQ ID NO: 613803 - DNA, 17 bp, Homo sapiens
aagatctttttttaagt

SEQ ID NO: 613804 - DNA, 16 bp, Homo sapiens
aagatgacctcgttcc

SEQ ID NO: 613805 - DNA, 22 bp, Homo sapiens
aagatgctgctgagcacatctc

SEQ ID NO: 613806 - DNA, 23 bp, Homo sapiens
aagatgctgctgagcacatctct

SEQ ID NO: 613807 - DNA, 15 bp, Homo sapiens
aagatgtaagaagct

SEQ ID NO: 613808 - DNA, 19 bp, Homo sapiens
aagatgtcccattgataat

SEQ ID NO: 613809 - DNA, 20 bp, Homo sapiens
aagattaagttataccagca

SEQ ID NO: 613810 - DNA, 21 bp, Homo sapiens
aagattgtacttttatcttaa

SEQ ID NO: 613811 - DNA, 20 bp, Homo sapiens
aagcaaatttctagatatga

SEQ ID NO: 613812 - DNA, 21 bp, Homo sapiens
aagcaacgggaacacctgctg

SEQ ID NO: 613813 - DNA, 18 bp, Homo sapiens
aagcaactgtctatttct

SEQ ID NO: 613814 - DNA, 18 bp, Homo sapiens
aagcacacacatctggcc

SEQ ID NO: 613815 - DNA, 21 bp, Homo sapiens
aagcacacacatctggccctg

SEQ ID NO: 613816 - DNA, 14 bp, Homo sapiens
aagcaccctgttcc

SEQ ID NO: 613817 - DNA, 15 bp, Homo sapiens
aagcacctctcagcc

SEQ ID NO: 613818 - DNA, 13 bp, Homo sapiens
aagcactttacag

SEQ ID NO: 613819 - DNA, 19 bp, Homo sapiens
aagcagaatgagatgattt

SEQ ID NO: 613820 - DNA, 15 bp, Homo sapiens
aagcagacacacaca

SEQ ID NO: 613821 - DNA, 22 bp, Homo sapiens
aagcagacacacacatatatac

SEQ ID NO: 613822 - DNA, 19 bp, Homo sapiens
aagcagagtcaagctgatg

SEQ ID NO: 613823 - DNA, 19 bp, Homo sapiens
aagcagcaaggtgggggtc

SEQ ID NO: 613824 - DNA, 21 bp, Homo sapiens
aagcaggaaagatcccaagtc

SEQ ID NO: 613825 - DNA, 22 bp, Homo sapiens
aagcatctgtgtaacctccaca

SEQ ID NO: 613826 - DNA, 19 bp, Homo sapiens
aagcatgccaatttctctt

SEQ ID NO: 613827 - DNA, 15 bp, Homo sapiens
aagcatgctcagtat

SEQ ID NO: 613828 - DNA, 18 bp, Homo sapiens
aagcatgctcagtattga

SEQ ID NO: 613829 - DNA, 12 bp, Homo sapiens
aagcatgtacag

SEQ ID NO: 613830 - DNA, 13 bp, Homo sapiens
aagcatgtacagt

SEQ ID NO: 613831 - DNA, 22 bp, Homo sapiens
aagcatgtacagtgttctgttt

SEQ ID NO: 613832 - DNA, 21 bp, Homo sapiens
aagccaaaatagagagtatac

SEQ ID NO: 613833 - DNA, 16 bp, Homo sapiens
aagccaatttttctgc

SEQ ID NO: 613834 - DNA, 20 bp, Homo sapiens
aagccaatttttctgcactg

SEQ ID NO: 613835 - DNA, 14 bp, Homo sapiens
aagccaggagaccc

SEQ ID NO: 613836 - DNA, 19 bp, Homo sapiens
aagccaggagaccctgtct

SEQ ID NO: 613837 - DNA, 23 bp, Homo sapiens
aagccagtggggtcccccctgag

SEQ ID NO: 613838 - DNA, 18 bp, Homo sapiens
aagccatagccccaggcc

SEQ ID NO: 613839 - DNA, 23 bp, Homo sapiens
aagccatggtgaactgataattt

SEQ ID NO: 613840 - DNA, 10 bp, Homo sapiens
aagcccaccc

SEQ ID NO: 613841 - DNA, 21 bp, Homo sapiens
aagcccacccgccccagagac

SEQ ID NO: 613842 - DNA, 22 bp, Homo sapiens
aagcccagcctatctctcttct

SEQ ID NO: 613843 - DNA, 14 bp, Homo sapiens
aagccccttggaga

SEQ ID NO: 613844 - DNA, 17 bp, Homo sapiens
aagccctccctgtctgt

SEQ ID NO: 613845 - DNA, 21 bp, Homo sapiens
aagcccttctcaagaccgagt

SEQ ID NO: 613846 - DNA, 13 bp, Homo sapiens
aagcctggattcc

SEQ ID NO: 613847 - DNA, 20 bp, Homo sapiens
aagcctggattccagcagtg

SEQ ID NO: 613848 - DNA, 13 bp, Homo sapiens
aagctaaaacact

SEQ ID NO: 613849 - DNA, 20 bp, Homo sapiens
aagctaatgtggtagtgaaa

SEQ ID NO: 613850 - DNA, 22 bp, Homo sapiens
aagctacatatgtaggaaaatt

SEQ ID NO: 613851 - DNA, 16 bp, Homo sapiens
aagctataaaagccca

SEQ ID NO: 613852 - DNA, 20 bp, Homo sapiens
aagctatttaagtggactgt

SEQ ID NO: 613853 - DNA, 22 bp, Homo sapiens
aagctatttaagtggactgtat

SEQ ID NO: 613854 - DNA, 22 bp, Homo sapiens
aagctcacacttgggctggcac

SEQ ID NO: 613855 - DNA, 16 bp, Homo sapiens
aagctcatagcacatg

SEQ ID NO: 613856 - DNA, 18 bp, Homo sapiens
aagctcgtagaaacaaga

SEQ ID NO: 613857 - DNA, 19 bp, Homo sapiens
aagctcttcattgcactgc

SEQ ID NO: 613858 - DNA, 16 bp, Homo sapiens
aagctttctcctttga

SEQ ID NO: 613859 - DNA, 16 bp, Homo sapiens
aagctttttgtgagaa

SEQ ID NO: 613860 - DNA, 18 bp, Homo sapiens
aagctttttgtgagaaag

SEQ ID NO: 613861 - DNA, 14 bp, Homo sapiens
aaggaaaagagaaa

SEQ ID NO: 613862 - DNA, 21 bp, Homo sapiens
aaggaagctttggaagcagca

SEQ ID NO: 613863 - DNA, 16 bp, Homo sapiens
aaggaaggacatttcc

SEQ ID NO: 613864 - DNA, 21 bp, Homo sapiens
aaggacaacctgcccctcccc

SEQ ID NO: 613865 - DNA, 16 bp, Homo sapiens
aaggacagtgttcaaa

SEQ ID NO: 613866 - DNA, 18 bp, Homo sapiens
aaggacagtgttcaaatt

SEQ ID NO: 613867 - DNA, 13 bp, Homo sapiens
aaggactgaagaa

SEQ ID NO: 613868 - DNA, 14 bp, Homo sapiens
aaggactgaagaaa

SEQ ID NO: 613869 - DNA, 11 bp, Homo sapiens
aaggagaggag

SEQ ID NO: 613870 - DNA, 23 bp, Homo sapiens
aaggagaggagtgcgctagagca

SEQ ID NO: 613871 - DNA, 13 bp, Homo sapiens
aaggatcctgagc

SEQ ID NO: 613872 - DNA, 15 bp, Homo sapiens
aaggatcctgagcca

SEQ ID NO: 613873 - DNA, 22 bp, Homo sapiens
aaggatcctgagccagatttca

SEQ ID NO: 613874 - DNA, 16 bp, Homo sapiens
aaggcaagaagtggga

SEQ ID NO: 613875 - DNA, 11 bp, Homo sapiens
aaggcactgtc

SEQ ID NO: 613876 - DNA, 12 bp, Homo sapiens
aaggcagccctc

SEQ ID NO: 613877 - DNA, 23 bp, Homo sapiens
aaggcccggccccatcagaggct

SEQ ID NO: 613878 - DNA, 23 bp, Homo sapiens
aaggcctgagggaagcccacccg

SEQ ID NO: 613879 - DNA, 19 bp, Homo sapiens
aaggcctgccccccttccc

SEQ ID NO: 613880 - DNA, 13 bp, Homo sapiens
aaggcggagggtc

SEQ ID NO: 613881 - DNA, 19 bp, Homo sapiens
aaggcggagggtctccctg

SEQ ID NO: 613882 - DNA, 17 bp, Homo sapiens
aaggctgactcttacta

SEQ ID NO: 613883 - DNA, 20 bp, Homo sapiens
aaggctgcagctaatttgtg

SEQ ID NO: 613884 - DNA, 22 bp, Homo sapiens
aaggctgcagctaatttgtgaa

SEQ ID NO: 613885 - DNA, 11 bp, Homo sapiens
aaggctgctgt

SEQ ID NO: 613886 - DNA, 14 bp, Homo sapiens
aagggaaatcaatt

SEQ ID NO: 613887 - DNA, 13 bp, Homo sapiens
aagggaagccctg

SEQ ID NO: 613888 - DNA, 22 bp, Homo sapiens
agaagcctgtctgtacttcatt

SEQ ID NO: 613889 - DNA, 19 bp, Homo sapiens
agaagctagatgcccctgc

SEQ ID NO: 613890 - DNA, 22 bp, Homo sapiens
agaaggattcttttttcaatgt

SEQ ID NO: 613891 - DNA, 23 bp, Homo sapiens
agaaggattcttttttcaatgta

SEQ ID NO: 613892 - DNA, 19 bp, Homo sapiens
agaaggcctgccccccttc

SEQ ID NO: 613893 - DNA, 14 bp, Homo sapiens
agaaggggcgaggc

SEQ ID NO: 613894 - DNA, 16 bp, Homo sapiens
agaagtccatgtgata

SEQ ID NO: 613895 - DNA, 23 bp, Homo sapiens
agaagtccatgtgataattgtaa

SEQ ID NO: 613896 - DNA, 22 bp, Homo sapiens
agaagtggaaggataatgagat

SEQ ID NO: 613897 - DNA, 14 bp, Homo sapiens
agaataggcaaact

SEQ ID NO: 613898 - DNA, 22 bp, Homo sapiens
agaataggcaaacttttatgca

SEQ ID NO: 613899 - DNA, 23 bp, Homo sapiens
agaataggcaaacttttatgcag

SEQ ID NO: 613900 - DNA, 16 bp, Homo sapiens
agaatcaagtctgtga

SEQ ID NO: 613901 - DNA, 18 bp, Homo sapiens
agaatccccgtgctcaca

SEQ ID NO: 613902 - DNA, 19 bp, Homo sapiens
agaatgaggcacatgacag

SEQ ID NO: 613903 - DNA, 21 bp, Homo sapiens
agaatgagggcgtgaaacaca

SEQ ID NO: 613904 - DNA, 23 bp, Homo sapiens
agaatgagggcgtgaaacacaat

SEQ ID NO: 613905 - DNA, 12 bp, Homo sapiens
agaatgtgaaaa

SEQ ID NO: 613906 - DNA, 13 bp, Homo sapiens
agaatgtgaaaaa

SEQ ID NO: 613907 - DNA, 20 bp, Homo sapiens
agaatgtgaaaaaaaaaagt

SEQ ID NO: 613908 - DNA, 19 bp, Homo sapiens
agaattaggtaatggatat

SEQ ID NO: 613909 - DNA, 21 bp, Homo sapiens
agaattaggtaatggatatga

SEQ ID NO: 613910 - DNA, 22 bp, Homo sapiens
agaattaggtaatggatatgaa

SEQ ID NO: 613911 - DNA, 17 bp, Homo sapiens
agaattcagtagcattt

SEQ ID NO: 613912 - DNA, 17 bp, Homo sapiens
agaattcatgatgctag

SEQ ID NO: 613913 - DNA, 23 bp, Homo sapiens
agaattcatgatgctagttctta

SEQ ID NO: 613914 - DNA, 21 bp, Homo sapiens
agaattgaaccgtcaatgtga

SEQ ID NO: 613915 - DNA, 21 bp, Homo sapiens
agaattgggcccttagaatgt

SEQ ID NO: 613916 - DNA, 15 bp, Homo sapiens
agagtggaggaggag

SEQ ID NO: 613917 - DNA, 16 bp, Homo sapiens
agagtggatctggagt

SEQ ID NO: 613918 - DNA, 14 bp, Homo sapiens
agagttcatagaaa

SEQ ID NO: 613919 - DNA, 20 bp, Homo sapiens
agagttcatagaaatacatc

SEQ ID NO: 613920 - DNA, 21 bp, Homo sapiens
agagttctccttgtacttgaa

SEQ ID NO: 613921 - DNA, 15 bp, Homo sapiens
agagttgcagtaaag

SEQ ID NO: 613922 - DNA, 15 bp, Homo sapiens
agataaatatcatta

SEQ ID NO: 613923 - DNA, 16 bp, Homo sapiens
agataaatatcattat

SEQ ID NO: 613924 - DNA, 18 bp, Homo sapiens
agataaatccaactctga

SEQ ID NO: 613925 - DNA, 20 bp, Homo sapiens
agataagtgctcagtattga

SEQ ID NO: 613926 - DNA, 15 bp, Homo sapiens
agataccattttgaa

SEQ ID NO: 613927 - DNA, 15 bp, Homo sapiens
agataccctctgaga

SEQ ID NO: 613928 - DNA, 17 bp, Homo sapiens
agatacgtatattttta

SEQ ID NO: 613929 - DNA, 17 bp, Homo sapiens
agatagttgtaaagata

SEQ ID NO: 613930 - DNA, 19 bp, Homo sapiens
agatcaggagaaactcggg

SEQ ID NO: 613931 - DNA, 19 bp, Homo sapiens
agatcattttttgtctatt

SEQ ID NO: 613932 - DNA, 21 bp, Homo sapiens
agatcattttttgtctatttt

SEQ ID NO: 613933 - DNA, 19 bp, Homo sapiens
agatccagggatggagatg

SEQ ID NO: 613934 - DNA, 20 bp, Homo sapiens
agatccctcggtcagcaccg

SEQ ID NO: 613935 - DNA, 20 bp, Homo sapiens
agatcctccgcggaggcccc

SEQ ID NO: 613936 - DNA, 21 bp, Homo sapiens
agatcctccgcggaggcccct

SEQ ID NO: 613937 - DNA, 11 bp, Homo sapiens
agatccttcca

SEQ ID NO: 613938 - DNA, 15 bp, Homo sapiens
agatcgtgccgtgga

SEQ ID NO: 613939 - DNA, 23 bp, Homo sapiens
agatctagtgccattatttctac

SEQ ID NO: 613940 - DNA, 20 bp, Homo sapiens
agatctgaagtagtgtgagt

SEQ ID NO: 613941 - DNA, 20 bp, Homo sapiens
agatcttgagcaaggcaaga

SEQ ID NO: 613942 - DNA, 17 bp, Homo sapiens
agatctttttttaagtg

SEQ ID NO: 613943 - DNA, 20 bp, Homo sapiens
agatgaaaaagcatgtacag

SEQ ID NO: 613944 - DNA, 16 bp, Homo sapiens
agatgactggaaacaa

SEQ ID NO: 613945 - DNA, 20 bp, Homo sapiens
agatgactggaaacaaggaa

SEQ ID NO: 613946 - DNA, 15 bp, Homo sapiens
agatgaggctggata

SEQ ID NO: 613947 - DNA, 15 bp, Homo sapiens
agatgatttaattct

SEQ ID NO: 613948 - DNA, 15 bp, Homo sapiens
agatggggcctgggc

SEQ ID NO: 613949 - DNA, 22 bp, Homo sapiens
agatgggttttgttaggggtgg

SEQ ID NO: 613950 - DNA, 22 bp, Homo sapiens
agatggtagaaactttggaagt

SEQ ID NO: 613951 - DNA, 17 bp, Homo sapiens
agatgttattactgttt

SEQ ID NO: 613952 - DNA, 11 bp, Homo sapiens
agattaataac

SEQ ID NO: 613953 - DNA, 19 bp, Homo sapiens
agattaataacagaaatac

SEQ ID NO: 613954 - DNA, 19 bp, Homo sapiens
agattatatacaaagctgt

SEQ ID NO: 613955 - DNA, 21 bp, Homo sapiens
agattattttctatatttgga

SEQ ID NO: 613956 - DNA, 19 bp, Homo sapiens
agattccctctcctccccc

SEQ ID NO: 613957 - DNA, 15 bp, Homo sapiens
agattcctacttaaa

SEQ ID NO: 613958 - DNA, 17 bp, Homo sapiens
agattcctacttaaaca

SEQ ID NO: 613959 - DNA, 21 bp, Homo sapiens
agattcctacttaaacaaaaa

SEQ ID NO: 613960 - DNA, 19 bp, Homo sapiens
agattgaagctaaaacact

SEQ ID NO: 613961 - DNA, 16 bp, Homo sapiens
agattgacttcagaaa

SEQ ID NO: 613962 - DNA, 13 bp, Homo sapiens
agattgctctggg

SEQ ID NO: 613963 - DNA, 16 bp, Homo sapiens
agattgggggggcttg

SEQ ID NO: 613964 - DNA, 21 bp, Homo sapiens
agattgtaaaggtaggtgcat

SEQ ID NO: 613965 - DNA, 19 bp, Homo sapiens
agatttggtaactcatttg

SEQ ID NO: 613966 - DNA, 20 bp, Homo sapiens
agattttaggaaatgaatgt

SEQ ID NO: 613967 - DNA, 23 bp, Homo sapiens
agattttgttttgctttttctga

SEQ ID NO: 613968 - DNA, 12 bp, Homo sapiens
agcaaaatatat

SEQ ID NO: 613969 - DNA, 15 bp, Homo sapiens
agcaaactgaaatta

SEQ ID NO: 613970 - DNA, 15 bp, Homo sapiens
agcaacatcttttga

SEQ ID NO: 613971 - DNA, 22 bp, Homo sapiens
agcaacattataatggccctgt

SEQ ID NO: 613972 - DNA, 16 bp, Homo sapiens
agcaaccagagcactg

SEQ ID NO: 613973 - DNA, 18 bp, Homo sapiens
agcaaccagagcactgta

SEQ ID NO: 613974 - DNA, 16 bp, Homo sapiens
agcaactgtctatttc

SEQ ID NO: 613975 - DNA, 14 bp, Homo sapiens
agcaacttttctca

SEQ ID NO: 613976 - DNA, 17 bp, Homo sapiens
agcaataagttgaatga

SEQ ID NO: 613977 - DNA, 15 bp, Homo sapiens
agcaatccttaaaaa

SEQ ID NO: 613978 - DNA, 16 bp, Homo sapiens
agcaatccttaaaaag

SEQ ID NO: 613979 - DNA, 18 bp, Homo sapiens
agcaatcttgctgtgaaa

SEQ ID NO: 613980 - DNA, 18 bp, Homo sapiens
agcacaaaaaatttaaga

SEQ ID NO: 613981 - DNA, 15 bp, Homo sapiens
agcacaagggcacat

SEQ ID NO: 613982 - DNA, 21 bp, Homo sapiens
agcacacacatctggccctga

SEQ ID NO: 613983 - DNA, 15 bp, Homo sapiens
agcacagctttcctg

SEQ ID NO: 613984 - DNA, 14 bp, Homo sapiens
agcacagtatttaa

SEQ ID NO: 613985 - DNA, 17 bp, Homo sapiens
agcacagtatttaacat

SEQ ID NO: 613986 - DNA, 16 bp, Homo sapiens
agcacatgttttacaa

SEQ ID NO: 613987 - DNA, 19 bp, Homo sapiens
agcacatgttttacaaaga

SEQ ID NO: 613988 - DNA, 19 bp, Homo sapiens
agcacatttgttaatgatt

SEQ ID NO: 613989 - DNA, 16 bp, Homo sapiens
agcaccagcctgagcc

SEQ ID NO: 613990 - DNA, 17 bp, Homo sapiens
agcaccagcctgagcca

SEQ ID NO: 613991 - DNA, 17 bp, Homo sapiens
agcaccccaccacacac

SEQ ID NO: 613992 - DNA, 21 bp, Homo sapiens
agcaccccaccacacacaccc

SEQ ID NO: 613993 - DNA, 18 bp, Homo sapiens
agcacccccagcctcccc

SEQ ID NO: 613994 - DNA, 20 bp, Homo sapiens
agcacccccagcctccccca

SEQ ID NO: 613995 - DNA, 16 bp, Homo sapiens
agcaccgtggtgtgag

SEQ ID NO: 613996 - DNA, 20 bp, Homo sapiens
agcaccgtggtgtgaggccc

SEQ ID NO: 613997 - DNA, 12 bp, Homo sapiens
agcacctcctcc

SEQ ID NO: 613998 - DNA, 13 bp, Homo sapiens
agcacctcctccg

SEQ ID NO: 613999 - DNA, 15 bp, Homo sapiens
agcacctgtcacctt

SEQ ID NO: 614000 - DNA, 16 bp, Homo sapiens
agcactagaatgagaa

SEQ ID NO: 614001 - DNA, 16 bp, Homo sapiens
agcactcccagggccc

SEQ ID NO: 614002 - DNA, 19 bp, Homo sapiens
agcactcccagggcccgag

SEQ ID NO: 614003 - DNA, 15 bp, Homo sapiens
agcagaaagccaggg

SEQ ID NO: 614004 - DNA, 21 bp, Homo sapiens
agcagaaagccagggtcctga

SEQ ID NO: 614005 - DNA, 12 bp, Homo sapiens
agcagacacaca

SEQ ID NO: 614006 - DNA, 15 bp, Homo sapiens
agcagacacacacat

SEQ ID NO: 614007 - DNA, 23 bp, Homo sapiens
agcagacattgtcagcaaattaa

SEQ ID NO: 614008 - DNA, 20 bp, Homo sapiens
agcagagaagcctgtctgta

SEQ ID NO: 614009 - DNA, 16 bp, Homo sapiens
agcagagatgtattat

SEQ ID NO: 614010 - DNA, 14 bp, Homo sapiens
agcagagcgcagcc

SEQ ID NO: 614011 - DNA, 12 bp, Homo sapiens
agttggcctctg

SEQ ID NO: 614012 - DNA, 15 bp, Homo sapiens
agttggcctctgccc

SEQ ID NO: 614013 - DNA, 16 bp, Homo sapiens
agttggcctctgcccc

SEQ ID NO: 614014 - DNA, 21 bp, Homo sapiens
agttgtaacattctatttcaa

SEQ ID NO: 614015 - DNA, 18 bp, Homo sapiens
agttgtgatctgttgtaa

SEQ ID NO: 614016 - DNA, 11 bp, Homo sapiens
agttgtgtgct

SEQ ID NO: 614017 - DNA, 23 bp, Homo sapiens
agtttaaaaatcagaaagacatt

SEQ ID NO: 614018 - DNA, 17 bp, Homo sapiens
agtttattatagtctgt

SEQ ID NO: 614019 - DNA, 20 bp, Homo sapiens
agtttattatagtctgtact

SEQ ID NO: 614020 - DNA, 21 bp, Homo sapiens
agtttattatagtctgtactt

SEQ ID NO: 614021 - DNA, 22 bp, Homo sapiens
agtttcatttttcattttctct

SEQ ID NO: 614022 - DNA, 16 bp, Homo sapiens
agtttccatttggatt

SEQ ID NO: 614023 - DNA, 17 bp, Homo sapiens
agtttccatttggattt

SEQ ID NO: 614024 - DNA, 16 bp, Homo sapiens
agtttgcttctgtaag

SEQ ID NO: 614025 - DNA, 18 bp, Homo sapiens
agtttggccctggagcca

SEQ ID NO: 614026 - DNA, 16 bp, Homo sapiens
agtttggtatgaaaca

SEQ ID NO: 614027 - DNA, 16 bp, Homo sapiens
agtttgtgaagtgatt

SEQ ID NO: 614028 - DNA, 22 bp, Homo sapiens
agtttgtgaagtgattgacatt

SEQ ID NO: 614029 - DNA, 22 bp, Homo sapiens
agttttaaaaaaataaaacatt

SEQ ID NO: 614030 - DNA, 19 bp, Homo sapiens
agtttttaaggttatttat

SEQ ID NO: 614031 - DNA, 23 bp, Homo sapiens
agtttttggtaatgatgattcaa

SEQ ID NO: 614032 - DNA, 14 bp, Homo sapiens
ataaaaaaaatagt

SEQ ID NO: 614033 - DNA, 11 bp, Homo sapiens
ataaaacattt

SEQ ID NO: 614034 - DNA, 13 bp, Homo sapiens
ataaaatacacgt

SEQ ID NO: 614035 - DNA, 15 bp, Homo sapiens
ataaaatctgtattg

SEQ ID NO: 614036 - DNA, 20 bp, Homo sapiens
ataaaatgtttatttttgct

SEQ ID NO: 614037 - DNA, 14 bp, Homo sapiens
ataaacacagtaag

SEQ ID NO: 614038 - DNA, 14 bp, Homo sapiens
ataaactgtgagat

SEQ ID NO: 614039 - DNA, 16 bp, Homo sapiens
ataaactgtgagataa

SEQ ID NO: 614040 - DNA, 14 bp, Homo sapiens
ataaagaaaccttt

SEQ ID NO: 614041 - DNA, 21 bp, Homo sapiens
ataaaggatatagcaacatct

SEQ ID NO: 614042 - DNA, 22 bp, Homo sapiens
ataaatatctatttatctgtct

SEQ ID NO: 614043 - DNA, 15 bp, Homo sapiens
ataaatattgtcctg

SEQ ID NO: 614044 - DNA, 20 bp, Homo sapiens
ataaatcacagatttccaaa

SEQ ID NO: 614045 - DNA, 19 bp, Homo sapiens
ataaattatttctaaaaca

SEQ ID NO: 614046 - DNA, 20 bp, Homo sapiens
ataaattttggaagaattca

SEQ ID NO: 614047 - DNA, 21 bp, Homo sapiens
ataaattttggaagaattcat

SEQ ID NO: 614048 - DNA, 11 bp, Homo sapiens
ataacaacaat

SEQ ID NO: 614049 - DNA, 14 bp, Homo sapiens
ataacaacaattta

SEQ ID NO: 614050 - DNA, 11 bp, Homo sapiens
ataacacacat

SEQ ID NO: 614051 - DNA, 15 bp, Homo sapiens
ataacaggcattgca

SEQ ID NO: 614052 - DNA, 21 bp, Homo sapiens
ataacaggcattgcactaaaa

SEQ ID NO: 614053 - DNA, 13 bp, Homo sapiens
ataacagtggcaa

SEQ ID NO: 614054 - DNA, 13 bp, Homo sapiens
ataactattgctg

SEQ ID NO: 614055 - DNA, 11 bp, Homo sapiens
ataagaaaaat

SEQ ID NO: 614056 - DNA, 15 bp, Homo sapiens
ataagaaaaatgctt

SEQ ID NO: 614057 - DNA, 13 bp, Homo sapiens
ataagaaacagtt

SEQ ID NO: 614058 - DNA, 18 bp, Homo sapiens
ataagaaacagtttaaca

SEQ ID NO: 614059 - DNA, 22 bp, Homo sapiens
ataagaaacagtttaacagaaa

SEQ ID NO: 614060 - DNA, 15 bp, Homo sapiens
ataagacaagtctga

SEQ ID NO: 614061 - DNA, 17 bp, Homo sapiens
ataagagacaaagtttg

SEQ ID NO: 614062 - DNA, 22 bp, Homo sapiens
ataagagacaaagtttggaagt

SEQ ID NO: 614063 - DNA, 17 bp, Homo sapiens
ataagccaaaataagac

SEQ ID NO: 614064 - DNA, 19 bp, Homo sapiens
ataagccaatttttctgca

SEQ ID NO: 614065 - DNA, 17 bp, Homo sapiens
ataagccatagccccag

SEQ ID NO: 614066 - DNA, 20 bp, Homo sapiens
ataagtaaatgtcttcatgt

SEQ ID NO: 614067 - DNA, 20 bp, Homo sapiens
ataatagatgtgaaaatgct

SEQ ID NO: 614068 - DNA, 15 bp, Homo sapiens
ataatataaatgaat

SEQ ID NO: 614069 - DNA, 14 bp, Homo sapiens
ataatatgcatata

SEQ ID NO: 614070 - DNA, 15 bp, Homo sapiens
ataatatgcatatat

SEQ ID NO: 614071 - DNA, 16 bp, Homo sapiens
ataatatgtacaaata

SEQ ID NO: 614072 - DNA, 13 bp, Homo sapiens
ataatattgcctt

SEQ ID NO: 614073 - DNA, 21 bp, Homo sapiens
ataatcatccttttttaaaaa

SEQ ID NO: 614074 - DNA, 20 bp, Homo sapiens
ataatgcttaacataaactt

SEQ ID NO: 614075 - DNA, 21 bp, Homo sapiens
ataatgcttctttcctcttaa

SEQ ID NO: 614076 - DNA, 17 bp, Homo sapiens
ataatggccctgtagct

SEQ ID NO: 614077 - DNA, 17 bp, Homo sapiens
ataatggcctcttaaaa

SEQ ID NO: 614078 - DNA, 23 bp, Homo sapiens
ataatggcctcttaaaaattatc

SEQ ID NO: 614079 - DNA, 15 bp, Homo sapiens
ataattaaatgaaat

SEQ ID NO: 614080 - DNA, 15 bp, Homo sapiens
ataattcgagcaaac

SEQ ID NO: 614081 - DNA, 12 bp, Homo sapiens
ataattgtaaag

SEQ ID NO: 614082 - DNA, 23 bp, Homo sapiens
ataattgtaaaggtgatgaattt

SEQ ID NO: 614083 - DNA, 23 bp, Homo sapiens
ataatttgccagacagagatcag

SEQ ID NO: 614084 - DNA, 17 bp, Homo sapiens
ataattttattgctgga

SEQ ID NO: 614085 - DNA, 13 bp, Homo sapiens
ataattttcattt

SEQ ID NO: 614086 - DNA, 11 bp, Homo sapiens
atacaaacagg

SEQ ID NO: 614087 - DNA, 13 bp, Homo sapiens
atacaaacaggtg

SEQ ID NO: 614088 - DNA, 20 bp, Homo sapiens
atacaaagctgtcactcaca

SEQ ID NO: 614089 - DNA, 11 bp, Homo sapiens
atacacacagg

SEQ ID NO: 614090 - DNA, 22 bp, Homo sapiens
atacacatacatatatacattt

SEQ ID NO: 614091 - DNA, 16 bp, Homo sapiens
atacaccaaatagctt

SEQ ID NO: 614092 - DNA, 16 bp, Homo sapiens
atacacgtgtatatga

SEQ ID NO: 614093 - DNA, 20 bp, Homo sapiens
atacactttacattcttgct

SEQ ID NO: 614094 - DNA, 22 bp, Homo sapiens
atacagatggtgtcctgcatgt

SEQ ID NO: 614095 - DNA, 23 bp, Homo sapiens
atacagatggtgtcctgcatgta

SEQ ID NO: 614096 - DNA, 16 bp, Homo sapiens
atacagcatttctttg

SEQ ID NO: 614097 - DNA, 15 bp, Homo sapiens
atacagtctctattt

SEQ ID NO: 614098 - DNA, 19 bp, Homo sapiens
atacagtctctatttgatt

SEQ ID NO: 614099 - DNA, 23 bp, Homo sapiens
atacagtctctatttgatttgca

SEQ ID NO: 614100 - DNA, 15 bp, Homo sapiens
atacagtgtgtagtt

SEQ ID NO: 614101 - DNA, 15 bp, Homo sapiens
atacatatatacatt

SEQ ID NO: 614102 - DNA, 16 bp, Homo sapiens
atacatatatacattt

SEQ ID NO: 614103 - DNA, 13 bp, Homo sapiens
atacatcatatgt

SEQ ID NO: 614104 - DNA, 21 bp, Homo sapiens
atacatcattttttgtttctt

SEQ ID NO: 614105 - DNA, 12 bp, Homo sapiens
ataccagcaaaa

SEQ ID NO: 614106 - DNA, 16 bp, Homo sapiens
atatgaaaactaagtt

SEQ ID NO: 614107 - DNA, 17 bp, Homo sapiens
atatgaagcagaatgag

SEQ ID NO: 614108 - DNA, 19 bp, Homo sapiens
atatgagaaatataaaaat

SEQ ID NO: 614109 - DNA, 22 bp, Homo sapiens
atatgagattggaaaaaattag

SEQ ID NO: 614110 - DNA, 14 bp, Homo sapiens
atatgaggatgtat

SEQ ID NO: 614111 - DNA, 17 bp, Homo sapiens
atatgaggatgtatgtg

SEQ ID NO: 614112 - DNA, 22 bp, Homo sapiens
atatgattctcctctcccaaat

SEQ ID NO: 614113 - DNA, 15 bp, Homo sapiens
atatgtaacttcaga

SEQ ID NO: 614114 - DNA, 22 bp, Homo sapiens
atatgtaacttcagatgtttcc

SEQ ID NO: 614115 - DNA, 23 bp, Homo sapiens
atatgtaacttcagatgtttcca

SEQ ID NO: 614116 - DNA, 16 bp, Homo sapiens
atatgtacaaataata

SEQ ID NO: 614117 - DNA, 13 bp, Homo sapiens
atatgtatatctg

SEQ ID NO: 614118 - DNA, 17 bp, Homo sapiens
atatgtatatctgtgta

SEQ ID NO: 614119 - DNA, 19 bp, Homo sapiens
atatgtatatctgtgtaag

SEQ ID NO: 614120 - DNA, 23 bp, Homo sapiens
atatgtatatctgtgtaagacac

SEQ ID NO: 614121 - DNA, 14 bp, Homo sapiens
atatgtctttaaaa

SEQ ID NO: 614122 - DNA, 15 bp, Homo sapiens
atatgttgatgaaat

SEQ ID NO: 614123 - DNA, 16 bp, Homo sapiens
atatgtttatacacac

SEQ ID NO: 614124 - DNA, 17 bp, Homo sapiens
atatgtttatacacaca

SEQ ID NO: 614125 - DNA, 19 bp, Homo sapiens
atatgtttggctgaaatta

SEQ ID NO: 614126 - DNA, 18 bp, Homo sapiens
atattaaagaaagtcata

SEQ ID NO: 614127 - DNA, 11 bp, Homo sapiens
atattatatat

SEQ ID NO: 614128 - DNA, 12 bp, Homo sapiens
atattatatata

SEQ ID NO: 614129 - DNA, 13 bp, Homo sapiens
atattatatcaga

SEQ ID NO: 614130 - DNA, 20 bp, Homo sapiens
atattatgccttgagaatga

SEQ ID NO: 614131 - DNA, 14 bp, Homo sapiens
atattattttctgg

SEQ ID NO: 614132 - DNA, 21 bp, Homo sapiens
atattattttctgtaattctt

SEQ ID NO: 614133 - DNA, 21 bp, Homo sapiens
atattccgggtgccattccca

SEQ ID NO: 614134 - DNA, 16 bp, Homo sapiens
atattctgcagaaaat

SEQ ID NO: 614135 - DNA, 15 bp, Homo sapiens
ctatcctgcaccctc

SEQ ID NO: 614136 - DNA, 21 bp, Homo sapiens
ctatcctgcaccctctgctat

SEQ ID NO: 614137 - DNA, 19 bp, Homo sapiens
ctatctcgctagccatata

SEQ ID NO: 614138 - DNA, 20 bp, Homo sapiens
ctatctggaaaaaaaaaaat

SEQ ID NO: 614139 - DNA, 22 bp, Homo sapiens
ctatctggaaaaaaaaaaatat

SEQ ID NO: 614140 - DNA, 18 bp, Homo sapiens
ctatgacactcatcaggt

SEQ ID NO: 614141 - DNA, 16 bp, Homo sapiens
ctatgatgtccaaact

SEQ ID NO: 614142 - DNA, 19 bp, Homo sapiens
ctatgattaaactgggaaa

SEQ ID NO: 614143 - DNA, 13 bp, Homo sapiens
ctatgcacaccaa

SEQ ID NO: 614144 - DNA, 16 bp, Homo sapiens
ctatgcacaccaaatt

SEQ ID NO: 614145 - DNA, 16 bp, Homo sapiens
ctatgcatatttatag

SEQ ID NO: 614146 - DNA, 17 bp, Homo sapiens
ctatgcatatttataga

SEQ ID NO: 614147 - DNA, 20 bp, Homo sapiens
ctatggaaagggtgtggctt

SEQ ID NO: 614148 - DNA, 22 bp, Homo sapiens
ctatggaaagggtgtggcttgg

SEQ ID NO: 614149 - DNA, 14 bp, Homo sapiens
ctatggacaattta

SEQ ID NO: 614150 - DNA, 16 bp, Homo sapiens
ctattaatttattaaa

SEQ ID NO: 614151 - DNA, 19 bp, Homo sapiens
ctattaatttattaaattt

SEQ ID NO: 614152 - DNA, 15 bp, Homo sapiens
ctattatctgggttt

SEQ ID NO: 614153 - DNA, 16 bp, Homo sapiens
ctattcattacatcct

SEQ ID NO: 614154 - DNA, 17 bp, Homo sapiens
ctattcgtaagttctgt

SEQ ID NO: 614155 - DNA, 20 bp, Homo sapiens
ctattcgtaagttctgtgca

SEQ ID NO: 614156 - DNA, 13 bp, Homo sapiens
ctattgctgtaaa

SEQ ID NO: 614157 - DNA, 15 bp, Homo sapiens
ctattgctgtaaata

SEQ ID NO: 614158 - DNA, 22 bp, Homo sapiens
ctattgctgtaaataaaaatag

SEQ ID NO: 614159 - DNA, 14 bp, Homo sapiens
ctattgtttatagg

SEQ ID NO: 614160 - DNA, 18 bp, Homo sapiens
ctattgtttataggaaat

SEQ ID NO: 614161 - DNA, 11 bp, Homo sapiens
ctatttaagtg

SEQ ID NO: 614162 - DNA, 12 bp, Homo sapiens
ctatttgatttg

SEQ ID NO: 614163 - DNA, 12 bp, Homo sapiens
ctatttgtttca

SEQ ID NO: 614164 - DNA, 15 bp, Homo sapiens
ctattttgcagcagt

SEQ ID NO: 614165 - DNA, 14 bp, Homo sapiens
ctcaaaagatctcc

SEQ ID NO: 614166 - DNA, 17 bp, Homo sapiens
ctcaaatctgctttcat

SEQ ID NO: 614167 - DNA, 18 bp, Homo sapiens
ctcaaatctgctttcatc

SEQ ID NO: 614168 - DNA, 12 bp, Homo sapiens
ctcaacctctca

SEQ ID NO: 614169 - DNA, 14 bp, Homo sapiens
ctcaacctctcaga

SEQ ID NO: 614170 - DNA, 19 bp, Homo sapiens
ctcaagatcctgtcttgct

SEQ ID NO: 614171 - DNA, 15 bp, Homo sapiens
ctcaagccaggagac

SEQ ID NO: 614172 - DNA, 12 bp, Homo sapiens
ctcaaggctgca

SEQ ID NO: 614173 - DNA, 18 bp, Homo sapiens
ctcaataaggcagtgcag

SEQ ID NO: 614174 - DNA, 17 bp, Homo sapiens
ctcaattatcttggaaa

SEQ ID NO: 614175 - DNA, 18 bp, Homo sapiens
ctcaattttggtttttct

SEQ ID NO: 614176 - DNA, 17 bp, Homo sapiens
ctcacaccggcactgtg

SEQ ID NO: 614177 - DNA, 20 bp, Homo sapiens
ctcacaccggcactgtgcac

SEQ ID NO: 614178 - DNA, 22 bp, Homo sapiens
ctcacaccggcactgtgcactc

SEQ ID NO: 614179 - DNA, 17 bp, Homo sapiens
ctcacacctcccttcat

SEQ ID NO: 614180 - DNA, 16 bp, Homo sapiens
ctcacacttgggctgg

SEQ ID NO: 614181 - DNA, 13 bp, Homo sapiens
ctcacagcacatt

SEQ ID NO: 614182 - DNA, 16 bp, Homo sapiens
ctcacagcacatttgt

SEQ ID NO: 614183 - DNA, 15 bp, Homo sapiens
ctcacagcctctccc

SEQ ID NO: 614184 - DNA, 17 bp, Homo sapiens
ctcaccaggaaattctg

SEQ ID NO: 614185 - DNA, 21 bp, Homo sapiens
ctcaccatttaatcatttcca

SEQ ID NO: 614186 - DNA, 14 bp, Homo sapiens
ctcacctctgagga

SEQ ID NO: 614187 - DNA, 19 bp, Homo sapiens
ctcaccttccctagttctt

SEQ ID NO: 614188 - DNA, 14 bp, Homo sapiens
ctcaccttctgttt

SEQ ID NO: 614189 - DNA, 15 bp, Homo sapiens
ctcaccttctgtttt

SEQ ID NO: 614190 - DNA, 14 bp, Homo sapiens
ctcacgtctgtgag

SEQ ID NO: 614191 - DNA, 18 bp, Homo sapiens
ctcactacatgggccagc

SEQ ID NO: 614192 - DNA, 14 bp, Homo sapiens
ctcactccactccc

SEQ ID NO: 614193 - DNA, 19 bp, Homo sapiens
ctcactgacttctcccggg

SEQ ID NO: 614194 - DNA, 15 bp, Homo sapiens
ctcactgatatattt

SEQ ID NO: 614195 - DNA, 15 bp, Homo sapiens
ctcactgggtgtggc

SEQ ID NO: 614196 - DNA, 16 bp, Homo sapiens
ctcctccatgctgtcc

SEQ ID NO: 614197 - DNA, 12 bp, Homo sapiens
ctcctccattca

SEQ ID NO: 614198 - DNA, 14 bp, Homo sapiens
ctcctcccatggcc

SEQ ID NO: 614199 - DNA, 22 bp, Homo sapiens
ctcctccccctcctccatgctg

SEQ ID NO: 614200 - DNA, 16 bp, Homo sapiens
ctcctccgtgggcagc

SEQ ID NO: 614201 - DNA, 15 bp, Homo sapiens
ctcctcctgcatgtc

SEQ ID NO: 614202 - DNA, 23 bp, Homo sapiens
ctcctcgggcgcctgcgctcctc

SEQ ID NO: 614203 - DNA, 15 bp, Homo sapiens
ctcctcgtccggcct

SEQ ID NO: 614204 - DNA, 18 bp, Homo sapiens
ctcctcgtccggcctgca

SEQ ID NO: 614205 - DNA, 19 bp, Homo sapiens
ctcctcgtccggcctgcag

SEQ ID NO: 614206 - DNA, 22 bp, Homo sapiens
ctcctcgtccggcctgcagccc

SEQ ID NO: 614207 - DNA, 13 bp, Homo sapiens
ctcctctcccaaa

SEQ ID NO: 614208 - DNA, 16 bp, Homo sapiens
ctcctctctctccctc

SEQ ID NO: 614209 - DNA, 20 bp, Homo sapiens
ctcctctctctccctccact

SEQ ID NO: 614210 - DNA, 18 bp, Homo sapiens
ctcctctgcagcctgagc

SEQ ID NO: 614211 - DNA, 20 bp, Homo sapiens
ctcctctgcagcctgagctc

SEQ ID NO: 614212 - DNA, 18 bp, Homo sapiens
ctcctctgccccctcccc

SEQ ID NO: 614213 - DNA, 15 bp, Homo sapiens
ctcctgagcctgtct

SEQ ID NO: 614214 - DNA, 16 bp, Homo sapiens
ctcctgtccagcaggt

SEQ ID NO: 614215 - DNA, 20 bp, Homo sapiens
ctcctgttttcacaccttac

SEQ ID NO: 614216 - DNA, 16 bp, Homo sapiens
ctccttaaaaatgtat

SEQ ID NO: 614217 - DNA, 15 bp, Homo sapiens
ctccttctcccctcc

SEQ ID NO: 614218 - DNA, 16 bp, Homo sapiens
ctccttctcccctcca

SEQ ID NO: 614219 - DNA, 20 bp, Homo sapiens
ctccttctcccctccagacc

SEQ ID NO: 614220 - DNA, 19 bp, Homo sapiens
ctccttgaaaccagctcag

SEQ ID NO: 614221 - DNA, 20 bp, Homo sapiens
ctccttgaaaccagctcagg

SEQ ID NO: 614222 - DNA, 13 bp, Homo sapiens
ctcctttctaagg

SEQ ID NO: 614223 - DNA, 23 bp, Homo sapiens
ctcctttctaaggagcactagaa

SEQ ID NO: 614224 - DNA, 16 bp, Homo sapiens
ctcctttgtcaaatgg

SEQ ID NO: 614225 - DNA, 17 bp, Homo sapiens
ctcctttttctaccttt

SEQ ID NO: 614226 - DNA, 18 bp, Homo sapiens
ctcgagagggctgagccc

SEQ ID NO: 614227 - DNA, 19 bp, Homo sapiens
ctcgagagggctgagcccc

SEQ ID NO: 614228 - DNA, 22 bp, Homo sapiens
ctcgagagggctgagcccctcc

SEQ ID NO: 614229 - DNA, 18 bp, Homo sapiens
ctcgcagcctgaagcctg

SEQ ID NO: 614230 - DNA, 20 bp, Homo sapiens
ctcgcagcctgaagcctgga

SEQ ID NO: 614231 - DNA, 23 bp, Homo sapiens
ctcgccccagccaagcctgactt

SEQ ID NO: 614232 - DNA, 16 bp, Homo sapiens
ctcgcccccgggccct

SEQ ID NO: 614233 - DNA, 15 bp, Homo sapiens
ctcgccctgtgccct

SEQ ID NO: 614234 - DNA, 13 bp, Homo sapiens
ctcgcgacaatgc

SEQ ID NO: 614235 - DNA, 22 bp, Homo sapiens
ctcggctgtgtggggagggtgg

SEQ ID NO: 614236 - DNA, 13 bp, Homo sapiens
ctcgggaaggcct

SEQ ID NO: 614237 - DNA, 17 bp, Homo sapiens
ctcgggaaggcctgagg

SEQ ID NO: 614238 - DNA, 20 bp, Homo sapiens
ctcgggcgcctgcgctcctc

SEQ ID NO: 614239 - DNA, 23 bp, Homo sapiens
ctcgggctggtgtcttgagacca

SEQ ID NO: 614240 - DNA, 16 bp, Homo sapiens
ctcgggtggggcctgc

SEQ ID NO: 614241 - DNA, 13 bp, Homo sapiens
ctcgtccggcctg

SEQ ID NO: 614242 - DNA, 15 bp, Homo sapiens
ctcgtccggcctgca

SEQ ID NO: 614243 - DNA, 16 bp, Homo sapiens
ctcgtccggcctgcag

SEQ ID NO: 614244 - DNA, 20 bp, Homo sapiens
ctcgtccggcctgcagccca

SEQ ID NO: 614245 - DNA, 11 bp, Homo sapiens
ctctaatttcc

SEQ ID NO: 614246 - DNA, 15 bp, Homo sapiens
ctctacaaaaaaaat

SEQ ID NO: 614247 - DNA, 16 bp, Homo sapiens
ctctatccctggccac

SEQ ID NO: 614248 - DNA, 23 bp, Homo sapiens
ctctatccctggccacctgccag

SEQ ID NO: 614249 - DNA, 17 bp, Homo sapiens
ctctatttgatttgcaa

SEQ ID NO: 614250 - DNA, 18 bp, Homo sapiens
ctctcagatccctcggtc

SEQ ID NO: 614251 - DNA, 12 bp, Homo sapiens
ctctcattccca

SEQ ID NO: 614252 - DNA, 14 bp, Homo sapiens
ctctcattcccagg

SEQ ID NO: 614253 - DNA, 20 bp, Homo sapiens
ctctccctaccctcttctca

SEQ ID NO: 614254 - DNA, 22 bp, Homo sapiens
ctctccctaccctcttctcagc

SEQ ID NO: 614255 - DNA, 20 bp, Homo sapiens
ctctccctccactcctccca

SEQ ID NO: 614256 - DNA, 21 bp, Homo sapiens
ctctccgcccacgcggctgct

SEQ ID NO: 614257 - DNA, 12 bp, Homo sapiens
ctctcctcgtcc

SEQ ID NO: 614258 - DNA, 22 bp, Homo sapiens
ctctcctcgtccggcctgcagc

SEQ ID NO: 614259 - DNA, 15 bp, Homo sapiens
ctgagcccctcctct

SEQ ID NO: 614260 - DNA, 19 bp, Homo sapiens
ctgagcctgtctctcccta

SEQ ID NO: 614261 - DNA, 15 bp, Homo sapiens
ctgagctccaccctc

SEQ ID NO: 614262 - DNA, 20 bp, Homo sapiens
ctgagctgggcaccacaggc

SEQ ID NO: 614263 - DNA, 22 bp, Homo sapiens
ctgagcttgattctaaagggga

SEQ ID NO: 614264 - DNA, 13 bp, Homo sapiens
ctgaggacggggc

SEQ ID NO: 614265 - DNA, 19 bp, Homo sapiens
ctgaggacggggcagagct

SEQ ID NO: 614266 - DNA, 20 bp, Homo sapiens
ctgaggacggggcagagctg

SEQ ID NO: 614267 - DNA, 21 bp, Homo sapiens
ctgaggacggggcagagctga

SEQ ID NO: 614268 - DNA, 19 bp, Homo sapiens
ctgagggggctctttccct

SEQ ID NO: 614269 - DNA, 15 bp, Homo sapiens
ctgaggttaagggga

SEQ ID NO: 614270 - DNA, 16 bp, Homo sapiens
ctgagtcggctgggca

SEQ ID NO: 614271 - DNA, 19 bp, Homo sapiens
ctgagtcggctgggcaggg

SEQ ID NO: 614272 - DNA, 17 bp, Homo sapiens
ctgataaagaaaccttt

SEQ ID NO: 614273 - DNA, 13 bp, Homo sapiens
ctgatacatctgt

SEQ ID NO: 614274 - DNA, 20 bp, Homo sapiens
ctgatacatctgtcagtgag

SEQ ID NO: 614275 - DNA, 22 bp, Homo sapiens
ctgatagaagaaggactgaaga

SEQ ID NO: 614276 - DNA, 24 bp, Homo sapiens
ctgatagaagaaggactgaagaaa

SEQ ID NO: 614277 - DNA, 16 bp, Homo sapiens
ctgatatattttccag

SEQ ID NO: 614278 - DNA, 20 bp, Homo sapiens
ctgatatcacgggcccgctc

SEQ ID NO: 614279 - DNA, 22 bp, Homo sapiens
ctgatatctgtttgcttctaaa

SEQ ID NO: 614280 - DNA, 13 bp, Homo sapiens
ctgatcctctctt

SEQ ID NO: 614281 - DNA, 19 bp, Homo sapiens
ctgatgaagttaagcacaa

SEQ ID NO: 614282 - DNA, 15 bp, Homo sapiens
ctgatgatgttctga

SEQ ID NO: 614283 - DNA, 16 bp, Homo sapiens
ctgatgggtcctgctg

SEQ ID NO: 614284 - DNA, 19 bp, Homo sapiens
ctgattattacaacaagca

SEQ ID NO: 614285 - DNA, 23 bp, Homo sapiens
ctgattattacaacaagcaaact

SEQ ID NO: 614286 - DNA, 14 bp, Homo sapiens
ctgatttattctgg

SEQ ID NO: 614287 - DNA, 23 bp, Homo sapiens
ctgatttttttttccttcagtgc

SEQ ID NO: 614288 - DNA, 12 bp, Homo sapiens
ctgcaataacag

SEQ ID NO: 614289 - DNA, 13 bp, Homo sapiens
ctgcaatgtctgt

SEQ ID NO: 614290 - DNA, 15 bp, Homo sapiens
ctgcacacataacac

SEQ ID NO: 614291 - DNA, 12 bp, Homo sapiens
ctgcaccctcca

SEQ ID NO: 614292 - DNA, 20 bp, Homo sapiens
ctgcaccctccacaggagcc

SEQ ID NO: 614293 - DNA, 23 bp, Homo sapiens
ctgcaccctctgctatgtctgtg

SEQ ID NO: 614294 - DNA, 18 bp, Homo sapiens
ctgcacctgcttctcagc

SEQ ID NO: 614295 - DNA, 14 bp, Homo sapiens
ctgcaccttgggca

SEQ ID NO: 614296 - DNA, 15 bp, Homo sapiens
ctgcaccttgggcac

SEQ ID NO: 614297 - DNA, 23 bp, Homo sapiens
ctgcaccttgggcacgggagagc

SEQ ID NO: 614298 - DNA, 14 bp, Homo sapiens
ctgcacgcccagga

SEQ ID NO: 614299 - DNA, 15 bp, Homo sapiens
ctgcactgccctccg

SEQ ID NO: 614300 - DNA, 18 bp, Homo sapiens
ctgcagaccacactctgc

SEQ ID NO: 614301 - DNA, 14 bp, Homo sapiens
ctgcagagaccttg

SEQ ID NO: 614302 - DNA, 14 bp, Homo sapiens
ctgcagcctgagct

SEQ ID NO: 614303 - DNA, 22 bp, Homo sapiens
ctgcagcctgagctccaccctc

SEQ ID NO: 614304 - DNA, 23 bp, Homo sapiens
ctgcagcctgagctccaccctcc

SEQ ID NO: 614305 - DNA, 15 bp, Homo sapiens
ctgcagctaatttgt

SEQ ID NO: 614306 - DNA, 19 bp, Homo sapiens
ctgcagctaatttgtgaaa

SEQ ID NO: 614307 - DNA, 20 bp, Homo sapiens
ctgcagctaatttgtgaaag

SEQ ID NO: 614308 - DNA, 23 bp, Homo sapiens
ctgcagctaatttgtgaaagtgg

SEQ ID NO: 614309 - DNA, 20 bp, Homo sapiens
ctgcaggaatcaaaaattga

SEQ ID NO: 614310 - DNA, 14 bp, Homo sapiens
ctgcagtattctgt

SEQ ID NO: 614311 - DNA, 15 bp, Homo sapiens
ctgcagtattctgta

SEQ ID NO: 614312 - DNA, 13 bp, Homo sapiens
ctgcagtcagcac

SEQ ID NO: 614313 - DNA, 16 bp, Homo sapiens
ctgcagtcagcacaga

SEQ ID NO: 614314 - DNA, 17 bp, Homo sapiens
ctgcagtcagcacagag

SEQ ID NO: 614315 - DNA, 17 bp, Homo sapiens
ctgcagttagcacagag

SEQ ID NO: 614316 - DNA, 20 bp, Homo sapiens
ctgcagttagcacagaggat

SEQ ID NO: 614317 - DNA, 21 bp, Homo sapiens
ctgcagttatttaccagaagt

SEQ ID NO: 614318 - DNA, 22 bp, Homo sapiens
ctgcagttatttaccagaagtt

SEQ ID NO: 614319 - DNA, 15 bp, Homo sapiens
ctgcagtttggccct

SEQ ID NO: 614320 - DNA, 16 bp, Homo sapiens
ctgcagtttggccctg

SEQ ID NO: 614321 - DNA, 21 bp, Homo sapiens
ctgcagtttggccctggagcc

SEQ ID NO: 614322 - DNA, 18 bp, Homo sapiens
ctgcatcccttggcccct

SEQ ID NO: 614323 - DNA, 20 bp, Homo sapiens
ctgcatcccttggcccctct

SEQ ID NO: 614324 - DNA, 13 bp, Homo sapiens
ctgcatggagaag

SEQ ID NO: 614325 - DNA, 20 bp, Homo sapiens
ctgcatgtatgccatgtatg

SEQ ID NO: 614326 - DNA, 20 bp, Homo sapiens
ctgcatgtcggggcccctgc

SEQ ID NO: 614327 - DNA, 21 bp, Homo sapiens
ctgcatgtcggggcccctgcg

SEQ ID NO: 614328 - DNA, 13 bp, Homo sapiens
ctgccaagagtcc

SEQ ID NO: 614329 - DNA, 14 bp, Homo sapiens
ctgccaggccctcc

SEQ ID NO: 614330 - DNA, 15 bp, Homo sapiens
ctgccaggccctcca

SEQ ID NO: 614331 - DNA, 17 bp, Homo sapiens
ctgccaggcctccctcg

SEQ ID NO: 614332 - DNA, 12 bp, Homo sapiens
ctgccagtgttt

SEQ ID NO: 614333 - DNA, 15 bp, Homo sapiens
ctgccatccttgctg

SEQ ID NO: 614334 - DNA, 18 bp, Homo sapiens
ctgcccaaagccatcttc

SEQ ID NO: 614335 - DNA, 20 bp, Homo sapiens
ctgcccacatttgggctcag

SEQ ID NO: 614336 - DNA, 13 bp, Homo sapiens
ctgcccaccctgg

SEQ ID NO: 614337 - DNA, 23 bp, Homo sapiens
ctgcccaccctgggcctcccgtc

SEQ ID NO: 614338 - DNA, 14 bp, Homo sapiens
ctgcccagttagcc

SEQ ID NO: 614339 - DNA, 16 bp, Homo sapiens
ctgccccatctcctcc

SEQ ID NO: 614340 - DNA, 14 bp, Homo sapiens
ctgccccccttccc

SEQ ID NO: 614341 - DNA, 15 bp, Homo sapiens
ctgccccccttccca

SEQ ID NO: 614342 - DNA, 12 bp, Homo sapiens
ctgccccctccc

SEQ ID NO: 614343 - DNA, 16 bp, Homo sapiens
ctgccccctcccccgc

SEQ ID NO: 614344 - DNA, 21 bp, Homo sapiens
ctgccccctcccccgcagaca

SEQ ID NO: 614345 - DNA, 18 bp, Homo sapiens
ctgcccctccgtccccag

SEQ ID NO: 614346 - DNA, 19 bp, Homo sapiens
ctgcccctccgtccccagg

SEQ ID NO: 614347 - DNA, 15 bp, Homo sapiens
ctgcccgcgcccgcc

SEQ ID NO: 614348 - DNA, 17 bp, Homo sapiens
ctgcccgcgcccgccgc

SEQ ID NO: 614349 - DNA, 15 bp, Homo sapiens
ctgccctcccccacg

SEQ ID NO: 614350 - DNA, 21 bp, Homo sapiens
ctgccctcccccacggccgtc

SEQ ID NO: 614351 - DNA, 19 bp, Homo sapiens
ctgccctcttaagatctga

SEQ ID NO: 614352 - DNA, 19 bp, Homo sapiens
ctgccctgcaccttgggca

SEQ ID NO: 614353 - DNA, 16 bp, Homo sapiens
ctgccctgcctgagga

SEQ ID NO: 614354 - DNA, 17 bp, Homo sapiens
ctgccctgcctgaggag

SEQ ID NO: 614355 - DNA, 20 bp, Homo sapiens
ctgccgcatctgcctggagc

SEQ ID NO: 614356 - DNA, 21 bp, Homo sapiens
ctgccgcatctgcctggagcc

SEQ ID NO: 614357 - DNA, 12 bp, Homo sapiens
ctgcctcactgt

SEQ ID NO: 614358 - DNA, 22 bp, Homo sapiens
ctgcctcactgtgacctgctcc

SEQ ID NO: 614359 - DNA, 20 bp, Homo sapiens
ctgcctcagccagtggcaca

SEQ ID NO: 614360 - DNA, 22 bp, Homo sapiens
ctgcctcagccagtggcacagg

SEQ ID NO: 614361 - DNA, 23 bp, Homo sapiens
ctgcctcagccagtggcacagga

SEQ ID NO: 614362 - DNA, 22 bp, Homo sapiens
ctgcctccctggggaccaggag

SEQ ID NO: 614363 - DNA, 16 bp, Homo sapiens
ctgcctctatccctgg

SEQ ID NO: 614364 - DNA, 18 bp, Homo sapiens
ctgcctctatccctggcc

SEQ ID NO: 614365 - DNA, 22 bp, Homo sapiens
ctgcctctatccctggccacct

SEQ ID NO: 614366 - DNA, 11 bp, Homo sapiens
ctgcctgagga

SEQ ID NO: 614367 - DNA, 20 bp, Homo sapiens
ctgcctgaggaggaggacac

SEQ ID NO: 614368 - DNA, 21 bp, Homo sapiens
ctgcctgaggaggaggacaca

SEQ ID NO: 614369 - DNA, 22 bp, Homo sapiens
ctgcctgaggaggaggacacag

SEQ ID NO: 614370 - DNA, 14 bp, Homo sapiens
ctgcctggagcctg

SEQ ID NO: 614371 - DNA, 21 bp, Homo sapiens
ctgcctggagcctgggcagca

SEQ ID NO: 614372 - DNA, 15 bp, Homo sapiens
ctgcctggcgggcag

SEQ ID NO: 614373 - DNA, 21 bp, Homo sapiens
ctgcctggcgggcagcccctg

SEQ ID NO: 614374 - DNA, 22 bp, Homo sapiens
ctgcctggcgggcagcccctgc

SEQ ID NO: 614375 - DNA, 13 bp, Homo sapiens
ctgcgcaccccgt

SEQ ID NO: 614376 - DNA, 12 bp, Homo sapiens
ctgcgccccagc

SEQ ID NO: 614377 - DNA, 21 bp, Homo sapiens
acacgaatattgctgatggtg

SEQ ID NO: 614378 - DNA, 18 bp, Homo sapiens
acacgccggggctggccc

SEQ ID NO: 614379 - DNA, 19 bp, Homo sapiens
acacgccggggctggccct

SEQ ID NO: 614380 - DNA, 21 bp, Homo sapiens
acacgccggggctggccctgc

SEQ ID NO: 614381 - DNA, 22 bp, Homo sapiens
acacgccggggctggccctgcc

SEQ ID NO: 614382 - DNA, 14 bp, Homo sapiens
acacgtgtatatga

SEQ ID NO: 614383 - DNA, 14 bp, Homo sapiens
acactcaccattta

SEQ ID NO: 614384 - DNA, 14 bp, Homo sapiens
acactcagcagccc

SEQ ID NO: 614385 - DNA, 17 bp, Homo sapiens
acactgatgggtcctgc

SEQ ID NO: 614386 - DNA, 23 bp, Homo sapiens
acactgatgggtcctgctgctcg

SEQ ID NO: 614387 - DNA, 18 bp, Homo sapiens
acactgcaccctccacag

SEQ ID NO: 614388 - DNA, 13 bp, Homo sapiens
acactgtcaagat

SEQ ID NO: 614389 - DNA, 18 bp, Homo sapiens
acactgtctgctgcccca

SEQ ID NO: 614390 - DNA, 14 bp, Homo sapiens
acacttctccttaa

SEQ ID NO: 614391 - DNA, 16 bp, Homo sapiens
acacttctccttaacc

SEQ ID NO: 614392 - DNA, 18 bp, Homo sapiens
acacttgggctggcaccc

SEQ ID NO: 614393 - DNA, 15 bp, Homo sapiens
acactttacattctt

SEQ ID NO: 614394 - DNA, 13 bp, Homo sapiens
acagaaaaacaaa

SEQ ID NO: 614395 - DNA, 15 bp, Homo sapiens
acagaaaaacaaaaa

SEQ ID NO: 614396 - DNA, 23 bp, Homo sapiens
acagaaacacggagtttccattt

SEQ ID NO: 614397 - DNA, 14 bp, Homo sapiens
acagaaatctctca

SEQ ID NO: 614398 - DNA, 21 bp, Homo sapiens
acagaaccaacgggtctgtgg

SEQ ID NO: 614399 - DNA, 22 bp, Homo sapiens
acagaaccagcactcccagggc

SEQ ID NO: 614400 - DNA, 18 bp, Homo sapiens
acagaaggcccgaggagg

SEQ ID NO: 614401 - DNA, 20 bp, Homo sapiens
acagaaggcccgaggaggcc

SEQ ID NO: 614402 - DNA, 23 bp, Homo sapiens
acagaagggagtgaaaacctctt

SEQ ID NO: 614403 - DNA, 22 bp, Homo sapiens
acagaagtggaaggataatgag

SEQ ID NO: 614404 - DNA, 22 bp, Homo sapiens
acagaattgggcccttagaatg

SEQ ID NO: 614405 - DNA, 23 bp, Homo sapiens
acagaattgggcccttagaatgt

SEQ ID NO: 614406 - DNA, 11 bp, Homo sapiens
acagacacaca

SEQ ID NO: 614407 - DNA, 23 bp, Homo sapiens
acagacggacgggacagcggccc

SEQ ID NO: 614408 - DNA, 13 bp, Homo sapiens
acagactgcctta

SEQ ID NO: 614409 - DNA, 19 bp, Homo sapiens
acagaggtttcattttcat

SEQ ID NO: 614410 - DNA, 13 bp, Homo sapiens
acagagtgccctg

SEQ ID NO: 614411 - DNA, 15 bp, Homo sapiens
acagagtggatctgg

SEQ ID NO: 614412 - DNA, 21 bp, Homo sapiens
acagatcctccgcggaggccc

SEQ ID NO: 614413 - DNA, 14 bp, Homo sapiens
acagatcttgagca

SEQ ID NO: 614414 - DNA, 17 bp, Homo sapiens
acagatcttgagcaagg

SEQ ID NO: 614415 - DNA, 13 bp, Homo sapiens
acagattatttgt

SEQ ID NO: 614416 - DNA, 16 bp, Homo sapiens
acagatttccaaaagt

SEQ ID NO: 614417 - DNA, 12 bp, Homo sapiens
acagcaaacaca

SEQ ID NO: 614418 - DNA, 13 bp, Homo sapiens
acagcaaacacag

SEQ ID NO: 614419 - DNA, 14 bp, Homo sapiens
acagcacaagggca

SEQ ID NO: 614420 - DNA, 15 bp, Homo sapiens
acagcacatttgtta

SEQ ID NO: 614421 - DNA, 16 bp, Homo sapiens
acagcacatttgttaa

SEQ ID NO: 614422 - DNA, 18 bp, Homo sapiens
acagcacatttgttaatg

SEQ ID NO: 614423 - DNA, 13 bp, Homo sapiens
acagcatgcattt

SEQ ID NO: 614424 - DNA, 14 bp, Homo sapiens
acagcatgcattta

SEQ ID NO: 614425 - DNA, 18 bp, Homo sapiens
acagcatttcagctgtga

SEQ ID NO: 614426 - DNA, 22 bp, Homo sapiens
acagccatacttccagcgaaat

SEQ ID NO: 614427 - DNA, 22 bp, Homo sapiens
acagcctttgcgctctgggttt

SEQ ID NO: 614428 - DNA, 13 bp, Homo sapiens
acagcggccccgc

SEQ ID NO: 614429 - DNA, 14 bp, Homo sapiens
acagcggcccggcc

SEQ ID NO: 614430 - DNA, 16 bp, Homo sapiens
acagcggcccggccca

SEQ ID NO: 614431 - DNA, 13 bp, Homo sapiens
acagctgggcagg

SEQ ID NO: 614432 - DNA, 16 bp, Homo sapiens
acagctgggcagggtg

SEQ ID NO: 614433 - DNA, 18 bp, Homo sapiens
acaggcaccatgctgggc

SEQ ID NO: 614434 - DNA, 18 bp, Homo sapiens
acaggcagttaggtgctg

SEQ ID NO: 614435 - DNA, 18 bp, Homo sapiens
acaggcattgcactaaaa

SEQ ID NO: 614436 - DNA, 17 bp, Homo sapiens
acagggacacagtctgg

SEQ ID NO: 614437 - DNA, 20 bp, Homo sapiens
acagggagggaacagacctc

SEQ ID NO: 614438 - DNA, 15 bp, Homo sapiens
acagggcgtcctctc

SEQ ID NO: 614439 - DNA, 14 bp, Homo sapiens
acaggggaggctga

SEQ ID NO: 614440 - DNA, 16 bp, Homo sapiens
acaggggaggctgaga

SEQ ID NO: 614441 - DNA, 13 bp, Homo sapiens
acagggtggggct

SEQ ID NO: 614442 - DNA, 17 bp, Homo sapiens
acagggtggggcttaga

SEQ ID NO: 614443 - DNA, 16 bp, Homo sapiens
acaggtgccccacctc

SEQ ID NO: 614444 - DNA, 17 bp, Homo sapiens
acaggttttatgagact

SEQ ID NO: 614445 - DNA, 18 bp, Homo sapiens
acagtaaatatacacttt

SEQ ID NO: 614446 - DNA, 22 bp, Homo sapiens
acagtaaatatacactttacat

SEQ ID NO: 614447 - DNA, 22 bp, Homo sapiens
acagtaagataggttctgcttt

SEQ ID NO: 614448 - DNA, 16 bp, Homo sapiens
acagtattgttcttgt

SEQ ID NO: 614449 - DNA, 22 bp, Homo sapiens
acagtattgttcttgtaaaact

SEQ ID NO: 614450 - DNA, 17 bp, Homo sapiens
cccaggacgcatgcagg

SEQ ID NO: 614451 - DNA, 19 bp, Homo sapiens
cccaggaggacctgggggg

SEQ ID NO: 614452 - DNA, 23 bp, Homo sapiens
cccaggatgaaggggccagacca

SEQ ID NO: 614453 - DNA, 17 bp, Homo sapiens
cccaggatgcatgcagg

SEQ ID NO: 614454 - DNA, 13 bp, Homo sapiens
cccaggcactctc

SEQ ID NO: 614455 - DNA, 14 bp, Homo sapiens
cccaggcccagcct

SEQ ID NO: 614456 - DNA, 15 bp, Homo sapiens
cccaggcccagcctc

SEQ ID NO: 614457 - DNA, 17 bp, Homo sapiens
cccaggcccagcctctt

SEQ ID NO: 614458 - DNA, 12 bp, Homo sapiens
cccaggcccgcc

SEQ ID NO: 614459 - DNA, 20 bp, Homo sapiens
cccaggcccgccctgcccgc

SEQ ID NO: 614460 - DNA, 23 bp, Homo sapiens
cccaggcggaggggcttggagca

SEQ ID NO: 614461 - DNA, 21 bp, Homo sapiens
cccaggctgcgcctgcccgcc

SEQ ID NO: 614462 - DNA, 11 bp, Homo sapiens
cccagggaggt

SEQ ID NO: 614463 - DNA, 17 bp, Homo sapiens
cccagggaggtggcagg

SEQ ID NO: 614464 - DNA, 19 bp, Homo sapiens
cccagggaggtggcaggga

SEQ ID NO: 614465 - DNA, 13 bp, Homo sapiens
cccagggcccgag

SEQ ID NO: 614466 - DNA, 15 bp, Homo sapiens
cccaggtattgtctt

SEQ ID NO: 614467 - DNA, 16 bp, Homo sapiens
cccagtccgccccgtg

SEQ ID NO: 614468 - DNA, 16 bp, Homo sapiens
cccagtcttgagtggg

SEQ ID NO: 614469 - DNA, 13 bp, Homo sapiens
cccagtggtgcgg

SEQ ID NO: 614470 - DNA, 16 bp, Homo sapiens
cccatcccctgcctct

SEQ ID NO: 614471 - DNA, 22 bp, Homo sapiens
cccatcgcctgggacgcccctt

SEQ ID NO: 614472 - DNA, 17 bp, Homo sapiens
cccatgcaggcagcctg

SEQ ID NO: 614473 - DNA, 18 bp, Homo sapiens
cccatgcaggcagcctgc

SEQ ID NO: 614474 - DNA, 14 bp, Homo sapiens
cccatgccaatgtc

SEQ ID NO: 614475 - DNA, 16 bp, Homo sapiens
cccatgccaatgtcca

SEQ ID NO: 614476 - DNA, 14 bp, Homo sapiens
cccatggccccagc

SEQ ID NO: 614477 - DNA, 18 bp, Homo sapiens
cccatggccccagctggc

SEQ ID NO: 614478 - DNA, 14 bp, Homo sapiens
cccatggtgcagtg

SEQ ID NO: 614479 - DNA, 15 bp, Homo sapiens
cccattcagtgacat

SEQ ID NO: 614480 - DNA, 19 bp, Homo sapiens
cccattgtgaatgttgtcc

SEQ ID NO: 614481 - DNA, 22 bp, Homo sapiens
cccattgtgaatgttgtcctgt

SEQ ID NO: 614482 - DNA, 18 bp, Homo sapiens
ccccaaattgccttcagc

SEQ ID NO: 614483 - DNA, 21 bp, Homo sapiens
ccccacaaggcccagccctgg

SEQ ID NO: 614484 - DNA, 20 bp, Homo sapiens
ccccacacgccggggctggc

SEQ ID NO: 614485 - DNA, 20 bp, Homo sapiens
ccccacaggagcgtgtccta

SEQ ID NO: 614486 - DNA, 17 bp, Homo sapiens
ccccaccacacacaccc

SEQ ID NO: 614487 - DNA, 13 bp, Homo sapiens
ccccaccccactc

SEQ ID NO: 614488 - DNA, 16 bp, Homo sapiens
ccccacggccgtccct

SEQ ID NO: 614489 - DNA, 18 bp, Homo sapiens
ccccacggccgtccctga

SEQ ID NO: 614490 - DNA, 11 bp, Homo sapiens
ccccactggaa

SEQ ID NO: 614491 - DNA, 16 bp, Homo sapiens
ccccagagactgccca

SEQ ID NO: 614492 - DNA, 18 bp, Homo sapiens
ccccagagactgcccacc

SEQ ID NO: 614493 - DNA, 22 bp, Homo sapiens
ccccagagactgcccaccctgg

SEQ ID NO: 614494 - DNA, 15 bp, Homo sapiens
ccccagagccactac

SEQ ID NO: 614495 - DNA, 15 bp, Homo sapiens
ccccagccaagcctg

SEQ ID NO: 614496 - DNA, 22 bp, Homo sapiens
ccccagctggctgggtcgcccc

SEQ ID NO: 614497 - DNA, 19 bp, Homo sapiens
ccccaggatgcatgcaggg

SEQ ID NO: 614498 - DNA, 14 bp, Homo sapiens
ccccaggcccgccc

SEQ ID NO: 614499 - DNA, 19 bp, Homo sapiens
ccccaggcggaggggcttg

SEQ ID NO: 614500 - DNA, 23 bp, Homo sapiens
ccccaggcggaggggcttggagc

SEQ ID NO: 614501 - DNA, 19 bp, Homo sapiens
ccccagggtcccctgcatg

SEQ ID NO: 614502 - DNA, 21 bp, Homo sapiens
ccccagggtcccctgcatggc

SEQ ID NO: 614503 - DNA, 15 bp, Homo sapiens
ccccagggtgcaggc

SEQ ID NO: 614504 - DNA, 16 bp, Homo sapiens
ccccaggtattgtctt

SEQ ID NO: 614505 - DNA, 12 bp, Homo sapiens
ccccagtggtgc

SEQ ID NO: 614506 - DNA, 14 bp, Homo sapiens
ccccatcagaggct

SEQ ID NO: 614507 - DNA, 13 bp, Homo sapiens
ccccatccttccc

SEQ ID NO: 614508 - DNA, 20 bp, Homo sapiens
ccccatcgcctgggacgccc

SEQ ID NO: 614509 - DNA, 17 bp, Homo sapiens
ccccatcgccttctggc

SEQ ID NO: 614510 - DNA, 19 bp, Homo sapiens
ccccatcgccttctgggga

SEQ ID NO: 614511 - DNA, 20 bp, Homo sapiens
ccccatctcctcccatggcc

SEQ ID NO: 614512 - DNA, 21 bp, Homo sapiens
ccccatctcctcccatggcct

SEQ ID NO: 614513 - DNA, 19 bp, Homo sapiens
ccccatgccaatgtccagg

SEQ ID NO: 614514 - DNA, 14 bp, Homo sapiens
ccccatgccctccc

SEQ ID NO: 614515 - DNA, 15 bp, Homo sapiens
ccccatggaacagcc

SEQ ID NO: 614516 - DNA, 19 bp, Homo sapiens
ccccatggtgcagtgaaga

SEQ ID NO: 614517 - DNA, 14 bp, Homo sapiens
ccccattcagtgac

SEQ ID NO: 614518 - DNA, 13 bp, Homo sapiens
cccccacccatgc

SEQ ID NO: 614519 - DNA, 14 bp, Homo sapiens
cccccaccccactc

SEQ ID NO: 614520 - DNA, 15 bp, Homo sapiens
cccccagcagctcac

SEQ ID NO: 614521 - DNA, 12 bp, Homo sapiens
cccccaggctgc

SEQ ID NO: 614522 - DNA, 20 bp, Homo sapiens
cccccaggctgcgcctgccc

SEQ ID NO: 614523 - DNA, 19 bp, Homo sapiens
cccccatgccctccctgct

SEQ ID NO: 614524 - DNA, 13 bp, Homo sapiens
ccccccagtccgc

SEQ ID NO: 614525 - DNA, 13 bp, Homo sapiens
cccccctccccaa

SEQ ID NO: 614526 - DNA, 12 bp, Homo sapiens
cccccggacgcc

SEQ ID NO: 614527 - DNA, 15 bp, Homo sapiens
cccccgggccctttc

SEQ ID NO: 614528 - DNA, 11 bp, Homo sapiens
ccccctcctgc

SEQ ID NO: 614529 - DNA, 13 bp, Homo sapiens
ccccctctcgggc

SEQ ID NO: 614530 - DNA, 10 bp, Homo sapiens
ccccctggct

SEQ ID NO: 614531 - DNA, 14 bp, Homo sapiens
ccccctggctttgg

SEQ ID NO: 614532 - DNA, 11 bp, Homo sapiens
ccccctgtggc

SEQ ID NO: 614533 - DNA, 23 bp, Homo sapiens
ccccgcccgccctcctctgcccc

SEQ ID NO: 614534 - DNA, 18 bp, Homo sapiens
ccccgcccggcctcctag

SEQ ID NO: 614535 - DNA, 22 bp, Homo sapiens
ccccgcgcgtgcccccagcgtg

SEQ ID NO: 614536 - DNA, 18 bp, Homo sapiens
ccccgctcttcccaagtc

SEQ ID NO: 614537 - DNA, 12 bp, Homo sapiens
ccccgctgcctg

SEQ ID NO: 614538 - DNA, 15 bp, Homo sapiens
ccccgctgcctggcg

SEQ ID NO: 614539 - DNA, 16 bp, Homo sapiens
ccccggacgctggctc

SEQ ID NO: 614540 - DNA, 20 bp, Homo sapiens
ccccggaggcgcccacctgc

SEQ ID NO: 614541 - DNA, 22 bp, Homo sapiens
ccccggaggcgcccacctgccc

SEQ ID NO: 614542 - DNA, 14 bp, Homo sapiens
ccccggcctgatgg

SEQ ID NO: 614543 - DNA, 17 bp, Homo sapiens
ccccggcctgatggcca

SEQ ID NO: 614544 - DNA, 14 bp, Homo sapiens
ccccgtcaccccgc

SEQ ID NO: 614545 - DNA, 18 bp, Homo sapiens
ccccgtcccggccccgcg

SEQ ID NO: 614546 - DNA, 17 bp, Homo sapiens
ccccgtccctttccctg

SEQ ID NO: 614547 - DNA, 23 bp, Homo sapiens
ccccgtctgccccttgaccccac

SEQ ID NO: 614548 - DNA, 13 bp, Homo sapiens
ccccgtgcggccc

SEQ ID NO: 614549 - DNA, 22 bp, Homo sapiens
ccccgtgcggcccgtgcgcagc

SEQ ID NO: 614550 - DNA, 18 bp, Homo sapiens
ccccgtgctcacagtagc

SEQ ID NO: 614551 - DNA, 17 bp, Homo sapiens
ccccgttgttgtccctg

SEQ ID NO: 614552 - DNA, 19 bp, Homo sapiens
ccccgttgttgtccctgca

SEQ ID NO: 614553 - DNA, 13 bp, Homo sapiens
cccctatcctgca

SEQ ID NO: 614554 - DNA, 15 bp, Homo sapiens
cccctatcctgcacc

SEQ ID NO: 614555 - DNA, 17 bp, Homo sapiens
cccctatcctgcaccct

SEQ ID NO: 614556 - DNA, 21 bp, Homo sapiens
cccctcagctctccctcacac

SEQ ID NO: 614557 - DNA, 14 bp, Homo sapiens
cccctccagacccc

SEQ ID NO: 614558 - DNA, 15 bp, Homo sapiens
cccctccccagcccc

SEQ ID NO: 614559 - DNA, 12 bp, Homo sapiens
cccctccccatg

SEQ ID NO: 614560 - DNA, 14 bp, Homo sapiens
cccctcccccgcag

SEQ ID NO: 614561 - DNA, 20 bp, Homo sapiens
cctgtactcgcttgtgcaga

SEQ ID NO: 614562 - DNA, 14 bp, Homo sapiens
cctgtcctgctcac

SEQ ID NO: 614563 - DNA, 12 bp, Homo sapiens
cctgtcgggccc

SEQ ID NO: 614564 - DNA, 16 bp, Homo sapiens
cctgtcgggcccgcac

SEQ ID NO: 614565 - DNA, 12 bp, Homo sapiens
cctgtctcctct

SEQ ID NO: 614566 - DNA, 16 bp, Homo sapiens
cctgtctcctctgtca

SEQ ID NO: 614567 - DNA, 21 bp, Homo sapiens
cctgtctctacaaaaaaaatc

SEQ ID NO: 614568 - DNA, 15 bp, Homo sapiens
cctgtgaactgccag

SEQ ID NO: 614569 - DNA, 16 bp, Homo sapiens
cctgtgaactgccagg

SEQ ID NO: 614570 - DNA, 17 bp, Homo sapiens
cctgtgatcgtgtgttg

SEQ ID NO: 614571 - DNA, 20 bp, Homo sapiens
cctgtgatcgtgtgttgcca

SEQ ID NO: 614572 - DNA, 15 bp, Homo sapiens
cctgtgcacctgact

SEQ ID NO: 614573 - DNA, 22 bp, Homo sapiens
cctgtgcagtagagagcctttc

SEQ ID NO: 614574 - DNA, 14 bp, Homo sapiens
cctgtgcccacgtg

SEQ ID NO: 614575 - DNA, 24 bp, Homo sapiens
cctgtgcccacgtgtgcagactgt

SEQ ID NO: 614576 - DNA, 17 bp, Homo sapiens
cctgtggcggccttccg

SEQ ID NO: 614577 - DNA, 17 bp, Homo sapiens
cctgtgggagtccactt

SEQ ID NO: 614578 - DNA, 19 bp, Homo sapiens
cctgtgggagtccactttc

SEQ ID NO: 614579 - DNA, 19 bp, Homo sapiens
cctgtgggggcggctgtgg

SEQ ID NO: 614580 - DNA, 21 bp, Homo sapiens
cctgtggtttgttatcagtac

SEQ ID NO: 614581 - DNA, 14 bp, Homo sapiens
cctgtgtcatctgt

SEQ ID NO: 614582 - DNA, 20 bp, Homo sapiens
cctgttcacgtgactcctca

SEQ ID NO: 614583 - DNA, 17 bp, Homo sapiens
cctgttccgcctcactg

SEQ ID NO: 614584 - DNA, 19 bp, Homo sapiens
cctgttccgcctcactggg

SEQ ID NO: 614585 - DNA, 15 bp, Homo sapiens
cctgtttctcctcca

SEQ ID NO: 614586 - DNA, 20 bp, Homo sapiens
ccttaaaaagaccatgcatt

SEQ ID NO: 614587 - DNA, 23 bp, Homo sapiens
ccttaagtcttactgttttgtgc

SEQ ID NO: 614588 - DNA, 16 bp, Homo sapiens
ccttacaaagccagct

SEQ ID NO: 614589 - DNA, 22 bp, Homo sapiens
ccttacaaagccagctctgagc

SEQ ID NO: 614590 - DNA, 20 bp, Homo sapiens
ccttacaaccacatttctgg

SEQ ID NO: 614591 - DNA, 16 bp, Homo sapiens
ccttatcataaattca

SEQ ID NO: 614592 - DNA, 22 bp, Homo sapiens
ccttatggaacactctgagact

SEQ ID NO: 614593 - DNA, 13 bp, Homo sapiens
ccttcaaatacat

SEQ ID NO: 614594 - DNA, 23 bp, Homo sapiens
ccttcaagcaccctgttccctct

SEQ ID NO: 614595 - DNA, 10 bp, Homo sapiens
ccttcagtgc

SEQ ID NO: 614596 - DNA, 14 bp, Homo sapiens
ccttcatcccaggg

SEQ ID NO: 614597 - DNA, 18 bp, Homo sapiens
ccttcattccgttaggaa

SEQ ID NO: 614598 - DNA, 16 bp, Homo sapiens
ccttccaacctgttca

SEQ ID NO: 614599 - DNA, 14 bp, Homo sapiens
ccttcccaccccta

SEQ ID NO: 614600 - DNA, 12 bp, Homo sapiens
ccttccccactc

SEQ ID NO: 614601 - DNA, 14 bp, Homo sapiens
ccttccccactccc

SEQ ID NO: 614602 - DNA, 16 bp, Homo sapiens
ccttcccctgcgccct

SEQ ID NO: 614603 - DNA, 23 bp, Homo sapiens
ccttcccctgcgccctccctccc

SEQ ID NO: 614604 - DNA, 21 bp, Homo sapiens
ccttcccgcagcaccagcctg

SEQ ID NO: 614605 - DNA, 20 bp, Homo sapiens
ccttccctagttctttgcat

SEQ ID NO: 614606 - DNA, 22 bp, Homo sapiens
ccttccgggtctcgcagcctga

SEQ ID NO: 614607 - DNA, 12 bp, Homo sapiens
ccttcctgccca

SEQ ID NO: 614608 - DNA, 13 bp, Homo sapiens
ccttcctgcccag

SEQ ID NO: 614609 - DNA, 14 bp, Homo sapiens
ccttcctgcccagg

SEQ ID NO: 614610 - DNA, 18 bp, Homo sapiens
ccttcctgtcctgctcac

SEQ ID NO: 614611 - DNA, 22 bp, Homo sapiens
ccttcgcgtatttcaggattct

SEQ ID NO: 614612 - DNA, 14 bp, Homo sapiens
ccttcggcagtggc

SEQ ID NO: 614613 - DNA, 12 bp, Homo sapiens
ccttctccacag

SEQ ID NO: 614614 - DNA, 13 bp, Homo sapiens
ccttctcccctcc

SEQ ID NO: 614615 - DNA, 15 bp, Homo sapiens
ccttctcccctccag

SEQ ID NO: 614616 - DNA, 20 bp, Homo sapiens
ccttctcccctccagacccc

SEQ ID NO: 614617 - DNA, 21 bp, Homo sapiens
ccttctcccctccagacccct

SEQ ID NO: 614618 - DNA, 22 bp, Homo sapiens
ccttctcccctccagaccccta

SEQ ID NO: 614619 - DNA, 22 bp, Homo sapiens
ccttctgatgaagttgtacaac

SEQ ID NO: 614620 - DNA, 18 bp, Homo sapiens
ccttctggccgctgcagt

SEQ ID NO: 614621 - DNA, 17 bp, Homo sapiens
ccttctggctgctgcag

SEQ ID NO: 614622 - DNA, 15 bp, Homo sapiens
ccttctttccttcct

SEQ ID NO: 614623 - DNA, 17 bp, Homo sapiens
ccttctttccttccttt

SEQ ID NO: 614624 - DNA, 18 bp, Homo sapiens
ccttgaaaccagctcagg

SEQ ID NO: 614625 - DNA, 20 bp, Homo sapiens
ccttgactattacactgcct

SEQ ID NO: 614626 - DNA, 12 bp, Homo sapiens
ccttgatgtttc

SEQ ID NO: 614627 - DNA, 14 bp, Homo sapiens
ccttgatgtttcta

SEQ ID NO: 614628 - DNA, 16 bp, Homo sapiens
ccttgctctacctggc

SEQ ID NO: 614629 - DNA, 17 bp, Homo sapiens
ccttgctgggccaggga

SEQ ID NO: 614630 - DNA, 12 bp, Homo sapiens
ccttggagagga

SEQ ID NO: 614631 - DNA, 16 bp, Homo sapiens
ccttggagaggagagt

SEQ ID NO: 614632 - DNA, 15 bp, Homo sapiens
ccttggcccctctct

SEQ ID NO: 614633 - DNA, 18 bp, Homo sapiens
ccttggcccctctctgtt

SEQ ID NO: 614634 - DNA, 17 bp, Homo sapiens
ccttgggcacgggagag

SEQ ID NO: 614635 - DNA, 18 bp, Homo sapiens
ccttgggcacgggagagc

SEQ ID NO: 614636 - DNA, 17 bp, Homo sapiens
ccttggttcctccagca

SEQ ID NO: 614637 - DNA, 22 bp, Homo sapiens
ccttgtacagaaccagcactcc

SEQ ID NO: 614638 - DNA, 17 bp, Homo sapiens
cgcgcgtgcccccagcg

SEQ ID NO: 614639 - DNA, 19 bp, Homo sapiens
cgcgcgttcgcggcggtgg

SEQ ID NO: 614640 - DNA, 16 bp, Homo sapiens
cgcgctctgcccctcc

SEQ ID NO: 614641 - DNA, 16 bp, Homo sapiens
cgcggagcccccgccc

SEQ ID NO: 614642 - DNA, 18 bp, Homo sapiens
cgcggagcccccgcccct

SEQ ID NO: 614643 - DNA, 14 bp, Homo sapiens
cgcggaggcccctg

SEQ ID NO: 614644 - DNA, 20 bp, Homo sapiens
cgcgggacagcggccccgcg

SEQ ID NO: 614645 - DNA, 12 bp, Homo sapiens
cgcgtgccccca

SEQ ID NO: 614646 - DNA, 18 bp, Homo sapiens
cgcgtgcccccagcgtgg

SEQ ID NO: 614647 - DNA, 14 bp, Homo sapiens
cgcgtgccttcccc

SEQ ID NO: 614648 - DNA, 19 bp, Homo sapiens
cgctccggcagaggcaggg

SEQ ID NO: 614649 - DNA, 14 bp, Homo sapiens
cgctcctctgcagc

SEQ ID NO: 614650 - DNA, 14 bp, Homo sapiens
cgctctgcccctcc

SEQ ID NO: 614651 - DNA, 20 bp, Homo sapiens
cgctctgcccctccgtcccc

SEQ ID NO: 614652 - DNA, 20 bp, Homo sapiens
cgctgcagtcagcacagaga

SEQ ID NO: 614653 - DNA, 18 bp, Homo sapiens
cgctgcctggcgggcagc

SEQ ID NO: 614654 - DNA, 14 bp, Homo sapiens
cgctgcgctcccac

SEQ ID NO: 614655 - DNA, 19 bp, Homo sapiens
cgctggagaccctgcgccc

SEQ ID NO: 614656 - DNA, 14 bp, Homo sapiens
cgctggtaactgtt

SEQ ID NO: 614657 - DNA, 16 bp, Homo sapiens
cgctgtccgtcctgct

SEQ ID NO: 614658 - DNA, 22 bp, Homo sapiens
cgcttgtgcagaaaacattgtt

SEQ ID NO: 614659 - DNA, 14 bp, Homo sapiens
cggacgccccccgg

SEQ ID NO: 614660 - DNA, 16 bp, Homo sapiens
cggacgctggagaccc

SEQ ID NO: 614661 - DNA, 17 bp, Homo sapiens
cggacgggacagcggcc

SEQ ID NO: 614662 - DNA, 18 bp, Homo sapiens
cggacgggacagcggccc

SEQ ID NO: 614663 - DNA, 22 bp, Homo sapiens
cggagcccccgcccctccccct

SEQ ID NO: 614664 - DNA, 14 bp, Homo sapiens
cggagcggctgagg

SEQ ID NO: 614665 - DNA, 15 bp, Homo sapiens
cggaggcccctgagg

SEQ ID NO: 614666 - DNA, 15 bp, Homo sapiens
cggaggcgcccacct

SEQ ID NO: 614667 - DNA, 17 bp, Homo sapiens
cggaggcgcccacctgc

SEQ ID NO: 614668 - DNA, 18 bp, Homo sapiens
cggaggcgcccacctgcc

SEQ ID NO: 614669 - DNA, 15 bp, Homo sapiens
cggaggggcttggag

SEQ ID NO: 614670 - DNA, 17 bp, Homo sapiens
cggaggggcttggagca

SEQ ID NO: 614671 - DNA, 19 bp, Homo sapiens
cggagggtctccctgggca

SEQ ID NO: 614672 - DNA, 15 bp, Homo sapiens
cggcaaagatccagc

SEQ ID NO: 614673 - DNA, 19 bp, Homo sapiens
cggcacattggcagtgtgt

SEQ ID NO: 614674 - DNA, 17 bp, Homo sapiens
cggcaccgcccacccac

SEQ ID NO: 614675 - DNA, 21 bp, Homo sapiens
cggcaccgcccacccacaccc

SEQ ID NO: 614676 - DNA, 15 bp, Homo sapiens
cggcactgtgcactc

SEQ ID NO: 614677 - DNA, 18 bp, Homo sapiens
cggcagaggcagggccct

SEQ ID NO: 614678 - DNA, 12 bp, Homo sapiens
cggcagccccat

SEQ ID NO: 614679 - DNA, 18 bp, Homo sapiens
cggcagcttgagcctgtc

SEQ ID NO: 614680 - DNA, 15 bp, Homo sapiens
cggcagtggctgggg

SEQ ID NO: 614681 - DNA, 16 bp, Homo sapiens
cggcatccgagcccct

SEQ ID NO: 614682 - DNA, 16 bp, Homo sapiens
cggcccacgcagagcc

SEQ ID NO: 614683 - DNA, 23 bp, Homo sapiens
cggcccacgcagagccccggagc

SEQ ID NO: 614684 - DNA, 17 bp, Homo sapiens
cggccccatcagaggct

SEQ ID NO: 614685 - DNA, 15 bp, Homo sapiens
ccacgcccctcccca

SEQ ID NO: 614686 - DNA, 13 bp, Homo sapiens
ccacgcccctgcc

SEQ ID NO: 614687 - DNA, 19 bp, Homo sapiens
ccacgccgatataagccat

SEQ ID NO: 614688 - DNA, 22 bp, Homo sapiens
ccacgccgatataagccatagc

SEQ ID NO: 614689 - DNA, 16 bp, Homo sapiens
ccacgcggctgctgct

SEQ ID NO: 614690 - DNA, 19 bp, Homo sapiens
cagttagcccggccaagga

SEQ ID NO: 614691 - DNA, 22 bp, Homo sapiens
cagttaggtgctgaatgaagct

SEQ ID NO: 614692 - DNA, 15 bp, Homo sapiens
cagttataatttcaa

SEQ ID NO: 614693 - DNA, 19 bp, Homo sapiens
cagttatttaccagaagtt

SEQ ID NO: 614694 - DNA, 18 bp, Homo sapiens
cagttccctcagccctca

SEQ ID NO: 614695 - DNA, 19 bp, Homo sapiens
cagttccctcagccctcat

SEQ ID NO: 614696 - DNA, 14 bp, Homo sapiens
cagttctcatcttg

SEQ ID NO: 614697 - DNA, 16 bp, Homo sapiens
cagttggcctctgccc

SEQ ID NO: 614698 - DNA, 16 bp, Homo sapiens
cagtttggccctggag

SEQ ID NO: 614699 - DNA, 17 bp, Homo sapiens
cagtttggccctggagc

SEQ ID NO: 614700 - DNA, 22 bp, Homo sapiens
cagtttggccctggagccaggg

SEQ ID NO: 614701 - DNA, 19 bp, Homo sapiens
cagtttggtatgaaacaaa

SEQ ID NO: 614702 - DNA, 18 bp, Homo sapiens
cataaaacacccttgaaa

SEQ ID NO: 614703 - DNA, 19 bp, Homo sapiens
cataaacacttctccttaa

SEQ ID NO: 614704 - DNA, 20 bp, Homo sapiens
cataaacacttctccttaac

SEQ ID NO: 614705 - DNA, 22 bp, Homo sapiens
cataaagtaataactgttagaa

SEQ ID NO: 614706 - DNA, 18 bp, Homo sapiens
cataaattatttctaaaa

SEQ ID NO: 614707 - DNA, 21 bp, Homo sapiens
cataaattatttctaaaacat

SEQ ID NO: 614708 - DNA, 11 bp, Homo sapiens
cataacacaca

SEQ ID NO: 614709 - DNA, 17 bp, Homo sapiens
cataagattatatacaa

SEQ ID NO: 614710 - DNA, 18 bp, Homo sapiens
cataagtaaatgtcttca

SEQ ID NO: 614711 - DNA, 23 bp, Homo sapiens
cataagtaaatgtcttcatgttg

SEQ ID NO: 614712 - DNA, 18 bp, Homo sapiens
cataagttagatgtttta

SEQ ID NO: 614713 - DNA, 14 bp, Homo sapiens
cataataccctttt

SEQ ID NO: 614714 - DNA, 18 bp, Homo sapiens
cataatatgcatatatat

SEQ ID NO: 614715 - DNA, 19 bp, Homo sapiens
cataatatgcatatatatg

SEQ ID NO: 614716 - DNA, 21 bp, Homo sapiens
cataatatgcatatatatgta

SEQ ID NO: 614717 - DNA, 22 bp, Homo sapiens
cataatcatccttttttaaaaa

SEQ ID NO: 614718 - DNA, 14 bp, Homo sapiens
cataatgatactga

SEQ ID NO: 614719 - DNA, 19 bp, Homo sapiens
cataatgatactgaattgt

SEQ ID NO: 614720 - DNA, 16 bp, Homo sapiens
cataattaaagtgtcc

SEQ ID NO: 614721 - DNA, 21 bp, Homo sapiens
cataattgtgagttaatttga

SEQ ID NO: 614722 - DNA, 20 bp, Homo sapiens
catacacagaaatcctaaca

SEQ ID NO: 614723 - DNA, 19 bp, Homo sapiens
catacagtctctatttgat

SEQ ID NO: 614724 - DNA, 16 bp, Homo sapiens
catacatatatacatt

SEQ ID NO: 614725 - DNA, 19 bp, Homo sapiens
catacgtgcccatttcaca

SEQ ID NO: 614726 - DNA, 22 bp, Homo sapiens
catacgtgcccatttcacacaa

SEQ ID NO: 614727 - DNA, 23 bp, Homo sapiens
catacgttgatagtttacaaaca

SEQ ID NO: 614728 - DNA, 12 bp, Homo sapiens
catactgtttaa

SEQ ID NO: 614729 - DNA, 15 bp, Homo sapiens
catagacaagtgttt

SEQ ID NO: 614730 - DNA, 12 bp, Homo sapiens
catagataccat

SEQ ID NO: 614731 - DNA, 21 bp, Homo sapiens
catagataccattttgaaata

SEQ ID NO: 614732 - DNA, 20 bp, Homo sapiens
catagctttagagaagccat

SEQ ID NO: 614733 - DNA, 22 bp, Homo sapiens
catagctttagagaagccataa

SEQ ID NO: 614734 - DNA, 19 bp, Homo sapiens
catagtcaatcaaacaggg

SEQ ID NO: 614735 - DNA, 20 bp, Homo sapiens
catagtggtattttaacata

SEQ ID NO: 614736 - DNA, 16 bp, Homo sapiens
catagtggtcatttgg

SEQ ID NO: 614737 - DNA, 18 bp, Homo sapiens
catagttctgcaataaca

SEQ ID NO: 614738 - DNA, 15 bp, Homo sapiens
catataaacacagta

SEQ ID NO: 614739 - DNA, 22 bp, Homo sapiens
catataataaattaatttttca

SEQ ID NO: 614740 - DNA, 20 bp, Homo sapiens
catataatttgccagacaga

SEQ ID NO: 614741 - DNA, 14 bp, Homo sapiens
catatagctttgca

SEQ ID NO: 614742 - DNA, 17 bp, Homo sapiens
catataggggcaaaaat

SEQ ID NO: 614743 - DNA, 23 bp, Homo sapiens
catataggggcaaaaatttgaca

SEQ ID NO: 614744 - DNA, 13 bp, Homo sapiens
catatatacattt

SEQ ID NO: 614745 - DNA, 16 bp, Homo sapiens
catatatataaaatac

SEQ ID NO: 614746 - DNA, 16 bp, Homo sapiens
catatatatgtatatt

SEQ ID NO: 614747 - DNA, 20 bp, Homo sapiens
catatggcaacgttcatgtt

SEQ ID NO: 614748 - DNA, 19 bp, Homo sapiens
catatgtaggaaaattttc

SEQ ID NO: 614749 - DNA, 18 bp, Homo sapiens
catatgttagatacacaa

SEQ ID NO: 614750 - DNA, 19 bp, Homo sapiens
catattaaagaaagtcata

SEQ ID NO: 614751 - DNA, 19 bp, Homo sapiens
catatttatagagttatta

SEQ ID NO: 614752 - DNA, 19 bp, Homo sapiens
catattttcctttatgtga

SEQ ID NO: 614753 - DNA, 16 bp, Homo sapiens
catcaacaaagaaata

SEQ ID NO: 614754 - DNA, 18 bp, Homo sapiens
catcaagtagtagtactt

SEQ ID NO: 614755 - DNA, 18 bp, Homo sapiens
catcaattgggttttgat

SEQ ID NO: 614756 - DNA, 17 bp, Homo sapiens
catcacaatttgttgaa

SEQ ID NO: 614757 - DNA, 18 bp, Homo sapiens
catcatatgttagataca

SEQ ID NO: 614758 - DNA, 20 bp, Homo sapiens
catcatatgttagatacaca

SEQ ID NO: 614759 - DNA, 15 bp, Homo sapiens
catcattcctgtcag

SEQ ID NO: 614760 - DNA, 23 bp, Homo sapiens
catcattcctgtcagagctttca

SEQ ID NO: 614761 - DNA, 15 bp, Homo sapiens
catcattgaaatctt

SEQ ID NO: 614762 - DNA, 21 bp, Homo sapiens
catcattgaaatctttttgct

SEQ ID NO: 614763 - DNA, 16 bp, Homo sapiens
catcatttcattcgtg

SEQ ID NO: 614764 - DNA, 16 bp, Homo sapiens
catcattttttgtttc

SEQ ID NO: 614765 - DNA, 18 bp, Homo sapiens
catccaccttcctgccca

SEQ ID NO: 614766 - DNA, 13 bp, Homo sapiens
catcccactgata

SEQ ID NO: 614767 - DNA, 18 bp, Homo sapiens
catcccactgatatcacg

SEQ ID NO: 614768 - DNA, 15 bp, Homo sapiens
catcccctgcctcta

SEQ ID NO: 614769 - DNA, 15 bp, Homo sapiens
catcccttggcccct

SEQ ID NO: 614770 - DNA, 15 bp, Homo sapiens
catccgagcccctgt

SEQ ID NO: 614771 - DNA, 23 bp, Homo sapiens
catcctacctaactccctaggcc

SEQ ID NO: 614772 - DNA, 22 bp, Homo sapiens
catcctgccttcatggaactca

SEQ ID NO: 614773 - DNA, 12 bp, Homo sapiens
catcctggaaat

SEQ ID NO: 614774 - DNA, 17 bp, Homo sapiens
catcctggcttgcctcc

SEQ ID NO: 614775 - DNA, 14 bp, Homo sapiens
catccttcccgcag

SEQ ID NO: 614776 - DNA, 15 bp, Homo sapiens
catccttcccgcagc

SEQ ID NO: 614777 - DNA, 17 bp, Homo sapiens
catccttcccgcagcac

SEQ ID NO: 614778 - DNA, 13 bp, Homo sapiens
catctagttttaa

SEQ ID NO: 614779 - DNA, 17 bp, Homo sapiens
catctcaaacactgctt

SEQ ID NO: 614780 - DNA, 23 bp, Homo sapiens
catctcaggtggcatttgcaggt

SEQ ID NO: 614781 - DNA, 20 bp, Homo sapiens
catctcctcccatggccttc

SEQ ID NO: 614782 - DNA, 17 bp, Homo sapiens
catctctgtaaaaagca

SEQ ID NO: 614783 - DNA, 12 bp, Homo sapiens
catctgaaatct

SEQ ID NO: 614784 - DNA, 13 bp, Homo sapiens
catctgaggagtc

SEQ ID NO: 614785 - DNA, 15 bp, Homo sapiens
catctgaggagtcca

SEQ ID NO: 614786 - DNA, 17 bp, Homo sapiens
catctgaggagtccaaa

SEQ ID NO: 614787 - DNA, 14 bp, Homo sapiens
catctgatatcagg

SEQ ID NO: 614788 - DNA, 22 bp, Homo sapiens
catctgatatcaggaaatatct

SEQ ID NO: 614789 - DNA, 14 bp, Homo sapiens
catctgatttctga

SEQ ID NO: 614790 - DNA, 19 bp, Homo sapiens
cagccctgttccgcctcac

SEQ ID NO: 614791 - DNA, 20 bp, Homo sapiens
cagccctgttccgcctcact

SEQ ID NO: 614792 - DNA, 21 bp, Homo sapiens
cagccctgttccgcctcactg

SEQ ID NO: 614793 - DNA, 14 bp, Homo sapiens
cagcccttgctcta

SEQ ID NO: 614794 - DNA, 17 bp, Homo sapiens
cagcccttgctctacct

SEQ ID NO: 614795 - DNA, 15 bp, Homo sapiens
cagccgcgctctgcc

SEQ ID NO: 614796 - DNA, 16 bp, Homo sapiens
cagccgcgctctgccc

SEQ ID NO: 614797 - DNA, 18 bp, Homo sapiens
cagccgcgctctgcccct

SEQ ID NO: 614798 - DNA, 13 bp, Homo sapiens
cagcctcatcagt

SEQ ID NO: 614799 - DNA, 14 bp, Homo sapiens
cagcctcccccagg

SEQ ID NO: 614800 - DNA, 15 bp, Homo sapiens
cagcctcccccaggc

SEQ ID NO: 614801 - DNA, 18 bp, Homo sapiens
cagcctcccccaggctgc

SEQ ID NO: 614802 - DNA, 16 bp, Homo sapiens
cagcctcgttggagag

SEQ ID NO: 614803 - DNA, 19 bp, Homo sapiens
cagcctcgttggagagcag

SEQ ID NO: 614804 - DNA, 23 bp, Homo sapiens
cagcctgaaagatacaggggatc

SEQ ID NO: 614805 - DNA, 15 bp, Homo sapiens
cagcctgagccacag

SEQ ID NO: 614806 - DNA, 11 bp, Homo sapiens
cagcctgagct

SEQ ID NO: 614807 - DNA, 15 bp, Homo sapiens
cagcctgagctccac

SEQ ID NO: 614808 - DNA, 18 bp, Homo sapiens
cagcctgagctccaccct

SEQ ID NO: 614809 - DNA, 18 bp, Homo sapiens
cagcctgccaggccctcc

SEQ ID NO: 614810 - DNA, 18 bp, Homo sapiens
cagcctgtgaactgccag

SEQ ID NO: 614811 - DNA, 19 bp, Homo sapiens
cagcctgtgaactgccagg

SEQ ID NO: 614812 - DNA, 20 bp, Homo sapiens
cagcctttgcgctctgggtt

SEQ ID NO: 614813 - DNA, 18 bp, Homo sapiens
cagcgacgcggcccgcgg

SEQ ID NO: 614814 - DNA, 14 bp, Homo sapiens
cagcgagtggtcaa

SEQ ID NO: 614815 - DNA, 17 bp, Homo sapiens
cagcgcatggcgccccg

SEQ ID NO: 614816 - DNA, 18 bp, Homo sapiens
cagcgcatggcgccccgg

SEQ ID NO: 614817 - DNA, 21 bp, Homo sapiens
cagcgccagggctcagatggg

SEQ ID NO: 614818 - DNA, 16 bp, Homo sapiens
cagcgcccgaggccag

SEQ ID NO: 614819 - DNA, 23 bp, Homo sapiens
cagcgcccgaggccagggccgcc

SEQ ID NO: 614820 - DNA, 12 bp, Homo sapiens
cagcgcctcccg

SEQ ID NO: 614821 - DNA, 15 bp, Homo sapiens
cagcgcctcccgccg

SEQ ID NO: 614822 - DNA, 21 bp, Homo sapiens
cagcgcctcccgccgcctcgg

SEQ ID NO: 614823 - DNA, 22 bp, Homo sapiens
cagcgcctcgccccagccaagc

SEQ ID NO: 614824 - DNA, 18 bp, Homo sapiens
cagcggccccgcggagcc

SEQ ID NO: 614825 - DNA, 19 bp, Homo sapiens
cagcggccccgcggagccc

SEQ ID NO: 614826 - DNA, 20 bp, Homo sapiens
cagcggccccgcggagcccc

SEQ ID NO: 614827 - DNA, 21 bp, Homo sapiens
cagcggccccgcggagccccc

SEQ ID NO: 614828 - DNA, 22 bp, Homo sapiens
cagcggcccggcccacgcagag

SEQ ID NO: 614829 - DNA, 23 bp, Homo sapiens
cagcggcccggcccacgcagagc

SEQ ID NO: 614830 - DNA, 14 bp, Homo sapiens
cagcgtctccccat

SEQ ID NO: 614831 - DNA, 17 bp, Homo sapiens
cagcgtctccccatgct

SEQ ID NO: 614832 - DNA, 15 bp, Homo sapiens
cagctaagcctgatg

SEQ ID NO: 614833 - DNA, 19 bp, Homo sapiens
cagctacaggggaggctga

SEQ ID NO: 614834 - DNA, 16 bp, Homo sapiens
cagctagaaagagaaa

SEQ ID NO: 614835 - DNA, 16 bp, Homo sapiens
cagctaggcagggagg

SEQ ID NO: 614836 - DNA, 18 bp, Homo sapiens
cagctaggcagggagggg

SEQ ID NO: 614837 - DNA, 21 bp, Homo sapiens
cagctcctcgggtggggcctg

SEQ ID NO: 614838 - DNA, 19 bp, Homo sapiens
cagctctaaagcagagatg

SEQ ID NO: 614839 - DNA, 18 bp, Homo sapiens
cagctctggatgaaggca

SEQ ID NO: 614840 - DNA, 20 bp, Homo sapiens
cagctgcagttagcacagag

SEQ ID NO: 614841 - DNA, 23 bp, Homo sapiens
cagctgcagttagcacagaggat

SEQ ID NO: 614842 - DNA, 13 bp, Homo sapiens
cagctggcagcgc

SEQ ID NO: 614843 - DNA, 17 bp, Homo sapiens
cagctggcagcgcctcc

SEQ ID NO: 614844 - DNA, 18 bp, Homo sapiens
cagctggcagcgcctccc

SEQ ID NO: 614845 - DNA, 20 bp, Homo sapiens
cagctgggcagggtgagaag

SEQ ID NO: 614846 - DNA, 16 bp, Homo sapiens
cagctgtctgtggctt

SEQ ID NO: 614847 - DNA, 22 bp, Homo sapiens
cagcttcacttaaaatcaaatt

SEQ ID NO: 614848 - DNA, 16 bp, Homo sapiens
cagcttcccaacaata

SEQ ID NO: 614849 - DNA, 15 bp, Homo sapiens
cagctttcctgggtc

SEQ ID NO: 614850 - DNA, 17 bp, Homo sapiens
caggaaaaggctgcagc

SEQ ID NO: 614851 - DNA, 22 bp, Homo sapiens
caggaaatatctgtgaaggact

SEQ ID NO: 614852 - DNA, 21 bp, Homo sapiens
caggaaattctgtttatgttc

SEQ ID NO: 614853 - DNA, 21 bp, Homo sapiens
caggaaatttttgcatgttta

SEQ ID NO: 614854 - DNA, 15 bp, Homo sapiens
caggaatgggccaag

SEQ ID NO: 614855 - DNA, 23 bp, Homo sapiens
caggaatggggggcgggccaggg

SEQ ID NO: 614856 - DNA, 15 bp, Homo sapiens
caggaccattttaga

SEQ ID NO: 614857 - DNA, 16 bp, Homo sapiens
caggaccattttagaa

SEQ ID NO: 614858 - DNA, 11 bp, Homo sapiens
caggacccccc

SEQ ID NO: 614859 - DNA, 15 bp, Homo sapiens
caggacccccccagt

SEQ ID NO: 614860 - DNA, 19 bp, Homo sapiens
caggacgcatgcagggccc

SEQ ID NO: 614861 - DNA, 16 bp, Homo sapiens
caggagactccaagga

SEQ ID NO: 614862 - DNA, 16 bp, Homo sapiens
caggagatgaggctgg

SEQ ID NO: 614863 - DNA, 14 bp, Homo sapiens
caggagcacagcca

SEQ ID NO: 614864 - DNA, 15 bp, Homo sapiens
caggagcacagccat

SEQ ID NO: 614865 - DNA, 14 bp, Homo sapiens
caggagcgtgtcct

SEQ ID NO: 614866 - DNA, 16 bp, Homo sapiens
caggaggacagagtgc

SEQ ID NO: 614867 - DNA, 23 bp, Homo sapiens
caggaggacctggggggggcaag

SEQ ID NO: 614868 - DNA, 23 bp, Homo sapiens
caggatgaaggggccagaccacg

SEQ ID NO: 614869 - DNA, 16 bp, Homo sapiens
caggatgcatgcaggg

SEQ ID NO: 614870 - DNA, 19 bp, Homo sapiens
caggatgcatgcagggccc

SEQ ID NO: 614871 - DNA, 22 bp, Homo sapiens
caggatgcatgcagggccccca

SEQ ID NO: 614872 - DNA, 15 bp, Homo sapiens
caggcacggaggctc

SEQ ID NO: 614873 - DNA, 17 bp, Homo sapiens
caggcagctaggcaggg

SEQ ID NO: 614874 - DNA, 22 bp, Homo sapiens
cagactgccttatattattttc

SEQ ID NO: 614875 - DNA, 20 bp, Homo sapiens
cagagaactaacactatttt

SEQ ID NO: 614876 - DNA, 23 bp, Homo sapiens
cagagaactaacactattttatg

SEQ ID NO: 614877 - DNA, 23 bp, Homo sapiens
cagagaccttgcgaccatgtgta

SEQ ID NO: 614878 - DNA, 14 bp, Homo sapiens
cagagacggcagcc

SEQ ID NO: 614879 - DNA, 15 bp, Homo sapiens
cagagacggcagccc

SEQ ID NO: 614880 - DNA, 17 bp, Homo sapiens
cagagacggcagcccca

SEQ ID NO: 614881 - DNA, 10 bp, Homo sapiens
cagagactgc

SEQ ID NO: 614882 - DNA, 16 bp, Homo sapiens
cagagactgcccaccc

SEQ ID NO: 614883 - DNA, 20 bp, Homo sapiens
cagagactgcccaccctggg

SEQ ID NO: 614884 - DNA, 21 bp, Homo sapiens
cagagactgcccaccctgggc

SEQ ID NO: 614885 - DNA, 22 bp, Homo sapiens
cagagactgcccaccctgggcc

SEQ ID NO: 614886 - DNA, 24 bp, Homo sapiens
cagagactgcccaccctgggcctc

SEQ ID NO: 614887 - DNA, 18 bp, Homo sapiens
cagagatcataaagagca

SEQ ID NO: 614888 - DNA, 15 bp, Homo sapiens
cagagatgtattatg

SEQ ID NO: 614889 - DNA, 20 bp, Homo sapiens
cagagattgggggggcttgg

SEQ ID NO: 614890 - DNA, 22 bp, Homo sapiens
cagagatttggtaactcatttg

SEQ ID NO: 614891 - DNA, 14 bp, Homo sapiens
cagagccccggagc

SEQ ID NO: 614892 - DNA, 16 bp, Homo sapiens
cagagccccggagcac

SEQ ID NO: 614893 - DNA, 11 bp, Homo sapiens
cagagccctgc

SEQ ID NO: 614894 - DNA, 12 bp, Homo sapiens
cagagccctgca

SEQ ID NO: 614895 - DNA, 22 bp, Homo sapiens
cagagcgatgtgttctttgtac

SEQ ID NO: 614896 - DNA, 15 bp, Homo sapiens
cagagcgcagccccc

SEQ ID NO: 614897 - DNA, 13 bp, Homo sapiens
cagagctaggccc

SEQ ID NO: 614898 - DNA, 14 bp, Homo sapiens
cagagctaggcccc

SEQ ID NO: 614899 - DNA, 23 bp, Homo sapiens
cagagctgagtcggctgggcagg

SEQ ID NO: 614900 - DNA, 20 bp, Homo sapiens
cagaggacagcttccccatc

SEQ ID NO: 614901 - DNA, 12 bp, Homo sapiens
cagaggcagggc

SEQ ID NO: 614902 - DNA, 14 bp, Homo sapiens
cagaggcagggccc

SEQ ID NO: 614903 - DNA, 19 bp, Homo sapiens
cagaggcagggccctgggg

SEQ ID NO: 614904 - DNA, 20 bp, Homo sapiens
cagaggcattggaggatggg

SEQ ID NO: 614905 - DNA, 18 bp, Homo sapiens
cagaggcccgaggcaccg

SEQ ID NO: 614906 - DNA, 18 bp, Homo sapiens
cagaggccggggtccagg

SEQ ID NO: 614907 - DNA, 22 bp, Homo sapiens
cagaggccggggtccaggcccg

SEQ ID NO: 614908 - DNA, 17 bp, Homo sapiens
cagagggttgtgatttt

SEQ ID NO: 614909 - DNA, 17 bp, Homo sapiens
cagagtaggtgggtctt

SEQ ID NO: 614910 - DNA, 21 bp, Homo sapiens
cagagtatacaagtgtttcta

SEQ ID NO: 614911 - DNA, 22 bp, Homo sapiens
cagagtgatttgtaaaacagtg

SEQ ID NO: 614912 - DNA, 14 bp, Homo sapiens
cagagtggatctgg

SEQ ID NO: 614913 - DNA, 21 bp, Homo sapiens
cagatcacatgcccctcttag

SEQ ID NO: 614914 - DNA, 21 bp, Homo sapiens
cagatccctcggtcagcaccg

SEQ ID NO: 614915 - DNA, 21 bp, Homo sapiens
cagatcctccgcggaggcccc

SEQ ID NO: 614916 - DNA, 16 bp, Homo sapiens
cagatcgtgccgtgga

SEQ ID NO: 614917 - DNA, 18 bp, Homo sapiens
cagatctcatagatgacc

SEQ ID NO: 614918 - DNA, 12 bp, Homo sapiens
cagatcttgagc

SEQ ID NO: 614919 - DNA, 16 bp, Homo sapiens
cagatggggcctgggc

SEQ ID NO: 614920 - DNA, 17 bp, Homo sapiens
cagatggggcctgggct

SEQ ID NO: 614921 - DNA, 20 bp, Homo sapiens
cagatggtgtcctgcatgta

SEQ ID NO: 614922 - DNA, 16 bp, Homo sapiens
cagattaataacagaa

SEQ ID NO: 614923 - DNA, 17 bp, Homo sapiens
cagattaataacagaaa

SEQ ID NO: 614924 - DNA, 19 bp, Homo sapiens
cagattaataacagaaata

SEQ ID NO: 614925 - DNA, 16 bp, Homo sapiens
cagattattttctata

SEQ ID NO: 614926 - DNA, 13 bp, Homo sapiens
cagatttcactct

SEQ ID NO: 614927 - DNA, 19 bp, Homo sapiens
cagatttcactctccttgg

SEQ ID NO: 614928 - DNA, 13 bp, Homo sapiens
cagatttccaaaa

SEQ ID NO: 614929 - DNA, 19 bp, Homo sapiens
cagatttccaaaagtacta

SEQ ID NO: 614930 - DNA, 18 bp, Homo sapiens
cagcaaaatatatgtttg

SEQ ID NO: 614931 - DNA, 16 bp, Homo sapiens
cagcaaagttttcaga

SEQ ID NO: 614932 - DNA, 19 bp, Homo sapiens
cagcaaattaattggcagc

SEQ ID NO: 614933 - DNA, 14 bp, Homo sapiens
cagcaacaacaaca

SEQ ID NO: 614934 - DNA, 22 bp, Homo sapiens
cagcaaggtgggggtcaggcta

SEQ ID NO: 614935 - DNA, 16 bp, Homo sapiens
cagcacatttgttaat

SEQ ID NO: 614936 - DNA, 23 bp, Homo sapiens
cagcaccgtggtgtgaggccccc

SEQ ID NO: 614937 - DNA, 13 bp, Homo sapiens
cagcacctccggg

SEQ ID NO: 614938 - DNA, 13 bp, Homo sapiens
cagcacctcctcc

SEQ ID NO: 614939 - DNA, 15 bp, Homo sapiens
cagcacctcctccgt

SEQ ID NO: 614940 - DNA, 17 bp, Homo sapiens
cagcacctcctccgtgg

SEQ ID NO: 614941 - DNA, 13 bp, Homo sapiens
cagcactcccagg

SEQ ID NO: 614942 - DNA, 21 bp, Homo sapiens
cagcactcccagggcccgagc

SEQ ID NO: 614943 - DNA, 12 bp, Homo sapiens
cagcagcagcag

SEQ ID NO: 614944 - DNA, 19 bp, Homo sapiens
cagcagcggcagcagcagc

SEQ ID NO: 614945 - DNA, 13 bp, Homo sapiens
atctgactgccaa

SEQ ID NO: 614946 - DNA, 14 bp, Homo sapiens
atctgactgccaaa

SEQ ID NO: 614947 - DNA, 13 bp, Homo sapiens
atctgatatcagg

SEQ ID NO: 614948 - DNA, 13 bp, Homo sapiens
atctgatttctga

SEQ ID NO: 614949 - DNA, 13 bp, Homo sapiens
atctgcctggagc

SEQ ID NO: 614950 - DNA, 14 bp, Homo sapiens
atctgcctggagcc

SEQ ID NO: 614951 - DNA, 16 bp, Homo sapiens
atctgcctggagcctg

SEQ ID NO: 614952 - DNA, 19 bp, Homo sapiens
atctgcctggagcctgggc

SEQ ID NO: 614953 - DNA, 20 bp, Homo sapiens
atctggaaaaaaaaaaatat

SEQ ID NO: 614954 - DNA, 11 bp, Homo sapiens
atctggccctg

SEQ ID NO: 614955 - DNA, 16 bp, Homo sapiens
atctggcctgggggct

SEQ ID NO: 614956 - DNA, 22 bp, Homo sapiens
atctggtgcgtgtggccctgtg

SEQ ID NO: 614957 - DNA, 18 bp, Homo sapiens
atctgtaaaaccaggctg

SEQ ID NO: 614958 - DNA, 16 bp, Homo sapiens
atctgtatatcagctc

SEQ ID NO: 614959 - DNA, 17 bp, Homo sapiens
atctgtatatcagctct

SEQ ID NO: 614960 - DNA, 21 bp, Homo sapiens
atctgtatatcagctctaaag

SEQ ID NO: 614961 - DNA, 13 bp, Homo sapiens
atctgtatgcctc

SEQ ID NO: 614962 - DNA, 22 bp, Homo sapiens
atctgtcagcttcccaacaata

SEQ ID NO: 614963 - DNA, 15 bp, Homo sapiens
atctgtcagtgagtc

SEQ ID NO: 614964 - DNA, 15 bp, Homo sapiens
atctgtctgagccct

SEQ ID NO: 614965 - DNA, 13 bp, Homo sapiens
atctgtctttatg

SEQ ID NO: 614966 - DNA, 15 bp, Homo sapiens
atctgtctttatgat

SEQ ID NO: 614967 - DNA, 19 bp, Homo sapiens
atctgtctttatgatttca

SEQ ID NO: 614968 - DNA, 19 bp, Homo sapiens
atctgtgtaacctccacag

SEQ ID NO: 614969 - DNA, 20 bp, Homo sapiens
atctgtgtaacctccacagt

SEQ ID NO: 614970 - DNA, 12 bp, Homo sapiens
atctgttgtaat

SEQ ID NO: 614971 - DNA, 18 bp, Homo sapiens
atctgttgtaatatcagt

SEQ ID NO: 614972 - DNA, 22 bp, Homo sapiens
atctgttgtaatatcagttaca

SEQ ID NO: 614973 - DNA, 22 bp, Homo sapiens
atcttaaaattggttaatgaaa

SEQ ID NO: 614974 - DNA, 18 bp, Homo sapiens
atcttaaacccacataaa

SEQ ID NO: 614975 - DNA, 20 bp, Homo sapiens
atcttaaacccacataaaca

SEQ ID NO: 614976 - DNA, 23 bp, Homo sapiens
atcttaaacccacataaacactt

SEQ ID NO: 614977 - DNA, 15 bp, Homo sapiens
atcttacacgaagaa

SEQ ID NO: 614978 - DNA, 18 bp, Homo sapiens
atcttacccttcaatgtt

SEQ ID NO: 614979 - DNA, 21 bp, Homo sapiens
atcttacccttcaatgttaaa

SEQ ID NO: 614980 - DNA, 22 bp, Homo sapiens
atcttacccttcaatgttaaat

SEQ ID NO: 614981 - DNA, 14 bp, Homo sapiens
atcttgagcaaggc

SEQ ID NO: 614982 - DNA, 12 bp, Homo sapiens
atcttgctgtga

SEQ ID NO: 614983 - DNA, 22 bp, Homo sapiens
atctttcaggaaatttttgcat

SEQ ID NO: 614984 - DNA, 13 bp, Homo sapiens
atctttgttaaaa

SEQ ID NO: 614985 - DNA, 17 bp, Homo sapiens
atctttgttaaaatata

SEQ ID NO: 614986 - DNA, 16 bp, Homo sapiens
atgaaaaagcatgtac

SEQ ID NO: 614987 - DNA, 21 bp, Homo sapiens
atgaaaaatagtgtgtccatg

SEQ ID NO: 614988 - DNA, 12 bp, Homo sapiens
atgaaaagtttt

SEQ ID NO: 614989 - DNA, 22 bp, Homo sapiens
atgaaaatggctgaagaaacac

SEQ ID NO: 614990 - DNA, 22 bp, Homo sapiens
atgaaagccctggaattttagg

SEQ ID NO: 614991 - DNA, 20 bp, Homo sapiens
atgaaatataaactgtgaga

SEQ ID NO: 614992 - DNA, 21 bp, Homo sapiens
atgaaatataaactgtgagat

SEQ ID NO: 614993 - DNA, 15 bp, Homo sapiens
atgaaatttaagcac

SEQ ID NO: 614994 - DNA, 17 bp, Homo sapiens
atgaagcaaacacacag

SEQ ID NO: 614995 - DNA, 22 bp, Homo sapiens
atgaaggggccagaccacgccc

SEQ ID NO: 614996 - DNA, 15 bp, Homo sapiens
atgaataaaatgttt

SEQ ID NO: 614997 - DNA, 13 bp, Homo sapiens
atgaattgccttt

SEQ ID NO: 614998 - DNA, 13 bp, Homo sapiens
atgaatttatcat

SEQ ID NO: 614999 - DNA, 19 bp, Homo sapiens
atgacacgaatattgctga

SEQ ID NO: 615000 - DNA, 14 bp, Homo sapiens
atgacagtagcata

SEQ ID NO: 615001 - DNA, 15 bp, Homo sapiens
atgacagtagcatac

SEQ ID NO: 615002 - DNA, 21 bp, Homo sapiens
atgacagtagcatactgatga

SEQ ID NO: 615003 - DNA, 21 bp, Homo sapiens
atgacagtggttatatttcaa

SEQ ID NO: 615004 - DNA, 22 bp, Homo sapiens
atgacctttcaataggaaaaac

SEQ ID NO: 615005 - DNA, 16 bp, Homo sapiens
atgactgacactcaga

SEQ ID NO: 615006 - DNA, 14 bp, Homo sapiens
atgactggaaacaa

SEQ ID NO: 615007 - DNA, 15 bp, Homo sapiens
atgactggaaacaag

SEQ ID NO: 615008 - DNA, 14 bp, Homo sapiens
atgagaaatcatgt

SEQ ID NO: 615009 - DNA, 12 bp, Homo sapiens
atgagaaattgt

SEQ ID NO: 615010 - DNA, 17 bp, Homo sapiens
atgagaaattgtgccaa

SEQ ID NO: 615011 - DNA, 15 bp, Homo sapiens
atgagacaacacaca

SEQ ID NO: 615012 - DNA, 13 bp, Homo sapiens
atgagaggaaatc

SEQ ID NO: 615013 - DNA, 14 bp, Homo sapiens
atgagaggaaatca

SEQ ID NO: 615014 - DNA, 23 bp, Homo sapiens
atgagatcccagagttatttccc

SEQ ID NO: 615015 - DNA, 16 bp, Homo sapiens
atgagatctttctaaa

SEQ ID NO: 615016 - DNA, 13 bp, Homo sapiens
atgagatgtaata

SEQ ID NO: 615017 - DNA, 15 bp, Homo sapiens
atgagatgtaataca

SEQ ID NO: 615018 - DNA, 16 bp, Homo sapiens
atgagattccctctcc

SEQ ID NO: 615019 - DNA, 14 bp, Homo sapiens
atgaggctggatag

SEQ ID NO: 615020 - DNA, 20 bp, Homo sapiens
atgagggcgtgaaacacaat

SEQ ID NO: 615021 - DNA, 22 bp, Homo sapiens
atgagttctgcacatacagatg

SEQ ID NO: 615022 - DNA, 15 bp, Homo sapiens
atgataatagctcac

SEQ ID NO: 615023 - DNA, 20 bp, Homo sapiens
atgataatagctcacagcac

SEQ ID NO: 615024 - DNA, 22 bp, Homo sapiens
atgataatagctcacagcacat

SEQ ID NO: 615025 - DNA, 13 bp, Homo sapiens
cacaaagtgaaat

SEQ ID NO: 615026 - DNA, 18 bp, Homo sapiens
cacaactgtggataaatt

SEQ ID NO: 615027 - DNA, 20 bp, Homo sapiens
cacaagcagacacacacata

SEQ ID NO: 615028 - DNA, 13 bp, Homo sapiens
cacaaggcccagc

SEQ ID NO: 615029 - DNA, 16 bp, Homo sapiens
cacaagggcacattgc

SEQ ID NO: 615030 - DNA, 19 bp, Homo sapiens
cacaatttgttgaatctca

SEQ ID NO: 615031 - DNA, 18 bp, Homo sapiens
cacacaaacctactgccc

SEQ ID NO: 615032 - DNA, 16 bp, Homo sapiens
cacacacacccttccc

SEQ ID NO: 615033 - DNA, 14 bp, Homo sapiens
cacacacagacaca

SEQ ID NO: 615034 - DNA, 18 bp, Homo sapiens
cacacataacacacatca

SEQ ID NO: 615035 - DNA, 16 bp, Homo sapiens
cacacatatatacata

SEQ ID NO: 615036 - DNA, 14 bp, Homo sapiens
cacaccccgtctgc

SEQ ID NO: 615037 - DNA, 17 bp, Homo sapiens
cacaccccgtctgcccc

SEQ ID NO: 615038 - DNA, 19 bp, Homo sapiens
cacaccccgtctgcccctt

SEQ ID NO: 615039 - DNA, 21 bp, Homo sapiens
cacaccccgtctgccccttga

SEQ ID NO: 615040 - DNA, 12 bp, Homo sapiens
cacacccttccc

SEQ ID NO: 615041 - DNA, 13 bp, Homo sapiens
cacacccttcccc

SEQ ID NO: 615042 - DNA, 16 bp, Homo sapiens
cacacccttccccact

SEQ ID NO: 615043 - DNA, 13 bp, Homo sapiens
cacaccggcactg

SEQ ID NO: 615044 - DNA, 14 bp, Homo sapiens
cacacctccacccg

SEQ ID NO: 615045 - DNA, 15 bp, Homo sapiens
cacaccttacaaagc

SEQ ID NO: 615046 - DNA, 18 bp, Homo sapiens
cacacgccggggctggcc

SEQ ID NO: 615047 - DNA, 22 bp, Homo sapiens
cacacgccggggctggccctgc

SEQ ID NO: 615048 - DNA, 18 bp, Homo sapiens
cacactcccaaactccaa

SEQ ID NO: 615049 - DNA, 17 bp, Homo sapiens
cacactgagctgggcac

SEQ ID NO: 615050 - DNA, 14 bp, Homo sapiens
cacactgccctctg

SEQ ID NO: 615051 - DNA, 15 bp, Homo sapiens
cacacttgggctggc

SEQ ID NO: 615052 - DNA, 12 bp, Homo sapiens
cacagactctgt

SEQ ID NO: 615053 - DNA, 19 bp, Homo sapiens
cacagaggacagcttcccc

SEQ ID NO: 615054 - DNA, 19 bp, Homo sapiens
cacagaggatggcttcccc

SEQ ID NO: 615055 - DNA, 15 bp, Homo sapiens
cacagcacaagggca

SEQ ID NO: 615056 - DNA, 20 bp, Homo sapiens
cacagcatgcatttagcatg

SEQ ID NO: 615057 - DNA, 17 bp, Homo sapiens
cacagcccagagactga

SEQ ID NO: 615058 - DNA, 20 bp, Homo sapiens
cacagcctttgcgctctggg

SEQ ID NO: 615059 - DNA, 19 bp, Homo sapiens
cacagctttcctgggtctg

SEQ ID NO: 615060 - DNA, 19 bp, Homo sapiens
cacaggagactccaaggag

SEQ ID NO: 615061 - DNA, 21 bp, Homo sapiens
cacaggagactccaaggagct

SEQ ID NO: 615062 - DNA, 20 bp, Homo sapiens
cacaggagccgcagaggccc

SEQ ID NO: 615063 - DNA, 21 bp, Homo sapiens
cacaggagccgcagaggcccg

SEQ ID NO: 615064 - DNA, 19 bp, Homo sapiens
cacaggatgcatattaaag

SEQ ID NO: 615065 - DNA, 14 bp, Homo sapiens
cacagtatttaaca

SEQ ID NO: 615066 - DNA, 16 bp, Homo sapiens
cacagtcctcacagcc

SEQ ID NO: 615067 - DNA, 17 bp, Homo sapiens
cacagtctaatttttat

SEQ ID NO: 615068 - DNA, 16 bp, Homo sapiens
cacagtgggcggcttc

SEQ ID NO: 615069 - DNA, 20 bp, Homo sapiens
cacagtgggcggcttccctg

SEQ ID NO: 615070 - DNA, 14 bp, Homo sapiens
cacataacacacat

SEQ ID NO: 615071 - DNA, 14 bp, Homo sapiens
cacatacagatggt

SEQ ID NO: 615072 - DNA, 16 bp, Homo sapiens
cacatataaacacagt

SEQ ID NO: 615073 - DNA, 17 bp, Homo sapiens
cacatatatacatacgc

SEQ ID NO: 615074 - DNA, 14 bp, Homo sapiens
cacatccaactact

SEQ ID NO: 615075 - DNA, 12 bp, Homo sapiens
cacatctgtata

SEQ ID NO: 615076 - DNA, 14 bp, Homo sapiens
cacatctgtatatc

SEQ ID NO: 615077 - DNA, 14 bp, Homo sapiens
cacatgcccctctt

SEQ ID NO: 615078 - DNA, 22 bp, Homo sapiens
cacatgcccctcttagaagaaa

SEQ ID NO: 615079 - DNA, 16 bp, Homo sapiens
cacatgttttacaaag

SEQ ID NO: 615080 - DNA, 14 bp, Homo sapiens
cacattcctgaccc

SEQ ID NO: 615081 - DNA, 15 bp, Homo sapiens
cacattcctgaccct

SEQ ID NO: 615082 - DNA, 19 bp, Homo sapiens
cacattgaaactgtattta

SEQ ID NO: 615083 - DNA, 23 bp, Homo sapiens
cacattgaaactgtatttacttg

SEQ ID NO: 615084 - DNA, 17 bp, Homo sapiens
cacattgcccatggctg

SEQ ID NO: 615085 - DNA, 15 bp, Homo sapiens
cacattgcttcatta

SEQ ID NO: 615086 - DNA, 18 bp, Homo sapiens
cacatttgggctcagggt

SEQ ID NO: 615087 - DNA, 20 bp, Homo sapiens
cacatttgttaatgattctt

SEQ ID NO: 615088 - DNA, 18 bp, Homo sapiens
caccaaattgctgagatg

SEQ ID NO: 615089 - DNA, 23 bp, Homo sapiens
caccaaattgctgagatgtttag

SEQ ID NO: 615090 - DNA, 17 bp, Homo sapiens
caccacacacacccttc

SEQ ID NO: 615091 - DNA, 20 bp, Homo sapiens
caccacacacacccttcccc

SEQ ID NO: 615092 - DNA, 12 bp, Homo sapiens
caccacaggctg

SEQ ID NO: 615093 - DNA, 11 bp, Homo sapiens
caccagcctga

SEQ ID NO: 615094 - DNA, 20 bp, Homo sapiens
caccagcctgagccacagtg

SEQ ID NO: 615095 - DNA, 19 bp, Homo sapiens
caccagttacttgtgttca

SEQ ID NO: 615096 - DNA, 20 bp, Homo sapiens
caccagttacttgtgttcat

SEQ ID NO: 615097 - DNA, 13 bp, Homo sapiens
caccatgctgggc

SEQ ID NO: 615098 - DNA, 15 bp, Homo sapiens
caccatgctgggccg

SEQ ID NO: 615099 - DNA, 22 bp, Homo sapiens
caccatttaatcatttccagca

SEQ ID NO: 615100 - DNA, 23 bp, Homo sapiens
caccatttaatcatttccagcaa

SEQ ID NO: 615101 - DNA, 20 bp, Homo sapiens
cacccacaccccgtctgccc

SEQ ID NO: 615102 - DNA, 12 bp, Homo sapiens
cacccagcagcg

SEQ ID NO: 615103 - DNA, 19 bp, Homo sapiens
cacccagcagcgcccgagg

SEQ ID NO: 615104 - DNA, 23 bp, Homo sapiens
cacccagcagcgcccgaggccag

SEQ ID NO: 615105 - DNA, 12 bp, Homo sapiens
cacccagcctgg

SEQ ID NO: 615106 - DNA, 13 bp, Homo sapiens
cacccatgccagc

SEQ ID NO: 615107 - DNA, 10 bp, Homo sapiens
cacccccagc

SEQ ID NO: 615108 - DNA, 16 bp, Homo sapiens
cacccccagcctcccc

SEQ ID NO: 615109 - DNA, 20 bp, Homo sapiens
cacccccagcctcccccagg

SEQ ID NO: 615110 - DNA, 15 bp, Homo sapiens
cacccccattgtgaa

SEQ ID NO: 615111 - DNA, 17 bp, Homo sapiens
caccccgctcttcccaa

SEQ ID NO: 615112 - DNA, 18 bp, Homo sapiens
caccccgctgcctggcgg

SEQ ID NO: 615113 - DNA, 14 bp, Homo sapiens
caccccgtctgccc

SEQ ID NO: 615114 - DNA, 15 bp, Homo sapiens
caccccgtctgcccc

SEQ ID NO: 615115 - DNA, 16 bp, Homo sapiens
caccccgttcccagcg

SEQ ID NO: 615116 - DNA, 19 bp, Homo sapiens
cacccctcttcccccttcc

SEQ ID NO: 615117 - DNA, 12 bp, Homo sapiens
cacccgccccag

SEQ ID NO: 615118 - DNA, 18 bp, Homo sapiens
cacccgccccagagactg

SEQ ID NO: 615119 - DNA, 19 bp, Homo sapiens
cacccgcccgcccccgccc

SEQ ID NO: 615120 - DNA, 17 bp, Homo sapiens
cacccgtcctggggtgg

SEQ ID NO: 615121 - DNA, 18 bp, Homo sapiens
cacccgtgttctcctcca

SEQ ID NO: 615122 - DNA, 14 bp, Homo sapiens
caccctcccctctt

SEQ ID NO: 615123 - DNA, 16 bp, Homo sapiens
caccctgactgtgggg

SEQ ID NO: 615124 - DNA, 11 bp, Homo sapiens
caccctgagca

SEQ ID NO: 615125 - DNA, 15 bp, Homo sapiens
caccctgcaggcagg

SEQ ID NO: 615126 - DNA, 15 bp, Homo sapiens
caccctgggcctccc

SEQ ID NO: 615127 - DNA, 18 bp, Homo sapiens
caccgaaaacgtggctgc

SEQ ID NO: 615128 - DNA, 12 bp, Homo sapiens
caccgcccaccc

SEQ ID NO: 615129 - DNA, 22 bp, Homo sapiens
caccgcccacccacaccccgtc

SEQ ID NO: 615130 - DNA, 17 bp, Homo sapiens
caccgcgcccctctgcg

SEQ ID NO: 615131 - DNA, 23 bp, Homo sapiens
caccgcgcccctctgcgccccag

SEQ ID NO: 615132 - DNA, 22 bp, Homo sapiens
caccggacgctggagaccctgc

SEQ ID NO: 615133 - DNA, 17 bp, Homo sapiens
caccgtggtgtgaggcc

SEQ ID NO: 615134 - DNA, 20 bp, Homo sapiens
caccgtggtgtgaggccccc

SEQ ID NO: 615135 - DNA, 15 bp, Homo sapiens
cacctccacccgtcc

SEQ ID NO: 615136 - DNA, 19 bp, Homo sapiens
cacctccccagagccctgc

SEQ ID NO: 615137 - DNA, 20 bp, Homo sapiens
cacctccccagagccctgca

SEQ ID NO: 615138 - DNA, 23 bp, Homo sapiens
cacctccccagagccctgcagtc

SEQ ID NO: 615139 - DNA, 15 bp, Homo sapiens
cacctcctccgtggg

SEQ ID NO: 615140 - DNA, 21 bp, Homo sapiens
cacctgcccagttagcccggc

SEQ ID NO: 615141 - DNA, 23 bp, Homo sapiens
cacctgctgagggggctctttcc

SEQ ID NO: 615142 - DNA, 17 bp, Homo sapiens
ttttatacctgtacaca

SEQ ID NO: 615143 - DNA, 17 bp, Homo sapiens
ttttatacttcaaatgt

SEQ ID NO: 615144 - DNA, 20 bp, Homo sapiens
ttttatacttcaaatgtcat

SEQ ID NO: 615145 - DNA, 13 bp, Homo sapiens
ttttatctcttct

SEQ ID NO: 615146 - DNA, 15 bp, Homo sapiens
ttttatgcaaatatt

SEQ ID NO: 615147 - DNA, 21 bp, Homo sapiens
ttttatgtttaaaatggcatt

SEQ ID NO: 615148 - DNA, 18 bp, Homo sapiens
ttttattcataagccaat

SEQ ID NO: 615149 - DNA, 20 bp, Homo sapiens
ttttattgtaacagacattg

SEQ ID NO: 615150 - DNA, 20 bp, Homo sapiens
ttttattgtttaaagcaact

SEQ ID NO: 615151 - DNA, 18 bp, Homo sapiens
ttttcaatgtactgtatt

SEQ ID NO: 615152 - DNA, 23 bp, Homo sapiens
ttttcacatgaacatactggctg

SEQ ID NO: 615153 - DNA, 12 bp, Homo sapiens
ttttcattctgg

SEQ ID NO: 615154 - DNA, 15 bp, Homo sapiens
ttttcattttctctc

SEQ ID NO: 615155 - DNA, 16 bp, Homo sapiens
ttttcattttctctcc

SEQ ID NO: 615156 - DNA, 19 bp, Homo sapiens
ttttcccagtgaataaata

SEQ ID NO: 615157 - DNA, 13 bp, Homo sapiens
ttttcctgtcaat

SEQ ID NO: 615158 - DNA, 15 bp, Homo sapiens
ttttccttcagtgcc

SEQ ID NO: 615159 - DNA, 19 bp, Homo sapiens
ttttccttttttatacaca

SEQ ID NO: 615160 - DNA, 23 bp, Homo sapiens
ttttctacctttttttctctcct

SEQ ID NO: 615161 - DNA, 14 bp, Homo sapiens
ttttctatatttgg

SEQ ID NO: 615162 - DNA, 16 bp, Homo sapiens
ttttctgcactgagca

SEQ ID NO: 615163 - DNA, 20 bp, Homo sapiens
ttttctgcactgagcagagt

SEQ ID NO: 615164 - DNA, 20 bp, Homo sapiens
ttttcttcacctcacttgtg

SEQ ID NO: 615165 - DNA, 19 bp, Homo sapiens
ttttcttccaacatgtgat

SEQ ID NO: 615166 - DNA, 15 bp, Homo sapiens
ttttcttttaatttt

SEQ ID NO: 615167 - DNA, 19 bp, Homo sapiens
ttttcttttttaattgaaa

SEQ ID NO: 615168 - DNA, 19 bp, Homo sapiens
ttttgagccttattaaaat

SEQ ID NO: 615169 - DNA, 17 bp, Homo sapiens
ttttgcatgtttaataa

SEQ ID NO: 615170 - DNA, 22 bp, Homo sapiens
ttttggtttttctcatttgaaa

SEQ ID NO: 615171 - DNA, 18 bp, Homo sapiens
ttttgtacgttaattaaa

SEQ ID NO: 615172 - DNA, 19 bp, Homo sapiens
ttttgtacgttaattaaac

SEQ ID NO: 615173 - DNA, 14 bp, Homo sapiens
ttttgtgaatggtt

SEQ ID NO: 615174 - DNA, 15 bp, Homo sapiens
ttttgtttcttggtg

SEQ ID NO: 615175 - DNA, 21 bp, Homo sapiens
tttttaagtgctatgcatatt

SEQ ID NO: 615176 - DNA, 14 bp, Homo sapiens
tttttaatttatga

SEQ ID NO: 615177 - DNA, 13 bp, Homo sapiens
tttttatacacat

SEQ ID NO: 615178 - DNA, 23 bp, Homo sapiens
tttttatacctgtacacacacag

SEQ ID NO: 615179 - DNA, 22 bp, Homo sapiens
tttttatacttcaaatgtcatt

SEQ ID NO: 615180 - DNA, 18 bp, Homo sapiens
tttttcattgtgttttct

SEQ ID NO: 615181 - DNA, 14 bp, Homo sapiens
tttttccagaattg

SEQ ID NO: 615182 - DNA, 14 bp, Homo sapiens
tttttgctctccct

SEQ ID NO: 615183 - DNA, 15 bp, Homo sapiens
ttttttatacacata

SEQ ID NO: 615184 - DNA, 13 bp, Homo sapiens
ttttttcaatgta

SEQ ID NO: 615185 - DNA, 12 bp, Homo sapiens
tggtatttactg

SEQ ID NO: 615186 - DNA, 23 bp, Homo sapiens
ttagcagctcttcccctttcctg

SEQ ID NO: 615187 - DNA, 18 bp, Homo sapiens
ttagcagtccatttttga

SEQ ID NO: 615188 - DNA, 15 bp, Homo sapiens
ttagcgttctgtttc

SEQ ID NO: 615189 - DNA, 17 bp, Homo sapiens
ttagcgttgttttgtgg

SEQ ID NO: 615190 - DNA, 19 bp, Homo sapiens
ttagcgttgttttgtggat

SEQ ID NO: 615191 - DNA, 20 bp, Homo sapiens
ttagcgttgttttgtggata

SEQ ID NO: 615192 - DNA, 17 bp, Homo sapiens
ttagctgtttactgaca

SEQ ID NO: 615193 - DNA, 24 bp, Homo sapiens
ttagctgtttactgacatggtgct

SEQ ID NO: 615194 - DNA, 19 bp, Homo sapiens
ttaggaaatgaatgtgtgt

SEQ ID NO: 615195 - DNA, 17 bp, Homo sapiens
ttaggaataacactgca

SEQ ID NO: 615196 - DNA, 20 bp, Homo sapiens
ttaggaatgctcaatgtgct

SEQ ID NO: 615197 - DNA, 15 bp, Homo sapiens
ttaggagttttgaga

SEQ ID NO: 615198 - DNA, 16 bp, Homo sapiens
ttagggaaatccaact

SEQ ID NO: 615199 - DNA, 15 bp, Homo sapiens
ttagggctctaattt

SEQ ID NO: 615200 - DNA, 24 bp, Homo sapiens
ttagggcttggatcgtggaagaag

SEQ ID NO: 615201 - DNA, 21 bp, Homo sapiens
ttaggtctgttgaagtgcatg

SEQ ID NO: 615202 - DNA, 14 bp, Homo sapiens
ttagtaaattccta

SEQ ID NO: 615203 - DNA, 13 bp, Homo sapiens
ttagtagctgata

SEQ ID NO: 615204 - DNA, 15 bp, Homo sapiens
ttagtagctgataaa

SEQ ID NO: 615205 - DNA, 14 bp, Homo sapiens
ttagtgttttcatt

SEQ ID NO: 615206 - DNA, 23 bp, Homo sapiens
ttagttaatctttgaaaactcat

SEQ ID NO: 615207 - DNA, 13 bp, Homo sapiens
ttcttatttgttt

SEQ ID NO: 615208 - DNA, 14 bp, Homo sapiens
ttcttcatataata

SEQ ID NO: 615209 - DNA, 16 bp, Homo sapiens
ttcttcccccagggtc

SEQ ID NO: 615210 - DNA, 11 bp, Homo sapiens
ttcttccttcc

SEQ ID NO: 615211 - DNA, 12 bp, Homo sapiens
ttcttccttcct

SEQ ID NO: 615212 - DNA, 20 bp, Homo sapiens
ttcttccttttgtatcctcc

SEQ ID NO: 615213 - DNA, 20 bp, Homo sapiens
ttcttgcactgtatccaagt

SEQ ID NO: 615214 - DNA, 18 bp, Homo sapiens
ttcttgcagtcatcagaa

SEQ ID NO: 615215 - DNA, 14 bp, Homo sapiens
ttcttgtaaaactg

SEQ ID NO: 615216 - DNA, 20 bp, Homo sapiens
ttcttgtaaaactgtgacat

SEQ ID NO: 615217 - DNA, 21 bp, Homo sapiens
ttcttgtaaaactgtgacatt

SEQ ID NO: 615218 - DNA, 21 bp, Homo sapiens
ttctttccttccttttttcct

SEQ ID NO: 615219 - DNA, 13 bp, Homo sapiens
ttcttttcccatt

SEQ ID NO: 615220 - DNA, 12 bp, Homo sapiens
ttgaaactgtat

SEQ ID NO: 615221 - DNA, 13 bp, Homo sapiens
ttgaaactgtatt

SEQ ID NO: 615222 - DNA, 14 bp, Homo sapiens
ttgaaactgtattt

SEQ ID NO: 615223 - DNA, 23 bp, Homo sapiens
ttgaaaggagaaaaaaaaagcca

SEQ ID NO: 615224 - DNA, 18 bp, Homo sapiens
ttgaaagggacaagtatc

SEQ ID NO: 615225 - DNA, 16 bp, Homo sapiens
ttgaaattatatctgt

SEQ ID NO: 615226 - DNA, 19 bp, Homo sapiens
ttgaaattatatctgtggt

SEQ ID NO: 615227 - DNA, 16 bp, Homo sapiens
ttgaaccgtcaatgtg

SEQ ID NO: 615228 - DNA, 15 bp, Homo sapiens
ttgaagtaagttcat

SEQ ID NO: 615229 - DNA, 19 bp, Homo sapiens
ttgaagtaagttcatcaaa

SEQ ID NO: 615230 - DNA, 18 bp, Homo sapiens
ttgaagtgcatgttaaaa

SEQ ID NO: 615231 - DNA, 19 bp, Homo sapiens
ttgaagtgcatgttaaaat

SEQ ID NO: 615232 - DNA, 16 bp, Homo sapiens
ttgaatgcttaaatga

SEQ ID NO: 615233 - DNA, 14 bp, Homo sapiens
ttgacaataagaaa

SEQ ID NO: 615234 - DNA, 15 bp, Homo sapiens
ttgacaataagaaac

SEQ ID NO: 615235 - DNA, 18 bp, Homo sapiens
ttgacaataagaaacagt

SEQ ID NO: 615236 - DNA, 17 bp, Homo sapiens
ttgacacactcaccatt

SEQ ID NO: 615237 - DNA, 21 bp, Homo sapiens
ttgacacactcaccatttaat

SEQ ID NO: 615238 - DNA, 17 bp, Homo sapiens
ttgacaccaaatatttt

SEQ ID NO: 615239 - DNA, 18 bp, Homo sapiens
ttgacagttacttacaca

SEQ ID NO: 615240 - DNA, 14 bp, Homo sapiens
ttgacatgtacaga

SEQ ID NO: 615241 - DNA, 20 bp, Homo sapiens
ttgacattgtcagaatgttg

SEQ ID NO: 615242 - DNA, 20 bp, Homo sapiens
ttgaccctgaaatattttct

SEQ ID NO: 615243 - DNA, 20 bp, Homo sapiens
ttgactgttatttgttgaga

SEQ ID NO: 615244 - DNA, 15 bp, Homo sapiens
ttgagacactgtcaa

SEQ ID NO: 615245 - DNA, 16 bp, Homo sapiens
ttgagaccagcctgcc

SEQ ID NO: 615246 - DNA, 23 bp, Homo sapiens
ttgagaccagcctgccaggccct

SEQ ID NO: 615247 - DNA, 17 bp, Homo sapiens
ttgagagggggatgccc

SEQ ID NO: 615248 - DNA, 15 bp, Homo sapiens
ttgagcaaggcaaga

SEQ ID NO: 615249 - DNA, 14 bp, Homo sapiens
ttgagccagcagac

SEQ ID NO: 615250 - DNA, 18 bp, Homo sapiens
ttgagccagcagacattg

SEQ ID NO: 615251 - DNA, 21 bp, Homo sapiens
ttgagggacgactttctttaa

SEQ ID NO: 615252 - DNA, 13 bp, Homo sapiens
ttgagtcatttta

SEQ ID NO: 615253 - DNA, 17 bp, Homo sapiens
ttgagtttcatttttca

SEQ ID NO: 615254 - DNA, 21 bp, Homo sapiens
ttgataattcgagcaaacaac

SEQ ID NO: 615255 - DNA, 14 bp, Homo sapiens
ttgatagtttacaa

SEQ ID NO: 615256 - DNA, 13 bp, Homo sapiens
ttgatatacagac

SEQ ID NO: 615257 - DNA, 15 bp, Homo sapiens
ttgatatacagacct

SEQ ID NO: 615258 - DNA, 15 bp, Homo sapiens
ttgatatcacagtct

SEQ ID NO: 615259 - DNA, 19 bp, Homo sapiens
ttgatatcacagtctaatt

SEQ ID NO: 615260 - DNA, 13 bp, Homo sapiens
ttgattcaaataa

SEQ ID NO: 615261 - DNA, 22 bp, Homo sapiens
ttgattcaagggcctagatttg

SEQ ID NO: 615262 - DNA, 16 bp, Homo sapiens
ttgattgtcaaataca

SEQ ID NO: 615263 - DNA, 22 bp, Homo sapiens
ttgatttgcaacactgccaaac

SEQ ID NO: 615264 - DNA, 15 bp, Homo sapiens
ttgcaacactgccaa

SEQ ID NO: 615265 - DNA, 16 bp, Homo sapiens
ttgcaacactgccaaa

SEQ ID NO: 615266 - DNA, 23 bp, Homo sapiens
ttgcaataaactcagtcaaatgt

SEQ ID NO: 615267 - DNA, 21 bp, Homo sapiens
ttgcactaaaagtgatgtgat

SEQ ID NO: 615268 - DNA, 15 bp, Homo sapiens
ttgcactgtatccaa

SEQ ID NO: 615269 - DNA, 13 bp, Homo sapiens
ttgcacttctgtt

SEQ ID NO: 615270 - DNA, 19 bp, Homo sapiens
ttgcacttctgttatcagg

SEQ ID NO: 615271 - DNA, 13 bp, Homo sapiens
ttgcagaaaaaga

SEQ ID NO: 615272 - DNA, 20 bp, Homo sapiens
ttgcagctatggacaattta

SEQ ID NO: 615273 - DNA, 17 bp, Homo sapiens
ttgcaggcccagcagac

SEQ ID NO: 615274 - DNA, 13 bp, Homo sapiens
ttgcagtaaagtt

SEQ ID NO: 615275 - DNA, 14 bp, Homo sapiens
ttgcagttatgtta

SEQ ID NO: 615276 - DNA, 21 bp, Homo sapiens
ttgcatcacaatttgttgaat

SEQ ID NO: 615277 - DNA, 21 bp, Homo sapiens
ttgcatgtttaataatatgta

SEQ ID NO: 615278 - DNA, 23 bp, Homo sapiens
ttgccaatgaactctttccccag

SEQ ID NO: 615279 - DNA, 20 bp, Homo sapiens
ttgccacattgcttcattaa

SEQ ID NO: 615280 - DNA, 15 bp, Homo sapiens
ttgccatgaggcctt

SEQ ID NO: 615281 - DNA, 23 bp, Homo sapiens
ttgctaagataattaaatgaaat

SEQ ID NO: 615282 - DNA, 17 bp, Homo sapiens
ttgctacctcagtcagt

SEQ ID NO: 615283 - DNA, 14 bp, Homo sapiens
tttaagtgttctgt

SEQ ID NO: 615284 - DNA, 19 bp, Homo sapiens
tttaataatatgtacaaat

SEQ ID NO: 615285 - DNA, 22 bp, Homo sapiens
tttaataatatgtacaaataat

SEQ ID NO: 615286 - DNA, 13 bp, Homo sapiens
tttaatcatttcc

SEQ ID NO: 615287 - DNA, 11 bp, Homo sapiens
tttaatgttct

SEQ ID NO: 615288 - DNA, 20 bp, Homo sapiens
tttaattcttaccgaaatga

SEQ ID NO: 615289 - DNA, 22 bp, Homo sapiens
tttaattcttaccgaaatgaaa

SEQ ID NO: 615290 - DNA, 15 bp, Homo sapiens
tttacaaagaaacaa

SEQ ID NO: 615291 - DNA, 21 bp, Homo sapiens
tttacaaagaaacaaaatata

SEQ ID NO: 615292 - DNA, 24 bp, Homo sapiens
tttacagatgagattccctctcct

SEQ ID NO: 615293 - DNA, 18 bp, Homo sapiens
tttacattgtcctgtagc

SEQ ID NO: 615294 - DNA, 13 bp, Homo sapiens
tttaccagaagtt

SEQ ID NO: 615295 - DNA, 20 bp, Homo sapiens
tttaccatcaaacaaatcat

SEQ ID NO: 615296 - DNA, 16 bp, Homo sapiens
tttactaacactggct

SEQ ID NO: 615297 - DNA, 13 bp, Homo sapiens
tttactaacagta

SEQ ID NO: 615298 - DNA, 17 bp, Homo sapiens
tttactaacagtaactg

SEQ ID NO: 615299 - DNA, 21 bp, Homo sapiens
tttactaacagtaactgccat

SEQ ID NO: 615300 - DNA, 17 bp, Homo sapiens
tttactcaggctttcta

SEQ ID NO: 615301 - DNA, 17 bp, Homo sapiens
tttagaagagttacctt

SEQ ID NO: 615302 - DNA, 15 bp, Homo sapiens
tttagaatgaatatt

SEQ ID NO: 615303 - DNA, 15 bp, Homo sapiens
tttagagaagccata

SEQ ID NO: 615304 - DNA, 21 bp, Homo sapiens
tttaggaaagttgtgattctt

SEQ ID NO: 615305 - DNA, 13 bp, Homo sapiens
tttagtagctgat

SEQ ID NO: 615306 - DNA, 16 bp, Homo sapiens
tttagtcctcaccttc

SEQ ID NO: 615307 - DNA, 13 bp, Homo sapiens
tttatacacacag

SEQ ID NO: 615308 - DNA, 12 bp, Homo sapiens
tttatacacata

SEQ ID NO: 615309 - DNA, 20 bp, Homo sapiens
tttatagagttcatagaaat

SEQ ID NO: 615310 - DNA, 15 bp, Homo sapiens
tttatcatgtgtttc

SEQ ID NO: 615311 - DNA, 10 bp, Homo sapiens
tttatgcatt

SEQ ID NO: 615312 - DNA, 11 bp, Homo sapiens
tttatgcattt

SEQ ID NO: 615313 - DNA, 16 bp, Homo sapiens
tttatgcatttatgca

SEQ ID NO: 615314 - DNA, 19 bp, Homo sapiens
tttatgcatttatgcatga

SEQ ID NO: 615315 - DNA, 22 bp, Homo sapiens
tttatgtcccttcacatagttt

SEQ ID NO: 615316 - DNA, 18 bp, Homo sapiens
tttatgtttaaaatggca

SEQ ID NO: 615317 - DNA, 19 bp, Homo sapiens
tttatgtttaaaatggcat

SEQ ID NO: 615318 - DNA, 21 bp, Homo sapiens
tttattctgtcaatgaaaagc

SEQ ID NO: 615319 - DNA, 16 bp, Homo sapiens
tttattgtaacagaca

SEQ ID NO: 615320 - DNA, 20 bp, Homo sapiens
tttattgtaacagacattgt

SEQ ID NO: 615321 - DNA, 16 bp, Homo sapiens
tttcaaagaaaacaga

SEQ ID NO: 615322 - DNA, 20 bp, Homo sapiens
tttcaaagaaaacagaccag

SEQ ID NO: 615323 - DNA, 19 bp, Homo sapiens
tttcaaagacttcatttaa

SEQ ID NO: 615324 - DNA, 20 bp, Homo sapiens
tttcaaagacttcatttaac

SEQ ID NO: 615325 - DNA, 23 bp, Homo sapiens
tttcaaagacttcatttaacact

SEQ ID NO: 615326 - DNA, 12 bp, Homo sapiens
tttcaataggaa

SEQ ID NO: 615327 - DNA, 23 bp, Homo sapiens
tttcaatccacagtattgttctt

SEQ ID NO: 615328 - DNA, 14 bp, Homo sapiens
tttcacatctgtat

SEQ ID NO: 615329 - DNA, 15 bp, Homo sapiens
tttcacatctgtata

SEQ ID NO: 615330 - DNA, 18 bp, Homo sapiens
tttcacttcttaaggaca

SEQ ID NO: 615331 - DNA, 18 bp, Homo sapiens
tttcagattgtaaaggta

SEQ ID NO: 615332 - DNA, 16 bp, Homo sapiens
tcccatggccttccct

SEQ ID NO: 615333 - DNA, 23 bp, Homo sapiens
tcccatttccttgtctaaagatc

SEQ ID NO: 615334 - DNA, 13 bp, Homo sapiens
tccccaaggaaga

SEQ ID NO: 615335 - DNA, 12 bp, Homo sapiens
tccccactcccg

SEQ ID NO: 615336 - DNA, 17 bp, Homo sapiens
tccccactcccgtgatg

SEQ ID NO: 615337 - DNA, 14 bp, Homo sapiens
tccccagagccctg

SEQ ID NO: 615338 - DNA, 21 bp, Homo sapiens
tccccagagccctgcagtcac

SEQ ID NO: 615339 - DNA, 17 bp, Homo sapiens
tccccagctgattagtg

SEQ ID NO: 615340 - DNA, 12 bp, Homo sapiens
tccccagtgtgg

SEQ ID NO: 615341 - DNA, 21 bp, Homo sapiens
tccccagttaatgtgccaaaa

SEQ ID NO: 615342 - DNA, 18 bp, Homo sapiens
tccccatcgccttctggg

SEQ ID NO: 615343 - DNA, 18 bp, Homo sapiens
tccccatggaacagccct

SEQ ID NO: 615344 - DNA, 19 bp, Homo sapiens
tccccatggaacagccctg

SEQ ID NO: 615345 - DNA, 20 bp, Homo sapiens
tccccatggaacagccctgc

SEQ ID NO: 615346 - DNA, 16 bp, Homo sapiens
tccccattcagtgaca

SEQ ID NO: 615347 - DNA, 17 bp, Homo sapiens
tcccccaggctgcgcct

SEQ ID NO: 615348 - DNA, 22 bp, Homo sapiens
tcccccaggctgcgcctgcccg

SEQ ID NO: 615349 - DNA, 12 bp, Homo sapiens
tcccccagggtc

SEQ ID NO: 615350 - DNA, 18 bp, Homo sapiens
tcccccagggtcccctgc

SEQ ID NO: 615351 - DNA, 21 bp, Homo sapiens
tccccctacagatcctccgcg

SEQ ID NO: 615352 - DNA, 21 bp, Homo sapiens
tccccctcagctctccctcac

SEQ ID NO: 615353 - DNA, 14 bp, Homo sapiens
tccccctcctgcac

SEQ ID NO: 615354 - DNA, 11 bp, Homo sapiens
tcccccttccc

SEQ ID NO: 615355 - DNA, 15 bp, Homo sapiens
tccccgcccgccctc

SEQ ID NO: 615356 - DNA, 16 bp, Homo sapiens
tccccgcccgccctcc

SEQ ID NO: 615357 - DNA, 19 bp, Homo sapiens
tccccgcccgccctcctct

SEQ ID NO: 615358 - DNA, 23 bp, Homo sapiens
tccccgcccgccctcctctgccc

SEQ ID NO: 615359 - DNA, 18 bp, Homo sapiens
tccccggacgctggctcg

SEQ ID NO: 615360 - DNA, 19 bp, Homo sapiens
tccccgtgctcacagtagc

SEQ ID NO: 615361 - DNA, 12 bp, Homo sapiens
tcccctccagac

SEQ ID NO: 615362 - DNA, 14 bp, Homo sapiens
tcccctccagaccc

SEQ ID NO: 615363 - DNA, 17 bp, Homo sapiens
tcccctgcgccctccct

SEQ ID NO: 615364 - DNA, 20 bp, Homo sapiens
tcccctgcgccctccctccc

SEQ ID NO: 615365 - DNA, 20 bp, Homo sapiens
tcccctggaagttgtccttt

SEQ ID NO: 615366 - DNA, 18 bp, Homo sapiens
tcccctggtcctgcactg

SEQ ID NO: 615367 - DNA, 18 bp, Homo sapiens
tcccctgtggtttgttat

SEQ ID NO: 615368 - DNA, 22 bp, Homo sapiens
tccccttcgcgtatttcaggat

SEQ ID NO: 615369 - DNA, 18 bp, Homo sapiens
tcccgccgcctcgggccg

SEQ ID NO: 615370 - DNA, 22 bp, Homo sapiens
tcccgccgcctcgggccgcctc

SEQ ID NO: 615371 - DNA, 15 bp, Homo sapiens
tcccggccccgcgcg

SEQ ID NO: 615372 - DNA, 19 bp, Homo sapiens
tcccggccccgcgcgtgcc

SEQ ID NO: 615373 - DNA, 19 bp, Homo sapiens
tcccggctctgaggctgcc

SEQ ID NO: 615374 - DNA, 14 bp, Homo sapiens
tcccggtgtgcagc

SEQ ID NO: 615375 - DNA, 18 bp, Homo sapiens
tcccgtccgtccgcccgc

SEQ ID NO: 615376 - DNA, 23 bp, Homo sapiens
tcccgtccgtccgcccgcccacc

SEQ ID NO: 615377 - DNA, 19 bp, Homo sapiens
tcccgtgccctgtttccaa

SEQ ID NO: 615378 - DNA, 17 bp, Homo sapiens
tccctaccctcttctca

SEQ ID NO: 615379 - DNA, 18 bp, Homo sapiens
tccctaccctcttctcag

SEQ ID NO: 615380 - DNA, 14 bp, Homo sapiens
tccctcagccctca

SEQ ID NO: 615381 - DNA, 17 bp, Homo sapiens
tccctcagccctcatta

SEQ ID NO: 615382 - DNA, 9 bp, Homo sapiens
tccctccac

SEQ ID NO: 615383 - DNA, 19 bp, Homo sapiens
tccctccacacctccaccc

SEQ ID NO: 615384 - DNA, 22 bp, Homo sapiens
tccctccacacctccacccgtc

SEQ ID NO: 615385 - DNA, 15 bp, Homo sapiens
tccctccactcctcc

SEQ ID NO: 615386 - DNA, 17 bp, Homo sapiens
tccctccactcctccca

SEQ ID NO: 615387 - DNA, 22 bp, Homo sapiens
tccctccccacagtcctcacag

SEQ ID NO: 615388 - DNA, 14 bp, Homo sapiens
tccctccctccaca

SEQ ID NO: 615389 - DNA, 16 bp, Homo sapiens
tccctcgggctggtgt

SEQ ID NO: 615390 - DNA, 18 bp, Homo sapiens
tccctcggtcagcaccgt

SEQ ID NO: 615391 - DNA, 17 bp, Homo sapiens
tagctgtttactgacat

SEQ ID NO: 615392 - DNA, 22 bp, Homo sapiens
tagcttagaccgtggtgtcctc

SEQ ID NO: 615393 - DNA, 21 bp, Homo sapiens
tagcttctgaaaggtgctttc

SEQ ID NO: 615394 - DNA, 17 bp, Homo sapiens
tagctttaaaaccacag

SEQ ID NO: 615395 - DNA, 19 bp, Homo sapiens
tagctttaaaaccacagct

SEQ ID NO: 615396 - DNA, 20 bp, Homo sapiens
tagctttagagaagccataa

SEQ ID NO: 615397 - DNA, 21 bp, Homo sapiens
tagctttgcaaccttgtactt

SEQ ID NO: 615398 - DNA, 19 bp, Homo sapiens
tagcttttcacttcttaag

SEQ ID NO: 615399 - DNA, 21 bp, Homo sapiens
taggaaagcctcactgatata

SEQ ID NO: 615400 - DNA, 19 bp, Homo sapiens
taggaaataaatctaaata

SEQ ID NO: 615401 - DNA, 18 bp, Homo sapiens
taggaaatgaatgtgtgt

SEQ ID NO: 615402 - DNA, 15 bp, Homo sapiens
taggaataacactgc

SEQ ID NO: 615403 - DNA, 16 bp, Homo sapiens
taggaatgctcaatgt

SEQ ID NO: 615404 - DNA, 18 bp, Homo sapiens
taggacatctctgtaaaa

SEQ ID NO: 615405 - DNA, 15 bp, Homo sapiens
taggagcttccagat

SEQ ID NO: 615406 - DNA, 19 bp, Homo sapiens
taggagcttccagatgggt

SEQ ID NO: 615407 - DNA, 12 bp, Homo sapiens
taggcagggagg

SEQ ID NO: 615408 - DNA, 13 bp, Homo sapiens
taggcagggaggg

SEQ ID NO: 615409 - DNA, 15 bp, Homo sapiens
tagggaattttcatt

SEQ ID NO: 615410 - DNA, 19 bp, Homo sapiens
tagggaattttcattttca

SEQ ID NO: 615411 - DNA, 16 bp, Homo sapiens
taggggcaaaaatttg

SEQ ID NO: 615412 - DNA, 23 bp, Homo sapiens
taggggcaaaaatttgacattgt

SEQ ID NO: 615413 - DNA, 14 bp, Homo sapiens
taggggtgggggag

SEQ ID NO: 615414 - DNA, 20 bp, Homo sapiens
taggggtgggggagaatggc

SEQ ID NO: 615415 - DNA, 15 bp, Homo sapiens
taggtctccacccct

SEQ ID NO: 615416 - DNA, 17 bp, Homo sapiens
taggttaataggaggac

SEQ ID NO: 615417 - DNA, 21 bp, Homo sapiens
taggtttagaatcaagtctgt

SEQ ID NO: 615418 - DNA, 23 bp, Homo sapiens
taggtttagaatcaagtctgtga

SEQ ID NO: 615419 - DNA, 18 bp, Homo sapiens
tagtaacagtatttccat

SEQ ID NO: 615420 - DNA, 18 bp, Homo sapiens
tagtagctgataaagaaa

SEQ ID NO: 615421 - DNA, 12 bp, Homo sapiens
tagtattttgag

SEQ ID NO: 615422 - DNA, 22 bp, Homo sapiens
tagtattttgagccttattaaa

SEQ ID NO: 615423 - DNA, 15 bp, Homo sapiens
tagtctgtacttcag

SEQ ID NO: 615424 - DNA, 19 bp, Homo sapiens
tagtgaaaattttattgaa

SEQ ID NO: 615425 - DNA, 24 bp, Homo sapiens
tagtgcctgtgatcgtgtgttgcc

SEQ ID NO: 615426 - DNA, 13 bp, Homo sapiens
tagtggtatttta

SEQ ID NO: 615427 - DNA, 20 bp, Homo sapiens
tagtgtcccttacctggctt

SEQ ID NO: 615428 - DNA, 19 bp, Homo sapiens
tagtgttttcattctggtc

SEQ ID NO: 615429 - DNA, 13 bp, Homo sapiens
tagttctgctgcc

SEQ ID NO: 615430 - DNA, 19 bp, Homo sapiens
tagttgagccagcagacat

SEQ ID NO: 615431 - DNA, 21 bp, Homo sapiens
tagttgagccagcagacattg

SEQ ID NO: 615432 - DNA, 17 bp, Homo sapiens
tagttgctccaactgaa

SEQ ID NO: 615433 - DNA, 11 bp, Homo sapiens
tataaactgtg

SEQ ID NO: 615434 - DNA, 18 bp, Homo sapiens
tataaactgtgagataaa

SEQ ID NO: 615435 - DNA, 20 bp, Homo sapiens
tataaatgaatgaaatataa

SEQ ID NO: 615436 - DNA, 12 bp, Homo sapiens
tataacatgaaa

SEQ ID NO: 615437 - DNA, 17 bp, Homo sapiens
tataacattgtaaatga

SEQ ID NO: 615438 - DNA, 19 bp, Homo sapiens
tataacattgtatgttaat

SEQ ID NO: 615439 - DNA, 20 bp, Homo sapiens
tataagagacaaagtttgga

SEQ ID NO: 615440 - DNA, 21 bp, Homo sapiens
tataagccatagccccaggcc

SEQ ID NO: 615441 - DNA, 14 bp, Homo sapiens
tataagtagaattc

SEQ ID NO: 615442 - DNA, 13 bp, Homo sapiens
tataatcaaaata

SEQ ID NO: 615443 - DNA, 22 bp, Homo sapiens
tataatcaaaataatacttcat

SEQ ID NO: 615444 - DNA, 17 bp, Homo sapiens
tataatggcctcttaaa

SEQ ID NO: 615445 - DNA, 21 bp, Homo sapiens
tataatttgccagacagagat

SEQ ID NO: 615446 - DNA, 19 bp, Homo sapiens
tataattttattgctggaa

SEQ ID NO: 615447 - DNA, 13 bp, Homo sapiens
tatacaaacaggt

SEQ ID NO: 615448 - DNA, 17 bp, Homo sapiens
tatacaaacaggtgcta

SEQ ID NO: 615449 - DNA, 14 bp, Homo sapiens
tatacaaagctgtc

SEQ ID NO: 615450 - DNA, 22 bp, Homo sapiens
tatacaaagctgtcactcacaa

SEQ ID NO: 615451 - DNA, 11 bp, Homo sapiens
tatacacataa

SEQ ID NO: 615452 - DNA, 13 bp, Homo sapiens
tatacatacgcaa

SEQ ID NO: 615453 - DNA, 22 bp, Homo sapiens
tatacatacgcaattgtatata

SEQ ID NO: 615454 - DNA, 16 bp, Homo sapiens
tataccagcaaaagtg

SEQ ID NO: 615455 - DNA, 20 bp, Homo sapiens
tataccccgtgaagcatcca

SEQ ID NO: 615456 - DNA, 21 bp, Homo sapiens
tataccccgtgaagcatccag

SEQ ID NO: 615457 - DNA, 21 bp, Homo sapiens
tataccctaggtctccacccc

SEQ ID NO: 615458 - DNA, 13 bp, Homo sapiens
tatactcatttgg

SEQ ID NO: 615459 - DNA, 15 bp, Homo sapiens
tatactcatttggat

SEQ ID NO: 615460 - DNA, 19 bp, Homo sapiens
tatactccttaaaaatgta

SEQ ID NO: 615461 - DNA, 13 bp, Homo sapiens
tatacttcaaatg

SEQ ID NO: 615462 - DNA, 21 bp, Homo sapiens
tatacttcaaatgtcatttca

SEQ ID NO: 615463 - DNA, 18 bp, Homo sapiens
tataggaaataaatctaa

SEQ ID NO: 615464 - DNA, 15 bp, Homo sapiens
tataggacttaattt

SEQ ID NO: 615465 - DNA, 13 bp, Homo sapiens
tatagggtttgtt

SEQ ID NO: 615466 - DNA, 15 bp, Homo sapiens
tatagtgttgtgtta

SEQ ID NO: 615467 - DNA, 15 bp, Homo sapiens
tatataaaatacacg

SEQ ID NO: 615468 - DNA, 16 bp, Homo sapiens
tatataaaatacacgt

SEQ ID NO: 615469 - DNA, 23 bp, Homo sapiens
tatataaaatacacgtgtatatg

SEQ ID NO: 615470 - DNA, 19 bp, Homo sapiens
tatataaatatctatttat

SEQ ID NO: 615471 - DNA, 18 bp, Homo sapiens
tatataattttattgctg

SEQ ID NO: 615472 - DNA, 12 bp, Homo sapiens
tatatacatacg

SEQ ID NO: 615473 - DNA, 21 bp, Homo sapiens
tatatacatacgcaattgtat

SEQ ID NO: 615474 - DNA, 20 bp, Homo sapiens
tatatataaaatacacgtgt

SEQ ID NO: 615475 - DNA, 22 bp, Homo sapiens
tatatataaaatacacgtgtat

SEQ ID NO: 615476 - DNA, 18 bp, Homo sapiens
tatatataaatatctatt

SEQ ID NO: 615477 - DNA, 13 bp, Homo sapiens
tatatattatata

SEQ ID NO: 615478 - DNA, 17 bp, Homo sapiens
tatatattctttcacaa

SEQ ID NO: 615479 - DNA, 12 bp, Homo sapiens
tatatcagctct

SEQ ID NO: 615480 - DNA, 19 bp, Homo sapiens
tattgccttgatgtttcta

SEQ ID NO: 615481 - DNA, 14 bp, Homo sapiens
tattgcgagaaaca

SEQ ID NO: 615482 - DNA, 17 bp, Homo sapiens
tattgctgatggtgcaa

SEQ ID NO: 615483 - DNA, 22 bp, Homo sapiens
tattgctgatggtgcaatgacc

SEQ ID NO: 615484 - DNA, 14 bp, Homo sapiens
tattgctgtaaata

SEQ ID NO: 615485 - DNA, 21 bp, Homo sapiens
tattgctgtaaataaaaatag

SEQ ID NO: 615486 - DNA, 15 bp, Homo sapiens
tattggcataaaaca

SEQ ID NO: 615487 - DNA, 21 bp, Homo sapiens
tattgttcttgtaaaactgtg

SEQ ID NO: 615488 - DNA, 20 bp, Homo sapiens
tatttaaatgtctaatgtat

SEQ ID NO: 615489 - DNA, 19 bp, Homo sapiens
tatttaagtggactgtatt

SEQ ID NO: 615490 - DNA, 20 bp, Homo sapiens
tatttaagtggactgtattt

SEQ ID NO: 615491 - DNA, 21 bp, Homo sapiens
tatttaagtggactgtatttc

SEQ ID NO: 615492 - DNA, 23 bp, Homo sapiens
tatttaccagaagtttaaatctt

SEQ ID NO: 615493 - DNA, 18 bp, Homo sapiens
tatttactgcaatgtctg

SEQ ID NO: 615494 - DNA, 19 bp, Homo sapiens
tatttactgcaatgtctgt

SEQ ID NO: 615495 - DNA, 17 bp, Homo sapiens
tatttatagagttatta

SEQ ID NO: 615496 - DNA, 17 bp, Homo sapiens
tatttatcatatttaat

SEQ ID NO: 615497 - DNA, 21 bp, Homo sapiens
tatttattgtatatatggata

SEQ ID NO: 615498 - DNA, 14 bp, Homo sapiens
tatttcaaccacac

SEQ ID NO: 615499 - DNA, 21 bp, Homo sapiens
tatttcaaccacacctaaatt

SEQ ID NO: 615500 - DNA, 14 bp, Homo sapiens
tatttcaaggaata

SEQ ID NO: 615501 - DNA, 16 bp, Homo sapiens
tatttcggctatgtct

SEQ ID NO: 615502 - DNA, 16 bp, Homo sapiens
tatttctgctgaattt

SEQ ID NO: 615503 - DNA, 21 bp, Homo sapiens
tatttctgctgaattttcaca

SEQ ID NO: 615504 - DNA, 18 bp, Homo sapiens
tatttgcataatatgcat

SEQ ID NO: 615505 - DNA, 23 bp, Homo sapiens
tatttgctaattaaaaagttaat

SEQ ID NO: 615506 - DNA, 21 bp, Homo sapiens
tatttgctcataagtaaatgt

SEQ ID NO: 615507 - DNA, 22 bp, Homo sapiens
tatttggatgtgagtttaatct

SEQ ID NO: 615508 - DNA, 20 bp, Homo sapiens
tatttgtcagtgtagatcaa

SEQ ID NO: 615509 - DNA, 14 bp, Homo sapiens
tatttgtgtaactg

SEQ ID NO: 615510 - DNA, 15 bp, Homo sapiens
tatttgtttggtcac

SEQ ID NO: 615511 - DNA, 19 bp, Homo sapiens
tattttaggaaactctcca

SEQ ID NO: 615512 - DNA, 12 bp, Homo sapiens
tattttctatat

SEQ ID NO: 615513 - DNA, 22 bp, Homo sapiens
tattttctgagtagcatatata

SEQ ID NO: 615514 - DNA, 14 bp, Homo sapiens
tattttctgtaatt

SEQ ID NO: 615515 - DNA, 13 bp, Homo sapiens
tacatctgtcagt

SEQ ID NO: 615516 - DNA, 22 bp, Homo sapiens
tacatgcctttccagtgctgct

SEQ ID NO: 615517 - DNA, 15 bp, Homo sapiens
tacatgggccagccc

SEQ ID NO: 615518 - DNA, 16 bp, Homo sapiens
tacatgggccagccct

SEQ ID NO: 615519 - DNA, 16 bp, Homo sapiens
tacattagtgagattt

SEQ ID NO: 615520 - DNA, 21 bp, Homo sapiens
tacattcttgctctgctcatc

SEQ ID NO: 615521 - DNA, 16 bp, Homo sapiens
tacattgtcctgtagc

SEQ ID NO: 615522 - DNA, 21 bp, Homo sapiens
tacattttgcagctatggaca

SEQ ID NO: 615523 - DNA, 16 bp, Homo sapiens
taccaactaagttgta

SEQ ID NO: 615524 - DNA, 20 bp, Homo sapiens
taccatagcttaagaagtat

SEQ ID NO: 615525 - DNA, 13 bp, Homo sapiens
taccatcaaacaa

SEQ ID NO: 615526 - DNA, 15 bp, Homo sapiens
taccattaaaatctt

SEQ ID NO: 615527 - DNA, 21 bp, Homo sapiens
taccattatggctttgtgctt

SEQ ID NO: 615528 - DNA, 19 bp, Homo sapiens
taccccaggacgcatgcag

SEQ ID NO: 615529 - DNA, 19 bp, Homo sapiens
taccccaggatgcatgcag

SEQ ID NO: 615530 - DNA, 18 bp, Homo sapiens
taccctaggtctccaccc

SEQ ID NO: 615531 - DNA, 21 bp, Homo sapiens
taccctaggtctccacccctc

SEQ ID NO: 615532 - DNA, 15 bp, Homo sapiens
taccctccctgtccc

SEQ ID NO: 615533 - DNA, 21 bp, Homo sapiens
taccctcttctcagctccact

SEQ ID NO: 615534 - DNA, 15 bp, Homo sapiens
taccgaaatgaaaat

SEQ ID NO: 615535 - DNA, 18 bp, Homo sapiens
taccgcccacccagcagc

SEQ ID NO: 615536 - DNA, 19 bp, Homo sapiens
taccgcccacccagcagcg

SEQ ID NO: 615537 - DNA, 22 bp, Homo sapiens
taccgcccacccagcagcgccc

SEQ ID NO: 615538 - DNA, 15 bp, Homo sapiens
tacctaacaatgttt

SEQ ID NO: 615539 - DNA, 20 bp, Homo sapiens
tacctgaaagcccttctcaa

SEQ ID NO: 615540 - DNA, 20 bp, Homo sapiens
tacctggcttagcgttctgt

SEQ ID NO: 615541 - DNA, 23 bp, Homo sapiens
tacctgtaatagcctcaccttcc

SEQ ID NO: 615542 - DNA, 17 bp, Homo sapiens
tacctgtgaatcaaaac

SEQ ID NO: 615543 - DNA, 22 bp, Homo sapiens
tacggtacaagctacatatgta

SEQ ID NO: 615544 - DNA, 15 bp, Homo sapiens
tacggtgagactctg

SEQ ID NO: 615545 - DNA, 15 bp, Homo sapiens
tacgttaattaaaca

SEQ ID NO: 615546 - DNA, 23 bp, Homo sapiens
tactaacgaccgacgcccctccg

SEQ ID NO: 615547 - DNA, 15 bp, Homo sapiens
tactagcaataagtt

SEQ ID NO: 615548 - DNA, 15 bp, Homo sapiens
tactataattgagaa

SEQ ID NO: 615549 - DNA, 20 bp, Homo sapiens
tactatggtatatattttga

SEQ ID NO: 615550 - DNA, 15 bp, Homo sapiens
tactcaggctttcta

SEQ ID NO: 615551 - DNA, 17 bp, Homo sapiens
tactcatccttgtataa

SEQ ID NO: 615552 - DNA, 20 bp, Homo sapiens
tactcatttggatataaatc

SEQ ID NO: 615553 - DNA, 24 bp, Homo sapiens
tactcctccccctcctccatgctg

SEQ ID NO: 615554 - DNA, 21 bp, Homo sapiens
tactccttaaaaatgtatgtt

SEQ ID NO: 615555 - DNA, 12 bp, Homo sapiens
tactctagattt

SEQ ID NO: 615556 - DNA, 16 bp, Homo sapiens
tactctagattttgtt

SEQ ID NO: 615557 - DNA, 23 bp, Homo sapiens
tactgaattgttatgtaaacatc

SEQ ID NO: 615558 - DNA, 17 bp, Homo sapiens
tactgacatggtgctgt

SEQ ID NO: 615559 - DNA, 19 bp, Homo sapiens
tactgacatggtgctgtgt

SEQ ID NO: 615560 - DNA, 15 bp, Homo sapiens
tactgttttgggcct

SEQ ID NO: 615561 - DNA, 20 bp, Homo sapiens
tacttaaacaaaaactttcc

SEQ ID NO: 615562 - DNA, 21 bp, Homo sapiens
tacttacacacctgagaatgt

SEQ ID NO: 615563 - DNA, 22 bp, Homo sapiens
tacttacacacctgagaatgtg

SEQ ID NO: 615564 - DNA, 20 bp, Homo sapiens
tacttatttataacattgta

SEQ ID NO: 615565 - DNA, 18 bp, Homo sapiens
tacttcaaatgtcatttc

SEQ ID NO: 615566 - DNA, 16 bp, Homo sapiens
tacttcagttctcatc

SEQ ID NO: 615567 - DNA, 14 bp, Homo sapiens
tacttctttttggt

SEQ ID NO: 615568 - DNA, 15 bp, Homo sapiens
tacttgtgttcattg

SEQ ID NO: 615569 - DNA, 15 bp, Homo sapiens
tactttacaatcatg

SEQ ID NO: 615570 - DNA, 13 bp, Homo sapiens
tactttgtgtctt

SEQ ID NO: 615571 - DNA, 15 bp, Homo sapiens
tagaaaaaactggaa

SEQ ID NO: 615572 - DNA, 23 bp, Homo sapiens
tagaaaaaactggaaacatctga

SEQ ID NO: 615573 - DNA, 16 bp, Homo sapiens
tagaaactttggaagt

SEQ ID NO: 615574 - DNA, 14 bp, Homo sapiens
tagaaattctataa

SEQ ID NO: 615575 - DNA, 20 bp, Homo sapiens
tagaaattctataagagaca

SEQ ID NO: 615576 - DNA, 16 bp, Homo sapiens
tagaactttaaaagaa

SEQ ID NO: 615577 - DNA, 15 bp, Homo sapiens
tagaagagcctgact

SEQ ID NO: 615578 - DNA, 17 bp, Homo sapiens
tagaagagcctgactgt

SEQ ID NO: 615579 - DNA, 23 bp, Homo sapiens
tagaataggcaaacttttatgca

SEQ ID NO: 615580 - DNA, 15 bp, Homo sapiens
tagaatcaagtctgt

SEQ ID NO: 615581 - DNA, 17 bp, Homo sapiens
tagaatcaagtctgtga

SEQ ID NO: 615582 - DNA, 13 bp, Homo sapiens
tagaatgagaaat

SEQ ID NO: 615583 - DNA, 12 bp, Homo sapiens
tagaatgtgaaa

SEQ ID NO: 615584 - DNA, 13 bp, Homo sapiens
tagaatgtgaaaa

SEQ ID NO: 615585 - DNA, 12 bp, Homo sapiens
tagacaatgtgg

SEQ ID NO: 615586 - DNA, 17 bp, Homo sapiens
tagacaatgtggaatta

SEQ ID NO: 615587 - DNA, 21 bp, Homo sapiens
tagacaatgtggaattacata

SEQ ID NO: 615588 - DNA, 23 bp, Homo sapiens
tagacaatgtggaattacataac

SEQ ID NO: 615589 - DNA, 23 bp, Homo sapiens
tagacagaggtttcattttcatc

SEQ ID NO: 615590 - DNA, 17 bp, Homo sapiens
tagaccgtggtgtcctc

SEQ ID NO: 615591 - DNA, 14 bp, Homo sapiens
tagagattgacttc

SEQ ID NO: 615592 - DNA, 21 bp, Homo sapiens
tagagattgacttcagaaact

SEQ ID NO: 615593 - DNA, 22 bp, Homo sapiens
tagagattgacttcagaaactt

SEQ ID NO: 615594 - DNA, 23 bp, Homo sapiens
tagagcattctggggtggggctt

SEQ ID NO: 615595 - DNA, 17 bp, Homo sapiens
tagagctatgcacacca

SEQ ID NO: 615596 - DNA, 16 bp, Homo sapiens
tagatatgagaaatat

SEQ ID NO: 615597 - DNA, 21 bp, Homo sapiens
tagatcccacgttgatgtctg

SEQ ID NO: 615598 - DNA, 18 bp, Homo sapiens
tagatgaaaaagcatgta

SEQ ID NO: 615599 - DNA, 20 bp, Homo sapiens
tagatgaaaaagcatgtaca

SEQ ID NO: 615600 - DNA, 22 bp, Homo sapiens
tagatgaaaaagcatgtacagt

SEQ ID NO: 615601 - DNA, 23 bp, Homo sapiens
tagatgaaaaagcatgtacagtg

SEQ ID NO: 615602 - DNA, 14 bp, Homo sapiens
tagatgtgaaaatg

SEQ ID NO: 615603 - DNA, 18 bp, Homo sapiens
tagattcattaggttgaa

SEQ ID NO: 615604 - DNA, 16 bp, Homo sapiens
tagattcctacttaaa

SEQ ID NO: 615605 - DNA, 19 bp, Homo sapiens
tagattcctacttaaacaa

SEQ ID NO: 615606 - DNA, 14 bp, Homo sapiens
tagattttcatgtt

SEQ ID NO: 615607 - DNA, 14 bp, Homo sapiens
tagatttttagatt

SEQ ID NO: 615608 - DNA, 18 bp, Homo sapiens
tagcaataagttgaatga

SEQ ID NO: 615609 - DNA, 16 bp, Homo sapiens
tagcacagaggatggc

SEQ ID NO: 615610 - DNA, 13 bp, Homo sapiens
tagcacatgtttt

SEQ ID NO: 615611 - DNA, 16 bp, Homo sapiens
tagcacatgttttaca

SEQ ID NO: 615612 - DNA, 12 bp, Homo sapiens
tagcactttata

SEQ ID NO: 615613 - DNA, 16 bp, Homo sapiens
tagcatactgatgaga

SEQ ID NO: 615614 - DNA, 20 bp, Homo sapiens
tgctgctctctaagaattca

SEQ ID NO: 615615 - DNA, 14 bp, Homo sapiens
tgctggctggggcc

SEQ ID NO: 615616 - DNA, 22 bp, Homo sapiens
tgctggctggggccggggctgc

SEQ ID NO: 615617 - DNA, 14 bp, Homo sapiens
tgctgggccaggga

SEQ ID NO: 615618 - DNA, 13 bp, Homo sapiens
tgctggggcaggg

SEQ ID NO: 615619 - DNA, 16 bp, Homo sapiens
tgctggggcagggccc

SEQ ID NO: 615620 - DNA, 21 bp, Homo sapiens
tgctggggcagggcccaggga

SEQ ID NO: 615621 - DNA, 18 bp, Homo sapiens
tgctgtaaataaaaatag

SEQ ID NO: 615622 - DNA, 19 bp, Homo sapiens
tgctgtatacaaacaggtg

SEQ ID NO: 615623 - DNA, 22 bp, Homo sapiens
tgctgtatacaaacaggtgcta

SEQ ID NO: 615624 - DNA, 11 bp, Homo sapiens
tgctgtatttg

SEQ ID NO: 615625 - DNA, 15 bp, Homo sapiens
tgctgtccctgtggg

SEQ ID NO: 615626 - DNA, 17 bp, Homo sapiens
tgatttttttttccttc

SEQ ID NO: 615627 - DNA, 19 bp, Homo sapiens
tgatttttttttccttcag

SEQ ID NO: 615628 - DNA, 23 bp, Homo sapiens
tgcaaaatacatgatgatttcag

SEQ ID NO: 615629 - DNA, 21 bp, Homo sapiens
tgcaaaccatcattgaaatct

SEQ ID NO: 615630 - DNA, 21 bp, Homo sapiens
tgcaaatattgctattgttta

SEQ ID NO: 615631 - DNA, 17 bp, Homo sapiens
tgcaaccttgtacttta

SEQ ID NO: 615632 - DNA, 17 bp, Homo sapiens
tgcaacttgagggacga

SEQ ID NO: 615633 - DNA, 16 bp, Homo sapiens
tgcaataaactcagtc

SEQ ID NO: 615634 - DNA, 19 bp, Homo sapiens
tgcaataacagttttaaga

SEQ ID NO: 615635 - DNA, 23 bp, Homo sapiens
tgcaatgacctttcaataggaaa

SEQ ID NO: 615636 - DNA, 18 bp, Homo sapiens
tgcacacaggagaaaatg

SEQ ID NO: 615637 - DNA, 20 bp, Homo sapiens
tgcacacataacacacatca

SEQ ID NO: 615638 - DNA, 19 bp, Homo sapiens
tgcacaccaaattgctgag

SEQ ID NO: 615639 - DNA, 21 bp, Homo sapiens
tgcacaccaaattgctgagat

SEQ ID NO: 615640 - DNA, 15 bp, Homo sapiens
tgcacagtggtccag

SEQ ID NO: 615641 - DNA, 13 bp, Homo sapiens
tgcacatacagat

SEQ ID NO: 615642 - DNA, 20 bp, Homo sapiens
tgcaccagtgccgcctgtgc

SEQ ID NO: 615643 - DNA, 15 bp, Homo sapiens
tgcaccctccacagg

SEQ ID NO: 615644 - DNA, 23 bp, Homo sapiens
tgcaccctctgctatgtctgtga

SEQ ID NO: 615645 - DNA, 24 bp, Homo sapiens
tgcaccctctgctatgtctgtgat

SEQ ID NO: 615646 - DNA, 17 bp, Homo sapiens
tgcacgcggactccggg

SEQ ID NO: 615647 - DNA, 16 bp, Homo sapiens
tgcactaaaagtgatg

SEQ ID NO: 615648 - DNA, 22 bp, Homo sapiens
tgcactaaaagtgatgtgattt

SEQ ID NO: 615649 - DNA, 16 bp, Homo sapiens
tgcactattcttaata

SEQ ID NO: 615650 - DNA, 22 bp, Homo sapiens
tctccctcccttctttccttcc

SEQ ID NO: 615651 - DNA, 23 bp, Homo sapiens
tctccctggggaggacccctgcc

SEQ ID NO: 615652 - DNA, 12 bp, Homo sapiens
tctccgcccccc

SEQ ID NO: 615653 - DNA, 17 bp, Homo sapiens
tctccgccccccggcct

SEQ ID NO: 615654 - DNA, 22 bp, Homo sapiens
tctccggatggaatcacagcca

SEQ ID NO: 615655 - DNA, 18 bp, Homo sapiens
tctcctccaaatgctgtc

SEQ ID NO: 615656 - DNA, 21 bp, Homo sapiens
tctcctcccatggccttccct

SEQ ID NO: 615657 - DNA, 17 bp, Homo sapiens
tctcctcccccaccttc

SEQ ID NO: 615658 - DNA, 21 bp, Homo sapiens
tctcctcgtccggcctgcagc

SEQ ID NO: 615659 - DNA, 12 bp, Homo sapiens
tctcctctccca

SEQ ID NO: 615660 - DNA, 18 bp, Homo sapiens
tctcctctctctccctcc

SEQ ID NO: 615661 - DNA, 12 bp, Homo sapiens
tctcctctgtca

SEQ ID NO: 615662 - DNA, 13 bp, Homo sapiens
tctcctctgtcag

SEQ ID NO: 615663 - DNA, 15 bp, Homo sapiens
tctcctgagcctgtc

SEQ ID NO: 615664 - DNA, 17 bp, Homo sapiens
tctcctgagcctgtctc

SEQ ID NO: 615665 - DNA, 16 bp, Homo sapiens
tctccttgtacttgaa

SEQ ID NO: 615666 - DNA, 23 bp, Homo sapiens
tctcctttgtcaaatggtatttt

SEQ ID NO: 615667 - DNA, 13 bp, Homo sapiens
tctcgcagcctga

SEQ ID NO: 615668 - DNA, 19 bp, Homo sapiens
tctcgtagaacctgcgcac

SEQ ID NO: 615669 - DNA, 22 bp, Homo sapiens
tctcgtagaacctgcgcacccc

SEQ ID NO: 615670 - DNA, 15 bp, Homo sapiens
tctctaattgattca

SEQ ID NO: 615671 - DNA, 23 bp, Homo sapiens
tctctagtgcaggaaaaggctgc

SEQ ID NO: 615672 - DNA, 16 bp, Homo sapiens
tctctcaaaatgtgcc

SEQ ID NO: 615673 - DNA, 12 bp, Homo sapiens
tctctcacccag

SEQ ID NO: 615674 - DNA, 21 bp, Homo sapiens
tctctccctccactcctccca

SEQ ID NO: 615675 - DNA, 15 bp, Homo sapiens
tctctctccctccac

SEQ ID NO: 615676 - DNA, 10 bp, Homo sapiens
tctctctctg

SEQ ID NO: 615677 - DNA, 13 bp, Homo sapiens
tctctctgtgctg

SEQ ID NO: 615678 - DNA, 13 bp, Homo sapiens
tctctctgtgtgg

SEQ ID NO: 615679 - DNA, 17 bp, Homo sapiens
tctctctgtgtggcaaa

SEQ ID NO: 615680 - DNA, 10 bp, Homo sapiens
tctctctgtt

SEQ ID NO: 615681 - DNA, 13 bp, Homo sapiens
tctctcttggtct

SEQ ID NO: 615682 - DNA, 21 bp, Homo sapiens
tctctgaactgcaacactgga

SEQ ID NO: 615683 - DNA, 20 bp, Homo sapiens
tctctgtaaaaagcaggtga

SEQ ID NO: 615684 - DNA, 15 bp, Homo sapiens
tctctgtgtggcaaa

SEQ ID NO: 615685 - DNA, 20 bp, Homo sapiens
tctctgtgtggcaaacattt

SEQ ID NO: 615686 - DNA, 21 bp, Homo sapiens
tctctgtttaccctccctgtc

SEQ ID NO: 615687 - DNA, 21 bp, Homo sapiens
tctcttaccccgtccctttcc

SEQ ID NO: 615688 - DNA, 17 bp, Homo sapiens
tctcttcttactgtatt

SEQ ID NO: 615689 - DNA, 22 bp, Homo sapiens
tctcttgctgtttaccgcccac

SEQ ID NO: 615690 - DNA, 16 bp, Homo sapiens
tctcttggtctctttc

SEQ ID NO: 615691 - DNA, 13 bp, Homo sapiens
tctctttatagag

SEQ ID NO: 615692 - DNA, 17 bp, Homo sapiens
tctgaaaggtgctttct

SEQ ID NO: 615693 - DNA, 14 bp, Homo sapiens
tctgaaatctacaa

SEQ ID NO: 615694 - DNA, 14 bp, Homo sapiens
tgaatctgagaaag

SEQ ID NO: 615695 - DNA, 22 bp, Homo sapiens
tgaatgaaatataaactgtgag

SEQ ID NO: 615696 - DNA, 16 bp, Homo sapiens
tgaatgctagacagaa

SEQ ID NO: 615697 - DNA, 12 bp, Homo sapiens
tgaatgctattt

SEQ ID NO: 615698 - DNA, 22 bp, Homo sapiens
tgaatgctatttgtgtaactga

SEQ ID NO: 615699 - DNA, 19 bp, Homo sapiens
tgaatgcttaaatgatcaa

SEQ ID NO: 615700 - DNA, 15 bp, Homo sapiens
tgaattcattgtctc

SEQ ID NO: 615701 - DNA, 21 bp, Homo sapiens
tgaattggcaaaattacagtt

SEQ ID NO: 615702 - DNA, 20 bp, Homo sapiens
tgaattgttatgtaaacatc

SEQ ID NO: 615703 - DNA, 18 bp, Homo sapiens
tgaatttaccatcaaaca

SEQ ID NO: 615704 - DNA, 17 bp, Homo sapiens
tgaatttatcattttag

SEQ ID NO: 615705 - DNA, 15 bp, Homo sapiens
tgaattttaaaatgc

SEQ ID NO: 615706 - DNA, 18 bp, Homo sapiens
tgaattttaaaatgcaaa

SEQ ID NO: 615707 - DNA, 13 bp, Homo sapiens
tgaattttcacat

SEQ ID NO: 615708 - DNA, 19 bp, Homo sapiens
tgacacattgcacacacag

SEQ ID NO: 615709 - DNA, 16 bp, Homo sapiens
tgacacgaatattgct

SEQ ID NO: 615710 - DNA, 20 bp, Homo sapiens
tgacactcagatgcccagta

SEQ ID NO: 615711 - DNA, 16 bp, Homo sapiens
tgacagaaggcccgag

SEQ ID NO: 615712 - DNA, 16 bp, Homo sapiens
tgacagcaaacacagt

SEQ ID NO: 615713 - DNA, 18 bp, Homo sapiens
tgacagcaaacacagtca

SEQ ID NO: 615714 - DNA, 23 bp, Homo sapiens
tgacagttttccataaagaagat

SEQ ID NO: 615715 - DNA, 14 bp, Homo sapiens
tgacatatttcata

SEQ ID NO: 615716 - DNA, 22 bp, Homo sapiens
tgacatgctaacctctctgaac

SEQ ID NO: 615717 - DNA, 12 bp, Homo sapiens
tgacatggtgct

SEQ ID NO: 615718 - DNA, 15 bp, Homo sapiens
tgacatggtgctgtg

SEQ ID NO: 615719 - DNA, 12 bp, Homo sapiens
tgacatgtacag

SEQ ID NO: 615720 - DNA, 17 bp, Homo sapiens
tgacatgtacagagaac

SEQ ID NO: 615721 - DNA, 13 bp, Homo sapiens
tgacattgtcaga

SEQ ID NO: 615722 - DNA, 14 bp, Homo sapiens
tgacattgtcagaa

SEQ ID NO: 615723 - DNA, 17 bp, Homo sapiens
tgacattgtcagaatgt

SEQ ID NO: 615724 - DNA, 23 bp, Homo sapiens
tgacattttgtagctagtttaaa

SEQ ID NO: 615725 - DNA, 18 bp, Homo sapiens
tgaccagaaaatttttgt

SEQ ID NO: 615726 - DNA, 17 bp, Homo sapiens
tgacccagcctgaaaga

SEQ ID NO: 615727 - DNA, 19 bp, Homo sapiens
tgaccccacacgccggggc

SEQ ID NO: 615728 - DNA, 15 bp, Homo sapiens
tgacccgtacacacc

SEQ ID NO: 615729 - DNA, 22 bp, Homo sapiens
tgaccctcacttttctcatctg

SEQ ID NO: 615730 - DNA, 21 bp, Homo sapiens
tgaccctcctgtccagcaggt

SEQ ID NO: 615731 - DNA, 17 bp, Homo sapiens
tgaccctgaaatatttt

SEQ ID NO: 615732 - DNA, 18 bp, Homo sapiens
tgaccggcccgccacctt

SEQ ID NO: 615733 - DNA, 14 bp, Homo sapiens
tgacctaccctgga

SEQ ID NO: 615734 - DNA, 17 bp, Homo sapiens
tgacctgctcctgccca

SEQ ID NO: 615735 - DNA, 18 bp, Homo sapiens
tgacctgctcctgcccac

SEQ ID NO: 615736 - DNA, 23 bp, Homo sapiens
tgaccttcggcagtggctggggg

SEQ ID NO: 615737 - DNA, 13 bp, Homo sapiens
tgacctttcaata

SEQ ID NO: 615738 - DNA, 15 bp, Homo sapiens
tgacctttcaatagg

SEQ ID NO: 615739 - DNA, 19 bp, Homo sapiens
tgacgacctacatctgaaa

SEQ ID NO: 615740 - DNA, 17 bp, Homo sapiens
tgactattacactgcct

SEQ ID NO: 615741 - DNA, 15 bp, Homo sapiens
tgactcctcaattcc

SEQ ID NO: 615742 - DNA, 21 bp, Homo sapiens
tgactgtacttgatttttcaa

SEQ ID NO: 615743 - DNA, 23 bp, Homo sapiens
tgactgtagtttttgttcacctt

SEQ ID NO: 615744 - DNA, 15 bp, Homo sapiens
tgactgtgttcagtg

SEQ ID NO: 615745 - DNA, 19 bp, Homo sapiens
tgactgtgttcagtgcctt

SEQ ID NO: 615746 - DNA, 22 bp, Homo sapiens
tgactgtgttcagtgccttgga

SEQ ID NO: 615747 - DNA, 16 bp, Homo sapiens
tgacttatttgctcat

SEQ ID NO: 615748 - DNA, 17 bp, Homo sapiens
tgacttcagactctctc

SEQ ID NO: 615749 - DNA, 20 bp, Homo sapiens
tgacttcagactctctcctc

SEQ ID NO: 615750 - DNA, 16 bp, Homo sapiens
tgacttcccagctggc

SEQ ID NO: 615751 - DNA, 17 bp, Homo sapiens
tgacttcccagctggca

SEQ ID NO: 615752 - DNA, 15 bp, Homo sapiens
tgacttcctgaactc

SEQ ID NO: 615753 - DNA, 22 bp, Homo sapiens
tgacttctttactaacactggc

SEQ ID NO: 615754 - DNA, 23 bp, Homo sapiens
tgacttctttactaacactggct

SEQ ID NO: 615755 - DNA, 23 bp, Homo sapiens
tgactttggggacaccctcctgc

SEQ ID NO: 615756 - DNA, 21 bp, Homo sapiens
tgagaaattgtgccaaagata

SEQ ID NO: 615757 - DNA, 16 bp, Homo sapiens
tgagaactaaatagat

SEQ ID NO: 615758 - DNA, 13 bp, Homo sapiens
tgagaatgtgcct

SEQ ID NO: 615759 - DNA, 17 bp, Homo sapiens
tgagacacagcccagag

SEQ ID NO: 615760 - DNA, 18 bp, Homo sapiens
tgagacacagcccagaga

SEQ ID NO: 615761 - DNA, 20 bp, Homo sapiens
tgagacacagcccagagact

SEQ ID NO: 615762 - DNA, 21 bp, Homo sapiens
tgagacacagcccagagactg

SEQ ID NO: 615763 - DNA, 22 bp, Homo sapiens
tgagacactgtcaagattaagt

SEQ ID NO: 615764 - DNA, 17 bp, Homo sapiens
tgagaccagcctgccag

SEQ ID NO: 615765 - DNA, 18 bp, Homo sapiens
tgagaccagcctgccagg

SEQ ID NO: 615766 - DNA, 19 bp, Homo sapiens
tgagactcgcgacaatgca

SEQ ID NO: 615767 - DNA, 20 bp, Homo sapiens
tgagactcgcgacaatgcaa

SEQ ID NO: 615768 - DNA, 21 bp, Homo sapiens
tgagactcgcgacaatgcaaa

SEQ ID NO: 615769 - DNA, 16 bp, Homo sapiens
tgagagaagagagtat

SEQ ID NO: 615770 - DNA, 13 bp, Homo sapiens
tgagagcagcctc

SEQ ID NO: 615771 - DNA, 12 bp, Homo sapiens
tgagaggaaatc

SEQ ID NO: 615772 - DNA, 18 bp, Homo sapiens
tgagaggagcgtgtccta

SEQ ID NO: 615773 - DNA, 23 bp, Homo sapiens
tgagagggggatgcccctggccc

SEQ ID NO: 615774 - DNA, 20 bp, Homo sapiens
tgagagggtgtgggtgccct

SEQ ID NO: 615775 - DNA, 21 bp, Homo sapiens
tgagagggtgtgggtgccctg

SEQ ID NO: 615776 - DNA, 16 bp, Homo sapiens
tgagagtcatctcaaa

SEQ ID NO: 615777 - DNA, 14 bp, Homo sapiens
tgagataaatatca

SEQ ID NO: 615778 - DNA, 17 bp, Homo sapiens
tgagataaatatcatta

SEQ ID NO: 615779 - DNA, 15 bp, Homo sapiens
tgagatctttctaaa

SEQ ID NO: 615780 - DNA, 19 bp, Homo sapiens
tgagatgtttagtagctga

SEQ ID NO: 615781 - DNA, 21 bp, Homo sapiens
tgagatgtttagtagctgata

SEQ ID NO: 615782 - DNA, 18 bp, Homo sapiens
tgagattggaaaaaatta

SEQ ID NO: 615783 - DNA, 19 bp, Homo sapiens
tgagatttagggttctata

SEQ ID NO: 615784 - DNA, 20 bp, Homo sapiens
tgagcaaggacaacctgccc

SEQ ID NO: 615785 - DNA, 16 bp, Homo sapiens
tgagcaaggcaagaag

SEQ ID NO: 615786 - DNA, 17 bp, Homo sapiens
tgagcactatctttcag

SEQ ID NO: 615787 - DNA, 22 bp, Homo sapiens
tgagcagacagggcgtcctctc

SEQ ID NO: 615788 - DNA, 21 bp, Homo sapiens
tgagcagatcgtgccgtggag

SEQ ID NO: 615789 - DNA, 12 bp, Homo sapiens
tgagcagctgaa

SEQ ID NO: 615790 - DNA, 15 bp, Homo sapiens
tgagcagtggggagc

SEQ ID NO: 615791 - DNA, 21 bp, Homo sapiens
tgagcagtggggagcgggggc

SEQ ID NO: 615792 - DNA, 23 bp, Homo sapiens
tgagcatgctccctcatgcagat

SEQ ID NO: 615793 - DNA, 15 bp, Homo sapiens
tgagccacagtgggg

SEQ ID NO: 615794 - DNA, 14 bp, Homo sapiens
tgagccagatttca

SEQ ID NO: 615795 - DNA, 16 bp, Homo sapiens
tgagccagcagacatt

SEQ ID NO: 615796 - DNA, 17 bp, Homo sapiens
tgagccagcagacattg

SEQ ID NO: 615797 - DNA, 18 bp, Homo sapiens
tgagccagcagacattgt

SEQ ID NO: 615798 - DNA, 17 bp, Homo sapiens
tgagcccctcctctcct

SEQ ID NO: 615799 - DNA, 16 bp, Homo sapiens
tgagcctgacctttct

SEQ ID NO: 615800 - DNA, 11 bp, Homo sapiens
tgagcctgtct

SEQ ID NO: 615801 - DNA, 12 bp, Homo sapiens
tgagcctgtctc

SEQ ID NO: 615802 - DNA, 17 bp, Homo sapiens
tgagccttattaaaata

SEQ ID NO: 615803 - DNA, 14 bp, Homo sapiens
tgagcgagtgacag

SEQ ID NO: 615804 - DNA, 15 bp, Homo sapiens
tgagctccaccctcc

SEQ ID NO: 615805 - DNA, 15 bp, Homo sapiens
tgagcttgattctaa

SEQ ID NO: 615806 - DNA, 22 bp, Homo sapiens
tgagcttgattctaaaggggac

SEQ ID NO: 615807 - DNA, 17 bp, Homo sapiens
tgaggaaactcatacag

SEQ ID NO: 615808 - DNA, 20 bp, Homo sapiens
tgaggaaacttggacattta

SEQ ID NO: 615809 - DNA, 10 bp, Homo sapiens
tgaggacaga

SEQ ID NO: 615810 - DNA, 14 bp, Homo sapiens
tcctacttaaacaa

SEQ ID NO: 615811 - DNA, 22 bp, Homo sapiens
tcctacttaaacaaaaactttc

SEQ ID NO: 615812 - DNA, 14 bp, Homo sapiens
tcctagcctctccg

SEQ ID NO: 615813 - DNA, 16 bp, Homo sapiens
tcctatgagagaagag

SEQ ID NO: 615814 - DNA, 17 bp, Homo sapiens
tcctcaagttgtgtgct

SEQ ID NO: 615815 - DNA, 18 bp, Homo sapiens
tcctcaagttgtgtgcta

SEQ ID NO: 615816 - DNA, 18 bp, Homo sapiens
tcctcaattatcttggaa

SEQ ID NO: 615817 - DNA, 17 bp, Homo sapiens
tcctcaattccagggaa

SEQ ID NO: 615818 - DNA, 12 bp, Homo sapiens
tcctcacagcct

SEQ ID NO: 615819 - DNA, 15 bp, Homo sapiens
tcctcacagcctctc

SEQ ID NO: 615820 - DNA, 16 bp, Homo sapiens
tcctcacagcctctcc

SEQ ID NO: 615821 - DNA, 22 bp, Homo sapiens
tcctccagactcgagagggctg

SEQ ID NO: 615822 - DNA, 20 bp, Homo sapiens
tcctccaggaggactgttct

SEQ ID NO: 615823 - DNA, 19 bp, Homo sapiens
tcctcccaactctggcctt

SEQ ID NO: 615824 - DNA, 13 bp, Homo sapiens
tcctccccctcct

SEQ ID NO: 615825 - DNA, 18 bp, Homo sapiens
tcctcgggtggggcctgc

SEQ ID NO: 615826 - DNA, 21 bp, Homo sapiens
tcctcggtggcatttgctgaa

SEQ ID NO: 615827 - DNA, 22 bp, Homo sapiens
tcctcggtggcatttgctgaat

SEQ ID NO: 615828 - DNA, 17 bp, Homo sapiens
tcctcgtccggcctgca

SEQ ID NO: 615829 - DNA, 23 bp, Homo sapiens
tcctctcctcgtccggcctgcag

SEQ ID NO: 615830 - DNA, 21 bp, Homo sapiens
tcctctcgtagaacctgcgca

SEQ ID NO: 615831 - DNA, 22 bp, Homo sapiens
tcctctcgtagaacctgcgcac

SEQ ID NO: 615832 - DNA, 14 bp, Homo sapiens
tcctctctctccct

SEQ ID NO: 615833 - DNA, 15 bp, Homo sapiens
tcctctctctctctc

SEQ ID NO: 615834 - DNA, 21 bp, Homo sapiens
tcctctctctctctctctctg

SEQ ID NO: 615835 - DNA, 22 bp, Homo sapiens
tcctctctctctctctctctgt

SEQ ID NO: 615836 - DNA, 14 bp, Homo sapiens
tcctctgcagcctg

SEQ ID NO: 615837 - DNA, 15 bp, Homo sapiens
tcctctgcagcctga

SEQ ID NO: 615838 - DNA, 11 bp, Homo sapiens
tcctctgcccc

SEQ ID NO: 615839 - DNA, 14 bp, Homo sapiens
tcctctgccccctc

SEQ ID NO: 615840 - DNA, 20 bp, Homo sapiens
tcctctgccccctcccccgc

SEQ ID NO: 615841 - DNA, 12 bp, Homo sapiens
tcctctgtcagt

SEQ ID NO: 615842 - DNA, 22 bp, Homo sapiens
tcctctgtccgtctgtcctgcg

SEQ ID NO: 615843 - DNA, 21 bp, Homo sapiens
tcctcttaatgtctcaaaata

SEQ ID NO: 615844 - DNA, 23 bp, Homo sapiens
tcctcttacctgtaatagcctca

SEQ ID NO: 615845 - DNA, 23 bp, Homo sapiens
tcctcttggtgtcaaatttttaa

SEQ ID NO: 615846 - DNA, 13 bp, Homo sapiens
tcctgagccagat

SEQ ID NO: 615847 - DNA, 17 bp, Homo sapiens
tcctgagccagatttca

SEQ ID NO: 615848 - DNA, 19 bp, Homo sapiens
tcctgagccagatttcact

SEQ ID NO: 615849 - DNA, 21 bp, Homo sapiens
tcctgagccagatttcactct

SEQ ID NO: 615850 - DNA, 18 bp, Homo sapiens
tcctgagcctgtctctcc

SEQ ID NO: 615851 - DNA, 12 bp, Homo sapiens
tcctgcaccctc

SEQ ID NO: 615852 - DNA, 13 bp, Homo sapiens
tcctgcaccctct

SEQ ID NO: 615853 - DNA, 15 bp, Homo sapiens
tcctgcaccctctgc

SEQ ID NO: 615854 - DNA, 14 bp, Homo sapiens
tcctgcactgtccc

SEQ ID NO: 615855 - DNA, 15 bp, Homo sapiens
tcctgcactgtcccg

SEQ ID NO: 615856 - DNA, 15 bp, Homo sapiens
tcctgcatgtatgcc

SEQ ID NO: 615857 - DNA, 20 bp, Homo sapiens
tcctgcccacgtgcagcacc

SEQ ID NO: 615858 - DNA, 21 bp, Homo sapiens
tcctgcccacgtgcagcacct

SEQ ID NO: 615859 - DNA, 22 bp, Homo sapiens
tcctgcctactggatgcttaca

SEQ ID NO: 615860 - DNA, 22 bp, Homo sapiens
tcctgcgcctgcgcctcctcct

SEQ ID NO: 615861 - DNA, 24 bp, Homo sapiens
tcctgcgcctgcgcctcctcctgc

SEQ ID NO: 615862 - DNA, 21 bp, Homo sapiens
tcctgctcacgtctgtgagtc

SEQ ID NO: 615863 - DNA, 22 bp, Homo sapiens
tcctgctcctcacccctgtagg

SEQ ID NO: 615864 - DNA, 13 bp, Homo sapiens
tcctgctcgccct

SEQ ID NO: 615865 - DNA, 17 bp, Homo sapiens
tcctgctgaccttctgc

SEQ ID NO: 615866 - DNA, 21 bp, Homo sapiens
tcctgctgctcgggaaggcct

SEQ ID NO: 615867 - DNA, 23 bp, Homo sapiens
tcctgctgctcgggaaggcctga

SEQ ID NO: 615868 - DNA, 20 bp, Homo sapiens
tcctggaaatttgtgtgctt

SEQ ID NO: 615869 - DNA, 14 bp, Homo sapiens
tcctggctcccagg

SEQ ID NO: 615870 - DNA, 16 bp, Homo sapiens
tcctggctcccagggt

SEQ ID NO: 615871 - DNA, 13 bp, Homo sapiens
tcctggcttgcct

SEQ ID NO: 615872 - DNA, 21 bp, Homo sapiens
tcctgggcaacagagtgagac

SEQ ID NO: 615873 - DNA, 18 bp, Homo sapiens
tcctggggtggttggagg

SEQ ID NO: 615874 - DNA, 16 bp, Homo sapiens
ttctcctttgtcaaat

SEQ ID NO: 615875 - DNA, 12 bp, Homo sapiens
ttctctctgtgt

SEQ ID NO: 615876 - DNA, 16 bp, Homo sapiens
ttctctctgtgtggca

SEQ ID NO: 615877 - DNA, 23 bp, Homo sapiens
ttctctctgtgtggcaaacattt

SEQ ID NO: 615878 - DNA, 12 bp, Homo sapiens
ttctctcttggt

SEQ ID NO: 615879 - DNA, 14 bp, Homo sapiens
ttctctgttaacct

SEQ ID NO: 615880 - DNA, 14 bp, Homo sapiens
ttctgaaggggaaa

SEQ ID NO: 615881 - DNA, 22 bp, Homo sapiens
ttctgaaggggaaaacctcagt

SEQ ID NO: 615882 - DNA, 11 bp, Homo sapiens
ttctgcaataa

SEQ ID NO: 615883 - DNA, 14 bp, Homo sapiens
ttctgcaataacag

SEQ ID NO: 615884 - DNA, 13 bp, Homo sapiens
ttctgcacataca

SEQ ID NO: 615885 - DNA, 17 bp, Homo sapiens
ttctgcacatacagatg

SEQ ID NO: 615886 - DNA, 17 bp, Homo sapiens
ttctgcactgagcagag

SEQ ID NO: 615887 - DNA, 14 bp, Homo sapiens
ttctgcagtattct

SEQ ID NO: 615888 - DNA, 16 bp, Homo sapiens
ttctgcagtattctgt

SEQ ID NO: 615889 - DNA, 14 bp, Homo sapiens
ttctgctgaatttt

SEQ ID NO: 615890 - DNA, 13 bp, Homo sapiens
ttctgctttctga

SEQ ID NO: 615891 - DNA, 16 bp, Homo sapiens
ttctggaaaaacagga

SEQ ID NO: 615892 - DNA, 22 bp, Homo sapiens
ttctggggtggggcttggaagg

SEQ ID NO: 615893 - DNA, 13 bp, Homo sapiens
ttctgtaattctt

SEQ ID NO: 615894 - DNA, 17 bp, Homo sapiens
ttctgtgcatctggcct

SEQ ID NO: 615895 - DNA, 18 bp, Homo sapiens
ttctgtgcatctggcctg

SEQ ID NO: 615896 - DNA, 23 bp, Homo sapiens
ttctgtgcatctggcctgggggc

SEQ ID NO: 615897 - DNA, 18 bp, Homo sapiens
ttctgtggctgatttact

SEQ ID NO: 615898 - DNA, 20 bp, Homo sapiens
ttcttaaggacagtgttcaa

SEQ ID NO: 615899 - DNA, 22 bp, Homo sapiens
ttcttaaggacagtgttcaaat

SEQ ID NO: 615900 - DNA, 15 bp, Homo sapiens
ttcttaccgaaatga

SEQ ID NO: 615901 - DNA, 16 bp, Homo sapiens
ttcttaccgaaatgaa

SEQ ID NO: 615902 - DNA, 18 bp, Homo sapiens
ttcttcctcttacctgta

SEQ ID NO: 615903 - DNA, 13 bp, Homo sapiens
ttcttccttcctt

SEQ ID NO: 615904 - DNA, 16 bp, Homo sapiens
ttcttctctctgtgct

SEQ ID NO: 615905 - DNA, 19 bp, Homo sapiens
ttcttgcactgtatccaag

SEQ ID NO: 615906 - DNA, 21 bp, Homo sapiens
ttcttgcggcaccgcccaccc

SEQ ID NO: 615907 - DNA, 22 bp, Homo sapiens
ttcttgcggcaccgcccaccca

SEQ ID NO: 615908 - DNA, 14 bp, Homo sapiens
ttcttgctctgctc

SEQ ID NO: 615909 - DNA, 15 bp, Homo sapiens
ttcttgggaggacac

SEQ ID NO: 615910 - DNA, 16 bp, Homo sapiens
ttcttggtatgatcat

SEQ ID NO: 615911 - DNA, 16 bp, Homo sapiens
ttcttgtaaaactgtg

SEQ ID NO: 615912 - DNA, 22 bp, Homo sapiens
ttcttgtaaaactgtgacattc

SEQ ID NO: 615913 - DNA, 14 bp, Homo sapiens
ttctttaacatatc

SEQ ID NO: 615914 - DNA, 13 bp, Homo sapiens
ttctttagtcatt

SEQ ID NO: 615915 - DNA, 14 bp, Homo sapiens
ttcttttgtgcata

SEQ ID NO: 615916 - DNA, 16 bp, Homo sapiens
ttcttttgtgcatatg

SEQ ID NO: 615917 - DNA, 22 bp, Homo sapiens
ttcttttgtgttggatttgttt

SEQ ID NO: 615918 - DNA, 21 bp, Homo sapiens
ttcttttttcaatgtactgta

SEQ ID NO: 615919 - DNA, 20 bp, Homo sapiens
ttgaaactgtatttacttgt

SEQ ID NO: 615920 - DNA, 20 bp, Homo sapiens
ttgaaaggagaaaaaaaaag

SEQ ID NO: 615921 - DNA, 17 bp, Homo sapiens
ttgaaagggacaagtat

SEQ ID NO: 615922 - DNA, 11 bp, Homo sapiens
ttgaaatcttt

SEQ ID NO: 615923 - DNA, 14 bp, Homo sapiens
ttgaaattatatct

SEQ ID NO: 615924 - DNA, 19 bp, Homo sapiens
ttgaacactgcaccctcca

SEQ ID NO: 615925 - DNA, 18 bp, Homo sapiens
ttgaagagagatatatct

SEQ ID NO: 615926 - DNA, 17 bp, Homo sapiens
ttgaagggaaatcaatt

SEQ ID NO: 615927 - DNA, 14 bp, Homo sapiens
ttgaagtgcatgtt

SEQ ID NO: 615928 - DNA, 21 bp, Homo sapiens
ttgaatagacagaggtttcat

SEQ ID NO: 615929 - DNA, 23 bp, Homo sapiens
ttgacaataagaaacagtttaac

SEQ ID NO: 615930 - DNA, 20 bp, Homo sapiens
ttgacacattgcacacacag

SEQ ID NO: 615931 - DNA, 14 bp, Homo sapiens
ttgacagttactta

SEQ ID NO: 615932 - DNA, 18 bp, Homo sapiens
ttgacatgtacagagaac

SEQ ID NO: 615933 - DNA, 18 bp, Homo sapiens
ttgacattgtcagaatgt

SEQ ID NO: 615934 - DNA, 19 bp, Homo sapiens
ttgacattgtcagaatgtt

SEQ ID NO: 615935 - DNA, 21 bp, Homo sapiens
ttgacgacctacatctgaaat

SEQ ID NO: 615936 - DNA, 22 bp, Homo sapiens
ttgacgacctacatctgaaatc

SEQ ID NO: 615937 - DNA, 20 bp, Homo sapiens
ttgactattacactgcctgg

SEQ ID NO: 615938 - DNA, 18 bp, Homo sapiens
ttgactgcttctctgcag

SEQ ID NO: 615939 - DNA, 16 bp, Homo sapiens
ttgagacactgtcaag

SEQ ID NO: 615940 - DNA, 17 bp, Homo sapiens
ttgagacactgtcaaga

SEQ ID NO: 615941 - DNA, 21 bp, Homo sapiens
ttgagacactgtcaagattaa

SEQ ID NO: 615942 - DNA, 17 bp, Homo sapiens
ttgagaccagcctgcca

SEQ ID NO: 615943 - DNA, 15 bp, Homo sapiens
ttgagagcagcctct

SEQ ID NO: 615944 - DNA, 22 bp, Homo sapiens
ttgagcagtaaatgtatattga

SEQ ID NO: 615945 - DNA, 23 bp, Homo sapiens
ttgagcatgcccaaatataacat

SEQ ID NO: 615946 - DNA, 17 bp, Homo sapiens
ttgagccttattaaaat

SEQ ID NO: 615947 - DNA, 21 bp, Homo sapiens
ttgagccttattaaaatattt

SEQ ID NO: 615948 - DNA, 14 bp, Homo sapiens
ttgaggaaactcat

SEQ ID NO: 615949 - DNA, 17 bp, Homo sapiens
ttgaggagttgcctgac

SEQ ID NO: 615950 - DNA, 17 bp, Homo sapiens
ttgagtgggccccctct

SEQ ID NO: 615951 - DNA, 14 bp, Homo sapiens
ttgataattcttac

SEQ ID NO: 615952 - DNA, 15 bp, Homo sapiens
ttgatactcgttatt

SEQ ID NO: 615953 - DNA, 20 bp, Homo sapiens
ttgatagtttacaaacaaga

SEQ ID NO: 615954 - DNA, 12 bp, Homo sapiens
ttgatctggtgc

SEQ ID NO: 615955 - DNA, 19 bp, Homo sapiens
ttgatctggtgcgtgtggc

SEQ ID NO: 615956 - DNA, 20 bp, Homo sapiens
ttgatctggtgcgtgtggcc

SEQ ID NO: 615957 - DNA, 19 bp, Homo sapiens
ttgatgaataaaatgttta

SEQ ID NO: 615958 - DNA, 23 bp, Homo sapiens
ttgatggtagaaattttatctct

SEQ ID NO: 615959 - DNA, 19 bp, Homo sapiens
ttgatgtattattatatat

SEQ ID NO: 615960 - DNA, 12 bp, Homo sapiens
ttgattctttca

SEQ ID NO: 615961 - DNA, 15 bp, Homo sapiens
ttgcactaaaagtga

SEQ ID NO: 615962 - DNA, 21 bp, Homo sapiens
ttgcactgcagttatttacca

SEQ ID NO: 615963 - DNA, 20 bp, Homo sapiens
ttgcatcacaatttgttgaa

SEQ ID NO: 615964 - DNA, 20 bp, Homo sapiens
ttgcatgcctgggcccaggc

SEQ ID NO: 615965 - DNA, 22 bp, Homo sapiens
ttgcatgtttaataatatgtac

SEQ ID NO: 615966 - DNA, 22 bp, Homo sapiens
ttgccatgaggcctttccccag

SEQ ID NO: 615967 - DNA, 14 bp, Homo sapiens
ttgcccttttcctt

SEQ ID NO: 615968 - DNA, 15 bp, Homo sapiens
tggaaatttgtgtgc

SEQ ID NO: 615969 - DNA, 17 bp, Homo sapiens
tggaacactctgagact

SEQ ID NO: 615970 - DNA, 16 bp, Homo sapiens
tggaagaaagggagaa

SEQ ID NO: 615971 - DNA, 16 bp, Homo sapiens
tggaagaattcatgat

SEQ ID NO: 615972 - DNA, 18 bp, Homo sapiens
tggaagcagcaaggtggg

SEQ ID NO: 615973 - DNA, 13 bp, Homo sapiens
tggaagtatagat

SEQ ID NO: 615974 - DNA, 14 bp, Homo sapiens
tggaagttgtcctt

SEQ ID NO: 615975 - DNA, 21 bp, Homo sapiens
tggaagttttacttgattaag

SEQ ID NO: 615976 - DNA, 20 bp, Homo sapiens
tggaattacataacaggcat

SEQ ID NO: 615977 - DNA, 18 bp, Homo sapiens
tggaattctgcttctctt

SEQ ID NO: 615978 - DNA, 14 bp, Homo sapiens
tggaattttttcct

SEQ ID NO: 615979 - DNA, 19 bp, Homo sapiens
tggaccagttccctcagcc

SEQ ID NO: 615980 - DNA, 22 bp, Homo sapiens
tggagaagggttctgccctgcc

SEQ ID NO: 615981 - DNA, 18 bp, Homo sapiens
tggagaccctgcgcccct

SEQ ID NO: 615982 - DNA, 20 bp, Homo sapiens
tggagaccctgcgcccctgc

SEQ ID NO: 615983 - DNA, 22 bp, Homo sapiens
tggagagactggttttttccag

SEQ ID NO: 615984 - DNA, 20 bp, Homo sapiens
tggagagagaggctgcctca

SEQ ID NO: 615985 - DNA, 23 bp, Homo sapiens
tggagagagaggctgcctcagcc

SEQ ID NO: 615986 - DNA, 15 bp, Homo sapiens
tggagagcagcaggt

SEQ ID NO: 615987 - DNA, 18 bp, Homo sapiens
tggagcagaaagccaggg

SEQ ID NO: 615988 - DNA, 19 bp, Homo sapiens
tggagcagaaagccagggt

SEQ ID NO: 615989 - DNA, 18 bp, Homo sapiens
tggagcagagacggcagc

SEQ ID NO: 615990 - DNA, 21 bp, Homo sapiens
tggagcagagacggcagcccc

SEQ ID NO: 615991 - DNA, 11 bp, Homo sapiens
tggagccaggg

SEQ ID NO: 615992 - DNA, 15 bp, Homo sapiens
tggagccagggcaga

SEQ ID NO: 615993 - DNA, 14 bp, Homo sapiens
tggagccccatcgc

SEQ ID NO: 615994 - DNA, 15 bp, Homo sapiens
tggagccccctggcg

SEQ ID NO: 615995 - DNA, 20 bp, Homo sapiens
tggagccccctggcggcagg

SEQ ID NO: 615996 - DNA, 21 bp, Homo sapiens
tggagccccctggcggcaggg

SEQ ID NO: 615997 - DNA, 13 bp, Homo sapiens
tggagcctgcagg

SEQ ID NO: 615998 - DNA, 15 bp, Homo sapiens
tggagcctgggcagc

SEQ ID NO: 615999 - DNA, 19 bp, Homo sapiens
tggagcttggagccccctg

SEQ ID NO: 616000 - DNA, 13 bp, Homo sapiens
tggaggagaagga

SEQ ID NO: 616001 - DNA, 14 bp, Homo sapiens
tggaggaggaggag

SEQ ID NO: 616002 - DNA, 19 bp, Homo sapiens
tggaggctgctgccccctg

SEQ ID NO: 616003 - DNA, 16 bp, Homo sapiens
tggaggggtcagcagg

SEQ ID NO: 616004 - DNA, 12 bp, Homo sapiens
tggaggtgatga

SEQ ID NO: 616005 - DNA, 15 bp, Homo sapiens
tggagtcagggctgt

SEQ ID NO: 616006 - DNA, 21 bp, Homo sapiens
tggagtctgaaggagaggagt

SEQ ID NO: 616007 - DNA, 13 bp, Homo sapiens
tggagtggagggg

SEQ ID NO: 616008 - DNA, 20 bp, Homo sapiens
tggagtggaggggtcagcag

SEQ ID NO: 616009 - DNA, 20 bp, Homo sapiens
tggataagaaaaatgcttga

SEQ ID NO: 616010 - DNA, 16 bp, Homo sapiens
tggatagattgtttta

SEQ ID NO: 616011 - DNA, 19 bp, Homo sapiens
tggataggagcttccagat

SEQ ID NO: 616012 - DNA, 12 bp, Homo sapiens
tggatataaatc

SEQ ID NO: 616013 - DNA, 15 bp, Homo sapiens
tggatataaatctta

SEQ ID NO: 616014 - DNA, 18 bp, Homo sapiens
tggatccttgtcagttgt

SEQ ID NO: 616015 - DNA, 18 bp, Homo sapiens
tggatcgtggaagaaggg

SEQ ID NO: 616016 - DNA, 23 bp, Homo sapiens
tggatcgtggaagaagggccacc

SEQ ID NO: 616017 - DNA, 13 bp, Homo sapiens
tggatgtgctttc

SEQ ID NO: 616018 - DNA, 23 bp, Homo sapiens
tggatttcctttgacctctcact

SEQ ID NO: 616019 - DNA, 22 bp, Homo sapiens
tggattttaaacaaaatttatg

SEQ ID NO: 616020 - DNA, 17 bp, Homo sapiens
tggcaaaattacagttc

SEQ ID NO: 616021 - DNA, 15 bp, Homo sapiens
tggcaacgttcatgt

SEQ ID NO: 616022 - DNA, 20 bp, Homo sapiens
tggcaagctcttcattgcac

SEQ ID NO: 616023 - DNA, 20 bp, Homo sapiens
tggcacccactggaggtggg

SEQ ID NO: 616024 - DNA, 16 bp, Homo sapiens
tggcacgtcatctagt

SEQ ID NO: 616025 - DNA, 18 bp, Homo sapiens
tggcacgtcatctagttt

SEQ ID NO: 616026 - DNA, 14 bp, Homo sapiens
tggcagcgcctccc

SEQ ID NO: 616027 - DNA, 22 bp, Homo sapiens
tggcagcgcctcccgccgcctc

SEQ ID NO: 616028 - DNA, 24 bp, Homo sapiens
tggcagcgcctcccgccgcctcgg

SEQ ID NO: 616029 - DNA, 21 bp, Homo sapiens
tggcagcgcctcgccccagcc

SEQ ID NO: 616030 - DNA, 14 bp, Homo sapiens
tggcagcttccctg

SEQ ID NO: 616031 - DNA, 19 bp, Homo sapiens
tggcagcttccctgaacac

SEQ ID NO: 616032 - DNA, 16 bp, Homo sapiens
tggcagggaagggtgc

SEQ ID NO: 616033 - DNA, 18 bp, Homo sapiens
tggcaggtgggctgcctg

SEQ ID NO: 616034 - DNA, 19 bp, Homo sapiens
tggcaggtgggctgcctgc

SEQ ID NO: 616035 - DNA, 24 bp, Homo sapiens
tggcagtgtgtcacactgagctgg

SEQ ID NO: 616036 - DNA, 16 bp, Homo sapiens
tggcatgctgtctcta

SEQ ID NO: 616037 - DNA, 20 bp, Homo sapiens
tggcattgaccttcatgacc

SEQ ID NO: 616038 - DNA, 16 bp, Homo sapiens
tggcatttagcacagt

SEQ ID NO: 616039 - DNA, 20 bp, Homo sapiens
tggcatttagcacagtattt

SEQ ID NO: 616040 - DNA, 21 bp, Homo sapiens
tggcatttgctgaataacaac

SEQ ID NO: 616041 - DNA, 15 bp, Homo sapiens
tggccacctgccagg

SEQ ID NO: 616042 - DNA, 19 bp, Homo sapiens
tggccatttgctagttctg

SEQ ID NO: 616043 - DNA, 18 bp, Homo sapiens
tggcccacccctcttccc

SEQ ID NO: 616044 - DNA, 23 bp, Homo sapiens
tggcccacccctcttcccccttc

SEQ ID NO: 616045 - DNA, 22 bp, Homo sapiens
tggccccagcccgacaggcatg

SEQ ID NO: 616046 - DNA, 17 bp, Homo sapiens
tggccccagctggctgg

SEQ ID NO: 616047 - DNA, 20 bp, Homo sapiens
tggccccagctggctgggtc

SEQ ID NO: 616048 - DNA, 14 bp, Homo sapiens
tggccccctcgcgc

SEQ ID NO: 616049 - DNA, 19 bp, Homo sapiens
tggccccctcgcgcccctg

SEQ ID NO: 616050 - DNA, 23 bp, Homo sapiens
tggccccctcgcgcccctgtcca

SEQ ID NO: 616051 - DNA, 20 bp, Homo sapiens
tggcccctccttctcccctc

SEQ ID NO: 616052 - DNA, 23 bp, Homo sapiens
tggcccctctctgtttaccctcc

SEQ ID NO: 616053 - DNA, 17 bp, Homo sapiens
tggccctgacttctgga

SEQ ID NO: 616054 - DNA, 12 bp, Homo sapiens
tggccctgccct

SEQ ID NO: 616055 - DNA, 15 bp, Homo sapiens
tggccctgccctccc

SEQ ID NO: 616056 - DNA, 16 bp, Homo sapiens
tggccctgccctcccc

SEQ ID NO: 616057 - DNA, 18 bp, Homo sapiens
tggccctgccctccccca

SEQ ID NO: 616058 - DNA, 22 bp, Homo sapiens
tggccctgccctcccccacggc

SEQ ID NO: 616059 - DNA, 13 bp, Homo sapiens
tggccctgcctca

SEQ ID NO: 616060 - DNA, 12 bp, Homo sapiens
tggccctggagc

SEQ ID NO: 616061 - DNA, 13 bp, Homo sapiens
tggccctggagcc

SEQ ID NO: 616062 - DNA, 18 bp, Homo sapiens
tggccctggagccagggc

SEQ ID NO: 616063 - DNA, 13 bp, Homo sapiens
tggccctgtggga

SEQ ID NO: 616064 - DNA, 14 bp, Homo sapiens
tggccctgtgggag

SEQ ID NO: 616065 - DNA, 22 bp, Homo sapiens
tggccctgtgggagtccacttt

SEQ ID NO: 616066 - DNA, 19 bp, Homo sapiens
tggccgaagccccttggag

SEQ ID NO: 616067 - DNA, 22 bp, Homo sapiens
tggccgaagccccttggagaga

SEQ ID NO: 616068 - DNA, 14 bp, Homo sapiens
tggccggctggccg

SEQ ID NO: 616069 - DNA, 21 bp, Homo sapiens
tggcctctgcccctcttccct

SEQ ID NO: 616070 - DNA, 19 bp, Homo sapiens
tggcctgagaagagtcgag

SEQ ID NO: 616071 - DNA, 11 bp, Homo sapiens
tggccttccct

SEQ ID NO: 616072 - DNA, 19 bp, Homo sapiens
tggccttggttcctccagc

SEQ ID NO: 616073 - DNA, 12 bp, Homo sapiens
tggcgccccatg

SEQ ID NO: 616074 - DNA, 17 bp, Homo sapiens
tggcgccccatgggccc

SEQ ID NO: 616075 - DNA, 18 bp, Homo sapiens
tggcgcgtgtgtggccta

SEQ ID NO: 616076 - DNA, 16 bp, Homo sapiens
tggcgggcagcccctg

SEQ ID NO: 616077 - DNA, 17 bp, Homo sapiens
tggcgggcagcccctgc

SEQ ID NO: 616078 - DNA, 18 bp, Homo sapiens
tgataattcgagcaaaca

SEQ ID NO: 616079 - DNA, 13 bp, Homo sapiens
tgataattcttac

SEQ ID NO: 616080 - DNA, 24 bp, Homo sapiens
tgataattgtaaaggtgatgaatt

SEQ ID NO: 616081 - DNA, 20 bp, Homo sapiens
tgatactcgttattcataca

SEQ ID NO: 616082 - DNA, 16 bp, Homo sapiens
tgatagaagaaggact

SEQ ID NO: 616083 - DNA, 13 bp, Homo sapiens
tgatagtttacaa

SEQ ID NO: 616084 - DNA, 14 bp, Homo sapiens
tgatagtttacaaa

SEQ ID NO: 616085 - DNA, 16 bp, Homo sapiens
tgatagtttacaaaca

SEQ ID NO: 616086 - DNA, 17 bp, Homo sapiens
tgatatacagacctcca

SEQ ID NO: 616087 - DNA, 17 bp, Homo sapiens
tgatatgttgatgaaat

SEQ ID NO: 616088 - DNA, 21 bp, Homo sapiens
tgatccaatactgttgccctt

SEQ ID NO: 616089 - DNA, 19 bp, Homo sapiens
tgatctggtgcgtgtggcc

SEQ ID NO: 616090 - DNA, 15 bp, Homo sapiens
tgatgaataaaatgt

SEQ ID NO: 616091 - DNA, 22 bp, Homo sapiens
tgatgaatttaccatcaaacaa

SEQ ID NO: 616092 - DNA, 14 bp, Homo sapiens
tgatgagacaacac

SEQ ID NO: 616093 - DNA, 17 bp, Homo sapiens
tgatgagacaacacaca

SEQ ID NO: 616094 - DNA, 14 bp, Homo sapiens
tgatgatggaaggg

SEQ ID NO: 616095 - DNA, 15 bp, Homo sapiens
tgatgatttcagaaa

SEQ ID NO: 616096 - DNA, 16 bp, Homo sapiens
tgatgatttcagaaac

SEQ ID NO: 616097 - DNA, 15 bp, Homo sapiens
tgatgctagttctta

SEQ ID NO: 616098 - DNA, 21 bp, Homo sapiens
tgatggaggtttcatactcta

SEQ ID NO: 616099 - DNA, 13 bp, Homo sapiens
tgatggccaggcc

SEQ ID NO: 616100 - DNA, 15 bp, Homo sapiens
tgatggccaggcctc

SEQ ID NO: 616101 - DNA, 17 bp, Homo sapiens
tgatggctatgttttgg

SEQ ID NO: 616102 - DNA, 16 bp, Homo sapiens
tgatgggtcctgctgc

SEQ ID NO: 616103 - DNA, 23 bp, Homo sapiens
tgatggtagaaattttatctctt

SEQ ID NO: 616104 - DNA, 17 bp, Homo sapiens
tgatggttcgttctgtt

SEQ ID NO: 616105 - DNA, 16 bp, Homo sapiens
tgatgtgatttatgca

SEQ ID NO: 616106 - DNA, 18 bp, Homo sapiens
tgatgtgatttatgcatt

SEQ ID NO: 616107 - DNA, 18 bp, Homo sapiens
tgatgtgctcatcagaaa

SEQ ID NO: 616108 - DNA, 19 bp, Homo sapiens
tgattaaggactacagaat

SEQ ID NO: 616109 - DNA, 21 bp, Homo sapiens
tgattaaggactacagaattg

SEQ ID NO: 616110 - DNA, 14 bp, Homo sapiens
tgattattacaaca

SEQ ID NO: 616111 - DNA, 18 bp, Homo sapiens
tgattattacaacaagca

SEQ ID NO: 616112 - DNA, 22 bp, Homo sapiens
tgattcaaataaccctgaatca

SEQ ID NO: 616113 - DNA, 17 bp, Homo sapiens
tgattcaaggcattatt

SEQ ID NO: 616114 - DNA, 14 bp, Homo sapiens
tgattcacttttat

SEQ ID NO: 616115 - DNA, 15 bp, Homo sapiens
tgattctaaagggga

SEQ ID NO: 616116 - DNA, 16 bp, Homo sapiens
tgattctaaaggggac

SEQ ID NO: 616117 - DNA, 14 bp, Homo sapiens
tgattctcctctcc

SEQ ID NO: 616118 - DNA, 16 bp, Homo sapiens
tgattctcctctccca

SEQ ID NO: 616119 - DNA, 15 bp, Homo sapiens
tgattcttgtgtcat

SEQ ID NO: 616120 - DNA, 22 bp, Homo sapiens
tgattctttcaatccacagtat

SEQ ID NO: 616121 - DNA, 22 bp, Homo sapiens
tgattgacattttgtagctagt

SEQ ID NO: 616122 - DNA, 12 bp, Homo sapiens
tgatttaacatt

SEQ ID NO: 616123 - DNA, 14 bp, Homo sapiens
tgatttaattctta

SEQ ID NO: 616124 - DNA, 19 bp, Homo sapiens
tgatttactaacagtaact

SEQ ID NO: 616125 - DNA, 15 bp, Homo sapiens
tgatttatgcattta

SEQ ID NO: 616126 - DNA, 18 bp, Homo sapiens
tgatttattctggtgtct

SEQ ID NO: 616127 - DNA, 13 bp, Homo sapiens
tgatttcagaaac

SEQ ID NO: 616128 - DNA, 22 bp, Homo sapiens
tgatttcatgattagacaatgt

SEQ ID NO: 616129 - DNA, 12 bp, Homo sapiens
tgcaaaccatca

SEQ ID NO: 616130 - DNA, 18 bp, Homo sapiens
tgcaaaccatcattgaaa

SEQ ID NO: 616131 - DNA, 17 bp, Homo sapiens
tgcaaagtgttgtctta

SEQ ID NO: 616132 - DNA, 18 bp, Homo sapiens
tgcaaagtgttgtcttat

SEQ ID NO: 616133 - DNA, 21 bp, Homo sapiens
tgcaaatatttttttgtagat

SEQ ID NO: 616134 - DNA, 18 bp, Homo sapiens
tgcaacactgccaaacat

SEQ ID NO: 616135 - DNA, 21 bp, Homo sapiens
tgcaacagactgccttatatt

SEQ ID NO: 616136 - DNA, 15 bp, Homo sapiens
tgcaacttgagggac

SEQ ID NO: 616137 - DNA, 22 bp, Homo sapiens
tgcaagtggacgtgggctccag

SEQ ID NO: 616138 - DNA, 23 bp, Homo sapiens
tgcaagtggacgtgggctccagg

SEQ ID NO: 616139 - DNA, 22 bp, Homo sapiens
tgcaataaactcagtcaaatgt

SEQ ID NO: 616140 - DNA, 16 bp, Homo sapiens
tgcaataacagtttta

SEQ ID NO: 616141 - DNA, 23 bp, Homo sapiens
tgcaatactaacgaccgacgccc

SEQ ID NO: 616142 - DNA, 13 bp, Homo sapiens
tgcaatgaccttt

SEQ ID NO: 616143 - DNA, 17 bp, Homo sapiens
tgcaatgacctttcaat

SEQ ID NO: 616144 - DNA, 23 bp, Homo sapiens
tgcaatgtctgtccctaaacata

SEQ ID NO: 616145 - DNA, 20 bp, Homo sapiens
tgcaatttgacttggcataa

SEQ ID NO: 616146 - DNA, 20 bp, Homo sapiens
tgcaatttgataatcagttt

SEQ ID NO: 616147 - DNA, 13 bp, Homo sapiens
tgcacaccaaatt

SEQ ID NO: 616148 - DNA, 22 bp, Homo sapiens
tgcacaccaaattgctgagatg

SEQ ID NO: 616149 - DNA, 17 bp, Homo sapiens
tgcaccagtgccgcctg

SEQ ID NO: 616150 - DNA, 15 bp, Homo sapiens
tgcacggcagcttga

SEQ ID NO: 616151 - DNA, 22 bp, Homo sapiens
tgcacggcagcttgagcctgtc

SEQ ID NO: 616152 - DNA, 21 bp, Homo sapiens
tgcactcttttgagcagtaaa

SEQ ID NO: 616153 - DNA, 17 bp, Homo sapiens
tgcactgccctccgccc

SEQ ID NO: 616154 - DNA, 17 bp, Homo sapiens
tgcagaaaaagagcttc

SEQ ID NO: 616155 - DNA, 12 bp, Homo sapiens
tgcagaaaacat

SEQ ID NO: 616156 - DNA, 13 bp, Homo sapiens
tgcagaaaacatt

SEQ ID NO: 616157 - DNA, 16 bp, Homo sapiens
tgcagaaaacattgtt

SEQ ID NO: 616158 - DNA, 14 bp, Homo sapiens
tgcagactgtggct

SEQ ID NO: 616159 - DNA, 19 bp, Homo sapiens
tgcagagctaggttgtcct

SEQ ID NO: 616160 - DNA, 13 bp, Homo sapiens
tgcagagtaaatc

SEQ ID NO: 616161 - DNA, 19 bp, Homo sapiens
tgcagagtatacaagtgtt

SEQ ID NO: 616162 - DNA, 17 bp, Homo sapiens
tgcagatgactggaaac

SEQ ID NO: 616163 - DNA, 13 bp, Homo sapiens
tgcagcacctgtc

SEQ ID NO: 616164 - DNA, 21 bp, Homo sapiens
tgcagcagagagaaataaaac

SEQ ID NO: 616165 - DNA, 22 bp, Homo sapiens
tgcagcagtaccatcccactga

SEQ ID NO: 616166 - DNA, 11 bp, Homo sapiens
tgcagcccaga

SEQ ID NO: 616167 - DNA, 20 bp, Homo sapiens
tgcagcctgagctccaccct

SEQ ID NO: 616168 - DNA, 22 bp, Homo sapiens
tgcatcccttggcccctctctg

SEQ ID NO: 616169 - DNA, 15 bp, Homo sapiens
tgcatctggcctggg

SEQ ID NO: 616170 - DNA, 16 bp, Homo sapiens
tgcatgaatccatcga

SEQ ID NO: 616171 - DNA, 16 bp, Homo sapiens
tgcatgagaactaaat

SEQ ID NO: 616172 - DNA, 21 bp, Homo sapiens
tgcatgccatctccaccctga

SEQ ID NO: 616173 - DNA, 19 bp, Homo sapiens
tgcatgcctgggcccaggc

SEQ ID NO: 616174 - DNA, 12 bp, Homo sapiens
tgcatggagaag

SEQ ID NO: 616175 - DNA, 20 bp, Homo sapiens
tgcatgttgccatgaggcct

SEQ ID NO: 616176 - DNA, 22 bp, Homo sapiens
tgcatgttgccatgaggccttt

SEQ ID NO: 616177 - DNA, 19 bp, Homo sapiens
tgcattcagatctgaagta

SEQ ID NO: 616178 - DNA, 12 bp, Homo sapiens
tgcatttagcat

SEQ ID NO: 616179 - DNA, 15 bp, Homo sapiens
tgcatttatgcatga

SEQ ID NO: 616180 - DNA, 16 bp, Homo sapiens
tgccaaacatcagtca

SEQ ID NO: 616181 - DNA, 21 bp, Homo sapiens
tgccaatgtccaggtcacagg

SEQ ID NO: 616182 - DNA, 18 bp, Homo sapiens
tgccacattgcttcatta

SEQ ID NO: 616183 - DNA, 20 bp, Homo sapiens
tgccacattgcttcattaaa

SEQ ID NO: 616184 - DNA, 20 bp, Homo sapiens
tgccacttagggagtgtgcc

SEQ ID NO: 616185 - DNA, 20 bp, Homo sapiens
tgccagacagagatcagaat

SEQ ID NO: 616186 - DNA, 14 bp, Homo sapiens
tgccaggcctccct

SEQ ID NO: 616187 - DNA, 21 bp, Homo sapiens
tgccaggctcccactgcccct

SEQ ID NO: 616188 - DNA, 20 bp, Homo sapiens
tgccagtgtttagaagagcc

SEQ ID NO: 616189 - DNA, 23 bp, Homo sapiens
tgccatccttgctgcagcttcta

SEQ ID NO: 616190 - DNA, 21 bp, Homo sapiens
tgccatctccaccctgagcct

SEQ ID NO: 616191 - DNA, 18 bp, Homo sapiens
tgccatgaggcctttccc

SEQ ID NO: 616192 - DNA, 23 bp, Homo sapiens
tgccatgaggcctttccccagtg

SEQ ID NO: 616193 - DNA, 19 bp, Homo sapiens
tgccatgtatgttgcatga

SEQ ID NO: 616194 - DNA, 14 bp, Homo sapiens
tgccattatttcta

SEQ ID NO: 616195 - DNA, 18 bp, Homo sapiens
tgcccacatttgggctca

SEQ ID NO: 616196 - DNA, 16 bp, Homo sapiens
tgcccaccctgggcct

SEQ ID NO: 616197 - DNA, 14 bp, Homo sapiens
tgcccacgcccctc

SEQ ID NO: 616198 - DNA, 20 bp, Homo sapiens
tgcccacgcccctccccagc

SEQ ID NO: 616199 - DNA, 18 bp, Homo sapiens
tgcccacgtgcagcacct

SEQ ID NO: 616200 - DNA, 16 bp, Homo sapiens
tgcccagcacctcctc

SEQ ID NO: 616201 - DNA, 17 bp, Homo sapiens
tgcccagcacctcctcc

SEQ ID NO: 616202 - DNA, 22 bp, Homo sapiens
tgcccagcacctcctccgtggg

SEQ ID NO: 616203 - DNA, 16 bp, Homo sapiens
tgcccatggctgggaa

SEQ ID NO: 616204 - DNA, 13 bp, Homo sapiens
tgcccatgtgtat

SEQ ID NO: 616205 - DNA, 17 bp, Homo sapiens
tgccccacaaggcccag

SEQ ID NO: 616206 - DNA, 18 bp, Homo sapiens
tgccccacaaggcccagc

SEQ ID NO: 616207 - DNA, 23 bp, Homo sapiens
tgccccacaaggcccagccctgg

SEQ ID NO: 616208 - DNA, 21 bp, Homo sapiens
tgccccatctcctcccatggc

SEQ ID NO: 616209 - DNA, 17 bp, Homo sapiens
tgccccccatgccctcc

SEQ ID NO: 616210 - DNA, 13 bp, Homo sapiens
tgccccccttccc

SEQ ID NO: 616211 - DNA, 19 bp, Homo sapiens
tgccccccttcccacccct

SEQ ID NO: 616212 - DNA, 17 bp, Homo sapiens
tgccccctcccccgcag

SEQ ID NO: 616213 - DNA, 22 bp, Homo sapiens
tgccccctcccccgcagacaga

SEQ ID NO: 616214 - DNA, 19 bp, Homo sapiens
tgcccctccgtccccaggg

SEQ ID NO: 616215 - DNA, 12 bp, Homo sapiens
tgcccctggccc

SEQ ID NO: 616216 - DNA, 13 bp, Homo sapiens
tgcccctggccct

SEQ ID NO: 616217 - DNA, 21 bp, Homo sapiens
tgcccctgggaacacagtgcc

SEQ ID NO: 616218 - DNA, 17 bp, Homo sapiens
tgccccttgaccccaca

SEQ ID NO: 616219 - DNA, 19 bp, Homo sapiens
tgcccgcgcccgccgcctc

SEQ ID NO: 616220 - DNA, 23 bp, Homo sapiens
tgcccgtggtgaggttgtgctgc

SEQ ID NO: 616221 - DNA, 16 bp, Homo sapiens
tgccctcactccactc

SEQ ID NO: 616222 - DNA, 19 bp, Homo sapiens
tgccctcactccactcccc

SEQ ID NO: 616223 - DNA, 11 bp, Homo sapiens
tgccctccccc

SEQ ID NO: 616224 - DNA, 17 bp, Homo sapiens
tgccctccctgctgcca

SEQ ID NO: 616225 - DNA, 12 bp, Homo sapiens
tgccctcggcca

SEQ ID NO: 616226 - DNA, 12 bp, Homo sapiens
tgccctgcctga

SEQ ID NO: 616227 - DNA, 14 bp, Homo sapiens
tgccctgcctgagg

SEQ ID NO: 616228 - DNA, 15 bp, Homo sapiens
tgccctgcctgagga

SEQ ID NO: 616229 - DNA, 20 bp, Homo sapiens
tgccgcttaaacatttccct

SEQ ID NO: 616230 - DNA, 22 bp, Homo sapiens
tgccgcttaaacatttccctgc

SEQ ID NO: 616231 - DNA, 19 bp, Homo sapiens
tgccggtggggccagcgct

SEQ ID NO: 616232 - DNA, 19 bp, Homo sapiens
tgccgtctttggttcctca

SEQ ID NO: 616233 - DNA, 23 bp, Homo sapiens
tgccgtctttggttcctcatggc

SEQ ID NO: 616234 - DNA, 13 bp, Homo sapiens
tgccgtggagctt

SEQ ID NO: 616235 - DNA, 16 bp, Homo sapiens
tgcctactggatgctt

SEQ ID NO: 616236 - DNA, 13 bp, Homo sapiens
tgcctcactgtga

SEQ ID NO: 616237 - DNA, 20 bp, Homo sapiens
tgcctcactgtgacctgctc

SEQ ID NO: 616238 - DNA, 21 bp, Homo sapiens
tgcctcactgtgacctgctcc

SEQ ID NO: 616239 - DNA, 22 bp, Homo sapiens
tgcctcactgtgacctgctcct

SEQ ID NO: 616240 - DNA, 18 bp, Homo sapiens
tgcctcatagcatagcca

SEQ ID NO: 616241 - DNA, 21 bp, Homo sapiens
tgcctcatagcatagccagca

SEQ ID NO: 616242 - DNA, 22 bp, Homo sapiens
tgcctcatagcatagccagcat

SEQ ID NO: 616243 - DNA, 16 bp, Homo sapiens
tgcctcatgaccctcc

SEQ ID NO: 616244 - DNA, 19 bp, Homo sapiens
tgcctcatgaccctcctgt

SEQ ID NO: 616245 - DNA, 23 bp, Homo sapiens
tgcctcatgaccctcctgtccag

SEQ ID NO: 616246 - DNA, 15 bp, Homo sapiens
tgcctctatccctgg

SEQ ID NO: 616247 - DNA, 17 bp, Homo sapiens
tgcctctatccctggcc

SEQ ID NO: 616248 - DNA, 18 bp, Homo sapiens
tgcctctatccctggcca

SEQ ID NO: 616249 - DNA, 21 bp, Homo sapiens
tgcctgaatccatcaggactt

SEQ ID NO: 616250 - DNA, 21 bp, Homo sapiens
tgcctgaggaggaggacacag

SEQ ID NO: 616251 - DNA, 18 bp, Homo sapiens
tgcctggagcctgggcag

SEQ ID NO: 616252 - DNA, 20 bp, Homo sapiens
tgcctggagcctgggcagca

SEQ ID NO: 616253 - DNA, 21 bp, Homo sapiens
tgcctggagcctgggcagcac

SEQ ID NO: 616254 - DNA, 22 bp, Homo sapiens
tgcctggaggagaaggaggaac

SEQ ID NO: 616255 - DNA, 22 bp, Homo sapiens
tgcctggaggatagcagagaag

SEQ ID NO: 616256 - DNA, 21 bp, Homo sapiens
tgcctggcgggcagcccctgc

SEQ ID NO: 616257 - DNA, 23 bp, Homo sapiens
tgcctggctgggctttggggctg

SEQ ID NO: 616258 - DNA, 19 bp, Homo sapiens
tgcctgggcccaggcccag

SEQ ID NO: 616259 - DNA, 19 bp, Homo sapiens
tgcctgtactcgcttgtgc

SEQ ID NO: 616260 - DNA, 14 bp, Homo sapiens
tggctgaaattatg

SEQ ID NO: 616261 - DNA, 11 bp, Homo sapiens
tggctgaagaa

SEQ ID NO: 616262 - DNA, 17 bp, Homo sapiens
tggctgaagaaacacag

SEQ ID NO: 616263 - DNA, 15 bp, Homo sapiens
tggctgcagagacct

SEQ ID NO: 616264 - DNA, 13 bp, Homo sapiens
tggctgccaagag

SEQ ID NO: 616265 - DNA, 20 bp, Homo sapiens
tggctgctcccagcctcttg

SEQ ID NO: 616266 - DNA, 15 bp, Homo sapiens
tggctggagccccat

SEQ ID NO: 616267 - DNA, 17 bp, Homo sapiens
tggctggagccccatcg

SEQ ID NO: 616268 - DNA, 22 bp, Homo sapiens
tggctggatgggggtgaagtat

SEQ ID NO: 616269 - DNA, 17 bp, Homo sapiens
tggctgggtttgggcag

SEQ ID NO: 616270 - DNA, 22 bp, Homo sapiens
tggctgggtttgggcagtggag

SEQ ID NO: 616271 - DNA, 23 bp, Homo sapiens
tggctgtggcccctccttctccc

SEQ ID NO: 616272 - DNA, 18 bp, Homo sapiens
tggcttagcgttctgttt

SEQ ID NO: 616273 - DNA, 15 bp, Homo sapiens
tggcttcagaattgt

SEQ ID NO: 616274 - DNA, 15 bp, Homo sapiens
tggcttcccatgtct

SEQ ID NO: 616275 - DNA, 17 bp, Homo sapiens
tggcttcccatgtcttt

SEQ ID NO: 616276 - DNA, 14 bp, Homo sapiens
tggcttctgggaca

SEQ ID NO: 616277 - DNA, 21 bp, Homo sapiens
tggcttctgggacaggcacca

SEQ ID NO: 616278 - DNA, 12 bp, Homo sapiens
tggcttgtaggg

SEQ ID NO: 616279 - DNA, 17 bp, Homo sapiens
tggctttggcgccccat

SEQ ID NO: 616280 - DNA, 14 bp, Homo sapiens
tggctttgtgctta

SEQ ID NO: 616281 - DNA, 17 bp, Homo sapiens
tgggaaagaacttggac

SEQ ID NO: 616282 - DNA, 15 bp, Homo sapiens
tgggaaattcttgca

SEQ ID NO: 616283 - DNA, 20 bp, Homo sapiens
tgggaaattcttgcactgta

SEQ ID NO: 616284 - DNA, 16 bp, Homo sapiens
tgggaacacagtgccc

SEQ ID NO: 616285 - DNA, 12 bp, Homo sapiens
tgggaagagaag

SEQ ID NO: 616286 - DNA, 13 bp, Homo sapiens
tgggaattgcatg

SEQ ID NO: 616287 - DNA, 14 bp, Homo sapiens
tgggaattgcatgc

SEQ ID NO: 616288 - DNA, 14 bp, Homo sapiens
tgggacggaagtgg

SEQ ID NO: 616289 - DNA, 13 bp, Homo sapiens
tgggaggcagcat

SEQ ID NO: 616290 - DNA, 14 bp, Homo sapiens
tgggagtccacttt

SEQ ID NO: 616291 - DNA, 16 bp, Homo sapiens
tgggataggagggtgc

SEQ ID NO: 616292 - DNA, 17 bp, Homo sapiens
tgggataggagggtgcc

SEQ ID NO: 616293 - DNA, 15 bp, Homo sapiens
tgggatccagagaga

SEQ ID NO: 616294 - DNA, 20 bp, Homo sapiens
tgggattcctcccctggaag

SEQ ID NO: 616295 - DNA, 13 bp, Homo sapiens
tgggcaccctgca

SEQ ID NO: 616296 - DNA, 15 bp, Homo sapiens
tgggcaccctgcagg

SEQ ID NO: 616297 - DNA, 19 bp, Homo sapiens
tgggcaccctgcaggcagg

SEQ ID NO: 616298 - DNA, 20 bp, Homo sapiens
tgggcaccctgcaggcaggc

SEQ ID NO: 616299 - DNA, 18 bp, Homo sapiens
tgggcacgggagagcgcc

SEQ ID NO: 616300 - DNA, 12 bp, Homo sapiens
tgggcagggccg

SEQ ID NO: 616301 - DNA, 15 bp, Homo sapiens
tgggcagtggagagg

SEQ ID NO: 616302 - DNA, 17 bp, Homo sapiens
tgggcagtggagagggg

SEQ ID NO: 616303 - DNA, 18 bp, Homo sapiens
tgggcagtggagagggga

SEQ ID NO: 616304 - DNA, 14 bp, Homo sapiens
tgggccaagccagg

SEQ ID NO: 616305 - DNA, 15 bp, Homo sapiens
tgggccagcccttgc

SEQ ID NO: 616306 - DNA, 15 bp, Homo sapiens
tgggcccaggcccag

SEQ ID NO: 616307 - DNA, 17 bp, Homo sapiens
tgggcccttagaatgtg

SEQ ID NO: 616308 - DNA, 22 bp, Homo sapiens
tgggcccttagaatgtgaaaaa

SEQ ID NO: 616309 - DNA, 18 bp, Homo sapiens
tgggcctccatgccccag

SEQ ID NO: 616310 - DNA, 21 bp, Homo sapiens
tgggcgccggttccacgtggg

SEQ ID NO: 616311 - DNA, 20 bp, Homo sapiens
tgggctcactacatgggcca

SEQ ID NO: 616312 - DNA, 22 bp, Homo sapiens
tgggctcactacatgggccagc

SEQ ID NO: 616313 - DNA, 16 bp, Homo sapiens
tgggctcagggttggc

SEQ ID NO: 616314 - DNA, 15 bp, Homo sapiens
tgggctccagagtag

SEQ ID NO: 616315 - DNA, 15 bp, Homo sapiens
tgggctgcctgctgt

SEQ ID NO: 616316 - DNA, 16 bp, Homo sapiens
tgggctgcctgctgtg

SEQ ID NO: 616317 - DNA, 15 bp, Homo sapiens
tgggctgctggggca

SEQ ID NO: 616318 - DNA, 21 bp, Homo sapiens
tgggctgctggggcagggccc

SEQ ID NO: 616319 - DNA, 22 bp, Homo sapiens
tgggctgctggggcagggccca

SEQ ID NO: 616320 - DNA, 23 bp, Homo sapiens
tgggctgctggggcagggcccag

SEQ ID NO: 616321 - DNA, 20 bp, Homo sapiens
tgggctgttgtgtctggagc

SEQ ID NO: 616322 - DNA, 22 bp, Homo sapiens
tgggctgttgtgtctggagcct

SEQ ID NO: 616323 - DNA, 23 bp, Homo sapiens
tgggctgttgtgtctggagcctg

SEQ ID NO: 616324 - DNA, 14 bp, Homo sapiens
tggggaccaggagc

SEQ ID NO: 616325 - DNA, 20 bp, Homo sapiens
tggggaggacccctgccctc

SEQ ID NO: 616326 - DNA, 14 bp, Homo sapiens
tggggagggtgggc

SEQ ID NO: 616327 - DNA, 20 bp, Homo sapiens
tggggcagggcccagggagg

SEQ ID NO: 616328 - DNA, 15 bp, Homo sapiens
tggggcctgggctgt

SEQ ID NO: 616329 - DNA, 14 bp, Homo sapiens
tggggctggtggga

SEQ ID NO: 616330 - DNA, 14 bp, Homo sapiens
tggggcttatcaga

SEQ ID NO: 616331 - DNA, 22 bp, Homo sapiens
tggggcttggaagggcgctgag

SEQ ID NO: 616332 - DNA, 22 bp, Homo sapiens
tgggggacgcccagcccccacc

SEQ ID NO: 616333 - DNA, 20 bp, Homo sapiens
tgggggaggtccctgccagt

SEQ ID NO: 616334 - DNA, 22 bp, Homo sapiens
tgggggctgcgtccctgctcag

SEQ ID NO: 616335 - DNA, 11 bp, Homo sapiens
tgggggctgct

SEQ ID NO: 616336 - DNA, 22 bp, Homo sapiens
tgggggctgttagctcagagga

SEQ ID NO: 616337 - DNA, 17 bp, Homo sapiens
tggggggcgggccaggg

SEQ ID NO: 616338 - DNA, 13 bp, Homo sapiens
tggggtagagagg

SEQ ID NO: 616339 - DNA, 14 bp, Homo sapiens
tggggtagagagga

SEQ ID NO: 616340 - DNA, 16 bp, Homo sapiens
tggggtagagaggaca

SEQ ID NO: 616341 - DNA, 16 bp, Homo sapiens
tggggtctctgagcag

SEQ ID NO: 616342 - DNA, 22 bp, Homo sapiens
tggggtctctgagcagtgggga

SEQ ID NO: 616343 - DNA, 13 bp, Homo sapiens
tgggtccaggaga

SEQ ID NO: 616344 - DNA, 16 bp, Homo sapiens
tgggtccccctcctgc

SEQ ID NO: 616345 - DNA, 17 bp, Homo sapiens
tgggtccccctcctgca

SEQ ID NO: 616346 - DNA, 18 bp, Homo sapiens
tgggtccccctcctgcac

SEQ ID NO: 616347 - DNA, 15 bp, Homo sapiens
tgggtcctgctgctc

SEQ ID NO: 616348 - DNA, 14 bp, Homo sapiens
tgggtcgcccctcc

SEQ ID NO: 616349 - DNA, 11 bp, Homo sapiens
tgggtgccctg

SEQ ID NO: 616350 - DNA, 15 bp, Homo sapiens
tgggtgtgccaggct

SEQ ID NO: 616351 - DNA, 16 bp, Homo sapiens
tgggtgtgccaggcta

SEQ ID NO: 616352 - DNA, 13 bp, Homo sapiens
tgggttaacagta

SEQ ID NO: 616353 - DNA, 23 bp, Homo sapiens
tgggttaacagtaaatatacact

SEQ ID NO: 616354 - DNA, 14 bp, Homo sapiens
tgggttccagacag

SEQ ID NO: 616355 - DNA, 20 bp, Homo sapiens
tgggttccagacagagtgga

SEQ ID NO: 616356 - DNA, 21 bp, Homo sapiens
tgggttccagacagagtggat

SEQ ID NO: 616357 - DNA, 16 bp, Homo sapiens
tgggttctttggaagc

SEQ ID NO: 616358 - DNA, 15 bp, Homo sapiens
tgggtttgggcagtg

SEQ ID NO: 616359 - DNA, 20 bp, Homo sapiens
tgggtttgggcagtggagag

SEQ ID NO: 616360 - DNA, 21 bp, Homo sapiens
tgggtttgggcagtggagagg

SEQ ID NO: 616361 - DNA, 13 bp, Homo sapiens
tggtaccagagcc

SEQ ID NO: 616362 - DNA, 16 bp, Homo sapiens
tggtacctctgtctat

SEQ ID NO: 616363 - DNA, 18 bp, Homo sapiens
tggtagaaactttggaag

SEQ ID NO: 616364 - DNA, 15 bp, Homo sapiens
tggtagttttcccta

SEQ ID NO: 616365 - DNA, 22 bp, Homo sapiens
tggtatgaaacaaatatactca

SEQ ID NO: 616366 - DNA, 14 bp, Homo sapiens
tggtattttaacat

SEQ ID NO: 616367 - DNA, 17 bp, Homo sapiens
tggtattttaacatagc

SEQ ID NO: 616368 - DNA, 18 bp, Homo sapiens
tggtattttaacatagca

SEQ ID NO: 616369 - DNA, 17 bp, Homo sapiens
tggtattttttgtgaat

SEQ ID NO: 616370 - DNA, 19 bp, Homo sapiens
tggtcaaggcccggcccca

SEQ ID NO: 616371 - DNA, 21 bp, Homo sapiens
tggtcaaggcccggccccatc

SEQ ID NO: 616372 - DNA, 19 bp, Homo sapiens
tggtcatttggtggctcta

SEQ ID NO: 616373 - DNA, 16 bp, Homo sapiens
tggtctctttctttcc

SEQ ID NO: 616374 - DNA, 20 bp, Homo sapiens
tggtctctttctttccaaag

SEQ ID NO: 616375 - DNA, 16 bp, Homo sapiens
tggtcttaactaatgt

SEQ ID NO: 616376 - DNA, 22 bp, Homo sapiens
tggtcttaactaatgtaaatat

SEQ ID NO: 616377 - DNA, 12 bp, Homo sapiens
tggtcttggaga

SEQ ID NO: 616378 - DNA, 14 bp, Homo sapiens
tggtcttggagagg

SEQ ID NO: 616379 - DNA, 14 bp, Homo sapiens
tgttcaaattctga

SEQ ID NO: 616380 - DNA, 16 bp, Homo sapiens
tgttcaaattctgatt

SEQ ID NO: 616381 - DNA, 17 bp, Homo sapiens
tgttcacgcaacttgaa

SEQ ID NO: 616382 - DNA, 16 bp, Homo sapiens
tgttcagatctcatag

SEQ ID NO: 616383 - DNA, 10 bp, Homo sapiens
tgttccaagt

SEQ ID NO: 616384 - DNA, 14 bp, Homo sapiens
tgttccctctttct

SEQ ID NO: 616385 - DNA, 16 bp, Homo sapiens
tgttccgttcatctga

SEQ ID NO: 616386 - DNA, 16 bp, Homo sapiens
tgttctcaacacacag

SEQ ID NO: 616387 - DNA, 20 bp, Homo sapiens
tgttctcctccaaatgctgt

SEQ ID NO: 616388 - DNA, 20 bp, Homo sapiens
tgttctctcttggtctcttt

SEQ ID NO: 616389 - DNA, 19 bp, Homo sapiens
tgttctgggttaacagtaa

SEQ ID NO: 616390 - DNA, 16 bp, Homo sapiens
tgttcttgcagcagag

SEQ ID NO: 616391 - DNA, 17 bp, Homo sapiens
tgttcttgtaaaactgt

SEQ ID NO: 616392 - DNA, 19 bp, Homo sapiens
tgttcttgtaaaactgtga

SEQ ID NO: 616393 - DNA, 22 bp, Homo sapiens
tgttcttgtaaaactgtgacat

SEQ ID NO: 616394 - DNA, 23 bp, Homo sapiens
tgttcttgtaaaactgtgacatt

SEQ ID NO: 616395 - DNA, 14 bp, Homo sapiens
tgttgacctaccct

SEQ ID NO: 616396 - DNA, 15 bp, Homo sapiens
tgttgattctttcaa

SEQ ID NO: 616397 - DNA, 14 bp, Homo sapiens
tgttgcttaatcta

SEQ ID NO: 616398 - DNA, 21 bp, Homo sapiens
tgttgtaatatcagttacagt

SEQ ID NO: 616399 - DNA, 13 bp, Homo sapiens
tgttgtccctgca

SEQ ID NO: 616400 - DNA, 16 bp, Homo sapiens
tgttgtcctgtgtcat

SEQ ID NO: 616401 - DNA, 17 bp, Homo sapiens
tgttgtctgaaacatag

SEQ ID NO: 616402 - DNA, 13 bp, Homo sapiens
tgttgtcttattc

SEQ ID NO: 616403 - DNA, 17 bp, Homo sapiens
tgttgtgtctggagcct

SEQ ID NO: 616404 - DNA, 20 bp, Homo sapiens
tgttgtgttacaataagtgt

SEQ ID NO: 616405 - DNA, 18 bp, Homo sapiens
tgtttaaaatggcattta

SEQ ID NO: 616406 - DNA, 21 bp, Homo sapiens
tgtttaaaatggcatttagca

SEQ ID NO: 616407 - DNA, 14 bp, Homo sapiens
tgtttaataatatg

SEQ ID NO: 616408 - DNA, 20 bp, Homo sapiens
tgtttaataatatgtacaaa

SEQ ID NO: 616409 - DNA, 23 bp, Homo sapiens
tgtttaatactcatccttgtata

SEQ ID NO: 616410 - DNA, 16 bp, Homo sapiens
tgtttaccctccctgt

SEQ ID NO: 616411 - DNA, 19 bp, Homo sapiens
tgtttaccctccctgtccc

SEQ ID NO: 616412 - DNA, 17 bp, Homo sapiens
tgtttagaagagcctga

SEQ ID NO: 616413 - DNA, 18 bp, Homo sapiens
tgtttagaagagcctgac

SEQ ID NO: 616414 - DNA, 15 bp, Homo sapiens
tgtttagtagctgat

SEQ ID NO: 616415 - DNA, 20 bp, Homo sapiens
tgtttagtagctgataaaga

SEQ ID NO: 616416 - DNA, 14 bp, Homo sapiens
tgtttccaagatgt

SEQ ID NO: 616417 - DNA, 20 bp, Homo sapiens
tgtttcgcattaagcacaca

SEQ ID NO: 616418 - DNA, 22 bp, Homo sapiens
tgtttcttacgcttgctatcat

SEQ ID NO: 616419 - DNA, 11 bp, Homo sapiens
tgtttcttggt

SEQ ID NO: 616420 - DNA, 16 bp, Homo sapiens
tgtttgaattgatttt

SEQ ID NO: 616421 - DNA, 21 bp, Homo sapiens
tgtttgaattgatttttaaac

SEQ ID NO: 616422 - DNA, 16 bp, Homo sapiens
tgtttggaggctgctg

SEQ ID NO: 616423 - DNA, 22 bp, Homo sapiens
tgttttacaaagaaacaaaata

SEQ ID NO: 616424 - DNA, 16 bp, Homo sapiens
tgttttatatgattaa

SEQ ID NO: 616425 - DNA, 15 bp, Homo sapiens
tgttttcattctggt

SEQ ID NO: 616426 - DNA, 21 bp, Homo sapiens
tgttttccccaattatcctcc

SEQ ID NO: 616427 - DNA, 16 bp, Homo sapiens
tgttttgccaacattg

SEQ ID NO: 616428 - DNA, 18 bp, Homo sapiens
tgttttgctttttctgac

SEQ ID NO: 616429 - DNA, 17 bp, Homo sapiens
tgttttgggcctccatg

SEQ ID NO: 616430 - DNA, 13 bp, Homo sapiens
tgttttgtggata

SEQ ID NO: 616431 - DNA, 14 bp, Homo sapiens
tgttttgtggataa

SEQ ID NO: 616432 - DNA, 12 bp, Homo sapiens
tgtttttacata

SEQ ID NO: 616433 - DNA, 16 bp, Homo sapiens
tgttttttatacttca

SEQ ID NO: 616434 - DNA, 22 bp, Homo sapiens
ttaaaaaaaatattctgtcatt

SEQ ID NO: 616435 - DNA, 17 bp, Homo sapiens
ttaaaaaaataaaacat

SEQ ID NO: 616436 - DNA, 21 bp, Homo sapiens
ttaaaaaaataatataaatga

SEQ ID NO: 616437 - DNA, 20 bp, Homo sapiens
ttaaaaaagatggatttgac

SEQ ID NO: 616438 - DNA, 18 bp, Homo sapiens
ttaaaaagaccatgcatt

SEQ ID NO: 616439 - DNA, 15 bp, Homo sapiens
ttaaaacaagagacc

SEQ ID NO: 616440 - DNA, 14 bp, Homo sapiens
ttaaaacatcaaaa

SEQ ID NO: 616441 - DNA, 14 bp, Homo sapiens
ttaaaatatagtgt

SEQ ID NO: 616442 - DNA, 18 bp, Homo sapiens
ttaaaatattttcttaat

SEQ ID NO: 616443 - DNA, 20 bp, Homo sapiens
ttaaaatggcatttagcaca

SEQ ID NO: 616444 - DNA, 18 bp, Homo sapiens
ttaaaatgtgtttttcag

SEQ ID NO: 616445 - DNA, 19 bp, Homo sapiens
ttaaacaaaaactttccat

SEQ ID NO: 616446 - DNA, 17 bp, Homo sapiens
ttaaacaaaatttatgt

SEQ ID NO: 616447 - DNA, 16 bp, Homo sapiens
ttaaacccacataaac

SEQ ID NO: 616448 - DNA, 17 bp, Homo sapiens
ttaaacccacataaaca

SEQ ID NO: 616449 - DNA, 21 bp, Homo sapiens
ttaaacccacataaacacttc

SEQ ID NO: 616450 - DNA, 18 bp, Homo sapiens
ttaaactaattaaactga

SEQ ID NO: 616451 - DNA, 18 bp, Homo sapiens
ttaaactgggaaatgaga

SEQ ID NO: 616452 - DNA, 12 bp, Homo sapiens
ttaaagaaaggc

SEQ ID NO: 616453 - DNA, 24 bp, Homo sapiens
ttaaagaagtccatgtgataattg

SEQ ID NO: 616454 - DNA, 16 bp, Homo sapiens
ttaaagcttatttccc

SEQ ID NO: 616455 - DNA, 15 bp, Homo sapiens
ttaaagtctgagaaa

SEQ ID NO: 616456 - DNA, 17 bp, Homo sapiens
ttaaagtctgagaaatt

SEQ ID NO: 616457 - DNA, 21 bp, Homo sapiens
ttaaagtgtccattgacatgt

SEQ ID NO: 616458 - DNA, 12 bp, Homo sapiens
ttaaatctttgt

SEQ ID NO: 616459 - DNA, 19 bp, Homo sapiens
ttaacactgagtgaaatat

SEQ ID NO: 616460 - DNA, 20 bp, Homo sapiens
ttaacactgagtgaaatatt

SEQ ID NO: 616461 - DNA, 13 bp, Homo sapiens
ttaacagctgtat

SEQ ID NO: 616462 - DNA, 13 bp, Homo sapiens
ttaacagtaaata

SEQ ID NO: 616463 - DNA, 19 bp, Homo sapiens
ttaacagtaaatatacact

SEQ ID NO: 616464 - DNA, 11 bp, Homo sapiens
ttaacatagca

SEQ ID NO: 616465 - DNA, 22 bp, Homo sapiens
ttaaccgggactacagaagtgg

SEQ ID NO: 616466 - DNA, 15 bp, Homo sapiens
ttaactaatgtaaat

SEQ ID NO: 616467 - DNA, 17 bp, Homo sapiens
ttaactaatgtaaatat

SEQ ID NO: 616468 - DNA, 16 bp, Homo sapiens
ttaactccgtttccaa

SEQ ID NO: 616469 - DNA, 18 bp, Homo sapiens
ttaagagattttatgttt

SEQ ID NO: 616470 - DNA, 17 bp, Homo sapiens
ttaagcacaaaaaattt

SEQ ID NO: 616471 - DNA, 11 bp, Homo sapiens
ttaagcacaca

SEQ ID NO: 616472 - DNA, 23 bp, Homo sapiens
ttaagcacacacatctggccctg

SEQ ID NO: 616473 - DNA, 16 bp, Homo sapiens
ttaaggactacagaat

SEQ ID NO: 616474 - DNA, 16 bp, Homo sapiens
ttaaggggatctaaaa

SEQ ID NO: 616475 - DNA, 14 bp, Homo sapiens
ttaaggttatttat

SEQ ID NO: 616476 - DNA, 15 bp, Homo sapiens
ttaagtaatttcatg

SEQ ID NO: 616477 - DNA, 18 bp, Homo sapiens
ttaagtcttactgttttg

SEQ ID NO: 616478 - DNA, 18 bp, Homo sapiens
ttaataaagattccatgg

SEQ ID NO: 616479 - DNA, 13 bp, Homo sapiens
ttaataacagaaa

SEQ ID NO: 616480 - DNA, 12 bp, Homo sapiens
ttaataatatgt

SEQ ID NO: 616481 - DNA, 20 bp, Homo sapiens
ttaataatatgtacaaataa

SEQ ID NO: 616482 - DNA, 21 bp, Homo sapiens
ttaataatatgtacaaataat

SEQ ID NO: 616483 - DNA, 19 bp, Homo sapiens
ttaatagtttctaaaccat

SEQ ID NO: 616484 - DNA, 16 bp, Homo sapiens
ttaatatactccttaa

SEQ ID NO: 616485 - DNA, 18 bp, Homo sapiens
ttaattgaaatacctatt

SEQ ID NO: 616486 - DNA, 17 bp, Homo sapiens
ttaattgatagaataaa

SEQ ID NO: 616487 - DNA, 16 bp, Homo sapiens
ttaattggcagcagat

SEQ ID NO: 616488 - DNA, 19 bp, Homo sapiens
ttaattggcagcagatttt

SEQ ID NO: 616489 - DNA, 22 bp, Homo sapiens
ttacaaacaagatacgtatatt

SEQ ID NO: 616490 - DNA, 19 bp, Homo sapiens
ttacaaatttttactcagg

SEQ ID NO: 616491 - DNA, 20 bp, Homo sapiens
ttacaaatttttactcaggc

SEQ ID NO: 616492 - DNA, 13 bp, Homo sapiens
ttacagaaacacg

SEQ ID NO: 616493 - DNA, 15 bp, Homo sapiens
ttacagaaacacgga

SEQ ID NO: 616494 - DNA, 15 bp, Homo sapiens
ttacagtggcagtat

SEQ ID NO: 616495 - DNA, 17 bp, Homo sapiens
ttacagtggcagtattg

SEQ ID NO: 616496 - DNA, 20 bp, Homo sapiens
ttacagtggcagtattgaca

SEQ ID NO: 616497 - DNA, 21 bp, Homo sapiens
ttacataacaggcattgcact

SEQ ID NO: 616498 - DNA, 18 bp, Homo sapiens
ttacatcccataacttgt

SEQ ID NO: 616499 - DNA, 14 bp, Homo sapiens
ttacatcctctgct

SEQ ID NO: 616500 - DNA, 21 bp, Homo sapiens
ttacatcctctgcttgtcatt

SEQ ID NO: 616501 - DNA, 17 bp, Homo sapiens
ttacattgtcctgtagc

SEQ ID NO: 616502 - DNA, 21 bp, Homo sapiens
ttacattgtcctgtagcttta

SEQ ID NO: 616503 - DNA, 22 bp, Homo sapiens
ttaccagaagtttaaatctttg

SEQ ID NO: 616504 - DNA, 22 bp, Homo sapiens
ttaccccgtccctttccctgca

SEQ ID NO: 616505 - DNA, 15 bp, Homo sapiens
ttaccctccctgtcc

SEQ ID NO: 616506 - DNA, 15 bp, Homo sapiens
ttacccttcaatgtt

SEQ ID NO: 616507 - DNA, 18 bp, Homo sapiens
ttaccgcccacccagcag

SEQ ID NO: 616508 - DNA, 11 bp, Homo sapiens
ttacctgaaag

SEQ ID NO: 616509 - DNA, 19 bp, Homo sapiens
ttacctgtaatagcctcac

SEQ ID NO: 616510 - DNA, 20 bp, Homo sapiens
ttacctgtaatagcctcacc

SEQ ID NO: 616511 - DNA, 22 bp, Homo sapiens
ttacctgttctctagttttcca

SEQ ID NO: 616512 - DNA, 16 bp, Homo sapiens
ttactaaccaccattt

SEQ ID NO: 616513 - DNA, 16 bp, Homo sapiens
ttactcaggctttcta

SEQ ID NO: 616514 - DNA, 20 bp, Homo sapiens
ttactcctcctgctcctcac

SEQ ID NO: 616515 - DNA, 20 bp, Homo sapiens
ttactctgcctgtcaagttt

SEQ ID NO: 616516 - DNA, 20 bp, Homo sapiens
ttactgacatggtgctgtgt

SEQ ID NO: 616517 - DNA, 13 bp, Homo sapiens
ttactgcaatgtc

SEQ ID NO: 616518 - DNA, 16 bp, Homo sapiens
ttactgcaatgtctgt

SEQ ID NO: 616519 - DNA, 15 bp, Homo sapiens
ttacttgtgttcatt

SEQ ID NO: 616520 - DNA, 22 bp, Homo sapiens
ttagaaaaccccacagaaatct

SEQ ID NO: 616521 - DNA, 23 bp, Homo sapiens
ttagaaaaccccacagaaatctc

SEQ ID NO: 616522 - DNA, 17 bp, Homo sapiens
ttagaagaaatatgagc

SEQ ID NO: 616523 - DNA, 20 bp, Homo sapiens
ttagaatcaagtctgtgaaa

SEQ ID NO: 616524 - DNA, 17 bp, Homo sapiens
ttagaatgaatattaaa

SEQ ID NO: 616525 - DNA, 13 bp, Homo sapiens
ttagaatgtgaaa

SEQ ID NO: 616526 - DNA, 13 bp, Homo sapiens
ttagaatgttgaa

SEQ ID NO: 616527 - DNA, 20 bp, Homo sapiens
ttagagataccctctgagac

SEQ ID NO: 616528 - DNA, 20 bp, Homo sapiens
ttagagattgacttcagaaa

SEQ ID NO: 616529 - DNA, 20 bp, Homo sapiens
ttagattcctacttaaacaa

SEQ ID NO: 616530 - DNA, 15 bp, Homo sapiens
ttagcacagtattta

SEQ ID NO: 616531 - DNA, 18 bp, Homo sapiens
ttagcacagtatttaaca

SEQ ID NO: 616532 - DNA, 23 bp, Homo sapiens
ttagcccggccaaggacactgat

SEQ ID NO: 616533 - DNA, 16 bp, Homo sapiens
ttagcgttgttttgtg

SEQ ID NO: 616534 - DNA, 21 bp, Homo sapiens
ttagctagttagagactcgcc

SEQ ID NO: 616535 - DNA, 21 bp, Homo sapiens
ttagctcagaggagaggagca

SEQ ID NO: 616536 - DNA, 11 bp, Homo sapiens
ttagctgttta

SEQ ID NO: 616537 - DNA, 11 bp, Homo sapiens
ttagtaaattc

SEQ ID NO: 616538 - DNA, 15 bp, Homo sapiens
ttagtaaattcctaa

SEQ ID NO: 616539 - DNA, 16 bp, Homo sapiens
ttagtagctgataaag

SEQ ID NO: 616540 - DNA, 13 bp, Homo sapiens
ttagtgttttcat

SEQ ID NO: 616541 - DNA, 15 bp, Homo sapiens
ttagtgttttcattc

SEQ ID NO: 616542 - DNA, 12 bp, Homo sapiens
ttataaaatctg

SEQ ID NO: 616543 - DNA, 16 bp, Homo sapiens
ttataaattataatgc

SEQ ID NO: 616544 - DNA, 15 bp, Homo sapiens
ttataacattgtaaa

SEQ ID NO: 616545 - DNA, 17 bp, Homo sapiens
ttataacattgtatgtt

SEQ ID NO: 616546 - DNA, 18 bp, Homo sapiens
ttataacattgtatgtta

SEQ ID NO: 616547 - DNA, 21 bp, Homo sapiens
ttataaggctgactcttacta

SEQ ID NO: 616548 - DNA, 19 bp, Homo sapiens
ttataatggccctgtagct

SEQ ID NO: 616549 - DNA, 12 bp, Homo sapiens
ttatacacataa

SEQ ID NO: 616550 - DNA, 16 bp, Homo sapiens
ttatagaaatttacta

SEQ ID NO: 616551 - DNA, 17 bp, Homo sapiens
ttatagagcctcaattt

SEQ ID NO: 616552 - DNA, 19 bp, Homo sapiens
ttatagagttattatagtt

SEQ ID NO: 616553 - DNA, 19 bp, Homo sapiens
ttatagagttcatagaaat

SEQ ID NO: 616554 - DNA, 17 bp, Homo sapiens
ttataggaaataaatct

SEQ ID NO: 616555 - DNA, 18 bp, Homo sapiens
ttatagtctgtacttcag

SEQ ID NO: 616556 - DNA, 19 bp, Homo sapiens
ttatatacaaagctgtcac

SEQ ID NO: 616557 - DNA, 13 bp, Homo sapiens
ttatatataaata

SEQ ID NO: 616558 - DNA, 14 bp, Homo sapiens
ttatatataaatat

SEQ ID NO: 616559 - DNA, 13 bp, Homo sapiens
ttatatatgtata

SEQ ID NO: 616560 - DNA, 22 bp, Homo sapiens
ttatatctgtggtcttcaaatt

SEQ ID NO: 616561 - DNA, 17 bp, Homo sapiens
ttatattattttctgta

SEQ ID NO: 616562 - DNA, 12 bp, Homo sapiens
ttatatttcaac

SEQ ID NO: 616563 - DNA, 17 bp, Homo sapiens
ttatcaaaaaacagaaa

SEQ ID NO: 616564 - DNA, 13 bp, Homo sapiens
ttatcctcaagtt

SEQ ID NO: 616565 - DNA, 22 bp, Homo sapiens
ttatctccagccaatttcaaag

SEQ ID NO: 616566 - DNA, 17 bp, Homo sapiens
ttatcttgacaggcgcc

SEQ ID NO: 616567 - DNA, 13 bp, Homo sapiens
ttatgaagatagt

SEQ ID NO: 616568 - DNA, 18 bp, Homo sapiens
ttatgaatcgcagacgca

SEQ ID NO: 616569 - DNA, 22 bp, Homo sapiens
ttatgaggaaacttggacattt

SEQ ID NO: 616570 - DNA, 20 bp, Homo sapiens
ttatgcaggcagattaataa

SEQ ID NO: 616571 - DNA, 23 bp, Homo sapiens
ttatgcatgagaactaaatagat

SEQ ID NO: 616572 - DNA, 18 bp, Homo sapiens
ttatgcatttatgcatga

SEQ ID NO: 616573 - DNA, 18 bp, Homo sapiens
ttatggaacactctgaga

SEQ ID NO: 616574 - DNA, 20 bp, Homo sapiens
ttatggaacactctgagact

SEQ ID NO: 616575 - DNA, 14 bp, Homo sapiens
ttatgtattctctt

SEQ ID NO: 616576 - DNA, 15 bp, Homo sapiens
ttatgtcaaatggat

SEQ ID NO: 616577 - DNA, 16 bp, Homo sapiens
ttatgtcaaatggatg

SEQ ID NO: 616578 - DNA, 18 bp, Homo sapiens
ttatgtcattttcagatc

SEQ ID NO: 616579 - DNA, 18 bp, Homo sapiens
ttatgtcccttcacatag

SEQ ID NO: 616580 - DNA, 19 bp, Homo sapiens
ttatgtttaaaatggcatt

SEQ ID NO: 616581 - DNA, 16 bp, Homo sapiens
ttattaaatttattaa

SEQ ID NO: 616582 - DNA, 21 bp, Homo sapiens
ttattaaatttattaaatgtt

SEQ ID NO: 616583 - DNA, 15 bp, Homo sapiens
ttattacaacaagca

SEQ ID NO: 616584 - DNA, 19 bp, Homo sapiens
ttattaggttaagtctcaa

SEQ ID NO: 616585 - DNA, 14 bp, Homo sapiens
ttattatagtctgt

SEQ ID NO: 616586 - DNA, 21 bp, Homo sapiens
tttgtgaagtgattgacattt

SEQ ID NO: 616587 - DNA, 18 bp, Homo sapiens
tttgtggataagaaaaat

SEQ ID NO: 616588 - DNA, 15 bp, Homo sapiens
tttgtgtcctttaaa

SEQ ID NO: 616589 - DNA, 12 bp, Homo sapiens
tttgtgtctttt

SEQ ID NO: 616590 - DNA, 13 bp, Homo sapiens
tttgttaaaatat

SEQ ID NO: 616591 - DNA, 17 bp, Homo sapiens
tttgtttcttacgcttg

SEQ ID NO: 616592 - DNA, 17 bp, Homo sapiens
ttttaaagaagtccatg

SEQ ID NO: 616593 - DNA, 22 bp, Homo sapiens
ttttaaagaagtccatgtgata

SEQ ID NO: 616594 - DNA, 18 bp, Homo sapiens
ttttaactgcttcaagtg

SEQ ID NO: 616595 - DNA, 13 bp, Homo sapiens
ttttacaaagaaa

SEQ ID NO: 616596 - DNA, 15 bp, Homo sapiens
ttttacaaagaaaca

SEQ ID NO: 616597 - DNA, 12 bp, Homo sapiens
ttttagaaattc

SEQ ID NO: 616598 - DNA, 18 bp, Homo sapiens
ttttagaagagttacctt

SEQ ID NO: 616599 - DNA, 13 bp, Homo sapiens
ttttagattccta

SEQ ID NO: 616600 - DNA, 20 bp, Homo sapiens
ttttatacctgtacacacac

SEQ ID NO: 616601 - DNA, 15 bp, Homo sapiens
ttttatacttcaaat

SEQ ID NO: 616602 - DNA, 18 bp, Homo sapiens
ttttatgtttaaaatggc

SEQ ID NO: 616603 - DNA, 21 bp, Homo sapiens
ttttattgtaacagacattgt

SEQ ID NO: 616604 - DNA, 17 bp, Homo sapiens
ttttattgtttaaagca

SEQ ID NO: 616605 - DNA, 13 bp, Homo sapiens
ttttcacttctta

SEQ ID NO: 616606 - DNA, 18 bp, Homo sapiens
ttttcacttcttaaggac

SEQ ID NO: 616607 - DNA, 18 bp, Homo sapiens
ttttcagttataatttca

SEQ ID NO: 616608 - DNA, 20 bp, Homo sapiens
ttttccattatgaggaaact

SEQ ID NO: 616609 - DNA, 21 bp, Homo sapiens
ttttcccagtgaataaatatt

SEQ ID NO: 616610 - DNA, 19 bp, Homo sapiens
ttttccccaattatcctcc

SEQ ID NO: 616611 - DNA, 22 bp, Homo sapiens
ttttccccattgaccctcacct

SEQ ID NO: 616612 - DNA, 16 bp, Homo sapiens
ttttccttgactatta

SEQ ID NO: 616613 - DNA, 15 bp, Homo sapiens
ttttctatatttgga

SEQ ID NO: 616614 - DNA, 22 bp, Homo sapiens
ttttcttccaacatgtgatgtg

SEQ ID NO: 616615 - DNA, 23 bp, Homo sapiens
ttttcttctttaatttttctgtt

SEQ ID NO: 616616 - DNA, 16 bp, Homo sapiens
ttttgagccttattaa

SEQ ID NO: 616617 - DNA, 14 bp, Homo sapiens
ttttgatggctatg

SEQ ID NO: 616618 - DNA, 13 bp, Homo sapiens
ttttgatgtatta

SEQ ID NO: 616619 - DNA, 17 bp, Homo sapiens
ttttgcagctatggaca

SEQ ID NO: 616620 - DNA, 11 bp, Homo sapiens
ttttgctctcc

SEQ ID NO: 616621 - DNA, 17 bp, Homo sapiens
ttttgctttttctgact

SEQ ID NO: 616622 - DNA, 21 bp, Homo sapiens
ttttgggaaatgctgatttaa

SEQ ID NO: 616623 - DNA, 19 bp, Homo sapiens
ttttgtctgtgataacaga

SEQ ID NO: 616624 - DNA, 24 bp, Homo sapiens
ttttgtgaatggttgcaaagtgtt

SEQ ID NO: 616625 - DNA, 17 bp, Homo sapiens
ttttgttcaccttctgt

SEQ ID NO: 616626 - DNA, 21 bp, Homo sapiens
ttttgttcaccttctgtgcat

SEQ ID NO: 616627 - DNA, 20 bp, Homo sapiens
tttttaaccaaataagaata

SEQ ID NO: 616628 - DNA, 19 bp, Homo sapiens
tttttaacttatctccagc

SEQ ID NO: 616629 - DNA, 17 bp, Homo sapiens
tttttaaggttatttat

SEQ ID NO: 616630 - DNA, 19 bp, Homo sapiens
tttttaagtaatttcatgc

SEQ ID NO: 616631 - DNA, 20 bp, Homo sapiens
tttttaagtgctatgcatat

SEQ ID NO: 616632 - DNA, 15 bp, Homo sapiens
tttttaagtgttctg

SEQ ID NO: 616633 - DNA, 16 bp, Homo sapiens
tttttactcaggcttt

SEQ ID NO: 616634 - DNA, 21 bp, Homo sapiens
tttttactcaggctttctatt

SEQ ID NO: 616635 - DNA, 22 bp, Homo sapiens
tttttactcaggctttctattg

SEQ ID NO: 616636 - DNA, 14 bp, Homo sapiens
tttttagattccta

SEQ ID NO: 616637 - DNA, 15 bp, Homo sapiens
tttttatacctgtac

SEQ ID NO: 616638 - DNA, 13 bp, Homo sapiens
tttttattcataa

SEQ ID NO: 616639 - DNA, 16 bp, Homo sapiens
tttttcaatgtactgt

SEQ ID NO: 616640 - DNA, 15 bp, Homo sapiens
tttttcattttctct

SEQ ID NO: 616641 - DNA, 15 bp, Homo sapiens
tttttccagaattga

SEQ ID NO: 616642 - DNA, 22 bp, Homo sapiens
tttttctaaaactaaatagcat

SEQ ID NO: 616643 - DNA, 17 bp, Homo sapiens
tttttctgcactgagca

SEQ ID NO: 616644 - DNA, 16 bp, Homo sapiens
tttttgagtaaaactt

SEQ ID NO: 616645 - DNA, 23 bp, Homo sapiens
tttttgttcaccttctgtgcatc

SEQ ID NO: 616646 - DNA, 17 bp, Homo sapiens
ttttttaagtgttctgt

SEQ ID NO: 616647 - DNA, 13 bp, Homo sapiens
ttttttatacttc

SEQ ID NO: 616648 - DNA, 12 bp, Homo sapiens
ttttttcaatgt

SEQ ID NO: 616649 - DNA, 13 bp, Homo sapiens
ttttttgtctgtg

SEQ ID NO: 616650 - DNA, 12 bp, Homo sapiens
tttttttaagtg

SEQ ID NO: 616651 - DNA, 21 bp, Homo sapiens
ctggggtctctgagcagtggg

SEQ ID NO: 616652 - DNA, 16 bp, Homo sapiens
ctggggtggggcttgg

SEQ ID NO: 616653 - DNA, 18 bp, Homo sapiens
ctggggtggggcttggaa

SEQ ID NO: 616654 - DNA, 20 bp, Homo sapiens
ctgggtccccctcctgcacg

SEQ ID NO: 616655 - DNA, 12 bp, Homo sapiens
ctgggtcccggg

SEQ ID NO: 616656 - DNA, 14 bp, Homo sapiens
ctgggtcgcccctc

SEQ ID NO: 616657 - DNA, 18 bp, Homo sapiens
ctgggtcgcccctcctcg

SEQ ID NO: 616658 - DNA, 22 bp, Homo sapiens
ctgggtcgcccctcctcgggcg

SEQ ID NO: 616659 - DNA, 20 bp, Homo sapiens
ctgggtgtggcctggcttct

SEQ ID NO: 616660 - DNA, 14 bp, Homo sapiens
ctgggttaacagta

SEQ ID NO: 616661 - DNA, 20 bp, Homo sapiens
ctgggttaacagtaaatata

SEQ ID NO: 616662 - DNA, 15 bp, Homo sapiens
ctgggttgttgcaga

SEQ ID NO: 616663 - DNA, 22 bp, Homo sapiens
ctgggttgttgcagagtaaatc

SEQ ID NO: 616664 - DNA, 16 bp, Homo sapiens
ctgggtttgggcagtg

SEQ ID NO: 616665 - DNA, 17 bp, Homo sapiens
ctgggtttgggcagtgg

SEQ ID NO: 616666 - DNA, 21 bp, Homo sapiens
ctgggtttgggcagtggagag

SEQ ID NO: 616667 - DNA, 23 bp, Homo sapiens
ctgggtttgggcagtggagaggg

SEQ ID NO: 616668 - DNA, 18 bp, Homo sapiens
ctggtcagtgaagcccag

SEQ ID NO: 616669 - DNA, 22 bp, Homo sapiens
ctggtcagtgaagcccaggagg

SEQ ID NO: 616670 - DNA, 23 bp, Homo sapiens
ctggtcagtgaagcccaggagga

SEQ ID NO: 616671 - DNA, 20 bp, Homo sapiens
ctggtccttagtaaattcct

SEQ ID NO: 616672 - DNA, 18 bp, Homo sapiens
ctggtctggagcccctat

SEQ ID NO: 616673 - DNA, 18 bp, Homo sapiens
ctggtgtcttgagaccag

SEQ ID NO: 616674 - DNA, 23 bp, Homo sapiens
ctggtgtcttgagaccagcctgc

SEQ ID NO: 616675 - DNA, 13 bp, Homo sapiens
ctggttttttcca

SEQ ID NO: 616676 - DNA, 19 bp, Homo sapiens
ctgtaatagcctcaccttc

SEQ ID NO: 616677 - DNA, 18 bp, Homo sapiens
ctgtaattcttctccttt

SEQ ID NO: 616678 - DNA, 20 bp, Homo sapiens
ctgtaattcttctcctttgt

SEQ ID NO: 616679 - DNA, 12 bp, Homo sapiens
ctgtacacacac

SEQ ID NO: 616680 - DNA, 17 bp, Homo sapiens
ctgtacgaggcttctct

SEQ ID NO: 616681 - DNA, 19 bp, Homo sapiens
ctgtacttcagttctcatc

SEQ ID NO: 616682 - DNA, 20 bp, Homo sapiens
ctgtacttgatttttcaaag

SEQ ID NO: 616683 - DNA, 15 bp, Homo sapiens
ctgtagaagatgacc

SEQ ID NO: 616684 - DNA, 20 bp, Homo sapiens
ctgtagtttttgttcacctt

SEQ ID NO: 616685 - DNA, 22 bp, Homo sapiens
ctgtagtttttgttcaccttct

SEQ ID NO: 616686 - DNA, 16 bp, Homo sapiens
ctgtatatcagctcta

SEQ ID NO: 616687 - DNA, 15 bp, Homo sapiens
ctgtatgggaagaag

SEQ ID NO: 616688 - DNA, 11 bp, Homo sapiens
ctgtattgcta

SEQ ID NO: 616689 - DNA, 17 bp, Homo sapiens
ctgtatttgaggaaact

SEQ ID NO: 616690 - DNA, 20 bp, Homo sapiens
ctgtatttgaggaaactcat

SEQ ID NO: 616691 - DNA, 18 bp, Homo sapiens
ctgtcactcacaaaaggc

SEQ ID NO: 616692 - DNA, 13 bp, Homo sapiens
ctgtcagagcttt

SEQ ID NO: 616693 - DNA, 14 bp, Homo sapiens
ctgtcagcttccca

SEQ ID NO: 616694 - DNA, 16 bp, Homo sapiens
ctgtcaggaccatttt

SEQ ID NO: 616695 - DNA, 18 bp, Homo sapiens
ctgtcaggaccattttag

SEQ ID NO: 616696 - DNA, 14 bp, Homo sapiens
ctgtcagtttgtga

SEQ ID NO: 616697 - DNA, 20 bp, Homo sapiens
ctgtcagtttgtgaagtgat

SEQ ID NO: 616698 - DNA, 19 bp, Homo sapiens
ctgtcatgtgcgaacacag

SEQ ID NO: 616699 - DNA, 21 bp, Homo sapiens
ctgtcatgtgcgaacacagtg

SEQ ID NO: 616700 - DNA, 17 bp, Homo sapiens
ctgtccatccgtctctg

SEQ ID NO: 616701 - DNA, 18 bp, Homo sapiens
ctgtccatccgtctctgt

SEQ ID NO: 616702 - DNA, 20 bp, Homo sapiens
ctgtccatccgtctctgtcc

SEQ ID NO: 616703 - DNA, 21 bp, Homo sapiens
ctgtccatccgtctctgtccg

SEQ ID NO: 616704 - DNA, 20 bp, Homo sapiens
ctgtccctgtgggctcacac

SEQ ID NO: 616705 - DNA, 15 bp, Homo sapiens
ctgtccgtcctgctc

SEQ ID NO: 616706 - DNA, 16 bp, Homo sapiens
ctgtccgtcctgctcg

SEQ ID NO: 616707 - DNA, 18 bp, Homo sapiens
ctgtccgtctgtcctgcg

SEQ ID NO: 616708 - DNA, 21 bp, Homo sapiens
ctgtccgtctgtcctgcgcct

SEQ ID NO: 616709 - DNA, 16 bp, Homo sapiens
ctgtccttccaacctg

SEQ ID NO: 616710 - DNA, 22 bp, Homo sapiens
ctgtcggtgtttggaggctgct

SEQ ID NO: 616711 - DNA, 16 bp, Homo sapiens
ctgtctatttctgctg

SEQ ID NO: 616712 - DNA, 20 bp, Homo sapiens
ctgtctctacaaaaaaaatc

SEQ ID NO: 616713 - DNA, 21 bp, Homo sapiens
ctgtctctccctaccctcttc

SEQ ID NO: 616714 - DNA, 19 bp, Homo sapiens
ctgtctctcttttgctctc

SEQ ID NO: 616715 - DNA, 19 bp, Homo sapiens
ctgtctgaaaaagtgtttt

SEQ ID NO: 616716 - DNA, 13 bp, Homo sapiens
ctgtctgagccct

SEQ ID NO: 616717 - DNA, 24 bp, Homo sapiens
ctgtctgagccctgccctcactcc

SEQ ID NO: 616718 - DNA, 13 bp, Homo sapiens
ctgtctgtacttc

SEQ ID NO: 616719 - DNA, 22 bp, Homo sapiens
ctgtctgtgtgaggctccctcc

SEQ ID NO: 616720 - DNA, 15 bp, Homo sapiens
ctgtctttatgattt

SEQ ID NO: 616721 - DNA, 16 bp, Homo sapiens
ctgtctttgctgttta

SEQ ID NO: 616722 - DNA, 12 bp, Homo sapiens
ctgtgaaacagt

SEQ ID NO: 616723 - DNA, 15 bp, Homo sapiens
ctgtgaactgccagg

SEQ ID NO: 616724 - DNA, 23 bp, Homo sapiens
ctgtgaactgccaggcagctgca

SEQ ID NO: 616725 - DNA, 17 bp, Homo sapiens
ctgtgacacagctgagc

SEQ ID NO: 616726 - DNA, 18 bp, Homo sapiens
ctgtgacacagctgagct

SEQ ID NO: 616727 - DNA, 16 bp, Homo sapiens
ctgtgacctgctcctg

SEQ ID NO: 616728 - DNA, 16 bp, Homo sapiens
ctgtgagataaatatc

SEQ ID NO: 616729 - DNA, 22 bp, Homo sapiens
ctgtgagataaatatcattata

SEQ ID NO: 616730 - DNA, 18 bp, Homo sapiens
ctgtgagtctgtcctttc

SEQ ID NO: 616731 - DNA, 12 bp, Homo sapiens
ctgtgataacag

SEQ ID NO: 616732 - DNA, 14 bp, Homo sapiens
ctgtgataacagag

SEQ ID NO: 616733 - DNA, 16 bp, Homo sapiens
ctgtgcatctggcctg

SEQ ID NO: 616734 - DNA, 12 bp, Homo sapiens
ctgtgccctctc

SEQ ID NO: 616735 - DNA, 22 bp, Homo sapiens
ctgtggatacgggggttccctt

SEQ ID NO: 616736 - DNA, 13 bp, Homo sapiens
ctgtggcccctcc

SEQ ID NO: 616737 - DNA, 16 bp, Homo sapiens
ctgtggcccctccttc

SEQ ID NO: 616738 - DNA, 22 bp, Homo sapiens
ctgtggcccctccttctcccct

SEQ ID NO: 616739 - DNA, 23 bp, Homo sapiens
ctgtggcccctccttctcccctc

SEQ ID NO: 616740 - DNA, 21 bp, Homo sapiens
ctgtggctgatttactaacag

SEQ ID NO: 616741 - DNA, 22 bp, Homo sapiens
ctgtggctgatttactaacagt

SEQ ID NO: 616742 - DNA, 23 bp, Homo sapiens
ctgtggctgatttactaacagta

SEQ ID NO: 616743 - DNA, 18 bp, Homo sapiens
ctgtggctgcagagacct

SEQ ID NO: 616744 - DNA, 13 bp, Homo sapiens
ctgtgggagtcca

SEQ ID NO: 616745 - DNA, 18 bp, Homo sapiens
ctgtgggctcacaccggc

SEQ ID NO: 616746 - DNA, 22 bp, Homo sapiens
ctgtgggggaggtccctgccag

SEQ ID NO: 616747 - DNA, 20 bp, Homo sapiens
ctgtggggtgcatcggtctc

SEQ ID NO: 616748 - DNA, 20 bp, Homo sapiens
ctgtggtgaggtcctgtcct

SEQ ID NO: 616749 - DNA, 23 bp, Homo sapiens
ctgtggtgaggtcctgtcctggc

SEQ ID NO: 616750 - DNA, 17 bp, Homo sapiens
ctgcttagtgtccctta

SEQ ID NO: 616751 - DNA, 12 bp, Homo sapiens
ctgcttcaagga

SEQ ID NO: 616752 - DNA, 20 bp, Homo sapiens
ctgcttcaaggatcctgagc

SEQ ID NO: 616753 - DNA, 18 bp, Homo sapiens
ctgcttgtcattctgcta

SEQ ID NO: 616754 - DNA, 14 bp, Homo sapiens
ctgctttcagtgcc

SEQ ID NO: 616755 - DNA, 18 bp, Homo sapiens
ctgctttcagtgcctgct

SEQ ID NO: 616756 - DNA, 15 bp, Homo sapiens
ctgctttcatccagc

SEQ ID NO: 616757 - DNA, 17 bp, Homo sapiens
ctgctttctgatacatc

SEQ ID NO: 616758 - DNA, 13 bp, Homo sapiens
ctgcttttgatgg

SEQ ID NO: 616759 - DNA, 21 bp, Homo sapiens
ctgcttttgatggctatgttt

SEQ ID NO: 616760 - DNA, 15 bp, Homo sapiens
ctggaaaagcacttt

SEQ ID NO: 616761 - DNA, 17 bp, Homo sapiens
ctggaaggttttgcttc

SEQ ID NO: 616762 - DNA, 20 bp, Homo sapiens
ctggaagtaagaaatattac

SEQ ID NO: 616763 - DNA, 16 bp, Homo sapiens
ctggaagttgtccttt

SEQ ID NO: 616764 - DNA, 19 bp, Homo sapiens
ctggaataagaagcaaata

SEQ ID NO: 616765 - DNA, 15 bp, Homo sapiens
ctggacagtgcctaa

SEQ ID NO: 616766 - DNA, 13 bp, Homo sapiens
ctggagaccctgc

SEQ ID NO: 616767 - DNA, 18 bp, Homo sapiens
ctggagaccctgcgcccc

SEQ ID NO: 616768 - DNA, 22 bp, Homo sapiens
ctggagaccctgcgcccctgcc

SEQ ID NO: 616769 - DNA, 14 bp, Homo sapiens
ctggagccagggca

SEQ ID NO: 616770 - DNA, 16 bp, Homo sapiens
ctggagccagggcaga

SEQ ID NO: 616771 - DNA, 18 bp, Homo sapiens
ctggagccagggcagagg

SEQ ID NO: 616772 - DNA, 20 bp, Homo sapiens
ctggagccagggcagaggaa

SEQ ID NO: 616773 - DNA, 12 bp, Homo sapiens
ctggagccccat

SEQ ID NO: 616774 - DNA, 12 bp, Homo sapiens
ctggagccccta

SEQ ID NO: 616775 - DNA, 19 bp, Homo sapiens
ctggagcccctatcctgca

SEQ ID NO: 616776 - DNA, 15 bp, Homo sapiens
ctggagcctgcaggc

SEQ ID NO: 616777 - DNA, 18 bp, Homo sapiens
ctggagcctgcaggcagg

SEQ ID NO: 616778 - DNA, 16 bp, Homo sapiens
ctggagcctgggcagc

SEQ ID NO: 616779 - DNA, 17 bp, Homo sapiens
ctggagtctgaaggaga

SEQ ID NO: 616780 - DNA, 16 bp, Homo sapiens
ctggatgcttacagtg

SEQ ID NO: 616781 - DNA, 15 bp, Homo sapiens
ctggatgtgctttca

SEQ ID NO: 616782 - DNA, 13 bp, Homo sapiens
ctggcacccactg

SEQ ID NO: 616783 - DNA, 14 bp, Homo sapiens
ctggcagcgcctcc

SEQ ID NO: 616784 - DNA, 12 bp, Homo sapiens
ctggccacctgc

SEQ ID NO: 616785 - DNA, 13 bp, Homo sapiens
ctggccacctgcc

SEQ ID NO: 616786 - DNA, 16 bp, Homo sapiens
ctggccacctgccagg

SEQ ID NO: 616787 - DNA, 20 bp, Homo sapiens
ctggccaggggcttctcccc

SEQ ID NO: 616788 - DNA, 12 bp, Homo sapiens
ctggccccaggc

SEQ ID NO: 616789 - DNA, 13 bp, Homo sapiens
ctggccccctcgc

SEQ ID NO: 616790 - DNA, 19 bp, Homo sapiens
ctggccccctcgcgcccct

SEQ ID NO: 616791 - DNA, 21 bp, Homo sapiens
ctggccccctcgcgcccctgt

SEQ ID NO: 616792 - DNA, 13 bp, Homo sapiens
ctggccctgccct

SEQ ID NO: 616793 - DNA, 14 bp, Homo sapiens
ctggccctgccctc

SEQ ID NO: 616794 - DNA, 16 bp, Homo sapiens
ctggccctgccctccc

SEQ ID NO: 616795 - DNA, 19 bp, Homo sapiens
ctggccctgccctccccca

SEQ ID NO: 616796 - DNA, 15 bp, Homo sapiens
ctggccctgcctcac

SEQ ID NO: 616797 - DNA, 14 bp, Homo sapiens
ctggcctgggggct

SEQ ID NO: 616798 - DNA, 22 bp, Homo sapiens
ctggccttggttcctccagcaa

SEQ ID NO: 616799 - DNA, 14 bp, Homo sapiens
ctggcgccaggggc

SEQ ID NO: 616800 - DNA, 17 bp, Homo sapiens
ctggcgccaggggcagg

SEQ ID NO: 616801 - DNA, 19 bp, Homo sapiens
ctggcgccaggggcaggca

SEQ ID NO: 616802 - DNA, 17 bp, Homo sapiens
ctggcgcgtgtgtggcc

SEQ ID NO: 616803 - DNA, 20 bp, Homo sapiens
ctggcggcaggggttggcag

SEQ ID NO: 616804 - DNA, 22 bp, Homo sapiens
ctggcggcaggggttggcagcg

SEQ ID NO: 616805 - DNA, 15 bp, Homo sapiens
ctggcgggcagcccc

SEQ ID NO: 616806 - DNA, 17 bp, Homo sapiens
ctggctacgacttggga

SEQ ID NO: 616807 - DNA, 17 bp, Homo sapiens
ctggctcccagggtcct

SEQ ID NO: 616808 - DNA, 18 bp, Homo sapiens
ctggctggggccggggct

SEQ ID NO: 616809 - DNA, 22 bp, Homo sapiens
ctggctggggccggggctgccg

SEQ ID NO: 616810 - DNA, 19 bp, Homo sapiens
ctggctgggtcgcccctcc

SEQ ID NO: 616811 - DNA, 17 bp, Homo sapiens
ctggctgtggcccctcc

SEQ ID NO: 616812 - DNA, 14 bp, Homo sapiens
ctggcttctgggac

SEQ ID NO: 616813 - DNA, 17 bp, Homo sapiens
ctgggaaagaacttgga

SEQ ID NO: 616814 - DNA, 18 bp, Homo sapiens
ctgggaaagaacttggac

SEQ ID NO: 616815 - DNA, 20 bp, Homo sapiens
ctgggaaatgagatcccaga

SEQ ID NO: 616816 - DNA, 21 bp, Homo sapiens
ctgggaaattgctccattcct

SEQ ID NO: 616817 - DNA, 16 bp, Homo sapiens
ctgggaacacagtgcc

SEQ ID NO: 616818 - DNA, 13 bp, Homo sapiens
ctgggcaccctgc

SEQ ID NO: 616819 - DNA, 14 bp, Homo sapiens
ctgggcaccctgca

SEQ ID NO: 616820 - DNA, 16 bp, Homo sapiens
ctgggcaccctgcagg

SEQ ID NO: 616821 - DNA, 17 bp, Homo sapiens
ctgggcaccctgcaggc

SEQ ID NO: 616822 - DNA, 22 bp, Homo sapiens
ctgggcaccctgcaggcaggca

SEQ ID NO: 616823 - DNA, 22 bp, Homo sapiens
ctgggcagcacctccgggactg

SEQ ID NO: 616824 - DNA, 23 bp, Homo sapiens
ctgggcagcacctccgggactga

SEQ ID NO: 616825 - DNA, 17 bp, Homo sapiens
ctgggcagggccgcagg

SEQ ID NO: 616826 - DNA, 13 bp, Homo sapiens
ctgggcagggtga

SEQ ID NO: 616827 - DNA, 14 bp, Homo sapiens
ctgggcccaggccc

SEQ ID NO: 616828 - DNA, 16 bp, Homo sapiens
ctgggcccaggcccag

SEQ ID NO: 616829 - DNA, 17 bp, Homo sapiens
gggcacgggagagcgcc

SEQ ID NO: 616830 - DNA, 20 bp, Homo sapiens
gggcagcccctgctggacca

SEQ ID NO: 616831 - DNA, 15 bp, Homo sapiens
gggcaggcagctagg

SEQ ID NO: 616832 - DNA, 23 bp, Homo sapiens
gggcaggcagctaggcagggagg

SEQ ID NO: 616833 - DNA, 12 bp, Homo sapiens
gggcagggccca

SEQ ID NO: 616834 - DNA, 19 bp, Homo sapiens
gggcagggcccagggaggt

SEQ ID NO: 616835 - DNA, 20 bp, Homo sapiens
gggcagggcccagggaggtg

SEQ ID NO: 616836 - DNA, 17 bp, Homo sapiens
gggcagggccgcagggc

SEQ ID NO: 616837 - DNA, 20 bp, Homo sapiens
gggcagggccgcagggcgct

SEQ ID NO: 616838 - DNA, 11 bp, Homo sapiens
gggcagggtga

SEQ ID NO: 616839 - DNA, 17 bp, Homo sapiens
gggcagtggaagagctg

SEQ ID NO: 616840 - DNA, 19 bp, Homo sapiens
gggcagtggagaggggact

SEQ ID NO: 616841 - DNA, 23 bp, Homo sapiens
gggcatccaccttcctgcccagg

SEQ ID NO: 616842 - DNA, 17 bp, Homo sapiens
gggccaccctgagcaga

SEQ ID NO: 616843 - DNA, 11 bp, Homo sapiens
gggccagggcg

SEQ ID NO: 616844 - DNA, 22 bp, Homo sapiens
gggccagggtgggaagagaaga

SEQ ID NO: 616845 - DNA, 20 bp, Homo sapiens
gggccagtcatggctgtccc

SEQ ID NO: 616846 - DNA, 14 bp, Homo sapiens
gggcccaggcccag

SEQ ID NO: 616847 - DNA, 16 bp, Homo sapiens
gggcccaggcccagcc

SEQ ID NO: 616848 - DNA, 18 bp, Homo sapiens
gggcccaggcccagcctc

SEQ ID NO: 616849 - DNA, 14 bp, Homo sapiens
gggcccagggaggt

SEQ ID NO: 616850 - DNA, 14 bp, Homo sapiens
gggcccccatgcag

SEQ ID NO: 616851 - DNA, 11 bp, Homo sapiens
gggcccctgcg

SEQ ID NO: 616852 - DNA, 17 bp, Homo sapiens
gggcccgctcaacctct

SEQ ID NO: 616853 - DNA, 20 bp, Homo sapiens
gggcccgctcaacctctcag

SEQ ID NO: 616854 - DNA, 21 bp, Homo sapiens
gggccgccgaagggcagcccc

SEQ ID NO: 616855 - DNA, 22 bp, Homo sapiens
gggccgccgaagggcagccccg

SEQ ID NO: 616856 - DNA, 11 bp, Homo sapiens
gggccgcctcc

SEQ ID NO: 616857 - DNA, 14 bp, Homo sapiens
gggccgcctcctcc

SEQ ID NO: 616858 - DNA, 16 bp, Homo sapiens
gggccgcctcctccag

SEQ ID NO: 616859 - DNA, 15 bp, Homo sapiens
gggccggggctgccg

SEQ ID NO: 616860 - DNA, 15 bp, Homo sapiens
gggcctgcatggaga

SEQ ID NO: 616861 - DNA, 22 bp, Homo sapiens
gggcctgggtccccctcctgca

SEQ ID NO: 616862 - DNA, 16 bp, Homo sapiens
gggcgcaaaggtgcct

SEQ ID NO: 616863 - DNA, 18 bp, Homo sapiens
gggcgcgcgcccccagga

SEQ ID NO: 616864 - DNA, 19 bp, Homo sapiens
gggcgcgcgcccccaggac

SEQ ID NO: 616865 - DNA, 21 bp, Homo sapiens
gggcgcgcgcccccaggaccc

SEQ ID NO: 616866 - DNA, 17 bp, Homo sapiens
gggcgctccggcagagg

SEQ ID NO: 616867 - DNA, 13 bp, Homo sapiens
gggcgggccaggg

SEQ ID NO: 616868 - DNA, 15 bp, Homo sapiens
gggcgtgaaacacaa

SEQ ID NO: 616869 - DNA, 16 bp, Homo sapiens
gggcgtgaaacacaat

SEQ ID NO: 616870 - DNA, 17 bp, Homo sapiens
gggctaactggccccag

SEQ ID NO: 616871 - DNA, 19 bp, Homo sapiens
gggctaactggccccaggc

SEQ ID NO: 616872 - DNA, 22 bp, Homo sapiens
gggctcagatggggcctgggct

SEQ ID NO: 616873 - DNA, 23 bp, Homo sapiens
gggctcagatggggcctgggctg

SEQ ID NO: 616874 - DNA, 13 bp, Homo sapiens
gggctctttccct

SEQ ID NO: 616875 - DNA, 12 bp, Homo sapiens
gggctgagcccc

SEQ ID NO: 616876 - DNA, 15 bp, Homo sapiens
gggctgagcccctcc

SEQ ID NO: 616877 - DNA, 14 bp, Homo sapiens
gggctgcgtccctg

SEQ ID NO: 616878 - DNA, 14 bp, Homo sapiens
gggctgctgcactg

SEQ ID NO: 616879 - DNA, 20 bp, Homo sapiens
gggctggtgggataggaggg

SEQ ID NO: 616880 - DNA, 21 bp, Homo sapiens
gggctggtgtcttgagaccag

SEQ ID NO: 616881 - DNA, 17 bp, Homo sapiens
gggctgttagctcagag

SEQ ID NO: 616882 - DNA, 16 bp, Homo sapiens
gggcttagaatggggc

SEQ ID NO: 616883 - DNA, 13 bp, Homo sapiens
gggcttggggtag

SEQ ID NO: 616884 - DNA, 19 bp, Homo sapiens
gggcttggggtagagagga

SEQ ID NO: 616885 - DNA, 13 bp, Homo sapiens
ggggaccaggagc

SEQ ID NO: 616886 - DNA, 22 bp, Homo sapiens
ggggacgcccagcccccacccc

SEQ ID NO: 616887 - DNA, 23 bp, Homo sapiens
ggggacgcccagcccccaccccc

SEQ ID NO: 616888 - DNA, 20 bp, Homo sapiens
ggggactgctttcagtgcct

SEQ ID NO: 616889 - DNA, 22 bp, Homo sapiens
ggggactgctttcagtgcctgc

SEQ ID NO: 616890 - DNA, 16 bp, Homo sapiens
ggggaggagcaccccc

SEQ ID NO: 616891 - DNA, 18 bp, Homo sapiens
ggggatctaaaaggagga

SEQ ID NO: 616892 - DNA, 14 bp, Homo sapiens
ggggatgcccctgg

SEQ ID NO: 616893 - DNA, 16 bp, Homo sapiens
ggggatgcccctggcc

SEQ ID NO: 616894 - DNA, 22 bp, Homo sapiens
ggggcaagagctcaggagaagg

SEQ ID NO: 616895 - DNA, 23 bp, Homo sapiens
ggggcaagagctcaggagaaggc

SEQ ID NO: 616896 - DNA, 14 bp, Homo sapiens
ggggcaggcagcta

SEQ ID NO: 616897 - DNA, 12 bp, Homo sapiens
ggggcagggccc

SEQ ID NO: 616898 - DNA, 14 bp, Homo sapiens
ggggcagggcccag

SEQ ID NO: 616899 - DNA, 12 bp, Homo sapiens
ggggccagacca

SEQ ID NO: 616900 - DNA, 13 bp, Homo sapiens
ggggcccatggcc

SEQ ID NO: 616901 - DNA, 15 bp, Homo sapiens
ggggcccatggcccc

SEQ ID NO: 616902 - DNA, 16 bp, Homo sapiens
ggggccgtgcagggcc

SEQ ID NO: 616903 - DNA, 14 bp, Homo sapiens
ggggcgagggcggc

SEQ ID NO: 616904 - DNA, 21 bp, Homo sapiens
ggggcgcgcgcccccaggacc

SEQ ID NO: 616905 - DNA, 21 bp, Homo sapiens
ggggcggcatccgagcccctg

SEQ ID NO: 616906 - DNA, 15 bp, Homo sapiens
ggggcgggccagggt

SEQ ID NO: 616907 - DNA, 17 bp, Homo sapiens
ggggctaactggcccca

SEQ ID NO: 616908 - DNA, 12 bp, Homo sapiens
ggggctctttcc

SEQ ID NO: 616909 - DNA, 20 bp, Homo sapiens
ggggctgcgtccctgctcag

SEQ ID NO: 616910 - DNA, 23 bp, Homo sapiens
ggggctgcgtccctgctcagccc

SEQ ID NO: 616911 - DNA, 21 bp, Homo sapiens
ggggctgctgcactgccctcc

SEQ ID NO: 616912 - DNA, 11 bp, Homo sapiens
ggggctggccc

SEQ ID NO: 616913 - DNA, 15 bp, Homo sapiens
ggggctggccctgcc

SEQ ID NO: 616914 - DNA, 19 bp, Homo sapiens
gggggacgcccagccccca

SEQ ID NO: 616915 - DNA, 21 bp, Homo sapiens
gggggcaagagctcaggagaa

SEQ ID NO: 616916 - DNA, 17 bp, Homo sapiens
gggggctaactggcccc

SEQ ID NO: 616917 - DNA, 15 bp, Homo sapiens
gggggttgggttcca

SEQ ID NO: 616918 - DNA, 14 bp, Homo sapiens
ggggtacaggcagt

SEQ ID NO: 616919 - DNA, 13 bp, Homo sapiens
ggggtagagagga

SEQ ID NO: 616920 - DNA, 15 bp, Homo sapiens
ggggtccccggacgc

SEQ ID NO: 616921 - DNA, 20 bp, Homo sapiens
ggggtcgggggaggagcacc

SEQ ID NO: 616922 - DNA, 21 bp, Homo sapiens
ggggtcgggggaggagcaccc

SEQ ID NO: 616923 - DNA, 13 bp, Homo sapiens
ggggtgccccaca

SEQ ID NO: 616924 - DNA, 23 bp, Homo sapiens
ggggtgccccacaaggcccagcc

SEQ ID NO: 616925 - DNA, 22 bp, Homo sapiens
gggtaagggactccagaagcag

SEQ ID NO: 616926 - DNA, 22 bp, Homo sapiens
gggtaagttgaagggaaatcaa

SEQ ID NO: 616927 - DNA, 14 bp, Homo sapiens
gggtccagccctcc

SEQ ID NO: 616928 - DNA, 11 bp, Homo sapiens
gggtccaggcc

SEQ ID NO: 616929 - DNA, 14 bp, Homo sapiens
gggtccaggcccgt

SEQ ID NO: 616930 - DNA, 17 bp, Homo sapiens
gggtcccccctgagtgg

SEQ ID NO: 616931 - DNA, 13 bp, Homo sapiens
gggtccccctcct

SEQ ID NO: 616932 - DNA, 17 bp, Homo sapiens
gggtccccctcctgcac

SEQ ID NO: 616933 - DNA, 22 bp, Homo sapiens
gggtccccctcctgcacgcgga

SEQ ID NO: 616934 - DNA, 14 bp, Homo sapiens
gggtcctgagtggc

SEQ ID NO: 616935 - DNA, 15 bp, Homo sapiens
gggtcgcccctcctc

SEQ ID NO: 616936 - DNA, 13 bp, Homo sapiens
gggtctccctggg

SEQ ID NO: 616937 - DNA, 23 bp, Homo sapiens
gggtgcgtgaccggcccgccacc

SEQ ID NO: 616938 - DNA, 23 bp, Homo sapiens
gggtggaattattagcaccagct

SEQ ID NO: 616939 - DNA, 14 bp, Homo sapiens
gggtggctggagcc

SEQ ID NO: 616940 - DNA, 17 bp, Homo sapiens
gggtggctggagcccca

SEQ ID NO: 616941 - DNA, 21 bp, Homo sapiens
gggtggctggagccccatcgc

SEQ ID NO: 616942 - DNA, 15 bp, Homo sapiens
gggtgggaagagaag

SEQ ID NO: 616943 - DNA, 14 bp, Homo sapiens
gggttaaagaaagg

SEQ ID NO: 616944 - DNA, 12 bp, Homo sapiens
gggttccagaca

SEQ ID NO: 616945 - DNA, 20 bp, Homo sapiens
gggttccagacagagtggat

SEQ ID NO: 616946 - DNA, 16 bp, Homo sapiens
gggttctatatttact

SEQ ID NO: 616947 - DNA, 20 bp, Homo sapiens
gggttctgccctgcctgagg

SEQ ID NO: 616948 - DNA, 22 bp, Homo sapiens
gggttctgccctgcctgaggag

SEQ ID NO: 616949 - DNA, 16 bp, Homo sapiens
gggttggcagcgcctc

SEQ ID NO: 616950 - DNA, 18 bp, Homo sapiens
gggttgggttccagacag

SEQ ID NO: 616951 - DNA, 17 bp, Homo sapiens
gggttttagaaattcta

SEQ ID NO: 616952 - DNA, 21 bp, Homo sapiens
ggtaaactgatgctttcagat

SEQ ID NO: 616953 - DNA, 21 bp, Homo sapiens
ggtacaggcagttaggtgctg

SEQ ID NO: 616954 - DNA, 19 bp, Homo sapiens
ggtaccagagcctatggaa

SEQ ID NO: 616955 - DNA, 14 bp, Homo sapiens
ggtatctctttctc

SEQ ID NO: 616956 - DNA, 19 bp, Homo sapiens
ggtattttgtcagttttaa

SEQ ID NO: 616957 - DNA, 17 bp, Homo sapiens
ggtcacaaagctattta

SEQ ID NO: 616958 - DNA, 13 bp, Homo sapiens
ggtcactgctaca

SEQ ID NO: 616959 - DNA, 13 bp, Homo sapiens
ggtcaggctacag

SEQ ID NO: 616960 - DNA, 22 bp, Homo sapiens
ggtcaggctacaggtgccccac

SEQ ID NO: 616961 - DNA, 16 bp, Homo sapiens
ggtccaatccagcctt

SEQ ID NO: 616962 - DNA, 12 bp, Homo sapiens
ggtccaggagat

SEQ ID NO: 616963 - DNA, 21 bp, Homo sapiens
ggtccaggagatgaggctgga

SEQ ID NO: 616964 - DNA, 15 bp, Homo sapiens
ggtccaggcccgtgg

SEQ ID NO: 616965 - DNA, 13 bp, Homo sapiens
ggtcccccctgag

SEQ ID NO: 616966 - DNA, 14 bp, Homo sapiens
ggtcccccctgagt

SEQ ID NO: 616967 - DNA, 12 bp, Homo sapiens
ggtccccctcct

SEQ ID NO: 616968 - DNA, 14 bp, Homo sapiens
ggtccccctcctgc

SEQ ID NO: 616969 - DNA, 19 bp, Homo sapiens
ggtcccgggtgccccccat

SEQ ID NO: 616970 - DNA, 21 bp, Homo sapiens
ggtcctgctgctcgggaaggc

SEQ ID NO: 616971 - DNA, 14 bp, Homo sapiens
ggtcctggccctct

SEQ ID NO: 616972 - DNA, 22 bp, Homo sapiens
ggtcctgggggctgctgcactg

SEQ ID NO: 616973 - DNA, 17 bp, Homo sapiens
ggtccttagtaaattcc

SEQ ID NO: 616974 - DNA, 15 bp, Homo sapiens
ggtcgggggaggagc

SEQ ID NO: 616975 - DNA, 22 bp, Homo sapiens
ggtcgggggaggagcaccccca

SEQ ID NO: 616976 - DNA, 18 bp, Homo sapiens
ggtctccacccctcaagc

SEQ ID NO: 616977 - DNA, 20 bp, Homo sapiens
ggtctccctgggcaccctgc

SEQ ID NO: 616978 - DNA, 13 bp, Homo sapiens
ggtctctgagcag

SEQ ID NO: 616979 - DNA, 16 bp, Homo sapiens
ggtctggagcccctat

SEQ ID NO: 616980 - DNA, 15 bp, Homo sapiens
ggtctggcgccaggg

SEQ ID NO: 616981 - DNA, 19 bp, Homo sapiens
ggtctgttgaagtgcatgt

SEQ ID NO: 616982 - DNA, 20 bp, Homo sapiens
ggtctgttgaagtgcatgtt

SEQ ID NO: 616983 - DNA, 17 bp, Homo sapiens
ggtgaactgaagcagag

SEQ ID NO: 616984 - DNA, 12 bp, Homo sapiens
ggtgatgaattt

SEQ ID NO: 616985 - DNA, 13 bp, Homo sapiens
ggtgcaatgacct

SEQ ID NO: 616986 - DNA, 18 bp, Homo sapiens
ggtgcaatgacctttcaa

SEQ ID NO: 616987 - DNA, 20 bp, Homo sapiens
ggtgcaatgacctttcaata

SEQ ID NO: 616988 - DNA, 12 bp, Homo sapiens
ggtgcaggcgcg

SEQ ID NO: 616989 - DNA, 21 bp, Homo sapiens
ggtgccccacaaggcccagcc

SEQ ID NO: 616990 - DNA, 13 bp, Homo sapiens
ggtgccccacctc

SEQ ID NO: 616991 - DNA, 21 bp, Homo sapiens
ggtgccccacctccccagagc

SEQ ID NO: 616992 - DNA, 22 bp, Homo sapiens
ggtgccccccatgccctccctg

SEQ ID NO: 616993 - DNA, 12 bp, Homo sapiens
ggtgcccctggg

SEQ ID NO: 616994 - DNA, 15 bp, Homo sapiens
ggtgcccctgggaac

SEQ ID NO: 616995 - DNA, 21 bp, Homo sapiens
ggtgcctcatagcatagccag

SEQ ID NO: 616996 - DNA, 23 bp, Homo sapiens
ggtgcctcatagcatagccagca

SEQ ID NO: 616997 - DNA, 13 bp, Homo sapiens
ggtgcctggctgg

SEQ ID NO: 616998 - DNA, 15 bp, Homo sapiens
ggtgcggaccggagc

SEQ ID NO: 616999 - DNA, 18 bp, Homo sapiens
ggtgcggaccggagcggc

SEQ ID NO: 617000 - DNA, 18 bp, Homo sapiens
ggtgcgggccaggtctgg

SEQ ID NO: 617001 - DNA, 20 bp, Homo sapiens
ggtgcgtgaccggcccgcca

SEQ ID NO: 617002 - DNA, 13 bp, Homo sapiens
ggtgcgtgtggcc

SEQ ID NO: 617003 - DNA, 16 bp, Homo sapiens
ggtggagtcagggctg

SEQ ID NO: 617004 - DNA, 14 bp, Homo sapiens
ggtggcagggaagg

SEQ ID NO: 617005 - DNA, 15 bp, Homo sapiens
ggtggcatttgcagg

SEQ ID NO: 617006 - DNA, 15 bp, Homo sapiens
ggtgggctccagagt

SEQ ID NO: 617007 - DNA, 16 bp, Homo sapiens
ggtggggccagcgctg

SEQ ID NO: 617008 - DNA, 22 bp, Homo sapiens
ggtggggcttggaagggcgctg

SEQ ID NO: 617009 - DNA, 20 bp, Homo sapiens
ggtggtcttggagaggaggt

SEQ ID NO: 617010 - DNA, 13 bp, Homo sapiens
ggtggttggaggc

SEQ ID NO: 617011 - DNA, 16 bp, Homo sapiens
ggtggttggaggcctg

SEQ ID NO: 617012 - DNA, 18 bp, Homo sapiens
ggtggtttcagaaagggc

SEQ ID NO: 617013 - DNA, 15 bp, Homo sapiens
ggtgtcaaattttta

SEQ ID NO: 617014 - DNA, 14 bp, Homo sapiens
ggtgtcctctgtcc

SEQ ID NO: 617015 - DNA, 13 bp, Homo sapiens
ggtgtcgggcatg

SEQ ID NO: 617016 - DNA, 13 bp, Homo sapiens
ggtgtcttgagac

SEQ ID NO: 617017 - DNA, 16 bp, Homo sapiens
ggtgtcttgagaccag

SEQ ID NO: 617018 - DNA, 23 bp, Homo sapiens
ggtgtcttgagaccagcctgcca

SEQ ID NO: 617019 - DNA, 20 bp, Homo sapiens
ggtgtgaggcccccggaggc

SEQ ID NO: 617020 - DNA, 15 bp, Homo sapiens
ggtgtggagtggagg

SEQ ID NO: 617021 - DNA, 19 bp, Homo sapiens
ggtgtggcctggcttctgg

SEQ ID NO: 617022 - DNA, 18 bp, Homo sapiens
ggttaaggggatctaaaa

SEQ ID NO: 617023 - DNA, 19 bp, Homo sapiens
ggttaaggggatctaaaag

SEQ ID NO: 617024 - DNA, 12 bp, Homo sapiens
ggttaagtctca

SEQ ID NO: 617025 - DNA, 18 bp, Homo sapiens
ggttagaaaggcagccct

SEQ ID NO: 617026 - DNA, 19 bp, Homo sapiens
ggttagaaaggcagccctc

SEQ ID NO: 617027 - DNA, 11 bp, Homo sapiens
ggttccagaca

SEQ ID NO: 617028 - DNA, 17 bp, Homo sapiens
ggttccagacagagtgg

SEQ ID NO: 617029 - DNA, 13 bp, Homo sapiens
ggttccctgcgcg

SEQ ID NO: 617030 - DNA, 13 bp, Homo sapiens
ggttcctccagca

SEQ ID NO: 617031 - DNA, 11 bp, Homo sapiens
ggttctagaag

SEQ ID NO: 617032 - DNA, 13 bp, Homo sapiens
ggttctagaaggg

SEQ ID NO: 617033 - DNA, 16 bp, Homo sapiens
ggttctagaaggggcg

SEQ ID NO: 617034 - DNA, 18 bp, Homo sapiens
ggttctagaaggggcgag

SEQ ID NO: 617035 - DNA, 19 bp, Homo sapiens
ggttctgccctgcctgagg

SEQ ID NO: 617036 - DNA, 20 bp, Homo sapiens
ggttctgccctgcctgagga

SEQ ID NO: 617037 - DNA, 23 bp, Homo sapiens
ggttctgccctgcctgaggagga

SEQ ID NO: 617038 - DNA, 17 bp, Homo sapiens
ggttctttatcatttct

SEQ ID NO: 617039 - DNA, 19 bp, Homo sapiens
ggttctttatcatttctct

SEQ ID NO: 617040 - DNA, 14 bp, Homo sapiens
ggttggaggcctgg

SEQ ID NO: 617041 - DNA, 17 bp, Homo sapiens
ggttggccggctggccg

SEQ ID NO: 617042 - DNA, 12 bp, Homo sapiens
ggtttactctgt

SEQ ID NO: 617043 - DNA, 22 bp, Homo sapiens
ggtttactctgtgctaagttgt

SEQ ID NO: 617044 - DNA, 18 bp, Homo sapiens
ggtttccatcaaagccct

SEQ ID NO: 617045 - DNA, 16 bp, Homo sapiens
ggtttgggcagtggag

SEQ ID NO: 617046 - DNA, 18 bp, Homo sapiens
ggtttgggcagtggagag

SEQ ID NO: 617047 - DNA, 19 bp, Homo sapiens
ggtttgtgggtccaggaga

SEQ ID NO: 617048 - DNA, 13 bp, Homo sapiens
gtaaaacagtggt

SEQ ID NO: 617049 - DNA, 19 bp, Homo sapiens
gtgaaaaaaaaaagtaatt

SEQ ID NO: 617050 - DNA, 19 bp, Homo sapiens
gtgaaaatcgaggaagcac

SEQ ID NO: 617051 - DNA, 21 bp, Homo sapiens
gtgaaaatcgaggaagcacct

SEQ ID NO: 617052 - DNA, 17 bp, Homo sapiens
gtgaaaattttattgaa

SEQ ID NO: 617053 - DNA, 13 bp, Homo sapiens
gtgaaacacaata

SEQ ID NO: 617054 - DNA, 14 bp, Homo sapiens
gtgaaacacaatat

SEQ ID NO: 617055 - DNA, 11 bp, Homo sapiens
gtgaacagctt

SEQ ID NO: 617056 - DNA, 23 bp, Homo sapiens
gtgaactttctcagcatatatat

SEQ ID NO: 617057 - DNA, 20 bp, Homo sapiens
gtgacacagctgagctggcc

SEQ ID NO: 617058 - DNA, 13 bp, Homo sapiens
gtgacagaaggcc

SEQ ID NO: 617059 - DNA, 21 bp, Homo sapiens
gtgacagaaggcccgaggagg

SEQ ID NO: 617060 - DNA, 13 bp, Homo sapiens
gtgaccagaatga

SEQ ID NO: 617061 - DNA, 19 bp, Homo sapiens
gtgaccggcccgccacctt

SEQ ID NO: 617062 - DNA, 18 bp, Homo sapiens
gtgacctgctcctgccca

SEQ ID NO: 617063 - DNA, 20 bp, Homo sapiens
gtgacttcagactctctcct

SEQ ID NO: 617064 - DNA, 18 bp, Homo sapiens
gtgagaagctagatgccc

SEQ ID NO: 617065 - DNA, 14 bp, Homo sapiens
gtgagataaatatc

SEQ ID NO: 617066 - DNA, 13 bp, Homo sapiens
gtgagattctaaa

SEQ ID NO: 617067 - DNA, 15 bp, Homo sapiens
gtgaggcccctgtgc

SEQ ID NO: 617068 - DNA, 19 bp, Homo sapiens
gtgaggcccctgtgcagta

SEQ ID NO: 617069 - DNA, 21 bp, Homo sapiens
gtgaggcccctgtgcagtaga

SEQ ID NO: 617070 - DNA, 19 bp, Homo sapiens
gtgaggcgtgggatccaga

SEQ ID NO: 617071 - DNA, 18 bp, Homo sapiens
gtgagtctgtcctttccc

SEQ ID NO: 617072 - DNA, 17 bp, Homo sapiens
gtgataattgtaaaggt

SEQ ID NO: 617073 - DNA, 13 bp, Homo sapiens
gtgatctgtcctt

SEQ ID NO: 617074 - DNA, 14 bp, Homo sapiens
gtgatctgtccttc

SEQ ID NO: 617075 - DNA, 18 bp, Homo sapiens
gtgatctgtccttccaac

SEQ ID NO: 617076 - DNA, 23 bp, Homo sapiens
gtgatctgttgtaatatcagtta

SEQ ID NO: 617077 - DNA, 16 bp, Homo sapiens
gtgatgaatttaccat

SEQ ID NO: 617078 - DNA, 15 bp, Homo sapiens
gtgatttatgcattt

SEQ ID NO: 617079 - DNA, 22 bp, Homo sapiens
gtgatttatgcatttatgcatg

SEQ ID NO: 617080 - DNA, 13 bp, Homo sapiens
gtgcacggcagct

SEQ ID NO: 617081 - DNA, 21 bp, Homo sapiens
gtgcagaaggtgaaatggagg

SEQ ID NO: 617082 - DNA, 14 bp, Homo sapiens
gtgcagagtataca

SEQ ID NO: 617083 - DNA, 16 bp, Homo sapiens
gtgcagcaaccagagc

SEQ ID NO: 617084 - DNA, 18 bp, Homo sapiens
gtgcaggcgcgcaccgcc

SEQ ID NO: 617085 - DNA, 18 bp, Homo sapiens
gtgcagggacagcctgca

SEQ ID NO: 617086 - DNA, 16 bp, Homo sapiens
gtgcatagatacacaa

SEQ ID NO: 617087 - DNA, 17 bp, Homo sapiens
gtgcatagatacacaat

SEQ ID NO: 617088 - DNA, 20 bp, Homo sapiens
gtgcatatggcaacgttcat

SEQ ID NO: 617089 - DNA, 22 bp, Homo sapiens
gtgcatatggcaacgttcatgt

SEQ ID NO: 617090 - DNA, 13 bp, Homo sapiens
gtgcatctggcct

SEQ ID NO: 617091 - DNA, 19 bp, Homo sapiens
gtgcatctggcctgggggc

SEQ ID NO: 617092 - DNA, 16 bp, Homo sapiens
gtgcccatgtgtatgg

SEQ ID NO: 617093 - DNA, 17 bp, Homo sapiens
gtgcccatgtgtatgga

SEQ ID NO: 617094 - DNA, 23 bp, Homo sapiens
gtgccccagtggtgcgggccagg

SEQ ID NO: 617095 - DNA, 19 bp, Homo sapiens
gtgccccccatgccctccc

SEQ ID NO: 617096 - DNA, 11 bp, Homo sapiens
gtgcccctggg

SEQ ID NO: 617097 - DNA, 14 bp, Homo sapiens
gtgccctctcactg

SEQ ID NO: 617098 - DNA, 13 bp, Homo sapiens
gtgccctgtttcc

SEQ ID NO: 617099 - DNA, 20 bp, Homo sapiens
gtgccctttctcttaccact

SEQ ID NO: 617100 - DNA, 15 bp, Homo sapiens
gtgccgcctgtgccc

SEQ ID NO: 617101 - DNA, 16 bp, Homo sapiens
gtgccgtggagcttgg

SEQ ID NO: 617102 - DNA, 13 bp, Homo sapiens
gtgcctggctggg

SEQ ID NO: 617103 - DNA, 14 bp, Homo sapiens
gtgcctggctgggc

SEQ ID NO: 617104 - DNA, 11 bp, Homo sapiens
gtgccttatgg

SEQ ID NO: 617105 - DNA, 14 bp, Homo sapiens
gtgccttatggaac

SEQ ID NO: 617106 - DNA, 23 bp, Homo sapiens
gtgccttatggaacactctgaga

SEQ ID NO: 617107 - DNA, 13 bp, Homo sapiens
gtgccttggagca

SEQ ID NO: 617108 - DNA, 17 bp, Homo sapiens
gtgcggaccggagcggc

SEQ ID NO: 617109 - DNA, 18 bp, Homo sapiens
gtgcggcccgtgcgcagc

SEQ ID NO: 617110 - DNA, 21 bp, Homo sapiens
gtgctattcgtaagttctgtg

SEQ ID NO: 617111 - DNA, 20 bp, Homo sapiens
gtgctcacagtagcttccta

SEQ ID NO: 617112 - DNA, 22 bp, Homo sapiens
gtgctcatcagaaacaatttct

SEQ ID NO: 617113 - DNA, 12 bp, Homo sapiens
gtgctcctctgc

SEQ ID NO: 617114 - DNA, 13 bp, Homo sapiens
gtgctcctctgcc

SEQ ID NO: 617115 - DNA, 14 bp, Homo sapiens
gtgctcctctgccc

SEQ ID NO: 617116 - DNA, 15 bp, Homo sapiens
gtgctcctgctgacc

SEQ ID NO: 617117 - DNA, 17 bp, Homo sapiens
gtgctgctgtggcatca

SEQ ID NO: 617118 - DNA, 17 bp, Homo sapiens
gtgctgttgattctttc

SEQ ID NO: 617119 - DNA, 14 bp, Homo sapiens
gtgcttcacacaaa

SEQ ID NO: 617120 - DNA, 19 bp, Homo sapiens
gtgcttcacacaaagtgaa

SEQ ID NO: 617121 - DNA, 13 bp, Homo sapiens
gtgctttcatgtt

SEQ ID NO: 617122 - DNA, 19 bp, Homo sapiens
gtgctttcatgtttaagaa

SEQ ID NO: 617123 - DNA, 17 bp, Homo sapiens
gtggaagaagggccacc

SEQ ID NO: 617124 - DNA, 20 bp, Homo sapiens
gtggaattattagcaccagc

SEQ ID NO: 617125 - DNA, 16 bp, Homo sapiens
gtggacatttgttctg

SEQ ID NO: 617126 - DNA, 15 bp, Homo sapiens
gtggaccacgacctc

SEQ ID NO: 617127 - DNA, 20 bp, Homo sapiens
gtggagcttggagccccctg

SEQ ID NO: 617128 - DNA, 21 bp, Homo sapiens
gtggagcttggagccccctgg

SEQ ID NO: 617129 - DNA, 11 bp, Homo sapiens
gtggaggagga

SEQ ID NO: 617130 - DNA, 21 bp, Homo sapiens
gtggaggaggaggaggagcct

SEQ ID NO: 617131 - DNA, 13 bp, Homo sapiens
gtggataagaaaa

SEQ ID NO: 617132 - DNA, 13 bp, Homo sapiens
gtggcaactgtgg

SEQ ID NO: 617133 - DNA, 18 bp, Homo sapiens
gtggcagggaagggtgcc

SEQ ID NO: 617134 - DNA, 21 bp, Homo sapiens
gtggcaggtgggctgcctgct

SEQ ID NO: 617135 - DNA, 12 bp, Homo sapiens
gtggcagtattg

SEQ ID NO: 617136 - DNA, 15 bp, Homo sapiens
gtggcatttgcaggt

SEQ ID NO: 617137 - DNA, 16 bp, Homo sapiens
gtggcatttgcaggtg

SEQ ID NO: 617138 - DNA, 11 bp, Homo sapiens
gtggcccctcc

SEQ ID NO: 617139 - DNA, 15 bp, Homo sapiens
gtggcctgagaagag

SEQ ID NO: 617140 - DNA, 21 bp, Homo sapiens
gtggcctggcttctgggacag

SEQ ID NO: 617141 - DNA, 23 bp, Homo sapiens
gtggcctggcttctgggacaggc

SEQ ID NO: 617142 - DNA, 14 bp, Homo sapiens
gtggcggccttccg

SEQ ID NO: 617143 - DNA, 22 bp, Homo sapiens
gtggctaaatgcctaataaaca

SEQ ID NO: 617144 - DNA, 15 bp, Homo sapiens
gtggcttaaacattt

SEQ ID NO: 617145 - DNA, 21 bp, Homo sapiens
gtgggactggcccacccctct

SEQ ID NO: 617146 - DNA, 22 bp, Homo sapiens
gtgggataggagggtgcccctg

SEQ ID NO: 617147 - DNA, 14 bp, Homo sapiens
gtgggatccagaga

SEQ ID NO: 617148 - DNA, 15 bp, Homo sapiens
gtgggatccagagag

SEQ ID NO: 617149 - DNA, 14 bp, Homo sapiens
gtgggcgcaaaggt

SEQ ID NO: 617150 - DNA, 21 bp, Homo sapiens
gtgggcgcaaaggtgcctcat

SEQ ID NO: 617151 - DNA, 13 bp, Homo sapiens
gtgggctccagag

SEQ ID NO: 617152 - DNA, 17 bp, Homo sapiens
gtgggctccagagtagg

SEQ ID NO: 617153 - DNA, 17 bp, Homo sapiens
gtgggctccagggactg

SEQ ID NO: 617154 - DNA, 17 bp, Homo sapiens
gtggggcccatggcccc

SEQ ID NO: 617155 - DNA, 18 bp, Homo sapiens
gtggggcttagaatgggg

SEQ ID NO: 617156 - DNA, 14 bp, Homo sapiens
gtgggggagaatgg

SEQ ID NO: 617157 - DNA, 21 bp, Homo sapiens
gtgggggagaatggctctggc

SEQ ID NO: 617158 - DNA, 24 bp, Homo sapiens
gtgggggtcaggctacaggtgccc

SEQ ID NO: 617159 - DNA, 17 bp, Homo sapiens
gtgggtccaggagatga

SEQ ID NO: 617160 - DNA, 15 bp, Homo sapiens
gtggtccagggtcca

SEQ ID NO: 617161 - DNA, 18 bp, Homo sapiens
gtggtccagggtccagcc

SEQ ID NO: 617162 - DNA, 23 bp, Homo sapiens
gtggtcttcaaattgtcttttgt

SEQ ID NO: 617163 - DNA, 15 bp, Homo sapiens
gtggtcttggagagg

SEQ ID NO: 617164 - DNA, 18 bp, Homo sapiens
taatgattcttgtgtcat

SEQ ID NO: 617165 - DNA, 18 bp, Homo sapiens
taatgcttaacataaact

SEQ ID NO: 617166 - DNA, 22 bp, Homo sapiens
taatgcttaacataaacttgta

SEQ ID NO: 617167 - DNA, 15 bp, Homo sapiens
taatggccaagtgta

SEQ ID NO: 617168 - DNA, 12 bp, Homo sapiens
taatgtgccaaa

SEQ ID NO: 617169 - DNA, 22 bp, Homo sapiens
taatgtgccaaaatgtcaattt

SEQ ID NO: 617170 - DNA, 15 bp, Homo sapiens
taattaaaaagttaa

SEQ ID NO: 617171 - DNA, 21 bp, Homo sapiens
taattaaacaaattccttccc

SEQ ID NO: 617172 - DNA, 13 bp, Homo sapiens
taattaaactgat

SEQ ID NO: 617173 - DNA, 16 bp, Homo sapiens
taattaaagtgtccat

SEQ ID NO: 617174 - DNA, 12 bp, Homo sapiens
taattaaatgaa

SEQ ID NO: 617175 - DNA, 11 bp, Homo sapiens
taattaatttc

SEQ ID NO: 617176 - DNA, 14 bp, Homo sapiens
taattaatttcagt

SEQ ID NO: 617177 - DNA, 20 bp, Homo sapiens
taattatggtacctctgtct

SEQ ID NO: 617178 - DNA, 23 bp, Homo sapiens
taattctcagaagtgaaaaagac

SEQ ID NO: 617179 - DNA, 18 bp, Homo sapiens
taattcttctcctttgtc

SEQ ID NO: 617180 - DNA, 22 bp, Homo sapiens
taattgtaaaggtgatgaattt

SEQ ID NO: 617181 - DNA, 14 bp, Homo sapiens
taattgtgagttaa

SEQ ID NO: 617182 - DNA, 23 bp, Homo sapiens
taatttagcagtccatttttgag

SEQ ID NO: 617183 - DNA, 16 bp, Homo sapiens
taatttatgaagatag

SEQ ID NO: 617184 - DNA, 21 bp, Homo sapiens
taatttatgaagatagtttat

SEQ ID NO: 617185 - DNA, 12 bp, Homo sapiens
taatttgataaa

SEQ ID NO: 617186 - DNA, 12 bp, Homo sapiens
taggttaagtct

SEQ ID NO: 617187 - DNA, 19 bp, Homo sapiens
taggttaataggaggacag

SEQ ID NO: 617188 - DNA, 21 bp, Homo sapiens
taggttctgctttctgataca

SEQ ID NO: 617189 - DNA, 21 bp, Homo sapiens
tagtaaataatgattcaatgt

SEQ ID NO: 617190 - DNA, 16 bp, Homo sapiens
tagtagctgataaaga

SEQ ID NO: 617191 - DNA, 23 bp, Homo sapiens
tagtattttgagccttattaaaa

SEQ ID NO: 617192 - DNA, 21 bp, Homo sapiens
tagtcatgtttctgcagtatt

SEQ ID NO: 617193 - DNA, 20 bp, Homo sapiens
tagtcctcaccttctgtttt

SEQ ID NO: 617194 - DNA, 13 bp, Homo sapiens
tagtctgtacttc

SEQ ID NO: 617195 - DNA, 16 bp, Homo sapiens
tagtcttgttgttcat

SEQ ID NO: 617196 - DNA, 15 bp, Homo sapiens
tagtgagatttaggg

SEQ ID NO: 617197 - DNA, 18 bp, Homo sapiens
tagtgtcacttttttcct

SEQ ID NO: 617198 - DNA, 21 bp, Homo sapiens
tagtgtcacttttttcctgtc

SEQ ID NO: 617199 - DNA, 23 bp, Homo sapiens
tagtgtcacttttttcctgtcaa

SEQ ID NO: 617200 - DNA, 14 bp, Homo sapiens
tagtgtcattcata

SEQ ID NO: 617201 - DNA, 20 bp, Homo sapiens
tagtgtcattcatatgagtt

SEQ ID NO: 617202 - DNA, 13 bp, Homo sapiens
tagtgtgtccatg

SEQ ID NO: 617203 - DNA, 16 bp, Homo sapiens
tagtgttttcattctg

SEQ ID NO: 617204 - DNA, 15 bp, Homo sapiens
tagttaaattggctt

SEQ ID NO: 617205 - DNA, 15 bp, Homo sapiens
tagttctgctgccct

SEQ ID NO: 617206 - DNA, 21 bp, Homo sapiens
tagttgaccaactatattgcg

SEQ ID NO: 617207 - DNA, 13 bp, Homo sapiens
tagttgtaaagat

SEQ ID NO: 617208 - DNA, 22 bp, Homo sapiens
tagtttattatagtctgtactt

SEQ ID NO: 617209 - DNA, 10 bp, Homo sapiens
tagttttcca

SEQ ID NO: 617210 - DNA, 14 bp, Homo sapiens
tataaaaaaaatag

SEQ ID NO: 617211 - DNA, 11 bp, Homo sapiens
tataaaaataa

SEQ ID NO: 617212 - DNA, 19 bp, Homo sapiens
tataaaagcccatgcttaa

SEQ ID NO: 617213 - DNA, 14 bp, Homo sapiens
tataaaatacacgt

SEQ ID NO: 617214 - DNA, 11 bp, Homo sapiens
tataaacacag

SEQ ID NO: 617215 - DNA, 16 bp, Homo sapiens
tataaactgtgagata

SEQ ID NO: 617216 - DNA, 22 bp, Homo sapiens
tataaatgaatgaaatataaac

SEQ ID NO: 617217 - DNA, 22 bp, Homo sapiens
tatgtacaggctgagacacagc

SEQ ID NO: 617218 - DNA, 23 bp, Homo sapiens
tatgtaggaaaattttcttcttt

SEQ ID NO: 617219 - DNA, 20 bp, Homo sapiens
tatgtcaaatggatgtaata

SEQ ID NO: 617220 - DNA, 17 bp, Homo sapiens
tatgtcattttcagatc

SEQ ID NO: 617221 - DNA, 14 bp, Homo sapiens
tatgtccattcact

SEQ ID NO: 617222 - DNA, 20 bp, Homo sapiens
tatgtcccttcacatagttt

SEQ ID NO: 617223 - DNA, 16 bp, Homo sapiens
tatgtgaactttctca

SEQ ID NO: 617224 - DNA, 20 bp, Homo sapiens
tatgtgagcactatctttca

SEQ ID NO: 617225 - DNA, 14 bp, Homo sapiens
tatgtgtatatgtt

SEQ ID NO: 617226 - DNA, 22 bp, Homo sapiens
tatgtgtatatgtttatacaca

SEQ ID NO: 617227 - DNA, 19 bp, Homo sapiens
tatgttagatacacaaaat

SEQ ID NO: 617228 - DNA, 20 bp, Homo sapiens
tatgttagatacacaaaata

SEQ ID NO: 617229 - DNA, 16 bp, Homo sapiens
tatgttgatgaaattc

SEQ ID NO: 617230 - DNA, 16 bp, Homo sapiens
tatgtttggctgaaat

SEQ ID NO: 617231 - DNA, 17 bp, Homo sapiens
tattaaaaattatagac

SEQ ID NO: 617232 - DNA, 15 bp, Homo sapiens
tattaaattcctcct

SEQ ID NO: 617233 - DNA, 15 bp, Homo sapiens
tattaatttattaaa

SEQ ID NO: 617234 - DNA, 20 bp, Homo sapiens
tattacaacaagcaaactga

SEQ ID NO: 617235 - DNA, 21 bp, Homo sapiens
tattacaacaagcaaactgaa

SEQ ID NO: 617236 - DNA, 15 bp, Homo sapiens
tattacataaaacac

SEQ ID NO: 617237 - DNA, 21 bp, Homo sapiens
tattatagtctgtacttcagt

SEQ ID NO: 617238 - DNA, 14 bp, Homo sapiens
tattatctgggttt

SEQ ID NO: 617239 - DNA, 23 bp, Homo sapiens
tattatcttaaacccacataaac

SEQ ID NO: 617240 - DNA, 18 bp, Homo sapiens
tattatggtgatactcca

SEQ ID NO: 617241 - DNA, 18 bp, Homo sapiens
tattattttctgtaattc

SEQ ID NO: 617242 - DNA, 17 bp, Homo sapiens
tattcaagaagatagtt

SEQ ID NO: 617243 - DNA, 23 bp, Homo sapiens
tattcataagccaatttttctgc

SEQ ID NO: 617244 - DNA, 21 bp, Homo sapiens
tattcccatggtagactgtga

SEQ ID NO: 617245 - DNA, 23 bp, Homo sapiens
tattcccatggtagactgtgaca

SEQ ID NO: 617246 - DNA, 14 bp, Homo sapiens
tattcctaattcct

SEQ ID NO: 617247 - DNA, 19 bp, Homo sapiens
tattctgtagccaacttaa

SEQ ID NO: 617248 - DNA, 23 bp, Homo sapiens
tattctgtagccaacttaaacct

SEQ ID NO: 617249 - DNA, 10 bp, Homo sapiens
tattctgtca

SEQ ID NO: 617250 - DNA, 14 bp, Homo sapiens
tattcttccaagtt

SEQ ID NO: 617251 - DNA, 17 bp, Homo sapiens
tattgaagtaagttcat

SEQ ID NO: 617252 - DNA, 17 bp, Homo sapiens
tattgccttgatgtttc

SEQ ID NO: 617253 - DNA, 19 bp, Homo sapiens
tattgcgagaaacagagat

SEQ ID NO: 617254 - DNA, 20 bp, Homo sapiens
tattgctgtaaataaaaata

SEQ ID NO: 617255 - DNA, 22 bp, Homo sapiens
tattgctgtaaataaaaatagc

SEQ ID NO: 617256 - DNA, 15 bp, Homo sapiens
tattgtatctccttt

SEQ ID NO: 617257 - DNA, 16 bp, Homo sapiens
tattgtcctgtttctt

SEQ ID NO: 617258 - DNA, 16 bp, Homo sapiens
tattgttcttgtaaaa

SEQ ID NO: 617259 - DNA, 20 bp, Homo sapiens
tattgttcttgtaaaactgt

SEQ ID NO: 617260 - DNA, 23 bp, Homo sapiens
tattgttcttgtaaaactgtgac

SEQ ID NO: 617261 - DNA, 11 bp, Homo sapiens
tattgtttaaa

SEQ ID NO: 617262 - DNA, 19 bp, Homo sapiens
tatttaaatgtctaatgta

SEQ ID NO: 617263 - DNA, 18 bp, Homo sapiens
tatttaagtggactgtat

SEQ ID NO: 617264 - DNA, 14 bp, Homo sapiens
tatttactgcaatg

SEQ ID NO: 617265 - DNA, 15 bp, Homo sapiens
tatttactgcaatgt

SEQ ID NO: 617266 - DNA, 16 bp, Homo sapiens
tatttactgcaatgtc

SEQ ID NO: 617267 - DNA, 14 bp, Homo sapiens
tatttacttgttat

SEQ ID NO: 617268 - DNA, 21 bp, Homo sapiens
tatttataacattgtaaatga

SEQ ID NO: 617269 - DNA, 16 bp, Homo sapiens
tatttatagagttatt

SEQ ID NO: 617270 - DNA, 16 bp, Homo sapiens
tatttatagagttcat

SEQ ID NO: 617271 - DNA, 20 bp, Homo sapiens
tatttatagagttcatagaa

SEQ ID NO: 617272 - DNA, 23 bp, Homo sapiens
tatttatagagttcatagaaata

SEQ ID NO: 617273 - DNA, 19 bp, Homo sapiens
tatttatctgtctgagccc

SEQ ID NO: 617274 - DNA, 17 bp, Homo sapiens
tatttcataagcacatc

SEQ ID NO: 617275 - DNA, 11 bp, Homo sapiens
tatttccatgg

SEQ ID NO: 617276 - DNA, 20 bp, Homo sapiens
tatttcggctatgtctcatg

SEQ ID NO: 617277 - DNA, 16 bp, Homo sapiens
tatttgaggaaactca

SEQ ID NO: 617278 - DNA, 22 bp, Homo sapiens
tatttgaggaaactcatacagt

SEQ ID NO: 617279 - DNA, 20 bp, Homo sapiens
tatttgctcataagtaaatg

SEQ ID NO: 617280 - DNA, 20 bp, Homo sapiens
tatttggattcacagccttt

SEQ ID NO: 617281 - DNA, 22 bp, Homo sapiens
tatttggtaacttgctgtgaaa

SEQ ID NO: 617282 - DNA, 14 bp, Homo sapiens
tatttgtatcacac

SEQ ID NO: 617283 - DNA, 13 bp, Homo sapiens
tatttgtttcatt

SEQ ID NO: 617284 - DNA, 16 bp, Homo sapiens
tattttattgtaacag

SEQ ID NO: 617285 - DNA, 21 bp, Homo sapiens
tattttctactttaaattgtg

SEQ ID NO: 617286 - DNA, 19 bp, Homo sapiens
tattttctatatttggatt

SEQ ID NO: 617287 - DNA, 17 bp, Homo sapiens
tattttctgtaattctt

SEQ ID NO: 617288 - DNA, 19 bp, Homo sapiens
tattttgattgtttgatga

SEQ ID NO: 617289 - DNA, 19 bp, Homo sapiens
tattttggacgtgtgagga

SEQ ID NO: 617290 - DNA, 12 bp, Homo sapiens
tattttttgtga

SEQ ID NO: 617291 - DNA, 17 bp, Homo sapiens
tcaaaaaacagaaaaac

SEQ ID NO: 617292 - DNA, 19 bp, Homo sapiens
tcaaaaaacagaaaaacaa

SEQ ID NO: 617293 - DNA, 21 bp, Homo sapiens
tcaaaaaccattacaaaatct

SEQ ID NO: 617294 - DNA, 12 bp, Homo sapiens
tccctcggtcag

SEQ ID NO: 617295 - DNA, 19 bp, Homo sapiens
tccctctttctttcttttg

SEQ ID NO: 617296 - DNA, 16 bp, Homo sapiens
tccctgaacactcatc

SEQ ID NO: 617297 - DNA, 18 bp, Homo sapiens
tccctgaacactcatccc

SEQ ID NO: 617298 - DNA, 21 bp, Homo sapiens
tccctgaacatagttttcacc

SEQ ID NO: 617299 - DNA, 22 bp, Homo sapiens
tccctgacactgtctgctgccc

SEQ ID NO: 617300 - DNA, 13 bp, Homo sapiens
tccctgacttccc

SEQ ID NO: 617301 - DNA, 22 bp, Homo sapiens
tccctgacttcccagctggcag

SEQ ID NO: 617302 - DNA, 14 bp, Homo sapiens
tccctgaggaatga

SEQ ID NO: 617303 - DNA, 18 bp, Homo sapiens
tccctgagggcccttccc

SEQ ID NO: 617304 - DNA, 19 bp, Homo sapiens
tccctgagggcccttccca

SEQ ID NO: 617305 - DNA, 23 bp, Homo sapiens
tccctgagggcccttcccaacct

SEQ ID NO: 617306 - DNA, 16 bp, Homo sapiens
tccctgctgagtggct

SEQ ID NO: 617307 - DNA, 19 bp, Homo sapiens
tccctggagctgtccttca

SEQ ID NO: 617308 - DNA, 17 bp, Homo sapiens
tccctgggcaccctgca

SEQ ID NO: 617309 - DNA, 18 bp, Homo sapiens
tccctgggcaccctgcag

SEQ ID NO: 617310 - DNA, 21 bp, Homo sapiens
tccctgggcaccctgcaggca

SEQ ID NO: 617311 - DNA, 23 bp, Homo sapiens
tccctgggcaccctgcaggcagg

SEQ ID NO: 617312 - DNA, 19 bp, Homo sapiens
tccctggggaccaggagct

SEQ ID NO: 617313 - DNA, 18 bp, Homo sapiens
tccctggggaggacccct

SEQ ID NO: 617314 - DNA, 20 bp, Homo sapiens
tccctggggaggacccctgc

SEQ ID NO: 617315 - DNA, 21 bp, Homo sapiens
tccctggggaggacccctgcc

SEQ ID NO: 617316 - DNA, 22 bp, Homo sapiens
tccctgtctgtctgtctctctt

SEQ ID NO: 617317 - DNA, 17 bp, Homo sapiens
tccctgtgggctcacac

SEQ ID NO: 617318 - DNA, 21 bp, Homo sapiens
tcccttcccactggaggcatg

SEQ ID NO: 617319 - DNA, 15 bp, Homo sapiens
tcccttcctgtcctg

SEQ ID NO: 617320 - DNA, 14 bp, Homo sapiens
tcccttctttcctt

SEQ ID NO: 617321 - DNA, 13 bp, Homo sapiens
tcccttggcccct

SEQ ID NO: 617322 - DNA, 15 bp, Homo sapiens
tcccttggcccctct

SEQ ID NO: 617323 - DNA, 16 bp, Homo sapiens
tcccttggcccctctc

SEQ ID NO: 617324 - DNA, 17 bp, Homo sapiens
tcccttggcccctctct

SEQ ID NO: 617325 - DNA, 23 bp, Homo sapiens
tccctttccccattcagtgacat

SEQ ID NO: 617326 - DNA, 13 bp, Homo sapiens
tccctttccctgc

SEQ ID NO: 617327 - DNA, 19 bp, Homo sapiens
tccctttttaaacaaatgg

SEQ ID NO: 617328 - DNA, 11 bp, Homo sapiens
tccgagcccct

SEQ ID NO: 617329 - DNA, 19 bp, Homo sapiens
tccgccccccggcctggcc

SEQ ID NO: 617330 - DNA, 17 bp, Homo sapiens
tccgccccgtgctcctc

SEQ ID NO: 617331 - DNA, 22 bp, Homo sapiens
tccgccccgtgctcctctgccc

SEQ ID NO: 617332 - DNA, 12 bp, Homo sapiens
tccgcccgccca

SEQ ID NO: 617333 - DNA, 20 bp, Homo sapiens
tccgcccgcccaccccgctg

SEQ ID NO: 617334 - DNA, 13 bp, Homo sapiens
tccgcgagcctgc

SEQ ID NO: 617335 - DNA, 14 bp, Homo sapiens
tccgcggaggcccc

SEQ ID NO: 617336 - DNA, 15 bp, Homo sapiens
tccgcggaggcccct

SEQ ID NO: 617337 - DNA, 17 bp, Homo sapiens
tccgcggaggcccctga

SEQ ID NO: 617338 - DNA, 18 bp, Homo sapiens
tccgctgcgctcccacct

SEQ ID NO: 617339 - DNA, 19 bp, Homo sapiens
tccggatggaatcacagcc

SEQ ID NO: 617340 - DNA, 12 bp, Homo sapiens
tccggcagaggc

SEQ ID NO: 617341 - DNA, 13 bp, Homo sapiens
tccggcagaggca

SEQ ID NO: 617342 - DNA, 14 bp, Homo sapiens
tccgggcagagacc

SEQ ID NO: 617343 - DNA, 18 bp, Homo sapiens
tccgggtctcgcagcctg

SEQ ID NO: 617344 - DNA, 19 bp, Homo sapiens
tccgggtctcgcagcctga

SEQ ID NO: 617345 - DNA, 21 bp, Homo sapiens
tccgtccccagggtgcaggcg

SEQ ID NO: 617346 - DNA, 15 bp, Homo sapiens
tccgtccgcccgccc

SEQ ID NO: 617347 - DNA, 14 bp, Homo sapiens
tccgtctctgtccg

SEQ ID NO: 617348 - DNA, 18 bp, Homo sapiens
ctcctcccaactctggcc

SEQ ID NO: 617349 - DNA, 15 bp, Homo sapiens
ctcctccccctcctc

SEQ ID NO: 617350 - DNA, 21 bp, Homo sapiens
ctcctccccctcctccatgct

SEQ ID NO: 617351 - DNA, 13 bp, Homo sapiens
ctcctcctccagt

SEQ ID NO: 617352 - DNA, 10 bp, Homo sapiens
ctcctcctgc

SEQ ID NO: 617353 - DNA, 16 bp, Homo sapiens
ctcctcgggcgcctgc

SEQ ID NO: 617354 - DNA, 20 bp, Homo sapiens
ctcctcgggtggggcctgcg

SEQ ID NO: 617355 - DNA, 17 bp, Homo sapiens
ctcctcgtccggcctgc

SEQ ID NO: 617356 - DNA, 11 bp, Homo sapiens
ctcctctccca

SEQ ID NO: 617357 - DNA, 18 bp, Homo sapiens
ctcctctctctccctcca

SEQ ID NO: 617358 - DNA, 19 bp, Homo sapiens
ctcctctctctccctccac

SEQ ID NO: 617359 - DNA, 22 bp, Homo sapiens
ctcctctctctccctccactcc

SEQ ID NO: 617360 - DNA, 16 bp, Homo sapiens
ctcctctgcagcctga

SEQ ID NO: 617361 - DNA, 13 bp, Homo sapiens
ctcctctgccccc

SEQ ID NO: 617362 - DNA, 15 bp, Homo sapiens
ctcctctgccccctc

SEQ ID NO: 617363 - DNA, 22 bp, Homo sapiens
ctcctctgccccctcccccgca

SEQ ID NO: 617364 - DNA, 13 bp, Homo sapiens
ctcctgagcctgt

SEQ ID NO: 617365 - DNA, 18 bp, Homo sapiens
ctcctgagcctgtctctc

SEQ ID NO: 617366 - DNA, 19 bp, Homo sapiens
ctcctgcccccccacccca

SEQ ID NO: 617367 - DNA, 21 bp, Homo sapiens
ctcctgctgaccttctgcggc

SEQ ID NO: 617368 - DNA, 17 bp, Homo sapiens
ctcctgttttcacacct

SEQ ID NO: 617369 - DNA, 21 bp, Homo sapiens
ctcctgttttcacaccttaca

SEQ ID NO: 617370 - DNA, 22 bp, Homo sapiens
ctccttaaaaatgtatgttggt

SEQ ID NO: 617371 - DNA, 18 bp, Homo sapiens
ctccttaaccacctagtc

SEQ ID NO: 617372 - DNA, 12 bp, Homo sapiens
ctccttacagaa

SEQ ID NO: 617373 - DNA, 12 bp, Homo sapiens
ctccttctcccc

SEQ ID NO: 617374 - DNA, 18 bp, Homo sapiens
ctccttctcccctccaga

SEQ ID NO: 617375 - DNA, 19 bp, Homo sapiens
ctcgccccagccaagcctg

SEQ ID NO: 617376 - DNA, 22 bp, Homo sapiens
ctcgccccccgcccggcctcct

SEQ ID NO: 617377 - DNA, 18 bp, Homo sapiens
ctcgcccccgggcccttt

SEQ ID NO: 617378 - DNA, 19 bp, Homo sapiens
ctcgcccccgggccctttc

SEQ ID NO: 617379 - DNA, 19 bp, Homo sapiens
ctcgccctgtgccctctca

SEQ ID NO: 617380 - DNA, 12 bp, Homo sapiens
ctcgcctgggaa

SEQ ID NO: 617381 - DNA, 13 bp, Homo sapiens
ctcgcgcccctgt

SEQ ID NO: 617382 - DNA, 14 bp, Homo sapiens
ctcgcgcccctgtc

SEQ ID NO: 617383 - DNA, 22 bp, Homo sapiens
ctcgcttgtgcagaaaacattg

SEQ ID NO: 617384 - DNA, 13 bp, Homo sapiens
ctcggacaccatc

SEQ ID NO: 617385 - DNA, 23 bp, Homo sapiens
ctcggccattgaacactgcaccc

SEQ ID NO: 617386 - DNA, 20 bp, Homo sapiens
ctcggccgaggcctgcgccc

SEQ ID NO: 617387 - DNA, 19 bp, Homo sapiens
ctcgggccgcctcctccag

SEQ ID NO: 617388 - DNA, 17 bp, Homo sapiens
ctcgggctctctcaccc

SEQ ID NO: 617389 - DNA, 14 bp, Homo sapiens
ctcggtcagcaccg

SEQ ID NO: 617390 - DNA, 22 bp, Homo sapiens
ctcgtccggcctgcagcccaga

SEQ ID NO: 617391 - DNA, 13 bp, Homo sapiens
ctctaaaactatc

SEQ ID NO: 617392 - DNA, 20 bp, Homo sapiens
ctctaaaactatcagcagcg

SEQ ID NO: 617393 - DNA, 20 bp, Homo sapiens
ctctaagaaatggctttcca

SEQ ID NO: 617394 - DNA, 21 bp, Homo sapiens
ctctaagaaatggctttccac

SEQ ID NO: 617395 - DNA, 18 bp, Homo sapiens
ctctaagaattcagtagc

SEQ ID NO: 617396 - DNA, 13 bp, Homo sapiens
ctctagttttcca

SEQ ID NO: 617397 - DNA, 19 bp, Homo sapiens
ctctatccctggccacctg

SEQ ID NO: 617398 - DNA, 16 bp, Homo sapiens
ctctcaaaatgtgccg

SEQ ID NO: 617399 - DNA, 17 bp, Homo sapiens
ctctcacttttttataa

SEQ ID NO: 617400 - DNA, 23 bp, Homo sapiens
ctctcacttttttataaattata

SEQ ID NO: 617401 - DNA, 23 bp, Homo sapiens
ctctcagatccctcggtcagcac

SEQ ID NO: 617402 - DNA, 17 bp, Homo sapiens
ctctcagcccctcagag

SEQ ID NO: 617403 - DNA, 19 bp, Homo sapiens
ctctcagcccctcagagaa

SEQ ID NO: 617404 - DNA, 16 bp, Homo sapiens
ctctccaccctccggc

SEQ ID NO: 617405 - DNA, 21 bp, Homo sapiens
ctctccctaccctcttctcag

SEQ ID NO: 617406 - DNA, 18 bp, Homo sapiens
ctctccctccactcctcc

SEQ ID NO: 617407 - DNA, 19 bp, Homo sapiens
ctctccctccactcctccc

SEQ ID NO: 617408 - DNA, 14 bp, Homo sapiens
ctctccgccccccg

SEQ ID NO: 617409 - DNA, 23 bp, Homo sapiens
tagttgagccagcagacattgtc

SEQ ID NO: 617410 - DNA, 15 bp, Homo sapiens
tagttgcttacaaaa

SEQ ID NO: 617411 - DNA, 14 bp, Homo sapiens
tagttgtaaagata

SEQ ID NO: 617412 - DNA, 14 bp, Homo sapiens
tagttgttaagttt

SEQ ID NO: 617413 - DNA, 16 bp, Homo sapiens
tagtttctaaaccatg

SEQ ID NO: 617414 - DNA, 23 bp, Homo sapiens
tagttttaaaaaaataaaacatt

SEQ ID NO: 617415 - DNA, 22 bp, Homo sapiens
tagtttttgttcaccttctgtg

SEQ ID NO: 617416 - DNA, 20 bp, Homo sapiens
tataaaaataattaaaacaa

SEQ ID NO: 617417 - DNA, 12 bp, Homo sapiens
tataaaagccca

SEQ ID NO: 617418 - DNA, 13 bp, Homo sapiens
tataaaatacacg

SEQ ID NO: 617419 - DNA, 20 bp, Homo sapiens
tataaaatacacgtgtatat

SEQ ID NO: 617420 - DNA, 21 bp, Homo sapiens
tataaaatacacgtgtatatg

SEQ ID NO: 617421 - DNA, 14 bp, Homo sapiens
tataaaatctgtat

SEQ ID NO: 617422 - DNA, 20 bp, Homo sapiens
tataaacacagtaagatagg

SEQ ID NO: 617423 - DNA, 13 bp, Homo sapiens
tataaactgtgag

SEQ ID NO: 617424 - DNA, 12 bp, Homo sapiens
tataaatatcta

SEQ ID NO: 617425 - DNA, 22 bp, Homo sapiens
tataaatcttacccttcaatgt

SEQ ID NO: 617426 - DNA, 15 bp, Homo sapiens
tataaatgaatgaaa

SEQ ID NO: 617427 - DNA, 14 bp, Homo sapiens
tataaattataatg

SEQ ID NO: 617428 - DNA, 19 bp, Homo sapiens
tataacattgtaaatgata

SEQ ID NO: 617429 - DNA, 18 bp, Homo sapiens
tataagagacaaagtttg

SEQ ID NO: 617430 - DNA, 22 bp, Homo sapiens
tataagagacaaagtttggaag

SEQ ID NO: 617431 - DNA, 12 bp, Homo sapiens
tataatcaaaat

SEQ ID NO: 617432 - DNA, 18 bp, Homo sapiens
tataatggcctcttaaaa

SEQ ID NO: 617433 - DNA, 22 bp, Homo sapiens
tataatttcaatttttaaattt

SEQ ID NO: 617434 - DNA, 18 bp, Homo sapiens
tataattttattgctgga

SEQ ID NO: 617435 - DNA, 19 bp, Homo sapiens
tataatttttcctttaatc

SEQ ID NO: 617436 - DNA, 16 bp, Homo sapiens
tatacaaacaggtgct

SEQ ID NO: 617437 - DNA, 19 bp, Homo sapiens
tatacaaagctgtcactca

SEQ ID NO: 617438 - DNA, 21 bp, Homo sapiens
tatacaaagctgtcactcaca

SEQ ID NO: 617439 - DNA, 20 bp, Homo sapiens
tatacatacgcaattgtata

SEQ ID NO: 617440 - DNA, 13 bp, Homo sapiens
tataccagcaaaa

SEQ ID NO: 617441 - DNA, 14 bp, Homo sapiens
tatacctgtacaca

SEQ ID NO: 617442 - DNA, 16 bp, Homo sapiens
tcacaaagctatttaa

SEQ ID NO: 617443 - DNA, 17 bp, Homo sapiens
tcacaaagctatttaag

SEQ ID NO: 617444 - DNA, 18 bp, Homo sapiens
tcacaaggttatcagaaa

SEQ ID NO: 617445 - DNA, 19 bp, Homo sapiens
tcacaaggttatcagaaag

SEQ ID NO: 617446 - DNA, 18 bp, Homo sapiens
tcacacaaagtgaaatta

SEQ ID NO: 617447 - DNA, 14 bp, Homo sapiens
tcacacaactgtgg

SEQ ID NO: 617448 - DNA, 14 bp, Homo sapiens
tcacaccggcactg

SEQ ID NO: 617449 - DNA, 16 bp, Homo sapiens
tcacacctcccttcat

SEQ ID NO: 617450 - DNA, 18 bp, Homo sapiens
tcacaccttacaaagcca

SEQ ID NO: 617451 - DNA, 22 bp, Homo sapiens
tcacaccttacaaagccagctc

SEQ ID NO: 617452 - DNA, 15 bp, Homo sapiens
tcacactgagctggg

SEQ ID NO: 617453 - DNA, 16 bp, Homo sapiens
tcacagcacatttgtt

SEQ ID NO: 617454 - DNA, 15 bp, Homo sapiens
tcacagggactctcc

SEQ ID NO: 617455 - DNA, 14 bp, Homo sapiens
tcacagtgggcggc

SEQ ID NO: 617456 - DNA, 14 bp, Homo sapiens
tcacatctgtatat

SEQ ID NO: 617457 - DNA, 20 bp, Homo sapiens
tcacatgcccctcttagaag

SEQ ID NO: 617458 - DNA, 15 bp, Homo sapiens
tcacattcctgaccc

SEQ ID NO: 617459 - DNA, 16 bp, Homo sapiens
tcaccaaaagacgagg

SEQ ID NO: 617460 - DNA, 15 bp, Homo sapiens
tcaccatttaatcat

SEQ ID NO: 617461 - DNA, 21 bp, Homo sapiens
tcaccatttaatcatttccag

SEQ ID NO: 617462 - DNA, 13 bp, Homo sapiens
tcacccagcctgg

SEQ ID NO: 617463 - DNA, 14 bp, Homo sapiens
tcaccctgactgtg

SEQ ID NO: 617464 - DNA, 14 bp, Homo sapiens
tcaccgaaaacgtg

SEQ ID NO: 617465 - DNA, 19 bp, Homo sapiens
tcaccgaaaacgtggctgc

SEQ ID NO: 617466 - DNA, 20 bp, Homo sapiens
tcaccgaaaacgtggctgct

SEQ ID NO: 617467 - DNA, 22 bp, Homo sapiens
tcaccgaaaacgtggctgcttc

SEQ ID NO: 617468 - DNA, 23 bp, Homo sapiens
tcaccgaaaacgtggctgcttca

SEQ ID NO: 617469 - DNA, 16 bp, Homo sapiens
tcacctatctggaaaa

SEQ ID NO: 617470 - DNA, 22 bp, Homo sapiens
tcacctgaataagggactttgg

SEQ ID NO: 617471 - DNA, 16 bp, Homo sapiens
tcaccttctgtgcatc

SEQ ID NO: 617472 - DNA, 15 bp, Homo sapiens
tcaccttctgtttta

SEQ ID NO: 617473 - DNA, 14 bp, Homo sapiens
tcacgggcccgctc

SEQ ID NO: 617474 - DNA, 16 bp, Homo sapiens
tcacgtctgtgagtct

SEQ ID NO: 617475 - DNA, 16 bp, Homo sapiens
tcacgtgaggcccctg

SEQ ID NO: 617476 - DNA, 19 bp, Homo sapiens
tcacgtgaggcccctgtgc

SEQ ID NO: 617477 - DNA, 16 bp, Homo sapiens
tcactccactcccctc

SEQ ID NO: 617478 - DNA, 17 bp, Homo sapiens
tcactgcctttttttct

SEQ ID NO: 617479 - DNA, 19 bp, Homo sapiens
tcactgtgacctgctcctg

SEQ ID NO: 617480 - DNA, 22 bp, Homo sapiens
tcactgtgacctgctcctgccc

SEQ ID NO: 617481 - DNA, 12 bp, Homo sapiens
tcacttcttaag

SEQ ID NO: 617482 - DNA, 14 bp, Homo sapiens
tcacttcttaagga

SEQ ID NO: 617483 - DNA, 15 bp, Homo sapiens
tcacttcttaaggac

SEQ ID NO: 617484 - DNA, 18 bp, Homo sapiens
tcacttgtggcagcttcc

SEQ ID NO: 617485 - DNA, 16 bp, Homo sapiens
tcacttgtttgtgttt

SEQ ID NO: 617486 - DNA, 22 bp, Homo sapiens
tcacttttttcctgtcaatata

SEQ ID NO: 617487 - DNA, 12 bp, Homo sapiens
tcagaaaagcac

SEQ ID NO: 617488 - DNA, 16 bp, Homo sapiens
tcagaaaagcacctct

SEQ ID NO: 617489 - DNA, 13 bp, Homo sapiens
tcagaaacttttt

SEQ ID NO: 617490 - DNA, 17 bp, Homo sapiens
tcagaaagatcaaatta

SEQ ID NO: 617491 - DNA, 19 bp, Homo sapiens
tcagaaagggcagcccctc

SEQ ID NO: 617492 - DNA, 22 bp, Homo sapiens
tcagaaagggcagcccctcccc

SEQ ID NO: 617493 - DNA, 23 bp, Homo sapiens
tcagaaagggcagcccctcccca

SEQ ID NO: 617494 - DNA, 16 bp, Homo sapiens
tcagaactcctttcta

SEQ ID NO: 617495 - DNA, 18 bp, Homo sapiens
tcagaatgtgcaaagcag

SEQ ID NO: 617496 - DNA, 12 bp, Homo sapiens
tcagaatgttgt

SEQ ID NO: 617497 - DNA, 17 bp, Homo sapiens
tcagacacctagactct

SEQ ID NO: 617498 - DNA, 19 bp, Homo sapiens
tcagacacctagactctaa

SEQ ID NO: 617499 - DNA, 16 bp, Homo sapiens
tcagactctctcctct

SEQ ID NO: 617500 - DNA, 16 bp, Homo sapiens
tcagatccttccaaac

SEQ ID NO: 617501 - DNA, 19 bp, Homo sapiens
tcagatctcatagatgacc

SEQ ID NO: 617502 - DNA, 18 bp, Homo sapiens
tcagatgcccagtatcat

SEQ ID NO: 617503 - DNA, 13 bp, Homo sapiens
tcagatggggcct

SEQ ID NO: 617504 - DNA, 23 bp, Homo sapiens
tcagatggggcctgggctgttgt

SEQ ID NO: 617505 - DNA, 15 bp, Homo sapiens
tcagatgtttccaag

SEQ ID NO: 617506 - DNA, 23 bp, Homo sapiens
tcagcaaattaattggcagcaga

SEQ ID NO: 617507 - DNA, 17 bp, Homo sapiens
tcagcaatccttaaaaa

SEQ ID NO: 617508 - DNA, 14 bp, Homo sapiens
tcagcagccccctg

SEQ ID NO: 617509 - DNA, 17 bp, Homo sapiens
tcagcagccccctgccc

SEQ ID NO: 617510 - DNA, 14 bp, Homo sapiens
tcagcatagagcta

SEQ ID NO: 617511 - DNA, 19 bp, Homo sapiens
tcagcatatatataaaata

SEQ ID NO: 617512 - DNA, 18 bp, Homo sapiens
tcagcatcctggaaattt

SEQ ID NO: 617513 - DNA, 19 bp, Homo sapiens
tcagcatcgtgtgggtccc

SEQ ID NO: 617514 - DNA, 17 bp, Homo sapiens
ctgagactcgcgacaat

SEQ ID NO: 617515 - DNA, 19 bp, Homo sapiens
ctgagactcgcgacaatgc

SEQ ID NO: 617516 - DNA, 21 bp, Homo sapiens
ctgagactcgcgacaatgcaa

SEQ ID NO: 617517 - DNA, 21 bp, Homo sapiens
ctgagagggtgtgggtgccct

SEQ ID NO: 617518 - DNA, 17 bp, Homo sapiens
ctgagcagatcgtgccg

SEQ ID NO: 617519 - DNA, 14 bp, Homo sapiens
ctgagccacagtgg

SEQ ID NO: 617520 - DNA, 20 bp, Homo sapiens
ctgagccacagtggggccca

SEQ ID NO: 617521 - DNA, 13 bp, Homo sapiens
ctgagccagattt

SEQ ID NO: 617522 - DNA, 17 bp, Homo sapiens
ctgagccagatttcact

SEQ ID NO: 617523 - DNA, 19 bp, Homo sapiens
ctgagccagatttcactct

SEQ ID NO: 617524 - DNA, 21 bp, Homo sapiens
ctgagccagatttcactctcc

SEQ ID NO: 617525 - DNA, 13 bp, Homo sapiens
ctgagcccctcct

SEQ ID NO: 617526 - DNA, 19 bp, Homo sapiens
ctgagccctgccctcactc

SEQ ID NO: 617527 - DNA, 16 bp, Homo sapiens
ctgagctgggcaccac

SEQ ID NO: 617528 - DNA, 20 bp, Homo sapiens
ctgaggaagtcccagtccaa

SEQ ID NO: 617529 - DNA, 11 bp, Homo sapiens
ctgaggacaga

SEQ ID NO: 617530 - DNA, 18 bp, Homo sapiens
ctgaggacggggcagagc

SEQ ID NO: 617531 - DNA, 22 bp, Homo sapiens
ctgaggacggggcagagctgag

SEQ ID NO: 617532 - DNA, 14 bp, Homo sapiens
ctgaggagtccaaa

SEQ ID NO: 617533 - DNA, 18 bp, Homo sapiens
ctgaggccccaggcccta

SEQ ID NO: 617534 - DNA, 21 bp, Homo sapiens
ctgaggctgccccaggggcac

SEQ ID NO: 617535 - DNA, 20 bp, Homo sapiens
ctgagggaagcccacccgcc

SEQ ID NO: 617536 - DNA, 22 bp, Homo sapiens
ctgagggaagcccacccgcccc

SEQ ID NO: 617537 - DNA, 23 bp, Homo sapiens
ctgagggaagcccacccgcccca

SEQ ID NO: 617538 - DNA, 21 bp, Homo sapiens
ctgagggacgagcagagcgca

SEQ ID NO: 617539 - DNA, 20 bp, Homo sapiens
ctgagggggctctttccctc

SEQ ID NO: 617540 - DNA, 18 bp, Homo sapiens
ctgagtcggctgggcagg

SEQ ID NO: 617541 - DNA, 20 bp, Homo sapiens
ctgagtcggctgggcagggc

SEQ ID NO: 617542 - DNA, 22 bp, Homo sapiens
ctgagtgacatgggtgtgccag

SEQ ID NO: 617543 - DNA, 20 bp, Homo sapiens
ctgagtggctcgtgtttcac

SEQ ID NO: 617544 - DNA, 18 bp, Homo sapiens
ctgagtgggctgggccct

SEQ ID NO: 617545 - DNA, 14 bp, Homo sapiens
ctgagttagctgtt

SEQ ID NO: 617546 - DNA, 18 bp, Homo sapiens
ctgagttagctgtttact

SEQ ID NO: 617547 - DNA, 15 bp, Homo sapiens
ctgataaagaaacct

SEQ ID NO: 617548 - DNA, 15 bp, Homo sapiens
ctgatatcacgggcc

SEQ ID NO: 617549 - DNA, 21 bp, Homo sapiens
ctgatatccaacagaaagcat

SEQ ID NO: 617550 - DNA, 20 bp, Homo sapiens
ctgatatctgtttgcttcta

SEQ ID NO: 617551 - DNA, 18 bp, Homo sapiens
ctgatgagacaacacaca

SEQ ID NO: 617552 - DNA, 12 bp, Homo sapiens
ctgatggccagg

SEQ ID NO: 617553 - DNA, 15 bp, Homo sapiens
ctgatggccaggcct

SEQ ID NO: 617554 - DNA, 21 bp, Homo sapiens
ctgatgggtatcatgcttcta

SEQ ID NO: 617555 - DNA, 17 bp, Homo sapiens
ctgatgggtcctgctgc

SEQ ID NO: 617556 - DNA, 15 bp, Homo sapiens
ctgatggtgcaatga

SEQ ID NO: 617557 - DNA, 19 bp, Homo sapiens
ctgatggtgcaatgacctt

SEQ ID NO: 617558 - DNA, 22 bp, Homo sapiens
ctgattattacaacaagcaaac

SEQ ID NO: 617559 - DNA, 19 bp, Homo sapiens
ctgattcaaggcattattt

SEQ ID NO: 617560 - DNA, 22 bp, Homo sapiens
ctgatttactaacagtaactgc

SEQ ID NO: 617561 - DNA, 19 bp, Homo sapiens
ctgatttattctggtgtct

SEQ ID NO: 617562 - DNA, 12 bp, Homo sapiens
ctgcaacactgg

SEQ ID NO: 617563 - DNA, 13 bp, Homo sapiens
ctgcaataacagt

SEQ ID NO: 617564 - DNA, 15 bp, Homo sapiens
ctgcacagtggtcca

SEQ ID NO: 617565 - DNA, 16 bp, Homo sapiens
ctgcacatacagatgg

SEQ ID NO: 617566 - DNA, 16 bp, Homo sapiens
ctgcaccctctgctat

SEQ ID NO: 617567 - DNA, 15 bp, Homo sapiens
ctgcacctgcttctc

SEQ ID NO: 617568 - DNA, 15 bp, Homo sapiens
ctgcacgcccaggat

SEQ ID NO: 617569 - DNA, 14 bp, Homo sapiens
ctgcactgccctcc

SEQ ID NO: 617570 - DNA, 22 bp, Homo sapiens
ctgcagaaaattaattgaaata

SEQ ID NO: 617571 - DNA, 20 bp, Homo sapiens
ctgcagagctaggttgtcct

SEQ ID NO: 617572 - DNA, 15 bp, Homo sapiens
ctgcagcccagaacg

SEQ ID NO: 617573 - DNA, 23 bp, Homo sapiens
ctgcagcccagaacgggcctccc

SEQ ID NO: 617574 - DNA, 15 bp, Homo sapiens
ctgcagcctgagctc

SEQ ID NO: 617575 - DNA, 21 bp, Homo sapiens
ctgcagcctgagctccaccct

SEQ ID NO: 617576 - DNA, 14 bp, Homo sapiens
ctgcagctaatttg

SEQ ID NO: 617577 - DNA, 21 bp, Homo sapiens
ctgcagcttctaactggtaaa

SEQ ID NO: 617578 - DNA, 15 bp, Homo sapiens
ctgcaggaatcaaaa

SEQ ID NO: 617579 - DNA, 19 bp, Homo sapiens
ctgcaggcaggtgggggct

SEQ ID NO: 617580 - DNA, 17 bp, Homo sapiens
ctgcagtttggccctgg

SEQ ID NO: 617581 - DNA, 23 bp, Homo sapiens
ctgcataagattatatacaaagc

SEQ ID NO: 617582 - DNA, 14 bp, Homo sapiens
ctgcatggctgaga

SEQ ID NO: 617583 - DNA, 15 bp, Homo sapiens
ctgcatgtcggggcc

SEQ ID NO: 617584 - DNA, 16 bp, Homo sapiens
ctgccaaataaatcat

SEQ ID NO: 617585 - DNA, 18 bp, Homo sapiens
ctgccaagagtccaagcc

SEQ ID NO: 617586 - DNA, 18 bp, Homo sapiens
ctgccaggccctccagca

SEQ ID NO: 617587 - DNA, 15 bp, Homo sapiens
ctgccaggcctccct

SEQ ID NO: 617588 - DNA, 18 bp, Homo sapiens
ctgggcaccctgcaggca

SEQ ID NO: 617589 - DNA, 19 bp, Homo sapiens
ctgggcaccctgcaggcag

SEQ ID NO: 617590 - DNA, 23 bp, Homo sapiens
ctgggcaccctgcaggcaggcag

SEQ ID NO: 617591 - DNA, 12 bp, Homo sapiens
ctgggcagggcc

SEQ ID NO: 617592 - DNA, 13 bp, Homo sapiens
ctgggcagggccg

SEQ ID NO: 617593 - DNA, 12 bp, Homo sapiens
ctgggcagggtg

SEQ ID NO: 617594 - DNA, 11 bp, Homo sapiens
ctgggccaggg

SEQ ID NO: 617595 - DNA, 20 bp, Homo sapiens
ctgggcccaggcccagcctc

SEQ ID NO: 617596 - DNA, 12 bp, Homo sapiens
ctgggcctcccg

SEQ ID NO: 617597 - DNA, 21 bp, Homo sapiens
ctgggcctcccgtccgtccgc

SEQ ID NO: 617598 - DNA, 12 bp, Homo sapiens
ctgggctcacta

SEQ ID NO: 617599 - DNA, 23 bp, Homo sapiens
ctgggctcactacatgggccagc

SEQ ID NO: 617600 - DNA, 21 bp, Homo sapiens
ctgggctgctggggcagggcc

SEQ ID NO: 617601 - DNA, 16 bp, Homo sapiens
ctgggctttggggctg

SEQ ID NO: 617602 - DNA, 19 bp, Homo sapiens
ctgggctttggggctggtg

SEQ ID NO: 617603 - DNA, 14 bp, Homo sapiens
ctggggaccaggag

SEQ ID NO: 617604 - DNA, 17 bp, Homo sapiens
ctggggaccaggagcta

SEQ ID NO: 617605 - DNA, 18 bp, Homo sapiens
ctggggaggacccctgcc

SEQ ID NO: 617606 - DNA, 21 bp, Homo sapiens
ctggggaggacccctgccctc

SEQ ID NO: 617607 - DNA, 21 bp, Homo sapiens
ctggggcatccaccttcctgc

SEQ ID NO: 617608 - DNA, 16 bp, Homo sapiens
ctggggccggggctgc

SEQ ID NO: 617609 - DNA, 17 bp, Homo sapiens
ctggggccggggctgcc

SEQ ID NO: 617610 - DNA, 15 bp, Homo sapiens
ctgggggactgcttt

SEQ ID NO: 617611 - DNA, 16 bp, Homo sapiens
ctgggggctgctgcac

SEQ ID NO: 617612 - DNA, 18 bp, Homo sapiens
ctggggtctctgagcagt

SEQ ID NO: 617613 - DNA, 13 bp, Homo sapiens
ctggggtctgtga

SEQ ID NO: 617614 - DNA, 17 bp, Homo sapiens
ctggggtggttggaggc

SEQ ID NO: 617615 - DNA, 21 bp, Homo sapiens
ctggggtggttggaggcctgg

SEQ ID NO: 617616 - DNA, 18 bp, Homo sapiens
ctgggtccccctcctgca

SEQ ID NO: 617617 - DNA, 16 bp, Homo sapiens
ctgggtcgcccctcct

SEQ ID NO: 617618 - DNA, 13 bp, Homo sapiens
ctgggtgtggcct

SEQ ID NO: 617619 - DNA, 21 bp, Homo sapiens
ctgggttaacagtaaatatac

SEQ ID NO: 617620 - DNA, 20 bp, Homo sapiens
ctggtaaaaagatccaggga

SEQ ID NO: 617621 - DNA, 14 bp, Homo sapiens
ctggtcctgcactg

SEQ ID NO: 617622 - DNA, 16 bp, Homo sapiens
ctggtccttagtaaat

SEQ ID NO: 617623 - DNA, 13 bp, Homo sapiens
ctggtctggagcc

SEQ ID NO: 617624 - DNA, 17 bp, Homo sapiens
ctggtctggagccccta

SEQ ID NO: 617625 - DNA, 20 bp, Homo sapiens
ctggtctggagcccctatcc

SEQ ID NO: 617626 - DNA, 21 bp, Homo sapiens
ctggtgatggaggtttcatac

SEQ ID NO: 617627 - DNA, 15 bp, Homo sapiens
ctggtgcgtgtggcc

SEQ ID NO: 617628 - DNA, 18 bp, Homo sapiens
ctggtgcgtgtggccctg

SEQ ID NO: 617629 - DNA, 22 bp, Homo sapiens
ctggtgcgtgtggccctgtggg

SEQ ID NO: 617630 - DNA, 19 bp, Homo sapiens
ctggtgggataggagggtg

SEQ ID NO: 617631 - DNA, 19 bp, Homo sapiens
ctggtgtcttgagaccagc

SEQ ID NO: 617632 - DNA, 21 bp, Homo sapiens
ctggtgtcttgagaccagcct

SEQ ID NO: 617633 - DNA, 20 bp, Homo sapiens
ctgtaaaatacatggtatct

SEQ ID NO: 617634 - DNA, 16 bp, Homo sapiens
ctgtaaataaaaatag

SEQ ID NO: 617635 - DNA, 20 bp, Homo sapiens
ctgtaatcacactctcttct

SEQ ID NO: 617636 - DNA, 19 bp, Homo sapiens
ctgtacacacacagacaca

SEQ ID NO: 617637 - DNA, 23 bp, Homo sapiens
ctgtacacacacagacacacaag

SEQ ID NO: 617638 - DNA, 17 bp, Homo sapiens
ctgtactcgcttgtgca

SEQ ID NO: 617639 - DNA, 18 bp, Homo sapiens
ctgtacttcagttctcat

SEQ ID NO: 617640 - DNA, 19 bp, Homo sapiens
ctgtagccaacttaaacct

SEQ ID NO: 617641 - DNA, 18 bp, Homo sapiens
ctgtagggaaaccttgga

SEQ ID NO: 617642 - DNA, 14 bp, Homo sapiens
ctgtatacaaacag

SEQ ID NO: 617643 - DNA, 17 bp, Homo sapiens
ctgtatacaaacaggtg

SEQ ID NO: 617644 - DNA, 21 bp, Homo sapiens
ctgtataccccgtgaagcatc

SEQ ID NO: 617645 - DNA, 14 bp, Homo sapiens
ctgtatcatttctt

SEQ ID NO: 617646 - DNA, 23 bp, Homo sapiens
ctgtatccaagttatttgatctg

SEQ ID NO: 617647 - DNA, 16 bp, Homo sapiens
ctgtatctgacatatt

SEQ ID NO: 617648 - DNA, 18 bp, Homo sapiens
ctgtcaagtttttatacc

SEQ ID NO: 617649 - DNA, 19 bp, Homo sapiens
ctgtcactcacaaaaggct

SEQ ID NO: 617650 - DNA, 14 bp, Homo sapiens
ctgtcagagctttc

SEQ ID NO: 617651 - DNA, 16 bp, Homo sapiens
ctgtcagcttcccaac

SEQ ID NO: 617652 - DNA, 13 bp, Homo sapiens
ctgtcaggaatgg

SEQ ID NO: 617653 - DNA, 17 bp, Homo sapiens
ctgtcaggaccatttta

SEQ ID NO: 617654 - DNA, 17 bp, Homo sapiens
ctgtccctaaacatagt

SEQ ID NO: 617655 - DNA, 22 bp, Homo sapiens
ctgtccctaaacatagtggtat

SEQ ID NO: 617656 - DNA, 12 bp, Homo sapiens
ctgtccctgtgg

SEQ ID NO: 617657 - DNA, 14 bp, Homo sapiens
ctgtccctgtgggc

SEQ ID NO: 617658 - DNA, 15 bp, Homo sapiens
ctgtccctgtgggct

SEQ ID NO: 617659 - DNA, 17 bp, Homo sapiens
ctgtccctgtgggctca

SEQ ID NO: 617660 - DNA, 20 bp, Homo sapiens
ctgtccgcgtcctttcctct

SEQ ID NO: 617661 - DNA, 14 bp, Homo sapiens
ctgtccgtcctgct

SEQ ID NO: 617662 - DNA, 22 bp, Homo sapiens
ctgtccgtcctgctcgccctgt

SEQ ID NO: 617663 - DNA, 20 bp, Homo sapiens
ctgtcctgcgcctgcgcctc

SEQ ID NO: 617664 - DNA, 15 bp, Homo sapiens
ctgtcctgctcacgt

SEQ ID NO: 617665 - DNA, 22 bp, Homo sapiens
ctgtccttcattccgttaggaa

SEQ ID NO: 617666 - DNA, 21 bp, Homo sapiens
ctgtccttccaacctgttcac

SEQ ID NO: 617667 - DNA, 13 bp, Homo sapiens
ctgtcctttccca

SEQ ID NO: 617668 - DNA, 21 bp, Homo sapiens
ctgtcgggcccgcactcagga

SEQ ID NO: 617669 - DNA, 20 bp, Homo sapiens
ctgtcggtgtttggaggctg

SEQ ID NO: 617670 - DNA, 23 bp, Homo sapiens
ctgtcggtgtttggaggctgctg

SEQ ID NO: 617671 - DNA, 14 bp, Homo sapiens
acctgtacacacac

SEQ ID NO: 617672 - DNA, 23 bp, Homo sapiens
acctgtacacacacagacacaca

SEQ ID NO: 617673 - DNA, 13 bp, Homo sapiens
acctgtagaagat

SEQ ID NO: 617674 - DNA, 19 bp, Homo sapiens
acctgttctctagttttcc

SEQ ID NO: 617675 - DNA, 21 bp, Homo sapiens
accttacaaccacatttctgg

SEQ ID NO: 617676 - DNA, 18 bp, Homo sapiens
accttcatgaccttacat

SEQ ID NO: 617677 - DNA, 15 bp, Homo sapiens
accttcctgcccagg

SEQ ID NO: 617678 - DNA, 17 bp, Homo sapiens
accttcggcagtggctg

SEQ ID NO: 617679 - DNA, 20 bp, Homo sapiens
accttctaatccatgtgctg

SEQ ID NO: 617680 - DNA, 23 bp, Homo sapiens
accttctgtgcatctggcctggg

SEQ ID NO: 617681 - DNA, 19 bp, Homo sapiens
accttgggcacgggagagc

SEQ ID NO: 617682 - DNA, 21 bp, Homo sapiens
acctttcaataggaaaaactg

SEQ ID NO: 617683 - DNA, 15 bp, Homo sapiens
acctttggcttaatt

SEQ ID NO: 617684 - DNA, 18 bp, Homo sapiens
acctttggcttaattcca

SEQ ID NO: 617685 - DNA, 16 bp, Homo sapiens
accttttaaaaaaata

SEQ ID NO: 617686 - DNA, 19 bp, Homo sapiens
accttttaaaaaaataata

SEQ ID NO: 617687 - DNA, 19 bp, Homo sapiens
acctttttttctctcctaa

SEQ ID NO: 617688 - DNA, 16 bp, Homo sapiens
acgaagaaatagaata

SEQ ID NO: 617689 - DNA, 19 bp, Homo sapiens
acgaagaaatagaataggc

SEQ ID NO: 617690 - DNA, 15 bp, Homo sapiens
acgaatattgctgat

SEQ ID NO: 617691 - DNA, 18 bp, Homo sapiens
acgaatattgctgatggt

SEQ ID NO: 617692 - DNA, 15 bp, Homo sapiens
acgacataagctggt

SEQ ID NO: 617693 - DNA, 17 bp, Homo sapiens
acgaccgacgcccctcc

SEQ ID NO: 617694 - DNA, 16 bp, Homo sapiens
acgactttctttaaca

SEQ ID NO: 617695 - DNA, 18 bp, Homo sapiens
acgagcagagcgcagccc

SEQ ID NO: 617696 - DNA, 20 bp, Homo sapiens
acgagcagagcgcagccccc

SEQ ID NO: 617697 - DNA, 22 bp, Homo sapiens
acgatccccatggaacagccct

SEQ ID NO: 617698 - DNA, 13 bp, Homo sapiens
acgatttaattta

SEQ ID NO: 617699 - DNA, 19 bp, Homo sapiens
acgcaagaggtttcagcat

SEQ ID NO: 617700 - DNA, 14 bp, Homo sapiens
acgcaattgtatat

SEQ ID NO: 617701 - DNA, 21 bp, Homo sapiens
acgcaattgtatatatatgtg

SEQ ID NO: 617702 - DNA, 19 bp, Homo sapiens
acgcagagccccggagcac

SEQ ID NO: 617703 - DNA, 16 bp, Homo sapiens
acgcatgcagggcccc

SEQ ID NO: 617704 - DNA, 17 bp, Homo sapiens
acgcccagcccccaccc

SEQ ID NO: 617705 - DNA, 23 bp, Homo sapiens
acgcccccgcccccgccccgctg

SEQ ID NO: 617706 - DNA, 17 bp, Homo sapiens
acgccgatataagccat

SEQ ID NO: 617707 - DNA, 19 bp, Homo sapiens
acgccgatataagccatag

SEQ ID NO: 617708 - DNA, 17 bp, Homo sapiens
acgccggggctggccct

SEQ ID NO: 617709 - DNA, 20 bp, Homo sapiens
acgccggggctggccctgcc

SEQ ID NO: 617710 - DNA, 16 bp, Homo sapiens
acgcggccgctctccg

SEQ ID NO: 617711 - DNA, 17 bp, Homo sapiens
acgctggagaccctgcg

SEQ ID NO: 617712 - DNA, 17 bp, Homo sapiens
acggaagtggcctgaga

SEQ ID NO: 617713 - DNA, 21 bp, Homo sapiens
acggaagtggcctgagaagag

SEQ ID NO: 617714 - DNA, 22 bp, Homo sapiens
acggaagtggcctgagaagagt

SEQ ID NO: 617715 - DNA, 12 bp, Homo sapiens
acggcagcccca

SEQ ID NO: 617716 - DNA, 21 bp, Homo sapiens
acggccgtccctgacttccca

SEQ ID NO: 617717 - DNA, 22 bp, Homo sapiens
acggcttccccatcgccttctg

SEQ ID NO: 617718 - DNA, 12 bp, Homo sapiens
acgggagagcgc

SEQ ID NO: 617719 - DNA, 13 bp, Homo sapiens
acgggagagcgcc

SEQ ID NO: 617720 - DNA, 19 bp, Homo sapiens
acgggagagcgccacccgc

SEQ ID NO: 617721 - DNA, 21 bp, Homo sapiens
acggggtcgggggaggagcac

SEQ ID NO: 617722 - DNA, 21 bp, Homo sapiens
acgtgatgtgctcatcagaaa

SEQ ID NO: 617723 - DNA, 13 bp, Homo sapiens
acgtgcagcacct

SEQ ID NO: 617724 - DNA, 14 bp, Homo sapiens
acgtgcccatttca

SEQ ID NO: 617725 - DNA, 17 bp, Homo sapiens
acgtggctgcttcaagg

SEQ ID NO: 617726 - DNA, 18 bp, Homo sapiens
acgtggctgcttcaagga

SEQ ID NO: 617727 - DNA, 19 bp, Homo sapiens
acgtggctgcttcaaggat

SEQ ID NO: 617728 - DNA, 23 bp, Homo sapiens
acgtggctgcttcaaggatcctg

SEQ ID NO: 617729 - DNA, 13 bp, Homo sapiens
acgtgtatatgag

SEQ ID NO: 617730 - DNA, 15 bp, Homo sapiens
acgtgtgcagactgt

SEQ ID NO: 617731 - DNA, 19 bp, Homo sapiens
acgtgtgcagactgtggct

SEQ ID NO: 617732 - DNA, 15 bp, Homo sapiens
acgtgtttcgggcca

SEQ ID NO: 617733 - DNA, 17 bp, Homo sapiens
acgttgatagtttacaa

SEQ ID NO: 617734 - DNA, 18 bp, Homo sapiens
acgttgatagtttacaaa

SEQ ID NO: 617735 - DNA, 16 bp, Homo sapiens
acgttgatgtctgaac

SEQ ID NO: 617736 - DNA, 21 bp, Homo sapiens
acgttgcagaaaaagagcttc

SEQ ID NO: 617737 - DNA, 13 bp, Homo sapiens
actaaaagtgatg

SEQ ID NO: 617738 - DNA, 14 bp, Homo sapiens
actaaatagatttt

SEQ ID NO: 617739 - DNA, 18 bp, Homo sapiens
actaaatagatttttaga

SEQ ID NO: 617740 - DNA, 15 bp, Homo sapiens
actaaatagcatgta

SEQ ID NO: 617741 - DNA, 20 bp, Homo sapiens
actaaatagcatgtattgtg

SEQ ID NO: 617742 - DNA, 15 bp, Homo sapiens
actaacactatttta

SEQ ID NO: 617743 - DNA, 22 bp, Homo sapiens
actaacactattttatgcaaat

SEQ ID NO: 617744 - DNA, 14 bp, Homo sapiens
actaacagtaactg

SEQ ID NO: 617745 - DNA, 14 bp, Homo sapiens
actaaccaccattt

SEQ ID NO: 617746 - DNA, 22 bp, Homo sapiens
actaacgaccgacgcccctccg

SEQ ID NO: 617747 - DNA, 22 bp, Homo sapiens
tgcctgaatccatcaggacttg

SEQ ID NO: 617748 - DNA, 14 bp, Homo sapiens
tgcctgagaccacg

SEQ ID NO: 617749 - DNA, 19 bp, Homo sapiens
tgcctgaggaggaggacac

SEQ ID NO: 617750 - DNA, 17 bp, Homo sapiens
tgcctggagggaatcca

SEQ ID NO: 617751 - DNA, 15 bp, Homo sapiens
tgcctggctgggctt

SEQ ID NO: 617752 - DNA, 16 bp, Homo sapiens
tgcctgggcccaggcc

SEQ ID NO: 617753 - DNA, 17 bp, Homo sapiens
tgcctgggcccaggccc

SEQ ID NO: 617754 - DNA, 20 bp, Homo sapiens
tgcctgggcccaggcccagc

SEQ ID NO: 617755 - DNA, 21 bp, Homo sapiens
tgcctgggcccaggcccagcc

SEQ ID NO: 617756 - DNA, 22 bp, Homo sapiens
tgcctgtactcgcttgtgcaga

SEQ ID NO: 617757 - DNA, 21 bp, Homo sapiens
tgcctgtcaggaccattttag

SEQ ID NO: 617758 - DNA, 22 bp, Homo sapiens
tgcctgtcaggaccattttaga

SEQ ID NO: 617759 - DNA, 19 bp, Homo sapiens
tgcctgttaggtctgttga

SEQ ID NO: 617760 - DNA, 12 bp, Homo sapiens
tgccttatatta

SEQ ID NO: 617761 - DNA, 18 bp, Homo sapiens
tgccttatattattttct

SEQ ID NO: 617762 - DNA, 20 bp, Homo sapiens
tgccttatattattttctgt

SEQ ID NO: 617763 - DNA, 24 bp, Homo sapiens
tgccttcatggaactcagctgtct

SEQ ID NO: 617764 - DNA, 14 bp, Homo sapiens
tgccttgagaatga

SEQ ID NO: 617765 - DNA, 14 bp, Homo sapiens
tgccttgatgtttc

SEQ ID NO: 617766 - DNA, 15 bp, Homo sapiens
tgccttgatgtttct

SEQ ID NO: 617767 - DNA, 16 bp, Homo sapiens
tgcctttgataattct

SEQ ID NO: 617768 - DNA, 16 bp, Homo sapiens
tgcgaacacagtgaca

SEQ ID NO: 617769 - DNA, 17 bp, Homo sapiens
tgcgacgatccccatgg

SEQ ID NO: 617770 - DNA, 22 bp, Homo sapiens
tgcgacggaggcaggaccaggc

SEQ ID NO: 617771 - DNA, 20 bp, Homo sapiens
tgcgcaccccgttcccagcg

SEQ ID NO: 617772 - DNA, 23 bp, Homo sapiens
tgcgcaccccgttcccagcgcat

SEQ ID NO: 617773 - DNA, 19 bp, Homo sapiens
tgcgcagccgcgctctgcc

SEQ ID NO: 617774 - DNA, 21 bp, Homo sapiens
tgcgcagccgcgctctgcccc

SEQ ID NO: 617775 - DNA, 22 bp, Homo sapiens
tgcgcagccgcgctctgcccct

SEQ ID NO: 617776 - DNA, 13 bp, Homo sapiens
tgcgcccctgccc

SEQ ID NO: 617777 - DNA, 18 bp, Homo sapiens
tgcgcccctgcccagcac

SEQ ID NO: 617778 - DNA, 11 bp, Homo sapiens
tgcgccctccc

SEQ ID NO: 617779 - DNA, 13 bp, Homo sapiens
tgcgccctccctc

SEQ ID NO: 617780 - DNA, 15 bp, Homo sapiens
tgcgccctccctccc

SEQ ID NO: 617781 - DNA, 19 bp, Homo sapiens
tgcgccctgacatgctaac

SEQ ID NO: 617782 - DNA, 14 bp, Homo sapiens
tgcgcctcctcctg

SEQ ID NO: 617783 - DNA, 15 bp, Homo sapiens
tgcgcctcctcctgc

SEQ ID NO: 617784 - DNA, 14 bp, Homo sapiens
tgcgcctgcccgcc

SEQ ID NO: 617785 - DNA, 14 bp, Homo sapiens
tgcgctcctctgca

SEQ ID NO: 617786 - DNA, 20 bp, Homo sapiens
tgcgctcctctgcagcctga

SEQ ID NO: 617787 - DNA, 23 bp, Homo sapiens
tgcgctcctctgcagcctgagct

SEQ ID NO: 617788 - DNA, 18 bp, Homo sapiens
tgcggaccggagcggctg

SEQ ID NO: 617789 - DNA, 19 bp, Homo sapiens
tgcggaccggagcggctga

SEQ ID NO: 617790 - DNA, 20 bp, Homo sapiens
tgcggaccggagcggctgag

SEQ ID NO: 617791 - DNA, 23 bp, Homo sapiens
tgcggcccgtgcgcagccgcgct

SEQ ID NO: 617792 - DNA, 20 bp, Homo sapiens
tgcgggccaggtctggcgcc

SEQ ID NO: 617793 - DNA, 17 bp, Homo sapiens
tgcgtgaccggcccgcc

SEQ ID NO: 617794 - DNA, 22 bp, Homo sapiens
tgcgtgaccggcccgccacctt

SEQ ID NO: 617795 - DNA, 23 bp, Homo sapiens
tgcgtgaccggcccgccaccttg

SEQ ID NO: 617796 - DNA, 16 bp, Homo sapiens
tgcgtgtggccctgtg

SEQ ID NO: 617797 - DNA, 19 bp, Homo sapiens
tgctaataaatattgtcct

SEQ ID NO: 617798 - DNA, 15 bp, Homo sapiens
tgctaattaaaaagt

SEQ ID NO: 617799 - DNA, 16 bp, Homo sapiens
tgctacctcagtcagt

SEQ ID NO: 617800 - DNA, 12 bp, Homo sapiens
tgctactcagta

SEQ ID NO: 617801 - DNA, 13 bp, Homo sapiens
tgctactcagtat

SEQ ID NO: 617802 - DNA, 15 bp, Homo sapiens
tgctagttctgctgc

SEQ ID NO: 617803 - DNA, 19 bp, Homo sapiens
tgctagttctgctgccctc

SEQ ID NO: 617804 - DNA, 18 bp, Homo sapiens
tgctatgcatatttatag

SEQ ID NO: 617805 - DNA, 17 bp, Homo sapiens
tgctattcgtaagttct

SEQ ID NO: 617806 - DNA, 18 bp, Homo sapiens
tgctattcgtaagttctg

SEQ ID NO: 617807 - DNA, 21 bp, Homo sapiens
tgctattcgtaagttctgtgc

SEQ ID NO: 617808 - DNA, 19 bp, Homo sapiens
tgctattgtttataggaaa

SEQ ID NO: 617809 - DNA, 19 bp, Homo sapiens
tgctatttgtgtaactgaa

SEQ ID NO: 617810 - DNA, 17 bp, Homo sapiens
tgctcaatgtgctgttg

SEQ ID NO: 617811 - DNA, 23 bp, Homo sapiens
tgctcacgtctgtgagtctgtcc

SEQ ID NO: 617812 - DNA, 14 bp, Homo sapiens
tgctcatctacaca

SEQ ID NO: 617813 - DNA, 15 bp, Homo sapiens
tgctcatctacacat

SEQ ID NO: 617814 - DNA, 16 bp, Homo sapiens
tgctcatctacacata

SEQ ID NO: 617815 - DNA, 17 bp, Homo sapiens
tgctcatctacacatat

SEQ ID NO: 617816 - DNA, 14 bp, Homo sapiens
tgctccattcctga

SEQ ID NO: 617817 - DNA, 16 bp, Homo sapiens
tgctccattcctgagt

SEQ ID NO: 617818 - DNA, 13 bp, Homo sapiens
tgctccctcatgc

SEQ ID NO: 617819 - DNA, 15 bp, Homo sapiens
tgctcctctgcccgc

SEQ ID NO: 617820 - DNA, 21 bp, Homo sapiens
tgctcctgcccacgtgcagca

SEQ ID NO: 617821 - DNA, 15 bp, Homo sapiens
tgctctacctggccg

SEQ ID NO: 617822 - DNA, 23 bp, Homo sapiens
tgctctcccctccctttttaaac

SEQ ID NO: 617823 - DNA, 16 bp, Homo sapiens
tgctctctcattccca

SEQ ID NO: 617824 - DNA, 17 bp, Homo sapiens
tgctgaattttcacatg

SEQ ID NO: 617825 - DNA, 14 bp, Homo sapiens
tgctgaccttctgc

SEQ ID NO: 617826 - DNA, 20 bp, Homo sapiens
tgctgagggggctctttccc

SEQ ID NO: 617827 - DNA, 22 bp, Homo sapiens
tgctgagggggctctttccctc

SEQ ID NO: 617828 - DNA, 20 bp, Homo sapiens
tgctgatggtgcaatgacct

SEQ ID NO: 617829 - DNA, 14 bp, Homo sapiens
tgctgcactgccct

SEQ ID NO: 617830 - DNA, 16 bp, Homo sapiens
tgctgcactgccctcc

SEQ ID NO: 617831 - DNA, 16 bp, Homo sapiens
tgctgccaggctccca

SEQ ID NO: 617832 - DNA, 18 bp, Homo sapiens
tgctgccaggctcccact

SEQ ID NO: 617833 - DNA, 16 bp, Homo sapiens
tgctgccctcttaaga

SEQ ID NO: 617834 - DNA, 15 bp, Homo sapiens
tgctgcctccctggg

SEQ ID NO: 617835 - DNA, 20 bp, Homo sapiens
tgctgctcgggaaggcctga

SEQ ID NO: 617836 - DNA, 17 bp, Homo sapiens
tgctgcttctccctggg

SEQ ID NO: 617837 - DNA, 10 bp, Homo sapiens
tgctggctgg

SEQ ID NO: 617838 - DNA, 18 bp, Homo sapiens
tgctggggcagggcccag

SEQ ID NO: 617839 - DNA, 20 bp, Homo sapiens
tgctggggcagggcccaggg

SEQ ID NO: 617840 - DNA, 15 bp, Homo sapiens
tgctggtttgggtaa

SEQ ID NO: 617841 - DNA, 16 bp, Homo sapiens
tgctgtatacaaacag

SEQ ID NO: 617842 - DNA, 21 bp, Homo sapiens
tgctgtatttgaggaaactca

SEQ ID NO: 617843 - DNA, 14 bp, Homo sapiens
tgctgtccctgtgg

SEQ ID NO: 617844 - DNA, 18 bp, Homo sapiens
tgctgtccctgtgggctc

SEQ ID NO: 617845 - DNA, 18 bp, Homo sapiens
tgctgtctgaaaaagtgt

SEQ ID NO: 617846 - DNA, 22 bp, Homo sapiens
tgctgtctgaaaaagtgttttt

SEQ ID NO: 617847 - DNA, 17 bp, Homo sapiens
tgctgtgaaacagtgtg

SEQ ID NO: 617848 - DNA, 15 bp, Homo sapiens
tgctgtgaaatgact

SEQ ID NO: 617849 - DNA, 17 bp, Homo sapiens
tgctgtgttaagaggac

SEQ ID NO: 617850 - DNA, 17 bp, Homo sapiens
tgctgttgattctttca

SEQ ID NO: 617851 - DNA, 15 bp, Homo sapiens
tgctgtttatatata

SEQ ID NO: 617852 - DNA, 21 bp, Homo sapiens
tgcttaacataaacttgtact

SEQ ID NO: 617853 - DNA, 22 bp, Homo sapiens
tgcttaacataaacttgtactt

SEQ ID NO: 617854 - DNA, 19 bp, Homo sapiens
tgcttaaggaaaagagaaa

SEQ ID NO: 617855 - DNA, 19 bp, Homo sapiens
tgcttaatctagagctatg

SEQ ID NO: 617856 - DNA, 21 bp, Homo sapiens
tgcttagtatctcatcaacaa

SEQ ID NO: 617857 - DNA, 15 bp, Homo sapiens
tgcttagtgtccctt

SEQ ID NO: 617858 - DNA, 18 bp, Homo sapiens
tgcttcaaggatcctgag

SEQ ID NO: 617859 - DNA, 19 bp, Homo sapiens
tgcttcaaggatcctgagc

SEQ ID NO: 617860 - DNA, 20 bp, Homo sapiens
tgcttcaaggatcctgagcc

SEQ ID NO: 617861 - DNA, 11 bp, Homo sapiens
tgcttcacaca

SEQ ID NO: 617862 - DNA, 18 bp, Homo sapiens
tgcttcacacaaagtgaa

SEQ ID NO: 617863 - DNA, 19 bp, Homo sapiens
tggctgaagaaacacagca

SEQ ID NO: 617864 - DNA, 20 bp, Homo sapiens
tggctgaagaaacacagcat

SEQ ID NO: 617865 - DNA, 15 bp, Homo sapiens
tggctgcttcaagga

SEQ ID NO: 617866 - DNA, 13 bp, Homo sapiens
tggctggagcccc

SEQ ID NO: 617867 - DNA, 20 bp, Homo sapiens
tggctgggaacatgacccag

SEQ ID NO: 617868 - DNA, 16 bp, Homo sapiens
tggctgtcccctgcaa

SEQ ID NO: 617869 - DNA, 17 bp, Homo sapiens
tggctgtcccctgcaag

SEQ ID NO: 617870 - DNA, 23 bp, Homo sapiens
tggctgttatctgtctttatgat

SEQ ID NO: 617871 - DNA, 11 bp, Homo sapiens
tggcttaattc

SEQ ID NO: 617872 - DNA, 13 bp, Homo sapiens
tggcttcagaatt

SEQ ID NO: 617873 - DNA, 13 bp, Homo sapiens
tggctttgtgctt

SEQ ID NO: 617874 - DNA, 23 bp, Homo sapiens
tgggaaatgagatcccagagtta

SEQ ID NO: 617875 - DNA, 17 bp, Homo sapiens
tgggaaattcttgcact

SEQ ID NO: 617876 - DNA, 19 bp, Homo sapiens
tgggaaattcttgcactgt

SEQ ID NO: 617877 - DNA, 18 bp, Homo sapiens
tgggaacacagtgcccca

SEQ ID NO: 617878 - DNA, 21 bp, Homo sapiens
tgggaaggttagaaaggcagc

SEQ ID NO: 617879 - DNA, 22 bp, Homo sapiens
tgggacggaagtggcctgagaa

SEQ ID NO: 617880 - DNA, 18 bp, Homo sapiens
tgggactggcccacccct

SEQ ID NO: 617881 - DNA, 17 bp, Homo sapiens
tgggactgtgcctttgg

SEQ ID NO: 617882 - DNA, 17 bp, Homo sapiens
tgggagccgtcagcctg

SEQ ID NO: 617883 - DNA, 17 bp, Homo sapiens
tgggatccagagagaag

SEQ ID NO: 617884 - DNA, 18 bp, Homo sapiens
tgggatccagagagaagc

SEQ ID NO: 617885 - DNA, 18 bp, Homo sapiens
tgggattcaggaatgggc

SEQ ID NO: 617886 - DNA, 16 bp, Homo sapiens
tgggattcctcccctg

SEQ ID NO: 617887 - DNA, 12 bp, Homo sapiens
tgggcaccctgc

SEQ ID NO: 617888 - DNA, 21 bp, Homo sapiens
tgggcacgggagagcgccacc

SEQ ID NO: 617889 - DNA, 17 bp, Homo sapiens
tgggcagcacctccggg

SEQ ID NO: 617890 - DNA, 18 bp, Homo sapiens
tgggcagcacctccggga

SEQ ID NO: 617891 - DNA, 13 bp, Homo sapiens
tgggcagggccgc

SEQ ID NO: 617892 - DNA, 16 bp, Homo sapiens
tgggcagggccgcagg

SEQ ID NO: 617893 - DNA, 22 bp, Homo sapiens
tgggcagggccgcagggcgctc

SEQ ID NO: 617894 - DNA, 15 bp, Homo sapiens
tgggccaagccaggg

SEQ ID NO: 617895 - DNA, 16 bp, Homo sapiens
tgggccagcccttgct

SEQ ID NO: 617896 - DNA, 23 bp, Homo sapiens
tgggccagcccttgctctacctg

SEQ ID NO: 617897 - DNA, 13 bp, Homo sapiens
tgggccagggaaa

SEQ ID NO: 617898 - DNA, 22 bp, Homo sapiens
tgggcccaggcccagcctcttg

SEQ ID NO: 617899 - DNA, 17 bp, Homo sapiens
tgggccctctgtccaca

SEQ ID NO: 617900 - DNA, 16 bp, Homo sapiens
tgggcccttagaatgt

SEQ ID NO: 617901 - DNA, 23 bp, Homo sapiens
tgggcctccatgccccagctctg

SEQ ID NO: 617902 - DNA, 22 bp, Homo sapiens
tgggcctgctgctctctaagaa

SEQ ID NO: 617903 - DNA, 20 bp, Homo sapiens
tgggcgcaaaggtgcctcat

SEQ ID NO: 617904 - DNA, 17 bp, Homo sapiens
tgggcgggccatttcac

SEQ ID NO: 617905 - DNA, 13 bp, Homo sapiens
tgggctcacaccg

SEQ ID NO: 617906 - DNA, 11 bp, Homo sapiens
tgggctccaga

SEQ ID NO: 617907 - DNA, 18 bp, Homo sapiens
tgggctggcacccactgg

SEQ ID NO: 617908 - DNA, 20 bp, Homo sapiens
tgggctggcacccactggag

SEQ ID NO: 617909 - DNA, 21 bp, Homo sapiens
tgggctgttgtgtctggagcc

SEQ ID NO: 617910 - DNA, 18 bp, Homo sapiens
tggggaggacccctgccc

SEQ ID NO: 617911 - DNA, 23 bp, Homo sapiens
tggggagggacacagaggacggc

SEQ ID NO: 617912 - DNA, 18 bp, Homo sapiens
tggggcaagattttcctt

SEQ ID NO: 617913 - DNA, 14 bp, Homo sapiens
tggggcagggccca

SEQ ID NO: 617914 - DNA, 15 bp, Homo sapiens
tggggcagggcccag

SEQ ID NO: 617915 - DNA, 17 bp, Homo sapiens
tggggcagggcccaggg

SEQ ID NO: 617916 - DNA, 19 bp, Homo sapiens
tggggcagggcccagggag

SEQ ID NO: 617917 - DNA, 19 bp, Homo sapiens
tggggcatccaccttcctg

SEQ ID NO: 617918 - DNA, 17 bp, Homo sapiens
tggggcccatggcccca

SEQ ID NO: 617919 - DNA, 20 bp, Homo sapiens
tggggcccatggccccagct

SEQ ID NO: 617920 - DNA, 23 bp, Homo sapiens
tggggcccatggccccagctggc

SEQ ID NO: 617921 - DNA, 16 bp, Homo sapiens
tggggccggggctgcc

SEQ ID NO: 617922 - DNA, 19 bp, Homo sapiens
tggggccggggctgccgca

SEQ ID NO: 617923 - DNA, 22 bp, Homo sapiens
tggggctggtgggataggaggg

SEQ ID NO: 617924 - DNA, 20 bp, Homo sapiens
tggggcttagaatggggctt

SEQ ID NO: 617925 - DNA, 21 bp, Homo sapiens
tggggcttagaatggggcttc

SEQ ID NO: 617926 - DNA, 15 bp, Homo sapiens
tggggcttggaaggg

SEQ ID NO: 617927 - DNA, 16 bp, Homo sapiens
tgggggacgcccagcc

SEQ ID NO: 617928 - DNA, 17 bp, Homo sapiens
tgggggacgcccagccc

SEQ ID NO: 617929 - DNA, 18 bp, Homo sapiens
tgggggacgcccagcccc

SEQ ID NO: 617930 - DNA, 23 bp, Homo sapiens
tgggggactgctttcagtgcctg

SEQ ID NO: 617931 - DNA, 19 bp, Homo sapiens
tgggggagaatggctctgg

SEQ ID NO: 617932 - DNA, 16 bp, Homo sapiens
tggggggcgggccagg

SEQ ID NO: 617933 - DNA, 14 bp, Homo sapiens
tgggggggcttggg

SEQ ID NO: 617934 - DNA, 20 bp, Homo sapiens
tgggggggcttggggtagag

SEQ ID NO: 617935 - DNA, 15 bp, Homo sapiens
tggggtacaggcagt

SEQ ID NO: 617936 - DNA, 17 bp, Homo sapiens
tggggtagagaggacag

SEQ ID NO: 617937 - DNA, 15 bp, Homo sapiens
tggggtctctgagca

SEQ ID NO: 617938 - DNA, 17 bp, Homo sapiens
tggggtctctgagcagt

SEQ ID NO: 617939 - DNA, 19 bp, Homo sapiens
tgggtattttgtcagtttt

SEQ ID NO: 617940 - DNA, 14 bp, Homo sapiens
tgggtccaggagat

SEQ ID NO: 617941 - DNA, 21 bp, Homo sapiens
tgggtcccgggtgccccccat

SEQ ID NO: 617942 - DNA, 13 bp, Homo sapiens
tgggtcctgctgc

SEQ ID NO: 617943 - DNA, 14 bp, Homo sapiens
tgggtcctgctgct

SEQ ID NO: 617944 - DNA, 15 bp, Homo sapiens
tgggtgccctgttga

SEQ ID NO: 617945 - DNA, 20 bp, Homo sapiens
tgggttaacagtaaatatac

SEQ ID NO: 617946 - DNA, 15 bp, Homo sapiens
tgggttccagacaga

SEQ ID NO: 617947 - DNA, 19 bp, Homo sapiens
tgggttccagacagagtgg

SEQ ID NO: 617948 - DNA, 16 bp, Homo sapiens
tggtaacttgctgtga

SEQ ID NO: 617949 - DNA, 13 bp, Homo sapiens
tggtatgaaacaa

SEQ ID NO: 617950 - DNA, 13 bp, Homo sapiens
tggtatttactgc

SEQ ID NO: 617951 - DNA, 20 bp, Homo sapiens
tggtatttactgcaatgtct

SEQ ID NO: 617952 - DNA, 22 bp, Homo sapiens
tggtatttactgcaatgtctgt

SEQ ID NO: 617953 - DNA, 20 bp, Homo sapiens
tggtattttaacatagcagc

SEQ ID NO: 617954 - DNA, 16 bp, Homo sapiens
tggtattttttgtgaa

SEQ ID NO: 617955 - DNA, 12 bp, Homo sapiens
tggtcctgcact

SEQ ID NO: 617956 - DNA, 13 bp, Homo sapiens
tggtctctttctt

SEQ ID NO: 617957 - DNA, 17 bp, Homo sapiens
tggtctctttctttcca

SEQ ID NO: 617958 - DNA, 18 bp, Homo sapiens
tggtctctttctttccaa

SEQ ID NO: 617959 - DNA, 13 bp, Homo sapiens
tggtctgtgttct

SEQ ID NO: 617960 - DNA, 23 bp, Homo sapiens
tggtctgtgttctcaacacacag

SEQ ID NO: 617961 - DNA, 11 bp, Homo sapiens
tggtcttggag

SEQ ID NO: 617962 - DNA, 15 bp, Homo sapiens
tggtcttggagagga

SEQ ID NO: 617963 - DNA, 19 bp, Homo sapiens
tggtcttgtttaatatttg

SEQ ID NO: 617964 - DNA, 21 bp, Homo sapiens
tggtgaactgaagcagagtca

SEQ ID NO: 617965 - DNA, 14 bp, Homo sapiens
tggtgaactgataa

SEQ ID NO: 617966 - DNA, 18 bp, Homo sapiens
tggtgatgcctaaaggaa

SEQ ID NO: 617967 - DNA, 20 bp, Homo sapiens
tggtgcaatgacctttcaat

SEQ ID NO: 617968 - DNA, 12 bp, Homo sapiens
tggtgcagtgaa

SEQ ID NO: 617969 - DNA, 18 bp, Homo sapiens
tggtgcgggccaggtctg

SEQ ID NO: 617970 - DNA, 21 bp, Homo sapiens
tggtgggagcacagctttcct

SEQ ID NO: 617971 - DNA, 20 bp, Homo sapiens
tggtgggataggagggtgcc

SEQ ID NO: 617972 - DNA, 17 bp, Homo sapiens
tggtggtttcagaaagg

SEQ ID NO: 617973 - DNA, 16 bp, Homo sapiens
tggtgtcaaattttta

SEQ ID NO: 617974 - DNA, 19 bp, Homo sapiens
tggtgtcgggcatgacacg

SEQ ID NO: 617975 - DNA, 14 bp, Homo sapiens
tggtgtgaggcccc

SEQ ID NO: 617976 - DNA, 16 bp, Homo sapiens
tggtgtggctgctccc

SEQ ID NO: 617977 - DNA, 14 bp, Homo sapiens
tggttaatgaaaaa

SEQ ID NO: 617978 - DNA, 20 bp, Homo sapiens
tggttaatgaaaaatctgaa

SEQ ID NO: 617979 - DNA, 23 bp, Homo sapiens
tgtctgtaatcacactctcttct

SEQ ID NO: 617980 - DNA, 16 bp, Homo sapiens
tgtctgtcccagttaa

SEQ ID NO: 617981 - DNA, 17 bp, Homo sapiens
tgtcttagatcaggaga

SEQ ID NO: 617982 - DNA, 17 bp, Homo sapiens
tgtcttattcctaattc

SEQ ID NO: 617983 - DNA, 19 bp, Homo sapiens
tgtcttttaaaaactcctg

SEQ ID NO: 617984 - DNA, 18 bp, Homo sapiens
tgtcttttgacatccagc

SEQ ID NO: 617985 - DNA, 13 bp, Homo sapiens
tgtcttttgtcat

SEQ ID NO: 617986 - DNA, 15 bp, Homo sapiens
tgtcttttgttctct

SEQ ID NO: 617987 - DNA, 13 bp, Homo sapiens
tgtgaaacagtgt

SEQ ID NO: 617988 - DNA, 18 bp, Homo sapiens
tgtgaaacagtgtggatg

SEQ ID NO: 617989 - DNA, 22 bp, Homo sapiens
tgtgaaacagtgtggatgtaaa

SEQ ID NO: 617990 - DNA, 15 bp, Homo sapiens
tgtgaactaatgaca

SEQ ID NO: 617991 - DNA, 17 bp, Homo sapiens
tgtgaactttctcagca

SEQ ID NO: 617992 - DNA, 21 bp, Homo sapiens
tgtgaactttctcagcatata

SEQ ID NO: 617993 - DNA, 14 bp, Homo sapiens
tgtgaagtgattga

SEQ ID NO: 617994 - DNA, 23 bp, Homo sapiens
tgtgaatgttgtcctgtgtcatc

SEQ ID NO: 617995 - DNA, 17 bp, Homo sapiens
tgtgacctgctcctgcc

SEQ ID NO: 617996 - DNA, 18 bp, Homo sapiens
tgtgagcgagtgacagaa

SEQ ID NO: 617997 - DNA, 15 bp, Homo sapiens
tgtgagtctgtcctt

SEQ ID NO: 617998 - DNA, 20 bp, Homo sapiens
tgtgagtctgtcctttccca

SEQ ID NO: 617999 - DNA, 14 bp, Homo sapiens
tgtgagtgttagaa

SEQ ID NO: 618000 - DNA, 18 bp, Homo sapiens
tgtgataacagagtgatt

SEQ ID NO: 618001 - DNA, 16 bp, Homo sapiens
tgtgatcgtgtgttgc

SEQ ID NO: 618002 - DNA, 19 bp, Homo sapiens
tgtgatggttcgttctgtt

SEQ ID NO: 618003 - DNA, 16 bp, Homo sapiens
tgtgatttatgcattt

SEQ ID NO: 618004 - DNA, 14 bp, Homo sapiens
tgtgcagaaaacat

SEQ ID NO: 618005 - DNA, 16 bp, Homo sapiens
tgtgcagaaaacattg

SEQ ID NO: 618006 - DNA, 15 bp, Homo sapiens
tgtgcagactgtggc

SEQ ID NO: 618007 - DNA, 16 bp, Homo sapiens
tgtgcagagtatacaa

SEQ ID NO: 618008 - DNA, 20 bp, Homo sapiens
tgtgcagagtatacaagtgt

SEQ ID NO: 618009 - DNA, 14 bp, Homo sapiens
tgtgcagtttggta

SEQ ID NO: 618010 - DNA, 15 bp, Homo sapiens
tgtgcagtttggtat

SEQ ID NO: 618011 - DNA, 20 bp, Homo sapiens
tgtgcagtttggtatgaaac

SEQ ID NO: 618012 - DNA, 16 bp, Homo sapiens
tgtgcatctggcctgg

SEQ ID NO: 618013 - DNA, 21 bp, Homo sapiens
tgtgccaaaatgtcaattttt

SEQ ID NO: 618014 - DNA, 20 bp, Homo sapiens
tgtgccaaagatagcagaag

SEQ ID NO: 618015 - DNA, 21 bp, Homo sapiens
tgtgcccacccgtgttctcct

SEQ ID NO: 618016 - DNA, 18 bp, Homo sapiens
tgtgccccttccccatgc

SEQ ID NO: 618017 - DNA, 21 bp, Homo sapiens
tgtgccccttccccatgctca

SEQ ID NO: 618018 - DNA, 21 bp, Homo sapiens
tgtgcctctcagtatcttaaa

SEQ ID NO: 618019 - DNA, 14 bp, Homo sapiens
tgtgcgaacacagt

SEQ ID NO: 618020 - DNA, 18 bp, Homo sapiens
tgtgcttatgtcatttct

SEQ ID NO: 618021 - DNA, 13 bp, Homo sapiens
tgtggagtggagg

SEQ ID NO: 618022 - DNA, 14 bp, Homo sapiens
tgtggagtggaggg

SEQ ID NO: 618023 - DNA, 19 bp, Homo sapiens
tgtggataaattttggaag

SEQ ID NO: 618024 - DNA, 13 bp, Homo sapiens
tgtggccccagcc

SEQ ID NO: 618025 - DNA, 20 bp, Homo sapiens
tgtggctgctcccagcctct

SEQ ID NO: 618026 - DNA, 16 bp, Homo sapiens
tgtggcttaaacattt

SEQ ID NO: 618027 - DNA, 15 bp, Homo sapiens
tgtgggactggccca

SEQ ID NO: 618028 - DNA, 14 bp, Homo sapiens
tgtgggagtccact

SEQ ID NO: 618029 - DNA, 20 bp, Homo sapiens
tgtgggagtccactttcctc

SEQ ID NO: 618030 - DNA, 14 bp, Homo sapiens
tgtggggtaagttg

SEQ ID NO: 618031 - DNA, 19 bp, Homo sapiens
tgtgggtttactctgtgct

SEQ ID NO: 618032 - DNA, 22 bp, Homo sapiens
tgtggtgaggtcctgtcctggc

SEQ ID NO: 618033 - DNA, 18 bp, Homo sapiens
tgtgtagctctgtccact

SEQ ID NO: 618034 - DNA, 21 bp, Homo sapiens
tgtgtagtagctcgtgtgctt

SEQ ID NO: 618035 - DNA, 21 bp, Homo sapiens
tgtgtatatgtttatacacac

SEQ ID NO: 618036 - DNA, 22 bp, Homo sapiens
tgtgtcacactgagctgggcac

SEQ ID NO: 618037 - DNA, 16 bp, Homo sapiens
tgtgtcatctgtcagc

SEQ ID NO: 618038 - DNA, 22 bp, Homo sapiens
tgtgtccgtgaaagttgtgatc

SEQ ID NO: 618039 - DNA, 23 bp, Homo sapiens
tgtgtccgtgaaagttgtgatct

SEQ ID NO: 618040 - DNA, 16 bp, Homo sapiens
tgtgtctccagctgat

SEQ ID NO: 618041 - DNA, 18 bp, Homo sapiens
tgtgtctggagcctgcag

SEQ ID NO: 618042 - DNA, 19 bp, Homo sapiens
tgtgtcttgtattatcata

SEQ ID NO: 618043 - DNA, 17 bp, Homo sapiens
tgtgtcttttgttctct

SEQ ID NO: 618044 - DNA, 18 bp, Homo sapiens
tgtgtcttttgttctctc

SEQ ID NO: 618045 - DNA, 9 bp, Homo sapiens
tgtgtggca

SEQ ID NO: 618046 - DNA, 20 bp, Homo sapiens
tgtgtggcctaatccacctg

SEQ ID NO: 618047 - DNA, 15 bp, Homo sapiens
tgtgttcagtgcctt

SEQ ID NO: 618048 - DNA, 20 bp, Homo sapiens
tgtgttctcaacacacagta

SEQ ID NO: 618049 - DNA, 15 bp, Homo sapiens
tgtgttcttctaggc

SEQ ID NO: 618050 - DNA, 20 bp, Homo sapiens
tgtgttgctctccattcttt

SEQ ID NO: 618051 - DNA, 18 bp, Homo sapiens
tgtgtttgaattgatttt

SEQ ID NO: 618052 - DNA, 16 bp, Homo sapiens
tgttaaaacatcaaaa

SEQ ID NO: 618053 - DNA, 18 bp, Homo sapiens
tgttaaaacatcaaaatg

SEQ ID NO: 618054 - DNA, 16 bp, Homo sapiens
tgttaaaataattata

SEQ ID NO: 618055 - DNA, 17 bp, Homo sapiens
tgttaaaatatagtgtt

SEQ ID NO: 618056 - DNA, 14 bp, Homo sapiens
tgttaaatctacaa

SEQ ID NO: 618057 - DNA, 14 bp, Homo sapiens
tgttaacctacaaa

SEQ ID NO: 618058 - DNA, 15 bp, Homo sapiens
tgttaacctacaaaa

SEQ ID NO: 618059 - DNA, 17 bp, Homo sapiens
tgttaatgattcttgtg

SEQ ID NO: 618060 - DNA, 17 bp, Homo sapiens
tgttagaaaaaactgga

SEQ ID NO: 618061 - DNA, 20 bp, Homo sapiens
tgttagatacacaaaatatt

SEQ ID NO: 618062 - DNA, 14 bp, Homo sapiens
tgttataaaatctg

SEQ ID NO: 618063 - DNA, 20 bp, Homo sapiens
tgttatcagtacaattcttt

SEQ ID NO: 618064 - DNA, 20 bp, Homo sapiens
tgttatctgtctttatgatt

SEQ ID NO: 618065 - DNA, 14 bp, Homo sapiens
tgttatgtaaacat

SEQ ID NO: 618066 - DNA, 20 bp, Homo sapiens
tgttattactgttttgggcc

SEQ ID NO: 618067 - DNA, 21 bp, Homo sapiens
tgttcaaagaacccccctccc

SEQ ID NO: 618068 - DNA, 22 bp, Homo sapiens
tgttcaaagaacccccctcccc

SEQ ID NO: 618069 - DNA, 23 bp, Homo sapiens
tgttcaaagaacccccctcccca

SEQ ID NO: 618070 - DNA, 14 bp, Homo sapiens
tgttcaatttcaga

SEQ ID NO: 618071 - DNA, 18 bp, Homo sapiens
tgttcaccttctgtgcat

SEQ ID NO: 618072 - DNA, 15 bp, Homo sapiens
tgttcagaaaagcac

SEQ ID NO: 618073 - DNA, 18 bp, Homo sapiens
tgttcagtgccttggagc

SEQ ID NO: 618074 - DNA, 22 bp, Homo sapiens
tgttcatataggggcaaaaatt

SEQ ID NO: 618075 - DNA, 15 bp, Homo sapiens
tgttccgttcatctg

SEQ ID NO: 618076 - DNA, 21 bp, Homo sapiens
tgttccgttcatctgaggagt

SEQ ID NO: 618077 - DNA, 23 bp, Homo sapiens
tgttctcaacacacagtatagat

SEQ ID NO: 618078 - DNA, 12 bp, Homo sapiens
tgttctgtgcaa

SEQ ID NO: 618079 - DNA, 13 bp, Homo sapiens
tgttctgtttaat

SEQ ID NO: 618080 - DNA, 12 bp, Homo sapiens
tgttcttgtaaa

SEQ ID NO: 618081 - DNA, 22 bp, Homo sapiens
tgttgaagtgcatgttaaaata

SEQ ID NO: 618082 - DNA, 11 bp, Homo sapiens
tgttgatgaaa

SEQ ID NO: 618083 - DNA, 14 bp, Homo sapiens
tgttgattaaaaca

SEQ ID NO: 618084 - DNA, 16 bp, Homo sapiens
tgttgattctttcaat

SEQ ID NO: 618085 - DNA, 21 bp, Homo sapiens
tgttgccatgaggcctttccc

SEQ ID NO: 618086 - DNA, 15 bp, Homo sapiens
tgttgctctccattc

SEQ ID NO: 618087 - DNA, 17 bp, Homo sapiens
tgttggccatcatttca

SEQ ID NO: 618088 - DNA, 16 bp, Homo sapiens
tgttgggaattgcatg

SEQ ID NO: 618089 - DNA, 17 bp, Homo sapiens
tgttgtaatatcagtta

SEQ ID NO: 618090 - DNA, 15 bp, Homo sapiens
tgttgtaatattttg

SEQ ID NO: 618091 - DNA, 17 bp, Homo sapiens
tgttgtaatattttgct

SEQ ID NO: 618092 - DNA, 20 bp, Homo sapiens
tgttgtaatattttgctgct

SEQ ID NO: 618093 - DNA, 22 bp, Homo sapiens
tgttgtaatattttgctgctga

SEQ ID NO: 618094 - DNA, 12 bp, Homo sapiens
tgttgtccctgc

SEQ ID NO: 618095 - DNA, 21 bp, Homo sapiens
ttaggtaatggatatgaaaga

SEQ ID NO: 618096 - DNA, 15 bp, Homo sapiens
ttaggtctgttgaag

SEQ ID NO: 618097 - DNA, 13 bp, Homo sapiens
ttagtcctcacct

SEQ ID NO: 618098 - DNA, 15 bp, Homo sapiens
ttagtgcttggctca

SEQ ID NO: 618099 - DNA, 22 bp, Homo sapiens
ttagttgaccaactatattgcg

SEQ ID NO: 618100 - DNA, 15 bp, Homo sapiens
ttataaatgttttaa

SEQ ID NO: 618101 - DNA, 16 bp, Homo sapiens
ttataaatgttttaaa

SEQ ID NO: 618102 - DNA, 17 bp, Homo sapiens
ttataacattgtaaatg

SEQ ID NO: 618103 - DNA, 19 bp, Homo sapiens
ttataacattgtatgttaa

SEQ ID NO: 618104 - DNA, 14 bp, Homo sapiens
ttataatttcaatt

SEQ ID NO: 618105 - DNA, 16 bp, Homo sapiens
ttataatttcaatttt

SEQ ID NO: 618106 - DNA, 11 bp, Homo sapiens
ttatacacaca

SEQ ID NO: 618107 - DNA, 12 bp, Homo sapiens
ttatacacacag

SEQ ID NO: 618108 - DNA, 13 bp, Homo sapiens
ttatacacataat

SEQ ID NO: 618109 - DNA, 12 bp, Homo sapiens
ttatacttcaaa

SEQ ID NO: 618110 - DNA, 22 bp, Homo sapiens
ttatagagttcatagaaataca

SEQ ID NO: 618111 - DNA, 14 bp, Homo sapiens
ttatagtctgtact

SEQ ID NO: 618112 - DNA, 16 bp, Homo sapiens
ttatagtctgtacttc

SEQ ID NO: 618113 - DNA, 21 bp, Homo sapiens
ttatatgattaaattatcatt

SEQ ID NO: 618114 - DNA, 20 bp, Homo sapiens
ttatattcccaaatctcaaa

SEQ ID NO: 618115 - DNA, 16 bp, Homo sapiens
ttatattctgcagaaa

SEQ ID NO: 618116 - DNA, 15 bp, Homo sapiens
ttatcaaaaaacaga

SEQ ID NO: 618117 - DNA, 16 bp, Homo sapiens
ttatcaaaaaacagaa

SEQ ID NO: 618118 - DNA, 18 bp, Homo sapiens
ttatcagaaagatcaaat

SEQ ID NO: 618119 - DNA, 21 bp, Homo sapiens
ttatcagaactcctttctaag

SEQ ID NO: 618120 - DNA, 11 bp, Homo sapiens
ttatcatgtgt

SEQ ID NO: 618121 - DNA, 13 bp, Homo sapiens
ttatctcttcttc

SEQ ID NO: 618122 - DNA, 17 bp, Homo sapiens
ttatctgtctgagccct

SEQ ID NO: 618123 - DNA, 20 bp, Homo sapiens
ttatctgtctgagccctgcc

SEQ ID NO: 618124 - DNA, 20 bp, Homo sapiens
ttatctgtctttatgatttc

SEQ ID NO: 618125 - DNA, 21 bp, Homo sapiens
ttatcttaaaagggtggtagt

SEQ ID NO: 618126 - DNA, 17 bp, Homo sapiens
ttatcttaaacccacat

SEQ ID NO: 618127 - DNA, 22 bp, Homo sapiens
ttatcttaaacccacataaaca

SEQ ID NO: 618128 - DNA, 15 bp, Homo sapiens
ttatgaatcgcagac

SEQ ID NO: 618129 - DNA, 14 bp, Homo sapiens
ttatgaggaaactt

SEQ ID NO: 618130 - DNA, 11 bp, Homo sapiens
ttatgcatgag

SEQ ID NO: 618131 - DNA, 20 bp, Homo sapiens
ttatgcatgagaactaaata

SEQ ID NO: 618132 - DNA, 15 bp, Homo sapiens
ttatggctttgtgct

SEQ ID NO: 618133 - DNA, 23 bp, Homo sapiens
ttatgtacaaaatgaattgcctt

SEQ ID NO: 618134 - DNA, 12 bp, Homo sapiens
ttatgtcatttt

SEQ ID NO: 618135 - DNA, 17 bp, Homo sapiens
ttatgtcccttcacata

SEQ ID NO: 618136 - DNA, 14 bp, Homo sapiens
ttatgttgtaatat

SEQ ID NO: 618137 - DNA, 14 bp, Homo sapiens
ttatgtttaaaatg

SEQ ID NO: 618138 - DNA, 18 bp, Homo sapiens
ttatgtttaaaatggcat

SEQ ID NO: 618139 - DNA, 21 bp, Homo sapiens
ttattaaaatattttcttaat

SEQ ID NO: 618140 - DNA, 20 bp, Homo sapiens
ttattaaatttattaaatgt

SEQ ID NO: 618141 - DNA, 21 bp, Homo sapiens
ttattacaacaagcaaactga

SEQ ID NO: 618142 - DNA, 15 bp, Homo sapiens
ttattagcaccagct

SEQ ID NO: 618143 - DNA, 18 bp, Homo sapiens
ttattagcaccagcttgc

SEQ ID NO: 618144 - DNA, 18 bp, Homo sapiens
ttattaggttaagtctca

SEQ ID NO: 618145 - DNA, 15 bp, Homo sapiens
ttattatagtctgta

SEQ ID NO: 618146 - DNA, 14 bp, Homo sapiens
ttattatagttatt

SEQ ID NO: 618147 - DNA, 14 bp, Homo sapiens
ttattcaaatccat

SEQ ID NO: 618148 - DNA, 13 bp, Homo sapiens
ttattcaataact

SEQ ID NO: 618149 - DNA, 23 bp, Homo sapiens
ttattcataagccaatttttctg

SEQ ID NO: 618150 - DNA, 16 bp, Homo sapiens
ttattcattagctgtg

SEQ ID NO: 618151 - DNA, 17 bp, Homo sapiens
ttattcctaattcctgt

SEQ ID NO: 618152 - DNA, 16 bp, Homo sapiens
ttattgtaacagacat

SEQ ID NO: 618153 - DNA, 17 bp, Homo sapiens
ttattgtaacagacatt

SEQ ID NO: 618154 - DNA, 18 bp, Homo sapiens
ttattgtaacagacattg

SEQ ID NO: 618155 - DNA, 15 bp, Homo sapiens
ttatttaaatgtcta

SEQ ID NO: 618156 - DNA, 15 bp, Homo sapiens
ttatttataacattg

SEQ ID NO: 618157 - DNA, 13 bp, Homo sapiens
ttatttgatctgg

SEQ ID NO: 618158 - DNA, 13 bp, Homo sapiens
ttattttcatata

SEQ ID NO: 618159 - DNA, 14 bp, Homo sapiens
ttattttctgtaat

SEQ ID NO: 618160 - DNA, 17 bp, Homo sapiens
ttcaaaaagccaaaata

SEQ ID NO: 618161 - DNA, 18 bp, Homo sapiens
ttcaaagaaaacagacca

SEQ ID NO: 618162 - DNA, 21 bp, Homo sapiens
ttcaaagaacccccctcccca

SEQ ID NO: 618163 - DNA, 19 bp, Homo sapiens
ttcaaataaccctgaatca

SEQ ID NO: 618164 - DNA, 17 bp, Homo sapiens
ttcaaatacattctaaa

SEQ ID NO: 618165 - DNA, 17 bp, Homo sapiens
ttcaaccctgccctgca

SEQ ID NO: 618166 - DNA, 21 bp, Homo sapiens
ttcaagcaccctgttccctct

SEQ ID NO: 618167 - DNA, 18 bp, Homo sapiens
ttcaagcattgctaaagt

SEQ ID NO: 618168 - DNA, 22 bp, Homo sapiens
ttcaaggaatagagttttcctc

SEQ ID NO: 618169 - DNA, 19 bp, Homo sapiens
ttcaaggatcctgagccag

SEQ ID NO: 618170 - DNA, 21 bp, Homo sapiens
ttcaaggatcctgagccagat

SEQ ID NO: 618171 - DNA, 24 bp, Homo sapiens
ttcaagggcctagatttggagact

SEQ ID NO: 618172 - DNA, 15 bp, Homo sapiens
ttcaataggaaaaac

SEQ ID NO: 618173 - DNA, 18 bp, Homo sapiens
ttcaataggaaaaactga

SEQ ID NO: 618174 - DNA, 21 bp, Homo sapiens
ttcaataggaaaaactgattt

SEQ ID NO: 618175 - DNA, 19 bp, Homo sapiens
ttcaatcattttgggaaat

SEQ ID NO: 618176 - DNA, 16 bp, Homo sapiens
ttcaatgctacaaaat

SEQ ID NO: 618177 - DNA, 18 bp, Homo sapiens
ttcacacaaagtgaaatt

SEQ ID NO: 618178 - DNA, 19 bp, Homo sapiens
ttcacacaaagtgaaatta

SEQ ID NO: 618179 - DNA, 15 bp, Homo sapiens
ttcacagtgggcggc

SEQ ID NO: 618180 - DNA, 13 bp, Homo sapiens
ttcacatctgtat

SEQ ID NO: 618181 - DNA, 22 bp, Homo sapiens
ttcaccagtttccaagtttatt

SEQ ID NO: 618182 - DNA, 15 bp, Homo sapiens
ttcaccttctgtgca

SEQ ID NO: 618183 - DNA, 14 bp, Homo sapiens
ttcacgcaacttga

SEQ ID NO: 618184 - DNA, 16 bp, Homo sapiens
ttcacttaaaatcaaa

SEQ ID NO: 618185 - DNA, 13 bp, Homo sapiens
ttcacttcttaag

SEQ ID NO: 618186 - DNA, 15 bp, Homo sapiens
ttcacttcttaagga

SEQ ID NO: 618187 - DNA, 22 bp, Homo sapiens
ttcacttcttaaggacagtgtt

SEQ ID NO: 618188 - DNA, 16 bp, Homo sapiens
ttcacttttattgtat

SEQ ID NO: 618189 - DNA, 14 bp, Homo sapiens
ttcagaaacttttt

SEQ ID NO: 618190 - DNA, 14 bp, Homo sapiens
ttcagatccttcca

SEQ ID NO: 618191 - DNA, 20 bp, Homo sapiens
ttcagatccttccaaactct

SEQ ID NO: 618192 - DNA, 15 bp, Homo sapiens
ttcagatctcataga

SEQ ID NO: 618193 - DNA, 20 bp, Homo sapiens
ttcagatctcatagatgacc

SEQ ID NO: 618194 - DNA, 15 bp, Homo sapiens
ttcagatctgaagta

SEQ ID NO: 618195 - DNA, 18 bp, Homo sapiens
ttcaggaaatttttgcat

SEQ ID NO: 618196 - DNA, 22 bp, Homo sapiens
ttcaggtgtatagggaattttc

SEQ ID NO: 618197 - DNA, 12 bp, Homo sapiens
ttcagtgcctgc

SEQ ID NO: 618198 - DNA, 15 bp, Homo sapiens
ttcagtgcctgctgt

SEQ ID NO: 618199 - DNA, 16 bp, Homo sapiens
ttcagtgcctgctgtt

SEQ ID NO: 618200 - DNA, 13 bp, Homo sapiens
ttcagtgccttat

SEQ ID NO: 618201 - DNA, 18 bp, Homo sapiens
ttcagtgccttggagcag

SEQ ID NO: 618202 - DNA, 23 bp, Homo sapiens
ttcataagccaatttttctgcac

SEQ ID NO: 618203 - DNA, 14 bp, Homo sapiens
ttcatacaaataat

SEQ ID NO: 618204 - DNA, 15 bp, Homo sapiens
ttcatactcaaagag

SEQ ID NO: 618205 - DNA, 14 bp, Homo sapiens
ttcatactctagat

SEQ ID NO: 618206 - DNA, 15 bp, Homo sapiens
ttcatagaaatacat

SEQ ID NO: 618207 - DNA, 22 bp, Homo sapiens
ttcatagacgcaaccttaactt

SEQ ID NO: 618208 - DNA, 21 bp, Homo sapiens
ttcatataataaattaatttt

SEQ ID NO: 618209 - DNA, 17 bp, Homo sapiens
ttcatccagccactgcc

SEQ ID NO: 618210 - DNA, 15 bp, Homo sapiens
ttcatcccagggtat

SEQ ID NO: 618211 - DNA, 13 bp, Homo sapiens
ttcatgcttttct

SEQ ID NO: 618212 - DNA, 17 bp, Homo sapiens
aaacttggacatttatg

SEQ ID NO: 618213 - DNA, 22 bp, Homo sapiens
aaacttggacatttatgtacaa

SEQ ID NO: 618214 - DNA, 16 bp, Homo sapiens
aaactttggaagtttt

SEQ ID NO: 618215 - DNA, 22 bp, Homo sapiens
aaactttggaagttttacttga

SEQ ID NO: 618216 - DNA, 21 bp, Homo sapiens
aaacttttataaatgttttaa

SEQ ID NO: 618217 - DNA, 13 bp, Homo sapiens
aaagaaaacagac

SEQ ID NO: 618218 - DNA, 13 bp, Homo sapiens
aaagaaagtcata

SEQ ID NO: 618219 - DNA, 13 bp, Homo sapiens
aaagaactgcccc

SEQ ID NO: 618220 - DNA, 13 bp, Homo sapiens
aaagacatccaca

SEQ ID NO: 618221 - DNA, 16 bp, Homo sapiens
aaagacattcttagtt

SEQ ID NO: 618222 - DNA, 15 bp, Homo sapiens
aaagaccatgcattc

SEQ ID NO: 618223 - DNA, 16 bp, Homo sapiens
aaaaatcagaaagaca

SEQ ID NO: 618224 - DNA, 17 bp, Homo sapiens
aaaaatgaaatttaagc

SEQ ID NO: 618225 - DNA, 13 bp, Homo sapiens
aaaaatgtatgtt

SEQ ID NO: 618226 - DNA, 16 bp, Homo sapiens
aaaaattatctttaaa

SEQ ID NO: 618227 - DNA, 13 bp, Homo sapiens
aaaaatttgacat

SEQ ID NO: 618228 - DNA, 14 bp, Homo sapiens
aaaacaaaatcctt

SEQ ID NO: 618229 - DNA, 22 bp, Homo sapiens
acactgcttaaggaaaagagaa

SEQ ID NO: 618230 - DNA, 16 bp, Homo sapiens
acactgtcaagattaa

SEQ ID NO: 618231 - DNA, 16 bp, Homo sapiens
acactgtctgctgccc

SEQ ID NO: 618232 - DNA, 22 bp, Homo sapiens
acactgtgaactaatgacaagt

SEQ ID NO: 618233 - DNA, 16 bp, Homo sapiens
acacttgggctggcac

SEQ ID NO: 618234 - DNA, 14 bp, Homo sapiens
acagaaatacatca

SEQ ID NO: 618235 - DNA, 14 bp, Homo sapiens
acagaacaacaaca

SEQ ID NO: 618236 - DNA, 14 bp, Homo sapiens
acagaaccagcact

SEQ ID NO: 618237 - DNA, 19 bp, Homo sapiens
acagaaccagcactcccag

SEQ ID NO: 618238 - DNA, 12 bp, Homo sapiens
acagaagaaaaa

SEQ ID NO: 618239 - DNA, 22 bp, Homo sapiens
acagaccagcatagttctgcaa

SEQ ID NO: 618240 - DNA, 13 bp, Homo sapiens
acagaccggggtg

SEQ ID NO: 618241 - DNA, 18 bp, Homo sapiens
acagacctccagattatt

SEQ ID NO: 618242 - DNA, 21 bp, Homo sapiens
acagacctccagattattttc

SEQ ID NO: 618243 - DNA, 18 bp, Homo sapiens
acagacggacgggacagc

SEQ ID NO: 618244 - DNA, 19 bp, Homo sapiens
acagagaactaacactatt

SEQ ID NO: 618245 - DNA, 14 bp, Homo sapiens
acagaggccggggt

SEQ ID NO: 618246 - DNA, 20 bp, Homo sapiens
acagaggccggggtccaggc

SEQ ID NO: 618247 - DNA, 21 bp, Homo sapiens
acggacgggacagcggcccgg

SEQ ID NO: 618248 - DNA, 10 bp, Homo sapiens
acggaggctc

SEQ ID NO: 618249 - DNA, 15 bp, Homo sapiens
acggcagccccatcc

SEQ ID NO: 618250 - DNA, 18 bp, Homo sapiens
acggcagcttgagcctgt

SEQ ID NO: 618251 - DNA, 21 bp, Homo sapiens
acggcagcttgagcctgtcac

SEQ ID NO: 618252 - DNA, 21 bp, Homo sapiens
acgggacagcggcccggccca

SEQ ID NO: 618253 - DNA, 22 bp, Homo sapiens
acgggcccgctcaacctctcag

SEQ ID NO: 618254 - DNA, 23 bp, Homo sapiens
acgggcccgctcaacctctcaga

SEQ ID NO: 618255 - DNA, 12 bp, Homo sapiens
acggggcagagc

SEQ ID NO: 618256 - DNA, 13 bp, Homo sapiens
acggggggctgcg

SEQ ID NO: 618257 - DNA, 13 bp, Homo sapiens
acgtcgctgtccg

SEQ ID NO: 618258 - DNA, 19 bp, Homo sapiens
acgtctaacttcatgctgt

SEQ ID NO: 618259 - DNA, 12 bp, Homo sapiens
acgtctgtgagt

SEQ ID NO: 618260 - DNA, 20 bp, Homo sapiens
acgtctgtgagtctgtcctt

SEQ ID NO: 618261 - DNA, 15 bp, Homo sapiens
acgtgcaacagactg

SEQ ID NO: 618262 - DNA, 16 bp, Homo sapiens
acgtggcgctgtcggt

SEQ ID NO: 618263 - DNA, 15 bp, Homo sapiens
acgtggtcaaggccc

SEQ ID NO: 618264 - DNA, 12 bp, Homo sapiens
acgtgtgaggat

SEQ ID NO: 618265 - DNA, 14 bp, Homo sapiens
acgttaattaaaca

SEQ ID NO: 618266 - DNA, 17 bp, Homo sapiens
acgttcatgttcatctc

SEQ ID NO: 618267 - DNA, 16 bp, Homo sapiens
acgttttccattatga

SEQ ID NO: 618268 - DNA, 14 bp, Homo sapiens
acgttttctgcaat

SEQ ID NO: 618269 - DNA, 21 bp, Homo sapiens
actaaaagtgatgtgatttat

SEQ ID NO: 618270 - DNA, 21 bp, Homo sapiens
actaaaggaaacaaagcaata

SEQ ID NO: 618271 - DNA, 16 bp, Homo sapiens
actaaatagcatgtat

SEQ ID NO: 618272 - DNA, 19 bp, Homo sapiens
actaaatagcatgtattgt

SEQ ID NO: 618273 - DNA, 12 bp, Homo sapiens
actaacactggc

SEQ ID NO: 618274 - DNA, 12 bp, Homo sapiens
actaacttattt

SEQ ID NO: 618275 - DNA, 17 bp, Homo sapiens
actaacttattttgatt

SEQ ID NO: 618276 - DNA, 17 bp, Homo sapiens
actaagctttctccttt

SEQ ID NO: 618277 - DNA, 22 bp, Homo sapiens
actaaggtacggtgagactctg

SEQ ID NO: 618278 - DNA, 21 bp, Homo sapiens
actacaaacatggggagccat

SEQ ID NO: 618279 - DNA, 13 bp, Homo sapiens
actacagaagtgg

SEQ ID NO: 618280 - DNA, 17 bp, Homo sapiens
actacaggttttatgag

SEQ ID NO: 618281 - DNA, 16 bp, Homo sapiens
actacatctgatatca

SEQ ID NO: 618282 - DNA, 18 bp, Homo sapiens
actacatctgatatcagg

SEQ ID NO: 618283 - DNA, 21 bp, Homo sapiens
actacatgggccagcccttgc

SEQ ID NO: 618284 - DNA, 21 bp, Homo sapiens
actaccccaggatgcatgcag

SEQ ID NO: 618285 - DNA, 19 bp, Homo sapiens
actacctttggcttaattc

SEQ ID NO: 618286 - DNA, 16 bp, Homo sapiens
actagaatgagaaatc

SEQ ID NO: 618287 - DNA, 23 bp, Homo sapiens
actagccctctttctctctgtgt

SEQ ID NO: 618288 - DNA, 23 bp, Homo sapiens
actaggaggttccggtgtctgga

SEQ ID NO: 618289 - DNA, 18 bp, Homo sapiens
actaggcatgttaggaat

SEQ ID NO: 618290 - DNA, 19 bp, Homo sapiens
actatattgcgagaaacag

SEQ ID NO: 618291 - DNA, 15 bp, Homo sapiens
actatctttcaggaa

SEQ ID NO: 618292 - DNA, 20 bp, Homo sapiens
actatggtatatattttgaa

SEQ ID NO: 618293 - DNA, 13 bp, Homo sapiens
actattttatgca

SEQ ID NO: 618294 - DNA, 15 bp, Homo sapiens
actattttatgcaaa

SEQ ID NO: 618295 - DNA, 21 bp, Homo sapiens
actcaaagaggccagtacttt

SEQ ID NO: 618296 - DNA, 13 bp, Homo sapiens
actcaaggcctcc

SEQ ID NO: 618297 - DNA, 17 bp, Homo sapiens
actcaggagcacagcca

SEQ ID NO: 618298 - DNA, 17 bp, Homo sapiens
actcaggcagcctgtgg

SEQ ID NO: 618299 - DNA, 22 bp, Homo sapiens
actcaggcagcctgtgggtcct

SEQ ID NO: 618300 - DNA, 14 bp, Homo sapiens
actcaggctttcta

SEQ ID NO: 618301 - DNA, 16 bp, Homo sapiens
actcaggctttctatt

SEQ ID NO: 618302 - DNA, 20 bp, Homo sapiens
actcagtaaggcagtgcagt

SEQ ID NO: 618303 - DNA, 23 bp, Homo sapiens
actcagtatgctttccctgagga

SEQ ID NO: 618304 - DNA, 21 bp, Homo sapiens
actcagtgcagggacagcctg

SEQ ID NO: 618305 - DNA, 22 bp, Homo sapiens
actcatacagtctctatttgat

SEQ ID NO: 618306 - DNA, 17 bp, Homo sapiens
actcatcgggagtgaat

SEQ ID NO: 618307 - DNA, 14 bp, Homo sapiens
actcatgttaattg

SEQ ID NO: 618308 - DNA, 22 bp, Homo sapiens
actcatttgggtattttgtcag

SEQ ID NO: 618309 - DNA, 14 bp, Homo sapiens
actccagaagcagc

SEQ ID NO: 618310 - DNA, 16 bp, Homo sapiens
actccagaagcagcag

SEQ ID NO: 618311 - DNA, 21 bp, Homo sapiens
actccagggttaaagaaaggc

SEQ ID NO: 618312 - DNA, 17 bp, Homo sapiens
actcccagggcccgagc

SEQ ID NO: 618313 - DNA, 14 bp, Homo sapiens
actccgtttccaaa

SEQ ID NO: 618314 - DNA, 20 bp, Homo sapiens
actcctcccaactctggcct

SEQ ID NO: 618315 - DNA, 19 bp, Homo sapiens
actcctccccctcctccat

SEQ ID NO: 618316 - DNA, 23 bp, Homo sapiens
actcctgggtgggtggggtacag

SEQ ID NO: 618317 - DNA, 20 bp, Homo sapiens
actccttaaaaatgtatgtt

SEQ ID NO: 618318 - DNA, 21 bp, Homo sapiens
actcgagagggctgagcccct

SEQ ID NO: 618319 - DNA, 22 bp, Homo sapiens
actcgagagggctgagcccctc

SEQ ID NO: 618320 - DNA, 16 bp, Homo sapiens
actcgcgacaatgcaa

SEQ ID NO: 618321 - DNA, 22 bp, Homo sapiens
actctaagaaatggctttccac

SEQ ID NO: 618322 - DNA, 19 bp, Homo sapiens
actctagattttgttttgc

SEQ ID NO: 618323 - DNA, 21 bp, Homo sapiens
actctagattttgttttgctt

SEQ ID NO: 618324 - DNA, 23 bp, Homo sapiens
actctagattttgttttgctttt

SEQ ID NO: 618325 - DNA, 15 bp, Homo sapiens
actctccatatgtga

SEQ ID NO: 618326 - DNA, 22 bp, Homo sapiens
actctctagtgcaggaaaaggc

SEQ ID NO: 618327 - DNA, 22 bp, Homo sapiens
actctgaagtcccttcctgtcc

SEQ ID NO: 618328 - DNA, 16 bp, Homo sapiens
actctgcgacgatccc

SEQ ID NO: 618329 - DNA, 22 bp, Homo sapiens
actctgcgacgatccccatgga

SEQ ID NO: 618330 - DNA, 23 bp, Homo sapiens
actctggccttggttcctccagc

SEQ ID NO: 618331 - DNA, 17 bp, Homo sapiens
actcttcatgtaatcac

SEQ ID NO: 618332 - DNA, 21 bp, Homo sapiens
actcttgtctcctcctccagg

SEQ ID NO: 618333 - DNA, 12 bp, Homo sapiens
actctttcccca

SEQ ID NO: 618334 - DNA, 19 bp, Homo sapiens
actgaaattagtgttttca

SEQ ID NO: 618335 - DNA, 21 bp, Homo sapiens
actgaaattagtgttttcatt

SEQ ID NO: 618336 - DNA, 16 bp, Homo sapiens
actgaagaaaatcctt

SEQ ID NO: 618337 - DNA, 16 bp, Homo sapiens
actgaatctgagaaag

SEQ ID NO: 618338 - DNA, 20 bp, Homo sapiens
actgaattgctatcatttgg

SEQ ID NO: 618339 - DNA, 21 bp, Homo sapiens
actgaattgttatgtaaacat

SEQ ID NO: 618340 - DNA, 14 bp, Homo sapiens
actgacatggtgct

SEQ ID NO: 618341 - DNA, 20 bp, Homo sapiens
actgaccttcggcagtggct

SEQ ID NO: 618342 - DNA, 23 bp, Homo sapiens
actgaccttcggcagtggctggg

SEQ ID NO: 618343 - DNA, 14 bp, Homo sapiens
actgagcagagtct

SEQ ID NO: 618344 - DNA, 18 bp, Homo sapiens
actgagtgaaatattact

SEQ ID NO: 618345 - DNA, 20 bp, Homo sapiens
actgatatcacgggcccgct

SEQ ID NO: 618346 - DNA, 14 bp, Homo sapiens
actgatgagacaac

SEQ ID NO: 618347 - DNA, 21 bp, Homo sapiens
actgatgagacaacacacaca

SEQ ID NO: 618348 - DNA, 22 bp, Homo sapiens
actgatgggtatcatgcttcta

SEQ ID NO: 618349 - DNA, 15 bp, Homo sapiens
actgatgggtcctgc

SEQ ID NO: 618350 - DNA, 19 bp, Homo sapiens
actgatttttttttccttc

SEQ ID NO: 618351 - DNA, 21 bp, Homo sapiens
actgatttttttttccttcag

SEQ ID NO: 618352 - DNA, 12 bp, Homo sapiens
actgcaacactg

SEQ ID NO: 618353 - DNA, 15 bp, Homo sapiens
actgcaatgtctgtc

SEQ ID NO: 618354 - DNA, 18 bp, Homo sapiens
actgcaccctccacagga

SEQ ID NO: 618355 - DNA, 20 bp, Homo sapiens
actgcaccctccacaggagc

SEQ ID NO: 618356 - DNA, 16 bp, Homo sapiens
actgcagccctctcca

SEQ ID NO: 618357 - DNA, 17 bp, Homo sapiens
agggcgctccggcagag

SEQ ID NO: 618358 - DNA, 23 bp, Homo sapiens
agggcgctccggcagaggcaggg

SEQ ID NO: 618359 - DNA, 18 bp, Homo sapiens
agggcggcggggcctggg

SEQ ID NO: 618360 - DNA, 22 bp, Homo sapiens
agggcgtgaaacacaatatcat

SEQ ID NO: 618361 - DNA, 22 bp, Homo sapiens
agggctcagatggggcctgggc

SEQ ID NO: 618362 - DNA, 23 bp, Homo sapiens
agggctcagatggggcctgggct

SEQ ID NO: 618363 - DNA, 13 bp, Homo sapiens
agggctgagcccc

SEQ ID NO: 618364 - DNA, 16 bp, Homo sapiens
agggctgagcccctcc

SEQ ID NO: 618365 - DNA, 17 bp, Homo sapiens
agggctgagcccctcct

SEQ ID NO: 618366 - DNA, 19 bp, Homo sapiens
agggctgagcccctcctct

SEQ ID NO: 618367 - DNA, 19 bp, Homo sapiens
agggcttggatcgtggaag

SEQ ID NO: 618368 - DNA, 17 bp, Homo sapiens
aggggaaaacctcagtt

SEQ ID NO: 618369 - DNA, 21 bp, Homo sapiens
aggggacttggataggagctt

SEQ ID NO: 618370 - DNA, 11 bp, Homo sapiens
aggggaggctg

SEQ ID NO: 618371 - DNA, 16 bp, Homo sapiens
aggggatctaaaagga

SEQ ID NO: 618372 - DNA, 21 bp, Homo sapiens
aggggatctaaaaggaggaca

SEQ ID NO: 618373 - DNA, 15 bp, Homo sapiens
aggggcaaaaatttg

SEQ ID NO: 618374 - DNA, 16 bp, Homo sapiens
aggggcaaaaatttga

SEQ ID NO: 618375 - DNA, 23 bp, Homo sapiens
aggggcaaaaatttgacattgtc

SEQ ID NO: 618376 - DNA, 17 bp, Homo sapiens
aggggcactgtgttctc

SEQ ID NO: 618377 - DNA, 12 bp, Homo sapiens
aggggcaggcag

SEQ ID NO: 618378 - DNA, 18 bp, Homo sapiens
aggggcaggcagctaggc

SEQ ID NO: 618379 - DNA, 14 bp, Homo sapiens
aggggccagaccac

SEQ ID NO: 618380 - DNA, 20 bp, Homo sapiens
aggggcttggagcagagacg

SEQ ID NO: 618381 - DNA, 22 bp, Homo sapiens
aggggtcagcaggggggttggg

SEQ ID NO: 618382 - DNA, 15 bp, Homo sapiens
agggtccagccctcc

SEQ ID NO: 618383 - DNA, 16 bp, Homo sapiens
agggtccagccctccg

SEQ ID NO: 618384 - DNA, 17 bp, Homo sapiens
agggtccagccctccgc

SEQ ID NO: 618385 - DNA, 23 bp, Homo sapiens
agggtcctgggggctgctgcact

SEQ ID NO: 618386 - DNA, 14 bp, Homo sapiens
agggtctccctggg

SEQ ID NO: 618387 - DNA, 22 bp, Homo sapiens
agggtctccctgggcaccctgc

SEQ ID NO: 618388 - DNA, 14 bp, Homo sapiens
agggtgagaagcta

SEQ ID NO: 618389 - DNA, 11 bp, Homo sapiens
agggtgcctgg

SEQ ID NO: 618390 - DNA, 14 bp, Homo sapiens
agggtgcctggctg

SEQ ID NO: 618391 - DNA, 22 bp, Homo sapiens
agggtgggcgtgacttcagact

SEQ ID NO: 618392 - DNA, 19 bp, Homo sapiens
agggtggtagttttcccta

SEQ ID NO: 618393 - DNA, 13 bp, Homo sapiens
agggtgtggcttg

SEQ ID NO: 618394 - DNA, 14 bp, Homo sapiens
agggtgtggcttgg

SEQ ID NO: 618395 - DNA, 12 bp, Homo sapiens
agggttccagac

SEQ ID NO: 618396 - DNA, 13 bp, Homo sapiens
agggttccagaca

SEQ ID NO: 618397 - DNA, 14 bp, Homo sapiens
agggttccagacag

SEQ ID NO: 618398 - DNA, 13 bp, Homo sapiens
agggttctagaag

SEQ ID NO: 618399 - DNA, 14 bp, Homo sapiens
agggttctgccctg

SEQ ID NO: 618400 - DNA, 20 bp, Homo sapiens
agggttctgccctgcctgag

SEQ ID NO: 618401 - DNA, 22 bp, Homo sapiens
agggttctgccctgcctgagga

SEQ ID NO: 618402 - DNA, 21 bp, Homo sapiens
agggtttgtttgctgcttttg

SEQ ID NO: 618403 - DNA, 18 bp, Homo sapiens
agggttttttagaaaacc

SEQ ID NO: 618404 - DNA, 21 bp, Homo sapiens
aggtagtgggtgaatgtgtga

SEQ ID NO: 618405 - DNA, 21 bp, Homo sapiens
aggtatctgatgatgttctga

SEQ ID NO: 618406 - DNA, 20 bp, Homo sapiens
aggtcagtgttataaaatct

SEQ ID NO: 618407 - DNA, 15 bp, Homo sapiens
aggtccctgccagtg

SEQ ID NO: 618408 - DNA, 20 bp, Homo sapiens
aggtcctttagtttgcttct

SEQ ID NO: 618409 - DNA, 12 bp, Homo sapiens
aggtctccaccc

SEQ ID NO: 618410 - DNA, 13 bp, Homo sapiens
aggtctccacccc

SEQ ID NO: 618411 - DNA, 14 bp, Homo sapiens
aggtctccacccct

SEQ ID NO: 618412 - DNA, 15 bp, Homo sapiens
aggtctccacccctc

SEQ ID NO: 618413 - DNA, 23 bp, Homo sapiens
aggtctccacccctcaagccagg

SEQ ID NO: 618414 - DNA, 19 bp, Homo sapiens
aggtctggcgccaggggca

SEQ ID NO: 618415 - DNA, 15 bp, Homo sapiens
aggtgaccagaatga

SEQ ID NO: 618416 - DNA, 17 bp, Homo sapiens
aggtgaccagaatgagg

SEQ ID NO: 618417 - DNA, 16 bp, Homo sapiens
aggtgaccataaagat

SEQ ID NO: 618418 - DNA, 22 bp, Homo sapiens
aggtgcatgccttcataaatta

SEQ ID NO: 618419 - DNA, 11 bp, Homo sapiens
aggtgcctcat

SEQ ID NO: 618420 - DNA, 18 bp, Homo sapiens
aggtgctgaatgaagctg

SEQ ID NO: 618421 - DNA, 20 bp, Homo sapiens
aggtgctgtgcgccttgtag

SEQ ID NO: 618422 - DNA, 15 bp, Homo sapiens
aggtgctttctccat

SEQ ID NO: 618423 - DNA, 23 bp, Homo sapiens
aggtggcagggaagggtgcctgg

SEQ ID NO: 618424 - DNA, 14 bp, Homo sapiens
aggtgggctgcctg

SEQ ID NO: 618425 - DNA, 15 bp, Homo sapiens
aggtgggctgcctgc

SEQ ID NO: 618426 - DNA, 17 bp, Homo sapiens
aggtgggctgcctgctg

SEQ ID NO: 618427 - DNA, 13 bp, Homo sapiens
aggtgggtcttgg

SEQ ID NO: 618428 - DNA, 15 bp, Homo sapiens
aggtgggtcttggat

SEQ ID NO: 618429 - DNA, 17 bp, Homo sapiens
aggtggtcttggagagg

SEQ ID NO: 618430 - DNA, 19 bp, Homo sapiens
aggtggtcttggagaggag

SEQ ID NO: 618431 - DNA, 13 bp, Homo sapiens
aggttaaggggat

SEQ ID NO: 618432 - DNA, 19 bp, Homo sapiens
aggttaaggggatctaaaa

SEQ ID NO: 618433 - DNA, 12 bp, Homo sapiens
aggttaagtctc

SEQ ID NO: 618434 - DNA, 14 bp, Homo sapiens
aggttatcagaaag

SEQ ID NO: 618435 - DNA, 21 bp, Homo sapiens
aggttatttttatttttttac

SEQ ID NO: 618436 - DNA, 17 bp, Homo sapiens
aggttccggtgtctgga

SEQ ID NO: 618437 - DNA, 17 bp, Homo sapiens
aggttggagtgcattca

SEQ ID NO: 618438 - DNA, 22 bp, Homo sapiens
aggtttagaatcaagtctgtga

SEQ ID NO: 618439 - DNA, 21 bp, Homo sapiens
aggtttgggggacgcccagcc

SEQ ID NO: 618440 - DNA, 22 bp, Homo sapiens
aggtttgggggacgcccagccc

SEQ ID NO: 618441 - DNA, 19 bp, Homo sapiens
agtaaaacttgtattggaa

SEQ ID NO: 618442 - DNA, 17 bp, Homo sapiens
agtaaatcccacgacat

SEQ ID NO: 618443 - DNA, 18 bp, Homo sapiens
agtaaatctaaattaact

SEQ ID NO: 618444 - DNA, 16 bp, Homo sapiens
agtaaatgtatattga

SEQ ID NO: 618445 - DNA, 18 bp, Homo sapiens
agtaactgccattttttg

SEQ ID NO: 618446 - DNA, 20 bp, Homo sapiens
agtaagttcatcaaacatgt

SEQ ID NO: 618447 - DNA, 15 bp, Homo sapiens
agtacaataaataaa

SEQ ID NO: 618448 - DNA, 14 bp, Homo sapiens
agtaccatcccact

SEQ ID NO: 618449 - DNA, 16 bp, Homo sapiens
agtaccatcccactga

SEQ ID NO: 618450 - DNA, 21 bp, Homo sapiens
agtacttaccagtcaatgcat

SEQ ID NO: 618451 - DNA, 20 bp, Homo sapiens
agtagcatactgatgagaca

SEQ ID NO: 618452 - DNA, 18 bp, Homo sapiens
agtagcattttaatagtt

SEQ ID NO: 618453 - DNA, 16 bp, Homo sapiens
agtagctcgtgtgctt

SEQ ID NO: 618454 - DNA, 23 bp, Homo sapiens
agtaggtctgcacacataacaca

SEQ ID NO: 618455 - DNA, 20 bp, Homo sapiens
agtaggtgggtcttggattg

SEQ ID NO: 618456 - DNA, 17 bp, Homo sapiens
agtagtacttaatagta

SEQ ID NO: 618457 - DNA, 13 bp, Homo sapiens
agtagtgtgagtg

SEQ ID NO: 618458 - DNA, 20 bp, Homo sapiens
agtatacacatcataaacaa

SEQ ID NO: 618459 - DNA, 22 bp, Homo sapiens
agtatcatacgttgatagttta

SEQ ID NO: 618460 - DNA, 22 bp, Homo sapiens
agtatctcatcaacaaagaaat

SEQ ID NO: 618461 - DNA, 15 bp, Homo sapiens
agtatcttaaaattg

SEQ ID NO: 618462 - DNA, 19 bp, Homo sapiens
agtatgctttccctgagga

SEQ ID NO: 618463 - DNA, 20 bp, Homo sapiens
agtatgctttccctgaggaa

SEQ ID NO: 618464 - DNA, 23 bp, Homo sapiens
agtatgctttccctgaggaatga

SEQ ID NO: 618465 - DNA, 22 bp, Homo sapiens
agtattctgtagccaacttaaa

SEQ ID NO: 618466 - DNA, 13 bp, Homo sapiens
agtattgacaata

SEQ ID NO: 618467 - DNA, 21 bp, Homo sapiens
agtattgagacactgtcaaga

SEQ ID NO: 618468 - DNA, 22 bp, Homo sapiens
agtattgttcttgtaaaactgt

SEQ ID NO: 618469 - DNA, 17 bp, Homo sapiens
agtatttaacattcttg

SEQ ID NO: 618470 - DNA, 16 bp, Homo sapiens
agtcaatcaaacaggg

SEQ ID NO: 618471 - DNA, 16 bp, Homo sapiens
agtcacgtgaggcccc

SEQ ID NO: 618472 - DNA, 19 bp, Homo sapiens
agtcagtgcccatgtgtat

SEQ ID NO: 618473 - DNA, 20 bp, Homo sapiens
agtcagtgcccatgtgtatg

SEQ ID NO: 618474 - DNA, 12 bp, Homo sapiens
agtcatctcaaa

SEQ ID NO: 618475 - DNA, 14 bp, Homo sapiens
ataaagctcacact

SEQ ID NO: 618476 - DNA, 16 bp, Homo sapiens
ataaagctcacacttg

SEQ ID NO: 618477 - DNA, 22 bp, Homo sapiens
ataaatagtgaaaattttattg

SEQ ID NO: 618478 - DNA, 16 bp, Homo sapiens
ataaatatcattatag

SEQ ID NO: 618479 - DNA, 15 bp, Homo sapiens
ataaatattttagga

SEQ ID NO: 618480 - DNA, 23 bp, Homo sapiens
ataaatattttaggaaactctcc

SEQ ID NO: 618481 - DNA, 12 bp, Homo sapiens
ataaatctaaat

SEQ ID NO: 618482 - DNA, 15 bp, Homo sapiens
ataaatgttttaaag

SEQ ID NO: 618483 - DNA, 22 bp, Homo sapiens
ataaattaatgagttttatcca

SEQ ID NO: 618484 - DNA, 16 bp, Homo sapiens
ataaattaatttttca

SEQ ID NO: 618485 - DNA, 18 bp, Homo sapiens
ataaattaatttttcaat

SEQ ID NO: 618486 - DNA, 13 bp, Homo sapiens
ataaattataatg

SEQ ID NO: 618487 - DNA, 20 bp, Homo sapiens
ataaattatttctaaaacat

SEQ ID NO: 618488 - DNA, 18 bp, Homo sapiens
ataaatttggccatgaaa

SEQ ID NO: 618489 - DNA, 14 bp, Homo sapiens
ataaattttggaag

SEQ ID NO: 618490 - DNA, 17 bp, Homo sapiens
ataaattttggaagaat

SEQ ID NO: 618491 - DNA, 14 bp, Homo sapiens
ataacactgcagcc

SEQ ID NO: 618492 - DNA, 13 bp, Homo sapiens
ataacatgaaagt

SEQ ID NO: 618493 - DNA, 18 bp, Homo sapiens
ataacattgtatgttaat

SEQ ID NO: 618494 - DNA, 16 bp, Homo sapiens
ataagaaacagtttaa

SEQ ID NO: 618495 - DNA, 19 bp, Homo sapiens
ataagaaacagtttaacag

SEQ ID NO: 618496 - DNA, 17 bp, Homo sapiens
ataagcatctgtgtaac

SEQ ID NO: 618497 - DNA, 22 bp, Homo sapiens
ataagcatctgtgtaacctcca

SEQ ID NO: 618498 - DNA, 18 bp, Homo sapiens
ataagccaaaataagact

SEQ ID NO: 618499 - DNA, 14 bp, Homo sapiens
ataagccaattttt

SEQ ID NO: 618500 - DNA, 18 bp, Homo sapiens
ataagccaatttttctgc

SEQ ID NO: 618501 - DNA, 23 bp, Homo sapiens
ataagccaatttttctgcactga

SEQ ID NO: 618502 - DNA, 16 bp, Homo sapiens
ataagctggtatcagt

SEQ ID NO: 618503 - DNA, 16 bp, Homo sapiens
ataaggcctcatcctc

SEQ ID NO: 618504 - DNA, 15 bp, Homo sapiens
ataagtaaatgtctt

SEQ ID NO: 618505 - DNA, 16 bp, Homo sapiens
ataagtaaatgtcttc

SEQ ID NO: 618506 - DNA, 18 bp, Homo sapiens
ataagtgctcagtattga

SEQ ID NO: 618507 - DNA, 17 bp, Homo sapiens
ataagttgaatgataat

SEQ ID NO: 618508 - DNA, 16 bp, Homo sapiens
ataataaatatatatt

SEQ ID NO: 618509 - DNA, 17 bp, Homo sapiens
ataatacccttttccaa

SEQ ID NO: 618510 - DNA, 17 bp, Homo sapiens
ataatagctcacagcac

SEQ ID NO: 618511 - DNA, 22 bp, Homo sapiens
ataatagctcacagcacatttg

SEQ ID NO: 618512 - DNA, 13 bp, Homo sapiens
ataatataaatga

SEQ ID NO: 618513 - DNA, 14 bp, Homo sapiens
ataatataaatgaa

SEQ ID NO: 618514 - DNA, 13 bp, Homo sapiens
ataatatgtacaa

SEQ ID NO: 618515 - DNA, 14 bp, Homo sapiens
ataatatgtacaaa

SEQ ID NO: 618516 - DNA, 17 bp, Homo sapiens
ataatatgtacaaataa

SEQ ID NO: 618517 - DNA, 18 bp, Homo sapiens
ataatatgtacaaataat

SEQ ID NO: 618518 - DNA, 23 bp, Homo sapiens
ataatattgccttgatgtttcta

SEQ ID NO: 618519 - DNA, 15 bp, Homo sapiens
ataatgattaggaga

SEQ ID NO: 618520 - DNA, 15 bp, Homo sapiens
ataatgattcaatgt

SEQ ID NO: 618521 - DNA, 22 bp, Homo sapiens
ataatgcttaacataaacttgt

SEQ ID NO: 618522 - DNA, 12 bp, Homo sapiens
ataattaaagtg

SEQ ID NO: 618523 - DNA, 16 bp, Homo sapiens
ataattaaagtgtcca

SEQ ID NO: 618524 - DNA, 20 bp, Homo sapiens
ataattaaagtgtccattga

SEQ ID NO: 618525 - DNA, 16 bp, Homo sapiens
ataattaaatgaaata

SEQ ID NO: 618526 - DNA, 18 bp, Homo sapiens
ataattaaatgaaatact

SEQ ID NO: 618527 - DNA, 16 bp, Homo sapiens
ataattcgagcaaaca

SEQ ID NO: 618528 - DNA, 21 bp, Homo sapiens
ataattgtaaaggtgatgaat

SEQ ID NO: 618529 - DNA, 22 bp, Homo sapiens
atacaaagctgtcactcacaaa

SEQ ID NO: 618530 - DNA, 15 bp, Homo sapiens
atacaaattttccca

SEQ ID NO: 618531 - DNA, 19 bp, Homo sapiens
atacaacacattgaaactg

SEQ ID NO: 618532 - DNA, 23 bp, Homo sapiens
atacaacacattgaaactgtatt

SEQ ID NO: 618533 - DNA, 13 bp, Homo sapiens
atacaagtgtttc

SEQ ID NO: 618534 - DNA, 19 bp, Homo sapiens
atacacagaaatcctaaca

SEQ ID NO: 618535 - DNA, 23 bp, Homo sapiens
atacacataattaaagtgtccat

SEQ ID NO: 618536 - DNA, 15 bp, Homo sapiens
atacagacctccaga

SEQ ID NO: 618537 - DNA, 21 bp, Homo sapiens
atacagcatttctttggaaac

SEQ ID NO: 618538 - DNA, 16 bp, Homo sapiens
ataccccgtgaagcat

SEQ ID NO: 618539 - DNA, 20 bp, Homo sapiens
ataccctaggtctccacccc

SEQ ID NO: 618540 - DNA, 15 bp, Homo sapiens
atacctgtacacaca

SEQ ID NO: 618541 - DNA, 18 bp, Homo sapiens
atacctgtacacacacag

SEQ ID NO: 618542 - DNA, 14 bp, Homo sapiens
atacgcaattgtat

SEQ ID NO: 618543 - DNA, 18 bp, Homo sapiens
atacgcaattgtatatat

SEQ ID NO: 618544 - DNA, 16 bp, Homo sapiens
atactatttattaaaa

SEQ ID NO: 618545 - DNA, 19 bp, Homo sapiens
atactatttattaaaacca

SEQ ID NO: 618546 - DNA, 17 bp, Homo sapiens
atactccaaggtggcat

SEQ ID NO: 618547 - DNA, 22 bp, Homo sapiens
atactccaaggtggcatagcca

SEQ ID NO: 618548 - DNA, 20 bp, Homo sapiens
atactcgttattcatacaaa

SEQ ID NO: 618549 - DNA, 21 bp, Homo sapiens
atactcgttattcatacaaat

SEQ ID NO: 618550 - DNA, 20 bp, Homo sapiens
atactctagattttgttttg

SEQ ID NO: 618551 - DNA, 19 bp, Homo sapiens
atactgaattgttatgtaa

SEQ ID NO: 618552 - DNA, 17 bp, Homo sapiens
attaaagtgtccattga

SEQ ID NO: 618553 - DNA, 20 bp, Homo sapiens
attaaagtgtccattgacat

SEQ ID NO: 618554 - DNA, 23 bp, Homo sapiens
attaaagtgtccattgacatgta

SEQ ID NO: 618555 - DNA, 15 bp, Homo sapiens
attaaatgaaatact

SEQ ID NO: 618556 - DNA, 11 bp, Homo sapiens
attaaatgttg

SEQ ID NO: 618557 - DNA, 19 bp, Homo sapiens
attaaattatcattgtttg

SEQ ID NO: 618558 - DNA, 12 bp, Homo sapiens
attaagaaaccc

SEQ ID NO: 618559 - DNA, 19 bp, Homo sapiens
attaaggactacagaattg

SEQ ID NO: 618560 - DNA, 18 bp, Homo sapiens
attaagttataccagcaa

SEQ ID NO: 618561 - DNA, 12 bp, Homo sapiens
attaatgagttt

SEQ ID NO: 618562 - DNA, 16 bp, Homo sapiens
attaattggcagcaga

SEQ ID NO: 618563 - DNA, 19 bp, Homo sapiens
attaattggcagcagattt

SEQ ID NO: 618564 - DNA, 19 bp, Homo sapiens
attaatttttcaatttctc

SEQ ID NO: 618565 - DNA, 16 bp, Homo sapiens
attaatttttttattg

SEQ ID NO: 618566 - DNA, 19 bp, Homo sapiens
attaatttttttattgttt

SEQ ID NO: 618567 - DNA, 21 bp, Homo sapiens
attaatttttttattgtttaa

SEQ ID NO: 618568 - DNA, 11 bp, Homo sapiens
attacagaaac

SEQ ID NO: 618569 - DNA, 13 bp, Homo sapiens
attacagaaacac

SEQ ID NO: 618570 - DNA, 21 bp, Homo sapiens
attacatcccataacttgtca

SEQ ID NO: 618571 - DNA, 22 bp, Homo sapiens
attacctgaaagcccttctcaa

SEQ ID NO: 618572 - DNA, 22 bp, Homo sapiens
attactctgcctgtcaagtttt

SEQ ID NO: 618573 - DNA, 15 bp, Homo sapiens
attagcaccagcttg

SEQ ID NO: 618574 - DNA, 14 bp, Homo sapiens
attaggttaagtct

SEQ ID NO: 618575 - DNA, 16 bp, Homo sapiens
attaggtttagaatca

SEQ ID NO: 618576 - DNA, 12 bp, Homo sapiens
attagtattttg

SEQ ID NO: 618577 - DNA, 12 bp, Homo sapiens
attagtgctatg

SEQ ID NO: 618578 - DNA, 20 bp, Homo sapiens
attagtgttttcattctggt

SEQ ID NO: 618579 - DNA, 16 bp, Homo sapiens
attataatgcatctaa

SEQ ID NO: 618580 - DNA, 18 bp, Homo sapiens
attataatgcatctaaac

SEQ ID NO: 618581 - DNA, 14 bp, Homo sapiens
attatagtctgtac

SEQ ID NO: 618582 - DNA, 14 bp, Homo sapiens
attatatacaaagc

SEQ ID NO: 618583 - DNA, 11 bp, Homo sapiens
attatatataa

SEQ ID NO: 618584 - DNA, 23 bp, Homo sapiens
attatattcccaaatctcaaaag

SEQ ID NO: 618585 - DNA, 18 bp, Homo sapiens
attatcaaaaaacagaaa

SEQ ID NO: 618586 - DNA, 14 bp, Homo sapiens
attatcattgtttg

SEQ ID NO: 618587 - DNA, 23 bp, Homo sapiens
attatctagtaggtctgcacaca

SEQ ID NO: 618588 - DNA, 15 bp, Homo sapiens
attatctgatccttg

SEQ ID NO: 618589 - DNA, 13 bp, Homo sapiens
attatctgggttt

SEQ ID NO: 618590 - DNA, 23 bp, Homo sapiens
attatctgggttttagaaattct

SEQ ID NO: 618591 - DNA, 17 bp, Homo sapiens
attattaaaaattatag

SEQ ID NO: 618592 - DNA, 22 bp, Homo sapiens
attattagttgaccaactatat

SEQ ID NO: 618593 - DNA, 23 bp, Homo sapiens
attattagttgaccaactatatt

SEQ ID NO: 618594 - DNA, 19 bp, Homo sapiens
attatttctaccattaaaa

SEQ ID NO: 618595 - DNA, 14 bp, Homo sapiens
attattttctatat

SEQ ID NO: 618596 - DNA, 14 bp, Homo sapiens
attattttctgtaa

SEQ ID NO: 618597 - DNA, 15 bp, Homo sapiens
attcaaacctaagtt

SEQ ID NO: 618598 - DNA, 21 bp, Homo sapiens
attcaaagaatcacctaatta

SEQ ID NO: 618599 - DNA, 14 bp, Homo sapiens
attcaacatcaatt

SEQ ID NO: 618600 - DNA, 22 bp, Homo sapiens
attcaataactattgctgcttt

SEQ ID NO: 618601 - DNA, 18 bp, Homo sapiens
attcaatcattttgggaa

SEQ ID NO: 618602 - DNA, 14 bp, Homo sapiens
attcacttttattg

SEQ ID NO: 618603 - DNA, 21 bp, Homo sapiens
attcagtagcattttaatagt

SEQ ID NO: 618604 - DNA, 16 bp, Homo sapiens
attcagtctatgctgt

SEQ ID NO: 618605 - DNA, 12 bp, Homo sapiens
attcagtgacat

SEQ ID NO: 618606 - DNA, 15 bp, Homo sapiens
attcagtggacattt

SEQ ID NO: 618607 - DNA, 22 bp, Homo sapiens
attcagtggacatttgttctgg

SEQ ID NO: 618608 - DNA, 15 bp, Homo sapiens
attcatactcaaaga

SEQ ID NO: 618609 - DNA, 18 bp, Homo sapiens
attcatatttatgaatct

SEQ ID NO: 618610 - DNA, 15 bp, Homo sapiens
attcatgctttctcc

SEQ ID NO: 618611 - DNA, 16 bp, Homo sapiens
attcatgctttctcct

SEQ ID NO: 618612 - DNA, 17 bp, Homo sapiens
attcattcatcctctta

SEQ ID NO: 618613 - DNA, 14 bp, Homo sapiens
attcatttacaact

SEQ ID NO: 618614 - DNA, 15 bp, Homo sapiens
attcatttacaactt

SEQ ID NO: 618615 - DNA, 18 bp, Homo sapiens
attccagtgtattttctg

SEQ ID NO: 618616 - DNA, 23 bp, Homo sapiens
attcccactaagctttctccttt

SEQ ID NO: 618617 - DNA, 21 bp, Homo sapiens
attcctaagagtggaggagga

SEQ ID NO: 618618 - DNA, 15 bp, Homo sapiens
attcctaattctatg

SEQ ID NO: 618619 - DNA, 20 bp, Homo sapiens
attcctaattctatgattaa

SEQ ID NO: 618620 - DNA, 14 bp, Homo sapiens
attcctacttaaac

SEQ ID NO: 618621 - DNA, 22 bp, Homo sapiens
attcctacttaaacaaaaactt

SEQ ID NO: 618622 - DNA, 17 bp, Homo sapiens
attcctcccctggaagt

SEQ ID NO: 618623 - DNA, 15 bp, Homo sapiens
attcctgaccctcac

SEQ ID NO: 618624 - DNA, 18 bp, Homo sapiens
attcctgaccctcacttt

SEQ ID NO: 618625 - DNA, 13 bp, Homo sapiens
attcgagcaaaca

SEQ ID NO: 618626 - DNA, 14 bp, Homo sapiens
attcgagcaaacaa

SEQ ID NO: 618627 - DNA, 13 bp, Homo sapiens
attcgtaagttct

SEQ ID NO: 618628 - DNA, 19 bp, Homo sapiens
attcgtgggcctgctgctc

SEQ ID NO: 618629 - DNA, 20 bp, Homo sapiens
attctataagagacaaagtt

SEQ ID NO: 618630 - DNA, 16 bp, Homo sapiens
attctatgattaaact

SEQ ID NO: 618631 - DNA, 17 bp, Homo sapiens
attctatgattaaactg

SEQ ID NO: 618632 - DNA, 21 bp, Homo sapiens
attctatttcaacttcaggaa

SEQ ID NO: 618633 - DNA, 13 bp, Homo sapiens
attctcctctccc

SEQ ID NO: 618634 - DNA, 14 bp, Homo sapiens
attctcctctccca

SEQ ID NO: 618635 - DNA, 14 bp, Homo sapiens
attctgaaggggaa

SEQ ID NO: 618636 - DNA, 23 bp, Homo sapiens
attctgaaggggaaaacctcagt

SEQ ID NO: 618637 - DNA, 15 bp, Homo sapiens
attctgattattaca

SEQ ID NO: 618638 - DNA, 20 bp, Homo sapiens
attctgctaatttatgaaga

SEQ ID NO: 618639 - DNA, 21 bp, Homo sapiens
attctgctaatttatgaagat

SEQ ID NO: 618640 - DNA, 19 bp, Homo sapiens
attctgtagccaacttaaa

SEQ ID NO: 618641 - DNA, 21 bp, Homo sapiens
attcttaccgaaatgaaaatg

SEQ ID NO: 618642 - DNA, 23 bp, Homo sapiens
attcttaccgaaatgaaaatggc

SEQ ID NO: 618643 - DNA, 19 bp, Homo sapiens
attcttactgttctgaaat

SEQ ID NO: 618644 - DNA, 15 bp, Homo sapiens
attcttagttaatct

SEQ ID NO: 618645 - DNA, 20 bp, Homo sapiens
attcttctcctttgtcaaat

SEQ ID NO: 618646 - DNA, 13 bp, Homo sapiens
attcttgcactgt

SEQ ID NO: 618647 - DNA, 16 bp, Homo sapiens
attcttgcactgtatc

SEQ ID NO: 618648 - DNA, 22 bp, Homo sapiens
attcttgcactgtatccaagtt

SEQ ID NO: 618649 - DNA, 14 bp, Homo sapiens
attcttgctctgct

SEQ ID NO: 618650 - DNA, 18 bp, Homo sapiens
attctttcaatccacagt

SEQ ID NO: 618651 - DNA, 22 bp, Homo sapiens
attctttgatatgttgatgaaa

SEQ ID NO: 618652 - DNA, 16 bp, Homo sapiens
attcttttttcaatgt

SEQ ID NO: 618653 - DNA, 14 bp, Homo sapiens
attgaaactgtatt

SEQ ID NO: 618654 - DNA, 17 bp, Homo sapiens
attgaaactgtatttac

SEQ ID NO: 618655 - DNA, 15 bp, Homo sapiens
attgaaagggacaag

SEQ ID NO: 618656 - DNA, 18 bp, Homo sapiens
attgaaagggacaagtat

SEQ ID NO: 618657 - DNA, 19 bp, Homo sapiens
attgaaagggacaagtatc

SEQ ID NO: 618658 - DNA, 20 bp, Homo sapiens
attgaaatctttttgctttg

SEQ ID NO: 618659 - DNA, 16 bp, Homo sapiens
attgaacactgcaccc

SEQ ID NO: 618660 - DNA, 19 bp, Homo sapiens
attgaaccgtcaatgtgaa

SEQ ID NO: 618661 - DNA, 21 bp, Homo sapiens
attgaaccgtcaatgtgaaat

SEQ ID NO: 618662 - DNA, 22 bp, Homo sapiens
attgaaccgtcaatgtgaaata

SEQ ID NO: 618663 - DNA, 23 bp, Homo sapiens
attgaagagagatatatctgaaa

SEQ ID NO: 618664 - DNA, 21 bp, Homo sapiens
caaatgttattcaataactat

SEQ ID NO: 618665 - DNA, 15 bp, Homo sapiens
caaattaattggcag

SEQ ID NO: 618666 - DNA, 19 bp, Homo sapiens
caaattaattggcagcaga

SEQ ID NO: 618667 - DNA, 20 bp, Homo sapiens
caaattaattggcagcagat

SEQ ID NO: 618668 - DNA, 12 bp, Homo sapiens
caaattctgatt

SEQ ID NO: 618669 - DNA, 17 bp, Homo sapiens
caaattctgattattac

SEQ ID NO: 618670 - DNA, 23 bp, Homo sapiens
caaatttttactcaggctttcta

SEQ ID NO: 618671 - DNA, 19 bp, Homo sapiens
caacaaactcaaaatgtgg

SEQ ID NO: 618672 - DNA, 19 bp, Homo sapiens
caacaaagcatgctcagta

SEQ ID NO: 618673 - DNA, 23 bp, Homo sapiens
caccactagggtcctggccctct

SEQ ID NO: 618674 - DNA, 14 bp, Homo sapiens
caccagcctgagcc

SEQ ID NO: 618675 - DNA, 15 bp, Homo sapiens
caccagcctgagcca

SEQ ID NO: 618676 - DNA, 13 bp, Homo sapiens
caccagtgccgcc

SEQ ID NO: 618677 - DNA, 18 bp, Homo sapiens
caccagtgccgcctgtgc

SEQ ID NO: 618678 - DNA, 19 bp, Homo sapiens
caccagtgccgcctgtgcc

SEQ ID NO: 618679 - DNA, 18 bp, Homo sapiens
caccatttcccctgtggt

SEQ ID NO: 618680 - DNA, 16 bp, Homo sapiens
cacccactagccctct

SEQ ID NO: 618681 - DNA, 22 bp, Homo sapiens
cacccactagccctctttctct

SEQ ID NO: 618682 - DNA, 11 bp, Homo sapiens
cacccccagcc

SEQ ID NO: 618683 - DNA, 12 bp, Homo sapiens
cacccccagcct

SEQ ID NO: 618684 - DNA, 17 bp, Homo sapiens
cacccccagcctccccc

SEQ ID NO: 618685 - DNA, 16 bp, Homo sapiens
caccccgctcttccca

SEQ ID NO: 618686 - DNA, 14 bp, Homo sapiens
caccccgctgcctg

SEQ ID NO: 618687 - DNA, 16 bp, Homo sapiens
caccccgctgcctggc

SEQ ID NO: 618688 - DNA, 15 bp, Homo sapiens
caccccgtcccggcc

SEQ ID NO: 618689 - DNA, 18 bp, Homo sapiens
caccccgtcccggccccg

SEQ ID NO: 618690 - DNA, 14 bp, Homo sapiens
caccccgttcccag

SEQ ID NO: 618691 - DNA, 17 bp, Homo sapiens
caccccgttcccagcgc

SEQ ID NO: 618692 - DNA, 19 bp, Homo sapiens
caccccgttgttgtccctg

SEQ ID NO: 618693 - DNA, 18 bp, Homo sapiens
cacccctcaagccaggag

SEQ ID NO: 618694 - DNA, 19 bp, Homo sapiens
cacccctcaagccaggaga

SEQ ID NO: 618695 - DNA, 13 bp, Homo sapiens
cacccctcttccc

SEQ ID NO: 618696 - DNA, 20 bp, Homo sapiens
cacccctcttcccccttccc

SEQ ID NO: 618697 - DNA, 17 bp, Homo sapiens
cacccgccccagagact

SEQ ID NO: 618698 - DNA, 14 bp, Homo sapiens
cacccgcccgcccc

SEQ ID NO: 618699 - DNA, 17 bp, Homo sapiens
cacccgcccgcccccgc

SEQ ID NO: 618700 - DNA, 18 bp, Homo sapiens
cacccgcccgcccccgcc

SEQ ID NO: 618701 - DNA, 16 bp, Homo sapiens
caccctccacaggagc

SEQ ID NO: 618702 - DNA, 13 bp, Homo sapiens
caccctcccctct

SEQ ID NO: 618703 - DNA, 18 bp, Homo sapiens
caccctcccctctcctga

SEQ ID NO: 618704 - DNA, 11 bp, Homo sapiens
caccctcctgc

SEQ ID NO: 618705 - DNA, 15 bp, Homo sapiens
caccctgagcctgac

SEQ ID NO: 618706 - DNA, 14 bp, Homo sapiens
caccctgcaggcag

SEQ ID NO: 618707 - DNA, 20 bp, Homo sapiens
caccctgcaggcaggcagac

SEQ ID NO: 618708 - DNA, 15 bp, Homo sapiens
caccctgttccctct

SEQ ID NO: 618709 - DNA, 15 bp, Homo sapiens
cactgcaccctccac

SEQ ID NO: 618710 - DNA, 16 bp, Homo sapiens
cactgcaccctccaca

SEQ ID NO: 618711 - DNA, 21 bp, Homo sapiens
cactgcaccctccacaggagc

SEQ ID NO: 618712 - DNA, 22 bp, Homo sapiens
cactgcaccctccacaggagcc

SEQ ID NO: 618713 - DNA, 15 bp, Homo sapiens
cactgcagccctctc

SEQ ID NO: 618714 - DNA, 15 bp, Homo sapiens
cactgcagttattta

SEQ ID NO: 618715 - DNA, 14 bp, Homo sapiens
cactgccaaacatc

SEQ ID NO: 618716 - DNA, 17 bp, Homo sapiens
cactgcctggaggatag

SEQ ID NO: 618717 - DNA, 23 bp, Homo sapiens
cactgcctggaggatagcagaga

SEQ ID NO: 618718 - DNA, 15 bp, Homo sapiens
cactggagcgtgtac

SEQ ID NO: 618719 - DNA, 18 bp, Homo sapiens
cactggagcgtgtactac

SEQ ID NO: 618720 - DNA, 18 bp, Homo sapiens
cactgggtgtggcctggc

SEQ ID NO: 618721 - DNA, 19 bp, Homo sapiens
cactgtgacctgctcctgc

SEQ ID NO: 618722 - DNA, 13 bp, Homo sapiens
cacttatttccat

SEQ ID NO: 618723 - DNA, 12 bp, Homo sapiens
cacttccttaac

SEQ ID NO: 618724 - DNA, 15 bp, Homo sapiens
cacttccttaacagc

SEQ ID NO: 618725 - DNA, 16 bp, Homo sapiens
cacttccttaacagct

SEQ ID NO: 618726 - DNA, 16 bp, Homo sapiens
cacttcggataatttt

SEQ ID NO: 618727 - DNA, 18 bp, Homo sapiens
cacttcggataattttca

SEQ ID NO: 618728 - DNA, 19 bp, Homo sapiens
cacttcggataattttcat

SEQ ID NO: 618729 - DNA, 22 bp, Homo sapiens
cacttcggataattttcatttt

SEQ ID NO: 618730 - DNA, 14 bp, Homo sapiens
cacttctccttaac

SEQ ID NO: 618731 - DNA, 13 bp, Homo sapiens
cacttctctgtta

SEQ ID NO: 618732 - DNA, 12 bp, Homo sapiens
cacttctgttat

SEQ ID NO: 618733 - DNA, 13 bp, Homo sapiens
cacttctgttatc

SEQ ID NO: 618734 - DNA, 23 bp, Homo sapiens
cacttcttaaggacagtgttcaa

SEQ ID NO: 618735 - DNA, 23 bp, Homo sapiens
cacttgggctggcacccactgga

SEQ ID NO: 618736 - DNA, 17 bp, Homo sapiens
cacttgtggcagcttcc

SEQ ID NO: 618737 - DNA, 20 bp, Homo sapiens
cactttacattcttgctctg

SEQ ID NO: 618738 - DNA, 13 bp, Homo sapiens
cactttcccacac

SEQ ID NO: 618739 - DNA, 12 bp, Homo sapiens
cactttcctctc

SEQ ID NO: 618740 - DNA, 14 bp, Homo sapiens
cactttcctctctc

SEQ ID NO: 618741 - DNA, 13 bp, Homo sapiens
cacttttgccaat

SEQ ID NO: 618742 - DNA, 13 bp, Homo sapiens
cacttttttataa

SEQ ID NO: 618743 - DNA, 14 bp, Homo sapiens
cacttttttataaa

SEQ ID NO: 618744 - DNA, 18 bp, Homo sapiens
cacttttttcctgtcaat

SEQ ID NO: 618745 - DNA, 18 bp, Homo sapiens
cagaaaaatgaaatttaa

SEQ ID NO: 618746 - DNA, 11 bp, Homo sapiens
cagaaaacatt

SEQ ID NO: 618747 - DNA, 13 bp, Homo sapiens
cagaaaacattgt

SEQ ID NO: 618748 - DNA, 15 bp, Homo sapiens
cagaaaccaagccat

SEQ ID NO: 618749 - DNA, 14 bp, Homo sapiens
cagaaactttttct

SEQ ID NO: 618750 - DNA, 11 bp, Homo sapiens
cagaaagacat

SEQ ID NO: 618751 - DNA, 17 bp, Homo sapiens
cagaaagggcagcccct

SEQ ID NO: 618752 - DNA, 19 bp, Homo sapiens
cagaaagggcagcccctcc

SEQ ID NO: 618753 - DNA, 21 bp, Homo sapiens
cagaaccaacgggtctgtggg

SEQ ID NO: 618754 - DNA, 15 bp, Homo sapiens
cagaaccagcactcc

SEQ ID NO: 618755 - DNA, 17 bp, Homo sapiens
cagaaccagcactccca

SEQ ID NO: 618756 - DNA, 18 bp, Homo sapiens
cagaaccagcactcccag

SEQ ID NO: 618757 - DNA, 14 bp, Homo sapiens
cagaacgggcctcc

SEQ ID NO: 618758 - DNA, 17 bp, Homo sapiens
cagaactcctttctaag

SEQ ID NO: 618759 - DNA, 22 bp, Homo sapiens
cagaagcagcagctagaaagag

SEQ ID NO: 618760 - DNA, 12 bp, Homo sapiens
cagaaggcccga

SEQ ID NO: 618761 - DNA, 14 bp, Homo sapiens
cagaaggcccgagg

SEQ ID NO: 618762 - DNA, 18 bp, Homo sapiens
cagaaggcccgaggaggc

SEQ ID NO: 618763 - DNA, 14 bp, Homo sapiens
cagaagtgaaaaag

SEQ ID NO: 618764 - DNA, 21 bp, Homo sapiens
cagaatgttgtgttggtattt

SEQ ID NO: 618765 - DNA, 23 bp, Homo sapiens
cagaatgttgtgttggtatttac

SEQ ID NO: 618766 - DNA, 15 bp, Homo sapiens
cagacacacacatat

SEQ ID NO: 618767 - DNA, 17 bp, Homo sapiens
cagacagagatcagaat

SEQ ID NO: 618768 - DNA, 13 bp, Homo sapiens
cagacagagtgga

SEQ ID NO: 618769 - DNA, 19 bp, Homo sapiens
cagacagggtggggcttag

SEQ ID NO: 618770 - DNA, 14 bp, Homo sapiens
cagacattgtcagc

SEQ ID NO: 618771 - DNA, 15 bp, Homo sapiens
cagacattgtcagca

SEQ ID NO: 618772 - DNA, 22 bp, Homo sapiens
cagacattgttttgccaacatt

SEQ ID NO: 618773 - DNA, 18 bp, Homo sapiens
cagaccacgcccctgcct

SEQ ID NO: 618774 - DNA, 20 bp, Homo sapiens
cagaccacggtgtggggggt

SEQ ID NO: 618775 - DNA, 21 bp, Homo sapiens
cagaccagcatagttctgcaa

SEQ ID NO: 618776 - DNA, 18 bp, Homo sapiens
cagacccctaccctttcc

SEQ ID NO: 618777 - DNA, 13 bp, Homo sapiens
cagacggggggct

SEQ ID NO: 618778 - DNA, 16 bp, Homo sapiens
cagactcgagagggct

SEQ ID NO: 618779 - DNA, 22 bp, Homo sapiens
cagactcgagagggctgagccc

SEQ ID NO: 618780 - DNA, 22 bp, Homo sapiens
cagactctctcctctctctccc

SEQ ID NO: 618781 - DNA, 22 bp, Homo sapiens
cagactctgtgagattctaaat

SEQ ID NO: 618782 - DNA, 21 bp, Homo sapiens
cagagaactaacactatttta

SEQ ID NO: 618783 - DNA, 22 bp, Homo sapiens
cagagaactaacactattttat

SEQ ID NO: 618784 - DNA, 14 bp, Homo sapiens
cagagaccttgcga

SEQ ID NO: 618785 - DNA, 18 bp, Homo sapiens
cagagacggcagccccat

SEQ ID NO: 618786 - DNA, 14 bp, Homo sapiens
cagagactgcccac

SEQ ID NO: 618787 - DNA, 23 bp, Homo sapiens
cagagactgcccaccctgggcct

SEQ ID NO: 618788 - DNA, 16 bp, Homo sapiens
cagagatcagaattga

SEQ ID NO: 618789 - DNA, 15 bp, Homo sapiens
cagagatcataaaga

SEQ ID NO: 618790 - DNA, 21 bp, Homo sapiens
cagagattgggggggcttggg

SEQ ID NO: 618791 - DNA, 13 bp, Homo sapiens
cagagcactgtat

SEQ ID NO: 618792 - DNA, 15 bp, Homo sapiens
cagagccccggagca

SEQ ID NO: 618793 - DNA, 14 bp, Homo sapiens
cagagccctgcagt

SEQ ID NO: 618794 - DNA, 18 bp, Homo sapiens
cagagcctatggaaaggg

SEQ ID NO: 618795 - DNA, 21 bp, Homo sapiens
cagagcgatgtgttctttgta

SEQ ID NO: 618796 - DNA, 23 bp, Homo sapiens
cagagcgatgtgttctttgtacc

SEQ ID NO: 618797 - DNA, 13 bp, Homo sapiens
cagagcgcagccc

SEQ ID NO: 618798 - DNA, 19 bp, Homo sapiens
cagagcgcagcccccacgc

SEQ ID NO: 618799 - DNA, 18 bp, Homo sapiens
cagagctgagtcggctgg

SEQ ID NO: 618800 - DNA, 21 bp, Homo sapiens
cagagctgagtcggctgggca

SEQ ID NO: 618801 - DNA, 22 bp, Homo sapiens
cagagctgagtcggctgggcag

SEQ ID NO: 618802 - DNA, 18 bp, Homo sapiens
cagaggaatgtagggcct

SEQ ID NO: 618803 - DNA, 19 bp, Homo sapiens
cagaggaatgtagggcctg

SEQ ID NO: 618804 - DNA, 20 bp, Homo sapiens
cagaggacggcttccccatc

SEQ ID NO: 618805 - DNA, 13 bp, Homo sapiens
cagaggcagggcc

SEQ ID NO: 618806 - DNA, 16 bp, Homo sapiens
cagaggcagggccctg

SEQ ID NO: 618807 - DNA, 15 bp, Homo sapiens
cagagtaggtgggtc

SEQ ID NO: 618808 - DNA, 21 bp, Homo sapiens
cagagtaggtgggtcttggat

SEQ ID NO: 618809 - DNA, 16 bp, Homo sapiens
cagagtcaagctgatg

SEQ ID NO: 618810 - DNA, 18 bp, Homo sapiens
cagagtcttgctacctca

SEQ ID NO: 618811 - DNA, 13 bp, Homo sapiens
cagagtgccctgg

SEQ ID NO: 618812 - DNA, 16 bp, Homo sapiens
cagagtgccctggggc

SEQ ID NO: 618813 - DNA, 19 bp, Homo sapiens
cagagtgccctggggcatc

SEQ ID NO: 618814 - DNA, 17 bp, Homo sapiens
cagatcacatgcccctc

SEQ ID NO: 618815 - DNA, 19 bp, Homo sapiens
cagatccctcggtcagcac

SEQ ID NO: 618816 - DNA, 20 bp, Homo sapiens
cagatccctcggtcagcacc

SEQ ID NO: 618817 - DNA, 15 bp, Homo sapiens
cagatctcatagatg

SEQ ID NO: 618818 - DNA, 16 bp, Homo sapiens
cagatcttgagcaagg

SEQ ID NO: 618819 - DNA, 22 bp, Homo sapiens
cagatgagattccctctcctcc

SEQ ID NO: 618820 - DNA, 18 bp, Homo sapiens
cagatgatgggagtggga

SEQ ID NO: 618821 - DNA, 14 bp, Homo sapiens
cagatggggcctgg

SEQ ID NO: 618822 - DNA, 18 bp, Homo sapiens
cagatgtttccaagatgt

SEQ ID NO: 618823 - DNA, 15 bp, Homo sapiens
cagattattttctat

SEQ ID NO: 618824 - DNA, 18 bp, Homo sapiens
cagattattttctatatt

SEQ ID NO: 618825 - DNA, 16 bp, Homo sapiens
cagatttccaaaagta

SEQ ID NO: 618826 - DNA, 18 bp, Homo sapiens
cagattttaggaaatgaa

SEQ ID NO: 618827 - DNA, 16 bp, Homo sapiens
cagcaaacacagtcac

SEQ ID NO: 618828 - DNA, 16 bp, Homo sapiens
cagcaaccagagcact

SEQ ID NO: 618829 - DNA, 17 bp, Homo sapiens
cagcaaccagagcactg

SEQ ID NO: 618830 - DNA, 20 bp, Homo sapiens
cagcaaccagagcactgtat

SEQ ID NO: 618831 - DNA, 21 bp, Homo sapiens
cagcaaccagagcactgtata

SEQ ID NO: 618832 - DNA, 15 bp, Homo sapiens
cagcacaagggcaca

SEQ ID NO: 618833 - DNA, 20 bp, Homo sapiens
cagcacacacaaacctactg

SEQ ID NO: 618834 - DNA, 16 bp, Homo sapiens
cagcaccagcctgagc

SEQ ID NO: 618835 - DNA, 18 bp, Homo sapiens
cagcaccagcctgagcca

SEQ ID NO: 618836 - DNA, 19 bp, Homo sapiens
cagcaccagcctgagccac

SEQ ID NO: 618837 - DNA, 20 bp, Homo sapiens
cagcacctcctccgtgggca

SEQ ID NO: 618838 - DNA, 22 bp, Homo sapiens
cagcacctcctccgtgggcagc

SEQ ID NO: 618839 - DNA, 14 bp, Homo sapiens
cagcacctgtcacc

SEQ ID NO: 618840 - DNA, 14 bp, Homo sapiens
cagcagacattgtc

SEQ ID NO: 618841 - DNA, 17 bp, Homo sapiens
cagcagacattgtcagc

SEQ ID NO: 618842 - DNA, 14 bp, Homo sapiens
cagcagcagcagca

SEQ ID NO: 618843 - DNA, 16 bp, Homo sapiens
cagcagccccctgccc

SEQ ID NO: 618844 - DNA, 15 bp, Homo sapiens
cagcagcgcccgagg

SEQ ID NO: 618845 - DNA, 18 bp, Homo sapiens
cagcagcggcagcagcag

SEQ ID NO: 618846 - DNA, 23 bp, Homo sapiens
cagcaggaggacagagtgccctg

SEQ ID NO: 618847 - DNA, 15 bp, Homo sapiens
cagcaggggggttgg

SEQ ID NO: 618848 - DNA, 22 bp, Homo sapiens
cagcaggggggttgggttccag

SEQ ID NO: 618849 - DNA, 13 bp, Homo sapiens
cagcaggtgctgt

SEQ ID NO: 618850 - DNA, 24 bp, Homo sapiens
cagcaggttgtgtgtgtgtgcagt

SEQ ID NO: 618851 - DNA, 18 bp, Homo sapiens
cagcagtaccatcccact

SEQ ID NO: 618852 - DNA, 21 bp, Homo sapiens
cagcatagttctgcaataaca

SEQ ID NO: 618853 - DNA, 12 bp, Homo sapiens
cagcatatatat

SEQ ID NO: 618854 - DNA, 21 bp, Homo sapiens
cagcatcctggaaatttgtgt

SEQ ID NO: 618855 - DNA, 17 bp, Homo sapiens
cagcatgcatttagcat

SEQ ID NO: 618856 - DNA, 22 bp, Homo sapiens
cagcatgcatttagcatgagtt

SEQ ID NO: 618857 - DNA, 15 bp, Homo sapiens
cagccaatttcaaag

SEQ ID NO: 618858 - DNA, 22 bp, Homo sapiens
cagccaatttcaaagaaaacag

SEQ ID NO: 618859 - DNA, 17 bp, Homo sapiens
cagcccagaacgggcct

SEQ ID NO: 618860 - DNA, 16 bp, Homo sapiens
cagcccatcccctgcc

SEQ ID NO: 618861 - DNA, 20 bp, Homo sapiens
cagcccatcccctgcctcta

SEQ ID NO: 618862 - DNA, 12 bp, Homo sapiens
cagcccatgctg

SEQ ID NO: 618863 - DNA, 16 bp, Homo sapiens
cagcccatgctggctg

SEQ ID NO: 618864 - DNA, 15 bp, Homo sapiens
cagccccatccttcc

SEQ ID NO: 618865 - DNA, 17 bp, Homo sapiens
cagccccatccttcccg

SEQ ID NO: 618866 - DNA, 21 bp, Homo sapiens
cagccccatccttcccgcagc

SEQ ID NO: 618867 - DNA, 16 bp, Homo sapiens
cagcccccacccatgc

SEQ ID NO: 618868 - DNA, 17 bp, Homo sapiens
cagcccccacccatgcc

SEQ ID NO: 618869 - DNA, 13 bp, Homo sapiens
cagcccccacccc

SEQ ID NO: 618870 - DNA, 13 bp, Homo sapiens
cagtgccttatgg

SEQ ID NO: 618871 - DNA, 15 bp, Homo sapiens
cagtgccttatggaa

SEQ ID NO: 618872 - DNA, 17 bp, Homo sapiens
cagtgccttatggaaca

SEQ ID NO: 618873 - DNA, 21 bp, Homo sapiens
cagtgccttatggaacactct

SEQ ID NO: 618874 - DNA, 18 bp, Homo sapiens
cagtggaagagctgctgt

SEQ ID NO: 618875 - DNA, 23 bp, Homo sapiens
cagtggacatttgttctgggtta

SEQ ID NO: 618876 - DNA, 12 bp, Homo sapiens
cagtggagaggg

SEQ ID NO: 618877 - DNA, 15 bp, Homo sapiens
cagtggcagtattga

SEQ ID NO: 618878 - DNA, 19 bp, Homo sapiens
cagtgggcggcttccctgc

SEQ ID NO: 618879 - DNA, 20 bp, Homo sapiens
cagtgggcggcttccctgcg

SEQ ID NO: 618880 - DNA, 17 bp, Homo sapiens
cagtggggcccatggcc

SEQ ID NO: 618881 - DNA, 20 bp, Homo sapiens
cagtggggtcccccctgagt

SEQ ID NO: 618882 - DNA, 21 bp, Homo sapiens
cagtggggtcccccctgagtg

SEQ ID NO: 618883 - DNA, 17 bp, Homo sapiens
cagtggtccagggtcca

SEQ ID NO: 618884 - DNA, 20 bp, Homo sapiens
cagtggtccagggtccagcc

SEQ ID NO: 618885 - DNA, 14 bp, Homo sapiens
cagtggtgatgcct

SEQ ID NO: 618886 - DNA, 18 bp, Homo sapiens
cagtggttcgggggaaat

SEQ ID NO: 618887 - DNA, 20 bp, Homo sapiens
cagtgtgcttacctgttgtc

SEQ ID NO: 618888 - DNA, 19 bp, Homo sapiens
cagtgtggatgtaaatttt

SEQ ID NO: 618889 - DNA, 11 bp, Homo sapiens
cagtgtggctt

SEQ ID NO: 618890 - DNA, 16 bp, Homo sapiens
cagtgtggcttaaaca

SEQ ID NO: 618891 - DNA, 19 bp, Homo sapiens
cagtgtggcttaaacattt

SEQ ID NO: 618892 - DNA, 16 bp, Homo sapiens
cagtgtgtcacactga

SEQ ID NO: 618893 - DNA, 19 bp, Homo sapiens
cagtgtgtcacactgagct

SEQ ID NO: 618894 - DNA, 16 bp, Homo sapiens
cagtgttataaaatct

SEQ ID NO: 618895 - DNA, 22 bp, Homo sapiens
cagtgttcaaattctgattatt

SEQ ID NO: 618896 - DNA, 16 bp, Homo sapiens
cagtgttctgtttaat

SEQ ID NO: 618897 - DNA, 17 bp, Homo sapiens
cagttaatgtgccaaaa

SEQ ID NO: 618898 - DNA, 14 bp, Homo sapiens
cagttacagtggca

SEQ ID NO: 618899 - DNA, 14 bp, Homo sapiens
cagttacttacaca

SEQ ID NO: 618900 - DNA, 14 bp, Homo sapiens
cagttccctcagcc

SEQ ID NO: 618901 - DNA, 17 bp, Homo sapiens
cagttccctcagccctc

SEQ ID NO: 618902 - DNA, 16 bp, Homo sapiens
cagttctcatcttgta

SEQ ID NO: 618903 - DNA, 20 bp, Homo sapiens
cagttgcaataaactcagtc

SEQ ID NO: 618904 - DNA, 14 bp, Homo sapiens
cagttggcctctgc

SEQ ID NO: 618905 - DNA, 22 bp, Homo sapiens
cagttgtaacattctatttcaa

SEQ ID NO: 618906 - DNA, 13 bp, Homo sapiens
cagtttaacagaa

SEQ ID NO: 618907 - DNA, 17 bp, Homo sapiens
cagtttaggacccaagg

SEQ ID NO: 618908 - DNA, 11 bp, Homo sapiens
cagtttccaag

SEQ ID NO: 618909 - DNA, 20 bp, Homo sapiens
cagtttggccctggagccag

SEQ ID NO: 618910 - DNA, 22 bp, Homo sapiens
cagtttggtatgaaacaaatat

SEQ ID NO: 618911 - DNA, 13 bp, Homo sapiens
cagtttgtgaagt

SEQ ID NO: 618912 - DNA, 23 bp, Homo sapiens
cagtttgtgaagtgattgacatt

SEQ ID NO: 618913 - DNA, 12 bp, Homo sapiens
cagtttgtgatc

SEQ ID NO: 618914 - DNA, 20 bp, Homo sapiens
cataaaacacccttgaaaat

SEQ ID NO: 618915 - DNA, 14 bp, Homo sapiens
cataaacaaagagt

SEQ ID NO: 618916 - DNA, 18 bp, Homo sapiens
cataaagaagatgtttaa

SEQ ID NO: 618917 - DNA, 21 bp, Homo sapiens
cataaagaagatgtttaactt

SEQ ID NO: 618918 - DNA, 23 bp, Homo sapiens
cataaagatcacaccaatttaga

SEQ ID NO: 618919 - DNA, 23 bp, Homo sapiens
cataaatagtaaataatgattca

SEQ ID NO: 618920 - DNA, 16 bp, Homo sapiens
cataagcaggttattt

SEQ ID NO: 618921 - DNA, 14 bp, Homo sapiens
cataatatgcatat

SEQ ID NO: 618922 - DNA, 16 bp, Homo sapiens
cataatgatactgaat

SEQ ID NO: 618923 - DNA, 22 bp, Homo sapiens
cataatgatactgaattgttat

SEQ ID NO: 618924 - DNA, 12 bp, Homo sapiens
catggccttccc

SEQ ID NO: 618925 - DNA, 13 bp, Homo sapiens
catggctgtcccc

SEQ ID NO: 618926 - DNA, 21 bp, Homo sapiens
catggctgtcccctgcaagtg

SEQ ID NO: 618927 - DNA, 21 bp, Homo sapiens
catggctgttatctgtcttta

SEQ ID NO: 618928 - DNA, 16 bp, Homo sapiens
catgggccagcccttg

SEQ ID NO: 618929 - DNA, 15 bp, Homo sapiens
catggtagactgtga

SEQ ID NO: 618930 - DNA, 14 bp, Homo sapiens
catgtaatattaaa

SEQ ID NO: 618931 - DNA, 16 bp, Homo sapiens
catgtaatattaaatt

SEQ ID NO: 618932 - DNA, 19 bp, Homo sapiens
catgtaatattaaattcct

SEQ ID NO: 618933 - DNA, 20 bp, Homo sapiens
catgtacagtgttctgttta

SEQ ID NO: 618934 - DNA, 17 bp, Homo sapiens
catgtatgccatgtatg

SEQ ID NO: 618935 - DNA, 16 bp, Homo sapiens
catgtatgttgcatga

SEQ ID NO: 618936 - DNA, 17 bp, Homo sapiens
catgtatgttgcatgaa

SEQ ID NO: 618937 - DNA, 21 bp, Homo sapiens
catgtattgtgtcttttgcat

SEQ ID NO: 618938 - DNA, 20 bp, Homo sapiens
catgtctttctccaaagtta

SEQ ID NO: 618939 - DNA, 20 bp, Homo sapiens
catgtgatgagaggaaatca

SEQ ID NO: 618940 - DNA, 17 bp, Homo sapiens
catgtgcgaacacagtg

SEQ ID NO: 618941 - DNA, 15 bp, Homo sapiens
catgtgctgctgtgg

SEQ ID NO: 618942 - DNA, 17 bp, Homo sapiens
catgtggggacagggct

SEQ ID NO: 618943 - DNA, 17 bp, Homo sapiens
catgtgtaacttctaga

SEQ ID NO: 618944 - DNA, 15 bp, Homo sapiens
catgtgtttctgtgt

SEQ ID NO: 618945 - DNA, 12 bp, Homo sapiens
catgttaaaata

SEQ ID NO: 618946 - DNA, 18 bp, Homo sapiens
catgttaggaattagaca

SEQ ID NO: 618947 - DNA, 16 bp, Homo sapiens
catgttcttgcagtca

SEQ ID NO: 618948 - DNA, 18 bp, Homo sapiens
catgttgccatgaggcct

SEQ ID NO: 618949 - DNA, 17 bp, Homo sapiens
catgtttaagaaatgag

SEQ ID NO: 618950 - DNA, 18 bp, Homo sapiens
catgtttaagaaatgaga

SEQ ID NO: 618951 - DNA, 22 bp, Homo sapiens
catgtttctgcagtattctgta

SEQ ID NO: 618952 - DNA, 14 bp, Homo sapiens
catgttttacaaag

SEQ ID NO: 618953 - DNA, 16 bp, Homo sapiens
cattaaaacaagagac

SEQ ID NO: 618954 - DNA, 23 bp, Homo sapiens
cattacatcctctgcttgtcatt

SEQ ID NO: 618955 - DNA, 21 bp, Homo sapiens
cattatagcatgtaatattaa

SEQ ID NO: 618956 - DNA, 15 bp, Homo sapiens
cattatttctaccat

SEQ ID NO: 618957 - DNA, 19 bp, Homo sapiens
cattcaaaaagccaaaata

SEQ ID NO: 618958 - DNA, 12 bp, Homo sapiens
cattcactttca

SEQ ID NO: 618959 - DNA, 17 bp, Homo sapiens
cattcagatctgaagta

SEQ ID NO: 618960 - DNA, 19 bp, Homo sapiens
cattcagtctatgctgtgt

SEQ ID NO: 618961 - DNA, 17 bp, Homo sapiens
cattcattcatcctctt

SEQ ID NO: 618962 - DNA, 23 bp, Homo sapiens
cattcatttacaacttccagatt

SEQ ID NO: 618963 - DNA, 23 bp, Homo sapiens
cattcccactaagctttctcctt

SEQ ID NO: 618964 - DNA, 23 bp, Homo sapiens
cattccgttaggaataacactgc

SEQ ID NO: 618965 - DNA, 19 bp, Homo sapiens
cattcctaagagtggagga

SEQ ID NO: 618966 - DNA, 17 bp, Homo sapiens
cattcctgaccctcact

SEQ ID NO: 618967 - DNA, 18 bp, Homo sapiens
cattctggggtggggctt

SEQ ID NO: 618968 - DNA, 20 bp, Homo sapiens
cattctggtccttagtaaat

SEQ ID NO: 618969 - DNA, 22 bp, Homo sapiens
cattcttataacattgtatgtt

SEQ ID NO: 618970 - DNA, 12 bp, Homo sapiens
cattcttgctct

SEQ ID NO: 618971 - DNA, 14 bp, Homo sapiens
cattgacatgtaca

SEQ ID NO: 618972 - DNA, 16 bp, Homo sapiens
cattgacatgtacaga

SEQ ID NO: 618973 - DNA, 17 bp, Homo sapiens
cattgacatgtacagag

SEQ ID NO: 618974 - DNA, 22 bp, Homo sapiens
cattgacatgtacagagaacta

SEQ ID NO: 618975 - DNA, 14 bp, Homo sapiens
cattgcactaaaag

SEQ ID NO: 618976 - DNA, 23 bp, Homo sapiens
cattgcacttcggataattttca

SEQ ID NO: 618977 - DNA, 13 bp, Homo sapiens
cattgccttctgg

SEQ ID NO: 618978 - DNA, 17 bp, Homo sapiens
ccacctccccagagccc

SEQ ID NO: 618979 - DNA, 21 bp, Homo sapiens
ccacctccccagagccctgca

SEQ ID NO: 618980 - DNA, 17 bp, Homo sapiens
ccacctcggacaccatc

SEQ ID NO: 618981 - DNA, 13 bp, Homo sapiens
ccacctgcccagt

SEQ ID NO: 618982 - DNA, 21 bp, Homo sapiens
ccacctgcccagttagcccgg

SEQ ID NO: 618983 - DNA, 14 bp, Homo sapiens
ccacctggtggccc

SEQ ID NO: 618984 - DNA, 17 bp, Homo sapiens
ccacctggtggccctgc

SEQ ID NO: 618985 - DNA, 19 bp, Homo sapiens
ccaccttcaagcaccctgt

SEQ ID NO: 618986 - DNA, 17 bp, Homo sapiens
ccaccttcctgcccagg

SEQ ID NO: 618987 - DNA, 23 bp, Homo sapiens
ccaccttgtacagaaccagcact

SEQ ID NO: 618988 - DNA, 20 bp, Homo sapiens
ccacgaggagcttccagtgc

SEQ ID NO: 618989 - DNA, 16 bp, Homo sapiens
ccacgcagagccccgg

SEQ ID NO: 618990 - DNA, 17 bp, Homo sapiens
ccacgcagagccccgga

SEQ ID NO: 618991 - DNA, 19 bp, Homo sapiens
ccacgcagagccccggagc

SEQ ID NO: 618992 - DNA, 20 bp, Homo sapiens
ccacgcagagccccggagca

SEQ ID NO: 618993 - DNA, 17 bp, Homo sapiens
ccacggccgtccctgac

SEQ ID NO: 618994 - DNA, 18 bp, Homo sapiens
ccacggtccaatccagcc

SEQ ID NO: 618995 - DNA, 14 bp, Homo sapiens
ccacgtgtgcagac

SEQ ID NO: 618996 - DNA, 18 bp, Homo sapiens
ccactaagctttctcctt

SEQ ID NO: 618997 - DNA, 14 bp, Homo sapiens
ccactacctttgtc

SEQ ID NO: 618998 - DNA, 19 bp, Homo sapiens
ccactagccctctttctct

SEQ ID NO: 618999 - DNA, 20 bp, Homo sapiens
ccactagccctctttctctc

SEQ ID NO: 619000 - DNA, 18 bp, Homo sapiens
ccactcaggcagcctgtg

SEQ ID NO: 619001 - DNA, 20 bp, Homo sapiens
ccactcaggcagcctgtggg

SEQ ID NO: 619002 - DNA, 13 bp, Homo sapiens
ccactcccctcat

SEQ ID NO: 619003 - DNA, 11 bp, Homo sapiens
ccactcctccc

SEQ ID NO: 619004 - DNA, 17 bp, Homo sapiens
ccactcctcccaactct

SEQ ID NO: 619005 - DNA, 18 bp, Homo sapiens
ccactcctcccaactctg

SEQ ID NO: 619006 - DNA, 22 bp, Homo sapiens
ccactcctcccaactctggcct

SEQ ID NO: 619007 - DNA, 22 bp, Homo sapiens
ccactctgaagtcccttcctgt

SEQ ID NO: 619008 - DNA, 17 bp, Homo sapiens
ccactgaatctgagaaa

SEQ ID NO: 619009 - DNA, 14 bp, Homo sapiens
ccacttatttccat

SEQ ID NO: 619010 - DNA, 13 bp, Homo sapiens
ccacttccttaac

SEQ ID NO: 619011 - DNA, 13 bp, Homo sapiens
ccagaaagaggaa

SEQ ID NO: 619012 - DNA, 14 bp, Homo sapiens
ccagaaagaggaat

SEQ ID NO: 619013 - DNA, 22 bp, Homo sapiens
ccagaaagaggaataaaatgat

SEQ ID NO: 619014 - DNA, 17 bp, Homo sapiens
ccagaacgcatgcaggg

SEQ ID NO: 619015 - DNA, 19 bp, Homo sapiens
ccagaacgcatgcagggcc

SEQ ID NO: 619016 - DNA, 17 bp, Homo sapiens
ccagaacgggcctcccc

SEQ ID NO: 619017 - DNA, 20 bp, Homo sapiens
ccagaacgggcctccccggg

SEQ ID NO: 619018 - DNA, 14 bp, Homo sapiens
ccagaagcagcagc

SEQ ID NO: 619019 - DNA, 18 bp, Homo sapiens
ccagacagagtggatctg

SEQ ID NO: 619020 - DNA, 12 bp, Homo sapiens
ccagacccctac

SEQ ID NO: 619021 - DNA, 21 bp, Homo sapiens
ccagacccctaccctttccca

SEQ ID NO: 619022 - DNA, 17 bp, Homo sapiens
ccagagactgcccaccc

SEQ ID NO: 619023 - DNA, 21 bp, Homo sapiens
ccagagactgcccaccctggg

SEQ ID NO: 619024 - DNA, 22 bp, Homo sapiens
ccagagactgcccaccctgggc

SEQ ID NO: 619025 - DNA, 12 bp, Homo sapiens
ccagagagaagc

SEQ ID NO: 619026 - DNA, 17 bp, Homo sapiens
ccagagccactaccttt

SEQ ID NO: 619027 - DNA, 14 bp, Homo sapiens
ccagagccctgcag

SEQ ID NO: 619028 - DNA, 19 bp, Homo sapiens
ccagagccctgcagtcacg

SEQ ID NO: 619029 - DNA, 14 bp, Homo sapiens
ccagatttcactct

SEQ ID NO: 619030 - DNA, 15 bp, Homo sapiens
ccagatttcactctc

SEQ ID NO: 619031 - DNA, 18 bp, Homo sapiens
ccagatttcactctcctt

SEQ ID NO: 619032 - DNA, 10 bp, Homo sapiens
ccagcaaaag

SEQ ID NO: 619033 - DNA, 10 bp, Homo sapiens
ccagcaaaat

SEQ ID NO: 619034 - DNA, 14 bp, Homo sapiens
ccagcaaaatatat

SEQ ID NO: 619035 - DNA, 18 bp, Homo sapiens
ccagcaaagttttcagat

SEQ ID NO: 619036 - DNA, 23 bp, Homo sapiens
ccagcaacattataatggccctg

SEQ ID NO: 619037 - DNA, 17 bp, Homo sapiens
ccagcaacttttctcat

SEQ ID NO: 619038 - DNA, 17 bp, Homo sapiens
ccagcaatgcctgcctg

SEQ ID NO: 619039 - DNA, 19 bp, Homo sapiens
ccagcacctcctccgtggg

SEQ ID NO: 619040 - DNA, 17 bp, Homo sapiens
ccagcactcccagggcc

SEQ ID NO: 619041 - DNA, 13 bp, Homo sapiens
ccagcagacattg

SEQ ID NO: 619042 - DNA, 14 bp, Homo sapiens
ccagcagacattgt

SEQ ID NO: 619043 - DNA, 15 bp, Homo sapiens
ccagcagcgcccgag

SEQ ID NO: 619044 - DNA, 12 bp, Homo sapiens
ccagcagctcac

SEQ ID NO: 619045 - DNA, 15 bp, Homo sapiens
ccagcagtgaatgct

SEQ ID NO: 619046 - DNA, 16 bp, Homo sapiens
ccagccaagcctgact

SEQ ID NO: 619047 - DNA, 18 bp, Homo sapiens
ccagccatgcccacgccc

SEQ ID NO: 619048 - DNA, 16 bp, Homo sapiens
catacgcaattgtata

SEQ ID NO: 619049 - DNA, 17 bp, Homo sapiens
catacgtgcccatttca

SEQ ID NO: 619050 - DNA, 16 bp, Homo sapiens
catacgttttctgcaa

SEQ ID NO: 619051 - DNA, 22 bp, Homo sapiens
catactgatgagacaacacaca

SEQ ID NO: 619052 - DNA, 23 bp, Homo sapiens
catactgatgagacaacacacac

SEQ ID NO: 619053 - DNA, 15 bp, Homo sapiens
catagagctatatat

SEQ ID NO: 619054 - DNA, 18 bp, Homo sapiens
catagataccattttgaa

SEQ ID NO: 619055 - DNA, 20 bp, Homo sapiens
catagataccattttgaaat

SEQ ID NO: 619056 - DNA, 20 bp, Homo sapiens
catagatagatcccacgttg

SEQ ID NO: 619057 - DNA, 16 bp, Homo sapiens
catagcatagccagca

SEQ ID NO: 619058 - DNA, 18 bp, Homo sapiens
catagcatagccagcatt

SEQ ID NO: 619059 - DNA, 15 bp, Homo sapiens
catagccattcattt

SEQ ID NO: 619060 - DNA, 19 bp, Homo sapiens
catagccattcatttacaa

SEQ ID NO: 619061 - DNA, 21 bp, Homo sapiens
catagccattcatttacaact

SEQ ID NO: 619062 - DNA, 15 bp, Homo sapiens
catagccccaggccc

SEQ ID NO: 619063 - DNA, 18 bp, Homo sapiens
catagccccaggcccgcc

SEQ ID NO: 619064 - DNA, 23 bp, Homo sapiens
catagccccaggcccgccctgcc

SEQ ID NO: 619065 - DNA, 21 bp, Homo sapiens
catagctttagagaagccata

SEQ ID NO: 619066 - DNA, 15 bp, Homo sapiens
catagggtttggaag

SEQ ID NO: 619067 - DNA, 22 bp, Homo sapiens
catagtgtctgctgctgcctcc

SEQ ID NO: 619068 - DNA, 13 bp, Homo sapiens
catagttctgcaa

SEQ ID NO: 619069 - DNA, 16 bp, Homo sapiens
catagttctgcaataa

SEQ ID NO: 619070 - DNA, 13 bp, Homo sapiens
catagttttcacc

SEQ ID NO: 619071 - DNA, 21 bp, Homo sapiens
catataggggcaaaaatttga

SEQ ID NO: 619072 - DNA, 14 bp, Homo sapiens
catatatataaaat

SEQ ID NO: 619073 - DNA, 17 bp, Homo sapiens
catatatataaaataca

SEQ ID NO: 619074 - DNA, 23 bp, Homo sapiens
catatggcaacgttcatgttcat

SEQ ID NO: 619075 - DNA, 14 bp, Homo sapiens
catattatatcaga

SEQ ID NO: 619076 - DNA, 17 bp, Homo sapiens
catattattttctgggt

SEQ ID NO: 619077 - DNA, 14 bp, Homo sapiens
catatttcataagc

SEQ ID NO: 619078 - DNA, 21 bp, Homo sapiens
catatttcataagcacatcca

SEQ ID NO: 619079 - DNA, 23 bp, Homo sapiens
catattttcctttatgtgatgta

SEQ ID NO: 619080 - DNA, 12 bp, Homo sapiens
catcaaagccct

SEQ ID NO: 619081 - DNA, 14 bp, Homo sapiens
catcaaagccctcc

SEQ ID NO: 619082 - DNA, 22 bp, Homo sapiens
catcaagaaacattcagaccag

SEQ ID NO: 619083 - DNA, 13 bp, Homo sapiens
catcagtcaattg

SEQ ID NO: 619084 - DNA, 14 bp, Homo sapiens
catcattgaaatct

SEQ ID NO: 619085 - DNA, 16 bp, Homo sapiens
catccaccttcctgcc

SEQ ID NO: 619086 - DNA, 17 bp, Homo sapiens
catccaccttcctgccc

SEQ ID NO: 619087 - DNA, 23 bp, Homo sapiens
catccaccttcctgcccagggga

SEQ ID NO: 619088 - DNA, 23 bp, Homo sapiens
catccatactgtttaatatttat

SEQ ID NO: 619089 - DNA, 22 bp, Homo sapiens
catcccactgatatcacgggcc

SEQ ID NO: 619090 - DNA, 18 bp, Homo sapiens
catcccttggcccctctc

SEQ ID NO: 619091 - DNA, 19 bp, Homo sapiens
catcccttggcccctctct

SEQ ID NO: 619092 - DNA, 14 bp, Homo sapiens
catccgagcccctg

SEQ ID NO: 619093 - DNA, 18 bp, Homo sapiens
catccgctgcgctcccac

SEQ ID NO: 619094 - DNA, 17 bp, Homo sapiens
catcctcttatatgtgc

SEQ ID NO: 619095 - DNA, 16 bp, Homo sapiens
catcctgccttcatgg

SEQ ID NO: 619096 - DNA, 15 bp, Homo sapiens
catcctggaaatttg

SEQ ID NO: 619097 - DNA, 18 bp, Homo sapiens
catccttcccgcagcacc

SEQ ID NO: 619098 - DNA, 20 bp, Homo sapiens
catccttcccgcagcaccag

SEQ ID NO: 619099 - DNA, 23 bp, Homo sapiens
catccttcccgcagcaccagcct

SEQ ID NO: 619100 - DNA, 17 bp, Homo sapiens
catccttgcacttctgt

SEQ ID NO: 619101 - DNA, 22 bp, Homo sapiens
catccttttttaaaaaaaagaa

SEQ ID NO: 619102 - DNA, 15 bp, Homo sapiens
catcgatttgtatta

SEQ ID NO: 619103 - DNA, 12 bp, Homo sapiens
catcgcctggga

SEQ ID NO: 619104 - DNA, 12 bp, Homo sapiens
catctaaaccac

SEQ ID NO: 619105 - DNA, 15 bp, Homo sapiens
catctaaatattatg

SEQ ID NO: 619106 - DNA, 21 bp, Homo sapiens
catctcaggtggcatttgcag

SEQ ID NO: 619107 - DNA, 16 bp, Homo sapiens
ccagcccatgctggct

SEQ ID NO: 619108 - DNA, 18 bp, Homo sapiens
ccagcccccacccatgcc

SEQ ID NO: 619109 - DNA, 22 bp, Homo sapiens
ccagcccccacccatgccagcg

SEQ ID NO: 619110 - DNA, 13 bp, Homo sapiens
ccagccctccgcc

SEQ ID NO: 619111 - DNA, 16 bp, Homo sapiens
ccagccctgggcaagg

SEQ ID NO: 619112 - DNA, 21 bp, Homo sapiens
ccagccctgttccgcctcact

SEQ ID NO: 619113 - DNA, 23 bp, Homo sapiens
ccagccctgttccgcctcactgg

SEQ ID NO: 619114 - DNA, 23 bp, Homo sapiens
ccagcctcccccaggctgcgcct

SEQ ID NO: 619115 - DNA, 20 bp, Homo sapiens
ccagcctcgttggagagcag

SEQ ID NO: 619116 - DNA, 20 bp, Homo sapiens
ccagcctcttgctcagagct

SEQ ID NO: 619117 - DNA, 16 bp, Homo sapiens
ccagcctgccaggccc

SEQ ID NO: 619118 - DNA, 21 bp, Homo sapiens
ccagcgcagcgccagggctca

SEQ ID NO: 619119 - DNA, 16 bp, Homo sapiens
ccagcggggcttctgg

SEQ ID NO: 619120 - DNA, 20 bp, Homo sapiens
ccagctcaggctactgccac

SEQ ID NO: 619121 - DNA, 19 bp, Homo sapiens
ccagctctggatgaaggca

SEQ ID NO: 619122 - DNA, 16 bp, Homo sapiens
ccagctgcaggaatca

SEQ ID NO: 619123 - DNA, 19 bp, Homo sapiens
ccagctgcaggaatcaaaa

SEQ ID NO: 619124 - DNA, 15 bp, Homo sapiens
ccagctggcagcgcc

SEQ ID NO: 619125 - DNA, 13 bp, Homo sapiens
ccagctggctggg

SEQ ID NO: 619126 - DNA, 20 bp, Homo sapiens
ccagctggctgggtcgcccc

SEQ ID NO: 619127 - DNA, 14 bp, Homo sapiens
ccagcttgcttctc

SEQ ID NO: 619128 - DNA, 11 bp, Homo sapiens
ccaggaccccc

SEQ ID NO: 619129 - DNA, 12 bp, Homo sapiens
ccaggacccccc

SEQ ID NO: 619130 - DNA, 13 bp, Homo sapiens
ccaggagaccctg

SEQ ID NO: 619131 - DNA, 17 bp, Homo sapiens
ccaggagaccctgtctt

SEQ ID NO: 619132 - DNA, 16 bp, Homo sapiens
ccaggagctagcccag

SEQ ID NO: 619133 - DNA, 13 bp, Homo sapiens
ccaggaggacctg

SEQ ID NO: 619134 - DNA, 21 bp, Homo sapiens
ccaggatgaaggggccagacc

SEQ ID NO: 619135 - DNA, 18 bp, Homo sapiens
ccaggcacggaggctcgt

SEQ ID NO: 619136 - DNA, 22 bp, Homo sapiens
ccaggccctaggattcctcccc

SEQ ID NO: 619137 - DNA, 13 bp, Homo sapiens
ccaggccctccag

SEQ ID NO: 619138 - DNA, 24 bp, Homo sapiens
ccaggcggaggggcttggagcaga

SEQ ID NO: 619139 - DNA, 16 bp, Homo sapiens
ccaggctagactagga

SEQ ID NO: 619140 - DNA, 13 bp, Homo sapiens
ccaggctgcgcct

SEQ ID NO: 619141 - DNA, 18 bp, Homo sapiens
ccaggctgcgcctgcccg

SEQ ID NO: 619142 - DNA, 17 bp, Homo sapiens
ccagggaggtggcaggg

SEQ ID NO: 619143 - DNA, 14 bp, Homo sapiens
ccagggcagaggaa

SEQ ID NO: 619144 - DNA, 15 bp, Homo sapiens
ccagggcagaggaat

SEQ ID NO: 619145 - DNA, 17 bp, Homo sapiens
ccaggggacgtggcgct

SEQ ID NO: 619146 - DNA, 16 bp, Homo sapiens
ccaggggcaggcagct

SEQ ID NO: 619147 - DNA, 21 bp, Homo sapiens
ccaggggcttctccccctcag

SEQ ID NO: 619148 - DNA, 18 bp, Homo sapiens
ccagggtccagccctccg

SEQ ID NO: 619149 - DNA, 15 bp, Homo sapiens
ccagggtcctgagtg

SEQ ID NO: 619150 - DNA, 20 bp, Homo sapiens
ccagggtcctgggggctgct

SEQ ID NO: 619151 - DNA, 18 bp, Homo sapiens
cccaaggtggtcttggag

SEQ ID NO: 619152 - DNA, 21 bp, Homo sapiens
cccaagtcaaacagtgtggct

SEQ ID NO: 619153 - DNA, 21 bp, Homo sapiens
cccaagtcctcgccccccgcc

SEQ ID NO: 619154 - DNA, 19 bp, Homo sapiens
cccaattatcaaaaaacag

SEQ ID NO: 619155 - DNA, 19 bp, Homo sapiens
cccaattatcctccttcac

SEQ ID NO: 619156 - DNA, 18 bp, Homo sapiens
cccacaccccgtctgccc

SEQ ID NO: 619157 - DNA, 16 bp, Homo sapiens
cccacacgccggggct

SEQ ID NO: 619158 - DNA, 20 bp, Homo sapiens
cccacacgccggggctggcc

SEQ ID NO: 619159 - DNA, 12 bp, Homo sapiens
cccacagaaatc

SEQ ID NO: 619160 - DNA, 19 bp, Homo sapiens
cccaccacacacacccttc

SEQ ID NO: 619161 - DNA, 16 bp, Homo sapiens
cccacccacaccccgt

SEQ ID NO: 619162 - DNA, 21 bp, Homo sapiens
cccacccacaccccgtctgcc

SEQ ID NO: 619163 - DNA, 13 bp, Homo sapiens
cccacccagcagc

SEQ ID NO: 619164 - DNA, 18 bp, Homo sapiens
cccacccatgccagcgca

SEQ ID NO: 619165 - DNA, 16 bp, Homo sapiens
cccaccccgctgcctg

SEQ ID NO: 619166 - DNA, 22 bp, Homo sapiens
cccaccccgctgcctggcgggc

SEQ ID NO: 619167 - DNA, 17 bp, Homo sapiens
cccacccgccccagaga

SEQ ID NO: 619168 - DNA, 14 bp, Homo sapiens
cccaccctgggcct

SEQ ID NO: 619169 - DNA, 22 bp, Homo sapiens
cccacctaaagggaagccctga

SEQ ID NO: 619170 - DNA, 16 bp, Homo sapiens
cccacctccccagagc

SEQ ID NO: 619171 - DNA, 18 bp, Homo sapiens
cccacctccccagagccc

SEQ ID NO: 619172 - DNA, 20 bp, Homo sapiens
cccacctccccagagccctg

SEQ ID NO: 619173 - DNA, 14 bp, Homo sapiens
cccacctcccggtg

SEQ ID NO: 619174 - DNA, 14 bp, Homo sapiens
cccacctgcccagt

SEQ ID NO: 619175 - DNA, 16 bp, Homo sapiens
cccacctgcccagtta

SEQ ID NO: 619176 - DNA, 21 bp, Homo sapiens
cccacgcagagccccggagca

SEQ ID NO: 619177 - DNA, 20 bp, Homo sapiens
cccacgcccctccccagccc

SEQ ID NO: 619178 - DNA, 21 bp, Homo sapiens
cccacgccgatataagccata

SEQ ID NO: 619179 - DNA, 13 bp, Homo sapiens
cccacggccgtcc

SEQ ID NO: 619180 - DNA, 23 bp, Homo sapiens
cccacggccgtccctgacttccc

SEQ ID NO: 619181 - DNA, 16 bp, Homo sapiens
cccacgtgtgcagact

SEQ ID NO: 619182 - DNA, 17 bp, Homo sapiens
cccacgtgtgcagactg

SEQ ID NO: 619183 - DNA, 16 bp, Homo sapiens
cccactaagctttctc

SEQ ID NO: 619184 - DNA, 20 bp, Homo sapiens
cccactaagctttctccttt

SEQ ID NO: 619185 - DNA, 22 bp, Homo sapiens
cccactaagctttctcctttga

SEQ ID NO: 619186 - DNA, 15 bp, Homo sapiens
cccactagccctctt

SEQ ID NO: 619187 - DNA, 20 bp, Homo sapiens
cccactgatatcacgggccc

SEQ ID NO: 619188 - DNA, 19 bp, Homo sapiens
cccactgcccctgcacctg

SEQ ID NO: 619189 - DNA, 15 bp, Homo sapiens
cccagaacgggcctc

SEQ ID NO: 619190 - DNA, 16 bp, Homo sapiens
cccagaacgggcctcc

SEQ ID NO: 619191 - DNA, 18 bp, Homo sapiens
cccagaacgggcctcccc

SEQ ID NO: 619192 - DNA, 13 bp, Homo sapiens
ccggtaggctgct

SEQ ID NO: 619193 - DNA, 15 bp, Homo sapiens
ccggtaggctgctgg

SEQ ID NO: 619194 - DNA, 17 bp, Homo sapiens
ccggtaggctgctggcg

SEQ ID NO: 619195 - DNA, 13 bp, Homo sapiens
ccggtccaccccg

SEQ ID NO: 619196 - DNA, 13 bp, Homo sapiens
ccggttccacgtg

SEQ ID NO: 619197 - DNA, 18 bp, Homo sapiens
ccgtcaccccgctcttcc

SEQ ID NO: 619198 - DNA, 20 bp, Homo sapiens
ccgtcaccccgctcttccca

SEQ ID NO: 619199 - DNA, 15 bp, Homo sapiens
ccgtcagcctgtgaa

SEQ ID NO: 619200 - DNA, 14 bp, Homo sapiens
ccgtcccggccccg

SEQ ID NO: 619201 - DNA, 13 bp, Homo sapiens
ccgtccctttccc

SEQ ID NO: 619202 - DNA, 15 bp, Homo sapiens
ccgtccctttccctg

SEQ ID NO: 619203 - DNA, 16 bp, Homo sapiens
ccgtccctttccctgc

SEQ ID NO: 619204 - DNA, 18 bp, Homo sapiens
ccgtccgcccgcccaccc

SEQ ID NO: 619205 - DNA, 14 bp, Homo sapiens
ccgtcctgctcgcc

SEQ ID NO: 619206 - DNA, 11 bp, Homo sapiens
ccgtctgcccc

SEQ ID NO: 619207 - DNA, 21 bp, Homo sapiens
ccgtctgccccttgaccccac

SEQ ID NO: 619208 - DNA, 14 bp, Homo sapiens
ccgtgcggcccgtg

SEQ ID NO: 619209 - DNA, 20 bp, Homo sapiens
ccgtgcggcccgtgcgcagc

SEQ ID NO: 619210 - DNA, 15 bp, Homo sapiens
ccgtgctcacagtag

SEQ ID NO: 619211 - DNA, 23 bp, Homo sapiens
ccgtggagcttggagccccctgg

SEQ ID NO: 619212 - DNA, 15 bp, Homo sapiens
ccgtggtgtcctctg

SEQ ID NO: 619213 - DNA, 17 bp, Homo sapiens
ccgtggtgtcctctgtc

SEQ ID NO: 619214 - DNA, 23 bp, Homo sapiens
ccgttagggaaatccaactccag

SEQ ID NO: 619215 - DNA, 14 bp, Homo sapiens
ccgttcatctgagg

SEQ ID NO: 619216 - DNA, 14 bp, Homo sapiens
ccgttcccagcgca

SEQ ID NO: 619217 - DNA, 18 bp, Homo sapiens
ccgttgttgtccctgcag

SEQ ID NO: 619218 - DNA, 13 bp, Homo sapiens
cctaaatgcaaag

SEQ ID NO: 619219 - DNA, 14 bp, Homo sapiens
cctaaatgcaaagc

SEQ ID NO: 619220 - DNA, 19 bp, Homo sapiens
cctaactccctaggcctga

SEQ ID NO: 619221 - DNA, 15 bp, Homo sapiens
cctaagagtggagga

SEQ ID NO: 619222 - DNA, 23 bp, Homo sapiens
cctaatccacctggtggccctgc

SEQ ID NO: 619223 - DNA, 17 bp, Homo sapiens
cctaattcctgtatgtt

SEQ ID NO: 619224 - DNA, 23 bp, Homo sapiens
cctacatctgaaatctacaacat

SEQ ID NO: 619225 - DNA, 15 bp, Homo sapiens
cctactccacctgtt

SEQ ID NO: 619226 - DNA, 12 bp, Homo sapiens
cctactgcccac

SEQ ID NO: 619227 - DNA, 15 bp, Homo sapiens
cctacttaaacaaaa

SEQ ID NO: 619228 - DNA, 21 bp, Homo sapiens
cctagcctctccgcccacgcg

SEQ ID NO: 619229 - DNA, 16 bp, Homo sapiens
cctaggattcctcccc

SEQ ID NO: 619230 - DNA, 17 bp, Homo sapiens
cctaggattcctccccc

SEQ ID NO: 619231 - DNA, 18 bp, Homo sapiens
cctaggtctccacccctc

SEQ ID NO: 619232 - DNA, 23 bp, Homo sapiens
cctatcatcagttaggattaggt

SEQ ID NO: 619233 - DNA, 13 bp, Homo sapiens
cctatccctggac

SEQ ID NO: 619234 - DNA, 17 bp, Homo sapiens
cctatcctgcaccctct

SEQ ID NO: 619235 - DNA, 14 bp, Homo sapiens
cctatctcccacaa

SEQ ID NO: 619236 - DNA, 23 bp, Homo sapiens
cctattgctgtaaataaaaatag

SEQ ID NO: 619237 - DNA, 20 bp, Homo sapiens
cctattttggacgtgtgagg

SEQ ID NO: 619238 - DNA, 19 bp, Homo sapiens
cctcaagccaggagaccct

SEQ ID NO: 619239 - DNA, 23 bp, Homo sapiens
cctcaagccaggagaccctgtct

SEQ ID NO: 619240 - DNA, 16 bp, Homo sapiens
cctcaagttgtgtgct

SEQ ID NO: 619241 - DNA, 21 bp, Homo sapiens
cctcaattatcttggaaaaat

SEQ ID NO: 619242 - DNA, 15 bp, Homo sapiens
cctcacagcctctcc

SEQ ID NO: 619243 - DNA, 17 bp, Homo sapiens
cctcacagcctctccct

SEQ ID NO: 619244 - DNA, 23 bp, Homo sapiens
cctcacccactttggcctccgtt

SEQ ID NO: 619245 - DNA, 12 bp, Homo sapiens
cctcacctctga

SEQ ID NO: 619246 - DNA, 14 bp, Homo sapiens
cctcacctctgagg

SEQ ID NO: 619247 - DNA, 15 bp, Homo sapiens
cctcacctctgagga

SEQ ID NO: 619248 - DNA, 16 bp, Homo sapiens
cctcacctctgaggac

SEQ ID NO: 619249 - DNA, 19 bp, Homo sapiens
cctcactccactcccctca

SEQ ID NO: 619250 - DNA, 21 bp, Homo sapiens
cctcactgggtgtggcctggc

SEQ ID NO: 619251 - DNA, 22 bp, Homo sapiens
cctcactgggtgtggcctggct

SEQ ID NO: 619252 - DNA, 21 bp, Homo sapiens
cctcactgtgacctgctcctg

SEQ ID NO: 619253 - DNA, 17 bp, Homo sapiens
cctcagcgtctccccat

SEQ ID NO: 619254 - DNA, 18 bp, Homo sapiens
cctcagctctccctcaca

SEQ ID NO: 619255 - DNA, 16 bp, Homo sapiens
cctcagttggcctctg

SEQ ID NO: 619256 - DNA, 18 bp, Homo sapiens
cctcagttggcctctgcc

SEQ ID NO: 619257 - DNA, 22 bp, Homo sapiens
cctcatagcatagccagcattc

SEQ ID NO: 619258 - DNA, 18 bp, Homo sapiens
cctcatgaccctcctgtc

SEQ ID NO: 619259 - DNA, 20 bp, Homo sapiens
cctcatgaccctcctgtcca

SEQ ID NO: 619260 - DNA, 13 bp, Homo sapiens
cctccacacctcc

SEQ ID NO: 619261 - DNA, 14 bp, Homo sapiens
cctccactcctccc

SEQ ID NO: 619262 - DNA, 10 bp, Homo sapiens
cctccagacc

SEQ ID NO: 619263 - DNA, 22 bp, Homo sapiens
cctccagactcgagagggctga

SEQ ID NO: 619264 - DNA, 17 bp, Homo sapiens
cctccagattattttct

SEQ ID NO: 619265 - DNA, 20 bp, Homo sapiens
cctccagattattttctata

SEQ ID NO: 619266 - DNA, 17 bp, Homo sapiens
cctccagcaatgcctgc

SEQ ID NO: 619267 - DNA, 14 bp, Homo sapiens
cctccatgccccag

SEQ ID NO: 619268 - DNA, 15 bp, Homo sapiens
cctccatgctgtccc

SEQ ID NO: 619269 - DNA, 16 bp, Homo sapiens
cctccatgctgtccct

SEQ ID NO: 619270 - DNA, 18 bp, Homo sapiens
cctccatgctgtccctgt

SEQ ID NO: 619271 - DNA, 16 bp, Homo sapiens
cctcccaactctggcc

SEQ ID NO: 619272 - DNA, 12 bp, Homo sapiens
cctcccatggcc

SEQ ID NO: 619273 - DNA, 18 bp, Homo sapiens
cctcccatggccttccct

SEQ ID NO: 619274 - DNA, 18 bp, Homo sapiens
cctccccagagccctgca

SEQ ID NO: 619275 - DNA, 14 bp, Homo sapiens
cctcccccagagcc

SEQ ID NO: 619276 - DNA, 15 bp, Homo sapiens
cctcccccagagcca

SEQ ID NO: 619277 - DNA, 15 bp, Homo sapiens
cctcccccaggctgc

SEQ ID NO: 619278 - DNA, 22 bp, Homo sapiens
cctcccccaggctgcgcctgcc

SEQ ID NO: 619279 - DNA, 17 bp, Homo sapiens
cctcccccgcagacaga

SEQ ID NO: 619280 - DNA, 14 bp, Homo sapiens
cctcccgccgcctc

SEQ ID NO: 619281 - DNA, 23 bp, Homo sapiens
cctcccgccgcctcgggccgcct

SEQ ID NO: 619282 - DNA, 15 bp, Homo sapiens
cctccctccacacct

SEQ ID NO: 619283 - DNA, 16 bp, Homo sapiens
cctccctccctgctcc

SEQ ID NO: 619284 - DNA, 18 bp, Homo sapiens
cctccctcgggctggtgt

SEQ ID NO: 619285 - DNA, 24 bp, Homo sapiens
cctccctggggaccaggagctagc

SEQ ID NO: 619286 - DNA, 11 bp, Homo sapiens
cctccctgtcc

SEQ ID NO: 619287 - DNA, 21 bp, Homo sapiens
cctccctttttaaacaaatgg

SEQ ID NO: 619288 - DNA, 14 bp, Homo sapiens
cctccgccagccct

SEQ ID NO: 619289 - DNA, 20 bp, Homo sapiens
cctccgcggaggcccctgag

SEQ ID NO: 619290 - DNA, 22 bp, Homo sapiens
cctccgggactgaccttcggca

SEQ ID NO: 619291 - DNA, 16 bp, Homo sapiens
cctccgtccccagggt

SEQ ID NO: 619292 - DNA, 18 bp, Homo sapiens
cctccgtgggcagctcct

SEQ ID NO: 619293 - DNA, 21 bp, Homo sapiens
cctcctccagttctgatgagg

SEQ ID NO: 619294 - DNA, 22 bp, Homo sapiens
cctcctccatgctgtccctgtg

SEQ ID NO: 619295 - DNA, 20 bp, Homo sapiens
cctcctcgggcgcctgcgct

SEQ ID NO: 619296 - DNA, 21 bp, Homo sapiens
cctcctcgggcgcctgcgctc

SEQ ID NO: 619297 - DNA, 13 bp, Homo sapiens
cctcctctcctcg

SEQ ID NO: 619298 - DNA, 14 bp, Homo sapiens
cctcctctcctcgt

SEQ ID NO: 619299 - DNA, 13 bp, Homo sapiens
cctcctgcacgcg

SEQ ID NO: 619300 - DNA, 23 bp, Homo sapiens
cctcctgcatgtcggggcccctg

SEQ ID NO: 619301 - DNA, 14 bp, Homo sapiens
cctcctgctcctca

SEQ ID NO: 619302 - DNA, 20 bp, Homo sapiens
cctcctgtctcctctgtcag

SEQ ID NO: 619303 - DNA, 13 bp, Homo sapiens
cctccttctcccc

SEQ ID NO: 619304 - DNA, 12 bp, Homo sapiens
cctcgccccccg

SEQ ID NO: 619305 - DNA, 17 bp, Homo sapiens
cctcgccccccgcccgg

SEQ ID NO: 619306 - DNA, 13 bp, Homo sapiens
cctcgcccccggg

SEQ ID NO: 619307 - DNA, 14 bp, Homo sapiens
cctcgcgcccctgt

SEQ ID NO: 619308 - DNA, 19 bp, Homo sapiens
cctcggctgtgtggggagg

SEQ ID NO: 619309 - DNA, 15 bp, Homo sapiens
cctcgggccgcctcc

SEQ ID NO: 619310 - DNA, 22 bp, Homo sapiens
cctcgggccgcctcctccagac

SEQ ID NO: 619311 - DNA, 22 bp, Homo sapiens
ccgggtgccccccatgccctcc

SEQ ID NO: 619312 - DNA, 22 bp, Homo sapiens
ccgggtgcgtgaccggcccgcc

SEQ ID NO: 619313 - DNA, 20 bp, Homo sapiens
cctggacgcatgcagggccc

SEQ ID NO: 619314 - DNA, 17 bp, Homo sapiens
cctggagccagggcaga

SEQ ID NO: 619315 - DNA, 14 bp, Homo sapiens
cctggagcctgggc

SEQ ID NO: 619316 - DNA, 16 bp, Homo sapiens
cctggagcctgggcag

SEQ ID NO: 619317 - DNA, 18 bp, Homo sapiens
cctggagcctgggcagca

SEQ ID NO: 619318 - DNA, 11 bp, Homo sapiens
cctggagctgt

SEQ ID NO: 619319 - DNA, 18 bp, Homo sapiens
cctggagctgtccttcat

SEQ ID NO: 619320 - DNA, 15 bp, Homo sapiens
cctggaggagaagga

SEQ ID NO: 619321 - DNA, 14 bp, Homo sapiens
cctggccacctgcc

SEQ ID NO: 619322 - DNA, 16 bp, Homo sapiens
cctggccacctgccag

SEQ ID NO: 619323 - DNA, 17 bp, Homo sapiens
cctggccacctgccagg

SEQ ID NO: 619324 - DNA, 21 bp, Homo sapiens
cctggccccctcgcgcccctg

SEQ ID NO: 619325 - DNA, 16 bp, Homo sapiens
cctttcctgggggatg

SEQ ID NO: 619326 - DNA, 16 bp, Homo sapiens
cctttctagcaattgc

SEQ ID NO: 619327 - DNA, 23 bp, Homo sapiens
cctttctccagcccatgctggct

SEQ ID NO: 619328 - DNA, 18 bp, Homo sapiens
cctttcttccttcctttc

SEQ ID NO: 619329 - DNA, 15 bp, Homo sapiens
cctttgataattctt

SEQ ID NO: 619330 - DNA, 16 bp, Homo sapiens
cctttgtcaaatggta

SEQ ID NO: 619331 - DNA, 23 bp, Homo sapiens
ccttttaaaaaaataatataaat

SEQ ID NO: 619332 - DNA, 18 bp, Homo sapiens
ccttttttaaaaaaaaga

SEQ ID NO: 619333 - DNA, 20 bp, Homo sapiens
ccttttttcctttcttcctt

SEQ ID NO: 619334 - DNA, 18 bp, Homo sapiens
cgaaaacgtggctgcttc

SEQ ID NO: 619335 - DNA, 22 bp, Homo sapiens
cgaaatgaaaatggctgaagaa

SEQ ID NO: 619336 - DNA, 13 bp, Homo sapiens
cgaaatggtacca

SEQ ID NO: 619337 - DNA, 23 bp, Homo sapiens
cgaactcgggattacagaaacac

SEQ ID NO: 619338 - DNA, 15 bp, Homo sapiens
cgaagccccttggag

SEQ ID NO: 619339 - DNA, 14 bp, Homo sapiens
cgaatattgctgat

SEQ ID NO: 619340 - DNA, 12 bp, Homo sapiens
cgaatggctttt

SEQ ID NO: 619341 - DNA, 20 bp, Homo sapiens
cgacaaagggaaggctgctg

SEQ ID NO: 619342 - DNA, 14 bp, Homo sapiens
cgaccacccctgtg

SEQ ID NO: 619343 - DNA, 18 bp, Homo sapiens
cgaccgacgcccctccgg

SEQ ID NO: 619344 - DNA, 16 bp, Homo sapiens
cgacgatccccatgga

SEQ ID NO: 619345 - DNA, 13 bp, Homo sapiens
cgacgcccctccg

SEQ ID NO: 619346 - DNA, 14 bp, Homo sapiens
cgacgcccctccgg

SEQ ID NO: 619347 - DNA, 15 bp, Homo sapiens
cgacgcccctccggg

SEQ ID NO: 619348 - DNA, 16 bp, Homo sapiens
cgactgggctgctggg

SEQ ID NO: 619349 - DNA, 23 bp, Homo sapiens
cgactgggctgctggggcagggc

SEQ ID NO: 619350 - DNA, 20 bp, Homo sapiens
cgactttctttaacatatca

SEQ ID NO: 619351 - DNA, 20 bp, Homo sapiens
cgagcagagcgcagccccca

SEQ ID NO: 619352 - DNA, 21 bp, Homo sapiens
cgagcagagcgcagcccccac

SEQ ID NO: 619353 - DNA, 19 bp, Homo sapiens
cgagcccctgtttctcctc

SEQ ID NO: 619354 - DNA, 22 bp, Homo sapiens
cgagcccctgtttctcctccat

SEQ ID NO: 619355 - DNA, 18 bp, Homo sapiens
cgagcgcgtgccttcccc

SEQ ID NO: 619356 - DNA, 20 bp, Homo sapiens
cgaggagcttccagtgcatg

SEQ ID NO: 619357 - DNA, 23 bp, Homo sapiens
cgaggagcttccagtgcatgttg

SEQ ID NO: 619358 - DNA, 17 bp, Homo sapiens
cgaggcagaatggtggg

SEQ ID NO: 619359 - DNA, 20 bp, Homo sapiens
cgatccccatggaacagccc

SEQ ID NO: 619360 - DNA, 21 bp, Homo sapiens
cgatccccatggaacagccct

SEQ ID NO: 619361 - DNA, 22 bp, Homo sapiens
cgatccccatggaacagccctg

SEQ ID NO: 619362 - DNA, 23 bp, Homo sapiens
cgatccccatggaacagccctgc

SEQ ID NO: 619363 - DNA, 13 bp, Homo sapiens
cgcaccgcccaac

SEQ ID NO: 619364 - DNA, 13 bp, Homo sapiens
cgcactcaggagc

SEQ ID NO: 619365 - DNA, 19 bp, Homo sapiens
cgcactcaggagcacagcc

SEQ ID NO: 619366 - DNA, 22 bp, Homo sapiens
cgcactcaggagcacagccata

SEQ ID NO: 619367 - DNA, 16 bp, Homo sapiens
cgcagacagacagaca

SEQ ID NO: 619368 - DNA, 17 bp, Homo sapiens
cgcagagccccggagca

SEQ ID NO: 619369 - DNA, 13 bp, Homo sapiens
cgcagcaccagcc

SEQ ID NO: 619370 - DNA, 16 bp, Homo sapiens
cgcagcaccagcctga

SEQ ID NO: 619371 - DNA, 18 bp, Homo sapiens
cgcagcaccagcctgagc

SEQ ID NO: 619372 - DNA, 21 bp, Homo sapiens
cgcagcaccagcctgagccac

SEQ ID NO: 619373 - DNA, 14 bp, Homo sapiens
cgcagcccccacgc

SEQ ID NO: 619374 - DNA, 16 bp, Homo sapiens
cgcagcccccacgccg

SEQ ID NO: 619375 - DNA, 21 bp, Homo sapiens
cgcagccgcgctctgcccctc

SEQ ID NO: 619376 - DNA, 18 bp, Homo sapiens
cgcagcctgaagcctgga

SEQ ID NO: 619377 - DNA, 19 bp, Homo sapiens
cgcagcgccagggctcaga

SEQ ID NO: 619378 - DNA, 23 bp, Homo sapiens
cgcagctggcgcgtgtgtggcct

SEQ ID NO: 619379 - DNA, 14 bp, Homo sapiens
cgcatctgcctgga

SEQ ID NO: 619380 - DNA, 11 bp, Homo sapiens
cgcatgcaggg

SEQ ID NO: 619381 - DNA, 21 bp, Homo sapiens
cgcatgcagggcccccactgg

SEQ ID NO: 619382 - DNA, 16 bp, Homo sapiens
cgcatggcgccccggg

SEQ ID NO: 619383 - DNA, 11 bp, Homo sapiens
cgccacccgcc

SEQ ID NO: 619384 - DNA, 13 bp, Homo sapiens
cgccagccctgtt

SEQ ID NO: 619385 - DNA, 20 bp, Homo sapiens
cgccagccctgttccgcctc

SEQ ID NO: 619386 - DNA, 19 bp, Homo sapiens
cgcccaacccccacctccc

SEQ ID NO: 619387 - DNA, 15 bp, Homo sapiens
cgcccacccacaccc

SEQ ID NO: 619388 - DNA, 14 bp, Homo sapiens
cgcccaccccgctg

SEQ ID NO: 619389 - DNA, 16 bp, Homo sapiens
cgcccaccccgctgcc

SEQ ID NO: 619390 - DNA, 17 bp, Homo sapiens
cgcccaccccgctgcct

SEQ ID NO: 619391 - DNA, 17 bp, Homo sapiens
cgcccacctgcccagtt

SEQ ID NO: 619392 - DNA, 22 bp, Homo sapiens
cgcccacgcggctgctgcttct

SEQ ID NO: 619393 - DNA, 13 bp, Homo sapiens
cgcccagccccca

SEQ ID NO: 619394 - DNA, 22 bp, Homo sapiens
cgcccaggatgaaggggccaga

SEQ ID NO: 619395 - DNA, 13 bp, Homo sapiens
cgccccagagact

SEQ ID NO: 619396 - DNA, 17 bp, Homo sapiens
cgccccagagactgccc

SEQ ID NO: 619397 - DNA, 18 bp, Homo sapiens
cgccccagagactgccca

SEQ ID NO: 619398 - DNA, 19 bp, Homo sapiens
cgccccagagactgcccac

SEQ ID NO: 619399 - DNA, 20 bp, Homo sapiens
cgccccagagactgcccacc

SEQ ID NO: 619400 - DNA, 15 bp, Homo sapiens
cgccccatgggccct

SEQ ID NO: 619401 - DNA, 12 bp, Homo sapiens
cgcccccaggac

SEQ ID NO: 619402 - DNA, 22 bp, Homo sapiens
cgccccccggcctggccccctc

SEQ ID NO: 619403 - DNA, 18 bp, Homo sapiens
cgccccgtgctcctctgc

SEQ ID NO: 619404 - DNA, 20 bp, Homo sapiens
cgccccgtgctcctctgccc

SEQ ID NO: 619405 - DNA, 11 bp, Homo sapiens
cgcccctcctc

SEQ ID NO: 619406 - DNA, 12 bp, Homo sapiens
cgcccctcctcg

SEQ ID NO: 619407 - DNA, 12 bp, Homo sapiens
cgcccctctgcg

SEQ ID NO: 619408 - DNA, 21 bp, Homo sapiens
cgcccctctgcgccccagcga

SEQ ID NO: 619409 - DNA, 17 bp, Homo sapiens
cgcccctgcccagcacc

SEQ ID NO: 619410 - DNA, 18 bp, Homo sapiens
cgcccctgcccagcacct

SEQ ID NO: 619411 - DNA, 21 bp, Homo sapiens
cggcttccccattgccttctg

SEQ ID NO: 619412 - DNA, 12 bp, Homo sapiens
cggcttccctgc

SEQ ID NO: 619413 - DNA, 14 bp, Homo sapiens
cgggaaggcctgag

SEQ ID NO: 619414 - DNA, 15 bp, Homo sapiens
cgggacagcggcccc

SEQ ID NO: 619415 - DNA, 16 bp, Homo sapiens
cgggacagcggcccgg

SEQ ID NO: 619416 - DNA, 16 bp, Homo sapiens
cgggactacagaagtg

SEQ ID NO: 619417 - DNA, 22 bp, Homo sapiens
cgggactgaccttcggcagtgg

SEQ ID NO: 619418 - DNA, 20 bp, Homo sapiens
cgggagagcgccacccgccc

SEQ ID NO: 619419 - DNA, 15 bp, Homo sapiens
cgggcagagaccacc

SEQ ID NO: 619420 - DNA, 14 bp, Homo sapiens
cgggcagcccctgc

SEQ ID NO: 619421 - DNA, 17 bp, Homo sapiens
cgggcagcccctgctgg

SEQ ID NO: 619422 - DNA, 21 bp, Homo sapiens
cgggcagcccctgctggacca

SEQ ID NO: 619423 - DNA, 11 bp, Homo sapiens
cgggccagggt

SEQ ID NO: 619424 - DNA, 13 bp, Homo sapiens
cgggccagggtgg

SEQ ID NO: 619425 - DNA, 15 bp, Homo sapiens
cgggccagggtggga

SEQ ID NO: 619426 - DNA, 16 bp, Homo sapiens
cgggccgcctcctcca

SEQ ID NO: 619427 - DNA, 21 bp, Homo sapiens
cgggccgcctcctccagactc

SEQ ID NO: 619428 - DNA, 17 bp, Homo sapiens
cgggcgcctgcgctcct

SEQ ID NO: 619429 - DNA, 20 bp, Homo sapiens
cgggcgcctgcgctcctctg

SEQ ID NO: 619430 - DNA, 12 bp, Homo sapiens
cggggcccctgc

SEQ ID NO: 619431 - DNA, 20 bp, Homo sapiens
cggggcggcatccgagcccc

SEQ ID NO: 619432 - DNA, 20 bp, Homo sapiens
cggggctggccctgccctcc

SEQ ID NO: 619433 - DNA, 15 bp, Homo sapiens
cggggcttctgggcg

SEQ ID NO: 619434 - DNA, 16 bp, Homo sapiens
cggggcttctgggcgc

SEQ ID NO: 619435 - DNA, 17 bp, Homo sapiens
cgggggctaactggccc

SEQ ID NO: 619436 - DNA, 18 bp, Homo sapiens
cgggggctaactggcccc

SEQ ID NO: 619437 - DNA, 20 bp, Homo sapiens
cgggggctaactggccccag

SEQ ID NO: 619438 - DNA, 22 bp, Homo sapiens
cgggggtccccggacgctggct

SEQ ID NO: 619439 - DNA, 18 bp, Homo sapiens
cggggtccaggcccgtgg

SEQ ID NO: 619440 - DNA, 15 bp, Homo sapiens
cggggtcgggggagg

SEQ ID NO: 619441 - DNA, 18 bp, Homo sapiens
cggggtcgggggaggagc

SEQ ID NO: 619442 - DNA, 16 bp, Homo sapiens
cgggtctgtgggactg

SEQ ID NO: 619443 - DNA, 22 bp, Homo sapiens
cgggtctgtgggactggcccac

SEQ ID NO: 619444 - DNA, 21 bp, Homo sapiens
cgggtgccccccatgccctcc

SEQ ID NO: 619445 - DNA, 17 bp, Homo sapiens
cgggtggctggagcccc

SEQ ID NO: 619446 - DNA, 20 bp, Homo sapiens
cgggtggctggagccccatc

SEQ ID NO: 619447 - DNA, 12 bp, Homo sapiens
cgggtggggcct

SEQ ID NO: 619448 - DNA, 15 bp, Homo sapiens
cggtaggctgctggc

SEQ ID NO: 619449 - DNA, 17 bp, Homo sapiens
cggtaggctgctggcgc

SEQ ID NO: 619450 - DNA, 12 bp, Homo sapiens
cggtccaccccg

SEQ ID NO: 619451 - DNA, 20 bp, Homo sapiens
cggtccaccccgtcccggcc

SEQ ID NO: 619452 - DNA, 16 bp, Homo sapiens
cggtggcatttgctga

SEQ ID NO: 619453 - DNA, 16 bp, Homo sapiens
cggtgggcgcctgtcg

SEQ ID NO: 619454 - DNA, 13 bp, Homo sapiens
cggtgtggggggt

SEQ ID NO: 619455 - DNA, 16 bp, Homo sapiens
cggtgtttggaggctg

SEQ ID NO: 619456 - DNA, 19 bp, Homo sapiens
cggtgtttggaggctgctg

SEQ ID NO: 619457 - DNA, 23 bp, Homo sapiens
cggtgtttggaggctgctgcccc

SEQ ID NO: 619458 - DNA, 17 bp, Homo sapiens
cggttggccggctggcc

SEQ ID NO: 619459 - DNA, 18 bp, Homo sapiens
cggttggccggctggccg

SEQ ID NO: 619460 - DNA, 13 bp, Homo sapiens
cgtagaaacaaga

SEQ ID NO: 619461 - DNA, 13 bp, Homo sapiens
cgtcagcctgtga

SEQ ID NO: 619462 - DNA, 15 bp, Homo sapiens
cgtcagcctgtgaac

SEQ ID NO: 619463 - DNA, 11 bp, Homo sapiens
cgtccccaggg

SEQ ID NO: 619464 - DNA, 12 bp, Homo sapiens
cgtcccggcccc

SEQ ID NO: 619465 - DNA, 18 bp, Homo sapiens
cgtccctgagggcccttc

SEQ ID NO: 619466 - DNA, 19 bp, Homo sapiens
cgtccctgagggcccttcc

SEQ ID NO: 619467 - DNA, 19 bp, Homo sapiens
cgtccctgctcagcccatc

SEQ ID NO: 619468 - DNA, 14 bp, Homo sapiens
cgtccgcccgccca

SEQ ID NO: 619469 - DNA, 17 bp, Homo sapiens
cgtccgcccgcccaccc

SEQ ID NO: 619470 - DNA, 14 bp, Homo sapiens
cgtccggcctgcag

SEQ ID NO: 619471 - DNA, 15 bp, Homo sapiens
cgtccggcctgcagc

SEQ ID NO: 619472 - DNA, 18 bp, Homo sapiens
cgtcctgctcgccctgtg

SEQ ID NO: 619473 - DNA, 23 bp, Homo sapiens
cgtcctgctcgccctgtgccctc

SEQ ID NO: 619474 - DNA, 22 bp, Homo sapiens
cgtcctggggtggttggaggcc

SEQ ID NO: 619475 - DNA, 11 bp, Homo sapiens
cgtctccccat

SEQ ID NO: 619476 - DNA, 13 bp, Homo sapiens
cgtctgtcctgcg

SEQ ID NO: 619477 - DNA, 15 bp, Homo sapiens
cgtctgtcctgcgcc

SEQ ID NO: 619478 - DNA, 14 bp, Homo sapiens
cgtgaaacacaata

SEQ ID NO: 619479 - DNA, 15 bp, Homo sapiens
cgtgagagtcatctc

SEQ ID NO: 619480 - DNA, 13 bp, Homo sapiens
cgtgaggcccctg

SEQ ID NO: 619481 - DNA, 20 bp, Homo sapiens
cgtgcccatttcacacaact

SEQ ID NO: 619482 - DNA, 13 bp, Homo sapiens
cgtgcccccagcg

SEQ ID NO: 619483 - DNA, 13 bp, Homo sapiens
cgtgccgtggagc

SEQ ID NO: 619484 - DNA, 14 bp, Homo sapiens
cgtgccgtggagct

SEQ ID NO: 619485 - DNA, 13 bp, Homo sapiens
cgtgcgcagccgc

SEQ ID NO: 619486 - DNA, 21 bp, Homo sapiens
cgtgcgcagccgcgctctgcc

SEQ ID NO: 619487 - DNA, 22 bp, Homo sapiens
cgtgcgcagccgcgctctgccc

SEQ ID NO: 619488 - DNA, 23 bp, Homo sapiens
cgtgcgcagccgcgctctgcccc

SEQ ID NO: 619489 - DNA, 22 bp, Homo sapiens
cgtgcggcccgtgcgcagccgc

SEQ ID NO: 619490 - DNA, 12 bp, Homo sapiens
cgtgctcctctg

SEQ ID NO: 619491 - DNA, 14 bp, Homo sapiens
cgtgctcctctgcc

SEQ ID NO: 619492 - DNA, 15 bp, Homo sapiens
cgtgggatccagaga

SEQ ID NO: 619493 - DNA, 17 bp, Homo sapiens
cgtgggatccagagaga

SEQ ID NO: 619494 - DNA, 22 bp, Homo sapiens
cgtgggcgcaaaggtgcctcat

SEQ ID NO: 619495 - DNA, 19 bp, Homo sapiens
cgtggggctaacgggcgcc

SEQ ID NO: 619496 - DNA, 14 bp, Homo sapiens
cgtggtgtgaggcc

SEQ ID NO: 619497 - DNA, 19 bp, Homo sapiens
cgtgtgcagactgtggctg

SEQ ID NO: 619498 - DNA, 18 bp, Homo sapiens
cgtgtggccctgtgggag

SEQ ID NO: 619499 - DNA, 20 bp, Homo sapiens
cgtgtggccctgtgggagtc

SEQ ID NO: 619500 - DNA, 23 bp, Homo sapiens
cgtgtgttgccattttgtctggc

SEQ ID NO: 619501 - DNA, 14 bp, Homo sapiens
cgtgtttcacagtg

SEQ ID NO: 619502 - DNA, 13 bp, Homo sapiens
cgttaattaaaca

SEQ ID NO: 619503 - DNA, 21 bp, Homo sapiens
cgttaggaataacactgcagc

SEQ ID NO: 619504 - DNA, 21 bp, Homo sapiens
cgttcatgttcatctcaggtg

SEQ ID NO: 619505 - DNA, 21 bp, Homo sapiens
cgttcccagcgcatggcgccc

SEQ ID NO: 619506 - DNA, 13 bp, Homo sapiens
cgttcgcggcggt

SEQ ID NO: 619507 - DNA, 21 bp, Homo sapiens
cgttgtgtgggtttactctgt

SEQ ID NO: 619508 - DNA, 15 bp, Homo sapiens
cgttgttttgtggat

SEQ ID NO: 619509 - DNA, 15 bp, Homo sapiens
cgtttcacatctgta

SEQ ID NO: 619510 - DNA, 18 bp, Homo sapiens
cgtttcacatctgtatat

SEQ ID NO: 619511 - DNA, 22 bp, Homo sapiens
ctaaaactaaatagcatgtatt

SEQ ID NO: 619512 - DNA, 12 bp, Homo sapiens
ctaaaagtgatg

SEQ ID NO: 619513 - DNA, 16 bp, Homo sapiens
ctaaaagtgatgtgat

SEQ ID NO: 619514 - DNA, 18 bp, Homo sapiens
ctaaaagtgatgtgattt

SEQ ID NO: 619515 - DNA, 22 bp, Homo sapiens
ctaaaagtgatgtgatttatgc

SEQ ID NO: 619516 - DNA, 17 bp, Homo sapiens
ctaaaccatgaaaagtt

SEQ ID NO: 619517 - DNA, 18 bp, Homo sapiens
ctaaagatctttttttaa

SEQ ID NO: 619518 - DNA, 19 bp, Homo sapiens
ctaaaggaaacaaagcaat

SEQ ID NO: 619519 - DNA, 15 bp, Homo sapiens
ctaaaggcggagggt

SEQ ID NO: 619520 - DNA, 17 bp, Homo sapiens
ctaaagggaagccctga

SEQ ID NO: 619521 - DNA, 14 bp, Homo sapiens
ctaaatagcatgta

SEQ ID NO: 619522 - DNA, 12 bp, Homo sapiens
ctaaatattatg

SEQ ID NO: 619523 - DNA, 13 bp, Homo sapiens
ctgaatctctcaa

SEQ ID NO: 619524 - DNA, 18 bp, Homo sapiens
ctgaatgaagctgccatc

SEQ ID NO: 619525 - DNA, 23 bp, Homo sapiens
ctgaatgctatttgtgtaactga

SEQ ID NO: 619526 - DNA, 16 bp, Homo sapiens
ctgaattcattgtctc

SEQ ID NO: 619527 - DNA, 22 bp, Homo sapiens
ctgaatttggggctacttatat

SEQ ID NO: 619528 - DNA, 19 bp, Homo sapiens
ctgacagcaaacacagtca

SEQ ID NO: 619529 - DNA, 17 bp, Homo sapiens
ctgacaggaaagtggat

SEQ ID NO: 619530 - DNA, 17 bp, Homo sapiens
ctgacatatttcataag

SEQ ID NO: 619531 - DNA, 22 bp, Homo sapiens
ctgacatatttcataagcacat

SEQ ID NO: 619532 - DNA, 16 bp, Homo sapiens
ctgacatggtgctgtg

SEQ ID NO: 619533 - DNA, 23 bp, Homo sapiens
ctgacatggtgctgtgtgtgagc

SEQ ID NO: 619534 - DNA, 13 bp, Homo sapiens
ctgaccctcactt

SEQ ID NO: 619535 - DNA, 16 bp, Homo sapiens
ctgaccttcggcagtg

SEQ ID NO: 619536 - DNA, 23 bp, Homo sapiens
ctgaccttcggcagtggctgggg

SEQ ID NO: 619537 - DNA, 19 bp, Homo sapiens
ctgactgtgttcagtgcct

SEQ ID NO: 619538 - DNA, 14 bp, Homo sapiens
ctgacttcccagct

SEQ ID NO: 619539 - DNA, 17 bp, Homo sapiens
ctgacttcccagctggc

SEQ ID NO: 619540 - DNA, 15 bp, Homo sapiens
ctgacttctggagat

SEQ ID NO: 619541 - DNA, 17 bp, Homo sapiens
ctgagacacagcccaga

SEQ ID NO: 619542 - DNA, 20 bp, Homo sapiens
ctgagacacagcccagagac

SEQ ID NO: 619543 - DNA, 22 bp, Homo sapiens
ctgagactcgcgacaatgcaaa

SEQ ID NO: 619544 - DNA, 18 bp, Homo sapiens
ctgagatgtttagtagct

SEQ ID NO: 619545 - DNA, 14 bp, Homo sapiens
ctgagcagacaggg

SEQ ID NO: 619546 - DNA, 15 bp, Homo sapiens
ctgagcagacagggc

SEQ ID NO: 619547 - DNA, 23 bp, Homo sapiens
ctgagcagacagggcgtcctctc

SEQ ID NO: 619548 - DNA, 22 bp, Homo sapiens
ctgagcagagtcttgctacctc

SEQ ID NO: 619549 - DNA, 16 bp, Homo sapiens
ctgagcagtggggagc

SEQ ID NO: 619550 - DNA, 16 bp, Homo sapiens
ctgagccacagtgggg

SEQ ID NO: 619551 - DNA, 17 bp, Homo sapiens
ctgagccacagtggggc

SEQ ID NO: 619552 - DNA, 14 bp, Homo sapiens
ctgagcccctcctc

SEQ ID NO: 619553 - DNA, 19 bp, Homo sapiens
ctgagcccctcctctcctc

SEQ ID NO: 619554 - DNA, 14 bp, Homo sapiens
ctgagccctgccct

SEQ ID NO: 619555 - DNA, 19 bp, Homo sapiens
ctgagcctgacctttctga

SEQ ID NO: 619556 - DNA, 12 bp, Homo sapiens
ctgagcctgtct

SEQ ID NO: 619557 - DNA, 14 bp, Homo sapiens
ctgagcctgtctct

SEQ ID NO: 619558 - DNA, 15 bp, Homo sapiens
ctgagcctgtctctc

SEQ ID NO: 619559 - DNA, 16 bp, Homo sapiens
ctgagcctgtctctcc

SEQ ID NO: 619560 - DNA, 14 bp, Homo sapiens
ctgagctccaccct

SEQ ID NO: 619561 - DNA, 16 bp, Homo sapiens
ctgagctccaccctcc

SEQ ID NO: 619562 - DNA, 20 bp, Homo sapiens
ctgagctccaccctcccctc

SEQ ID NO: 619563 - DNA, 13 bp, Homo sapiens
ctgagctggccta

SEQ ID NO: 619564 - DNA, 14 bp, Homo sapiens
ctgagctgggcacc

SEQ ID NO: 619565 - DNA, 16 bp, Homo sapiens
ctgaggacagaggccg

SEQ ID NO: 619566 - DNA, 15 bp, Homo sapiens
ctgaggacggggcag

SEQ ID NO: 619567 - DNA, 17 bp, Homo sapiens
ctgaggacggggcagag

SEQ ID NO: 619568 - DNA, 11 bp, Homo sapiens
ctgaggaggag

SEQ ID NO: 619569 - DNA, 20 bp, Homo sapiens
ctgaggaggaggacacagca

SEQ ID NO: 619570 - DNA, 13 bp, Homo sapiens
ctgaggagtccaa

SEQ ID NO: 619571 - DNA, 14 bp, Homo sapiens
ctgagggaagccca

SEQ ID NO: 619572 - DNA, 16 bp, Homo sapiens
ctgagggaagcccacc

SEQ ID NO: 619573 - DNA, 17 bp, Homo sapiens
ctgagggaagcccaccc

SEQ ID NO: 619574 - DNA, 18 bp, Homo sapiens
ctgagggaagcccacccg

SEQ ID NO: 619575 - DNA, 19 bp, Homo sapiens
ctgagggaagcccacccgc

SEQ ID NO: 619576 - DNA, 18 bp, Homo sapiens
ctgagggacgagcagagc

SEQ ID NO: 619577 - DNA, 20 bp, Homo sapiens
ctgagggacgagcagagcgc

SEQ ID NO: 619578 - DNA, 13 bp, Homo sapiens
ctgagggcagggt

SEQ ID NO: 619579 - DNA, 16 bp, Homo sapiens
ctgagggcccttccca

SEQ ID NO: 619580 - DNA, 18 bp, Homo sapiens
ctgagggcccttcccaac

SEQ ID NO: 619581 - DNA, 21 bp, Homo sapiens
ctgagtcggctgggcagggcc

SEQ ID NO: 619582 - DNA, 13 bp, Homo sapiens
ctgagtggctcgt

SEQ ID NO: 619583 - DNA, 16 bp, Homo sapiens
ctgagtggctcgtgtt

SEQ ID NO: 619584 - DNA, 24 bp, Homo sapiens
ctgagtggctcgtgtttcacagtg

SEQ ID NO: 619585 - DNA, 23 bp, Homo sapiens
ctgagtggctgaaataaaagcct

SEQ ID NO: 619586 - DNA, 15 bp, Homo sapiens
ctgagttagctgttt

SEQ ID NO: 619587 - DNA, 16 bp, Homo sapiens
ctgatgaagttgtaca

SEQ ID NO: 619588 - DNA, 13 bp, Homo sapiens
ctgatgagacaac

SEQ ID NO: 619589 - DNA, 15 bp, Homo sapiens
ctgatgatggaaggg

SEQ ID NO: 619590 - DNA, 18 bp, Homo sapiens
ctgatgggtatcatgctt

SEQ ID NO: 619591 - DNA, 16 bp, Homo sapiens
ctgatggtgcaatgac

SEQ ID NO: 619592 - DNA, 21 bp, Homo sapiens
ctgatggtgcaatgacctttc

SEQ ID NO: 619593 - DNA, 13 bp, Homo sapiens
ctgattagtgtct

SEQ ID NO: 619594 - DNA, 15 bp, Homo sapiens
ctgatttactaacag

SEQ ID NO: 619595 - DNA, 19 bp, Homo sapiens
ctgatttttttttccttca

SEQ ID NO: 619596 - DNA, 20 bp, Homo sapiens
cttctcaaatgctactcagt

SEQ ID NO: 619597 - DNA, 13 bp, Homo sapiens
cttctcagctcca

SEQ ID NO: 619598 - DNA, 14 bp, Homo sapiens
cttctccccctcag

SEQ ID NO: 619599 - DNA, 15 bp, Homo sapiens
cttctcccctccaga

SEQ ID NO: 619600 - DNA, 22 bp, Homo sapiens
cttctccctggggaggacccct

SEQ ID NO: 619601 - DNA, 12 bp, Homo sapiens
cttctccttaac

SEQ ID NO: 619602 - DNA, 18 bp, Homo sapiens
cttctggccgctgcagtc

SEQ ID NO: 619603 - DNA, 14 bp, Homo sapiens
cttctggctgctgc

SEQ ID NO: 619604 - DNA, 16 bp, Homo sapiens
cttctggctgctgcag

SEQ ID NO: 619605 - DNA, 22 bp, Homo sapiens
cttctgggacaggcaccatgct

SEQ ID NO: 619606 - DNA, 18 bp, Homo sapiens
cttctggggagggacaca

SEQ ID NO: 619607 - DNA, 12 bp, Homo sapiens
cttctgtgcatc

SEQ ID NO: 619608 - DNA, 18 bp, Homo sapiens
cttctgtgcatctggcct

SEQ ID NO: 619609 - DNA, 20 bp, Homo sapiens
cttctgtgcatctggcctgg

SEQ ID NO: 619610 - DNA, 23 bp, Homo sapiens
cttcttaaggacagtgttcaaat

SEQ ID NO: 619611 - DNA, 14 bp, Homo sapiens
cttcttgcggcacc

SEQ ID NO: 619612 - DNA, 14 bp, Homo sapiens
cttcttttcccatt

SEQ ID NO: 619613 - DNA, 20 bp, Homo sapiens
cttgaaattatatctgtggt

SEQ ID NO: 619614 - DNA, 24 bp, Homo sapiens
cttgaaattatatctgtggtcttc

SEQ ID NO: 619615 - DNA, 13 bp, Homo sapiens
cttgaagaactga

SEQ ID NO: 619616 - DNA, 13 bp, Homo sapiens
cttgaatgcttaa

SEQ ID NO: 619617 - DNA, 18 bp, Homo sapiens
cttgacaggcgccgcctc

SEQ ID NO: 619618 - DNA, 17 bp, Homo sapiens
cttgacagttacttaca

SEQ ID NO: 619619 - DNA, 22 bp, Homo sapiens
cttgacagttacttacacacct

SEQ ID NO: 619620 - DNA, 22 bp, Homo sapiens
cttgagaccagcctgccaggcc

SEQ ID NO: 619621 - DNA, 22 bp, Homo sapiens
cttgagcaaggcaagaagtggg

SEQ ID NO: 619622 - DNA, 14 bp, Homo sapiens
cttgagcagctgaa

SEQ ID NO: 619623 - DNA, 13 bp, Homo sapiens
cttgagcatgccc

SEQ ID NO: 619624 - DNA, 16 bp, Homo sapiens
cttgaggccaaatgag

SEQ ID NO: 619625 - DNA, 17 bp, Homo sapiens
cttgaggccaaatgagt

SEQ ID NO: 619626 - DNA, 20 bp, Homo sapiens
cttgaggccaaatgagttcc

SEQ ID NO: 619627 - DNA, 18 bp, Homo sapiens
cttgagtgggccccctct

SEQ ID NO: 619628 - DNA, 16 bp, Homo sapiens
cttgatgtttctatat

SEQ ID NO: 619629 - DNA, 19 bp, Homo sapiens
cttgcacttctgttatcag

SEQ ID NO: 619630 - DNA, 13 bp, Homo sapiens
cttgcagcagaga

SEQ ID NO: 619631 - DNA, 16 bp, Homo sapiens
cttgcagtcatcagaa

SEQ ID NO: 619632 - DNA, 17 bp, Homo sapiens
cttgcagtcatcagaag

SEQ ID NO: 619633 - DNA, 17 bp, Homo sapiens
cttgcagttatgttatc

SEQ ID NO: 619634 - DNA, 21 bp, Homo sapiens
cttgcatgcctgggcccaggc

SEQ ID NO: 619635 - DNA, 16 bp, Homo sapiens
cttgcattttagctaa

SEQ ID NO: 619636 - DNA, 18 bp, Homo sapiens
cttgcctgaatccatcag

SEQ ID NO: 619637 - DNA, 14 bp, Homo sapiens
cttgcgaccatgtg

SEQ ID NO: 619638 - DNA, 16 bp, Homo sapiens
cttgcgaccatgtgta

SEQ ID NO: 619639 - DNA, 17 bp, Homo sapiens
cttgctctacctggccg

SEQ ID NO: 619640 - DNA, 15 bp, Homo sapiens
cttgctgggccaggg

SEQ ID NO: 619641 - DNA, 18 bp, Homo sapiens
cttgctgtgaaatgactg

SEQ ID NO: 619642 - DNA, 12 bp, Homo sapiens
cttggacattta

SEQ ID NO: 619643 - DNA, 19 bp, Homo sapiens
cttggacttctaaaggcgg

SEQ ID NO: 619644 - DNA, 21 bp, Homo sapiens
cttggagcagagacggcagcc

SEQ ID NO: 619645 - DNA, 22 bp, Homo sapiens
cttggagcagagacggcagccc

SEQ ID NO: 619646 - DNA, 23 bp, Homo sapiens
cttggagcagagacggcagcccc

SEQ ID NO: 619647 - DNA, 13 bp, Homo sapiens
cttggagccccct

SEQ ID NO: 619648 - DNA, 19 bp, Homo sapiens
cttggagccccctggcggc

SEQ ID NO: 619649 - DNA, 23 bp, Homo sapiens
cttggagccccctggcggcaggg

SEQ ID NO: 619650 - DNA, 21 bp, Homo sapiens
cttggataggagcttccagat

SEQ ID NO: 619651 - DNA, 14 bp, Homo sapiens
cttggatcgtggaa

SEQ ID NO: 619652 - DNA, 16 bp, Homo sapiens
cttggatcgtggaaga

SEQ ID NO: 619653 - DNA, 12 bp, Homo sapiens
cttggcccctct

SEQ ID NO: 619654 - DNA, 14 bp, Homo sapiens
cttggcccctctct

SEQ ID NO: 619655 - DNA, 16 bp, Homo sapiens
cttggctcagacacct

SEQ ID NO: 619656 - DNA, 19 bp, Homo sapiens
cttggctcagacacctaga

SEQ ID NO: 619657 - DNA, 22 bp, Homo sapiens
cttgggaaacagagaaccctgt

SEQ ID NO: 619658 - DNA, 21 bp, Homo sapiens
cttgggcacgggagagcgcca

SEQ ID NO: 619659 - DNA, 22 bp, Homo sapiens
cttgggcacgggagagcgccac

SEQ ID NO: 619660 - DNA, 23 bp, Homo sapiens
cttgggcgggccatttcacattc

SEQ ID NO: 619661 - DNA, 19 bp, Homo sapiens
cttgggctggcacccactg

SEQ ID NO: 619662 - DNA, 23 bp, Homo sapiens
cttggtcacaaagctatttaagt

SEQ ID NO: 619663 - DNA, 11 bp, Homo sapiens
cttggtctctt

SEQ ID NO: 619664 - DNA, 21 bp, Homo sapiens
cttggtctctttctttccaaa

SEQ ID NO: 619665 - DNA, 15 bp, Homo sapiens
cttggtctgtgttct

SEQ ID NO: 619666 - DNA, 22 bp, Homo sapiens
cttggtctgtgttctcaacaca

SEQ ID NO: 619667 - DNA, 19 bp, Homo sapiens
cttggtgcctaatgttcca

SEQ ID NO: 619668 - DNA, 18 bp, Homo sapiens
cttggtgtcaaattttta

SEQ ID NO: 619669 - DNA, 19 bp, Homo sapiens
cttggtgtcgggcatgaca

SEQ ID NO: 619670 - DNA, 22 bp, Homo sapiens
cttggttcctccagcaatgcct

SEQ ID NO: 619671 - DNA, 23 bp, Homo sapiens
cttggtttccatcaaagccctcc

SEQ ID NO: 619672 - DNA, 19 bp, Homo sapiens
cttgtaaaactgtgacatt

SEQ ID NO: 619673 - DNA, 20 bp, Homo sapiens
cttgtacttacactgaaatc

SEQ ID NO: 619674 - DNA, 15 bp, Homo sapiens
cttgtactttacaat

SEQ ID NO: 619675 - DNA, 18 bp, Homo sapiens
cttgtctcctcctccagg

SEQ ID NO: 619676 - DNA, 17 bp, Homo sapiens
cttgtgcagaaaacatt

SEQ ID NO: 619677 - DNA, 19 bp, Homo sapiens
cttgtgcagaaaacattgt

SEQ ID NO: 619678 - DNA, 19 bp, Homo sapiens
cttgtggcagcttccctga

SEQ ID NO: 619679 - DNA, 14 bp, Homo sapiens
cttgtggggccagg

SEQ ID NO: 619680 - DNA, 13 bp, Homo sapiens
cttgttcttcctc

SEQ ID NO: 619681 - DNA, 16 bp, Homo sapiens
ctttaaaaccacagct

SEQ ID NO: 619682 - DNA, 17 bp, Homo sapiens
ctttaaaaccacagctg

SEQ ID NO: 619683 - DNA, 16 bp, Homo sapiens
ctttaaaacttactat

SEQ ID NO: 619684 - DNA, 21 bp, Homo sapiens
ctttaacatatcattcagaat

SEQ ID NO: 619685 - DNA, 24 bp, Homo sapiens
ctttataagccaatgaagcaaaca

SEQ ID NO: 619686 - DNA, 14 bp, Homo sapiens
ctttatgatttcat

SEQ ID NO: 619687 - DNA, 15 bp, Homo sapiens
ctttatgatttcatg

SEQ ID NO: 619688 - DNA, 12 bp, Homo sapiens
ctttatgtattc

SEQ ID NO: 619689 - DNA, 14 bp, Homo sapiens
ctttatgtattctc

SEQ ID NO: 619690 - DNA, 15 bp, Homo sapiens
ctttatgtattctct

SEQ ID NO: 619691 - DNA, 17 bp, Homo sapiens
ctttcaataggaaaaac

SEQ ID NO: 619692 - DNA, 20 bp, Homo sapiens
ctttcaataggaaaaactga

SEQ ID NO: 619693 - DNA, 20 bp, Homo sapiens
ctttcaatccacagtattgt

SEQ ID NO: 619694 - DNA, 18 bp, Homo sapiens
ctttcagtgcctgctgtt

SEQ ID NO: 619695 - DNA, 19 bp, Homo sapiens
ctttcagtgcctgctgttc

SEQ ID NO: 619696 - DNA, 19 bp, Homo sapiens
ctttcatccagccactgcc

SEQ ID NO: 619697 - DNA, 19 bp, Homo sapiens
ctttcatgtttaagaaatg

SEQ ID NO: 619698 - DNA, 16 bp, Homo sapiens
ctttccagtgctgctc

SEQ ID NO: 619699 - DNA, 14 bp, Homo sapiens
ctttccatgacagt

SEQ ID NO: 619700 - DNA, 18 bp, Homo sapiens
ctttccatgacagtagca

SEQ ID NO: 619701 - DNA, 19 bp, Homo sapiens
ctttccatgacagtagcat

SEQ ID NO: 619702 - DNA, 21 bp, Homo sapiens
ctttcccacccactagccctc

SEQ ID NO: 619703 - DNA, 23 bp, Homo sapiens
ctttccccattcagtgacatgtc

SEQ ID NO: 619704 - DNA, 15 bp, Homo sapiens
ctttccctcatgtat

SEQ ID NO: 619705 - DNA, 15 bp, Homo sapiens
ctttccctgcatccc

SEQ ID NO: 619706 - DNA, 16 bp, Homo sapiens
ctttccctgcatccct

SEQ ID NO: 619707 - DNA, 18 bp, Homo sapiens
ctttcctctcctctctgg

SEQ ID NO: 619708 - DNA, 11 bp, Homo sapiens
ctttccttcct

SEQ ID NO: 619709 - DNA, 12 bp, Homo sapiens
ctttccttcctt

SEQ ID NO: 619710 - DNA, 14 bp, Homo sapiens
ctttctcagcatat

SEQ ID NO: 619711 - DNA, 19 bp, Homo sapiens
ctttctcagcatatatata

SEQ ID NO: 619712 - DNA, 12 bp, Homo sapiens
ctttctcctttg

SEQ ID NO: 619713 - DNA, 13 bp, Homo sapiens
ctttctctctgtg

SEQ ID NO: 619714 - DNA, 18 bp, Homo sapiens
ctttctctctgtgtggca

SEQ ID NO: 619715 - DNA, 22 bp, Homo sapiens
ctttctctctttcttttgtgca

SEQ ID NO: 619716 - DNA, 20 bp, Homo sapiens
ctttctgagtgacatgggtg

SEQ ID NO: 619717 - DNA, 16 bp, Homo sapiens
ctttctgatacatctg

SEQ ID NO: 619718 - DNA, 19 bp, Homo sapiens
ctttctggaaaaacaggat

SEQ ID NO: 619719 - DNA, 14 bp, Homo sapiens
ctttcttccttcct

SEQ ID NO: 619720 - DNA, 13 bp, Homo sapiens
ctttctttaacat

SEQ ID NO: 619721 - DNA, 14 bp, Homo sapiens
ctttctttaacata

SEQ ID NO: 619722 - DNA, 11 bp, Homo sapiens
ctttctttcca

SEQ ID NO: 619723 - DNA, 13 bp, Homo sapiens
ctttctttccaaa

SEQ ID NO: 619724 - DNA, 15 bp, Homo sapiens
ctttctttccaaagg

SEQ ID NO: 619725 - DNA, 12 bp, Homo sapiens
ctttcttttctt

SEQ ID NO: 619726 - DNA, 13 bp, Homo sapiens
ctttcttttgtgc

SEQ ID NO: 619727 - DNA, 14 bp, Homo sapiens
ctttcttttgtgca

SEQ ID NO: 619728 - DNA, 15 bp, Homo sapiens
ctttcttttgtgcat

SEQ ID NO: 619729 - DNA, 16 bp, Homo sapiens
ctttcttttgtgttgg

SEQ ID NO: 619730 - DNA, 20 bp, Homo sapiens
ctttggaagcagcaaggtgg

SEQ ID NO: 619731 - DNA, 16 bp, Homo sapiens
ctttggggacaccctc

SEQ ID NO: 619732 - DNA, 21 bp, Homo sapiens
ctttggggacaccctcctgcc

SEQ ID NO: 619733 - DNA, 21 bp, Homo sapiens
ctttggggcttatcagaactc

SEQ ID NO: 619734 - DNA, 19 bp, Homo sapiens
ctttgtgtcttttgttctc

SEQ ID NO: 619735 - DNA, 22 bp, Homo sapiens
ctttgtgtcttttgttctctct

SEQ ID NO: 619736 - DNA, 12 bp, Homo sapiens
ctttgttaaaat

SEQ ID NO: 619737 - DNA, 22 bp, Homo sapiens
ctttgttgcttaatctagagct

SEQ ID NO: 619738 - DNA, 17 bp, Homo sapiens
cttttataaatgtttta

SEQ ID NO: 619739 - DNA, 18 bp, Homo sapiens
cttttattcattagctgt

SEQ ID NO: 619740 - DNA, 15 bp, Homo sapiens
cttttcacttcttaa

SEQ ID NO: 619741 - DNA, 18 bp, Homo sapiens
cttttcccacctctttgg

SEQ ID NO: 619742 - DNA, 17 bp, Homo sapiens
cttttctttttattagg

SEQ ID NO: 619743 - DNA, 12 bp, Homo sapiens
cttttgttctct

SEQ ID NO: 619744 - DNA, 19 bp, Homo sapiens
ctttttaaacaaatggctt

SEQ ID NO: 619745 - DNA, 14 bp, Homo sapiens
ctttttctaccttt

SEQ ID NO: 619746 - DNA, 17 bp, Homo sapiens
ctttttctgactccagt

SEQ ID NO: 619747 - DNA, 14 bp, Homo sapiens
ctttttgtgagaaa

SEQ ID NO: 619748 - DNA, 17 bp, Homo sapiens
ctttttgtgagaaagag

SEQ ID NO: 619749 - DNA, 22 bp, Homo sapiens
cttttttaattgaaagggacaa

SEQ ID NO: 619750 - DNA, 15 bp, Homo sapiens
cttttttatacacat

SEQ ID NO: 619751 - DNA, 12 bp, Homo sapiens
cttttttcaatg

SEQ ID NO: 619752 - DNA, 14 bp, Homo sapiens
cttttttcaatgta

SEQ ID NO: 619753 - DNA, 19 bp, Homo sapiens
cttttttcctgtcaatata

SEQ ID NO: 619754 - DNA, 13 bp, Homo sapiens
cttttttgtacat

SEQ ID NO: 619755 - DNA, 17 bp, Homo sapiens
cttttttttcttcacct

SEQ ID NO: 619756 - DNA, 21 bp, Homo sapiens
gaaaaacactgagaaaaagca

SEQ ID NO: 619757 - DNA, 15 bp, Homo sapiens
gaaaaagcatgtaca

SEQ ID NO: 619758 - DNA, 17 bp, Homo sapiens
gaaaaagcatgtacagt

SEQ ID NO: 619759 - DNA, 20 bp, Homo sapiens
gaaaaagcatgtacagtgtt

SEQ ID NO: 619760 - DNA, 23 bp, Homo sapiens
gaaaaagggattgaggagttgcc

SEQ ID NO: 619761 - DNA, 20 bp, Homo sapiens
gaaaaatctgaatttctaaa

SEQ ID NO: 619762 - DNA, 18 bp, Homo sapiens
gaaaaatgaaatttaagc

SEQ ID NO: 619763 - DNA, 13 bp, Homo sapiens
gaaaacctcagtt

SEQ ID NO: 619764 - DNA, 22 bp, Homo sapiens
gaaaacctcagttggcctctgc

SEQ ID NO: 619765 - DNA, 23 bp, Homo sapiens
gaaaacctcagttggcctctgcc

SEQ ID NO: 619766 - DNA, 20 bp, Homo sapiens
gaaaacgtggctgcttcaag

SEQ ID NO: 619767 - DNA, 22 bp, Homo sapiens
gaaaacgtggctgcttcaagga

SEQ ID NO: 619768 - DNA, 17 bp, Homo sapiens
gaaaactggaataagaa

SEQ ID NO: 619769 - DNA, 14 bp, Homo sapiens
gaaaatcgaggaag

SEQ ID NO: 619770 - DNA, 14 bp, Homo sapiens
gaaaatgctttctc

SEQ ID NO: 619771 - DNA, 15 bp, Homo sapiens
gaaaatgctttctca

SEQ ID NO: 619772 - DNA, 17 bp, Homo sapiens
gaaaatggctgaagaaa

SEQ ID NO: 619773 - DNA, 19 bp, Homo sapiens
gaaaatttaaaaattaaag

SEQ ID NO: 619774 - DNA, 20 bp, Homo sapiens
gaaaatttaaaaattaaagc

SEQ ID NO: 619775 - DNA, 15 bp, Homo sapiens
gaaaatttttgtctt

SEQ ID NO: 619776 - DNA, 16 bp, Homo sapiens
gaaacaaaatataaat

SEQ ID NO: 619777 - DNA, 13 bp, Homo sapiens
gaaacaaatatac

SEQ ID NO: 619778 - DNA, 23 bp, Homo sapiens
gaaacaaatatactcatttggat

SEQ ID NO: 619779 - DNA, 19 bp, Homo sapiens
gaaacacagcatgcattta

SEQ ID NO: 619780 - DNA, 15 bp, Homo sapiens
gaaacacggagtttc

SEQ ID NO: 619781 - DNA, 18 bp, Homo sapiens
gaaacacggagtttccat

SEQ ID NO: 619782 - DNA, 13 bp, Homo sapiens
gaaacagaagaaa

SEQ ID NO: 619783 - DNA, 15 bp, Homo sapiens
gaaacagaagaaaaa

SEQ ID NO: 619784 - DNA, 20 bp, Homo sapiens
gaaacagtgtggatgtaaat

SEQ ID NO: 619785 - DNA, 15 bp, Homo sapiens
gaaacagtttaacag

SEQ ID NO: 619786 - DNA, 16 bp, Homo sapiens
gaaacatctgatttct

SEQ ID NO: 619787 - DNA, 18 bp, Homo sapiens
gaaacatctgatttctga

SEQ ID NO: 619788 - DNA, 20 bp, Homo sapiens
gaaacatctgatttctgaac

SEQ ID NO: 619789 - DNA, 19 bp, Homo sapiens
gaaaccaccttaaaacatt

SEQ ID NO: 619790 - DNA, 13 bp, Homo sapiens
gaaaccttggaga

SEQ ID NO: 619791 - DNA, 15 bp, Homo sapiens
gaaaccttggagagg

SEQ ID NO: 619792 - DNA, 18 bp, Homo sapiens
gaaaccttggagaggaga

SEQ ID NO: 619793 - DNA, 12 bp, Homo sapiens
gaaagacagtaa

SEQ ID NO: 619794 - DNA, 13 bp, Homo sapiens
gaaagagaaaaag

SEQ ID NO: 619795 - DNA, 11 bp, Homo sapiens
gaaagggacaa

SEQ ID NO: 619796 - DNA, 15 bp, Homo sapiens
gaaagggcagcccct

SEQ ID NO: 619797 - DNA, 17 bp, Homo sapiens
gaaagggcagcccctcc

SEQ ID NO: 619798 - DNA, 14 bp, Homo sapiens
gaaaggtgctttct

SEQ ID NO: 619799 - DNA, 22 bp, Homo sapiens
gaaagttctattatctgggttt

SEQ ID NO: 619800 - DNA, 14 bp, Homo sapiens
gaaataaatctaaa

SEQ ID NO: 619801 - DNA, 14 bp, Homo sapiens
gaaatagcagagcc

SEQ ID NO: 619802 - DNA, 15 bp, Homo sapiens
gaaatagcagagcct

SEQ ID NO: 619803 - DNA, 19 bp, Homo sapiens
gaaatataaaaataattaa

SEQ ID NO: 619804 - DNA, 16 bp, Homo sapiens
gaaatataaactgtga

SEQ ID NO: 619805 - DNA, 20 bp, Homo sapiens
gaaatatctgtgaaggactt

SEQ ID NO: 619806 - DNA, 19 bp, Homo sapiens
gaaatattttctactttaa

SEQ ID NO: 619807 - DNA, 15 bp, Homo sapiens
gaaatcaatttaaag

SEQ ID NO: 619808 - DNA, 19 bp, Homo sapiens
gaaatcaatttaaaggaaa

SEQ ID NO: 619809 - DNA, 19 bp, Homo sapiens
gaaccagcactcccagggc

SEQ ID NO: 619810 - DNA, 22 bp, Homo sapiens
gaaccagcactcccagggcccg

SEQ ID NO: 619811 - DNA, 16 bp, Homo sapiens
gaacccccctccccaa

SEQ ID NO: 619812 - DNA, 21 bp, Homo sapiens
gaacccccctccccaaggaag

SEQ ID NO: 619813 - DNA, 17 bp, Homo sapiens
gaacctgcgcaccccgt

SEQ ID NO: 619814 - DNA, 17 bp, Homo sapiens
gaacgcatgcagggccc

SEQ ID NO: 619815 - DNA, 15 bp, Homo sapiens
gaacgcccccgcccc

SEQ ID NO: 619816 - DNA, 22 bp, Homo sapiens
gaactaaatagatttttagatt

SEQ ID NO: 619817 - DNA, 17 bp, Homo sapiens
gaactcgggattacaga

SEQ ID NO: 619818 - DNA, 19 bp, Homo sapiens
gaactcgggattacagaaa

SEQ ID NO: 619819 - DNA, 13 bp, Homo sapiens
gaactctttcccc

SEQ ID NO: 619820 - DNA, 14 bp, Homo sapiens
gaactctttcccca

SEQ ID NO: 619821 - DNA, 17 bp, Homo sapiens
gaactctttccccagct

SEQ ID NO: 619822 - DNA, 15 bp, Homo sapiens
gaactgaagcagagt

SEQ ID NO: 619823 - DNA, 18 bp, Homo sapiens
gaactgccccatctcctc

SEQ ID NO: 619824 - DNA, 18 bp, Homo sapiens
gaactgggttctttggaa

SEQ ID NO: 619825 - DNA, 19 bp, Homo sapiens
gaacttggtgcctaatgtt

SEQ ID NO: 619826 - DNA, 20 bp, Homo sapiens
gaagaaacacagcatgcatt

SEQ ID NO: 619827 - DNA, 21 bp, Homo sapiens
gaagaaacacagcatgcattt

SEQ ID NO: 619828 - DNA, 21 bp, Homo sapiens
gaagaaggactgaagaaaatc

SEQ ID NO: 619829 - DNA, 15 bp, Homo sapiens
gaagaccctatctcc

SEQ ID NO: 619830 - DNA, 21 bp, Homo sapiens
gaagagaagaaatagcagagc

SEQ ID NO: 619831 - DNA, 17 bp, Homo sapiens
gaagagcctgactgtgt

SEQ ID NO: 619832 - DNA, 21 bp, Homo sapiens
gaagatgtttaacttaatcaa

SEQ ID NO: 619833 - DNA, 18 bp, Homo sapiens
gaagcaaacacacagact

SEQ ID NO: 619834 - DNA, 15 bp, Homo sapiens
gaagcaaataaatat

SEQ ID NO: 619835 - DNA, 15 bp, Homo sapiens
gaagcacctctcagc

SEQ ID NO: 619836 - DNA, 22 bp, Homo sapiens
gaagcagaatgagatgatttaa

SEQ ID NO: 619837 - DNA, 13 bp, Homo sapiens
gaagcccacccgc

SEQ ID NO: 619838 - DNA, 14 bp, Homo sapiens
gaagcccacccgcc

SEQ ID NO: 619839 - DNA, 18 bp, Homo sapiens
gaagcccacccgccccag

SEQ ID NO: 619840 - DNA, 20 bp, Homo sapiens
gaagcccacccgccccagag

SEQ ID NO: 619841 - DNA, 19 bp, Homo sapiens
gaagccccttggagagaga

SEQ ID NO: 619842 - DNA, 13 bp, Homo sapiens
gaagctaaaacac

SEQ ID NO: 619843 - DNA, 15 bp, Homo sapiens
gaagctcaaggctgc

SEQ ID NO: 619844 - DNA, 18 bp, Homo sapiens
gaagctcaaggctgcagt

SEQ ID NO: 619845 - DNA, 16 bp, Homo sapiens
gaagctttggaagcag

SEQ ID NO: 619846 - DNA, 17 bp, Homo sapiens
gaagctttggaagcagc

SEQ ID NO: 619847 - DNA, 19 bp, Homo sapiens
gaagctttggaagcagcaa

SEQ ID NO: 619848 - DNA, 13 bp, Homo sapiens
gaaggagaggagt

SEQ ID NO: 619849 - DNA, 19 bp, Homo sapiens
gaaggcaaaaactgtactg

SEQ ID NO: 619850 - DNA, 21 bp, Homo sapiens
gaaggcccgaggaggccgact

SEQ ID NO: 619851 - DNA, 13 bp, Homo sapiens
gaaggcctgaggg

SEQ ID NO: 619852 - DNA, 23 bp, Homo sapiens
gaaggcctgagggaagcccaccc

SEQ ID NO: 619853 - DNA, 16 bp, Homo sapiens
gaagggaaatcaattt

SEQ ID NO: 619854 - DNA, 17 bp, Homo sapiens
gaagggagtgaaaacct

SEQ ID NO: 619855 - DNA, 14 bp, Homo sapiens
gaagggccaccctg

SEQ ID NO: 619856 - DNA, 15 bp, Homo sapiens
gaagggccaccctga

SEQ ID NO: 619857 - DNA, 19 bp, Homo sapiens
gaagggccaccctgagcag

SEQ ID NO: 619858 - DNA, 20 bp, Homo sapiens
gaagggcgctgagggcaggg

SEQ ID NO: 619859 - DNA, 15 bp, Homo sapiens
gaagggtgcctggct

SEQ ID NO: 619860 - DNA, 17 bp, Homo sapiens
gaagggtgcctggctgg

SEQ ID NO: 619861 - DNA, 18 bp, Homo sapiens
gaagggtgcctggctggg

SEQ ID NO: 619862 - DNA, 23 bp, Homo sapiens
gaagggttctgccctgcctgagg

SEQ ID NO: 619863 - DNA, 17 bp, Homo sapiens
gaagtaagttcatcaaa

SEQ ID NO: 619864 - DNA, 20 bp, Homo sapiens
gaagtatagatggtagaaac

SEQ ID NO: 619865 - DNA, 22 bp, Homo sapiens
gaagtatagatggtagaaactt

SEQ ID NO: 619866 - DNA, 18 bp, Homo sapiens
gaagtcccttcctgtcct

SEQ ID NO: 619867 - DNA, 20 bp, Homo sapiens
gaagtgggattcaggaatgg

SEQ ID NO: 619868 - DNA, 21 bp, Homo sapiens
gaagtgggattcaggaatggg

SEQ ID NO: 619869 - DNA, 22 bp, Homo sapiens
gaagtgggattcaggaatgggc

SEQ ID NO: 619870 - DNA, 16 bp, Homo sapiens
gaagttgtcctttctg

SEQ ID NO: 619871 - DNA, 22 bp, Homo sapiens
gaagttttacttgattaaggac

SEQ ID NO: 619872 - DNA, 16 bp, Homo sapiens
gaataacaacaattta

SEQ ID NO: 619873 - DNA, 22 bp, Homo sapiens
gaataacactcaagactatgtt

SEQ ID NO: 619874 - DNA, 15 bp, Homo sapiens
gaatagagttttcct

SEQ ID NO: 619875 - DNA, 20 bp, Homo sapiens
gaatattaaagtctgagaaa

SEQ ID NO: 619876 - DNA, 14 bp, Homo sapiens
gaatattgctgatg

SEQ ID NO: 619877 - DNA, 19 bp, Homo sapiens
gaatattgctgatggtgca

SEQ ID NO: 619878 - DNA, 22 bp, Homo sapiens
gaatattgctgatggtgcaatg

SEQ ID NO: 619879 - DNA, 19 bp, Homo sapiens
gaatcaacagtgaacagct

SEQ ID NO: 619880 - DNA, 15 bp, Homo sapiens
gaatcagaggcagag

SEQ ID NO: 619881 - DNA, 19 bp, Homo sapiens
gaatctctcaaaatgtgcc

SEQ ID NO: 619882 - DNA, 19 bp, Homo sapiens
gaatgaaatataaactgtg

SEQ ID NO: 619883 - DNA, 24 bp, Homo sapiens
gaatgaaatataaactgtgagata

SEQ ID NO: 619884 - DNA, 16 bp, Homo sapiens
gaatgagatgatttaa

SEQ ID NO: 619885 - DNA, 18 bp, Homo sapiens
gaatgagggcgtgaaaca

SEQ ID NO: 619886 - DNA, 21 bp, Homo sapiens
gaatgagggcgtgaaacacaa

SEQ ID NO: 619887 - DNA, 23 bp, Homo sapiens
gaatgagggcgtgaaacacaata

SEQ ID NO: 619888 - DNA, 21 bp, Homo sapiens
gaatgccgcgaactgggttct

SEQ ID NO: 619889 - DNA, 16 bp, Homo sapiens
gaatgctcaatgtgct

SEQ ID NO: 619890 - DNA, 20 bp, Homo sapiens
gaatgggccaagccagggtt

SEQ ID NO: 619891 - DNA, 11 bp, Homo sapiens
gaatggggctt

SEQ ID NO: 619892 - DNA, 19 bp, Homo sapiens
gaatggggggcgggccagg

SEQ ID NO: 619893 - DNA, 23 bp, Homo sapiens
gaatggggggcgggccagggtgg

SEQ ID NO: 619894 - DNA, 15 bp, Homo sapiens
gaatggtgggctcca

SEQ ID NO: 619895 - DNA, 18 bp, Homo sapiens
gaatggtgggctccagag

SEQ ID NO: 619896 - DNA, 11 bp, Homo sapiens
gaatgtgaaaa

SEQ ID NO: 619897 - DNA, 12 bp, Homo sapiens
gaatgtgaaaaa

SEQ ID NO: 619898 - DNA, 22 bp, Homo sapiens
gaatgtgaaaaaaaaaagtaat

SEQ ID NO: 619899 - DNA, 19 bp, Homo sapiens
gacaccctttaatgttcta

SEQ ID NO: 619900 - DNA, 22 bp, Homo sapiens
gacacgtttggccagtgacatt

SEQ ID NO: 619901 - DNA, 13 bp, Homo sapiens
gacactcagatgc

SEQ ID NO: 619902 - DNA, 19 bp, Homo sapiens
gacactgatgggtcctgct

SEQ ID NO: 619903 - DNA, 20 bp, Homo sapiens
gacactgatgggtcctgctg

SEQ ID NO: 619904 - DNA, 22 bp, Homo sapiens
gacactgatgggtcctgctgct

SEQ ID NO: 619905 - DNA, 14 bp, Homo sapiens
gacagaaggcccga

SEQ ID NO: 619906 - DNA, 20 bp, Homo sapiens
gacagaaggcccgaggaggc

SEQ ID NO: 619907 - DNA, 14 bp, Homo sapiens
gacagagatttggt

SEQ ID NO: 619908 - DNA, 12 bp, Homo sapiens
gacagagtggat

SEQ ID NO: 619909 - DNA, 13 bp, Homo sapiens
gacagatcttgag

SEQ ID NO: 619910 - DNA, 15 bp, Homo sapiens
gacagatcttgagca

SEQ ID NO: 619911 - DNA, 18 bp, Homo sapiens
gacagatcttgagcaagg

SEQ ID NO: 619912 - DNA, 16 bp, Homo sapiens
gacagcaaacacagtc

SEQ ID NO: 619913 - DNA, 14 bp, Homo sapiens
gacagcggcccggc

SEQ ID NO: 619914 - DNA, 20 bp, Homo sapiens
gacaggcgccgcctcgcccc

SEQ ID NO: 619915 - DNA, 14 bp, Homo sapiens
gacagggcgtcctc

SEQ ID NO: 619916 - DNA, 23 bp, Homo sapiens
gacagggtggggcttagaatggg

SEQ ID NO: 619917 - DNA, 14 bp, Homo sapiens
gacagtagcatact

SEQ ID NO: 619918 - DNA, 13 bp, Homo sapiens
gacagtgcagtgc

SEQ ID NO: 619919 - DNA, 20 bp, Homo sapiens
gacagttttccataaagaag

SEQ ID NO: 619920 - DNA, 15 bp, Homo sapiens
gacatggtgctgtgt

SEQ ID NO: 619921 - DNA, 11 bp, Homo sapiens
gacatgtacag

SEQ ID NO: 619922 - DNA, 21 bp, Homo sapiens
gacatgtctttggcttcagaa

SEQ ID NO: 619923 - DNA, 13 bp, Homo sapiens
gacattttgtagc

SEQ ID NO: 619924 - DNA, 17 bp, Homo sapiens
gacattttgtagctagt

SEQ ID NO: 619925 - DNA, 21 bp, Homo sapiens
gaccaaggtgcggaccggagc

SEQ ID NO: 619926 - DNA, 14 bp, Homo sapiens
gaccacccctgtgc

SEQ ID NO: 619927 - DNA, 22 bp, Homo sapiens
gaccaccgcgcccctctgcgcc

SEQ ID NO: 619928 - DNA, 18 bp, Homo sapiens
gaccacgacctcgtccat

SEQ ID NO: 619929 - DNA, 19 bp, Homo sapiens
gaccacggtccaatccagc

SEQ ID NO: 619930 - DNA, 15 bp, Homo sapiens
gaccacttccttaac

SEQ ID NO: 619931 - DNA, 17 bp, Homo sapiens
gaccagcatagttctgc

SEQ ID NO: 619932 - DNA, 21 bp, Homo sapiens
gaccagcctgccaggccctcc

SEQ ID NO: 619933 - DNA, 18 bp, Homo sapiens
gaccatttagtcctcacc

SEQ ID NO: 619934 - DNA, 20 bp, Homo sapiens
gaccatttagtcctcacctt

SEQ ID NO: 619935 - DNA, 12 bp, Homo sapiens
gacccagcctga

SEQ ID NO: 619936 - DNA, 13 bp, Homo sapiens
gaccccacacgcc

SEQ ID NO: 619937 - DNA, 19 bp, Homo sapiens
gaccccacacgccggggct

SEQ ID NO: 619938 - DNA, 20 bp, Homo sapiens
gaccccacacgccggggctg

SEQ ID NO: 619939 - DNA, 21 bp, Homo sapiens
gaccccacacgccggggctgg

SEQ ID NO: 619940 - DNA, 14 bp, Homo sapiens
gaccccatctcatt

SEQ ID NO: 619941 - DNA, 13 bp, Homo sapiens
gacccctgccctc

SEQ ID NO: 619942 - DNA, 17 bp, Homo sapiens
gaccctatctcccacaa

SEQ ID NO: 619943 - DNA, 17 bp, Homo sapiens
gaccctatttgtttcat

SEQ ID NO: 619944 - DNA, 12 bp, Homo sapiens
gaccctcacctg

SEQ ID NO: 619945 - DNA, 17 bp, Homo sapiens
gaccctgcgcccctgcc

SEQ ID NO: 619946 - DNA, 19 bp, Homo sapiens
gaccctgcgcccctgccca

SEQ ID NO: 619947 - DNA, 17 bp, Homo sapiens
gaccgacgcccctccgg

SEQ ID NO: 619948 - DNA, 19 bp, Homo sapiens
gaccggagcggctgaggac

SEQ ID NO: 619949 - DNA, 15 bp, Homo sapiens
gaccggcccgccacc

SEQ ID NO: 619950 - DNA, 17 bp, Homo sapiens
gacctacatctgaaatc

SEQ ID NO: 619951 - DNA, 20 bp, Homo sapiens
gacctccctgtctctacaaa

SEQ ID NO: 619952 - DNA, 16 bp, Homo sapiens
gacctgctcctgccca

SEQ ID NO: 619953 - DNA, 14 bp, Homo sapiens
gaccttcggcagtg

SEQ ID NO: 619954 - DNA, 15 bp, Homo sapiens
gaccttcggcagtgg

SEQ ID NO: 619955 - DNA, 17 bp, Homo sapiens
gaccttcggcagtggct

SEQ ID NO: 619956 - DNA, 18 bp, Homo sapiens
gaccttcggcagtggctg

SEQ ID NO: 619957 - DNA, 19 bp, Homo sapiens
gaccttcggcagtggctgg

SEQ ID NO: 619958 - DNA, 21 bp, Homo sapiens
gacctttcaataggaaaaact

SEQ ID NO: 619959 - DNA, 14 bp, Homo sapiens
gacctttctgagtg

SEQ ID NO: 619960 - DNA, 15 bp, Homo sapiens
gacgacctacatctg

SEQ ID NO: 619961 - DNA, 20 bp, Homo sapiens
gacgacctacatctgaaatc

SEQ ID NO: 619962 - DNA, 18 bp, Homo sapiens
gacgagcagagcgcagcc

SEQ ID NO: 619963 - DNA, 23 bp, Homo sapiens
gacgatccccatggaacagccct

SEQ ID NO: 619964 - DNA, 12 bp, Homo sapiens
gacgcatgcagg

SEQ ID NO: 619965 - DNA, 16 bp, Homo sapiens
gacgcatgcagggccc

SEQ ID NO: 619966 - DNA, 11 bp, Homo sapiens
gacgcccagcc

SEQ ID NO: 619967 - DNA, 16 bp, Homo sapiens
gacgcccctccgggca

SEQ ID NO: 619968 - DNA, 19 bp, Homo sapiens
gacgctggagaccctgcgc

SEQ ID NO: 619969 - DNA, 14 bp, Homo sapiens
gacgctggtaactg

SEQ ID NO: 619970 - DNA, 13 bp, Homo sapiens
gacggcagcccca

SEQ ID NO: 619971 - DNA, 14 bp, Homo sapiens
gacggcagccccat

SEQ ID NO: 619972 - DNA, 18 bp, Homo sapiens
gacggcagccccatcctt

SEQ ID NO: 619973 - DNA, 12 bp, Homo sapiens
gacgggacagcg

SEQ ID NO: 619974 - DNA, 22 bp, Homo sapiens
gacgggacagcggcccggccca

SEQ ID NO: 619975 - DNA, 20 bp, Homo sapiens
gacgtcgctgtccgtcctgc

SEQ ID NO: 619976 - DNA, 14 bp, Homo sapiens
gactacagaagtgg

SEQ ID NO: 619977 - DNA, 17 bp, Homo sapiens
gactacagaagtggaag

SEQ ID NO: 619978 - DNA, 20 bp, Homo sapiens
gactccagtggggcaagatt

SEQ ID NO: 619979 - DNA, 21 bp, Homo sapiens
gactccccgcccgccctcctc

SEQ ID NO: 619980 - DNA, 20 bp, Homo sapiens
gactcctcaattccagggaa

SEQ ID NO: 619981 - DNA, 20 bp, Homo sapiens
gactcgagagggctgagccc

SEQ ID NO: 619982 - DNA, 13 bp, Homo sapiens
gactcgcgacaat

SEQ ID NO: 619983 - DNA, 17 bp, Homo sapiens
gactcgcgacaatgcaa

SEQ ID NO: 619984 - DNA, 22 bp, Homo sapiens
gactctaaaactatcagcagcg

SEQ ID NO: 619985 - DNA, 17 bp, Homo sapiens
gagaagggttctgccct

SEQ ID NO: 619986 - DNA, 23 bp, Homo sapiens
gagacaaagtttggaagtacata

SEQ ID NO: 619987 - DNA, 13 bp, Homo sapiens
gagaccagcctgc

SEQ ID NO: 619988 - DNA, 22 bp, Homo sapiens
gagaccagcctgccaggccctc

SEQ ID NO: 619989 - DNA, 17 bp, Homo sapiens
gagaccctgcgcccctg

SEQ ID NO: 619990 - DNA, 20 bp, Homo sapiens
gagaccctgcgcccctgccc

SEQ ID NO: 619991 - DNA, 21 bp, Homo sapiens
gagaccctgcgcccctgccca

SEQ ID NO: 619992 - DNA, 15 bp, Homo sapiens
gagacggcagcccca

SEQ ID NO: 619993 - DNA, 22 bp, Homo sapiens
gagactaacttattttgattgt

SEQ ID NO: 619994 - DNA, 13 bp, Homo sapiens
gagactccaagga

SEQ ID NO: 619995 - DNA, 16 bp, Homo sapiens
gagactcgcctgggaa

SEQ ID NO: 619996 - DNA, 19 bp, Homo sapiens
gagactgcccaccctgggc

SEQ ID NO: 619997 - DNA, 16 bp, Homo sapiens
gagactggttttttcc

SEQ ID NO: 619998 - DNA, 19 bp, Homo sapiens
gagacttcctattaattta

SEQ ID NO: 619999 - DNA, 21 bp, Homo sapiens
gagacttcctattaatttatt

SEQ ID NO: 620000 - DNA, 15 bp, Homo sapiens
gagagaacagggatg

SEQ ID NO: 620001 - DNA, 14 bp, Homo sapiens
gagagagaggctgc

SEQ ID NO: 620002 - DNA, 14 bp, Homo sapiens
gagagagcaatctt

SEQ ID NO: 620003 - DNA, 18 bp, Homo sapiens
gagagatatatctgaaaa

SEQ ID NO: 620004 - DNA, 17 bp, Homo sapiens
gagagcagcaggtgctg

SEQ ID NO: 620005 - DNA, 18 bp, Homo sapiens
gagagccctctgctgctt

SEQ ID NO: 620006 - DNA, 21 bp, Homo sapiens
gagagcctttctccagcccat

SEQ ID NO: 620007 - DNA, 23 bp, Homo sapiens
gagagcctttctccagcccatgc

SEQ ID NO: 620008 - DNA, 15 bp, Homo sapiens
gagagcgccacccgc

SEQ ID NO: 620009 - DNA, 15 bp, Homo sapiens
gagagcggcttcccc

SEQ ID NO: 620010 - DNA, 11 bp, Homo sapiens
gagagggctga

SEQ ID NO: 620011 - DNA, 12 bp, Homo sapiens
gagagggctgag

SEQ ID NO: 620012 - DNA, 15 bp, Homo sapiens
gagagggctgagccc

SEQ ID NO: 620013 - DNA, 19 bp, Homo sapiens
gagagggctgagcccctcc

SEQ ID NO: 620014 - DNA, 23 bp, Homo sapiens
gagagggggatgcccctggccct

SEQ ID NO: 620015 - DNA, 18 bp, Homo sapiens
gagatatatctgaaaact

SEQ ID NO: 620016 - DNA, 14 bp, Homo sapiens
gagatcagaattga

SEQ ID NO: 620017 - DNA, 12 bp, Homo sapiens
gagatgggaagg

SEQ ID NO: 620018 - DNA, 17 bp, Homo sapiens
gagatgttattactgtt

SEQ ID NO: 620019 - DNA, 20 bp, Homo sapiens
gagattccctctcctccccc

SEQ ID NO: 620020 - DNA, 20 bp, Homo sapiens
gagcaaactgaagcccacag

SEQ ID NO: 620021 - DNA, 20 bp, Homo sapiens
gagcaaggacaacctgcccc

SEQ ID NO: 620022 - DNA, 20 bp, Homo sapiens
gagcaatcttgctgtgaaac

SEQ ID NO: 620023 - DNA, 12 bp, Homo sapiens
gagcacagccat

SEQ ID NO: 620024 - DNA, 17 bp, Homo sapiens
gagcaccacggggtcgg

SEQ ID NO: 620025 - DNA, 22 bp, Homo sapiens
gagcaccacggggtcgggggag

SEQ ID NO: 620026 - DNA, 16 bp, Homo sapiens
gagcacccccagcctc

SEQ ID NO: 620027 - DNA, 19 bp, Homo sapiens
gagcacccccagcctcccc

SEQ ID NO: 620028 - DNA, 20 bp, Homo sapiens
gagcacccccagcctccccc

SEQ ID NO: 620029 - DNA, 21 bp, Homo sapiens
gagcacccccagcctccccca

SEQ ID NO: 620030 - DNA, 22 bp, Homo sapiens
gagcacccccagcctcccccag

SEQ ID NO: 620031 - DNA, 17 bp, Homo sapiens
gagcactagaatgagaa

SEQ ID NO: 620032 - DNA, 14 bp, Homo sapiens
gagcagacagggcg

SEQ ID NO: 620033 - DNA, 11 bp, Homo sapiens
gagcagagacg

SEQ ID NO: 620034 - DNA, 18 bp, Homo sapiens
gagcagagacggcagccc

SEQ ID NO: 620035 - DNA, 20 bp, Homo sapiens
gagcagagacggcagcccca

SEQ ID NO: 620036 - DNA, 15 bp, Homo sapiens
gagcagagcgcagcc

SEQ ID NO: 620037 - DNA, 20 bp, Homo sapiens
gagcagagcgcagcccccac

SEQ ID NO: 620038 - DNA, 13 bp, Homo sapiens
gagcagcaggtgc

SEQ ID NO: 620039 - DNA, 14 bp, Homo sapiens
gagccacagtgggg

SEQ ID NO: 620040 - DNA, 17 bp, Homo sapiens
gagccactacctttgtc

SEQ ID NO: 620041 - DNA, 23 bp, Homo sapiens
gagccactacctttgtccaggcc

SEQ ID NO: 620042 - DNA, 20 bp, Homo sapiens
gagccagatttcactctcct

SEQ ID NO: 620043 - DNA, 20 bp, Homo sapiens
gagccagcagacattgtcag

SEQ ID NO: 620044 - DNA, 19 bp, Homo sapiens
gagccagggcagaggaatg

SEQ ID NO: 620045 - DNA, 15 bp, Homo sapiens
gagcccccgcccctc

SEQ ID NO: 620046 - DNA, 12 bp, Homo sapiens
gagccccctggc

SEQ ID NO: 620047 - DNA, 18 bp, Homo sapiens
gagccccctggcggcagg

SEQ ID NO: 620048 - DNA, 13 bp, Homo sapiens
gagccccggagca

SEQ ID NO: 620049 - DNA, 15 bp, Homo sapiens
gagcccctcctctcc

SEQ ID NO: 620050 - DNA, 12 bp, Homo sapiens
gagccctgccct

SEQ ID NO: 620051 - DNA, 23 bp, Homo sapiens
gagccctgccctcactccactcc

SEQ ID NO: 620052 - DNA, 24 bp, Homo sapiens
gagccctgccctcactccactccc

SEQ ID NO: 620053 - DNA, 22 bp, Homo sapiens
gagccgtgacctccaggaaggg

SEQ ID NO: 620054 - DNA, 16 bp, Homo sapiens
gagcctatggaaaggg

SEQ ID NO: 620055 - DNA, 23 bp, Homo sapiens
gagcctatggaaagggtgtggct

SEQ ID NO: 620056 - DNA, 18 bp, Homo sapiens
gagcctgtcacgtggtca

SEQ ID NO: 620057 - DNA, 15 bp, Homo sapiens
gagcctgtctctccc

SEQ ID NO: 620058 - DNA, 16 bp, Homo sapiens
gagcctgtctctccct

SEQ ID NO: 620059 - DNA, 16 bp, Homo sapiens
gagccttgctgggcca

SEQ ID NO: 620060 - DNA, 17 bp, Homo sapiens
gagccttgctgggccag

SEQ ID NO: 620061 - DNA, 19 bp, Homo sapiens
gagccttgctgggccaggg

SEQ ID NO: 620062 - DNA, 20 bp, Homo sapiens
gagccttgctgggccaggga

SEQ ID NO: 620063 - DNA, 16 bp, Homo sapiens
gagcgatgtgttcttt

SEQ ID NO: 620064 - DNA, 14 bp, Homo sapiens
gagcgccacccgcc

SEQ ID NO: 620065 - DNA, 16 bp, Homo sapiens
gagcgccacccgcccg

SEQ ID NO: 620066 - DNA, 22 bp, Homo sapiens
gagcgccacccgcccgcccccg

SEQ ID NO: 620067 - DNA, 18 bp, Homo sapiens
gataggagggtgcccctg

SEQ ID NO: 620068 - DNA, 15 bp, Homo sapiens
gatagtttacaaaca

SEQ ID NO: 620069 - DNA, 13 bp, Homo sapiens
gatataagccata

SEQ ID NO: 620070 - DNA, 21 bp, Homo sapiens
gatataagccatagccccagg

SEQ ID NO: 620071 - DNA, 23 bp, Homo sapiens
gatataataaatatatatttatc

SEQ ID NO: 620072 - DNA, 16 bp, Homo sapiens
gatatatctgaaaact

SEQ ID NO: 620073 - DNA, 17 bp, Homo sapiens
gatatgaaagagaaaat

SEQ ID NO: 620074 - DNA, 15 bp, Homo sapiens
gatatgtctttaaaa

SEQ ID NO: 620075 - DNA, 16 bp, Homo sapiens
gatatgttgatgaaat

SEQ ID NO: 620076 - DNA, 15 bp, Homo sapiens
gatatttttaattta

SEQ ID NO: 620077 - DNA, 13 bp, Homo sapiens
gatcaagaatctt

SEQ ID NO: 620078 - DNA, 22 bp, Homo sapiens
gatcaagaatcttttgtgaaat

SEQ ID NO: 620079 - DNA, 15 bp, Homo sapiens
gatcacatgcccctc

SEQ ID NO: 620080 - DNA, 14 bp, Homo sapiens
gatcactttctgaa

SEQ ID NO: 620081 - DNA, 17 bp, Homo sapiens
gatccacttctctgtta

SEQ ID NO: 620082 - DNA, 12 bp, Homo sapiens
gatccagagaga

SEQ ID NO: 620083 - DNA, 15 bp, Homo sapiens
gatccagcggggctt

SEQ ID NO: 620084 - DNA, 21 bp, Homo sapiens
gatccagcggggcttctgggc

SEQ ID NO: 620085 - DNA, 19 bp, Homo sapiens
gatccagggatggagatgg

SEQ ID NO: 620086 - DNA, 20 bp, Homo sapiens
gatccctcggtcagcaccgt

SEQ ID NO: 620087 - DNA, 21 bp, Homo sapiens
gatcctctcttcttttcccat

SEQ ID NO: 620088 - DNA, 12 bp, Homo sapiens
gatcctgagcca

SEQ ID NO: 620089 - DNA, 13 bp, Homo sapiens
gatcctgagccag

SEQ ID NO: 620090 - DNA, 19 bp, Homo sapiens
gatcctgagccagatttca

SEQ ID NO: 620091 - DNA, 19 bp, Homo sapiens
gatcgtgccgtggagcttg

SEQ ID NO: 620092 - DNA, 22 bp, Homo sapiens
gatcgtgccgtggagcttggag

SEQ ID NO: 620093 - DNA, 20 bp, Homo sapiens
gatcgtttcacatctgtata

SEQ ID NO: 620094 - DNA, 22 bp, Homo sapiens
gatcgtttcacatctgtatatc

SEQ ID NO: 620095 - DNA, 20 bp, Homo sapiens
gatctaaaaggaggacaggg

SEQ ID NO: 620096 - DNA, 14 bp, Homo sapiens
gatctcatagatga

SEQ ID NO: 620097 - DNA, 15 bp, Homo sapiens
gatctggagtctgaa

SEQ ID NO: 620098 - DNA, 19 bp, Homo sapiens
gatctggagtctgaaggag

SEQ ID NO: 620099 - DNA, 21 bp, Homo sapiens
gatctggtgcgtgtggccctg

SEQ ID NO: 620100 - DNA, 12 bp, Homo sapiens
gatctgtccttc

SEQ ID NO: 620101 - DNA, 22 bp, Homo sapiens
gatctgtccttccaacctgttc

SEQ ID NO: 620102 - DNA, 21 bp, Homo sapiens
gatctgtgcagcgaggtccac

SEQ ID NO: 620103 - DNA, 12 bp, Homo sapiens
gatctgttgtaa

SEQ ID NO: 620104 - DNA, 16 bp, Homo sapiens
gatctttttttaagtg

SEQ ID NO: 620105 - DNA, 15 bp, Homo sapiens
gatgaaaaagcatgt

SEQ ID NO: 620106 - DNA, 16 bp, Homo sapiens
gatgaaaaagcatgta

SEQ ID NO: 620107 - DNA, 20 bp, Homo sapiens
gcatctgcctggagcctggg

SEQ ID NO: 620108 - DNA, 20 bp, Homo sapiens
gcatgacacgaatattgctg

SEQ ID NO: 620109 - DNA, 16 bp, Homo sapiens
gcatgagttctgcaca

SEQ ID NO: 620110 - DNA, 21 bp, Homo sapiens
gcatgcaccagtgccgcctgt

SEQ ID NO: 620111 - DNA, 16 bp, Homo sapiens
gcatgctcagtattga

SEQ ID NO: 620112 - DNA, 15 bp, Homo sapiens
gcatgctccctcatg

SEQ ID NO: 620113 - DNA, 20 bp, Homo sapiens
gcatggagaagggttctgcc

SEQ ID NO: 620114 - DNA, 17 bp, Homo sapiens
gcatgtaatattaaatt

SEQ ID NO: 620115 - DNA, 13 bp, Homo sapiens
gcatgtacagtgt

SEQ ID NO: 620116 - DNA, 20 bp, Homo sapiens
gcatgtattgtgtcttttgc

SEQ ID NO: 620117 - DNA, 18 bp, Homo sapiens
gcatgtcctatccctgga

SEQ ID NO: 620118 - DNA, 14 bp, Homo sapiens
gcatgtcggggccc

SEQ ID NO: 620119 - DNA, 18 bp, Homo sapiens
gcatgtcggggcccctgc

SEQ ID NO: 620120 - DNA, 19 bp, Homo sapiens
gcatgtcggggcccctgcg

SEQ ID NO: 620121 - DNA, 17 bp, Homo sapiens
gcatgtgatgagaggaa

SEQ ID NO: 620122 - DNA, 19 bp, Homo sapiens
gcatgtgatgagaggaaat

SEQ ID NO: 620123 - DNA, 14 bp, Homo sapiens
gcatgtttaataat

SEQ ID NO: 620124 - DNA, 23 bp, Homo sapiens
gcatgtttaataatatgtacaaa

SEQ ID NO: 620125 - DNA, 13 bp, Homo sapiens
gcattaagcacac

SEQ ID NO: 620126 - DNA, 15 bp, Homo sapiens
gcattaagcacacac

SEQ ID NO: 620127 - DNA, 21 bp, Homo sapiens
gcattaagcacacacatctgg

SEQ ID NO: 620128 - DNA, 20 bp, Homo sapiens
gcattactggccttttcact

SEQ ID NO: 620129 - DNA, 14 bp, Homo sapiens
gcattcagcacaca

SEQ ID NO: 620130 - DNA, 17 bp, Homo sapiens
gcattcagcacacacaa

SEQ ID NO: 620131 - DNA, 19 bp, Homo sapiens
gcattctggggtggggctt

SEQ ID NO: 620132 - DNA, 16 bp, Homo sapiens
gcattgaccttcatga

SEQ ID NO: 620133 - DNA, 15 bp, Homo sapiens
gcattgcactaaaag

SEQ ID NO: 620134 - DNA, 17 bp, Homo sapiens
gcattgcactaaaagtg

SEQ ID NO: 620135 - DNA, 23 bp, Homo sapiens
gcattgcactaaaagtgatgtga

SEQ ID NO: 620136 - DNA, 13 bp, Homo sapiens
gcatttagcacag

SEQ ID NO: 620137 - DNA, 23 bp, Homo sapiens
gcatttagcacagtatttaacat

SEQ ID NO: 620138 - DNA, 17 bp, Homo sapiens
gcatttagcatgagttc

SEQ ID NO: 620139 - DNA, 10 bp, Homo sapiens
gcatttatgc

SEQ ID NO: 620140 - DNA, 14 bp, Homo sapiens
gcatttatgcatga

SEQ ID NO: 620141 - DNA, 23 bp, Homo sapiens
gcatttatgcatgagaactaaat

SEQ ID NO: 620142 - DNA, 14 bp, Homo sapiens
gcatttcagctgtg

SEQ ID NO: 620143 - DNA, 21 bp, Homo sapiens
gcatttcttatttgtttggtc

SEQ ID NO: 620144 - DNA, 15 bp, Homo sapiens
gcatttgctgaataa

SEQ ID NO: 620145 - DNA, 16 bp, Homo sapiens
gccaaaatgtcaattt

SEQ ID NO: 620146 - DNA, 22 bp, Homo sapiens
gccaaaatgtcaatttttaact

SEQ ID NO: 620147 - DNA, 16 bp, Homo sapiens
gccaaagatagcagaa

SEQ ID NO: 620148 - DNA, 19 bp, Homo sapiens
gccaaataaatcatcctca

SEQ ID NO: 620149 - DNA, 20 bp, Homo sapiens
gccaaataaatcatcctcat

SEQ ID NO: 620150 - DNA, 11 bp, Homo sapiens
gccaaatgagt

SEQ ID NO: 620151 - DNA, 16 bp, Homo sapiens
gccaaggacactgatg

SEQ ID NO: 620152 - DNA, 14 bp, Homo sapiens
gccaaggtctgaac

SEQ ID NO: 620153 - DNA, 15 bp, Homo sapiens
gccaagtgtcctgct

SEQ ID NO: 620154 - DNA, 18 bp, Homo sapiens
gccaataaagctcacact

SEQ ID NO: 620155 - DNA, 21 bp, Homo sapiens
gccaatgaagcaaacacacag

SEQ ID NO: 620156 - DNA, 21 bp, Homo sapiens
gccaatgtccaggtcacaggc

SEQ ID NO: 620157 - DNA, 14 bp, Homo sapiens
gccaattcatctca

SEQ ID NO: 620158 - DNA, 19 bp, Homo sapiens
gccacaagggcagtggaag

SEQ ID NO: 620159 - DNA, 15 bp, Homo sapiens
gccacagtggggccc

SEQ ID NO: 620160 - DNA, 15 bp, Homo sapiens
gccacccgcccgccc

SEQ ID NO: 620161 - DNA, 17 bp, Homo sapiens
gccacccgcccgccccc

SEQ ID NO: 620162 - DNA, 13 bp, Homo sapiens
gccaccctgagca

SEQ ID NO: 620163 - DNA, 23 bp, Homo sapiens
gccaccctggcatgctgtctcta

SEQ ID NO: 620164 - DNA, 16 bp, Homo sapiens
gccacctgccaggcct

SEQ ID NO: 620165 - DNA, 16 bp, Homo sapiens
gccactacctttgtcc

SEQ ID NO: 620166 - DNA, 16 bp, Homo sapiens
gccacttatttccatg

SEQ ID NO: 620167 - DNA, 14 bp, Homo sapiens
gccagacagagatc

SEQ ID NO: 620168 - DNA, 14 bp, Homo sapiens
gccagcagacattg

SEQ ID NO: 620169 - DNA, 15 bp, Homo sapiens
gccagcagacattgt

SEQ ID NO: 620170 - DNA, 22 bp, Homo sapiens
gccagccatgcccacgcccctc

SEQ ID NO: 620171 - DNA, 15 bp, Homo sapiens
gccagcgcagcgcca

SEQ ID NO: 620172 - DNA, 14 bp, Homo sapiens
gccagcgctgaaca

SEQ ID NO: 620173 - DNA, 22 bp, Homo sapiens
gccagcgctgaacagaccgggg

SEQ ID NO: 620174 - DNA, 13 bp, Homo sapiens
gccagctctgagc

SEQ ID NO: 620175 - DNA, 20 bp, Homo sapiens
gccagctgcaggaatcaaaa

SEQ ID NO: 620176 - DNA, 14 bp, Homo sapiens
gccaggagaccctg

SEQ ID NO: 620177 - DNA, 16 bp, Homo sapiens
gccaggagaccctgtc

SEQ ID NO: 620178 - DNA, 17 bp, Homo sapiens
gccaggcacggaggctc

SEQ ID NO: 620179 - DNA, 13 bp, Homo sapiens
gccaggccctcca

SEQ ID NO: 620180 - DNA, 19 bp, Homo sapiens
gccaggctagactaggagg

SEQ ID NO: 620181 - DNA, 15 bp, Homo sapiens
gccagggcagaggaa

SEQ ID NO: 620182 - DNA, 17 bp, Homo sapiens
gccagggctcagatggg

SEQ ID NO: 620183 - DNA, 14 bp, Homo sapiens
gccaggggcaggca

SEQ ID NO: 620184 - DNA, 15 bp, Homo sapiens
gccaggggcaggcag

SEQ ID NO: 620185 - DNA, 23 bp, Homo sapiens
gccaggggcttctccccctcagc

SEQ ID NO: 620186 - DNA, 15 bp, Homo sapiens
gccagggtgggaaga

SEQ ID NO: 620187 - DNA, 14 bp, Homo sapiens
gccagggttccaga

SEQ ID NO: 620188 - DNA, 22 bp, Homo sapiens
gccagggttccagacagggtgg

SEQ ID NO: 620189 - DNA, 23 bp, Homo sapiens
gccagggttccagacagggtggg

SEQ ID NO: 620190 - DNA, 21 bp, Homo sapiens
gccaggtctggcgccaggggc

SEQ ID NO: 620191 - DNA, 17 bp, Homo sapiens
gccagtggcacaggaga

SEQ ID NO: 620192 - DNA, 22 bp, Homo sapiens
gccagtgtttagaagagcctga

SEQ ID NO: 620193 - DNA, 13 bp, Homo sapiens
gccatacttccag

SEQ ID NO: 620194 - DNA, 20 bp, Homo sapiens
gccatctccaccctgagcct

SEQ ID NO: 620195 - DNA, 16 bp, Homo sapiens
gccatgtatgttgcat

SEQ ID NO: 620196 - DNA, 19 bp, Homo sapiens
gccattgaacactgcaccc

SEQ ID NO: 620197 - DNA, 17 bp, Homo sapiens
gcccaaataacagtggc

SEQ ID NO: 620198 - DNA, 21 bp, Homo sapiens
gcccaaataacagtggcaagc

SEQ ID NO: 620199 - DNA, 14 bp, Homo sapiens
gcccaacccccacc

SEQ ID NO: 620200 - DNA, 17 bp, Homo sapiens
gcccacatttgggctca

SEQ ID NO: 620201 - DNA, 18 bp, Homo sapiens
gcccacatttgggctcag

SEQ ID NO: 620202 - DNA, 16 bp, Homo sapiens
gcccacccagcagcgc

SEQ ID NO: 620203 - DNA, 17 bp, Homo sapiens
gcccacccagcagcgcc

SEQ ID NO: 620204 - DNA, 18 bp, Homo sapiens
gcccacccagcagcgccc

SEQ ID NO: 620205 - DNA, 17 bp, Homo sapiens
gcccaccccgctgcctg

SEQ ID NO: 620206 - DNA, 20 bp, Homo sapiens
gcccaccccgctgcctggcg

SEQ ID NO: 620207 - DNA, 12 bp, Homo sapiens
gcccacccctct

SEQ ID NO: 620208 - DNA, 15 bp, Homo sapiens
gcccacccgccccag

SEQ ID NO: 620209 - DNA, 20 bp, Homo sapiens
gcccacccgccccagagact

SEQ ID NO: 620210 - DNA, 23 bp, Homo sapiens
gcccacccgtgttctcctccaaa

SEQ ID NO: 620211 - DNA, 22 bp, Homo sapiens
gcccacctaaagggaagccctg

SEQ ID NO: 620212 - DNA, 15 bp, Homo sapiens
gcccacctgcccagt

SEQ ID NO: 620213 - DNA, 23 bp, Homo sapiens
gcccacgcccctccccagccccc

SEQ ID NO: 620214 - DNA, 13 bp, Homo sapiens
gcccacgtgcagc

SEQ ID NO: 620215 - DNA, 19 bp, Homo sapiens
gcccacgtgcagcacctgt

SEQ ID NO: 620216 - DNA, 22 bp, Homo sapiens
gcccacgtgtgcagactgtggc

SEQ ID NO: 620217 - DNA, 19 bp, Homo sapiens
gcccagaacgggcctcccc

SEQ ID NO: 620218 - DNA, 19 bp, Homo sapiens
gcccagcccccacccccgt

SEQ ID NO: 620219 - DNA, 12 bp, Homo sapiens
gcccagccctgg

SEQ ID NO: 620220 - DNA, 14 bp, Homo sapiens
gcccagccctgggc

SEQ ID NO: 620221 - DNA, 21 bp, Homo sapiens
gcccagcctatctctcttctg

SEQ ID NO: 620222 - DNA, 12 bp, Homo sapiens
gcccagcctctt

SEQ ID NO: 620223 - DNA, 13 bp, Homo sapiens
gcccagcctcttg

SEQ ID NO: 620224 - DNA, 12 bp, Homo sapiens
gcccagggaggt

SEQ ID NO: 620225 - DNA, 20 bp, Homo sapiens
gcccagggaggtggcaggga

SEQ ID NO: 620226 - DNA, 17 bp, Homo sapiens
gcagcaccagcctgagc

SEQ ID NO: 620227 - DNA, 18 bp, Homo sapiens
gcagcaccagcctgagcc

SEQ ID NO: 620228 - DNA, 19 bp, Homo sapiens
gcagcaccagcctgagcca

SEQ ID NO: 620229 - DNA, 20 bp, Homo sapiens
gcagcaccagcctgagccac

SEQ ID NO: 620230 - DNA, 14 bp, Homo sapiens
gcagcacctccggg

SEQ ID NO: 620231 - DNA, 17 bp, Homo sapiens
gcagcacctgtcacctt

SEQ ID NO: 620232 - DNA, 20 bp, Homo sapiens
gcagcagattttaggaaatg

SEQ ID NO: 620233 - DNA, 15 bp, Homo sapiens
gcagcagcagcagca

SEQ ID NO: 620234 - DNA, 17 bp, Homo sapiens
gcagcagcagcagcagt

SEQ ID NO: 620235 - DNA, 17 bp, Homo sapiens
gcagcagtaccatccca

SEQ ID NO: 620236 - DNA, 21 bp, Homo sapiens
gcagcagtaccatcccactga

SEQ ID NO: 620237 - DNA, 19 bp, Homo sapiens
gcagcccagaacgggcctc

SEQ ID NO: 620238 - DNA, 17 bp, Homo sapiens
gcagccccatccttccc

SEQ ID NO: 620239 - DNA, 14 bp, Homo sapiens
gcagccccctgtgg

SEQ ID NO: 620240 - DNA, 17 bp, Homo sapiens
gcagccccgcgaccacc

SEQ ID NO: 620241 - DNA, 11 bp, Homo sapiens
gcagcccctgc

SEQ ID NO: 620242 - DNA, 15 bp, Homo sapiens
gcagcccctgctgga

SEQ ID NO: 620243 - DNA, 22 bp, Homo sapiens
gcagcccctgctggaccaaggt

SEQ ID NO: 620244 - DNA, 16 bp, Homo sapiens
gcagccctcacctctg

SEQ ID NO: 620245 - DNA, 21 bp, Homo sapiens
gcagccgcgctctgcccctcc

SEQ ID NO: 620246 - DNA, 13 bp, Homo sapiens
gcagcctgaagcc

SEQ ID NO: 620247 - DNA, 16 bp, Homo sapiens
gcagcctgaagcctgg

SEQ ID NO: 620248 - DNA, 17 bp, Homo sapiens
gcagcctgagctccacc

SEQ ID NO: 620249 - DNA, 22 bp, Homo sapiens
gcagcctgagctccaccctccc

SEQ ID NO: 620250 - DNA, 21 bp, Homo sapiens
gcagcgcccgaggccagggcc

SEQ ID NO: 620251 - DNA, 13 bp, Homo sapiens
gcagcgcctcccg

SEQ ID NO: 620252 - DNA, 15 bp, Homo sapiens
gcagcgcctcccgcc

SEQ ID NO: 620253 - DNA, 17 bp, Homo sapiens
gcagcggcagcagcagc

SEQ ID NO: 620254 - DNA, 17 bp, Homo sapiens
gcagctaatttgtgaaa

SEQ ID NO: 620255 - DNA, 23 bp, Homo sapiens
gcagctaggcagggagggggctg

SEQ ID NO: 620256 - DNA, 21 bp, Homo sapiens
gcaggaggacagagtgccctg

SEQ ID NO: 620257 - DNA, 15 bp, Homo sapiens
gcaggcagctaggca

SEQ ID NO: 620258 - DNA, 18 bp, Homo sapiens
gcaggcaggtgggggctg

SEQ ID NO: 620259 - DNA, 21 bp, Homo sapiens
gcaggcgcgcaccgcccaacc

SEQ ID NO: 620260 - DNA, 18 bp, Homo sapiens
gcagggaagggtgcctgg

SEQ ID NO: 620261 - DNA, 14 bp, Homo sapiens
gcagggacagcctg

SEQ ID NO: 620262 - DNA, 17 bp, Homo sapiens
gcagggccctggggtct

SEQ ID NO: 620263 - DNA, 20 bp, Homo sapiens
gcagggccctggggtctctg

SEQ ID NO: 620264 - DNA, 14 bp, Homo sapiens
gcaggggggttggg

SEQ ID NO: 620265 - DNA, 18 bp, Homo sapiens
gcagggttctagaagggg

SEQ ID NO: 620266 - DNA, 23 bp, Homo sapiens
gcagggttctagaaggggcgagg

SEQ ID NO: 620267 - DNA, 17 bp, Homo sapiens
gcaggtgaccagaatga

SEQ ID NO: 620268 - DNA, 22 bp, Homo sapiens
gcaggtgggctgcctgctgtgt

SEQ ID NO: 620269 - DNA, 20 bp, Homo sapiens
gcagtaccatcccactgata

SEQ ID NO: 620270 - DNA, 17 bp, Homo sapiens
gcagtagagagcctttc

SEQ ID NO: 620271 - DNA, 17 bp, Homo sapiens
gcagtatgtacaggctg

SEQ ID NO: 620272 - DNA, 14 bp, Homo sapiens
gcagtcatcagaag

SEQ ID NO: 620273 - DNA, 21 bp, Homo sapiens
gcagtgaacacactcagcagc

SEQ ID NO: 620274 - DNA, 23 bp, Homo sapiens
gcagtgaacacactcagcagccc

SEQ ID NO: 620275 - DNA, 17 bp, Homo sapiens
gcagtggctgggggact

SEQ ID NO: 620276 - DNA, 21 bp, Homo sapiens
gcagtggctgggggactgctt

SEQ ID NO: 620277 - DNA, 15 bp, Homo sapiens
gcagtggtgatgcct

SEQ ID NO: 620278 - DNA, 21 bp, Homo sapiens
gcagtggtgatgcctaaagga

SEQ ID NO: 620279 - DNA, 14 bp, Homo sapiens
gcagtttggccctg

SEQ ID NO: 620280 - DNA, 19 bp, Homo sapiens
gcagtttggccctggagcc

SEQ ID NO: 620281 - DNA, 22 bp, Homo sapiens
gcagtttggccctggagccagg

SEQ ID NO: 620282 - DNA, 14 bp, Homo sapiens
gcatagagctatat

SEQ ID NO: 620283 - DNA, 21 bp, Homo sapiens
gcatagggtttggaagaaagg

SEQ ID NO: 620284 - DNA, 19 bp, Homo sapiens
gcatatatataaaatacac

SEQ ID NO: 620285 - DNA, 21 bp, Homo sapiens
gcatatttatagagttattat

SEQ ID NO: 620286 - DNA, 19 bp, Homo sapiens
gcatccaccttcctgccca

SEQ ID NO: 620287 - DNA, 12 bp, Homo sapiens
gcatccaggcac

SEQ ID NO: 620288 - DNA, 16 bp, Homo sapiens
gcatcccttggcccct

SEQ ID NO: 620289 - DNA, 18 bp, Homo sapiens
gcatcccttggcccctct

SEQ ID NO: 620290 - DNA, 17 bp, Homo sapiens
gcatccgagcccctgtt

SEQ ID NO: 620291 - DNA, 18 bp, Homo sapiens
gcatccgctgcgctccca

SEQ ID NO: 620292 - DNA, 14 bp, Homo sapiens
gcatcctggaaatt

SEQ ID NO: 620293 - DNA, 19 bp, Homo sapiens
gcccaggggacgtggcgct

SEQ ID NO: 620294 - DNA, 16 bp, Homo sapiens
gcccagtccctggagc

SEQ ID NO: 620295 - DNA, 24 bp, Homo sapiens
gcccagtccctggagctgtccttc

SEQ ID NO: 620296 - DNA, 14 bp, Homo sapiens
gcccagtcttgagt

SEQ ID NO: 620297 - DNA, 13 bp, Homo sapiens
gcccagttagccc

SEQ ID NO: 620298 - DNA, 13 bp, Homo sapiens
gcccatcccctgc

SEQ ID NO: 620299 - DNA, 18 bp, Homo sapiens
gcccatcccctgcctcta

SEQ ID NO: 620300 - DNA, 12 bp, Homo sapiens
gcccatgctggc

SEQ ID NO: 620301 - DNA, 16 bp, Homo sapiens
gcccatgctggctggg

SEQ ID NO: 620302 - DNA, 17 bp, Homo sapiens
gcccatgctggctgggg

SEQ ID NO: 620303 - DNA, 18 bp, Homo sapiens
gcccatgctggctggggc

SEQ ID NO: 620304 - DNA, 19 bp, Homo sapiens
gcccatgctggctggggcc

SEQ ID NO: 620305 - DNA, 15 bp, Homo sapiens
gcccatggccccagc

SEQ ID NO: 620306 - DNA, 15 bp, Homo sapiens
gcccatggctgggaa

SEQ ID NO: 620307 - DNA, 13 bp, Homo sapiens
gcccatgtgtatg

SEQ ID NO: 620308 - DNA, 15 bp, Homo sapiens
gccccacaaggccca

SEQ ID NO: 620309 - DNA, 23 bp, Homo sapiens
gccccacaaggcccagccctggg

SEQ ID NO: 620310 - DNA, 12 bp, Homo sapiens
gccccagagact

SEQ ID NO: 620311 - DNA, 21 bp, Homo sapiens
gccccagagactgcccaccct

SEQ ID NO: 620312 - DNA, 13 bp, Homo sapiens
gccccagctggct

SEQ ID NO: 620313 - DNA, 15 bp, Homo sapiens
gccccaggcccgccc

SEQ ID NO: 620314 - DNA, 20 bp, Homo sapiens
gccccagtggtgcgggccag

SEQ ID NO: 620315 - DNA, 21 bp, Homo sapiens
gccccagtggtgcgggccagg

SEQ ID NO: 620316 - DNA, 19 bp, Homo sapiens
gccccatccttcccgcagc

SEQ ID NO: 620317 - DNA, 21 bp, Homo sapiens
gccccatccttcccgcagcac

SEQ ID NO: 620318 - DNA, 24 bp, Homo sapiens
gccccatccttcccgcagcaccag

SEQ ID NO: 620319 - DNA, 18 bp, Homo sapiens
gccccatgggccctcagc

SEQ ID NO: 620320 - DNA, 14 bp, Homo sapiens
gcccccacccatgc

SEQ ID NO: 620321 - DNA, 16 bp, Homo sapiens
gcccccacccatgcca

SEQ ID NO: 620322 - DNA, 13 bp, Homo sapiens
gcccccaggaccc

SEQ ID NO: 620323 - DNA, 14 bp, Homo sapiens
gcccccatgcaggc

SEQ ID NO: 620324 - DNA, 16 bp, Homo sapiens
gccccccatgccctcc

SEQ ID NO: 620325 - DNA, 21 bp, Homo sapiens
gccccccatgccctccctgct

SEQ ID NO: 620326 - DNA, 18 bp, Homo sapiens
gccccccttcccacccct

SEQ ID NO: 620327 - DNA, 21 bp, Homo sapiens
gcccccgcccctccccctaca

SEQ ID NO: 620328 - DNA, 14 bp, Homo sapiens
gcccccgccctcgc

SEQ ID NO: 620329 - DNA, 16 bp, Homo sapiens
gcccccgccctcgctc

SEQ ID NO: 620330 - DNA, 18 bp, Homo sapiens
gcccccgccctcgctccg

SEQ ID NO: 620331 - DNA, 19 bp, Homo sapiens
gcccccgccctcgctccgg

SEQ ID NO: 620332 - DNA, 19 bp, Homo sapiens
gcccccggaggcgcccacc

SEQ ID NO: 620333 - DNA, 22 bp, Homo sapiens
gcccccggaggcgcccacctgc

SEQ ID NO: 620334 - DNA, 16 bp, Homo sapiens
gccccctcccccgcag

SEQ ID NO: 620335 - DNA, 18 bp, Homo sapiens
gccccctcccccgcagac

SEQ ID NO: 620336 - DNA, 20 bp, Homo sapiens
gccccctcccccgcagacag

SEQ ID NO: 620337 - DNA, 19 bp, Homo sapiens
gccccctcgcgcccctgtc

SEQ ID NO: 620338 - DNA, 11 bp, Homo sapiens
gccccctctct

SEQ ID NO: 620339 - DNA, 21 bp, Homo sapiens
gccccctctcttaccccgtcc

SEQ ID NO: 620340 - DNA, 15 bp, Homo sapiens
gccccgcgcgtgccc

SEQ ID NO: 620341 - DNA, 19 bp, Homo sapiens
gccccgcgcgtgcccccag

SEQ ID NO: 620342 - DNA, 13 bp, Homo sapiens
gccccggagcacc

SEQ ID NO: 620343 - DNA, 16 bp, Homo sapiens
gccccggagcaccacg

SEQ ID NO: 620344 - DNA, 16 bp, Homo sapiens
gccccgggccgcgagc

SEQ ID NO: 620345 - DNA, 16 bp, Homo sapiens
gccccgtgctcctctg

SEQ ID NO: 620346 - DNA, 18 bp, Homo sapiens
gccccgtgctcctctgcc

SEQ ID NO: 620347 - DNA, 20 bp, Homo sapiens
gccccgtgctcctctgcccg

SEQ ID NO: 620348 - DNA, 14 bp, Homo sapiens
gcccctatcctgca

SEQ ID NO: 620349 - DNA, 16 bp, Homo sapiens
gcccctatcctgcacc

SEQ ID NO: 620350 - DNA, 17 bp, Homo sapiens
gcccctatcctgcaccc

SEQ ID NO: 620351 - DNA, 18 bp, Homo sapiens
gcccctccgggcagagac

SEQ ID NO: 620352 - DNA, 19 bp, Homo sapiens
gcccctccgggcagagacc

SEQ ID NO: 620353 - DNA, 14 bp, Homo sapiens
gcccctccgtcccc

SEQ ID NO: 620354 - DNA, 20 bp, Homo sapiens
gcccctccgtccccagggtg

SEQ ID NO: 620355 - DNA, 21 bp, Homo sapiens
gcccctcctcgggcgcctgcg

SEQ ID NO: 620356 - DNA, 22 bp, Homo sapiens
gcccctcctcgggcgcctgcgc

SEQ ID NO: 620357 - DNA, 13 bp, Homo sapiens
gcccctcctctcc

SEQ ID NO: 620358 - DNA, 17 bp, Homo sapiens
gcccctcctctcctcgt

SEQ ID NO: 620359 - DNA, 23 bp, Homo sapiens
gcccctcctctcctcgtccggcc

SEQ ID NO: 620360 - DNA, 13 bp, Homo sapiens
gcccctccttctc

SEQ ID NO: 620361 - DNA, 14 bp, Homo sapiens
gcccctccttctcc

SEQ ID NO: 620362 - DNA, 18 bp, Homo sapiens
gcccctccttctcccctc

SEQ ID NO: 620363 - DNA, 19 bp, Homo sapiens
gcccctccttctcccctcc

SEQ ID NO: 620364 - DNA, 23 bp, Homo sapiens
gcccctccttctcccctccagac

SEQ ID NO: 620365 - DNA, 19 bp, Homo sapiens
gcccctgcagtttggccct

SEQ ID NO: 620366 - DNA, 20 bp, Homo sapiens
gcccctgcagtttggccctg

SEQ ID NO: 620367 - DNA, 11 bp, Homo sapiens
gcccctgccca

SEQ ID NO: 620368 - DNA, 18 bp, Homo sapiens
gcccctgcccagcacctc

SEQ ID NO: 620369 - DNA, 15 bp, Homo sapiens
gcccctgcctgagac

SEQ ID NO: 620370 - DNA, 21 bp, Homo sapiens
gcccctgcgtgtgttctctcc

SEQ ID NO: 620371 - DNA, 15 bp, Homo sapiens
gcccctgctggacca

SEQ ID NO: 620372 - DNA, 18 bp, Homo sapiens
gcccctggccctgcctca

SEQ ID NO: 620373 - DNA, 21 bp, Homo sapiens
gcccctgtccatccgtctctg

SEQ ID NO: 620374 - DNA, 22 bp, Homo sapiens
gcccctgtccatccgtctctgt

SEQ ID NO: 620375 - DNA, 14 bp, Homo sapiens
gcccctgtgcagta

SEQ ID NO: 620376 - DNA, 19 bp, Homo sapiens
gcccctgtttctcctccat

SEQ ID NO: 620377 - DNA, 14 bp, Homo sapiens
gccccttgacccca

SEQ ID NO: 620378 - DNA, 17 bp, Homo sapiens
gccccttgaccccacac

SEQ ID NO: 620379 - DNA, 15 bp, Homo sapiens
gccccttggagagag

SEQ ID NO: 620380 - DNA, 21 bp, Homo sapiens
gccccttggagagagaggctg

SEQ ID NO: 620381 - DNA, 16 bp, Homo sapiens
gcccgacaggcatgca

SEQ ID NO: 620382 - DNA, 15 bp, Homo sapiens
gcccgagcgcgtgcc

SEQ ID NO: 620383 - DNA, 20 bp, Homo sapiens
gcccgagcgcgtgccttccc

SEQ ID NO: 620384 - DNA, 14 bp, Homo sapiens
gcccgaggaggccg

SEQ ID NO: 620385 - DNA, 23 bp, Homo sapiens
gcccgcactcaggagcacagcca

SEQ ID NO: 620386 - DNA, 12 bp, Homo sapiens
gcccgcccaccc

SEQ ID NO: 620387 - DNA, 13 bp, Homo sapiens
gcccgcccacccc

SEQ ID NO: 620388 - DNA, 21 bp, Homo sapiens
gcccgcccaccccgctgcctg

SEQ ID NO: 620389 - DNA, 12 bp, Homo sapiens
gcccgcccccgc

SEQ ID NO: 620390 - DNA, 21 bp, Homo sapiens
gcccgccctcctctgccccct

SEQ ID NO: 620391 - DNA, 13 bp, Homo sapiens
gcccgccctgccc

SEQ ID NO: 620392 - DNA, 20 bp, Homo sapiens
gcccgccgcctccctcaccc

SEQ ID NO: 620393 - DNA, 22 bp, Homo sapiens
gcccgcgggtggctggagcccc

SEQ ID NO: 620394 - DNA, 15 bp, Homo sapiens
gcccgctcaacctct

SEQ ID NO: 620395 - DNA, 17 bp, Homo sapiens
gcccggccaaggacact

SEQ ID NO: 620396 - DNA, 22 bp, Homo sapiens
gcccggccaaggacactgatgg

SEQ ID NO: 620397 - DNA, 18 bp, Homo sapiens
gcccggcccacgcagagc

SEQ ID NO: 620398 - DNA, 20 bp, Homo sapiens
gcccggccccatcagaggct

SEQ ID NO: 620399 - DNA, 23 bp, Homo sapiens
gcccggccccatcagaggctggg

SEQ ID NO: 620400 - DNA, 13 bp, Homo sapiens
gcccggcctccta

SEQ ID NO: 620401 - DNA, 22 bp, Homo sapiens
gcccggcctcctagcctctccg

SEQ ID NO: 620402 - DNA, 21 bp, Homo sapiens
gcccgtgcgcagccgcgctct

SEQ ID NO: 620403 - DNA, 22 bp, Homo sapiens
gcccgtggtgaggttgtgctgc

SEQ ID NO: 620404 - DNA, 18 bp, Homo sapiens
gccctaggattcctcccc

SEQ ID NO: 620405 - DNA, 20 bp, Homo sapiens
gccctaggattcctccccca

SEQ ID NO: 620406 - DNA, 23 bp, Homo sapiens
gccctaggattcctcccccagag

SEQ ID NO: 620407 - DNA, 18 bp, Homo sapiens
gccctcacctctgaggac

SEQ ID NO: 620408 - DNA, 19 bp, Homo sapiens
gccctcactccactcccct

SEQ ID NO: 620409 - DNA, 23 bp, Homo sapiens
gccctcagcgtctccccatgctg

SEQ ID NO: 620410 - DNA, 12 bp, Homo sapiens
gccctccctccc

SEQ ID NO: 620411 - DNA, 14 bp, Homo sapiens
gccctccctccctc

SEQ ID NO: 620412 - DNA, 16 bp, Homo sapiens
gccctccctgctgcca

SEQ ID NO: 620413 - DNA, 16 bp, Homo sapiens
gccctccgccagccct

SEQ ID NO: 620414 - DNA, 20 bp, Homo sapiens
gccctcctctgccccctccc

SEQ ID NO: 620415 - DNA, 17 bp, Homo sapiens
gccctctcactgacttc

SEQ ID NO: 620416 - DNA, 22 bp, Homo sapiens
gccctctcactgacttctcccg

SEQ ID NO: 620417 - DNA, 13 bp, Homo sapiens
gccctctgccact

SEQ ID NO: 620418 - DNA, 19 bp, Homo sapiens
gccctcttaagatctgact

SEQ ID NO: 620419 - DNA, 17 bp, Homo sapiens
gccctctttctctctgt

SEQ ID NO: 620420 - DNA, 23 bp, Homo sapiens
gccctctttctctctgtgtggca

SEQ ID NO: 620421 - DNA, 17 bp, Homo sapiens
gccctgacttctggaga

SEQ ID NO: 620422 - DNA, 15 bp, Homo sapiens
gccctgcccgcgccc

SEQ ID NO: 620423 - DNA, 10 bp, Homo sapiens
gccctgccct

SEQ ID NO: 620424 - DNA, 14 bp, Homo sapiens
gccctgccctcact

SEQ ID NO: 620425 - DNA, 17 bp, Homo sapiens
gccctgccctcccccac

SEQ ID NO: 620426 - DNA, 13 bp, Homo sapiens
gccctgcctcact

SEQ ID NO: 620427 - DNA, 16 bp, Homo sapiens
gccctgcctcactgtg

SEQ ID NO: 620428 - DNA, 23 bp, Homo sapiens
gccctgcctcactgtgacctgct

SEQ ID NO: 620429 - DNA, 18 bp, Homo sapiens
gccctgcctgaggaggag

SEQ ID NO: 620430 - DNA, 19 bp, Homo sapiens
gccctgcctgaggaggagg

SEQ ID NO: 620431 - DNA, 15 bp, Homo sapiens
gccctggagccaggg

SEQ ID NO: 620432 - DNA, 16 bp, Homo sapiens
gccctggagccagggc

SEQ ID NO: 620433 - DNA, 20 bp, Homo sapiens
gccctgggcaaggaagcttt

SEQ ID NO: 620434 - DNA, 12 bp, Homo sapiens
gccctggggtct

SEQ ID NO: 620435 - DNA, 16 bp, Homo sapiens
gccctggggtctctga

SEQ ID NO: 620436 - DNA, 20 bp, Homo sapiens
gccctggggtctctgagcag

SEQ ID NO: 620437 - DNA, 22 bp, Homo sapiens
gccctggggtctctgagcagtg

SEQ ID NO: 620438 - DNA, 17 bp, Homo sapiens
gccctgtgccctctcac

SEQ ID NO: 620439 - DNA, 11 bp, Homo sapiens
gccctgtggga

SEQ ID NO: 620440 - DNA, 17 bp, Homo sapiens
gccctgtgggagtccac

SEQ ID NO: 620441 - DNA, 21 bp, Homo sapiens
gccctgtgggagtccactttc

SEQ ID NO: 620442 - DNA, 17 bp, Homo sapiens
gccgaagccccttggag

SEQ ID NO: 620443 - DNA, 18 bp, Homo sapiens
gccgaagccccttggaga

SEQ ID NO: 620444 - DNA, 22 bp, Homo sapiens
gccgaagccccttggagagaga

SEQ ID NO: 620445 - DNA, 15 bp, Homo sapiens
gccgaagggcagccc

SEQ ID NO: 620446 - DNA, 16 bp, Homo sapiens
gccgactgggctgctg

SEQ ID NO: 620447 - DNA, 18 bp, Homo sapiens
gccgactgggctgctggg

SEQ ID NO: 620448 - DNA, 20 bp, Homo sapiens
gccgactgggctgctggggc

SEQ ID NO: 620449 - DNA, 21 bp, Homo sapiens
gccgactgggctgctggggca

SEQ ID NO: 620450 - DNA, 17 bp, Homo sapiens
gccgatataagccatag

SEQ ID NO: 620451 - DNA, 14 bp, Homo sapiens
gccgcagaggcccg

SEQ ID NO: 620452 - DNA, 20 bp, Homo sapiens
gccgcagggcgctccggcag

SEQ ID NO: 620453 - DNA, 18 bp, Homo sapiens
gccgcatctgcctggagc

SEQ ID NO: 620454 - DNA, 15 bp, Homo sapiens
gccgccgaagggcag

SEQ ID NO: 620455 - DNA, 23 bp, Homo sapiens
gccgccgaagggcagccccgcga

SEQ ID NO: 620456 - DNA, 24 bp, Homo sapiens
gccgccgaagggcagccccgcgac

SEQ ID NO: 620457 - DNA, 17 bp, Homo sapiens
gccgcctccctcacccg

SEQ ID NO: 620458 - DNA, 20 bp, Homo sapiens
gccgcctccctcacccggca

SEQ ID NO: 620459 - DNA, 12 bp, Homo sapiens
gccgcctcctcc

SEQ ID NO: 620460 - DNA, 17 bp, Homo sapiens
gccgcctcctccagact

SEQ ID NO: 620461 - DNA, 13 bp, Homo sapiens
gccgcctcgggcc

SEQ ID NO: 620462 - DNA, 23 bp, Homo sapiens
gccgcctcgggccgcctcctcca

SEQ ID NO: 620463 - DNA, 14 bp, Homo sapiens
gccgcgctctgccc

SEQ ID NO: 620464 - DNA, 16 bp, Homo sapiens
gccgcgctctgcccct

SEQ ID NO: 620465 - DNA, 17 bp, Homo sapiens
gccgcgctctgcccctc

SEQ ID NO: 620466 - DNA, 22 bp, Homo sapiens
gccgctgcagtcagcacagaga

SEQ ID NO: 620467 - DNA, 21 bp, Homo sapiens
gccggctggccggtccacccc

SEQ ID NO: 620468 - DNA, 12 bp, Homo sapiens
gccggggctgcc

SEQ ID NO: 620469 - DNA, 13 bp, Homo sapiens
gccggggctggcc

SEQ ID NO: 620470 - DNA, 17 bp, Homo sapiens
gccggggctggccctgc

SEQ ID NO: 620471 - DNA, 19 bp, Homo sapiens
gccggggctggccctgccc

SEQ ID NO: 620472 - DNA, 21 bp, Homo sapiens
gccggggctggccctgccctc

SEQ ID NO: 620473 - DNA, 16 bp, Homo sapiens
gccggggtgtggaatc

SEQ ID NO: 620474 - DNA, 19 bp, Homo sapiens
gccggtaggctgctggcgc

SEQ ID NO: 620475 - DNA, 14 bp, Homo sapiens
gccggtccaccccg

SEQ ID NO: 620476 - DNA, 18 bp, Homo sapiens
gccggtccaccccgtccc

SEQ ID NO: 620477 - DNA, 23 bp, Homo sapiens
gccggtccaccccgtcccggccc

SEQ ID NO: 620478 - DNA, 19 bp, Homo sapiens
gccggtggggccagcgctg

SEQ ID NO: 620479 - DNA, 15 bp, Homo sapiens
gccggttggccggct

SEQ ID NO: 620480 - DNA, 22 bp, Homo sapiens
gccgtccctgacttcccagctg

SEQ ID NO: 620481 - DNA, 14 bp, Homo sapiens
gccgtgcagggcca

SEQ ID NO: 620482 - DNA, 15 bp, Homo sapiens
gccgtggagcttgga

SEQ ID NO: 620483 - DNA, 21 bp, Homo sapiens
gcctagatttggagactttgt

SEQ ID NO: 620484 - DNA, 20 bp, Homo sapiens
gcctatggaaagggtgtggc

SEQ ID NO: 620485 - DNA, 17 bp, Homo sapiens
gcctcactgtgacctgc

SEQ ID NO: 620486 - DNA, 23 bp, Homo sapiens
gcctcactgtgacctgctcctgc

SEQ ID NO: 620487 - DNA, 15 bp, Homo sapiens
gcctcagccagtggc

SEQ ID NO: 620488 - DNA, 21 bp, Homo sapiens
gcctcagccagtggcacagga

SEQ ID NO: 620489 - DNA, 17 bp, Homo sapiens
gcctcatagcatagcca

SEQ ID NO: 620490 - DNA, 21 bp, Homo sapiens
gcctcatagcatagccagcat

SEQ ID NO: 620491 - DNA, 14 bp, Homo sapiens
gcctccatgcccca

SEQ ID NO: 620492 - DNA, 15 bp, Homo sapiens
gcctccatgccccag

SEQ ID NO: 620493 - DNA, 20 bp, Homo sapiens
gcctccatgccccagctctg

SEQ ID NO: 620494 - DNA, 21 bp, Homo sapiens
gcctccatgccccagctctgg

SEQ ID NO: 620495 - DNA, 14 bp, Homo sapiens
gcctcccccaggct

SEQ ID NO: 620496 - DNA, 23 bp, Homo sapiens
gcctcccccaggctgcgcctgcc

SEQ ID NO: 620497 - DNA, 18 bp, Homo sapiens
gcctccccgggggtcccc

SEQ ID NO: 620498 - DNA, 22 bp, Homo sapiens
gcctccccgggggtccccggac

SEQ ID NO: 620499 - DNA, 21 bp, Homo sapiens
gcctccctggggaccaggagc

SEQ ID NO: 620500 - DNA, 22 bp, Homo sapiens
gcctccctggggaccaggagct

SEQ ID NO: 620501 - DNA, 15 bp, Homo sapiens
gcctcctagcctctc

SEQ ID NO: 620502 - DNA, 14 bp, Homo sapiens
gcctcctccagact

SEQ ID NO: 620503 - DNA, 15 bp, Homo sapiens
gcctcctccagactc

SEQ ID NO: 620504 - DNA, 13 bp, Homo sapiens
gcctcctcctgca

SEQ ID NO: 620505 - DNA, 18 bp, Homo sapiens
gcctcgccccagccaagc

SEQ ID NO: 620506 - DNA, 23 bp, Homo sapiens
gcctcgccccagccaagcctgac

SEQ ID NO: 620507 - DNA, 13 bp, Homo sapiens
gcctcgcccccgg

SEQ ID NO: 620508 - DNA, 16 bp, Homo sapiens
gcctcgcccccgggcc

SEQ ID NO: 620509 - DNA, 19 bp, Homo sapiens
gcctcgggccgcctcctcc

SEQ ID NO: 620510 - DNA, 14 bp, Homo sapiens
gcctctatccctgg

SEQ ID NO: 620511 - DNA, 18 bp, Homo sapiens
gcctctatccctggccac

SEQ ID NO: 620512 - DNA, 20 bp, Homo sapiens
gcctctatccctggccacct

SEQ ID NO: 620513 - DNA, 22 bp, Homo sapiens
gcctctatccctggccacctgc

SEQ ID NO: 620514 - DNA, 12 bp, Homo sapiens
gcctctccctta

SEQ ID NO: 620515 - DNA, 14 bp, Homo sapiens
gcctgaagcctgga

SEQ ID NO: 620516 - DNA, 22 bp, Homo sapiens
gcctgactttggggacaccctc

SEQ ID NO: 620517 - DNA, 18 bp, Homo sapiens
gcctgagctccaccctcc

SEQ ID NO: 620518 - DNA, 23 bp, Homo sapiens
gcctgagctccaccctcccctct

SEQ ID NO: 620519 - DNA, 13 bp, Homo sapiens
gcctgaggaggag

SEQ ID NO: 620520 - DNA, 23 bp, Homo sapiens
gcctgaggaggaggacacagcac

SEQ ID NO: 620521 - DNA, 13 bp, Homo sapiens
gcctgagggaagc

SEQ ID NO: 620522 - DNA, 14 bp, Homo sapiens
gcctgagggaagcc

SEQ ID NO: 620523 - DNA, 17 bp, Homo sapiens
gcctgagttagctgttt

SEQ ID NO: 620524 - DNA, 13 bp, Homo sapiens
gcctgatggccag

SEQ ID NO: 620525 - DNA, 15 bp, Homo sapiens
gcctgccaggccctc

SEQ ID NO: 620526 - DNA, 14 bp, Homo sapiens
gcctgccccccttc

SEQ ID NO: 620527 - DNA, 16 bp, Homo sapiens
gcctgccccccttccc

SEQ ID NO: 620528 - DNA, 17 bp, Homo sapiens
gcctgcccgcccgccgg

SEQ ID NO: 620529 - DNA, 15 bp, Homo sapiens
gcgtcctttcctctc

SEQ ID NO: 620530 - DNA, 19 bp, Homo sapiens
gcgtctccccatgctgggc

SEQ ID NO: 620531 - DNA, 21 bp, Homo sapiens
gcgtctccccatgctgggctc

SEQ ID NO: 620532 - DNA, 20 bp, Homo sapiens
gcgtgaccggcccgccacct

SEQ ID NO: 620533 - DNA, 22 bp, Homo sapiens
gcgtgggatccagagagaagca

SEQ ID NO: 620534 - DNA, 15 bp, Homo sapiens
gcgtggttctgccac

SEQ ID NO: 620535 - DNA, 19 bp, Homo sapiens
gctaaatgcctaataaaca

SEQ ID NO: 620536 - DNA, 22 bp, Homo sapiens
gctaagataattaaatgaaata

SEQ ID NO: 620537 - DNA, 15 bp, Homo sapiens
gctaattaaaaagtt

SEQ ID NO: 620538 - DNA, 15 bp, Homo sapiens
gctaatttgtgaaag

SEQ ID NO: 620539 - DNA, 17 bp, Homo sapiens
gctacaccttagcagct

SEQ ID NO: 620540 - DNA, 16 bp, Homo sapiens
gctacaggggaggctg

SEQ ID NO: 620541 - DNA, 17 bp, Homo sapiens
gctacaggtgccccacc

SEQ ID NO: 620542 - DNA, 18 bp, Homo sapiens
gctacatatgtaggaaaa

SEQ ID NO: 620543 - DNA, 20 bp, Homo sapiens
gctagacagaaaccaagcca

SEQ ID NO: 620544 - DNA, 15 bp, Homo sapiens
gctagagcattctgg

SEQ ID NO: 620545 - DNA, 14 bp, Homo sapiens
gctagccatatatt

SEQ ID NO: 620546 - DNA, 13 bp, Homo sapiens
gctaggcagggag

SEQ ID NO: 620547 - DNA, 14 bp, Homo sapiens
gctaggcagggagg

SEQ ID NO: 620548 - DNA, 15 bp, Homo sapiens
gctaggcagggaggg

SEQ ID NO: 620549 - DNA, 19 bp, Homo sapiens
gctagtgtagcttctgaaa

SEQ ID NO: 620550 - DNA, 19 bp, Homo sapiens
gctagttagagactcgcct

SEQ ID NO: 620551 - DNA, 12 bp, Homo sapiens
gctagttctgct

SEQ ID NO: 620552 - DNA, 15 bp, Homo sapiens
gctagttctgctgcc

SEQ ID NO: 620553 - DNA, 17 bp, Homo sapiens
gctagttctgctgccct

SEQ ID NO: 620554 - DNA, 19 bp, Homo sapiens
gctagttctgctgccctct

SEQ ID NO: 620555 - DNA, 23 bp, Homo sapiens
gctatatatatatatatatgtat

SEQ ID NO: 620556 - DNA, 17 bp, Homo sapiens
gctatgcacaccaaatt

SEQ ID NO: 620557 - DNA, 18 bp, Homo sapiens
gctatgcacaccaaattg

SEQ ID NO: 620558 - DNA, 22 bp, Homo sapiens
gctatggacaatttaccacagg

SEQ ID NO: 620559 - DNA, 15 bp, Homo sapiens
gctatgtctcatgtt

SEQ ID NO: 620560 - DNA, 16 bp, Homo sapiens
gctatgtctcatgttt

SEQ ID NO: 620561 - DNA, 12 bp, Homo sapiens
gctattaagaaa

SEQ ID NO: 620562 - DNA, 16 bp, Homo sapiens
gctattcgtaagttct

SEQ ID NO: 620563 - DNA, 17 bp, Homo sapiens
gctattcgtaagttctg

SEQ ID NO: 620564 - DNA, 20 bp, Homo sapiens
gctattcgtaagttctgtgc

SEQ ID NO: 620565 - DNA, 20 bp, Homo sapiens
gctatttaagtggactgtat

SEQ ID NO: 620566 - DNA, 20 bp, Homo sapiens
gctcacacttgggctggcac

SEQ ID NO: 620567 - DNA, 17 bp, Homo sapiens
gctcacagcacatttgt

SEQ ID NO: 620568 - DNA, 22 bp, Homo sapiens
gctcacgtctgtgagtctgtcc

SEQ ID NO: 620569 - DNA, 21 bp, Homo sapiens
gctcactacatgggccagccc

SEQ ID NO: 620570 - DNA, 22 bp, Homo sapiens
gctcactacatgggccagccct

SEQ ID NO: 620571 - DNA, 23 bp, Homo sapiens
gctcactacatgggccagccctt

SEQ ID NO: 620572 - DNA, 15 bp, Homo sapiens
gctcagcattgtgta

SEQ ID NO: 620573 - DNA, 20 bp, Homo sapiens
gctcagcccatcccctgcct

SEQ ID NO: 620574 - DNA, 20 bp, Homo sapiens
gctcagggttggccatttgc

SEQ ID NO: 620575 - DNA, 21 bp, Homo sapiens
gctcagtaacacagtgcagtg

SEQ ID NO: 620576 - DNA, 22 bp, Homo sapiens
gctcagtaacacagtgcagtgc

SEQ ID NO: 620577 - DNA, 15 bp, Homo sapiens
gctcagtattgagac

SEQ ID NO: 620578 - DNA, 15 bp, Homo sapiens
gctcatctacacata

SEQ ID NO: 620579 - DNA, 23 bp, Homo sapiens
gctccaactgaattgctatcatt

SEQ ID NO: 620580 - DNA, 13 bp, Homo sapiens
gctccactctgaa

SEQ ID NO: 620581 - DNA, 21 bp, Homo sapiens
gctccactctgaagtcccttc

SEQ ID NO: 620582 - DNA, 15 bp, Homo sapiens
gctcccacctcggac

SEQ ID NO: 620583 - DNA, 12 bp, Homo sapiens
gctcccactgcc

SEQ ID NO: 620584 - DNA, 18 bp, Homo sapiens
gctcccactgcccctgca

SEQ ID NO: 620585 - DNA, 16 bp, Homo sapiens
gctcccagcagaggcc

SEQ ID NO: 620586 - DNA, 14 bp, Homo sapiens
gctcccagggtcct

SEQ ID NO: 620587 - DNA, 16 bp, Homo sapiens
gctcccggtgtgcagc

SEQ ID NO: 620588 - DNA, 17 bp, Homo sapiens
gctccctcatgcagata

SEQ ID NO: 620589 - DNA, 12 bp, Homo sapiens
gctcccttttca

SEQ ID NO: 620590 - DNA, 15 bp, Homo sapiens
gctccggcagaggca

SEQ ID NO: 620591 - DNA, 20 bp, Homo sapiens
gctccggcagaggcagggcc

SEQ ID NO: 620592 - DNA, 21 bp, Homo sapiens
gctccggcagaggcagggccc

SEQ ID NO: 620593 - DNA, 22 bp, Homo sapiens
gctccggcagaggcagggccct

SEQ ID NO: 620594 - DNA, 11 bp, Homo sapiens
gctcctcaccc

SEQ ID NO: 620595 - DNA, 14 bp, Homo sapiens
gctcctcacccctg

SEQ ID NO: 620596 - DNA, 19 bp, Homo sapiens
gctcctcgggtggggcctg

SEQ ID NO: 620597 - DNA, 20 bp, Homo sapiens
gctcctcgggtggggcctgc

SEQ ID NO: 620598 - DNA, 20 bp, Homo sapiens
gctcctctgcagcctgagct

SEQ ID NO: 620599 - DNA, 11 bp, Homo sapiens
gctcctgccca

SEQ ID NO: 620600 - DNA, 15 bp, Homo sapiens
gctcctgcccacgtg

SEQ ID NO: 620601 - DNA, 19 bp, Homo sapiens
gctcctgctgaccttctgc

SEQ ID NO: 620602 - DNA, 20 bp, Homo sapiens
gctcgccctgtgccctctca

SEQ ID NO: 620603 - DNA, 16 bp, Homo sapiens
gctcgggaaggcctga

SEQ ID NO: 620604 - DNA, 14 bp, Homo sapiens
gctcgggactgtct

SEQ ID NO: 620605 - DNA, 15 bp, Homo sapiens
gctctacctggccgg

SEQ ID NO: 620606 - DNA, 18 bp, Homo sapiens
gctctatgcctcagtttc

SEQ ID NO: 620607 - DNA, 13 bp, Homo sapiens
gctctccgccccc

SEQ ID NO: 620608 - DNA, 17 bp, Homo sapiens
gctctccgccccccggc

SEQ ID NO: 620609 - DNA, 22 bp, Homo sapiens
gctctccgccccccggcctggc

SEQ ID NO: 620610 - DNA, 15 bp, Homo sapiens
gctctctaagaattc

SEQ ID NO: 620611 - DNA, 19 bp, Homo sapiens
gctctctcacccagcctgg

SEQ ID NO: 620612 - DNA, 13 bp, Homo sapiens
gctctgcccctcc

SEQ ID NO: 620613 - DNA, 14 bp, Homo sapiens
gctctgcccctccg

SEQ ID NO: 620614 - DNA, 22 bp, Homo sapiens
gctctgcccctccgtccccagg

SEQ ID NO: 620615 - DNA, 18 bp, Homo sapiens
gctctgctcatctacaca

SEQ ID NO: 620616 - DNA, 16 bp, Homo sapiens
gctctggatgaaggca

SEQ ID NO: 620617 - DNA, 12 bp, Homo sapiens
gctctgtccact

SEQ ID NO: 620618 - DNA, 15 bp, Homo sapiens
gctctgtccactctg

SEQ ID NO: 620619 - DNA, 22 bp, Homo sapiens
gctcttcccaagtcctcgcccc

SEQ ID NO: 620620 - DNA, 21 bp, Homo sapiens
gctcttcccctttcctggggg

SEQ ID NO: 620621 - DNA, 17 bp, Homo sapiens
gctgaaattatgtcaaa

SEQ ID NO: 620622 - DNA, 12 bp, Homo sapiens
gctgaataacaa

SEQ ID NO: 620623 - DNA, 18 bp, Homo sapiens
gctgaataacaacaattt

SEQ ID NO: 620624 - DNA, 14 bp, Homo sapiens
gctgaattttcaca

SEQ ID NO: 620625 - DNA, 14 bp, Homo sapiens
gctgactcttacta

SEQ ID NO: 620626 - DNA, 17 bp, Homo sapiens
gctgagacacagcccag

SEQ ID NO: 620627 - DNA, 23 bp, Homo sapiens
gctgagacgcaaggatcacttga

SEQ ID NO: 620628 - DNA, 19 bp, Homo sapiens
gctgagagggtgtgggtgc

SEQ ID NO: 620629 - DNA, 21 bp, Homo sapiens
gctgagagggtgtgggtgccc

SEQ ID NO: 620630 - DNA, 19 bp, Homo sapiens
gctgagatgggaggatcac

SEQ ID NO: 620631 - DNA, 23 bp, Homo sapiens
gctgagatgggaggatcacttga

SEQ ID NO: 620632 - DNA, 19 bp, Homo sapiens
gctgagatgtttagtagct

SEQ ID NO: 620633 - DNA, 14 bp, Homo sapiens
gctgagcacatctc

SEQ ID NO: 620634 - DNA, 19 bp, Homo sapiens
gctgaggacggggcagagc

SEQ ID NO: 620635 - DNA, 23 bp, Homo sapiens
gctgaggacggggcagagctgag

SEQ ID NO: 620636 - DNA, 19 bp, Homo sapiens
gctgagtcggctgggcagg

SEQ ID NO: 620637 - DNA, 20 bp, Homo sapiens
gctgagtcggctgggcaggg

SEQ ID NO: 620638 - DNA, 21 bp, Homo sapiens
gctgagtcggctgggcagggc

SEQ ID NO: 620639 - DNA, 15 bp, Homo sapiens
gctgatggtgcaatg

SEQ ID NO: 620640 - DNA, 19 bp, Homo sapiens
gctgatttactaacagtaa

SEQ ID NO: 620641 - DNA, 22 bp, Homo sapiens
gctgcagctaatttgtgaaagt

SEQ ID NO: 620642 - DNA, 18 bp, Homo sapiens
gctgcagttagcacagag

SEQ ID NO: 620643 - DNA, 19 bp, Homo sapiens
gctgcagttagcacagagg

SEQ ID NO: 620644 - DNA, 21 bp, Homo sapiens
gctgccatccttgctgcagct

SEQ ID NO: 620645 - DNA, 19 bp, Homo sapiens
gctgccctcttaagatctg

SEQ ID NO: 620646 - DNA, 21 bp, Homo sapiens
gctgccgcatctgcctggagc

SEQ ID NO: 620647 - DNA, 14 bp, Homo sapiens
gctgcctcagccag

SEQ ID NO: 620648 - DNA, 23 bp, Homo sapiens
gctgcctcatgaccctcctgtcc

SEQ ID NO: 620649 - DNA, 14 bp, Homo sapiens
gctgcctccctggg

SEQ ID NO: 620650 - DNA, 23 bp, Homo sapiens
gctgcctccctggggaccaggag

SEQ ID NO: 620651 - DNA, 11 bp, Homo sapiens
gctgcctggcg

SEQ ID NO: 620652 - DNA, 18 bp, Homo sapiens
gctgcctggcgggcagcc

SEQ ID NO: 620653 - DNA, 19 bp, Homo sapiens
gctgcctggcgggcagccc

SEQ ID NO: 620654 - DNA, 21 bp, Homo sapiens
gctgcctggcgggcagcccct

SEQ ID NO: 620655 - DNA, 18 bp, Homo sapiens
gctgcgcctgcccgcccg

SEQ ID NO: 620656 - DNA, 16 bp, Homo sapiens
gctgctcgggaaggcc

SEQ ID NO: 620657 - DNA, 20 bp, Homo sapiens
gctgctcgggaaggcctgag

SEQ ID NO: 620658 - DNA, 16 bp, Homo sapiens
gctgctctctaagaat

SEQ ID NO: 620659 - DNA, 18 bp, Homo sapiens
gctgctctctaagaattc

SEQ ID NO: 620660 - DNA, 22 bp, Homo sapiens
gctgctgagcacatctcttcat

SEQ ID NO: 620661 - DNA, 21 bp, Homo sapiens
gctgctgcagtcagcacagag

SEQ ID NO: 620662 - DNA, 15 bp, Homo sapiens
gctgctggggcaggg

SEQ ID NO: 620663 - DNA, 18 bp, Homo sapiens
gctgctggggcagggccc

SEQ ID NO: 620664 - DNA, 23 bp, Homo sapiens
gctgctggggcagggcccaggga

SEQ ID NO: 620665 - DNA, 20 bp, Homo sapiens
gctgctgtatttgaggaaac

SEQ ID NO: 620666 - DNA, 14 bp, Homo sapiens
gctgctgtgtagct

SEQ ID NO: 620667 - DNA, 23 bp, Homo sapiens
gctgcttcaaggatcctgagcca

SEQ ID NO: 620668 - DNA, 13 bp, Homo sapiens
gctgcttttgatg

SEQ ID NO: 620669 - DNA, 19 bp, Homo sapiens
gctgcttttgatggctatg

SEQ ID NO: 620670 - DNA, 22 bp, Homo sapiens
gctggagaccctgcgcccctgc

SEQ ID NO: 620671 - DNA, 13 bp, Homo sapiens
gctggagccccat

SEQ ID NO: 620672 - DNA, 21 bp, Homo sapiens
gctggagccccatcgcctggg

SEQ ID NO: 620673 - DNA, 22 bp, Homo sapiens
gctggagccccatcgcctggga

SEQ ID NO: 620674 - DNA, 18 bp, Homo sapiens
gctggataggagaggaaa

SEQ ID NO: 620675 - DNA, 14 bp, Homo sapiens
gctggcacccactg

SEQ ID NO: 620676 - DNA, 13 bp, Homo sapiens
gctggcagcgcct

SEQ ID NO: 620677 - DNA, 15 bp, Homo sapiens
gctggcagcgcctcc

SEQ ID NO: 620678 - DNA, 16 bp, Homo sapiens
gctggcagcgcctccc

SEQ ID NO: 620679 - DNA, 19 bp, Homo sapiens
gctggcagcgcctcccgcc

SEQ ID NO: 620680 - DNA, 23 bp, Homo sapiens
gctggcagcgcctcccgccgcct

SEQ ID NO: 620681 - DNA, 20 bp, Homo sapiens
gctggccctgccctccccca

SEQ ID NO: 620682 - DNA, 21 bp, Homo sapiens
gctggccctgccctcccccac

SEQ ID NO: 620683 - DNA, 20 bp, Homo sapiens
gctgggaaagaacttggact

SEQ ID NO: 620684 - DNA, 13 bp, Homo sapiens
gctgggcagggcc

SEQ ID NO: 620685 - DNA, 21 bp, Homo sapiens
gctgggcagggccgcagggcg

SEQ ID NO: 620686 - DNA, 13 bp, Homo sapiens
gctgggcagggtg

SEQ ID NO: 620687 - DNA, 18 bp, Homo sapiens
gctggggcagggcccagg

SEQ ID NO: 620688 - DNA, 22 bp, Homo sapiens
gctggggcagggcccagggagg

SEQ ID NO: 620689 - DNA, 17 bp, Homo sapiens
gctgggtcccgggtgcc

SEQ ID NO: 620690 - DNA, 12 bp, Homo sapiens
gctgggtcgccc

SEQ ID NO: 620691 - DNA, 21 bp, Homo sapiens
gctgggtttgggcagtggaga

SEQ ID NO: 620692 - DNA, 15 bp, Homo sapiens
gctggtaactgttaa

SEQ ID NO: 620693 - DNA, 19 bp, Homo sapiens
gctgtaaataaaaatagct

SEQ ID NO: 620694 - DNA, 19 bp, Homo sapiens
gctgtaaggccattcttta

SEQ ID NO: 620695 - DNA, 22 bp, Homo sapiens
gctgtattatcttaaacccaca

SEQ ID NO: 620696 - DNA, 13 bp, Homo sapiens
gctgtccctgtgg

SEQ ID NO: 620697 - DNA, 15 bp, Homo sapiens
gctgtccctgtgggc

SEQ ID NO: 620698 - DNA, 20 bp, Homo sapiens
gctgtccctgtgggctcaca

SEQ ID NO: 620699 - DNA, 16 bp, Homo sapiens
gctgtccgtcctgctc

SEQ ID NO: 620700 - DNA, 23 bp, Homo sapiens
gctgtccgtcctgctcgccctgt

SEQ ID NO: 620701 - DNA, 13 bp, Homo sapiens
gctgtcggtgttt

SEQ ID NO: 620702 - DNA, 23 bp, Homo sapiens
gctgtcggtgtttggaggctgct

SEQ ID NO: 620703 - DNA, 20 bp, Homo sapiens
gctgtctgaaaaagtgtttt

SEQ ID NO: 620704 - DNA, 22 bp, Homo sapiens
gctgtctgaaaaagtgttttta

SEQ ID NO: 620705 - DNA, 14 bp, Homo sapiens
gctgtgaaatgact

SEQ ID NO: 620706 - DNA, 18 bp, Homo sapiens
gctgtggcatcaggaaag

SEQ ID NO: 620707 - DNA, 22 bp, Homo sapiens
gctgtggcccctccttctcccc

SEQ ID NO: 620708 - DNA, 23 bp, Homo sapiens
gctgtgtgtgagcgagtgacaga

SEQ ID NO: 620709 - DNA, 14 bp, Homo sapiens
gctgttagctcaga

SEQ ID NO: 620710 - DNA, 17 bp, Homo sapiens
gctgttatctgtcttta

SEQ ID NO: 620711 - DNA, 16 bp, Homo sapiens
gctgttcattgatgac

SEQ ID NO: 620712 - DNA, 14 bp, Homo sapiens
gctgtttactgaca

SEQ ID NO: 620713 - DNA, 21 bp, Homo sapiens
gctgtttactgacatggtgct

SEQ ID NO: 620714 - DNA, 12 bp, Homo sapiens
gcttaaacattt

SEQ ID NO: 620715 - DNA, 20 bp, Homo sapiens
gcttaaacatttccctgctg

SEQ ID NO: 620716 - DNA, 13 bp, Homo sapiens
gcttaaacatttt

SEQ ID NO: 620717 - DNA, 15 bp, Homo sapiens
gcttaacataaactt

SEQ ID NO: 620718 - DNA, 13 bp, Homo sapiens
gcttaagaagtat

SEQ ID NO: 620719 - DNA, 14 bp, Homo sapiens
gcttaatctagagc

SEQ ID NO: 620720 - DNA, 15 bp, Homo sapiens
gcttaatctagagct

SEQ ID NO: 620721 - DNA, 19 bp, Homo sapiens
gcttaatctagagctatgc

SEQ ID NO: 620722 - DNA, 14 bp, Homo sapiens
gcttacagtgactg

SEQ ID NO: 620723 - DNA, 23 bp, Homo sapiens
gcttatcagaactcctttctaag

SEQ ID NO: 620724 - DNA, 20 bp, Homo sapiens
gcttcaaggatcctgagcca

SEQ ID NO: 620725 - DNA, 21 bp, Homo sapiens
gcttcacacaaagtgaaatta

SEQ ID NO: 620726 - DNA, 14 bp, Homo sapiens
gcttccagtgcatg

SEQ ID NO: 620727 - DNA, 14 bp, Homo sapiens
gcttcccaacaata

SEQ ID NO: 620728 - DNA, 14 bp, Homo sapiens
gcttccccatcgcc

SEQ ID NO: 620729 - DNA, 18 bp, Homo sapiens
gcttccctgaacactcat

SEQ ID NO: 620730 - DNA, 16 bp, Homo sapiens
gcttctctttatagag

SEQ ID NO: 620731 - DNA, 20 bp, Homo sapiens
gcttctgaaaggtgctttct

SEQ ID NO: 620732 - DNA, 23 bp, Homo sapiens
gcttctgggacaggcaccatgct

SEQ ID NO: 620733 - DNA, 24 bp, Homo sapiens
gcttctgggcgccggttccacgtg

SEQ ID NO: 620734 - DNA, 13 bp, Homo sapiens
gcttgagcctgtc

SEQ ID NO: 620735 - DNA, 19 bp, Homo sapiens
gcttgaggccaaatgagtt

SEQ ID NO: 620736 - DNA, 20 bp, Homo sapiens
gcttgattctaaaggggaca

SEQ ID NO: 620737 - DNA, 21 bp, Homo sapiens
gcttgattctaaaggggacag

SEQ ID NO: 620738 - DNA, 23 bp, Homo sapiens
gcttggaaaatgttctgacagca

SEQ ID NO: 620739 - DNA, 16 bp, Homo sapiens
gcttggagcagagacg

SEQ ID NO: 620740 - DNA, 20 bp, Homo sapiens
gcttggagccccctggcggc

SEQ ID NO: 620741 - DNA, 14 bp, Homo sapiens
gcttggggtagaga

SEQ ID NO: 620742 - DNA, 20 bp, Homo sapiens
gcttggggtagagaggacag

SEQ ID NO: 620743 - DNA, 19 bp, Homo sapiens
gcttgtagggtgaggcgtg

SEQ ID NO: 620744 - DNA, 18 bp, Homo sapiens
gcttgtgcagaaaacatt

SEQ ID NO: 620745 - DNA, 23 bp, Homo sapiens
gctttaaaaccacagctgggcag

SEQ ID NO: 620746 - DNA, 21 bp, Homo sapiens
gctttcatgtttaagaaatga

SEQ ID NO: 620747 - DNA, 16 bp, Homo sapiens
gctttccaacacacaa

SEQ ID NO: 620748 - DNA, 14 bp, Homo sapiens
gctttccctgagga

SEQ ID NO: 620749 - DNA, 22 bp, Homo sapiens
gctttccgcgtggttctgccac

SEQ ID NO: 620750 - DNA, 24 bp, Homo sapiens
gctttccgcgtggttctgccactt

SEQ ID NO: 620751 - DNA, 11 bp, Homo sapiens
gctttctattg

SEQ ID NO: 620752 - DNA, 21 bp, Homo sapiens
gctttctattggcatggattt

SEQ ID NO: 620753 - DNA, 13 bp, Homo sapiens
gctttgaaaatgt

SEQ ID NO: 620754 - DNA, 13 bp, Homo sapiens
gctttggggctgg

SEQ ID NO: 620755 - DNA, 18 bp, Homo sapiens
gctttggggctggtggga

SEQ ID NO: 620756 - DNA, 13 bp, Homo sapiens
gcttttcacttct

SEQ ID NO: 620757 - DNA, 14 bp, Homo sapiens
gcttttcacttctt

SEQ ID NO: 620758 - DNA, 14 bp, Homo sapiens
gcttttgatggcta

SEQ ID NO: 620759 - DNA, 14 bp, Homo sapiens
ggaaaaactgattt

SEQ ID NO: 620760 - DNA, 12 bp, Homo sapiens
ggaaaacctcag

SEQ ID NO: 620761 - DNA, 21 bp, Homo sapiens
ggaaaaggcttgagtctggat

SEQ ID NO: 620762 - DNA, 23 bp, Homo sapiens
ggaaacaaagtttacattgtcct

SEQ ID NO: 620763 - DNA, 15 bp, Homo sapiens
ggaaaccttggagag

SEQ ID NO: 620764 - DNA, 15 bp, Homo sapiens
ggaaagatcccaagt

SEQ ID NO: 620765 - DNA, 15 bp, Homo sapiens
ggacggggcagagct

SEQ ID NO: 620766 - DNA, 16 bp, Homo sapiens
ggacggggcagagctg

SEQ ID NO: 620767 - DNA, 20 bp, Homo sapiens
ggacgtcgctgtccgtcctg

SEQ ID NO: 620768 - DNA, 13 bp, Homo sapiens
ggactacagaagt

SEQ ID NO: 620769 - DNA, 18 bp, Homo sapiens
ggactgaccttcggcagt

SEQ ID NO: 620770 - DNA, 22 bp, Homo sapiens
ggactgtcttcaaccctgccct

SEQ ID NO: 620771 - DNA, 13 bp, Homo sapiens
ggacttaatttag

SEQ ID NO: 620772 - DNA, 14 bp, Homo sapiens
ggagaaggaggaac

SEQ ID NO: 620773 - DNA, 13 bp, Homo sapiens
ggagaaggcctgc

SEQ ID NO: 620774 - DNA, 16 bp, Homo sapiens
ggagaatggctctggc

SEQ ID NO: 620775 - DNA, 23 bp, Homo sapiens
ggagaccctgcgcccctgcccag

SEQ ID NO: 620776 - DNA, 22 bp, Homo sapiens
ggagagactggttttttccagc

SEQ ID NO: 620777 - DNA, 13 bp, Homo sapiens
ggagagagaggct

SEQ ID NO: 620778 - DNA, 14 bp, Homo sapiens
ggagagagaggctg

SEQ ID NO: 620779 - DNA, 15 bp, Homo sapiens
ggagagagaggctgc

SEQ ID NO: 620780 - DNA, 23 bp, Homo sapiens
ggagagagcaatcttgctgtgaa

SEQ ID NO: 620781 - DNA, 21 bp, Homo sapiens
ggagagcagcaggtgctgtgc

SEQ ID NO: 620782 - DNA, 17 bp, Homo sapiens
ggagagcgccacccgcc

SEQ ID NO: 620783 - DNA, 21 bp, Homo sapiens
ggagaggagcaaacaggaaaa

SEQ ID NO: 620784 - DNA, 15 bp, Homo sapiens
ggagatgaggctgga

SEQ ID NO: 620785 - DNA, 16 bp, Homo sapiens
ggagatgaggctggat

SEQ ID NO: 620786 - DNA, 15 bp, Homo sapiens
ggagcaaacaggaaa

SEQ ID NO: 620787 - DNA, 12 bp, Homo sapiens
ggagcacagcca

SEQ ID NO: 620788 - DNA, 15 bp, Homo sapiens
ggagcacagccatag

SEQ ID NO: 620789 - DNA, 12 bp, Homo sapiens
ggagcaccccca

SEQ ID NO: 620790 - DNA, 13 bp, Homo sapiens
ggagcacccccag

SEQ ID NO: 620791 - DNA, 14 bp, Homo sapiens
ggagcacccccagc

SEQ ID NO: 620792 - DNA, 18 bp, Homo sapiens
ggagcactagaatgagaa

SEQ ID NO: 620793 - DNA, 17 bp, Homo sapiens
ggagcagagacggcagc

SEQ ID NO: 620794 - DNA, 18 bp, Homo sapiens
ggagcagagacggcagcc

SEQ ID NO: 620795 - DNA, 12 bp, Homo sapiens
ggagccagggca

SEQ ID NO: 620796 - DNA, 13 bp, Homo sapiens
ggagccagggcag

SEQ ID NO: 620797 - DNA, 16 bp, Homo sapiens
ggagcccccgcccctc

SEQ ID NO: 620798 - DNA, 14 bp, Homo sapiens
ggagccccctggcg

SEQ ID NO: 620799 - DNA, 19 bp, Homo sapiens
ggagccgcagaggcccgag

SEQ ID NO: 620800 - DNA, 15 bp, Homo sapiens
ggagcctgggcagca

SEQ ID NO: 620801 - DNA, 16 bp, Homo sapiens
ggagcctgggcagcac

SEQ ID NO: 620802 - DNA, 20 bp, Homo sapiens
ggagccttgctgggccaggg

SEQ ID NO: 620803 - DNA, 15 bp, Homo sapiens
ggagcggctgaggac

SEQ ID NO: 620804 - DNA, 22 bp, Homo sapiens
ggagcggctgaggacggggcag

SEQ ID NO: 620805 - DNA, 22 bp, Homo sapiens
ggagcgggggctaactggcccc

SEQ ID NO: 620806 - DNA, 23 bp, Homo sapiens
ggagcgggggctaactggcccca

SEQ ID NO: 620807 - DNA, 22 bp, Homo sapiens
ggagctagcccagtccctggag

SEQ ID NO: 620808 - DNA, 17 bp, Homo sapiens
ggagcttccagtgcatg

SEQ ID NO: 620809 - DNA, 12 bp, Homo sapiens
ggagcttggagc

SEQ ID NO: 620810 - DNA, 18 bp, Homo sapiens
ggagcttggagccccctg

SEQ ID NO: 620811 - DNA, 20 bp, Homo sapiens
ggagcttggagccccctggc

SEQ ID NO: 620812 - DNA, 15 bp, Homo sapiens
ggaggacccctgccc

SEQ ID NO: 620813 - DNA, 17 bp, Homo sapiens
ggaggacccctgccctc

SEQ ID NO: 620814 - DNA, 19 bp, Homo sapiens
ggaggagaaggaggaaccc

SEQ ID NO: 620815 - DNA, 13 bp, Homo sapiens
ggaggagcacccc

SEQ ID NO: 620816 - DNA, 19 bp, Homo sapiens
ggaggagcacccccagcct

SEQ ID NO: 620817 - DNA, 14 bp, Homo sapiens
ggaggagccttgct

SEQ ID NO: 620818 - DNA, 18 bp, Homo sapiens
ggaggagccttgctgggc

SEQ ID NO: 620819 - DNA, 12 bp, Homo sapiens
ggaggaggacac

SEQ ID NO: 620820 - DNA, 11 bp, Homo sapiens
ggaggaggagc

SEQ ID NO: 620821 - DNA, 13 bp, Homo sapiens
ggaggaggagcct

SEQ ID NO: 620822 - DNA, 14 bp, Homo sapiens
ggaggaggagcctt

SEQ ID NO: 620823 - DNA, 17 bp, Homo sapiens
ggaggaggagccttgct

SEQ ID NO: 620824 - DNA, 14 bp, Homo sapiens
ggaggaggaggagc

SEQ ID NO: 620825 - DNA, 17 bp, Homo sapiens
ggaggccgactgggctg

SEQ ID NO: 620826 - DNA, 21 bp, Homo sapiens
ggaggccgactgggctgctgg

SEQ ID NO: 620827 - DNA, 20 bp, Homo sapiens
ggaggcctggtctggagccc

SEQ ID NO: 620828 - DNA, 13 bp, Homo sapiens
ggaggcgcccacc

SEQ ID NO: 620829 - DNA, 15 bp, Homo sapiens
ggaggcgcccacctg

SEQ ID NO: 620830 - DNA, 19 bp, Homo sapiens
ggaggcgcccacctgccca

SEQ ID NO: 620831 - DNA, 13 bp, Homo sapiens
ggaggctgctgcc

SEQ ID NO: 620832 - DNA, 13 bp, Homo sapiens
ggagggcgctttt

SEQ ID NO: 620833 - DNA, 17 bp, Homo sapiens
ggaggtgtggagtggag

SEQ ID NO: 620834 - DNA, 20 bp, Homo sapiens
ggagtctgaaggagaggagt

SEQ ID NO: 620835 - DNA, 15 bp, Homo sapiens
ggataattttcattt

SEQ ID NO: 620836 - DNA, 17 bp, Homo sapiens
ggataggagcttccaga

SEQ ID NO: 620837 - DNA, 16 bp, Homo sapiens
ggcaaagaactgcccc

SEQ ID NO: 620838 - DNA, 16 bp, Homo sapiens
ggcaacagagtgagac

SEQ ID NO: 620839 - DNA, 22 bp, Homo sapiens
ggcaagagctcaggagaaggcc

SEQ ID NO: 620840 - DNA, 19 bp, Homo sapiens
ggcaagattttcctttttt

SEQ ID NO: 620841 - DNA, 15 bp, Homo sapiens
ggcaagctcatagca

SEQ ID NO: 620842 - DNA, 18 bp, Homo sapiens
ggcaagctcatagcacat

SEQ ID NO: 620843 - DNA, 23 bp, Homo sapiens
ggcaatagcgctcccttttcacc

SEQ ID NO: 620844 - DNA, 15 bp, Homo sapiens
ggcaatcaatgttca

SEQ ID NO: 620845 - DNA, 18 bp, Homo sapiens
ggcacattgcccatggct

SEQ ID NO: 620846 - DNA, 24 bp, Homo sapiens
ggcaccactagggtcctggccctc

SEQ ID NO: 620847 - DNA, 17 bp, Homo sapiens
ggcaccatgctgggccg

SEQ ID NO: 620848 - DNA, 12 bp, Homo sapiens
ggcacccactgg

SEQ ID NO: 620849 - DNA, 13 bp, Homo sapiens
ggcaccgcccacc

SEQ ID NO: 620850 - DNA, 23 bp, Homo sapiens
ggcaccggacgctggagaccctg

SEQ ID NO: 620851 - DNA, 24 bp, Homo sapiens
ggcaccggacgctggagaccctgc

SEQ ID NO: 620852 - DNA, 19 bp, Homo sapiens
ggcacgggagagcgccacc

SEQ ID NO: 620853 - DNA, 18 bp, Homo sapiens
ggcacgtcatctagtttt

SEQ ID NO: 620854 - DNA, 15 bp, Homo sapiens
ggcagaatggtgggc

SEQ ID NO: 620855 - DNA, 19 bp, Homo sapiens
ggcagagaccaccgcgccc

SEQ ID NO: 620856 - DNA, 19 bp, Homo sapiens
ggcagagattgggggggct

SEQ ID NO: 620857 - DNA, 21 bp, Homo sapiens
ggcagagattgggggggcttg

SEQ ID NO: 620858 - DNA, 14 bp, Homo sapiens
ggcagaggcagggc

SEQ ID NO: 620859 - DNA, 16 bp, Homo sapiens
ggcagcacctccggga

SEQ ID NO: 620860 - DNA, 15 bp, Homo sapiens
ggcagcagcagcagc

SEQ ID NO: 620861 - DNA, 23 bp, Homo sapiens
ggcagccccatccttcccgcagc

SEQ ID NO: 620862 - DNA, 12 bp, Homo sapiens
ggcagcccctcc

SEQ ID NO: 620863 - DNA, 15 bp, Homo sapiens
ggcagcccctcccca

SEQ ID NO: 620864 - DNA, 20 bp, Homo sapiens
ggcagccctcacctctgagg

SEQ ID NO: 620865 - DNA, 22 bp, Homo sapiens
ggcagccctcacctctgaggac

SEQ ID NO: 620866 - DNA, 13 bp, Homo sapiens
ggcagcctgcaga

SEQ ID NO: 620867 - DNA, 15 bp, Homo sapiens
ggcagcctgcagacc

SEQ ID NO: 620868 - DNA, 18 bp, Homo sapiens
ggcagcctgtgggtcctt

SEQ ID NO: 620869 - DNA, 15 bp, Homo sapiens
ggcagcgcctcccgc

SEQ ID NO: 620870 - DNA, 20 bp, Homo sapiens
ggcagcgcctcccgccgcct

SEQ ID NO: 620871 - DNA, 21 bp, Homo sapiens
ggcagcgcctcccgccgcctc

SEQ ID NO: 620872 - DNA, 15 bp, Homo sapiens
ggcagcgcctcgccc

SEQ ID NO: 620873 - DNA, 16 bp, Homo sapiens
ggcagcgcctcgcccc

SEQ ID NO: 620874 - DNA, 15 bp, Homo sapiens
ggcagctaggcaggg

SEQ ID NO: 620875 - DNA, 19 bp, Homo sapiens
ggcagctaggcagggaggg

SEQ ID NO: 620876 - DNA, 23 bp, Homo sapiens
ggcagctgcagttagcacagagg

SEQ ID NO: 620877 - DNA, 13 bp, Homo sapiens
ggcagcttccctg

SEQ ID NO: 620878 - DNA, 21 bp, Homo sapiens
ggcagcttgagcctgtcacgt

SEQ ID NO: 620879 - DNA, 13 bp, Homo sapiens
ggcaggcagacca

SEQ ID NO: 620880 - DNA, 20 bp, Homo sapiens
ggcaggcagctaggcaggga

SEQ ID NO: 620881 - DNA, 21 bp, Homo sapiens
ggcagggaagggtgcctggct

SEQ ID NO: 620882 - DNA, 21 bp, Homo sapiens
ggcagggcccagggaggtggc

SEQ ID NO: 620883 - DNA, 17 bp, Homo sapiens
ggcagggccgcagggcg

SEQ ID NO: 620884 - DNA, 17 bp, Homo sapiens
ggcagggttctagaagg

SEQ ID NO: 620885 - DNA, 18 bp, Homo sapiens
ggcaggtgggctgcctgc

SEQ ID NO: 620886 - DNA, 15 bp, Homo sapiens
ggcagtggctggggg

SEQ ID NO: 620887 - DNA, 22 bp, Homo sapiens
ggcagtgtgtcacactgagctg

SEQ ID NO: 620888 - DNA, 15 bp, Homo sapiens
ggcagttaggtgctg

SEQ ID NO: 620889 - DNA, 15 bp, Homo sapiens
ggcatccaccttcct

SEQ ID NO: 620890 - DNA, 20 bp, Homo sapiens
ggcatccaccttcctgccca

SEQ ID NO: 620891 - DNA, 21 bp, Homo sapiens
ggcatccaccttcctgcccag

SEQ ID NO: 620892 - DNA, 23 bp, Homo sapiens
ggcatgtgatgagaggaaatcac

SEQ ID NO: 620893 - DNA, 23 bp, Homo sapiens
ggcattggaggatgggggtcctg

SEQ ID NO: 620894 - DNA, 19 bp, Homo sapiens
ggcatttagcacagtattt

SEQ ID NO: 620895 - DNA, 13 bp, Homo sapiens
ggcatttgctgaa

SEQ ID NO: 620896 - DNA, 14 bp, Homo sapiens
ggcatttgctgaat

SEQ ID NO: 620897 - DNA, 15 bp, Homo sapiens
ggccaccctgagcag

SEQ ID NO: 620898 - DNA, 17 bp, Homo sapiens
ggccaccctgagcagat

SEQ ID NO: 620899 - DNA, 22 bp, Homo sapiens
ggccacctgccaggcctccctc

SEQ ID NO: 620900 - DNA, 22 bp, Homo sapiens
ggccagaccacgcccctgcctg

SEQ ID NO: 620901 - DNA, 20 bp, Homo sapiens
ggccagcgagtggtcaagga

SEQ ID NO: 620902 - DNA, 23 bp, Homo sapiens
ggccagggaaacaaagtttacat

SEQ ID NO: 620903 - DNA, 20 bp, Homo sapiens
ggccattgaacactgcaccc

SEQ ID NO: 620904 - DNA, 12 bp, Homo sapiens
ggcccacccctc

SEQ ID NO: 620905 - DNA, 15 bp, Homo sapiens
ggcccacccctcttc

SEQ ID NO: 620906 - DNA, 13 bp, Homo sapiens
ggcccagccctgg

SEQ ID NO: 620907 - DNA, 15 bp, Homo sapiens
ggcccagcctcttgt

SEQ ID NO: 620908 - DNA, 17 bp, Homo sapiens
ggcccaggcccagcctc

SEQ ID NO: 620909 - DNA, 17 bp, Homo sapiens
ggcccagggaggtggca

SEQ ID NO: 620910 - DNA, 15 bp, Homo sapiens
ggcccatggccccag

SEQ ID NO: 620911 - DNA, 20 bp, Homo sapiens
ggcccatggccccagctggc

SEQ ID NO: 620912 - DNA, 13 bp, Homo sapiens
ggccccaggccct

SEQ ID NO: 620913 - DNA, 23 bp, Homo sapiens
ggcccccacaggagcatgtccta

SEQ ID NO: 620914 - DNA, 23 bp, Homo sapiens
ggcccccacaggagcgtgtccta

SEQ ID NO: 620915 - DNA, 21 bp, Homo sapiens
ggcccccggaggcgcccacct

SEQ ID NO: 620916 - DNA, 22 bp, Homo sapiens
ggcccccggaggcgcccacctg

SEQ ID NO: 620917 - DNA, 19 bp, Homo sapiens
ggccccctcgcgcccctgt

SEQ ID NO: 620918 - DNA, 14 bp, Homo sapiens
ggccccgcgcgtgc

SEQ ID NO: 620919 - DNA, 17 bp, Homo sapiens
ggccccgcggagccccc

SEQ ID NO: 620920 - DNA, 15 bp, Homo sapiens
ggcccctccttctcc

SEQ ID NO: 620921 - DNA, 20 bp, Homo sapiens
ggcccctccttctcccctcc

SEQ ID NO: 620922 - DNA, 11 bp, Homo sapiens
ggcccctctct

SEQ ID NO: 620923 - DNA, 14 bp, Homo sapiens
ggcccgaggaggcc

SEQ ID NO: 620924 - DNA, 14 bp, Homo sapiens
ggcccgccaccttg

SEQ ID NO: 620925 - DNA, 21 bp, Homo sapiens
ggcccgcggggacgtcgctgt

SEQ ID NO: 620926 - DNA, 13 bp, Homo sapiens
ggcccggcccacg

SEQ ID NO: 620927 - DNA, 19 bp, Homo sapiens
ggcccggcccacgcagagc

SEQ ID NO: 620928 - DNA, 18 bp, Homo sapiens
ggcccgtgcgcagccgcg

SEQ ID NO: 620929 - DNA, 20 bp, Homo sapiens
ggcccgtgcgcagccgcgct

SEQ ID NO: 620930 - DNA, 21 bp, Homo sapiens
ggccctaggattcctccccca

SEQ ID NO: 620931 - DNA, 18 bp, Homo sapiens
ggccctgacttctggaga

SEQ ID NO: 620932 - DNA, 11 bp, Homo sapiens
ggccctgccct

SEQ ID NO: 620933 - DNA, 15 bp, Homo sapiens
ggccctgccctcccc

SEQ ID NO: 620934 - DNA, 16 bp, Homo sapiens
ggccctgccctccccc

SEQ ID NO: 620935 - DNA, 17 bp, Homo sapiens
ggccctgccctccccca

SEQ ID NO: 620936 - DNA, 12 bp, Homo sapiens
ggccctggagcc

SEQ ID NO: 620937 - DNA, 18 bp, Homo sapiens
ggccctggagccagggca

SEQ ID NO: 620938 - DNA, 19 bp, Homo sapiens
ggccctggagccagggcag

SEQ ID NO: 620939 - DNA, 23 bp, Homo sapiens
ggccctggagccagggcagagga

SEQ ID NO: 620940 - DNA, 16 bp, Homo sapiens
ggccctggggtctctg

SEQ ID NO: 620941 - DNA, 17 bp, Homo sapiens
ggccctgtgggagtcca

SEQ ID NO: 620942 - DNA, 18 bp, Homo sapiens
ggcccttagaatgtgaaa

SEQ ID NO: 620943 - DNA, 19 bp, Homo sapiens
ggccgaagccccttggaga

SEQ ID NO: 620944 - DNA, 14 bp, Homo sapiens
ggccgactgggctg

SEQ ID NO: 620945 - DNA, 20 bp, Homo sapiens
ggccgactgggctgctgggg

SEQ ID NO: 620946 - DNA, 16 bp, Homo sapiens
ggccgcagggcgctcc

SEQ ID NO: 620947 - DNA, 19 bp, Homo sapiens
ggccgcagggcgctccggc

SEQ ID NO: 620948 - DNA, 18 bp, Homo sapiens
ggccgccgaagggcagcc

SEQ ID NO: 620949 - DNA, 21 bp, Homo sapiens
ggccgccgaagggcagccccg

SEQ ID NO: 620950 - DNA, 14 bp, Homo sapiens
ggccgcctcctcca

SEQ ID NO: 620951 - DNA, 15 bp, Homo sapiens
ggccgcctcctccag

SEQ ID NO: 620952 - DNA, 16 bp, Homo sapiens
ggccgcctcctccaga

SEQ ID NO: 620953 - DNA, 18 bp, Homo sapiens
ggccgcctcctccagact

SEQ ID NO: 620954 - DNA, 20 bp, Homo sapiens
ggccgcctcctccagactcg

SEQ ID NO: 620955 - DNA, 15 bp, Homo sapiens
ggccgctctccgccc

SEQ ID NO: 620956 - DNA, 20 bp, Homo sapiens
ggccgctctccgccccccgg

SEQ ID NO: 620957 - DNA, 14 bp, Homo sapiens
ggccggggtccagg

SEQ ID NO: 620958 - DNA, 17 bp, Homo sapiens
ggccggggtccaggccc

SEQ ID NO: 620959 - DNA, 15 bp, Homo sapiens
ggccggtaggctgct

SEQ ID NO: 620960 - DNA, 16 bp, Homo sapiens
ggccggtaggctgctg

SEQ ID NO: 620961 - DNA, 12 bp, Homo sapiens
ggccgtccctga

SEQ ID NO: 620962 - DNA, 21 bp, Homo sapiens
ggccgtccctgacttcccagc

SEQ ID NO: 620963 - DNA, 15 bp, Homo sapiens
ggccgtgcagggcca

SEQ ID NO: 620964 - DNA, 12 bp, Homo sapiens
ggcctccatgcc

SEQ ID NO: 620965 - DNA, 15 bp, Homo sapiens
ggcctccctcgggct

SEQ ID NO: 620966 - DNA, 21 bp, Homo sapiens
ggcctgagggaagcccacccg

SEQ ID NO: 620967 - DNA, 19 bp, Homo sapiens
ggcctgatggccaggcctc

SEQ ID NO: 620968 - DNA, 13 bp, Homo sapiens
ggcctgcagccca

SEQ ID NO: 620969 - DNA, 15 bp, Homo sapiens
ggcctgcatggagaa

SEQ ID NO: 620970 - DNA, 16 bp, Homo sapiens
ggcctgcatggagaag

SEQ ID NO: 620971 - DNA, 12 bp, Homo sapiens
ggcctgcccccc

SEQ ID NO: 620972 - DNA, 18 bp, Homo sapiens
ggcctgccccccttccca

SEQ ID NO: 620973 - DNA, 20 bp, Homo sapiens
ggcctgcctacgtgctgccc

SEQ ID NO: 620974 - DNA, 14 bp, Homo sapiens
ggcctggccccctc

SEQ ID NO: 620975 - DNA, 15 bp, Homo sapiens
ggcctggccccctcg

SEQ ID NO: 620976 - DNA, 14 bp, Homo sapiens
ggcctgggctgttg

SEQ ID NO: 620977 - DNA, 16 bp, Homo sapiens
ggcctgggtccccctc

SEQ ID NO: 620978 - DNA, 19 bp, Homo sapiens
ggcctgggtccccctcctg

SEQ ID NO: 620979 - DNA, 21 bp, Homo sapiens
ggcctgggtccccctcctgca

SEQ ID NO: 620980 - DNA, 15 bp, Homo sapiens
ggccttccctcccca

SEQ ID NO: 620981 - DNA, 18 bp, Homo sapiens
ggccttggttcctccagc

SEQ ID NO: 620982 - DNA, 20 bp, Homo sapiens
ggcgagggcggcggggcctg

SEQ ID NO: 620983 - DNA, 17 bp, Homo sapiens
ggcgcaaaggtgcctca

SEQ ID NO: 620984 - DNA, 18 bp, Homo sapiens
ggcgcaaaggtgcctcat

SEQ ID NO: 620985 - DNA, 19 bp, Homo sapiens
ggcgccaggggcaggcagc

SEQ ID NO: 620986 - DNA, 13 bp, Homo sapiens
ggcgcccacctgc

SEQ ID NO: 620987 - DNA, 15 bp, Homo sapiens
ggcgcccacctgccc

SEQ ID NO: 620988 - DNA, 16 bp, Homo sapiens
ggcgccccatgggccc

SEQ ID NO: 620989 - DNA, 15 bp, Homo sapiens
ggcgcgcaccgccca

SEQ ID NO: 620990 - DNA, 20 bp, Homo sapiens
ggcgcgcaccgcccaacccc

SEQ ID NO: 620991 - DNA, 21 bp, Homo sapiens
ggcgcgcgcccccaggacccc

SEQ ID NO: 620992 - DNA, 18 bp, Homo sapiens
ggcgctccggcagaggca

SEQ ID NO: 620993 - DNA, 15 bp, Homo sapiens
ggcgctgagggcagg

SEQ ID NO: 620994 - DNA, 15 bp, Homo sapiens
ggcggaggggcttgg

SEQ ID NO: 620995 - DNA, 19 bp, Homo sapiens
ggcggaggggcttggagca

SEQ ID NO: 620996 - DNA, 20 bp, Homo sapiens
ggcggaggggcttggagcag

SEQ ID NO: 620997 - DNA, 21 bp, Homo sapiens
ggcggaggggcttggagcaga

SEQ ID NO: 620998 - DNA, 22 bp, Homo sapiens
ggcggcacattggcagtgtgtc

SEQ ID NO: 620999 - DNA, 14 bp, Homo sapiens
ggcgggcagcccct

SEQ ID NO: 621000 - DNA, 15 bp, Homo sapiens
ggcgtgaaacacaat

SEQ ID NO: 621001 - DNA, 14 bp, Homo sapiens
ggcgtggcttggca

SEQ ID NO: 621002 - DNA, 19 bp, Homo sapiens
ggcgtgggatccagagaga

SEQ ID NO: 621003 - DNA, 22 bp, Homo sapiens
ggcgtgggatccagagagaagc

SEQ ID NO: 621004 - DNA, 20 bp, Homo sapiens
ggctaaatgcctaataaaca

SEQ ID NO: 621005 - DNA, 17 bp, Homo sapiens
ggctaactggccccagg

SEQ ID NO: 621006 - DNA, 18 bp, Homo sapiens
ggctaactggccccaggc

SEQ ID NO: 621007 - DNA, 12 bp, Homo sapiens
ggctacaggtgc

SEQ ID NO: 621008 - DNA, 13 bp, Homo sapiens
ggctactgccact

SEQ ID NO: 621009 - DNA, 21 bp, Homo sapiens
ggctcagatggggcctgggct

SEQ ID NO: 621010 - DNA, 22 bp, Homo sapiens
ggctcagggttggccatttgct

SEQ ID NO: 621011 - DNA, 18 bp, Homo sapiens
ggctccgggctgtgtcct

SEQ ID NO: 621012 - DNA, 21 bp, Homo sapiens
ggctctgaatctctcaaaatg

SEQ ID NO: 621013 - DNA, 22 bp, Homo sapiens
ggctgaaattatgtcaaatgga

SEQ ID NO: 621014 - DNA, 10 bp, Homo sapiens
ggctgaagaa

SEQ ID NO: 621015 - DNA, 12 bp, Homo sapiens
ggctgagacaca

SEQ ID NO: 621016 - DNA, 19 bp, Homo sapiens
ggctgagcccctcctctcc

SEQ ID NO: 621017 - DNA, 22 bp, Homo sapiens
ggctgaggacggggcagagctg

SEQ ID NO: 621018 - DNA, 19 bp, Homo sapiens
ggctgccgcatctgcctgg

SEQ ID NO: 621019 - DNA, 13 bp, Homo sapiens
ggctgcctcagcc

SEQ ID NO: 621020 - DNA, 14 bp, Homo sapiens
ggctgcgcctgccc

SEQ ID NO: 621021 - DNA, 15 bp, Homo sapiens
ggctgcgcctgcccg

SEQ ID NO: 621022 - DNA, 17 bp, Homo sapiens
ggctgcgcctgcccgcc

SEQ ID NO: 621023 - DNA, 19 bp, Homo sapiens
ggctgctgcactgccctcc

SEQ ID NO: 621024 - DNA, 23 bp, Homo sapiens
ggctgctgcagtcagcacagaga

SEQ ID NO: 621025 - DNA, 13 bp, Homo sapiens
ggctgctgccccc

SEQ ID NO: 621026 - DNA, 19 bp, Homo sapiens
ggctgctgcttctccctgg

SEQ ID NO: 621027 - DNA, 13 bp, Homo sapiens
ggctgctggcgcc

SEQ ID NO: 621028 - DNA, 13 bp, Homo sapiens
ggctgctggggca

SEQ ID NO: 621029 - DNA, 17 bp, Homo sapiens
ggctgctggggcagggc

SEQ ID NO: 621030 - DNA, 19 bp, Homo sapiens
ggctgctgtgtagctctgt

SEQ ID NO: 621031 - DNA, 12 bp, Homo sapiens
ggctgcttcaag

SEQ ID NO: 621032 - DNA, 14 bp, Homo sapiens
ggctgcttcaagga

SEQ ID NO: 621033 - DNA, 19 bp, Homo sapiens
ggctgcttcaaggatcctg

SEQ ID NO: 621034 - DNA, 20 bp, Homo sapiens
ggctgcttcaaggatcctga

SEQ ID NO: 621035 - DNA, 22 bp, Homo sapiens
ggctgcttcaaggatcctgagc

SEQ ID NO: 621036 - DNA, 14 bp, Homo sapiens
ggctggataggaga

SEQ ID NO: 621037 - DNA, 16 bp, Homo sapiens
ggctggatgtgctttc

SEQ ID NO: 621038 - DNA, 11 bp, Homo sapiens
ggctggccctg

SEQ ID NO: 621039 - DNA, 14 bp, Homo sapiens
ggctggccctgccc

SEQ ID NO: 621040 - DNA, 18 bp, Homo sapiens
ggctggccctgccctccc

SEQ ID NO: 621041 - DNA, 13 bp, Homo sapiens
ggctgggcagggc

SEQ ID NO: 621042 - DNA, 14 bp, Homo sapiens
ggctgggcagggcc

SEQ ID NO: 621043 - DNA, 18 bp, Homo sapiens
ggctgggcagggccgcag

SEQ ID NO: 621044 - DNA, 19 bp, Homo sapiens
ggctgggcagggccgcagg

SEQ ID NO: 621045 - DNA, 16 bp, Homo sapiens
ggctggggccggggct

SEQ ID NO: 621046 - DNA, 13 bp, Homo sapiens
ggctgggggactg

SEQ ID NO: 621047 - DNA, 16 bp, Homo sapiens
ggctgggggactgctt

SEQ ID NO: 621048 - DNA, 17 bp, Homo sapiens
ggctgggtcgcccctcc

SEQ ID NO: 621049 - DNA, 16 bp, Homo sapiens
ggctggtgtcttgaga

SEQ ID NO: 621050 - DNA, 17 bp, Homo sapiens
ggctgtcccctgcaagt

SEQ ID NO: 621051 - DNA, 18 bp, Homo sapiens
ggctgttatctgtcttta

SEQ ID NO: 621052 - DNA, 17 bp, Homo sapiens
ggcttacctgttctcta

SEQ ID NO: 621053 - DNA, 16 bp, Homo sapiens
ggcttatcagaactcc

SEQ ID NO: 621054 - DNA, 14 bp, Homo sapiens
ggcttccatggtgg

SEQ ID NO: 621055 - DNA, 15 bp, Homo sapiens
ggcttccatggtggt

SEQ ID NO: 621056 - DNA, 22 bp, Homo sapiens
ggcttccatggtggtttcagaa

SEQ ID NO: 621057 - DNA, 14 bp, Homo sapiens
ggcttctccccctc

SEQ ID NO: 621058 - DNA, 15 bp, Homo sapiens
ggcttctccccctca

SEQ ID NO: 621059 - DNA, 15 bp, Homo sapiens
ggcttggagcagaga

SEQ ID NO: 621060 - DNA, 23 bp, Homo sapiens
ggcttggagcagagacggcagcc

SEQ ID NO: 621061 - DNA, 17 bp, Homo sapiens
ggcttggggtagagagg

SEQ ID NO: 621062 - DNA, 17 bp, Homo sapiens
gggaaaccttggagagg

SEQ ID NO: 621063 - DNA, 14 bp, Homo sapiens
gggaacacagtgcc

SEQ ID NO: 621064 - DNA, 17 bp, Homo sapiens
gggaacacagtgcccca

SEQ ID NO: 621065 - DNA, 20 bp, Homo sapiens
gggaacatgacccagcctga

SEQ ID NO: 621066 - DNA, 14 bp, Homo sapiens
gggaagagaagaaa

SEQ ID NO: 621067 - DNA, 20 bp, Homo sapiens
gggaagcccacccgccccag

SEQ ID NO: 621068 - DNA, 21 bp, Homo sapiens
gggaagcccacccgccccaga

SEQ ID NO: 621069 - DNA, 22 bp, Homo sapiens
gggaagcccacccgccccagag

SEQ ID NO: 621070 - DNA, 14 bp, Homo sapiens
gggaaggctgctgt

SEQ ID NO: 621071 - DNA, 15 bp, Homo sapiens
gggaaggctgctgtg

SEQ ID NO: 621072 - DNA, 12 bp, Homo sapiens
gggaattttcat

SEQ ID NO: 621073 - DNA, 15 bp, Homo sapiens
gggaattttcatttt

SEQ ID NO: 621074 - DNA, 20 bp, Homo sapiens
gggacagatcttgagcaagg

SEQ ID NO: 621075 - DNA, 12 bp, Homo sapiens
gggacagcctgc

SEQ ID NO: 621076 - DNA, 22 bp, Homo sapiens
gggacagcggccccgcggagcc

SEQ ID NO: 621077 - DNA, 16 bp, Homo sapiens
gggacagcggcccggc

SEQ ID NO: 621078 - DNA, 23 bp, Homo sapiens
gggacgagcagagcgcagccccc

SEQ ID NO: 621079 - DNA, 14 bp, Homo sapiens
gggacgcccctttc

SEQ ID NO: 621080 - DNA, 14 bp, Homo sapiens
gggactacagaagt

SEQ ID NO: 621081 - DNA, 13 bp, Homo sapiens
gggactctccata

SEQ ID NO: 621082 - DNA, 21 bp, Homo sapiens
gggactgctttcagtgcctgc

SEQ ID NO: 621083 - DNA, 19 bp, Homo sapiens
gggactggcccacccctct

SEQ ID NO: 621084 - DNA, 23 bp, Homo sapiens
gggactgtcttcaaccctgccct

SEQ ID NO: 621085 - DNA, 18 bp, Homo sapiens
gggagaatggctctggct

SEQ ID NO: 621086 - DNA, 13 bp, Homo sapiens
gggagactgagct

SEQ ID NO: 621087 - DNA, 18 bp, Homo sapiens
gggaggacccctgccctc

SEQ ID NO: 621088 - DNA, 21 bp, Homo sapiens
gggaggagcacccccagcctc

SEQ ID NO: 621089 - DNA, 13 bp, Homo sapiens
gggagggggctgg

SEQ ID NO: 621090 - DNA, 14 bp, Homo sapiens
gggaggtggcaggg

SEQ ID NO: 621091 - DNA, 17 bp, Homo sapiens
gggaggtggcagggaag

SEQ ID NO: 621092 - DNA, 13 bp, Homo sapiens
gggatccagagag

SEQ ID NO: 621093 - DNA, 17 bp, Homo sapiens
gggatctaaaaggagga

SEQ ID NO: 621094 - DNA, 24 bp, Homo sapiens
gggatgcccctggccctgcctcac

SEQ ID NO: 621095 - DNA, 21 bp, Homo sapiens
gggatgctatctcgctagcca

SEQ ID NO: 621096 - DNA, 20 bp, Homo sapiens
gggcacattgcccatggctg

SEQ ID NO: 621097 - DNA, 13 bp, Homo sapiens
gggcacgggagag

SEQ ID NO: 621098 - DNA, 16 bp, Homo sapiens
gggcacgggagagcgc

SEQ ID NO: 621099 - DNA, 20 bp, Homo sapiens
gggcacgggagagcgccacc

SEQ ID NO: 621100 - DNA, 22 bp, Homo sapiens
gggcacgggagagcgccacccg

SEQ ID NO: 621101 - DNA, 14 bp, Homo sapiens
gggcagaatagctg

SEQ ID NO: 621102 - DNA, 15 bp, Homo sapiens
gggcagagaccaccg

SEQ ID NO: 621103 - DNA, 16 bp, Homo sapiens
gggcagagaccaccgc

SEQ ID NO: 621104 - DNA, 22 bp, Homo sapiens
gggcagagaccaccgcgcccct

SEQ ID NO: 621105 - DNA, 20 bp, Homo sapiens
gggcagagctgagtcggctg

SEQ ID NO: 621106 - DNA, 21 bp, Homo sapiens
gggcagccccgcgaccacccc

SEQ ID NO: 621107 - DNA, 23 bp, Homo sapiens
gggcagccccgcgaccacccctg

SEQ ID NO: 621108 - DNA, 13 bp, Homo sapiens
gggcagcccctgc

SEQ ID NO: 621109 - DNA, 15 bp, Homo sapiens
gggcagcccctgctg

SEQ ID NO: 621110 - DNA, 13 bp, Homo sapiens
gggcaggcagcta

SEQ ID NO: 621111 - DNA, 18 bp, Homo sapiens
gggcaggcagctaggcag

SEQ ID NO: 621112 - DNA, 13 bp, Homo sapiens
gggcagggcccag

SEQ ID NO: 621113 - DNA, 14 bp, Homo sapiens
gggcagggcccagg

SEQ ID NO: 621114 - DNA, 16 bp, Homo sapiens
gggcagggtgagaagc

SEQ ID NO: 621115 - DNA, 21 bp, Homo sapiens
gggcatagggtttggaagaaa

SEQ ID NO: 621116 - DNA, 22 bp, Homo sapiens
gggccaagccagggttccagac

SEQ ID NO: 621117 - DNA, 13 bp, Homo sapiens
gggccagcccttg

SEQ ID NO: 621118 - DNA, 15 bp, Homo sapiens
gggccagcccttgct

SEQ ID NO: 621119 - DNA, 16 bp, Homo sapiens
gggccaggtctggcgc

SEQ ID NO: 621120 - DNA, 18 bp, Homo sapiens
gggccaggtctggcgcca

SEQ ID NO: 621121 - DNA, 19 bp, Homo sapiens
gggccaggtctggcgccag

SEQ ID NO: 621122 - DNA, 19 bp, Homo sapiens
gggccatttcacattcctg

SEQ ID NO: 621123 - DNA, 21 bp, Homo sapiens
gggccatttcacattcctgac

SEQ ID NO: 621124 - DNA, 12 bp, Homo sapiens
gggcccaggccc

SEQ ID NO: 621125 - DNA, 13 bp, Homo sapiens
gggcccagggagg

SEQ ID NO: 621126 - DNA, 20 bp, Homo sapiens
gggcccagggaggtggcagg

SEQ ID NO: 621127 - DNA, 18 bp, Homo sapiens
gggcccatggccccagct

SEQ ID NO: 621128 - DNA, 13 bp, Homo sapiens
gggcccgagcgcg

SEQ ID NO: 621129 - DNA, 16 bp, Homo sapiens
gggcccgagcgcgtgc

SEQ ID NO: 621130 - DNA, 21 bp, Homo sapiens
gggcccgctcaacctctcaga

SEQ ID NO: 621131 - DNA, 12 bp, Homo sapiens
gggccctcagcg

SEQ ID NO: 621132 - DNA, 18 bp, Homo sapiens
gggccctcagcgtctccc

SEQ ID NO: 621133 - DNA, 14 bp, Homo sapiens
gggccctctgtcca

SEQ ID NO: 621134 - DNA, 19 bp, Homo sapiens
gggccctggggtctctgag

SEQ ID NO: 621135 - DNA, 21 bp, Homo sapiens
gggccctggggtctctgagca

SEQ ID NO: 621136 - DNA, 20 bp, Homo sapiens
gggcccttcccaacctcccc

SEQ ID NO: 621137 - DNA, 21 bp, Homo sapiens
gggcccttcccaacctcccct

SEQ ID NO: 621138 - DNA, 13 bp, Homo sapiens
gggccgcagggcg

SEQ ID NO: 621139 - DNA, 16 bp, Homo sapiens
gggccgcagggcgctc

SEQ ID NO: 621140 - DNA, 17 bp, Homo sapiens
gggccgcctcctccaga

SEQ ID NO: 621141 - DNA, 20 bp, Homo sapiens
gggccgcctcctccagactc

SEQ ID NO: 621142 - DNA, 18 bp, Homo sapiens
gggcctccatgccccagc

SEQ ID NO: 621143 - DNA, 23 bp, Homo sapiens
gggcctccatgccccagctctgg

SEQ ID NO: 621144 - DNA, 21 bp, Homo sapiens
gggcctcccgtccgtccgccc

SEQ ID NO: 621145 - DNA, 17 bp, Homo sapiens
gggcctgggtccccctc

SEQ ID NO: 621146 - DNA, 18 bp, Homo sapiens
gggcctgggtccccctcc

SEQ ID NO: 621147 - DNA, 20 bp, Homo sapiens
gggcctgggtccccctcctg

SEQ ID NO: 621148 - DNA, 23 bp, Homo sapiens
gggcgcgcgcccccaggaccccc

SEQ ID NO: 621149 - DNA, 16 bp, Homo sapiens
gggcgctccggcagag

SEQ ID NO: 621150 - DNA, 15 bp, Homo sapiens
gggcgctgagggcag

SEQ ID NO: 621151 - DNA, 12 bp, Homo sapiens
gggcgggccagg

SEQ ID NO: 621152 - DNA, 16 bp, Homo sapiens
gggcgtgacttcagac

SEQ ID NO: 621153 - DNA, 15 bp, Homo sapiens
gggctaactggcccc

SEQ ID NO: 621154 - DNA, 20 bp, Homo sapiens
gggctaactggccccaggcg

SEQ ID NO: 621155 - DNA, 20 bp, Homo sapiens
gggctcactacatgggccag

SEQ ID NO: 621156 - DNA, 13 bp, Homo sapiens
gggctcagggttg

SEQ ID NO: 621157 - DNA, 19 bp, Homo sapiens
gggctcagggttggccatt

SEQ ID NO: 621158 - DNA, 21 bp, Homo sapiens
gggctccccttcgcgtatttc

SEQ ID NO: 621159 - DNA, 21 bp, Homo sapiens
gggctctctcacccagcctgg

SEQ ID NO: 621160 - DNA, 20 bp, Homo sapiens
gggctgccgcatctgcctgg

SEQ ID NO: 621161 - DNA, 22 bp, Homo sapiens
gggctgcgtccctgctcagccc

SEQ ID NO: 621162 - DNA, 14 bp, Homo sapiens
gggctgctggggca

SEQ ID NO: 621163 - DNA, 16 bp, Homo sapiens
gggctgctggggcagg

SEQ ID NO: 621164 - DNA, 22 bp, Homo sapiens
gggctgctggggcagggcccag

SEQ ID NO: 621165 - DNA, 13 bp, Homo sapiens
gggctggccctgc

SEQ ID NO: 621166 - DNA, 20 bp, Homo sapiens
gggctgttagctcagaggag

SEQ ID NO: 621167 - DNA, 20 bp, Homo sapiens
gggctgttgtgtctggagcc

SEQ ID NO: 621168 - DNA, 21 bp, Homo sapiens
gggctgttgtgtctggagcct

SEQ ID NO: 621169 - DNA, 23 bp, Homo sapiens
gggcttatcagaactcctttcta

SEQ ID NO: 621170 - DNA, 14 bp, Homo sapiens
gggcttggaagggc

SEQ ID NO: 621171 - DNA, 13 bp, Homo sapiens
gggcttggagcag

SEQ ID NO: 621172 - DNA, 14 bp, Homo sapiens
gggcttggagcaga

SEQ ID NO: 621173 - DNA, 16 bp, Homo sapiens
gggcttggggtagaga

SEQ ID NO: 621174 - DNA, 20 bp, Homo sapiens
gggcttggggtagagaggac

SEQ ID NO: 621175 - DNA, 22 bp, Homo sapiens
gggcttggggtagagaggacag

SEQ ID NO: 621176 - DNA, 15 bp, Homo sapiens
gggctttggggctgg

SEQ ID NO: 621177 - DNA, 17 bp, Homo sapiens
ggggacaccctcctgcc

SEQ ID NO: 621178 - DNA, 19 bp, Homo sapiens
ggggacgcccagcccccac

SEQ ID NO: 621179 - DNA, 21 bp, Homo sapiens
ggggactgctttcagtgcctg

SEQ ID NO: 621180 - DNA, 16 bp, Homo sapiens
ggggacttggatagga

SEQ ID NO: 621181 - DNA, 16 bp, Homo sapiens
ggggagaatggctctg

SEQ ID NO: 621182 - DNA, 13 bp, Homo sapiens
ggggaggagcacc

SEQ ID NO: 621183 - DNA, 15 bp, Homo sapiens
ggggaggagcacccc

SEQ ID NO: 621184 - DNA, 23 bp, Homo sapiens
ggggatcatgttaaaaatagcag

SEQ ID NO: 621185 - DNA, 15 bp, Homo sapiens
ggggatgcccctggc

SEQ ID NO: 621186 - DNA, 21 bp, Homo sapiens
ggggatgcccctggccctgcc

SEQ ID NO: 621187 - DNA, 13 bp, Homo sapiens
ggggcagagctga

SEQ ID NO: 621188 - DNA, 11 bp, Homo sapiens
ggggcaggcag

SEQ ID NO: 621189 - DNA, 15 bp, Homo sapiens
ggggcaggcagctag

SEQ ID NO: 621190 - DNA, 14 bp, Homo sapiens
ggggcccatggccc

SEQ ID NO: 621191 - DNA, 23 bp, Homo sapiens
ggggcctgcggggttccctgcgc

SEQ ID NO: 621192 - DNA, 19 bp, Homo sapiens
ggggcctgggtccccctcc

SEQ ID NO: 621193 - DNA, 18 bp, Homo sapiens
ggggcggcatccgagccc

SEQ ID NO: 621194 - DNA, 20 bp, Homo sapiens
ggggcggcatccgagcccct

SEQ ID NO: 621195 - DNA, 18 bp, Homo sapiens
ggggctaactggccccag

SEQ ID NO: 621196 - DNA, 13 bp, Homo sapiens
ggggctggccctg

SEQ ID NO: 621197 - DNA, 16 bp, Homo sapiens
ggggctggccctgccc

SEQ ID NO: 621198 - DNA, 17 bp, Homo sapiens
ggggctggccctgccct

SEQ ID NO: 621199 - DNA, 20 bp, Homo sapiens
ggggctggccctgccctccc

SEQ ID NO: 621200 - DNA, 21 bp, Homo sapiens
ggggctggccctgccctcccc

SEQ ID NO: 621201 - DNA, 22 bp, Homo sapiens
ggggctggccctgccctccccc

SEQ ID NO: 621202 - DNA, 13 bp, Homo sapiens
ggggcttggaagg

SEQ ID NO: 621203 - DNA, 13 bp, Homo sapiens
ggggcttggagca

SEQ ID NO: 621204 - DNA, 16 bp, Homo sapiens
ggggcttggagcagag

SEQ ID NO: 621205 - DNA, 19 bp, Homo sapiens
ggggcttggggtagagagg

SEQ ID NO: 621206 - DNA, 20 bp, Homo sapiens
ggggcttggggtagagagga

SEQ ID NO: 621207 - DNA, 23 bp, Homo sapiens
ggggcttggggtagagaggacag

SEQ ID NO: 621208 - DNA, 20 bp, Homo sapiens
gggggactgctttcagtgcc

SEQ ID NO: 621209 - DNA, 14 bp, Homo sapiens
gggggaggagcacc

SEQ ID NO: 621210 - DNA, 15 bp, Homo sapiens
gggggaggagcaccc

SEQ ID NO: 621211 - DNA, 20 bp, Homo sapiens
gggggcttggggtagagagg

SEQ ID NO: 621212 - DNA, 21 bp, Homo sapiens
gggggcttggggtagagagga

SEQ ID NO: 621213 - DNA, 15 bp, Homo sapiens
ggggtctctgagcag

SEQ ID NO: 621214 - DNA, 15 bp, Homo sapiens
ggggtggggcttgga

SEQ ID NO: 621215 - DNA, 19 bp, Homo sapiens
ggggtggggcttggaaggg

SEQ ID NO: 621216 - DNA, 18 bp, Homo sapiens
ggggtggttggaggcctg

SEQ ID NO: 621217 - DNA, 20 bp, Homo sapiens
ggggttggcagcgcctcgcc

SEQ ID NO: 621218 - DNA, 17 bp, Homo sapiens
gggtaacaaagtgagac

SEQ ID NO: 621219 - DNA, 16 bp, Homo sapiens
gggtatcatgcttcta

SEQ ID NO: 621220 - DNA, 17 bp, Homo sapiens
gtatatgtttatacaca

SEQ ID NO: 621221 - DNA, 21 bp, Homo sapiens
gtatattgatgtaactgtgtc

SEQ ID NO: 621222 - DNA, 19 bp, Homo sapiens
gtatctgatgatgttctga

SEQ ID NO: 621223 - DNA, 17 bp, Homo sapiens
gtatgaaacaaatatac

SEQ ID NO: 621224 - DNA, 22 bp, Homo sapiens
gtatggaagacaaatacacata

SEQ ID NO: 621225 - DNA, 23 bp, Homo sapiens
gtatgtgtatatgtttatacaca

SEQ ID NO: 621226 - DNA, 13 bp, Homo sapiens
gtatgttatccac

SEQ ID NO: 621227 - DNA, 13 bp, Homo sapiens
gtatgttgcatga

SEQ ID NO: 621228 - DNA, 22 bp, Homo sapiens
gtattaatgtagggcagaatag

SEQ ID NO: 621229 - DNA, 16 bp, Homo sapiens
gtattacataaaacac

SEQ ID NO: 621230 - DNA, 14 bp, Homo sapiens
gtattatcataagt

SEQ ID NO: 621231 - DNA, 16 bp, Homo sapiens
gtattgctagtttaaa

SEQ ID NO: 621232 - DNA, 20 bp, Homo sapiens
gtattgttcttgtaaaactg

SEQ ID NO: 621233 - DNA, 18 bp, Homo sapiens
gtatttcggctatgtctc

SEQ ID NO: 621234 - DNA, 18 bp, Homo sapiens
gtatttgaggaaactcat

SEQ ID NO: 621235 - DNA, 23 bp, Homo sapiens
gtatttgaggaaactcatacagt

SEQ ID NO: 621236 - DNA, 15 bp, Homo sapiens
gtattttaacatagc

SEQ ID NO: 621237 - DNA, 20 bp, Homo sapiens
gtattttaacatagcagctg

SEQ ID NO: 621238 - DNA, 15 bp, Homo sapiens
gtattttaataaaga

SEQ ID NO: 621239 - DNA, 23 bp, Homo sapiens
gtattttaataaagattccatgg

SEQ ID NO: 621240 - DNA, 13 bp, Homo sapiens
gtattttattgta

SEQ ID NO: 621241 - DNA, 10 bp, Homo sapiens
gtattttgag

SEQ ID NO: 621242 - DNA, 14 bp, Homo sapiens
gtattttgtcagtt

SEQ ID NO: 621243 - DNA, 18 bp, Homo sapiens
gtattttgtcagttttaa

SEQ ID NO: 621244 - DNA, 12 bp, Homo sapiens
gtcaaagaagac

SEQ ID NO: 621245 - DNA, 22 bp, Homo sapiens
gtcaaatggtattttttgtgaa

SEQ ID NO: 621246 - DNA, 16 bp, Homo sapiens
gtcaagtttttatacc

SEQ ID NO: 621247 - DNA, 13 bp, Homo sapiens
gtcaatcaaacag

SEQ ID NO: 621248 - DNA, 13 bp, Homo sapiens
gtcaatgaaaagc

SEQ ID NO: 621249 - DNA, 20 bp, Homo sapiens
gtctcaaaataaaaccagaa

SEQ ID NO: 621250 - DNA, 20 bp, Homo sapiens
gtctcaattctgaaggggaa

SEQ ID NO: 621251 - DNA, 14 bp, Homo sapiens
gtctccacccctca

SEQ ID NO: 621252 - DNA, 17 bp, Homo sapiens
gtctccccatgctgggc

SEQ ID NO: 621253 - DNA, 22 bp, Homo sapiens
gtctccccatgctgggctcact

SEQ ID NO: 621254 - DNA, 19 bp, Homo sapiens
gtctccctgggcaccctgc

SEQ ID NO: 621255 - DNA, 22 bp, Homo sapiens
gtctccctgggcaccctgcagg

SEQ ID NO: 621256 - DNA, 13 bp, Homo sapiens
gtctcctctgtca

SEQ ID NO: 621257 - DNA, 21 bp, Homo sapiens
gtctcctctgtcagtttgtga

SEQ ID NO: 621258 - DNA, 13 bp, Homo sapiens
gtctcgcagcctg

SEQ ID NO: 621259 - DNA, 15 bp, Homo sapiens
gtctcgcagcctgaa

SEQ ID NO: 621260 - DNA, 18 bp, Homo sapiens
gtctcgcagcctgaagcc

SEQ ID NO: 621261 - DNA, 23 bp, Homo sapiens
gtctcgcagcctgaagcctggat

SEQ ID NO: 621262 - DNA, 16 bp, Homo sapiens
gtctctaattgattca

SEQ ID NO: 621263 - DNA, 17 bp, Homo sapiens
gtctctcttttgctctc

SEQ ID NO: 621264 - DNA, 13 bp, Homo sapiens
gtctctgagcagt

SEQ ID NO: 621265 - DNA, 15 bp, Homo sapiens
gtctctgagcagtgg

SEQ ID NO: 621266 - DNA, 14 bp, Homo sapiens
gtctctttctttcc

SEQ ID NO: 621267 - DNA, 15 bp, Homo sapiens
gtctctttctttcca

SEQ ID NO: 621268 - DNA, 16 bp, Homo sapiens
gtctctttctttccaa

SEQ ID NO: 621269 - DNA, 19 bp, Homo sapiens
gtctctttctttccaaagg

SEQ ID NO: 621270 - DNA, 14 bp, Homo sapiens
gtgctgggtcctta

SEQ ID NO: 621271 - DNA, 14 bp, Homo sapiens
gtgctgttgattct

SEQ ID NO: 621272 - DNA, 15 bp, Homo sapiens
gtgctgttgattctt

SEQ ID NO: 621273 - DNA, 21 bp, Homo sapiens
gtgcttatgtcatttcttctc

SEQ ID NO: 621274 - DNA, 20 bp, Homo sapiens
gtgcttcacacaaagtgaaa

SEQ ID NO: 621275 - DNA, 21 bp, Homo sapiens
gtgcttcacacaaagtgaaat

SEQ ID NO: 621276 - DNA, 23 bp, Homo sapiens
gtgcttcacacaaagtgaaatta

SEQ ID NO: 621277 - DNA, 20 bp, Homo sapiens
gtgcttgaggccaaatgagt

SEQ ID NO: 621278 - DNA, 23 bp, Homo sapiens
gtgctttcatgtttaagaaatga

SEQ ID NO: 621279 - DNA, 12 bp, Homo sapiens
gtgctttctcca

SEQ ID NO: 621280 - DNA, 14 bp, Homo sapiens
gtgctttgtctaat

SEQ ID NO: 621281 - DNA, 20 bp, Homo sapiens
gtggaagagctgctgtattt

SEQ ID NO: 621282 - DNA, 23 bp, Homo sapiens
gtggaattacataacaggcattg

SEQ ID NO: 621283 - DNA, 13 bp, Homo sapiens
gtggaccacgacc

SEQ ID NO: 621284 - DNA, 22 bp, Homo sapiens
gtggagcttggagccccctggc

SEQ ID NO: 621285 - DNA, 18 bp, Homo sapiens
gtggataaattttggaag

SEQ ID NO: 621286 - DNA, 15 bp, Homo sapiens
gtggattgttttttc

SEQ ID NO: 621287 - DNA, 18 bp, Homo sapiens
gtggcaagctcttcattg

SEQ ID NO: 621288 - DNA, 20 bp, Homo sapiens
gtggcagggaagggtgcctg

SEQ ID NO: 621289 - DNA, 17 bp, Homo sapiens
gtggcagtgcagcaacc

SEQ ID NO: 621290 - DNA, 22 bp, Homo sapiens
gtggcagtgcagcaaccagagc

SEQ ID NO: 621291 - DNA, 16 bp, Homo sapiens
gtggcatttgctgaat

SEQ ID NO: 621292 - DNA, 22 bp, Homo sapiens
gtggcccctccttctcccctcc

SEQ ID NO: 621293 - DNA, 11 bp, Homo sapiens
gtggccctgcg

SEQ ID NO: 621294 - DNA, 13 bp, Homo sapiens
gtggccctgtggg

SEQ ID NO: 621295 - DNA, 16 bp, Homo sapiens
gtggctcccagcagag

SEQ ID NO: 621296 - DNA, 22 bp, Homo sapiens
gtggctgatttactaacagtaa

SEQ ID NO: 621297 - DNA, 19 bp, Homo sapiens
gtggctgctcccagcctct

SEQ ID NO: 621298 - DNA, 19 bp, Homo sapiens
gtggctgcttcaaggatcc

SEQ ID NO: 621299 - DNA, 12 bp, Homo sapiens
gtgggaagagaa

SEQ ID NO: 621300 - DNA, 13 bp, Homo sapiens
gtgggatccagag

SEQ ID NO: 621301 - DNA, 20 bp, Homo sapiens
gtgggatccagagagaagca

SEQ ID NO: 621302 - DNA, 22 bp, Homo sapiens
gtgggcgcaaaggtgcctcata

SEQ ID NO: 621303 - DNA, 18 bp, Homo sapiens
gtgggcggcttccctgcg

SEQ ID NO: 621304 - DNA, 22 bp, Homo sapiens
gtgggctcacaccggcactgtg

SEQ ID NO: 621305 - DNA, 22 bp, Homo sapiens
gtggggacagaggatttctgct

SEQ ID NO: 621306 - DNA, 12 bp, Homo sapiens
gtggggccagga

SEQ ID NO: 621307 - DNA, 21 bp, Homo sapiens
gtggggcccatggccccagct

SEQ ID NO: 621308 - DNA, 24 bp, Homo sapiens
gtggggcttagaatggggcttcca

SEQ ID NO: 621309 - DNA, 19 bp, Homo sapiens
gtgggggagaatggctctg

SEQ ID NO: 621310 - DNA, 15 bp, Homo sapiens
gtgggggaggtccct

SEQ ID NO: 621311 - DNA, 14 bp, Homo sapiens
gtgggggcggctgt

SEQ ID NO: 621312 - DNA, 16 bp, Homo sapiens
gtgggggcggctgtgg

SEQ ID NO: 621313 - DNA, 17 bp, Homo sapiens
gtggggggtgccccaca

SEQ ID NO: 621314 - DNA, 22 bp, Homo sapiens
gtggtattttaacatagcagct

SEQ ID NO: 621315 - DNA, 16 bp, Homo sapiens
gtggtcttggagagga

SEQ ID NO: 621316 - DNA, 20 bp, Homo sapiens
gtggtcttggagaggaggtg

SEQ ID NO: 621317 - DNA, 22 bp, Homo sapiens
gtggtgaggtcctgtcctggct

SEQ ID NO: 621318 - DNA, 20 bp, Homo sapiens
gtggtgaggttgtgctgcct

SEQ ID NO: 621319 - DNA, 21 bp, Homo sapiens
gtggtgaggttgtgctgcctg

SEQ ID NO: 621320 - DNA, 15 bp, Homo sapiens
gtggtgatgcctaaa

SEQ ID NO: 621321 - DNA, 16 bp, Homo sapiens
gtggtgtgaggccccc

SEQ ID NO: 621322 - DNA, 19 bp, Homo sapiens
gtggtgtgaggcccccgga

SEQ ID NO: 621323 - DNA, 14 bp, Homo sapiens
gtggttctgccact

SEQ ID NO: 621324 - DNA, 22 bp, Homo sapiens
gtggttggaggcctggtctgga

SEQ ID NO: 621325 - DNA, 21 bp, Homo sapiens
gtgtaagacacgtgcaacaga

SEQ ID NO: 621326 - DNA, 17 bp, Homo sapiens
gtgtacatttatgtgtg

SEQ ID NO: 621327 - DNA, 18 bp, Homo sapiens
gtgtacatttatgtgtga

SEQ ID NO: 621328 - DNA, 20 bp, Homo sapiens
gtgtatatgtttatacacac

SEQ ID NO: 621329 - DNA, 15 bp, Homo sapiens
gtgtcacttttttcc

SEQ ID NO: 621330 - DNA, 18 bp, Homo sapiens
gtgtcattcatatgagtt

SEQ ID NO: 621331 - DNA, 20 bp, Homo sapiens
gtgtccattgacatgtacag

SEQ ID NO: 621332 - DNA, 15 bp, Homo sapiens
gtgtcctaaatgcaa

SEQ ID NO: 621333 - DNA, 13 bp, Homo sapiens
gtgtcctgcatgt

SEQ ID NO: 621334 - DNA, 14 bp, Homo sapiens
gtgtcctgcatgta

SEQ ID NO: 621335 - DNA, 20 bp, Homo sapiens
gtgtcttttgttctctcttg

SEQ ID NO: 621336 - DNA, 19 bp, Homo sapiens
gtgtgcagagtatacaagt

SEQ ID NO: 621337 - DNA, 14 bp, Homo sapiens
gtgtgcttcacaca

SEQ ID NO: 621338 - DNA, 14 bp, Homo sapiens
gtgtggagtggagg

SEQ ID NO: 621339 - DNA, 17 bp, Homo sapiens
gtgtggagtggaggggt

SEQ ID NO: 621340 - DNA, 19 bp, Homo sapiens
gtgtggagtggaggggtca

SEQ ID NO: 621341 - DNA, 20 bp, Homo sapiens
gtgtggcctaatccacctgg

SEQ ID NO: 621342 - DNA, 13 bp, Homo sapiens
gtgtggcttggaa

SEQ ID NO: 621343 - DNA, 14 bp, Homo sapiens
gtgtggcttggaac

SEQ ID NO: 621344 - DNA, 13 bp, Homo sapiens
gtgtggggagggt

SEQ ID NO: 621345 - DNA, 15 bp, Homo sapiens
gtgtggggagggtgg

SEQ ID NO: 621346 - DNA, 16 bp, Homo sapiens
gtgtggggagggtggg

SEQ ID NO: 621347 - DNA, 17 bp, Homo sapiens
gtgtggggagggtgggc

SEQ ID NO: 621348 - DNA, 18 bp, Homo sapiens
gtgtgtcacactgagctg

SEQ ID NO: 621349 - DNA, 13 bp, Homo sapiens
gtgtgtgtgtgca

SEQ ID NO: 621350 - DNA, 21 bp, Homo sapiens
gtgttagaaaaaactggaaac

SEQ ID NO: 621351 - DNA, 15 bp, Homo sapiens
gtgttcaaattctga

SEQ ID NO: 621352 - DNA, 12 bp, Homo sapiens
gtgttctcctcc

SEQ ID NO: 621353 - DNA, 13 bp, Homo sapiens
gtgttctcctcca

SEQ ID NO: 621354 - DNA, 12 bp, Homo sapiens
gtgtttaactga

SEQ ID NO: 621355 - DNA, 17 bp, Homo sapiens
gttaaatctacaaactt

SEQ ID NO: 621356 - DNA, 20 bp, Homo sapiens
gttaaatctacaaactttta

SEQ ID NO: 621357 - DNA, 15 bp, Homo sapiens
gttaaggggatctaa

SEQ ID NO: 621358 - DNA, 23 bp, Homo sapiens
gttaatctttgaaaactcataca

SEQ ID NO: 621359 - DNA, 21 bp, Homo sapiens
gttaatgaaaaatctgaattt

SEQ ID NO: 621360 - DNA, 16 bp, Homo sapiens
gttacagtggcagtat

SEQ ID NO: 621361 - DNA, 15 bp, Homo sapiens
gttacccctgaaatc

SEQ ID NO: 621362 - DNA, 22 bp, Homo sapiens
gttacctaacaatgttttttat

SEQ ID NO: 621363 - DNA, 17 bp, Homo sapiens
gttagaaaaaactggaa

SEQ ID NO: 621364 - DNA, 11 bp, Homo sapiens
gttagctcaga

SEQ ID NO: 621365 - DNA, 21 bp, Homo sapiens
gttagctcagaggagaggagc

SEQ ID NO: 621366 - DNA, 21 bp, Homo sapiens
gttagctgtttactgacatgg

SEQ ID NO: 621367 - DNA, 16 bp, Homo sapiens
gttaggggtgggggag

SEQ ID NO: 621368 - DNA, 21 bp, Homo sapiens
gttaggggtgggggagaatgg

SEQ ID NO: 621369 - DNA, 14 bp, Homo sapiens
gttataatttcaat

SEQ ID NO: 621370 - DNA, 19 bp, Homo sapiens
gttatctgtctttatgatt

SEQ ID NO: 621371 - DNA, 21 bp, Homo sapiens
gttattcaataactattgctg

SEQ ID NO: 621372 - DNA, 20 bp, Homo sapiens
gttatttactcctcctgctc

SEQ ID NO: 621373 - DNA, 19 bp, Homo sapiens
gttcaaagaacccccctcc

SEQ ID NO: 621374 - DNA, 13 bp, Homo sapiens
gttcaaattctga

SEQ ID NO: 621375 - DNA, 16 bp, Homo sapiens
gttcaccttctgtgca

SEQ ID NO: 621376 - DNA, 16 bp, Homo sapiens
gttcagtgccttggag

SEQ ID NO: 621377 - DNA, 12 bp, Homo sapiens
gttcatgaatac

SEQ ID NO: 621378 - DNA, 22 bp, Homo sapiens
gttcattcatactcaaagaggc

SEQ ID NO: 621379 - DNA, 11 bp, Homo sapiens
gttccaagtgt

SEQ ID NO: 621380 - DNA, 14 bp, Homo sapiens
gttccaagtgtgtg

SEQ ID NO: 621381 - DNA, 17 bp, Homo sapiens
gttccaagtgtgtgtgc

SEQ ID NO: 621382 - DNA, 16 bp, Homo sapiens
gttccacgtggggtgg

SEQ ID NO: 621383 - DNA, 11 bp, Homo sapiens
gttccagacag

SEQ ID NO: 621384 - DNA, 22 bp, Homo sapiens
gttccagacagagtggatctgg

SEQ ID NO: 621385 - DNA, 21 bp, Homo sapiens
gttccagacagggtggggctt

SEQ ID NO: 621386 - DNA, 19 bp, Homo sapiens
gttccctcagccctcatta

SEQ ID NO: 621387 - DNA, 12 bp, Homo sapiens
gttcctcatggc

SEQ ID NO: 621388 - DNA, 17 bp, Homo sapiens
taaaatgtgtttttcag

SEQ ID NO: 621389 - DNA, 14 bp, Homo sapiens
taaaattattaaaa

SEQ ID NO: 621390 - DNA, 15 bp, Homo sapiens
taaaattattaaaaa

SEQ ID NO: 621391 - DNA, 20 bp, Homo sapiens
taaaattattaaaaattata

SEQ ID NO: 621392 - DNA, 18 bp, Homo sapiens
taactgttaacccagtgt

SEQ ID NO: 621393 - DNA, 14 bp, Homo sapiens
tagagaagccataa

SEQ ID NO: 621394 - DNA, 18 bp, Homo sapiens
tagagataccctctgaga

SEQ ID NO: 621395 - DNA, 20 bp, Homo sapiens
tagagataccctctgagaca

SEQ ID NO: 621396 - DNA, 17 bp, Homo sapiens
tagagcattctggggtg

SEQ ID NO: 621397 - DNA, 20 bp, Homo sapiens
tagagcattctggggtgggg

SEQ ID NO: 621398 - DNA, 22 bp, Homo sapiens
tagagctcttgggtatgtagaa

SEQ ID NO: 621399 - DNA, 14 bp, Homo sapiens
tagatacacaaaat

SEQ ID NO: 621400 - DNA, 17 bp, Homo sapiens
tagatacacaaaatatt

SEQ ID NO: 621401 - DNA, 22 bp, Homo sapiens
tagatacacaatcgtattacat

SEQ ID NO: 621402 - DNA, 19 bp, Homo sapiens
tagataccattttgaaata

SEQ ID NO: 621403 - DNA, 20 bp, Homo sapiens
tagataccattttgaaatat

SEQ ID NO: 621404 - DNA, 16 bp, Homo sapiens
tagatctagtgccatt

SEQ ID NO: 621405 - DNA, 17 bp, Homo sapiens
tagatgaaaaagcatgt

SEQ ID NO: 621406 - DNA, 21 bp, Homo sapiens
tagatgaaaaagcatgtacag

SEQ ID NO: 621407 - DNA, 15 bp, Homo sapiens
tagatggtagaaact

SEQ ID NO: 621408 - DNA, 17 bp, Homo sapiens
tagattcctacttaaac

SEQ ID NO: 621409 - DNA, 21 bp, Homo sapiens
tagattcctacttaaacaaaa

SEQ ID NO: 621410 - DNA, 18 bp, Homo sapiens
tagattgttttagagtta

SEQ ID NO: 621411 - DNA, 17 bp, Homo sapiens
tagattttcatgttctt

SEQ ID NO: 621412 - DNA, 15 bp, Homo sapiens
tagattttgttttgc

SEQ ID NO: 621413 - DNA, 23 bp, Homo sapiens
tagattttgttttgctttttctg

SEQ ID NO: 621414 - DNA, 17 bp, Homo sapiens
tcccgcagcaccagcct

SEQ ID NO: 621415 - DNA, 13 bp, Homo sapiens
tcccgccgcctcg

SEQ ID NO: 621416 - DNA, 23 bp, Homo sapiens
tcccgccgcctcgggccgcctcc

SEQ ID NO: 621417 - DNA, 18 bp, Homo sapiens
tcccggagctcaggccct

SEQ ID NO: 621418 - DNA, 14 bp, Homo sapiens
tcccggccccgcgc

SEQ ID NO: 621419 - DNA, 22 bp, Homo sapiens
tcccgggtgccccccatgccct

SEQ ID NO: 621420 - DNA, 18 bp, Homo sapiens
tcccgtggctttgtgctt

SEQ ID NO: 621421 - DNA, 14 bp, Homo sapiens
tccctaggcctgag

SEQ ID NO: 621422 - DNA, 13 bp, Homo sapiens
tccctagttcttt

SEQ ID NO: 621423 - DNA, 18 bp, Homo sapiens
tccctcacacctcccttc

SEQ ID NO: 621424 - DNA, 18 bp, Homo sapiens
tccctcagccctcattaa

SEQ ID NO: 621425 - DNA, 14 bp, Homo sapiens
tccctcatgcagat

SEQ ID NO: 621426 - DNA, 15 bp, Homo sapiens
tccctcatgcagata

SEQ ID NO: 621427 - DNA, 12 bp, Homo sapiens
tccctccacacc

SEQ ID NO: 621428 - DNA, 18 bp, Homo sapiens
tccctccacacctccacc

SEQ ID NO: 621429 - DNA, 20 bp, Homo sapiens
tccctccacacctccacccg

SEQ ID NO: 621430 - DNA, 13 bp, Homo sapiens
tccctccctccac

SEQ ID NO: 621431 - DNA, 16 bp, Homo sapiens
tccctccctccacacc

SEQ ID NO: 621432 - DNA, 14 bp, Homo sapiens
tccctcgggctggt

SEQ ID NO: 621433 - DNA, 15 bp, Homo sapiens
tccctcgggctggtg

SEQ ID NO: 621434 - DNA, 16 bp, Homo sapiens
tccctcggtcagcacc

SEQ ID NO: 621435 - DNA, 16 bp, Homo sapiens
tccctgaacatagttt

SEQ ID NO: 621436 - DNA, 14 bp, Homo sapiens
tccctgagggccct

SEQ ID NO: 621437 - DNA, 21 bp, Homo sapiens
tccctgagggcccttcccaac

SEQ ID NO: 621438 - DNA, 21 bp, Homo sapiens
tccctgcatcccttggcccct

SEQ ID NO: 621439 - DNA, 15 bp, Homo sapiens
tccctgcgacggagg

SEQ ID NO: 621440 - DNA, 24 bp, Homo sapiens
tccctgcgacggaggcaggaccag

SEQ ID NO: 621441 - DNA, 18 bp, Homo sapiens
tccctgcgcgcagctggc

SEQ ID NO: 621442 - DNA, 17 bp, Homo sapiens
tccctgctcagcccatc

SEQ ID NO: 621443 - DNA, 17 bp, Homo sapiens
tccctggccacctgcca

SEQ ID NO: 621444 - DNA, 17 bp, Homo sapiens
tccctggggaccaggag

SEQ ID NO: 621445 - DNA, 18 bp, Homo sapiens
tccctggggaccaggagc

SEQ ID NO: 621446 - DNA, 21 bp, Homo sapiens
tccctggggaccaggagctag

SEQ ID NO: 621447 - DNA, 17 bp, Homo sapiens
tccctggggaggacccc

SEQ ID NO: 621448 - DNA, 22 bp, Homo sapiens
tccctggggaggacccctgccc

SEQ ID NO: 621449 - DNA, 13 bp, Homo sapiens
tccctgtcatagt

SEQ ID NO: 621450 - DNA, 15 bp, Homo sapiens
tccctgtgggctcac

SEQ ID NO: 621451 - DNA, 16 bp, Homo sapiens
tccctgtgggctcaca

SEQ ID NO: 621452 - DNA, 14 bp, Homo sapiens
tcccttcacatagt

SEQ ID NO: 621453 - DNA, 13 bp, Homo sapiens
tcccttcatccca

SEQ ID NO: 621454 - DNA, 17 bp, Homo sapiens
tcccttcccattggcct

SEQ ID NO: 621455 - DNA, 14 bp, Homo sapiens
tcccttcctgtcct

SEQ ID NO: 621456 - DNA, 19 bp, Homo sapiens
tcccttcctgtcctgctca

SEQ ID NO: 621457 - DNA, 17 bp, Homo sapiens
tcccttctttccttcct

SEQ ID NO: 621458 - DNA, 21 bp, Homo sapiens
tccctttccccattcagtgac

SEQ ID NO: 621459 - DNA, 12 bp, Homo sapiens
tccgagcccctg

SEQ ID NO: 621460 - DNA, 17 bp, Homo sapiens
tccgagcccctgtttct

SEQ ID NO: 621461 - DNA, 16 bp, Homo sapiens
tccgcacgcggccgct

SEQ ID NO: 621462 - DNA, 20 bp, Homo sapiens
tccgccccccggcctggccc

SEQ ID NO: 621463 - DNA, 17 bp, Homo sapiens
tccgcccgcccaccccg

SEQ ID NO: 621464 - DNA, 22 bp, Homo sapiens
tccggatggaatcacagccaat

SEQ ID NO: 621465 - DNA, 17 bp, Homo sapiens
tccggcagaggcagggc

SEQ ID NO: 621466 - DNA, 19 bp, Homo sapiens
tccggcagaggcagggccc

SEQ ID NO: 621467 - DNA, 21 bp, Homo sapiens
tccggcagaggcagggccctg

SEQ ID NO: 621468 - DNA, 14 bp, Homo sapiens
tccgggactgacct

SEQ ID NO: 621469 - DNA, 14 bp, Homo sapiens
tccgtccccagggt

SEQ ID NO: 621470 - DNA, 12 bp, Homo sapiens
tccgtccgcccg

SEQ ID NO: 621471 - DNA, 18 bp, Homo sapiens
tccgtccgcccgcccacc

SEQ ID NO: 621472 - DNA, 13 bp, Homo sapiens
tccgtctgtcctg

SEQ ID NO: 621473 - DNA, 18 bp, Homo sapiens
tccgtctgtcctgcgcct

SEQ ID NO: 621474 - DNA, 16 bp, Homo sapiens
tccgtgggcagctcct

SEQ ID NO: 621475 - DNA, 12 bp, Homo sapiens
tccgtgtctgtt

SEQ ID NO: 621476 - DNA, 22 bp, Homo sapiens
tccgttcatctgaggagtccaa

SEQ ID NO: 621477 - DNA, 19 bp, Homo sapiens
tcctaacattatattccca

SEQ ID NO: 621478 - DNA, 13 bp, Homo sapiens
tcctatccccgga

SEQ ID NO: 621479 - DNA, 18 bp, Homo sapiens
tcctcaccttctgtttta

SEQ ID NO: 621480 - DNA, 22 bp, Homo sapiens
tcctcatggctgttatctgtct

SEQ ID NO: 621481 - DNA, 14 bp, Homo sapiens
tcctccaaatgctg

SEQ ID NO: 621482 - DNA, 17 bp, Homo sapiens
tcctccaaatgctgtcg

SEQ ID NO: 621483 - DNA, 15 bp, Homo sapiens
tcctccagtacaata

SEQ ID NO: 621484 - DNA, 18 bp, Homo sapiens
tcctccatgctgtccctg

SEQ ID NO: 621485 - DNA, 20 bp, Homo sapiens
tcctccatgctgtccctgtg

SEQ ID NO: 621486 - DNA, 15 bp, Homo sapiens
tcctcccatggcctt

SEQ ID NO: 621487 - DNA, 20 bp, Homo sapiens
tcctcccatggccttccctc

SEQ ID NO: 621488 - DNA, 24 bp, Homo sapiens
tcctcccccaccttcaagcaccct

SEQ ID NO: 621489 - DNA, 15 bp, Homo sapiens
tcctcccccagagcc

SEQ ID NO: 621490 - DNA, 17 bp, Homo sapiens
tcctccccctcctccat

SEQ ID NO: 621491 - DNA, 19 bp, Homo sapiens
tcctccgcggaggcccctg

SEQ ID NO: 621492 - DNA, 20 bp, Homo sapiens
tcctccgcggaggcccctga

SEQ ID NO: 621493 - DNA, 16 bp, Homo sapiens
tcctccgtgggcagct

SEQ ID NO: 621494 - DNA, 11 bp, Homo sapiens
tcctcctgcat

SEQ ID NO: 621495 - DNA, 19 bp, Homo sapiens
tcctcctgtctcctctgtc

SEQ ID NO: 621496 - DNA, 18 bp, Homo sapiens
tcctcgggcgcctgcgct

SEQ ID NO: 621497 - DNA, 14 bp, Homo sapiens
tcctcggtggcatt

SEQ ID NO: 621498 - DNA, 20 bp, Homo sapiens
tcctcggtggcatttgctga

SEQ ID NO: 621499 - DNA, 19 bp, Homo sapiens
tcctcgtccggcctgcagc

SEQ ID NO: 621500 - DNA, 13 bp, Homo sapiens
tcctctcctctct

SEQ ID NO: 621501 - DNA, 16 bp, Homo sapiens
tcctctctctccctcc

SEQ ID NO: 621502 - DNA, 19 bp, Homo sapiens
tcctctctctccctccact

SEQ ID NO: 621503 - DNA, 17 bp, Homo sapiens
tcctctgcagcctgagc

SEQ ID NO: 621504 - DNA, 15 bp, Homo sapiens
tcctctgccccctcc

SEQ ID NO: 621505 - DNA, 18 bp, Homo sapiens
tcctctgccccctccccc

SEQ ID NO: 621506 - DNA, 19 bp, Homo sapiens
tcctctgccccctcccccg

SEQ ID NO: 621507 - DNA, 21 bp, Homo sapiens
tcctctgccccctcccccgca

SEQ ID NO: 621508 - DNA, 18 bp, Homo sapiens
tcctctgtcagtttgtga

SEQ ID NO: 621509 - DNA, 12 bp, Homo sapiens
tcctcttacctg

SEQ ID NO: 621510 - DNA, 14 bp, Homo sapiens
tcctcttacctgta

SEQ ID NO: 621511 - DNA, 20 bp, Homo sapiens
tcctcttatatgtgcccctt

SEQ ID NO: 621512 - DNA, 18 bp, Homo sapiens
tcctgagccagatttcac

SEQ ID NO: 621513 - DNA, 14 bp, Homo sapiens
tcctgagcctgtct

SEQ ID NO: 621514 - DNA, 13 bp, Homo sapiens
tcctgatgtcttg

SEQ ID NO: 621515 - DNA, 16 bp, Homo sapiens
tcctgcaccctctgct

SEQ ID NO: 621516 - DNA, 17 bp, Homo sapiens
tcctgcactgtcccgga

SEQ ID NO: 621517 - DNA, 14 bp, Homo sapiens
tcctgcatgtatgc

SEQ ID NO: 621518 - DNA, 22 bp, Homo sapiens
tcctgcatgtcggggcccctgc

SEQ ID NO: 621519 - DNA, 15 bp, Homo sapiens
tcctgctcctcaccc

SEQ ID NO: 621520 - DNA, 14 bp, Homo sapiens
tcctgctcgccctg

SEQ ID NO: 621521 - DNA, 18 bp, Homo sapiens
tcgtggaagaagggccac

SEQ ID NO: 621522 - DNA, 14 bp, Homo sapiens
tcgtggattgtttt

SEQ ID NO: 621523 - DNA, 16 bp, Homo sapiens
tcgtgtgcttagaaac

SEQ ID NO: 621524 - DNA, 19 bp, Homo sapiens
tcgttctgtttacatcagt

SEQ ID NO: 621525 - DNA, 21 bp, Homo sapiens
tcgttctgtttacatcagttt

SEQ ID NO: 621526 - DNA, 19 bp, Homo sapiens
tcgttgatgctaataaata

SEQ ID NO: 621527 - DNA, 19 bp, Homo sapiens
tctaaaacattaattgagg

SEQ ID NO: 621528 - DNA, 21 bp, Homo sapiens
tctaaaactaaatagcatgta

SEQ ID NO: 621529 - DNA, 18 bp, Homo sapiens
tctaaaccatgaaaagtt

SEQ ID NO: 621530 - DNA, 22 bp, Homo sapiens
tctaaatcactttaatttagaa

SEQ ID NO: 621531 - DNA, 19 bp, Homo sapiens
tctaactccttgaggtctt

SEQ ID NO: 621532 - DNA, 15 bp, Homo sapiens
tctaatgtattttat

SEQ ID NO: 621533 - DNA, 24 bp, Homo sapiens
tctaatgtattttattgtaacaga

SEQ ID NO: 621534 - DNA, 18 bp, Homo sapiens
tctacaaacttttataaa

SEQ ID NO: 621535 - DNA, 19 bp, Homo sapiens
tctacaaacttttataaat

SEQ ID NO: 621536 - DNA, 20 bp, Homo sapiens
tctactccatggtgaactga

SEQ ID NO: 621537 - DNA, 21 bp, Homo sapiens
tctagaaataaaatcaccctg

SEQ ID NO: 621538 - DNA, 13 bp, Homo sapiens
tctagaaggggcg

SEQ ID NO: 621539 - DNA, 16 bp, Homo sapiens
tctagagctatgcaca

SEQ ID NO: 621540 - DNA, 19 bp, Homo sapiens
tctagagctatgcacacca

SEQ ID NO: 621541 - DNA, 20 bp, Homo sapiens
tctagagctatgcacaccaa

SEQ ID NO: 621542 - DNA, 21 bp, Homo sapiens
tctagtaggtctgcacacata

SEQ ID NO: 621543 - DNA, 22 bp, Homo sapiens
tctagttgtggacttttcccca

SEQ ID NO: 621544 - DNA, 16 bp, Homo sapiens
tctataagagacaaag

SEQ ID NO: 621545 - DNA, 14 bp, Homo sapiens
tctatgattaaact

SEQ ID NO: 621546 - DNA, 23 bp, Homo sapiens
tctatgctgtgtgcagagtatac

SEQ ID NO: 621547 - DNA, 18 bp, Homo sapiens
tctattagcttactgatt

SEQ ID NO: 621548 - DNA, 15 bp, Homo sapiens
tctattatctgggtt

SEQ ID NO: 621549 - DNA, 16 bp, Homo sapiens
tctattatctgggttt

SEQ ID NO: 621550 - DNA, 21 bp, Homo sapiens
tctattatctgggttttagaa

SEQ ID NO: 621551 - DNA, 16 bp, Homo sapiens
tctatttatctgtctg

SEQ ID NO: 621552 - DNA, 18 bp, Homo sapiens
tctcaaaataaaaccaga

SEQ ID NO: 621553 - DNA, 18 bp, Homo sapiens
tctcaaaatgtgccgtct

SEQ ID NO: 621554 - DNA, 13 bp, Homo sapiens
tctcaacacacag

SEQ ID NO: 621555 - DNA, 15 bp, Homo sapiens
tctcaacacacagta

SEQ ID NO: 621556 - DNA, 14 bp, Homo sapiens
tctcacccagcctg

SEQ ID NO: 621557 - DNA, 20 bp, Homo sapiens
tctcagaagtgaaaaagact

SEQ ID NO: 621558 - DNA, 14 bp, Homo sapiens
tctcagatccctcg

SEQ ID NO: 621559 - DNA, 16 bp, Homo sapiens
tctcagcatatatata

SEQ ID NO: 621560 - DNA, 23 bp, Homo sapiens
tctcagcatatatataaaataca

SEQ ID NO: 621561 - DNA, 17 bp, Homo sapiens
tctcagcccctcagaga

SEQ ID NO: 621562 - DNA, 13 bp, Homo sapiens
tctcagctccact

SEQ ID NO: 621563 - DNA, 19 bp, Homo sapiens
tctcagtatcttaaaattg

SEQ ID NO: 621564 - DNA, 21 bp, Homo sapiens
tctcatctgtaaaaccaggct

SEQ ID NO: 621565 - DNA, 21 bp, Homo sapiens
tctcatgcatagacaagtgtt

SEQ ID NO: 621566 - DNA, 23 bp, Homo sapiens
tctcatggtattatctagtaggt

SEQ ID NO: 621567 - DNA, 16 bp, Homo sapiens
tctccacaacctcctc

SEQ ID NO: 621568 - DNA, 14 bp, Homo sapiens
tctccacccctcaa

SEQ ID NO: 621569 - DNA, 16 bp, Homo sapiens
tctccacccctcaagc

SEQ ID NO: 621570 - DNA, 22 bp, Homo sapiens
tctccacccctcaagccaggag

SEQ ID NO: 621571 - DNA, 14 bp, Homo sapiens
tctccaccctgagc

SEQ ID NO: 621572 - DNA, 21 bp, Homo sapiens
tctccagcccatgctggctgg

SEQ ID NO: 621573 - DNA, 12 bp, Homo sapiens
tctccagctgat

SEQ ID NO: 621574 - DNA, 17 bp, Homo sapiens
tctccattcttttaaat

SEQ ID NO: 621575 - DNA, 14 bp, Homo sapiens
tctccccctcagct

SEQ ID NO: 621576 - DNA, 19 bp, Homo sapiens
tctcccctccagaccccta

SEQ ID NO: 621577 - DNA, 20 bp, Homo sapiens
tctccctaccctcttctcag

SEQ ID NO: 621578 - DNA, 22 bp, Homo sapiens
tctccctaccctcttctcagct

SEQ ID NO: 621579 - DNA, 21 bp, Homo sapiens
tctccctcacacctcccttca

SEQ ID NO: 621580 - DNA, 15 bp, Homo sapiens
tctccctccactcct

SEQ ID NO: 621581 - DNA, 19 bp, Homo sapiens
tctccctcccttctttcct

SEQ ID NO: 621582 - DNA, 20 bp, Homo sapiens
tctccctcccttctttcctt

SEQ ID NO: 621583 - DNA, 17 bp, Homo sapiens
tctccctgggcaccctg

SEQ ID NO: 621584 - DNA, 18 bp, Homo sapiens
tctccctgggcaccctgc

SEQ ID NO: 621585 - DNA, 22 bp, Homo sapiens
tctccgccccccggcctggccc

SEQ ID NO: 621586 - DNA, 20 bp, Homo sapiens
tctccggatggaatcacagc

SEQ ID NO: 621587 - DNA, 23 bp, Homo sapiens
tctccggatggaatcacagccaa

SEQ ID NO: 621588 - DNA, 16 bp, Homo sapiens
tctcctccaaatgctg

SEQ ID NO: 621589 - DNA, 16 bp, Homo sapiens
tctcctcccatggcct

SEQ ID NO: 621590 - DNA, 22 bp, Homo sapiens
tctcctcggtggcatttgctga

SEQ ID NO: 621591 - DNA, 23 bp, Homo sapiens
tctcctcggtggcatttgctgaa

SEQ ID NO: 621592 - DNA, 17 bp, Homo sapiens
tctcctcgtccggcctg

SEQ ID NO: 621593 - DNA, 18 bp, Homo sapiens
tctcctcgtccggcctgc

SEQ ID NO: 621594 - DNA, 20 bp, Homo sapiens
tctcctcgtccggcctgcag

SEQ ID NO: 621595 - DNA, 18 bp, Homo sapiens
tctcctctcccaaataaa

SEQ ID NO: 621596 - DNA, 22 bp, Homo sapiens
tctcctctctctccctccactc

SEQ ID NO: 621597 - DNA, 16 bp, Homo sapiens
tctcctgagcctgtct

SEQ ID NO: 621598 - DNA, 14 bp, Homo sapiens
tctcctgtatcatt

SEQ ID NO: 621599 - DNA, 15 bp, Homo sapiens
tctccttaaccccca

SEQ ID NO: 621600 - DNA, 16 bp, Homo sapiens
tctccttaacccccat

SEQ ID NO: 621601 - DNA, 23 bp, Homo sapiens
tctccttggtgtcgggcatgaca

SEQ ID NO: 621602 - DNA, 23 bp, Homo sapiens
tctcctttaatatactccttaaa

SEQ ID NO: 621603 - DNA, 18 bp, Homo sapiens
tctcgcagcctgaagcct

SEQ ID NO: 621604 - DNA, 22 bp, Homo sapiens
tctcgcagcctgaagcctggat

SEQ ID NO: 621605 - DNA, 15 bp, Homo sapiens
tctcgtagaacctgc

SEQ ID NO: 621606 - DNA, 23 bp, Homo sapiens
tctcgtagaacctgcgcaccccg

SEQ ID NO: 621607 - DNA, 13 bp, Homo sapiens
tctctaagaattc

SEQ ID NO: 621608 - DNA, 15 bp, Homo sapiens
tctctatttgatttg

SEQ ID NO: 621609 - DNA, 23 bp, Homo sapiens
tctctccctaccctcttctcagc

SEQ ID NO: 621610 - DNA, 13 bp, Homo sapiens
tctctccctccac

SEQ ID NO: 621611 - DNA, 16 bp, Homo sapiens
tctctccctccactcc

SEQ ID NO: 621612 - DNA, 20 bp, Homo sapiens
tctctccctccactcctccc

SEQ ID NO: 621613 - DNA, 17 bp, Homo sapiens
tctctcctctctctccc

SEQ ID NO: 621614 - DNA, 13 bp, Homo sapiens
tctctctccctcc

SEQ ID NO: 621615 - DNA, 14 bp, Homo sapiens
tctctctccctcca

SEQ ID NO: 621616 - DNA, 12 bp, Homo sapiens
tctctctctctg

SEQ ID NO: 621617 - DNA, 11 bp, Homo sapiens
tctctctctgt

SEQ ID NO: 621618 - DNA, 12 bp, Homo sapiens
tctctctctgtt

SEQ ID NO: 621619 - DNA, 14 bp, Homo sapiens
tctctcttggtctc

SEQ ID NO: 621620 - DNA, 19 bp, Homo sapiens
tctctctttcttttgtgca

SEQ ID NO: 621621 - DNA, 19 bp, Homo sapiens
tctctgaactgcaacactg

SEQ ID NO: 621622 - DNA, 15 bp, Homo sapiens
tctctgagcagtggg

SEQ ID NO: 621623 - DNA, 17 bp, Homo sapiens
tctctggggtctgtgat

SEQ ID NO: 621624 - DNA, 14 bp, Homo sapiens
tctctgttccaagt

SEQ ID NO: 621625 - DNA, 16 bp, Homo sapiens
tctctgttccaagtgt

SEQ ID NO: 621626 - DNA, 22 bp, Homo sapiens
tctctgttccaagtgtgtgtgc

SEQ ID NO: 621627 - DNA, 17 bp, Homo sapiens
tctctgtttaccctccc

SEQ ID NO: 621628 - DNA, 14 bp, Homo sapiens
tctcttaccccgtc

SEQ ID NO: 621629 - DNA, 20 bp, Homo sapiens
tctcttaccccgtccctttc

SEQ ID NO: 621630 - DNA, 19 bp, Homo sapiens
tctcttcatgcgcagtccc

SEQ ID NO: 621631 - DNA, 17 bp, Homo sapiens
tctgaacccttccacca

SEQ ID NO: 621632 - DNA, 19 bp, Homo sapiens
tctgaagtcccttcctgtc

SEQ ID NO: 621633 - DNA, 15 bp, Homo sapiens
tctgaatctctcaaa

SEQ ID NO: 621634 - DNA, 19 bp, Homo sapiens
tctgaatctctcaaaatgt

SEQ ID NO: 621635 - DNA, 20 bp, Homo sapiens
tctgaatctctcaaaatgtg

SEQ ID NO: 621636 - DNA, 20 bp, Homo sapiens
tctgaatttctaaaaccctt

SEQ ID NO: 621637 - DNA, 23 bp, Homo sapiens
tctgacaccctttaatgttctat

SEQ ID NO: 621638 - DNA, 15 bp, Homo sapiens
aggagattgctctgg

SEQ ID NO: 621639 - DNA, 15 bp, Homo sapiens
aggagcacagccata

SEQ ID NO: 621640 - DNA, 20 bp, Homo sapiens
aggagcactagaatgagaaa

SEQ ID NO: 621641 - DNA, 20 bp, Homo sapiens
aggagcatgtcctatccctg

SEQ ID NO: 621642 - DNA, 13 bp, Homo sapiens
aggagccttgctg

SEQ ID NO: 621643 - DNA, 19 bp, Homo sapiens
aggagccttgctgggccag

SEQ ID NO: 621644 - DNA, 14 bp, Homo sapiens
aggagcgtgtccta

SEQ ID NO: 621645 - DNA, 14 bp, Homo sapiens
aggagcttccagtg

SEQ ID NO: 621646 - DNA, 23 bp, Homo sapiens
aggagcttccagtgcatgttgcc

SEQ ID NO: 621647 - DNA, 17 bp, Homo sapiens
aggaggacacagcacaa

SEQ ID NO: 621648 - DNA, 19 bp, Homo sapiens
aggaggacacagcacaagg

SEQ ID NO: 621649 - DNA, 19 bp, Homo sapiens
aggaggacagagtgccctg

SEQ ID NO: 621650 - DNA, 14 bp, Homo sapiens
tgcctgtcaagttt

SEQ ID NO: 621651 - DNA, 20 bp, Homo sapiens
tgcctgtggtgaggtcctgt

SEQ ID NO: 621652 - DNA, 16 bp, Homo sapiens
tgccttatggaacact

SEQ ID NO: 621653 - DNA, 18 bp, Homo sapiens
tgccttatggaacactct

SEQ ID NO: 621654 - DNA, 20 bp, Homo sapiens
tgccttatggaacactctga

SEQ ID NO: 621655 - DNA, 21 bp, Homo sapiens
tgccttatggaacactctgag

SEQ ID NO: 621656 - DNA, 13 bp, Homo sapiens
tgccttcagccct

SEQ ID NO: 621657 - DNA, 16 bp, Homo sapiens
tgccttcataaattat

SEQ ID NO: 621658 - DNA, 20 bp, Homo sapiens
tgccttctggggagggacac

SEQ ID NO: 621659 - DNA, 17 bp, Homo sapiens
tgccttgatgtttctat

SEQ ID NO: 621660 - DNA, 16 bp, Homo sapiens
tgccttgggcgggcca

SEQ ID NO: 621661 - DNA, 21 bp, Homo sapiens
tgcgaacacagtgacacgttt

SEQ ID NO: 621662 - DNA, 14 bp, Homo sapiens
tgcgaccatgtgta

SEQ ID NO: 621663 - DNA, 12 bp, Homo sapiens
tgcgccccagcg

SEQ ID NO: 621664 - DNA, 14 bp, Homo sapiens
tgcgcccctgccca

SEQ ID NO: 621665 - DNA, 16 bp, Homo sapiens
tgcgcccctgcccagc

SEQ ID NO: 621666 - DNA, 19 bp, Homo sapiens
tgcgccctccctccctcca

SEQ ID NO: 621667 - DNA, 20 bp, Homo sapiens
tgcgccctccctccctccac

SEQ ID NO: 621668 - DNA, 21 bp, Homo sapiens
tgcgccctccctccctccaca

SEQ ID NO: 621669 - DNA, 12 bp, Homo sapiens
tgcgcctcctcc

SEQ ID NO: 621670 - DNA, 11 bp, Homo sapiens
aaaagcacttt

SEQ ID NO: 621671 - DNA, 18 bp, Homo sapiens
aaaagcatgtacagtgtt

SEQ ID NO: 621672 - DNA, 15 bp, Homo sapiens
aaaagcattaaaaat

SEQ ID NO: 621673 - DNA, 14 bp, Homo sapiens
aaaaggtacaatgc

SEQ ID NO: 621674 - DNA, 17 bp, Homo sapiens
aaaagtgatgtgattta

SEQ ID NO: 621675 - DNA, 15 bp, Homo sapiens
aaaagtgcaacttga

SEQ ID NO: 621676 - DNA, 17 bp, Homo sapiens
aaaagtgtttttacata

SEQ ID NO: 621677 - DNA, 20 bp, Homo sapiens
aaaagtgtttttacatatag

SEQ ID NO: 621678 - DNA, 22 bp, Homo sapiens
aaaagttttcaagcattgctaa

SEQ ID NO: 621679 - DNA, 22 bp, Homo sapiens
aaaataagccaaaataagacta

SEQ ID NO: 621680 - DNA, 19 bp, Homo sapiens
aaaatacacgtgtatatga

SEQ ID NO: 621681 - DNA, 12 bp, Homo sapiens
aaaatacttatt

SEQ ID NO: 621682 - DNA, 12 bp, Homo sapiens
aaaatacttctt

SEQ ID NO: 621683 - DNA, 21 bp, Homo sapiens
aaaatagtcatgtttctgcag

SEQ ID NO: 621684 - DNA, 22 bp, Homo sapiens
aaaatagtcatgtttctgcagt

SEQ ID NO: 621685 - DNA, 11 bp, Homo sapiens
aaaatatatgt

SEQ ID NO: 621686 - DNA, 13 bp, Homo sapiens
aaaatatattgaa

SEQ ID NO: 621687 - DNA, 18 bp, Homo sapiens
aaaatcaaatttttctgg

SEQ ID NO: 621688 - DNA, 16 bp, Homo sapiens
aaaatcaccctgactg

SEQ ID NO: 621689 - DNA, 16 bp, Homo sapiens
aaaatcagaaagacat

SEQ ID NO: 621690 - DNA, 18 bp, Homo sapiens
aaaatccttgccttcaaa

SEQ ID NO: 621691 - DNA, 13 bp, Homo sapiens
aaaatctgaattt

SEQ ID NO: 621692 - DNA, 18 bp, Homo sapiens
aaaatcttgaaagcgaaa

SEQ ID NO: 621693 - DNA, 15 bp, Homo sapiens
aaaatgaattgcctt

SEQ ID NO: 621694 - DNA, 13 bp, Homo sapiens
aaaatgctttctc

SEQ ID NO: 621695 - DNA, 14 bp, Homo sapiens
aaaatgctttctca

SEQ ID NO: 621696 - DNA, 15 bp, Homo sapiens
aaaatgctttctcat

SEQ ID NO: 621697 - DNA, 17 bp, Homo sapiens
aaaatgctttctcatgc

SEQ ID NO: 621698 - DNA, 17 bp, Homo sapiens
aaaatggcatttagcac

SEQ ID NO: 621699 - DNA, 18 bp, Homo sapiens
aaaatggcatttagcaca

SEQ ID NO: 621700 - DNA, 16 bp, Homo sapiens
aaaatggctgaagaaa

SEQ ID NO: 621701 - DNA, 14 bp, Homo sapiens
aaaatgtgtttttc

SEQ ID NO: 621702 - DNA, 14 bp, Homo sapiens
aaaatgttctgaca

SEQ ID NO: 621703 - DNA, 16 bp, Homo sapiens
aaaattaattgaaata

SEQ ID NO: 621704 - DNA, 22 bp, Homo sapiens
aaaattgaagagagatatatct

SEQ ID NO: 621705 - DNA, 23 bp, Homo sapiens
aaaatttatgtcattttcagatc

SEQ ID NO: 621706 - DNA, 19 bp, Homo sapiens
aaaattttattgaatataa

SEQ ID NO: 621707 - DNA, 16 bp, Homo sapiens
aaaattttcttcttta

SEQ ID NO: 621708 - DNA, 17 bp, Homo sapiens
aaaatttttgtctttca

SEQ ID NO: 621709 - DNA, 17 bp, Homo sapiens
aaacaaaaactttccat

SEQ ID NO: 621710 - DNA, 18 bp, Homo sapiens
aaacaaaaactttccatg

SEQ ID NO: 621711 - DNA, 23 bp, Homo sapiens
aaacaaaaactttccatgacagt

SEQ ID NO: 621712 - DNA, 13 bp, Homo sapiens
aaacaaatatact

SEQ ID NO: 621713 - DNA, 18 bp, Homo sapiens
aaacaaatatactcattt

SEQ ID NO: 621714 - DNA, 14 bp, Homo sapiens
aaacaaatcatttt

SEQ ID NO: 621715 - DNA, 19 bp, Homo sapiens
aaacaaatcattttgatgt

SEQ ID NO: 621716 - DNA, 21 bp, Homo sapiens
aaacaactttctggaaaaaca

SEQ ID NO: 621717 - DNA, 21 bp, Homo sapiens
aaacaagagaccacttcctta

SEQ ID NO: 621718 - DNA, 21 bp, Homo sapiens
aaacacagcatgcatttagca

SEQ ID NO: 621719 - DNA, 16 bp, Homo sapiens
aaacacttctccttaa

SEQ ID NO: 621720 - DNA, 18 bp, Homo sapiens
aaacacttctccttaacc

SEQ ID NO: 621721 - DNA, 13 bp, Homo sapiens
aatgacctttcaa

SEQ ID NO: 621722 - DNA, 15 bp, Homo sapiens
aatgacctttcaata

SEQ ID NO: 621723 - DNA, 16 bp, Homo sapiens
aatgacctttcaatag

SEQ ID NO: 621724 - DNA, 17 bp, Homo sapiens
aatgacctttcaatagg

SEQ ID NO: 621725 - DNA, 21 bp, Homo sapiens
aatgacctttcaataggaaaa

SEQ ID NO: 621726 - DNA, 14 bp, Homo sapiens
aatgagaaattgtg

SEQ ID NO: 621727 - DNA, 22 bp, Homo sapiens
aatgagccaataaagctcacac

SEQ ID NO: 621728 - DNA, 20 bp, Homo sapiens
aatgagggcgtgaaacacaa

SEQ ID NO: 621729 - DNA, 18 bp, Homo sapiens
aatgagtgataaatttgg

SEQ ID NO: 621730 - DNA, 14 bp, Homo sapiens
aatgagttcccttg

SEQ ID NO: 621731 - DNA, 20 bp, Homo sapiens
aatgatgattcaatcatttt

SEQ ID NO: 621732 - DNA, 14 bp, Homo sapiens
aatgattcaatgtg

SEQ ID NO: 621733 - DNA, 16 bp, Homo sapiens
aatgattcaatgtgaa

SEQ ID NO: 621734 - DNA, 17 bp, Homo sapiens
aatgattcaatgtgaat

SEQ ID NO: 621735 - DNA, 19 bp, Homo sapiens
aatgattcacttttattgt

SEQ ID NO: 621736 - DNA, 16 bp, Homo sapiens
aatgattcttgtgtca

SEQ ID NO: 621737 - DNA, 12 bp, Homo sapiens
aatgcaaaccat

SEQ ID NO: 621738 - DNA, 16 bp, Homo sapiens
aatgcctaataaacaa

SEQ ID NO: 621739 - DNA, 20 bp, Homo sapiens
aatgctacaaaatgtgtgct

SEQ ID NO: 621740 - DNA, 11 bp, Homo sapiens
aatgctatttg

SEQ ID NO: 621741 - DNA, 20 bp, Homo sapiens
aatgctatttgtgtaactga

SEQ ID NO: 621742 - DNA, 18 bp, Homo sapiens
aatgcttaacataaactt

SEQ ID NO: 621743 - DNA, 18 bp, Homo sapiens
aatgcttgaccctgaaat

SEQ ID NO: 621744 - DNA, 12 bp, Homo sapiens
aatgctttctca

SEQ ID NO: 621745 - DNA, 21 bp, Homo sapiens
aatgctttctcatgcatagac

SEQ ID NO: 621746 - DNA, 18 bp, Homo sapiens
aatgctttgaaaatgttt

SEQ ID NO: 621747 - DNA, 17 bp, Homo sapiens
aatggatatgaaagaga

SEQ ID NO: 621748 - DNA, 19 bp, Homo sapiens
aatggatatgaaagagaaa

SEQ ID NO: 621749 - DNA, 14 bp, Homo sapiens
aatggatgtaatat

SEQ ID NO: 621750 - DNA, 16 bp, Homo sapiens
aatggcatttagcaca

SEQ ID NO: 621751 - DNA, 17 bp, Homo sapiens
aatggcatttagcacag

SEQ ID NO: 621752 - DNA, 18 bp, Homo sapiens
aatggcatttagcacagt

SEQ ID NO: 621753 - DNA, 18 bp, Homo sapiens
aatggccaagtgtacatt

SEQ ID NO: 621754 - DNA, 14 bp, Homo sapiens
aatggcctcttaaa

SEQ ID NO: 621755 - DNA, 15 bp, Homo sapiens
aatggcctcttaaaa

SEQ ID NO: 621756 - DNA, 16 bp, Homo sapiens
aatggcctcttaaaaa

SEQ ID NO: 621757 - DNA, 13 bp, Homo sapiens
aatggctgaagaa

SEQ ID NO: 621758 - DNA, 17 bp, Homo sapiens
aatggctgaagaaacac

SEQ ID NO: 621759 - DNA, 18 bp, Homo sapiens
aatggggggcgggccagg

SEQ ID NO: 621760 - DNA, 23 bp, Homo sapiens
aatggttctttatcatttctctt

SEQ ID NO: 621761 - DNA, 13 bp, Homo sapiens
aatgtactgtatt

SEQ ID NO: 621762 - DNA, 17 bp, Homo sapiens
aatgtagggcagaatag

SEQ ID NO: 621763 - DNA, 16 bp, Homo sapiens
aatgtattttattgta

SEQ ID NO: 621764 - DNA, 23 bp, Homo sapiens
aatgtattttattgtaacagaca

SEQ ID NO: 621765 - DNA, 16 bp, Homo sapiens
aatgtcatttcataca

SEQ ID NO: 621766 - DNA, 17 bp, Homo sapiens
aatgtccaggtcacagg

SEQ ID NO: 621767 - DNA, 20 bp, Homo sapiens
aatgtctgtccctaaacata

SEQ ID NO: 621768 - DNA, 14 bp, Homo sapiens
aatgtcttcatgtt

SEQ ID NO: 621769 - DNA, 14 bp, Homo sapiens
aatgtgaattttaa

SEQ ID NO: 621770 - DNA, 12 bp, Homo sapiens
aatgtgccaaaa

SEQ ID NO: 621771 - DNA, 14 bp, Homo sapiens
aatgtgctgttgat

SEQ ID NO: 621772 - DNA, 23 bp, Homo sapiens
aaatatattgaagtaagttcatc

SEQ ID NO: 621773 - DNA, 12 bp, Homo sapiens
aaatatctgtga

SEQ ID NO: 621774 - DNA, 21 bp, Homo sapiens
aaatatgattctcctctccca

SEQ ID NO: 621775 - DNA, 12 bp, Homo sapiens
aaatattctgtc

SEQ ID NO: 621776 - DNA, 14 bp, Homo sapiens
aaatattctgtcat

SEQ ID NO: 621777 - DNA, 21 bp, Homo sapiens
aaatattgctgtctgaaaaag

SEQ ID NO: 621778 - DNA, 16 bp, Homo sapiens
aaatattttctacttt

SEQ ID NO: 621779 - DNA, 14 bp, Homo sapiens
aaatattttcttaa

SEQ ID NO: 621780 - DNA, 20 bp, Homo sapiens
aaatattttcttaattatgg

SEQ ID NO: 621781 - DNA, 15 bp, Homo sapiens
aaatcaaatttttct

SEQ ID NO: 621782 - DNA, 14 bp, Homo sapiens
aaatcaatttaaag

SEQ ID NO: 621783 - DNA, 21 bp, Homo sapiens
aaatcacagatttccaaaagt

SEQ ID NO: 621784 - DNA, 12 bp, Homo sapiens
aaatcattttga

SEQ ID NO: 621785 - DNA, 16 bp, Homo sapiens
aaatcattttgatgta

SEQ ID NO: 621786 - DNA, 17 bp, Homo sapiens
aaatcattttgatgtat

SEQ ID NO: 621787 - DNA, 21 bp, Homo sapiens
aaatccaatagtctgccacaa

SEQ ID NO: 621788 - DNA, 17 bp, Homo sapiens
aaatccttgccttcaaa

SEQ ID NO: 621789 - DNA, 18 bp, Homo sapiens
aaatctacaaacttttat

SEQ ID NO: 621790 - DNA, 20 bp, Homo sapiens
aaatctacaacataatgata

SEQ ID NO: 621791 - DNA, 19 bp, Homo sapiens
aaatcttacccttcaatgt

SEQ ID NO: 621792 - DNA, 21 bp, Homo sapiens
aaatcttacccttcaatgtta

SEQ ID NO: 621793 - DNA, 21 bp, Homo sapiens
aaatctttgttaaaatatagt

SEQ ID NO: 621794 - DNA, 17 bp, Homo sapiens
aaatgaaatacttgaca

SEQ ID NO: 621795 - DNA, 15 bp, Homo sapiens
aaatgaaatttaagc

SEQ ID NO: 621796 - DNA, 23 bp, Homo sapiens
aaatgaatgaaatataaactgtg

SEQ ID NO: 621797 - DNA, 12 bp, Homo sapiens
aaatgaatgtgt

SEQ ID NO: 621798 - DNA, 15 bp, Homo sapiens
aaatgaatgtgtgtg

SEQ ID NO: 621799 - DNA, 14 bp, Homo sapiens
aaatgagaaattgt

SEQ ID NO: 621800 - DNA, 17 bp, Homo sapiens
aaatgatatgtctttaa

SEQ ID NO: 621801 - DNA, 19 bp, Homo sapiens
aaatgatatgtctttaaaa

SEQ ID NO: 621802 - DNA, 15 bp, Homo sapiens
aaatgcctaataaac

SEQ ID NO: 621803 - DNA, 12 bp, Homo sapiens
aaatgctttctc

SEQ ID NO: 621804 - DNA, 18 bp, Homo sapiens
aaatgctttctcatgcat

SEQ ID NO: 621805 - DNA, 18 bp, Homo sapiens
aaatggaggaaaccacaa

SEQ ID NO: 621806 - DNA, 17 bp, Homo sapiens
aaatggatagattgttt

SEQ ID NO: 621807 - DNA, 16 bp, Homo sapiens
aaatggcatttagcac

SEQ ID NO: 621808 - DNA, 23 bp, Homo sapiens
aaatggctgaagaaacacagcat

SEQ ID NO: 621809 - DNA, 20 bp, Homo sapiens
aaatggcttgttcagtcact

SEQ ID NO: 621810 - DNA, 14 bp, Homo sapiens
aaatggctttccac

SEQ ID NO: 621811 - DNA, 14 bp, Homo sapiens
aaatgggaaaatat

SEQ ID NO: 621812 - DNA, 15 bp, Homo sapiens
aaatggtattttttg

SEQ ID NO: 621813 - DNA, 20 bp, Homo sapiens
aaatggtattttttgtgaat

SEQ ID NO: 621814 - DNA, 14 bp, Homo sapiens
aaatgtcatttcat

SEQ ID NO: 621815 - DNA, 15 bp, Homo sapiens
aaatgtcatttcata

SEQ ID NO: 621816 - DNA, 17 bp, Homo sapiens
aaatgtcatttcataca

SEQ ID NO: 621817 - DNA, 14 bp, Homo sapiens
aaatgtgtttttca

SEQ ID NO: 621818 - DNA, 17 bp, Homo sapiens
aaatgttttaaagaagt

SEQ ID NO: 621819 - DNA, 16 bp, Homo sapiens
aaattaattggcagca

SEQ ID NO: 621820 - DNA, 21 bp, Homo sapiens
aaattaattggcagcagattt

SEQ ID NO: 621821 - DNA, 18 bp, Homo sapiens
aaattagggctctaattt

SEQ ID NO: 621822 - DNA, 16 bp, Homo sapiens
aaattagtattttgag

SEQ ID NO: 621823 - DNA, 20 bp, Homo sapiens
aaattagtattttgagcctt

SEQ ID NO: 621824 - DNA, 12 bp, Homo sapiens
aaattagtgttt

SEQ ID NO: 621825 - DNA, 13 bp, Homo sapiens
aaattagtgtttt

SEQ ID NO: 621826 - DNA, 18 bp, Homo sapiens
aaattataatgcatctaa

SEQ ID NO: 621827 - DNA, 13 bp, Homo sapiens
aaattatctttaa

SEQ ID NO: 621828 - DNA, 15 bp, Homo sapiens
aaattatctttaaaa

SEQ ID NO: 621829 - DNA, 19 bp, Homo sapiens
aaattatgtcaaatggatg

SEQ ID NO: 621830 - DNA, 13 bp, Homo sapiens
aaattattaaaaa

SEQ ID NO: 621831 - DNA, 17 bp, Homo sapiens
aaattcagtggacattt

SEQ ID NO: 621832 - DNA, 22 bp, Homo sapiens
aaattcagtggacatttgttct

SEQ ID NO: 621833 - DNA, 15 bp, Homo sapiens
aaattctataagaga

SEQ ID NO: 621834 - DNA, 21 bp, Homo sapiens
aactcatacagtctctatttg

SEQ ID NO: 621835 - DNA, 22 bp, Homo sapiens
aactccagggttaaagaaaggc

SEQ ID NO: 621836 - DNA, 18 bp, Homo sapiens
aactcgggattacagaaa

SEQ ID NO: 621837 - DNA, 18 bp, Homo sapiens
aactcgggcactccctaa

SEQ ID NO: 621838 - DNA, 19 bp, Homo sapiens
aactcgggcactccctaag

SEQ ID NO: 621839 - DNA, 10 bp, Homo sapiens
aactctggcc

SEQ ID NO: 621840 - DNA, 13 bp, Homo sapiens
aactctttcccca

SEQ ID NO: 621841 - DNA, 15 bp, Homo sapiens
aactgaagcagagtc

SEQ ID NO: 621842 - DNA, 14 bp, Homo sapiens
aactgatgctttca

SEQ ID NO: 621843 - DNA, 16 bp, Homo sapiens
aactggaaacatctga

SEQ ID NO: 621844 - DNA, 14 bp, Homo sapiens
aactgtactgtgtt

SEQ ID NO: 621845 - DNA, 16 bp, Homo sapiens
aactgtatttacttgt

SEQ ID NO: 621846 - DNA, 17 bp, Homo sapiens
aactgtatttacttgtt

SEQ ID NO: 621847 - DNA, 17 bp, Homo sapiens
aactgtctatttctgct

SEQ ID NO: 621848 - DNA, 18 bp, Homo sapiens
aactgtgacattccacag

SEQ ID NO: 621849 - DNA, 14 bp, Homo sapiens
aactgtgagataaa

SEQ ID NO: 621850 - DNA, 18 bp, Homo sapiens
aacttaaacctgtgcttt

SEQ ID NO: 621851 - DNA, 13 bp, Homo sapiens
aacttattttgat

SEQ ID NO: 621852 - DNA, 15 bp, Homo sapiens
aacttcagatgtttc

SEQ ID NO: 621853 - DNA, 16 bp, Homo sapiens
aacttcagatgtttcc

SEQ ID NO: 621854 - DNA, 19 bp, Homo sapiens
aacttgaaattatatctgt

SEQ ID NO: 621855 - DNA, 12 bp, Homo sapiens
aacttgctgtga

SEQ ID NO: 621856 - DNA, 15 bp, Homo sapiens
aacttgctgtgaaat

SEQ ID NO: 621857 - DNA, 18 bp, Homo sapiens
aacttgtattggaagtat

SEQ ID NO: 621858 - DNA, 10 bp, Homo sapiens
aactttccat

SEQ ID NO: 621859 - DNA, 13 bp, Homo sapiens
aactttccatgac

SEQ ID NO: 621860 - DNA, 18 bp, Homo sapiens
aactttctcagcatatat

SEQ ID NO: 621861 - DNA, 21 bp, Homo sapiens
aactttggaagttttacttga

SEQ ID NO: 621862 - DNA, 18 bp, Homo sapiens
aacttttataaatgtttt

SEQ ID NO: 621863 - DNA, 20 bp, Homo sapiens
aagaaaaaagtgcaacttga

SEQ ID NO: 621864 - DNA, 12 bp, Homo sapiens
aagaaacacagc

SEQ ID NO: 621865 - DNA, 14 bp, Homo sapiens
aagaaacacagcat

SEQ ID NO: 621866 - DNA, 20 bp, Homo sapiens
aagaaacacagcatgcattt

SEQ ID NO: 621867 - DNA, 17 bp, Homo sapiens
aagaaacagtttaacag

SEQ ID NO: 621868 - DNA, 13 bp, Homo sapiens
aagaaacctttta

SEQ ID NO: 621869 - DNA, 16 bp, Homo sapiens
aagaaagatgctgatg

SEQ ID NO: 621870 - DNA, 17 bp, Homo sapiens
aagaaagggagaaggat

SEQ ID NO: 621871 - DNA, 21 bp, Homo sapiens
aagaaattagggctctaattt

SEQ ID NO: 621872 - DNA, 16 bp, Homo sapiens
aagaacccccctcccc

SEQ ID NO: 621873 - DNA, 17 bp, Homo sapiens
aagaacccccctcccca

SEQ ID NO: 621874 - DNA, 22 bp, Homo sapiens
aagaacccccctccccaaggaa

SEQ ID NO: 621875 - DNA, 21 bp, Homo sapiens
aagaacctgtagaagatgacc

SEQ ID NO: 621876 - DNA, 17 bp, Homo sapiens
aagaagatagttgtaaa

SEQ ID NO: 621877 - DNA, 19 bp, Homo sapiens
aagaagctaaaatgaaaaa

SEQ ID NO: 621878 - DNA, 21 bp, Homo sapiens
aagaagtccatgtgataattg

SEQ ID NO: 621879 - DNA, 20 bp, Homo sapiens
aagaattcagtagcatttta

SEQ ID NO: 621880 - DNA, 13 bp, Homo sapiens
aagacaaatacac

SEQ ID NO: 621881 - DNA, 14 bp, Homo sapiens
aagacaagtctgag

SEQ ID NO: 621882 - DNA, 21 bp, Homo sapiens
aagacattcttagttaatctt

SEQ ID NO: 621883 - DNA, 15 bp, Homo sapiens
aagacccactgaatc

SEQ ID NO: 621884 - DNA, 18 bp, Homo sapiens
aagaccccaggaagtcat

SEQ ID NO: 621885 - DNA, 23 bp, Homo sapiens
aagacggaatgaccagaaaattt

SEQ ID NO: 621886 - DNA, 16 bp, Homo sapiens
aagagaaaaagccctc

SEQ ID NO: 621887 - DNA, 22 bp, Homo sapiens
aagagaaaatgctttctcatgc

SEQ ID NO: 621888 - DNA, 18 bp, Homo sapiens
aagagaccacttccttaa

SEQ ID NO: 621889 - DNA, 20 bp, Homo sapiens
aagagagatatatctgaaaa

SEQ ID NO: 621890 - DNA, 18 bp, Homo sapiens
aagagattttatgtttaa

SEQ ID NO: 621891 - DNA, 14 bp, Homo sapiens
aagagctcaggaga

SEQ ID NO: 621892 - DNA, 21 bp, Homo sapiens
aagagctcaggagaaggcctg

SEQ ID NO: 621893 - DNA, 16 bp, Homo sapiens
aagagctgctgtattt

SEQ ID NO: 621894 - DNA, 22 bp, Homo sapiens
aagagcttcccctaacctgggt

SEQ ID NO: 621895 - DNA, 12 bp, Homo sapiens
atgtactgtatt

SEQ ID NO: 621896 - DNA, 22 bp, Homo sapiens
atgtatgccatgtatgttgcat

SEQ ID NO: 621897 - DNA, 20 bp, Homo sapiens
atgtatgtccattcactttc

SEQ ID NO: 621898 - DNA, 15 bp, Homo sapiens
atgtatgtgtatatg

SEQ ID NO: 621899 - DNA, 16 bp, Homo sapiens
atgtatgtgtatatgt

SEQ ID NO: 621900 - DNA, 22 bp, Homo sapiens
atgtatgtgtatatgtttatac

SEQ ID NO: 621901 - DNA, 15 bp, Homo sapiens
atgtatgttgcatga

SEQ ID NO: 621902 - DNA, 22 bp, Homo sapiens
atgtattgtgtcttttgcatga

SEQ ID NO: 621903 - DNA, 14 bp, Homo sapiens
atgtattttattgt

SEQ ID NO: 621904 - DNA, 20 bp, Homo sapiens
atgtattttattgtaacaga

SEQ ID NO: 621905 - DNA, 19 bp, Homo sapiens
atgtcatttcatacaaatt

SEQ ID NO: 621906 - DNA, 16 bp, Homo sapiens
atgtcccattgataat

SEQ ID NO: 621907 - DNA, 21 bp, Homo sapiens
atgtcccttcacatagttttt

SEQ ID NO: 621908 - DNA, 15 bp, Homo sapiens
atgtcggggcccctg

SEQ ID NO: 621909 - DNA, 16 bp, Homo sapiens
atgtcggggcccctgc

SEQ ID NO: 621910 - DNA, 17 bp, Homo sapiens
atgtctaatgtatttta

SEQ ID NO: 621911 - DNA, 14 bp, Homo sapiens
atgtctcaaaataa

SEQ ID NO: 621912 - DNA, 22 bp, Homo sapiens
atgtctcaaaataaaaccagaa

SEQ ID NO: 621913 - DNA, 10 bp, Homo sapiens
atgtctgtga

SEQ ID NO: 621914 - DNA, 14 bp, Homo sapiens
atgtcttcatgttg

SEQ ID NO: 621915 - DNA, 13 bp, Homo sapiens
atgtctttaaaat

SEQ ID NO: 621916 - DNA, 15 bp, Homo sapiens
atgtgaaaatgcttt

SEQ ID NO: 621917 - DNA, 16 bp, Homo sapiens
atgtgaactttctcag

SEQ ID NO: 621918 - DNA, 19 bp, Homo sapiens
atgtgaactttctcagcat

SEQ ID NO: 621919 - DNA, 20 bp, Homo sapiens
atgtgaactttctcagcata

SEQ ID NO: 621920 - DNA, 22 bp, Homo sapiens
atgtgaactttctcagcatata

SEQ ID NO: 621921 - DNA, 13 bp, Homo sapiens
atgtgataattgt

SEQ ID NO: 621922 - DNA, 15 bp, Homo sapiens
atgtgataattgtaa

SEQ ID NO: 621923 - DNA, 16 bp, Homo sapiens
atgtgataattgtaaa

SEQ ID NO: 621924 - DNA, 15 bp, Homo sapiens
atgtgatgagaggaa

SEQ ID NO: 621925 - DNA, 16 bp, Homo sapiens
atgtgatttatgcatt

SEQ ID NO: 621926 - DNA, 16 bp, Homo sapiens
atgtgcacggcagctt

SEQ ID NO: 621927 - DNA, 16 bp, Homo sapiens
atgtgctgctgtggca

SEQ ID NO: 621928 - DNA, 20 bp, Homo sapiens
atgtggaattacataacagg

SEQ ID NO: 621929 - DNA, 23 bp, Homo sapiens
atgtgtatatgtttatacacaca

SEQ ID NO: 621930 - DNA, 12 bp, Homo sapiens
atgtgtatggaa

SEQ ID NO: 621931 - DNA, 22 bp, Homo sapiens
atgtgtgtggttttttttctaa

SEQ ID NO: 621932 - DNA, 23 bp, Homo sapiens
atgtgtttggagttaaaatgtgt

SEQ ID NO: 621933 - DNA, 12 bp, Homo sapiens
atgttaaatcta

SEQ ID NO: 621934 - DNA, 14 bp, Homo sapiens
atgttaaatctaca

SEQ ID NO: 621935 - DNA, 19 bp, Homo sapiens
atgttaaatctacaaactt

SEQ ID NO: 621936 - DNA, 13 bp, Homo sapiens
atgttaatacatc

SEQ ID NO: 621937 - DNA, 15 bp, Homo sapiens
atgttaatacatcat

SEQ ID NO: 621938 - DNA, 19 bp, Homo sapiens
atgttaattgatagaataa

SEQ ID NO: 621939 - DNA, 13 bp, Homo sapiens
atgttattactgt

SEQ ID NO: 621940 - DNA, 21 bp, Homo sapiens
atgttattactgttttgggcc

SEQ ID NO: 621941 - DNA, 14 bp, Homo sapiens
atgttatttctctg

SEQ ID NO: 621942 - DNA, 17 bp, Homo sapiens
atgttcacgcaacttga

SEQ ID NO: 621943 - DNA, 20 bp, Homo sapiens
atgttcatgtgtaacttcta

SEQ ID NO: 621944 - DNA, 19 bp, Homo sapiens
atgttctgacagcatttca

SEQ ID NO: 621945 - DNA, 18 bp, Homo sapiens
atgttcttgagcagctga

SEQ ID NO: 621946 - DNA, 15 bp, Homo sapiens
atgttgatgaaattc

SEQ ID NO: 621947 - DNA, 19 bp, Homo sapiens
atgttgccatgaggccttt

SEQ ID NO: 621948 - DNA, 19 bp, Homo sapiens
atgttgtgttggtatttac

SEQ ID NO: 621949 - DNA, 15 bp, Homo sapiens
atgtttaaaatggca

SEQ ID NO: 621950 - DNA, 19 bp, Homo sapiens
atgtttaacttaatcaatt

SEQ ID NO: 621951 - DNA, 19 bp, Homo sapiens
atgtttaagaaatgagaaa

SEQ ID NO: 621952 - DNA, 16 bp, Homo sapiens
atgtttaataatatgt

SEQ ID NO: 621953 - DNA, 19 bp, Homo sapiens
atgtttagtagctgataaa

SEQ ID NO: 621954 - DNA, 16 bp, Homo sapiens
atgtttatacacacag

SEQ ID NO: 621955 - DNA, 19 bp, Homo sapiens
atgtttctatatgtaactt

SEQ ID NO: 621956 - DNA, 20 bp, Homo sapiens
atgtttctgcagtattctgt

SEQ ID NO: 621957 - DNA, 18 bp, Homo sapiens
atgttttacaatggctgg

SEQ ID NO: 621958 - DNA, 17 bp, Homo sapiens
atgttttttatacttca

SEQ ID NO: 621959 - DNA, 22 bp, Homo sapiens
atgttttttatacttcaaatgt

SEQ ID NO: 621960 - DNA, 13 bp, Homo sapiens
attaaaaattata

SEQ ID NO: 621961 - DNA, 11 bp, Homo sapiens
attaaactaat

SEQ ID NO: 621962 - DNA, 19 bp, Homo sapiens
attaaactgggaaatgaga

SEQ ID NO: 621963 - DNA, 19 bp, Homo sapiens
attaaagtctgagaaattt

SEQ ID NO: 621964 - DNA, 19 bp, Homo sapiens
attaaagtgtccattgaca

SEQ ID NO: 621965 - DNA, 22 bp, Homo sapiens
attaaagtgtccattgacatgt

SEQ ID NO: 621966 - DNA, 13 bp, Homo sapiens
attaaataataga

SEQ ID NO: 621967 - DNA, 13 bp, Homo sapiens
attaaatgaaata

SEQ ID NO: 621968 - DNA, 17 bp, Homo sapiens
attaaatgaaatacttg

SEQ ID NO: 621969 - DNA, 15 bp, Homo sapiens
attaaattatcattg

SEQ ID NO: 621970 - DNA, 18 bp, Homo sapiens
attaaattatcattgttt

SEQ ID NO: 621971 - DNA, 23 bp, Homo sapiens
attaaattcctcctgtctcctct

SEQ ID NO: 621972 - DNA, 12 bp, Homo sapiens
attaacaaattc

SEQ ID NO: 621973 - DNA, 14 bp, Homo sapiens
attaacaaattcag

SEQ ID NO: 621974 - DNA, 21 bp, Homo sapiens
attaagaaaccccctcatgga

SEQ ID NO: 621975 - DNA, 12 bp, Homo sapiens
attaagcacaca

SEQ ID NO: 621976 - DNA, 24 bp, Homo sapiens
attaagcacacacatctggccctg

SEQ ID NO: 621977 - DNA, 17 bp, Homo sapiens
attaagttataccagca

SEQ ID NO: 621978 - DNA, 16 bp, Homo sapiens
attaataacagaaata

SEQ ID NO: 621979 - DNA, 16 bp, Homo sapiens
attaatttattaaatt

SEQ ID NO: 621980 - DNA, 12 bp, Homo sapiens
attaatttttca

SEQ ID NO: 621981 - DNA, 18 bp, Homo sapiens
attaatttttttattgtt

SEQ ID NO: 621982 - DNA, 17 bp, Homo sapiens
attacaacaagcaaact

SEQ ID NO: 621983 - DNA, 21 bp, Homo sapiens
attacaacaagcaaactgaaa

SEQ ID NO: 621984 - DNA, 15 bp, Homo sapiens
attacataacaggca

SEQ ID NO: 621985 - DNA, 14 bp, Homo sapiens
attacatcctctgc

SEQ ID NO: 621986 - DNA, 16 bp, Homo sapiens
attacctgaaagccct

SEQ ID NO: 621987 - DNA, 17 bp, Homo sapiens
attactggaagtaagaa

SEQ ID NO: 621988 - DNA, 19 bp, Homo sapiens
attagacaatgtggaatta

SEQ ID NO: 621989 - DNA, 21 bp, Homo sapiens
attagagattgacttcagaaa

SEQ ID NO: 621990 - DNA, 20 bp, Homo sapiens
attagattttaaaacttcat

SEQ ID NO: 621991 - DNA, 12 bp, Homo sapiens
attagcaccagc

SEQ ID NO: 621992 - DNA, 14 bp, Homo sapiens
attagcaccagctt

SEQ ID NO: 621993 - DNA, 22 bp, Homo sapiens
attagcaccagcttgcttctct

SEQ ID NO: 621994 - DNA, 16 bp, Homo sapiens
attaggttaagtctca

SEQ ID NO: 621995 - DNA, 13 bp, Homo sapiens
attagtgttttca

SEQ ID NO: 621996 - DNA, 19 bp, Homo sapiens
attagtgttttcattctgg

SEQ ID NO: 621997 - DNA, 15 bp, Homo sapiens
attataatgcatcta

SEQ ID NO: 621998 - DNA, 12 bp, Homo sapiens
attatagcatgt

SEQ ID NO: 621999 - DNA, 18 bp, Homo sapiens
attatatctgtggtcttc

SEQ ID NO: 622000 - DNA, 19 bp, Homo sapiens
attatatgaagcagaatga

SEQ ID NO: 622001 - DNA, 13 bp, Homo sapiens
attatcattgttt

SEQ ID NO: 622002 - DNA, 21 bp, Homo sapiens
attatcctcaagttgtgtgct

SEQ ID NO: 622003 - DNA, 12 bp, Homo sapiens
atttaagcacaa

SEQ ID NO: 622004 - DNA, 14 bp, Homo sapiens
atttaatcatttcc

SEQ ID NO: 622005 - DNA, 21 bp, Homo sapiens
atttaatgagttttatcttga

SEQ ID NO: 622006 - DNA, 16 bp, Homo sapiens
atttacaacttccaga

SEQ ID NO: 622007 - DNA, 17 bp, Homo sapiens
atttaccacaggatgca

SEQ ID NO: 622008 - DNA, 22 bp, Homo sapiens
atttaccacaggatgcatatta

SEQ ID NO: 622009 - DNA, 15 bp, Homo sapiens
atttaccagaagttt

SEQ ID NO: 622010 - DNA, 17 bp, Homo sapiens
atttaccatcaaacaaa

SEQ ID NO: 622011 - DNA, 19 bp, Homo sapiens
atttactaacagtaactgc

SEQ ID NO: 622012 - DNA, 18 bp, Homo sapiens
atttactatgtaaatgct

SEQ ID NO: 622013 - DNA, 18 bp, Homo sapiens
atttactgcaatgtctgt

SEQ ID NO: 622014 - DNA, 12 bp, Homo sapiens
atttagcacagt

SEQ ID NO: 622015 - DNA, 13 bp, Homo sapiens
atttagcacagta

SEQ ID NO: 622016 - DNA, 14 bp, Homo sapiens
atttagcacagtat

SEQ ID NO: 622017 - DNA, 13 bp, Homo sapiens
atttagcatgagt

SEQ ID NO: 622018 - DNA, 19 bp, Homo sapiens
atttagggttctatattta

SEQ ID NO: 622019 - DNA, 12 bp, Homo sapiens
aggaatgctcaa

SEQ ID NO: 622020 - DNA, 20 bp, Homo sapiens
aggacactgatgggtcctgc

SEQ ID NO: 622021 - DNA, 17 bp, Homo sapiens
aggacagaggccggggt

SEQ ID NO: 622022 - DNA, 16 bp, Homo sapiens
aggacagagtgccctg

SEQ ID NO: 622023 - DNA, 18 bp, Homo sapiens
aggacagagtgccctggg

SEQ ID NO: 622024 - DNA, 15 bp, Homo sapiens
aggacagcttcccca

SEQ ID NO: 622025 - DNA, 19 bp, Homo sapiens
aggacagtgttcaaattct

SEQ ID NO: 622026 - DNA, 13 bp, Homo sapiens
aggacccaaggtg

SEQ ID NO: 622027 - DNA, 20 bp, Homo sapiens
aggacccaaggtggtcttgg

SEQ ID NO: 622028 - DNA, 21 bp, Homo sapiens
aggacccaaggtggtcttgga

SEQ ID NO: 622029 - DNA, 14 bp, Homo sapiens
aggacccctgccct

SEQ ID NO: 622030 - DNA, 12 bp, Homo sapiens
aggacgcatgca

SEQ ID NO: 622031 - DNA, 14 bp, Homo sapiens
aggacgcatgcagg

SEQ ID NO: 622032 - DNA, 11 bp, Homo sapiens
aggactacaga

SEQ ID NO: 622033 - DNA, 15 bp, Homo sapiens
aggactacagaattg

SEQ ID NO: 622034 - DNA, 16 bp, Homo sapiens
aggactacagaattgg

SEQ ID NO: 622035 - DNA, 12 bp, Homo sapiens
aggactgaagaa

SEQ ID NO: 622036 - DNA, 21 bp, Homo sapiens
atatcagttacagtggcagta

SEQ ID NO: 622037 - DNA, 22 bp, Homo sapiens
atatcagttacagtggcagtat

SEQ ID NO: 622038 - DNA, 20 bp, Homo sapiens
atatcatccccaaatgtgtc

SEQ ID NO: 622039 - DNA, 13 bp, Homo sapiens
atatcattcagaa

SEQ ID NO: 622040 - DNA, 13 bp, Homo sapiens
atatctatttatc

SEQ ID NO: 622041 - DNA, 19 bp, Homo sapiens
atatctatttatctgtctg

SEQ ID NO: 622042 - DNA, 20 bp, Homo sapiens
atatctatttatctgtctga

SEQ ID NO: 622043 - DNA, 14 bp, Homo sapiens
atatctgtgtaaga

SEQ ID NO: 622044 - DNA, 17 bp, Homo sapiens
atatctgtttgcttcta

SEQ ID NO: 622045 - DNA, 19 bp, Homo sapiens
atatgaaagagaaaatgct

SEQ ID NO: 622046 - DNA, 16 bp, Homo sapiens
atatgaagcagaatga

SEQ ID NO: 622047 - DNA, 16 bp, Homo sapiens
atatgaggatgtatgt

SEQ ID NO: 622048 - DNA, 19 bp, Homo sapiens
atatgaggatgtatgtgta

SEQ ID NO: 622049 - DNA, 21 bp, Homo sapiens
atatgaggatgtatgtgtata

SEQ ID NO: 622050 - DNA, 16 bp, Homo sapiens
atatgattaaattatc

SEQ ID NO: 622051 - DNA, 17 bp, Homo sapiens
atatgattctcctctcc

SEQ ID NO: 622052 - DNA, 17 bp, Homo sapiens
atatgcatatatatgta

SEQ ID NO: 622053 - DNA, 19 bp, Homo sapiens
atatgcatatatatgtata

SEQ ID NO: 622054 - DNA, 23 bp, Homo sapiens
atatggatatttttaatttatga

SEQ ID NO: 622055 - DNA, 14 bp, Homo sapiens
atatgtacaaataa

SEQ ID NO: 622056 - DNA, 23 bp, Homo sapiens
atatgtaggaaaattttcttctt

SEQ ID NO: 622057 - DNA, 19 bp, Homo sapiens
atatgtgaactttctcagc

SEQ ID NO: 622058 - DNA, 14 bp, Homo sapiens
atatgttgatgaaa

SEQ ID NO: 622059 - DNA, 15 bp, Homo sapiens
atatgtttatacaca

SEQ ID NO: 622060 - DNA, 15 bp, Homo sapiens
atatgtttggctgaa

SEQ ID NO: 622061 - DNA, 21 bp, Homo sapiens
atatgtttggctgaaattatg

SEQ ID NO: 622062 - DNA, 15 bp, Homo sapiens
atattaaagaaagtc

SEQ ID NO: 622063 - DNA, 19 bp, Homo sapiens
atattaaagtctgagaaat

SEQ ID NO: 622064 - DNA, 17 bp, Homo sapiens
atattactctgcctgtc

SEQ ID NO: 622065 - DNA, 23 bp, Homo sapiens
atattactctgcctgtcaagttt

SEQ ID NO: 622066 - DNA, 13 bp, Homo sapiens
atattattttctg

SEQ ID NO: 622067 - DNA, 14 bp, Homo sapiens
atattctttcacaa

SEQ ID NO: 622068 - DNA, 21 bp, Homo sapiens
atattgacaagtttaaaggct

SEQ ID NO: 622069 - DNA, 18 bp, Homo sapiens
atattgatgtaactgtgt

SEQ ID NO: 622070 - DNA, 16 bp, Homo sapiens
atattgccttgatgtt

SEQ ID NO: 622071 - DNA, 24 bp, Homo sapiens
atattgccttgatgtttctatatg

SEQ ID NO: 622072 - DNA, 17 bp, Homo sapiens
atattgcgagaaacaga

SEQ ID NO: 622073 - DNA, 20 bp, Homo sapiens
atattgctattgtttatagg

SEQ ID NO: 622074 - DNA, 17 bp, Homo sapiens
atattgctgtctgaaaa

SEQ ID NO: 622075 - DNA, 17 bp, Homo sapiens
atattggttctatttat

SEQ ID NO: 622076 - DNA, 20 bp, Homo sapiens
atatttaataggataaatta

SEQ ID NO: 622077 - DNA, 18 bp, Homo sapiens
atatttatcatatttaat

SEQ ID NO: 622078 - DNA, 16 bp, Homo sapiens
atatttggattcacag

SEQ ID NO: 622079 - DNA, 12 bp, Homo sapiens
atattttcttaa

SEQ ID NO: 622080 - DNA, 13 bp, Homo sapiens
atattttcttaat

SEQ ID NO: 622081 - DNA, 12 bp, Homo sapiens
atattttgaaag

SEQ ID NO: 622082 - DNA, 17 bp, Homo sapiens
atatttttaatttatga

SEQ ID NO: 622083 - DNA, 13 bp, Homo sapiens
atcaaaaaacaga

SEQ ID NO: 622084 - DNA, 18 bp, Homo sapiens
atcaaaaaacagaaaaac

SEQ ID NO: 622085 - DNA, 19 bp, Homo sapiens
atcaaaaattgaagagaga

SEQ ID NO: 622086 - DNA, 13 bp, Homo sapiens
atcaactcatgtt

SEQ ID NO: 622087 - DNA, 23 bp, Homo sapiens
atcaagaatcttttgtgaaatta

SEQ ID NO: 622088 - DNA, 13 bp, Homo sapiens
atcaagtctgtga

SEQ ID NO: 622089 - DNA, 21 bp, Homo sapiens
atcaatgttcacgcaacttga

SEQ ID NO: 622090 - DNA, 23 bp, Homo sapiens
atcaatgttcacgcaacttgaaa

SEQ ID NO: 622091 - DNA, 22 bp, Homo sapiens
atcaattaatttttttattgtt

SEQ ID NO: 622092 - DNA, 18 bp, Homo sapiens
atcaattgggttttgatc

SEQ ID NO: 622093 - DNA, 19 bp, Homo sapiens
atcaattgggttttgatct

SEQ ID NO: 622094 - DNA, 24 bp, Homo sapiens
atcacaccagttacttgtgttcat

SEQ ID NO: 622095 - DNA, 15 bp, Homo sapiens
atcacagtctaattt

SEQ ID NO: 622096 - DNA, 19 bp, Homo sapiens
atcacagtctaatttttat

SEQ ID NO: 622097 - DNA, 17 bp, Homo sapiens
atcaccctgactgtggg

SEQ ID NO: 622098 - DNA, 18 bp, Homo sapiens
atcaccgggaacgccccc

SEQ ID NO: 622099 - DNA, 20 bp, Homo sapiens
atcagaaagacattcttagt

SEQ ID NO: 622100 - DNA, 17 bp, Homo sapiens
atcagaggctgggggag

SEQ ID NO: 622101 - DNA, 14 bp, Homo sapiens
atcagctctaaagc

SEQ ID NO: 622102 - DNA, 22 bp, Homo sapiens
atcagctctgcataagattata

SEQ ID NO: 622103 - DNA, 22 bp, Homo sapiens
atcaggaaaggaagatgtaaga

SEQ ID NO: 622104 - DNA, 21 bp, Homo sapiens
atcaggaggggtgttaaaaca

SEQ ID NO: 622105 - DNA, 22 bp, Homo sapiens
atcaggaggggtgttaaaacat

SEQ ID NO: 622106 - DNA, 19 bp, Homo sapiens
atcagggcccaaataacag

SEQ ID NO: 622107 - DNA, 13 bp, Homo sapiens
atcagtacaattc

SEQ ID NO: 622108 - DNA, 18 bp, Homo sapiens
atcagtacaattctttgt

SEQ ID NO: 622109 - DNA, 16 bp, Homo sapiens
atcagtcaattgcttg

SEQ ID NO: 622110 - DNA, 15 bp, Homo sapiens
atcagttacagtggc

SEQ ID NO: 622111 - DNA, 22 bp, Homo sapiens
atcagttacagtggcagtattg

SEQ ID NO: 622112 - DNA, 23 bp, Homo sapiens
atcatacgttgatagtttacaaa

SEQ ID NO: 622113 - DNA, 18 bp, Homo sapiens
atcatccccaaatgtgtc

SEQ ID NO: 622114 - DNA, 18 bp, Homo sapiens
atcatgacttctttacta

SEQ ID NO: 622115 - DNA, 13 bp, Homo sapiens
atcatgtgtttct

SEQ ID NO: 622116 - DNA, 18 bp, Homo sapiens
atcatgtgtttctgtgta

SEQ ID NO: 622117 - DNA, 15 bp, Homo sapiens
atcattcttataaca

SEQ ID NO: 622118 - DNA, 22 bp, Homo sapiens
atcattcttataacattgtatg

SEQ ID NO: 622119 - DNA, 15 bp, Homo sapiens
atcattgaaatcttt

SEQ ID NO: 622120 - DNA, 19 bp, Homo sapiens
atcattgaaatctttttgc

SEQ ID NO: 622121 - DNA, 17 bp, Homo sapiens
atcatttccagcaaaat

SEQ ID NO: 622122 - DNA, 21 bp, Homo sapiens
atcatttccagcaaaatatat

SEQ ID NO: 622123 - DNA, 13 bp, Homo sapiens
atcattttgatgt

SEQ ID NO: 622124 - DNA, 14 bp, Homo sapiens
atcattttgatgta

SEQ ID NO: 622125 - DNA, 20 bp, Homo sapiens
atcattttgatgtattatta

SEQ ID NO: 622126 - DNA, 14 bp, Homo sapiens
atcattttgggaaa

SEQ ID NO: 622127 - DNA, 16 bp, Homo sapiens
atcattttttgtttct

SEQ ID NO: 622128 - DNA, 17 bp, Homo sapiens
atccaaaatagtcatgt

SEQ ID NO: 622129 - DNA, 16 bp, Homo sapiens
atccaactggaaggct

SEQ ID NO: 622130 - DNA, 17 bp, Homo sapiens
atccaactggaaggctt

SEQ ID NO: 622131 - DNA, 15 bp, Homo sapiens
atccaccttcctgcc

SEQ ID NO: 622132 - DNA, 18 bp, Homo sapiens
atccaccttcctgcccag

SEQ ID NO: 622133 - DNA, 16 bp, Homo sapiens
atccactaggtgccca

SEQ ID NO: 622134 - DNA, 23 bp, Homo sapiens
atccactaggtgcccagtcttga

SEQ ID NO: 622135 - DNA, 20 bp, Homo sapiens
atccagagagaagcacccca

SEQ ID NO: 622136 - DNA, 21 bp, Homo sapiens
atccagagagaagcaccccac

SEQ ID NO: 622137 - DNA, 15 bp, Homo sapiens
atccagccttcttcc

SEQ ID NO: 622138 - DNA, 13 bp, Homo sapiens
atccagcggggct

SEQ ID NO: 622139 - DNA, 16 bp, Homo sapiens
atccatactgtttaat

SEQ ID NO: 622140 - DNA, 19 bp, Homo sapiens
atccatgtgctgctgtggc

SEQ ID NO: 622141 - DNA, 22 bp, Homo sapiens
atcccacgttgatgtctgaacg

SEQ ID NO: 622142 - DNA, 14 bp, Homo sapiens
atcccagagttatt

SEQ ID NO: 622143 - DNA, 18 bp, Homo sapiens
atccccataatgcttctt

SEQ ID NO: 622144 - DNA, 14 bp, Homo sapiens
atcccttggcccct

SEQ ID NO: 622145 - DNA, 16 bp, Homo sapiens
atcccttggcccctct

SEQ ID NO: 622146 - DNA, 18 bp, Homo sapiens
atcccttggcccctctct

SEQ ID NO: 622147 - DNA, 20 bp, Homo sapiens
atcctcaattatcttggaaa

SEQ ID NO: 622148 - DNA, 18 bp, Homo sapiens
atcctccgcggaggcccc

SEQ ID NO: 622149 - DNA, 21 bp, Homo sapiens
atcctccgcggaggcccctga

SEQ ID NO: 622150 - DNA, 12 bp, Homo sapiens
atcctgagccag

SEQ ID NO: 622151 - DNA, 16 bp, Homo sapiens
caaggcctccagccac

SEQ ID NO: 622152 - DNA, 17 bp, Homo sapiens
caagggcacattgccca

SEQ ID NO: 622153 - DNA, 18 bp, Homo sapiens
caagggcacattgcccat

SEQ ID NO: 622154 - DNA, 23 bp, Homo sapiens
caagggcacattgcccatggctg

SEQ ID NO: 622155 - DNA, 21 bp, Homo sapiens
caaggtgcggaccggagcggc

SEQ ID NO: 622156 - DNA, 12 bp, Homo sapiens
caaggtgggggt

SEQ ID NO: 622157 - DNA, 21 bp, Homo sapiens
caaggtggtcttggagaggag

SEQ ID NO: 622158 - DNA, 22 bp, Homo sapiens
caagtagtagtacttaatagta

SEQ ID NO: 622159 - DNA, 21 bp, Homo sapiens
caagtcctcgccccccgcccg

SEQ ID NO: 622160 - DNA, 17 bp, Homo sapiens
caagtctacctgccttg

SEQ ID NO: 622161 - DNA, 20 bp, Homo sapiens
caagtgaatgagtttccagc

SEQ ID NO: 622162 - DNA, 15 bp, Homo sapiens
caagtgtacatttga

SEQ ID NO: 622163 - DNA, 11 bp, Homo sapiens
caagtgtcctg

SEQ ID NO: 622164 - DNA, 17 bp, Homo sapiens
caagtgtgtgtgcaatg

SEQ ID NO: 622165 - DNA, 22 bp, Homo sapiens
caagtgttacctaacaatgttt

SEQ ID NO: 622166 - DNA, 16 bp, Homo sapiens
caagtgtttctagtaa

SEQ ID NO: 622167 - DNA, 16 bp, Homo sapiens
caagttcattcatact

SEQ ID NO: 622168 - DNA, 15 bp, Homo sapiens
caataagaaacagtt

SEQ ID NO: 622169 - DNA, 20 bp, Homo sapiens
caataagaaacagtttaaca

SEQ ID NO: 622170 - DNA, 19 bp, Homo sapiens
caataagctcctaaattat

SEQ ID NO: 622171 - DNA, 22 bp, Homo sapiens
caataagctcctaaattataga

SEQ ID NO: 622172 - DNA, 17 bp, Homo sapiens
caataagttgaatgata

SEQ ID NO: 622173 - DNA, 15 bp, Homo sapiens
caatactttgtgtct

SEQ ID NO: 622174 - DNA, 15 bp, Homo sapiens
caataggaaaaactg

SEQ ID NO: 622175 - DNA, 23 bp, Homo sapiens
caatatcatccccaaatgtgtct

SEQ ID NO: 622176 - DNA, 23 bp, Homo sapiens
caatatttgtggtttaactttgt

SEQ ID NO: 622177 - DNA, 16 bp, Homo sapiens
caatcattttgggaaa

SEQ ID NO: 622178 - DNA, 15 bp, Homo sapiens
caatccacagtattg

SEQ ID NO: 622179 - DNA, 17 bp, Homo sapiens
caatccacagtattgtt

SEQ ID NO: 622180 - DNA, 13 bp, Homo sapiens
caatccagccttc

SEQ ID NO: 622181 - DNA, 19 bp, Homo sapiens
caatccccataatgcttct

SEQ ID NO: 622182 - DNA, 20 bp, Homo sapiens
caatccccataatgcttctt

SEQ ID NO: 622183 - DNA, 19 bp, Homo sapiens
caatcgactgggtttatgt

SEQ ID NO: 622184 - DNA, 16 bp, Homo sapiens
caatgaactctttccc

SEQ ID NO: 622185 - DNA, 17 bp, Homo sapiens
caatgccaattcatctc

SEQ ID NO: 622186 - DNA, 21 bp, Homo sapiens
caatgtctgtccctaaacata

SEQ ID NO: 622187 - DNA, 16 bp, Homo sapiens
caatgtgctgttgatt

SEQ ID NO: 622188 - DNA, 23 bp, Homo sapiens
caatgtgctgttgattctttcaa

SEQ ID NO: 622189 - DNA, 16 bp, Homo sapiens
caatgtggaattacat

SEQ ID NO: 622190 - DNA, 13 bp, Homo sapiens
caatgttaaatct

SEQ ID NO: 622191 - DNA, 16 bp, Homo sapiens
caatgttaaatctaca

SEQ ID NO: 622192 - DNA, 19 bp, Homo sapiens
caatgttccgttcatctga

SEQ ID NO: 622193 - DNA, 21 bp, Homo sapiens
caatgttccgttcatctgagg

SEQ ID NO: 622194 - DNA, 18 bp, Homo sapiens
caatgttttttatacttc

SEQ ID NO: 622195 - DNA, 12 bp, Homo sapiens
caattaattttt

SEQ ID NO: 622196 - DNA, 14 bp, Homo sapiens
caattgcttgagca

SEQ ID NO: 622197 - DNA, 23 bp, Homo sapiens
caattgggttttgatctcagcat

SEQ ID NO: 622198 - DNA, 22 bp, Homo sapiens
caattgtatatatatgtgaact

SEQ ID NO: 622199 - DNA, 23 bp, Homo sapiens
caatttaaaggaaagttctatta

SEQ ID NO: 622200 - DNA, 17 bp, Homo sapiens
caatttcaaagaaaaca

SEQ ID NO: 622201 - DNA, 16 bp, Homo sapiens
caatttttaaatttct

SEQ ID NO: 622202 - DNA, 22 bp, Homo sapiens
cacaaaaggctggatgtgcttt

SEQ ID NO: 622203 - DNA, 18 bp, Homo sapiens
cacaaagctatttaagtg

SEQ ID NO: 622204 - DNA, 17 bp, Homo sapiens
cacaaagtgaaattagt

SEQ ID NO: 622205 - DNA, 17 bp, Homo sapiens
cacaaccatgttcttga

SEQ ID NO: 622206 - DNA, 18 bp, Homo sapiens
cacaacctcctcctccag

SEQ ID NO: 622207 - DNA, 19 bp, Homo sapiens
cacaactgtggataaattt

SEQ ID NO: 622208 - DNA, 20 bp, Homo sapiens
cacaactgtggataaatttt

SEQ ID NO: 622209 - DNA, 18 bp, Homo sapiens
cacaagcagacacacaca

SEQ ID NO: 622210 - DNA, 22 bp, Homo sapiens
cacaatttgttgaatctcaggt

SEQ ID NO: 622211 - DNA, 15 bp, Homo sapiens
cacacaaaacaacag

SEQ ID NO: 622212 - DNA, 23 bp, Homo sapiens
cacacaaaacaacagcaacaaca

SEQ ID NO: 622213 - DNA, 10 bp, Homo sapiens
cacacacaaa

SEQ ID NO: 622214 - DNA, 12 bp, Homo sapiens
cacacacaaaac

SEQ ID NO: 622215 - DNA, 14 bp, Homo sapiens
cacacacaaaacaa

SEQ ID NO: 622216 - DNA, 19 bp, Homo sapiens
cacacacaaaacaacagca

SEQ ID NO: 622217 - DNA, 13 bp, Homo sapiens
cacacacacaaaa

SEQ ID NO: 622218 - DNA, 13 bp, Homo sapiens
cacacacagacac

SEQ ID NO: 622219 - DNA, 15 bp, Homo sapiens
cacacacccttcccc

SEQ ID NO: 622220 - DNA, 14 bp, Homo sapiens
cacacagacacaca

SEQ ID NO: 622221 - DNA, 17 bp, Homo sapiens
cacacaggagaaaatgc

SEQ ID NO: 622222 - DNA, 13 bp, Homo sapiens
cacacataacaca

SEQ ID NO: 622223 - DNA, 12 bp, Homo sapiens
cacacatatata

SEQ ID NO: 622224 - DNA, 19 bp, Homo sapiens
cacacatatatacatacgc

SEQ ID NO: 622225 - DNA, 17 bp, Homo sapiens
cacacatctggccctga

SEQ ID NO: 622226 - DNA, 15 bp, Homo sapiens
cacaccaaattgctg

SEQ ID NO: 622227 - DNA, 11 bp, Homo sapiens
cacacccttcc

SEQ ID NO: 622228 - DNA, 15 bp, Homo sapiens
cacaccggcactgtg

SEQ ID NO: 622229 - DNA, 22 bp, Homo sapiens
cacaccttacaaagccagctct

SEQ ID NO: 622230 - DNA, 15 bp, Homo sapiens
cacacgccggggctg

SEQ ID NO: 622231 - DNA, 13 bp, Homo sapiens
cacactcagcagc

SEQ ID NO: 622232 - DNA, 15 bp, Homo sapiens
cacactcagcagccc

SEQ ID NO: 622233 - DNA, 14 bp, Homo sapiens
cacactctcttctt

SEQ ID NO: 622234 - DNA, 13 bp, Homo sapiens
cacactgagctgg

SEQ ID NO: 622235 - DNA, 14 bp, Homo sapiens
cacactgagctggg

SEQ ID NO: 622236 - DNA, 14 bp, Homo sapiens
cacatataaacaca

SEQ ID NO: 622237 - DNA, 21 bp, Homo sapiens
cacatataaacacagtaagat

SEQ ID NO: 622238 - DNA, 14 bp, Homo sapiens
cacatatatacata

SEQ ID NO: 622239 - DNA, 18 bp, Homo sapiens
cacatatatacatacgca

SEQ ID NO: 622240 - DNA, 20 bp, Homo sapiens
cacatccccaccctcccctc

SEQ ID NO: 622241 - DNA, 23 bp, Homo sapiens
cacatccccaccctcccctctcc

SEQ ID NO: 622242 - DNA, 14 bp, Homo sapiens
cacatctggccctg

SEQ ID NO: 622243 - DNA, 15 bp, Homo sapiens
cacattgaaactgta

SEQ ID NO: 622244 - DNA, 17 bp, Homo sapiens
cacattgcacacacagt

SEQ ID NO: 622245 - DNA, 20 bp, Homo sapiens
cacattgcacacacagtctg

SEQ ID NO: 622246 - DNA, 22 bp, Homo sapiens
cacattgcttcattaaaacaag

SEQ ID NO: 622247 - DNA, 19 bp, Homo sapiens
cacatttctggccatttaa

SEQ ID NO: 622248 - DNA, 20 bp, Homo sapiens
cacatttgggctcagggttg

SEQ ID NO: 622249 - DNA, 15 bp, Homo sapiens
cacatttgttaatga

SEQ ID NO: 622250 - DNA, 23 bp, Homo sapiens
caccaaatagcttttcacttctt

SEQ ID NO: 622251 - DNA, 20 bp, Homo sapiens
caccaaattgctgagatgtt

SEQ ID NO: 622252 - DNA, 15 bp, Homo sapiens
caccacaggctgcct

SEQ ID NO: 622253 - DNA, 16 bp, Homo sapiens
caccactttcccacac

SEQ ID NO: 622254 - DNA, 22 bp, Homo sapiens
caccagcctgagccacagtggg

SEQ ID NO: 622255 - DNA, 15 bp, Homo sapiens
caccagtgccgcctg

SEQ ID NO: 622256 - DNA, 16 bp, Homo sapiens
caccagtgccgcctgt

SEQ ID NO: 622257 - DNA, 20 bp, Homo sapiens
caccatttaatcatttccag

SEQ ID NO: 622258 - DNA, 17 bp, Homo sapiens
caccatttcccctgtgg

SEQ ID NO: 622259 - DNA, 21 bp, Homo sapiens
caccatttcccctgtggtttg

SEQ ID NO: 622260 - DNA, 15 bp, Homo sapiens
cacccaaaccccggg

SEQ ID NO: 622261 - DNA, 14 bp, Homo sapiens
cacccactagccct

SEQ ID NO: 622262 - DNA, 11 bp, Homo sapiens
cacccagcctg

SEQ ID NO: 622263 - DNA, 16 bp, Homo sapiens
cacccatgccagcgca

SEQ ID NO: 622264 - DNA, 17 bp, Homo sapiens
cacccatgccagcgcag

SEQ ID NO: 622265 - DNA, 13 bp, Homo sapiens
cacccccagcctc

SEQ ID NO: 622266 - DNA, 15 bp, Homo sapiens
cacccccagcctccc

SEQ ID NO: 622267 - DNA, 13 bp, Homo sapiens
caccccgctgcct

SEQ ID NO: 622268 - DNA, 23 bp, Homo sapiens
caccccgctgcctggcgggcagc

SEQ ID NO: 622269 - DNA, 19 bp, Homo sapiens
caccccgtcccggccccgc

SEQ ID NO: 622270 - DNA, 22 bp, Homo sapiens
caccccgttgttgtccctgcag

SEQ ID NO: 622271 - DNA, 14 bp, Homo sapiens
cacccctcttcccc

SEQ ID NO: 622272 - DNA, 16 bp, Homo sapiens
cacccctcttccccct

SEQ ID NO: 622273 - DNA, 21 bp, Homo sapiens
cacccctcttcccccttcccc

SEQ ID NO: 622274 - DNA, 12 bp, Homo sapiens
cacccctgtgcg

SEQ ID NO: 622275 - DNA, 14 bp, Homo sapiens
cacccgccccagag

SEQ ID NO: 622276 - DNA, 21 bp, Homo sapiens
cacccgccccagagactgccc

SEQ ID NO: 622277 - DNA, 23 bp, Homo sapiens
cacccgccccagagactgcccac

SEQ ID NO: 622278 - DNA, 17 bp, Homo sapiens
cacccggcaaggggcgc

SEQ ID NO: 622279 - DNA, 17 bp, Homo sapiens
cacccgtgttctcctcc

SEQ ID NO: 622280 - DNA, 14 bp, Homo sapiens
caccctccacagga

SEQ ID NO: 622281 - DNA, 17 bp, Homo sapiens
caccctccacaggagcc

SEQ ID NO: 622282 - DNA, 23 bp, Homo sapiens
caccctccacaggagccgcagag

SEQ ID NO: 622283 - DNA, 21 bp, Homo sapiens
caccctctgctatgtctgtga

SEQ ID NO: 622284 - DNA, 23 bp, Homo sapiens
caccctctgctatgtctgtgatg

SEQ ID NO: 622285 - DNA, 14 bp, Homo sapiens
caccctgactgtgg

SEQ ID NO: 622286 - DNA, 13 bp, Homo sapiens
caccctgagcctg

SEQ ID NO: 622287 - DNA, 16 bp, Homo sapiens
caccctgcaggcaggc

SEQ ID NO: 622288 - DNA, 19 bp, Homo sapiens
caccctgcaggcaggcaga

SEQ ID NO: 622289 - DNA, 22 bp, Homo sapiens
caccctgcaggcaggcagacca

SEQ ID NO: 622290 - DNA, 14 bp, Homo sapiens
caccctgggcctcc

SEQ ID NO: 622291 - DNA, 19 bp, Homo sapiens
caccctgttccctctttct

SEQ ID NO: 622292 - DNA, 21 bp, Homo sapiens
cacccttccccactcccgtga

SEQ ID NO: 622293 - DNA, 15 bp, Homo sapiens
caccgcccaaccccc

SEQ ID NO: 622294 - DNA, 14 bp, Homo sapiens
caccgcccacccac

SEQ ID NO: 622295 - DNA, 18 bp, Homo sapiens
caccgcgcccctctgcgc

SEQ ID NO: 622296 - DNA, 14 bp, Homo sapiens
caccggcactgtgc

SEQ ID NO: 622297 - DNA, 15 bp, Homo sapiens
caccggcactgtgca

SEQ ID NO: 622298 - DNA, 15 bp, Homo sapiens
cacctaattaatttc

SEQ ID NO: 622299 - DNA, 12 bp, Homo sapiens
cacctctgagga

SEQ ID NO: 622300 - DNA, 21 bp, Homo sapiens
cacctctgaggacagaggccg

SEQ ID NO: 622301 - DNA, 14 bp, Homo sapiens
cacctgaaatgcct

SEQ ID NO: 622302 - DNA, 15 bp, Homo sapiens
cacctgccaggcctc

SEQ ID NO: 622303 - DNA, 13 bp, Homo sapiens
cacctgcttctca

SEQ ID NO: 622304 - DNA, 14 bp, Homo sapiens
cacctggtggccct

SEQ ID NO: 622305 - DNA, 16 bp, Homo sapiens
cacctggtggccctgc

SEQ ID NO: 622306 - DNA, 17 bp, Homo sapiens
caccttacaaagccagc

SEQ ID NO: 622307 - DNA, 21 bp, Homo sapiens
caccttccctagttctttgca

SEQ ID NO: 622308 - DNA, 13 bp, Homo sapiens
caccttcctgccc

SEQ ID NO: 622309 - DNA, 14 bp, Homo sapiens
caccttcctgccca

SEQ ID NO: 622310 - DNA, 19 bp, Homo sapiens
caccttctgtgcatctggc

SEQ ID NO: 622311 - DNA, 17 bp, Homo sapiens
caccttgtacagaacca

SEQ ID NO: 622312 - DNA, 21 bp, Homo sapiens
caccttgtacagaaccagcac

SEQ ID NO: 622313 - DNA, 19 bp, Homo sapiens
cacgaatattgctgatggt

SEQ ID NO: 622314 - DNA, 17 bp, Homo sapiens
atcctgagccagatttc

SEQ ID NO: 622315 - DNA, 21 bp, Homo sapiens
atcctgagccagatttcactc

SEQ ID NO: 622316 - DNA, 17 bp, Homo sapiens
atcctgccttcatggaa

SEQ ID NO: 622317 - DNA, 22 bp, Homo sapiens
atccttaaaaagaccatgcatt

SEQ ID NO: 622318 - DNA, 23 bp, Homo sapiens
atccttccatcttgtggggccag

SEQ ID NO: 622319 - DNA, 18 bp, Homo sapiens
atccttcccgcagcacca

SEQ ID NO: 622320 - DNA, 18 bp, Homo sapiens
atccttgcacttctgtta

SEQ ID NO: 622321 - DNA, 18 bp, Homo sapiens
atccttgctgcagcttct

SEQ ID NO: 622322 - DNA, 19 bp, Homo sapiens
atccttgctgcagcttcta

SEQ ID NO: 622323 - DNA, 16 bp, Homo sapiens
atcgcagacgcaagag

SEQ ID NO: 622324 - DNA, 13 bp, Homo sapiens
atcgtattacata

SEQ ID NO: 622325 - DNA, 18 bp, Homo sapiens
atcgtattacataaaaca

SEQ ID NO: 622326 - DNA, 18 bp, Homo sapiens
atcgtgccgtggagcttg

SEQ ID NO: 622327 - DNA, 16 bp, Homo sapiens
atcgtttcacatctgt

SEQ ID NO: 622328 - DNA, 14 bp, Homo sapiens
atctaaatattatg

SEQ ID NO: 622329 - DNA, 16 bp, Homo sapiens
atctaaattaacttct

SEQ ID NO: 622330 - DNA, 12 bp, Homo sapiens
atctacaaactt

SEQ ID NO: 622331 - DNA, 15 bp, Homo sapiens
atctacaaactttta

SEQ ID NO: 622332 - DNA, 21 bp, Homo sapiens
atctacaaacttttataaatg

SEQ ID NO: 622333 - DNA, 22 bp, Homo sapiens
atctacaaacttttataaatgt

SEQ ID NO: 622334 - DNA, 21 bp, Homo sapiens
atctacacatataaacacagt

SEQ ID NO: 622335 - DNA, 20 bp, Homo sapiens
atctagtgccattatttcta

SEQ ID NO: 622336 - DNA, 18 bp, Homo sapiens
atctatttatctgtctga

SEQ ID NO: 622337 - DNA, 19 bp, Homo sapiens
atctatttatctgtctgag

SEQ ID NO: 622338 - DNA, 17 bp, Homo sapiens
atctcaaacactgctta

SEQ ID NO: 622339 - DNA, 18 bp, Homo sapiens
atctcaaatctgctttca

SEQ ID NO: 622340 - DNA, 23 bp, Homo sapiens
atctcaaatctgctttcatccag

SEQ ID NO: 622341 - DNA, 17 bp, Homo sapiens
atctcagcatcctggaa

SEQ ID NO: 622342 - DNA, 22 bp, Homo sapiens
atctcattcaggtgttctcttc

SEQ ID NO: 622343 - DNA, 21 bp, Homo sapiens
atctccaccctgagcctgacc

SEQ ID NO: 622344 - DNA, 16 bp, Homo sapiens
atctctcaaaatgtgc

SEQ ID NO: 622345 - DNA, 17 bp, Homo sapiens
atctctcaaaatgtgcc

SEQ ID NO: 622346 - DNA, 17 bp, Homo sapiens
atctctcacccagttca

SEQ ID NO: 622347 - DNA, 14 bp, Homo sapiens
atctcttcttcctt

SEQ ID NO: 622348 - DNA, 14 bp, Homo sapiens
atctgaaaactgga

SEQ ID NO: 622349 - DNA, 15 bp, Homo sapiens
atctgaaaactggaa

SEQ ID NO: 622350 - DNA, 15 bp, Homo sapiens
atctgaatttctaaa

SEQ ID NO: 622351 - DNA, 12 bp, Homo sapiens
atctgactgcca

SEQ ID NO: 622352 - DNA, 15 bp, Homo sapiens
atctgaggagtccaa

SEQ ID NO: 622353 - DNA, 16 bp, Homo sapiens
atctgaggagtccaaa

SEQ ID NO: 622354 - DNA, 22 bp, Homo sapiens
atctgatatcaggaaatatctg

SEQ ID NO: 622355 - DNA, 17 bp, Homo sapiens
atctgatgatgttctga

SEQ ID NO: 622356 - DNA, 12 bp, Homo sapiens
atctgcctggag

SEQ ID NO: 622357 - DNA, 11 bp, Homo sapiens
atctgctttca

SEQ ID NO: 622358 - DNA, 22 bp, Homo sapiens
atctggagtctgaaggagagga

SEQ ID NO: 622359 - DNA, 14 bp, Homo sapiens
atctggccattgca

SEQ ID NO: 622360 - DNA, 13 bp, Homo sapiens
atctggccctgac

SEQ ID NO: 622361 - DNA, 16 bp, Homo sapiens
atctgggttttagaaa

SEQ ID NO: 622362 - DNA, 13 bp, Homo sapiens
atctggtgcgtgt

SEQ ID NO: 622363 - DNA, 18 bp, Homo sapiens
atctggtgcgtgtggccc

SEQ ID NO: 622364 - DNA, 18 bp, Homo sapiens
atctgtatatcagctcta

SEQ ID NO: 622365 - DNA, 17 bp, Homo sapiens
atctgtcagcttcccaa

SEQ ID NO: 622366 - DNA, 16 bp, Homo sapiens
atctgtctgagccctg

SEQ ID NO: 622367 - DNA, 17 bp, Homo sapiens
atctgtctgagccctgc

SEQ ID NO: 622368 - DNA, 18 bp, Homo sapiens
atctgtctgagccctgcc

SEQ ID NO: 622369 - DNA, 19 bp, Homo sapiens
atctgtctgagccctgccc

SEQ ID NO: 622370 - DNA, 21 bp, Homo sapiens
atctgtctgagccctgccctc

SEQ ID NO: 622371 - DNA, 11 bp, Homo sapiens
atctgtcttta

SEQ ID NO: 622372 - DNA, 16 bp, Homo sapiens
atctgtggtcttcaaa

SEQ ID NO: 622373 - DNA, 19 bp, Homo sapiens
atctgttgtaatatcagtt

SEQ ID NO: 622374 - DNA, 20 bp, Homo sapiens
atctgttgtaatatcagtta

SEQ ID NO: 622375 - DNA, 13 bp, Homo sapiens
atcttaaaattgg

SEQ ID NO: 622376 - DNA, 16 bp, Homo sapiens
atcttaaacccacata

SEQ ID NO: 622377 - DNA, 20 bp, Homo sapiens
atcttaaccttcaaatacat

SEQ ID NO: 622378 - DNA, 17 bp, Homo sapiens
atcttacacgaagaaat

SEQ ID NO: 622379 - DNA, 18 bp, Homo sapiens
atcttacacgaagaaata

SEQ ID NO: 622380 - DNA, 23 bp, Homo sapiens
atcttacccttcaatgttaaatc

SEQ ID NO: 622381 - DNA, 16 bp, Homo sapiens
atcttaggatttacca

SEQ ID NO: 622382 - DNA, 17 bp, Homo sapiens
atcttgacaggcgccgc

SEQ ID NO: 622383 - DNA, 22 bp, Homo sapiens
atcttgacaggcgccgcctcgc

SEQ ID NO: 622384 - DNA, 15 bp, Homo sapiens
atcttgctgtgaaac

SEQ ID NO: 622385 - DNA, 23 bp, Homo sapiens
atcttgggattcctcccctggaa

SEQ ID NO: 622386 - DNA, 14 bp, Homo sapiens
atcttgtggggcca

SEQ ID NO: 622387 - DNA, 16 bp, Homo sapiens
atcttgtggggccagg

SEQ ID NO: 622388 - DNA, 17 bp, Homo sapiens
atctttgaaaactcata

SEQ ID NO: 622389 - DNA, 19 bp, Homo sapiens
atctttgaaaactcataca

SEQ ID NO: 622390 - DNA, 15 bp, Homo sapiens
atctttgttaaaata

SEQ ID NO: 622391 - DNA, 18 bp, Homo sapiens
atctttgttaaaatatag

SEQ ID NO: 622392 - DNA, 16 bp, Homo sapiens
atcttttcagccttgt

SEQ ID NO: 622393 - DNA, 21 bp, Homo sapiens
atgaaaaagcatgtacagtgt

SEQ ID NO: 622394 - DNA, 17 bp, Homo sapiens
atgaaaaatctgaattt

SEQ ID NO: 622395 - DNA, 15 bp, Homo sapiens
atgaaaagttttcaa

SEQ ID NO: 622396 - DNA, 19 bp, Homo sapiens
atgaaaatggctgaagaaa

SEQ ID NO: 622397 - DNA, 23 bp, Homo sapiens
atgaaaatggctgaagaaacaca

SEQ ID NO: 622398 - DNA, 14 bp, Homo sapiens
atgaaacaaatata

SEQ ID NO: 622399 - DNA, 15 bp, Homo sapiens
atgaaacaaatatac

SEQ ID NO: 622400 - DNA, 21 bp, Homo sapiens
atgaaacaaatatactcattt

SEQ ID NO: 622401 - DNA, 12 bp, Homo sapiens
atgaaagagaaa

SEQ ID NO: 622402 - DNA, 16 bp, Homo sapiens
atgaaagtcagtttaa

SEQ ID NO: 622403 - DNA, 17 bp, Homo sapiens
atgaaatataaactgtg

SEQ ID NO: 622404 - DNA, 16 bp, Homo sapiens
atgaaatttaagcaca

SEQ ID NO: 622405 - DNA, 18 bp, Homo sapiens
atgaaatttaagcacaaa

SEQ ID NO: 622406 - DNA, 21 bp, Homo sapiens
atgaagccctaagtaaatcta

SEQ ID NO: 622407 - DNA, 22 bp, Homo sapiens
atgaaggcaaaaactgtactgt

SEQ ID NO: 622408 - DNA, 19 bp, Homo sapiens
atgaagttaagcacaacca

SEQ ID NO: 622409 - DNA, 13 bp, Homo sapiens
atgaataaaatgt

SEQ ID NO: 622410 - DNA, 24 bp, Homo sapiens
atgaatccatcgatttgtattaat

SEQ ID NO: 622411 - DNA, 15 bp, Homo sapiens
atgaatgaaatataa

SEQ ID NO: 622412 - DNA, 21 bp, Homo sapiens
atgaatgaaatataaactgtg

SEQ ID NO: 622413 - DNA, 22 bp, Homo sapiens
atgaattgcctttgataattct

SEQ ID NO: 622414 - DNA, 13 bp, Homo sapiens
atgaatttaccat

SEQ ID NO: 622415 - DNA, 18 bp, Homo sapiens
atgacacgaatattgctg

SEQ ID NO: 622416 - DNA, 20 bp, Homo sapiens
atgacacgaatattgctgat

SEQ ID NO: 622417 - DNA, 20 bp, Homo sapiens
atgacagtggttatatttca

SEQ ID NO: 622418 - DNA, 14 bp, Homo sapiens
atgacccagcctga

SEQ ID NO: 622419 - DNA, 13 bp, Homo sapiens
atgacctcgttcc

SEQ ID NO: 622420 - DNA, 21 bp, Homo sapiens
atgacctttcaataggaaaaa

SEQ ID NO: 622421 - DNA, 23 bp, Homo sapiens
atgacctttcaataggaaaaact

SEQ ID NO: 622422 - DNA, 18 bp, Homo sapiens
atgactgacactcagatg

SEQ ID NO: 622423 - DNA, 20 bp, Homo sapiens
atgacttctttactaacact

SEQ ID NO: 622424 - DNA, 16 bp, Homo sapiens
atgagaaatataaaaa

SEQ ID NO: 622425 - DNA, 12 bp, Homo sapiens
atgagaaatcat

SEQ ID NO: 622426 - DNA, 15 bp, Homo sapiens
atgagaaatcatgtt

SEQ ID NO: 622427 - DNA, 17 bp, Homo sapiens
atgagacaacacacaca

SEQ ID NO: 622428 - DNA, 22 bp, Homo sapiens
atgagacttcctattaatttat

SEQ ID NO: 622429 - DNA, 12 bp, Homo sapiens
atgagaggaaat

SEQ ID NO: 622430 - DNA, 16 bp, Homo sapiens
agcctgcaggcaggtg

SEQ ID NO: 622431 - DNA, 21 bp, Homo sapiens
agcctgccaggccctccagca

SEQ ID NO: 622432 - DNA, 20 bp, Homo sapiens
agcctggattccagcagtga

SEQ ID NO: 622433 - DNA, 13 bp, Homo sapiens
agcctgtctctcc

SEQ ID NO: 622434 - DNA, 21 bp, Homo sapiens
agccttaagtcttactgtttt

SEQ ID NO: 622435 - DNA, 15 bp, Homo sapiens
agccttattaaaata

SEQ ID NO: 622436 - DNA, 21 bp, Homo sapiens
agccttattaaaatattttct

SEQ ID NO: 622437 - DNA, 16 bp, Homo sapiens
agccttgctgggccag

SEQ ID NO: 622438 - DNA, 18 bp, Homo sapiens
agccttgctgggccaggg

SEQ ID NO: 622439 - DNA, 20 bp, Homo sapiens
agcctttctccagcccatgc

SEQ ID NO: 622440 - DNA, 21 bp, Homo sapiens
agcctttctccagcccatgct

SEQ ID NO: 622441 - DNA, 17 bp, Homo sapiens
agcctttgcgctctggg

SEQ ID NO: 622442 - DNA, 21 bp, Homo sapiens
agcgaggcagaatggtgggct

SEQ ID NO: 622443 - DNA, 20 bp, Homo sapiens
agcgcacctcgccgtgtctt

SEQ ID NO: 622444 - DNA, 14 bp, Homo sapiens
agcgcagcccccac

SEQ ID NO: 622445 - DNA, 15 bp, Homo sapiens
agcgcatggcgcccc

SEQ ID NO: 622446 - DNA, 19 bp, Homo sapiens
agcgcatggcgccccgggc

SEQ ID NO: 622447 - DNA, 20 bp, Homo sapiens
agcgcatggcgccccgggcc

SEQ ID NO: 622448 - DNA, 15 bp, Homo sapiens
agcgcccgaggccag

SEQ ID NO: 622449 - DNA, 22 bp, Homo sapiens
agataattaaatgaaatacttg

SEQ ID NO: 622450 - DNA, 15 bp, Homo sapiens
agatacacaaaatat

SEQ ID NO: 622451 - DNA, 20 bp, Homo sapiens
agataccattttgaaatatt

SEQ ID NO: 622452 - DNA, 17 bp, Homo sapiens
agataccctctgagaca

SEQ ID NO: 622453 - DNA, 17 bp, Homo sapiens
agataggttctgctttc

SEQ ID NO: 622454 - DNA, 18 bp, Homo sapiens
agatatatctgaaaactg

SEQ ID NO: 622455 - DNA, 20 bp, Homo sapiens
agatatatctgaaaactgga

SEQ ID NO: 622456 - DNA, 21 bp, Homo sapiens
agatatatctgaaaactggaa

SEQ ID NO: 622457 - DNA, 21 bp, Homo sapiens
agatatgagaaatataaaaat

SEQ ID NO: 622458 - DNA, 23 bp, Homo sapiens
agatatgagaaatataaaaataa

SEQ ID NO: 622459 - DNA, 15 bp, Homo sapiens
agatcaactcatgtt

SEQ ID NO: 622460 - DNA, 15 bp, Homo sapiens
agatcacatgcccct

SEQ ID NO: 622461 - DNA, 23 bp, Homo sapiens
agatccatcggtttatactattt

SEQ ID NO: 622462 - DNA, 22 bp, Homo sapiens
agatcctccgcggaggcccctg

SEQ ID NO: 622463 - DNA, 17 bp, Homo sapiens
agatctcctgtgcacct

SEQ ID NO: 622464 - DNA, 15 bp, Homo sapiens
agatctgactgccaa

SEQ ID NO: 622465 - DNA, 12 bp, Homo sapiens
agatcttgagca

SEQ ID NO: 622466 - DNA, 18 bp, Homo sapiens
agatctttttttaagtgt

SEQ ID NO: 622467 - DNA, 17 bp, Homo sapiens
agatgaaaaagcatgta

SEQ ID NO: 622468 - DNA, 21 bp, Homo sapiens
agatgaaaaagcatgtacagt

SEQ ID NO: 622469 - DNA, 22 bp, Homo sapiens
agatgaaaaagcatgtacagtg

SEQ ID NO: 622470 - DNA, 22 bp, Homo sapiens
agatgacccccaggtattgtct

SEQ ID NO: 622471 - DNA, 16 bp, Homo sapiens
agatgatttaattctt

SEQ ID NO: 622472 - DNA, 18 bp, Homo sapiens
agatggatttgacacact

SEQ ID NO: 622473 - DNA, 21 bp, Homo sapiens
agatgggaaggttagaaaggc

SEQ ID NO: 622474 - DNA, 18 bp, Homo sapiens
agatggggagggcgcttt

SEQ ID NO: 622475 - DNA, 17 bp, Homo sapiens
agatggggcctgggctg

SEQ ID NO: 622476 - DNA, 18 bp, Homo sapiens
agatgggttgagtttgct

SEQ ID NO: 622477 - DNA, 14 bp, Homo sapiens
agatgtaatacacc

SEQ ID NO: 622478 - DNA, 15 bp, Homo sapiens
agatgttttagttta

SEQ ID NO: 622479 - DNA, 22 bp, Homo sapiens
agattaagttataccagcaaaa

SEQ ID NO: 622480 - DNA, 18 bp, Homo sapiens
agattaataacagaaata

SEQ ID NO: 622481 - DNA, 21 bp, Homo sapiens
agattatatacaaagctgtca

SEQ ID NO: 622482 - DNA, 14 bp, Homo sapiens
agattattttctat

SEQ ID NO: 622483 - DNA, 15 bp, Homo sapiens
agattattttctata

SEQ ID NO: 622484 - DNA, 14 bp, Homo sapiens
agattcctacttaa

SEQ ID NO: 622485 - DNA, 16 bp, Homo sapiens
agattcctacttaaac

SEQ ID NO: 622486 - DNA, 18 bp, Homo sapiens
agattgaagctaaaacac

SEQ ID NO: 622487 - DNA, 16 bp, Homo sapiens
agattgcgtggacccc

SEQ ID NO: 622488 - DNA, 21 bp, Homo sapiens
agattgtacttttatcttaaa

SEQ ID NO: 622489 - DNA, 15 bp, Homo sapiens
agatttgagctgcct

SEQ ID NO: 622490 - DNA, 20 bp, Homo sapiens
agattttaaaacttcatctg

SEQ ID NO: 622491 - DNA, 15 bp, Homo sapiens
agattttatgtttaa

SEQ ID NO: 622492 - DNA, 16 bp, Homo sapiens
agattttatgtttaaa

SEQ ID NO: 622493 - DNA, 19 bp, Homo sapiens
agattttccttttttatac

SEQ ID NO: 622494 - DNA, 14 bp, Homo sapiens
agattttgttttgc

SEQ ID NO: 622495 - DNA, 22 bp, Homo sapiens
agattttgttttgctttttctg

SEQ ID NO: 622496 - DNA, 16 bp, Homo sapiens
agatttttagattcct

SEQ ID NO: 622497 - DNA, 13 bp, Homo sapiens
agcaaaaggatga

SEQ ID NO: 622498 - DNA, 13 bp, Homo sapiens
agcaaaatatatg

SEQ ID NO: 622499 - DNA, 21 bp, Homo sapiens
agcaaacaactttctggaaaa

SEQ ID NO: 622500 - DNA, 13 bp, Homo sapiens
agcaaacacacag

SEQ ID NO: 622501 - DNA, 20 bp, Homo sapiens
agcaaagcatgccaatttct

SEQ ID NO: 622502 - DNA, 15 bp, Homo sapiens
agcaaagttttcaga

SEQ ID NO: 622503 - DNA, 15 bp, Homo sapiens
agcaaattaattggc

SEQ ID NO: 622504 - DNA, 22 bp, Homo sapiens
agcaaattaattggcagcagat

SEQ ID NO: 622505 - DNA, 19 bp, Homo sapiens
agcaacgggaacacctgct

SEQ ID NO: 622506 - DNA, 21 bp, Homo sapiens
agcaactgtctatttctgctg

SEQ ID NO: 622507 - DNA, 17 bp, Homo sapiens
agcaaggcaagaagtgg

SEQ ID NO: 622508 - DNA, 20 bp, Homo sapiens
agcaaggcaagaagtgggat

SEQ ID NO: 622509 - DNA, 23 bp, Homo sapiens
agcaaggtgggggtcaggctaca

SEQ ID NO: 622510 - DNA, 16 bp, Homo sapiens
agcaataagttgaatg

SEQ ID NO: 622511 - DNA, 17 bp, Homo sapiens
agcaatccttaaaaaga

SEQ ID NO: 622512 - DNA, 21 bp, Homo sapiens
agcaatccttaaaaagaccat

SEQ ID NO: 622513 - DNA, 23 bp, Homo sapiens
agcaatcttgctgtgaaacagtg

SEQ ID NO: 622514 - DNA, 17 bp, Homo sapiens
agcacaagggcacattg

SEQ ID NO: 622515 - DNA, 14 bp, Homo sapiens
agcacacacatctg

SEQ ID NO: 622516 - DNA, 17 bp, Homo sapiens
agcacacacatctggcc

SEQ ID NO: 622517 - DNA, 19 bp, Homo sapiens
agcacacacatctggccct

SEQ ID NO: 622518 - DNA, 16 bp, Homo sapiens
agcacagagagcggct

SEQ ID NO: 622519 - DNA, 21 bp, Homo sapiens
agcacagaggatggcttcccc

SEQ ID NO: 622520 - DNA, 22 bp, Homo sapiens
agcacagaggatggcttcccca

SEQ ID NO: 622521 - DNA, 16 bp, Homo sapiens
agcacagtatttaaca

SEQ ID NO: 622522 - DNA, 19 bp, Homo sapiens
agcacagtatttaacattc

SEQ ID NO: 622523 - DNA, 16 bp, Homo sapiens
agcaccacggggtcgg

SEQ ID NO: 622524 - DNA, 22 bp, Homo sapiens
agcaccacggggtcgggggagg

SEQ ID NO: 622525 - DNA, 15 bp, Homo sapiens
agcaccagcctgagc

SEQ ID NO: 622526 - DNA, 11 bp, Homo sapiens
agcaccagctt

SEQ ID NO: 622527 - DNA, 13 bp, Homo sapiens
agcaccagcttgc

SEQ ID NO: 622528 - DNA, 14 bp, Homo sapiens
agcacccccagcct

SEQ ID NO: 622529 - DNA, 21 bp, Homo sapiens
agcacccccagcctcccccag

SEQ ID NO: 622530 - DNA, 17 bp, Homo sapiens
agcaccgtggtgtgagg

SEQ ID NO: 622531 - DNA, 22 bp, Homo sapiens
agcacctcttgaagaactgact

SEQ ID NO: 622532 - DNA, 23 bp, Homo sapiens
agcacgttttccattatgaggaa

SEQ ID NO: 622533 - DNA, 17 bp, Homo sapiens
agcactagaatgagaaa

SEQ ID NO: 622534 - DNA, 19 bp, Homo sapiens
agcactagaatgagaaatc

SEQ ID NO: 622535 - DNA, 20 bp, Homo sapiens
agcactatcgaggtatttgg

SEQ ID NO: 622536 - DNA, 17 bp, Homo sapiens
agcactttataagccaa

SEQ ID NO: 622537 - DNA, 22 bp, Homo sapiens
agcagacacacacatatataca

SEQ ID NO: 622538 - DNA, 13 bp, Homo sapiens
agcagacattgtc

SEQ ID NO: 622539 - DNA, 17 bp, Homo sapiens
agcagagacggcagccc

SEQ ID NO: 622540 - DNA, 18 bp, Homo sapiens
agcagagacggcagcccc

SEQ ID NO: 622541 - DNA, 17 bp, Homo sapiens
agcagattttaggaaat

SEQ ID NO: 622542 - DNA, 20 bp, Homo sapiens
agcagcaaggtgggggtcag

SEQ ID NO: 622543 - DNA, 16 bp, Homo sapiens
acttagggagtgtgcc

SEQ ID NO: 622544 - DNA, 17 bp, Homo sapiens
acttatttataacattg

SEQ ID NO: 622545 - DNA, 12 bp, Homo sapiens
acttattttgat

SEQ ID NO: 622546 - DNA, 15 bp, Homo sapiens
acttattttgattgt

SEQ ID NO: 622547 - DNA, 12 bp, Homo sapiens
acttcaaatgtc

SEQ ID NO: 622548 - DNA, 19 bp, Homo sapiens
acttcaaatgtcatttcat

SEQ ID NO: 622549 - DNA, 24 bp, Homo sapiens
acttcaaatgtcatttcatacaaa

SEQ ID NO: 622550 - DNA, 18 bp, Homo sapiens
acttcagaaactttttct

SEQ ID NO: 622551 - DNA, 13 bp, Homo sapiens
acttcagactctc

SEQ ID NO: 622552 - DNA, 20 bp, Homo sapiens
acttcagactctctcctctc

SEQ ID NO: 622553 - DNA, 19 bp, Homo sapiens
acttcagatgtttccaaga

SEQ ID NO: 622554 - DNA, 13 bp, Homo sapiens
acttcatttaaca

SEQ ID NO: 622555 - DNA, 17 bp, Homo sapiens
acttcatttaacactga

SEQ ID NO: 622556 - DNA, 12 bp, Homo sapiens
acttcccagctg

SEQ ID NO: 622557 - DNA, 20 bp, Homo sapiens
acttcccagctggcagcgcc

SEQ ID NO: 622558 - DNA, 12 bp, Homo sapiens
acttccttaaca

SEQ ID NO: 622559 - DNA, 14 bp, Homo sapiens
acttccttaacagc

SEQ ID NO: 622560 - DNA, 18 bp, Homo sapiens
acttctactgttcaattt

SEQ ID NO: 622561 - DNA, 22 bp, Homo sapiens
acttctattttcaagtggaaac

SEQ ID NO: 622562 - DNA, 23 bp, Homo sapiens
acttctggagatggatccttcca

SEQ ID NO: 622563 - DNA, 17 bp, Homo sapiens
acttgaaattatatctg

SEQ ID NO: 622564 - DNA, 14 bp, Homo sapiens
acttgattaaggac

SEQ ID NO: 622565 - DNA, 18 bp, Homo sapiens
acttgctgtgaaatgact

SEQ ID NO: 622566 - DNA, 20 bp, Homo sapiens
acttggtgattacctgaaag

SEQ ID NO: 622567 - DNA, 19 bp, Homo sapiens
acttgtacttacactgaaa

SEQ ID NO: 622568 - DNA, 14 bp, Homo sapiens
acttgtattggaag

SEQ ID NO: 622569 - DNA, 16 bp, Homo sapiens
acttgttatgttgtaa

SEQ ID NO: 622570 - DNA, 18 bp, Homo sapiens
acttgttatgttgtaata

SEQ ID NO: 622571 - DNA, 19 bp, Homo sapiens
acttgttatgttgtaatat

SEQ ID NO: 622572 - DNA, 15 bp, Homo sapiens
actttaaattgtgga

SEQ ID NO: 622573 - DNA, 17 bp, Homo sapiens
actttccatgacagtag

SEQ ID NO: 622574 - DNA, 20 bp, Homo sapiens
actttccatgacagtagcat

SEQ ID NO: 622575 - DNA, 21 bp, Homo sapiens
actttccatgacagtagcata

SEQ ID NO: 622576 - DNA, 12 bp, Homo sapiens
actttcccacac

SEQ ID NO: 622577 - DNA, 14 bp, Homo sapiens
actttcctatgaca

SEQ ID NO: 622578 - DNA, 12 bp, Homo sapiens
actttctcagca

SEQ ID NO: 622579 - DNA, 18 bp, Homo sapiens
actttctcagcatatata

SEQ ID NO: 622580 - DNA, 19 bp, Homo sapiens
actttctcagcatatatat

SEQ ID NO: 622581 - DNA, 19 bp, Homo sapiens
actttctgaaattcacaaa

SEQ ID NO: 622582 - DNA, 15 bp, Homo sapiens
actttctttaacata

SEQ ID NO: 622583 - DNA, 21 bp, Homo sapiens
actttggggacaccctcctgc

SEQ ID NO: 622584 - DNA, 14 bp, Homo sapiens
actttgtgtctttt

SEQ ID NO: 622585 - DNA, 19 bp, Homo sapiens
actttgtgtcttttgttct

SEQ ID NO: 622586 - DNA, 17 bp, Homo sapiens
acttttataaatgtttt

SEQ ID NO: 622587 - DNA, 23 bp, Homo sapiens
acttttataaatgttttaaagaa

SEQ ID NO: 622588 - DNA, 22 bp, Homo sapiens
acttttattgtataattatgaa

SEQ ID NO: 622589 - DNA, 12 bp, Homo sapiens
acttttttataa

SEQ ID NO: 622590 - DNA, 23 bp, Homo sapiens
acttttttataaattataatgca

SEQ ID NO: 622591 - DNA, 21 bp, Homo sapiens
acttttttcctgtcaatatat

SEQ ID NO: 622592 - DNA, 20 bp, Homo sapiens
agaaaaaagtgcaacttgag

SEQ ID NO: 622593 - DNA, 20 bp, Homo sapiens
agaaaacagaccagcatagt

SEQ ID NO: 622594 - DNA, 11 bp, Homo sapiens
agaaaacattg

SEQ ID NO: 622595 - DNA, 13 bp, Homo sapiens
agaaaacattgtt

SEQ ID NO: 622596 - DNA, 20 bp, Homo sapiens
agaaaaccccacagaaatct

SEQ ID NO: 622597 - DNA, 18 bp, Homo sapiens
agaaaatgagatgggttg

SEQ ID NO: 622598 - DNA, 16 bp, Homo sapiens
agaaaatgctttctca

SEQ ID NO: 622599 - DNA, 17 bp, Homo sapiens
agaaaatgctttctcat

SEQ ID NO: 622600 - DNA, 13 bp, Homo sapiens
agaaaatttaaaa

SEQ ID NO: 622601 - DNA, 15 bp, Homo sapiens
agaaacaaaatataa

SEQ ID NO: 622602 - DNA, 13 bp, Homo sapiens
agaaacacagcat

SEQ ID NO: 622603 - DNA, 14 bp, Homo sapiens
agaaacacagcatg

SEQ ID NO: 622604 - DNA, 18 bp, Homo sapiens
agaaacacagcatgcatt

SEQ ID NO: 622605 - DNA, 20 bp, Homo sapiens
agaaacacggagtttccatt

SEQ ID NO: 622606 - DNA, 16 bp, Homo sapiens
agaaacagtttaacag

SEQ ID NO: 622607 - DNA, 23 bp, Homo sapiens
agaaaccttttaaaaaaataata

SEQ ID NO: 622608 - DNA, 14 bp, Homo sapiens
agaaactaagaatc

SEQ ID NO: 622609 - DNA, 22 bp, Homo sapiens
agaaactcgggcactccctaag

SEQ ID NO: 622610 - DNA, 14 bp, Homo sapiens
agaaactttttcta

SEQ ID NO: 622611 - DNA, 12 bp, Homo sapiens
agaaagaaaaaa

SEQ ID NO: 622612 - DNA, 15 bp, Homo sapiens
agaaagaggaataaa

SEQ ID NO: 622613 - DNA, 13 bp, Homo sapiens
agaaaggagggca

SEQ ID NO: 622614 - DNA, 14 bp, Homo sapiens
agaaaggcagccct

SEQ ID NO: 622615 - DNA, 22 bp, Homo sapiens
agaaagggagaaggattctttt

SEQ ID NO: 622616 - DNA, 21 bp, Homo sapiens
agaaagggcagcccctcccca

SEQ ID NO: 622617 - DNA, 13 bp, Homo sapiens
agaaagtcatagt

SEQ ID NO: 622618 - DNA, 16 bp, Homo sapiens
agaaatataaaaataa

SEQ ID NO: 622619 - DNA, 12 bp, Homo sapiens
agaaatgagaaa

SEQ ID NO: 622620 - DNA, 17 bp, Homo sapiens
agaaatgagtgataaat

SEQ ID NO: 622621 - DNA, 20 bp, Homo sapiens
agaaattagggctctaattt

SEQ ID NO: 622622 - DNA, 12 bp, Homo sapiens
agaaattctata

SEQ ID NO: 622623 - DNA, 15 bp, Homo sapiens
agaaattctataaga

SEQ ID NO: 622624 - DNA, 19 bp, Homo sapiens
agaaattgtgccaaagata

SEQ ID NO: 622625 - DNA, 20 bp, Homo sapiens
agaaattgtgccaaagatag

SEQ ID NO: 622626 - DNA, 12 bp, Homo sapiens
agaaatttacaa

SEQ ID NO: 622627 - DNA, 16 bp, Homo sapiens
agaaatttttttccag

SEQ ID NO: 622628 - DNA, 17 bp, Homo sapiens
agaaccaacgggtctgt

SEQ ID NO: 622629 - DNA, 20 bp, Homo sapiens
agaaccagcactcccagggc

SEQ ID NO: 622630 - DNA, 19 bp, Homo sapiens
agaacctgtagaagatgac

SEQ ID NO: 622631 - DNA, 14 bp, Homo sapiens
agaacgcatgcagg

SEQ ID NO: 622632 - DNA, 16 bp, Homo sapiens
agaacgcatgcagggc

SEQ ID NO: 622633 - DNA, 22 bp, Homo sapiens
acctcagttggcctctgcccct

SEQ ID NO: 622634 - DNA, 18 bp, Homo sapiens
acctccacagtagcattt

SEQ ID NO: 622635 - DNA, 11 bp, Homo sapiens
acctccacccg

SEQ ID NO: 622636 - DNA, 19 bp, Homo sapiens
acctccagattattttcta

SEQ ID NO: 622637 - DNA, 20 bp, Homo sapiens
acctccagattattttctat

SEQ ID NO: 622638 - DNA, 22 bp, Homo sapiens
acctccagattattttctatat

SEQ ID NO: 622639 - DNA, 18 bp, Homo sapiens
acctccccagagccctgc

SEQ ID NO: 622640 - DNA, 19 bp, Homo sapiens
acctccccagagccctgca

SEQ ID NO: 622641 - DNA, 16 bp, Homo sapiens
acctcccctggtcctg

SEQ ID NO: 622642 - DNA, 22 bp, Homo sapiens
acctcctccgtgggcagctcct

SEQ ID NO: 622643 - DNA, 15 bp, Homo sapiens
acctcgccgtgtctt

SEQ ID NO: 622644 - DNA, 16 bp, Homo sapiens
acctcggacaccatct

SEQ ID NO: 622645 - DNA, 13 bp, Homo sapiens
acctcggctgtgt

SEQ ID NO: 622646 - DNA, 20 bp, Homo sapiens
acctcggctgtgtggggagg

SEQ ID NO: 622647 - DNA, 17 bp, Homo sapiens
acctctcacttttttat

SEQ ID NO: 622648 - DNA, 17 bp, Homo sapiens
acctctcagatccctcg

SEQ ID NO: 622649 - DNA, 12 bp, Homo sapiens
acctcttgtttt

SEQ ID NO: 622650 - DNA, 14 bp, Homo sapiens
acctgaaagccctt

SEQ ID NO: 622651 - DNA, 16 bp, Homo sapiens
acctgaaagcccttct

SEQ ID NO: 622652 - DNA, 19 bp, Homo sapiens
acctgacagcaaacacagt

SEQ ID NO: 622653 - DNA, 19 bp, Homo sapiens
acctgccaggcctccctcg

SEQ ID NO: 622654 - DNA, 10 bp, Homo sapiens
acctgcccag

SEQ ID NO: 622655 - DNA, 20 bp, Homo sapiens
acctgcccagttagcccggc

SEQ ID NO: 622656 - DNA, 22 bp, Homo sapiens
acctgcccagttagcccggcca

SEQ ID NO: 622657 - DNA, 16 bp, Homo sapiens
acctgccttgcctgtt

SEQ ID NO: 622658 - DNA, 15 bp, Homo sapiens
acctgctcctgccca

SEQ ID NO: 622659 - DNA, 20 bp, Homo sapiens
acctggccggtaggctgctg

SEQ ID NO: 622660 - DNA, 21 bp, Homo sapiens
acctggccggtaggctgctgg

SEQ ID NO: 622661 - DNA, 16 bp, Homo sapiens
acctgtacacacacag

SEQ ID NO: 622662 - DNA, 20 bp, Homo sapiens
acctgtacacacacagacac

SEQ ID NO: 622663 - DNA, 16 bp, Homo sapiens
acctgtaggtctatga

SEQ ID NO: 622664 - DNA, 13 bp, Homo sapiens
acctgtgctttca

SEQ ID NO: 622665 - DNA, 22 bp, Homo sapiens
acctgtgctttcatgtttaaga

SEQ ID NO: 622666 - DNA, 18 bp, Homo sapiens
accttagcagctcttccc

SEQ ID NO: 622667 - DNA, 19 bp, Homo sapiens
accttagcagctcttcccc

SEQ ID NO: 622668 - DNA, 14 bp, Homo sapiens
accttcaaatacat

SEQ ID NO: 622669 - DNA, 17 bp, Homo sapiens
accttccctagttcttt

SEQ ID NO: 622670 - DNA, 12 bp, Homo sapiens
accttcctgccc

SEQ ID NO: 622671 - DNA, 19 bp, Homo sapiens
accttcggcagtggctggg

SEQ ID NO: 622672 - DNA, 19 bp, Homo sapiens
accttctgatgaagttgta

SEQ ID NO: 622673 - DNA, 16 bp, Homo sapiens
accttggagaggagag

SEQ ID NO: 622674 - DNA, 12 bp, Homo sapiens
acgaagaaatag

SEQ ID NO: 622675 - DNA, 18 bp, Homo sapiens
acgagaggtatgcctgta

SEQ ID NO: 622676 - DNA, 22 bp, Homo sapiens
acgagcagagcgcagcccccac

SEQ ID NO: 622677 - DNA, 16 bp, Homo sapiens
acgaggcttctctaac

SEQ ID NO: 622678 - DNA, 21 bp, Homo sapiens
acgcacacacacgcaaataca

SEQ ID NO: 622679 - DNA, 12 bp, Homo sapiens
acgcagagcccc

SEQ ID NO: 622680 - DNA, 14 bp, Homo sapiens
acgcagagccccgg

SEQ ID NO: 622681 - DNA, 17 bp, Homo sapiens
acgccacggccgtgttc

SEQ ID NO: 622682 - DNA, 13 bp, Homo sapiens
acgcccagccccc

SEQ ID NO: 622683 - DNA, 18 bp, Homo sapiens
acgcccagcccccacccc

SEQ ID NO: 622684 - DNA, 19 bp, Homo sapiens
acgcccagcccccaccccc

SEQ ID NO: 622685 - DNA, 23 bp, Homo sapiens
acgcccagcccccacccccgtca

SEQ ID NO: 622686 - DNA, 17 bp, Homo sapiens
acgcccctccccagccc

SEQ ID NO: 622687 - DNA, 16 bp, Homo sapiens
acgcccctttctcttg

SEQ ID NO: 622688 - DNA, 22 bp, Homo sapiens
acgccgatataagccatagccc

SEQ ID NO: 622689 - DNA, 21 bp, Homo sapiens
acgccggggctggccctgccc

SEQ ID NO: 622690 - DNA, 23 bp, Homo sapiens
acgcggctgctgcttctccctgg

SEQ ID NO: 622691 - DNA, 15 bp, Homo sapiens
acgctggagaccctg

SEQ ID NO: 622692 - DNA, 14 bp, Homo sapiens
acggaagtggcctg

SEQ ID NO: 622693 - DNA, 14 bp, Homo sapiens
acggacgggacagc

SEQ ID NO: 622694 - DNA, 18 bp, Homo sapiens
acggacgggacagcggcc

SEQ ID NO: 622695 - DNA, 21 bp, Homo sapiens
acggagtttccatttggattt

SEQ ID NO: 622696 - DNA, 11 bp, Homo sapiens
acggcagcccc

SEQ ID NO: 622697 - DNA, 14 bp, Homo sapiens
acggcagccccatc

SEQ ID NO: 622698 - DNA, 14 bp, Homo sapiens
acggccgtccctga

SEQ ID NO: 622699 - DNA, 23 bp, Homo sapiens
acggccgtccctgacttcccagc

SEQ ID NO: 622700 - DNA, 17 bp, Homo sapiens
acgggacagcggcccgg

SEQ ID NO: 622701 - DNA, 13 bp, Homo sapiens
acggggcagagct

SEQ ID NO: 622702 - DNA, 15 bp, Homo sapiens
acggggcagagctga

SEQ ID NO: 622703 - DNA, 22 bp, Homo sapiens
acgggtctgtgggactggccca

SEQ ID NO: 622704 - DNA, 16 bp, Homo sapiens
acggtgagactctgag

SEQ ID NO: 622705 - DNA, 17 bp, Homo sapiens
acgtatatttttaactg

SEQ ID NO: 622706 - DNA, 17 bp, Homo sapiens
acgtcatctagttttaa

SEQ ID NO: 622707 - DNA, 18 bp, Homo sapiens
acgtctcaggttattcgt

SEQ ID NO: 622708 - DNA, 16 bp, Homo sapiens
acgtctgtgagtctgt

SEQ ID NO: 622709 - DNA, 21 bp, Homo sapiens
acgtgaggcccctgtgcagta

SEQ ID NO: 622710 - DNA, 16 bp, Homo sapiens
acgtgcaacagactgc

SEQ ID NO: 622711 - DNA, 20 bp, Homo sapiens
acgtgcaacagactgcctta

SEQ ID NO: 622712 - DNA, 17 bp, Homo sapiens
acgtgcagcacctgtca

SEQ ID NO: 622713 - DNA, 18 bp, Homo sapiens
acgtgcccatttcacaca

SEQ ID NO: 622714 - DNA, 11 bp, Homo sapiens
acgtggctgct

SEQ ID NO: 622715 - DNA, 16 bp, Homo sapiens
acatgggccagccctt

SEQ ID NO: 622716 - DNA, 18 bp, Homo sapiens
acatgtggggacagggct

SEQ ID NO: 622717 - DNA, 13 bp, Homo sapiens
acatgttttacaa

SEQ ID NO: 622718 - DNA, 15 bp, Homo sapiens
acatgttttacaaag

SEQ ID NO: 622719 - DNA, 20 bp, Homo sapiens
acatgttttacaaagaaaca

SEQ ID NO: 622720 - DNA, 16 bp, Homo sapiens
acattaattgaggctt

SEQ ID NO: 622721 - DNA, 15 bp, Homo sapiens
acattatagattttc

SEQ ID NO: 622722 - DNA, 20 bp, Homo sapiens
acattccagtgtattttctg

SEQ ID NO: 622723 - DNA, 23 bp, Homo sapiens
acattcctaagagtggaggagga

SEQ ID NO: 622724 - DNA, 11 bp, Homo sapiens
acattcctgac

SEQ ID NO: 622725 - DNA, 13 bp, Homo sapiens
acattcctgaccc

SEQ ID NO: 622726 - DNA, 19 bp, Homo sapiens
acattcctgaccctcactt

SEQ ID NO: 622727 - DNA, 21 bp, Homo sapiens
acattcggaggtcaagaaagc

SEQ ID NO: 622728 - DNA, 14 bp, Homo sapiens
acattcttgctctg

SEQ ID NO: 622729 - DNA, 16 bp, Homo sapiens
acattgaaactgtatt

SEQ ID NO: 622730 - DNA, 14 bp, Homo sapiens
acattgccttatat

SEQ ID NO: 622731 - DNA, 15 bp, Homo sapiens
acattgcttcattaa

SEQ ID NO: 622732 - DNA, 14 bp, Homo sapiens
acattggcagtgtg

SEQ ID NO: 622733 - DNA, 17 bp, Homo sapiens
acattggcagtgtgtca

SEQ ID NO: 622734 - DNA, 17 bp, Homo sapiens
acattgtcagaatgttg

SEQ ID NO: 622735 - DNA, 18 bp, Homo sapiens
acattgtcagaatgttgt

SEQ ID NO: 622736 - DNA, 15 bp, Homo sapiens
acatttatgtacaaa

SEQ ID NO: 622737 - DNA, 20 bp, Homo sapiens
acatttatgtacaaaatgaa

SEQ ID NO: 622738 - DNA, 14 bp, Homo sapiens
acatttatgtgtga

SEQ ID NO: 622739 - DNA, 13 bp, Homo sapiens
acatttccctgct

SEQ ID NO: 622740 - DNA, 13 bp, Homo sapiens
acatttgggctca

SEQ ID NO: 622741 - DNA, 15 bp, Homo sapiens
acatttgggctcagg

SEQ ID NO: 622742 - DNA, 19 bp, Homo sapiens
acatttgttaatgattctt

SEQ ID NO: 622743 - DNA, 15 bp, Homo sapiens
acattttaaatggac

SEQ ID NO: 622744 - DNA, 18 bp, Homo sapiens
acattttaaatggacaga

SEQ ID NO: 622745 - DNA, 14 bp, Homo sapiens
acattttcaagaca

SEQ ID NO: 622746 - DNA, 12 bp, Homo sapiens
acattttgtagc

SEQ ID NO: 622747 - DNA, 14 bp, Homo sapiens
accaaattgctgag

SEQ ID NO: 622748 - DNA, 20 bp, Homo sapiens
accaaggtgcggaccggagc

SEQ ID NO: 622749 - DNA, 18 bp, Homo sapiens
accaatttagaatgaata

SEQ ID NO: 622750 - DNA, 13 bp, Homo sapiens
accacacacaccc

SEQ ID NO: 622751 - DNA, 22 bp, Homo sapiens
accacacctaaattaacaaatt

SEQ ID NO: 622752 - DNA, 13 bp, Homo sapiens
accacatttctgg

SEQ ID NO: 622753 - DNA, 14 bp, Homo sapiens
accacccctgtgcg

SEQ ID NO: 622754 - DNA, 23 bp, Homo sapiens
accaccctatcatcagttaggat

SEQ ID NO: 622755 - DNA, 14 bp, Homo sapiens
accaccgcgcccct

SEQ ID NO: 622756 - DNA, 16 bp, Homo sapiens
accaccgcgcccctct

SEQ ID NO: 622757 - DNA, 17 bp, Homo sapiens
accaccgcgcccctctg

SEQ ID NO: 622758 - DNA, 18 bp, Homo sapiens
accaccgcgcccctctgc

SEQ ID NO: 622759 - DNA, 14 bp, Homo sapiens
accaccttaaaaca

SEQ ID NO: 622760 - DNA, 12 bp, Homo sapiens
accacgcccctg

SEQ ID NO: 622761 - DNA, 19 bp, Homo sapiens
accacggggtcgggggagg

SEQ ID NO: 622762 - DNA, 23 bp, Homo sapiens
accacggggtcgggggaggagca

SEQ ID NO: 622763 - DNA, 23 bp, Homo sapiens
accacggtccaatccagccttct

SEQ ID NO: 622764 - DNA, 14 bp, Homo sapiens
accacttccttaac

SEQ ID NO: 622765 - DNA, 16 bp, Homo sapiens
accacttccttaacag

SEQ ID NO: 622766 - DNA, 17 bp, Homo sapiens
accacttccttaacagc

SEQ ID NO: 622767 - DNA, 20 bp, Homo sapiens
accagaaaatttttgtcttt

SEQ ID NO: 622768 - DNA, 17 bp, Homo sapiens
accagaagtttaaatct

SEQ ID NO: 622769 - DNA, 17 bp, Homo sapiens
accagaatgaggcacat

SEQ ID NO: 622770 - DNA, 23 bp, Homo sapiens
accagaatgaggcacatgacagt

SEQ ID NO: 622771 - DNA, 13 bp, Homo sapiens
accagagcactgt

SEQ ID NO: 622772 - DNA, 14 bp, Homo sapiens
accagcactcccag

SEQ ID NO: 622773 - DNA, 18 bp, Homo sapiens
accagcatagttctgcaa

SEQ ID NO: 622774 - DNA, 15 bp, Homo sapiens
accagcctgagccac

SEQ ID NO: 622775 - DNA, 17 bp, Homo sapiens
accagttccctcagccc

SEQ ID NO: 622776 - DNA, 11 bp, Homo sapiens
accataaagat

SEQ ID NO: 622777 - DNA, 19 bp, Homo sapiens
accatagcttaagaagtat

SEQ ID NO: 622778 - DNA, 18 bp, Homo sapiens
accatctaggatgatttt

SEQ ID NO: 622779 - DNA, 18 bp, Homo sapiens
accatgcattcagatctg

SEQ ID NO: 622780 - DNA, 23 bp, Homo sapiens
accatggccgaagccccttggag

SEQ ID NO: 622781 - DNA, 15 bp, Homo sapiens
accatgttaatacat

SEQ ID NO: 622782 - DNA, 15 bp, Homo sapiens
accattatggctttg

SEQ ID NO: 622783 - DNA, 20 bp, Homo sapiens
accatttcccctgtggtttg

SEQ ID NO: 622784 - DNA, 15 bp, Homo sapiens
accattttgaaatat

SEQ ID NO: 622785 - DNA, 19 bp, Homo sapiens
acccaagttggagtgcagt

SEQ ID NO: 622786 - DNA, 15 bp, Homo sapiens
acccactagccctct

SEQ ID NO: 622787 - DNA, 24 bp, Homo sapiens
acccactagccctctttctctctg

SEQ ID NO: 622788 - DNA, 19 bp, Homo sapiens
acccactgaatctgagaaa

SEQ ID NO: 622789 - DNA, 11 bp, Homo sapiens
acccagcctgg

SEQ ID NO: 622790 - DNA, 19 bp, Homo sapiens
acccaggattcaacatcaa

SEQ ID NO: 622791 - DNA, 16 bp, Homo sapiens
acccagtgttcagcat

SEQ ID NO: 622792 - DNA, 19 bp, Homo sapiens
accccacacgccggggctg

SEQ ID NO: 622793 - DNA, 11 bp, Homo sapiens
accccactgga

SEQ ID NO: 622794 - DNA, 22 bp, Homo sapiens
accccagaacgcatgcagggcc

SEQ ID NO: 622795 - DNA, 16 bp, Homo sapiens
acccccacctcccggt

SEQ ID NO: 622796 - DNA, 16 bp, Homo sapiens
acccccagcagctcac

SEQ ID NO: 622797 - DNA, 12 bp, Homo sapiens
acccccagcctc

SEQ ID NO: 622798 - DNA, 14 bp, Homo sapiens
acccccagcctccc

SEQ ID NO: 622799 - DNA, 21 bp, Homo sapiens
accccgctgcctggcgggcag

SEQ ID NO: 622800 - DNA, 13 bp, Homo sapiens
accccgtcccggc

SEQ ID NO: 622801 - DNA, 18 bp, Homo sapiens
accccgtcccggccccgc

SEQ ID NO: 622802 - DNA, 15 bp, Homo sapiens
accccgtccctttcc

SEQ ID NO: 622803 - DNA, 17 bp, Homo sapiens
accccgtgaagcatcca

SEQ ID NO: 622804 - DNA, 17 bp, Homo sapiens
accccgttcccagcgca

SEQ ID NO: 622805 - DNA, 18 bp, Homo sapiens
accccgttgttgtccctg

SEQ ID NO: 622806 - DNA, 21 bp, Homo sapiens
accccgttgttgtccctgcag

SEQ ID NO: 622807 - DNA, 20 bp, Homo sapiens
acccctcaagccaggagacc

SEQ ID NO: 622808 - DNA, 23 bp, Homo sapiens
acccctcaagccaggagaccctg

SEQ ID NO: 622809 - DNA, 14 bp, Homo sapiens
acccctcttccccc

SEQ ID NO: 622810 - DNA, 19 bp, Homo sapiens
acccctcttcccccttccc

SEQ ID NO: 622811 - DNA, 11 bp, Homo sapiens
acccctgtagg

SEQ ID NO: 622812 - DNA, 21 bp, Homo sapiens
acccctgtagggaaaccttgg

SEQ ID NO: 622813 - DNA, 23 bp, Homo sapiens
acccctgtagggaaaccttggag

SEQ ID NO: 622814 - DNA, 18 bp, Homo sapiens
acccgccccagagactgc

SEQ ID NO: 622815 - DNA, 20 bp, Homo sapiens
acccgccccagagactgccc

SEQ ID NO: 622816 - DNA, 14 bp, Homo sapiens
acccgcccgccccc

SEQ ID NO: 622817 - DNA, 12 bp, Homo sapiens
acccgtcctggg

SEQ ID NO: 622818 - DNA, 13 bp, Homo sapiens
acccgtgttctcc

SEQ ID NO: 622819 - DNA, 14 bp, Homo sapiens
accctatcatcagt

SEQ ID NO: 622820 - DNA, 16 bp, Homo sapiens
accctatctcccacaa

SEQ ID NO: 622821 - DNA, 17 bp, Homo sapiens
accctatttgtttcatt

SEQ ID NO: 622822 - DNA, 21 bp, Homo sapiens
accctatttgtttcattaaag

SEQ ID NO: 622823 - DNA, 13 bp, Homo sapiens
accctcccctctc

SEQ ID NO: 622824 - DNA, 18 bp, Homo sapiens
accctcccctctcctgag

SEQ ID NO: 622825 - DNA, 15 bp, Homo sapiens
accctccctgtcccc

SEQ ID NO: 622826 - DNA, 18 bp, Homo sapiens
accctccctgtcccctga

SEQ ID NO: 622827 - DNA, 15 bp, Homo sapiens
accctgaatcagagg

SEQ ID NO: 622828 - DNA, 18 bp, Homo sapiens
accctgaatcagaggcag

SEQ ID NO: 622829 - DNA, 20 bp, Homo sapiens
accctgaatcagaggcagag

SEQ ID NO: 622830 - DNA, 12 bp, Homo sapiens
accctgagcctg

SEQ ID NO: 622831 - DNA, 21 bp, Homo sapiens
accctgcaggcaggcagacca

SEQ ID NO: 622832 - DNA, 16 bp, Homo sapiens
accctgccctgcacct

SEQ ID NO: 622833 - DNA, 17 bp, Homo sapiens
accctgcgcccctgccc

SEQ ID NO: 622834 - DNA, 14 bp, Homo sapiens
accctgggcctccc

SEQ ID NO: 622835 - DNA, 22 bp, Homo sapiens
aattgggcccttagaatgtgaa

SEQ ID NO: 622836 - DNA, 19 bp, Homo sapiens
aattgtaaaggtgatgaat

SEQ ID NO: 622837 - DNA, 12 bp, Homo sapiens
aattgtatatat

SEQ ID NO: 622838 - DNA, 22 bp, Homo sapiens
aattgtgccaaagatagcagaa

SEQ ID NO: 622839 - DNA, 17 bp, Homo sapiens
aattgttatgtaaacat

SEQ ID NO: 622840 - DNA, 19 bp, Homo sapiens
aattgttatgtaaacatca

SEQ ID NO: 622841 - DNA, 14 bp, Homo sapiens
aatttaaaaattaa

SEQ ID NO: 622842 - DNA, 15 bp, Homo sapiens
aatttaagcacaaaa

SEQ ID NO: 622843 - DNA, 17 bp, Homo sapiens
aatttactatgtaaatg

SEQ ID NO: 622844 - DNA, 16 bp, Homo sapiens
aatttaggaatgctca

SEQ ID NO: 622845 - DNA, 12 bp, Homo sapiens
aatttatcattt

SEQ ID NO: 622846 - DNA, 14 bp, Homo sapiens
aatttatcatttta

SEQ ID NO: 622847 - DNA, 15 bp, Homo sapiens
aatttatgtcatttt

SEQ ID NO: 622848 - DNA, 12 bp, Homo sapiens
aatttcaaagaa

SEQ ID NO: 622849 - DNA, 22 bp, Homo sapiens
aatttcaaagaaaacagaccag

SEQ ID NO: 622850 - DNA, 21 bp, Homo sapiens
aatttcagaaactaagaatca

SEQ ID NO: 622851 - DNA, 16 bp, Homo sapiens
aatttgatatcacagt

SEQ ID NO: 622852 - DNA, 16 bp, Homo sapiens
aatttgccagacagag

SEQ ID NO: 622853 - DNA, 16 bp, Homo sapiens
aatttggccatgaaag

SEQ ID NO: 622854 - DNA, 19 bp, Homo sapiens
aatttggggctacttatat

SEQ ID NO: 622855 - DNA, 19 bp, Homo sapiens
aatttgtgtgcttcacaca

SEQ ID NO: 622856 - DNA, 16 bp, Homo sapiens
aatttgttctgtgcaa

SEQ ID NO: 622857 - DNA, 17 bp, Homo sapiens
aattttggtttttctca

SEQ ID NO: 622858 - DNA, 15 bp, Homo sapiens
aatttttattcataa

SEQ ID NO: 622859 - DNA, 16 bp, Homo sapiens
aatttttctgcactga

SEQ ID NO: 622860 - DNA, 15 bp, Homo sapiens
aatttttgcatgttt

SEQ ID NO: 622861 - DNA, 17 bp, Homo sapiens
aatttttgcatgtttaa

SEQ ID NO: 622862 - DNA, 18 bp, Homo sapiens
aatttttttattgtttaa

SEQ ID NO: 622863 - DNA, 17 bp, Homo sapiens
acaaaaaaaagaaagaa

SEQ ID NO: 622864 - DNA, 15 bp, Homo sapiens
acaaaaactttccat

SEQ ID NO: 622865 - DNA, 19 bp, Homo sapiens
acaaaaactttccatgaca

SEQ ID NO: 622866 - DNA, 20 bp, Homo sapiens
acaaaaactttccatgacag

SEQ ID NO: 622867 - DNA, 13 bp, Homo sapiens
acaaaacaacagc

SEQ ID NO: 622868 - DNA, 17 bp, Homo sapiens
acaaaaggctggatgtg

SEQ ID NO: 622869 - DNA, 11 bp, Homo sapiens
acaaaatataa

SEQ ID NO: 622870 - DNA, 14 bp, Homo sapiens
acaaaatataaatc

SEQ ID NO: 622871 - DNA, 15 bp, Homo sapiens
acaaaatataaatca

SEQ ID NO: 622872 - DNA, 23 bp, Homo sapiens
acaaaatataaatcacagatttc

SEQ ID NO: 622873 - DNA, 16 bp, Homo sapiens
acaaaatgaattgcct

SEQ ID NO: 622874 - DNA, 17 bp, Homo sapiens
acaaaatgaattgcctt

SEQ ID NO: 622875 - DNA, 19 bp, Homo sapiens
acaaaatgaattgcctttg

SEQ ID NO: 622876 - DNA, 21 bp, Homo sapiens
acaaaatgtgtgcttggaaaa

SEQ ID NO: 622877 - DNA, 22 bp, Homo sapiens
acaaaatgtgtgcttggaaaat

SEQ ID NO: 622878 - DNA, 16 bp, Homo sapiens
acaaacaacaaagcag

SEQ ID NO: 622879 - DNA, 13 bp, Homo sapiens
acaaacaagatac

SEQ ID NO: 622880 - DNA, 21 bp, Homo sapiens
acaaacaagatacgtatattt

SEQ ID NO: 622881 - DNA, 16 bp, Homo sapiens
acaaacttttataaat

SEQ ID NO: 622882 - DNA, 12 bp, Homo sapiens
acaaagaaatat

SEQ ID NO: 622883 - DNA, 22 bp, Homo sapiens
aagctcgtagaaacaagacaag

SEQ ID NO: 622884 - DNA, 17 bp, Homo sapiens
aagctgtgaccctcaat

SEQ ID NO: 622885 - DNA, 17 bp, Homo sapiens
aagctttttgtgagaaa

SEQ ID NO: 622886 - DNA, 22 bp, Homo sapiens
aaggaagctttggaagcagcaa

SEQ ID NO: 622887 - DNA, 14 bp, Homo sapiens
aaggactacagaat

SEQ ID NO: 622888 - DNA, 15 bp, Homo sapiens
aaggactacagaatt

SEQ ID NO: 622889 - DNA, 12 bp, Homo sapiens
aaggagaaaaaa

SEQ ID NO: 622890 - DNA, 12 bp, Homo sapiens
aaggagaggagt

SEQ ID NO: 622891 - DNA, 13 bp, Homo sapiens
aaggagaggagtg

SEQ ID NO: 622892 - DNA, 18 bp, Homo sapiens
aaggagatggggagggcg

SEQ ID NO: 622893 - DNA, 22 bp, Homo sapiens
aaggagcactagaatgagaaat

SEQ ID NO: 622894 - DNA, 11 bp, Homo sapiens
aaggatcctga

SEQ ID NO: 622895 - DNA, 14 bp, Homo sapiens
aaggatcctgagcc

SEQ ID NO: 622896 - DNA, 17 bp, Homo sapiens
aaggatcctgagccaga

SEQ ID NO: 622897 - DNA, 20 bp, Homo sapiens
aaggattcttttttcaatgt

SEQ ID NO: 622898 - DNA, 16 bp, Homo sapiens
aaggcagccctcacct

SEQ ID NO: 622899 - DNA, 21 bp, Homo sapiens
aaggcagccctcacctctgag

SEQ ID NO: 622900 - DNA, 18 bp, Homo sapiens
aaggcccgaggaggccga

SEQ ID NO: 622901 - DNA, 12 bp, Homo sapiens
aaggcctgaggg

SEQ ID NO: 622902 - DNA, 22 bp, Homo sapiens
aaggcctgagggaagcccaccc

SEQ ID NO: 622903 - DNA, 18 bp, Homo sapiens
aaggcctgccccccttcc

SEQ ID NO: 622904 - DNA, 20 bp, Homo sapiens
aaggcggagggtctccctgg

SEQ ID NO: 622905 - DNA, 15 bp, Homo sapiens
aagggaaggctgctg

SEQ ID NO: 622906 - DNA, 19 bp, Homo sapiens
aagggaaggctgctgtgta

SEQ ID NO: 622907 - DNA, 22 bp, Homo sapiens
aagggattgaggagttgcctga

SEQ ID NO: 622908 - DNA, 15 bp, Homo sapiens
aagggcagccccgcg

SEQ ID NO: 622909 - DNA, 17 bp, Homo sapiens
aagggcagcccctcccc

SEQ ID NO: 622910 - DNA, 14 bp, Homo sapiens
aaggggaaaacctc

SEQ ID NO: 622911 - DNA, 17 bp, Homo sapiens
aaggggaaaacctcagt

SEQ ID NO: 622912 - DNA, 16 bp, Homo sapiens
aaggggatctaaaagg

SEQ ID NO: 622913 - DNA, 16 bp, Homo sapiens
aaggggcgcgcgcccc

SEQ ID NO: 622914 - DNA, 12 bp, Homo sapiens
aagggtgcctgg

SEQ ID NO: 622915 - DNA, 21 bp, Homo sapiens
aagggttctgccctgcctgag

SEQ ID NO: 622916 - DNA, 17 bp, Homo sapiens
aaggtgatgaatttacc

SEQ ID NO: 622917 - DNA, 20 bp, Homo sapiens
aaggttatttatttaaatgt

SEQ ID NO: 622918 - DNA, 17 bp, Homo sapiens
aaggtttcactgttcat

SEQ ID NO: 622919 - DNA, 14 bp, Homo sapiens
aagtaagttcatca

SEQ ID NO: 622920 - DNA, 15 bp, Homo sapiens
aagtaattaaaaaga

SEQ ID NO: 622921 - DNA, 14 bp, Homo sapiens
aagtaatttcatgc

SEQ ID NO: 622922 - DNA, 22 bp, Homo sapiens
aagtatccctgatttattctgg

SEQ ID NO: 622923 - DNA, 18 bp, Homo sapiens
aagtatgtcttcaaaata

SEQ ID NO: 622924 - DNA, 16 bp, Homo sapiens
aagtcaaacagtgtgg

SEQ ID NO: 622925 - DNA, 18 bp, Homo sapiens
aagtcaaacagtgtggct

SEQ ID NO: 622926 - DNA, 12 bp, Homo sapiens
aagtcaagtcta

SEQ ID NO: 622927 - DNA, 14 bp, Homo sapiens
aagtccatgtgata

SEQ ID NO: 622928 - DNA, 13 bp, Homo sapiens
aagtcccttcctg

SEQ ID NO: 622929 - DNA, 19 bp, Homo sapiens
aagtcctcgccccccgccc

SEQ ID NO: 622930 - DNA, 16 bp, Homo sapiens
aagtctgagtagttat

SEQ ID NO: 622931 - DNA, 13 bp, Homo sapiens
aagtgaaattagt

SEQ ID NO: 622932 - DNA, 20 bp, Homo sapiens
aagtgaaattagtattttga

SEQ ID NO: 622933 - DNA, 15 bp, Homo sapiens
aagtgatgtgattta

SEQ ID NO: 622934 - DNA, 13 bp, Homo sapiens
aagtgcatgttaa

SEQ ID NO: 622935 - DNA, 20 bp, Homo sapiens
aagtgcatgttaaaataatt

SEQ ID NO: 622936 - DNA, 22 bp, Homo sapiens
aagtgcatgttaaaataattat

SEQ ID NO: 622937 - DNA, 13 bp, Homo sapiens
aagtggactgtat

SEQ ID NO: 622938 - DNA, 15 bp, Homo sapiens
aagtggactgtattt

SEQ ID NO: 622939 - DNA, 22 bp, Homo sapiens
aagtggcaagctcttcattgca

SEQ ID NO: 622940 - DNA, 18 bp, Homo sapiens
aagtgtccattgacatgt

SEQ ID NO: 622941 - DNA, 22 bp, Homo sapiens
aagtgtgttgggaattgcatgc

SEQ ID NO: 622942 - DNA, 22 bp, Homo sapiens
aagtgttggccatcatttcatt

SEQ ID NO: 622943 - DNA, 16 bp, Homo sapiens
aagttacccctgaaat

SEQ ID NO: 622944 - DNA, 18 bp, Homo sapiens
aagttataccagcaaaag

SEQ ID NO: 622945 - DNA, 19 bp, Homo sapiens
aagttatttgatctggtgc

SEQ ID NO: 622946 - DNA, 13 bp, Homo sapiens
gacggggcagagc

SEQ ID NO: 622947 - DNA, 22 bp, Homo sapiens
gacgtcgctgtccgtcctgctc

SEQ ID NO: 622948 - DNA, 21 bp, Homo sapiens
gactaacttattttgattgtt

SEQ ID NO: 622949 - DNA, 19 bp, Homo sapiens
gactcagtgcagggacagc

SEQ ID NO: 622950 - DNA, 20 bp, Homo sapiens
gactcagtgcagggacagcc

SEQ ID NO: 622951 - DNA, 22 bp, Homo sapiens
gactcagtgcagggacagcctg

SEQ ID NO: 622952 - DNA, 16 bp, Homo sapiens
gactccccgcccgccc

SEQ ID NO: 622953 - DNA, 22 bp, Homo sapiens
gactccccgcccgccctcctct

SEQ ID NO: 622954 - DNA, 18 bp, Homo sapiens
gactcgagagggctgagc

SEQ ID NO: 622955 - DNA, 19 bp, Homo sapiens
gactcgagagggctgagcc

SEQ ID NO: 622956 - DNA, 21 bp, Homo sapiens
gactcgagagggctgagcccc

SEQ ID NO: 622957 - DNA, 19 bp, Homo sapiens
gactcgcgacaatgcaaac

SEQ ID NO: 622958 - DNA, 20 bp, Homo sapiens
gactctatggactcgatttt

SEQ ID NO: 622959 - DNA, 20 bp, Homo sapiens
gactctctcctctctctccc

SEQ ID NO: 622960 - DNA, 19 bp, Homo sapiens
gactgaagaaaatccttca

SEQ ID NO: 622961 - DNA, 17 bp, Homo sapiens
gactgacactcagatgc

SEQ ID NO: 622962 - DNA, 12 bp, Homo sapiens
gactgcccaccc

SEQ ID NO: 622963 - DNA, 14 bp, Homo sapiens
gactgcccaccctg

SEQ ID NO: 622964 - DNA, 19 bp, Homo sapiens
gactgcccaccctgggcct

SEQ ID NO: 622965 - DNA, 20 bp, Homo sapiens
gactgcccaccctgggcctc

SEQ ID NO: 622966 - DNA, 23 bp, Homo sapiens
gactgcccaccctgggcctcccg

SEQ ID NO: 622967 - DNA, 20 bp, Homo sapiens
gactgctttcagtgcctgct

SEQ ID NO: 622968 - DNA, 10 bp, Homo sapiens
gactgggctg

SEQ ID NO: 622969 - DNA, 12 bp, Homo sapiens
gactgggctgct

SEQ ID NO: 622970 - DNA, 19 bp, Homo sapiens
gactgggctgctggggcag

SEQ ID NO: 622971 - DNA, 17 bp, Homo sapiens
gactgtcttcaaccctg

SEQ ID NO: 622972 - DNA, 19 bp, Homo sapiens
gactgtcttcaaccctgcc

SEQ ID NO: 622973 - DNA, 21 bp, Homo sapiens
gactgtcttcaaccctgccct

SEQ ID NO: 622974 - DNA, 11 bp, Homo sapiens
gactgtggggt

SEQ ID NO: 622975 - DNA, 19 bp, Homo sapiens
gacttcagactctctcctc

SEQ ID NO: 622976 - DNA, 23 bp, Homo sapiens
gacttcagactctctcctctctc

SEQ ID NO: 622977 - DNA, 22 bp, Homo sapiens
gacttcccagctggcagcgcct

SEQ ID NO: 622978 - DNA, 18 bp, Homo sapiens
gacttctttactaacact

SEQ ID NO: 622979 - DNA, 19 bp, Homo sapiens
gacttctttactaacactg

SEQ ID NO: 622980 - DNA, 23 bp, Homo sapiens
gacttggataggagcttccagat

SEQ ID NO: 622981 - DNA, 16 bp, Homo sapiens
gactttcctatgacac

SEQ ID NO: 622982 - DNA, 14 bp, Homo sapiens
gactttggaattct

SEQ ID NO: 622983 - DNA, 13 bp, Homo sapiens
gacttttccccat

SEQ ID NO: 622984 - DNA, 24 bp, Homo sapiens
gagaaaaaaaaagccactaaggtc

SEQ ID NO: 622985 - DNA, 23 bp, Homo sapiens
gagaaaaagcattaaaaataagc

SEQ ID NO: 622986 - DNA, 13 bp, Homo sapiens
gagaaaaagccct

SEQ ID NO: 622987 - DNA, 16 bp, Homo sapiens
gagaaaatgctttctc

SEQ ID NO: 622988 - DNA, 20 bp, Homo sapiens
gagaagaaatagcagagcct

SEQ ID NO: 622989 - DNA, 15 bp, Homo sapiens
gagaagcaccccacc

SEQ ID NO: 622990 - DNA, 12 bp, Homo sapiens
gagaagccataa

SEQ ID NO: 622991 - DNA, 20 bp, Homo sapiens
gagaagctagatgcccctgc

SEQ ID NO: 622992 - DNA, 14 bp, Homo sapiens
gagaaggaggaacc

SEQ ID NO: 622993 - DNA, 14 bp, Homo sapiens
gagaaggcctgccc

SEQ ID NO: 622994 - DNA, 23 bp, Homo sapiens
gagaagggttctgccctgcctga

SEQ ID NO: 622995 - DNA, 23 bp, Homo sapiens
gagaatgagggcgtgaaacacaa

SEQ ID NO: 622996 - DNA, 14 bp, Homo sapiens
gagacactgtcaag

SEQ ID NO: 622997 - DNA, 18 bp, Homo sapiens
gagaccaccgcgcccctc

SEQ ID NO: 622998 - DNA, 21 bp, Homo sapiens
gagaccaccgcgcccctctgc

SEQ ID NO: 622999 - DNA, 15 bp, Homo sapiens
gagaccacttcctta

SEQ ID NO: 623000 - DNA, 21 bp, Homo sapiens
gagaccacttccttaacagct

SEQ ID NO: 623001 - DNA, 15 bp, Homo sapiens
gagaccctgcgcccc

SEQ ID NO: 623002 - DNA, 18 bp, Homo sapiens
gagaccctgcgcccctgc

SEQ ID NO: 623003 - DNA, 19 bp, Homo sapiens
gagaccctgcgcccctgcc

SEQ ID NO: 623004 - DNA, 13 bp, Homo sapiens
gagacggcagccc

SEQ ID NO: 623005 - DNA, 19 bp, Homo sapiens
gagactaacttattttgat

SEQ ID NO: 623006 - DNA, 18 bp, Homo sapiens
gagactcgcgacaatgca

SEQ ID NO: 623007 - DNA, 21 bp, Homo sapiens
gagactcgcgacaatgcaaac

SEQ ID NO: 623008 - DNA, 17 bp, Homo sapiens
gagactgcccaccctgg

SEQ ID NO: 623009 - DNA, 18 bp, Homo sapiens
gagacttctaaatcataa

SEQ ID NO: 623010 - DNA, 15 bp, Homo sapiens
gagagaagcacccca

SEQ ID NO: 623011 - DNA, 19 bp, Homo sapiens
gagagactggttttttcca

SEQ ID NO: 623012 - DNA, 15 bp, Homo sapiens
gagagagaggctgcc

SEQ ID NO: 623013 - DNA, 13 bp, Homo sapiens
gagagcgccaccc

SEQ ID NO: 623014 - DNA, 16 bp, Homo sapiens
gagagcgccacccgcc

SEQ ID NO: 623015 - DNA, 18 bp, Homo sapiens
gagagcgccacccgcccg

SEQ ID NO: 623016 - DNA, 21 bp, Homo sapiens
gagagcggcttccccatcgcc

SEQ ID NO: 623017 - DNA, 15 bp, Homo sapiens
gagaggaaaaaggct

SEQ ID NO: 623018 - DNA, 12 bp, Homo sapiens
gagaggaaatca

SEQ ID NO: 623019 - DNA, 15 bp, Homo sapiens
gagaggaggtgtgga

SEQ ID NO: 623020 - DNA, 22 bp, Homo sapiens
gagaggaggtgtggagtggagg

SEQ ID NO: 623021 - DNA, 16 bp, Homo sapiens
gagaggctgcctcagc

SEQ ID NO: 623022 - DNA, 21 bp, Homo sapiens
gagaggctgcctcagccagtg

SEQ ID NO: 623023 - DNA, 20 bp, Homo sapiens
gagagggctgagcccctcct

SEQ ID NO: 623024 - DNA, 22 bp, Homo sapiens
gagagggctgagcccctcctct

SEQ ID NO: 623025 - DNA, 15 bp, Homo sapiens
gagaggggacttgga

SEQ ID NO: 623026 - DNA, 22 bp, Homo sapiens
gagaggggacttggataggagc

SEQ ID NO: 623027 - DNA, 15 bp, Homo sapiens
gagagtatggtgctg

SEQ ID NO: 623028 - DNA, 24 bp, Homo sapiens
gagagtggcaggtgggctgcctgc

SEQ ID NO: 623029 - DNA, 16 bp, Homo sapiens
gagataccctctgaga

SEQ ID NO: 623030 - DNA, 14 bp, Homo sapiens
gagatgaggctgga

SEQ ID NO: 623031 - DNA, 14 bp, Homo sapiens
gagattgctctggg

SEQ ID NO: 623032 - DNA, 17 bp, Homo sapiens
gagattggaaaaaatta

SEQ ID NO: 623033 - DNA, 19 bp, Homo sapiens
gagattggaaaaaattaga

SEQ ID NO: 623034 - DNA, 17 bp, Homo sapiens
gagcaaggcaagaagtg

SEQ ID NO: 623035 - DNA, 15 bp, Homo sapiens
gagcaccacggggtc

SEQ ID NO: 623036 - DNA, 14 bp, Homo sapiens
gagcacccccagcc

SEQ ID NO: 623037 - DNA, 18 bp, Homo sapiens
gagcactagaatgagaaa

SEQ ID NO: 623038 - DNA, 21 bp, Homo sapiens
gagcactagaatgagaaatca

SEQ ID NO: 623039 - DNA, 16 bp, Homo sapiens
gagcagaaagccaggg

SEQ ID NO: 623040 - DNA, 17 bp, Homo sapiens
gagcagaaagccagggt

SEQ ID NO: 623041 - DNA, 19 bp, Homo sapiens
gagcagagacggcagcccc

SEQ ID NO: 623042 - DNA, 24 bp, Homo sapiens
gagcagagacggcagccccatcct

SEQ ID NO: 623043 - DNA, 16 bp, Homo sapiens
gagcagagcgcagccc

SEQ ID NO: 623044 - DNA, 17 bp, Homo sapiens
gagcagagcgcagcccc

SEQ ID NO: 623045 - DNA, 19 bp, Homo sapiens
gagcagagcgcagccccca

SEQ ID NO: 623046 - DNA, 21 bp, Homo sapiens
gagcagagcgcagcccccacg

SEQ ID NO: 623047 - DNA, 11 bp, Homo sapiens
gagcagagtct

SEQ ID NO: 623048 - DNA, 21 bp, Homo sapiens
gagcagatcgtgccgtggagc

SEQ ID NO: 623049 - DNA, 22 bp, Homo sapiens
gagcagatcgtgccgtggagct

SEQ ID NO: 623050 - DNA, 12 bp, Homo sapiens
gagcagcaggtg

SEQ ID NO: 623051 - DNA, 15 bp, Homo sapiens
gagcagcaggtgctg

SEQ ID NO: 623052 - DNA, 13 bp, Homo sapiens
gagcagtggggag

SEQ ID NO: 623053 - DNA, 18 bp, Homo sapiens
gagcatgcccaaatataa

SEQ ID NO: 623054 - DNA, 23 bp, Homo sapiens
gagcatgcccaaatataacatga

SEQ ID NO: 623055 - DNA, 22 bp, Homo sapiens
gagcatgctccctcatgcagat

SEQ ID NO: 623056 - DNA, 16 bp, Homo sapiens
gagcattctggggtgg

SEQ ID NO: 623057 - DNA, 18 bp, Homo sapiens
gagcattctggggtgggg

SEQ ID NO: 623058 - DNA, 19 bp, Homo sapiens
gagcattctggggtggggc

SEQ ID NO: 623059 - DNA, 20 bp, Homo sapiens
gagccaataaagctcacact

SEQ ID NO: 623060 - DNA, 21 bp, Homo sapiens
gagccaataaagctcacactt

SEQ ID NO: 623061 - DNA, 23 bp, Homo sapiens
gagccacagtggggcccatggcc

SEQ ID NO: 623062 - DNA, 24 bp, Homo sapiens
gagccacagtggggcccatggccc

SEQ ID NO: 623063 - DNA, 20 bp, Homo sapiens
cttggctcagacacctagac

SEQ ID NO: 623064 - DNA, 14 bp, Homo sapiens
cttggcttcttctt

SEQ ID NO: 623065 - DNA, 17 bp, Homo sapiens
cttgggcacgggagagc

SEQ ID NO: 623066 - DNA, 23 bp, Homo sapiens
cttgggcacgggagagcgccacc

SEQ ID NO: 623067 - DNA, 16 bp, Homo sapiens
cttggggtagagagga

SEQ ID NO: 623068 - DNA, 22 bp, Homo sapiens
cttggtcacaaagctatttaag

SEQ ID NO: 623069 - DNA, 12 bp, Homo sapiens
cttggtctcttt

SEQ ID NO: 623070 - DNA, 19 bp, Homo sapiens
cttggtctctttctttcca

SEQ ID NO: 623071 - DNA, 20 bp, Homo sapiens
cttggtctctttctttccaa

SEQ ID NO: 623072 - DNA, 22 bp, Homo sapiens
cttggtctctttctttccaaag

SEQ ID NO: 623073 - DNA, 23 bp, Homo sapiens
cttggtgattacctgaaagccct

SEQ ID NO: 623074 - DNA, 20 bp, Homo sapiens
cttggtgtaaaccattcttg

SEQ ID NO: 623075 - DNA, 15 bp, Homo sapiens
cttggttcctccagc

SEQ ID NO: 623076 - DNA, 19 bp, Homo sapiens
cttgtacttacactgaaat

SEQ ID NO: 623077 - DNA, 16 bp, Homo sapiens
cttgtactttacaatc

SEQ ID NO: 623078 - DNA, 18 bp, Homo sapiens
cttgtagacgcacctgct

SEQ ID NO: 623079 - DNA, 19 bp, Homo sapiens
cttgtagggtgaggcgtgg

SEQ ID NO: 623080 - DNA, 16 bp, Homo sapiens
ctcctgctgaccttct

SEQ ID NO: 623081 - DNA, 19 bp, Homo sapiens
ctcctgtctcctctgtcag

SEQ ID NO: 623082 - DNA, 13 bp, Homo sapiens
ctccttcatgctt

SEQ ID NO: 623083 - DNA, 10 bp, Homo sapiens
ctccttctcc

SEQ ID NO: 623084 - DNA, 23 bp, Homo sapiens
ctccttggtgtcgggcatgacac

SEQ ID NO: 623085 - DNA, 13 bp, Homo sapiens
ctccttgtacttg

SEQ ID NO: 623086 - DNA, 16 bp, Homo sapiens
ctcgagagggctgagc

SEQ ID NO: 623087 - DNA, 17 bp, Homo sapiens
ctcgagagggctgagcc

SEQ ID NO: 623088 - DNA, 21 bp, Homo sapiens
ctcgagagggctgagcccctc

SEQ ID NO: 623089 - DNA, 23 bp, Homo sapiens
ctcgagagggctgagcccctcct

SEQ ID NO: 623090 - DNA, 23 bp, Homo sapiens
ctcgcactacatctgatatcagg

SEQ ID NO: 623091 - DNA, 14 bp, Homo sapiens
ctcgcagcctgaag

SEQ ID NO: 623092 - DNA, 21 bp, Homo sapiens
ctcgcagcctgaagcctggat

SEQ ID NO: 623093 - DNA, 13 bp, Homo sapiens
ctcgccctgtgcc

SEQ ID NO: 623094 - DNA, 16 bp, Homo sapiens
ctcgccctgtgccctc

SEQ ID NO: 623095 - DNA, 21 bp, Homo sapiens
ctcgcctgggaaattgctcca

SEQ ID NO: 623096 - DNA, 15 bp, Homo sapiens
ctcgcgacaatgcaa

SEQ ID NO: 623097 - DNA, 15 bp, Homo sapiens
ctcgcgcccctgtcc

SEQ ID NO: 623098 - DNA, 17 bp, Homo sapiens
ctcgcgcccctgtccat

SEQ ID NO: 623099 - DNA, 14 bp, Homo sapiens
ctcgcttgtgcaga

SEQ ID NO: 623100 - DNA, 17 bp, Homo sapiens
ctcgggccgcctcctcc

SEQ ID NO: 623101 - DNA, 20 bp, Homo sapiens
ctcgggccgcctcctccaga

SEQ ID NO: 623102 - DNA, 16 bp, Homo sapiens
ctcgggcgcctgcgct

SEQ ID NO: 623103 - DNA, 22 bp, Homo sapiens
ctcgggcgcctgcgctcctctg

SEQ ID NO: 623104 - DNA, 15 bp, Homo sapiens
ctcgggctctctcac

SEQ ID NO: 623105 - DNA, 18 bp, Homo sapiens
ctcggtggcatttgctga

SEQ ID NO: 623106 - DNA, 14 bp, Homo sapiens
ctcgtccggcctgc

SEQ ID NO: 623107 - DNA, 14 bp, Homo sapiens
ctcgtgcatgtaat

SEQ ID NO: 623108 - DNA, 14 bp, Homo sapiens
ctcgtgtttcacag

SEQ ID NO: 623109 - DNA, 16 bp, Homo sapiens
ctcgtgtttcacagtg

SEQ ID NO: 623110 - DNA, 17 bp, Homo sapiens
ctcgtgtttcacagtgg

SEQ ID NO: 623111 - DNA, 22 bp, Homo sapiens
ctctaagaaatggctttccaca

SEQ ID NO: 623112 - DNA, 13 bp, Homo sapiens
ctctaagaattca

SEQ ID NO: 623113 - DNA, 24 bp, Homo sapiens
ctctaaggtaaaaccatctaggat

SEQ ID NO: 623114 - DNA, 14 bp, Homo sapiens
ctctacctggccgg

SEQ ID NO: 623115 - DNA, 17 bp, Homo sapiens
ctctactgaaaacacaa

SEQ ID NO: 623116 - DNA, 17 bp, Homo sapiens
ctctagattttgttttg

SEQ ID NO: 623117 - DNA, 13 bp, Homo sapiens
ctctagtgcagga

SEQ ID NO: 623118 - DNA, 15 bp, Homo sapiens
ctctatccctggcca

SEQ ID NO: 623119 - DNA, 14 bp, Homo sapiens
ctctcaaaatgtgc

SEQ ID NO: 623120 - DNA, 15 bp, Homo sapiens
ctctcaaaatgtgcc

SEQ ID NO: 623121 - DNA, 16 bp, Homo sapiens
ctctcacccagcctgg

SEQ ID NO: 623122 - DNA, 17 bp, Homo sapiens
ctctcagatccctcggt

SEQ ID NO: 623123 - DNA, 22 bp, Homo sapiens
ctctcagatccctcggtcagca

SEQ ID NO: 623124 - DNA, 18 bp, Homo sapiens
ctctcagtatcttaaaat

SEQ ID NO: 623125 - DNA, 19 bp, Homo sapiens
ctctcagtatcttaaaatt

SEQ ID NO: 623126 - DNA, 16 bp, Homo sapiens
ctctcattcccaggca

SEQ ID NO: 623127 - DNA, 12 bp, Homo sapiens
ctctccctccac

SEQ ID NO: 623128 - DNA, 14 bp, Homo sapiens
ctctccctccactc

SEQ ID NO: 623129 - DNA, 16 bp, Homo sapiens
ctctccctccactcct

SEQ ID NO: 623130 - DNA, 18 bp, Homo sapiens
ctctcctcggtggcattt

SEQ ID NO: 623131 - DNA, 21 bp, Homo sapiens
ctccctgggcaccctgcaggc

SEQ ID NO: 623132 - DNA, 21 bp, Homo sapiens
ctccctggggaggacccctgc

SEQ ID NO: 623133 - DNA, 23 bp, Homo sapiens
ctccctggggaggacccctgccc

SEQ ID NO: 623134 - DNA, 13 bp, Homo sapiens
ctccctgtcccct

SEQ ID NO: 623135 - DNA, 14 bp, Homo sapiens
ctccgccagccctg

SEQ ID NO: 623136 - DNA, 15 bp, Homo sapiens
ctccgccagccctgt

SEQ ID NO: 623137 - DNA, 14 bp, Homo sapiens
ctccgcccttccct

SEQ ID NO: 623138 - DNA, 18 bp, Homo sapiens
ctccgcggaggcccctga

SEQ ID NO: 623139 - DNA, 19 bp, Homo sapiens
ctccgcggaggcccctgag

SEQ ID NO: 623140 - DNA, 20 bp, Homo sapiens
ctccgcggaggcccctgagg

SEQ ID NO: 623141 - DNA, 21 bp, Homo sapiens
ctccggatggaatcacagcca

SEQ ID NO: 623142 - DNA, 22 bp, Homo sapiens
ctccggatggaatcacagccaa

SEQ ID NO: 623143 - DNA, 23 bp, Homo sapiens
ctccggatggaatcacagccaat

SEQ ID NO: 623144 - DNA, 12 bp, Homo sapiens
ctccggcagagg

SEQ ID NO: 623145 - DNA, 17 bp, Homo sapiens
ctccggcagaggcaggg

SEQ ID NO: 623146 - DNA, 19 bp, Homo sapiens
ctccggcagaggcagggcc

SEQ ID NO: 623147 - DNA, 20 bp, Homo sapiens
ctccggcagaggcagggccc

SEQ ID NO: 623148 - DNA, 19 bp, Homo sapiens
ctccggccagcgagtggtc

SEQ ID NO: 623149 - DNA, 13 bp, Homo sapiens
ctccgtccccagg

SEQ ID NO: 623150 - DNA, 15 bp, Homo sapiens
ctccgtccccagggt

SEQ ID NO: 623151 - DNA, 20 bp, Homo sapiens
ctccgtccccagggtgcagg

SEQ ID NO: 623152 - DNA, 18 bp, Homo sapiens
ctccgtttccaaatacat

SEQ ID NO: 623153 - DNA, 13 bp, Homo sapiens
ctcctagcctctc

SEQ ID NO: 623154 - DNA, 17 bp, Homo sapiens
ctcctcacccctgtagg

SEQ ID NO: 623155 - DNA, 12 bp, Homo sapiens
ctcctccaaatg

SEQ ID NO: 623156 - DNA, 15 bp, Homo sapiens
ctcctccaaatgctg

SEQ ID NO: 623157 - DNA, 23 bp, Homo sapiens
ctcctccagtacaataaataaaa

SEQ ID NO: 623158 - DNA, 19 bp, Homo sapiens
ctcctcccaactctggcct

SEQ ID NO: 623159 - DNA, 15 bp, Homo sapiens
ctcctcccatggcct

SEQ ID NO: 623160 - DNA, 16 bp, Homo sapiens
ctcctcccatggcctt

SEQ ID NO: 623161 - DNA, 16 bp, Homo sapiens
ctcctcccccaccttc

SEQ ID NO: 623162 - DNA, 12 bp, Homo sapiens
ctcctccccctc

SEQ ID NO: 623163 - DNA, 17 bp, Homo sapiens
ctcctccccctcctcca

SEQ ID NO: 623164 - DNA, 23 bp, Homo sapiens
ctcctccgtgggcagctcctcgg

SEQ ID NO: 623165 - DNA, 12 bp, Homo sapiens
ctcctcctgcat

SEQ ID NO: 623166 - DNA, 13 bp, Homo sapiens
ctcctcctgcatg

SEQ ID NO: 623167 - DNA, 20 bp, Homo sapiens
ctcctcgggcgcctgcgctc

SEQ ID NO: 623168 - DNA, 21 bp, Homo sapiens
ctcctcgggcgcctgcgctcc

SEQ ID NO: 623169 - DNA, 16 bp, Homo sapiens
ctcctcggtggcattt

SEQ ID NO: 623170 - DNA, 20 bp, Homo sapiens
ctcctcggtggcatttgctg

SEQ ID NO: 623171 - DNA, 22 bp, Homo sapiens
ctcctcggtggcatttgctgaa

SEQ ID NO: 623172 - DNA, 20 bp, Homo sapiens
ctcctcgtccggcctgcagc

SEQ ID NO: 623173 - DNA, 21 bp, Homo sapiens
ctcctcgtccggcctgcagcc

SEQ ID NO: 623174 - DNA, 23 bp, Homo sapiens
ctcctcgtccggcctgcagccca

SEQ ID NO: 623175 - DNA, 21 bp, Homo sapiens
ctcctctcctcgtccggcctg

SEQ ID NO: 623176 - DNA, 13 bp, Homo sapiens
ctcctctgcagcc

SEQ ID NO: 623177 - DNA, 14 bp, Homo sapiens
ctcctctgcagcct

SEQ ID NO: 623178 - DNA, 21 bp, Homo sapiens
ctcctctgcagcctgagctcc

SEQ ID NO: 623179 - DNA, 11 bp, Homo sapiens
ctcctctgccc

SEQ ID NO: 623180 - DNA, 14 bp, Homo sapiens
ctcctctgccccct

SEQ ID NO: 623181 - DNA, 16 bp, Homo sapiens
ctcctctgccccctcc

SEQ ID NO: 623182 - DNA, 13 bp, Homo sapiens
ctcctctgtcagt

SEQ ID NO: 623183 - DNA, 21 bp, Homo sapiens
ctcctctgtcagtttgtgaag

SEQ ID NO: 623184 - DNA, 14 bp, Homo sapiens
ctcctgagcctgtc

SEQ ID NO: 623185 - DNA, 17 bp, Homo sapiens
ctcctgagcctgtctct

SEQ ID NO: 623186 - DNA, 21 bp, Homo sapiens
ctcctgcacgcggactccggg

SEQ ID NO: 623187 - DNA, 21 bp, Homo sapiens
ctcctgcatgtcggggcccct

SEQ ID NO: 623188 - DNA, 23 bp, Homo sapiens
ctcctgcatgtcggggcccctgc

SEQ ID NO: 623189 - DNA, 15 bp, Homo sapiens
ctcctgcccacgtgc

SEQ ID NO: 623190 - DNA, 18 bp, Homo sapiens
ctcctgcccacgtgcagc

SEQ ID NO: 623191 - DNA, 24 bp, Homo sapiens
ctcctgcccacgtgcagcacctgt

SEQ ID NO: 623192 - DNA, 20 bp, Homo sapiens
ctcagccctcattaaactaa

SEQ ID NO: 623193 - DNA, 15 bp, Homo sapiens
ctcagcgtctcccca

SEQ ID NO: 623194 - DNA, 18 bp, Homo sapiens
ctcagcgtctccccatgc

SEQ ID NO: 623195 - DNA, 19 bp, Homo sapiens
ctcagcgtctccccatgct

SEQ ID NO: 623196 - DNA, 21 bp, Homo sapiens
ctcagcgtctccccatgctgg

SEQ ID NO: 623197 - DNA, 13 bp, Homo sapiens
ctcagctctccct

SEQ ID NO: 623198 - DNA, 18 bp, Homo sapiens
ctcagctgtctgtggctt

SEQ ID NO: 623199 - DNA, 19 bp, Homo sapiens
ctcaggagaaggcctgccc

SEQ ID NO: 623200 - DNA, 19 bp, Homo sapiens
ctcaggagcacagccatag

SEQ ID NO: 623201 - DNA, 21 bp, Homo sapiens
ctcaggagcacagccatagca

SEQ ID NO: 623202 - DNA, 14 bp, Homo sapiens
ctcaggcagcctgt

SEQ ID NO: 623203 - DNA, 13 bp, Homo sapiens
ctcaggctactgc

SEQ ID NO: 623204 - DNA, 13 bp, Homo sapiens
ctcaggctttcta

SEQ ID NO: 623205 - DNA, 16 bp, Homo sapiens
ctcaggtgcgtgccac

SEQ ID NO: 623206 - DNA, 18 bp, Homo sapiens
ctcagtaaatcagtgcag

SEQ ID NO: 623207 - DNA, 20 bp, Homo sapiens
ctcagtaagacagtgcagtg

SEQ ID NO: 623208 - DNA, 18 bp, Homo sapiens
ctcagtaaggcagtgcag

SEQ ID NO: 623209 - DNA, 18 bp, Homo sapiens
ctcagtaatacagtacag

SEQ ID NO: 623210 - DNA, 15 bp, Homo sapiens
ctcagtatcttaaaa

SEQ ID NO: 623211 - DNA, 20 bp, Homo sapiens
ctcagtatgctttccctgag

SEQ ID NO: 623212 - DNA, 22 bp, Homo sapiens
ctcagtattgagacactgtcaa

SEQ ID NO: 623213 - DNA, 20 bp, Homo sapiens
ctcagtgcagggacagcctg

SEQ ID NO: 623214 - DNA, 18 bp, Homo sapiens
ctcagttaggcagtgcag

SEQ ID NO: 623215 - DNA, 15 bp, Homo sapiens
ctcagttggcctctg

SEQ ID NO: 623216 - DNA, 18 bp, Homo sapiens
ctcagttggcctctgccc

SEQ ID NO: 623217 - DNA, 15 bp, Homo sapiens
ctcatagcacatgtt

SEQ ID NO: 623218 - DNA, 23 bp, Homo sapiens
ctcatagcacatgttttacaaag

SEQ ID NO: 623219 - DNA, 14 bp, Homo sapiens
ctcatcaacaaaga

SEQ ID NO: 623220 - DNA, 15 bp, Homo sapiens
ctcatcaacaaagaa

SEQ ID NO: 623221 - DNA, 19 bp, Homo sapiens
ctcatccactaggtgccca

SEQ ID NO: 623222 - DNA, 15 bp, Homo sapiens
ctcatcccaaaagct

SEQ ID NO: 623223 - DNA, 16 bp, Homo sapiens
ctcatccttgtataaa

SEQ ID NO: 623224 - DNA, 15 bp, Homo sapiens
ctcatcgggagtgaa

SEQ ID NO: 623225 - DNA, 19 bp, Homo sapiens
ctcatctgtaaaaccaggc

SEQ ID NO: 623226 - DNA, 20 bp, Homo sapiens
ctcatctgtaaaaccaggct

SEQ ID NO: 623227 - DNA, 19 bp, Homo sapiens
ctcatgaccctcctgtcca

SEQ ID NO: 623228 - DNA, 12 bp, Homo sapiens
ctcatggctgtt

SEQ ID NO: 623229 - DNA, 23 bp, Homo sapiens
ctcatggctgttatctgtcttta

SEQ ID NO: 623230 - DNA, 14 bp, Homo sapiens
ctcatgtgatttac

SEQ ID NO: 623231 - DNA, 17 bp, Homo sapiens
ctcatgtgtttggagtt

SEQ ID NO: 623232 - DNA, 15 bp, Homo sapiens
ctcattagggctttt

SEQ ID NO: 623233 - DNA, 15 bp, Homo sapiens
ctcattgttcagaaa

SEQ ID NO: 623234 - DNA, 12 bp, Homo sapiens
ctccacaggagc

SEQ ID NO: 623235 - DNA, 21 bp, Homo sapiens
ctccacaggagccgcagaggc

SEQ ID NO: 623236 - DNA, 21 bp, Homo sapiens
ctccaccctccggccagcgag

SEQ ID NO: 623237 - DNA, 15 bp, Homo sapiens
ctccaccctgagcct

SEQ ID NO: 623238 - DNA, 16 bp, Homo sapiens
ctccaccctgagcctg

SEQ ID NO: 623239 - DNA, 20 bp, Homo sapiens
ctccaccctgagcctgacct

SEQ ID NO: 623240 - DNA, 13 bp, Homo sapiens
ctccactcctccc

SEQ ID NO: 623241 - DNA, 14 bp, Homo sapiens
ctccactcctccca

SEQ ID NO: 623242 - DNA, 17 bp, Homo sapiens
ctccactcctcccaact

SEQ ID NO: 623243 - DNA, 14 bp, Homo sapiens
ctccactctgaagt

SEQ ID NO: 623244 - DNA, 18 bp, Homo sapiens
ctccactctgaagtccct

SEQ ID NO: 623245 - DNA, 15 bp, Homo sapiens
ctccagaagcagcag

SEQ ID NO: 623246 - DNA, 16 bp, Homo sapiens
ctccagaagcagcagc

SEQ ID NO: 623247 - DNA, 22 bp, Homo sapiens
cgtccctttccctgcatccctt

SEQ ID NO: 623248 - DNA, 23 bp, Homo sapiens
cgtccctttccctgcatcccttg

SEQ ID NO: 623249 - DNA, 10 bp, Homo sapiens
cgtccggcct

SEQ ID NO: 623250 - DNA, 18 bp, Homo sapiens
cgtccggcctgcagccca

SEQ ID NO: 623251 - DNA, 16 bp, Homo sapiens
cgtccgtccgcccgcc

SEQ ID NO: 623252 - DNA, 23 bp, Homo sapiens
cgtcctctcgtagaacctgcgca

SEQ ID NO: 623253 - DNA, 17 bp, Homo sapiens
cgtcctgctcgccctgt

SEQ ID NO: 623254 - DNA, 10 bp, Homo sapiens
cgtctgcccc

SEQ ID NO: 623255 - DNA, 18 bp, Homo sapiens
cgtctttggttcctcatg

SEQ ID NO: 623256 - DNA, 13 bp, Homo sapiens
cgtcttttgaaaa

SEQ ID NO: 623257 - DNA, 13 bp, Homo sapiens
cgtgaagcatcca

SEQ ID NO: 623258 - DNA, 15 bp, Homo sapiens
cgtgaccggcccgcc

SEQ ID NO: 623259 - DNA, 12 bp, Homo sapiens
cgtgcagggcca

SEQ ID NO: 623260 - DNA, 14 bp, Homo sapiens
cgtgccctgtttcc

SEQ ID NO: 623261 - DNA, 13 bp, Homo sapiens
cgtgccttccccg

SEQ ID NO: 623262 - DNA, 19 bp, Homo sapiens
cgtgcggcccgtgcgcagc

SEQ ID NO: 623263 - DNA, 21 bp, Homo sapiens
cgtgcggcccgtgcgcagccg

SEQ ID NO: 623264 - DNA, 15 bp, Homo sapiens
cgtgctcctctgccc

SEQ ID NO: 623265 - DNA, 16 bp, Homo sapiens
cgtgctcctctgcccg

SEQ ID NO: 623266 - DNA, 20 bp, Homo sapiens
cgtggaagaagggccaccct

SEQ ID NO: 623267 - DNA, 13 bp, Homo sapiens
cgtggagcttgga

SEQ ID NO: 623268 - DNA, 16 bp, Homo sapiens
cgtggagcttggagcc

SEQ ID NO: 623269 - DNA, 17 bp, Homo sapiens
cgtggagcttggagccc

SEQ ID NO: 623270 - DNA, 22 bp, Homo sapiens
cgtggagcttggagccccctgg

SEQ ID NO: 623271 - DNA, 17 bp, Homo sapiens
cgtggcaactgtggaag

SEQ ID NO: 623272 - DNA, 15 bp, Homo sapiens
cgtggctcccagcag

SEQ ID NO: 623273 - DNA, 20 bp, Homo sapiens
cgtggctcccagcagaggcc

SEQ ID NO: 623274 - DNA, 12 bp, Homo sapiens
cgtggctgcttc

SEQ ID NO: 623275 - DNA, 18 bp, Homo sapiens
cgtgggcgcaaaggtgcc

SEQ ID NO: 623276 - DNA, 19 bp, Homo sapiens
cgtgggcgcaaaggtgcct

SEQ ID NO: 623277 - DNA, 19 bp, Homo sapiens
cgtggtgtgaggcccccgg

SEQ ID NO: 623278 - DNA, 19 bp, Homo sapiens
cgtgtatatgaggatgtat

SEQ ID NO: 623279 - DNA, 23 bp, Homo sapiens
cgtgtatatgaggatgtatgtgt

SEQ ID NO: 623280 - DNA, 21 bp, Homo sapiens
cgtgtcttttaaaaactcctg

SEQ ID NO: 623281 - DNA, 23 bp, Homo sapiens
cgtgtcttttaaaaactcctgtt

SEQ ID NO: 623282 - DNA, 15 bp, Homo sapiens
cgtgtggccctgtgg

SEQ ID NO: 623283 - DNA, 16 bp, Homo sapiens
cgtgtggccctgtggg

SEQ ID NO: 623284 - DNA, 19 bp, Homo sapiens
cgtgtggccctgtgggagt

SEQ ID NO: 623285 - DNA, 15 bp, Homo sapiens
cgtgtgttctctccg

SEQ ID NO: 623286 - DNA, 13 bp, Homo sapiens
cgttattcataca

SEQ ID NO: 623287 - DNA, 14 bp, Homo sapiens
cgttgatagtttac

SEQ ID NO: 623288 - DNA, 24 bp, Homo sapiens
cgttgatagtttacaaacaagata

SEQ ID NO: 623289 - DNA, 14 bp, Homo sapiens
cgttggagagcagc

SEQ ID NO: 623290 - DNA, 19 bp, Homo sapiens
cgttgttttgtggataaga

SEQ ID NO: 623291 - DNA, 18 bp, Homo sapiens
ctaaaaggaggacaggga

SEQ ID NO: 623292 - DNA, 14 bp, Homo sapiens
ctaaagcagagatg

SEQ ID NO: 623293 - DNA, 20 bp, Homo sapiens
ctaaagtcaggccattcagt

SEQ ID NO: 623294 - DNA, 17 bp, Homo sapiens
ctaaatagcatgtattg

SEQ ID NO: 623295 - DNA, 18 bp, Homo sapiens
ctaaatcactttaattta

SEQ ID NO: 623296 - DNA, 20 bp, Homo sapiens
ctaaatcactttaatttaga

SEQ ID NO: 623297 - DNA, 18 bp, Homo sapiens
ctaaatgcctaataaaca

SEQ ID NO: 623298 - DNA, 13 bp, Homo sapiens
ctaaatgttcatg

SEQ ID NO: 623299 - DNA, 12 bp, Homo sapiens
ctaacactggct

SEQ ID NO: 623300 - DNA, 14 bp, Homo sapiens
ctaacagtaactgc

SEQ ID NO: 623301 - DNA, 13 bp, Homo sapiens
ctaacctctctga

SEQ ID NO: 623302 - DNA, 17 bp, Homo sapiens
ctaactccttacagaag

SEQ ID NO: 623303 - DNA, 14 bp, Homo sapiens
ctaactggccccag

SEQ ID NO: 623304 - DNA, 14 bp, Homo sapiens
ctaacttattttga

SEQ ID NO: 623305 - DNA, 22 bp, Homo sapiens
ctaagataattaaatgaaatac

SEQ ID NO: 623306 - DNA, 14 bp, Homo sapiens
ctaagctttctcct

SEQ ID NO: 623307 - DNA, 17 bp, Homo sapiens
ctaagtaaatctaaatt

SEQ ID NO: 623308 - DNA, 18 bp, Homo sapiens
ctaagtaaatctaaatta

SEQ ID NO: 623309 - DNA, 17 bp, Homo sapiens
ctaagttgtattttaat

SEQ ID NO: 623310 - DNA, 21 bp, Homo sapiens
ctaagttgtattttaataaag

SEQ ID NO: 623311 - DNA, 14 bp, Homo sapiens
ctaatatacagtgt

SEQ ID NO: 623312 - DNA, 14 bp, Homo sapiens
ctaatccacctggt

SEQ ID NO: 623313 - DNA, 16 bp, Homo sapiens
ctaatccacctggtgg

SEQ ID NO: 623314 - DNA, 22 bp, Homo sapiens
ctaatggccaagtgtacatttg

SEQ ID NO: 623315 - DNA, 21 bp, Homo sapiens
ctaatgtattttattgtaaca

SEQ ID NO: 623316 - DNA, 22 bp, Homo sapiens
ctaatgtattttattgtaacag

SEQ ID NO: 623317 - DNA, 15 bp, Homo sapiens
ctaattaaaaagtta

SEQ ID NO: 623318 - DNA, 16 bp, Homo sapiens
ctaattaaaaagttaa

SEQ ID NO: 623319 - DNA, 15 bp, Homo sapiens
ctaattaatttcagt

SEQ ID NO: 623320 - DNA, 12 bp, Homo sapiens
ctaattcctgta

SEQ ID NO: 623321 - DNA, 13 bp, Homo sapiens
ctaatttgtgaaa

SEQ ID NO: 623322 - DNA, 17 bp, Homo sapiens
ctaatttttattcataa

SEQ ID NO: 623323 - DNA, 23 bp, Homo sapiens
ctacaaaaaaaatcaaaaaatta

SEQ ID NO: 623324 - DNA, 10 bp, Homo sapiens
ctacaaacat

SEQ ID NO: 623325 - DNA, 20 bp, Homo sapiens
ctacacatataaacacagta

SEQ ID NO: 623326 - DNA, 23 bp, Homo sapiens
ctacacatataaacacagtaaga

SEQ ID NO: 623327 - DNA, 14 bp, Homo sapiens
ctacagatcctccg

SEQ ID NO: 623328 - DNA, 23 bp, Homo sapiens
ctacagcttttaagattgtactt

SEQ ID NO: 623329 - DNA, 13 bp, Homo sapiens
ctacatctgaaat

SEQ ID NO: 623330 - DNA, 20 bp, Homo sapiens
ctacatgggccagcccttgc

SEQ ID NO: 623331 - DNA, 22 bp, Homo sapiens
ctaccctggaccgagtggacca

SEQ ID NO: 623332 - DNA, 15 bp, Homo sapiens
ctaccctttcccaaa

SEQ ID NO: 623333 - DNA, 21 bp, Homo sapiens
ctacctttggcttaattccaa

SEQ ID NO: 623334 - DNA, 21 bp, Homo sapiens
ctactcctccccctcctccat

SEQ ID NO: 623335 - DNA, 11 bp, Homo sapiens
ctactgcccac

SEQ ID NO: 623336 - DNA, 14 bp, Homo sapiens
ctactgcccacatt

SEQ ID NO: 623337 - DNA, 14 bp, Homo sapiens
ctacttaaacaaaa

SEQ ID NO: 623338 - DNA, 16 bp, Homo sapiens
ctacttaaacaaaaac

SEQ ID NO: 623339 - DNA, 19 bp, Homo sapiens
ctacttaaacaaaaacttt

SEQ ID NO: 623340 - DNA, 15 bp, Homo sapiens
ctacttatattctgc

SEQ ID NO: 623341 - DNA, 18 bp, Homo sapiens
ctactttaaattgtggat

SEQ ID NO: 623342 - DNA, 20 bp, Homo sapiens
ctagaaagagaaaaagccct

SEQ ID NO: 623343 - DNA, 22 bp, Homo sapiens
ctagaaagagaaaaagccctct

SEQ ID NO: 623344 - DNA, 23 bp, Homo sapiens
ctagaaataaaatcaccctgact

SEQ ID NO: 623345 - DNA, 13 bp, Homo sapiens
ctagagcattctg

SEQ ID NO: 623346 - DNA, 17 bp, Homo sapiens
ctagatttggagacttt

SEQ ID NO: 623347 - DNA, 13 bp, Homo sapiens
ctagattttgttt

SEQ ID NO: 623348 - DNA, 13 bp, Homo sapiens
ctagccatatatt

SEQ ID NO: 623349 - DNA, 23 bp, Homo sapiens
ctagcccagtccctggagctgtc

SEQ ID NO: 623350 - DNA, 20 bp, Homo sapiens
ctaggaggttccggtgtctg

SEQ ID NO: 623351 - DNA, 15 bp, Homo sapiens
ctaggattcctcccc

SEQ ID NO: 623352 - DNA, 14 bp, Homo sapiens
ctaggcagggaggg

SEQ ID NO: 623353 - DNA, 17 bp, Homo sapiens
ctaggttaataggagga

SEQ ID NO: 623354 - DNA, 24 bp, Homo sapiens
ctagtaggtctgcacacataacac

SEQ ID NO: 623355 - DNA, 18 bp, Homo sapiens
ctagtgccattatttcta

SEQ ID NO: 623356 - DNA, 16 bp, Homo sapiens
ctagttagagactcgc

SEQ ID NO: 623357 - DNA, 17 bp, Homo sapiens
ctagttctgctgccctc

SEQ ID NO: 623358 - DNA, 21 bp, Homo sapiens
ctagtttaaaattattaaaaa

SEQ ID NO: 623359 - DNA, 23 bp, Homo sapiens
ctagttttaaaaaaataaaacat

SEQ ID NO: 623360 - DNA, 21 bp, Homo sapiens
ctataaaagcccatgcttaaa

SEQ ID NO: 623361 - DNA, 22 bp, Homo sapiens
ctataagagacaaagtttggaa

SEQ ID NO: 623362 - DNA, 21 bp, Homo sapiens
ctataccctaggtctccaccc

SEQ ID NO: 623363 - DNA, 20 bp, Homo sapiens
ctataggacttaatttagca

SEQ ID NO: 623364 - DNA, 15 bp, Homo sapiens
ctatatttactgttt

SEQ ID NO: 623365 - DNA, 17 bp, Homo sapiens
ctatatttactgtttat

SEQ ID NO: 623366 - DNA, 17 bp, Homo sapiens
cgggctctctcacccag

SEQ ID NO: 623367 - DNA, 13 bp, Homo sapiens
cggggcagagctg

SEQ ID NO: 623368 - DNA, 14 bp, Homo sapiens
cggggcagagctga

SEQ ID NO: 623369 - DNA, 21 bp, Homo sapiens
cggggcggcatccgagcccct

SEQ ID NO: 623370 - DNA, 23 bp, Homo sapiens
cggggctgccgcatctgcctgga

SEQ ID NO: 623371 - DNA, 17 bp, Homo sapiens
cggggcttctgggcgcc

SEQ ID NO: 623372 - DNA, 15 bp, Homo sapiens
cgggggaggagcacc

SEQ ID NO: 623373 - DNA, 16 bp, Homo sapiens
cgggggaggagcaccc

SEQ ID NO: 623374 - DNA, 17 bp, Homo sapiens
cgggggaggagcacccc

SEQ ID NO: 623375 - DNA, 22 bp, Homo sapiens
cgggggaggagcacccccagcc

SEQ ID NO: 623376 - DNA, 24 bp, Homo sapiens
cgggggaggagcacccccagcctc

SEQ ID NO: 623377 - DNA, 16 bp, Homo sapiens
cgggggctaactggcc

SEQ ID NO: 623378 - DNA, 22 bp, Homo sapiens
cgggggctaactggccccaggc

SEQ ID NO: 623379 - DNA, 21 bp, Homo sapiens
cggggtgtggaatcaccggga

SEQ ID NO: 623380 - DNA, 15 bp, Homo sapiens
cggggttccctgcgc

SEQ ID NO: 623381 - DNA, 11 bp, Homo sapiens
cgggtctgtgg

SEQ ID NO: 623382 - DNA, 13 bp, Homo sapiens
cgggtctgtggga

SEQ ID NO: 623383 - DNA, 18 bp, Homo sapiens
cgggtgcgtgaccggccc

SEQ ID NO: 623384 - DNA, 23 bp, Homo sapiens
cgggtgcgtgaccggcccgccac

SEQ ID NO: 623385 - DNA, 15 bp, Homo sapiens
cggtccaatccagcc

SEQ ID NO: 623386 - DNA, 16 bp, Homo sapiens
cggtccaatccagcct

SEQ ID NO: 623387 - DNA, 15 bp, Homo sapiens
cggtccaccccgtcc

SEQ ID NO: 623388 - DNA, 16 bp, Homo sapiens
cggtgagactctgagg

SEQ ID NO: 623389 - DNA, 17 bp, Homo sapiens
cggtggcatttgctgaa

SEQ ID NO: 623390 - DNA, 21 bp, Homo sapiens
cggtgggagccgtcagcctgt

SEQ ID NO: 623391 - DNA, 23 bp, Homo sapiens
cggtgggcgcctgtcgggcccgc

SEQ ID NO: 623392 - DNA, 17 bp, Homo sapiens
cggtggggccagcgctg

SEQ ID NO: 623393 - DNA, 21 bp, Homo sapiens
cggtgtagggaacggcctgag

SEQ ID NO: 623394 - DNA, 17 bp, Homo sapiens
cggtgtttggaggctgc

SEQ ID NO: 623395 - DNA, 20 bp, Homo sapiens
cggtgtttggaggctgctgc

SEQ ID NO: 623396 - DNA, 16 bp, Homo sapiens
cgtagaacctgcgcac

SEQ ID NO: 623397 - DNA, 13 bp, Homo sapiens
cgtcaatgtgaaa

SEQ ID NO: 623398 - DNA, 14 bp, Homo sapiens
cgtcagcctgtgaa

SEQ ID NO: 623399 - DNA, 13 bp, Homo sapiens
cgtccccagggtg

SEQ ID NO: 623400 - DNA, 14 bp, Homo sapiens
cgtccccagggtgc

SEQ ID NO: 623401 - DNA, 19 bp, Homo sapiens
cgtccccagggtgcaggcg

SEQ ID NO: 623402 - DNA, 22 bp, Homo sapiens
cgtcccggccccgcgcgtgccc

SEQ ID NO: 623403 - DNA, 17 bp, Homo sapiens
cgtccctgacttcccag

SEQ ID NO: 623404 - DNA, 22 bp, Homo sapiens
cgtccctgagggcccttcccaa

SEQ ID NO: 623405 - DNA, 15 bp, Homo sapiens
cgtccctgctcagcc

SEQ ID NO: 623406 - DNA, 16 bp, Homo sapiens
cgtccctttccctgca

SEQ ID NO: 623407 - DNA, 17 bp, Homo sapiens
cgtccctttccctgcat

SEQ ID NO: 623408 - DNA, 14 bp, Homo sapiens
cgccttctggggag

SEQ ID NO: 623409 - DNA, 14 bp, Homo sapiens
cgcgaactgggttc

SEQ ID NO: 623410 - DNA, 15 bp, Homo sapiens
cgcgacaatgcaaac

SEQ ID NO: 623411 - DNA, 17 bp, Homo sapiens
cgcgacaatgcaaacca

SEQ ID NO: 623412 - DNA, 13 bp, Homo sapiens
cgcgaccacccct

SEQ ID NO: 623413 - DNA, 13 bp, Homo sapiens
cgcgcaccgccca

SEQ ID NO: 623414 - DNA, 14 bp, Homo sapiens
cgcgcccccaggac

SEQ ID NO: 623415 - DNA, 21 bp, Homo sapiens
cgcgcccccaggaccccccca

SEQ ID NO: 623416 - DNA, 22 bp, Homo sapiens
cgcgcccccaggacccccccag

SEQ ID NO: 623417 - DNA, 21 bp, Homo sapiens
cgcgcccctctgcgccccagc

SEQ ID NO: 623418 - DNA, 18 bp, Homo sapiens
cgcgcccgccgcctccct

SEQ ID NO: 623419 - DNA, 19 bp, Homo sapiens
cgcgcgggacagcggcccc

SEQ ID NO: 623420 - DNA, 13 bp, Homo sapiens
cgcgcgtgccccc

SEQ ID NO: 623421 - DNA, 13 bp, Homo sapiens
cgcgctctgcccc

SEQ ID NO: 623422 - DNA, 14 bp, Homo sapiens
cgcgctctgcccct

SEQ ID NO: 623423 - DNA, 17 bp, Homo sapiens
cgcgctctgcccctccg

SEQ ID NO: 623424 - DNA, 12 bp, Homo sapiens
cgcggagccccc

SEQ ID NO: 623425 - DNA, 15 bp, Homo sapiens
cgcggagcccccgcc

SEQ ID NO: 623426 - DNA, 15 bp, Homo sapiens
cgcggaggcccctga

SEQ ID NO: 623427 - DNA, 23 bp, Homo sapiens
cgcggctgctgcttctccctggg

SEQ ID NO: 623428 - DNA, 18 bp, Homo sapiens
cgcgggtggctggagccc

SEQ ID NO: 623429 - DNA, 22 bp, Homo sapiens
cgcgggtggctggagccccatc

SEQ ID NO: 623430 - DNA, 18 bp, Homo sapiens
cgcgtcctttcctctcct

SEQ ID NO: 623431 - DNA, 16 bp, Homo sapiens
cgcgtgcccccagcgt

SEQ ID NO: 623432 - DNA, 17 bp, Homo sapiens
cgcgtgcccccagcgtg

SEQ ID NO: 623433 - DNA, 21 bp, Homo sapiens
cgcgtgccttccccgtgcggc

SEQ ID NO: 623434 - DNA, 22 bp, Homo sapiens
cgctagagcattctggggtggg

SEQ ID NO: 623435 - DNA, 16 bp, Homo sapiens
cgctccggcagaggca

SEQ ID NO: 623436 - DNA, 23 bp, Homo sapiens
cgctccgggtgcgtgaccggccc

SEQ ID NO: 623437 - DNA, 15 bp, Homo sapiens
cgctcctctgcagcc

SEQ ID NO: 623438 - DNA, 17 bp, Homo sapiens
cgctcctctgcagcctg

SEQ ID NO: 623439 - DNA, 18 bp, Homo sapiens
cgctcctctgcagcctga

SEQ ID NO: 623440 - DNA, 19 bp, Homo sapiens
cgctcctctgcagcctgag

SEQ ID NO: 623441 - DNA, 12 bp, Homo sapiens
cgctctgcccct

SEQ ID NO: 623442 - DNA, 13 bp, Homo sapiens
cgctctgcccctc

SEQ ID NO: 623443 - DNA, 16 bp, Homo sapiens
cgctgcagtcagcaca

SEQ ID NO: 623444 - DNA, 10 bp, Homo sapiens
cgctgcctgg

SEQ ID NO: 623445 - DNA, 13 bp, Homo sapiens
ccttgctgggcca

SEQ ID NO: 623446 - DNA, 22 bp, Homo sapiens
ccttgctgggccagggaaacaa

SEQ ID NO: 623447 - DNA, 22 bp, Homo sapiens
ccttggagagagaggctgcctc

SEQ ID NO: 623448 - DNA, 23 bp, Homo sapiens
ccttggagagagaggctgcctca

SEQ ID NO: 623449 - DNA, 13 bp, Homo sapiens
ccttggagaggag

SEQ ID NO: 623450 - DNA, 22 bp, Homo sapiens
ccttggagcagaaagccagggt

SEQ ID NO: 623451 - DNA, 14 bp, Homo sapiens
ccttggcccctctc

SEQ ID NO: 623452 - DNA, 20 bp, Homo sapiens
ccttggtgtcgggcatgaca

SEQ ID NO: 623453 - DNA, 14 bp, Homo sapiens
ccttggttcctcca

SEQ ID NO: 623454 - DNA, 15 bp, Homo sapiens
ccttggttcctccag

SEQ ID NO: 623455 - DNA, 18 bp, Homo sapiens
ccttgtgatcactttctg

SEQ ID NO: 623456 - DNA, 20 bp, Homo sapiens
ccttgtgatcactttctgaa

SEQ ID NO: 623457 - DNA, 18 bp, Homo sapiens
cctttatcatgtgtttct

SEQ ID NO: 623458 - DNA, 20 bp, Homo sapiens
cctttatcatgtgtttctgt

SEQ ID NO: 623459 - DNA, 15 bp, Homo sapiens
cctttcaataggaaa

SEQ ID NO: 623460 - DNA, 15 bp, Homo sapiens
cctttccccagtgtg

SEQ ID NO: 623461 - DNA, 18 bp, Homo sapiens
cctttccccattcagtga

SEQ ID NO: 623462 - DNA, 20 bp, Homo sapiens
cctttccccattcagtgaca

SEQ ID NO: 623463 - DNA, 21 bp, Homo sapiens
cctttcccgatgcgtggctcc

SEQ ID NO: 623464 - DNA, 13 bp, Homo sapiens
cctttccctgcat

SEQ ID NO: 623465 - DNA, 14 bp, Homo sapiens
cctttctcttgctg

SEQ ID NO: 623466 - DNA, 21 bp, Homo sapiens
cctttctgagtgacatgggtg

SEQ ID NO: 623467 - DNA, 23 bp, Homo sapiens
cctttctgagtgacatgggtgtg

SEQ ID NO: 623468 - DNA, 13 bp, Homo sapiens
cctttcttccttc

SEQ ID NO: 623469 - DNA, 14 bp, Homo sapiens
cctttcttccttcc

SEQ ID NO: 623470 - DNA, 16 bp, Homo sapiens
cctttcttccttcctt

SEQ ID NO: 623471 - DNA, 16 bp, Homo sapiens
cctttttctacctttt

SEQ ID NO: 623472 - DNA, 15 bp, Homo sapiens
cgaaaacgtggctgc

SEQ ID NO: 623473 - DNA, 15 bp, Homo sapiens
cgaacaaaccaagga

SEQ ID NO: 623474 - DNA, 13 bp, Homo sapiens
cgaagaaatagaa

SEQ ID NO: 623475 - DNA, 21 bp, Homo sapiens
cgaagaaatagaataggcaaa

SEQ ID NO: 623476 - DNA, 17 bp, Homo sapiens
cctctctctccctccac

SEQ ID NO: 623477 - DNA, 21 bp, Homo sapiens
cctctctctctctctctctgt

SEQ ID NO: 623478 - DNA, 18 bp, Homo sapiens
cctctctgtttaccctcc

SEQ ID NO: 623479 - DNA, 17 bp, Homo sapiens
cctctcttaccccgtcc

SEQ ID NO: 623480 - DNA, 15 bp, Homo sapiens
cctctgagacagaga

SEQ ID NO: 623481 - DNA, 22 bp, Homo sapiens
cctctgcagcctgagctccacc

SEQ ID NO: 623482 - DNA, 16 bp, Homo sapiens
cctctgcataaatatt

SEQ ID NO: 623483 - DNA, 13 bp, Homo sapiens
cctctgccccctc

SEQ ID NO: 623484 - DNA, 19 bp, Homo sapiens
cctctgccccctcccccgc

SEQ ID NO: 623485 - DNA, 21 bp, Homo sapiens
cctctgccccctcccccgcag

SEQ ID NO: 623486 - DNA, 15 bp, Homo sapiens
cctctgcgccccagc

SEQ ID NO: 623487 - DNA, 12 bp, Homo sapiens
ccctttccctgc

SEQ ID NO: 623488 - DNA, 17 bp, Homo sapiens
ccctttcgtccacatca

SEQ ID NO: 623489 - DNA, 16 bp, Homo sapiens
ccgaagccccttggag

SEQ ID NO: 623490 - DNA, 14 bp, Homo sapiens
ccgaccccatctca

SEQ ID NO: 623491 - DNA, 13 bp, Homo sapiens
ccgagcccctgtt

SEQ ID NO: 623492 - DNA, 11 bp, Homo sapiens
ccgaggaggcc

SEQ ID NO: 623493 - DNA, 23 bp, Homo sapiens
ccgagtggaccacgacctcgtcc

SEQ ID NO: 623494 - DNA, 19 bp, Homo sapiens
ccgcacgcggccgctctcc

SEQ ID NO: 623495 - DNA, 19 bp, Homo sapiens
ccgcactcaggagcacagc

SEQ ID NO: 623496 - DNA, 20 bp, Homo sapiens
ccgcactcaggagcacagcc

SEQ ID NO: 623497 - DNA, 16 bp, Homo sapiens
ccgcagcaccagcctg

SEQ ID NO: 623498 - DNA, 17 bp, Homo sapiens
ccgcagcaccagcctga

SEQ ID NO: 623499 - DNA, 19 bp, Homo sapiens
ccgcagcaccagcctgagc

SEQ ID NO: 623500 - DNA, 20 bp, Homo sapiens
ccgcagggcgctccggcaga

SEQ ID NO: 623501 - DNA, 19 bp, Homo sapiens
ccgcatctgcctggagcct

SEQ ID NO: 623502 - DNA, 22 bp, Homo sapiens
ccgcatctgcctggagcctggg

SEQ ID NO: 623503 - DNA, 18 bp, Homo sapiens
ccgcccaacccccacctc

SEQ ID NO: 623504 - DNA, 12 bp, Homo sapiens
ccgcccaccccg

SEQ ID NO: 623505 - DNA, 14 bp, Homo sapiens
ccgcccccgccctc

SEQ ID NO: 623506 - DNA, 17 bp, Homo sapiens
ccgcccccgccctcgct

SEQ ID NO: 623507 - DNA, 14 bp, Homo sapiens
ccgcccctccccct

SEQ ID NO: 623508 - DNA, 13 bp, Homo sapiens
ccgcccgcccacc

SEQ ID NO: 623509 - DNA, 13 bp, Homo sapiens
ccgcccggcctcc

SEQ ID NO: 623510 - DNA, 11 bp, Homo sapiens
ccgccctcctc

SEQ ID NO: 623511 - DNA, 18 bp, Homo sapiens
ccgccgaagggcagcccc

SEQ ID NO: 623512 - DNA, 22 bp, Homo sapiens
ccgccgaagggcagccccgcga

SEQ ID NO: 623513 - DNA, 15 bp, Homo sapiens
ccgccgcctcgggcc

SEQ ID NO: 623514 - DNA, 16 bp, Homo sapiens
ccgccggttggccggc

SEQ ID NO: 623515 - DNA, 13 bp, Homo sapiens
ccgcctcactggg

SEQ ID NO: 623516 - DNA, 16 bp, Homo sapiens
ccgcctcctccagact

SEQ ID NO: 623517 - DNA, 20 bp, Homo sapiens
ccgcctcgggccgcctcctc

SEQ ID NO: 623518 - DNA, 19 bp, Homo sapiens
ccgcctgtgcccacgtgtg

SEQ ID NO: 623519 - DNA, 15 bp, Homo sapiens
ccgcgaactgggttc

SEQ ID NO: 623520 - DNA, 19 bp, Homo sapiens
ccgcgaccacccctgtgcg

SEQ ID NO: 623521 - DNA, 15 bp, Homo sapiens
ccgcgcccctctgcg

SEQ ID NO: 623522 - DNA, 16 bp, Homo sapiens
ccgcgcccctctgcgc

SEQ ID NO: 623523 - DNA, 18 bp, Homo sapiens
ccgcgcgtgcccccagcg

SEQ ID NO: 623524 - DNA, 20 bp, Homo sapiens
ccgcgctctgcccctccgtc

SEQ ID NO: 623525 - DNA, 20 bp, Homo sapiens
ccgcgggtggctggagcccc

SEQ ID NO: 623526 - DNA, 14 bp, Homo sapiens
ccgcgtcctttcct

SEQ ID NO: 623527 - DNA, 19 bp, Homo sapiens
ccgctgcagtcagcacaga

SEQ ID NO: 623528 - DNA, 21 bp, Homo sapiens
ccgctgcagtcagcacagaga

SEQ ID NO: 623529 - DNA, 19 bp, Homo sapiens
ccggacgcatgcagggccc

SEQ ID NO: 623530 - DNA, 12 bp, Homo sapiens
ccggacgctgga

SEQ ID NO: 623531 - DNA, 19 bp, Homo sapiens
ccggacgctggagaccctg

SEQ ID NO: 623532 - DNA, 20 bp, Homo sapiens
ccggacgctggagaccctgc

SEQ ID NO: 623533 - DNA, 15 bp, Homo sapiens
ccggaggcgcccacc

SEQ ID NO: 623534 - DNA, 18 bp, Homo sapiens
ccggaggcgcccacctgc

SEQ ID NO: 623535 - DNA, 21 bp, Homo sapiens
ccggaggcgcccacctgccca

SEQ ID NO: 623536 - DNA, 21 bp, Homo sapiens
ccggcaaggggcgcgcgcccc

SEQ ID NO: 623537 - DNA, 13 bp, Homo sapiens
ccggcactgtgca

SEQ ID NO: 623538 - DNA, 12 bp, Homo sapiens
ccggcagaggca

SEQ ID NO: 623539 - DNA, 17 bp, Homo sapiens
ccggcagaggcagggcc

SEQ ID NO: 623540 - DNA, 15 bp, Homo sapiens
ccggccaaggacact

SEQ ID NO: 623541 - DNA, 17 bp, Homo sapiens
ccggccaaggacactga

SEQ ID NO: 623542 - DNA, 19 bp, Homo sapiens
ccggccaaggacactgatg

SEQ ID NO: 623543 - DNA, 20 bp, Homo sapiens
ccggcccacgcagagccccg

SEQ ID NO: 623544 - DNA, 18 bp, Homo sapiens
ccggccccatcagaggct

SEQ ID NO: 623545 - DNA, 16 bp, Homo sapiens
ccggcccccctctcgg

SEQ ID NO: 623546 - DNA, 20 bp, Homo sapiens
ccggcccccctctcgggctc

SEQ ID NO: 623547 - DNA, 14 bp, Homo sapiens
ccggctgactcagt

SEQ ID NO: 623548 - DNA, 18 bp, Homo sapiens
ccggctggccggtccacc

SEQ ID NO: 623549 - DNA, 22 bp, Homo sapiens
ccgggagcgcacctcgccgtgt

SEQ ID NO: 623550 - DNA, 16 bp, Homo sapiens
ccgggcagagaccacc

SEQ ID NO: 623551 - DNA, 19 bp, Homo sapiens
ccgggcagagaccaccgcg

SEQ ID NO: 623552 - DNA, 12 bp, Homo sapiens
ccggggctggcc

SEQ ID NO: 623553 - DNA, 16 bp, Homo sapiens
ccggggctggccctgc

SEQ ID NO: 623554 - DNA, 17 bp, Homo sapiens
ccggggctggccctgcc

SEQ ID NO: 623555 - DNA, 18 bp, Homo sapiens
ccggggctggccctgccc

SEQ ID NO: 623556 - DNA, 23 bp, Homo sapiens
ccgggtctcgcagcctgaagcct

SEQ ID NO: 623557 - DNA, 16 bp, Homo sapiens
ccgggtgccattccca

SEQ ID NO: 623558 - DNA, 23 bp, Homo sapiens
ccgggtgccccccatgccctccc

SEQ ID NO: 623559 - DNA, 17 bp, Homo sapiens
ccggtggggccagcgct

SEQ ID NO: 623560 - DNA, 14 bp, Homo sapiens
ccggttccacgtgg

SEQ ID NO: 623561 - DNA, 19 bp, Homo sapiens
ccggttggccggctggccg

SEQ ID NO: 623562 - DNA, 22 bp, Homo sapiens
ccgtccctgacttcccagctgg

SEQ ID NO: 623563 - DNA, 15 bp, Homo sapiens
ccgtccgcccgccca

SEQ ID NO: 623564 - DNA, 20 bp, Homo sapiens
ccgtcctgctcgccctgtgc

SEQ ID NO: 623565 - DNA, 12 bp, Homo sapiens
ccgtctgtcctg

SEQ ID NO: 623566 - DNA, 14 bp, Homo sapiens
ccgtctgtcctgcg

SEQ ID NO: 623567 - DNA, 21 bp, Homo sapiens
ccgtctttggttcctcatggc

SEQ ID NO: 623568 - DNA, 13 bp, Homo sapiens
ccgtgcgcagccg

SEQ ID NO: 623569 - DNA, 19 bp, Homo sapiens
ccgtgcgcagccgcgctct

SEQ ID NO: 623570 - DNA, 15 bp, Homo sapiens
ccgtgcggcccgtgc

SEQ ID NO: 623571 - DNA, 15 bp, Homo sapiens
ccgtgctcctctgcc

SEQ ID NO: 623572 - DNA, 18 bp, Homo sapiens
ccgtgctcctctgcccgc

SEQ ID NO: 623573 - DNA, 15 bp, Homo sapiens
ccgtgggcagctcct

SEQ ID NO: 623574 - DNA, 14 bp, Homo sapiens
ccgtggtgtcctct

SEQ ID NO: 623575 - DNA, 18 bp, Homo sapiens
ccgtggtgtcctctgtcc

SEQ ID NO: 623576 - DNA, 14 bp, Homo sapiens
ccgtggtgtgaggc

SEQ ID NO: 623577 - DNA, 18 bp, Homo sapiens
ccgtggtgtgaggccccc

SEQ ID NO: 623578 - DNA, 23 bp, Homo sapiens
ccgtggtgtgaggcccccggagg

SEQ ID NO: 623579 - DNA, 19 bp, Homo sapiens
ccgttaggaataacactgc

SEQ ID NO: 623580 - DNA, 23 bp, Homo sapiens
ccgttgtgtgggtttactctgtg

SEQ ID NO: 623581 - DNA, 17 bp, Homo sapiens
cctaaagggaagccctg

SEQ ID NO: 623582 - DNA, 22 bp, Homo sapiens
cctaaattaacaaattcagtgg

SEQ ID NO: 623583 - DNA, 19 bp, Homo sapiens
cctaagagtggaggaggag

SEQ ID NO: 623584 - DNA, 14 bp, Homo sapiens
cctaatccacctgg

SEQ ID NO: 623585 - DNA, 16 bp, Homo sapiens
cctaattctatgatta

SEQ ID NO: 623586 - DNA, 13 bp, Homo sapiens
cctacatctgaaa

SEQ ID NO: 623587 - DNA, 16 bp, Homo sapiens
cctaccctcttctcag

SEQ ID NO: 623588 - DNA, 18 bp, Homo sapiens
cctaccctggaccgagtg

SEQ ID NO: 623589 - DNA, 13 bp, Homo sapiens
cctacgtgctgcc

SEQ ID NO: 623590 - DNA, 20 bp, Homo sapiens
cctactcctccccctcctcc

SEQ ID NO: 623591 - DNA, 13 bp, Homo sapiens
cctactgcccaca

SEQ ID NO: 623592 - DNA, 23 bp, Homo sapiens
cctactggatgcttacagtgact

SEQ ID NO: 623593 - DNA, 15 bp, Homo sapiens
cctaggtctccaccc

SEQ ID NO: 623594 - DNA, 16 bp, Homo sapiens
cctaggtctccacccc

SEQ ID NO: 623595 - DNA, 22 bp, Homo sapiens
cctagttctttgcattcgtcct

SEQ ID NO: 623596 - DNA, 15 bp, Homo sapiens
cctatcatcagttag

SEQ ID NO: 623597 - DNA, 16 bp, Homo sapiens
cctatcctgcaccctc

SEQ ID NO: 623598 - DNA, 18 bp, Homo sapiens
cctatcctgcaccctctg

SEQ ID NO: 623599 - DNA, 21 bp, Homo sapiens
cctattgctgtaaataaaaat

SEQ ID NO: 623600 - DNA, 24 bp, Homo sapiens
cctattgctgtaaataaaaatagc

SEQ ID NO: 623601 - DNA, 13 bp, Homo sapiens
cctcaagccagga

SEQ ID NO: 623602 - DNA, 16 bp, Homo sapiens
cctcaagccaggagac

SEQ ID NO: 623603 - DNA, 17 bp, Homo sapiens
cctcacacctcccttca

SEQ ID NO: 623604 - DNA, 12 bp, Homo sapiens
cctcacagcctc

SEQ ID NO: 623605 - DNA, 13 bp, Homo sapiens
cctcacagcctct

SEQ ID NO: 623606 - DNA, 22 bp, Homo sapiens
cactctagttgtggacttttcc

SEQ ID NO: 623607 - DNA, 18 bp, Homo sapiens
cactctgaagtcccttcc

SEQ ID NO: 623608 - DNA, 20 bp, Homo sapiens
cactctgaagtcccttcctg

SEQ ID NO: 623609 - DNA, 21 bp, Homo sapiens
cactctgaagtcccttcctgt

SEQ ID NO: 623610 - DNA, 19 bp, Homo sapiens
cactctgaataccaagtgt

SEQ ID NO: 623611 - DNA, 13 bp, Homo sapiens
cactgacttctcc

SEQ ID NO: 623612 - DNA, 16 bp, Homo sapiens
cactgatgggtcctgc

SEQ ID NO: 623613 - DNA, 20 bp, Homo sapiens
cactgccatttcctcctggg

SEQ ID NO: 623614 - DNA, 20 bp, Homo sapiens
cactgccctccgcccttccc

SEQ ID NO: 623615 - DNA, 21 bp, Homo sapiens
cactgccctccgcccttccct

SEQ ID NO: 623616 - DNA, 15 bp, Homo sapiens
cactgccctctgcca

SEQ ID NO: 623617 - DNA, 23 bp, Homo sapiens
cactgtcatgtgcgaacacagtg

SEQ ID NO: 623618 - DNA, 13 bp, Homo sapiens
cactgtctgctgc

SEQ ID NO: 623619 - DNA, 14 bp, Homo sapiens
cactgtctgctgcc

SEQ ID NO: 623620 - DNA, 21 bp, Homo sapiens
cactgtgacctgctcctgccc

SEQ ID NO: 623621 - DNA, 23 bp, Homo sapiens
cacttagggagtgtgccttgggc

SEQ ID NO: 623622 - DNA, 18 bp, Homo sapiens
cacttccttaacagctgt

SEQ ID NO: 623623 - DNA, 22 bp, Homo sapiens
cacttccttaacagctgtatta

SEQ ID NO: 623624 - DNA, 23 bp, Homo sapiens
cacttccttaacagctgtattat

SEQ ID NO: 623625 - DNA, 13 bp, Homo sapiens
cacttctccttaa

SEQ ID NO: 623626 - DNA, 18 bp, Homo sapiens
cacttctccttaaccccc

SEQ ID NO: 623627 - DNA, 15 bp, Homo sapiens
cacttgggctggcac

SEQ ID NO: 623628 - DNA, 22 bp, Homo sapiens
cacttgggctggcacccactgg

SEQ ID NO: 623629 - DNA, 14 bp, Homo sapiens
cacttgtaattaga

SEQ ID NO: 623630 - DNA, 14 bp, Homo sapiens
cactttaatttaga

SEQ ID NO: 623631 - DNA, 16 bp, Homo sapiens
cactttcctctctctc

SEQ ID NO: 623632 - DNA, 16 bp, Homo sapiens
cactttgggaggctga

SEQ ID NO: 623633 - DNA, 19 bp, Homo sapiens
cacttttattgtataatta

SEQ ID NO: 623634 - DNA, 16 bp, Homo sapiens
cacttttttcctgtca

SEQ ID NO: 623635 - DNA, 15 bp, Homo sapiens
cagaaaaacaaaaaa

SEQ ID NO: 623636 - DNA, 19 bp, Homo sapiens
cagaaaaacaaaaaaaaga

SEQ ID NO: 623637 - DNA, 16 bp, Homo sapiens
cagaaaagcacctctt

SEQ ID NO: 623638 - DNA, 23 bp, Homo sapiens
cagaaaatttttgtctttcatgg

SEQ ID NO: 623639 - DNA, 23 bp, Homo sapiens
cagaaacacggagtttccatttg

SEQ ID NO: 623640 - DNA, 21 bp, Homo sapiens
cagaaagaggaataaaatgat

SEQ ID NO: 623641 - DNA, 16 bp, Homo sapiens
cagaaagggcagcccc

SEQ ID NO: 623642 - DNA, 19 bp, Homo sapiens
cagaaatacatcatatgtt

SEQ ID NO: 623643 - DNA, 16 bp, Homo sapiens
cagaaccagcactccc

SEQ ID NO: 623644 - DNA, 23 bp, Homo sapiens
cagaaccagcactcccagggccc

SEQ ID NO: 623645 - DNA, 16 bp, Homo sapiens
cagaacgcatgcaggg

SEQ ID NO: 623646 - DNA, 17 bp, Homo sapiens
cagaacgggcctccccg

SEQ ID NO: 623647 - DNA, 21 bp, Homo sapiens
cagaagcagcagctagaaaga

SEQ ID NO: 623648 - DNA, 16 bp, Homo sapiens
cagaagcagttgcaat

SEQ ID NO: 623649 - DNA, 18 bp, Homo sapiens
cagaagctcaaggctgca

SEQ ID NO: 623650 - DNA, 17 bp, Homo sapiens
cagaaggcccgaggagg

SEQ ID NO: 623651 - DNA, 19 bp, Homo sapiens
cagaaggcccgaggaggcc

SEQ ID NO: 623652 - DNA, 22 bp, Homo sapiens
cagaagtttaaatctttgttaa

SEQ ID NO: 623653 - DNA, 14 bp, Homo sapiens
cagaatgagatgat

SEQ ID NO: 623654 - DNA, 20 bp, Homo sapiens
cagaatggtgggctccagag

SEQ ID NO: 623655 - DNA, 22 bp, Homo sapiens
cagaattgaaccgtcaatgtga

SEQ ID NO: 623656 - DNA, 22 bp, Homo sapiens
cagaattgggcccttagaatgt

SEQ ID NO: 623657 - DNA, 12 bp, Homo sapiens
cagacacacaca

SEQ ID NO: 623658 - DNA, 19 bp, Homo sapiens
cagacacacacatatatac

SEQ ID NO: 623659 - DNA, 14 bp, Homo sapiens
cagacacctagact

SEQ ID NO: 623660 - DNA, 16 bp, Homo sapiens
cagacagggtggggct

SEQ ID NO: 623661 - DNA, 13 bp, Homo sapiens
cagacattgtttt

SEQ ID NO: 623662 - DNA, 19 bp, Homo sapiens
cagacattgttttgccaac

SEQ ID NO: 623663 - DNA, 20 bp, Homo sapiens
cagacattgttttgccaaca

SEQ ID NO: 623664 - DNA, 18 bp, Homo sapiens
cagaccacggtgtggggg

SEQ ID NO: 623665 - DNA, 14 bp, Homo sapiens
cagacccctaccct

SEQ ID NO: 623666 - DNA, 22 bp, Homo sapiens
cagacctccagattattttcta

SEQ ID NO: 623667 - DNA, 12 bp, Homo sapiens
cagacggacggg

SEQ ID NO: 623668 - DNA, 14 bp, Homo sapiens
cagacggggggctg

SEQ ID NO: 623669 - DNA, 17 bp, Homo sapiens
cagactcgagagggctg

SEQ ID NO: 623670 - DNA, 17 bp, Homo sapiens
cagactgccttatatta

SEQ ID NO: 623671 - DNA, 14 bp, Homo sapiens
cagactgtggctgc

SEQ ID NO: 623672 - DNA, 20 bp, Homo sapiens
cagagaccaccgcgcccctc

SEQ ID NO: 623673 - DNA, 16 bp, Homo sapiens
cagagacggcagcccc

SEQ ID NO: 623674 - DNA, 21 bp, Homo sapiens
cagagacggcagccccatcct

SEQ ID NO: 623675 - DNA, 22 bp, Homo sapiens
cagagacggcagccccatcctt

SEQ ID NO: 623676 - DNA, 13 bp, Homo sapiens
cagagactgccca

SEQ ID NO: 623677 - DNA, 18 bp, Homo sapiens
ccagtcatggctgtcccc

SEQ ID NO: 623678 - DNA, 21 bp, Homo sapiens
ccagtcatggctgtcccctgc

SEQ ID NO: 623679 - DNA, 13 bp, Homo sapiens
ccagtccctggag

SEQ ID NO: 623680 - DNA, 15 bp, Homo sapiens
ccagtccctggagct

SEQ ID NO: 623681 - DNA, 17 bp, Homo sapiens
ccagtccctggagctgt

SEQ ID NO: 623682 - DNA, 13 bp, Homo sapiens
ccagtccgccccg

SEQ ID NO: 623683 - DNA, 16 bp, Homo sapiens
ccagtccgccccgtgc

SEQ ID NO: 623684 - DNA, 15 bp, Homo sapiens
ccagtgccgcctgtg

SEQ ID NO: 623685 - DNA, 18 bp, Homo sapiens
ccagtgccgcctgtgccc

SEQ ID NO: 623686 - DNA, 12 bp, Homo sapiens
ccagtggcacag

SEQ ID NO: 623687 - DNA, 13 bp, Homo sapiens
ccagtggggtccc

SEQ ID NO: 623688 - DNA, 18 bp, Homo sapiens
ccagtggtgcgggccagg

SEQ ID NO: 623689 - DNA, 22 bp, Homo sapiens
ccagtggtgcgggccaggtctg

SEQ ID NO: 623690 - DNA, 19 bp, Homo sapiens
ccagtgtttagaagagcct

SEQ ID NO: 623691 - DNA, 23 bp, Homo sapiens
ccagttccctcagccctcattaa

SEQ ID NO: 623692 - DNA, 20 bp, Homo sapiens
ccataacgttagactgcaat

SEQ ID NO: 623693 - DNA, 14 bp, Homo sapiens
ccatagccccaggc

SEQ ID NO: 623694 - DNA, 22 bp, Homo sapiens
ccatcaaagccctccctgtctg

SEQ ID NO: 623695 - DNA, 18 bp, Homo sapiens
ccatcagaggctggggga

SEQ ID NO: 623696 - DNA, 21 bp, Homo sapiens
ccatcagatgatgggagtggg

SEQ ID NO: 623697 - DNA, 12 bp, Homo sapiens
ccatcaggactt

SEQ ID NO: 623698 - DNA, 12 bp, Homo sapiens
ccatcattgaaa

SEQ ID NO: 623699 - DNA, 14 bp, Homo sapiens
ccatcattgaaatc

SEQ ID NO: 623700 - DNA, 16 bp, Homo sapiens
ccatcattgaaatctt

SEQ ID NO: 623701 - DNA, 12 bp, Homo sapiens
ccatcatttcat

SEQ ID NO: 623702 - DNA, 14 bp, Homo sapiens
ccatcatttcattc

SEQ ID NO: 623703 - DNA, 16 bp, Homo sapiens
ccatcccctgcctcta

SEQ ID NO: 623704 - DNA, 15 bp, Homo sapiens
ccatccttcccgcag

SEQ ID NO: 623705 - DNA, 17 bp, Homo sapiens
ccatccttcccgcagca

SEQ ID NO: 623706 - DNA, 18 bp, Homo sapiens
ccatccttcccgcagcac

SEQ ID NO: 623707 - DNA, 14 bp, Homo sapiens
ccatctccaccctg

SEQ ID NO: 623708 - DNA, 24 bp, Homo sapiens
ccatctccaccctgagcctgacct

SEQ ID NO: 623709 - DNA, 12 bp, Homo sapiens
ccatcttgggat

SEQ ID NO: 623710 - DNA, 17 bp, Homo sapiens
ccatgaaaagttttcaa

SEQ ID NO: 623711 - DNA, 21 bp, Homo sapiens
ccatgcaggcagcctgcagac

SEQ ID NO: 623712 - DNA, 22 bp, Homo sapiens
ccatgcccacgcccctccccag

SEQ ID NO: 623713 - DNA, 17 bp, Homo sapiens
ccatgccccagctctgg

SEQ ID NO: 623714 - DNA, 18 bp, Homo sapiens
ccatgccccagctctgga

SEQ ID NO: 623715 - DNA, 16 bp, Homo sapiens
ccatgctcagctcagc

SEQ ID NO: 623716 - DNA, 13 bp, Homo sapiens
ccatgctggctgg

SEQ ID NO: 623717 - DNA, 14 bp, Homo sapiens
ccatgctggctggg

SEQ ID NO: 623718 - DNA, 15 bp, Homo sapiens
ccatgctggctgggg

SEQ ID NO: 623719 - DNA, 16 bp, Homo sapiens
ccatgctggctggggc

SEQ ID NO: 623720 - DNA, 20 bp, Homo sapiens
ccatgctggctggggccggg

SEQ ID NO: 623721 - DNA, 12 bp, Homo sapiens
ccatgctgggct

SEQ ID NO: 623722 - DNA, 22 bp, Homo sapiens
ccatgctgggctcactacatgg

SEQ ID NO: 623723 - DNA, 18 bp, Homo sapiens
ccatgctgtccctgtggg

SEQ ID NO: 623724 - DNA, 22 bp, Homo sapiens
ccatgctgtccctgtgggctca

SEQ ID NO: 623725 - DNA, 23 bp, Homo sapiens
ccatgctgtccctgtgggctcac

SEQ ID NO: 623726 - DNA, 15 bp, Homo sapiens
ccatggaacagccct

SEQ ID NO: 623727 - DNA, 20 bp, Homo sapiens
ccatggaacagccctgcacg

SEQ ID NO: 623728 - DNA, 17 bp, Homo sapiens
ccatggatgcagaaatg

SEQ ID NO: 623729 - DNA, 14 bp, Homo sapiens
ccatggccccagct

SEQ ID NO: 623730 - DNA, 15 bp, Homo sapiens
ccatggccccagctg

SEQ ID NO: 623731 - DNA, 18 bp, Homo sapiens
ccatggccccagctggct

SEQ ID NO: 623732 - DNA, 22 bp, Homo sapiens
ccatggccgaagccccttggag

SEQ ID NO: 623733 - DNA, 15 bp, Homo sapiens
ccatggccttccctc

SEQ ID NO: 623734 - DNA, 17 bp, Homo sapiens
ccatggtagactgtgac

SEQ ID NO: 623735 - DNA, 21 bp, Homo sapiens
ccatggtgaactgaagcagag

SEQ ID NO: 623736 - DNA, 14 bp, Homo sapiens
ccatggtgcagtga

SEQ ID NO: 623737 - DNA, 22 bp, Homo sapiens
ccatggtgcagtgaagaaaatg

SEQ ID NO: 623738 - DNA, 15 bp, Homo sapiens
ccatgtatgttgcat

SEQ ID NO: 623739 - DNA, 16 bp, Homo sapiens
ccatgtgtagattgcg

SEQ ID NO: 623740 - DNA, 13 bp, Homo sapiens
ccatgttgtgttc

SEQ ID NO: 623741 - DNA, 11 bp, Homo sapiens
ccattcctgag

SEQ ID NO: 623742 - DNA, 22 bp, Homo sapiens
ccattgaccctcacctgaataa

SEQ ID NO: 623743 - DNA, 13 bp, Homo sapiens
ccattgccttctg

SEQ ID NO: 623744 - DNA, 21 bp, Homo sapiens
ccattgtgaatgttgtcctgt

SEQ ID NO: 623745 - DNA, 22 bp, Homo sapiens
ccatttagtcctcaccttctgt

SEQ ID NO: 623746 - DNA, 23 bp, Homo sapiens
ccatttcacattcctgaccctca

SEQ ID NO: 623747 - DNA, 14 bp, Homo sapiens
ccattttgaaatat

SEQ ID NO: 623748 - DNA, 17 bp, Homo sapiens
ccatttttgagtaaaac

SEQ ID NO: 623749 - DNA, 22 bp, Homo sapiens
ccattttttgtctgtgataaca

SEQ ID NO: 623750 - DNA, 12 bp, Homo sapiens
cccaaacccttc

SEQ ID NO: 623751 - DNA, 16 bp, Homo sapiens
cccaaattgccttcag

SEQ ID NO: 623752 - DNA, 17 bp, Homo sapiens
cccaaattgccttcagc

SEQ ID NO: 623753 - DNA, 23 bp, Homo sapiens
cccaacaatactttgtgtctttt

SEQ ID NO: 623754 - DNA, 12 bp, Homo sapiens
cccaacccccac

SEQ ID NO: 623755 - DNA, 15 bp, Homo sapiens
cccaacccccacctc

SEQ ID NO: 623756 - DNA, 15 bp, Homo sapiens
cccaagtcctcgccc

SEQ ID NO: 623757 - DNA, 16 bp, Homo sapiens
cccaagtcctcgcccc

SEQ ID NO: 623758 - DNA, 15 bp, Homo sapiens
cccacaaggcccagc

SEQ ID NO: 623759 - DNA, 19 bp, Homo sapiens
cccacaaggcccagccctg

SEQ ID NO: 623760 - DNA, 15 bp, Homo sapiens
cccacaccccgtctg

SEQ ID NO: 623761 - DNA, 19 bp, Homo sapiens
cccacaccccgtctgcccc

SEQ ID NO: 623762 - DNA, 17 bp, Homo sapiens
cccacacgccggggctg

SEQ ID NO: 623763 - DNA, 19 bp, Homo sapiens
cccacacgccggggctggc

SEQ ID NO: 623764 - DNA, 17 bp, Homo sapiens
cccacaggagcatgtcc

SEQ ID NO: 623765 - DNA, 14 bp, Homo sapiens
cccacatttgggct

SEQ ID NO: 623766 - DNA, 17 bp, Homo sapiens
cccacatttgggctcag

SEQ ID NO: 623767 - DNA, 13 bp, Homo sapiens
cccacccacaccc

SEQ ID NO: 623768 - DNA, 12 bp, Homo sapiens
cccacccagcag

SEQ ID NO: 623769 - DNA, 17 bp, Homo sapiens
cccacccagcagcgccc

SEQ ID NO: 623770 - DNA, 15 bp, Homo sapiens
cccacccatgccagc

SEQ ID NO: 623771 - DNA, 22 bp, Homo sapiens
cccacccctcttcccccttccc

SEQ ID NO: 623772 - DNA, 23 bp, Homo sapiens
cccacccgccccagagactgccc

SEQ ID NO: 623773 - DNA, 20 bp, Homo sapiens
cccaccctcccctctcctga

SEQ ID NO: 623774 - DNA, 18 bp, Homo sapiens
cccaccctgggcctcccg

SEQ ID NO: 623775 - DNA, 19 bp, Homo sapiens
cccaccctgggcctcccgt

SEQ ID NO: 623776 - DNA, 15 bp, Homo sapiens
cccacctcccggtgt

SEQ ID NO: 623777 - DNA, 12 bp, Homo sapiens
cccacgcagagc

SEQ ID NO: 623778 - DNA, 15 bp, Homo sapiens
cccacgcagagcccc

SEQ ID NO: 623779 - DNA, 17 bp, Homo sapiens
cccacgcccctccccag

SEQ ID NO: 623780 - DNA, 18 bp, Homo sapiens
cccacgcccctccccagc

SEQ ID NO: 623781 - DNA, 17 bp, Homo sapiens
cccacgtgcagcacctg

SEQ ID NO: 623782 - DNA, 21 bp, Homo sapiens
cccactgatatcacgggcccg

SEQ ID NO: 623783 - DNA, 15 bp, Homo sapiens
cccactttggcctcc

SEQ ID NO: 623784 - DNA, 15 bp, Homo sapiens
cccagaacgcatgca

SEQ ID NO: 623785 - DNA, 14 bp, Homo sapiens
cccagaacgggcct

SEQ ID NO: 623786 - DNA, 14 bp, Homo sapiens
cccagagactgccc

SEQ ID NO: 623787 - DNA, 15 bp, Homo sapiens
cccagagactgccca

SEQ ID NO: 623788 - DNA, 17 bp, Homo sapiens
cccagagactgcccacc

SEQ ID NO: 623789 - DNA, 19 bp, Homo sapiens
cccagagactgcccaccct

SEQ ID NO: 623790 - DNA, 16 bp, Homo sapiens
ccccctgagtgggctg

SEQ ID NO: 623791 - DNA, 14 bp, Homo sapiens
ccccctgtggcggc

SEQ ID NO: 623792 - DNA, 13 bp, Homo sapiens
ccccgcccctccc

SEQ ID NO: 623793 - DNA, 17 bp, Homo sapiens
ccccgcccggcctccta

SEQ ID NO: 623794 - DNA, 15 bp, Homo sapiens
ccccgcgaccacccc

SEQ ID NO: 623795 - DNA, 16 bp, Homo sapiens
ccccgcgcgtgccccc

SEQ ID NO: 623796 - DNA, 19 bp, Homo sapiens
ccccgcgcgtgcccccagc

SEQ ID NO: 623797 - DNA, 14 bp, Homo sapiens
ccccgcggagcccc

SEQ ID NO: 623798 - DNA, 16 bp, Homo sapiens
ccccgcggagcccccg

SEQ ID NO: 623799 - DNA, 17 bp, Homo sapiens
ccccgcggagcccccgc

SEQ ID NO: 623800 - DNA, 19 bp, Homo sapiens
ccccgcggagcccccgccc

SEQ ID NO: 623801 - DNA, 21 bp, Homo sapiens
ccccgctgcctggcgggcagc

SEQ ID NO: 623802 - DNA, 17 bp, Homo sapiens
ccccggaggcgcccacc

SEQ ID NO: 623803 - DNA, 15 bp, Homo sapiens
ccccggcccccctct

SEQ ID NO: 623804 - DNA, 13 bp, Homo sapiens
ccccgggcccttt

SEQ ID NO: 623805 - DNA, 12 bp, Homo sapiens
ccccgtctgccc

SEQ ID NO: 623806 - DNA, 13 bp, Homo sapiens
ccccgtctgcccc

SEQ ID NO: 623807 - DNA, 14 bp, Homo sapiens
ccccgtctgcccct

SEQ ID NO: 623808 - DNA, 13 bp, Homo sapiens
ccccgtgctcaca

SEQ ID NO: 623809 - DNA, 18 bp, Homo sapiens
ccccgttgttgtccctgc

SEQ ID NO: 623810 - DNA, 16 bp, Homo sapiens
cccctataccctaggt

SEQ ID NO: 623811 - DNA, 16 bp, Homo sapiens
cccctatcctgcaccc

SEQ ID NO: 623812 - DNA, 21 bp, Homo sapiens
cccctatcctgcaccctctgc

SEQ ID NO: 623813 - DNA, 21 bp, Homo sapiens
cccctcaagccaggagaccct

SEQ ID NO: 623814 - DNA, 16 bp, Homo sapiens
cccctcagctctccct

SEQ ID NO: 623815 - DNA, 19 bp, Homo sapiens
cccctcagctctccctcac

SEQ ID NO: 623816 - DNA, 13 bp, Homo sapiens
cccctccagaccc

SEQ ID NO: 623817 - DNA, 20 bp, Homo sapiens
cccctccagacccctaccct

SEQ ID NO: 623818 - DNA, 14 bp, Homo sapiens
cccctccccagccc

SEQ ID NO: 623819 - DNA, 11 bp, Homo sapiens
cccctcccccg

SEQ ID NO: 623820 - DNA, 18 bp, Homo sapiens
cccctccgtccccagggt

SEQ ID NO: 623821 - DNA, 16 bp, Homo sapiens
cccctcctccatgctg

SEQ ID NO: 623822 - DNA, 20 bp, Homo sapiens
cccctcctccatgctgtccc

SEQ ID NO: 623823 - DNA, 10 bp, Homo sapiens
cccctcctcg

SEQ ID NO: 623824 - DNA, 12 bp, Homo sapiens
cccctcctgcac

SEQ ID NO: 623825 - DNA, 11 bp, Homo sapiens
cccctccttct

SEQ ID NO: 623826 - DNA, 12 bp, Homo sapiens
cccctccttctc

SEQ ID NO: 623827 - DNA, 13 bp, Homo sapiens
cccctccttctcc

SEQ ID NO: 623828 - DNA, 19 bp, Homo sapiens
cccctcgcgcccctgtcca

SEQ ID NO: 623829 - DNA, 13 bp, Homo sapiens
cccctctgcgccc

SEQ ID NO: 623830 - DNA, 16 bp, Homo sapiens
cccctcttagaagaaa

SEQ ID NO: 623831 - DNA, 16 bp, Homo sapiens
cccctgcccagcacct

SEQ ID NO: 623832 - DNA, 23 bp, Homo sapiens
cccctgcctctatccctggccac

SEQ ID NO: 623833 - DNA, 13 bp, Homo sapiens
cccctgcctgaga

SEQ ID NO: 623834 - DNA, 14 bp, Homo sapiens
cccctgcgccctcc

SEQ ID NO: 623835 - DNA, 10 bp, Homo sapiens
cccctggccc

SEQ ID NO: 623836 - DNA, 11 bp, Homo sapiens
cccctggccct

SEQ ID NO: 623837 - DNA, 23 bp, Homo sapiens
cccctgggaacacagtgccccag

SEQ ID NO: 623838 - DNA, 17 bp, Homo sapiens
cccctggtcctgcactg

SEQ ID NO: 623839 - DNA, 21 bp, Homo sapiens
cccctggtcctgcactgtccc

SEQ ID NO: 623840 - DNA, 22 bp, Homo sapiens
cccctgtagggaaaccttggag

SEQ ID NO: 623841 - DNA, 15 bp, Homo sapiens
ccccttcccctgcgc

SEQ ID NO: 623842 - DNA, 18 bp, Homo sapiens
ccccttcccctgcgccct

SEQ ID NO: 623843 - DNA, 16 bp, Homo sapiens
ccccttgaccccacac

SEQ ID NO: 623844 - DNA, 18 bp, Homo sapiens
cccgagcgcgtgccttcc

SEQ ID NO: 623845 - DNA, 20 bp, Homo sapiens
cccgagcgcgtgccttcccc

SEQ ID NO: 623846 - DNA, 14 bp, Homo sapiens
cccgaggccagggc

SEQ ID NO: 623847 - DNA, 15 bp, Homo sapiens
cccgaggccagggcc

SEQ ID NO: 623848 - DNA, 21 bp, Homo sapiens
cccgatgcgtggctcccagca

SEQ ID NO: 623849 - DNA, 15 bp, Homo sapiens
cccgcactcaggagc

SEQ ID NO: 623850 - DNA, 15 bp, Homo sapiens
cccgcagacagacag

SEQ ID NO: 623851 - DNA, 16 bp, Homo sapiens
cccgcagacagacaga

SEQ ID NO: 623852 - DNA, 14 bp, Homo sapiens
cccgcagcaccagc

SEQ ID NO: 623853 - DNA, 16 bp, Homo sapiens
cccgcagcaccagcct

SEQ ID NO: 623854 - DNA, 18 bp, Homo sapiens
cccgcagcaccagcctga

SEQ ID NO: 623855 - DNA, 21 bp, Homo sapiens
cccgcagcaccagcctgagcc

SEQ ID NO: 623856 - DNA, 13 bp, Homo sapiens
cccgcccaccccg

SEQ ID NO: 623857 - DNA, 15 bp, Homo sapiens
cccgcccgccctcct

SEQ ID NO: 623858 - DNA, 14 bp, Homo sapiens
cccgccctcctctg

SEQ ID NO: 623859 - DNA, 15 bp, Homo sapiens
cccgccctcctctgc

SEQ ID NO: 623860 - DNA, 13 bp, Homo sapiens
cccgcgaccaccc

SEQ ID NO: 623861 - DNA, 17 bp, Homo sapiens
cccgcgaccacccctgt

SEQ ID NO: 623862 - DNA, 21 bp, Homo sapiens
cccgcgcccgccgcctccctc

SEQ ID NO: 623863 - DNA, 14 bp, Homo sapiens
cccgcggagccccc

SEQ ID NO: 623864 - DNA, 23 bp, Homo sapiens
cccgcggggacgtcgctgtccgt

SEQ ID NO: 623865 - DNA, 23 bp, Homo sapiens
cccgctcaacctctcagatccct

SEQ ID NO: 623866 - DNA, 12 bp, Homo sapiens
cccgctgctccc

SEQ ID NO: 623867 - DNA, 18 bp, Homo sapiens
cccgctgctcccggtgtg

SEQ ID NO: 623868 - DNA, 14 bp, Homo sapiens
cccgcttggcttct

SEQ ID NO: 623869 - DNA, 16 bp, Homo sapiens
cccgcttggcttcttc

SEQ ID NO: 623870 - DNA, 15 bp, Homo sapiens
cccggaggcgcccac

SEQ ID NO: 623871 - DNA, 23 bp, Homo sapiens
cccggaggcgcccacctgcccag

SEQ ID NO: 623872 - DNA, 18 bp, Homo sapiens
cccggcaaggggcgcgcg

SEQ ID NO: 623873 - DNA, 17 bp, Homo sapiens
cccggccaaggacactg

SEQ ID NO: 623874 - DNA, 20 bp, Homo sapiens
cccggccccgcgcgtgcccc

SEQ ID NO: 623875 - DNA, 17 bp, Homo sapiens
cccggcctcctagcctc

SEQ ID NO: 623876 - DNA, 22 bp, Homo sapiens
cccggcctcctagcctctccgc

SEQ ID NO: 623877 - DNA, 16 bp, Homo sapiens
cccggcctgatggcca

SEQ ID NO: 623878 - DNA, 16 bp, Homo sapiens
cccgggtcgtgtcttt

SEQ ID NO: 623879 - DNA, 16 bp, Homo sapiens
cccggtgtatgcagtg

SEQ ID NO: 623880 - DNA, 14 bp, Homo sapiens
cccggtgtgcagcg

SEQ ID NO: 623881 - DNA, 16 bp, Homo sapiens
cccgtccctttccctg

SEQ ID NO: 623882 - DNA, 12 bp, Homo sapiens
cccgtctgcccc

SEQ ID NO: 623883 - DNA, 14 bp, Homo sapiens
cccgtctgcccctt

SEQ ID NO: 623884 - DNA, 17 bp, Homo sapiens
cccgtgctcacagtagc

SEQ ID NO: 623885 - DNA, 17 bp, Homo sapiens
cccgtgctcctctgccc

SEQ ID NO: 623886 - DNA, 18 bp, Homo sapiens
cccgttgttgtccctgca

SEQ ID NO: 623887 - DNA, 18 bp, Homo sapiens
ccctaaacatagtggtat

SEQ ID NO: 623888 - DNA, 16 bp, Homo sapiens
ccctaacatagtgtct

SEQ ID NO: 623889 - DNA, 21 bp, Homo sapiens
ccctaggtctccacccctcaa

SEQ ID NO: 623890 - DNA, 20 bp, Homo sapiens
ccctatcctgcaccctctgc

SEQ ID NO: 623891 - DNA, 14 bp, Homo sapiens
ccctatttgtttca

SEQ ID NO: 623892 - DNA, 23 bp, Homo sapiens
ccctcaagccaggagaccctgtc

SEQ ID NO: 623893 - DNA, 21 bp, Homo sapiens
ccctcacacctcccttcatcc

SEQ ID NO: 623894 - DNA, 12 bp, Homo sapiens
ccctcacctctg

SEQ ID NO: 623895 - DNA, 16 bp, Homo sapiens
ccctcacctctgagga

SEQ ID NO: 623896 - DNA, 17 bp, Homo sapiens
ccctcacctctgaggac

SEQ ID NO: 623897 - DNA, 13 bp, Homo sapiens
ccctcactccact

SEQ ID NO: 623898 - DNA, 21 bp, Homo sapiens
ccctcactccactcccctcat

SEQ ID NO: 623899 - DNA, 17 bp, Homo sapiens
gtatcatctaaatatta

SEQ ID NO: 623900 - DNA, 14 bp, Homo sapiens
gtatcatgcttcta

SEQ ID NO: 623901 - DNA, 21 bp, Homo sapiens
gtatctcaaatctgctttcat

SEQ ID NO: 623902 - DNA, 14 bp, Homo sapiens
gtatctcctttaat

SEQ ID NO: 623903 - DNA, 16 bp, Homo sapiens
gtatctcctttaatat

SEQ ID NO: 623904 - DNA, 22 bp, Homo sapiens
gtatctgacatatttcataagc

SEQ ID NO: 623905 - DNA, 23 bp, Homo sapiens
gtatctgatatctgtttgcttct

SEQ ID NO: 623906 - DNA, 13 bp, Homo sapiens
gtatcttaaaatt

SEQ ID NO: 623907 - DNA, 14 bp, Homo sapiens
gtatcttaaaattg

SEQ ID NO: 623908 - DNA, 19 bp, Homo sapiens
gtatgccatgtatgttgca

SEQ ID NO: 623909 - DNA, 17 bp, Homo sapiens
gtatgctttccctgagg

SEQ ID NO: 623910 - DNA, 20 bp, Homo sapiens
gtatggaagacaaatacaca

SEQ ID NO: 623911 - DNA, 20 bp, Homo sapiens
gtatgtcttcaaaatatatt

SEQ ID NO: 623912 - DNA, 11 bp, Homo sapiens
gtatgtgtata

SEQ ID NO: 623913 - DNA, 12 bp, Homo sapiens
gtatgtgtatat

SEQ ID NO: 623914 - DNA, 12 bp, Homo sapiens
gtattaatgtag

SEQ ID NO: 623915 - DNA, 20 bp, Homo sapiens
gtattatcttaaacccacat

SEQ ID NO: 623916 - DNA, 17 bp, Homo sapiens
gtattgacaataagaaa

SEQ ID NO: 623917 - DNA, 23 bp, Homo sapiens
gtattgacaataagaaacagttt

SEQ ID NO: 623918 - DNA, 16 bp, Homo sapiens
gtatttactgcaatgt

SEQ ID NO: 623919 - DNA, 13 bp, Homo sapiens
gtatttacttgtt

SEQ ID NO: 623920 - DNA, 17 bp, Homo sapiens
gtatttcggctatgtct

SEQ ID NO: 623921 - DNA, 16 bp, Homo sapiens
gtcaaatacagcattt

SEQ ID NO: 623922 - DNA, 19 bp, Homo sapiens
gtcaaatacagcatttctt

SEQ ID NO: 623923 - DNA, 14 bp, Homo sapiens
gtcaaatggtattt

SEQ ID NO: 623924 - DNA, 21 bp, Homo sapiens
gtcaaatggtattttttgtga

SEQ ID NO: 623925 - DNA, 23 bp, Homo sapiens
gtcaaatggtattttttgtgaat

SEQ ID NO: 623926 - DNA, 17 bp, Homo sapiens
gtcaagtctacctgcct

SEQ ID NO: 623927 - DNA, 11 bp, Homo sapiens
gtcaatatata

SEQ ID NO: 623928 - DNA, 15 bp, Homo sapiens
gtcaatcaaacaggg

SEQ ID NO: 623929 - DNA, 12 bp, Homo sapiens
gtcaatgtgaaa

SEQ ID NO: 623930 - DNA, 13 bp, Homo sapiens
gtcaatgtgaaat

SEQ ID NO: 623931 - DNA, 16 bp, Homo sapiens
gtcaattgcttgagca

SEQ ID NO: 623932 - DNA, 16 bp, Homo sapiens
gtcacaaagctattta

SEQ ID NO: 623933 - DNA, 18 bp, Homo sapiens
gtcaccccgctcttccca

SEQ ID NO: 623934 - DNA, 17 bp, Homo sapiens
gtcacgtgaggcccctg

SEQ ID NO: 623935 - DNA, 18 bp, Homo sapiens
gtcacgtgaggcccctgt

SEQ ID NO: 623936 - DNA, 19 bp, Homo sapiens
gtcactcacaaaaggctgg

SEQ ID NO: 623937 - DNA, 22 bp, Homo sapiens
gtcagcaaattaattggcagca

SEQ ID NO: 623938 - DNA, 22 bp, Homo sapiens
gtcagcaccgtggtgtgaggcc

SEQ ID NO: 623939 - DNA, 13 bp, Homo sapiens
gtcagcttcccaa

SEQ ID NO: 623940 - DNA, 18 bp, Homo sapiens
gtcaggctacaggtgccc

SEQ ID NO: 623941 - DNA, 16 bp, Homo sapiens
gtcagtattgttttgg

SEQ ID NO: 623942 - DNA, 19 bp, Homo sapiens
gtcagtgaagcccaggagg

SEQ ID NO: 623943 - DNA, 23 bp, Homo sapiens
gtcagtgaagcccaggaggacct

SEQ ID NO: 623944 - DNA, 16 bp, Homo sapiens
gtcatctagttttaaa

SEQ ID NO: 623945 - DNA, 18 bp, Homo sapiens
gtcatgtgcgaacacagt

SEQ ID NO: 623946 - DNA, 19 bp, Homo sapiens
gtcatgtgcgaacacagtg

SEQ ID NO: 623947 - DNA, 19 bp, Homo sapiens
gtcatgttggtaccctgga

SEQ ID NO: 623948 - DNA, 20 bp, Homo sapiens
gtcattctgctaatttatga

SEQ ID NO: 623949 - DNA, 21 bp, Homo sapiens
gtcattggttacaaattttta

SEQ ID NO: 623950 - DNA, 21 bp, Homo sapiens
gtcatttcttctctctgtgct

SEQ ID NO: 623951 - DNA, 17 bp, Homo sapiens
gtcatttggtggctcta

SEQ ID NO: 623952 - DNA, 13 bp, Homo sapiens
gtccaatccagcc

SEQ ID NO: 623953 - DNA, 14 bp, Homo sapiens
gtccaatccagcct

SEQ ID NO: 623954 - DNA, 20 bp, Homo sapiens
gtccacccccattgtgaatg

SEQ ID NO: 623955 - DNA, 19 bp, Homo sapiens
gtccaccccgtcccggccc

SEQ ID NO: 623956 - DNA, 18 bp, Homo sapiens
gtccaggcccgtgggcgc

SEQ ID NO: 623957 - DNA, 19 bp, Homo sapiens
gtccagggtccagccctcc

SEQ ID NO: 623958 - DNA, 15 bp, Homo sapiens
gtccatccgtctctg

SEQ ID NO: 623959 - DNA, 17 bp, Homo sapiens
gtccatccgtctctgtc

SEQ ID NO: 623960 - DNA, 20 bp, Homo sapiens
gtccatgtgataattgtaaa

SEQ ID NO: 623961 - DNA, 22 bp, Homo sapiens
gtccattgacatgtacagagaa

SEQ ID NO: 623962 - DNA, 20 bp, Homo sapiens
gtcccacccccagcagctca

SEQ ID NO: 623963 - DNA, 21 bp, Homo sapiens
gtcccacccccagcagctcac

SEQ ID NO: 623964 - DNA, 12 bp, Homo sapiens
gtccccagggtg

SEQ ID NO: 623965 - DNA, 19 bp, Homo sapiens
gtccccagggtgcaggcgc

SEQ ID NO: 623966 - DNA, 13 bp, Homo sapiens
gtcccccctgagt

SEQ ID NO: 623967 - DNA, 13 bp, Homo sapiens
gtccccctcctgc

SEQ ID NO: 623968 - DNA, 19 bp, Homo sapiens
gtcccggagctcaggccct

SEQ ID NO: 623969 - DNA, 23 bp, Homo sapiens
gtccctgacttcccagctggcag

SEQ ID NO: 623970 - DNA, 13 bp, Homo sapiens
gtccctgcagggc

SEQ ID NO: 623971 - DNA, 14 bp, Homo sapiens
gtccctggagctgt

SEQ ID NO: 623972 - DNA, 14 bp, Homo sapiens
gtccctgtgggctc

SEQ ID NO: 623973 - DNA, 18 bp, Homo sapiens
gtccctgtgggctcacac

SEQ ID NO: 623974 - DNA, 19 bp, Homo sapiens
gtccctgtgggctcacacc

SEQ ID NO: 623975 - DNA, 21 bp, Homo sapiens
gtccctgtgggctcacaccgg

SEQ ID NO: 623976 - DNA, 13 bp, Homo sapiens
gtcccttcctgtc

SEQ ID NO: 623977 - DNA, 16 bp, Homo sapiens
gtcccttcctgtcctg

SEQ ID NO: 623978 - DNA, 17 bp, Homo sapiens
gtccgcccgcccacccc

SEQ ID NO: 623979 - DNA, 14 bp, Homo sapiens
gtccggcctgcagc

SEQ ID NO: 623980 - DNA, 16 bp, Homo sapiens
gtccggcctgcagccc

SEQ ID NO: 623981 - DNA, 19 bp, Homo sapiens
gtccgtccgcccgcccacc

SEQ ID NO: 623982 - DNA, 13 bp, Homo sapiens
gtccgtcctgctc

SEQ ID NO: 623983 - DNA, 22 bp, Homo sapiens
gtccgtcctgctcgccctgtgc

SEQ ID NO: 623984 - DNA, 15 bp, Homo sapiens
gtcctaaatgcaaag

SEQ ID NO: 623985 - DNA, 14 bp, Homo sapiens
gtcctatccccgga

SEQ ID NO: 623986 - DNA, 22 bp, Homo sapiens
gtcctatccccggacgcatgca

SEQ ID NO: 623987 - DNA, 15 bp, Homo sapiens
gtcctcacagcctct

SEQ ID NO: 623988 - DNA, 17 bp, Homo sapiens
gtcctcacagcctctcc

SEQ ID NO: 623989 - DNA, 20 bp, Homo sapiens
gtcctcacagcctctccctt

SEQ ID NO: 623990 - DNA, 17 bp, Homo sapiens
gtcctcaccttctgttt

SEQ ID NO: 623991 - DNA, 16 bp, Homo sapiens
gtcctcattgttcaga

SEQ ID NO: 623992 - DNA, 15 bp, Homo sapiens
gtcctcgccccccgc

SEQ ID NO: 623993 - DNA, 20 bp, Homo sapiens
gtcctcgccccccgcccggc

SEQ ID NO: 623994 - DNA, 13 bp, Homo sapiens
gtcctgcactgtc

SEQ ID NO: 623995 - DNA, 12 bp, Homo sapiens
gtcctgcatgta

SEQ ID NO: 623996 - DNA, 18 bp, Homo sapiens
gtcctgcatgtatgccat

SEQ ID NO: 623997 - DNA, 19 bp, Homo sapiens
gtcctgcgcctgcgcctcc

SEQ ID NO: 623998 - DNA, 13 bp, Homo sapiens
gtcctgctcacgt

SEQ ID NO: 623999 - DNA, 22 bp, Homo sapiens
gtcctgctcgccctgtgccctc

SEQ ID NO: 624000 - DNA, 11 bp, Homo sapiens
gtcctgctgct

SEQ ID NO: 624001 - DNA, 12 bp, Homo sapiens
gtcctgctgctc

SEQ ID NO: 624002 - DNA, 13 bp, Homo sapiens
gtcctgctgctcg

SEQ ID NO: 624003 - DNA, 20 bp, Homo sapiens
gtcctggctcccagggtcct

SEQ ID NO: 624004 - DNA, 14 bp, Homo sapiens
gtcctgggggctgc

SEQ ID NO: 624005 - DNA, 15 bp, Homo sapiens
gtcctgggggctgct

SEQ ID NO: 624006 - DNA, 20 bp, Homo sapiens
gtcctgggggctgctgcact

SEQ ID NO: 624007 - DNA, 12 bp, Homo sapiens
gtcctggggtgg

SEQ ID NO: 624008 - DNA, 17 bp, Homo sapiens
gtcctgtcctggctccc

SEQ ID NO: 624009 - DNA, 12 bp, Homo sapiens
gtcctgtgtcat

SEQ ID NO: 624010 - DNA, 16 bp, Homo sapiens
gtcctgtgtcatctgt

SEQ ID NO: 624011 - DNA, 18 bp, Homo sapiens
gtcctgtgtcatctgtca

SEQ ID NO: 624012 - DNA, 15 bp, Homo sapiens
gtcctttcctctcct

SEQ ID NO: 624013 - DNA, 18 bp, Homo sapiens
gtcctttcctctcctctc

SEQ ID NO: 624014 - DNA, 19 bp, Homo sapiens
gtcctttcctctcctctct

SEQ ID NO: 624015 - DNA, 21 bp, Homo sapiens
gtcctttcctctcctctctgg

SEQ ID NO: 624016 - DNA, 18 bp, Homo sapiens
gtcgagtgatatggcttg

SEQ ID NO: 624017 - DNA, 14 bp, Homo sapiens
gtcgcccctcctcg

SEQ ID NO: 624018 - DNA, 12 bp, Homo sapiens
ggtcgcccctcc

SEQ ID NO: 624019 - DNA, 14 bp, Homo sapiens
ggtcgcccctcctc

SEQ ID NO: 624020 - DNA, 21 bp, Homo sapiens
ggtcgcccctcctcgggcgcc

SEQ ID NO: 624021 - DNA, 14 bp, Homo sapiens
ggtctccctgggca

SEQ ID NO: 624022 - DNA, 21 bp, Homo sapiens
ggtctcgcagcctgaagcctg

SEQ ID NO: 624023 - DNA, 23 bp, Homo sapiens
ggtctcgcagcctgaagcctgga

SEQ ID NO: 624024 - DNA, 20 bp, Homo sapiens
ggtctgcacacataacacac

SEQ ID NO: 624025 - DNA, 22 bp, Homo sapiens
ggtctgcacacataacacacat

SEQ ID NO: 624026 - DNA, 13 bp, Homo sapiens
ggtctggagcccc

SEQ ID NO: 624027 - DNA, 15 bp, Homo sapiens
ggtctggagccccta

SEQ ID NO: 624028 - DNA, 20 bp, Homo sapiens
ggtcttggagaggaggtgtg

SEQ ID NO: 624029 - DNA, 13 bp, Homo sapiens
ggtgagactctga

SEQ ID NO: 624030 - DNA, 20 bp, Homo sapiens
ggtgagactctgaggtgtca

SEQ ID NO: 624031 - DNA, 16 bp, Homo sapiens
ggtgattacctgaaag

SEQ ID NO: 624032 - DNA, 16 bp, Homo sapiens
ggtgcaatgacctttc

SEQ ID NO: 624033 - DNA, 19 bp, Homo sapiens
ggtgcaatgacctttcaat

SEQ ID NO: 624034 - DNA, 19 bp, Homo sapiens
ggtgccccacaaggcccag

SEQ ID NO: 624035 - DNA, 20 bp, Homo sapiens
ggtgccccacaaggcccagc

SEQ ID NO: 624036 - DNA, 15 bp, Homo sapiens
ggtgccccacctccc

SEQ ID NO: 624037 - DNA, 23 bp, Homo sapiens
ggtgccccacctccccagagccc

SEQ ID NO: 624038 - DNA, 22 bp, Homo sapiens
ggtgcgtgtggccctgtgggag

SEQ ID NO: 624039 - DNA, 20 bp, Homo sapiens
ggtgctgaatgaagctgcca

SEQ ID NO: 624040 - DNA, 13 bp, Homo sapiens
ggtgctttctcca

SEQ ID NO: 624041 - DNA, 21 bp, Homo sapiens
ggtggcagtgcagcaaccaga

SEQ ID NO: 624042 - DNA, 15 bp, Homo sapiens
ggtggcatttgctga

SEQ ID NO: 624043 - DNA, 14 bp, Homo sapiens
ggtggctggagccc

SEQ ID NO: 624044 - DNA, 17 bp, Homo sapiens
ggtggctggagccccat

SEQ ID NO: 624045 - DNA, 21 bp, Homo sapiens
ggtgggagcacagctttcctg

SEQ ID NO: 624046 - DNA, 16 bp, Homo sapiens
ggtgggataggagggt

SEQ ID NO: 624047 - DNA, 13 bp, Homo sapiens
ggtgggctccaga

SEQ ID NO: 624048 - DNA, 18 bp, Homo sapiens
ggtgggctccagagtagg

SEQ ID NO: 624049 - DNA, 14 bp, Homo sapiens
ggtgggctgcctgc

SEQ ID NO: 624050 - DNA, 20 bp, Homo sapiens
ggtggggcttagaatggggc

SEQ ID NO: 624051 - DNA, 14 bp, Homo sapiens
ggtgggggctgcgt

SEQ ID NO: 624052 - DNA, 14 bp, Homo sapiens
ggtggtcttggaga

SEQ ID NO: 624053 - DNA, 16 bp, Homo sapiens
ggtggtcttggagagg

SEQ ID NO: 624054 - DNA, 17 bp, Homo sapiens
ggtggtttcagaaaggg

SEQ ID NO: 624055 - DNA, 20 bp, Homo sapiens
ggtgtatagggaattttcat

SEQ ID NO: 624056 - DNA, 13 bp, Homo sapiens
ggtgtcctctgtc

SEQ ID NO: 624057 - DNA, 16 bp, Homo sapiens
ggtgtcgggcatgaca

SEQ ID NO: 624058 - DNA, 13 bp, Homo sapiens
ggtgtgccaggct

SEQ ID NO: 624059 - DNA, 19 bp, Homo sapiens
ggtgtggctgctcccagcc

SEQ ID NO: 624060 - DNA, 15 bp, Homo sapiens
ggtgttaaaacatca

SEQ ID NO: 624061 - DNA, 12 bp, Homo sapiens
ggttaaggggat

SEQ ID NO: 624062 - DNA, 19 bp, Homo sapiens
ggttaataggaggacagaa

SEQ ID NO: 624063 - DNA, 22 bp, Homo sapiens
ggttaatgaaaaatctgaattt

SEQ ID NO: 624064 - DNA, 14 bp, Homo sapiens
ggttagaaaggcag

SEQ ID NO: 624065 - DNA, 12 bp, Homo sapiens
ggttccagacag

SEQ ID NO: 624066 - DNA, 15 bp, Homo sapiens
ggttccctttcccca

SEQ ID NO: 624067 - DNA, 13 bp, Homo sapiens
ggttcctcatggc

SEQ ID NO: 624068 - DNA, 16 bp, Homo sapiens
ggttctgccctgcctg

SEQ ID NO: 624069 - DNA, 16 bp, Homo sapiens
ggttctgctttctgat

SEQ ID NO: 624070 - DNA, 13 bp, Homo sapiens
ggttgcaaagtgt

SEQ ID NO: 624071 - DNA, 23 bp, Homo sapiens
ggttggcagcgcctcgccccagc

SEQ ID NO: 624072 - DNA, 14 bp, Homo sapiens
ggttggccggctgg

SEQ ID NO: 624073 - DNA, 14 bp, Homo sapiens
ggttgggttccaga

SEQ ID NO: 624074 - DNA, 23 bp, Homo sapiens
ggttgggttccagacagagtgga

SEQ ID NO: 624075 - DNA, 15 bp, Homo sapiens
ggtttagctgtgcag

SEQ ID NO: 624076 - DNA, 14 bp, Homo sapiens
ggtttcattttcat

SEQ ID NO: 624077 - DNA, 19 bp, Homo sapiens
ggtttccatcaaagccctc

SEQ ID NO: 624078 - DNA, 19 bp, Homo sapiens
ggtttgggcagtggagagg

SEQ ID NO: 624079 - DNA, 21 bp, Homo sapiens
ggtttgggggacgcccagccc

SEQ ID NO: 624080 - DNA, 19 bp, Homo sapiens
ggtttgttatcagtacaat

SEQ ID NO: 624081 - DNA, 14 bp, Homo sapiens
ggtttgtttgctgc

SEQ ID NO: 624082 - DNA, 19 bp, Homo sapiens
ggttttagaaattctataa

SEQ ID NO: 624083 - DNA, 11 bp, Homo sapiens
gtaaaactgtg

SEQ ID NO: 624084 - DNA, 12 bp, Homo sapiens
gtaaaactgtga

SEQ ID NO: 624085 - DNA, 13 bp, Homo sapiens
gtaaaactgtgac

SEQ ID NO: 624086 - DNA, 14 bp, Homo sapiens
gtaaataaaaatag

SEQ ID NO: 624087 - DNA, 22 bp, Homo sapiens
gtaaatcccacgacataagctg

SEQ ID NO: 624088 - DNA, 18 bp, Homo sapiens
gtaaattcctaattctat

SEQ ID NO: 624089 - DNA, 20 bp, Homo sapiens
gtaaattcctaattctatga

SEQ ID NO: 624090 - DNA, 15 bp, Homo sapiens
gtaacagacattgtt

SEQ ID NO: 624091 - DNA, 18 bp, Homo sapiens
gtaacctgaagttttatg

SEQ ID NO: 624092 - DNA, 22 bp, Homo sapiens
gtaaggccattctttagtcatt

SEQ ID NO: 624093 - DNA, 18 bp, Homo sapiens
gtaagttgaagggaaatc

SEQ ID NO: 624094 - DNA, 19 bp, Homo sapiens
gtaagttgaagggaaatca

SEQ ID NO: 624095 - DNA, 18 bp, Homo sapiens
gtaataactgttagaatt

SEQ ID NO: 624096 - DNA, 14 bp, Homo sapiens
gtaatataagacaa

SEQ ID NO: 624097 - DNA, 18 bp, Homo sapiens
gtaatatcagttacagtg

SEQ ID NO: 624098 - DNA, 17 bp, Homo sapiens
gtaatggatatgaaaga

SEQ ID NO: 624099 - DNA, 14 bp, Homo sapiens
gtaattcttctcct

SEQ ID NO: 624100 - DNA, 20 bp, Homo sapiens
gtaattcttctcctttgtca

SEQ ID NO: 624101 - DNA, 18 bp, Homo sapiens
gtacaaataatattgcct

SEQ ID NO: 624102 - DNA, 20 bp, Homo sapiens
gtacaaataatattgccttg

SEQ ID NO: 624103 - DNA, 11 bp, Homo sapiens
gtacacacaca

SEQ ID NO: 624104 - DNA, 12 bp, Homo sapiens
gtacacacacag

SEQ ID NO: 624105 - DNA, 14 bp, Homo sapiens
gtacacacacagac

SEQ ID NO: 624106 - DNA, 15 bp, Homo sapiens
gtacacacacagaca

SEQ ID NO: 624107 - DNA, 23 bp, Homo sapiens
gtacagaaccagcactcccaggg

SEQ ID NO: 624108 - DNA, 20 bp, Homo sapiens
gtacaggcagttaggtgctg

SEQ ID NO: 624109 - DNA, 14 bp, Homo sapiens
gtacatttatgtgt

SEQ ID NO: 624110 - DNA, 17 bp, Homo sapiens
gtaccatcccactgata

SEQ ID NO: 624111 - DNA, 19 bp, Homo sapiens
gtaccatcccactgatatc

SEQ ID NO: 624112 - DNA, 22 bp, Homo sapiens
gtactaccccaggacgcatgca

SEQ ID NO: 624113 - DNA, 22 bp, Homo sapiens
gtactaccccaggatgcatgca

SEQ ID NO: 624114 - DNA, 11 bp, Homo sapiens
gtactgtattg

SEQ ID NO: 624115 - DNA, 21 bp, Homo sapiens
gtacttacactgaaatccaaa

SEQ ID NO: 624116 - DNA, 16 bp, Homo sapiens
gtagaaactttggaag

SEQ ID NO: 624117 - DNA, 15 bp, Homo sapiens
gtagatcattttttg

SEQ ID NO: 624118 - DNA, 20 bp, Homo sapiens
gtagcatactgatgagacaa

SEQ ID NO: 624119 - DNA, 13 bp, Homo sapiens
gtagcatatataa

SEQ ID NO: 624120 - DNA, 11 bp, Homo sapiens
gtaggctgctg

SEQ ID NO: 624121 - DNA, 12 bp, Homo sapiens
gtaggctgctgg

SEQ ID NO: 624122 - DNA, 17 bp, Homo sapiens
gtaggctgctggcgcct

SEQ ID NO: 624123 - DNA, 16 bp, Homo sapiens
gtagggaaaccttgga

SEQ ID NO: 624124 - DNA, 17 bp, Homo sapiens
gtagggtgaggcgtggg

SEQ ID NO: 624125 - DNA, 17 bp, Homo sapiens
gtaggtctgcacacata

SEQ ID NO: 624126 - DNA, 21 bp, Homo sapiens
gtataagatgctgctgagcac

SEQ ID NO: 624127 - DNA, 13 bp, Homo sapiens
gtataattatgaa

SEQ ID NO: 624128 - DNA, 17 bp, Homo sapiens
gtatacaaacaggtgct

SEQ ID NO: 624129 - DNA, 17 bp, Homo sapiens
gtatacaagtgtttcta

SEQ ID NO: 624130 - DNA, 14 bp, Homo sapiens
gtatatatatgtga

SEQ ID NO: 624131 - DNA, 20 bp, Homo sapiens
gtatatgaggatgtatgtgt

SEQ ID NO: 624132 - DNA, 14 bp, Homo sapiens
gtatatgtttatac

SEQ ID NO: 624133 - DNA, 20 bp, Homo sapiens
gtatatgtttatacacacag

SEQ ID NO: 624134 - DNA, 21 bp, Homo sapiens
gtatatgtttatacacacagg

SEQ ID NO: 624135 - DNA, 22 bp, Homo sapiens
gtatatgtttatacacacagga

SEQ ID NO: 624136 - DNA, 15 bp, Homo sapiens
gtatatttttaactg

SEQ ID NO: 624137 - DNA, 18 bp, Homo sapiens
ggcccgcactcaggagca

SEQ ID NO: 624138 - DNA, 13 bp, Homo sapiens
ggcccgccctgcc

SEQ ID NO: 624139 - DNA, 14 bp, Homo sapiens
ggcccgccctgccc

SEQ ID NO: 624140 - DNA, 19 bp, Homo sapiens
ggcccgccctgcccgcgcc

SEQ ID NO: 624141 - DNA, 17 bp, Homo sapiens
ggcccgctcaacctctc

SEQ ID NO: 624142 - DNA, 19 bp, Homo sapiens
ggcccgctcaacctctcag

SEQ ID NO: 624143 - DNA, 22 bp, Homo sapiens
ggcccgctcaacctctcagatc

SEQ ID NO: 624144 - DNA, 22 bp, Homo sapiens
ggcccggcccacgcagagcccc

SEQ ID NO: 624145 - DNA, 14 bp, Homo sapiens
ggcccgtgcgcagc

SEQ ID NO: 624146 - DNA, 15 bp, Homo sapiens
ggcccgtgcgcagcc

SEQ ID NO: 624147 - DNA, 22 bp, Homo sapiens
ggccctcagcgtctccccatgc

SEQ ID NO: 624148 - DNA, 17 bp, Homo sapiens
ggccctgacttctggag

SEQ ID NO: 624149 - DNA, 13 bp, Homo sapiens
ggccctgccctcc

SEQ ID NO: 624150 - DNA, 19 bp, Homo sapiens
ggccctgccctcccccacg

SEQ ID NO: 624151 - DNA, 11 bp, Homo sapiens
ggccctggagc

SEQ ID NO: 624152 - DNA, 14 bp, Homo sapiens
ggccctggagccag

SEQ ID NO: 624153 - DNA, 15 bp, Homo sapiens
ggccctggagccagg

SEQ ID NO: 624154 - DNA, 17 bp, Homo sapiens
ggccctggggtctctga

SEQ ID NO: 624155 - DNA, 20 bp, Homo sapiens
ggccctggggtctctgagca

SEQ ID NO: 624156 - DNA, 21 bp, Homo sapiens
ggccctggggtctctgagcag

SEQ ID NO: 624157 - DNA, 18 bp, Homo sapiens
ggccgaagccccttggag

SEQ ID NO: 624158 - DNA, 16 bp, Homo sapiens
ggccgactgggctgct

SEQ ID NO: 624159 - DNA, 22 bp, Homo sapiens
ggccgactgggctgctggggca

SEQ ID NO: 624160 - DNA, 12 bp, Homo sapiens
ggccgcagggcg

SEQ ID NO: 624161 - DNA, 19 bp, Homo sapiens
ggccgccgaagggcagccc

SEQ ID NO: 624162 - DNA, 13 bp, Homo sapiens
ggccgcctcctcc

SEQ ID NO: 624163 - DNA, 16 bp, Homo sapiens
ggccgctctccgcccc

SEQ ID NO: 624164 - DNA, 18 bp, Homo sapiens
ggccgctctccgcccccc

SEQ ID NO: 624165 - DNA, 17 bp, Homo sapiens
ggccgctgcagtcagca

SEQ ID NO: 624166 - DNA, 14 bp, Homo sapiens
ggccggtaggctgc

SEQ ID NO: 624167 - DNA, 17 bp, Homo sapiens
ggccggtaggctgctgg

SEQ ID NO: 624168 - DNA, 19 bp, Homo sapiens
ggccgtccctgacttccca

SEQ ID NO: 624169 - DNA, 16 bp, Homo sapiens
ggcctcagggaccaag

SEQ ID NO: 624170 - DNA, 20 bp, Homo sapiens
ggcctccatgccccagctct

SEQ ID NO: 624171 - DNA, 10 bp, Homo sapiens
ggcctccccg

SEQ ID NO: 624172 - DNA, 21 bp, Homo sapiens
ggcctcccgtccgtccgcccg

SEQ ID NO: 624173 - DNA, 19 bp, Homo sapiens
ggcctccctcgggctggtg

SEQ ID NO: 624174 - DNA, 20 bp, Homo sapiens
ggcctccctcgggctggtgt

SEQ ID NO: 624175 - DNA, 18 bp, Homo sapiens
ggcctcctagcctctccg

SEQ ID NO: 624176 - DNA, 15 bp, Homo sapiens
ggcctgagggaagcc

SEQ ID NO: 624177 - DNA, 23 bp, Homo sapiens
ggcctgagggaagcccacccgcc

SEQ ID NO: 624178 - DNA, 19 bp, Homo sapiens
ggcctgatatccaacagaa

SEQ ID NO: 624179 - DNA, 18 bp, Homo sapiens
ggcctgatggccaggcct

SEQ ID NO: 624180 - DNA, 14 bp, Homo sapiens
ggcctgcagcccag

SEQ ID NO: 624181 - DNA, 15 bp, Homo sapiens
ggcctgcagcccaga

SEQ ID NO: 624182 - DNA, 17 bp, Homo sapiens
ggcctgcagcccagaac

SEQ ID NO: 624183 - DNA, 13 bp, Homo sapiens
ggcctgcccccct

SEQ ID NO: 624184 - DNA, 17 bp, Homo sapiens
ggcctgccccccttccc

SEQ ID NO: 624185 - DNA, 23 bp, Homo sapiens
ggcctgccccccttcccacccct

SEQ ID NO: 624186 - DNA, 21 bp, Homo sapiens
ggcctgcggggttccctgcgc

SEQ ID NO: 624187 - DNA, 11 bp, Homo sapiens
ggcctggcccc

SEQ ID NO: 624188 - DNA, 12 bp, Homo sapiens
ggcctgggctgt

SEQ ID NO: 624189 - DNA, 16 bp, Homo sapiens
ggcctggtctggagcc

SEQ ID NO: 624190 - DNA, 16 bp, Homo sapiens
ggcgcccacctgccca

SEQ ID NO: 624191 - DNA, 17 bp, Homo sapiens
ggcgcctgcgctcctct

SEQ ID NO: 624192 - DNA, 23 bp, Homo sapiens
ggcgcctgcgctcctctgcagcc

SEQ ID NO: 624193 - DNA, 17 bp, Homo sapiens
ggcgcgcgcccccagga

SEQ ID NO: 624194 - DNA, 22 bp, Homo sapiens
ggcgcgcgcccccaggaccccc

SEQ ID NO: 624195 - DNA, 19 bp, Homo sapiens
ggcggagggtctccctggg

SEQ ID NO: 624196 - DNA, 17 bp, Homo sapiens
ggcggcatccgagcccc

SEQ ID NO: 624197 - DNA, 19 bp, Homo sapiens
ggcggcatccgagcccctg

SEQ ID NO: 624198 - DNA, 14 bp, Homo sapiens
ggcggcttccctgc

SEQ ID NO: 624199 - DNA, 15 bp, Homo sapiens
ggcgggcagcccctg

SEQ ID NO: 624200 - DNA, 23 bp, Homo sapiens
ggcgggcagcccctgctggacca

SEQ ID NO: 624201 - DNA, 12 bp, Homo sapiens
ggcgggccaggg

SEQ ID NO: 624202 - DNA, 23 bp, Homo sapiens
ggcgggccagggtgggaagagaa

SEQ ID NO: 624203 - DNA, 13 bp, Homo sapiens
ggcggggcctggg

SEQ ID NO: 624204 - DNA, 21 bp, Homo sapiens
ggcgtccctgagggcccttcc

SEQ ID NO: 624205 - DNA, 14 bp, Homo sapiens
ggcgtcctctcgta

SEQ ID NO: 624206 - DNA, 14 bp, Homo sapiens
ggcgtgaaacacaa

SEQ ID NO: 624207 - DNA, 18 bp, Homo sapiens
ggcgtgggatccagagag

SEQ ID NO: 624208 - DNA, 14 bp, Homo sapiens
ggctaactggcccc

SEQ ID NO: 624209 - DNA, 16 bp, Homo sapiens
ggctaactggccccag

SEQ ID NO: 624210 - DNA, 18 bp, Homo sapiens
ggctccagagtaggtggg

SEQ ID NO: 624211 - DNA, 17 bp, Homo sapiens
ggctcgtgtttcacagt

SEQ ID NO: 624212 - DNA, 19 bp, Homo sapiens
ggctctctcacccagcctg

SEQ ID NO: 624213 - DNA, 20 bp, Homo sapiens
ggctctctcacccagcctgg

SEQ ID NO: 624214 - DNA, 16 bp, Homo sapiens
ggagtccactttcctc

SEQ ID NO: 624215 - DNA, 19 bp, Homo sapiens
ggagtccactttcctctct

SEQ ID NO: 624216 - DNA, 22 bp, Homo sapiens
ggagtccactttcctctctctc

SEQ ID NO: 624217 - DNA, 19 bp, Homo sapiens
ggagtctgaaggagaggag

SEQ ID NO: 624218 - DNA, 15 bp, Homo sapiens
ggataagaaaaatgc

SEQ ID NO: 624219 - DNA, 19 bp, Homo sapiens
ggataggagggtgcccctg

SEQ ID NO: 624220 - DNA, 20 bp, Homo sapiens
ggataggagggtgcccctgg

SEQ ID NO: 624221 - DNA, 11 bp, Homo sapiens
ggatccagaga

SEQ ID NO: 624222 - DNA, 13 bp, Homo sapiens
ggatccagagaga

SEQ ID NO: 624223 - DNA, 13 bp, Homo sapiens
ggatcctgagcca

SEQ ID NO: 624224 - DNA, 18 bp, Homo sapiens
ggatcctgagccagattt

SEQ ID NO: 624225 - DNA, 19 bp, Homo sapiens
ggatcgtggaagaagggcc

SEQ ID NO: 624226 - DNA, 13 bp, Homo sapiens
ggatgcatgcagg

SEQ ID NO: 624227 - DNA, 15 bp, Homo sapiens
ggatgcccctggccc

SEQ ID NO: 624228 - DNA, 17 bp, Homo sapiens
ggatggagatgggaagg

SEQ ID NO: 624229 - DNA, 14 bp, Homo sapiens
ggatgtaatatagg

SEQ ID NO: 624230 - DNA, 13 bp, Homo sapiens
ggatgtatgtgta

SEQ ID NO: 624231 - DNA, 22 bp, Homo sapiens
ggattcccgtggctttgtgctt

SEQ ID NO: 624232 - DNA, 14 bp, Homo sapiens
ggattgaggatgaa

SEQ ID NO: 624233 - DNA, 15 bp, Homo sapiens
ggattggtaccagag

SEQ ID NO: 624234 - DNA, 18 bp, Homo sapiens
ggattggtaccagagcct

SEQ ID NO: 624235 - DNA, 10 bp, Homo sapiens
ggattgtttt

SEQ ID NO: 624236 - DNA, 16 bp, Homo sapiens
ggatttaatttgatat

SEQ ID NO: 624237 - DNA, 16 bp, Homo sapiens
ggatttgacacactca

SEQ ID NO: 624238 - DNA, 23 bp, Homo sapiens
ggcaaagaactgccccatctcct

SEQ ID NO: 624239 - DNA, 14 bp, Homo sapiens
ggcaactgtggaag

SEQ ID NO: 624240 - DNA, 20 bp, Homo sapiens
ggcaagagctcaggagaagg

SEQ ID NO: 624241 - DNA, 17 bp, Homo sapiens
ggcaagatagctccttc

SEQ ID NO: 624242 - DNA, 12 bp, Homo sapiens
ggcaagattttc

SEQ ID NO: 624243 - DNA, 19 bp, Homo sapiens
ggcaagctcatagcacatg

SEQ ID NO: 624244 - DNA, 22 bp, Homo sapiens
ggcaaggaagctttggaagcag

SEQ ID NO: 624245 - DNA, 22 bp, Homo sapiens
ggcaaggggcgcgcgcccccag

SEQ ID NO: 624246 - DNA, 23 bp, Homo sapiens
ggcaccactagggtcctggccct

SEQ ID NO: 624247 - DNA, 16 bp, Homo sapiens
ggcaccctgcaggcag

SEQ ID NO: 624248 - DNA, 16 bp, Homo sapiens
ggcaccgcccacccac

SEQ ID NO: 624249 - DNA, 22 bp, Homo sapiens
ggcaccgcccacccacaccccg

SEQ ID NO: 624250 - DNA, 15 bp, Homo sapiens
ggcacgggagagcgc

SEQ ID NO: 624251 - DNA, 16 bp, Homo sapiens
ggcacgggagagcgcc

SEQ ID NO: 624252 - DNA, 22 bp, Homo sapiens
ggcactccctaagtccactcta

SEQ ID NO: 624253 - DNA, 16 bp, Homo sapiens
ggcactgtgcactcta

SEQ ID NO: 624254 - DNA, 21 bp, Homo sapiens
ggcagaggaatgtagggcctg

SEQ ID NO: 624255 - DNA, 16 bp, Homo sapiens
ggcagaggcagggccc

SEQ ID NO: 624256 - DNA, 17 bp, Homo sapiens
ggcagaggcagggccct

SEQ ID NO: 624257 - DNA, 22 bp, Homo sapiens
ggcagcacctccgggactgacc

SEQ ID NO: 624258 - DNA, 11 bp, Homo sapiens
ggcagccccat

SEQ ID NO: 624259 - DNA, 20 bp, Homo sapiens
ggcagccccgcgaccacccc

SEQ ID NO: 624260 - DNA, 22 bp, Homo sapiens
ggcagccccgcgaccacccctg

SEQ ID NO: 624261 - DNA, 11 bp, Homo sapiens
ggcagcccctc

SEQ ID NO: 624262 - DNA, 14 bp, Homo sapiens
ggcagccctcacct

SEQ ID NO: 624263 - DNA, 18 bp, Homo sapiens
ggcagccctcacctctga

SEQ ID NO: 624264 - DNA, 22 bp, Homo sapiens
ggcagcgcctcccgccgcctcg

SEQ ID NO: 624265 - DNA, 23 bp, Homo sapiens
ggcagcgcctcgccccagccaag

SEQ ID NO: 624266 - DNA, 16 bp, Homo sapiens
ggcagctaggcaggga

SEQ ID NO: 624267 - DNA, 18 bp, Homo sapiens
ggcagctaggcagggagg

SEQ ID NO: 624268 - DNA, 21 bp, Homo sapiens
ggcagctgcagttagcacaga

SEQ ID NO: 624269 - DNA, 14 bp, Homo sapiens
ggcagcttgagcct

SEQ ID NO: 624270 - DNA, 17 bp, Homo sapiens
ggcagcttgagcctgtc

SEQ ID NO: 624271 - DNA, 19 bp, Homo sapiens
ggcagggaagggtgcctgg

SEQ ID NO: 624272 - DNA, 22 bp, Homo sapiens
ggcagggaagggtgcctggctg

SEQ ID NO: 624273 - DNA, 17 bp, Homo sapiens
ggcagggagggggctgg

SEQ ID NO: 624274 - DNA, 19 bp, Homo sapiens
ggcagggagggggctggga

SEQ ID NO: 624275 - DNA, 17 bp, Homo sapiens
ggcagggcccagggagg

SEQ ID NO: 624276 - DNA, 11 bp, Homo sapiens
ggcagggccct

SEQ ID NO: 624277 - DNA, 16 bp, Homo sapiens
ggcagggtgagaagct

SEQ ID NO: 624278 - DNA, 13 bp, Homo sapiens
ggcagggttctag

SEQ ID NO: 624279 - DNA, 24 bp, Homo sapiens
ggcagtgaacacactcagcagccc

SEQ ID NO: 624280 - DNA, 16 bp, Homo sapiens
ggcagtgcagcaacca

SEQ ID NO: 624281 - DNA, 22 bp, Homo sapiens
ggcagtgcagcaaccagagcac

SEQ ID NO: 624282 - DNA, 14 bp, Homo sapiens
ggcagtggagaggg

SEQ ID NO: 624283 - DNA, 22 bp, Homo sapiens
ggcatccaccttcctgcccagg

SEQ ID NO: 624284 - DNA, 15 bp, Homo sapiens
ggcatccacttcaca

SEQ ID NO: 624285 - DNA, 22 bp, Homo sapiens
ggaagctttggaagcagcaagg

SEQ ID NO: 624286 - DNA, 14 bp, Homo sapiens
ggaaggctgctgtg

SEQ ID NO: 624287 - DNA, 16 bp, Homo sapiens
ggaagggtgcctggct

SEQ ID NO: 624288 - DNA, 14 bp, Homo sapiens
ggaataacactgca

SEQ ID NO: 624289 - DNA, 17 bp, Homo sapiens
ggaataacactgcagcc

SEQ ID NO: 624290 - DNA, 17 bp, Homo sapiens
ggaataagaagcaaata

SEQ ID NO: 624291 - DNA, 21 bp, Homo sapiens
ggaataagaagcaaataaata

SEQ ID NO: 624292 - DNA, 14 bp, Homo sapiens
ggaatcaaaaattg

SEQ ID NO: 624293 - DNA, 16 bp, Homo sapiens
ggaatgtagggcctgc

SEQ ID NO: 624294 - DNA, 21 bp, Homo sapiens
ggaattattagcaccagcttg

SEQ ID NO: 624295 - DNA, 22 bp, Homo sapiens
ggaattattagcaccagcttgc

SEQ ID NO: 624296 - DNA, 17 bp, Homo sapiens
ggaattttcattttcat

SEQ ID NO: 624297 - DNA, 20 bp, Homo sapiens
ggacaacctgcccctcccca

SEQ ID NO: 624298 - DNA, 21 bp, Homo sapiens
ggacacagcacaagggcacat

SEQ ID NO: 624299 - DNA, 15 bp, Homo sapiens
ggacactacaaacat

SEQ ID NO: 624300 - DNA, 14 bp, Homo sapiens
ggacagaggccggg

SEQ ID NO: 624301 - DNA, 14 bp, Homo sapiens
ggacagagtgccct

SEQ ID NO: 624302 - DNA, 16 bp, Homo sapiens
ggacagagtgccctgg

SEQ ID NO: 624303 - DNA, 18 bp, Homo sapiens
ggacagcctgcacagtgg

SEQ ID NO: 624304 - DNA, 20 bp, Homo sapiens
ggacagcggccccgcggagc

SEQ ID NO: 624305 - DNA, 21 bp, Homo sapiens
ggacagcggccccgcggagcc

SEQ ID NO: 624306 - DNA, 17 bp, Homo sapiens
ggacagcggcccggccc

SEQ ID NO: 624307 - DNA, 20 bp, Homo sapiens
ggacagcggcccggcccacg

SEQ ID NO: 624308 - DNA, 21 bp, Homo sapiens
ggacagggagggaacagacct

SEQ ID NO: 624309 - DNA, 20 bp, Homo sapiens
ggaccatggccgaagcccct

SEQ ID NO: 624310 - DNA, 12 bp, Homo sapiens
ggacccctgccc

SEQ ID NO: 624311 - DNA, 14 bp, Homo sapiens
ggaccggagcggct

SEQ ID NO: 624312 - DNA, 17 bp, Homo sapiens
ggaccggagcggctgag

SEQ ID NO: 624313 - DNA, 19 bp, Homo sapiens
ggaccggagcggctgagga

SEQ ID NO: 624314 - DNA, 22 bp, Homo sapiens
ggacgagcagagcgcagccccc

SEQ ID NO: 624315 - DNA, 14 bp, Homo sapiens
ggacgcatgcaggg

SEQ ID NO: 624316 - DNA, 13 bp, Homo sapiens
ggacgcccagccc

SEQ ID NO: 624317 - DNA, 19 bp, Homo sapiens
ggacgcccagcccccaccc

SEQ ID NO: 624318 - DNA, 12 bp, Homo sapiens
ggacgctggctc

SEQ ID NO: 624319 - DNA, 21 bp, Homo sapiens
ggacgggacagcggcccggcc

SEQ ID NO: 624320 - DNA, 23 bp, Homo sapiens
ggacgggacagcggcccggccca

SEQ ID NO: 624321 - DNA, 14 bp, Homo sapiens
ggactacagaagtg

SEQ ID NO: 624322 - DNA, 15 bp, Homo sapiens
ggactacagaagtgg

SEQ ID NO: 624323 - DNA, 24 bp, Homo sapiens
ggactgaccttcggcagtggctgg

SEQ ID NO: 624324 - DNA, 22 bp, Homo sapiens
ggactgctttcagtgcctgctg

SEQ ID NO: 624325 - DNA, 18 bp, Homo sapiens
ggactggcccacccctct

SEQ ID NO: 624326 - DNA, 19 bp, Homo sapiens
ggactgtcttcaaccctgc

SEQ ID NO: 624327 - DNA, 20 bp, Homo sapiens
ggactgtcttcaaccctgcc

SEQ ID NO: 624328 - DNA, 23 bp, Homo sapiens
ggactgtcttcaaccctgccctg

SEQ ID NO: 624329 - DNA, 13 bp, Homo sapiens
ggagaaggaggaa

SEQ ID NO: 624330 - DNA, 17 bp, Homo sapiens
ggagaaggcctgccccc

SEQ ID NO: 624331 - DNA, 18 bp, Homo sapiens
ggagaaggcctgcccccc

SEQ ID NO: 624332 - DNA, 22 bp, Homo sapiens
ggagaaggcctgccccccttcc

SEQ ID NO: 624333 - DNA, 23 bp, Homo sapiens
ggagaaggcctgccccccttccc

SEQ ID NO: 624334 - DNA, 22 bp, Homo sapiens
ggagaccctgcgcccctgccca

SEQ ID NO: 624335 - DNA, 14 bp, Homo sapiens
ggagaccctgtctt

SEQ ID NO: 624336 - DNA, 14 bp, Homo sapiens
ggagactgagcttg

SEQ ID NO: 624337 - DNA, 23 bp, Homo sapiens
ggagagagaggctgcctcagcca

SEQ ID NO: 624338 - DNA, 16 bp, Homo sapiens
ggagagcagcaggtgc

SEQ ID NO: 624339 - DNA, 15 bp, Homo sapiens
ggagagcgccacccg

SEQ ID NO: 624340 - DNA, 18 bp, Homo sapiens
ggagagcgccacccgccc

SEQ ID NO: 624341 - DNA, 20 bp, Homo sapiens
ggagagtggcaggtgggctg

SEQ ID NO: 624342 - DNA, 20 bp, Homo sapiens
ggagatggggagggcgcttt

SEQ ID NO: 624343 - DNA, 13 bp, Homo sapiens
ggagcacagccat

SEQ ID NO: 624344 - DNA, 17 bp, Homo sapiens
ggagcacccccagcctc

SEQ ID NO: 624345 - DNA, 18 bp, Homo sapiens
ggagcacccccagcctcc

SEQ ID NO: 624346 - DNA, 20 bp, Homo sapiens
ggagcacccccagcctcccc

SEQ ID NO: 624347 - DNA, 21 bp, Homo sapiens
ggagcacccccagcctccccc

SEQ ID NO: 624348 - DNA, 17 bp, Homo sapiens
ggagcagaaagccaggg

SEQ ID NO: 624349 - DNA, 14 bp, Homo sapiens
gcctaatccacctg

SEQ ID NO: 624350 - DNA, 17 bp, Homo sapiens
gcctattttggtgaggt

SEQ ID NO: 624351 - DNA, 18 bp, Homo sapiens
gcctcaagtcggtgggcc

SEQ ID NO: 624352 - DNA, 21 bp, Homo sapiens
gcctcaattttggtttttctc

SEQ ID NO: 624353 - DNA, 22 bp, Homo sapiens
gcctcaccttccctagttcttt

SEQ ID NO: 624354 - DNA, 19 bp, Homo sapiens
gcctcactgggtgtggcct

SEQ ID NO: 624355 - DNA, 15 bp, Homo sapiens
gcctcactgtgacct

SEQ ID NO: 624356 - DNA, 19 bp, Homo sapiens
gcctcactgtgacctgctc

SEQ ID NO: 624357 - DNA, 16 bp, Homo sapiens
gcctcatagcatagcc

SEQ ID NO: 624358 - DNA, 20 bp, Homo sapiens
gcctcatagcatagccagca

SEQ ID NO: 624359 - DNA, 20 bp, Homo sapiens
gcctcatcagtatttggact

SEQ ID NO: 624360 - DNA, 19 bp, Homo sapiens
gcctcatgaccctcctgtc

SEQ ID NO: 624361 - DNA, 22 bp, Homo sapiens
gcctccatgccccagctctgga

SEQ ID NO: 624362 - DNA, 23 bp, Homo sapiens
gcctccatgccccagctctggat

SEQ ID NO: 624363 - DNA, 13 bp, Homo sapiens
gcctcccccaggc

SEQ ID NO: 624364 - DNA, 15 bp, Homo sapiens
gcctcccccaggctg

SEQ ID NO: 624365 - DNA, 19 bp, Homo sapiens
gcctcccccaggctgcgcc

SEQ ID NO: 624366 - DNA, 15 bp, Homo sapiens
gcctccccgggggtc

SEQ ID NO: 624367 - DNA, 16 bp, Homo sapiens
gcctcccgtccgtccg

SEQ ID NO: 624368 - DNA, 21 bp, Homo sapiens
gcctcccgtccgtccgcccgc

SEQ ID NO: 624369 - DNA, 16 bp, Homo sapiens
gcctccctcgggctgg

SEQ ID NO: 624370 - DNA, 18 bp, Homo sapiens
gcctccctcgggctggtg

SEQ ID NO: 624371 - DNA, 14 bp, Homo sapiens
gcctcctagcctct

SEQ ID NO: 624372 - DNA, 17 bp, Homo sapiens
gcctcctagcctctccg

SEQ ID NO: 624373 - DNA, 13 bp, Homo sapiens
gcctcctccagac

SEQ ID NO: 624374 - DNA, 16 bp, Homo sapiens
gcctcctccagactcg

SEQ ID NO: 624375 - DNA, 12 bp, Homo sapiens
gcctcctcctgc

SEQ ID NO: 624376 - DNA, 15 bp, Homo sapiens
gcctcctcctgcatg

SEQ ID NO: 624377 - DNA, 20 bp, Homo sapiens
gcctcgccccagccaagcct

SEQ ID NO: 624378 - DNA, 22 bp, Homo sapiens
gcctcgggccgcctcctccaga

SEQ ID NO: 624379 - DNA, 16 bp, Homo sapiens
gcctcgttggagagca

SEQ ID NO: 624380 - DNA, 21 bp, Homo sapiens
gcctctatccctggccacctg

SEQ ID NO: 624381 - DNA, 16 bp, Homo sapiens
gcctctgcccctcttc

SEQ ID NO: 624382 - DNA, 23 bp, Homo sapiens
gcctcttgaatgcttaaatgatc

SEQ ID NO: 624383 - DNA, 21 bp, Homo sapiens
gcctcttgttcttagggcttg

SEQ ID NO: 624384 - DNA, 17 bp, Homo sapiens
gcctgactcctgggtgg

SEQ ID NO: 624385 - DNA, 13 bp, Homo sapiens
gcctgagaagagt

SEQ ID NO: 624386 - DNA, 14 bp, Homo sapiens
gcctgagaccacgg

SEQ ID NO: 624387 - DNA, 21 bp, Homo sapiens
gcctgagaggagcgtgtccta

SEQ ID NO: 624388 - DNA, 18 bp, Homo sapiens
gcctgagccacagtgggg

SEQ ID NO: 624389 - DNA, 19 bp, Homo sapiens
gcctgagctccaccctccc

SEQ ID NO: 624390 - DNA, 22 bp, Homo sapiens
gcctgagctccaccctcccctc

SEQ ID NO: 624391 - DNA, 12 bp, Homo sapiens
gcctgaggagga

SEQ ID NO: 624392 - DNA, 18 bp, Homo sapiens
gcctgaggaggaggacac

SEQ ID NO: 624393 - DNA, 20 bp, Homo sapiens
gcctgagggaagcccacccg

SEQ ID NO: 624394 - DNA, 22 bp, Homo sapiens
gcctgagggaagcccacccgcc

SEQ ID NO: 624395 - DNA, 16 bp, Homo sapiens
gcctgagttagctgtt

SEQ ID NO: 624396 - DNA, 12 bp, Homo sapiens
gcctgcagccca

SEQ ID NO: 624397 - DNA, 15 bp, Homo sapiens
gcctgcagcccagaa

SEQ ID NO: 624398 - DNA, 16 bp, Homo sapiens
gcctgcagcccagaac

SEQ ID NO: 624399 - DNA, 15 bp, Homo sapiens
gcctgcatggagaag

SEQ ID NO: 624400 - DNA, 18 bp, Homo sapiens
gcctgccaggccctccag

SEQ ID NO: 624401 - DNA, 15 bp, Homo sapiens
gcctgccccccttcc

SEQ ID NO: 624402 - DNA, 13 bp, Homo sapiens
gcctgcccgcccg

SEQ ID NO: 624403 - DNA, 14 bp, Homo sapiens
gcctgcgcctcctc

SEQ ID NO: 624404 - DNA, 15 bp, Homo sapiens
gcctgcgcctcctcc

SEQ ID NO: 624405 - DNA, 20 bp, Homo sapiens
gcctgcgcctcctcctgcat

SEQ ID NO: 624406 - DNA, 22 bp, Homo sapiens
gcctgcgctcctctgcagcctg

SEQ ID NO: 624407 - DNA, 20 bp, Homo sapiens
gcctgctgtgttaagaggac

SEQ ID NO: 624408 - DNA, 12 bp, Homo sapiens
gcctggagcctg

SEQ ID NO: 624409 - DNA, 16 bp, Homo sapiens
gcctggagcctgggca

SEQ ID NO: 624410 - DNA, 17 bp, Homo sapiens
gcctggagcctgggcag

SEQ ID NO: 624411 - DNA, 19 bp, Homo sapiens
gcctggagcctgggcagca

SEQ ID NO: 624412 - DNA, 21 bp, Homo sapiens
gcctggaggagaaggaggaac

SEQ ID NO: 624413 - DNA, 18 bp, Homo sapiens
gcctggattccagcagtg

SEQ ID NO: 624414 - DNA, 23 bp, Homo sapiens
gcctggattccagcagtgaatgc

SEQ ID NO: 624415 - DNA, 22 bp, Homo sapiens
gcctggccccctcgcgcccctg

SEQ ID NO: 624416 - DNA, 23 bp, Homo sapiens
gcctggccttgagccgtgacctc

SEQ ID NO: 624417 - DNA, 17 bp, Homo sapiens
gcctggcgggcagcccc

SEQ ID NO: 624418 - DNA, 18 bp, Homo sapiens
gcctggcgggcagcccct

SEQ ID NO: 624419 - DNA, 20 bp, Homo sapiens
gctgctggggcagggcccag

SEQ ID NO: 624420 - DNA, 16 bp, Homo sapiens
gctgctgtgtagctct

SEQ ID NO: 624421 - DNA, 17 bp, Homo sapiens
gctgctgtgtagctctg

SEQ ID NO: 624422 - DNA, 19 bp, Homo sapiens
gctgctgtgtagctctgtc

SEQ ID NO: 624423 - DNA, 20 bp, Homo sapiens
gctgctgtgtagctctgtcc

SEQ ID NO: 624424 - DNA, 22 bp, Homo sapiens
gctgcttcaaggatcctgagcc

SEQ ID NO: 624425 - DNA, 15 bp, Homo sapiens
gctgcttctccctgg

SEQ ID NO: 624426 - DNA, 16 bp, Homo sapiens
gctgcttctccctggg

SEQ ID NO: 624427 - DNA, 17 bp, Homo sapiens
gctgcttctccctgggg

SEQ ID NO: 624428 - DNA, 14 bp, Homo sapiens
gctggagaccctgc

SEQ ID NO: 624429 - DNA, 18 bp, Homo sapiens
gctggagaccctgcgccc

SEQ ID NO: 624430 - DNA, 18 bp, Homo sapiens
gctggcagcgcctcccgc

SEQ ID NO: 624431 - DNA, 15 bp, Homo sapiens
gctggccctgccctc

SEQ ID NO: 624432 - DNA, 18 bp, Homo sapiens
gctggccggtccaccccg

SEQ ID NO: 624433 - DNA, 22 bp, Homo sapiens
gctggccggtccaccccgtccc

SEQ ID NO: 624434 - DNA, 11 bp, Homo sapiens
gctggctgggg

SEQ ID NO: 624435 - DNA, 18 bp, Homo sapiens
gctgggcagggccgcagg

SEQ ID NO: 624436 - DNA, 14 bp, Homo sapiens
gctgggcagggtga

SEQ ID NO: 624437 - DNA, 15 bp, Homo sapiens
gctgggccagggaaa

SEQ ID NO: 624438 - DNA, 13 bp, Homo sapiens
gctgggccctctg

SEQ ID NO: 624439 - DNA, 17 bp, Homo sapiens
gctgggctttggggctg

SEQ ID NO: 624440 - DNA, 23 bp, Homo sapiens
gctgggctttggggctggtggga

SEQ ID NO: 624441 - DNA, 17 bp, Homo sapiens
gctggggcagggcccag

SEQ ID NO: 624442 - DNA, 14 bp, Homo sapiens
gctgggtcccgggt

SEQ ID NO: 624443 - DNA, 16 bp, Homo sapiens
gctgggtcgcccctcc

SEQ ID NO: 624444 - DNA, 17 bp, Homo sapiens
gctgggtcgcccctcct

SEQ ID NO: 624445 - DNA, 14 bp, Homo sapiens
gctggtaactgtta

SEQ ID NO: 624446 - DNA, 16 bp, Homo sapiens
gctggtgtcttgagac

SEQ ID NO: 624447 - DNA, 18 bp, Homo sapiens
gctggtgtcttgagacca

SEQ ID NO: 624448 - DNA, 14 bp, Homo sapiens
gctgtatacaaaca

SEQ ID NO: 624449 - DNA, 15 bp, Homo sapiens
gctgtatacaaacag

SEQ ID NO: 624450 - DNA, 18 bp, Homo sapiens
gctgtatacaaacaggtg

SEQ ID NO: 624451 - DNA, 20 bp, Homo sapiens
gctgtatacaaacaggtgct

SEQ ID NO: 624452 - DNA, 20 bp, Homo sapiens
gctgtattatcttaaaccca

SEQ ID NO: 624453 - DNA, 16 bp, Homo sapiens
gctgtcccctgcaagt

SEQ ID NO: 624454 - DNA, 22 bp, Homo sapiens
gctgtccctgtgggctcacacc

SEQ ID NO: 624455 - DNA, 21 bp, Homo sapiens
gctgtcggtgtttggaggctg

SEQ ID NO: 624456 - DNA, 20 bp, Homo sapiens
gctgtgaaatgactgcatca

SEQ ID NO: 624457 - DNA, 19 bp, Homo sapiens
gctgtggcatcaggaaagg

SEQ ID NO: 624458 - DNA, 14 bp, Homo sapiens
gctgtggcccctcc

SEQ ID NO: 624459 - DNA, 23 bp, Homo sapiens
gctgtggcccctccttctcccct

SEQ ID NO: 624460 - DNA, 14 bp, Homo sapiens
gctgttatctgtct

SEQ ID NO: 624461 - DNA, 16 bp, Homo sapiens
gctgttgattctttca

SEQ ID NO: 624462 - DNA, 15 bp, Homo sapiens
gctgtttactgacat

SEQ ID NO: 624463 - DNA, 19 bp, Homo sapiens
gcttaaacatttccctgct

SEQ ID NO: 624464 - DNA, 18 bp, Homo sapiens
gcttaaggaaaagagaaa

SEQ ID NO: 624465 - DNA, 13 bp, Homo sapiens
gcttaattccaat

SEQ ID NO: 624466 - DNA, 22 bp, Homo sapiens
gcttagtatctcatcaacaaag

SEQ ID NO: 624467 - DNA, 23 bp, Homo sapiens
gcttagtatctcatcaacaaaga

SEQ ID NO: 624468 - DNA, 18 bp, Homo sapiens
gcttcaaggatcctgagc

SEQ ID NO: 624469 - DNA, 19 bp, Homo sapiens
gcttcaaggatcctgagcc

SEQ ID NO: 624470 - DNA, 21 bp, Homo sapiens
gcttcaaggatcctgagccag

SEQ ID NO: 624471 - DNA, 10 bp, Homo sapiens
gcttcacaca

SEQ ID NO: 624472 - DNA, 16 bp, Homo sapiens
gcttcacacaaagtga

SEQ ID NO: 624473 - DNA, 21 bp, Homo sapiens
gcttcattaaaacaagagacc

SEQ ID NO: 624474 - DNA, 10 bp, Homo sapiens
gcttccagat

SEQ ID NO: 624475 - DNA, 15 bp, Homo sapiens
gcttccccatcgcct

SEQ ID NO: 624476 - DNA, 14 bp, Homo sapiens
gcttccccattgcc

SEQ ID NO: 624477 - DNA, 15 bp, Homo sapiens
gcttccccattgcct

SEQ ID NO: 624478 - DNA, 17 bp, Homo sapiens
gcccctccgtccccagg

SEQ ID NO: 624479 - DNA, 18 bp, Homo sapiens
gcccctccgtccccaggg

SEQ ID NO: 624480 - DNA, 11 bp, Homo sapiens
gcccctcctcg

SEQ ID NO: 624481 - DNA, 19 bp, Homo sapiens
gcccctcctcgggcgcctg

SEQ ID NO: 624482 - DNA, 20 bp, Homo sapiens
gcccctcctcgggcgcctgc

SEQ ID NO: 624483 - DNA, 19 bp, Homo sapiens
gcccctcctctcctcgtcc

SEQ ID NO: 624484 - DNA, 20 bp, Homo sapiens
gcccctccttctcccctcca

SEQ ID NO: 624485 - DNA, 21 bp, Homo sapiens
gcccctccttctcccctccag

SEQ ID NO: 624486 - DNA, 14 bp, Homo sapiens
gcccctctgcgccc

SEQ ID NO: 624487 - DNA, 18 bp, Homo sapiens
gcccctctgcgccccagc

SEQ ID NO: 624488 - DNA, 20 bp, Homo sapiens
gcccctgagggacgagcaga

SEQ ID NO: 624489 - DNA, 19 bp, Homo sapiens
gcccctgcacctgcttctc

SEQ ID NO: 624490 - DNA, 11 bp, Homo sapiens
gcccctggccc

SEQ ID NO: 624491 - DNA, 17 bp, Homo sapiens
gcccctggccctgcctc

SEQ ID NO: 624492 - DNA, 21 bp, Homo sapiens
gcccctggccctgcctcactg

SEQ ID NO: 624493 - DNA, 23 bp, Homo sapiens
gcccctgtccatccgtctctgtc

SEQ ID NO: 624494 - DNA, 18 bp, Homo sapiens
gcccctgtttctcctcca

SEQ ID NO: 624495 - DNA, 14 bp, Homo sapiens
gcccctttctcttg

SEQ ID NO: 624496 - DNA, 15 bp, Homo sapiens
gcccctttctcttgc

SEQ ID NO: 624497 - DNA, 14 bp, Homo sapiens
gcccgaccccatct

SEQ ID NO: 624498 - DNA, 19 bp, Homo sapiens
gcccgaccccatctcattc

SEQ ID NO: 624499 - DNA, 21 bp, Homo sapiens
gcccgagcgcgtgccttcccc

SEQ ID NO: 624500 - DNA, 23 bp, Homo sapiens
gcccgagcgcgtgccttccccgt

SEQ ID NO: 624501 - DNA, 23 bp, Homo sapiens
gcccgaggaggccgactgggctg

SEQ ID NO: 624502 - DNA, 14 bp, Homo sapiens
gcccgaggccaggg

SEQ ID NO: 624503 - DNA, 18 bp, Homo sapiens
gcccgaggccagggccgc

SEQ ID NO: 624504 - DNA, 15 bp, Homo sapiens
gcccgcccaccccgc

SEQ ID NO: 624505 - DNA, 17 bp, Homo sapiens
gcccgcccaccccgctg

SEQ ID NO: 624506 - DNA, 22 bp, Homo sapiens
gcccgcccaccccgctgcctgg

SEQ ID NO: 624507 - DNA, 16 bp, Homo sapiens
gcccgcccccgccctc

SEQ ID NO: 624508 - DNA, 13 bp, Homo sapiens
gcccgccctcctc

SEQ ID NO: 624509 - DNA, 14 bp, Homo sapiens
gcccgccctcctct

SEQ ID NO: 624510 - DNA, 12 bp, Homo sapiens
gcccgccctgcc

SEQ ID NO: 624511 - DNA, 18 bp, Homo sapiens
gcccgccggttggccggc

SEQ ID NO: 624512 - DNA, 15 bp, Homo sapiens
gcccgcgcccgccgc

SEQ ID NO: 624513 - DNA, 21 bp, Homo sapiens
gcccgcgggtggctggagccc

SEQ ID NO: 624514 - DNA, 23 bp, Homo sapiens
gcccgctcaacctctcagatccc

SEQ ID NO: 624515 - DNA, 13 bp, Homo sapiens
gcccggcccacgc

SEQ ID NO: 624516 - DNA, 22 bp, Homo sapiens
gcccggcccacgcagagccccg

SEQ ID NO: 624517 - DNA, 12 bp, Homo sapiens
gcccggccccat

SEQ ID NO: 624518 - DNA, 13 bp, Homo sapiens
gcccggccccatc

SEQ ID NO: 624519 - DNA, 19 bp, Homo sapiens
gcccggcctcctagcctct

SEQ ID NO: 624520 - DNA, 16 bp, Homo sapiens
gcccgtgcgcagccgc

SEQ ID NO: 624521 - DNA, 13 bp, Homo sapiens
gccctcacctctg

SEQ ID NO: 624522 - DNA, 14 bp, Homo sapiens
gccctcacctctga

SEQ ID NO: 624523 - DNA, 16 bp, Homo sapiens
gccctcacctctgagg

SEQ ID NO: 624524 - DNA, 17 bp, Homo sapiens
gccctcacctctgagga

SEQ ID NO: 624525 - DNA, 20 bp, Homo sapiens
gccctcactccactcccctc

SEQ ID NO: 624526 - DNA, 10 bp, Homo sapiens
gccctccccc

SEQ ID NO: 624527 - DNA, 14 bp, Homo sapiens
gccctcccccacgg

SEQ ID NO: 624528 - DNA, 10 bp, Homo sapiens
gccctccctc

SEQ ID NO: 624529 - DNA, 16 bp, Homo sapiens
gccctccctccctcca

SEQ ID NO: 624530 - DNA, 19 bp, Homo sapiens
gccctccctccctccacac

SEQ ID NO: 624531 - DNA, 20 bp, Homo sapiens
gccctccctccctccacacc

SEQ ID NO: 624532 - DNA, 14 bp, Homo sapiens
gccctccgccagcc

SEQ ID NO: 624533 - DNA, 19 bp, Homo sapiens
gccctccgccagccctgtt

SEQ ID NO: 624534 - DNA, 14 bp, Homo sapiens
gccctccgcccttc

SEQ ID NO: 624535 - DNA, 18 bp, Homo sapiens
gccctccgcccttccctg

SEQ ID NO: 624536 - DNA, 11 bp, Homo sapiens
gccctcctctg

SEQ ID NO: 624537 - DNA, 12 bp, Homo sapiens
gccctcctctgc

SEQ ID NO: 624538 - DNA, 13 bp, Homo sapiens
gccctcctctgcc

SEQ ID NO: 624539 - DNA, 14 bp, Homo sapiens
gccctcctctgccc

SEQ ID NO: 624540 - DNA, 17 bp, Homo sapiens
gccctcctctgccccct

SEQ ID NO: 624541 - DNA, 18 bp, Homo sapiens
gccctcctctgccccctc

SEQ ID NO: 624542 - DNA, 22 bp, Homo sapiens
gccctcctctgccccctccccc

SEQ ID NO: 624543 - DNA, 15 bp, Homo sapiens
gccctctgctgcttt

SEQ ID NO: 624544 - DNA, 17 bp, Homo sapiens
gccctcttaagatctga

SEQ ID NO: 624545 - DNA, 20 bp, Homo sapiens
gccctgacaacaactatcac

SEQ ID NO: 624546 - DNA, 21 bp, Homo sapiens
gccctgacatgctaacctctc

SEQ ID NO: 624547 - DNA, 16 bp, Homo sapiens
gccctgacttctggag

SEQ ID NO: 624548 - DNA, 19 bp, Homo sapiens
gccctgacttctggagatg

SEQ ID NO: 624549 - DNA, 22 bp, Homo sapiens
gccctgcagtcacgtgaggccc

SEQ ID NO: 624550 - DNA, 21 bp, Homo sapiens
gccctgcccgcgcccgccgcc

SEQ ID NO: 624551 - DNA, 13 bp, Homo sapiens
gccctgccctcac

SEQ ID NO: 624552 - DNA, 15 bp, Homo sapiens
gccctgccctcactc

SEQ ID NO: 624553 - DNA, 21 bp, Homo sapiens
gccctgccctcactccactcc

SEQ ID NO: 624554 - DNA, 12 bp, Homo sapiens
gccctgccctcc

SEQ ID NO: 624555 - DNA, 11 bp, Homo sapiens
gccctgcctga

SEQ ID NO: 624556 - DNA, 13 bp, Homo sapiens
gccctgcctgagg

SEQ ID NO: 624557 - DNA, 15 bp, Homo sapiens
gccctgcctgaggag

SEQ ID NO: 624558 - DNA, 16 bp, Homo sapiens
gccctgcctgaggagg

SEQ ID NO: 624559 - DNA, 11 bp, Homo sapiens
gccctggagcc

SEQ ID NO: 624560 - DNA, 14 bp, Homo sapiens
gccctggagccagg

SEQ ID NO: 624561 - DNA, 10 bp, Homo sapiens
gccctgggca

SEQ ID NO: 624562 - DNA, 21 bp, Homo sapiens
gccctgggcaaggaagctttg

SEQ ID NO: 624563 - DNA, 23 bp, Homo sapiens
gccctggggcatccaccttcctg

SEQ ID NO: 624564 - DNA, 17 bp, Homo sapiens
gccctggggtctctgag

SEQ ID NO: 624565 - DNA, 23 bp, Homo sapiens
gccctggggtctctgagcagtgg

SEQ ID NO: 624566 - DNA, 16 bp, Homo sapiens
gccctgtgccctctca

SEQ ID NO: 624567 - DNA, 14 bp, Homo sapiens
gcccttagaatgtg

SEQ ID NO: 624568 - DNA, 18 bp, Homo sapiens
gcccttcccaacctcccc

SEQ ID NO: 624569 - DNA, 20 bp, Homo sapiens
gcccttcccaacctcccctg

SEQ ID NO: 624570 - DNA, 18 bp, Homo sapiens
gcccttgctctacctggc

SEQ ID NO: 624571 - DNA, 23 bp, Homo sapiens
gccctttgcaggcccagcagact

SEQ ID NO: 624572 - DNA, 14 bp, Homo sapiens
gccgactgggctgc

SEQ ID NO: 624573 - DNA, 18 bp, Homo sapiens
gccgcagggcgctccggc

SEQ ID NO: 624574 - DNA, 23 bp, Homo sapiens
gccgcagggcgctccggcagagg

SEQ ID NO: 624575 - DNA, 17 bp, Homo sapiens
gccgcatctgcctggag

SEQ ID NO: 624576 - DNA, 20 bp, Homo sapiens
gccgcatctgcctggagcct

SEQ ID NO: 624577 - DNA, 20 bp, Homo sapiens
gccgccgaagggcagccccg

SEQ ID NO: 624578 - DNA, 14 bp, Homo sapiens
gccgcctcctccag

SEQ ID NO: 624579 - DNA, 16 bp, Homo sapiens
gccgcctcgggccgcc

SEQ ID NO: 624580 - DNA, 22 bp, Homo sapiens
gccgcctcgggccgcctcctcc

SEQ ID NO: 624581 - DNA, 23 bp, Homo sapiens
gccgcgaactgggttctttggaa

SEQ ID NO: 624582 - DNA, 13 bp, Homo sapiens
gccgcgctctgcc

SEQ ID NO: 624583 - DNA, 19 bp, Homo sapiens
gccgcgctctgcccctccg

SEQ ID NO: 624584 - DNA, 14 bp, Homo sapiens
gccgctctccgccc

SEQ ID NO: 624585 - DNA, 12 bp, Homo sapiens
gccggctggccg

SEQ ID NO: 624586 - DNA, 13 bp, Homo sapiens
gccggggctgccg

SEQ ID NO: 624587 - DNA, 14 bp, Homo sapiens
gccggggctggccc

SEQ ID NO: 624588 - DNA, 15 bp, Homo sapiens
gccggggctggccct

SEQ ID NO: 624589 - DNA, 16 bp, Homo sapiens
gccggggctggccctg

SEQ ID NO: 624590 - DNA, 16 bp, Homo sapiens
gccggggtccaggccc

SEQ ID NO: 624591 - DNA, 14 bp, Homo sapiens
gccggtaggctgct

SEQ ID NO: 624592 - DNA, 15 bp, Homo sapiens
gccggtaggctgctg

SEQ ID NO: 624593 - DNA, 20 bp, Homo sapiens
gccggtaggctgctggcgcc

SEQ ID NO: 624594 - DNA, 19 bp, Homo sapiens
gccggttggccggctggcc

SEQ ID NO: 624595 - DNA, 13 bp, Homo sapiens
gccgtcagcctgt

SEQ ID NO: 624596 - DNA, 12 bp, Homo sapiens
gccgtggagctt

SEQ ID NO: 624597 - DNA, 16 bp, Homo sapiens
gccgtggagcttggag

SEQ ID NO: 624598 - DNA, 19 bp, Homo sapiens
gccagcattcagcacacac

SEQ ID NO: 624599 - DNA, 18 bp, Homo sapiens
gccagcccttgctctacc

SEQ ID NO: 624600 - DNA, 17 bp, Homo sapiens
gccagcgcagcgccagg

SEQ ID NO: 624601 - DNA, 20 bp, Homo sapiens
gccagcgcagcgccagggct

SEQ ID NO: 624602 - DNA, 16 bp, Homo sapiens
gccaggccctccagca

SEQ ID NO: 624603 - DNA, 18 bp, Homo sapiens
gccaggccctccagcagg

SEQ ID NO: 624604 - DNA, 20 bp, Homo sapiens
gccaggcctcagggaccaag

SEQ ID NO: 624605 - DNA, 14 bp, Homo sapiens
gccaggcctccctc

SEQ ID NO: 624606 - DNA, 17 bp, Homo sapiens
gccaggcctccctcggg

SEQ ID NO: 624607 - DNA, 16 bp, Homo sapiens
gccaggggcaggcagc

SEQ ID NO: 624608 - DNA, 17 bp, Homo sapiens
gccaggggcaggcagct

SEQ ID NO: 624609 - DNA, 22 bp, Homo sapiens
gccagggtgggaagagaagaaa

SEQ ID NO: 624610 - DNA, 13 bp, Homo sapiens
gccagggttccag

SEQ ID NO: 624611 - DNA, 15 bp, Homo sapiens
gccagggttccagac

SEQ ID NO: 624612 - DNA, 16 bp, Homo sapiens
gccagggttccagaca

SEQ ID NO: 624613 - DNA, 17 bp, Homo sapiens
gccaggtctggcgccag

SEQ ID NO: 624614 - DNA, 23 bp, Homo sapiens
gccaggtctggcgccaggggcag

SEQ ID NO: 624615 - DNA, 22 bp, Homo sapiens
gccagtggggtcccccctgagt

SEQ ID NO: 624616 - DNA, 21 bp, Homo sapiens
gccagtgtttagaagagcctg

SEQ ID NO: 624617 - DNA, 24 bp, Homo sapiens
gccagtgtttagaagagcctgact

SEQ ID NO: 624618 - DNA, 11 bp, Homo sapiens
gccatacttcc

SEQ ID NO: 624619 - DNA, 13 bp, Homo sapiens
gccatcatttcat

SEQ ID NO: 624620 - DNA, 16 bp, Homo sapiens
gccatctccaccctga

SEQ ID NO: 624621 - DNA, 21 bp, Homo sapiens
gccatctccaccctgagcctg

SEQ ID NO: 624622 - DNA, 15 bp, Homo sapiens
gccatgcccacgccc

SEQ ID NO: 624623 - DNA, 20 bp, Homo sapiens
gccatgcccacgcccctccc

SEQ ID NO: 624624 - DNA, 23 bp, Homo sapiens
gccatgcccacgcccctccccag

SEQ ID NO: 624625 - DNA, 20 bp, Homo sapiens
gccatgtatgttgcatgaat

SEQ ID NO: 624626 - DNA, 22 bp, Homo sapiens
gccattcagtctatgctgtgtg

SEQ ID NO: 624627 - DNA, 12 bp, Homo sapiens
gccattcccact

SEQ ID NO: 624628 - DNA, 16 bp, Homo sapiens
gccattgaacactgca

SEQ ID NO: 624629 - DNA, 18 bp, Homo sapiens
gccattgaacactgcacc

SEQ ID NO: 624630 - DNA, 21 bp, Homo sapiens
gccattgaacactgcaccctc

SEQ ID NO: 624631 - DNA, 17 bp, Homo sapiens
gccatttcacattcctg

SEQ ID NO: 624632 - DNA, 19 bp, Homo sapiens
gccatttcacattcctgac

SEQ ID NO: 624633 - DNA, 21 bp, Homo sapiens
gccatttcacattcctgaccc

SEQ ID NO: 624634 - DNA, 19 bp, Homo sapiens
gccatttgctagttctgct

SEQ ID NO: 624635 - DNA, 20 bp, Homo sapiens
gccattttgtctggctgtgg

SEQ ID NO: 624636 - DNA, 15 bp, Homo sapiens
gcccacccacacccc

SEQ ID NO: 624637 - DNA, 10 bp, Homo sapiens
gcccaccccg

SEQ ID NO: 624638 - DNA, 16 bp, Homo sapiens
gcccacccctcttccc

SEQ ID NO: 624639 - DNA, 21 bp, Homo sapiens
gcccacccctcttcccccttc

SEQ ID NO: 624640 - DNA, 14 bp, Homo sapiens
gcccaccctgggcc

SEQ ID NO: 624641 - DNA, 23 bp, Homo sapiens
gcccacctaaagggaagccctga

SEQ ID NO: 624642 - DNA, 14 bp, Homo sapiens
gcccacctgcccag

SEQ ID NO: 624643 - DNA, 14 bp, Homo sapiens
gcccacgcagagcc

SEQ ID NO: 624644 - DNA, 19 bp, Homo sapiens
gcccacgcccctccccagc

SEQ ID NO: 624645 - DNA, 21 bp, Homo sapiens
gcccacgcccctccccagccc

SEQ ID NO: 624646 - DNA, 15 bp, Homo sapiens
gcccacgtgcagcac

SEQ ID NO: 624647 - DNA, 14 bp, Homo sapiens
gcccacttcacaca

SEQ ID NO: 624648 - DNA, 18 bp, Homo sapiens
gcccagaacgggcctccc

SEQ ID NO: 624649 - DNA, 22 bp, Homo sapiens
gcccagaacgggcctccccggg

SEQ ID NO: 624650 - DNA, 15 bp, Homo sapiens
gcccagcacctcctc

SEQ ID NO: 624651 - DNA, 16 bp, Homo sapiens
gcccagcacctcctcc

SEQ ID NO: 624652 - DNA, 15 bp, Homo sapiens
gcccagcccccaccc

SEQ ID NO: 624653 - DNA, 15 bp, Homo sapiens
gcccagccctgggca

SEQ ID NO: 624654 - DNA, 17 bp, Homo sapiens
gcccagccctgggcaag

SEQ ID NO: 624655 - DNA, 15 bp, Homo sapiens
gcccaggaggacctg

SEQ ID NO: 624656 - DNA, 16 bp, Homo sapiens
gcccaggaggacctgg

SEQ ID NO: 624657 - DNA, 12 bp, Homo sapiens
gcccaggcccag

SEQ ID NO: 624658 - DNA, 14 bp, Homo sapiens
gcccaggcccagcc

SEQ ID NO: 624659 - DNA, 15 bp, Homo sapiens
gcccaggcccagcct

SEQ ID NO: 624660 - DNA, 11 bp, Homo sapiens
gcccagggagg

SEQ ID NO: 624661 - DNA, 16 bp, Homo sapiens
gcccagggaggtggca

SEQ ID NO: 624662 - DNA, 21 bp, Homo sapiens
gcccagggaggtggcagggaa

SEQ ID NO: 624663 - DNA, 22 bp, Homo sapiens
gcccagggaggtggcagggaag

SEQ ID NO: 624664 - DNA, 17 bp, Homo sapiens
gcccaggggacgtggcg

SEQ ID NO: 624665 - DNA, 18 bp, Homo sapiens
gcccaggggacgtggcgc

SEQ ID NO: 624666 - DNA, 17 bp, Homo sapiens
gcccagtccctggagct

SEQ ID NO: 624667 - DNA, 18 bp, Homo sapiens
gcccagtccctggagctg

SEQ ID NO: 624668 - DNA, 23 bp, Homo sapiens
gcccagtcttgagtgggccccct

SEQ ID NO: 624669 - DNA, 15 bp, Homo sapiens
gcccagttagcccgg

SEQ ID NO: 624670 - DNA, 16 bp, Homo sapiens
gcccagttagcccggc

SEQ ID NO: 624671 - DNA, 17 bp, Homo sapiens
gcccagttagcccggcc

SEQ ID NO: 624672 - DNA, 21 bp, Homo sapiens
gcccagttagcccggccaagg

SEQ ID NO: 624673 - DNA, 16 bp, Homo sapiens
gcccatggccccagct

SEQ ID NO: 624674 - DNA, 18 bp, Homo sapiens
gcccatggccccagctgg

SEQ ID NO: 624675 - DNA, 21 bp, Homo sapiens
gcccatggccccagctggctg

SEQ ID NO: 624676 - DNA, 14 bp, Homo sapiens
gcccatttcacaca

SEQ ID NO: 624677 - DNA, 21 bp, Homo sapiens
gccccacaaggcccagccctg

SEQ ID NO: 624678 - DNA, 22 bp, Homo sapiens
gccccacaaggcccagccctgg

SEQ ID NO: 624679 - DNA, 18 bp, Homo sapiens
gccccacctccccagagc

SEQ ID NO: 624680 - DNA, 23 bp, Homo sapiens
gccccacctccccagagccctgc

SEQ ID NO: 624681 - DNA, 13 bp, Homo sapiens
gccccagagactg

SEQ ID NO: 624682 - DNA, 14 bp, Homo sapiens
gccccagagactgc

SEQ ID NO: 624683 - DNA, 19 bp, Homo sapiens
gccccagagactgcccacc

SEQ ID NO: 624684 - DNA, 15 bp, Homo sapiens
gccccagccaagcct

SEQ ID NO: 624685 - DNA, 16 bp, Homo sapiens
gccccagccaagcctg

SEQ ID NO: 624686 - DNA, 18 bp, Homo sapiens
gccccagccaagcctgac

SEQ ID NO: 624687 - DNA, 15 bp, Homo sapiens
gccccagcccgacag

SEQ ID NO: 624688 - DNA, 13 bp, Homo sapiens
gccccaggcccgc

SEQ ID NO: 624689 - DNA, 16 bp, Homo sapiens
gccccaggcggagggg

SEQ ID NO: 624690 - DNA, 17 bp, Homo sapiens
gccccaggcggaggggc

SEQ ID NO: 624691 - DNA, 22 bp, Homo sapiens
gccccaggcggaggggcttgga

SEQ ID NO: 624692 - DNA, 16 bp, Homo sapiens
gccccatcagaggctg

SEQ ID NO: 624693 - DNA, 13 bp, Homo sapiens
gccccatccttcc

SEQ ID NO: 624694 - DNA, 23 bp, Homo sapiens
gccccatccttcccgcagcacca

SEQ ID NO: 624695 - DNA, 22 bp, Homo sapiens
gccccatctcctcccatggcct

SEQ ID NO: 624696 - DNA, 15 bp, Homo sapiens
gccccatgggccctc

SEQ ID NO: 624697 - DNA, 17 bp, Homo sapiens
gcccccaaattgccttc

SEQ ID NO: 624698 - DNA, 18 bp, Homo sapiens
gcccccaaattgccttca

SEQ ID NO: 624699 - DNA, 19 bp, Homo sapiens
gcccccaaattgccttcag

SEQ ID NO: 624700 - DNA, 23 bp, Homo sapiens
gcccccaaattgccttcagccct

SEQ ID NO: 624701 - DNA, 10 bp, Homo sapiens
gcccccagga

SEQ ID NO: 624702 - DNA, 12 bp, Homo sapiens
gcccccaggacc

SEQ ID NO: 624703 - DNA, 14 bp, Homo sapiens
gcccccaggacccc

SEQ ID NO: 624704 - DNA, 20 bp, Homo sapiens
gcccccatgcaggcagcctg

SEQ ID NO: 624705 - DNA, 17 bp, Homo sapiens
gccccccggcctggccc

SEQ ID NO: 624706 - DNA, 13 bp, Homo sapiens
gccccccttccca

SEQ ID NO: 624707 - DNA, 14 bp, Homo sapiens
gccccccttcccac

SEQ ID NO: 624708 - DNA, 20 bp, Homo sapiens
gcccccgccctcgctccggg

SEQ ID NO: 624709 - DNA, 14 bp, Homo sapiens
gccccctggcggca

SEQ ID NO: 624710 - DNA, 17 bp, Homo sapiens
gccccctggcggcaggg

SEQ ID NO: 624711 - DNA, 18 bp, Homo sapiens
gccccctggcggcagggg

SEQ ID NO: 624712 - DNA, 14 bp, Homo sapiens
gccccggagcacca

SEQ ID NO: 624713 - DNA, 14 bp, Homo sapiens
gccccgtgctcctc

SEQ ID NO: 624714 - DNA, 22 bp, Homo sapiens
gcccctatcctgcaccctctgc

SEQ ID NO: 624715 - DNA, 16 bp, Homo sapiens
gcccctccccagcccc

SEQ ID NO: 624716 - DNA, 20 bp, Homo sapiens
gcccctccgggcagagacca

SEQ ID NO: 624717 - DNA, 13 bp, Homo sapiens
gcagggagggggc

SEQ ID NO: 624718 - DNA, 16 bp, Homo sapiens
gcagggagggggctgg

SEQ ID NO: 624719 - DNA, 17 bp, Homo sapiens
gcagggagggggctggg

SEQ ID NO: 624720 - DNA, 18 bp, Homo sapiens
gcagggagggggctggga

SEQ ID NO: 624721 - DNA, 21 bp, Homo sapiens
gcagggagggggctgggaaag

SEQ ID NO: 624722 - DNA, 16 bp, Homo sapiens
gcagggcccagggagg

SEQ ID NO: 624723 - DNA, 22 bp, Homo sapiens
gcagggcccagggaggtggcag

SEQ ID NO: 624724 - DNA, 23 bp, Homo sapiens
gcagggcccagggaggtggcagg

SEQ ID NO: 624725 - DNA, 17 bp, Homo sapiens
gcagggcccccacagga

SEQ ID NO: 624726 - DNA, 14 bp, Homo sapiens
gcagggccctgggg

SEQ ID NO: 624727 - DNA, 13 bp, Homo sapiens
gcagggccgcagg

SEQ ID NO: 624728 - DNA, 14 bp, Homo sapiens
gcagggccgcaggg

SEQ ID NO: 624729 - DNA, 17 bp, Homo sapiens
gcagggcgctccggcag

SEQ ID NO: 624730 - DNA, 19 bp, Homo sapiens
gcagggcgctccggcagag

SEQ ID NO: 624731 - DNA, 18 bp, Homo sapiens
gcaggggccgtgcagggc

SEQ ID NO: 624732 - DNA, 16 bp, Homo sapiens
gcaggggttggcagcg

SEQ ID NO: 624733 - DNA, 14 bp, Homo sapiens
gcagggtgagaagc

SEQ ID NO: 624734 - DNA, 18 bp, Homo sapiens
gcaggtgaccagaatgag

SEQ ID NO: 624735 - DNA, 20 bp, Homo sapiens
gcaggtgaccagaatgaggc

SEQ ID NO: 624736 - DNA, 23 bp, Homo sapiens
gcaggtgctgtgcgccttgtaga

SEQ ID NO: 624737 - DNA, 14 bp, Homo sapiens
gcaggtgggctgcc

SEQ ID NO: 624738 - DNA, 15 bp, Homo sapiens
gcaggtgggctgcct

SEQ ID NO: 624739 - DNA, 15 bp, Homo sapiens
gcaggtgggggctgc

SEQ ID NO: 624740 - DNA, 22 bp, Homo sapiens
gcaggttgtgtgtgtgtgcagt

SEQ ID NO: 624741 - DNA, 17 bp, Homo sapiens
gcagtaccatcccactg

SEQ ID NO: 624742 - DNA, 14 bp, Homo sapiens
gcagtagagagcct

SEQ ID NO: 624743 - DNA, 18 bp, Homo sapiens
gcagtatatattctttca

SEQ ID NO: 624744 - DNA, 22 bp, Homo sapiens
gcagtatatattctttcacaag

SEQ ID NO: 624745 - DNA, 16 bp, Homo sapiens
gcagtgcagcaaccag

SEQ ID NO: 624746 - DNA, 13 bp, Homo sapiens
gcagtggagaggg

SEQ ID NO: 624747 - DNA, 17 bp, Homo sapiens
gcagtggagaggggact

SEQ ID NO: 624748 - DNA, 21 bp, Homo sapiens
gcagtggagaggggacttgga

SEQ ID NO: 624749 - DNA, 21 bp, Homo sapiens
gcagtgtgtcacactgagctg

SEQ ID NO: 624750 - DNA, 16 bp, Homo sapiens
gcagttagcacagagg

SEQ ID NO: 624751 - DNA, 20 bp, Homo sapiens
gcagttatttaccagaagtt

SEQ ID NO: 624752 - DNA, 18 bp, Homo sapiens
gcagtttggccctggagc

SEQ ID NO: 624753 - DNA, 21 bp, Homo sapiens
gcagtttggccctggagccag

SEQ ID NO: 624754 - DNA, 17 bp, Homo sapiens
gcagtttggtatgaaac

SEQ ID NO: 624755 - DNA, 20 bp, Homo sapiens
gcagtttggtatgaaacaaa

SEQ ID NO: 624756 - DNA, 11 bp, Homo sapiens
gcataaaacaa

SEQ ID NO: 624757 - DNA, 20 bp, Homo sapiens
gcataagattatatacaaag

SEQ ID NO: 624758 - DNA, 15 bp, Homo sapiens
gcataatatgcatat

SEQ ID NO: 624759 - DNA, 19 bp, Homo sapiens
gcataatatgcatatatat

SEQ ID NO: 624760 - DNA, 15 bp, Homo sapiens
gcataattgtgagtt

SEQ ID NO: 624761 - DNA, 14 bp, Homo sapiens
gcatactgatgaga

SEQ ID NO: 624762 - DNA, 19 bp, Homo sapiens
gcatactgatgagacaaca

SEQ ID NO: 624763 - DNA, 23 bp, Homo sapiens
gcatagccagcattcagcacaca

SEQ ID NO: 624764 - DNA, 16 bp, Homo sapiens
gcatagccattcattt

SEQ ID NO: 624765 - DNA, 21 bp, Homo sapiens
gcatagttctgcaataacagt

SEQ ID NO: 624766 - DNA, 20 bp, Homo sapiens
gcatatggcaacgttcatgt

SEQ ID NO: 624767 - DNA, 17 bp, Homo sapiens
gcatccaccttcctgcc

SEQ ID NO: 624768 - DNA, 20 bp, Homo sapiens
gcatccaccttcctgcccag

SEQ ID NO: 624769 - DNA, 22 bp, Homo sapiens
gcatccatggatgcagaaatga

SEQ ID NO: 624770 - DNA, 22 bp, Homo sapiens
gcatcccttggcccctctctgt

SEQ ID NO: 624771 - DNA, 13 bp, Homo sapiens
gcatccgagcccc

SEQ ID NO: 624772 - DNA, 16 bp, Homo sapiens
gcatccgagcccctgt

SEQ ID NO: 624773 - DNA, 22 bp, Homo sapiens
gcatccgagcccctgtttctcc

SEQ ID NO: 624774 - DNA, 11 bp, Homo sapiens
gcatctgcctg

SEQ ID NO: 624775 - DNA, 16 bp, Homo sapiens
gcatctgcctggagcc

SEQ ID NO: 624776 - DNA, 14 bp, Homo sapiens
gcatctggcctggg

SEQ ID NO: 624777 - DNA, 17 bp, Homo sapiens
gcatctggcctgggggc

SEQ ID NO: 624778 - DNA, 18 bp, Homo sapiens
gcatgaatccatcgattt

SEQ ID NO: 624779 - DNA, 21 bp, Homo sapiens
gcatgacacgaatattgctga

SEQ ID NO: 624780 - DNA, 15 bp, Homo sapiens
gcatgagaactaaat

SEQ ID NO: 624781 - DNA, 17 bp, Homo sapiens
gcatgagaactaaatag

SEQ ID NO: 624782 - DNA, 18 bp, Homo sapiens
gcatgagaactaaataga

SEQ ID NO: 624783 - DNA, 17 bp, Homo sapiens
gcatgagttctgcacat

SEQ ID NO: 624784 - DNA, 13 bp, Homo sapiens
gcatgcagggccc

SEQ ID NO: 624785 - DNA, 19 bp, Homo sapiens
gcatgcatttagcatgagt

SEQ ID NO: 624786 - DNA, 16 bp, Homo sapiens
gcatgcccaaatataa

SEQ ID NO: 624787 - DNA, 16 bp, Homo sapiens
gcatgcgatgtcatat

SEQ ID NO: 624788 - DNA, 11 bp, Homo sapiens
gcatgctcagt

SEQ ID NO: 624789 - DNA, 14 bp, Homo sapiens
gcatgctcagtatt

SEQ ID NO: 624790 - DNA, 15 bp, Homo sapiens
gcatgctcagtattg

SEQ ID NO: 624791 - DNA, 12 bp, Homo sapiens
gcatggagaagg

SEQ ID NO: 624792 - DNA, 15 bp, Homo sapiens
gcatggcgccccggg

SEQ ID NO: 624793 - DNA, 23 bp, Homo sapiens
gcatgtacagtgttctgtttaat

SEQ ID NO: 624794 - DNA, 23 bp, Homo sapiens
gcatgtattgtgtcttttgcatg

SEQ ID NO: 624795 - DNA, 16 bp, Homo sapiens
gcatgtcggggcccct

SEQ ID NO: 624796 - DNA, 18 bp, Homo sapiens
gcatgtgatgagaggaaa

SEQ ID NO: 624797 - DNA, 17 bp, Homo sapiens
gcatgttaggaattaga

SEQ ID NO: 624798 - DNA, 19 bp, Homo sapiens
gcatgttgccatgaggcct

SEQ ID NO: 624799 - DNA, 22 bp, Homo sapiens
gcatgtttaataatatgtacaa

SEQ ID NO: 624800 - DNA, 19 bp, Homo sapiens
gcattaaaaataagccaaa

SEQ ID NO: 624801 - DNA, 15 bp, Homo sapiens
gcattgaccttcatg

SEQ ID NO: 624802 - DNA, 16 bp, Homo sapiens
gcatttagcatgagtt

SEQ ID NO: 624803 - DNA, 19 bp, Homo sapiens
gcatttagcatgagttctg

SEQ ID NO: 624804 - DNA, 16 bp, Homo sapiens
gcatttatgcatgaga

SEQ ID NO: 624805 - DNA, 14 bp, Homo sapiens
gcatttctttggaa

SEQ ID NO: 624806 - DNA, 16 bp, Homo sapiens
gcatttctttggaaac

SEQ ID NO: 624807 - DNA, 23 bp, Homo sapiens
gcatttgcaggtgaccagaatga

SEQ ID NO: 624808 - DNA, 22 bp, Homo sapiens
gcatttgctgaataacaacaat

SEQ ID NO: 624809 - DNA, 15 bp, Homo sapiens
gccaaaataagacta

SEQ ID NO: 624810 - DNA, 19 bp, Homo sapiens
gccaaaatgtcaattttta

SEQ ID NO: 624811 - DNA, 20 bp, Homo sapiens
gccaaagatagcagaagagt

SEQ ID NO: 624812 - DNA, 22 bp, Homo sapiens
gccaacttaaacctgtgctttc

SEQ ID NO: 624813 - DNA, 15 bp, Homo sapiens
gccaagaattagatt

SEQ ID NO: 624814 - DNA, 19 bp, Homo sapiens
gccaagccagggttccaga

SEQ ID NO: 624815 - DNA, 20 bp, Homo sapiens
gccaagccagggttccagac

SEQ ID NO: 624816 - DNA, 22 bp, Homo sapiens
gccaagccagggttccagacag

SEQ ID NO: 624817 - DNA, 14 bp, Homo sapiens
gccaagcctgactt

SEQ ID NO: 624818 - DNA, 14 bp, Homo sapiens
gccaaggacactga

SEQ ID NO: 624819 - DNA, 20 bp, Homo sapiens
gccaaggacactgatgggtc

SEQ ID NO: 624820 - DNA, 13 bp, Homo sapiens
gccaagtgtcctg

SEQ ID NO: 624821 - DNA, 15 bp, Homo sapiens
gccaatgtccaggtc

SEQ ID NO: 624822 - DNA, 11 bp, Homo sapiens
gccaatttttc

SEQ ID NO: 624823 - DNA, 13 bp, Homo sapiens
gccaatttttctg

SEQ ID NO: 624824 - DNA, 16 bp, Homo sapiens
gccaatttttctgcac

SEQ ID NO: 624825 - DNA, 21 bp, Homo sapiens
gccacagtggggcccatggcc

SEQ ID NO: 624826 - DNA, 22 bp, Homo sapiens
gccacagtggggcccatggccc

SEQ ID NO: 624827 - DNA, 10 bp, Homo sapiens
gccaccctga

SEQ ID NO: 624828 - DNA, 14 bp, Homo sapiens
gccaccctgagcag

SEQ ID NO: 624829 - DNA, 14 bp, Homo sapiens
gccacctgccaggc

SEQ ID NO: 624830 - DNA, 18 bp, Homo sapiens
gccacctgccaggcctcc

SEQ ID NO: 624831 - DNA, 20 bp, Homo sapiens
gccacctgccaggcctccct

SEQ ID NO: 624832 - DNA, 20 bp, Homo sapiens
gccacttagggagtgtgcct

SEQ ID NO: 624833 - DNA, 21 bp, Homo sapiens
gccagatttcactctccttgg

SEQ ID NO: 624834 - DNA, 16 bp, Homo sapiens
gccagcagacattgtc

SEQ ID NO: 624835 - DNA, 12 bp, Homo sapiens
gcagcctgagct

SEQ ID NO: 624836 - DNA, 15 bp, Homo sapiens
gcagcctgagctcca

SEQ ID NO: 624837 - DNA, 16 bp, Homo sapiens
gcagcctgagctccac

SEQ ID NO: 624838 - DNA, 18 bp, Homo sapiens
gcagcctgagctccaccc

SEQ ID NO: 624839 - DNA, 14 bp, Homo sapiens
gcagcgccagggct

SEQ ID NO: 624840 - DNA, 14 bp, Homo sapiens
gcagcgcccgaggc

SEQ ID NO: 624841 - DNA, 20 bp, Homo sapiens
gcagcgcccgaggccagggc

SEQ ID NO: 624842 - DNA, 12 bp, Homo sapiens
gcagcgcctccc

SEQ ID NO: 624843 - DNA, 16 bp, Homo sapiens
gcagcgcctcgcccca

SEQ ID NO: 624844 - DNA, 16 bp, Homo sapiens
gcagctaatttgtgaa

SEQ ID NO: 624845 - DNA, 18 bp, Homo sapiens
gcagctaatttgtgaaag

SEQ ID NO: 624846 - DNA, 19 bp, Homo sapiens
gcagctaatttgtgaaagt

SEQ ID NO: 624847 - DNA, 21 bp, Homo sapiens
gcagctaggcagggagggggc

SEQ ID NO: 624848 - DNA, 22 bp, Homo sapiens
gcagctaggcagggagggggct

SEQ ID NO: 624849 - DNA, 13 bp, Homo sapiens
gcagctatggaca

SEQ ID NO: 624850 - DNA, 14 bp, Homo sapiens
gcagctatggacaa

SEQ ID NO: 624851 - DNA, 23 bp, Homo sapiens
gcagctcctcgggtggggcctgc

SEQ ID NO: 624852 - DNA, 19 bp, Homo sapiens
gcagctcttcccctttcct

SEQ ID NO: 624853 - DNA, 22 bp, Homo sapiens
gcagctgcagttagcacagagg

SEQ ID NO: 624854 - DNA, 17 bp, Homo sapiens
gcaggcagattaataac

SEQ ID NO: 624855 - DNA, 17 bp, Homo sapiens
gcaggcgcgcaccgccc

SEQ ID NO: 624856 - DNA, 19 bp, Homo sapiens
gcagggaagggtgcctggc

SEQ ID NO: 624857 - DNA, 20 bp, Homo sapiens
gcagggaagggtgcctggct

SEQ ID NO: 624858 - DNA, 23 bp, Homo sapiens
gaaagagaaaatgctttctcatg

SEQ ID NO: 624859 - DNA, 22 bp, Homo sapiens
gaaagaggaataaaatgattaa

SEQ ID NO: 624860 - DNA, 18 bp, Homo sapiens
gaaagatacaggggatca

SEQ ID NO: 624861 - DNA, 18 bp, Homo sapiens
gaaagatcccaagtcaaa

SEQ ID NO: 624862 - DNA, 20 bp, Homo sapiens
gaaagccagggtcctgagtg

SEQ ID NO: 624863 - DNA, 20 bp, Homo sapiens
gaaaggcagagattgggggg

SEQ ID NO: 624864 - DNA, 21 bp, Homo sapiens
gaaaggcagccctcacctctg

SEQ ID NO: 624865 - DNA, 14 bp, Homo sapiens
gaaagggacaagta

SEQ ID NO: 624866 - DNA, 20 bp, Homo sapiens
gaaagggcagcccctcccca

SEQ ID NO: 624867 - DNA, 18 bp, Homo sapiens
gaaagggtgtggcttgga

SEQ ID NO: 624868 - DNA, 13 bp, Homo sapiens
gaatggttgcaaa

SEQ ID NO: 624869 - DNA, 23 bp, Homo sapiens
gaatgtgaaaaaaaaaagtaatt

SEQ ID NO: 624870 - DNA, 23 bp, Homo sapiens
gaatgtgcaaagcagtatgtaca

SEQ ID NO: 624871 - DNA, 15 bp, Homo sapiens
gaattaggtaatgga

SEQ ID NO: 624872 - DNA, 16 bp, Homo sapiens
gaattcagtagcattt

SEQ ID NO: 624873 - DNA, 21 bp, Homo sapiens
gaattcatgatgctagttctt

SEQ ID NO: 624874 - DNA, 22 bp, Homo sapiens
gaattcatgatgctagttctta

SEQ ID NO: 624875 - DNA, 17 bp, Homo sapiens
gaattcatgcctcaagt

SEQ ID NO: 624876 - DNA, 23 bp, Homo sapiens
gaattgaaccgtcaatgtgaaat

SEQ ID NO: 624877 - DNA, 12 bp, Homo sapiens
gaattgattttt

SEQ ID NO: 624878 - DNA, 16 bp, Homo sapiens
gaattggcagaagcag

SEQ ID NO: 624879 - DNA, 20 bp, Homo sapiens
gaattgggcccttagaatgt

SEQ ID NO: 624880 - DNA, 22 bp, Homo sapiens
gaattgtttttagaaatttatt

SEQ ID NO: 624881 - DNA, 19 bp, Homo sapiens
gaatttaccatcaaacaaa

SEQ ID NO: 624882 - DNA, 13 bp, Homo sapiens
gaattttcatttt

SEQ ID NO: 624883 - DNA, 18 bp, Homo sapiens
gaattttcattttcatta

SEQ ID NO: 624884 - DNA, 19 bp, Homo sapiens
gacaaagggaaggctgctg

SEQ ID NO: 624885 - DNA, 17 bp, Homo sapiens
gacaaatacacatacat

SEQ ID NO: 624886 - DNA, 17 bp, Homo sapiens
gacaataagaaacagtt

SEQ ID NO: 624887 - DNA, 18 bp, Homo sapiens
gacaataagaaacagttt

SEQ ID NO: 624888 - DNA, 16 bp, Homo sapiens
gacacactcaccattt

SEQ ID NO: 624889 - DNA, 19 bp, Homo sapiens
gacacagcacaagggcaca

SEQ ID NO: 624890 - DNA, 19 bp, Homo sapiens
gacacagctgagctggcct

SEQ ID NO: 624891 - DNA, 17 bp, Homo sapiens
gacaccctcctgccccc

SEQ ID NO: 624892 - DNA, 19 bp, Homo sapiens
gacacgaatattgctgatg

SEQ ID NO: 624893 - DNA, 21 bp, Homo sapiens
gacacgtgcaacagactgcct

SEQ ID NO: 624894 - DNA, 14 bp, Homo sapiens
gacactacaaacat

SEQ ID NO: 624895 - DNA, 21 bp, Homo sapiens
gacactgatgggtcctgctgc

SEQ ID NO: 624896 - DNA, 23 bp, Homo sapiens
gacactgatgggtcctgctgctc

SEQ ID NO: 624897 - DNA, 18 bp, Homo sapiens
gacactgtctgctgcccc

SEQ ID NO: 624898 - DNA, 16 bp, Homo sapiens
gacagaaaccaagcca

SEQ ID NO: 624899 - DNA, 22 bp, Homo sapiens
gacagaaccaacgggtctgtgg

SEQ ID NO: 624900 - DNA, 18 bp, Homo sapiens
gacagacggacgggacag

SEQ ID NO: 624901 - DNA, 19 bp, Homo sapiens
gacagacggacgggacagc

SEQ ID NO: 624902 - DNA, 22 bp, Homo sapiens
gacagagagccaagctaatgtg

SEQ ID NO: 624903 - DNA, 16 bp, Homo sapiens
gacagagtgccctggg

SEQ ID NO: 624904 - DNA, 13 bp, Homo sapiens
gacagagtggatc

SEQ ID NO: 624905 - DNA, 14 bp, Homo sapiens
gacagcaaacacag

SEQ ID NO: 624906 - DNA, 21 bp, Homo sapiens
gacagcggccccgcggagccc

SEQ ID NO: 624907 - DNA, 21 bp, Homo sapiens
gacagcggcccggcccacgca

SEQ ID NO: 624908 - DNA, 22 bp, Homo sapiens
gacagcggcccggcccacgcag

SEQ ID NO: 624909 - DNA, 16 bp, Homo sapiens
gacaggcgccgcctcg

SEQ ID NO: 624910 - DNA, 13 bp, Homo sapiens
gacagggagggaa

SEQ ID NO: 624911 - DNA, 19 bp, Homo sapiens
gacagtgttcaaattctga

SEQ ID NO: 624912 - DNA, 13 bp, Homo sapiens
gacagttacttac

SEQ ID NO: 624913 - DNA, 19 bp, Homo sapiens
gacatgctaacctctctga

SEQ ID NO: 624914 - DNA, 21 bp, Homo sapiens
gacatgctaacctctctgaac

SEQ ID NO: 624915 - DNA, 13 bp, Homo sapiens
gacatggtgctgt

SEQ ID NO: 624916 - DNA, 16 bp, Homo sapiens
gacatggtgctgtgtg

SEQ ID NO: 624917 - DNA, 12 bp, Homo sapiens
gacatgtacaga

SEQ ID NO: 624918 - DNA, 22 bp, Homo sapiens
gacattcctaagagtggaggag

SEQ ID NO: 624919 - DNA, 23 bp, Homo sapiens
gacattcctaagagtggaggagg

SEQ ID NO: 624920 - DNA, 15 bp, Homo sapiens
gacattgtcagaatg

SEQ ID NO: 624921 - DNA, 16 bp, Homo sapiens
gacattgtcagaatgt

SEQ ID NO: 624922 - DNA, 18 bp, Homo sapiens
gacattgtcagaatgttg

SEQ ID NO: 624923 - DNA, 13 bp, Homo sapiens
gacattgttttgc

SEQ ID NO: 624924 - DNA, 20 bp, Homo sapiens
gacattgttttgccaacatt

SEQ ID NO: 624925 - DNA, 22 bp, Homo sapiens
gacattgttttgccaacattgc

SEQ ID NO: 624926 - DNA, 20 bp, Homo sapiens
gacatttatgtacaaaatga

SEQ ID NO: 624927 - DNA, 22 bp, Homo sapiens
gacattttgtagctagtttaaa

SEQ ID NO: 624928 - DNA, 15 bp, Homo sapiens
gaccaaggagatggg

SEQ ID NO: 624929 - DNA, 24 bp, Homo sapiens
gaccaccgcgcccctctgcgcccc

SEQ ID NO: 624930 - DNA, 16 bp, Homo sapiens
gaccacggtgtggggg

SEQ ID NO: 624931 - DNA, 19 bp, Homo sapiens
gaccacggtgtggggggtg

SEQ ID NO: 624932 - DNA, 14 bp, Homo sapiens
gaccacttccttaa

SEQ ID NO: 624933 - DNA, 19 bp, Homo sapiens
gaccacttccttaacagct

SEQ ID NO: 624934 - DNA, 13 bp, Homo sapiens
gaccagcctgcca

SEQ ID NO: 624935 - DNA, 15 bp, Homo sapiens
gaccagcctgccagg

SEQ ID NO: 624936 - DNA, 19 bp, Homo sapiens
gaccagcctgccaggccct

SEQ ID NO: 624937 - DNA, 24 bp, Homo sapiens
gaccagcctgccaggccctccagc

SEQ ID NO: 624938 - DNA, 10 bp, Homo sapiens
gaccaggagc

SEQ ID NO: 624939 - DNA, 15 bp, Homo sapiens
gaccaggagctagcc

SEQ ID NO: 624940 - DNA, 18 bp, Homo sapiens
gaccataaagatcacacc

SEQ ID NO: 624941 - DNA, 19 bp, Homo sapiens
gaccatttagtcctcacct

SEQ ID NO: 624942 - DNA, 12 bp, Homo sapiens
gacccctaccct

SEQ ID NO: 624943 - DNA, 16 bp, Homo sapiens
gacccctaccctttcc

SEQ ID NO: 624944 - DNA, 14 bp, Homo sapiens
gacccctgccctcg

SEQ ID NO: 624945 - DNA, 18 bp, Homo sapiens
gaccctatttgtttcatt

SEQ ID NO: 624946 - DNA, 19 bp, Homo sapiens
gaccctatttgtttcatta

SEQ ID NO: 624947 - DNA, 12 bp, Homo sapiens
gaccctcacttt

SEQ ID NO: 624948 - DNA, 14 bp, Homo sapiens
gaccctcctgtcca

SEQ ID NO: 624949 - DNA, 15 bp, Homo sapiens
gaccctcctgtccag

SEQ ID NO: 624950 - DNA, 17 bp, Homo sapiens
gaccctgtctttgctgt

SEQ ID NO: 624951 - DNA, 16 bp, Homo sapiens
gaccgacgcccctccg

SEQ ID NO: 624952 - DNA, 11 bp, Homo sapiens
gaccggcccgc

SEQ ID NO: 624953 - DNA, 17 bp, Homo sapiens
gaccggcccgccacctt

SEQ ID NO: 624954 - DNA, 15 bp, Homo sapiens
gaccggggtggagtc

SEQ ID NO: 624955 - DNA, 18 bp, Homo sapiens
gaccgtggtgtcctctgt

SEQ ID NO: 624956 - DNA, 20 bp, Homo sapiens
gaccgtggtgtcctctgtcc

SEQ ID NO: 624957 - DNA, 15 bp, Homo sapiens
gacctaccctggacc

SEQ ID NO: 624958 - DNA, 23 bp, Homo sapiens
gacctactcctccccctcctcca

SEQ ID NO: 624959 - DNA, 22 bp, Homo sapiens
gacctccagattattttctata

SEQ ID NO: 624960 - DNA, 23 bp, Homo sapiens
gacctccagattattttctatat

SEQ ID NO: 624961 - DNA, 14 bp, Homo sapiens
gacctcctgatgtc

SEQ ID NO: 624962 - DNA, 22 bp, Homo sapiens
gacctcggctgtgtggggaggg

SEQ ID NO: 624963 - DNA, 17 bp, Homo sapiens
gacctctcactttttta

SEQ ID NO: 624964 - DNA, 14 bp, Homo sapiens
gacctgctcctgcc

SEQ ID NO: 624965 - DNA, 17 bp, Homo sapiens
gacctgctcctgcccac

SEQ ID NO: 624966 - DNA, 16 bp, Homo sapiens
gaccttacaaccacat

SEQ ID NO: 624967 - DNA, 22 bp, Homo sapiens
gaccttacaaccacatttctgg

SEQ ID NO: 624968 - DNA, 20 bp, Homo sapiens
gaccttcggcagtggctggg

SEQ ID NO: 624969 - DNA, 21 bp, Homo sapiens
gaccttcggcagtggctgggg

SEQ ID NO: 624970 - DNA, 22 bp, Homo sapiens
gaccttctgcggctccgggctg

SEQ ID NO: 624971 - DNA, 11 bp, Homo sapiens
gacctttcaat

SEQ ID NO: 624972 - DNA, 20 bp, Homo sapiens
gacctttcaataggaaaaac

SEQ ID NO: 624973 - DNA, 13 bp, Homo sapiens
gacgagcagagcg

SEQ ID NO: 624974 - DNA, 16 bp, Homo sapiens
gacgcccagcccccac

SEQ ID NO: 624975 - DNA, 23 bp, Homo sapiens
gacgcccagcccccacccccgtc

SEQ ID NO: 624976 - DNA, 21 bp, Homo sapiens
gacgctggagaccctgcgccc

SEQ ID NO: 624977 - DNA, 17 bp, Homo sapiens
gacgctggtaactgtta

SEQ ID NO: 624978 - DNA, 14 bp, Homo sapiens
gacggaagtggcct

SEQ ID NO: 624979 - DNA, 21 bp, Homo sapiens
gacggaagtggcctgagaaga

SEQ ID NO: 624980 - DNA, 18 bp, Homo sapiens
gacggaggcaggaccagg

SEQ ID NO: 624981 - DNA, 21 bp, Homo sapiens
gacgggacagcggcccggccc

SEQ ID NO: 624982 - DNA, 19 bp, Homo sapiens
tatcctcaagttgtgtgct

SEQ ID NO: 624983 - DNA, 13 bp, Homo sapiens
tatcctgcaccct

SEQ ID NO: 624984 - DNA, 16 bp, Homo sapiens
tatcctgcaccctctg

SEQ ID NO: 624985 - DNA, 21 bp, Homo sapiens
tatctagtaggtctgcacaca

SEQ ID NO: 624986 - DNA, 23 bp, Homo sapiens
tatctagtaggtctgcacacata

SEQ ID NO: 624987 - DNA, 19 bp, Homo sapiens
tatctatttatctgtctga

SEQ ID NO: 624988 - DNA, 23 bp, Homo sapiens
tatctcatcaacaaagaaatatt

SEQ ID NO: 624989 - DNA, 20 bp, Homo sapiens
tatctccagccaatttcaaa

SEQ ID NO: 624990 - DNA, 21 bp, Homo sapiens
tatctgggggactagaacaca

SEQ ID NO: 624991 - DNA, 19 bp, Homo sapiens
tatctgggttttagaaatt

SEQ ID NO: 624992 - DNA, 12 bp, Homo sapiens
tatctgtctgag

SEQ ID NO: 624993 - DNA, 19 bp, Homo sapiens
tatctgtctgagccctgcc

SEQ ID NO: 624994 - DNA, 15 bp, Homo sapiens
tatctgtctttatga

SEQ ID NO: 624995 - DNA, 20 bp, Homo sapiens
tatctgtctttatgatttca

SEQ ID NO: 624996 - DNA, 16 bp, Homo sapiens
tatctgtgaaggactt

SEQ ID NO: 624997 - DNA, 18 bp, Homo sapiens
tatcttggaaaaatgcgt

SEQ ID NO: 624998 - DNA, 15 bp, Homo sapiens
tatctttaaaactta

SEQ ID NO: 624999 - DNA, 17 bp, Homo sapiens
tatgaaacaaatatact

SEQ ID NO: 625000 - DNA, 12 bp, Homo sapiens
tatgaaagagaa

SEQ ID NO: 625001 - DNA, 13 bp, Homo sapiens
tatgaaagagaaa

SEQ ID NO: 625002 - DNA, 17 bp, Homo sapiens
tatgaagcagaatgaga

SEQ ID NO: 625003 - DNA, 20 bp, Homo sapiens
tatgagaaatataaaaataa

SEQ ID NO: 625004 - DNA, 20 bp, Homo sapiens
tatgagattggaaaaaatta

SEQ ID NO: 625005 - DNA, 23 bp, Homo sapiens
tatgagattggaaaaaattagac

SEQ ID NO: 625006 - DNA, 16 bp, Homo sapiens
tatgagcatgctccct

SEQ ID NO: 625007 - DNA, 18 bp, Homo sapiens
tatgagcatgctccctca

SEQ ID NO: 625008 - DNA, 19 bp, Homo sapiens
tatgattaaattatcattg

SEQ ID NO: 625009 - DNA, 22 bp, Homo sapiens
tatgattaaattatcattgttt

SEQ ID NO: 625010 - DNA, 16 bp, Homo sapiens
tatgattctcctctcc

SEQ ID NO: 625011 - DNA, 18 bp, Homo sapiens
tatgattctcctctccca

SEQ ID NO: 625012 - DNA, 21 bp, Homo sapiens
tatgatttcatgattagacaa

SEQ ID NO: 625013 - DNA, 20 bp, Homo sapiens
tatgcaaatatttttttgta

SEQ ID NO: 625014 - DNA, 23 bp, Homo sapiens
tatgcacaccaaattgctgagat

SEQ ID NO: 625015 - DNA, 19 bp, Homo sapiens
tatgcaggcagattaataa

SEQ ID NO: 625016 - DNA, 15 bp, Homo sapiens
tatgcatatatatgt

SEQ ID NO: 625017 - DNA, 14 bp, Homo sapiens
tatgcatttatgca

SEQ ID NO: 625018 - DNA, 17 bp, Homo sapiens
tatgcatttatgcatga

SEQ ID NO: 625019 - DNA, 22 bp, Homo sapiens
tatgccatgtatgttgcatgaa

SEQ ID NO: 625020 - DNA, 12 bp, Homo sapiens
tatgcctgtact

SEQ ID NO: 625021 - DNA, 16 bp, Homo sapiens
tatgctgtgtgcagag

SEQ ID NO: 625022 - DNA, 22 bp, Homo sapiens
tatgctgtgtgcagagtataca

SEQ ID NO: 625023 - DNA, 15 bp, Homo sapiens
tatgctttccctgag

SEQ ID NO: 625024 - DNA, 16 bp, Homo sapiens
tatgctttccctgagg

SEQ ID NO: 625025 - DNA, 13 bp, Homo sapiens
tatggaacactct

SEQ ID NO: 625026 - DNA, 18 bp, Homo sapiens
tatggaacactctgagac

SEQ ID NO: 625027 - DNA, 19 bp, Homo sapiens
tatggaacactctgagact

SEQ ID NO: 625028 - DNA, 19 bp, Homo sapiens
tatggacaatttaccacag

SEQ ID NO: 625029 - DNA, 18 bp, Homo sapiens
tatggcttgtagggtgag

SEQ ID NO: 625030 - DNA, 14 bp, Homo sapiens
tatggctttgtgct

SEQ ID NO: 625031 - DNA, 17 bp, Homo sapiens
tatggtacctctgtcta

SEQ ID NO: 625032 - DNA, 20 bp, Homo sapiens
tatggtgctgggtccttaaa

SEQ ID NO: 625033 - DNA, 17 bp, Homo sapiens
tatgtaacttcagatgt

SEQ ID NO: 625034 - DNA, 19 bp, Homo sapiens
tatgtaacttcagatgttt

SEQ ID NO: 625035 - DNA, 21 bp, Homo sapiens
tatgtacaggctgagacacag

SEQ ID NO: 625036 - DNA, 15 bp, Homo sapiens
tatgtattctcttct

SEQ ID NO: 625037 - DNA, 13 bp, Homo sapiens
tatgtcaaatgga

SEQ ID NO: 625038 - DNA, 11 bp, Homo sapiens
tatgtctgtga

SEQ ID NO: 625039 - DNA, 16 bp, Homo sapiens
tatgtcttcaaaatat

SEQ ID NO: 625040 - DNA, 12 bp, Homo sapiens
tatgtctttaaa

SEQ ID NO: 625041 - DNA, 16 bp, Homo sapiens
tatgtgcatagataca

SEQ ID NO: 625042 - DNA, 12 bp, Homo sapiens
tatgtgtatatg

SEQ ID NO: 625043 - DNA, 13 bp, Homo sapiens
tatgtgtatatgt

SEQ ID NO: 625044 - DNA, 16 bp, Homo sapiens
tatgtttaaaatggca

SEQ ID NO: 625045 - DNA, 15 bp, Homo sapiens
tatgtttatacacac

SEQ ID NO: 625046 - DNA, 17 bp, Homo sapiens
tattaaagtctgagaaa

SEQ ID NO: 625047 - DNA, 19 bp, Homo sapiens
tattaaagtctgagaaatt

SEQ ID NO: 625048 - DNA, 15 bp, Homo sapiens
tattatagtctgtac

SEQ ID NO: 625049 - DNA, 20 bp, Homo sapiens
tattatatatgtatatctgt

SEQ ID NO: 625050 - DNA, 19 bp, Homo sapiens
tattattttctgtaattct

SEQ ID NO: 625051 - DNA, 23 bp, Homo sapiens
tattcataccttctgatgaagtt

SEQ ID NO: 625052 - DNA, 19 bp, Homo sapiens
tattcatgctttctccttt

SEQ ID NO: 625053 - DNA, 20 bp, Homo sapiens
tattcatgctttctcctttt

SEQ ID NO: 625054 - DNA, 21 bp, Homo sapiens
tattcattacatcctctgctt

SEQ ID NO: 625055 - DNA, 17 bp, Homo sapiens
tattcccaaatctcaaa

SEQ ID NO: 625056 - DNA, 16 bp, Homo sapiens
tattcgtaagttctgt

SEQ ID NO: 625057 - DNA, 20 bp, Homo sapiens
tattcgtaagttctgtgcag

SEQ ID NO: 625058 - DNA, 19 bp, Homo sapiens
tattctgcagaaaattaat

SEQ ID NO: 625059 - DNA, 17 bp, Homo sapiens
tattcttccaagttcat

SEQ ID NO: 625060 - DNA, 19 bp, Homo sapiens
tattgaagtaagttcatca

SEQ ID NO: 625061 - DNA, 15 bp, Homo sapiens
tattgagacactgtc

SEQ ID NO: 625062 - DNA, 16 bp, Homo sapiens
tattgagacactgtca

SEQ ID NO: 625063 - DNA, 18 bp, Homo sapiens
tattgagacactgtcaag

SEQ ID NO: 625064 - DNA, 18 bp, Homo sapiens
tattgccttgatgtttct

SEQ ID NO: 625065 - DNA, 14 bp, Homo sapiens
tcactgttcatgaa

SEQ ID NO: 625066 - DNA, 20 bp, Homo sapiens
tcacttcttaaggacagtgt

SEQ ID NO: 625067 - DNA, 21 bp, Homo sapiens
tcacttcttaaggacagtgtt

SEQ ID NO: 625068 - DNA, 16 bp, Homo sapiens
tcacttttattgtata

SEQ ID NO: 625069 - DNA, 18 bp, Homo sapiens
tcacttttttcctgtcaa

SEQ ID NO: 625070 - DNA, 19 bp, Homo sapiens
tcacttttttcctgtcaat

SEQ ID NO: 625071 - DNA, 22 bp, Homo sapiens
tcagaaacaaagcatttgactt

SEQ ID NO: 625072 - DNA, 24 bp, Homo sapiens
tcagaaacaaagcatttgactttc

SEQ ID NO: 625073 - DNA, 20 bp, Homo sapiens
tcagaaagacattcttagtt

SEQ ID NO: 625074 - DNA, 20 bp, Homo sapiens
tcagaactcctttctaagga

SEQ ID NO: 625075 - DNA, 17 bp, Homo sapiens
tcagaagtgaaaaagac

SEQ ID NO: 625076 - DNA, 18 bp, Homo sapiens
tcagaagtgaaaaagact

SEQ ID NO: 625077 - DNA, 20 bp, Homo sapiens
tcagacacctagactctaaa

SEQ ID NO: 625078 - DNA, 15 bp, Homo sapiens
tcagactctctcctc

SEQ ID NO: 625079 - DNA, 17 bp, Homo sapiens
tcagagcacaggcatat

SEQ ID NO: 625080 - DNA, 22 bp, Homo sapiens
tcagagcacaggcatattattt

SEQ ID NO: 625081 - DNA, 14 bp, Homo sapiens
tcagaggagaggag

SEQ ID NO: 625082 - DNA, 13 bp, Homo sapiens
tcagatccttcca

SEQ ID NO: 625083 - DNA, 14 bp, Homo sapiens
tcagatctgaagta

SEQ ID NO: 625084 - DNA, 15 bp, Homo sapiens
tcagatctgaagtag

SEQ ID NO: 625085 - DNA, 22 bp, Homo sapiens
tcagatctgaagtagtgtgagt

SEQ ID NO: 625086 - DNA, 14 bp, Homo sapiens
tcagatggggcctg

SEQ ID NO: 625087 - DNA, 12 bp, Homo sapiens
tcagattgtaaa

SEQ ID NO: 625088 - DNA, 23 bp, Homo sapiens
tcagcaccgtggtgtgaggcccc

SEQ ID NO: 625089 - DNA, 12 bp, Homo sapiens
tcagcagccccc

SEQ ID NO: 625090 - DNA, 17 bp, Homo sapiens
tcagcagcggcagcagc

SEQ ID NO: 625091 - DNA, 13 bp, Homo sapiens
tcagcatatatat

SEQ ID NO: 625092 - DNA, 18 bp, Homo sapiens
tcagccagtggcacagga

SEQ ID NO: 625093 - DNA, 17 bp, Homo sapiens
tcagcccatcccctgcc

SEQ ID NO: 625094 - DNA, 15 bp, Homo sapiens
tcagcgtctccccat

SEQ ID NO: 625095 - DNA, 17 bp, Homo sapiens
tcagcgtctccccatgc

SEQ ID NO: 625096 - DNA, 21 bp, Homo sapiens
tcagcgtctccccatgctggg

SEQ ID NO: 625097 - DNA, 22 bp, Homo sapiens
tcagcgtctccccatgctgggc

SEQ ID NO: 625098 - DNA, 17 bp, Homo sapiens
tcagctgtctgtggctt

SEQ ID NO: 625099 - DNA, 16 bp, Homo sapiens
tcagcttcccaacaat

SEQ ID NO: 625100 - DNA, 17 bp, Homo sapiens
tcagcttcccaacaata

SEQ ID NO: 625101 - DNA, 22 bp, Homo sapiens
tcaggaaaggaagatgtaagaa

SEQ ID NO: 625102 - DNA, 18 bp, Homo sapiens
tcaggaaatatctgtgaa

SEQ ID NO: 625103 - DNA, 14 bp, Homo sapiens
tcaggaaatttttg

SEQ ID NO: 625104 - DNA, 19 bp, Homo sapiens
tcaggaaatttttgcatgt

SEQ ID NO: 625105 - DNA, 21 bp, Homo sapiens
tcaggaatgggccaagccagg

SEQ ID NO: 625106 - DNA, 12 bp, Homo sapiens
taagaaacagtt

SEQ ID NO: 625107 - DNA, 18 bp, Homo sapiens
taagaaacagtttaacag

SEQ ID NO: 625108 - DNA, 17 bp, Homo sapiens
taagaaatggctttcca

SEQ ID NO: 625109 - DNA, 21 bp, Homo sapiens
taagaattcagtagcatttta

SEQ ID NO: 625110 - DNA, 15 bp, Homo sapiens
taagacaagtctgag

SEQ ID NO: 625111 - DNA, 17 bp, Homo sapiens
taagacacgtgcaacag

SEQ ID NO: 625112 - DNA, 18 bp, Homo sapiens
taagagacaaagtttgga

SEQ ID NO: 625113 - DNA, 19 bp, Homo sapiens
taagagacaaagtttggaa

SEQ ID NO: 625114 - DNA, 17 bp, Homo sapiens
taagattatatacaaag

SEQ ID NO: 625115 - DNA, 21 bp, Homo sapiens
taagattatatacaaagctgt

SEQ ID NO: 625116 - DNA, 19 bp, Homo sapiens
taagcacaaccatgttctt

SEQ ID NO: 625117 - DNA, 22 bp, Homo sapiens
taagcacacacatctggccctg

SEQ ID NO: 625118 - DNA, 23 bp, Homo sapiens
taagcacacacatctggccctga

SEQ ID NO: 625119 - DNA, 15 bp, Homo sapiens
taagccaatttttct

SEQ ID NO: 625120 - DNA, 13 bp, Homo sapiens
taagcctgatgat

SEQ ID NO: 625121 - DNA, 14 bp, Homo sapiens
taagctttctcctt

SEQ ID NO: 625122 - DNA, 15 bp, Homo sapiens
taagctttctccttt

SEQ ID NO: 625123 - DNA, 16 bp, Homo sapiens
taagctttctcctttg

SEQ ID NO: 625124 - DNA, 15 bp, Homo sapiens
taaggacagagattt

SEQ ID NO: 625125 - DNA, 15 bp, Homo sapiens
taaggactacagaat

SEQ ID NO: 625126 - DNA, 18 bp, Homo sapiens
taaggggaattaacaatt

SEQ ID NO: 625127 - DNA, 21 bp, Homo sapiens
taaggttatttatttaaatgt

SEQ ID NO: 625128 - DNA, 21 bp, Homo sapiens
taagtaaatgtcttcatgttg

SEQ ID NO: 625129 - DNA, 12 bp, Homo sapiens
taagtaatttca

SEQ ID NO: 625130 - DNA, 14 bp, Homo sapiens
taagtaatttcatg

SEQ ID NO: 625131 - DNA, 18 bp, Homo sapiens
taagtagtgtcattcata

SEQ ID NO: 625132 - DNA, 23 bp, Homo sapiens
taagtgcttgaggccaaatgagt

SEQ ID NO: 625133 - DNA, 15 bp, Homo sapiens
taagtgttctgtggc

SEQ ID NO: 625134 - DNA, 17 bp, Homo sapiens
taagttcccatttcctt

SEQ ID NO: 625135 - DNA, 23 bp, Homo sapiens
taagttcccatttccttgtctaa

SEQ ID NO: 625136 - DNA, 19 bp, Homo sapiens
taagttctgtgcagtttgg

SEQ ID NO: 625137 - DNA, 23 bp, Homo sapiens
taagttctgtgcagtttggtatg

SEQ ID NO: 625138 - DNA, 22 bp, Homo sapiens
taagttgtattttaataaagat

SEQ ID NO: 625139 - DNA, 18 bp, Homo sapiens
taataacagaaatacatc

SEQ ID NO: 625140 - DNA, 15 bp, Homo sapiens
taataatatgtacaa

SEQ ID NO: 625141 - DNA, 16 bp, Homo sapiens
taataatatgtacaaa

SEQ ID NO: 625142 - DNA, 20 bp, Homo sapiens
taatacaccaaatagctttt

SEQ ID NO: 625143 - DNA, 22 bp, Homo sapiens
taatacatcattttttgtttct

SEQ ID NO: 625144 - DNA, 14 bp, Homo sapiens
taatagatgtgaaa

SEQ ID NO: 625145 - DNA, 15 bp, Homo sapiens
taatagcctcacctt

SEQ ID NO: 625146 - DNA, 21 bp, Homo sapiens
taatataaatgaatgaaatat

SEQ ID NO: 625147 - DNA, 12 bp, Homo sapiens
taatatactcct

SEQ ID NO: 625148 - DNA, 20 bp, Homo sapiens
taatatactccttaaaaatg

SEQ ID NO: 625149 - DNA, 16 bp, Homo sapiens
taatatagggtttgtt

SEQ ID NO: 625150 - DNA, 16 bp, Homo sapiens
taatatcagttacagt

SEQ ID NO: 625151 - DNA, 17 bp, Homo sapiens
taatatcagttacagtg

SEQ ID NO: 625152 - DNA, 13 bp, Homo sapiens
taatatgtacaaa

SEQ ID NO: 625153 - DNA, 19 bp, Homo sapiens
taatattgccttgatgttt

SEQ ID NO: 625154 - DNA, 21 bp, Homo sapiens
taatattgccttgatgtttct

SEQ ID NO: 625155 - DNA, 19 bp, Homo sapiens
taatcatttccagcaaaat

SEQ ID NO: 625156 - DNA, 22 bp, Homo sapiens
taatcatttccagcaaaatata

SEQ ID NO: 625157 - DNA, 22 bp, Homo sapiens
taatgaaaaatctgaatttcta

SEQ ID NO: 625158 - DNA, 20 bp, Homo sapiens
taatgagccaataaagctca

SEQ ID NO: 625159 - DNA, 14 bp, Homo sapiens
taatgatactgaat

SEQ ID NO: 625160 - DNA, 14 bp, Homo sapiens
taatgattcaatgt

SEQ ID NO: 625161 - DNA, 20 bp, Homo sapiens
taatggccaagtgtacattt

SEQ ID NO: 625162 - DNA, 16 bp, Homo sapiens
taatgtagggcagaat

SEQ ID NO: 625163 - DNA, 21 bp, Homo sapiens
taatgtagggcagaatagctg

SEQ ID NO: 625164 - DNA, 12 bp, Homo sapiens
taatgtatttta

SEQ ID NO: 625165 - DNA, 12 bp, Homo sapiens
taatgtggtagt

SEQ ID NO: 625166 - DNA, 18 bp, Homo sapiens
taatgttctatataattt

SEQ ID NO: 625167 - DNA, 15 bp, Homo sapiens
taattaaatgaaata

SEQ ID NO: 625168 - DNA, 22 bp, Homo sapiens
taattaaatgaaatacttgaca

SEQ ID NO: 625169 - DNA, 23 bp, Homo sapiens
taattatcctcaagttgtgtgct

SEQ ID NO: 625170 - DNA, 18 bp, Homo sapiens
taattcgagcaaacaact

SEQ ID NO: 625171 - DNA, 22 bp, Homo sapiens
taattcttaccgaaatgaaaat

SEQ ID NO: 625172 - DNA, 20 bp, Homo sapiens
taattcttctcctttgtcaa

SEQ ID NO: 625173 - DNA, 14 bp, Homo sapiens
taattggcagcaga

SEQ ID NO: 625174 - DNA, 15 bp, Homo sapiens
taattggcagcagat

SEQ ID NO: 625175 - DNA, 17 bp, Homo sapiens
taatttatgaagatagt

SEQ ID NO: 625176 - DNA, 14 bp, Homo sapiens
taatttattaaatt

SEQ ID NO: 625177 - DNA, 12 bp, Homo sapiens
taatttgtgaaa

SEQ ID NO: 625178 - DNA, 11 bp, Homo sapiens
taatttttcct

SEQ ID NO: 625179 - DNA, 17 bp, Homo sapiens
taatttttttattgttt

SEQ ID NO: 625180 - DNA, 20 bp, Homo sapiens
taatttttttattgtttaaa

SEQ ID NO: 625181 - DNA, 16 bp, Homo sapiens
tacaaaatgaattgcc

SEQ ID NO: 625182 - DNA, 23 bp, Homo sapiens
tacaaaatgaattgcctttgata

SEQ ID NO: 625183 - DNA, 14 bp, Homo sapiens
tacaaaatgtgtgc

SEQ ID NO: 625184 - DNA, 21 bp, Homo sapiens
tacaaacaagatacgtatatt

SEQ ID NO: 625185 - DNA, 18 bp, Homo sapiens
tacaaacttttataaatg

SEQ ID NO: 625186 - DNA, 19 bp, Homo sapiens
tacaaacttttataaatgt

SEQ ID NO: 625187 - DNA, 20 bp, Homo sapiens
tacaaacttttataaatgtt

SEQ ID NO: 625188 - DNA, 21 bp, Homo sapiens
tacaaacttttataaatgttt

SEQ ID NO: 625189 - DNA, 22 bp, Homo sapiens
tacaaacttttataaatgtttt

SEQ ID NO: 625190 - DNA, 14 bp, Homo sapiens
tacaaagaaacaaa

SEQ ID NO: 625191 - DNA, 16 bp, Homo sapiens
tacaaataatattgcc

SEQ ID NO: 625192 - DNA, 17 bp, Homo sapiens
tacaaataatattgcct

SEQ ID NO: 625193 - DNA, 17 bp, Homo sapiens
tacaaatttttactcag

SEQ ID NO: 625194 - DNA, 20 bp, Homo sapiens
tacaaatttttactcaggct

SEQ ID NO: 625195 - DNA, 14 bp, Homo sapiens
tacaacatatactt

SEQ ID NO: 625196 - DNA, 14 bp, Homo sapiens
tacaaccacatttc

SEQ ID NO: 625197 - DNA, 22 bp, Homo sapiens
tacaagtgtttctagtaacagt

SEQ ID NO: 625198 - DNA, 14 bp, Homo sapiens
tacaatacaacaca

SEQ ID NO: 625199 - DNA, 14 bp, Homo sapiens
tacacacacagaca

SEQ ID NO: 625200 - DNA, 15 bp, Homo sapiens
tacacacctgagaat

SEQ ID NO: 625201 - DNA, 14 bp, Homo sapiens
tacacatacatata

SEQ ID NO: 625202 - DNA, 21 bp, Homo sapiens
tacacatataaacacagtaag

SEQ ID NO: 625203 - DNA, 22 bp, Homo sapiens
tacaccactttcccacactgtg

SEQ ID NO: 625204 - DNA, 13 bp, Homo sapiens
tacacgaagaaat

SEQ ID NO: 625205 - DNA, 14 bp, Homo sapiens
tacactgaaatcca

SEQ ID NO: 625206 - DNA, 22 bp, Homo sapiens
tacagagaactaacactatttt

SEQ ID NO: 625207 - DNA, 15 bp, Homo sapiens
tacagatggtgtcct

SEQ ID NO: 625208 - DNA, 23 bp, Homo sapiens
tacagatggtgtcctgcatgtat

SEQ ID NO: 625209 - DNA, 13 bp, Homo sapiens
tacagcatttctt

SEQ ID NO: 625210 - DNA, 20 bp, Homo sapiens
tacagcccagtggaggaggg

SEQ ID NO: 625211 - DNA, 22 bp, Homo sapiens
tacagtctctatttgatttgca

SEQ ID NO: 625212 - DNA, 13 bp, Homo sapiens
tacagtgactgtg

SEQ ID NO: 625213 - DNA, 17 bp, Homo sapiens
tacagtggcagtattga

SEQ ID NO: 625214 - DNA, 15 bp, Homo sapiens
tacagtgttctgttt

SEQ ID NO: 625215 - DNA, 15 bp, Homo sapiens
tacataacaggcatt

SEQ ID NO: 625216 - DNA, 23 bp, Homo sapiens
tacatagctttagagaagccata

SEQ ID NO: 625217 - DNA, 16 bp, Homo sapiens
tacatagtggtcattt

SEQ ID NO: 625218 - DNA, 18 bp, Homo sapiens
tacatatagctttgcaac

SEQ ID NO: 625219 - DNA, 21 bp, Homo sapiens
tacatcattttttgtttcttc

SEQ ID NO: 625220 - DNA, 12 bp, Homo sapiens
tacatctgaaat

SEQ ID NO: 625221 - DNA, 14 bp, Homo sapiens
tacatctgaaatct

SEQ ID NO: 625222 - DNA, 16 bp, Homo sapiens
tacatctgatatcagg

SEQ ID NO: 625223 - DNA, 18 bp, Homo sapiens
tacatctgatatcaggaa

SEQ ID NO: 625224 - DNA, 20 bp, Homo sapiens
taaaactgtgacattccaca

SEQ ID NO: 625225 - DNA, 14 bp, Homo sapiens
taaaaggaggacag

SEQ ID NO: 625226 - DNA, 20 bp, Homo sapiens
taaaaggaggacagggaggg

SEQ ID NO: 625227 - DNA, 15 bp, Homo sapiens
taaaagggtggtagt

SEQ ID NO: 625228 - DNA, 18 bp, Homo sapiens
taaaatacacgtgtatat

SEQ ID NO: 625229 - DNA, 20 bp, Homo sapiens
taaaatacatggtatctctt

SEQ ID NO: 625230 - DNA, 22 bp, Homo sapiens
taaaatcaccctgactgtgggg

SEQ ID NO: 625231 - DNA, 23 bp, Homo sapiens
taaaatgattcacttttattgta

SEQ ID NO: 625232 - DNA, 12 bp, Homo sapiens
taaaatgcaaat

SEQ ID NO: 625233 - DNA, 19 bp, Homo sapiens
taaaattgattgtcaaata

SEQ ID NO: 625234 - DNA, 18 bp, Homo sapiens
taaaattggttaatgaaa

SEQ ID NO: 625235 - DNA, 19 bp, Homo sapiens
taaaattggttaatgaaaa

SEQ ID NO: 625236 - DNA, 20 bp, Homo sapiens
taaaattggttaatgaaaaa

SEQ ID NO: 625237 - DNA, 14 bp, Homo sapiens
taaacaaaaacttt

SEQ ID NO: 625238 - DNA, 18 bp, Homo sapiens
taaacaaaaactttccat

SEQ ID NO: 625239 - DNA, 23 bp, Homo sapiens
taaacaaaaactttccatgacag

SEQ ID NO: 625240 - DNA, 19 bp, Homo sapiens
taaacaaaatttatgtcat

SEQ ID NO: 625241 - DNA, 20 bp, Homo sapiens
taaacaaaatttatgtcatt

SEQ ID NO: 625242 - DNA, 22 bp, Homo sapiens
taaacaaaatttatgtcatttt

SEQ ID NO: 625243 - DNA, 22 bp, Homo sapiens
taaacaaagagtagaactttaa

SEQ ID NO: 625244 - DNA, 18 bp, Homo sapiens
taaacacagattatttgt

SEQ ID NO: 625245 - DNA, 15 bp, Homo sapiens
taaacacttctcctt

SEQ ID NO: 625246 - DNA, 15 bp, Homo sapiens
taaacatttccctgc

SEQ ID NO: 625247 - DNA, 14 bp, Homo sapiens
taaacccacataaa

SEQ ID NO: 625248 - DNA, 12 bp, Homo sapiens
taaactagcaaa

SEQ ID NO: 625249 - DNA, 10 bp, Homo sapiens
taaactgtga

SEQ ID NO: 625250 - DNA, 11 bp, Homo sapiens
taaactgtgag

SEQ ID NO: 625251 - DNA, 13 bp, Homo sapiens
taaactgtgagat

SEQ ID NO: 625252 - DNA, 13 bp, Homo sapiens
taaacttgtactt

SEQ ID NO: 625253 - DNA, 17 bp, Homo sapiens
taaagaaaggcagagat

SEQ ID NO: 625254 - DNA, 13 bp, Homo sapiens
taaagaagatgtt

SEQ ID NO: 625255 - DNA, 15 bp, Homo sapiens
taaagaagtccatgt

SEQ ID NO: 625256 - DNA, 15 bp, Homo sapiens
taaagatattgtatc

SEQ ID NO: 625257 - DNA, 21 bp, Homo sapiens
taaagcaactgtctatttctg

SEQ ID NO: 625258 - DNA, 23 bp, Homo sapiens
taaagcaactgtctatttctgct

SEQ ID NO: 625259 - DNA, 19 bp, Homo sapiens
taaagcaagctcacttgct

SEQ ID NO: 625260 - DNA, 21 bp, Homo sapiens
taaagcaagctcacttgcttt

SEQ ID NO: 625261 - DNA, 13 bp, Homo sapiens
taaagctcacact

SEQ ID NO: 625262 - DNA, 18 bp, Homo sapiens
taaaggaaagttctatta

SEQ ID NO: 625263 - DNA, 21 bp, Homo sapiens
taaaggcggagggtctccctg

SEQ ID NO: 625264 - DNA, 14 bp, Homo sapiens
taaagggaagccct

SEQ ID NO: 625265 - DNA, 21 bp, Homo sapiens
taaaggggacagatcttgagc

SEQ ID NO: 625266 - DNA, 20 bp, Homo sapiens
taaagtaataactgttagaa

SEQ ID NO: 625267 - DNA, 18 bp, Homo sapiens
taaagtgtccattgacat

SEQ ID NO: 625268 - DNA, 20 bp, Homo sapiens
taaagtgtccattgacatgt

SEQ ID NO: 625269 - DNA, 21 bp, Homo sapiens
taaagtgtccattgacatgta

SEQ ID NO: 625270 - DNA, 20 bp, Homo sapiens
taaagttccatgaagacaaa

SEQ ID NO: 625271 - DNA, 13 bp, Homo sapiens
taaataaaaatta

SEQ ID NO: 625272 - DNA, 19 bp, Homo sapiens
taaataatcatacacagaa

SEQ ID NO: 625273 - DNA, 15 bp, Homo sapiens
taaataatgattcaa

SEQ ID NO: 625274 - DNA, 21 bp, Homo sapiens
taaatagatttttagattcct

SEQ ID NO: 625275 - DNA, 12 bp, Homo sapiens
taaatagcatgt

SEQ ID NO: 625276 - DNA, 18 bp, Homo sapiens
taaatagcatgtattgtg

SEQ ID NO: 625277 - DNA, 19 bp, Homo sapiens
taaatagcatgtattgtgt

SEQ ID NO: 625278 - DNA, 21 bp, Homo sapiens
taaatagcatgtattgtgtct

SEQ ID NO: 625279 - DNA, 17 bp, Homo sapiens
taaatagtaaataatga

SEQ ID NO: 625280 - DNA, 14 bp, Homo sapiens
taaatatatattta

SEQ ID NO: 625281 - DNA, 18 bp, Homo sapiens
taaatatatatttatcat

SEQ ID NO: 625282 - DNA, 20 bp, Homo sapiens
taaatatatatttatcatat

SEQ ID NO: 625283 - DNA, 14 bp, Homo sapiens
taaatattgctgtc

SEQ ID NO: 625284 - DNA, 18 bp, Homo sapiens
taaatattttaggaaact

SEQ ID NO: 625285 - DNA, 13 bp, Homo sapiens
taaatcacagatt

SEQ ID NO: 625286 - DNA, 15 bp, Homo sapiens
taaatcactttaatt

SEQ ID NO: 625287 - DNA, 14 bp, Homo sapiens
taaatctaaatata

SEQ ID NO: 625288 - DNA, 17 bp, Homo sapiens
taaatctaaattaactt

SEQ ID NO: 625289 - DNA, 24 bp, Homo sapiens
taaatctttgttaaaatatagtgt

SEQ ID NO: 625290 - DNA, 22 bp, Homo sapiens
taaatgaaatacttgacaacat

SEQ ID NO: 625291 - DNA, 22 bp, Homo sapiens
taaatgaatgaaatataaactg

SEQ ID NO: 625292 - DNA, 14 bp, Homo sapiens
taaatgcctaataa

SEQ ID NO: 625293 - DNA, 15 bp, Homo sapiens
taaatgcttgatgga

SEQ ID NO: 625294 - DNA, 15 bp, Homo sapiens
taaatgtctaatgta

SEQ ID NO: 625295 - DNA, 16 bp, Homo sapiens
taaatgtctaatgtat

SEQ ID NO: 625296 - DNA, 15 bp, Homo sapiens
taaatgtcttcatgt

SEQ ID NO: 625297 - DNA, 14 bp, Homo sapiens
taaattaacaaatt

SEQ ID NO: 625298 - DNA, 17 bp, Homo sapiens
taaattaacaaattcag

SEQ ID NO: 625299 - DNA, 21 bp, Homo sapiens
taaattatagagcctcaattt

SEQ ID NO: 625300 - DNA, 12 bp, Homo sapiens
taaattatcatt

SEQ ID NO: 625301 - DNA, 15 bp, Homo sapiens
taaattatcattgtt

SEQ ID NO: 625302 - DNA, 14 bp, Homo sapiens
taaattcctaattc

SEQ ID NO: 625303 - DNA, 17 bp, Homo sapiens
taaattcctaattctat

SEQ ID NO: 625304 - DNA, 16 bp, Homo sapiens
taaattcctcctgtct

SEQ ID NO: 625305 - DNA, 12 bp, Homo sapiens
taaattgtggat

SEQ ID NO: 625306 - DNA, 18 bp, Homo sapiens
taaatttattaaatgttg

SEQ ID NO: 625307 - DNA, 18 bp, Homo sapiens
taaatttggccatgaaag

SEQ ID NO: 625308 - DNA, 13 bp, Homo sapiens
taaattttggaag

SEQ ID NO: 625309 - DNA, 20 bp, Homo sapiens
taaattttggaagaattcat

SEQ ID NO: 625310 - DNA, 17 bp, Homo sapiens
taaatttttgtaagaaa

SEQ ID NO: 625311 - DNA, 17 bp, Homo sapiens
taacaacaatttaggaa

SEQ ID NO: 625312 - DNA, 12 bp, Homo sapiens
taacaatgtttt

SEQ ID NO: 625313 - DNA, 21 bp, Homo sapiens
taacaatgttttttatacttc

SEQ ID NO: 625314 - DNA, 17 bp, Homo sapiens
taacagaaatacatcat

SEQ ID NO: 625315 - DNA, 19 bp, Homo sapiens
taacagaaatacatcatat

SEQ ID NO: 625316 - DNA, 11 bp, Homo sapiens
taacagacatt

SEQ ID NO: 625317 - DNA, 14 bp, Homo sapiens
taacagacattgtt

SEQ ID NO: 625318 - DNA, 17 bp, Homo sapiens
taacaggcattgcacta

SEQ ID NO: 625319 - DNA, 15 bp, Homo sapiens
taacagtaaatatac

SEQ ID NO: 625320 - DNA, 18 bp, Homo sapiens
taacagtaaatatacact

SEQ ID NO: 625321 - DNA, 13 bp, Homo sapiens
taacagtaactgc

SEQ ID NO: 625322 - DNA, 18 bp, Homo sapiens
taacataaacttgtactt

SEQ ID NO: 625323 - DNA, 19 bp, Homo sapiens
taacataaacttgtactta

SEQ ID NO: 625324 - DNA, 16 bp, Homo sapiens
taacattcttggtcac

SEQ ID NO: 625325 - DNA, 17 bp, Homo sapiens
taacattgtaaatgata

SEQ ID NO: 625326 - DNA, 14 bp, Homo sapiens
taacattgtatgtt

SEQ ID NO: 625327 - DNA, 17 bp, Homo sapiens
taaccatgttgtgttct

SEQ ID NO: 625328 - DNA, 19 bp, Homo sapiens
taaccatgttgtgttcttc

SEQ ID NO: 625329 - DNA, 14 bp, Homo sapiens
taacccttaatata

SEQ ID NO: 625330 - DNA, 21 bp, Homo sapiens
taaccgggactacagaagtgg

SEQ ID NO: 625331 - DNA, 22 bp, Homo sapiens
taacctacaaaacgtatttatc

SEQ ID NO: 625332 - DNA, 16 bp, Homo sapiens
taacctgaagttttat

SEQ ID NO: 625333 - DNA, 20 bp, Homo sapiens
taacgaccgacgcccctccg

SEQ ID NO: 625334 - DNA, 17 bp, Homo sapiens
taactaatgtaaatatt

SEQ ID NO: 625335 - DNA, 15 bp, Homo sapiens
taactccttacagaa

SEQ ID NO: 625336 - DNA, 17 bp, Homo sapiens
tcatgttggtaccctgg

SEQ ID NO: 625337 - DNA, 14 bp, Homo sapiens
tcatgtttaagaaa

SEQ ID NO: 625338 - DNA, 14 bp, Homo sapiens
tcatgtttctgcag

SEQ ID NO: 625339 - DNA, 15 bp, Homo sapiens
tcatgtttctgcagt

SEQ ID NO: 625340 - DNA, 23 bp, Homo sapiens
tcatgtttctgcagtattctgta

SEQ ID NO: 625341 - DNA, 20 bp, Homo sapiens
tcattaaaacaagagaccac

SEQ ID NO: 625342 - DNA, 22 bp, Homo sapiens
tcattaaaacaagagaccactt

SEQ ID NO: 625343 - DNA, 13 bp, Homo sapiens
tcattagctgtga

SEQ ID NO: 625344 - DNA, 14 bp, Homo sapiens
tcattatagcatgt

SEQ ID NO: 625345 - DNA, 18 bp, Homo sapiens
tcattatagcatgtaata

SEQ ID NO: 625346 - DNA, 16 bp, Homo sapiens
tcattatttcaaggaa

SEQ ID NO: 625347 - DNA, 16 bp, Homo sapiens
tcattcaaaaagccaa

SEQ ID NO: 625348 - DNA, 16 bp, Homo sapiens
tcattcatactcaaag

SEQ ID NO: 625349 - DNA, 23 bp, Homo sapiens
tcattccaagtgtatatttgtat

SEQ ID NO: 625350 - DNA, 22 bp, Homo sapiens
tcattcgtgggcctgctgctct

SEQ ID NO: 625351 - DNA, 13 bp, Homo sapiens
tcattgaaatctt

SEQ ID NO: 625352 - DNA, 21 bp, Homo sapiens
tcatttaacactgagtgaaat

SEQ ID NO: 625353 - DNA, 14 bp, Homo sapiens
tcatttcatacaaa

SEQ ID NO: 625354 - DNA, 15 bp, Homo sapiens
tcatttcatacaaat

SEQ ID NO: 625355 - DNA, 21 bp, Homo sapiens
tcatttccagcaaaatatatg

SEQ ID NO: 625356 - DNA, 15 bp, Homo sapiens
tcatttggtggctct

SEQ ID NO: 625357 - DNA, 22 bp, Homo sapiens
tcattttatatatgaaaactaa

SEQ ID NO: 625358 - DNA, 21 bp, Homo sapiens
tcattttattctgtcaatgaa

SEQ ID NO: 625359 - DNA, 16 bp, Homo sapiens
tcattttcatctcatt

SEQ ID NO: 625360 - DNA, 22 bp, Homo sapiens
tcattttcattatttcaaggaa

SEQ ID NO: 625361 - DNA, 15 bp, Homo sapiens
tcattttctctcctc

SEQ ID NO: 625362 - DNA, 12 bp, Homo sapiens
tcattttgatgt

SEQ ID NO: 625363 - DNA, 16 bp, Homo sapiens
tccaaaggttgtacat

SEQ ID NO: 625364 - DNA, 21 bp, Homo sapiens
tccaaaggttgtacatagtgg

SEQ ID NO: 625365 - DNA, 16 bp, Homo sapiens
tccaaaggtttcaact

SEQ ID NO: 625366 - DNA, 20 bp, Homo sapiens
tccaagaccttacaaccaca

SEQ ID NO: 625367 - DNA, 12 bp, Homo sapiens
tccaagtgtgtg

SEQ ID NO: 625368 - DNA, 20 bp, Homo sapiens
tccaagtgtgtgtgcaatgt

SEQ ID NO: 625369 - DNA, 16 bp, Homo sapiens
tccaagttcattcata

SEQ ID NO: 625370 - DNA, 17 bp, Homo sapiens
tccaatagtctgccaca

SEQ ID NO: 625371 - DNA, 15 bp, Homo sapiens
tccaatccagccttc

SEQ ID NO: 625372 - DNA, 16 bp, Homo sapiens
tccacagtagcatttc

SEQ ID NO: 625373 - DNA, 17 bp, Homo sapiens
tccacagtattgttctt

SEQ ID NO: 625374 - DNA, 21 bp, Homo sapiens
tccacagtattgttcttgtaa

SEQ ID NO: 625375 - DNA, 23 bp, Homo sapiens
tccacagtattgttcttgtaaaa

SEQ ID NO: 625376 - DNA, 17 bp, Homo sapiens
tccacccccattgtgaa

SEQ ID NO: 625377 - DNA, 21 bp, Homo sapiens
tccacccctcaagccaggaga

SEQ ID NO: 625378 - DNA, 13 bp, Homo sapiens
tccaccctcccct

SEQ ID NO: 625379 - DNA, 23 bp, Homo sapiens
tccacctgttactacttcttttt

SEQ ID NO: 625380 - DNA, 16 bp, Homo sapiens
tccaccttcctgccca

SEQ ID NO: 625381 - DNA, 17 bp, Homo sapiens
tccaccttcctgcccag

SEQ ID NO: 625382 - DNA, 21 bp, Homo sapiens
tccacgtgtttcgggccaggg

SEQ ID NO: 625383 - DNA, 13 bp, Homo sapiens
tccactcctccca

SEQ ID NO: 625384 - DNA, 13 bp, Homo sapiens
tagcatatcctca

SEQ ID NO: 625385 - DNA, 18 bp, Homo sapiens
tagcatatcctcaattat

SEQ ID NO: 625386 - DNA, 22 bp, Homo sapiens
tagcatccatggatgcagaaat

SEQ ID NO: 625387 - DNA, 14 bp, Homo sapiens
tagcatgagttctg

SEQ ID NO: 625388 - DNA, 17 bp, Homo sapiens
tagcatgtaatattaaa

SEQ ID NO: 625389 - DNA, 18 bp, Homo sapiens
tagcatgtaatattaaat

SEQ ID NO: 625390 - DNA, 21 bp, Homo sapiens
tagcatgtaatattaaattcc

SEQ ID NO: 625391 - DNA, 18 bp, Homo sapiens
tagcatgtattgtgtctt

SEQ ID NO: 625392 - DNA, 19 bp, Homo sapiens
tagccagcattcagcacac

SEQ ID NO: 625393 - DNA, 21 bp, Homo sapiens
tagccagcattcagcacacac

SEQ ID NO: 625394 - DNA, 21 bp, Homo sapiens
tagccccaggcccgccctgcc

SEQ ID NO: 625395 - DNA, 23 bp, Homo sapiens
tagccccaggcccgccctgcccg

SEQ ID NO: 625396 - DNA, 19 bp, Homo sapiens
tagccctctttctctctgt

SEQ ID NO: 625397 - DNA, 20 bp, Homo sapiens
tagccctctttctctctgtg

SEQ ID NO: 625398 - DNA, 15 bp, Homo sapiens
tagctataaatagtg

SEQ ID NO: 625399 - DNA, 16 bp, Homo sapiens
tagctcacagcacatt

SEQ ID NO: 625400 - DNA, 14 bp, Homo sapiens
tagctccttcatgc

SEQ ID NO: 625401 - DNA, 22 bp, Homo sapiens
tagctccttcatgcttttctca

SEQ ID NO: 625402 - DNA, 19 bp, Homo sapiens
tagctctgaatgctatttg

SEQ ID NO: 625403 - DNA, 16 bp, Homo sapiens
tcctgggtgggtgggg

SEQ ID NO: 625404 - DNA, 22 bp, Homo sapiens
tcctgggtgggtggggtacagg

SEQ ID NO: 625405 - DNA, 24 bp, Homo sapiens
tcctgtagctttaaaaccacagct

SEQ ID NO: 625406 - DNA, 13 bp, Homo sapiens
tcctgtccagcag

SEQ ID NO: 625407 - DNA, 19 bp, Homo sapiens
tcctgtcctggctcccagg

SEQ ID NO: 625408 - DNA, 17 bp, Homo sapiens
tcctgtctcctctgtca

SEQ ID NO: 625409 - DNA, 14 bp, Homo sapiens
tcctgtgtcatctg

SEQ ID NO: 625410 - DNA, 16 bp, Homo sapiens
tcctgtgtcatctgtc

SEQ ID NO: 625411 - DNA, 18 bp, Homo sapiens
tcctgtgtcatctgtcag

SEQ ID NO: 625412 - DNA, 18 bp, Homo sapiens
tccttaaaaatgtatgtt

SEQ ID NO: 625413 - DNA, 14 bp, Homo sapiens
tccttagtaaattc

SEQ ID NO: 625414 - DNA, 15 bp, Homo sapiens
tccttcactccctgt

SEQ ID NO: 625415 - DNA, 11 bp, Homo sapiens
tccttcagtgc

SEQ ID NO: 625416 - DNA, 15 bp, Homo sapiens
tccttcagtgcctta

SEQ ID NO: 625417 - DNA, 16 bp, Homo sapiens
tccttcagtgccttat

SEQ ID NO: 625418 - DNA, 18 bp, Homo sapiens
tccttcatgcttttctca

SEQ ID NO: 625419 - DNA, 23 bp, Homo sapiens
tccttcccgcagcaccagcctga

SEQ ID NO: 625420 - DNA, 14 bp, Homo sapiens
tccttctcccctcc

SEQ ID NO: 625421 - DNA, 15 bp, Homo sapiens
tccttgactattaca

SEQ ID NO: 625422 - DNA, 21 bp, Homo sapiens
tccttggtgtcgggcatgaca

SEQ ID NO: 625423 - DNA, 15 bp, Homo sapiens
tccttgtacttgaat

SEQ ID NO: 625424 - DNA, 23 bp, Homo sapiens
tccttgtacttgaataataacca

SEQ ID NO: 625425 - DNA, 19 bp, Homo sapiens
tcctttatgtgatgtaact

SEQ ID NO: 625426 - DNA, 15 bp, Homo sapiens
tcctttcctctcctc

SEQ ID NO: 625427 - DNA, 18 bp, Homo sapiens
tcctttgacctctcactt

SEQ ID NO: 625428 - DNA, 14 bp, Homo sapiens
tcctttgagggcag

SEQ ID NO: 625429 - DNA, 15 bp, Homo sapiens
tcctttgtcaaatgg

SEQ ID NO: 625430 - DNA, 16 bp, Homo sapiens
tccttttttatacaca

SEQ ID NO: 625431 - DNA, 14 bp, Homo sapiens
tccttttttccttt

SEQ ID NO: 625432 - DNA, 18 bp, Homo sapiens
tcgagagggctgagcccc

SEQ ID NO: 625433 - DNA, 15 bp, Homo sapiens
tcgatcgtttcacat

SEQ ID NO: 625434 - DNA, 19 bp, Homo sapiens
tcgcagcctgaagcctgga

SEQ ID NO: 625435 - DNA, 11 bp, Homo sapiens
tcgcccaccta

SEQ ID NO: 625436 - DNA, 15 bp, Homo sapiens
tcgcccccgggccct

SEQ ID NO: 625437 - DNA, 18 bp, Homo sapiens
tcgcccccgggccctttc

SEQ ID NO: 625438 - DNA, 12 bp, Homo sapiens
tcgcccctcctc

SEQ ID NO: 625439 - DNA, 12 bp, Homo sapiens
tcgccctgtgcc

SEQ ID NO: 625440 - DNA, 13 bp, Homo sapiens
tcgcgacaatgca

SEQ ID NO: 625441 - DNA, 14 bp, Homo sapiens
tcgcgacaatgcaa

SEQ ID NO: 625442 - DNA, 16 bp, Homo sapiens
tcgcgacaatgcaaac

SEQ ID NO: 625443 - DNA, 15 bp, Homo sapiens
tcggaggtcaagaaa

SEQ ID NO: 625444 - DNA, 18 bp, Homo sapiens
tcggataattttcatttt

SEQ ID NO: 625445 - DNA, 14 bp, Homo sapiens
tcggcagtggctgg

SEQ ID NO: 625446 - DNA, 15 bp, Homo sapiens
tcgggaaggcctgag

SEQ ID NO: 625447 - DNA, 16 bp, Homo sapiens
tcgggcactccctaag

SEQ ID NO: 625448 - DNA, 12 bp, Homo sapiens
tcgggcatgaca

SEQ ID NO: 625449 - DNA, 18 bp, Homo sapiens
tcgggccagggcgtggct

SEQ ID NO: 625450 - DNA, 20 bp, Homo sapiens
tcgggccgcctcctccagac

SEQ ID NO: 625451 - DNA, 11 bp, Homo sapiens
tcgggggagga

SEQ ID NO: 625452 - DNA, 23 bp, Homo sapiens
gggcctgcggggttccctgcgcg

SEQ ID NO: 625453 - DNA, 15 bp, Homo sapiens
gggcctgggctgttg

SEQ ID NO: 625454 - DNA, 18 bp, Homo sapiens
gggcgcctgcgctcctct

SEQ ID NO: 625455 - DNA, 19 bp, Homo sapiens
gggcgcctgcgctcctctg

SEQ ID NO: 625456 - DNA, 16 bp, Homo sapiens
gggcgcctgtcgggcc

SEQ ID NO: 625457 - DNA, 23 bp, Homo sapiens
gggcgctccggcagaggcagggc

SEQ ID NO: 625458 - DNA, 18 bp, Homo sapiens
gggcggcatccgagcccc

SEQ ID NO: 625459 - DNA, 16 bp, Homo sapiens
gggctaacgggcgcct

SEQ ID NO: 625460 - DNA, 14 bp, Homo sapiens
gggctaactggccc

SEQ ID NO: 625461 - DNA, 18 bp, Homo sapiens
gggctaactggccccagg

SEQ ID NO: 625462 - DNA, 21 bp, Homo sapiens
gggctaactggccccaggcgg

SEQ ID NO: 625463 - DNA, 20 bp, Homo sapiens
gggctcagatggggcctggg

SEQ ID NO: 625464 - DNA, 14 bp, Homo sapiens
gggctctttccctc

SEQ ID NO: 625465 - DNA, 14 bp, Homo sapiens
gggctgagcccctc

SEQ ID NO: 625466 - DNA, 18 bp, Homo sapiens
gggctgagcccctcctct

SEQ ID NO: 625467 - DNA, 23 bp, Homo sapiens
gggctgccgcatctgcctggagc

SEQ ID NO: 625468 - DNA, 16 bp, Homo sapiens
gggctgcgtccctgct

SEQ ID NO: 625469 - DNA, 21 bp, Homo sapiens
gggctgcgtccctgctcagcc

SEQ ID NO: 625470 - DNA, 15 bp, Homo sapiens
gggctgctggggcag

SEQ ID NO: 625471 - DNA, 15 bp, Homo sapiens
gggctggcacccact

SEQ ID NO: 625472 - DNA, 14 bp, Homo sapiens
gggctggccctgcc

SEQ ID NO: 625473 - DNA, 16 bp, Homo sapiens
gggctggccctgccct

SEQ ID NO: 625474 - DNA, 18 bp, Homo sapiens
gggctgggccctctgtcc

SEQ ID NO: 625475 - DNA, 18 bp, Homo sapiens
gggctggtgggataggag

SEQ ID NO: 625476 - DNA, 18 bp, Homo sapiens
gggctgttagctcagagg

SEQ ID NO: 625477 - DNA, 23 bp, Homo sapiens
gggctgttgtgtctggagcctgc

SEQ ID NO: 625478 - DNA, 18 bp, Homo sapiens
gggcttctccccctcagc

SEQ ID NO: 625479 - DNA, 19 bp, Homo sapiens
gggcttctccccctcagct

SEQ ID NO: 625480 - DNA, 17 bp, Homo sapiens
gggcttggagcagagac

SEQ ID NO: 625481 - DNA, 18 bp, Homo sapiens
gggcttggggtagagagg

SEQ ID NO: 625482 - DNA, 14 bp, Homo sapiens
gggctttggggctg

SEQ ID NO: 625483 - DNA, 20 bp, Homo sapiens
tgtgtatatgtttatacaca

SEQ ID NO: 625484 - DNA, 23 bp, Homo sapiens
tgtgtatatgtttatacacacag

SEQ ID NO: 625485 - DNA, 18 bp, Homo sapiens
tgtgtcatctgtcagctt

SEQ ID NO: 625486 - DNA, 15 bp, Homo sapiens
tgtgtctggagcctg

SEQ ID NO: 625487 - DNA, 16 bp, Homo sapiens
tgtgtcttgtattatc

SEQ ID NO: 625488 - DNA, 14 bp, Homo sapiens
tgtgtcttttgcat

SEQ ID NO: 625489 - DNA, 16 bp, Homo sapiens
tgtgtgcaatgttccg

SEQ ID NO: 625490 - DNA, 23 bp, Homo sapiens
tgtgtgcaatgttccgttcatct

SEQ ID NO: 625491 - DNA, 22 bp, Homo sapiens
tgtgtgcagagtatacaagtgt

SEQ ID NO: 625492 - DNA, 15 bp, Homo sapiens
tgtgtgcttcacaca

SEQ ID NO: 625493 - DNA, 16 bp, Homo sapiens
tgtgtgcttcacacaa

SEQ ID NO: 625494 - DNA, 17 bp, Homo sapiens
tgtgtggcaaacattta

SEQ ID NO: 625495 - DNA, 21 bp, Homo sapiens
tgtgtggcaaacatttaaaaa

SEQ ID NO: 625496 - DNA, 14 bp, Homo sapiens
tgtgtgtgcaatgt

SEQ ID NO: 625497 - DNA, 18 bp, Homo sapiens
tgtgttctcaacacacag

SEQ ID NO: 625498 - DNA, 22 bp, Homo sapiens
tgtgttgccattttgtctggct

SEQ ID NO: 625499 - DNA, 18 bp, Homo sapiens
tgtgttggtatttactgc

SEQ ID NO: 625500 - DNA, 22 bp, Homo sapiens
tgtgttggtatttactgcaatg

SEQ ID NO: 625501 - DNA, 20 bp, Homo sapiens
tgtgtttcgcattaagcaca

SEQ ID NO: 625502 - DNA, 19 bp, Homo sapiens
tgttaaaaatagcagtatt

SEQ ID NO: 625503 - DNA, 15 bp, Homo sapiens
tgttaaaacatcaaa

SEQ ID NO: 625504 - DNA, 10 bp, Homo sapiens
tgttaaaata

SEQ ID NO: 625505 - DNA, 19 bp, Homo sapiens
tgttaaatctacaaacttt

SEQ ID NO: 625506 - DNA, 18 bp, Homo sapiens
tgttaatacatcattttt

SEQ ID NO: 625507 - DNA, 16 bp, Homo sapiens
tgttaatgattcttgt

SEQ ID NO: 625508 - DNA, 24 bp, Homo sapiens
tgttagctcagaggagaggagcaa

SEQ ID NO: 625509 - DNA, 13 bp, Homo sapiens
tgttataaaatct

SEQ ID NO: 625510 - DNA, 20 bp, Homo sapiens
tgttataaaatctgtattgc

SEQ ID NO: 625511 - DNA, 20 bp, Homo sapiens
tgttatcattcttataacat

SEQ ID NO: 625512 - DNA, 13 bp, Homo sapiens
tgttatctgtctt

SEQ ID NO: 625513 - DNA, 16 bp, Homo sapiens
tgttatctgtctttat

SEQ ID NO: 625514 - DNA, 23 bp, Homo sapiens
tgttatctgtctttatgatttca

SEQ ID NO: 625515 - DNA, 19 bp, Homo sapiens
tgttatgtaaacatcataa

SEQ ID NO: 625516 - DNA, 13 bp, Homo sapiens
tgttatgttgtaa

SEQ ID NO: 625517 - DNA, 20 bp, Homo sapiens
tgttattcaataactattgc

SEQ ID NO: 625518 - DNA, 18 bp, Homo sapiens
tgttcaaattctgattat

SEQ ID NO: 625519 - DNA, 17 bp, Homo sapiens
tgttcaccttctgtgca

SEQ ID NO: 625520 - DNA, 19 bp, Homo sapiens
tgttcaccttctgtgcatc

SEQ ID NO: 625521 - DNA, 18 bp, Homo sapiens
tgttcacgcaacttgaaa

SEQ ID NO: 625522 - DNA, 15 bp, Homo sapiens
tgttcacgtgactcc

SEQ ID NO: 625523 - DNA, 18 bp, Homo sapiens
tgttcacgtgactcctca

SEQ ID NO: 625524 - DNA, 19 bp, Homo sapiens
tgttcacgtgactcctcaa

SEQ ID NO: 625525 - DNA, 14 bp, Homo sapiens
tgttcagaaaagca

SEQ ID NO: 625526 - DNA, 12 bp, Homo sapiens
tgttcagcatag

SEQ ID NO: 625527 - DNA, 14 bp, Homo sapiens
tgttcagtgccttg

SEQ ID NO: 625528 - DNA, 14 bp, Homo sapiens
tgttccaagtgtgt

SEQ ID NO: 625529 - DNA, 21 bp, Homo sapiens
tgttccaagtgtgtgtgcaat

SEQ ID NO: 625530 - DNA, 18 bp, Homo sapiens
tgttccagattcaatcga

SEQ ID NO: 625531 - DNA, 19 bp, Homo sapiens
tgttccgttcatctgagga

SEQ ID NO: 625532 - DNA, 20 bp, Homo sapiens
tgttccgttcatctgaggag

SEQ ID NO: 625533 - DNA, 20 bp, Homo sapiens
tgttctaactagtaatcttg

SEQ ID NO: 625534 - DNA, 17 bp, Homo sapiens
tgttctatataattttt

SEQ ID NO: 625535 - DNA, 15 bp, Homo sapiens
tgttctcaacacaca

SEQ ID NO: 625536 - DNA, 16 bp, Homo sapiens
tgttctcctccaaatg

SEQ ID NO: 625537 - DNA, 19 bp, Homo sapiens
tgttctctagttttccaga

SEQ ID NO: 625538 - DNA, 12 bp, Homo sapiens
tgttctctcttg

SEQ ID NO: 625539 - DNA, 19 bp, Homo sapiens
tgttctgtttaatactcat

SEQ ID NO: 625540 - DNA, 20 bp, Homo sapiens
tgttcttgtaaaactgtgac

SEQ ID NO: 625541 - DNA, 21 bp, Homo sapiens
tgttcttgtaaaactgtgaca

SEQ ID NO: 625542 - DNA, 18 bp, Homo sapiens
tgttgaagtgcatgttaa

SEQ ID NO: 625543 - DNA, 19 bp, Homo sapiens
tgttgaagtgcatgttaaa

SEQ ID NO: 625544 - DNA, 21 bp, Homo sapiens
tgttgaagtgcatgttaaaat

SEQ ID NO: 625545 - DNA, 23 bp, Homo sapiens
tgttgagagggggatgcccctgg

SEQ ID NO: 625546 - DNA, 14 bp, Homo sapiens
tgttgattctttca

SEQ ID NO: 625547 - DNA, 22 bp, Homo sapiens
tgttgattctttcaatccacag

SEQ ID NO: 625548 - DNA, 23 bp, Homo sapiens
tgttgcatgaatccatcgatttg

SEQ ID NO: 625549 - DNA, 16 bp, Homo sapiens
tgttgccatgaggcct

SEQ ID NO: 625550 - DNA, 19 bp, Homo sapiens
tgttgcttaatctagagct

SEQ ID NO: 625551 - DNA, 20 bp, Homo sapiens
tgttgcttaatctagagcta

SEQ ID NO: 625552 - DNA, 21 bp, Homo sapiens
tgttgcttaatctagagctat

SEQ ID NO: 625553 - DNA, 20 bp, Homo sapiens
tgttggccatcatttcattc

SEQ ID NO: 625554 - DNA, 14 bp, Homo sapiens
tgttggtatttact

SEQ ID NO: 625555 - DNA, 19 bp, Homo sapiens
tgttggtttagcgttgttt

SEQ ID NO: 625556 - DNA, 15 bp, Homo sapiens
tgttgtaatatcagt

SEQ ID NO: 625557 - DNA, 21 bp, Homo sapiens
tgttgtcctgtgtcatctgtc

SEQ ID NO: 625558 - DNA, 18 bp, Homo sapiens
tgttgtgttacaataagt

SEQ ID NO: 625559 - DNA, 18 bp, Homo sapiens
tgtttaataatatgtaca

SEQ ID NO: 625560 - DNA, 19 bp, Homo sapiens
tgtttaataatatgtacaa

SEQ ID NO: 625561 - DNA, 12 bp, Homo sapiens
tgtttagtagct

SEQ ID NO: 625562 - DNA, 16 bp, Homo sapiens
tgtttagtagctgata

SEQ ID NO: 625563 - DNA, 14 bp, Homo sapiens
tgtttctatatgta

SEQ ID NO: 625564 - DNA, 15 bp, Homo sapiens
tgtttgctgcttttg

SEQ ID NO: 625565 - DNA, 17 bp, Homo sapiens
tgtttggaggctgctgc

SEQ ID NO: 625566 - DNA, 18 bp, Homo sapiens
tgtttggagttaaaatgt

SEQ ID NO: 625567 - DNA, 15 bp, Homo sapiens
tgtttggtcactgct

SEQ ID NO: 625568 - DNA, 21 bp, Homo sapiens
tgtttgtcctttatgtattct

SEQ ID NO: 625569 - DNA, 16 bp, Homo sapiens
tgttttgctttttctg

SEQ ID NO: 625570 - DNA, 20 bp, Homo sapiens
tgttttgctttttctgactc

SEQ ID NO: 625571 - DNA, 16 bp, Homo sapiens
ttaaaaaaaaaaatga

SEQ ID NO: 625572 - DNA, 18 bp, Homo sapiens
ttaaaaaaaatattctgt

SEQ ID NO: 625573 - DNA, 19 bp, Homo sapiens
ttaaaaaaaatattctgtc

SEQ ID NO: 625574 - DNA, 21 bp, Homo sapiens
ttaaaaaaaatattctgtcat

SEQ ID NO: 625575 - DNA, 23 bp, Homo sapiens
ttaaaaaaataaaacattttaaa

SEQ ID NO: 625576 - DNA, 15 bp, Homo sapiens
ttaaaaaaataatat

SEQ ID NO: 625577 - DNA, 19 bp, Homo sapiens
ttaaaaaaataatataaat

SEQ ID NO: 625578 - DNA, 20 bp, Homo sapiens
ttaaaaaaataatataaatg

SEQ ID NO: 625579 - DNA, 15 bp, Homo sapiens
ttaaaaaagatggat

SEQ ID NO: 625580 - DNA, 17 bp, Homo sapiens
ttaaaaagacactttta

SEQ ID NO: 625581 - DNA, 20 bp, Homo sapiens
ttaaaaagttaatcttcatg

SEQ ID NO: 625582 - DNA, 20 bp, Homo sapiens
ttaaaacaagagaccacttc

SEQ ID NO: 625583 - DNA, 23 bp, Homo sapiens
ttaaaacaagagaccacttcctt

SEQ ID NO: 625584 - DNA, 15 bp, Homo sapiens
ttaaaaccacagctg

SEQ ID NO: 625585 - DNA, 14 bp, Homo sapiens
ttaaaacttcatct

SEQ ID NO: 625586 - DNA, 15 bp, Homo sapiens
ttaaaatatagtgtt

SEQ ID NO: 625587 - DNA, 23 bp, Homo sapiens
ttaaaatatagtgttgtgttaca

SEQ ID NO: 625588 - DNA, 14 bp, Homo sapiens
ttaaaatcttgaaa

SEQ ID NO: 625589 - DNA, 15 bp, Homo sapiens
ttaaaatcttgaaag

SEQ ID NO: 625590 - DNA, 18 bp, Homo sapiens
ttaaaatggcatttagca

SEQ ID NO: 625591 - DNA, 20 bp, Homo sapiens
ttaaaatgtgtttttcagtt

SEQ ID NO: 625592 - DNA, 15 bp, Homo sapiens
ttaaaattggttaat

SEQ ID NO: 625593 - DNA, 12 bp, Homo sapiens
ttaaacaaatgg

SEQ ID NO: 625594 - DNA, 18 bp, Homo sapiens
ttaaacctgtgctttcat

SEQ ID NO: 625595 - DNA, 16 bp, Homo sapiens
ttaaactgggaaatga

SEQ ID NO: 625596 - DNA, 17 bp, Homo sapiens
ttaaaggaaagttctat

SEQ ID NO: 625597 - DNA, 16 bp, Homo sapiens
ttaaagtctgagaaat

SEQ ID NO: 625598 - DNA, 19 bp, Homo sapiens
ttaaagtgtccattgacat

SEQ ID NO: 625599 - DNA, 16 bp, Homo sapiens
ttaaatctacaaactt

SEQ ID NO: 625600 - DNA, 19 bp, Homo sapiens
ttaaatctacaaactttta

SEQ ID NO: 625601 - DNA, 17 bp, Homo sapiens
ttaaatctttgttaaaa

SEQ ID NO: 625602 - DNA, 13 bp, Homo sapiens
ttaaatggacaga

SEQ ID NO: 625603 - DNA, 23 bp, Homo sapiens
ttaaattatcattgtttgtcctt

SEQ ID NO: 625604 - DNA, 14 bp, Homo sapiens
ttaaatttattaaa

SEQ ID NO: 625605 - DNA, 16 bp, Homo sapiens
ttaacactgagtgaaa

SEQ ID NO: 625606 - DNA, 23 bp, Homo sapiens
ttaacactgagtgaaatattact

SEQ ID NO: 625607 - DNA, 15 bp, Homo sapiens
ttaacagctgtatta

SEQ ID NO: 625608 - DNA, 16 bp, Homo sapiens
ttaacagtaaatatac

SEQ ID NO: 625609 - DNA, 18 bp, Homo sapiens
ttaacatagcagctggtt

SEQ ID NO: 625610 - DNA, 22 bp, Homo sapiens
ttaacccagtgttcagcataga

SEQ ID NO: 625611 - DNA, 21 bp, Homo sapiens
ttaacccccatttttgtaata

SEQ ID NO: 625612 - DNA, 23 bp, Homo sapiens
ttaacttaagggttttttagaaa

SEQ ID NO: 625613 - DNA, 14 bp, Homo sapiens
ttaagaaatgagaa

SEQ ID NO: 625614 - DNA, 23 bp, Homo sapiens
ttaagaaatgagaaattgtgcca

SEQ ID NO: 625615 - DNA, 15 bp, Homo sapiens
ttaagatctgactgc

SEQ ID NO: 625616 - DNA, 12 bp, Homo sapiens
ttaagattgaag

SEQ ID NO: 625617 - DNA, 22 bp, Homo sapiens
ttaagattgaagctaaaacact

SEQ ID NO: 625618 - DNA, 22 bp, Homo sapiens
ttaagcacaaaaaatttaagag

SEQ ID NO: 625619 - DNA, 22 bp, Homo sapiens
ttaagcacaaccatgttcttga

SEQ ID NO: 625620 - DNA, 15 bp, Homo sapiens
ttaaggaaaagagaa

SEQ ID NO: 625621 - DNA, 17 bp, Homo sapiens
ttaaggacagtgttcaa

SEQ ID NO: 625622 - DNA, 16 bp, Homo sapiens
ttaagggttttttaga

SEQ ID NO: 625623 - DNA, 15 bp, Homo sapiens
ttaaggttatttatt

SEQ ID NO: 625624 - DNA, 17 bp, Homo sapiens
ttaagtctcaattctga

SEQ ID NO: 625625 - DNA, 15 bp, Homo sapiens
ttaagtcttactgtt

SEQ ID NO: 625626 - DNA, 16 bp, Homo sapiens
ttaagtggactgtatt

SEQ ID NO: 625627 - DNA, 22 bp, Homo sapiens
ttaagtgttctgtggctgattt

SEQ ID NO: 625628 - DNA, 15 bp, Homo sapiens
ttaataatatgtaca

SEQ ID NO: 625629 - DNA, 19 bp, Homo sapiens
ttaataatatgtacaaata

SEQ ID NO: 625630 - DNA, 14 bp, Homo sapiens
ttaatagaaaatat

SEQ ID NO: 625631 - DNA, 17 bp, Homo sapiens
ttaatcaattaattttt

SEQ ID NO: 625632 - DNA, 20 bp, Homo sapiens
ttaatctagagctatgcaca

SEQ ID NO: 625633 - DNA, 16 bp, Homo sapiens
ttaatgaaaaatctga

SEQ ID NO: 625634 - DNA, 19 bp, Homo sapiens
ttaatgaaaaatctgaatt

SEQ ID NO: 625635 - DNA, 21 bp, Homo sapiens
ttaatgaaaaatctgaatttc

SEQ ID NO: 625636 - DNA, 16 bp, Homo sapiens
ttaatgattcttgtgt

SEQ ID NO: 625637 - DNA, 19 bp, Homo sapiens
ttaatgattcttgtgtcat

SEQ ID NO: 625638 - DNA, 13 bp, Homo sapiens
ttaatgtctcaaa

SEQ ID NO: 625639 - DNA, 11 bp, Homo sapiens
ttaatgtgcca

SEQ ID NO: 625640 - DNA, 11 bp, Homo sapiens
ttaatgttcta

SEQ ID NO: 625641 - DNA, 20 bp, Homo sapiens
ttaatgttctatataatttt

SEQ ID NO: 625642 - DNA, 18 bp, Homo sapiens
ttaattggcagcagattt

SEQ ID NO: 625643 - DNA, 14 bp, Homo sapiens
ttaatttattaaat

SEQ ID NO: 625644 - DNA, 12 bp, Homo sapiens
ttaatttgataa

SEQ ID NO: 625645 - DNA, 15 bp, Homo sapiens
ttaatttttttattg

SEQ ID NO: 625646 - DNA, 17 bp, Homo sapiens
ttaatttttttattgtt

SEQ ID NO: 625647 - DNA, 14 bp, Homo sapiens
ttacaaaatcttaa

SEQ ID NO: 625648 - DNA, 14 bp, Homo sapiens
ttacaaacaagata

SEQ ID NO: 625649 - DNA, 14 bp, Homo sapiens
ttacaaagaaacaa

SEQ ID NO: 625650 - DNA, 20 bp, Homo sapiens
ttacaaatgatttcgtgact

SEQ ID NO: 625651 - DNA, 15 bp, Homo sapiens
ttacaaatttttact

SEQ ID NO: 625652 - DNA, 16 bp, Homo sapiens
ttacaaatttttactc

SEQ ID NO: 625653 - DNA, 18 bp, Homo sapiens
ttacacacctgagaatgt

SEQ ID NO: 625654 - DNA, 13 bp, Homo sapiens
ttacactgaaatc

SEQ ID NO: 625655 - DNA, 11 bp, Homo sapiens
ttacagctgaa

SEQ ID NO: 625656 - DNA, 14 bp, Homo sapiens
ttacagtggcagta

SEQ ID NO: 625657 - DNA, 16 bp, Homo sapiens
ttacagtggcagtatt

SEQ ID NO: 625658 - DNA, 14 bp, Homo sapiens
ttacagttcacact

SEQ ID NO: 625659 - DNA, 11 bp, Homo sapiens
ttacataacag

SEQ ID NO: 625660 - DNA, 12 bp, Homo sapiens
ttacataacagg

SEQ ID NO: 625661 - DNA, 15 bp, Homo sapiens
ttacataacaggcat

SEQ ID NO: 625662 - DNA, 16 bp, Homo sapiens
ttaccagaagtttaaa

SEQ ID NO: 625663 - DNA, 17 bp, Homo sapiens
ttaccagtcaatgcatt

SEQ ID NO: 625664 - DNA, 22 bp, Homo sapiens
ttaccatcaaacaaatcatttt

SEQ ID NO: 625665 - DNA, 14 bp, Homo sapiens
ttacccctctacca

SEQ ID NO: 625666 - DNA, 13 bp, Homo sapiens
ttaccctccctgt

SEQ ID NO: 625667 - DNA, 17 bp, Homo sapiens
ttaccctccctgtcccc

SEQ ID NO: 625668 - DNA, 13 bp, Homo sapiens
ttaccgaaatgaa

SEQ ID NO: 625669 - DNA, 21 bp, Homo sapiens
ttacctgtaatagcctcacct

SEQ ID NO: 625670 - DNA, 13 bp, Homo sapiens
ttacctgttctct

SEQ ID NO: 625671 - DNA, 17 bp, Homo sapiens
ttacctgttctctagtt

SEQ ID NO: 625672 - DNA, 21 bp, Homo sapiens
ttacctgttgtctgaaacata

SEQ ID NO: 625673 - DNA, 16 bp, Homo sapiens
ttaccttggttaactt

SEQ ID NO: 625674 - DNA, 17 bp, Homo sapiens
ttactatgtaaatgctt

SEQ ID NO: 625675 - DNA, 13 bp, Homo sapiens
ttactcctcctgc

SEQ ID NO: 625676 - DNA, 23 bp, Homo sapiens
ttactctgtgctaagttgtctta

SEQ ID NO: 625677 - DNA, 17 bp, Homo sapiens
ttactgacatggtgctg

SEQ ID NO: 625678 - DNA, 18 bp, Homo sapiens
ttactggccttttcactg

SEQ ID NO: 625679 - DNA, 23 bp, Homo sapiens
ttactgtatttgggatatgagtt

SEQ ID NO: 625680 - DNA, 14 bp, Homo sapiens
ttactgttctgaaa

SEQ ID NO: 625681 - DNA, 16 bp, Homo sapiens
ttactgttctgaaatt

SEQ ID NO: 625682 - DNA, 20 bp, Homo sapiens
ttactgtttgaaaagaaata

SEQ ID NO: 625683 - DNA, 19 bp, Homo sapiens
ttactgttttgggcctcca

SEQ ID NO: 625684 - DNA, 19 bp, Homo sapiens
ttacttacacacctgagaa

SEQ ID NO: 625685 - DNA, 13 bp, Homo sapiens
ttactttgcccat

SEQ ID NO: 625686 - DNA, 17 bp, Homo sapiens
ttagaaaaaactggaaa

SEQ ID NO: 625687 - DNA, 18 bp, Homo sapiens
ttagaaaaaactggaaac

SEQ ID NO: 625688 - DNA, 13 bp, Homo sapiens
ttagaaaggcagc

SEQ ID NO: 625689 - DNA, 11 bp, Homo sapiens
ttagaatgtga

SEQ ID NO: 625690 - DNA, 23 bp, Homo sapiens
ttagacaatgtggaattacataa

SEQ ID NO: 625691 - DNA, 13 bp, Homo sapiens
ttagagaagccat

SEQ ID NO: 625692 - DNA, 15 bp, Homo sapiens
ttagagaagccataa

SEQ ID NO: 625693 - DNA, 21 bp, Homo sapiens
ttagagataccctctgagaca

SEQ ID NO: 625694 - DNA, 22 bp, Homo sapiens
ttagattcctacttaaacaaaa

SEQ ID NO: 625695 - DNA, 12 bp, Homo sapiens
ttagcacagagg

SEQ ID NO: 625696 - DNA, 21 bp, Homo sapiens
ttagcacagtatttaacattc

SEQ ID NO: 625697 - DNA, 14 bp, Homo sapiens
ttagcaccagcttg

SEQ ID NO: 625698 - DNA, 19 bp, Homo sapiens
ttagcaccagcttgcttct

SEQ ID NO: 625699 - DNA, 17 bp, Homo sapiens
tgtcattggttacaaat

SEQ ID NO: 625700 - DNA, 22 bp, Homo sapiens
tgtcatttcatacaaattttcc

SEQ ID NO: 625701 - DNA, 14 bp, Homo sapiens
tgtcattttcagat

SEQ ID NO: 625702 - DNA, 18 bp, Homo sapiens
tgtccaaacttaacagat

SEQ ID NO: 625703 - DNA, 20 bp, Homo sapiens
tgtccaggcagtagatcatt

SEQ ID NO: 625704 - DNA, 13 bp, Homo sapiens
tgtccaggtcaca

SEQ ID NO: 625705 - DNA, 17 bp, Homo sapiens
tgtccaggtcacaggca

SEQ ID NO: 625706 - DNA, 17 bp, Homo sapiens
tgtccatccgtctctgt

SEQ ID NO: 625707 - DNA, 20 bp, Homo sapiens
tgtccatccgtctctgtccg

SEQ ID NO: 625708 - DNA, 14 bp, Homo sapiens
tgtccattgacatg

SEQ ID NO: 625709 - DNA, 16 bp, Homo sapiens
tgtccattgacatgta

SEQ ID NO: 625710 - DNA, 18 bp, Homo sapiens
tgtccattgacatgtaca

SEQ ID NO: 625711 - DNA, 20 bp, Homo sapiens
tgtcccggagctcaggccct

SEQ ID NO: 625712 - DNA, 17 bp, Homo sapiens
tgtcccttcacatagtt

SEQ ID NO: 625713 - DNA, 13 bp, Homo sapiens
tgtcccttcccca

SEQ ID NO: 625714 - DNA, 21 bp, Homo sapiens
tgtccgcgtcctttcctctcc

SEQ ID NO: 625715 - DNA, 14 bp, Homo sapiens
tgtccgtcctgctc

SEQ ID NO: 625716 - DNA, 19 bp, Homo sapiens
tgtccgtcctgctcgccct

SEQ ID NO: 625717 - DNA, 14 bp, Homo sapiens
tgtccgtctgtcct

SEQ ID NO: 625718 - DNA, 18 bp, Homo sapiens
tgtccgtctgtcctgcgc

SEQ ID NO: 625719 - DNA, 19 bp, Homo sapiens
tgtccgtgaaagttgtgat

SEQ ID NO: 625720 - DNA, 21 bp, Homo sapiens
tgtccgtgaaagttgtgatct

SEQ ID NO: 625721 - DNA, 22 bp, Homo sapiens
tgtcctaaatgcaaagcacacc

SEQ ID NO: 625722 - DNA, 21 bp, Homo sapiens
tgtcctatccctggacgcatg

SEQ ID NO: 625723 - DNA, 21 bp, Homo sapiens
tgtcctgcatgtatgccatgt

SEQ ID NO: 625724 - DNA, 12 bp, Homo sapiens
tgtcctgctcac

SEQ ID NO: 625725 - DNA, 21 bp, Homo sapiens
tgtcctgctcacgtctgtgag

SEQ ID NO: 625726 - DNA, 12 bp, Homo sapiens
tgtcctgtgtca

SEQ ID NO: 625727 - DNA, 13 bp, Homo sapiens
tgtcctgtttctt

SEQ ID NO: 625728 - DNA, 19 bp, Homo sapiens
tgtcctttatgtattctct

SEQ ID NO: 625729 - DNA, 15 bp, Homo sapiens
tgtcgggcatgacac

SEQ ID NO: 625730 - DNA, 13 bp, Homo sapiens
tgtcggggcccct

SEQ ID NO: 625731 - DNA, 13 bp, Homo sapiens
tgtctaatgtatt

SEQ ID NO: 625732 - DNA, 19 bp, Homo sapiens
tgtctaatgtattttattg

SEQ ID NO: 625733 - DNA, 13 bp, Homo sapiens
tgtctatttttaa

SEQ ID NO: 625734 - DNA, 22 bp, Homo sapiens
tgtctcaaaaaccattacaaaa

SEQ ID NO: 625735 - DNA, 14 bp, Homo sapiens
tgtctcaaaataaa

SEQ ID NO: 625736 - DNA, 21 bp, Homo sapiens
tgtctcaaaataaaaccagaa

SEQ ID NO: 625737 - DNA, 20 bp, Homo sapiens
tgtctctacaaaaaaaatca

SEQ ID NO: 625738 - DNA, 15 bp, Homo sapiens
tgtctgaaacataga

SEQ ID NO: 625739 - DNA, 15 bp, Homo sapiens
tgtctgagccctgcc

SEQ ID NO: 625740 - DNA, 20 bp, Homo sapiens
tgtctgagccctgccctcac

SEQ ID NO: 625741 - DNA, 21 bp, Homo sapiens
tgtctgagccctgccctcact

SEQ ID NO: 625742 - DNA, 17 bp, Homo sapiens
tgtctggaaaagcactt

SEQ ID NO: 625743 - DNA, 13 bp, Homo sapiens
tgtctggagcctg

SEQ ID NO: 625744 - DNA, 19 bp, Homo sapiens
tgtctggctgtggcccctc

SEQ ID NO: 625745 - DNA, 20 bp, Homo sapiens
tgtctggctgtggcccctcc

SEQ ID NO: 625746 - DNA, 17 bp, Homo sapiens
tgtctgtccctaaacat

SEQ ID NO: 625747 - DNA, 12 bp, Homo sapiens
tgtcttattcct

SEQ ID NO: 625748 - DNA, 22 bp, Homo sapiens
tgtcttattcctaattcctgta

SEQ ID NO: 625749 - DNA, 18 bp, Homo sapiens
tgtcttcaaccctgccct

SEQ ID NO: 625750 - DNA, 15 bp, Homo sapiens
tgtcttcatgttgat

SEQ ID NO: 625751 - DNA, 18 bp, Homo sapiens
tgtcttgagaccagcctg

SEQ ID NO: 625752 - DNA, 19 bp, Homo sapiens
tgtcttgagaccagcctgc

SEQ ID NO: 625753 - DNA, 22 bp, Homo sapiens
tgtcttgagaccagcctgccag

SEQ ID NO: 625754 - DNA, 16 bp, Homo sapiens
tgtcttgtattatcat

SEQ ID NO: 625755 - DNA, 15 bp, Homo sapiens
tgtctttaaaatgat

SEQ ID NO: 625756 - DNA, 19 bp, Homo sapiens
tgtctttctccaaagttat

SEQ ID NO: 625757 - DNA, 20 bp, Homo sapiens
tgtctttggcttcagaattg

SEQ ID NO: 625758 - DNA, 12 bp, Homo sapiens
tgtcttttgcat

SEQ ID NO: 625759 - DNA, 17 bp, Homo sapiens
tgtcttttgttctctct

SEQ ID NO: 625760 - DNA, 22 bp, Homo sapiens
tgtgaaaatgctttgaaaatgt

SEQ ID NO: 625761 - DNA, 19 bp, Homo sapiens
tgtgaactttctcagcata

SEQ ID NO: 625762 - DNA, 16 bp, Homo sapiens
tgtgaaggtcttgcct

SEQ ID NO: 625763 - DNA, 17 bp, Homo sapiens
tgtgaatggttgcaaag

SEQ ID NO: 625764 - DNA, 21 bp, Homo sapiens
tgtgaattttaaaatgcaaat

SEQ ID NO: 625765 - DNA, 15 bp, Homo sapiens
tgtgacattccacag

SEQ ID NO: 625766 - DNA, 14 bp, Homo sapiens
tgtgacctgctcct

SEQ ID NO: 625767 - DNA, 18 bp, Homo sapiens
tgtgacctgctcctgccc

SEQ ID NO: 625768 - DNA, 19 bp, Homo sapiens
tgtgacctgctcctgccca

SEQ ID NO: 625769 - DNA, 12 bp, Homo sapiens
tgtgagataaat

SEQ ID NO: 625770 - DNA, 17 bp, Homo sapiens
tgtgagcgagtgacaga

SEQ ID NO: 625771 - DNA, 14 bp, Homo sapiens
tgtgagtctgtcct

SEQ ID NO: 625772 - DNA, 19 bp, Homo sapiens
tgtgagttaatttgataaa

SEQ ID NO: 625773 - DNA, 16 bp, Homo sapiens
tgtgatctgtccttcc

SEQ ID NO: 625774 - DNA, 18 bp, Homo sapiens
tgtgatgagaggaaatca

SEQ ID NO: 625775 - DNA, 18 bp, Homo sapiens
tgtgatgtaaggcactgt

SEQ ID NO: 625776 - DNA, 15 bp, Homo sapiens
tgtgatgtgttgctc

SEQ ID NO: 625777 - DNA, 15 bp, Homo sapiens
tgtgattctttgata

SEQ ID NO: 625778 - DNA, 13 bp, Homo sapiens
tgtgcacctgact

SEQ ID NO: 625779 - DNA, 21 bp, Homo sapiens
tgtgcacggcagcttgagcct

SEQ ID NO: 625780 - DNA, 15 bp, Homo sapiens
tgtgcagaaaacatt

SEQ ID NO: 625781 - DNA, 14 bp, Homo sapiens
tgtgcatctggcct

SEQ ID NO: 625782 - DNA, 21 bp, Homo sapiens
tgtgcatctggcctgggggct

SEQ ID NO: 625783 - DNA, 19 bp, Homo sapiens
tgtgccaaaatgtcaattt

SEQ ID NO: 625784 - DNA, 19 bp, Homo sapiens
tgtgccaaagatagcagaa

SEQ ID NO: 625785 - DNA, 22 bp, Homo sapiens
tgtgcccacccgtgttctcctc

SEQ ID NO: 625786 - DNA, 15 bp, Homo sapiens
tgtgcccacgtgtgc

SEQ ID NO: 625787 - DNA, 14 bp, Homo sapiens
tgtgccccttcccc

SEQ ID NO: 625788 - DNA, 16 bp, Homo sapiens
tgtgcccgtggtgagg

SEQ ID NO: 625789 - DNA, 19 bp, Homo sapiens
tgtgccgtctttggttcct

SEQ ID NO: 625790 - DNA, 12 bp, Homo sapiens
tgtgccttgggc

SEQ ID NO: 625791 - DNA, 13 bp, Homo sapiens
tgtgcttcacaca

SEQ ID NO: 625792 - DNA, 19 bp, Homo sapiens
tgtgcttcacacaaagtga

SEQ ID NO: 625793 - DNA, 23 bp, Homo sapiens
tgtgcttcacacaaagtgaaatt

SEQ ID NO: 625794 - DNA, 12 bp, Homo sapiens
tgtgcttgttct

SEQ ID NO: 625795 - DNA, 19 bp, Homo sapiens
tgtgcttgttcttcctctt

SEQ ID NO: 625796 - DNA, 23 bp, Homo sapiens
tgtggaatcaccgggaacgcccc

SEQ ID NO: 625797 - DNA, 17 bp, Homo sapiens
tgtggaattacataaca

SEQ ID NO: 625798 - DNA, 16 bp, Homo sapiens
tgtggagtggaggggt

SEQ ID NO: 625799 - DNA, 18 bp, Homo sapiens
tgtggataaattttggaa

SEQ ID NO: 625800 - DNA, 13 bp, Homo sapiens
tgtggataagaaa

SEQ ID NO: 625801 - DNA, 20 bp, Homo sapiens
tgtggataagaaaaatgctt

SEQ ID NO: 625802 - DNA, 14 bp, Homo sapiens
tgtggccccagccc

SEQ ID NO: 625803 - DNA, 22 bp, Homo sapiens
tgtggcccctccttctcccctc

SEQ ID NO: 625804 - DNA, 16 bp, Homo sapiens
tgtggccctgtgggag

SEQ ID NO: 625805 - DNA, 17 bp, Homo sapiens
tgtggccctgtgggagt

SEQ ID NO: 625806 - DNA, 19 bp, Homo sapiens
tgtggcctaatccacctgg

SEQ ID NO: 625807 - DNA, 16 bp, Homo sapiens
tgtggctgatttacta

SEQ ID NO: 625808 - DNA, 19 bp, Homo sapiens
tgtggctgcagagaccttg

SEQ ID NO: 625809 - DNA, 15 bp, Homo sapiens
tgtggcttaaacatt

SEQ ID NO: 625810 - DNA, 14 bp, Homo sapiens
tgtgggactggccc

SEQ ID NO: 625811 - DNA, 13 bp, Homo sapiens
tgtgggctcacac

SEQ ID NO: 625812 - DNA, 18 bp, Homo sapiens
tgtgggggaggtccctgc

SEQ ID NO: 625813 - DNA, 16 bp, Homo sapiens
tgtgggtccctaagca

SEQ ID NO: 625814 - DNA, 14 bp, Homo sapiens
tgtgggtgccctgt

SEQ ID NO: 625815 - DNA, 20 bp, Homo sapiens
tgtgggtttactctgtgcta

SEQ ID NO: 625816 - DNA, 17 bp, Homo sapiens
tgtgtagctctgtccac

SEQ ID NO: 625817 - DNA, 12 bp, Homo sapiens
tgtgtatatgtt

SEQ ID NO: 625818 - DNA, 14 bp, Homo sapiens
tttgctttttctga

SEQ ID NO: 625819 - DNA, 13 bp, Homo sapiens
tttggaagcagca

SEQ ID NO: 625820 - DNA, 16 bp, Homo sapiens
tttggaagcagcaagg

SEQ ID NO: 625821 - DNA, 16 bp, Homo sapiens
tttggaagttttactt

SEQ ID NO: 625822 - DNA, 12 bp, Homo sapiens
tttggccctgga

SEQ ID NO: 625823 - DNA, 14 bp, Homo sapiens
tttggccctggagc

SEQ ID NO: 625824 - DNA, 18 bp, Homo sapiens
tttggccctggagccagg

SEQ ID NO: 625825 - DNA, 19 bp, Homo sapiens
tttggccctggagccaggg

SEQ ID NO: 625826 - DNA, 15 bp, Homo sapiens
tttggctgaaattat

SEQ ID NO: 625827 - DNA, 19 bp, Homo sapiens
tttggctgaaattatgtca

SEQ ID NO: 625828 - DNA, 23 bp, Homo sapiens
tttgggcacatgtatgtccattc

SEQ ID NO: 625829 - DNA, 15 bp, Homo sapiens
tttggtatgaaacaa

SEQ ID NO: 625830 - DNA, 18 bp, Homo sapiens
tttggtttttctcatttg

SEQ ID NO: 625831 - DNA, 12 bp, Homo sapiens
tttggtttttga

SEQ ID NO: 625832 - DNA, 17 bp, Homo sapiens
tttgtacgttaattaaa

SEQ ID NO: 625833 - DNA, 22 bp, Homo sapiens
tttgtatcctccattgtatctt

SEQ ID NO: 625834 - DNA, 14 bp, Homo sapiens
tttgtccaggcctg

SEQ ID NO: 625835 - DNA, 22 bp, Homo sapiens
tttgtgagaaagagattcttgc

SEQ ID NO: 625836 - DNA, 15 bp, Homo sapiens
tttgtgcttgttctt

SEQ ID NO: 625837 - DNA, 18 bp, Homo sapiens
tttgtgcttgttcttcct

SEQ ID NO: 625838 - DNA, 15 bp, Homo sapiens
tttgtggataagaaa

SEQ ID NO: 625839 - DNA, 13 bp, Homo sapiens
tttgtgtgcttca

SEQ ID NO: 625840 - DNA, 18 bp, Homo sapiens
tttgtgtgcttcacacaa

SEQ ID NO: 625841 - DNA, 18 bp, Homo sapiens
tttgttaaaatatagtgt

SEQ ID NO: 625842 - DNA, 18 bp, Homo sapiens
tttgttatcagtacaatt

SEQ ID NO: 625843 - DNA, 15 bp, Homo sapiens
tttgttcaccttctg

SEQ ID NO: 625844 - DNA, 19 bp, Homo sapiens
tttgttcaccttctgtgca

SEQ ID NO: 625845 - DNA, 21 bp, Homo sapiens
tttgttcaccttctgtgcatc

SEQ ID NO: 625846 - DNA, 15 bp, Homo sapiens
tttgttctctcttgg

SEQ ID NO: 625847 - DNA, 10 bp, Homo sapiens
tttgttctgt

SEQ ID NO: 625848 - DNA, 21 bp, Homo sapiens
tttgtttctgttgttcacttg

SEQ ID NO: 625849 - DNA, 12 bp, Homo sapiens
tttgtttgctgc

SEQ ID NO: 625850 - DNA, 13 bp, Homo sapiens
tttgtttgctgct

SEQ ID NO: 625851 - DNA, 18 bp, Homo sapiens
tttgttttgctttttctg

SEQ ID NO: 625852 - DNA, 13 bp, Homo sapiens
ttttaaaaaaata

SEQ ID NO: 625853 - DNA, 21 bp, Homo sapiens
ttttaaaaaaataaaacattt

SEQ ID NO: 625854 - DNA, 18 bp, Homo sapiens
ttttaaaaaaataatata

SEQ ID NO: 625855 - DNA, 18 bp, Homo sapiens
ttttaaaatgcaaatatt

SEQ ID NO: 625856 - DNA, 21 bp, Homo sapiens
ttttaaacaaaatttatgtca

SEQ ID NO: 625857 - DNA, 22 bp, Homo sapiens
ttttaacatagcagctggttaa

SEQ ID NO: 625858 - DNA, 21 bp, Homo sapiens
ttttaactgcttcaagtgtta

SEQ ID NO: 625859 - DNA, 12 bp, Homo sapiens
ttttaattgaaa

SEQ ID NO: 625860 - DNA, 23 bp, Homo sapiens
ttttaattgaaagggacaagtat

SEQ ID NO: 625861 - DNA, 18 bp, Homo sapiens
ttttactcaggctttcta

SEQ ID NO: 625862 - DNA, 22 bp, Homo sapiens
ttttactcaggctttctattgg

SEQ ID NO: 625863 - DNA, 17 bp, Homo sapiens
ttttacttgattaagga

SEQ ID NO: 625864 - DNA, 18 bp, Homo sapiens
ttttacttgattaaggac

SEQ ID NO: 625865 - DNA, 18 bp, Homo sapiens
ttttagattcctacttaa

SEQ ID NO: 625866 - DNA, 23 bp, Homo sapiens
ttttagattcctacttaaacaaa

SEQ ID NO: 625867 - DNA, 12 bp, Homo sapiens
ttttataaatgt

SEQ ID NO: 625868 - DNA, 13 bp, Homo sapiens
ttttataaatgtt

SEQ ID NO: 625869 - DNA, 17 bp, Homo sapiens
ttttataaatgttttaa

SEQ ID NO: 625870 - DNA, 19 bp, Homo sapiens
ttttataaggctgactctt

SEQ ID NO: 625871 - DNA, 20 bp, Homo sapiens
ttttataaggctgactctta

SEQ ID NO: 625872 - DNA, 13 bp, Homo sapiens
ttttatacacata

SEQ ID NO: 625873 - DNA, 15 bp, Homo sapiens
ttataaaatctgtat

SEQ ID NO: 625874 - DNA, 14 bp, Homo sapiens
ttataacattgtaa

SEQ ID NO: 625875 - DNA, 17 bp, Homo sapiens
ttataaggctgactctt

SEQ ID NO: 625876 - DNA, 16 bp, Homo sapiens
ttataatgcatctaaa

SEQ ID NO: 625877 - DNA, 17 bp, Homo sapiens
ttataatgcatctaaac

SEQ ID NO: 625878 - DNA, 13 bp, Homo sapiens
ttataatttcaat

SEQ ID NO: 625879 - DNA, 15 bp, Homo sapiens
ttataatttcaattt

SEQ ID NO: 625880 - DNA, 14 bp, Homo sapiens
ttatacacataatt

SEQ ID NO: 625881 - DNA, 15 bp, Homo sapiens
ttatacctgtacaca

SEQ ID NO: 625882 - DNA, 19 bp, Homo sapiens
ttatactatttattaaaac

SEQ ID NO: 625883 - DNA, 18 bp, Homo sapiens
ttatagagcctcaatttt

SEQ ID NO: 625884 - DNA, 13 bp, Homo sapiens
ttatagagttatt

SEQ ID NO: 625885 - DNA, 23 bp, Homo sapiens
ttatagagttcatagaaatacat

SEQ ID NO: 625886 - DNA, 19 bp, Homo sapiens
ttatagcatgtaatattaa

SEQ ID NO: 625887 - DNA, 18 bp, Homo sapiens
ttataggaaataaatcta

SEQ ID NO: 625888 - DNA, 20 bp, Homo sapiens
ttatatatgtatatctgtgt

SEQ ID NO: 625889 - DNA, 17 bp, Homo sapiens
ttatatcagactgcttt

SEQ ID NO: 625890 - DNA, 20 bp, Homo sapiens
ttatattattttctgtaatt

SEQ ID NO: 625891 - DNA, 20 bp, Homo sapiens
ttatcaaaaaacagaaaaac

SEQ ID NO: 625892 - DNA, 21 bp, Homo sapiens
ttatcagggcccaaataacag

SEQ ID NO: 625893 - DNA, 20 bp, Homo sapiens
ttatcagtacaattctttgt

SEQ ID NO: 625894 - DNA, 12 bp, Homo sapiens
ttatcattgttt

SEQ ID NO: 625895 - DNA, 22 bp, Homo sapiens
ttatccactacaggttttatga

SEQ ID NO: 625896 - DNA, 20 bp, Homo sapiens
ttatcctcaagttgtgtgct

SEQ ID NO: 625897 - DNA, 22 bp, Homo sapiens
ttatctagtaggtctgcacaca

SEQ ID NO: 625898 - DNA, 13 bp, Homo sapiens
ttatctccagcca

SEQ ID NO: 625899 - DNA, 21 bp, Homo sapiens
ttatctccagccaatttcaaa

SEQ ID NO: 625900 - DNA, 16 bp, Homo sapiens
ttatctgggttttaga

SEQ ID NO: 625901 - DNA, 20 bp, Homo sapiens
ttatctgggttttagaaatt

SEQ ID NO: 625902 - DNA, 11 bp, Homo sapiens
ttatctgtctg

SEQ ID NO: 625903 - DNA, 13 bp, Homo sapiens
ttatctgtcttta

SEQ ID NO: 625904 - DNA, 12 bp, Homo sapiens
ttatctttaaaa

SEQ ID NO: 625905 - DNA, 21 bp, Homo sapiens
ttatgaggaaacttggacatt

SEQ ID NO: 625906 - DNA, 16 bp, Homo sapiens
ttatgatttcatgatt

SEQ ID NO: 625907 - DNA, 22 bp, Homo sapiens
ttatgatttcatgattagacaa

SEQ ID NO: 625908 - DNA, 15 bp, Homo sapiens
ttatggtgatactcc

SEQ ID NO: 625909 - DNA, 14 bp, Homo sapiens
ttatgtacaaaatg

SEQ ID NO: 625910 - DNA, 16 bp, Homo sapiens
ttatgtacaaaatgaa

SEQ ID NO: 625911 - DNA, 13 bp, Homo sapiens
ttatgtgatgtaa

SEQ ID NO: 625912 - DNA, 18 bp, Homo sapiens
ttatgttgtaatattttg

SEQ ID NO: 625913 - DNA, 20 bp, Homo sapiens
ttatgtttaaaatggcattt

SEQ ID NO: 625914 - DNA, 15 bp, Homo sapiens
ttattaaatttatta

SEQ ID NO: 625915 - DNA, 20 bp, Homo sapiens
ttattacaacaagcaaactg

SEQ ID NO: 625916 - DNA, 16 bp, Homo sapiens
ttattagcaccagctt

SEQ ID NO: 625917 - DNA, 18 bp, Homo sapiens
ttattattttcatataat

SEQ ID NO: 625918 - DNA, 22 bp, Homo sapiens
ttattattttcatataatttgc

SEQ ID NO: 625919 - DNA, 16 bp, Homo sapiens
ttattcatacaaataa

SEQ ID NO: 625920 - DNA, 13 bp, Homo sapiens
ttattcttccaag

SEQ ID NO: 625921 - DNA, 22 bp, Homo sapiens
ttattcttccaagttcattcat

SEQ ID NO: 625922 - DNA, 12 bp, Homo sapiens
ttattgtttaaa

SEQ ID NO: 625923 - DNA, 22 bp, Homo sapiens
ttattgtttaaagcaactgtct

SEQ ID NO: 625924 - DNA, 20 bp, Homo sapiens
ttatttaaatgtctaatgta

SEQ ID NO: 625925 - DNA, 15 bp, Homo sapiens
ttatttatttaaatg

SEQ ID NO: 625926 - DNA, 22 bp, Homo sapiens
ttatttcccaacccaggattca

SEQ ID NO: 625927 - DNA, 22 bp, Homo sapiens
ttatttctaaaacattaattga

SEQ ID NO: 625928 - DNA, 15 bp, Homo sapiens
ttatttctgtatctg

SEQ ID NO: 625929 - DNA, 20 bp, Homo sapiens
ttatttgctcataagtaaat

SEQ ID NO: 625930 - DNA, 15 bp, Homo sapiens
ttatttgtcagtgta

SEQ ID NO: 625931 - DNA, 22 bp, Homo sapiens
ttattttgattgtttgatgaat

SEQ ID NO: 625932 - DNA, 21 bp, Homo sapiens
ttattttttttcttccaacat

SEQ ID NO: 625933 - DNA, 22 bp, Homo sapiens
ttcaaaaagccaaaatagagag

SEQ ID NO: 625934 - DNA, 16 bp, Homo sapiens
ttcaaaatatattgaa

SEQ ID NO: 625935 - DNA, 19 bp, Homo sapiens
ttcaaagaacccccctccc

SEQ ID NO: 625936 - DNA, 20 bp, Homo sapiens
ttcaaagacttcatttaaca

SEQ ID NO: 625937 - DNA, 15 bp, Homo sapiens
ttcaaattctgatta

SEQ ID NO: 625938 - DNA, 20 bp, Homo sapiens
ttcaaattctgattattaca

SEQ ID NO: 625939 - DNA, 16 bp, Homo sapiens
ttcaaattgtcttttg

SEQ ID NO: 625940 - DNA, 14 bp, Homo sapiens
ttcaaccctgccct

SEQ ID NO: 625941 - DNA, 14 bp, Homo sapiens
ttcaagctttttgt

SEQ ID NO: 625942 - DNA, 16 bp, Homo sapiens
ttcaagctttttgtga

SEQ ID NO: 625943 - DNA, 23 bp, Homo sapiens
ttcaagctttttgtgagaaagag

SEQ ID NO: 625944 - DNA, 16 bp, Homo sapiens
ttcaaggatcctgagc

SEQ ID NO: 625945 - DNA, 13 bp, Homo sapiens
ttcaataggaaaa

SEQ ID NO: 625946 - DNA, 22 bp, Homo sapiens
ttcaatccacagtattgttctt

SEQ ID NO: 625947 - DNA, 13 bp, Homo sapiens
ttcaatccccata

SEQ ID NO: 625948 - DNA, 22 bp, Homo sapiens
ttcaatccccataatgcttctt

SEQ ID NO: 625949 - DNA, 16 bp, Homo sapiens
ttcaatgtgaatttta

SEQ ID NO: 625950 - DNA, 13 bp, Homo sapiens
ttcaatgttaaat

SEQ ID NO: 625951 - DNA, 21 bp, Homo sapiens
ttcacacaaagtgaaattagt

SEQ ID NO: 625952 - DNA, 19 bp, Homo sapiens
ttcacaccttacaaagcca

SEQ ID NO: 625953 - DNA, 20 bp, Homo sapiens
ttcacaccttacaaagccag

SEQ ID NO: 625954 - DNA, 15 bp, Homo sapiens
ttcacattcctgacc

SEQ ID NO: 625955 - DNA, 14 bp, Homo sapiens
ttcacctgaaatgc

SEQ ID NO: 625956 - DNA, 16 bp, Homo sapiens
ttcaccttctgtgcat

SEQ ID NO: 625957 - DNA, 22 bp, Homo sapiens
ttcacgcaacttgaaattatat

SEQ ID NO: 625958 - DNA, 14 bp, Homo sapiens
ttcactctccttgg

SEQ ID NO: 625959 - DNA, 21 bp, Homo sapiens
ttcacttcttaaggacagtgt

SEQ ID NO: 625960 - DNA, 17 bp, Homo sapiens
ttcagaaactttttcta

SEQ ID NO: 625961 - DNA, 22 bp, Homo sapiens
ttcagaaagggcagcccctccc

SEQ ID NO: 625962 - DNA, 17 bp, Homo sapiens
ttcagactctctcctct

SEQ ID NO: 625963 - DNA, 17 bp, Homo sapiens
ttcagatccttccaaac

SEQ ID NO: 625964 - DNA, 13 bp, Homo sapiens
ttctcaacacaca

SEQ ID NO: 625965 - DNA, 21 bp, Homo sapiens
ttctcagaagtgaaaaagact

SEQ ID NO: 625966 - DNA, 22 bp, Homo sapiens
ttctcagaagtgaaaaagactt

SEQ ID NO: 625967 - DNA, 18 bp, Homo sapiens
ttctcagctccactctga

SEQ ID NO: 625968 - DNA, 17 bp, Homo sapiens
ttctcatttgaaatgtt

SEQ ID NO: 625969 - DNA, 18 bp, Homo sapiens
ttctccagcccatgctgg

SEQ ID NO: 625970 - DNA, 15 bp, Homo sapiens
ttctccccctcagct

SEQ ID NO: 625971 - DNA, 16 bp, Homo sapiens
ttctcccctccagacc

SEQ ID NO: 625972 - DNA, 18 bp, Homo sapiens
ttctcctccaaatgctgt

SEQ ID NO: 625973 - DNA, 22 bp, Homo sapiens
ttctcctccattcatgtttaat

SEQ ID NO: 625974 - DNA, 12 bp, Homo sapiens
ttctcctctccc

SEQ ID NO: 625975 - DNA, 16 bp, Homo sapiens
ttctccttgtacttga

SEQ ID NO: 625976 - DNA, 13 bp, Homo sapiens
ttctcctttttct

SEQ ID NO: 625977 - DNA, 13 bp, Homo sapiens
ttctctctgtgct

SEQ ID NO: 625978 - DNA, 20 bp, Homo sapiens
ttctctgttaacctacaaaa

SEQ ID NO: 625979 - DNA, 18 bp, Homo sapiens
ttctcttctacttcttgt

SEQ ID NO: 625980 - DNA, 12 bp, Homo sapiens
ttctctttcaca

SEQ ID NO: 625981 - DNA, 19 bp, Homo sapiens
ttctgaaaggtgctttctc

SEQ ID NO: 625982 - DNA, 15 bp, Homo sapiens
ttctgactccagtgg

SEQ ID NO: 625983 - DNA, 23 bp, Homo sapiens
ttctgagtgacatgggtgtgcca

SEQ ID NO: 625984 - DNA, 13 bp, Homo sapiens
ttctgatgaagtt

SEQ ID NO: 625985 - DNA, 15 bp, Homo sapiens
ttctgattattacaa

SEQ ID NO: 625986 - DNA, 13 bp, Homo sapiens
ttctgcagaaaat

SEQ ID NO: 625987 - DNA, 17 bp, Homo sapiens
ttctgcagtattctgta

SEQ ID NO: 625988 - DNA, 16 bp, Homo sapiens
ttctgctaatttatga

SEQ ID NO: 625989 - DNA, 18 bp, Homo sapiens
ttctgctgaattttcaca

SEQ ID NO: 625990 - DNA, 13 bp, Homo sapiens
ttctgctgccctc

SEQ ID NO: 625991 - DNA, 14 bp, Homo sapiens
ttctgctttctgat

SEQ ID NO: 625992 - DNA, 18 bp, Homo sapiens
ttctggaaaaacaggata

SEQ ID NO: 625993 - DNA, 16 bp, Homo sapiens
ttctgggtttgatact

SEQ ID NO: 625994 - DNA, 13 bp, Homo sapiens
ttctggtccttag

SEQ ID NO: 625995 - DNA, 20 bp, Homo sapiens
ttctggtccttagtaaattc

SEQ ID NO: 625996 - DNA, 14 bp, Homo sapiens
ttctgtcaatgaaa

SEQ ID NO: 625997 - DNA, 12 bp, Homo sapiens
ttctgtgcagtt

SEQ ID NO: 625998 - DNA, 23 bp, Homo sapiens
ttctgttggtcttaactaatgta

SEQ ID NO: 625999 - DNA, 19 bp, Homo sapiens
ttcttactgttctgaaatt

SEQ ID NO: 626000 - DNA, 22 bp, Homo sapiens
ttcttagttaatctttgaaaac

SEQ ID NO: 626001 - DNA, 18 bp, Homo sapiens
tctgtccctaaacatagt

SEQ ID NO: 626002 - DNA, 22 bp, Homo sapiens
tctgtccttccaacctgttcac

SEQ ID NO: 626003 - DNA, 14 bp, Homo sapiens
tctgtcctttccca

SEQ ID NO: 626004 - DNA, 18 bp, Homo sapiens
tctgtctctcttttgctc

SEQ ID NO: 626005 - DNA, 11 bp, Homo sapiens
tctgtctgagc

SEQ ID NO: 626006 - DNA, 15 bp, Homo sapiens
tctgtctgagccctg

SEQ ID NO: 626007 - DNA, 21 bp, Homo sapiens
tctgtgcagtttggtatgaaa

SEQ ID NO: 626008 - DNA, 17 bp, Homo sapiens
tctgtgcatctggcctg

SEQ ID NO: 626009 - DNA, 17 bp, Homo sapiens
tctgtgctaagttgtct

SEQ ID NO: 626010 - DNA, 16 bp, Homo sapiens
tctgtgggactggccc

SEQ ID NO: 626011 - DNA, 21 bp, Homo sapiens
tctgtgggactggcccacccc

SEQ ID NO: 626012 - DNA, 12 bp, Homo sapiens
tctgtgtggcaa

SEQ ID NO: 626013 - DNA, 15 bp, Homo sapiens
tctgttccaagtgtg

SEQ ID NO: 626014 - DNA, 21 bp, Homo sapiens
tctgttccaagtgtgtgtgca

SEQ ID NO: 626015 - DNA, 13 bp, Homo sapiens
tctgttgttcact

SEQ ID NO: 626016 - DNA, 16 bp, Homo sapiens
tctgtttaccctccct

SEQ ID NO: 626017 - DNA, 18 bp, Homo sapiens
tctgtttaccctccctgt

SEQ ID NO: 626018 - DNA, 21 bp, Homo sapiens
tcttaaaattggttaatgaaa

SEQ ID NO: 626019 - DNA, 14 bp, Homo sapiens
tcttaactaatgta

SEQ ID NO: 626020 - DNA, 19 bp, Homo sapiens
tcttaaggacagtgttcaa

SEQ ID NO: 626021 - DNA, 21 bp, Homo sapiens
tcttaaggacagtgttcaaat

SEQ ID NO: 626022 - DNA, 13 bp, Homo sapiens
tcttaattatggt

SEQ ID NO: 626023 - DNA, 16 bp, Homo sapiens
tcttacacgaagaaat

SEQ ID NO: 626024 - DNA, 17 bp, Homo sapiens
tcttacacgaagaaata

SEQ ID NO: 626025 - DNA, 19 bp, Homo sapiens
tcttaccgaaatgaaaatg

SEQ ID NO: 626026 - DNA, 18 bp, Homo sapiens
tcttactgttctgaaatt

SEQ ID NO: 626027 - DNA, 22 bp, Homo sapiens
tcttattcatgctttctccttt

SEQ ID NO: 626028 - DNA, 19 bp, Homo sapiens
tcttattcctaattcctgt

SEQ ID NO: 626029 - DNA, 15 bp, Homo sapiens
tcttcaaccctgccc

SEQ ID NO: 626030 - DNA, 18 bp, Homo sapiens
tcttcacctcacttgtgg

SEQ ID NO: 626031 - DNA, 14 bp, Homo sapiens
tcttcatacaaagg

SEQ ID NO: 626032 - DNA, 17 bp, Homo sapiens
tcttccaacatgtgatg

SEQ ID NO: 626033 - DNA, 22 bp, Homo sapiens
tcttccaacatgtgatgtgttg

SEQ ID NO: 626034 - DNA, 22 bp, Homo sapiens
tcttcccaagtcctcgcccccc

SEQ ID NO: 626035 - DNA, 13 bp, Homo sapiens
tcttcccccttcc

SEQ ID NO: 626036 - DNA, 14 bp, Homo sapiens
tcttcccctttcct

SEQ ID NO: 626037 - DNA, 10 bp, Homo sapiens
tcttccttcc

SEQ ID NO: 626038 - DNA, 11 bp, Homo sapiens
tcttccttcct

SEQ ID NO: 626039 - DNA, 16 bp, Homo sapiens
tgtcattctgctaatt

SEQ ID NO: 626040 - DNA, 14 bp, Homo sapiens
tccctgccagtgtt

SEQ ID NO: 626041 - DNA, 15 bp, Homo sapiens
tccctgcgcgcagct

SEQ ID NO: 626042 - DNA, 12 bp, Homo sapiens
tccctgctcagc

SEQ ID NO: 626043 - DNA, 16 bp, Homo sapiens
tccctgctgccaggct

SEQ ID NO: 626044 - DNA, 22 bp, Homo sapiens
tccctgctgccaggctcccact

SEQ ID NO: 626045 - DNA, 18 bp, Homo sapiens
tccctggacgcatgcagg

SEQ ID NO: 626046 - DNA, 22 bp, Homo sapiens
tccctggacgcatgcagggccc

SEQ ID NO: 626047 - DNA, 13 bp, Homo sapiens
tccctggagctgt

SEQ ID NO: 626048 - DNA, 20 bp, Homo sapiens
tccctggagctgtccttcat

SEQ ID NO: 626049 - DNA, 16 bp, Homo sapiens
tccctgggcaccctgc

SEQ ID NO: 626050 - DNA, 23 bp, Homo sapiens
tccctggggaggacccctgccct

SEQ ID NO: 626051 - DNA, 11 bp, Homo sapiens
tccctgtcccc

SEQ ID NO: 626052 - DNA, 20 bp, Homo sapiens
tccctgtctgtctgtctctc

SEQ ID NO: 626053 - DNA, 22 bp, Homo sapiens
tccctgtgggctcacaccggca

SEQ ID NO: 626054 - DNA, 18 bp, Homo sapiens
tcccttcatcccagggta

SEQ ID NO: 626055 - DNA, 16 bp, Homo sapiens
tcccttctttccttcc

SEQ ID NO: 626056 - DNA, 18 bp, Homo sapiens
tcccttctttccttcctt

SEQ ID NO: 626057 - DNA, 16 bp, Homo sapiens
tcccttgattcaaata

SEQ ID NO: 626058 - DNA, 20 bp, Homo sapiens
tccctttatcatgtgtttct

SEQ ID NO: 626059 - DNA, 22 bp, Homo sapiens
tccctttccccattcagtgaca

SEQ ID NO: 626060 - DNA, 20 bp, Homo sapiens
tccctttccctgcatccctt

SEQ ID NO: 626061 - DNA, 13 bp, Homo sapiens
tccgagcccctgt

SEQ ID NO: 626062 - DNA, 14 bp, Homo sapiens
tccgagcccctgtt

SEQ ID NO: 626063 - DNA, 23 bp, Homo sapiens
tccgagcccctgtttctcctcca

SEQ ID NO: 626064 - DNA, 19 bp, Homo sapiens
tccgcacgcggccgctctc

SEQ ID NO: 626065 - DNA, 16 bp, Homo sapiens
tccgccacgaggagct

SEQ ID NO: 626066 - DNA, 19 bp, Homo sapiens
tccgccacgaggagcttcc

SEQ ID NO: 626067 - DNA, 14 bp, Homo sapiens
tccgccagccctgt

SEQ ID NO: 626068 - DNA, 15 bp, Homo sapiens
tccgccagccctgtt

SEQ ID NO: 626069 - DNA, 19 bp, Homo sapiens
tccgccccgtgctcctctg

SEQ ID NO: 626070 - DNA, 14 bp, Homo sapiens
tccgcccgcccacc

SEQ ID NO: 626071 - DNA, 21 bp, Homo sapiens
tccgcccgcccaccccgctgc

SEQ ID NO: 626072 - DNA, 15 bp, Homo sapiens
tccgcctcactgggt

SEQ ID NO: 626073 - DNA, 20 bp, Homo sapiens
tccgcgtcctttcctctcct

SEQ ID NO: 626074 - DNA, 21 bp, Homo sapiens
tccgcgtcctttcctctcctc

SEQ ID NO: 626075 - DNA, 17 bp, Homo sapiens
tccgcgtggttctgcca

SEQ ID NO: 626076 - DNA, 16 bp, Homo sapiens
tccggatttaatttga

SEQ ID NO: 626077 - DNA, 14 bp, Homo sapiens
tccggcctgcagcc

SEQ ID NO: 626078 - DNA, 16 bp, Homo sapiens
tccggcctgcagccca

SEQ ID NO: 626079 - DNA, 17 bp, Homo sapiens
tccggcctgcagcccag

SEQ ID NO: 626080 - DNA, 20 bp, Homo sapiens
tccggcctgcagcccagaac

SEQ ID NO: 626081 - DNA, 23 bp, Homo sapiens
tccgggtctcgcagcctgaagcc

SEQ ID NO: 626082 - DNA, 16 bp, Homo sapiens
tccgggtgccattccc

SEQ ID NO: 626083 - DNA, 22 bp, Homo sapiens
tccggtgtctggaaaagcactt

SEQ ID NO: 626084 - DNA, 13 bp, Homo sapiens
tccgtccccaggg

SEQ ID NO: 626085 - DNA, 13 bp, Homo sapiens
tccgtccgcccgc

SEQ ID NO: 626086 - DNA, 16 bp, Homo sapiens
tccgtctgtcctgcgc

SEQ ID NO: 626087 - DNA, 15 bp, Homo sapiens
tccgtgaaagttgtg

SEQ ID NO: 626088 - DNA, 20 bp, Homo sapiens
tccgtgagagtcatctcaaa

SEQ ID NO: 626089 - DNA, 12 bp, Homo sapiens
tccgttaggaat

SEQ ID NO: 626090 - DNA, 17 bp, Homo sapiens
tcctaagagtggaggag

SEQ ID NO: 626091 - DNA, 13 bp, Homo sapiens
tcctaattcctgt

SEQ ID NO: 626092 - DNA, 14 bp, Homo sapiens
tcctaattcctgta

SEQ ID NO: 626093 - DNA, 19 bp, Homo sapiens
tcctaattcctgtatgtta

SEQ ID NO: 626094 - DNA, 18 bp, Homo sapiens
aaatcacagatttccaaa

SEQ ID NO: 626095 - DNA, 19 bp, Homo sapiens
aaatcacagatttccaaaa

SEQ ID NO: 626096 - DNA, 20 bp, Homo sapiens
aaatcaccctgactgtgggg

SEQ ID NO: 626097 - DNA, 19 bp, Homo sapiens
aaatcactttaatttagaa

SEQ ID NO: 626098 - DNA, 18 bp, Homo sapiens
aaatcatcctcatgtcct

SEQ ID NO: 626099 - DNA, 14 bp, Homo sapiens
aaatcattttgatg

SEQ ID NO: 626100 - DNA, 21 bp, Homo sapiens
aaatctacaaacttttataaa

SEQ ID NO: 626101 - DNA, 17 bp, Homo sapiens
aaatctgctttcatcca

SEQ ID NO: 626102 - DNA, 19 bp, Homo sapiens
aaatctgctttcatccagc

SEQ ID NO: 626103 - DNA, 20 bp, Homo sapiens
aaatcttacccttcaatgtt

SEQ ID NO: 626104 - DNA, 22 bp, Homo sapiens
aaatcttgaaagcgaaatactt

SEQ ID NO: 626105 - DNA, 13 bp, Homo sapiens
aaatctttgttaa

SEQ ID NO: 626106 - DNA, 14 bp, Homo sapiens
aaatgaaaatggct

SEQ ID NO: 626107 - DNA, 12 bp, Homo sapiens
aaatgaaatact

SEQ ID NO: 626108 - DNA, 13 bp, Homo sapiens
aaatgaaatactt

SEQ ID NO: 626109 - DNA, 13 bp, Homo sapiens
aaatgaatgaaat

SEQ ID NO: 626110 - DNA, 17 bp, Homo sapiens
aaatgaatgaaatataa

SEQ ID NO: 626111 - DNA, 22 bp, Homo sapiens
aaatgaatgtgtgtggtttttt

SEQ ID NO: 626112 - DNA, 13 bp, Homo sapiens
aaatgaattgcct

SEQ ID NO: 626113 - DNA, 22 bp, Homo sapiens
aaatgagatcccagagttattt

SEQ ID NO: 626114 - DNA, 18 bp, Homo sapiens
aaatgatatgtctttaaa

SEQ ID NO: 626115 - DNA, 21 bp, Homo sapiens
aaatgatcaaggagggagaaa

SEQ ID NO: 626116 - DNA, 22 bp, Homo sapiens
aaatgattcacttttattgtat

SEQ ID NO: 626117 - DNA, 17 bp, Homo sapiens
aaatgcaaagcacacct

SEQ ID NO: 626118 - DNA, 14 bp, Homo sapiens
aaatgctgatttaa

SEQ ID NO: 626119 - DNA, 21 bp, Homo sapiens
aaatgctgatttaaacttctt

SEQ ID NO: 626120 - DNA, 19 bp, Homo sapiens
aaatgcttgaccctgaaat

SEQ ID NO: 626121 - DNA, 14 bp, Homo sapiens
aaatgctttgaaaa

SEQ ID NO: 626122 - DNA, 19 bp, Homo sapiens
aaatggaggaaaccacaaa

SEQ ID NO: 626123 - DNA, 13 bp, Homo sapiens
aaatggatgtaat

SEQ ID NO: 626124 - DNA, 17 bp, Homo sapiens
aaatggcatttagcaca

SEQ ID NO: 626125 - DNA, 21 bp, Homo sapiens
aaatggcatttagcacagtat

SEQ ID NO: 626126 - DNA, 23 bp, Homo sapiens
aaatggcatttagcacagtattt

SEQ ID NO: 626127 - DNA, 21 bp, Homo sapiens
aaatgtatgttggtttagcgt

SEQ ID NO: 626128 - DNA, 20 bp, Homo sapiens
aaatgtgtcttgtattatca

SEQ ID NO: 626129 - DNA, 13 bp, Homo sapiens
aaatgtttatttt

SEQ ID NO: 626130 - DNA, 20 bp, Homo sapiens
aaatgttttacaatggctgg

SEQ ID NO: 626131 - DNA, 16 bp, Homo sapiens
aaattaacaaattcag

SEQ ID NO: 626132 - DNA, 19 bp, Homo sapiens
aaattaattggcagcagat

SEQ ID NO: 626133 - DNA, 13 bp, Homo sapiens
aaattaatttttc

SEQ ID NO: 626134 - DNA, 20 bp, Homo sapiens
aaattagggctctaatttcc

SEQ ID NO: 626135 - DNA, 18 bp, Homo sapiens
aaattatgtcaaatggat

SEQ ID NO: 626136 - DNA, 19 bp, Homo sapiens
aaattattaaaaattatag

SEQ ID NO: 626137 - DNA, 17 bp, Homo sapiens
aaattatttctaaaaca

SEQ ID NO: 626138 - DNA, 21 bp, Homo sapiens
aaattatttctaaaacattaa

SEQ ID NO: 626139 - DNA, 14 bp, Homo sapiens
aaattcctaattct

SEQ ID NO: 626140 - DNA, 17 bp, Homo sapiens
aaattctataagagaca

SEQ ID NO: 626141 - DNA, 12 bp, Homo sapiens
aaattgccttca

SEQ ID NO: 626142 - DNA, 13 bp, Homo sapiens
aaattgctgagat

SEQ ID NO: 626143 - DNA, 22 bp, Homo sapiens
aaattggttaatgaaaaatctg

SEQ ID NO: 626144 - DNA, 21 bp, Homo sapiens
aaattgtcttttgtcatgtgg

SEQ ID NO: 626145 - DNA, 13 bp, Homo sapiens
aaattgtgccaaa

SEQ ID NO: 626146 - DNA, 14 bp, Homo sapiens
aaattgtgccaaag

SEQ ID NO: 626147 - DNA, 13 bp, Homo sapiens
aaattgtggatga

SEQ ID NO: 626148 - DNA, 11 bp, Homo sapiens
aaatttaagag

SEQ ID NO: 626149 - DNA, 21 bp, Homo sapiens
aaatttaagagattttatgtt

SEQ ID NO: 626150 - DNA, 13 bp, Homo sapiens
aaatttaagcaca

SEQ ID NO: 626151 - DNA, 21 bp, Homo sapiens
aaatttgacattgtcagaatg

SEQ ID NO: 626152 - DNA, 22 bp, Homo sapiens
aaatttgacattgtcagaatgt

SEQ ID NO: 626153 - DNA, 13 bp, Homo sapiens
aaatttgtgtgct

SEQ ID NO: 626154 - DNA, 16 bp, Homo sapiens
aaattttattgaatat

SEQ ID NO: 626155 - DNA, 23 bp, Homo sapiens
aaattttcttctttaatttttct

SEQ ID NO: 626156 - DNA, 18 bp, Homo sapiens
aaattttggaagaattca

SEQ ID NO: 626157 - DNA, 15 bp, Homo sapiens
aaatttttactcagg

SEQ ID NO: 626158 - DNA, 21 bp, Homo sapiens
aaatttttactcaggctttct

SEQ ID NO: 626159 - DNA, 18 bp, Homo sapiens
aaatttttgcatgtttaa

SEQ ID NO: 626160 - DNA, 16 bp, Homo sapiens
aaatttttttccagaa

SEQ ID NO: 626161 - DNA, 19 bp, Homo sapiens
aaatttttttccagaattg

SEQ ID NO: 626162 - DNA, 21 bp, Homo sapiens
aacaaaaactttccatgacag

SEQ ID NO: 626163 - DNA, 23 bp, Homo sapiens
aacaaaatataaatcacagattt

SEQ ID NO: 626164 - DNA, 21 bp, Homo sapiens
aacaaaatccttgccttcaaa

SEQ ID NO: 626165 - DNA, 12 bp, Homo sapiens
aacaaaatttat

SEQ ID NO: 626166 - DNA, 14 bp, Homo sapiens
aacaaagaaatatt

SEQ ID NO: 626167 - DNA, 14 bp, Homo sapiens
aacaaagcatgctc

SEQ ID NO: 626168 - DNA, 22 bp, Homo sapiens
aacaaagcatttgactttctgt

SEQ ID NO: 626169 - DNA, 14 bp, Homo sapiens
aacaaatatactca

SEQ ID NO: 626170 - DNA, 16 bp, Homo sapiens
aacaaatcattttgat

SEQ ID NO: 626171 - DNA, 17 bp, Homo sapiens
aacaaatcattttgatg

SEQ ID NO: 626172 - DNA, 15 bp, Homo sapiens
aacaacagcaacaac

SEQ ID NO: 626173 - DNA, 17 bp, Homo sapiens
aacaagatacgtatatt

SEQ ID NO: 626174 - DNA, 14 bp, Homo sapiens
aacaagcaaactga

SEQ ID NO: 626175 - DNA, 20 bp, Homo sapiens
aacaagccacgttgcagaaa

SEQ ID NO: 626176 - DNA, 18 bp, Homo sapiens
aacaaggaaggacatttc

SEQ ID NO: 626177 - DNA, 21 bp, Homo sapiens
aacaatgttttttatacttca

SEQ ID NO: 626178 - DNA, 20 bp, Homo sapiens
aacaatttaggaatgctcaa

SEQ ID NO: 626179 - DNA, 15 bp, Homo sapiens
aacacacacacacac

SEQ ID NO: 626180 - DNA, 17 bp, Homo sapiens
aacacacagactctgtg

SEQ ID NO: 626181 - DNA, 12 bp, Homo sapiens
aacacacagtat

SEQ ID NO: 626182 - DNA, 13 bp, Homo sapiens
aacacagattatt

SEQ ID NO: 626183 - DNA, 15 bp, Homo sapiens
aacacagcatgcatt

SEQ ID NO: 626184 - DNA, 21 bp, Homo sapiens
aacacagtgccccagtggtgc

SEQ ID NO: 626185 - DNA, 18 bp, Homo sapiens
aacacattgaaactgtat

SEQ ID NO: 626186 - DNA, 19 bp, Homo sapiens
aacacattgaaactgtatt

SEQ ID NO: 626187 - DNA, 22 bp, Homo sapiens
aacacattgaaactgtatttac

SEQ ID NO: 626188 - DNA, 12 bp, Homo sapiens
aacactctgaga

SEQ ID NO: 626189 - DNA, 14 bp, Homo sapiens
aacacttctcctta

SEQ ID NO: 626190 - DNA, 14 bp, Homo sapiens
aacagaaaaacaaa

SEQ ID NO: 626191 - DNA, 14 bp, Homo sapiens
aacagaaagcatag

SEQ ID NO: 626192 - DNA, 13 bp, Homo sapiens
aacagaagaaaaa

SEQ ID NO: 626193 - DNA, 21 bp, Homo sapiens
aacagactgccttatattatt

SEQ ID NO: 626194 - DNA, 19 bp, Homo sapiens
aagacacgtgcaacagact

SEQ ID NO: 626195 - DNA, 15 bp, Homo sapiens
aagacattcttagtt

SEQ ID NO: 626196 - DNA, 22 bp, Homo sapiens
aagacccactgaatctgagaaa

SEQ ID NO: 626197 - DNA, 23 bp, Homo sapiens
aagacccactgaatctgagaaag

SEQ ID NO: 626198 - DNA, 13 bp, Homo sapiens
aagactcaatcat

SEQ ID NO: 626199 - DNA, 23 bp, Homo sapiens
aagactcagtatgctttccctga

SEQ ID NO: 626200 - DNA, 22 bp, Homo sapiens
aagacttcaaatgttattcaat

SEQ ID NO: 626201 - DNA, 19 bp, Homo sapiens
aagacttcatttaacactg

SEQ ID NO: 626202 - DNA, 20 bp, Homo sapiens
aagagaccacttccttaaca

SEQ ID NO: 626203 - DNA, 17 bp, Homo sapiens
aagagagatatatctga

SEQ ID NO: 626204 - DNA, 16 bp, Homo sapiens
aagagcacgttttcca

SEQ ID NO: 626205 - DNA, 15 bp, Homo sapiens
aagagcctgactgtg

SEQ ID NO: 626206 - DNA, 19 bp, Homo sapiens
aagagctcaggagaaggcc

SEQ ID NO: 626207 - DNA, 19 bp, Homo sapiens
aagaggaaaatattgacaa

SEQ ID NO: 626208 - DNA, 16 bp, Homo sapiens
aagaggccagtacttt

SEQ ID NO: 626209 - DNA, 22 bp, Homo sapiens
aagagtcgagtgatatggcttg

SEQ ID NO: 626210 - DNA, 15 bp, Homo sapiens
aagagtggaggagga

SEQ ID NO: 626211 - DNA, 22 bp, Homo sapiens
aagagttctccttgtacttgaa

SEQ ID NO: 626212 - DNA, 21 bp, Homo sapiens
aagataattaaatgaaatact

SEQ ID NO: 626213 - DNA, 22 bp, Homo sapiens
aagataattaaatgaaatactt

SEQ ID NO: 626214 - DNA, 20 bp, Homo sapiens
aagatagcagaagagtagat

SEQ ID NO: 626215 - DNA, 22 bp, Homo sapiens
aagataggttctgctttctgat

SEQ ID NO: 626216 - DNA, 15 bp, Homo sapiens
aagggacatgtcttt

SEQ ID NO: 626217 - DNA, 23 bp, Homo sapiens
aagggacatgtctttggcttcag

SEQ ID NO: 626218 - DNA, 17 bp, Homo sapiens
aagggactccagaagca

SEQ ID NO: 626219 - DNA, 18 bp, Homo sapiens
aagggactccagaagcag

SEQ ID NO: 626220 - DNA, 22 bp, Homo sapiens
aagggactccagaagcagcagc

SEQ ID NO: 626221 - DNA, 14 bp, Homo sapiens
aagggcacattgcc

SEQ ID NO: 626222 - DNA, 15 bp, Homo sapiens
aagggcagcccctcc

SEQ ID NO: 626223 - DNA, 18 bp, Homo sapiens
aagggcagcccctcccca

SEQ ID NO: 626224 - DNA, 17 bp, Homo sapiens
aagggccaccctgagca

SEQ ID NO: 626225 - DNA, 14 bp, Homo sapiens
aagggccttctcca

SEQ ID NO: 626226 - DNA, 18 bp, Homo sapiens
aagggcgctgagggcagg

SEQ ID NO: 626227 - DNA, 14 bp, Homo sapiens
aagggtgcctggct

SEQ ID NO: 626228 - DNA, 18 bp, Homo sapiens
aagggtgcctggctgggc

SEQ ID NO: 626229 - DNA, 20 bp, Homo sapiens
aagggtggtagttttcccta

SEQ ID NO: 626230 - DNA, 16 bp, Homo sapiens
aagggttctgccctgc

SEQ ID NO: 626231 - DNA, 22 bp, Homo sapiens
aaggtcagtgttataaaatctg

SEQ ID NO: 626232 - DNA, 12 bp, Homo sapiens
aaggtgcctcat

SEQ ID NO: 626233 - DNA, 14 bp, Homo sapiens
aaggtgctttctcc

SEQ ID NO: 626234 - DNA, 14 bp, Homo sapiens
aaggtggcatagcc

SEQ ID NO: 626235 - DNA, 23 bp, Homo sapiens
aaggtggtcttggagaggaggtg

SEQ ID NO: 626236 - DNA, 17 bp, Homo sapiens
aaggttatttatttaaa

SEQ ID NO: 626237 - DNA, 15 bp, Homo sapiens
aagtacataaagtaa

SEQ ID NO: 626238 - DNA, 20 bp, Homo sapiens
aagtactgcatgatcttaca

SEQ ID NO: 626239 - DNA, 14 bp, Homo sapiens
aagtactttctggt

SEQ ID NO: 626240 - DNA, 17 bp, Homo sapiens
aagtagtgtgagtgtta

SEQ ID NO: 626241 - DNA, 16 bp, Homo sapiens
aagtatcatctaaata

SEQ ID NO: 626242 - DNA, 15 bp, Homo sapiens
aagtatgtcttcaaa

SEQ ID NO: 626243 - DNA, 19 bp, Homo sapiens
aagtcatagtttttttctt

SEQ ID NO: 626244 - DNA, 21 bp, Homo sapiens
aagtccatgtgataattgtaa

SEQ ID NO: 626245 - DNA, 18 bp, Homo sapiens
aagtcccttcctgtcctg

SEQ ID NO: 626246 - DNA, 22 bp, Homo sapiens
aagtctacctgccttgcctgtt

SEQ ID NO: 626247 - DNA, 22 bp, Homo sapiens
aagtctcaattctgaaggggaa

SEQ ID NO: 626248 - DNA, 15 bp, Homo sapiens
aagtctgagaaattt

SEQ ID NO: 626249 - DNA, 21 bp, Homo sapiens
aagtctgagaaatttacaaaa

SEQ ID NO: 626250 - DNA, 12 bp, Homo sapiens
aagtgacttatt

SEQ ID NO: 626251 - DNA, 17 bp, Homo sapiens
aagtgatgtgatttatg

SEQ ID NO: 626252 - DNA, 19 bp, Homo sapiens
aagtgatgtgatttatgca

SEQ ID NO: 626253 - DNA, 21 bp, Homo sapiens
aagtgatgtgatttatgcatt

SEQ ID NO: 626254 - DNA, 14 bp, Homo sapiens
aagtgattgacatt

SEQ ID NO: 626255 - DNA, 11 bp, Homo sapiens
aagtgcatgtt

SEQ ID NO: 626256 - DNA, 17 bp, Homo sapiens
aagtggaaggataatga

SEQ ID NO: 626257 - DNA, 15 bp, Homo sapiens
aagtggcaagctctt

SEQ ID NO: 626258 - DNA, 19 bp, Homo sapiens
aagtggcaagctcttcatt

SEQ ID NO: 626259 - DNA, 21 bp, Homo sapiens
aagtgtacatttgatttgata

SEQ ID NO: 626260 - DNA, 16 bp, Homo sapiens
aagtgtgtgtgcaatg

SEQ ID NO: 626261 - DNA, 17 bp, Homo sapiens
aagtgtgtgtgcaatgt

SEQ ID NO: 626262 - DNA, 17 bp, Homo sapiens
aagtgttctgtggctga

SEQ ID NO: 626263 - DNA, 21 bp, Homo sapiens
aagtgttggccatcatttcat

SEQ ID NO: 626264 - DNA, 22 bp, Homo sapiens
aagtgtttctagtaacagtatt

SEQ ID NO: 626265 - DNA, 14 bp, Homo sapiens
aagtgtttttacat

SEQ ID NO: 626266 - DNA, 12 bp, Homo sapiens
aagttcatcaaa

SEQ ID NO: 626267 - DNA, 19 bp, Homo sapiens
aagttcattcatactcaaa

SEQ ID NO: 626268 - DNA, 22 bp, Homo sapiens
aagttcattcatactcaaagag

SEQ ID NO: 626269 - DNA, 14 bp, Homo sapiens
aagttctattatct

SEQ ID NO: 626270 - DNA, 18 bp, Homo sapiens
aagttctattatctgggt

SEQ ID NO: 626271 - DNA, 21 bp, Homo sapiens
aagttctgtgcagtttggtat

SEQ ID NO: 626272 - DNA, 14 bp, Homo sapiens
aagttgaatgataa

SEQ ID NO: 626273 - DNA, 15 bp, Homo sapiens
aagttgtcctttctg

SEQ ID NO: 626274 - DNA, 15 bp, Homo sapiens
aagttgtgatctgtt

SEQ ID NO: 626275 - DNA, 19 bp, Homo sapiens
aagttgtgatctgttgtaa

SEQ ID NO: 626276 - DNA, 16 bp, Homo sapiens
aagttgtgattctttg

SEQ ID NO: 626277 - DNA, 12 bp, Homo sapiens
aagttgtgtgct

SEQ ID NO: 626278 - DNA, 22 bp, Homo sapiens
aagtttcgagagaaaggagggc

SEQ ID NO: 626279 - DNA, 13 bp, Homo sapiens
aagttttcagatt

SEQ ID NO: 626280 - DNA, 22 bp, Homo sapiens
aagttttcagattgtaaaggta

SEQ ID NO: 626281 - DNA, 15 bp, Homo sapiens
aagtttttggtaatg

SEQ ID NO: 626282 - DNA, 11 bp, Homo sapiens
aataaaaatag

SEQ ID NO: 626283 - DNA, 13 bp, Homo sapiens
aataaaaatagct

SEQ ID NO: 626284 - DNA, 21 bp, Homo sapiens
aataaagccttgtgatcactt

SEQ ID NO: 626285 - DNA, 16 bp, Homo sapiens
aataaatcatcctcat

SEQ ID NO: 626286 - DNA, 11 bp, Homo sapiens
aataacactgc

SEQ ID NO: 626287 - DNA, 15 bp, Homo sapiens
aataaccctgaatca

SEQ ID NO: 626288 - DNA, 20 bp, Homo sapiens
aataagaaacagtttaacag

SEQ ID NO: 626289 - DNA, 22 bp, Homo sapiens
aataagctcctaaattatagag

SEQ ID NO: 626290 - DNA, 15 bp, Homo sapiens
aataatacttcatac

SEQ ID NO: 626291 - DNA, 19 bp, Homo sapiens
aataatatgtacaaataat

SEQ ID NO: 626292 - DNA, 23 bp, Homo sapiens
aataatattgccttgatgtttct

SEQ ID NO: 626293 - DNA, 24 bp, Homo sapiens
aataatattgccttgatgtttcta

SEQ ID NO: 626294 - DNA, 20 bp, Homo sapiens
aataatgattcaatgtgaat

SEQ ID NO: 626295 - DNA, 12 bp, Homo sapiens
aataattaaaac

SEQ ID NO: 626296 - DNA, 21 bp, Homo sapiens
aatacatcattttttgtttct

SEQ ID NO: 626297 - DNA, 22 bp, Homo sapiens
aatacattctaaatcactttaa

SEQ ID NO: 626298 - DNA, 14 bp, Homo sapiens
aatacttcttttta

SEQ ID NO: 626299 - DNA, 12 bp, Homo sapiens
aatacttgaaaa

SEQ ID NO: 626300 - DNA, 19 bp, Homo sapiens
aatacttgacaacattttt

SEQ ID NO: 626301 - DNA, 14 bp, Homo sapiens
aatactttgtgtct

SEQ ID NO: 626302 - DNA, 12 bp, Homo sapiens
aatagaaaatat

SEQ ID NO: 626303 - DNA, 16 bp, Homo sapiens
aatagaataggcaaac

SEQ ID NO: 626304 - DNA, 14 bp, Homo sapiens
aatagagttttcct

SEQ ID NO: 626305 - DNA, 20 bp, Homo sapiens
aatagatgtgaaaatgcttt

SEQ ID NO: 626306 - DNA, 15 bp, Homo sapiens
aatagatttttagat

SEQ ID NO: 626307 - DNA, 18 bp, Homo sapiens
aatagcatgtattgtgtc

SEQ ID NO: 626308 - DNA, 19 bp, Homo sapiens
aatagcatgtattgtgtct

SEQ ID NO: 626309 - DNA, 22 bp, Homo sapiens
aatagctataaatagtgaaaat

SEQ ID NO: 626310 - DNA, 16 bp, Homo sapiens
aatagctgatagaaga

SEQ ID NO: 626311 - DNA, 16 bp, Homo sapiens
aataggaaaaactgat

SEQ ID NO: 626312 - DNA, 19 bp, Homo sapiens
aataggaaaaactgatttt

SEQ ID NO: 626313 - DNA, 23 bp, Homo sapiens
aatagtaaataatgattcaatgt

SEQ ID NO: 626314 - DNA, 18 bp, Homo sapiens
aatagtcatgtttctgca

SEQ ID NO: 626315 - DNA, 19 bp, Homo sapiens
aatagtgaaaattttattg

SEQ ID NO: 626316 - DNA, 20 bp, Homo sapiens
aatagttgagccagcagaca

SEQ ID NO: 626317 - DNA, 21 bp, Homo sapiens
aatagttgagccagcagacat

SEQ ID NO: 626318 - DNA, 23 bp, Homo sapiens
aatagtttctaaaccatgaaaag

SEQ ID NO: 626319 - DNA, 17 bp, Homo sapiens
aatataaactgtgagat

SEQ ID NO: 626320 - DNA, 21 bp, Homo sapiens
aatataaactgtgagataaat

SEQ ID NO: 626321 - DNA, 14 bp, Homo sapiens
aatataaatcacag

SEQ ID NO: 626322 - DNA, 14 bp, Homo sapiens
aatataacatgaaa

SEQ ID NO: 626323 - DNA, 17 bp, Homo sapiens
aatatacagtgtgtagt

SEQ ID NO: 626324 - DNA, 20 bp, Homo sapiens
aatatactcatttggatata

SEQ ID NO: 626325 - DNA, 15 bp, Homo sapiens
aatatactccttaaa

SEQ ID NO: 626326 - DNA, 19 bp, Homo sapiens
aatatactccttaaaaatg

SEQ ID NO: 626327 - DNA, 17 bp, Homo sapiens
aatatagtgttgtgtta

SEQ ID NO: 626328 - DNA, 16 bp, Homo sapiens
aatatcattatagcat

SEQ ID NO: 626329 - DNA, 19 bp, Homo sapiens
aatatctatttatctgtct

SEQ ID NO: 626330 - DNA, 22 bp, Homo sapiens
aatatctatttatctgtctgag

SEQ ID NO: 626331 - DNA, 23 bp, Homo sapiens
aatatctatttatctgtctgagc

SEQ ID NO: 626332 - DNA, 15 bp, Homo sapiens
aatatgagattggaa

SEQ ID NO: 626333 - DNA, 16 bp, Homo sapiens
aatatgcatatatatg

SEQ ID NO: 626334 - DNA, 17 bp, Homo sapiens
aatatgcatatatatgt

SEQ ID NO: 626335 - DNA, 15 bp, Homo sapiens
aatatgtacaaataa

SEQ ID NO: 626336 - DNA, 10 bp, Homo sapiens
aatattctgt

SEQ ID NO: 626337 - DNA, 12 bp, Homo sapiens
aatattgccttg

SEQ ID NO: 626338 - DNA, 14 bp, Homo sapiens
aatattgccttgat

SEQ ID NO: 626339 - DNA, 21 bp, Homo sapiens
aatattgccttgatgtttcta

SEQ ID NO: 626340 - DNA, 15 bp, Homo sapiens
aatattgctgatggt

SEQ ID NO: 626341 - DNA, 21 bp, Homo sapiens
aatattgctgatggtgcaatg

SEQ ID NO: 626342 - DNA, 23 bp, Homo sapiens
aatatttatagagttcatagaaa

SEQ ID NO: 626343 - DNA, 22 bp, Homo sapiens
aatatttgtggtttaactttgt

SEQ ID NO: 626344 - DNA, 21 bp, Homo sapiens
aatattttaggaaactctcca

SEQ ID NO: 626345 - DNA, 22 bp, Homo sapiens
aatattttcaagctttttgtga

SEQ ID NO: 626346 - DNA, 16 bp, Homo sapiens
aatattttcttaatta

SEQ ID NO: 626347 - DNA, 18 bp, Homo sapiens
aatcaagtctgtgaaagt

SEQ ID NO: 626348 - DNA, 20 bp, Homo sapiens
aatcaagtctgtgaaagtct

SEQ ID NO: 626349 - DNA, 23 bp, Homo sapiens
aatcaatgttcacgcaacttgaa

SEQ ID NO: 626350 - DNA, 19 bp, Homo sapiens
aatcaccctgactgtgggg

SEQ ID NO: 626351 - DNA, 23 bp, Homo sapiens
aatcaccgaaaacgtggctgctt

SEQ ID NO: 626352 - DNA, 19 bp, Homo sapiens
aatcatccttttttaaaaa

SEQ ID NO: 626353 - DNA, 21 bp, Homo sapiens
aatcatttccagcaaaatata

SEQ ID NO: 626354 - DNA, 22 bp, Homo sapiens
aatcatttccagcaaaatatat

SEQ ID NO: 626355 - DNA, 16 bp, Homo sapiens
aatcattttgatgtat

SEQ ID NO: 626356 - DNA, 16 bp, Homo sapiens
aatcattttgggaaat

SEQ ID NO: 626357 - DNA, 14 bp, Homo sapiens
aatccacagtattg

SEQ ID NO: 626358 - DNA, 15 bp, Homo sapiens
aatccacagtattgt

SEQ ID NO: 626359 - DNA, 19 bp, Homo sapiens
aatccacagtattgttctt

SEQ ID NO: 626360 - DNA, 21 bp, Homo sapiens
aatccacctggtggccctgcg

SEQ ID NO: 626361 - DNA, 13 bp, Homo sapiens
attcctgaccctc

SEQ ID NO: 626362 - DNA, 13 bp, Homo sapiens
attcctgtatgtt

SEQ ID NO: 626363 - DNA, 15 bp, Homo sapiens
attccttgcctgtca

SEQ ID NO: 626364 - DNA, 18 bp, Homo sapiens
attcgagcaaacaacttt

SEQ ID NO: 626365 - DNA, 14 bp, Homo sapiens
attcgtaagttctg

SEQ ID NO: 626366 - DNA, 16 bp, Homo sapiens
attcgtaagttctgtg

SEQ ID NO: 626367 - DNA, 20 bp, Homo sapiens
attcgtaagttctgtgcagt

SEQ ID NO: 626368 - DNA, 15 bp, Homo sapiens
attctaaatgttcat

SEQ ID NO: 626369 - DNA, 15 bp, Homo sapiens
attctataagagaca

SEQ ID NO: 626370 - DNA, 21 bp, Homo sapiens
attctcctttttacccctcta

SEQ ID NO: 626371 - DNA, 22 bp, Homo sapiens
attctgtcattggttacaaatt

SEQ ID NO: 626372 - DNA, 21 bp, Homo sapiens
attctgtttatgttcttgcag

SEQ ID NO: 626373 - DNA, 18 bp, Homo sapiens
attcttaccgaaatgaaa

SEQ ID NO: 626374 - DNA, 20 bp, Homo sapiens
attcttactgttctgaaatt

SEQ ID NO: 626375 - DNA, 14 bp, Homo sapiens
attcttgcactgta

SEQ ID NO: 626376 - DNA, 20 bp, Homo sapiens
attcttgcactgtatccaag

SEQ ID NO: 626377 - DNA, 21 bp, Homo sapiens
attctttcaatccacagtatt

SEQ ID NO: 626378 - DNA, 22 bp, Homo sapiens
attctttcaatccacagtattg

SEQ ID NO: 626379 - DNA, 18 bp, Homo sapiens
attctttgatatgttgat

SEQ ID NO: 626380 - DNA, 19 bp, Homo sapiens
attcttttttcaatgtact

SEQ ID NO: 626381 - DNA, 17 bp, Homo sapiens
attgaaagggacaagta

SEQ ID NO: 626382 - DNA, 12 bp, Homo sapiens
attgaaatcttt

SEQ ID NO: 626383 - DNA, 18 bp, Homo sapiens
attgaaatctttttgctt

SEQ ID NO: 626384 - DNA, 19 bp, Homo sapiens
attgaacactgcaccctcc

SEQ ID NO: 626385 - DNA, 16 bp, Homo sapiens
attgaaccgtcaatgt

SEQ ID NO: 626386 - DNA, 18 bp, Homo sapiens
attgaagtaagttcatca

SEQ ID NO: 626387 - DNA, 12 bp, Homo sapiens
attgacaagttt

SEQ ID NO: 626388 - DNA, 18 bp, Homo sapiens
attgacaataagaaacag

SEQ ID NO: 626389 - DNA, 20 bp, Homo sapiens
attgacaccaaatattttca

SEQ ID NO: 626390 - DNA, 22 bp, Homo sapiens
attgacgacctacatctgaaat

SEQ ID NO: 626391 - DNA, 15 bp, Homo sapiens
attgacttcagaaac

SEQ ID NO: 626392 - DNA, 15 bp, Homo sapiens
attgagacactgtca

SEQ ID NO: 626393 - DNA, 21 bp, Homo sapiens
attgataattcgagcaaacaa

SEQ ID NO: 626394 - DNA, 19 bp, Homo sapiens
attgcacacacagtctgtt

SEQ ID NO: 626395 - DNA, 13 bp, Homo sapiens
attgcactaaaag

SEQ ID NO: 626396 - DNA, 19 bp, Homo sapiens
attgcactgcagttattta

SEQ ID NO: 626397 - DNA, 22 bp, Homo sapiens
attgcacttcggataattttca

SEQ ID NO: 626398 - DNA, 23 bp, Homo sapiens
attgcacttcggataattttcat

SEQ ID NO: 626399 - DNA, 13 bp, Homo sapiens
attgccttgatgt

SEQ ID NO: 626400 - DNA, 15 bp, Homo sapiens
attgcctttgataat

SEQ ID NO: 626401 - DNA, 14 bp, Homo sapiens
attgctaaagtcag

SEQ ID NO: 626402 - DNA, 19 bp, Homo sapiens
attgctattgtttatagga

SEQ ID NO: 626403 - DNA, 17 bp, Homo sapiens
attgctgagatgtttag

SEQ ID NO: 626404 - DNA, 15 bp, Homo sapiens
attgctgatggtgca

SEQ ID NO: 626405 - DNA, 23 bp, Homo sapiens
attgctgatggtgcaatgacctt

SEQ ID NO: 626406 - DNA, 14 bp, Homo sapiens
attgctgtaaataa

SEQ ID NO: 626407 - DNA, 18 bp, Homo sapiens
attgctgtaaataaaaat

SEQ ID NO: 626408 - DNA, 21 bp, Homo sapiens
attgctgtaaataaaaatagc

SEQ ID NO: 626409 - DNA, 15 bp, Homo sapiens
attgctgtctgaaaa

SEQ ID NO: 626410 - DNA, 16 bp, Homo sapiens
attgctgtctgaaaaa

SEQ ID NO: 626411 - DNA, 14 bp, Homo sapiens
attgcttctctaaa

SEQ ID NO: 626412 - DNA, 17 bp, Homo sapiens
attgcttctctaaaaca

SEQ ID NO: 626413 - DNA, 14 bp, Homo sapiens
attgcttgagcatg

SEQ ID NO: 626414 - DNA, 23 bp, Homo sapiens
attggaagtatagatggtagaaa

SEQ ID NO: 626415 - DNA, 12 bp, Homo sapiens
attggcagcaga

SEQ ID NO: 626416 - DNA, 19 bp, Homo sapiens
attgggcccttagaatgtg

SEQ ID NO: 626417 - DNA, 15 bp, Homo sapiens
attgggggggcttgg

SEQ ID NO: 626418 - DNA, 23 bp, Homo sapiens
attgggtaagggactccagaagc

SEQ ID NO: 626419 - DNA, 17 bp, Homo sapiens
attggttaatgaaaaat

SEQ ID NO: 626420 - DNA, 19 bp, Homo sapiens
attgtaaaggtaggtgcat

SEQ ID NO: 626421 - DNA, 16 bp, Homo sapiens
attgtaaaggtgatga

SEQ ID NO: 626422 - DNA, 21 bp, Homo sapiens
attgtaaaggtgatgaattta

SEQ ID NO: 626423 - DNA, 15 bp, Homo sapiens
attgtaacagacatt

SEQ ID NO: 626424 - DNA, 18 bp, Homo sapiens
attgtaacagacattgtt

SEQ ID NO: 626425 - DNA, 18 bp, Homo sapiens
attgtatctcctttaata

SEQ ID NO: 626426 - DNA, 13 bp, Homo sapiens
attgtatcttcat

SEQ ID NO: 626427 - DNA, 13 bp, Homo sapiens
attgtatgttaat

SEQ ID NO: 626428 - DNA, 14 bp, Homo sapiens
attgtcaaatacag

SEQ ID NO: 626429 - DNA, 13 bp, Homo sapiens
attgtcagaatgt

SEQ ID NO: 626430 - DNA, 17 bp, Homo sapiens
attgtcctgtttcttca

SEQ ID NO: 626431 - DNA, 18 bp, Homo sapiens
attgtcttttgtcatgtg

SEQ ID NO: 626432 - DNA, 23 bp, Homo sapiens
attgtgaatgttgtcctgtgtca

SEQ ID NO: 626433 - DNA, 19 bp, Homo sapiens
attgtgagttaatttgata

SEQ ID NO: 626434 - DNA, 21 bp, Homo sapiens
attgtgttttcttcgtggatt

SEQ ID NO: 626435 - DNA, 12 bp, Homo sapiens
attgttatgtaa

SEQ ID NO: 626436 - DNA, 23 bp, Homo sapiens
attgttcagaaaagcacctcttg

SEQ ID NO: 626437 - DNA, 22 bp, Homo sapiens
attgttcttgtaaaactgtgac

SEQ ID NO: 626438 - DNA, 14 bp, Homo sapiens
attgtttgatgaat

SEQ ID NO: 626439 - DNA, 15 bp, Homo sapiens
atttaaaggaaagtt

SEQ ID NO: 626440 - DNA, 16 bp, Homo sapiens
atttaaaggaaagttc

SEQ ID NO: 626441 - DNA, 21 bp, Homo sapiens
atttaaaggaaagttctatta

SEQ ID NO: 626442 - DNA, 17 bp, Homo sapiens
atttaagtggactgtat

SEQ ID NO: 626443 - DNA, 19 bp, Homo sapiens
atttaagtggactgtattt

SEQ ID NO: 626444 - DNA, 21 bp, Homo sapiens
atttaagtggactgtatttcg

SEQ ID NO: 626445 - DNA, 18 bp, Homo sapiens
atttaatttgatatcaca

SEQ ID NO: 626446 - DNA, 21 bp, Homo sapiens
atttaccagaagtttaaatct

SEQ ID NO: 626447 - DNA, 12 bp, Homo sapiens
atttactatgta

SEQ ID NO: 626448 - DNA, 16 bp, Homo sapiens
atttactatgtaaatg

SEQ ID NO: 626449 - DNA, 16 bp, Homo sapiens
atttactcctcctgct

SEQ ID NO: 626450 - DNA, 14 bp, Homo sapiens
atttactgcaatgt

SEQ ID NO: 626451 - DNA, 12 bp, Homo sapiens
atttactgttta

SEQ ID NO: 626452 - DNA, 16 bp, Homo sapiens
atttactgtttataat

SEQ ID NO: 626453 - DNA, 21 bp, Homo sapiens
atttacttgttatgttgtaat

SEQ ID NO: 626454 - DNA, 15 bp, Homo sapiens
atttagaatgaatat

SEQ ID NO: 626455 - DNA, 16 bp, Homo sapiens
atttagcacagtattt

SEQ ID NO: 626456 - DNA, 17 bp, Homo sapiens
atttagcacagtattta

SEQ ID NO: 626457 - DNA, 20 bp, Homo sapiens
atttagcacagtatttaaca

SEQ ID NO: 626458 - DNA, 21 bp, Homo sapiens
atttagcacagtatttaacat

SEQ ID NO: 626459 - DNA, 16 bp, Homo sapiens
atttaggaatgctcaa

SEQ ID NO: 626460 - DNA, 22 bp, Homo sapiens
atttaggaatgctcaatgtgct

SEQ ID NO: 626461 - DNA, 16 bp, Homo sapiens
atttatcatatttaat

SEQ ID NO: 626462 - DNA, 22 bp, Homo sapiens
atttatcattttagtatagttt

SEQ ID NO: 626463 - DNA, 14 bp, Homo sapiens
atttatctgtctga

SEQ ID NO: 626464 - DNA, 13 bp, Homo sapiens
atttatgcatgag

SEQ ID NO: 626465 - DNA, 22 bp, Homo sapiens
atttatgcatgagaactaaata

SEQ ID NO: 626466 - DNA, 13 bp, Homo sapiens
atttatgcattta

SEQ ID NO: 626467 - DNA, 18 bp, Homo sapiens
atttatgcatttatgcat

SEQ ID NO: 626468 - DNA, 18 bp, Homo sapiens
atttatgtacaaaatgaa

SEQ ID NO: 626469 - DNA, 14 bp, Homo sapiens
atttattaaatgtt

SEQ ID NO: 626470 - DNA, 21 bp, Homo sapiens
atttattaaatttattaaatg

SEQ ID NO: 626471 - DNA, 22 bp, Homo sapiens
atttattaaatttattaaatgt

SEQ ID NO: 626472 - DNA, 14 bp, Homo sapiens
atttattattttca

SEQ ID NO: 626473 - DNA, 22 bp, Homo sapiens
atttcaaccacacctaaattaa

SEQ ID NO: 626474 - DNA, 13 bp, Homo sapiens
atttcaatcactg

SEQ ID NO: 626475 - DNA, 14 bp, Homo sapiens
atttcaatcactga

SEQ ID NO: 626476 - DNA, 21 bp, Homo sapiens
atttcaatttttaaatttctt

SEQ ID NO: 626477 - DNA, 18 bp, Homo sapiens
atttcagctgtgagcttt

SEQ ID NO: 626478 - DNA, 21 bp, Homo sapiens
atttcagtaagatcaagctcc

SEQ ID NO: 626479 - DNA, 14 bp, Homo sapiens
atttcataagcaca

SEQ ID NO: 626480 - DNA, 14 bp, Homo sapiens
atttcatacaaatt

SEQ ID NO: 626481 - DNA, 16 bp, Homo sapiens
atttcatgattagaca

SEQ ID NO: 626482 - DNA, 17 bp, Homo sapiens
atttcatgattagacaa

SEQ ID NO: 626483 - DNA, 23 bp, Homo sapiens
atttcccaacccaggattcaaca

SEQ ID NO: 626484 - DNA, 14 bp, Homo sapiens
atttcggctatgtc

SEQ ID NO: 626485 - DNA, 21 bp, Homo sapiens
atttctaccattaaaatcttg

SEQ ID NO: 626486 - DNA, 18 bp, Homo sapiens
atttctattttgcagcag

SEQ ID NO: 626487 - DNA, 16 bp, Homo sapiens
atttctgctgaatttt

SEQ ID NO: 626488 - DNA, 22 bp, Homo sapiens
atttctgctgaattttcacatg

SEQ ID NO: 626489 - DNA, 18 bp, Homo sapiens
atttctgtgtcctgtttt

SEQ ID NO: 626490 - DNA, 18 bp, Homo sapiens
atttcttctctctgtgct

SEQ ID NO: 626491 - DNA, 17 bp, Homo sapiens
atttcttggtgctttgt

SEQ ID NO: 626492 - DNA, 13 bp, Homo sapiens
atttgaaatgttt

SEQ ID NO: 626493 - DNA, 20 bp, Homo sapiens
atttgacacactcaccattt

SEQ ID NO: 626494 - DNA, 20 bp, Homo sapiens
atttgacattgtcagaatgt

SEQ ID NO: 626495 - DNA, 22 bp, Homo sapiens
atttgacattgtcagaatgttg

SEQ ID NO: 626496 - DNA, 18 bp, Homo sapiens
atttgactttctgtctgt

SEQ ID NO: 626497 - DNA, 18 bp, Homo sapiens
atttgagctgcctggagg

SEQ ID NO: 626498 - DNA, 17 bp, Homo sapiens
atttgatatacagacct

SEQ ID NO: 626499 - DNA, 21 bp, Homo sapiens
atttgatatacagacctccag

SEQ ID NO: 626500 - DNA, 22 bp, Homo sapiens
atttgatatacagacctccaga

SEQ ID NO: 626501 - DNA, 23 bp, Homo sapiens
atttgatatacagacctccagat

SEQ ID NO: 626502 - DNA, 19 bp, Homo sapiens
atttgatttgatatacaga

SEQ ID NO: 626503 - DNA, 18 bp, Homo sapiens
atttgatttgcaacactg

SEQ ID NO: 626504 - DNA, 13 bp, Homo sapiens
atttgcaacactg

SEQ ID NO: 626505 - DNA, 14 bp, Homo sapiens
atttgcaacactgc

SEQ ID NO: 626506 - DNA, 18 bp, Homo sapiens
atttgcataatatgcata

SEQ ID NO: 626507 - DNA, 23 bp, Homo sapiens
atttgccagacagagatcagaat

SEQ ID NO: 626508 - DNA, 17 bp, Homo sapiens
atttgctagttctgctg

SEQ ID NO: 626509 - DNA, 19 bp, Homo sapiens
atttgctagttctgctgcc

SEQ ID NO: 626510 - DNA, 16 bp, Homo sapiens
atttgctcataagtaa

SEQ ID NO: 626511 - DNA, 19 bp, Homo sapiens
atttgctcataagtaaatg

SEQ ID NO: 626512 - DNA, 21 bp, Homo sapiens
atttgctgaataacaacaatt

SEQ ID NO: 626513 - DNA, 16 bp, Homo sapiens
atttggatataaatct

SEQ ID NO: 626514 - DNA, 17 bp, Homo sapiens
atttggatataaatctt

SEQ ID NO: 626515 - DNA, 13 bp, Homo sapiens
atttggattttaa

SEQ ID NO: 626516 - DNA, 21 bp, Homo sapiens
atttggattttaaacaaaatt

SEQ ID NO: 626517 - DNA, 17 bp, Homo sapiens
atttgggctcagggttg

SEQ ID NO: 626518 - DNA, 21 bp, Homo sapiens
atttgggtattttgtcagttt

SEQ ID NO: 626519 - DNA, 16 bp, Homo sapiens
atttgtattaatgtag

SEQ ID NO: 626520 - DNA, 18 bp, Homo sapiens
atttgtggtttaactttg

SEQ ID NO: 626521 - DNA, 12 bp, Homo sapiens
atttgtgtaact

SEQ ID NO: 626522 - DNA, 15 bp, Homo sapiens
atttgtgtaactgaa

SEQ ID NO: 626523 - DNA, 17 bp, Homo sapiens
atttgttaatgattctt

SEQ ID NO: 626524 - DNA, 11 bp, Homo sapiens
atttgtttcat

SEQ ID NO: 626525 - DNA, 14 bp, Homo sapiens
attttaaaatgcaa

SEQ ID NO: 626526 - DNA, 15 bp, Homo sapiens
attttaaatggacag

SEQ ID NO: 626527 - DNA, 15 bp, Homo sapiens
attttagctaattta

SEQ ID NO: 626528 - DNA, 16 bp, Homo sapiens
attttaggaaagttgt

SEQ ID NO: 626529 - DNA, 21 bp, Homo sapiens
attttaggaaatgaatgtgtg

SEQ ID NO: 626530 - DNA, 13 bp, Homo sapiens
attttatctcttc

SEQ ID NO: 626531 - DNA, 12 bp, Homo sapiens
attttatgttta

SEQ ID NO: 626532 - DNA, 17 bp, Homo sapiens
attttatgtttaaaatg

SEQ ID NO: 626533 - DNA, 21 bp, Homo sapiens
attttatgtttaaaatggcat

SEQ ID NO: 626534 - DNA, 13 bp, Homo sapiens
attttattgaata

SEQ ID NO: 626535 - DNA, 16 bp, Homo sapiens
attttattgaatataa

SEQ ID NO: 626536 - DNA, 20 bp, Homo sapiens
attttattgtaacagacatt

SEQ ID NO: 626537 - DNA, 14 bp, Homo sapiens
attttcaagctttt

SEQ ID NO: 626538 - DNA, 16 bp, Homo sapiens
attttcacatgaacat

SEQ ID NO: 626539 - DNA, 17 bp, Homo sapiens
attttcacatgaacata

SEQ ID NO: 626540 - DNA, 16 bp, Homo sapiens
attttcagatccttcc

SEQ ID NO: 626541 - DNA, 15 bp, Homo sapiens
attttcattatttca

SEQ ID NO: 626542 - DNA, 21 bp, Homo sapiens
attttcccccttgcagttatg

SEQ ID NO: 626543 - DNA, 13 bp, Homo sapiens
attttcctttttt

SEQ ID NO: 626544 - DNA, 22 bp, Homo sapiens
attttccttttttatacacata

SEQ ID NO: 626545 - DNA, 14 bp, Homo sapiens
attttctctcctcg

SEQ ID NO: 626546 - DNA, 18 bp, Homo sapiens
attttctctcctcggtgg

SEQ ID NO: 626547 - DNA, 18 bp, Homo sapiens
attttctgagtagcatat

SEQ ID NO: 626548 - DNA, 16 bp, Homo sapiens
attttctgtaattctt

SEQ ID NO: 626549 - DNA, 21 bp, Homo sapiens
attttctgtaattcttctcct

SEQ ID NO: 626550 - DNA, 18 bp, Homo sapiens
attttctgtgttgttcat

SEQ ID NO: 626551 - DNA, 19 bp, Homo sapiens
attttctgtgttgttcata

SEQ ID NO: 626552 - DNA, 23 bp, Homo sapiens
attttcttctttaatttttctgt

SEQ ID NO: 626553 - DNA, 20 bp, Homo sapiens
attttgagccttattaaaat

SEQ ID NO: 626554 - DNA, 21 bp, Homo sapiens
attttgattgtttgatgaata

SEQ ID NO: 626555 - DNA, 21 bp, Homo sapiens
attttggaagaattcatgatg

SEQ ID NO: 626556 - DNA, 18 bp, Homo sapiens
attttggacgtgtgagga

SEQ ID NO: 626557 - DNA, 23 bp, Homo sapiens
attttgggaaattcttgcactgt

SEQ ID NO: 626558 - DNA, 16 bp, Homo sapiens
attttggtttttctca

SEQ ID NO: 626559 - DNA, 22 bp, Homo sapiens
attttggtttttctcatttgaa

SEQ ID NO: 626560 - DNA, 14 bp, Homo sapiens
attttgtagctagt

SEQ ID NO: 626561 - DNA, 20 bp, Homo sapiens
attttgtctgcttagtatct

SEQ ID NO: 626562 - DNA, 16 bp, Homo sapiens
atttttaactgcttca

SEQ ID NO: 626563 - DNA, 21 bp, Homo sapiens
atttttactcaggctttctat

SEQ ID NO: 626564 - DNA, 23 bp, Homo sapiens
atttttactcaggctttctattg

SEQ ID NO: 626565 - DNA, 12 bp, Homo sapiens
atttttattcat

SEQ ID NO: 626566 - DNA, 15 bp, Homo sapiens
atttttattcataag

SEQ ID NO: 626567 - DNA, 18 bp, Homo sapiens
atttttctactgctcttt

SEQ ID NO: 626568 - DNA, 14 bp, Homo sapiens
atttttctgcactg

SEQ ID NO: 626569 - DNA, 16 bp, Homo sapiens
atttttctgcactgag

SEQ ID NO: 626570 - DNA, 19 bp, Homo sapiens
atttttctgggaagaaaat

SEQ ID NO: 626571 - DNA, 19 bp, Homo sapiens
atttttgtaatataagaca

SEQ ID NO: 626572 - DNA, 20 bp, Homo sapiens
attttttcctgctagtgtag

SEQ ID NO: 626573 - DNA, 21 bp, Homo sapiens
attttttgtctgtgataacag

SEQ ID NO: 626574 - DNA, 18 bp, Homo sapiens
atttttttattgtttaaa

SEQ ID NO: 626575 - DNA, 16 bp, Homo sapiens
atttttttccagaatt

SEQ ID NO: 626576 - DNA, 23 bp, Homo sapiens
atttttttgtagatgaaaaagca

SEQ ID NO: 626577 - DNA, 15 bp, Homo sapiens
attttttttcttcca

SEQ ID NO: 626578 - DNA, 24 bp, Homo sapiens
attttttttcttccaacatgtgat

SEQ ID NO: 626579 - DNA, 16 bp, Homo sapiens
atttttttttccttca

SEQ ID NO: 626580 - DNA, 23 bp, Homo sapiens
atttttttttccttcagtgcctt

SEQ ID NO: 626581 - DNA, 20 bp, Homo sapiens
caaaaaaaagaaagaaaaaa

SEQ ID NO: 626582 - DNA, 14 bp, Homo sapiens
caaaaactttccat

SEQ ID NO: 626583 - DNA, 18 bp, Homo sapiens
caaaaactttccatgaca

SEQ ID NO: 626584 - DNA, 24 bp, Homo sapiens
caaaaactttccatgacagtagca

SEQ ID NO: 626585 - DNA, 13 bp, Homo sapiens
caaaacaacagca

SEQ ID NO: 626586 - DNA, 15 bp, Homo sapiens
caaaacaacagcaac

SEQ ID NO: 626587 - DNA, 16 bp, Homo sapiens
caaaacaacagcaaca

SEQ ID NO: 626588 - DNA, 21 bp, Homo sapiens
caaaaggatgatttaacatta

SEQ ID NO: 626589 - DNA, 23 bp, Homo sapiens
caaaaggctggatgtgctttcat

SEQ ID NO: 626590 - DNA, 16 bp, Homo sapiens
caaaagtactagcaat

SEQ ID NO: 626591 - DNA, 20 bp, Homo sapiens
caaaagtactagcaataagt

SEQ ID NO: 626592 - DNA, 15 bp, Homo sapiens
caaaataaaaccaga

SEQ ID NO: 626593 - DNA, 18 bp, Homo sapiens
caaaatagtcatgtttct

SEQ ID NO: 626594 - DNA, 19 bp, Homo sapiens
caaaatagtcatgtttctg

SEQ ID NO: 626595 - DNA, 22 bp, Homo sapiens
caaaatagtcatgtttctgcag

SEQ ID NO: 626596 - DNA, 18 bp, Homo sapiens
caaaatatatgtttggct

SEQ ID NO: 626597 - DNA, 23 bp, Homo sapiens
caaaatatatgtttggctgaaat

SEQ ID NO: 626598 - DNA, 12 bp, Homo sapiens
caaaatgaattg

SEQ ID NO: 626599 - DNA, 21 bp, Homo sapiens
caaacaaatcattttgatgta

SEQ ID NO: 626600 - DNA, 10 bp, Homo sapiens
caaacattta

SEQ ID NO: 626601 - DNA, 16 bp, Homo sapiens
caaaccatcattgaaa

SEQ ID NO: 626602 - DNA, 17 bp, Homo sapiens
caaaccatcattgaaat

SEQ ID NO: 626603 - DNA, 21 bp, Homo sapiens
caaaccatcattgaaatcttt

SEQ ID NO: 626604 - DNA, 13 bp, Homo sapiens
caaacctactgcc

SEQ ID NO: 626605 - DNA, 19 bp, Homo sapiens
caaactctctagtgcagga

SEQ ID NO: 626606 - DNA, 23 bp, Homo sapiens
caaactctctagtgcaggaaaag

SEQ ID NO: 626607 - DNA, 16 bp, Homo sapiens
caaacttttataaatg

SEQ ID NO: 626608 - DNA, 15 bp, Homo sapiens
caaacttttatgcag

SEQ ID NO: 626609 - DNA, 18 bp, Homo sapiens
caaagaaacaaaatataa

SEQ ID NO: 626610 - DNA, 21 bp, Homo sapiens
caaagaaacaaaatataaatc

SEQ ID NO: 626611 - DNA, 15 bp, Homo sapiens
caaagaacccccctc

SEQ ID NO: 626612 - DNA, 16 bp, Homo sapiens
caaagaacccccctcc

SEQ ID NO: 626613 - DNA, 19 bp, Homo sapiens
caaagaacccccctcccca

SEQ ID NO: 626614 - DNA, 22 bp, Homo sapiens
caaagaactgccccatctcctc

SEQ ID NO: 626615 - DNA, 22 bp, Homo sapiens
caaagaatcacctaattaattt

SEQ ID NO: 626616 - DNA, 18 bp, Homo sapiens
caaagaggccagtacttt

SEQ ID NO: 626617 - DNA, 22 bp, Homo sapiens
caaagcagtatgtacaggctga

SEQ ID NO: 626618 - DNA, 20 bp, Homo sapiens
caaagcatgctcagtattga

SEQ ID NO: 626619 - DNA, 20 bp, Homo sapiens
caaagccagctctgagcaga

SEQ ID NO: 626620 - DNA, 23 bp, Homo sapiens
caaagccctccctgtctgtctgt

SEQ ID NO: 626621 - DNA, 12 bp, Homo sapiens
caaagctattta

SEQ ID NO: 626622 - DNA, 18 bp, Homo sapiens
caaagctatttaagtgga

SEQ ID NO: 626623 - DNA, 22 bp, Homo sapiens
caaagctatttaagtggactgt

SEQ ID NO: 626624 - DNA, 23 bp, Homo sapiens
caaagggaaggctgctgtgtagc

SEQ ID NO: 626625 - DNA, 13 bp, Homo sapiens
caaaggtgcctca

SEQ ID NO: 626626 - DNA, 20 bp, Homo sapiens
caaagtgaaattagtatttt

SEQ ID NO: 626627 - DNA, 23 bp, Homo sapiens
caaagtgaaattagtattttgag

SEQ ID NO: 626628 - DNA, 21 bp, Homo sapiens
caaagtgttgtcttattccta

SEQ ID NO: 626629 - DNA, 13 bp, Homo sapiens
caaagttttcaga

SEQ ID NO: 626630 - DNA, 14 bp, Homo sapiens
caaagttttcagat

SEQ ID NO: 626631 - DNA, 11 bp, Homo sapiens
caaataacagt

SEQ ID NO: 626632 - DNA, 11 bp, Homo sapiens
caaataatatt

SEQ ID NO: 626633 - DNA, 17 bp, Homo sapiens
caaatacacatacatat

SEQ ID NO: 626634 - DNA, 15 bp, Homo sapiens
caaatacattccagt

SEQ ID NO: 626635 - DNA, 22 bp, Homo sapiens
caaatagcttttcacttcttaa

SEQ ID NO: 626636 - DNA, 16 bp, Homo sapiens
caaatagggcaaagaa

SEQ ID NO: 626637 - DNA, 20 bp, Homo sapiens
caaatagggcaaagaatcaa

SEQ ID NO: 626638 - DNA, 12 bp, Homo sapiens
caaatataacat

SEQ ID NO: 626639 - DNA, 21 bp, Homo sapiens
caaatataacatgaaagtcaa

SEQ ID NO: 626640 - DNA, 21 bp, Homo sapiens
caaatatgattctcctctccc

SEQ ID NO: 626641 - DNA, 14 bp, Homo sapiens
caaatattttcaag

SEQ ID NO: 626642 - DNA, 20 bp, Homo sapiens
caaatcattttgatgtatta

SEQ ID NO: 626643 - DNA, 22 bp, Homo sapiens
caaatctcaaaagatctcctgt

SEQ ID NO: 626644 - DNA, 14 bp, Homo sapiens
caaatctgctttca

SEQ ID NO: 626645 - DNA, 14 bp, Homo sapiens
caaatggatgtaat

SEQ ID NO: 626646 - DNA, 12 bp, Homo sapiens
caaatgtcattt

SEQ ID NO: 626647 - DNA, 13 bp, Homo sapiens
caaatgtcatttc

SEQ ID NO: 626648 - DNA, 18 bp, Homo sapiens
caaatgtcatttcataca

SEQ ID NO: 626649 - DNA, 21 bp, Homo sapiens
caaatgtcatttcatacaaat

SEQ ID NO: 626650 - DNA, 21 bp, Homo sapiens
caaatgtgtcttgtattatca

SEQ ID NO: 626651 - DNA, 13 bp, Homo sapiens
caaattccttccc

SEQ ID NO: 626652 - DNA, 12 bp, Homo sapiens
caaattgctgag

SEQ ID NO: 626653 - DNA, 13 bp, Homo sapiens
caaattgctgaga

SEQ ID NO: 626654 - DNA, 22 bp, Homo sapiens
caaattgtcttttgtcatgtgg

SEQ ID NO: 626655 - DNA, 14 bp, Homo sapiens
caaatttttactca

SEQ ID NO: 626656 - DNA, 19 bp, Homo sapiens
caaatttttactcaggctt

SEQ ID NO: 626657 - DNA, 22 bp, Homo sapiens
caaatttttactcaggctttct

SEQ ID NO: 626658 - DNA, 14 bp, Homo sapiens
caacaaagaaatat

SEQ ID NO: 626659 - DNA, 17 bp, Homo sapiens
caacaaagcatgctcag

SEQ ID NO: 626660 - DNA, 12 bp, Homo sapiens
caacaacaaagc

SEQ ID NO: 626661 - DNA, 18 bp, Homo sapiens
caacaatactttgtgtct

SEQ ID NO: 626662 - DNA, 22 bp, Homo sapiens
caacaatttaggaatgctcaat

SEQ ID NO: 626663 - DNA, 21 bp, Homo sapiens
caacacacacacacacaaaac

SEQ ID NO: 626664 - DNA, 19 bp, Homo sapiens
caacacattgaaactgtat

SEQ ID NO: 626665 - DNA, 22 bp, Homo sapiens
caacactgccaaacatcagtca

SEQ ID NO: 626666 - DNA, 12 bp, Homo sapiens
caacagaacaac

SEQ ID NO: 626667 - DNA, 16 bp, Homo sapiens
caacagaacaacaaca

SEQ ID NO: 626668 - DNA, 13 bp, Homo sapiens
caaccatgttctt

SEQ ID NO: 626669 - DNA, 16 bp, Homo sapiens
caacccaggtgttgtc

SEQ ID NO: 626670 - DNA, 12 bp, Homo sapiens
caacccccacct

SEQ ID NO: 626671 - DNA, 13 bp, Homo sapiens
caacccccacctc

SEQ ID NO: 626672 - DNA, 14 bp, Homo sapiens
caacccccacctcc

SEQ ID NO: 626673 - DNA, 18 bp, Homo sapiens
caacccccacctcccggt

SEQ ID NO: 626674 - DNA, 15 bp, Homo sapiens
caaccctgccctgca

SEQ ID NO: 626675 - DNA, 19 bp, Homo sapiens
caacctcccctggtcctgc

SEQ ID NO: 626676 - DNA, 14 bp, Homo sapiens
caacctgcccctcc

SEQ ID NO: 626677 - DNA, 21 bp, Homo sapiens
caacctgttcacgtgactcct

SEQ ID NO: 626678 - DNA, 23 bp, Homo sapiens
caacctgttcacgtgactcctca

SEQ ID NO: 626679 - DNA, 16 bp, Homo sapiens
caacgggaacacctgc

SEQ ID NO: 626680 - DNA, 15 bp, Homo sapiens
caactaagttgtatt

SEQ ID NO: 626681 - DNA, 14 bp, Homo sapiens
caactatattgcga

SEQ ID NO: 626682 - DNA, 23 bp, Homo sapiens
caactccagggttaaagaaaggc

SEQ ID NO: 626683 - DNA, 13 bp, Homo sapiens
caactctgactgt

SEQ ID NO: 626684 - DNA, 18 bp, Homo sapiens
caactggaaggctttatt

SEQ ID NO: 626685 - DNA, 18 bp, Homo sapiens
caactgtctatttctgct

SEQ ID NO: 626686 - DNA, 14 bp, Homo sapiens
caactgtggataaa

SEQ ID NO: 626687 - DNA, 18 bp, Homo sapiens
caactgtggataaatttt

SEQ ID NO: 626688 - DNA, 22 bp, Homo sapiens
caactgtggataaattttggaa

SEQ ID NO: 626689 - DNA, 14 bp, Homo sapiens
caacttaaacctgt

SEQ ID NO: 626690 - DNA, 19 bp, Homo sapiens
caacttaaacctgtgcttt

SEQ ID NO: 626691 - DNA, 17 bp, Homo sapiens
caacttacatatgtctt

SEQ ID NO: 626692 - DNA, 13 bp, Homo sapiens
caactttgctttt

SEQ ID NO: 626693 - DNA, 20 bp, Homo sapiens
caagaagatagttgtaaaga

SEQ ID NO: 626694 - DNA, 14 bp, Homo sapiens
caagaagtgggatt

SEQ ID NO: 626695 - DNA, 18 bp, Homo sapiens
caagacagccatacttcc

SEQ ID NO: 626696 - DNA, 16 bp, Homo sapiens
caagagaccacttcct

SEQ ID NO: 626697 - DNA, 19 bp, Homo sapiens
caagagaccacttccttaa

SEQ ID NO: 626698 - DNA, 20 bp, Homo sapiens
caagagaccacttccttaac

SEQ ID NO: 626699 - DNA, 15 bp, Homo sapiens
caagagctcaggaga

SEQ ID NO: 626700 - DNA, 22 bp, Homo sapiens
caagagctcaggagaaggcctg

SEQ ID NO: 626701 - DNA, 17 bp, Homo sapiens
caagaggtttcagcatt

SEQ ID NO: 626702 - DNA, 12 bp, Homo sapiens
caagattttgtt

SEQ ID NO: 626703 - DNA, 13 bp, Homo sapiens
caagcaaactgaa

SEQ ID NO: 626704 - DNA, 15 bp, Homo sapiens
caagcaaactgaaat

SEQ ID NO: 626705 - DNA, 18 bp, Homo sapiens
caagcaccctgttccctc

SEQ ID NO: 626706 - DNA, 16 bp, Homo sapiens
caagcagacacacaca

SEQ ID NO: 626707 - DNA, 13 bp, Homo sapiens
caagccaggagac

SEQ ID NO: 626708 - DNA, 16 bp, Homo sapiens
caagccagggttccag

SEQ ID NO: 626709 - DNA, 20 bp, Homo sapiens
caagccagggttccagacag

SEQ ID NO: 626710 - DNA, 17 bp, Homo sapiens
caagctaatgtggtagt

SEQ ID NO: 626711 - DNA, 18 bp, Homo sapiens
caagctataaaagcccat

SEQ ID NO: 626712 - DNA, 20 bp, Homo sapiens
caaggaagctttggaagcag

SEQ ID NO: 626713 - DNA, 14 bp, Homo sapiens
caaggagctactga

SEQ ID NO: 626714 - DNA, 14 bp, Homo sapiens
caaggatcctgagc

SEQ ID NO: 626715 - DNA, 16 bp, Homo sapiens
caaggatcctgagcca

SEQ ID NO: 626716 - DNA, 21 bp, Homo sapiens
aggaggagccttgctgggcca

SEQ ID NO: 626717 - DNA, 13 bp, Homo sapiens
aggaggaggagcc

SEQ ID NO: 626718 - DNA, 18 bp, Homo sapiens
aggaggccgactgggctg

SEQ ID NO: 626719 - DNA, 20 bp, Homo sapiens
aggaggccgactgggctgct

SEQ ID NO: 626720 - DNA, 14 bp, Homo sapiens
aggagggtgcccct

SEQ ID NO: 626721 - DNA, 18 bp, Homo sapiens
aggagggtgcccctggga

SEQ ID NO: 626722 - DNA, 17 bp, Homo sapiens
aggaggtgtggagtgga

SEQ ID NO: 626723 - DNA, 18 bp, Homo sapiens
aggaggtgtggagtggag

SEQ ID NO: 626724 - DNA, 19 bp, Homo sapiens
aggaggtgtggagtggagg

SEQ ID NO: 626725 - DNA, 17 bp, Homo sapiens
aggagtgcgctagagca

SEQ ID NO: 626726 - DNA, 20 bp, Homo sapiens
aggataaattaatgagtttt

SEQ ID NO: 626727 - DNA, 15 bp, Homo sapiens
aggataatgagatgt

SEQ ID NO: 626728 - DNA, 19 bp, Homo sapiens
aggatcacttgagcccaga

SEQ ID NO: 626729 - DNA, 15 bp, Homo sapiens
aggatcctgagccag

SEQ ID NO: 626730 - DNA, 22 bp, Homo sapiens
aggatgaaggggccagaccacg

SEQ ID NO: 626731 - DNA, 12 bp, Homo sapiens
aggatgcatatt

SEQ ID NO: 626732 - DNA, 12 bp, Homo sapiens
aggatgtatgtg

SEQ ID NO: 626733 - DNA, 15 bp, Homo sapiens
aggatgtatgtgtat

SEQ ID NO: 626734 - DNA, 16 bp, Homo sapiens
aggatgtggatggagg

SEQ ID NO: 626735 - DNA, 15 bp, Homo sapiens
aggattcctccccca

SEQ ID NO: 626736 - DNA, 17 bp, Homo sapiens
aggattcttttttcaat

SEQ ID NO: 626737 - DNA, 16 bp, Homo sapiens
aggcaaacttttatgc

SEQ ID NO: 626738 - DNA, 13 bp, Homo sapiens
aggcaagaagtgg

SEQ ID NO: 626739 - DNA, 17 bp, Homo sapiens
aggcaagaagtgggatt

SEQ ID NO: 626740 - DNA, 14 bp, Homo sapiens
aggcagaatggtgg

SEQ ID NO: 626741 - DNA, 21 bp, Homo sapiens
aggcagaatggtgggctccag

SEQ ID NO: 626742 - DNA, 21 bp, Homo sapiens
aggcagattaataacagaaat

SEQ ID NO: 626743 - DNA, 23 bp, Homo sapiens
aggcagattaataacagaaatac

SEQ ID NO: 626744 - DNA, 12 bp, Homo sapiens
aggcagcctgtg

SEQ ID NO: 626745 - DNA, 18 bp, Homo sapiens
aggcagcctgtgggtcct

SEQ ID NO: 626746 - DNA, 19 bp, Homo sapiens
aggcagcctgtgggtcctt

SEQ ID NO: 626747 - DNA, 19 bp, Homo sapiens
aggcagctaggcagggagg

SEQ ID NO: 626748 - DNA, 13 bp, Homo sapiens
aggcagctgcagt

SEQ ID NO: 626749 - DNA, 20 bp, Homo sapiens
aggcagggagggggctggga

SEQ ID NO: 626750 - DNA, 20 bp, Homo sapiens
aggcaggtgggggctgcgtc

SEQ ID NO: 626751 - DNA, 23 bp, Homo sapiens
aggcaggtgggggctgcgtccct

SEQ ID NO: 626752 - DNA, 22 bp, Homo sapiens
aggcagtagatcattttttgtc

SEQ ID NO: 626753 - DNA, 17 bp, Homo sapiens
aggcatgtgatgagagg

SEQ ID NO: 626754 - DNA, 20 bp, Homo sapiens
aggcatgtgatgagaggaaa

SEQ ID NO: 626755 - DNA, 24 bp, Homo sapiens
aggcatgtgatgagaggaaatcac

SEQ ID NO: 626756 - DNA, 19 bp, Homo sapiens
aggccaaatgagttccctt

SEQ ID NO: 626757 - DNA, 12 bp, Homo sapiens
aggccagggccg

SEQ ID NO: 626758 - DNA, 23 bp, Homo sapiens
aggccattcagtctatgctgtgt

SEQ ID NO: 626759 - DNA, 13 bp, Homo sapiens
aggcccagcagac

SEQ ID NO: 626760 - DNA, 19 bp, Homo sapiens
aggcccagccctgggcaag

SEQ ID NO: 626761 - DNA, 21 bp, Homo sapiens
aggcccccggaggcgcccacc

SEQ ID NO: 626762 - DNA, 16 bp, Homo sapiens
aggcccgtgggcgcaa

SEQ ID NO: 626763 - DNA, 16 bp, Homo sapiens
aggccgactgggctgc

SEQ ID NO: 626764 - DNA, 19 bp, Homo sapiens
aggccgactgggctgctgg

SEQ ID NO: 626765 - DNA, 19 bp, Homo sapiens
aggcctccctcgggctggt

SEQ ID NO: 626766 - DNA, 15 bp, Homo sapiens
aggcctgagggaagc

SEQ ID NO: 626767 - DNA, 19 bp, Homo sapiens
aggcctgagttagctgttt

SEQ ID NO: 626768 - DNA, 16 bp, Homo sapiens
aggcctgccccccttc

SEQ ID NO: 626769 - DNA, 22 bp, Homo sapiens
aggcctgccccccttcccaccc

SEQ ID NO: 626770 - DNA, 23 bp, Homo sapiens
aggcctgccccccttcccacccc

SEQ ID NO: 626771 - DNA, 14 bp, Homo sapiens
aggcctggtctgga

SEQ ID NO: 626772 - DNA, 15 bp, Homo sapiens
aggcctttccccagt

SEQ ID NO: 626773 - DNA, 16 bp, Homo sapiens
aggcgcccacctgccc

SEQ ID NO: 626774 - DNA, 12 bp, Homo sapiens
aggcgcgcaccg

SEQ ID NO: 626775 - DNA, 15 bp, Homo sapiens
aggcgcgcaccgccc

SEQ ID NO: 626776 - DNA, 13 bp, Homo sapiens
aggcggagggtct

SEQ ID NO: 626777 - DNA, 22 bp, Homo sapiens
aggcggagggtctccctgggca

SEQ ID NO: 626778 - DNA, 17 bp, Homo sapiens
aggcgtgggatccagag

SEQ ID NO: 626779 - DNA, 14 bp, Homo sapiens
aggctacaggtgcc

SEQ ID NO: 626780 - DNA, 15 bp, Homo sapiens
aggctacaggtgccc

SEQ ID NO: 626781 - DNA, 18 bp, Homo sapiens
aggctacaggtgccccac

SEQ ID NO: 626782 - DNA, 17 bp, Homo sapiens
aggctcccactgcccct

SEQ ID NO: 626783 - DNA, 15 bp, Homo sapiens
aggctctgaatctct

SEQ ID NO: 626784 - DNA, 15 bp, Homo sapiens
aggctgagacacagc

SEQ ID NO: 626785 - DNA, 16 bp, Homo sapiens
aggctgagacacagcc

SEQ ID NO: 626786 - DNA, 20 bp, Homo sapiens
aggctgcagctaatttgtga

SEQ ID NO: 626787 - DNA, 23 bp, Homo sapiens
aggctgcagctaatttgtgaaag

SEQ ID NO: 626788 - DNA, 17 bp, Homo sapiens
aggctgccccaggggca

SEQ ID NO: 626789 - DNA, 16 bp, Homo sapiens
aggctgcctcagccag

SEQ ID NO: 626790 - DNA, 18 bp, Homo sapiens
aggctgcctcagccagtg

SEQ ID NO: 626791 - DNA, 22 bp, Homo sapiens
aggctgcctcagccagtggcac

SEQ ID NO: 626792 - DNA, 23 bp, Homo sapiens
aggctgcctcagccagtggcaca

SEQ ID NO: 626793 - DNA, 22 bp, Homo sapiens
aggctgcctcatgaccctcctg

SEQ ID NO: 626794 - DNA, 16 bp, Homo sapiens
aggctgcgcctgcccg

SEQ ID NO: 626795 - DNA, 18 bp, Homo sapiens
aggctgcgcctgcccgcc

SEQ ID NO: 626796 - DNA, 11 bp, Homo sapiens
aggctgctgcc

SEQ ID NO: 626797 - DNA, 18 bp, Homo sapiens
aggctgctgccccctggc

SEQ ID NO: 626798 - DNA, 17 bp, Homo sapiens
aggctggataggagagg

SEQ ID NO: 626799 - DNA, 18 bp, Homo sapiens
aggctggataggagagga

SEQ ID NO: 626800 - DNA, 20 bp, Homo sapiens
aggctggatgtgctttcatc

SEQ ID NO: 626801 - DNA, 22 bp, Homo sapiens
aggctttattcttccaagttca

SEQ ID NO: 626802 - DNA, 16 bp, Homo sapiens
agggaaaccttggaga

SEQ ID NO: 626803 - DNA, 18 bp, Homo sapiens
agggaaaccttggagagg

SEQ ID NO: 626804 - DNA, 14 bp, Homo sapiens
agggaaatccaact

SEQ ID NO: 626805 - DNA, 19 bp, Homo sapiens
agggaaatccaactccagg

SEQ ID NO: 626806 - DNA, 18 bp, Homo sapiens
agggaacagacctcggct

SEQ ID NO: 626807 - DNA, 20 bp, Homo sapiens
agggaagcccacccgcccca

SEQ ID NO: 626808 - DNA, 21 bp, Homo sapiens
agggaagcccacccgccccag

SEQ ID NO: 626809 - DNA, 23 bp, Homo sapiens
agggaagcccacccgccccagag

SEQ ID NO: 626810 - DNA, 17 bp, Homo sapiens
agggaagggtgcctggc

SEQ ID NO: 626811 - DNA, 18 bp, Homo sapiens
agggaagggtgcctggct

SEQ ID NO: 626812 - DNA, 20 bp, Homo sapiens
agggaagggtgcctggctgg

SEQ ID NO: 626813 - DNA, 21 bp, Homo sapiens
agggaatccatatcagctctg

SEQ ID NO: 626814 - DNA, 13 bp, Homo sapiens
agggaccaaggag

SEQ ID NO: 626815 - DNA, 19 bp, Homo sapiens
agggactccagaagcagca

SEQ ID NO: 626816 - DNA, 12 bp, Homo sapiens
agggactctcca

SEQ ID NO: 626817 - DNA, 14 bp, Homo sapiens
agggagggggctgg

SEQ ID NO: 626818 - DNA, 16 bp, Homo sapiens
agggaggtggcaggga

SEQ ID NO: 626819 - DNA, 13 bp, Homo sapiens
agggagtgtgcct

SEQ ID NO: 626820 - DNA, 22 bp, Homo sapiens
agggatgctatctcgctagcca

SEQ ID NO: 626821 - DNA, 18 bp, Homo sapiens
agggattgaggagttgcc

SEQ ID NO: 626822 - DNA, 18 bp, Homo sapiens
agagctgagtcggctggg

SEQ ID NO: 626823 - DNA, 12 bp, Homo sapiens
agagctgctgta

SEQ ID NO: 626824 - DNA, 21 bp, Homo sapiens
agaggaataaaatgattaagt

SEQ ID NO: 626825 - DNA, 23 bp, Homo sapiens
agaggacggcttccccatcgcct

SEQ ID NO: 626826 - DNA, 13 bp, Homo sapiens
agaggagagtggc

SEQ ID NO: 626827 - DNA, 13 bp, Homo sapiens
agaggaggtgtgg

SEQ ID NO: 626828 - DNA, 14 bp, Homo sapiens
agaggaggtgtgga

SEQ ID NO: 626829 - DNA, 20 bp, Homo sapiens
agaggaggtgtggagtggag

SEQ ID NO: 626830 - DNA, 13 bp, Homo sapiens
agaggcagagacc

SEQ ID NO: 626831 - DNA, 19 bp, Homo sapiens
agaggcccgaggcaccgga

SEQ ID NO: 626832 - DNA, 16 bp, Homo sapiens
agaggccggggtccag

SEQ ID NO: 626833 - DNA, 13 bp, Homo sapiens
agaggctgcctca

SEQ ID NO: 626834 - DNA, 15 bp, Homo sapiens
agaggctgcctcagc

SEQ ID NO: 626835 - DNA, 16 bp, Homo sapiens
agaggctgcctcagcc

SEQ ID NO: 626836 - DNA, 14 bp, Homo sapiens
agaggctgggggag

SEQ ID NO: 626837 - DNA, 12 bp, Homo sapiens
agagggctgagc

SEQ ID NO: 626838 - DNA, 15 bp, Homo sapiens
agagggctgagcccc

SEQ ID NO: 626839 - DNA, 20 bp, Homo sapiens
agagggggatgcccctggcc

SEQ ID NO: 626840 - DNA, 15 bp, Homo sapiens
agaggtttcagcatt

SEQ ID NO: 626841 - DNA, 18 bp, Homo sapiens
agaggtttcagcattccc

SEQ ID NO: 626842 - DNA, 15 bp, Homo sapiens
agagtatggattgaa

SEQ ID NO: 626843 - DNA, 18 bp, Homo sapiens
agagtatggtgctgggtc

SEQ ID NO: 626844 - DNA, 18 bp, Homo sapiens
agagtgatttgtaaaaca

SEQ ID NO: 626845 - DNA, 12 bp, Homo sapiens
agagtgccctgg

SEQ ID NO: 626846 - DNA, 17 bp, Homo sapiens
agcggggcttctgggcg

SEQ ID NO: 626847 - DNA, 13 bp, Homo sapiens
agcgggggctaac

SEQ ID NO: 626848 - DNA, 20 bp, Homo sapiens
agcgggggctaactggcccc

SEQ ID NO: 626849 - DNA, 22 bp, Homo sapiens
agcgggggctaactggccccag

SEQ ID NO: 626850 - DNA, 22 bp, Homo sapiens
agcgtctccccatgctgggctc

SEQ ID NO: 626851 - DNA, 19 bp, Homo sapiens
agcgtgtactaccccagaa

SEQ ID NO: 626852 - DNA, 12 bp, Homo sapiens
agcgtgtcctat

SEQ ID NO: 626853 - DNA, 21 bp, Homo sapiens
agcgtgtcctatccccggacg

SEQ ID NO: 626854 - DNA, 19 bp, Homo sapiens
agctaatgtggtagtgaaa

SEQ ID NO: 626855 - DNA, 14 bp, Homo sapiens
agctaatttgtgaa

SEQ ID NO: 626856 - DNA, 16 bp, Homo sapiens
agctaatttgtgaaag

SEQ ID NO: 626857 - DNA, 22 bp, Homo sapiens
agctaccaactaagttgtattt

SEQ ID NO: 626858 - DNA, 14 bp, Homo sapiens
agctaggcagggag

SEQ ID NO: 626859 - DNA, 15 bp, Homo sapiens
agctaggcagggagg

SEQ ID NO: 626860 - DNA, 16 bp, Homo sapiens
agctaggcagggaggg

SEQ ID NO: 626861 - DNA, 18 bp, Homo sapiens
agctagttagagactcgc

SEQ ID NO: 626862 - DNA, 18 bp, Homo sapiens
agctagtttaaaattatt

SEQ ID NO: 626863 - DNA, 20 bp, Homo sapiens
agctagtttaaaattattaa

SEQ ID NO: 626864 - DNA, 19 bp, Homo sapiens
agctataaaagcccatgct

SEQ ID NO: 626865 - DNA, 22 bp, Homo sapiens
agctataaaagcccatgcttaa

SEQ ID NO: 626866 - DNA, 21 bp, Homo sapiens
agctatttaagtggactgtat

SEQ ID NO: 626867 - DNA, 17 bp, Homo sapiens
agctcacagcacatttg

SEQ ID NO: 626868 - DNA, 19 bp, Homo sapiens
agctcacagcacatttgtt

SEQ ID NO: 626869 - DNA, 15 bp, Homo sapiens
agctcaggagaaggc

SEQ ID NO: 626870 - DNA, 21 bp, Homo sapiens
agctcaggagaaggcctgccc

SEQ ID NO: 626871 - DNA, 22 bp, Homo sapiens
agctcaggagaaggcctgcccc

SEQ ID NO: 626872 - DNA, 15 bp, Homo sapiens
agctccaccctcccc

SEQ ID NO: 626873 - DNA, 16 bp, Homo sapiens
agctccaccctcccct

SEQ ID NO: 626874 - DNA, 16 bp, Homo sapiens
agctccactctgaagt

SEQ ID NO: 626875 - DNA, 20 bp, Homo sapiens
agctcctcgggtggggcctg

SEQ ID NO: 626876 - DNA, 15 bp, Homo sapiens
agctccttcatgctt

SEQ ID NO: 626877 - DNA, 13 bp, Homo sapiens
agctcgtgtgctt

SEQ ID NO: 626878 - DNA, 18 bp, Homo sapiens
agctctgaatgctatttg

SEQ ID NO: 626879 - DNA, 15 bp, Homo sapiens
agctcttcccctttc

SEQ ID NO: 626880 - DNA, 18 bp, Homo sapiens
agctgcagttagcacaga

SEQ ID NO: 626881 - DNA, 18 bp, Homo sapiens
agctgccatccttgctgc

SEQ ID NO: 626882 - DNA, 19 bp, Homo sapiens
agctgccatccttgctgca

SEQ ID NO: 626883 - DNA, 12 bp, Homo sapiens
agctggcagcgc

SEQ ID NO: 626884 - DNA, 22 bp, Homo sapiens
agctggctgggtcgcccctcct

SEQ ID NO: 626885 - DNA, 19 bp, Homo sapiens
agctgggcaccacaggctg

SEQ ID NO: 626886 - DNA, 21 bp, Homo sapiens
agctgtattatcttaaaccca

SEQ ID NO: 626887 - DNA, 11 bp, Homo sapiens
agcttccagat

SEQ ID NO: 626888 - DNA, 19 bp, Homo sapiens
agcttccagtgcatgttgc

SEQ ID NO: 626889 - DNA, 14 bp, Homo sapiens
agcttcccaacaat

SEQ ID NO: 626890 - DNA, 15 bp, Homo sapiens
agcttcccaacaata

SEQ ID NO: 626891 - DNA, 21 bp, Homo sapiens
agcttctgaaaggtgctttct

SEQ ID NO: 626892 - DNA, 13 bp, Homo sapiens
agcttgagcctgt

SEQ ID NO: 626893 - DNA, 18 bp, Homo sapiens
agcttggagccccctggc

SEQ ID NO: 626894 - DNA, 18 bp, Homo sapiens
agctttagagaagccata

SEQ ID NO: 626895 - DNA, 19 bp, Homo sapiens
agctttcctgggtctggat

SEQ ID NO: 626896 - DNA, 13 bp, Homo sapiens
agctttctccttt

SEQ ID NO: 626897 - DNA, 17 bp, Homo sapiens
agcttttcacttcttaa

SEQ ID NO: 626898 - DNA, 17 bp, Homo sapiens
agctttttgtgagaaag

SEQ ID NO: 626899 - DNA, 15 bp, Homo sapiens
aggaaaagagaaaca

SEQ ID NO: 626900 - DNA, 17 bp, Homo sapiens
aggaaaaggctgcagct

SEQ ID NO: 626901 - DNA, 18 bp, Homo sapiens
aggaaacttggacattta

SEQ ID NO: 626902 - DNA, 16 bp, Homo sapiens
aggaaagcctcactga

SEQ ID NO: 626903 - DNA, 17 bp, Homo sapiens
aggaaagtactgcatga

SEQ ID NO: 626904 - DNA, 16 bp, Homo sapiens
aggaaagtggatgcca

SEQ ID NO: 626905 - DNA, 22 bp, Homo sapiens
aggaaagttctattatctgggt

SEQ ID NO: 626906 - DNA, 13 bp, Homo sapiens
aggaaatgaatgt

SEQ ID NO: 626907 - DNA, 14 bp, Homo sapiens
aggaaatgaatgtg

SEQ ID NO: 626908 - DNA, 20 bp, Homo sapiens
aggaacatgacccgtacaca

SEQ ID NO: 626909 - DNA, 22 bp, Homo sapiens
aggaacatgacccgtacacacc

SEQ ID NO: 626910 - DNA, 16 bp, Homo sapiens
aggaagtcatcctgca

SEQ ID NO: 626911 - DNA, 20 bp, Homo sapiens
aggaatgctcaatgtgctgt

SEQ ID NO: 626912 - DNA, 20 bp, Homo sapiens
aggaatgggccaagccaggg

SEQ ID NO: 626913 - DNA, 15 bp, Homo sapiens
aggaatgtagggcct

SEQ ID NO: 626914 - DNA, 18 bp, Homo sapiens
aggacaacctgcccctcc

SEQ ID NO: 626915 - DNA, 12 bp, Homo sapiens
aggacacagcac

SEQ ID NO: 626916 - DNA, 13 bp, Homo sapiens
aggacacagcaca

SEQ ID NO: 626917 - DNA, 12 bp, Homo sapiens
aggacactgatg

SEQ ID NO: 626918 - DNA, 23 bp, Homo sapiens
aggacactgatgggtcctgctgc

SEQ ID NO: 626919 - DNA, 15 bp, Homo sapiens
aggacagaggccggg

SEQ ID NO: 626920 - DNA, 17 bp, Homo sapiens
aggacagagtgccctgg

SEQ ID NO: 626921 - DNA, 17 bp, Homo sapiens
aggacagggagggaaca

SEQ ID NO: 626922 - DNA, 14 bp, Homo sapiens
aggacagtttagga

SEQ ID NO: 626923 - DNA, 16 bp, Homo sapiens
aggacatctctgtaaa

SEQ ID NO: 626924 - DNA, 13 bp, Homo sapiens
aggaccattttag

SEQ ID NO: 626925 - DNA, 15 bp, Homo sapiens
aggaccattttagaa

SEQ ID NO: 626926 - DNA, 20 bp, Homo sapiens
aggacccccccagtccgccc

SEQ ID NO: 626927 - DNA, 15 bp, Homo sapiens
aggacccctgccctc

SEQ ID NO: 626928 - DNA, 16 bp, Homo sapiens
aggacccctgccctcg

SEQ ID NO: 626929 - DNA, 13 bp, Homo sapiens
aggacgcatgcag

SEQ ID NO: 626930 - DNA, 16 bp, Homo sapiens
aggacgcatgcagggc

SEQ ID NO: 626931 - DNA, 14 bp, Homo sapiens
aggacggggcagag

SEQ ID NO: 626932 - DNA, 16 bp, Homo sapiens
aggacggggcagagct

SEQ ID NO: 626933 - DNA, 17 bp, Homo sapiens
aggacggggcagagctg

SEQ ID NO: 626934 - DNA, 13 bp, Homo sapiens
aggactgaagaaa

SEQ ID NO: 626935 - DNA, 14 bp, Homo sapiens
aggacttaatttag

SEQ ID NO: 626936 - DNA, 20 bp, Homo sapiens
aggagaaaatgcaatttgat

SEQ ID NO: 626937 - DNA, 22 bp, Homo sapiens
aggagaaaatgcaatttgataa

SEQ ID NO: 626938 - DNA, 20 bp, Homo sapiens
aggagaaggcctgcccccct

SEQ ID NO: 626939 - DNA, 14 bp, Homo sapiens
aggagaccctgtct

SEQ ID NO: 626940 - DNA, 17 bp, Homo sapiens
aggagaccctgtctttg

SEQ ID NO: 626941 - DNA, 19 bp, Homo sapiens
aggagactccaaggagcta

SEQ ID NO: 626942 - DNA, 17 bp, Homo sapiens
aggagagccctctgctg

SEQ ID NO: 626943 - DNA, 18 bp, Homo sapiens
aggagagccctctgctgc

SEQ ID NO: 626944 - DNA, 21 bp, Homo sapiens
aggagagccctctgctgcttt

SEQ ID NO: 626945 - DNA, 13 bp, Homo sapiens
aggagaggagtgc

SEQ ID NO: 626946 - DNA, 16 bp, Homo sapiens
aggagatgaggctgga

SEQ ID NO: 626947 - DNA, 17 bp, Homo sapiens
aggagatgaggctggat

SEQ ID NO: 626948 - DNA, 17 bp, Homo sapiens
aatccatatcagctctg

SEQ ID NO: 626949 - DNA, 21 bp, Homo sapiens
aatccccgtgctcacagtagc

SEQ ID NO: 626950 - DNA, 20 bp, Homo sapiens
aatcgtattacataaaacac

SEQ ID NO: 626951 - DNA, 12 bp, Homo sapiens
aatctaaattaa

SEQ ID NO: 626952 - DNA, 14 bp, Homo sapiens
aatctaaattaact

SEQ ID NO: 626953 - DNA, 18 bp, Homo sapiens
aatctacaaacttttata

SEQ ID NO: 626954 - DNA, 17 bp, Homo sapiens
aatctagagctatgcac

SEQ ID NO: 626955 - DNA, 19 bp, Homo sapiens
aatctagagctatgcacac

SEQ ID NO: 626956 - DNA, 23 bp, Homo sapiens
aatctgagaaagtactttctggt

SEQ ID NO: 626957 - DNA, 17 bp, Homo sapiens
aatctgctttcatccag

SEQ ID NO: 626958 - DNA, 15 bp, Homo sapiens
aatcttgctgtgaaa

SEQ ID NO: 626959 - DNA, 18 bp, Homo sapiens
aatcttgctgtgaaacag

SEQ ID NO: 626960 - DNA, 18 bp, Homo sapiens
aatctttgttaaaatata

SEQ ID NO: 626961 - DNA, 19 bp, Homo sapiens
aatctttgttaaaatatag

SEQ ID NO: 626962 - DNA, 14 bp, Homo sapiens
aatcttttgtgaaa

SEQ ID NO: 626963 - DNA, 16 bp, Homo sapiens
aatcttttgtgaaatt

SEQ ID NO: 626964 - DNA, 15 bp, Homo sapiens
aatgaaaaatctgaa

SEQ ID NO: 626965 - DNA, 16 bp, Homo sapiens
aatgaaatacttgaca

SEQ ID NO: 626966 - DNA, 22 bp, Homo sapiens
aatgaaatacttgacaacattt

SEQ ID NO: 626967 - DNA, 21 bp, Homo sapiens
aatgaaatataaactgtgaga

SEQ ID NO: 626968 - DNA, 22 bp, Homo sapiens
aatgaaatataaactgtgagat

SEQ ID NO: 626969 - DNA, 15 bp, Homo sapiens
aatgaaatttaagca

SEQ ID NO: 626970 - DNA, 18 bp, Homo sapiens
aatgaagcaaacacacag

SEQ ID NO: 626971 - DNA, 23 bp, Homo sapiens
aatgaatattaaagtctgagaaa

SEQ ID NO: 626972 - DNA, 13 bp, Homo sapiens
aatgaatgaaata

SEQ ID NO: 626973 - DNA, 18 bp, Homo sapiens
aatgaatgaaatataaac

SEQ ID NO: 626974 - DNA, 23 bp, Homo sapiens
aatgaatgaaatataaactgtga

SEQ ID NO: 626975 - DNA, 16 bp, Homo sapiens
aatgaatgtgtgtggt

SEQ ID NO: 626976 - DNA, 18 bp, Homo sapiens
aatgaatttatcatttta

SEQ ID NO: 626977 - DNA, 14 bp, Homo sapiens
aatgacctttcaat

SEQ ID NO: 626978 - DNA, 15 bp, Homo sapiens
aatgagaaattgtgc

SEQ ID NO: 626979 - DNA, 19 bp, Homo sapiens
aatgagatgttattactgt

SEQ ID NO: 626980 - DNA, 22 bp, Homo sapiens
aatgagggcgtgaaacacaata

SEQ ID NO: 626981 - DNA, 23 bp, Homo sapiens
aatgagggcgtgaaacacaatat

SEQ ID NO: 626982 - DNA, 21 bp, Homo sapiens
aatgatatgtctttaaaatga

SEQ ID NO: 626983 - DNA, 14 bp, Homo sapiens
aatgcaaaccatca

SEQ ID NO: 626984 - DNA, 22 bp, Homo sapiens
aatgcaaaccatcattgaaatc

SEQ ID NO: 626985 - DNA, 16 bp, Homo sapiens
aatgcaaatattgcta

SEQ ID NO: 626986 - DNA, 20 bp, Homo sapiens
aatgcaaatattgctattgt

SEQ ID NO: 626987 - DNA, 20 bp, Homo sapiens
aatgccgcgaactgggttct

SEQ ID NO: 626988 - DNA, 21 bp, Homo sapiens
aatgcctttctagcaattgct

SEQ ID NO: 626989 - DNA, 14 bp, Homo sapiens
aatgctatttgtgt

SEQ ID NO: 626990 - DNA, 14 bp, Homo sapiens
aatgctcaatgtgc

SEQ ID NO: 626991 - DNA, 15 bp, Homo sapiens
aatgctcaatgtgct

SEQ ID NO: 626992 - DNA, 17 bp, Homo sapiens
aatgctcaatgtgctgt

SEQ ID NO: 626993 - DNA, 18 bp, Homo sapiens
aatgctttctcatgcata

SEQ ID NO: 626994 - DNA, 15 bp, Homo sapiens
aatggatgtaatata

SEQ ID NO: 626995 - DNA, 21 bp, Homo sapiens
aatggcatctcgttgtaagta

SEQ ID NO: 626996 - DNA, 20 bp, Homo sapiens
aatggcctcttaaaaattat

SEQ ID NO: 626997 - DNA, 22 bp, Homo sapiens
aatggctgaagaaacacagcat

SEQ ID NO: 626998 - DNA, 16 bp, Homo sapiens
aatgggaaaatatata

SEQ ID NO: 626999 - DNA, 21 bp, Homo sapiens
aatggggggcgggccagggtg

SEQ ID NO: 627000 - DNA, 19 bp, Homo sapiens
aatggtattttttgtgaat

SEQ ID NO: 627001 - DNA, 22 bp, Homo sapiens
aatggtgaactgtcattacaga

SEQ ID NO: 627002 - DNA, 17 bp, Homo sapiens
aatggtgggctccagag

SEQ ID NO: 627003 - DNA, 23 bp, Homo sapiens
aatgtagggcagaatagctgata

SEQ ID NO: 627004 - DNA, 20 bp, Homo sapiens
aatgtcatttcatacaaatt

SEQ ID NO: 627005 - DNA, 16 bp, Homo sapiens
aatgtctaatgtattt

SEQ ID NO: 627006 - DNA, 19 bp, Homo sapiens
aatgtctaatgtattttat

SEQ ID NO: 627007 - DNA, 15 bp, Homo sapiens
aatgtctcaaaataa

SEQ ID NO: 627008 - DNA, 19 bp, Homo sapiens
aatgtgcctctcagtatct

SEQ ID NO: 627009 - DNA, 16 bp, Homo sapiens
aatgtgtgcttggaaa

SEQ ID NO: 627010 - DNA, 15 bp, Homo sapiens
aatgttaaatctaca

SEQ ID NO: 627011 - DNA, 19 bp, Homo sapiens
aatgttcacgcaacttgaa

SEQ ID NO: 627012 - DNA, 21 bp, Homo sapiens
aatgttccgttcatctgagga

SEQ ID NO: 627013 - DNA, 16 bp, Homo sapiens
aatgttgaagaactca

SEQ ID NO: 627014 - DNA, 23 bp, Homo sapiens
aatgttgaagaactcatgtgatt

SEQ ID NO: 627015 - DNA, 23 bp, Homo sapiens
aatgttttaaagaagtccatgtg

SEQ ID NO: 627016 - DNA, 17 bp, Homo sapiens
aattaaaacaaaatcct

SEQ ID NO: 627017 - DNA, 19 bp, Homo sapiens
aattaaacaaattccttcc

SEQ ID NO: 627018 - DNA, 20 bp, Homo sapiens
aattaaacaaattccttccc

SEQ ID NO: 627019 - DNA, 12 bp, Homo sapiens
aattaaactgat

SEQ ID NO: 627020 - DNA, 14 bp, Homo sapiens
aattaaagcagcaa

SEQ ID NO: 627021 - DNA, 18 bp, Homo sapiens
aattaaagtgtccattga

SEQ ID NO: 627022 - DNA, 14 bp, Homo sapiens
aattaaatgaaata

SEQ ID NO: 627023 - DNA, 15 bp, Homo sapiens
aattaaatgaaatac

SEQ ID NO: 627024 - DNA, 12 bp, Homo sapiens
aattaacaaatt

SEQ ID NO: 627025 - DNA, 18 bp, Homo sapiens
aattaatttttcaatttc

SEQ ID NO: 627026 - DNA, 13 bp, Homo sapiens
aattacagttcac

SEQ ID NO: 627027 - DNA, 21 bp, Homo sapiens
aattacatcccataacttgtc

SEQ ID NO: 627028 - DNA, 22 bp, Homo sapiens
aattagagattgacttcagaaa

SEQ ID NO: 627029 - DNA, 14 bp, Homo sapiens
acttctccttaacc

SEQ ID NO: 627030 - DNA, 21 bp, Homo sapiens
acttctctgttaacctacaaa

SEQ ID NO: 627031 - DNA, 15 bp, Homo sapiens
acttctgttatcagg

SEQ ID NO: 627032 - DNA, 23 bp, Homo sapiens
acttcttaaggacagtgttcaaa

SEQ ID NO: 627033 - DNA, 24 bp, Homo sapiens
acttcttaaggacagtgttcaaat

SEQ ID NO: 627034 - DNA, 16 bp, Homo sapiens
acttgaaattatatct

SEQ ID NO: 627035 - DNA, 16 bp, Homo sapiens
acttgattaaggacta

SEQ ID NO: 627036 - DNA, 16 bp, Homo sapiens
acttggaagaaaaaga

SEQ ID NO: 627037 - DNA, 21 bp, Homo sapiens
acttggacatttatgtacaaa

SEQ ID NO: 627038 - DNA, 23 bp, Homo sapiens
acttggataggagcttccagatg

SEQ ID NO: 627039 - DNA, 22 bp, Homo sapiens
acttgggaaacagagaaccctg

SEQ ID NO: 627040 - DNA, 18 bp, Homo sapiens
acttgtataagtagaatt

SEQ ID NO: 627041 - DNA, 21 bp, Homo sapiens
acttgtataagtagaattctt

SEQ ID NO: 627042 - DNA, 16 bp, Homo sapiens
acttgtttgtgtttga

SEQ ID NO: 627043 - DNA, 17 bp, Homo sapiens
actttataagccaatga

SEQ ID NO: 627044 - DNA, 22 bp, Homo sapiens
actttcaggaaggggtgtcagt

SEQ ID NO: 627045 - DNA, 13 bp, Homo sapiens
actttccatgaca

SEQ ID NO: 627046 - DNA, 22 bp, Homo sapiens
actttccatgacagtagcatac

SEQ ID NO: 627047 - DNA, 20 bp, Homo sapiens
actttctcagcatatatata

SEQ ID NO: 627048 - DNA, 16 bp, Homo sapiens
actttgaataaaataa

SEQ ID NO: 627049 - DNA, 14 bp, Homo sapiens
actttgccatcctt

SEQ ID NO: 627050 - DNA, 13 bp, Homo sapiens
actttggaagttt

SEQ ID NO: 627051 - DNA, 14 bp, Homo sapiens
actttgggaggctg

SEQ ID NO: 627052 - DNA, 21 bp, Homo sapiens
actttgtgtcttttgttctct

SEQ ID NO: 627053 - DNA, 17 bp, Homo sapiens
acttttatcttaaaagg

SEQ ID NO: 627054 - DNA, 22 bp, Homo sapiens
actttttctaaattataaagac

SEQ ID NO: 627055 - DNA, 15 bp, Homo sapiens
acttttttcctgtca

SEQ ID NO: 627056 - DNA, 18 bp, Homo sapiens
agaaaaaactggaaacat

SEQ ID NO: 627057 - DNA, 11 bp, Homo sapiens
agaaaaacaaa

SEQ ID NO: 627058 - DNA, 15 bp, Homo sapiens
agaaaaagccctctt

SEQ ID NO: 627059 - DNA, 18 bp, Homo sapiens
agaaaacagaccagcata

SEQ ID NO: 627060 - DNA, 19 bp, Homo sapiens
agaaaacagaccagcatag

SEQ ID NO: 627061 - DNA, 19 bp, Homo sapiens
agaaaacattgttccagat

SEQ ID NO: 627062 - DNA, 18 bp, Homo sapiens
agaaaatccttcagcaat

SEQ ID NO: 627063 - DNA, 13 bp, Homo sapiens
agaaaatgcaatt

SEQ ID NO: 627064 - DNA, 13 bp, Homo sapiens
agaaaatgctttc

SEQ ID NO: 627065 - DNA, 14 bp, Homo sapiens
agaaaatgctttct

SEQ ID NO: 627066 - DNA, 15 bp, Homo sapiens
agaaaatgctttctc

SEQ ID NO: 627067 - DNA, 18 bp, Homo sapiens
agaaaatgctttctcatg

SEQ ID NO: 627068 - DNA, 22 bp, Homo sapiens
agaaaatgctttctcatgcata

SEQ ID NO: 627069 - DNA, 23 bp, Homo sapiens
agaaaatgctttctcatgcatag

SEQ ID NO: 627070 - DNA, 12 bp, Homo sapiens
agaaacaagaca

SEQ ID NO: 627071 - DNA, 14 bp, Homo sapiens
agaaacaatttctg

SEQ ID NO: 627072 - DNA, 20 bp, Homo sapiens
agaaacacagcatgcattta

SEQ ID NO: 627073 - DNA, 16 bp, Homo sapiens
agaaacagaagaaaaa

SEQ ID NO: 627074 - DNA, 20 bp, Homo sapiens
agaaacagaagaaaaacact

SEQ ID NO: 627075 - DNA, 15 bp, Homo sapiens
agaaacagtttaaca

SEQ ID NO: 627076 - DNA, 17 bp, Homo sapiens
agaaacagtttaacaga

SEQ ID NO: 627077 - DNA, 14 bp, Homo sapiens
agaaaccaagccat

SEQ ID NO: 627078 - DNA, 22 bp, Homo sapiens
agaaacccctgacaccttttca

SEQ ID NO: 627079 - DNA, 13 bp, Homo sapiens
agaaactttggaa

SEQ ID NO: 627080 - DNA, 23 bp, Homo sapiens
agaaactttggaagttttacttg

SEQ ID NO: 627081 - DNA, 24 bp, Homo sapiens
agaaactttggaagttttacttga

SEQ ID NO: 627082 - DNA, 13 bp, Homo sapiens
agaaagacattct

SEQ ID NO: 627083 - DNA, 21 bp, Homo sapiens
agaaaggcagccctcacctct

SEQ ID NO: 627084 - DNA, 22 bp, Homo sapiens
agaaaggcagccctcacctctg

SEQ ID NO: 627085 - DNA, 19 bp, Homo sapiens
agaaagggcagcccctccc

SEQ ID NO: 627086 - DNA, 20 bp, Homo sapiens
agaaagggcagcccctcccc

SEQ ID NO: 627087 - DNA, 21 bp, Homo sapiens
agaaatacatcatatgttaga

SEQ ID NO: 627088 - DNA, 19 bp, Homo sapiens
agaaatagaataggcaaac

SEQ ID NO: 627089 - DNA, 11 bp, Homo sapiens
agaaatagcag

SEQ ID NO: 627090 - DNA, 22 bp, Homo sapiens
agaaatctctcacccagttcag

SEQ ID NO: 627091 - DNA, 14 bp, Homo sapiens
agaaatgagaaatt

SEQ ID NO: 627092 - DNA, 16 bp, Homo sapiens
agaaatggctttccac

SEQ ID NO: 627093 - DNA, 19 bp, Homo sapiens
agaaattagggctctaatt

SEQ ID NO: 627094 - DNA, 13 bp, Homo sapiens
agaaattctataa

SEQ ID NO: 627095 - DNA, 15 bp, Homo sapiens
agaaattttatctct

SEQ ID NO: 627096 - DNA, 12 bp, Homo sapiens
agaacaacaaca

SEQ ID NO: 627097 - DNA, 13 bp, Homo sapiens
agaacagggatgc

SEQ ID NO: 627098 - DNA, 16 bp, Homo sapiens
agaaccaacgggtctg

SEQ ID NO: 627099 - DNA, 19 bp, Homo sapiens
agaaccaacgggtctgtgg

SEQ ID NO: 627100 - DNA, 19 bp, Homo sapiens
agaaccagcactcccaggg

SEQ ID NO: 627101 - DNA, 15 bp, Homo sapiens
agaacccccctcccc

SEQ ID NO: 627102 - DNA, 22 bp, Homo sapiens
agaacccccctccccaaggaag

SEQ ID NO: 627103 - DNA, 13 bp, Homo sapiens
agaacgggcctcc

SEQ ID NO: 627104 - DNA, 17 bp, Homo sapiens
agaacgggcctccccgg

SEQ ID NO: 627105 - DNA, 14 bp, Homo sapiens
agaactaaatagat

SEQ ID NO: 627106 - DNA, 20 bp, Homo sapiens
agaactaaatagatttttag

SEQ ID NO: 627107 - DNA, 22 bp, Homo sapiens
agaactaacactattttatgca

SEQ ID NO: 627108 - DNA, 13 bp, Homo sapiens
agaactcctttct

SEQ ID NO: 627109 - DNA, 14 bp, Homo sapiens
agaactgccccatc

SEQ ID NO: 627110 - DNA, 19 bp, Homo sapiens
agaactgccccatctcctc

SEQ ID NO: 627111 - DNA, 21 bp, Homo sapiens
agaactgccccatctcctccc

SEQ ID NO: 627112 - DNA, 14 bp, Homo sapiens
agaagatagttgta

SEQ ID NO: 627113 - DNA, 23 bp, Homo sapiens
agaagcagcagctagaaagagaa

SEQ ID NO: 627114 - DNA, 14 bp, Homo sapiens
attagtattttgag

SEQ ID NO: 627115 - DNA, 12 bp, Homo sapiens
attagtgttttc

SEQ ID NO: 627116 - DNA, 14 bp, Homo sapiens
attagtgttttcat

SEQ ID NO: 627117 - DNA, 15 bp, Homo sapiens
attatagtctgtact

SEQ ID NO: 627118 - DNA, 17 bp, Homo sapiens
attatatacaaagctgt

SEQ ID NO: 627119 - DNA, 16 bp, Homo sapiens
attatcaaaaaacaga

SEQ ID NO: 627120 - DNA, 19 bp, Homo sapiens
attatcaaaaaacagaaaa

SEQ ID NO: 627121 - DNA, 17 bp, Homo sapiens
attatcattgtttgtcc

SEQ ID NO: 627122 - DNA, 17 bp, Homo sapiens
attatctgggttttaga

SEQ ID NO: 627123 - DNA, 13 bp, Homo sapiens
attatcttaaacc

SEQ ID NO: 627124 - DNA, 13 bp, Homo sapiens
attatcttggaaa

SEQ ID NO: 627125 - DNA, 23 bp, Homo sapiens
attatgaggaaacttggacattt

SEQ ID NO: 627126 - DNA, 18 bp, Homo sapiens
attatgccttgagaatga

SEQ ID NO: 627127 - DNA, 18 bp, Homo sapiens
attcaagaagatagttgt

SEQ ID NO: 627128 - DNA, 21 bp, Homo sapiens
attcaagaagatagttgtaaa

SEQ ID NO: 627129 - DNA, 12 bp, Homo sapiens
attcaatgtgaa

SEQ ID NO: 627130 - DNA, 17 bp, Homo sapiens
attcaatgtgaatttta

SEQ ID NO: 627131 - DNA, 15 bp, Homo sapiens
attcacttttattgt

SEQ ID NO: 627132 - DNA, 17 bp, Homo sapiens
attcacttttattgtat

SEQ ID NO: 627133 - DNA, 23 bp, Homo sapiens
attcagaatgtgcaaagcagtat

SEQ ID NO: 627134 - DNA, 14 bp, Homo sapiens
attcagatctgaag

SEQ ID NO: 627135 - DNA, 14 bp, Homo sapiens
attcaggaatgggc

SEQ ID NO: 627136 - DNA, 22 bp, Homo sapiens
attcagtagcattttaatagtt

SEQ ID NO: 627137 - DNA, 17 bp, Homo sapiens
attcagtctatgctgtg

SEQ ID NO: 627138 - DNA, 21 bp, Homo sapiens
attcataagccaatttttctg

SEQ ID NO: 627139 - DNA, 13 bp, Homo sapiens
attcatactcaaa

SEQ ID NO: 627140 - DNA, 18 bp, Homo sapiens
attcatgatgctagttct

SEQ ID NO: 627141 - DNA, 19 bp, Homo sapiens
attcatgatgctagttctt

SEQ ID NO: 627142 - DNA, 17 bp, Homo sapiens
attcatgctttctcctt

SEQ ID NO: 627143 - DNA, 18 bp, Homo sapiens
attcatgctttctccttt

SEQ ID NO: 627144 - DNA, 19 bp, Homo sapiens
attcatgctttctcctttt

SEQ ID NO: 627145 - DNA, 15 bp, Homo sapiens
attcattacatcctc

SEQ ID NO: 627146 - DNA, 21 bp, Homo sapiens
attcattacatcctctgcttg

SEQ ID NO: 627147 - DNA, 17 bp, Homo sapiens
attcattgtctcagtga

SEQ ID NO: 627148 - DNA, 18 bp, Homo sapiens
attcattgtctcagtgaa

SEQ ID NO: 627149 - DNA, 20 bp, Homo sapiens
attcccaattatcaaaaaac

SEQ ID NO: 627150 - DNA, 20 bp, Homo sapiens
attcccactaagctttctcc

SEQ ID NO: 627151 - DNA, 22 bp, Homo sapiens
attcccactaagctttctcctt

SEQ ID NO: 627152 - DNA, 21 bp, Homo sapiens
attcccatggtagactgtgac

SEQ ID NO: 627153 - DNA, 22 bp, Homo sapiens
attccgttaggaataacactgc

SEQ ID NO: 627154 - DNA, 15 bp, Homo sapiens
attcctaattcctgt

SEQ ID NO: 627155 - DNA, 17 bp, Homo sapiens
attcctacttaaacaaa

SEQ ID NO: 627156 - DNA, 19 bp, Homo sapiens
attcctacttaaacaaaaa

SEQ ID NO: 627157 - DNA, 14 bp, Homo sapiens
attcctcccctgga

SEQ ID NO: 627158 - DNA, 13 bp, Homo sapiens
attcctcctgtct

SEQ ID NO: 627159 - DNA, 16 bp, Homo sapiens
atgatcaaggagggag

SEQ ID NO: 627160 - DNA, 14 bp, Homo sapiens
atgatcaccctgaa

SEQ ID NO: 627161 - DNA, 23 bp, Homo sapiens
atgatccctgaacatagttttca

SEQ ID NO: 627162 - DNA, 17 bp, Homo sapiens
atgatcttacacgaaga

SEQ ID NO: 627163 - DNA, 15 bp, Homo sapiens
atgatgattcaatca

SEQ ID NO: 627164 - DNA, 15 bp, Homo sapiens
atgatgctagttctt

SEQ ID NO: 627165 - DNA, 22 bp, Homo sapiens
atgatggaagggccttctccac

SEQ ID NO: 627166 - DNA, 12 bp, Homo sapiens
atgatgttctga

SEQ ID NO: 627167 - DNA, 19 bp, Homo sapiens
atgattaaattatcattgt

SEQ ID NO: 627168 - DNA, 19 bp, Homo sapiens
atgattagacaatgtggaa

SEQ ID NO: 627169 - DNA, 21 bp, Homo sapiens
atgattcaatcattttgggaa

SEQ ID NO: 627170 - DNA, 15 bp, Homo sapiens
atgattcaatgtgaa

SEQ ID NO: 627171 - DNA, 21 bp, Homo sapiens
atgattcacttttattgtata

SEQ ID NO: 627172 - DNA, 13 bp, Homo sapiens
atgattctcctct

SEQ ID NO: 627173 - DNA, 12 bp, Homo sapiens
atgatttaacat

SEQ ID NO: 627174 - DNA, 16 bp, Homo sapiens
atgatttaattcttac

SEQ ID NO: 627175 - DNA, 13 bp, Homo sapiens
atgatttcagaaa

SEQ ID NO: 627176 - DNA, 16 bp, Homo sapiens
atgcaaaccatcattg

SEQ ID NO: 627177 - DNA, 22 bp, Homo sapiens
atgcaaaccatcattgaaatct

SEQ ID NO: 627178 - DNA, 18 bp, Homo sapiens
atgcacaccaaattgctg

SEQ ID NO: 627179 - DNA, 20 bp, Homo sapiens
atgcacaccaaattgctgag

SEQ ID NO: 627180 - DNA, 21 bp, Homo sapiens
atgcacaccaaattgctgaga

SEQ ID NO: 627181 - DNA, 22 bp, Homo sapiens
atgcacaccaaattgctgagat

SEQ ID NO: 627182 - DNA, 20 bp, Homo sapiens
atgcaccagtgccgcctgtg

SEQ ID NO: 627183 - DNA, 22 bp, Homo sapiens
atgcaccagtgccgcctgtgcc

SEQ ID NO: 627184 - DNA, 15 bp, Homo sapiens
atgcatatatatgta

SEQ ID NO: 627185 - DNA, 20 bp, Homo sapiens
atgcatgagaactaaataga

SEQ ID NO: 627186 - DNA, 21 bp, Homo sapiens
atgcatgagaactaaatagat

SEQ ID NO: 627187 - DNA, 16 bp, Homo sapiens
atgcatttagcatgag

SEQ ID NO: 627188 - DNA, 12 bp, Homo sapiens
atgcatttatgc

SEQ ID NO: 627189 - DNA, 17 bp, Homo sapiens
atgccaatgtccaggtc

SEQ ID NO: 627190 - DNA, 18 bp, Homo sapiens
atgccatgtatgttgcat

SEQ ID NO: 627191 - DNA, 22 bp, Homo sapiens
atgcccaaatataacatgaaag

SEQ ID NO: 627192 - DNA, 14 bp, Homo sapiens
atgccccagctctg

SEQ ID NO: 627193 - DNA, 21 bp, Homo sapiens
atgcccctgcagtttggccct

SEQ ID NO: 627194 - DNA, 16 bp, Homo sapiens
atgccctccctgctgc

SEQ ID NO: 627195 - DNA, 21 bp, Homo sapiens
atgccctccctgctgccaggc

SEQ ID NO: 627196 - DNA, 13 bp, Homo sapiens
atgccgtgcgggc

SEQ ID NO: 627197 - DNA, 13 bp, Homo sapiens
atgcctaataaac

SEQ ID NO: 627198 - DNA, 18 bp, Homo sapiens
caaggatcctgagccaga

SEQ ID NO: 627199 - DNA, 15 bp, Homo sapiens
caaggcaagaagtgg

SEQ ID NO: 627200 - DNA, 19 bp, Homo sapiens
caaggcccagccctgggca

SEQ ID NO: 627201 - DNA, 16 bp, Homo sapiens
caagggcagtggaaga

SEQ ID NO: 627202 - DNA, 15 bp, Homo sapiens
caaggtggtcttgga

SEQ ID NO: 627203 - DNA, 16 bp, Homo sapiens
caagtagtagtactta

SEQ ID NO: 627204 - DNA, 19 bp, Homo sapiens
caagtatcatctaaatatt

SEQ ID NO: 627205 - DNA, 15 bp, Homo sapiens
caagtcctcgccccc

SEQ ID NO: 627206 - DNA, 17 bp, Homo sapiens
caagtggacgtgggctc

SEQ ID NO: 627207 - DNA, 14 bp, Homo sapiens
caagtgtacatttg

SEQ ID NO: 627208 - DNA, 22 bp, Homo sapiens
caagtgtatatttgtatcacac

SEQ ID NO: 627209 - DNA, 14 bp, Homo sapiens
caagtgtgtgtgca

SEQ ID NO: 627210 - DNA, 17 bp, Homo sapiens
caagtgttacctaacaa

SEQ ID NO: 627211 - DNA, 19 bp, Homo sapiens
caagtgttacctaacaatg

SEQ ID NO: 627212 - DNA, 21 bp, Homo sapiens
caagttgccacattgcttcat

SEQ ID NO: 627213 - DNA, 13 bp, Homo sapiens
caagttgtgtgct

SEQ ID NO: 627214 - DNA, 15 bp, Homo sapiens
caagttgtgtgctat

SEQ ID NO: 627215 - DNA, 21 bp, Homo sapiens
caagttgtgtgctattcgtaa

SEQ ID NO: 627216 - DNA, 20 bp, Homo sapiens
caagtttttggtaatgatga

SEQ ID NO: 627217 - DNA, 16 bp, Homo sapiens
caataaactcagtcaa

SEQ ID NO: 627218 - DNA, 15 bp, Homo sapiens
caataaagctcacac

SEQ ID NO: 627219 - DNA, 13 bp, Homo sapiens
caataagaaacag

SEQ ID NO: 627220 - DNA, 14 bp, Homo sapiens
caataagaaacagt

SEQ ID NO: 627221 - DNA, 14 bp, Homo sapiens
caataagttgaatg

SEQ ID NO: 627222 - DNA, 14 bp, Homo sapiens
caataggaaaaact

SEQ ID NO: 627223 - DNA, 23 bp, Homo sapiens
caatcatgcctacattagtgaga

SEQ ID NO: 627224 - DNA, 16 bp, Homo sapiens
caatccacagtattgt

SEQ ID NO: 627225 - DNA, 15 bp, Homo sapiens
caatcttgctgtgaa

SEQ ID NO: 627226 - DNA, 16 bp, Homo sapiens
caatcttgctgtgaaa

SEQ ID NO: 627227 - DNA, 17 bp, Homo sapiens
caatgaactctttcccc

SEQ ID NO: 627228 - DNA, 16 bp, Homo sapiens
caatgacctttcaata

SEQ ID NO: 627229 - DNA, 14 bp, Homo sapiens
caatgcaaaccatc

SEQ ID NO: 627230 - DNA, 17 bp, Homo sapiens
caatgcaaaccatcatt

SEQ ID NO: 627231 - DNA, 22 bp, Homo sapiens
caatgcaaaccatcattgaaat

SEQ ID NO: 627232 - DNA, 20 bp, Homo sapiens
caatgctacaaaatgtgtgc

SEQ ID NO: 627233 - DNA, 22 bp, Homo sapiens
caatggctgggtttgggcagtg

SEQ ID NO: 627234 - DNA, 23 bp, Homo sapiens
caatggtgaactgtcattacaga

SEQ ID NO: 627235 - DNA, 14 bp, Homo sapiens
caatgtactgtatt

SEQ ID NO: 627236 - DNA, 15 bp, Homo sapiens
caatgtactgtattg

SEQ ID NO: 627237 - DNA, 14 bp, Homo sapiens
caatgtccaggtca

SEQ ID NO: 627238 - DNA, 20 bp, Homo sapiens
caatgtccaggtcacaggca

SEQ ID NO: 627239 - DNA, 16 bp, Homo sapiens
caatgtgaaataaaga

SEQ ID NO: 627240 - DNA, 21 bp, Homo sapiens
caatgtgaattttaaaatgca

SEQ ID NO: 627241 - DNA, 16 bp, Homo sapiens
caatgttttttatact

SEQ ID NO: 627242 - DNA, 19 bp, Homo sapiens
caattaatttttttattgt

SEQ ID NO: 627243 - DNA, 23 bp, Homo sapiens
caattaatttttttattgtttaa

SEQ ID NO: 627244 - DNA, 20 bp, Homo sapiens
caattcatatttatgaatct

SEQ ID NO: 627245 - DNA, 17 bp, Homo sapiens
caattctttgttgctta

SEQ ID NO: 627246 - DNA, 15 bp, Homo sapiens
caattgtatatatat

SEQ ID NO: 627247 - DNA, 15 bp, Homo sapiens
caatttaaaggaaag

SEQ ID NO: 627248 - DNA, 22 bp, Homo sapiens
caatttaccacaggatgcatat

SEQ ID NO: 627249 - DNA, 18 bp, Homo sapiens
caatttcaaagaaaacag

SEQ ID NO: 627250 - DNA, 12 bp, Homo sapiens
caatttgttctg

SEQ ID NO: 627251 - DNA, 14 bp, Homo sapiens
caatttttaactta

SEQ ID NO: 627252 - DNA, 18 bp, Homo sapiens
caatttttctgcactgag

SEQ ID NO: 627253 - DNA, 11 bp, Homo sapiens
cacaaaacaac

SEQ ID NO: 627254 - DNA, 15 bp, Homo sapiens
cacaaaacaacagca

SEQ ID NO: 627255 - DNA, 15 bp, Homo sapiens
atacttcatacaaca

SEQ ID NO: 627256 - DNA, 20 bp, Homo sapiens
atacttccagcgaaatggta

SEQ ID NO: 627257 - DNA, 15 bp, Homo sapiens
atactttgtgtcttt

SEQ ID NO: 627258 - DNA, 13 bp, Homo sapiens
atagaaatacatc

SEQ ID NO: 627259 - DNA, 19 bp, Homo sapiens
atagaagaaggactgaaga

SEQ ID NO: 627260 - DNA, 21 bp, Homo sapiens
atagaagaaggactgaagaaa

SEQ ID NO: 627261 - DNA, 16 bp, Homo sapiens
atagaataggcaaact

SEQ ID NO: 627262 - DNA, 21 bp, Homo sapiens
atagacaagtgttttgggttt

SEQ ID NO: 627263 - DNA, 14 bp, Homo sapiens
atagacagaggttt

SEQ ID NO: 627264 - DNA, 17 bp, Homo sapiens
atagacagaggtttcat

SEQ ID NO: 627265 - DNA, 19 bp, Homo sapiens
atagacagaggtttcattt

SEQ ID NO: 627266 - DNA, 16 bp, Homo sapiens
atagagttcatagaaa

SEQ ID NO: 627267 - DNA, 19 bp, Homo sapiens
atagagttcatagaaatac

SEQ ID NO: 627268 - DNA, 12 bp, Homo sapiens
atagagttttcc

SEQ ID NO: 627269 - DNA, 14 bp, Homo sapiens
atagatggtagaaa

SEQ ID NO: 627270 - DNA, 14 bp, Homo sapiens
atagatgtgaaaat

SEQ ID NO: 627271 - DNA, 15 bp, Homo sapiens
atagatgtgaaaatg

SEQ ID NO: 627272 - DNA, 17 bp, Homo sapiens
atagatgtgaaaatgct

SEQ ID NO: 627273 - DNA, 18 bp, Homo sapiens
atagatgtgaaaatgctt

SEQ ID NO: 627274 - DNA, 15 bp, Homo sapiens
atagcacatgtttta

SEQ ID NO: 627275 - DNA, 18 bp, Homo sapiens
atagcatgtattgtgtct

SEQ ID NO: 627276 - DNA, 19 bp, Homo sapiens
atagccagcattcagcaca

SEQ ID NO: 627277 - DNA, 18 bp, Homo sapiens
atagccattcatttacaa

SEQ ID NO: 627278 - DNA, 18 bp, Homo sapiens
atagctataaatagtgaa

SEQ ID NO: 627279 - DNA, 14 bp, Homo sapiens
atagctcacagcac

SEQ ID NO: 627280 - DNA, 16 bp, Homo sapiens
atagcttaagaagtat

SEQ ID NO: 627281 - DNA, 20 bp, Homo sapiens
atagctttagagaagccata

SEQ ID NO: 627282 - DNA, 21 bp, Homo sapiens
atagctttagagaagccataa

SEQ ID NO: 627283 - DNA, 12 bp, Homo sapiens
atagctttgcaa

SEQ ID NO: 627284 - DNA, 16 bp, Homo sapiens
ataggaaaaactgatt

SEQ ID NO: 627285 - DNA, 17 bp, Homo sapiens
ataggaaataaatctaa

SEQ ID NO: 627286 - DNA, 13 bp, Homo sapiens
ataggagaggaaa

SEQ ID NO: 627287 - DNA, 14 bp, Homo sapiens
ataggagggtgccc

SEQ ID NO: 627288 - DNA, 17 bp, Homo sapiens
ataggataaattaatga

SEQ ID NO: 627289 - DNA, 17 bp, Homo sapiens
atagggaattttcattt

SEQ ID NO: 627290 - DNA, 18 bp, Homo sapiens
atagggaattttcatttt

SEQ ID NO: 627291 - DNA, 19 bp, Homo sapiens
atagggtttggaagaaagg

SEQ ID NO: 627292 - DNA, 18 bp, Homo sapiens
ataggttctgctttctga

SEQ ID NO: 627293 - DNA, 17 bp, Homo sapiens
atagtcaatcaaacagg

SEQ ID NO: 627294 - DNA, 19 bp, Homo sapiens
atagtcatgtttctgcagt

SEQ ID NO: 627295 - DNA, 20 bp, Homo sapiens
atagtcatgtttctgcagta

SEQ ID NO: 627296 - DNA, 16 bp, Homo sapiens
atagtggtattttaac

SEQ ID NO: 627297 - DNA, 17 bp, Homo sapiens
atagtggtcatttggtg

SEQ ID NO: 627298 - DNA, 14 bp, Homo sapiens
atagtgttgtgtta

SEQ ID NO: 627299 - DNA, 22 bp, Homo sapiens
atagtgttgtgttacaataagt

SEQ ID NO: 627300 - DNA, 14 bp, Homo sapiens
atagttattcaaat

SEQ ID NO: 627301 - DNA, 12 bp, Homo sapiens
atagttccattc

SEQ ID NO: 627302 - DNA, 20 bp, Homo sapiens
atagttgagccagcagacat

SEQ ID NO: 627303 - DNA, 16 bp, Homo sapiens
atagtttgaattcatg

SEQ ID NO: 627304 - DNA, 22 bp, Homo sapiens
atagttttcacccaagagctgt

SEQ ID NO: 627305 - DNA, 20 bp, Homo sapiens
atagttttcgataaaggata

SEQ ID NO: 627306 - DNA, 20 bp, Homo sapiens
atagtttttaaggttattta

SEQ ID NO: 627307 - DNA, 12 bp, Homo sapiens
atataaaaataa

SEQ ID NO: 627308 - DNA, 15 bp, Homo sapiens
atataaaatacacgt

SEQ ID NO: 627309 - DNA, 21 bp, Homo sapiens
atataaaatacacgtgtatat

SEQ ID NO: 627310 - DNA, 15 bp, Homo sapiens
atataaactgtgaga

SEQ ID NO: 627311 - DNA, 16 bp, Homo sapiens
atataaactgtgagat

SEQ ID NO: 627312 - DNA, 15 bp, Homo sapiens
atataaatcacagat

SEQ ID NO: 627313 - DNA, 13 bp, Homo sapiens
atataagacaagt

SEQ ID NO: 627314 - DNA, 12 bp, Homo sapiens
atataagccata

SEQ ID NO: 627315 - DNA, 19 bp, Homo sapiens
atataataaatatatattt

SEQ ID NO: 627316 - DNA, 21 bp, Homo sapiens
atataataaattaatttttca

SEQ ID NO: 627317 - DNA, 21 bp, Homo sapiens
atataatggcctcttaaaaat

SEQ ID NO: 627318 - DNA, 15 bp, Homo sapiens
atataatttttcctt

SEQ ID NO: 627319 - DNA, 15 bp, Homo sapiens
atatacactttacat

SEQ ID NO: 627320 - DNA, 16 bp, Homo sapiens
atatacagacctccag

SEQ ID NO: 627321 - DNA, 18 bp, Homo sapiens
atatacagacctccagat

SEQ ID NO: 627322 - DNA, 23 bp, Homo sapiens
atatacatacgcaattgtatata

SEQ ID NO: 627323 - DNA, 16 bp, Homo sapiens
atatactcatttggat

SEQ ID NO: 627324 - DNA, 20 bp, Homo sapiens
atatagctttgcaaccttgt

SEQ ID NO: 627325 - DNA, 14 bp, Homo sapiens
atatagggtttgtt

SEQ ID NO: 627326 - DNA, 19 bp, Homo sapiens
atatagtgttgtgttacaa

SEQ ID NO: 627327 - DNA, 15 bp, Homo sapiens
atatataaaatacac

SEQ ID NO: 627328 - DNA, 23 bp, Homo sapiens
atatataaaatacacgtgtatat

SEQ ID NO: 627329 - DNA, 15 bp, Homo sapiens
atatatacatacgca

SEQ ID NO: 627330 - DNA, 22 bp, Homo sapiens
atatatacatacgcaattgtat

SEQ ID NO: 627331 - DNA, 17 bp, Homo sapiens
atatataccaagcccct

SEQ ID NO: 627332 - DNA, 15 bp, Homo sapiens
atatatatgtgaact

SEQ ID NO: 627333 - DNA, 12 bp, Homo sapiens
atatattctttc

SEQ ID NO: 627334 - DNA, 14 bp, Homo sapiens
atatatttgcataa

SEQ ID NO: 627335 - DNA, 23 bp, Homo sapiens
atatatttgcataatatgcatat

SEQ ID NO: 627336 - DNA, 13 bp, Homo sapiens
atatattttgaaa

SEQ ID NO: 627337 - DNA, 20 bp, Homo sapiens
atatcagctctgcataagat

SEQ ID NO: 627338 - DNA, 18 bp, Homo sapiens
atatcaggaaatatctgt

SEQ ID NO: 627339 - DNA, 16 bp, Homo sapiens
atatcagttacagtgg

SEQ ID NO: 627340 - DNA, 21 bp, Homo sapiens
atatcatccccaaatgtgtct

SEQ ID NO: 627341 - DNA, 16 bp, Homo sapiens
atatctgaaaactgga

SEQ ID NO: 627342 - DNA, 17 bp, Homo sapiens
atatctgaaaactggaa

SEQ ID NO: 627343 - DNA, 23 bp, Homo sapiens
atatctgaaaactggaataagaa

SEQ ID NO: 627344 - DNA, 18 bp, Homo sapiens
atatctgtggtcttcaaa

SEQ ID NO: 627345 - DNA, 16 bp, Homo sapiens
atcctggaaatttgtg

SEQ ID NO: 627346 - DNA, 14 bp, Homo sapiens
atccttccatcttg

SEQ ID NO: 627347 - DNA, 15 bp, Homo sapiens
atccttcccgcagca

SEQ ID NO: 627348 - DNA, 23 bp, Homo sapiens
atccttcccgcagcaccagcctg

SEQ ID NO: 627349 - DNA, 24 bp, Homo sapiens
atccttcccgcagcaccagcctga

SEQ ID NO: 627350 - DNA, 22 bp, Homo sapiens
atccttgtataaaaaaaatagt

SEQ ID NO: 627351 - DNA, 20 bp, Homo sapiens
atcgatttgtattaatgtag

SEQ ID NO: 627352 - DNA, 16 bp, Homo sapiens
atcgtgccgtggagct

SEQ ID NO: 627353 - DNA, 23 bp, Homo sapiens
atcgtggaagaagggccaccctg

SEQ ID NO: 627354 - DNA, 18 bp, Homo sapiens
atcgtttcacatctgtat

SEQ ID NO: 627355 - DNA, 14 bp, Homo sapiens
atctacaaactttt

SEQ ID NO: 627356 - DNA, 17 bp, Homo sapiens
atctacaaacttttata

SEQ ID NO: 627357 - DNA, 23 bp, Homo sapiens
atctacaaacttttataaatgtt

SEQ ID NO: 627358 - DNA, 17 bp, Homo sapiens
atctacacatataaaca

SEQ ID NO: 627359 - DNA, 19 bp, Homo sapiens
atctacacatataaacaca

SEQ ID NO: 627360 - DNA, 22 bp, Homo sapiens
atctacacatataaacacagta

SEQ ID NO: 627361 - DNA, 14 bp, Homo sapiens
atctactagaacct

SEQ ID NO: 627362 - DNA, 18 bp, Homo sapiens
atctagagctatgcacac

SEQ ID NO: 627363 - DNA, 20 bp, Homo sapiens
atctagagctatgcacacca

SEQ ID NO: 627364 - DNA, 21 bp, Homo sapiens
atctagtgccattatttctac

SEQ ID NO: 627365 - DNA, 23 bp, Homo sapiens
atctcaaaagatctcctgtgcac

SEQ ID NO: 627366 - DNA, 20 bp, Homo sapiens
atctcagcatcctggaaatt

SEQ ID NO: 627367 - DNA, 18 bp, Homo sapiens
atctcaggtggcatttgc

SEQ ID NO: 627368 - DNA, 16 bp, Homo sapiens
atctcatcaacaaaga

SEQ ID NO: 627369 - DNA, 18 bp, Homo sapiens
atctccagccaatttcaa

SEQ ID NO: 627370 - DNA, 20 bp, Homo sapiens
atctcctcccatggccttcc

SEQ ID NO: 627371 - DNA, 22 bp, Homo sapiens
atctcctcccatggccttccct

SEQ ID NO: 627372 - DNA, 21 bp, Homo sapiens
atctcctgtgcacctgacttt

SEQ ID NO: 627373 - DNA, 15 bp, Homo sapiens
atctctcaaaatgtg

SEQ ID NO: 627374 - DNA, 12 bp, Homo sapiens
atctctgtaaaa

SEQ ID NO: 627375 - DNA, 13 bp, Homo sapiens
atctcttcttcct

SEQ ID NO: 627376 - DNA, 19 bp, Homo sapiens
atctgaagtagtgtgagtg

SEQ ID NO: 627377 - DNA, 13 bp, Homo sapiens
atctgaatttcta

SEQ ID NO: 627378 - DNA, 13 bp, Homo sapiens
cccagctggcagc

SEQ ID NO: 627379 - DNA, 16 bp, Homo sapiens
cccagctggctgggtc

SEQ ID NO: 627380 - DNA, 23 bp, Homo sapiens
cccagctggctgggtcgcccctc

SEQ ID NO: 627381 - DNA, 20 bp, Homo sapiens
cccaggacccccccagtccg

SEQ ID NO: 627382 - DNA, 18 bp, Homo sapiens
caggcagttaggtgctga

SEQ ID NO: 627383 - DNA, 23 bp, Homo sapiens
caggcatgcaccagtgccgcctg

SEQ ID NO: 627384 - DNA, 14 bp, Homo sapiens
caggcattgcacta

SEQ ID NO: 627385 - DNA, 15 bp, Homo sapiens
caggcccgccctgcc

SEQ ID NO: 627386 - DNA, 21 bp, Homo sapiens
caggcccgtgggcgcaaaggt

SEQ ID NO: 627387 - DNA, 23 bp, Homo sapiens
caggcctcagggaccaaggagat

SEQ ID NO: 627388 - DNA, 17 bp, Homo sapiens
caggcgccgcctcgccc

SEQ ID NO: 627389 - DNA, 21 bp, Homo sapiens
caggcgcgcaccgcccaaccc

SEQ ID NO: 627390 - DNA, 15 bp, Homo sapiens
caggctacaggtgcc

SEQ ID NO: 627391 - DNA, 18 bp, Homo sapiens
caggctacaggtgcccca

SEQ ID NO: 627392 - DNA, 21 bp, Homo sapiens
caggctacaggtgccccacct

SEQ ID NO: 627393 - DNA, 18 bp, Homo sapiens
caggctcccactgcccct

SEQ ID NO: 627394 - DNA, 22 bp, Homo sapiens
caggctcccactgcccctgcac

SEQ ID NO: 627395 - DNA, 16 bp, Homo sapiens
caggctctgaatctct

SEQ ID NO: 627396 - DNA, 22 bp, Homo sapiens
caggctgagacacagcccagag

SEQ ID NO: 627397 - DNA, 15 bp, Homo sapiens
caggctgcgcctgcc

SEQ ID NO: 627398 - DNA, 16 bp, Homo sapiens
caggctgcgcctgccc

SEQ ID NO: 627399 - DNA, 20 bp, Homo sapiens
caggctgcgcctgcccgccc

SEQ ID NO: 627400 - DNA, 23 bp, Homo sapiens
caggctgcgcctgcccgcccgcc

SEQ ID NO: 627401 - DNA, 14 bp, Homo sapiens
cagggaaccagagc

SEQ ID NO: 627402 - DNA, 14 bp, Homo sapiens
cagggaagggtgcc

SEQ ID NO: 627403 - DNA, 15 bp, Homo sapiens
cagggaagggtgcct

SEQ ID NO: 627404 - DNA, 20 bp, Homo sapiens
cagggaagggtgcctggctg

SEQ ID NO: 627405 - DNA, 23 bp, Homo sapiens
cagggaagggtgcctggctgggc

SEQ ID NO: 627406 - DNA, 14 bp, Homo sapiens
cagggacagcctgc

SEQ ID NO: 627407 - DNA, 17 bp, Homo sapiens
cagggacagcctgcaca

SEQ ID NO: 627408 - DNA, 18 bp, Homo sapiens
cagggacagcctgcacag

SEQ ID NO: 627409 - DNA, 14 bp, Homo sapiens
cagggactctccat

SEQ ID NO: 627410 - DNA, 12 bp, Homo sapiens
cagggagggaac

SEQ ID NO: 627411 - DNA, 18 bp, Homo sapiens
cccctcccccgcagacag

SEQ ID NO: 627412 - DNA, 23 bp, Homo sapiens
cccctccctttttaaacaaatgg

SEQ ID NO: 627413 - DNA, 21 bp, Homo sapiens
cccctccgggcagagaccacc

SEQ ID NO: 627414 - DNA, 13 bp, Homo sapiens
cccctcctccatg

SEQ ID NO: 627415 - DNA, 22 bp, Homo sapiens
cccctcctccatgctgtccctg

SEQ ID NO: 627416 - DNA, 16 bp, Homo sapiens
cccctccttctcccct

SEQ ID NO: 627417 - DNA, 19 bp, Homo sapiens
cccctccttctcccctcca

SEQ ID NO: 627418 - DNA, 20 bp, Homo sapiens
cccctccttctcccctccag

SEQ ID NO: 627419 - DNA, 21 bp, Homo sapiens
cccctccttctcccctccaga

SEQ ID NO: 627420 - DNA, 16 bp, Homo sapiens
ctgttgtaatatcagt

SEQ ID NO: 627421 - DNA, 16 bp, Homo sapiens
ctgttgtctgaaacat

SEQ ID NO: 627422 - DNA, 21 bp, Homo sapiens
ctgttgtgtctggagcctgca

SEQ ID NO: 627423 - DNA, 15 bp, Homo sapiens
ctgtttatatatata

SEQ ID NO: 627424 - DNA, 20 bp, Homo sapiens
ctgtttccaatgccaattca

SEQ ID NO: 627425 - DNA, 23 bp, Homo sapiens
ctgtttccaatgccaattcatct

SEQ ID NO: 627426 - DNA, 15 bp, Homo sapiens
ctgtttctcctccat

SEQ ID NO: 627427 - DNA, 17 bp, Homo sapiens
cttaaaaaaaaaaatga

SEQ ID NO: 627428 - DNA, 12 bp, Homo sapiens
cttaaaaatgta

SEQ ID NO: 627429 - DNA, 20 bp, Homo sapiens
cttaaaaattatctttaaaa

SEQ ID NO: 627430 - DNA, 15 bp, Homo sapiens
cttaaacaaaaactt

SEQ ID NO: 627431 - DNA, 21 bp, Homo sapiens
cttaaacaaaaactttccatg

SEQ ID NO: 627432 - DNA, 22 bp, Homo sapiens
cttaaacaaaaactttccatga

SEQ ID NO: 627433 - DNA, 23 bp, Homo sapiens
cttaaacaaaaactttccatgac

SEQ ID NO: 627434 - DNA, 19 bp, Homo sapiens
cttaaacccacataaacac

SEQ ID NO: 627435 - DNA, 15 bp, Homo sapiens
cttaaacctgtgctt

SEQ ID NO: 627436 - DNA, 20 bp, Homo sapiens
cttaacataaacttgtactt

SEQ ID NO: 627437 - DNA, 15 bp, Homo sapiens
cttaactaatgtaaa

SEQ ID NO: 627438 - DNA, 16 bp, Homo sapiens
cttaactaatgtaaat

SEQ ID NO: 627439 - DNA, 18 bp, Homo sapiens
cttaaggaaaagagaaac

SEQ ID NO: 627440 - DNA, 15 bp, Homo sapiens
cttaagtcttactgt

SEQ ID NO: 627441 - DNA, 16 bp, Homo sapiens
cttaatatacaggtat

SEQ ID NO: 627442 - DNA, 18 bp, Homo sapiens
cttaatcaattaattttt

SEQ ID NO: 627443 - DNA, 14 bp, Homo sapiens
cttacaaagccagc

SEQ ID NO: 627444 - DNA, 15 bp, Homo sapiens
cttacaaagccagct

SEQ ID NO: 627445 - DNA, 18 bp, Homo sapiens
cttacaaccacatttctg

SEQ ID NO: 627446 - DNA, 21 bp, Homo sapiens
cttacacgaagaaatagaata

SEQ ID NO: 627447 - DNA, 18 bp, Homo sapiens
cttacactgaaatccaaa

SEQ ID NO: 627448 - DNA, 15 bp, Homo sapiens
cttacagtaggagtg

SEQ ID NO: 627449 - DNA, 12 bp, Homo sapiens
cttacagtgact

SEQ ID NO: 627450 - DNA, 15 bp, Homo sapiens
cttacagtgactgtg

SEQ ID NO: 627451 - DNA, 19 bp, Homo sapiens
cttaccccgtccctttccc

SEQ ID NO: 627452 - DNA, 16 bp, Homo sapiens
cttacccttcaatgtt

SEQ ID NO: 627453 - DNA, 15 bp, Homo sapiens
cttactgattaactc

SEQ ID NO: 627454 - DNA, 16 bp, Homo sapiens
cttactgttttgtgcg

SEQ ID NO: 627455 - DNA, 16 bp, Homo sapiens
cttagaagaaatatga

SEQ ID NO: 627456 - DNA, 15 bp, Homo sapiens
cttagaatgtgaaaa

SEQ ID NO: 627457 - DNA, 19 bp, Homo sapiens
cttagaccgtggtgtcctc

SEQ ID NO: 627458 - DNA, 20 bp, Homo sapiens
cttagaccgtggtgtcctct

SEQ ID NO: 627459 - DNA, 21 bp, Homo sapiens
cttagagataccctctgagac

SEQ ID NO: 627460 - DNA, 23 bp, Homo sapiens
cttagcagctcttcccctttcct

SEQ ID NO: 627461 - DNA, 19 bp, Homo sapiens
cttagcttagaccgtggtg

SEQ ID NO: 627462 - DNA, 23 bp, Homo sapiens
cttaggcaatggtgaactgtcat

SEQ ID NO: 627463 - DNA, 22 bp, Homo sapiens
cttagggagtgtgccttgggcg

SEQ ID NO: 627464 - DNA, 17 bp, Homo sapiens
cttagtaaattcctaat

SEQ ID NO: 627465 - DNA, 19 bp, Homo sapiens
cttagtatctcatcaacaa

SEQ ID NO: 627466 - DNA, 22 bp, Homo sapiens
cttagtatctcatcaacaaaga

SEQ ID NO: 627467 - DNA, 18 bp, Homo sapiens
cttataacattgtatgtt

SEQ ID NO: 627468 - DNA, 16 bp, Homo sapiens
cttatatgtgcccctt

SEQ ID NO: 627469 - DNA, 16 bp, Homo sapiens
cttatattattttctg

SEQ ID NO: 627470 - DNA, 22 bp, Homo sapiens
cttatctccagccaatttcaaa

SEQ ID NO: 627471 - DNA, 16 bp, Homo sapiens
cttatggaacactctg

SEQ ID NO: 627472 - DNA, 17 bp, Homo sapiens
cttatggaacactctga

SEQ ID NO: 627473 - DNA, 21 bp, Homo sapiens
cttatggaacactctgagact

SEQ ID NO: 627474 - DNA, 22 bp, Homo sapiens
cttattttgattgtttgatgaa

SEQ ID NO: 627475 - DNA, 17 bp, Homo sapiens
cttcaaatacattctaa

SEQ ID NO: 627476 - DNA, 19 bp, Homo sapiens
cttcaaccctgccctgcac

SEQ ID NO: 627477 - DNA, 19 bp, Homo sapiens
cttcaaggatcctgagcca

SEQ ID NO: 627478 - DNA, 20 bp, Homo sapiens
cttcaaggatcctgagccag

SEQ ID NO: 627479 - DNA, 23 bp, Homo sapiens
cttcaaggatcctgagccagatt

SEQ ID NO: 627480 - DNA, 23 bp, Homo sapiens
cttcaatccccataatgcttctt

SEQ ID NO: 627481 - DNA, 14 bp, Homo sapiens
cttcacacaaagtg

SEQ ID NO: 627482 - DNA, 20 bp, Homo sapiens
cttcacttaaaatcaaattt

SEQ ID NO: 627483 - DNA, 12 bp, Homo sapiens
cttcagaaactt

SEQ ID NO: 627484 - DNA, 12 bp, Homo sapiens
cttcagactctc

SEQ ID NO: 627485 - DNA, 14 bp, Homo sapiens
cttcagactctctc

SEQ ID NO: 627486 - DNA, 19 bp, Homo sapiens
cttcagatgtttccaagat

SEQ ID NO: 627487 - DNA, 22 bp, Homo sapiens
cttcagccctaacatagtgtct

SEQ ID NO: 627488 - DNA, 11 bp, Homo sapiens
cttcagtgcct

SEQ ID NO: 627489 - DNA, 18 bp, Homo sapiens
cttcagtgccttatggaa

SEQ ID NO: 627490 - DNA, 17 bp, Homo sapiens
cttcagttctcatcttg

SEQ ID NO: 627491 - DNA, 14 bp, Homo sapiens
cttcatcccagggt

SEQ ID NO: 627492 - DNA, 15 bp, Homo sapiens
cttcatcccagggta

SEQ ID NO: 627493 - DNA, 19 bp, Homo sapiens
cttcatgaccttacatagc

SEQ ID NO: 627494 - DNA, 14 bp, Homo sapiens
cttcatggaactca

SEQ ID NO: 627495 - DNA, 15 bp, Homo sapiens
cttcattaaaacaag

SEQ ID NO: 627496 - DNA, 23 bp, Homo sapiens
cttcattaaaacaagagaccact

SEQ ID NO: 627497 - DNA, 14 bp, Homo sapiens
cttcatttaacact

SEQ ID NO: 627498 - DNA, 21 bp, Homo sapiens
cttcatttaacactgagtgaa

SEQ ID NO: 627499 - DNA, 10 bp, Homo sapiens
cttccagatg

SEQ ID NO: 627500 - DNA, 23 bp, Homo sapiens
cttccagatttgagctgcctgga

SEQ ID NO: 627501 - DNA, 14 bp, Homo sapiens
cttccagtgcatgt

SEQ ID NO: 627502 - DNA, 19 bp, Homo sapiens
cttccatcttgtggggcca

SEQ ID NO: 627503 - DNA, 23 bp, Homo sapiens
cttccatcttgtggggccaggac

SEQ ID NO: 627504 - DNA, 13 bp, Homo sapiens
cttcccaacaata

SEQ ID NO: 627505 - DNA, 21 bp, Homo sapiens
cttcccaagtcctcgcccccc

SEQ ID NO: 627506 - DNA, 21 bp, Homo sapiens
cttcccatgtctttctccaaa

SEQ ID NO: 627507 - DNA, 20 bp, Homo sapiens
cttcccccttcccctgcgcc

SEQ ID NO: 627508 - DNA, 16 bp, Homo sapiens
cttccccgtgcggccc

SEQ ID NO: 627509 - DNA, 15 bp, Homo sapiens
cttcccctgcgccct

SEQ ID NO: 627510 - DNA, 17 bp, Homo sapiens
cttcccctgcgccctcc

SEQ ID NO: 627511 - DNA, 14 bp, Homo sapiens
cttcccctttcctg

SEQ ID NO: 627512 - DNA, 17 bp, Homo sapiens
cttcccgcagcaccagc

SEQ ID NO: 627513 - DNA, 20 bp, Homo sapiens
cttcccgcagcaccagcctg

SEQ ID NO: 627514 - DNA, 22 bp, Homo sapiens
cttcccgcagcaccagcctgag

SEQ ID NO: 627515 - DNA, 13 bp, Homo sapiens
cttccctgtccag

SEQ ID NO: 627516 - DNA, 10 bp, Homo sapiens
cttccttcct

SEQ ID NO: 627517 - DNA, 11 bp, Homo sapiens
cttccttcctt

SEQ ID NO: 627518 - DNA, 19 bp, Homo sapiens
cttcgcgtatttcaggatt

SEQ ID NO: 627519 - DNA, 16 bp, Homo sapiens
cttcggataattttca

SEQ ID NO: 627520 - DNA, 17 bp, Homo sapiens
cttcggataattttcat

SEQ ID NO: 627521 - DNA, 17 bp, Homo sapiens
cttcggcagtggctggg

SEQ ID NO: 627522 - DNA, 19 bp, Homo sapiens
cttctaaatcataatcatc

SEQ ID NO: 627523 - DNA, 14 bp, Homo sapiens
cttctactccatgg

SEQ ID NO: 627524 - DNA, 17 bp, Homo sapiens
ctccagattattttcta

SEQ ID NO: 627525 - DNA, 19 bp, Homo sapiens
ctccagattattttctata

SEQ ID NO: 627526 - DNA, 22 bp, Homo sapiens
ctccagattattttctatattt

SEQ ID NO: 627527 - DNA, 20 bp, Homo sapiens
ctccagcccatgctggctgg

SEQ ID NO: 627528 - DNA, 15 bp, Homo sapiens
ctccagtacaataaa

SEQ ID NO: 627529 - DNA, 17 bp, Homo sapiens
ctccatgctgtccctgt

SEQ ID NO: 627530 - DNA, 22 bp, Homo sapiens
ctccatggtgaactgaagcaga

SEQ ID NO: 627531 - DNA, 15 bp, Homo sapiens
ctcccaaactccaag

SEQ ID NO: 627532 - DNA, 19 bp, Homo sapiens
ctcccaaataaactcctta

SEQ ID NO: 627533 - DNA, 23 bp, Homo sapiens
ctcccaaataaactccttaacca

SEQ ID NO: 627534 - DNA, 18 bp, Homo sapiens
ctcccacctcggacacca

SEQ ID NO: 627535 - DNA, 17 bp, Homo sapiens
ctcccactgcccctgca

SEQ ID NO: 627536 - DNA, 16 bp, Homo sapiens
ctcccagggcccgagc

SEQ ID NO: 627537 - DNA, 14 bp, Homo sapiens
ctccccacagtcct

SEQ ID NO: 627538 - DNA, 21 bp, Homo sapiens
ctccccagagccctgcagtca

SEQ ID NO: 627539 - DNA, 14 bp, Homo sapiens
ctccccagccccca

SEQ ID NO: 627540 - DNA, 22 bp, Homo sapiens
ctcccccacggccgtccctgac

SEQ ID NO: 627541 - DNA, 18 bp, Homo sapiens
ctcccccaggctgcgcct

SEQ ID NO: 627542 - DNA, 15 bp, Homo sapiens
ctcccccgcagacag

SEQ ID NO: 627543 - DNA, 12 bp, Homo sapiens
ctccccctcagc

SEQ ID NO: 627544 - DNA, 13 bp, Homo sapiens
ctccccctcagct

SEQ ID NO: 627545 - DNA, 19 bp, Homo sapiens
ctccccgcccgccctcctc

SEQ ID NO: 627546 - DNA, 14 bp, Homo sapiens
ctcccctccagacc

SEQ ID NO: 627547 - DNA, 18 bp, Homo sapiens
ctcccctctcctgagcct

SEQ ID NO: 627548 - DNA, 15 bp, Homo sapiens
ctcccctggtcctgc

SEQ ID NO: 627549 - DNA, 19 bp, Homo sapiens
ctcccctggtcctgcactg

SEQ ID NO: 627550 - DNA, 23 bp, Homo sapiens
ctccccttcgcgtatttcaggat

SEQ ID NO: 627551 - DNA, 16 bp, Homo sapiens
ctcccgccgcctcggg

SEQ ID NO: 627552 - DNA, 14 bp, Homo sapiens
ctcccggtgtgcag

SEQ ID NO: 627553 - DNA, 15 bp, Homo sapiens
ctcccggtgtgcagc

SEQ ID NO: 627554 - DNA, 10 bp, Homo sapiens
ctccctccac

SEQ ID NO: 627555 - DNA, 19 bp, Homo sapiens
ctccctccacacctccacc

SEQ ID NO: 627556 - DNA, 20 bp, Homo sapiens
ctccctccacacctccaccc

SEQ ID NO: 627557 - DNA, 16 bp, Homo sapiens
ctccctccctccctgc

SEQ ID NO: 627558 - DNA, 19 bp, Homo sapiens
ctccctgctccctgctccc

SEQ ID NO: 627559 - DNA, 13 bp, Homo sapiens
ctccctgctgcca

SEQ ID NO: 627560 - DNA, 17 bp, Homo sapiens
ctccctgggcaccctgc

SEQ ID NO: 627561 - DNA, 23 bp, Homo sapiens
ctccctgggcaccctgcaggcag

SEQ ID NO: 627562 - DNA, 18 bp, Homo sapiens
ctccctggggaccaggag

SEQ ID NO: 627563 - DNA, 19 bp, Homo sapiens
ctccctggggaccaggagc

SEQ ID NO: 627564 - DNA, 17 bp, Homo sapiens
ctccctggggaggaccc

SEQ ID NO: 627565 - DNA, 20 bp, Homo sapiens
ctccctggggaggacccctg

SEQ ID NO: 627566 - DNA, 22 bp, Homo sapiens
ctccctggggaggacccctgcc

SEQ ID NO: 627567 - DNA, 16 bp, Homo sapiens
ctcccttctttccttc

SEQ ID NO: 627568 - DNA, 17 bp, Homo sapiens
ctcccttctttccttcc

SEQ ID NO: 627569 - DNA, 18 bp, Homo sapiens
ctcccttctttccttcct

SEQ ID NO: 627570 - DNA, 19 bp, Homo sapiens
ctccctttatcatgtgttt

SEQ ID NO: 627571 - DNA, 20 bp, Homo sapiens
ctccgcccttccctgacact

SEQ ID NO: 627572 - DNA, 13 bp, Homo sapiens
ctccgcggaggcc

SEQ ID NO: 627573 - DNA, 15 bp, Homo sapiens
ctccgcggaggcccc

SEQ ID NO: 627574 - DNA, 16 bp, Homo sapiens
ctccgcggaggcccct

SEQ ID NO: 627575 - DNA, 18 bp, Homo sapiens
ctccggcagaggcagggc

SEQ ID NO: 627576 - DNA, 21 bp, Homo sapiens
ctccggcagaggcagggccct

SEQ ID NO: 627577 - DNA, 23 bp, Homo sapiens
ctccggcagaggcagggccctgg

SEQ ID NO: 627578 - DNA, 15 bp, Homo sapiens
ctccgggcagagacc

SEQ ID NO: 627579 - DNA, 15 bp, Homo sapiens
ctcttcccccttccc

SEQ ID NO: 627580 - DNA, 17 bp, Homo sapiens
ctcttcccccttcccct

SEQ ID NO: 627581 - DNA, 19 bp, Homo sapiens
ctcttcccccttcccctgc

SEQ ID NO: 627582 - DNA, 19 bp, Homo sapiens
ctcttctcagctccactct

SEQ ID NO: 627583 - DNA, 12 bp, Homo sapiens
ctcttcttcctt

SEQ ID NO: 627584 - DNA, 19 bp, Homo sapiens
ctcttgctgtttaccgccc

SEQ ID NO: 627585 - DNA, 23 bp, Homo sapiens
ctcttgctgtttaccgcccaccc

SEQ ID NO: 627586 - DNA, 12 bp, Homo sapiens
ctcttggtctct

SEQ ID NO: 627587 - DNA, 13 bp, Homo sapiens
ctcttggtctctt

SEQ ID NO: 627588 - DNA, 15 bp, Homo sapiens
ctcttggtctctttc

SEQ ID NO: 627589 - DNA, 12 bp, Homo sapiens
ctctttccccag

SEQ ID NO: 627590 - DNA, 17 bp, Homo sapiens
ctctttctctctgtgtg

SEQ ID NO: 627591 - DNA, 16 bp, Homo sapiens
ctctttctttccaaag

SEQ ID NO: 627592 - DNA, 15 bp, Homo sapiens
ctctttcttttgtgc

SEQ ID NO: 627593 - DNA, 14 bp, Homo sapiens
ctcttttgctctct

SEQ ID NO: 627594 - DNA, 14 bp, Homo sapiens
ctgaaaaagtgttt

SEQ ID NO: 627595 - DNA, 17 bp, Homo sapiens
ctgaaaaagtgttttta

SEQ ID NO: 627596 - DNA, 15 bp, Homo sapiens
ctgaaaactggaata

SEQ ID NO: 627597 - DNA, 21 bp, Homo sapiens
ctgaaaactggaataagaagc

SEQ ID NO: 627598 - DNA, 22 bp, Homo sapiens
ctgaaaactggaataagaagca

SEQ ID NO: 627599 - DNA, 16 bp, Homo sapiens
ctgaaaggtgctttct

SEQ ID NO: 627600 - DNA, 17 bp, Homo sapiens
ctgaaatccaaaatagt

SEQ ID NO: 627601 - DNA, 18 bp, Homo sapiens
ctgaaattagtgttttca

SEQ ID NO: 627602 - DNA, 23 bp, Homo sapiens
ctgaaattagtgttttcattctg

SEQ ID NO: 627603 - DNA, 20 bp, Homo sapiens
ctgaaattatgtcaaatgga

SEQ ID NO: 627604 - DNA, 22 bp, Homo sapiens
ctgaacagaccggggtggagtc

SEQ ID NO: 627605 - DNA, 20 bp, Homo sapiens
ctgaactatcagggcaagct

SEQ ID NO: 627606 - DNA, 20 bp, Homo sapiens
ctgaagaaaatccttcagca

SEQ ID NO: 627607 - DNA, 13 bp, Homo sapiens
ctgaaggagagga

SEQ ID NO: 627608 - DNA, 18 bp, Homo sapiens
ctgaagtcccttcctgtc

SEQ ID NO: 627609 - DNA, 14 bp, Homo sapiens
ctgaataacaacaa

SEQ ID NO: 627610 - DNA, 17 bp, Homo sapiens
ctgaatcagaggcagag

SEQ ID NO: 627611 - DNA, 19 bp, Homo sapiens
ctgaatccatcaggacttg

SEQ ID NO: 627612 - DNA, 18 bp, Homo sapiens
ctgaatctctcaaaatgt

SEQ ID NO: 627613 - DNA, 19 bp, Homo sapiens
ctgaatctctcaaaatgtg

SEQ ID NO: 627614 - DNA, 21 bp, Homo sapiens
ctgaatctctcaaaatgtgcc

SEQ ID NO: 627615 - DNA, 15 bp, Homo sapiens
ctgaatctgagaaag

SEQ ID NO: 627616 - DNA, 20 bp, Homo sapiens
ctgaattcattgtctcagtg

SEQ ID NO: 627617 - DNA, 22 bp, Homo sapiens
ctgaattcattgtctcagtgaa

SEQ ID NO: 627618 - DNA, 15 bp, Homo sapiens
ctgaattgttatgta

SEQ ID NO: 627619 - DNA, 13 bp, Homo sapiens
ctgaattttcaca

SEQ ID NO: 627620 - DNA, 21 bp, Homo sapiens
ctgacaagttacccctgaaat

SEQ ID NO: 627621 - DNA, 13 bp, Homo sapiens
ctgacacccttta

SEQ ID NO: 627622 - DNA, 17 bp, Homo sapiens
ctgacagcaaacacagt

SEQ ID NO: 627623 - DNA, 21 bp, Homo sapiens
ctgacatatttcataagcaca

SEQ ID NO: 627624 - DNA, 18 bp, Homo sapiens
ctgacatggtgctgtgtg

SEQ ID NO: 627625 - DNA, 21 bp, Homo sapiens
ctgaccttcggcagtggctgg

SEQ ID NO: 627626 - DNA, 22 bp, Homo sapiens
ctgaccttcggcagtggctggg

SEQ ID NO: 627627 - DNA, 22 bp, Homo sapiens
ctgaccttctgcggctccgggc

SEQ ID NO: 627628 - DNA, 14 bp, Homo sapiens
ctgactcagtgcag

SEQ ID NO: 627629 - DNA, 14 bp, Homo sapiens
ctgactcctgggtg

SEQ ID NO: 627630 - DNA, 15 bp, Homo sapiens
ctgactcctgggtgg

SEQ ID NO: 627631 - DNA, 22 bp, Homo sapiens
ctgactgtgttcagtgccttgg

SEQ ID NO: 627632 - DNA, 15 bp, Homo sapiens
ctgacttcccagctg

SEQ ID NO: 627633 - DNA, 22 bp, Homo sapiens
ctgacttcccagctggcagcgc

SEQ ID NO: 627634 - DNA, 23 bp, Homo sapiens
ctgacttcccagctggcagcgcc

SEQ ID NO: 627635 - DNA, 24 bp, Homo sapiens
ctgacttcccagctggcagcgcct

SEQ ID NO: 627636 - DNA, 21 bp, Homo sapiens
ctgactttggagacgatgctt

SEQ ID NO: 627637 - DNA, 20 bp, Homo sapiens
ctgagaaaaagcattaaaaa

SEQ ID NO: 627638 - DNA, 18 bp, Homo sapiens
ctgagaagagtcgagtga

SEQ ID NO: 627639 - DNA, 21 bp, Homo sapiens
ctgagacacagcccagagact

SEQ ID NO: 627640 - DNA, 19 bp, Homo sapiens
ctgagaggagcgtgtccta

SEQ ID NO: 627641 - DNA, 17 bp, Homo sapiens
ctgagatgggaggatca

SEQ ID NO: 627642 - DNA, 18 bp, Homo sapiens
ctgagcacatctcttcat

SEQ ID NO: 627643 - DNA, 21 bp, Homo sapiens
ctgagcagatcgtgccgtgga

SEQ ID NO: 627644 - DNA, 13 bp, Homo sapiens
ctgagcagtgggg

SEQ ID NO: 627645 - DNA, 18 bp, Homo sapiens
ctgagccagatttcactc

SEQ ID NO: 627646 - DNA, 23 bp, Homo sapiens
ccctgagtgggctgggccctctg

SEQ ID NO: 627647 - DNA, 12 bp, Homo sapiens
ccctgcaggcag

SEQ ID NO: 627648 - DNA, 21 bp, Homo sapiens
ccctgcagtttggccctggag

SEQ ID NO: 627649 - DNA, 23 bp, Homo sapiens
ccctgcagtttggccctggagcc

SEQ ID NO: 627650 - DNA, 16 bp, Homo sapiens
ccctgcatcccttggc

SEQ ID NO: 627651 - DNA, 15 bp, Homo sapiens
ccctgcccagcacct

SEQ ID NO: 627652 - DNA, 16 bp, Homo sapiens
ccctgcccagcacctc

SEQ ID NO: 627653 - DNA, 13 bp, Homo sapiens
ccctgccctcact

SEQ ID NO: 627654 - DNA, 18 bp, Homo sapiens
ccctgccctcactccact

SEQ ID NO: 627655 - DNA, 14 bp, Homo sapiens
ccctgccctgcacc

SEQ ID NO: 627656 - DNA, 21 bp, Homo sapiens
ccctgcctctatccctggcca

SEQ ID NO: 627657 - DNA, 22 bp, Homo sapiens
ccctgcctgaggaggaggacac

SEQ ID NO: 627658 - DNA, 14 bp, Homo sapiens
ccctgcgcccctgc

SEQ ID NO: 627659 - DNA, 16 bp, Homo sapiens
ccctgcgcccctgccc

SEQ ID NO: 627660 - DNA, 21 bp, Homo sapiens
ccctgctcccggctctgaggc

SEQ ID NO: 627661 - DNA, 14 bp, Homo sapiens
ccctgctccctgct

SEQ ID NO: 627662 - DNA, 14 bp, Homo sapiens
ccctgctgccaggc

SEQ ID NO: 627663 - DNA, 23 bp, Homo sapiens
ccctgctgccaggctcccactgc

SEQ ID NO: 627664 - DNA, 18 bp, Homo sapiens
ccctggaagttgtccttt

SEQ ID NO: 627665 - DNA, 20 bp, Homo sapiens
ccctggacgcatgcagggcc

SEQ ID NO: 627666 - DNA, 13 bp, Homo sapiens
ccctggagccagg

SEQ ID NO: 627667 - DNA, 18 bp, Homo sapiens
ccctggagccagggcaga

SEQ ID NO: 627668 - DNA, 18 bp, Homo sapiens
ccctggccacctgccagg

SEQ ID NO: 627669 - DNA, 14 bp, Homo sapiens
ccctggcggcaggg

SEQ ID NO: 627670 - DNA, 15 bp, Homo sapiens
ccctggcggcagggg

SEQ ID NO: 627671 - DNA, 16 bp, Homo sapiens
ccctggctttggcgcc

SEQ ID NO: 627672 - DNA, 21 bp, Homo sapiens
ccctgggcaccctgcaggcag

SEQ ID NO: 627673 - DNA, 18 bp, Homo sapiens
ccctggggaccaggagct

SEQ ID NO: 627674 - DNA, 19 bp, Homo sapiens
ccctggggaggacccctgc

SEQ ID NO: 627675 - DNA, 15 bp, Homo sapiens
ccctggggcatccac

SEQ ID NO: 627676 - DNA, 15 bp, Homo sapiens
ccctggggtctctga

SEQ ID NO: 627677 - DNA, 18 bp, Homo sapiens
ccctggggtctctgagca

SEQ ID NO: 627678 - DNA, 21 bp, Homo sapiens
ccctggggtctctgagcagtg

SEQ ID NO: 627679 - DNA, 22 bp, Homo sapiens
ccctggggtctctgagcagtgg

SEQ ID NO: 627680 - DNA, 23 bp, Homo sapiens
ccctggggtctctgagcagtggg

SEQ ID NO: 627681 - DNA, 12 bp, Homo sapiens
ccctggtcctgc

SEQ ID NO: 627682 - DNA, 13 bp, Homo sapiens
ccctgtagggaaa

SEQ ID NO: 627683 - DNA, 22 bp, Homo sapiens
ccctgtccatccgtctctgtcc

SEQ ID NO: 627684 - DNA, 12 bp, Homo sapiens
ccctgtcccctg

SEQ ID NO: 627685 - DNA, 14 bp, Homo sapiens
ccctgtgccctctc

SEQ ID NO: 627686 - DNA, 15 bp, Homo sapiens
ccctgtgccctctca

SEQ ID NO: 627687 - DNA, 12 bp, Homo sapiens
ccctgtgggagt

SEQ ID NO: 627688 - DNA, 17 bp, Homo sapiens
ccctgtgggagtccact

SEQ ID NO: 627689 - DNA, 22 bp, Homo sapiens
ccctgtgggagtccactttcct

SEQ ID NO: 627690 - DNA, 16 bp, Homo sapiens
ccctgtgggctcacac

SEQ ID NO: 627691 - DNA, 21 bp, Homo sapiens
ccctgtgggctcacaccggca

SEQ ID NO: 627692 - DNA, 21 bp, Homo sapiens
ccctgttccgcctcactgggt

SEQ ID NO: 627693 - DNA, 22 bp, Homo sapiens
ccctgttccgcctcactgggtg

SEQ ID NO: 627694 - DNA, 19 bp, Homo sapiens
ccctgttgacctaccctgg

SEQ ID NO: 627695 - DNA, 12 bp, Homo sapiens
cccttcatccca

SEQ ID NO: 627696 - DNA, 12 bp, Homo sapiens
cccttccccact

SEQ ID NO: 627697 - DNA, 20 bp, Homo sapiens
cccttcccctgcgccctccc

SEQ ID NO: 627698 - DNA, 22 bp, Homo sapiens
cccttcccctgcgccctccctc

SEQ ID NO: 627699 - DNA, 16 bp, Homo sapiens
cccttccctgacactg

SEQ ID NO: 627700 - DNA, 17 bp, Homo sapiens
cccttcctgtcctgctc

SEQ ID NO: 627701 - DNA, 18 bp, Homo sapiens
cccttcctgtcctgctca

SEQ ID NO: 627702 - DNA, 17 bp, Homo sapiens
cccttcgcgtatttcag

SEQ ID NO: 627703 - DNA, 22 bp, Homo sapiens
cccttcggtattgttcaaagaa

SEQ ID NO: 627704 - DNA, 16 bp, Homo sapiens
cccttctttccttcct

SEQ ID NO: 627705 - DNA, 18 bp, Homo sapiens
ccctttcccaaacccttc

SEQ ID NO: 627706 - DNA, 11 bp, Homo sapiens
ccctttcccca

SEQ ID NO: 627707 - DNA, 20 bp, Homo sapiens
ccctttccccattcagtgac

SEQ ID NO: 627708 - DNA, 14 bp, Homo sapiens
ccctttccctgcat

SEQ ID NO: 627709 - DNA, 18 bp, Homo sapiens
ccctttccctgcatccct

SEQ ID NO: 627710 - DNA, 14 bp, Homo sapiens
ccctttcgtccaca

SEQ ID NO: 627711 - DNA, 15 bp, Homo sapiens
ccctttctcttgctg

SEQ ID NO: 627712 - DNA, 17 bp, Homo sapiens
ccgaagccccttggaga

SEQ ID NO: 627713 - DNA, 18 bp, Homo sapiens
ccgaagccccttggagag

SEQ ID NO: 627714 - DNA, 22 bp, Homo sapiens
ccgaagccccttggagagagag

SEQ ID NO: 627715 - DNA, 13 bp, Homo sapiens
ccgaagggcagcc

SEQ ID NO: 627716 - DNA, 21 bp, Homo sapiens
ccgacaaagggaaggctgctg

SEQ ID NO: 627717 - DNA, 16 bp, Homo sapiens
ccgactgggctgctgg

SEQ ID NO: 627718 - DNA, 12 bp, Homo sapiens
ccgagcccctgt

SEQ ID NO: 627719 - DNA, 18 bp, Homo sapiens
ccgagcgcgtgccttccc

SEQ ID NO: 627720 - DNA, 12 bp, Homo sapiens
ccgaggaggccg

SEQ ID NO: 627721 - DNA, 15 bp, Homo sapiens
ccgatataagccata

SEQ ID NO: 627722 - DNA, 21 bp, Homo sapiens
ccgcacgcggccgctctccgc

SEQ ID NO: 627723 - DNA, 15 bp, Homo sapiens
ccgcactcaggagca

SEQ ID NO: 627724 - DNA, 21 bp, Homo sapiens
ccgcactcaggagcacagcca

SEQ ID NO: 627725 - DNA, 16 bp, Homo sapiens
ccgcagaggcccgagg

SEQ ID NO: 627726 - DNA, 12 bp, Homo sapiens
ccgcagcaccag

SEQ ID NO: 627727 - DNA, 21 bp, Homo sapiens
ccgcagcaccagcctgagcca

SEQ ID NO: 627728 - DNA, 23 bp, Homo sapiens
ccgcagggcgctccggcagaggc

SEQ ID NO: 627729 - DNA, 19 bp, Homo sapiens
ccgccacgaggagcttcca

SEQ ID NO: 627730 - DNA, 15 bp, Homo sapiens
ccgcccacccacacc

SEQ ID NO: 627731 - DNA, 14 bp, Homo sapiens
ccgcccacccagca

SEQ ID NO: 627732 - DNA, 15 bp, Homo sapiens
ccgcccacccagcag

SEQ ID NO: 627733 - DNA, 16 bp, Homo sapiens
ccgcccacccagcagc

SEQ ID NO: 627734 - DNA, 19 bp, Homo sapiens
ccgcccacgcggctgctgc

SEQ ID NO: 627735 - DNA, 13 bp, Homo sapiens
ccgccccagagac

SEQ ID NO: 627736 - DNA, 14 bp, Homo sapiens
ccgccccagagact

SEQ ID NO: 627737 - DNA, 15 bp, Homo sapiens
ccgccccagagactg

SEQ ID NO: 627738 - DNA, 16 bp, Homo sapiens
ccgccccgtgctcctc

SEQ ID NO: 627739 - DNA, 17 bp, Homo sapiens
ccgccccgtgctcctct

SEQ ID NO: 627740 - DNA, 20 bp, Homo sapiens
ccgccccgtgctcctctgcc

SEQ ID NO: 627741 - DNA, 14 bp, Homo sapiens
ccgcccgcccaccc

SEQ ID NO: 627742 - DNA, 18 bp, Homo sapiens
ccgcccgcccaccccgct

SEQ ID NO: 627743 - DNA, 14 bp, Homo sapiens
ccgcccgcccccgc

SEQ ID NO: 627744 - DNA, 15 bp, Homo sapiens
ccgcccggcctccta

SEQ ID NO: 627745 - DNA, 12 bp, Homo sapiens
ccgccctcctct

SEQ ID NO: 627746 - DNA, 13 bp, Homo sapiens
ccgccctcgctcc

SEQ ID NO: 627747 - DNA, 18 bp, Homo sapiens
ccgcccttccctgacact

SEQ ID NO: 627748 - DNA, 18 bp, Homo sapiens
cctcacagcctctccctt

SEQ ID NO: 627749 - DNA, 16 bp, Homo sapiens
cctcacccctgtaggg

SEQ ID NO: 627750 - DNA, 19 bp, Homo sapiens
cctcacctctgaggacaga

SEQ ID NO: 627751 - DNA, 17 bp, Homo sapiens
cctcactccactcccct

SEQ ID NO: 627752 - DNA, 18 bp, Homo sapiens
cctcactccactcccctc

SEQ ID NO: 627753 - DNA, 15 bp, Homo sapiens
cctcactgtgacctg

SEQ ID NO: 627754 - DNA, 16 bp, Homo sapiens
cctcactgtgacctgc

SEQ ID NO: 627755 - DNA, 21 bp, Homo sapiens
cctcagagaatgatcaccctg

SEQ ID NO: 627756 - DNA, 11 bp, Homo sapiens
cctcagccagt

SEQ ID NO: 627757 - DNA, 19 bp, Homo sapiens
cctcagccagtggcacagg

SEQ ID NO: 627758 - DNA, 16 bp, Homo sapiens
cctcagcgtctcccca

SEQ ID NO: 627759 - DNA, 19 bp, Homo sapiens
cctcagcgtctccccatgc

SEQ ID NO: 627760 - DNA, 14 bp, Homo sapiens
cctcagctctccct

SEQ ID NO: 627761 - DNA, 23 bp, Homo sapiens
cctcagggaccaaggagatgggg

SEQ ID NO: 627762 - DNA, 19 bp, Homo sapiens
cctcagttggcctctgccc

SEQ ID NO: 627763 - DNA, 23 bp, Homo sapiens
cctcatgcctttatttctgtatc

SEQ ID NO: 627764 - DNA, 12 bp, Homo sapiens
cctcatggctgt

SEQ ID NO: 627765 - DNA, 13 bp, Homo sapiens
cctccaaatgctg

SEQ ID NO: 627766 - DNA, 15 bp, Homo sapiens
cctccacacctccac

SEQ ID NO: 627767 - DNA, 14 bp, Homo sapiens
cctccacaggagcc

SEQ ID NO: 627768 - DNA, 13 bp, Homo sapiens
cctccacccgtcc

SEQ ID NO: 627769 - DNA, 13 bp, Homo sapiens
cctccactcctcc

SEQ ID NO: 627770 - DNA, 13 bp, Homo sapiens
cgcagcctgaagc

SEQ ID NO: 627771 - DNA, 13 bp, Homo sapiens
cgcagggcgctcc

SEQ ID NO: 627772 - DNA, 18 bp, Homo sapiens
cgcagggcgctccggcag

SEQ ID NO: 627773 - DNA, 21 bp, Homo sapiens
cgcagggcgctccggcagagg

SEQ ID NO: 627774 - DNA, 13 bp, Homo sapiens
cgcatctgcctgg

SEQ ID NO: 627775 - DNA, 16 bp, Homo sapiens
cgcatctgcctggagc

SEQ ID NO: 627776 - DNA, 22 bp, Homo sapiens
cgcatctgcctggagcctgggc

SEQ ID NO: 627777 - DNA, 14 bp, Homo sapiens
cgccacgaggagct

SEQ ID NO: 627778 - DNA, 21 bp, Homo sapiens
cgccagccctgttccgcctca

SEQ ID NO: 627779 - DNA, 13 bp, Homo sapiens
cgcccacccacac

SEQ ID NO: 627780 - DNA, 15 bp, Homo sapiens
cgcccacccagcagc

SEQ ID NO: 627781 - DNA, 19 bp, Homo sapiens
cgcccacccagcagcgccc

SEQ ID NO: 627782 - DNA, 18 bp, Homo sapiens
cgcccaccccgctgcctg

SEQ ID NO: 627783 - DNA, 11 bp, Homo sapiens
cgcccacctgc

SEQ ID NO: 627784 - DNA, 13 bp, Homo sapiens
cgcccacctgccc

SEQ ID NO: 627785 - DNA, 15 bp, Homo sapiens
cgcccagcccccacc

SEQ ID NO: 627786 - DNA, 11 bp, Homo sapiens
cgccccagaga

SEQ ID NO: 627787 - DNA, 14 bp, Homo sapiens
cgccccagagactg

SEQ ID NO: 627788 - DNA, 22 bp, Homo sapiens
cgccccagagactgcccaccct

SEQ ID NO: 627789 - DNA, 17 bp, Homo sapiens
cgccccatgggccctca

SEQ ID NO: 627790 - DNA, 20 bp, Homo sapiens
cgccccatgggccctcagcg

SEQ ID NO: 627791 - DNA, 11 bp, Homo sapiens
cgcccccagga

SEQ ID NO: 627792 - DNA, 20 bp, Homo sapiens
cgccccccggcctggccccc

SEQ ID NO: 627793 - DNA, 17 bp, Homo sapiens
cgccccgtgctcctctg

SEQ ID NO: 627794 - DNA, 14 bp, Homo sapiens
cgcccctccccagc

SEQ ID NO: 627795 - DNA, 13 bp, Homo sapiens
cgcccctcctcgg

SEQ ID NO: 627796 - DNA, 13 bp, Homo sapiens
cgcccctctgcgc

SEQ ID NO: 627797 - DNA, 20 bp, Homo sapiens
cgcccctctgcgccccagcg

SEQ ID NO: 627798 - DNA, 15 bp, Homo sapiens
cgcccctgcccagca

SEQ ID NO: 627799 - DNA, 12 bp, Homo sapiens
cgcccctgcctg

SEQ ID NO: 627800 - DNA, 13 bp, Homo sapiens
cgcccctgcctga

SEQ ID NO: 627801 - DNA, 22 bp, Homo sapiens
cgcccctgtccatccgtctctg

SEQ ID NO: 627802 - DNA, 17 bp, Homo sapiens
cgcccctttctcttgct

SEQ ID NO: 627803 - DNA, 14 bp, Homo sapiens
cgcccgaggccagg

SEQ ID NO: 627804 - DNA, 12 bp, Homo sapiens
cgcccgcccacc

SEQ ID NO: 627805 - DNA, 13 bp, Homo sapiens
cgcccgcccaccc

SEQ ID NO: 627806 - DNA, 13 bp, Homo sapiens
cgcccgcccccgc

SEQ ID NO: 627807 - DNA, 16 bp, Homo sapiens
cgcccgccggttggcc

SEQ ID NO: 627808 - DNA, 10 bp, Homo sapiens
cgccctcctc

SEQ ID NO: 627809 - DNA, 14 bp, Homo sapiens
cgccctcctctgcc

SEQ ID NO: 627810 - DNA, 16 bp, Homo sapiens
cgccctcctctgcccc

SEQ ID NO: 627811 - DNA, 19 bp, Homo sapiens
cgccctcctctgccccctc

SEQ ID NO: 627812 - DNA, 14 bp, Homo sapiens
cgccctgcccgcgc

SEQ ID NO: 627813 - DNA, 15 bp, Homo sapiens
cgccctgtgccctct

SEQ ID NO: 627814 - DNA, 20 bp, Homo sapiens
cgccctgtgccctctcactg

SEQ ID NO: 627815 - DNA, 20 bp, Homo sapiens
cgcccttccctgacactgtc

SEQ ID NO: 627816 - DNA, 20 bp, Homo sapiens
cgccgatataagccatagcc

SEQ ID NO: 627817 - DNA, 21 bp, Homo sapiens
cgccgatataagccatagccc

SEQ ID NO: 627818 - DNA, 15 bp, Homo sapiens
cgccggggctggccc

SEQ ID NO: 627819 - DNA, 17 bp, Homo sapiens
cgccggggctggccctg

SEQ ID NO: 627820 - DNA, 22 bp, Homo sapiens
cgccggggctggccctgccctc

SEQ ID NO: 627821 - DNA, 14 bp, Homo sapiens
cgcctcccgccgcc

SEQ ID NO: 627822 - DNA, 15 bp, Homo sapiens
cgcctcccgccgcct

SEQ ID NO: 627823 - DNA, 15 bp, Homo sapiens
cgcctcctccagact

SEQ ID NO: 627824 - DNA, 14 bp, Homo sapiens
cgcctcctcctgca

SEQ ID NO: 627825 - DNA, 18 bp, Homo sapiens
cgcctcgccccagccaag

SEQ ID NO: 627826 - DNA, 20 bp, Homo sapiens
cgcctcgccccagccaagcc

SEQ ID NO: 627827 - DNA, 21 bp, Homo sapiens
cgcctcgccccagccaagcct

SEQ ID NO: 627828 - DNA, 22 bp, Homo sapiens
cgcctcgccccagccaagcctg

SEQ ID NO: 627829 - DNA, 20 bp, Homo sapiens
cgcctcgggccgcctcctcc

SEQ ID NO: 627830 - DNA, 20 bp, Homo sapiens
cgcctgcgctcctctgcagc

SEQ ID NO: 627831 - DNA, 19 bp, Homo sapiens
cgccttctggccgctgcag

SEQ ID NO: 627832 - DNA, 13 bp, Homo sapiens
cgccttctgggga

SEQ ID NO: 627833 - DNA, 16 bp, Homo sapiens
cgcgacaatgcaaacc

SEQ ID NO: 627834 - DNA, 12 bp, Homo sapiens
cgcgaccacccc

SEQ ID NO: 627835 - DNA, 18 bp, Homo sapiens
cgcgaccacccctgtgcg

SEQ ID NO: 627836 - DNA, 12 bp, Homo sapiens
cgcgcagctggc

SEQ ID NO: 627837 - DNA, 13 bp, Homo sapiens
cgcgcccccagga

SEQ ID NO: 627838 - DNA, 13 bp, Homo sapiens
cgcgcccctctgc

SEQ ID NO: 627839 - DNA, 16 bp, Homo sapiens
cgcgcccctctgcgcc

SEQ ID NO: 627840 - DNA, 12 bp, Homo sapiens
cgcgcccctgtc

SEQ ID NO: 627841 - DNA, 16 bp, Homo sapiens
cgcgcccgccgcctcc

SEQ ID NO: 627842 - DNA, 13 bp, Homo sapiens
cgcgcgcccccag

SEQ ID NO: 627843 - DNA, 13 bp, Homo sapiens
ctaccctttccca

SEQ ID NO: 627844 - DNA, 22 bp, Homo sapiens
ctacctaactccctaggcctga

SEQ ID NO: 627845 - DNA, 15 bp, Homo sapiens
ctacctcagtcagta

SEQ ID NO: 627846 - DNA, 11 bp, Homo sapiens
ctacctggccg

SEQ ID NO: 627847 - DNA, 20 bp, Homo sapiens
ctacctttggcttaattcca

SEQ ID NO: 627848 - DNA, 14 bp, Homo sapiens
ctacctttttttct

SEQ ID NO: 627849 - DNA, 19 bp, Homo sapiens
ctactcctccccctcctcc

SEQ ID NO: 627850 - DNA, 20 bp, Homo sapiens
ctactcctccccctcctcca

SEQ ID NO: 627851 - DNA, 22 bp, Homo sapiens
ctactggatgcttacagtgact

SEQ ID NO: 627852 - DNA, 13 bp, Homo sapiens
ctacttaaacaaa

SEQ ID NO: 627853 - DNA, 15 bp, Homo sapiens
ctactttctgttatc

SEQ ID NO: 627854 - DNA, 14 bp, Homo sapiens
ctagaaagagaaaa

SEQ ID NO: 627855 - DNA, 21 bp, Homo sapiens
ctagaaagagaaaaagccctc

SEQ ID NO: 627856 - DNA, 23 bp, Homo sapiens
ctagaaagagaaaaagccctctt

SEQ ID NO: 627857 - DNA, 20 bp, Homo sapiens
ctagaatgagaaatcatgtt

SEQ ID NO: 627858 - DNA, 19 bp, Homo sapiens
ctagacagaaaccaagcca

SEQ ID NO: 627859 - DNA, 20 bp, Homo sapiens
ctagactaggaggttccggt

SEQ ID NO: 627860 - DNA, 20 bp, Homo sapiens
ctagagcattctggggtggg

SEQ ID NO: 627861 - DNA, 15 bp, Homo sapiens
ctagatatgagaaat

SEQ ID NO: 627862 - DNA, 16 bp, Homo sapiens
ctagatatgagaaata

SEQ ID NO: 627863 - DNA, 12 bp, Homo sapiens
ctagattttgtt

SEQ ID NO: 627864 - DNA, 20 bp, Homo sapiens
ctagattttgttttgctttt

SEQ ID NO: 627865 - DNA, 21 bp, Homo sapiens
ctagattttgttttgcttttt

SEQ ID NO: 627866 - DNA, 20 bp, Homo sapiens
ctagcactttgggaggctga

SEQ ID NO: 627867 - DNA, 18 bp, Homo sapiens
ctagccctctttctctct

SEQ ID NO: 627868 - DNA, 19 bp, Homo sapiens
ctagccctctttctctctg

SEQ ID NO: 627869 - DNA, 21 bp, Homo sapiens
ctagccctctttctctctgtg

SEQ ID NO: 627870 - DNA, 17 bp, Homo sapiens
ctaggattcctccccca

SEQ ID NO: 627871 - DNA, 22 bp, Homo sapiens
ctaggattcctcccccagagcc

SEQ ID NO: 627872 - DNA, 23 bp, Homo sapiens
ctaggattcctcccccagagcca

SEQ ID NO: 627873 - DNA, 19 bp, Homo sapiens
ctaggcagggagggggctg

SEQ ID NO: 627874 - DNA, 20 bp, Homo sapiens
ctaggcagggagggggctgg

SEQ ID NO: 627875 - DNA, 22 bp, Homo sapiens
ctaggcagggagggggctggga

SEQ ID NO: 627876 - DNA, 22 bp, Homo sapiens
ctaggcccccaaattgccttca

SEQ ID NO: 627877 - DNA, 15 bp, Homo sapiens
ctaggtgcccagtct

SEQ ID NO: 627878 - DNA, 15 bp, Homo sapiens
ctagtaacagtattt

SEQ ID NO: 627879 - DNA, 16 bp, Homo sapiens
ctagtaggtctgcaca

SEQ ID NO: 627880 - DNA, 19 bp, Homo sapiens
ctagtgtagcttctgaaag

SEQ ID NO: 627881 - DNA, 15 bp, Homo sapiens
ctagttagagactcg

SEQ ID NO: 627882 - DNA, 16 bp, Homo sapiens
ctagttctgctgccct

SEQ ID NO: 627883 - DNA, 18 bp, Homo sapiens
ctagttgtggacttttcc

SEQ ID NO: 627884 - DNA, 15 bp, Homo sapiens
ctagtttaaaattat

SEQ ID NO: 627885 - DNA, 15 bp, Homo sapiens
ctataagagacaaag

SEQ ID NO: 627886 - DNA, 22 bp, Homo sapiens
ctataccctaggtctccacccc

SEQ ID NO: 627887 - DNA, 21 bp, Homo sapiens
ctataggacttaatttagcag

SEQ ID NO: 627888 - DNA, 22 bp, Homo sapiens
ctatatatatatatatatgtat

SEQ ID NO: 627889 - DNA, 13 bp, Homo sapiens
ctatatgtaactt

SEQ ID NO: 627890 - DNA, 12 bp, Homo sapiens
ctatatttactg

SEQ ID NO: 627891 - DNA, 17 bp, Homo sapiens
ctatatttggattcaca

SEQ ID NO: 627892 - DNA, 20 bp, Homo sapiens
ctatcaccaaaagacgaggc

SEQ ID NO: 627893 - DNA, 21 bp, Homo sapiens
ctatcagcagcggcagcagca

SEQ ID NO: 627894 - DNA, 15 bp, Homo sapiens
ctatcagggcaagct

SEQ ID NO: 627895 - DNA, 23 bp, Homo sapiens
ctatccccggacgcatgcagggc

SEQ ID NO: 627896 - DNA, 23 bp, Homo sapiens
ctatccctggacgcatgcagggc

SEQ ID NO: 627897 - DNA, 15 bp, Homo sapiens
tcgggccgcctcctc

SEQ ID NO: 627898 - DNA, 21 bp, Homo sapiens
tcgggcgcctgcgctcctctg

SEQ ID NO: 627899 - DNA, 22 bp, Homo sapiens
tcgggggaggagcacccccagc

SEQ ID NO: 627900 - DNA, 15 bp, Homo sapiens
tcgtagaacctgcgc

SEQ ID NO: 627901 - DNA, 16 bp, Homo sapiens
tcgtagaacctgcgca

SEQ ID NO: 627902 - DNA, 19 bp, Homo sapiens
tcgtccatttaaacccggc

SEQ ID NO: 627903 - DNA, 16 bp, Homo sapiens
tcgtccggcctgcagc

SEQ ID NO: 627904 - DNA, 22 bp, Homo sapiens
tcgtccggcctgcagcccagaa

SEQ ID NO: 627905 - DNA, 22 bp, Homo sapiens
tcgtgccgtggagcttggagcc

SEQ ID NO: 627906 - DNA, 22 bp, Homo sapiens
tcgtggaagaagggccaccctg

SEQ ID NO: 627907 - DNA, 23 bp, Homo sapiens
tcgtggaagaagggccaccctga

SEQ ID NO: 627908 - DNA, 15 bp, Homo sapiens
tcgtgtttcacagtg

SEQ ID NO: 627909 - DNA, 17 bp, Homo sapiens
tcgtgtttcacagtggg

SEQ ID NO: 627910 - DNA, 15 bp, Homo sapiens
tcgttctgtttacat

SEQ ID NO: 627911 - DNA, 18 bp, Homo sapiens
tcgttggagagcagcagg

SEQ ID NO: 627912 - DNA, 15 bp, Homo sapiens
tctaaaactaaatag

SEQ ID NO: 627913 - DNA, 17 bp, Homo sapiens
tctaaaactaaatagca

SEQ ID NO: 627914 - DNA, 20 bp, Homo sapiens
tctaaaactaaatagcatgt

SEQ ID NO: 627915 - DNA, 16 bp, Homo sapiens
tctaaaaggaggacag

SEQ ID NO: 627916 - DNA, 16 bp, Homo sapiens
tctaaaccatgaaaag

SEQ ID NO: 627917 - DNA, 22 bp, Homo sapiens
tctaaagatctttttttaagtg

SEQ ID NO: 627918 - DNA, 12 bp, Homo sapiens
tctaaatattat

SEQ ID NO: 627919 - DNA, 13 bp, Homo sapiens
tctaaatcataat

SEQ ID NO: 627920 - DNA, 16 bp, Homo sapiens
tctaaatcataatcat

SEQ ID NO: 627921 - DNA, 12 bp, Homo sapiens
tctaagaattca

SEQ ID NO: 627922 - DNA, 14 bp, Homo sapiens
tctaagaattcagt

SEQ ID NO: 627923 - DNA, 16 bp, Homo sapiens
tctaatccatgtgctg

SEQ ID NO: 627924 - DNA, 17 bp, Homo sapiens
tctaatgtattttattg

SEQ ID NO: 627925 - DNA, 23 bp, Homo sapiens
tctacctggccggtaggctgctg

SEQ ID NO: 627926 - DNA, 21 bp, Homo sapiens
tctacctttttttctctccta

SEQ ID NO: 627927 - DNA, 18 bp, Homo sapiens
tctagagctatgcacacc

SEQ ID NO: 627928 - DNA, 22 bp, Homo sapiens
tctagagctatgcacaccaaat

SEQ ID NO: 627929 - DNA, 17 bp, Homo sapiens
tctagatatgagaaata

SEQ ID NO: 627930 - DNA, 16 bp, Homo sapiens
tctagtaggtctgcac

SEQ ID NO: 627931 - DNA, 15 bp, Homo sapiens
tctagtgcaggaaaa

SEQ ID NO: 627932 - DNA, 20 bp, Homo sapiens
tctagtgcaggaaaaggctg

SEQ ID NO: 627933 - DNA, 16 bp, Homo sapiens
tctagtgccattattt

SEQ ID NO: 627934 - DNA, 23 bp, Homo sapiens
tctataggacttaatttagcagt

SEQ ID NO: 627935 - DNA, 15 bp, Homo sapiens
tctatatttactgtt

SEQ ID NO: 627936 - DNA, 15 bp, Homo sapiens
tctatccctggccac

SEQ ID NO: 627937 - DNA, 16 bp, Homo sapiens
tctatccctggccacc

SEQ ID NO: 627938 - DNA, 19 bp, Homo sapiens
tctatttatctgtctgagc

SEQ ID NO: 627939 - DNA, 12 bp, Homo sapiens
tctatttctgct

SEQ ID NO: 627940 - DNA, 13 bp, Homo sapiens
tctatttctgctg

SEQ ID NO: 627941 - DNA, 21 bp, Homo sapiens
tctatttctgctgaattttca

SEQ ID NO: 627942 - DNA, 15 bp, Homo sapiens
tctattttgcagcag

SEQ ID NO: 627943 - DNA, 20 bp, Homo sapiens
tctcaaacactgcttaagga

SEQ ID NO: 627944 - DNA, 21 bp, Homo sapiens
tctcaaatctgctttcatcca

SEQ ID NO: 627945 - DNA, 21 bp, Homo sapiens
tctggagtctgaaggagagga

SEQ ID NO: 627946 - DNA, 22 bp, Homo sapiens
tctggataatttgtataagatg

SEQ ID NO: 627947 - DNA, 13 bp, Homo sapiens
tctggatgaaggc

SEQ ID NO: 627948 - DNA, 18 bp, Homo sapiens
tctggccgctgcagtcag

SEQ ID NO: 627949 - DNA, 19 bp, Homo sapiens
tctggccttggttcctcca

SEQ ID NO: 627950 - DNA, 16 bp, Homo sapiens
tctggcgccaggggca

SEQ ID NO: 627951 - DNA, 19 bp, Homo sapiens
tctggcgccaggggcaggc

SEQ ID NO: 627952 - DNA, 20 bp, Homo sapiens
tctggcgccaggggcaggca

SEQ ID NO: 627953 - DNA, 21 bp, Homo sapiens
tctggctacgacttgggacgg

SEQ ID NO: 627954 - DNA, 18 bp, Homo sapiens
tctggctgctgcagtcag

SEQ ID NO: 627955 - DNA, 15 bp, Homo sapiens
tctggctgtggcccc

SEQ ID NO: 627956 - DNA, 16 bp, Homo sapiens
tctggctgtggcccct

SEQ ID NO: 627957 - DNA, 18 bp, Homo sapiens
tctggctgtggcccctcc

SEQ ID NO: 627958 - DNA, 15 bp, Homo sapiens
tctggggagggacac

SEQ ID NO: 627959 - DNA, 14 bp, Homo sapiens
tctggggtggggct

SEQ ID NO: 627960 - DNA, 20 bp, Homo sapiens
tctggggtggggcttggaag

SEQ ID NO: 627961 - DNA, 18 bp, Homo sapiens
tctgggttaacagtaaat

SEQ ID NO: 627962 - DNA, 22 bp, Homo sapiens
tctggtcagtgaagcccaggag

SEQ ID NO: 627963 - DNA, 17 bp, Homo sapiens
tctggtccttagtaaat

SEQ ID NO: 627964 - DNA, 17 bp, Homo sapiens
tctggtgcgtgtggccc

SEQ ID NO: 627965 - DNA, 17 bp, Homo sapiens
tctggtgtctaataaac

SEQ ID NO: 627966 - DNA, 17 bp, Homo sapiens
tctgtaaaaccaggctg

SEQ ID NO: 627967 - DNA, 18 bp, Homo sapiens
tctgtaattcttctcctt

SEQ ID NO: 627968 - DNA, 19 bp, Homo sapiens
tctgtacgaggcttctcta

SEQ ID NO: 627969 - DNA, 20 bp, Homo sapiens
tctgtacgaggcttctctaa

SEQ ID NO: 627970 - DNA, 21 bp, Homo sapiens
tctgtacgaggcttctctaac

SEQ ID NO: 627971 - DNA, 12 bp, Homo sapiens
tctgtacttcat

SEQ ID NO: 627972 - DNA, 17 bp, Homo sapiens
tctgtatatcagctcta

SEQ ID NO: 627973 - DNA, 21 bp, Homo sapiens
tctgtcagcttcccaacaata

SEQ ID NO: 627974 - DNA, 18 bp, Homo sapiens
tctgtcagtgagtcagag

SEQ ID NO: 627975 - DNA, 18 bp, Homo sapiens
tctgtcagtttgtgaagt

SEQ ID NO: 627976 - DNA, 18 bp, Homo sapiens
tctgtcccagttaactgt

SEQ ID NO: 627977 - DNA, 16 bp, Homo sapiens
tctgtccgtctgtcct

SEQ ID NO: 627978 - DNA, 15 bp, Homo sapiens
tctgtcctgcgcctg

SEQ ID NO: 627979 - DNA, 21 bp, Homo sapiens
tctgtctctcttttgctctct

SEQ ID NO: 627980 - DNA, 12 bp, Homo sapiens
tctgtgagattc

SEQ ID NO: 627981 - DNA, 22 bp, Homo sapiens
tctgtgagtctgtcctttccca

SEQ ID NO: 627982 - DNA, 23 bp, Homo sapiens
tctgtgatgtcagtagtgcctgt

SEQ ID NO: 627983 - DNA, 19 bp, Homo sapiens
tctgtgcatctggcctggg

SEQ ID NO: 627984 - DNA, 22 bp, Homo sapiens
tctgtgcatctggcctgggggc

SEQ ID NO: 627985 - DNA, 13 bp, Homo sapiens
tctgtgggactgg

SEQ ID NO: 627986 - DNA, 16 bp, Homo sapiens
tctgtgtggcaaacat

SEQ ID NO: 627987 - DNA, 17 bp, Homo sapiens
tctgtgtggcaaacatt

SEQ ID NO: 627988 - DNA, 19 bp, Homo sapiens
tctgtgtggcaaacattta

SEQ ID NO: 627989 - DNA, 20 bp, Homo sapiens
tctgtgttctcaacacacag

SEQ ID NO: 627990 - DNA, 10 bp, Homo sapiens
tctgttccaa

SEQ ID NO: 627991 - DNA, 18 bp, Homo sapiens
tctgttgaagtgcatgtt

SEQ ID NO: 627992 - DNA, 22 bp, Homo sapiens
tctgttgaccaatctctattca

SEQ ID NO: 627993 - DNA, 23 bp, Homo sapiens
tctgtttaatactcatccttgta

SEQ ID NO: 627994 - DNA, 20 bp, Homo sapiens
tcttaaaaattatctttaaa

SEQ ID NO: 627995 - DNA, 17 bp, Homo sapiens
tcttaaacccacataaa

SEQ ID NO: 627996 - DNA, 19 bp, Homo sapiens
tcttaaacccacataaaca

SEQ ID NO: 627997 - DNA, 20 bp, Homo sapiens
tcttaaccttcaaatacatt

SEQ ID NO: 627998 - DNA, 15 bp, Homo sapiens
tcttaactaatgtaa

SEQ ID NO: 627999 - DNA, 18 bp, Homo sapiens
tcttaaggacagtgttca

SEQ ID NO: 628000 - DNA, 23 bp, Homo sapiens
tcttaaggacagtgttcaaattc

SEQ ID NO: 628001 - DNA, 18 bp, Homo sapiens
tcttaccactagttgctt

SEQ ID NO: 628002 - DNA, 22 bp, Homo sapiens
tcttaccccgtccctttccctg

SEQ ID NO: 628003 - DNA, 17 bp, Homo sapiens
tcttacccttcaatgtt

SEQ ID NO: 628004 - DNA, 16 bp, Homo sapiens
tcttaccgaaatgaaa

SEQ ID NO: 628005 - DNA, 13 bp, Homo sapiens
tcttactgttttg

SEQ ID NO: 628006 - DNA, 16 bp, Homo sapiens
tcttactgttttgtgc

SEQ ID NO: 628007 - DNA, 17 bp, Homo sapiens
tcttactgttttgtgcg

SEQ ID NO: 628008 - DNA, 13 bp, Homo sapiens
tcttagagatacc

SEQ ID NO: 628009 - DNA, 21 bp, Homo sapiens
tcttagagataccctctgaga

SEQ ID NO: 628010 - DNA, 20 bp, Homo sapiens
tcttagttaatctttgaaaa

SEQ ID NO: 628011 - DNA, 22 bp, Homo sapiens
tcttagttaatctttgaaaact

SEQ ID NO: 628012 - DNA, 16 bp, Homo sapiens
tcttataacattgtat

SEQ ID NO: 628013 - DNA, 19 bp, Homo sapiens
tcttataacattgtatgtt

SEQ ID NO: 628014 - DNA, 12 bp, Homo sapiens
tcttattcctaa

SEQ ID NO: 628015 - DNA, 18 bp, Homo sapiens
tcttcaaccctgccctgc

SEQ ID NO: 628016 - DNA, 20 bp, Homo sapiens
tcttcaaccctgccctgcac

SEQ ID NO: 628017 - DNA, 21 bp, Homo sapiens
tgtcctggctcccagggtcct

SEQ ID NO: 628018 - DNA, 19 bp, Homo sapiens
tgtcctgtgtcatctgtca

SEQ ID NO: 628019 - DNA, 22 bp, Homo sapiens
tgtccttcattccgttaggaat

SEQ ID NO: 628020 - DNA, 21 bp, Homo sapiens
tgtcgggcaagatagctcctt

SEQ ID NO: 628021 - DNA, 12 bp, Homo sapiens
tgtcgggcatga

SEQ ID NO: 628022 - DNA, 16 bp, Homo sapiens
tgtcggggcccctgcg

SEQ ID NO: 628023 - DNA, 18 bp, Homo sapiens
tgtctaatgtattttatt

SEQ ID NO: 628024 - DNA, 14 bp, Homo sapiens
tgtctatttctgct

SEQ ID NO: 628025 - DNA, 15 bp, Homo sapiens
tgtctatttctgctg

SEQ ID NO: 628026 - DNA, 15 bp, Homo sapiens
tgtctcaaaataaaa

SEQ ID NO: 628027 - DNA, 19 bp, Homo sapiens
tgtctcaaaataaaaccag

SEQ ID NO: 628028 - DNA, 12 bp, Homo sapiens
tgtctcagtgaa

SEQ ID NO: 628029 - DNA, 22 bp, Homo sapiens
tgtctcagtgaaggaagaacct

SEQ ID NO: 628030 - DNA, 15 bp, Homo sapiens
tgtctcatgttttat

SEQ ID NO: 628031 - DNA, 20 bp, Homo sapiens
tgtctcatgttttatatgat

SEQ ID NO: 628032 - DNA, 14 bp, Homo sapiens
tgtctccagctgat

SEQ ID NO: 628033 - DNA, 16 bp, Homo sapiens
tgtctccagctgattt

SEQ ID NO: 628034 - DNA, 16 bp, Homo sapiens
tgtctgagccctgccc

SEQ ID NO: 628035 - DNA, 23 bp, Homo sapiens
tgtctgcttagtatctcatcaac

SEQ ID NO: 628036 - DNA, 17 bp, Homo sapiens
tgtctggagcctgcagg

SEQ ID NO: 628037 - DNA, 18 bp, Homo sapiens
tgtctggagcctgcaggc

SEQ ID NO: 628038 - DNA, 18 bp, Homo sapiens
tgtctggctgtggcccct

SEQ ID NO: 628039 - DNA, 18 bp, Homo sapiens
tgtctgtccctaaacata

SEQ ID NO: 628040 - DNA, 19 bp, Homo sapiens
tgtcttattcctaattcct

SEQ ID NO: 628041 - DNA, 21 bp, Homo sapiens
tgtcttcaaccctgccctgca

SEQ ID NO: 628042 - DNA, 23 bp, Homo sapiens
tgtcttcaaccctgccctgcacc

SEQ ID NO: 628043 - DNA, 23 bp, Homo sapiens
tgtcttgagaccagcctgccagg

SEQ ID NO: 628044 - DNA, 16 bp, Homo sapiens
tgtcttgtgttgctgt

SEQ ID NO: 628045 - DNA, 11 bp, Homo sapiens
tgtctttaaaa

SEQ ID NO: 628046 - DNA, 21 bp, Homo sapiens
tgtctttgctgtttatatata

SEQ ID NO: 628047 - DNA, 18 bp, Homo sapiens
tgtgaaaatgctttgaaa

SEQ ID NO: 628048 - DNA, 20 bp, Homo sapiens
tgtgaaaatgctttgaaaat

SEQ ID NO: 628049 - DNA, 15 bp, Homo sapiens
tgtgaaagtctcctg

SEQ ID NO: 628050 - DNA, 16 bp, Homo sapiens
tgtgaagtgattgaca

SEQ ID NO: 628051 - DNA, 20 bp, Homo sapiens
tgtgaatggttgcaaagtgt

SEQ ID NO: 628052 - DNA, 20 bp, Homo sapiens
tgtgaattttaaaatgcaaa

SEQ ID NO: 628053 - DNA, 14 bp, Homo sapiens
tgtgacattccaca

SEQ ID NO: 628054 - DNA, 16 bp, Homo sapiens
tgtgacattccacaga

SEQ ID NO: 628055 - DNA, 15 bp, Homo sapiens
tgtgacctgctcctg

SEQ ID NO: 628056 - DNA, 13 bp, Homo sapiens
tgtgagataaata

SEQ ID NO: 628057 - DNA, 14 bp, Homo sapiens
tgtgagataaatat

SEQ ID NO: 628058 - DNA, 15 bp, Homo sapiens
tgtgagataaatatc

SEQ ID NO: 628059 - DNA, 21 bp, Homo sapiens
tgtgagcactatctttcagga

SEQ ID NO: 628060 - DNA, 14 bp, Homo sapiens
tgtgagttaatttg

SEQ ID NO: 628061 - DNA, 15 bp, Homo sapiens
tgtgataattgtaaa

SEQ ID NO: 628062 - DNA, 23 bp, Homo sapiens
tgtgatggttcgttctgtttaca

SEQ ID NO: 628063 - DNA, 16 bp, Homo sapiens
tgtgatgtaaggcact

SEQ ID NO: 628064 - DNA, 16 bp, Homo sapiens
tgtgatgtgttgctct

SEQ ID NO: 628065 - DNA, 14 bp, Homo sapiens
tgtgatttatgcat

SEQ ID NO: 628066 - DNA, 19 bp, Homo sapiens
tgtgatttatgcatttatg

SEQ ID NO: 628067 - DNA, 21 bp, Homo sapiens
tgtgcagagtatacaagtgtt

SEQ ID NO: 628068 - DNA, 15 bp, Homo sapiens
tgtgcatctggcctg

SEQ ID NO: 628069 - DNA, 18 bp, Homo sapiens
tgtgcatctggcctgggg

SEQ ID NO: 628070 - DNA, 14 bp, Homo sapiens
tgtgccaaagatag

SEQ ID NO: 628071 - DNA, 18 bp, Homo sapiens
tgtgccaaagatagcaga

SEQ ID NO: 628072 - DNA, 21 bp, Homo sapiens
tgtgcccacgtgtgcagactg

SEQ ID NO: 628073 - DNA, 23 bp, Homo sapiens
tgtgcctttgggaggcagcatca

SEQ ID NO: 628074 - DNA, 13 bp, Homo sapiens
tgtgcgaacacag

SEQ ID NO: 628075 - DNA, 23 bp, Homo sapiens
tgtgcgaacacagtgacacgttt

SEQ ID NO: 628076 - DNA, 16 bp, Homo sapiens
tgtgctaagttgtctt

SEQ ID NO: 628077 - DNA, 21 bp, Homo sapiens
tgtgctattcgtaagttctgt

SEQ ID NO: 628078 - DNA, 22 bp, Homo sapiens
tgtgctattcgtaagttctgtg

SEQ ID NO: 628079 - DNA, 16 bp, Homo sapiens
tgtgctcatcagaaac

SEQ ID NO: 628080 - DNA, 15 bp, Homo sapiens
tgtgctgctgtggca

SEQ ID NO: 628081 - DNA, 16 bp, Homo sapiens
tgtgcttcacacaaag

SEQ ID NO: 628082 - DNA, 18 bp, Homo sapiens
tgtgcttcacacaaagtg

SEQ ID NO: 628083 - DNA, 14 bp, Homo sapiens
tgtgcttgttcttc

SEQ ID NO: 628084 - DNA, 12 bp, Homo sapiens
tgtgctttcatg

SEQ ID NO: 628085 - DNA, 13 bp, Homo sapiens
tgtgctttcatgt

SEQ ID NO: 628086 - DNA, 19 bp, Homo sapiens
tgtggagtggaggggtcag

SEQ ID NO: 628087 - DNA, 13 bp, Homo sapiens
tgtggataaattt

SEQ ID NO: 628088 - DNA, 18 bp, Homo sapiens
tgtggataagaaaaatgc

SEQ ID NO: 628089 - DNA, 19 bp, Homo sapiens
tgtggataagaaaaatgct

SEQ ID NO: 628090 - DNA, 14 bp, Homo sapiens
tgtggcaaacattt

SEQ ID NO: 628091 - DNA, 17 bp, Homo sapiens
tgtggcatcaggaaagg

SEQ ID NO: 628092 - DNA, 15 bp, Homo sapiens
tgtggcccctccttc

SEQ ID NO: 628093 - DNA, 17 bp, Homo sapiens
tgtggcccctccttctc

SEQ ID NO: 628094 - DNA, 15 bp, Homo sapiens
tgtggccctgtggga

SEQ ID NO: 628095 - DNA, 17 bp, Homo sapiens
tgtggcttaaacatttt

SEQ ID NO: 628096 - DNA, 14 bp, Homo sapiens
tgtggcttggaaca

SEQ ID NO: 628097 - DNA, 16 bp, Homo sapiens
tgtgggactggcccac

SEQ ID NO: 628098 - DNA, 13 bp, Homo sapiens
tgtgggagtccac

SEQ ID NO: 628099 - DNA, 12 bp, Homo sapiens
tgtggggccagg

SEQ ID NO: 628100 - DNA, 13 bp, Homo sapiens
tgtggggggtgcc

SEQ ID NO: 628101 - DNA, 23 bp, Homo sapiens
tgtggtgaggtcctgtcctggct

SEQ ID NO: 628102 - DNA, 21 bp, Homo sapiens
tgtgtaatttcctgctcctcc

SEQ ID NO: 628103 - DNA, 13 bp, Homo sapiens
tgtgtacaaaata

SEQ ID NO: 628104 - DNA, 15 bp, Homo sapiens
tgtgtcatctgtcag

SEQ ID NO: 628105 - DNA, 18 bp, Homo sapiens
tgtgtcctaaatgcaaag

SEQ ID NO: 628106 - DNA, 18 bp, Homo sapiens
tgtgtctccagctgattt

SEQ ID NO: 628107 - DNA, 23 bp, Homo sapiens
tgtgtctccagctgattttaact

SEQ ID NO: 628108 - DNA, 21 bp, Homo sapiens
tgtgtgaaggtcttgcctgaa

SEQ ID NO: 628109 - DNA, 13 bp, Homo sapiens
tgtgtgcaatgtt

SEQ ID NO: 628110 - DNA, 15 bp, Homo sapiens
tgtgtggcaaacatt

SEQ ID NO: 628111 - DNA, 22 bp, Homo sapiens
tgtgtggcctaatccacctggt

SEQ ID NO: 628112 - DNA, 18 bp, Homo sapiens
tgtgtgggtttactctgt

SEQ ID NO: 628113 - DNA, 15 bp, Homo sapiens
tgtgtgtgcaatgtt

SEQ ID NO: 628114 - DNA, 12 bp, Homo sapiens
tgtgttacaata

SEQ ID NO: 628115 - DNA, 17 bp, Homo sapiens
tgtgttacaataagtgt

SEQ ID NO: 628116 - DNA, 16 bp, Homo sapiens
tgtgttctcaacacac

SEQ ID NO: 628117 - DNA, 19 bp, Homo sapiens
tgtgttgccattttgtctg

SEQ ID NO: 628118 - DNA, 24 bp, Homo sapiens
tgtgttgccattttgtctggctgt

SEQ ID NO: 628119 - DNA, 16 bp, Homo sapiens
tgtgttggtatttact

SEQ ID NO: 628120 - DNA, 22 bp, Homo sapiens
tgtgtttcgcattaagcacaca

SEQ ID NO: 628121 - DNA, 16 bp, Homo sapiens
tgtgtttttcagttat

SEQ ID NO: 628122 - DNA, 17 bp, Homo sapiens
tgttaaaacatcaaaat

SEQ ID NO: 628123 - DNA, 15 bp, Homo sapiens
tgttaaataaggcct

SEQ ID NO: 628124 - DNA, 15 bp, Homo sapiens
tgttaaatctacaaa

SEQ ID NO: 628125 - DNA, 22 bp, Homo sapiens
tgttaataaagtgcactgccac

SEQ ID NO: 628126 - DNA, 20 bp, Homo sapiens
tgttaatgattcttgtgtca

SEQ ID NO: 628127 - DNA, 16 bp, Homo sapiens
tgttacctaacaatgt

SEQ ID NO: 628128 - DNA, 19 bp, Homo sapiens
tgttacctaacaatgtttt

SEQ ID NO: 628129 - DNA, 17 bp, Homo sapiens
ttaatatttatagagtt

SEQ ID NO: 628130 - DNA, 20 bp, Homo sapiens
ttaatatttatagagttcat

SEQ ID NO: 628131 - DNA, 16 bp, Homo sapiens
ttaatcaattaatttt

SEQ ID NO: 628132 - DNA, 14 bp, Homo sapiens
ttaatcatttccag

SEQ ID NO: 628133 - DNA, 20 bp, Homo sapiens
ttaatcatttccagcaaaat

SEQ ID NO: 628134 - DNA, 14 bp, Homo sapiens
ttaatctagagcta

SEQ ID NO: 628135 - DNA, 23 bp, Homo sapiens
ttaatcttttcagccttgtaaat

SEQ ID NO: 628136 - DNA, 13 bp, Homo sapiens
ttaatgattcttg

SEQ ID NO: 628137 - DNA, 18 bp, Homo sapiens
ttaatgattcttgtgtca

SEQ ID NO: 628138 - DNA, 16 bp, Homo sapiens
ttaatgtgccaaaatg

SEQ ID NO: 628139 - DNA, 15 bp, Homo sapiens
ttaattaaacaaatt

SEQ ID NO: 628140 - DNA, 17 bp, Homo sapiens
ttaattcttaccgaaat

SEQ ID NO: 628141 - DNA, 21 bp, Homo sapiens
ttaattcttaccgaaatgaaa

SEQ ID NO: 628142 - DNA, 18 bp, Homo sapiens
ttattatagtctgtactt

SEQ ID NO: 628143 - DNA, 22 bp, Homo sapiens
ttattatagtctgtacttcagt

SEQ ID NO: 628144 - DNA, 21 bp, Homo sapiens
ttattcatgctttctcctttt

SEQ ID NO: 628145 - DNA, 16 bp, Homo sapiens
ttattcctaattcctg

SEQ ID NO: 628146 - DNA, 12 bp, Homo sapiens
ttattctaatta

SEQ ID NO: 628147 - DNA, 14 bp, Homo sapiens
ttattcttccaagt

SEQ ID NO: 628148 - DNA, 19 bp, Homo sapiens
ttattgtaacagacattgt

SEQ ID NO: 628149 - DNA, 20 bp, Homo sapiens
ttattgtaacagacattgtt

SEQ ID NO: 628150 - DNA, 15 bp, Homo sapiens
ttattttctgtaatt

SEQ ID NO: 628151 - DNA, 18 bp, Homo sapiens
ttcaaagaacccccctcc

SEQ ID NO: 628152 - DNA, 20 bp, Homo sapiens
ttcaaagaacccccctcccc

SEQ ID NO: 628153 - DNA, 13 bp, Homo sapiens
ttcaaagaatcac

SEQ ID NO: 628154 - DNA, 22 bp, Homo sapiens
ttcaaataaccctgaatcagag

SEQ ID NO: 628155 - DNA, 14 bp, Homo sapiens
ttcaaatgtcattt

SEQ ID NO: 628156 - DNA, 23 bp, Homo sapiens
ttcaaattctgattattacaaca

SEQ ID NO: 628157 - DNA, 19 bp, Homo sapiens
ttcaaccacacctaaatta

SEQ ID NO: 628158 - DNA, 20 bp, Homo sapiens
ttcaagctttttgtgagaaa

SEQ ID NO: 628159 - DNA, 19 bp, Homo sapiens
ttcaaggaatagagttttc

SEQ ID NO: 628160 - DNA, 18 bp, Homo sapiens
ttcaaggatcctgagcca

SEQ ID NO: 628161 - DNA, 20 bp, Homo sapiens
ttcaataggaaaaactgatt

SEQ ID NO: 628162 - DNA, 22 bp, Homo sapiens
ttcaataggaaaaactgatttt

SEQ ID NO: 628163 - DNA, 15 bp, Homo sapiens
ttcaatgtactgtat

SEQ ID NO: 628164 - DNA, 16 bp, Homo sapiens
ttcaatgtactgtatt

SEQ ID NO: 628165 - DNA, 17 bp, Homo sapiens
ttcaatgtactgtattg

SEQ ID NO: 628166 - DNA, 13 bp, Homo sapiens
ttcacatgaacat

SEQ ID NO: 628167 - DNA, 12 bp, Homo sapiens
ttcacattcctg

SEQ ID NO: 628168 - DNA, 15 bp, Homo sapiens
ttcacttaaaatcaa

SEQ ID NO: 628169 - DNA, 14 bp, Homo sapiens
ttcactttcaggaa

SEQ ID NO: 628170 - DNA, 22 bp, Homo sapiens
ttcagaaacaaagcatttgact

SEQ ID NO: 628171 - DNA, 19 bp, Homo sapiens
ttcagaaactttttctaaa

SEQ ID NO: 628172 - DNA, 23 bp, Homo sapiens
ttcagaattgtttttagaaattt

SEQ ID NO: 628173 - DNA, 20 bp, Homo sapiens
ttcagactctctcctctctc

SEQ ID NO: 628174 - DNA, 16 bp, Homo sapiens
ttcagatctcatagat

SEQ ID NO: 628175 - DNA, 18 bp, Homo sapiens
ttcagatctcatagatga

SEQ ID NO: 628176 - DNA, 12 bp, Homo sapiens
ttcagatgtttc

SEQ ID NO: 628177 - DNA, 10 bp, Homo sapiens
ttcagcacac

SEQ ID NO: 628178 - DNA, 20 bp, Homo sapiens
ttcagcatcgtgtgggtccc

SEQ ID NO: 628179 - DNA, 22 bp, Homo sapiens
ttcagggagggctgttcaagtt

SEQ ID NO: 628180 - DNA, 17 bp, Homo sapiens
ttcagtctatgctgtgt

SEQ ID NO: 628181 - DNA, 21 bp, Homo sapiens
ttcagtctatgctgtgtgcag

SEQ ID NO: 628182 - DNA, 14 bp, Homo sapiens
ttcagtgcctgctg

SEQ ID NO: 628183 - DNA, 18 bp, Homo sapiens
ttcagtgcctgctgttcg

SEQ ID NO: 628184 - DNA, 21 bp, Homo sapiens
ttcagtgccttatggaacact

SEQ ID NO: 628185 - DNA, 13 bp, Homo sapiens
ttcagtgccttgg

SEQ ID NO: 628186 - DNA, 16 bp, Homo sapiens
ttcagtgccttggagc

SEQ ID NO: 628187 - DNA, 20 bp, Homo sapiens
ttcatgatgctagttcttac

SEQ ID NO: 628188 - DNA, 14 bp, Homo sapiens
ttcatgattagaca

SEQ ID NO: 628189 - DNA, 19 bp, Homo sapiens
ttcatgcgcagtccccagg

SEQ ID NO: 628190 - DNA, 17 bp, Homo sapiens
ttcatgcttttctcatg

SEQ ID NO: 628191 - DNA, 19 bp, Homo sapiens
ttcatgcttttctcatggt

SEQ ID NO: 628192 - DNA, 17 bp, Homo sapiens
ttcattaaaacaagaga

SEQ ID NO: 628193 - DNA, 14 bp, Homo sapiens
ttcattagctgtga

SEQ ID NO: 628194 - DNA, 16 bp, Homo sapiens
ttcattatttcaagga

SEQ ID NO: 628195 - DNA, 13 bp, Homo sapiens
ttcattgcactgc

SEQ ID NO: 628196 - DNA, 17 bp, Homo sapiens
ttcattgtctcagtgaa

SEQ ID NO: 628197 - DNA, 13 bp, Homo sapiens
ttcatttaacact

SEQ ID NO: 628198 - DNA, 16 bp, Homo sapiens
ttcatttaacactgag

SEQ ID NO: 628199 - DNA, 11 bp, Homo sapiens
ttcattttcat

SEQ ID NO: 628200 - DNA, 18 bp, Homo sapiens
ttcattttcattatttca

SEQ ID NO: 628201 - DNA, 13 bp, Homo sapiens
ttcattttctctc

SEQ ID NO: 628202 - DNA, 17 bp, Homo sapiens
ttccaaaagtactagca

SEQ ID NO: 628203 - DNA, 17 bp, Homo sapiens
ttccaaaggttgtacat

SEQ ID NO: 628204 - DNA, 17 bp, Homo sapiens
ttccaagtgtgtgtgca

SEQ ID NO: 628205 - DNA, 24 bp, Homo sapiens
ttccagcaaaatatatgtttggct

SEQ ID NO: 628206 - DNA, 22 bp, Homo sapiens
ttccagcagtgaatgctagaca

SEQ ID NO: 628207 - DNA, 21 bp, Homo sapiens
ttccagctaagcctgatgatg

SEQ ID NO: 628208 - DNA, 15 bp, Homo sapiens
ttccagggaaccaga

SEQ ID NO: 628209 - DNA, 16 bp, Homo sapiens
ttccagggaaccagag

SEQ ID NO: 628210 - DNA, 18 bp, Homo sapiens
ttccataaagaagatgtt

SEQ ID NO: 628211 - DNA, 20 bp, Homo sapiens
ttccatacgtgcccatttca

SEQ ID NO: 628212 - DNA, 21 bp, Homo sapiens
ttccatcaaagccctccctgt

SEQ ID NO: 628213 - DNA, 20 bp, Homo sapiens
ttcccaagtcctcgcccccc

SEQ ID NO: 628214 - DNA, 20 bp, Homo sapiens
ttcccaattatcaaaaaaca

SEQ ID NO: 628215 - DNA, 19 bp, Homo sapiens
ttcccacccactagccctc

SEQ ID NO: 628216 - DNA, 12 bp, Homo sapiens
ttcccaccccta

SEQ ID NO: 628217 - DNA, 18 bp, Homo sapiens
ttcccagcaaagttttca

SEQ ID NO: 628218 - DNA, 20 bp, Homo sapiens
ttcccagcgcatggcgcccc

SEQ ID NO: 628219 - DNA, 23 bp, Homo sapiens
ttcccagcgcatggcgccccggg

SEQ ID NO: 628220 - DNA, 13 bp, Homo sapiens
ttcccagctggca

SEQ ID NO: 628221 - DNA, 18 bp, Homo sapiens
ttcccagctggcagcgcc

SEQ ID NO: 628222 - DNA, 19 bp, Homo sapiens
ttcccatggtagactgtga

SEQ ID NO: 628223 - DNA, 20 bp, Homo sapiens
ttcccatggtagactgtgac

SEQ ID NO: 628224 - DNA, 16 bp, Homo sapiens
ttccccactcccgtga

SEQ ID NO: 628225 - DNA, 19 bp, Homo sapiens
ttccccatcgccttctggg

SEQ ID NO: 628226 - DNA, 18 bp, Homo sapiens
ttccccattcagtgacat

SEQ ID NO: 628227 - DNA, 18 bp, Homo sapiens
ttccccattgccttctgg

SEQ ID NO: 628228 - DNA, 13 bp, Homo sapiens
ttcccccttcccc

SEQ ID NO: 628229 - DNA, 19 bp, Homo sapiens
ttcccctgcgccctccctc

SEQ ID NO: 628230 - DNA, 21 bp, Homo sapiens
ttcccctgcgccctccctccc

SEQ ID NO: 628231 - DNA, 13 bp, Homo sapiens
ttcccctttcctg

SEQ ID NO: 628232 - DNA, 14 bp, Homo sapiens
ttcccgcagcacca

SEQ ID NO: 628233 - DNA, 14 bp, Homo sapiens
ttccctgcatccct

SEQ ID NO: 628234 - DNA, 16 bp, Homo sapiens
ttcccttgattcaaat

SEQ ID NO: 628235 - DNA, 17 bp, Homo sapiens
ttcccttgattcaaata

SEQ ID NO: 628236 - DNA, 23 bp, Homo sapiens
ttccctttccccattcagtgaca

SEQ ID NO: 628237 - DNA, 18 bp, Homo sapiens
ttccgttcatctgaggag

SEQ ID NO: 628238 - DNA, 15 bp, Homo sapiens
ttcctacttaaacaa

SEQ ID NO: 628239 - DNA, 22 bp, Homo sapiens
ttcctcatggctgttatctgtc

SEQ ID NO: 628240 - DNA, 15 bp, Homo sapiens
ttcctcccctggaag

SEQ ID NO: 628241 - DNA, 17 bp, Homo sapiens
ttcctcctgtctcctct

SEQ ID NO: 628242 - DNA, 23 bp, Homo sapiens
ttcctctctctctctctctctgt

SEQ ID NO: 628243 - DNA, 19 bp, Homo sapiens
ttcctcttaatgtctcaaa

SEQ ID NO: 628244 - DNA, 20 bp, Homo sapiens
ttcctcttaatgtctcaaaa

SEQ ID NO: 628245 - DNA, 16 bp, Homo sapiens
ttcctcttacctgtaa

SEQ ID NO: 628246 - DNA, 15 bp, Homo sapiens
ttcctgaactcccag

SEQ ID NO: 628247 - DNA, 15 bp, Homo sapiens
ttcctgaccctcact

SEQ ID NO: 628248 - DNA, 13 bp, Homo sapiens
ttcctgctagtgt

SEQ ID NO: 628249 - DNA, 16 bp, Homo sapiens
ttcctgctcctccagt

SEQ ID NO: 628250 - DNA, 15 bp, Homo sapiens
ttcctgtcctgctca

SEQ ID NO: 628251 - DNA, 19 bp, Homo sapiens
ttccttaacagctgtatta

SEQ ID NO: 628252 - DNA, 15 bp, Homo sapiens
ttccttcagtgcctt

SEQ ID NO: 628253 - DNA, 14 bp, Homo sapiens
ttcctttatgtgat

SEQ ID NO: 628254 - DNA, 13 bp, Homo sapiens
ttcggataatttt

SEQ ID NO: 628255 - DNA, 20 bp, Homo sapiens
ttcggataattttcattttt

SEQ ID NO: 628256 - DNA, 13 bp, Homo sapiens
ttcgttctgttta

SEQ ID NO: 628257 - DNA, 22 bp, Homo sapiens
ttctaaaacccttggtctgtgt

SEQ ID NO: 628258 - DNA, 20 bp, Homo sapiens
tttagattcctacttaaaca

SEQ ID NO: 628259 - DNA, 16 bp, Homo sapiens
tttagcagtccatttt

SEQ ID NO: 628260 - DNA, 13 bp, Homo sapiens
tttagctgtgcag

SEQ ID NO: 628261 - DNA, 19 bp, Homo sapiens
tttagtagctgataaagaa

SEQ ID NO: 628262 - DNA, 21 bp, Homo sapiens
tttagtagctgataaagaaac

SEQ ID NO: 628263 - DNA, 15 bp, Homo sapiens
tttagtatagttttc

SEQ ID NO: 628264 - DNA, 16 bp, Homo sapiens
tttataaatgttttaa

SEQ ID NO: 628265 - DNA, 17 bp, Homo sapiens
tttataaggctgactct

SEQ ID NO: 628266 - DNA, 11 bp, Homo sapiens
tttatacacat

SEQ ID NO: 628267 - DNA, 15 bp, Homo sapiens
tttatacacataatt

SEQ ID NO: 628268 - DNA, 18 bp, Homo sapiens
tttatacctgtacacaca

SEQ ID NO: 628269 - DNA, 19 bp, Homo sapiens
tttatacctgtacacacac

SEQ ID NO: 628270 - DNA, 18 bp, Homo sapiens
tttatacttcaaatgtca

SEQ ID NO: 628271 - DNA, 18 bp, Homo sapiens
tttatagagttcatagaa

SEQ ID NO: 628272 - DNA, 14 bp, Homo sapiens
tttatatgattaaa

SEQ ID NO: 628273 - DNA, 12 bp, Homo sapiens
tttatcatttta

SEQ ID NO: 628274 - DNA, 14 bp, Homo sapiens
tttatctggccatt

SEQ ID NO: 628275 - DNA, 12 bp, Homo sapiens
tttatcttgaca

SEQ ID NO: 628276 - DNA, 17 bp, Homo sapiens
tttatgatttcatgatt

SEQ ID NO: 628277 - DNA, 19 bp, Homo sapiens
tttatgcatgagaactaaa

SEQ ID NO: 628278 - DNA, 23 bp, Homo sapiens
tttatgcatgagaactaaataga

SEQ ID NO: 628279 - DNA, 15 bp, Homo sapiens
tttatgcatttatgc

SEQ ID NO: 628280 - DNA, 12 bp, Homo sapiens
tttatgtacaaa

SEQ ID NO: 628281 - DNA, 14 bp, Homo sapiens
tttattaaatttat

SEQ ID NO: 628282 - DNA, 19 bp, Homo sapiens
tttattaggttaagtctca

SEQ ID NO: 628283 - DNA, 13 bp, Homo sapiens
tttattattttca

SEQ ID NO: 628284 - DNA, 15 bp, Homo sapiens
tttattattttcata

SEQ ID NO: 628285 - DNA, 16 bp, Homo sapiens
tttattcattagctgt

SEQ ID NO: 628286 - DNA, 22 bp, Homo sapiens
tttattgtaacagacattgttt

SEQ ID NO: 628287 - DNA, 16 bp, Homo sapiens
tttatttctgtatctg

SEQ ID NO: 628288 - DNA, 16 bp, Homo sapiens
tttatttttgctctcc

SEQ ID NO: 628289 - DNA, 14 bp, Homo sapiens
tttcaataggaaaa

SEQ ID NO: 628290 - DNA, 17 bp, Homo sapiens
tttcaataggaaaaact

SEQ ID NO: 628291 - DNA, 19 bp, Homo sapiens
tttcaataggaaaaactga

SEQ ID NO: 628292 - DNA, 13 bp, Homo sapiens
tttcacatctgta

SEQ ID NO: 628293 - DNA, 19 bp, Homo sapiens
tttcacattcctgaccctc

SEQ ID NO: 628294 - DNA, 15 bp, Homo sapiens
tttcacctgaaatgc

SEQ ID NO: 628295 - DNA, 16 bp, Homo sapiens
tttcacctgaaatgcc

SEQ ID NO: 628296 - DNA, 16 bp, Homo sapiens
tttcacttcttaagga

SEQ ID NO: 628297 - DNA, 18 bp, Homo sapiens
tttcagcattcccaatta

SEQ ID NO: 628298 - DNA, 15 bp, Homo sapiens
tttcagtgcctgctg

SEQ ID NO: 628299 - DNA, 16 bp, Homo sapiens
tttcagtgcctgctgt

SEQ ID NO: 628300 - DNA, 14 bp, Homo sapiens
tttcatacaaattt

SEQ ID NO: 628301 - DNA, 20 bp, Homo sapiens
tttcatagataccattttga

SEQ ID NO: 628302 - DNA, 21 bp, Homo sapiens
tttcatagataccattttgaa

SEQ ID NO: 628303 - DNA, 13 bp, Homo sapiens
tttccaaatacat

SEQ ID NO: 628304 - DNA, 20 bp, Homo sapiens
tttccaagtttattgccctc

SEQ ID NO: 628305 - DNA, 19 bp, Homo sapiens
tttccacatccccaccctc

SEQ ID NO: 628306 - DNA, 20 bp, Homo sapiens
tttccagctaagcctgatga

SEQ ID NO: 628307 - DNA, 21 bp, Homo sapiens
tttccatacgtgcccatttca

SEQ ID NO: 628308 - DNA, 16 bp, Homo sapiens
tttccatttggatttt

SEQ ID NO: 628309 - DNA, 17 bp, Homo sapiens
tttccatttggatttta

SEQ ID NO: 628310 - DNA, 19 bp, Homo sapiens
tttccatttggattttaaa

SEQ ID NO: 628311 - DNA, 18 bp, Homo sapiens
tttcccacactgtgaact

SEQ ID NO: 628312 - DNA, 19 bp, Homo sapiens
tttccccaattatcctcct

SEQ ID NO: 628313 - DNA, 18 bp, Homo sapiens
tttccccattcagtgaca

SEQ ID NO: 628314 - DNA, 12 bp, Homo sapiens
tttccctgagga

SEQ ID NO: 628315 - DNA, 14 bp, Homo sapiens
tttccctgcatccc

SEQ ID NO: 628316 - DNA, 16 bp, Homo sapiens
tttcctctcctctctg

SEQ ID NO: 628317 - DNA, 23 bp, Homo sapiens
tttcctcttaatgtctcaaaata

SEQ ID NO: 628318 - DNA, 22 bp, Homo sapiens
tttcctgctcctccagtacaat

SEQ ID NO: 628319 - DNA, 17 bp, Homo sapiens
tttcctttcttccttcc

SEQ ID NO: 628320 - DNA, 19 bp, Homo sapiens
tttcctttcttccttcctt

SEQ ID NO: 628321 - DNA, 23 bp, Homo sapiens
tttctaaaacccttggtctgtgt

SEQ ID NO: 628322 - DNA, 15 bp, Homo sapiens
tttctaaaactaaat

SEQ ID NO: 628323 - DNA, 21 bp, Homo sapiens
tttctaccattaaaatcttga

SEQ ID NO: 628324 - DNA, 14 bp, Homo sapiens
tttctactttaaat

SEQ ID NO: 628325 - DNA, 22 bp, Homo sapiens
tttctatatgtaacttcagatg

SEQ ID NO: 628326 - DNA, 23 bp, Homo sapiens
tttctatatgtaacttcagatgt

SEQ ID NO: 628327 - DNA, 15 bp, Homo sapiens
tttctcagcatatat

SEQ ID NO: 628328 - DNA, 15 bp, Homo sapiens
tttctcatgcataga

SEQ ID NO: 628329 - DNA, 17 bp, Homo sapiens
tttctctctgtgtggca

SEQ ID NO: 628330 - DNA, 21 bp, Homo sapiens
tttctctctttcttttgtgca

SEQ ID NO: 628331 - DNA, 14 bp, Homo sapiens
tttctgtaattctt

SEQ ID NO: 628332 - DNA, 12 bp, Homo sapiens
tttcttccttcc

SEQ ID NO: 628333 - DNA, 21 bp, Homo sapiens
tttcttccttcctttctctct

SEQ ID NO: 628334 - DNA, 17 bp, Homo sapiens
tttcttctctctgtgct

SEQ ID NO: 628335 - DNA, 14 bp, Homo sapiens
tttcttctttaatt

SEQ ID NO: 628336 - DNA, 23 bp, Homo sapiens
tttctttttattaggttaagtct

SEQ ID NO: 628337 - DNA, 19 bp, Homo sapiens
tttgaaaatgtttttaagt

SEQ ID NO: 628338 - DNA, 16 bp, Homo sapiens
tttgaaatgtttttga

SEQ ID NO: 628339 - DNA, 19 bp, Homo sapiens
tttgacattgtcagaatgt

SEQ ID NO: 628340 - DNA, 20 bp, Homo sapiens
tttgacattgtcagaatgtt

SEQ ID NO: 628341 - DNA, 18 bp, Homo sapiens
tttgagccttattaaaat

SEQ ID NO: 628342 - DNA, 15 bp, Homo sapiens
tttgaggaaactcat

SEQ ID NO: 628343 - DNA, 19 bp, Homo sapiens
tttgagtgtcaggctctga

SEQ ID NO: 628344 - DNA, 19 bp, Homo sapiens
ttggaacagtaatcagttt

SEQ ID NO: 628345 - DNA, 21 bp, Homo sapiens
ttggaagggcgctgagggcag

SEQ ID NO: 628346 - DNA, 23 bp, Homo sapiens
ttggaagggcgctgagggcaggg

SEQ ID NO: 628347 - DNA, 22 bp, Homo sapiens
ttggaagttttacttgattaag

SEQ ID NO: 628348 - DNA, 14 bp, Homo sapiens
ttggaattctgctt

SEQ ID NO: 628349 - DNA, 23 bp, Homo sapiens
ttggagcagagacggcagcccca

SEQ ID NO: 628350 - DNA, 18 bp, Homo sapiens
ttggagccccctggcggc

SEQ ID NO: 628351 - DNA, 15 bp, Homo sapiens
ttggatataaatctt

SEQ ID NO: 628352 - DNA, 20 bp, Homo sapiens
ttggattggtaccagagcct

SEQ ID NO: 628353 - DNA, 16 bp, Homo sapiens
ttggcagtgtgtcaca

SEQ ID NO: 628354 - DNA, 13 bp, Homo sapiens
ttggccctggagc

SEQ ID NO: 628355 - DNA, 14 bp, Homo sapiens
ttggccctggagcc

SEQ ID NO: 628356 - DNA, 12 bp, Homo sapiens
ttggcctctgcc

SEQ ID NO: 628357 - DNA, 13 bp, Homo sapiens
ttggcctctgccc

SEQ ID NO: 628358 - DNA, 19 bp, Homo sapiens
ttggctgccaagagtccaa

SEQ ID NO: 628359 - DNA, 15 bp, Homo sapiens
ttggcttcagaattg

SEQ ID NO: 628360 - DNA, 19 bp, Homo sapiens
ttggcttcttctttaggat

SEQ ID NO: 628361 - DNA, 20 bp, Homo sapiens
ttgggaaattcttgcactgt

SEQ ID NO: 628362 - DNA, 22 bp, Homo sapiens
ttgggattcctcccctggaagt

SEQ ID NO: 628363 - DNA, 18 bp, Homo sapiens
ttgggcccttagaatgtg

SEQ ID NO: 628364 - DNA, 15 bp, Homo sapiens
ttgggcctccatgcc

SEQ ID NO: 628365 - DNA, 20 bp, Homo sapiens
ttgggctcagggttggccat

SEQ ID NO: 628366 - DNA, 21 bp, Homo sapiens
ttggggacaccctcctgcccc

SEQ ID NO: 628367 - DNA, 15 bp, Homo sapiens
ttggggtagagagga

SEQ ID NO: 628368 - DNA, 13 bp, Homo sapiens
ttgggttccagac

SEQ ID NO: 628369 - DNA, 23 bp, Homo sapiens
ttggtaatgatgattcaatcatt

SEQ ID NO: 628370 - DNA, 13 bp, Homo sapiens
ttggtatgaaaca

SEQ ID NO: 628371 - DNA, 16 bp, Homo sapiens
ttggtatgaaacaaat

SEQ ID NO: 628372 - DNA, 21 bp, Homo sapiens
ttggtatgaaacaaatatact

SEQ ID NO: 628373 - DNA, 16 bp, Homo sapiens
ttggtctctttctttc

SEQ ID NO: 628374 - DNA, 19 bp, Homo sapiens
ttggtgtcgggcatgacac

SEQ ID NO: 628375 - DNA, 15 bp, Homo sapiens
ttggttcctcatggc

SEQ ID NO: 628376 - DNA, 13 bp, Homo sapiens
ttgtaaaactgtg

SEQ ID NO: 628377 - DNA, 14 bp, Homo sapiens
ttgtaaaactgtga

SEQ ID NO: 628378 - DNA, 21 bp, Homo sapiens
ttgtaaagatattgtatctcc

SEQ ID NO: 628379 - DNA, 17 bp, Homo sapiens
ttgtaaaggtaggtgca

SEQ ID NO: 628380 - DNA, 13 bp, Homo sapiens
ttgtaatataaga

SEQ ID NO: 628381 - DNA, 13 bp, Homo sapiens
ttgtaatatcagt

SEQ ID NO: 628382 - DNA, 18 bp, Homo sapiens
ttgtaatattttgctgct

SEQ ID NO: 628383 - DNA, 18 bp, Homo sapiens
ttgtacgttaattaaaca

SEQ ID NO: 628384 - DNA, 18 bp, Homo sapiens
ttgtacttacactgaaat

SEQ ID NO: 628385 - DNA, 14 bp, Homo sapiens
ttgtactttacaat

SEQ ID NO: 628386 - DNA, 15 bp, Homo sapiens
ttgtagctagtttaa

SEQ ID NO: 628387 - DNA, 20 bp, Homo sapiens
ttgtagctagtttaaaatta

SEQ ID NO: 628388 - DNA, 21 bp, Homo sapiens
ttgtagctagtttaaaattat

SEQ ID NO: 628389 - DNA, 16 bp, Homo sapiens
ttgtataaaaaaaata

SEQ ID NO: 628390 - DNA, 15 bp, Homo sapiens
ttgtataattatgaa

SEQ ID NO: 628391 - DNA, 14 bp, Homo sapiens
ttgtatatatatgt

SEQ ID NO: 628392 - DNA, 15 bp, Homo sapiens
ttgtatatatatgtg

SEQ ID NO: 628393 - DNA, 17 bp, Homo sapiens
ttgtatatatatgtgaa

SEQ ID NO: 628394 - DNA, 19 bp, Homo sapiens
ttgtatatatatgtgaact

SEQ ID NO: 628395 - DNA, 13 bp, Homo sapiens
ttgtattggaagt

SEQ ID NO: 628396 - DNA, 15 bp, Homo sapiens
ttgtcagaatgttgt

SEQ ID NO: 628397 - DNA, 15 bp, Homo sapiens
ttgtcattctgctaa

SEQ ID NO: 628398 - DNA, 16 bp, Homo sapiens
ttgtcattctgctaat

SEQ ID NO: 628399 - DNA, 13 bp, Homo sapiens
ttgtcctgtagct

SEQ ID NO: 628400 - DNA, 13 bp, Homo sapiens
ttgtcctgtttct

SEQ ID NO: 628401 - DNA, 18 bp, Homo sapiens
ttgtcctttctgatcctc

SEQ ID NO: 628402 - DNA, 15 bp, Homo sapiens
ttgtctgaaacatag

SEQ ID NO: 628403 - DNA, 21 bp, Homo sapiens
ttgtctggctgtggcccctcc

SEQ ID NO: 628404 - DNA, 13 bp, Homo sapiens
ttgtcttattcct

SEQ ID NO: 628405 - DNA, 16 bp, Homo sapiens
ttgtgagttaatttga

SEQ ID NO: 628406 - DNA, 10 bp, Homo sapiens
ttgtgccaaa

SEQ ID NO: 628407 - DNA, 15 bp, Homo sapiens
ttgtgcggtgtgtct

SEQ ID NO: 628408 - DNA, 19 bp, Homo sapiens
ttgtgcttatgtcatttct

SEQ ID NO: 628409 - DNA, 13 bp, Homo sapiens
ttgtggggccagg

SEQ ID NO: 628410 - DNA, 14 bp, Homo sapiens
ttgtggggccagga

SEQ ID NO: 628411 - DNA, 18 bp, Homo sapiens
ttgtgtcttttgcatgat

SEQ ID NO: 628412 - DNA, 17 bp, Homo sapiens
ttgtgtgcttcacacaa

SEQ ID NO: 628413 - DNA, 17 bp, Homo sapiens
ttgtgtgggtttactct

SEQ ID NO: 628414 - DNA, 20 bp, Homo sapiens
ttgtgtgggtttactctgtg

SEQ ID NO: 628415 - DNA, 13 bp, Homo sapiens
ttgtgttacaata

SEQ ID NO: 628416 - DNA, 18 bp, Homo sapiens
ttgtgttggtatttactg

SEQ ID NO: 628417 - DNA, 20 bp, Homo sapiens
ttgttcaaagaacccccctc

SEQ ID NO: 628418 - DNA, 15 bp, Homo sapiens
ttgttcaccttctgt

SEQ ID NO: 628419 - DNA, 18 bp, Homo sapiens
ttgttcaccttctgtgca

SEQ ID NO: 628420 - DNA, 18 bp, Homo sapiens
ttgttcagtcacttgttt

SEQ ID NO: 628421 - DNA, 14 bp, Homo sapiens
ttgttgtccctgca

SEQ ID NO: 628422 - DNA, 17 bp, Homo sapiens
ttgtttaaagcaactgt

SEQ ID NO: 628423 - DNA, 15 bp, Homo sapiens
ttgttttgctttttc

SEQ ID NO: 628424 - DNA, 19 bp, Homo sapiens
ttgttttgctttttctgac

SEQ ID NO: 628425 - DNA, 17 bp, Homo sapiens
ttgttttttcattgtgt

SEQ ID NO: 628426 - DNA, 22 bp, Homo sapiens
tttaaaaaaataatataaatga

SEQ ID NO: 628427 - DNA, 19 bp, Homo sapiens
tttaaaagccctttccaaa

SEQ ID NO: 628428 - DNA, 20 bp, Homo sapiens
tttaaaagccctttccaaag

SEQ ID NO: 628429 - DNA, 14 bp, Homo sapiens
tttaaaattattaa

SEQ ID NO: 628430 - DNA, 16 bp, Homo sapiens
tttaaacaaaatttat

SEQ ID NO: 628431 - DNA, 17 bp, Homo sapiens
tttaaagcaactgtcta

SEQ ID NO: 628432 - DNA, 16 bp, Homo sapiens
tttaaatctttgttaa

SEQ ID NO: 628433 - DNA, 19 bp, Homo sapiens
tttaaatctttgttaaaat

SEQ ID NO: 628434 - DNA, 15 bp, Homo sapiens
catctgatttctgaa

SEQ ID NO: 628435 - DNA, 16 bp, Homo sapiens
catctgatttctgaac

SEQ ID NO: 628436 - DNA, 15 bp, Homo sapiens
catctgcctggagcc

SEQ ID NO: 628437 - DNA, 14 bp, Homo sapiens
catctggccctgac

SEQ ID NO: 628438 - DNA, 12 bp, Homo sapiens
catctggcctgg

SEQ ID NO: 628439 - DNA, 19 bp, Homo sapiens
catctgtatatcagctcta

SEQ ID NO: 628440 - DNA, 11 bp, Homo sapiens
catctgtcagc

SEQ ID NO: 628441 - DNA, 19 bp, Homo sapiens
catctgtcagcttcccaac

SEQ ID NO: 628442 - DNA, 18 bp, Homo sapiens
catcttgtaaataatgct

SEQ ID NO: 628443 - DNA, 17 bp, Homo sapiens
catcttgtggggccagg

SEQ ID NO: 628444 - DNA, 17 bp, Homo sapiens
catgaaaagttttcaag

SEQ ID NO: 628445 - DNA, 21 bp, Homo sapiens
catgaaagccctggaatttta

SEQ ID NO: 628446 - DNA, 23 bp, Homo sapiens
catgaaagtcaagtctacctgcc

SEQ ID NO: 628447 - DNA, 18 bp, Homo sapiens
ccacggggtcgggggagg

SEQ ID NO: 628448 - DNA, 22 bp, Homo sapiens
ccacggggtcgggggaggagca

SEQ ID NO: 628449 - DNA, 19 bp, Homo sapiens
ccacggtccaatccagcct

SEQ ID NO: 628450 - DNA, 15 bp, Homo sapiens
ccacgtgcagcacct

SEQ ID NO: 628451 - DNA, 18 bp, Homo sapiens
ccacgtgcagcacctgtc

SEQ ID NO: 628452 - DNA, 21 bp, Homo sapiens
ccacgtgcagcacctgtcacc

SEQ ID NO: 628453 - DNA, 16 bp, Homo sapiens
ccacgtgtgcagactg

SEQ ID NO: 628454 - DNA, 21 bp, Homo sapiens
ccacgtgtttcgggccagggc

SEQ ID NO: 628455 - DNA, 22 bp, Homo sapiens
ccacgttgcagaaaaagagctt

SEQ ID NO: 628456 - DNA, 21 bp, Homo sapiens
ccactagccctctttctctct

SEQ ID NO: 628457 - DNA, 23 bp, Homo sapiens
ccactagccctctttctctctgt

SEQ ID NO: 628458 - DNA, 18 bp, Homo sapiens
ccactaggtgcccagtct

SEQ ID NO: 628459 - DNA, 23 bp, Homo sapiens
ccactctgaagtcccttcctgtc

SEQ ID NO: 628460 - DNA, 21 bp, Homo sapiens
ccactctgaataccaagtgtg

SEQ ID NO: 628461 - DNA, 17 bp, Homo sapiens
ccactggagcgtgtact

SEQ ID NO: 628462 - DNA, 17 bp, Homo sapiens
ccacttatttccatgga

SEQ ID NO: 628463 - DNA, 12 bp, Homo sapiens
ccacttccttaa

SEQ ID NO: 628464 - DNA, 13 bp, Homo sapiens
ccactttcctctc

SEQ ID NO: 628465 - DNA, 15 bp, Homo sapiens
ccactttcctctctc

SEQ ID NO: 628466 - DNA, 17 bp, Homo sapiens
ccactttcctctctctc

SEQ ID NO: 628467 - DNA, 17 bp, Homo sapiens
ccactttggcctccgtt

SEQ ID NO: 628468 - DNA, 11 bp, Homo sapiens
ccagaaagagg

SEQ ID NO: 628469 - DNA, 18 bp, Homo sapiens
ccagaaagaggaataaaa

SEQ ID NO: 628470 - DNA, 14 bp, Homo sapiens
ccagaacgggcctc

SEQ ID NO: 628471 - DNA, 19 bp, Homo sapiens
ccagaagctcaaggctgca

SEQ ID NO: 628472 - DNA, 20 bp, Homo sapiens
ccagaagctcaaggctgcag

SEQ ID NO: 628473 - DNA, 20 bp, Homo sapiens
ccagaatgaggcacatgaca

SEQ ID NO: 628474 - DNA, 12 bp, Homo sapiens
ccagaattgaga

SEQ ID NO: 628475 - DNA, 18 bp, Homo sapiens
ccagacagagatcagaat

SEQ ID NO: 628476 - DNA, 19 bp, Homo sapiens
ccagacagagtggatctgg

SEQ ID NO: 628477 - DNA, 17 bp, Homo sapiens
ccagacagggtggggct

SEQ ID NO: 628478 - DNA, 20 bp, Homo sapiens
ccagacccctaccctttccc

SEQ ID NO: 628479 - DNA, 20 bp, Homo sapiens
ccagacgtgctcctgctgac

SEQ ID NO: 628480 - DNA, 17 bp, Homo sapiens
ccagactcgagagggct

SEQ ID NO: 628481 - DNA, 18 bp, Homo sapiens
ccagactcgagagggctg

SEQ ID NO: 628482 - DNA, 20 bp, Homo sapiens
ccagactcgagagggctgag

SEQ ID NO: 628483 - DNA, 22 bp, Homo sapiens
ccagagaaatgaaagtcagttt

SEQ ID NO: 628484 - DNA, 14 bp, Homo sapiens
ccagagactgccca

SEQ ID NO: 628485 - DNA, 15 bp, Homo sapiens
ccagagactgcccac

SEQ ID NO: 628486 - DNA, 16 bp, Homo sapiens
ccagagactgcccacc

SEQ ID NO: 628487 - DNA, 16 bp, Homo sapiens
ccagagcactgtatac

SEQ ID NO: 628488 - DNA, 20 bp, Homo sapiens
ccagagccactacctttgtc

SEQ ID NO: 628489 - DNA, 15 bp, Homo sapiens
ccagagccctgcagt

SEQ ID NO: 628490 - DNA, 17 bp, Homo sapiens
ccagagccctgcagtca

SEQ ID NO: 628491 - DNA, 18 bp, Homo sapiens
ccagagtaggtgggtctt

SEQ ID NO: 628492 - DNA, 16 bp, Homo sapiens
ccagagttatttccca

SEQ ID NO: 628493 - DNA, 19 bp, Homo sapiens
ccagatttcactctccttg

SEQ ID NO: 628494 - DNA, 15 bp, Homo sapiens
ccagcactcccaggg

SEQ ID NO: 628495 - DNA, 16 bp, Homo sapiens
ccagcactcccagggc

SEQ ID NO: 628496 - DNA, 19 bp, Homo sapiens
ccagcactcccagggcccg

SEQ ID NO: 628497 - DNA, 15 bp, Homo sapiens
ccagcagacattgtc

SEQ ID NO: 628498 - DNA, 20 bp, Homo sapiens
ccagcagtgaatgctagaca

SEQ ID NO: 628499 - DNA, 20 bp, Homo sapiens
ccagcatagttctgcaataa

SEQ ID NO: 628500 - DNA, 16 bp, Homo sapiens
ccagcattcagcacac

SEQ ID NO: 628501 - DNA, 17 bp, Homo sapiens
ccagcattcagcacaca

SEQ ID NO: 628502 - DNA, 15 bp, Homo sapiens
ccagcccatgctggc

SEQ ID NO: 628503 - DNA, 17 bp, Homo sapiens
ccagcccatgctggctg

SEQ ID NO: 628504 - DNA, 15 bp, Homo sapiens
ccagcccccaccccc

SEQ ID NO: 628505 - DNA, 16 bp, Homo sapiens
ccagcccccacccccg

SEQ ID NO: 628506 - DNA, 19 bp, Homo sapiens
ccagccctccgccagccct

SEQ ID NO: 628507 - DNA, 13 bp, Homo sapiens
ccagccctgggca

SEQ ID NO: 628508 - DNA, 22 bp, Homo sapiens
ccagccctgttccgcctcactg

SEQ ID NO: 628509 - DNA, 19 bp, Homo sapiens
ccagcctatctctcttctg

SEQ ID NO: 628510 - DNA, 13 bp, Homo sapiens
ccagcctccccca

SEQ ID NO: 628511 - DNA, 16 bp, Homo sapiens
ccagcctcccccaggc

SEQ ID NO: 628512 - DNA, 18 bp, Homo sapiens
ccagcctcccccaggctg

SEQ ID NO: 628513 - DNA, 22 bp, Homo sapiens
ccagcctcccccaggctgcgcc

SEQ ID NO: 628514 - DNA, 22 bp, Homo sapiens
ccagcctgaaagatacagggga

SEQ ID NO: 628515 - DNA, 12 bp, Homo sapiens
ccagcctgagcc

SEQ ID NO: 628516 - DNA, 16 bp, Homo sapiens
ccagcctgagccacag

SEQ ID NO: 628517 - DNA, 19 bp, Homo sapiens
ccagcctgagccacagtgg

SEQ ID NO: 628518 - DNA, 17 bp, Homo sapiens
ccagcgacgcggcccgc

SEQ ID NO: 628519 - DNA, 15 bp, Homo sapiens
ccagctctgagcaga

SEQ ID NO: 628520 - DNA, 21 bp, Homo sapiens
ccagctctggatgaaggcaaa

SEQ ID NO: 628521 - DNA, 23 bp, Homo sapiens
ccagctgcaggaatcaaaaattg

SEQ ID NO: 628522 - DNA, 18 bp, Homo sapiens
ccagctggcagcgcctcc

SEQ ID NO: 628523 - DNA, 14 bp, Homo sapiens
ccagctggctgggt

SEQ ID NO: 628524 - DNA, 16 bp, Homo sapiens
ccagctggctgggtcg

SEQ ID NO: 628525 - DNA, 23 bp, Homo sapiens
ccagctggctgggtcgcccctcc

SEQ ID NO: 628526 - DNA, 20 bp, Homo sapiens
ccaggaagtcatcctgcaat

SEQ ID NO: 628527 - DNA, 21 bp, Homo sapiens
ccaggaagtcatcctgcaatg

SEQ ID NO: 628528 - DNA, 17 bp, Homo sapiens
ccaggacccccccagtc

SEQ ID NO: 628529 - DNA, 17 bp, Homo sapiens
ccaggacgcatgcaggg

SEQ ID NO: 628530 - DNA, 12 bp, Homo sapiens
ccaggagaccct

SEQ ID NO: 628531 - DNA, 19 bp, Homo sapiens
ccaggagctagcccagtcc

SEQ ID NO: 628532 - DNA, 14 bp, Homo sapiens
ccaggaggacctgg

SEQ ID NO: 628533 - DNA, 22 bp, Homo sapiens
ccaggatgaaggggccagacca

SEQ ID NO: 628534 - DNA, 16 bp, Homo sapiens
ccaggcacccaaaccc

SEQ ID NO: 628535 - DNA, 17 bp, Homo sapiens
ccaggcccgccctgccc

SEQ ID NO: 628536 - DNA, 12 bp, Homo sapiens
ccaggcccgtgg

SEQ ID NO: 628537 - DNA, 17 bp, Homo sapiens
ccaggcccgtgggcgca

SEQ ID NO: 628538 - DNA, 18 bp, Homo sapiens
ccaggcccgtgggcgcaa

SEQ ID NO: 628539 - DNA, 21 bp, Homo sapiens
ccaggccctaggattcctccc

SEQ ID NO: 628540 - DNA, 15 bp, Homo sapiens
ccaggccctccagca

SEQ ID NO: 628541 - DNA, 19 bp, Homo sapiens
ccaggcggaggggcttgga

SEQ ID NO: 628542 - DNA, 20 bp, Homo sapiens
ccaggcggaggggcttggag

SEQ ID NO: 628543 - DNA, 16 bp, Homo sapiens
ccaggctgcgcctgcc

SEQ ID NO: 628544 - DNA, 20 bp, Homo sapiens
ccaggctgcgcctgcccgcc

SEQ ID NO: 628545 - DNA, 14 bp, Homo sapiens
ccagggaaccagag

SEQ ID NO: 628546 - DNA, 22 bp, Homo sapiens
ccagggcccgagcgcgtgcctt

SEQ ID NO: 628547 - DNA, 14 bp, Homo sapiens
ccagggctcagatg

SEQ ID NO: 628548 - DNA, 12 bp, Homo sapiens
ccaggggcaggc

SEQ ID NO: 628549 - DNA, 14 bp, Homo sapiens
ccaggggcaggcag

SEQ ID NO: 628550 - DNA, 15 bp, Homo sapiens
ccaggggcaggcagc

SEQ ID NO: 628551 - DNA, 20 bp, Homo sapiens
ccaggggcaggcagctaggc

SEQ ID NO: 628552 - DNA, 13 bp, Homo sapiens
ccaggggcttctc

SEQ ID NO: 628553 - DNA, 17 bp, Homo sapiens
ccagggtccagccctcc

SEQ ID NO: 628554 - DNA, 20 bp, Homo sapiens
ccagggtccagccctccgcc

SEQ ID NO: 628555 - DNA, 16 bp, Homo sapiens
ccagggtgcaggcgcg

SEQ ID NO: 628556 - DNA, 18 bp, Homo sapiens
ccagggttaaagaaaggc

SEQ ID NO: 628557 - DNA, 16 bp, Homo sapiens
ccagggttccagacag

SEQ ID NO: 628558 - DNA, 15 bp, Homo sapiens
ccaggtctggcgcca

SEQ ID NO: 628559 - DNA, 17 bp, Homo sapiens
ccagtcatggctgtccc

SEQ ID NO: 628560 - DNA, 18 bp, Homo sapiens
gtaaatatacactttaca

SEQ ID NO: 628561 - DNA, 23 bp, Homo sapiens
gtaaatcccacgacataagctgg

SEQ ID NO: 628562 - DNA, 16 bp, Homo sapiens
gtaaatgtcttcatgt

SEQ ID NO: 628563 - DNA, 20 bp, Homo sapiens
gtaaatgtcttcatgttgat

SEQ ID NO: 628564 - DNA, 12 bp, Homo sapiens
gtaacagacatt

SEQ ID NO: 628565 - DNA, 19 bp, Homo sapiens
gtaaccatgttgtgttctt

SEQ ID NO: 628566 - DNA, 13 bp, Homo sapiens
gtaactcatttgg

SEQ ID NO: 628567 - DNA, 22 bp, Homo sapiens
gtaactgccattttttgtctgt

SEQ ID NO: 628568 - DNA, 22 bp, Homo sapiens
gtaactgttaacccagtgttca

SEQ ID NO: 628569 - DNA, 19 bp, Homo sapiens
gtaacttgctgtgaaatga

SEQ ID NO: 628570 - DNA, 15 bp, Homo sapiens
gtaagaaaatttaaa

SEQ ID NO: 628571 - DNA, 15 bp, Homo sapiens
gtaagataggttctg

SEQ ID NO: 628572 - DNA, 23 bp, Homo sapiens
gtaaggccattctttagtcattc

SEQ ID NO: 628573 - DNA, 21 bp, Homo sapiens
gtaagggactccagaagcagc

SEQ ID NO: 628574 - DNA, 24 bp, Homo sapiens
gtaagggactccagaagcagcagc

SEQ ID NO: 628575 - DNA, 20 bp, Homo sapiens
gtaagttgaagggaaatcaa

SEQ ID NO: 628576 - DNA, 15 bp, Homo sapiens
gtaatagcctcacct

SEQ ID NO: 628577 - DNA, 20 bp, Homo sapiens
gtaatataagacaagtctga

SEQ ID NO: 628578 - DNA, 20 bp, Homo sapiens
gtaatatcagttacagtggc

SEQ ID NO: 628579 - DNA, 13 bp, Homo sapiens
gtaatattaaatt

SEQ ID NO: 628580 - DNA, 14 bp, Homo sapiens
gtaatattaaattc

SEQ ID NO: 628581 - DNA, 21 bp, Homo sapiens
gtaattaaaaagacactttta

SEQ ID NO: 628582 - DNA, 18 bp, Homo sapiens
gtaatttcctgctcctcc

SEQ ID NO: 628583 - DNA, 19 bp, Homo sapiens
gtacaaaatgaattgcctt

SEQ ID NO: 628584 - DNA, 20 bp, Homo sapiens
gtacaaaatgaattgccttt

SEQ ID NO: 628585 - DNA, 18 bp, Homo sapiens
gtacaataaataaaagaa

SEQ ID NO: 628586 - DNA, 18 bp, Homo sapiens
gtacaattctttgttgct

SEQ ID NO: 628587 - DNA, 19 bp, Homo sapiens
gtacaattctttgttgctt

SEQ ID NO: 628588 - DNA, 21 bp, Homo sapiens
gtacaattctttgttgcttaa

SEQ ID NO: 628589 - DNA, 19 bp, Homo sapiens
gtacaccactttcccacac

SEQ ID NO: 628590 - DNA, 14 bp, Homo sapiens
gtacagtgttctgt

SEQ ID NO: 628591 - DNA, 16 bp, Homo sapiens
gtacagtgttctgttt

SEQ ID NO: 628592 - DNA, 16 bp, Homo sapiens
gtacataaagtaataa

SEQ ID NO: 628593 - DNA, 21 bp, Homo sapiens
gtacatttatgtgtgaagcaa

SEQ ID NO: 628594 - DNA, 22 bp, Homo sapiens
gtacatttgatttgatatacag

SEQ ID NO: 628595 - DNA, 21 bp, Homo sapiens
gtaccagagcctatggaaagg

SEQ ID NO: 628596 - DNA, 15 bp, Homo sapiens
gtaccatcccactga

SEQ ID NO: 628597 - DNA, 20 bp, Homo sapiens
gtaccccagcctcgttggag

SEQ ID NO: 628598 - DNA, 16 bp, Homo sapiens
gtacgttaattaaaca

SEQ ID NO: 628599 - DNA, 22 bp, Homo sapiens
gtactaccccagaacgcatgca

SEQ ID NO: 628600 - DNA, 14 bp, Homo sapiens
gtactaccccagga

SEQ ID NO: 628601 - DNA, 14 bp, Homo sapiens
gtactctaatatac

SEQ ID NO: 628602 - DNA, 20 bp, Homo sapiens
gtactctaatatacagtgtg

SEQ ID NO: 628603 - DNA, 18 bp, Homo sapiens
gtactctgagtcctcatt

SEQ ID NO: 628604 - DNA, 20 bp, Homo sapiens
gtacttacactgaaatccaa

SEQ ID NO: 628605 - DNA, 20 bp, Homo sapiens
gtacttgatttttcaaagac

SEQ ID NO: 628606 - DNA, 13 bp, Homo sapiens
gtagactgtgaca

SEQ ID NO: 628607 - DNA, 16 bp, Homo sapiens
gtagagtcaggagaaa

SEQ ID NO: 628608 - DNA, 17 bp, Homo sapiens
gtagagtcctaggacat

SEQ ID NO: 628609 - DNA, 22 bp, Homo sapiens
gtagatgaaaaagcatgtacag

SEQ ID NO: 628610 - DNA, 20 bp, Homo sapiens
gtagcaacccaggtgttgtc

SEQ ID NO: 628611 - DNA, 17 bp, Homo sapiens
gtagctcgtgtgcttag

SEQ ID NO: 628612 - DNA, 15 bp, Homo sapiens
gtaggctgctggcgc

SEQ ID NO: 628613 - DNA, 17 bp, Homo sapiens
gtagggaaaccttggag

SEQ ID NO: 628614 - DNA, 21 bp, Homo sapiens
gtagggcctgcatggagaagg

SEQ ID NO: 628615 - DNA, 15 bp, Homo sapiens
gtaggtctgcacaca

SEQ ID NO: 628616 - DNA, 15 bp, Homo sapiens
gtagtgggtgaatgt

SEQ ID NO: 628617 - DNA, 17 bp, Homo sapiens
gtataagatgctgctga

SEQ ID NO: 628618 - DNA, 15 bp, Homo sapiens
gtataagtagaattc

SEQ ID NO: 628619 - DNA, 14 bp, Homo sapiens
gtatacaaacaggt

SEQ ID NO: 628620 - DNA, 15 bp, Homo sapiens
gtatacaagtgtttc

SEQ ID NO: 628621 - DNA, 18 bp, Homo sapiens
gtatagatggtagaaact

SEQ ID NO: 628622 - DNA, 22 bp, Homo sapiens
gtatagggaattttcattttca

SEQ ID NO: 628623 - DNA, 13 bp, Homo sapiens
gtatatatatgtg

SEQ ID NO: 628624 - DNA, 14 bp, Homo sapiens
gtatatattttgaa

SEQ ID NO: 628625 - DNA, 18 bp, Homo sapiens
gtatatattttgaaagga

SEQ ID NO: 628626 - DNA, 15 bp, Homo sapiens
gtatatgtttataca

SEQ ID NO: 628627 - DNA, 19 bp, Homo sapiens
gtatatgtttatacacaca

SEQ ID NO: 628628 - DNA, 21 bp, Homo sapiens
gtatcatacgttgatagttta

SEQ ID NO: 628629 - DNA, 23 bp, Homo sapiens
gtatctgatgatgttctgaaatg

SEQ ID NO: 628630 - DNA, 16 bp, Homo sapiens
gtatgctttccctgag

SEQ ID NO: 628631 - DNA, 19 bp, Homo sapiens
gtatgctttccctgaggaa

SEQ ID NO: 628632 - DNA, 22 bp, Homo sapiens
gtatgctttccctgaggaatga

SEQ ID NO: 628633 - DNA, 21 bp, Homo sapiens
gtatggaagacaaatacacat

SEQ ID NO: 628634 - DNA, 16 bp, Homo sapiens
gtatgtacaggctgag

SEQ ID NO: 628635 - DNA, 19 bp, Homo sapiens
gtatgtacaggctgagaca

SEQ ID NO: 628636 - DNA, 20 bp, Homo sapiens
gtattctgtagccaacttaa

SEQ ID NO: 628637 - DNA, 18 bp, Homo sapiens
gtattgacaataagaaac

SEQ ID NO: 628638 - DNA, 23 bp, Homo sapiens
gtattgacgacctacatctgaaa

SEQ ID NO: 628639 - DNA, 18 bp, Homo sapiens
gtattgagacactgtcaa

SEQ ID NO: 628640 - DNA, 22 bp, Homo sapiens
gtattgagacactgtcaagatt

SEQ ID NO: 628641 - DNA, 17 bp, Homo sapiens
gtattgtgtcttttgca

SEQ ID NO: 628642 - DNA, 20 bp, Homo sapiens
gtatttactgcaatgtctgt

SEQ ID NO: 628643 - DNA, 22 bp, Homo sapiens
gtatttacttgttatgttgtaa

SEQ ID NO: 628644 - DNA, 17 bp, Homo sapiens
gtattttattgtaacag

SEQ ID NO: 628645 - DNA, 16 bp, Homo sapiens
gtcaaacagtgtggct

SEQ ID NO: 628646 - DNA, 22 bp, Homo sapiens
gtcaaacagtgtggcttaaaca

SEQ ID NO: 628647 - DNA, 20 bp, Homo sapiens
gtcaagattaagttatacca

SEQ ID NO: 628648 - DNA, 16 bp, Homo sapiens
gtcaatatatagagac

SEQ ID NO: 628649 - DNA, 12 bp, Homo sapiens
gtcaatgcattg

SEQ ID NO: 628650 - DNA, 20 bp, Homo sapiens
gtcaatgtgaaataaagagt

SEQ ID NO: 628651 - DNA, 17 bp, Homo sapiens
gtcaattgcttgagcat

SEQ ID NO: 628652 - DNA, 19 bp, Homo sapiens
gtcacactgagctgggcac

SEQ ID NO: 628653 - DNA, 21 bp, Homo sapiens
gtcacgtgaggcccctgtgca

SEQ ID NO: 628654 - DNA, 23 bp, Homo sapiens
gtcactcacaaaaggctggatgt

SEQ ID NO: 628655 - DNA, 23 bp, Homo sapiens
gtcactgctacaccttagcagct

SEQ ID NO: 628656 - DNA, 18 bp, Homo sapiens
gtcacttttttcctgtca

SEQ ID NO: 628657 - DNA, 22 bp, Homo sapiens
gtcagaatgttgtgttggtatt

SEQ ID NO: 628658 - DNA, 13 bp, Homo sapiens
gtcagcacagaga

SEQ ID NO: 628659 - DNA, 13 bp, Homo sapiens
gtcagcagggggg

SEQ ID NO: 628660 - DNA, 16 bp, Homo sapiens
gtcaggaccattttag

SEQ ID NO: 628661 - DNA, 20 bp, Homo sapiens
gtcaggagagccctctgctg

SEQ ID NO: 628662 - DNA, 20 bp, Homo sapiens
gtcaggccattcagtctatg

SEQ ID NO: 628663 - DNA, 20 bp, Homo sapiens
gtcaggctacaggtgcccca

SEQ ID NO: 628664 - DNA, 15 bp, Homo sapiens
gtcagggctgtgctt

SEQ ID NO: 628665 - DNA, 18 bp, Homo sapiens
gtcagggctgtgctttcc

SEQ ID NO: 628666 - DNA, 19 bp, Homo sapiens
gtcagtgtactctgagtcc

SEQ ID NO: 628667 - DNA, 16 bp, Homo sapiens
gtcagtgtagatcaac

SEQ ID NO: 628668 - DNA, 14 bp, Homo sapiens
gtcagtttgtgaag

SEQ ID NO: 628669 - DNA, 19 bp, Homo sapiens
gtcagtttgtgaagtgatt

SEQ ID NO: 628670 - DNA, 20 bp, Homo sapiens
gtcatattcataccttctga

SEQ ID NO: 628671 - DNA, 19 bp, Homo sapiens
gtcatctcaaacactgctt

SEQ ID NO: 628672 - DNA, 12 bp, Homo sapiens
gtcatctgtcag

SEQ ID NO: 628673 - DNA, 18 bp, Homo sapiens
gtcatgttggtaccctgg

SEQ ID NO: 628674 - DNA, 16 bp, Homo sapiens
gtccaatccagccttc

SEQ ID NO: 628675 - DNA, 22 bp, Homo sapiens
gtccacatgtggggacagggct

SEQ ID NO: 628676 - DNA, 17 bp, Homo sapiens
gtccacccccattgtga

SEQ ID NO: 628677 - DNA, 19 bp, Homo sapiens
gtccacccccattgtgaat

SEQ ID NO: 628678 - DNA, 18 bp, Homo sapiens
gtccaccccgtcccggcc

SEQ ID NO: 628679 - DNA, 19 bp, Homo sapiens
gtccagcaggtagtgggtg

SEQ ID NO: 628680 - DNA, 12 bp, Homo sapiens
gtccagccctcc

SEQ ID NO: 628681 - DNA, 13 bp, Homo sapiens
gtccagccctccg

SEQ ID NO: 628682 - DNA, 15 bp, Homo sapiens
gtccagccctccgcc

SEQ ID NO: 628683 - DNA, 21 bp, Homo sapiens
gtccaggagatgaggctggat

SEQ ID NO: 628684 - DNA, 16 bp, Homo sapiens
gtccagggtccagccc

SEQ ID NO: 628685 - DNA, 17 bp, Homo sapiens
gtccagggtccagccct

SEQ ID NO: 628686 - DNA, 18 bp, Homo sapiens
gtccagggtccagccctc

SEQ ID NO: 628687 - DNA, 15 bp, Homo sapiens
gtccaggtcacaggc

SEQ ID NO: 628688 - DNA, 18 bp, Homo sapiens
gtccatccgtctctgtcc

SEQ ID NO: 628689 - DNA, 19 bp, Homo sapiens
gtccatccgtctctgtccg

SEQ ID NO: 628690 - DNA, 17 bp, Homo sapiens
gtccattcactttcagg

SEQ ID NO: 628691 - DNA, 15 bp, Homo sapiens
gtccattgacatgta

SEQ ID NO: 628692 - DNA, 17 bp, Homo sapiens
gtccattgacatgtaca

SEQ ID NO: 628693 - DNA, 12 bp, Homo sapiens
gtcccccctgag

SEQ ID NO: 628694 - DNA, 19 bp, Homo sapiens
gtcccccctgagtgggctg

SEQ ID NO: 628695 - DNA, 23 bp, Homo sapiens
gtcccgggtgccccccatgccct

SEQ ID NO: 628696 - DNA, 17 bp, Homo sapiens
gtccctgacttcccagc

SEQ ID NO: 628697 - DNA, 18 bp, Homo sapiens
gtccctgacttcccagct

SEQ ID NO: 628698 - DNA, 18 bp, Homo sapiens
gtccctgagggcccttcc

SEQ ID NO: 628699 - DNA, 20 bp, Homo sapiens
gtccctgagggcccttccca

SEQ ID NO: 628700 - DNA, 17 bp, Homo sapiens
gtccctgctcagcccat

SEQ ID NO: 628701 - DNA, 20 bp, Homo sapiens
gtccctgctcagcccatccc

SEQ ID NO: 628702 - DNA, 17 bp, Homo sapiens
gtccctggagctgtcct

SEQ ID NO: 628703 - DNA, 17 bp, Homo sapiens
gtccctgtgggctcaca

SEQ ID NO: 628704 - DNA, 22 bp, Homo sapiens
gtccctgtgggctcacaccggc

SEQ ID NO: 628705 - DNA, 17 bp, Homo sapiens
gtcccttcacatagttt

SEQ ID NO: 628706 - DNA, 15 bp, Homo sapiens
gtccctttccctgca

SEQ ID NO: 628707 - DNA, 15 bp, Homo sapiens
gtccgcacgcggccg

SEQ ID NO: 628708 - DNA, 16 bp, Homo sapiens
gtccgcgtcctttcct

SEQ ID NO: 628709 - DNA, 18 bp, Homo sapiens
gtccggcctgcagcccag

SEQ ID NO: 628710 - DNA, 14 bp, Homo sapiens
gtccgtctgtcctg

SEQ ID NO: 628711 - DNA, 18 bp, Homo sapiens
gtccgtctgtcctgcgcc

SEQ ID NO: 628712 - DNA, 15 bp, Homo sapiens
gtccgtgaaagttgt

SEQ ID NO: 628713 - DNA, 16 bp, Homo sapiens
gtcctagagaattcct

SEQ ID NO: 628714 - DNA, 14 bp, Homo sapiens
gtcctatccctgga

SEQ ID NO: 628715 - DNA, 17 bp, Homo sapiens
gtcctcattgttcagaa

SEQ ID NO: 628716 - DNA, 23 bp, Homo sapiens
gtcctcgccccccgcccggcctc

SEQ ID NO: 628717 - DNA, 21 bp, Homo sapiens
gtcctctcgtagaacctgcgc

SEQ ID NO: 628718 - DNA, 20 bp, Homo sapiens
gtcctctgtccgtctgtcct

SEQ ID NO: 628719 - DNA, 15 bp, Homo sapiens
gtcctgcatgtatgc

SEQ ID NO: 628720 - DNA, 18 bp, Homo sapiens
gtcctgctcgccctgtgc

SEQ ID NO: 628721 - DNA, 20 bp, Homo sapiens
gtcctgctgctcgggaaggc

SEQ ID NO: 628722 - DNA, 22 bp, Homo sapiens
gtcctgctgctcgggaaggcct

SEQ ID NO: 628723 - DNA, 21 bp, Homo sapiens
gtcctgtcctggctcccaggg

SEQ ID NO: 628724 - DNA, 12 bp, Homo sapiens
gtcctgtttctt

SEQ ID NO: 628725 - DNA, 21 bp, Homo sapiens
gtccttaaaaaatatgctctc

SEQ ID NO: 628726 - DNA, 13 bp, Homo sapiens
gtcctttatgtat

SEQ ID NO: 628727 - DNA, 17 bp, Homo sapiens
gtcctttatgtattctc

SEQ ID NO: 628728 - DNA, 22 bp, Homo sapiens
gtcctttcctctcctctctgga

SEQ ID NO: 628729 - DNA, 22 bp, Homo sapiens
gtcctttgagtgtcaggctctg

SEQ ID NO: 628730 - DNA, 11 bp, Homo sapiens
gtcgcccctcc

SEQ ID NO: 628731 - DNA, 20 bp, Homo sapiens
gtcgcccctcctcgggcgcc

SEQ ID NO: 628732 - DNA, 14 bp, Homo sapiens
gtcggggcccctgc

SEQ ID NO: 628733 - DNA, 12 bp, Homo sapiens
gtcgggggagga

SEQ ID NO: 628734 - DNA, 18 bp, Homo sapiens
gtcgggggaggagcaccc

SEQ ID NO: 628735 - DNA, 11 bp, Homo sapiens
gtctaaagatc

SEQ ID NO: 628736 - DNA, 17 bp, Homo sapiens
gtctacctgccttgcct

SEQ ID NO: 628737 - DNA, 22 bp, Homo sapiens
gtctataggacttaatttagca

SEQ ID NO: 628738 - DNA, 21 bp, Homo sapiens
gtctatgatgtccaaacttaa

SEQ ID NO: 628739 - DNA, 15 bp, Homo sapiens
gtctcaaaataaaac

SEQ ID NO: 628740 - DNA, 12 bp, Homo sapiens
gtctcagtgaag

SEQ ID NO: 628741 - DNA, 17 bp, Homo sapiens
gtctccacccctcaagc

SEQ ID NO: 628742 - DNA, 13 bp, Homo sapiens
gtctccagctgat

SEQ ID NO: 628743 - DNA, 18 bp, Homo sapiens
gtctccccatgctgggct

SEQ ID NO: 628744 - DNA, 19 bp, Homo sapiens
gtctccccatgctgggctc

SEQ ID NO: 628745 - DNA, 20 bp, Homo sapiens
gtctccctgggcaccctgca

SEQ ID NO: 628746 - DNA, 23 bp, Homo sapiens
gtctcctctgtcagtttgtgaag

SEQ ID NO: 628747 - DNA, 15 bp, Homo sapiens
gtctcctgtatcatt

SEQ ID NO: 628748 - DNA, 16 bp, Homo sapiens
gtctcgcagcctgaag

SEQ ID NO: 628749 - DNA, 20 bp, Homo sapiens
gtctcgcagcctgaagcctg

SEQ ID NO: 628750 - DNA, 14 bp, Homo sapiens
gtctctgagcagtg

SEQ ID NO: 628751 - DNA, 17 bp, Homo sapiens
gtctctgagcagtgggg

SEQ ID NO: 628752 - DNA, 17 bp, Homo sapiens
gtctctttctttccaaa

SEQ ID NO: 628753 - DNA, 23 bp, Homo sapiens
gtctgaaaaagtgtttttacata

SEQ ID NO: 628754 - DNA, 16 bp, Homo sapiens
gtctgaaggagaggag

SEQ ID NO: 628755 - DNA, 20 bp, Homo sapiens
gtctgagccctgccctcact

SEQ ID NO: 628756 - DNA, 24 bp, Homo sapiens
gtctgagccctgccctcactccac

SEQ ID NO: 628757 - DNA, 11 bp, Homo sapiens
gtctgcacaca

SEQ ID NO: 628758 - DNA, 9 bp, Homo sapiens
gtctgcccc

SEQ ID NO: 628759 - DNA, 16 bp, Homo sapiens
gtctgccccttgaccc

SEQ ID NO: 628760 - DNA, 17 bp, Homo sapiens
gtctgccccttgacccc

SEQ ID NO: 628761 - DNA, 21 bp, Homo sapiens
gtctgccccttgaccccacac

SEQ ID NO: 628762 - DNA, 16 bp, Homo sapiens
gtctgctgctgcctcc

SEQ ID NO: 628763 - DNA, 24 bp, Homo sapiens
gtctggagcccctatcctgcaccc

SEQ ID NO: 628764 - DNA, 22 bp, Homo sapiens
gtctggattcccgtggctttgt

SEQ ID NO: 628765 - DNA, 22 bp, Homo sapiens
gtctggcgccaggggcaggcag

SEQ ID NO: 628766 - DNA, 23 bp, Homo sapiens
gtctggcgccaggggcaggcagc

SEQ ID NO: 628767 - DNA, 15 bp, Homo sapiens
gtctggctgtggccc

SEQ ID NO: 628768 - DNA, 19 bp, Homo sapiens
gtctgtccctaaacatagt

SEQ ID NO: 628769 - DNA, 12 bp, Homo sapiens
gtctgtcctgcg

SEQ ID NO: 628770 - DNA, 15 bp, Homo sapiens
gtctgtcctgcgcct

SEQ ID NO: 628771 - DNA, 11 bp, Homo sapiens
gtctgtctctc

SEQ ID NO: 628772 - DNA, 15 bp, Homo sapiens
gtctgtgagtctgtc

SEQ ID NO: 628773 - DNA, 17 bp, Homo sapiens
gtctgtgagtctgtcct

SEQ ID NO: 628774 - DNA, 16 bp, Homo sapiens
gtctgtgataacagag

SEQ ID NO: 628775 - DNA, 20 bp, Homo sapiens
gtctgtgatgtcagtagtgc

SEQ ID NO: 628776 - DNA, 22 bp, Homo sapiens
gtctgttgaagtgcatgttaaa

SEQ ID NO: 628777 - DNA, 18 bp, Homo sapiens
gtcttaactaatgtaaat

SEQ ID NO: 628778 - DNA, 19 bp, Homo sapiens
gtcttgagaccagcctgcc

SEQ ID NO: 628779 - DNA, 20 bp, Homo sapiens
gtcttgagaccagcctgcca

SEQ ID NO: 628780 - DNA, 21 bp, Homo sapiens
gtcttgagaccagcctgccag

SEQ ID NO: 628781 - DNA, 22 bp, Homo sapiens
gtcttgagaccagcctgccagg

SEQ ID NO: 628782 - DNA, 15 bp, Homo sapiens
gtctttatgatttca

SEQ ID NO: 628783 - DNA, 16 bp, Homo sapiens
gtctttggttcctcat

SEQ ID NO: 628784 - DNA, 19 bp, Homo sapiens
gtctttggttcctcatggc

SEQ ID NO: 628785 - DNA, 23 bp, Homo sapiens
gtctttggttcctcatggctgtt

SEQ ID NO: 628786 - DNA, 12 bp, Homo sapiens
gtcttttgcatg

SEQ ID NO: 628787 - DNA, 13 bp, Homo sapiens
gtcttttgcatga

SEQ ID NO: 628788 - DNA, 17 bp, Homo sapiens
gtggtcttggagaggag

SEQ ID NO: 628789 - DNA, 17 bp, Homo sapiens
gtggtgcgggccaggtc

SEQ ID NO: 628790 - DNA, 22 bp, Homo sapiens
gtggtggcagtgcagcaaccag

SEQ ID NO: 628791 - DNA, 16 bp, Homo sapiens
gtggtgtcctctgtcc

SEQ ID NO: 628792 - DNA, 16 bp, Homo sapiens
gtggttctgccactta

SEQ ID NO: 628793 - DNA, 15 bp, Homo sapiens
gtggttggaggcctg

SEQ ID NO: 628794 - DNA, 13 bp, Homo sapiens
gtggttgtttttt

SEQ ID NO: 628795 - DNA, 15 bp, Homo sapiens
gtgtagctctgtcca

SEQ ID NO: 628796 - DNA, 21 bp, Homo sapiens
gtttaacagaaaaatgaaatt

SEQ ID NO: 628797 - DNA, 18 bp, Homo sapiens
gtttaataatatgtacaa

SEQ ID NO: 628798 - DNA, 20 bp, Homo sapiens
gtttacattgtcctgtagct

SEQ ID NO: 628799 - DNA, 17 bp, Homo sapiens
gtttaccctccctgtcc

SEQ ID NO: 628800 - DNA, 22 bp, Homo sapiens
gtttactgacatggtgctgtgt

SEQ ID NO: 628801 - DNA, 13 bp, Homo sapiens
gtttcacatctgt

SEQ ID NO: 628802 - DNA, 15 bp, Homo sapiens
gtttcactgttcatg

SEQ ID NO: 628803 - DNA, 21 bp, Homo sapiens
gtttcagaaagggcagcccct

SEQ ID NO: 628804 - DNA, 23 bp, Homo sapiens
gtttcagaaagggcagcccctcc

SEQ ID NO: 628805 - DNA, 13 bp, Homo sapiens
gtttcattttcat

SEQ ID NO: 628806 - DNA, 18 bp, Homo sapiens
gtttccatcaaagccctc

SEQ ID NO: 628807 - DNA, 12 bp, Homo sapiens
gtttccatttgg

SEQ ID NO: 628808 - DNA, 13 bp, Homo sapiens
gtttccatttgga

SEQ ID NO: 628809 - DNA, 12 bp, Homo sapiens
taacagtaaata

SEQ ID NO: 628810 - DNA, 16 bp, Homo sapiens
taacagtaaatataca

SEQ ID NO: 628811 - DNA, 14 bp, Homo sapiens
taacagtatttcca

SEQ ID NO: 628812 - DNA, 19 bp, Homo sapiens
taacatagtgtctgctgct

SEQ ID NO: 628813 - DNA, 20 bp, Homo sapiens
taacatgaaagtcaagtcta

SEQ ID NO: 628814 - DNA, 18 bp, Homo sapiens
taacattatattcccaaa

SEQ ID NO: 628815 - DNA, 15 bp, Homo sapiens
taacattcttggtca

SEQ ID NO: 628816 - DNA, 12 bp, Homo sapiens
taacattgtaaa

SEQ ID NO: 628817 - DNA, 19 bp, Homo sapiens
taacccagtgttcagcata

SEQ ID NO: 628818 - DNA, 19 bp, Homo sapiens
taaccctgaatcagaggca

SEQ ID NO: 628819 - DNA, 19 bp, Homo sapiens
taacctgggttgttgcaga

SEQ ID NO: 628820 - DNA, 18 bp, Homo sapiens
taacgaccgacgcccctc

SEQ ID NO: 628821 - DNA, 13 bp, Homo sapiens
taactaatgtaaa

SEQ ID NO: 628822 - DNA, 23 bp, Homo sapiens
taactccttgtgagctgcttctc

SEQ ID NO: 628823 - DNA, 11 bp, Homo sapiens
taactggcccc

SEQ ID NO: 628824 - DNA, 14 bp, Homo sapiens
taactggccccagg

SEQ ID NO: 628825 - DNA, 15 bp, Homo sapiens
taactgttaacccag

SEQ ID NO: 628826 - DNA, 21 bp, Homo sapiens
taactgttaacccagtgttca

SEQ ID NO: 628827 - DNA, 15 bp, Homo sapiens
taacttaatcaatta

SEQ ID NO: 628828 - DNA, 16 bp, Homo sapiens
taacttactatttaga

SEQ ID NO: 628829 - DNA, 18 bp, Homo sapiens
taacttatctccagccaa

SEQ ID NO: 628830 - DNA, 13 bp, Homo sapiens
taacttattttga

SEQ ID NO: 628831 - DNA, 14 bp, Homo sapiens
taacttattttgat

SEQ ID NO: 628832 - DNA, 19 bp, Homo sapiens
taacttcagatgtttccaa

SEQ ID NO: 628833 - DNA, 20 bp, Homo sapiens
taacttcagatgtttccaag

SEQ ID NO: 628834 - DNA, 18 bp, Homo sapiens
taacttgctgtgaaatga

SEQ ID NO: 628835 - DNA, 17 bp, Homo sapiens
taagaaacagtttaaca

SEQ ID NO: 628836 - DNA, 15 bp, Homo sapiens
taagaaatgagaaat

SEQ ID NO: 628837 - DNA, 22 bp, Homo sapiens
taagaaatgagaaattgtgcca

SEQ ID NO: 628838 - DNA, 18 bp, Homo sapiens
taagaaatggctttccac

SEQ ID NO: 628839 - DNA, 20 bp, Homo sapiens
taagaaatggctttccacat

SEQ ID NO: 628840 - DNA, 14 bp, Homo sapiens
taagaagcaaataa

SEQ ID NO: 628841 - DNA, 10 bp, Homo sapiens
taagaattca

SEQ ID NO: 628842 - DNA, 12 bp, Homo sapiens
taagaattcagt

SEQ ID NO: 628843 - DNA, 12 bp, Homo sapiens
taagagccacaa

SEQ ID NO: 628844 - DNA, 17 bp, Homo sapiens
taagataattaaatgaa

SEQ ID NO: 628845 - DNA, 14 bp, Homo sapiens
taagatctgactgc

SEQ ID NO: 628846 - DNA, 22 bp, Homo sapiens
taagatgggcatagggtttgga

SEQ ID NO: 628847 - DNA, 21 bp, Homo sapiens
taagcaacgggaacacctgct

SEQ ID NO: 628848 - DNA, 16 bp, Homo sapiens
taagcacaaaaaattt

SEQ ID NO: 628849 - DNA, 20 bp, Homo sapiens
taagcacaaccatgttcttg

SEQ ID NO: 628850 - DNA, 21 bp, Homo sapiens
taagcacaaccatgttcttga

SEQ ID NO: 628851 - DNA, 21 bp, Homo sapiens
taagcacacacatctggccct

SEQ ID NO: 628852 - DNA, 19 bp, Homo sapiens
taagccaatttttctgcac

SEQ ID NO: 628853 - DNA, 17 bp, Homo sapiens
taagccactggtatctg

SEQ ID NO: 628854 - DNA, 18 bp, Homo sapiens
taagccatagccccaggc

SEQ ID NO: 628855 - DNA, 14 bp, Homo sapiens
taaggaaaagagaa

SEQ ID NO: 628856 - DNA, 15 bp, Homo sapiens
taaggacagtgttca

SEQ ID NO: 628857 - DNA, 19 bp, Homo sapiens
taaggacagtgttcaaatt

SEQ ID NO: 628858 - DNA, 23 bp, Homo sapiens
taaggacagtgttcaaattctga

SEQ ID NO: 628859 - DNA, 20 bp, Homo sapiens
taagggactccagaagcagc

SEQ ID NO: 628860 - DNA, 22 bp, Homo sapiens
taaggggaattaacaattgcca

SEQ ID NO: 628861 - DNA, 19 bp, Homo sapiens
taaggtcagtgttataaaa

SEQ ID NO: 628862 - DNA, 14 bp, Homo sapiens
taagtaaatgtctt

SEQ ID NO: 628863 - DNA, 19 bp, Homo sapiens
taagtaaatgtcttcatgt

SEQ ID NO: 628864 - DNA, 11 bp, Homo sapiens
taagtcttact

SEQ ID NO: 628865 - DNA, 16 bp, Homo sapiens
taagtcttactgtttt

SEQ ID NO: 628866 - DNA, 15 bp, Homo sapiens
taagtgctcagtatt

SEQ ID NO: 628867 - DNA, 21 bp, Homo sapiens
taagtgttctgtggctgattt

SEQ ID NO: 628868 - DNA, 18 bp, Homo sapiens
taagttataccagcaaaa

SEQ ID NO: 628869 - DNA, 19 bp, Homo sapiens
taagttataccagcaaaag

SEQ ID NO: 628870 - DNA, 16 bp, Homo sapiens
taagttctgtgcagtt

SEQ ID NO: 628871 - DNA, 22 bp, Homo sapiens
taagttctgtgcagtttggtat

SEQ ID NO: 628872 - DNA, 15 bp, Homo sapiens
taagttgaatgataa

SEQ ID NO: 628873 - DNA, 24 bp, Homo sapiens
taagttgtattttaataaagattc

SEQ ID NO: 628874 - DNA, 19 bp, Homo sapiens
taataacagaaatacatca

SEQ ID NO: 628875 - DNA, 19 bp, Homo sapiens
taataatatgtacaaataa

SEQ ID NO: 628876 - DNA, 14 bp, Homo sapiens
taatacttcataca

SEQ ID NO: 628877 - DNA, 23 bp, Homo sapiens
taatagctcacagcacatttgtt

SEQ ID NO: 628878 - DNA, 13 bp, Homo sapiens
taatataaatgaa

SEQ ID NO: 628879 - DNA, 16 bp, Homo sapiens
taatataaatgaatga

SEQ ID NO: 628880 - DNA, 15 bp, Homo sapiens
taatataagacaagt

SEQ ID NO: 628881 - DNA, 18 bp, Homo sapiens
taatatacagtgtgtagt

SEQ ID NO: 628882 - DNA, 20 bp, Homo sapiens
taatatacagtgtgtagttt

SEQ ID NO: 628883 - DNA, 15 bp, Homo sapiens
taatatactccttaa

SEQ ID NO: 628884 - DNA, 12 bp, Homo sapiens
taatatcagtta

SEQ ID NO: 628885 - DNA, 22 bp, Homo sapiens
taatatcagttacagtggcagt

SEQ ID NO: 628886 - DNA, 19 bp, Homo sapiens
taatatgcatatatatgta

SEQ ID NO: 628887 - DNA, 18 bp, Homo sapiens
taatatgtacaaataata

SEQ ID NO: 628888 - DNA, 13 bp, Homo sapiens
taatattgccttg

SEQ ID NO: 628889 - DNA, 22 bp, Homo sapiens
taatattgccttgatgtttcta

SEQ ID NO: 628890 - DNA, 13 bp, Homo sapiens
taatatttataga

SEQ ID NO: 628891 - DNA, 23 bp, Homo sapiens
taatcaattaatttttttattgt

SEQ ID NO: 628892 - DNA, 20 bp, Homo sapiens
taatcatccttttttaaaaa

SEQ ID NO: 628893 - DNA, 15 bp, Homo sapiens
taatcatttccagca

SEQ ID NO: 628894 - DNA, 16 bp, Homo sapiens
taatccatgtgctgct

SEQ ID NO: 628895 - DNA, 21 bp, Homo sapiens
taatctagagctatgcacacc

SEQ ID NO: 628896 - DNA, 23 bp, Homo sapiens
taatctagagctatgcacaccaa

SEQ ID NO: 628897 - DNA, 19 bp, Homo sapiens
taatctttgaaaactcata

SEQ ID NO: 628898 - DNA, 21 bp, Homo sapiens
taatctttgaaaactcataca

SEQ ID NO: 628899 - DNA, 18 bp, Homo sapiens
taatgaaaaatctgaatt

SEQ ID NO: 628900 - DNA, 16 bp, Homo sapiens
taatgacaagtgactt

SEQ ID NO: 628901 - DNA, 17 bp, Homo sapiens
taatgagatgtaataca

SEQ ID NO: 628902 - DNA, 20 bp, Homo sapiens
taatgagatgttattactgt

SEQ ID NO: 628903 - DNA, 22 bp, Homo sapiens
taatgagatgttattactgttt

SEQ ID NO: 628904 - DNA, 17 bp, Homo sapiens
taatgattcttgtgtca

SEQ ID NO: 628905 - DNA, 16 bp, Homo sapiens
tcaaaaattgaagaga

SEQ ID NO: 628906 - DNA, 18 bp, Homo sapiens
tcaaaaattgaagagaga

SEQ ID NO: 628907 - DNA, 17 bp, Homo sapiens
tcaaaataaaaccagaa

SEQ ID NO: 628908 - DNA, 19 bp, Homo sapiens
tcaaacactgcttaaggaa

SEQ ID NO: 628909 - DNA, 22 bp, Homo sapiens
tcaaacagggacactacaaaca

SEQ ID NO: 628910 - DNA, 23 bp, Homo sapiens
tcaaacagggacactacaaacat

SEQ ID NO: 628911 - DNA, 15 bp, Homo sapiens
tcaaacgaaatggct

SEQ ID NO: 628912 - DNA, 18 bp, Homo sapiens
tcaaagaacccccctccc

SEQ ID NO: 628913 - DNA, 20 bp, Homo sapiens
tcaaagacttcatttaacac

SEQ ID NO: 628914 - DNA, 20 bp, Homo sapiens
tcaaagccctccctgtctgt

SEQ ID NO: 628915 - DNA, 21 bp, Homo sapiens
tcaaataaccctgaatcagag

SEQ ID NO: 628916 - DNA, 20 bp, Homo sapiens
tcaaatggtattttttgtga

SEQ ID NO: 628917 - DNA, 13 bp, Homo sapiens
tcaaattctgatt

SEQ ID NO: 628918 - DNA, 17 bp, Homo sapiens
tcaaattctgattatta

SEQ ID NO: 628919 - DNA, 23 bp, Homo sapiens
tcaaatttttaagtaatttcatg

SEQ ID NO: 628920 - DNA, 16 bp, Homo sapiens
tcaacaaagaaatatt

SEQ ID NO: 628921 - DNA, 21 bp, Homo sapiens
tcaacaaagaaatattatttg

SEQ ID NO: 628922 - DNA, 20 bp, Homo sapiens
tcaagaaagcagtatatatt

SEQ ID NO: 628923 - DNA, 18 bp, Homo sapiens
tcaagaagatagttgtaa

SEQ ID NO: 628924 - DNA, 23 bp, Homo sapiens
tcaagaagatagttgtaaagata

SEQ ID NO: 628925 - DNA, 17 bp, Homo sapiens
tcaagcaccctgttccc

SEQ ID NO: 628926 - DNA, 19 bp, Homo sapiens
tcaagcaccctgttccctc

SEQ ID NO: 628927 - DNA, 13 bp, Homo sapiens
tcaagccaggaga

SEQ ID NO: 628928 - DNA, 18 bp, Homo sapiens
tcaagctccatcttattt

SEQ ID NO: 628929 - DNA, 15 bp, Homo sapiens
tcaaggaatagagtt

SEQ ID NO: 628930 - DNA, 23 bp, Homo sapiens
tcaaggatcctgagccagatttc

SEQ ID NO: 628931 - DNA, 16 bp, Homo sapiens
tcaaggcccggcccca

SEQ ID NO: 628932 - DNA, 22 bp, Homo sapiens
tcaagtgttacctaacaatgtt

SEQ ID NO: 628933 - DNA, 16 bp, Homo sapiens
tcaagttgtgtgctat

SEQ ID NO: 628934 - DNA, 14 bp, Homo sapiens
tcaataggaaaaac

SEQ ID NO: 628935 - DNA, 21 bp, Homo sapiens
tcaatatttgtggtttaactt

SEQ ID NO: 628936 - DNA, 15 bp, Homo sapiens
tcaatcactgaaaat

SEQ ID NO: 628937 - DNA, 16 bp, Homo sapiens
tcaatccacagtattg

SEQ ID NO: 628938 - DNA, 17 bp, Homo sapiens
tcaatccacagtattgt

SEQ ID NO: 628939 - DNA, 12 bp, Homo sapiens
tcaatgtactgt

SEQ ID NO: 628940 - DNA, 21 bp, Homo sapiens
tcaatgtactgtattgggacg

SEQ ID NO: 628941 - DNA, 13 bp, Homo sapiens
tcaatgtgaaata

SEQ ID NO: 628942 - DNA, 21 bp, Homo sapiens
tcaatgtgaaataaagagttc

SEQ ID NO: 628943 - DNA, 20 bp, Homo sapiens
tcaatgttcacgcaacttga

SEQ ID NO: 628944 - DNA, 18 bp, Homo sapiens
tcaattcatatttatgaa

SEQ ID NO: 628945 - DNA, 16 bp, Homo sapiens
tcatccagccactgcc

SEQ ID NO: 628946 - DNA, 15 bp, Homo sapiens
tcatctcagcaatca

SEQ ID NO: 628947 - DNA, 11 bp, Homo sapiens
tcatctgtcag

SEQ ID NO: 628948 - DNA, 12 bp, Homo sapiens
tcatctgtcagc

SEQ ID NO: 628949 - DNA, 13 bp, Homo sapiens
tcatcttgtaaat

SEQ ID NO: 628950 - DNA, 18 bp, Homo sapiens
tcatgaccctcctgtcca

SEQ ID NO: 628951 - DNA, 17 bp, Homo sapiens
tcatgatgctagttctt

SEQ ID NO: 628952 - DNA, 21 bp, Homo sapiens
tcatgcctttatttctgtatc

SEQ ID NO: 628953 - DNA, 14 bp, Homo sapiens
tcatgctgtctgtg

SEQ ID NO: 628954 - DNA, 13 bp, Homo sapiens
tcatggctgtccc

SEQ ID NO: 628955 - DNA, 18 bp, Homo sapiens
tcatggctgtcccctgca

SEQ ID NO: 628956 - DNA, 20 bp, Homo sapiens
tcatggctgttatctgtctt

SEQ ID NO: 628957 - DNA, 15 bp, Homo sapiens
tcatgtaatcacata

SEQ ID NO: 628958 - DNA, 15 bp, Homo sapiens
tcatgtatacttcaa

SEQ ID NO: 628959 - DNA, 17 bp, Homo sapiens
tcatgtgcgaacacagt

SEQ ID NO: 628960 - DNA, 18 bp, Homo sapiens
tcatgttaattgatagaa

SEQ ID NO: 628961 - DNA, 18 bp, Homo sapiens
tcatgttggtaccctgga

SEQ ID NO: 628962 - DNA, 13 bp, Homo sapiens
tcatgtttaagaa

SEQ ID NO: 628963 - DNA, 23 bp, Homo sapiens
tcatgtttaagaaatgagaaatt

SEQ ID NO: 628964 - DNA, 23 bp, Homo sapiens
tcattaaactaattaaactgatg

SEQ ID NO: 628965 - DNA, 18 bp, Homo sapiens
tcattagacaaatgtctt

SEQ ID NO: 628966 - DNA, 18 bp, Homo sapiens
tcattagctgtgattttt

SEQ ID NO: 628967 - DNA, 13 bp, Homo sapiens
tcattatttcaag

SEQ ID NO: 628968 - DNA, 22 bp, Homo sapiens
tcattcagaatgtgcaaagcag

SEQ ID NO: 628969 - DNA, 19 bp, Homo sapiens
tcattcaggtgttctcttc

SEQ ID NO: 628970 - DNA, 14 bp, Homo sapiens
tcattccgttagga

SEQ ID NO: 628971 - DNA, 15 bp, Homo sapiens
tcattccgttaggaa

SEQ ID NO: 628972 - DNA, 21 bp, Homo sapiens
tcattctgctaatttatgaag

SEQ ID NO: 628973 - DNA, 21 bp, Homo sapiens
tcattctggtccttagtaaat

SEQ ID NO: 628974 - DNA, 23 bp, Homo sapiens
tcattcttataacattgtatgtt

SEQ ID NO: 628975 - DNA, 12 bp, Homo sapiens
tcattgaaatct

SEQ ID NO: 628976 - DNA, 22 bp, Homo sapiens
tcattgaaatctttttgctttg

SEQ ID NO: 628977 - DNA, 15 bp, Homo sapiens
tcattgcactgcagt

SEQ ID NO: 628978 - DNA, 16 bp, Homo sapiens
tcattggttacaaatt

SEQ ID NO: 628979 - DNA, 15 bp, Homo sapiens
tcattgttaaagtaa

SEQ ID NO: 628980 - DNA, 19 bp, Homo sapiens
tcatttacaacttccagat

SEQ ID NO: 628981 - DNA, 20 bp, Homo sapiens
tcatttcatacaaattttcc

SEQ ID NO: 628982 - DNA, 12 bp, Homo sapiens
tcatttccagca

SEQ ID NO: 628983 - DNA, 15 bp, Homo sapiens
tcatttccagcaaaa

SEQ ID NO: 628984 - DNA, 20 bp, Homo sapiens
tcatttccagcaaaatatat

SEQ ID NO: 628985 - DNA, 18 bp, Homo sapiens
tcatttggatataaatct

SEQ ID NO: 628986 - DNA, 18 bp, Homo sapiens
tcattttcagatccttcc

SEQ ID NO: 628987 - DNA, 14 bp, Homo sapiens
tcattttcattatt

SEQ ID NO: 628988 - DNA, 13 bp, Homo sapiens
tcattttctctcc

SEQ ID NO: 628989 - DNA, 16 bp, Homo sapiens
tcattttctctcctcg

SEQ ID NO: 628990 - DNA, 13 bp, Homo sapiens
tcattttttgtct

SEQ ID NO: 628991 - DNA, 14 bp, Homo sapiens
tcattttttgtcta

SEQ ID NO: 628992 - DNA, 18 bp, Homo sapiens
tccaaacttaacagatca

SEQ ID NO: 628993 - DNA, 17 bp, Homo sapiens
tccaaatacattccagt

SEQ ID NO: 628994 - DNA, 18 bp, Homo sapiens
tccaacccaggtctgctt

SEQ ID NO: 628995 - DNA, 14 bp, Homo sapiens
tccaagatgtccca

SEQ ID NO: 628996 - DNA, 14 bp, Homo sapiens
tccaagtgtgtgtg

SEQ ID NO: 628997 - DNA, 18 bp, Homo sapiens
tccaagtgtgtgtgcaat

SEQ ID NO: 628998 - DNA, 21 bp, Homo sapiens
tccaagttatttgatctggtg

SEQ ID NO: 628999 - DNA, 13 bp, Homo sapiens
tccaatccagcct

SEQ ID NO: 629000 - DNA, 21 bp, Homo sapiens
tccaatgccaattcatctcag

SEQ ID NO: 629001 - DNA, 17 bp, Homo sapiens
tccacaacctcctcctc

SEQ ID NO: 629002 - DNA, 16 bp, Homo sapiens
tccacacctccacccg

SEQ ID NO: 629003 - DNA, 12 bp, Homo sapiens
tccacaggagcc

SEQ ID NO: 629004 - DNA, 23 bp, Homo sapiens
tccacagggacacagtctggtgc

SEQ ID NO: 629005 - DNA, 13 bp, Homo sapiens
tccacagtattgt

SEQ ID NO: 629006 - DNA, 16 bp, Homo sapiens
tccacagtattgttct

SEQ ID NO: 629007 - DNA, 17 bp, Homo sapiens
tccacatccccaccctc

SEQ ID NO: 629008 - DNA, 21 bp, Homo sapiens
tccacatccccaccctcccct

SEQ ID NO: 629009 - DNA, 18 bp, Homo sapiens
tccacccccattgtgaat

SEQ ID NO: 629010 - DNA, 18 bp, Homo sapiens
tccaccttcctgcccagg

SEQ ID NO: 629011 - DNA, 22 bp, Homo sapiens
tccacgtgtttcgggccagggc

SEQ ID NO: 629012 - DNA, 17 bp, Homo sapiens
tccactaggtgcccagt

SEQ ID NO: 629013 - DNA, 16 bp, Homo sapiens
tccactcccctcatcc

SEQ ID NO: 629014 - DNA, 19 bp, Homo sapiens
tccactcccctcatccact

SEQ ID NO: 629015 - DNA, 9 bp, Homo sapiens
tccactcct

SEQ ID NO: 629016 - DNA, 12 bp, Homo sapiens
tccactcctccc

SEQ ID NO: 629017 - DNA, 23 bp, Homo sapiens
tccactcctcccaactctggcct

SEQ ID NO: 629018 - DNA, 14 bp, Homo sapiens
tccactttcctctc

SEQ ID NO: 629019 - DNA, 15 bp, Homo sapiens
tccactttcctctct

SEQ ID NO: 629020 - DNA, 16 bp, Homo sapiens
tccactttcctctctc

SEQ ID NO: 629021 - DNA, 18 bp, Homo sapiens
tccactttcctctctctc

SEQ ID NO: 629022 - DNA, 12 bp, Homo sapiens
tccagaagcagc

SEQ ID NO: 629023 - DNA, 23 bp, Homo sapiens
tccagacagagtggatctggagt

SEQ ID NO: 629024 - DNA, 16 bp, Homo sapiens
tccagacagggtgggg

SEQ ID NO: 629025 - DNA, 11 bp, Homo sapiens
tccagacccct

SEQ ID NO: 629026 - DNA, 22 bp, Homo sapiens
tccagactcgagagggctgagc

SEQ ID NO: 629027 - DNA, 22 bp, Homo sapiens
tccagagagaagcaccccacca

SEQ ID NO: 629028 - DNA, 11 bp, Homo sapiens
tccagcaaaat

SEQ ID NO: 629029 - DNA, 18 bp, Homo sapiens
tccagcccatgctggctg

SEQ ID NO: 629030 - DNA, 22 bp, Homo sapiens
tccagcccatgctggctggggc

SEQ ID NO: 629031 - DNA, 22 bp, Homo sapiens
tccagctaagcctgatgatgga

SEQ ID NO: 629032 - DNA, 16 bp, Homo sapiens
tccaggagatgaggct

SEQ ID NO: 629033 - DNA, 15 bp, Homo sapiens
tccaggtcacaggca

SEQ ID NO: 629034 - DNA, 19 bp, Homo sapiens
tccagtgtattttctgtgt

SEQ ID NO: 629035 - DNA, 22 bp, Homo sapiens
tccatacgtgcccatttcacac

SEQ ID NO: 629036 - DNA, 23 bp, Homo sapiens
tccatacgtgcccatttcacaca

SEQ ID NO: 629037 - DNA, 16 bp, Homo sapiens
tccatactgtttaata

SEQ ID NO: 629038 - DNA, 14 bp, Homo sapiens
tccatatcagctct

SEQ ID NO: 629039 - DNA, 20 bp, Homo sapiens
tccatatcagctctgcataa

SEQ ID NO: 629040 - DNA, 17 bp, Homo sapiens
tccatcaggacttggga

SEQ ID NO: 629041 - DNA, 19 bp, Homo sapiens
tccatcttgtggggccagg

SEQ ID NO: 629042 - DNA, 19 bp, Homo sapiens
tccatgacagtagcatact

SEQ ID NO: 629043 - DNA, 14 bp, Homo sapiens
tccatgccccagct

SEQ ID NO: 629044 - DNA, 18 bp, Homo sapiens
tccatgccccagctctgg

SEQ ID NO: 629045 - DNA, 19 bp, Homo sapiens
tccatgccccagctctgga

SEQ ID NO: 629046 - DNA, 15 bp, Homo sapiens
tccatgctgtccctg

SEQ ID NO: 629047 - DNA, 16 bp, Homo sapiens
tccatgtgataattgt

SEQ ID NO: 629048 - DNA, 12 bp, Homo sapiens
tccattcctgag

SEQ ID NO: 629049 - DNA, 21 bp, Homo sapiens
tccattctatgactcttgtct

SEQ ID NO: 629050 - DNA, 14 bp, Homo sapiens
tccattgacatgta

SEQ ID NO: 629051 - DNA, 20 bp, Homo sapiens
tccattgacatgtacagaga

SEQ ID NO: 629052 - DNA, 17 bp, Homo sapiens
tccatttatttaaaact

SEQ ID NO: 629053 - DNA, 18 bp, Homo sapiens
tccatttatttaaaacta

SEQ ID NO: 629054 - DNA, 11 bp, Homo sapiens
tccatttggat

SEQ ID NO: 629055 - DNA, 15 bp, Homo sapiens
tccatttggatttta

SEQ ID NO: 629056 - DNA, 19 bp, Homo sapiens
tccatttggattttaaaca

SEQ ID NO: 629057 - DNA, 20 bp, Homo sapiens
tccatttggattttaaacaa

SEQ ID NO: 629058 - DNA, 21 bp, Homo sapiens
tccatttggattttaaacaaa

SEQ ID NO: 629059 - DNA, 16 bp, Homo sapiens
tccatttttgagtaaa

SEQ ID NO: 629060 - DNA, 17 bp, Homo sapiens
tcccaaataaactcctt

SEQ ID NO: 629061 - DNA, 19 bp, Homo sapiens
tcccaacaatactttgtgt

SEQ ID NO: 629062 - DNA, 22 bp, Homo sapiens
tcccaacaatactttgtgtctt

SEQ ID NO: 629063 - DNA, 14 bp, Homo sapiens
tcccaactctggcc

SEQ ID NO: 629064 - DNA, 14 bp, Homo sapiens
tccgtctgtcctgc

SEQ ID NO: 629065 - DNA, 15 bp, Homo sapiens
tccgtctgtcctgcg

SEQ ID NO: 629066 - DNA, 13 bp, Homo sapiens
tccgtgaaagttg

SEQ ID NO: 629067 - DNA, 20 bp, Homo sapiens
tcctaattctatgattaaac

SEQ ID NO: 629068 - DNA, 15 bp, Homo sapiens
tcctacttaaacaaa

SEQ ID NO: 629069 - DNA, 21 bp, Homo sapiens
tcctatgagagaagagagtat

SEQ ID NO: 629070 - DNA, 15 bp, Homo sapiens
tcctattaatttatt

SEQ ID NO: 629071 - DNA, 18 bp, Homo sapiens
tcctcacagcctctccct

SEQ ID NO: 629072 - DNA, 19 bp, Homo sapiens
tcctcacagcctctccctt

SEQ ID NO: 629073 - DNA, 23 bp, Homo sapiens
tcctcatggctgttatctgtctt

SEQ ID NO: 629074 - DNA, 16 bp, Homo sapiens
tcctccattgtatctt

SEQ ID NO: 629075 - DNA, 17 bp, Homo sapiens
tcctcccaactctggcc

SEQ ID NO: 629076 - DNA, 18 bp, Homo sapiens
tcctcccaactctggcct

SEQ ID NO: 629077 - DNA, 20 bp, Homo sapiens
tcctcccccaccttcaagca

SEQ ID NO: 629078 - DNA, 15 bp, Homo sapiens
tcctccccctcctcc

SEQ ID NO: 629079 - DNA, 18 bp, Homo sapiens
tcctccccctcctccatg

SEQ ID NO: 629080 - DNA, 15 bp, Homo sapiens
tcctcccctggaagt

SEQ ID NO: 629081 - DNA, 13 bp, Homo sapiens
tcctccgtgggca

SEQ ID NO: 629082 - DNA, 14 bp, Homo sapiens
tcctccgtgggcag

SEQ ID NO: 629083 - DNA, 18 bp, Homo sapiens
tcctccgtgggcagctcc

SEQ ID NO: 629084 - DNA, 21 bp, Homo sapiens
tcctccgtgggcagctcctcg

SEQ ID NO: 629085 - DNA, 21 bp, Homo sapiens
tcctcctgcatgtcggggccc

SEQ ID NO: 629086 - DNA, 13 bp, Homo sapiens
tcctcctgctcct

SEQ ID NO: 629087 - DNA, 16 bp, Homo sapiens
tcctcctgctcctcac

SEQ ID NO: 629088 - DNA, 16 bp, Homo sapiens
tcctcctgtctcctct

SEQ ID NO: 629089 - DNA, 17 bp, Homo sapiens
tcctcgccccccgcccg

SEQ ID NO: 629090 - DNA, 16 bp, Homo sapiens
tcctcgtccggcctgc

SEQ ID NO: 629091 - DNA, 22 bp, Homo sapiens
tcctcgtccggcctgcagccca

SEQ ID NO: 629092 - DNA, 23 bp, Homo sapiens
tcctcgtccggcctgcagcccag

SEQ ID NO: 629093 - DNA, 15 bp, Homo sapiens
tcctctctctccctc

SEQ ID NO: 629094 - DNA, 18 bp, Homo sapiens
tcctctctctccctccac

SEQ ID NO: 629095 - DNA, 12 bp, Homo sapiens
tcctctgccccc

SEQ ID NO: 629096 - DNA, 22 bp, Homo sapiens
tcctctgccccctcccccgcag

SEQ ID NO: 629097 - DNA, 19 bp, Homo sapiens
tcctctgcccgcgggtggc

SEQ ID NO: 629098 - DNA, 16 bp, Homo sapiens
tcctctgcttgtcatt

SEQ ID NO: 629099 - DNA, 17 bp, Homo sapiens
tcctctgcttgtcattc

SEQ ID NO: 629100 - DNA, 22 bp, Homo sapiens
tcctctgtcagtttgtgaagtg

SEQ ID NO: 629101 - DNA, 23 bp, Homo sapiens
tcctctgtccgtctgtcctgcgc

SEQ ID NO: 629102 - DNA, 18 bp, Homo sapiens
tcctcttaatgtctcaaa

SEQ ID NO: 629103 - DNA, 21 bp, Homo sapiens
tcctcttggtgtcaaattttt

SEQ ID NO: 629104 - DNA, 14 bp, Homo sapiens
tcctgaccctcact

SEQ ID NO: 629105 - DNA, 14 bp, Homo sapiens
tcctgagccagatt

SEQ ID NO: 629106 - DNA, 16 bp, Homo sapiens
tcctgagcctgtctct

SEQ ID NO: 629107 - DNA, 15 bp, Homo sapiens
tcctgcaatgggaga

SEQ ID NO: 629108 - DNA, 17 bp, Homo sapiens
tcctgcccccccacccc

SEQ ID NO: 629109 - DNA, 17 bp, Homo sapiens
tcctgcgcctgcgcctc

SEQ ID NO: 629110 - DNA, 20 bp, Homo sapiens
tcctgcgcctgcgcctcctc

SEQ ID NO: 629111 - DNA, 13 bp, Homo sapiens
tcctgctcctcac

SEQ ID NO: 629112 - DNA, 17 bp, Homo sapiens
tcctgctcgccctgtgc

SEQ ID NO: 629113 - DNA, 22 bp, Homo sapiens
tcctgctcgccctgtgccctct

SEQ ID NO: 629114 - DNA, 16 bp, Homo sapiens
tcctgctgctcgggaa

SEQ ID NO: 629115 - DNA, 19 bp, Homo sapiens
tcctgctgctcgggaaggc

SEQ ID NO: 629116 - DNA, 22 bp, Homo sapiens
tcctgctgctcgggaaggcctg

SEQ ID NO: 629117 - DNA, 15 bp, Homo sapiens
tcctggctcccaggg

SEQ ID NO: 629118 - DNA, 15 bp, Homo sapiens
tcctgtccagcaggt

SEQ ID NO: 629119 - DNA, 15 bp, Homo sapiens
tcctgtctcctctgt

SEQ ID NO: 629120 - DNA, 19 bp, Homo sapiens
tcctgtctcctctgtcagt

SEQ ID NO: 629121 - DNA, 20 bp, Homo sapiens
tcctgtctcctctgtcagtt

SEQ ID NO: 629122 - DNA, 19 bp, Homo sapiens
tcctgtgtcatctgtcagc

SEQ ID NO: 629123 - DNA, 19 bp, Homo sapiens
tccttaaaaagaccatgca

SEQ ID NO: 629124 - DNA, 15 bp, Homo sapiens
gaacatagttttcac

SEQ ID NO: 629125 - DNA, 18 bp, Homo sapiens
gaacatgacccagcctga

SEQ ID NO: 629126 - DNA, 21 bp, Homo sapiens
gaacatgacccgtacacacca

SEQ ID NO: 629127 - DNA, 18 bp, Homo sapiens
gaacatttgggagactga

SEQ ID NO: 629128 - DNA, 15 bp, Homo sapiens
gaaccagcactccca

SEQ ID NO: 629129 - DNA, 21 bp, Homo sapiens
gaaccagcactcccagggccc

SEQ ID NO: 629130 - DNA, 17 bp, Homo sapiens
gaacctgtagaagatga

SEQ ID NO: 629131 - DNA, 19 bp, Homo sapiens
gaacctgtagaagatgacc

SEQ ID NO: 629132 - DNA, 22 bp, Homo sapiens
gaacctgtagaagatgacctcg

SEQ ID NO: 629133 - DNA, 17 bp, Homo sapiens
gaactaacactatttta

SEQ ID NO: 629134 - DNA, 16 bp, Homo sapiens
gaactgataatttttg

SEQ ID NO: 629135 - DNA, 22 bp, Homo sapiens
gaacttggacttctaaaggcgg

SEQ ID NO: 629136 - DNA, 18 bp, Homo sapiens
gaagaaacacagcatgca

SEQ ID NO: 629137 - DNA, 12 bp, Homo sapiens
gaagaaagggag

SEQ ID NO: 629138 - DNA, 14 bp, Homo sapiens
gaagaaatatgagc

SEQ ID NO: 629139 - DNA, 22 bp, Homo sapiens
gaagaacctgtagaagatgacc

SEQ ID NO: 629140 - DNA, 16 bp, Homo sapiens
gaagaactgacttcct

SEQ ID NO: 629141 - DNA, 17 bp, Homo sapiens
gaagaaggactgaagaa

SEQ ID NO: 629142 - DNA, 18 bp, Homo sapiens
gaagaaggactgaagaaa

SEQ ID NO: 629143 - DNA, 14 bp, Homo sapiens
gaagaattcatgat

SEQ ID NO: 629144 - DNA, 14 bp, Homo sapiens
gaagaattggcaga

SEQ ID NO: 629145 - DNA, 19 bp, Homo sapiens
gaagagagtatggtgctgg

SEQ ID NO: 629146 - DNA, 16 bp, Homo sapiens
gaagagtagataagtg

SEQ ID NO: 629147 - DNA, 16 bp, Homo sapiens
gaagatagttgtaaag

SEQ ID NO: 629148 - DNA, 22 bp, Homo sapiens
gaagatgtttaacttaatcaat

SEQ ID NO: 629149 - DNA, 14 bp, Homo sapiens
gaagcaaataaata

SEQ ID NO: 629150 - DNA, 16 bp, Homo sapiens
gaagcaccccaccaca

SEQ ID NO: 629151 - DNA, 14 bp, Homo sapiens
gaagcacctctcag

SEQ ID NO: 629152 - DNA, 12 bp, Homo sapiens
gaagcagaatga

SEQ ID NO: 629153 - DNA, 16 bp, Homo sapiens
gaagcagcaaggtggg

SEQ ID NO: 629154 - DNA, 11 bp, Homo sapiens
gaagcatccag

SEQ ID NO: 629155 - DNA, 14 bp, Homo sapiens
gaagcatccaggca

SEQ ID NO: 629156 - DNA, 19 bp, Homo sapiens
gaagcccacccgccccaga

SEQ ID NO: 629157 - DNA, 13 bp, Homo sapiens
gaagcccaggagg

SEQ ID NO: 629158 - DNA, 20 bp, Homo sapiens
gaagcctggattccagcagt

SEQ ID NO: 629159 - DNA, 17 bp, Homo sapiens
gaagctagatgcccctg

SEQ ID NO: 629160 - DNA, 18 bp, Homo sapiens
gaagctttggaagcagca

SEQ ID NO: 629161 - DNA, 14 bp, Homo sapiens
gaaggactgaagaa

SEQ ID NO: 629162 - DNA, 15 bp, Homo sapiens
gaaggactgaagaaa

SEQ ID NO: 629163 - DNA, 15 bp, Homo sapiens
gaaggagaggagtgc

SEQ ID NO: 629164 - DNA, 17 bp, Homo sapiens
gaaggagaggagtgcgc

SEQ ID NO: 629165 - DNA, 22 bp, Homo sapiens
gaaggattcttttttcaatgta

SEQ ID NO: 629166 - DNA, 17 bp, Homo sapiens
gaaggcccgaggaggcc

SEQ ID NO: 629167 - DNA, 12 bp, Homo sapiens
gaaggcctgagg

SEQ ID NO: 629168 - DNA, 16 bp, Homo sapiens
gaaggcctgcccccct

SEQ ID NO: 629169 - DNA, 17 bp, Homo sapiens
gaaggcctgcccccctt

SEQ ID NO: 629170 - DNA, 14 bp, Homo sapiens
gaaggctttattct

SEQ ID NO: 629171 - DNA, 13 bp, Homo sapiens
gaagggcagcccc

SEQ ID NO: 629172 - DNA, 19 bp, Homo sapiens
gaagggcgctgagggcagg

SEQ ID NO: 629173 - DNA, 13 bp, Homo sapiens
gaagggtgcctgg

SEQ ID NO: 629174 - DNA, 16 bp, Homo sapiens
gaagggtgcctggctg

SEQ ID NO: 629175 - DNA, 19 bp, Homo sapiens
gaagggtgcctggctgggc

SEQ ID NO: 629176 - DNA, 18 bp, Homo sapiens
gaagggttctgccctgcc

SEQ ID NO: 629177 - DNA, 21 bp, Homo sapiens
gaagtatagatggtagaaact

SEQ ID NO: 629178 - DNA, 14 bp, Homo sapiens
gaagtcccttcctg

SEQ ID NO: 629179 - DNA, 17 bp, Homo sapiens
gaagtcccttcctgtcc

SEQ ID NO: 629180 - DNA, 18 bp, Homo sapiens
gaagtgcatgttaaaata

SEQ ID NO: 629181 - DNA, 19 bp, Homo sapiens
gaagtgggattcaggaatg

SEQ ID NO: 629182 - DNA, 14 bp, Homo sapiens
gaagtttaaatctt

SEQ ID NO: 629183 - DNA, 23 bp, Homo sapiens
gaagttttacttgattaaggact

SEQ ID NO: 629184 - DNA, 12 bp, Homo sapiens
gaataaatattt

SEQ ID NO: 629185 - DNA, 16 bp, Homo sapiens
gaataacactgcagcc

SEQ ID NO: 629186 - DNA, 11 bp, Homo sapiens
gaatattgctg

SEQ ID NO: 629187 - DNA, 24 bp, Homo sapiens
gaatattgctgatggtgcaatgac

SEQ ID NO: 629188 - DNA, 13 bp, Homo sapiens
gaatcacagccaa

SEQ ID NO: 629189 - DNA, 17 bp, Homo sapiens
gaatccatatcagctct

SEQ ID NO: 629190 - DNA, 16 bp, Homo sapiens
gaatccatcaggactt

SEQ ID NO: 629191 - DNA, 19 bp, Homo sapiens
gaatccatcaggacttggg

SEQ ID NO: 629192 - DNA, 13 bp, Homo sapiens
gaatgaaatataa

SEQ ID NO: 629193 - DNA, 20 bp, Homo sapiens
gaatgaaatataaactgtga

SEQ ID NO: 629194 - DNA, 22 bp, Homo sapiens
gaatgaaatataaactgtgaga

SEQ ID NO: 629195 - DNA, 23 bp, Homo sapiens
gaatgaaatataaactgtgagat

SEQ ID NO: 629196 - DNA, 23 bp, Homo sapiens
gaatgaccagaaaatttttgtct

SEQ ID NO: 629197 - DNA, 20 bp, Homo sapiens
gaatgagggcgtgaaacaca

SEQ ID NO: 629198 - DNA, 20 bp, Homo sapiens
gaatgccgcgaactgggttc

SEQ ID NO: 629199 - DNA, 17 bp, Homo sapiens
gaatgctcaatgtgctg

SEQ ID NO: 629200 - DNA, 14 bp, Homo sapiens
gaatggctctggct

SEQ ID NO: 629201 - DNA, 19 bp, Homo sapiens
gaatgggccaagccagggt

SEQ ID NO: 629202 - DNA, 17 bp, Homo sapiens
gaatggggcttccatgg

SEQ ID NO: 629203 - DNA, 20 bp, Homo sapiens
gaatggggggcgggccaggg

SEQ ID NO: 629204 - DNA, 19 bp, Homo sapiens
gaatggtgggctccagagt

SEQ ID NO: 629205 - DNA, 22 bp, Homo sapiens
gaatggtgggctccagagtagg

SEQ ID NO: 629206 - DNA, 18 bp, Homo sapiens
gaatgtgcaaagcagtat

SEQ ID NO: 629207 - DNA, 19 bp, Homo sapiens
gaatgttgtcctgtgtcat

SEQ ID NO: 629208 - DNA, 14 bp, Homo sapiens
gaattacataacag

SEQ ID NO: 629209 - DNA, 23 bp, Homo sapiens
gaattcagtagcattttaatagt

SEQ ID NO: 629210 - DNA, 14 bp, Homo sapiens
gaattcattgtctc

SEQ ID NO: 629211 - DNA, 17 bp, Homo sapiens
gaattcattgtctcagt

SEQ ID NO: 629212 - DNA, 20 bp, Homo sapiens
gaattcattgtctcagtgaa

SEQ ID NO: 629213 - DNA, 16 bp, Homo sapiens
gaattgctatcatttg

SEQ ID NO: 629214 - DNA, 22 bp, Homo sapiens
gaattgttatgtaaacatcata

SEQ ID NO: 629215 - DNA, 21 bp, Homo sapiens
gaatttggggctacttatatt

SEQ ID NO: 629216 - DNA, 22 bp, Homo sapiens
gaattttcacatgaacatactg

SEQ ID NO: 629217 - DNA, 20 bp, Homo sapiens
gaattttcattttcattatt

SEQ ID NO: 629218 - DNA, 22 bp, Homo sapiens
gaattttttcctgctagtgtag

SEQ ID NO: 629219 - DNA, 13 bp, Homo sapiens
gacaaatacacat

SEQ ID NO: 629220 - DNA, 15 bp, Homo sapiens
gacaaatacacatac

SEQ ID NO: 629221 - DNA, 13 bp, Homo sapiens
gacaacacacaca

SEQ ID NO: 629222 - DNA, 20 bp, Homo sapiens
gacaacacacacacacacaa

SEQ ID NO: 629223 - DNA, 23 bp, Homo sapiens
gacaagtctgagtagttatgaat

SEQ ID NO: 629224 - DNA, 16 bp, Homo sapiens
gacaatgcaaaccatc

SEQ ID NO: 629225 - DNA, 22 bp, Homo sapiens
gacaatgcaaaccatcattgaa

SEQ ID NO: 629226 - DNA, 13 bp, Homo sapiens
gacaatgtggaat

SEQ ID NO: 629227 - DNA, 18 bp, Homo sapiens
gacaatgtggaattacat

SEQ ID NO: 629228 - DNA, 23 bp, Homo sapiens
gacaatgtggaattacataacag

SEQ ID NO: 629229 - DNA, 17 bp, Homo sapiens
gacacacacatatatac

SEQ ID NO: 629230 - DNA, 13 bp, Homo sapiens
gacacagcacaag

SEQ ID NO: 629231 - DNA, 16 bp, Homo sapiens
gacacagcccagagac

SEQ ID NO: 629232 - DNA, 19 bp, Homo sapiens
gacacagcccagagactga

SEQ ID NO: 629233 - DNA, 16 bp, Homo sapiens
gacaccctcctgcccc

SEQ ID NO: 629234 - DNA, 22 bp, Homo sapiens
gacacctagactctaaaactat

SEQ ID NO: 629235 - DNA, 17 bp, Homo sapiens
gacacgaatattgctga

SEQ ID NO: 629236 - DNA, 18 bp, Homo sapiens
gacacgaatattgctgat

SEQ ID NO: 629237 - DNA, 22 bp, Homo sapiens
gacacgaatattgctgatggtg

SEQ ID NO: 629238 - DNA, 18 bp, Homo sapiens
gacactgatgggtcctgc

SEQ ID NO: 629239 - DNA, 17 bp, Homo sapiens
gcccgcactcaggagca

SEQ ID NO: 629240 - DNA, 18 bp, Homo sapiens
gcccgcactcaggagcac

SEQ ID NO: 629241 - DNA, 14 bp, Homo sapiens
gcccgcccaccccg

SEQ ID NO: 629242 - DNA, 23 bp, Homo sapiens
gcccgcccaccccgctgcctggc

SEQ ID NO: 629243 - DNA, 21 bp, Homo sapiens
gcccgcccccgccctcgctcc

SEQ ID NO: 629244 - DNA, 17 bp, Homo sapiens
gcccgccctcctctgcc

SEQ ID NO: 629245 - DNA, 18 bp, Homo sapiens
gcccgccctcctctgccc

SEQ ID NO: 629246 - DNA, 19 bp, Homo sapiens
gcccgccctcctctgcccc

SEQ ID NO: 629247 - DNA, 14 bp, Homo sapiens
gcccgccctgcccg

SEQ ID NO: 629248 - DNA, 16 bp, Homo sapiens
gcccgccgcctccctc

SEQ ID NO: 629249 - DNA, 17 bp, Homo sapiens
gcccgccggttggccgg

SEQ ID NO: 629250 - DNA, 20 bp, Homo sapiens
gcccgcgggtggctggagcc

SEQ ID NO: 629251 - DNA, 19 bp, Homo sapiens
gcccgctcaacctctcaga

SEQ ID NO: 629252 - DNA, 14 bp, Homo sapiens
gcccggccaaggac

SEQ ID NO: 629253 - DNA, 20 bp, Homo sapiens
gcccggcccacgcagagccc

SEQ ID NO: 629254 - DNA, 21 bp, Homo sapiens
gcccggcccacgcagagcccc

SEQ ID NO: 629255 - DNA, 15 bp, Homo sapiens
gcccggcctcctagc

SEQ ID NO: 629256 - DNA, 17 bp, Homo sapiens
gcccggcctcctagcct

SEQ ID NO: 629257 - DNA, 14 bp, Homo sapiens
gcccgtgcgcagcc

SEQ ID NO: 629258 - DNA, 23 bp, Homo sapiens
gcccgtgcgcagccgcgctctgc

SEQ ID NO: 629259 - DNA, 15 bp, Homo sapiens
gccctcacctctgag

SEQ ID NO: 629260 - DNA, 20 bp, Homo sapiens
gccctcacctctgaggacag

SEQ ID NO: 629261 - DNA, 23 bp, Homo sapiens
gccctcacctctgaggacagagg

SEQ ID NO: 629262 - DNA, 14 bp, Homo sapiens
gccctcactccact

SEQ ID NO: 629263 - DNA, 17 bp, Homo sapiens
gccctcactccactccc

SEQ ID NO: 629264 - DNA, 18 bp, Homo sapiens
gccctcactccactcccc

SEQ ID NO: 629265 - DNA, 21 bp, Homo sapiens
gccctcagcgtctccccatgc

SEQ ID NO: 629266 - DNA, 17 bp, Homo sapiens
gccctccctccctccac

SEQ ID NO: 629267 - DNA, 18 bp, Homo sapiens
gccctccctgctgccagg

SEQ ID NO: 629268 - DNA, 15 bp, Homo sapiens
gccctccgcccttcc

SEQ ID NO: 629269 - DNA, 15 bp, Homo sapiens
gccctcctctgcccc

SEQ ID NO: 629270 - DNA, 23 bp, Homo sapiens
gccctcctctgccccctcccccg

SEQ ID NO: 629271 - DNA, 16 bp, Homo sapiens
gccctcttaagatctg

SEQ ID NO: 629272 - DNA, 11 bp, Homo sapiens
gccctcttcaa

SEQ ID NO: 629273 - DNA, 13 bp, Homo sapiens
gccctctttctct

SEQ ID NO: 629274 - DNA, 15 bp, Homo sapiens
gccctctttctctct

SEQ ID NO: 629275 - DNA, 16 bp, Homo sapiens
gccctctttctctctg

SEQ ID NO: 629276 - DNA, 19 bp, Homo sapiens
gccctctttctctctgtgt

SEQ ID NO: 629277 - DNA, 21 bp, Homo sapiens
gccctctttctctctgtgtgg

SEQ ID NO: 629278 - DNA, 22 bp, Homo sapiens
gccctctttctctctgtgtggc

SEQ ID NO: 629279 - DNA, 22 bp, Homo sapiens
gccctgcaccttgggcacggga

SEQ ID NO: 629280 - DNA, 20 bp, Homo sapiens
gccctgcagtcacgtgaggc

SEQ ID NO: 629281 - DNA, 18 bp, Homo sapiens
gccctgccctcactccac

SEQ ID NO: 629282 - DNA, 19 bp, Homo sapiens
gccctgccctcactccact

SEQ ID NO: 629283 - DNA, 14 bp, Homo sapiens
gccctgccctcccc

SEQ ID NO: 629284 - DNA, 19 bp, Homo sapiens
gccctgccctcccccacgg

SEQ ID NO: 629285 - DNA, 11 bp, Homo sapiens
gccctgcctca

SEQ ID NO: 629286 - DNA, 12 bp, Homo sapiens
gccctgcctcac

SEQ ID NO: 629287 - DNA, 14 bp, Homo sapiens
gccctgcctgagga

SEQ ID NO: 629288 - DNA, 13 bp, Homo sapiens
gccctggagccag

SEQ ID NO: 629289 - DNA, 18 bp, Homo sapiens
gccctggagccagggcag

SEQ ID NO: 629290 - DNA, 19 bp, Homo sapiens
gccctggagccagggcaga

SEQ ID NO: 629291 - DNA, 23 bp, Homo sapiens
gccctggagccagggcagaggaa

SEQ ID NO: 629292 - DNA, 22 bp, Homo sapiens
gccctgggcaaggaagctttgg

SEQ ID NO: 629293 - DNA, 11 bp, Homo sapiens
gccctggggca

SEQ ID NO: 629294 - DNA, 15 bp, Homo sapiens
gccctggggtctctg

SEQ ID NO: 629295 - DNA, 18 bp, Homo sapiens
gccctggggtctctgagc

SEQ ID NO: 629296 - DNA, 19 bp, Homo sapiens
gccctggggtctctgagca

SEQ ID NO: 629297 - DNA, 14 bp, Homo sapiens
gccctgtgccctct

SEQ ID NO: 629298 - DNA, 15 bp, Homo sapiens
gccctgtgccctctc

SEQ ID NO: 629299 - DNA, 16 bp, Homo sapiens
gccctgtgggagtcca

SEQ ID NO: 629300 - DNA, 18 bp, Homo sapiens
gccctgtgggagtccact

SEQ ID NO: 629301 - DNA, 23 bp, Homo sapiens
gccctgtgggagtccactttcct

SEQ ID NO: 629302 - DNA, 19 bp, Homo sapiens
gccctgttccgcctcactg

SEQ ID NO: 629303 - DNA, 14 bp, Homo sapiens
gccctgtttccaat

SEQ ID NO: 629304 - DNA, 15 bp, Homo sapiens
gcccttcccaacctc

SEQ ID NO: 629305 - DNA, 21 bp, Homo sapiens
gcccttccctgacactgtctg

SEQ ID NO: 629306 - DNA, 14 bp, Homo sapiens
gcccttgctctacc

SEQ ID NO: 629307 - DNA, 19 bp, Homo sapiens
gcccttgctctacctggcc

SEQ ID NO: 629308 - DNA, 21 bp, Homo sapiens
gcccttgctctacctggccgg

SEQ ID NO: 629309 - DNA, 15 bp, Homo sapiens
gccctttgcaggccc

SEQ ID NO: 629310 - DNA, 16 bp, Homo sapiens
gccctttgcaggccca

SEQ ID NO: 629311 - DNA, 16 bp, Homo sapiens
gccgaagggcagcccc

SEQ ID NO: 629312 - DNA, 18 bp, Homo sapiens
gccgaagggcagccccgc

SEQ ID NO: 629313 - DNA, 13 bp, Homo sapiens
gccgactgggctg

SEQ ID NO: 629314 - DNA, 16 bp, Homo sapiens
gccgatataagccata

SEQ ID NO: 629315 - DNA, 12 bp, Homo sapiens
gccgcagaggcc

SEQ ID NO: 629316 - DNA, 19 bp, Homo sapiens
gccgcagaggcccgaggca

SEQ ID NO: 629317 - DNA, 21 bp, Homo sapiens
gccgcagggcgctccggcaga

SEQ ID NO: 629318 - DNA, 19 bp, Homo sapiens
gccgcatctgcctggagcc

SEQ ID NO: 629319 - DNA, 19 bp, Homo sapiens
gccgcctccctcacccggc

SEQ ID NO: 629320 - DNA, 13 bp, Homo sapiens
gccgcctcctcca

SEQ ID NO: 629321 - DNA, 15 bp, Homo sapiens
gccgcctcctccaga

SEQ ID NO: 629322 - DNA, 20 bp, Homo sapiens
gccgcctcgcccccgggccc

SEQ ID NO: 629323 - DNA, 24 bp, Homo sapiens
gccgcctcgggccgcctcctccag

SEQ ID NO: 629324 - DNA, 18 bp, Homo sapiens
gccgcgctctgcccctcc

SEQ ID NO: 629325 - DNA, 19 bp, Homo sapiens
gccgctctccgccccccgg

SEQ ID NO: 629326 - DNA, 19 bp, Homo sapiens
gccgctgcagtcagcacag

SEQ ID NO: 629327 - DNA, 20 bp, Homo sapiens
gccggggtccaggcccgtgg

SEQ ID NO: 629328 - DNA, 20 bp, Homo sapiens
gccggttggccggctggccg

SEQ ID NO: 629329 - DNA, 17 bp, Homo sapiens
gccgtccctgacttccc

SEQ ID NO: 629330 - DNA, 19 bp, Homo sapiens
gccgtctttggttcctcat

SEQ ID NO: 629331 - DNA, 15 bp, Homo sapiens
gccgtgcagggccag

SEQ ID NO: 629332 - DNA, 23 bp, Homo sapiens
gccgtggagcttggagccccctg

SEQ ID NO: 629333 - DNA, 22 bp, Homo sapiens
gccgttagggaaatccaactcc

SEQ ID NO: 629334 - DNA, 15 bp, Homo sapiens
gcctaataaacaatt

SEQ ID NO: 629335 - DNA, 22 bp, Homo sapiens
gcctcactgatatattttccag

SEQ ID NO: 629336 - DNA, 13 bp, Homo sapiens
gcctcactgggtg

SEQ ID NO: 629337 - DNA, 20 bp, Homo sapiens
gcctcactgtgacctgctcc

SEQ ID NO: 629338 - DNA, 21 bp, Homo sapiens
gcctcactgtgacctgctcct

SEQ ID NO: 629339 - DNA, 22 bp, Homo sapiens
gcctcactgtgacctgctcctg

SEQ ID NO: 629340 - DNA, 13 bp, Homo sapiens
gcctcccgccgcc

SEQ ID NO: 629341 - DNA, 20 bp, Homo sapiens
gcctccctggggaccaggag

SEQ ID NO: 629342 - DNA, 17 bp, Homo sapiens
gcctcgcccccgggccc

SEQ ID NO: 629343 - DNA, 18 bp, Homo sapiens
gcctcgcccccgggccct

SEQ ID NO: 629344 - DNA, 14 bp, Homo sapiens
gcctcgggccgcct

SEQ ID NO: 629345 - DNA, 21 bp, Homo sapiens
gcctcgggccgcctcctccag

SEQ ID NO: 629346 - DNA, 15 bp, Homo sapiens
gcctcgttggagagc

SEQ ID NO: 629347 - DNA, 16 bp, Homo sapiens
gcctctatccctggcc

SEQ ID NO: 629348 - DNA, 17 bp, Homo sapiens
gcctctatccctggcca

SEQ ID NO: 629349 - DNA, 23 bp, Homo sapiens
gcctctatccctggccacctgcc

SEQ ID NO: 629350 - DNA, 21 bp, Homo sapiens
gcctctcagtatcttaaaatt

SEQ ID NO: 629351 - DNA, 16 bp, Homo sapiens
gcctctccgcccacgc

SEQ ID NO: 629352 - DNA, 22 bp, Homo sapiens
gcctcttaaaaattatctttaa

SEQ ID NO: 629353 - DNA, 22 bp, Homo sapiens
gcctgaaagatacaggggatca

SEQ ID NO: 629354 - DNA, 13 bp, Homo sapiens
gcctgaagcctgg

SEQ ID NO: 629355 - DNA, 15 bp, Homo sapiens
gcctgaagcctggat

SEQ ID NO: 629356 - DNA, 20 bp, Homo sapiens
gcctgaatccatcaggactt

SEQ ID NO: 629357 - DNA, 13 bp, Homo sapiens
gcctgagccacag

SEQ ID NO: 629358 - DNA, 20 bp, Homo sapiens
gcctgagccacagtggggcc

SEQ ID NO: 629359 - DNA, 21 bp, Homo sapiens
gcctgagccacagtggggccc

SEQ ID NO: 629360 - DNA, 22 bp, Homo sapiens
gcctgagccacagtggggccca

SEQ ID NO: 629361 - DNA, 15 bp, Homo sapiens
gcctgagctccaccc

SEQ ID NO: 629362 - DNA, 20 bp, Homo sapiens
gcctgagctccaccctcccc

SEQ ID NO: 629363 - DNA, 16 bp, Homo sapiens
gcctgagggaagccca

SEQ ID NO: 629364 - DNA, 19 bp, Homo sapiens
gcctgagggaagcccaccc

SEQ ID NO: 629365 - DNA, 21 bp, Homo sapiens
gcctgagggaagcccacccgc

SEQ ID NO: 629366 - DNA, 22 bp, Homo sapiens
gcctgcacagtggtccagggtc

SEQ ID NO: 629367 - DNA, 13 bp, Homo sapiens
gcctgcagcccag

SEQ ID NO: 629368 - DNA, 14 bp, Homo sapiens
gcctgcagcccaga

SEQ ID NO: 629369 - DNA, 14 bp, Homo sapiens
gcctgccaggccct

SEQ ID NO: 629370 - DNA, 23 bp, Homo sapiens
gcctgccaggccctccagcagga

SEQ ID NO: 629371 - DNA, 15 bp, Homo sapiens
gcctgcccgcccgcc

SEQ ID NO: 629372 - DNA, 16 bp, Homo sapiens
gcctgcccgcccgccg

SEQ ID NO: 629373 - DNA, 14 bp, Homo sapiens
gcctgcgctcctct

SEQ ID NO: 629374 - DNA, 16 bp, Homo sapiens
gcctgcgctcctctgc

SEQ ID NO: 629375 - DNA, 17 bp, Homo sapiens
gcctgcgctcctctgca

SEQ ID NO: 629376 - DNA, 18 bp, Homo sapiens
gcctgcgctcctctgcag

SEQ ID NO: 629377 - DNA, 20 bp, Homo sapiens
gcctgcgctcctctgcagcc

SEQ ID NO: 629378 - DNA, 21 bp, Homo sapiens
gcctgcgctcctctgcagcct

SEQ ID NO: 629379 - DNA, 19 bp, Homo sapiens
gcctgcggggttccctgcg

SEQ ID NO: 629380 - DNA, 13 bp, Homo sapiens
gcctggaggagaa

SEQ ID NO: 629381 - DNA, 16 bp, Homo sapiens
gcctggaggagaagga

SEQ ID NO: 629382 - DNA, 19 bp, Homo sapiens
gcctggaggagaaggagga

SEQ ID NO: 629383 - DNA, 23 bp, Homo sapiens
gcctggaggatagcagagaagcc

SEQ ID NO: 629384 - DNA, 16 bp, Homo sapiens
gcctggccccctcgcg

SEQ ID NO: 629385 - DNA, 15 bp, Homo sapiens
gcctggcgggcagcc

SEQ ID NO: 629386 - DNA, 22 bp, Homo sapiens
gcctggcgggcagcccctgctg

SEQ ID NO: 629387 - DNA, 11 bp, Homo sapiens
gcctggctggg

SEQ ID NO: 629388 - DNA, 21 bp, Homo sapiens
gcctggctgggctttggggct

SEQ ID NO: 629389 - DNA, 19 bp, Homo sapiens
gcctgggaaattgctccat

SEQ ID NO: 629390 - DNA, 15 bp, Homo sapiens
gcctgggacgcccct

SEQ ID NO: 629391 - DNA, 18 bp, Homo sapiens
gcctgggcagcacctccg

SEQ ID NO: 629392 - DNA, 18 bp, Homo sapiens
gcctgggcccaggcccag

SEQ ID NO: 629393 - DNA, 22 bp, Homo sapiens
gcctgggcccaggcccagcctc

SEQ ID NO: 629394 - DNA, 15 bp, Homo sapiens
gcctgggtccccctc

SEQ ID NO: 629395 - DNA, 20 bp, Homo sapiens
gcctgggtccccctcctgca

SEQ ID NO: 629396 - DNA, 19 bp, Homo sapiens
gcctgtactcgcttgtgca

SEQ ID NO: 629397 - DNA, 19 bp, Homo sapiens
gcctgtcaggaccatttta

SEQ ID NO: 629398 - DNA, 15 bp, Homo sapiens
gcctgtcgggcccgc

SEQ ID NO: 629399 - DNA, 19 bp, Homo sapiens
gcctgtggtgaggtcctgt

SEQ ID NO: 629400 - DNA, 10 bp, Homo sapiens
gccttatgga

SEQ ID NO: 629401 - DNA, 16 bp, Homo sapiens
gccttatggaacactc

SEQ ID NO: 629402 - DNA, 21 bp, Homo sapiens
gccttatggaacactctgaga

SEQ ID NO: 629403 - DNA, 21 bp, Homo sapiens
gccttattaaaatattttctt

SEQ ID NO: 629404 - DNA, 12 bp, Homo sapiens
gccttcagccct

SEQ ID NO: 629405 - DNA, 22 bp, Homo sapiens
gccttccgggtctcgcagcctg

SEQ ID NO: 629406 - DNA, 23 bp, Homo sapiens
gccttccgggtctcgcagcctga

SEQ ID NO: 629407 - DNA, 18 bp, Homo sapiens
gccttctggctgctgcag

SEQ ID NO: 629408 - DNA, 14 bp, Homo sapiens
gccttgatgtttct

SEQ ID NO: 629409 - DNA, 17 bp, Homo sapiens
gccttgctgggccaggg

SEQ ID NO: 629410 - DNA, 22 bp, Homo sapiens
gccttggagcagaaagccaggg

SEQ ID NO: 629411 - DNA, 16 bp, Homo sapiens
gccttggttcctccag

SEQ ID NO: 629412 - DNA, 14 bp, Homo sapiens
gcctttccccagtg

SEQ ID NO: 629413 - DNA, 16 bp, Homo sapiens
gcctttctccagccca

SEQ ID NO: 629414 - DNA, 20 bp, Homo sapiens
gcctttctccagcccatgct

SEQ ID NO: 629415 - DNA, 13 bp, Homo sapiens
gcgaactgggttc

SEQ ID NO: 629416 - DNA, 20 bp, Homo sapiens
gcgacaatgcaaaccatcat

SEQ ID NO: 629417 - DNA, 23 bp, Homo sapiens
gcgacaatgcaaaccatcattga

SEQ ID NO: 629418 - DNA, 17 bp, Homo sapiens
gcgaccacccctgtgcg

SEQ ID NO: 629419 - DNA, 12 bp, Homo sapiens
gcgacgcggccc

SEQ ID NO: 629420 - DNA, 17 bp, Homo sapiens
gcgacggaggcaggacc

SEQ ID NO: 629421 - DNA, 19 bp, Homo sapiens
gcgagaaacagagatcata

SEQ ID NO: 629422 - DNA, 14 bp, Homo sapiens
gcgaggcagaatgg

SEQ ID NO: 629423 - DNA, 22 bp, Homo sapiens
gcgatgtgttctttgtacctgt

SEQ ID NO: 629424 - DNA, 14 bp, Homo sapiens
gcgcaccgcccaac

SEQ ID NO: 629425 - DNA, 13 bp, Homo sapiens
gcgcagcccccac

SEQ ID NO: 629426 - DNA, 16 bp, Homo sapiens
gcgcagccgcgctctg

SEQ ID NO: 629427 - DNA, 12 bp, Homo sapiens
gcgccacccgcc

SEQ ID NO: 629428 - DNA, 15 bp, Homo sapiens
gcgccagggctcaga

SEQ ID NO: 629429 - DNA, 15 bp, Homo sapiens
gcgcccacctgccca

SEQ ID NO: 629430 - DNA, 14 bp, Homo sapiens
gcgcccccaggacc

SEQ ID NO: 629431 - DNA, 17 bp, Homo sapiens
gcgcccccaggaccccc

SEQ ID NO: 629432 - DNA, 12 bp, Homo sapiens
gcgcccctctgc

SEQ ID NO: 629433 - DNA, 17 bp, Homo sapiens
gcgcccctctgcgcccc

SEQ ID NO: 629434 - DNA, 19 bp, Homo sapiens
gcgcccctctgcgccccag

SEQ ID NO: 629435 - DNA, 15 bp, Homo sapiens
gcgcccctgcccagc

SEQ ID NO: 629436 - DNA, 18 bp, Homo sapiens
gcgcccctgcccagcacc

SEQ ID NO: 629437 - DNA, 13 bp, Homo sapiens
gcgccctccctcc

SEQ ID NO: 629438 - DNA, 14 bp, Homo sapiens
gcgccctccctccc

SEQ ID NO: 629439 - DNA, 16 bp, Homo sapiens
gcgccctccctccctc

SEQ ID NO: 629440 - DNA, 15 bp, Homo sapiens
gcgccgcctcgcccc

SEQ ID NO: 629441 - DNA, 15 bp, Homo sapiens
gcgccggttccacgt

SEQ ID NO: 629442 - DNA, 16 bp, Homo sapiens
gcgccggttccacgtg

SEQ ID NO: 629443 - DNA, 13 bp, Homo sapiens
gcgcctcgcccca

SEQ ID NO: 629444 - DNA, 14 bp, Homo sapiens
gcgcctgcccgccc

SEQ ID NO: 629445 - DNA, 16 bp, Homo sapiens
gcgcctgcgcctcctc

SEQ ID NO: 629446 - DNA, 17 bp, Homo sapiens
gcgcctgcgcctcctcc

SEQ ID NO: 629447 - DNA, 16 bp, Homo sapiens
gcgcctgcgctcctct

SEQ ID NO: 629448 - DNA, 17 bp, Homo sapiens
gcgcctgcgctcctctg

SEQ ID NO: 629449 - DNA, 20 bp, Homo sapiens
gcgcctgcgctcctctgcag

SEQ ID NO: 629450 - DNA, 13 bp, Homo sapiens
gcgcctgtcgggc

SEQ ID NO: 629451 - DNA, 15 bp, Homo sapiens
gcgcctgtcgggccc

SEQ ID NO: 629452 - DNA, 22 bp, Homo sapiens
gcgcgcaccgcccaacccccac

SEQ ID NO: 629453 - DNA, 15 bp, Homo sapiens
gcgcgcccccaggac

SEQ ID NO: 629454 - DNA, 21 bp, Homo sapiens
gcgcgcgggacagcggccccg

SEQ ID NO: 629455 - DNA, 18 bp, Homo sapiens
gcgcgggacagcggcccc

SEQ ID NO: 629456 - DNA, 13 bp, Homo sapiens
gcgcgtgccccca

SEQ ID NO: 629457 - DNA, 23 bp, Homo sapiens
gcgctagagcattctggggtggg

SEQ ID NO: 629458 - DNA, 15 bp, Homo sapiens
gcgctccggcagagg

SEQ ID NO: 629459 - DNA, 19 bp, Homo sapiens
gcgctcctctgcagcctga

SEQ ID NO: 629460 - DNA, 21 bp, Homo sapiens
gcgctcctctgcagcctgagc

SEQ ID NO: 629461 - DNA, 22 bp, Homo sapiens
gcgctcctctgcagcctgagct

SEQ ID NO: 629462 - DNA, 13 bp, Homo sapiens
gcgctctgcccct

SEQ ID NO: 629463 - DNA, 14 bp, Homo sapiens
gcgctctgcccctc

SEQ ID NO: 629464 - DNA, 23 bp, Homo sapiens
gcgctgagggcagggttctagaa

SEQ ID NO: 629465 - DNA, 23 bp, Homo sapiens
gcgctgtcggtgtttggaggctg

SEQ ID NO: 629466 - DNA, 18 bp, Homo sapiens
gcggaccggagcggctga

SEQ ID NO: 629467 - DNA, 12 bp, Homo sapiens
gcggagcccccg

SEQ ID NO: 629468 - DNA, 17 bp, Homo sapiens
gcggagcccccgcccct

SEQ ID NO: 629469 - DNA, 18 bp, Homo sapiens
gcggagcccccgcccctc

SEQ ID NO: 629470 - DNA, 19 bp, Homo sapiens
gcggagcccccgcccctcc

SEQ ID NO: 629471 - DNA, 12 bp, Homo sapiens
gcggaggcccct

SEQ ID NO: 629472 - DNA, 17 bp, Homo sapiens
gcggaggcccctgaggg

SEQ ID NO: 629473 - DNA, 16 bp, Homo sapiens
gcggaggggcttggag

SEQ ID NO: 629474 - DNA, 15 bp, Homo sapiens
gcggcaccgcccacc

SEQ ID NO: 629475 - DNA, 17 bp, Homo sapiens
gcggcaccgcccaccca

SEQ ID NO: 629476 - DNA, 18 bp, Homo sapiens
gcggcaccgcccacccac

SEQ ID NO: 629477 - DNA, 16 bp, Homo sapiens
gcggccccgcggagcc

SEQ ID NO: 629478 - DNA, 15 bp, Homo sapiens
gcggcccgtgcgcag

SEQ ID NO: 629479 - DNA, 13 bp, Homo sapiens
gcggccgctctcc

SEQ ID NO: 629480 - DNA, 16 bp, Homo sapiens
gcggcggtgggcgcct

SEQ ID NO: 629481 - DNA, 18 bp, Homo sapiens
gcggcggtgggcgcctgt

SEQ ID NO: 629482 - DNA, 13 bp, Homo sapiens
gcggcttccctgc

SEQ ID NO: 629483 - DNA, 16 bp, Homo sapiens
gcgggacagcggcccc

SEQ ID NO: 629484 - DNA, 18 bp, Homo sapiens
gcgggacagcggccccgc

SEQ ID NO: 629485 - DNA, 18 bp, Homo sapiens
gcgggcagcccctgctgg

SEQ ID NO: 629486 - DNA, 21 bp, Homo sapiens
gcgggcagcccctgctggacc

SEQ ID NO: 629487 - DNA, 22 bp, Homo sapiens
gcgggcagcccctgctggacca

SEQ ID NO: 629488 - DNA, 13 bp, Homo sapiens
gcgggccagggtg

SEQ ID NO: 629489 - DNA, 14 bp, Homo sapiens
gcgggccagggtgg

SEQ ID NO: 629490 - DNA, 21 bp, Homo sapiens
gcggggcctgggtccccctcc

SEQ ID NO: 629491 - DNA, 18 bp, Homo sapiens
gcgggtggctggagcccc

SEQ ID NO: 629492 - DNA, 14 bp, Homo sapiens
gcgtccctgctcag

SEQ ID NO: 629493 - DNA, 15 bp, Homo sapiens
gcgtccctgctcagc

SEQ ID NO: 629494 - DNA, 22 bp, Homo sapiens
gcgtcctttcctctcctctctg

SEQ ID NO: 629495 - DNA, 23 bp, Homo sapiens
gcgtcctttcctctcctctctgg

SEQ ID NO: 629496 - DNA, 24 bp, Homo sapiens
gcgtcctttcctctcctctctgga

SEQ ID NO: 629497 - DNA, 16 bp, Homo sapiens
gcgtctccccatgctg

SEQ ID NO: 629498 - DNA, 13 bp, Homo sapiens
gcgtgaaacacaa

SEQ ID NO: 629499 - DNA, 15 bp, Homo sapiens
gcgtgaccggcccgc

SEQ ID NO: 629500 - DNA, 18 bp, Homo sapiens
gcgtgaccggcccgccac

SEQ ID NO: 629501 - DNA, 21 bp, Homo sapiens
gcgtgacttcagactctctcc

SEQ ID NO: 629502 - DNA, 14 bp, Homo sapiens
gcgtgcccccagcg

SEQ ID NO: 629503 - DNA, 22 bp, Homo sapiens
gcgtgccttccccgtgcggccc

SEQ ID NO: 629504 - DNA, 16 bp, Homo sapiens
gcgtggaccccgacaa

SEQ ID NO: 629505 - DNA, 19 bp, Homo sapiens
gcgtggcttggcattgacc

SEQ ID NO: 629506 - DNA, 16 bp, Homo sapiens
gcgtgggatccagaga

SEQ ID NO: 629507 - DNA, 16 bp, Homo sapiens
gcgtgtggccctgtgg

SEQ ID NO: 629508 - DNA, 17 bp, Homo sapiens
gcgttgttttgtggata

SEQ ID NO: 629509 - DNA, 14 bp, Homo sapiens
gctaacctctctga

SEQ ID NO: 629510 - DNA, 15 bp, Homo sapiens
gctaactggccccag

SEQ ID NO: 629511 - DNA, 17 bp, Homo sapiens
gctaagttgtcttacac

SEQ ID NO: 629512 - DNA, 20 bp, Homo sapiens
gctacaccttagcagctctt

SEQ ID NO: 629513 - DNA, 12 bp, Homo sapiens
gctacaggtgcc

SEQ ID NO: 629514 - DNA, 23 bp, Homo sapiens
gctagaaagagaaaaagccctct

SEQ ID NO: 629515 - DNA, 19 bp, Homo sapiens
gctagacagaaaccaagcc

SEQ ID NO: 629516 - DNA, 17 bp, Homo sapiens
gctagagcattctgggg

SEQ ID NO: 629517 - DNA, 22 bp, Homo sapiens
gctagcccagtccctggagctg

SEQ ID NO: 629518 - DNA, 18 bp, Homo sapiens
gctaggcagggagggggc

SEQ ID NO: 629519 - DNA, 18 bp, Homo sapiens
gctaggttaataggagga

SEQ ID NO: 629520 - DNA, 22 bp, Homo sapiens
gctaggttaataggaggacaga

SEQ ID NO: 629521 - DNA, 16 bp, Homo sapiens
gctagttctgctgccc

SEQ ID NO: 629522 - DNA, 17 bp, Homo sapiens
gctagtttaaaattatt

SEQ ID NO: 629523 - DNA, 16 bp, Homo sapiens
gctataaatagtgaaa

SEQ ID NO: 629524 - DNA, 12 bp, Homo sapiens
gctatgcacacc

SEQ ID NO: 629525 - DNA, 22 bp, Homo sapiens
gctatgcacaccaaattgctga

SEQ ID NO: 629526 - DNA, 14 bp, Homo sapiens
gctatggacaattt

SEQ ID NO: 629527 - DNA, 19 bp, Homo sapiens
gctatggacaatttaccac

SEQ ID NO: 629528 - DNA, 21 bp, Homo sapiens
gctatgtctcatgttttatat

SEQ ID NO: 629529 - DNA, 15 bp, Homo sapiens
gctatgtctgtgatg

SEQ ID NO: 629530 - DNA, 23 bp, Homo sapiens
gctatgttttggagagagcaatc

SEQ ID NO: 629531 - DNA, 14 bp, Homo sapiens
gctattaagaaact

SEQ ID NO: 629532 - DNA, 18 bp, Homo sapiens
gctattcgtaagttctgt

SEQ ID NO: 629533 - DNA, 21 bp, Homo sapiens
gctattgtttataggaaataa

SEQ ID NO: 629534 - DNA, 22 bp, Homo sapiens
gctattgtttataggaaataaa

SEQ ID NO: 629535 - DNA, 11 bp, Homo sapiens
gctatttaagt

SEQ ID NO: 629536 - DNA, 14 bp, Homo sapiens
gctcaacctctcag

SEQ ID NO: 629537 - DNA, 20 bp, Homo sapiens
gctcaataaggcagtgcagt

SEQ ID NO: 629538 - DNA, 21 bp, Homo sapiens
gctcaataaggcagtgcagtg

SEQ ID NO: 629539 - DNA, 13 bp, Homo sapiens
gctcaatgtgctg

SEQ ID NO: 629540 - DNA, 19 bp, Homo sapiens
gctcaatgtgctgttgatt

SEQ ID NO: 629541 - DNA, 20 bp, Homo sapiens
gctcacaccggcactgtgca

SEQ ID NO: 629542 - DNA, 13 bp, Homo sapiens
gctcacacttggg

SEQ ID NO: 629543 - DNA, 17 bp, Homo sapiens
gctcacacttgggctgg

SEQ ID NO: 629544 - DNA, 14 bp, Homo sapiens
gctcagaggagagg

SEQ ID NO: 629545 - DNA, 18 bp, Homo sapiens
gctcagatggggcctggg

SEQ ID NO: 629546 - DNA, 22 bp, Homo sapiens
gctcagatggggcctgggctgt

SEQ ID NO: 629547 - DNA, 22 bp, Homo sapiens
gctcagcccatcccctgcctct

SEQ ID NO: 629548 - DNA, 22 bp, Homo sapiens
gctcagtattgagacactgtca

SEQ ID NO: 629549 - DNA, 15 bp, Homo sapiens
gctcatagcacatgt

SEQ ID NO: 629550 - DNA, 17 bp, Homo sapiens
gctcatagcacatgttt

SEQ ID NO: 629551 - DNA, 22 bp, Homo sapiens
gctcatagcacatgttttacaa

SEQ ID NO: 629552 - DNA, 22 bp, Homo sapiens
gctcatcagaaacaatttctgt

SEQ ID NO: 629553 - DNA, 19 bp, Homo sapiens
gctccaccctcccctcttc

SEQ ID NO: 629554 - DNA, 20 bp, Homo sapiens
gctccaccctcccctcttct

SEQ ID NO: 629555 - DNA, 23 bp, Homo sapiens
gctccactctgaagtcccttcct

SEQ ID NO: 629556 - DNA, 19 bp, Homo sapiens
gctccagagtaggtgggtc

SEQ ID NO: 629557 - DNA, 14 bp, Homo sapiens
gctccattcctgag

SEQ ID NO: 629558 - DNA, 18 bp, Homo sapiens
gctccctccctccctgct

SEQ ID NO: 629559 - DNA, 14 bp, Homo sapiens
gctccggcagaggc

SEQ ID NO: 629560 - DNA, 17 bp, Homo sapiens
gctccggcagaggcagg

SEQ ID NO: 629561 - DNA, 14 bp, Homo sapiens
gctccgggtgcgtg

SEQ ID NO: 629562 - DNA, 22 bp, Homo sapiens
gctccgggtgcgtgaccggccc

SEQ ID NO: 629563 - DNA, 18 bp, Homo sapiens
gctcctcacccctgtagg

SEQ ID NO: 629564 - DNA, 17 bp, Homo sapiens
gctcctccagtacaata

SEQ ID NO: 629565 - DNA, 18 bp, Homo sapiens
gctcctctgcagcctgag

SEQ ID NO: 629566 - DNA, 16 bp, Homo sapiens
gctcctgcccacgtgc

SEQ ID NO: 629567 - DNA, 18 bp, Homo sapiens
gctcctgcccacgtgcag

SEQ ID NO: 629568 - DNA, 22 bp, Homo sapiens
gctcctgcccacgtgcagcacc

SEQ ID NO: 629569 - DNA, 12 bp, Homo sapiens
gctcgccctgtg

SEQ ID NO: 629570 - DNA, 14 bp, Homo sapiens
gctcgccctgtgcc

SEQ ID NO: 629571 - DNA, 22 bp, Homo sapiens
gctcggccaggcacggaggctc

SEQ ID NO: 629572 - DNA, 15 bp, Homo sapiens
gctcgggaaggcctg

SEQ ID NO: 629573 - DNA, 18 bp, Homo sapiens
gctcgggaaggcctgagg

SEQ ID NO: 629574 - DNA, 19 bp, Homo sapiens
gctcgggaaggcctgaggg

SEQ ID NO: 629575 - DNA, 13 bp, Homo sapiens
gctcgtgcatgta

SEQ ID NO: 629576 - DNA, 14 bp, Homo sapiens
gctcgtgcatgtaa

SEQ ID NO: 629577 - DNA, 15 bp, Homo sapiens
gctctaaagcagaga

SEQ ID NO: 629578 - DNA, 16 bp, Homo sapiens
gctctctaagaattca

SEQ ID NO: 629579 - DNA, 16 bp, Homo sapiens
gctctctcacccagcc

SEQ ID NO: 629580 - DNA, 23 bp, Homo sapiens
gctctctcacccagcctggtact

SEQ ID NO: 629581 - DNA, 17 bp, Homo sapiens
gctctgaatctctcaaa

SEQ ID NO: 629582 - DNA, 20 bp, Homo sapiens
gctctgaatgctatttgtgt

SEQ ID NO: 629583 - DNA, 23 bp, Homo sapiens
gctctgaggctgccccaggggca

SEQ ID NO: 629584 - DNA, 19 bp, Homo sapiens
gctctgctcatctacacat

SEQ ID NO: 629585 - DNA, 15 bp, Homo sapiens
gctctggatgaaggc

SEQ ID NO: 629586 - DNA, 20 bp, Homo sapiens
gctcttcccaagtcctcgcc

SEQ ID NO: 629587 - DNA, 17 bp, Homo sapiens
gctcttgggtatgtaga

SEQ ID NO: 629588 - DNA, 22 bp, Homo sapiens
gctcttgggtatgtagaactgt

SEQ ID NO: 629589 - DNA, 12 bp, Homo sapiens
gctctttccctc

SEQ ID NO: 629590 - DNA, 20 bp, Homo sapiens
gctgaaattatgtcaaatgg

SEQ ID NO: 629591 - DNA, 16 bp, Homo sapiens
gctgaatgaagctgcc

SEQ ID NO: 629592 - DNA, 21 bp, Homo sapiens
gctgaatgaagctgccatcct

SEQ ID NO: 629593 - DNA, 21 bp, Homo sapiens
gctgaattttcacatgaacat

SEQ ID NO: 629594 - DNA, 14 bp, Homo sapiens
gctgactcagtgca

SEQ ID NO: 629595 - DNA, 15 bp, Homo sapiens
gctgactcagtgcag

SEQ ID NO: 629596 - DNA, 23 bp, Homo sapiens
gctgactcttactaaccaccatt

SEQ ID NO: 629597 - DNA, 20 bp, Homo sapiens
gctgagacacagcccagaga

SEQ ID NO: 629598 - DNA, 13 bp, Homo sapiens
gctgagcccctcc

SEQ ID NO: 629599 - DNA, 14 bp, Homo sapiens
gctgagcccctcct

SEQ ID NO: 629600 - DNA, 19 bp, Homo sapiens
gctgagcccctcctctcct

SEQ ID NO: 629601 - DNA, 17 bp, Homo sapiens
gctgaggacggggcaga

SEQ ID NO: 629602 - DNA, 20 bp, Homo sapiens
gctgaggacggggcagagct

SEQ ID NO: 629603 - DNA, 15 bp, Homo sapiens
gctgagggcagggtt

SEQ ID NO: 629604 - DNA, 20 bp, Homo sapiens
gctgagggggctctttccct

SEQ ID NO: 629605 - DNA, 15 bp, Homo sapiens
gctgagtcggctggg

SEQ ID NO: 629606 - DNA, 22 bp, Homo sapiens
gctgagtcggctgggcagggcc

SEQ ID NO: 629607 - DNA, 14 bp, Homo sapiens
gctgatagaagaag

SEQ ID NO: 629608 - DNA, 15 bp, Homo sapiens
gctgcaggaatcaaa

SEQ ID NO: 629609 - DNA, 16 bp, Homo sapiens
gctgcaggaatcaaaa

SEQ ID NO: 629610 - DNA, 18 bp, Homo sapiens
gctgcagtcagcacagag

SEQ ID NO: 629611 - DNA, 20 bp, Homo sapiens
gctgcagtcagcacagagag

SEQ ID NO: 629612 - DNA, 16 bp, Homo sapiens
gctgccaggctcccac

SEQ ID NO: 629613 - DNA, 18 bp, Homo sapiens
gctgccaggctcccactg

SEQ ID NO: 629614 - DNA, 20 bp, Homo sapiens
gctgcctcatgaccctcctg

SEQ ID NO: 629615 - DNA, 15 bp, Homo sapiens
gctgcctggcgggca

SEQ ID NO: 629616 - DNA, 16 bp, Homo sapiens
gctgcctggcgggcag

SEQ ID NO: 629617 - DNA, 17 bp, Homo sapiens
gctgcctggcgggcagc

SEQ ID NO: 629618 - DNA, 20 bp, Homo sapiens
gctgcctggcgggcagcccc

SEQ ID NO: 629619 - DNA, 14 bp, Homo sapiens
gctgcgcctgcccg

SEQ ID NO: 629620 - DNA, 17 bp, Homo sapiens
gctgcgcctgcccgccc

SEQ ID NO: 629621 - DNA, 23 bp, Homo sapiens
gctgcgctcccacctcggacacc

SEQ ID NO: 629622 - DNA, 16 bp, Homo sapiens
gctgctcccagcctct

SEQ ID NO: 629623 - DNA, 15 bp, Homo sapiens
gctgctcccggtgtg

SEQ ID NO: 629624 - DNA, 18 bp, Homo sapiens
gctgctcgggaaggcctg

SEQ ID NO: 629625 - DNA, 22 bp, Homo sapiens
gctgctgcagtcagcacagaga

SEQ ID NO: 629626 - DNA, 18 bp, Homo sapiens
gctgctgcctccctgggg

SEQ ID NO: 629627 - DNA, 16 bp, Homo sapiens
gctgctgcttctccct

SEQ ID NO: 629628 - DNA, 12 bp, Homo sapiens
gctgctggcgcc

SEQ ID NO: 629629 - DNA, 13 bp, Homo sapiens
gctgctggcgcct

SEQ ID NO: 629630 - DNA, 17 bp, Homo sapiens
gctgctggggcagggcc

SEQ ID NO: 629631 - DNA, 22 bp, Homo sapiens
gctgctggggcagggcccaggg

SEQ ID NO: 629632 - DNA, 15 bp, Homo sapiens
gctgctgtggcatca

SEQ ID NO: 629633 - DNA, 21 bp, Homo sapiens
gctgcttcaaggatcctgagc

SEQ ID NO: 629634 - DNA, 13 bp, Homo sapiens
gctgctttccaac

SEQ ID NO: 629635 - DNA, 21 bp, Homo sapiens
gctggagaccctgcgcccctg

SEQ ID NO: 629636 - DNA, 14 bp, Homo sapiens
gctggagccccatc

SEQ ID NO: 629637 - DNA, 14 bp, Homo sapiens
gctggataggagag

SEQ ID NO: 629638 - DNA, 16 bp, Homo sapiens
gctggatgtgctttca

SEQ ID NO: 629639 - DNA, 16 bp, Homo sapiens
gctggcacccactgga

SEQ ID NO: 629640 - DNA, 12 bp, Homo sapiens
gctggccctgcc

SEQ ID NO: 629641 - DNA, 19 bp, Homo sapiens
gctggccctgccctccccc

SEQ ID NO: 629642 - DNA, 19 bp, Homo sapiens
gctggccggtccaccccgt

SEQ ID NO: 629643 - DNA, 12 bp, Homo sapiens
gctggctggggc

SEQ ID NO: 629644 - DNA, 14 bp, Homo sapiens
gctggctggggccg

SEQ ID NO: 629645 - DNA, 15 bp, Homo sapiens
gctggctggggccgg

SEQ ID NO: 629646 - DNA, 15 bp, Homo sapiens
gctgggaaagaactt

SEQ ID NO: 629647 - DNA, 19 bp, Homo sapiens
gctgggaaagaacttggac

SEQ ID NO: 629648 - DNA, 21 bp, Homo sapiens
gctgggaacatgacccagcct

SEQ ID NO: 629649 - DNA, 23 bp, Homo sapiens
gctgggaacatgacccagcctga

SEQ ID NO: 629650 - DNA, 17 bp, Homo sapiens
gctgggcaccacaggct

SEQ ID NO: 629651 - DNA, 15 bp, Homo sapiens
gctgggcagggccgc

SEQ ID NO: 629652 - DNA, 17 bp, Homo sapiens
gctgggcagggccgcag

SEQ ID NO: 629653 - DNA, 12 bp, Homo sapiens
gctgggccaggg

SEQ ID NO: 629654 - DNA, 13 bp, Homo sapiens
gctgggccaggga

SEQ ID NO: 629655 - DNA, 14 bp, Homo sapiens
gctgggccagggaa

SEQ ID NO: 629656 - DNA, 15 bp, Homo sapiens
gctgggccctctgtc

SEQ ID NO: 629657 - DNA, 23 bp, Homo sapiens
gctggggcagggcccagggaggt

SEQ ID NO: 629658 - DNA, 12 bp, Homo sapiens
gctggggccggg

SEQ ID NO: 629659 - DNA, 17 bp, Homo sapiens
gctggggccggggctgc

SEQ ID NO: 629660 - DNA, 16 bp, Homo sapiens
gctgggggaggcggca

SEQ ID NO: 629661 - DNA, 14 bp, Homo sapiens
gctgggtcgcccct

SEQ ID NO: 629662 - DNA, 19 bp, Homo sapiens
gctgggtcgcccctcctcg

SEQ ID NO: 629663 - DNA, 17 bp, Homo sapiens
gctgggtttgggcagtg

SEQ ID NO: 629664 - DNA, 19 bp, Homo sapiens
gctggtgatggaggtttca

SEQ ID NO: 629665 - DNA, 21 bp, Homo sapiens
gctggtgatggaggtttcata

SEQ ID NO: 629666 - DNA, 18 bp, Homo sapiens
gctggtgggataggaggg

SEQ ID NO: 629667 - DNA, 19 bp, Homo sapiens
gctggtgggataggagggt

SEQ ID NO: 629668 - DNA, 15 bp, Homo sapiens
gctgtatttgaggaa

SEQ ID NO: 629669 - DNA, 17 bp, Homo sapiens
gctgtatttgaggaaac

SEQ ID NO: 629670 - DNA, 13 bp, Homo sapiens
gctgtcccctgca

SEQ ID NO: 629671 - DNA, 23 bp, Homo sapiens
gctgtccctgtgggctcacaccg

SEQ ID NO: 629672 - DNA, 15 bp, Homo sapiens
gctgtccgtcctgct

SEQ ID NO: 629673 - DNA, 21 bp, Homo sapiens
gctgtccgtcctgctcgccct

SEQ ID NO: 629674 - DNA, 14 bp, Homo sapiens
gctgtctgtggctt

SEQ ID NO: 629675 - DNA, 17 bp, Homo sapiens
gctgtctgtgtgaggct

SEQ ID NO: 629676 - DNA, 20 bp, Homo sapiens
gctgtgaaacagtgtggatg

SEQ ID NO: 629677 - DNA, 19 bp, Homo sapiens
gctgtgaccctcaattcat

SEQ ID NO: 629678 - DNA, 22 bp, Homo sapiens
gctgtgatttttgttgattaaa

SEQ ID NO: 629679 - DNA, 18 bp, Homo sapiens
gctgtggcccctccttct

SEQ ID NO: 629680 - DNA, 21 bp, Homo sapiens
gctgtggcccctccttctccc

SEQ ID NO: 629681 - DNA, 22 bp, Homo sapiens
gctgtgggggaggtccctgcca

SEQ ID NO: 629682 - DNA, 17 bp, Homo sapiens
gctgtgtagctctgtcc

SEQ ID NO: 629683 - DNA, 16 bp, Homo sapiens
gctgtgtgcagagtat

SEQ ID NO: 629684 - DNA, 17 bp, Homo sapiens
gctgtgttaagaggact

SEQ ID NO: 629685 - DNA, 13 bp, Homo sapiens
gctgttatctgtc

SEQ ID NO: 629686 - DNA, 20 bp, Homo sapiens
gctgttgtgtctggagcctg

SEQ ID NO: 629687 - DNA, 14 bp, Homo sapiens
gcttaacataaact

SEQ ID NO: 629688 - DNA, 22 bp, Homo sapiens
gcttaacataaacttgtactta

SEQ ID NO: 629689 - DNA, 19 bp, Homo sapiens
gcttaaggaaaagagaaac

SEQ ID NO: 629690 - DNA, 16 bp, Homo sapiens
gcttacagtgactgtg

SEQ ID NO: 629691 - DNA, 19 bp, Homo sapiens
gcttacctgttctctagtt

SEQ ID NO: 629692 - DNA, 13 bp, Homo sapiens
gcttagaatgggg

SEQ ID NO: 629693 - DNA, 14 bp, Homo sapiens
gcttagtatctcat

SEQ ID NO: 629694 - DNA, 14 bp, Homo sapiens
gcttcaaggatcct

SEQ ID NO: 629695 - DNA, 22 bp, Homo sapiens
gcttcaaggatcctgagccaga

SEQ ID NO: 629696 - DNA, 14 bp, Homo sapiens
gcttcattaaaaca

SEQ ID NO: 629697 - DNA, 15 bp, Homo sapiens
gcttcattaaaacaa

SEQ ID NO: 629698 - DNA, 16 bp, Homo sapiens
gcttcattaaaacaag

SEQ ID NO: 629699 - DNA, 23 bp, Homo sapiens
gcttccatggtggtttcagaaag

SEQ ID NO: 629700 - DNA, 20 bp, Homo sapiens
gcttccccattgccttctgg

SEQ ID NO: 629701 - DNA, 14 bp, Homo sapiens
gcttctccctgggg

SEQ ID NO: 629702 - DNA, 23 bp, Homo sapiens
gcttctccctggggaggacccct

SEQ ID NO: 629703 - DNA, 22 bp, Homo sapiens
gcttctctgccggtggggccag

SEQ ID NO: 629704 - DNA, 13 bp, Homo sapiens
gcttgaccctgaa

SEQ ID NO: 629705 - DNA, 19 bp, Homo sapiens
gcttgattctaaaggggac

SEQ ID NO: 629706 - DNA, 14 bp, Homo sapiens
gcttgcttctctgc

SEQ ID NO: 629707 - DNA, 21 bp, Homo sapiens
gcttggaacatttgggagact

SEQ ID NO: 629708 - DNA, 15 bp, Homo sapiens
gcttggagcagagac

SEQ ID NO: 629709 - DNA, 12 bp, Homo sapiens
gcttggagcccc

SEQ ID NO: 629710 - DNA, 15 bp, Homo sapiens
gcttggagccccctg

SEQ ID NO: 629711 - DNA, 18 bp, Homo sapiens
gcttgtagggtgaggcgt

SEQ ID NO: 629712 - DNA, 15 bp, Homo sapiens
gcttgttcagtcact

SEQ ID NO: 629713 - DNA, 22 bp, Homo sapiens
gcttgttcttcctcttacctgt

SEQ ID NO: 629714 - DNA, 17 bp, Homo sapiens
gctttagagaagccata

SEQ ID NO: 629715 - DNA, 18 bp, Homo sapiens
gctttagagaagccataa

SEQ ID NO: 629716 - DNA, 21 bp, Homo sapiens
gctttcagtgcctgctgttcg

SEQ ID NO: 629717 - DNA, 19 bp, Homo sapiens
gctttcatccaactggaag

SEQ ID NO: 629718 - DNA, 18 bp, Homo sapiens
gctttccctgaggaatga

SEQ ID NO: 629719 - DNA, 11 bp, Homo sapiens
gctttctcatg

SEQ ID NO: 629720 - DNA, 13 bp, Homo sapiens
gctttctcatgca

SEQ ID NO: 629721 - DNA, 16 bp, Homo sapiens
gctttggaagcagcaa

SEQ ID NO: 629722 - DNA, 20 bp, Homo sapiens
gctttggggcttatcagaac

SEQ ID NO: 629723 - DNA, 17 bp, Homo sapiens
gcttttcccacctcttt

SEQ ID NO: 629724 - DNA, 20 bp, Homo sapiens
gcttttgtacgttaattaaa

SEQ ID NO: 629725 - DNA, 11 bp, Homo sapiens
gctttttctga

SEQ ID NO: 629726 - DNA, 14 bp, Homo sapiens
gctttttctgactc

SEQ ID NO: 629727 - DNA, 20 bp, Homo sapiens
ggaaaagcactttacagatg

SEQ ID NO: 629728 - DNA, 20 bp, Homo sapiens
ggaaaaggcttgagtctgga

SEQ ID NO: 629729 - DNA, 19 bp, Homo sapiens
ggaaaccaccttaaaacat

SEQ ID NO: 629730 - DNA, 18 bp, Homo sapiens
ggaaagggtgtggcttgg

SEQ ID NO: 629731 - DNA, 22 bp, Homo sapiens
ggaaatcaatttaaaggaaagt

SEQ ID NO: 629732 - DNA, 14 bp, Homo sapiens
ggaaatcaccgaaa

SEQ ID NO: 629733 - DNA, 14 bp, Homo sapiens
ggaaatgctgattt

SEQ ID NO: 629734 - DNA, 12 bp, Homo sapiens
ggaacagccctg

SEQ ID NO: 629735 - DNA, 13 bp, Homo sapiens
ggaacagccctgc

SEQ ID NO: 629736 - DNA, 17 bp, Homo sapiens
ggaacatttgggagact

SEQ ID NO: 629737 - DNA, 23 bp, Homo sapiens
ggaagaacctgtagaagatgacc

SEQ ID NO: 629738 - DNA, 14 bp, Homo sapiens
ggaagaagggccac

SEQ ID NO: 629739 - DNA, 22 bp, Homo sapiens
ggaagaagggccaccctgagca

SEQ ID NO: 629740 - DNA, 16 bp, Homo sapiens
ggaagagaagaaatag

SEQ ID NO: 629741 - DNA, 17 bp, Homo sapiens
ggaagagctgctgtatt

SEQ ID NO: 629742 - DNA, 11 bp, Homo sapiens
ggaagcagcaa

SEQ ID NO: 629743 - DNA, 16 bp, Homo sapiens
ggaagcccacccgccc

SEQ ID NO: 629744 - DNA, 22 bp, Homo sapiens
ggaagcccacccgccccagaga

SEQ ID NO: 629745 - DNA, 24 bp, Homo sapiens
ggaagcccacccgccccagagact

SEQ ID NO: 629746 - DNA, 15 bp, Homo sapiens
ggaaggcctgaggga

SEQ ID NO: 629747 - DNA, 21 bp, Homo sapiens
ggaaggcctgagggaagccca

SEQ ID NO: 629748 - DNA, 16 bp, Homo sapiens
ggaaggggtgtcagta

SEQ ID NO: 629749 - DNA, 18 bp, Homo sapiens
ggaagggtgcctggctgg

SEQ ID NO: 629750 - DNA, 20 bp, Homo sapiens
ggaagggtgcctggctgggc

SEQ ID NO: 629751 - DNA, 20 bp, Homo sapiens
ggaaggttagaaaggcagcc

SEQ ID NO: 629752 - DNA, 17 bp, Homo sapiens
ggaagtacataaagtaa

SEQ ID NO: 629753 - DNA, 20 bp, Homo sapiens
ggaataagaagcaaataaat

SEQ ID NO: 629754 - DNA, 21 bp, Homo sapiens
ggaatgaccagaaaatttttg

SEQ ID NO: 629755 - DNA, 12 bp, Homo sapiens
ggaatgctcaat

SEQ ID NO: 629756 - DNA, 21 bp, Homo sapiens
ggaatggggggcgggccaggg

SEQ ID NO: 629757 - DNA, 11 bp, Homo sapiens
ggacacagagg

SEQ ID NO: 629758 - DNA, 23 bp, Homo sapiens
ggacacagaggacagcttcccca

SEQ ID NO: 629759 - DNA, 20 bp, Homo sapiens
ggacacagcacaagggcaca

SEQ ID NO: 629760 - DNA, 15 bp, Homo sapiens
ggacaccctcctgcc

SEQ ID NO: 629761 - DNA, 18 bp, Homo sapiens
ggacaccctcctgccccc

SEQ ID NO: 629762 - DNA, 21 bp, Homo sapiens
ggacactgatgggtcctgctg

SEQ ID NO: 629763 - DNA, 24 bp, Homo sapiens
ggacactgatgggtcctgctgctc

SEQ ID NO: 629764 - DNA, 23 bp, Homo sapiens
ggacagaaccaacgggtctgtgg

SEQ ID NO: 629765 - DNA, 15 bp, Homo sapiens
ggacagcggcccggc

SEQ ID NO: 629766 - DNA, 18 bp, Homo sapiens
ggacagcggcccggccca

SEQ ID NO: 629767 - DNA, 22 bp, Homo sapiens
ggaccaaggtgcggaccggagc

SEQ ID NO: 629768 - DNA, 14 bp, Homo sapiens
ggacccccccagtc

SEQ ID NO: 629769 - DNA, 11 bp, Homo sapiens
ggaccggacgc

SEQ ID NO: 629770 - DNA, 17 bp, Homo sapiens
ggaccggacgcatgcag

SEQ ID NO: 629771 - DNA, 22 bp, Homo sapiens
ggaccggagcggctgaggacgg

SEQ ID NO: 629772 - DNA, 14 bp, Homo sapiens
ggacgagcagagcg

SEQ ID NO: 629773 - DNA, 18 bp, Homo sapiens
ggacgagcagagcgcagc

SEQ ID NO: 629774 - DNA, 21 bp, Homo sapiens
ggacgagcagagcgcagcccc

SEQ ID NO: 629775 - DNA, 23 bp, Homo sapiens
ggacgagcagagcgcagccccca

SEQ ID NO: 629776 - DNA, 17 bp, Homo sapiens
ggacgcatgcagggccc

SEQ ID NO: 629777 - DNA, 18 bp, Homo sapiens
ggacgcatgcagggcccc

SEQ ID NO: 629778 - DNA, 18 bp, Homo sapiens
ggacgctggagaccctgc

SEQ ID NO: 629779 - DNA, 19 bp, Homo sapiens
ggacgctggagaccctgcg

SEQ ID NO: 629780 - DNA, 13 bp, Homo sapiens
ggacggaagtggc

SEQ ID NO: 629781 - DNA, 17 bp, Homo sapiens
ggacgtcgctgtccgtc

SEQ ID NO: 629782 - DNA, 16 bp, Homo sapiens
ggactccagaagcagc

SEQ ID NO: 629783 - DNA, 23 bp, Homo sapiens
ggactgaccttcggcagtggctg

SEQ ID NO: 629784 - DNA, 19 bp, Homo sapiens
ggactgctttcagtgcctg

SEQ ID NO: 629785 - DNA, 20 bp, Homo sapiens
ggactgctttcagtgcctgc

SEQ ID NO: 629786 - DNA, 21 bp, Homo sapiens
ggactgtcttcaaccctgccc

SEQ ID NO: 629787 - DNA, 16 bp, Homo sapiens
ggacttaatttagcag

SEQ ID NO: 629788 - DNA, 21 bp, Homo sapiens
ggacttggtgattacctgaaa

SEQ ID NO: 629789 - DNA, 18 bp, Homo sapiens
ggagaaaggcaaaccaat

SEQ ID NO: 629790 - DNA, 22 bp, Homo sapiens
ggagaccctatttgtttcatta

SEQ ID NO: 629791 - DNA, 13 bp, Homo sapiens
ggagaccctgcgc

SEQ ID NO: 629792 - DNA, 18 bp, Homo sapiens
ggagaccctgcgcccctg

SEQ ID NO: 629793 - DNA, 19 bp, Homo sapiens
ggagaccctgcgcccctgc

SEQ ID NO: 629794 - DNA, 17 bp, Homo sapiens
ggagactccaaggagct

SEQ ID NO: 629795 - DNA, 21 bp, Homo sapiens
ggagactccaaggagctactg

SEQ ID NO: 629796 - DNA, 20 bp, Homo sapiens
ggagagagaggctgcctcag

SEQ ID NO: 629797 - DNA, 13 bp, Homo sapiens
ggagagcagcagg

SEQ ID NO: 629798 - DNA, 18 bp, Homo sapiens
ggagagcagcaggtgctg

SEQ ID NO: 629799 - DNA, 22 bp, Homo sapiens
ggagaggtcttgctcacaggga

SEQ ID NO: 629800 - DNA, 21 bp, Homo sapiens
ggagagtggcaggtgggctgc

SEQ ID NO: 629801 - DNA, 13 bp, Homo sapiens
ggagatgggaagg

SEQ ID NO: 629802 - DNA, 14 bp, Homo sapiens
ggagattgctctgg

SEQ ID NO: 629803 - DNA, 15 bp, Homo sapiens
ggagcacccccagcc

SEQ ID NO: 629804 - DNA, 20 bp, Homo sapiens
ggagcactagaatgagaaat

SEQ ID NO: 629805 - DNA, 23 bp, Homo sapiens
ggagcagagacggcagccccatc

SEQ ID NO: 629806 - DNA, 21 bp, Homo sapiens
ggagcatgtcctatccctgga

SEQ ID NO: 629807 - DNA, 14 bp, Homo sapiens
ggagccagggcaga

SEQ ID NO: 629808 - DNA, 14 bp, Homo sapiens
ggagcccccgcccc

SEQ ID NO: 629809 - DNA, 16 bp, Homo sapiens
ggagccccctggcggc

SEQ ID NO: 629810 - DNA, 22 bp, Homo sapiens
ggagccccctggcggcaggggt

SEQ ID NO: 629811 - DNA, 15 bp, Homo sapiens
ggagccgcagaggcc

SEQ ID NO: 629812 - DNA, 15 bp, Homo sapiens
ggagcctgcaggcag

SEQ ID NO: 629813 - DNA, 14 bp, Homo sapiens
ggagcggctgagga

SEQ ID NO: 629814 - DNA, 21 bp, Homo sapiens
ggagcgggggctaactggccc

SEQ ID NO: 629815 - DNA, 14 bp, Homo sapiens
ggagcttggagccc

SEQ ID NO: 629816 - DNA, 11 bp, Homo sapiens
ggaggacagaa

SEQ ID NO: 629817 - DNA, 19 bp, Homo sapiens
ggaggacagagtgccctgg

SEQ ID NO: 629818 - DNA, 18 bp, Homo sapiens
ggaggacctggggggggc

SEQ ID NO: 629819 - DNA, 16 bp, Homo sapiens
ggaggactgttctaac

SEQ ID NO: 629820 - DNA, 17 bp, Homo sapiens
ggaggagaaggaggaac

SEQ ID NO: 629821 - DNA, 18 bp, Homo sapiens
ggaggagcacccccagcc

SEQ ID NO: 629822 - DNA, 20 bp, Homo sapiens
ggaggagccttgctgggcca

SEQ ID NO: 629823 - DNA, 12 bp, Homo sapiens
ggaggcccctga

SEQ ID NO: 629824 - DNA, 14 bp, Homo sapiens
ggaggcctggtctg

SEQ ID NO: 629825 - DNA, 17 bp, Homo sapiens
ggaggcctggtctggag

SEQ ID NO: 629826 - DNA, 17 bp, Homo sapiens
ggaggcgcccacctgcc

SEQ ID NO: 629827 - DNA, 23 bp, Homo sapiens
ggaggcgcccacctgcccagtta

SEQ ID NO: 629828 - DNA, 21 bp, Homo sapiens
ggaggcggcacattggcagtg

SEQ ID NO: 629829 - DNA, 21 bp, Homo sapiens
ggaggctgagacgcaaggatc

SEQ ID NO: 629830 - DNA, 12 bp, Homo sapiens
ggaggctgctgc

SEQ ID NO: 629831 - DNA, 15 bp, Homo sapiens
ggaggctgctgcccc

SEQ ID NO: 629832 - DNA, 16 bp, Homo sapiens
ggaggctgctgccccc

SEQ ID NO: 629833 - DNA, 15 bp, Homo sapiens
ggagggacacagagg

SEQ ID NO: 629834 - DNA, 18 bp, Homo sapiens
ggaggggtgttaaaacat

SEQ ID NO: 629835 - DNA, 14 bp, Homo sapiens
ggaggtggcaggga

SEQ ID NO: 629836 - DNA, 19 bp, Homo sapiens
ggaggttccggtgtctgga

SEQ ID NO: 629837 - DNA, 22 bp, Homo sapiens
ggagtcagggctgtgctttccg

SEQ ID NO: 629838 - DNA, 14 bp, Homo sapiens
ggagtccactttcc

SEQ ID NO: 629839 - DNA, 18 bp, Homo sapiens
ggagtctgaaggagagga

SEQ ID NO: 629840 - DNA, 21 bp, Homo sapiens
ggagtggaggggtcagcaggg

SEQ ID NO: 629841 - DNA, 13 bp, Homo sapiens
ggagttgcctgac

SEQ ID NO: 629842 - DNA, 14 bp, Homo sapiens
ggataatgagatgt

SEQ ID NO: 629843 - DNA, 20 bp, Homo sapiens
ggatagcagagaagcctgtc

SEQ ID NO: 629844 - DNA, 12 bp, Homo sapiens
ggatccagagag

SEQ ID NO: 629845 - DNA, 22 bp, Homo sapiens
ggatctggagtctgaaggagag

SEQ ID NO: 629846 - DNA, 14 bp, Homo sapiens
ggatgatttaacat

SEQ ID NO: 629847 - DNA, 19 bp, Homo sapiens
ggatgcccctggccctgcc

SEQ ID NO: 629848 - DNA, 20 bp, Homo sapiens
ggatgcccctggccctgcct

SEQ ID NO: 629849 - DNA, 22 bp, Homo sapiens
ggatgcccctggccctgcctca

SEQ ID NO: 629850 - DNA, 15 bp, Homo sapiens
ggatgtatgtgtata

SEQ ID NO: 629851 - DNA, 15 bp, Homo sapiens
ggatgtgagtttaat

SEQ ID NO: 629852 - DNA, 12 bp, Homo sapiens
ggatgtgctttc

SEQ ID NO: 629853 - DNA, 12 bp, Homo sapiens
ggattcaggaat

SEQ ID NO: 629854 - DNA, 17 bp, Homo sapiens
ggattcctcccctggaa

SEQ ID NO: 629855 - DNA, 18 bp, Homo sapiens
ggattctcctttttaccc

SEQ ID NO: 629856 - DNA, 13 bp, Homo sapiens
ggattttaaacaa

SEQ ID NO: 629857 - DNA, 19 bp, Homo sapiens
ggattttaaacaaaattta

SEQ ID NO: 629858 - DNA, 21 bp, Homo sapiens
ggcaaaaatttgacattgtca

SEQ ID NO: 629859 - DNA, 11 bp, Homo sapiens
ggcaaacattt

SEQ ID NO: 629860 - DNA, 20 bp, Homo sapiens
ggcaaaccaatttgttctgt

SEQ ID NO: 629861 - DNA, 21 bp, Homo sapiens
ggcaaaccaatttgttctgtg

SEQ ID NO: 629862 - DNA, 18 bp, Homo sapiens
ggcaaagaactgccccat

SEQ ID NO: 629863 - DNA, 20 bp, Homo sapiens
ggcaaagaactgccccatct

SEQ ID NO: 629864 - DNA, 15 bp, Homo sapiens
ggcaacgttcatgtt

SEQ ID NO: 629865 - DNA, 18 bp, Homo sapiens
ggcaagagctcaggagaa

SEQ ID NO: 629866 - DNA, 21 bp, Homo sapiens
ggcaagagctcaggagaaggc

SEQ ID NO: 629867 - DNA, 15 bp, Homo sapiens
ggcaaggaagctttg

SEQ ID NO: 629868 - DNA, 14 bp, Homo sapiens
ggcacactgagcaa

SEQ ID NO: 629869 - DNA, 18 bp, Homo sapiens
ggcacatgacagtggtta

SEQ ID NO: 629870 - DNA, 14 bp, Homo sapiens
ggcacattgcccat

SEQ ID NO: 629871 - DNA, 19 bp, Homo sapiens
ggcacattgcccatggctg

SEQ ID NO: 629872 - DNA, 17 bp, Homo sapiens
ggcaccctgcaggcagg

SEQ ID NO: 629873 - DNA, 14 bp, Homo sapiens
ggcaccgcccaccc

SEQ ID NO: 629874 - DNA, 21 bp, Homo sapiens
ggcaccgcccacccacacccc

SEQ ID NO: 629875 - DNA, 18 bp, Homo sapiens
ggcacgggagagcgccac

SEQ ID NO: 629876 - DNA, 16 bp, Homo sapiens
ggcagaatggtgggct

SEQ ID NO: 629877 - DNA, 21 bp, Homo sapiens
ggcagaatggtgggctccaga

SEQ ID NO: 629878 - DNA, 22 bp, Homo sapiens
ggcagaatggtgggctccagag

SEQ ID NO: 629879 - DNA, 23 bp, Homo sapiens
ggcagagaccaccgcgcccctct

SEQ ID NO: 629880 - DNA, 16 bp, Homo sapiens
ggcagagacctcctga

SEQ ID NO: 629881 - DNA, 20 bp, Homo sapiens
ggcagagctgagtcggctgg

SEQ ID NO: 629882 - DNA, 21 bp, Homo sapiens
ggcagagctgagtcggctggg

SEQ ID NO: 629883 - DNA, 22 bp, Homo sapiens
ggcagagctgagtcggctgggc

SEQ ID NO: 629884 - DNA, 23 bp, Homo sapiens
ggcagagctgagtcggctgggca

SEQ ID NO: 629885 - DNA, 23 bp, Homo sapiens
ggcagaggaatgtagggcctgca

SEQ ID NO: 629886 - DNA, 12 bp, Homo sapiens
ggcagaggcagg

SEQ ID NO: 629887 - DNA, 14 bp, Homo sapiens
ggcagattaataac

SEQ ID NO: 629888 - DNA, 14 bp, Homo sapiens
ggcagcagcagcag

SEQ ID NO: 629889 - DNA, 20 bp, Homo sapiens
ggcagcatgcgatgtcatat

SEQ ID NO: 629890 - DNA, 15 bp, Homo sapiens
ggcagccccatcctt

SEQ ID NO: 629891 - DNA, 19 bp, Homo sapiens
ggcagccccatccttcccg

SEQ ID NO: 629892 - DNA, 22 bp, Homo sapiens
ggcagccccatccttcccgcag

SEQ ID NO: 629893 - DNA, 23 bp, Homo sapiens
ggcagccccgcgaccacccctgt

SEQ ID NO: 629894 - DNA, 13 bp, Homo sapiens
ggcagcccctccc

SEQ ID NO: 629895 - DNA, 14 bp, Homo sapiens
ggcagcccctgctg

SEQ ID NO: 629896 - DNA, 15 bp, Homo sapiens
ggcagcccctgctgg

SEQ ID NO: 629897 - DNA, 18 bp, Homo sapiens
ggcagcccctgctggacc

SEQ ID NO: 629898 - DNA, 19 bp, Homo sapiens
ggcagcccctgctggacca

SEQ ID NO: 629899 - DNA, 21 bp, Homo sapiens
ggcagcccctgctggaccaag

SEQ ID NO: 629900 - DNA, 13 bp, Homo sapiens
ggcagccctcacc

SEQ ID NO: 629901 - DNA, 11 bp, Homo sapiens
ggcagcctgtg

SEQ ID NO: 629902 - DNA, 22 bp, Homo sapiens
ggcagctgcagttagcacagag

SEQ ID NO: 629903 - DNA, 16 bp, Homo sapiens
ggcagcttgagcctgt

SEQ ID NO: 629904 - DNA, 19 bp, Homo sapiens
ggcagcttgagcctgtcac

SEQ ID NO: 629905 - DNA, 20 bp, Homo sapiens
ggcagggaagggtgcctggc

SEQ ID NO: 629906 - DNA, 23 bp, Homo sapiens
ggcagggaagggtgcctggctgg

SEQ ID NO: 629907 - DNA, 15 bp, Homo sapiens
ggcagggagggggct

SEQ ID NO: 629908 - DNA, 18 bp, Homo sapiens
ggcagggagggggctggg

SEQ ID NO: 629909 - DNA, 23 bp, Homo sapiens
ggcagggccctggggtctctgag

SEQ ID NO: 629910 - DNA, 20 bp, Homo sapiens
ggcaggggttggcagcgcct

SEQ ID NO: 629911 - DNA, 16 bp, Homo sapiens
ggcaggtgggctgcct

SEQ ID NO: 629912 - DNA, 23 bp, Homo sapiens
ggcaggtgggctgcctgctgtgt

SEQ ID NO: 629913 - DNA, 13 bp, Homo sapiens
ggcagtgcagtgc

SEQ ID NO: 629914 - DNA, 13 bp, Homo sapiens
ggcagtggagagg

SEQ ID NO: 629915 - DNA, 12 bp, Homo sapiens
ggcagtggctgg

SEQ ID NO: 629916 - DNA, 13 bp, Homo sapiens
ggcagtggctggg

SEQ ID NO: 629917 - DNA, 16 bp, Homo sapiens
ggcatattattttctg

SEQ ID NO: 629918 - DNA, 15 bp, Homo sapiens
ggcatcaggaaagga

SEQ ID NO: 629919 - DNA, 16 bp, Homo sapiens
ggcatccaccttcctg

SEQ ID NO: 629920 - DNA, 20 bp, Homo sapiens
ctcaaagaggccagtacttt

SEQ ID NO: 629921 - DNA, 16 bp, Homo sapiens
ctcaaatctgctttca

SEQ ID NO: 629922 - DNA, 18 bp, Homo sapiens
ctcaacctctcagatccc

SEQ ID NO: 629923 - DNA, 13 bp, Homo sapiens
ctcaagccaggag

SEQ ID NO: 629924 - DNA, 19 bp, Homo sapiens
ctcaagtcggtgggcctgc

SEQ ID NO: 629925 - DNA, 20 bp, Homo sapiens
ctcaatgccaggcagtgcag

SEQ ID NO: 629926 - DNA, 13 bp, Homo sapiens
ctcaatgtgctgt

SEQ ID NO: 629927 - DNA, 22 bp, Homo sapiens
ctcaattatcttggaaaaatgc

SEQ ID NO: 629928 - DNA, 13 bp, Homo sapiens
ctcacaaaaggct

SEQ ID NO: 629929 - DNA, 18 bp, Homo sapiens
ctcacacctcccttcatc

SEQ ID NO: 629930 - DNA, 20 bp, Homo sapiens
ctcacacctcccttcatccc

SEQ ID NO: 629931 - DNA, 19 bp, Homo sapiens
ctcacagcacatttgttaa

SEQ ID NO: 629932 - DNA, 22 bp, Homo sapiens
ctcaccatttaatcatttccag

SEQ ID NO: 629933 - DNA, 22 bp, Homo sapiens
ctcacccactttggcctccgtt

SEQ ID NO: 629934 - DNA, 13 bp, Homo sapiens
ctcacccagcctg

SEQ ID NO: 629935 - DNA, 14 bp, Homo sapiens
ctcacccctgtagg

SEQ ID NO: 629936 - DNA, 18 bp, Homo sapiens
ctcacccctgtagggaaa

SEQ ID NO: 629937 - DNA, 24 bp, Homo sapiens
ctcacccggcaaggggcgcgcgcc

SEQ ID NO: 629938 - DNA, 12 bp, Homo sapiens
ctcacctctgag

SEQ ID NO: 629939 - DNA, 23 bp, Homo sapiens
ctcacgtctgtgagtctgtcctt

SEQ ID NO: 629940 - DNA, 16 bp, Homo sapiens
ctcactacatgggcca

SEQ ID NO: 629941 - DNA, 16 bp, Homo sapiens
ctcactccactcccct

SEQ ID NO: 629942 - DNA, 17 bp, Homo sapiens
ctcactgacttctcccg

SEQ ID NO: 629943 - DNA, 21 bp, Homo sapiens
ctcactgggtgtggcctggct

SEQ ID NO: 629944 - DNA, 22 bp, Homo sapiens
ctcactgggtgtggcctggctt

SEQ ID NO: 629945 - DNA, 20 bp, Homo sapiens
ctcacttgtggcagcttccc

SEQ ID NO: 629946 - DNA, 15 bp, Homo sapiens
ctcagaagtgaaaaa

SEQ ID NO: 629947 - DNA, 19 bp, Homo sapiens
ctcagaagtgaaaaagact

SEQ ID NO: 629948 - DNA, 17 bp, Homo sapiens
ctcagaggagaggagca

SEQ ID NO: 629949 - DNA, 18 bp, Homo sapiens
ctcagaggagaggagcaa

SEQ ID NO: 629950 - DNA, 15 bp, Homo sapiens
ctcagatccctcggt

SEQ ID NO: 629951 - DNA, 22 bp, Homo sapiens
ctcagatccctcggtcagcacc

SEQ ID NO: 629952 - DNA, 14 bp, Homo sapiens
ctcagatggggcct

SEQ ID NO: 629953 - DNA, 20 bp, Homo sapiens
ctcagatggggcctgggctg

SEQ ID NO: 629954 - DNA, 21 bp, Homo sapiens
ctcagatggggcctgggctgt

SEQ ID NO: 629955 - DNA, 18 bp, Homo sapiens
ctcagcagccccctgccc

SEQ ID NO: 629956 - DNA, 19 bp, Homo sapiens
ctcagcagccccctgcccg

SEQ ID NO: 629957 - DNA, 17 bp, Homo sapiens
ctcagcatcctggaaat

SEQ ID NO: 629958 - DNA, 23 bp, Homo sapiens
ctcagcatcctggaaatttgtgt

SEQ ID NO: 629959 - DNA, 19 bp, Homo sapiens
ctcagccagtggcacagga

SEQ ID NO: 629960 - DNA, 22 bp, Homo sapiens
ctcagccagtggcacaggagac

SEQ ID NO: 629961 - DNA, 19 bp, Homo sapiens
ctcagcccatcccctgcct

SEQ ID NO: 629962 - DNA, 20 bp, Homo sapiens
ctcagcccatcccctgcctc

SEQ ID NO: 629963 - DNA, 21 bp, Homo sapiens
ctcagcccatcccctgcctct

SEQ ID NO: 629964 - DNA, 17 bp, Homo sapiens
ctcagcccctcagagaa

SEQ ID NO: 629965 - DNA, 16 bp, Homo sapiens
ctcagccctcattaaa

SEQ ID NO: 629966 - DNA, 14 bp, Homo sapiens
ctcagctccactct

SEQ ID NO: 629967 - DNA, 19 bp, Homo sapiens
ctcagctccactctgaagt

SEQ ID NO: 629968 - DNA, 16 bp, Homo sapiens
ctcagctgtctgtggc

SEQ ID NO: 629969 - DNA, 23 bp, Homo sapiens
ctcaggagaaggcctgcccccct

SEQ ID NO: 629970 - DNA, 13 bp, Homo sapiens
ctcaggagcacag

SEQ ID NO: 629971 - DNA, 14 bp, Homo sapiens
ctcaggagcacagc

SEQ ID NO: 629972 - DNA, 15 bp, Homo sapiens
ctcaggagcacagcc

SEQ ID NO: 629973 - DNA, 17 bp, Homo sapiens
ctcaggagcacagccat

SEQ ID NO: 629974 - DNA, 13 bp, Homo sapiens
ctcaggcagcctg

SEQ ID NO: 629975 - DNA, 16 bp, Homo sapiens
ctcaggcagcctgtgg

SEQ ID NO: 629976 - DNA, 14 bp, Homo sapiens
ctcaggctttctat

SEQ ID NO: 629977 - DNA, 16 bp, Homo sapiens
ctcagggaccaaggag

SEQ ID NO: 629978 - DNA, 23 bp, Homo sapiens
ctcagggaccaaggagatgggga

SEQ ID NO: 629979 - DNA, 17 bp, Homo sapiens
ctcaggtggcatttgca

SEQ ID NO: 629980 - DNA, 18 bp, Homo sapiens
ctcaggtggcatttgcag

SEQ ID NO: 629981 - DNA, 18 bp, Homo sapiens
ctcagtaacacagtgcag

SEQ ID NO: 629982 - DNA, 23 bp, Homo sapiens
ctcagtatgctttccctgaggaa

SEQ ID NO: 629983 - DNA, 17 bp, Homo sapiens
ctcagtattgacgacct

SEQ ID NO: 629984 - DNA, 19 bp, Homo sapiens
ctcagtgcagggacagcct

SEQ ID NO: 629985 - DNA, 21 bp, Homo sapiens
ctcagtgcagggacagcctgc

SEQ ID NO: 629986 - DNA, 24 bp, Homo sapiens
ctcagtgcagggacagcctgcaca

SEQ ID NO: 629987 - DNA, 19 bp, Homo sapiens
ctcataagtaaatgtcttc

SEQ ID NO: 629988 - DNA, 21 bp, Homo sapiens
ctcatagatgacccccaggta

SEQ ID NO: 629989 - DNA, 13 bp, Homo sapiens
ctcatagcacatg

SEQ ID NO: 629990 - DNA, 19 bp, Homo sapiens
ctcatagcatagccagcat

SEQ ID NO: 629991 - DNA, 21 bp, Homo sapiens
ctcatcaggtaaactgatgct

SEQ ID NO: 629992 - DNA, 22 bp, Homo sapiens
ctcatccactaggtgcccagtc

SEQ ID NO: 629993 - DNA, 17 bp, Homo sapiens
ctcatcccccatcagat

SEQ ID NO: 629994 - DNA, 22 bp, Homo sapiens
ctcatctgtaaaaccaggctga

SEQ ID NO: 629995 - DNA, 21 bp, Homo sapiens
ctcatcttgtaaataatgctt

SEQ ID NO: 629996 - DNA, 20 bp, Homo sapiens
ctcatgaccctcctgtccag

SEQ ID NO: 629997 - DNA, 13 bp, Homo sapiens
ctcatgttttata

SEQ ID NO: 629998 - DNA, 18 bp, Homo sapiens
ctcatttggatataaatc

SEQ ID NO: 629999 - DNA, 13 bp, Homo sapiens
ctccaaatgctgt

SEQ ID NO: 630000 - DNA, 21 bp, Homo sapiens
ctccaagacagccatacttcc

SEQ ID NO: 630001 - DNA, 13 bp, Homo sapiens
ctccacacctcca

SEQ ID NO: 630002 - DNA, 14 bp, Homo sapiens
ctccacacctccac

SEQ ID NO: 630003 - DNA, 16 bp, Homo sapiens
ctccacacctccaccc

SEQ ID NO: 630004 - DNA, 14 bp, Homo sapiens
ctccacagtagcat

SEQ ID NO: 630005 - DNA, 12 bp, Homo sapiens
ctccacccctca

SEQ ID NO: 630006 - DNA, 22 bp, Homo sapiens
ctccacccctcaagccaggaga

SEQ ID NO: 630007 - DNA, 22 bp, Homo sapiens
ctccaccctccggccagcgagt

SEQ ID NO: 630008 - DNA, 14 bp, Homo sapiens
ctccaccctgagcc

SEQ ID NO: 630009 - DNA, 19 bp, Homo sapiens
ctccaccctgagcctgacc

SEQ ID NO: 630010 - DNA, 14 bp, Homo sapiens
ctccactcccctca

SEQ ID NO: 630011 - DNA, 17 bp, Homo sapiens
ctccactcccctcatcc

SEQ ID NO: 630012 - DNA, 16 bp, Homo sapiens
ctccactcctcccaac

SEQ ID NO: 630013 - DNA, 22 bp, Homo sapiens
ctccagaagcagcagctagaaa

SEQ ID NO: 630014 - DNA, 20 bp, Homo sapiens
ctccagacccctaccctttc

SEQ ID NO: 630015 - DNA, 21 bp, Homo sapiens
ctccagacccctaccctttcc

SEQ ID NO: 630016 - DNA, 23 bp, Homo sapiens
ctccagacccctaccctttccca

SEQ ID NO: 630017 - DNA, 18 bp, Homo sapiens
ctccagactcgagagggc

SEQ ID NO: 630018 - DNA, 15 bp, Homo sapiens
ctccagattattttc

SEQ ID NO: 630019 - DNA, 18 bp, Homo sapiens
ctccagattattttctat

SEQ ID NO: 630020 - DNA, 23 bp, Homo sapiens
ctccagattattttctatatttg

SEQ ID NO: 630021 - DNA, 18 bp, Homo sapiens
ctccagccacttatttcc

SEQ ID NO: 630022 - DNA, 17 bp, Homo sapiens
ctccagcccatgctggc

SEQ ID NO: 630023 - DNA, 19 bp, Homo sapiens
ctccagcccatgctggctg

SEQ ID NO: 630024 - DNA, 22 bp, Homo sapiens
ctccaggaagggaccccactgg

SEQ ID NO: 630025 - DNA, 16 bp, Homo sapiens
ctccatgccccagctc

SEQ ID NO: 630026 - DNA, 19 bp, Homo sapiens
ctccatgccccagctctgg

SEQ ID NO: 630027 - DNA, 20 bp, Homo sapiens
ctccatgccccagctctgga

SEQ ID NO: 630028 - DNA, 18 bp, Homo sapiens
ctccatgctgtccctgtg

SEQ ID NO: 630029 - DNA, 13 bp, Homo sapiens
ctccattcctgag

SEQ ID NO: 630030 - DNA, 15 bp, Homo sapiens
ctccattcctgagta

SEQ ID NO: 630031 - DNA, 17 bp, Homo sapiens
ctccattcttttaaatc

SEQ ID NO: 630032 - DNA, 22 bp, Homo sapiens
ctctccggatggaatcacagcc

SEQ ID NO: 630033 - DNA, 23 bp, Homo sapiens
ctctccggatggaatcacagcca

SEQ ID NO: 630034 - DNA, 13 bp, Homo sapiens
ctctcctcggtgg

SEQ ID NO: 630035 - DNA, 17 bp, Homo sapiens
ctctcctctctctccct

SEQ ID NO: 630036 - DNA, 18 bp, Homo sapiens
ctctcctctctctccctc

SEQ ID NO: 630037 - DNA, 16 bp, Homo sapiens
ctctcctgagcctgtc

SEQ ID NO: 630038 - DNA, 18 bp, Homo sapiens
ctctctaagaattcagta

SEQ ID NO: 630039 - DNA, 13 bp, Homo sapiens
ctctctccctcca

SEQ ID NO: 630040 - DNA, 14 bp, Homo sapiens
ctctctccctccac

SEQ ID NO: 630041 - DNA, 13 bp, Homo sapiens
ctctctcctctct

SEQ ID NO: 630042 - DNA, 15 bp, Homo sapiens
ctctctctccctcca

SEQ ID NO: 630043 - DNA, 16 bp, Homo sapiens
ctctctctccctccac

SEQ ID NO: 630044 - DNA, 10 bp, Homo sapiens
ctctctctct

SEQ ID NO: 630045 - DNA, 13 bp, Homo sapiens
ctctctctctctg

SEQ ID NO: 630046 - DNA, 14 bp, Homo sapiens
ctctctctctctgt

SEQ ID NO: 630047 - DNA, 13 bp, Homo sapiens
ctctctctctgtt

SEQ ID NO: 630048 - DNA, 16 bp, Homo sapiens
ctctctctctgttcca

SEQ ID NO: 630049 - DNA, 10 bp, Homo sapiens
ctctctctgt

SEQ ID NO: 630050 - DNA, 14 bp, Homo sapiens
ctctctctgttcca

SEQ ID NO: 630051 - DNA, 21 bp, Homo sapiens
ctctctgaactgcaacactgg

SEQ ID NO: 630052 - DNA, 14 bp, Homo sapiens
ctctctgtgtggca

SEQ ID NO: 630053 - DNA, 15 bp, Homo sapiens
ctctctgtgtggcaa

SEQ ID NO: 630054 - DNA, 16 bp, Homo sapiens
ctctctgtgtggcaaa

SEQ ID NO: 630055 - DNA, 22 bp, Homo sapiens
ctctcttaccccgtccctttcc

SEQ ID NO: 630056 - DNA, 13 bp, Homo sapiens
ctctcttggtctc

SEQ ID NO: 630057 - DNA, 15 bp, Homo sapiens
ctctcttggtctctt

SEQ ID NO: 630058 - DNA, 23 bp, Homo sapiens
ctctcttggtctctttctttcca

SEQ ID NO: 630059 - DNA, 24 bp, Homo sapiens
ctctcttggtctctttctttccaa

SEQ ID NO: 630060 - DNA, 12 bp, Homo sapiens
ctctctttcttt

SEQ ID NO: 630061 - DNA, 19 bp, Homo sapiens
ctctgaatctctcaaaatg

SEQ ID NO: 630062 - DNA, 21 bp, Homo sapiens
ctctgaatctctcaaaatgtg

SEQ ID NO: 630063 - DNA, 22 bp, Homo sapiens
ctctgaatctctcaaaatgtgc

SEQ ID NO: 630064 - DNA, 17 bp, Homo sapiens
ctctgaatgctatttgt

SEQ ID NO: 630065 - DNA, 18 bp, Homo sapiens
ctctgaatgctatttgtg

SEQ ID NO: 630066 - DNA, 19 bp, Homo sapiens
ctctgaatgctatttgtgt

SEQ ID NO: 630067 - DNA, 23 bp, Homo sapiens
ctctgagacagagagccaagcta

SEQ ID NO: 630068 - DNA, 20 bp, Homo sapiens
ctctgagactcgcgacaatg

SEQ ID NO: 630069 - DNA, 14 bp, Homo sapiens
ctctgagcagtggg

SEQ ID NO: 630070 - DNA, 14 bp, Homo sapiens
ctctgagtcctcat

SEQ ID NO: 630071 - DNA, 14 bp, Homo sapiens
ctctgccccctccc

SEQ ID NO: 630072 - DNA, 15 bp, Homo sapiens
ctctgccccctcccc

SEQ ID NO: 630073 - DNA, 17 bp, Homo sapiens
ctctgccccctcccccg

SEQ ID NO: 630074 - DNA, 22 bp, Homo sapiens
ctctgcccctccgtccccaggg

SEQ ID NO: 630075 - DNA, 19 bp, Homo sapiens
ctctgcgacgatccccatg

SEQ ID NO: 630076 - DNA, 13 bp, Homo sapiens
ctctgcgccccag

SEQ ID NO: 630077 - DNA, 14 bp, Homo sapiens
ctctgcgccccagc

SEQ ID NO: 630078 - DNA, 15 bp, Homo sapiens
ctctgcgccccagcg

SEQ ID NO: 630079 - DNA, 17 bp, Homo sapiens
ctctgctatgtctgtga

SEQ ID NO: 630080 - DNA, 17 bp, Homo sapiens
ctctgctcatctacaca

SEQ ID NO: 630081 - DNA, 21 bp, Homo sapiens
ctctggccttggttcctccag

SEQ ID NO: 630082 - DNA, 22 bp, Homo sapiens
ctctggccttggttcctccagc

SEQ ID NO: 630083 - DNA, 16 bp, Homo sapiens
ctctgggttttgggat

SEQ ID NO: 630084 - DNA, 20 bp, Homo sapiens
ctctgtacgaggcttctcta

SEQ ID NO: 630085 - DNA, 11 bp, Homo sapiens
ctctgtccaca

SEQ ID NO: 630086 - DNA, 17 bp, Homo sapiens
ctctgtccgtctgtcct

SEQ ID NO: 630087 - DNA, 20 bp, Homo sapiens
ctctgtccgtctgtcctgcg

SEQ ID NO: 630088 - DNA, 19 bp, Homo sapiens
ctctgtgtggcaaacattt

SEQ ID NO: 630089 - DNA, 20 bp, Homo sapiens
ctctgtgtggcaaacattta

SEQ ID NO: 630090 - DNA, 17 bp, Homo sapiens
ctgtctatttctgctga

SEQ ID NO: 630091 - DNA, 19 bp, Homo sapiens
ctgtctatttctgctgaat

SEQ ID NO: 630092 - DNA, 12 bp, Homo sapiens
ctgtctcctctg

SEQ ID NO: 630093 - DNA, 23 bp, Homo sapiens
ctgtctctccctaccctcttctc

SEQ ID NO: 630094 - DNA, 13 bp, Homo sapiens
ctgtctgaaaaag

SEQ ID NO: 630095 - DNA, 12 bp, Homo sapiens
ctgtctgagccc

SEQ ID NO: 630096 - DNA, 17 bp, Homo sapiens
ctgtctgagccctgccc

SEQ ID NO: 630097 - DNA, 21 bp, Homo sapiens
ctgtctgagccctgccctcac

SEQ ID NO: 630098 - DNA, 12 bp, Homo sapiens
ctgtctgtggct

SEQ ID NO: 630099 - DNA, 16 bp, Homo sapiens
ctgtgaaatgactgca

SEQ ID NO: 630100 - DNA, 18 bp, Homo sapiens
ctgtgaatcaaaacaaat

SEQ ID NO: 630101 - DNA, 18 bp, Homo sapiens
ctgtgacctgctcctgcc

SEQ ID NO: 630102 - DNA, 15 bp, Homo sapiens
ctgtgagataaatat

SEQ ID NO: 630103 - DNA, 19 bp, Homo sapiens
ctgtgagataaatatcatt

SEQ ID NO: 630104 - DNA, 21 bp, Homo sapiens
ctgtgagataaatatcattat

SEQ ID NO: 630105 - DNA, 17 bp, Homo sapiens
ctgtgataacagagtga

SEQ ID NO: 630106 - DNA, 20 bp, Homo sapiens
ctgtgatcgtgtgttgccat

SEQ ID NO: 630107 - DNA, 22 bp, Homo sapiens
ctgtgctggtgggggcctcttt

SEQ ID NO: 630108 - DNA, 14 bp, Homo sapiens
ctgtggcccctcct

SEQ ID NO: 630109 - DNA, 18 bp, Homo sapiens
ctgtggcccctccttctc

SEQ ID NO: 630110 - DNA, 24 bp, Homo sapiens
ctgtggctgcagagaccttgcgac

SEQ ID NO: 630111 - DNA, 20 bp, Homo sapiens
ctgtggcttcccatgtcttt

SEQ ID NO: 630112 - DNA, 19 bp, Homo sapiens
ctgtgggactggcccaccc

SEQ ID NO: 630113 - DNA, 23 bp, Homo sapiens
ctgtgggactggcccacccctct

SEQ ID NO: 630114 - DNA, 15 bp, Homo sapiens
ctgtgggagtccact

SEQ ID NO: 630115 - DNA, 22 bp, Homo sapiens
ctgtgggagtccactttcctct

SEQ ID NO: 630116 - DNA, 17 bp, Homo sapiens
ctgtgggctcacaccgg

SEQ ID NO: 630117 - DNA, 21 bp, Homo sapiens
ctgtgggggaggtccctgcca

SEQ ID NO: 630118 - DNA, 23 bp, Homo sapiens
ctgtgggggaggtccctgccagt

SEQ ID NO: 630119 - DNA, 14 bp, Homo sapiens
ctgcctggcgggca

SEQ ID NO: 630120 - DNA, 23 bp, Homo sapiens
ctgcctggcgggcagcccctgct

SEQ ID NO: 630121 - DNA, 15 bp, Homo sapiens
ctgcctgtcaagttt

SEQ ID NO: 630122 - DNA, 19 bp, Homo sapiens
ctgcctgtggtgaggtcct

SEQ ID NO: 630123 - DNA, 22 bp, Homo sapiens
ctgcctgtggtgaggtcctgtc

SEQ ID NO: 630124 - DNA, 15 bp, Homo sapiens
ctgccttatattatt

SEQ ID NO: 630125 - DNA, 16 bp, Homo sapiens
ctgccttatattattt

SEQ ID NO: 630126 - DNA, 19 bp, Homo sapiens
ctgccttctcccctccaag

SEQ ID NO: 630127 - DNA, 13 bp, Homo sapiens
ctgcgccccagcg

SEQ ID NO: 630128 - DNA, 15 bp, Homo sapiens
ctgcgccccagcgac

SEQ ID NO: 630129 - DNA, 16 bp, Homo sapiens
ctgcgcccctgcccag

SEQ ID NO: 630130 - DNA, 21 bp, Homo sapiens
ctgcgcccctgcccagcacct

SEQ ID NO: 630131 - DNA, 15 bp, Homo sapiens
ctgcgcctcctcctg

SEQ ID NO: 630132 - DNA, 19 bp, Homo sapiens
ctgcgcctcctcctgcatg

SEQ ID NO: 630133 - DNA, 13 bp, Homo sapiens
ctgcgcctgcccg

SEQ ID NO: 630134 - DNA, 14 bp, Homo sapiens
ctgcgcctgcccgc

SEQ ID NO: 630135 - DNA, 15 bp, Homo sapiens
ctgcgcctgcccgcc

SEQ ID NO: 630136 - DNA, 15 bp, Homo sapiens
ctgcgcctgcgcctc

SEQ ID NO: 630137 - DNA, 16 bp, Homo sapiens
ctgcgcctgcgcctcc

SEQ ID NO: 630138 - DNA, 19 bp, Homo sapiens
ctgcgctcccacctcggac

SEQ ID NO: 630139 - DNA, 14 bp, Homo sapiens
ctgcgctcctctgc

SEQ ID NO: 630140 - DNA, 16 bp, Homo sapiens
ctgcgctcctctgcag

SEQ ID NO: 630141 - DNA, 18 bp, Homo sapiens
ctgcgctcctctgcagcc

SEQ ID NO: 630142 - DNA, 20 bp, Homo sapiens
ctgcgctcctctgcagcctg

SEQ ID NO: 630143 - DNA, 13 bp, Homo sapiens
ctgcgtccctgct

SEQ ID NO: 630144 - DNA, 22 bp, Homo sapiens
ctgctaatttatgaagatagtt

SEQ ID NO: 630145 - DNA, 15 bp, Homo sapiens
ctgctacaccttagc

SEQ ID NO: 630146 - DNA, 18 bp, Homo sapiens
ctgctatgtctgtgatgt

SEQ ID NO: 630147 - DNA, 16 bp, Homo sapiens
ctgctcagcccatccc

SEQ ID NO: 630148 - DNA, 23 bp, Homo sapiens
ctgctcagcccatcccctgcctc

SEQ ID NO: 630149 - DNA, 14 bp, Homo sapiens
ctgctcccggtgtg

SEQ ID NO: 630150 - DNA, 17 bp, Homo sapiens
ctgctcccggtgtgcag

SEQ ID NO: 630151 - DNA, 19 bp, Homo sapiens
ctgctcgccctgtgccctc

SEQ ID NO: 630152 - DNA, 23 bp, Homo sapiens
ctgctcgccctgtgccctctcac

SEQ ID NO: 630153 - DNA, 13 bp, Homo sapiens
ctgctcgggaagg

SEQ ID NO: 630154 - DNA, 15 bp, Homo sapiens
ctgctcgggaaggcc

SEQ ID NO: 630155 - DNA, 23 bp, Homo sapiens
ctgctgaattttcacatgaacat

SEQ ID NO: 630156 - DNA, 13 bp, Homo sapiens
ctgctgagcacat

SEQ ID NO: 630157 - DNA, 19 bp, Homo sapiens
ctgctgagggggctctttc

SEQ ID NO: 630158 - DNA, 16 bp, Homo sapiens
ctgctgcactgccctc

SEQ ID NO: 630159 - DNA, 19 bp, Homo sapiens
ctgctgcagtcagcacaga

SEQ ID NO: 630160 - DNA, 12 bp, Homo sapiens
ctgctgccaggc

SEQ ID NO: 630161 - DNA, 22 bp, Homo sapiens
ctgctgccaggctcccactgcc

SEQ ID NO: 630162 - DNA, 17 bp, Homo sapiens
ctgctgccccctggctt

SEQ ID NO: 630163 - DNA, 16 bp, Homo sapiens
ctgctgcctcaggaat

SEQ ID NO: 630164 - DNA, 15 bp, Homo sapiens
ctgctgcttctccct

SEQ ID NO: 630165 - DNA, 17 bp, Homo sapiens
ctgctgcttctccctgg

SEQ ID NO: 630166 - DNA, 22 bp, Homo sapiens
ctgctggaccaaggtgcggacc

SEQ ID NO: 630167 - DNA, 14 bp, Homo sapiens
ctgctggggcaggg

SEQ ID NO: 630168 - DNA, 15 bp, Homo sapiens
ctgctggggcagggc

SEQ ID NO: 630169 - DNA, 20 bp, Homo sapiens
ctgctggggcagggcccagg

SEQ ID NO: 630170 - DNA, 21 bp, Homo sapiens
ctgctggggcagggcccaggg

SEQ ID NO: 630171 - DNA, 23 bp, Homo sapiens
ctgctgtggcatcaggaaaggaa

SEQ ID NO: 630172 - DNA, 20 bp, Homo sapiens
ctgctgtgtagctctgtcca

SEQ ID NO: 630173 - DNA, 13 bp, Homo sapiens
ctgcttaaggaaa

SEQ ID NO: 630174 - DNA, 13 bp, Homo sapiens
ctgcttcaaggat

SEQ ID NO: 630175 - DNA, 16 bp, Homo sapiens
ctgcttcaaggatcct

SEQ ID NO: 630176 - DNA, 13 bp, Homo sapiens
ctgcttctcttta

SEQ ID NO: 630177 - DNA, 15 bp, Homo sapiens
ctgctttcagtgcct

SEQ ID NO: 630178 - DNA, 20 bp, Homo sapiens
ctgctttcagtgcctgctgt

SEQ ID NO: 630179 - DNA, 21 bp, Homo sapiens
ctgctttctgatacatctgtc

SEQ ID NO: 630180 - DNA, 17 bp, Homo sapiens
ctggaaaaaaaaaaata

SEQ ID NO: 630181 - DNA, 14 bp, Homo sapiens
ctggaaaagcactt

SEQ ID NO: 630182 - DNA, 14 bp, Homo sapiens
ctggaaatttgtgt

SEQ ID NO: 630183 - DNA, 13 bp, Homo sapiens
ctggaataagaag

SEQ ID NO: 630184 - DNA, 21 bp, Homo sapiens
ctggaataagaagcaaataaa

SEQ ID NO: 630185 - DNA, 16 bp, Homo sapiens
ctggaatctactagaa

SEQ ID NO: 630186 - DNA, 14 bp, Homo sapiens
ctggacatattccc

SEQ ID NO: 630187 - DNA, 16 bp, Homo sapiens
ctggaccaaggtgcgg

SEQ ID NO: 630188 - DNA, 20 bp, Homo sapiens
ctggaccaaggtgcggaccg

SEQ ID NO: 630189 - DNA, 23 bp, Homo sapiens
ctggaccgagtggaccacgacct

SEQ ID NO: 630190 - DNA, 16 bp, Homo sapiens
ctggacgcatgcaggg

SEQ ID NO: 630191 - DNA, 16 bp, Homo sapiens
ctggagaccctgcgcc

SEQ ID NO: 630192 - DNA, 19 bp, Homo sapiens
ctggagaccctgcgcccct

SEQ ID NO: 630193 - DNA, 21 bp, Homo sapiens
ctggagaccctgcgcccctgc

SEQ ID NO: 630194 - DNA, 23 bp, Homo sapiens
ctggagaccctgcgcccctgccc

SEQ ID NO: 630195 - DNA, 22 bp, Homo sapiens
ctggagccagggcagaggaatg

SEQ ID NO: 630196 - DNA, 19 bp, Homo sapiens
ctggagccccatcgcctgg

SEQ ID NO: 630197 - DNA, 12 bp, Homo sapiens
ctggagcctggg

SEQ ID NO: 630198 - DNA, 15 bp, Homo sapiens
ctggagcctgggcag

SEQ ID NO: 630199 - DNA, 19 bp, Homo sapiens
ctggaggaagccagtgggg

SEQ ID NO: 630200 - DNA, 13 bp, Homo sapiens
ctggagtctgaag

SEQ ID NO: 630201 - DNA, 19 bp, Homo sapiens
ctggagtctgaaggagagg

SEQ ID NO: 630202 - DNA, 14 bp, Homo sapiens
ctggataatttgta

SEQ ID NO: 630203 - DNA, 19 bp, Homo sapiens
ctggatgcttacagtgact

SEQ ID NO: 630204 - DNA, 16 bp, Homo sapiens
ctggatgtgctttcat

SEQ ID NO: 630205 - DNA, 20 bp, Homo sapiens
ctggattcccgtggctttgt

SEQ ID NO: 630206 - DNA, 21 bp, Homo sapiens
ctggcagcgcctcccgccgcc

SEQ ID NO: 630207 - DNA, 20 bp, Homo sapiens
ctggcatgctgtctctaatt

SEQ ID NO: 630208 - DNA, 19 bp, Homo sapiens
ctggccacctgccaggcct

SEQ ID NO: 630209 - DNA, 13 bp, Homo sapiens
ctggcccacccct

SEQ ID NO: 630210 - DNA, 15 bp, Homo sapiens
ctggcccacccctct

SEQ ID NO: 630211 - DNA, 17 bp, Homo sapiens
ctggcccacccctcttc

SEQ ID NO: 630212 - DNA, 11 bp, Homo sapiens
ctggccccagg

SEQ ID NO: 630213 - DNA, 18 bp, Homo sapiens
ctggccccaggcggaggg

SEQ ID NO: 630214 - DNA, 12 bp, Homo sapiens
ctggccccctcg

SEQ ID NO: 630215 - DNA, 22 bp, Homo sapiens
ctggccccctcgcgcccctgtc

SEQ ID NO: 630216 - DNA, 11 bp, Homo sapiens
ctggccctgac

SEQ ID NO: 630217 - DNA, 15 bp, Homo sapiens
ctggccctgccctcc

SEQ ID NO: 630218 - DNA, 16 bp, Homo sapiens
ctggccggtaggctgc

SEQ ID NO: 630219 - DNA, 15 bp, Homo sapiens
ctggccggtccaccc

SEQ ID NO: 630220 - DNA, 16 bp, Homo sapiens
ctggccggtccacccc

SEQ ID NO: 630221 - DNA, 17 bp, Homo sapiens
ctggccggtccaccccg

SEQ ID NO: 630222 - DNA, 21 bp, Homo sapiens
ctggccttggttcctccagca

SEQ ID NO: 630223 - DNA, 16 bp, Homo sapiens
ctggcgccaggggcag

SEQ ID NO: 630224 - DNA, 22 bp, Homo sapiens
ctggcgggcagcccctgctgga

SEQ ID NO: 630225 - DNA, 20 bp, Homo sapiens
ctggctacgacttgggacgg

SEQ ID NO: 630226 - DNA, 20 bp, Homo sapiens
ctggctggggccggggctgc

SEQ ID NO: 630227 - DNA, 21 bp, Homo sapiens
ctggctgggtcgcccctcctc

SEQ ID NO: 630228 - DNA, 14 bp, Homo sapiens
ctggctgtggcccc

SEQ ID NO: 630229 - DNA, 15 bp, Homo sapiens
ctggctgtggcccct

SEQ ID NO: 630230 - DNA, 21 bp, Homo sapiens
ctggctgtggcccctccttct

SEQ ID NO: 630231 - DNA, 23 bp, Homo sapiens
ctgggaaatgagatcccagagtt

SEQ ID NO: 630232 - DNA, 19 bp, Homo sapiens
ctgggacaggcaccatgct

SEQ ID NO: 630233 - DNA, 13 bp, Homo sapiens
ctgggacgcccct

SEQ ID NO: 630234 - DNA, 21 bp, Homo sapiens
ctgggcaaggaagctttggaa

SEQ ID NO: 630235 - DNA, 12 bp, Homo sapiens
ctgggcaccctg

SEQ ID NO: 630236 - DNA, 16 bp, Homo sapiens
aatataacatgaaagt

SEQ ID NO: 630237 - DNA, 12 bp, Homo sapiens
aatataagacaa

SEQ ID NO: 630238 - DNA, 15 bp, Homo sapiens
aatatactcatttgg

SEQ ID NO: 630239 - DNA, 18 bp, Homo sapiens
aatatactcatttggata

SEQ ID NO: 630240 - DNA, 21 bp, Homo sapiens
aatatattgaagtaagttcat

SEQ ID NO: 630241 - DNA, 23 bp, Homo sapiens
aatatatttgcataatatgcata

SEQ ID NO: 630242 - DNA, 24 bp, Homo sapiens
aatatatttgcataatatgcatat

SEQ ID NO: 630243 - DNA, 15 bp, Homo sapiens
aatatcagttacagt

SEQ ID NO: 630244 - DNA, 22 bp, Homo sapiens
aatatcatccccaaatgtgtct

SEQ ID NO: 630245 - DNA, 15 bp, Homo sapiens
aatatcattatagca

SEQ ID NO: 630246 - DNA, 14 bp, Homo sapiens
aatatgcatatata

SEQ ID NO: 630247 - DNA, 19 bp, Homo sapiens
aatatgcatatatatgtat

SEQ ID NO: 630248 - DNA, 23 bp, Homo sapiens
aatatgcatatatatgtatattt

SEQ ID NO: 630249 - DNA, 14 bp, Homo sapiens
aatatgtacaaata

SEQ ID NO: 630250 - DNA, 18 bp, Homo sapiens
aatattgccttgatgttt

SEQ ID NO: 630251 - DNA, 22 bp, Homo sapiens
aatattgctattgtttatagga

SEQ ID NO: 630252 - DNA, 18 bp, Homo sapiens
aatattgctgatggtgca

SEQ ID NO: 630253 - DNA, 18 bp, Homo sapiens
aatattgtcctgtttctt

SEQ ID NO: 630254 - DNA, 13 bp, Homo sapiens
aatatttatagag

SEQ ID NO: 630255 - DNA, 21 bp, Homo sapiens
aatatttatagagttcataga

SEQ ID NO: 630256 - DNA, 14 bp, Homo sapiens
aatattttaggaaa

SEQ ID NO: 630257 - DNA, 14 bp, Homo sapiens
aatattttgctgct

SEQ ID NO: 630258 - DNA, 20 bp, Homo sapiens
aatattttgctgctgaattt

SEQ ID NO: 630259 - DNA, 14 bp, Homo sapiens
aatcaaaaaattat

SEQ ID NO: 630260 - DNA, 14 bp, Homo sapiens
aatcaaaaattgaa

SEQ ID NO: 630261 - DNA, 22 bp, Homo sapiens
aatcaaaataatacttcataca

SEQ ID NO: 630262 - DNA, 22 bp, Homo sapiens
aatcaattaatttttttattgt

SEQ ID NO: 630263 - DNA, 16 bp, Homo sapiens
aatcaatttaaaggaa

SEQ ID NO: 630264 - DNA, 22 bp, Homo sapiens
aatcaatttaaaggaaagttct

SEQ ID NO: 630265 - DNA, 21 bp, Homo sapiens
aatcaccgaaaacgtggctgc

SEQ ID NO: 630266 - DNA, 13 bp, Homo sapiens
aatcagaaagaca

SEQ ID NO: 630267 - DNA, 14 bp, Homo sapiens
aatcagaaagacat

SEQ ID NO: 630268 - DNA, 15 bp, Homo sapiens
aatcagaggcagaga

SEQ ID NO: 630269 - DNA, 20 bp, Homo sapiens
aatcagtttccactacattc

SEQ ID NO: 630270 - DNA, 12 bp, Homo sapiens
aatcatcctcat

SEQ ID NO: 630271 - DNA, 21 bp, Homo sapiens
aatcatgcctacattagtgag

SEQ ID NO: 630272 - DNA, 17 bp, Homo sapiens
aatcatttccagcaaaa

SEQ ID NO: 630273 - DNA, 12 bp, Homo sapiens
aatcattttgat

SEQ ID NO: 630274 - DNA, 14 bp, Homo sapiens
aatccaactccagg

SEQ ID NO: 630275 - DNA, 12 bp, Homo sapiens
aatccagccttc

SEQ ID NO: 630276 - DNA, 21 bp, Homo sapiens
aatccagccttcttcccccag

SEQ ID NO: 630277 - DNA, 13 bp, Homo sapiens
aatccatcgattt

SEQ ID NO: 630278 - DNA, 15 bp, Homo sapiens
aatccatgtgctgct

SEQ ID NO: 630279 - DNA, 15 bp, Homo sapiens
aatccttcagcaatc

SEQ ID NO: 630280 - DNA, 20 bp, Homo sapiens
aatccttcagcaatccttaa

SEQ ID NO: 630281 - DNA, 13 bp, Homo sapiens
aatctacaaactt

SEQ ID NO: 630282 - DNA, 23 bp, Homo sapiens
aatctacaaacttttataaatgt

SEQ ID NO: 630283 - DNA, 12 bp, Homo sapiens
aatctagagcta

SEQ ID NO: 630284 - DNA, 15 bp, Homo sapiens
aatctctcaaaatgt

SEQ ID NO: 630285 - DNA, 17 bp, Homo sapiens
aatctctcaaaatgtgc

SEQ ID NO: 630286 - DNA, 14 bp, Homo sapiens
aatctgaatttcta

SEQ ID NO: 630287 - DNA, 16 bp, Homo sapiens
aatctgaatttctaaa

SEQ ID NO: 630288 - DNA, 12 bp, Homo sapiens
aatctgctttca

SEQ ID NO: 630289 - DNA, 18 bp, Homo sapiens
aatctgctttcatccagc

SEQ ID NO: 630290 - DNA, 16 bp, Homo sapiens
aatcttaaccttcaaa

SEQ ID NO: 630291 - DNA, 19 bp, Homo sapiens
aatcttacccttcaatgtt

SEQ ID NO: 630292 - DNA, 22 bp, Homo sapiens
aatcttacccttcaatgttaaa

SEQ ID NO: 630293 - DNA, 16 bp, Homo sapiens
aatcttgctgtgaaac

SEQ ID NO: 630294 - DNA, 18 bp, Homo sapiens
aatcttggccctattcat

SEQ ID NO: 630295 - DNA, 20 bp, Homo sapiens
aatcttggccctattcatta

SEQ ID NO: 630296 - DNA, 13 bp, Homo sapiens
aatctttgttaaa

SEQ ID NO: 630297 - DNA, 17 bp, Homo sapiens
aatgaaaaatctgaatt

SEQ ID NO: 630298 - DNA, 19 bp, Homo sapiens
aatgaaaatggctgaagaa

SEQ ID NO: 630299 - DNA, 12 bp, Homo sapiens
aatgaaatactt

SEQ ID NO: 630300 - DNA, 19 bp, Homo sapiens
aatgaaatataaactgtga

SEQ ID NO: 630301 - DNA, 20 bp, Homo sapiens
aatgaaatataaactgtgag

SEQ ID NO: 630302 - DNA, 18 bp, Homo sapiens
aatgaaatttaagcacaa

SEQ ID NO: 630303 - DNA, 15 bp, Homo sapiens
aatgaactctttccc

SEQ ID NO: 630304 - DNA, 14 bp, Homo sapiens
aatgaagcaaacac

SEQ ID NO: 630305 - DNA, 13 bp, Homo sapiens
aatgaatgtgtgt

SEQ ID NO: 630306 - DNA, 20 bp, Homo sapiens
aatgaatgtgtgtggttttt

SEQ ID NO: 630307 - DNA, 18 bp, Homo sapiens
aatgacaagtgacttatt

SEQ ID NO: 630308 - DNA, 22 bp, Homo sapiens
aatgacaagtgacttatttgct

SEQ ID NO: 630309 - DNA, 18 bp, Homo sapiens
aatgacctttcaatagga

SEQ ID NO: 630310 - DNA, 20 bp, Homo sapiens
aatgacctttcaataggaaa

SEQ ID NO: 630311 - DNA, 12 bp, Homo sapiens
aatgagaaatca

SEQ ID NO: 630312 - DNA, 21 bp, Homo sapiens
aatgagatcccagagttattt

SEQ ID NO: 630313 - DNA, 17 bp, Homo sapiens
aatgagggcgtgaaaca

SEQ ID NO: 630314 - DNA, 18 bp, Homo sapiens
aatgagggcgtgaaacac

SEQ ID NO: 630315 - DNA, 19 bp, Homo sapiens
aatgagggcgtgaaacaca

SEQ ID NO: 630316 - DNA, 16 bp, Homo sapiens
aatgataatagctcac

SEQ ID NO: 630317 - DNA, 16 bp, Homo sapiens
aatgatatgtctttaa

SEQ ID NO: 630318 - DNA, 17 bp, Homo sapiens
aatgatatgtctttaaa

SEQ ID NO: 630319 - DNA, 20 bp, Homo sapiens
aatgattcaatgtgaatttt

SEQ ID NO: 630320 - DNA, 17 bp, Homo sapiens
aatgattcttgtgtcat

SEQ ID NO: 630321 - DNA, 11 bp, Homo sapiens
aatgcaaacca

SEQ ID NO: 630322 - DNA, 15 bp, Homo sapiens
aaatggctgaagaaa

SEQ ID NO: 630323 - DNA, 16 bp, Homo sapiens
aaatggctgaagaaac

SEQ ID NO: 630324 - DNA, 17 bp, Homo sapiens
aaatggctgaagaaaca

SEQ ID NO: 630325 - DNA, 20 bp, Homo sapiens
aaatggctgaagaaacacag

SEQ ID NO: 630326 - DNA, 22 bp, Homo sapiens
aaatggctgaagaaacacagca

SEQ ID NO: 630327 - DNA, 17 bp, Homo sapiens
aaatggtattttttgtg

SEQ ID NO: 630328 - DNA, 16 bp, Homo sapiens
aaatgtctaatgtatt

SEQ ID NO: 630329 - DNA, 18 bp, Homo sapiens
aaatgtctaatgtatttt

SEQ ID NO: 630330 - DNA, 20 bp, Homo sapiens
aaatgtctaatgtattttat

SEQ ID NO: 630331 - DNA, 17 bp, Homo sapiens
aaatgtgtcttgtatta

SEQ ID NO: 630332 - DNA, 17 bp, Homo sapiens
aaatgtgtgcttggaaa

SEQ ID NO: 630333 - DNA, 15 bp, Homo sapiens
aaatgtttatttttg

SEQ ID NO: 630334 - DNA, 12 bp, Homo sapiens
aaatgtttttga

SEQ ID NO: 630335 - DNA, 13 bp, Homo sapiens
aaattaaagcagc

SEQ ID NO: 630336 - DNA, 14 bp, Homo sapiens
aaattaaagcagca

SEQ ID NO: 630337 - DNA, 16 bp, Homo sapiens
aaattaacttctattt

SEQ ID NO: 630338 - DNA, 17 bp, Homo sapiens
aaattaacttctatttt

SEQ ID NO: 630339 - DNA, 13 bp, Homo sapiens
aaattaggaaagt

SEQ ID NO: 630340 - DNA, 23 bp, Homo sapiens
aaattaggaaagtactgcatgat

SEQ ID NO: 630341 - DNA, 23 bp, Homo sapiens
aaattagggctctaatttcctta

SEQ ID NO: 630342 - DNA, 17 bp, Homo sapiens
aaattagtgttttcatt

SEQ ID NO: 630343 - DNA, 22 bp, Homo sapiens
aaattagtgttttcattctggt

SEQ ID NO: 630344 - DNA, 15 bp, Homo sapiens
aaattatcattgttt

SEQ ID NO: 630345 - DNA, 14 bp, Homo sapiens
aaattatctttaaa

SEQ ID NO: 630346 - DNA, 17 bp, Homo sapiens
aaattatctttaaaact

SEQ ID NO: 630347 - DNA, 14 bp, Homo sapiens
aaattatttctaaa

SEQ ID NO: 630348 - DNA, 16 bp, Homo sapiens
aaattcacaaagttaa

SEQ ID NO: 630349 - DNA, 11 bp, Homo sapiens
aaattcctaat

SEQ ID NO: 630350 - DNA, 18 bp, Homo sapiens
aaattctgattattacaa

SEQ ID NO: 630351 - DNA, 23 bp, Homo sapiens
aaattcttgcactgtatccaagt

SEQ ID NO: 630352 - DNA, 12 bp, Homo sapiens
aaattgaagaga

SEQ ID NO: 630353 - DNA, 15 bp, Homo sapiens
aaattgccttcagcc

SEQ ID NO: 630354 - DNA, 16 bp, Homo sapiens
aaattgctgagatgtt

SEQ ID NO: 630355 - DNA, 20 bp, Homo sapiens
aaattgctgagatgtttagt

SEQ ID NO: 630356 - DNA, 19 bp, Homo sapiens
aaattggttaatgaaaaat

SEQ ID NO: 630357 - DNA, 18 bp, Homo sapiens
aaattgtcttttgtcatg

SEQ ID NO: 630358 - DNA, 18 bp, Homo sapiens
aaattgtgccaaagatag

SEQ ID NO: 630359 - DNA, 14 bp, Homo sapiens
aaattgtggatgaa

SEQ ID NO: 630360 - DNA, 21 bp, Homo sapiens
aaattgtggatgaagacccta

SEQ ID NO: 630361 - DNA, 15 bp, Homo sapiens
aaatttactatgtaa

SEQ ID NO: 630362 - DNA, 16 bp, Homo sapiens
aaatttactatgtaaa

SEQ ID NO: 630363 - DNA, 15 bp, Homo sapiens
aaatttatgtcattt

SEQ ID NO: 630364 - DNA, 18 bp, Homo sapiens
aaatttatgtcattttca

SEQ ID NO: 630365 - DNA, 22 bp, Homo sapiens
aaatttatgtcattttcagatc

SEQ ID NO: 630366 - DNA, 12 bp, Homo sapiens
aaatttattaaa

SEQ ID NO: 630367 - DNA, 19 bp, Homo sapiens
aaattttattgaatataat

SEQ ID NO: 630368 - DNA, 17 bp, Homo sapiens
aaattttcccagtgaat

SEQ ID NO: 630369 - DNA, 21 bp, Homo sapiens
aaattttcccagtgaataaat

SEQ ID NO: 630370 - DNA, 23 bp, Homo sapiens
aaatttttaagtaatttcatgca

SEQ ID NO: 630371 - DNA, 14 bp, Homo sapiens
aaatttttactcag

SEQ ID NO: 630372 - DNA, 23 bp, Homo sapiens
aaatttttactcaggctttctat

SEQ ID NO: 630373 - DNA, 20 bp, Homo sapiens
aaatttttctgggaagaaaa

SEQ ID NO: 630374 - DNA, 16 bp, Homo sapiens
aaatttttgcatgttt

SEQ ID NO: 630375 - DNA, 19 bp, Homo sapiens
aaatttttgcatgtttaat

SEQ ID NO: 630376 - DNA, 17 bp, Homo sapiens
aacaaaaaaaagaaaga

SEQ ID NO: 630377 - DNA, 12 bp, Homo sapiens
aacaaaaacttt

SEQ ID NO: 630378 - DNA, 15 bp, Homo sapiens
aacaaaaactttcca

SEQ ID NO: 630379 - DNA, 16 bp, Homo sapiens
aacaaaaactttccat

SEQ ID NO: 630380 - DNA, 18 bp, Homo sapiens
aacaaaaactttccatga

SEQ ID NO: 630381 - DNA, 21 bp, Homo sapiens
aacaaaatttatgtcattttc

SEQ ID NO: 630382 - DNA, 18 bp, Homo sapiens
aacaaaccagcaactttt

SEQ ID NO: 630383 - DNA, 13 bp, Homo sapiens
aacaaagaaatat

SEQ ID NO: 630384 - DNA, 15 bp, Homo sapiens
aacaaagcatgctca

SEQ ID NO: 630385 - DNA, 20 bp, Homo sapiens
aacaaagtttacattgtcct

SEQ ID NO: 630386 - DNA, 12 bp, Homo sapiens
aacaaattcagt

SEQ ID NO: 630387 - DNA, 13 bp, Homo sapiens
aacaacaaagcat

SEQ ID NO: 630388 - DNA, 18 bp, Homo sapiens
aacctgacagcaaacaca

SEQ ID NO: 630389 - DNA, 21 bp, Homo sapiens
aacctgacagcaaacacagtc

SEQ ID NO: 630390 - DNA, 22 bp, Homo sapiens
aacctgcccctccccagccctt

SEQ ID NO: 630391 - DNA, 15 bp, Homo sapiens
aacctgcgcaccccg

SEQ ID NO: 630392 - DNA, 21 bp, Homo sapiens
aaccttggagaggagagtggc

SEQ ID NO: 630393 - DNA, 20 bp, Homo sapiens
aacgaccgtcttttgaaaac

SEQ ID NO: 630394 - DNA, 23 bp, Homo sapiens
aacgtgatgtgctcatcagaaac

SEQ ID NO: 630395 - DNA, 13 bp, Homo sapiens
aacgtggctgctt

SEQ ID NO: 630396 - DNA, 17 bp, Homo sapiens
aacgttagactgcaata

SEQ ID NO: 630397 - DNA, 17 bp, Homo sapiens
aacgttcatgttcatct

SEQ ID NO: 630398 - DNA, 12 bp, Homo sapiens
aactaacactat

SEQ ID NO: 630399 - DNA, 20 bp, Homo sapiens
aactaaggtacggtgagact

SEQ ID NO: 630400 - DNA, 16 bp, Homo sapiens
aactaagttgtatttt

SEQ ID NO: 630401 - DNA, 18 bp, Homo sapiens
aactaatgacaagtgact

SEQ ID NO: 630402 - DNA, 16 bp, Homo sapiens
aactaatgtaaatatt

SEQ ID NO: 630403 - DNA, 16 bp, Homo sapiens
aactaattaaactgat

SEQ ID NO: 630404 - DNA, 22 bp, Homo sapiens
aactagcaaaaggatgatttaa

SEQ ID NO: 630405 - DNA, 20 bp, Homo sapiens
aactatcagggcaagctcat

SEQ ID NO: 630406 - DNA, 20 bp, Homo sapiens
aactcatacagtctctattt

SEQ ID NO: 630407 - DNA, 22 bp, Homo sapiens
aactcatacagtctctatttga

SEQ ID NO: 630408 - DNA, 22 bp, Homo sapiens
aactcatttgggtattttgtca

SEQ ID NO: 630409 - DNA, 15 bp, Homo sapiens
aactccctaggcctg

SEQ ID NO: 630410 - DNA, 16 bp, Homo sapiens
aactccctaggcctga

SEQ ID NO: 630411 - DNA, 22 bp, Homo sapiens
aactcgggattacagaaacacg

SEQ ID NO: 630412 - DNA, 23 bp, Homo sapiens
aactctggccttggttcctccag

SEQ ID NO: 630413 - DNA, 23 bp, Homo sapiens
aactctgtacgaggcttctctaa

SEQ ID NO: 630414 - DNA, 21 bp, Homo sapiens
aactgaaattagtgttttcat

SEQ ID NO: 630415 - DNA, 13 bp, Homo sapiens
aactgacttgctg

SEQ ID NO: 630416 - DNA, 19 bp, Homo sapiens
aactgatttttttttcctt

SEQ ID NO: 630417 - DNA, 20 bp, Homo sapiens
aactgatttttttttccttc

SEQ ID NO: 630418 - DNA, 21 bp, Homo sapiens
aactgatttttttttccttca

SEQ ID NO: 630419 - DNA, 20 bp, Homo sapiens
aactgccaggcagctgcagt

SEQ ID NO: 630420 - DNA, 11 bp, Homo sapiens
aactgcttcaa

SEQ ID NO: 630421 - DNA, 13 bp, Homo sapiens
aactggccccagg

SEQ ID NO: 630422 - DNA, 13 bp, Homo sapiens
aactgggaaatga

SEQ ID NO: 630423 - DNA, 17 bp, Homo sapiens
aactgggaaatgagatc

SEQ ID NO: 630424 - DNA, 17 bp, Homo sapiens
aactgggttctttggaa

SEQ ID NO: 630425 - DNA, 13 bp, Homo sapiens
aactgtgacattc

SEQ ID NO: 630426 - DNA, 20 bp, Homo sapiens
aactgtgagataaatatcat

SEQ ID NO: 630427 - DNA, 19 bp, Homo sapiens
aactgtggataaattttgg

SEQ ID NO: 630428 - DNA, 21 bp, Homo sapiens
aacttaagggttttttagaaa

SEQ ID NO: 630429 - DNA, 16 bp, Homo sapiens
aacttatctccagcca

SEQ ID NO: 630430 - DNA, 17 bp, Homo sapiens
aacttatctccagccaa

SEQ ID NO: 630431 - DNA, 14 bp, Homo sapiens
aacttattttgatt

SEQ ID NO: 630432 - DNA, 14 bp, Homo sapiens
aacttcagatgttt

SEQ ID NO: 630433 - DNA, 18 bp, Homo sapiens
aacttcatgctgtctgtg

SEQ ID NO: 630434 - DNA, 16 bp, Homo sapiens
aacttctactcttcaa

SEQ ID NO: 630435 - DNA, 23 bp, Homo sapiens
aacttgagggacgactttcttta

SEQ ID NO: 630436 - DNA, 12 bp, Homo sapiens
aacttgtactta

SEQ ID NO: 630437 - DNA, 17 bp, Homo sapiens
aactttccatgacagta

SEQ ID NO: 630438 - DNA, 19 bp, Homo sapiens
aactttccatgacagtagc

SEQ ID NO: 630439 - DNA, 21 bp, Homo sapiens
aactttccatgacagtagcat

SEQ ID NO: 630440 - DNA, 15 bp, Homo sapiens
aactttctcagcata

SEQ ID NO: 630441 - DNA, 13 bp, Homo sapiens
aactttggaagtt

SEQ ID NO: 630442 - DNA, 23 bp, Homo sapiens
aatgcaaaccatcattgaaatct

SEQ ID NO: 630443 - DNA, 23 bp, Homo sapiens
aatgcattgtggatatgagcttt

SEQ ID NO: 630444 - DNA, 15 bp, Homo sapiens
aatgcctaataaaca

SEQ ID NO: 630445 - DNA, 16 bp, Homo sapiens
aatgctatttgtgtaa

SEQ ID NO: 630446 - DNA, 21 bp, Homo sapiens
aatgctatttgtgtaactgaa

SEQ ID NO: 630447 - DNA, 18 bp, Homo sapiens
aatgctcaatgtgctgtt

SEQ ID NO: 630448 - DNA, 14 bp, Homo sapiens
aatgcttaaatgat

SEQ ID NO: 630449 - DNA, 16 bp, Homo sapiens
aatgcttaacataaac

SEQ ID NO: 630450 - DNA, 18 bp, Homo sapiens
aatgcttctttcctctta

SEQ ID NO: 630451 - DNA, 21 bp, Homo sapiens
aatggcatttagcacagtatt

SEQ ID NO: 630452 - DNA, 16 bp, Homo sapiens
aatggctgggtttggg

SEQ ID NO: 630453 - DNA, 22 bp, Homo sapiens
aatggctgggtttgggcagtgg

SEQ ID NO: 630454 - DNA, 20 bp, Homo sapiens
aatggggggcgggccagggt

SEQ ID NO: 630455 - DNA, 22 bp, Homo sapiens
aatggggggcgggccagggtgg

SEQ ID NO: 630456 - DNA, 23 bp, Homo sapiens
aatggggggcgggccagggtggg

SEQ ID NO: 630457 - DNA, 16 bp, Homo sapiens
aatggtattgtaacta

SEQ ID NO: 630458 - DNA, 18 bp, Homo sapiens
aatggtattttttgtgaa

SEQ ID NO: 630459 - DNA, 16 bp, Homo sapiens
aatggtgggctccaga

SEQ ID NO: 630460 - DNA, 17 bp, Homo sapiens
aatggttgcaaagtgtt

SEQ ID NO: 630461 - DNA, 17 bp, Homo sapiens
aatgtaaatattgctgt

SEQ ID NO: 630462 - DNA, 15 bp, Homo sapiens
aatgtagggcagaat

SEQ ID NO: 630463 - DNA, 12 bp, Homo sapiens
aatgtagggcct

SEQ ID NO: 630464 - DNA, 17 bp, Homo sapiens
aatgtattttattgtaa

SEQ ID NO: 630465 - DNA, 21 bp, Homo sapiens
aatgtattttattgtaacaga

SEQ ID NO: 630466 - DNA, 23 bp, Homo sapiens
aatgtcatttcatacaaattttc

SEQ ID NO: 630467 - DNA, 23 bp, Homo sapiens
aatgtgaattttaaaatgcaaat

SEQ ID NO: 630468 - DNA, 11 bp, Homo sapiens
aatgtgccaaa

SEQ ID NO: 630469 - DNA, 22 bp, Homo sapiens
aatgtgccgtctttggttcctc

SEQ ID NO: 630470 - DNA, 15 bp, Homo sapiens
aatgtggaattacat

SEQ ID NO: 630471 - DNA, 21 bp, Homo sapiens
aatgtggaattacataacagg

SEQ ID NO: 630472 - DNA, 22 bp, Homo sapiens
aatgtgtgaaggtcttgcctga

SEQ ID NO: 630473 - DNA, 13 bp, Homo sapiens
aatgtgtttttca

SEQ ID NO: 630474 - DNA, 18 bp, Homo sapiens
aatgtttatttttgctct

SEQ ID NO: 630475 - DNA, 15 bp, Homo sapiens
aatgttttaaagaag

SEQ ID NO: 630476 - DNA, 18 bp, Homo sapiens
aatgtttttgatttatca

SEQ ID NO: 630477 - DNA, 22 bp, Homo sapiens
aatgttttttatacttcaaatg

SEQ ID NO: 630478 - DNA, 23 bp, Homo sapiens
aattaaaaagacacttttaccga

SEQ ID NO: 630479 - DNA, 13 bp, Homo sapiens
aattaaagcagca

SEQ ID NO: 630480 - DNA, 15 bp, Homo sapiens
aattaaagcagcaaa

SEQ ID NO: 630481 - DNA, 20 bp, Homo sapiens
aattaaagtgtccattgaca

SEQ ID NO: 630482 - DNA, 21 bp, Homo sapiens
aattaaagtgtccattgacat

SEQ ID NO: 630483 - DNA, 22 bp, Homo sapiens
aattaatgagttttatccaaga

SEQ ID NO: 630484 - DNA, 17 bp, Homo sapiens
aattaattggcagcaga

SEQ ID NO: 630485 - DNA, 11 bp, Homo sapiens
aattaattttt

SEQ ID NO: 630486 - DNA, 17 bp, Homo sapiens
aattaatttttcaattt

SEQ ID NO: 630487 - DNA, 18 bp, Homo sapiens
aattaatttttttattgt

SEQ ID NO: 630488 - DNA, 23 bp, Homo sapiens
aattaatttttttattgtttaaa

SEQ ID NO: 630489 - DNA, 16 bp, Homo sapiens
aattacataacaggca

SEQ ID NO: 630490 - DNA, 18 bp, Homo sapiens
aattacataacaggcatt

SEQ ID NO: 630491 - DNA, 18 bp, Homo sapiens
aattagggctctaatttc

SEQ ID NO: 630492 - DNA, 15 bp, Homo sapiens
aattagtgttttcat

SEQ ID NO: 630493 - DNA, 15 bp, Homo sapiens
aattataatgcatct

SEQ ID NO: 630494 - DNA, 20 bp, Homo sapiens
aattatagagcctcaatttt

SEQ ID NO: 630495 - DNA, 21 bp, Homo sapiens
aattatagagcctcaattttg

SEQ ID NO: 630496 - DNA, 12 bp, Homo sapiens
aattatatctgt

SEQ ID NO: 630497 - DNA, 21 bp, Homo sapiens
aattatcaaaaaacagaaaaa

SEQ ID NO: 630498 - DNA, 18 bp, Homo sapiens
aattatcctcaagttgtg

SEQ ID NO: 630499 - DNA, 14 bp, Homo sapiens
aattatcttggaaa

SEQ ID NO: 630500 - DNA, 20 bp, Homo sapiens
aattatgaagccctaagtaa

SEQ ID NO: 630501 - DNA, 14 bp, Homo sapiens
aattatgtcaaatg

SEQ ID NO: 630502 - DNA, 15 bp, Homo sapiens
aattattaaaaatta

SEQ ID NO: 630503 - DNA, 18 bp, Homo sapiens
aattattaaaaattatag

SEQ ID NO: 630504 - DNA, 20 bp, Homo sapiens
aattatttctaaaacattaa

SEQ ID NO: 630505 - DNA, 14 bp, Homo sapiens
aattcaaagaatca

SEQ ID NO: 630506 - DNA, 17 bp, Homo sapiens
aattcagtagcatttta

SEQ ID NO: 630507 - DNA, 18 bp, Homo sapiens
aattcagtagcattttaa

SEQ ID NO: 630508 - DNA, 13 bp, Homo sapiens
aattcatgatgct

SEQ ID NO: 630509 - DNA, 19 bp, Homo sapiens
aattcatgatgctagttct

SEQ ID NO: 630510 - DNA, 19 bp, Homo sapiens
aattcattgtctcagtgaa

SEQ ID NO: 630511 - DNA, 18 bp, Homo sapiens
aattcctcctgtctcctc

SEQ ID NO: 630512 - DNA, 12 bp, Homo sapiens
aattcgagcaaa

SEQ ID NO: 630513 - DNA, 13 bp, Homo sapiens
aattcgagcaaac

SEQ ID NO: 630514 - DNA, 14 bp, Homo sapiens
aattcgagcaaaca

SEQ ID NO: 630515 - DNA, 23 bp, Homo sapiens
aattctatgattaaactgggaaa

SEQ ID NO: 630516 - DNA, 20 bp, Homo sapiens
aattctgaaggggaaaacct

SEQ ID NO: 630517 - DNA, 23 bp, Homo sapiens
aattctgaaggggaaaacctcag

SEQ ID NO: 630518 - DNA, 15 bp, Homo sapiens
aattctgtttatgtt

SEQ ID NO: 630519 - DNA, 18 bp, Homo sapiens
aattcttaccgaaatgaa

SEQ ID NO: 630520 - DNA, 19 bp, Homo sapiens
aattcttaccgaaatgaaa

SEQ ID NO: 630521 - DNA, 19 bp, Homo sapiens
aattcttactgttctgaaa

SEQ ID NO: 630522 - DNA, 22 bp, Homo sapiens
aattcttctcctttgtcaaatg

SEQ ID NO: 630523 - DNA, 13 bp, Homo sapiens
aattcttgcactg

SEQ ID NO: 630524 - DNA, 15 bp, Homo sapiens
aattcttgcactgta

SEQ ID NO: 630525 - DNA, 22 bp, Homo sapiens
aattcttgcactgtatccaagt

SEQ ID NO: 630526 - DNA, 21 bp, Homo sapiens
aattgaaagggacaagtatca

SEQ ID NO: 630527 - DNA, 20 bp, Homo sapiens
aattgaaccgtcaatgtgaa

SEQ ID NO: 630528 - DNA, 23 bp, Homo sapiens
aattgaagagagatatatctgaa

SEQ ID NO: 630529 - DNA, 21 bp, Homo sapiens
aattgctctatgcctcagttt

SEQ ID NO: 630530 - DNA, 13 bp, Homo sapiens
aattggcttgttt

SEQ ID NO: 630531 - DNA, 23 bp, Homo sapiens
aattgggcccttagaatgtgaaa

SEQ ID NO: 630532 - DNA, 15 bp, Homo sapiens
aattggttaatgaaa

SEQ ID NO: 630533 - DNA, 16 bp, Homo sapiens
aattggttaatgaaaa

SEQ ID NO: 630534 - DNA, 16 bp, Homo sapiens
aattgtatatatatgt

SEQ ID NO: 630535 - DNA, 18 bp, Homo sapiens
aattgtatatatatgtga

SEQ ID NO: 630536 - DNA, 11 bp, Homo sapiens
aattgtggatg

SEQ ID NO: 630537 - DNA, 22 bp, Homo sapiens
aattgtttttagaaatttattc

SEQ ID NO: 630538 - DNA, 20 bp, Homo sapiens
aatttaagcacaaaaaattt

SEQ ID NO: 630539 - DNA, 21 bp, Homo sapiens
aatttaccacaggatgcatat

SEQ ID NO: 630540 - DNA, 23 bp, Homo sapiens
aatttaccacaggatgcatatta

SEQ ID NO: 630541 - DNA, 20 bp, Homo sapiens
aatttactatgtaaatgctt

SEQ ID NO: 630542 - DNA, 20 bp, Homo sapiens
aatttagcagtccatttttg

SEQ ID NO: 630543 - DNA, 19 bp, Homo sapiens
aatttaggaatgctcaatg

SEQ ID NO: 630544 - DNA, 22 bp, Homo sapiens
aatttaggaatgctcaatgtgc

SEQ ID NO: 630545 - DNA, 23 bp, Homo sapiens
aatttatgtcattttcagatcct

SEQ ID NO: 630546 - DNA, 14 bp, Homo sapiens
aatttattaaatgt

SEQ ID NO: 630547 - DNA, 16 bp, Homo sapiens
aatttattaaatttat

SEQ ID NO: 630548 - DNA, 19 bp, Homo sapiens
aatttcagaaactaagaat

SEQ ID NO: 630549 - DNA, 18 bp, Homo sapiens
aatttgccagacagagat

SEQ ID NO: 630550 - DNA, 15 bp, Homo sapiens
aatttggccatgaaa

SEQ ID NO: 630551 - DNA, 15 bp, Homo sapiens
acctaacaatgtttt

SEQ ID NO: 630552 - DNA, 21 bp, Homo sapiens
acctaactccctaggcctgag

SEQ ID NO: 630553 - DNA, 22 bp, Homo sapiens
acctaccctggaccgagtggac

SEQ ID NO: 630554 - DNA, 16 bp, Homo sapiens
acctactcctccccct

SEQ ID NO: 630555 - DNA, 12 bp, Homo sapiens
acctactgccca

SEQ ID NO: 630556 - DNA, 22 bp, Homo sapiens
acctactgcccacatttgggct

SEQ ID NO: 630557 - DNA, 12 bp, Homo sapiens
acctcacttgtg

SEQ ID NO: 630558 - DNA, 19 bp, Homo sapiens
acctcagttggcctctgcc

SEQ ID NO: 630559 - DNA, 20 bp, Homo sapiens
acctcagttggcctctgccc

SEQ ID NO: 630560 - DNA, 14 bp, Homo sapiens
acctccacccgtcc

SEQ ID NO: 630561 - DNA, 23 bp, Homo sapiens
acctccaggaagggaccccactg

SEQ ID NO: 630562 - DNA, 15 bp, Homo sapiens
acctccccagagccc

SEQ ID NO: 630563 - DNA, 22 bp, Homo sapiens
acctccccagagccctgcagtc

SEQ ID NO: 630564 - DNA, 17 bp, Homo sapiens
acctcccctggtcctgc

SEQ ID NO: 630565 - DNA, 18 bp, Homo sapiens
acctcggccgaggcctgc

SEQ ID NO: 630566 - DNA, 14 bp, Homo sapiens
acctctcagatccc

SEQ ID NO: 630567 - DNA, 20 bp, Homo sapiens
acctctcagcccctcagaga

SEQ ID NO: 630568 - DNA, 17 bp, Homo sapiens
acctctttcggaaatga

SEQ ID NO: 630569 - DNA, 13 bp, Homo sapiens
acctgaaagccct

SEQ ID NO: 630570 - DNA, 11 bp, Homo sapiens
acctgaaatgc

SEQ ID NO: 630571 - DNA, 16 bp, Homo sapiens
acctgaagttttatga

SEQ ID NO: 630572 - DNA, 20 bp, Homo sapiens
acctgaataagggactttgg

SEQ ID NO: 630573 - DNA, 17 bp, Homo sapiens
acctgacagcaaacaca

SEQ ID NO: 630574 - DNA, 13 bp, Homo sapiens
acctgagaatgtg

SEQ ID NO: 630575 - DNA, 14 bp, Homo sapiens
acctgctcctgccc

SEQ ID NO: 630576 - DNA, 20 bp, Homo sapiens
acctgctcctgcccacgtgc

SEQ ID NO: 630577 - DNA, 21 bp, Homo sapiens
acctgctgagggggctctttc

SEQ ID NO: 630578 - DNA, 22 bp, Homo sapiens
acctgctgagggggctctttcc

SEQ ID NO: 630579 - DNA, 22 bp, Homo sapiens
acctgcttctcagcgcaacagc

SEQ ID NO: 630580 - DNA, 22 bp, Homo sapiens
acctggccggtaggctgctggc

SEQ ID NO: 630581 - DNA, 14 bp, Homo sapiens
acctggtaattatc

SEQ ID NO: 630582 - DNA, 16 bp, Homo sapiens
acctggtggccctgcg

SEQ ID NO: 630583 - DNA, 17 bp, Homo sapiens
acctggtggccctgcgg

SEQ ID NO: 630584 - DNA, 13 bp, Homo sapiens
acctgtacacaca

SEQ ID NO: 630585 - DNA, 15 bp, Homo sapiens
acctgtacacacaca

SEQ ID NO: 630586 - DNA, 17 bp, Homo sapiens
acctgtacacacacaga

SEQ ID NO: 630587 - DNA, 17 bp, Homo sapiens
acctgtagaagatgacc

SEQ ID NO: 630588 - DNA, 12 bp, Homo sapiens
acctgtgctttc

SEQ ID NO: 630589 - DNA, 20 bp, Homo sapiens
accttacaaagccagctctg

SEQ ID NO: 630590 - DNA, 17 bp, Homo sapiens
accttagcagctcttcc

SEQ ID NO: 630591 - DNA, 19 bp, Homo sapiens
accttcatgaccttacata

SEQ ID NO: 630592 - DNA, 18 bp, Homo sapiens
accttcggcagtggctgg

SEQ ID NO: 630593 - DNA, 20 bp, Homo sapiens
accttcggcagtggctgggg

SEQ ID NO: 630594 - DNA, 23 bp, Homo sapiens
accttctaatccatgtgctgctg

SEQ ID NO: 630595 - DNA, 21 bp, Homo sapiens
accttgcattttagctaattt

SEQ ID NO: 630596 - DNA, 22 bp, Homo sapiens
accttgtacagaaccagcactc

SEQ ID NO: 630597 - DNA, 16 bp, Homo sapiens
acctttcaataggaaa

SEQ ID NO: 630598 - DNA, 17 bp, Homo sapiens
acctttcaataggaaaa

SEQ ID NO: 630599 - DNA, 23 bp, Homo sapiens
acctttcaataggaaaaactgat

SEQ ID NO: 630600 - DNA, 20 bp, Homo sapiens
accttttaaaaaaataatat

SEQ ID NO: 630601 - DNA, 15 bp, Homo sapiens
acctttttttctctc

SEQ ID NO: 630602 - DNA, 17 bp, Homo sapiens
acctttttttctctcct

SEQ ID NO: 630603 - DNA, 18 bp, Homo sapiens
acctttttttctctccta

SEQ ID NO: 630604 - DNA, 21 bp, Homo sapiens
acgaatattgctgatggtgca

SEQ ID NO: 630605 - DNA, 15 bp, Homo sapiens
acgaccgacgcccct

SEQ ID NO: 630606 - DNA, 17 bp, Homo sapiens
acgagcagagcgcagcc

SEQ ID NO: 630607 - DNA, 15 bp, Homo sapiens
acgaggcggcaaaga

SEQ ID NO: 630608 - DNA, 15 bp, Homo sapiens
acgcaattgtatata

SEQ ID NO: 630609 - DNA, 20 bp, Homo sapiens
acgcaattgtatatatatgt

SEQ ID NO: 630610 - DNA, 15 bp, Homo sapiens
acgcagagccccgga

SEQ ID NO: 630611 - DNA, 18 bp, Homo sapiens
acgcagagccccggagca

SEQ ID NO: 630612 - DNA, 11 bp, Homo sapiens
acgcccagccc

SEQ ID NO: 630613 - DNA, 15 bp, Homo sapiens
acgcccagcccccac

SEQ ID NO: 630614 - DNA, 22 bp, Homo sapiens
acgcccaggatgaaggggccag

SEQ ID NO: 630615 - DNA, 16 bp, Homo sapiens
acgcccctccccagcc

SEQ ID NO: 630616 - DNA, 21 bp, Homo sapiens
acgcccctccccagcccccac

SEQ ID NO: 630617 - DNA, 21 bp, Homo sapiens
acgcccctccgggcagagacc

SEQ ID NO: 630618 - DNA, 17 bp, Homo sapiens
acgcccctttctcttgc

SEQ ID NO: 630619 - DNA, 18 bp, Homo sapiens
acgccggggctggccctg

SEQ ID NO: 630620 - DNA, 23 bp, Homo sapiens
acgccggggctggccctgccctc

SEQ ID NO: 630621 - DNA, 19 bp, Homo sapiens
acgcggccgctctccgccc

SEQ ID NO: 630622 - DNA, 14 bp, Homo sapiens
acgctggagaccct

SEQ ID NO: 630623 - DNA, 18 bp, Homo sapiens
acgctggagaccctgcgc

SEQ ID NO: 630624 - DNA, 13 bp, Homo sapiens
actgttttgtgcg

SEQ ID NO: 630625 - DNA, 13 bp, Homo sapiens
acttaaacaaaaa

SEQ ID NO: 630626 - DNA, 14 bp, Homo sapiens
acttaaacaaaaac

SEQ ID NO: 630627 - DNA, 23 bp, Homo sapiens
acttaaacaaaaactttccatga

SEQ ID NO: 630628 - DNA, 18 bp, Homo sapiens
acttaagggttttttaga

SEQ ID NO: 630629 - DNA, 21 bp, Homo sapiens
acttaagggttttttagaaaa

SEQ ID NO: 630630 - DNA, 19 bp, Homo sapiens
acttaatcaattaattttt

SEQ ID NO: 630631 - DNA, 22 bp, Homo sapiens
acttagggagtgtgccttgggc

SEQ ID NO: 630632 - DNA, 17 bp, Homo sapiens
acttcacacatttataa

SEQ ID NO: 630633 - DNA, 20 bp, Homo sapiens
acttcagaaactttttctaa

SEQ ID NO: 630634 - DNA, 19 bp, Homo sapiens
acttcagactctctcctct

SEQ ID NO: 630635 - DNA, 15 bp, Homo sapiens
acttcagatgtttcc

SEQ ID NO: 630636 - DNA, 16 bp, Homo sapiens
acttcagatgtttcca

SEQ ID NO: 630637 - DNA, 14 bp, Homo sapiens
acttcagttctcat

SEQ ID NO: 630638 - DNA, 20 bp, Homo sapiens
acttcagttctcatcttgta

SEQ ID NO: 630639 - DNA, 13 bp, Homo sapiens
acttcccagctgg

SEQ ID NO: 630640 - DNA, 15 bp, Homo sapiens
acttcccagctggca

SEQ ID NO: 630641 - DNA, 17 bp, Homo sapiens
acttcctattaatttat

SEQ ID NO: 630642 - DNA, 21 bp, Homo sapiens
acttcctattaatttattaaa

SEQ ID NO: 630643 - DNA, 17 bp, Homo sapiens
acttcggataattttca

SEQ ID NO: 630644 - DNA, 21 bp, Homo sapiens
acttcggataattttcatttt

SEQ ID NO: 630645 - DNA, 15 bp, Homo sapiens
acttctcaaatgcta

SEQ ID NO: 630646 - DNA, 20 bp, Homo sapiens
acttctttactaacactggc

SEQ ID NO: 630647 - DNA, 23 bp, Homo sapiens
acttgaaattatatctgtggtct

SEQ ID NO: 630648 - DNA, 22 bp, Homo sapiens
acttgattaaggactacagaat

SEQ ID NO: 630649 - DNA, 14 bp, Homo sapiens
acttgatttttcaa

SEQ ID NO: 630650 - DNA, 17 bp, Homo sapiens
acttgatttttcaaaga

SEQ ID NO: 630651 - DNA, 18 bp, Homo sapiens
acttgatttttcaaagac

SEQ ID NO: 630652 - DNA, 16 bp, Homo sapiens
acttgctgtgaaatga

SEQ ID NO: 630653 - DNA, 14 bp, Homo sapiens
acttgctgtgactt

SEQ ID NO: 630654 - DNA, 12 bp, Homo sapiens
acttggacattt

SEQ ID NO: 630655 - DNA, 21 bp, Homo sapiens
acttggataggagcttccaga

SEQ ID NO: 630656 - DNA, 21 bp, Homo sapiens
acttgtacttacactgaaatc

SEQ ID NO: 630657 - DNA, 23 bp, Homo sapiens
acttgtacttacactgaaatcca

SEQ ID NO: 630658 - DNA, 17 bp, Homo sapiens
acttgtataagtagaat

SEQ ID NO: 630659 - DNA, 13 bp, Homo sapiens
actttacaatcat

SEQ ID NO: 630660 - DNA, 14 bp, Homo sapiens
actttacaatcatg

SEQ ID NO: 630661 - DNA, 14 bp, Homo sapiens
actttccatgacag

SEQ ID NO: 630662 - DNA, 19 bp, Homo sapiens
actttccatgacagtagca

SEQ ID NO: 630663 - DNA, 15 bp, Homo sapiens
actttcccacactgt

SEQ ID NO: 630664 - DNA, 16 bp, Homo sapiens
actttcccacactgtg

SEQ ID NO: 630665 - DNA, 18 bp, Homo sapiens
actttcccacactgtgaa

SEQ ID NO: 630666 - DNA, 14 bp, Homo sapiens
actttcctctctct

SEQ ID NO: 630667 - DNA, 15 bp, Homo sapiens
actttcctctctctc

SEQ ID NO: 630668 - DNA, 13 bp, Homo sapiens
actttctggaaaa

SEQ ID NO: 630669 - DNA, 18 bp, Homo sapiens
actttggaattctgcttc

SEQ ID NO: 630670 - DNA, 16 bp, Homo sapiens
actttggatcaggaaa

SEQ ID NO: 630671 - DNA, 20 bp, Homo sapiens
actttggggacaccctcctg

SEQ ID NO: 630672 - DNA, 20 bp, Homo sapiens
actttgtgtcttttgttctc

SEQ ID NO: 630673 - DNA, 15 bp, Homo sapiens
acttttataaatgtt

SEQ ID NO: 630674 - DNA, 17 bp, Homo sapiens
acttttatgcaggcaga

SEQ ID NO: 630675 - DNA, 17 bp, Homo sapiens
acttttttcctgtcaat

SEQ ID NO: 630676 - DNA, 13 bp, Homo sapiens
agaaaaagcatta

SEQ ID NO: 630677 - DNA, 13 bp, Homo sapiens
agaaaaagccctc

SEQ ID NO: 630678 - DNA, 12 bp, Homo sapiens
agaaaacattgt

SEQ ID NO: 630679 - DNA, 23 bp, Homo sapiens
agaaaatttttgtctttcatgga

SEQ ID NO: 630680 - DNA, 13 bp, Homo sapiens
agaaacaatttct

SEQ ID NO: 630681 - DNA, 15 bp, Homo sapiens
agaaacaatttctgt

SEQ ID NO: 630682 - DNA, 16 bp, Homo sapiens
agaaacacagcatgca

SEQ ID NO: 630683 - DNA, 23 bp, Homo sapiens
agaccatgcattcagatctgaag

SEQ ID NO: 630684 - DNA, 18 bp, Homo sapiens
agaccctatctcccacaa

SEQ ID NO: 630685 - DNA, 15 bp, Homo sapiens
agaccctgcgcccct

SEQ ID NO: 630686 - DNA, 17 bp, Homo sapiens
agaccctgcgcccctgc

SEQ ID NO: 630687 - DNA, 18 bp, Homo sapiens
agaccctgcgcccctgcc

SEQ ID NO: 630688 - DNA, 21 bp, Homo sapiens
agaccgtggtgtcctctgtcc

SEQ ID NO: 630689 - DNA, 15 bp, Homo sapiens
agacctccagattat

SEQ ID NO: 630690 - DNA, 14 bp, Homo sapiens
agacctcctgatgt

SEQ ID NO: 630691 - DNA, 20 bp, Homo sapiens
agacctcggctgtgtgggga

SEQ ID NO: 630692 - DNA, 18 bp, Homo sapiens
agactcctctcttctgac

SEQ ID NO: 630693 - DNA, 18 bp, Homo sapiens
agactcgagagggctgag

SEQ ID NO: 630694 - DNA, 20 bp, Homo sapiens
agactcgagagggctgagcc

SEQ ID NO: 630695 - DNA, 21 bp, Homo sapiens
agactcgagagggctgagccc

SEQ ID NO: 630696 - DNA, 23 bp, Homo sapiens
agactcgagagggctgagcccct

SEQ ID NO: 630697 - DNA, 14 bp, Homo sapiens
agactctctcctct

SEQ ID NO: 630698 - DNA, 21 bp, Homo sapiens
agactctctcctctctctccc

SEQ ID NO: 630699 - DNA, 11 bp, Homo sapiens
agactgcccac

SEQ ID NO: 630700 - DNA, 13 bp, Homo sapiens
agactgcccaccc

SEQ ID NO: 630701 - DNA, 15 bp, Homo sapiens
agactgcccaccctg

SEQ ID NO: 630702 - DNA, 18 bp, Homo sapiens
agactgcccaccctgggc

SEQ ID NO: 630703 - DNA, 19 bp, Homo sapiens
agactgcccaccctgggcc

SEQ ID NO: 630704 - DNA, 20 bp, Homo sapiens
agactgcccaccctgggcct

SEQ ID NO: 630705 - DNA, 17 bp, Homo sapiens
agactgccttatattat

SEQ ID NO: 630706 - DNA, 19 bp, Homo sapiens
agactgccttatattattt

SEQ ID NO: 630707 - DNA, 22 bp, Homo sapiens
agacttcctattaatttattaa

SEQ ID NO: 630708 - DNA, 17 bp, Homo sapiens
agacttctaaatcataa

SEQ ID NO: 630709 - DNA, 17 bp, Homo sapiens
agagaaaatgctttctc

SEQ ID NO: 630710 - DNA, 15 bp, Homo sapiens
agagaagaaatagca

SEQ ID NO: 630711 - DNA, 12 bp, Homo sapiens
agagaagccata

SEQ ID NO: 630712 - DNA, 13 bp, Homo sapiens
agagaagccataa

SEQ ID NO: 630713 - DNA, 17 bp, Homo sapiens
agagacaaagtttggaa

SEQ ID NO: 630714 - DNA, 20 bp, Homo sapiens
agagaccaccgcgcccctct

SEQ ID NO: 630715 - DNA, 15 bp, Homo sapiens
agagacggcagcccc

SEQ ID NO: 630716 - DNA, 21 bp, Homo sapiens
agagacggcagccccatcctt

SEQ ID NO: 630717 - DNA, 16 bp, Homo sapiens
agagactgcccaccct

SEQ ID NO: 630718 - DNA, 16 bp, Homo sapiens
agagagcaatcttgct

SEQ ID NO: 630719 - DNA, 18 bp, Homo sapiens
agagataccctctgagac

SEQ ID NO: 630720 - DNA, 14 bp, Homo sapiens
agagatatatctga

SEQ ID NO: 630721 - DNA, 20 bp, Homo sapiens
agagattgacttcagaaact

SEQ ID NO: 630722 - DNA, 19 bp, Homo sapiens
agagattggcacttccctg

SEQ ID NO: 630723 - DNA, 14 bp, Homo sapiens
agagcagcaggtgc

SEQ ID NO: 630724 - DNA, 13 bp, Homo sapiens
agagcagcctctt

SEQ ID NO: 630725 - DNA, 16 bp, Homo sapiens
agagccccggagcacc

SEQ ID NO: 630726 - DNA, 22 bp, Homo sapiens
agagccctctgctgctttccaa

SEQ ID NO: 630727 - DNA, 17 bp, Homo sapiens
agagcctatggaaaggg

SEQ ID NO: 630728 - DNA, 19 bp, Homo sapiens
agagcctattttggtgagg

SEQ ID NO: 630729 - DNA, 14 bp, Homo sapiens
agagcctcaatttt

SEQ ID NO: 630730 - DNA, 14 bp, Homo sapiens
agagcctgactgtg

SEQ ID NO: 630731 - DNA, 21 bp, Homo sapiens
agagcctgactgtgttcagtg

SEQ ID NO: 630732 - DNA, 19 bp, Homo sapiens
agagcctttctccagccca

SEQ ID NO: 630733 - DNA, 16 bp, Homo sapiens
agagcgccacccgccc

SEQ ID NO: 630734 - DNA, 17 bp, Homo sapiens
agagcgccacccgcccg

SEQ ID NO: 630735 - DNA, 23 bp, Homo sapiens
agagctatatatatatatatatg

SEQ ID NO: 630736 - DNA, 16 bp, Homo sapiens
agagctatgcacacca

SEQ ID NO: 630737 - DNA, 22 bp, Homo sapiens
agagctatgcacaccaaattgc

SEQ ID NO: 630738 - DNA, 14 bp, Homo sapiens
agagctcaggagaa

SEQ ID NO: 630739 - DNA, 16 bp, Homo sapiens
agagctcaggagaagg

SEQ ID NO: 630740 - DNA, 17 bp, Homo sapiens
agagctcaggagaaggc

SEQ ID NO: 630741 - DNA, 17 bp, Homo sapiens
agagctgagtcggctgg

SEQ ID NO: 630742 - DNA, 15 bp, Homo sapiens
agagctgctgtattt

SEQ ID NO: 630743 - DNA, 22 bp, Homo sapiens
agagcttcccctaacctgggtt

SEQ ID NO: 630744 - DNA, 23 bp, Homo sapiens
agagcttcccctaacctgggttg

SEQ ID NO: 630745 - DNA, 12 bp, Homo sapiens
agaggaaatcac

SEQ ID NO: 630746 - DNA, 16 bp, Homo sapiens
agaggaataaaatgat

SEQ ID NO: 630747 - DNA, 10 bp, Homo sapiens
agaggaatgt

SEQ ID NO: 630748 - DNA, 19 bp, Homo sapiens
agaggaatgtagggcctgc

SEQ ID NO: 630749 - DNA, 23 bp, Homo sapiens
agaggacagcttccccatcgcct

SEQ ID NO: 630750 - DNA, 17 bp, Homo sapiens
agaggaggtgtggagtg

SEQ ID NO: 630751 - DNA, 21 bp, Homo sapiens
agaggaggtgtggagtggagg

SEQ ID NO: 630752 - DNA, 16 bp, Homo sapiens
agaggagtgcgctaga

SEQ ID NO: 630753 - DNA, 21 bp, Homo sapiens
agaggcagagacctcctgatg

SEQ ID NO: 630754 - DNA, 12 bp, Homo sapiens
agaggcagggcc

SEQ ID NO: 630755 - DNA, 17 bp, Homo sapiens
agaggcagggccctggg

SEQ ID NO: 630756 - DNA, 19 bp, Homo sapiens
agaggctgcctcagccagt

SEQ ID NO: 630757 - DNA, 20 bp, Homo sapiens
agagggctgagcccctcctc

SEQ ID NO: 630758 - DNA, 13 bp, Homo sapiens
agaggtttcattt

SEQ ID NO: 630759 - DNA, 15 bp, Homo sapiens
agaggtttcattttc

SEQ ID NO: 630760 - DNA, 14 bp, Homo sapiens
agagtcaggagaaa

SEQ ID NO: 630761 - DNA, 19 bp, Homo sapiens
agagtcaggagaaacccct

SEQ ID NO: 630762 - DNA, 22 bp, Homo sapiens
agagtcgagtgatatggcttgt

SEQ ID NO: 630763 - DNA, 22 bp, Homo sapiens
agagtggatctggagtctgaag

SEQ ID NO: 630764 - DNA, 18 bp, Homo sapiens
agagttctccttgtactt

SEQ ID NO: 630765 - DNA, 13 bp, Homo sapiens
agagttttcctca

SEQ ID NO: 630766 - DNA, 18 bp, Homo sapiens
agataaatccaatagtct

SEQ ID NO: 630767 - DNA, 18 bp, Homo sapiens
agataccattttgaaata

SEQ ID NO: 630768 - DNA, 14 bp, Homo sapiens
agatagctccttca

SEQ ID NO: 630769 - DNA, 15 bp, Homo sapiens
agatatatctgaaaa

SEQ ID NO: 630770 - DNA, 17 bp, Homo sapiens
agatatatctgaaaact

SEQ ID NO: 630771 - DNA, 20 bp, Homo sapiens
agatattgtatctcctttaa

SEQ ID NO: 630772 - DNA, 24 bp, Homo sapiens
agatcaagaatcttttgtgaaatt

SEQ ID NO: 630773 - DNA, 12 bp, Homo sapiens
agatcatttttt

SEQ ID NO: 630774 - DNA, 15 bp, Homo sapiens
agatcccaagtcaaa

SEQ ID NO: 630775 - DNA, 17 bp, Homo sapiens
agatcccaagtcaaaca

SEQ ID NO: 630776 - DNA, 20 bp, Homo sapiens
agatcccaagtcaaacagtg

SEQ ID NO: 630777 - DNA, 15 bp, Homo sapiens
agatccctcggtcag

SEQ ID NO: 630778 - DNA, 22 bp, Homo sapiens
agatccctcggtcagcaccgtg

SEQ ID NO: 630779 - DNA, 23 bp, Homo sapiens
agatcctccgcggaggcccctga

SEQ ID NO: 630780 - DNA, 22 bp, Homo sapiens
agatcgtgccgtggagcttgga

SEQ ID NO: 630781 - DNA, 23 bp, Homo sapiens
agatcgtgccgtggagcttggag

SEQ ID NO: 630782 - DNA, 22 bp, Homo sapiens
agatctagtgccattatttcta

SEQ ID NO: 630783 - DNA, 16 bp, Homo sapiens
agatctcatagatgac

SEQ ID NO: 630784 - DNA, 17 bp, Homo sapiens
agatctcatagatgacc

SEQ ID NO: 630785 - DNA, 13 bp, Homo sapiens
agatctgaagtag

SEQ ID NO: 630786 - DNA, 21 bp, Homo sapiens
agatctgaagtagtgtgagtg

SEQ ID NO: 630787 - DNA, 12 bp, Homo sapiens
agatctgactgc

SEQ ID NO: 630788 - DNA, 16 bp, Homo sapiens
agatcttgagcaaggc

SEQ ID NO: 630789 - DNA, 19 bp, Homo sapiens
agatctttttttaagtgtt

SEQ ID NO: 630790 - DNA, 23 bp, Homo sapiens
agatgacccccaggtattgtctt

SEQ ID NO: 630791 - DNA, 13 bp, Homo sapiens
agatgaggctgga

SEQ ID NO: 630792 - DNA, 22 bp, Homo sapiens
agatgaggctggataggagagg

SEQ ID NO: 630793 - DNA, 19 bp, Homo sapiens
agatgctgctgagcacatc

SEQ ID NO: 630794 - DNA, 23 bp, Homo sapiens
agatgggaaggttagaaaggcag

SEQ ID NO: 630795 - DNA, 14 bp, Homo sapiens
agatggggagggcg

SEQ ID NO: 630796 - DNA, 20 bp, Homo sapiens
agatggggagggcgcttttg

SEQ ID NO: 630797 - DNA, 13 bp, Homo sapiens
agatggggcctgg

SEQ ID NO: 630798 - DNA, 16 bp, Homo sapiens
agatggggcctgggct

SEQ ID NO: 630799 - DNA, 13 bp, Homo sapiens
agcagcaaggtgg

SEQ ID NO: 630800 - DNA, 16 bp, Homo sapiens
agcagcaaggtggggg

SEQ ID NO: 630801 - DNA, 14 bp, Homo sapiens
agcagcaggtgctg

SEQ ID NO: 630802 - DNA, 21 bp, Homo sapiens
agcagcaggtgctgtgcgcct

SEQ ID NO: 630803 - DNA, 16 bp, Homo sapiens
agcagccccctgcccg

SEQ ID NO: 630804 - DNA, 16 bp, Homo sapiens
agcagcgcccgaggcc

SEQ ID NO: 630805 - DNA, 21 bp, Homo sapiens
agcagctagaaagagaaaaag

SEQ ID NO: 630806 - DNA, 21 bp, Homo sapiens
agcagctcttcccctttcctg

SEQ ID NO: 630807 - DNA, 19 bp, Homo sapiens
agcagtaccatcccactga

SEQ ID NO: 630808 - DNA, 21 bp, Homo sapiens
agcagtaccatcccactgata

SEQ ID NO: 630809 - DNA, 22 bp, Homo sapiens
agcagtatatattctttcacaa

SEQ ID NO: 630810 - DNA, 16 bp, Homo sapiens
agcagtccatttttga

SEQ ID NO: 630811 - DNA, 18 bp, Homo sapiens
agcagtgaatgctagaca

SEQ ID NO: 630812 - DNA, 20 bp, Homo sapiens
agcagtgaatgctagacaga

SEQ ID NO: 630813 - DNA, 12 bp, Homo sapiens
agcatactgatg

SEQ ID NO: 630814 - DNA, 13 bp, Homo sapiens
agcatagccagca

SEQ ID NO: 630815 - DNA, 16 bp, Homo sapiens
agcatagttctgcaat

SEQ ID NO: 630816 - DNA, 20 bp, Homo sapiens
agcatagttctgcaataaca

SEQ ID NO: 630817 - DNA, 21 bp, Homo sapiens
agcatagttctgcaataacag

SEQ ID NO: 630818 - DNA, 12 bp, Homo sapiens
aggcgcccacct

SEQ ID NO: 630819 - DNA, 13 bp, Homo sapiens
aggcgcccacctg

SEQ ID NO: 630820 - DNA, 14 bp, Homo sapiens
aggcgcccacctgc

SEQ ID NO: 630821 - DNA, 15 bp, Homo sapiens
aggcgcccacctgcc

SEQ ID NO: 630822 - DNA, 18 bp, Homo sapiens
aggcgcccacctgcccag

SEQ ID NO: 630823 - DNA, 23 bp, Homo sapiens
aggcggaggggcttggagcagag

SEQ ID NO: 630824 - DNA, 20 bp, Homo sapiens
aggcggagggtctccctggg

SEQ ID NO: 630825 - DNA, 13 bp, Homo sapiens
aggcgtgggatcc

SEQ ID NO: 630826 - DNA, 20 bp, Homo sapiens
aggctcccactgcccctgca

SEQ ID NO: 630827 - DNA, 20 bp, Homo sapiens
aggctccctccctccctgct

SEQ ID NO: 630828 - DNA, 19 bp, Homo sapiens
aggctctgaatctctcaaa

SEQ ID NO: 630829 - DNA, 21 bp, Homo sapiens
aggctgagacacagcccagag

SEQ ID NO: 630830 - DNA, 19 bp, Homo sapiens
aggctgagacgcaaggatc

SEQ ID NO: 630831 - DNA, 23 bp, Homo sapiens
aggctgatgccgtgcgggctaat

SEQ ID NO: 630832 - DNA, 22 bp, Homo sapiens
aggctgcagctaatttgtgaaa

SEQ ID NO: 630833 - DNA, 17 bp, Homo sapiens
aggctgcctcagccagt

SEQ ID NO: 630834 - DNA, 10 bp, Homo sapiens
aggctgctgc

SEQ ID NO: 630835 - DNA, 12 bp, Homo sapiens
aggctgctgtgt

SEQ ID NO: 630836 - DNA, 20 bp, Homo sapiens
aggctggataggagaggaaa

SEQ ID NO: 630837 - DNA, 23 bp, Homo sapiens
aggcttgtgtaatttcctgctcc

SEQ ID NO: 630838 - DNA, 17 bp, Homo sapiens
aggctttctattggcat

SEQ ID NO: 630839 - DNA, 21 bp, Homo sapiens
agggaaaccttggagaggaga

SEQ ID NO: 630840 - DNA, 21 bp, Homo sapiens
agggaaatcaatttaaaggaa

SEQ ID NO: 630841 - DNA, 13 bp, Homo sapiens
agggaaccagagc

SEQ ID NO: 630842 - DNA, 16 bp, Homo sapiens
agggaagcccacccgc

SEQ ID NO: 630843 - DNA, 17 bp, Homo sapiens
agggaagcccacccgcc

SEQ ID NO: 630844 - DNA, 19 bp, Homo sapiens
agggaagcccacccgcccc

SEQ ID NO: 630845 - DNA, 13 bp, Homo sapiens
agggaagggtgcc

SEQ ID NO: 630846 - DNA, 22 bp, Homo sapiens
agggaagggtgcctggctgggc

SEQ ID NO: 630847 - DNA, 13 bp, Homo sapiens
agggaattttcat

SEQ ID NO: 630848 - DNA, 17 bp, Homo sapiens
agggaattttcattttc

SEQ ID NO: 630849 - DNA, 13 bp, Homo sapiens
agggacacagagg

SEQ ID NO: 630850 - DNA, 17 bp, Homo sapiens
agggacatgtctttggc

SEQ ID NO: 630851 - DNA, 14 bp, Homo sapiens
agggaccaaggaga

SEQ ID NO: 630852 - DNA, 14 bp, Homo sapiens
agggaggtggcagg

SEQ ID NO: 630853 - DNA, 23 bp, Homo sapiens
agggatgctatctcgctagccat

SEQ ID NO: 630854 - DNA, 16 bp, Homo sapiens
agggattgaggagttg

SEQ ID NO: 630855 - DNA, 20 bp, Homo sapiens
agggcaagctcatagcacat

SEQ ID NO: 630856 - DNA, 22 bp, Homo sapiens
agggcacattgcccatggctgg

SEQ ID NO: 630857 - DNA, 13 bp, Homo sapiens
agggcagaggaat

SEQ ID NO: 630858 - DNA, 13 bp, Homo sapiens
agggcagccccgc

SEQ ID NO: 630859 - DNA, 14 bp, Homo sapiens
agggcagcccctcc

SEQ ID NO: 630860 - DNA, 15 bp, Homo sapiens
agggcagcccctccc

SEQ ID NO: 630861 - DNA, 17 bp, Homo sapiens
agggcagggttctagaa

SEQ ID NO: 630862 - DNA, 18 bp, Homo sapiens
agggcagggttctagaag

SEQ ID NO: 630863 - DNA, 12 bp, Homo sapiens
agggccaccctg

SEQ ID NO: 630864 - DNA, 16 bp, Homo sapiens
agggccaccctgagca

SEQ ID NO: 630865 - DNA, 23 bp, Homo sapiens
agggccctggggtctctgagcag

SEQ ID NO: 630866 - DNA, 23 bp, Homo sapiens
agggcccttcccaacctcccctg

SEQ ID NO: 630867 - DNA, 14 bp, Homo sapiens
agggccgcagggcg

SEQ ID NO: 630868 - DNA, 11 bp, Homo sapiens
agggccgccga

SEQ ID NO: 630869 - DNA, 17 bp, Homo sapiens
agtcatggctgtcccct

SEQ ID NO: 630870 - DNA, 12 bp, Homo sapiens
agtccaaggtat

SEQ ID NO: 630871 - DNA, 19 bp, Homo sapiens
agtccacccccattgtgaa

SEQ ID NO: 630872 - DNA, 14 bp, Homo sapiens
agtccactttcctc

SEQ ID NO: 630873 - DNA, 20 bp, Homo sapiens
agtccactttcctctctctc

SEQ ID NO: 630874 - DNA, 19 bp, Homo sapiens
agtccatgtgataattgta

SEQ ID NO: 630875 - DNA, 13 bp, Homo sapiens
agtccatttttga

SEQ ID NO: 630876 - DNA, 17 bp, Homo sapiens
agtccatttttgagtaa

SEQ ID NO: 630877 - DNA, 18 bp, Homo sapiens
agtccatttttgagtaaa

SEQ ID NO: 630878 - DNA, 13 bp, Homo sapiens
agtccctggagct

SEQ ID NO: 630879 - DNA, 20 bp, Homo sapiens
agtcccttcctgtcctgctc

SEQ ID NO: 630880 - DNA, 23 bp, Homo sapiens
agtccgccccgtgctcctctgcc

SEQ ID NO: 630881 - DNA, 13 bp, Homo sapiens
agtcctcacagcc

SEQ ID NO: 630882 - DNA, 20 bp, Homo sapiens
agtcctcacagcctctccct

SEQ ID NO: 630883 - DNA, 16 bp, Homo sapiens
agtcctcgccccccgc

SEQ ID NO: 630884 - DNA, 19 bp, Homo sapiens
agtcggctgggcagggccg

SEQ ID NO: 630885 - DNA, 13 bp, Homo sapiens
agtctaattttta

SEQ ID NO: 630886 - DNA, 20 bp, Homo sapiens
agtctaatttttattcataa

SEQ ID NO: 630887 - DNA, 20 bp, Homo sapiens
agtctctatttgatttgcaa

SEQ ID NO: 630888 - DNA, 20 bp, Homo sapiens
agtctgaggccccaggccct

SEQ ID NO: 630889 - DNA, 19 bp, Homo sapiens
agtctgagtagttatgaat

SEQ ID NO: 630890 - DNA, 18 bp, Homo sapiens
agtctgtacttcagttct

SEQ ID NO: 630891 - DNA, 11 bp, Homo sapiens
agtctgtcctt

SEQ ID NO: 630892 - DNA, 14 bp, Homo sapiens
agtctgtcctttcc

SEQ ID NO: 630893 - DNA, 20 bp, Homo sapiens
agtgaaaaagacttcaaatg

SEQ ID NO: 630894 - DNA, 19 bp, Homo sapiens
agtgaaaacctctttcgga

SEQ ID NO: 630895 - DNA, 17 bp, Homo sapiens
agtgaaattagtatttt

SEQ ID NO: 630896 - DNA, 13 bp, Homo sapiens
agtgaagaaaatg

SEQ ID NO: 630897 - DNA, 15 bp, Homo sapiens
agtgaagcccaggag

SEQ ID NO: 630898 - DNA, 16 bp, Homo sapiens
agtgaagcccaggagg

SEQ ID NO: 630899 - DNA, 17 bp, Homo sapiens
agtgaagcccaggagga

SEQ ID NO: 630900 - DNA, 13 bp, Homo sapiens
agtgaataaatat

SEQ ID NO: 630901 - DNA, 23 bp, Homo sapiens
agtgaataaatattttaggaaac

SEQ ID NO: 630902 - DNA, 18 bp, Homo sapiens
agtgacagaaggcccgag

SEQ ID NO: 630903 - DNA, 19 bp, Homo sapiens
agtgacatgggtgtgccag

SEQ ID NO: 630904 - DNA, 22 bp, Homo sapiens
agtgacatgtcctctctgcttg

SEQ ID NO: 630905 - DNA, 21 bp, Homo sapiens
agtgagaaatttttttccaga

SEQ ID NO: 630906 - DNA, 14 bp, Homo sapiens
agtgattgacattt

SEQ ID NO: 630907 - DNA, 19 bp, Homo sapiens
agtgcagcaaccagagcac

SEQ ID NO: 630908 - DNA, 22 bp, Homo sapiens
agtgcaggaaaaggctgcagct

SEQ ID NO: 630909 - DNA, 17 bp, Homo sapiens
agtgcagggacagcctg

SEQ ID NO: 630910 - DNA, 18 bp, Homo sapiens
agtgcagggacagcctgc

SEQ ID NO: 630911 - DNA, 23 bp, Homo sapiens
agtgcattcattcatcctcttat

SEQ ID NO: 630912 - DNA, 16 bp, Homo sapiens
agtgccattatttcta

SEQ ID NO: 630913 - DNA, 14 bp, Homo sapiens
agtgcccatgtgta

SEQ ID NO: 630914 - DNA, 14 bp, Homo sapiens
agtgccctggggca

SEQ ID NO: 630915 - DNA, 11 bp, Homo sapiens
agtgcctgctg

SEQ ID NO: 630916 - DNA, 15 bp, Homo sapiens
agtgcctgctgttcg

SEQ ID NO: 630917 - DNA, 20 bp, Homo sapiens
agtgccttatggaacactct

SEQ ID NO: 630918 - DNA, 23 bp, Homo sapiens
atcatatttaataggataaatta

SEQ ID NO: 630919 - DNA, 13 bp, Homo sapiens
atcatcctcatgt

SEQ ID NO: 630920 - DNA, 22 bp, Homo sapiens
atcatgcctacattagtgagat

SEQ ID NO: 630921 - DNA, 17 bp, Homo sapiens
atcatgtgtttctgtgt

SEQ ID NO: 630922 - DNA, 14 bp, Homo sapiens
atcattgaaatctt

SEQ ID NO: 630923 - DNA, 21 bp, Homo sapiens
atcattgaaatctttttgctt

SEQ ID NO: 630924 - DNA, 22 bp, Homo sapiens
atcattggtatctgatatctgt

SEQ ID NO: 630925 - DNA, 14 bp, Homo sapiens
atcatttctcttcc

SEQ ID NO: 630926 - DNA, 18 bp, Homo sapiens
atcattttagtatagttt

SEQ ID NO: 630927 - DNA, 19 bp, Homo sapiens
atccaaaatagtcatgttt

SEQ ID NO: 630928 - DNA, 14 bp, Homo sapiens
atccacagtattgt

SEQ ID NO: 630929 - DNA, 17 bp, Homo sapiens
atccacagtattgttct

SEQ ID NO: 630930 - DNA, 11 bp, Homo sapiens
atccacctggt

SEQ ID NO: 630931 - DNA, 19 bp, Homo sapiens
atccaccttcctgcccagg

SEQ ID NO: 630932 - DNA, 19 bp, Homo sapiens
atccactaggtgcccagtc

SEQ ID NO: 630933 - DNA, 17 bp, Homo sapiens
atccagcggggcttctg

SEQ ID NO: 630934 - DNA, 21 bp, Homo sapiens
atccagcggggcttctgggcg

SEQ ID NO: 630935 - DNA, 21 bp, Homo sapiens
atccaggcacccaaaccccgg

SEQ ID NO: 630936 - DNA, 15 bp, Homo sapiens
atccatatcagctct

SEQ ID NO: 630937 - DNA, 14 bp, Homo sapiens
atccatcaggactt

SEQ ID NO: 630938 - DNA, 18 bp, Homo sapiens
atccatcgatttgtatta

SEQ ID NO: 630939 - DNA, 21 bp, Homo sapiens
atccatcgatttgtattaatg

SEQ ID NO: 630940 - DNA, 18 bp, Homo sapiens
atccatggatgcagaaat

SEQ ID NO: 630941 - DNA, 11 bp, Homo sapiens
atcccaagtca

SEQ ID NO: 630942 - DNA, 13 bp, Homo sapiens
atcccaagtcaaa

SEQ ID NO: 630943 - DNA, 18 bp, Homo sapiens
atcccaagtcaaacagtg

SEQ ID NO: 630944 - DNA, 19 bp, Homo sapiens
atcccaagtcaaacagtgt

SEQ ID NO: 630945 - DNA, 20 bp, Homo sapiens
atcccaagtcaaacagtgtg

SEQ ID NO: 630946 - DNA, 21 bp, Homo sapiens
atcccactgatatcacgggcc

SEQ ID NO: 630947 - DNA, 16 bp, Homo sapiens
atccccaaatgtgtct

SEQ ID NO: 630948 - DNA, 21 bp, Homo sapiens
atccccaaatgtgtcttgtat

SEQ ID NO: 630949 - DNA, 21 bp, Homo sapiens
atccccatggaacagccctgc

SEQ ID NO: 630950 - DNA, 18 bp, Homo sapiens
atccctcggtcagcaccg

SEQ ID NO: 630951 - DNA, 17 bp, Homo sapiens
atccctgaacatagttt

SEQ ID NO: 630952 - DNA, 19 bp, Homo sapiens
atccctggccacctgccag

SEQ ID NO: 630953 - DNA, 19 bp, Homo sapiens
atcccttggcccctctctg

SEQ ID NO: 630954 - DNA, 13 bp, Homo sapiens
atccgagcccctg

SEQ ID NO: 630955 - DNA, 14 bp, Homo sapiens
atccgagcccctgt

SEQ ID NO: 630956 - DNA, 15 bp, Homo sapiens
atccgagcccctgtt

SEQ ID NO: 630957 - DNA, 14 bp, Homo sapiens
atccgtctctgtcc

SEQ ID NO: 630958 - DNA, 15 bp, Homo sapiens
atccgtctctgtccg

SEQ ID NO: 630959 - DNA, 16 bp, Homo sapiens
atcctccgcggaggcc

SEQ ID NO: 630960 - DNA, 23 bp, Homo sapiens
atcctctgcttgtcattctgcta

SEQ ID NO: 630961 - DNA, 20 bp, Homo sapiens
atcctcttatatgtgcccct

SEQ ID NO: 630962 - DNA, 11 bp, Homo sapiens
atcctgagcca

SEQ ID NO: 630963 - DNA, 13 bp, Homo sapiens
atcctgagccaga

SEQ ID NO: 630964 - DNA, 14 bp, Homo sapiens
atcctgagccagat

SEQ ID NO: 630965 - DNA, 15 bp, Homo sapiens
atcctgcaccctctg

SEQ ID NO: 630966 - DNA, 16 bp, Homo sapiens
atcctgcaccctctgc

SEQ ID NO: 630967 - DNA, 21 bp, Homo sapiens
atcctgccttcatggaactca

SEQ ID NO: 630968 - DNA, 20 bp, Homo sapiens
atcctggaaatttgtgtgct

SEQ ID NO: 630969 - DNA, 21 bp, Homo sapiens
atccttcccgcagcaccagcc

SEQ ID NO: 630970 - DNA, 15 bp, Homo sapiens
atccttgctgcagct

SEQ ID NO: 630971 - DNA, 15 bp, Homo sapiens
atcgatttgtattaa

SEQ ID NO: 630972 - DNA, 18 bp, Homo sapiens
atcgatttgtattaatgt

SEQ ID NO: 630973 - DNA, 21 bp, Homo sapiens
atcgcctgggacgcccctttc

SEQ ID NO: 630974 - DNA, 13 bp, Homo sapiens
atctaaatattat

SEQ ID NO: 630975 - DNA, 19 bp, Homo sapiens
atctaaattaacttctatt

SEQ ID NO: 630976 - DNA, 19 bp, Homo sapiens
atctactagaaccttctaa

SEQ ID NO: 630977 - DNA, 21 bp, Homo sapiens
atctcaaaagatctcctgtgc

SEQ ID NO: 630978 - DNA, 17 bp, Homo sapiens
atctcaaatctgctttc

SEQ ID NO: 630979 - DNA, 19 bp, Homo sapiens
atctcagcatcctggaaat

SEQ ID NO: 630980 - DNA, 23 bp, Homo sapiens
atctcagcatcctggaaatttgt

SEQ ID NO: 630981 - DNA, 16 bp, Homo sapiens
atctcaggtggcattt

SEQ ID NO: 630982 - DNA, 19 bp, Homo sapiens
atctcaggtggcatttgca

SEQ ID NO: 630983 - DNA, 19 bp, Homo sapiens
atctccaccctgagcctga

SEQ ID NO: 630984 - DNA, 21 bp, Homo sapiens
atctccagccaatttcaaaga

SEQ ID NO: 630985 - DNA, 17 bp, Homo sapiens
atctcctcccatggcct

SEQ ID NO: 630986 - DNA, 18 bp, Homo sapiens
atctcgtatggatttcta

SEQ ID NO: 630987 - DNA, 13 bp, Homo sapiens
atctgaaaactgg

SEQ ID NO: 630988 - DNA, 14 bp, Homo sapiens
atctgaaatctaca

SEQ ID NO: 630989 - DNA, 18 bp, Homo sapiens
atctgaaatctacaacat

SEQ ID NO: 630990 - DNA, 16 bp, Homo sapiens
atctgactgccaaata

SEQ ID NO: 630991 - DNA, 19 bp, Homo sapiens
atctgatgatgttctgaaa

SEQ ID NO: 630992 - DNA, 11 bp, Homo sapiens
atctgcctgga

SEQ ID NO: 630993 - DNA, 20 bp, Homo sapiens
atctgcctggagcctgggca

SEQ ID NO: 630994 - DNA, 21 bp, Homo sapiens
atctggagtctgaaggagagg

SEQ ID NO: 630995 - DNA, 23 bp, Homo sapiens
atctggagtctgaaggagaggag

SEQ ID NO: 630996 - DNA, 21 bp, Homo sapiens
atctgggttttagaaattcta

SEQ ID NO: 630997 - DNA, 17 bp, Homo sapiens
atctggtgcgtgtggcc

SEQ ID NO: 630998 - DNA, 16 bp, Homo sapiens
atctgtaaaaccaggc

SEQ ID NO: 630999 - DNA, 17 bp, Homo sapiens
atctgtaaaaccaggct

SEQ ID NO: 631000 - DNA, 15 bp, Homo sapiens
atctgtatatcagct

SEQ ID NO: 631001 - DNA, 14 bp, Homo sapiens
atctgtcagcttcc

SEQ ID NO: 631002 - DNA, 13 bp, Homo sapiens
atctgtctgagcc

SEQ ID NO: 631003 - DNA, 14 bp, Homo sapiens
atctgtctgagccc

SEQ ID NO: 631004 - DNA, 22 bp, Homo sapiens
atctgtctgagccctgccctca

SEQ ID NO: 631005 - DNA, 21 bp, Homo sapiens
atctgtctttatgatttcatg

SEQ ID NO: 631006 - DNA, 22 bp, Homo sapiens
atctgtgtaacctccacagtag

SEQ ID NO: 631007 - DNA, 13 bp, Homo sapiens
atctgttgtaata

SEQ ID NO: 631008 - DNA, 15 bp, Homo sapiens
atctgtttgcttcta

SEQ ID NO: 631009 - DNA, 23 bp, Homo sapiens
atcttcctgcctactggatgctt

SEQ ID NO: 631010 - DNA, 14 bp, Homo sapiens
atcttgctgtgaaa

SEQ ID NO: 631011 - DNA, 20 bp, Homo sapiens
ataggttctgctttctgata

SEQ ID NO: 631012 - DNA, 19 bp, Homo sapiens
atagtgttgtgttacaata

SEQ ID NO: 631013 - DNA, 23 bp, Homo sapiens
atagtgttgtgttacaataagtg

SEQ ID NO: 631014 - DNA, 19 bp, Homo sapiens
atagttaccgatggtgtcc

SEQ ID NO: 631015 - DNA, 12 bp, Homo sapiens
atagttctgcaa

SEQ ID NO: 631016 - DNA, 23 bp, Homo sapiens
atagttgtaaagatattgtatct

SEQ ID NO: 631017 - DNA, 18 bp, Homo sapiens
atagtttttaaggttatt

SEQ ID NO: 631018 - DNA, 19 bp, Homo sapiens
atagtttttaaggttattt

SEQ ID NO: 631019 - DNA, 22 bp, Homo sapiens
atataaaaataattaaaacaaa

SEQ ID NO: 631020 - DNA, 19 bp, Homo sapiens
atataaaatacacgtgtat

SEQ ID NO: 631021 - DNA, 12 bp, Homo sapiens
atataaactgtg

SEQ ID NO: 631022 - DNA, 14 bp, Homo sapiens
atataaatgaatga

SEQ ID NO: 631023 - DNA, 12 bp, Homo sapiens
atataacatgaa

SEQ ID NO: 631024 - DNA, 17 bp, Homo sapiens
atataacatgaaagtca

SEQ ID NO: 631025 - DNA, 17 bp, Homo sapiens
atataagacaagtctga

SEQ ID NO: 631026 - DNA, 14 bp, Homo sapiens
atataagccatagc

SEQ ID NO: 631027 - DNA, 16 bp, Homo sapiens
atataagccatagccc

SEQ ID NO: 631028 - DNA, 21 bp, Homo sapiens
atataataaatatatatttat

SEQ ID NO: 631029 - DNA, 23 bp, Homo sapiens
atataataaatatatatttatca

SEQ ID NO: 631030 - DNA, 18 bp, Homo sapiens
atataatggcctcttaaa

SEQ ID NO: 631031 - DNA, 16 bp, Homo sapiens
atatacagtgtgtagt

SEQ ID NO: 631032 - DNA, 20 bp, Homo sapiens
atatacatacgcaattgtat

SEQ ID NO: 631033 - DNA, 13 bp, Homo sapiens
atatacattttgc

SEQ ID NO: 631034 - DNA, 23 bp, Homo sapiens
atataggggcaaaaatttgacat

SEQ ID NO: 631035 - DNA, 18 bp, Homo sapiens
atatagtgttgtgttaca

SEQ ID NO: 631036 - DNA, 22 bp, Homo sapiens
atatataaaatacacgtgtata

SEQ ID NO: 631037 - DNA, 12 bp, Homo sapiens
atatatatgtat

SEQ ID NO: 631038 - DNA, 14 bp, Homo sapiens
atatatatgtatat

SEQ ID NO: 631039 - DNA, 14 bp, Homo sapiens
atatatattaaaat

SEQ ID NO: 631040 - DNA, 14 bp, Homo sapiens
atatatatttatca

SEQ ID NO: 631041 - DNA, 15 bp, Homo sapiens
atatatatttatcat

SEQ ID NO: 631042 - DNA, 19 bp, Homo sapiens
atatatgaaaactaagttc

SEQ ID NO: 631043 - DNA, 16 bp, Homo sapiens
atatatgtatatctgt

SEQ ID NO: 631044 - DNA, 19 bp, Homo sapiens
atatatgtgaactttctca

SEQ ID NO: 631045 - DNA, 22 bp, Homo sapiens
atatattgaagtaagttcatca

SEQ ID NO: 631046 - DNA, 19 bp, Homo sapiens
atatatttattattttcat

SEQ ID NO: 631047 - DNA, 22 bp, Homo sapiens
atatatttattattttcatata

SEQ ID NO: 631048 - DNA, 15 bp, Homo sapiens
atatatttgcataat

SEQ ID NO: 631049 - DNA, 18 bp, Homo sapiens
atatatttgcataatatg

SEQ ID NO: 631050 - DNA, 11 bp, Homo sapiens
atatcagctct

SEQ ID NO: 631051 - DNA, 14 bp, Homo sapiens
atatcagctctgca

SEQ ID NO: 631052 - DNA, 20 bp, Homo sapiens
atatcaggaaatatctgtga

SEQ ID NO: 631053 - DNA, 21 bp, Homo sapiens
atatcaggaaatatctgtgaa

SEQ ID NO: 631054 - DNA, 17 bp, Homo sapiens
atatcagttacagtggc

SEQ ID NO: 631055 - DNA, 14 bp, Homo sapiens
atatcattcagaat

SEQ ID NO: 631056 - DNA, 23 bp, Homo sapiens
atatctatttatctgtctgagcc

SEQ ID NO: 631057 - DNA, 16 bp, Homo sapiens
atatgaaagagaaaat

SEQ ID NO: 631058 - DNA, 17 bp, Homo sapiens
atatgaaagagaaaatg

SEQ ID NO: 631059 - DNA, 14 bp, Homo sapiens
atatgagattggaa

SEQ ID NO: 631060 - DNA, 16 bp, Homo sapiens
atatgagattggaaaa

SEQ ID NO: 631061 - DNA, 17 bp, Homo sapiens
atatgagcatgctccct

SEQ ID NO: 631062 - DNA, 16 bp, Homo sapiens
atatgagctttcgttg

SEQ ID NO: 631063 - DNA, 20 bp, Homo sapiens
atatgaggatgtatgtgtat

SEQ ID NO: 631064 - DNA, 18 bp, Homo sapiens
atatgattctcctctccc

SEQ ID NO: 631065 - DNA, 13 bp, Homo sapiens
atatgcatatata

SEQ ID NO: 631066 - DNA, 14 bp, Homo sapiens
atatgcatatatat

SEQ ID NO: 631067 - DNA, 18 bp, Homo sapiens
atatgcatatatatgtat

SEQ ID NO: 631068 - DNA, 12 bp, Homo sapiens
atatggatattt

SEQ ID NO: 631069 - DNA, 18 bp, Homo sapiens
atatggcaacgttcatgt

SEQ ID NO: 631070 - DNA, 19 bp, Homo sapiens
atatggcaacgttcatgtt

SEQ ID NO: 631071 - DNA, 22 bp, Homo sapiens
atatggcaacgttcatgttcat

SEQ ID NO: 631072 - DNA, 18 bp, Homo sapiens
atatgtaacttcagatgt

SEQ ID NO: 631073 - DNA, 13 bp, Homo sapiens
atatgtacaaata

SEQ ID NO: 631074 - DNA, 15 bp, Homo sapiens
atatgtacaaataat

SEQ ID NO: 631075 - DNA, 16 bp, Homo sapiens
atatgtaggaaaattt

SEQ ID NO: 631076 - DNA, 13 bp, Homo sapiens
atatgtctttaaa

SEQ ID NO: 631077 - DNA, 17 bp, Homo sapiens
atatgtgaactttctca

SEQ ID NO: 631078 - DNA, 23 bp, Homo sapiens
atatgtgaactttctcagcatat

SEQ ID NO: 631079 - DNA, 12 bp, Homo sapiens
atatgtgcccct

SEQ ID NO: 631080 - DNA, 18 bp, Homo sapiens
atatgtttatacacacag

SEQ ID NO: 631081 - DNA, 23 bp, Homo sapiens
atattaaaaagccaagtgtcctg

SEQ ID NO: 631082 - DNA, 17 bp, Homo sapiens
atattaaaattgattgt

SEQ ID NO: 631083 - DNA, 16 bp, Homo sapiens
atattattttctgtaa

SEQ ID NO: 631084 - DNA, 14 bp, Homo sapiens
atattcccatggta

SEQ ID NO: 631085 - DNA, 17 bp, Homo sapiens
atattctgtcattggtt

SEQ ID NO: 631086 - DNA, 14 bp, Homo sapiens
atattgatgtaact

SEQ ID NO: 631087 - DNA, 17 bp, Homo sapiens
atattgccttgatgttt

SEQ ID NO: 631088 - DNA, 17 bp, Homo sapiens
atattgctgatggtgca

SEQ ID NO: 631089 - DNA, 12 bp, Homo sapiens
atattgctgtct

SEQ ID NO: 631090 - DNA, 17 bp, Homo sapiens
atatttattattttcat

SEQ ID NO: 631091 - DNA, 20 bp, Homo sapiens
atatttgcataatatgcata

SEQ ID NO: 631092 - DNA, 18 bp, Homo sapiens
atattttcctttatgtga

SEQ ID NO: 631093 - DNA, 21 bp, Homo sapiens
atattttcctttatgtgatgt

SEQ ID NO: 631094 - DNA, 19 bp, Homo sapiens
atattttgctgctgaattt

SEQ ID NO: 631095 - DNA, 22 bp, Homo sapiens
atcaaagccctccctgtctgtc

SEQ ID NO: 631096 - DNA, 19 bp, Homo sapiens
atgaaatacttgacaacat

SEQ ID NO: 631097 - DNA, 15 bp, Homo sapiens
atgaaatataaactg

SEQ ID NO: 631098 - DNA, 19 bp, Homo sapiens
atgaaatataaactgtgag

SEQ ID NO: 631099 - DNA, 17 bp, Homo sapiens
atgaaatttaagcacaa

SEQ ID NO: 631100 - DNA, 22 bp, Homo sapiens
atgaactcaggtttccggctac

SEQ ID NO: 631101 - DNA, 12 bp, Homo sapiens
atgaactctttc

SEQ ID NO: 631102 - DNA, 17 bp, Homo sapiens
atgaactctttccccag

SEQ ID NO: 631103 - DNA, 23 bp, Homo sapiens
atgaagcaaacacacagactctg

SEQ ID NO: 631104 - DNA, 14 bp, Homo sapiens
atgaagcagaatga

SEQ ID NO: 631105 - DNA, 15 bp, Homo sapiens
atgaagcagaatgag

SEQ ID NO: 631106 - DNA, 20 bp, Homo sapiens
atgaagccctaagtaaatct

SEQ ID NO: 631107 - DNA, 12 bp, Homo sapiens
atgaagctgcca

SEQ ID NO: 631108 - DNA, 19 bp, Homo sapiens
atgaaggggccagaccacg

SEQ ID NO: 631109 - DNA, 14 bp, Homo sapiens
atgaataaaatgtt

SEQ ID NO: 631110 - DNA, 20 bp, Homo sapiens
atgaatacgtaaactgcgta

SEQ ID NO: 631111 - DNA, 22 bp, Homo sapiens
atgaatcgcagacgcaagaggt

SEQ ID NO: 631112 - DNA, 12 bp, Homo sapiens
atgaatgaaata

SEQ ID NO: 631113 - DNA, 16 bp, Homo sapiens
atgaatgaaatataaa

SEQ ID NO: 631114 - DNA, 23 bp, Homo sapiens
atgaatgaaatataaactgtgag

SEQ ID NO: 631115 - DNA, 12 bp, Homo sapiens
atgaattgcctt

SEQ ID NO: 631116 - DNA, 20 bp, Homo sapiens
atgaatttaccatcaaacaa

SEQ ID NO: 631117 - DNA, 14 bp, Homo sapiens
atgacaagtgactt

SEQ ID NO: 631118 - DNA, 17 bp, Homo sapiens
atgacagtagcatactg

SEQ ID NO: 631119 - DNA, 19 bp, Homo sapiens
atgacccccaggtattgtc

SEQ ID NO: 631120 - DNA, 16 bp, Homo sapiens
atgacccgtacacacc

SEQ ID NO: 631121 - DNA, 15 bp, Homo sapiens
atgacctttcaatag

SEQ ID NO: 631122 - DNA, 18 bp, Homo sapiens
atgagaaattgtgccaaa

SEQ ID NO: 631123 - DNA, 22 bp, Homo sapiens
atgagaaattgtgccaaagata

SEQ ID NO: 631124 - DNA, 16 bp, Homo sapiens
atgagaggaaatcacc

SEQ ID NO: 631125 - DNA, 19 bp, Homo sapiens
atgagatcccagagttatt

SEQ ID NO: 631126 - DNA, 21 bp, Homo sapiens
atgagatgatttaattcttac

SEQ ID NO: 631127 - DNA, 20 bp, Homo sapiens
atgagatgttattactgttt

SEQ ID NO: 631128 - DNA, 19 bp, Homo sapiens
atgagattggaaaaaatta

SEQ ID NO: 631129 - DNA, 22 bp, Homo sapiens
atgagattggaaaaaattagac

SEQ ID NO: 631130 - DNA, 18 bp, Homo sapiens
atgagcatgctccctcat

SEQ ID NO: 631131 - DNA, 21 bp, Homo sapiens
atgagccaataaagctcacac

SEQ ID NO: 631132 - DNA, 16 bp, Homo sapiens
atgaggatgtatgtgt

SEQ ID NO: 631133 - DNA, 17 bp, Homo sapiens
atgaggatgtatgtgta

SEQ ID NO: 631134 - DNA, 18 bp, Homo sapiens
atgaggatgtatgtgtat

SEQ ID NO: 631135 - DNA, 20 bp, Homo sapiens
atgaggctggataggagagg

SEQ ID NO: 631136 - DNA, 18 bp, Homo sapiens
atgagggcgtgaaacaca

SEQ ID NO: 631137 - DNA, 19 bp, Homo sapiens
atgagggcgtgaaacacaa

SEQ ID NO: 631138 - DNA, 20 bp, Homo sapiens
atgagttctgcacatacaga

SEQ ID NO: 631139 - DNA, 20 bp, Homo sapiens
atgagtttccagctaagcct

SEQ ID NO: 631140 - DNA, 13 bp, Homo sapiens
atgataatagctc

SEQ ID NO: 631141 - DNA, 21 bp, Homo sapiens
atgatactgaattgttatgta

SEQ ID NO: 631142 - DNA, 15 bp, Homo sapiens
atgatacttggtcct

SEQ ID NO: 631143 - DNA, 15 bp, Homo sapiens
atgatatgtctttaa

SEQ ID NO: 631144 - DNA, 21 bp, Homo sapiens
atgatccggatttaatttgat

SEQ ID NO: 631145 - DNA, 22 bp, Homo sapiens
atgatccggatttaatttgata

SEQ ID NO: 631146 - DNA, 13 bp, Homo sapiens
atgatgttctgaa

SEQ ID NO: 631147 - DNA, 17 bp, Homo sapiens
atgatgttctgaaatgg

SEQ ID NO: 631148 - DNA, 13 bp, Homo sapiens
atgattagacaat

SEQ ID NO: 631149 - DNA, 14 bp, Homo sapiens
atgattcaatgtga

SEQ ID NO: 631150 - DNA, 15 bp, Homo sapiens
atgattcttgtgtca

SEQ ID NO: 631151 - DNA, 13 bp, Homo sapiens
atgatttaacatt

SEQ ID NO: 631152 - DNA, 15 bp, Homo sapiens
atgatttaattctta

SEQ ID NO: 631153 - DNA, 14 bp, Homo sapiens
atgatttcagaaac

SEQ ID NO: 631154 - DNA, 18 bp, Homo sapiens
atgcaaaccatcattgaa

SEQ ID NO: 631155 - DNA, 19 bp, Homo sapiens
atgcaaaccatcattgaaa

SEQ ID NO: 631156 - DNA, 20 bp, Homo sapiens
atgcaaaccatcattgaaat

SEQ ID NO: 631157 - DNA, 18 bp, Homo sapiens
atgcaaatatttttttgt

SEQ ID NO: 631158 - DNA, 13 bp, Homo sapiens
atgcacaccaaat

SEQ ID NO: 631159 - DNA, 19 bp, Homo sapiens
atgcaccagtgccgcctgt

SEQ ID NO: 631160 - DNA, 17 bp, Homo sapiens
atgcactcttttgagca

SEQ ID NO: 631161 - DNA, 18 bp, Homo sapiens
atgcaggcagattaataa

SEQ ID NO: 631162 - DNA, 18 bp, Homo sapiens
atgcagggcccccacagg

SEQ ID NO: 631163 - DNA, 21 bp, Homo sapiens
atgcagggcccccacaggagc

SEQ ID NO: 631164 - DNA, 17 bp, Homo sapiens
atgcatagacaagtgtt

SEQ ID NO: 631165 - DNA, 18 bp, Homo sapiens
atgcatagacaagtgttt

SEQ ID NO: 631166 - DNA, 12 bp, Homo sapiens
atgcatatatat

SEQ ID NO: 631167 - DNA, 21 bp, Homo sapiens
atgcatattaaagaaagtcat

SEQ ID NO: 631168 - DNA, 22 bp, Homo sapiens
atgcattgtggatatgagcttt

SEQ ID NO: 631169 - DNA, 16 bp, Homo sapiens
atgcatttatgcatga

SEQ ID NO: 631170 - DNA, 13 bp, Homo sapiens
atgccaatgtcca

SEQ ID NO: 631171 - DNA, 13 bp, Homo sapiens
atgccagggacat

SEQ ID NO: 631172 - DNA, 17 bp, Homo sapiens
atgccatctccaccctg

SEQ ID NO: 631173 - DNA, 23 bp, Homo sapiens
atgccatctccaccctgagcctg

SEQ ID NO: 631174 - DNA, 21 bp, Homo sapiens
atgccatgtatgttgcatgaa

SEQ ID NO: 631175 - DNA, 13 bp, Homo sapiens
atgcccaaatata

SEQ ID NO: 631176 - DNA, 13 bp, Homo sapiens
atgccccagctct

SEQ ID NO: 631177 - DNA, 22 bp, Homo sapiens
atgcccctgcagtttggccctg

SEQ ID NO: 631178 - DNA, 12 bp, Homo sapiens
atgcccctggcc

SEQ ID NO: 631179 - DNA, 13 bp, Homo sapiens
atgcccctggccc

SEQ ID NO: 631180 - DNA, 20 bp, Homo sapiens
atgcccctggccctgcctca

SEQ ID NO: 631181 - DNA, 21 bp, Homo sapiens
atgcccctggccctgcctcac

SEQ ID NO: 631182 - DNA, 19 bp, Homo sapiens
atgccctccctgctgccag

SEQ ID NO: 631183 - DNA, 15 bp, Homo sapiens
atgcctacattagtg

SEQ ID NO: 631184 - DNA, 20 bp, Homo sapiens
atgcctacattagtgagatt

SEQ ID NO: 631185 - DNA, 12 bp, Homo sapiens
atgcctcagttt

SEQ ID NO: 631186 - DNA, 14 bp, Homo sapiens
atgcgatgtcatat

SEQ ID NO: 631187 - DNA, 17 bp, Homo sapiens
atgcgtggctcccagca

SEQ ID NO: 631188 - DNA, 16 bp, Homo sapiens
atgctaacctctctga

SEQ ID NO: 631189 - DNA, 18 bp, Homo sapiens
atgctatctcgctagcca

SEQ ID NO: 631190 - DNA, 19 bp, Homo sapiens
atgctatctcgctagccat

SEQ ID NO: 631191 - DNA, 21 bp, Homo sapiens
atgctatctcgctagccatat

SEQ ID NO: 631192 - DNA, 14 bp, Homo sapiens
atgctcaatgtgct

SEQ ID NO: 631193 - DNA, 17 bp, Homo sapiens
atgctcaatgtgctgtt

SEQ ID NO: 631194 - DNA, 21 bp, Homo sapiens
atgctcaatgtgctgttgatt

SEQ ID NO: 631195 - DNA, 16 bp, Homo sapiens
atgctcagctcagcat

SEQ ID NO: 631196 - DNA, 13 bp, Homo sapiens
atgctcagtattg

SEQ ID NO: 631197 - DNA, 21 bp, Homo sapiens
atgctgattcaaggcattatt

SEQ ID NO: 631198 - DNA, 17 bp, Homo sapiens
attgaagctaaaacact

SEQ ID NO: 631199 - DNA, 23 bp, Homo sapiens
attgacatgtacagagaactaac

SEQ ID NO: 631200 - DNA, 21 bp, Homo sapiens
attgacgacctacatctgaaa

SEQ ID NO: 631201 - DNA, 16 bp, Homo sapiens
attgagacactgtcaa

SEQ ID NO: 631202 - DNA, 17 bp, Homo sapiens
attgagagcagcctctt

SEQ ID NO: 631203 - DNA, 22 bp, Homo sapiens
attgagtcattttatatatgaa

SEQ ID NO: 631204 - DNA, 13 bp, Homo sapiens
attgagtgtacat

SEQ ID NO: 631205 - DNA, 20 bp, Homo sapiens
attgcacacacagtctgttc

SEQ ID NO: 631206 - DNA, 21 bp, Homo sapiens
attgcccatggctgggaacat

SEQ ID NO: 631207 - DNA, 17 bp, Homo sapiens
attgcgagaaacagaga

SEQ ID NO: 631208 - DNA, 21 bp, Homo sapiens
attgctctggggcttgctatt

SEQ ID NO: 631209 - DNA, 21 bp, Homo sapiens
attgctgagatgtttagtagc

SEQ ID NO: 631210 - DNA, 22 bp, Homo sapiens
attgctgagatgtttagtagct

SEQ ID NO: 631211 - DNA, 19 bp, Homo sapiens
attgctgatggtgcaatga

SEQ ID NO: 631212 - DNA, 21 bp, Homo sapiens
attgctgtctgaaaaagtgtt

SEQ ID NO: 631213 - DNA, 15 bp, Homo sapiens
attgcttgagcatgc

SEQ ID NO: 631214 - DNA, 15 bp, Homo sapiens
attggcagcagattt

SEQ ID NO: 631215 - DNA, 17 bp, Homo sapiens
attggcagtgtgtcaca

SEQ ID NO: 631216 - DNA, 15 bp, Homo sapiens
attggcatggatttc

SEQ ID NO: 631217 - DNA, 15 bp, Homo sapiens
attggtaccagagcc

SEQ ID NO: 631218 - DNA, 19 bp, Homo sapiens
attggttaatgaaaaatct

SEQ ID NO: 631219 - DNA, 16 bp, Homo sapiens
attggttacaaatttt

SEQ ID NO: 631220 - DNA, 20 bp, Homo sapiens
attggttacaaatttttact

SEQ ID NO: 631221 - DNA, 19 bp, Homo sapiens
attgtaaaggtgatgaatt

SEQ ID NO: 631222 - DNA, 22 bp, Homo sapiens
attgtaaaggtgatgaatttac

SEQ ID NO: 631223 - DNA, 23 bp, Homo sapiens
attgtaaaggtgatgaatttacc

SEQ ID NO: 631224 - DNA, 14 bp, Homo sapiens
attgtaacagacat

SEQ ID NO: 631225 - DNA, 14 bp, Homo sapiens
attgtatatatatg

SEQ ID NO: 631226 - DNA, 19 bp, Homo sapiens
attgtatatatatgtgaac

SEQ ID NO: 631227 - DNA, 20 bp, Homo sapiens
attgtatatatatgtgaact

SEQ ID NO: 631228 - DNA, 16 bp, Homo sapiens
attgtatatatggata

SEQ ID NO: 631229 - DNA, 14 bp, Homo sapiens
attgtcctgtttct

SEQ ID NO: 631230 - DNA, 20 bp, Homo sapiens
attgtcttttgtcatgtggc

SEQ ID NO: 631231 - DNA, 12 bp, Homo sapiens
attgtgccaaag

SEQ ID NO: 631232 - DNA, 21 bp, Homo sapiens
attgtgccaaagatagcagaa

SEQ ID NO: 631233 - DNA, 14 bp, Homo sapiens
attgtggatgaaga

SEQ ID NO: 631234 - DNA, 16 bp, Homo sapiens
attgtgtcttttgcat

SEQ ID NO: 631235 - DNA, 17 bp, Homo sapiens
attgtgtcttttgcatg

SEQ ID NO: 631236 - DNA, 22 bp, Homo sapiens
attgttcaaagaacccccctcc

SEQ ID NO: 631237 - DNA, 16 bp, Homo sapiens
attgttcagaaaagca

SEQ ID NO: 631238 - DNA, 23 bp, Homo sapiens
attgtttttagaaatttattctt

SEQ ID NO: 631239 - DNA, 21 bp, Homo sapiens
atttaaaaattaaagcagcaa

SEQ ID NO: 631240 - DNA, 20 bp, Homo sapiens
atttaacactgagtgaaata

SEQ ID NO: 631241 - DNA, 15 bp, Homo sapiens
atttaactagcactt

SEQ ID NO: 631242 - DNA, 17 bp, Homo sapiens
atttaactagcacttta

SEQ ID NO: 631243 - DNA, 13 bp, Homo sapiens
atttaagcacaaa

SEQ ID NO: 631244 - DNA, 14 bp, Homo sapiens
atttaagcacaaaa

SEQ ID NO: 631245 - DNA, 18 bp, Homo sapiens
atttaagtggactgtatt

SEQ ID NO: 631246 - DNA, 23 bp, Homo sapiens
atttaagtggactgtatttcggc

SEQ ID NO: 631247 - DNA, 22 bp, Homo sapiens
atttaatcatttccagcaaaat

SEQ ID NO: 631248 - DNA, 12 bp, Homo sapiens
atttaattctta

SEQ ID NO: 631249 - DNA, 14 bp, Homo sapiens
atttaattcttacc

SEQ ID NO: 631250 - DNA, 18 bp, Homo sapiens
atttacaacttccagatt

SEQ ID NO: 631251 - DNA, 13 bp, Homo sapiens
atttaccagaagt

SEQ ID NO: 631252 - DNA, 19 bp, Homo sapiens
atttaccagaagtttaaat

SEQ ID NO: 631253 - DNA, 21 bp, Homo sapiens
atttaccatcaaacaaatcat

SEQ ID NO: 631254 - DNA, 14 bp, Homo sapiens
atttactaacagta

SEQ ID NO: 631255 - DNA, 15 bp, Homo sapiens
atttactcctcctgc

SEQ ID NO: 631256 - DNA, 21 bp, Homo sapiens
atttactgtttataataggtg

SEQ ID NO: 631257 - DNA, 18 bp, Homo sapiens
atttagcacagtatttaa

SEQ ID NO: 631258 - DNA, 22 bp, Homo sapiens
atttagcacagtatttaacatt

SEQ ID NO: 631259 - DNA, 14 bp, Homo sapiens
atttagcatgagtt

SEQ ID NO: 631260 - DNA, 17 bp, Homo sapiens
atttagcatgagttctg

SEQ ID NO: 631261 - DNA, 19 bp, Homo sapiens
atttaggaatgctcaatgt

SEQ ID NO: 631262 - DNA, 15 bp, Homo sapiens
atttagtcctcacct

SEQ ID NO: 631263 - DNA, 16 bp, Homo sapiens
atttagtcctcacctt

SEQ ID NO: 631264 - DNA, 18 bp, Homo sapiens
atttataaggacagagat

SEQ ID NO: 631265 - DNA, 21 bp, Homo sapiens
atttatagagttcatagaaat

SEQ ID NO: 631266 - DNA, 12 bp, Homo sapiens
atttatgtacaa

SEQ ID NO: 631267 - DNA, 13 bp, Homo sapiens
atttatgtacaaa

SEQ ID NO: 631268 - DNA, 15 bp, Homo sapiens
atttatgtacaaaat

SEQ ID NO: 631269 - DNA, 16 bp, Homo sapiens
atttatgtcattttca

SEQ ID NO: 631270 - DNA, 13 bp, Homo sapiens
atttattaaatgt

SEQ ID NO: 631271 - DNA, 16 bp, Homo sapiens
atttattgtatatatg

SEQ ID NO: 631272 - DNA, 16 bp, Homo sapiens
atttcaaagaaaacag

SEQ ID NO: 631273 - DNA, 20 bp, Homo sapiens
atttcaaagaaaacagacca

SEQ ID NO: 631274 - DNA, 21 bp, Homo sapiens
atttcaaccacacctaaatta

SEQ ID NO: 631275 - DNA, 13 bp, Homo sapiens
atttcacacaact

SEQ ID NO: 631276 - DNA, 20 bp, Homo sapiens
atttcacacaactgtggata

SEQ ID NO: 631277 - DNA, 15 bp, Homo sapiens
atttcataagcacat

SEQ ID NO: 631278 - DNA, 13 bp, Homo sapiens
atttcatacaaat

SEQ ID NO: 631279 - DNA, 13 bp, Homo sapiens
atttccagcaaaa

SEQ ID NO: 631280 - DNA, 18 bp, Homo sapiens
atttccagcaaaatatat

SEQ ID NO: 631281 - DNA, 21 bp, Homo sapiens
atttccatggattcccctgga

SEQ ID NO: 631282 - DNA, 15 bp, Homo sapiens
atttcctgctcctcc

SEQ ID NO: 631283 - DNA, 23 bp, Homo sapiens
atttctagatatgagaaatataa

SEQ ID NO: 631284 - DNA, 14 bp, Homo sapiens
atttctgctgaatt

SEQ ID NO: 631285 - DNA, 19 bp, Homo sapiens
atttcttggtatgatcatt

SEQ ID NO: 631286 - DNA, 19 bp, Homo sapiens
atttgacattgtcagaatg

SEQ ID NO: 631287 - DNA, 13 bp, Homo sapiens
atttgataaagat

SEQ ID NO: 631288 - DNA, 16 bp, Homo sapiens
atttgataatcagttt

SEQ ID NO: 631289 - DNA, 18 bp, Homo sapiens
atttgatatacagacctc

SEQ ID NO: 631290 - DNA, 14 bp, Homo sapiens
atttgatatcacag

SEQ ID NO: 631291 - DNA, 15 bp, Homo sapiens
atttgatatcacagt

SEQ ID NO: 631292 - DNA, 20 bp, Homo sapiens
atttgatctggtgcgtgtgg

SEQ ID NO: 631293 - DNA, 19 bp, Homo sapiens
atttgcaacactgccaaac

SEQ ID NO: 631294 - DNA, 23 bp, Homo sapiens
atttgcaacactgccaaacatca

SEQ ID NO: 631295 - DNA, 21 bp, Homo sapiens
atttgcaggtgaccagaatga

SEQ ID NO: 631296 - DNA, 17 bp, Homo sapiens
atttgccagacagagat

SEQ ID NO: 631297 - DNA, 18 bp, Homo sapiens
atttgccagacagagatc

SEQ ID NO: 631298 - DNA, 19 bp, Homo sapiens
atttgccagacagagatca

SEQ ID NO: 631299 - DNA, 22 bp, Homo sapiens
atttgcgtccgcacgcggccgc

SEQ ID NO: 631300 - DNA, 10 bp, Homo sapiens
atttgctgaa

SEQ ID NO: 631301 - DNA, 15 bp, Homo sapiens
atttgctgcatttca

SEQ ID NO: 631302 - DNA, 15 bp, Homo sapiens
atttggccatgaaag

SEQ ID NO: 631303 - DNA, 11 bp, Homo sapiens
atttgtaaaac

SEQ ID NO: 631304 - DNA, 19 bp, Homo sapiens
atttgtggtttaactttgt

SEQ ID NO: 631305 - DNA, 18 bp, Homo sapiens
atttgttaatgattcttg

SEQ ID NO: 631306 - DNA, 20 bp, Homo sapiens
attttaaaaaagatggattt

SEQ ID NO: 631307 - DNA, 24 bp, Homo sapiens
attttaaaaaagatggatttgaca

SEQ ID NO: 631308 - DNA, 23 bp, Homo sapiens
attttaaaacttcatctgtctgt

SEQ ID NO: 631309 - DNA, 20 bp, Homo sapiens
attttaaacaaaatttatgt

SEQ ID NO: 631310 - DNA, 16 bp, Homo sapiens
attttaaatggacaga

SEQ ID NO: 631311 - DNA, 13 bp, Homo sapiens
attttaataaaga

SEQ ID NO: 631312 - DNA, 14 bp, Homo sapiens
attttaataaagat

SEQ ID NO: 631313 - DNA, 13 bp, Homo sapiens
attttaggaaact

SEQ ID NO: 631314 - DNA, 13 bp, Homo sapiens
caacaacaaagca

SEQ ID NO: 631315 - DNA, 13 bp, Homo sapiens
caacaacaacaga

SEQ ID NO: 631316 - DNA, 15 bp, Homo sapiens
caacaacagaacaac

SEQ ID NO: 631317 - DNA, 19 bp, Homo sapiens
caacaacagaacaacaaca

SEQ ID NO: 631318 - DNA, 18 bp, Homo sapiens
caacacattgaaactgta

SEQ ID NO: 631319 - DNA, 20 bp, Homo sapiens
caacacattgaaactgtatt

SEQ ID NO: 631320 - DNA, 20 bp, Homo sapiens
caacagactgccttatatta

SEQ ID NO: 631321 - DNA, 22 bp, Homo sapiens
caacagcaacaacaacagaaca

SEQ ID NO: 631322 - DNA, 14 bp, Homo sapiens
caacataatgatac

SEQ ID NO: 631323 - DNA, 9 bp, Homo sapiens
caacatgtg

SEQ ID NO: 631324 - DNA, 15 bp, Homo sapiens
caacccccacctccc

SEQ ID NO: 631325 - DNA, 19 bp, Homo sapiens
caacccccacctcccggtg

SEQ ID NO: 631326 - DNA, 13 bp, Homo sapiens
caaccctgccctg

SEQ ID NO: 631327 - DNA, 20 bp, Homo sapiens
caacctcccctggtcctgca

SEQ ID NO: 631328 - DNA, 21 bp, Homo sapiens
caacctgacagcaaacacagt

SEQ ID NO: 631329 - DNA, 17 bp, Homo sapiens
caacctgcccctcccca

SEQ ID NO: 631330 - DNA, 22 bp, Homo sapiens
caacctgcccctccccagccct

SEQ ID NO: 631331 - DNA, 19 bp, Homo sapiens
caaccttgtactttacaat

SEQ ID NO: 631332 - DNA, 15 bp, Homo sapiens
caacgggtctgtggg

SEQ ID NO: 631333 - DNA, 18 bp, Homo sapiens
caactctgactgtaaaat

SEQ ID NO: 631334 - DNA, 15 bp, Homo sapiens
caactctggccttgg

SEQ ID NO: 631335 - DNA, 20 bp, Homo sapiens
caactgaattgctatcattt

SEQ ID NO: 631336 - DNA, 21 bp, Homo sapiens
caactgtctatttctgctgaa

SEQ ID NO: 631337 - DNA, 18 bp, Homo sapiens
caacttaaacctgtgctt

SEQ ID NO: 631338 - DNA, 23 bp, Homo sapiens
caacttgaaattatatctgtggt

SEQ ID NO: 631339 - DNA, 12 bp, Homo sapiens
caagaatgcagt

SEQ ID NO: 631340 - DNA, 23 bp, Homo sapiens
caagaccttacaaccacatttct

SEQ ID NO: 631341 - DNA, 14 bp, Homo sapiens
caagagaccacttc

SEQ ID NO: 631342 - DNA, 18 bp, Homo sapiens
caagagaccacttcctta

SEQ ID NO: 631343 - DNA, 21 bp, Homo sapiens
caagagaccacttccttaaca

SEQ ID NO: 631344 - DNA, 16 bp, Homo sapiens
caagagctcaggagaa

SEQ ID NO: 631345 - DNA, 18 bp, Homo sapiens
caagagctcaggagaagg

SEQ ID NO: 631346 - DNA, 14 bp, Homo sapiens
caagaggtttcagc

SEQ ID NO: 631347 - DNA, 21 bp, Homo sapiens
caagattaagttataccagca

SEQ ID NO: 631348 - DNA, 12 bp, Homo sapiens
caagattttcct

SEQ ID NO: 631349 - DNA, 16 bp, Homo sapiens
caagattttccttttt

SEQ ID NO: 631350 - DNA, 19 bp, Homo sapiens
caagattttccttttttat

SEQ ID NO: 631351 - DNA, 21 bp, Homo sapiens
caagattttccttttttatac

SEQ ID NO: 631352 - DNA, 15 bp, Homo sapiens
caagcaccctgttcc

SEQ ID NO: 631353 - DNA, 19 bp, Homo sapiens
caagcattgctaaagtcag

SEQ ID NO: 631354 - DNA, 20 bp, Homo sapiens
caagccaggagaccctgtct

SEQ ID NO: 631355 - DNA, 18 bp, Homo sapiens
caagccagggttccagac

SEQ ID NO: 631356 - DNA, 19 bp, Homo sapiens
caagccagggttccagaca

SEQ ID NO: 631357 - DNA, 13 bp, Homo sapiens
caagctacatatg

SEQ ID NO: 631358 - DNA, 14 bp, Homo sapiens
caagctcacttgct

SEQ ID NO: 631359 - DNA, 14 bp, Homo sapiens
caagctcatagcac

SEQ ID NO: 631360 - DNA, 19 bp, Homo sapiens
caagctcatagcacatgtt

SEQ ID NO: 631361 - DNA, 15 bp, Homo sapiens
caagctcttcattgc

SEQ ID NO: 631362 - DNA, 15 bp, Homo sapiens
caaggaagctttgga

SEQ ID NO: 631363 - DNA, 13 bp, Homo sapiens
caaggaaggacat

SEQ ID NO: 631364 - DNA, 15 bp, Homo sapiens
caaggaaggacattt

SEQ ID NO: 631365 - DNA, 23 bp, Homo sapiens
caaggacaacctgcccctcccca

SEQ ID NO: 631366 - DNA, 20 bp, Homo sapiens
caaggagctactgacattcc

SEQ ID NO: 631367 - DNA, 18 bp, Homo sapiens
caaggcatcacagttcac

SEQ ID NO: 631368 - DNA, 15 bp, Homo sapiens
caaggcccagccctg

SEQ ID NO: 631369 - DNA, 18 bp, Homo sapiens
caaggggcgcgcgccccc

SEQ ID NO: 631370 - DNA, 23 bp, Homo sapiens
caaggtgggggtcaggctacagg

SEQ ID NO: 631371 - DNA, 18 bp, Homo sapiens
caagtatcatctaaatat

SEQ ID NO: 631372 - DNA, 21 bp, Homo sapiens
caagtatcatctaaatattat

SEQ ID NO: 631373 - DNA, 17 bp, Homo sapiens
caagtcaaacagtgtgg

SEQ ID NO: 631374 - DNA, 19 bp, Homo sapiens
caagtcaaacagtgtggct

SEQ ID NO: 631375 - DNA, 16 bp, Homo sapiens
caagtcctcgcccccc

SEQ ID NO: 631376 - DNA, 18 bp, Homo sapiens
caagtcctcgccccccgc

SEQ ID NO: 631377 - DNA, 15 bp, Homo sapiens
caagtctagtggaac

SEQ ID NO: 631378 - DNA, 13 bp, Homo sapiens
caagtctgtgaaa

SEQ ID NO: 631379 - DNA, 19 bp, Homo sapiens
caagtgtgtgtgcaatgtt

SEQ ID NO: 631380 - DNA, 23 bp, Homo sapiens
caagttacccctgaaatctgagt

SEQ ID NO: 631381 - DNA, 20 bp, Homo sapiens
caagttgccacattgcttca

SEQ ID NO: 631382 - DNA, 23 bp, Homo sapiens
caagttgccacattgcttcatta

SEQ ID NO: 631383 - DNA, 21 bp, Homo sapiens
caagtttattgccctcaaaat

SEQ ID NO: 631384 - DNA, 23 bp, Homo sapiens
caagtttttatacctgtacacac

SEQ ID NO: 631385 - DNA, 12 bp, Homo sapiens
caagtttttggt

SEQ ID NO: 631386 - DNA, 16 bp, Homo sapiens
caataaagctcacact

SEQ ID NO: 631387 - DNA, 13 bp, Homo sapiens
caataacagtttt

SEQ ID NO: 631388 - DNA, 22 bp, Homo sapiens
caataagaaacagtttaacaga

SEQ ID NO: 631389 - DNA, 23 bp, Homo sapiens
caataagaaacagtttaacagaa

SEQ ID NO: 631390 - DNA, 23 bp, Homo sapiens
caataagctcctaaattatagag

SEQ ID NO: 631391 - DNA, 20 bp, Homo sapiens
caatactgttgcccttttcc

SEQ ID NO: 631392 - DNA, 16 bp, Homo sapiens
caatactttgtgtctt

SEQ ID NO: 631393 - DNA, 18 bp, Homo sapiens
caatactttgtgtctttt

SEQ ID NO: 631394 - DNA, 13 bp, Homo sapiens
caataggaaaaac

SEQ ID NO: 631395 - DNA, 17 bp, Homo sapiens
caataggaaaaactgat

SEQ ID NO: 631396 - DNA, 21 bp, Homo sapiens
caataggaaaaactgattttt

SEQ ID NO: 631397 - DNA, 14 bp, Homo sapiens
caatccagccttct

SEQ ID NO: 631398 - DNA, 11 bp, Homo sapiens
caatcttgctg

SEQ ID NO: 631399 - DNA, 13 bp, Homo sapiens
caatcttgctgtg

SEQ ID NO: 631400 - DNA, 22 bp, Homo sapiens
caatcttgctgtgaaacagtgt

SEQ ID NO: 631401 - DNA, 20 bp, Homo sapiens
caatgaagcaaacacacaga

SEQ ID NO: 631402 - DNA, 15 bp, Homo sapiens
caatgacctttcaat

SEQ ID NO: 631403 - DNA, 23 bp, Homo sapiens
caatgacctttcaataggaaaaa

SEQ ID NO: 631404 - DNA, 18 bp, Homo sapiens
caatgcaaaccatcattg

SEQ ID NO: 631405 - DNA, 19 bp, Homo sapiens
caatgcaaaccatcattga

SEQ ID NO: 631406 - DNA, 20 bp, Homo sapiens
caatgcaaaccatcattgaa

SEQ ID NO: 631407 - DNA, 14 bp, Homo sapiens
caatgcctgcctga

SEQ ID NO: 631408 - DNA, 12 bp, Homo sapiens
caatgtgctgtt

SEQ ID NO: 631409 - DNA, 17 bp, Homo sapiens
caatgtggaattacata

SEQ ID NO: 631410 - DNA, 19 bp, Homo sapiens
caatgtggaattacataac

SEQ ID NO: 631411 - DNA, 22 bp, Homo sapiens
caatgttccgttcatctgagga

SEQ ID NO: 631412 - DNA, 19 bp, Homo sapiens
caattaactccgtttccaa

SEQ ID NO: 631413 - DNA, 15 bp, Homo sapiens
caattatcaaaaaac

SEQ ID NO: 631414 - DNA, 18 bp, Homo sapiens
caattatcaaaaaacaga

SEQ ID NO: 631415 - DNA, 19 bp, Homo sapiens
caattatcaaaaaacagaa

SEQ ID NO: 631416 - DNA, 23 bp, Homo sapiens
caattatcaaaaaacagaaaaac

SEQ ID NO: 631417 - DNA, 21 bp, Homo sapiens
caattctgaaggggaaaacct

SEQ ID NO: 631418 - DNA, 13 bp, Homo sapiens
caattgtatatat

SEQ ID NO: 631419 - DNA, 17 bp, Homo sapiens
cacaagcagacacacac

SEQ ID NO: 631420 - DNA, 17 bp, Homo sapiens
cacaaggcccagccctg

SEQ ID NO: 631421 - DNA, 18 bp, Homo sapiens
cacaaggcccagccctgg

SEQ ID NO: 631422 - DNA, 19 bp, Homo sapiens
cacaataaaagacatccac

SEQ ID NO: 631423 - DNA, 19 bp, Homo sapiens
cacacaaacctactgccca

SEQ ID NO: 631424 - DNA, 20 bp, Homo sapiens
cacacaaacctactgcccac

SEQ ID NO: 631425 - DNA, 21 bp, Homo sapiens
cacacaaacctactgcccaca

SEQ ID NO: 631426 - DNA, 17 bp, Homo sapiens
cacacaaagtgaaatta

SEQ ID NO: 631427 - DNA, 15 bp, Homo sapiens
cacacacaaaacaac

SEQ ID NO: 631428 - DNA, 15 bp, Homo sapiens
cacacacacacacaa

SEQ ID NO: 631429 - DNA, 16 bp, Homo sapiens
cacacacacacacaaa

SEQ ID NO: 631430 - DNA, 14 bp, Homo sapiens
cacacacacccttc

SEQ ID NO: 631431 - DNA, 14 bp, Homo sapiens
cacacacatatata

SEQ ID NO: 631432 - DNA, 14 bp, Homo sapiens
cacacacccttccc

SEQ ID NO: 631433 - DNA, 17 bp, Homo sapiens
cacacagacacacaagc

SEQ ID NO: 631434 - DNA, 15 bp, Homo sapiens
cacacagtatagata

SEQ ID NO: 631435 - DNA, 14 bp, Homo sapiens
cacacatctggccc

SEQ ID NO: 631436 - DNA, 16 bp, Homo sapiens
cacacatctggccctg

SEQ ID NO: 631437 - DNA, 19 bp, Homo sapiens
cacaccaaattgctgagat

SEQ ID NO: 631438 - DNA, 20 bp, Homo sapiens
cacaccacgcgtcacccaac

SEQ ID NO: 631439 - DNA, 16 bp, Homo sapiens
cacaccccgtctgccc

SEQ ID NO: 631440 - DNA, 20 bp, Homo sapiens
cacaccccgtctgccccttg

SEQ ID NO: 631441 - DNA, 15 bp, Homo sapiens
cacacccttccccac

SEQ ID NO: 631442 - DNA, 17 bp, Homo sapiens
cacacccttccccactc

SEQ ID NO: 631443 - DNA, 18 bp, Homo sapiens
cacaccggcactgtgcac

SEQ ID NO: 631444 - DNA, 16 bp, Homo sapiens
cacacctaaattaaca

SEQ ID NO: 631445 - DNA, 20 bp, Homo sapiens
cacacctaaattaacaaatt

SEQ ID NO: 631446 - DNA, 13 bp, Homo sapiens
cacacctccaccc

SEQ ID NO: 631447 - DNA, 13 bp, Homo sapiens
cacacctcccttc

SEQ ID NO: 631448 - DNA, 16 bp, Homo sapiens
cacacctgagaatgtg

SEQ ID NO: 631449 - DNA, 19 bp, Homo sapiens
cacactgccctctgccact

SEQ ID NO: 631450 - DNA, 13 bp, Homo sapiens
cacacttgggctg

SEQ ID NO: 631451 - DNA, 14 bp, Homo sapiens
cacacttgggctgg

SEQ ID NO: 631452 - DNA, 11 bp, Homo sapiens
cacagactctg

SEQ ID NO: 631453 - DNA, 16 bp, Homo sapiens
cacagaggacggcttc

SEQ ID NO: 631454 - DNA, 14 bp, Homo sapiens
cacagattatttgt

SEQ ID NO: 631455 - DNA, 14 bp, Homo sapiens
cacagatttccaaa

SEQ ID NO: 631456 - DNA, 15 bp, Homo sapiens
cacagcatgcattta

SEQ ID NO: 631457 - DNA, 19 bp, Homo sapiens
cacagccaataaacaccag

SEQ ID NO: 631458 - DNA, 15 bp, Homo sapiens
cacagccatagcaga

SEQ ID NO: 631459 - DNA, 12 bp, Homo sapiens
cacagcctctcc

SEQ ID NO: 631460 - DNA, 15 bp, Homo sapiens
cacagcctctccctt

SEQ ID NO: 631461 - DNA, 23 bp, Homo sapiens
cacagcctttgcgctctgggttt

SEQ ID NO: 631462 - DNA, 17 bp, Homo sapiens
cacagctgggcagggtg

SEQ ID NO: 631463 - DNA, 18 bp, Homo sapiens
cacaggagaaaatgcaat

SEQ ID NO: 631464 - DNA, 18 bp, Homo sapiens
cacaggagcatgtcctat

SEQ ID NO: 631465 - DNA, 14 bp, Homo sapiens
cacaggagccgcag

SEQ ID NO: 631466 - DNA, 17 bp, Homo sapiens
cacaggagccgcagagg

SEQ ID NO: 631467 - DNA, 21 bp, Homo sapiens
cacaggagcgtgtactacccc

SEQ ID NO: 631468 - DNA, 17 bp, Homo sapiens
cacaggagcgtgtccta

SEQ ID NO: 631469 - DNA, 22 bp, Homo sapiens
cacaggagcgtgtcctatcccc

SEQ ID NO: 631470 - DNA, 14 bp, Homo sapiens
cacaggatgcatat

SEQ ID NO: 631471 - DNA, 21 bp, Homo sapiens
cacaggctgcctcatgaccct

SEQ ID NO: 631472 - DNA, 19 bp, Homo sapiens
cacagtattgttcttgtaa

SEQ ID NO: 631473 - DNA, 14 bp, Homo sapiens
cacagtcctcacag

SEQ ID NO: 631474 - DNA, 17 bp, Homo sapiens
cacagtcctcacagcct

SEQ ID NO: 631475 - DNA, 16 bp, Homo sapiens
cacagtctaattttta

SEQ ID NO: 631476 - DNA, 15 bp, Homo sapiens
cacagtcttttccta

SEQ ID NO: 631477 - DNA, 16 bp, Homo sapiens
cacagtgacacgtttg

SEQ ID NO: 631478 - DNA, 16 bp, Homo sapiens
cacagtgccccagtgg

SEQ ID NO: 631479 - DNA, 18 bp, Homo sapiens
cacagtgccccagtggtg

SEQ ID NO: 631480 - DNA, 20 bp, Homo sapiens
cacataaacacttctcctta

SEQ ID NO: 631481 - DNA, 21 bp, Homo sapiens
cacataaacacttctccttaa

SEQ ID NO: 631482 - DNA, 22 bp, Homo sapiens
cacataaacacttctccttaac

SEQ ID NO: 631483 - DNA, 22 bp, Homo sapiens
cacataattaaagtgtccattg

SEQ ID NO: 631484 - DNA, 14 bp, Homo sapiens
cacatacatatata

SEQ ID NO: 631485 - DNA, 15 bp, Homo sapiens
cacatatatacatac

SEQ ID NO: 631486 - DNA, 15 bp, Homo sapiens
cacatccccaccctc

SEQ ID NO: 631487 - DNA, 16 bp, Homo sapiens
cacatctggccctgac

SEQ ID NO: 631488 - DNA, 20 bp, Homo sapiens
cacatgacagtggttatatt

SEQ ID NO: 631489 - DNA, 19 bp, Homo sapiens
cacatgcccctcttagaag

SEQ ID NO: 631490 - DNA, 20 bp, Homo sapiens
cacattcctgaccctcactt

SEQ ID NO: 631491 - DNA, 13 bp, Homo sapiens
cacattgaaactg

SEQ ID NO: 631492 - DNA, 13 bp, Homo sapiens
cacattgcacaca

SEQ ID NO: 631493 - DNA, 17 bp, Homo sapiens
cacattgcttcattaaa

SEQ ID NO: 631494 - DNA, 18 bp, Homo sapiens
cacattgcttcattaaaa

SEQ ID NO: 631495 - DNA, 12 bp, Homo sapiens
cacatttgttaa

SEQ ID NO: 631496 - DNA, 19 bp, Homo sapiens
cacatttgttaatgattct

SEQ ID NO: 631497 - DNA, 13 bp, Homo sapiens
caccaaatatttt

SEQ ID NO: 631498 - DNA, 16 bp, Homo sapiens
caccaaatattttcaa

SEQ ID NO: 631499 - DNA, 15 bp, Homo sapiens
caccaaattgctgag

SEQ ID NO: 631500 - DNA, 15 bp, Homo sapiens
caccacacacaccct

SEQ ID NO: 631501 - DNA, 23 bp, Homo sapiens
caccacggggtcgggggaggagc

SEQ ID NO: 631502 - DNA, 13 bp, Homo sapiens
caccactagggtc

SEQ ID NO: 631503 - DNA, 21 bp, Homo sapiens
caggaggacagagtgccctgg

SEQ ID NO: 631504 - DNA, 22 bp, Homo sapiens
caggaggacagagtgccctggg

SEQ ID NO: 631505 - DNA, 22 bp, Homo sapiens
caggagtcagtgcccatgtgta

SEQ ID NO: 631506 - DNA, 12 bp, Homo sapiens
caggatgcatat

SEQ ID NO: 631507 - DNA, 15 bp, Homo sapiens
caggatgcatattaa

SEQ ID NO: 631508 - DNA, 16 bp, Homo sapiens
caggatgcatattaaa

SEQ ID NO: 631509 - DNA, 14 bp, Homo sapiens
caggattctccttt

SEQ ID NO: 631510 - DNA, 17 bp, Homo sapiens
caggcaccatgctgggc

SEQ ID NO: 631511 - DNA, 19 bp, Homo sapiens
caggcaccatgctgggccg

SEQ ID NO: 631512 - DNA, 11 bp, Homo sapiens
caggcactctc

SEQ ID NO: 631513 - DNA, 19 bp, Homo sapiens
caggcagattaataacaga

SEQ ID NO: 631514 - DNA, 14 bp, Homo sapiens
caggcagcctgcag

SEQ ID NO: 631515 - DNA, 15 bp, Homo sapiens
caggcagctaggcag

SEQ ID NO: 631516 - DNA, 18 bp, Homo sapiens
caggcagctaggcaggga

SEQ ID NO: 631517 - DNA, 20 bp, Homo sapiens
caggcatccgctgcgctccc

SEQ ID NO: 631518 - DNA, 17 bp, Homo sapiens
caggcatgcaccagtgc

SEQ ID NO: 631519 - DNA, 18 bp, Homo sapiens
caggcattgcactaaaag

SEQ ID NO: 631520 - DNA, 20 bp, Homo sapiens
caggcattgcactaaaagtg

SEQ ID NO: 631521 - DNA, 21 bp, Homo sapiens
caggcccgccctgcccgcgcc

SEQ ID NO: 631522 - DNA, 12 bp, Homo sapiens
caggccctccag

SEQ ID NO: 631523 - DNA, 14 bp, Homo sapiens
caggcctcagggac

SEQ ID NO: 631524 - DNA, 18 bp, Homo sapiens
caggcctccctcgggctg

SEQ ID NO: 631525 - DNA, 20 bp, Homo sapiens
caggcgccgcctcgcccccg

SEQ ID NO: 631526 - DNA, 14 bp, Homo sapiens
caggcgcgcaccgc

SEQ ID NO: 631527 - DNA, 15 bp, Homo sapiens
caggcgcgcaccgcc

SEQ ID NO: 631528 - DNA, 23 bp, Homo sapiens
caggcgcgcaccgcccaaccccc

SEQ ID NO: 631529 - DNA, 13 bp, Homo sapiens
caggcggaggggc

SEQ ID NO: 631530 - DNA, 15 bp, Homo sapiens
caggcggaggggctt

SEQ ID NO: 631531 - DNA, 17 bp, Homo sapiens
caggcggaggggcttgg

SEQ ID NO: 631532 - DNA, 22 bp, Homo sapiens
caggcggaggggcttggagcag

SEQ ID NO: 631533 - DNA, 22 bp, Homo sapiens
caggctacaggtgccccacctc

SEQ ID NO: 631534 - DNA, 15 bp, Homo sapiens
caggctcccactgcc

SEQ ID NO: 631535 - DNA, 21 bp, Homo sapiens
caggctgagacacagcccaga

SEQ ID NO: 631536 - DNA, 20 bp, Homo sapiens
caggctgatgccgtgcgggc

SEQ ID NO: 631537 - DNA, 14 bp, Homo sapiens
caggctgcgcctgc

SEQ ID NO: 631538 - DNA, 17 bp, Homo sapiens
caggctgcgcctgcccg

SEQ ID NO: 631539 - DNA, 21 bp, Homo sapiens
caggctgcgcctgcccgcccg

SEQ ID NO: 631540 - DNA, 11 bp, Homo sapiens
caggctttcta

SEQ ID NO: 631541 - DNA, 16 bp, Homo sapiens
cagggaagggtgcctg

SEQ ID NO: 631542 - DNA, 17 bp, Homo sapiens
cagggaagggtgcctgg

SEQ ID NO: 631543 - DNA, 13 bp, Homo sapiens
cagggacagcctg

SEQ ID NO: 631544 - DNA, 15 bp, Homo sapiens
cagggaccaaggaga

SEQ ID NO: 631545 - DNA, 19 bp, Homo sapiens
cagggaccaaggagatggg

SEQ ID NO: 631546 - DNA, 16 bp, Homo sapiens
cagggagggggctggg

SEQ ID NO: 631547 - DNA, 14 bp, Homo sapiens
cagggaggtggcag

SEQ ID NO: 631548 - DNA, 15 bp, Homo sapiens
cagggaggtggcagg

SEQ ID NO: 631549 - DNA, 14 bp, Homo sapiens
cagggatggagatg

SEQ ID NO: 631550 - DNA, 16 bp, Homo sapiens
cagggcagaggaatgt

SEQ ID NO: 631551 - DNA, 23 bp, Homo sapiens
cagggccctggggtctctgagca

SEQ ID NO: 631552 - DNA, 22 bp, Homo sapiens
cagggccgccgaagggcagccc

SEQ ID NO: 631553 - DNA, 18 bp, Homo sapiens
cagggcgctccggcagag

SEQ ID NO: 631554 - DNA, 19 bp, Homo sapiens
cagggcgctccggcagagg

SEQ ID NO: 631555 - DNA, 21 bp, Homo sapiens
cagggcgctccggcagaggca

SEQ ID NO: 631556 - DNA, 22 bp, Homo sapiens
cagggcgctccggcagaggcag

SEQ ID NO: 631557 - DNA, 14 bp, Homo sapiens
cagggcgtcctctc

SEQ ID NO: 631558 - DNA, 18 bp, Homo sapiens
cagggctcagatggggcc

SEQ ID NO: 631559 - DNA, 21 bp, Homo sapiens
cagggctcagatggggcctgg

SEQ ID NO: 631560 - DNA, 20 bp, Homo sapiens
cagggctggtgtggctgctc

SEQ ID NO: 631561 - DNA, 13 bp, Homo sapiens
caggggcaggcag

SEQ ID NO: 631562 - DNA, 14 bp, Homo sapiens
caggggcaggcagc

SEQ ID NO: 631563 - DNA, 15 bp, Homo sapiens
caggggcttctcccc

SEQ ID NO: 631564 - DNA, 13 bp, Homo sapiens
caggggttggcag

SEQ ID NO: 631565 - DNA, 14 bp, Homo sapiens
cagggtccagccct

SEQ ID NO: 631566 - DNA, 22 bp, Homo sapiens
cagggtcctgggggctgctgca

SEQ ID NO: 631567 - DNA, 11 bp, Homo sapiens
cagggtgcagg

SEQ ID NO: 631568 - DNA, 23 bp, Homo sapiens
cagggtgcaggcgcgcaccgccc

SEQ ID NO: 631569 - DNA, 12 bp, Homo sapiens
cagggtgggaag

SEQ ID NO: 631570 - DNA, 16 bp, Homo sapiens
cagggtgggaagagaa

SEQ ID NO: 631571 - DNA, 21 bp, Homo sapiens
cagggttaaagaaaggcagag

SEQ ID NO: 631572 - DNA, 14 bp, Homo sapiens
cagggttccagaca

SEQ ID NO: 631573 - DNA, 17 bp, Homo sapiens
cagggttccagacaggg

SEQ ID NO: 631574 - DNA, 22 bp, Homo sapiens
caggtatctgatgatgttctga

SEQ ID NO: 631575 - DNA, 15 bp, Homo sapiens
caggtgaccagaatg

SEQ ID NO: 631576 - DNA, 15 bp, Homo sapiens
caggtgccccacctc

SEQ ID NO: 631577 - DNA, 22 bp, Homo sapiens
caggtgccccacctccccagag

SEQ ID NO: 631578 - DNA, 16 bp, Homo sapiens
caggtgcgtgccacat

SEQ ID NO: 631579 - DNA, 12 bp, Homo sapiens
caggtggcattt

SEQ ID NO: 631580 - DNA, 16 bp, Homo sapiens
caggtggcatttgcag

SEQ ID NO: 631581 - DNA, 18 bp, Homo sapiens
caggtgggggctgcgtcc

SEQ ID NO: 631582 - DNA, 22 bp, Homo sapiens
caggtgggggctgcgtccctgc

SEQ ID NO: 631583 - DNA, 13 bp, Homo sapiens
cagtaccatccca

SEQ ID NO: 631584 - DNA, 16 bp, Homo sapiens
cagtaccatcccactg

SEQ ID NO: 631585 - DNA, 21 bp, Homo sapiens
cagtagcatactgatgagaca

SEQ ID NO: 631586 - DNA, 20 bp, Homo sapiens
cagtagcattttaatagttt

SEQ ID NO: 631587 - DNA, 18 bp, Homo sapiens
cagtagtgcctgtgatcg

SEQ ID NO: 631588 - DNA, 23 bp, Homo sapiens
cagtagtgtcacttttttcctgt

SEQ ID NO: 631589 - DNA, 18 bp, Homo sapiens
cagtatagataaatccaa

SEQ ID NO: 631590 - DNA, 17 bp, Homo sapiens
cagtatatattctttca

SEQ ID NO: 631591 - DNA, 18 bp, Homo sapiens
cagtatgctttccctgag

SEQ ID NO: 631592 - DNA, 16 bp, Homo sapiens
cagtatgtacaggctg

SEQ ID NO: 631593 - DNA, 19 bp, Homo sapiens
cagtattgacaataagaaa

SEQ ID NO: 631594 - DNA, 21 bp, Homo sapiens
cagtattgagacactgtcaag

SEQ ID NO: 631595 - DNA, 12 bp, Homo sapiens
cagtatttaaca

SEQ ID NO: 631596 - DNA, 13 bp, Homo sapiens
cagtatttaacat

SEQ ID NO: 631597 - DNA, 20 bp, Homo sapiens
cagtcaattgcttgagcatg

SEQ ID NO: 631598 - DNA, 20 bp, Homo sapiens
cagtcacgtgaggcccctgt

SEQ ID NO: 631599 - DNA, 22 bp, Homo sapiens
cagtcacgtgaggcccctgtgc

SEQ ID NO: 631600 - DNA, 23 bp, Homo sapiens
cagtcacgtgaggcccctgtgca

SEQ ID NO: 631601 - DNA, 22 bp, Homo sapiens
cagtcatggctgtcccctgcaa

SEQ ID NO: 631602 - DNA, 22 bp, Homo sapiens
cagtccacccccattgtgaatg

SEQ ID NO: 631603 - DNA, 12 bp, Homo sapiens
cagtccgccccg

SEQ ID NO: 631604 - DNA, 16 bp, Homo sapiens
cagtccgccccgtgct

SEQ ID NO: 631605 - DNA, 20 bp, Homo sapiens
cagtccgccccgtgctcctc

SEQ ID NO: 631606 - DNA, 20 bp, Homo sapiens
cagtcctcacagcctctccc

SEQ ID NO: 631607 - DNA, 13 bp, Homo sapiens
cagtctaattttt

SEQ ID NO: 631608 - DNA, 13 bp, Homo sapiens
cagtctatgctgt

SEQ ID NO: 631609 - DNA, 23 bp, Homo sapiens
cagtctctatttgatttgcaaca

SEQ ID NO: 631610 - DNA, 15 bp, Homo sapiens
cagtcttgagtgggc

SEQ ID NO: 631611 - DNA, 15 bp, Homo sapiens
cagtcttttcctacg

SEQ ID NO: 631612 - DNA, 18 bp, Homo sapiens
cagtgaagcccaggagga

SEQ ID NO: 631613 - DNA, 22 bp, Homo sapiens
cagtgcagcaaccagagcactg

SEQ ID NO: 631614 - DNA, 16 bp, Homo sapiens
cagtgccccagtggtg

SEQ ID NO: 631615 - DNA, 19 bp, Homo sapiens
cagtgcctaactccttaca

SEQ ID NO: 631616 - DNA, 16 bp, Homo sapiens
catctcgtatggattt

SEQ ID NO: 631617 - DNA, 15 bp, Homo sapiens
catctcttcatgcgc

SEQ ID NO: 631618 - DNA, 13 bp, Homo sapiens
catctgaaatcta

SEQ ID NO: 631619 - DNA, 21 bp, Homo sapiens
catctgaaatctacaacataa

SEQ ID NO: 631620 - DNA, 16 bp, Homo sapiens
catctgaggagtccaa

SEQ ID NO: 631621 - DNA, 22 bp, Homo sapiens
catctgcctggagcctgggcag

SEQ ID NO: 631622 - DNA, 16 bp, Homo sapiens
catctggcctgggggc

SEQ ID NO: 631623 - DNA, 17 bp, Homo sapiens
catctggcctgggggct

SEQ ID NO: 631624 - DNA, 17 bp, Homo sapiens
catctgtcagcttccca

SEQ ID NO: 631625 - DNA, 21 bp, Homo sapiens
catcttgggattcctcccctg

SEQ ID NO: 631626 - DNA, 12 bp, Homo sapiens
catcttgtaaat

SEQ ID NO: 631627 - DNA, 20 bp, Homo sapiens
catcttgtggggccaggacc

SEQ ID NO: 631628 - DNA, 15 bp, Homo sapiens
catgaaaagttttca

SEQ ID NO: 631629 - DNA, 16 bp, Homo sapiens
catgaaaagttttcaa

SEQ ID NO: 631630 - DNA, 23 bp, Homo sapiens
catgaaagccctggaattttagg

SEQ ID NO: 631631 - DNA, 14 bp, Homo sapiens
catgacacgaatat

SEQ ID NO: 631632 - DNA, 18 bp, Homo sapiens
catgacacgaatattgct

SEQ ID NO: 631633 - DNA, 18 bp, Homo sapiens
catgacagtagcatactg

SEQ ID NO: 631634 - DNA, 16 bp, Homo sapiens
catgacccagcctgaa

SEQ ID NO: 631635 - DNA, 18 bp, Homo sapiens
catgacccgtacacacca

SEQ ID NO: 631636 - DNA, 13 bp, Homo sapiens
catgaccctcctg

SEQ ID NO: 631637 - DNA, 15 bp, Homo sapiens
catgaccctcctgtc

SEQ ID NO: 631638 - DNA, 18 bp, Homo sapiens
catgagaactaaatagat

SEQ ID NO: 631639 - DNA, 20 bp, Homo sapiens
catgaggcctttccccagtg

SEQ ID NO: 631640 - DNA, 17 bp, Homo sapiens
catgagttctgcacata

SEQ ID NO: 631641 - DNA, 20 bp, Homo sapiens
catgagttctgcacatacag

SEQ ID NO: 631642 - DNA, 16 bp, Homo sapiens
catgatgatttcagaa

SEQ ID NO: 631643 - DNA, 19 bp, Homo sapiens
catgatgctagttcttacg

SEQ ID NO: 631644 - DNA, 15 bp, Homo sapiens
catgcagggccccca

SEQ ID NO: 631645 - DNA, 19 bp, Homo sapiens
catgcagggcccccatgca

SEQ ID NO: 631646 - DNA, 21 bp, Homo sapiens
catgccagcgcagcgccaggg

SEQ ID NO: 631647 - DNA, 23 bp, Homo sapiens
catgccatctccaccctgagcct

SEQ ID NO: 631648 - DNA, 20 bp, Homo sapiens
catgcccacgcccctcccca

SEQ ID NO: 631649 - DNA, 18 bp, Homo sapiens
catgccccagctctggat

SEQ ID NO: 631650 - DNA, 17 bp, Homo sapiens
catgcccctcttagaag

SEQ ID NO: 631651 - DNA, 21 bp, Homo sapiens
catgccctccctgctgccagg

SEQ ID NO: 631652 - DNA, 19 bp, Homo sapiens
catgcctacattagtgaga

SEQ ID NO: 631653 - DNA, 19 bp, Homo sapiens
catgcctgggcccaggccc

SEQ ID NO: 631654 - DNA, 21 bp, Homo sapiens
catgcctgggcccaggcccag

SEQ ID NO: 631655 - DNA, 17 bp, Homo sapiens
catgccttcataaatta

SEQ ID NO: 631656 - DNA, 9 bp, Homo sapiens
catgctcag

SEQ ID NO: 631657 - DNA, 15 bp, Homo sapiens
catgctcagctcagc

SEQ ID NO: 631658 - DNA, 14 bp, Homo sapiens
catgctggctgggg

SEQ ID NO: 631659 - DNA, 20 bp, Homo sapiens
catgctgtcttagatcagga

SEQ ID NO: 631660 - DNA, 21 bp, Homo sapiens
catgcttaaataaaaattatg

SEQ ID NO: 631661 - DNA, 14 bp, Homo sapiens
catgctttctcctt

SEQ ID NO: 631662 - DNA, 16 bp, Homo sapiens
catgctttctcctttt

SEQ ID NO: 631663 - DNA, 17 bp, Homo sapiens
catggaacagccctgca

SEQ ID NO: 631664 - DNA, 17 bp, Homo sapiens
catggaatgcaatttga

SEQ ID NO: 631665 - DNA, 23 bp, Homo sapiens
catggagaagggttctgccctgc

SEQ ID NO: 631666 - DNA, 20 bp, Homo sapiens
catggagtagagtcaggaga

SEQ ID NO: 631667 - DNA, 23 bp, Homo sapiens
catggatttcctttgacctctca

SEQ ID NO: 631668 - DNA, 18 bp, Homo sapiens
catggcacactgccctct

SEQ ID NO: 631669 - DNA, 12 bp, Homo sapiens
catggccccagc

SEQ ID NO: 631670 - DNA, 14 bp, Homo sapiens
catggccccagctg

SEQ ID NO: 631671 - DNA, 15 bp, Homo sapiens
catggccccagctgg

SEQ ID NO: 631672 - DNA, 18 bp, Homo sapiens
catggccccagctggctg

SEQ ID NO: 631673 - DNA, 20 bp, Homo sapiens
catggccgaagccccttgga

SEQ ID NO: 631674 - DNA, 23 bp, Homo sapiens
catggccgaagccccttggagag

SEQ ID NO: 631675 - DNA, 13 bp, Homo sapiens
ccaagcctgactt

SEQ ID NO: 631676 - DNA, 21 bp, Homo sapiens
ccaagcctgactttggggaca

SEQ ID NO: 631677 - DNA, 18 bp, Homo sapiens
ccaagctaatgtggtagt

SEQ ID NO: 631678 - DNA, 22 bp, Homo sapiens
ccaaggacactgatgggtcctg

SEQ ID NO: 631679 - DNA, 14 bp, Homo sapiens
ccaagtcctcgccc

SEQ ID NO: 631680 - DNA, 19 bp, Homo sapiens
ccaagtgtatatttgtatc

SEQ ID NO: 631681 - DNA, 12 bp, Homo sapiens
ccaagtgtcctg

SEQ ID NO: 631682 - DNA, 13 bp, Homo sapiens
ccaagtgtgttgg

SEQ ID NO: 631683 - DNA, 13 bp, Homo sapiens
ccaatccagcctt

SEQ ID NO: 631684 - DNA, 18 bp, Homo sapiens
ccaatgaactctttcccc

SEQ ID NO: 631685 - DNA, 19 bp, Homo sapiens
ccaatgtccaggtcacagg

SEQ ID NO: 631686 - DNA, 12 bp, Homo sapiens
ccaatttagaat

SEQ ID NO: 631687 - DNA, 18 bp, Homo sapiens
ccaatttgttctgtgcaa

SEQ ID NO: 631688 - DNA, 13 bp, Homo sapiens
ccaatttttctgc

SEQ ID NO: 631689 - DNA, 12 bp, Homo sapiens
ccacaaggccca

SEQ ID NO: 631690 - DNA, 22 bp, Homo sapiens
ccacaaggcccagccctgggca

SEQ ID NO: 631691 - DNA, 14 bp, Homo sapiens
ccacacacaccctt

SEQ ID NO: 631692 - DNA, 18 bp, Homo sapiens
ccacaccccgtctgcccc

SEQ ID NO: 631693 - DNA, 14 bp, Homo sapiens
ccacacgccggggc

SEQ ID NO: 631694 - DNA, 22 bp, Homo sapiens
ccacacgccggggctggccctg

SEQ ID NO: 631695 - DNA, 22 bp, Homo sapiens
ccacagagttactgccacggtc

SEQ ID NO: 631696 - DNA, 13 bp, Homo sapiens
ccacagctgggca

SEQ ID NO: 631697 - DNA, 12 bp, Homo sapiens
ccacaggagccg

SEQ ID NO: 631698 - DNA, 22 bp, Homo sapiens
ccacaggagccgcagaggcccg

SEQ ID NO: 631699 - DNA, 15 bp, Homo sapiens
ccacaggagcgtgta

SEQ ID NO: 631700 - DNA, 16 bp, Homo sapiens
ccacaggagcgtgtac

SEQ ID NO: 631701 - DNA, 17 bp, Homo sapiens
ccacaggagcgtgtact

SEQ ID NO: 631702 - DNA, 11 bp, Homo sapiens
ccacagtattg

SEQ ID NO: 631703 - DNA, 16 bp, Homo sapiens
ccacagtattgttctt

SEQ ID NO: 631704 - DNA, 18 bp, Homo sapiens
ccacagtcctcacagcct

SEQ ID NO: 631705 - DNA, 15 bp, Homo sapiens
ccacagtggggccca

SEQ ID NO: 631706 - DNA, 20 bp, Homo sapiens
ccacagtggggcccatggcc

SEQ ID NO: 631707 - DNA, 21 bp, Homo sapiens
ccacataaacacttctcctta

SEQ ID NO: 631708 - DNA, 20 bp, Homo sapiens
ccacatgtggggacagggct

SEQ ID NO: 631709 - DNA, 18 bp, Homo sapiens
ccacattgcttcattaaa

SEQ ID NO: 631710 - DNA, 23 bp, Homo sapiens
ccacattgcttcattaaaacaag

SEQ ID NO: 631711 - DNA, 12 bp, Homo sapiens
ccacccagcagc

SEQ ID NO: 631712 - DNA, 17 bp, Homo sapiens
ccacccccagcagctca

SEQ ID NO: 631713 - DNA, 18 bp, Homo sapiens
ccacccccgtcaccccgc

SEQ ID NO: 631714 - DNA, 13 bp, Homo sapiens
ccaccccgctgcc

SEQ ID NO: 631715 - DNA, 15 bp, Homo sapiens
ccaccccgtcccggc

SEQ ID NO: 631716 - DNA, 13 bp, Homo sapiens
ccacccctcaagc

SEQ ID NO: 631717 - DNA, 17 bp, Homo sapiens
ccacccctcttccccct

SEQ ID NO: 631718 - DNA, 21 bp, Homo sapiens
ccacccgcccgcccccgccct

SEQ ID NO: 631719 - DNA, 15 bp, Homo sapiens
ccacccgtgttctcc

SEQ ID NO: 631720 - DNA, 14 bp, Homo sapiens
ccaccctcccctct

SEQ ID NO: 631721 - DNA, 22 bp, Homo sapiens
ccaccctgagcctgacctttct

SEQ ID NO: 631722 - DNA, 14 bp, Homo sapiens
ccaccgcgcccctc

SEQ ID NO: 631723 - DNA, 19 bp, Homo sapiens
ccacctaaagggaagccct

SEQ ID NO: 631724 - DNA, 20 bp, Homo sapiens
ccacctaaagggaagccctg

SEQ ID NO: 631725 - DNA, 16 bp, Homo sapiens
cgcccctttctcttgc

SEQ ID NO: 631726 - DNA, 19 bp, Homo sapiens
cgcccgaggccagggccgc

SEQ ID NO: 631727 - DNA, 20 bp, Homo sapiens
cgcccgcccaccccgctgcc

SEQ ID NO: 631728 - DNA, 17 bp, Homo sapiens
cgcccgcccccgccctc

SEQ ID NO: 631729 - DNA, 15 bp, Homo sapiens
cgcccgccctcctct

SEQ ID NO: 631730 - DNA, 22 bp, Homo sapiens
cgcccgccctcctctgccccct

SEQ ID NO: 631731 - DNA, 12 bp, Homo sapiens
cgcccgccgcct

SEQ ID NO: 631732 - DNA, 21 bp, Homo sapiens
cgcccgccggttggccggctg

SEQ ID NO: 631733 - DNA, 17 bp, Homo sapiens
cgccctccctccctcca

SEQ ID NO: 631734 - DNA, 18 bp, Homo sapiens
cgccctccctccctccac

SEQ ID NO: 631735 - DNA, 21 bp, Homo sapiens
cgccctcctctgccccctccc

SEQ ID NO: 631736 - DNA, 20 bp, Homo sapiens
cgccgcctccctcacccggc

SEQ ID NO: 631737 - DNA, 14 bp, Homo sapiens
cgccggggctggcc

SEQ ID NO: 631738 - DNA, 16 bp, Homo sapiens
cgccggggctggccct

SEQ ID NO: 631739 - DNA, 23 bp, Homo sapiens
cgccggggctggccctgccctcc

SEQ ID NO: 631740 - DNA, 20 bp, Homo sapiens
cgccggttggccggctggcc

SEQ ID NO: 631741 - DNA, 16 bp, Homo sapiens
cgcctcccgccgcctc

SEQ ID NO: 631742 - DNA, 20 bp, Homo sapiens
cgcctcccgccgcctcgggc

SEQ ID NO: 631743 - DNA, 14 bp, Homo sapiens
cgcctcctccagac

SEQ ID NO: 631744 - DNA, 17 bp, Homo sapiens
cgcctcctccagactcg

SEQ ID NO: 631745 - DNA, 15 bp, Homo sapiens
cgcctcctcctgcat

SEQ ID NO: 631746 - DNA, 17 bp, Homo sapiens
cgcctcgggccgcctcc

SEQ ID NO: 631747 - DNA, 19 bp, Homo sapiens
cgcctcgggccgcctcctc

SEQ ID NO: 631748 - DNA, 23 bp, Homo sapiens
cgcctcgggccgcctcctccaga

SEQ ID NO: 631749 - DNA, 13 bp, Homo sapiens
cgcctgcgcctcc

SEQ ID NO: 631750 - DNA, 15 bp, Homo sapiens
cgcctgcgcctcctc

SEQ ID NO: 631751 - DNA, 22 bp, Homo sapiens
cgcctgcgctcctctgcagcct

SEQ ID NO: 631752 - DNA, 11 bp, Homo sapiens
cgcctgtgccc

SEQ ID NO: 631753 - DNA, 18 bp, Homo sapiens
cgcctgtgcccacgtgtg

SEQ ID NO: 631754 - DNA, 21 bp, Homo sapiens
cgcctgtgcccacgtgtgcag

SEQ ID NO: 631755 - DNA, 19 bp, Homo sapiens
cgccttctggctgctgcag

SEQ ID NO: 631756 - DNA, 15 bp, Homo sapiens
cgcgcccccaggacc

SEQ ID NO: 631757 - DNA, 13 bp, Homo sapiens
ctctgttccaagt

SEQ ID NO: 631758 - DNA, 16 bp, Homo sapiens
ctctgttccaagtgtg

SEQ ID NO: 631759 - DNA, 19 bp, Homo sapiens
ctctgttccaagtgtgtgt

SEQ ID NO: 631760 - DNA, 22 bp, Homo sapiens
ctctgttccaagtgtgtgtgca

SEQ ID NO: 631761 - DNA, 13 bp, Homo sapiens
ctcttaccccgtc

SEQ ID NO: 631762 - DNA, 23 bp, Homo sapiens
ctcttatatgtgccccttcccca

SEQ ID NO: 631763 - DNA, 20 bp, Homo sapiens
ctcttcatgcgcagtcccca

SEQ ID NO: 631764 - DNA, 16 bp, Homo sapiens
ctcttcccccttcccc

SEQ ID NO: 631765 - DNA, 15 bp, Homo sapiens
ctcttcccctttcct

SEQ ID NO: 631766 - DNA, 15 bp, Homo sapiens
ctcttctcagctcca

SEQ ID NO: 631767 - DNA, 16 bp, Homo sapiens
ctcttctcagctccac

SEQ ID NO: 631768 - DNA, 16 bp, Homo sapiens
ctcttcttgcggcacc

SEQ ID NO: 631769 - DNA, 20 bp, Homo sapiens
ctcttgctgtttaccgccca

SEQ ID NO: 631770 - DNA, 20 bp, Homo sapiens
ctcttgggtatgtagaactg

SEQ ID NO: 631771 - DNA, 23 bp, Homo sapiens
ctcttggtctctttctttccaaa

SEQ ID NO: 631772 - DNA, 23 bp, Homo sapiens
ctcttggtgtcaaatttttaagt

SEQ ID NO: 631773 - DNA, 21 bp, Homo sapiens
ctcttgttcttagggcttgga

SEQ ID NO: 631774 - DNA, 15 bp, Homo sapiens
ctctttcggaaatga

SEQ ID NO: 631775 - DNA, 13 bp, Homo sapiens
ctctttctctctg

SEQ ID NO: 631776 - DNA, 14 bp, Homo sapiens
ctctttctctctgt

SEQ ID NO: 631777 - DNA, 12 bp, Homo sapiens
ctctttctttcc

SEQ ID NO: 631778 - DNA, 14 bp, Homo sapiens
ctctttctttccaa

SEQ ID NO: 631779 - DNA, 15 bp, Homo sapiens
ctctttctttccaaa

SEQ ID NO: 631780 - DNA, 22 bp, Homo sapiens
ctctttctttcttttgtgttgg

SEQ ID NO: 631781 - DNA, 16 bp, Homo sapiens
ctcttttgctctctca

SEQ ID NO: 631782 - DNA, 22 bp, Homo sapiens
ctcttttgctctctcattccca

SEQ ID NO: 631783 - DNA, 19 bp, Homo sapiens
ctgaaaacacaaacaacaa

SEQ ID NO: 631784 - DNA, 13 bp, Homo sapiens
ctgaaaactggaa

SEQ ID NO: 631785 - DNA, 19 bp, Homo sapiens
ctgaaaactggaataagaa

SEQ ID NO: 631786 - DNA, 23 bp, Homo sapiens
ctgaaaactggaataagaagcaa

SEQ ID NO: 631787 - DNA, 17 bp, Homo sapiens
ctgaaagatacagggga

SEQ ID NO: 631788 - DNA, 16 bp, Homo sapiens
ctgaaataaaagcctc

SEQ ID NO: 631789 - DNA, 23 bp, Homo sapiens
ctgaaattaggaaagtactgcat

SEQ ID NO: 631790 - DNA, 15 bp, Homo sapiens
ctgaaattagtgttt

SEQ ID NO: 631791 - DNA, 20 bp, Homo sapiens
ctgaaattagtgttttcatt

SEQ ID NO: 631792 - DNA, 11 bp, Homo sapiens
ctgaaattatg

SEQ ID NO: 631793 - DNA, 17 bp, Homo sapiens
ctgaaattatgtcaaat

SEQ ID NO: 631794 - DNA, 17 bp, Homo sapiens
ctgaacagaccggggtg

SEQ ID NO: 631795 - DNA, 18 bp, Homo sapiens
ctgaacatagttttcacc

SEQ ID NO: 631796 - DNA, 14 bp, Homo sapiens
ctgaagaaacacag

SEQ ID NO: 631797 - DNA, 16 bp, Homo sapiens
ctgaagcagagtcaag

SEQ ID NO: 631798 - DNA, 13 bp, Homo sapiens
ctgaagtcccttc

SEQ ID NO: 631799 - DNA, 15 bp, Homo sapiens
ctgaagtcccttcct

SEQ ID NO: 631800 - DNA, 21 bp, Homo sapiens
ctgaagtcccttcctgtcctg

SEQ ID NO: 631801 - DNA, 16 bp, Homo sapiens
ctgaataacaacaatt

SEQ ID NO: 631802 - DNA, 22 bp, Homo sapiens
ctgaataacaacaatttaggaa

SEQ ID NO: 631803 - DNA, 18 bp, Homo sapiens
ctgcttggtttagctgtg

SEQ ID NO: 631804 - DNA, 20 bp, Homo sapiens
ctgcttgtcattctgctaat

SEQ ID NO: 631805 - DNA, 17 bp, Homo sapiens
ctgctttcagtgcctgc

SEQ ID NO: 631806 - DNA, 19 bp, Homo sapiens
ctgctttctgatacatctg

SEQ ID NO: 631807 - DNA, 18 bp, Homo sapiens
ctggaaaaaaaaaaatat

SEQ ID NO: 631808 - DNA, 16 bp, Homo sapiens
ctggaaaagcacttta

SEQ ID NO: 631809 - DNA, 17 bp, Homo sapiens
ctggaaacatctgattt

SEQ ID NO: 631810 - DNA, 17 bp, Homo sapiens
ctggaaatttgtgtgct

SEQ ID NO: 631811 - DNA, 22 bp, Homo sapiens
ctggaccaaggtgcggaccgga

SEQ ID NO: 631812 - DNA, 15 bp, Homo sapiens
ctggagaccctgcgc

SEQ ID NO: 631813 - DNA, 12 bp, Homo sapiens
ctggagccaggg

SEQ ID NO: 631814 - DNA, 13 bp, Homo sapiens
ctggagccagggc

SEQ ID NO: 631815 - DNA, 15 bp, Homo sapiens
ctggagccagggcag

SEQ ID NO: 631816 - DNA, 17 bp, Homo sapiens
ctggagccccatcgcct

SEQ ID NO: 631817 - DNA, 22 bp, Homo sapiens
ctggagcccctatcctgcaccc

SEQ ID NO: 631818 - DNA, 13 bp, Homo sapiens
ctggagcctgggc

SEQ ID NO: 631819 - DNA, 17 bp, Homo sapiens
ctggagcctgggcagca

SEQ ID NO: 631820 - DNA, 16 bp, Homo sapiens
ctggagctgtccttca

SEQ ID NO: 631821 - DNA, 23 bp, Homo sapiens
ctggagctgtccttcattccgtt

SEQ ID NO: 631822 - DNA, 15 bp, Homo sapiens
ctggaggagaaggag

SEQ ID NO: 631823 - DNA, 17 bp, Homo sapiens
ctggaggagaaggagga

SEQ ID NO: 631824 - DNA, 22 bp, Homo sapiens
ctggattccagcagtgaatgct

SEQ ID NO: 631825 - DNA, 12 bp, Homo sapiens
ctggatttaact

SEQ ID NO: 631826 - DNA, 16 bp, Homo sapiens
ctggcagcgcctcccg

SEQ ID NO: 631827 - DNA, 22 bp, Homo sapiens
ctggcagcgcctcccgccgcct

SEQ ID NO: 631828 - DNA, 22 bp, Homo sapiens
ctggcccacccctcttccccct

SEQ ID NO: 631829 - DNA, 13 bp, Homo sapiens
ctggccccaggcg

SEQ ID NO: 631830 - DNA, 14 bp, Homo sapiens
ctggccccaggcgg

SEQ ID NO: 631831 - DNA, 15 bp, Homo sapiens
ctggccccaggcgga

SEQ ID NO: 631832 - DNA, 19 bp, Homo sapiens
ctggccccaggcggagggg

SEQ ID NO: 631833 - DNA, 12 bp, Homo sapiens
ctggccctgcct

SEQ ID NO: 631834 - DNA, 17 bp, Homo sapiens
ctggccctgcctcactg

SEQ ID NO: 631835 - DNA, 17 bp, Homo sapiens
ctggccggtaggctgct

SEQ ID NO: 631836 - DNA, 18 bp, Homo sapiens
ctggccggtaggctgctg

SEQ ID NO: 631837 - DNA, 19 bp, Homo sapiens
ctggccggtaggctgctgg

SEQ ID NO: 631838 - DNA, 20 bp, Homo sapiens
ctggccggtaggctgctggc

SEQ ID NO: 631839 - DNA, 18 bp, Homo sapiens
ctggccggtccaccccgt

SEQ ID NO: 631840 - DNA, 17 bp, Homo sapiens
ctggccttggttcctcc

SEQ ID NO: 631841 - DNA, 19 bp, Homo sapiens
ctggccttggttcctccag

SEQ ID NO: 631842 - DNA, 20 bp, Homo sapiens
ctggccttggttcctccagc

SEQ ID NO: 631843 - DNA, 21 bp, Homo sapiens
ctggcgccaggggcaggcagc

SEQ ID NO: 631844 - DNA, 22 bp, Homo sapiens
ctggcgccaggggcaggcagct

SEQ ID NO: 631845 - DNA, 12 bp, Homo sapiens
ctggcggcaggg

SEQ ID NO: 631846 - DNA, 13 bp, Homo sapiens
ctggcgggcagcc

SEQ ID NO: 631847 - DNA, 14 bp, Homo sapiens
ctggcgggcagccc

SEQ ID NO: 631848 - DNA, 16 bp, Homo sapiens
ctggcgggcagcccct

SEQ ID NO: 631849 - DNA, 20 bp, Homo sapiens
ctggcgggcagcccctgctg

SEQ ID NO: 631850 - DNA, 21 bp, Homo sapiens
ctggcgggcagcccctgctgg

SEQ ID NO: 631851 - DNA, 22 bp, Homo sapiens
ctggctgggctttggggctggt

SEQ ID NO: 631852 - DNA, 18 bp, Homo sapiens
ctggctgggtcgcccctc

SEQ ID NO: 631853 - DNA, 18 bp, Homo sapiens
ctggctgtggcccctcct

SEQ ID NO: 631854 - DNA, 22 bp, Homo sapiens
ctggctgtggcccctccttctc

SEQ ID NO: 631855 - DNA, 15 bp, Homo sapiens
ctggctttggcgccc

SEQ ID NO: 631856 - DNA, 17 bp, Homo sapiens
ctgggaacacagtgccc

SEQ ID NO: 631857 - DNA, 21 bp, Homo sapiens
ctgggaacacagtgccccagt

SEQ ID NO: 631858 - DNA, 16 bp, Homo sapiens
ctgggaacatgaccca

SEQ ID NO: 631859 - DNA, 21 bp, Homo sapiens
ctgggaacatgacccagcctg

SEQ ID NO: 631860 - DNA, 18 bp, Homo sapiens
ctgggacaggcaccatgc

SEQ ID NO: 631861 - DNA, 17 bp, Homo sapiens
ctgggcaccacaggctg

SEQ ID NO: 631862 - DNA, 15 bp, Homo sapiens
ctgggcaccctgcag

SEQ ID NO: 631863 - DNA, 21 bp, Homo sapiens
ctgggcaccctgcaggcaggc

SEQ ID NO: 631864 - DNA, 19 bp, Homo sapiens
ctgggcagcacctccggga

SEQ ID NO: 631865 - DNA, 21 bp, Homo sapiens
ctgggcagcacctccgggact

SEQ ID NO: 631866 - DNA, 22 bp, Homo sapiens
ctgggcagggccgcagggcgct

SEQ ID NO: 631867 - DNA, 21 bp, Homo sapiens
ctgggccagggaaacaaagtt

SEQ ID NO: 631868 - DNA, 22 bp, Homo sapiens
ctgggcctcccgtccgtccgcc

SEQ ID NO: 631869 - DNA, 22 bp, Homo sapiens
ctgggctcactacatgggccag

SEQ ID NO: 631870 - DNA, 15 bp, Homo sapiens
ctgggctgctggggc

SEQ ID NO: 631871 - DNA, 21 bp, Homo sapiens
ctgggctgttgtgtctggagc

SEQ ID NO: 631872 - DNA, 18 bp, Homo sapiens
ctgggctttggggctggt

SEQ ID NO: 631873 - DNA, 16 bp, Homo sapiens
ctggggaccaggagct

SEQ ID NO: 631874 - DNA, 14 bp, Homo sapiens
ctggggaggacccc

SEQ ID NO: 631875 - DNA, 15 bp, Homo sapiens
ctggggagggacaca

SEQ ID NO: 631876 - DNA, 16 bp, Homo sapiens
ctggggaggggctccg

SEQ ID NO: 631877 - DNA, 22 bp, Homo sapiens
ctggggcagggcccagggaggt

SEQ ID NO: 631878 - DNA, 13 bp, Homo sapiens
ctggggcttgcta

SEQ ID NO: 631879 - DNA, 22 bp, Homo sapiens
ctgggggactgctttcagtgcc

SEQ ID NO: 631880 - DNA, 23 bp, Homo sapiens
ctgggggactgctttcagtgcct

SEQ ID NO: 631881 - DNA, 12 bp, Homo sapiens
ctgggggctgct

SEQ ID NO: 631882 - DNA, 19 bp, Homo sapiens
ctggggggggcaagagctc

SEQ ID NO: 631883 - DNA, 16 bp, Homo sapiens
ctggggtctctgagca

SEQ ID NO: 631884 - DNA, 17 bp, Homo sapiens
ctggggtctctgagcag

SEQ ID NO: 631885 - DNA, 19 bp, Homo sapiens
ctggggtctctgagcagtg

SEQ ID NO: 631886 - DNA, 13 bp, Homo sapiens
ctggggtggggct

SEQ ID NO: 631887 - DNA, 14 bp, Homo sapiens
ctggggtggggctt

SEQ ID NO: 631888 - DNA, 15 bp, Homo sapiens
ctggggtggggcttg

SEQ ID NO: 631889 - DNA, 20 bp, Homo sapiens
ctggggtggttggaggcctg

SEQ ID NO: 631890 - DNA, 14 bp, Homo sapiens
ctgggtccccctcc

SEQ ID NO: 631891 - DNA, 15 bp, Homo sapiens
ctgggtccccctcct

SEQ ID NO: 631892 - DNA, 17 bp, Homo sapiens
ctgggtcgcccctcctc

SEQ ID NO: 631893 - DNA, 18 bp, Homo sapiens
ctgggtgtggcctggctt

SEQ ID NO: 631894 - DNA, 23 bp, Homo sapiens
ctgggttgttgcagagtaaatcc

SEQ ID NO: 631895 - DNA, 18 bp, Homo sapiens
ctgggtttgggcagtgga

SEQ ID NO: 631896 - DNA, 22 bp, Homo sapiens
ctgggtttgggcagtggagagg

SEQ ID NO: 631897 - DNA, 15 bp, Homo sapiens
ctgggttttagaaat

SEQ ID NO: 631898 - DNA, 12 bp, Homo sapiens
ctggtaattatc

SEQ ID NO: 631899 - DNA, 23 bp, Homo sapiens
ctggtaattatcctcaagttgtg

SEQ ID NO: 631900 - DNA, 18 bp, Homo sapiens
ctgtttactgacatggtg

SEQ ID NO: 631901 - DNA, 22 bp, Homo sapiens
ctgtttctcctccattcatgtt

SEQ ID NO: 631902 - DNA, 16 bp, Homo sapiens
ctgttttgggcctcca

SEQ ID NO: 631903 - DNA, 17 bp, Homo sapiens
ctgttttgggcctccat

SEQ ID NO: 631904 - DNA, 18 bp, Homo sapiens
ctgttttgggcctccatg

SEQ ID NO: 631905 - DNA, 12 bp, Homo sapiens
ctgttttgtgcg

SEQ ID NO: 631906 - DNA, 16 bp, Homo sapiens
cttaaaattggttaat

SEQ ID NO: 631907 - DNA, 20 bp, Homo sapiens
cttaaaattggttaatgaaa

SEQ ID NO: 631908 - DNA, 22 bp, Homo sapiens
cttaaaattggttaatgaaaaa

SEQ ID NO: 631909 - DNA, 20 bp, Homo sapiens
cttaaacaaaaactttccat

SEQ ID NO: 631910 - DNA, 16 bp, Homo sapiens
cttaaacattgcctta

SEQ ID NO: 631911 - DNA, 19 bp, Homo sapiens
cttaaacatttccctgctg

SEQ ID NO: 631912 - DNA, 16 bp, Homo sapiens
cttaaacccacataaa

SEQ ID NO: 631913 - DNA, 17 bp, Homo sapiens
cttaaacccacataaac

SEQ ID NO: 631914 - DNA, 18 bp, Homo sapiens
cttaaacccacataaaca

SEQ ID NO: 631915 - DNA, 16 bp, Homo sapiens
cttaacagatcacatg

SEQ ID NO: 631916 - DNA, 14 bp, Homo sapiens
cttaacagctgtat

SEQ ID NO: 631917 - DNA, 16 bp, Homo sapiens
cttaacagctgtatta

SEQ ID NO: 631918 - DNA, 17 bp, Homo sapiens
cttaacataaacttgta

SEQ ID NO: 631919 - DNA, 21 bp, Homo sapiens
cttaacataaacttgtactta

SEQ ID NO: 631920 - DNA, 22 bp, Homo sapiens
cttaacataaacttgtacttac

SEQ ID NO: 631921 - DNA, 19 bp, Homo sapiens
cttaaccttcaaatacatt

SEQ ID NO: 631922 - DNA, 16 bp, Homo sapiens
cttaagatctgactgc

SEQ ID NO: 631923 - DNA, 17 bp, Homo sapiens
cttaagatctgactgcc

SEQ ID NO: 631924 - DNA, 20 bp, Homo sapiens
cttaaggacagtgttcaaat

SEQ ID NO: 631925 - DNA, 23 bp, Homo sapiens
cttaaggacagtgttcaaattct

SEQ ID NO: 631926 - DNA, 20 bp, Homo sapiens
cttaataggcctaaaatagt

SEQ ID NO: 631927 - DNA, 21 bp, Homo sapiens
cttacaaagccagctctgagc

SEQ ID NO: 631928 - DNA, 16 bp, Homo sapiens
cttacacacctgagaa

SEQ ID NO: 631929 - DNA, 16 bp, Homo sapiens
cttacacgaagaaata

SEQ ID NO: 631930 - DNA, 20 bp, Homo sapiens
cttacacgaagaaatagaat

SEQ ID NO: 631931 - DNA, 23 bp, Homo sapiens
cttacagtaggagtgagaaattt

SEQ ID NO: 631932 - DNA, 20 bp, Homo sapiens
cttactaaccaccatttccc

SEQ ID NO: 631933 - DNA, 17 bp, Homo sapiens
cttagaatactgtattg

SEQ ID NO: 631934 - DNA, 12 bp, Homo sapiens
cttagaatgggg

SEQ ID NO: 631935 - DNA, 14 bp, Homo sapiens
cttagaatgtgaaa

SEQ ID NO: 631936 - DNA, 16 bp, Homo sapiens
cttagaatgtgaaaaa

SEQ ID NO: 631937 - DNA, 13 bp, Homo sapiens
cttagtaaattcc

SEQ ID NO: 631938 - DNA, 14 bp, Homo sapiens
cttataacattgta

SEQ ID NO: 631939 - DNA, 15 bp, Homo sapiens
cttataacattgtat

SEQ ID NO: 631940 - DNA, 17 bp, Homo sapiens
cttatattattttctgt

SEQ ID NO: 631941 - DNA, 19 bp, Homo sapiens
cttatggaacactctgaga

SEQ ID NO: 631942 - DNA, 20 bp, Homo sapiens
cttatggaacactctgagac

SEQ ID NO: 631943 - DNA, 23 bp, Homo sapiens
cttatgtcatttcttctctctgt

SEQ ID NO: 631944 - DNA, 13 bp, Homo sapiens
cttattaaaatat

SEQ ID NO: 631945 - DNA, 15 bp, Homo sapiens
cttattaaaatattt

SEQ ID NO: 631946 - DNA, 23 bp, Homo sapiens
cttattaaaatattttcttaatt

SEQ ID NO: 631947 - DNA, 13 bp, Homo sapiens
cttattcctaatt

SEQ ID NO: 631948 - DNA, 18 bp, Homo sapiens
cttatttgtatttttcct

SEQ ID NO: 631949 - DNA, 14 bp, Homo sapiens
cttattttgattgt

SEQ ID NO: 631950 - DNA, 16 bp, Homo sapiens
cttcaaatgtcatttc

SEQ ID NO: 631951 - DNA, 14 bp, Homo sapiens
cttcaaccctgccc

SEQ ID NO: 631952 - DNA, 15 bp, Homo sapiens
cttcaaccctgccct

SEQ ID NO: 631953 - DNA, 17 bp, Homo sapiens
cttcaaccctgccctgc

SEQ ID NO: 631954 - DNA, 18 bp, Homo sapiens
cttcaaccctgccctgca

SEQ ID NO: 631955 - DNA, 19 bp, Homo sapiens
cttcaagcaccctgttccc

SEQ ID NO: 631956 - DNA, 10 bp, Homo sapiens
cttcaaggat

SEQ ID NO: 631957 - DNA, 21 bp, Homo sapiens
cttcaaggatcctgagccaga

SEQ ID NO: 631958 - DNA, 22 bp, Homo sapiens
cttcaaggatcctgagccagat

SEQ ID NO: 631959 - DNA, 19 bp, Homo sapiens
cttcaagtaagatcaagaa

SEQ ID NO: 631960 - DNA, 17 bp, Homo sapiens
cttcaatgttaaatcta

SEQ ID NO: 631961 - DNA, 15 bp, Homo sapiens
cttcacttaaaatca

SEQ ID NO: 631962 - DNA, 19 bp, Homo sapiens
cttcagaaactttttctaa

SEQ ID NO: 631963 - DNA, 20 bp, Homo sapiens
cttcagactctctcctctct

SEQ ID NO: 631964 - DNA, 17 bp, Homo sapiens
cttcagcaatccttaaa

SEQ ID NO: 631965 - DNA, 21 bp, Homo sapiens
cttcaggaaagcagcagtttt

SEQ ID NO: 631966 - DNA, 12 bp, Homo sapiens
cttcagtgcctt

SEQ ID NO: 631967 - DNA, 22 bp, Homo sapiens
cttcagtgccttatggaacact

SEQ ID NO: 631968 - DNA, 13 bp, Homo sapiens
cttcagttctcat

SEQ ID NO: 631969 - DNA, 16 bp, Homo sapiens
cttcagttctcatctt

SEQ ID NO: 631970 - DNA, 18 bp, Homo sapiens
cttcataaattatttcta

SEQ ID NO: 631971 - DNA, 22 bp, Homo sapiens
cttcatgcgcagtccccaggta

SEQ ID NO: 631972 - DNA, 19 bp, Homo sapiens
cttcatgctgtctgtgtga

SEQ ID NO: 631973 - DNA, 16 bp, Homo sapiens
cttcatgcttttctca

SEQ ID NO: 631974 - DNA, 18 bp, Homo sapiens
cttcatgcttttctcatg

SEQ ID NO: 631975 - DNA, 19 bp, Homo sapiens
cttcatggccatagctttt

SEQ ID NO: 631976 - DNA, 14 bp, Homo sapiens
cttcattaaaacaa

SEQ ID NO: 631977 - DNA, 19 bp, Homo sapiens
cttcattccgttaggaata

SEQ ID NO: 631978 - DNA, 16 bp, Homo sapiens
cttcatttaacactga

SEQ ID NO: 631979 - DNA, 16 bp, Homo sapiens
cttccagtgcatgttg

SEQ ID NO: 631980 - DNA, 17 bp, Homo sapiens
cttccatcttgtggggc

SEQ ID NO: 631981 - DNA, 21 bp, Homo sapiens
cttccatggtggtttcagaaa

SEQ ID NO: 631982 - DNA, 22 bp, Homo sapiens
cttccatggtggtttcagaaag

SEQ ID NO: 631983 - DNA, 21 bp, Homo sapiens
cttcccaacaatactttgtgt

SEQ ID NO: 631984 - DNA, 16 bp, Homo sapiens
cttcccaagtcctcgc

SEQ ID NO: 631985 - DNA, 16 bp, Homo sapiens
cttcccagctggcagc

SEQ ID NO: 631986 - DNA, 18 bp, Homo sapiens
cttcccagctggcagcgc

SEQ ID NO: 631987 - DNA, 19 bp, Homo sapiens
cttcccagctggcagcgcc

SEQ ID NO: 631988 - DNA, 20 bp, Homo sapiens
cttcccagctggcagcgcct

SEQ ID NO: 631989 - DNA, 22 bp, Homo sapiens
cttcccagctggcagcgcctcc

SEQ ID NO: 631990 - DNA, 17 bp, Homo sapiens
cttcccatgtctttctc

SEQ ID NO: 631991 - DNA, 10 bp, Homo sapiens
cttccccact

SEQ ID NO: 631992 - DNA, 13 bp, Homo sapiens
cttccccactccc

SEQ ID NO: 631993 - DNA, 19 bp, Homo sapiens
cttccccatcgccttctgg

SEQ ID NO: 631994 - DNA, 23 bp, Homo sapiens
cttcccccagggtcccctgcatg

SEQ ID NO: 631995 - DNA, 18 bp, Homo sapiens
cttccccgtgcggcccgt

SEQ ID NO: 631996 - DNA, 19 bp, Homo sapiens
cttcccctgcgccctccct

SEQ ID NO: 631997 - DNA, 22 bp, Homo sapiens
cttcccctgcgccctccctccc

SEQ ID NO: 631998 - DNA, 19 bp, Homo sapiens
cttcccctttcctggggga

SEQ ID NO: 631999 - DNA, 13 bp, Homo sapiens
cttcccgcagcac

SEQ ID NO: 632000 - DNA, 14 bp, Homo sapiens
cttcccgcagcacc

SEQ ID NO: 632001 - DNA, 16 bp, Homo sapiens
cttcccgcagcaccag

SEQ ID NO: 632002 - DNA, 21 bp, Homo sapiens
cttcccgcagcaccagcctga

SEQ ID NO: 632003 - DNA, 14 bp, Homo sapiens
cttccctagttctt

SEQ ID NO: 632004 - DNA, 23 bp, Homo sapiens
cttccctgacactgtctgctgcc

SEQ ID NO: 632005 - DNA, 22 bp, Homo sapiens
cttccgggtctcgcagcctgaa

SEQ ID NO: 632006 - DNA, 13 bp, Homo sapiens
cttcctcttacct

SEQ ID NO: 632007 - DNA, 18 bp, Homo sapiens
cttcctgaactcccagtc

SEQ ID NO: 632008 - DNA, 12 bp, Homo sapiens
cttcctgcccag

SEQ ID NO: 632009 - DNA, 13 bp, Homo sapiens
cttcctgcccagg

SEQ ID NO: 632010 - DNA, 14 bp, Homo sapiens
cttcctgtcctgct

SEQ ID NO: 632011 - DNA, 15 bp, Homo sapiens
cttcctgtcctgctc

SEQ ID NO: 632012 - DNA, 17 bp, Homo sapiens
cttcctgtcctgctcac

SEQ ID NO: 632013 - DNA, 23 bp, Homo sapiens
cttcggataattttcatttttaa

SEQ ID NO: 632014 - DNA, 16 bp, Homo sapiens
cttctaaaggcggagg

SEQ ID NO: 632015 - DNA, 13 bp, Homo sapiens
cttctaaatcata

SEQ ID NO: 632016 - DNA, 20 bp, Homo sapiens
cttctaaatcataatcatcc

SEQ ID NO: 632017 - DNA, 23 bp, Homo sapiens
cttctacaatacaacacattgaa

SEQ ID NO: 632018 - DNA, 12 bp, Homo sapiens
ctggtcctgcac

SEQ ID NO: 632019 - DNA, 14 bp, Homo sapiens
ctggtctggagccc

SEQ ID NO: 632020 - DNA, 16 bp, Homo sapiens
ctggtctggagcccct

SEQ ID NO: 632021 - DNA, 16 bp, Homo sapiens
ctggtgcgtgtggccc

SEQ ID NO: 632022 - DNA, 13 bp, Homo sapiens
ctggtggccctgc

SEQ ID NO: 632023 - DNA, 23 bp, Homo sapiens
ctggttaaccgggactacagaag

SEQ ID NO: 632024 - DNA, 18 bp, Homo sapiens
ctgtaaataaaaatagct

SEQ ID NO: 632025 - DNA, 12 bp, Homo sapiens
ctgtaactgtcc

SEQ ID NO: 632026 - DNA, 18 bp, Homo sapiens
ctgtaaggccattcttta

SEQ ID NO: 632027 - DNA, 13 bp, Homo sapiens
ctgtacacacaca

SEQ ID NO: 632028 - DNA, 14 bp, Homo sapiens
ctgtacacacacag

SEQ ID NO: 632029 - DNA, 20 bp, Homo sapiens
ctgtacacacacagacacac

SEQ ID NO: 632030 - DNA, 21 bp, Homo sapiens
ctgtacacacacagacacaca

SEQ ID NO: 632031 - DNA, 19 bp, Homo sapiens
ctgtacgaggcttctctaa

SEQ ID NO: 632032 - DNA, 18 bp, Homo sapiens
ctgtactcgcttgtgcag

SEQ ID NO: 632033 - DNA, 23 bp, Homo sapiens
ctgtacttgatttttcaaagact

SEQ ID NO: 632034 - DNA, 19 bp, Homo sapiens
ctgtagctctgaatgctat

SEQ ID NO: 632035 - DNA, 13 bp, Homo sapiens
ctgtagctttaaa

SEQ ID NO: 632036 - DNA, 19 bp, Homo sapiens
ctgtagggaaaccttggag

SEQ ID NO: 632037 - DNA, 20 bp, Homo sapiens
ctgtagggaaaccttggaga

SEQ ID NO: 632038 - DNA, 16 bp, Homo sapiens
ctgtatacaaacaggt

SEQ ID NO: 632039 - DNA, 20 bp, Homo sapiens
ctgtatacaaacaggtgcta

SEQ ID NO: 632040 - DNA, 15 bp, Homo sapiens
ctgtatctgacatat

SEQ ID NO: 632041 - DNA, 20 bp, Homo sapiens
ctgtatttacttgttatgtt

SEQ ID NO: 632042 - DNA, 21 bp, Homo sapiens
ctgtatttacttgttatgttg

SEQ ID NO: 632043 - DNA, 15 bp, Homo sapiens
ctgtatttgaggaaa

SEQ ID NO: 632044 - DNA, 19 bp, Homo sapiens
ctgtcaagattaagttata

SEQ ID NO: 632045 - DNA, 15 bp, Homo sapiens
ctgtcagcttcccaa

SEQ ID NO: 632046 - DNA, 19 bp, Homo sapiens
ctgtcagcttcccaacaat

SEQ ID NO: 632047 - DNA, 16 bp, Homo sapiens
ctgtcagtttgtgaag

SEQ ID NO: 632048 - DNA, 17 bp, Homo sapiens
ctgtcagtttgtgaagt

SEQ ID NO: 632049 - DNA, 19 bp, Homo sapiens
ctgtccatccgtctctgtc

SEQ ID NO: 632050 - DNA, 17 bp, Homo sapiens
ctgtcccggagctcagg

SEQ ID NO: 632051 - DNA, 14 bp, Homo sapiens
ctgtccctaaacat

SEQ ID NO: 632052 - DNA, 19 bp, Homo sapiens
ctgtccctgtgggctcaca

SEQ ID NO: 632053 - DNA, 21 bp, Homo sapiens
ctgtccctgtgggctcacacc

SEQ ID NO: 632054 - DNA, 12 bp, Homo sapiens
ctgtcctgctca

SEQ ID NO: 632055 - DNA, 13 bp, Homo sapiens
ctgtcctgctcac

SEQ ID NO: 632056 - DNA, 18 bp, Homo sapiens
ctgtcctgctcacgtctg

SEQ ID NO: 632057 - DNA, 17 bp, Homo sapiens
ctgtcctggctcccagg

SEQ ID NO: 632058 - DNA, 15 bp, Homo sapiens
ctgtccttccaacct

SEQ ID NO: 632059 - DNA, 19 bp, Homo sapiens
ctgtcggtgtttggaggct

SEQ ID NO: 632060 - DNA, 19 bp, Homo sapiens
ctgtctataggacttaatt

SEQ ID NO: 632061 - DNA, 14 bp, Homo sapiens
ctgtctatttctgc

SEQ ID NO: 632062 - DNA, 22 bp, Homo sapiens
ctgtctctacaaaaaaaatcaa

SEQ ID NO: 632063 - DNA, 17 bp, Homo sapiens
ctgtctctccctaccct

SEQ ID NO: 632064 - DNA, 14 bp, Homo sapiens
ctgtctgagccctg

SEQ ID NO: 632065 - DNA, 16 bp, Homo sapiens
ctgtctgagccctgcc

SEQ ID NO: 632066 - DNA, 19 bp, Homo sapiens
ctgtctgagccctgccctc

SEQ ID NO: 632067 - DNA, 22 bp, Homo sapiens
ctgtctgagccctgccctcact

SEQ ID NO: 632068 - DNA, 13 bp, Homo sapiens
ctgtctgtctctc

SEQ ID NO: 632069 - DNA, 16 bp, Homo sapiens
ctgtctgtctctcttt

SEQ ID NO: 632070 - DNA, 21 bp, Homo sapiens
ctgtctgtgtgaggctccctc

SEQ ID NO: 632071 - DNA, 21 bp, Homo sapiens
ctgtcttcaaccctgccctgc

SEQ ID NO: 632072 - DNA, 22 bp, Homo sapiens
ctgtcttcaaccctgccctgca

SEQ ID NO: 632073 - DNA, 23 bp, Homo sapiens
ctgtctttgctgtttatatatat

SEQ ID NO: 632074 - DNA, 21 bp, Homo sapiens
ctgtgaaagtctcctgtatca

SEQ ID NO: 632075 - DNA, 22 bp, Homo sapiens
ctgtgaaagtctcctgtatcat

SEQ ID NO: 632076 - DNA, 16 bp, Homo sapiens
ctgtgacacagctgag

SEQ ID NO: 632077 - DNA, 16 bp, Homo sapiens
ctgtgacattccacag

SEQ ID NO: 632078 - DNA, 13 bp, Homo sapiens
ctgtgacctgctc

SEQ ID NO: 632079 - DNA, 17 bp, Homo sapiens
ctgtgacctgctcctgc

SEQ ID NO: 632080 - DNA, 16 bp, Homo sapiens
ctgtgagtctgtcctt

SEQ ID NO: 632081 - DNA, 20 bp, Homo sapiens
ctgtgagtctgtcctttccc

SEQ ID NO: 632082 - DNA, 13 bp, Homo sapiens
ctgtgataacaga

SEQ ID NO: 632083 - DNA, 23 bp, Homo sapiens
ctgtgatgtcagtagtgcctgtg

SEQ ID NO: 632084 - DNA, 14 bp, Homo sapiens
ctgtgcactctact

SEQ ID NO: 632085 - DNA, 12 bp, Homo sapiens
ctgtgcagtaga

SEQ ID NO: 632086 - DNA, 17 bp, Homo sapiens
ctgtgcagtagagagcc

SEQ ID NO: 632087 - DNA, 18 bp, Homo sapiens
ctgtgcagtagagagcct

SEQ ID NO: 632088 - DNA, 21 bp, Homo sapiens
ctgtgcagtagagagcctttc

SEQ ID NO: 632089 - DNA, 17 bp, Homo sapiens
ctgtgcatctggcctgg

SEQ ID NO: 632090 - DNA, 11 bp, Homo sapiens
ctgtgccctct

SEQ ID NO: 632091 - DNA, 11 bp, Homo sapiens
ctgtgcctttg

SEQ ID NO: 632092 - DNA, 12 bp, Homo sapiens
ctgtgcctttgg

SEQ ID NO: 632093 - DNA, 16 bp, Homo sapiens
ctgtgcgccttgtaga

SEQ ID NO: 632094 - DNA, 20 bp, Homo sapiens
ctgtgcgccttgtagaatgc

SEQ ID NO: 632095 - DNA, 17 bp, Homo sapiens
ctgtgctaagttgtctt

SEQ ID NO: 632096 - DNA, 20 bp, Homo sapiens
ctgtgctaagttgtcttaca

SEQ ID NO: 632097 - DNA, 21 bp, Homo sapiens
ctgtgctttcatgtttaagaa

SEQ ID NO: 632098 - DNA, 19 bp, Homo sapiens
ctgtggcccctccttctcc

SEQ ID NO: 632099 - DNA, 16 bp, Homo sapiens
ctgtggcggccttccg

SEQ ID NO: 632100 - DNA, 12 bp, Homo sapiens
ctgtggctgatt

SEQ ID NO: 632101 - DNA, 12 bp, Homo sapiens
ctgtgggactgg

SEQ ID NO: 632102 - DNA, 16 bp, Homo sapiens
ctgtgggactggccca

SEQ ID NO: 632103 - DNA, 22 bp, Homo sapiens
ctgtgggactggcccacccctc

SEQ ID NO: 632104 - DNA, 15 bp, Homo sapiens
ctgtgggctcacacc

SEQ ID NO: 632105 - DNA, 22 bp, Homo sapiens
ctgtgggctcacaccggcactg

SEQ ID NO: 632106 - DNA, 17 bp, Homo sapiens
ctgtgggggaggtccct

SEQ ID NO: 632107 - DNA, 20 bp, Homo sapiens
ctgtgggggaggtccctgcc

SEQ ID NO: 632108 - DNA, 22 bp, Homo sapiens
ctgtggtcttcaaattgtcttt

SEQ ID NO: 632109 - DNA, 22 bp, Homo sapiens
ctgtgtagtagctcgtgtgctt

SEQ ID NO: 632110 - DNA, 15 bp, Homo sapiens
ctgtgtcatctgtca

SEQ ID NO: 632111 - DNA, 19 bp, Homo sapiens
ctgtgtcctaaatgcaaag

SEQ ID NO: 632112 - DNA, 16 bp, Homo sapiens
ctgtgttcagtgcctt

SEQ ID NO: 632113 - DNA, 14 bp, Homo sapiens
ctgtgttgttcata

SEQ ID NO: 632114 - DNA, 23 bp, Homo sapiens
ctgtgtttcgcattaagcacaca

SEQ ID NO: 632115 - DNA, 14 bp, Homo sapiens
ctgttatctgtctt

SEQ ID NO: 632116 - DNA, 16 bp, Homo sapiens
ctgttatctgtcttta

SEQ ID NO: 632117 - DNA, 22 bp, Homo sapiens
ctgttatctgtctttatgattt

SEQ ID NO: 632118 - DNA, 15 bp, Homo sapiens
ctgttcacgtgactc

SEQ ID NO: 632119 - DNA, 13 bp, Homo sapiens
ctgttcagaggca

SEQ ID NO: 632120 - DNA, 13 bp, Homo sapiens
ctgttccaagtgt

SEQ ID NO: 632121 - DNA, 15 bp, Homo sapiens
ctgttccctctttct

SEQ ID NO: 632122 - DNA, 16 bp, Homo sapiens
ctgttccgcctcactg

SEQ ID NO: 632123 - DNA, 18 bp, Homo sapiens
ctgttccgcctcactggg

SEQ ID NO: 632124 - DNA, 14 bp, Homo sapiens
ctgttctgaaatta

SEQ ID NO: 632125 - DNA, 14 bp, Homo sapiens
ctgttgaagtgcat

SEQ ID NO: 632126 - DNA, 22 bp, Homo sapiens
ctgttgaagtgcatgttaaaat

SEQ ID NO: 632127 - DNA, 15 bp, Homo sapiens
ctgttgattctttca

SEQ ID NO: 632128 - DNA, 23 bp, Homo sapiens
ctgttgattctttcaatccacag

SEQ ID NO: 632129 - DNA, 21 bp, Homo sapiens
ctgttgtaatatcagttacag

SEQ ID NO: 632130 - DNA, 15 bp, Homo sapiens
ctgttgtctgaaaca

SEQ ID NO: 632131 - DNA, 14 bp, Homo sapiens
ctgtttaccctccc

SEQ ID NO: 632132 - DNA, 15 bp, Homo sapiens
ctgtttaccctccct

SEQ ID NO: 632133 - DNA, 16 bp, Homo sapiens
ctgtttaccctccctg

SEQ ID NO: 632134 - DNA, 19 bp, Homo sapiens
ctgtttaccgcccacccag

SEQ ID NO: 632135 - DNA, 22 bp, Homo sapiens
ctgtttaccgcccacccagcag

SEQ ID NO: 632136 - DNA, 23 bp, Homo sapiens
ctgtttaccgcccacccagcagc

SEQ ID NO: 632137 - DNA, 19 bp, Homo sapiens
gaatgtgcaaagcagtatg

SEQ ID NO: 632138 - DNA, 18 bp, Homo sapiens
gaatgttgtcctgtgtca

SEQ ID NO: 632139 - DNA, 23 bp, Homo sapiens
gaatgttgtgttggtatttactg

SEQ ID NO: 632140 - DNA, 15 bp, Homo sapiens
gaattacataacagg

SEQ ID NO: 632141 - DNA, 19 bp, Homo sapiens
gaattattagcaccagctt

SEQ ID NO: 632142 - DNA, 20 bp, Homo sapiens
gaattattagcaccagcttg

SEQ ID NO: 632143 - DNA, 21 bp, Homo sapiens
gaattcattgtctcagtgaag

SEQ ID NO: 632144 - DNA, 19 bp, Homo sapiens
gaattgaaccgtcaatgtg

SEQ ID NO: 632145 - DNA, 17 bp, Homo sapiens
gaattgagagatgtttt

SEQ ID NO: 632146 - DNA, 20 bp, Homo sapiens
gaattgcctttgataattct

SEQ ID NO: 632147 - DNA, 18 bp, Homo sapiens
gaattggctgccaagagt

SEQ ID NO: 632148 - DNA, 13 bp, Homo sapiens
gaattttaaaatg

SEQ ID NO: 632149 - DNA, 18 bp, Homo sapiens
gaattttatttctctcag

SEQ ID NO: 632150 - DNA, 12 bp, Homo sapiens
gaattttcattt

SEQ ID NO: 632151 - DNA, 23 bp, Homo sapiens
gaattttcattttcattatttca

SEQ ID NO: 632152 - DNA, 18 bp, Homo sapiens
gacaaagggaaggctgct

SEQ ID NO: 632153 - DNA, 14 bp, Homo sapiens
gacaaatacacata

SEQ ID NO: 632154 - DNA, 22 bp, Homo sapiens
gacaaatacacatacatatata

SEQ ID NO: 632155 - DNA, 12 bp, Homo sapiens
gacaacacacac

SEQ ID NO: 632156 - DNA, 14 bp, Homo sapiens
gacaacctgcccct

SEQ ID NO: 632157 - DNA, 21 bp, Homo sapiens
gacaagtgacttatttgctca

SEQ ID NO: 632158 - DNA, 21 bp, Homo sapiens
gacaataagaaacagtttaac

SEQ ID NO: 632159 - DNA, 12 bp, Homo sapiens
gacaatgcaaac

SEQ ID NO: 632160 - DNA, 14 bp, Homo sapiens
gacaatttaccaca

SEQ ID NO: 632161 - DNA, 13 bp, Homo sapiens
gacacacacatat

SEQ ID NO: 632162 - DNA, 22 bp, Homo sapiens
gacacactcaccatttaatcat

SEQ ID NO: 632163 - DNA, 16 bp, Homo sapiens
gacacagcacaagggc

SEQ ID NO: 632164 - DNA, 17 bp, Homo sapiens
gaaatgattgagagcag

SEQ ID NO: 632165 - DNA, 21 bp, Homo sapiens
gaaatgattgagagcagcctc

SEQ ID NO: 632166 - DNA, 20 bp, Homo sapiens
gaaatgtttttgatttatca

SEQ ID NO: 632167 - DNA, 16 bp, Homo sapiens
gaaattctataagaga

SEQ ID NO: 632168 - DNA, 17 bp, Homo sapiens
gaaattctataagagac

SEQ ID NO: 632169 - DNA, 19 bp, Homo sapiens
gaaattctataagagacaa

SEQ ID NO: 632170 - DNA, 17 bp, Homo sapiens
gaaattgtgccaaagat

SEQ ID NO: 632171 - DNA, 16 bp, Homo sapiens
gaaattttatctcttc

SEQ ID NO: 632172 - DNA, 15 bp, Homo sapiens
gaaatttttgcatgt

SEQ ID NO: 632173 - DNA, 20 bp, Homo sapiens
gaaatttttttccagaattg

SEQ ID NO: 632174 - DNA, 24 bp, Homo sapiens
gaacaaatatgattctcctctccc

SEQ ID NO: 632175 - DNA, 23 bp, Homo sapiens
gaacaacaacaaagcatgctcag

SEQ ID NO: 632176 - DNA, 15 bp, Homo sapiens
gaacacactcagcag

SEQ ID NO: 632177 - DNA, 17 bp, Homo sapiens
gaacactcatcccccat

SEQ ID NO: 632178 - DNA, 13 bp, Homo sapiens
gaacactctgaga

SEQ ID NO: 632179 - DNA, 17 bp, Homo sapiens
gaacactgcaccctcca

SEQ ID NO: 632180 - DNA, 14 bp, Homo sapiens
gaacagccctgcac

SEQ ID NO: 632181 - DNA, 15 bp, Homo sapiens
gaacagccctgcacg

SEQ ID NO: 632182 - DNA, 17 bp, Homo sapiens
gaacatgacccagcctg

SEQ ID NO: 632183 - DNA, 20 bp, Homo sapiens
gaacatgacccgtacacacc

SEQ ID NO: 632184 - DNA, 21 bp, Homo sapiens
gaaccaacgggtctgtgggac

SEQ ID NO: 632185 - DNA, 13 bp, Homo sapiens
gaaccagcactcc

SEQ ID NO: 632186 - DNA, 16 bp, Homo sapiens
gaaccagcactcccag

SEQ ID NO: 632187 - DNA, 17 bp, Homo sapiens
gaaccagcactcccagg

SEQ ID NO: 632188 - DNA, 21 bp, Homo sapiens
gactctctcctctctctccct

SEQ ID NO: 632189 - DNA, 21 bp, Homo sapiens
gactcttactaaccaccattt

SEQ ID NO: 632190 - DNA, 18 bp, Homo sapiens
gactgcccaccctgggcc

SEQ ID NO: 632191 - DNA, 18 bp, Homo sapiens
gactgctttcagtgcctg

SEQ ID NO: 632192 - DNA, 21 bp, Homo sapiens
gactgctttcagtgcctgctg

SEQ ID NO: 632193 - DNA, 21 bp, Homo sapiens
gactggcccacccctcttccc

SEQ ID NO: 632194 - DNA, 22 bp, Homo sapiens
gactggcccacccctcttcccc

SEQ ID NO: 632195 - DNA, 20 bp, Homo sapiens
gactgtcttcaaccctgccc

SEQ ID NO: 632196 - DNA, 22 bp, Homo sapiens
gactgtcttcaaccctgccctg

SEQ ID NO: 632197 - DNA, 21 bp, Homo sapiens
gactgtggctgcagagacctt

SEQ ID NO: 632198 - DNA, 20 bp, Homo sapiens
gactgtgttcagtgccttgg

SEQ ID NO: 632199 - DNA, 15 bp, Homo sapiens
gacttaatttagcag

SEQ ID NO: 632200 - DNA, 17 bp, Homo sapiens
gacttcagaaacttttt

SEQ ID NO: 632201 - DNA, 20 bp, Homo sapiens
gacttcagactctctcctct

SEQ ID NO: 632202 - DNA, 22 bp, Homo sapiens
gacttcagactctctcctctct

SEQ ID NO: 632203 - DNA, 19 bp, Homo sapiens
gacttcatttaacactgag

SEQ ID NO: 632204 - DNA, 22 bp, Homo sapiens
gacttcatttaacactgagtga

SEQ ID NO: 632205 - DNA, 13 bp, Homo sapiens
gacttcccagctg

SEQ ID NO: 632206 - DNA, 14 bp, Homo sapiens
gacttcccagctgg

SEQ ID NO: 632207 - DNA, 23 bp, Homo sapiens
gacttcccagctggcagcgcctc

SEQ ID NO: 632208 - DNA, 14 bp, Homo sapiens
gacttctaaatcat

SEQ ID NO: 632209 - DNA, 22 bp, Homo sapiens
gacttctttactaacactggct

SEQ ID NO: 632210 - DNA, 16 bp, Homo sapiens
gacttggataggagct

SEQ ID NO: 632211 - DNA, 16 bp, Homo sapiens
gacttgtataagtaga

SEQ ID NO: 632212 - DNA, 17 bp, Homo sapiens
gactttgaataaaataa

SEQ ID NO: 632213 - DNA, 15 bp, Homo sapiens
gagaaaaagccctct

SEQ ID NO: 632214 - DNA, 18 bp, Homo sapiens
gagaaaatgctttctcat

SEQ ID NO: 632215 - DNA, 18 bp, Homo sapiens
gagaaatttttttccaga

SEQ ID NO: 632216 - DNA, 18 bp, Homo sapiens
gagaaggcctgcccccct

SEQ ID NO: 632217 - DNA, 21 bp, Homo sapiens
gagaaggcctgccccccttcc

SEQ ID NO: 632218 - DNA, 22 bp, Homo sapiens
gagaaggcctgccccccttccc

SEQ ID NO: 632219 - DNA, 23 bp, Homo sapiens
gagaaggcctgccccccttccca

SEQ ID NO: 632220 - DNA, 15 bp, Homo sapiens
gagcggctgaggacg

SEQ ID NO: 632221 - DNA, 23 bp, Homo sapiens
gagcggcttccccattgccttct

SEQ ID NO: 632222 - DNA, 21 bp, Homo sapiens
gagcgggggctaactggcccc

SEQ ID NO: 632223 - DNA, 22 bp, Homo sapiens
gagcgggggctaactggcccca

SEQ ID NO: 632224 - DNA, 12 bp, Homo sapiens
gagcgtgtccta

SEQ ID NO: 632225 - DNA, 18 bp, Homo sapiens
gagcgtgtcctatccccg

SEQ ID NO: 632226 - DNA, 23 bp, Homo sapiens
gagcgtgtcctatccccggacgc

SEQ ID NO: 632227 - DNA, 14 bp, Homo sapiens
gagctatgcacacc

SEQ ID NO: 632228 - DNA, 17 bp, Homo sapiens
gagctatgcacaccaaa

SEQ ID NO: 632229 - DNA, 13 bp, Homo sapiens
gagctcaggagaa

SEQ ID NO: 632230 - DNA, 16 bp, Homo sapiens
gagctcaggagaaggc

SEQ ID NO: 632231 - DNA, 14 bp, Homo sapiens
gagctccaccctcc

SEQ ID NO: 632232 - DNA, 17 bp, Homo sapiens
gagctccaccctcccct

SEQ ID NO: 632233 - DNA, 22 bp, Homo sapiens
gagctccaccctcccctcttct

SEQ ID NO: 632234 - DNA, 17 bp, Homo sapiens
gagctgagtcggctggg

SEQ ID NO: 632235 - DNA, 20 bp, Homo sapiens
gagctgagtcggctgggcag

SEQ ID NO: 632236 - DNA, 15 bp, Homo sapiens
gagctgctgtatttg

SEQ ID NO: 632237 - DNA, 21 bp, Homo sapiens
gagctggcctattttggacgt

SEQ ID NO: 632238 - DNA, 19 bp, Homo sapiens
gagcttggagccccctggc

SEQ ID NO: 632239 - DNA, 21 bp, Homo sapiens
gaggaaaaggcttgagtctgg

SEQ ID NO: 632240 - DNA, 15 bp, Homo sapiens
gaggaagcacctctc

SEQ ID NO: 632241 - DNA, 21 bp, Homo sapiens
gaggaatgtagggcctgcatg

SEQ ID NO: 632242 - DNA, 15 bp, Homo sapiens
gaggacacagcacaa

SEQ ID NO: 632243 - DNA, 16 bp, Homo sapiens
gaggacacagcacaag

SEQ ID NO: 632244 - DNA, 23 bp, Homo sapiens
gaggacacagcacaagggcacat

SEQ ID NO: 632245 - DNA, 23 bp, Homo sapiens
gaggacacttttgccaatgaact

SEQ ID NO: 632246 - DNA, 14 bp, Homo sapiens
gaggacagggaggg

SEQ ID NO: 632247 - DNA, 11 bp, Homo sapiens
gaggacccctg

SEQ ID NO: 632248 - DNA, 21 bp, Homo sapiens
gaggacccctgccctcggcca

SEQ ID NO: 632249 - DNA, 22 bp, Homo sapiens
gaggacggggcagagctgagtc

SEQ ID NO: 632250 - DNA, 17 bp, Homo sapiens
gaggagattgctctggg

SEQ ID NO: 632251 - DNA, 21 bp, Homo sapiens
gaggagcaaacaggaaaatga

SEQ ID NO: 632252 - DNA, 10 bp, Homo sapiens
gaggagcacc

SEQ ID NO: 632253 - DNA, 18 bp, Homo sapiens
gaggagcacccccagcct

SEQ ID NO: 632254 - DNA, 19 bp, Homo sapiens
gaggagccttgctgggcca

SEQ ID NO: 632255 - DNA, 20 bp, Homo sapiens
gaggagccttgctgggccag

SEQ ID NO: 632256 - DNA, 21 bp, Homo sapiens
gaggagccttgctgggccagg

SEQ ID NO: 632257 - DNA, 21 bp, Homo sapiens
gaggagcttccagtgcatgtt

SEQ ID NO: 632258 - DNA, 16 bp, Homo sapiens
gaggaggaggacacag

SEQ ID NO: 632259 - DNA, 15 bp, Homo sapiens
gaggaggaggagcct

SEQ ID NO: 632260 - DNA, 19 bp, Homo sapiens
gaggaggccgactgggctg

SEQ ID NO: 632261 - DNA, 21 bp, Homo sapiens
gaggaggccgactgggctgct

SEQ ID NO: 632262 - DNA, 20 bp, Homo sapiens
gaggaggtgtggagtggagg

SEQ ID NO: 632263 - DNA, 13 bp, Homo sapiens
gaggagtccaaaa

SEQ ID NO: 632264 - DNA, 18 bp, Homo sapiens
gaggatgtatgtgtatat

SEQ ID NO: 632265 - DNA, 15 bp, Homo sapiens
gaggcagaatggtgg

SEQ ID NO: 632266 - DNA, 23 bp, Homo sapiens
gaggcagaatggtgggctccaga

SEQ ID NO: 632267 - DNA, 12 bp, Homo sapiens
gaggcagggccc

SEQ ID NO: 632268 - DNA, 17 bp, Homo sapiens
gaggcagggccctgggg

SEQ ID NO: 632269 - DNA, 16 bp, Homo sapiens
gaggccccaggcccta

SEQ ID NO: 632270 - DNA, 18 bp, Homo sapiens
gaggcccctgtgcagtag

SEQ ID NO: 632271 - DNA, 23 bp, Homo sapiens
gaggccgactgggctgctggggc

SEQ ID NO: 632272 - DNA, 15 bp, Homo sapiens
gaggcctggtctgga

SEQ ID NO: 632273 - DNA, 12 bp, Homo sapiens
gaggcgcccacc

SEQ ID NO: 632274 - DNA, 15 bp, Homo sapiens
gaggcgcccacctgc

SEQ ID NO: 632275 - DNA, 17 bp, Homo sapiens
gaggcgcccacctgccc

SEQ ID NO: 632276 - DNA, 22 bp, Homo sapiens
gaggcgtgggatccagagagaa

SEQ ID NO: 632277 - DNA, 15 bp, Homo sapiens
gaggctgcctcagcc

SEQ ID NO: 632278 - DNA, 16 bp, Homo sapiens
gaggctgcctcagcca

SEQ ID NO: 632279 - DNA, 11 bp, Homo sapiens
gaggctgctgc

SEQ ID NO: 632280 - DNA, 13 bp, Homo sapiens
gaggctgctgccc

SEQ ID NO: 632281 - DNA, 14 bp, Homo sapiens
gaggctgctgcccc

SEQ ID NO: 632282 - DNA, 20 bp, Homo sapiens
gaggctggataggagaggaa

SEQ ID NO: 632283 - DNA, 23 bp, Homo sapiens
gagggaagcccacccgccccaga

SEQ ID NO: 632284 - DNA, 17 bp, Homo sapiens
gagggcagtggggagca

SEQ ID NO: 632285 - DNA, 18 bp, Homo sapiens
gagggcggcggggcctgg

SEQ ID NO: 632286 - DNA, 12 bp, Homo sapiens
gagggctgagcc

SEQ ID NO: 632287 - DNA, 17 bp, Homo sapiens
gagggctgagcccctcc

SEQ ID NO: 632288 - DNA, 20 bp, Homo sapiens
gagggctgagcccctcctct

SEQ ID NO: 632289 - DNA, 13 bp, Homo sapiens
gaggggacttgga

SEQ ID NO: 632290 - DNA, 15 bp, Homo sapiens
gaggggcttggagca

SEQ ID NO: 632291 - DNA, 16 bp, Homo sapiens
gagggtctccctgggc

SEQ ID NO: 632292 - DNA, 15 bp, Homo sapiens
gagggtgcccctggg

SEQ ID NO: 632293 - DNA, 17 bp, Homo sapiens
gagggtgcccctgggaa

SEQ ID NO: 632294 - DNA, 22 bp, Homo sapiens
gaggtcctgtcctggctcccag

SEQ ID NO: 632295 - DNA, 13 bp, Homo sapiens
gaggtttcagcat

SEQ ID NO: 632296 - DNA, 19 bp, Homo sapiens
gagtaaaacttgtattgga

SEQ ID NO: 632297 - DNA, 20 bp, Homo sapiens
gagtaaaacttgtattggaa

SEQ ID NO: 632298 - DNA, 21 bp, Homo sapiens
gagtagataagtgctcagtat

SEQ ID NO: 632299 - DNA, 20 bp, Homo sapiens
gagtcagtgcccatgtgtat

SEQ ID NO: 632300 - DNA, 20 bp, Homo sapiens
gagtccactttcctctctct

SEQ ID NO: 632301 - DNA, 21 bp, Homo sapiens
gagtcctcattgttcagaaaa

SEQ ID NO: 632302 - DNA, 20 bp, Homo sapiens
gagtcggctgggcagggccg

SEQ ID NO: 632303 - DNA, 15 bp, Homo sapiens
gagtctgaaggagag

SEQ ID NO: 632304 - DNA, 18 bp, Homo sapiens
gagtctgaaggagaggag

SEQ ID NO: 632305 - DNA, 12 bp, Homo sapiens
gagtctgtcctt

SEQ ID NO: 632306 - DNA, 14 bp, Homo sapiens
gagtgccctggggc

SEQ ID NO: 632307 - DNA, 18 bp, Homo sapiens
gagtggatctggagtctg

SEQ ID NO: 632308 - DNA, 14 bp, Homo sapiens
gagtggcaggtggg

SEQ ID NO: 632309 - DNA, 18 bp, Homo sapiens
gagtggcaggtgggctgc

SEQ ID NO: 632310 - DNA, 14 bp, Homo sapiens
gagtggctcgtgtt

SEQ ID NO: 632311 - DNA, 22 bp, Homo sapiens
gagtgggctgggccctctgtcc

SEQ ID NO: 632312 - DNA, 13 bp, Homo sapiens
gagtgtcaggctc

SEQ ID NO: 632313 - DNA, 12 bp, Homo sapiens
gagttctgcaca

SEQ ID NO: 632314 - DNA, 20 bp, Homo sapiens
gataaagaaaccttttaaaa

SEQ ID NO: 632315 - DNA, 17 bp, Homo sapiens
gataaatatcattatag

SEQ ID NO: 632316 - DNA, 18 bp, Homo sapiens
gataaatccaactctgac

SEQ ID NO: 632317 - DNA, 16 bp, Homo sapiens
gataaattttggaaga

SEQ ID NO: 632318 - DNA, 21 bp, Homo sapiens
gataatagctcacagcacatt

SEQ ID NO: 632319 - DNA, 16 bp, Homo sapiens
gataatgagatgtaat

SEQ ID NO: 632320 - DNA, 18 bp, Homo sapiens
gataatgagatgtaatac

SEQ ID NO: 632321 - DNA, 13 bp, Homo sapiens
gataattcttact

SEQ ID NO: 632322 - DNA, 12 bp, Homo sapiens
gataattttcat

SEQ ID NO: 632323 - DNA, 16 bp, Homo sapiens
gataccattttgaaat

SEQ ID NO: 632324 - DNA, 17 bp, Homo sapiens
gataccattttgaaata

SEQ ID NO: 632325 - DNA, 13 bp, Homo sapiens
gataccctctgag

SEQ ID NO: 632326 - DNA, 14 bp, Homo sapiens
gataccctctgaga

SEQ ID NO: 632327 - DNA, 16 bp, Homo sapiens
gataccctctgagaca

SEQ ID NO: 632328 - DNA, 22 bp, Homo sapiens
gataccctctgagacagagagc

SEQ ID NO: 632329 - DNA, 17 bp, Homo sapiens
gatacgatgactgacac

SEQ ID NO: 632330 - DNA, 18 bp, Homo sapiens
gatacgatgactgacact

SEQ ID NO: 632331 - DNA, 22 bp, Homo sapiens
gatacgggggttccctttcccc

SEQ ID NO: 632332 - DNA, 21 bp, Homo sapiens
gatactgaattgttatgtaaa

SEQ ID NO: 632333 - DNA, 23 bp, Homo sapiens
gatagaagaaggactgaagaaaa

SEQ ID NO: 632334 - DNA, 17 bp, Homo sapiens
gataggagcttccagat

SEQ ID NO: 632335 - DNA, 20 bp, Homo sapiens
gatgaaaaagcatgtacagt

SEQ ID NO: 632336 - DNA, 19 bp, Homo sapiens
gatgaagaccctatctccc

SEQ ID NO: 632337 - DNA, 14 bp, Homo sapiens
gatgaataaaatgt

SEQ ID NO: 632338 - DNA, 16 bp, Homo sapiens
gatgagaggaaatcac

SEQ ID NO: 632339 - DNA, 15 bp, Homo sapiens
gatgatgttctgaaa

SEQ ID NO: 632340 - DNA, 22 bp, Homo sapiens
gatgattcaatcattttgggaa

SEQ ID NO: 632341 - DNA, 15 bp, Homo sapiens
gatgatttaattctt

SEQ ID NO: 632342 - DNA, 12 bp, Homo sapiens
gatgatttcaga

SEQ ID NO: 632343 - DNA, 13 bp, Homo sapiens
gatgcagaaatga

SEQ ID NO: 632344 - DNA, 20 bp, Homo sapiens
gatgcatattaaagaaagtc

SEQ ID NO: 632345 - DNA, 12 bp, Homo sapiens
gatgcatgcagg

SEQ ID NO: 632346 - DNA, 22 bp, Homo sapiens
gatgcccctgcagtttggccct

SEQ ID NO: 632347 - DNA, 16 bp, Homo sapiens
gatgcttacagtgact

SEQ ID NO: 632348 - DNA, 14 bp, Homo sapiens
gatggaatcacagc

SEQ ID NO: 632349 - DNA, 17 bp, Homo sapiens
gatggaatcacagccaa

SEQ ID NO: 632350 - DNA, 18 bp, Homo sapiens
gatggaatcacagccaat

SEQ ID NO: 632351 - DNA, 14 bp, Homo sapiens
gatggggagggcgc

SEQ ID NO: 632352 - DNA, 16 bp, Homo sapiens
gatgggtcctgctgct

SEQ ID NO: 632353 - DNA, 22 bp, Homo sapiens
gatgggttttgttaggggtggg

SEQ ID NO: 632354 - DNA, 14 bp, Homo sapiens
gatgtattattata

SEQ ID NO: 632355 - DNA, 17 bp, Homo sapiens
gatgtgatttatgcatt

SEQ ID NO: 632356 - DNA, 20 bp, Homo sapiens
gatgtgcacggcagcttgag

SEQ ID NO: 632357 - DNA, 22 bp, Homo sapiens
gatgttattactgttttgggcc

SEQ ID NO: 632358 - DNA, 23 bp, Homo sapiens
gatgttattactgttttgggcct

SEQ ID NO: 632359 - DNA, 19 bp, Homo sapiens
gatgtttctatatgtaact

SEQ ID NO: 632360 - DNA, 14 bp, Homo sapiens
gattaaactgggaa

SEQ ID NO: 632361 - DNA, 16 bp, Homo sapiens
gattaaactgggaaat

SEQ ID NO: 632362 - DNA, 18 bp, Homo sapiens
gattaataacagaaatac

SEQ ID NO: 632363 - DNA, 19 bp, Homo sapiens
gattaataacagaaataca

SEQ ID NO: 632364 - DNA, 13 bp, Homo sapiens
gattacagaaaca

SEQ ID NO: 632365 - DNA, 14 bp, Homo sapiens
gattacagaaacac

SEQ ID NO: 632366 - DNA, 16 bp, Homo sapiens
gattagacaatgtgga

SEQ ID NO: 632367 - DNA, 13 bp, Homo sapiens
gattattacaaca

SEQ ID NO: 632368 - DNA, 17 bp, Homo sapiens
gattcaaataaccctga

SEQ ID NO: 632369 - DNA, 21 bp, Homo sapiens
gattcaaataaccctgaatca

SEQ ID NO: 632370 - DNA, 13 bp, Homo sapiens
gattcaacatcaa

SEQ ID NO: 632371 - DNA, 18 bp, Homo sapiens
gattcaatcgactgggtt

SEQ ID NO: 632372 - DNA, 11 bp, Homo sapiens
gattcaatgtg

SEQ ID NO: 632373 - DNA, 15 bp, Homo sapiens
gattcctacttaaac

SEQ ID NO: 632374 - DNA, 17 bp, Homo sapiens
gattcctacttaaacaa

SEQ ID NO: 632375 - DNA, 18 bp, Homo sapiens
gattcctcccccagagcc

SEQ ID NO: 632376 - DNA, 18 bp, Homo sapiens
gattcctcccctggaagt

SEQ ID NO: 632377 - DNA, 23 bp, Homo sapiens
gattctttcaatccacagtattg

SEQ ID NO: 632378 - DNA, 17 bp, Homo sapiens
gattgggggggcttggg

SEQ ID NO: 632379 - DNA, 14 bp, Homo sapiens
gattggtaccagag

SEQ ID NO: 632380 - DNA, 11 bp, Homo sapiens
gatttcactct

SEQ ID NO: 632381 - DNA, 12 bp, Homo sapiens
gatttcactctc

SEQ ID NO: 632382 - DNA, 13 bp, Homo sapiens
gatttcactctcc

SEQ ID NO: 632383 - DNA, 15 bp, Homo sapiens
gatttcatgattaga

SEQ ID NO: 632384 - DNA, 19 bp, Homo sapiens
gatttcatgattagacaat

SEQ ID NO: 632385 - DNA, 20 bp, Homo sapiens
gatttgatatacagacctcc

SEQ ID NO: 632386 - DNA, 17 bp, Homo sapiens
gatttgcaacactgcca

SEQ ID NO: 632387 - DNA, 20 bp, Homo sapiens
gatttggagactttgttcct

SEQ ID NO: 632388 - DNA, 13 bp, Homo sapiens
gattttaaacaaa

SEQ ID NO: 632389 - DNA, 19 bp, Homo sapiens
gattttaaacaaaatttat

SEQ ID NO: 632390 - DNA, 21 bp, Homo sapiens
gattttatgtttaaaatggca

SEQ ID NO: 632391 - DNA, 23 bp, Homo sapiens
gattttatgtttaaaatggcatt

SEQ ID NO: 632392 - DNA, 15 bp, Homo sapiens
gattttcatgttctt

SEQ ID NO: 632393 - DNA, 13 bp, Homo sapiens
gattttgttttgc

SEQ ID NO: 632394 - DNA, 16 bp, Homo sapiens
gatttttttttccttc

SEQ ID NO: 632395 - DNA, 18 bp, Homo sapiens
gatttttttttccttcag

SEQ ID NO: 632396 - DNA, 21 bp, Homo sapiens
gatttttttttccttcagtgc

SEQ ID NO: 632397 - DNA, 18 bp, Homo sapiens
gcaaaaactgtactgtgt

SEQ ID NO: 632398 - DNA, 21 bp, Homo sapiens
gcaaaatatatgtttggctga

SEQ ID NO: 632399 - DNA, 17 bp, Homo sapiens
gcaaaattacagttcac

SEQ ID NO: 632400 - DNA, 20 bp, Homo sapiens
gcaaaattacagttcacact

SEQ ID NO: 632401 - DNA, 18 bp, Homo sapiens
gcaaacaactttctggaa

SEQ ID NO: 632402 - DNA, 21 bp, Homo sapiens
gcaaacacacagactctgtga

SEQ ID NO: 632403 - DNA, 19 bp, Homo sapiens
gcaaaccaatttgttctgt

SEQ ID NO: 632404 - DNA, 17 bp, Homo sapiens
gcaaaccatcattgaaa

SEQ ID NO: 632405 - DNA, 21 bp, Homo sapiens
gcaaaccatcattgaaatctt

SEQ ID NO: 632406 - DNA, 19 bp, Homo sapiens
gcaaactgaaattagtgtt

SEQ ID NO: 632407 - DNA, 15 bp, Homo sapiens
gcaaaggtgcctcat

SEQ ID NO: 632408 - DNA, 18 bp, Homo sapiens
gcaaagtgttgtcttatt

SEQ ID NO: 632409 - DNA, 14 bp, Homo sapiens
gcaaagttttcaga

SEQ ID NO: 632410 - DNA, 17 bp, Homo sapiens
gcaacaacaacagaaca

SEQ ID NO: 632411 - DNA, 11 bp, Homo sapiens
gcaacactgga

SEQ ID NO: 632412 - DNA, 16 bp, Homo sapiens
gcaaccagagcactgt

SEQ ID NO: 632413 - DNA, 17 bp, Homo sapiens
gcaaccagagcactgta

SEQ ID NO: 632414 - DNA, 18 bp, Homo sapiens
gcaaccagagcactgtat

SEQ ID NO: 632415 - DNA, 14 bp, Homo sapiens
gcaaccttgtactt

SEQ ID NO: 632416 - DNA, 16 bp, Homo sapiens
gcaaccttgtacttta

SEQ ID NO: 632417 - DNA, 19 bp, Homo sapiens
gcaacttgaaattatatct

SEQ ID NO: 632418 - DNA, 16 bp, Homo sapiens
gcaacttgagggacga

SEQ ID NO: 632419 - DNA, 16 bp, Homo sapiens
gcaagagctcaggaga

SEQ ID NO: 632420 - DNA, 16 bp, Homo sapiens
gcaagaggtttcagca

SEQ ID NO: 632421 - DNA, 17 bp, Homo sapiens
gcaagctcatagcacat

SEQ ID NO: 632422 - DNA, 21 bp, Homo sapiens
gcaaggaagctttggaagcag

SEQ ID NO: 632423 - DNA, 22 bp, Homo sapiens
gcaaggaagctttggaagcagc

SEQ ID NO: 632424 - DNA, 15 bp, Homo sapiens
gcaataaactcagtc

SEQ ID NO: 632425 - DNA, 14 bp, Homo sapiens
gcaataacagtttt

SEQ ID NO: 632426 - DNA, 14 bp, Homo sapiens
gcaataagttgaat

SEQ ID NO: 632427 - DNA, 17 bp, Homo sapiens
gcaataagttgaatgat

SEQ ID NO: 632428 - DNA, 13 bp, Homo sapiens
gcaatgacctttc

SEQ ID NO: 632429 - DNA, 17 bp, Homo sapiens
gcaatgacctttcaata

SEQ ID NO: 632430 - DNA, 22 bp, Homo sapiens
gcaatgacctttcaataggaaa

SEQ ID NO: 632431 - DNA, 22 bp, Homo sapiens
gcaatgttccgttcatctgagg

SEQ ID NO: 632432 - DNA, 16 bp, Homo sapiens
gcaatttacttggaat

SEQ ID NO: 632433 - DNA, 15 bp, Homo sapiens
gcacaaaaaatttaa

SEQ ID NO: 632434 - DNA, 16 bp, Homo sapiens
gcacacacatctggcc

SEQ ID NO: 632435 - DNA, 17 bp, Homo sapiens
gcacacacatctggccc

SEQ ID NO: 632436 - DNA, 19 bp, Homo sapiens
gcacacacatctggccctg

SEQ ID NO: 632437 - DNA, 21 bp, Homo sapiens
gcacacacatctggccctgac

SEQ ID NO: 632438 - DNA, 14 bp, Homo sapiens
gcacacataacaca

SEQ ID NO: 632439 - DNA, 16 bp, Homo sapiens
gcacagtatttaacat

SEQ ID NO: 632440 - DNA, 14 bp, Homo sapiens
gcacatccaactac

SEQ ID NO: 632441 - DNA, 23 bp, Homo sapiens
gcacatgttttacaaagaaacaa

SEQ ID NO: 632442 - DNA, 18 bp, Homo sapiens
gcacattgcccatggctg

SEQ ID NO: 632443 - DNA, 22 bp, Homo sapiens
gcacattgcccatggctgggaa

SEQ ID NO: 632444 - DNA, 19 bp, Homo sapiens
gcacatttgttaatgattc

SEQ ID NO: 632445 - DNA, 17 bp, Homo sapiens
gcaccacaggctgcctc

SEQ ID NO: 632446 - DNA, 14 bp, Homo sapiens
gcaccagcctgagc

SEQ ID NO: 632447 - DNA, 17 bp, Homo sapiens
gcaccagcctgagccac

SEQ ID NO: 632448 - DNA, 20 bp, Homo sapiens
gcaccagtgccgcctgtgcc

SEQ ID NO: 632449 - DNA, 14 bp, Homo sapiens
gcaccatgctgggc

SEQ ID NO: 632450 - DNA, 20 bp, Homo sapiens
gcaccatgctgggccggggt

SEQ ID NO: 632451 - DNA, 16 bp, Homo sapiens
gcacccccagcctccc

SEQ ID NO: 632452 - DNA, 19 bp, Homo sapiens
gcacccccagcctccccca

SEQ ID NO: 632453 - DNA, 22 bp, Homo sapiens
gcacccccagcctcccccaggc

SEQ ID NO: 632454 - DNA, 17 bp, Homo sapiens
ctttccctgcatccctt

SEQ ID NO: 632455 - DNA, 12 bp, Homo sapiens
ctttcctctctc

SEQ ID NO: 632456 - DNA, 19 bp, Homo sapiens
ctttcctgggggatgtgca

SEQ ID NO: 632457 - DNA, 23 bp, Homo sapiens
ctttctccaaagttatccagagg

SEQ ID NO: 632458 - DNA, 18 bp, Homo sapiens
gcaccctccacaggagcc

SEQ ID NO: 632459 - DNA, 22 bp, Homo sapiens
gcaccctctgctatgtctgtga

SEQ ID NO: 632460 - DNA, 13 bp, Homo sapiens
gcaccctgcaggc

SEQ ID NO: 632461 - DNA, 15 bp, Homo sapiens
gcaccctgcaggcag

SEQ ID NO: 632462 - DNA, 16 bp, Homo sapiens
gcaccctgttccctct

SEQ ID NO: 632463 - DNA, 13 bp, Homo sapiens
gcaccgcccaccc

SEQ ID NO: 632464 - DNA, 14 bp, Homo sapiens
gcaccgcccaccca

SEQ ID NO: 632465 - DNA, 20 bp, Homo sapiens
gcaccggacgctggagaccc

SEQ ID NO: 632466 - DNA, 17 bp, Homo sapiens
gcaccgtggtgtgaggc

SEQ ID NO: 632467 - DNA, 19 bp, Homo sapiens
gcacctccgggactgacct

SEQ ID NO: 632468 - DNA, 18 bp, Homo sapiens
gcacctcctccgtgggca

SEQ ID NO: 632469 - DNA, 22 bp, Homo sapiens
gcacctcctccgtgggcagctc

SEQ ID NO: 632470 - DNA, 12 bp, Homo sapiens
gcacctgcttct

SEQ ID NO: 632471 - DNA, 18 bp, Homo sapiens
gcaccttgggcacgggag

SEQ ID NO: 632472 - DNA, 15 bp, Homo sapiens
gcacgcctgccttct

SEQ ID NO: 632473 - DNA, 18 bp, Homo sapiens
gcacgcggccgctctccg

SEQ ID NO: 632474 - DNA, 20 bp, Homo sapiens
gcacgcggccgctctccgcc

SEQ ID NO: 632475 - DNA, 15 bp, Homo sapiens
gcactagaatgagaa

SEQ ID NO: 632476 - DNA, 17 bp, Homo sapiens
gcactagaatgagaaat

SEQ ID NO: 632477 - DNA, 19 bp, Homo sapiens
gcactagaatgagaaatca

SEQ ID NO: 632478 - DNA, 17 bp, Homo sapiens
gcactatctttcaggaa

SEQ ID NO: 632479 - DNA, 20 bp, Homo sapiens
gcactcaggagcacagccat

SEQ ID NO: 632480 - DNA, 21 bp, Homo sapiens
gcactcaggagcacagccata

SEQ ID NO: 632481 - DNA, 15 bp, Homo sapiens
gcactcccagggccc

SEQ ID NO: 632482 - DNA, 16 bp, Homo sapiens
gcactcccagggcccg

SEQ ID NO: 632483 - DNA, 23 bp, Homo sapiens
gcactctactctgcgacgatccc

SEQ ID NO: 632484 - DNA, 11 bp, Homo sapiens
gcactgccctc

SEQ ID NO: 632485 - DNA, 15 bp, Homo sapiens
gcactgccctccgcc

SEQ ID NO: 632486 - DNA, 20 bp, Homo sapiens
gcactgccctccgcccttcc

SEQ ID NO: 632487 - DNA, 17 bp, Homo sapiens
gcactttataagccaat

SEQ ID NO: 632488 - DNA, 17 bp, Homo sapiens
gcactttgggaggctga

SEQ ID NO: 632489 - DNA, 14 bp, Homo sapiens
gcagaaaacattgt

SEQ ID NO: 632490 - DNA, 17 bp, Homo sapiens
gcagaatgagatgattt

SEQ ID NO: 632491 - DNA, 13 bp, Homo sapiens
gcagacacacaca

SEQ ID NO: 632492 - DNA, 17 bp, Homo sapiens
gcagacagacagacaga

SEQ ID NO: 632493 - DNA, 12 bp, Homo sapiens
gcagacattgtc

SEQ ID NO: 632494 - DNA, 22 bp, Homo sapiens
gcagaccacactctgcctggcc

SEQ ID NO: 632495 - DNA, 23 bp, Homo sapiens
gcagactgtggctgcagagacct

SEQ ID NO: 632496 - DNA, 22 bp, Homo sapiens
gcagacttgagtctgaggcccc

SEQ ID NO: 632497 - DNA, 14 bp, Homo sapiens
gcagagacggcagc

SEQ ID NO: 632498 - DNA, 16 bp, Homo sapiens
gcagagacggcagccc

SEQ ID NO: 632499 - DNA, 19 bp, Homo sapiens
gcagagacggcagccccat

SEQ ID NO: 632500 - DNA, 21 bp, Homo sapiens
gcagagattgggggggcttgg

SEQ ID NO: 632501 - DNA, 15 bp, Homo sapiens
gcagagccccggagc

SEQ ID NO: 632502 - DNA, 18 bp, Homo sapiens
gcagagccccggagcacc

SEQ ID NO: 632503 - DNA, 13 bp, Homo sapiens
gcagagcgcagcc

SEQ ID NO: 632504 - DNA, 18 bp, Homo sapiens
gcagagcgcagcccccac

SEQ ID NO: 632505 - DNA, 13 bp, Homo sapiens
gcagagctgagtc

SEQ ID NO: 632506 - DNA, 14 bp, Homo sapiens
gcagaggcagggcc

SEQ ID NO: 632507 - DNA, 22 bp, Homo sapiens
gcagagtcaagctgatgaagtt

SEQ ID NO: 632508 - DNA, 19 bp, Homo sapiens
gcagattaataacagaaat

SEQ ID NO: 632509 - DNA, 14 bp, Homo sapiens
ttatagagttcata

SEQ ID NO: 632510 - DNA, 20 bp, Homo sapiens
ttataggaaataaatctaaa

SEQ ID NO: 632511 - DNA, 21 bp, Homo sapiens
ttataggaaataaatctaaat

SEQ ID NO: 632512 - DNA, 15 bp, Homo sapiens
ttatagtctgtactt

SEQ ID NO: 632513 - DNA, 15 bp, Homo sapiens
ttatatacaaagctg

SEQ ID NO: 632514 - DNA, 22 bp, Homo sapiens
ttatatcagactgctttgagaa

SEQ ID NO: 632515 - DNA, 18 bp, Homo sapiens
ttatattcccaaatctca

SEQ ID NO: 632516 - DNA, 21 bp, Homo sapiens
ttatattctgcagaaaattaa

SEQ ID NO: 632517 - DNA, 12 bp, Homo sapiens
ttatcaaaaaac

SEQ ID NO: 632518 - DNA, 21 bp, Homo sapiens
ttatcaaaaaacagaaaaaca

SEQ ID NO: 632519 - DNA, 20 bp, Homo sapiens
ttatcagaaagatcaaatta

SEQ ID NO: 632520 - DNA, 20 bp, Homo sapiens
ttatcagaactcctttctaa

SEQ ID NO: 632521 - DNA, 22 bp, Homo sapiens
ttatcagggcccaaataacagt

SEQ ID NO: 632522 - DNA, 21 bp, Homo sapiens
ttatctagaaattaagattga

SEQ ID NO: 632523 - DNA, 23 bp, Homo sapiens
ttatctagaaattaagattgaag

SEQ ID NO: 632524 - DNA, 21 bp, Homo sapiens
ttatctagcatagcacaaacg

SEQ ID NO: 632525 - DNA, 20 bp, Homo sapiens
ttatctagtaggtctgcaca

SEQ ID NO: 632526 - DNA, 23 bp, Homo sapiens
ttatctagtaggtctgcacacat

SEQ ID NO: 632527 - DNA, 20 bp, Homo sapiens
ttatctccagccaatttcaa

SEQ ID NO: 632528 - DNA, 23 bp, Homo sapiens
ttatctccagccaatttcaaaga

SEQ ID NO: 632529 - DNA, 16 bp, Homo sapiens
ttatctgtctttatga

SEQ ID NO: 632530 - DNA, 13 bp, Homo sapiens
ttatcttaaaagg

SEQ ID NO: 632531 - DNA, 14 bp, Homo sapiens
ttatcttaaaccca

SEQ ID NO: 632532 - DNA, 20 bp, Homo sapiens
ttatgagacttcctattaat

SEQ ID NO: 632533 - DNA, 14 bp, Homo sapiens
ttatgatttcatga

SEQ ID NO: 632534 - DNA, 17 bp, Homo sapiens
ttatgcaggcagattaa

SEQ ID NO: 632535 - DNA, 21 bp, Homo sapiens
ttatgcaggcagattaataac

SEQ ID NO: 632536 - DNA, 19 bp, Homo sapiens
ttatgcatgagaactaaat

SEQ ID NO: 632537 - DNA, 16 bp, Homo sapiens
ttatggaacactctga

SEQ ID NO: 632538 - DNA, 17 bp, Homo sapiens
ttatggaacactctgag

SEQ ID NO: 632539 - DNA, 17 bp, Homo sapiens
ttatgtacaaaatgaat

SEQ ID NO: 632540 - DNA, 14 bp, Homo sapiens
ttatgtcattttca

SEQ ID NO: 632541 - DNA, 22 bp, Homo sapiens
ttatgtcccttcacatagtttt

SEQ ID NO: 632542 - DNA, 13 bp, Homo sapiens
ttatgttgtaata

SEQ ID NO: 632543 - DNA, 13 bp, Homo sapiens
ttattaaaatatt

SEQ ID NO: 632544 - DNA, 22 bp, Homo sapiens
ttattaaaatattttcttaatt

SEQ ID NO: 632545 - DNA, 18 bp, Homo sapiens
ttattaaatttattaaat

SEQ ID NO: 632546 - DNA, 22 bp, Homo sapiens
ttattacaacaagcaaactgaa

SEQ ID NO: 632547 - DNA, 19 bp, Homo sapiens
ttattattttcatataatt

SEQ ID NO: 632548 - DNA, 17 bp, Homo sapiens
ttattcattagctgtga

SEQ ID NO: 632549 - DNA, 18 bp, Homo sapiens
ttattcctaattcctgta

SEQ ID NO: 632550 - DNA, 21 bp, Homo sapiens
ttattcctaattcctgtatgt

SEQ ID NO: 632551 - DNA, 16 bp, Homo sapiens
ttatttaaatgtctaa

SEQ ID NO: 632552 - DNA, 21 bp, Homo sapiens
ttatttactcctcctgctcct

SEQ ID NO: 632553 - DNA, 15 bp, Homo sapiens
ttatttctaaaacat

SEQ ID NO: 632554 - DNA, 18 bp, Homo sapiens
ttatttgctcataagtaa

SEQ ID NO: 632555 - DNA, 13 bp, Homo sapiens
ttattttctatat

SEQ ID NO: 632556 - DNA, 18 bp, Homo sapiens
ttcaaagacttcatttaa

SEQ ID NO: 632557 - DNA, 15 bp, Homo sapiens
ttcaaataaccctga

SEQ ID NO: 632558 - DNA, 22 bp, Homo sapiens
ttcaaatgtcatttcatacaaa

SEQ ID NO: 632559 - DNA, 20 bp, Homo sapiens
ttcaaccacacctaaattaa

SEQ ID NO: 632560 - DNA, 16 bp, Homo sapiens
ttcaacttcaggaaag

SEQ ID NO: 632561 - DNA, 21 bp, Homo sapiens
ttcaagctttttgtgagaaag

SEQ ID NO: 632562 - DNA, 15 bp, Homo sapiens
ttcaaggatcctgag

SEQ ID NO: 632563 - DNA, 21 bp, Homo sapiens
ttcaagtaagatcaagaatct

SEQ ID NO: 632564 - DNA, 14 bp, Homo sapiens
ttcaagtgttacct

SEQ ID NO: 632565 - DNA, 16 bp, Homo sapiens
ttcaatccacagtatt

SEQ ID NO: 632566 - DNA, 17 bp, Homo sapiens
ttcaatgttaaatctac

SEQ ID NO: 632567 - DNA, 15 bp, Homo sapiens
ttcacaactttgctt

SEQ ID NO: 632568 - DNA, 21 bp, Homo sapiens
ttcacacaactgtggataaat

SEQ ID NO: 632569 - DNA, 14 bp, Homo sapiens
ttcacaccttacaa

SEQ ID NO: 632570 - DNA, 22 bp, Homo sapiens
ttcacaccttacaaagccagct

SEQ ID NO: 632571 - DNA, 14 bp, Homo sapiens
ttcacatgaacata

SEQ ID NO: 632572 - DNA, 17 bp, Homo sapiens
ttcaccttctgtgcatc

SEQ ID NO: 632573 - DNA, 21 bp, Homo sapiens
ttcaccttctgtgcatctggc

SEQ ID NO: 632574 - DNA, 16 bp, Homo sapiens
ttcacgcaacttgaaa

SEQ ID NO: 632575 - DNA, 13 bp, Homo sapiens
ttcactctccttg

SEQ ID NO: 632576 - DNA, 19 bp, Homo sapiens
ttcagaaagggcagcccct

SEQ ID NO: 632577 - DNA, 20 bp, Homo sapiens
ttcagaaagggcagcccctc

SEQ ID NO: 632578 - DNA, 15 bp, Homo sapiens
ttcagactctctcct

SEQ ID NO: 632579 - DNA, 24 bp, Homo sapiens
ttcagactctctcctctctctccc

SEQ ID NO: 632580 - DNA, 19 bp, Homo sapiens
ttcagatccttccaaactc

SEQ ID NO: 632581 - DNA, 13 bp, Homo sapiens
ttcagatgtttcc

SEQ ID NO: 632582 - DNA, 14 bp, Homo sapiens
ttcagattgtaaag

SEQ ID NO: 632583 - DNA, 19 bp, Homo sapiens
ttcaggaaagcagcagttt

SEQ ID NO: 632584 - DNA, 23 bp, Homo sapiens
ttcaggtgtatagggaattttca

SEQ ID NO: 632585 - DNA, 20 bp, Homo sapiens
ttcagtcacttgtttgtgtt

SEQ ID NO: 632586 - DNA, 14 bp, Homo sapiens
ttcagtctatgctg

SEQ ID NO: 632587 - DNA, 24 bp, Homo sapiens
ttcagtggcacgtcatctagtttt

SEQ ID NO: 632588 - DNA, 13 bp, Homo sapiens
ttcagttctcatc

SEQ ID NO: 632589 - DNA, 14 bp, Homo sapiens
ttcataagccaatt

SEQ ID NO: 632590 - DNA, 12 bp, Homo sapiens
ttcatagaaata

SEQ ID NO: 632591 - DNA, 23 bp, Homo sapiens
ttcatagataccattttgaaata

SEQ ID NO: 632592 - DNA, 23 bp, Homo sapiens
ttcatataataaattaatttttc

SEQ ID NO: 632593 - DNA, 16 bp, Homo sapiens
ttcatccaactggaag

SEQ ID NO: 632594 - DNA, 20 bp, Homo sapiens
ttcatctcaggtggcatttg

SEQ ID NO: 632595 - DNA, 21 bp, Homo sapiens
ttcatctgaggagtccaaaat

SEQ ID NO: 632596 - DNA, 15 bp, Homo sapiens
ttcatgaccttacat

SEQ ID NO: 632597 - DNA, 15 bp, Homo sapiens
ttcatgatgctagtt

SEQ ID NO: 632598 - DNA, 16 bp, Homo sapiens
ttcatgattagacaat

SEQ ID NO: 632599 - DNA, 16 bp, Homo sapiens
ttcatgctttctcctt

SEQ ID NO: 632600 - DNA, 16 bp, Homo sapiens
ttcatgtttaagaaat

SEQ ID NO: 632601 - DNA, 15 bp, Homo sapiens
ttcattgcactgcag

SEQ ID NO: 632602 - DNA, 21 bp, Homo sapiens
ttcatttacaacttccagatt

SEQ ID NO: 632603 - DNA, 13 bp, Homo sapiens
ttcattttcatct

SEQ ID NO: 632604 - DNA, 18 bp, Homo sapiens
ttccaagtgtgtgtgcaa

SEQ ID NO: 632605 - DNA, 21 bp, Homo sapiens
ttccaagtgtgtgtgcaatgt

SEQ ID NO: 632606 - DNA, 19 bp, Homo sapiens
ttccaatgccaattcatct

SEQ ID NO: 632607 - DNA, 22 bp, Homo sapiens
ttccaatgccaattcatctcag

SEQ ID NO: 632608 - DNA, 12 bp, Homo sapiens
ttccagaattga

SEQ ID NO: 632609 - DNA, 22 bp, Homo sapiens
ttccataaagaagatgtttaac

SEQ ID NO: 632610 - DNA, 21 bp, Homo sapiens
ttccatcttgtggggccagga

SEQ ID NO: 632611 - DNA, 18 bp, Homo sapiens
ttccatgacagtagcata

SEQ ID NO: 632612 - DNA, 16 bp, Homo sapiens
ttccatggcacactgc

SEQ ID NO: 632613 - DNA, 12 bp, Homo sapiens
ttccattctatg

SEQ ID NO: 632614 - DNA, 15 bp, Homo sapiens
ttcccaaatctcaaa

SEQ ID NO: 632615 - DNA, 16 bp, Homo sapiens
ttcccaacctcccctg

SEQ ID NO: 632616 - DNA, 16 bp, Homo sapiens
ttcccaagtcctcgcc

SEQ ID NO: 632617 - DNA, 14 bp, Homo sapiens
ttcccaattatcaa

SEQ ID NO: 632618 - DNA, 19 bp, Homo sapiens
ttcccactaagctttctcc

SEQ ID NO: 632619 - DNA, 22 bp, Homo sapiens
ttcccagctggcagcgcctccc

SEQ ID NO: 632620 - DNA, 19 bp, Homo sapiens
ttcccatttccttgtctaa

SEQ ID NO: 632621 - DNA, 12 bp, Homo sapiens
ttccccactccc

SEQ ID NO: 632622 - DNA, 11 bp, Homo sapiens
ttccccagtgt

SEQ ID NO: 632623 - DNA, 22 bp, Homo sapiens
ttccccagtgtggccccagccc

SEQ ID NO: 632624 - DNA, 23 bp, Homo sapiens
ttccccagtgtggccccagcccg

SEQ ID NO: 632625 - DNA, 21 bp, Homo sapiens
ttccccatcgccttctgggga

SEQ ID NO: 632626 - DNA, 17 bp, Homo sapiens
ttccccattcagtgaca

SEQ ID NO: 632627 - DNA, 19 bp, Homo sapiens
ttccccattgccttctggg

SEQ ID NO: 632628 - DNA, 18 bp, Homo sapiens
ttcccccagggtcccctg

SEQ ID NO: 632629 - DNA, 10 bp, Homo sapiens
ttcccccttc

SEQ ID NO: 632630 - DNA, 11 bp, Homo sapiens
ttcccccttcc

SEQ ID NO: 632631 - DNA, 16 bp, Homo sapiens
ttcccccttcccctgc

SEQ ID NO: 632632 - DNA, 12 bp, Homo sapiens
ttcccctttcct

SEQ ID NO: 632633 - DNA, 17 bp, Homo sapiens
ttccctagttctttgca

SEQ ID NO: 632634 - DNA, 15 bp, Homo sapiens
ttccctgaacactca

SEQ ID NO: 632635 - DNA, 12 bp, Homo sapiens
ttccctgaggaa

SEQ ID NO: 632636 - DNA, 16 bp, Homo sapiens
ttccctgcatcccttg

SEQ ID NO: 632637 - DNA, 21 bp, Homo sapiens
ttccctgcgcgcagctggcgc

SEQ ID NO: 632638 - DNA, 12 bp, Homo sapiens
ttccctttcccc

SEQ ID NO: 632639 - DNA, 16 bp, Homo sapiens
ttcctacttaaacaaa

SEQ ID NO: 632640 - DNA, 11 bp, Homo sapiens
ttcctcatggc

SEQ ID NO: 632641 - DNA, 23 bp, Homo sapiens
ttcctcccctggaagttgtcctt

SEQ ID NO: 632642 - DNA, 13 bp, Homo sapiens
ttcctctcctctc

SEQ ID NO: 632643 - DNA, 17 bp, Homo sapiens
ttcctctcctctctgga

SEQ ID NO: 632644 - DNA, 23 bp, Homo sapiens
ttcctcttggtgtcaaattttta

SEQ ID NO: 632645 - DNA, 12 bp, Homo sapiens
ttcctgaccctc

SEQ ID NO: 632646 - DNA, 17 bp, Homo sapiens
ttcctgaccctcacttt

SEQ ID NO: 632647 - DNA, 21 bp, Homo sapiens
ttcctgtcctgctcacgtctg

SEQ ID NO: 632648 - DNA, 14 bp, Homo sapiens
ttccttaacagctg

SEQ ID NO: 632649 - DNA, 21 bp, Homo sapiens
ttccttaacagctgtattatc

SEQ ID NO: 632650 - DNA, 11 bp, Homo sapiens
ttccttcagtg

SEQ ID NO: 632651 - DNA, 14 bp, Homo sapiens
ttccttcagtgcct

SEQ ID NO: 632652 - DNA, 23 bp, Homo sapiens
ttccttcagtgccttatggaaca

SEQ ID NO: 632653 - DNA, 10 bp, Homo sapiens
ttccttcctt

SEQ ID NO: 632654 - DNA, 11 bp, Homo sapiens
ttccttccttt

SEQ ID NO: 632655 - DNA, 15 bp, Homo sapiens
ttccttgtctaaaga

SEQ ID NO: 632656 - DNA, 15 bp, Homo sapiens
ttcctttcttccttc

SEQ ID NO: 632657 - DNA, 16 bp, Homo sapiens
ttcctttgacctctca

SEQ ID NO: 632658 - DNA, 15 bp, Homo sapiens
ttccttttttataca

SEQ ID NO: 632659 - DNA, 17 bp, Homo sapiens
ttcgagcaaacaacttt

SEQ ID NO: 632660 - DNA, 23 bp, Homo sapiens
ttcgagcaaacaactttctggaa

SEQ ID NO: 632661 - DNA, 22 bp, Homo sapiens
ttcgatcgtttcacatctgtat

SEQ ID NO: 632662 - DNA, 23 bp, Homo sapiens
ttcgatcgtttcacatctgtata

SEQ ID NO: 632663 - DNA, 14 bp, Homo sapiens
ttcggataattttc

SEQ ID NO: 632664 - DNA, 17 bp, Homo sapiens
ttcggataattttcatt

SEQ ID NO: 632665 - DNA, 19 bp, Homo sapiens
ttcggataattttcatttt

SEQ ID NO: 632666 - DNA, 13 bp, Homo sapiens
ttcgtaagttctg

SEQ ID NO: 632667 - DNA, 17 bp, Homo sapiens
ttcgtaagttctgtgca

SEQ ID NO: 632668 - DNA, 18 bp, Homo sapiens
ttcgtaagttctgtgcag

SEQ ID NO: 632669 - DNA, 23 bp, Homo sapiens
ttcgtccttagaatactgtattg

SEQ ID NO: 632670 - DNA, 18 bp, Homo sapiens
ttcgtgggcctgctgctc

SEQ ID NO: 632671 - DNA, 19 bp, Homo sapiens
ttctaaaactaaatagcat

SEQ ID NO: 632672 - DNA, 22 bp, Homo sapiens
ttctaaaactaaatagcatgta

SEQ ID NO: 632673 - DNA, 15 bp, Homo sapiens
ttctaaaccatgaaa

SEQ ID NO: 632674 - DNA, 18 bp, Homo sapiens
ttctaaaggtttcactgt

SEQ ID NO: 632675 - DNA, 21 bp, Homo sapiens
ttctacaatacaacacattga

SEQ ID NO: 632676 - DNA, 18 bp, Homo sapiens
ttctactgttcaatttca

SEQ ID NO: 632677 - DNA, 20 bp, Homo sapiens
ttctacttcttgtgctttac

SEQ ID NO: 632678 - DNA, 16 bp, Homo sapiens
ttctagatatgagaaa

SEQ ID NO: 632679 - DNA, 23 bp, Homo sapiens
tttctgctgaattttcacatgaa

SEQ ID NO: 632680 - DNA, 10 bp, Homo sapiens
tttctgctta

SEQ ID NO: 632681 - DNA, 20 bp, Homo sapiens
tttctggtggcaaatgaatt

SEQ ID NO: 632682 - DNA, 19 bp, Homo sapiens
tttctgtaattcttctcct

SEQ ID NO: 632683 - DNA, 19 bp, Homo sapiens
tttctgttggtcttaacta

SEQ ID NO: 632684 - DNA, 20 bp, Homo sapiens
tttctgttgttcacttggag

SEQ ID NO: 632685 - DNA, 11 bp, Homo sapiens
tttcttccttc

SEQ ID NO: 632686 - DNA, 23 bp, Homo sapiens
tttcttctttaatttttctgttg

SEQ ID NO: 632687 - DNA, 17 bp, Homo sapiens
tttcttggtatgatcat

SEQ ID NO: 632688 - DNA, 14 bp, Homo sapiens
tttgaaaactcatc

SEQ ID NO: 632689 - DNA, 14 bp, Homo sapiens
tttgaaatgttttt

SEQ ID NO: 632690 - DNA, 13 bp, Homo sapiens
tttgacacactca

SEQ ID NO: 632691 - DNA, 19 bp, Homo sapiens
tttgagaccaacctgggta

SEQ ID NO: 632692 - DNA, 13 bp, Homo sapiens
tttgagtaaaact

SEQ ID NO: 632693 - DNA, 14 bp, Homo sapiens
tttgagtaaaactt

SEQ ID NO: 632694 - DNA, 21 bp, Homo sapiens
tttgagtgtcaggctctgaat

SEQ ID NO: 632695 - DNA, 16 bp, Homo sapiens
tttgatatacagacct

SEQ ID NO: 632696 - DNA, 19 bp, Homo sapiens
tttgatatcacagtctaat

SEQ ID NO: 632697 - DNA, 24 bp, Homo sapiens
tttgatctcagcatcctggaaatt

SEQ ID NO: 632698 - DNA, 16 bp, Homo sapiens
tttgatggctatgttt

SEQ ID NO: 632699 - DNA, 18 bp, Homo sapiens
tttgattgtttgatgaat

SEQ ID NO: 632700 - DNA, 15 bp, Homo sapiens
tttgatttatcaata

SEQ ID NO: 632701 - DNA, 12 bp, Homo sapiens
tttgatttgcaa

SEQ ID NO: 632702 - DNA, 16 bp, Homo sapiens
tttgatttgcaacact

SEQ ID NO: 632703 - DNA, 22 bp, Homo sapiens
tttgcaaccttgtactttacaa

SEQ ID NO: 632704 - DNA, 21 bp, Homo sapiens
tttgcaggtgaccagaatgag

SEQ ID NO: 632705 - DNA, 17 bp, Homo sapiens
tttgcataatatgcata

SEQ ID NO: 632706 - DNA, 16 bp, Homo sapiens
tttgcgctctgggttt

SEQ ID NO: 632707 - DNA, 13 bp, Homo sapiens
tttgctaattaaa

SEQ ID NO: 632708 - DNA, 19 bp, Homo sapiens
tttgctaattaaaaagtta

SEQ ID NO: 632709 - DNA, 21 bp, Homo sapiens
tttgctagttctgctgccctc

SEQ ID NO: 632710 - DNA, 22 bp, Homo sapiens
tttgctagttctgctgccctct

SEQ ID NO: 632711 - DNA, 15 bp, Homo sapiens
tttgctcataagtaa

SEQ ID NO: 632712 - DNA, 18 bp, Homo sapiens
tttgctgtatacaaacag

SEQ ID NO: 632713 - DNA, 21 bp, Homo sapiens
tttggaaaacgatttaattta

SEQ ID NO: 632714 - DNA, 19 bp, Homo sapiens
tttggagactttgttcctt

SEQ ID NO: 632715 - DNA, 17 bp, Homo sapiens
tttggaggctgctgccc

SEQ ID NO: 632716 - DNA, 21 bp, Homo sapiens
tttggccagtgacatttcaat

SEQ ID NO: 632717 - DNA, 15 bp, Homo sapiens
tttggccctggagcc

SEQ ID NO: 632718 - DNA, 18 bp, Homo sapiens
tttggggcttatcagaac

SEQ ID NO: 632719 - DNA, 19 bp, Homo sapiens
tttgggggacgcccagccc

SEQ ID NO: 632720 - DNA, 20 bp, Homo sapiens
tttgggtaacctgaagtttt

SEQ ID NO: 632721 - DNA, 21 bp, Homo sapiens
tttgggtaacctgaagtttta

SEQ ID NO: 632722 - DNA, 19 bp, Homo sapiens
tttgggtattttgtcagtt

SEQ ID NO: 632723 - DNA, 21 bp, Homo sapiens
tttggttcctcatggctgtta

SEQ ID NO: 632724 - DNA, 23 bp, Homo sapiens
tttggtttttctcatttgaaatg

SEQ ID NO: 632725 - DNA, 16 bp, Homo sapiens
tttgtaaaacagtggt

SEQ ID NO: 632726 - DNA, 21 bp, Homo sapiens
tttgtacatagccaactgtag

SEQ ID NO: 632727 - DNA, 21 bp, Homo sapiens
tttgtacgttaattaaacaaa

SEQ ID NO: 632728 - DNA, 16 bp, Homo sapiens
tttgtcctttatgtat

SEQ ID NO: 632729 - DNA, 17 bp, Homo sapiens
tttgtcctttatgtatt

SEQ ID NO: 632730 - DNA, 16 bp, Homo sapiens
tttgtctggctgtggc

SEQ ID NO: 632731 - DNA, 22 bp, Homo sapiens
tttgtctggctgtggcccctcc

SEQ ID NO: 632732 - DNA, 17 bp, Homo sapiens
tttgtgaaagtggcaag

SEQ ID NO: 632733 - DNA, 20 bp, Homo sapiens
tttgtgatctgtccttccaa

SEQ ID NO: 632734 - DNA, 16 bp, Homo sapiens
tttgtgcttgttcttc

SEQ ID NO: 632735 - DNA, 13 bp, Homo sapiens
tttgtgtaactga

SEQ ID NO: 632736 - DNA, 20 bp, Homo sapiens
tttgttcaccttctgtgcat

SEQ ID NO: 632737 - DNA, 23 bp, Homo sapiens
tttgttgaatctcaggtaaatga

SEQ ID NO: 632738 - DNA, 20 bp, Homo sapiens
ttttaaagaagtccatgtga

SEQ ID NO: 632739 - DNA, 14 bp, Homo sapiens
ttttacatatagct

SEQ ID NO: 632740 - DNA, 19 bp, Homo sapiens
ttttactcaggctttctat

SEQ ID NO: 632741 - DNA, 21 bp, Homo sapiens
ttttactcaggctttctattg

SEQ ID NO: 632742 - DNA, 15 bp, Homo sapiens
ttttaggaaatgaat

SEQ ID NO: 632743 - DNA, 17 bp, Homo sapiens
ttttataaattataatg

SEQ ID NO: 632744 - DNA, 19 bp, Homo sapiens
ttttatacacataattaaa

SEQ ID NO: 632745 - DNA, 18 bp, Homo sapiens
ttttatacttcaaatgtc

SEQ ID NO: 632746 - DNA, 19 bp, Homo sapiens
ttttatacttcaaatgtca

SEQ ID NO: 632747 - DNA, 18 bp, Homo sapiens
ttttatgagacttcctat

SEQ ID NO: 632748 - DNA, 20 bp, Homo sapiens
ttttattaggttaagtctca

SEQ ID NO: 632749 - DNA, 22 bp, Homo sapiens
ttttattaggttaagtctcaat

SEQ ID NO: 632750 - DNA, 20 bp, Homo sapiens
ttttattcataagccaattt

SEQ ID NO: 632751 - DNA, 13 bp, Homo sapiens
ttttattgctgga

SEQ ID NO: 632752 - DNA, 16 bp, Homo sapiens
ttttattgtaacagac

SEQ ID NO: 632753 - DNA, 22 bp, Homo sapiens
ttttattgtaacagacattgtt

SEQ ID NO: 632754 - DNA, 10 bp, Homo sapiens
ttttattgtt

SEQ ID NO: 632755 - DNA, 15 bp, Homo sapiens
ttttcaaagacttca

SEQ ID NO: 632756 - DNA, 14 bp, Homo sapiens
ttttcacatgaaca

SEQ ID NO: 632757 - DNA, 19 bp, Homo sapiens
ttttcagattgtaaaggta

SEQ ID NO: 632758 - DNA, 20 bp, Homo sapiens
ttttcagccttgtaaatggg

SEQ ID NO: 632759 - DNA, 22 bp, Homo sapiens
ttttcattctggtccttagtaa

SEQ ID NO: 632760 - DNA, 20 bp, Homo sapiens
ttttccagggcaatcaatgt

SEQ ID NO: 632761 - DNA, 17 bp, Homo sapiens
ttttcccacctctttgg

SEQ ID NO: 632762 - DNA, 14 bp, Homo sapiens
ttttcctttcttcc

SEQ ID NO: 632763 - DNA, 12 bp, Homo sapiens
ttttctacttta

SEQ ID NO: 632764 - DNA, 13 bp, Homo sapiens
ttttctcatttga

SEQ ID NO: 632765 - DNA, 14 bp, Homo sapiens
ttttgaaaactcat

SEQ ID NO: 632766 - DNA, 23 bp, Homo sapiens
ttttgatgtattattatatatgt

SEQ ID NO: 632767 - DNA, 17 bp, Homo sapiens
ttttgattgtttgatga

SEQ ID NO: 632768 - DNA, 14 bp, Homo sapiens
ttttgcatgtttaa

SEQ ID NO: 632769 - DNA, 20 bp, Homo sapiens
ttttgctttttctgactcca

SEQ ID NO: 632770 - DNA, 22 bp, Homo sapiens
ttttggaaaacgatttaattta

SEQ ID NO: 632771 - DNA, 14 bp, Homo sapiens
ttttgtagatgaaa

SEQ ID NO: 632772 - DNA, 12 bp, Homo sapiens
ttttgtagctag

SEQ ID NO: 632773 - DNA, 13 bp, Homo sapiens
ttttgtgagaaag

SEQ ID NO: 632774 - DNA, 14 bp, Homo sapiens
ttttgttgattaaa

SEQ ID NO: 632775 - DNA, 19 bp, Homo sapiens
ttttgttgattaaaacatt

SEQ ID NO: 632776 - DNA, 23 bp, Homo sapiens
tttttactgtttgaaaagaaata

SEQ ID NO: 632777 - DNA, 21 bp, Homo sapiens
tttttataaattataatgcat

SEQ ID NO: 632778 - DNA, 12 bp, Homo sapiens
tttttcctacca

SEQ ID NO: 632779 - DNA, 22 bp, Homo sapiens
tttttcctatgaccataaaatt

SEQ ID NO: 632780 - DNA, 11 bp, Homo sapiens
tttttccttca

SEQ ID NO: 632781 - DNA, 18 bp, Homo sapiens
tttttctgactccagtgg

SEQ ID NO: 632782 - DNA, 14 bp, Homo sapiens
tttttctgcactga

SEQ ID NO: 632783 - DNA, 23 bp, Homo sapiens
tttttctgcactgagcagagtct

SEQ ID NO: 632784 - DNA, 17 bp, Homo sapiens
tttttgatttatcaata

SEQ ID NO: 632785 - DNA, 12 bp, Homo sapiens
ctgcgcccctgc

SEQ ID NO: 632786 - DNA, 19 bp, Homo sapiens
ctgcgcccctgcccagcac

SEQ ID NO: 632787 - DNA, 20 bp, Homo sapiens
ctgcgcccctgcccagcacc

SEQ ID NO: 632788 - DNA, 15 bp, Homo sapiens
ctgcgccctccctcc

SEQ ID NO: 632789 - DNA, 12 bp, Homo sapiens
ctgcgcctcctc

SEQ ID NO: 632790 - DNA, 13 bp, Homo sapiens
ctgcgcctcctcc

SEQ ID NO: 632791 - DNA, 17 bp, Homo sapiens
ctgcgcctcctcctgca

SEQ ID NO: 632792 - DNA, 12 bp, Homo sapiens
ctgcgcctgccc

SEQ ID NO: 632793 - DNA, 13 bp, Homo sapiens
ctgcgctcctctg

SEQ ID NO: 632794 - DNA, 15 bp, Homo sapiens
ctgcgctcctctgca

SEQ ID NO: 632795 - DNA, 22 bp, Homo sapiens
ctgcgctcctctgcagcctgag

SEQ ID NO: 632796 - DNA, 22 bp, Homo sapiens
ctgcggggcggcatccgagccc

SEQ ID NO: 632797 - DNA, 15 bp, Homo sapiens
ctgcggggttccctg

SEQ ID NO: 632798 - DNA, 16 bp, Homo sapiens
ctgcgtccctgctcag

SEQ ID NO: 632799 - DNA, 19 bp, Homo sapiens
ctgcgtccctgctcagccc

SEQ ID NO: 632800 - DNA, 22 bp, Homo sapiens
ctgctacaccttagcagctctt

SEQ ID NO: 632801 - DNA, 14 bp, Homo sapiens
ctgctatgtctgtg

SEQ ID NO: 632802 - DNA, 15 bp, Homo sapiens
ctgctatgtctgtga

SEQ ID NO: 632803 - DNA, 18 bp, Homo sapiens
ctgctcccagcctcttgc

SEQ ID NO: 632804 - DNA, 20 bp, Homo sapiens
ctgctcccggctctgaggct

SEQ ID NO: 632805 - DNA, 13 bp, Homo sapiens
ctgctcctcaccc

SEQ ID NO: 632806 - DNA, 23 bp, Homo sapiens
ctgctcctccagtacaataaata

SEQ ID NO: 632807 - DNA, 13 bp, Homo sapiens
ctgctcctgccca

SEQ ID NO: 632808 - DNA, 14 bp, Homo sapiens
ctgctcgccctgtg

SEQ ID NO: 632809 - DNA, 16 bp, Homo sapiens
ctgctcgccctgtgcc

SEQ ID NO: 632810 - DNA, 17 bp, Homo sapiens
ctgctcgccctgtgccc

SEQ ID NO: 632811 - DNA, 12 bp, Homo sapiens
ctgctcgggaag

SEQ ID NO: 632812 - DNA, 14 bp, Homo sapiens
ctgctgaattttca

SEQ ID NO: 632813 - DNA, 22 bp, Homo sapiens
ctgctgagggggctctttccct

SEQ ID NO: 632814 - DNA, 23 bp, Homo sapiens
ctgctgagggggctctttccctc

SEQ ID NO: 632815 - DNA, 17 bp, Homo sapiens
ctgctgcactgccctcc

SEQ ID NO: 632816 - DNA, 17 bp, Homo sapiens
ctgctgcctccctgggg

SEQ ID NO: 632817 - DNA, 21 bp, Homo sapiens
ctgctgcctccctggggacca

SEQ ID NO: 632818 - DNA, 17 bp, Homo sapiens
ctgctgctcgggaaggc

SEQ ID NO: 632819 - DNA, 14 bp, Homo sapiens
ctgctgctgcctcc

SEQ ID NO: 632820 - DNA, 19 bp, Homo sapiens
ctgctggggcagggcccag

SEQ ID NO: 632821 - DNA, 16 bp, Homo sapiens
ctgctgtatttgagga

SEQ ID NO: 632822 - DNA, 21 bp, Homo sapiens
ctgctgtatttgaggaaactc

SEQ ID NO: 632823 - DNA, 14 bp, Homo sapiens
ctgctgtggcatca

SEQ ID NO: 632824 - DNA, 13 bp, Homo sapiens
ctgctgtgtagct

SEQ ID NO: 632825 - DNA, 23 bp, Homo sapiens
ctgcttagtatctcatcaacaaa

SEQ ID NO: 632826 - DNA, 20 bp, Homo sapiens
aaatagcttttcacttctta

SEQ ID NO: 632827 - DNA, 21 bp, Homo sapiens
aaatagcttttcacttcttaa

SEQ ID NO: 632828 - DNA, 13 bp, Homo sapiens
aaatagtcatgtt

SEQ ID NO: 632829 - DNA, 15 bp, Homo sapiens
aaatataaactgtga

SEQ ID NO: 632830 - DNA, 15 bp, Homo sapiens
aaatataacatgaaa

SEQ ID NO: 632831 - DNA, 16 bp, Homo sapiens
aaatatactcatttgg

SEQ ID NO: 632832 - DNA, 18 bp, Homo sapiens
aaatatatattaaaattg

SEQ ID NO: 632833 - DNA, 22 bp, Homo sapiens
aaatatcattatagcatgtaat

SEQ ID NO: 632834 - DNA, 21 bp, Homo sapiens
aaatatctatttatctgtctg

SEQ ID NO: 632835 - DNA, 23 bp, Homo sapiens
aaatatgctctcccctccctttt

SEQ ID NO: 632836 - DNA, 15 bp, Homo sapiens
aaatattctgtcatt

SEQ ID NO: 632837 - DNA, 13 bp, Homo sapiens
aaatattgctgtc

SEQ ID NO: 632838 - DNA, 14 bp, Homo sapiens
aaatattgctgtct

SEQ ID NO: 632839 - DNA, 13 bp, Homo sapiens
aaatattttctac

SEQ ID NO: 632840 - DNA, 21 bp, Homo sapiens
aaatattttctactttaaatt

SEQ ID NO: 632841 - DNA, 16 bp, Homo sapiens
aaatattttcttaatt

SEQ ID NO: 632842 - DNA, 15 bp, Homo sapiens
aaatcacagatttcc

SEQ ID NO: 632843 - DNA, 17 bp, Homo sapiens
aaatcacagatttccaa

SEQ ID NO: 632844 - DNA, 15 bp, Homo sapiens
aaatcagaaagacat

SEQ ID NO: 632845 - DNA, 15 bp, Homo sapiens
aaatcataatcatcc

SEQ ID NO: 632846 - DNA, 15 bp, Homo sapiens
aaatcatcctcatgt

SEQ ID NO: 632847 - DNA, 19 bp, Homo sapiens
aaatcattttgatgtatta

SEQ ID NO: 632848 - DNA, 20 bp, Homo sapiens
aaatcattttgatgtattat

SEQ ID NO: 632849 - DNA, 15 bp, Homo sapiens
aaatctaaattaact

SEQ ID NO: 632850 - DNA, 14 bp, Homo sapiens
aaatctcatcccta

SEQ ID NO: 632851 - DNA, 12 bp, Homo sapiens
aaatctgaattt

SEQ ID NO: 632852 - DNA, 22 bp, Homo sapiens
aaatcttaaccttcaaatacat

SEQ ID NO: 632853 - DNA, 23 bp, Homo sapiens
aaatcttacccttcaatgttaaa

SEQ ID NO: 632854 - DNA, 18 bp, Homo sapiens
aaatctttgttaaaatat

SEQ ID NO: 632855 - DNA, 19 bp, Homo sapiens
aaatctttgttaaaatata

SEQ ID NO: 632856 - DNA, 20 bp, Homo sapiens
aaatctttgttaaaatatag

SEQ ID NO: 632857 - DNA, 13 bp, Homo sapiens
aaatctttttgct

SEQ ID NO: 632858 - DNA, 14 bp, Homo sapiens
aaatctttttgctt

SEQ ID NO: 632859 - DNA, 16 bp, Homo sapiens
aaatgaaatttaagca

SEQ ID NO: 632860 - DNA, 18 bp, Homo sapiens
aaatgaaatttaagcaca

SEQ ID NO: 632861 - DNA, 11 bp, Homo sapiens
aaatgaatgtg

SEQ ID NO: 632862 - DNA, 14 bp, Homo sapiens
aaatgaatgtgtgt

SEQ ID NO: 632863 - DNA, 17 bp, Homo sapiens
aaatgaatgtgtgtggt

SEQ ID NO: 632864 - DNA, 19 bp, Homo sapiens
aaatgaatgtgtgtggttt

SEQ ID NO: 632865 - DNA, 14 bp, Homo sapiens
aaatgaattgcctt

SEQ ID NO: 632866 - DNA, 12 bp, Homo sapiens
aaatgagaaatt

SEQ ID NO: 632867 - DNA, 21 bp, Homo sapiens
aaatgagaaattgtgccaaag

SEQ ID NO: 632868 - DNA, 21 bp, Homo sapiens
aaatgagtcacttacttcata

SEQ ID NO: 632869 - DNA, 19 bp, Homo sapiens
aaatgatacttggtcctta

SEQ ID NO: 632870 - DNA, 21 bp, Homo sapiens
aaatgatggcgacttgtataa

SEQ ID NO: 632871 - DNA, 21 bp, Homo sapiens
aaatgattcacttttattgta

SEQ ID NO: 632872 - DNA, 15 bp, Homo sapiens
aaatgctactcagta

SEQ ID NO: 632873 - DNA, 11 bp, Homo sapiens
aaatgctttct

SEQ ID NO: 632874 - DNA, 18 bp, Homo sapiens
aaatggatgtaatatagg

SEQ ID NO: 632875 - DNA, 15 bp, Homo sapiens
aaatggcatttagca

SEQ ID NO: 632876 - DNA, 14 bp, Homo sapiens
aaatggctgaagaa

SEQ ID NO: 632877 - DNA, 12 bp, Homo sapiens
aaatggtatttt

SEQ ID NO: 632878 - DNA, 19 bp, Homo sapiens
aaatggtattttttgtgaa

SEQ ID NO: 632879 - DNA, 21 bp, Homo sapiens
aaatggtattttttgtgaatg

SEQ ID NO: 632880 - DNA, 11 bp, Homo sapiens
aaatgtctaat

SEQ ID NO: 632881 - DNA, 19 bp, Homo sapiens
aaatgtctaatgtatttta

SEQ ID NO: 632882 - DNA, 22 bp, Homo sapiens
aaatgtctaatgtattttattg

SEQ ID NO: 632883 - DNA, 15 bp, Homo sapiens
aaatgtcttcatgtt

SEQ ID NO: 632884 - DNA, 18 bp, Homo sapiens
aaatgtgtgcttggaaaa

SEQ ID NO: 632885 - DNA, 18 bp, Homo sapiens
aaatgttattcaataact

SEQ ID NO: 632886 - DNA, 21 bp, Homo sapiens
aaatgttttacaatggctggg

SEQ ID NO: 632887 - DNA, 23 bp, Homo sapiens
aaattaacaaattcagtggacat

SEQ ID NO: 632888 - DNA, 20 bp, Homo sapiens
aaattaacttctattttcaa

SEQ ID NO: 632889 - DNA, 18 bp, Homo sapiens
aaattaattggcagcaga

SEQ ID NO: 632890 - DNA, 14 bp, Homo sapiens
aaattaatttttca

SEQ ID NO: 632891 - DNA, 20 bp, Homo sapiens
aaattaggaaagtactgcat

SEQ ID NO: 632892 - DNA, 19 bp, Homo sapiens
aaattagggctctaatttc

SEQ ID NO: 632893 - DNA, 21 bp, Homo sapiens
aaattagggctctaatttcct

SEQ ID NO: 632894 - DNA, 12 bp, Homo sapiens
aaattagtattt

SEQ ID NO: 632895 - DNA, 13 bp, Homo sapiens
aaattagtatttt

SEQ ID NO: 632896 - DNA, 16 bp, Homo sapiens
aaattagtgttttcat

SEQ ID NO: 632897 - DNA, 19 bp, Homo sapiens
aaattagtgttttcattct

SEQ ID NO: 632898 - DNA, 21 bp, Homo sapiens
aaattagtgttttcattctgg

SEQ ID NO: 632899 - DNA, 15 bp, Homo sapiens
aaattataatgcatc

SEQ ID NO: 632900 - DNA, 20 bp, Homo sapiens
aaattatcattgtttgtcct

SEQ ID NO: 632901 - DNA, 20 bp, Homo sapiens
aaattcagtggacatttgtt

SEQ ID NO: 632902 - DNA, 15 bp, Homo sapiens
aaattcctaattcta

SEQ ID NO: 632903 - DNA, 16 bp, Homo sapiens
aaattcctaattctat

SEQ ID NO: 632904 - DNA, 13 bp, Homo sapiens
aaattctgattat

SEQ ID NO: 632905 - DNA, 14 bp, Homo sapiens
aaattcttgcactg

SEQ ID NO: 632906 - DNA, 15 bp, Homo sapiens
aaattcttgcactgt

SEQ ID NO: 632907 - DNA, 14 bp, Homo sapiens
aaattgccttcagc

SEQ ID NO: 632908 - DNA, 19 bp, Homo sapiens
aaattgccttcagccctaa

SEQ ID NO: 632909 - DNA, 15 bp, Homo sapiens
aaattgctgagatgt

SEQ ID NO: 632910 - DNA, 18 bp, Homo sapiens
aaattgctgagatgttta

SEQ ID NO: 632911 - DNA, 18 bp, Homo sapiens
aaattggttaatgaaaaa

SEQ ID NO: 632912 - DNA, 11 bp, Homo sapiens
aaattgtggat

SEQ ID NO: 632913 - DNA, 12 bp, Homo sapiens
aaattgtggatg

SEQ ID NO: 632914 - DNA, 15 bp, Homo sapiens
aaatttaagcacaaa

SEQ ID NO: 632915 - DNA, 20 bp, Homo sapiens
aaatttctagatatgagaaa

SEQ ID NO: 632916 - DNA, 23 bp, Homo sapiens
aaatttgacattgtcagaatgtt

SEQ ID NO: 632917 - DNA, 21 bp, Homo sapiens
aaatttttaagtaatttcatg

SEQ ID NO: 632918 - DNA, 14 bp, Homo sapiens
aaatttttgcatgt

SEQ ID NO: 632919 - DNA, 17 bp, Homo sapiens
aaatttttgcatgttta

SEQ ID NO: 632920 - DNA, 18 bp, Homo sapiens
aaatttttgtctttcatg

SEQ ID NO: 632921 - DNA, 22 bp, Homo sapiens
aacaaaaaaaagaaagaaaaaa

SEQ ID NO: 632922 - DNA, 17 bp, Homo sapiens
aacaaaccagcaacttt

SEQ ID NO: 632923 - DNA, 15 bp, Homo sapiens
aacaaactcaaaatg

SEQ ID NO: 632924 - DNA, 12 bp, Homo sapiens
aacaaagaaata

SEQ ID NO: 632925 - DNA, 21 bp, Homo sapiens
aacaaagcatgctcagtattg

SEQ ID NO: 632926 - DNA, 22 bp, Homo sapiens
aacaaagcatgctcagtattga

SEQ ID NO: 632927 - DNA, 11 bp, Homo sapiens
aacaaatatac

SEQ ID NO: 632928 - DNA, 14 bp, Homo sapiens
aacaaatggcttgt

SEQ ID NO: 632929 - DNA, 17 bp, Homo sapiens
aacaacaaagcatgctc

SEQ ID NO: 632930 - DNA, 15 bp, Homo sapiens
aacaacaacagaaca

SEQ ID NO: 632931 - DNA, 14 bp, Homo sapiens
aacaagagaccact

SEQ ID NO: 632932 - DNA, 14 bp, Homo sapiens
aacaaggaaggaca

SEQ ID NO: 632933 - DNA, 15 bp, Homo sapiens
aacaaggaaggacat

SEQ ID NO: 632934 - DNA, 23 bp, Homo sapiens
aacaatgttttttatacttcaaa

SEQ ID NO: 632935 - DNA, 19 bp, Homo sapiens
aacacacagtatagataaa

SEQ ID NO: 632936 - DNA, 23 bp, Homo sapiens
aacacacagtatagataaatcca

SEQ ID NO: 632937 - DNA, 14 bp, Homo sapiens
aacacagtgcccca

SEQ ID NO: 632938 - DNA, 22 bp, Homo sapiens
aacacggagtttccatttggat

SEQ ID NO: 632939 - DNA, 14 bp, Homo sapiens
aacactaatggcca

SEQ ID NO: 632940 - DNA, 16 bp, Homo sapiens
aacactaatggccaag

SEQ ID NO: 632941 - DNA, 13 bp, Homo sapiens
aacactattttat

SEQ ID NO: 632942 - DNA, 15 bp, Homo sapiens
aacactgagtgaaat

SEQ ID NO: 632943 - DNA, 15 bp, Homo sapiens
aatcaccgaaaacgt

SEQ ID NO: 632944 - DNA, 13 bp, Homo sapiens
aatcactgaaaat

SEQ ID NO: 632945 - DNA, 20 bp, Homo sapiens
aatccaaaatagtcatgttt

SEQ ID NO: 632946 - DNA, 12 bp, Homo sapiens
aatccaactcca

SEQ ID NO: 632947 - DNA, 15 bp, Homo sapiens
aatccaatagtctgc

SEQ ID NO: 632948 - DNA, 19 bp, Homo sapiens
aatccacctggtggccctg

SEQ ID NO: 632949 - DNA, 13 bp, Homo sapiens
aatccatatcagc

SEQ ID NO: 632950 - DNA, 19 bp, Homo sapiens
aatccatgtgctgctgtgg

SEQ ID NO: 632951 - DNA, 19 bp, Homo sapiens
aatccccataatgcttctt

SEQ ID NO: 632952 - DNA, 19 bp, Homo sapiens
aatccttcagcaatcctta

SEQ ID NO: 632953 - DNA, 16 bp, Homo sapiens
aatccttgccttcaaa

SEQ ID NO: 632954 - DNA, 15 bp, Homo sapiens
aatctactagaacct

SEQ ID NO: 632955 - DNA, 23 bp, Homo sapiens
aatctcaaaagatctcctgtgca

SEQ ID NO: 632956 - DNA, 20 bp, Homo sapiens
aatctcgcactacatctgat

SEQ ID NO: 632957 - DNA, 18 bp, Homo sapiens
aatctctcaaaatgtgcc

SEQ ID NO: 632958 - DNA, 19 bp, Homo sapiens
aatctctcaaaatgtgccg

SEQ ID NO: 632959 - DNA, 20 bp, Homo sapiens
aatcttacccttcaatgtta

SEQ ID NO: 632960 - DNA, 16 bp, Homo sapiens
aatctttgttaaaata

SEQ ID NO: 632961 - DNA, 17 bp, Homo sapiens
aatctttgttaaaatat

SEQ ID NO: 632962 - DNA, 16 bp, Homo sapiens
aatgaaatttaagcac

SEQ ID NO: 632963 - DNA, 17 bp, Homo sapiens
aatgaaatttaagcaca

SEQ ID NO: 632964 - DNA, 17 bp, Homo sapiens
aatgaactctttcccca

SEQ ID NO: 632965 - DNA, 15 bp, Homo sapiens
aatgaagcaaacaca

SEQ ID NO: 632966 - DNA, 17 bp, Homo sapiens
aatgaagcaaacacaca

SEQ ID NO: 632967 - DNA, 12 bp, Homo sapiens
aatgaatgaaat

SEQ ID NO: 632968 - DNA, 22 bp, Homo sapiens
aatgaatgaaatataaactgtg

SEQ ID NO: 632969 - DNA, 12 bp, Homo sapiens
aatgaattgcct

SEQ ID NO: 632970 - DNA, 20 bp, Homo sapiens
aatgaatttatcattttagt

SEQ ID NO: 632971 - DNA, 14 bp, Homo sapiens
aatgaccagaaaat

SEQ ID NO: 632972 - DNA, 15 bp, Homo sapiens
aatgagaaatcatgt

SEQ ID NO: 632973 - DNA, 19 bp, Homo sapiens
aatgagaaattgtgccaaa

SEQ ID NO: 632974 - DNA, 20 bp, Homo sapiens
aatgagaaattgtgccaaag

SEQ ID NO: 632975 - DNA, 22 bp, Homo sapiens
aatgagaaattgtgccaaagat

SEQ ID NO: 632976 - DNA, 20 bp, Homo sapiens
aatgagatgttattactgtt

SEQ ID NO: 632977 - DNA, 23 bp, Homo sapiens
aatgagccaataaagctcacact

SEQ ID NO: 632978 - DNA, 21 bp, Homo sapiens
aatgaggcacatgacagtggt

SEQ ID NO: 632979 - DNA, 20 bp, Homo sapiens
aatgagtttccagctaagcc

SEQ ID NO: 632980 - DNA, 17 bp, Homo sapiens
aatgatactgaattgtt

SEQ ID NO: 632981 - DNA, 18 bp, Homo sapiens
aatgatatgtctttaaaa

SEQ ID NO: 632982 - DNA, 16 bp, Homo sapiens
aatgatgattcaatca

SEQ ID NO: 632983 - DNA, 18 bp, Homo sapiens
aatgattaggagagctgt

SEQ ID NO: 632984 - DNA, 15 bp, Homo sapiens
aatgattcaatgtga

SEQ ID NO: 632985 - DNA, 16 bp, Homo sapiens
aatgcaaaccatcatt

SEQ ID NO: 632986 - DNA, 23 bp, Homo sapiens
aatgcagtatccgcgagcctgct

SEQ ID NO: 632987 - DNA, 16 bp, Homo sapiens
aatgccaattcatctc

SEQ ID NO: 632988 - DNA, 16 bp, Homo sapiens
aatgctcaatgtgctg

SEQ ID NO: 632989 - DNA, 13 bp, Homo sapiens
aatgctgatttaa

SEQ ID NO: 632990 - DNA, 19 bp, Homo sapiens
aatgcttctttcctcttaa

SEQ ID NO: 632991 - DNA, 11 bp, Homo sapiens
aatgctttctc

SEQ ID NO: 632992 - DNA, 13 bp, Homo sapiens
aatgctttctcat

SEQ ID NO: 632993 - DNA, 14 bp, Homo sapiens
aatgctttctcatg

SEQ ID NO: 632994 - DNA, 13 bp, Homo sapiens
aatggatgtaata

SEQ ID NO: 632995 - DNA, 17 bp, Homo sapiens
aatggatgtaatatagg

SEQ ID NO: 632996 - DNA, 20 bp, Homo sapiens
aatggcatttagcacagtat

SEQ ID NO: 632997 - DNA, 23 bp, Homo sapiens
aatggcatttagcacagtattta

SEQ ID NO: 632998 - DNA, 14 bp, Homo sapiens
aatggccaagtgta

SEQ ID NO: 632999 - DNA, 19 bp, Homo sapiens
aatggccaagtgtacattt

SEQ ID NO: 633000 - DNA, 13 bp, Homo sapiens
aatggcctcttaa

SEQ ID NO: 633001 - DNA, 19 bp, Homo sapiens
aatggcctcttaaaaatta

SEQ ID NO: 633002 - DNA, 18 bp, Homo sapiens
aatggctgaagaaacaca

SEQ ID NO: 633003 - DNA, 15 bp, Homo sapiens
aatggctgggtttgg

SEQ ID NO: 633004 - DNA, 19 bp, Homo sapiens
aatggggggcgggccaggg

SEQ ID NO: 633005 - DNA, 17 bp, Homo sapiens
aatggtattttttgtga

SEQ ID NO: 633006 - DNA, 18 bp, Homo sapiens
aatggtgggctccagagt

SEQ ID NO: 633007 - DNA, 19 bp, Homo sapiens
aatggtgggctccagagta

SEQ ID NO: 633008 - DNA, 21 bp, Homo sapiens
aatgtagggcctgcatggaga

SEQ ID NO: 633009 - DNA, 22 bp, Homo sapiens
aatgtagggcctgcatggagaa

SEQ ID NO: 633010 - DNA, 17 bp, Homo sapiens
aatgtatattgatgtaa

SEQ ID NO: 633011 - DNA, 15 bp, Homo sapiens
aatgtattttattgt

SEQ ID NO: 633012 - DNA, 17 bp, Homo sapiens
aatgtcaatttttaact

SEQ ID NO: 633013 - DNA, 19 bp, Homo sapiens
aatgtccaggtcacaggca

SEQ ID NO: 633014 - DNA, 20 bp, Homo sapiens
aatgtccaggtcacaggcat

SEQ ID NO: 633015 - DNA, 20 bp, Homo sapiens
aatgtctaatgtattttatt

SEQ ID NO: 633016 - DNA, 23 bp, Homo sapiens
aatgtctgtccctaaacatagtg

SEQ ID NO: 633017 - DNA, 21 bp, Homo sapiens
aatgtcttcatgttgatgtgt

SEQ ID NO: 633018 - DNA, 22 bp, Homo sapiens
aatgtgaaaaaaaaaagtaatt

SEQ ID NO: 633019 - DNA, 20 bp, Homo sapiens
aatgtgaaataaagagttct

SEQ ID NO: 633020 - DNA, 17 bp, Homo sapiens
aatgtgccaaaatgtca

SEQ ID NO: 633021 - DNA, 18 bp, Homo sapiens
aatgtgccaaaatgtcaa

SEQ ID NO: 633022 - DNA, 18 bp, Homo sapiens
aatgtgctgttgattctt

SEQ ID NO: 633023 - DNA, 21 bp, Homo sapiens
aatgtgctgttgattctttca

SEQ ID NO: 633024 - DNA, 22 bp, Homo sapiens
aatgtgctgttgattctttcaa

SEQ ID NO: 633025 - DNA, 21 bp, Homo sapiens
aatgtgtcttgtattatcata

SEQ ID NO: 633026 - DNA, 22 bp, Homo sapiens
aatgtgtgtggttttttttcta

SEQ ID NO: 633027 - DNA, 18 bp, Homo sapiens
aatgttccgttcatctga

SEQ ID NO: 633028 - DNA, 22 bp, Homo sapiens
aatgttctatataatttttcct

SEQ ID NO: 633029 - DNA, 12 bp, Homo sapiens
aatgttgtcctg

SEQ ID NO: 633030 - DNA, 17 bp, Homo sapiens
aatgttgtcctgtgtca

SEQ ID NO: 633031 - DNA, 18 bp, Homo sapiens
aatgttgtcctgtgtcat

SEQ ID NO: 633032 - DNA, 17 bp, Homo sapiens
aatgtttatttttgctc

SEQ ID NO: 633033 - DNA, 12 bp, Homo sapiens
aattaaagtgtc

SEQ ID NO: 633034 - DNA, 13 bp, Homo sapiens
aattaaagtgtcc

SEQ ID NO: 633035 - DNA, 16 bp, Homo sapiens
aattaaatgaaatact

SEQ ID NO: 633036 - DNA, 17 bp, Homo sapiens
aattaaatgaaatactt

SEQ ID NO: 633037 - DNA, 19 bp, Homo sapiens
aattaactccgtttccaaa

SEQ ID NO: 633038 - DNA, 18 bp, Homo sapiens
aattaattggcagcagat

SEQ ID NO: 633039 - DNA, 13 bp, Homo sapiens
aattaatttcagt

SEQ ID NO: 633040 - DNA, 16 bp, Homo sapiens
aattacagttcacact

SEQ ID NO: 633041 - DNA, 13 bp, Homo sapiens
aattacataacag

SEQ ID NO: 633042 - DNA, 14 bp, Homo sapiens
aattagtgttttca

SEQ ID NO: 633043 - DNA, 14 bp, Homo sapiens
aattatatgaagca

SEQ ID NO: 633044 - DNA, 15 bp, Homo sapiens
aattatcttggaaaa

SEQ ID NO: 633045 - DNA, 19 bp, Homo sapiens
aattatgtcaaatggatgt

SEQ ID NO: 633046 - DNA, 17 bp, Homo sapiens
aattattaaaaattata

SEQ ID NO: 633047 - DNA, 16 bp, Homo sapiens
aattcaaacctaagtt

SEQ ID NO: 633048 - DNA, 19 bp, Homo sapiens
aattcagtagcattttaat

SEQ ID NO: 633049 - DNA, 16 bp, Homo sapiens
aattcagtggacattt

SEQ ID NO: 633050 - DNA, 19 bp, Homo sapiens
aattcagtggacatttgtt

SEQ ID NO: 633051 - DNA, 21 bp, Homo sapiens
aattcatgatgctagttctta

SEQ ID NO: 633052 - DNA, 14 bp, Homo sapiens
aattcctcctgtct

SEQ ID NO: 633053 - DNA, 21 bp, Homo sapiens
aattcttaccgaaatgaaaat

SEQ ID NO: 633054 - DNA, 22 bp, Homo sapiens
aattcttaccgaaatgaaaatg

SEQ ID NO: 633055 - DNA, 21 bp, Homo sapiens
aattcttactgttctgaaatt

SEQ ID NO: 633056 - DNA, 15 bp, Homo sapiens
aattcttctcctttg

SEQ ID NO: 633057 - DNA, 21 bp, Homo sapiens
aattcttctcctttgtcaaat

SEQ ID NO: 633058 - DNA, 23 bp, Homo sapiens
aattcttctcctttgtcaaatgg

SEQ ID NO: 633059 - DNA, 19 bp, Homo sapiens
acaggcattgcactaaaag

SEQ ID NO: 633060 - DNA, 16 bp, Homo sapiens
acagtaactgccattt

SEQ ID NO: 633061 - DNA, 13 bp, Homo sapiens
acagtatttccat

SEQ ID NO: 633062 - DNA, 18 bp, Homo sapiens
acagtcctcacagcctct

SEQ ID NO: 633063 - DNA, 14 bp, Homo sapiens
acagtggcagtatt

SEQ ID NO: 633064 - DNA, 15 bp, Homo sapiens
acagtggcagtattg

SEQ ID NO: 633065 - DNA, 18 bp, Homo sapiens
acagtggggcccatggcc

SEQ ID NO: 633066 - DNA, 22 bp, Homo sapiens
acagtggggcccatggccccag

SEQ ID NO: 633067 - DNA, 16 bp, Homo sapiens
acagtggtccagggtc

SEQ ID NO: 633068 - DNA, 23 bp, Homo sapiens
acagtggttgttttttcattgtg

SEQ ID NO: 633069 - DNA, 20 bp, Homo sapiens
acagtgtggcttaaacattt

SEQ ID NO: 633070 - DNA, 21 bp, Homo sapiens
acagtgtggcttaaacatttt

SEQ ID NO: 633071 - DNA, 13 bp, Homo sapiens
acagtgtgtagtt

SEQ ID NO: 633072 - DNA, 13 bp, Homo sapiens
acagtgttcaaat

SEQ ID NO: 633073 - DNA, 16 bp, Homo sapiens
acagtgttcaaattct

SEQ ID NO: 633074 - DNA, 19 bp, Homo sapiens
acagtgttcaaattctgat

SEQ ID NO: 633075 - DNA, 13 bp, Homo sapiens
acagtgttctgtt

SEQ ID NO: 633076 - DNA, 14 bp, Homo sapiens
acagtgttctgttt

SEQ ID NO: 633077 - DNA, 12 bp, Homo sapiens
acagtttaacag

SEQ ID NO: 633078 - DNA, 18 bp, Homo sapiens
acagtttaacagaaaaat

SEQ ID NO: 633079 - DNA, 21 bp, Homo sapiens
acagtttaacagaaaaatgaa

SEQ ID NO: 633080 - DNA, 23 bp, Homo sapiens
acataaaacacccttgaaaatat

SEQ ID NO: 633081 - DNA, 22 bp, Homo sapiens
acataaacacttctccttaacc

SEQ ID NO: 633082 - DNA, 23 bp, Homo sapiens
acataaacttgtacttacactga

SEQ ID NO: 633083 - DNA, 19 bp, Homo sapiens
acataaagtaataactgtt

SEQ ID NO: 633084 - DNA, 24 bp, Homo sapiens
acataaagtaataactgttagaat

SEQ ID NO: 633085 - DNA, 13 bp, Homo sapiens
acataacacacat

SEQ ID NO: 633086 - DNA, 17 bp, Homo sapiens
acataacaggcattgca

SEQ ID NO: 633087 - DNA, 12 bp, Homo sapiens
acatacagatgg

SEQ ID NO: 633088 - DNA, 13 bp, Homo sapiens
acatacatatata

SEQ ID NO: 633089 - DNA, 18 bp, Homo sapiens
acatacgcaattgtatat

SEQ ID NO: 633090 - DNA, 23 bp, Homo sapiens
acatagctttagagaagccataa

SEQ ID NO: 633091 - DNA, 21 bp, Homo sapiens
acatagtggtattttaacata

SEQ ID NO: 633092 - DNA, 13 bp, Homo sapiens
acatagtttttaa

SEQ ID NO: 633093 - DNA, 14 bp, Homo sapiens
acatatatacatac

SEQ ID NO: 633094 - DNA, 15 bp, Homo sapiens
acatatcattcagaa

SEQ ID NO: 633095 - DNA, 16 bp, Homo sapiens
acatatgtaggaaaat

SEQ ID NO: 633096 - DNA, 19 bp, Homo sapiens
acatatttcataagcacat

SEQ ID NO: 633097 - DNA, 15 bp, Homo sapiens
acatcagttttaacg

SEQ ID NO: 633098 - DNA, 19 bp, Homo sapiens
acatcatatgttagataca

SEQ ID NO: 633099 - DNA, 23 bp, Homo sapiens
acatcatatgttagatacacaaa

SEQ ID NO: 633100 - DNA, 13 bp, Homo sapiens
acatctctgtaaa

SEQ ID NO: 633101 - DNA, 18 bp, Homo sapiens
acatctctgtaaaaagca

SEQ ID NO: 633102 - DNA, 23 bp, Homo sapiens
acatctctgtaaaaagcaggtga

SEQ ID NO: 633103 - DNA, 15 bp, Homo sapiens
acatctgatatcagg

SEQ ID NO: 633104 - DNA, 16 bp, Homo sapiens
acatctgtcagtgagt

SEQ ID NO: 633105 - DNA, 19 bp, Homo sapiens
acatgaaagtcaagtctac

SEQ ID NO: 633106 - DNA, 14 bp, Homo sapiens
acatgaacatactg

SEQ ID NO: 633107 - DNA, 22 bp, Homo sapiens
acatgacagtggttatatttca

SEQ ID NO: 633108 - DNA, 20 bp, Homo sapiens
acatgacccagcctgaaaga

SEQ ID NO: 633109 - DNA, 15 bp, Homo sapiens
acatgcccctcttag

SEQ ID NO: 633110 - DNA, 21 bp, Homo sapiens
acatgcctttccagtgctgct

SEQ ID NO: 633111 - DNA, 20 bp, Homo sapiens
acatggttacctctgcataa

SEQ ID NO: 633112 - DNA, 21 bp, Homo sapiens
acatgtctttggcttcagaat

SEQ ID NO: 633113 - DNA, 23 bp, Homo sapiens
acatgtctttggcttcagaattg

SEQ ID NO: 633114 - DNA, 22 bp, Homo sapiens
acattaattgaggcttacagta

SEQ ID NO: 633115 - DNA, 15 bp, Homo sapiens
acattcttgctctgc

SEQ ID NO: 633116 - DNA, 18 bp, Homo sapiens
acattcttggtcacaaag

SEQ ID NO: 633117 - DNA, 15 bp, Homo sapiens
acattgaaactgtat

SEQ ID NO: 633118 - DNA, 18 bp, Homo sapiens
acattgaaactgtattta

SEQ ID NO: 633119 - DNA, 22 bp, Homo sapiens
acattgcttcattaaaacaaga

SEQ ID NO: 633120 - DNA, 14 bp, Homo sapiens
acattgtcagaatg

SEQ ID NO: 633121 - DNA, 16 bp, Homo sapiens
acattgtcagaatgtt

SEQ ID NO: 633122 - DNA, 14 bp, Homo sapiens
acattgtcagcaaa

SEQ ID NO: 633123 - DNA, 12 bp, Homo sapiens
acattgttttgc

SEQ ID NO: 633124 - DNA, 12 bp, Homo sapiens
acatttatgtac

SEQ ID NO: 633125 - DNA, 14 bp, Homo sapiens
acatttatgtacaa

SEQ ID NO: 633126 - DNA, 19 bp, Homo sapiens
acatttatgtacaaaatga

SEQ ID NO: 633127 - DNA, 20 bp, Homo sapiens
acatttctggccatttaact

SEQ ID NO: 633128 - DNA, 21 bp, Homo sapiens
acattttttgtttcttggtgt

SEQ ID NO: 633129 - DNA, 16 bp, Homo sapiens
accaaattgctgagat

SEQ ID NO: 633130 - DNA, 14 bp, Homo sapiens
accaacgggtctgt

SEQ ID NO: 633131 - DNA, 16 bp, Homo sapiens
accaacgggtctgtgg

SEQ ID NO: 633132 - DNA, 19 bp, Homo sapiens
accaagctataaaagccca

SEQ ID NO: 633133 - DNA, 20 bp, Homo sapiens
accaagctgtgaccctcaat

SEQ ID NO: 633134 - DNA, 17 bp, Homo sapiens
accaatttgttctgtgc

SEQ ID NO: 633135 - DNA, 19 bp, Homo sapiens
accacacacacccttcccc

SEQ ID NO: 633136 - DNA, 16 bp, Homo sapiens
accacactctgcctgg

SEQ ID NO: 633137 - DNA, 13 bp, Homo sapiens
accacagctgggc

SEQ ID NO: 633138 - DNA, 16 bp, Homo sapiens
accacaggatgcatat

SEQ ID NO: 633139 - DNA, 17 bp, Homo sapiens
accacaggatgcatatt

SEQ ID NO: 633140 - DNA, 13 bp, Homo sapiens
accacccctgtgc

SEQ ID NO: 633141 - DNA, 19 bp, Homo sapiens
accaccgcgcccctctgcg

SEQ ID NO: 633142 - DNA, 16 bp, Homo sapiens
accacgcccctgcctg

SEQ ID NO: 633143 - DNA, 20 bp, Homo sapiens
accacggtccaatccagcct

SEQ ID NO: 633144 - DNA, 21 bp, Homo sapiens
accactagggtcctggccctc

SEQ ID NO: 633145 - DNA, 18 bp, Homo sapiens
accacttccttaacagct

SEQ ID NO: 633146 - DNA, 23 bp, Homo sapiens
accagaaaatttttgtctttcat

SEQ ID NO: 633147 - DNA, 13 bp, Homo sapiens
accagaaagagga

SEQ ID NO: 633148 - DNA, 21 bp, Homo sapiens
accagaatgaggcacatgaca

SEQ ID NO: 633149 - DNA, 14 bp, Homo sapiens
accagagcactgta

SEQ ID NO: 633150 - DNA, 21 bp, Homo sapiens
accagagcctatggaaagggt

SEQ ID NO: 633151 - DNA, 18 bp, Homo sapiens
accagagcgatgtgttct

SEQ ID NO: 633152 - DNA, 18 bp, Homo sapiens
accagcaacttttctcat

SEQ ID NO: 633153 - DNA, 23 bp, Homo sapiens
accagcactcccagggcccgagc

SEQ ID NO: 633154 - DNA, 16 bp, Homo sapiens
accagcatagttctgc

SEQ ID NO: 633155 - DNA, 12 bp, Homo sapiens
accagcctgagc

SEQ ID NO: 633156 - DNA, 13 bp, Homo sapiens
accagcctgagcc

SEQ ID NO: 633157 - DNA, 14 bp, Homo sapiens
accagcctgagcca

SEQ ID NO: 633158 - DNA, 23 bp, Homo sapiens
accagcctgagccacagtggggc

SEQ ID NO: 633159 - DNA, 16 bp, Homo sapiens
accagcctgccaggcc

SEQ ID NO: 633160 - DNA, 17 bp, Homo sapiens
accagcctgccaggccc

SEQ ID NO: 633161 - DNA, 22 bp, Homo sapiens
accagcctgccaggccctccag

SEQ ID NO: 633162 - DNA, 17 bp, Homo sapiens
accagcttgcttctctg

SEQ ID NO: 633163 - DNA, 22 bp, Homo sapiens
accaggaaattctgtttatgtt

SEQ ID NO: 633164 - DNA, 18 bp, Homo sapiens
accaggagctagcccagt

SEQ ID NO: 633165 - DNA, 17 bp, Homo sapiens
accaggctgatgccgtg

SEQ ID NO: 633166 - DNA, 18 bp, Homo sapiens
accagttacttgtgttca

SEQ ID NO: 633167 - DNA, 19 bp, Homo sapiens
accagttacttgtgttcat

SEQ ID NO: 633168 - DNA, 17 bp, Homo sapiens
accatctaggatgattt

SEQ ID NO: 633169 - DNA, 23 bp, Homo sapiens
accatcttgggattcctcccctg

SEQ ID NO: 633170 - DNA, 21 bp, Homo sapiens
accatgtgtagattgcgtgga

SEQ ID NO: 633171 - DNA, 20 bp, Homo sapiens
accatgttaatacatcattt

SEQ ID NO: 633172 - DNA, 23 bp, Homo sapiens
accatgttcttgagcagctgaat

SEQ ID NO: 633173 - DNA, 19 bp, Homo sapiens
accatttagtcctcacctt

SEQ ID NO: 633174 - DNA, 16 bp, Homo sapiens
accatttcccctgtgg

SEQ ID NO: 633175 - DNA, 13 bp, Homo sapiens
actctttccccag

SEQ ID NO: 633176 - DNA, 19 bp, Homo sapiens
actgaaaggttgcactcta

SEQ ID NO: 633177 - DNA, 15 bp, Homo sapiens
actgaaattagtgtt

SEQ ID NO: 633178 - DNA, 20 bp, Homo sapiens
actgaaattagtgttttcat

SEQ ID NO: 633179 - DNA, 16 bp, Homo sapiens
actgacactcagatgc

SEQ ID NO: 633180 - DNA, 21 bp, Homo sapiens
actgacattcctaagagtgga

SEQ ID NO: 633181 - DNA, 21 bp, Homo sapiens
actgaccttcggcagtggctg

SEQ ID NO: 633182 - DNA, 22 bp, Homo sapiens
actgaccttcggcagtggctgg

SEQ ID NO: 633183 - DNA, 13 bp, Homo sapiens
actgagtgaaata

SEQ ID NO: 633184 - DNA, 14 bp, Homo sapiens
actgagtgaaatat

SEQ ID NO: 633185 - DNA, 21 bp, Homo sapiens
actgatgggtcctgctgctcg

SEQ ID NO: 633186 - DNA, 16 bp, Homo sapiens
actgatttttttttcc

SEQ ID NO: 633187 - DNA, 17 bp, Homo sapiens
actgatttttttttcct

SEQ ID NO: 633188 - DNA, 20 bp, Homo sapiens
actgatttttttttccttca

SEQ ID NO: 633189 - DNA, 22 bp, Homo sapiens
actgatttttttttccttcagt

SEQ ID NO: 633190 - DNA, 23 bp, Homo sapiens
actgatttttttttccttcagtg

SEQ ID NO: 633191 - DNA, 14 bp, Homo sapiens
actgcaacactgga

SEQ ID NO: 633192 - DNA, 15 bp, Homo sapiens
actgcaccctccaca

SEQ ID NO: 633193 - DNA, 22 bp, Homo sapiens
actgcagttatttaccagaagt

SEQ ID NO: 633194 - DNA, 15 bp, Homo sapiens
actgcatgatcttac

SEQ ID NO: 633195 - DNA, 12 bp, Homo sapiens
actgccattttt

SEQ ID NO: 633196 - DNA, 14 bp, Homo sapiens
actgccattttttg

SEQ ID NO: 633197 - DNA, 12 bp, Homo sapiens
actgcccaccct

SEQ ID NO: 633198 - DNA, 13 bp, Homo sapiens
actgcccaccctg

SEQ ID NO: 633199 - DNA, 14 bp, Homo sapiens
actgccccatctcc

SEQ ID NO: 633200 - DNA, 23 bp, Homo sapiens
actgcccctgcacctgcttctca

SEQ ID NO: 633201 - DNA, 22 bp, Homo sapiens
actgccctctgccactgacagg

SEQ ID NO: 633202 - DNA, 21 bp, Homo sapiens
actgcttaaggaaaagagaaa

SEQ ID NO: 633203 - DNA, 14 bp, Homo sapiens
actgcttctctgca

SEQ ID NO: 633204 - DNA, 16 bp, Homo sapiens
actgctttcagtgcct

SEQ ID NO: 633205 - DNA, 18 bp, Homo sapiens
actgctttcagtgcctgc

SEQ ID NO: 633206 - DNA, 23 bp, Homo sapiens
actggaataagaagcaaataaat

SEQ ID NO: 633207 - DNA, 15 bp, Homo sapiens
actggatgcttacag

SEQ ID NO: 633208 - DNA, 23 bp, Homo sapiens
actggcccacccctcttccccct

SEQ ID NO: 633209 - DNA, 13 bp, Homo sapiens
actggccccaggc

SEQ ID NO: 633210 - DNA, 17 bp, Homo sapiens
actggccttttcactga

SEQ ID NO: 633211 - DNA, 12 bp, Homo sapiens
actgggaaatga

SEQ ID NO: 633212 - DNA, 24 bp, Homo sapiens
actgggtgtggcctggcttctggg

SEQ ID NO: 633213 - DNA, 23 bp, Homo sapiens
actggtaaaaagatccagggatg

SEQ ID NO: 633214 - DNA, 11 bp, Homo sapiens
actgtactgtg

SEQ ID NO: 633215 - DNA, 12 bp, Homo sapiens
actgtactgtgt

SEQ ID NO: 633216 - DNA, 19 bp, Homo sapiens
actgtacttgatttttcaa

SEQ ID NO: 633217 - DNA, 23 bp, Homo sapiens
actgtcccggagctcaggccctg

SEQ ID NO: 633218 - DNA, 17 bp, Homo sapiens
actgtcttcaaccctgc

SEQ ID NO: 633219 - DNA, 22 bp, Homo sapiens
actgtcttcaaccctgccctgc

SEQ ID NO: 633220 - DNA, 16 bp, Homo sapiens
actgtgacctgctcct

SEQ ID NO: 633221 - DNA, 17 bp, Homo sapiens
actgtgacctgctcctg

SEQ ID NO: 633222 - DNA, 22 bp, Homo sapiens
actgtgacctgctcctgcccac

SEQ ID NO: 633223 - DNA, 16 bp, Homo sapiens
actgtgttcagtgcct

SEQ ID NO: 633224 - DNA, 20 bp, Homo sapiens
actgtgttcagtgccttgga

SEQ ID NO: 633225 - DNA, 19 bp, Homo sapiens
actgttaacccagtgttca

SEQ ID NO: 633226 - DNA, 12 bp, Homo sapiens
actgttcaattt

SEQ ID NO: 633227 - DNA, 20 bp, Homo sapiens
actgttcatgaatacgtaaa

SEQ ID NO: 633228 - DNA, 22 bp, Homo sapiens
actgttctaactagtaatcttg

SEQ ID NO: 633229 - DNA, 14 bp, Homo sapiens
actgttctgaaatt

SEQ ID NO: 633230 - DNA, 16 bp, Homo sapiens
actgttgcccttttcc

SEQ ID NO: 633231 - DNA, 17 bp, Homo sapiens
actgtttaatatttata

SEQ ID NO: 633232 - DNA, 19 bp, Homo sapiens
actgtttaatatttataga

SEQ ID NO: 633233 - DNA, 14 bp, Homo sapiens
actgtttataatag

SEQ ID NO: 633234 - DNA, 21 bp, Homo sapiens
actgttttgtgcggtgtgtct

SEQ ID NO: 633235 - DNA, 21 bp, Homo sapiens
acttaaaatcaaatttttctg

SEQ ID NO: 633236 - DNA, 16 bp, Homo sapiens
acttaaacaaaaactt

SEQ ID NO: 633237 - DNA, 17 bp, Homo sapiens
acttaaacaaaaacttt

SEQ ID NO: 633238 - DNA, 19 bp, Homo sapiens
acttaaacctgtgctttca

SEQ ID NO: 633239 - DNA, 18 bp, Homo sapiens
acttaatcaattaatttt

SEQ ID NO: 633240 - DNA, 13 bp, Homo sapiens
acttaatttagca

SEQ ID NO: 633241 - DNA, 18 bp, Homo sapiens
acttacacacctgagaat

SEQ ID NO: 633242 - DNA, 20 bp, Homo sapiens
acttacacacctgagaatgt

SEQ ID NO: 633243 - DNA, 14 bp, Homo sapiens
acttacactgaaat

SEQ ID NO: 633244 - DNA, 14 bp, Homo sapiens
acttactatggtat

SEQ ID NO: 633245 - DNA, 15 bp, Homo sapiens
acttagggagtgtgc

SEQ ID NO: 633246 - DNA, 13 bp, Homo sapiens
acttatctccagc

SEQ ID NO: 633247 - DNA, 14 bp, Homo sapiens
acttatctccagcc

SEQ ID NO: 633248 - DNA, 13 bp, Homo sapiens
acttatttccatg

SEQ ID NO: 633249 - DNA, 23 bp, Homo sapiens
acttatttgctcataagtaaatg

SEQ ID NO: 633250 - DNA, 18 bp, Homo sapiens
acttcagactctctcctc

SEQ ID NO: 633251 - DNA, 23 bp, Homo sapiens
acttcagatgtttccaagatgtc

SEQ ID NO: 633252 - DNA, 16 bp, Homo sapiens
acttcatacaacatat

SEQ ID NO: 633253 - DNA, 22 bp, Homo sapiens
acttccagatttgagctgcctg

SEQ ID NO: 633254 - DNA, 14 bp, Homo sapiens
acttcccagctggc

SEQ ID NO: 633255 - DNA, 16 bp, Homo sapiens
acttcctattaattta

SEQ ID NO: 633256 - DNA, 21 bp, Homo sapiens
acttctcaaatgctactcagt

SEQ ID NO: 633257 - DNA, 16 bp, Homo sapiens
acttctccttaacccc

SEQ ID NO: 633258 - DNA, 20 bp, Homo sapiens
acttctgttatcagggccca

SEQ ID NO: 633259 - DNA, 16 bp, Homo sapiens
acttcttgtgctttac

SEQ ID NO: 633260 - DNA, 20 bp, Homo sapiens
acttgagggacgactttctt

SEQ ID NO: 633261 - DNA, 23 bp, Homo sapiens
acttgagggacgactttctttaa

SEQ ID NO: 633262 - DNA, 19 bp, Homo sapiens
acttgatttttcaaagact

SEQ ID NO: 633263 - DNA, 12 bp, Homo sapiens
acttgctgtgaa

SEQ ID NO: 633264 - DNA, 15 bp, Homo sapiens
acttggaatttgctt

SEQ ID NO: 633265 - DNA, 23 bp, Homo sapiens
acttggaatttgcttagccttta

SEQ ID NO: 633266 - DNA, 14 bp, Homo sapiens
acttggacatttat

SEQ ID NO: 633267 - DNA, 22 bp, Homo sapiens
acttggataggagcttccagat

SEQ ID NO: 633268 - DNA, 15 bp, Homo sapiens
acttgggctggcacc

SEQ ID NO: 633269 - DNA, 14 bp, Homo sapiens
acttgtgttcattg

SEQ ID NO: 633270 - DNA, 13 bp, Homo sapiens
actttaaattgtg

SEQ ID NO: 633271 - DNA, 18 bp, Homo sapiens
actttaaattgtggatga

SEQ ID NO: 633272 - DNA, 17 bp, Homo sapiens
actttacattcttgctc

SEQ ID NO: 633273 - DNA, 15 bp, Homo sapiens
actttataagccaat

SEQ ID NO: 633274 - DNA, 15 bp, Homo sapiens
actttccatgacagt

SEQ ID NO: 633275 - DNA, 12 bp, Homo sapiens
actttcctctct

SEQ ID NO: 633276 - DNA, 22 bp, Homo sapiens
actttctggtggcaaatgaatt

SEQ ID NO: 633277 - DNA, 14 bp, Homo sapiens
actttgaataaaat

SEQ ID NO: 633278 - DNA, 23 bp, Homo sapiens
actttgtgtcttttgttctctct

SEQ ID NO: 633279 - DNA, 14 bp, Homo sapiens
acttttataaatgt

SEQ ID NO: 633280 - DNA, 16 bp, Homo sapiens
acttttataaatgttt

SEQ ID NO: 633281 - DNA, 15 bp, Homo sapiens
acttttattgtataa

SEQ ID NO: 633282 - DNA, 17 bp, Homo sapiens
acttttgccaatgaact

SEQ ID NO: 633283 - DNA, 18 bp, Homo sapiens
acttttttcctgtcaata

SEQ ID NO: 633284 - DNA, 15 bp, Homo sapiens
agaaaaaactggaaa

SEQ ID NO: 633285 - DNA, 19 bp, Homo sapiens
agaaaaaactggaaacatc

SEQ ID NO: 633286 - DNA, 22 bp, Homo sapiens
agaaaaacactgagaaaaagca

SEQ ID NO: 633287 - DNA, 17 bp, Homo sapiens
agaaaaagcattaaaaa

SEQ ID NO: 633288 - DNA, 18 bp, Homo sapiens
agaaaaatgaaatttaag

SEQ ID NO: 633289 - DNA, 23 bp, Homo sapiens
agaaaaatgcttgaccctgaaat

SEQ ID NO: 633290 - DNA, 15 bp, Homo sapiens
agaaaacattgttcc

SEQ ID NO: 633291 - DNA, 12 bp, Homo sapiens
agcccctcctct

SEQ ID NO: 633292 - DNA, 12 bp, Homo sapiens
agcccctgctgg

SEQ ID NO: 633293 - DNA, 16 bp, Homo sapiens
agcccctgctggacca

SEQ ID NO: 633294 - DNA, 15 bp, Homo sapiens
agccccttggagaga

SEQ ID NO: 633295 - DNA, 14 bp, Homo sapiens
agccctctttctct

SEQ ID NO: 633296 - DNA, 16 bp, Homo sapiens
agccctctttctctct

SEQ ID NO: 633297 - DNA, 17 bp, Homo sapiens
agccctctttctctctg

SEQ ID NO: 633298 - DNA, 20 bp, Homo sapiens
agccctctttctctctgtgt

SEQ ID NO: 633299 - DNA, 22 bp, Homo sapiens
agccctctttctctctgtgtgg

SEQ ID NO: 633300 - DNA, 13 bp, Homo sapiens
agccctgcacgcc

SEQ ID NO: 633301 - DNA, 22 bp, Homo sapiens
agccctgcagtcacgtgaggcc

SEQ ID NO: 633302 - DNA, 16 bp, Homo sapiens
agccctgccctcactc

SEQ ID NO: 633303 - DNA, 17 bp, Homo sapiens
agccctgccctcactcc

SEQ ID NO: 633304 - DNA, 18 bp, Homo sapiens
agccctgccctcactcca

SEQ ID NO: 633305 - DNA, 19 bp, Homo sapiens
agccctgccctcactccac

SEQ ID NO: 633306 - DNA, 23 bp, Homo sapiens
agccctgccctcactccactccc

SEQ ID NO: 633307 - DNA, 15 bp, Homo sapiens
agccctgttccgcct

SEQ ID NO: 633308 - DNA, 19 bp, Homo sapiens
agccctgttccgcctcact

SEQ ID NO: 633309 - DNA, 16 bp, Homo sapiens
agcccttgctctacct

SEQ ID NO: 633310 - DNA, 17 bp, Homo sapiens
agcccttgctctacctg

SEQ ID NO: 633311 - DNA, 19 bp, Homo sapiens
agcccttgctctacctggc

SEQ ID NO: 633312 - DNA, 23 bp, Homo sapiens
agcccttgctctacctggccggt

SEQ ID NO: 633313 - DNA, 18 bp, Homo sapiens
agccgcagaggcccgagg

SEQ ID NO: 633314 - DNA, 14 bp, Homo sapiens
agccgcgctctgcc

SEQ ID NO: 633315 - DNA, 16 bp, Homo sapiens
agccgtgacctccagg

SEQ ID NO: 633316 - DNA, 15 bp, Homo sapiens
agcctatctctcttc

SEQ ID NO: 633317 - DNA, 18 bp, Homo sapiens
agcctatctctcttctgc

SEQ ID NO: 633318 - DNA, 23 bp, Homo sapiens
agcctccactttggatcaggaaa

SEQ ID NO: 633319 - DNA, 14 bp, Homo sapiens
agcctcccccaggc

SEQ ID NO: 633320 - DNA, 15 bp, Homo sapiens
agcctcccccaggct

SEQ ID NO: 633321 - DNA, 22 bp, Homo sapiens
agcctcgttggagagcagcagg

SEQ ID NO: 633322 - DNA, 14 bp, Homo sapiens
agcctctccgccca

SEQ ID NO: 633323 - DNA, 15 bp, Homo sapiens
agcctctccgcccac

SEQ ID NO: 633324 - DNA, 18 bp, Homo sapiens
agcctcttgctcagagct

SEQ ID NO: 633325 - DNA, 15 bp, Homo sapiens
agcctgaagcctgga

SEQ ID NO: 633326 - DNA, 16 bp, Homo sapiens
agcctgacctttctga

SEQ ID NO: 633327 - DNA, 20 bp, Homo sapiens
agcctgactgtgttcagtgc

SEQ ID NO: 633328 - DNA, 22 bp, Homo sapiens
agcctgactgtgttcagtgcct

SEQ ID NO: 633329 - DNA, 19 bp, Homo sapiens
agcctgactttggggacac

SEQ ID NO: 633330 - DNA, 11 bp, Homo sapiens
agcctgagcca

SEQ ID NO: 633331 - DNA, 20 bp, Homo sapiens
agcctgagccacagtggggc

SEQ ID NO: 633332 - DNA, 12 bp, Homo sapiens
agcctgagctcc

SEQ ID NO: 633333 - DNA, 16 bp, Homo sapiens
agcctgagctccaccc

SEQ ID NO: 633334 - DNA, 13 bp, Homo sapiens
agcctgcaggcag

SEQ ID NO: 633335 - DNA, 13 bp, Homo sapiens
agcctgccaggcc

SEQ ID NO: 633336 - DNA, 15 bp, Homo sapiens
agcctgccaggccct

SEQ ID NO: 633337 - DNA, 18 bp, Homo sapiens
agcctggattccagcagt

SEQ ID NO: 633338 - DNA, 22 bp, Homo sapiens
agcctgtgaactgccaggcagc

SEQ ID NO: 633339 - DNA, 17 bp, Homo sapiens
agccttaagtcttactg

SEQ ID NO: 633340 - DNA, 12 bp, Homo sapiens
agccttattaaa

SEQ ID NO: 633341 - DNA, 18 bp, Homo sapiens
agccttattaaaatattt

SEQ ID NO: 633342 - DNA, 10 bp, Homo sapiens
agccttgctg

SEQ ID NO: 633343 - DNA, 15 bp, Homo sapiens
agccttgctgggcca

SEQ ID NO: 633344 - DNA, 23 bp, Homo sapiens
agccttgtgatcactttctgaaa

SEQ ID NO: 633345 - DNA, 15 bp, Homo sapiens
agcctttaataggct

SEQ ID NO: 633346 - DNA, 20 bp, Homo sapiens
agcctttgcgctctgggttt

SEQ ID NO: 633347 - DNA, 15 bp, Homo sapiens
agcgaggcagaatgg

SEQ ID NO: 633348 - DNA, 19 bp, Homo sapiens
agcgaggcagaatggtggg

SEQ ID NO: 633349 - DNA, 17 bp, Homo sapiens
agcgagtgacagaaggc

SEQ ID NO: 633350 - DNA, 14 bp, Homo sapiens
agcgatgtgttctt

SEQ ID NO: 633351 - DNA, 17 bp, Homo sapiens
agcgcagcccccacgcc

SEQ ID NO: 633352 - DNA, 14 bp, Homo sapiens
agcgccacccgccc

SEQ ID NO: 633353 - DNA, 20 bp, Homo sapiens
agcgcccgaggccagggccg

SEQ ID NO: 633354 - DNA, 20 bp, Homo sapiens
agcgcctcgccccagccaag

SEQ ID NO: 633355 - DNA, 15 bp, Homo sapiens
agcgctcccttttca

SEQ ID NO: 633356 - DNA, 13 bp, Homo sapiens
agcggccccgcgg

SEQ ID NO: 633357 - DNA, 15 bp, Homo sapiens
agcggcccggcccac

SEQ ID NO: 633358 - DNA, 17 bp, Homo sapiens
agcggcccggcccacgc

SEQ ID NO: 633359 - DNA, 22 bp, Homo sapiens
agcggcccggcccacgcagagc

SEQ ID NO: 633360 - DNA, 20 bp, Homo sapiens
agcggctgaggacggggcag

SEQ ID NO: 633361 - DNA, 22 bp, Homo sapiens
agcggcttccccattgccttct

SEQ ID NO: 633362 - DNA, 15 bp, Homo sapiens
agcgtctccccatgc

SEQ ID NO: 633363 - DNA, 21 bp, Homo sapiens
agcgtctccccatgctgggct

SEQ ID NO: 633364 - DNA, 14 bp, Homo sapiens
agcgttgttttgtg

SEQ ID NO: 633365 - DNA, 15 bp, Homo sapiens
agctaagcctgatga

SEQ ID NO: 633366 - DNA, 16 bp, Homo sapiens
agctaatgtggtagtg

SEQ ID NO: 633367 - DNA, 15 bp, Homo sapiens
agctaatttgtgaaa

SEQ ID NO: 633368 - DNA, 17 bp, Homo sapiens
agctaatttgtgaaagt

SEQ ID NO: 633369 - DNA, 18 bp, Homo sapiens
agctacaggggaggctga

SEQ ID NO: 633370 - DNA, 14 bp, Homo sapiens
agctaccatgttaa

SEQ ID NO: 633371 - DNA, 23 bp, Homo sapiens
agctagcccagtccctggagctg

SEQ ID NO: 633372 - DNA, 19 bp, Homo sapiens
agctaggcagggagggggc

SEQ ID NO: 633373 - DNA, 21 bp, Homo sapiens
agctaggcagggagggggctg

SEQ ID NO: 633374 - DNA, 17 bp, Homo sapiens
agctagtttaaaattat

SEQ ID NO: 633375 - DNA, 15 bp, Homo sapiens
agctataaaagccca

SEQ ID NO: 633376 - DNA, 21 bp, Homo sapiens
agctataaaagcccatgctta

SEQ ID NO: 633377 - DNA, 16 bp, Homo sapiens
agctatgcacaccaaa

SEQ ID NO: 633378 - DNA, 15 bp, Homo sapiens
agctcaaggctgcag

SEQ ID NO: 633379 - DNA, 12 bp, Homo sapiens
agctcacagcac

SEQ ID NO: 633380 - DNA, 13 bp, Homo sapiens
agctcacagcaca

SEQ ID NO: 633381 - DNA, 15 bp, Homo sapiens
agctcacagcacatt

SEQ ID NO: 633382 - DNA, 16 bp, Homo sapiens
agctcacagcacattt

SEQ ID NO: 633383 - DNA, 17 bp, Homo sapiens
agctcagaggagaggag

SEQ ID NO: 633384 - DNA, 12 bp, Homo sapiens
agctcaggagaa

SEQ ID NO: 633385 - DNA, 17 bp, Homo sapiens
agctcatagcacatgtt

SEQ ID NO: 633386 - DNA, 17 bp, Homo sapiens
agctccaccctcccctc

SEQ ID NO: 633387 - DNA, 19 bp, Homo sapiens
agctccactctgaagtccc

SEQ ID NO: 633388 - DNA, 15 bp, Homo sapiens
agctcctaaattata

SEQ ID NO: 633389 - DNA, 21 bp, Homo sapiens
agctccttcatgcttttctca

SEQ ID NO: 633390 - DNA, 22 bp, Homo sapiens
agctccttcatgcttttctcat

SEQ ID NO: 633391 - DNA, 14 bp, Homo sapiens
agctcgtgtgctta

SEQ ID NO: 633392 - DNA, 21 bp, Homo sapiens
agctcgtgtgcttagaaacct

SEQ ID NO: 633393 - DNA, 16 bp, Homo sapiens
agctctaaagcagaga

SEQ ID NO: 633394 - DNA, 13 bp, Homo sapiens
agctctccctcac

SEQ ID NO: 633395 - DNA, 19 bp, Homo sapiens
agctctgcataagattata

SEQ ID NO: 633396 - DNA, 20 bp, Homo sapiens
agctcttcattgcactgcag

SEQ ID NO: 633397 - DNA, 16 bp, Homo sapiens
agctcttcccctttcc

SEQ ID NO: 633398 - DNA, 17 bp, Homo sapiens
agctgagtcggctgggc

SEQ ID NO: 633399 - DNA, 18 bp, Homo sapiens
agctgagtcggctgggca

SEQ ID NO: 633400 - DNA, 22 bp, Homo sapiens
agctgagtcggctgggcagggc

SEQ ID NO: 633401 - DNA, 20 bp, Homo sapiens
agctgcaggaatcaaaaatt

SEQ ID NO: 633402 - DNA, 19 bp, Homo sapiens
agctgcagttagcacagag

SEQ ID NO: 633403 - DNA, 20 bp, Homo sapiens
agctgcagttagcacagagg

SEQ ID NO: 633404 - DNA, 22 bp, Homo sapiens
agctgccatccttgctgcagct

SEQ ID NO: 633405 - DNA, 16 bp, Homo sapiens
agctggcagcgcctcc

SEQ ID NO: 633406 - DNA, 20 bp, Homo sapiens
agctgtcactcacaaaaggc

SEQ ID NO: 633407 - DNA, 16 bp, Homo sapiens
agctgtttactgacat

SEQ ID NO: 633408 - DNA, 18 bp, Homo sapiens
agtgggctgggccctctg

SEQ ID NO: 633409 - DNA, 20 bp, Homo sapiens
agtggggcccatggccccag

SEQ ID NO: 633410 - DNA, 20 bp, Homo sapiens
agtggggtcccccctgagtg

SEQ ID NO: 633411 - DNA, 21 bp, Homo sapiens
agtggggtcccccctgagtgg

SEQ ID NO: 633412 - DNA, 23 bp, Homo sapiens
agtggggtcccccctgagtgggc

SEQ ID NO: 633413 - DNA, 21 bp, Homo sapiens
agtggtattttaacatagcag

SEQ ID NO: 633414 - DNA, 16 bp, Homo sapiens
agtggtccagggtcca

SEQ ID NO: 633415 - DNA, 22 bp, Homo sapiens
agtggtggcagtgcagcaacca

SEQ ID NO: 633416 - DNA, 17 bp, Homo sapiens
agtggttcgggggaaat

SEQ ID NO: 633417 - DNA, 15 bp, Homo sapiens
agtggttgttttttc

SEQ ID NO: 633418 - DNA, 22 bp, Homo sapiens
agtgtacaccactttcccacac

SEQ ID NO: 633419 - DNA, 15 bp, Homo sapiens
agtgtagcttctgaa

SEQ ID NO: 633420 - DNA, 15 bp, Homo sapiens
agtgtatatttgtat

SEQ ID NO: 633421 - DNA, 23 bp, Homo sapiens
agtgtccattgacatgtacagag

SEQ ID NO: 633422 - DNA, 21 bp, Homo sapiens
agtgtctgctgctgcctccct

SEQ ID NO: 633423 - DNA, 15 bp, Homo sapiens
agtgtgagtgttaga

SEQ ID NO: 633424 - DNA, 17 bp, Homo sapiens
agtgtgagtgttagaaa

SEQ ID NO: 633425 - DNA, 15 bp, Homo sapiens
agtgtgccttgggcg

SEQ ID NO: 633426 - DNA, 21 bp, Homo sapiens
agtgtggatgtaaattttata

SEQ ID NO: 633427 - DNA, 17 bp, Homo sapiens
agtgtggcttaaacatt

SEQ ID NO: 633428 - DNA, 19 bp, Homo sapiens
agtgtgtcacactgagctg

SEQ ID NO: 633429 - DNA, 13 bp, Homo sapiens
agtgtgtgtgcaa

SEQ ID NO: 633430 - DNA, 16 bp, Homo sapiens
agtgttagaaaaaact

SEQ ID NO: 633431 - DNA, 15 bp, Homo sapiens
agtgttataaaatct

SEQ ID NO: 633432 - DNA, 17 bp, Homo sapiens
agtgttataaaatctgt

SEQ ID NO: 633433 - DNA, 17 bp, Homo sapiens
agtgttcaaattctgat

SEQ ID NO: 633434 - DNA, 18 bp, Homo sapiens
agtgttcaaattctgatt

SEQ ID NO: 633435 - DNA, 13 bp, Homo sapiens
agtgttctgtggc

SEQ ID NO: 633436 - DNA, 14 bp, Homo sapiens
agtgttctgtggct

SEQ ID NO: 633437 - DNA, 22 bp, Homo sapiens
agtgttggccatcatttcattc

SEQ ID NO: 633438 - DNA, 19 bp, Homo sapiens
agtgtttctagtaacagta

SEQ ID NO: 633439 - DNA, 13 bp, Homo sapiens
agtgttttcattc

SEQ ID NO: 633440 - DNA, 16 bp, Homo sapiens
agtgtttttacatata

SEQ ID NO: 633441 - DNA, 17 bp, Homo sapiens
agttaatctttgaaaac

SEQ ID NO: 633442 - DNA, 14 bp, Homo sapiens
agttaatgtgccaa

SEQ ID NO: 633443 - DNA, 14 bp, Homo sapiens
agttacagtggcag

SEQ ID NO: 633444 - DNA, 18 bp, Homo sapiens
agttacagtggcagtatt

SEQ ID NO: 633445 - DNA, 22 bp, Homo sapiens
agttacagtggcagtattgaca

SEQ ID NO: 633446 - DNA, 15 bp, Homo sapiens
agttataatttcaat

SEQ ID NO: 633447 - DNA, 15 bp, Homo sapiens
agttataccagcaaa

SEQ ID NO: 633448 - DNA, 15 bp, Homo sapiens
agttccattctatga

SEQ ID NO: 633449 - DNA, 16 bp, Homo sapiens
agttccattctatgac

SEQ ID NO: 633450 - DNA, 19 bp, Homo sapiens
agttcccttgattcaaata

SEQ ID NO: 633451 - DNA, 23 bp, Homo sapiens
agttcctgagtggatatgcgaat

SEQ ID NO: 633452 - DNA, 12 bp, Homo sapiens
agttctcatctt

SEQ ID NO: 633453 - DNA, 16 bp, Homo sapiens
agttctccttgtactt

SEQ ID NO: 633454 - DNA, 17 bp, Homo sapiens
agttctgcaataacagt

SEQ ID NO: 633455 - DNA, 14 bp, Homo sapiens
agttctgctgccct

SEQ ID NO: 633456 - DNA, 15 bp, Homo sapiens
agttctgctgccctc

SEQ ID NO: 633457 - DNA, 14 bp, Homo sapiens
agttctgtgcagtt

SEQ ID NO: 633458 - DNA, 18 bp, Homo sapiens
agttcttacgcttgacag

SEQ ID NO: 633459 - DNA, 17 bp, Homo sapiens
agttgaccaactatatt

SEQ ID NO: 633460 - DNA, 16 bp, Homo sapiens
agttgagccagcagac

SEQ ID NO: 633461 - DNA, 19 bp, Homo sapiens
agttgagccagcagacatt

SEQ ID NO: 633462 - DNA, 16 bp, Homo sapiens
agttgccacattgctt

SEQ ID NO: 633463 - DNA, 18 bp, Homo sapiens
agttgccgtggcaactgt

SEQ ID NO: 633464 - DNA, 19 bp, Homo sapiens
agttggttacctattgctg

SEQ ID NO: 633465 - DNA, 22 bp, Homo sapiens
agttgtaaagatattgtatctc

SEQ ID NO: 633466 - DNA, 22 bp, Homo sapiens
agttgtactggttagattcatt

SEQ ID NO: 633467 - DNA, 20 bp, Homo sapiens
agttgtattttaataaagat

SEQ ID NO: 633468 - DNA, 15 bp, Homo sapiens
agttgtcctttctga

SEQ ID NO: 633469 - DNA, 17 bp, Homo sapiens
agttgtcctttctgatc

SEQ ID NO: 633470 - DNA, 13 bp, Homo sapiens
agttgtcttacac

SEQ ID NO: 633471 - DNA, 20 bp, Homo sapiens
agttgtgatctgttgtaata

SEQ ID NO: 633472 - DNA, 14 bp, Homo sapiens
agtttaaaattatt

SEQ ID NO: 633473 - DNA, 17 bp, Homo sapiens
agtttaaaattattaaa

SEQ ID NO: 633474 - DNA, 20 bp, Homo sapiens
agtttaaatctttgttaaaa

SEQ ID NO: 633475 - DNA, 22 bp, Homo sapiens
agtttattgccctcaaaatctt

SEQ ID NO: 633476 - DNA, 14 bp, Homo sapiens
agtttcatttttca

SEQ ID NO: 633477 - DNA, 13 bp, Homo sapiens
agtttccatttgg

SEQ ID NO: 633478 - DNA, 14 bp, Homo sapiens
agtttccatttgga

SEQ ID NO: 633479 - DNA, 21 bp, Homo sapiens
agtttccatttggattttaaa

SEQ ID NO: 633480 - DNA, 19 bp, Homo sapiens
agtttctaaaccatgaaaa

SEQ ID NO: 633481 - DNA, 20 bp, Homo sapiens
agtttgctgtatacaaacag

SEQ ID NO: 633482 - DNA, 21 bp, Homo sapiens
agtttgctgtatacaaacagg

SEQ ID NO: 633483 - DNA, 17 bp, Homo sapiens
agtttggtatgaaacaa

SEQ ID NO: 633484 - DNA, 22 bp, Homo sapiens
agtttggtatgaaacaaatata

SEQ ID NO: 633485 - DNA, 23 bp, Homo sapiens
agttttaaaaaaataaaacattt

SEQ ID NO: 633486 - DNA, 15 bp, Homo sapiens
agttttatcttgaca

SEQ ID NO: 633487 - DNA, 14 bp, Homo sapiens
agttttcaagcatt

SEQ ID NO: 633488 - DNA, 17 bp, Homo sapiens
agttttcaagcattgct

SEQ ID NO: 633489 - DNA, 17 bp, Homo sapiens
agttttcttttaatttt

SEQ ID NO: 633490 - DNA, 20 bp, Homo sapiens
agtttttatacctgtacaca

SEQ ID NO: 633491 - DNA, 12 bp, Homo sapiens
ataaaagaaaga

SEQ ID NO: 633492 - DNA, 11 bp, Homo sapiens
ataaaagccca

SEQ ID NO: 633493 - DNA, 17 bp, Homo sapiens
ataaaatacacgtgtat

SEQ ID NO: 633494 - DNA, 20 bp, Homo sapiens
ataaaatacacgtgtatatg

SEQ ID NO: 633495 - DNA, 19 bp, Homo sapiens
ataaacacttctccttaac

SEQ ID NO: 633496 - DNA, 13 bp, Homo sapiens
ataaactccttaa

SEQ ID NO: 633497 - DNA, 10 bp, Homo sapiens
ataaactgtg

SEQ ID NO: 633498 - DNA, 17 bp, Homo sapiens
ataaactgtgagataaa

SEQ ID NO: 633499 - DNA, 20 bp, Homo sapiens
ataaactgtgagataaatat

SEQ ID NO: 633500 - DNA, 22 bp, Homo sapiens
ataaactgtgagataaatatca

SEQ ID NO: 633501 - DNA, 14 bp, Homo sapiens
ataaacttgtactt

SEQ ID NO: 633502 - DNA, 16 bp, Homo sapiens
ataaacttgtacttac

SEQ ID NO: 633503 - DNA, 22 bp, Homo sapiens
ataaagagttctccttgtactt

SEQ ID NO: 633504 - DNA, 18 bp, Homo sapiens
ataaagtaataactgtta

SEQ ID NO: 633505 - DNA, 16 bp, Homo sapiens
ataaataaaagaaaga

SEQ ID NO: 633506 - DNA, 13 bp, Homo sapiens
ataaatatcatta

SEQ ID NO: 633507 - DNA, 15 bp, Homo sapiens
ataaatatctattta

SEQ ID NO: 633508 - DNA, 16 bp, Homo sapiens
ataaatatctatttat

SEQ ID NO: 633509 - DNA, 21 bp, Homo sapiens
ataaatattgtcctgtttctt

SEQ ID NO: 633510 - DNA, 14 bp, Homo sapiens
ataaatcacagatt

SEQ ID NO: 633511 - DNA, 13 bp, Homo sapiens
ataaatctaaata

SEQ ID NO: 633512 - DNA, 21 bp, Homo sapiens
ataaatcttacccttcaatgt

SEQ ID NO: 633513 - DNA, 22 bp, Homo sapiens
ataaatcttacccttcaatgtt

SEQ ID NO: 633514 - DNA, 18 bp, Homo sapiens
ataaatcttccaaagttt

SEQ ID NO: 633515 - DNA, 18 bp, Homo sapiens
ataaatgaatgaaatata

SEQ ID NO: 633516 - DNA, 12 bp, Homo sapiens
ataaatgtttta

SEQ ID NO: 633517 - DNA, 17 bp, Homo sapiens
ataaattaatttttcaa

SEQ ID NO: 633518 - DNA, 21 bp, Homo sapiens
ataaattataatgcatctaaa

SEQ ID NO: 633519 - DNA, 14 bp, Homo sapiens
ataaattatttcta

SEQ ID NO: 633520 - DNA, 12 bp, Homo sapiens
ataaattttgga

SEQ ID NO: 633521 - DNA, 15 bp, Homo sapiens
ataaattttggaaga

SEQ ID NO: 633522 - DNA, 12 bp, Homo sapiens
ataacacacatc

SEQ ID NO: 633523 - DNA, 20 bp, Homo sapiens
ataacactgcagccctctcc

SEQ ID NO: 633524 - DNA, 20 bp, Homo sapiens
ataacagagtgatttgtaaa

SEQ ID NO: 633525 - DNA, 20 bp, Homo sapiens
atcattggtatctgatatct

SEQ ID NO: 633526 - DNA, 16 bp, Homo sapiens
atcatttccagcaaaa

SEQ ID NO: 633527 - DNA, 19 bp, Homo sapiens
atcatttccagcaaaatat

SEQ ID NO: 633528 - DNA, 20 bp, Homo sapiens
atcatttccagcaaaatata

SEQ ID NO: 633529 - DNA, 17 bp, Homo sapiens
atcattttgatgtatta

SEQ ID NO: 633530 - DNA, 21 bp, Homo sapiens
atcattttgatgtattattat

SEQ ID NO: 633531 - DNA, 18 bp, Homo sapiens
atccaacagaaagcatag

SEQ ID NO: 633532 - DNA, 14 bp, Homo sapiens
atccaactggaagg

SEQ ID NO: 633533 - DNA, 13 bp, Homo sapiens
atccacagtattg

SEQ ID NO: 633534 - DNA, 20 bp, Homo sapiens
atccacctggtggccctgcg

SEQ ID NO: 633535 - DNA, 20 bp, Homo sapiens
atccagagggttgtgatttt

SEQ ID NO: 633536 - DNA, 14 bp, Homo sapiens
atccagccttcttc

SEQ ID NO: 633537 - DNA, 18 bp, Homo sapiens
atccagggatggagatgg

SEQ ID NO: 633538 - DNA, 13 bp, Homo sapiens
atccatactgttt

SEQ ID NO: 633539 - DNA, 14 bp, Homo sapiens
atccatatcagctc

SEQ ID NO: 633540 - DNA, 16 bp, Homo sapiens
atccatcgatttgtat

SEQ ID NO: 633541 - DNA, 19 bp, Homo sapiens
atccatcggtttatactat

SEQ ID NO: 633542 - DNA, 18 bp, Homo sapiens
atccccatggaacagccc

SEQ ID NO: 633543 - DNA, 20 bp, Homo sapiens
atccccatggaacagccctg

SEQ ID NO: 633544 - DNA, 19 bp, Homo sapiens
atccccgtgctcacagtag

SEQ ID NO: 633545 - DNA, 13 bp, Homo sapiens
atcccctgcctct

SEQ ID NO: 633546 - DNA, 17 bp, Homo sapiens
atccctcggtcagcacc

SEQ ID NO: 633547 - DNA, 20 bp, Homo sapiens
atccctgaacatagttttca

SEQ ID NO: 633548 - DNA, 19 bp, Homo sapiens
atccctggacgcatgcagg

SEQ ID NO: 633549 - DNA, 12 bp, Homo sapiens
atccctggccac

SEQ ID NO: 633550 - DNA, 22 bp, Homo sapiens
atccctggccacctgccaggcc

SEQ ID NO: 633551 - DNA, 17 bp, Homo sapiens
atcccttggcccctctc

SEQ ID NO: 633552 - DNA, 12 bp, Homo sapiens
atccgagcccct

SEQ ID NO: 633553 - DNA, 16 bp, Homo sapiens
atccgagcccctgttt

SEQ ID NO: 633554 - DNA, 13 bp, Homo sapiens
atccgtctctgtc

SEQ ID NO: 633555 - DNA, 23 bp, Homo sapiens
atcctagcactttgggaggctga

SEQ ID NO: 633556 - DNA, 18 bp, Homo sapiens
atcctcaagttgtgtgct

SEQ ID NO: 633557 - DNA, 21 bp, Homo sapiens
atcctcaagttgtgtgctatt

SEQ ID NO: 633558 - DNA, 22 bp, Homo sapiens
atcctccgcggaggcccctgag

SEQ ID NO: 633559 - DNA, 15 bp, Homo sapiens
atcctgagccagatt

SEQ ID NO: 633560 - DNA, 23 bp, Homo sapiens
atccttaaaaagaccatgcattc

SEQ ID NO: 633561 - DNA, 14 bp, Homo sapiens
atccttcccgcagc

SEQ ID NO: 633562 - DNA, 17 bp, Homo sapiens
atccttcccgcagcacc

SEQ ID NO: 633563 - DNA, 19 bp, Homo sapiens
atccttcccgcagcaccag

SEQ ID NO: 633564 - DNA, 22 bp, Homo sapiens
atccttcccgcagcaccagcct

SEQ ID NO: 633565 - DNA, 15 bp, Homo sapiens
atccttgtcagttgt

SEQ ID NO: 633566 - DNA, 17 bp, Homo sapiens
atcgtttcacatctgta

SEQ ID NO: 633567 - DNA, 19 bp, Homo sapiens
atcgtttcacatctgtata

SEQ ID NO: 633568 - DNA, 18 bp, Homo sapiens
atctacaaacttttataa

SEQ ID NO: 633569 - DNA, 20 bp, Homo sapiens
atctagtaggtctgcacaca

SEQ ID NO: 633570 - DNA, 22 bp, Homo sapiens
atctagtaggtctgcacacata

SEQ ID NO: 633571 - DNA, 13 bp, Homo sapiens
atctagtgccatt

SEQ ID NO: 633572 - DNA, 19 bp, Homo sapiens
atctagtgccattatttct

SEQ ID NO: 633573 - DNA, 20 bp, Homo sapiens
atctcaggtggcatttgcag

SEQ ID NO: 633574 - DNA, 15 bp, Homo sapiens
atctcatagatgacc

SEQ ID NO: 633575 - DNA, 16 bp, Homo sapiens
atctcattagggcttt

SEQ ID NO: 633576 - DNA, 17 bp, Homo sapiens
atctccagccaatttca

SEQ ID NO: 633577 - DNA, 19 bp, Homo sapiens
atctccagccaatttcaaa

SEQ ID NO: 633578 - DNA, 13 bp, Homo sapiens
atctcgctagcca

SEQ ID NO: 633579 - DNA, 14 bp, Homo sapiens
atctctcaaaatgt

SEQ ID NO: 633580 - DNA, 19 bp, Homo sapiens
atctctcaaaatgtgccgt

SEQ ID NO: 633581 - DNA, 12 bp, Homo sapiens
atctgaaatcta

SEQ ID NO: 633582 - DNA, 13 bp, Homo sapiens
atctgaaatctac

SEQ ID NO: 633583 - DNA, 15 bp, Homo sapiens
atctgaaatctacaa

SEQ ID NO: 633584 - DNA, 12 bp, Homo sapiens
atctgaagtagt

SEQ ID NO: 633585 - DNA, 21 bp, Homo sapiens
atctgaagtagtgtgagtgtt

SEQ ID NO: 633586 - DNA, 17 bp, Homo sapiens
atctgacatatttcata

SEQ ID NO: 633587 - DNA, 17 bp, Homo sapiens
atctgactgccaaataa

SEQ ID NO: 633588 - DNA, 20 bp, Homo sapiens
atctgagaaagtactttctg

SEQ ID NO: 633589 - DNA, 14 bp, Homo sapiens
atctgaggagtcca

SEQ ID NO: 633590 - DNA, 20 bp, Homo sapiens
atctgatatcaggaaatatc

SEQ ID NO: 633591 - DNA, 16 bp, Homo sapiens
atctgatgatgttctg

SEQ ID NO: 633592 - DNA, 14 bp, Homo sapiens
atctgatttctgaa

SEQ ID NO: 633593 - DNA, 15 bp, Homo sapiens
atctgcctggagcct

SEQ ID NO: 633594 - DNA, 17 bp, Homo sapiens
atctgcctggagcctgg

SEQ ID NO: 633595 - DNA, 17 bp, Homo sapiens
atctgctttcatccagc

SEQ ID NO: 633596 - DNA, 12 bp, Homo sapiens
atctggccctga

SEQ ID NO: 633597 - DNA, 22 bp, Homo sapiens
atctgggttttagaaattctat

SEQ ID NO: 633598 - DNA, 23 bp, Homo sapiens
atctggtgcgtgtggccctgtgg

SEQ ID NO: 633599 - DNA, 15 bp, Homo sapiens
atctgtcagcttccc

SEQ ID NO: 633600 - DNA, 18 bp, Homo sapiens
atctgtcagcttcccaac

SEQ ID NO: 633601 - DNA, 14 bp, Homo sapiens
atctgtctttatga

SEQ ID NO: 633602 - DNA, 21 bp, Homo sapiens
atctgtgtaacctccacagta

SEQ ID NO: 633603 - DNA, 11 bp, Homo sapiens
atctgttgtaa

SEQ ID NO: 633604 - DNA, 14 bp, Homo sapiens
atctgttgtaatat

SEQ ID NO: 633605 - DNA, 15 bp, Homo sapiens
atctgttgtaatatc

SEQ ID NO: 633606 - DNA, 23 bp, Homo sapiens
atctgttgtaatatcagttacag

SEQ ID NO: 633607 - DNA, 14 bp, Homo sapiens
atctgtttgcttct

SEQ ID NO: 633608 - DNA, 16 bp, Homo sapiens
atctgtttgcttctaa

SEQ ID NO: 633609 - DNA, 17 bp, Homo sapiens
atctgtttgcttctaaa

SEQ ID NO: 633610 - DNA, 19 bp, Homo sapiens
atcttaaaagggtggtagt

SEQ ID NO: 633611 - DNA, 20 bp, Homo sapiens
atcttacacgaagaaataga

SEQ ID NO: 633612 - DNA, 22 bp, Homo sapiens
atcttacacgaagaaatagaat

SEQ ID NO: 633613 - DNA, 19 bp, Homo sapiens
atcttgaaagcgaaatact

SEQ ID NO: 633614 - DNA, 17 bp, Homo sapiens
atcttgagcaaggcaag

SEQ ID NO: 633615 - DNA, 20 bp, Homo sapiens
atcttgggattcctcccctg

SEQ ID NO: 633616 - DNA, 22 bp, Homo sapiens
atcttgtaaataatgcttaaca

SEQ ID NO: 633617 - DNA, 13 bp, Homo sapiens
atctttcaggaaa

SEQ ID NO: 633618 - DNA, 14 bp, Homo sapiens
atctttcaggaaat

SEQ ID NO: 633619 - DNA, 16 bp, Homo sapiens
atctttttttaagtgt

SEQ ID NO: 633620 - DNA, 14 bp, Homo sapiens
atgaaaaagcatgt

SEQ ID NO: 633621 - DNA, 15 bp, Homo sapiens
atgaaaaagcatgta

SEQ ID NO: 633622 - DNA, 14 bp, Homo sapiens
atgaaaaatctgaa

SEQ ID NO: 633623 - DNA, 13 bp, Homo sapiens
atgaaacaaatat

SEQ ID NO: 633624 - DNA, 19 bp, Homo sapiens
atgaaagtcaagtctacct

SEQ ID NO: 633625 - DNA, 18 bp, Homo sapiens
atgaaatataaactgtga

SEQ ID NO: 633626 - DNA, 14 bp, Homo sapiens
atgaaatttaagca

SEQ ID NO: 633627 - DNA, 22 bp, Homo sapiens
atgaagcagaatgagatgattt

SEQ ID NO: 633628 - DNA, 14 bp, Homo sapiens
atgaagctgccatc

SEQ ID NO: 633629 - DNA, 21 bp, Homo sapiens
atgaagctgccatccttgctg

SEQ ID NO: 633630 - DNA, 22 bp, Homo sapiens
atgaagctgccatccttgctgc

SEQ ID NO: 633631 - DNA, 21 bp, Homo sapiens
atgaaggcaaaaactgtactg

SEQ ID NO: 633632 - DNA, 16 bp, Homo sapiens
atgaataaaatgttta

SEQ ID NO: 633633 - DNA, 20 bp, Homo sapiens
atgaatccatcgatttgtat

SEQ ID NO: 633634 - DNA, 23 bp, Homo sapiens
atgaatcgcagacgcaagaggtt

SEQ ID NO: 633635 - DNA, 13 bp, Homo sapiens
atgaatgaaatat

SEQ ID NO: 633636 - DNA, 14 bp, Homo sapiens
atgaatgaaatata

SEQ ID NO: 633637 - DNA, 22 bp, Homo sapiens
atgaatgaaatataaactgtga

SEQ ID NO: 633638 - DNA, 18 bp, Homo sapiens
atgaatggttctttatca

SEQ ID NO: 633639 - DNA, 21 bp, Homo sapiens
atgaatgtgtgtggttttttt

SEQ ID NO: 633640 - DNA, 15 bp, Homo sapiens
atgaatttatcattt

SEQ ID NO: 633641 - DNA, 19 bp, Homo sapiens
atgaatttatcattttagt

SEQ ID NO: 633642 - DNA, 15 bp, Homo sapiens
attgccttcagccct

SEQ ID NO: 633643 - DNA, 18 bp, Homo sapiens
attgccttgatgtttcta

SEQ ID NO: 633644 - DNA, 13 bp, Homo sapiens
attgcgagaaaca

SEQ ID NO: 633645 - DNA, 13 bp, Homo sapiens
attgctgagatgt

SEQ ID NO: 633646 - DNA, 16 bp, Homo sapiens
attgctgatggtgcaa

SEQ ID NO: 633647 - DNA, 18 bp, Homo sapiens
attgctgatggtgcaatg

SEQ ID NO: 633648 - DNA, 22 bp, Homo sapiens
attgctgtaaataaaaatagct

SEQ ID NO: 633649 - DNA, 23 bp, Homo sapiens
attgctgtctgaaaaagtgtttt

SEQ ID NO: 633650 - DNA, 19 bp, Homo sapiens
attgcttcattaaaacaag

SEQ ID NO: 633651 - DNA, 13 bp, Homo sapiens
attgcttgagcat

SEQ ID NO: 633652 - DNA, 15 bp, Homo sapiens
attggaaaaaattag

SEQ ID NO: 633653 - DNA, 20 bp, Homo sapiens
attggaggatgggggtcctg

SEQ ID NO: 633654 - DNA, 14 bp, Homo sapiens
attggatcaggaac

SEQ ID NO: 633655 - DNA, 23 bp, Homo sapiens
attggcaaaattacagttcacac

SEQ ID NO: 633656 - DNA, 13 bp, Homo sapiens
attggcagcagat

SEQ ID NO: 633657 - DNA, 16 bp, Homo sapiens
attgggggggcttggg

SEQ ID NO: 633658 - DNA, 14 bp, Homo sapiens
attggttaatgaaa

SEQ ID NO: 633659 - DNA, 21 bp, Homo sapiens
attggttaatgaaaaatctga

SEQ ID NO: 633660 - DNA, 18 bp, Homo sapiens
attgtaaaggtaggtgca

SEQ ID NO: 633661 - DNA, 20 bp, Homo sapiens
attgtaaaggtgatgaattt

SEQ ID NO: 633662 - DNA, 17 bp, Homo sapiens
attgtaacagacattgt

SEQ ID NO: 633663 - DNA, 16 bp, Homo sapiens
attgtatatatatgtg

SEQ ID NO: 633664 - DNA, 14 bp, Homo sapiens
attgtatctccttt

SEQ ID NO: 633665 - DNA, 13 bp, Homo sapiens
attgtcctgtagc

SEQ ID NO: 633666 - DNA, 14 bp, Homo sapiens
attgtcctgtagct

SEQ ID NO: 633667 - DNA, 14 bp, Homo sapiens
attgtctcagtgaa

SEQ ID NO: 633668 - DNA, 15 bp, Homo sapiens
attgtctcagtgaag

SEQ ID NO: 633669 - DNA, 11 bp, Homo sapiens
attgtgccaaa

SEQ ID NO: 633670 - DNA, 15 bp, Homo sapiens
attgtgccaaagata

SEQ ID NO: 633671 - DNA, 16 bp, Homo sapiens
attgtgccaaagatag

SEQ ID NO: 633672 - DNA, 18 bp, Homo sapiens
attgtgtcttttgcatga

SEQ ID NO: 633673 - DNA, 16 bp, Homo sapiens
attgtttaaagcaact

SEQ ID NO: 633674 - DNA, 20 bp, Homo sapiens
attgtttgatgaataaaatg

SEQ ID NO: 633675 - DNA, 22 bp, Homo sapiens
attgtttgatgaataaaatgtt

SEQ ID NO: 633676 - DNA, 23 bp, Homo sapiens
attgtttgatgaataaaatgttt

SEQ ID NO: 633677 - DNA, 18 bp, Homo sapiens
attgttttggtttgctac

SEQ ID NO: 633678 - DNA, 16 bp, Homo sapiens
attgtttttagaaatt

SEQ ID NO: 633679 - DNA, 17 bp, Homo sapiens
atttaaatgtctaatgt

SEQ ID NO: 633680 - DNA, 22 bp, Homo sapiens
atttaagagattttatgtttaa

SEQ ID NO: 633681 - DNA, 19 bp, Homo sapiens
atttaagcacaaaaaattt

SEQ ID NO: 633682 - DNA, 21 bp, Homo sapiens
atttaatcatttccagcaaaa

SEQ ID NO: 633683 - DNA, 23 bp, Homo sapiens
atttaattcttaccgaaatgaaa

SEQ ID NO: 633684 - DNA, 22 bp, Homo sapiens
atttaatttgatatcacagtct

SEQ ID NO: 633685 - DNA, 21 bp, Homo sapiens
atttacaacttccagatttga

SEQ ID NO: 633686 - DNA, 14 bp, Homo sapiens
atttaccacaggat

SEQ ID NO: 633687 - DNA, 20 bp, Homo sapiens
atttaccacaggatgcatat

SEQ ID NO: 633688 - DNA, 14 bp, Homo sapiens
atttaccagaagtt

SEQ ID NO: 633689 - DNA, 17 bp, Homo sapiens
atttaccagaagtttaa

SEQ ID NO: 633690 - DNA, 23 bp, Homo sapiens
atttaccatcaaacaaatcattt

SEQ ID NO: 633691 - DNA, 13 bp, Homo sapiens
atttactaacagt

SEQ ID NO: 633692 - DNA, 15 bp, Homo sapiens
atttactaacagtaa

SEQ ID NO: 633693 - DNA, 18 bp, Homo sapiens
atttactaacagtaactg

SEQ ID NO: 633694 - DNA, 22 bp, Homo sapiens
atttactaacagtaactgccat

SEQ ID NO: 633695 - DNA, 23 bp, Homo sapiens
atttactaacagtaactgccatt

SEQ ID NO: 633696 - DNA, 15 bp, Homo sapiens
atttactgcaatgtc

SEQ ID NO: 633697 - DNA, 22 bp, Homo sapiens
atttagaagataggtgagcaac

SEQ ID NO: 633698 - DNA, 15 bp, Homo sapiens
atttagcacagtatt

SEQ ID NO: 633699 - DNA, 18 bp, Homo sapiens
atttagcatgagttctgc

SEQ ID NO: 633700 - DNA, 21 bp, Homo sapiens
atttagggttctatatttact

SEQ ID NO: 633701 - DNA, 17 bp, Homo sapiens
atttataacattgtaaa

SEQ ID NO: 633702 - DNA, 15 bp, Homo sapiens
atttatagagttcat

SEQ ID NO: 633703 - DNA, 14 bp, Homo sapiens
atttatcaatattt

SEQ ID NO: 633704 - DNA, 17 bp, Homo sapiens
atttatcatatttaata

SEQ ID NO: 633705 - DNA, 17 bp, Homo sapiens
atttatctgtctgagcc

SEQ ID NO: 633706 - DNA, 16 bp, Homo sapiens
atttatgaagatagtt

SEQ ID NO: 633707 - DNA, 20 bp, Homo sapiens
atttatgatataataaatat

SEQ ID NO: 633708 - DNA, 14 bp, Homo sapiens
atttatgcatgaga

SEQ ID NO: 633709 - DNA, 15 bp, Homo sapiens
atttatgcatgagaa

SEQ ID NO: 633710 - DNA, 12 bp, Homo sapiens
atttatgcattt

SEQ ID NO: 633711 - DNA, 12 bp, Homo sapiens
atttatgtgtga

SEQ ID NO: 633712 - DNA, 15 bp, Homo sapiens
atttattaaatttat

SEQ ID NO: 633713 - DNA, 23 bp, Homo sapiens
atttattaaatttattaaatgtt

SEQ ID NO: 633714 - DNA, 15 bp, Homo sapiens
atttattattttcat

SEQ ID NO: 633715 - DNA, 14 bp, Homo sapiens
atttattctaatta

SEQ ID NO: 633716 - DNA, 11 bp, Homo sapiens
atttattctgg

SEQ ID NO: 633717 - DNA, 15 bp, Homo sapiens
atttattcttatctt

SEQ ID NO: 633718 - DNA, 20 bp, Homo sapiens
atttattgtatatatggata

SEQ ID NO: 633719 - DNA, 14 bp, Homo sapiens
atttatttaaatgt

SEQ ID NO: 633720 - DNA, 13 bp, Homo sapiens
atttatttattgt

SEQ ID NO: 633721 - DNA, 19 bp, Homo sapiens
atttcaaccacacctaaat

SEQ ID NO: 633722 - DNA, 17 bp, Homo sapiens
atttcaaggaatagagt

SEQ ID NO: 633723 - DNA, 14 bp, Homo sapiens
atttcactctcctt

SEQ ID NO: 633724 - DNA, 14 bp, Homo sapiens
atttcaggattctc

SEQ ID NO: 633725 - DNA, 19 bp, Homo sapiens
atttcataagcacatccaa

SEQ ID NO: 633726 - DNA, 23 bp, Homo sapiens
atttcatgattagacaatgtgga

SEQ ID NO: 633727 - DNA, 14 bp, Homo sapiens
atttcatgcacaca

SEQ ID NO: 633728 - DNA, 12 bp, Homo sapiens
atttcattcgtg

SEQ ID NO: 633729 - DNA, 17 bp, Homo sapiens
atttccagcaaaatata

SEQ ID NO: 633730 - DNA, 16 bp, Homo sapiens
atttcccctgtggttt

SEQ ID NO: 633731 - DNA, 21 bp, Homo sapiens
atttccgtgagagtcatctca

SEQ ID NO: 633732 - DNA, 14 bp, Homo sapiens
atttcctgctcctc

SEQ ID NO: 633733 - DNA, 12 bp, Homo sapiens
atttccttgtct

SEQ ID NO: 633734 - DNA, 20 bp, Homo sapiens
atttctaaaacattaattga

SEQ ID NO: 633735 - DNA, 19 bp, Homo sapiens
atttctctggggtctgtga

SEQ ID NO: 633736 - DNA, 17 bp, Homo sapiens
atttctggccatttaac

SEQ ID NO: 633737 - DNA, 16 bp, Homo sapiens
atttctgtatctgaca

SEQ ID NO: 633738 - DNA, 22 bp, Homo sapiens
atttcttatttgtttggtcact

SEQ ID NO: 633739 - DNA, 24 bp, Homo sapiens
atttcttatttgtttggtcactgc

SEQ ID NO: 633740 - DNA, 13 bp, Homo sapiens
atttctttggaaa

SEQ ID NO: 633741 - DNA, 13 bp, Homo sapiens
atttgacacactc

SEQ ID NO: 633742 - DNA, 17 bp, Homo sapiens
atttgacattgtcagaa

SEQ ID NO: 633743 - DNA, 15 bp, Homo sapiens
atttgaggaaactca

SEQ ID NO: 633744 - DNA, 20 bp, Homo sapiens
atttgataatcagtttccac

SEQ ID NO: 633745 - DNA, 20 bp, Homo sapiens
atttgatatacagacctcca

SEQ ID NO: 633746 - DNA, 22 bp, Homo sapiens
atttgcaacactgccaaacatc

SEQ ID NO: 633747 - DNA, 22 bp, Homo sapiens
atttgccagacagagatcagaa

SEQ ID NO: 633748 - DNA, 20 bp, Homo sapiens
atttgctcataagtaaatgt

SEQ ID NO: 633749 - DNA, 21 bp, Homo sapiens
atttgctcataagtaaatgtc

SEQ ID NO: 633750 - DNA, 19 bp, Homo sapiens
atttgctgaataacaacaa

SEQ ID NO: 633751 - DNA, 20 bp, Homo sapiens
atttgctgaataacaacaat

SEQ ID NO: 633752 - DNA, 13 bp, Homo sapiens
atttggattcaca

SEQ ID NO: 633753 - DNA, 22 bp, Homo sapiens
atttggggctacttatattctg

SEQ ID NO: 633754 - DNA, 17 bp, Homo sapiens
atttgggtattttgtca

SEQ ID NO: 633755 - DNA, 17 bp, Homo sapiens
atttgtaaaacagtggt

SEQ ID NO: 633756 - DNA, 13 bp, Homo sapiens
atttgtattaatg

SEQ ID NO: 633757 - DNA, 16 bp, Homo sapiens
atttgttaatgattct

SEQ ID NO: 633758 - DNA, 16 bp, Homo sapiens
atttgtttcattaaag

SEQ ID NO: 633759 - DNA, 15 bp, Homo sapiens
cacccgccccagaga

SEQ ID NO: 633760 - DNA, 16 bp, Homo sapiens
cacccgccccagagac

SEQ ID NO: 633761 - DNA, 19 bp, Homo sapiens
cacccgccccagagactgc

SEQ ID NO: 633762 - DNA, 22 bp, Homo sapiens
cacccgccccagagactgccca

SEQ ID NO: 633763 - DNA, 18 bp, Homo sapiens
caccctccacaggagccg

SEQ ID NO: 633764 - DNA, 14 bp, Homo sapiens
caccctcccctctc

SEQ ID NO: 633765 - DNA, 17 bp, Homo sapiens
caccctcccctctcctg

SEQ ID NO: 633766 - DNA, 19 bp, Homo sapiens
caccctccggccagcgagt

SEQ ID NO: 633767 - DNA, 22 bp, Homo sapiens
caccctcctgcccccccacccc

SEQ ID NO: 633768 - DNA, 20 bp, Homo sapiens
caccctgaattcattgtctc

SEQ ID NO: 633769 - DNA, 22 bp, Homo sapiens
caccctgaattcattgtctcag

SEQ ID NO: 633770 - DNA, 17 bp, Homo sapiens
caccctgcaggcaggca

SEQ ID NO: 633771 - DNA, 13 bp, Homo sapiens
caccctgggcctc

SEQ ID NO: 633772 - DNA, 16 bp, Homo sapiens
caccctgggcctcccg

SEQ ID NO: 633773 - DNA, 18 bp, Homo sapiens
caccctgggcctcccgtc

SEQ ID NO: 633774 - DNA, 13 bp, Homo sapiens
cacccttccccac

SEQ ID NO: 633775 - DNA, 14 bp, Homo sapiens
cacccttccccact

SEQ ID NO: 633776 - DNA, 17 bp, Homo sapiens
cacccttccccactccc

SEQ ID NO: 633777 - DNA, 19 bp, Homo sapiens
caccgaaaacgtggctgct

SEQ ID NO: 633778 - DNA, 21 bp, Homo sapiens
caccgaaaacgtggctgcttc

SEQ ID NO: 633779 - DNA, 20 bp, Homo sapiens
caccgcccaacccccacctc

SEQ ID NO: 633780 - DNA, 13 bp, Homo sapiens
caccgcccaccca

SEQ ID NO: 633781 - DNA, 16 bp, Homo sapiens
caccgcccacccacac

SEQ ID NO: 633782 - DNA, 14 bp, Homo sapiens
caccgcgcccctct

SEQ ID NO: 633783 - DNA, 21 bp, Homo sapiens
caccgtggtgtgaggcccccg

SEQ ID NO: 633784 - DNA, 23 bp, Homo sapiens
caccgtggtgtgaggcccccgga

SEQ ID NO: 633785 - DNA, 18 bp, Homo sapiens
cacctaaagggaagccct

SEQ ID NO: 633786 - DNA, 23 bp, Homo sapiens
cacctaaatttttgtaagaaaat

SEQ ID NO: 633787 - DNA, 14 bp, Homo sapiens
cacctccacccgtc

SEQ ID NO: 633788 - DNA, 16 bp, Homo sapiens
cacctccccagagccc

SEQ ID NO: 633789 - DNA, 22 bp, Homo sapiens
cacctcccggtgtatgcagtgg

SEQ ID NO: 633790 - DNA, 22 bp, Homo sapiens
cacctcccttcatcccagggta

SEQ ID NO: 633791 - DNA, 23 bp, Homo sapiens
cacctcccttcatcccagggtat

SEQ ID NO: 633792 - DNA, 16 bp, Homo sapiens
cacctccgggactgac

SEQ ID NO: 633793 - DNA, 20 bp, Homo sapiens
cacctccgggactgaccttc

SEQ ID NO: 633794 - DNA, 13 bp, Homo sapiens
cacctcctccgtg

SEQ ID NO: 633795 - DNA, 13 bp, Homo sapiens
cacctctgaggac

SEQ ID NO: 633796 - DNA, 16 bp, Homo sapiens
cacctctgaggacaga

SEQ ID NO: 633797 - DNA, 19 bp, Homo sapiens
cacctgccaggcctccctc

SEQ ID NO: 633798 - DNA, 11 bp, Homo sapiens
cacctgcccag

SEQ ID NO: 633799 - DNA, 12 bp, Homo sapiens
cacctgcccagt

SEQ ID NO: 633800 - DNA, 18 bp, Homo sapiens
cacctgcccagttagccc

SEQ ID NO: 633801 - DNA, 22 bp, Homo sapiens
cacctgcccagttagcccggcc

SEQ ID NO: 633802 - DNA, 14 bp, Homo sapiens
cacctgcttctcag

SEQ ID NO: 633803 - DNA, 17 bp, Homo sapiens
cacctggtggccctgcg

SEQ ID NO: 633804 - DNA, 13 bp, Homo sapiens
caccttaaaacat

SEQ ID NO: 633805 - DNA, 15 bp, Homo sapiens
caccttacaaagcca

SEQ ID NO: 633806 - DNA, 16 bp, Homo sapiens
caccttacaaagccag

SEQ ID NO: 633807 - DNA, 15 bp, Homo sapiens
caccttcctgcccag

SEQ ID NO: 633808 - DNA, 15 bp, Homo sapiens
caccttctgtgcatc

SEQ ID NO: 633809 - DNA, 13 bp, Homo sapiens
caccttctgtttt

SEQ ID NO: 633810 - DNA, 20 bp, Homo sapiens
caccttgggcacgggagagc

SEQ ID NO: 633811 - DNA, 23 bp, Homo sapiens
caccttgggcacgggagagcgcc

SEQ ID NO: 633812 - DNA, 18 bp, Homo sapiens
caccttgtacagaaccag

SEQ ID NO: 633813 - DNA, 23 bp, Homo sapiens
caccttgtacagaaccagcactc

SEQ ID NO: 633814 - DNA, 14 bp, Homo sapiens
cacctttccgtgcc

SEQ ID NO: 633815 - DNA, 12 bp, Homo sapiens
cacgaagaaata

SEQ ID NO: 633816 - DNA, 13 bp, Homo sapiens
cacgaagaaatag

SEQ ID NO: 633817 - DNA, 22 bp, Homo sapiens
cacgaatattgctgatggtgca

SEQ ID NO: 633818 - DNA, 17 bp, Homo sapiens
cacgacataagctggta

SEQ ID NO: 633819 - DNA, 21 bp, Homo sapiens
cacgaggagcttccagtgcat

SEQ ID NO: 633820 - DNA, 13 bp, Homo sapiens
cacgcaacttgaa

SEQ ID NO: 633821 - DNA, 18 bp, Homo sapiens
cacgcagagccccggagc

SEQ ID NO: 633822 - DNA, 20 bp, Homo sapiens
cacgcagagccccggagcac

SEQ ID NO: 633823 - DNA, 15 bp, Homo sapiens
cacgcccctccccag

SEQ ID NO: 633824 - DNA, 18 bp, Homo sapiens
cacgcccctccccagccc

SEQ ID NO: 633825 - DNA, 15 bp, Homo sapiens
cacgcccctgcctga

SEQ ID NO: 633826 - DNA, 23 bp, Homo sapiens
cacgccgatataagccatagccc

SEQ ID NO: 633827 - DNA, 16 bp, Homo sapiens
cacgccggggctggcc

SEQ ID NO: 633828 - DNA, 21 bp, Homo sapiens
cacgccggggctggccctgcc

SEQ ID NO: 633829 - DNA, 14 bp, Homo sapiens
cacggagtttccat

SEQ ID NO: 633830 - DNA, 14 bp, Homo sapiens
cacggcagcttgag

SEQ ID NO: 633831 - DNA, 13 bp, Homo sapiens
cacggccgtccct

SEQ ID NO: 633832 - DNA, 16 bp, Homo sapiens
cacggccgtccctgac

SEQ ID NO: 633833 - DNA, 21 bp, Homo sapiens
cacggccgtccctgacttccc

SEQ ID NO: 633834 - DNA, 19 bp, Homo sapiens
cacgggagagcgccacccg

SEQ ID NO: 633835 - DNA, 14 bp, Homo sapiens
cacgggcccgctca

SEQ ID NO: 633836 - DNA, 18 bp, Homo sapiens
cacggtccaatccagcct

SEQ ID NO: 633837 - DNA, 19 bp, Homo sapiens
cacggtcctttgagtgtca

SEQ ID NO: 633838 - DNA, 22 bp, Homo sapiens
cacggtgtggggggtgccccac

SEQ ID NO: 633839 - DNA, 18 bp, Homo sapiens
cacgtgaggcccctgtgc

SEQ ID NO: 633840 - DNA, 15 bp, Homo sapiens
cacgtgcagcacctg

SEQ ID NO: 633841 - DNA, 16 bp, Homo sapiens
cacgtgcagcacctgt

SEQ ID NO: 633842 - DNA, 22 bp, Homo sapiens
cacgtgcagcacctgtcacctt

SEQ ID NO: 633843 - DNA, 15 bp, Homo sapiens
cacgtggggtggaat

SEQ ID NO: 633844 - DNA, 12 bp, Homo sapiens
cacgtgtatatg

SEQ ID NO: 633845 - DNA, 20 bp, Homo sapiens
cacgtgtgcagactgtggct

SEQ ID NO: 633846 - DNA, 14 bp, Homo sapiens
cactaaaagtgatg

SEQ ID NO: 633847 - DNA, 17 bp, Homo sapiens
cactaagctttctcctt

SEQ ID NO: 633848 - DNA, 18 bp, Homo sapiens
cactaagctttctccttt

SEQ ID NO: 633849 - DNA, 20 bp, Homo sapiens
cactaagctttctcctttga

SEQ ID NO: 633850 - DNA, 12 bp, Homo sapiens
cactacaaacat

SEQ ID NO: 633851 - DNA, 20 bp, Homo sapiens
cactacatgggccagccctt

SEQ ID NO: 633852 - DNA, 14 bp, Homo sapiens
cactacctttgtcc

SEQ ID NO: 633853 - DNA, 13 bp, Homo sapiens
cactagaatgaga

SEQ ID NO: 633854 - DNA, 16 bp, Homo sapiens
cactagaatgagaaat

SEQ ID NO: 633855 - DNA, 16 bp, Homo sapiens
cactcaagactatgtt

SEQ ID NO: 633856 - DNA, 14 bp, Homo sapiens
cactcagcagcccc

SEQ ID NO: 633857 - DNA, 13 bp, Homo sapiens
cactcaggagcac

SEQ ID NO: 633858 - DNA, 16 bp, Homo sapiens
cactcaggagcacagc

SEQ ID NO: 633859 - DNA, 20 bp, Homo sapiens
cactcaggagcacagccata

SEQ ID NO: 633860 - DNA, 18 bp, Homo sapiens
cactcatcccccatcaga

SEQ ID NO: 633861 - DNA, 12 bp, Homo sapiens
cactcccagggc

SEQ ID NO: 633862 - DNA, 13 bp, Homo sapiens
cactcccagggcc

SEQ ID NO: 633863 - DNA, 15 bp, Homo sapiens
cactcccagggcccg

SEQ ID NO: 633864 - DNA, 19 bp, Homo sapiens
cactccccccatcctacct

SEQ ID NO: 633865 - DNA, 14 bp, Homo sapiens
cactcctcccaact

SEQ ID NO: 633866 - DNA, 12 bp, Homo sapiens
cactctccttgg

SEQ ID NO: 633867 - DNA, 11 bp, Homo sapiens
cactctgaagt

SEQ ID NO: 633868 - DNA, 19 bp, Homo sapiens
cactctgaagtcccttcct

SEQ ID NO: 633869 - DNA, 12 bp, Homo sapiens
cactctgagact

SEQ ID NO: 633870 - DNA, 23 bp, Homo sapiens
cactctgagactcgcgacaatgc

SEQ ID NO: 633871 - DNA, 14 bp, Homo sapiens
cactgaagagtatg

SEQ ID NO: 633872 - DNA, 18 bp, Homo sapiens
cactgaatctgagaaagt

SEQ ID NO: 633873 - DNA, 17 bp, Homo sapiens
cactgagtgaaatatta

SEQ ID NO: 633874 - DNA, 19 bp, Homo sapiens
cactgatatcacgggcccg

SEQ ID NO: 633875 - DNA, 21 bp, Homo sapiens
cactgatatcacgggcccgct

SEQ ID NO: 633876 - DNA, 15 bp, Homo sapiens
caggagaccctgtct

SEQ ID NO: 633877 - DNA, 20 bp, Homo sapiens
caggagactccaaggagcta

SEQ ID NO: 633878 - DNA, 17 bp, Homo sapiens
caggagatgaggctgga

SEQ ID NO: 633879 - DNA, 17 bp, Homo sapiens
caggagcacagccatag

SEQ ID NO: 633880 - DNA, 19 bp, Homo sapiens
caggagccgcagaggcccg

SEQ ID NO: 633881 - DNA, 16 bp, Homo sapiens
caggagcgtgtactac

SEQ ID NO: 633882 - DNA, 16 bp, Homo sapiens
caggagcgtgtcctat

SEQ ID NO: 633883 - DNA, 19 bp, Homo sapiens
caggaggacagagtgccct

SEQ ID NO: 633884 - DNA, 20 bp, Homo sapiens
caggaggacagagtgccctg

SEQ ID NO: 633885 - DNA, 13 bp, Homo sapiens
caggaggacctgg

SEQ ID NO: 633886 - DNA, 17 bp, Homo sapiens
caggaggactgttctaa

SEQ ID NO: 633887 - DNA, 19 bp, Homo sapiens
caggatgaaggggccagac

SEQ ID NO: 633888 - DNA, 18 bp, Homo sapiens
caggatgcatattaaaga

SEQ ID NO: 633889 - DNA, 15 bp, Homo sapiens
caggatgcatgcagg

SEQ ID NO: 633890 - DNA, 18 bp, Homo sapiens
caggcaccatgctgggcc

SEQ ID NO: 633891 - DNA, 13 bp, Homo sapiens
caggcagcctgtg

SEQ ID NO: 633892 - DNA, 18 bp, Homo sapiens
caggcagcctgtgggtcc

SEQ ID NO: 633893 - DNA, 17 bp, Homo sapiens
caggcatattattttct

SEQ ID NO: 633894 - DNA, 18 bp, Homo sapiens
caggcatgcaccagtgcc

SEQ ID NO: 633895 - DNA, 21 bp, Homo sapiens
caggcattgcactaaaagtga

SEQ ID NO: 633896 - DNA, 17 bp, Homo sapiens
caggcatttagctagtt

SEQ ID NO: 633897 - DNA, 15 bp, Homo sapiens
caggcccagcctctt

SEQ ID NO: 633898 - DNA, 12 bp, Homo sapiens
caggcccgccct

SEQ ID NO: 633899 - DNA, 16 bp, Homo sapiens
caggcccgccctgccc

SEQ ID NO: 633900 - DNA, 16 bp, Homo sapiens
caggccctccagcagg

SEQ ID NO: 633901 - DNA, 13 bp, Homo sapiens
caggcctcaggga

SEQ ID NO: 633902 - DNA, 16 bp, Homo sapiens
caggcctcagggacca

SEQ ID NO: 633903 - DNA, 15 bp, Homo sapiens
caggcctccctcggg

SEQ ID NO: 633904 - DNA, 17 bp, Homo sapiens
caggcgcgcaccgccca

SEQ ID NO: 633905 - DNA, 19 bp, Homo sapiens
caggcgcgcaccgcccaac

SEQ ID NO: 633906 - DNA, 22 bp, Homo sapiens
caggcgcgcaccgcccaacccc

SEQ ID NO: 633907 - DNA, 19 bp, Homo sapiens
caggcggaggggcttggag

SEQ ID NO: 633908 - DNA, 20 bp, Homo sapiens
caggcggaggggcttggagc

SEQ ID NO: 633909 - DNA, 21 bp, Homo sapiens
caggcggaggggcttggagca

SEQ ID NO: 633910 - DNA, 21 bp, Homo sapiens
caggctcccactgcccctgca

SEQ ID NO: 633911 - DNA, 21 bp, Homo sapiens
caggctgcctcatgaccctcc

SEQ ID NO: 633912 - DNA, 19 bp, Homo sapiens
caggctgcgcctgcccgcc

SEQ ID NO: 633913 - DNA, 14 bp, Homo sapiens
caggctttctattg

SEQ ID NO: 633914 - DNA, 18 bp, Homo sapiens
cagggaaacaaagtttac

SEQ ID NO: 633915 - DNA, 19 bp, Homo sapiens
cagggaagggtgcctggct

SEQ ID NO: 633916 - DNA, 21 bp, Homo sapiens
cagggaagggtgcctggctgg

SEQ ID NO: 633917 - DNA, 20 bp, Homo sapiens
cagggacactacaaacatgg

SEQ ID NO: 633918 - DNA, 19 bp, Homo sapiens
cagggagggaacagacctc

SEQ ID NO: 633919 - DNA, 12 bp, Homo sapiens
cagggagggggc

SEQ ID NO: 633920 - DNA, 18 bp, Homo sapiens
cagggagggggctgggaa

SEQ ID NO: 633921 - DNA, 19 bp, Homo sapiens
cagggatggagatgggaag

SEQ ID NO: 633922 - DNA, 15 bp, Homo sapiens
cagggcagaggaatg

SEQ ID NO: 633923 - DNA, 19 bp, Homo sapiens
cagggcagaggaatgtagg

SEQ ID NO: 633924 - DNA, 14 bp, Homo sapiens
cagggcccagggag

SEQ ID NO: 633925 - DNA, 21 bp, Homo sapiens
cagggcccagggaggtggcag

SEQ ID NO: 633926 - DNA, 23 bp, Homo sapiens
cagggcccagggaggtggcaggg

SEQ ID NO: 633927 - DNA, 15 bp, Homo sapiens
cagggcccgagcgcg

SEQ ID NO: 633928 - DNA, 17 bp, Homo sapiens
cagggccctggggtctc

SEQ ID NO: 633929 - DNA, 14 bp, Homo sapiens
cagggccgcagggc

SEQ ID NO: 633930 - DNA, 15 bp, Homo sapiens
cagggccgcagggcg

SEQ ID NO: 633931 - DNA, 18 bp, Homo sapiens
cagggccgcagggcgctc

SEQ ID NO: 633932 - DNA, 19 bp, Homo sapiens
cagggccgcagggcgctcc

SEQ ID NO: 633933 - DNA, 20 bp, Homo sapiens
cagggccgccgaagggcagc

SEQ ID NO: 633934 - DNA, 13 bp, Homo sapiens
cagggcgctccgg

SEQ ID NO: 633935 - DNA, 15 bp, Homo sapiens
cagggcgctccggca

SEQ ID NO: 633936 - DNA, 17 bp, Homo sapiens
cagggcgctccggcaga

SEQ ID NO: 633937 - DNA, 20 bp, Homo sapiens
cagggcgctccggcagaggc

SEQ ID NO: 633938 - DNA, 13 bp, Homo sapiens
cagggcgtcctct

SEQ ID NO: 633939 - DNA, 13 bp, Homo sapiens
cagggctgtgctt

SEQ ID NO: 633940 - DNA, 16 bp, Homo sapiens
caggggaggctgagac

SEQ ID NO: 633941 - DNA, 12 bp, Homo sapiens
caggggcaggca

SEQ ID NO: 633942 - DNA, 19 bp, Homo sapiens
caggggccgtgcagggcca

SEQ ID NO: 633943 - DNA, 18 bp, Homo sapiens
caggggttggcagcgcct

SEQ ID NO: 633944 - DNA, 15 bp, Homo sapiens
cagggtccagccctc

SEQ ID NO: 633945 - DNA, 17 bp, Homo sapiens
cagggtccagccctccg

SEQ ID NO: 633946 - DNA, 22 bp, Homo sapiens
cagggtccagccctccgccagc

SEQ ID NO: 633947 - DNA, 15 bp, Homo sapiens
cagggtcctgagtgg

SEQ ID NO: 633948 - DNA, 17 bp, Homo sapiens
cagggtgcaggcgcgca

SEQ ID NO: 633949 - DNA, 18 bp, Homo sapiens
cagggtgggaagagaaga

SEQ ID NO: 633950 - DNA, 13 bp, Homo sapiens
cagggttccagac

SEQ ID NO: 633951 - DNA, 18 bp, Homo sapiens
cagggttccagacagggt

SEQ ID NO: 633952 - DNA, 20 bp, Homo sapiens
cagggttccagacagggtgg

SEQ ID NO: 633953 - DNA, 21 bp, Homo sapiens
cagggttccagacagggtggg

SEQ ID NO: 633954 - DNA, 23 bp, Homo sapiens
cagggttccagacagggtggggc

SEQ ID NO: 633955 - DNA, 19 bp, Homo sapiens
cagggttctagaaggggcg

SEQ ID NO: 633956 - DNA, 15 bp, Homo sapiens
caggtctggcgccag

SEQ ID NO: 633957 - DNA, 16 bp, Homo sapiens
caggtgaccagaatga

SEQ ID NO: 633958 - DNA, 14 bp, Homo sapiens
caggtgccccacct

SEQ ID NO: 633959 - DNA, 18 bp, Homo sapiens
caggtggcatttgcaggt

SEQ ID NO: 633960 - DNA, 16 bp, Homo sapiens
caggtgggctgcctgc

SEQ ID NO: 633961 - DNA, 13 bp, Homo sapiens
caggtgggggctg

SEQ ID NO: 633962 - DNA, 21 bp, Homo sapiens
caggttttatgagacttccta

SEQ ID NO: 633963 - DNA, 12 bp, Homo sapiens
cagtaaatatac

SEQ ID NO: 633964 - DNA, 19 bp, Homo sapiens
cagtaacacagtgcagtgc

SEQ ID NO: 633965 - DNA, 20 bp, Homo sapiens
cagtacaataaataaaagaa

SEQ ID NO: 633966 - DNA, 20 bp, Homo sapiens
cagtacaattctttgttgct

SEQ ID NO: 633967 - DNA, 17 bp, Homo sapiens
cagtaccatcccactga

SEQ ID NO: 633968 - DNA, 19 bp, Homo sapiens
cagtactttctttctgtgt

SEQ ID NO: 633969 - DNA, 13 bp, Homo sapiens
cagtagagagcct

SEQ ID NO: 633970 - DNA, 18 bp, Homo sapiens
cagtagcatactgatgag

SEQ ID NO: 633971 - DNA, 21 bp, Homo sapiens
cagtatatattctttcacaag

SEQ ID NO: 633972 - DNA, 14 bp, Homo sapiens
cagtatcttaaaat

SEQ ID NO: 633973 - DNA, 21 bp, Homo sapiens
cagtatgctttccctgaggaa

SEQ ID NO: 633974 - DNA, 11 bp, Homo sapiens
cagtattctgt

SEQ ID NO: 633975 - DNA, 13 bp, Homo sapiens
cagtattctgtag

SEQ ID NO: 633976 - DNA, 14 bp, Homo sapiens
cagtattctgtagc

SEQ ID NO: 633977 - DNA, 17 bp, Homo sapiens
cagtattctgtagccaa

SEQ ID NO: 633978 - DNA, 17 bp, Homo sapiens
cagtattgagacactgt

SEQ ID NO: 633979 - DNA, 18 bp, Homo sapiens
cagtattgttcttgtaaa

SEQ ID NO: 633980 - DNA, 23 bp, Homo sapiens
cagtattgttcttgtaaaactgt

SEQ ID NO: 633981 - DNA, 15 bp, Homo sapiens
cagtcaatgcattgt

SEQ ID NO: 633982 - DNA, 19 bp, Homo sapiens
cagtcagcacagagagcgg

SEQ ID NO: 633983 - DNA, 14 bp, Homo sapiens
cagtccaaggtatt

SEQ ID NO: 633984 - DNA, 13 bp, Homo sapiens
cagtccctggagc

SEQ ID NO: 633985 - DNA, 14 bp, Homo sapiens
cagtccctggagct

SEQ ID NO: 633986 - DNA, 21 bp, Homo sapiens
cagtccgccccgtgctcctct

SEQ ID NO: 633987 - DNA, 22 bp, Homo sapiens
cagtcctcacagcctctccctt

SEQ ID NO: 633988 - DNA, 21 bp, Homo sapiens
cagtctatgctgtgtgcagag

SEQ ID NO: 633989 - DNA, 15 bp, Homo sapiens
cagtctctatttgat

SEQ ID NO: 633990 - DNA, 17 bp, Homo sapiens
cagtctgttcagaggca

SEQ ID NO: 633991 - DNA, 17 bp, Homo sapiens
cagtcttgagtgggccc

SEQ ID NO: 633992 - DNA, 19 bp, Homo sapiens
cagtgaacacactcagcag

SEQ ID NO: 633993 - DNA, 23 bp, Homo sapiens
cattctatgactcttgtctcctc

SEQ ID NO: 633994 - DNA, 15 bp, Homo sapiens
cattgaaactgtatt

SEQ ID NO: 633995 - DNA, 16 bp, Homo sapiens
cattgaaactgtattt

SEQ ID NO: 633996 - DNA, 19 bp, Homo sapiens
cattgaacactgcaccctc

SEQ ID NO: 633997 - DNA, 16 bp, Homo sapiens
cattgacaccaaatat

SEQ ID NO: 633998 - DNA, 22 bp, Homo sapiens
cattgacaccaaatattttcaa

SEQ ID NO: 633999 - DNA, 23 bp, Homo sapiens
cattgcactaaaagtgatgtgat

SEQ ID NO: 634000 - DNA, 13 bp, Homo sapiens
cattgcctatttc

SEQ ID NO: 634001 - DNA, 14 bp, Homo sapiens
cattgcttcattaa

SEQ ID NO: 634002 - DNA, 17 bp, Homo sapiens
cattgggccatgtttaa

SEQ ID NO: 634003 - DNA, 15 bp, Homo sapiens
cattggttacaaatt

SEQ ID NO: 634004 - DNA, 11 bp, Homo sapiens
cattgtcctgt

SEQ ID NO: 634005 - DNA, 20 bp, Homo sapiens
cattgtgttttcttcgtgga

SEQ ID NO: 634006 - DNA, 20 bp, Homo sapiens
cattgttttgccaacattgc

SEQ ID NO: 634007 - DNA, 15 bp, Homo sapiens
catttaaacccggct

SEQ ID NO: 634008 - DNA, 13 bp, Homo sapiens
catttaacactga

SEQ ID NO: 634009 - DNA, 19 bp, Homo sapiens
catttaactagcactttat

SEQ ID NO: 634010 - DNA, 13 bp, Homo sapiens
catttaatcattt

SEQ ID NO: 634011 - DNA, 22 bp, Homo sapiens
catttaatgagttttatcttga

SEQ ID NO: 634012 - DNA, 16 bp, Homo sapiens
catttacaacttccag

SEQ ID NO: 634013 - DNA, 16 bp, Homo sapiens
catttagcacagtatt

SEQ ID NO: 634014 - DNA, 14 bp, Homo sapiens
catttagtcctcac

SEQ ID NO: 634015 - DNA, 21 bp, Homo sapiens
catttatgcaatttacttgga

SEQ ID NO: 634016 - DNA, 14 bp, Homo sapiens
catttatgtacaaa

SEQ ID NO: 634017 - DNA, 19 bp, Homo sapiens
catttatgtacaaaatgaa

SEQ ID NO: 634018 - DNA, 13 bp, Homo sapiens
catttatgtgtga

SEQ ID NO: 634019 - DNA, 17 bp, Homo sapiens
catttcacattcctgac

SEQ ID NO: 634020 - DNA, 15 bp, Homo sapiens
catttcatacaaatt

SEQ ID NO: 634021 - DNA, 15 bp, Homo sapiens
catttccagcaaaat

SEQ ID NO: 634022 - DNA, 23 bp, Homo sapiens
catttccgtgagagtcatctcaa

SEQ ID NO: 634023 - DNA, 18 bp, Homo sapiens
catttccttgtctaaaga

SEQ ID NO: 634024 - DNA, 22 bp, Homo sapiens
catttcttctctctgtgctggt

SEQ ID NO: 634025 - DNA, 12 bp, Homo sapiens
catttgaaatgt

SEQ ID NO: 634026 - DNA, 12 bp, Homo sapiens
catttgctgaat

SEQ ID NO: 634027 - DNA, 23 bp, Homo sapiens
catttggattttaaacaaaattt

SEQ ID NO: 634028 - DNA, 18 bp, Homo sapiens
catttgggagactgagct

SEQ ID NO: 634029 - DNA, 14 bp, Homo sapiens
catttgggtatttt

SEQ ID NO: 634030 - DNA, 18 bp, Homo sapiens
catttgggtattttgtca

SEQ ID NO: 634031 - DNA, 20 bp, Homo sapiens
catttgttaatgattcttgt

SEQ ID NO: 634032 - DNA, 17 bp, Homo sapiens
cattttaaatggacaga

SEQ ID NO: 634033 - DNA, 12 bp, Homo sapiens
cattttctctcc

SEQ ID NO: 634034 - DNA, 14 bp, Homo sapiens
cattttctctcctc

SEQ ID NO: 634035 - DNA, 15 bp, Homo sapiens
cattttgaaatattc

SEQ ID NO: 634036 - DNA, 12 bp, Homo sapiens
cattttgatgta

SEQ ID NO: 634037 - DNA, 16 bp, Homo sapiens
cattttgggaaattct

SEQ ID NO: 634038 - DNA, 15 bp, Homo sapiens
ccaaaagctgctttc

SEQ ID NO: 634039 - DNA, 18 bp, Homo sapiens
ccaaactctctagtgcag

SEQ ID NO: 634040 - DNA, 16 bp, Homo sapiens
ccaaatataacatgaa

SEQ ID NO: 634041 - DNA, 20 bp, Homo sapiens
ccaacattgcctatttcagt

SEQ ID NO: 634042 - DNA, 16 bp, Homo sapiens
ccaacccccacctccc

SEQ ID NO: 634043 - DNA, 17 bp, Homo sapiens
ccaacccccacctcccg

SEQ ID NO: 634044 - DNA, 18 bp, Homo sapiens
ccaacccccacctcccgg

SEQ ID NO: 634045 - DNA, 17 bp, Homo sapiens
ccaacctggtaattatc

SEQ ID NO: 634046 - DNA, 15 bp, Homo sapiens
ccaacgggtctgtgg

SEQ ID NO: 634047 - DNA, 17 bp, Homo sapiens
ccaactctggccttggt

SEQ ID NO: 634048 - DNA, 15 bp, Homo sapiens
ccaactggaaggctt

SEQ ID NO: 634049 - DNA, 22 bp, Homo sapiens
ccaactgtagccaccctggcat

SEQ ID NO: 634050 - DNA, 15 bp, Homo sapiens
ccaacttaaacctgt

SEQ ID NO: 634051 - DNA, 21 bp, Homo sapiens
ccaagccagggttccagacag

SEQ ID NO: 634052 - DNA, 22 bp, Homo sapiens
ccaagccagggttccagacagg

SEQ ID NO: 634053 - DNA, 11 bp, Homo sapiens
ccaagcccagc

SEQ ID NO: 634054 - DNA, 15 bp, Homo sapiens
ccaaggacactgatg

SEQ ID NO: 634055 - DNA, 21 bp, Homo sapiens
ccaaggacactgatgggtcct

SEQ ID NO: 634056 - DNA, 21 bp, Homo sapiens
ccaaggtggtcttggagagga

SEQ ID NO: 634057 - DNA, 22 bp, Homo sapiens
ccaaggtggtcttggagaggag

SEQ ID NO: 634058 - DNA, 17 bp, Homo sapiens
ccaagtgtacatttgat

SEQ ID NO: 634059 - DNA, 13 bp, Homo sapiens
ccaagtgtcctgc

SEQ ID NO: 634060 - DNA, 16 bp, Homo sapiens
ccaagtgtgtgtgcaa

SEQ ID NO: 634061 - DNA, 17 bp, Homo sapiens
ccaatgaactctttccc

SEQ ID NO: 634062 - DNA, 19 bp, Homo sapiens
ccaatgaactctttcccca

SEQ ID NO: 634063 - DNA, 22 bp, Homo sapiens
ccaatgtccaggtcacaggcat

SEQ ID NO: 634064 - DNA, 16 bp, Homo sapiens
ccaattatcaaaaaac

SEQ ID NO: 634065 - DNA, 18 bp, Homo sapiens
ccaattatcaaaaaacag

SEQ ID NO: 634066 - DNA, 10 bp, Homo sapiens
ccaatttctc

SEQ ID NO: 634067 - DNA, 13 bp, Homo sapiens
ccacaaggcccag

SEQ ID NO: 634068 - DNA, 15 bp, Homo sapiens
ccacaaggcccagcc

SEQ ID NO: 634069 - DNA, 19 bp, Homo sapiens
ccacaaggcccagccctgg

SEQ ID NO: 634070 - DNA, 21 bp, Homo sapiens
ccacacacacccttccccact

SEQ ID NO: 634071 - DNA, 15 bp, Homo sapiens
ccacacgccggggct

SEQ ID NO: 634072 - DNA, 18 bp, Homo sapiens
ccacacgccggggctggc

SEQ ID NO: 634073 - DNA, 19 bp, Homo sapiens
ccacacgccggggctggcc

SEQ ID NO: 634074 - DNA, 23 bp, Homo sapiens
ccacacgccggggctggccctgc

SEQ ID NO: 634075 - DNA, 16 bp, Homo sapiens
ccacagaaatctctca

SEQ ID NO: 634076 - DNA, 14 bp, Homo sapiens
ccacagctgggcag

SEQ ID NO: 634077 - DNA, 20 bp, Homo sapiens
ccacaggagcatgtcctatc

SEQ ID NO: 634078 - DNA, 18 bp, Homo sapiens
ccacaggagcgtgtccta

SEQ ID NO: 634079 - DNA, 20 bp, Homo sapiens
ccacaggagcgtgtcctatc

SEQ ID NO: 634080 - DNA, 22 bp, Homo sapiens
ccacagtggggcccatggcccc

SEQ ID NO: 634081 - DNA, 23 bp, Homo sapiens
ccacagtggggcccatggcccca

SEQ ID NO: 634082 - DNA, 23 bp, Homo sapiens
ccacataaacacttctccttaac

SEQ ID NO: 634083 - DNA, 23 bp, Homo sapiens
ccacatttctggccatttaacta

SEQ ID NO: 634084 - DNA, 16 bp, Homo sapiens
ccaccaaaaactgggt

SEQ ID NO: 634085 - DNA, 17 bp, Homo sapiens
ccacccactagccctct

SEQ ID NO: 634086 - DNA, 15 bp, Homo sapiens
ccacccagcagcgcc

SEQ ID NO: 634087 - DNA, 20 bp, Homo sapiens
ccacccagcagcgcccgagg

SEQ ID NO: 634088 - DNA, 14 bp, Homo sapiens
ccacccatgccagc

SEQ ID NO: 634089 - DNA, 14 bp, Homo sapiens
ccaccccgctgcct

SEQ ID NO: 634090 - DNA, 17 bp, Homo sapiens
ccaccccgctgcctggc

SEQ ID NO: 634091 - DNA, 18 bp, Homo sapiens
ccaccccgctgcctggcg

SEQ ID NO: 634092 - DNA, 18 bp, Homo sapiens
ccacccctcaagccagga

SEQ ID NO: 634093 - DNA, 13 bp, Homo sapiens
ccacccgccccag

SEQ ID NO: 634094 - DNA, 18 bp, Homo sapiens
ccacccgccccagagact

SEQ ID NO: 634095 - DNA, 23 bp, Homo sapiens
ccacccgccccagagactgccca

SEQ ID NO: 634096 - DNA, 13 bp, Homo sapiens
ccaccctgagcct

SEQ ID NO: 634097 - DNA, 17 bp, Homo sapiens
ccaccctgagcctgacc

SEQ ID NO: 634098 - DNA, 12 bp, Homo sapiens
ccaccctgggcc

SEQ ID NO: 634099 - DNA, 14 bp, Homo sapiens
ccaccctgggcctc

SEQ ID NO: 634100 - DNA, 15 bp, Homo sapiens
ccaccctgggcctcc

SEQ ID NO: 634101 - DNA, 12 bp, Homo sapiens
ccaccgcgcccc

SEQ ID NO: 634102 - DNA, 21 bp, Homo sapiens
ccacctaaagggaagccctga

SEQ ID NO: 634103 - DNA, 15 bp, Homo sapiens
ccacctccccagagc

SEQ ID NO: 634104 - DNA, 14 bp, Homo sapiens
ccacctcggacacc

SEQ ID NO: 634105 - DNA, 17 bp, Homo sapiens
ccacctctccccacctt

SEQ ID NO: 634106 - DNA, 14 bp, Homo sapiens
ccacctgccaggcc

SEQ ID NO: 634107 - DNA, 13 bp, Homo sapiens
ccacctggtggcc

SEQ ID NO: 634108 - DNA, 17 bp, Homo sapiens
ccaccttcaagcaccct

SEQ ID NO: 634109 - DNA, 15 bp, Homo sapiens
ccaccttcctgccca

SEQ ID NO: 634110 - DNA, 14 bp, Homo sapiens
cccaggctgcgcct

SEQ ID NO: 634111 - DNA, 18 bp, Homo sapiens
cccaggctgcgcctgccc

SEQ ID NO: 634112 - DNA, 19 bp, Homo sapiens
cccaggctgcgcctgcccg

SEQ ID NO: 634113 - DNA, 20 bp, Homo sapiens
cccaggctgcgcctgcccgc

SEQ ID NO: 634114 - DNA, 14 bp, Homo sapiens
cccagggcccgagc

SEQ ID NO: 634115 - DNA, 18 bp, Homo sapiens
cccaggggacgtggcgct

SEQ ID NO: 634116 - DNA, 13 bp, Homo sapiens
cccagggtcctgg

SEQ ID NO: 634117 - DNA, 14 bp, Homo sapiens
cccaggtgttgtcc

SEQ ID NO: 634118 - DNA, 23 bp, Homo sapiens
cccaggtgttgtccgtgtctgtt

SEQ ID NO: 634119 - DNA, 15 bp, Homo sapiens
cccagtccctggagc

SEQ ID NO: 634120 - DNA, 15 bp, Homo sapiens
cccagtgtggcccca

SEQ ID NO: 634121 - DNA, 18 bp, Homo sapiens
cccatcgccttctggctg

SEQ ID NO: 634122 - DNA, 14 bp, Homo sapiens
cccatgccagcgca

SEQ ID NO: 634123 - DNA, 15 bp, Homo sapiens
cccatgccagcgcag

SEQ ID NO: 634124 - DNA, 12 bp, Homo sapiens
cccatgccctcc

SEQ ID NO: 634125 - DNA, 20 bp, Homo sapiens
cccatgccctccctgctgcc

SEQ ID NO: 634126 - DNA, 17 bp, Homo sapiens
cccatgctggctggggc

SEQ ID NO: 634127 - DNA, 12 bp, Homo sapiens
cccatgctgggc

SEQ ID NO: 634128 - DNA, 13 bp, Homo sapiens
cccatggccccag

SEQ ID NO: 634129 - DNA, 15 bp, Homo sapiens
cccatggccccagct

SEQ ID NO: 634130 - DNA, 15 bp, Homo sapiens
cccatgggccctcag

SEQ ID NO: 634131 - DNA, 17 bp, Homo sapiens
cccatgggccctcagcg

SEQ ID NO: 634132 - DNA, 18 bp, Homo sapiens
cccattgtgaatgttgtc

SEQ ID NO: 634133 - DNA, 23 bp, Homo sapiens
cccattgtgaatgttgtcctgtg

SEQ ID NO: 634134 - DNA, 13 bp, Homo sapiens
cccatttcacaca

SEQ ID NO: 634135 - DNA, 18 bp, Homo sapiens
cccatttccttgtctaaa

SEQ ID NO: 634136 - DNA, 16 bp, Homo sapiens
ccccaaattgccttca

SEQ ID NO: 634137 - DNA, 19 bp, Homo sapiens
ccccacacgccggggctgg

SEQ ID NO: 634138 - DNA, 12 bp, Homo sapiens
ccccacagtcct

SEQ ID NO: 634139 - DNA, 12 bp, Homo sapiens
ccccacccatgc

SEQ ID NO: 634140 - DNA, 21 bp, Homo sapiens
ccccagagccactacctttgt

SEQ ID NO: 634141 - DNA, 17 bp, Homo sapiens
ccccagccaagcctgac

SEQ ID NO: 634142 - DNA, 19 bp, Homo sapiens
ccccagccaagcctgactt

SEQ ID NO: 634143 - DNA, 18 bp, Homo sapiens
ccccagcctcccccaggc

SEQ ID NO: 634144 - DNA, 20 bp, Homo sapiens
ccccagcctcccccaggctg

SEQ ID NO: 634145 - DNA, 16 bp, Homo sapiens
ccccagctggctgggt

SEQ ID NO: 634146 - DNA, 18 bp, Homo sapiens
ccccaggcccgccctgcc

SEQ ID NO: 634147 - DNA, 18 bp, Homo sapiens
ccccaggctgcgcctgcc

SEQ ID NO: 634148 - DNA, 20 bp, Homo sapiens
ccccaggggcactgtgttct

SEQ ID NO: 634149 - DNA, 18 bp, Homo sapiens
ccccagggtcccctgcat

SEQ ID NO: 634150 - DNA, 16 bp, Homo sapiens
ccccagggtgcaggcg

SEQ ID NO: 634151 - DNA, 17 bp, Homo sapiens
ccccagtggtgcgggcc

SEQ ID NO: 634152 - DNA, 15 bp, Homo sapiens
ccccataatgcttct

SEQ ID NO: 634153 - DNA, 17 bp, Homo sapiens
ccccatcagaggctggg

SEQ ID NO: 634154 - DNA, 17 bp, Homo sapiens
ccccatccttcccgcag

SEQ ID NO: 634155 - DNA, 12 bp, Homo sapiens
ccccatcgcctg

SEQ ID NO: 634156 - DNA, 21 bp, Homo sapiens
ccccatcgcctgggacgcccc

SEQ ID NO: 634157 - DNA, 15 bp, Homo sapiens
ccccatgccctccct

SEQ ID NO: 634158 - DNA, 16 bp, Homo sapiens
ccccatgccctccctg

SEQ ID NO: 634159 - DNA, 13 bp, Homo sapiens
ccccatgctgggc

SEQ ID NO: 634160 - DNA, 14 bp, Homo sapiens
ccccatgctgggct

SEQ ID NO: 634161 - DNA, 15 bp, Homo sapiens
ccccatgctgggctc

SEQ ID NO: 634162 - DNA, 23 bp, Homo sapiens
ccccatggaacagccctgcacgc

SEQ ID NO: 634163 - DNA, 16 bp, Homo sapiens
ccccatgggccctcag

SEQ ID NO: 634164 - DNA, 19 bp, Homo sapiens
ccccattgccttctgggga

SEQ ID NO: 634165 - DNA, 20 bp, Homo sapiens
cccccaaattgccttcagcc

SEQ ID NO: 634166 - DNA, 12 bp, Homo sapiens
cccccacggccg

SEQ ID NO: 634167 - DNA, 16 bp, Homo sapiens
cccccagcctccccca

SEQ ID NO: 634168 - DNA, 18 bp, Homo sapiens
cccccagcctcccccagg

SEQ ID NO: 634169 - DNA, 21 bp, Homo sapiens
cccccagcctcccccaggctg

SEQ ID NO: 634170 - DNA, 12 bp, Homo sapiens
cccccatgccct

SEQ ID NO: 634171 - DNA, 13 bp, Homo sapiens
cccccattgtgaa

SEQ ID NO: 634172 - DNA, 13 bp, Homo sapiens
ccccccatgccct

SEQ ID NO: 634173 - DNA, 12 bp, Homo sapiens
cccccctgagtg

SEQ ID NO: 634174 - DNA, 12 bp, Homo sapiens
ccccccttccca

SEQ ID NO: 634175 - DNA, 16 bp, Homo sapiens
cccccgcccggcctcc

SEQ ID NO: 634176 - DNA, 18 bp, Homo sapiens
cccccgccctcgctccgg

SEQ ID NO: 634177 - DNA, 19 bp, Homo sapiens
cccccggaggcgcccacct

SEQ ID NO: 634178 - DNA, 23 bp, Homo sapiens
cccccggaggcgcccacctgccc

SEQ ID NO: 634179 - DNA, 17 bp, Homo sapiens
ccccctacagatcctcc

SEQ ID NO: 634180 - DNA, 19 bp, Homo sapiens
ccccctacagatcctccgc

SEQ ID NO: 634181 - DNA, 24 bp, Homo sapiens
ccccctacagatcctccgcggagg

SEQ ID NO: 634182 - DNA, 17 bp, Homo sapiens
ccccctcgcgcccctgt

SEQ ID NO: 634183 - DNA, 19 bp, Homo sapiens
cccccttcccctgcgccct

SEQ ID NO: 634184 - DNA, 17 bp, Homo sapiens
ccccgccccgctgctcc

SEQ ID NO: 634185 - DNA, 20 bp, Homo sapiens
ccccgcccgccctcctctgc

SEQ ID NO: 634186 - DNA, 15 bp, Homo sapiens
ccccgcccggcctcc

SEQ ID NO: 634187 - DNA, 15 bp, Homo sapiens
ccccgccctcgctcc

SEQ ID NO: 634188 - DNA, 18 bp, Homo sapiens
ccccgcgaccacccctgt

SEQ ID NO: 634189 - DNA, 20 bp, Homo sapiens
ccccgctgcctggcgggcag

SEQ ID NO: 634190 - DNA, 13 bp, Homo sapiens
ccccgctgctccc

SEQ ID NO: 634191 - DNA, 17 bp, Homo sapiens
ccccggacgctggctcg

SEQ ID NO: 634192 - DNA, 21 bp, Homo sapiens
ccccggcctgatggccaggcc

SEQ ID NO: 634193 - DNA, 15 bp, Homo sapiens
ccccggcctggcccc

SEQ ID NO: 634194 - DNA, 14 bp, Homo sapiens
ccccgtgcggcccg

SEQ ID NO: 634195 - DNA, 14 bp, Homo sapiens
ccccgtgctcctct

SEQ ID NO: 634196 - DNA, 17 bp, Homo sapiens
ccccgtgctcctctgcc

SEQ ID NO: 634197 - DNA, 19 bp, Homo sapiens
ccccgtgctcctctgcccg

SEQ ID NO: 634198 - DNA, 14 bp, Homo sapiens
ccccgttcccagcg

SEQ ID NO: 634199 - DNA, 14 bp, Homo sapiens
cccctaccctttcc

SEQ ID NO: 634200 - DNA, 14 bp, Homo sapiens
cccctatcctgcac

SEQ ID NO: 634201 - DNA, 11 bp, Homo sapiens
cccctccagac

SEQ ID NO: 634202 - DNA, 12 bp, Homo sapiens
cccctccccaag

SEQ ID NO: 634203 - DNA, 21 bp, Homo sapiens
cccctcctcgggcgcctgcgc

SEQ ID NO: 634204 - DNA, 22 bp, Homo sapiens
cccctccttctcccctccagac

SEQ ID NO: 634205 - DNA, 18 bp, Homo sapiens
cccctcgcgcccctgtcc

SEQ ID NO: 634206 - DNA, 22 bp, Homo sapiens
cccctctcctgagcctgtctct

SEQ ID NO: 634207 - DNA, 21 bp, Homo sapiens
cccctctcgggctctctcacc

SEQ ID NO: 634208 - DNA, 11 bp, Homo sapiens
cccctcttccc

SEQ ID NO: 634209 - DNA, 24 bp, Homo sapiens
cccctgagggacgagcagagcgca

SEQ ID NO: 634210 - DNA, 21 bp, Homo sapiens
cccctgagtgggctgggccct

SEQ ID NO: 634211 - DNA, 14 bp, Homo sapiens
cccctgcacctgct

SEQ ID NO: 634212 - DNA, 19 bp, Homo sapiens
cccctgcacctgcttctca

SEQ ID NO: 634213 - DNA, 20 bp, Homo sapiens
cccctgcagtttggccctgg

SEQ ID NO: 634214 - DNA, 14 bp, Homo sapiens
cccctgccctcggc

SEQ ID NO: 634215 - DNA, 17 bp, Homo sapiens
cccctgccctcggccat

SEQ ID NO: 634216 - DNA, 19 bp, Homo sapiens
cccctgcctctatccctgg

SEQ ID NO: 634217 - DNA, 14 bp, Homo sapiens
cccctgctggacca

SEQ ID NO: 634218 - DNA, 13 bp, Homo sapiens
cccctggccctgc

SEQ ID NO: 634219 - DNA, 22 bp, Homo sapiens
cccctggccctgcctcactgtg

SEQ ID NO: 634220 - DNA, 18 bp, Homo sapiens
cccctgggaacacagtgc

SEQ ID NO: 634221 - DNA, 15 bp, Homo sapiens
cccctggtcctgcac

SEQ ID NO: 634222 - DNA, 19 bp, Homo sapiens
cccctgtttctcctccatt

SEQ ID NO: 634223 - DNA, 15 bp, Homo sapiens
ccccttgaccccaca

SEQ ID NO: 634224 - DNA, 15 bp, Homo sapiens
cccctttctcttgct

SEQ ID NO: 634225 - DNA, 22 bp, Homo sapiens
cccgaggaggccgactgggctg

SEQ ID NO: 634226 - DNA, 17 bp, Homo sapiens
cccgatgcgtggctccc

SEQ ID NO: 634227 - DNA, 14 bp, Homo sapiens
ccctggagccaggg

SEQ ID NO: 634228 - DNA, 16 bp, Homo sapiens
ccctggagccagggca

SEQ ID NO: 634229 - DNA, 13 bp, Homo sapiens
ccctggagctgtc

SEQ ID NO: 634230 - DNA, 14 bp, Homo sapiens
ccctggagctgtcc

SEQ ID NO: 634231 - DNA, 19 bp, Homo sapiens
ccctggagctgtccttcat

SEQ ID NO: 634232 - DNA, 16 bp, Homo sapiens
ccctggccctgcctca

SEQ ID NO: 634233 - DNA, 17 bp, Homo sapiens
ccctgggaacacagtgc

SEQ ID NO: 634234 - DNA, 15 bp, Homo sapiens
ccctggggaccagga

SEQ ID NO: 634235 - DNA, 20 bp, Homo sapiens
ccctggggaccaggagctag

SEQ ID NO: 634236 - DNA, 18 bp, Homo sapiens
ccctgtgactatggctct

SEQ ID NO: 634237 - DNA, 13 bp, Homo sapiens
ccctgtgccctct

SEQ ID NO: 634238 - DNA, 18 bp, Homo sapiens
ccctgtgccctctcactg

SEQ ID NO: 634239 - DNA, 19 bp, Homo sapiens
ccctgtgggctcacaccgg

SEQ ID NO: 634240 - DNA, 17 bp, Homo sapiens
ccctgttccgcctcact

SEQ ID NO: 634241 - DNA, 11 bp, Homo sapiens
cccttcccaac

SEQ ID NO: 634242 - DNA, 13 bp, Homo sapiens
cccttccccactc

SEQ ID NO: 634243 - DNA, 14 bp, Homo sapiens
cccttccccactcc

SEQ ID NO: 634244 - DNA, 15 bp, Homo sapiens
cccttccccactccc

SEQ ID NO: 634245 - DNA, 16 bp, Homo sapiens
cccttccccactcccg

SEQ ID NO: 634246 - DNA, 18 bp, Homo sapiens
cccttcccctgcgccctc

SEQ ID NO: 634247 - DNA, 13 bp, Homo sapiens
cccttcctgtcct

SEQ ID NO: 634248 - DNA, 19 bp, Homo sapiens
cccttgctctacctggccg

SEQ ID NO: 634249 - DNA, 17 bp, Homo sapiens
cccttggagagagaggc

SEQ ID NO: 634250 - DNA, 14 bp, Homo sapiens
cccttggcccctct

SEQ ID NO: 634251 - DNA, 18 bp, Homo sapiens
ccctttccccattcagtg

SEQ ID NO: 634252 - DNA, 15 bp, Homo sapiens
ccctttccctgcatc

SEQ ID NO: 634253 - DNA, 13 bp, Homo sapiens
ccctttctcttgc

SEQ ID NO: 634254 - DNA, 20 bp, Homo sapiens
ccctttgcaggcccagcaga

SEQ ID NO: 634255 - DNA, 12 bp, Homo sapiens
ccgacgcccctc

SEQ ID NO: 634256 - DNA, 13 bp, Homo sapiens
ccgacgcccctcc

SEQ ID NO: 634257 - DNA, 14 bp, Homo sapiens
ccgacgcccctccg

SEQ ID NO: 634258 - DNA, 15 bp, Homo sapiens
ccgacgcccctccgg

SEQ ID NO: 634259 - DNA, 16 bp, Homo sapiens
ccgacgcccctccggg

SEQ ID NO: 634260 - DNA, 17 bp, Homo sapiens
ccgagcgcgtgccttcc

SEQ ID NO: 634261 - DNA, 19 bp, Homo sapiens
ccgagcgcgtgccttcccc

SEQ ID NO: 634262 - DNA, 15 bp, Homo sapiens
ccgaggcctgcgccc

SEQ ID NO: 634263 - DNA, 18 bp, Homo sapiens
ccgatataagccatagcc

SEQ ID NO: 634264 - DNA, 22 bp, Homo sapiens
ccgcactcaggagcacagccat

SEQ ID NO: 634265 - DNA, 13 bp, Homo sapiens
ccgcagaggcccg

SEQ ID NO: 634266 - DNA, 14 bp, Homo sapiens
ccgcagcaccagcc

SEQ ID NO: 634267 - DNA, 20 bp, Homo sapiens
ccgcagcaccagcctgagcc

SEQ ID NO: 634268 - DNA, 17 bp, Homo sapiens
ccgcagggcgctccggc

SEQ ID NO: 634269 - DNA, 15 bp, Homo sapiens
ccgcatctgcctgga

SEQ ID NO: 634270 - DNA, 16 bp, Homo sapiens
ccgcatctgcctggag

SEQ ID NO: 634271 - DNA, 17 bp, Homo sapiens
ccgcatctgcctggagc

SEQ ID NO: 634272 - DNA, 21 bp, Homo sapiens
ccgccacgaggagcttccagt

SEQ ID NO: 634273 - DNA, 12 bp, Homo sapiens
ccgcccacccag

SEQ ID NO: 634274 - DNA, 17 bp, Homo sapiens
ccgcccacccagcagcg

SEQ ID NO: 634275 - DNA, 20 bp, Homo sapiens
ccgccccagagactgcccac

SEQ ID NO: 634276 - DNA, 16 bp, Homo sapiens
ccgccccgctgctccc

SEQ ID NO: 634277 - DNA, 11 bp, Homo sapiens
ccgcccctccc

SEQ ID NO: 634278 - DNA, 16 bp, Homo sapiens
ccgcccggcctcctag

SEQ ID NO: 634279 - DNA, 14 bp, Homo sapiens
ccgccctcctctgc

SEQ ID NO: 634280 - DNA, 15 bp, Homo sapiens
ccgccctcctctgcc

SEQ ID NO: 634281 - DNA, 13 bp, Homo sapiens
ccgccctgcccgc

SEQ ID NO: 634282 - DNA, 14 bp, Homo sapiens
ccgcctccctcacc

SEQ ID NO: 634283 - DNA, 11 bp, Homo sapiens
ccgcctcctcc

SEQ ID NO: 634284 - DNA, 13 bp, Homo sapiens
ccgcctcctccag

SEQ ID NO: 634285 - DNA, 15 bp, Homo sapiens
ccgcctcgggccgcc

SEQ ID NO: 634286 - DNA, 18 bp, Homo sapiens
ccgcgaccacccctgtgc

SEQ ID NO: 634287 - DNA, 12 bp, Homo sapiens
ccgcgcccgccg

SEQ ID NO: 634288 - DNA, 22 bp, Homo sapiens
ccgcgcgcgggacagcggcccc

SEQ ID NO: 634289 - DNA, 23 bp, Homo sapiens
ccgcgcgcgggacagcggccccg

SEQ ID NO: 634290 - DNA, 15 bp, Homo sapiens
ccgcgctctgcccct

SEQ ID NO: 634291 - DNA, 17 bp, Homo sapiens
ccgcgctctgcccctcc

SEQ ID NO: 634292 - DNA, 13 bp, Homo sapiens
ccgcggagccccc

SEQ ID NO: 634293 - DNA, 18 bp, Homo sapiens
ccgcggaggcccctgagg

SEQ ID NO: 634294 - DNA, 21 bp, Homo sapiens
ccgcgggtggctggagcccca

SEQ ID NO: 634295 - DNA, 15 bp, Homo sapiens
ccgcgtcctttcctc

SEQ ID NO: 634296 - DNA, 16 bp, Homo sapiens
ccgctcaacctctcag

SEQ ID NO: 634297 - DNA, 22 bp, Homo sapiens
ccgctcttcccaagtcctcgcc

SEQ ID NO: 634298 - DNA, 12 bp, Homo sapiens
ccgctgcctggc

SEQ ID NO: 634299 - DNA, 13 bp, Homo sapiens
ccgctgcctggcg

SEQ ID NO: 634300 - DNA, 19 bp, Homo sapiens
ccgctgcctggcgggcagc

SEQ ID NO: 634301 - DNA, 22 bp, Homo sapiens
ccgctgcctggcgggcagcccc

SEQ ID NO: 634302 - DNA, 18 bp, Homo sapiens
ccggacgcatgcagggcc

SEQ ID NO: 634303 - DNA, 13 bp, Homo sapiens
ccggacgctggct

SEQ ID NO: 634304 - DNA, 14 bp, Homo sapiens
ccggacgctggctc

SEQ ID NO: 634305 - DNA, 18 bp, Homo sapiens
ccggacgctggctcggga

SEQ ID NO: 634306 - DNA, 14 bp, Homo sapiens
ccggagcggctgag

SEQ ID NO: 634307 - DNA, 16 bp, Homo sapiens
ccggagcggctgagga

SEQ ID NO: 634308 - DNA, 20 bp, Homo sapiens
ccggagcggctgaggacggg

SEQ ID NO: 634309 - DNA, 17 bp, Homo sapiens
ccggaggcgcccacctg

SEQ ID NO: 634310 - DNA, 19 bp, Homo sapiens
ccggatggaatcacagcca

SEQ ID NO: 634311 - DNA, 20 bp, Homo sapiens
ccggatggaatcacagccaa

SEQ ID NO: 634312 - DNA, 15 bp, Homo sapiens
ccggcaaggggcgcg

SEQ ID NO: 634313 - DNA, 16 bp, Homo sapiens
ccggcagaggcagggc

SEQ ID NO: 634314 - DNA, 18 bp, Homo sapiens
ccggcagaggcagggccc

SEQ ID NO: 634315 - DNA, 16 bp, Homo sapiens
ccggccaaggacactg

SEQ ID NO: 634316 - DNA, 16 bp, Homo sapiens
ccggcccacgcagagc

SEQ ID NO: 634317 - DNA, 18 bp, Homo sapiens
ccggcccacgcagagccc

SEQ ID NO: 634318 - DNA, 19 bp, Homo sapiens
ccggcccccctctcgggct

SEQ ID NO: 634319 - DNA, 18 bp, Homo sapiens
ccggccccgcgcgtgccc

SEQ ID NO: 634320 - DNA, 15 bp, Homo sapiens
ccggcccgccacctt

SEQ ID NO: 634321 - DNA, 14 bp, Homo sapiens
ccggcctcctagcc

SEQ ID NO: 634322 - DNA, 21 bp, Homo sapiens
ccggcctcctagcctctccgc

SEQ ID NO: 634323 - DNA, 20 bp, Homo sapiens
ccggcctgatggccaggcct

SEQ ID NO: 634324 - DNA, 13 bp, Homo sapiens
ccggcctgcagcc

SEQ ID NO: 634325 - DNA, 17 bp, Homo sapiens
ccggcctgcagcccaga

SEQ ID NO: 634326 - DNA, 19 bp, Homo sapiens
ccggcctggccccctcgcg

SEQ ID NO: 634327 - DNA, 15 bp, Homo sapiens
ccggctggccggtcc

SEQ ID NO: 634328 - DNA, 22 bp, Homo sapiens
ccgggactgaccttcggcagtg

SEQ ID NO: 634329 - DNA, 23 bp, Homo sapiens
ccgggactgaccttcggcagtgg

SEQ ID NO: 634330 - DNA, 17 bp, Homo sapiens
ccgggcagagaccaccg

SEQ ID NO: 634331 - DNA, 13 bp, Homo sapiens
ccggggctggccc

SEQ ID NO: 634332 - DNA, 15 bp, Homo sapiens
ccggggctggccctg

SEQ ID NO: 634333 - DNA, 15 bp, Homo sapiens
ccggggtccaggccc

SEQ ID NO: 634334 - DNA, 13 bp, Homo sapiens
ccggggtggagtc

SEQ ID NO: 634335 - DNA, 14 bp, Homo sapiens
ccgggtgccattcc

SEQ ID NO: 634336 - DNA, 21 bp, Homo sapiens
ccgggtgcgtgaccggcccgc

SEQ ID NO: 634337 - DNA, 13 bp, Homo sapiens
ccggtggggccag

SEQ ID NO: 634338 - DNA, 18 bp, Homo sapiens
ccggttggccggctggcc

SEQ ID NO: 634339 - DNA, 13 bp, Homo sapiens
ccgtcagcctgtg

SEQ ID NO: 634340 - DNA, 12 bp, Homo sapiens
ccgtccccaggg

SEQ ID NO: 634341 - DNA, 15 bp, Homo sapiens
ccgtcccggccccgc

SEQ ID NO: 634342 - DNA, 13 bp, Homo sapiens
ccgtccgcccgcc

SEQ ID NO: 634343 - DNA, 19 bp, Homo sapiens
ccgtcctgctcgccctgtg

SEQ ID NO: 634344 - DNA, 13 bp, Homo sapiens
ccgtctctgtccg

SEQ ID NO: 634345 - DNA, 16 bp, Homo sapiens
cctgctcctgcccacg

SEQ ID NO: 634346 - DNA, 15 bp, Homo sapiens
cctgctcgccctgtg

SEQ ID NO: 634347 - DNA, 19 bp, Homo sapiens
cctgctcgccctgtgccct

SEQ ID NO: 634348 - DNA, 20 bp, Homo sapiens
cctgctgccaggctcccact

SEQ ID NO: 634349 - DNA, 17 bp, Homo sapiens
cctgctgctcgggaagg

SEQ ID NO: 634350 - DNA, 23 bp, Homo sapiens
cctgctgctcgggaaggcctgag

SEQ ID NO: 634351 - DNA, 13 bp, Homo sapiens
cctgctgctctct

SEQ ID NO: 634352 - DNA, 19 bp, Homo sapiens
cctgctgtgttaagaggac

SEQ ID NO: 634353 - DNA, 18 bp, Homo sapiens
cctggaccgagtggacca

SEQ ID NO: 634354 - DNA, 19 bp, Homo sapiens
cctggacgcatgcagggcc

SEQ ID NO: 634355 - DNA, 12 bp, Homo sapiens
cctggagccagg

SEQ ID NO: 634356 - DNA, 14 bp, Homo sapiens
cctggagccagggc

SEQ ID NO: 634357 - DNA, 15 bp, Homo sapiens
cctggagccagggca

SEQ ID NO: 634358 - DNA, 17 bp, Homo sapiens
cctggagcctgggcagc

SEQ ID NO: 634359 - DNA, 19 bp, Homo sapiens
cctggaggagaaggaggaa

SEQ ID NO: 634360 - DNA, 22 bp, Homo sapiens
cctggccacctgccaggcctcc

SEQ ID NO: 634361 - DNA, 13 bp, Homo sapiens
cctggccccctcg

SEQ ID NO: 634362 - DNA, 20 bp, Homo sapiens
cctggccccctcgcgcccct

SEQ ID NO: 634363 - DNA, 15 bp, Homo sapiens
cctggccctgcctca

SEQ ID NO: 634364 - DNA, 14 bp, Homo sapiens
cctggcggcagggg

SEQ ID NO: 634365 - DNA, 19 bp, Homo sapiens
cctggcggcaggggttggc

SEQ ID NO: 634366 - DNA, 15 bp, Homo sapiens
cctggcgggcagccc

SEQ ID NO: 634367 - DNA, 18 bp, Homo sapiens
cctggcgggcagcccctg

SEQ ID NO: 634368 - DNA, 19 bp, Homo sapiens
cctggcgggcagcccctgc

SEQ ID NO: 634369 - DNA, 23 bp, Homo sapiens
cctggcgggcagcccctgctgga

SEQ ID NO: 634370 - DNA, 14 bp, Homo sapiens
cctggctcccaggg

SEQ ID NO: 634371 - DNA, 11 bp, Homo sapiens
cctggctgggc

SEQ ID NO: 634372 - DNA, 16 bp, Homo sapiens
cctggctgggctttgg

SEQ ID NO: 634373 - DNA, 13 bp, Homo sapiens
cctggcttctggg

SEQ ID NO: 634374 - DNA, 18 bp, Homo sapiens
cctggcttctgggacagg

SEQ ID NO: 634375 - DNA, 22 bp, Homo sapiens
cctggcttctgggacaggcacc

SEQ ID NO: 634376 - DNA, 19 bp, Homo sapiens
cctgggaacacagtgcccc

SEQ ID NO: 634377 - DNA, 18 bp, Homo sapiens
cctgggacgcccctttct

SEQ ID NO: 634378 - DNA, 14 bp, Homo sapiens
cctgggcaccctgc

SEQ ID NO: 634379 - DNA, 21 bp, Homo sapiens
cctgggcaccctgcaggcagg

SEQ ID NO: 634380 - DNA, 17 bp, Homo sapiens
cctgggcagcacctccg

SEQ ID NO: 634381 - DNA, 20 bp, Homo sapiens
cctgggcagcacctccggga

SEQ ID NO: 634382 - DNA, 22 bp, Homo sapiens
cctgggcccaggcccagcctct

SEQ ID NO: 634383 - DNA, 13 bp, Homo sapiens
cctgggctgttgt

SEQ ID NO: 634384 - DNA, 16 bp, Homo sapiens
cctggggaccaggagc

SEQ ID NO: 634385 - DNA, 16 bp, Homo sapiens
cctggggaggacccct

SEQ ID NO: 634386 - DNA, 18 bp, Homo sapiens
cctggggaggacccctgc

SEQ ID NO: 634387 - DNA, 19 bp, Homo sapiens
cctggggcatccaccttcc

SEQ ID NO: 634388 - DNA, 23 bp, Homo sapiens
cctgggggatgtgcacggcagct

SEQ ID NO: 634389 - DNA, 13 bp, Homo sapiens
cctgggggctgct

SEQ ID NO: 634390 - DNA, 16 bp, Homo sapiens
cctgggggctgctgca

SEQ ID NO: 634391 - DNA, 18 bp, Homo sapiens
cctgggggctgctgcact

SEQ ID NO: 634392 - DNA, 22 bp, Homo sapiens
cctgggggctgttagctcagag

SEQ ID NO: 634393 - DNA, 13 bp, Homo sapiens
cctggggggggca

SEQ ID NO: 634394 - DNA, 18 bp, Homo sapiens
cctggggtctctgagcag

SEQ ID NO: 634395 - DNA, 19 bp, Homo sapiens
cctggggtggttggaggcc

SEQ ID NO: 634396 - DNA, 20 bp, Homo sapiens
cctggggtggttggaggcct

SEQ ID NO: 634397 - DNA, 14 bp, Homo sapiens
cctgggtccccctc

SEQ ID NO: 634398 - DNA, 16 bp, Homo sapiens
cctgggtccccctcct

SEQ ID NO: 634399 - DNA, 20 bp, Homo sapiens
cctgggtgggtggggtacag

SEQ ID NO: 634400 - DNA, 17 bp, Homo sapiens
cctggtcctgcactgtc

SEQ ID NO: 634401 - DNA, 20 bp, Homo sapiens
cctggtcctgcactgtcccg

SEQ ID NO: 634402 - DNA, 14 bp, Homo sapiens
cctgtacacacaca

SEQ ID NO: 634403 - DNA, 21 bp, Homo sapiens
cctgtacacacacagacacac

SEQ ID NO: 634404 - DNA, 23 bp, Homo sapiens
cctgtacacacacagacacacaa

SEQ ID NO: 634405 - DNA, 20 bp, Homo sapiens
cctgtagaagatgacctcgt

SEQ ID NO: 634406 - DNA, 22 bp, Homo sapiens
cctgtagctttaaaaccacagc

SEQ ID NO: 634407 - DNA, 20 bp, Homo sapiens
cctgtagggaaaccttggag

SEQ ID NO: 634408 - DNA, 23 bp, Homo sapiens
cctgtcaatatatagagacttct

SEQ ID NO: 634409 - DNA, 14 bp, Homo sapiens
cctgtcctggctcc

SEQ ID NO: 634410 - DNA, 15 bp, Homo sapiens
cctgtcgggcccgca

SEQ ID NO: 634411 - DNA, 14 bp, Homo sapiens
cctgtctcctctgt

SEQ ID NO: 634412 - DNA, 13 bp, Homo sapiens
cctgtctctccct

SEQ ID NO: 634413 - DNA, 20 bp, Homo sapiens
cctgtctctccctaccctct

SEQ ID NO: 634414 - DNA, 20 bp, Homo sapiens
cctgtctgtctgtctctctt

SEQ ID NO: 634415 - DNA, 19 bp, Homo sapiens
cctgtctttgctgtttata

SEQ ID NO: 634416 - DNA, 23 bp, Homo sapiens
cctgtctttgctgtttatatata

SEQ ID NO: 634417 - DNA, 15 bp, Homo sapiens
cctgtgactatggct

SEQ ID NO: 634418 - DNA, 15 bp, Homo sapiens
cctgtgatcgtgtgt

SEQ ID NO: 634419 - DNA, 19 bp, Homo sapiens
cctgtgcagtagagagcct

SEQ ID NO: 634420 - DNA, 20 bp, Homo sapiens
cctgtgcagtagagagcctt

SEQ ID NO: 634421 - DNA, 17 bp, Homo sapiens
cctgtgcccacgtgtgc

SEQ ID NO: 634422 - DNA, 14 bp, Homo sapiens
cctgtgccctctca

SEQ ID NO: 634423 - DNA, 13 bp, Homo sapiens
cctgtgctttcat

SEQ ID NO: 634424 - DNA, 21 bp, Homo sapiens
cctgtgggagtccactttcct

SEQ ID NO: 634425 - DNA, 23 bp, Homo sapiens
cctgtgggagtccactttcctct

SEQ ID NO: 634426 - DNA, 16 bp, Homo sapiens
cctgtgggctcacacc

SEQ ID NO: 634427 - DNA, 19 bp, Homo sapiens
cctgtgggctcacaccggc

SEQ ID NO: 634428 - DNA, 17 bp, Homo sapiens
cctgtgggggcggctgt

SEQ ID NO: 634429 - DNA, 20 bp, Homo sapiens
cctgtggtgaggtcctgtcc

SEQ ID NO: 634430 - DNA, 13 bp, Homo sapiens
cctgtgtcatctg

SEQ ID NO: 634431 - DNA, 17 bp, Homo sapiens
cctgtgtcatctgtcag

SEQ ID NO: 634432 - DNA, 17 bp, Homo sapiens
cctgttccctctttctt

SEQ ID NO: 634433 - DNA, 16 bp, Homo sapiens
cctgttgacctaccct

SEQ ID NO: 634434 - DNA, 18 bp, Homo sapiens
cctgttgacctaccctgg

SEQ ID NO: 634435 - DNA, 17 bp, Homo sapiens
cctgttgtctgaaacat

SEQ ID NO: 634436 - DNA, 19 bp, Homo sapiens
cctgttttcacaccttaca

SEQ ID NO: 634437 - DNA, 20 bp, Homo sapiens
ccttaacttactatttagat

SEQ ID NO: 634438 - DNA, 13 bp, Homo sapiens
ccttacaaagcca

SEQ ID NO: 634439 - DNA, 15 bp, Homo sapiens
ccttacaaagccagc

SEQ ID NO: 634440 - DNA, 12 bp, Homo sapiens
ccttagaatgtg

SEQ ID NO: 634441 - DNA, 14 bp, Homo sapiens
ccttatggaacact

SEQ ID NO: 634442 - DNA, 17 bp, Homo sapiens
ccttatggaacactctg

SEQ ID NO: 634443 - DNA, 19 bp, Homo sapiens
ccttatggaacactctgag

SEQ ID NO: 634444 - DNA, 20 bp, Homo sapiens
ccttatggaacactctgaga

SEQ ID NO: 634445 - DNA, 23 bp, Homo sapiens
ccttattaaaatattttcttaat

SEQ ID NO: 634446 - DNA, 14 bp, Homo sapiens
ccttcaagcaccct

SEQ ID NO: 634447 - DNA, 15 bp, Homo sapiens
ccttcaatgttaaat

SEQ ID NO: 634448 - DNA, 15 bp, Homo sapiens
ccttcagtgccttat

SEQ ID NO: 634449 - DNA, 14 bp, Homo sapiens
ccttcataaattat

SEQ ID NO: 634450 - DNA, 19 bp, Homo sapiens
ccttcataaattatttcta

SEQ ID NO: 634451 - DNA, 15 bp, Homo sapiens
ccttcatcccagggt

SEQ ID NO: 634452 - DNA, 17 bp, Homo sapiens
ccttcatgcttttctca

SEQ ID NO: 634453 - DNA, 21 bp, Homo sapiens
ccttcatgcttttctcatggt

SEQ ID NO: 634454 - DNA, 21 bp, Homo sapiens
ccttccaaactctctagtgca

SEQ ID NO: 634455 - DNA, 18 bp, Homo sapiens
ccttccatcttgtggggc

SEQ ID NO: 634456 - DNA, 20 bp, Homo sapiens
ccttccatcttgtggggcca

SEQ ID NO: 634457 - DNA, 15 bp, Homo sapiens
ccttcccaacctccc

SEQ ID NO: 634458 - DNA, 11 bp, Homo sapiens
ccttccccact

SEQ ID NO: 634459 - DNA, 15 bp, Homo sapiens
ccttccccactcccg

SEQ ID NO: 634460 - DNA, 22 bp, Homo sapiens
ccttcccgcagcaccagcctga

SEQ ID NO: 634461 - DNA, 14 bp, Homo sapiens
cggcctggccccct

SEQ ID NO: 634462 - DNA, 16 bp, Homo sapiens
cggcctggccccctcg

SEQ ID NO: 634463 - DNA, 18 bp, Homo sapiens
cggctatgtctcatgttt

SEQ ID NO: 634464 - DNA, 22 bp, Homo sapiens
cggctgaggacggggcagagct

SEQ ID NO: 634465 - DNA, 18 bp, Homo sapiens
cggctggccggtccaccc

SEQ ID NO: 634466 - DNA, 16 bp, Homo sapiens
cggctgggcagggccg

SEQ ID NO: 634467 - DNA, 21 bp, Homo sapiens
cggcttccccatcgccttctg

SEQ ID NO: 634468 - DNA, 13 bp, Homo sapiens
cgggaacgccccc

SEQ ID NO: 634469 - DNA, 15 bp, Homo sapiens
cgggaaggcctgagg

SEQ ID NO: 634470 - DNA, 20 bp, Homo sapiens
cgggaaggcctgagggaagc

SEQ ID NO: 634471 - DNA, 13 bp, Homo sapiens
cgggacagcggcc

SEQ ID NO: 634472 - DNA, 19 bp, Homo sapiens
cgggacagcggcccggccc

SEQ ID NO: 634473 - DNA, 18 bp, Homo sapiens
cgggagagcgccacccgc

SEQ ID NO: 634474 - DNA, 17 bp, Homo sapiens
cgggattacagaaacac

SEQ ID NO: 634475 - DNA, 20 bp, Homo sapiens
cgggcaagatagctccttca

SEQ ID NO: 634476 - DNA, 12 bp, Homo sapiens
cgggcatgacac

SEQ ID NO: 634477 - DNA, 15 bp, Homo sapiens
cgggcatgacacgaa

SEQ ID NO: 634478 - DNA, 10 bp, Homo sapiens
cgggccaggg

SEQ ID NO: 634479 - DNA, 12 bp, Homo sapiens
cgggccagggtg

SEQ ID NO: 634480 - DNA, 14 bp, Homo sapiens
cgggccagggtggg

SEQ ID NO: 634481 - DNA, 15 bp, Homo sapiens
cgggccaggtctggc

SEQ ID NO: 634482 - DNA, 17 bp, Homo sapiens
cgggccaggtctggcgc

SEQ ID NO: 634483 - DNA, 12 bp, Homo sapiens
cgggccgcctcc

SEQ ID NO: 634484 - DNA, 14 bp, Homo sapiens
cgggccgcctcctc

SEQ ID NO: 634485 - DNA, 15 bp, Homo sapiens
cgggccgcctcctcc

SEQ ID NO: 634486 - DNA, 20 bp, Homo sapiens
cgggccgcctcctccagact

SEQ ID NO: 634487 - DNA, 12 bp, Homo sapiens
cgggcgcctgcg

SEQ ID NO: 634488 - DNA, 16 bp, Homo sapiens
cgggcgcctgcgctcc

SEQ ID NO: 634489 - DNA, 18 bp, Homo sapiens
cgggcgcctgcgctcctc

SEQ ID NO: 634490 - DNA, 15 bp, Homo sapiens
cggggcagagctgag

SEQ ID NO: 634491 - DNA, 15 bp, Homo sapiens
cggggcctgggtccc

SEQ ID NO: 634492 - DNA, 23 bp, Homo sapiens
cggggcctgggtccccctcctgc

SEQ ID NO: 634493 - DNA, 21 bp, Homo sapiens
cggggctgccgcatctgcctg

SEQ ID NO: 634494 - DNA, 12 bp, Homo sapiens
cggggctggccc

SEQ ID NO: 634495 - DNA, 12 bp, Homo sapiens
cggggcttctgg

SEQ ID NO: 634496 - DNA, 19 bp, Homo sapiens
cgggggaggagcaccccca

SEQ ID NO: 634497 - DNA, 19 bp, Homo sapiens
cgggggctaactggcccca

SEQ ID NO: 634498 - DNA, 23 bp, Homo sapiens
cgggggctaactggccccaggcg

SEQ ID NO: 634499 - DNA, 20 bp, Homo sapiens
cggggggctgcgggcggggc

SEQ ID NO: 634500 - DNA, 19 bp, Homo sapiens
cggggtggagtcagggctg

SEQ ID NO: 634501 - DNA, 22 bp, Homo sapiens
cgggtcatattcataccttctg

SEQ ID NO: 634502 - DNA, 16 bp, Homo sapiens
cgggtctcgcagcctg

SEQ ID NO: 634503 - DNA, 19 bp, Homo sapiens
cgggtgcgtgaccggcccg

SEQ ID NO: 634504 - DNA, 21 bp, Homo sapiens
cgggtgcgtgaccggcccgcc

SEQ ID NO: 634505 - DNA, 14 bp, Homo sapiens
cgggtggggcctgc

SEQ ID NO: 634506 - DNA, 16 bp, Homo sapiens
cggtgtatgcagtggt

SEQ ID NO: 634507 - DNA, 21 bp, Homo sapiens
cggtgtggggggtgccccaca

SEQ ID NO: 634508 - DNA, 18 bp, Homo sapiens
cggtgtttggaggctgct

SEQ ID NO: 634509 - DNA, 14 bp, Homo sapiens
cgtaagttctgtgc

SEQ ID NO: 634510 - DNA, 22 bp, Homo sapiens
cgtagaacctgcgcaccccgtt

SEQ ID NO: 634511 - DNA, 12 bp, Homo sapiens
cgtcaatgtgaa

SEQ ID NO: 634512 - DNA, 14 bp, Homo sapiens
cgtcaatgtgaaat

SEQ ID NO: 634513 - DNA, 22 bp, Homo sapiens
cgtccctgacttcccagctggc

SEQ ID NO: 634514 - DNA, 20 bp, Homo sapiens
cgtccctgagggcccttccc

SEQ ID NO: 634515 - DNA, 23 bp, Homo sapiens
cgtccctgagggcccttcccaac

SEQ ID NO: 634516 - DNA, 12 bp, Homo sapiens
cgtccctgctca

SEQ ID NO: 634517 - DNA, 19 bp, Homo sapiens
cgtccctttccctgcatcc

SEQ ID NO: 634518 - DNA, 13 bp, Homo sapiens
cgtccgcacgcgg

SEQ ID NO: 634519 - DNA, 19 bp, Homo sapiens
cgtccgcccgcccaccccg

SEQ ID NO: 634520 - DNA, 16 bp, Homo sapiens
cgtccggcctgcagcc

SEQ ID NO: 634521 - DNA, 16 bp, Homo sapiens
cgtcctgctcgccctg

SEQ ID NO: 634522 - DNA, 19 bp, Homo sapiens
cgtcctgctcgccctgtgc

SEQ ID NO: 634523 - DNA, 14 bp, Homo sapiens
cgtcgctgtccgtc

SEQ ID NO: 634524 - DNA, 20 bp, Homo sapiens
cgtcgctgtccgtcctgctc

SEQ ID NO: 634525 - DNA, 18 bp, Homo sapiens
cgtctccccatgctgggc

SEQ ID NO: 634526 - DNA, 19 bp, Homo sapiens
cgtctccccatgctgggct

SEQ ID NO: 634527 - DNA, 20 bp, Homo sapiens
cgtctccccatgctgggctc

SEQ ID NO: 634528 - DNA, 12 bp, Homo sapiens
cgtctctgtccg

SEQ ID NO: 634529 - DNA, 22 bp, Homo sapiens
cgtctctgtccgcgtcctttcc

SEQ ID NO: 634530 - DNA, 19 bp, Homo sapiens
cgtctttggttcctcatgg

SEQ ID NO: 634531 - DNA, 20 bp, Homo sapiens
cgtctttggttcctcatggc

SEQ ID NO: 634532 - DNA, 12 bp, Homo sapiens
cgtgaaacacaa

SEQ ID NO: 634533 - DNA, 18 bp, Homo sapiens
cgtgaccggcccgccacc

SEQ ID NO: 634534 - DNA, 19 bp, Homo sapiens
cgtgacttcagactctctc

SEQ ID NO: 634535 - DNA, 17 bp, Homo sapiens
cgtgaggcccctgtgca

SEQ ID NO: 634536 - DNA, 12 bp, Homo sapiens
cgtgcagcacct

SEQ ID NO: 634537 - DNA, 13 bp, Homo sapiens
cgtgcagggccag

SEQ ID NO: 634538 - DNA, 17 bp, Homo sapiens
cgtgcccatttcacaca

SEQ ID NO: 634539 - DNA, 22 bp, Homo sapiens
cgtgccttccccgtgcggcccg

SEQ ID NO: 634540 - DNA, 20 bp, Homo sapiens
cgtgcgcagccgcgctctgc

SEQ ID NO: 634541 - DNA, 15 bp, Homo sapiens
cgtggaagaagggcc

SEQ ID NO: 634542 - DNA, 17 bp, Homo sapiens
cgtggaagaagggccac

SEQ ID NO: 634543 - DNA, 22 bp, Homo sapiens
cgtggaagaagggccaccctga

SEQ ID NO: 634544 - DNA, 14 bp, Homo sapiens
cgtggctgcttcaa

SEQ ID NO: 634545 - DNA, 23 bp, Homo sapiens
cgtgggagtatgttatttctctg

SEQ ID NO: 634546 - DNA, 14 bp, Homo sapiens
cgtgggatccagag

SEQ ID NO: 634547 - DNA, 18 bp, Homo sapiens
cgtgggatccagagagaa

SEQ ID NO: 634548 - DNA, 21 bp, Homo sapiens
cgtgggcgcaaaggtgcctca

SEQ ID NO: 634549 - DNA, 13 bp, Homo sapiens
cgtgggctccagg

SEQ ID NO: 634550 - DNA, 23 bp, Homo sapiens
cgtggtgaggttgtgctgcctgt

SEQ ID NO: 634551 - DNA, 16 bp, Homo sapiens
cgtggtgtgaggcccc

SEQ ID NO: 634552 - DNA, 22 bp, Homo sapiens
cgtgtatatgaggatgtatgtg

SEQ ID NO: 634553 - DNA, 13 bp, Homo sapiens
cgtgtgcagactg

SEQ ID NO: 634554 - DNA, 14 bp, Homo sapiens
cgtgtgcagactgt

SEQ ID NO: 634555 - DNA, 18 bp, Homo sapiens
cgtgtgcagactgtggct

SEQ ID NO: 634556 - DNA, 14 bp, Homo sapiens
cgtgtggccctgtg

SEQ ID NO: 634557 - DNA, 17 bp, Homo sapiens
cgtgtggccctgtggga

SEQ ID NO: 634558 - DNA, 16 bp, Homo sapiens
cgtgtttcgggccagg

SEQ ID NO: 634559 - DNA, 14 bp, Homo sapiens
cgttaattaaacaa

SEQ ID NO: 634560 - DNA, 19 bp, Homo sapiens
cgttaggaataacactgca

SEQ ID NO: 634561 - DNA, 14 bp, Homo sapiens
cgttcatctgagga

SEQ ID NO: 634562 - DNA, 12 bp, Homo sapiens
cgttctgtttac

SEQ ID NO: 634563 - DNA, 20 bp, Homo sapiens
cgttctgtttacatcagttt

SEQ ID NO: 634564 - DNA, 22 bp, Homo sapiens
cgttggagagcagcaggtgctg

SEQ ID NO: 634565 - DNA, 15 bp, Homo sapiens
cgttgttgtccctgc

SEQ ID NO: 634566 - DNA, 17 bp, Homo sapiens
cgttgttgtccctgcag

SEQ ID NO: 634567 - DNA, 14 bp, Homo sapiens
cgttgttttgtgga

SEQ ID NO: 634568 - DNA, 18 bp, Homo sapiens
cgttgttttgtggataag

SEQ ID NO: 634569 - DNA, 12 bp, Homo sapiens
ctaaaaggagga

SEQ ID NO: 634570 - DNA, 16 bp, Homo sapiens
ctaaaaggaggacagg

SEQ ID NO: 634571 - DNA, 17 bp, Homo sapiens
ctaaaagtgatgtgatt

SEQ ID NO: 634572 - DNA, 15 bp, Homo sapiens
ctaaaccatgaaaag

SEQ ID NO: 634573 - DNA, 21 bp, Homo sapiens
ctaaaccatgaaaagttttca

SEQ ID NO: 634574 - DNA, 20 bp, Homo sapiens
ctaaaggaaacaaagcaata

SEQ ID NO: 634575 - DNA, 23 bp, Homo sapiens
ctaaaggcggagggtctccctgg

SEQ ID NO: 634576 - DNA, 16 bp, Homo sapiens
ctaaagggaagccctg

SEQ ID NO: 634577 - DNA, 15 bp, Homo sapiens
ctaaaggggacagat

SEQ ID NO: 634578 - DNA, 13 bp, Homo sapiens
ctccccctcctcc

SEQ ID NO: 634579 - DNA, 14 bp, Homo sapiens
ctccccctcctcca

SEQ ID NO: 634580 - DNA, 21 bp, Homo sapiens
ctccccgcccgccctcctctg

SEQ ID NO: 634581 - DNA, 22 bp, Homo sapiens
ctccccgcccgccctcctctgc

SEQ ID NO: 634582 - DNA, 13 bp, Homo sapiens
ctcccctccaagt

SEQ ID NO: 634583 - DNA, 11 bp, Homo sapiens
ctcccctccag

SEQ ID NO: 634584 - DNA, 13 bp, Homo sapiens
ctcccctccagac

SEQ ID NO: 634585 - DNA, 16 bp, Homo sapiens
ctcccctccagacccc

SEQ ID NO: 634586 - DNA, 17 bp, Homo sapiens
ctcccctccagacccct

SEQ ID NO: 634587 - DNA, 20 bp, Homo sapiens
ctcccctccagacccctacc

SEQ ID NO: 634588 - DNA, 14 bp, Homo sapiens
ctcccctctcctga

SEQ ID NO: 634589 - DNA, 22 bp, Homo sapiens
ctcccgccgcctcgggccgcct

SEQ ID NO: 634590 - DNA, 14 bp, Homo sapiens
ctcccggctctgag

SEQ ID NO: 634591 - DNA, 19 bp, Homo sapiens
ctccctcacacctcccttc

SEQ ID NO: 634592 - DNA, 18 bp, Homo sapiens
ctccctccacacctccac

SEQ ID NO: 634593 - DNA, 15 bp, Homo sapiens
ctccctccactcctc

SEQ ID NO: 634594 - DNA, 18 bp, Homo sapiens
ctccctcgggctggtgtc

SEQ ID NO: 634595 - DNA, 22 bp, Homo sapiens
ctccctgctgccaggctcccac

SEQ ID NO: 634596 - DNA, 11 bp, Homo sapiens
ctccctgggca

SEQ ID NO: 634597 - DNA, 16 bp, Homo sapiens
ctccctgggcaccctg

SEQ ID NO: 634598 - DNA, 19 bp, Homo sapiens
ctccctgggcaccctgcag

SEQ ID NO: 634599 - DNA, 21 bp, Homo sapiens
ctccctggggaccaggagcta

SEQ ID NO: 634600 - DNA, 22 bp, Homo sapiens
ctccctggggaccaggagctag

SEQ ID NO: 634601 - DNA, 18 bp, Homo sapiens
ctccctggggaggacccc

SEQ ID NO: 634602 - DNA, 19 bp, Homo sapiens
ctccctggggaggacccct

SEQ ID NO: 634603 - DNA, 14 bp, Homo sapiens
ctccctgtctgtct

SEQ ID NO: 634604 - DNA, 19 bp, Homo sapiens
ctcccttctttccttcctt

SEQ ID NO: 634605 - DNA, 14 bp, Homo sapiens
ctccgccccccggc

SEQ ID NO: 634606 - DNA, 22 bp, Homo sapiens
ctccgccccccggcctggcccc

SEQ ID NO: 634607 - DNA, 23 bp, Homo sapiens
ctccgccccccggcctggccccc

SEQ ID NO: 634608 - DNA, 20 bp, Homo sapiens
ctccggatggaatcacagcc

SEQ ID NO: 634609 - DNA, 20 bp, Homo sapiens
ctccggccagcgagtggtca

SEQ ID NO: 634610 - DNA, 14 bp, Homo sapiens
ctccgtccccaggg

SEQ ID NO: 634611 - DNA, 21 bp, Homo sapiens
ctccgtgggcagctcctcggg

SEQ ID NO: 634612 - DNA, 18 bp, Homo sapiens
ctcctagcctctccgccc

SEQ ID NO: 634613 - DNA, 18 bp, Homo sapiens
ctcctcacccctgtaggg

SEQ ID NO: 634614 - DNA, 21 bp, Homo sapiens
ctcctccagactcgagagggc

SEQ ID NO: 634615 - DNA, 21 bp, Homo sapiens
ctcctccaggaggactgttct

SEQ ID NO: 634616 - DNA, 13 bp, Homo sapiens
ctcctccatgctg

SEQ ID NO: 634617 - DNA, 13 bp, Homo sapiens
ctcctcccaactc

SEQ ID NO: 634618 - DNA, 18 bp, Homo sapiens
ctcctccccctcctccat

SEQ ID NO: 634619 - DNA, 20 bp, Homo sapiens
ctcctccccctcctccatgc

SEQ ID NO: 634620 - DNA, 21 bp, Homo sapiens
ctcctccgtgggcagctcctc

SEQ ID NO: 634621 - DNA, 11 bp, Homo sapiens
ctcctcctgca

SEQ ID NO: 634622 - DNA, 18 bp, Homo sapiens
ctcctcgggtggggcctg

SEQ ID NO: 634623 - DNA, 19 bp, Homo sapiens
ctcctcgggtggggcctgc

SEQ ID NO: 634624 - DNA, 15 bp, Homo sapiens
ctcctctctctccct

SEQ ID NO: 634625 - DNA, 13 bp, Homo sapiens
ctcctctctggaa

SEQ ID NO: 634626 - DNA, 15 bp, Homo sapiens
ctcctctgcagcctg

SEQ ID NO: 634627 - DNA, 12 bp, Homo sapiens
ctcctctgcccc

SEQ ID NO: 634628 - DNA, 13 bp, Homo sapiens
ctcctctgcccgc

SEQ ID NO: 634629 - DNA, 12 bp, Homo sapiens
ctcctctgtcag

SEQ ID NO: 634630 - DNA, 22 bp, Homo sapiens
ctcctgcatgtcggggcccctg

SEQ ID NO: 634631 - DNA, 12 bp, Homo sapiens
ctcctgcccacg

SEQ ID NO: 634632 - DNA, 16 bp, Homo sapiens
ctcctgcccacgtgca

SEQ ID NO: 634633 - DNA, 22 bp, Homo sapiens
ctcctgcccacgtgcagcacct

SEQ ID NO: 634634 - DNA, 18 bp, Homo sapiens
ctcctgctgaccttctgc

SEQ ID NO: 634635 - DNA, 23 bp, Homo sapiens
ctcctgggtgggtggggtacagg

SEQ ID NO: 634636 - DNA, 15 bp, Homo sapiens
ctcctgtccagcagg

SEQ ID NO: 634637 - DNA, 13 bp, Homo sapiens
ctcctgtctcctc

SEQ ID NO: 634638 - DNA, 18 bp, Homo sapiens
ctcctgtctcctctgtca

SEQ ID NO: 634639 - DNA, 22 bp, Homo sapiens
ctcctgttttcacaccttacaa

SEQ ID NO: 634640 - DNA, 22 bp, Homo sapiens
ctccttacagaagggagtgaaa

SEQ ID NO: 634641 - DNA, 14 bp, Homo sapiens
ctccttcatgcttt

SEQ ID NO: 634642 - DNA, 16 bp, Homo sapiens
ctccttcatgcttttc

SEQ ID NO: 634643 - DNA, 19 bp, Homo sapiens
ctccttcatgcttttctca

SEQ ID NO: 634644 - DNA, 13 bp, Homo sapiens
ctccttctcccct

SEQ ID NO: 634645 - DNA, 14 bp, Homo sapiens
ctccttctcccctc

SEQ ID NO: 634646 - DNA, 17 bp, Homo sapiens
ctccttctcccctccag

SEQ ID NO: 634647 - DNA, 19 bp, Homo sapiens
ctccttctcccctccagac

SEQ ID NO: 634648 - DNA, 14 bp, Homo sapiens
ctccttgtacttga

SEQ ID NO: 634649 - DNA, 16 bp, Homo sapiens
ctcctttttctacctt

SEQ ID NO: 634650 - DNA, 15 bp, Homo sapiens
ctcgagagggctgag

SEQ ID NO: 634651 - DNA, 20 bp, Homo sapiens
ctcgagagggctgagcccct

SEQ ID NO: 634652 - DNA, 12 bp, Homo sapiens
ctcgcagcctga

SEQ ID NO: 634653 - DNA, 12 bp, Homo sapiens
ctcgccctgtgc

SEQ ID NO: 634654 - DNA, 14 bp, Homo sapiens
ctcgccctgtgccc

SEQ ID NO: 634655 - DNA, 15 bp, Homo sapiens
ctcgggaaggcctga

SEQ ID NO: 634656 - DNA, 23 bp, Homo sapiens
ctcgggaaggcctgagggaagcc

SEQ ID NO: 634657 - DNA, 12 bp, Homo sapiens
ctcgggccgcct

SEQ ID NO: 634658 - DNA, 21 bp, Homo sapiens
ctcgggccgcctcctccagac

SEQ ID NO: 634659 - DNA, 22 bp, Homo sapiens
ctcgggccgcctcctccagact

SEQ ID NO: 634660 - DNA, 14 bp, Homo sapiens
ctcgggcgcctgcg

SEQ ID NO: 634661 - DNA, 13 bp, Homo sapiens
ctcggtggcattt

SEQ ID NO: 634662 - DNA, 19 bp, Homo sapiens
ctcggtggcatttgctgaa

SEQ ID NO: 634663 - DNA, 17 bp, Homo sapiens
ctcgtagaacctgcgca

SEQ ID NO: 634664 - DNA, 17 bp, Homo sapiens
ctcgtccggcctgcagc

SEQ ID NO: 634665 - DNA, 14 bp, Homo sapiens
ctctaattgattca

SEQ ID NO: 634666 - DNA, 13 bp, Homo sapiens
ctctacctggccg

SEQ ID NO: 634667 - DNA, 19 bp, Homo sapiens
ctctagattttgttttgct

SEQ ID NO: 634668 - DNA, 20 bp, Homo sapiens
ctctagattttgttttgctt

SEQ ID NO: 634669 - DNA, 17 bp, Homo sapiens
ctctaggtaaactagca

SEQ ID NO: 634670 - DNA, 20 bp, Homo sapiens
ctctagttgtggacttttcc

SEQ ID NO: 634671 - DNA, 14 bp, Homo sapiens
ctctatccctggcc

SEQ ID NO: 634672 - DNA, 20 bp, Homo sapiens
ctctatccctggccacctgc

SEQ ID NO: 634673 - DNA, 23 bp, Homo sapiens
ctctatggactcgattttaccat

SEQ ID NO: 634674 - DNA, 13 bp, Homo sapiens
ctctcaaaatgtg

SEQ ID NO: 634675 - DNA, 13 bp, Homo sapiens
ctctcagatccct

SEQ ID NO: 634676 - DNA, 18 bp, Homo sapiens
ctctccattcttttaaat

SEQ ID NO: 634677 - DNA, 15 bp, Homo sapiens
ctctccctaccctct

SEQ ID NO: 634678 - DNA, 15 bp, Homo sapiens
ctctccctccactcc

SEQ ID NO: 634679 - DNA, 17 bp, Homo sapiens
ctctcctcggtggcatt

SEQ ID NO: 634680 - DNA, 23 bp, Homo sapiens
ctctcctcggtggcatttgctga

SEQ ID NO: 634681 - DNA, 17 bp, Homo sapiens
ctctcctcgtccggcct

SEQ ID NO: 634682 - DNA, 15 bp, Homo sapiens
ctctcctctctctcc

SEQ ID NO: 634683 - DNA, 12 bp, Homo sapiens
ctctcctctctg

SEQ ID NO: 634684 - DNA, 18 bp, Homo sapiens
ctctcctgagcctgtctc

SEQ ID NO: 634685 - DNA, 19 bp, Homo sapiens
ctctcctgagcctgtctct

SEQ ID NO: 634686 - DNA, 16 bp, Homo sapiens
ctctcgggctctctca

SEQ ID NO: 634687 - DNA, 19 bp, Homo sapiens
ctctcgggctctctcaccc

SEQ ID NO: 634688 - DNA, 19 bp, Homo sapiens
ctctcgtagaacctgcgca

SEQ ID NO: 634689 - DNA, 14 bp, Homo sapiens
ctctctagtgcagg

SEQ ID NO: 634690 - DNA, 12 bp, Homo sapiens
ctctctccctcc

SEQ ID NO: 634691 - DNA, 14 bp, Homo sapiens
ctctctctccctcc

SEQ ID NO: 634692 - DNA, 13 bp, Homo sapiens
ctctctctctctc

SEQ ID NO: 634693 - DNA, 9 bp, Homo sapiens
ctctctctg

SEQ ID NO: 634694 - DNA, 11 bp, Homo sapiens
ctctctctgtt

SEQ ID NO: 634695 - DNA, 15 bp, Homo sapiens
ctctctgaactgcaa

SEQ ID NO: 634696 - DNA, 15 bp, Homo sapiens
ctgcctccctgggga

SEQ ID NO: 634697 - DNA, 23 bp, Homo sapiens
ctgcctccctggggaccaggagc

SEQ ID NO: 634698 - DNA, 19 bp, Homo sapiens
ctgcctctatccctggcca

SEQ ID NO: 634699 - DNA, 15 bp, Homo sapiens
ctgcctgagaccacg

SEQ ID NO: 634700 - DNA, 12 bp, Homo sapiens
ctgcctgaggag

SEQ ID NO: 634701 - DNA, 14 bp, Homo sapiens
ctgcctgaggagga

SEQ ID NO: 634702 - DNA, 18 bp, Homo sapiens
ctgcctggagcctgggca

SEQ ID NO: 634703 - DNA, 19 bp, Homo sapiens
ctgcctggaggagaaggag

SEQ ID NO: 634704 - DNA, 22 bp, Homo sapiens
ctgcctggaggagaaggaggaa

SEQ ID NO: 634705 - DNA, 23 bp, Homo sapiens
ctgcctggaggatagcagagaag

SEQ ID NO: 634706 - DNA, 20 bp, Homo sapiens
ctgcctggcgggcagcccct

SEQ ID NO: 634707 - DNA, 14 bp, Homo sapiens
ctgcgcccctgccc

SEQ ID NO: 634708 - DNA, 17 bp, Homo sapiens
ctgcgcccctgcccagc

SEQ ID NO: 634709 - DNA, 18 bp, Homo sapiens
ctgcgcccctgcccagca

SEQ ID NO: 634710 - DNA, 16 bp, Homo sapiens
ctgcgccctccctccc

SEQ ID NO: 634711 - DNA, 20 bp, Homo sapiens
ctgcgccctccctccctcca

SEQ ID NO: 634712 - DNA, 16 bp, Homo sapiens
ctgcgcctcctcctgc

SEQ ID NO: 634713 - DNA, 18 bp, Homo sapiens
ctgcgcctcctcctgcat

SEQ ID NO: 634714 - DNA, 17 bp, Homo sapiens
ctgcgcctgcgcctcct

SEQ ID NO: 634715 - DNA, 18 bp, Homo sapiens
ctgcgcctgcgcctcctc

SEQ ID NO: 634716 - DNA, 19 bp, Homo sapiens
ctgcgctcctctgcagcct

SEQ ID NO: 634717 - DNA, 23 bp, Homo sapiens
ctgcgctcctctgcagcctgagc

SEQ ID NO: 634718 - DNA, 20 bp, Homo sapiens
ctgcgtgtgttctctccgga

SEQ ID NO: 634719 - DNA, 21 bp, Homo sapiens
ctgctacaccttagcagctct

SEQ ID NO: 634720 - DNA, 22 bp, Homo sapiens
ctgctatgctgttcattgatga

SEQ ID NO: 634721 - DNA, 18 bp, Homo sapiens
ctgctcacgtctgtgagt

SEQ ID NO: 634722 - DNA, 13 bp, Homo sapiens
ctgctcagcccat

SEQ ID NO: 634723 - DNA, 20 bp, Homo sapiens
ctgctcagcccatcccctgc

SEQ ID NO: 634724 - DNA, 13 bp, Homo sapiens
ctgctcccagcct

SEQ ID NO: 634725 - DNA, 19 bp, Homo sapiens
ctgctcccagcctcttgct

SEQ ID NO: 634726 - DNA, 15 bp, Homo sapiens
ctgctcccggtgtgc

SEQ ID NO: 634727 - DNA, 21 bp, Homo sapiens
ctgctcccggtgtgcagcggg

SEQ ID NO: 634728 - DNA, 14 bp, Homo sapiens
ctgctcctgcccac

SEQ ID NO: 634729 - DNA, 18 bp, Homo sapiens
ctgctcctgcccacgtgc

SEQ ID NO: 634730 - DNA, 21 bp, Homo sapiens
ctgctcgccctgtgccctctc

SEQ ID NO: 634731 - DNA, 17 bp, Homo sapiens
ctgctgaattttcacat

SEQ ID NO: 634732 - DNA, 19 bp, Homo sapiens
ctgctgaccttctgcggct

SEQ ID NO: 634733 - DNA, 13 bp, Homo sapiens
ctgctgcactgcc

SEQ ID NO: 634734 - DNA, 18 bp, Homo sapiens
ctgctgcactgccctccg

SEQ ID NO: 634735 - DNA, 21 bp, Homo sapiens
ctgctgcagtcagcacagaga

SEQ ID NO: 634736 - DNA, 18 bp, Homo sapiens
ctgctgcctccctgggga

SEQ ID NO: 634737 - DNA, 23 bp, Homo sapiens
ctgctgcctccctggggaccagg

SEQ ID NO: 634738 - DNA, 18 bp, Homo sapiens
ctgctgctcgggaaggcc

SEQ ID NO: 634739 - DNA, 19 bp, Homo sapiens
ctgctgctcgggaaggcct

SEQ ID NO: 634740 - DNA, 21 bp, Homo sapiens
ctgctgctcgggaaggcctga

SEQ ID NO: 634741 - DNA, 22 bp, Homo sapiens
ctgctgctcgggaaggcctgag

SEQ ID NO: 634742 - DNA, 16 bp, Homo sapiens
ctgctgcttctccctg

SEQ ID NO: 634743 - DNA, 18 bp, Homo sapiens
ctgctgcttctccctggg

SEQ ID NO: 634744 - DNA, 14 bp, Homo sapiens
ctgctgtatttgag

SEQ ID NO: 634745 - DNA, 17 bp, Homo sapiens
ctgctgtgtagctctgt

SEQ ID NO: 634746 - DNA, 19 bp, Homo sapiens
ctgctgtgtagctctgtcc

SEQ ID NO: 634747 - DNA, 12 bp, Homo sapiens
ctgcttagtgtc

SEQ ID NO: 634748 - DNA, 16 bp, Homo sapiens
ctgcttagtgtccctt

SEQ ID NO: 634749 - DNA, 21 bp, Homo sapiens
ctgcttcaaggatcctgagcc

SEQ ID NO: 634750 - DNA, 15 bp, Homo sapiens
ctgcttctccctggg

SEQ ID NO: 634751 - DNA, 16 bp, Homo sapiens
ctgcttctccctgggg

SEQ ID NO: 634752 - DNA, 18 bp, Homo sapiens
ctgcttctctttatagag

SEQ ID NO: 634753 - DNA, 19 bp, Homo sapiens
ctgctttcagtgcctgctg

SEQ ID NO: 634754 - DNA, 21 bp, Homo sapiens
ctgctttcagtgcctgctgtt

SEQ ID NO: 634755 - DNA, 23 bp, Homo sapiens
ctgctttggggcttatcagaact

SEQ ID NO: 634756 - DNA, 16 bp, Homo sapiens
ctggaaggctttattc

SEQ ID NO: 634757 - DNA, 16 bp, Homo sapiens
ctggaccgagtggacc

SEQ ID NO: 634758 - DNA, 20 bp, Homo sapiens
ctggagaccctgcgcccctg

SEQ ID NO: 634759 - DNA, 15 bp, Homo sapiens
ctggagatggatcct

SEQ ID NO: 634760 - DNA, 19 bp, Homo sapiens
ctggagccagggcagagga

SEQ ID NO: 634761 - DNA, 21 bp, Homo sapiens
ctggagccagggcagaggaat

SEQ ID NO: 634762 - DNA, 23 bp, Homo sapiens
ctggagcccctatcctgcaccct

SEQ ID NO: 634763 - DNA, 17 bp, Homo sapiens
ctggagcctgcaggcag

SEQ ID NO: 634764 - DNA, 23 bp, Homo sapiens
ctggagcctgcaggcaggtgggg

SEQ ID NO: 634765 - DNA, 14 bp, Homo sapiens
ctggagcctgggca

SEQ ID NO: 634766 - DNA, 21 bp, Homo sapiens
ctggagcgtgtactaccccag

SEQ ID NO: 634767 - DNA, 14 bp, Homo sapiens
ctggaggagaagga

SEQ ID NO: 634768 - DNA, 18 bp, Homo sapiens
ctggaggagaaggaggaa

SEQ ID NO: 634769 - DNA, 19 bp, Homo sapiens
ctggaggagaaggaggaac

SEQ ID NO: 634770 - DNA, 16 bp, Homo sapiens
ctggagtctgaaggag

SEQ ID NO: 634771 - DNA, 18 bp, Homo sapiens
ctggagtctgaaggagag

SEQ ID NO: 634772 - DNA, 20 bp, Homo sapiens
ctggagtctgaaggagagga

SEQ ID NO: 634773 - DNA, 21 bp, Homo sapiens
ctggagtctgaaggagaggag

SEQ ID NO: 634774 - DNA, 15 bp, Homo sapiens
ctggataatttgtat

SEQ ID NO: 634775 - DNA, 17 bp, Homo sapiens
ctggataggagaggaaa

SEQ ID NO: 634776 - DNA, 13 bp, Homo sapiens
ctggatgaaggca

SEQ ID NO: 634777 - DNA, 14 bp, Homo sapiens
ctggatgaaggcaa

SEQ ID NO: 634778 - DNA, 13 bp, Homo sapiens
ctggatgtgcttt

SEQ ID NO: 634779 - DNA, 21 bp, Homo sapiens
ctggattcccgtggctttgtg

SEQ ID NO: 634780 - DNA, 15 bp, Homo sapiens
ctggcagcgcctccc

SEQ ID NO: 634781 - DNA, 17 bp, Homo sapiens
ctggcagcgcctcccgc

SEQ ID NO: 634782 - DNA, 15 bp, Homo sapiens
ctggccacctgccag

SEQ ID NO: 634783 - DNA, 18 bp, Homo sapiens
ctggccacctgccaggcc

SEQ ID NO: 634784 - DNA, 22 bp, Homo sapiens
ctggccacctgccaggcctccc

SEQ ID NO: 634785 - DNA, 16 bp, Homo sapiens
ctggcccacccctctt

SEQ ID NO: 634786 - DNA, 19 bp, Homo sapiens
ctggcccacccctcttccc

SEQ ID NO: 634787 - DNA, 21 bp, Homo sapiens
ctggccccaggcggaggggct

SEQ ID NO: 634788 - DNA, 15 bp, Homo sapiens
ctggccccctcgcgc

SEQ ID NO: 634789 - DNA, 13 bp, Homo sapiens
ctggccctgcctc

SEQ ID NO: 634790 - DNA, 14 bp, Homo sapiens
ctggccctgcctca

SEQ ID NO: 634791 - DNA, 16 bp, Homo sapiens
ctggccctgcctcact

SEQ ID NO: 634792 - DNA, 21 bp, Homo sapiens
ctggccggtaggctgctggcg

SEQ ID NO: 634793 - DNA, 18 bp, Homo sapiens
ctggccttggttcctcca

SEQ ID NO: 634794 - DNA, 20 bp, Homo sapiens
ctggcgccaggggcaggcag

SEQ ID NO: 634795 - DNA, 15 bp, Homo sapiens
ctggctcccagggtc

SEQ ID NO: 634796 - DNA, 16 bp, Homo sapiens
ctggctgggctttggg

SEQ ID NO: 634797 - DNA, 21 bp, Homo sapiens
ctggctgggctttggggctgg

SEQ ID NO: 634798 - DNA, 13 bp, Homo sapiens
ctggctggggccg

SEQ ID NO: 634799 - DNA, 20 bp, Homo sapiens
ctggctgggtcgcccctcct

SEQ ID NO: 634800 - DNA, 19 bp, Homo sapiens
ctggcttagcgttctgttt

SEQ ID NO: 634801 - DNA, 14 bp, Homo sapiens
ctggctttggcgcc

SEQ ID NO: 634802 - DNA, 13 bp, Homo sapiens
ctgggaaagaact

SEQ ID NO: 634803 - DNA, 19 bp, Homo sapiens
ctgggaaagaacttggact

SEQ ID NO: 634804 - DNA, 16 bp, Homo sapiens
ctgggaaattgctcca

SEQ ID NO: 634805 - DNA, 18 bp, Homo sapiens
ctgggaacatgacccagc

SEQ ID NO: 634806 - DNA, 19 bp, Homo sapiens
ctgggaacatgacccagcc

SEQ ID NO: 634807 - DNA, 22 bp, Homo sapiens
ctgggaacatgacccagcctga

SEQ ID NO: 634808 - DNA, 20 bp, Homo sapiens
ctgggcaaggaagctttgga

SEQ ID NO: 634809 - DNA, 18 bp, Homo sapiens
ctgggcaccacaggctgc

SEQ ID NO: 634810 - DNA, 15 bp, Homo sapiens
ctgggcagggccgca

SEQ ID NO: 634811 - DNA, 19 bp, Homo sapiens
ctgggcagggccgcagggc

SEQ ID NO: 634812 - DNA, 16 bp, Homo sapiens
cttccctgacactgtc

SEQ ID NO: 634813 - DNA, 24 bp, Homo sapiens
cttccctgacactgtctgctgccc

SEQ ID NO: 634814 - DNA, 14 bp, Homo sapiens
cttcctgcccaggg

SEQ ID NO: 634815 - DNA, 12 bp, Homo sapiens
cttcctgtcctg

SEQ ID NO: 634816 - DNA, 10 bp, Homo sapiens
cttccttaac

SEQ ID NO: 634817 - DNA, 16 bp, Homo sapiens
cttccttaacagctgt

SEQ ID NO: 634818 - DNA, 20 bp, Homo sapiens
cttccttaacagctgtatta

SEQ ID NO: 634819 - DNA, 19 bp, Homo sapiens
cttccttttgtatcctcca

SEQ ID NO: 634820 - DNA, 18 bp, Homo sapiens
cttcggcagtggctgggg

SEQ ID NO: 634821 - DNA, 19 bp, Homo sapiens
cttcggcagtggctggggg

SEQ ID NO: 634822 - DNA, 17 bp, Homo sapiens
cttctaactggtaaaaa

SEQ ID NO: 634823 - DNA, 20 bp, Homo sapiens
cttctaatccatgtgctgct

SEQ ID NO: 634824 - DNA, 22 bp, Homo sapiens
cttctactccatggtgaactga

SEQ ID NO: 634825 - DNA, 13 bp, Homo sapiens
cttctattttcaa

SEQ ID NO: 634826 - DNA, 16 bp, Homo sapiens
cttctcagctccactc

SEQ ID NO: 634827 - DNA, 12 bp, Homo sapiens
cttctcccctcc

SEQ ID NO: 634828 - DNA, 17 bp, Homo sapiens
cttctcccctccagacc

SEQ ID NO: 634829 - DNA, 19 bp, Homo sapiens
cttctcccctccagacccc

SEQ ID NO: 634830 - DNA, 13 bp, Homo sapiens
cttctccctgggg

SEQ ID NO: 634831 - DNA, 13 bp, Homo sapiens
cttctccttaacc

SEQ ID NO: 634832 - DNA, 22 bp, Homo sapiens
cttctcctttgtcaaatggtat

SEQ ID NO: 634833 - DNA, 14 bp, Homo sapiens
cttctctctgtgct

SEQ ID NO: 634834 - DNA, 14 bp, Homo sapiens
cttctctttataga

SEQ ID NO: 634835 - DNA, 21 bp, Homo sapiens
cttctgaaaggtgctttctcc

SEQ ID NO: 634836 - DNA, 18 bp, Homo sapiens
cttctggctgctgcagtc

SEQ ID NO: 634837 - DNA, 21 bp, Homo sapiens
cttctgggacaggcaccatgc

SEQ ID NO: 634838 - DNA, 23 bp, Homo sapiens
cttctgggcgccggttccacgtg

SEQ ID NO: 634839 - DNA, 16 bp, Homo sapiens
cttctggggagggaca

SEQ ID NO: 634840 - DNA, 21 bp, Homo sapiens
cttctggggaggggctccgtg

SEQ ID NO: 634841 - DNA, 19 bp, Homo sapiens
cttctgtgcatctggcctg

SEQ ID NO: 634842 - DNA, 18 bp, Homo sapiens
cttcttaaggacagtgtt

SEQ ID NO: 634843 - DNA, 19 bp, Homo sapiens
cttcttaaggacagtgttc

SEQ ID NO: 634844 - DNA, 21 bp, Homo sapiens
cttcttacgaacgccacggcc

SEQ ID NO: 634845 - DNA, 22 bp, Homo sapiens
cttcttacgaacgccacggccg

SEQ ID NO: 634846 - DNA, 15 bp, Homo sapiens
cttcttcccccaggg

SEQ ID NO: 634847 - DNA, 18 bp, Homo sapiens
cttcttgcggcaccgccc

SEQ ID NO: 634848 - DNA, 19 bp, Homo sapiens
cttcttgcggcaccgccca

SEQ ID NO: 634849 - DNA, 13 bp, Homo sapiens
cttctttcctctt

SEQ ID NO: 634850 - DNA, 14 bp, Homo sapiens
cttctttcctctta

SEQ ID NO: 634851 - DNA, 16 bp, Homo sapiens
cttctttccttccttt

SEQ ID NO: 634852 - DNA, 17 bp, Homo sapiens
cttgaaattatatctgt

SEQ ID NO: 634853 - DNA, 21 bp, Homo sapiens
cttgaaattatatctgtggtc

SEQ ID NO: 634854 - DNA, 14 bp, Homo sapiens
cttgaagaactgac

SEQ ID NO: 634855 - DNA, 18 bp, Homo sapiens
cttgaatgcttaaatgat

SEQ ID NO: 634856 - DNA, 19 bp, Homo sapiens
cttgaatgcttaaatgatc

SEQ ID NO: 634857 - DNA, 17 bp, Homo sapiens
cttgacaggcgccgcct

SEQ ID NO: 634858 - DNA, 15 bp, Homo sapiens
cttgagaccagcctg

SEQ ID NO: 634859 - DNA, 19 bp, Homo sapiens
cttgagaccagcctgccag

SEQ ID NO: 634860 - DNA, 16 bp, Homo sapiens
cttgagcatgcccaaa

SEQ ID NO: 634861 - DNA, 11 bp, Homo sapiens
cttgagcctgt

SEQ ID NO: 634862 - DNA, 12 bp, Homo sapiens
cttgagcctgtc

SEQ ID NO: 634863 - DNA, 21 bp, Homo sapiens
cttgagcctgtcacgtggtca

SEQ ID NO: 634864 - DNA, 16 bp, Homo sapiens
cttgagtgggccccct

SEQ ID NO: 634865 - DNA, 19 bp, Homo sapiens
cttgagtgggccccctctc

SEQ ID NO: 634866 - DNA, 20 bp, Homo sapiens
cttgatgtttctatatgtaa

SEQ ID NO: 634867 - DNA, 22 bp, Homo sapiens
cttgattaaggactacagaatt

SEQ ID NO: 634868 - DNA, 14 bp, Homo sapiens
cttgattcaaataa

SEQ ID NO: 634869 - DNA, 14 bp, Homo sapiens
cttgcactgtatcc

SEQ ID NO: 634870 - DNA, 14 bp, Homo sapiens
cttgcacttctgtt

SEQ ID NO: 634871 - DNA, 15 bp, Homo sapiens
cttgcggcaccgccc

SEQ ID NO: 634872 - DNA, 19 bp, Homo sapiens
cttgcggcaccgcccaccc

SEQ ID NO: 634873 - DNA, 21 bp, Homo sapiens
cttgcggcaccgcccacccac

SEQ ID NO: 634874 - DNA, 14 bp, Homo sapiens
cttgctacctcagt

SEQ ID NO: 634875 - DNA, 16 bp, Homo sapiens
cttgctctacctggcc

SEQ ID NO: 634876 - DNA, 13 bp, Homo sapiens
cttgctgggccag

SEQ ID NO: 634877 - DNA, 22 bp, Homo sapiens
cttgctgggccagggaaacaaa

SEQ ID NO: 634878 - DNA, 13 bp, Homo sapiens
cttgctgtgaaac

SEQ ID NO: 634879 - DNA, 17 bp, Homo sapiens
cttgctgtgaaacagtg

SEQ ID NO: 634880 - DNA, 18 bp, Homo sapiens
cttgctgtgaaacagtgt

SEQ ID NO: 634881 - DNA, 23 bp, Homo sapiens
cttgctgtttaccgcccacccag

SEQ ID NO: 634882 - DNA, 22 bp, Homo sapiens
cttggacttctaaaggcggagg

SEQ ID NO: 634883 - DNA, 13 bp, Homo sapiens
cttggagagagag

SEQ ID NO: 634884 - DNA, 11 bp, Homo sapiens
cttggagagga

SEQ ID NO: 634885 - DNA, 21 bp, Homo sapiens
cttggagaggagagtggcagg

SEQ ID NO: 634886 - DNA, 21 bp, Homo sapiens
cttggagaggaggtgtggagt

SEQ ID NO: 634887 - DNA, 15 bp, Homo sapiens
cttggagcagagacg

SEQ ID NO: 634888 - DNA, 16 bp, Homo sapiens
cttggagcagagacgg

SEQ ID NO: 634889 - DNA, 16 bp, Homo sapiens
cttggagccccctggc

SEQ ID NO: 634890 - DNA, 20 bp, Homo sapiens
cttggataggagcttccaga

SEQ ID NO: 634891 - DNA, 16 bp, Homo sapiens
cttggcattgaccttc

SEQ ID NO: 634892 - DNA, 23 bp, Homo sapiens
cttgggaaacagagaaccctgtg

SEQ ID NO: 634893 - DNA, 17 bp, Homo sapiens
cttgggacggaagtggc

SEQ ID NO: 634894 - DNA, 16 bp, Homo sapiens
cttgggattcctcccc

SEQ ID NO: 634895 - DNA, 21 bp, Homo sapiens
cttgggattcctcccctggaa

SEQ ID NO: 634896 - DNA, 19 bp, Homo sapiens
cttgggcacgggagagcgc

SEQ ID NO: 634897 - DNA, 20 bp, Homo sapiens
cttgggcacgggagagcgcc

SEQ ID NO: 634898 - DNA, 16 bp, Homo sapiens
cttgggctggcaccca

SEQ ID NO: 634899 - DNA, 18 bp, Homo sapiens
cttgggctggcacccact

SEQ ID NO: 634900 - DNA, 17 bp, Homo sapiens
cttggggtagagaggac

SEQ ID NO: 634901 - DNA, 14 bp, Homo sapiens
cttggtctgtgttc

SEQ ID NO: 634902 - DNA, 20 bp, Homo sapiens
cttggtgattacctgaaagc

SEQ ID NO: 634903 - DNA, 16 bp, Homo sapiens
cttggtgctttgtcta

SEQ ID NO: 634904 - DNA, 20 bp, Homo sapiens
cttggtgtcgggcatgacac

SEQ ID NO: 634905 - DNA, 17 bp, Homo sapiens
cttggtgttgttatggc

SEQ ID NO: 634906 - DNA, 13 bp, Homo sapiens
cttggttcctcca

SEQ ID NO: 634907 - DNA, 16 bp, Homo sapiens
cttggttcctccagca

SEQ ID NO: 634908 - DNA, 21 bp, Homo sapiens
cttggtttccatcaaagccct

SEQ ID NO: 634909 - DNA, 22 bp, Homo sapiens
cttggtttccatcaaagccctc

SEQ ID NO: 634910 - DNA, 15 bp, Homo sapiens
cttgtaaaactgtga

SEQ ID NO: 634911 - DNA, 22 bp, Homo sapiens
cttgtaaaactgtgacattcca

SEQ ID NO: 634912 - DNA, 21 bp, Homo sapiens
cttgtaaataatgcttaacat

SEQ ID NO: 634913 - DNA, 22 bp, Homo sapiens
cttgtaaatgggaaaatatata

SEQ ID NO: 634914 - DNA, 21 bp, Homo sapiens
cttgtacagaaccagcactcc

SEQ ID NO: 634915 - DNA, 19 bp, Homo sapiens
cttgtctcctcctccagga

SEQ ID NO: 634916 - DNA, 16 bp, Homo sapiens
cttgtctgtgtatttc

SEQ ID NO: 634917 - DNA, 21 bp, Homo sapiens
cttgtgcagaaaacattgttc

SEQ ID NO: 634918 - DNA, 15 bp, Homo sapiens
cttgtggggccagga

SEQ ID NO: 634919 - DNA, 17 bp, Homo sapiens
cttgtgtaatttcctgc

SEQ ID NO: 634920 - DNA, 21 bp, Homo sapiens
cttgtgtaatttcctgctcct

SEQ ID NO: 634921 - DNA, 15 bp, Homo sapiens
cttgttatgttgtaa

SEQ ID NO: 634922 - DNA, 22 bp, Homo sapiens
cttgttcagtcacttgtttgtg

SEQ ID NO: 634923 - DNA, 18 bp, Homo sapiens
ctttaaaaccacagctgg

SEQ ID NO: 634924 - DNA, 21 bp, Homo sapiens
ctttaaaagaaggtaaataat

SEQ ID NO: 634925 - DNA, 21 bp, Homo sapiens
ctttaatatactccttaaaaa

SEQ ID NO: 634926 - DNA, 14 bp, Homo sapiens
ctttactaacactg

SEQ ID NO: 634927 - DNA, 22 bp, Homo sapiens
ctttataagccaatgaagcaaa

SEQ ID NO: 634928 - DNA, 20 bp, Homo sapiens
gacaagtctgagtagttatg

SEQ ID NO: 634929 - DNA, 13 bp, Homo sapiens
gacaataagaaac

SEQ ID NO: 634930 - DNA, 18 bp, Homo sapiens
gacaatgcaaaccatcat

SEQ ID NO: 634931 - DNA, 21 bp, Homo sapiens
gacacacaagcagacacacac

SEQ ID NO: 634932 - DNA, 20 bp, Homo sapiens
gacacacacatatatacata

SEQ ID NO: 634933 - DNA, 21 bp, Homo sapiens
gacacacacatatatacatac

SEQ ID NO: 634934 - DNA, 21 bp, Homo sapiens
gacacagaggacggcttcccc

SEQ ID NO: 634935 - DNA, 18 bp, Homo sapiens
gacacagcacaagggcac

SEQ ID NO: 634936 - DNA, 17 bp, Homo sapiens
gacacccaaagcccact

SEQ ID NO: 634937 - DNA, 18 bp, Homo sapiens
gacaccctcctgcccccc

SEQ ID NO: 634938 - DNA, 15 bp, Homo sapiens
gacacgaatattgct

SEQ ID NO: 634939 - DNA, 14 bp, Homo sapiens
gacactgtctgctg

SEQ ID NO: 634940 - DNA, 18 bp, Homo sapiens
gacagaaccaacgggtct

SEQ ID NO: 634941 - DNA, 19 bp, Homo sapiens
gacagaaccaacgggtctg

SEQ ID NO: 634942 - DNA, 14 bp, Homo sapiens
gacagacagacaga

SEQ ID NO: 634943 - DNA, 23 bp, Homo sapiens
gacagacggacgggacagcggcc

SEQ ID NO: 634944 - DNA, 15 bp, Homo sapiens
gacagagatcagaat

SEQ ID NO: 634945 - DNA, 16 bp, Homo sapiens
gacagaggccggggtc

SEQ ID NO: 634946 - DNA, 19 bp, Homo sapiens
gacagaggccggggtccag

SEQ ID NO: 634947 - DNA, 20 bp, Homo sapiens
gacagaggtttcattttcat

SEQ ID NO: 634948 - DNA, 13 bp, Homo sapiens
gacagagtgccct

SEQ ID NO: 634949 - DNA, 17 bp, Homo sapiens
gacagagtggatctgga

SEQ ID NO: 634950 - DNA, 21 bp, Homo sapiens
gacagagtggatctggagtct

SEQ ID NO: 634951 - DNA, 15 bp, Homo sapiens
gacagcaaacacagt

SEQ ID NO: 634952 - DNA, 16 bp, Homo sapiens
gacagcggccccgcgg

SEQ ID NO: 634953 - DNA, 13 bp, Homo sapiens
gacagcggcccgg

SEQ ID NO: 634954 - DNA, 18 bp, Homo sapiens
gacagcggcccggcccac

SEQ ID NO: 634955 - DNA, 12 bp, Homo sapiens
gacagcttcccc

SEQ ID NO: 634956 - DNA, 19 bp, Homo sapiens
gacaggcgccgcctcgccc

SEQ ID NO: 634957 - DNA, 12 bp, Homo sapiens
gacagggtgggg

SEQ ID NO: 634958 - DNA, 10 bp, Homo sapiens
gacagtgcct

SEQ ID NO: 634959 - DNA, 17 bp, Homo sapiens
gacagtggttatatttc

SEQ ID NO: 634960 - DNA, 23 bp, Homo sapiens
gacataagctggtatcagtggtt

SEQ ID NO: 634961 - DNA, 22 bp, Homo sapiens
gacattgtcagaatgttgtgtt

SEQ ID NO: 634962 - DNA, 16 bp, Homo sapiens
gacatttatgtacaaa

SEQ ID NO: 634963 - DNA, 21 bp, Homo sapiens
gacatttcaatcactgaaaat

SEQ ID NO: 634964 - DNA, 14 bp, Homo sapiens
gacattttgtagct

SEQ ID NO: 634965 - DNA, 17 bp, Homo sapiens
gaccaactatattgcga

SEQ ID NO: 634966 - DNA, 20 bp, Homo sapiens
gaccacactctgcctggcct

SEQ ID NO: 634967 - DNA, 16 bp, Homo sapiens
gaccaccgcgcccctc

SEQ ID NO: 634968 - DNA, 18 bp, Homo sapiens
gaccaccgcgcccctctg

SEQ ID NO: 634969 - DNA, 17 bp, Homo sapiens
gaccacgacctcgtcca

SEQ ID NO: 634970 - DNA, 20 bp, Homo sapiens
gaccacggtccaatccagcc

SEQ ID NO: 634971 - DNA, 21 bp, Homo sapiens
gaccacggtccaatccagcct

SEQ ID NO: 634972 - DNA, 22 bp, Homo sapiens
gaccacggtgtggggggtgccc

SEQ ID NO: 634973 - DNA, 11 bp, Homo sapiens
gaccagcatag

SEQ ID NO: 634974 - DNA, 14 bp, Homo sapiens
gaccagcctgccag

SEQ ID NO: 634975 - DNA, 18 bp, Homo sapiens
gaccagcctgccaggccc

SEQ ID NO: 634976 - DNA, 23 bp, Homo sapiens
gaccagcctgccaggccctccag

SEQ ID NO: 634977 - DNA, 22 bp, Homo sapiens
gaccaggagctagcccagtccc

SEQ ID NO: 634978 - DNA, 22 bp, Homo sapiens
gaccatgcattcagatctgaag

SEQ ID NO: 634979 - DNA, 22 bp, Homo sapiens
gaccatggccgaagccccttgg

SEQ ID NO: 634980 - DNA, 23 bp, Homo sapiens
gaccatggccgaagccccttgga

SEQ ID NO: 634981 - DNA, 13 bp, Homo sapiens
gacccagcctgaa

SEQ ID NO: 634982 - DNA, 15 bp, Homo sapiens
gacccagggaatgcc

SEQ ID NO: 634983 - DNA, 13 bp, Homo sapiens
gacccccccagtc

SEQ ID NO: 634984 - DNA, 15 bp, Homo sapiens
gacccccccagtccg

SEQ ID NO: 634985 - DNA, 15 bp, Homo sapiens
gacccctaccctttc

SEQ ID NO: 634986 - DNA, 15 bp, Homo sapiens
gacccctgccctcgg

SEQ ID NO: 634987 - DNA, 17 bp, Homo sapiens
gacccctgccctcggcc

SEQ ID NO: 634988 - DNA, 18 bp, Homo sapiens
gacccctgccctcggcca

SEQ ID NO: 634989 - DNA, 16 bp, Homo sapiens
gaccctatttgtttca

SEQ ID NO: 634990 - DNA, 11 bp, Homo sapiens
gaccctcactt

SEQ ID NO: 634991 - DNA, 17 bp, Homo sapiens
gaccctcctgtccagca

SEQ ID NO: 634992 - DNA, 20 bp, Homo sapiens
gaccctcctgtccagcaggt

SEQ ID NO: 634993 - DNA, 16 bp, Homo sapiens
gaccctgcgcccctgc

SEQ ID NO: 634994 - DNA, 14 bp, Homo sapiens
gaccgacgcccctc

SEQ ID NO: 634995 - DNA, 15 bp, Homo sapiens
gaccgacgcccctcc

SEQ ID NO: 634996 - DNA, 18 bp, Homo sapiens
gaccggagcggctgagga

SEQ ID NO: 634997 - DNA, 16 bp, Homo sapiens
gaccggcccgccacct

SEQ ID NO: 634998 - DNA, 22 bp, Homo sapiens
gacctacatctgaaatctacaa

SEQ ID NO: 634999 - DNA, 20 bp, Homo sapiens
gacctaccctggaccgagtg

SEQ ID NO: 635000 - DNA, 20 bp, Homo sapiens
gacctctcacttttttataa

SEQ ID NO: 635001 - DNA, 15 bp, Homo sapiens
gacctgctcctgccc

SEQ ID NO: 635002 - DNA, 22 bp, Homo sapiens
gaccttcggcagtggctggggg

SEQ ID NO: 635003 - DNA, 19 bp, Homo sapiens
gacctttcaataggaaaaa

SEQ ID NO: 635004 - DNA, 19 bp, Homo sapiens
gacgcaagaggtttcagca

SEQ ID NO: 635005 - DNA, 14 bp, Homo sapiens
gacgcccagccccc

SEQ ID NO: 635006 - DNA, 20 bp, Homo sapiens
gacgcccagcccccaccccc

SEQ ID NO: 635007 - DNA, 12 bp, Homo sapiens
gacgcccctccg

SEQ ID NO: 635008 - DNA, 15 bp, Homo sapiens
gacggacgggacagc

SEQ ID NO: 635009 - DNA, 12 bp, Homo sapiens
gacggcagcccc

SEQ ID NO: 635010 - DNA, 16 bp, Homo sapiens
gacggcagccccatcc

SEQ ID NO: 635011 - DNA, 19 bp, Homo sapiens
gacgggacagcggcccggc

SEQ ID NO: 635012 - DNA, 14 bp, Homo sapiens
gacggggcagagct

SEQ ID NO: 635013 - DNA, 15 bp, Homo sapiens
gacggggcagagctg

SEQ ID NO: 635014 - DNA, 11 bp, Homo sapiens
gactacagaag

SEQ ID NO: 635015 - DNA, 13 bp, Homo sapiens
gactacagaattg

SEQ ID NO: 635016 - DNA, 15 bp, Homo sapiens
gactaggaggttccg

SEQ ID NO: 635017 - DNA, 24 bp, Homo sapiens
gactcagtatgctttccctgagga

SEQ ID NO: 635018 - DNA, 18 bp, Homo sapiens
gactccaaggagctactg

SEQ ID NO: 635019 - DNA, 17 bp, Homo sapiens
gactccagaagcagcag

SEQ ID NO: 635020 - DNA, 23 bp, Homo sapiens
gactccccgcccgccctcctctg

SEQ ID NO: 635021 - DNA, 17 bp, Homo sapiens
gactcgagagggctgag

SEQ ID NO: 635022 - DNA, 21 bp, Homo sapiens
gactctaaaactatcagcagc

SEQ ID NO: 635023 - DNA, 14 bp, Homo sapiens
gactctctcctctc

SEQ ID NO: 635024 - DNA, 15 bp, Homo sapiens
gactctctcctctct

SEQ ID NO: 635025 - DNA, 23 bp, Homo sapiens
gactctctcctctctctccctcc

SEQ ID NO: 635026 - DNA, 11 bp, Homo sapiens
gactgaagaaa

SEQ ID NO: 635027 - DNA, 22 bp, Homo sapiens
gactgcccaccctgggcctccc

SEQ ID NO: 635028 - DNA, 13 bp, Homo sapiens
gactggcccaccc

SEQ ID NO: 635029 - DNA, 15 bp, Homo sapiens
gactggcccacccct

SEQ ID NO: 635030 - DNA, 16 bp, Homo sapiens
gactggcccacccctc

SEQ ID NO: 635031 - DNA, 17 bp, Homo sapiens
gactggcccacccctct

SEQ ID NO: 635032 - DNA, 19 bp, Homo sapiens
gactggcccacccctcttc

SEQ ID NO: 635033 - DNA, 13 bp, Homo sapiens
gactgggctgctg

SEQ ID NO: 635034 - DNA, 14 bp, Homo sapiens
gactgggctgctgg

SEQ ID NO: 635035 - DNA, 15 bp, Homo sapiens
gactgggctgctggg

SEQ ID NO: 635036 - DNA, 16 bp, Homo sapiens
gactgggctgctgggg

SEQ ID NO: 635037 - DNA, 17 bp, Homo sapiens
gactgggctgctggggc

SEQ ID NO: 635038 - DNA, 16 bp, Homo sapiens
gactgggtttatgtcc

SEQ ID NO: 635039 - DNA, 22 bp, Homo sapiens
gactgttctaactagtaatctt

SEQ ID NO: 635040 - DNA, 12 bp, Homo sapiens
gacttaatttag

SEQ ID NO: 635041 - DNA, 15 bp, Homo sapiens
gacttcagactctct

SEQ ID NO: 635042 - DNA, 15 bp, Homo sapiens
gacttcccagctggc

SEQ ID NO: 635043 - DNA, 16 bp, Homo sapiens
gacttcccagctggca

SEQ ID NO: 635044 - DNA, 24 bp, Homo sapiens
gacttcccagctggcagcgcctcc

SEQ ID NO: 635045 - DNA, 21 bp, Homo sapiens
gatccttccatcttgtggggc

SEQ ID NO: 635046 - DNA, 14 bp, Homo sapiens
gatcgtgccgtgga

SEQ ID NO: 635047 - DNA, 17 bp, Homo sapiens
gatcgtgccgtggagct

SEQ ID NO: 635048 - DNA, 18 bp, Homo sapiens
gatctaaaaggaggacag

SEQ ID NO: 635049 - DNA, 19 bp, Homo sapiens
gatctaaaaggaggacagg

SEQ ID NO: 635050 - DNA, 21 bp, Homo sapiens
gatctcagcatcctggaaatt

SEQ ID NO: 635051 - DNA, 15 bp, Homo sapiens
gatctccagttgtat

SEQ ID NO: 635052 - DNA, 12 bp, Homo sapiens
gatctcctgtgc

SEQ ID NO: 635053 - DNA, 16 bp, Homo sapiens
gatctggtgcgtgtgg

SEQ ID NO: 635054 - DNA, 18 bp, Homo sapiens
gatctggtgcgtgtggcc

SEQ ID NO: 635055 - DNA, 22 bp, Homo sapiens
gatctggtgcgtgtggccctgt

SEQ ID NO: 635056 - DNA, 23 bp, Homo sapiens
gatctggtgcgtgtggccctgtg

SEQ ID NO: 635057 - DNA, 13 bp, Homo sapiens
gatctgttgtaat

SEQ ID NO: 635058 - DNA, 17 bp, Homo sapiens
gatctgttgtaatatca

SEQ ID NO: 635059 - DNA, 22 bp, Homo sapiens
gatcttgagcaaggcaagaagt

SEQ ID NO: 635060 - DNA, 22 bp, Homo sapiens
gatctttttttaagtgttctgt

SEQ ID NO: 635061 - DNA, 18 bp, Homo sapiens
gatgaaaaagcatgtaca

SEQ ID NO: 635062 - DNA, 19 bp, Homo sapiens
gatgaaaaagcatgtacag

SEQ ID NO: 635063 - DNA, 22 bp, Homo sapiens
gatgaaaaagcatgtacagtgt

SEQ ID NO: 635064 - DNA, 23 bp, Homo sapiens
gatgaagaccctatctcccacaa

SEQ ID NO: 635065 - DNA, 14 bp, Homo sapiens
gatgagaggaaatc

SEQ ID NO: 635066 - DNA, 20 bp, Homo sapiens
gatgagattccctctcctcc

SEQ ID NO: 635067 - DNA, 21 bp, Homo sapiens
gatgaggctggataggagagg

SEQ ID NO: 635068 - DNA, 14 bp, Homo sapiens
gatgcatattaaag

SEQ ID NO: 635069 - DNA, 23 bp, Homo sapiens
gatgcccctgcagtttggccctg

SEQ ID NO: 635070 - DNA, 14 bp, Homo sapiens
gatgcccctggccc

SEQ ID NO: 635071 - DNA, 17 bp, Homo sapiens
gatgcccctggccctgc

SEQ ID NO: 635072 - DNA, 15 bp, Homo sapiens
gatgcgtggctccca

SEQ ID NO: 635073 - DNA, 16 bp, Homo sapiens
gatgctagttcttacg

SEQ ID NO: 635074 - DNA, 16 bp, Homo sapiens
gatggaggtttcatac

SEQ ID NO: 635075 - DNA, 14 bp, Homo sapiens
gatggatttgacac

SEQ ID NO: 635076 - DNA, 14 bp, Homo sapiens
gatggccaggcctc

SEQ ID NO: 635077 - DNA, 14 bp, Homo sapiens
gatgggtcctgctg

SEQ ID NO: 635078 - DNA, 23 bp, Homo sapiens
gatgggttttgttaggggtgggg

SEQ ID NO: 635079 - DNA, 17 bp, Homo sapiens
gatggtgcaatgacctt

SEQ ID NO: 635080 - DNA, 23 bp, Homo sapiens
gatggtgcaatgacctttcaata

SEQ ID NO: 635081 - DNA, 13 bp, Homo sapiens
gatgtatgtgtat

SEQ ID NO: 635082 - DNA, 21 bp, Homo sapiens
gatgtgtccgtgaaagttgtg

SEQ ID NO: 635083 - DNA, 18 bp, Homo sapiens
gatgtttaacttaatcaa

SEQ ID NO: 635084 - DNA, 17 bp, Homo sapiens
gatgtttagtagctgat

SEQ ID NO: 635085 - DNA, 20 bp, Homo sapiens
gatgtttccaagatgtccca

SEQ ID NO: 635086 - DNA, 19 bp, Homo sapiens
gattaaggactacagaatt

SEQ ID NO: 635087 - DNA, 14 bp, Homo sapiens
gattagacaatgtg

SEQ ID NO: 635088 - DNA, 14 bp, Homo sapiens
gattattttctata

SEQ ID NO: 635089 - DNA, 18 bp, Homo sapiens
gattcaaataaccctgaa

SEQ ID NO: 635090 - DNA, 13 bp, Homo sapiens
gattcaatgtgaa

SEQ ID NO: 635091 - DNA, 19 bp, Homo sapiens
gattcctacttaaacaaaa

SEQ ID NO: 635092 - DNA, 17 bp, Homo sapiens
gattcctcccccagagc

SEQ ID NO: 635093 - DNA, 17 bp, Homo sapiens
gattctaaaggggacag

SEQ ID NO: 635094 - DNA, 24 bp, Homo sapiens
gattctaaaggggacagatcttga

SEQ ID NO: 635095 - DNA, 18 bp, Homo sapiens
gattcttttttcaatgta

SEQ ID NO: 635096 - DNA, 22 bp, Homo sapiens
gattcttttttcaatgtactgt

SEQ ID NO: 635097 - DNA, 18 bp, Homo sapiens
gattgacattttgtagct

SEQ ID NO: 635098 - DNA, 21 bp, Homo sapiens
gattgacttcagaaacttttt

SEQ ID NO: 635099 - DNA, 19 bp, Homo sapiens
gattgaggagttgcctgac

SEQ ID NO: 635100 - DNA, 16 bp, Homo sapiens
gattggtaccagagcc

SEQ ID NO: 635101 - DNA, 19 bp, Homo sapiens
gattgtaaaggtaggtgca

SEQ ID NO: 635102 - DNA, 22 bp, Homo sapiens
gattgtttgatgaataaaatgt

SEQ ID NO: 635103 - DNA, 12 bp, Homo sapiens
gatttaattctt

SEQ ID NO: 635104 - DNA, 15 bp, Homo sapiens
gatttatcaatattt

SEQ ID NO: 635105 - DNA, 13 bp, Homo sapiens
gatttatgcattt

SEQ ID NO: 635106 - DNA, 16 bp, Homo sapiens
gatttcactctccttg

SEQ ID NO: 635107 - DNA, 18 bp, Homo sapiens
gatttcatgattagacaa

SEQ ID NO: 635108 - DNA, 16 bp, Homo sapiens
gatttgtaaaacagtg

SEQ ID NO: 635109 - DNA, 18 bp, Homo sapiens
gatttgtaaaacagtggt

SEQ ID NO: 635110 - DNA, 12 bp, Homo sapiens
gatttgtattaa

SEQ ID NO: 635111 - DNA, 19 bp, Homo sapiens
gattttccttttttataca

SEQ ID NO: 635112 - DNA, 22 bp, Homo sapiens
gatttttttttccttcagtgcc

SEQ ID NO: 635113 - DNA, 15 bp, Homo sapiens
gcaaaaatttgacat

SEQ ID NO: 635114 - DNA, 18 bp, Homo sapiens
gcaaaatacatgatgatt

SEQ ID NO: 635115 - DNA, 21 bp, Homo sapiens
gcaaaatacatgatgatttca

SEQ ID NO: 635116 - DNA, 17 bp, Homo sapiens
gcaaacaactttctgga

SEQ ID NO: 635117 - DNA, 19 bp, Homo sapiens
gcaaacacacagactctgt

SEQ ID NO: 635118 - DNA, 10 bp, Homo sapiens
gcaaacattt

SEQ ID NO: 635119 - DNA, 15 bp, Homo sapiens
gcaaacatttaaaaa

SEQ ID NO: 635120 - DNA, 12 bp, Homo sapiens
gcaaaccatcat

SEQ ID NO: 635121 - DNA, 16 bp, Homo sapiens
gcaaaccatcattgaa

SEQ ID NO: 635122 - DNA, 20 bp, Homo sapiens
gcaaaccatcattgaaatct

SEQ ID NO: 635123 - DNA, 15 bp, Homo sapiens
gcaaagaactgcccc

SEQ ID NO: 635124 - DNA, 17 bp, Homo sapiens
gcaaagaactgccccat

SEQ ID NO: 635125 - DNA, 14 bp, Homo sapiens
gcaaaggagggcaa

SEQ ID NO: 635126 - DNA, 18 bp, Homo sapiens
gcaacaacaacagaacaa

SEQ ID NO: 635127 - DNA, 16 bp, Homo sapiens
gcaacagctgtgtgtg

SEQ ID NO: 635128 - DNA, 12 bp, Homo sapiens
gcaacatctttt

SEQ ID NO: 635129 - DNA, 18 bp, Homo sapiens
gcaacctgacagcaaaca

SEQ ID NO: 635130 - DNA, 20 bp, Homo sapiens
gcaacctgacagcaaacaca

SEQ ID NO: 635131 - DNA, 15 bp, Homo sapiens
gcaacttgaaattat

SEQ ID NO: 635132 - DNA, 13 bp, Homo sapiens
gcaagaagtggga

SEQ ID NO: 635133 - DNA, 20 bp, Homo sapiens
gcaagaggtttcagcattcc

SEQ ID NO: 635134 - DNA, 20 bp, Homo sapiens
gcaagctcatagcacatgtt

SEQ ID NO: 635135 - DNA, 15 bp, Homo sapiens
gcaaggaagctttgg

SEQ ID NO: 635136 - DNA, 19 bp, Homo sapiens
gcaaggacaacctgcccct

SEQ ID NO: 635137 - DNA, 19 bp, Homo sapiens
gcaaggcaagaagtgggat

SEQ ID NO: 635138 - DNA, 19 bp, Homo sapiens
gcaataacagttttaagat

SEQ ID NO: 635139 - DNA, 16 bp, Homo sapiens
gcaataagttgaatga

SEQ ID NO: 635140 - DNA, 20 bp, Homo sapiens
gcaatgacctttcaatagga

SEQ ID NO: 635141 - DNA, 23 bp, Homo sapiens
gcaatgacctttcaataggaaaa

SEQ ID NO: 635142 - DNA, 21 bp, Homo sapiens
gcaattgcttctctaaaacag

SEQ ID NO: 635143 - DNA, 18 bp, Homo sapiens
gcaattgtatatatatgt

SEQ ID NO: 635144 - DNA, 17 bp, Homo sapiens
gcacaaccatgttcttg

SEQ ID NO: 635145 - DNA, 22 bp, Homo sapiens
gcacacacaaacctactgccca

SEQ ID NO: 635146 - DNA, 16 bp, Homo sapiens
gcacacacagtctgtt

SEQ ID NO: 635147 - DNA, 14 bp, Homo sapiens
gcacacacatctgg

SEQ ID NO: 635148 - DNA, 13 bp, Homo sapiens
gcacagtatttaa

SEQ ID NO: 635149 - DNA, 15 bp, Homo sapiens
gcacatgttttacaa

SEQ ID NO: 635150 - DNA, 21 bp, Homo sapiens
gcacatttgttaatgattctt

SEQ ID NO: 635151 - DNA, 13 bp, Homo sapiens
gcaccacaggctg

SEQ ID NO: 635152 - DNA, 15 bp, Homo sapiens
gcaccacggggtcgg

SEQ ID NO: 635153 - DNA, 15 bp, Homo sapiens
gcaccagcctgagcc

SEQ ID NO: 635154 - DNA, 16 bp, Homo sapiens
gcaccagcctgagcca

SEQ ID NO: 635155 - DNA, 18 bp, Homo sapiens
gcaccagcctgagccaca

SEQ ID NO: 635156 - DNA, 19 bp, Homo sapiens
gcaccagcctgagccacag

SEQ ID NO: 635157 - DNA, 11 bp, Homo sapiens
gcaccagcttg

SEQ ID NO: 635158 - DNA, 21 bp, Homo sapiens
gcaccagtgccgcctgtgccc

SEQ ID NO: 635159 - DNA, 11 bp, Homo sapiens
gcacccccagc

SEQ ID NO: 635160 - DNA, 18 bp, Homo sapiens
gcacccccagcctccccc

SEQ ID NO: 635161 - DNA, 15 bp, Homo sapiens
gcccacgcccctccc

SEQ ID NO: 635162 - DNA, 18 bp, Homo sapiens
gcccacgcccctccccag

SEQ ID NO: 635163 - DNA, 20 bp, Homo sapiens
gcccacgcggctgctgcttc

SEQ ID NO: 635164 - DNA, 23 bp, Homo sapiens
gcccacgcggctgctgcttctcc

SEQ ID NO: 635165 - DNA, 18 bp, Homo sapiens
gcccacgtgtgcagactg

SEQ ID NO: 635166 - DNA, 19 bp, Homo sapiens
gcccacgtgtgcagactgt

SEQ ID NO: 635167 - DNA, 17 bp, Homo sapiens
gcccagaacgggcctcc

SEQ ID NO: 635168 - DNA, 14 bp, Homo sapiens
gcccagcacctcct

SEQ ID NO: 635169 - DNA, 20 bp, Homo sapiens
gcccagcacctcctccgtgg

SEQ ID NO: 635170 - DNA, 13 bp, Homo sapiens
gcccagcccccac

SEQ ID NO: 635171 - DNA, 14 bp, Homo sapiens
gcccagcccccacc

SEQ ID NO: 635172 - DNA, 20 bp, Homo sapiens
gcccagcccccacccccgtc

SEQ ID NO: 635173 - DNA, 18 bp, Homo sapiens
gcccagccctgggcaagg

SEQ ID NO: 635174 - DNA, 19 bp, Homo sapiens
gcccagccctgggcaagga

SEQ ID NO: 635175 - DNA, 14 bp, Homo sapiens
gcccagcctcttgt

SEQ ID NO: 635176 - DNA, 13 bp, Homo sapiens
gcccaggcccagc

SEQ ID NO: 635177 - DNA, 15 bp, Homo sapiens
gcccagtccctggag

SEQ ID NO: 635178 - DNA, 18 bp, Homo sapiens
gcccagtcttgagtgggc

SEQ ID NO: 635179 - DNA, 20 bp, Homo sapiens
gcccagttagcccggccaag

SEQ ID NO: 635180 - DNA, 24 bp, Homo sapiens
gcccatcccctgcctctatccctg

SEQ ID NO: 635181 - DNA, 22 bp, Homo sapiens
gcccatggccccagctggctgg

SEQ ID NO: 635182 - DNA, 16 bp, Homo sapiens
gccccacaaggcccag

SEQ ID NO: 635183 - DNA, 19 bp, Homo sapiens
gccccacctccccagagcc

SEQ ID NO: 635184 - DNA, 16 bp, Homo sapiens
gccccagagactgccc

SEQ ID NO: 635185 - DNA, 18 bp, Homo sapiens
gccccagagactgcccac

SEQ ID NO: 635186 - DNA, 20 bp, Homo sapiens
gccccagagactgcccaccc

SEQ ID NO: 635187 - DNA, 22 bp, Homo sapiens
gccccagagactgcccaccctg

SEQ ID NO: 635188 - DNA, 12 bp, Homo sapiens
gccccagctctg

SEQ ID NO: 635189 - DNA, 14 bp, Homo sapiens
gccccagctctgga

SEQ ID NO: 635190 - DNA, 15 bp, Homo sapiens
gccccagctggctgg

SEQ ID NO: 635191 - DNA, 22 bp, Homo sapiens
gccccagctggctgggtcgccc

SEQ ID NO: 635192 - DNA, 18 bp, Homo sapiens
gccccaggcccgccctgc

SEQ ID NO: 635193 - DNA, 19 bp, Homo sapiens
gccccaggcccgccctgcc

SEQ ID NO: 635194 - DNA, 21 bp, Homo sapiens
gccccaggcccgccctgcccg

SEQ ID NO: 635195 - DNA, 19 bp, Homo sapiens
gccccaggcggaggggctt

SEQ ID NO: 635196 - DNA, 13 bp, Homo sapiens
gccccagtggtgc

SEQ ID NO: 635197 - DNA, 18 bp, Homo sapiens
gccccatcagaggctggg

SEQ ID NO: 635198 - DNA, 11 bp, Homo sapiens
gccccatcctt

SEQ ID NO: 635199 - DNA, 15 bp, Homo sapiens
gccccatccttcccg

SEQ ID NO: 635200 - DNA, 22 bp, Homo sapiens
gccccatccttcccgcagcacc

SEQ ID NO: 635201 - DNA, 13 bp, Homo sapiens
gccccatctcctc

SEQ ID NO: 635202 - DNA, 16 bp, Homo sapiens
gccccatctcctccca

SEQ ID NO: 635203 - DNA, 17 bp, Homo sapiens
gccccatgggccctcag

SEQ ID NO: 635204 - DNA, 19 bp, Homo sapiens
gccccatgggccctcagcg

SEQ ID NO: 635205 - DNA, 18 bp, Homo sapiens
gcccccacccatgccagc

SEQ ID NO: 635206 - DNA, 19 bp, Homo sapiens
gccccccgcccggcctcct

SEQ ID NO: 635207 - DNA, 20 bp, Homo sapiens
gccccccgcccggcctccta

SEQ ID NO: 635208 - DNA, 16 bp, Homo sapiens
gccccccggcctggcc

SEQ ID NO: 635209 - DNA, 17 bp, Homo sapiens
gcccccggaggcgccca

SEQ ID NO: 635210 - DNA, 20 bp, Homo sapiens
gcccccggaggcgcccacct

SEQ ID NO: 635211 - DNA, 21 bp, Homo sapiens
gcccccggaggcgcccacctg

SEQ ID NO: 635212 - DNA, 12 bp, Homo sapiens
gccccctccccc

SEQ ID NO: 635213 - DNA, 13 bp, Homo sapiens
gccccctcccccg

SEQ ID NO: 635214 - DNA, 14 bp, Homo sapiens
gccccctcccccgc

SEQ ID NO: 635215 - DNA, 15 bp, Homo sapiens
gccccctcccccgca

SEQ ID NO: 635216 - DNA, 17 bp, Homo sapiens
gccccctcccccgcaga

SEQ ID NO: 635217 - DNA, 14 bp, Homo sapiens
gccccctcgcgccc

SEQ ID NO: 635218 - DNA, 17 bp, Homo sapiens
gccccctcgcgcccctg

SEQ ID NO: 635219 - DNA, 18 bp, Homo sapiens
gccccctcgcgcccctgt

SEQ ID NO: 635220 - DNA, 13 bp, Homo sapiens
gccccctggcggc

SEQ ID NO: 635221 - DNA, 17 bp, Homo sapiens
gccccgcgaccacccct

SEQ ID NO: 635222 - DNA, 19 bp, Homo sapiens
gccccgcgaccacccctgt

SEQ ID NO: 635223 - DNA, 15 bp, Homo sapiens
gccccgcggagcccc

SEQ ID NO: 635224 - DNA, 16 bp, Homo sapiens
gccccgcggagccccc

SEQ ID NO: 635225 - DNA, 19 bp, Homo sapiens
gccccgcggagcccccgcc

SEQ ID NO: 635226 - DNA, 14 bp, Homo sapiens
gccccgctgctccc

SEQ ID NO: 635227 - DNA, 18 bp, Homo sapiens
gccccgcttggcttcttc

SEQ ID NO: 635228 - DNA, 22 bp, Homo sapiens
gccccgcttggcttcttcttta

SEQ ID NO: 635229 - DNA, 17 bp, Homo sapiens
gccccgtgctcctctgc

SEQ ID NO: 635230 - DNA, 14 bp, Homo sapiens
gcccctcagagaat

SEQ ID NO: 635231 - DNA, 17 bp, Homo sapiens
gcccctccccagccccc

SEQ ID NO: 635232 - DNA, 16 bp, Homo sapiens
gcccctccccagccct

SEQ ID NO: 635233 - DNA, 16 bp, Homo sapiens
gcccctccgggcagag

SEQ ID NO: 635234 - DNA, 19 bp, Homo sapiens
gcccctccgtccccagggt

SEQ ID NO: 635235 - DNA, 12 bp, Homo sapiens
gcccctcctcgg

SEQ ID NO: 635236 - DNA, 15 bp, Homo sapiens
gcccctcctctcctc

SEQ ID NO: 635237 - DNA, 15 bp, Homo sapiens
gcccctccttctccc

SEQ ID NO: 635238 - DNA, 17 bp, Homo sapiens
gcccctccttctcccct

SEQ ID NO: 635239 - DNA, 22 bp, Homo sapiens
gcccctccttctcccctccaga

SEQ ID NO: 635240 - DNA, 17 bp, Homo sapiens
gcccctctgcgccccag

SEQ ID NO: 635241 - DNA, 20 bp, Homo sapiens
gcccctctgcgccccagcga

SEQ ID NO: 635242 - DNA, 14 bp, Homo sapiens
gcccctgcccagca

SEQ ID NO: 635243 - DNA, 16 bp, Homo sapiens
gcccctgcccagcacc

SEQ ID NO: 635244 - DNA, 17 bp, Homo sapiens
gcccctgcccagcacct

SEQ ID NO: 635245 - DNA, 19 bp, Homo sapiens
gcccctgcccagcacctcc

SEQ ID NO: 635246 - DNA, 20 bp, Homo sapiens
gcccctgcccagcacctcct

SEQ ID NO: 635247 - DNA, 16 bp, Homo sapiens
gcccctgcgtgtgttc

SEQ ID NO: 635248 - DNA, 14 bp, Homo sapiens
gcccctgctggacc

SEQ ID NO: 635249 - DNA, 17 bp, Homo sapiens
gcccctgctggaccaag

SEQ ID NO: 635250 - DNA, 15 bp, Homo sapiens
gcccctggccctgcc

SEQ ID NO: 635251 - DNA, 19 bp, Homo sapiens
gcccctggccctgcctcac

SEQ ID NO: 635252 - DNA, 22 bp, Homo sapiens
gcccctgtgcagtagagagcct

SEQ ID NO: 635253 - DNA, 15 bp, Homo sapiens
gcccctgtttctcct

SEQ ID NO: 635254 - DNA, 16 bp, Homo sapiens
gcccctgtttctcctc

SEQ ID NO: 635255 - DNA, 14 bp, Homo sapiens
gccccttccccatg

SEQ ID NO: 635256 - DNA, 13 bp, Homo sapiens
gccccttggagag

SEQ ID NO: 635257 - DNA, 14 bp, Homo sapiens
gccccttggagaga

SEQ ID NO: 635258 - DNA, 18 bp, Homo sapiens
gcccctttctcttgctgt

SEQ ID NO: 635259 - DNA, 17 bp, Homo sapiens
gcccgaggccagggccg

SEQ ID NO: 635260 - DNA, 16 bp, Homo sapiens
gcccgcactcaggagc

SEQ ID NO: 635261 - DNA, 12 bp, Homo sapiens
gcccgccacctt

SEQ ID NO: 635262 - DNA, 23 bp, Homo sapiens
gcccgccaccttgtacagaacca

SEQ ID NO: 635263 - DNA, 19 bp, Homo sapiens
gcccgcccaccccgctgcc

SEQ ID NO: 635264 - DNA, 17 bp, Homo sapiens
gcccgcccccgccctcg

SEQ ID NO: 635265 - DNA, 14 bp, Homo sapiens
gcccgcccgccggt

SEQ ID NO: 635266 - DNA, 15 bp, Homo sapiens
gcccgccctcctctg

SEQ ID NO: 635267 - DNA, 16 bp, Homo sapiens
gcccgccctcctctgc

SEQ ID NO: 635268 - DNA, 20 bp, Homo sapiens
gcccgccctcctctgccccc

SEQ ID NO: 635269 - DNA, 22 bp, Homo sapiens
gcccgccctcctctgccccctc

SEQ ID NO: 635270 - DNA, 15 bp, Homo sapiens
gcccgccgcctccct

SEQ ID NO: 635271 - DNA, 20 bp, Homo sapiens
gcccgccggttggccggctg

SEQ ID NO: 635272 - DNA, 23 bp, Homo sapiens
gcccgccggttggccggctggcc

SEQ ID NO: 635273 - DNA, 17 bp, Homo sapiens
gcccgctcaacctctca

SEQ ID NO: 635274 - DNA, 18 bp, Homo sapiens
gcccgctcaacctctcag

SEQ ID NO: 635275 - DNA, 16 bp, Homo sapiens
gcccggcccacgcaga

SEQ ID NO: 635276 - DNA, 19 bp, Homo sapiens
gcccggcccacgcagagcc

SEQ ID NO: 635277 - DNA, 23 bp, Homo sapiens
gcccggcccacgcagagccccgg

SEQ ID NO: 635278 - DNA, 22 bp, Homo sapiens
gctggtgtcttgagaccagcct

SEQ ID NO: 635279 - DNA, 16 bp, Homo sapiens
gctgtaaataaaaata

SEQ ID NO: 635280 - DNA, 17 bp, Homo sapiens
gctgtaaataaaaatag

SEQ ID NO: 635281 - DNA, 17 bp, Homo sapiens
gctgtatacaaacaggt

SEQ ID NO: 635282 - DNA, 16 bp, Homo sapiens
gctgtatttgaggaaa

SEQ ID NO: 635283 - DNA, 21 bp, Homo sapiens
gctgtctgaaaaagtgttttt

SEQ ID NO: 635284 - DNA, 15 bp, Homo sapiens
gctgtctgtggcttc

SEQ ID NO: 635285 - DNA, 15 bp, Homo sapiens
gctgtgaaacagtgt

SEQ ID NO: 635286 - DNA, 15 bp, Homo sapiens
gctgtggcccctcct

SEQ ID NO: 635287 - DNA, 18 bp, Homo sapiens
gctgtgggggaggtccct

SEQ ID NO: 635288 - DNA, 12 bp, Homo sapiens
gctgtgtagctc

SEQ ID NO: 635289 - DNA, 18 bp, Homo sapiens
gctgtgtagctctgtcca

SEQ ID NO: 635290 - DNA, 19 bp, Homo sapiens
gctgtgtggggagggtggg

SEQ ID NO: 635291 - DNA, 16 bp, Homo sapiens
gctgtgttaagaggac

SEQ ID NO: 635292 - DNA, 15 bp, Homo sapiens
gctgttgattctttc

SEQ ID NO: 635293 - DNA, 18 bp, Homo sapiens
gctgttgtgtctggagcc

SEQ ID NO: 635294 - DNA, 16 bp, Homo sapiens
gctgtttaccgcccac

SEQ ID NO: 635295 - DNA, 21 bp, Homo sapiens
gcttaaggaaaagagaaacac

SEQ ID NO: 635296 - DNA, 22 bp, Homo sapiens
gcttaatctagagctatgcaca

SEQ ID NO: 635297 - DNA, 13 bp, Homo sapiens
gcttacagtgact

SEQ ID NO: 635298 - DNA, 20 bp, Homo sapiens
gcttacctgttctctagttt

SEQ ID NO: 635299 - DNA, 23 bp, Homo sapiens
gcttacctgttgtctgaaacata

SEQ ID NO: 635300 - DNA, 16 bp, Homo sapiens
gcttagaatggggctt

SEQ ID NO: 635301 - DNA, 17 bp, Homo sapiens
gcttagcgttctgtttc

SEQ ID NO: 635302 - DNA, 16 bp, Homo sapiens
gcttatcagaactcct

SEQ ID NO: 635303 - DNA, 21 bp, Homo sapiens
gcttatcagaactcctttcta

SEQ ID NO: 635304 - DNA, 22 bp, Homo sapiens
gcttatcagaactcctttctaa

SEQ ID NO: 635305 - DNA, 13 bp, Homo sapiens
gcttcagaattgt

SEQ ID NO: 635306 - DNA, 22 bp, Homo sapiens
gcttcattaaaacaagagacca

SEQ ID NO: 635307 - DNA, 21 bp, Homo sapiens
gcttccatggtggtttcagaa

SEQ ID NO: 635308 - DNA, 17 bp, Homo sapiens
gcttcccatgtctttct

SEQ ID NO: 635309 - DNA, 20 bp, Homo sapiens
gcttccccatcgccttctgg

SEQ ID NO: 635310 - DNA, 19 bp, Homo sapiens
gcttccctgcgacggaggc

SEQ ID NO: 635311 - DNA, 23 bp, Homo sapiens
gcttctccacaacctcctcctcc

SEQ ID NO: 635312 - DNA, 14 bp, Homo sapiens
gcttctccccctca

SEQ ID NO: 635313 - DNA, 21 bp, Homo sapiens
gcttctccccctcagctctcc

SEQ ID NO: 635314 - DNA, 13 bp, Homo sapiens
gcttctccctggg

SEQ ID NO: 635315 - DNA, 21 bp, Homo sapiens
gcttcttacgaacgccacggc

SEQ ID NO: 635316 - DNA, 15 bp, Homo sapiens
gcttgaccctgaaat

SEQ ID NO: 635317 - DNA, 13 bp, Homo sapiens
gcttgagcatgcc

SEQ ID NO: 635318 - DNA, 12 bp, Homo sapiens
gcttgagcctgt

SEQ ID NO: 635319 - DNA, 16 bp, Homo sapiens
gcttgctattaagaaa

SEQ ID NO: 635320 - DNA, 21 bp, Homo sapiens
gcttggagcagagacggcagc

SEQ ID NO: 635321 - DNA, 22 bp, Homo sapiens
gcttggagcagagacggcagcc

SEQ ID NO: 635322 - DNA, 23 bp, Homo sapiens
gcttggagcagagacggcagccc

SEQ ID NO: 635323 - DNA, 18 bp, Homo sapiens
gcttggagccccctggcg

SEQ ID NO: 635324 - DNA, 22 bp, Homo sapiens
gcttggagccccctggcggcag

SEQ ID NO: 635325 - DNA, 18 bp, Homo sapiens
gcttggggtagagaggac

SEQ ID NO: 635326 - DNA, 14 bp, Homo sapiens
gcttgtagggtgag

SEQ ID NO: 635327 - DNA, 15 bp, Homo sapiens
gcttgtagggtgagg

SEQ ID NO: 635328 - DNA, 21 bp, Homo sapiens
gcttgtgcagaaaacattgtt

SEQ ID NO: 635329 - DNA, 19 bp, Homo sapiens
gcttgtgtaatttcctgct

SEQ ID NO: 635330 - DNA, 22 bp, Homo sapiens
gcttgtgtaatttcctgctcct

SEQ ID NO: 635331 - DNA, 21 bp, Homo sapiens
gcttgtttaaggttcttgctg

SEQ ID NO: 635332 - DNA, 18 bp, Homo sapiens
gctttcagtgcctgctgt

SEQ ID NO: 635333 - DNA, 20 bp, Homo sapiens
gctttcagtgcctgctgttc

SEQ ID NO: 635334 - DNA, 13 bp, Homo sapiens
gctttccctgagg

SEQ ID NO: 635335 - DNA, 15 bp, Homo sapiens
gctttccctgaggaa

SEQ ID NO: 635336 - DNA, 14 bp, Homo sapiens
gctttcctgggtct

SEQ ID NO: 635337 - DNA, 17 bp, Homo sapiens
gctttctcatgcataga

SEQ ID NO: 635338 - DNA, 12 bp, Homo sapiens
gctttctccttt

SEQ ID NO: 635339 - DNA, 15 bp, Homo sapiens
gctttggggctggtg

SEQ ID NO: 635340 - DNA, 19 bp, Homo sapiens
gcttttaagattgtacttt

SEQ ID NO: 635341 - DNA, 20 bp, Homo sapiens
gcttttgatggctatgtttt

SEQ ID NO: 635342 - DNA, 22 bp, Homo sapiens
gcttttgtacgttaattaaaca

SEQ ID NO: 635343 - DNA, 12 bp, Homo sapiens
gctttttctgac

SEQ ID NO: 635344 - DNA, 18 bp, Homo sapiens
gctttttctgactccagt

SEQ ID NO: 635345 - DNA, 13 bp, Homo sapiens
ggaaaaaggcttc

SEQ ID NO: 635346 - DNA, 13 bp, Homo sapiens
ggaaaaggcttga

SEQ ID NO: 635347 - DNA, 16 bp, Homo sapiens
ggaaacaaagcaatag

SEQ ID NO: 635348 - DNA, 15 bp, Homo sapiens
ggaaacatctgattt

SEQ ID NO: 635349 - DNA, 16 bp, Homo sapiens
ggaaaccttggagagg

SEQ ID NO: 635350 - DNA, 19 bp, Homo sapiens
ggaaaccttggagaggaga

SEQ ID NO: 635351 - DNA, 22 bp, Homo sapiens
ggaaactcatacagtctctatt

SEQ ID NO: 635352 - DNA, 20 bp, Homo sapiens
ggaaagatcccaagtcaaac

SEQ ID NO: 635353 - DNA, 19 bp, Homo sapiens
ggaaagtactgcatgatct

SEQ ID NO: 635354 - DNA, 14 bp, Homo sapiens
ggaaagttctatta

SEQ ID NO: 635355 - DNA, 18 bp, Homo sapiens
ggaaatagttccattcta

SEQ ID NO: 635356 - DNA, 14 bp, Homo sapiens
ggaaatatctgtga

SEQ ID NO: 635357 - DNA, 21 bp, Homo sapiens
ggaaatcaccgaaaacgtggc

SEQ ID NO: 635358 - DNA, 17 bp, Homo sapiens
ggaaatttttgcatgtt

SEQ ID NO: 635359 - DNA, 18 bp, Homo sapiens
ggaaatttttgcatgttt

SEQ ID NO: 635360 - DNA, 16 bp, Homo sapiens
ggaacagacctcggct

SEQ ID NO: 635361 - DNA, 23 bp, Homo sapiens
ggaagaacaaatatgattctcct

SEQ ID NO: 635362 - DNA, 18 bp, Homo sapiens
ggaagaagggccaccctg

SEQ ID NO: 635363 - DNA, 11 bp, Homo sapiens
ggaagaattca

SEQ ID NO: 635364 - DNA, 18 bp, Homo sapiens
ggaagagctgctgtattt

SEQ ID NO: 635365 - DNA, 16 bp, Homo sapiens
ggaagcacctctcagc

SEQ ID NO: 635366 - DNA, 21 bp, Homo sapiens
ggaagcccacccgccccagag

SEQ ID NO: 635367 - DNA, 19 bp, Homo sapiens
ggaagctttggaagcagca

SEQ ID NO: 635368 - DNA, 20 bp, Homo sapiens
ggaagctttggaagcagcaa

SEQ ID NO: 635369 - DNA, 16 bp, Homo sapiens
ggaaggcctgagggaa

SEQ ID NO: 635370 - DNA, 13 bp, Homo sapiens
ggaaggctgctgt

SEQ ID NO: 635371 - DNA, 17 bp, Homo sapiens
ggaaggctgctgtgtag

SEQ ID NO: 635372 - DNA, 18 bp, Homo sapiens
ggaaggctgctgtgtagc

SEQ ID NO: 635373 - DNA, 13 bp, Homo sapiens
ggaaggctttatt

SEQ ID NO: 635374 - DNA, 13 bp, Homo sapiens
ggaagggtgcctg

SEQ ID NO: 635375 - DNA, 17 bp, Homo sapiens
ggaagggtgcctggctg

SEQ ID NO: 635376 - DNA, 19 bp, Homo sapiens
ggaagggtgcctggctggg

SEQ ID NO: 635377 - DNA, 16 bp, Homo sapiens
ggaagtacataaagta

SEQ ID NO: 635378 - DNA, 15 bp, Homo sapiens
ggaagtcatcctgca

SEQ ID NO: 635379 - DNA, 19 bp, Homo sapiens
ggaagtcatcctgcaatgg

SEQ ID NO: 635380 - DNA, 17 bp, Homo sapiens
ggaagtggcctgagaag

SEQ ID NO: 635381 - DNA, 16 bp, Homo sapiens
ggaatagagttttcct

SEQ ID NO: 635382 - DNA, 12 bp, Homo sapiens
ggaatcacagcc

SEQ ID NO: 635383 - DNA, 19 bp, Homo sapiens
ggaatcacagccaataaac

SEQ ID NO: 635384 - DNA, 19 bp, Homo sapiens
ggaatccatatcagctctg

SEQ ID NO: 635385 - DNA, 11 bp, Homo sapiens
ggaatgctcaa

SEQ ID NO: 635386 - DNA, 17 bp, Homo sapiens
ggaatgctcaatgtgct

SEQ ID NO: 635387 - DNA, 20 bp, Homo sapiens
ggaatggggggcgggccagg

SEQ ID NO: 635388 - DNA, 21 bp, Homo sapiens
ggaattacataacaggcattg

SEQ ID NO: 635389 - DNA, 19 bp, Homo sapiens
ggaattattagcaccagct

SEQ ID NO: 635390 - DNA, 20 bp, Homo sapiens
ggaattattagcaccagctt

SEQ ID NO: 635391 - DNA, 14 bp, Homo sapiens
ggacaccctcctgc

SEQ ID NO: 635392 - DNA, 22 bp, Homo sapiens
ggacactgatgggtcctgctgc

SEQ ID NO: 635393 - DNA, 23 bp, Homo sapiens
ggacactgatgggtcctgctgct

SEQ ID NO: 635394 - DNA, 18 bp, Homo sapiens
ggcgccggttccacgtgg

SEQ ID NO: 635395 - DNA, 14 bp, Homo sapiens
ggcgcctgcgctcc

SEQ ID NO: 635396 - DNA, 21 bp, Homo sapiens
ggcgcctgcgctcctctgcag

SEQ ID NO: 635397 - DNA, 14 bp, Homo sapiens
ggcgcgcgccccca

SEQ ID NO: 635398 - DNA, 19 bp, Homo sapiens
ggcgcgcgcccccaggacc

SEQ ID NO: 635399 - DNA, 23 bp, Homo sapiens
ggcgcgcgcccccaggacccccc

SEQ ID NO: 635400 - DNA, 17 bp, Homo sapiens
ggcgctccggcagaggc

SEQ ID NO: 635401 - DNA, 19 bp, Homo sapiens
ggcgctccggcagaggcag

SEQ ID NO: 635402 - DNA, 20 bp, Homo sapiens
ggcgctccggcagaggcagg

SEQ ID NO: 635403 - DNA, 21 bp, Homo sapiens
ggcgctccggcagaggcaggg

SEQ ID NO: 635404 - DNA, 20 bp, Homo sapiens
ggcggagggtctccctgggc

SEQ ID NO: 635405 - DNA, 21 bp, Homo sapiens
ggcggagggtctccctgggca

SEQ ID NO: 635406 - DNA, 18 bp, Homo sapiens
ggcggcacattggcagtg

SEQ ID NO: 635407 - DNA, 22 bp, Homo sapiens
ggcggcggggcctgggtccccc

SEQ ID NO: 635408 - DNA, 13 bp, Homo sapiens
ggcgggcagcccc

SEQ ID NO: 635409 - DNA, 16 bp, Homo sapiens
ggcgggcagcccctgc

SEQ ID NO: 635410 - DNA, 18 bp, Homo sapiens
ggcgggcagcccctgctg

SEQ ID NO: 635411 - DNA, 22 bp, Homo sapiens
ggcgggcagcccctgctggacc

SEQ ID NO: 635412 - DNA, 11 bp, Homo sapiens
ggcgggccagg

SEQ ID NO: 635413 - DNA, 20 bp, Homo sapiens
ggcgggccagggtgggaaga

SEQ ID NO: 635414 - DNA, 23 bp, Homo sapiens
ggcgtccctgagggcccttccca

SEQ ID NO: 635415 - DNA, 11 bp, Homo sapiens
ggcgtcctctc

SEQ ID NO: 635416 - DNA, 16 bp, Homo sapiens
ggcgtgggatccagag

SEQ ID NO: 635417 - DNA, 17 bp, Homo sapiens
ggcgtgggatccagaga

SEQ ID NO: 635418 - DNA, 15 bp, Homo sapiens
ggctaactggcccca

SEQ ID NO: 635419 - DNA, 16 bp, Homo sapiens
ggctcagggttggcca

SEQ ID NO: 635420 - DNA, 19 bp, Homo sapiens
ggctcccactgcccctgca

SEQ ID NO: 635421 - DNA, 15 bp, Homo sapiens
ggctcccagcagagg

SEQ ID NO: 635422 - DNA, 16 bp, Homo sapiens
ggctcccagcagaggc

SEQ ID NO: 635423 - DNA, 20 bp, Homo sapiens
ggctcgtgtttcacagtggg

SEQ ID NO: 635424 - DNA, 13 bp, Homo sapiens
ggctctaatttcc

SEQ ID NO: 635425 - DNA, 22 bp, Homo sapiens
ggctgaaataaaagcctctggt

SEQ ID NO: 635426 - DNA, 14 bp, Homo sapiens
ggctgactcagtgc

SEQ ID NO: 635427 - DNA, 23 bp, Homo sapiens
ggctgagagggtgtgggtgccct

SEQ ID NO: 635428 - DNA, 13 bp, Homo sapiens
ggctgagcccctc

SEQ ID NO: 635429 - DNA, 19 bp, Homo sapiens
ggctgaggacggggcagag

SEQ ID NO: 635430 - DNA, 14 bp, Homo sapiens
ggctgcagagacct

SEQ ID NO: 635431 - DNA, 18 bp, Homo sapiens
ggctgccgcatctgcctg

SEQ ID NO: 635432 - DNA, 22 bp, Homo sapiens
ggctgccgcatctgcctggagc

SEQ ID NO: 635433 - DNA, 23 bp, Homo sapiens
ggctgccgcatctgcctggagcc

SEQ ID NO: 635434 - DNA, 11 bp, Homo sapiens
ggctgcctcag

SEQ ID NO: 635435 - DNA, 16 bp, Homo sapiens
ggctgcctcagccagt

SEQ ID NO: 635436 - DNA, 18 bp, Homo sapiens
ggctgcgtccctgctcag

SEQ ID NO: 635437 - DNA, 19 bp, Homo sapiens
ggctgcgtccctgctcagc

SEQ ID NO: 635438 - DNA, 21 bp, Homo sapiens
ggctgctgcagtcagcacaga

SEQ ID NO: 635439 - DNA, 19 bp, Homo sapiens
ggctgctggggcagggccc

SEQ ID NO: 635440 - DNA, 18 bp, Homo sapiens
ggctgctgtgtagctctg

SEQ ID NO: 635441 - DNA, 22 bp, Homo sapiens
ggctgctgtgtagctctgtcca

SEQ ID NO: 635442 - DNA, 10 bp, Homo sapiens
ggctggccct

SEQ ID NO: 635443 - DNA, 12 bp, Homo sapiens
ggctggccctgc

SEQ ID NO: 635444 - DNA, 15 bp, Homo sapiens
ggctggccctgccct

SEQ ID NO: 635445 - DNA, 21 bp, Homo sapiens
ggctggccctgccctccccca

SEQ ID NO: 635446 - DNA, 22 bp, Homo sapiens
ggctggccctgccctcccccac

SEQ ID NO: 635447 - DNA, 22 bp, Homo sapiens
ggctgggaacatgacccagcct

SEQ ID NO: 635448 - DNA, 15 bp, Homo sapiens
ggctgggcagggccg

SEQ ID NO: 635449 - DNA, 18 bp, Homo sapiens
ggctgggccctctgtcca

SEQ ID NO: 635450 - DNA, 17 bp, Homo sapiens
ggctgggctttggggct

SEQ ID NO: 635451 - DNA, 22 bp, Homo sapiens
ggctgggctttggggctggtgg

SEQ ID NO: 635452 - DNA, 23 bp, Homo sapiens
ggctggtgggataggagggtgcc

SEQ ID NO: 635453 - DNA, 19 bp, Homo sapiens
ggctggtgtcttgagacca

SEQ ID NO: 635454 - DNA, 14 bp, Homo sapiens
ggctgtcccctgca

SEQ ID NO: 635455 - DNA, 12 bp, Homo sapiens
ggctgtggcccc

SEQ ID NO: 635456 - DNA, 16 bp, Homo sapiens
ggctgtggcccctcct

SEQ ID NO: 635457 - DNA, 20 bp, Homo sapiens
ggctgtgtcctaaatgcaaa

SEQ ID NO: 635458 - DNA, 15 bp, Homo sapiens
ggctgttagctcaga

SEQ ID NO: 635459 - DNA, 20 bp, Homo sapiens
ggctgttagctcagaggaga

SEQ ID NO: 635460 - DNA, 13 bp, Homo sapiens
ggctgttatctgt

SEQ ID NO: 635461 - DNA, 17 bp, Homo sapiens
ggcttccatggtggttt

SEQ ID NO: 635462 - DNA, 18 bp, Homo sapiens
ggcttctccccctcagct

SEQ ID NO: 635463 - DNA, 16 bp, Homo sapiens
ggcttctgggacaggc

SEQ ID NO: 635464 - DNA, 13 bp, Homo sapiens
ggcttctgggcgc

SEQ ID NO: 635465 - DNA, 15 bp, Homo sapiens
ggcttgagtctggat

SEQ ID NO: 635466 - DNA, 13 bp, Homo sapiens
ggcttggagcaga

SEQ ID NO: 635467 - DNA, 17 bp, Homo sapiens
ggcttggagcagagacg

SEQ ID NO: 635468 - DNA, 21 bp, Homo sapiens
ggcttggcattgaccttcatg

SEQ ID NO: 635469 - DNA, 12 bp, Homo sapiens
ggctttctattg

SEQ ID NO: 635470 - DNA, 14 bp, Homo sapiens
gggaaaacctcagt

SEQ ID NO: 635471 - DNA, 23 bp, Homo sapiens
gggaaaacctcagttggcctctg

SEQ ID NO: 635472 - DNA, 15 bp, Homo sapiens
gggaacacctgctga

SEQ ID NO: 635473 - DNA, 15 bp, Homo sapiens
gggaagcccacccgc

SEQ ID NO: 635474 - DNA, 16 bp, Homo sapiens
gggaagcccacccgcc

SEQ ID NO: 635475 - DNA, 12 bp, Homo sapiens
gggaaggcctga

SEQ ID NO: 635476 - DNA, 22 bp, Homo sapiens
gggaaggcctgagggaagccca

SEQ ID NO: 635477 - DNA, 16 bp, Homo sapiens
gggaaggctgctgtgt

SEQ ID NO: 635478 - DNA, 16 bp, Homo sapiens
gggaagggtgcctggc

SEQ ID NO: 635479 - DNA, 19 bp, Homo sapiens
gggacaccctcctgccccc

SEQ ID NO: 635480 - DNA, 21 bp, Homo sapiens
gggacagcggccccgcggagc

SEQ ID NO: 635481 - DNA, 22 bp, Homo sapiens
gggacagcggcccggcccacgc

SEQ ID NO: 635482 - DNA, 17 bp, Homo sapiens
gggacaggcaccatgct

SEQ ID NO: 635483 - DNA, 12 bp, Homo sapiens
gggaccaggagc

SEQ ID NO: 635484 - DNA, 14 bp, Homo sapiens
gggacgcccagccc

SEQ ID NO: 635485 - DNA, 15 bp, Homo sapiens
gggacgcccagcccc

SEQ ID NO: 635486 - DNA, 21 bp, Homo sapiens
gggacgcccagcccccacccc

SEQ ID NO: 635487 - DNA, 12 bp, Homo sapiens
gggacgcccctt

SEQ ID NO: 635488 - DNA, 22 bp, Homo sapiens
gggactgaccttcggcagtggc

SEQ ID NO: 635489 - DNA, 22 bp, Homo sapiens
gggactgctttcagtgcctgct

SEQ ID NO: 635490 - DNA, 15 bp, Homo sapiens
gggactggcccaccc

SEQ ID NO: 635491 - DNA, 16 bp, Homo sapiens
gggactggcccacccc

SEQ ID NO: 635492 - DNA, 21 bp, Homo sapiens
gggactggcccacccctcttc

SEQ ID NO: 635493 - DNA, 23 bp, Homo sapiens
gggactggcccacccctcttccc

SEQ ID NO: 635494 - DNA, 21 bp, Homo sapiens
gggactgtcttcaaccctgcc

SEQ ID NO: 635495 - DNA, 17 bp, Homo sapiens
gggagagcgccacccgc

SEQ ID NO: 635496 - DNA, 12 bp, Homo sapiens
gggaggacccct

SEQ ID NO: 635497 - DNA, 16 bp, Homo sapiens
gggaggacccctgccc

SEQ ID NO: 635498 - DNA, 12 bp, Homo sapiens
gggaggagcacc

SEQ ID NO: 635499 - DNA, 19 bp, Homo sapiens
gggaggagcacccccagcc

SEQ ID NO: 635500 - DNA, 12 bp, Homo sapiens
gggaggctgaga

SEQ ID NO: 635501 - DNA, 16 bp, Homo sapiens
gggagggaacagacct

SEQ ID NO: 635502 - DNA, 15 bp, Homo sapiens
gggagggggctggga

SEQ ID NO: 635503 - DNA, 23 bp, Homo sapiens
gggagtccactttcctctctctc

SEQ ID NO: 635504 - DNA, 21 bp, Homo sapiens
gggataggagggtgcccctgg

SEQ ID NO: 635505 - DNA, 20 bp, Homo sapiens
gggatctaaaaggaggacag

SEQ ID NO: 635506 - DNA, 20 bp, Homo sapiens
gggattcctcccctggaagt

SEQ ID NO: 635507 - DNA, 20 bp, Homo sapiens
gggcaaagaactgccccatc

SEQ ID NO: 635508 - DNA, 23 bp, Homo sapiens
gggcaacctgacagcaaacacag

SEQ ID NO: 635509 - DNA, 22 bp, Homo sapiens
gggcaaggaagctttggaagca

SEQ ID NO: 635510 - DNA, 21 bp, Homo sapiens
ggttctgccctgcctgaggag

SEQ ID NO: 635511 - DNA, 15 bp, Homo sapiens
ggttgggttccagac

SEQ ID NO: 635512 - DNA, 22 bp, Homo sapiens
ggttgtacatagtggtcatttg

SEQ ID NO: 635513 - DNA, 23 bp, Homo sapiens
ggtttagcgttgttttgtggata

SEQ ID NO: 635514 - DNA, 14 bp, Homo sapiens
ggtttcagaaaggg

SEQ ID NO: 635515 - DNA, 15 bp, Homo sapiens
ggtttcagaaagggc

SEQ ID NO: 635516 - DNA, 17 bp, Homo sapiens
ggtttcatactctagat

SEQ ID NO: 635517 - DNA, 17 bp, Homo sapiens
ggtttgggcagtggaga

SEQ ID NO: 635518 - DNA, 22 bp, Homo sapiens
ggtttgggcagtggagagggga

SEQ ID NO: 635519 - DNA, 22 bp, Homo sapiens
gtaaaccattcttgggaggaca

SEQ ID NO: 635520 - DNA, 15 bp, Homo sapiens
gtaaagatattgtat

SEQ ID NO: 635521 - DNA, 15 bp, Homo sapiens
gtaaaggtaggtgca

SEQ ID NO: 635522 - DNA, 22 bp, Homo sapiens
gtaaaggtgatgaatttaccat

SEQ ID NO: 635523 - DNA, 23 bp, Homo sapiens
gtaaataatgattcaatgtgaat

SEQ ID NO: 635524 - DNA, 13 bp, Homo sapiens
gtaaatatacact

SEQ ID NO: 635525 - DNA, 20 bp, Homo sapiens
gtaaatgaggtctttgcatt

SEQ ID NO: 635526 - DNA, 15 bp, Homo sapiens
gtaaatgatatgtct

SEQ ID NO: 635527 - DNA, 17 bp, Homo sapiens
gtaaatgggaaaatata

SEQ ID NO: 635528 - DNA, 12 bp, Homo sapiens
gtaaatgtcttc

SEQ ID NO: 635529 - DNA, 13 bp, Homo sapiens
gtaacagacattg

SEQ ID NO: 635530 - DNA, 16 bp, Homo sapiens
gtaacagtatttccat

SEQ ID NO: 635531 - DNA, 17 bp, Homo sapiens
gtaacattctatttcaa

SEQ ID NO: 635532 - DNA, 12 bp, Homo sapiens
gtaactgaaagg

SEQ ID NO: 635533 - DNA, 20 bp, Homo sapiens
gtaactgttaacccagtgtt

SEQ ID NO: 635534 - DNA, 17 bp, Homo sapiens
gtaacttcagatgtttc

SEQ ID NO: 635535 - DNA, 18 bp, Homo sapiens
gtaacttcagatgtttcc

SEQ ID NO: 635536 - DNA, 21 bp, Homo sapiens
gtaacttgctgtgaaatgact

SEQ ID NO: 635537 - DNA, 22 bp, Homo sapiens
gtaagcaacgggaacacctgct

SEQ ID NO: 635538 - DNA, 13 bp, Homo sapiens
gtaaggcactgtc

SEQ ID NO: 635539 - DNA, 20 bp, Homo sapiens
gtaagggactccagaagcag

SEQ ID NO: 635540 - DNA, 14 bp, Homo sapiens
gtaagttctgtgca

SEQ ID NO: 635541 - DNA, 15 bp, Homo sapiens
gtaatataagacaag

SEQ ID NO: 635542 - DNA, 23 bp, Homo sapiens
gtaatatagggtttgtttgctgc

SEQ ID NO: 635543 - DNA, 17 bp, Homo sapiens
gtaatatcagttacagt

SEQ ID NO: 635544 - DNA, 23 bp, Homo sapiens
gtaatattaaattcctcctgtct

SEQ ID NO: 635545 - DNA, 22 bp, Homo sapiens
gtaattcttctcctttgtcaaa

SEQ ID NO: 635546 - DNA, 18 bp, Homo sapiens
gtacaaaatgaattgcct

SEQ ID NO: 635547 - DNA, 19 bp, Homo sapiens
gtacaaataatattgcctt

SEQ ID NO: 635548 - DNA, 17 bp, Homo sapiens
gtacaataaataaaaga

SEQ ID NO: 635549 - DNA, 19 bp, Homo sapiens
gtacacacacagacacaca

SEQ ID NO: 635550 - DNA, 20 bp, Homo sapiens
gtacagagaactaacactat

SEQ ID NO: 635551 - DNA, 21 bp, Homo sapiens
gtacagagaactaacactatt

SEQ ID NO: 635552 - DNA, 18 bp, Homo sapiens
gtacaggctgagacacag

SEQ ID NO: 635553 - DNA, 20 bp, Homo sapiens
gtacataaagtaataactgt

SEQ ID NO: 635554 - DNA, 21 bp, Homo sapiens
gtacataaagtaataactgtt

SEQ ID NO: 635555 - DNA, 15 bp, Homo sapiens
gtacatttatgtgtg

SEQ ID NO: 635556 - DNA, 17 bp, Homo sapiens
gtactcgcttgtgcaga

SEQ ID NO: 635557 - DNA, 15 bp, Homo sapiens
gtactctgagtcctc

SEQ ID NO: 635558 - DNA, 14 bp, Homo sapiens
gtactggatttaac

SEQ ID NO: 635559 - DNA, 16 bp, Homo sapiens
gtacttacactgaaat

SEQ ID NO: 635560 - DNA, 17 bp, Homo sapiens
gtacttcagttctcatc

SEQ ID NO: 635561 - DNA, 21 bp, Homo sapiens
gtacttcattcaaaaagccaa

SEQ ID NO: 635562 - DNA, 21 bp, Homo sapiens
gtacttgatttttcaaagact

SEQ ID NO: 635563 - DNA, 11 bp, Homo sapiens
gtagagaggac

SEQ ID NO: 635564 - DNA, 15 bp, Homo sapiens
gtagagtcaggagaa

SEQ ID NO: 635565 - DNA, 13 bp, Homo sapiens
gtagatcattttt

SEQ ID NO: 635566 - DNA, 14 bp, Homo sapiens
gtagattgcgtgga

SEQ ID NO: 635567 - DNA, 20 bp, Homo sapiens
gtagcatttcttatttgttt

SEQ ID NO: 635568 - DNA, 17 bp, Homo sapiens
gtagctagtttaaaatt

SEQ ID NO: 635569 - DNA, 20 bp, Homo sapiens
gtagctagtttaaaattatt

SEQ ID NO: 635570 - DNA, 18 bp, Homo sapiens
gtagctgataaagaaacc

SEQ ID NO: 635571 - DNA, 20 bp, Homo sapiens
gtagctttaaaaccacagct

SEQ ID NO: 635572 - DNA, 16 bp, Homo sapiens
gtaggctgctggcgcc

SEQ ID NO: 635573 - DNA, 20 bp, Homo sapiens
gtaggctgctggcgcctagg

SEQ ID NO: 635574 - DNA, 20 bp, Homo sapiens
gtagggaaaccttggagagg

SEQ ID NO: 635575 - DNA, 16 bp, Homo sapiens
gtagggtgaggcgtgg

SEQ ID NO: 635576 - DNA, 16 bp, Homo sapiens
gtaggtctatgatgtc

SEQ ID NO: 635577 - DNA, 18 bp, Homo sapiens
gtagtagctcgtgtgctt

SEQ ID NO: 635578 - DNA, 12 bp, Homo sapiens
gtagtgtcattc

SEQ ID NO: 635579 - DNA, 18 bp, Homo sapiens
gtatacaaacaggtgcta

SEQ ID NO: 635580 - DNA, 17 bp, Homo sapiens
gtatagggaattttcat

SEQ ID NO: 635581 - DNA, 18 bp, Homo sapiens
gtatagggaattttcatt

SEQ ID NO: 635582 - DNA, 14 bp, Homo sapiens
gtatatatttatta

SEQ ID NO: 635583 - DNA, 14 bp, Homo sapiens
gtatatcagctcta

SEQ ID NO: 635584 - DNA, 20 bp, Homo sapiens
gtatatcagctctaaagcag

SEQ ID NO: 635585 - DNA, 16 bp, Homo sapiens
gtatatgtttatacac

SEQ ID NO: 635586 - DNA, 18 bp, Homo sapiens
gtatatgtttatacacac

SEQ ID NO: 635587 - DNA, 19 bp, Homo sapiens
gtatcatctaaatattatg

SEQ ID NO: 635588 - DNA, 23 bp, Homo sapiens
gtatctcaaatctgctttcatcc

SEQ ID NO: 635589 - DNA, 18 bp, Homo sapiens
gtatgctttccctgagga

SEQ ID NO: 635590 - DNA, 15 bp, Homo sapiens
gtatggtgctgggtc

SEQ ID NO: 635591 - DNA, 23 bp, Homo sapiens
gtatgtacaggctgagacacagc

SEQ ID NO: 635592 - DNA, 13 bp, Homo sapiens
gtatgtgtatatg

SEQ ID NO: 635593 - DNA, 16 bp, Homo sapiens
gtatgtgtatatgttt

SEQ ID NO: 635594 - DNA, 14 bp, Homo sapiens
gtatgttaatagaa

SEQ ID NO: 635595 - DNA, 12 bp, Homo sapiens
gtattatcataa

SEQ ID NO: 635596 - DNA, 16 bp, Homo sapiens
gtattgacaataagaa

SEQ ID NO: 635597 - DNA, 21 bp, Homo sapiens
gtattgacaataagaaacagt

SEQ ID NO: 635598 - DNA, 19 bp, Homo sapiens
gtattgagacactgtcaag

SEQ ID NO: 635599 - DNA, 18 bp, Homo sapiens
gtattgtgtcttttgcat

SEQ ID NO: 635600 - DNA, 21 bp, Homo sapiens
gtattgtgtcttttgcatgat

SEQ ID NO: 635601 - DNA, 17 bp, Homo sapiens
gtattgttcttgtaaaa

SEQ ID NO: 635602 - DNA, 21 bp, Homo sapiens
gtattgttcttgtaaaactgt

SEQ ID NO: 635603 - DNA, 22 bp, Homo sapiens
gtattgttcttgtaaaactgtg

SEQ ID NO: 635604 - DNA, 20 bp, Homo sapiens
gtattgttttggtttgctac

SEQ ID NO: 635605 - DNA, 11 bp, Homo sapiens
gtatttaacat

SEQ ID NO: 635606 - DNA, 18 bp, Homo sapiens
gtatttactgcaatgtct

SEQ ID NO: 635607 - DNA, 16 bp, Homo sapiens
gtatttcggctatgtc

SEQ ID NO: 635608 - DNA, 20 bp, Homo sapiens
gtatttggtaacttgctgtg

SEQ ID NO: 635609 - DNA, 14 bp, Homo sapiens
gtattttttgtgaa

SEQ ID NO: 635610 - DNA, 15 bp, Homo sapiens
gtattttttgtgaat

SEQ ID NO: 635611 - DNA, 16 bp, Homo sapiens
gtattttttgtgaatg

SEQ ID NO: 635612 - DNA, 14 bp, Homo sapiens
gtcaaacagtgtgg

SEQ ID NO: 635613 - DNA, 20 bp, Homo sapiens
gtcaaatggatgtaatatag

SEQ ID NO: 635614 - DNA, 13 bp, Homo sapiens
gtcaaatggtatt

SEQ ID NO: 635615 - DNA, 16 bp, Homo sapiens
gtcaaatggtattttt

SEQ ID NO: 635616 - DNA, 13 bp, Homo sapiens
gtcaagtttttat

SEQ ID NO: 635617 - DNA, 15 bp, Homo sapiens
gtcaagtttttatac

SEQ ID NO: 635618 - DNA, 20 bp, Homo sapiens
gtcaattgcttgagcatgcc

SEQ ID NO: 635619 - DNA, 16 bp, Homo sapiens
gtcacactgagctggg

SEQ ID NO: 635620 - DNA, 18 bp, Homo sapiens
gtcacactgagctgggca

SEQ ID NO: 635621 - DNA, 15 bp, Homo sapiens
gtcacgtgaggcccc

SEQ ID NO: 635622 - DNA, 22 bp, Homo sapiens
gtcacgtgaggcccctgtgcag

SEQ ID NO: 635623 - DNA, 20 bp, Homo sapiens
gtcacttttttcctgtcaat

SEQ ID NO: 635624 - DNA, 14 bp, Homo sapiens
gtcagaatgttgtg

SEQ ID NO: 635625 - DNA, 15 bp, Homo sapiens
gtcagagctttcagg

SEQ ID NO: 635626 - DNA, 23 bp, Homo sapiens
gtgtcctctgtccgtctgtcctg

SEQ ID NO: 635627 - DNA, 15 bp, Homo sapiens
gtgtcgggcatgaca

SEQ ID NO: 635628 - DNA, 18 bp, Homo sapiens
gtgtctgctgctgcctcc

SEQ ID NO: 635629 - DNA, 15 bp, Homo sapiens
gtgtctggagcctgc

SEQ ID NO: 635630 - DNA, 15 bp, Homo sapiens
gtgtcttttgcatga

SEQ ID NO: 635631 - DNA, 23 bp, Homo sapiens
gtgtcttttgttctctcttggtc

SEQ ID NO: 635632 - DNA, 18 bp, Homo sapiens
gtgtgaaggtcttgcctg

SEQ ID NO: 635633 - DNA, 19 bp, Homo sapiens
gtgtgaaggtcttgcctga

SEQ ID NO: 635634 - DNA, 14 bp, Homo sapiens
gtgtgaggctccct

SEQ ID NO: 635635 - DNA, 18 bp, Homo sapiens
gtgtgagtgttagaaaaa

SEQ ID NO: 635636 - DNA, 15 bp, Homo sapiens
gtgtgcttcacacaa

SEQ ID NO: 635637 - DNA, 12 bp, Homo sapiens
gtgtggagtgga

SEQ ID NO: 635638 - DNA, 16 bp, Homo sapiens
gtgtggcaaacattta

SEQ ID NO: 635639 - DNA, 17 bp, Homo sapiens
gtgtggccctgtgggag

SEQ ID NO: 635640 - DNA, 13 bp, Homo sapiens
gtgtggctgctcc

SEQ ID NO: 635641 - DNA, 18 bp, Homo sapiens
gtgtggcttaaacatttt

SEQ ID NO: 635642 - DNA, 14 bp, Homo sapiens
gtgtggggagggtg

SEQ ID NO: 635643 - DNA, 17 bp, Homo sapiens
gtgtggggggtgcccca

SEQ ID NO: 635644 - DNA, 20 bp, Homo sapiens
gtgtgtcacactgagctggg

SEQ ID NO: 635645 - DNA, 18 bp, Homo sapiens
gtgttagaaaaaactgga

SEQ ID NO: 635646 - DNA, 14 bp, Homo sapiens
gtgttcaaattctg

SEQ ID NO: 635647 - DNA, 12 bp, Homo sapiens
gtgttctgtggc

SEQ ID NO: 635648 - DNA, 24 bp, Homo sapiens
gtgttgagagggggatgcccctgg

SEQ ID NO: 635649 - DNA, 18 bp, Homo sapiens
gtgttgggaattgcatgc

SEQ ID NO: 635650 - DNA, 15 bp, Homo sapiens
gtgtttcgggccagg

SEQ ID NO: 635651 - DNA, 17 bp, Homo sapiens
gtgtttgaattgatttt

SEQ ID NO: 635652 - DNA, 17 bp, Homo sapiens
gtgtttggaggctgctg

SEQ ID NO: 635653 - DNA, 18 bp, Homo sapiens
gtgtttggaggctgctgc

SEQ ID NO: 635654 - DNA, 12 bp, Homo sapiens
gttaaaacatca

SEQ ID NO: 635655 - DNA, 15 bp, Homo sapiens
gttaaaatatagtgt

SEQ ID NO: 635656 - DNA, 20 bp, Homo sapiens
gttaaaatgtgtttttcagt

SEQ ID NO: 635657 - DNA, 20 bp, Homo sapiens
gttaaccgggactacagaag

SEQ ID NO: 635658 - DNA, 20 bp, Homo sapiens
gttaaggggatctaaaagga

SEQ ID NO: 635659 - DNA, 16 bp, Homo sapiens
gttaataggaggacag

SEQ ID NO: 635660 - DNA, 15 bp, Homo sapiens
gttaatgtgccaaaa

SEQ ID NO: 635661 - DNA, 13 bp, Homo sapiens
gttaattaaacaa

SEQ ID NO: 635662 - DNA, 18 bp, Homo sapiens
gttacagtggcagtattg

SEQ ID NO: 635663 - DNA, 14 bp, Homo sapiens
gttacttacacacc

SEQ ID NO: 635664 - DNA, 18 bp, Homo sapiens
gttagcccggccaaggac

SEQ ID NO: 635665 - DNA, 17 bp, Homo sapiens
gttaggaataacactgc

SEQ ID NO: 635666 - DNA, 19 bp, Homo sapiens
gttaggattaggtttagaa

SEQ ID NO: 635667 - DNA, 22 bp, Homo sapiens
gttaggattaggtttagaatca

SEQ ID NO: 635668 - DNA, 23 bp, Homo sapiens
gttagggaaatccaactccaggg

SEQ ID NO: 635669 - DNA, 22 bp, Homo sapiens
gttaggtgctgaatgaagctgc

SEQ ID NO: 635670 - DNA, 21 bp, Homo sapiens
gttataaaatctgtattgcta

SEQ ID NO: 635671 - DNA, 16 bp, Homo sapiens
gttataccagcaaaag

SEQ ID NO: 635672 - DNA, 23 bp, Homo sapiens
gttatcagggcccaaataacagt

SEQ ID NO: 635673 - DNA, 22 bp, Homo sapiens
gttatcagtacaattctttgtt

SEQ ID NO: 635674 - DNA, 15 bp, Homo sapiens
gttatccactacagg

SEQ ID NO: 635675 - DNA, 14 bp, Homo sapiens
gttatctagaaatt

SEQ ID NO: 635676 - DNA, 14 bp, Homo sapiens
gttatctgtcttta

SEQ ID NO: 635677 - DNA, 19 bp, Homo sapiens
gttatgaatcgcagacgca

SEQ ID NO: 635678 - DNA, 12 bp, Homo sapiens
gttatgttgtaa

SEQ ID NO: 635679 - DNA, 15 bp, Homo sapiens
gttattcatacaaat

SEQ ID NO: 635680 - DNA, 17 bp, Homo sapiens
gttatttatttaaatgt

SEQ ID NO: 635681 - DNA, 15 bp, Homo sapiens
gttattttgtgtcct

SEQ ID NO: 635682 - DNA, 24 bp, Homo sapiens
gttcaatgctacaaaatgtgtgct

SEQ ID NO: 635683 - DNA, 17 bp, Homo sapiens
gttcaccttctgtgcat

SEQ ID NO: 635684 - DNA, 20 bp, Homo sapiens
gttcaccttctgtgcatctg

SEQ ID NO: 635685 - DNA, 15 bp, Homo sapiens
gttcacgcaacttga

SEQ ID NO: 635686 - DNA, 18 bp, Homo sapiens
gttcacgtgactcctcaa

SEQ ID NO: 635687 - DNA, 17 bp, Homo sapiens
gttcagaaaagcacctc

SEQ ID NO: 635688 - DNA, 13 bp, Homo sapiens
gttcagcatagag

SEQ ID NO: 635689 - DNA, 18 bp, Homo sapiens
gttcattcatactcaaag

SEQ ID NO: 635690 - DNA, 10 bp, Homo sapiens
gttccagaca

SEQ ID NO: 635691 - DNA, 13 bp, Homo sapiens
gttccagacagag

SEQ ID NO: 635692 - DNA, 16 bp, Homo sapiens
gttccagacagggtgg

SEQ ID NO: 635693 - DNA, 22 bp, Homo sapiens
gttcccagcgcatggcgccccg

SEQ ID NO: 635694 - DNA, 15 bp, Homo sapiens
gttccctcagccctc

SEQ ID NO: 635695 - DNA, 16 bp, Homo sapiens
gttccctcagccctca

SEQ ID NO: 635696 - DNA, 12 bp, Homo sapiens
gttccctttccc

SEQ ID NO: 635697 - DNA, 17 bp, Homo sapiens
gttctatttatttattg

SEQ ID NO: 635698 - DNA, 15 bp, Homo sapiens
gttctcaacacacag

SEQ ID NO: 635699 - DNA, 17 bp, Homo sapiens
gttctcatcttgtaaat

SEQ ID NO: 635700 - DNA, 22 bp, Homo sapiens
gttctctcttggtctctttctt

SEQ ID NO: 635701 - DNA, 20 bp, Homo sapiens
gttctgcaataacagtttta

SEQ ID NO: 635702 - DNA, 16 bp, Homo sapiens
gttctgcacatacaga

SEQ ID NO: 635703 - DNA, 15 bp, Homo sapiens
gttctgccacttagg

SEQ ID NO: 635704 - DNA, 12 bp, Homo sapiens
gttctgccctgc

SEQ ID NO: 635705 - DNA, 23 bp, Homo sapiens
gttctgccctgcctgaggaggag

SEQ ID NO: 635706 - DNA, 14 bp, Homo sapiens
gttctgctttctga

SEQ ID NO: 635707 - DNA, 20 bp, Homo sapiens
gttctgggttaacagtaaat

SEQ ID NO: 635708 - DNA, 18 bp, Homo sapiens
gttcttcctcttacctgt

SEQ ID NO: 635709 - DNA, 17 bp, Homo sapiens
gttcttgtaaaactgtg

SEQ ID NO: 635710 - DNA, 15 bp, Homo sapiens
gttctttcttttctt

SEQ ID NO: 635711 - DNA, 16 bp, Homo sapiens
gttgaagggaaatcaa

SEQ ID NO: 635712 - DNA, 21 bp, Homo sapiens
gttgaagtgcatgttaaaata

SEQ ID NO: 635713 - DNA, 21 bp, Homo sapiens
gttgagagggggatgcccctg

SEQ ID NO: 635714 - DNA, 22 bp, Homo sapiens
gttgagagggggatgcccctgg

SEQ ID NO: 635715 - DNA, 23 bp, Homo sapiens
gttgatattggttctatttattt

SEQ ID NO: 635716 - DNA, 13 bp, Homo sapiens
gttgatgaaattc

SEQ ID NO: 635717 - DNA, 22 bp, Homo sapiens
gttgatgctaataaatattgtc

SEQ ID NO: 635718 - DNA, 13 bp, Homo sapiens
gttgattctttca

SEQ ID NO: 635719 - DNA, 16 bp, Homo sapiens
gttgcaaagtgttgtc

SEQ ID NO: 635720 - DNA, 21 bp, Homo sapiens
gttgccacattgcttcattaa

SEQ ID NO: 635721 - DNA, 15 bp, Homo sapiens
gttgccatgaggcct

SEQ ID NO: 635722 - DNA, 19 bp, Homo sapiens
gttgccatgaggcctttcc

SEQ ID NO: 635723 - DNA, 13 bp, Homo sapiens
gttgcccttttcc

SEQ ID NO: 635724 - DNA, 13 bp, Homo sapiens
gttggaggcctgg

SEQ ID NO: 635725 - DNA, 19 bp, Homo sapiens
gttggaggcctggtctgga

SEQ ID NO: 635726 - DNA, 15 bp, Homo sapiens
gttggccggctggcc

SEQ ID NO: 635727 - DNA, 14 bp, Homo sapiens
gttggcctctgccc

SEQ ID NO: 635728 - DNA, 15 bp, Homo sapiens
gttggcctctgcccc

SEQ ID NO: 635729 - DNA, 16 bp, Homo sapiens
gttgggttccagacag

SEQ ID NO: 635730 - DNA, 15 bp, Homo sapiens
gttggtatttactgc

SEQ ID NO: 635731 - DNA, 14 bp, Homo sapiens
gttgtaatatcagt

SEQ ID NO: 635732 - DNA, 23 bp, Homo sapiens
gttgtaatatcagttacagtggc

SEQ ID NO: 635733 - DNA, 19 bp, Homo sapiens
gttgtaatattttgctgct

SEQ ID NO: 635734 - DNA, 14 bp, Homo sapiens
gttgtccctgcagg

SEQ ID NO: 635735 - DNA, 16 bp, Homo sapiens
gttgtcctttctgatc

SEQ ID NO: 635736 - DNA, 13 bp, Homo sapiens
gttgtgctgcctg

SEQ ID NO: 635737 - DNA, 14 bp, Homo sapiens
gttgtgtctggagc

SEQ ID NO: 635738 - DNA, 20 bp, Homo sapiens
gttgtgtgggtttactctgt

SEQ ID NO: 635739 - DNA, 15 bp, Homo sapiens
gttgttgtccctgca

SEQ ID NO: 635740 - DNA, 13 bp, Homo sapiens
gttgttttgtgga

SEQ ID NO: 635741 - DNA, 16 bp, Homo sapiens
gtttaaaaatcagaaa

SEQ ID NO: 635742 - DNA, 17 bp, Homo sapiens
gtttaaaattattaaaa

SEQ ID NO: 635743 - DNA, 12 bp, Homo sapiens
taattatggtac

SEQ ID NO: 635744 - DNA, 19 bp, Homo sapiens
taattcttactgttctgaa

SEQ ID NO: 635745 - DNA, 22 bp, Homo sapiens
taattcttactgttctgaaatt

SEQ ID NO: 635746 - DNA, 17 bp, Homo sapiens
taattcttctcctttgt

SEQ ID NO: 635747 - DNA, 23 bp, Homo sapiens
taattcttctcctttgtcaaatg

SEQ ID NO: 635748 - DNA, 19 bp, Homo sapiens
taattgaaagggacaagta

SEQ ID NO: 635749 - DNA, 20 bp, Homo sapiens
taattgaaagggacaagtat

SEQ ID NO: 635750 - DNA, 12 bp, Homo sapiens
taattggcagca

SEQ ID NO: 635751 - DNA, 16 bp, Homo sapiens
taattgtgagttaatt

SEQ ID NO: 635752 - DNA, 22 bp, Homo sapiens
taatttagcagtccatttttga

SEQ ID NO: 635753 - DNA, 20 bp, Homo sapiens
taatttaggagttttgagaa

SEQ ID NO: 635754 - DNA, 20 bp, Homo sapiens
taatttattaaatttattaa

SEQ ID NO: 635755 - DNA, 16 bp, Homo sapiens
taatttgccagacaga

SEQ ID NO: 635756 - DNA, 21 bp, Homo sapiens
taatttgtataagatgctgct

SEQ ID NO: 635757 - DNA, 13 bp, Homo sapiens
taatttgtgaaag

SEQ ID NO: 635758 - DNA, 14 bp, Homo sapiens
taatttgtgaaagt

SEQ ID NO: 635759 - DNA, 23 bp, Homo sapiens
taatttgtgaaagtggcaagctc

SEQ ID NO: 635760 - DNA, 23 bp, Homo sapiens
taatttttattcataagccaatt

SEQ ID NO: 635761 - DNA, 15 bp, Homo sapiens
tacaaaaaaaatcaa

SEQ ID NO: 635762 - DNA, 22 bp, Homo sapiens
tacaaaaaaaatcaaaaaatta

SEQ ID NO: 635763 - DNA, 17 bp, Homo sapiens
tacaaaatgaattgcct

SEQ ID NO: 635764 - DNA, 21 bp, Homo sapiens
tacaaaatgtgtgcttggaaa

SEQ ID NO: 635765 - DNA, 14 bp, Homo sapiens
tacaaacaggtgct

SEQ ID NO: 635766 - DNA, 9 bp, Homo sapiens
tacaaacat

SEQ ID NO: 635767 - DNA, 21 bp, Homo sapiens
tacaaagaaacaaaatataaa

SEQ ID NO: 635768 - DNA, 18 bp, Homo sapiens
tacaaataatattgcctt

SEQ ID NO: 635769 - DNA, 15 bp, Homo sapiens
tacaaatttttactc

SEQ ID NO: 635770 - DNA, 21 bp, Homo sapiens
tacaacaagcaaactgaaatt

SEQ ID NO: 635771 - DNA, 16 bp, Homo sapiens
tacaagctacatatgt

SEQ ID NO: 635772 - DNA, 17 bp, Homo sapiens
tacaagctacatatgta

SEQ ID NO: 635773 - DNA, 24 bp, Homo sapiens
tacaagtgtttctagtaacagtat

SEQ ID NO: 635774 - DNA, 23 bp, Homo sapiens
tacaatcatgcctacattagtga

SEQ ID NO: 635775 - DNA, 18 bp, Homo sapiens
tacaattctttgttgctt

SEQ ID NO: 635776 - DNA, 16 bp, Homo sapiens
tacacacacagacaca

SEQ ID NO: 635777 - DNA, 18 bp, Homo sapiens
tacacacctgagaatgtg

SEQ ID NO: 635778 - DNA, 17 bp, Homo sapiens
tacacatacatatatac

SEQ ID NO: 635779 - DNA, 20 bp, Homo sapiens
tacacatacatatatacatt

SEQ ID NO: 635780 - DNA, 20 bp, Homo sapiens
tacacatataaacacagtaa

SEQ ID NO: 635781 - DNA, 20 bp, Homo sapiens
tacaccaaatagcttttcac

SEQ ID NO: 635782 - DNA, 21 bp, Homo sapiens
tacaccaaatagcttttcact

SEQ ID NO: 635783 - DNA, 18 bp, Homo sapiens
tacaccactttcccacac

SEQ ID NO: 635784 - DNA, 23 bp, Homo sapiens
tacaccactttcccacactgtga

SEQ ID NO: 635785 - DNA, 15 bp, Homo sapiens
tacacgaagaaatag

SEQ ID NO: 635786 - DNA, 16 bp, Homo sapiens
tacacgaagaaataga

SEQ ID NO: 635787 - DNA, 23 bp, Homo sapiens
tacacgaagaaatagaataggca

SEQ ID NO: 635788 - DNA, 13 bp, Homo sapiens
tacacgtgtatat

SEQ ID NO: 635789 - DNA, 23 bp, Homo sapiens
tacagaaccagcactcccagggc

SEQ ID NO: 635790 - DNA, 19 bp, Homo sapiens
tacagagaactaacactat

SEQ ID NO: 635791 - DNA, 18 bp, Homo sapiens
tacagatgagattccctc

SEQ ID NO: 635792 - DNA, 14 bp, Homo sapiens
tacagtgtgtagtt

SEQ ID NO: 635793 - DNA, 14 bp, Homo sapiens
tacagtgttctgtt

SEQ ID NO: 635794 - DNA, 20 bp, Homo sapiens
tacataacaggcattgcact

SEQ ID NO: 635795 - DNA, 21 bp, Homo sapiens
tacataacaggcattgcacta

SEQ ID NO: 635796 - DNA, 17 bp, Homo sapiens
tacatacgcaattgtat

SEQ ID NO: 635797 - DNA, 20 bp, Homo sapiens
tacatacgcaattgtatata

SEQ ID NO: 635798 - DNA, 19 bp, Homo sapiens
tacatatatacattttgca

SEQ ID NO: 635799 - DNA, 20 bp, Homo sapiens
tacatcctctgcttgtcatt

SEQ ID NO: 635800 - DNA, 15 bp, Homo sapiens
tacatctgaaatcta

SEQ ID NO: 635801 - DNA, 13 bp, Homo sapiens
tacatctgatatc

SEQ ID NO: 635802 - DNA, 20 bp, Homo sapiens
tacatctgatatcaggaaat

SEQ ID NO: 635803 - DNA, 19 bp, Homo sapiens
tacattcttgctctgctca

SEQ ID NO: 635804 - DNA, 14 bp, Homo sapiens
tacattgtcctgta

SEQ ID NO: 635805 - DNA, 14 bp, Homo sapiens
taccaaatgccttt

SEQ ID NO: 635806 - DNA, 19 bp, Homo sapiens
taccaagtgtgttgggaat

SEQ ID NO: 635807 - DNA, 17 bp, Homo sapiens
taccacaggatgcatat

SEQ ID NO: 635808 - DNA, 18 bp, Homo sapiens
taccacaggatgcatatt

SEQ ID NO: 635809 - DNA, 21 bp, Homo sapiens
taccacaggatgcatattaaa

SEQ ID NO: 635810 - DNA, 22 bp, Homo sapiens
taccagaagtttaaatctttgt

SEQ ID NO: 635811 - DNA, 12 bp, Homo sapiens
taccagcaaaag

SEQ ID NO: 635812 - DNA, 14 bp, Homo sapiens
taccatcaaacaaa

SEQ ID NO: 635813 - DNA, 18 bp, Homo sapiens
taccatcaaacaaatcat

SEQ ID NO: 635814 - DNA, 15 bp, Homo sapiens
taccattttgaaata

SEQ ID NO: 635815 - DNA, 19 bp, Homo sapiens
taccccagaacgcatgcag

SEQ ID NO: 635816 - DNA, 18 bp, Homo sapiens
taccccgtccctttccct

SEQ ID NO: 635817 - DNA, 17 bp, Homo sapiens
taccctaggtctccacc

SEQ ID NO: 635818 - DNA, 20 bp, Homo sapiens
taccctggacagtgcctaac

SEQ ID NO: 635819 - DNA, 16 bp, Homo sapiens
taccgcccacccagca

SEQ ID NO: 635820 - DNA, 20 bp, Homo sapiens
taccgcccacccagcagcgc

SEQ ID NO: 635821 - DNA, 13 bp, Homo sapiens
tacctcagtcagt

SEQ ID NO: 635822 - DNA, 16 bp, Homo sapiens
tacctgccttgcctgt

SEQ ID NO: 635823 - DNA, 19 bp, Homo sapiens
tacctgttgtctgaaacat

SEQ ID NO: 635824 - DNA, 19 bp, Homo sapiens
taccttctgatgaagttgt

SEQ ID NO: 635825 - DNA, 16 bp, Homo sapiens
tacgaggcttctctaa

SEQ ID NO: 635826 - DNA, 20 bp, Homo sapiens
tacgggggttccctttcccc

SEQ ID NO: 635827 - DNA, 21 bp, Homo sapiens
tacggtacaagctacatatgt

SEQ ID NO: 635828 - DNA, 16 bp, Homo sapiens
tacggtgagactctga

SEQ ID NO: 635829 - DNA, 20 bp, Homo sapiens
tacgtgcccatttcacacaa

SEQ ID NO: 635830 - DNA, 16 bp, Homo sapiens
tactagaaccttctaa

SEQ ID NO: 635831 - DNA, 16 bp, Homo sapiens
tactcctccccctcct

SEQ ID NO: 635832 - DNA, 18 bp, Homo sapiens
tactcctccccctcctcc

SEQ ID NO: 635833 - DNA, 19 bp, Homo sapiens
tactcctccccctcctcca

SEQ ID NO: 635834 - DNA, 19 bp, Homo sapiens
tactctaaggtaaaaccat

SEQ ID NO: 635835 - DNA, 13 bp, Homo sapiens
tactctaatatac

SEQ ID NO: 635836 - DNA, 14 bp, Homo sapiens
tactctaatataca

SEQ ID NO: 635837 - DNA, 16 bp, Homo sapiens
tactctaatatacagt

SEQ ID NO: 635838 - DNA, 18 bp, Homo sapiens
tactgaaggtgccagacg

SEQ ID NO: 635839 - DNA, 21 bp, Homo sapiens
tactgatgagacaacacacac

SEQ ID NO: 635840 - DNA, 15 bp, Homo sapiens
tactgcaatgtctgt

SEQ ID NO: 635841 - DNA, 16 bp, Homo sapiens
tactgcaatgtctgtc

SEQ ID NO: 635842 - DNA, 21 bp, Homo sapiens
tactgccacggtcctttgagt

SEQ ID NO: 635843 - DNA, 15 bp, Homo sapiens
tactgcccacatttg

SEQ ID NO: 635844 - DNA, 14 bp, Homo sapiens
tactggccttttca

SEQ ID NO: 635845 - DNA, 16 bp, Homo sapiens
tactggccttttcact

SEQ ID NO: 635846 - DNA, 14 bp, Homo sapiens
tactggctggtgat

SEQ ID NO: 635847 - DNA, 14 bp, Homo sapiens
tactgttctgaaat

SEQ ID NO: 635848 - DNA, 18 bp, Homo sapiens
tactgtttgaaaagaaat

SEQ ID NO: 635849 - DNA, 21 bp, Homo sapiens
tactgttttgtgcggtgtgtc

SEQ ID NO: 635850 - DNA, 17 bp, Homo sapiens
tacttaaacaaaaactt

SEQ ID NO: 635851 - DNA, 18 bp, Homo sapiens
tacttaaacaaaaacttt

SEQ ID NO: 635852 - DNA, 21 bp, Homo sapiens
tacttaaacaaaaactttcca

SEQ ID NO: 635853 - DNA, 23 bp, Homo sapiens
tacttaaacaaaaactttccatg

SEQ ID NO: 635854 - DNA, 22 bp, Homo sapiens
tacttacactgaaatccaaaat

SEQ ID NO: 635855 - DNA, 17 bp, Homo sapiens
tacttatttataacatt

SEQ ID NO: 635856 - DNA, 13 bp, Homo sapiens
tacttcattcaaa

SEQ ID NO: 635857 - DNA, 22 bp, Homo sapiens
tacttccatgcactcttcatgt

SEQ ID NO: 635858 - DNA, 15 bp, Homo sapiens
tacttgatttttcaa

SEQ ID NO: 635859 - DNA, 18 bp, Homo sapiens
tatggtacctctgtctat

SEQ ID NO: 635860 - DNA, 17 bp, Homo sapiens
tatggtgatactccaag

SEQ ID NO: 635861 - DNA, 13 bp, Homo sapiens
tatgtaaacatca

SEQ ID NO: 635862 - DNA, 21 bp, Homo sapiens
tatgtacaaaatgaattgcct

SEQ ID NO: 635863 - DNA, 22 bp, Homo sapiens
tatgtacaaaatgaattgcctt

SEQ ID NO: 635864 - DNA, 15 bp, Homo sapiens
tatgtacaaataata

SEQ ID NO: 635865 - DNA, 20 bp, Homo sapiens
tatgtacaaataatattgcc

SEQ ID NO: 635866 - DNA, 18 bp, Homo sapiens
tatgtatatctgtgtaag

SEQ ID NO: 635867 - DNA, 23 bp, Homo sapiens
tatgtcattttcagatccttcca

SEQ ID NO: 635868 - DNA, 14 bp, Homo sapiens
tatgtctcatgttt

SEQ ID NO: 635869 - DNA, 12 bp, Homo sapiens
tatgtctgtgat

SEQ ID NO: 635870 - DNA, 16 bp, Homo sapiens
tatgtctttaaaatga

SEQ ID NO: 635871 - DNA, 18 bp, Homo sapiens
tatgtgtatatgtttata

SEQ ID NO: 635872 - DNA, 19 bp, Homo sapiens
tatgtttaaaatggcattt

SEQ ID NO: 635873 - DNA, 17 bp, Homo sapiens
tatgtttggctgaaatt

SEQ ID NO: 635874 - DNA, 18 bp, Homo sapiens
tatgtttggctgaaatta

SEQ ID NO: 635875 - DNA, 20 bp, Homo sapiens
tatgtttggctgaaattatg

SEQ ID NO: 635876 - DNA, 16 bp, Homo sapiens
tattaaaattgattgt

SEQ ID NO: 635877 - DNA, 21 bp, Homo sapiens
tattaatgtagggcagaatag

SEQ ID NO: 635878 - DNA, 22 bp, Homo sapiens
tattacactgcctggaggatag

SEQ ID NO: 635879 - DNA, 17 bp, Homo sapiens
tattactgttttgggcc

SEQ ID NO: 635880 - DNA, 18 bp, Homo sapiens
tattactgttttgggcct

SEQ ID NO: 635881 - DNA, 14 bp, Homo sapiens
tattagcaccagct

SEQ ID NO: 635882 - DNA, 15 bp, Homo sapiens
tattatctagtaggt

SEQ ID NO: 635883 - DNA, 22 bp, Homo sapiens
tattatcttaaacccacataaa

SEQ ID NO: 635884 - DNA, 22 bp, Homo sapiens
tattatggtgatactccaaggt

SEQ ID NO: 635885 - DNA, 16 bp, Homo sapiens
tattcctaattcctgt

SEQ ID NO: 635886 - DNA, 14 bp, Homo sapiens
tattctcttctaca

SEQ ID NO: 635887 - DNA, 22 bp, Homo sapiens
tattgacaataagaaacagttt

SEQ ID NO: 635888 - DNA, 23 bp, Homo sapiens
tattgctgatggtgcaatgacct

SEQ ID NO: 635889 - DNA, 19 bp, Homo sapiens
tattgctgtaaataaaaat

SEQ ID NO: 635890 - DNA, 21 bp, Homo sapiens
tattgctgtctgaaaaagtgt

SEQ ID NO: 635891 - DNA, 16 bp, Homo sapiens
tattggcataaaacaa

SEQ ID NO: 635892 - DNA, 16 bp, Homo sapiens
tattgtaacagacatt

SEQ ID NO: 635893 - DNA, 17 bp, Homo sapiens
tattgtaacagacattg

SEQ ID NO: 635894 - DNA, 18 bp, Homo sapiens
tattgtaacagacattgt

SEQ ID NO: 635895 - DNA, 21 bp, Homo sapiens
tattgtcttttgacatccagc

SEQ ID NO: 635896 - DNA, 14 bp, Homo sapiens
tattgttcttgtaa

SEQ ID NO: 635897 - DNA, 22 bp, Homo sapiens
tattgttcttgtaaaactgtga

SEQ ID NO: 635898 - DNA, 17 bp, Homo sapiens
tattgtttaaagcaact

SEQ ID NO: 635899 - DNA, 16 bp, Homo sapiens
tattgttttggtttgc

SEQ ID NO: 635900 - DNA, 12 bp, Homo sapiens
tatttaaatgtc

SEQ ID NO: 635901 - DNA, 14 bp, Homo sapiens
tatttaaatgtcta

SEQ ID NO: 635902 - DNA, 12 bp, Homo sapiens
tatttaacattc

SEQ ID NO: 635903 - DNA, 15 bp, Homo sapiens
tatttaagtggactg

SEQ ID NO: 635904 - DNA, 14 bp, Homo sapiens
tatttaccaagatt

SEQ ID NO: 635905 - DNA, 12 bp, Homo sapiens
tatttactgttt

SEQ ID NO: 635906 - DNA, 17 bp, Homo sapiens
tatttataacattgtaa

SEQ ID NO: 635907 - DNA, 17 bp, Homo sapiens
tatttatagagttcata

SEQ ID NO: 635908 - DNA, 14 bp, Homo sapiens
tatttatctgtctg

SEQ ID NO: 635909 - DNA, 17 bp, Homo sapiens
tatttatctgtctgagc

SEQ ID NO: 635910 - DNA, 22 bp, Homo sapiens
tatttattgtatatatggatat

SEQ ID NO: 635911 - DNA, 16 bp, Homo sapiens
tatttatttaaatgtc

SEQ ID NO: 635912 - DNA, 18 bp, Homo sapiens
tatttatttaaatgtcta

SEQ ID NO: 635913 - DNA, 18 bp, Homo sapiens
tatttcaaggaatagagt

SEQ ID NO: 635914 - DNA, 14 bp, Homo sapiens
tatttcaggattct

SEQ ID NO: 635915 - DNA, 23 bp, Homo sapiens
tatttccatacgtgcccatttca

SEQ ID NO: 635916 - DNA, 13 bp, Homo sapiens
tatttctgctgaa

SEQ ID NO: 635917 - DNA, 17 bp, Homo sapiens
tatttctgtatctgaca

SEQ ID NO: 635918 - DNA, 14 bp, Homo sapiens
tatttgatttgcaa

SEQ ID NO: 635919 - DNA, 15 bp, Homo sapiens
tatttgctaattaaa

SEQ ID NO: 635920 - DNA, 18 bp, Homo sapiens
tatttggattcacagcct

SEQ ID NO: 635921 - DNA, 11 bp, Homo sapiens
tatttgtttca

SEQ ID NO: 635922 - DNA, 15 bp, Homo sapiens
tattttaacatagca

SEQ ID NO: 635923 - DNA, 13 bp, Homo sapiens
tattttaataaag

SEQ ID NO: 635924 - DNA, 14 bp, Homo sapiens
tattttatgcaaat

SEQ ID NO: 635925 - DNA, 17 bp, Homo sapiens
tattttattgtaacaga

SEQ ID NO: 635926 - DNA, 18 bp, Homo sapiens
tattttattgtaacagac

SEQ ID NO: 635927 - DNA, 12 bp, Homo sapiens
tattttctactt

SEQ ID NO: 635928 - DNA, 18 bp, Homo sapiens
tattttctactttaaatt

SEQ ID NO: 635929 - DNA, 20 bp, Homo sapiens
tattttgagccttattaaaa

SEQ ID NO: 635930 - DNA, 18 bp, Homo sapiens
tatttttaatttatgata

SEQ ID NO: 635931 - DNA, 20 bp, Homo sapiens
tcaaaaaacagaaaaacaaa

SEQ ID NO: 635932 - DNA, 21 bp, Homo sapiens
tcaaaaattgaagagagatat

SEQ ID NO: 635933 - DNA, 11 bp, Homo sapiens
tcaaaatgtgc

SEQ ID NO: 635934 - DNA, 12 bp, Homo sapiens
tcaaaatgtgcc

SEQ ID NO: 635935 - DNA, 16 bp, Homo sapiens
tcaaacaaatcatttt

SEQ ID NO: 635936 - DNA, 18 bp, Homo sapiens
tcaaacaaatcattttga

SEQ ID NO: 635937 - DNA, 19 bp, Homo sapiens
tcaaacaaatcattttgat

SEQ ID NO: 635938 - DNA, 23 bp, Homo sapiens
tcaaacaaatcattttgatgtat

SEQ ID NO: 635939 - DNA, 15 bp, Homo sapiens
tcaaacactgcttaa

SEQ ID NO: 635940 - DNA, 15 bp, Homo sapiens
tcaaagaacccccct

SEQ ID NO: 635941 - DNA, 16 bp, Homo sapiens
tcaaagaagactcagt

SEQ ID NO: 635942 - DNA, 23 bp, Homo sapiens
tcaaagacttcatttaacactga

SEQ ID NO: 635943 - DNA, 20 bp, Homo sapiens
tcaaatacagcatttctttg

SEQ ID NO: 635944 - DNA, 15 bp, Homo sapiens
tcaaatctgctttca

SEQ ID NO: 635945 - DNA, 20 bp, Homo sapiens
tcaaatgctactcagtatat

SEQ ID NO: 635946 - DNA, 16 bp, Homo sapiens
tcaaatggatgtaata

SEQ ID NO: 635947 - DNA, 22 bp, Homo sapiens
tcaaatggtattttttgtgaat

SEQ ID NO: 635948 - DNA, 22 bp, Homo sapiens
tcaaatgtcatttcatacaaat

SEQ ID NO: 635949 - DNA, 22 bp, Homo sapiens
tcaaattctgattattacaaca

SEQ ID NO: 635950 - DNA, 22 bp, Homo sapiens
tcaaatttttctgggaagaaaa

SEQ ID NO: 635951 - DNA, 14 bp, Homo sapiens
tcaacaaagaaata

SEQ ID NO: 635952 - DNA, 15 bp, Homo sapiens
tcaacaaagaaatat

SEQ ID NO: 635953 - DNA, 23 bp, Homo sapiens
tcaacatcaattgggttttgatc

SEQ ID NO: 635954 - DNA, 22 bp, Homo sapiens
tcaaccacacctaaattaacaa

SEQ ID NO: 635955 - DNA, 14 bp, Homo sapiens
tcaaccctgccctg

SEQ ID NO: 635956 - DNA, 17 bp, Homo sapiens
tcaacctctcagatccc

SEQ ID NO: 635957 - DNA, 14 bp, Homo sapiens
tcaacttcaggaaa

SEQ ID NO: 635958 - DNA, 17 bp, Homo sapiens
tcaagactatgttctcc

SEQ ID NO: 635959 - DNA, 15 bp, Homo sapiens
tcaagcattgctaaa

SEQ ID NO: 635960 - DNA, 15 bp, Homo sapiens
tcaagccaggagacc

SEQ ID NO: 635961 - DNA, 21 bp, Homo sapiens
tcaagccaggagaccctgtct

SEQ ID NO: 635962 - DNA, 13 bp, Homo sapiens
tcaaggatcctga

SEQ ID NO: 635963 - DNA, 14 bp, Homo sapiens
tcaaggatcctgag

SEQ ID NO: 635964 - DNA, 15 bp, Homo sapiens
tcaaggatcctgagc

SEQ ID NO: 635965 - DNA, 16 bp, Homo sapiens
tcaaggatcctgagcc

SEQ ID NO: 635966 - DNA, 18 bp, Homo sapiens
tcaaggatcctgagccag

SEQ ID NO: 635967 - DNA, 14 bp, Homo sapiens
tcaaggcattattt

SEQ ID NO: 635968 - DNA, 19 bp, Homo sapiens
tcaaggcccttacaccctt

SEQ ID NO: 635969 - DNA, 13 bp, Homo sapiens
tcaaggctgcagt

SEQ ID NO: 635970 - DNA, 22 bp, Homo sapiens
tcaagtagtagtacttaatagt

SEQ ID NO: 635971 - DNA, 16 bp, Homo sapiens
tcaagtctacctgcct

SEQ ID NO: 635972 - DNA, 14 bp, Homo sapiens
tcaagtctgtgaaa

SEQ ID NO: 635973 - DNA, 16 bp, Homo sapiens
tcaagtggaaaccttg

SEQ ID NO: 635974 - DNA, 14 bp, Homo sapiens
tcaagttgtgtgct

SEQ ID NO: 635975 - DNA, 13 bp, Homo sapiens
tcaataggaaaaa

SEQ ID NO: 635976 - DNA, 15 bp, Homo sapiens
tcatagaaatacatc

SEQ ID NO: 635977 - DNA, 22 bp, Homo sapiens
tcatagataccattttgaaata

SEQ ID NO: 635978 - DNA, 22 bp, Homo sapiens
tcatagatgacccccaggtatt

SEQ ID NO: 635979 - DNA, 14 bp, Homo sapiens
tcatagcacatgtt

SEQ ID NO: 635980 - DNA, 20 bp, Homo sapiens
tcatagcacatgttttacaa

SEQ ID NO: 635981 - DNA, 21 bp, Homo sapiens
tcatagcacatgttttacaaa

SEQ ID NO: 635982 - DNA, 15 bp, Homo sapiens
tcatataatttgcca

SEQ ID NO: 635983 - DNA, 22 bp, Homo sapiens
tcatataatttgccagacagag

SEQ ID NO: 635984 - DNA, 23 bp, Homo sapiens
tcatataatttgccagacagaga

SEQ ID NO: 635985 - DNA, 12 bp, Homo sapiens
tcatatctgtat

SEQ ID NO: 635986 - DNA, 15 bp, Homo sapiens
tcatatgagttcctg

SEQ ID NO: 635987 - DNA, 23 bp, Homo sapiens
tcatatgttagatacacaaaata

SEQ ID NO: 635988 - DNA, 15 bp, Homo sapiens
tcatatttacctgtg

SEQ ID NO: 635989 - DNA, 17 bp, Homo sapiens
tcatatttacctgtgaa

SEQ ID NO: 635990 - DNA, 14 bp, Homo sapiens
tcatcaaacatgtt

SEQ ID NO: 635991 - DNA, 18 bp, Homo sapiens
tcatcaacaaagaaatat

SEQ ID NO: 635992 - DNA, 13 bp, Homo sapiens
tcatcagaagtgg

SEQ ID NO: 635993 - DNA, 19 bp, Homo sapiens
tcatccaactggaaggctt

SEQ ID NO: 635994 - DNA, 21 bp, Homo sapiens
tcatccactaggtgcccagtc

SEQ ID NO: 635995 - DNA, 19 bp, Homo sapiens
tcatccccaaatgtgtctt

SEQ ID NO: 635996 - DNA, 17 bp, Homo sapiens
tcatcctgccttcatgg

SEQ ID NO: 635997 - DNA, 15 bp, Homo sapiens
tcatctacacatata

SEQ ID NO: 635998 - DNA, 17 bp, Homo sapiens
tcatctacacatataaa

SEQ ID NO: 635999 - DNA, 22 bp, Homo sapiens
tcatctacacatataaacacag

SEQ ID NO: 636000 - DNA, 15 bp, Homo sapiens
tcatctgtaaaacca

SEQ ID NO: 636001 - DNA, 15 bp, Homo sapiens
tcatgaccttacata

SEQ ID NO: 636002 - DNA, 14 bp, Homo sapiens
tcatgattagacaa

SEQ ID NO: 636003 - DNA, 15 bp, Homo sapiens
tcatgattagacaat

SEQ ID NO: 636004 - DNA, 16 bp, Homo sapiens
tcatgattagacaatg

SEQ ID NO: 636005 - DNA, 19 bp, Homo sapiens
tcatgattagacaatgtgg

SEQ ID NO: 636006 - DNA, 20 bp, Homo sapiens
tcatgcacacaggagaaaat

SEQ ID NO: 636007 - DNA, 15 bp, Homo sapiens
tcatgcatagacaag

SEQ ID NO: 636008 - DNA, 19 bp, Homo sapiens
tcatgcatagacaagtgtt

SEQ ID NO: 636009 - DNA, 17 bp, Homo sapiens
tcatgcgcagtccccag

SEQ ID NO: 636010 - DNA, 15 bp, Homo sapiens
tcatgctttctcctt

SEQ ID NO: 636011 - DNA, 14 bp, Homo sapiens
tcatgcttttctca

SEQ ID NO: 636012 - DNA, 18 bp, Homo sapiens
tcatgcttttctcatggt

SEQ ID NO: 636013 - DNA, 20 bp, Homo sapiens
tcatggaatgcaatttgact

SEQ ID NO: 636014 - DNA, 19 bp, Homo sapiens
tcatggctgtcccctgcaa

SEQ ID NO: 636015 - DNA, 12 bp, Homo sapiens
tcatgttgatgt

SEQ ID NO: 636016 - DNA, 20 bp, Homo sapiens
tcatgtttaagaaatgagaa

SEQ ID NO: 636017 - DNA, 18 bp, Homo sapiens
tcatgtttaatttgcatc

SEQ ID NO: 636018 - DNA, 15 bp, Homo sapiens
tcatgttttatatga

SEQ ID NO: 636019 - DNA, 12 bp, Homo sapiens
tcattaaaacaa

SEQ ID NO: 636020 - DNA, 18 bp, Homo sapiens
tcattacatcctctgctt

SEQ ID NO: 636021 - DNA, 22 bp, Homo sapiens
tcattagacaaatgtcttgaag

SEQ ID NO: 636022 - DNA, 15 bp, Homo sapiens
tcattatagcatgta

SEQ ID NO: 636023 - DNA, 14 bp, Homo sapiens
tcattatttcaagg

SEQ ID NO: 636024 - DNA, 23 bp, Homo sapiens
tcattcagaatgtgcaaagcagt

SEQ ID NO: 636025 - DNA, 16 bp, Homo sapiens
tcattcaggtgttctc

SEQ ID NO: 636026 - DNA, 17 bp, Homo sapiens
tcattccgttaggaata

SEQ ID NO: 636027 - DNA, 20 bp, Homo sapiens
tcattctggtccttagtaaa

SEQ ID NO: 636028 - DNA, 23 bp, Homo sapiens
tcattgacaccaaatattttcaa

SEQ ID NO: 636029 - DNA, 14 bp, Homo sapiens
tcattgcactgcag

SEQ ID NO: 636030 - DNA, 16 bp, Homo sapiens
tcattgcactgcagtt

SEQ ID NO: 636031 - DNA, 15 bp, Homo sapiens
tcattggttacaaat

SEQ ID NO: 636032 - DNA, 19 bp, Homo sapiens
tcattgtgttttcttcgtg

SEQ ID NO: 636033 - DNA, 21 bp, Homo sapiens
tcattgtgttttcttcgtgga

SEQ ID NO: 636034 - DNA, 23 bp, Homo sapiens
tcatttaacactgagtgaaatat

SEQ ID NO: 636035 - DNA, 12 bp, Homo sapiens
tcatttcataca

SEQ ID NO: 636036 - DNA, 16 bp, Homo sapiens
tcatttccagcaaaat

SEQ ID NO: 636037 - DNA, 23 bp, Homo sapiens
tcatttccagcaaaatatatgtt

SEQ ID NO: 636038 - DNA, 11 bp, Homo sapiens
tcattttctct

SEQ ID NO: 636039 - DNA, 13 bp, Homo sapiens
tcattttgatgta

SEQ ID NO: 636040 - DNA, 15 bp, Homo sapiens
tcattttgatgtatt

SEQ ID NO: 636041 - DNA, 20 bp, Homo sapiens
tcattttgggaaattcttgc

SEQ ID NO: 636042 - DNA, 15 bp, Homo sapiens
tcattttttgtttct

SEQ ID NO: 636043 - DNA, 19 bp, Homo sapiens
tccaaaagtactagcaata

SEQ ID NO: 636044 - DNA, 21 bp, Homo sapiens
tccaaaatagtcatgtttctg

SEQ ID NO: 636045 - DNA, 23 bp, Homo sapiens
tccaaaatagtcatgtttctgca

SEQ ID NO: 636046 - DNA, 16 bp, Homo sapiens
tccaaacttaacagat

SEQ ID NO: 636047 - DNA, 17 bp, Homo sapiens
tccaacatgtgatgtgt

SEQ ID NO: 636048 - DNA, 20 bp, Homo sapiens
tccaagacagccatacttcc

SEQ ID NO: 636049 - DNA, 15 bp, Homo sapiens
tccaagtgtgtgtgc

SEQ ID NO: 636050 - DNA, 18 bp, Homo sapiens
tccaagttcattcatact

SEQ ID NO: 636051 - DNA, 14 bp, Homo sapiens
tccaatccagcctt

SEQ ID NO: 636052 - DNA, 17 bp, Homo sapiens
tccaatgccaattcatc

SEQ ID NO: 636053 - DNA, 15 bp, Homo sapiens
tccacacctccaccc

SEQ ID NO: 636054 - DNA, 18 bp, Homo sapiens
tccacagagttactgcca

SEQ ID NO: 636055 - DNA, 15 bp, Homo sapiens
tccacaggagccgca

SEQ ID NO: 636056 - DNA, 21 bp, Homo sapiens
tccacagggacacagtctggt

SEQ ID NO: 636057 - DNA, 21 bp, Homo sapiens
tccacagtagcatttcttatt

SEQ ID NO: 636058 - DNA, 12 bp, Homo sapiens
tccacagtattg

SEQ ID NO: 636059 - DNA, 22 bp, Homo sapiens
tccacagtattgttcttgtaaa

SEQ ID NO: 636060 - DNA, 21 bp, Homo sapiens
tccacatgtggggacagggct

SEQ ID NO: 636061 - DNA, 20 bp, Homo sapiens
tccacccctcaagccaggag

SEQ ID NO: 636062 - DNA, 16 bp, Homo sapiens
tccacctggtggccct

SEQ ID NO: 636063 - DNA, 19 bp, Homo sapiens
tccacctggtggccctgcg

SEQ ID NO: 636064 - DNA, 20 bp, Homo sapiens
tccacctggtggccctgcgg

SEQ ID NO: 636065 - DNA, 15 bp, Homo sapiens
tccaccttcctgccc

SEQ ID NO: 636066 - DNA, 19 bp, Homo sapiens
tccaccttcctgcccaggg

SEQ ID NO: 636067 - DNA, 13 bp, Homo sapiens
tccactcccctca

SEQ ID NO: 636068 - DNA, 14 bp, Homo sapiens
tccactcccctcat

SEQ ID NO: 636069 - DNA, 15 bp, Homo sapiens
tccactcccctcatc

SEQ ID NO: 636070 - DNA, 17 bp, Homo sapiens
tccactttcctctctct

SEQ ID NO: 636071 - DNA, 13 bp, Homo sapiens
tccagaattgaga

SEQ ID NO: 636072 - DNA, 10 bp, Homo sapiens
tccagacaga

SEQ ID NO: 636073 - DNA, 22 bp, Homo sapiens
tccagacagagtggatctggag

SEQ ID NO: 636074 - DNA, 14 bp, Homo sapiens
tccagacccctacc

SEQ ID NO: 636075 - DNA, 13 bp, Homo sapiens
tccagagagaagc

SEQ ID NO: 636076 - DNA, 18 bp, Homo sapiens
tccagagagaagcacccc

SEQ ID NO: 636077 - DNA, 20 bp, Homo sapiens
tccagagagaagcaccccac

SEQ ID NO: 636078 - DNA, 22 bp, Homo sapiens
tccagagtaggtgggtcttgga

SEQ ID NO: 636079 - DNA, 23 bp, Homo sapiens
tccagagtaggtgggtcttggat

SEQ ID NO: 636080 - DNA, 16 bp, Homo sapiens
tccagattattttcta

SEQ ID NO: 636081 - DNA, 13 bp, Homo sapiens
tccagcccatgct

SEQ ID NO: 636082 - DNA, 17 bp, Homo sapiens
tccagcccatgctggct

SEQ ID NO: 636083 - DNA, 21 bp, Homo sapiens
tccagcccatgctggctgggg

SEQ ID NO: 636084 - DNA, 15 bp, Homo sapiens
tccagccctccgcca

SEQ ID NO: 636085 - DNA, 16 bp, Homo sapiens
tccagccctccgccag

SEQ ID NO: 636086 - DNA, 22 bp, Homo sapiens
tccagccctccgccagccctgt

SEQ ID NO: 636087 - DNA, 22 bp, Homo sapiens
tccagccttcttcccccagggt

SEQ ID NO: 636088 - DNA, 21 bp, Homo sapiens
tccagcggggcttctgggcgc

SEQ ID NO: 636089 - DNA, 18 bp, Homo sapiens
tccaggaggactgttcta

SEQ ID NO: 636090 - DNA, 13 bp, Homo sapiens
tccagggtccagc

SEQ ID NO: 636091 - DNA, 16 bp, Homo sapiens
tccagggtccagccct

SEQ ID NO: 636092 - DNA, 12 bp, Homo sapiens
tccttctcccct

SEQ ID NO: 636093 - DNA, 19 bp, Homo sapiens
tccttctcccctccagacc

SEQ ID NO: 636094 - DNA, 21 bp, Homo sapiens
tccttgactattacactgcct

SEQ ID NO: 636095 - DNA, 15 bp, Homo sapiens
tccttgcacttctgt

SEQ ID NO: 636096 - DNA, 13 bp, Homo sapiens
tccttgctgcagc

SEQ ID NO: 636097 - DNA, 14 bp, Homo sapiens
tccttgctgcagct

SEQ ID NO: 636098 - DNA, 17 bp, Homo sapiens
tccttgctgcagcttct

SEQ ID NO: 636099 - DNA, 22 bp, Homo sapiens
tccttggtgtcgggcatgacac

SEQ ID NO: 636100 - DNA, 13 bp, Homo sapiens
tccttgtcagttg

SEQ ID NO: 636101 - DNA, 20 bp, Homo sapiens
tccttgtctaaagatctttt

SEQ ID NO: 636102 - DNA, 20 bp, Homo sapiens
tcctttaatatactccttaa

SEQ ID NO: 636103 - DNA, 15 bp, Homo sapiens
tcctttatgtattct

SEQ ID NO: 636104 - DNA, 15 bp, Homo sapiens
tcctttatgtgatgt

SEQ ID NO: 636105 - DNA, 14 bp, Homo sapiens
tcctttcctctcct

SEQ ID NO: 636106 - DNA, 13 bp, Homo sapiens
tcctttctctctt

SEQ ID NO: 636107 - DNA, 17 bp, Homo sapiens
tcctttctgatcctctc

SEQ ID NO: 636108 - DNA, 16 bp, Homo sapiens
tccttttgtatcctcc

SEQ ID NO: 636109 - DNA, 18 bp, Homo sapiens
tccttttttatacacata

SEQ ID NO: 636110 - DNA, 17 bp, Homo sapiens
tccttttttcctttctt

SEQ ID NO: 636111 - DNA, 20 bp, Homo sapiens
tcgacaggtgccctttctct

SEQ ID NO: 636112 - DNA, 22 bp, Homo sapiens
tcgacaggtgccctttctctta

SEQ ID NO: 636113 - DNA, 13 bp, Homo sapiens
tcgagagggctga

SEQ ID NO: 636114 - DNA, 19 bp, Homo sapiens
tcgattttaccatatggaa

SEQ ID NO: 636115 - DNA, 18 bp, Homo sapiens
tcgcagcctgaagcctgg

SEQ ID NO: 636116 - DNA, 15 bp, Homo sapiens
tcgcattaagcacac

SEQ ID NO: 636117 - DNA, 23 bp, Homo sapiens
tcgcccacctaaagggaagccct

SEQ ID NO: 636118 - DNA, 17 bp, Homo sapiens
tcgccccccgcccggcc

SEQ ID NO: 636119 - DNA, 19 bp, Homo sapiens
tcgccctgtgccctctcac

SEQ ID NO: 636120 - DNA, 20 bp, Homo sapiens
tcgcctgggaaattgctcca

SEQ ID NO: 636121 - DNA, 13 bp, Homo sapiens
tcgctgctggcct

SEQ ID NO: 636122 - DNA, 20 bp, Homo sapiens
tcgcttgtgcagaaaacatt

SEQ ID NO: 636123 - DNA, 21 bp, Homo sapiens
tcgcttgtgcagaaaacattg

SEQ ID NO: 636124 - DNA, 22 bp, Homo sapiens
tcggccattgaacactgcaccc

SEQ ID NO: 636125 - DNA, 14 bp, Homo sapiens
tcggccgaggcctg

SEQ ID NO: 636126 - DNA, 17 bp, Homo sapiens
tcggctatgtctcatgt

SEQ ID NO: 636127 - DNA, 16 bp, Homo sapiens
tcggctgggcagggcc

SEQ ID NO: 636128 - DNA, 15 bp, Homo sapiens
tcgggattacagaaa

SEQ ID NO: 636129 - DNA, 18 bp, Homo sapiens
tcgggattacagaaacac

SEQ ID NO: 636130 - DNA, 17 bp, Homo sapiens
tcgggccgcctcctcca

SEQ ID NO: 636131 - DNA, 22 bp, Homo sapiens
tcgggcgcctgcgctcctctgc

SEQ ID NO: 636132 - DNA, 21 bp, Homo sapiens
tcgggctctctcacccagcct

SEQ ID NO: 636133 - DNA, 13 bp, Homo sapiens
tcggggcccctgc

SEQ ID NO: 636134 - DNA, 17 bp, Homo sapiens
tcgggggaggagcaccc

SEQ ID NO: 636135 - DNA, 23 bp, Homo sapiens
tcgggggaggagcacccccagcc

SEQ ID NO: 636136 - DNA, 19 bp, Homo sapiens
tcgtccggcctgcagccca

SEQ ID NO: 636137 - DNA, 19 bp, Homo sapiens
tcgtgccgtggagcttgga

SEQ ID NO: 636138 - DNA, 20 bp, Homo sapiens
tcgtgccgtggagcttggag

SEQ ID NO: 636139 - DNA, 19 bp, Homo sapiens
tcgttgactgcttctctgc

SEQ ID NO: 636140 - DNA, 16 bp, Homo sapiens
tcgtttcacatctgta

SEQ ID NO: 636141 - DNA, 20 bp, Homo sapiens
tctaaagcagagatgtatta

SEQ ID NO: 636142 - DNA, 23 bp, Homo sapiens
tctaaaggcggagggtctccctg

SEQ ID NO: 636143 - DNA, 22 bp, Homo sapiens
tctaaaggtttcactgttcatg

SEQ ID NO: 636144 - DNA, 21 bp, Homo sapiens
tctaagaaatggctttccaca

SEQ ID NO: 636145 - DNA, 15 bp, Homo sapiens
tctaaggaatgatcc

SEQ ID NO: 636146 - DNA, 15 bp, Homo sapiens
tctaattgattcaag

SEQ ID NO: 636147 - DNA, 17 bp, Homo sapiens
tctaatttttattcata

SEQ ID NO: 636148 - DNA, 20 bp, Homo sapiens
tctacaaaaaaaatcaaaaa

SEQ ID NO: 636149 - DNA, 14 bp, Homo sapiens
tctacaacataatg

SEQ ID NO: 636150 - DNA, 22 bp, Homo sapiens
tctacaacataatgatactgaa

SEQ ID NO: 636151 - DNA, 16 bp, Homo sapiens
tctacaatacaacaca

SEQ ID NO: 636152 - DNA, 22 bp, Homo sapiens
tctacacatataaacacagtaa

SEQ ID NO: 636153 - DNA, 19 bp, Homo sapiens
tctacctttttttctctcc

SEQ ID NO: 636154 - DNA, 15 bp, Homo sapiens
tctactttaaattgt

SEQ ID NO: 636155 - DNA, 16 bp, Homo sapiens
tctactttaaattgtg

SEQ ID NO: 636156 - DNA, 19 bp, Homo sapiens
tctactttaaattgtggat

SEQ ID NO: 636157 - DNA, 20 bp, Homo sapiens
tctactttaaattgtggatg

SEQ ID NO: 636158 - DNA, 14 bp, Homo sapiens
tctagtaacagtat

SEQ ID NO: 636159 - DNA, 17 bp, Homo sapiens
tctagtaacagtatttc

SEQ ID NO: 636160 - DNA, 19 bp, Homo sapiens
tctagtgccattatttcta

SEQ ID NO: 636161 - DNA, 14 bp, Homo sapiens
tctatatttactgt

SEQ ID NO: 636162 - DNA, 17 bp, Homo sapiens
tctatatttactgttta

SEQ ID NO: 636163 - DNA, 14 bp, Homo sapiens
tctatccctggcca

SEQ ID NO: 636164 - DNA, 23 bp, Homo sapiens
tctatgatgtccaaacttaacag

SEQ ID NO: 636165 - DNA, 15 bp, Homo sapiens
tctatgattaaactg

SEQ ID NO: 636166 - DNA, 15 bp, Homo sapiens
tctatgctgtgtgca

SEQ ID NO: 636167 - DNA, 17 bp, Homo sapiens
tctatgctgtgtgcaga

SEQ ID NO: 636168 - DNA, 20 bp, Homo sapiens
tctattagcttactgattaa

SEQ ID NO: 636169 - DNA, 23 bp, Homo sapiens
tctattatctgggttttagaaat

SEQ ID NO: 636170 - DNA, 11 bp, Homo sapiens
tctatttctgc

SEQ ID NO: 636171 - DNA, 14 bp, Homo sapiens
tctcaaaatgtgcc

SEQ ID NO: 636172 - DNA, 22 bp, Homo sapiens
tctcaaatctgctttcatccag

SEQ ID NO: 636173 - DNA, 19 bp, Homo sapiens
tctcaatggtattgtaact

SEQ ID NO: 636174 - DNA, 19 bp, Homo sapiens
tctcaattctgaaggggaa

SEQ ID NO: 636175 - DNA, 15 bp, Homo sapiens
tctcacccagttcag

SEQ ID NO: 636176 - DNA, 17 bp, Homo sapiens
tctcagcatatatataa

SEQ ID NO: 636177 - DNA, 20 bp, Homo sapiens
tctcagctccactctgaagt

SEQ ID NO: 636178 - DNA, 18 bp, Homo sapiens
tctcaggtggcatttgca

SEQ ID NO: 636179 - DNA, 19 bp, Homo sapiens
tctcaggtggcatttgcag

SEQ ID NO: 636180 - DNA, 16 bp, Homo sapiens
tctcatagatgacccc

SEQ ID NO: 636181 - DNA, 20 bp, Homo sapiens
tctcatctgtaaaaccaggc

SEQ ID NO: 636182 - DNA, 23 bp, Homo sapiens
tctcatcttgtaaataatgctta

SEQ ID NO: 636183 - DNA, 18 bp, Homo sapiens
tctcatgcatagacaagt

SEQ ID NO: 636184 - DNA, 17 bp, Homo sapiens
tctcatgttttatatga

SEQ ID NO: 636185 - DNA, 21 bp, Homo sapiens
tctcattcaggtgttctcttc

SEQ ID NO: 636186 - DNA, 16 bp, Homo sapiens
tctcatttgaaatgtt

SEQ ID NO: 636187 - DNA, 17 bp, Homo sapiens
tctcatttgaaatgttt

SEQ ID NO: 636188 - DNA, 12 bp, Homo sapiens
tctccacccctc

SEQ ID NO: 636189 - DNA, 21 bp, Homo sapiens
tctccacccctcaagccagga

SEQ ID NO: 636190 - DNA, 23 bp, Homo sapiens
tctccaccctccggccagcgagt

SEQ ID NO: 636191 - DNA, 16 bp, Homo sapiens
tctccaccctgagcct

SEQ ID NO: 636192 - DNA, 17 bp, Homo sapiens
tctccaccctgagcctg

SEQ ID NO: 636193 - DNA, 21 bp, Homo sapiens
tctccaccctgagcctgacct

SEQ ID NO: 636194 - DNA, 20 bp, Homo sapiens
tctccagttgtatcctctga

SEQ ID NO: 636195 - DNA, 14 bp, Homo sapiens
tctccccatgctgg

SEQ ID NO: 636196 - DNA, 13 bp, Homo sapiens
tctccccctcagc

SEQ ID NO: 636197 - DNA, 15 bp, Homo sapiens
tctcccctccagacc

SEQ ID NO: 636198 - DNA, 16 bp, Homo sapiens
tctcccctccagaccc

SEQ ID NO: 636199 - DNA, 19 bp, Homo sapiens
tctccctaccctcttctca

SEQ ID NO: 636200 - DNA, 21 bp, Homo sapiens
tctccctaccctcttctcagc

SEQ ID NO: 636201 - DNA, 11 bp, Homo sapiens
tctccctccac

SEQ ID NO: 636202 - DNA, 12 bp, Homo sapiens
tctccctccact

SEQ ID NO: 636203 - DNA, 14 bp, Homo sapiens
tctccctccactcc

SEQ ID NO: 636204 - DNA, 19 bp, Homo sapiens
tctccctccactcctccca

SEQ ID NO: 636205 - DNA, 20 bp, Homo sapiens
tctccctccactcctcccaa

SEQ ID NO: 636206 - DNA, 22 bp, Homo sapiens
tctccctggggaggacccctgc

SEQ ID NO: 636207 - DNA, 13 bp, Homo sapiens
tctccgcccacgc

SEQ ID NO: 636208 - DNA, 23 bp, Homo sapiens
tgaagataaatccaactctgact

SEQ ID NO: 636209 - DNA, 23 bp, Homo sapiens
tgaagcagagtcaagctgatgaa

SEQ ID NO: 636210 - DNA, 15 bp, Homo sapiens
tgaagcatccaggca

SEQ ID NO: 636211 - DNA, 16 bp, Homo sapiens
tgaagcccaggaggac

SEQ ID NO: 636212 - DNA, 15 bp, Homo sapiens
tgaagccctaagtaa

SEQ ID NO: 636213 - DNA, 17 bp, Homo sapiens
tgaagcctggattccag

SEQ ID NO: 636214 - DNA, 22 bp, Homo sapiens
tgaagcctggattccagcagtg

SEQ ID NO: 636215 - DNA, 14 bp, Homo sapiens
tgaagctaaaacac

SEQ ID NO: 636216 - DNA, 17 bp, Homo sapiens
tgaagtagtgtgagtgt

SEQ ID NO: 636217 - DNA, 18 bp, Homo sapiens
tgaagtagtgtgagtgtt

SEQ ID NO: 636218 - DNA, 16 bp, Homo sapiens
tgaagtatgtcttcaa

SEQ ID NO: 636219 - DNA, 20 bp, Homo sapiens
tgaagtatgtcttcaaaata

SEQ ID NO: 636220 - DNA, 21 bp, Homo sapiens
tgaagtcccttcctgtcctgc

SEQ ID NO: 636221 - DNA, 14 bp, Homo sapiens
tgaataaaatgttt

SEQ ID NO: 636222 - DNA, 14 bp, Homo sapiens
tgaataacaacaat

SEQ ID NO: 636223 - DNA, 22 bp, Homo sapiens
tgaataataaccacgattccaa

SEQ ID NO: 636224 - DNA, 21 bp, Homo sapiens
tgaatagacagaggtttcatt

SEQ ID NO: 636225 - DNA, 22 bp, Homo sapiens
tgaatagacagaggtttcattt

SEQ ID NO: 636226 - DNA, 23 bp, Homo sapiens
tgaatagacagaggtttcatttt

SEQ ID NO: 636227 - DNA, 21 bp, Homo sapiens
tgaatattaaagtctgagaaa

SEQ ID NO: 636228 - DNA, 15 bp, Homo sapiens
tgaatcagaggcaga

SEQ ID NO: 636229 - DNA, 16 bp, Homo sapiens
tgaatcagaggcagag

SEQ ID NO: 636230 - DNA, 22 bp, Homo sapiens
tgaatctgagaaagtactttct

SEQ ID NO: 636231 - DNA, 16 bp, Homo sapiens
tgaatgaaatataaac

SEQ ID NO: 636232 - DNA, 20 bp, Homo sapiens
tgaatgaaatataaactgtg

SEQ ID NO: 636233 - DNA, 22 bp, Homo sapiens
tgaatgagtttccagctaagcc

SEQ ID NO: 636234 - DNA, 17 bp, Homo sapiens
tgaatgcttaaatgatc

SEQ ID NO: 636235 - DNA, 14 bp, Homo sapiens
tgaatggttgcaaa

SEQ ID NO: 636236 - DNA, 18 bp, Homo sapiens
tgaatggttgcaaagtgt

SEQ ID NO: 636237 - DNA, 21 bp, Homo sapiens
tgaatgttgtcctgtgtcatc

SEQ ID NO: 636238 - DNA, 22 bp, Homo sapiens
tgaattggctgccaagagtcca

SEQ ID NO: 636239 - DNA, 20 bp, Homo sapiens
tgaatttaccatcaaacaaa

SEQ ID NO: 636240 - DNA, 20 bp, Homo sapiens
tgaatttggggctacttata

SEQ ID NO: 636241 - DNA, 23 bp, Homo sapiens
tgacacactcaccatttaatcat

SEQ ID NO: 636242 - DNA, 16 bp, Homo sapiens
tgacacattgcacaca

SEQ ID NO: 636243 - DNA, 18 bp, Homo sapiens
tgacaccaaatattttca

SEQ ID NO: 636244 - DNA, 16 bp, Homo sapiens
tgacaccttttcaggt

SEQ ID NO: 636245 - DNA, 18 bp, Homo sapiens
tgacactcatcaggtaaa

SEQ ID NO: 636246 - DNA, 20 bp, Homo sapiens
tgacagaaggcccgaggagg

SEQ ID NO: 636247 - DNA, 21 bp, Homo sapiens
tgacagaaggcccgaggaggc

SEQ ID NO: 636248 - DNA, 14 bp, Homo sapiens
tgacagcaaacaca

SEQ ID NO: 636249 - DNA, 20 bp, Homo sapiens
tgacaggcgccgcctcgccc

SEQ ID NO: 636250 - DNA, 15 bp, Homo sapiens
tgacagttacttaca

SEQ ID NO: 636251 - DNA, 16 bp, Homo sapiens
tgacatgggtgtgcca

SEQ ID NO: 636252 - DNA, 13 bp, Homo sapiens
tgacatgtacaga

SEQ ID NO: 636253 - DNA, 19 bp, Homo sapiens
tgacattcctaagagtgga

SEQ ID NO: 636254 - DNA, 16 bp, Homo sapiens
tgacattgtcagaatg

SEQ ID NO: 636255 - DNA, 20 bp, Homo sapiens
tgacattgtcagaatgttgt

SEQ ID NO: 636256 - DNA, 22 bp, Homo sapiens
tgacattgtcagaatgttgtgt

SEQ ID NO: 636257 - DNA, 22 bp, Homo sapiens
tgacatttcaatcactgaaaat

SEQ ID NO: 636258 - DNA, 16 bp, Homo sapiens
tgacattttgtagcta

SEQ ID NO: 636259 - DNA, 21 bp, Homo sapiens
tgaccagaaaatttttgtctt

SEQ ID NO: 636260 - DNA, 23 bp, Homo sapiens
tgaccagaatgaggcacatgaca

SEQ ID NO: 636261 - DNA, 12 bp, Homo sapiens
tgacccagcctg

SEQ ID NO: 636262 - DNA, 16 bp, Homo sapiens
tgacccagcctgaaag

SEQ ID NO: 636263 - DNA, 20 bp, Homo sapiens
tgacccccaggtattgtctt

SEQ ID NO: 636264 - DNA, 12 bp, Homo sapiens
tgaccctcacct

SEQ ID NO: 636265 - DNA, 17 bp, Homo sapiens
tgaccggcccgccacct

SEQ ID NO: 636266 - DNA, 19 bp, Homo sapiens
tgaccggcccgccaccttg

SEQ ID NO: 636267 - DNA, 21 bp, Homo sapiens
tgacctctcacttttttataa

SEQ ID NO: 636268 - DNA, 14 bp, Homo sapiens
tgacctgctcctgc

SEQ ID NO: 636269 - DNA, 15 bp, Homo sapiens
tgacctgctcctgcc

SEQ ID NO: 636270 - DNA, 16 bp, Homo sapiens
tgacctgctcctgccc

SEQ ID NO: 636271 - DNA, 16 bp, Homo sapiens
tgaccttacatagctt

SEQ ID NO: 636272 - DNA, 14 bp, Homo sapiens
tgaccttcatgacc

SEQ ID NO: 636273 - DNA, 12 bp, Homo sapiens
tgacctttcaat

SEQ ID NO: 636274 - DNA, 16 bp, Homo sapiens
tgacctttcaatagga

SEQ ID NO: 636275 - DNA, 18 bp, Homo sapiens
tgacctttcaataggaaa

SEQ ID NO: 636276 - DNA, 20 bp, Homo sapiens
tgactcagaaacagaagaaa

SEQ ID NO: 636277 - DNA, 15 bp, Homo sapiens
tgactcagtgcaggg

SEQ ID NO: 636278 - DNA, 18 bp, Homo sapiens
tgactgacactcagatgc

SEQ ID NO: 636279 - DNA, 22 bp, Homo sapiens
tgacttcccagctggcagcgcc

SEQ ID NO: 636280 - DNA, 14 bp, Homo sapiens
tgacttctcccggg

SEQ ID NO: 636281 - DNA, 16 bp, Homo sapiens
tgactttcctatgaca

SEQ ID NO: 636282 - DNA, 13 bp, Homo sapiens
tgactttgaataa

SEQ ID NO: 636283 - DNA, 19 bp, Homo sapiens
tgagaaaaagcattaaaaa

SEQ ID NO: 636284 - DNA, 17 bp, Homo sapiens
tgagaaattgtgccaaa

SEQ ID NO: 636285 - DNA, 19 bp, Homo sapiens
tgagaaatttttttccaga

SEQ ID NO: 636286 - DNA, 20 bp, Homo sapiens
tgagaaatttttttccagaa

SEQ ID NO: 636287 - DNA, 22 bp, Homo sapiens
tgagaatgagggcgtgaaacac

SEQ ID NO: 636288 - DNA, 14 bp, Homo sapiens
tgagacaacacaca

SEQ ID NO: 636289 - DNA, 16 bp, Homo sapiens
tgagacaacacacaca

SEQ ID NO: 636290 - DNA, 15 bp, Homo sapiens
tgagacactgtcaag

SEQ ID NO: 636291 - DNA, 21 bp, Homo sapiens
tgagaccagcctgccaggccc

SEQ ID NO: 636292 - DNA, 22 bp, Homo sapiens
tgagaccagcctgccaggccct

SEQ ID NO: 636293 - DNA, 23 bp, Homo sapiens
tgagaccagcctgccaggccctc

SEQ ID NO: 636294 - DNA, 22 bp, Homo sapiens
tgagactcgcgacaatgcaaac

SEQ ID NO: 636295 - DNA, 13 bp, Homo sapiens
tgagactctgagg

SEQ ID NO: 636296 - DNA, 22 bp, Homo sapiens
tgagacttcctattaatttatt

SEQ ID NO: 636297 - DNA, 11 bp, Homo sapiens
tgagaggaaat

SEQ ID NO: 636298 - DNA, 13 bp, Homo sapiens
tgagaggaaatca

SEQ ID NO: 636299 - DNA, 17 bp, Homo sapiens
tgagaggaaatcaccga

SEQ ID NO: 636300 - DNA, 18 bp, Homo sapiens
tgagagggggatgcccct

SEQ ID NO: 636301 - DNA, 19 bp, Homo sapiens
tgagagggggatgcccctg

SEQ ID NO: 636302 - DNA, 14 bp, Homo sapiens
tgagagtcatctca

SEQ ID NO: 636303 - DNA, 20 bp, Homo sapiens
tgagagtcatctcaaacact

SEQ ID NO: 636304 - DNA, 16 bp, Homo sapiens
tgagataaatatcatt

SEQ ID NO: 636305 - DNA, 14 bp, Homo sapiens
tgagatctttctaa

SEQ ID NO: 636306 - DNA, 17 bp, Homo sapiens
tgagatgatttaattct

SEQ ID NO: 636307 - DNA, 17 bp, Homo sapiens
tgagattccctctcctc

SEQ ID NO: 636308 - DNA, 13 bp, Homo sapiens
tgagattctaaat

SEQ ID NO: 636309 - DNA, 19 bp, Homo sapiens
tgagcaaggcaagaagtgg

SEQ ID NO: 636310 - DNA, 20 bp, Homo sapiens
tgagcaaggcaagaagtggg

SEQ ID NO: 636311 - DNA, 20 bp, Homo sapiens
tgagcacatctcttcatgcg

SEQ ID NO: 636312 - DNA, 21 bp, Homo sapiens
tgagcagacagggcgtcctct

SEQ ID NO: 636313 - DNA, 18 bp, Homo sapiens
tgagcagatcgtgccgtg

SEQ ID NO: 636314 - DNA, 13 bp, Homo sapiens
tgagcagctgaat

SEQ ID NO: 636315 - DNA, 21 bp, Homo sapiens
tgagccaataaagctcacact

SEQ ID NO: 636316 - DNA, 22 bp, Homo sapiens
tgagccaataaagctcacactt

SEQ ID NO: 636317 - DNA, 23 bp, Homo sapiens
tgagccacagtggggcccatggc

SEQ ID NO: 636318 - DNA, 18 bp, Homo sapiens
tgagccagatttcactct

SEQ ID NO: 636319 - DNA, 11 bp, Homo sapiens
tgagcccctcc

SEQ ID NO: 636320 - DNA, 12 bp, Homo sapiens
tgagcccctcct

SEQ ID NO: 636321 - DNA, 15 bp, Homo sapiens
tgagccctgccctca

SEQ ID NO: 636322 - DNA, 17 bp, Homo sapiens
tgagccctgccctcact

SEQ ID NO: 636323 - DNA, 22 bp, Homo sapiens
tgagcctgacctttctgagtga

SEQ ID NO: 636324 - DNA, 22 bp, Homo sapiens
ttctgggaagaaaatgagatgg

SEQ ID NO: 636325 - DNA, 18 bp, Homo sapiens
ttctgggttaacagtaaa

SEQ ID NO: 636326 - DNA, 19 bp, Homo sapiens
ttctgtaattcttctcctt

SEQ ID NO: 636327 - DNA, 22 bp, Homo sapiens
ttctgtcattggttacaaattt

SEQ ID NO: 636328 - DNA, 23 bp, Homo sapiens
ttctgtggctgatttactaacag

SEQ ID NO: 636329 - DNA, 15 bp, Homo sapiens
ttctgttggtcttaa

SEQ ID NO: 636330 - DNA, 19 bp, Homo sapiens
ttctgtttacatcagtttt

SEQ ID NO: 636331 - DNA, 12 bp, Homo sapiens
ttcttaattatg

SEQ ID NO: 636332 - DNA, 19 bp, Homo sapiens
ttcttacgaacgccacggc

SEQ ID NO: 636333 - DNA, 14 bp, Homo sapiens
ttcttactgttctg

SEQ ID NO: 636334 - DNA, 14 bp, Homo sapiens
ttcttccttccttt

SEQ ID NO: 636335 - DNA, 12 bp, Homo sapiens
ttcttctccttt

SEQ ID NO: 636336 - DNA, 21 bp, Homo sapiens
ttcttctcctttgtcaaatgg

SEQ ID NO: 636337 - DNA, 20 bp, Homo sapiens
ttcttctttaatttttctgt

SEQ ID NO: 636338 - DNA, 18 bp, Homo sapiens
ttcttgtaaaactgtgac

SEQ ID NO: 636339 - DNA, 19 bp, Homo sapiens
ttcttgtaaaactgtgaca

SEQ ID NO: 636340 - DNA, 13 bp, Homo sapiens
ttctttcctctta

SEQ ID NO: 636341 - DNA, 15 bp, Homo sapiens
ttctttccttccttt

SEQ ID NO: 636342 - DNA, 18 bp, Homo sapiens
ttctttcttttgtgttgg

SEQ ID NO: 636343 - DNA, 12 bp, Homo sapiens
ttctttgttgct

SEQ ID NO: 636344 - DNA, 13 bp, Homo sapiens
ttcttttaatttt

SEQ ID NO: 636345 - DNA, 11 bp, Homo sapiens
ttcttttgtgc

SEQ ID NO: 636346 - DNA, 19 bp, Homo sapiens
ttcttttgtgttggatttg

SEQ ID NO: 636347 - DNA, 17 bp, Homo sapiens
ttcttttttaattgaaa

SEQ ID NO: 636348 - DNA, 22 bp, Homo sapiens
ttcttttttcaatgtactgtat

SEQ ID NO: 636349 - DNA, 17 bp, Homo sapiens
ttgaaactgtatttact

SEQ ID NO: 636350 - DNA, 17 bp, Homo sapiens
ttgaaagcgaaatactt

SEQ ID NO: 636351 - DNA, 21 bp, Homo sapiens
ttgaaagcgaaatacttgaaa

SEQ ID NO: 636352 - DNA, 17 bp, Homo sapiens
ttgaaattatatctgtg

SEQ ID NO: 636353 - DNA, 23 bp, Homo sapiens
ttgaaccgtcaatgtgaaataaa

SEQ ID NO: 636354 - DNA, 15 bp, Homo sapiens
ttgaagggaaatcaa

SEQ ID NO: 636355 - DNA, 17 bp, Homo sapiens
ttgaagtgcatgttaaa

SEQ ID NO: 636356 - DNA, 17 bp, Homo sapiens
ttgaatgctgattcaag

SEQ ID NO: 636357 - DNA, 21 bp, Homo sapiens
ttgacacattgcacacacagt

SEQ ID NO: 636358 - DNA, 21 bp, Homo sapiens
ttgacaccaaatattttcaag

SEQ ID NO: 636359 - DNA, 22 bp, Homo sapiens
ttgacaccaaatattttcaagc

SEQ ID NO: 636360 - DNA, 13 bp, Homo sapiens
ttgacagttactt

SEQ ID NO: 636361 - DNA, 14 bp, Homo sapiens
ttgacattttgtag

SEQ ID NO: 636362 - DNA, 16 bp, Homo sapiens
ttgacattttgtagct

SEQ ID NO: 636363 - DNA, 13 bp, Homo sapiens
ttgaccctgaaat

SEQ ID NO: 636364 - DNA, 18 bp, Homo sapiens
ttgaccctgaaatatttt

SEQ ID NO: 636365 - DNA, 22 bp, Homo sapiens
ttgacctctcacttttttataa

SEQ ID NO: 636366 - DNA, 21 bp, Homo sapiens
ttgacttcagaaactttttct

SEQ ID NO: 636367 - DNA, 15 bp, Homo sapiens
ttgagcatgcccaaa

SEQ ID NO: 636368 - DNA, 19 bp, Homo sapiens
ttgagccttattaaaatat

SEQ ID NO: 636369 - DNA, 15 bp, Homo sapiens
ttgaggccaaatgag

SEQ ID NO: 636370 - DNA, 12 bp, Homo sapiens
ttgagtaaaact

SEQ ID NO: 636371 - DNA, 15 bp, Homo sapiens
ttgagtgggccccct

SEQ ID NO: 636372 - DNA, 16 bp, Homo sapiens
ttgagtgggccccctc

SEQ ID NO: 636373 - DNA, 18 bp, Homo sapiens
ttgagtgggccccctctc

SEQ ID NO: 636374 - DNA, 16 bp, Homo sapiens
ttgagtgtcaggctct

SEQ ID NO: 636375 - DNA, 19 bp, Homo sapiens
ttgataattcgagcaaaca

SEQ ID NO: 636376 - DNA, 22 bp, Homo sapiens
ttgatgaataaaatgtttattt

SEQ ID NO: 636377 - DNA, 15 bp, Homo sapiens
ttgatgctaataaat

SEQ ID NO: 636378 - DNA, 19 bp, Homo sapiens
ttgatggtagaaattttat

SEQ ID NO: 636379 - DNA, 20 bp, Homo sapiens
ttgatttttcaaagacttca

SEQ ID NO: 636380 - DNA, 17 bp, Homo sapiens
ttgcactaaaagtgatg

SEQ ID NO: 636381 - DNA, 15 bp, Homo sapiens
ttgcacttctgttat

SEQ ID NO: 636382 - DNA, 14 bp, Homo sapiens
ttgcagagtaaatc

SEQ ID NO: 636383 - DNA, 16 bp, Homo sapiens
ttgcaggtgaccagaa

SEQ ID NO: 636384 - DNA, 18 bp, Homo sapiens
ttgcaggtgaccagaatg

SEQ ID NO: 636385 - DNA, 20 bp, Homo sapiens
ttgcaggtgaccagaatgag

SEQ ID NO: 636386 - DNA, 16 bp, Homo sapiens
ttgcatgtttaataat

SEQ ID NO: 636387 - DNA, 16 bp, Homo sapiens
ttgccaacattgccta

SEQ ID NO: 636388 - DNA, 20 bp, Homo sapiens
ttgccaatgaactctttccc

SEQ ID NO: 636389 - DNA, 20 bp, Homo sapiens
ttgccatcagcaacatcatt

SEQ ID NO: 636390 - DNA, 14 bp, Homo sapiens
ttgccatgaggcct

SEQ ID NO: 636391 - DNA, 16 bp, Homo sapiens
ttgccatgaggccttt

SEQ ID NO: 636392 - DNA, 12 bp, Homo sapiens
ttgcccttttcc

SEQ ID NO: 636393 - DNA, 13 bp, Homo sapiens
ttgcgctctgggt

SEQ ID NO: 636394 - DNA, 22 bp, Homo sapiens
ttgctaagataattaaatgaaa

SEQ ID NO: 636395 - DNA, 13 bp, Homo sapiens
ttgctacctcagt

SEQ ID NO: 636396 - DNA, 17 bp, Homo sapiens
ttgctattgtttatagg

SEQ ID NO: 636397 - DNA, 12 bp, Homo sapiens
ttgctcagagct

SEQ ID NO: 636398 - DNA, 15 bp, Homo sapiens
ttgctcataagtaaa

SEQ ID NO: 636399 - DNA, 16 bp, Homo sapiens
ttgctcataagtaaat

SEQ ID NO: 636400 - DNA, 14 bp, Homo sapiens
ttgctctacctggc

SEQ ID NO: 636401 - DNA, 15 bp, Homo sapiens
ttgctctacctggcc

SEQ ID NO: 636402 - DNA, 16 bp, Homo sapiens
ttgctctccattcttt

SEQ ID NO: 636403 - DNA, 23 bp, Homo sapiens
ttgctctccctcccttctttcct

SEQ ID NO: 636404 - DNA, 21 bp, Homo sapiens
ttgctctgctcatctacacat

SEQ ID NO: 636405 - DNA, 19 bp, Homo sapiens
ttgctgaataacaacaatt

SEQ ID NO: 636406 - DNA, 16 bp, Homo sapiens
ttgctgatattgcagt

SEQ ID NO: 636407 - DNA, 17 bp, Homo sapiens
ttgctgatggtgcaatg

SEQ ID NO: 636408 - DNA, 18 bp, Homo sapiens
ttgctgatggtgcaatga

SEQ ID NO: 636409 - DNA, 19 bp, Homo sapiens
ttgctgatggtgcaatgac

SEQ ID NO: 636410 - DNA, 12 bp, Homo sapiens
ttgctgcagctt

SEQ ID NO: 636411 - DNA, 17 bp, Homo sapiens
ttgctgtatacaaacag

SEQ ID NO: 636412 - DNA, 14 bp, Homo sapiens
ttgctgtctgaaaa

SEQ ID NO: 636413 - DNA, 17 bp, Homo sapiens
ttgctgtgaaacagtgt

SEQ ID NO: 636414 - DNA, 17 bp, Homo sapiens
ttgctgtgaaatgactg

SEQ ID NO: 636415 - DNA, 16 bp, Homo sapiens
ttgcttcattaaaaca

SEQ ID NO: 636416 - DNA, 18 bp, Homo sapiens
ttggaagaattcatgatg

SEQ ID NO: 636417 - DNA, 15 bp, Homo sapiens
ttggagccccctggc

SEQ ID NO: 636418 - DNA, 19 bp, Homo sapiens
ttggagccccctggcggca

SEQ ID NO: 636419 - DNA, 20 bp, Homo sapiens
ttggagccccctggcggcag

SEQ ID NO: 636420 - DNA, 13 bp, Homo sapiens
ttggaggctgctg

SEQ ID NO: 636421 - DNA, 16 bp, Homo sapiens
ttggaggctgctgccc

SEQ ID NO: 636422 - DNA, 15 bp, Homo sapiens
ttggattttaaacaa

SEQ ID NO: 636423 - DNA, 12 bp, Homo sapiens
ttggcagcagat

SEQ ID NO: 636424 - DNA, 14 bp, Homo sapiens
ttggcagcagattt

SEQ ID NO: 636425 - DNA, 16 bp, Homo sapiens
ttggcagcgcctcgcc

SEQ ID NO: 636426 - DNA, 14 bp, Homo sapiens
ttggcagtgtgtca

SEQ ID NO: 636427 - DNA, 17 bp, Homo sapiens
ttggccatcatttcatt

SEQ ID NO: 636428 - DNA, 18 bp, Homo sapiens
ttggccatcatttcattc

SEQ ID NO: 636429 - DNA, 17 bp, Homo sapiens
ttggccatttgctagtt

SEQ ID NO: 636430 - DNA, 16 bp, Homo sapiens
ttggccctggagccag

SEQ ID NO: 636431 - DNA, 13 bp, Homo sapiens
ttggccggctggc

SEQ ID NO: 636432 - DNA, 15 bp, Homo sapiens
ttggccggctggccg

SEQ ID NO: 636433 - DNA, 16 bp, Homo sapiens
ttggctgccaagagtc

SEQ ID NO: 636434 - DNA, 20 bp, Homo sapiens
ttgggacggaagtggcctga

SEQ ID NO: 636435 - DNA, 12 bp, Homo sapiens
ttgggaggctga

SEQ ID NO: 636436 - DNA, 20 bp, Homo sapiens
ttgggattcctcccctggaa

SEQ ID NO: 636437 - DNA, 23 bp, Homo sapiens
ttgggcagtggagaggggacttg

SEQ ID NO: 636438 - DNA, 19 bp, Homo sapiens
ttggggacaccctcctgcc

SEQ ID NO: 636439 - DNA, 18 bp, Homo sapiens
ttgggtatgtagaactgt

SEQ ID NO: 636440 - DNA, 12 bp, Homo sapiens
ttgggttccaga

SEQ ID NO: 636441 - DNA, 23 bp, Homo sapiens
agggcaacctgacagcaaacaca

SEQ ID NO: 636442 - DNA, 14 bp, Homo sapiens
agggcacattgccc

SEQ ID NO: 636443 - DNA, 23 bp, Homo sapiens
agggcacattgcccatggctggg

SEQ ID NO: 636444 - DNA, 22 bp, Homo sapiens
agggcagccccgcgaccacccc

SEQ ID NO: 636445 - DNA, 23 bp, Homo sapiens
agggcagccccgcgaccacccct

SEQ ID NO: 636446 - DNA, 17 bp, Homo sapiens
agggcagcccctcccca

SEQ ID NO: 636447 - DNA, 23 bp, Homo sapiens
agggcaggggccgtgcagggcca

SEQ ID NO: 636448 - DNA, 13 bp, Homo sapiens
agttaatgtgcca

SEQ ID NO: 636449 - DNA, 16 bp, Homo sapiens
agttaatgtgccaaaa

SEQ ID NO: 636450 - DNA, 18 bp, Homo sapiens
agttaatttgataaagat

SEQ ID NO: 636451 - DNA, 15 bp, Homo sapiens
agttacagtggcagt

SEQ ID NO: 636452 - DNA, 22 bp, Homo sapiens
agttacccctgaaatctgagtt

SEQ ID NO: 636453 - DNA, 16 bp, Homo sapiens
agttacttacacacct

SEQ ID NO: 636454 - DNA, 15 bp, Homo sapiens
agttacttgtgttca

SEQ ID NO: 636455 - DNA, 20 bp, Homo sapiens
agttatttaccagaagttta

SEQ ID NO: 636456 - DNA, 23 bp, Homo sapiens
agttatttcccaacccaggattc

SEQ ID NO: 636457 - DNA, 23 bp, Homo sapiens
agttcattcatactcaaagaggc

SEQ ID NO: 636458 - DNA, 17 bp, Homo sapiens
agttccctcagccctca

SEQ ID NO: 636459 - DNA, 19 bp, Homo sapiens
agttctattatctgggttt

SEQ ID NO: 636460 - DNA, 13 bp, Homo sapiens
agttctccttgta

SEQ ID NO: 636461 - DNA, 16 bp, Homo sapiens
agttctgcacatacag

SEQ ID NO: 636462 - DNA, 15 bp, Homo sapiens
agttgaatgataata

SEQ ID NO: 636463 - DNA, 20 bp, Homo sapiens
agttgaccaactatattgcg

SEQ ID NO: 636464 - DNA, 15 bp, Homo sapiens
agttgagccagcaga

SEQ ID NO: 636465 - DNA, 21 bp, Homo sapiens
agttgagccagcagacattgt

SEQ ID NO: 636466 - DNA, 21 bp, Homo sapiens
agttgcctgactcctgggtgg

SEQ ID NO: 636467 - DNA, 15 bp, Homo sapiens
actgtgttcagtgcc

SEQ ID NO: 636468 - DNA, 19 bp, Homo sapiens
actgtgtttcgcattaagc

SEQ ID NO: 636469 - DNA, 22 bp, Homo sapiens
actgttcccagcaaagttttca

SEQ ID NO: 636470 - DNA, 12 bp, Homo sapiens
actgttctaact

SEQ ID NO: 636471 - DNA, 13 bp, Homo sapiens
actgttttgggcc

SEQ ID NO: 636472 - DNA, 14 bp, Homo sapiens
actgttttgggcct

SEQ ID NO: 636473 - DNA, 15 bp, Homo sapiens
actgttttgggcctc

SEQ ID NO: 636474 - DNA, 15 bp, Homo sapiens
acttaaacaaaaact

SEQ ID NO: 636475 - DNA, 18 bp, Homo sapiens
acttaaacaaaaactttc

SEQ ID NO: 636476 - DNA, 21 bp, Homo sapiens
acttaaacaaaaactttccat

SEQ ID NO: 636477 - DNA, 15 bp, Homo sapiens
acttaaacctgtgct

SEQ ID NO: 636478 - DNA, 14 bp, Homo sapiens
acttaacagatcac

SEQ ID NO: 636479 - DNA, 22 bp, Homo sapiens
acttacacacctgagaatgtgc

SEQ ID NO: 636480 - DNA, 13 bp, Homo sapiens
acttacactgaaa

SEQ ID NO: 636481 - DNA, 18 bp, Homo sapiens
acttacactgaaatccaa

SEQ ID NO: 636482 - DNA, 22 bp, Homo sapiens
acttatattctgcagaaaatta

SEQ ID NO: 636483 - DNA, 23 bp, Homo sapiens
acttatttataacattgtaaatg

SEQ ID NO: 636484 - DNA, 17 bp, Homo sapiens
acttattttgattgttt

SEQ ID NO: 636485 - DNA, 11 bp, Homo sapiens
acttcaaatgt

SEQ ID NO: 636486 - DNA, 19 bp, Homo sapiens
acttcagaaactttttcta

SEQ ID NO: 636487 - DNA, 14 bp, Homo sapiens
acttcagatgtttc

SEQ ID NO: 636488 - DNA, 17 bp, Homo sapiens
acttcagatgtttccaa

SEQ ID NO: 636489 - DNA, 22 bp, Homo sapiens
acttcagatgtttccaagatgt

SEQ ID NO: 636490 - DNA, 15 bp, Homo sapiens
acttcagttctcatc

SEQ ID NO: 636491 - DNA, 18 bp, Homo sapiens
acttcagttctcatcttg

SEQ ID NO: 636492 - DNA, 18 bp, Homo sapiens
acttcatgctgtctgtgt

SEQ ID NO: 636493 - DNA, 13 bp, Homo sapiens
acttccagatttg

SEQ ID NO: 636494 - DNA, 21 bp, Homo sapiens
acttccagatttgagctgcct

SEQ ID NO: 636495 - DNA, 16 bp, Homo sapiens
acttcccagctggcag

SEQ ID NO: 636496 - DNA, 23 bp, Homo sapiens
acttcccagctggcagcgcctcc

SEQ ID NO: 636497 - DNA, 22 bp, Homo sapiens
acttcctattaatttattaaat

SEQ ID NO: 636498 - DNA, 20 bp, Homo sapiens
acttcggataattttcattt

SEQ ID NO: 636499 - DNA, 16 bp, Homo sapiens
acttctaaatcataat

SEQ ID NO: 636500 - DNA, 15 bp, Homo sapiens
agcagagcgcagccc

SEQ ID NO: 636501 - DNA, 18 bp, Homo sapiens
agcagagcgcagccccca

SEQ ID NO: 636502 - DNA, 22 bp, Homo sapiens
agcagagtcaagctgatgaagt

SEQ ID NO: 636503 - DNA, 17 bp, Homo sapiens
agcagatcgtgccgtgg

SEQ ID NO: 636504 - DNA, 14 bp, Homo sapiens
agcagcaaggtggg

SEQ ID NO: 636505 - DNA, 19 bp, Homo sapiens
agcagcgcccgaggccagg

SEQ ID NO: 636506 - DNA, 17 bp, Homo sapiens
agcaggaaagatcccaa

SEQ ID NO: 636507 - DNA, 22 bp, Homo sapiens
agcaggggggttgggttccaga

SEQ ID NO: 636508 - DNA, 23 bp, Homo sapiens
agcaggggggttgggttccagac

SEQ ID NO: 636509 - DNA, 20 bp, Homo sapiens
agcaggtagtgggtgaatgt

SEQ ID NO: 636510 - DNA, 23 bp, Homo sapiens
agcaggtagtgggtgaatgtgtg

SEQ ID NO: 636511 - DNA, 21 bp, Homo sapiens
agcagtaaatgtatattgatg

SEQ ID NO: 636512 - DNA, 15 bp, Homo sapiens
agcagtaccatccca

SEQ ID NO: 636513 - DNA, 21 bp, Homo sapiens
agcagttgcaataaactcagt

SEQ ID NO: 636514 - DNA, 20 bp, Homo sapiens
agcagttttcttttaatttt

SEQ ID NO: 636515 - DNA, 23 bp, Homo sapiens
agcatagccagcattcagcacac

SEQ ID NO: 636516 - DNA, 13 bp, Homo sapiens
agcatatatataa

SEQ ID NO: 636517 - DNA, 13 bp, Homo sapiens
agcatcctggaaa

SEQ ID NO: 636518 - DNA, 16 bp, Homo sapiens
agcatcctggaaattt

SEQ ID NO: 636519 - DNA, 14 bp, Homo sapiens
aacattctatttca

SEQ ID NO: 636520 - DNA, 14 bp, Homo sapiens
aacattgcctattt

SEQ ID NO: 636521 - DNA, 16 bp, Homo sapiens
aacattgcctatttca

SEQ ID NO: 636522 - DNA, 15 bp, Homo sapiens
aacattgtatgttaa

SEQ ID NO: 636523 - DNA, 17 bp, Homo sapiens
aacattgttccagattc

SEQ ID NO: 636524 - DNA, 15 bp, Homo sapiens
aacatttccctgctg

SEQ ID NO: 636525 - DNA, 20 bp, Homo sapiens
aacatttgggagactgagct

SEQ ID NO: 636526 - DNA, 15 bp, Homo sapiens
aacattttaaatgga

SEQ ID NO: 636527 - DNA, 17 bp, Homo sapiens
aacattttaaatggaca

SEQ ID NO: 636528 - DNA, 13 bp, Homo sapiens
aaccaccttaaaa

SEQ ID NO: 636529 - DNA, 20 bp, Homo sapiens
aaccatcattgaaatctttt

SEQ ID NO: 636530 - DNA, 21 bp, Homo sapiens
aaccatcattgaaatcttttt

SEQ ID NO: 636531 - DNA, 22 bp, Homo sapiens
aaccatgttcttgagcagctga

SEQ ID NO: 636532 - DNA, 12 bp, Homo sapiens
aaccattacaaa

SEQ ID NO: 636533 - DNA, 23 bp, Homo sapiens
aacccaaggcatcacagttcaca

SEQ ID NO: 636534 - DNA, 14 bp, Homo sapiens
aaccccacagaaat

SEQ ID NO: 636535 - DNA, 12 bp, Homo sapiens
aacccccacctc

SEQ ID NO: 636536 - DNA, 18 bp, Homo sapiens
aacccccacctcccggtg

SEQ ID NO: 636537 - DNA, 22 bp, Homo sapiens
aacccccctccccaaggaagaa

SEQ ID NO: 636538 - DNA, 21 bp, Homo sapiens
aaccctgtgggggcggctgtg

SEQ ID NO: 636539 - DNA, 11 bp, Homo sapiens
aacccttacag

SEQ ID NO: 636540 - DNA, 15 bp, Homo sapiens
aaccgtcaatgtgaa

SEQ ID NO: 636541 - DNA, 16 bp, Homo sapiens
aaccgtcaatgtgaaa

SEQ ID NO: 636542 - DNA, 19 bp, Homo sapiens
aacctcagttggcctctgc

SEQ ID NO: 636543 - DNA, 20 bp, Homo sapiens
aacctcagttggcctctgcc

SEQ ID NO: 636544 - DNA, 21 bp, Homo sapiens
aacctccacagtagcatttct

SEQ ID NO: 636545 - DNA, 17 bp, Homo sapiens
aacctctactgaaaaca

SEQ ID NO: 636546 - DNA, 19 bp, Homo sapiens
aacctctctgaactgcaac

SEQ ID NO: 636547 - DNA, 22 bp, Homo sapiens
aacctctctgaactgcaacact

SEQ ID NO: 636548 - DNA, 23 bp, Homo sapiens
aacctgacagcaaacacagtcac

SEQ ID NO: 636549 - DNA, 17 bp, Homo sapiens
aacctgtgctttcatgt

SEQ ID NO: 636550 - DNA, 18 bp, Homo sapiens
aacctgtgctttcatgtt

SEQ ID NO: 636551 - DNA, 17 bp, Homo sapiens
aaccttcaaatacattc

SEQ ID NO: 636552 - DNA, 20 bp, Homo sapiens
aaccttcaaatacattctaa

SEQ ID NO: 636553 - DNA, 17 bp, Homo sapiens
aaccttggagaggagag

SEQ ID NO: 636554 - DNA, 22 bp, Homo sapiens
aaccttttaaaaaaataatata

SEQ ID NO: 636555 - DNA, 17 bp, Homo sapiens
aacgaccgacgcccctc

SEQ ID NO: 636556 - DNA, 17 bp, Homo sapiens
aacgaccgtcttttgaa

SEQ ID NO: 636557 - DNA, 17 bp, Homo sapiens
aacgatcatatctgtat

SEQ ID NO: 636558 - DNA, 15 bp, Homo sapiens
aacgatttaatttat

SEQ ID NO: 636559 - DNA, 13 bp, Homo sapiens
aacgggtctgtgg

SEQ ID NO: 636560 - DNA, 15 bp, Homo sapiens
aacgttcatgttcat

SEQ ID NO: 636561 - DNA, 20 bp, Homo sapiens
aacgttcatgttcatctcag

SEQ ID NO: 636562 - DNA, 15 bp, Homo sapiens
aactaaatagcatgt

SEQ ID NO: 636563 - DNA, 20 bp, Homo sapiens
aactaaatagcatgtattgt

SEQ ID NO: 636564 - DNA, 17 bp, Homo sapiens
aactaagttgtatttta

SEQ ID NO: 636565 - DNA, 17 bp, Homo sapiens
aactaatgtaaatattg

SEQ ID NO: 636566 - DNA, 22 bp, Homo sapiens
aactacccatgcaattaaaagg

SEQ ID NO: 636567 - DNA, 23 bp, Homo sapiens
aactccaagacagccatacttcc

SEQ ID NO: 636568 - DNA, 15 bp, Homo sapiens
aactccgtttccaaa

SEQ ID NO: 636569 - DNA, 19 bp, Homo sapiens
aactctctagtgcaggaaa

SEQ ID NO: 636570 - DNA, 22 bp, Homo sapiens
aactctgtacgaggcttctcta

SEQ ID NO: 636571 - DNA, 18 bp, Homo sapiens
aactgaaattagtgtttt

SEQ ID NO: 636572 - DNA, 23 bp, Homo sapiens
aactgatgggtatcatgcttcta

SEQ ID NO: 636573 - DNA, 22 bp, Homo sapiens
aactgatttttttttccttcag

SEQ ID NO: 636574 - DNA, 12 bp, Homo sapiens
aactgcaacact

SEQ ID NO: 636575 - DNA, 15 bp, Homo sapiens
aactgcaacactgga

SEQ ID NO: 636576 - DNA, 18 bp, Homo sapiens
aactgccattttttgtct

SEQ ID NO: 636577 - DNA, 20 bp, Homo sapiens
aactggaaggctttattctt

SEQ ID NO: 636578 - DNA, 14 bp, Homo sapiens
aactggaataagaa

SEQ ID NO: 636579 - DNA, 15 bp, Homo sapiens
aactgtaaaatactt

SEQ ID NO: 636580 - DNA, 13 bp, Homo sapiens
aactgtactgtgt

SEQ ID NO: 636581 - DNA, 11 bp, Homo sapiens
aactgtattta

SEQ ID NO: 636582 - DNA, 22 bp, Homo sapiens
aactgtatttacttgttatgtt

SEQ ID NO: 636583 - DNA, 15 bp, Homo sapiens
aactgtcattacaga

SEQ ID NO: 636584 - DNA, 16 bp, Homo sapiens
aactgtctatttctgc

SEQ ID NO: 636585 - DNA, 17 bp, Homo sapiens
aactgtgacattccaca

SEQ ID NO: 636586 - DNA, 13 bp, Homo sapiens
aactgtgagataa

SEQ ID NO: 636587 - DNA, 17 bp, Homo sapiens
aactgtgagataaatat

SEQ ID NO: 636588 - DNA, 18 bp, Homo sapiens
aactgtgagataaatatc

SEQ ID NO: 636589 - DNA, 16 bp, Homo sapiens
aactgtggataaattt

SEQ ID NO: 636590 - DNA, 20 bp, Homo sapiens
aactgtggataaattttgga

SEQ ID NO: 636591 - DNA, 19 bp, Homo sapiens
aactgttaacccagtgttc

SEQ ID NO: 636592 - DNA, 17 bp, Homo sapiens
aacttaaacctgtgctt

SEQ ID NO: 636593 - DNA, 19 bp, Homo sapiens
aacttaattgctctatgcc

SEQ ID NO: 636594 - DNA, 15 bp, Homo sapiens
aacttattttgattg

SEQ ID NO: 636595 - DNA, 17 bp, Homo sapiens
aacttattttgattgtt

SEQ ID NO: 636596 - DNA, 18 bp, Homo sapiens
aacttattttgattgttt

SEQ ID NO: 636597 - DNA, 14 bp, Homo sapiens
aacttgctgtgaaa

SEQ ID NO: 636598 - DNA, 15 bp, Homo sapiens
aactttccatgacag

SEQ ID NO: 636599 - DNA, 16 bp, Homo sapiens
aactttccatgacagt

SEQ ID NO: 636600 - DNA, 17 bp, Homo sapiens
aactttctcagcatata

SEQ ID NO: 636601 - DNA, 19 bp, Homo sapiens
aactttctcagcatatata

SEQ ID NO: 636602 - DNA, 21 bp, Homo sapiens
aactttctcagcatatatata

SEQ ID NO: 636603 - DNA, 15 bp, Homo sapiens
aagaaaatccttcag

SEQ ID NO: 636604 - DNA, 15 bp, Homo sapiens
aagaaaatttaaaaa

SEQ ID NO: 636605 - DNA, 16 bp, Homo sapiens
aagaaaatttaaaaat

SEQ ID NO: 636606 - DNA, 21 bp, Homo sapiens
aagaaaatttaaaaattaaag

SEQ ID NO: 636607 - DNA, 24 bp, Homo sapiens
aagaaacacagcatgcatttagca

SEQ ID NO: 636608 - DNA, 14 bp, Homo sapiens
aagaaagatgctga

SEQ ID NO: 636609 - DNA, 22 bp, Homo sapiens
aagaaagggagaaggattcttt

SEQ ID NO: 636610 - DNA, 23 bp, Homo sapiens
aagaaatgagaaattgtgccaaa

SEQ ID NO: 636611 - DNA, 17 bp, Homo sapiens
aagaaatggctttccac

SEQ ID NO: 636612 - DNA, 21 bp, Homo sapiens
aagaacccccctccccaagga

SEQ ID NO: 636613 - DNA, 16 bp, Homo sapiens
aagaaggactgaagaa

SEQ ID NO: 636614 - DNA, 23 bp, Homo sapiens
aagaattcatgatgctagttctt

SEQ ID NO: 636615 - DNA, 18 bp, Homo sapiens
acagtatttaacattctt

SEQ ID NO: 636616 - DNA, 16 bp, Homo sapiens
acagtcctcacagcct

SEQ ID NO: 636617 - DNA, 19 bp, Homo sapiens
acagtcctcacagcctctc

SEQ ID NO: 636618 - DNA, 20 bp, Homo sapiens
acagtcctcacagcctctcc

SEQ ID NO: 636619 - DNA, 22 bp, Homo sapiens
acagtcctcacagcctctccct

SEQ ID NO: 636620 - DNA, 22 bp, Homo sapiens
acagtctaatttttattcataa

SEQ ID NO: 636621 - DNA, 20 bp, Homo sapiens
acagtggcaagctaccaact

SEQ ID NO: 636622 - DNA, 18 bp, Homo sapiens
acagtgtggatgtaaatt

SEQ ID NO: 636623 - DNA, 21 bp, Homo sapiens
acagtgttcaaattctgatta

SEQ ID NO: 636624 - DNA, 16 bp, Homo sapiens
acagtgttctgtttaa

SEQ ID NO: 636625 - DNA, 17 bp, Homo sapiens
acagtgttctgtttaat

SEQ ID NO: 636626 - DNA, 16 bp, Homo sapiens
acagttacttacacac

SEQ ID NO: 636627 - DNA, 20 bp, Homo sapiens
acagtttaacagaaaaatga

SEQ ID NO: 636628 - DNA, 12 bp, Homo sapiens
acataaacactt

SEQ ID NO: 636629 - DNA, 13 bp, Homo sapiens
acataaacacttc

SEQ ID NO: 636630 - DNA, 21 bp, Homo sapiens
acataaacacttctccttaac

SEQ ID NO: 636631 - DNA, 22 bp, Homo sapiens
acataacaggcattgcactaaa

SEQ ID NO: 636632 - DNA, 13 bp, Homo sapiens
acataattaaagt

SEQ ID NO: 636633 - DNA, 15 bp, Homo sapiens
acataattaaagtgt

SEQ ID NO: 636634 - DNA, 16 bp, Homo sapiens
acataattaaagtgtc

SEQ ID NO: 636635 - DNA, 15 bp, Homo sapiens
acatacatatataca

SEQ ID NO: 636636 - DNA, 16 bp, Homo sapiens
acatactggctggtga

SEQ ID NO: 636637 - DNA, 17 bp, Homo sapiens
acatagtggtattttaa

SEQ ID NO: 636638 - DNA, 20 bp, Homo sapiens
acatagtggtattttaacat

SEQ ID NO: 636639 - DNA, 22 bp, Homo sapiens
acatagtggtattttaacatag

SEQ ID NO: 636640 - DNA, 19 bp, Homo sapiens
acatataaacacagtaaga

SEQ ID NO: 636641 - DNA, 16 bp, Homo sapiens
acatatagctttgcaa

SEQ ID NO: 636642 - DNA, 14 bp, Homo sapiens
acatatatacattt

SEQ ID NO: 636643 - DNA, 17 bp, Homo sapiens
acatatcattcagaatg

SEQ ID NO: 636644 - DNA, 15 bp, Homo sapiens
acatatttcataagc

SEQ ID NO: 636645 - DNA, 20 bp, Homo sapiens
acatatttcataagcacatc

SEQ ID NO: 636646 - DNA, 19 bp, Homo sapiens
acatcaattgggttttgat

SEQ ID NO: 636647 - DNA, 18 bp, Homo sapiens
acatcataaatagtaaat

SEQ ID NO: 636648 - DNA, 21 bp, Homo sapiens
acatcattcctgtcagagctt

SEQ ID NO: 636649 - DNA, 12 bp, Homo sapiens
acatcatttttt

SEQ ID NO: 636650 - DNA, 20 bp, Homo sapiens
acatccagcagtccaaggta

SEQ ID NO: 636651 - DNA, 14 bp, Homo sapiens
acatctgaaatcta

SEQ ID NO: 636652 - DNA, 19 bp, Homo sapiens
acatctgatttctgaacta

SEQ ID NO: 636653 - DNA, 12 bp, Homo sapiens
acatctggccct

SEQ ID NO: 636654 - DNA, 13 bp, Homo sapiens
acatctggccctg

SEQ ID NO: 636655 - DNA, 14 bp, Homo sapiens
acatctggccctga

SEQ ID NO: 636656 - DNA, 20 bp, Homo sapiens
acatctgtatatcagctcta

SEQ ID NO: 636657 - DNA, 22 bp, Homo sapiens
acatctgtatatcagctctaaa

SEQ ID NO: 636658 - DNA, 20 bp, Homo sapiens
acatctgtcagtgagtcaga

SEQ ID NO: 636659 - DNA, 17 bp, Homo sapiens
acatgaaagtcaagtct

SEQ ID NO: 636660 - DNA, 23 bp, Homo sapiens
acatgacagtggttatatttcaa

SEQ ID NO: 636661 - DNA, 17 bp, Homo sapiens
acatgacccagcctgaa

SEQ ID NO: 636662 - DNA, 18 bp, Homo sapiens
acatgacccgtacacacc

SEQ ID NO: 636663 - DNA, 14 bp, Homo sapiens
acatgcctttccag

SEQ ID NO: 636664 - DNA, 19 bp, Homo sapiens
acatgctcatcccaaaagc

SEQ ID NO: 636665 - DNA, 22 bp, Homo sapiens
acatgctcatcccaaaagctag

SEQ ID NO: 636666 - DNA, 13 bp, Homo sapiens
acatgctgtctta

SEQ ID NO: 636667 - DNA, 16 bp, Homo sapiens
acatggtgctgtgtgt

SEQ ID NO: 636668 - DNA, 20 bp, Homo sapiens
acatgtggggacagggctgg

SEQ ID NO: 636669 - DNA, 14 bp, Homo sapiens
acatgttttacaaa

SEQ ID NO: 636670 - DNA, 19 bp, Homo sapiens
acatgttttacaaagaaac

SEQ ID NO: 636671 - DNA, 22 bp, Homo sapiens
acattcggaggtcaagaaagca

SEQ ID NO: 636672 - DNA, 18 bp, Homo sapiens
acattctatttcaacttc

SEQ ID NO: 636673 - DNA, 20 bp, Homo sapiens
acattgaaactgtatttact

SEQ ID NO: 636674 - DNA, 13 bp, Homo sapiens
acattgtcagaat

SEQ ID NO: 636675 - DNA, 15 bp, Homo sapiens
acattgtcagaatgt

SEQ ID NO: 636676 - DNA, 18 bp, Homo sapiens
acattgtcagcaaattaa

SEQ ID NO: 636677 - DNA, 16 bp, Homo sapiens
acattgtcctgtagct

SEQ ID NO: 636678 - DNA, 21 bp, Homo sapiens
acattgttttgccaacattgc

SEQ ID NO: 636679 - DNA, 16 bp, Homo sapiens
acatttatgtacaaaa

SEQ ID NO: 636680 - DNA, 17 bp, Homo sapiens
acatttatgtacaaaat

SEQ ID NO: 636681 - DNA, 16 bp, Homo sapiens
acatttcaatcactga

SEQ ID NO: 636682 - DNA, 24 bp, Homo sapiens
acatttctggccatttaactagca

SEQ ID NO: 636683 - DNA, 22 bp, Homo sapiens
acatttgggagactgagcttga

SEQ ID NO: 636684 - DNA, 17 bp, Homo sapiens
acatttgttaatgattc

SEQ ID NO: 636685 - DNA, 18 bp, Homo sapiens
acatttgttaatgattct

SEQ ID NO: 636686 - DNA, 17 bp, Homo sapiens
acatttgttctgggtta

SEQ ID NO: 636687 - DNA, 22 bp, Homo sapiens
acatttgttctgggttaacagt

SEQ ID NO: 636688 - DNA, 14 bp, Homo sapiens
accaaataagaata

SEQ ID NO: 636689 - DNA, 20 bp, Homo sapiens
accaaatattttcaagcttt

SEQ ID NO: 636690 - DNA, 13 bp, Homo sapiens
accaaattgctga

SEQ ID NO: 636691 - DNA, 15 bp, Homo sapiens
accaaattgctgaga

SEQ ID NO: 636692 - DNA, 22 bp, Homo sapiens
accaacgggtctgtgggactgg

SEQ ID NO: 636693 - DNA, 23 bp, Homo sapiens
accaacgggtctgtgggactggc

SEQ ID NO: 636694 - DNA, 15 bp, Homo sapiens
accaactaagttgta

SEQ ID NO: 636695 - DNA, 22 bp, Homo sapiens
accaactatattgcgagaaaca

SEQ ID NO: 636696 - DNA, 18 bp, Homo sapiens
accacacacacccttccc

SEQ ID NO: 636697 - DNA, 20 bp, Homo sapiens
accacacacacccttcccca

SEQ ID NO: 636698 - DNA, 20 bp, Homo sapiens
accacagctgggcagggtga

SEQ ID NO: 636699 - DNA, 13 bp, Homo sapiens
accacaggctgcc

SEQ ID NO: 636700 - DNA, 13 bp, Homo sapiens
accaccatttccc

SEQ ID NO: 636701 - DNA, 15 bp, Homo sapiens
accaccttaaaacat

SEQ ID NO: 636702 - DNA, 16 bp, Homo sapiens
accacgacctcgtcca

SEQ ID NO: 636703 - DNA, 13 bp, Homo sapiens
accacgcccctgc

SEQ ID NO: 636704 - DNA, 19 bp, Homo sapiens
accactagggtcctggccc

SEQ ID NO: 636705 - DNA, 13 bp, Homo sapiens
accacttccttaa

SEQ ID NO: 636706 - DNA, 15 bp, Homo sapiens
accacttccttaaca

SEQ ID NO: 636707 - DNA, 15 bp, Homo sapiens
accactttcccacac

SEQ ID NO: 636708 - DNA, 15 bp, Homo sapiens
accagaaagaggaat

SEQ ID NO: 636709 - DNA, 18 bp, Homo sapiens
accagaagtttaaatctt

SEQ ID NO: 636710 - DNA, 14 bp, Homo sapiens
accagcaacattat

SEQ ID NO: 636711 - DNA, 12 bp, Homo sapiens
accagcactccc

SEQ ID NO: 636712 - DNA, 13 bp, Homo sapiens
accagcctgccag

SEQ ID NO: 636713 - DNA, 22 bp, Homo sapiens
accagctcaggctactgccact

SEQ ID NO: 636714 - DNA, 15 bp, Homo sapiens
accaggagctagccc

SEQ ID NO: 636715 - DNA, 21 bp, Homo sapiens
accaggagctagcccagtccc

SEQ ID NO: 636716 - DNA, 14 bp, Homo sapiens
accagtgccgcctg

SEQ ID NO: 636717 - DNA, 20 bp, Homo sapiens
accagttccctcagccctca

SEQ ID NO: 636718 - DNA, 15 bp, Homo sapiens
accatcattgaaatc

SEQ ID NO: 636719 - DNA, 15 bp, Homo sapiens
accatcccactgata

SEQ ID NO: 636720 - DNA, 18 bp, Homo sapiens
accatgaaaagttttcaa

SEQ ID NO: 636721 - DNA, 14 bp, Homo sapiens
accatgctgggccg

SEQ ID NO: 636722 - DNA, 14 bp, Homo sapiens
accatgttaataca

SEQ ID NO: 636723 - DNA, 16 bp, Homo sapiens
accattacaaaatctt

SEQ ID NO: 636724 - DNA, 19 bp, Homo sapiens
accattatggctttgtgct

SEQ ID NO: 636725 - DNA, 14 bp, Homo sapiens
accatttaatcatt

SEQ ID NO: 636726 - DNA, 15 bp, Homo sapiens
accatttaatcattt

SEQ ID NO: 636727 - DNA, 22 bp, Homo sapiens
accattttgaaatattcacaag

SEQ ID NO: 636728 - DNA, 23 bp, Homo sapiens
acccaaggtggtcttggagagga

SEQ ID NO: 636729 - DNA, 16 bp, Homo sapiens
acccactagccctctt

SEQ ID NO: 636730 - DNA, 19 bp, Homo sapiens
acccactagccctctttct

SEQ ID NO: 636731 - DNA, 14 bp, Homo sapiens
acccatgccagcgc

SEQ ID NO: 636732 - DNA, 13 bp, Homo sapiens
accccaccacaca

SEQ ID NO: 636733 - DNA, 22 bp, Homo sapiens
accccaggatgcatgcagggcc

SEQ ID NO: 636734 - DNA, 17 bp, Homo sapiens
acccccagcctccccca

SEQ ID NO: 636735 - DNA, 20 bp, Homo sapiens
acccccagcctcccccaggc

SEQ ID NO: 636736 - DNA, 15 bp, Homo sapiens
acccccatgccaatg

SEQ ID NO: 636737 - DNA, 14 bp, Homo sapiens
acccccctccccaa

SEQ ID NO: 636738 - DNA, 22 bp, Homo sapiens
accccgctcttcccaagtcctc

SEQ ID NO: 636739 - DNA, 19 bp, Homo sapiens
accccgtcccggccccgcg

SEQ ID NO: 636740 - DNA, 18 bp, Homo sapiens
accccgtccctttccctg

SEQ ID NO: 636741 - DNA, 20 bp, Homo sapiens
accccgtccctttccctgca

SEQ ID NO: 636742 - DNA, 21 bp, Homo sapiens
accccgtccctttccctgcat

SEQ ID NO: 636743 - DNA, 14 bp, Homo sapiens
accccgtctgcccc

SEQ ID NO: 636744 - DNA, 23 bp, Homo sapiens
accccgtctgccccttgacccca

SEQ ID NO: 636745 - DNA, 14 bp, Homo sapiens
accccgttcccagc

SEQ ID NO: 636746 - DNA, 16 bp, Homo sapiens
acccctctaccaagct

SEQ ID NO: 636747 - DNA, 18 bp, Homo sapiens
acccctctaccaagctgt

SEQ ID NO: 636748 - DNA, 22 bp, Homo sapiens
acccctcttcccccttcccctg

SEQ ID NO: 636749 - DNA, 16 bp, Homo sapiens
acccctgccctcggcc

SEQ ID NO: 636750 - DNA, 14 bp, Homo sapiens
acccgccccagaga

SEQ ID NO: 636751 - DNA, 22 bp, Homo sapiens
acccgccccagagactgcccac

SEQ ID NO: 636752 - DNA, 23 bp, Homo sapiens
acccgccccagagactgcccacc

SEQ ID NO: 636753 - DNA, 17 bp, Homo sapiens
acccgcccgcccccgcc

SEQ ID NO: 636754 - DNA, 19 bp, Homo sapiens
acccgtcctggggtggttg

SEQ ID NO: 636755 - DNA, 18 bp, Homo sapiens
accctaggtctccacccc

SEQ ID NO: 636756 - DNA, 19 bp, Homo sapiens
accctaggtctccacccct

SEQ ID NO: 636757 - DNA, 22 bp, Homo sapiens
accctaggtctccacccctcaa

SEQ ID NO: 636758 - DNA, 15 bp, Homo sapiens
accctcccctctcct

SEQ ID NO: 636759 - DNA, 13 bp, Homo sapiens
accctcccctctt

SEQ ID NO: 636760 - DNA, 10 bp, Homo sapiens
accctccctg

SEQ ID NO: 636761 - DNA, 13 bp, Homo sapiens
accctccctgtcc

SEQ ID NO: 636762 - DNA, 23 bp, Homo sapiens
accctccggccagcgagtggtca

SEQ ID NO: 636763 - DNA, 14 bp, Homo sapiens
accctcctgccccc

SEQ ID NO: 636764 - DNA, 19 bp, Homo sapiens
accctcctgcccccccacc

SEQ ID NO: 636765 - DNA, 18 bp, Homo sapiens
accctctgagacagagag

SEQ ID NO: 636766 - DNA, 20 bp, Homo sapiens
accctctgctatgtctgtga

SEQ ID NO: 636767 - DNA, 14 bp, Homo sapiens
accctgaatcagag

SEQ ID NO: 636768 - DNA, 18 bp, Homo sapiens
accctgaattcattgtct

SEQ ID NO: 636769 - DNA, 19 bp, Homo sapiens
accctgaattcattgtctc

SEQ ID NO: 636770 - DNA, 22 bp, Homo sapiens
accctgagcagatcgtgccgtg

SEQ ID NO: 636771 - DNA, 16 bp, Homo sapiens
accctgagcctgacct

SEQ ID NO: 636772 - DNA, 16 bp, Homo sapiens
accctgcaggcaggca

SEQ ID NO: 636773 - DNA, 14 bp, Homo sapiens
accctgccctgcac

SEQ ID NO: 636774 - DNA, 12 bp, Homo sapiens
accctgcgcccc

SEQ ID NO: 636775 - DNA, 16 bp, Homo sapiens
acccttcaatgttaaa

SEQ ID NO: 636776 - DNA, 23 bp, Homo sapiens
acccttggtctgtgttctcaaca

SEQ ID NO: 636777 - DNA, 19 bp, Homo sapiens
accgaaaacgtggctgctt

SEQ ID NO: 636778 - DNA, 20 bp, Homo sapiens
accgaactcgggattacaga

SEQ ID NO: 636779 - DNA, 12 bp, Homo sapiens
aaaaaaatatga

SEQ ID NO: 636780 - DNA, 11 bp, Homo sapiens
aaaaaaatcaa

SEQ ID NO: 636781 - DNA, 12 bp, Homo sapiens
aaaaaacagaaa

SEQ ID NO: 636782 - DNA, 20 bp, Homo sapiens
aaaaaccaaataagcatctg

SEQ ID NO: 636783 - DNA, 13 bp, Homo sapiens
aaaaactgatttt

SEQ ID NO: 636784 - DNA, 23 bp, Homo sapiens
aaaaactttccatgacagtagca

SEQ ID NO: 636785 - DNA, 14 bp, Homo sapiens
aaaaagatccaggg

SEQ ID NO: 636786 - DNA, 15 bp, Homo sapiens
aaaaagcatgtacag

SEQ ID NO: 636787 - DNA, 17 bp, Homo sapiens
aaaaagcatgtacagtg

SEQ ID NO: 636788 - DNA, 12 bp, Homo sapiens
aaaaagccctct

SEQ ID NO: 636789 - DNA, 15 bp, Homo sapiens
aaaaatagcagtatt

SEQ ID NO: 636790 - DNA, 19 bp, Homo sapiens
aaaaatctgaatttctaaa

SEQ ID NO: 636791 - DNA, 16 bp, Homo sapiens
aaaaatgcttgaccct

SEQ ID NO: 636792 - DNA, 16 bp, Homo sapiens
aaaaattatagactcc

SEQ ID NO: 636793 - DNA, 13 bp, Homo sapiens
aaaaattgaagag

SEQ ID NO: 636794 - DNA, 19 bp, Homo sapiens
aaaaattgaagagagatat

SEQ ID NO: 636795 - DNA, 14 bp, Homo sapiens
aaaaatttgacatt

SEQ ID NO: 636796 - DNA, 21 bp, Homo sapiens
aaaaatttgacattgtcagaa

SEQ ID NO: 636797 - DNA, 23 bp, Homo sapiens
aaaacaaaatccttgccttcaaa

SEQ ID NO: 636798 - DNA, 15 bp, Homo sapiens
aaaacaacagcaaca

SEQ ID NO: 636799 - DNA, 18 bp, Homo sapiens
aaaacacccttgaaaata

SEQ ID NO: 636800 - DNA, 16 bp, Homo sapiens
aaaacattttaaatgg

SEQ ID NO: 636801 - DNA, 19 bp, Homo sapiens
aaaacattttaaatggaca

SEQ ID NO: 636802 - DNA, 16 bp, Homo sapiens
aaaaccacagctgggc

SEQ ID NO: 636803 - DNA, 17 bp, Homo sapiens
aaaaccacagctgggca

SEQ ID NO: 636804 - DNA, 19 bp, Homo sapiens
aaaaccattacaaaatctt

SEQ ID NO: 636805 - DNA, 16 bp, Homo sapiens
aaaacgatttaattta

SEQ ID NO: 636806 - DNA, 17 bp, Homo sapiens
aaaacgatttaatttat

SEQ ID NO: 636807 - DNA, 16 bp, Homo sapiens
aaaacgtggctgcttc

SEQ ID NO: 636808 - DNA, 18 bp, Homo sapiens
aaaacgtggctgcttcaa

SEQ ID NO: 636809 - DNA, 21 bp, Homo sapiens
aaaacgtggctgcttcaagga

SEQ ID NO: 636810 - DNA, 18 bp, Homo sapiens
aaaactaaatagcatgta

SEQ ID NO: 636811 - DNA, 19 bp, Homo sapiens
aaaactaaatagcatgtat

SEQ ID NO: 636812 - DNA, 21 bp, Homo sapiens
aaaactcctgttttcacacct

SEQ ID NO: 636813 - DNA, 22 bp, Homo sapiens
aaaactgatttttttttccttc

SEQ ID NO: 636814 - DNA, 10 bp, Homo sapiens
aaaactgtga

SEQ ID NO: 636815 - DNA, 12 bp, Homo sapiens
aaaactgtgaca

SEQ ID NO: 636816 - DNA, 23 bp, Homo sapiens
aaaactttccatgacagtagcat

SEQ ID NO: 636817 - DNA, 17 bp, Homo sapiens
aaaagaaagaaaaaagt

SEQ ID NO: 636818 - DNA, 19 bp, Homo sapiens
aaaagaccatgcattcaga

SEQ ID NO: 636819 - DNA, 13 bp, Homo sapiens
aaaagacttcaaa

SEQ ID NO: 636820 - DNA, 13 bp, Homo sapiens
aaaagagcttccc

SEQ ID NO: 636821 - DNA, 14 bp, Homo sapiens
aaaagcacctcttg

SEQ ID NO: 636822 - DNA, 16 bp, Homo sapiens
aaaagcacctcttgaa

SEQ ID NO: 636823 - DNA, 12 bp, Homo sapiens
aaaagcatgtac

SEQ ID NO: 636824 - DNA, 13 bp, Homo sapiens
aaaagcattaaaa

SEQ ID NO: 636825 - DNA, 17 bp, Homo sapiens
aaaagccaagtgtcctg

SEQ ID NO: 636826 - DNA, 19 bp, Homo sapiens
aaaagcggggttcaatgct

SEQ ID NO: 636827 - DNA, 20 bp, Homo sapiens
aaaaggctgcagctaatttg

SEQ ID NO: 636828 - DNA, 19 bp, Homo sapiens
aaaagtgatgtgatttatg

SEQ ID NO: 636829 - DNA, 16 bp, Homo sapiens
aaaagtgcagtagtgt

SEQ ID NO: 636830 - DNA, 16 bp, Homo sapiens
aaaagtgtttttacat

SEQ ID NO: 636831 - DNA, 18 bp, Homo sapiens
aaaagtgtttttacatat

SEQ ID NO: 636832 - DNA, 12 bp, Homo sapiens
aaaagttttcaa

SEQ ID NO: 636833 - DNA, 15 bp, Homo sapiens
aaaataaaacatttt

SEQ ID NO: 636834 - DNA, 15 bp, Homo sapiens
aaaataatataaatg

SEQ ID NO: 636835 - DNA, 21 bp, Homo sapiens
aaaatatccaagcccagccta

SEQ ID NO: 636836 - DNA, 19 bp, Homo sapiens
aaaatatgagattggaaaa

SEQ ID NO: 636837 - DNA, 16 bp, Homo sapiens
aaaatattctgtcatt

SEQ ID NO: 636838 - DNA, 15 bp, Homo sapiens
aaaatattttcttaa

SEQ ID NO: 636839 - DNA, 17 bp, Homo sapiens
aaaatcatatttacctg

SEQ ID NO: 636840 - DNA, 14 bp, Homo sapiens
aaaatccttcagca

SEQ ID NO: 636841 - DNA, 18 bp, Homo sapiens
aaaatcgaggaagcacct

SEQ ID NO: 636842 - DNA, 13 bp, Homo sapiens
aaaatgaattgcc

SEQ ID NO: 636843 - DNA, 12 bp, Homo sapiens
aaaatgctttct

SEQ ID NO: 636844 - DNA, 16 bp, Homo sapiens
aaaatggcatttagca

SEQ ID NO: 636845 - DNA, 15 bp, Homo sapiens
aaaatggctgaagaa

SEQ ID NO: 636846 - DNA, 15 bp, Homo sapiens
aaaatgtgtgcttgg

SEQ ID NO: 636847 - DNA, 14 bp, Homo sapiens
aaaattatctttaa

SEQ ID NO: 636848 - DNA, 20 bp, Homo sapiens
aaaattattaaaaattatag

SEQ ID NO: 636849 - DNA, 16 bp, Homo sapiens
aaaatttaaaaattaa

SEQ ID NO: 636850 - DNA, 20 bp, Homo sapiens
aaaatttatgtcattttcag

SEQ ID NO: 636851 - DNA, 17 bp, Homo sapiens
aaaattttcttctttaa

SEQ ID NO: 636852 - DNA, 20 bp, Homo sapiens
aaaattttcttctttaattt

SEQ ID NO: 636853 - DNA, 15 bp, Homo sapiens
aaacaaaaactttcc

SEQ ID NO: 636854 - DNA, 15 bp, Homo sapiens
aaacaaaatataaat

SEQ ID NO: 636855 - DNA, 22 bp, Homo sapiens
aaacaaaatccttgccttcaaa

SEQ ID NO: 636856 - DNA, 23 bp, Homo sapiens
aaacaaagtttacattgtcctgt

SEQ ID NO: 636857 - DNA, 15 bp, Homo sapiens
aaacaaatatactca

SEQ ID NO: 636858 - DNA, 18 bp, Homo sapiens
aaacaaatcattttgatg

SEQ ID NO: 636859 - DNA, 20 bp, Homo sapiens
aaacaaattcaagaatgcag

SEQ ID NO: 636860 - DNA, 23 bp, Homo sapiens
aaacaagagaccacttccttaac

SEQ ID NO: 636861 - DNA, 18 bp, Homo sapiens
aaatatagtgttgtgtta

SEQ ID NO: 636862 - DNA, 22 bp, Homo sapiens
aaatatagtgttgtgttacaat

SEQ ID NO: 636863 - DNA, 16 bp, Homo sapiens
aaatatatatttatca

SEQ ID NO: 636864 - DNA, 17 bp, Homo sapiens
aaatatcattatagcat

SEQ ID NO: 636865 - DNA, 17 bp, Homo sapiens
aaatatgagattggaaa

SEQ ID NO: 636866 - DNA, 19 bp, Homo sapiens
aaatatgattctcctctcc

SEQ ID NO: 636867 - DNA, 14 bp, Homo sapiens
aaatattagcaaag

SEQ ID NO: 636868 - DNA, 12 bp, Homo sapiens
aaatattatgcc

SEQ ID NO: 636869 - DNA, 13 bp, Homo sapiens
aaatattctgtca

SEQ ID NO: 636870 - DNA, 19 bp, Homo sapiens
aaatattgctattgtttat

SEQ ID NO: 636871 - DNA, 14 bp, Homo sapiens
aaatattttaggaa

SEQ ID NO: 636872 - DNA, 17 bp, Homo sapiens
aaatattttaggaaact

SEQ ID NO: 636873 - DNA, 19 bp, Homo sapiens
aaatattttcttaattatg

SEQ ID NO: 636874 - DNA, 20 bp, Homo sapiens
aaatatttttttgtagatga

SEQ ID NO: 636875 - DNA, 12 bp, Homo sapiens
gattgacatttt

SEQ ID NO: 636876 - DNA, 21 bp, Homo sapiens
gattgacattttgtagctagt

SEQ ID NO: 636877 - DNA, 16 bp, Homo sapiens
gattgggggggcttgg

SEQ ID NO: 636878 - DNA, 22 bp, Homo sapiens
gattgggggggcttggggtaga

SEQ ID NO: 636879 - DNA, 15 bp, Homo sapiens
gattgtttgatgaat

SEQ ID NO: 636880 - DNA, 15 bp, Homo sapiens
gatttaattcttacc

SEQ ID NO: 636881 - DNA, 19 bp, Homo sapiens
gatttaatttgatatcaca

SEQ ID NO: 636882 - DNA, 23 bp, Homo sapiens
gatttaatttgatatcacagtct

SEQ ID NO: 636883 - DNA, 18 bp, Homo sapiens
gatttcactctccttggt

SEQ ID NO: 636884 - DNA, 12 bp, Homo sapiens
gatttcagaaac

SEQ ID NO: 636885 - DNA, 11 bp, Homo sapiens
gattttatgtt

SEQ ID NO: 636886 - DNA, 14 bp, Homo sapiens
gattttcatgttct

SEQ ID NO: 636887 - DNA, 18 bp, Homo sapiens
gattttccttttttatac

SEQ ID NO: 636888 - DNA, 21 bp, Homo sapiens
gattttccttttttatacaca

SEQ ID NO: 636889 - DNA, 19 bp, Homo sapiens
gcagcaaccagagcactgt

SEQ ID NO: 636890 - DNA, 20 bp, Homo sapiens
gcagcaaccagagcactgta

SEQ ID NO: 636891 - DNA, 13 bp, Homo sapiens
gcagcaaggtggg

SEQ ID NO: 636892 - DNA, 13 bp, Homo sapiens
gcagcaccagcct

SEQ ID NO: 636893 - DNA, 22 bp, Homo sapiens
gcagcaccagcctgagccacag

SEQ ID NO: 636894 - DNA, 20 bp, Homo sapiens
gcagcagctagaaagagaaa

SEQ ID NO: 636895 - DNA, 16 bp, Homo sapiens
gcagcagtaccatccc

SEQ ID NO: 636896 - DNA, 19 bp, Homo sapiens
gcagcatgcgatgtcatat

SEQ ID NO: 636897 - DNA, 22 bp, Homo sapiens
gcagcccagaacgggcctcccc

SEQ ID NO: 636898 - DNA, 23 bp, Homo sapiens
gcagcccagaacgggcctccccg

SEQ ID NO: 636899 - DNA, 13 bp, Homo sapiens
gcagcccccacgc

SEQ ID NO: 636900 - DNA, 15 bp, Homo sapiens
gcagccccctgtggc

SEQ ID NO: 636901 - DNA, 21 bp, Homo sapiens
gcagccccgcgaccacccctg

SEQ ID NO: 636902 - DNA, 23 bp, Homo sapiens
gcagccccgcgaccacccctgtg

SEQ ID NO: 636903 - DNA, 14 bp, Homo sapiens
gcagcccctcccca

SEQ ID NO: 636904 - DNA, 18 bp, Homo sapiens
gcagcccctgctggacca

SEQ ID NO: 636905 - DNA, 13 bp, Homo sapiens
gcagccctcacct

SEQ ID NO: 636906 - DNA, 21 bp, Homo sapiens
gcagccctcacctctgaggac

SEQ ID NO: 636907 - DNA, 12 bp, Homo sapiens
gcagccctctcc

SEQ ID NO: 636908 - DNA, 15 bp, Homo sapiens
gcagccgcgctctgc

SEQ ID NO: 636909 - DNA, 16 bp, Homo sapiens
gcagccgcgctctgcc

SEQ ID NO: 636910 - DNA, 19 bp, Homo sapiens
gcagccgcgctctgcccct

SEQ ID NO: 636911 - DNA, 20 bp, Homo sapiens
gcagccgcgctctgcccctc

SEQ ID NO: 636912 - DNA, 13 bp, Homo sapiens
gcagcctcttgaa

SEQ ID NO: 636913 - DNA, 14 bp, Homo sapiens
gcagcctcttgaat

SEQ ID NO: 636914 - DNA, 17 bp, Homo sapiens
gcagcctgaagcctgga

SEQ ID NO: 636915 - DNA, 11 bp, Homo sapiens
gcagcctgagc

SEQ ID NO: 636916 - DNA, 13 bp, Homo sapiens
gcagcctgagctc

SEQ ID NO: 636917 - DNA, 19 bp, Homo sapiens
gcagcctgagctccaccct

SEQ ID NO: 636918 - DNA, 23 bp, Homo sapiens
gcagcctgcagaccacactctgc

SEQ ID NO: 636919 - DNA, 14 bp, Homo sapiens
gcagcgaggtccac

SEQ ID NO: 636920 - DNA, 14 bp, Homo sapiens
gcagctaggcaggg

SEQ ID NO: 636921 - DNA, 18 bp, Homo sapiens
gcagctaggcagggaggg

SEQ ID NO: 636922 - DNA, 21 bp, Homo sapiens
gcagctggcgcgtgtgtggcc

SEQ ID NO: 636923 - DNA, 14 bp, Homo sapiens
gcagcttgagcctg

SEQ ID NO: 636924 - DNA, 18 bp, Homo sapiens
gcaggaaaaggctgcagc

SEQ ID NO: 636925 - DNA, 18 bp, Homo sapiens
gcaggaaagatcccaagt

SEQ ID NO: 636926 - DNA, 13 bp, Homo sapiens
gcaggaccaggca

SEQ ID NO: 636927 - DNA, 22 bp, Homo sapiens
gcaggaggacagagtgccctgg

SEQ ID NO: 636928 - DNA, 18 bp, Homo sapiens
gcaggcagctaggcaggg

SEQ ID NO: 636929 - DNA, 21 bp, Homo sapiens
gcaggcagctaggcagggagg

SEQ ID NO: 636930 - DNA, 21 bp, Homo sapiens
gcagggaagggtgcctggctg

SEQ ID NO: 636931 - DNA, 22 bp, Homo sapiens
gcagggaagggtgcctggctgg

SEQ ID NO: 636932 - DNA, 23 bp, Homo sapiens
gcagggccagtcatggctgtccc

SEQ ID NO: 636933 - DNA, 20 bp, Homo sapiens
gcagggcccagggaggtggc

SEQ ID NO: 636934 - DNA, 22 bp, Homo sapiens
gcagggccctggggtctctgag

SEQ ID NO: 636935 - DNA, 23 bp, Homo sapiens
gcagggccctggggtctctgagc

SEQ ID NO: 636936 - DNA, 18 bp, Homo sapiens
gcagggccgcagggcgct

SEQ ID NO: 636937 - DNA, 14 bp, Homo sapiens
gcagggcgctccgg

SEQ ID NO: 636938 - DNA, 20 bp, Homo sapiens
gcagggcgctccggcagagg

SEQ ID NO: 636939 - DNA, 21 bp, Homo sapiens
gcagggcgctccggcagaggc

SEQ ID NO: 636940 - DNA, 13 bp, Homo sapiens
gcaggggggttgg

SEQ ID NO: 636941 - DNA, 13 bp, Homo sapiens
gcagggttctaga

SEQ ID NO: 636942 - DNA, 17 bp, Homo sapiens
gcaggtgctgtgcgcct

SEQ ID NO: 636943 - DNA, 22 bp, Homo sapiens
gcaggtgggggctgcgtccctg

SEQ ID NO: 636944 - DNA, 15 bp, Homo sapiens
gcaggttatttttat

SEQ ID NO: 636945 - DNA, 18 bp, Homo sapiens
gcagtaccatcccactga

SEQ ID NO: 636946 - DNA, 16 bp, Homo sapiens
gcagtagagagccttt

SEQ ID NO: 636947 - DNA, 16 bp, Homo sapiens
gcagtagatcattttt

SEQ ID NO: 636948 - DNA, 17 bp, Homo sapiens
gcagtcacgtgaggccc

SEQ ID NO: 636949 - DNA, 18 bp, Homo sapiens
gcagtcacgtgaggcccc

SEQ ID NO: 636950 - DNA, 16 bp, Homo sapiens
gcagtcagcacagaga

SEQ ID NO: 636951 - DNA, 21 bp, Homo sapiens
gcagtgcagcaaccagagcac

SEQ ID NO: 636952 - DNA, 22 bp, Homo sapiens
gcagtgcagcaaccagagcact

SEQ ID NO: 636953 - DNA, 12 bp, Homo sapiens
gcagtggctggg

SEQ ID NO: 636954 - DNA, 13 bp, Homo sapiens
gcagtggctgggg

SEQ ID NO: 636955 - DNA, 14 bp, Homo sapiens
gcagtggctggggg

SEQ ID NO: 636956 - DNA, 15 bp, Homo sapiens
gcagtttggccctgg

SEQ ID NO: 636957 - DNA, 16 bp, Homo sapiens
gcagtttggccctgga

SEQ ID NO: 636958 - DNA, 21 bp, Homo sapiens
gcatactgatgagacaacaca

SEQ ID NO: 636959 - DNA, 14 bp, Homo sapiens
gcatagacaagtgt

SEQ ID NO: 636960 - DNA, 16 bp, Homo sapiens
gcatagacaagtgttt

SEQ ID NO: 636961 - DNA, 16 bp, Homo sapiens
gcatagggtttggaag

SEQ ID NO: 636962 - DNA, 20 bp, Homo sapiens
gcatagttctgcaataacag

SEQ ID NO: 636963 - DNA, 12 bp, Homo sapiens
gcatatatatgt

SEQ ID NO: 636964 - DNA, 14 bp, Homo sapiens
gcatattaaagaaa

SEQ ID NO: 636965 - DNA, 14 bp, Homo sapiens
gcatcacagttcac

SEQ ID NO: 636966 - DNA, 16 bp, Homo sapiens
gcatccaccttcctgc

SEQ ID NO: 636967 - DNA, 18 bp, Homo sapiens
gcatccaccttcctgccc

SEQ ID NO: 636968 - DNA, 13 bp, Homo sapiens
gcatcccttggcc

SEQ ID NO: 636969 - DNA, 14 bp, Homo sapiens
gcatccgagcccct

SEQ ID NO: 636970 - DNA, 15 bp, Homo sapiens
gcatccgagcccctg

SEQ ID NO: 636971 - DNA, 13 bp, Homo sapiens
gcatcctggaaat

SEQ ID NO: 636972 - DNA, 22 bp, Homo sapiens
gcatcctggaaatttgtgtgct

SEQ ID NO: 636973 - DNA, 18 bp, Homo sapiens
gcatcgtgtgggtcccta

SEQ ID NO: 636974 - DNA, 14 bp, Homo sapiens
gcatctgcctggag

SEQ ID NO: 636975 - DNA, 17 bp, Homo sapiens
gcatctgcctggagcct

SEQ ID NO: 636976 - DNA, 19 bp, Homo sapiens
gcatctgcctggagcctgg

SEQ ID NO: 636977 - DNA, 21 bp, Homo sapiens
gcatctgcctggagcctgggc

SEQ ID NO: 636978 - DNA, 12 bp, Homo sapiens
gcatctggcctg

SEQ ID NO: 636979 - DNA, 13 bp, Homo sapiens
gcatctggcctgg

SEQ ID NO: 636980 - DNA, 16 bp, Homo sapiens
gcatctggcctggggg

SEQ ID NO: 636981 - DNA, 20 bp, Homo sapiens
gcatctgtgtaacctccaca

SEQ ID NO: 636982 - DNA, 13 bp, Homo sapiens
gcatgaagataaa

SEQ ID NO: 636983 - DNA, 22 bp, Homo sapiens
gcatgacacgaatattgctgat

SEQ ID NO: 636984 - DNA, 15 bp, Homo sapiens
cttctcagctccact

SEQ ID NO: 636985 - DNA, 20 bp, Homo sapiens
cttctcagctccactctgaa

SEQ ID NO: 636986 - DNA, 15 bp, Homo sapiens
cttctccccctcagc

SEQ ID NO: 636987 - DNA, 16 bp, Homo sapiens
cttctcccctccagac

SEQ ID NO: 636988 - DNA, 20 bp, Homo sapiens
cttctcccctccagacccct

SEQ ID NO: 636989 - DNA, 16 bp, Homo sapiens
cttctctaaaacagca

SEQ ID NO: 636990 - DNA, 16 bp, Homo sapiens
cttctggccgctgcag

SEQ ID NO: 636991 - DNA, 23 bp, Homo sapiens
cttctgggacaggcaccatgctg

SEQ ID NO: 636992 - DNA, 15 bp, Homo sapiens
cttctggggagggac

SEQ ID NO: 636993 - DNA, 15 bp, Homo sapiens
cttctggggaggggc

SEQ ID NO: 636994 - DNA, 21 bp, Homo sapiens
ctttctccagcccatgctggc

SEQ ID NO: 636995 - DNA, 14 bp, Homo sapiens
ctttctccatttat

SEQ ID NO: 636996 - DNA, 12 bp, Homo sapiens
ctttctctctgt

SEQ ID NO: 636997 - DNA, 20 bp, Homo sapiens
ctttctctctgtgtggcaaa

SEQ ID NO: 636998 - DNA, 12 bp, Homo sapiens
ctttctggaaaa

SEQ ID NO: 636999 - DNA, 15 bp, Homo sapiens
ctttctgttatctag

SEQ ID NO: 637000 - DNA, 15 bp, Homo sapiens
ctttcttccttcctt

SEQ ID NO: 637001 - DNA, 16 bp, Homo sapiens
ctttcttccttccttt

SEQ ID NO: 637002 - DNA, 21 bp, Homo sapiens
ctttcttccttcctttctctc

SEQ ID NO: 637003 - DNA, 12 bp, Homo sapiens
ctttctttccaa

SEQ ID NO: 637004 - DNA, 14 bp, Homo sapiens
ctttctttccaaag

SEQ ID NO: 637005 - DNA, 11 bp, Homo sapiens
ctttcttttct

SEQ ID NO: 637006 - DNA, 19 bp, Homo sapiens
ctttgaaaactcatacagt

SEQ ID NO: 637007 - DNA, 21 bp, Homo sapiens
ctttgagtgtcaggctctgaa

SEQ ID NO: 637008 - DNA, 19 bp, Homo sapiens
ctttgatatgttgatgaaa

SEQ ID NO: 637009 - DNA, 13 bp, Homo sapiens
ctttggaagcagc

SEQ ID NO: 637010 - DNA, 15 bp, Homo sapiens
ctttggaagcagcaa

SEQ ID NO: 637011 - DNA, 14 bp, Homo sapiens
ctttggaagcagcc

SEQ ID NO: 637012 - DNA, 13 bp, Homo sapiens
ctttgggaggctg

SEQ ID NO: 637013 - DNA, 15 bp, Homo sapiens
ctttggggctggtgg

SEQ ID NO: 637014 - DNA, 17 bp, Homo sapiens
ctttggttcctcatggc

SEQ ID NO: 637015 - DNA, 11 bp, Homo sapiens
ctttgtgctta

SEQ ID NO: 637016 - DNA, 15 bp, Homo sapiens
ctttgtgcttgttct

SEQ ID NO: 637017 - DNA, 13 bp, Homo sapiens
ctttgtgtctttt

SEQ ID NO: 637018 - DNA, 20 bp, Homo sapiens
ctttgtgtcttttgttctct

SEQ ID NO: 637019 - DNA, 14 bp, Homo sapiens
ctttgttaaaatat

SEQ ID NO: 637020 - DNA, 15 bp, Homo sapiens
ctttgttaaaatata

SEQ ID NO: 637021 - DNA, 16 bp, Homo sapiens
ctttgttaaaatatag

SEQ ID NO: 637022 - DNA, 15 bp, Homo sapiens
cttttataaatgttt

SEQ ID NO: 637023 - DNA, 17 bp, Homo sapiens
cttttattgtataatta

SEQ ID NO: 637024 - DNA, 19 bp, Homo sapiens
cttttccaacctacctcac

SEQ ID NO: 637025 - DNA, 14 bp, Homo sapiens
cttttctcatctgt

SEQ ID NO: 637026 - DNA, 14 bp, Homo sapiens
cttttgctctctca

SEQ ID NO: 637027 - DNA, 20 bp, Homo sapiens
cttttgctctctcattccca

SEQ ID NO: 637028 - DNA, 21 bp, Homo sapiens
cttttgtacgttaattaaaca

SEQ ID NO: 637029 - DNA, 23 bp, Homo sapiens
cttttgttctctcttggtctctt

SEQ ID NO: 637030 - DNA, 19 bp, Homo sapiens
cttttttatacacataatt

SEQ ID NO: 637031 - DNA, 15 bp, Homo sapiens
cttttttcaatgtac

SEQ ID NO: 637032 - DNA, 19 bp, Homo sapiens
cttttttcaatgtactgta

SEQ ID NO: 637033 - DNA, 22 bp, Homo sapiens
cttttttcaatgtactgtattg

SEQ ID NO: 637034 - DNA, 11 bp, Homo sapiens
gaaaaaattag

SEQ ID NO: 637035 - DNA, 13 bp, Homo sapiens
gaaaaagcatgta

SEQ ID NO: 637036 - DNA, 14 bp, Homo sapiens
gaaaaagcatgtac

SEQ ID NO: 637037 - DNA, 16 bp, Homo sapiens
gaaaaagccctcttca

SEQ ID NO: 637038 - DNA, 15 bp, Homo sapiens
gaaaaagtgttttta

SEQ ID NO: 637039 - DNA, 18 bp, Homo sapiens
gaaaaagtgtttttacat

SEQ ID NO: 637040 - DNA, 15 bp, Homo sapiens
gaaaaatctgaattt

SEQ ID NO: 637041 - DNA, 16 bp, Homo sapiens
gaaaaatctgaatttc

SEQ ID NO: 637042 - DNA, 11 bp, Homo sapiens
gaaaacattgt

SEQ ID NO: 637043 - DNA, 18 bp, Homo sapiens
gaaaacattgttccagat

SEQ ID NO: 637044 - DNA, 14 bp, Homo sapiens
gaaaacgtggctgc

SEQ ID NO: 637045 - DNA, 18 bp, Homo sapiens
gaaaacgtggctgcttca

SEQ ID NO: 637046 - DNA, 12 bp, Homo sapiens
gaaaactaagtt

SEQ ID NO: 637047 - DNA, 21 bp, Homo sapiens
gaaaactcatcgggagtgaat

SEQ ID NO: 637048 - DNA, 17 bp, Homo sapiens
gaaaagcacctcttgaa

SEQ ID NO: 637049 - DNA, 15 bp, Homo sapiens
gaaaatatatttgca

SEQ ID NO: 637050 - DNA, 20 bp, Homo sapiens
gaaaatgctttgaaaatgtt

SEQ ID NO: 637051 - DNA, 22 bp, Homo sapiens
gaaaatggctgaagaaacacag

SEQ ID NO: 637052 - DNA, 14 bp, Homo sapiens
gaaacaaaatataa

SEQ ID NO: 637053 - DNA, 23 bp, Homo sapiens
gaaacaaaatataaatcacagat

SEQ ID NO: 637054 - DNA, 24 bp, Homo sapiens
gaaacaaagcatttgactttctgt

SEQ ID NO: 637055 - DNA, 22 bp, Homo sapiens
gaaacaaatatactcatttgga

SEQ ID NO: 637056 - DNA, 16 bp, Homo sapiens
gaaacaaggaaggaca

SEQ ID NO: 637057 - DNA, 14 bp, Homo sapiens
gaaacaatttctgt

SEQ ID NO: 637058 - DNA, 18 bp, Homo sapiens
gaaacacagcatgcattt

SEQ ID NO: 637059 - DNA, 23 bp, Homo sapiens
gaaacacagcatgcatttagcat

SEQ ID NO: 637060 - DNA, 23 bp, Homo sapiens
gaaacacggagtttccatttgga

SEQ ID NO: 637061 - DNA, 20 bp, Homo sapiens
gaaacagagaaccctgtggg

SEQ ID NO: 637062 - DNA, 14 bp, Homo sapiens
gaaacatctgattt

SEQ ID NO: 637063 - DNA, 17 bp, Homo sapiens
gaaactcatacagtctc

SEQ ID NO: 637064 - DNA, 22 bp, Homo sapiens
gaaactcatacagtctctattt

SEQ ID NO: 637065 - DNA, 17 bp, Homo sapiens
gaaactttggaagtttt

SEQ ID NO: 637066 - DNA, 11 bp, Homo sapiens
gaaagagaaaa

SEQ ID NO: 637067 - DNA, 16 bp, Homo sapiens
gaaagagaaaatgctt

SEQ ID NO: 637068 - DNA, 19 bp, Homo sapiens
gaaagagaaaatgctttct

SEQ ID NO: 637069 - DNA, 15 bp, Homo sapiens
gaaagatacagggga

SEQ ID NO: 637070 - DNA, 15 bp, Homo sapiens
gaaagcgaaatactt

SEQ ID NO: 637071 - DNA, 21 bp, Homo sapiens
gaaaggaagatgtaagaagct

SEQ ID NO: 637072 - DNA, 22 bp, Homo sapiens
gaaaggcagccctcacctctga

SEQ ID NO: 637073 - DNA, 17 bp, Homo sapiens
gaaaggtgctttctcca

SEQ ID NO: 637074 - DNA, 20 bp, Homo sapiens
gaaagttctattatctgggt

SEQ ID NO: 637075 - DNA, 17 bp, Homo sapiens
gaaagttgtgatctgtt

SEQ ID NO: 637076 - DNA, 17 bp, Homo sapiens
gaaataaaagcctctgg

SEQ ID NO: 637077 - DNA, 21 bp, Homo sapiens
gaaataaaatcaccctgactg

SEQ ID NO: 637078 - DNA, 13 bp, Homo sapiens
gaaataaatctaa

SEQ ID NO: 637079 - DNA, 16 bp, Homo sapiens
gaaataaatctaaata

SEQ ID NO: 637080 - DNA, 18 bp, Homo sapiens
gaaataagtagtgtcatt

SEQ ID NO: 637081 - DNA, 16 bp, Homo sapiens
gaaatataaaaataat

SEQ ID NO: 637082 - DNA, 18 bp, Homo sapiens
gaaatataaactgtgaga

SEQ ID NO: 637083 - DNA, 23 bp, Homo sapiens
gaaatattttctactttaaattg

SEQ ID NO: 637084 - DNA, 19 bp, Homo sapiens
gaaatcaccgaaaacgtgg

SEQ ID NO: 637085 - DNA, 16 bp, Homo sapiens
gaaatgagatcccaga

SEQ ID NO: 637086 - DNA, 16 bp, Homo sapiens
gaaattagtattttga

SEQ ID NO: 637087 - DNA, 21 bp, Homo sapiens
gaaattagtgttttcattctg

SEQ ID NO: 637088 - DNA, 15 bp, Homo sapiens
gaaattatatctgtg

SEQ ID NO: 637089 - DNA, 21 bp, Homo sapiens
gaaattatgtcaaatggatgt

SEQ ID NO: 637090 - DNA, 17 bp, Homo sapiens
gaaattcttgcactgta

SEQ ID NO: 637091 - DNA, 14 bp, Homo sapiens
gaaattgtgccaaa

SEQ ID NO: 637092 - DNA, 15 bp, Homo sapiens
gaaattgtgccaaag

SEQ ID NO: 637093 - DNA, 20 bp, Homo sapiens
gaaattgtgccaaagatagc

SEQ ID NO: 637094 - DNA, 21 bp, Homo sapiens
gaaattgtgccaaagatagca

SEQ ID NO: 637095 - DNA, 20 bp, Homo sapiens
gaaatttactatgtaaatgc

SEQ ID NO: 637096 - DNA, 11 bp, Homo sapiens
gaaatttattc

SEQ ID NO: 637097 - DNA, 18 bp, Homo sapiens
gaaatttttgcatgttta

SEQ ID NO: 637098 - DNA, 23 bp, Homo sapiens
gaaatttttgcatgtttaataat

SEQ ID NO: 637099 - DNA, 16 bp, Homo sapiens
gaaatttttttccaga

SEQ ID NO: 637100 - DNA, 23 bp, Homo sapiens
gaacaaatatgattctcctctcc

SEQ ID NO: 637101 - DNA, 17 bp, Homo sapiens
gaacacactcagcagcc

SEQ ID NO: 637102 - DNA, 20 bp, Homo sapiens
gaacacactcagcagccccc

SEQ ID NO: 637103 - DNA, 13 bp, Homo sapiens
gaacacagtgccc

SEQ ID NO: 637104 - DNA, 15 bp, Homo sapiens
gaacacagtgcccca

SEQ ID NO: 637105 - DNA, 14 bp, Homo sapiens
gaacactctgagac

SEQ ID NO: 637106 - DNA, 15 bp, Homo sapiens
gaacactctgagact

SEQ ID NO: 637107 - DNA, 18 bp, Homo sapiens
gaacactgcaccctccac

SEQ ID NO: 637108 - DNA, 18 bp, Homo sapiens
gaacatactggctggtga

SEQ ID NO: 637109 - DNA, 15 bp, Homo sapiens
gagggcgcttttgta

SEQ ID NO: 637110 - DNA, 13 bp, Homo sapiens
gagggctgagccc

SEQ ID NO: 637111 - DNA, 14 bp, Homo sapiens
gagggctgagcccc

SEQ ID NO: 637112 - DNA, 15 bp, Homo sapiens
gagggctgagcccct

SEQ ID NO: 637113 - DNA, 16 bp, Homo sapiens
gaggggcttggagcag

SEQ ID NO: 637114 - DNA, 13 bp, Homo sapiens
gagggggctggga

SEQ ID NO: 637115 - DNA, 16 bp, Homo sapiens
gaggggtcagcagggg

SEQ ID NO: 637116 - DNA, 23 bp, Homo sapiens
gagggtctccctgggcaccctgc

SEQ ID NO: 637117 - DNA, 16 bp, Homo sapiens
gagggtgcccctggga

SEQ ID NO: 637118 - DNA, 14 bp, Homo sapiens
gaggtccctgccag

SEQ ID NO: 637119 - DNA, 16 bp, Homo sapiens
gcagacggggggctgc

SEQ ID NO: 637120 - DNA, 21 bp, Homo sapiens
gcagacggggggctgcgggcg

SEQ ID NO: 637121 - DNA, 12 bp, Homo sapiens
gcagactgtggc

SEQ ID NO: 637122 - DNA, 18 bp, Homo sapiens
gcagagacggcagcccca

SEQ ID NO: 637123 - DNA, 14 bp, Homo sapiens
gcagagatgtatta

SEQ ID NO: 637124 - DNA, 20 bp, Homo sapiens
gcagagattgggggggcttg

SEQ ID NO: 637125 - DNA, 17 bp, Homo sapiens
gcagagccccggagcac

SEQ ID NO: 637126 - DNA, 14 bp, Homo sapiens
gcagagcgcagccc

SEQ ID NO: 637127 - DNA, 15 bp, Homo sapiens
gcagagcgcagcccc

SEQ ID NO: 637128 - DNA, 22 bp, Homo sapiens
gcagagctgagtcggctgggca

SEQ ID NO: 637129 - DNA, 11 bp, Homo sapiens
gcagaggcagg

SEQ ID NO: 637130 - DNA, 15 bp, Homo sapiens
gcagaggcagggccc

SEQ ID NO: 637131 - DNA, 18 bp, Homo sapiens
gcagaggcagggccctgg

SEQ ID NO: 637132 - DNA, 21 bp, Homo sapiens
gcagaggcccgaggcaccgga

SEQ ID NO: 637133 - DNA, 16 bp, Homo sapiens
gcagagtcaagctgat

SEQ ID NO: 637134 - DNA, 16 bp, Homo sapiens
gcagatcgtgccgtgg

SEQ ID NO: 637135 - DNA, 20 bp, Homo sapiens
gcagattaataacagaaata

SEQ ID NO: 637136 - DNA, 20 bp, Homo sapiens
gcagattttaggaaatgaat

SEQ ID NO: 637137 - DNA, 16 bp, Homo sapiens
gcagcaaccagagcac

SEQ ID NO: 637138 - DNA, 14 bp, Homo sapiens
cgtgtgcttagaaa

SEQ ID NO: 637139 - DNA, 23 bp, Homo sapiens
cgtgtggccctgtgggagtccac

SEQ ID NO: 637140 - DNA, 18 bp, Homo sapiens
cgtgttctcctccaaatg

SEQ ID NO: 637141 - DNA, 16 bp, Homo sapiens
cgtgtttcacagtggg

SEQ ID NO: 637142 - DNA, 18 bp, Homo sapiens
cgttgatagtttacaaac

SEQ ID NO: 637143 - DNA, 21 bp, Homo sapiens
cgttggagagcagcaggtgct

SEQ ID NO: 637144 - DNA, 16 bp, Homo sapiens
cgttgttttgtggata

SEQ ID NO: 637145 - DNA, 18 bp, Homo sapiens
ctaaaacattaattgagg

SEQ ID NO: 637146 - DNA, 16 bp, Homo sapiens
ctaaaactaaatagca

SEQ ID NO: 637147 - DNA, 20 bp, Homo sapiens
ctaaaagtgatgtgatttat

SEQ ID NO: 637148 - DNA, 17 bp, Homo sapiens
ctaaacatagtggtatt

SEQ ID NO: 637149 - DNA, 21 bp, Homo sapiens
ctaaacatagtggtattttaa

SEQ ID NO: 637150 - DNA, 13 bp, Homo sapiens
ctaaaccatgaaa

SEQ ID NO: 637151 - DNA, 21 bp, Homo sapiens
ctaaagatctttttttaagtg

SEQ ID NO: 637152 - DNA, 13 bp, Homo sapiens
ctaaagcagagat

SEQ ID NO: 637153 - DNA, 16 bp, Homo sapiens
ctaaagcagagatgta

SEQ ID NO: 637154 - DNA, 22 bp, Homo sapiens
ctaaaggggacagatcttgagc

SEQ ID NO: 637155 - DNA, 18 bp, Homo sapiens
ctaaatagatttttagat

SEQ ID NO: 637156 - DNA, 20 bp, Homo sapiens
ctaaatagcatgtattgtgt

SEQ ID NO: 637157 - DNA, 23 bp, Homo sapiens
ctaaatagcatgtattgtgtctt

SEQ ID NO: 637158 - DNA, 13 bp, Homo sapiens
ctaaatattatgc

SEQ ID NO: 637159 - DNA, 12 bp, Homo sapiens
ctaaatgcaaag

SEQ ID NO: 637160 - DNA, 17 bp, Homo sapiens
ctaaatgcctaataaac

SEQ ID NO: 637161 - DNA, 12 bp, Homo sapiens
ctaaatgttcat

SEQ ID NO: 637162 - DNA, 17 bp, Homo sapiens
ctaaattaacaaattca

SEQ ID NO: 637163 - DNA, 23 bp, Homo sapiens
ctaacaatgttttttatacttca

SEQ ID NO: 637164 - DNA, 15 bp, Homo sapiens
ctaacactattttat

SEQ ID NO: 637165 - DNA, 11 bp, Homo sapiens
ctaacactggc

SEQ ID NO: 637166 - DNA, 20 bp, Homo sapiens
ctaacagtgctggtttgtcc

SEQ ID NO: 637167 - DNA, 22 bp, Homo sapiens
ctaacgaccgacgcccctccgg

SEQ ID NO: 637168 - DNA, 13 bp, Homo sapiens
ctaacgggcgcct

SEQ ID NO: 637169 - DNA, 13 bp, Homo sapiens
ctaactggcccca

SEQ ID NO: 637170 - DNA, 17 bp, Homo sapiens
ctaagaattcagtagca

SEQ ID NO: 637171 - DNA, 17 bp, Homo sapiens
ctaagagtggaggagga

SEQ ID NO: 637172 - DNA, 23 bp, Homo sapiens
ctaaggagcactagaatgagaaa

SEQ ID NO: 637173 - DNA, 22 bp, Homo sapiens
ctaagttatttactcctcctgc

SEQ ID NO: 637174 - DNA, 22 bp, Homo sapiens
ctaagttgtattttaataaaga

SEQ ID NO: 637175 - DNA, 23 bp, Homo sapiens
ctaatccacctggtggccctgcg

SEQ ID NO: 637176 - DNA, 18 bp, Homo sapiens
ctaatccatgtgctgctg

SEQ ID NO: 637177 - DNA, 14 bp, Homo sapiens
ctaatgacaagtga

SEQ ID NO: 637178 - DNA, 15 bp, Homo sapiens
ctaatgtattttatt

SEQ ID NO: 637179 - DNA, 19 bp, Homo sapiens
ctaatgtattttattgtaa

SEQ ID NO: 637180 - DNA, 20 bp, Homo sapiens
ctaatgtattttattgtaac

SEQ ID NO: 637181 - DNA, 15 bp, Homo sapiens
ctaattaaactgatg

SEQ ID NO: 637182 - DNA, 14 bp, Homo sapiens
ctaattaatttcag

SEQ ID NO: 637183 - DNA, 17 bp, Homo sapiens
ctaattaatttcagtaa

SEQ ID NO: 637184 - DNA, 15 bp, Homo sapiens
ctacaaaatgtgtgc

SEQ ID NO: 637185 - DNA, 16 bp, Homo sapiens
ctacaaaatgtgtgct

SEQ ID NO: 637186 - DNA, 17 bp, Homo sapiens
ctacaaacttttataaa

SEQ ID NO: 637187 - DNA, 19 bp, Homo sapiens
ctacaaacttttataaatg

SEQ ID NO: 637188 - DNA, 20 bp, Homo sapiens
ctacaaacttttataaatgt

SEQ ID NO: 637189 - DNA, 22 bp, Homo sapiens
ctacaaacttttataaatgttt

SEQ ID NO: 637190 - DNA, 20 bp, Homo sapiens
ctacaccttagcagctcttc

SEQ ID NO: 637191 - DNA, 16 bp, Homo sapiens
ctacaggggaggctga

SEQ ID NO: 637192 - DNA, 15 bp, Homo sapiens
ctacaggttttatga

SEQ ID NO: 637193 - DNA, 20 bp, Homo sapiens
ctacatatgtaggaaaattt

SEQ ID NO: 637194 - DNA, 20 bp, Homo sapiens
ctacatctgaaatctacaac

SEQ ID NO: 637195 - DNA, 23 bp, Homo sapiens
ctacatgggccagcccttgctct

SEQ ID NO: 637196 - DNA, 19 bp, Homo sapiens
ctaccaactaagttgtatt

SEQ ID NO: 637197 - DNA, 21 bp, Homo sapiens
ctacccatgcaattaaaaggt

SEQ ID NO: 637198 - DNA, 20 bp, Homo sapiens
ctaccccagaacgcatgcag

SEQ ID NO: 637199 - DNA, 16 bp, Homo sapiens
ctaccctcttctcagc

SEQ ID NO: 637200 - DNA, 22 bp, Homo sapiens
ctaccctcttctcagctccact

SEQ ID NO: 637201 - DNA, 17 bp, Homo sapiens
cctggccctgcctcact

SEQ ID NO: 637202 - DNA, 18 bp, Homo sapiens
cctggccctgcctcactg

SEQ ID NO: 637203 - DNA, 17 bp, Homo sapiens
cctggccggtaggctgc

SEQ ID NO: 637204 - DNA, 21 bp, Homo sapiens
cctggccggtaggctgctggc

SEQ ID NO: 637205 - DNA, 12 bp, Homo sapiens
cctggccttgag

SEQ ID NO: 637206 - DNA, 13 bp, Homo sapiens
cctggcggcaggg

SEQ ID NO: 637207 - DNA, 16 bp, Homo sapiens
cctggcgggcagcccc

SEQ ID NO: 637208 - DNA, 22 bp, Homo sapiens
cctggcgggcagcccctgctgg

SEQ ID NO: 637209 - DNA, 12 bp, Homo sapiens
cctggctgggct

SEQ ID NO: 637210 - DNA, 21 bp, Homo sapiens
cctggctgggctttggggctg

SEQ ID NO: 637211 - DNA, 18 bp, Homo sapiens
cctgggaacacagtgccc

SEQ ID NO: 637212 - DNA, 23 bp, Homo sapiens
cctgggacgcccctttctcttgc

SEQ ID NO: 637213 - DNA, 19 bp, Homo sapiens
cctgggcaccctgcaggca

SEQ ID NO: 637214 - DNA, 22 bp, Homo sapiens
cctgggcaccctgcaggcaggc

SEQ ID NO: 637215 - DNA, 23 bp, Homo sapiens
cctgggcaccctgcaggcaggca

SEQ ID NO: 637216 - DNA, 19 bp, Homo sapiens
cctgggcagcacctccggg

SEQ ID NO: 637217 - DNA, 12 bp, Homo sapiens
cctgggcctccc

SEQ ID NO: 637218 - DNA, 15 bp, Homo sapiens
cctgggcctcccgtc

SEQ ID NO: 637219 - DNA, 22 bp, Homo sapiens
cctgggcctcccgtccgtccgc

SEQ ID NO: 637220 - DNA, 20 bp, Homo sapiens
cctgggctgttgtgtctgga

SEQ ID NO: 637221 - DNA, 23 bp, Homo sapiens
cctgggctgttgtgtctggagcc

SEQ ID NO: 637222 - DNA, 15 bp, Homo sapiens
cctggggaggacccc

SEQ ID NO: 637223 - DNA, 16 bp, Homo sapiens
cctggggtctctgagc

SEQ ID NO: 637224 - DNA, 20 bp, Homo sapiens
cctggggtctctgagcagtg

SEQ ID NO: 637225 - DNA, 22 bp, Homo sapiens
cctggggtggttggaggcctgg

SEQ ID NO: 637226 - DNA, 19 bp, Homo sapiens
cctgggtccccctcctgca

SEQ ID NO: 637227 - DNA, 21 bp, Homo sapiens
cctgggtccccctcctgcacg

SEQ ID NO: 637228 - DNA, 23 bp, Homo sapiens
cctgggtggtatagggcgtttgg

SEQ ID NO: 637229 - DNA, 13 bp, Homo sapiens
cctggtaattatc

SEQ ID NO: 637230 - DNA, 14 bp, Homo sapiens
cctggtcctgcact

SEQ ID NO: 637231 - DNA, 14 bp, Homo sapiens
cctggtctggagcc

SEQ ID NO: 637232 - DNA, 18 bp, Homo sapiens
cctggtctggagccccta

SEQ ID NO: 637233 - DNA, 21 bp, Homo sapiens
cctggtctggagcccctatcc

SEQ ID NO: 637234 - DNA, 13 bp, Homo sapiens
cctgtacacacac

SEQ ID NO: 637235 - DNA, 15 bp, Homo sapiens
cctgtacacacacag

SEQ ID NO: 637236 - DNA, 19 bp, Homo sapiens
cctgtactcgcttgtgcag

SEQ ID NO: 637237 - DNA, 19 bp, Homo sapiens
cggccccatcagaggctgg

SEQ ID NO: 637238 - DNA, 22 bp, Homo sapiens
cggccccgcggagcccccgccc

SEQ ID NO: 637239 - DNA, 14 bp, Homo sapiens
cggcccgccacctt

SEQ ID NO: 637240 - DNA, 15 bp, Homo sapiens
cggcccggcccacgc

SEQ ID NO: 637241 - DNA, 17 bp, Homo sapiens
cggcccggcccacgcag

SEQ ID NO: 637242 - DNA, 15 bp, Homo sapiens
cggcccgtgcgcagc

SEQ ID NO: 637243 - DNA, 17 bp, Homo sapiens
cggcccgtgcgcagccg

SEQ ID NO: 637244 - DNA, 13 bp, Homo sapiens
cggccgctctccg

SEQ ID NO: 637245 - DNA, 17 bp, Homo sapiens
cggccgctctccgcccc

SEQ ID NO: 637246 - DNA, 18 bp, Homo sapiens
cggcctcctagcctctcc

SEQ ID NO: 637247 - DNA, 13 bp, Homo sapiens
cggcctgcagccc

SEQ ID NO: 637248 - DNA, 18 bp, Homo sapiens
cggcctgcagcccagaac

SEQ ID NO: 637249 - DNA, 12 bp, Homo sapiens
cggcggtgggcg

SEQ ID NO: 637250 - DNA, 16 bp, Homo sapiens
cggctgaggacggggc

SEQ ID NO: 637251 - DNA, 21 bp, Homo sapiens
cggctgaggacggggcagagc

SEQ ID NO: 637252 - DNA, 23 bp, Homo sapiens
cggctgaggacggggcagagctg

SEQ ID NO: 637253 - DNA, 14 bp, Homo sapiens
cggctggccggtcc

SEQ ID NO: 637254 - DNA, 13 bp, Homo sapiens
cggctgggcaggg

SEQ ID NO: 637255 - DNA, 23 bp, Homo sapiens
cggctgtgggggaggtccctgcc

SEQ ID NO: 637256 - DNA, 18 bp, Homo sapiens
cgggacagcggcccggcc

SEQ ID NO: 637257 - DNA, 13 bp, Homo sapiens
cgggactgacctt

SEQ ID NO: 637258 - DNA, 22 bp, Homo sapiens
cgggactgtcttcaaccctgcc

SEQ ID NO: 637259 - DNA, 23 bp, Homo sapiens
cgggactgtcttcaaccctgccc

SEQ ID NO: 637260 - DNA, 15 bp, Homo sapiens
cgggagagcgccacc

SEQ ID NO: 637261 - DNA, 17 bp, Homo sapiens
cgggagagcgccacccg

SEQ ID NO: 637262 - DNA, 14 bp, Homo sapiens
cgggattacagaaa

SEQ ID NO: 637263 - DNA, 20 bp, Homo sapiens
cgggcagagaccaccgcgcc

SEQ ID NO: 637264 - DNA, 12 bp, Homo sapiens
cgggcagcccct

SEQ ID NO: 637265 - DNA, 15 bp, Homo sapiens
cgggcagcccctgct

SEQ ID NO: 637266 - DNA, 17 bp, Homo sapiens
cgggccagggcgtggct

SEQ ID NO: 637267 - DNA, 23 bp, Homo sapiens
cgggcccgcactcaggagcacag

SEQ ID NO: 637268 - DNA, 17 bp, Homo sapiens
cgggcccgctcaacctc

SEQ ID NO: 637269 - DNA, 21 bp, Homo sapiens
cgggcccgctcaacctctcag

SEQ ID NO: 637270 - DNA, 18 bp, Homo sapiens
cgggccgcctcctccaga

SEQ ID NO: 637271 - DNA, 14 bp, Homo sapiens
cgggcctccccggg

SEQ ID NO: 637272 - DNA, 23 bp, Homo sapiens
cgggcctccccgggggtccccgg

SEQ ID NO: 637273 - DNA, 14 bp, Homo sapiens
cgggcgcctgcgct

SEQ ID NO: 637274 - DNA, 21 bp, Homo sapiens
cgggctctctcacccagcctg

SEQ ID NO: 637275 - DNA, 22 bp, Homo sapiens
cggggcggcatccgagcccctg

SEQ ID NO: 637276 - DNA, 19 bp, Homo sapiens
cggggctccccttcgcgta

SEQ ID NO: 637277 - DNA, 17 bp, Homo sapiens
cggggctgccgcatctg

SEQ ID NO: 637278 - DNA, 20 bp, Homo sapiens
cggggctgccgcatctgcct

SEQ ID NO: 637279 - DNA, 11 bp, Homo sapiens
cggggctggcc

SEQ ID NO: 637280 - DNA, 13 bp, Homo sapiens
cggggctggccct

SEQ ID NO: 637281 - DNA, 16 bp, Homo sapiens
cggggctggccctgcc

SEQ ID NO: 637282 - DNA, 17 bp, Homo sapiens
cggggctggccctgccc

SEQ ID NO: 637283 - DNA, 23 bp, Homo sapiens
cggggctggccctgccctccccc

SEQ ID NO: 637284 - DNA, 18 bp, Homo sapiens
cgggggaggagcaccccc

SEQ ID NO: 637285 - DNA, 23 bp, Homo sapiens
cgggggaggagcacccccagcct

SEQ ID NO: 637286 - DNA, 21 bp, Homo sapiens
cggggtcgggggaggagcacc

SEQ ID NO: 637287 - DNA, 17 bp, Homo sapiens
cgggtctcgcagcctga

SEQ ID NO: 637288 - DNA, 18 bp, Homo sapiens
cgggtctcgcagcctgaa

SEQ ID NO: 637289 - DNA, 20 bp, Homo sapiens
cgggtctcgcagcctgaagc

SEQ ID NO: 637290 - DNA, 22 bp, Homo sapiens
cgggtctcgcagcctgaagcct

SEQ ID NO: 637291 - DNA, 17 bp, Homo sapiens
cgggtgccccccatgcc

SEQ ID NO: 637292 - DNA, 15 bp, Homo sapiens
cgggtggctggagcc

SEQ ID NO: 637293 - DNA, 22 bp, Homo sapiens
cggtccaccccgtcccggcccc

SEQ ID NO: 637294 - DNA, 21 bp, Homo sapiens
cggtcctttgagtgtcaggct

SEQ ID NO: 637295 - DNA, 13 bp, Homo sapiens
cggtgagactctg

SEQ ID NO: 637296 - DNA, 14 bp, Homo sapiens
cggtgagactctga

SEQ ID NO: 637297 - DNA, 18 bp, Homo sapiens
cggtggcatttgctgaat

SEQ ID NO: 637298 - DNA, 18 bp, Homo sapiens
cggtgtctggaaaagcac

SEQ ID NO: 637299 - DNA, 20 bp, Homo sapiens
cggtgtctggaaaagcactt

SEQ ID NO: 637300 - DNA, 21 bp, Homo sapiens
cggtgtttggaggctgctgcc

SEQ ID NO: 637301 - DNA, 14 bp, Homo sapiens
cgtagaacctgcgc

SEQ ID NO: 637302 - DNA, 15 bp, Homo sapiens
cgtagaacctgcgca

SEQ ID NO: 637303 - DNA, 15 bp, Homo sapiens
cgtcaatgtgaaata

SEQ ID NO: 637304 - DNA, 21 bp, Homo sapiens
ctgggccggggtgtggaatca

SEQ ID NO: 637305 - DNA, 14 bp, Homo sapiens
ctgggcctcccgtc

SEQ ID NO: 637306 - DNA, 20 bp, Homo sapiens
ctgggcgccggttccacgtg

SEQ ID NO: 637307 - DNA, 16 bp, Homo sapiens
ctgggctgctggggca

SEQ ID NO: 637308 - DNA, 17 bp, Homo sapiens
ctgggctgctggggcag

SEQ ID NO: 637309 - DNA, 20 bp, Homo sapiens
ctgggctgctggggcagggc

SEQ ID NO: 637310 - DNA, 17 bp, Homo sapiens
ctgggctttggggctgg

SEQ ID NO: 637311 - DNA, 22 bp, Homo sapiens
ctgggctttggggctggtggga

SEQ ID NO: 637312 - DNA, 19 bp, Homo sapiens
ctggggaggacccctgccc

SEQ ID NO: 637313 - DNA, 14 bp, Homo sapiens
ctggggagggacac

SEQ ID NO: 637314 - DNA, 17 bp, Homo sapiens
ctggggagggacacaga

SEQ ID NO: 637315 - DNA, 19 bp, Homo sapiens
ctggggagggacacagagg

SEQ ID NO: 637316 - DNA, 20 bp, Homo sapiens
ctggggcagggcccagggag

SEQ ID NO: 637317 - DNA, 21 bp, Homo sapiens
ctggggcagggcccagggagg

SEQ ID NO: 637318 - DNA, 22 bp, Homo sapiens
ctggggcatccaccttcctgcc

SEQ ID NO: 637319 - DNA, 15 bp, Homo sapiens
ctggggccggggctg

SEQ ID NO: 637320 - DNA, 20 bp, Homo sapiens
ctggggccggggctgccgca

SEQ ID NO: 637321 - DNA, 23 bp, Homo sapiens
ctgggggatgtgcacggcagctt

SEQ ID NO: 637322 - DNA, 23 bp, Homo sapiens
ctgtgtagtagctcgtgtgctta

SEQ ID NO: 637323 - DNA, 16 bp, Homo sapiens
ctgtgtcatctgtcag

SEQ ID NO: 637324 - DNA, 15 bp, Homo sapiens
ctgtgtggcaaacat

SEQ ID NO: 637325 - DNA, 16 bp, Homo sapiens
ctgtgtggcaaacatt

SEQ ID NO: 637326 - DNA, 22 bp, Homo sapiens
ctgtgtggcaaacatttaaaaa

SEQ ID NO: 637327 - DNA, 13 bp, Homo sapiens
ctgtgtggggagg

SEQ ID NO: 637328 - DNA, 21 bp, Homo sapiens
ctgtgtgtgagcgagtgacag

SEQ ID NO: 637329 - DNA, 21 bp, Homo sapiens
ctgttaaggcatccacttcac

SEQ ID NO: 637330 - DNA, 21 bp, Homo sapiens
ctgttcacgtgactcctcaat

SEQ ID NO: 637331 - DNA, 16 bp, Homo sapiens
ctgttccaagtgtgtg

SEQ ID NO: 637332 - DNA, 17 bp, Homo sapiens
ctgttccgcctcactgg

SEQ ID NO: 637333 - DNA, 12 bp, Homo sapiens
ctgttctgaaat

SEQ ID NO: 637334 - DNA, 20 bp, Homo sapiens
ctgttctgaaattaggaaag

SEQ ID NO: 637335 - DNA, 19 bp, Homo sapiens
ctgttgacctaccctggac

SEQ ID NO: 637336 - DNA, 15 bp, Homo sapiens
cctcttcaatcccca

SEQ ID NO: 637337 - DNA, 21 bp, Homo sapiens
cctcttgaatgcttaaatgat

SEQ ID NO: 637338 - DNA, 17 bp, Homo sapiens
cctcttgctcagagcta

SEQ ID NO: 637339 - DNA, 23 bp, Homo sapiens
cctcttgttcttagggcttggat

SEQ ID NO: 637340 - DNA, 17 bp, Homo sapiens
cctctttcggaaatgat

SEQ ID NO: 637341 - DNA, 13 bp, Homo sapiens
cctctttctctct

SEQ ID NO: 637342 - DNA, 14 bp, Homo sapiens
cctctttctctctg

SEQ ID NO: 637343 - DNA, 15 bp, Homo sapiens
cctctttctctctgt

SEQ ID NO: 637344 - DNA, 16 bp, Homo sapiens
cctctttctctctgtg

SEQ ID NO: 637345 - DNA, 18 bp, Homo sapiens
cctctttctctctgtgtg

SEQ ID NO: 637346 - DNA, 19 bp, Homo sapiens
cctctttctctctgtgtgg

SEQ ID NO: 637347 - DNA, 20 bp, Homo sapiens
cctgaactcccagtcatgtt

SEQ ID NO: 637348 - DNA, 13 bp, Homo sapiens
cctgaagcctgga

SEQ ID NO: 637349 - DNA, 18 bp, Homo sapiens
cctgaagcctggattcca

SEQ ID NO: 637350 - DNA, 12 bp, Homo sapiens
cctgaatcagag

SEQ ID NO: 637351 - DNA, 15 bp, Homo sapiens
cctgaatcagaggca

SEQ ID NO: 637352 - DNA, 18 bp, Homo sapiens
cctgaatccatcaggact

SEQ ID NO: 637353 - DNA, 19 bp, Homo sapiens
cctgaatccatcaggactt

SEQ ID NO: 637354 - DNA, 16 bp, Homo sapiens
cctgaattcattgtct

SEQ ID NO: 637355 - DNA, 20 bp, Homo sapiens
cctgacactgtctgctgccc

SEQ ID NO: 637356 - DNA, 18 bp, Homo sapiens
cctgacagcaaacacagt

SEQ ID NO: 637357 - DNA, 13 bp, Homo sapiens
cctgactcctggg

SEQ ID NO: 637358 - DNA, 14 bp, Homo sapiens
cctgactcctgggt

SEQ ID NO: 637359 - DNA, 16 bp, Homo sapiens
cctgactcctgggtgg

SEQ ID NO: 637360 - DNA, 11 bp, Homo sapiens
cctgactgtgt

SEQ ID NO: 637361 - DNA, 13 bp, Homo sapiens
cctgacttcccag

SEQ ID NO: 637362 - DNA, 14 bp, Homo sapiens
cctgacttcccagc

SEQ ID NO: 637363 - DNA, 16 bp, Homo sapiens
cctgacttcccagctg

SEQ ID NO: 637364 - DNA, 21 bp, Homo sapiens
cctgacttcccagctggcagc

SEQ ID NO: 637365 - DNA, 23 bp, Homo sapiens
cctgacttctggagatggatcct

SEQ ID NO: 637366 - DNA, 12 bp, Homo sapiens
cctgagccagat

SEQ ID NO: 637367 - DNA, 18 bp, Homo sapiens
cctgagccagatttcact

SEQ ID NO: 637368 - DNA, 19 bp, Homo sapiens
ccttgtagacgcacctgct

SEQ ID NO: 637369 - DNA, 22 bp, Homo sapiens
ccttgtagacgcacctgctgag

SEQ ID NO: 637370 - DNA, 14 bp, Homo sapiens
ccttgtgagctgct

SEQ ID NO: 637371 - DNA, 21 bp, Homo sapiens
cctttcaataggaaaaactga

SEQ ID NO: 637372 - DNA, 17 bp, Homo sapiens
cctttccctgcatccct

SEQ ID NO: 637373 - DNA, 18 bp, Homo sapiens
cctttccgtgccgggagc

SEQ ID NO: 637374 - DNA, 19 bp, Homo sapiens
cctttcctctcctctctgg

SEQ ID NO: 637375 - DNA, 15 bp, Homo sapiens
cctttgcaggcccag

SEQ ID NO: 637376 - DNA, 17 bp, Homo sapiens
ccttttgtatcctccat

SEQ ID NO: 637377 - DNA, 19 bp, Homo sapiens
cgaaaacgtggctgcttca

SEQ ID NO: 637378 - DNA, 13 bp, Homo sapiens
cgaaatgaaaatg

SEQ ID NO: 637379 - DNA, 18 bp, Homo sapiens
cgaaatggtaccaaggag

SEQ ID NO: 637380 - DNA, 15 bp, Homo sapiens
cgaatattgctgatg

SEQ ID NO: 637381 - DNA, 19 bp, Homo sapiens
cgacaaagggaaggctgct

SEQ ID NO: 637382 - DNA, 12 bp, Homo sapiens
cgacaatgcaaa

SEQ ID NO: 637383 - DNA, 13 bp, Homo sapiens
cgaccacccctgt

SEQ ID NO: 637384 - DNA, 16 bp, Homo sapiens
cgaccacccctgtgcg

SEQ ID NO: 637385 - DNA, 15 bp, Homo sapiens
cgaccatgtgtagat

SEQ ID NO: 637386 - DNA, 13 bp, Homo sapiens
cgaccccatctca

SEQ ID NO: 637387 - DNA, 16 bp, Homo sapiens
cgacctacatctgaaa

SEQ ID NO: 637388 - DNA, 21 bp, Homo sapiens
cgacggaggcaggaccaggca

SEQ ID NO: 637389 - DNA, 20 bp, Homo sapiens
cgactgggctgctggggcag

SEQ ID NO: 637390 - DNA, 21 bp, Homo sapiens
cgagagggctgagcccctcct

SEQ ID NO: 637391 - DNA, 22 bp, Homo sapiens
cgagcagagcgcagcccccacg

SEQ ID NO: 637392 - DNA, 17 bp, Homo sapiens
cgagcgcgtgccttccc

SEQ ID NO: 637393 - DNA, 17 bp, Homo sapiens
cgaggagcttccagtgc

SEQ ID NO: 637394 - DNA, 21 bp, Homo sapiens
cgaggaggccgactgggctgc

SEQ ID NO: 637395 - DNA, 19 bp, Homo sapiens
cgaggcagaatggtgggct

SEQ ID NO: 637396 - DNA, 17 bp, Homo sapiens
cgatttgtattaatgta

SEQ ID NO: 637397 - DNA, 20 bp, Homo sapiens
cgcaacagctgtgtgtgccc

SEQ ID NO: 637398 - DNA, 22 bp, Homo sapiens
cgcaaggatcacttgagcccag

SEQ ID NO: 637399 - DNA, 16 bp, Homo sapiens
cgcaattgtatatata

SEQ ID NO: 637400 - DNA, 18 bp, Homo sapiens
cgcaccccgttcccagcg

SEQ ID NO: 637401 - DNA, 14 bp, Homo sapiens
cgcactacatctga

SEQ ID NO: 637402 - DNA, 12 bp, Homo sapiens
cgcagcaccagc

SEQ ID NO: 637403 - DNA, 15 bp, Homo sapiens
cgcagcaccagcctg

SEQ ID NO: 637404 - DNA, 17 bp, Homo sapiens
cgcagcaccagcctgag

SEQ ID NO: 637405 - DNA, 19 bp, Homo sapiens
cgcagcaccagcctgagcc

SEQ ID NO: 637406 - DNA, 11 bp, Homo sapiens
cgcagccccca

SEQ ID NO: 637407 - DNA, 18 bp, Homo sapiens
cgcagccgcgctctgccc

SEQ ID NO: 637408 - DNA, 19 bp, Homo sapiens
cgcagccgcgctctgcccc

SEQ ID NO: 637409 - DNA, 22 bp, Homo sapiens
cgcagccgcgctctgcccctcc

SEQ ID NO: 637410 - DNA, 22 bp, Homo sapiens
cagtggggcccatggccccagc

SEQ ID NO: 637411 - DNA, 22 bp, Homo sapiens
cagtggtccagggtccagccct

SEQ ID NO: 637412 - DNA, 16 bp, Homo sapiens
cagtggtgcgggccag

SEQ ID NO: 637413 - DNA, 21 bp, Homo sapiens
cagtgtactctgagtcctcat

SEQ ID NO: 637414 - DNA, 16 bp, Homo sapiens
cagtgtggatgtaaat

SEQ ID NO: 637415 - DNA, 17 bp, Homo sapiens
cagtgtggcttaaacat

SEQ ID NO: 637416 - DNA, 15 bp, Homo sapiens
cagtgtgtagtttgt

SEQ ID NO: 637417 - DNA, 20 bp, Homo sapiens
cagtgtgtcacactgagctg

SEQ ID NO: 637418 - DNA, 15 bp, Homo sapiens
cagtgttcaaattct

SEQ ID NO: 637419 - DNA, 16 bp, Homo sapiens
cagtgttcaaattctg

SEQ ID NO: 637420 - DNA, 18 bp, Homo sapiens
cagtgttcagcatagagc

SEQ ID NO: 637421 - DNA, 13 bp, Homo sapiens
cagtgttctgttt

SEQ ID NO: 637422 - DNA, 18 bp, Homo sapiens
cagtgtttagaagagcct

SEQ ID NO: 637423 - DNA, 22 bp, Homo sapiens
cagtgtttagaagagcctgact

SEQ ID NO: 637424 - DNA, 23 bp, Homo sapiens
cagtgtttagaagagcctgactg

SEQ ID NO: 637425 - DNA, 20 bp, Homo sapiens
cagttacagtggcagtattg

SEQ ID NO: 637426 - DNA, 17 bp, Homo sapiens
cagttacttgtgttcat

SEQ ID NO: 637427 - DNA, 15 bp, Homo sapiens
cagttagcacagagg

SEQ ID NO: 637428 - DNA, 15 bp, Homo sapiens
catgacccgtacaca

SEQ ID NO: 637429 - DNA, 17 bp, Homo sapiens
catgaccctcctgtcca

SEQ ID NO: 637430 - DNA, 15 bp, Homo sapiens
catgaggcctttccc

SEQ ID NO: 637431 - DNA, 15 bp, Homo sapiens
catgatgctagttct

SEQ ID NO: 637432 - DNA, 17 bp, Homo sapiens
catgatgctagttctta

SEQ ID NO: 637433 - DNA, 14 bp, Homo sapiens
catgattagacaat

SEQ ID NO: 637434 - DNA, 18 bp, Homo sapiens
catgattagacaatgtgg

SEQ ID NO: 637435 - DNA, 21 bp, Homo sapiens
catgattagacaatgtggaat

SEQ ID NO: 637436 - DNA, 20 bp, Homo sapiens
catgcagggcccccacagga

SEQ ID NO: 637437 - DNA, 14 bp, Homo sapiens
catgcattcagatc

SEQ ID NO: 637438 - DNA, 17 bp, Homo sapiens
catgcattcagatctga

SEQ ID NO: 637439 - DNA, 16 bp, Homo sapiens
catgcatttagcatga

SEQ ID NO: 637440 - DNA, 23 bp, Homo sapiens
catgcatttagcatgagttctgc

SEQ ID NO: 637441 - DNA, 16 bp, Homo sapiens
catgccaatgtccagg

SEQ ID NO: 637442 - DNA, 18 bp, Homo sapiens
catgccaatgtccaggtc

SEQ ID NO: 637443 - DNA, 15 bp, Homo sapiens
catgcccaaatataa

SEQ ID NO: 637444 - DNA, 13 bp, Homo sapiens
catgcccacgccc

SEQ ID NO: 637445 - DNA, 17 bp, Homo sapiens
catgccccagctctgga

SEQ ID NO: 637446 - DNA, 20 bp, Homo sapiens
catgccccagctctggatga

SEQ ID NO: 637447 - DNA, 19 bp, Homo sapiens
catgcccctcttagaagaa

SEQ ID NO: 637448 - DNA, 15 bp, Homo sapiens
catgcctgggcccag

SEQ ID NO: 637449 - DNA, 20 bp, Homo sapiens
catgcctttatttctgtatc

SEQ ID NO: 637450 - DNA, 17 bp, Homo sapiens
catgctaacctctctga

SEQ ID NO: 637451 - DNA, 19 bp, Homo sapiens
catgctaacctctctgaac

SEQ ID NO: 637452 - DNA, 14 bp, Homo sapiens
catgctcagtattg

SEQ ID NO: 637453 - DNA, 12 bp, Homo sapiens
catgctggctgg

SEQ ID NO: 637454 - DNA, 15 bp, Homo sapiens
catgctggctggggc

SEQ ID NO: 637455 - DNA, 18 bp, Homo sapiens
catgctgtccctgtgggc

SEQ ID NO: 637456 - DNA, 19 bp, Homo sapiens
catgctgtccctgtgggct

SEQ ID NO: 637457 - DNA, 22 bp, Homo sapiens
catgctgtccctgtgggctcac

SEQ ID NO: 637458 - DNA, 23 bp, Homo sapiens
catgctgtccctgtgggctcaca

SEQ ID NO: 637459 - DNA, 13 bp, Homo sapiens
catgctttctcct

SEQ ID NO: 637460 - DNA, 15 bp, Homo sapiens
catgctttctccttt

SEQ ID NO: 637461 - DNA, 17 bp, Homo sapiens
catgctttctccttttt

SEQ ID NO: 637462 - DNA, 14 bp, Homo sapiens
catgcttttctcat

SEQ ID NO: 637463 - DNA, 20 bp, Homo sapiens
catggagaagggttctgccc

SEQ ID NO: 637464 - DNA, 19 bp, Homo sapiens
catggatgcagaaatgagt

SEQ ID NO: 637465 - DNA, 18 bp, Homo sapiens
catggcagcatgcgatgt

SEQ ID NO: 637466 - DNA, 13 bp, Homo sapiens
catggccccagct

SEQ ID NO: 637467 - DNA, 17 bp, Homo sapiens
catggccccagctggct

SEQ ID NO: 637468 - DNA, 21 bp, Homo sapiens
catggccgaagccccttggag

SEQ ID NO: 637469 - DNA, 14 bp, Homo sapiens
catggccttccctc

SEQ ID NO: 637470 - DNA, 15 bp, Homo sapiens
catggctgagagggt

SEQ ID NO: 637471 - DNA, 22 bp, Homo sapiens
catggctgggaacatgacccag

SEQ ID NO: 637472 - DNA, 15 bp, Homo sapiens
catggctgtcccctg

SEQ ID NO: 637473 - DNA, 17 bp, Homo sapiens
catggctgtcccctgca

SEQ ID NO: 637474 - DNA, 18 bp, Homo sapiens
catggctgttatctgtct

SEQ ID NO: 637475 - DNA, 13 bp, Homo sapiens
catgggccagccc

SEQ ID NO: 637476 - DNA, 14 bp, Homo sapiens
catgggccagccct

SEQ ID NO: 637477 - DNA, 13 bp, Homo sapiens
catgggccctcag

SEQ ID NO: 637478 - DNA, 15 bp, Homo sapiens
catgggccctcagcg

SEQ ID NO: 637479 - DNA, 17 bp, Homo sapiens
catggtagactgtgaca

SEQ ID NO: 637480 - DNA, 17 bp, Homo sapiens
catggtgaactgaagca

SEQ ID NO: 637481 - DNA, 21 bp, Homo sapiens
catggtgctgtgtgtgagcga

SEQ ID NO: 637482 - DNA, 22 bp, Homo sapiens
catggtgctgtgtgtgagcgag

SEQ ID NO: 637483 - DNA, 22 bp, Homo sapiens
catgtacagagaactaacacta

SEQ ID NO: 637484 - DNA, 15 bp, Homo sapiens
catgtacagtgttct

SEQ ID NO: 637485 - DNA, 22 bp, Homo sapiens
catgtacagtgttctgtttaat

SEQ ID NO: 637486 - DNA, 13 bp, Homo sapiens
catgtatgtccat

SEQ ID NO: 637487 - DNA, 13 bp, Homo sapiens
catgtatgttgca

SEQ ID NO: 637488 - DNA, 18 bp, Homo sapiens
catgtatgttgcatgaat

SEQ ID NO: 637489 - DNA, 15 bp, Homo sapiens
catgtcctatccctg

SEQ ID NO: 637490 - DNA, 15 bp, Homo sapiens
catgtcggggcccct

SEQ ID NO: 637491 - DNA, 17 bp, Homo sapiens
catgtcggggcccctgc

SEQ ID NO: 637492 - DNA, 17 bp, Homo sapiens
catgtgataattgtaaa

SEQ ID NO: 637493 - DNA, 20 bp, Homo sapiens
catgtgataattgtaaaggt

SEQ ID NO: 637494 - DNA, 16 bp, Homo sapiens
catgtgatgagaggaa

SEQ ID NO: 637495 - DNA, 16 bp, Homo sapiens
catgtgcgaacacagt

SEQ ID NO: 637496 - DNA, 17 bp, Homo sapiens
catgtgctgctgtggca

SEQ ID NO: 637497 - DNA, 19 bp, Homo sapiens
catgtggggacagggctgg

SEQ ID NO: 637498 - DNA, 18 bp, Homo sapiens
catgttaaaataattata

SEQ ID NO: 637499 - DNA, 21 bp, Homo sapiens
catgttaaaataattatatga

SEQ ID NO: 637500 - DNA, 19 bp, Homo sapiens
catgttaatacatcatttt

SEQ ID NO: 637501 - DNA, 18 bp, Homo sapiens
catgttaattgatagaat

SEQ ID NO: 637502 - DNA, 22 bp, Homo sapiens
catgttgccatgaggcctttcc

SEQ ID NO: 637503 - DNA, 17 bp, Homo sapiens
catgttggtaccctgga

SEQ ID NO: 637504 - DNA, 12 bp, Homo sapiens
catgtttaagaa

SEQ ID NO: 637505 - DNA, 15 bp, Homo sapiens
cattaaaacaagaga

SEQ ID NO: 637506 - DNA, 16 bp, Homo sapiens
cattaaaatcttgaaa

SEQ ID NO: 637507 - DNA, 20 bp, Homo sapiens
cattaagcacacacatctgg

SEQ ID NO: 637508 - DNA, 23 bp, Homo sapiens
cattaagcacacacatctggccc

SEQ ID NO: 637509 - DNA, 23 bp, Homo sapiens
cattaatgagatgttattactgt

SEQ ID NO: 637510 - DNA, 19 bp, Homo sapiens
cattatagattttcatgtt

SEQ ID NO: 637511 - DNA, 23 bp, Homo sapiens
cattatgaggaaacttggacatt

SEQ ID NO: 637512 - DNA, 20 bp, Homo sapiens
cattatttctaccattaaaa

SEQ ID NO: 637513 - DNA, 21 bp, Homo sapiens
cattatttctaccattaaaat

SEQ ID NO: 637514 - DNA, 16 bp, Homo sapiens
cattcagatctgaagt

SEQ ID NO: 637515 - DNA, 12 bp, Homo sapiens
cattcagtgaca

SEQ ID NO: 637516 - DNA, 15 bp, Homo sapiens
cattcatactcaaag

SEQ ID NO: 637517 - DNA, 19 bp, Homo sapiens
cattcatactcaaagaggc

SEQ ID NO: 637518 - DNA, 14 bp, Homo sapiens
cattcatttacaac

SEQ ID NO: 637519 - DNA, 13 bp, Homo sapiens
cattccacagagt

SEQ ID NO: 637520 - DNA, 20 bp, Homo sapiens
cattcccaattatcaaaaaa

SEQ ID NO: 637521 - DNA, 20 bp, Homo sapiens
cattcccactaagctttctc

SEQ ID NO: 637522 - DNA, 13 bp, Homo sapiens
cattccgttagga

SEQ ID NO: 637523 - DNA, 18 bp, Homo sapiens
cattcctgaccctcactt

SEQ ID NO: 637524 - DNA, 19 bp, Homo sapiens
cattcgtgggcctgctgct

SEQ ID NO: 637525 - DNA, 20 bp, Homo sapiens
cattcgtgggcctgctgctc

SEQ ID NO: 637526 - DNA, 21 bp, Homo sapiens
cattcgtgggcctgctgctct

SEQ ID NO: 637527 - DNA, 20 bp, Homo sapiens
cattctggggtggggcttgg

SEQ ID NO: 637528 - DNA, 14 bp, Homo sapiens
cattgaaactgtat

SEQ ID NO: 637529 - DNA, 21 bp, Homo sapiens
cattgacaccaaatattttca

SEQ ID NO: 637530 - DNA, 15 bp, Homo sapiens
cattgacatgtacag

SEQ ID NO: 637531 - DNA, 19 bp, Homo sapiens
cattgacatgtacagagaa

SEQ ID NO: 637532 - DNA, 21 bp, Homo sapiens
cattgacatgtacagagaact

SEQ ID NO: 637533 - DNA, 21 bp, Homo sapiens
cattgcactaaaagtgatgtg

SEQ ID NO: 637534 - DNA, 20 bp, Homo sapiens
cattgcctatttcagtggca

SEQ ID NO: 637535 - DNA, 15 bp, Homo sapiens
cattgcttcattaaa

SEQ ID NO: 637536 - DNA, 20 bp, Homo sapiens
cattgcttcattaaaacaag

SEQ ID NO: 637537 - DNA, 16 bp, Homo sapiens
cattggcagtgtgtca

SEQ ID NO: 637538 - DNA, 22 bp, Homo sapiens
cattggcagtgtgtcacactga

SEQ ID NO: 637539 - DNA, 21 bp, Homo sapiens
cattggttacaaatttttact

SEQ ID NO: 637540 - DNA, 11 bp, Homo sapiens
cattgtatgtt

SEQ ID NO: 637541 - DNA, 13 bp, Homo sapiens
cattgtatgttaa

SEQ ID NO: 637542 - DNA, 21 bp, Homo sapiens
cattgtatgttaatagaaaat

SEQ ID NO: 637543 - DNA, 15 bp, Homo sapiens
cattgtcagaatgtt

SEQ ID NO: 637544 - DNA, 15 bp, Homo sapiens
cccctcgcgcccctg

SEQ ID NO: 637545 - DNA, 17 bp, Homo sapiens
cccctcgcgcccctgtc

SEQ ID NO: 637546 - DNA, 23 bp, Homo sapiens
cccctcttcttgcggcaccgccc

SEQ ID NO: 637547 - DNA, 19 bp, Homo sapiens
cccctgcagtttggccctg

SEQ ID NO: 637548 - DNA, 13 bp, Homo sapiens
cccctgcccagca

SEQ ID NO: 637549 - DNA, 18 bp, Homo sapiens
cccctgcccagcacctcc

SEQ ID NO: 637550 - DNA, 20 bp, Homo sapiens
cccctgcccagcacctcctc

SEQ ID NO: 637551 - DNA, 12 bp, Homo sapiens
cccctgccctcg

SEQ ID NO: 637552 - DNA, 17 bp, Homo sapiens
cccctgcgccctccctc

SEQ ID NO: 637553 - DNA, 23 bp, Homo sapiens
cccctgcgccctccctccctcca

SEQ ID NO: 637554 - DNA, 18 bp, Homo sapiens
cccctggaagttgtcctt

SEQ ID NO: 637555 - DNA, 12 bp, Homo sapiens
cccctggccctg

SEQ ID NO: 637556 - DNA, 18 bp, Homo sapiens
cccctggccctgcctcac

SEQ ID NO: 637557 - DNA, 19 bp, Homo sapiens
cccctggccctgcctcact

SEQ ID NO: 637558 - DNA, 14 bp, Homo sapiens
cccctggcggcagg

SEQ ID NO: 637559 - DNA, 15 bp, Homo sapiens
cccctgggaacacag

SEQ ID NO: 637560 - DNA, 13 bp, Homo sapiens
cccctggtcctgc

SEQ ID NO: 637561 - DNA, 23 bp, Homo sapiens
cccctgtagggaaaccttggaga

SEQ ID NO: 637562 - DNA, 17 bp, Homo sapiens
cccctgtttctcctcca

SEQ ID NO: 637563 - DNA, 18 bp, Homo sapiens
cccctgtttctcctccat

SEQ ID NO: 637564 - DNA, 13 bp, Homo sapiens
ccccttcccaccc

SEQ ID NO: 637565 - DNA, 14 bp, Homo sapiens
ccccttcccacccc

SEQ ID NO: 637566 - DNA, 13 bp, Homo sapiens
ccccttcccctgc

SEQ ID NO: 637567 - DNA, 13 bp, Homo sapiens
ccccttggagaga

SEQ ID NO: 637568 - DNA, 14 bp, Homo sapiens
cccgaccccatctc

SEQ ID NO: 637569 - DNA, 13 bp, Homo sapiens
cccgaggccaggg

SEQ ID NO: 637570 - DNA, 16 bp, Homo sapiens
cccgcactcaggagca

SEQ ID NO: 637571 - DNA, 22 bp, Homo sapiens
cccgcactcaggagcacagcca

SEQ ID NO: 637572 - DNA, 13 bp, Homo sapiens
cccgcagcaccag

SEQ ID NO: 637573 - DNA, 22 bp, Homo sapiens
cccgcagcaccagcctgagcca

SEQ ID NO: 637574 - DNA, 19 bp, Homo sapiens
cccgcccaccccgctgcct

SEQ ID NO: 637575 - DNA, 11 bp, Homo sapiens
cccgccccaga

SEQ ID NO: 637576 - DNA, 12 bp, Homo sapiens
cccgccccagag

SEQ ID NO: 637577 - DNA, 16 bp, Homo sapiens
cccgccccagagactg

SEQ ID NO: 637578 - DNA, 18 bp, Homo sapiens
cccgcccccgccccgctg

SEQ ID NO: 637579 - DNA, 15 bp, Homo sapiens
cccgcccccgccctc

SEQ ID NO: 637580 - DNA, 16 bp, Homo sapiens
cccgccccgctgctcc

SEQ ID NO: 637581 - DNA, 12 bp, Homo sapiens
cccgcccctccc

SEQ ID NO: 637582 - DNA, 16 bp, Homo sapiens
cccgcccctcccccta

SEQ ID NO: 637583 - DNA, 17 bp, Homo sapiens
cccgccctcctctgccc

SEQ ID NO: 637584 - DNA, 18 bp, Homo sapiens
cccgccgcctcgggccgc

SEQ ID NO: 637585 - DNA, 18 bp, Homo sapiens
cccgccggttggccggct

SEQ ID NO: 637586 - DNA, 22 bp, Homo sapiens
cccgccggttggccggctggcc

SEQ ID NO: 637587 - DNA, 23 bp, Homo sapiens
cccgccggttggccggctggccg

SEQ ID NO: 637588 - DNA, 14 bp, Homo sapiens
cccgcgaccacccc

SEQ ID NO: 637589 - DNA, 18 bp, Homo sapiens
cccgcgaccacccctgtg

SEQ ID NO: 637590 - DNA, 22 bp, Homo sapiens
cccgcgcccgccgcctccctca

SEQ ID NO: 637591 - DNA, 16 bp, Homo sapiens
cccgcgcgtgccccca

SEQ ID NO: 637592 - DNA, 18 bp, Homo sapiens
cccgcgcgtgcccccagc

SEQ ID NO: 637593 - DNA, 19 bp, Homo sapiens
cccgcgcgtgcccccagcg

SEQ ID NO: 637594 - DNA, 13 bp, Homo sapiens
cccgcggagcccc

SEQ ID NO: 637595 - DNA, 16 bp, Homo sapiens
cccgcggagcccccgc

SEQ ID NO: 637596 - DNA, 21 bp, Homo sapiens
cccgcggagcccccgcccctc

SEQ ID NO: 637597 - DNA, 22 bp, Homo sapiens
cccgcggggacgtcgctgtccg

SEQ ID NO: 637598 - DNA, 20 bp, Homo sapiens
cccgctgcctggcgggcagc

SEQ ID NO: 637599 - DNA, 19 bp, Homo sapiens
cccggacgcatgcagggcc

SEQ ID NO: 637600 - DNA, 15 bp, Homo sapiens
cccggacgctggctc

SEQ ID NO: 637601 - DNA, 16 bp, Homo sapiens
cccggaggcgcccacc

SEQ ID NO: 637602 - DNA, 21 bp, Homo sapiens
cccggaggcgcccacctgccc

SEQ ID NO: 637603 - DNA, 14 bp, Homo sapiens
cccggcccacgcag

SEQ ID NO: 637604 - DNA, 18 bp, Homo sapiens
cccggcccacgcagagcc

SEQ ID NO: 637605 - DNA, 12 bp, Homo sapiens
cccggcctccta

SEQ ID NO: 637606 - DNA, 12 bp, Homo sapiens
cccggcctgatg

SEQ ID NO: 637607 - DNA, 19 bp, Homo sapiens
cccggcctgatggccaggc

SEQ ID NO: 637608 - DNA, 13 bp, Homo sapiens
cccggcctggccc

SEQ ID NO: 637609 - DNA, 17 bp, Homo sapiens
cccggcctggccccctc

SEQ ID NO: 637610 - DNA, 17 bp, Homo sapiens
cccgggggtccccggac

SEQ ID NO: 637611 - DNA, 17 bp, Homo sapiens
cccggtgtatgcagtgg

SEQ ID NO: 637612 - DNA, 20 bp, Homo sapiens
cccgtgcggcccgtgcgcag

SEQ ID NO: 637613 - DNA, 22 bp, Homo sapiens
cccgtgcggcccgtgcgcagcc

SEQ ID NO: 637614 - DNA, 23 bp, Homo sapiens
cccgttgtgtgggtttactctgt

SEQ ID NO: 637615 - DNA, 13 bp, Homo sapiens
ccctagttctttg

SEQ ID NO: 637616 - DNA, 15 bp, Homo sapiens
ccctatcctgcaccc

SEQ ID NO: 637617 - DNA, 18 bp, Homo sapiens
ccctatcctgcaccctct

SEQ ID NO: 637618 - DNA, 21 bp, Homo sapiens
ccctcaagccaggagaccctg

SEQ ID NO: 637619 - DNA, 18 bp, Homo sapiens
ccctcacacctcccttca

SEQ ID NO: 637620 - DNA, 21 bp, Homo sapiens
ccctcacccactttggcctcc

SEQ ID NO: 637621 - DNA, 15 bp, Homo sapiens
ccctcacctctgagg

SEQ ID NO: 637622 - DNA, 19 bp, Homo sapiens
ccctcacctctgaggacag

SEQ ID NO: 637623 - DNA, 17 bp, Homo sapiens
ccctcactccactcccc

SEQ ID NO: 637624 - DNA, 14 bp, Homo sapiens
ccctcagcgtctcc

SEQ ID NO: 637625 - DNA, 13 bp, Homo sapiens
ccctcatccacta

SEQ ID NO: 637626 - DNA, 13 bp, Homo sapiens
ccctccacacctc

SEQ ID NO: 637627 - DNA, 14 bp, Homo sapiens
ccctccacaggagc

SEQ ID NO: 637628 - DNA, 16 bp, Homo sapiens
ccctccccaaggaaga

SEQ ID NO: 637629 - DNA, 21 bp, Homo sapiens
ccctccccacagtcctcacag

SEQ ID NO: 637630 - DNA, 14 bp, Homo sapiens
ccctccccagccct

SEQ ID NO: 637631 - DNA, 13 bp, Homo sapiens
ccctcccccgcag

SEQ ID NO: 637632 - DNA, 14 bp, Homo sapiens
ccctcccccgcaga

SEQ ID NO: 637633 - DNA, 12 bp, Homo sapiens
ccctccccctac

SEQ ID NO: 637634 - DNA, 23 bp, Homo sapiens
ccctccccctacagatcctccgc

SEQ ID NO: 637635 - DNA, 11 bp, Homo sapiens
ccctccctgtc

SEQ ID NO: 637636 - DNA, 23 bp, Homo sapiens
ccctccctgtctgtctgtctctc

SEQ ID NO: 637637 - DNA, 15 bp, Homo sapiens
ccctccgccagccct

SEQ ID NO: 637638 - DNA, 19 bp, Homo sapiens
ccctccgtccccagggtgc

SEQ ID NO: 637639 - DNA, 16 bp, Homo sapiens
ccctcctccatgctgt

SEQ ID NO: 637640 - DNA, 23 bp, Homo sapiens
ccctcctccatgctgtccctgtg

SEQ ID NO: 637641 - DNA, 14 bp, Homo sapiens
ccctcctcgggcgc

SEQ ID NO: 637642 - DNA, 15 bp, Homo sapiens
ccctcctctcctcgt

SEQ ID NO: 637643 - DNA, 15 bp, Homo sapiens
ccctccttctcccct

SEQ ID NO: 637644 - DNA, 20 bp, Homo sapiens
ccctccttctcccctccaga

SEQ ID NO: 637645 - DNA, 21 bp, Homo sapiens
ccctccttctcccctccagac

SEQ ID NO: 637646 - DNA, 23 bp, Homo sapiens
ccctccttctcccctccagaccc

SEQ ID NO: 637647 - DNA, 20 bp, Homo sapiens
ccctcggtcagcaccgtggt

SEQ ID NO: 637648 - DNA, 17 bp, Homo sapiens
ccctctcttaccccgtc

SEQ ID NO: 637649 - DNA, 13 bp, Homo sapiens
ccctcttccccct

SEQ ID NO: 637650 - DNA, 16 bp, Homo sapiens
ccgccgaagggcagcc

SEQ ID NO: 637651 - DNA, 17 bp, Homo sapiens
ccgccgaagggcagccc

SEQ ID NO: 637652 - DNA, 20 bp, Homo sapiens
ccgccgaagggcagccccgc

SEQ ID NO: 637653 - DNA, 17 bp, Homo sapiens
ccgccgcctccctcacc

SEQ ID NO: 637654 - DNA, 14 bp, Homo sapiens
ccgcctcactgggt

SEQ ID NO: 637655 - DNA, 15 bp, Homo sapiens
ccgcctcgcccccgg

SEQ ID NO: 637656 - DNA, 18 bp, Homo sapiens
ccgcctcgcccccgggcc

SEQ ID NO: 637657 - DNA, 17 bp, Homo sapiens
ccgcctcgggccgcctc

SEQ ID NO: 637658 - DNA, 18 bp, Homo sapiens
ccgcctcgggccgcctcc

SEQ ID NO: 637659 - DNA, 21 bp, Homo sapiens
ccgcctcgggccgcctcctcc

SEQ ID NO: 637660 - DNA, 12 bp, Homo sapiens
ccgcctgtgccc

SEQ ID NO: 637661 - DNA, 12 bp, Homo sapiens
ccgcgaccaccc

SEQ ID NO: 637662 - DNA, 14 bp, Homo sapiens
ccgcgaccacccct

SEQ ID NO: 637663 - DNA, 15 bp, Homo sapiens
ccgcgaccacccctg

SEQ ID NO: 637664 - DNA, 16 bp, Homo sapiens
ccgcgaccacccctgt

SEQ ID NO: 637665 - DNA, 15 bp, Homo sapiens
ccgcgcgtgccccca

SEQ ID NO: 637666 - DNA, 13 bp, Homo sapiens
ccgcgctctgccc

SEQ ID NO: 637667 - DNA, 14 bp, Homo sapiens
ccgcgctctgcccc

SEQ ID NO: 637668 - DNA, 19 bp, Homo sapiens
cagcagctagaaagagaaa

SEQ ID NO: 637669 - DNA, 17 bp, Homo sapiens
cagcagtaccatcccac

SEQ ID NO: 637670 - DNA, 22 bp, Homo sapiens
cagcagtaccatcccactgata

SEQ ID NO: 637671 - DNA, 20 bp, Homo sapiens
cagcatatatataaaataca

SEQ ID NO: 637672 - DNA, 17 bp, Homo sapiens
cagcatcgtgtgggtcc

SEQ ID NO: 637673 - DNA, 13 bp, Homo sapiens
cagcatgcattta

SEQ ID NO: 637674 - DNA, 14 bp, Homo sapiens
cagcatgcatttag

SEQ ID NO: 637675 - DNA, 15 bp, Homo sapiens
cagcattcagcacac

SEQ ID NO: 637676 - DNA, 17 bp, Homo sapiens
cagcattcagcacacac

SEQ ID NO: 637677 - DNA, 23 bp, Homo sapiens
cagcattcccaattatcaaaaaa

SEQ ID NO: 637678 - DNA, 14 bp, Homo sapiens
cagccaatttcaaa

SEQ ID NO: 637679 - DNA, 17 bp, Homo sapiens
cagccagtggcacagga

SEQ ID NO: 637680 - DNA, 17 bp, Homo sapiens
cagccatgcccacgccc

SEQ ID NO: 637681 - DNA, 19 bp, Homo sapiens
cagcccagaacgggcctcc

SEQ ID NO: 637682 - DNA, 20 bp, Homo sapiens
cagcccagaacgggcctccc

SEQ ID NO: 637683 - DNA, 21 bp, Homo sapiens
cagcccagaacgggcctcccc

SEQ ID NO: 637684 - DNA, 23 bp, Homo sapiens
cagcccagaacgggcctccccgg

SEQ ID NO: 637685 - DNA, 14 bp, Homo sapiens
cagcccagagactg

SEQ ID NO: 637686 - DNA, 18 bp, Homo sapiens
cagcccatcccctgcctc

SEQ ID NO: 637687 - DNA, 19 bp, Homo sapiens
cagcccatcccctgcctct

SEQ ID NO: 637688 - DNA, 18 bp, Homo sapiens
cagcccatgctggctggg

SEQ ID NO: 637689 - DNA, 19 bp, Homo sapiens
cagcccatgctggctgggg

SEQ ID NO: 637690 - DNA, 20 bp, Homo sapiens
cagcccatgctggctggggc
